United States Patent 11,421,016 (CANCER NEOEPITOPES) - sequence listing, part 15

SEQ ID NO: 648079 - protein, 9 aa, Homo Sapiens
RDRVSPCLP

SEQ ID NO: 648080 - protein, 9 aa, Homo Sapiens
APEDPLPSP

SEQ ID NO: 648081 - protein, 9 aa, Homo Sapiens
VKGQAESQS

SEQ ID NO: 648082 - protein, 9 aa, Homo Sapiens
NIALLPNNA

SEQ ID NO: 648083 - protein, 9 aa, Homo Sapiens
IHAFSSVEY

SEQ ID NO: 648084 - protein, 9 aa, Homo Sapiens
PRISCRKGS

SEQ ID NO: 648085 - protein, 9 aa, Homo Sapiens
NSGLRSIQH

SEQ ID NO: 648086 - protein, 9 aa, Homo Sapiens
TGDHPFMCK

SEQ ID NO: 648087 - protein, 9 aa, Homo Sapiens
FTEENVLFW

SEQ ID NO: 648088 - protein, 9 aa, Homo Sapiens
EKQPLADPE

SEQ ID NO: 648089 - protein, 9 aa, Homo Sapiens
PVGASQRTA

SEQ ID NO: 648090 - protein, 9 aa, Homo Sapiens
KPTTRDCAL

SEQ ID NO: 648091 - protein, 9 aa, Homo Sapiens
GVTVWEMMT

SEQ ID NO: 648092 - protein, 9 aa, Homo Sapiens
SDINDTWFF

SEQ ID NO: 648093 - protein, 9 aa, Homo Sapiens
QNYQNLLAL

SEQ ID NO: 648094 - protein, 9 aa, Homo Sapiens
YAVANALHS

SEQ ID NO: 648095 - protein, 9 aa, Homo Sapiens
VPSKTMLSY

SEQ ID NO: 648096 - protein, 9 aa, Homo Sapiens
CFSPCCQPT

SEQ ID NO: 648097 - protein, 9 aa, Homo Sapiens
AQVHGVMDP

SEQ ID NO: 648098 - protein, 9 aa, Homo Sapiens
VVDLPQENR

SEQ ID NO: 648099 - protein, 9 aa, Homo Sapiens
SRDTDKENG

SEQ ID NO: 648100 - protein, 9 aa, Homo Sapiens
RVSIYKLTA

SEQ ID NO: 648101 - protein, 9 aa, Homo Sapiens
INSQLRPIM

SEQ ID NO: 648102 - protein, 9 aa, Homo Sapiens
VNPQLASKH

SEQ ID NO: 648103 - protein, 9 aa, Homo Sapiens
TLTDLFLTN

SEQ ID NO: 648104 - protein, 9 aa, Homo Sapiens
RQQETPAHA

SEQ ID NO: 648105 - protein, 9 aa, Homo Sapiens
PLLGGCVDD

SEQ ID NO: 648106 - protein, 9 aa, Homo Sapiens
QHIPVVPAQ

SEQ ID NO: 648107 - protein, 9 aa, Homo Sapiens
SSISQLKTL

SEQ ID NO: 648108 - protein, 9 aa, Homo Sapiens
KALLNMDSP

SEQ ID NO: 648109 - protein, 9 aa, Homo Sapiens
LEPAQRTLY

SEQ ID NO: 648110 - protein, 9 aa, Homo Sapiens
VCNKFTFDS

SEQ ID NO: 648111 - protein, 9 aa, Homo Sapiens
VLTGTAFYH

SEQ ID NO: 648112 - protein, 9 aa, Homo Sapiens
RKSLSNSLH

SEQ ID NO: 648113 - protein, 9 aa, Homo Sapiens
SLLYRSRYL

SEQ ID NO: 648114 - protein, 9 aa, Homo Sapiens
KGQAESQSQ

SEQ ID NO: 648115 - protein, 9 aa, Homo Sapiens
DGKIVVDEF

SEQ ID NO: 648116 - protein, 9 aa, Homo Sapiens
HVSNCWICH

SEQ ID NO: 648117 - protein, 9 aa, Homo Sapiens
SAVSAFEIF

SEQ ID NO: 648118 - protein, 9 aa, Homo Sapiens
RRAYSNFGN

SEQ ID NO: 648119 - protein, 9 aa, Homo Sapiens
DGRGNLNAT

SEQ ID NO: 648120 - protein, 9 aa, Homo Sapiens
SCRKGSKAY

SEQ ID NO: 648121 - protein, 9 aa, Homo Sapiens
SPNLFRVIR

SEQ ID NO: 648122 - protein, 9 aa, Homo Sapiens
LFEVQWQLA

SEQ ID NO: 648123 - protein, 9 aa, Homo Sapiens
LALLRRFHH

SEQ ID NO: 648124 - protein, 9 aa, Homo Sapiens
HPFMCKHCL

SEQ ID NO: 648125 - protein, 9 aa, Homo Sapiens
ASPGASTHD

SEQ ID NO: 648126 - protein, 9 aa, Homo Sapiens
GGPGHGSGG

SEQ ID NO: 648127 - protein, 9 aa, Homo Sapiens
WTVSGVALA

SEQ ID NO: 648128 - protein, 9 aa, Homo Sapiens
ATTLSQPQQ

SEQ ID NO: 648129 - protein, 9 aa, Homo Sapiens
ESPAGRFLR

SEQ ID NO: 648130 - protein, 9 aa, Homo Sapiens
GILGHLARD

SEQ ID NO: 648131 - protein, 9 aa, Homo Sapiens
ASMSIPEHV

SEQ ID NO: 648132 - protein, 9 aa, Homo Sapiens
IPEHVLTGD

SEQ ID NO: 648133 - protein, 9 aa, Homo Sapiens
NQFNLDTQD

SEQ ID NO: 648134 - protein, 9 aa, Homo Sapiens
QVCVSEQEQ

SEQ ID NO: 648135 - protein, 9 aa, Homo Sapiens
QQQESATTH

SEQ ID NO: 648136 - protein, 9 aa, Homo Sapiens
IEAAKALLN

SEQ ID NO: 648137 - protein, 9 aa, Homo Sapiens
VQLHTGIKE

SEQ ID NO: 648138 - protein, 9 aa, Homo Sapiens
LPSEDCTTM

SEQ ID NO: 648139 - protein, 9 aa, Homo Sapiens
SERSNNGMQ

SEQ ID NO: 648140 - protein, 9 aa, Homo Sapiens
DSSFPRMNL

SEQ ID NO: 648141 - protein, 9 aa, Homo Sapiens
KGKKKYNLE

SEQ ID NO: 648142 - protein, 9 aa, Homo Sapiens
WLHLVTMSG

SEQ ID NO: 648143 - protein, 9 aa, Homo Sapiens
AVYAVANAL

SEQ ID NO: 648144 - protein, 9 aa, Homo Sapiens
TLQNVAQAL

SEQ ID NO: 648145 - protein, 9 aa, Homo Sapiens
VSVLRGQGM

SEQ ID NO: 648146 - protein, 9 aa, Homo Sapiens
AQDPTNLSG

SEQ ID NO: 648147 - protein, 9 aa, Homo Sapiens
TLVSERSNN

SEQ ID NO: 648148 - protein, 9 aa, Homo Sapiens
PTHTLQPHQ

SEQ ID NO: 648149 - protein, 9 aa, Homo Sapiens
TCGILGHLA

SEQ ID NO: 648150 - protein, 9 aa, Homo Sapiens
PELAKKPAS

SEQ ID NO: 648151 - protein, 9 aa, Homo Sapiens
PAPAEVLKG

SEQ ID NO: 648152 - protein, 9 aa, Homo Sapiens
SAMPHAPSP

SEQ ID NO: 648153 - protein, 9 aa, Homo Sapiens
QPRVDFSSI

SEQ ID NO: 648154 - protein, 9 aa, Homo Sapiens
DESDSPHIV

SEQ ID NO: 648155 - protein, 9 aa, Homo Sapiens
QLTLAPFVD

SEQ ID NO: 648156 - protein, 9 aa, Homo Sapiens
KYFVSPNLF

SEQ ID NO: 648157 - protein, 9 aa, Homo Sapiens
KKKYNLESA

SEQ ID NO: 648158 - protein, 9 aa, Homo Sapiens
PHQHIPVVP

SEQ ID NO: 648159 - protein, 9 aa, Homo Sapiens
CLPGWSRTP

SEQ ID NO: 648160 - protein, 9 aa, Homo Sapiens
KKPASRQKE

SEQ ID NO: 648161 - protein, 9 aa, Homo Sapiens
KEFTEENVL

SEQ ID NO: 648162 - protein, 9 aa, Homo Sapiens
EDLRQMFAK

SEQ ID NO: 648163 - protein, 9 aa, Homo Sapiens
WATPRTDPL

SEQ ID NO: 648164 - protein, 9 aa, Homo Sapiens
GPAPAEVLK

SEQ ID NO: 648165 - protein, 9 aa, Homo Sapiens
TIATNELLE

SEQ ID NO: 648166 - protein, 9 aa, Homo Sapiens
ITMPFQFAG

SEQ ID NO: 648167 - protein, 9 aa, Homo Sapiens
SLRKLVWRY

SEQ ID NO: 648168 - protein, 9 aa, Homo Sapiens
KPGAEKAKP

SEQ ID NO: 648169 - protein, 9 aa, Homo Sapiens
PIERLASEG

SEQ ID NO: 648170 - protein, 9 aa, Homo Sapiens
SKFRMSIVD

SEQ ID NO: 648171 - protein, 9 aa, Homo Sapiens
TLHLKDNGA

SEQ ID NO: 648172 - protein, 9 aa, Homo Sapiens
ATPLAKKLE

SEQ ID NO: 648173 - protein, 9 aa, Homo Sapiens
QGLCLCIDF

SEQ ID NO: 648174 - protein, 9 aa, Homo Sapiens
GEMQMMSIW

SEQ ID NO: 648175 - protein, 9 aa, Homo Sapiens
EIMDELVRV

SEQ ID NO: 648176 - protein, 9 aa, Homo Sapiens
PRTDPLSQP

SEQ ID NO: 648177 - protein, 9 aa, Homo Sapiens
TYMPNQFNL

SEQ ID NO: 648178 - protein, 9 aa, Homo Sapiens
APFVDSSAG

SEQ ID NO: 648179 - protein, 9 aa, Homo Sapiens
YFYSSNNKQ

SEQ ID NO: 648180 - protein, 9 aa, Homo Sapiens
GINNVSVSG

SEQ ID NO: 648181 - protein, 9 aa, Homo Sapiens
SSRRIRCNI

SEQ ID NO: 648182 - protein, 9 aa, Homo Sapiens
AIFVHGVST

SEQ ID NO: 648183 - protein, 9 aa, Homo Sapiens
QQCWATPRT

SEQ ID NO: 648184 - protein, 9 aa, Homo Sapiens
CCRCELGLE

SEQ ID NO: 648185 - protein, 9 aa, Homo Sapiens
AESPAGRFL

SEQ ID NO: 648186 - protein, 9 aa, Homo Sapiens
QPHQHIPVV

SEQ ID NO: 648187 - protein, 9 aa, Homo Sapiens
LLRVLRPLK

SEQ ID NO: 648188 - protein, 9 aa, Homo Sapiens
QALPGSSTI

SEQ ID NO: 648189 - protein, 9 aa, Homo Sapiens
TGYIKDSVL

SEQ ID NO: 648190 - protein, 9 aa, Homo Sapiens
APLLEGGTC

SEQ ID NO: 648191 - protein, 9 aa, Homo Sapiens
QTLTDLFLT

SEQ ID NO: 648192 - protein, 9 aa, Homo Sapiens
FTTSYLFTS

SEQ ID NO: 648193 - protein, 9 aa, Homo Sapiens
VAQALPGSS

SEQ ID NO: 648194 - protein, 9 aa, Homo Sapiens
GKLVLNDKL

SEQ ID NO: 648195 - protein, 9 aa, Homo Sapiens
DVVLSAVSA

SEQ ID NO: 648196 - protein, 9 aa, Homo Sapiens
LANISMEEL

SEQ ID NO: 648197 - protein, 9 aa, Homo Sapiens
LKPLLVGPS

SEQ ID NO: 648198 - protein, 9 aa, Homo Sapiens
SGLGLPVGS

SEQ ID NO: 648199 - protein, 9 aa, Homo Sapiens
ARSHGNGEG

SEQ ID NO: 648200 - protein, 9 aa, Homo Sapiens
RHERGEKHL

SEQ ID NO: 648201 - protein, 9 aa, Homo Sapiens
VLSVHGAGN

SEQ ID NO: 648202 - protein, 9 aa, Homo Sapiens
GIKEVLDDN

SEQ ID NO: 648203 - protein, 9 aa, Homo Sapiens
RSRYLMLLV

SEQ ID NO: 648204 - protein, 9 aa, Homo Sapiens
QSTKDLSRV

SEQ ID NO: 648205 - protein, 9 aa, Homo Sapiens
NLDTQDEAG

SEQ ID NO: 648206 - protein, 9 aa, Homo Sapiens
VNESVVSST

SEQ ID NO: 648207 - protein, 9 aa, Homo Sapiens
LLRKDACSW

SEQ ID NO: 648208 - protein, 9 aa, Homo Sapiens
AGPEIMDEL

SEQ ID NO: 648209 - protein, 9 aa, Homo Sapiens
APMLTRRVG

SEQ ID NO: 648210 - protein, 9 aa, Homo Sapiens
MPYINDTHF

SEQ ID NO: 648211 - protein, 9 aa, Homo Sapiens
GAEKAKPSA

SEQ ID NO: 648212 - protein, 9 aa, Homo Sapiens
LWAQKGAQE

SEQ ID NO: 648213 - protein, 9 aa, Homo Sapiens
TLLKNFLLY

SEQ ID NO: 648214 - protein, 9 aa, Homo Sapiens
LYMNVTEAA

SEQ ID NO: 648215 - protein, 9 aa, Homo Sapiens
KWSSRGSES

SEQ ID NO: 648216 - protein, 9 aa, Homo Sapiens
DHPFMCKHC

SEQ ID NO: 648217 - protein, 9 aa, Homo Sapiens
RGVLRNLAG

SEQ ID NO: 648218 - protein, 9 aa, Homo Sapiens
ITLHLKDNG

SEQ ID NO: 648219 - protein, 9 aa, Homo Sapiens
GDYVPGDAP

SEQ ID NO: 648220 - protein, 9 aa, Homo Sapiens
RSQPQRAES

SEQ ID NO: 648221 - protein, 9 aa, Homo Sapiens
ILGIMLRRL

SEQ ID NO: 648222 - protein, 9 aa, Homo Sapiens
CRCELGLEK

SEQ ID NO: 648223 - protein, 9 aa, Homo Sapiens
TELALKLLQ

SEQ ID NO: 648224 - protein, 9 aa, Homo Sapiens
RPPARKQAH

SEQ ID NO: 648225 - protein, 9 aa, Homo Sapiens
RDCALQFTQ

SEQ ID NO: 648226 - protein, 9 aa, Homo Sapiens
VERMSVIWD

SEQ ID NO: 648227 - protein, 9 aa, Homo Sapiens
HCRGSGPQV

SEQ ID NO: 648228 - protein, 9 aa, Homo Sapiens
PTTRDCALQ

SEQ ID NO: 648229 - protein, 9 aa, Homo Sapiens
VQWQLAQLE

SEQ ID NO: 648230 - protein, 9 aa, Homo Sapiens
EAAFTTSYL

SEQ ID NO: 648231 - protein, 9 aa, Homo Sapiens
PQRYTKPGA

SEQ ID NO: 648232 - protein, 9 aa, Homo Sapiens
TPQFSFSPA

SEQ ID NO: 648233 - protein, 9 aa, Homo Sapiens
NKFTFDSLE

SEQ ID NO: 648234 - protein, 9 aa, Homo Sapiens
FVHGVSTSG

SEQ ID NO: 648235 - protein, 9 aa, Homo Sapiens
KRNHTGDIP

SEQ ID NO: 648236 - protein, 9 aa, Homo Sapiens
EHRKHKKHP

SEQ ID NO: 648237 - protein, 9 aa, Homo Sapiens
NQTLTDLFL

SEQ ID NO: 648238 - protein, 9 aa, Homo Sapiens
PQIAAVAMP

SEQ ID NO: 648239 - protein, 9 aa, Homo Sapiens
PDLYVREQL

SEQ ID NO: 648240 - protein, 9 aa, Homo Sapiens
GAGHTVRDE

SEQ ID NO: 648241 - protein, 9 aa, Homo Sapiens
TRSTVSVLR

SEQ ID NO: 648242 - protein, 9 aa, Homo Sapiens
DVPPHAPPY

SEQ ID NO: 648243 - protein, 9 aa, Homo Sapiens
FKKEREEST

SEQ ID NO: 648244 - protein, 9 aa, Homo Sapiens
AAADGQDGG

SEQ ID NO: 648245 - protein, 9 aa, Homo Sapiens
FSEARGRSR

SEQ ID NO: 648246 - protein, 9 aa, Homo Sapiens
LEHLLQKAV

SEQ ID NO: 648247 - protein, 9 aa, Homo Sapiens
FARYWHGDY

SEQ ID NO: 648248 - protein, 9 aa, Homo Sapiens
WCTGYIKDS

SEQ ID NO: 648249 - protein, 9 aa, Homo Sapiens
AAWTVSGVA

SEQ ID NO: 648250 - protein, 9 aa, Homo Sapiens
VGREAVRLS

SEQ ID NO: 648251 - protein, 9 aa, Homo Sapiens
EKPYECKDY

SEQ ID NO: 648252 - protein, 9 aa, Homo Sapiens
AKRNTVLDE

SEQ ID NO: 648253 - protein, 9 aa, Homo Sapiens
GVEYTVHLW

SEQ ID NO: 648254 - protein, 9 aa, Homo Sapiens
RLEHLLQKA

SEQ ID NO: 648255 - protein, 9 aa, Homo Sapiens
GRSRTWEAS

SEQ ID NO: 648256 - protein, 9 aa, Homo Sapiens
GNRANILLV

SEQ ID NO: 648257 - protein, 9 aa, Homo Sapiens
HAFSSVEYG

SEQ ID NO: 648258 - protein, 9 aa, Homo Sapiens
VTEHEILNI

SEQ ID NO: 648259 - protein, 9 aa, Homo Sapiens
LGINNVSVS

SEQ ID NO: 648260 - protein, 9 aa, Homo Sapiens
SSNNKQPNS

SEQ ID NO: 648261 - protein, 9 aa, Homo Sapiens
EHSGLAATF

SEQ ID NO: 648262 - protein, 9 aa, Homo Sapiens
LKMANPIIG

SEQ ID NO: 648263 - protein, 9 aa, Homo Sapiens
QWQLAQLEA

SEQ ID NO: 648264 - protein, 9 aa, Homo Sapiens
AYSNFGNAY

SEQ ID NO: 648265 - protein, 9 aa, Homo Sapiens
RIHNHLLLF

SEQ ID NO: 648266 - protein, 9 aa, Homo Sapiens
YRDVMLQNY

SEQ ID NO: 648267 - protein, 9 aa, Homo Sapiens
QITAGRRRR

SEQ ID NO: 648268 - protein, 9 aa, Homo Sapiens
LIENLEVFR

SEQ ID NO: 648269 - protein, 9 aa, Homo Sapiens
WQLAQLEAR

SEQ ID NO: 648270 - protein, 9 aa, Homo Sapiens
SKKWSSRGS

SEQ ID NO: 648271 - protein, 9 aa, Homo Sapiens
DLKHLSQCS

SEQ ID NO: 648272 - protein, 9 aa, Homo Sapiens
GVGETITEE

SEQ ID NO: 648273 - protein, 9 aa, Homo Sapiens
IASFTFQPG

SEQ ID NO: 648274 - protein, 9 aa, Homo Sapiens
APSPATRWA

SEQ ID NO: 648275 - protein, 9 aa, Homo Sapiens
GGGRGPGRG

SEQ ID NO: 648276 - protein, 9 aa, Homo Sapiens
STSESGELV

SEQ ID NO: 648277 - protein, 9 aa, Homo Sapiens
FGATTTAPS

SEQ ID NO: 648278 - protein, 9 aa, Homo Sapiens
KMDSRVQVN

SEQ ID NO: 648279 - protein, 9 aa, Homo Sapiens
FAHACTLLT

SEQ ID NO: 648280 - protein, 9 aa, Homo Sapiens
LKLLQKRIE

SEQ ID NO: 648281 - protein, 9 aa, Homo Sapiens
LRKDACSWS

SEQ ID NO: 648282 - protein, 9 aa, Homo Sapiens
DAPLLGIMN

SEQ ID NO: 648283 - protein, 9 aa, Homo Sapiens
DITLPSEDC

SEQ ID NO: 648284 - protein, 9 aa, Homo Sapiens
DSGIHFGAT

SEQ ID NO: 648285 - protein, 9 aa, Homo Sapiens
GAITVKVPN

SEQ ID NO: 648286 - protein, 9 aa, Homo Sapiens
ASRQKELLK

SEQ ID NO: 648287 - protein, 9 aa, Homo Sapiens
EVSMVLTGT

SEQ ID NO: 648288 - protein, 9 aa, Homo Sapiens
NIDVVLSAV

SEQ ID NO: 648289 - protein, 9 aa, Homo Sapiens
KIVVDEFST

SEQ ID NO: 648290 - protein, 9 aa, Homo Sapiens
RQMFAKEAA

SEQ ID NO: 648291 - protein, 9 aa, Homo Sapiens
PGEALTPSS

SEQ ID NO: 648292 - protein, 9 aa, Homo Sapiens
FSEAAFTTS

SEQ ID NO: 648293 - protein, 9 aa, Homo Sapiens
GQTVRIVGR

SEQ ID NO: 648294 - protein, 9 aa, Homo Sapiens
MDELVRVLC

SEQ ID NO: 648295 - protein, 9 aa, Homo Sapiens
GRRDEAGGG

SEQ ID NO: 648296 - protein, 9 aa, Homo Sapiens
PAAASVSSA

SEQ ID NO: 648297 - protein, 9 aa, Homo Sapiens
CLFSASLGG

SEQ ID NO: 648298 - protein, 9 aa, Homo Sapiens
TIETIEAAK

SEQ ID NO: 648299 - protein, 9 aa, Homo Sapiens
RYTKPGAEK

SEQ ID NO: 648300 - protein, 9 aa, Homo Sapiens
TWTLVGSRL

SEQ ID NO: 648301 - protein, 9 aa, Homo Sapiens
MLQNYQNLL

SEQ ID NO: 648302 - protein, 9 aa, Homo Sapiens
DPLPSPGDT

SEQ ID NO: 648303 - protein, 9 aa, Homo Sapiens
YSSNNKQPN

SEQ ID NO: 648304 - protein, 9 aa, Homo Sapiens
LDSSFPRMN

SEQ ID NO: 648305 - protein, 9 aa, Homo Sapiens
IQSGQTVRI

SEQ ID NO: 648306 - protein, 9 aa, Homo Sapiens
KGSFFQPTA

SEQ ID NO: 648307 - protein, 9 aa, Homo Sapiens
AVTVACKAD

SEQ ID NO: 648308 - protein, 9 aa, Homo Sapiens
HFLDRNYEK

SEQ ID NO: 648309 - protein, 9 aa, Homo Sapiens
YVTLTWTTL

SEQ ID NO: 648310 - protein, 9 aa, Homo Sapiens
LYVREQLAL

SEQ ID NO: 648311 - protein, 9 aa, Homo Sapiens
RKEEKVTFD

SEQ ID NO: 648312 - protein, 9 aa, Homo Sapiens
RDTDKENGP

SEQ ID NO: 648313 - protein, 9 aa, Homo Sapiens
FLNGKWFKK

SEQ ID NO: 648314 - protein, 9 aa, Homo Sapiens
EQEQASCRK

SEQ ID NO: 648315 - protein, 9 aa, Homo Sapiens
EEAEDPEEN

SEQ ID NO: 648316 - protein, 9 aa, Homo Sapiens
TLPSEDCTT

SEQ ID NO: 648317 - protein, 9 aa, Homo Sapiens
ESDSPHIVR

SEQ ID NO: 648318 - protein, 9 aa, Homo Sapiens
PHAPSPATR

SEQ ID NO: 648319 - protein, 9 aa, Homo Sapiens
PAMSPNALN

SEQ ID NO: 648320 - protein, 9 aa, Homo Sapiens
GNASKQAGA

SEQ ID NO: 648321 - protein, 9 aa, Homo Sapiens
EVPSKTMLS

SEQ ID NO: 648322 - protein, 9 aa, Homo Sapiens
SNDAGLLGN

SEQ ID NO: 648323 - protein, 9 aa, Homo Sapiens
TLEERHERG

SEQ ID NO: 648324 - protein, 9 aa, Homo Sapiens
HRKHKKHPT

SEQ ID NO: 648325 - protein, 9 aa, Homo Sapiens
GYEVPSKTM

SEQ ID NO: 648326 - protein, 9 aa, Homo Sapiens
RPIPPSRVI

SEQ ID NO: 648327 - protein, 9 aa, Homo Sapiens
GPGSAVAAP

SEQ ID NO: 648328 - protein, 9 aa, Homo Sapiens
LAATFQQLP

SEQ ID NO: 648329 - protein, 9 aa, Homo Sapiens
AAPEDPLPS

SEQ ID NO: 648330 - protein, 9 aa, Homo Sapiens
ALQLYLRKS

SEQ ID NO: 648331 - protein, 9 aa, Homo Sapiens
GCGGDDFFL

SEQ ID NO: 648332 - protein, 9 aa, Homo Sapiens
RKDACSWST

SEQ ID NO: 648333 - protein, 9 aa, Homo Sapiens
FVSPNLFRV

SEQ ID NO: 648334 - protein, 9 aa, Homo Sapiens
RLHTGDHPF

SEQ ID NO: 648335 - protein, 9 aa, Homo Sapiens
RNRHQEEVA

SEQ ID NO: 648336 - protein, 9 aa, Homo Sapiens
LRLEHLLQK

SEQ ID NO: 648337 - protein, 9 aa, Homo Sapiens
DRATELALK

SEQ ID NO: 648338 - protein, 9 aa, Homo Sapiens
DPTNLSGPA

SEQ ID NO: 648339 - protein, 9 aa, Homo Sapiens
SPGASTHDS

SEQ ID NO: 648340 - protein, 9 aa, Homo Sapiens
YWHGDYLPF

SEQ ID NO: 648341 - protein, 9 aa, Homo Sapiens
YSNFGNAYI

SEQ ID NO: 648342 - protein, 9 aa, Homo Sapiens
TISNGKNQP

SEQ ID NO: 648343 - protein, 9 aa, Homo Sapiens
SFITPGALK

SEQ ID NO: 648344 - protein, 9 aa, Homo Sapiens
LNGKWFKKE

SEQ ID NO: 648345 - protein, 9 aa, Homo Sapiens
ESHNLINKV

SEQ ID NO: 648346 - protein, 9 aa, Homo Sapiens
ISNGKNQPT

SEQ ID NO: 648347 - protein, 9 aa, Homo Sapiens
PPYWAQPLL

SEQ ID NO: 648348 - protein, 9 aa, Homo Sapiens
PSKTMLSYS

SEQ ID NO: 648349 - protein, 9 aa, Homo Sapiens
RIVGRTGSG

SEQ ID NO: 648350 - protein, 9 aa, Homo Sapiens
ISQSVHVAF

SEQ ID NO: 648351 - protein, 9 aa, Homo Sapiens
RRPQRYTKP

SEQ ID NO: 648352 - protein, 9 aa, Homo Sapiens
LRLLLWPCP

SEQ ID NO: 648353 - protein, 9 aa, Homo Sapiens
RAIWVFFML

SEQ ID NO: 648354 - protein, 9 aa, Homo Sapiens
DAACHEATQ

SEQ ID NO: 648355 - protein, 9 aa, Homo Sapiens
MSRTVVLDD

SEQ ID NO: 648356 - protein, 9 aa, Homo Sapiens
STVSVLRGQ

SEQ ID NO: 648357 - protein, 9 aa, Homo Sapiens
CGGDDFFLV

SEQ ID NO: 648358 - protein, 9 aa, Homo Sapiens
IWVFFMLRS

SEQ ID NO: 648359 - protein, 9 aa, Homo Sapiens
VMIKDYSGV

SEQ ID NO: 648360 - protein, 9 aa, Homo Sapiens
RRPVLLHLH

SEQ ID NO: 648361 - protein, 9 aa, Homo Sapiens
SYLFTSELY

SEQ ID NO: 648362 - protein, 9 aa, Homo Sapiens
GIHFGATTT

SEQ ID NO: 648363 - protein, 9 aa, Homo Sapiens
EKFYALDSS

SEQ ID NO: 648364 - protein, 9 aa, Homo Sapiens
EHSSRRIRC

SEQ ID NO: 648365 - protein, 9 aa, Homo Sapiens
VDDTILSRQ

SEQ ID NO: 648366 - protein, 9 aa, Homo Sapiens
CELGLEKED

SEQ ID NO: 648367 - protein, 9 aa, Homo Sapiens
HLRLHTGDH

SEQ ID NO: 648368 - protein, 9 aa, Homo Sapiens
EKAKPSAAG

SEQ ID NO: 648369 - protein, 9 aa, Homo Sapiens
GPVGASQRT

SEQ ID NO: 648370 - protein, 9 aa, Homo Sapiens
SLFEVQWQL

SEQ ID NO: 648371 - protein, 9 aa, Homo Sapiens
GQAESQSQT

SEQ ID NO: 648372 - protein, 9 aa, Homo Sapiens
PLLGIMNVD

SEQ ID NO: 648373 - protein, 9 aa, Homo Sapiens
YFVSPNLFR

SEQ ID NO: 648374 - protein, 9 aa, Homo Sapiens
VSSTRAVNV

SEQ ID NO: 648375 - protein, 9 aa, Homo Sapiens
HEATQWVTH

SEQ ID NO: 648376 - protein, 9 aa, Homo Sapiens
AAFTTSYLF

SEQ ID NO: 648377 - protein, 9 aa, Homo Sapiens
RVDFSSIAV

SEQ ID NO: 648378 - protein, 9 aa, Homo Sapiens
QSGQTVRIV

SEQ ID NO: 648379 - protein, 9 aa, Homo Sapiens
SEEFFKKEP

SEQ ID NO: 648380 - protein, 9 aa, Homo Sapiens
TNGVVERMS

SEQ ID NO: 648381 - protein, 9 aa, Homo Sapiens
LFLTNNALG

SEQ ID NO: 648382 - protein, 9 aa, Homo Sapiens
VMDPAPAST

SEQ ID NO: 648383 - protein, 9 aa, Homo Sapiens
KLRGVLRNL

SEQ ID NO: 648384 - protein, 9 aa, Homo Sapiens
FLRRSPGEA

SEQ ID NO: 648385 - protein, 9 aa, Homo Sapiens
IRAPSGLGL

SEQ ID NO: 648386 - protein, 9 aa, Homo Sapiens
GGGCGGDDF

SEQ ID NO: 648387 - protein, 9 aa, Homo Sapiens
AYKGQILKM

SEQ ID NO: 648388 - protein, 9 aa, Homo Sapiens
DWLHLVTMS

SEQ ID NO: 648389 - protein, 9 aa, Homo Sapiens
APFKEEDES

SEQ ID NO: 648390 - protein, 9 aa, Homo Sapiens
AKLESRLQY

SEQ ID NO: 648391 - protein, 9 aa, Homo Sapiens
YWAQPLLMG

SEQ ID NO: 648392 - protein, 9 aa, Homo Sapiens
ILFSYFALI

SEQ ID NO: 648393 - protein, 9 aa, Homo Sapiens
MQMMSIWYS

SEQ ID NO: 648394 - protein, 9 aa, Homo Sapiens
GLILAFFMS

SEQ ID NO: 648395 - protein, 9 aa, Homo Sapiens
EALLELLCC

SEQ ID NO: 648396 - protein, 9 aa, Homo Sapiens
SSVCPVRVL

SEQ ID NO: 648397 - protein, 9 aa, Homo Sapiens
DGDGKIVVD

SEQ ID NO: 648398 - protein, 9 aa, Homo Sapiens
IVGIVGSMI

SEQ ID NO: 648399 - protein, 9 aa, Homo Sapiens
LDTQDEAGL

SEQ ID NO: 648400 - protein, 9 aa, Homo Sapiens
IKSLRLLRV

SEQ ID NO: 648401 - protein, 9 aa, Homo Sapiens
AFKVPPLIQ

SEQ ID NO: 648402 - protein, 9 aa, Homo Sapiens
APSSAWWGL

SEQ ID NO: 648403 - protein, 9 aa, Homo Sapiens
ERRAYSNFG

SEQ ID NO: 648404 - protein, 9 aa, Homo Sapiens
ARFSRGSSR

SEQ ID NO: 648405 - protein, 9 aa, Homo Sapiens
YNHELYMNV

SEQ ID NO: 648406 - protein, 9 aa, Homo Sapiens
AFNWSSHLS

SEQ ID NO: 648407 - protein, 9 aa, Homo Sapiens
CNECVKVFN

SEQ ID NO: 648408 - protein, 9 aa, Homo Sapiens
NTNKFYMSY

SEQ ID NO: 648409 - protein, 9 aa, Homo Sapiens
THKAEREVS

SEQ ID NO: 648410 - protein, 9 aa, Homo Sapiens
RQRAKRNTV

SEQ ID NO: 648411 - protein, 9 aa, Homo Sapiens
LGQRRPPAR

SEQ ID NO: 648412 - protein, 9 aa, Homo Sapiens
LLYRSRYLM

SEQ ID NO: 648413 - protein, 9 aa, Homo Sapiens
ESGNRANIL

SEQ ID NO: 648414 - protein, 9 aa, Homo Sapiens
SKAITSSRV

SEQ ID NO: 648415 - protein, 9 aa, Homo Sapiens
SSPSAGLPK

SEQ ID NO: 648416 - protein, 9 aa, Homo Sapiens
KRNTVLDEA

SEQ ID NO: 648417 - protein, 9 aa, Homo Sapiens
FVDSSAGHS

SEQ ID NO: 648418 - protein, 9 aa, Homo Sapiens
VGIVGSMIS

SEQ ID NO: 648419 - protein, 9 aa, Homo Sapiens
IDFQFDTVV

SEQ ID NO: 648420 - protein, 9 aa, Homo Sapiens
GTEHSGLAA

SEQ ID NO: 648421 - protein, 9 aa, Homo Sapiens
SRTVVLDDP

SEQ ID NO: 648422 - protein, 9 aa, Homo Sapiens
LSLNGSEVS

SEQ ID NO: 648423 - protein, 9 aa, Homo Sapiens
DDPTSGVDP

SEQ ID NO: 648424 - protein, 9 aa, Homo Sapiens
ISRDTDKEN

SEQ ID NO: 648425 - protein, 9 aa, Homo Sapiens
EHEILNIFQ

SEQ ID NO: 648426 - protein, 9 aa, Homo Sapiens
GAQHEAEAG

SEQ ID NO: 648427 - protein, 9 aa, Homo Sapiens
VCVDTHLRS

SEQ ID NO: 648428 - protein, 9 aa, Homo Sapiens
PPAARSHGN

SEQ ID NO: 648429 - protein, 9 aa, Homo Sapiens
SPGGAQDPT

SEQ ID NO: 648430 - protein, 9 aa, Homo Sapiens
KKLQEEISD

SEQ ID NO: 648431 - protein, 9 aa, Homo Sapiens
QRYTKPGAE

SEQ ID NO: 648432 - protein, 9 aa, Homo Sapiens
SGAWPGLGS

SEQ ID NO: 648433 - protein, 9 aa, Homo Sapiens
LHTGIKEVL

SEQ ID NO: 648434 - protein, 9 aa, Homo Sapiens
SPNALNQFP

SEQ ID NO: 648435 - protein, 9 aa, Homo Sapiens
FFKTAVVLV

SEQ ID NO: 648436 - protein, 9 aa, Homo Sapiens
LQLKQNIAL

SEQ ID NO: 648437 - protein, 9 aa, Homo Sapiens
QTILFSYFA

SEQ ID NO: 648438 - protein, 9 aa, Homo Sapiens
SHNLINKVD

SEQ ID NO: 648439 - protein, 9 aa, Homo Sapiens
KFYALDSSF

SEQ ID NO: 648440 - protein, 9 aa, Homo Sapiens
TPAPSSAWW

SEQ ID NO: 648441 - protein, 9 aa, Homo Sapiens
PGVVDLPQE

SEQ ID NO: 648442 - protein, 9 aa, Homo Sapiens
VDITLPSED

SEQ ID NO: 648443 - protein, 9 aa, Homo Sapiens
VPEKPSKAI

SEQ ID NO: 648444 - protein, 9 aa, Homo Sapiens
VSNCWICHN

SEQ ID NO: 648445 - protein, 9 aa, Homo Sapiens
TILFSYFAL

SEQ ID NO: 648446 - protein, 9 aa, Homo Sapiens
DLILAEYSD

SEQ ID NO: 648447 - protein, 9 aa, Homo Sapiens
AKKPASRQK

SEQ ID NO: 648448 - protein, 9 aa, Homo Sapiens
TPLAKKLEP

SEQ ID NO: 648449 - protein, 9 aa, Homo Sapiens
CLSHSEEFF

SEQ ID NO: 648450 - protein, 9 aa, Homo Sapiens
YMPNQFNLD

SEQ ID NO: 648451 - protein, 9 aa, Homo Sapiens
RSPGEALTP

SEQ ID NO: 648452 - protein, 9 aa, Homo Sapiens
DCALQFTQQ

SEQ ID NO: 648453 - protein, 9 aa, Homo Sapiens
IAAVAMPRI

SEQ ID NO: 648454 - protein, 9 aa, Homo Sapiens
SCQHMGDCL

SEQ ID NO: 648455 - protein, 9 aa, Homo Sapiens
VVLDDPTSG

SEQ ID NO: 648456 - protein, 9 aa, Homo Sapiens
QLANISMEE

SEQ ID NO: 648457 - protein, 9 aa, Homo Sapiens
LRKSLSNSL

SEQ ID NO: 648458 - protein, 9 aa, Homo Sapiens
ALSLLYRSR

SEQ ID NO: 648459 - protein, 9 aa, Homo Sapiens
ATPRTDPLS

SEQ ID NO: 648460 - protein, 9 aa, Homo Sapiens
AGKMAAADG

SEQ ID NO: 648461 - protein, 9 aa, Homo Sapiens
LHSKISSLN

SEQ ID NO: 648462 - protein, 9 aa, Homo Sapiens
LAAFFFKTA

SEQ ID NO: 648463 - protein, 9 aa, Homo Sapiens
LRLHTGDHP

SEQ ID NO: 648464 - protein, 9 aa, Homo Sapiens
LWCTGYIKD

SEQ ID NO: 648465 - protein, 9 aa, Homo Sapiens
TTSYLFTSE

SEQ ID NO: 648466 - protein, 9 aa, Homo Sapiens
QAESQSQTS

SEQ ID NO: 648467 - protein, 9 aa, Homo Sapiens
GTKMDSRVQ

SEQ ID NO: 648468 - protein, 9 aa, Homo Sapiens
IAWILGLHS

SEQ ID NO: 648469 - protein, 9 aa, Homo Sapiens
NTVLDEANN

SEQ ID NO: 648470 - protein, 9 aa, Homo Sapiens
SQPQEAGQA

SEQ ID NO: 648471 - protein, 9 aa, Homo Sapiens
SQSVHVAFK

SEQ ID NO: 648472 - protein, 9 aa, Homo Sapiens
EEEGVGETI

SEQ ID NO: 648473 - protein, 9 aa, Homo Sapiens
IIASGNHVS

SEQ ID NO: 648474 - protein, 9 aa, Homo Sapiens
VLIENLEVF

SEQ ID NO: 648475 - protein, 9 aa, Homo Sapiens
PPHAPPYWA

SEQ ID NO: 648476 - protein, 9 aa, Homo Sapiens
SEEDWLHLV

SEQ ID NO: 648477 - protein, 9 aa, Homo Sapiens
SETSQENYW

SEQ ID NO: 648478 - protein, 9 aa, Homo Sapiens
ESAEEACGS

SEQ ID NO: 648479 - protein, 9 aa, Homo Sapiens
RAQTILFSY

SEQ ID NO: 648480 - protein, 9 aa, Homo Sapiens
RGNLNATSK

SEQ ID NO: 648481 - protein, 9 aa, Homo Sapiens
YGVLMAMAL

SEQ ID NO: 648482 - protein, 9 aa, Homo Sapiens
AWTVSGVAL

SEQ ID NO: 648483 - protein, 9 aa, Homo Sapiens
IGSDYVTLT

SEQ ID NO: 648484 - protein, 9 aa, Homo Sapiens
DTDKENGPS

SEQ ID NO: 648485 - protein, 9 aa, Homo Sapiens
SSRGSESHE

SEQ ID NO: 648486 - protein, 9 aa, Homo Sapiens
EPAQRTLYR

SEQ ID NO: 648487 - protein, 9 aa, Homo Sapiens
LLEGGTCLF

SEQ ID NO: 648488 - protein, 9 aa, Homo Sapiens
LGIMLRRLQ

SEQ ID NO: 648489 - protein, 9 aa, Homo Sapiens
TPSSLSPSM

SEQ ID NO: 648490 - protein, 9 aa, Homo Sapiens
ITSASMSIP

SEQ ID NO: 648491 - protein, 9 aa, Homo Sapiens
LESHNLINK

SEQ ID NO: 648492 - protein, 9 aa, Homo Sapiens
PSGLGLPVG

SEQ ID NO: 648493 - protein, 9 aa, Homo Sapiens
LRRPVLLHL

SEQ ID NO: 648494 - protein, 9 aa, Homo Sapiens
CQSSEPGDE

SEQ ID NO: 648495 - protein, 9 aa, Homo Sapiens
SQPQRAESP

SEQ ID NO: 648496 - protein, 9 aa, Homo Sapiens
SPCLPGWSR

SEQ ID NO: 648497 - protein, 9 aa, Homo Sapiens
SQRTAAPED

SEQ ID NO: 648498 - protein, 9 aa, Homo Sapiens
FLPLLGGCV

SEQ ID NO: 648499 - protein, 9 aa, Homo Sapiens
DFFGRLLME

SEQ ID NO: 648500 - protein, 9 aa, Homo Sapiens
HTVRDEPPS

SEQ ID NO: 648501 - protein, 9 aa, Homo Sapiens
PGGAQDPTN

SEQ ID NO: 648502 - protein, 9 aa, Homo Sapiens
KNITVTSGD

SEQ ID NO: 648503 - protein, 9 aa, Homo Sapiens
HSPGGAQDP

SEQ ID NO: 648504 - protein, 9 aa, Homo Sapiens
LLSLNGSEV

SEQ ID NO: 648505 - protein, 9 aa, Homo Sapiens
KRAQTILFS

SEQ ID NO: 648506 - protein, 9 aa, Homo Sapiens
EVFRKNGFD

SEQ ID NO: 648507 - protein, 9 aa, Homo Sapiens
AVLCERMSQ

SEQ ID NO: 648508 - protein, 9 aa, Homo Sapiens
AGGAGEMQM

SEQ ID NO: 648509 - protein, 9 aa, Homo Sapiens
NFGNAYIFL

SEQ ID NO: 648510 - protein, 9 aa, Homo Sapiens
QPELAKKPA

SEQ ID NO: 648511 - protein, 9 aa, Homo Sapiens
KQAHRSQPQ

SEQ ID NO: 648512 - protein, 9 aa, Homo Sapiens
REFLKKEFT

SEQ ID NO: 648513 - protein, 9 aa, Homo Sapiens
HSGLAATFQ

SEQ ID NO: 648514 - protein, 9 aa, Homo Sapiens
NHVSNCWIC

SEQ ID NO: 648515 - protein, 9 aa, Homo Sapiens
AAFFFKTAV

SEQ ID NO: 648516 - protein, 9 aa, Homo Sapiens
SEQLANISM

SEQ ID NO: 648517 - protein, 9 aa, Homo Sapiens
WGLGLGQRR

SEQ ID NO: 648518 - protein, 9 aa, Homo Sapiens
LLERESTAQ

SEQ ID NO: 648519 - protein, 9 aa, Homo Sapiens
VGQAGPEIM

SEQ ID NO: 648520 - protein, 9 aa, Homo Sapiens
SPATRWAAW

SEQ ID NO: 648521 - protein, 9 aa, Homo Sapiens
FASGEKQPL

SEQ ID NO: 648522 - protein, 9 aa, Homo Sapiens
FGNAYIFLG

SEQ ID NO: 648523 - protein, 9 aa, Homo Sapiens
AGSQPQEAG

SEQ ID NO: 648524 - protein, 9 aa, Homo Sapiens
ECDKEFSPR

SEQ ID NO: 648525 - protein, 9 aa, Homo Sapiens
EHLLQKAVH

SEQ ID NO: 648526 - protein, 9 aa, Homo Sapiens
QRPEPQLKG

SEQ ID NO: 648527 - protein, 9 aa, Homo Sapiens
SLSNSLHPL

SEQ ID NO: 648528 - protein, 9 aa, Homo Sapiens
RLLLWPCPG

SEQ ID NO: 648529 - protein, 9 aa, Homo Sapiens
PAPATTLSQ

SEQ ID NO: 648530 - protein, 9 aa, Homo Sapiens
TAGRRRRLW

SEQ ID NO: 648531 - protein, 9 aa, Homo Sapiens
LVSSLSSES

SEQ ID NO: 648532 - protein, 9 aa, Homo Sapiens
EATQWVTHL

SEQ ID NO: 648533 - protein, 9 aa, Homo Sapiens
PQFSFSPAG

SEQ ID NO: 648534 - protein, 9 aa, Homo Sapiens
AEYEADRDS

SEQ ID NO: 648535 - protein, 9 aa, Homo Sapiens
MNVTEAAKS

SEQ ID NO: 648536 - protein, 9 aa, Homo Sapiens
WILGLHSKI

SEQ ID NO: 648537 - protein, 9 aa, Homo Sapiens
LQNVAQALP

SEQ ID NO: 648538 - protein, 9 aa, Homo Sapiens
NLLLRKDAC

SEQ ID NO: 648539 - protein, 9 aa, Homo Sapiens
QCWATPRTD

SEQ ID NO: 648540 - protein, 9 aa, Homo Sapiens
GSDYVTLTW

SEQ ID NO: 648541 - protein, 9 aa, Homo Sapiens
GLGLGQRRP

SEQ ID NO: 648542 - protein, 9 aa, Homo Sapiens
SEHSRNRHQ

SEQ ID NO: 648543 - protein, 9 aa, Homo Sapiens
APPYWAQPL

SEQ ID NO: 648544 - protein, 9 aa, Homo Sapiens
DACSWSTGM

SEQ ID NO: 648545 - protein, 9 aa, Homo Sapiens
GTSRKLSVK

SEQ ID NO: 648546 - protein, 9 aa, Homo Sapiens
PGALKGLPR

SEQ ID NO: 648547 - protein, 9 aa, Homo Sapiens
VGCAVAVLS

SEQ ID NO: 648548 - protein, 9 aa, Homo Sapiens
AVANALHSL

SEQ ID NO: 648549 - protein, 9 aa, Homo Sapiens
NITVTSGDY

SEQ ID NO: 648550 - protein, 9 aa, Homo Sapiens
DKDGDGKIV

SEQ ID NO: 648551 - protein, 9 aa, Homo Sapiens
VKEYIGHLD

SEQ ID NO: 648552 - protein, 9 aa, Homo Sapiens
TFMARFSRG

SEQ ID NO: 648553 - protein, 9 aa, Homo Sapiens
AHRSQPQRA

SEQ ID NO: 648554 - protein, 9 aa, Homo Sapiens
PATRWAAWT

SEQ ID NO: 648555 - protein, 9 aa, Homo Sapiens
GSQPQEAGQ

SEQ ID NO: 648556 - protein, 9 aa, Homo Sapiens
DLFLTNNAL

SEQ ID NO: 648557 - protein, 9 aa, Homo Sapiens
FGRLLMEDG

SEQ ID NO: 648558 - protein, 9 aa, Homo Sapiens
PHAPPYWAQ

SEQ ID NO: 648559 - protein, 9 aa, Homo Sapiens
AAGGANSGC

SEQ ID NO: 648560 - protein, 9 aa, Homo Sapiens
FYINENTFK

SEQ ID NO: 648561 - protein, 9 aa, Homo Sapiens
LALKLLQKR

SEQ ID NO: 648562 - protein, 9 aa, Homo Sapiens
AGDAPLLGI

SEQ ID NO: 648563 - protein, 9 aa, Homo Sapiens
GVPAMSPNA

SEQ ID NO: 648564 - protein, 9 aa, Homo Sapiens
LGLHSKISS

SEQ ID NO: 648565 - protein, 9 aa, Homo Sapiens
NIQSGQTVR

SEQ ID NO: 648566 - protein, 9 aa, Homo Sapiens
VTSGDYSLF

SEQ ID NO: 648567 - protein, 9 aa, Homo Sapiens
SGLAATFQQ

SEQ ID NO: 648568 - protein, 9 aa, Homo Sapiens
GEALTPSSL

SEQ ID NO: 648569 - protein, 9 aa, Homo Sapiens
SGDYSLFQK

SEQ ID NO: 648570 - protein, 9 aa, Homo Sapiens
RQCGKAFRT

SEQ ID NO: 648571 - protein, 9 aa, Homo Sapiens
PIMSELEER

SEQ ID NO: 648572 - protein, 9 aa, Homo Sapiens
RGNASPGAS

SEQ ID NO: 648573 - protein, 9 aa, Homo Sapiens
GAVIARQRL

SEQ ID NO: 648574 - protein, 9 aa, Homo Sapiens
IHNHLLLFV

SEQ ID NO: 648575 - protein, 9 aa, Homo Sapiens
EPELAAFFF

SEQ ID NO: 648576 - protein, 9 aa, Homo Sapiens
ADAPGPQGP

SEQ ID NO: 648577 - protein, 9 aa, Homo Sapiens
KPRVNMFPF

SEQ ID NO: 648578 - protein, 9 aa, Homo Sapiens
QRTAAPEDP

SEQ ID NO: 648579 - protein, 9 aa, Homo Sapiens
AKRENWKPV

SEQ ID NO: 648580 - protein, 9 aa, Homo Sapiens
SRRIRCNIC

SEQ ID NO: 648581 - protein, 9 aa, Homo Sapiens
MTHCFSPCC

SEQ ID NO: 648582 - protein, 9 aa, Homo Sapiens
NSGCGSSGG

SEQ ID NO: 648583 - protein, 9 aa, Homo Sapiens
YLPFDGPGG

SEQ ID NO: 648584 - protein, 9 aa, Homo Sapiens
PAGRFLRRS

SEQ ID NO: 648585 - protein, 9 aa, Homo Sapiens
KRPVRQRPE

SEQ ID NO: 648586 - protein, 9 aa, Homo Sapiens
RPGVVDLPQ

SEQ ID NO: 648587 - protein, 9 aa, Homo Sapiens
FHHRARCLA

SEQ ID NO: 648588 - protein, 9 aa, Homo Sapiens
PNALNQFPA

SEQ ID NO: 648589 - protein, 9 aa, Homo Sapiens
RLASEGAIT

SEQ ID NO: 648590 - protein, 9 aa, Homo Sapiens
PGDTPAPSS

SEQ ID NO: 648591 - protein, 9 aa, Homo Sapiens
EAEDPEENV

SEQ ID NO: 648592 - protein, 9 aa, Homo Sapiens
PEDLRQMFA

SEQ ID NO: 648593 - protein, 9 aa, Homo Sapiens
RSCGSGTKM

SEQ ID NO: 648594 - protein, 9 aa, Homo Sapiens
INEGEHSSR

SEQ ID NO: 648595 - protein, 9 aa, Homo Sapiens
CVPEKPSKA

SEQ ID NO: 648596 - protein, 9 aa, Homo Sapiens
KWFKKEREE

SEQ ID NO: 648597 - protein, 9 aa, Homo Sapiens
RCELGLEKE

SEQ ID NO: 648598 - protein, 9 aa, Homo Sapiens
QHRAFAKNP

SEQ ID NO: 648599 - protein, 9 aa, Homo Sapiens
EPMFTWTLV

SEQ ID NO: 648600 - protein, 9 aa, Homo Sapiens
CHEATQWVT

SEQ ID NO: 648601 - protein, 9 aa, Homo Sapiens
GSFFQPTAK

SEQ ID NO: 648602 - protein, 9 aa, Homo Sapiens
ELVSSLSSE

SEQ ID NO: 648603 - protein, 9 aa, Homo Sapiens
FKKEPLSDT

SEQ ID NO: 648604 - protein, 9 aa, Homo Sapiens
VKKQSTKDL

SEQ ID NO: 648605 - protein, 9 aa, Homo Sapiens
CGSYETETG

SEQ ID NO: 648606 - protein, 9 aa, Homo Sapiens
EMQMMSIWY

SEQ ID NO: 648607 - protein, 9 aa, Homo Sapiens
IEKYFVSPN

SEQ ID NO: 648608 - protein, 9 aa, Homo Sapiens
SAFKTSPFP

SEQ ID NO: 648609 - protein, 9 aa, Homo Sapiens
KLEPVSWSS

SEQ ID NO: 648610 - protein, 9 aa, Homo Sapiens
QAPLLEGGT

SEQ ID NO: 648611 - protein, 9 aa, Homo Sapiens
LLRRFHHRA

SEQ ID NO: 648612 - protein, 9 aa, Homo Sapiens
ASVSSAAAV

SEQ ID NO: 648613 - protein, 9 aa, Homo Sapiens
CTWPAEGSA

SEQ ID NO: 648614 - protein, 9 aa, Homo Sapiens
EAGGGGPGH

SEQ ID NO: 648615 - protein, 9 aa, Homo Sapiens
PHFLDRNYE

SEQ ID NO: 648616 - protein, 9 aa, Homo Sapiens
LTAAVMHYG

SEQ ID NO: 648617 - protein, 9 aa, Homo Sapiens
FTFQPGMGQ

SEQ ID NO: 648618 - protein, 9 aa, Homo Sapiens
GTVITMPFQ

SEQ ID NO: 648619 - protein, 9 aa, Homo Sapiens
ESSVCPVRV

SEQ ID NO: 648620 - protein, 9 aa, Homo Sapiens
GEHSSRRIR

SEQ ID NO: 648621 - protein, 9 aa, Homo Sapiens
GGAVYYCTW

SEQ ID NO: 648622 - protein, 9 aa, Homo Sapiens
VSVSGQSVL

SEQ ID NO: 648623 - protein, 9 aa, Homo Sapiens
SQQIFTNVT

SEQ ID NO: 648624 - protein, 9 aa, Homo Sapiens
ASTHDSLSD

SEQ ID NO: 648625 - protein, 9 aa, Homo Sapiens
ILAFFMSIC

SEQ ID NO: 648626 - protein, 9 aa, Homo Sapiens
MVLTGTAFY

SEQ ID NO: 648627 - protein, 9 aa, Homo Sapiens
SPGEALTPS

SEQ ID NO: 648628 - protein, 9 aa, Homo Sapiens
IAKLESRLQ

SEQ ID NO: 648629 - protein, 9 aa, Homo Sapiens
KPQLSLKPL

SEQ ID NO: 648630 - protein, 9 aa, Homo Sapiens
GGGGCGGDD

SEQ ID NO: 648631 - protein, 9 aa, Homo Sapiens
GALKGLPRL

SEQ ID NO: 648632 - protein, 9 aa, Homo Sapiens
SRGSSRSPV

SEQ ID NO: 648633 - protein, 9 aa, Homo Sapiens
IPPSRVIEE

SEQ ID NO: 648634 - protein, 9 aa, Homo Sapiens
RFLRRSPGE

SEQ ID NO: 648635 - protein, 9 aa, Homo Sapiens
ALLELLCCT

SEQ ID NO: 648636 - protein, 9 aa, Homo Sapiens
LKGLGGGFR

SEQ ID NO: 648637 - protein, 9 aa, Homo Sapiens
VDTHLRSTC

SEQ ID NO: 648638 - protein, 9 aa, Homo Sapiens
TMPFQFAGG

SEQ ID NO: 648639 - protein, 9 aa, Homo Sapiens
AEEACGSQE

SEQ ID NO: 648640 - protein, 9 aa, Homo Sapiens
LEGGTCLFS

SEQ ID NO: 648641 - protein, 9 aa, Homo Sapiens
RLQYLSIAH

SEQ ID NO: 648642 - protein, 9 aa, Homo Sapiens
RQHCYTCGI

SEQ ID NO: 648643 - protein, 9 aa, Homo Sapiens
DQPSGGGGC

SEQ ID NO: 648644 - protein, 9 aa, Homo Sapiens
KFYKDNINA

SEQ ID NO: 648645 - protein, 9 aa, Homo Sapiens
EALTPSSLS

SEQ ID NO: 648646 - protein, 9 aa, Homo Sapiens
VECDKEFSP

SEQ ID NO: 648647 - protein, 9 aa, Homo Sapiens
PEGTNGVVE

SEQ ID NO: 648648 - protein, 9 aa, Homo Sapiens
KIIASGNHV

SEQ ID NO: 648649 - protein, 9 aa, Homo Sapiens
CVSEQEQAS

SEQ ID NO: 648650 - protein, 9 aa, Homo Sapiens
ENWKPVTVM

SEQ ID NO: 648651 - protein, 9 aa, Homo Sapiens
RGPGRGLPG

SEQ ID NO: 648652 - protein, 9 aa, Homo Sapiens
QPGMGQFMA

SEQ ID NO: 648653 - protein, 9 aa, Homo Sapiens
TDLFLTNNA

SEQ ID NO: 648654 - protein, 9 aa, Homo Sapiens
NRTFQAGSQ

SEQ ID NO: 648655 - protein, 9 aa, Homo Sapiens
IPAAASVSS

SEQ ID NO: 648656 - protein, 9 aa, Homo Sapiens
HERGEKHLG

SEQ ID NO: 648657 - protein, 9 aa, Homo Sapiens
GQRRPPARK

SEQ ID NO: 648658 - protein, 9 aa, Homo Sapiens
GVALAGPVG

SEQ ID NO: 648659 - protein, 9 aa, Homo Sapiens
QLRPIMSEL

SEQ ID NO: 648660 - protein, 9 aa, Homo Sapiens
CWATPRTDP

SEQ ID NO: 648661 - protein, 9 aa, Homo Sapiens
VLRGQGMVL

SEQ ID NO: 648662 - protein, 9 aa, Homo Sapiens
TAAVMHYGN

SEQ ID NO: 648663 - protein, 9 aa, Homo Sapiens
GTCLFSASL

SEQ ID NO: 648664 - protein, 9 aa, Homo Sapiens
LVSERSNNG

SEQ ID NO: 648665 - protein, 9 aa, Homo Sapiens
LGHKPRVNM

SEQ ID NO: 648666 - protein, 9 aa, Homo Sapiens
RKRPVRQRP

SEQ ID NO: 648667 - protein, 9 aa, Homo Sapiens
ASKHSMVNS

SEQ ID NO: 648668 - protein, 9 aa, Homo Sapiens
TVLQLKQNI

SEQ ID NO: 648669 - protein, 9 aa, Homo Sapiens
WHGDYLPFD

SEQ ID NO: 648670 - protein, 9 aa, Homo Sapiens
FVNLVECDK

SEQ ID NO: 648671 - protein, 9 aa, Homo Sapiens
KHSMVNSLP

SEQ ID NO: 648672 - protein, 9 aa, Homo Sapiens
AARSHGNGE

SEQ ID NO: 648673 - protein, 9 aa, Homo Sapiens
KQNIALLPN

SEQ ID NO: 648674 - protein, 9 aa, Homo Sapiens
GRLLMEDGM

SEQ ID NO: 648675 - protein, 9 aa, Homo Sapiens
HTGDHPFMC

SEQ ID NO: 648676 - protein, 9 aa, Homo Sapiens
VYEAWRLGC

SEQ ID NO: 648677 - protein, 9 aa, Homo Sapiens
GTAFYHKYF

SEQ ID NO: 648678 - protein, 9 aa, Homo Sapiens
WTCISRDTD

SEQ ID NO: 648679 - protein, 9 aa, Homo Sapiens
FSASLGGPE

SEQ ID NO: 648680 - protein, 9 aa, Homo Sapiens
LTDLFLTNN

SEQ ID NO: 648681 - protein, 9 aa, Homo Sapiens
NKMSAIFVH

SEQ ID NO: 648682 - protein, 9 aa, Homo Sapiens
EENVAVSPT

SEQ ID NO: 648683 - protein, 9 aa, Homo Sapiens
TLLTMFDQN

SEQ ID NO: 648684 - protein, 9 aa, Homo Sapiens
VNLVECDKE

SEQ ID NO: 648685 - protein, 9 aa, Homo Sapiens
RAYSNFGNA

SEQ ID NO: 648686 - protein, 9 aa, Homo Sapiens
RKGSKAYGS

SEQ ID NO: 648687 - protein, 9 aa, Homo Sapiens
HLSQCSSIS

SEQ ID NO: 648688 - protein, 9 aa, Homo Sapiens
QESATTHKA

SEQ ID NO: 648689 - protein, 9 aa, Homo Sapiens
FQPGMGQFM

SEQ ID NO: 648690 - protein, 9 aa, Homo Sapiens
ARLHPCGSY

SEQ ID NO: 648691 - protein, 9 aa, Homo Sapiens
GAVGVGKSA

SEQ ID NO: 648692 - protein, 9 aa, Homo Sapiens
GDYLPFDGP

SEQ ID NO: 648693 - protein, 9 aa, Homo Sapiens
KESGKGSFF

SEQ ID NO: 648694 - protein, 9 aa, Homo Sapiens
YETETGGDC

SEQ ID NO: 648695 - protein, 9 aa, Homo Sapiens
PHACRQQET

SEQ ID NO: 648696 - protein, 9 aa, Homo Sapiens
YKDNINAGQ

SEQ ID NO: 648697 - protein, 9 aa, Homo Sapiens
DIREALLEL

SEQ ID NO: 648698 - protein, 9 aa, Homo Sapiens
WESGAWPGL

SEQ ID NO: 648699 - protein, 9 aa, Homo Sapiens
APPAARSHG

SEQ ID NO: 648700 - protein, 9 aa, Homo Sapiens
SATTHKAER

SEQ ID NO: 648701 - protein, 9 aa, Homo Sapiens
AHACTLLTM

SEQ ID NO: 648702 - protein, 9 aa, Homo Sapiens
VHLWAQKGA

SEQ ID NO: 648703 - protein, 9 aa, Homo Sapiens
CPGSPALWL

SEQ ID NO: 648704 - protein, 9 aa, Homo Sapiens
KFTFDSLEA

SEQ ID NO: 648705 - protein, 9 aa, Homo Sapiens
GSAVAAPPA

SEQ ID NO: 648706 - protein, 9 aa, Homo Sapiens
DENGPLMMQ

SEQ ID NO: 648707 - protein, 9 aa, Homo Sapiens
PAARSHGNG

SEQ ID NO: 648708 - protein, 9 aa, Homo Sapiens
GSLFEVQWQ

SEQ ID NO: 648709 - protein, 9 aa, Homo Sapiens
AGGGPGSAV

SEQ ID NO: 648710 - protein, 9 aa, Homo Sapiens
GHASFISCP

SEQ ID NO: 648711 - protein, 9 aa, Homo Sapiens
SEDCTTMID

SEQ ID NO: 648712 - protein, 9 aa, Homo Sapiens
DADAPGPQG

SEQ ID NO: 648713 - protein, 9 aa, Homo Sapiens
QDPTNLSGP

SEQ ID NO: 648714 - protein, 9 aa, Homo Sapiens
LRGVLRNLA

SEQ ID NO: 648715 - protein, 9 aa, Homo Sapiens
GRRPQRYTK

SEQ ID NO: 648716 - protein, 9 aa, Homo Sapiens
GREAVRLSC

SEQ ID NO: 648717 - protein, 9 aa, Homo Sapiens
THYPDLYVR

SEQ ID NO: 648718 - protein, 9 aa, Homo Sapiens
QINSQLRPI

SEQ ID NO: 648719 - protein, 9 aa, Homo Sapiens
ATTHKAERE

SEQ ID NO: 648720 - protein, 9 aa, Homo Sapiens
TIGGDLVEN

SEQ ID NO: 648721 - protein, 9 aa, Homo Sapiens
QRRPPARKQ

SEQ ID NO: 648722 - protein, 9 aa, Homo Sapiens
LWNLRSNDA

SEQ ID NO: 648723 - protein, 9 aa, Homo Sapiens
EAGQKGDAD

SEQ ID NO: 648724 - protein, 9 aa, Homo Sapiens
RLAGGAGEM

SEQ ID NO: 648725 - protein, 9 aa, Homo Sapiens
CSDAEYEAD

SEQ ID NO: 648726 - protein, 9 aa, Homo Sapiens
GKKKYNLES

SEQ ID NO: 648727 - protein, 9 aa, Homo Sapiens
PAPSSAWWG

SEQ ID NO: 648728 - protein, 9 aa, Homo Sapiens
LSAVSAFEI

SEQ ID NO: 648729 - protein, 9 aa, Homo Sapiens
HSAGDAPLL

SEQ ID NO: 648730 - protein, 9 aa, Homo Sapiens
LSQCSSISQ

SEQ ID NO: 648731 - protein, 9 aa, Homo Sapiens
RTVKGTLGN

SEQ ID NO: 648732 - protein, 9 aa, Homo Sapiens
NYGPHSCQH

SEQ ID NO: 648733 - protein, 9 aa, Homo Sapiens
DAPGQPYRA

SEQ ID NO: 648734 - protein, 9 aa, Homo Sapiens
HTGIKEVLD

SEQ ID NO: 648735 - protein, 9 aa, Homo Sapiens
VSSLSSEST

SEQ ID NO: 648736 - protein, 9 aa, Homo Sapiens
VCVSEQEQA

SEQ ID NO: 648737 - protein, 9 aa, Homo Sapiens
SGNHVSNCW

SEQ ID NO: 648738 - protein, 9 aa, Homo Sapiens
RLSRDPDVG

SEQ ID NO: 648739 - protein, 9 aa, Homo Sapiens
MSPAPQAPL

SEQ ID NO: 648740 - protein, 9 aa, Homo Sapiens
AVGVEPHFL

SEQ ID NO: 648741 - protein, 9 aa, Homo Sapiens
TMFDQNLLI

SEQ ID NO: 648742 - protein, 9 aa, Homo Sapiens
TCLFSASLG

SEQ ID NO: 648743 - protein, 9 aa, Homo Sapiens
EATLEERHE

SEQ ID NO: 648744 - protein, 9 aa, Homo Sapiens
GLESEPYIF

SEQ ID NO: 648745 - protein, 9 aa, Homo Sapiens
EGVGETITE

SEQ ID NO: 648746 - protein, 9 aa, Homo Sapiens
YPGAVTVAC

SEQ ID NO: 648747 - protein, 9 aa, Homo Sapiens
HHKSRKEHR

SEQ ID NO: 648748 - protein, 9 aa, Homo Sapiens
NKFYMSYHL

SEQ ID NO: 648749 - protein, 9 aa, Homo Sapiens
TIKSLRLLR

SEQ ID NO: 648750 - protein, 9 aa, Homo Sapiens
DDTKITLHL

SEQ ID NO: 648751 - protein, 9 aa, Homo Sapiens
NWRSGWDWS

SEQ ID NO: 648752 - protein, 9 aa, Homo Sapiens
VEKTRRAIW

SEQ ID NO: 648753 - protein, 9 aa, Homo Sapiens
DKENGPSAR

SEQ ID NO: 648754 - protein, 9 aa, Homo Sapiens
GLGDYVPGD

SEQ ID NO: 648755 - protein, 9 aa, Homo Sapiens
GSSRSPVRT

SEQ ID NO: 648756 - protein, 9 aa, Homo Sapiens
GGGPGHGSG

SEQ ID NO: 648757 - protein, 9 aa, Homo Sapiens
EDWLHLVTM

SEQ ID NO: 648758 - protein, 9 aa, Homo Sapiens
QAGPEIMDE

SEQ ID NO: 648759 - protein, 9 aa, Homo Sapiens
LFSYFALIG

SEQ ID NO: 648760 - protein, 9 aa, Homo Sapiens
SRLQYLSIA

SEQ ID NO: 648761 - protein, 9 aa, Homo Sapiens
DITSASMSI

SEQ ID NO: 648762 - protein, 9 aa, Homo Sapiens
VGASQRTAA

SEQ ID NO: 648763 - protein, 9 aa, Homo Sapiens
ACKADGSPV

SEQ ID NO: 648764 - protein, 9 aa, Homo Sapiens
DNINAGQQG

SEQ ID NO: 648765 - protein, 9 aa, Homo Sapiens
SGTSRKLSV

SEQ ID NO: 648766 - protein, 9 aa, Homo Sapiens
NDTWFFMNL

SEQ ID NO: 648767 - protein, 9 aa, Homo Sapiens
INQTLTDLF

SEQ ID NO: 648768 - protein, 9 aa, Homo Sapiens
AKIFAARIH

SEQ ID NO: 648769 - protein, 9 aa, Homo Sapiens
AGLPKASAT

SEQ ID NO: 648770 - protein, 9 aa, Homo Sapiens
ASGEKQPLA

SEQ ID NO: 648771 - protein, 9 aa, Homo Sapiens
VIARQRLAG

SEQ ID NO: 648772 - protein, 9 aa, Homo Sapiens
KSLSNSLHP

SEQ ID NO: 648773 - protein, 9 aa, Homo Sapiens
EFFKKEPLS

SEQ ID NO: 648774 - protein, 9 aa, Homo Sapiens
LPQENREAA

SEQ ID NO: 648775 - protein, 9 aa, Homo Sapiens
AVGVGKSAL

SEQ ID NO: 648776 - protein, 9 aa, Homo Sapiens
CRKGSKAYG

SEQ ID NO: 648777 - protein, 9 aa, Homo Sapiens
LAANDFFGR

SEQ ID NO: 648778 - protein, 9 aa, Homo Sapiens
RRRRLWYAT

SEQ ID NO: 648779 - protein, 9 aa, Homo Sapiens
HSMVNSLPT

SEQ ID NO: 648780 - protein, 9 aa, Homo Sapiens
FSPCCQPTC

SEQ ID NO: 648781 - protein, 9 aa, Homo Sapiens
WSSRGSESH

SEQ ID NO: 648782 - protein, 9 aa, Homo Sapiens
HAPPYWAQP

SEQ ID NO: 648783 - protein, 9 aa, Homo Sapiens
SGKGSFFQP

SEQ ID NO: 648784 - protein, 9 aa, Homo Sapiens
VRGRARLIA

SEQ ID NO: 648785 - protein, 9 aa, Homo Sapiens
PAYKGQILK

SEQ ID NO: 648786 - protein, 9 aa, Homo Sapiens
VVSSTRAVN

SEQ ID NO: 648787 - protein, 9 aa, Homo Sapiens
LVENVDLID

SEQ ID NO: 648788 - protein, 9 aa, Homo Sapiens
QAAGKLVLN

SEQ ID NO: 648789 - protein, 9 aa, Homo Sapiens
ELAAFFFKT

SEQ ID NO: 648790 - protein, 9 aa, Homo Sapiens
VEPSLRKLV

SEQ ID NO: 648791 - protein, 9 aa, Homo Sapiens
MFDQNLLIL

SEQ ID NO: 648792 - protein, 9 aa, Homo Sapiens
LLKNFLLYR

SEQ ID NO: 648793 - protein, 9 aa, Homo Sapiens
NWKPVTVMF

SEQ ID NO: 648794 - protein, 9 aa, Homo Sapiens
LPGWSRTPD

SEQ ID NO: 648795 - protein, 9 aa, Homo Sapiens
KEPELAAFF

SEQ ID NO: 648796 - protein, 9 aa, Homo Sapiens
KAKPSAAGA

SEQ ID NO: 648797 - protein, 9 aa, Homo Sapiens
SPSAGLPKA

SEQ ID NO: 648798 - protein, 9 aa, Homo Sapiens
NLVECDKEF

SEQ ID NO: 648799 - protein, 9 aa, Homo Sapiens
SIYKLTAAV

SEQ ID NO: 648800 - protein, 9 aa, Homo Sapiens
PSAAGAQHE

SEQ ID NO: 648801 - protein, 9 aa, Homo Sapiens
VDGRGNLNA

SEQ ID NO: 648802 - protein, 9 aa, Homo Sapiens
ATNELLERE

SEQ ID NO: 648803 - protein, 9 aa, Homo Sapiens
LPSPRISCR

SEQ ID NO: 648804 - protein, 9 aa, Homo Sapiens
PLLEGGTCL

SEQ ID NO: 648805 - protein, 9 aa, Homo Sapiens
ANALHSLLG

SEQ ID NO: 648806 - protein, 9 aa, Homo Sapiens
HQHIPVVPA

SEQ ID NO: 648807 - protein, 9 aa, Homo Sapiens
IFATIVGIV

SEQ ID NO: 648808 - protein, 9 aa, Homo Sapiens
CKADGSPVK

SEQ ID NO: 648809 - protein, 9 aa, Homo Sapiens
PAQVKKQST

SEQ ID NO: 648810 - protein, 9 aa, Homo Sapiens
SVMIKDYSG

SEQ ID NO: 648811 - protein, 9 aa, Homo Sapiens
IGGDLVENV

SEQ ID NO: 648812 - protein, 9 aa, Homo Sapiens
ATLEERHER

SEQ ID NO: 648813 - protein, 9 aa, Homo Sapiens
EAGGGPGSA

SEQ ID NO: 648814 - protein, 9 aa, Homo Sapiens
LSPSMSPAP

SEQ ID NO: 648815 - protein, 9 aa, Homo Sapiens
EAAQVHGVM

SEQ ID NO: 648816 - protein, 9 aa, Homo Sapiens
SNNGMQRIL

SEQ ID NO: 648817 - protein, 9 aa, Homo Sapiens
SQGTEHSGL

SEQ ID NO: 648818 - protein, 9 aa, Homo Sapiens
ISCRKGSKA

SEQ ID NO: 648819 - protein, 9 aa, Homo Sapiens
RRFHHRARC

SEQ ID NO: 648820 - protein, 9 aa, Homo Sapiens
SKPTTRDCA

SEQ ID NO: 648821 - protein, 9 aa, Homo Sapiens
AAVMHYGNM

SEQ ID NO: 648822 - protein, 9 aa, Homo Sapiens
NASPGASTH

SEQ ID NO: 648823 - protein, 9 aa, Homo Sapiens
SPAPQAPLL

SEQ ID NO: 648824 - protein, 9 aa, Homo Sapiens
ASQRTAAPE

SEQ ID NO: 648825 - protein, 9 aa, Homo Sapiens
GAGLESEPY

SEQ ID NO: 648826 - protein, 9 aa, Homo Sapiens
IERLASEGA

SEQ ID NO: 648827 - protein, 9 aa, Homo Sapiens
QQESATTHK

SEQ ID NO: 648828 - protein, 9 aa, Homo Sapiens
HQEEVAYGL

SEQ ID NO: 648829 - protein, 9 aa, Homo Sapiens
GGRGPGRGL

SEQ ID NO: 648830 - protein, 9 aa, Homo Sapiens
SLNGSEVSA

SEQ ID NO: 648831 - protein, 9 aa, Homo Sapiens
GDTPAPSSA

SEQ ID NO: 648832 - protein, 9 aa, Homo Sapiens
RNTVLDEAN

SEQ ID NO: 648833 - protein, 9 aa, Homo Sapiens
MQGPATDAG

SEQ ID NO: 648834 - protein, 9 aa, Homo Sapiens
RDEPPSVPT

SEQ ID NO: 648835 - protein, 9 aa, Homo Sapiens
LPQIAAVAM

SEQ ID NO: 648836 - protein, 9 aa, Homo Sapiens
VEYGVLMAM

SEQ ID NO: 648837 - protein, 9 aa, Homo Sapiens
AIWVFFMLR

SEQ ID NO: 648838 - protein, 9 aa, Homo Sapiens
HASFISCPP

SEQ ID NO: 648839 - protein, 9 aa, Homo Sapiens
STHDSLSDY

SEQ ID NO: 648840 - protein, 9 aa, Homo Sapiens
YKCNECVKV

SEQ ID NO: 648841 - protein, 9 aa, Homo Sapiens
VACKADGSP

SEQ ID NO: 648842 - protein, 9 aa, Homo Sapiens
AVAVLSVHG

SEQ ID NO: 648843 - protein, 9 aa, Homo Sapiens
HSRNRHQEE

SEQ ID NO: 648844 - protein, 9 aa, Homo Sapiens
LRNKLRGVL

SEQ ID NO: 648845 - protein, 9 aa, Homo Sapiens
GKKSGTSRK

SEQ ID NO: 648846 - protein, 9 aa, Homo Sapiens
KSETSQENY

SEQ ID NO: 648847 - protein, 9 aa, Homo Sapiens
AGKLVLNDK

SEQ ID NO: 648848 - protein, 9 aa, Homo Sapiens
PGHGSGGGR

SEQ ID NO: 648849 - protein, 9 aa, Homo Sapiens
RYAKRENWK

SEQ ID NO: 648850 - protein, 9 aa, Homo Sapiens
VLDDPTSGV

SEQ ID NO: 648851 - protein, 9 aa, Homo Sapiens
RSNNGMQRI

SEQ ID NO: 648852 - protein, 9 aa, Homo Sapiens
LIFATIVGI

SEQ ID NO: 648853 - protein, 9 aa, Homo Sapiens
LRRSPGEAL

SEQ ID NO: 648854 - protein, 9 aa, Homo Sapiens
PWLCQSSEP

SEQ ID NO: 648855 - protein, 9 aa, Homo Sapiens
LNGSEVSAS

SEQ ID NO: 648856 - protein, 9 aa, Homo Sapiens
TLSQPQQNQ

SEQ ID NO: 648857 - protein, 9 aa, Homo Sapiens
SSVEYGVLM

SEQ ID NO: 648858 - protein, 9 aa, Homo Sapiens
VDLPQENRE

SEQ ID NO: 648859 - protein, 9 aa, Homo Sapiens
YKGQILKMA

SEQ ID NO: 648860 - protein, 9 aa, Homo Sapiens
PATTLSQPQ

SEQ ID NO: 648861 - protein, 9 aa, Homo Sapiens
APQAPLLEG

SEQ ID NO: 648862 - protein, 9 aa, Homo Sapiens
FITPGALKG

SEQ ID NO: 648863 - protein, 9 aa, Homo Sapiens
PCRSAMPHA

SEQ ID NO: 648864 - protein, 9 aa, Homo Sapiens
AAGAQHEAE

SEQ ID NO: 648865 - protein, 9 aa, Homo Sapiens
ESVVSSTRA

SEQ ID NO: 648866 - protein, 9 aa, Homo Sapiens
ESRLQYLSI

SEQ ID NO: 648867 - protein, 9 aa, Homo Sapiens
HNLINKVDK

SEQ ID NO: 648868 - protein, 9 aa, Homo Sapiens
KLVVVGAVG

SEQ ID NO: 648869 - protein, 9 aa, Homo Sapiens
RKEHRKHKK

SEQ ID NO: 648870 - protein, 9 aa, Homo Sapiens
LATPLAKKL

SEQ ID NO: 648871 - protein, 9 aa, Homo Sapiens
LVLNDKLLP

SEQ ID NO: 648872 - protein, 9 aa, Homo Sapiens
YRLWCTGYI

SEQ ID NO: 648873 - protein, 9 aa, Homo Sapiens
FLLRLEHLL

SEQ ID NO: 648874 - protein, 9 aa, Homo Sapiens
IHFGATTTA

SEQ ID NO: 648875 - protein, 9 aa, Homo Sapiens
TVHLWAQKG

SEQ ID NO: 648876 - protein, 9 aa, Homo Sapiens
VLNDKLLPK

SEQ ID NO: 648877 - protein, 9 aa, Homo Sapiens
SGGGGCGGD

SEQ ID NO: 648878 - protein, 9 aa, Homo Sapiens
APAEVLKGL

SEQ ID NO: 648879 - protein, 9 aa, Homo Sapiens
RVRGRARLI

SEQ ID NO: 648880 - protein, 9 aa, Homo Sapiens
PFTPQFSFS

SEQ ID NO: 648881 - protein, 9 aa, Homo Sapiens
KMKGKKKYN

SEQ ID NO: 648882 - protein, 9 aa, Homo Sapiens
TWPAEGSAQ

SEQ ID NO: 648883 - protein, 9 aa, Homo Sapiens
SVVSSTRAV

SEQ ID NO: 648884 - protein, 9 aa, Homo Sapiens
DINDTWFFM

SEQ ID NO: 648885 - protein, 9 aa, Homo Sapiens
DLVENVDLI

SEQ ID NO: 648886 - protein, 9 aa, Homo Sapiens
AVAAPPAAR

SEQ ID NO: 648887 - protein, 9 aa, Homo Sapiens
ALAGPVGAS

SEQ ID NO: 648888 - protein, 9 aa, Homo Sapiens
SRVDGRGNL

SEQ ID NO: 648889 - protein, 9 aa, Homo Sapiens
GTNGVVERM

SEQ ID NO: 648890 - protein, 9 aa, Homo Sapiens
HKPRVNMFP

SEQ ID NO: 648891 - protein, 9 aa, Homo Sapiens
MSAIFVHGV

SEQ ID NO: 648892 - protein, 9 aa, Homo Sapiens
GIRAPSGLG

SEQ ID NO: 648893 - protein, 9 aa, Homo Sapiens
GPHSCQHMG

SEQ ID NO: 648894 - protein, 9 aa, Homo Sapiens
IPYKCEECH

SEQ ID NO: 648895 - protein, 9 aa, Homo Sapiens
QPQEAGQAA

SEQ ID NO: 648896 - protein, 9 aa, Homo Sapiens
GVMDPAPAS

SEQ ID NO: 648897 - protein, 9 aa, Homo Sapiens
EEACGSQES

SEQ ID NO: 648898 - protein, 9 aa, Homo Sapiens
LAPFVDSSA

SEQ ID NO: 648899 - protein, 9 aa, Homo Sapiens
LTTVHRPIP

SEQ ID NO: 648900 - protein, 9 aa, Homo Sapiens
STKDLSRVF

SEQ ID NO: 648901 - protein, 9 aa, Homo Sapiens
FFFKTAVVL

SEQ ID NO: 648902 - protein, 9 aa, Homo Sapiens
LASEGAITV

SEQ ID NO: 648903 - protein, 9 aa, Homo Sapiens
VIASFTFQP

SEQ ID NO: 648904 - protein, 9 aa, Homo Sapiens
ITAGRRRRL

SEQ ID NO: 648905 - protein, 9 aa, Homo Sapiens
YINDTHFYP

SEQ ID NO: 648906 - protein, 9 aa, Homo Sapiens
GAVTVACKA

SEQ ID NO: 648907 - protein, 9 aa, Homo Sapiens
AADGQDGGG

SEQ ID NO: 648908 - protein, 9 aa, Homo Sapiens
TSFSVADTV

SEQ ID NO: 648909 - protein, 9 aa, Homo Sapiens
HRSQPQRAE

SEQ ID NO: 648910 - protein, 9 aa, Homo Sapiens
APATTLSQP

SEQ ID NO: 648911 - protein, 9 aa, Homo Sapiens
EVLQDSQDR

SEQ ID NO: 648912 - protein, 9 aa, Homo Sapiens
YIIPIGSDY

SEQ ID NO: 648913 - protein, 9 aa, Homo Sapiens
ALKLLQKRI

SEQ ID NO: 648914 - protein, 9 aa, Homo Sapiens
DEAGGGPGS

SEQ ID NO: 648915 - protein, 9 aa, Homo Sapiens
ATGVLLSLN

SEQ ID NO: 648916 - protein, 9 aa, Homo Sapiens
GRGLPGAAT

SEQ ID NO: 648917 - protein, 9 aa, Homo Sapiens
GLHSKISSL

SEQ ID NO: 648918 - protein, 9 aa, Homo Sapiens
ERESTAQYN

SEQ ID NO: 648919 - protein, 9 aa, Homo Sapiens
SAEEACGSQ

SEQ ID NO: 648920 - protein, 9 aa, Homo Sapiens
TCCRCELGL

SEQ ID NO: 648921 - protein, 9 aa, Homo Sapiens
NAGQQGLSV

SEQ ID NO: 648922 - protein, 9 aa, Homo Sapiens
SRYLMLLVF

SEQ ID NO: 648923 - protein, 9 aa, Homo Sapiens
FNWSSHLSQ

SEQ ID NO: 648924 - protein, 9 aa, Homo Sapiens
TSASMSIPE

SEQ ID NO: 648925 - protein, 9 aa, Homo Sapiens
HLESHNLIN

SEQ ID NO: 648926 - protein, 9 aa, Homo Sapiens
THCFSPCCQ

SEQ ID NO: 648927 - protein, 9 aa, Homo Sapiens
TIVGIVGSM

SEQ ID NO: 648928 - protein, 9 aa, Homo Sapiens
QLYLRKSLS

SEQ ID NO: 648929 - protein, 9 aa, Homo Sapiens
MEELDEIRE

SEQ ID NO: 648930 - protein, 9 aa, Homo Sapiens
VVERMSVIW

SEQ ID NO: 648931 - protein, 9 aa, Homo Sapiens
EHSRNRHQE

SEQ ID NO: 648932 - protein, 9 aa, Homo Sapiens
VAMPRISSP

SEQ ID NO: 648933 - protein, 9 aa, Homo Sapiens
PIGSDYVTL

SEQ ID NO: 648934 - protein, 9 aa, Homo Sapiens
GEKQPLADP

SEQ ID NO: 648935 - protein, 9 aa, Homo Sapiens
PEVLQDSQD

SEQ ID NO: 648936 - protein, 9 aa, Homo Sapiens
NVDLIDKFV

SEQ ID NO: 648937 - protein, 9 aa, Homo Sapiens
NSVMIKDYS

SEQ ID NO: 648938 - protein, 9 aa, Homo Sapiens
SPRISCRKG

SEQ ID NO: 648939 - protein, 9 aa, Homo Sapiens
QIPAAASVS

SEQ ID NO: 648940 - protein, 9 aa, Homo Sapiens
IQHRAFAKN

SEQ ID NO: 648941 - protein, 9 aa, Homo Sapiens
DAEYEADRD

SEQ ID NO: 648942 - protein, 9 aa, Homo Sapiens
NSQLRPIMS

SEQ ID NO: 648943 - protein, 9 aa, Homo Sapiens
GAQDPTNLS

SEQ ID NO: 648944 - protein, 9 aa, Homo Sapiens
HSSRRIRCN

SEQ ID NO: 648945 - protein, 9 aa, Homo Sapiens
PSLPSSPSA

SEQ ID NO: 648946 - protein, 9 aa, Homo Sapiens
ERSNNGMQR

SEQ ID NO: 648947 - protein, 9 aa, Homo Sapiens
RAESPAGRF

SEQ ID NO: 648948 - protein, 9 aa, Homo Sapiens
VHRPIPPSR

SEQ ID NO: 648949 - protein, 9 aa, Homo Sapiens
EAAKALLNM

SEQ ID NO: 648950 - protein, 9 aa, Homo Sapiens
INNVSVSGQ

SEQ ID NO: 648951 - protein, 9 aa, Homo Sapiens
SGNRANILL

SEQ ID NO: 648952 - protein, 9 aa, Homo Sapiens
QGTEHSGLA

SEQ ID NO: 648953 - protein, 9 aa, Homo Sapiens
KCPKPAAHE

SEQ ID NO: 648954 - protein, 9 aa, Homo Sapiens
HLTTVHRPI

SEQ ID NO: 648955 - protein, 9 aa, Homo Sapiens
QRQRAKRNT

SEQ ID NO: 648956 - protein, 9 aa, Homo Sapiens
LSLLYRSRY

SEQ ID NO: 648957 - protein, 9 aa, Homo Sapiens
KPSAAGAQH

SEQ ID NO: 648958 - protein, 9 aa, Homo Sapiens
EVQWQLAQL

SEQ ID NO: 648959 - protein, 9 aa, Homo Sapiens
CLRLLLWPC

SEQ ID NO: 648960 - protein, 9 aa, Homo Sapiens
QLSLKPLLV

SEQ ID NO: 648961 - protein, 9 aa, Homo Sapiens
ERLASEGAI

SEQ ID NO: 648962 - protein, 9 aa, Homo Sapiens
AEKAKPSAA

SEQ ID NO: 648963 - protein, 9 aa, Homo Sapiens
DPTSGVDPC

SEQ ID NO: 648964 - protein, 9 aa, Homo Sapiens
KFRMSIVDS

SEQ ID NO: 648965 - protein, 9 aa, Homo Sapiens
PGVEYTVHL

SEQ ID NO: 648966 - protein, 9 aa, Homo Sapiens
LLLWPCPGS

SEQ ID NO: 648967 - protein, 9 aa, Homo Sapiens
YVPGDAPGQ

SEQ ID NO: 648968 - protein, 9 aa, Homo Sapiens
YKLVVVGAV

SEQ ID NO: 648969 - protein, 9 aa, Homo Sapiens
TDAACHEAT

SEQ ID NO: 648970 - protein, 9 aa, Homo Sapiens
TTQVKGQAE

SEQ ID NO: 648971 - protein, 9 aa, Homo Sapiens
AAPPAARSH

SEQ ID NO: 648972 - protein, 9 aa, Homo Sapiens
VLKGLGGGF

SEQ ID NO: 648973 - protein, 9 aa, Homo Sapiens
KDNINAGQQ

SEQ ID NO: 648974 - protein, 9 aa, Homo Sapiens
ASWTGNPLA

SEQ ID NO: 648975 - protein, 9 aa, Homo Sapiens
PSTAVKVRK

SEQ ID NO: 648976 - protein, 9 aa, Homo Sapiens
MVGSALYVS

SEQ ID NO: 648977 - protein, 9 aa, Homo Sapiens
NEEVISKCD

SEQ ID NO: 648978 - protein, 9 aa, Homo Sapiens
SPLENQLQV

SEQ ID NO: 648979 - protein, 9 aa, Homo Sapiens
HSRSPDPSP

SEQ ID NO: 648980 - protein, 9 aa, Homo Sapiens
HSKGERHGS

SEQ ID NO: 648981 - protein, 9 aa, Homo Sapiens
TLCETGYGQ

SEQ ID NO: 648982 - protein, 9 aa, Homo Sapiens
SLLQSASRQ

SEQ ID NO: 648983 - protein, 9 aa, Homo Sapiens
HRLSAEEIG

SEQ ID NO: 648984 - protein, 9 aa, Homo Sapiens
SVHLLVDVP

SEQ ID NO: 648985 - protein, 9 aa, Homo Sapiens
GAATEYGGA

SEQ ID NO: 648986 - protein, 9 aa, Homo Sapiens
NDGVGTAVK

SEQ ID NO: 648987 - protein, 9 aa, Homo Sapiens
LLLEPLKLH

SEQ ID NO: 648988 - protein, 9 aa, Homo Sapiens
RQGRTLYDF

SEQ ID NO: 648989 - protein, 9 aa, Homo Sapiens
IEKLASRAV

SEQ ID NO: 648990 - protein, 9 aa, Homo Sapiens
YRREKQKNE

SEQ ID NO: 648991 - protein, 9 aa, Homo Sapiens
PIDNIDELD

SEQ ID NO: 648992 - protein, 9 aa, Homo Sapiens
PLQSLVSSF

SEQ ID NO: 648993 - protein, 9 aa, Homo Sapiens
YLMGGRKFD

SEQ ID NO: 648994 - protein, 9 aa, Homo Sapiens
IKPGYLLLT

SEQ ID NO: 648995 - protein, 9 aa, Homo Sapiens
LLSGLLVLV

SEQ ID NO: 648996 - protein, 9 aa, Homo Sapiens
IIFVLLLSA

SEQ ID NO: 648997 - protein, 9 aa, Homo Sapiens
RYIENPYLM

SEQ ID NO: 648998 - protein, 9 aa, Homo Sapiens
LRRVLQSPL

SEQ ID NO: 648999 - protein, 9 aa, Homo Sapiens
AVKSGQENR

SEQ ID NO: 649000 - protein, 9 aa, Homo Sapiens
IPLRTVSES

SEQ ID NO: 649001 - protein, 9 aa, Homo Sapiens
NLGKVDIFL

SEQ ID NO: 649002 - protein, 9 aa, Homo Sapiens
VLKRMGMSC

SEQ ID NO: 649003 - protein, 9 aa, Homo Sapiens
EEVISKCDQ

SEQ ID NO: 649004 - protein, 9 aa, Homo Sapiens
VGACGVGKS

SEQ ID NO: 649005 - protein, 9 aa, Homo Sapiens
AQAGTQESG

SEQ ID NO: 649006 - protein, 9 aa, Homo Sapiens
LFRNRTPNG

SEQ ID NO: 649007 - protein, 9 aa, Homo Sapiens
LIPLRTVSE

SEQ ID NO: 649008 - protein, 9 aa, Homo Sapiens
VIRYTASWH

SEQ ID NO: 649009 - protein, 9 aa, Homo Sapiens
PILTLPKGA

SEQ ID NO: 649010 - protein, 9 aa, Homo Sapiens
EREQLRHPP

SEQ ID NO: 649011 - protein, 9 aa, Homo Sapiens
NVNPPQQGE

SEQ ID NO: 649012 - protein, 9 aa, Homo Sapiens
LQSASRQLQ

SEQ ID NO: 649013 - protein, 9 aa, Homo Sapiens
SPAWKHFLS

SEQ ID NO: 649014 - protein, 9 aa, Homo Sapiens
EIFGKVLQC

SEQ ID NO: 649015 - protein, 9 aa, Homo Sapiens
FGKVLQCDE

SEQ ID NO: 649016 - protein, 9 aa, Homo Sapiens
RTPNGPMSK

SEQ ID NO: 649017 - protein, 9 aa, Homo Sapiens
IQYDHESCG

SEQ ID NO: 649018 - protein, 9 aa, Homo Sapiens
QEHCQISSQ

SEQ ID NO: 649019 - protein, 9 aa, Homo Sapiens
CETGYGQIR

SEQ ID NO: 649020 - protein, 9 aa, Homo Sapiens
AGRPAGSVH

SEQ ID NO: 649021 - protein, 9 aa, Homo Sapiens
TGMVGSALY

SEQ ID NO: 649022 - protein, 9 aa, Homo Sapiens
GGPQSDSDS

SEQ ID NO: 649023 - protein, 9 aa, Homo Sapiens
NKKLMKKLH

SEQ ID NO: 649024 - protein, 9 aa, Homo Sapiens
PQSDSDSDA

SEQ ID NO: 649025 - protein, 9 aa, Homo Sapiens
EVFLSMGIV

SEQ ID NO: 649026 - protein, 9 aa, Homo Sapiens
EKQKNEALR

SEQ ID NO: 649027 - protein, 9 aa, Homo Sapiens
GKVDIFLKD

SEQ ID NO: 649028 - protein, 9 aa, Homo Sapiens
QNAQSSYES

SEQ ID NO: 649029 - protein, 9 aa, Homo Sapiens
MKINETIED

SEQ ID NO: 649030 - protein, 9 aa, Homo Sapiens
SYAFKKHSK

SEQ ID NO: 649031 - protein, 9 aa, Homo Sapiens
NKTPHNSFI

SEQ ID NO: 649032 - protein, 9 aa, Homo Sapiens
TASWHMVFF

SEQ ID NO: 649033 - protein, 9 aa, Homo Sapiens
SDSAVMDDS

SEQ ID NO: 649034 - protein, 9 aa, Homo Sapiens
PSTFIHLRR

SEQ ID NO: 649035 - protein, 9 aa, Homo Sapiens
NFNMVNSLI

SEQ ID NO: 649036 - protein, 9 aa, Homo Sapiens
GPGRPELIP

SEQ ID NO: 649037 - protein, 9 aa, Homo Sapiens
LPAITDVPM

SEQ ID NO: 649038 - protein, 9 aa, Homo Sapiens
KRQGRTLYD

SEQ ID NO: 649039 - protein, 9 aa, Homo Sapiens
KLPSTFIHL

SEQ ID NO: 649040 - protein, 9 aa, Homo Sapiens
YWPIDNIDE

SEQ ID NO: 649041 - protein, 9 aa, Homo Sapiens
ATASWTGNP

SEQ ID NO: 649042 - protein, 9 aa, Homo Sapiens
KQNAQSSYE

SEQ ID NO: 649043 - protein, 9 aa, Homo Sapiens
QLQVLPILT

SEQ ID NO: 649044 - protein, 9 aa, Homo Sapiens
PVVWLLSGL

SEQ ID NO: 649045 - protein, 9 aa, Homo Sapiens
LSDSAVMDD

SEQ ID NO: 649046 - protein, 9 aa, Homo Sapiens
GTYVPLGFP

SEQ ID NO: 649047 - protein, 9 aa, Homo Sapiens
TLPKGAHEE

SEQ ID NO: 649048 - protein, 9 aa, Homo Sapiens
IFLKDVQPG

SEQ ID NO: 649049 - protein, 9 aa, Homo Sapiens
DPALRAPEF

SEQ ID NO: 649050 - protein, 9 aa, Homo Sapiens
IHCKARKGR

SEQ ID NO: 649051 - protein, 9 aa, Homo Sapiens
TSKIEKLAS

SEQ ID NO: 649052 - protein, 9 aa, Homo Sapiens
KEPQQDNPS

SEQ ID NO: 649053 - protein, 9 aa, Homo Sapiens
KGAHEEVND

SEQ ID NO: 649054 - protein, 9 aa, Homo Sapiens
RPGDEVLEL

SEQ ID NO: 649055 - protein, 9 aa, Homo Sapiens
AIVSISALS

SEQ ID NO: 649056 - protein, 9 aa, Homo Sapiens
VDNMLEPSP

SEQ ID NO: 649057 - protein, 9 aa, Homo Sapiens
FVLLLSAIV

SEQ ID NO: 649058 - protein, 9 aa, Homo Sapiens
HLTGMVGSA

SEQ ID NO: 649059 - protein, 9 aa, Homo Sapiens
AIHCKARKG

SEQ ID NO: 649060 - protein, 9 aa, Homo Sapiens
QVLPILTLP

SEQ ID NO: 649061 - protein, 9 aa, Homo Sapiens
HKGSFKDNP

SEQ ID NO: 649062 - protein, 9 aa, Homo Sapiens
VGTAVKSGQ

SEQ ID NO: 649063 - protein, 9 aa, Homo Sapiens
PGYLLLTTG

SEQ ID NO: 649064 - protein, 9 aa, Homo Sapiens
RWHGIFIPV

SEQ ID NO: 649065 - protein, 9 aa, Homo Sapiens
AEEIGLVAQ

SEQ ID NO: 649066 - protein, 9 aa, Homo Sapiens
YVPLGFPHP

SEQ ID NO: 649067 - protein, 9 aa, Homo Sapiens
NVNVRSLSG

SEQ ID NO: 649068 - protein, 9 aa, Homo Sapiens
KLVVVGACG

SEQ ID NO: 649069 - protein, 9 aa, Homo Sapiens
KVLQCDEYE

SEQ ID NO: 649070 - protein, 9 aa, Homo Sapiens
KGQGRLFLS

SEQ ID NO: 649071 - protein, 9 aa, Homo Sapiens
TFIHLRRVL

SEQ ID NO: 649072 - protein, 9 aa, Homo Sapiens
FISLLDYQL

SEQ ID NO: 649073 - protein, 9 aa, Homo Sapiens
LSHASYLSD

SEQ ID NO: 649074 - protein, 9 aa, Homo Sapiens
LKDVQPGSV

SEQ ID NO: 649075 - protein, 9 aa, Homo Sapiens
EEASELSEV

SEQ ID NO: 649076 - protein, 9 aa, Homo Sapiens
IRYTASWHM

SEQ ID NO: 649077 - protein, 9 aa, Homo Sapiens
LPKGAHEEV

SEQ ID NO: 649078 - protein, 9 aa, Homo Sapiens
FLKDVQPGS

SEQ ID NO: 649079 - protein, 9 aa, Homo Sapiens
RKGRTGIMI

SEQ ID NO: 649080 - protein, 9 aa, Homo Sapiens
GACGVGKSA

SEQ ID NO: 649081 - protein, 9 aa, Homo Sapiens
DGASANTTV

SEQ ID NO: 649082 - protein, 9 aa, Homo Sapiens
KRMGMSCGL

SEQ ID NO: 649083 - protein, 9 aa, Homo Sapiens
RYTASWHMV

SEQ ID NO: 649084 - protein, 9 aa, Homo Sapiens
AHEEVNDGV

SEQ ID NO: 649085 - protein, 9 aa, Homo Sapiens
GFSFTTTVM

SEQ ID NO: 649086 - protein, 9 aa, Homo Sapiens
LASPWPDGD

SEQ ID NO: 649087 - protein, 9 aa, Homo Sapiens
AFWVWGGED

SEQ ID NO: 649088 - protein, 9 aa, Homo Sapiens
SLPETALKQ

SEQ ID NO: 649089 - protein, 9 aa, Homo Sapiens
SFKDNPQLY

SEQ ID NO: 649090 - protein, 9 aa, Homo Sapiens
HVDNMLEPS

SEQ ID NO: 649091 - protein, 9 aa, Homo Sapiens
TEEASELSE

SEQ ID NO: 649092 - protein, 9 aa, Homo Sapiens
SLPLLLLLG

SEQ ID NO: 649093 - protein, 9 aa, Homo Sapiens
LKDGIQYDH

SEQ ID NO: 649094 - protein, 9 aa, Homo Sapiens
EKKEQETSY

SEQ ID NO: 649095 - protein, 9 aa, Homo Sapiens
KDNPQLYQE

SEQ ID NO: 649096 - protein, 9 aa, Homo Sapiens
ATAALGGAD

SEQ ID NO: 649097 - protein, 9 aa, Homo Sapiens
LELNGRLLQ

SEQ ID NO: 649098 - protein, 9 aa, Homo Sapiens
GRPELIPLR

SEQ ID NO: 649099 - protein, 9 aa, Homo Sapiens
NMIPQDNVN

SEQ ID NO: 649100 - protein, 9 aa, Homo Sapiens
LDYQLHNLI

SEQ ID NO: 649101 - protein, 9 aa, Homo Sapiens
TVYRWHGIF

SEQ ID NO: 649102 - protein, 9 aa, Homo Sapiens
TNNGKLLLE

SEQ ID NO: 649103 - protein, 9 aa, Homo Sapiens
VNDGVGTAV

SEQ ID NO: 649104 - protein, 9 aa, Homo Sapiens
IKPEVFLSM

SEQ ID NO: 649105 - protein, 9 aa, Homo Sapiens
ARKGRTGIM

SEQ ID NO: 649106 - protein, 9 aa, Homo Sapiens
PAGSVHLLV

SEQ ID NO: 649107 - protein, 9 aa, Homo Sapiens
AVKVRKPSP

SEQ ID NO: 649108 - protein, 9 aa, Homo Sapiens
TQESGPEEY

SEQ ID NO: 649109 - protein, 9 aa, Homo Sapiens
AAAATAALG

SEQ ID NO: 649110 - protein, 9 aa, Homo Sapiens
ELSEVPAAA

SEQ ID NO: 649111 - protein, 9 aa, Homo Sapiens
FNMVNSLIY

SEQ ID NO: 649112 - protein, 9 aa, Homo Sapiens
ENPYLMGGR

SEQ ID NO: 649113 - protein, 9 aa, Homo Sapiens
KINETIEDM

SEQ ID NO: 649114 - protein, 9 aa, Homo Sapiens
SATASWTGN

SEQ ID NO: 649115 - protein, 9 aa, Homo Sapiens
EEVNDGVGT

SEQ ID NO: 649116 - protein, 9 aa, Homo Sapiens
SNKTPHNSF

SEQ ID NO: 649117 - protein, 9 aa, Homo Sapiens
PEVFLSMGI

SEQ ID NO: 649118 - protein, 9 aa, Homo Sapiens
TPHNSFINH

SEQ ID NO: 649119 - protein, 9 aa, Homo Sapiens
PYSSTVSEH

SEQ ID NO: 649120 - protein, 9 aa, Homo Sapiens
GKLLLEPLK

SEQ ID NO: 649121 - protein, 9 aa, Homo Sapiens
QSSYESFEP

SEQ ID NO: 649122 - protein, 9 aa, Homo Sapiens
DQLLNVDLT

SEQ ID NO: 649123 - protein, 9 aa, Homo Sapiens
KGSFKDNPQ

SEQ ID NO: 649124 - protein, 9 aa, Homo Sapiens
NIDELDIKF

SEQ ID NO: 649125 - protein, 9 aa, Homo Sapiens
LLFLLAGCL

SEQ ID NO: 649126 - protein, 9 aa, Homo Sapiens
GIQYDHESC

SEQ ID NO: 649127 - protein, 9 aa, Homo Sapiens
RREKQKNEA

SEQ ID NO: 649128 - protein, 9 aa, Homo Sapiens
QSPLENQLQ

SEQ ID NO: 649129 - protein, 9 aa, Homo Sapiens
HASYLSDSA

SEQ ID NO: 649130 - protein, 9 aa, Homo Sapiens
CGKLEDVSR

SEQ ID NO: 649131 - protein, 9 aa, Homo Sapiens
PSLLLLLLG

SEQ ID NO: 649132 - protein, 9 aa, Homo Sapiens
SSYESFEPY

SEQ ID NO: 649133 - protein, 9 aa, Homo Sapiens
LKALARFLA

SEQ ID NO: 649134 - protein, 9 aa, Homo Sapiens
CQEHCQISS

SEQ ID NO: 649135 - protein, 9 aa, Homo Sapiens
KEPKKGQGR

SEQ ID NO: 649136 - protein, 9 aa, Homo Sapiens
WKHFLSLPE

SEQ ID NO: 649137 - protein, 9 aa, Homo Sapiens
STFIHLRRV

SEQ ID NO: 649138 - protein, 9 aa, Homo Sapiens
LNGRLLQGA

SEQ ID NO: 649139 - protein, 9 aa, Homo Sapiens
RDQLLNVDL

SEQ ID NO: 649140 - protein, 9 aa, Homo Sapiens
IPQDNVNPP

SEQ ID NO: 649141 - protein, 9 aa, Homo Sapiens
LHRENTIYR

SEQ ID NO: 649142 - protein, 9 aa, Homo Sapiens
SEHSRSPDP

SEQ ID NO: 649143 - protein, 9 aa, Homo Sapiens
DSDSDAQRM

SEQ ID NO: 649144 - protein, 9 aa, Homo Sapiens
SDSDSDAQR

SEQ ID NO: 649145 - protein, 9 aa, Homo Sapiens
SPLQSLVSS

SEQ ID NO: 649146 - protein, 9 aa, Homo Sapiens
SYESFEPYP

SEQ ID NO: 649147 - protein, 9 aa, Homo Sapiens
WMLGAENLT

SEQ ID NO: 649148 - protein, 9 aa, Homo Sapiens
LPRESYQMG

SEQ ID NO: 649149 - protein, 9 aa, Homo Sapiens
SPFHNFNMV

SEQ ID NO: 649150 - protein, 9 aa, Homo Sapiens
RPELIPLRT

SEQ ID NO: 649151 - protein, 9 aa, Homo Sapiens
EPQQDNPSS

SEQ ID NO: 649152 - protein, 9 aa, Homo Sapiens
KQKNEALRK

SEQ ID NO: 649153 - protein, 9 aa, Homo Sapiens
ETALKQYAC

SEQ ID NO: 649154 - protein, 9 aa, Homo Sapiens
SELSEVPAA

SEQ ID NO: 649155 - protein, 9 aa, Homo Sapiens
GYCSGHGFC

SEQ ID NO: 649156 - protein, 9 aa, Homo Sapiens
EYRREKQKN

SEQ ID NO: 649157 - protein, 9 aa, Homo Sapiens
QNVNVRSLS

SEQ ID NO: 649158 - protein, 9 aa, Homo Sapiens
EIACKSPPP

SEQ ID NO: 649159 - protein, 9 aa, Homo Sapiens
CQISSQAKI

SEQ ID NO: 649160 - protein, 9 aa, Homo Sapiens
YCSGHGFCD

SEQ ID NO: 649161 - protein, 9 aa, Homo Sapiens
TTVSLQEFL

SEQ ID NO: 649162 - protein, 9 aa, Homo Sapiens
PKKLFRNRT

SEQ ID NO: 649163 - protein, 9 aa, Homo Sapiens
QQPQRQLPR

SEQ ID NO: 649164 - protein, 9 aa, Homo Sapiens
TLDGASANT

SEQ ID NO: 649165 - protein, 9 aa, Homo Sapiens
ITDVPMRIS

SEQ ID NO: 649166 - protein, 9 aa, Homo Sapiens
TVSYAFKKH

SEQ ID NO: 649167 - protein, 9 aa, Homo Sapiens
DKTTEIACK

SEQ ID NO: 649168 - protein, 9 aa, Homo Sapiens
NRTPNGPMS

SEQ ID NO: 649169 - protein, 9 aa, Homo Sapiens
HGIFIPVED

SEQ ID NO: 649170 - protein, 9 aa, Homo Sapiens
DVPMRISDD

SEQ ID NO: 649171 - protein, 9 aa, Homo Sapiens
WTGNPLATT

SEQ ID NO: 649172 - protein, 9 aa, Homo Sapiens
MGIVSLLEN

SEQ ID NO: 649173 - protein, 9 aa, Homo Sapiens
YLLLTTGGT

SEQ ID NO: 649174 - protein, 9 aa, Homo Sapiens
QYDHESCGS

SEQ ID NO: 649175 - protein, 9 aa, Homo Sapiens
DEREQLRHP

SEQ ID NO: 649176 - protein, 9 aa, Homo Sapiens
GRLFLSQWP

SEQ ID NO: 649177 - protein, 9 aa, Homo Sapiens
LLLSAIVSI

SEQ ID NO: 649178 - protein, 9 aa, Homo Sapiens
LDGASANTT

SEQ ID NO: 649179 - protein, 9 aa, Homo Sapiens
GEETVYGAG

SEQ ID NO: 649180 - protein, 9 aa, Homo Sapiens
RQLPRESYQ

SEQ ID NO: 649181 - protein, 9 aa, Homo Sapiens
VISKCDQFD

SEQ ID NO: 649182 - protein, 9 aa, Homo Sapiens
VLELNGRLL

SEQ ID NO: 649183 - protein, 9 aa, Homo Sapiens
KKLMKKLHE

SEQ ID NO: 649184 - protein, 9 aa, Homo Sapiens
TAVKVRKPS

SEQ ID NO: 649185 - protein, 9 aa, Homo Sapiens
TASWTGNPL

SEQ ID NO: 649186 - protein, 9 aa, Homo Sapiens
EHCQISSQA

SEQ ID NO: 649187 - protein, 9 aa, Homo Sapiens
FLLAGCLWI

SEQ ID NO: 649188 - protein, 9 aa, Homo Sapiens
SDAQRMAFE

SEQ ID NO: 649189 - protein, 9 aa, Homo Sapiens
DNPQLYQEI

SEQ ID NO: 649190 - protein, 9 aa, Homo Sapiens
DIKPGYLLL

SEQ ID NO: 649191 - protein, 9 aa, Homo Sapiens
GASANTTVS

SEQ ID NO: 649192 - protein, 9 aa, Homo Sapiens
PAITDVPMR

SEQ ID NO: 649193 - protein, 9 aa, Homo Sapiens
PIQQPQRQL

SEQ ID NO: 649194 - protein, 9 aa, Homo Sapiens
YTASWHMVF

SEQ ID NO: 649195 - protein, 9 aa, Homo Sapiens
LEDVSRFFS

SEQ ID NO: 649196 - protein, 9 aa, Homo Sapiens
SLVSSFPSS

SEQ ID NO: 649197 - protein, 9 aa, Homo Sapiens
HNFNMVNSL

SEQ ID NO: 649198 - protein, 9 aa, Homo Sapiens
KLHESRFDV

SEQ ID NO: 649199 - protein, 9 aa, Homo Sapiens
TYVPLGFPH

SEQ ID NO: 649200 - protein, 9 aa, Homo Sapiens
PKKGQGRLF

SEQ ID NO: 649201 - protein, 9 aa, Homo Sapiens
DFLRKLPST

SEQ ID NO: 649202 - protein, 9 aa, Homo Sapiens
PAQSPLQSL

SEQ ID NO: 649203 - protein, 9 aa, Homo Sapiens
NLTPEDDMP

SEQ ID NO: 649204 - protein, 9 aa, Homo Sapiens
SAIVSISAL

SEQ ID NO: 649205 - protein, 9 aa, Homo Sapiens
TQCGFSFTT

SEQ ID NO: 649206 - protein, 9 aa, Homo Sapiens
KKLHESRFD

SEQ ID NO: 649207 - protein, 9 aa, Homo Sapiens
SMGIVSLLE

SEQ ID NO: 649208 - protein, 9 aa, Homo Sapiens
LSGLLVLVS

SEQ ID NO: 649209 - protein, 9 aa, Homo Sapiens
RRVLQSPLE

SEQ ID NO: 649210 - protein, 9 aa, Homo Sapiens
QLPRESYQM

SEQ ID NO: 649211 - protein, 9 aa, Homo Sapiens
SWHMVFFSE

SEQ ID NO: 649212 - protein, 9 aa, Homo Sapiens
AITDVPMRI

SEQ ID NO: 649213 - protein, 9 aa, Homo Sapiens
VVWLLSGLL

SEQ ID NO: 649214 - protein, 9 aa, Homo Sapiens
VVVGACGVG

SEQ ID NO: 649215 - protein, 9 aa, Homo Sapiens
LPPVVWLLS

SEQ ID NO: 649216 - protein, 9 aa, Homo Sapiens
QQDNPSSRD

SEQ ID NO: 649217 - protein, 9 aa, Homo Sapiens
PEFRDEREQ

SEQ ID NO: 649218 - protein, 9 aa, Homo Sapiens
KPGYLLLTT

SEQ ID NO: 649219 - protein, 9 aa, Homo Sapiens
HCQISSQAK

SEQ ID NO: 649220 - protein, 9 aa, Homo Sapiens
INETIEDMD

SEQ ID NO: 649221 - protein, 9 aa, Homo Sapiens
CLWISFLYG

SEQ ID NO: 649222 - protein, 9 aa, Homo Sapiens
RQLQDFLRK

SEQ ID NO: 649223 - protein, 9 aa, Homo Sapiens
NPYLMGGRK

SEQ ID NO: 649224 - protein, 9 aa, Homo Sapiens
LLDYQLHNL

SEQ ID NO: 649225 - protein, 9 aa, Homo Sapiens
LSLPETALK

SEQ ID NO: 649226 - protein, 9 aa, Homo Sapiens
SAEEIGLVA

SEQ ID NO: 649227 - protein, 9 aa, Homo Sapiens
AGSVHLLVD

SEQ ID NO: 649228 - protein, 9 aa, Homo Sapiens
VVGACGVGK

SEQ ID NO: 649229 - protein, 9 aa, Homo Sapiens
KLGAATEYG

SEQ ID NO: 649230 - protein, 9 aa, Homo Sapiens
PETALKQYA

SEQ ID NO: 649231 - protein, 9 aa, Homo Sapiens
SVTVYRWHG

SEQ ID NO: 649232 - protein, 9 aa, Homo Sapiens
KDGIQYDHE

SEQ ID NO: 649233 - protein, 9 aa, Homo Sapiens
QSDSDSDAQ

SEQ ID NO: 649234 - protein, 9 aa, Homo Sapiens
YESFEPYPE

SEQ ID NO: 649235 - protein, 9 aa, Homo Sapiens
SDSDAQRMA

SEQ ID NO: 649236 - protein, 9 aa, Homo Sapiens
ENQLQVLPI

SEQ ID NO: 649237 - protein, 9 aa, Homo Sapiens
KKLFRNRTP

SEQ ID NO: 649238 - protein, 9 aa, Homo Sapiens
VYGAGVSVG

SEQ ID NO: 649239 - protein, 9 aa, Homo Sapiens
PQQDNPSSR

SEQ ID NO: 649240 - protein, 9 aa, Homo Sapiens
PSPKEPQQD

SEQ ID NO: 649241 - protein, 9 aa, Homo Sapiens
PFAAAAATA

SEQ ID NO: 649242 - protein, 9 aa, Homo Sapiens
RMGMSCGLE

SEQ ID NO: 649243 - protein, 9 aa, Homo Sapiens
LLQSASRQL

SEQ ID NO: 649244 - protein, 9 aa, Homo Sapiens
FRNRTPNGP

SEQ ID NO: 649245 - protein, 9 aa, Homo Sapiens
YIENPYLMG

SEQ ID NO: 649246 - protein, 9 aa, Homo Sapiens
EETVYGAGV

SEQ ID NO: 649247 - protein, 9 aa, Homo Sapiens
QSPLQSLVS

SEQ ID NO: 649248 - protein, 9 aa, Homo Sapiens
PQDNVNPPQ

SEQ ID NO: 649249 - protein, 9 aa, Homo Sapiens
PLGFPHPQS

SEQ ID NO: 649250 - protein, 9 aa, Homo Sapiens
YEVKYYEKK

SEQ ID NO: 649251 - protein, 9 aa, Homo Sapiens
WLLSGLLVL

SEQ ID NO: 649252 - protein, 9 aa, Homo Sapiens
MGGRKFDLR

SEQ ID NO: 649253 - protein, 9 aa, Homo Sapiens
YGQIRYSVS

SEQ ID NO: 649254 - protein, 9 aa, Homo Sapiens
LKLKDGIQY

SEQ ID NO: 649255 - protein, 9 aa, Homo Sapiens
EASELSEVP

SEQ ID NO: 649256 - protein, 9 aa, Homo Sapiens
VSRFFSMAE

SEQ ID NO: 649257 - protein, 9 aa, Homo Sapiens
LGKVDIFLK

SEQ ID NO: 649258 - protein, 9 aa, Homo Sapiens
VYRWHGIFI

SEQ ID NO: 649259 - protein, 9 aa, Homo Sapiens
SWTGNPLAT

SEQ ID NO: 649260 - protein, 9 aa, Homo Sapiens
AGTQESGPE

SEQ ID NO: 649261 - protein, 9 aa, Homo Sapiens
SPFAAAAAT

SEQ ID NO: 649262 - protein, 9 aa, Homo Sapiens
GRPAGSVHL

SEQ ID NO: 649263 - protein, 9 aa, Homo Sapiens
HNSFINHIE

SEQ ID NO: 649264 - protein, 9 aa, Homo Sapiens
KLKDGIQYD

SEQ ID NO: 649265 - protein, 9 aa, Homo Sapiens
LGFPHPQSR

SEQ ID NO: 649266 - protein, 9 aa, Homo Sapiens
RLFLSQWPQ

SEQ ID NO: 649267 - protein, 9 aa, Homo Sapiens
VPMRISDDD

SEQ ID NO: 649268 - protein, 9 aa, Homo Sapiens
TVYGAGVSV

SEQ ID NO: 649269 - protein, 9 aa, Homo Sapiens
PTDTSKIEK

SEQ ID NO: 649270 - protein, 9 aa, Homo Sapiens
GNMKINETI

SEQ ID NO: 649271 - protein, 8 aa, Homo Sapiens
PAAYTLAR

SEQ ID NO: 649272 - protein, 9 aa, Homo Sapiens
CGVGKSALT

SEQ ID NO: 649273 - protein, 9 aa, Homo Sapiens
ANTTVSLQE

SEQ ID NO: 649274 - protein, 9 aa, Homo Sapiens
PKEPQQDNP

SEQ ID NO: 649275 - protein, 9 aa, Homo Sapiens
MIPQDNVNP

SEQ ID NO: 649276 - protein, 9 aa, Homo Sapiens
LFLLAGCLW

SEQ ID NO: 649277 - protein, 9 aa, Homo Sapiens
SLLDYQLHN

SEQ ID NO: 649278 - protein, 9 aa, Homo Sapiens
TEALASPWP

SEQ ID NO: 649279 - protein, 9 aa, Homo Sapiens
NPLATTQRF

SEQ ID NO: 649280 - protein, 9 aa, Homo Sapiens
GWHVDNMLE

SEQ ID NO: 649281 - protein, 9 aa, Homo Sapiens
EAQAGTQES

SEQ ID NO: 649282 - protein, 9 aa, Homo Sapiens
PHNSFINHI

SEQ ID NO: 649283 - protein, 9 aa, Homo Sapiens
YPQDPALRA

SEQ ID NO: 649284 - protein, 9 aa, Homo Sapiens
EALASPWPD

SEQ ID NO: 649285 - protein, 9 aa, Homo Sapiens
PELIPLRTV

SEQ ID NO: 649286 - protein, 9 aa, Homo Sapiens
ASWHMVFFS

SEQ ID NO: 649287 - protein, 9 aa, Homo Sapiens
LMGGRKFDL

SEQ ID NO: 649288 - protein, 9 aa, Homo Sapiens
LRKLPSTFI

SEQ ID NO: 649289 - protein, 9 aa, Homo Sapiens
PLLLLLGAW

SEQ ID NO: 649290 - protein, 9 aa, Homo Sapiens
RNRTPNGPM

SEQ ID NO: 649291 - protein, 9 aa, Homo Sapiens
CGFSFTTTV

SEQ ID NO: 649292 - protein, 9 aa, Homo Sapiens
YEKKEQETS

SEQ ID NO: 649293 - protein, 9 aa, Homo Sapiens
LMKKLHESR

SEQ ID NO: 649294 - protein, 9 aa, Homo Sapiens
NPQLYQEIQ

SEQ ID NO: 649295 - protein, 9 aa, Homo Sapiens
YSSTVSEHS

SEQ ID NO: 649296 - protein, 9 aa, Homo Sapiens
EPKKGQGRL

SEQ ID NO: 649297 - protein, 9 aa, Homo Sapiens
TIEDMDAQL

SEQ ID NO: 649298 - protein, 9 aa, Homo Sapiens
GAENLTPED

SEQ ID NO: 649299 - protein, 9 aa, Homo Sapiens
SGLLVLVSL

SEQ ID NO: 649300 - protein, 9 aa, Homo Sapiens
VLLLSAIVS

SEQ ID NO: 649301 - protein, 9 aa, Homo Sapiens
ISKCDQFDG

SEQ ID NO: 649302 - protein, 9 aa, Homo Sapiens
LLSAIVSIS

SEQ ID NO: 649303 - protein, 9 aa, Homo Sapiens
KTTEIACKS

SEQ ID NO: 649304 - protein, 9 aa, Homo Sapiens
YGAGVSVGR

SEQ ID NO: 649305 - protein, 9 aa, Homo Sapiens
LQDFLRKLP

SEQ ID NO: 649306 - protein, 9 aa, Homo Sapiens
WPDGDSSPT

SEQ ID NO: 649307 - protein, 9 aa, Homo Sapiens
QDFLRKLPS

SEQ ID NO: 649308 - protein, 9 aa, Homo Sapiens
DNIDELDIK

SEQ ID NO: 649309 - protein, 9 aa, Homo Sapiens
EVKYYEKKE

SEQ ID NO: 649310 - protein, 9 aa, Homo Sapiens
HFLSLPETA

SEQ ID NO: 649311 - protein, 9 aa, Homo Sapiens
DLTNNGKLL

SEQ ID NO: 649312 - protein, 9 aa, Homo Sapiens
GPQSDSDSD

SEQ ID NO: 649313 - protein, 9 aa, Homo Sapiens
ESPSPKEPQ

SEQ ID NO: 649314 - protein, 9 aa, Homo Sapiens
SALYVSPEV

SEQ ID NO: 649315 - protein, 9 aa, Homo Sapiens
IDNIDELDI

SEQ ID NO: 649316 - protein, 9 aa, Homo Sapiens
LGAENLTPE

SEQ ID NO: 649317 - protein, 9 aa, Homo Sapiens
GTAVKSGQE

SEQ ID NO: 649318 - protein, 9 aa, Homo Sapiens
SRFFSMAEK

SEQ ID NO: 649319 - protein, 9 aa, Homo Sapiens
LRAPEFLQT

SEQ ID NO: 649320 - protein, 9 aa, Homo Sapiens
GKYWPIDNI

SEQ ID NO: 649321 - protein, 9 aa, Homo Sapiens
HESRFDVVL

SEQ ID NO: 649322 - protein, 9 aa, Homo Sapiens
KSPAWKHFL

SEQ ID NO: 649323 - protein, 9 aa, Homo Sapiens
KDIKPGYLL

SEQ ID NO: 649324 - protein, 9 aa, Homo Sapiens
GKVLQCDEY

SEQ ID NO: 649325 - protein, 9 aa, Homo Sapiens
EDKEELRDQ

SEQ ID NO: 649326 - protein, 9 aa, Homo Sapiens
RCPGYCSGH

SEQ ID NO: 649327 - protein, 9 aa, Homo Sapiens
YYSGENLYL

SEQ ID NO: 649328 - protein, 9 aa, Homo Sapiens
SPWPDGDSS

SEQ ID NO: 649329 - protein, 9 aa, Homo Sapiens
TDDKTTEIA

SEQ ID NO: 649330 - protein, 9 aa, Homo Sapiens
LSMGIVSLL

SEQ ID NO: 649331 - protein, 9 aa, Homo Sapiens
ASPWPDGDS

SEQ ID NO: 649332 - protein, 9 aa, Homo Sapiens
SYLSDSAVM

SEQ ID NO: 649333 - protein, 9 aa, Homo Sapiens
FKKHSKGER

SEQ ID NO: 649334 - protein, 9 aa, Homo Sapiens
AAAAATAAL

SEQ ID NO: 649335 - protein, 9 aa, Homo Sapiens
VPISGWHVD

SEQ ID NO: 649336 - protein, 9 aa, Homo Sapiens
PMRISDDDT

SEQ ID NO: 649337 - protein, 9 aa, Homo Sapiens
KKEQETSYT

SEQ ID NO: 649338 - protein, 9 aa, Homo Sapiens
SKIEKLASR

SEQ ID NO: 649339 - protein, 9 aa, Homo Sapiens
NSFINHIET

SEQ ID NO: 649340 - protein, 9 aa, Homo Sapiens
QLRHPPAPH

SEQ ID NO: 649341 - protein, 9 aa, Homo Sapiens
VPLGFPHPQ

SEQ ID NO: 649342 - protein, 9 aa, Homo Sapiens
ISGWHVDNM

SEQ ID NO: 649343 - protein, 9 aa, Homo Sapiens
YRAGRPAGS

SEQ ID NO: 649344 - protein, 9 aa, Homo Sapiens
TEYGGAAGF

SEQ ID NO: 649345 - protein, 9 aa, Homo Sapiens
IGLVAQHPS

SEQ ID NO: 649346 - protein, 9 aa, Homo Sapiens
GYLLLTTGG

SEQ ID NO: 649347 - protein, 9 aa, Homo Sapiens
SEVPAAAGE

SEQ ID NO: 649348 - protein, 9 aa, Homo Sapiens
QCGFSFTTT

SEQ ID NO: 649349 - protein, 9 aa, Homo Sapiens
GYGQIRYSV

SEQ ID NO: 649350 - protein, 9 aa, Homo Sapiens
QKNEALRKQ

SEQ ID NO: 649351 - protein, 9 aa, Homo Sapiens
GMSCGLESG

SEQ ID NO: 649352 - protein, 9 aa, Homo Sapiens
PLENQLQVL

SEQ ID NO: 649353 - protein, 9 aa, Homo Sapiens
ELRDQLLNV

SEQ ID NO: 649354 - protein, 9 aa, Homo Sapiens
NGFPNAFWV

SEQ ID NO: 649355 - protein, 9 aa, Homo Sapiens
SPKEPQQDN

SEQ ID NO: 649356 - protein, 9 aa, Homo Sapiens
VRSLSGHNY

SEQ ID NO: 649357 - protein, 9 aa, Homo Sapiens
AAATAALGG

SEQ ID NO: 649358 - protein, 9 aa, Homo Sapiens
SEKRCPGYC

SEQ ID NO: 649359 - protein, 9 aa, Homo Sapiens
KKQNAQSSY

SEQ ID NO: 649360 - protein, 9 aa, Homo Sapiens
VRKPSPNRS

SEQ ID NO: 649361 - protein, 9 aa, Homo Sapiens
KARKGRTGI

SEQ ID NO: 649362 - protein, 9 aa, Homo Sapiens
STVSEHSRS

SEQ ID NO: 649363 - protein, 9 aa, Homo Sapiens
KWMLGAENL

SEQ ID NO: 649364 - protein, 9 aa, Homo Sapiens
AQSPLQSLV

SEQ ID NO: 649365 - protein, 9 aa, Homo Sapiens
VKYYEKKEQ

SEQ ID NO: 649366 - protein, 9 aa, Homo Sapiens
SSPFHNFNM

SEQ ID NO: 649367 - protein, 9 aa, Homo Sapiens
STAVKVRKP

SEQ ID NO: 649368 - protein, 9 aa, Homo Sapiens
GTLCETGYG

SEQ ID NO: 649369 - protein, 9 aa, Homo Sapiens
LSAEEIGLV

SEQ ID NO: 649370 - protein, 9 aa, Homo Sapiens
FVPISGWHV

SEQ ID NO: 649371 - protein, 9 aa, Homo Sapiens
KLLLEPLKL

SEQ ID NO: 649372 - protein, 9 aa, Homo Sapiens
ASELSEVPA

SEQ ID NO: 649373 - protein, 9 aa, Homo Sapiens
LSEVPAAAG

SEQ ID NO: 649374 - protein, 9 aa, Homo Sapiens
GDEVLELNG

SEQ ID NO: 649375 - protein, 9 aa, Homo Sapiens
GNPLATTQR

SEQ ID NO: 649376 - protein, 9 aa, Homo Sapiens
SLLLLLLGA

SEQ ID NO: 649377 - protein, 9 aa, Homo Sapiens
MGMSCGLES

SEQ ID NO: 649378 - protein, 9 aa, Homo Sapiens
KIEKLASRA

SEQ ID NO: 649379 - protein, 9 aa, Homo Sapiens
LAGCLWISF

SEQ ID NO: 649380 - protein, 9 aa, Homo Sapiens
VKVRKPSPN

SEQ ID NO: 649381 - protein, 9 aa, Homo Sapiens
PALRAPEFL

SEQ ID NO: 649382 - protein, 9 aa, Homo Sapiens
DVSRFFSMA

SEQ ID NO: 649383 - protein, 9 aa, Homo Sapiens
LLAGCLWIS

SEQ ID NO: 649384 - protein, 9 aa, Homo Sapiens
MLGAENLTP

SEQ ID NO: 649385 - protein, 9 aa, Homo Sapiens
LGTLCETGY

SEQ ID NO: 649386 - protein, 9 aa, Homo Sapiens
ALKQYACTV

SEQ ID NO: 649387 - protein, 9 aa, Homo Sapiens
MPTDTSKIE

SEQ ID NO: 649388 - protein, 9 aa, Homo Sapiens
EFRDEREQL

SEQ ID NO: 649389 - protein, 9 aa, Homo Sapiens
GMVGSALYV

SEQ ID NO: 649390 - protein, 9 aa, Homo Sapiens
TDTSKIEKL

SEQ ID NO: 649391 - protein, 9 aa, Homo Sapiens
NMVNSLIYP

SEQ ID NO: 649392 - protein, 9 aa, Homo Sapiens
PISGWHVDN

SEQ ID NO: 649393 - protein, 9 aa, Homo Sapiens
ENLTPEDDM

SEQ ID NO: 649394 - protein, 9 aa, Homo Sapiens
TEIACKSPP

SEQ ID NO: 649395 - protein, 9 aa, Homo Sapiens
KLFRNRTPN

SEQ ID NO: 649396 - protein, 9 aa, Homo Sapiens
AQSSYESFE

SEQ ID NO: 649397 - protein, 9 aa, Homo Sapiens
NGKLLLEPL

SEQ ID NO: 649398 - protein, 9 aa, Homo Sapiens
AATEYGGAA

SEQ ID NO: 649399 - protein, 9 aa, Homo Sapiens
NTTVSLQEF

SEQ ID NO: 649400 - protein, 9 aa, Homo Sapiens
EYGGAAGFA

SEQ ID NO: 649401 - protein, 9 aa, Homo Sapiens
QGRLFLSQW

SEQ ID NO: 649402 - protein, 9 aa, Homo Sapiens
EELRDQLLN

SEQ ID NO: 649403 - protein, 9 aa, Homo Sapiens
GHKGSFKDN

SEQ ID NO: 649404 - protein, 9 aa, Homo Sapiens
RPAGSVHLL

SEQ ID NO: 649405 - protein, 9 aa, Homo Sapiens
WHVDNMLEP

SEQ ID NO: 649406 - protein, 9 aa, Homo Sapiens
SPSPKEPQQ

SEQ ID NO: 649407 - protein, 9 aa, Homo Sapiens
FSFTTTVMQ

SEQ ID NO: 649408 - protein, 9 aa, Homo Sapiens
WPIDNIDEL

SEQ ID NO: 649409 - protein, 9 aa, Homo Sapiens
LCETGYGQI

SEQ ID NO: 649410 - protein, 9 aa, Homo Sapiens
TPNGPMSKE

SEQ ID NO: 649411 - protein, 9 aa, Homo Sapiens
VWGGEDDDL

SEQ ID NO: 649412 - protein, 9 aa, Homo Sapiens
VAAIHCKAR

SEQ ID NO: 649413 - protein, 9 aa, Homo Sapiens
EHSRSPDPS

SEQ ID NO: 649414 - protein, 9 aa, Homo Sapiens
LQCDEYEEV

SEQ ID NO: 649415 - protein, 9 aa, Homo Sapiens
DFSQNVNVR

SEQ ID NO: 649416 - protein, 9 aa, Homo Sapiens
QAGTQESGP

SEQ ID NO: 649417 - protein, 9 aa, Homo Sapiens
GWGEETVYG

SEQ ID NO: 649418 - protein, 9 aa, Homo Sapiens
GHLTGMVGS

SEQ ID NO: 649419 - protein, 9 aa, Homo Sapiens
YGGAAGFAT

SEQ ID NO: 649420 - protein, 9 aa, Homo Sapiens
VNVRSLSGH

SEQ ID NO: 649421 - protein, 9 aa, Homo Sapiens
ISSQAKIDI

SEQ ID NO: 649422 - protein, 9 aa, Homo Sapiens
SHASYLSDS

SEQ ID NO: 649423 - protein, 9 aa, Homo Sapiens
ILTLPKGAH

SEQ ID NO: 649424 - protein, 9 aa, Homo Sapiens
ALASPWPDG

SEQ ID NO: 649425 - protein, 9 aa, Homo Sapiens
NAFWVWGGE

SEQ ID NO: 649426 - protein, 9 aa, Homo Sapiens
VLPILTLPK

SEQ ID NO: 649427 - protein, 9 aa, Homo Sapiens
TYPQDPALR

SEQ ID NO: 649428 - protein, 9 aa, Homo Sapiens
CSEKRCPGY

SEQ ID NO: 649429 - protein, 9 aa, Homo Sapiens
MLLFLLAGC

SEQ ID NO: 649430 - protein, 9 aa, Homo Sapiens
SQNVNVRSL

SEQ ID NO: 649431 - protein, 9 aa, Homo Sapiens
MKKLHESRF

SEQ ID NO: 649432 - protein, 9 aa, Homo Sapiens
RSLSGHNYL

SEQ ID NO: 649433 - protein, 9 aa, Homo Sapiens
TTDDKTTEI

SEQ ID NO: 649434 - protein, 9 aa, Homo Sapiens
ETGYGQIRY

SEQ ID NO: 649435 - protein, 9 aa, Homo Sapiens
FLSMGIVSL

SEQ ID NO: 649436 - protein, 9 aa, Homo Sapiens
EDVSRFFSM

SEQ ID NO: 649437 - protein, 9 aa, Homo Sapiens
FINHIETVL

SEQ ID NO: 649438 - protein, 9 aa, Homo Sapiens
PQRQLPRES

SEQ ID NO: 649439 - protein, 9 aa, Homo Sapiens
PKGAHEEVN

SEQ ID NO: 649440 - protein, 9 aa, Homo Sapiens
TAVKSGQEN

SEQ ID NO: 649441 - protein, 9 aa, Homo Sapiens
IHLRRVLQS

SEQ ID NO: 649442 - protein, 9 aa, Homo Sapiens
RENTIYRDL

SEQ ID NO: 649443 - protein, 9 aa, Homo Sapiens
FWVWGGEDD

SEQ ID NO: 649444 - protein, 9 aa, Homo Sapiens
LHESRFDVV

SEQ ID NO: 649445 - protein, 9 aa, Homo Sapiens
TGYGQIRYS

SEQ ID NO: 649446 - protein, 9 aa, Homo Sapiens
KNEALRKQQ

SEQ ID NO: 649447 - protein, 9 aa, Homo Sapiens
ISLLDYQLH

SEQ ID NO: 649448 - protein, 9 aa, Homo Sapiens
LPLLLLLGA

SEQ ID NO: 649449 - protein, 9 aa, Homo Sapiens
VFLSMGIVS

SEQ ID NO: 649450 - protein, 9 aa, Homo Sapiens
WVWGGEDDD

SEQ ID NO: 649451 - protein, 9 aa, Homo Sapiens
FFISLLDYQ

SEQ ID NO: 649452 - protein, 9 aa, Homo Sapiens
CPGYCSGHG

SEQ ID NO: 649453 - protein, 9 aa, Homo Sapiens
KVRKPSPNR

SEQ ID NO: 649454 - protein, 9 aa, Homo Sapiens
TDVPMRISD

SEQ ID NO: 649455 - protein, 9 aa, Homo Sapiens
NQLQVLPIL

SEQ ID NO: 649456 - protein, 9 aa, Homo Sapiens
SASRQLQDF

SEQ ID NO: 649457 - protein, 9 aa, Homo Sapiens
REKQKNEAL

SEQ ID NO: 649458 - protein, 9 aa, Homo Sapiens
PQDPALRAP

SEQ ID NO: 649459 - protein, 9 aa, Homo Sapiens
MRISDDDTA

SEQ ID NO: 649460 - protein, 9 aa, Homo Sapiens
VSYAFKKHS

SEQ ID NO: 649461 - protein, 9 aa, Homo Sapiens
NNGKLLLEP

SEQ ID NO: 649462 - protein, 9 aa, Homo Sapiens
PHRLSAEEI

SEQ ID NO: 649463 - protein, 9 aa, Homo Sapiens
SQAKIDILL

SEQ ID NO: 649464 - protein, 9 aa, Homo Sapiens
EVNDGVGTA

SEQ ID NO: 649465 - protein, 9 aa, Homo Sapiens
YRWHGIFIP

SEQ ID NO: 649466 - protein, 9 aa, Homo Sapiens
DSDAQRMAF

SEQ ID NO: 649467 - protein, 9 aa, Homo Sapiens
TAALGGADA

SEQ ID NO: 649468 - protein, 9 aa, Homo Sapiens
DTSKIEKLA

SEQ ID NO: 649469 - protein, 9 aa, Homo Sapiens
KYWPIDNID

SEQ ID NO: 649470 - protein, 9 aa, Homo Sapiens
FLRKLPSTF

SEQ ID NO: 649471 - protein, 9 aa, Homo Sapiens
QSLVSSFPS

SEQ ID NO: 649472 - protein, 9 aa, Homo Sapiens
PAWKHFLSL

SEQ ID NO: 649473 - protein, 9 aa, Homo Sapiens
NMKINETIE

SEQ ID NO: 649474 - protein, 9 aa, Homo Sapiens
VHKDIKPGY

SEQ ID NO: 649475 - protein, 9 aa, Homo Sapiens
DIFLKDVQP

SEQ ID NO: 649476 - protein, 9 aa, Homo Sapiens
RNMIPQDNV

SEQ ID NO: 649477 - protein, 9 aa, Homo Sapiens
MKILTQCGF

SEQ ID NO: 649478 - protein, 9 aa, Homo Sapiens
QLQDFLRKL

SEQ ID NO: 649479 - protein, 9 aa, Homo Sapiens
QESGPEEYC

SEQ ID NO: 649480 - protein, 9 aa, Homo Sapiens
PGDEVLELN

SEQ ID NO: 649481 - protein, 9 aa, Homo Sapiens
ETIEDMDAQ

SEQ ID NO: 649482 - protein, 9 aa, Homo Sapiens
LTQCGFSFT

SEQ ID NO: 649483 - protein, 9 aa, Homo Sapiens
GMGTYVPLG

SEQ ID NO: 649484 - protein, 9 aa, Homo Sapiens
VGSALYVSP

SEQ ID NO: 649485 - protein, 9 aa, Homo Sapiens
EVLELNGRL

SEQ ID NO: 649486 - protein, 9 aa, Homo Sapiens
MSCGLESGS

SEQ ID NO: 649487 - protein, 9 aa, Homo Sapiens
QGRTLYDFG

SEQ ID NO: 649488 - protein, 9 aa, Homo Sapiens
SANTTVSLQ

SEQ ID NO: 649489 - protein, 9 aa, Homo Sapiens
TTEALASPW

SEQ ID NO: 649490 - protein, 9 aa, Homo Sapiens
CIVIRYTAS

SEQ ID NO: 649491 - protein, 9 aa, Homo Sapiens
TALKQYACT

SEQ ID NO: 649492 - protein, 9 aa, Homo Sapiens
QSASRQLQD

SEQ ID NO: 649493 - protein, 9 aa, Homo Sapiens
GTEEASELS

SEQ ID NO: 649494 - protein, 9 aa, Homo Sapiens
ETVYGAGVS

SEQ ID NO: 649495 - protein, 9 aa, Homo Sapiens
QRQLPRESY

SEQ ID NO: 649496 - protein, 9 aa, Homo Sapiens
SSTVSEHSR

SEQ ID NO: 649497 - protein, 9 aa, Homo Sapiens
LPILTLPKG

SEQ ID NO: 649498 - protein, 9 aa, Homo Sapiens
HLRRVLQSP

SEQ ID NO: 649499 - protein, 9 aa, Homo Sapiens
GSVHLLVDV

SEQ ID NO: 649500 - protein, 9 aa, Homo Sapiens
EKRCPGYCS

SEQ ID NO: 649501 - protein, 9 aa, Homo Sapiens
GTQESGPEE

SEQ ID NO: 649502 - protein, 9 aa, Homo Sapiens
SKCDQFDGS

SEQ ID NO: 649503 - protein, 9 aa, Homo Sapiens
GSFKDNPQL

SEQ ID NO: 649504 - protein, 9 aa, Homo Sapiens
SFINHIETV

SEQ ID NO: 649505 - protein, 9 aa, Homo Sapiens
ASRQLQDFL

SEQ ID NO: 649506 - protein, 9 aa, Homo Sapiens
AAIHCKARK

SEQ ID NO: 649507 - protein, 9 aa, Homo Sapiens
RKLPSTFIH

SEQ ID NO: 649508 - protein, 9 aa, Homo Sapiens
SSQAKIDIL

SEQ ID NO: 649509 - protein, 9 aa, Homo Sapiens
FLSLPETAL

SEQ ID NO: 649510 - protein, 9 aa, Homo Sapiens
SRQLQDFLR

SEQ ID NO: 649511 - protein, 9 aa, Homo Sapiens
STTDDKTTE

SEQ ID NO: 649512 - protein, 9 aa, Homo Sapiens
QISSQAKID

SEQ ID NO: 649513 - protein, 9 aa, Homo Sapiens
QPQRQLPRE

SEQ ID NO: 649514 - protein, 9 aa, Homo Sapiens
RAGRPAGSV

SEQ ID NO: 649515 - protein, 9 aa, Homo Sapiens
SSVTVYRWH

SEQ ID NO: 649516 - protein, 9 aa, Homo Sapiens
LQSPLENQL

SEQ ID NO: 649517 - protein, 9 aa, Homo Sapiens
KKGQGRLFL

SEQ ID NO: 649518 - protein, 9 aa, Homo Sapiens
GAHEEVNDG

SEQ ID NO: 649519 - protein, 9 aa, Homo Sapiens
VLQSPLENQ

SEQ ID NO: 649520 - protein, 9 aa, Homo Sapiens
PYLMGGRKF

SEQ ID NO: 649521 - protein, 9 aa, Homo Sapiens
ACGVGKSAL

SEQ ID NO: 649522 - protein, 9 aa, Homo Sapiens
LTNNGKLLL

SEQ ID NO: 649523 - protein, 9 aa, Homo Sapiens
HCKARKGRT

SEQ ID NO: 649524 - protein, 9 aa, Homo Sapiens
SGWHVDNML

SEQ ID NO: 649525 - protein, 9 aa, Homo Sapiens
MGTYVPLGF

SEQ ID NO: 649526 - protein, 9 aa, Homo Sapiens
LVSSFPSST

SEQ ID NO: 649527 - protein, 9 aa, Homo Sapiens
VNPPQQGEA

SEQ ID NO: 649528 - protein, 9 aa, Homo Sapiens
RTYPQDPAL

SEQ ID NO: 649529 - protein, 9 aa, Homo Sapiens
SGPEEYCQE

SEQ ID NO: 649530 - protein, 9 aa, Homo Sapiens
VWLLSGLLV

SEQ ID NO: 649531 - protein, 9 aa, Homo Sapiens
IQQPQRQLP

SEQ ID NO: 649532 - protein, 9 aa, Homo Sapiens
TIYRDLKPE

SEQ ID NO: 649533 - protein, 9 aa, Homo Sapiens
KHFLSLPET

SEQ ID NO: 649534 - protein, 9 aa, Homo Sapiens
ENTIYRDLK

SEQ ID NO: 649535 - protein, 9 aa, Homo Sapiens
KTPHNSFIN

SEQ ID NO: 649536 - protein, 9 aa, Homo Sapiens
GGMGTYVPL

SEQ ID NO: 649537 - protein, 9 aa, Homo Sapiens
NTIYRDLKP

SEQ ID NO: 649538 - protein, 9 aa, Homo Sapiens
FSSPFHNFN

SEQ ID NO: 649539 - protein, 9 aa, Homo Sapiens
KRCPGYCSG

SEQ ID NO: 649540 - protein, 9 aa, Homo Sapiens
DGIQYDHES

SEQ ID NO: 649541 - protein, 9 aa, Homo Sapiens
KPEVFLSMG

SEQ ID NO: 649542 - protein, 9 aa, Homo Sapiens
HEEVNDGVG

SEQ ID NO: 649543 - protein, 9 aa, Homo Sapiens
FSQNVNVRS

SEQ ID NO: 649544 - protein, 9 aa, Homo Sapiens
KKHSKGERH

SEQ ID NO: 649545 - protein, 9 aa, Homo Sapiens
NETIEDMDA

SEQ ID NO: 649546 - protein, 9 aa, Homo Sapiens
EEDKEELRD

SEQ ID NO: 649547 - protein, 9 aa, Homo Sapiens
VLQCDEYEE

SEQ ID NO: 649548 - protein, 9 aa, Homo Sapiens
RKPSPNRSK

SEQ ID NO: 649549 - protein, 9 aa, Homo Sapiens
VDIFLKDVQ

SEQ ID NO: 649550 - protein, 9 aa, Homo Sapiens
RLSAEEIGL

SEQ ID NO: 649551 - protein, 9 aa, Homo Sapiens
LKRMGMSCG

SEQ ID NO: 649552 - protein, 9 aa, Homo Sapiens
EEIGLVAQH

SEQ ID NO: 649553 - protein, 9 aa, Homo Sapiens
SCGLESGSC

SEQ ID NO: 649554 - protein, 9 aa, Homo Sapiens
NAQSSYESF

SEQ ID NO: 649555 - protein, 9 aa, Homo Sapiens
PGYCSGHGF

SEQ ID NO: 649556 - protein, 9 aa, Homo Sapiens
KLMKKLHES

SEQ ID NO: 649557 - protein, 9 aa, Homo Sapiens
FKDNPQLYQ

SEQ ID NO: 649558 - protein, 9 aa, Homo Sapiens
YDHESCGSN

SEQ ID NO: 649559 - protein, 9 aa, Homo Sapiens
DDKTTEIAC

SEQ ID NO: 649560 - protein, 9 aa, Homo Sapiens
KLEDVSRFF

SEQ ID NO: 649561 - protein, 9 aa, Homo Sapiens
TVSEHSRSP

SEQ ID NO: 649562 - protein, 9 aa, Homo Sapiens
LGAATEYGG

SEQ ID NO: 649563 - protein, 9 aa, Homo Sapiens
ASANTTVSL

SEQ ID NO: 649564 - protein, 9 aa, Homo Sapiens
EIGLVAQHP

SEQ ID NO: 649565 - protein, 9 aa, Homo Sapiens
GKLEDVSRF

SEQ ID NO: 649566 - protein, 9 aa, Homo Sapiens
REQLRHPPA

SEQ ID NO: 649567 - protein, 9 aa, Homo Sapiens
PFHNFNMVN

SEQ ID NO: 649568 - protein, 9 aa, Homo Sapiens
LENQLQVLP

SEQ ID NO: 649569 - protein, 9 aa, Homo Sapiens
DYQLHNLIM

SEQ ID NO: 649570 - protein, 9 aa, Homo Sapiens
KVDIFLKDV

SEQ ID NO: 649571 - protein, 9 aa, Homo Sapiens
DNVNPPQQG

SEQ ID NO: 649572 - protein, 9 aa, Homo Sapiens
AENLTPEDD

SEQ ID NO: 649573 - protein, 9 aa, Homo Sapiens
FIHLRRVLQ

SEQ ID NO: 649574 - protein, 9 aa, Homo Sapiens
LSAIVSISA

SEQ ID NO: 649575 - protein, 9 aa, Homo Sapiens
MLKALARFL

SEQ ID NO: 649576 - protein, 9 aa, Homo Sapiens
IEDMDAQLL

SEQ ID NO: 649577 - protein, 9 aa, Homo Sapiens
YSGENLYLS

SEQ ID NO: 649578 - protein, 9 aa, Homo Sapiens
KHSKGERHG

SEQ ID NO: 649579 - protein, 9 aa, Homo Sapiens
EQLRHPPAP

SEQ ID NO: 649580 - protein, 9 aa, Homo Sapiens
LRDQLLNVD

SEQ ID NO: 649581 - protein, 9 aa, Homo Sapiens
ATEYGGAAG

SEQ ID NO: 649582 - protein, 9 aa, Homo Sapiens
DLHRENTIY

SEQ ID NO: 649583 - protein, 9 aa, Homo Sapiens
VSEHSRSPD

SEQ ID NO: 649584 - protein, 9 aa, Homo Sapiens
NEALRKQQS

SEQ ID NO: 649585 - protein, 9 aa, Homo Sapiens
EDLHRENTI

SEQ ID NO: 649586 - protein, 9 aa, Homo Sapiens
SGPGRPELI

SEQ ID NO: 649587 - protein, 9 aa, Homo Sapiens
LQSLVSSFP

SEQ ID NO: 649588 - protein, 9 aa, Homo Sapiens
WHGIFIPVE

SEQ ID NO: 649589 - protein, 9 aa, Homo Sapiens
GVGTAVKSG

SEQ ID NO: 649590 - protein, 9 aa, Homo Sapiens
AGWGEETVY

SEQ ID NO: 649591 - protein, 9 aa, Homo Sapiens
SYYSGENLY

SEQ ID NO: 649592 - protein, 9 aa, Homo Sapiens
DKEELRDQL

SEQ ID NO: 649593 - protein, 9 aa, Homo Sapiens
FPNAFWVWG

SEQ ID NO: 649594 - protein, 9 aa, Homo Sapiens
PNAFWVWGG

SEQ ID NO: 649595 - protein, 9 aa, Homo Sapiens
LTLPKGAHE

SEQ ID NO: 649596 - protein, 9 aa, Homo Sapiens
HRENTIYRD

SEQ ID NO: 649597 - protein, 9 aa, Homo Sapiens
RCGKLEDVS

SEQ ID NO: 649598 - protein, 9 aa, Homo Sapiens
ESGPEEYCQ

SEQ ID NO: 649599 - protein, 9 aa, Homo Sapiens
VKWMLGAEN

SEQ ID NO: 649600 - protein, 9 aa, Homo Sapiens
PPVVWLLSG

SEQ ID NO: 649601 - protein, 9 aa, Homo Sapiens
KPSPNRSKL

SEQ ID NO: 649602 - protein, 9 aa, Homo Sapiens
DEVLELNGR

SEQ ID NO: 649603 - protein, 9 aa, Homo Sapiens
WGEETVYGA

SEQ ID NO: 649604 - protein, 9 aa, Homo Sapiens
LQVLPILTL

SEQ ID NO: 649605 - protein, 9 aa, Homo Sapiens
TLSHASYLS

SEQ ID NO: 649606 - protein, 9 aa, Homo Sapiens
ALRAPEFLQ

SEQ ID NO: 649607 - protein, 9 aa, Homo Sapiens
QCDEYEEVE

SEQ ID NO: 649608 - protein, 9 aa, Homo Sapiens
GSALYVSPE

SEQ ID NO: 649609 - protein, 9 aa, Homo Sapiens
CDEYEEVED

SEQ ID NO: 649610 - protein, 9 aa, Homo Sapiens
ELNGRLLQG

SEQ ID NO: 649611 - protein, 9 aa, Homo Sapiens
PGRPELIPL

SEQ ID NO: 649612 - protein, 9 aa, Homo Sapiens
ILTQCGFSF

SEQ ID NO: 649613 - protein, 9 aa, Homo Sapiens
RDEREQLRH

SEQ ID NO: 649614 - protein, 9 aa, Homo Sapiens
FRDEREQLR

SEQ ID NO: 649615 - protein, 9 aa, Homo Sapiens
TTEIACKSP

SEQ ID NO: 649616 - protein, 9 aa, Homo Sapiens
TGNPLATTQ

SEQ ID NO: 649617 - protein, 9 aa, Homo Sapiens
EVISKCDQF

SEQ ID NO: 649618 - protein, 9 aa, Homo Sapiens
AGCLWISFL

SEQ ID NO: 649619 - protein, 9 aa, Homo Sapiens
QDPALRAPE

SEQ ID NO: 649620 - protein, 9 aa, Homo Sapiens
IDELDIKFK

SEQ ID NO: 649621 - protein, 9 aa, Homo Sapiens
KEELRDQLL

SEQ ID NO: 649622 - protein, 9 aa, Homo Sapiens
QDNVNPPQQ

SEQ ID NO: 649623 - protein, 9 aa, Homo Sapiens
IFVLLLSAI

SEQ ID NO: 649624 - protein, 9 aa, Homo Sapiens
GFPNAFWVW

SEQ ID NO: 649625 - protein, 9 aa, Homo Sapiens
CDQFDGSLL

SEQ ID NO: 649626 - protein, 9 aa, Homo Sapiens
NVRSLSGHN

SEQ ID NO: 649627 - protein, 9 aa, Homo Sapiens
HKDIKPGYL

SEQ ID NO: 649628 - protein, 9 aa, Homo Sapiens
CKARKGRTG

SEQ ID NO: 649629 - protein, 9 aa, Homo Sapiens
TMPTDTSKI

SEQ ID NO: 649630 - protein, 9 aa, Homo Sapiens
YQLHNLIML

SEQ ID NO: 649631 - protein, 9 aa, Homo Sapiens
LTGMVGSAL

SEQ ID NO: 649632 - protein, 9 aa, Homo Sapiens
IVIRYTASW

SEQ ID NO: 649633 - protein, 9 aa, Homo Sapiens
ELIPLRTVS

SEQ ID NO: 649634 - protein, 9 aa, Homo Sapiens
GRTLYDFGG

SEQ ID NO: 649635 - protein, 9 aa, Homo Sapiens
RVLQSPLEN

SEQ ID NO: 649636 - protein, 9 aa, Homo Sapiens
AWKHFLSLP

SEQ ID NO: 649637 - protein, 9 aa, Homo Sapiens
IFGKVLQCD

SEQ ID NO: 649638 - protein, 9 aa, Homo Sapiens
GQGRLFLSQ

SEQ ID NO: 649639 - protein, 9 aa, Homo Sapiens
GCLWISFLY

SEQ ID NO: 649640 - protein, 9 aa, Homo Sapiens
DGVGTAVKS

SEQ ID NO: 649641 - protein, 9 aa, Homo Sapiens
KNEEVISKC

SEQ ID NO: 649642 - protein, 9 aa, Homo Sapiens
FHNFNMVNS

SEQ ID NO: 649643 - protein, 9 aa, Homo Sapiens
FAAAAATAA

SEQ ID NO: 649644 - protein, 9 aa, Homo Sapiens
ASYLSDSAV

SEQ ID NO: 649645 - protein, 9 aa, Homo Sapiens
LPETALKQY

SEQ ID NO: 649646 - protein, 9 aa, Homo Sapiens
YYEKKEQET

SEQ ID NO: 649647 - protein, 9 aa, Homo Sapiens
KILTQCGFS

SEQ ID NO: 649648 - protein, 9 aa, Homo Sapiens
TKLGAATEY

SEQ ID NO: 649649 - protein, 9 aa, Homo Sapiens
AATAALGGA

SEQ ID NO: 649650 - protein, 9 aa, Homo Sapiens
LPSTFIHLR

SEQ ID NO: 649651 - protein, 9 aa, Homo Sapiens
YKLVVVGAC

SEQ ID NO: 649652 - protein, 9 aa, Homo Sapiens
KEQETSYTI

SEQ ID NO: 649653 - protein, 9 aa, Homo Sapiens
KYYEKKEQE

SEQ ID NO: 649654 - protein, 9 aa, Homo Sapiens
YLSDSAVMD

SEQ ID NO: 649655 - protein, 9 aa, Homo Sapiens
LVVVGACGV

SEQ ID NO: 649656 - protein, 9 aa, Homo Sapiens
YAFKKHSKG

SEQ ID NO: 649657 - protein, 9 aa, Homo Sapiens
VTVYRWHGI

SEQ ID NO: 649658 - protein, 9 aa, Homo Sapiens
SFFISLLDY

SEQ ID NO: 649659 - protein, 9 aa, Homo Sapiens
IENPYLMGG

SEQ ID NO: 649660 - protein, 9 aa, Homo Sapiens
VKSGQENRN

SEQ ID NO: 649661 - protein, 9 aa, Homo Sapiens
PWPDGDSSP

SEQ ID NO: 649662 - protein, 9 aa, Homo Sapiens
AFKKHSKGE

SEQ ID NO: 649663 - protein, 9 aa, Homo Sapiens
LLEPLKLHV

SEQ ID NO: 649664 - protein, 9 aa, Homo Sapiens
KCDQFDGSL

SEQ ID NO: 649665 - protein, 9 aa, Homo Sapiens
HKGNGLDLS

SEQ ID NO: 649666 - protein, 9 aa, Homo Sapiens
QHCVKYDFH

SEQ ID NO: 649667 - protein, 9 aa, Homo Sapiens
NFTCTGDGD

SEQ ID NO: 649668 - protein, 9 aa, Homo Sapiens
EMDLGLLSQ

SEQ ID NO: 649669 - protein, 9 aa, Homo Sapiens
ITVSDFTDR

SEQ ID NO: 649670 - protein, 9 aa, Homo Sapiens
TYSVGTVGT

SEQ ID NO: 649671 - protein, 9 aa, Homo Sapiens
GSAEPPGPL

SEQ ID NO: 649672 - protein, 9 aa, Homo Sapiens
NVLNVSIPK

SEQ ID NO: 649673 - protein, 9 aa, Homo Sapiens
RCEWEDGYY

SEQ ID NO: 649674 - protein, 9 aa, Homo Sapiens
DLFTCCKCR

SEQ ID NO: 649675 - protein, 9 aa, Homo Sapiens
IVYWVFMLH

SEQ ID NO: 649676 - protein, 9 aa, Homo Sapiens
EDNFENSSQ

SEQ ID NO: 649677 - protein, 9 aa, Homo Sapiens
DDYYDGEWC

SEQ ID NO: 649678 - protein, 9 aa, Homo Sapiens
LHSFFQPRE

SEQ ID NO: 649679 - protein, 9 aa, Homo Sapiens
NAIEEEESN

SEQ ID NO: 649680 - protein, 9 aa, Homo Sapiens
THDHMSGWC

SEQ ID NO: 649681 - protein, 9 aa, Homo Sapiens
YVVAFKPFD

SEQ ID NO: 649682 - protein, 9 aa, Homo Sapiens
KKLDLVNVV

SEQ ID NO: 649683 - protein, 9 aa, Homo Sapiens
SLCDPETLI

SEQ ID NO: 649684 - protein, 9 aa, Homo Sapiens
LAAVHSPLE

SEQ ID NO: 649685 - protein, 9 aa, Homo Sapiens
LDETSSNAY

SEQ ID NO: 649686 - protein, 9 aa, Homo Sapiens
SAESDISIG

SEQ ID NO: 649687 - protein, 9 aa, Homo Sapiens
TIVLVVSVL

SEQ ID NO: 649688 - protein, 9 aa, Homo Sapiens
YSTLVLCNL

SEQ ID NO: 649689 - protein, 9 aa, Homo Sapiens
ESMQFPVTV

SEQ ID NO: 649690 - protein, 9 aa, Homo Sapiens
ILVAIFYDR

SEQ ID NO: 649691 - protein, 9 aa, Homo Sapiens
IVYSKYFGR

SEQ ID NO: 649692 - protein, 9 aa, Homo Sapiens
ELCHLWLMP

SEQ ID NO: 649693 - protein, 9 aa, Homo Sapiens
HLDWVSSIL

SEQ ID NO: 649694 - protein, 9 aa, Homo Sapiens
SKFEKNTSN

SEQ ID NO: 649695 - protein, 9 aa, Homo Sapiens
GHRHEGVKD

SEQ ID NO: 649696 - protein, 9 aa, Homo Sapiens
SAPGAPRDA

SEQ ID NO: 649697 - protein, 9 aa, Homo Sapiens
SYQQDCCVP

SEQ ID NO: 649698 - protein, 9 aa, Homo Sapiens
IKITDFGIC

SEQ ID NO: 649699 - protein, 9 aa, Homo Sapiens
QIRNKKGDH

SEQ ID NO: 649700 - protein, 9 aa, Homo Sapiens
MVKALCQLQ

SEQ ID NO: 649701 - protein, 9 aa, Homo Sapiens
YWIPKKLPR

SEQ ID NO: 649702 - protein, 9 aa, Homo Sapiens
QVGFIVGQY

SEQ ID NO: 649703 - protein, 9 aa, Homo Sapiens
LDYNSPVNN

SEQ ID NO: 649704 - protein, 9 aa, Homo Sapiens
APSSLRCAL

SEQ ID NO: 649705 - protein, 9 aa, Homo Sapiens
FIYLDAGLH

SEQ ID NO: 649706 - protein, 9 aa, Homo Sapiens
IRDPSVIVM

SEQ ID NO: 649707 - protein, 9 aa, Homo Sapiens
YIEKFIVPY

SEQ ID NO: 649708 - protein, 9 aa, Homo Sapiens
KWLYFMMFL

SEQ ID NO: 649709 - protein, 9 aa, Homo Sapiens
NSECNSDMV

SEQ ID NO: 649710 - protein, 9 aa, Homo Sapiens
EDDYYDGEW

SEQ ID NO: 649711 - protein, 9 aa, Homo Sapiens
SELWDLTEA

SEQ ID NO: 649712 - protein, 9 aa, Homo Sapiens
QKREDDHGA

SEQ ID NO: 649713 - protein, 9 aa, Homo Sapiens
SSSTPLAAN

SEQ ID NO: 649714 - protein, 9 aa, Homo Sapiens
LLSGSIRTN

SEQ ID NO: 649715 - protein, 9 aa, Homo Sapiens
AGFSTYSLL

SEQ ID NO: 649716 - protein, 9 aa, Homo Sapiens
SDKLVERSH

SEQ ID NO: 649717 - protein, 9 aa, Homo Sapiens
WVHHTAGQV

SEQ ID NO: 649718 - protein, 9 aa, Homo Sapiens
GHTDGTIVR

SEQ ID NO: 649719 - protein, 9 aa, Homo Sapiens
TILDGFHSK

SEQ ID NO: 649720 - protein, 9 aa, Homo Sapiens
VWVEVVLDG

SEQ ID NO: 649721 - protein, 9 aa, Homo Sapiens
EKTLSAVTN

SEQ ID NO: 649722 - protein, 9 aa, Homo Sapiens
NAEALIVRR

SEQ ID NO: 649723 - protein, 9 aa, Homo Sapiens
PIYEDKNRK

SEQ ID NO: 649724 - protein, 9 aa, Homo Sapiens
LKRKDQSQV

SEQ ID NO: 649725 - protein, 9 aa, Homo Sapiens
LELHYEALR

SEQ ID NO: 649726 - protein, 9 aa, Homo Sapiens
IGQWRKMFD

SEQ ID NO: 649727 - protein, 9 aa, Homo Sapiens
LHGSHSGPS

SEQ ID NO: 649728 - protein, 9 aa, Homo Sapiens
LQEAMRKLL

SEQ ID NO: 649729 - protein, 9 aa, Homo Sapiens
PVVSQDEKR

SEQ ID NO: 649730 - protein, 9 aa, Homo Sapiens
PTTLAFGDH

SEQ ID NO: 649731 - protein, 9 aa, Homo Sapiens
LLDRDSLVH

SEQ ID NO: 649732 - protein, 9 aa, Homo Sapiens
NGRVVMLVM

SEQ ID NO: 649733 - protein, 9 aa, Homo Sapiens
VAGTALLLY

SEQ ID NO: 649734 - protein, 9 aa, Homo Sapiens
NWLGQGLIE

SEQ ID NO: 649735 - protein, 9 aa, Homo Sapiens
CIGQWRKMF

SEQ ID NO: 649736 - protein, 9 aa, Homo Sapiens
SLFPRGTRE

SEQ ID NO: 649737 - protein, 9 aa, Homo Sapiens
EVSVTFKSK

SEQ ID NO: 649738 - protein, 9 aa, Homo Sapiens
IFFIYLDAG

SEQ ID NO: 649739 - protein, 9 aa, Homo Sapiens
LLCQSDAIS

SEQ ID NO: 649740 - protein, 9 aa, Homo Sapiens
SRASFCPRL

SEQ ID NO: 649741 - protein, 9 aa, Homo Sapiens
NSSQFRPER

SEQ ID NO: 649742 - protein, 9 aa, Homo Sapiens
MVGLSKRLQ

SEQ ID NO: 649743 - protein, 9 aa, Homo Sapiens
FVEFYYWES

SEQ ID NO: 649744 - protein, 9 aa, Homo Sapiens
TWNKSCRSP

SEQ ID NO: 649745 - protein, 9 aa, Homo Sapiens
SQSSSFHSS

SEQ ID NO: 649746 - protein, 9 aa, Homo Sapiens
LVTLLSHDA

SEQ ID NO: 649747 - protein, 9 aa, Homo Sapiens
ILVWLFTHD

SEQ ID NO: 649748 - protein, 9 aa, Homo Sapiens
RRLHEMKKE

SEQ ID NO: 649749 - protein, 9 aa, Homo Sapiens
CPEGSNCGE

SEQ ID NO: 649750 - protein, 9 aa, Homo Sapiens
YPCGACQSE

SEQ ID NO: 649751 - protein, 9 aa, Homo Sapiens
VNNIFERIA

SEQ ID NO: 649752 - protein, 9 aa, Homo Sapiens
PQTGSRPSE

SEQ ID NO: 649753 - protein, 9 aa, Homo Sapiens
FGICKENVF

SEQ ID NO: 649754 - protein, 9 aa, Homo Sapiens
CFERIIQSF

SEQ ID NO: 649755 - protein, 9 aa, Homo Sapiens
SYECQAEQT

SEQ ID NO: 649756 - protein, 9 aa, Homo Sapiens
LASTRPPGP

SEQ ID NO: 649757 - protein, 9 aa, Homo Sapiens
ESLSGEPEL

SEQ ID NO: 649758 - protein, 9 aa, Homo Sapiens
FELFTDLIL

SEQ ID NO: 649759 - protein, 9 aa, Homo Sapiens
PRATISTYL

SEQ ID NO: 649760 - protein, 9 aa, Homo Sapiens
VLPKITIKF

SEQ ID NO: 649761 - protein, 9 aa, Homo Sapiens
PMFFTHDLA

SEQ ID NO: 649762 - protein, 9 aa, Homo Sapiens
ILPFIKELV

SEQ ID NO: 649763 - protein, 9 aa, Homo Sapiens
FGKHGFQCQ

SEQ ID NO: 649764 - protein, 9 aa, Homo Sapiens
SNAYCSTES

SEQ ID NO: 649765 - protein, 9 aa, Homo Sapiens
INNQGSYPC

SEQ ID NO: 649766 - protein, 9 aa, Homo Sapiens
EKFEQEKKH

SEQ ID NO: 649767 - protein, 9 aa, Homo Sapiens
RSPSSSSPS

SEQ ID NO: 649768 - protein, 9 aa, Homo Sapiens
HGPFLIIAS

SEQ ID NO: 649769 - protein, 9 aa, Homo Sapiens
CENAKPGQM

SEQ ID NO: 649770 - protein, 9 aa, Homo Sapiens
QKSEVENLK

SEQ ID NO: 649771 - protein, 9 aa, Homo Sapiens
SQQTNGITR

SEQ ID NO: 649772 - protein, 9 aa, Homo Sapiens
ACKKLAYGE

SEQ ID NO: 649773 - protein, 9 aa, Homo Sapiens
FPQCTFFFL

SEQ ID NO: 649774 - protein, 9 aa, Homo Sapiens
KKLEYFINK

SEQ ID NO: 649775 - protein, 9 aa, Homo Sapiens
TLKNIMEYY

SEQ ID NO: 649776 - protein, 9 aa, Homo Sapiens
TSSNAYCST

SEQ ID NO: 649777 - protein, 9 aa, Homo Sapiens
EILLNDNNL

SEQ ID NO: 649778 - protein, 9 aa, Homo Sapiens
RVSYGPLHE

SEQ ID NO: 649779 - protein, 9 aa, Homo Sapiens
ILVFNVPGI

SEQ ID NO: 649780 - protein, 9 aa, Homo Sapiens
KKFYLISTS

SEQ ID NO: 649781 - protein, 9 aa, Homo Sapiens
EEHVMLGSL

SEQ ID NO: 649782 - protein, 9 aa, Homo Sapiens
GPRLGSEPI

SEQ ID NO: 649783 - protein, 9 aa, Homo Sapiens
LNSECNSDM

SEQ ID NO: 649784 - protein, 9 aa, Homo Sapiens
CESANTHVL

SEQ ID NO: 649785 - protein, 9 aa, Homo Sapiens
QRELIIADR

SEQ ID NO: 649786 - protein, 9 aa, Homo Sapiens
LDGEAEEVA

SEQ ID NO: 649787 - protein, 9 aa, Homo Sapiens
QDEILAHTG

SEQ ID NO: 649788 - protein, 9 aa, Homo Sapiens
GRKYPPVDP

SEQ ID NO: 649789 - protein, 9 aa, Homo Sapiens
MWSVACTVV

SEQ ID NO: 649790 - protein, 9 aa, Homo Sapiens
AGNASKDVK

SEQ ID NO: 649791 - protein, 9 aa, Homo Sapiens
SSSYQQDCC

SEQ ID NO: 649792 - protein, 9 aa, Homo Sapiens
MQELAGETR

SEQ ID NO: 649793 - protein, 9 aa, Homo Sapiens
YQLFTLTSP

SEQ ID NO: 649794 - protein, 9 aa, Homo Sapiens
QEPLFDVLQ

SEQ ID NO: 649795 - protein, 9 aa, Homo Sapiens
WDLESRCCL

SEQ ID NO: 649796 - protein, 9 aa, Homo Sapiens
ILEKASDKL

SEQ ID NO: 649797 - protein, 9 aa, Homo Sapiens
KKRHEKQLA

SEQ ID NO: 649798 - protein, 9 aa, Homo Sapiens
PDISERLPR

SEQ ID NO: 649799 - protein, 9 aa, Homo Sapiens
GDLKATDIS

SEQ ID NO: 649800 - protein, 9 aa, Homo Sapiens
MDRRYRTRI

SEQ ID NO: 649801 - protein, 9 aa, Homo Sapiens
LKLPSFSKQ

SEQ ID NO: 649802 - protein, 9 aa, Homo Sapiens
ESTQKKNKD

SEQ ID NO: 649803 - protein, 9 aa, Homo Sapiens
GSKSPDNIW

SEQ ID NO: 649804 - protein, 9 aa, Homo Sapiens
KGGAVYYCP

SEQ ID NO: 649805 - protein, 9 aa, Homo Sapiens
WLLLALLHH

SEQ ID NO: 649806 - protein, 9 aa, Homo Sapiens
KPHVRVSSR

SEQ ID NO: 649807 - protein, 9 aa, Homo Sapiens
QLSKKILLK

SEQ ID NO: 649808 - protein, 9 aa, Homo Sapiens
TMSHQALGR

SEQ ID NO: 649809 - protein, 9 aa, Homo Sapiens
KHPCNASIE

SEQ ID NO: 649810 - protein, 9 aa, Homo Sapiens
DRGQAWLPR

SEQ ID NO: 649811 - protein, 9 aa, Homo Sapiens
YNPELDLFP

SEQ ID NO: 649812 - protein, 9 aa, Homo Sapiens
GPGGGTLVG

SEQ ID NO: 649813 - protein, 9 aa, Homo Sapiens
GFIILRNGL

SEQ ID NO: 649814 - protein, 9 aa, Homo Sapiens
FNFLASYLM

SEQ ID NO: 649815 - protein, 9 aa, Homo Sapiens
KHGIKKVDT

SEQ ID NO: 649816 - protein, 9 aa, Homo Sapiens
QEWPMYQIY

SEQ ID NO: 649817 - protein, 9 aa, Homo Sapiens
CDSFQDITV

SEQ ID NO: 649818 - protein, 9 aa, Homo Sapiens
ELPNTLTFI

SEQ ID NO: 649819 - protein, 9 aa, Homo Sapiens
LEELQQILS

SEQ ID NO: 649820 - protein, 9 aa, Homo Sapiens
VIQDFWRRS

SEQ ID NO: 649821 - protein, 9 aa, Homo Sapiens
VQVIKYCSC

SEQ ID NO: 649822 - protein, 9 aa, Homo Sapiens
DTFDTMNTQ

SEQ ID NO: 649823 - protein, 9 aa, Homo Sapiens
TRWKTFQAY

SEQ ID NO: 649824 - protein, 9 aa, Homo Sapiens
SCGSGTTMD

SEQ ID NO: 649825 - protein, 9 aa, Homo Sapiens
TFRKIVYSK

SEQ ID NO: 649826 - protein, 9 aa, Homo Sapiens
LSLFPRGTR

SEQ ID NO: 649827 - protein, 9 aa, Homo Sapiens
QYCVAGTAL

SEQ ID NO: 649828 - protein, 9 aa, Homo Sapiens
MKDSFLYLE

SEQ ID NO: 649829 - protein, 9 aa, Homo Sapiens
SLRCALRSQ

SEQ ID NO: 649830 - protein, 9 aa, Homo Sapiens
QPNVACATK

SEQ ID NO: 649831 - protein, 9 aa, Homo Sapiens
VEGESYSMP

SEQ ID NO: 649832 - protein, 9 aa, Homo Sapiens
EFLGLRLDW

SEQ ID NO: 649833 - protein, 9 aa, Homo Sapiens
ADYYGKCSR

SEQ ID NO: 649834 - protein, 9 aa, Homo Sapiens
EKSELRRTQ

SEQ ID NO: 649835 - protein, 9 aa, Homo Sapiens
SPTTFLKIM

SEQ ID NO: 649836 - protein, 9 aa, Homo Sapiens
KITFNSRFV

SEQ ID NO: 649837 - protein, 9 aa, Homo Sapiens
DSWDVVEGL

SEQ ID NO: 649838 - protein, 9 aa, Homo Sapiens
SLTKSSVRI

SEQ ID NO: 649839 - protein, 9 aa, Homo Sapiens
REFQTLVIE

SEQ ID NO: 649840 - protein, 9 aa, Homo Sapiens
VHCEPQGLL

SEQ ID NO: 649841 - protein, 9 aa, Homo Sapiens
YCSTESQSR

SEQ ID NO: 649842 - protein, 9 aa, Homo Sapiens
AREPLRNIE

SEQ ID NO: 649843 - protein, 9 aa, Homo Sapiens
STESQSSSF

SEQ ID NO: 649844 - protein, 9 aa, Homo Sapiens
QLQTGSCCM

SEQ ID NO: 649845 - protein, 9 aa, Homo Sapiens
FGYVVAFKP

SEQ ID NO: 649846 - protein, 9 aa, Homo Sapiens
NKTKTYFWK

SEQ ID NO: 649847 - protein, 9 aa, Homo Sapiens
SLFSKGSDV

SEQ ID NO: 649848 - protein, 9 aa, Homo Sapiens
PGIQGDKGL

SEQ ID NO: 649849 - protein, 9 aa, Homo Sapiens
SSWPGTWNK

SEQ ID NO: 649850 - protein, 9 aa, Homo Sapiens
ITGVDSGSE

SEQ ID NO: 649851 - protein, 9 aa, Homo Sapiens
TRPPGPMTT

SEQ ID NO: 649852 - protein, 9 aa, Homo Sapiens
GRVVMLVMF

SEQ ID NO: 649853 - protein, 9 aa, Homo Sapiens
IEKFIVPYM

SEQ ID NO: 649854 - protein, 9 aa, Homo Sapiens
GRLLPHLAA

SEQ ID NO: 649855 - protein, 9 aa, Homo Sapiens
HACCHPQAV

SEQ ID NO: 649856 - protein, 9 aa, Homo Sapiens
SNNFYKLVT

SEQ ID NO: 649857 - protein, 9 aa, Homo Sapiens
KSDTNWKYK

SEQ ID NO: 649858 - protein, 9 aa, Homo Sapiens
PWNSGGALL

SEQ ID NO: 649859 - protein, 9 aa, Homo Sapiens
PCSQMKLQM

SEQ ID NO: 649860 - protein, 9 aa, Homo Sapiens
NIIVIMAVS

SEQ ID NO: 649861 - protein, 9 aa, Homo Sapiens
ERLETPQED

SEQ ID NO: 649862 - protein, 9 aa, Homo Sapiens
LQIFLCDKI

SEQ ID NO: 649863 - protein, 9 aa, Homo Sapiens
PRKKKRKHQ

SEQ ID NO: 649864 - protein, 9 aa, Homo Sapiens
IYRIPCLDL

SEQ ID NO: 649865 - protein, 9 aa, Homo Sapiens
GDKGQKGIV

SEQ ID NO: 649866 - protein, 9 aa, Homo Sapiens
GLQLEFCHS

SEQ ID NO: 649867 - protein, 9 aa, Homo Sapiens
SGGAPMRDM

SEQ ID NO: 649868 - protein, 9 aa, Homo Sapiens
VGDLLELHY

SEQ ID NO: 649869 - protein, 9 aa, Homo Sapiens
QTIGFAAEQ

SEQ ID NO: 649870 - protein, 9 aa, Homo Sapiens
NTEKFSSES

SEQ ID NO: 649871 - protein, 9 aa, Homo Sapiens
QATHQLVEG

SEQ ID NO: 649872 - protein, 9 aa, Homo Sapiens
SGGGIMSKT

SEQ ID NO: 649873 - protein, 9 aa, Homo Sapiens
NNFGYVVAF

SEQ ID NO: 649874 - protein, 9 aa, Homo Sapiens
GEQNDNRNP

SEQ ID NO: 649875 - protein, 9 aa, Homo Sapiens
PEFTFGLEP

SEQ ID NO: 649876 - protein, 9 aa, Homo Sapiens
VTSTVFKSP

SEQ ID NO: 649877 - protein, 9 aa, Homo Sapiens
LAVDFFIFC

SEQ ID NO: 649878 - protein, 9 aa, Homo Sapiens
CTNFDPLEF

SEQ ID NO: 649879 - protein, 9 aa, Homo Sapiens
SKCENISGT

SEQ ID NO: 649880 - protein, 9 aa, Homo Sapiens
PNTSIEILN

SEQ ID NO: 649881 - protein, 9 aa, Homo Sapiens
SNPDLLQLH

SEQ ID NO: 649882 - protein, 9 aa, Homo Sapiens
NTELCQYLD

SEQ ID NO: 649883 - protein, 9 aa, Homo Sapiens
YRALLFLNS

SEQ ID NO: 649884 - protein, 9 aa, Homo Sapiens
YPRGSQHLI

SEQ ID NO: 649885 - protein, 9 aa, Homo Sapiens
EAVFIHKGY

SEQ ID NO: 649886 - protein, 9 aa, Homo Sapiens
DWREFQTLV

SEQ ID NO: 649887 - protein, 9 aa, Homo Sapiens
SQMNIVHKK

SEQ ID NO: 649888 - protein, 9 aa, Homo Sapiens
QGSKSPDNI

SEQ ID NO: 649889 - protein, 9 aa, Homo Sapiens
SPVGSPVGE

SEQ ID NO: 649890 - protein, 9 aa, Homo Sapiens
PTRKSYTYW

SEQ ID NO: 649891 - protein, 9 aa, Homo Sapiens
GDFERIIMP

SEQ ID NO: 649892 - protein, 9 aa, Homo Sapiens
RSTTRAQVD

SEQ ID NO: 649893 - protein, 9 aa, Homo Sapiens
LAGRVAAAV

SEQ ID NO: 649894 - protein, 9 aa, Homo Sapiens
AESDISIGV

SEQ ID NO: 649895 - protein, 9 aa, Homo Sapiens
GAPRDATSS

SEQ ID NO: 649896 - protein, 9 aa, Homo Sapiens
DGVDVNIPT

SEQ ID NO: 649897 - protein, 9 aa, Homo Sapiens
RISPEPLHQ

SEQ ID NO: 649898 - protein, 9 aa, Homo Sapiens
AGPVTLEPT

SEQ ID NO: 649899 - protein, 9 aa, Homo Sapiens
WQTSYVESS

SEQ ID NO: 649900 - protein, 9 aa, Homo Sapiens
KNPKPDKND

SEQ ID NO: 649901 - protein, 9 aa, Homo Sapiens
ERTVRHEMQ

SEQ ID NO: 649902 - protein, 9 aa, Homo Sapiens
AIEHFQPND

SEQ ID NO: 649903 - protein, 9 aa, Homo Sapiens
WHQDFPVNK

SEQ ID NO: 649904 - protein, 9 aa, Homo Sapiens
HTIILAQQE

SEQ ID NO: 649905 - protein, 9 aa, Homo Sapiens
YAFLLDLFK

SEQ ID NO: 649906 - protein, 9 aa, Homo Sapiens
NKTRIDDAN

SEQ ID NO: 649907 - protein, 9 aa, Homo Sapiens
LVWLFTHDH

SEQ ID NO: 649908 - protein, 9 aa, Homo Sapiens
ALGPWNSGG

SEQ ID NO: 649909 - protein, 9 aa, Homo Sapiens
DGQKEKFKF

SEQ ID NO: 649910 - protein, 9 aa, Homo Sapiens
ILWEDLHNN

SEQ ID NO: 649911 - protein, 9 aa, Homo Sapiens
VKVKIMLDL

SEQ ID NO: 649912 - protein, 9 aa, Homo Sapiens
AMVKALCQL

SEQ ID NO: 649913 - protein, 9 aa, Homo Sapiens
CPRLAWHTR

SEQ ID NO: 649914 - protein, 9 aa, Homo Sapiens
AGRTRRWFF

SEQ ID NO: 649915 - protein, 9 aa, Homo Sapiens
SLSHESLEP

SEQ ID NO: 649916 - protein, 9 aa, Homo Sapiens
TTRLFAPLK

SEQ ID NO: 649917 - protein, 9 aa, Homo Sapiens
HVLQVSEAC

SEQ ID NO: 649918 - protein, 9 aa, Homo Sapiens
DALHSFFQP

SEQ ID NO: 649919 - protein, 9 aa, Homo Sapiens
WKHQNLQRA

SEQ ID NO: 649920 - protein, 9 aa, Homo Sapiens
RETLEKQLS

SEQ ID NO: 649921 - protein, 9 aa, Homo Sapiens
LPKITIKFF

SEQ ID NO: 649922 - protein, 9 aa, Homo Sapiens
LLNARVLRA

SEQ ID NO: 649923 - protein, 9 aa, Homo Sapiens
LVKHGIKKV

SEQ ID NO: 649924 - protein, 9 aa, Homo Sapiens
SKSQSLSHE

SEQ ID NO: 649925 - protein, 9 aa, Homo Sapiens
WAVKIVTCF

SEQ ID NO: 649926 - protein, 9 aa, Homo Sapiens
DYSFVVFRS

SEQ ID NO: 649927 - protein, 9 aa, Homo Sapiens
PEDIQDLGV

SEQ ID NO: 649928 - protein, 9 aa, Homo Sapiens
DVLSSLHST

SEQ ID NO: 649929 - protein, 9 aa, Homo Sapiens
GERLVPIGK

SEQ ID NO: 649930 - protein, 9 aa, Homo Sapiens
LLEGTVRLG

SEQ ID NO: 649931 - protein, 9 aa, Homo Sapiens
TKTFGGVGG

SEQ ID NO: 649932 - protein, 9 aa, Homo Sapiens
AALEQAACK

SEQ ID NO: 649933 - protein, 9 aa, Homo Sapiens
YSKYFGRGI

SEQ ID NO: 649934 - protein, 9 aa, Homo Sapiens
GETSATAVD

SEQ ID NO: 649935 - protein, 9 aa, Homo Sapiens
FPRGTRESR

SEQ ID NO: 649936 - protein, 9 aa, Homo Sapiens
GGGTLVGDI

SEQ ID NO: 649937 - protein, 9 aa, Homo Sapiens
APERIADCT

SEQ ID NO: 649938 - protein, 9 aa, Homo Sapiens
GDFYLQVEH

SEQ ID NO: 649939 - protein, 9 aa, Homo Sapiens
LPVATRLPQ

SEQ ID NO: 649940 - protein, 9 aa, Homo Sapiens
GDYSFVVFR

SEQ ID NO: 649941 - protein, 9 aa, Homo Sapiens
LPEFTFGLE

SEQ ID NO: 649942 - protein, 9 aa, Homo Sapiens
LIYETLSWK

SEQ ID NO: 649943 - protein, 9 aa, Homo Sapiens
EVNYIITTF

SEQ ID NO: 649944 - protein, 9 aa, Homo Sapiens
GQKGIVGRH

SEQ ID NO: 649945 - protein, 9 aa, Homo Sapiens
LGTNFSSRP

SEQ ID NO: 649946 - protein, 9 aa, Homo Sapiens
VSSPNENVA

SEQ ID NO: 649947 - protein, 9 aa, Homo Sapiens
DIVKGGAVY

SEQ ID NO: 649948 - protein, 9 aa, Homo Sapiens
LFQKVILRR

SEQ ID NO: 649949 - protein, 9 aa, Homo Sapiens
FAVMHAQTT

SEQ ID NO: 649950 - protein, 9 aa, Homo Sapiens
LAGETRPLP

SEQ ID NO: 649951 - protein, 9 aa, Homo Sapiens
SRAGGTRVA

SEQ ID NO: 649952 - protein, 9 aa, Homo Sapiens
RPCRSIVFA

SEQ ID NO: 649953 - protein, 9 aa, Homo Sapiens
IRLEGIVNL

SEQ ID NO: 649954 - protein, 9 aa, Homo Sapiens
KVESMQFPV

SEQ ID NO: 649955 - protein, 9 aa, Homo Sapiens
CHSSFTVPK

SEQ ID NO: 649956 - protein, 9 aa, Homo Sapiens
YKFHECGKV

SEQ ID NO: 649957 - protein, 9 aa, Homo Sapiens
LSHDALGTN

SEQ ID NO: 649958 - protein, 9 aa, Homo Sapiens
FHLDWVSSI

SEQ ID NO: 649959 - protein, 9 aa, Homo Sapiens
TEEELLEGT

SEQ ID NO: 649960 - protein, 9 aa, Homo Sapiens
SRFIVIADL

SEQ ID NO: 649961 - protein, 9 aa, Homo Sapiens
LIRNDLLDL

SEQ ID NO: 649962 - protein, 9 aa, Homo Sapiens
PLSEMQTDL

SEQ ID NO: 649963 - protein, 9 aa, Homo Sapiens
HQALGRCWQ

SEQ ID NO: 649964 - protein, 9 aa, Homo Sapiens
VNGPREPRR

SEQ ID NO: 649965 - protein, 9 aa, Homo Sapiens
KDELVGNFY

SEQ ID NO: 649966 - protein, 9 aa, Homo Sapiens
ISQPKNRAE

SEQ ID NO: 649967 - protein, 9 aa, Homo Sapiens
ELYVHCEPQ

SEQ ID NO: 649968 - protein, 9 aa, Homo Sapiens
ENYSNLVAL

SEQ ID NO: 649969 - protein, 9 aa, Homo Sapiens
KGNGLDLSG

SEQ ID NO: 649970 - protein, 9 aa, Homo Sapiens
NYSNLVALG

SEQ ID NO: 649971 - protein, 9 aa, Homo Sapiens
QPDIVKGGA

SEQ ID NO: 649972 - protein, 9 aa, Homo Sapiens
SGSTETPSS

SEQ ID NO: 649973 - protein, 9 aa, Homo Sapiens
ENNGGARLG

SEQ ID NO: 649974 - protein, 9 aa, Homo Sapiens
HPWVTHFAA

SEQ ID NO: 649975 - protein, 9 aa, Homo Sapiens
SSLVLVSLE

SEQ ID NO: 649976 - protein, 9 aa, Homo Sapiens
ETEQMAERK

SEQ ID NO: 649977 - protein, 9 aa, Homo Sapiens
TKSSVRIGQ

SEQ ID NO: 649978 - protein, 9 aa, Homo Sapiens
QGSYPCQCR

SEQ ID NO: 649979 - protein, 9 aa, Homo Sapiens
FHPRKWYMI

SEQ ID NO: 649980 - protein, 9 aa, Homo Sapiens
SISLLSDSK

SEQ ID NO: 649981 - protein, 9 aa, Homo Sapiens
RCLFCFRSL

SEQ ID NO: 649982 - protein, 9 aa, Homo Sapiens
ATAEGGAPK

SEQ ID NO: 649983 - protein, 9 aa, Homo Sapiens
LHLQDLETE

SEQ ID NO: 649984 - protein, 9 aa, Homo Sapiens
EQAACKLDA

SEQ ID NO: 649985 - protein, 9 aa, Homo Sapiens
DAVPCLEEC

SEQ ID NO: 649986 - protein, 9 aa, Homo Sapiens
KVNNNLHKN

SEQ ID NO: 649987 - protein, 9 aa, Homo Sapiens
NQTGFPNKY

SEQ ID NO: 649988 - protein, 9 aa, Homo Sapiens
SFVPPSGHS

SEQ ID NO: 649989 - protein, 9 aa, Homo Sapiens
KDVPRNRGY

SEQ ID NO: 649990 - protein, 9 aa, Homo Sapiens
QPKGYCLRC

SEQ ID NO: 649991 - protein, 9 aa, Homo Sapiens
MTRWKTFQA

SEQ ID NO: 649992 - protein, 9 aa, Homo Sapiens
PTCKLLFEI

SEQ ID NO: 649993 - protein, 9 aa, Homo Sapiens
RLLKIWLYQ

SEQ ID NO: 649994 - protein, 9 aa, Homo Sapiens
EAQWEGLTV

SEQ ID NO: 649995 - protein, 9 aa, Homo Sapiens
NLFGVMSST

SEQ ID NO: 649996 - protein, 9 aa, Homo Sapiens
REPLRNIER

SEQ ID NO: 649997 - protein, 9 aa, Homo Sapiens
TISKLVYNP

SEQ ID NO: 649998 - protein, 9 aa, Homo Sapiens
LSWHASVPG

SEQ ID NO: 649999 - protein, 9 aa, Homo Sapiens
IYSSSNNFY

SEQ ID NO: 650000 - protein, 9 aa, Homo Sapiens
PCRETWRCP

SEQ ID NO: 650001 - protein, 9 aa, Homo Sapiens
AGHPWVTHF

SEQ ID NO: 650002 - protein, 9 aa, Homo Sapiens
GVLYGIDSM

SEQ ID NO: 650003 - protein, 9 aa, Homo Sapiens
IEALSAEDS

SEQ ID NO: 650004 - protein, 9 aa, Homo Sapiens
LKGQSEDPG

SEQ ID NO: 650005 - protein, 9 aa, Homo Sapiens
ITFVIWLLS

SEQ ID NO: 650006 - protein, 9 aa, Homo Sapiens
EGSLFEVQW

SEQ ID NO: 650007 - protein, 9 aa, Homo Sapiens
LVFNLQDPW

SEQ ID NO: 650008 - protein, 9 aa, Homo Sapiens
EDDVLENGS

SEQ ID NO: 650009 - protein, 9 aa, Homo Sapiens
HFKKVRRPS

SEQ ID NO: 650010 - protein, 9 aa, Homo Sapiens
LSILVGAMF

SEQ ID NO: 650011 - protein, 9 aa, Homo Sapiens
GPHQAEPIS

SEQ ID NO: 650012 - protein, 9 aa, Homo Sapiens
FLKDCVGGE

SEQ ID NO: 650013 - protein, 9 aa, Homo Sapiens
KRCLFCFRS

SEQ ID NO: 650014 - protein, 9 aa, Homo Sapiens
KNQKKSKLH

SEQ ID NO: 650015 - protein, 9 aa, Homo Sapiens
PTSMWAHQA

SEQ ID NO: 650016 - protein, 9 aa, Homo Sapiens
FGDFERIIM

SEQ ID NO: 650017 - protein, 9 aa, Homo Sapiens
LDKAQIYDV

SEQ ID NO: 650018 - protein, 9 aa, Homo Sapiens
RALPSLRAW

SEQ ID NO: 650019 - protein, 9 aa, Homo Sapiens
PQAPCKGSG

SEQ ID NO: 650020 - protein, 9 aa, Homo Sapiens
GPFLIIASL

SEQ ID NO: 650021 - protein, 9 aa, Homo Sapiens
FSTYSLLSL

SEQ ID NO: 650022 - protein, 9 aa, Homo Sapiens
YESQTLKEA

SEQ ID NO: 650023 - protein, 9 aa, Homo Sapiens
FLKIMLPSP

SEQ ID NO: 650024 - protein, 9 aa, Homo Sapiens
RIPLPPPTA

SEQ ID NO: 650025 - protein, 9 aa, Homo Sapiens
GACVVVVKI

SEQ ID NO: 650026 - protein, 9 aa, Homo Sapiens
SLRLREVSM

SEQ ID NO: 650027 - protein, 9 aa, Homo Sapiens
HQNLQRAMK

SEQ ID NO: 650028 - protein, 9 aa, Homo Sapiens
WLRPMRTLP

SEQ ID NO: 650029 - protein, 9 aa, Homo Sapiens
PRYYPRGSQ

SEQ ID NO: 650030 - protein, 9 aa, Homo Sapiens
FGSDSQVTR

SEQ ID NO: 650031 - protein, 9 aa, Homo Sapiens
GQLSKKILL

SEQ ID NO: 650032 - protein, 9 aa, Homo Sapiens
FYDRWALGE

SEQ ID NO: 650033 - protein, 9 aa, Homo Sapiens
AILALLLVV

SEQ ID NO: 650034 - protein, 9 aa, Homo Sapiens
TPTVCLSCS

SEQ ID NO: 650035 - protein, 9 aa, Homo Sapiens
PKNRAETLV

SEQ ID NO: 650036 - protein, 9 aa, Homo Sapiens
EVHATSKEA

SEQ ID NO: 650037 - protein, 9 aa, Homo Sapiens
LITIADALF

SEQ ID NO: 650038 - protein, 9 aa, Homo Sapiens
PVATRLPQG

SEQ ID NO: 650039 - protein, 9 aa, Homo Sapiens
ITLDSVTAF

SEQ ID NO: 650040 - protein, 9 aa, Homo Sapiens
YICYPRPCR

SEQ ID NO: 650041 - protein, 9 aa, Homo Sapiens
VVPENKNVS

SEQ ID NO: 650042 - protein, 9 aa, Homo Sapiens
ELAYESQTL

SEQ ID NO: 650043 - protein, 9 aa, Homo Sapiens
QPTEANWGH

SEQ ID NO: 650044 - protein, 9 aa, Homo Sapiens
VNFYEFVAG

SEQ ID NO: 650045 - protein, 9 aa, Homo Sapiens
TAKSNSSLG

SEQ ID NO: 650046 - protein, 9 aa, Homo Sapiens
KQIQFADDI

SEQ ID NO: 650047 - protein, 9 aa, Homo Sapiens
PIVSRMLLQ

SEQ ID NO: 650048 - protein, 9 aa, Homo Sapiens
HRLITIADA

SEQ ID NO: 650049 - protein, 9 aa, Homo Sapiens
CLTLASLRL

SEQ ID NO: 650050 - protein, 9 aa, Homo Sapiens
LKQSLMLMA

SEQ ID NO: 650051 - protein, 9 aa, Homo Sapiens
ISPEPLHQV

SEQ ID NO: 650052 - protein, 9 aa, Homo Sapiens
SSVLSYDIS

SEQ ID NO: 650053 - protein, 9 aa, Homo Sapiens
GLRNGSARA

SEQ ID NO: 650054 - protein, 9 aa, Homo Sapiens
EKRMGGLLF

SEQ ID NO: 650055 - protein, 9 aa, Homo Sapiens
DAAFFNAWA

SEQ ID NO: 650056 - protein, 9 aa, Homo Sapiens
FQLSNVFNP

SEQ ID NO: 650057 - protein, 9 aa, Homo Sapiens
FVNNIFERI

SEQ ID NO: 650058 - protein, 9 aa, Homo Sapiens
NKKGDHANV

SEQ ID NO: 650059 - protein, 9 aa, Homo Sapiens
LKKVSIFHD

SEQ ID NO: 650060 - protein, 9 aa, Homo Sapiens
DGEWCAEDD

SEQ ID NO: 650061 - protein, 9 aa, Homo Sapiens
ESQSSSFHS

SEQ ID NO: 650062 - protein, 9 aa, Homo Sapiens
FVAHLAKHL

SEQ ID NO: 650063 - protein, 9 aa, Homo Sapiens
SSEGYLHLS

SEQ ID NO: 650064 - protein, 9 aa, Homo Sapiens
CENQRRACV

SEQ ID NO: 650065 - protein, 9 aa, Homo Sapiens
IRVAGFRMT

SEQ ID NO: 650066 - protein, 9 aa, Homo Sapiens
ATDVDTGVS

SEQ ID NO: 650067 - protein, 9 aa, Homo Sapiens
KLVERSHIF

SEQ ID NO: 650068 - protein, 9 aa, Homo Sapiens
FNFAPLLFV

SEQ ID NO: 650069 - protein, 9 aa, Homo Sapiens
GIHCGATTT

SEQ ID NO: 650070 - protein, 9 aa, Homo Sapiens
WKKSLATCS

SEQ ID NO: 650071 - protein, 9 aa, Homo Sapiens
GRSTTRAQV

SEQ ID NO: 650072 - protein, 9 aa, Homo Sapiens
YFVAELAAS

SEQ ID NO: 650073 - protein, 9 aa, Homo Sapiens
IFSQRCGAK

SEQ ID NO: 650074 - protein, 9 aa, Homo Sapiens
KFEQEKKHR

SEQ ID NO: 650075 - protein, 9 aa, Homo Sapiens
ALGRCWQRK

SEQ ID NO: 650076 - protein, 9 aa, Homo Sapiens
FMGYSVMVL

SEQ ID NO: 650077 - protein, 9 aa, Homo Sapiens
GYCLRCHRA

SEQ ID NO: 650078 - protein, 9 aa, Homo Sapiens
RLREVSMSP

SEQ ID NO: 650079 - protein, 9 aa, Homo Sapiens
FDFQWHKIM

SEQ ID NO: 650080 - protein, 9 aa, Homo Sapiens
WSDISELLV

SEQ ID NO: 650081 - protein, 9 aa, Homo Sapiens
VSTESQSSS

SEQ ID NO: 650082 - protein, 9 aa, Homo Sapiens
NPLNEDLHH

SEQ ID NO: 650083 - protein, 9 aa, Homo Sapiens
ILSGHTDGT

SEQ ID NO: 650084 - protein, 9 aa, Homo Sapiens
NGIITGYHI

SEQ ID NO: 650085 - protein, 9 aa, Homo Sapiens
TTVSAFAAF

SEQ ID NO: 650086 - protein, 9 aa, Homo Sapiens
QSAGCQNTM

SEQ ID NO: 650087 - protein, 9 aa, Homo Sapiens
EPLFDVLQK

SEQ ID NO: 650088 - protein, 9 aa, Homo Sapiens
HCQECGLAV

SEQ ID NO: 650089 - protein, 9 aa, Homo Sapiens
DWKMKDNQK

SEQ ID NO: 650090 - protein, 9 aa, Homo Sapiens
GSTECVLLI

SEQ ID NO: 650091 - protein, 9 aa, Homo Sapiens
ANRESQGEK

SEQ ID NO: 650092 - protein, 9 aa, Homo Sapiens
IMTIGGNII

SEQ ID NO: 650093 - protein, 9 aa, Homo Sapiens
SDKQQAELV

SEQ ID NO: 650094 - protein, 9 aa, Homo Sapiens
PSPTTLAFG

SEQ ID NO: 650095 - protein, 9 aa, Homo Sapiens
LISYWIPKK

SEQ ID NO: 650096 - protein, 9 aa, Homo Sapiens
DLLDEAGST

SEQ ID NO: 650097 - protein, 9 aa, Homo Sapiens
NNLAVTYFF

SEQ ID NO: 650098 - protein, 9 aa, Homo Sapiens
EEIVEHGAI

SEQ ID NO: 650099 - protein, 9 aa, Homo Sapiens
GSFNFAPLL

SEQ ID NO: 650100 - protein, 9 aa, Homo Sapiens
DVIEQFWDF

SEQ ID NO: 650101 - protein, 9 aa, Homo Sapiens
GAIEEREMR

SEQ ID NO: 650102 - protein, 9 aa, Homo Sapiens
QDFPVNKRK

SEQ ID NO: 650103 - protein, 9 aa, Homo Sapiens
TACSPDYTL

SEQ ID NO: 650104 - protein, 9 aa, Homo Sapiens
LLSAYTRPS

SEQ ID NO: 650105 - protein, 9 aa, Homo Sapiens
PDANLLNAR

SEQ ID NO: 650106 - protein, 9 aa, Homo Sapiens
FVLFQFLFT

SEQ ID NO: 650107 - protein, 9 aa, Homo Sapiens
TRPLPLGVI

SEQ ID NO: 650108 - protein, 9 aa, Homo Sapiens
GSGTTMDSR

SEQ ID NO: 650109 - protein, 9 aa, Homo Sapiens
RKHARFPST

SEQ ID NO: 650110 - protein, 9 aa, Homo Sapiens
TLEKQLSME

SEQ ID NO: 650111 - protein, 9 aa, Homo Sapiens
ATMSLPLAG

SEQ ID NO: 650112 - protein, 9 aa, Homo Sapiens
NDTEDDPTL

SEQ ID NO: 650113 - protein, 9 aa, Homo Sapiens
VSDFTDRNR

SEQ ID NO: 650114 - protein, 9 aa, Homo Sapiens
DDVLENGSS

SEQ ID NO: 650115 - protein, 9 aa, Homo Sapiens
ALGPRLGSE

SEQ ID NO: 650116 - protein, 9 aa, Homo Sapiens
CILGNIEET

SEQ ID NO: 650117 - protein, 9 aa, Homo Sapiens
KSVYRALLF

SEQ ID NO: 650118 - protein, 9 aa, Homo Sapiens
ASQPNSHPI

SEQ ID NO: 650119 - protein, 9 aa, Homo Sapiens
GRRRKTLKL

SEQ ID NO: 650120 - protein, 9 aa, Homo Sapiens
AEHLEKTLS

SEQ ID NO: 650121 - protein, 9 aa, Homo Sapiens
PCNASIECD

SEQ ID NO: 650122 - protein, 9 aa, Homo Sapiens
EGNSDQLMG

SEQ ID NO: 650123 - protein, 9 aa, Homo Sapiens
EFQTLVIEM

SEQ ID NO: 650124 - protein, 9 aa, Homo Sapiens
SMTSKAGLP

SEQ ID NO: 650125 - protein, 9 aa, Homo Sapiens
GFASLGGAD

SEQ ID NO: 650126 - protein, 9 aa, Homo Sapiens
ADTFDLQTI

SEQ ID NO: 650127 - protein, 9 aa, Homo Sapiens
IQSEDYHHE

SEQ ID NO: 650128 - protein, 9 aa, Homo Sapiens
ANRHNHGDS

SEQ ID NO: 650129 - protein, 9 aa, Homo Sapiens
PPPTAPETY

SEQ ID NO: 650130 - protein, 9 aa, Homo Sapiens
QLIVDMPTY

SEQ ID NO: 650131 - protein, 9 aa, Homo Sapiens
QPHSRSLPD

SEQ ID NO: 650132 - protein, 9 aa, Homo Sapiens
CSQMKLQMD

SEQ ID NO: 650133 - protein, 9 aa, Homo Sapiens
QNIEDEIKL

SEQ ID NO: 650134 - protein, 9 aa, Homo Sapiens
QMAIHIYSG

SEQ ID NO: 650135 - protein, 9 aa, Homo Sapiens
EKLQEPLFD

SEQ ID NO: 650136 - protein, 9 aa, Homo Sapiens
CTFFFLHKE

SEQ ID NO: 650137 - protein, 9 aa, Homo Sapiens
LQAFQNIED

SEQ ID NO: 650138 - protein, 9 aa, Homo Sapiens
KEKVSSLVL

SEQ ID NO: 650139 - protein, 9 aa, Homo Sapiens
GAHVSGFVG

SEQ ID NO: 650140 - protein, 9 aa, Homo Sapiens
STVSQYSAW

SEQ ID NO: 650141 - protein, 9 aa, Homo Sapiens
SLALYEENI

SEQ ID NO: 650142 - protein, 9 aa, Homo Sapiens
EDELIAQKS

SEQ ID NO: 650143 - protein, 9 aa, Homo Sapiens
KCFSGQLSK

SEQ ID NO: 650144 - protein, 9 aa, Homo Sapiens
YADKSVGNN

SEQ ID NO: 650145 - protein, 9 aa, Homo Sapiens
PWLSLFPRG

SEQ ID NO: 650146 - protein, 9 aa, Homo Sapiens
VLDEQTALN

SEQ ID NO: 650147 - protein, 9 aa, Homo Sapiens
QVADYYGKC

SEQ ID NO: 650148 - protein, 9 aa, Homo Sapiens
VELGPGGGT

SEQ ID NO: 650149 - protein, 9 aa, Homo Sapiens
SQAKCEASH

SEQ ID NO: 650150 - protein, 9 aa, Homo Sapiens
FGGVGGGAR

SEQ ID NO: 650151 - protein, 9 aa, Homo Sapiens
SSCGKTNLA

SEQ ID NO: 650152 - protein, 9 aa, Homo Sapiens
KEVWAGHTV

SEQ ID NO: 650153 - protein, 9 aa, Homo Sapiens
PVLGICYGV

SEQ ID NO: 650154 - protein, 9 aa, Homo Sapiens
NFYKLVTDG

SEQ ID NO: 650155 - protein, 9 aa, Homo Sapiens
GKSYECQAE

SEQ ID NO: 650156 - protein, 9 aa, Homo Sapiens
YYSPGLHVQ

SEQ ID NO: 650157 - protein, 9 aa, Homo Sapiens
ESAAKSTST

SEQ ID NO: 650158 - protein, 9 aa, Homo Sapiens
NASLCDPTF

SEQ ID NO: 650159 - protein, 9 aa, Homo Sapiens
ASTVVNGVA

SEQ ID NO: 650160 - protein, 9 aa, Homo Sapiens
WLFTHDHMS

SEQ ID NO: 650161 - protein, 9 aa, Homo Sapiens
GEKPYKFHE

SEQ ID NO: 650162 - protein, 9 aa, Homo Sapiens
TKELLSTIR

SEQ ID NO: 650163 - protein, 9 aa, Homo Sapiens
LVPVVQVRL

SEQ ID NO: 650164 - protein, 9 aa, Homo Sapiens
LPQIYYIES

SEQ ID NO: 650165 - protein, 9 aa, Homo Sapiens
VQLPFPPCT

SEQ ID NO: 650166 - protein, 9 aa, Homo Sapiens
FAVSDNESD

SEQ ID NO: 650167 - protein, 9 aa, Homo Sapiens
GSRPSETFA

SEQ ID NO: 650168 - protein, 9 aa, Homo Sapiens
TLKKVSIFH

SEQ ID NO: 650169 - protein, 9 aa, Homo Sapiens
LRARLTLVS

SEQ ID NO: 650170 - protein, 9 aa, Homo Sapiens
AQIKEGGKS

SEQ ID NO: 650171 - protein, 9 aa, Homo Sapiens
LPWGALVSF

SEQ ID NO: 650172 - protein, 9 aa, Homo Sapiens
TAKRCLFCF

SEQ ID NO: 650173 - protein, 9 aa, Homo Sapiens
RELIIADRQ

SEQ ID NO: 650174 - protein, 9 aa, Homo Sapiens
PGGGTLVGD

SEQ ID NO: 650175 - protein, 9 aa, Homo Sapiens
SPGLSWHAS

SEQ ID NO: 650176 - protein, 9 aa, Homo Sapiens
DKAQIYDVV

SEQ ID NO: 650177 - protein, 9 aa, Homo Sapiens
RLETPQEDH

SEQ ID NO: 650178 - protein, 9 aa, Homo Sapiens
VEEGDTALL

SEQ ID NO: 650179 - protein, 9 aa, Homo Sapiens
GTWNKSCRS

SEQ ID NO: 650180 - protein, 9 aa, Homo Sapiens
KKQPKGYCL

SEQ ID NO: 650181 - protein, 9 aa, Homo Sapiens
ITVNGPREP

SEQ ID NO: 650182 - protein, 9 aa, Homo Sapiens
LLCTKDKLL

SEQ ID NO: 650183 - protein, 9 aa, Homo Sapiens
VRKTTKKIG

SEQ ID NO: 650184 - protein, 9 aa, Homo Sapiens
TEANWGHRT

SEQ ID NO: 650185 - protein, 9 aa, Homo Sapiens
HQLVEGESY

SEQ ID NO: 650186 - protein, 9 aa, Homo Sapiens
TNSCTCPND

SEQ ID NO: 650187 - protein, 9 aa, Homo Sapiens
AWLPRGPPQ

SEQ ID NO: 650188 - protein, 9 aa, Homo Sapiens
KTRIDDANQ

SEQ ID NO: 650189 - protein, 9 aa, Homo Sapiens
STVKKEASE

SEQ ID NO: 650190 - protein, 9 aa, Homo Sapiens
AAENKQMLK

SEQ ID NO: 650191 - protein, 9 aa, Homo Sapiens
QPPAKLSIG

SEQ ID NO: 650192 - protein, 9 aa, Homo Sapiens
LTNDSLTLF

SEQ ID NO: 650193 - protein, 9 aa, Homo Sapiens
HYLAQLAFW

SEQ ID NO: 650194 - protein, 9 aa, Homo Sapiens
LERSPGGGR

SEQ ID NO: 650195 - protein, 9 aa, Homo Sapiens
LWEDLHNNS

SEQ ID NO: 650196 - protein, 9 aa, Homo Sapiens
LLQHLQRHI

SEQ ID NO: 650197 - protein, 9 aa, Homo Sapiens
ETSNPYADD

SEQ ID NO: 650198 - protein, 9 aa, Homo Sapiens
LGLQLEFCH

SEQ ID NO: 650199 - protein, 9 aa, Homo Sapiens
DWWQEWPMY

SEQ ID NO: 650200 - protein, 9 aa, Homo Sapiens
PLHVTSLSS

SEQ ID NO: 650201 - protein, 9 aa, Homo Sapiens
NGPREPRRH

SEQ ID NO: 650202 - protein, 9 aa, Homo Sapiens
CNTSCSPVF

SEQ ID NO: 650203 - protein, 9 aa, Homo Sapiens
AASGWTVSP

SEQ ID NO: 650204 - protein, 9 aa, Homo Sapiens
ICKENVFPG

SEQ ID NO: 650205 - protein, 9 aa, Homo Sapiens
PGIESRVEE

SEQ ID NO: 650206 - protein, 9 aa, Homo Sapiens
PPVDPESRT

SEQ ID NO: 650207 - protein, 9 aa, Homo Sapiens
TMDSRVQVN

SEQ ID NO: 650208 - protein, 9 aa, Homo Sapiens
NILGKYMEQ

SEQ ID NO: 650209 - protein, 9 aa, Homo Sapiens
VTEEELLEG

SEQ ID NO: 650210 - protein, 9 aa, Homo Sapiens
MLCGVEAIQ

SEQ ID NO: 650211 - protein, 9 aa, Homo Sapiens
ASQADGTPA

SEQ ID NO: 650212 - protein, 9 aa, Homo Sapiens
LSGEPELER

SEQ ID NO: 650213 - protein, 9 aa, Homo Sapiens
QLTAKRAGF

SEQ ID NO: 650214 - protein, 9 aa, Homo Sapiens
ILRNGLLTI

SEQ ID NO: 650215 - protein, 9 aa, Homo Sapiens
QLTAKSNSS

SEQ ID NO: 650216 - protein, 9 aa, Homo Sapiens
LAGVWGSSW

SEQ ID NO: 650217 - protein, 9 aa, Homo Sapiens
SCSLTKHKK

SEQ ID NO: 650218 - protein, 9 aa, Homo Sapiens
SEAVFIHKG

SEQ ID NO: 650219 - protein, 9 aa, Homo Sapiens
SGWTVSPRV

SEQ ID NO: 650220 - protein, 9 aa, Homo Sapiens
LGADGVDVN

SEQ ID NO: 650221 - protein, 9 aa, Homo Sapiens
VLFLGRSVI

SEQ ID NO: 650222 - protein, 9 aa, Homo Sapiens
SLNVSQDLY

SEQ ID NO: 650223 - protein, 9 aa, Homo Sapiens
TLVSRASFC

SEQ ID NO: 650224 - protein, 9 aa, Homo Sapiens
NESQVEPSV

SEQ ID NO: 650225 - protein, 9 aa, Homo Sapiens
LQVEHQEEQ

SEQ ID NO: 650226 - protein, 9 aa, Homo Sapiens
SFQDITVSD

SEQ ID NO: 650227 - protein, 9 aa, Homo Sapiens
KCVDFHTLK

SEQ ID NO: 650228 - protein, 9 aa, Homo Sapiens
LPEAVKEKI

SEQ ID NO: 650229 - protein, 9 aa, Homo Sapiens
RVIKLIGQT

SEQ ID NO: 650230 - protein, 9 aa, Homo Sapiens
IYFSQEELG

SEQ ID NO: 650231 - protein, 9 aa, Homo Sapiens
PLIRAINSS

SEQ ID NO: 650232 - protein, 9 aa, Homo Sapiens
RPSRADPNH

SEQ ID NO: 650233 - protein, 9 aa, Homo Sapiens
NIPTDFEGW

SEQ ID NO: 650234 - protein, 9 aa, Homo Sapiens
FLLDENLLK

SEQ ID NO: 650235 - protein, 9 aa, Homo Sapiens
IECDKCQRR

SEQ ID NO: 650236 - protein, 9 aa, Homo Sapiens
IPALQPVAS

SEQ ID NO: 650237 - protein, 9 aa, Homo Sapiens
DADPSTNDF

SEQ ID NO: 650238 - protein, 9 aa, Homo Sapiens
ESRKEPEQL

SEQ ID NO: 650239 - protein, 9 aa, Homo Sapiens
SSSVLSYDI

SEQ ID NO: 650240 - protein, 9 aa, Homo Sapiens
TVEPPSKDF

SEQ ID NO: 650241 - protein, 9 aa, Homo Sapiens
GQMIQIVSA

SEQ ID NO: 650242 - protein, 9 aa, Homo Sapiens
AKFQENQKE

SEQ ID NO: 650243 - protein, 9 aa, Homo Sapiens
AEPISDHRM

SEQ ID NO: 650244 - protein, 9 aa, Homo Sapiens
SVSTESQSS

SEQ ID NO: 650245 - protein, 9 aa, Homo Sapiens
TQLPEAVKE

SEQ ID NO: 650246 - protein, 9 aa, Homo Sapiens
TAIEYRLQA

SEQ ID NO: 650247 - protein, 9 aa, Homo Sapiens
LEKIYNGVI

SEQ ID NO: 650248 - protein, 9 aa, Homo Sapiens
ALQPVASFA

SEQ ID NO: 650249 - protein, 9 aa, Homo Sapiens
KSLQASLKV

SEQ ID NO: 650250 - protein, 9 aa, Homo Sapiens
SVLTDINFA

SEQ ID NO: 650251 - protein, 9 aa, Homo Sapiens
EKRSNVGLR

SEQ ID NO: 650252 - protein, 9 aa, Homo Sapiens
HLRLLWRNL

SEQ ID NO: 650253 - protein, 9 aa, Homo Sapiens
GIPFFPSAN

SEQ ID NO: 650254 - protein, 9 aa, Homo Sapiens
PFIKELVSD

SEQ ID NO: 650255 - protein, 9 aa, Homo Sapiens
TIGGNIIVI

SEQ ID NO: 650256 - protein, 9 aa, Homo Sapiens
IMSKTCTYE

SEQ ID NO: 650257 - protein, 9 aa, Homo Sapiens
NARVLRAML

SEQ ID NO: 650258 - protein, 9 aa, Homo Sapiens
NTSIEILNP

SEQ ID NO: 650259 - protein, 9 aa, Homo Sapiens
DELVGNFYS

SEQ ID NO: 650260 - protein, 9 aa, Homo Sapiens
RCALRSQRG

SEQ ID NO: 650261 - protein, 9 aa, Homo Sapiens
AKRCLFCFR

SEQ ID NO: 650262 - protein, 9 aa, Homo Sapiens
CEKTFRQSS

SEQ ID NO: 650263 - protein, 9 aa, Homo Sapiens
NNIFERIAG

SEQ ID NO: 650264 - protein, 9 aa, Homo Sapiens
GATAIEYRL

SEQ ID NO: 650265 - protein, 9 aa, Homo Sapiens
KFFAPDPEN

SEQ ID NO: 650266 - protein, 9 aa, Homo Sapiens
TTRAQVDLV

SEQ ID NO: 650267 - protein, 9 aa, Homo Sapiens
RNESTQKKN

SEQ ID NO: 650268 - protein, 9 aa, Homo Sapiens
TCYYWEKCS

SEQ ID NO: 650269 - protein, 9 aa, Homo Sapiens
KNPQGSKSP

SEQ ID NO: 650270 - protein, 9 aa, Homo Sapiens
MLKATMSLP

SEQ ID NO: 650271 - protein, 9 aa, Homo Sapiens
MAEHLEKTL

SEQ ID NO: 650272 - protein, 9 aa, Homo Sapiens
NEEMEWVKQ

SEQ ID NO: 650273 - protein, 9 aa, Homo Sapiens
LTEEDAGNY

SEQ ID NO: 650274 - protein, 9 aa, Homo Sapiens
EALSAEDSF

SEQ ID NO: 650275 - protein, 9 aa, Homo Sapiens
TFGLEPRVA

SEQ ID NO: 650276 - protein, 9 aa, Homo Sapiens
PVLEKILFV

SEQ ID NO: 650277 - protein, 9 aa, Homo Sapiens
VVVKANSGT

SEQ ID NO: 650278 - protein, 9 aa, Homo Sapiens
LSPEGSVAN

SEQ ID NO: 650279 - protein, 9 aa, Homo Sapiens
LIVDMPTYN

SEQ ID NO: 650280 - protein, 9 aa, Homo Sapiens
LKRREMARE

SEQ ID NO: 650281 - protein, 9 aa, Homo Sapiens
THFAAGPGL

SEQ ID NO: 650282 - protein, 9 aa, Homo Sapiens
KVSIFHDCE

SEQ ID NO: 650283 - protein, 9 aa, Homo Sapiens
RKQHMNTKR

SEQ ID NO: 650284 - protein, 9 aa, Homo Sapiens
YMPKWLYFM

SEQ ID NO: 650285 - protein, 9 aa, Homo Sapiens
SFSEETNSC

SEQ ID NO: 650286 - protein, 9 aa, Homo Sapiens
CIRDAAAAA

SEQ ID NO: 650287 - protein, 9 aa, Homo Sapiens
SARCSVLIK

SEQ ID NO: 650288 - protein, 9 aa, Homo Sapiens
GVVVKANSG

SEQ ID NO: 650289 - protein, 9 aa, Homo Sapiens
VATRLPQGA

SEQ ID NO: 650290 - protein, 9 aa, Homo Sapiens
KCREEVRGI

SEQ ID NO: 650291 - protein, 9 aa, Homo Sapiens
VADHYLAQL

SEQ ID NO: 650292 - protein, 9 aa, Homo Sapiens
VDTGVSGEI

SEQ ID NO: 650293 - protein, 9 aa, Homo Sapiens
SNITIPKKL

SEQ ID NO: 650294 - protein, 9 aa, Homo Sapiens
PELERAFMD

SEQ ID NO: 650295 - protein, 9 aa, Homo Sapiens
LACTDITSI

SEQ ID NO: 650296 - protein, 9 aa, Homo Sapiens
WRPCRSIVF

SEQ ID NO: 650297 - protein, 9 aa, Homo Sapiens
ALHALSPGL

SEQ ID NO: 650298 - protein, 9 aa, Homo Sapiens
QFLKQSLML

SEQ ID NO: 650299 - protein, 9 aa, Homo Sapiens
SPDYLQVLD

SEQ ID NO: 650300 - protein, 9 aa, Homo Sapiens
NQGRSSLQA

SEQ ID NO: 650301 - protein, 9 aa, Homo Sapiens
ECQAEQTIS

SEQ ID NO: 650302 - protein, 9 aa, Homo Sapiens
LLKIWKHQN

SEQ ID NO: 650303 - protein, 9 aa, Homo Sapiens
AGLLCQGEQ

SEQ ID NO: 650304 - protein, 9 aa, Homo Sapiens
SAASAGRTR

SEQ ID NO: 650305 - protein, 9 aa, Homo Sapiens
PDLLQLHHR

SEQ ID NO: 650306 - protein, 9 aa, Homo Sapiens
KDNQKCSQC

SEQ ID NO: 650307 - protein, 9 aa, Homo Sapiens
ESYWVMEGL

SEQ ID NO: 650308 - protein, 9 aa, Homo Sapiens
GYPQFAPAV

SEQ ID NO: 650309 - protein, 9 aa, Homo Sapiens
ILLNDNNLA

SEQ ID NO: 650310 - protein, 9 aa, Homo Sapiens
EDKNRKKIP

SEQ ID NO: 650311 - protein, 9 aa, Homo Sapiens
LMASFLPRT

SEQ ID NO: 650312 - protein, 9 aa, Homo Sapiens
PNKTKTYFW

SEQ ID NO: 650313 - protein, 9 aa, Homo Sapiens
WWQEWPMYQ

SEQ ID NO: 650314 - protein, 9 aa, Homo Sapiens
LTDINFAMK

SEQ ID NO: 650315 - protein, 9 aa, Homo Sapiens
PQHLGECGH

SEQ ID NO: 650316 - protein, 9 aa, Homo Sapiens
VGLRQLTVW

SEQ ID NO: 650317 - protein, 9 aa, Homo Sapiens
IQDFWRRSC

SEQ ID NO: 650318 - protein, 9 aa, Homo Sapiens
VETSNPYAD

SEQ ID NO: 650319 - protein, 9 aa, Homo Sapiens
GVDSGSEAE

SEQ ID NO: 650320 - protein, 9 aa, Homo Sapiens
VRPHKCKIC

SEQ ID NO: 650321 - protein, 9 aa, Homo Sapiens
HVCSNNSDP

SEQ ID NO: 650322 - protein, 9 aa, Homo Sapiens
IILRNGLLT

SEQ ID NO: 650323 - protein, 9 aa, Homo Sapiens
DTIWDMRNL

SEQ ID NO: 650324 - protein, 9 aa, Homo Sapiens
TCSDKQQAE

SEQ ID NO: 650325 - protein, 9 aa, Homo Sapiens
PRSQRNLGK

SEQ ID NO: 650326 - protein, 9 aa, Homo Sapiens
PQEDLVRFM

SEQ ID NO: 650327 - protein, 9 aa, Homo Sapiens
DIQDLGVRF

SEQ ID NO: 650328 - protein, 9 aa, Homo Sapiens
DKKGIPPDQ

SEQ ID NO: 650329 - protein, 9 aa, Homo Sapiens
DPLGLQLGL

SEQ ID NO: 650330 - protein, 9 aa, Homo Sapiens
FAFFIDKVR

SEQ ID NO: 650331 - protein, 9 aa, Homo Sapiens
QTDLFTCCK

SEQ ID NO: 650332 - protein, 9 aa, Homo Sapiens
LHALSPGLS

SEQ ID NO: 650333 - protein, 9 aa, Homo Sapiens
LSAYTRPSC

SEQ ID NO: 650334 - protein, 9 aa, Homo Sapiens
MAAAGHFPG

SEQ ID NO: 650335 - protein, 9 aa, Homo Sapiens
FTFGLEPRV

SEQ ID NO: 650336 - protein, 9 aa, Homo Sapiens
WYIPQSLWG

SEQ ID NO: 650337 - protein, 9 aa, Homo Sapiens
GGHTAVAIC

SEQ ID NO: 650338 - protein, 9 aa, Homo Sapiens
KCGNLQPTS

SEQ ID NO: 650339 - protein, 9 aa, Homo Sapiens
HTDGTIVRY

SEQ ID NO: 650340 - protein, 9 aa, Homo Sapiens
FFMAFRNTD

SEQ ID NO: 650341 - protein, 9 aa, Homo Sapiens
EKTFRQSSC

SEQ ID NO: 650342 - protein, 9 aa, Homo Sapiens
SVSGLHSKA

SEQ ID NO: 650343 - protein, 9 aa, Homo Sapiens
RFIVIADLR

SEQ ID NO: 650344 - protein, 9 aa, Homo Sapiens
SQADGTPAK

SEQ ID NO: 650345 - protein, 9 aa, Homo Sapiens
APLLFVLSS

SEQ ID NO: 650346 - protein, 9 aa, Homo Sapiens
PNSNLEKIY

SEQ ID NO: 650347 - protein, 9 aa, Homo Sapiens
GCTGHWEQL

SEQ ID NO: 650348 - protein, 9 aa, Homo Sapiens
FDKARNENK

SEQ ID NO: 650349 - protein, 9 aa, Homo Sapiens
IRASLFSKG

SEQ ID NO: 650350 - protein, 9 aa, Homo Sapiens
LLQLHHRIL

SEQ ID NO: 650351 - protein, 9 aa, Homo Sapiens
VATLEDEGT

SEQ ID NO: 650352 - protein, 9 aa, Homo Sapiens
HHIQEMMVQ

SEQ ID NO: 650353 - protein, 9 aa, Homo Sapiens
GYQTYVHFP

SEQ ID NO: 650354 - protein, 9 aa, Homo Sapiens
SAPQLEAVL

SEQ ID NO: 650355 - protein, 9 aa, Homo Sapiens
APETQAKPS

SEQ ID NO: 650356 - protein, 9 aa, Homo Sapiens
RHMMDRRYR

SEQ ID NO: 650357 - protein, 9 aa, Homo Sapiens
RQFLKQSLM

SEQ ID NO: 650358 - protein, 9 aa, Homo Sapiens
FILFGLTDD

SEQ ID NO: 650359 - protein, 9 aa, Homo Sapiens
KRLLKCVHH

SEQ ID NO: 650360 - protein, 9 aa, Homo Sapiens
SYLDSGIHC

SEQ ID NO: 650361 - protein, 9 aa, Homo Sapiens
ESLSLIHAV

SEQ ID NO: 650362 - protein, 9 aa, Homo Sapiens
EEEEGEGNS

SEQ ID NO: 650363 - protein, 9 aa, Homo Sapiens
GQPSDENSF

SEQ ID NO: 650364 - protein, 9 aa, Homo Sapiens
NQRRACVKK

SEQ ID NO: 650365 - protein, 9 aa, Homo Sapiens
FRFAGTHAE

SEQ ID NO: 650366 - protein, 9 aa, Homo Sapiens
KLRFPTKQD

SEQ ID NO: 650367 - protein, 9 aa, Homo Sapiens
SEKPSLFNG

SEQ ID NO: 650368 - protein, 9 aa, Homo Sapiens
LKNAMKIES

SEQ ID NO: 650369 - protein, 9 aa, Homo Sapiens
LNLCDISVD

SEQ ID NO: 650370 - protein, 9 aa, Homo Sapiens
LENEENWKS

SEQ ID NO: 650371 - protein, 9 aa, Homo Sapiens
TGNDLSPTV

SEQ ID NO: 650372 - protein, 9 aa, Homo Sapiens
PQGPPAALQ

SEQ ID NO: 650373 - protein, 9 aa, Homo Sapiens
PTNVLNVSI

SEQ ID NO: 650374 - protein, 9 aa, Homo Sapiens
LSDWEWCSS

SEQ ID NO: 650375 - protein, 9 aa, Homo Sapiens
CRGLVEVLY

SEQ ID NO: 650376 - protein, 9 aa, Homo Sapiens
EAGHPWVTH

SEQ ID NO: 650377 - protein, 9 aa, Homo Sapiens
RAALSILVG

SEQ ID NO: 650378 - protein, 9 aa, Homo Sapiens
DDEMSEDDV

SEQ ID NO: 650379 - protein, 9 aa, Homo Sapiens
SFPSDTFDT

SEQ ID NO: 650380 - protein, 9 aa, Homo Sapiens
SGQLSKKIL

SEQ ID NO: 650381 - protein, 9 aa, Homo Sapiens
NKTGTMYWV

SEQ ID NO: 650382 - protein, 9 aa, Homo Sapiens
IPALHALSP

SEQ ID NO: 650383 - protein, 9 aa, Homo Sapiens
KEGMKYIKL

SEQ ID NO: 650384 - protein, 9 aa, Homo Sapiens
DFGICKENV

SEQ ID NO: 650385 - protein, 9 aa, Homo Sapiens
LASPNAATS

SEQ ID NO: 650386 - protein, 9 aa, Homo Sapiens
CLENEENWK

SEQ ID NO: 650387 - protein, 9 aa, Homo Sapiens
LEQAACKLD

SEQ ID NO: 650388 - protein, 9 aa, Homo Sapiens
SGIHCGATT

SEQ ID NO: 650389 - protein, 9 aa, Homo Sapiens
RPNSPSPTT

SEQ ID NO: 650390 - protein, 9 aa, Homo Sapiens
SWDSIFGDF

SEQ ID NO: 650391 - protein, 9 aa, Homo Sapiens
AALSILVGA

SEQ ID NO: 650392 - protein, 9 aa, Homo Sapiens
PKITIKFFA

SEQ ID NO: 650393 - protein, 9 aa, Homo Sapiens
HEKQLAQID

SEQ ID NO: 650394 - protein, 9 aa, Homo Sapiens
ASGVFQTTD

SEQ ID NO: 650395 - protein, 9 aa, Homo Sapiens
CYGVQMMNK

SEQ ID NO: 650396 - protein, 9 aa, Homo Sapiens
RKTTKKIGT

SEQ ID NO: 650397 - protein, 9 aa, Homo Sapiens
TAPETQAKP

SEQ ID NO: 650398 - protein, 9 aa, Homo Sapiens
GSNCGESRE

SEQ ID NO: 650399 - protein, 9 aa, Homo Sapiens
LIIADRQTG

SEQ ID NO: 650400 - protein, 9 aa, Homo Sapiens
LHTTPKQGF

SEQ ID NO: 650401 - protein, 9 aa, Homo Sapiens
SSMKSNFLQ

SEQ ID NO: 650402 - protein, 9 aa, Homo Sapiens
NKLLQNWTE

SEQ ID NO: 650403 - protein, 9 aa, Homo Sapiens
TALLLYSRI

SEQ ID NO: 650404 - protein, 9 aa, Homo Sapiens
LIRTTMQVG

SEQ ID NO: 650405 - protein, 9 aa, Homo Sapiens
SRVLALLDR

SEQ ID NO: 650406 - protein, 9 aa, Homo Sapiens
LRRLHEMKK

SEQ ID NO: 650407 - protein, 9 aa, Homo Sapiens
ELQQQYEDV

SEQ ID NO: 650408 - protein, 9 aa, Homo Sapiens
AIHIYSGNT

SEQ ID NO: 650409 - protein, 9 aa, Homo Sapiens
DSNKTRIDD

SEQ ID NO: 650410 - protein, 9 aa, Homo Sapiens
EHQEKCREE

SEQ ID NO: 650411 - protein, 9 aa, Homo Sapiens
VGGNIGVRT

SEQ ID NO: 650412 - protein, 9 aa, Homo Sapiens
QLPELPNTL

SEQ ID NO: 650413 - protein, 9 aa, Homo Sapiens
FQESEERPN

SEQ ID NO: 650414 - protein, 9 aa, Homo Sapiens
KKTGHQRTS

SEQ ID NO: 650415 - protein, 9 aa, Homo Sapiens
RVSTASKGA

SEQ ID NO: 650416 - protein, 9 aa, Homo Sapiens
FIRLEGIVN

SEQ ID NO: 650417 - protein, 9 aa, Homo Sapiens
VFAVMHAQT

SEQ ID NO: 650418 - protein, 9 aa, Homo Sapiens
DIAVHGWAL

SEQ ID NO: 650419 - protein, 9 aa, Homo Sapiens
TTNDTAANS

SEQ ID NO: 650420 - protein, 9 aa, Homo Sapiens
TVNILIVDE

SEQ ID NO: 650421 - protein, 9 aa, Homo Sapiens
LLHEKFYCL

SEQ ID NO: 650422 - protein, 9 aa, Homo Sapiens
KTRWTLKNI

SEQ ID NO: 650423 - protein, 9 aa, Homo Sapiens
ADVLSSLHS

SEQ ID NO: 650424 - protein, 9 aa, Homo Sapiens
AFLLDLFKK

SEQ ID NO: 650425 - protein, 9 aa, Homo Sapiens
VLLRQPPAK

SEQ ID NO: 650426 - protein, 9 aa, Homo Sapiens
VNKRKKLST

SEQ ID NO: 650427 - protein, 9 aa, Homo Sapiens
EEVASKLDH

SEQ ID NO: 650428 - protein, 9 aa, Homo Sapiens
SPTHISDAW

SEQ ID NO: 650429 - protein, 9 aa, Homo Sapiens
ETPGGRLGE

SEQ ID NO: 650430 - protein, 9 aa, Homo Sapiens
YDQNEIKEQ

SEQ ID NO: 650431 - protein, 9 aa, Homo Sapiens
CVKYDFHPR

SEQ ID NO: 650432 - protein, 9 aa, Homo Sapiens
IYETLSWKY

SEQ ID NO: 650433 - protein, 9 aa, Homo Sapiens
KCHIVIEKP

SEQ ID NO: 650434 - protein, 9 aa, Homo Sapiens
WQEWPMYQI

SEQ ID NO: 650435 - protein, 9 aa, Homo Sapiens
IAQKSEVEN

SEQ ID NO: 650436 - protein, 9 aa, Homo Sapiens
KWHQDFPVN

SEQ ID NO: 650437 - protein, 9 aa, Homo Sapiens
EDEEKIQSE

SEQ ID NO: 650438 - protein, 9 aa, Homo Sapiens
AEPPGPLKA

SEQ ID NO: 650439 - protein, 9 aa, Homo Sapiens
EEGDLEEDI

SEQ ID NO: 650440 - protein, 9 aa, Homo Sapiens
ICKKSGLDT

SEQ ID NO: 650441 - protein, 9 aa, Homo Sapiens
LLDLFKKLS

SEQ ID NO: 650442 - protein, 9 aa, Homo Sapiens
FFTNPAKNL

SEQ ID NO: 650443 - protein, 9 aa, Homo Sapiens
FGGVQVSSP

SEQ ID NO: 650444 - protein, 9 aa, Homo Sapiens
LQEPLFDVL

SEQ ID NO: 650445 - protein, 9 aa, Homo Sapiens
VVMSRKICW

SEQ ID NO: 650446 - protein, 9 aa, Homo Sapiens
TEQMAERKS

SEQ ID NO: 650447 - protein, 9 aa, Homo Sapiens
IYNGVIPFD

SEQ ID NO: 650448 - protein, 9 aa, Homo Sapiens
PSGLEEVSG

SEQ ID NO: 650449 - protein, 9 aa, Homo Sapiens
SFDAWQALG

SEQ ID NO: 650450 - protein, 9 aa, Homo Sapiens
MAERKSKKK

SEQ ID NO: 650451 - protein, 9 aa, Homo Sapiens
LIAQKSEVE

SEQ ID NO: 650452 - protein, 9 aa, Homo Sapiens
EGYLHLSTA

SEQ ID NO: 650453 - protein, 9 aa, Homo Sapiens
VYRALLFLN

SEQ ID NO: 650454 - protein, 9 aa, Homo Sapiens
TDLTAFSPS

SEQ ID NO: 650455 - protein, 9 aa, Homo Sapiens
NDLSPTVSF

SEQ ID NO: 650456 - protein, 9 aa, Homo Sapiens
VSHVVHITM

SEQ ID NO: 650457 - protein, 9 aa, Homo Sapiens
LVAQIKEGG

SEQ ID NO: 650458 - protein, 9 aa, Homo Sapiens
SPRRRLQGS

SEQ ID NO: 650459 - protein, 9 aa, Homo Sapiens
NSDMVCPHK

SEQ ID NO: 650460 - protein, 9 aa, Homo Sapiens
DLSDWEWCS

SEQ ID NO: 650461 - protein, 9 aa, Homo Sapiens
VQVRLVGST

SEQ ID NO: 650462 - protein, 9 aa, Homo Sapiens
MGRIWVDAV

SEQ ID NO: 650463 - protein, 9 aa, Homo Sapiens
TDDTSKKIA

SEQ ID NO: 650464 - protein, 9 aa, Homo Sapiens
RSNVGLRQL

SEQ ID NO: 650465 - protein, 9 aa, Homo Sapiens
EMMVQLLRT

SEQ ID NO: 650466 - protein, 9 aa, Homo Sapiens
EHLEKTLSA

SEQ ID NO: 650467 - protein, 9 aa, Homo Sapiens
MKLQKLHLW

SEQ ID NO: 650468 - protein, 9 aa, Homo Sapiens
HCLDGRAAL

SEQ ID NO: 650469 - protein, 9 aa, Homo Sapiens
GKENNGGAR

SEQ ID NO: 650470 - protein, 9 aa, Homo Sapiens
EMLSDGTET

SEQ ID NO: 650471 - protein, 9 aa, Homo Sapiens
VHYFVAELA

SEQ ID NO: 650472 - protein, 9 aa, Homo Sapiens
NIISEKKAI

SEQ ID NO: 650473 - protein, 9 aa, Homo Sapiens
SPEGSVANK

SEQ ID NO: 650474 - protein, 9 aa, Homo Sapiens
CESRNHIDR

SEQ ID NO: 650475 - protein, 9 aa, Homo Sapiens
IVIMAVSME

SEQ ID NO: 650476 - protein, 9 aa, Homo Sapiens
CCRIRLTWA

SEQ ID NO: 650477 - protein, 8 aa, Homo Sapiens
IFNKILPN

SEQ ID NO: 650478 - protein, 9 aa, Homo Sapiens
HLEKTLSAV

SEQ ID NO: 650479 - protein, 9 aa, Homo Sapiens
SAYSPSTVE

SEQ ID NO: 650480 - protein, 9 aa, Homo Sapiens
YISPEKEQQ

SEQ ID NO: 650481 - protein, 9 aa, Homo Sapiens
LSLHLLDNA

SEQ ID NO: 650482 - protein, 9 aa, Homo Sapiens
RRVSYIKAV

SEQ ID NO: 650483 - protein, 9 aa, Homo Sapiens
SKDVPRNRG

SEQ ID NO: 650484 - protein, 9 aa, Homo Sapiens
HSKEVWAGH

SEQ ID NO: 650485 - protein, 9 aa, Homo Sapiens
SGLEEVSGY

SEQ ID NO: 650486 - protein, 9 aa, Homo Sapiens
VLKLPSFSK

SEQ ID NO: 650487 - protein, 9 aa, Homo Sapiens
ADPSTNDFL

SEQ ID NO: 650488 - protein, 9 aa, Homo Sapiens
LLVPWLYLV

SEQ ID NO: 650489 - protein, 9 aa, Homo Sapiens
YRVSYGPLH

SEQ ID NO: 650490 - protein, 9 aa, Homo Sapiens
ENSFEDAVY

SEQ ID NO: 650491 - protein, 9 aa, Homo Sapiens
RFSGSKDVP

SEQ ID NO: 650492 - protein, 9 aa, Homo Sapiens
EISTSELQE

SEQ ID NO: 650493 - protein, 9 aa, Homo Sapiens
NFNQGRSSL

SEQ ID NO: 650494 - protein, 9 aa, Homo Sapiens
RFVEFYYWE

SEQ ID NO: 650495 - protein, 9 aa, Homo Sapiens
IWVDAVPCL

SEQ ID NO: 650496 - protein, 9 aa, Homo Sapiens
IENLMSASG

SEQ ID NO: 650497 - protein, 9 aa, Homo Sapiens
SVGTVGTQD

SEQ ID NO: 650498 - protein, 9 aa, Homo Sapiens
EPPGPLKAE

SEQ ID NO: 650499 - protein, 9 aa, Homo Sapiens
KVKIMLDLS

SEQ ID NO: 650500 - protein, 9 aa, Homo Sapiens
LKCVHHNPS

SEQ ID NO: 650501 - protein, 9 aa, Homo Sapiens
LLLQHLQRH

SEQ ID NO: 650502 - protein, 9 aa, Homo Sapiens
DVNIPTDFE

SEQ ID NO: 650503 - protein, 9 aa, Homo Sapiens
LHEKFYCLL

SEQ ID NO: 650504 - protein, 9 aa, Homo Sapiens
QFAPAVYSG

SEQ ID NO: 650505 - protein, 9 aa, Homo Sapiens
IRTTMQVGF

SEQ ID NO: 650506 - protein, 9 aa, Homo Sapiens
ASPNAATSS

SEQ ID NO: 650507 - protein, 9 aa, Homo Sapiens
GDRCRGLVE

SEQ ID NO: 650508 - protein, 9 aa, Homo Sapiens
KSATAAEKP

SEQ ID NO: 650509 - protein, 9 aa, Homo Sapiens
IHQDEILAH

SEQ ID NO: 650510 - protein, 9 aa, Homo Sapiens
VSIHRLITI

SEQ ID NO: 650511 - protein, 9 aa, Homo Sapiens
GLLAPVSAY

SEQ ID NO: 650512 - protein, 9 aa, Homo Sapiens
ASGSAAFKF

SEQ ID NO: 650513 - protein, 9 aa, Homo Sapiens
ICWEPTSWQ

SEQ ID NO: 650514 - protein, 9 aa, Homo Sapiens
GGEEDTEAL

SEQ ID NO: 650515 - protein, 9 aa, Homo Sapiens
LSSPNFTLD

SEQ ID NO: 650516 - protein, 9 aa, Homo Sapiens
QPQAPCKGS

SEQ ID NO: 650517 - protein, 9 aa, Homo Sapiens
HQEKCREEV

SEQ ID NO: 650518 - protein, 9 aa, Homo Sapiens
LQEVVGIWS

SEQ ID NO: 650519 - protein, 9 aa, Homo Sapiens
FASLGGADN

SEQ ID NO: 650520 - protein, 9 aa, Homo Sapiens
RIKCSRDFL

SEQ ID NO: 650521 - protein, 9 aa, Homo Sapiens
VCGNITLDS

SEQ ID NO: 650522 - protein, 9 aa, Homo Sapiens
KHLGLGIGE

SEQ ID NO: 650523 - protein, 9 aa, Homo Sapiens
LLPLVVQVI

SEQ ID NO: 650524 - protein, 9 aa, Homo Sapiens
RLFAPLKRK

SEQ ID NO: 650525 - protein, 9 aa, Homo Sapiens
AFMGYSVMV

SEQ ID NO: 650526 - protein, 9 aa, Homo Sapiens
ITLKNAMKI

SEQ ID NO: 650527 - protein, 9 aa, Homo Sapiens
NTLTFIDIS

SEQ ID NO: 650528 - protein, 9 aa, Homo Sapiens
YKNSSREKS

SEQ ID NO: 650529 - protein, 9 aa, Homo Sapiens
AFSTNLLTD

SEQ ID NO: 650530 - protein, 9 aa, Homo Sapiens
PSVLPPQSR

SEQ ID NO: 650531 - protein, 9 aa, Homo Sapiens
PVNKRKKLS

SEQ ID NO: 650532 - protein, 9 aa, Homo Sapiens
VAFAKFQEN

SEQ ID NO: 650533 - protein, 9 aa, Homo Sapiens
TVNPTADPH

SEQ ID NO: 650534 - protein, 9 aa, Homo Sapiens
GADGVDVNI

SEQ ID NO: 650535 - protein, 9 aa, Homo Sapiens
FITETASQP

SEQ ID NO: 650536 - protein, 9 aa, Homo Sapiens
EAQWDGLTG

SEQ ID NO: 650537 - protein, 9 aa, Homo Sapiens
AKCEASHPG

SEQ ID NO: 650538 - protein, 9 aa, Homo Sapiens
SLQASLKVY

SEQ ID NO: 650539 - protein, 9 aa, Homo Sapiens
SAGCQNTMW

SEQ ID NO: 650540 - protein, 9 aa, Homo Sapiens
SGNIVYWVF

SEQ ID NO: 650541 - protein, 9 aa, Homo Sapiens
AVKPQEVHM

SEQ ID NO: 650542 - protein, 9 aa, Homo Sapiens
FFPGRSNCP

SEQ ID NO: 650543 - protein, 9 aa, Homo Sapiens
ILIRTTMQV

SEQ ID NO: 650544 - protein, 9 aa, Homo Sapiens
LKVLWRGRD

SEQ ID NO: 650545 - protein, 9 aa, Homo Sapiens
YEGLEYCKE

SEQ ID NO: 650546 - protein, 9 aa, Homo Sapiens
RLQGSIWGP

SEQ ID NO: 650547 - protein, 9 aa, Homo Sapiens
KDHRFSKAC

SEQ ID NO: 650548 - protein, 9 aa, Homo Sapiens
SCGYDTCYY

SEQ ID NO: 650549 - protein, 9 aa, Homo Sapiens
TSNITIPKK

SEQ ID NO: 650550 - protein, 9 aa, Homo Sapiens
KSSVRIGQL

SEQ ID NO: 650551 - protein, 9 aa, Homo Sapiens
EKVSSLVLV

SEQ ID NO: 650552 - protein, 9 aa, Homo Sapiens
SGNDTYEAA

SEQ ID NO: 650553 - protein, 9 aa, Homo Sapiens
DGYNLSLVQ

SEQ ID NO: 650554 - protein, 9 aa, Homo Sapiens
ANLEDRCPR

SEQ ID NO: 650555 - protein, 9 aa, Homo Sapiens
SHPGKITSN

SEQ ID NO: 650556 - protein, 9 aa, Homo Sapiens
RKSKKKVEE

SEQ ID NO: 650557 - protein, 9 aa, Homo Sapiens
CQFHLLLPG

SEQ ID NO: 650558 - protein, 9 aa, Homo Sapiens
PWGARIPAG

SEQ ID NO: 650559 - protein, 9 aa, Homo Sapiens
WCCYSGWYC

SEQ ID NO: 650560 - protein, 9 aa, Homo Sapiens
NTSHHALEI

SEQ ID NO: 650561 - protein, 9 aa, Homo Sapiens
SVTLERSPG

SEQ ID NO: 650562 - protein, 9 aa, Homo Sapiens
TRIHPSYTN

SEQ ID NO: 650563 - protein, 9 aa, Homo Sapiens
LVIIVSIPA

SEQ ID NO: 650564 - protein, 9 aa, Homo Sapiens
LGTHGDLCQ

SEQ ID NO: 650565 - protein, 9 aa, Homo Sapiens
LRKLEELQQ

SEQ ID NO: 650566 - protein, 9 aa, Homo Sapiens
AHLTSHIRN

SEQ ID NO: 650567 - protein, 9 aa, Homo Sapiens
MLHVLPSTV

SEQ ID NO: 650568 - protein, 9 aa, Homo Sapiens
FVFVSFERH

SEQ ID NO: 650569 - protein, 9 aa, Homo Sapiens
MFFTHDLAF

SEQ ID NO: 650570 - protein, 9 aa, Homo Sapiens
AYTRPSCGP

SEQ ID NO: 650571 - protein, 9 aa, Homo Sapiens
PNTLTFIDI

SEQ ID NO: 650572 - protein, 9 aa, Homo Sapiens
PGALAAVHS

SEQ ID NO: 650573 - protein, 9 aa, Homo Sapiens
LVLCNLFGV

SEQ ID NO: 650574 - protein, 9 aa, Homo Sapiens
SDCKILHRQ

SEQ ID NO: 650575 - protein, 9 aa, Homo Sapiens
LNELQQQYE

SEQ ID NO: 650576 - protein, 9 aa, Homo Sapiens
DRVPCSKFF

SEQ ID NO: 650577 - protein, 9 aa, Homo Sapiens
SPEKEQQYI

SEQ ID NO: 650578 - protein, 9 aa, Homo Sapiens
EDGCVTDHF

SEQ ID NO: 650579 - protein, 9 aa, Homo Sapiens
LFTDLILAD

SEQ ID NO: 650580 - protein, 9 aa, Homo Sapiens
LGLQLGLTE

SEQ ID NO: 650581 - protein, 9 aa, Homo Sapiens
LVARFRQLR

SEQ ID NO: 650582 - protein, 9 aa, Homo Sapiens
GNITLDSVT

SEQ ID NO: 650583 - protein, 9 aa, Homo Sapiens
NTSCSPVFE

SEQ ID NO: 650584 - protein, 9 aa, Homo Sapiens
SCIRPCMLA

SEQ ID NO: 650585 - protein, 9 aa, Homo Sapiens
RRRLQGSIW

SEQ ID NO: 650586 - protein, 9 aa, Homo Sapiens
RESLFAKHA

SEQ ID NO: 650587 - protein, 9 aa, Homo Sapiens
PNPSPSSPT

SEQ ID NO: 650588 - protein, 9 aa, Homo Sapiens
ICVILVFNV

SEQ ID NO: 650589 - protein, 9 aa, Homo Sapiens
FFAPDPENK

SEQ ID NO: 650590 - protein, 9 aa, Homo Sapiens
FQLNVYDVQ

SEQ ID NO: 650591 - protein, 9 aa, Homo Sapiens
EDRCPRRTQ

SEQ ID NO: 650592 - protein, 9 aa, Homo Sapiens
TQRNYLIQT

SEQ ID NO: 650593 - protein, 9 aa, Homo Sapiens
PGTPVVSQD

SEQ ID NO: 650594 - protein, 9 aa, Homo Sapiens
ASLFSKGSD

SEQ ID NO: 650595 - protein, 9 aa, Homo Sapiens
TGPNKSGKS

SEQ ID NO: 650596 - protein, 9 aa, Homo Sapiens
PPQAFKNLK

SEQ ID NO: 650597 - protein, 9 aa, Homo Sapiens
GEIEVQPRV

SEQ ID NO: 650598 - protein, 9 aa, Homo Sapiens
TPLAANRES

SEQ ID NO: 650599 - protein, 9 aa, Homo Sapiens
LIITGPNKS

SEQ ID NO: 650600 - protein, 9 aa, Homo Sapiens
DCVGGEVEK

SEQ ID NO: 650601 - protein, 9 aa, Homo Sapiens
SPTPATSME

SEQ ID NO: 650602 - protein, 9 aa, Homo Sapiens
SECNSDMVC

SEQ ID NO: 650603 - protein, 9 aa, Homo Sapiens
DRAALTLLW

SEQ ID NO: 650604 - protein, 9 aa, Homo Sapiens
FYKLVTDGA

SEQ ID NO: 650605 - protein, 9 aa, Homo Sapiens
HLTRTLSTS

SEQ ID NO: 650606 - protein, 9 aa, Homo Sapiens
WRTHHAHRT

SEQ ID NO: 650607 - protein, 9 aa, Homo Sapiens
VAASQDMQQ

SEQ ID NO: 650608 - protein, 9 aa, Homo Sapiens
LLAGRVAAA

SEQ ID NO: 650609 - protein, 9 aa, Homo Sapiens
VPAQLRPPL

SEQ ID NO: 650610 - protein, 9 aa, Homo Sapiens
SLLSLGPRL

SEQ ID NO: 650611 - protein, 9 aa, Homo Sapiens
IMSQILPFI

SEQ ID NO: 650612 - protein, 9 aa, Homo Sapiens
IKLIGQTPI

SEQ ID NO: 650613 - protein, 9 aa, Homo Sapiens
IRQLPELPN

SEQ ID NO: 650614 - protein, 9 aa, Homo Sapiens
FLYLEPLGA

SEQ ID NO: 650615 - protein, 9 aa, Homo Sapiens
LSSEMDLRF

SEQ ID NO: 650616 - protein, 9 aa, Homo Sapiens
PGQKREDDH

SEQ ID NO: 650617 - protein, 9 aa, Homo Sapiens
GAHLSSVAS

SEQ ID NO: 650618 - protein, 9 aa, Homo Sapiens
STSKIPALQ

SEQ ID NO: 650619 - protein, 9 aa, Homo Sapiens
GGDLQKIGQ

SEQ ID NO: 650620 - protein, 9 aa, Homo Sapiens
VDNEENTLN

SEQ ID NO: 650621 - protein, 9 aa, Homo Sapiens
VLPSTVKKE

SEQ ID NO: 650622 - protein, 9 aa, Homo Sapiens
FEEDGCVTD

SEQ ID NO: 650623 - protein, 9 aa, Homo Sapiens
VSVTFKSKK

SEQ ID NO: 650624 - protein, 9 aa, Homo Sapiens
GEDEPSSQH

SEQ ID NO: 650625 - protein, 9 aa, Homo Sapiens
AFKRDVFIL

SEQ ID NO: 650626 - protein, 9 aa, Homo Sapiens
SAYTRPSCG

SEQ ID NO: 650627 - protein, 9 aa, Homo Sapiens
IVNVAFSTN

SEQ ID NO: 650628 - protein, 9 aa, Homo Sapiens
ICIKACKKL

SEQ ID NO: 650629 - protein, 9 aa, Homo Sapiens
ALSAEDSFT

SEQ ID NO: 650630 - protein, 9 aa, Homo Sapiens
KQHMNTKRA

SEQ ID NO: 650631 - protein, 9 aa, Homo Sapiens
DPQAMFHIE

SEQ ID NO: 650632 - protein, 9 aa, Homo Sapiens
QEELGLLDE

SEQ ID NO: 650633 - protein, 9 aa, Homo Sapiens
LVLVSLESA

SEQ ID NO: 650634 - protein, 9 aa, Homo Sapiens
EPISCYMEH

SEQ ID NO: 650635 - protein, 9 aa, Homo Sapiens
DPQHLGECG

SEQ ID NO: 650636 - protein, 9 aa, Homo Sapiens
SKTGMILSR

SEQ ID NO: 650637 - protein, 9 aa, Homo Sapiens
ELKITFVIW

SEQ ID NO: 650638 - protein, 9 aa, Homo Sapiens
CSAEGERLV

SEQ ID NO: 650639 - protein, 9 aa, Homo Sapiens
VKANSGTIA

SEQ ID NO: 650640 - protein, 9 aa, Homo Sapiens
DISERLPRD

SEQ ID NO: 650641 - protein, 9 aa, Homo Sapiens
PCNCGLVFN

SEQ ID NO: 650642 - protein, 9 aa, Homo Sapiens
MAMVKALCQ

SEQ ID NO: 650643 - protein, 9 aa, Homo Sapiens
SPGSLCIRD

SEQ ID NO: 650644 - protein, 9 aa, Homo Sapiens
FYYWESYWV

SEQ ID NO: 650645 - protein, 9 aa, Homo Sapiens
NIGVRTVQH

SEQ ID NO: 650646 - protein, 9 aa, Homo Sapiens
LHVAAVSTI

SEQ ID NO: 650647 - protein, 9 aa, Homo Sapiens
SFEDAVYWE

SEQ ID NO: 650648 - protein, 9 aa, Homo Sapiens
FKKVRRPSR

SEQ ID NO: 650649 - protein, 9 aa, Homo Sapiens
KCQAIASDV

SEQ ID NO: 650650 - protein, 9 aa, Homo Sapiens
SWLRPMRTL

SEQ ID NO: 650651 - protein, 9 aa, Homo Sapiens
LLRIEIEMV

SEQ ID NO: 650652 - protein, 9 aa, Homo Sapiens
FNLQDPWVP

SEQ ID NO: 650653 - protein, 9 aa, Homo Sapiens
GSAGPPGER

SEQ ID NO: 650654 - protein, 9 aa, Homo Sapiens
ALYEENIFM

SEQ ID NO: 650655 - protein, 9 aa, Homo Sapiens
ENSSQFRPE

SEQ ID NO: 650656 - protein, 9 aa, Homo Sapiens
CNPVHAREP

SEQ ID NO: 650657 - protein, 9 aa, Homo Sapiens
LQCILGNIE

SEQ ID NO: 650658 - protein, 9 aa, Homo Sapiens
CMTQAGVQW

SEQ ID NO: 650659 - protein, 9 aa, Homo Sapiens
GFGGVQVSS

SEQ ID NO: 650660 - protein, 9 aa, Homo Sapiens
QYIYRIPCL

SEQ ID NO: 650661 - protein, 9 aa, Homo Sapiens
SWHASVPGQ

SEQ ID NO: 650662 - protein, 9 aa, Homo Sapiens
HSLALYEEN

SEQ ID NO: 650663 - protein, 9 aa, Homo Sapiens
PQMAIHIYS

SEQ ID NO: 650664 - protein, 9 aa, Homo Sapiens
RILADTPQE

SEQ ID NO: 650665 - protein, 9 aa, Homo Sapiens
YKRLLKCVH

SEQ ID NO: 650666 - protein, 9 aa, Homo Sapiens
MTIGGNIIV

SEQ ID NO: 650667 - protein, 9 aa, Homo Sapiens
QVQQVADYY

SEQ ID NO: 650668 - protein, 9 aa, Homo Sapiens
SAEPPGPLK

SEQ ID NO: 650669 - protein, 9 aa, Homo Sapiens
CTSSSYQQD

SEQ ID NO: 650670 - protein, 9 aa, Homo Sapiens
DQNGQLISY

SEQ ID NO: 650671 - protein, 9 aa, Homo Sapiens
HTGKNHMDV

SEQ ID NO: 650672 - protein, 9 aa, Homo Sapiens
EQEKKHRPS

SEQ ID NO: 650673 - protein, 9 aa, Homo Sapiens
RPIYEDKNR

SEQ ID NO: 650674 - protein, 9 aa, Homo Sapiens
ASKGASSFS

SEQ ID NO: 650675 - protein, 9 aa, Homo Sapiens
VRHEMQILS

SEQ ID NO: 650676 - protein, 9 aa, Homo Sapiens
FPVNKRKKL

SEQ ID NO: 650677 - protein, 9 aa, Homo Sapiens
AFPSSCGKT

SEQ ID NO: 650678 - protein, 9 aa, Homo Sapiens
LGLQLATPV

SEQ ID NO: 650679 - protein, 9 aa, Homo Sapiens
GKAFNQSCS

SEQ ID NO: 650680 - protein, 9 aa, Homo Sapiens
CSKFFQVHC

SEQ ID NO: 650681 - protein, 9 aa, Homo Sapiens
GVSNPQLII

SEQ ID NO: 650682 - protein, 9 aa, Homo Sapiens
IIADRQTGK

SEQ ID NO: 650683 - protein, 9 aa, Homo Sapiens
ALLKVLWRG

SEQ ID NO: 650684 - protein, 9 aa, Homo Sapiens
PLSAESDIS

SEQ ID NO: 650685 - protein, 9 aa, Homo Sapiens
GSIPLVDTI

SEQ ID NO: 650686 - protein, 9 aa, Homo Sapiens
LGSATNFNQ

SEQ ID NO: 650687 - protein, 9 aa, Homo Sapiens
LVRQHHELC

SEQ ID NO: 650688 - protein, 9 aa, Homo Sapiens
ESGEEEVAS

SEQ ID NO: 650689 - protein, 9 aa, Homo Sapiens
YEKRMGGLL

SEQ ID NO: 650690 - protein, 9 aa, Homo Sapiens
QDAKLSNMF

SEQ ID NO: 650691 - protein, 9 aa, Homo Sapiens
CSLTKHKKI

SEQ ID NO: 650692 - protein, 9 aa, Homo Sapiens
GYHISWEVY

SEQ ID NO: 650693 - protein, 9 aa, Homo Sapiens
DAWTYTCLA

SEQ ID NO: 650694 - protein, 9 aa, Homo Sapiens
IVGRHGKIG

SEQ ID NO: 650695 - protein, 9 aa, Homo Sapiens
DLQTIGFAA

SEQ ID NO: 650696 - protein, 9 aa, Homo Sapiens
MSLLFLPAF

SEQ ID NO: 650697 - protein, 9 aa, Homo Sapiens
LDGRAALSI

SEQ ID NO: 650698 - protein, 9 aa, Homo Sapiens
NCGESRELP

SEQ ID NO: 650699 - protein, 9 aa, Homo Sapiens
TELCQYLDN

SEQ ID NO: 650700 - protein, 9 aa, Homo Sapiens
PLVPVVQVR

SEQ ID NO: 650701 - protein, 9 aa, Homo Sapiens
PTVETSNPY

SEQ ID NO: 650702 - protein, 9 aa, Homo Sapiens
KRKHQLWAA

SEQ ID NO: 650703 - protein, 9 aa, Homo Sapiens
PKNQKKSKL

SEQ ID NO: 650704 - protein, 9 aa, Homo Sapiens
FINMPTCKL

SEQ ID NO: 650705 - protein, 9 aa, Homo Sapiens
DYNSPVNNP

SEQ ID NO: 650706 - protein, 9 aa, Homo Sapiens
YWESYWVME

SEQ ID NO: 650707 - protein, 9 aa, Homo Sapiens
EDTLADLTL

SEQ ID NO: 650708 - protein, 9 aa, Homo Sapiens
LNLTCSDKQ

SEQ ID NO: 650709 - protein, 9 aa, Homo Sapiens
GLTDCLELQ

SEQ ID NO: 650710 - protein, 9 aa, Homo Sapiens
LSGEAGHPW

SEQ ID NO: 650711 - protein, 9 aa, Homo Sapiens
EVTEFILFG

SEQ ID NO: 650712 - protein, 9 aa, Homo Sapiens
VLPPQSRNV

SEQ ID NO: 650713 - protein, 9 aa, Homo Sapiens
HWAVKIVTC

SEQ ID NO: 650714 - protein, 9 aa, Homo Sapiens
RVPCSKFFQ

SEQ ID NO: 650715 - protein, 9 aa, Homo Sapiens
YWCRPLQIF

SEQ ID NO: 650716 - protein, 9 aa, Homo Sapiens
ASAGRTRRW

SEQ ID NO: 650717 - protein, 9 aa, Homo Sapiens
FNVPGIFSF

SEQ ID NO: 650718 - protein, 9 aa, Homo Sapiens
PILEEECMF

SEQ ID NO: 650719 - protein, 9 aa, Homo Sapiens
HQVTESART

SEQ ID NO: 650720 - protein, 9 aa, Homo Sapiens
NEDLHHPIH

SEQ ID NO: 650721 - protein, 9 aa, Homo Sapiens
EERPNYLKN

SEQ ID NO: 650722 - protein, 9 aa, Homo Sapiens
CHLWLMPDL

SEQ ID NO: 650723 - protein, 9 aa, Homo Sapiens
CLSCSQARC

SEQ ID NO: 650724 - protein, 9 aa, Homo Sapiens
SEERPNYLK

SEQ ID NO: 650725 - protein, 9 aa, Homo Sapiens
AILKKLDLV

SEQ ID NO: 650726 - protein, 9 aa, Homo Sapiens
GKPPLRCTN

SEQ ID NO: 650727 - protein, 9 aa, Homo Sapiens
EEVKPLSEM

SEQ ID NO: 650728 - protein, 9 aa, Homo Sapiens
EDMVGRLLP

SEQ ID NO: 650729 - protein, 9 aa, Homo Sapiens
VHSLRLPGI

SEQ ID NO: 650730 - protein, 9 aa, Homo Sapiens
SESSSSNSS

SEQ ID NO: 650731 - protein, 9 aa, Homo Sapiens
FTCTGDGDI

SEQ ID NO: 650732 - protein, 9 aa, Homo Sapiens
WQLAQLEAR

SEQ ID NO: 650733 - protein, 9 aa, Homo Sapiens
YCTDWEEDE

SEQ ID NO: 650734 - protein, 9 aa, Homo Sapiens
RALLVELTR

SEQ ID NO: 650735 - protein, 9 aa, Homo Sapiens
RASALSSHF

SEQ ID NO: 650736 - protein, 9 aa, Homo Sapiens
KIGQFCMVY

SEQ ID NO: 650737 - protein, 9 aa, Homo Sapiens
WLPEGPAGV

SEQ ID NO: 650738 - protein, 9 aa, Homo Sapiens
FTLNELQQQ

SEQ ID NO: 650739 - protein, 9 aa, Homo Sapiens
WESLSGEPE

SEQ ID NO: 650740 - protein, 9 aa, Homo Sapiens
APKGKENNG

SEQ ID NO: 650741 - protein, 9 aa, Homo Sapiens
YWVFMLHKK

SEQ ID NO: 650742 - protein, 9 aa, Homo Sapiens
RTLSTSCRR

SEQ ID NO: 650743 - protein, 9 aa, Homo Sapiens
VWGSSWPGT

SEQ ID NO: 650744 - protein, 9 aa, Homo Sapiens
LHEMKKEQE

SEQ ID NO: 650745 - protein, 9 aa, Homo Sapiens
RGSVYRRSH

SEQ ID NO: 650746 - protein, 9 aa, Homo Sapiens
LVSATLRPE

SEQ ID NO: 650747 - protein, 9 aa, Homo Sapiens
WKMKDNQKC

SEQ ID NO: 650748 - protein, 9 aa, Homo Sapiens
EGPPKTDLT

SEQ ID NO: 650749 - protein, 9 aa, Homo Sapiens
HHRQCLENE

SEQ ID NO: 650750 - protein, 9 aa, Homo Sapiens
TSRKPTAGE

SEQ ID NO: 650751 - protein, 9 aa, Homo Sapiens
SSSFSGTSS

SEQ ID NO: 650752 - protein, 9 aa, Homo Sapiens
EDKKIEIRE

SEQ ID NO: 650753 - protein, 9 aa, Homo Sapiens
DKDVEEGSE

SEQ ID NO: 650754 - protein, 9 aa, Homo Sapiens
LTLSDETCH

SEQ ID NO: 650755 - protein, 9 aa, Homo Sapiens
SSFTVPKML

SEQ ID NO: 650756 - protein, 9 aa, Homo Sapiens
EASHPGKIT

SEQ ID NO: 650757 - protein, 9 aa, Homo Sapiens
SLFDFQWHK

SEQ ID NO: 650758 - protein, 9 aa, Homo Sapiens
STVLEKCNR

SEQ ID NO: 650759 - protein, 9 aa, Homo Sapiens
KTLEDALHS

SEQ ID NO: 650760 - protein, 9 aa, Homo Sapiens
KQPKGYCLR

SEQ ID NO: 650761 - protein, 9 aa, Homo Sapiens
ISCIQIRNK

SEQ ID NO: 650762 - protein, 9 aa, Homo Sapiens
IIASLSTIT

SEQ ID NO: 650763 - protein, 9 aa, Homo Sapiens
RCFCNCNDL

SEQ ID NO: 650764 - protein, 9 aa, Homo Sapiens
KKGIPPDQQ

SEQ ID NO: 650765 - protein, 9 aa, Homo Sapiens
AMKIESGDS

SEQ ID NO: 650766 - protein, 9 aa, Homo Sapiens
NFAPLLFVL

SEQ ID NO: 650767 - protein, 9 aa, Homo Sapiens
PLQKFCLVM

SEQ ID NO: 650768 - protein, 9 aa, Homo Sapiens
VVKANSGTI

SEQ ID NO: 650769 - protein, 9 aa, Homo Sapiens
KIMLDLSNL

SEQ ID NO: 650770 - protein, 9 aa, Homo Sapiens
IYDVVLVGG

SEQ ID NO: 650771 - protein, 9 aa, Homo Sapiens
HVLPSTVKK

SEQ ID NO: 650772 - protein, 9 aa, Homo Sapiens
LPKACSIGD

SEQ ID NO: 650773 - protein, 9 aa, Homo Sapiens
GEISTSELQ

SEQ ID NO: 650774 - protein, 9 aa, Homo Sapiens
FSEETNSCT

SEQ ID NO: 650775 - protein, 9 aa, Homo Sapiens
SLSMTSKAG

SEQ ID NO: 650776 - protein, 9 aa, Homo Sapiens
ALSILVGAM

SEQ ID NO: 650777 - protein, 9 aa, Homo Sapiens
DNPLVLHQD

SEQ ID NO: 650778 - protein, 9 aa, Homo Sapiens
VVLVTNVIC

SEQ ID NO: 650779 - protein, 9 aa, Homo Sapiens
GQFCMVYSE

SEQ ID NO: 650780 - protein, 9 aa, Homo Sapiens
LVPWLYLVA

SEQ ID NO: 650781 - protein, 9 aa, Homo Sapiens
LNTEKFSSE

SEQ ID NO: 650782 - protein, 9 aa, Homo Sapiens
VSTASKGAS

SEQ ID NO: 650783 - protein, 9 aa, Homo Sapiens
TGVNASMRR

SEQ ID NO: 650784 - protein, 9 aa, Homo Sapiens
NLKKLQVID

SEQ ID NO: 650785 - protein, 9 aa, Homo Sapiens
EHVWVEVVL

SEQ ID NO: 650786 - protein, 9 aa, Homo Sapiens
FIDICHSSF

SEQ ID NO: 650787 - protein, 9 aa, Homo Sapiens
TEVEAQTIK

SEQ ID NO: 650788 - protein, 9 aa, Homo Sapiens
ASKDVKVKR

SEQ ID NO: 650789 - protein, 9 aa, Homo Sapiens
GHSNPMNPT

SEQ ID NO: 650790 - protein, 9 aa, Homo Sapiens
RWKTFQAYL

SEQ ID NO: 650791 - protein, 9 aa, Homo Sapiens
PPEDIQDLG

SEQ ID NO: 650792 - protein, 9 aa, Homo Sapiens
ITEKLTDVA

SEQ ID NO: 650793 - protein, 9 aa, Homo Sapiens
DMPTYNPEL

SEQ ID NO: 650794 - protein, 9 aa, Homo Sapiens
IMRFINMPT

SEQ ID NO: 650795 - protein, 9 aa, Homo Sapiens
RPLQIFLCD

SEQ ID NO: 650796 - protein, 9 aa, Homo Sapiens
FLASYLMMA

SEQ ID NO: 650797 - protein, 9 aa, Homo Sapiens
TAGETSATA

SEQ ID NO: 650798 - protein, 9 aa, Homo Sapiens
PKASTVVNG

SEQ ID NO: 650799 - protein, 9 aa, Homo Sapiens
AGLALLAFL

SEQ ID NO: 650800 - protein, 9 aa, Homo Sapiens
SKDVKVKRI

SEQ ID NO: 650801 - protein, 9 aa, Homo Sapiens
LQTGSCCMT

SEQ ID NO: 650802 - protein, 9 aa, Homo Sapiens
MERVFWLLF

SEQ ID NO: 650803 - protein, 9 aa, Homo Sapiens
RKLTYCVKA

SEQ ID NO: 650804 - protein, 9 aa, Homo Sapiens
AAPHGPPWA

SEQ ID NO: 650805 - protein, 9 aa, Homo Sapiens
RQDSWDVVE

SEQ ID NO: 650806 - protein, 9 aa, Homo Sapiens
FGQWVHHTA

SEQ ID NO: 650807 - protein, 9 aa, Homo Sapiens
SRMLLQQDL

SEQ ID NO: 650808 - protein, 9 aa, Homo Sapiens
AKPGQMIQI

SEQ ID NO: 650809 - protein, 9 aa, Homo Sapiens
AGQTLAAVP

SEQ ID NO: 650810 - protein, 9 aa, Homo Sapiens
VPENKNVST

SEQ ID NO: 650811 - protein, 9 aa, Homo Sapiens
CLVMSMMHL

SEQ ID NO: 650812 - protein, 9 aa, Homo Sapiens
VNKTGTMYW

SEQ ID NO: 650813 - protein, 9 aa, Homo Sapiens
KELLSTIRD

SEQ ID NO: 650814 - protein, 9 aa, Homo Sapiens
NFGYVVAFK

SEQ ID NO: 650815 - protein, 9 aa, Homo Sapiens
KRKKRHEKQ

SEQ ID NO: 650816 - protein, 9 aa, Homo Sapiens
SFGRKVVYV

SEQ ID NO: 650817 - protein, 9 aa, Homo Sapiens
NLLNARVLR

SEQ ID NO: 650818 - protein, 9 aa, Homo Sapiens
PFLIIASLS

SEQ ID NO: 650819 - protein, 9 aa, Homo Sapiens
RNNYNYVIW

SEQ ID NO: 650820 - protein, 9 aa, Homo Sapiens
AMLAMDTDD

SEQ ID NO: 650821 - protein, 9 aa, Homo Sapiens
CSDQNESQV

SEQ ID NO: 650822 - protein, 9 aa, Homo Sapiens
PEEHVMLGS

SEQ ID NO: 650823 - protein, 9 aa, Homo Sapiens
LYEGLEYCK

SEQ ID NO: 650824 - protein, 9 aa, Homo Sapiens
ALWKSLLPR

SEQ ID NO: 650825 - protein, 9 aa, Homo Sapiens
ISPEKEQQY

SEQ ID NO: 650826 - protein, 9 aa, Homo Sapiens
ATVAVMSCS

SEQ ID NO: 650827 - protein, 9 aa, Homo Sapiens
IFLVSATLR

SEQ ID NO: 650828 - protein, 9 aa, Homo Sapiens
RHEKQLAQI

SEQ ID NO: 650829 - protein, 9 aa, Homo Sapiens
GAEVRVIKL

SEQ ID NO: 650830 - protein, 9 aa, Homo Sapiens
EGGAPKAIS

SEQ ID NO: 650831 - protein, 9 aa, Homo Sapiens
MLLALLRKR

SEQ ID NO: 650832 - protein, 9 aa, Homo Sapiens
SLRYSVTVP

SEQ ID NO: 650833 - protein, 9 aa, Homo Sapiens
YLQVLDEQT

SEQ ID NO: 650834 - protein, 9 aa, Homo Sapiens
VSGLHSKAR

SEQ ID NO: 650835 - protein, 9 aa, Homo Sapiens
KKILLKIWK

SEQ ID NO: 650836 - protein, 9 aa, Homo Sapiens
RAGVYADKS

SEQ ID NO: 650837 - protein, 9 aa, Homo Sapiens
VIADLRKDS

SEQ ID NO: 650838 - protein, 9 aa, Homo Sapiens
RSMGWGEEF

SEQ ID NO: 650839 - protein, 9 aa, Homo Sapiens
LSLGPRLAG

SEQ ID NO: 650840 - protein, 9 aa, Homo Sapiens
SEIQALQEL

SEQ ID NO: 650841 - protein, 9 aa, Homo Sapiens
HWEQLNLPG

SEQ ID NO: 650842 - protein, 9 aa, Homo Sapiens
LHYPVVMSR

SEQ ID NO: 650843 - protein, 9 aa, Homo Sapiens
LFSSAHLQN

SEQ ID NO: 650844 - protein, 9 aa, Homo Sapiens
TNWKYKNFA

SEQ ID NO: 650845 - protein, 9 aa, Homo Sapiens
TCHRSKNLK

SEQ ID NO: 650846 - protein, 9 aa, Homo Sapiens
PGAAPHGPP

SEQ ID NO: 650847 - protein, 9 aa, Homo Sapiens
TLHTPMYVL

SEQ ID NO: 650848 - protein, 9 aa, Homo Sapiens
RRKTLKLCR

SEQ ID NO: 650849 - protein, 9 aa, Homo Sapiens
VLGLQLATP

SEQ ID NO: 650850 - protein, 9 aa, Homo Sapiens
EWEDGYYRA

SEQ ID NO: 650851 - protein, 9 aa, Homo Sapiens
DPVSPEGQL

SEQ ID NO: 650852 - protein, 9 aa, Homo Sapiens
MLPIHQDEI

SEQ ID NO: 650853 - protein, 9 aa, Homo Sapiens
FSSCIRPCM

SEQ ID NO: 650854 - protein, 9 aa, Homo Sapiens
AIFSGDPQE

SEQ ID NO: 650855 - protein, 9 aa, Homo Sapiens
PCSKFFQVH

SEQ ID NO: 650856 - protein, 9 aa, Homo Sapiens
GARIPAGAR

SEQ ID NO: 650857 - protein, 9 aa, Homo Sapiens
DPSTNDFLL

SEQ ID NO: 650858 - protein, 9 aa, Homo Sapiens
LAGLALLAF

SEQ ID NO: 650859 - protein, 9 aa, Homo Sapiens
QVEPSVNAD

SEQ ID NO: 650860 - protein, 9 aa, Homo Sapiens
DKNRKKIPQ

SEQ ID NO: 650861 - protein, 9 aa, Homo Sapiens
LPTRKSYTY

SEQ ID NO: 650862 - protein, 9 aa, Homo Sapiens
ISTSELQEA

SEQ ID NO: 650863 - protein, 9 aa, Homo Sapiens
KAISGVPTP

SEQ ID NO: 650864 - protein, 9 aa, Homo Sapiens
GEEDTEALT

SEQ ID NO: 650865 - protein, 9 aa, Homo Sapiens
IAHKFTQHN

SEQ ID NO: 650866 - protein, 9 aa, Homo Sapiens
TDRVPCSKF

SEQ ID NO: 650867 - protein, 9 aa, Homo Sapiens
VVLDGEAEE

SEQ ID NO: 650868 - protein, 9 aa, Homo Sapiens
GGAGVGAGV

SEQ ID NO: 650869 - protein, 9 aa, Homo Sapiens
GDYLYNFTC

SEQ ID NO: 650870 - protein, 9 aa, Homo Sapiens
AVPRATIST

SEQ ID NO: 650871 - protein, 9 aa, Homo Sapiens
IIFLLPTPC

SEQ ID NO: 650872 - protein, 9 aa, Homo Sapiens
KDVKVKRIT

SEQ ID NO: 650873 - protein, 9 aa, Homo Sapiens
QTTSGSSAP

SEQ ID NO: 650874 - protein, 9 aa, Homo Sapiens
PQCTFFFLH

SEQ ID NO: 650875 - protein, 9 aa, Homo Sapiens
TIPKKLEYF

SEQ ID NO: 650876 - protein, 9 aa, Homo Sapiens
STVVNGVAS

SEQ ID NO: 650877 - protein, 9 aa, Homo Sapiens
QTGSRPSET

SEQ ID NO: 650878 - protein, 9 aa, Homo Sapiens
NKFAFFIDK

SEQ ID NO: 650879 - protein, 9 aa, Homo Sapiens
CIQIRNKKG

SEQ ID NO: 650880 - protein, 9 aa, Homo Sapiens
SSWSRRLKV

SEQ ID NO: 650881 - protein, 9 aa, Homo Sapiens
LYTPRYYPR

SEQ ID NO: 650882 - protein, 9 aa, Homo Sapiens
KKVDTVVIY

SEQ ID NO: 650883 - protein, 9 aa, Homo Sapiens
YDEIEVFQL

SEQ ID NO: 650884 - protein, 9 aa, Homo Sapiens
EDQDAAFFN

SEQ ID NO: 650885 - protein, 9 aa, Homo Sapiens
VKWTIEVIC

SEQ ID NO: 650886 - protein, 9 aa, Homo Sapiens
VTAPETQAK

SEQ ID NO: 650887 - protein, 9 aa, Homo Sapiens
NNYNYVIWA

SEQ ID NO: 650888 - protein, 9 aa, Homo Sapiens
SSFSGTSSS

SEQ ID NO: 650889 - protein, 9 aa, Homo Sapiens
DLLELHYEA

SEQ ID NO: 650890 - protein, 9 aa, Homo Sapiens
LSSLHSTLL

SEQ ID NO: 650891 - protein, 9 aa, Homo Sapiens
PEKEQQYIA

SEQ ID NO: 650892 - protein, 9 aa, Homo Sapiens
FCDVTVFID

SEQ ID NO: 650893 - protein, 9 aa, Homo Sapiens
LPGIESRVE

SEQ ID NO: 650894 - protein, 9 aa, Homo Sapiens
KLREYDGLV

SEQ ID NO: 650895 - protein, 9 aa, Homo Sapiens
PGQMIQIVS

SEQ ID NO: 650896 - protein, 9 aa, Homo Sapiens
DSQLSLHLL

SEQ ID NO: 650897 - protein, 9 aa, Homo Sapiens
PLVDTIWDM

SEQ ID NO: 650898 - protein, 9 aa, Homo Sapiens
KEAQWDGLT

SEQ ID NO: 650899 - protein, 9 aa, Homo Sapiens
EDSATTNDT

SEQ ID NO: 650900 - protein, 9 aa, Homo Sapiens
KNIFLVSAT

SEQ ID NO: 650901 - protein, 9 aa, Homo Sapiens
KLQNKIDQE

SEQ ID NO: 650902 - protein, 9 aa, Homo Sapiens
KSHVGQVIT

SEQ ID NO: 650903 - protein, 9 aa, Homo Sapiens
GNDLSPTVS

SEQ ID NO: 650904 - protein, 9 aa, Homo Sapiens
NSGFELFTD

SEQ ID NO: 650905 - protein, 9 aa, Homo Sapiens
VGRSTTRAQ

SEQ ID NO: 650906 - protein, 9 aa, Homo Sapiens
QEVVGIWSD

SEQ ID NO: 650907 - protein, 9 aa, Homo Sapiens
KMTRWKTFQ

SEQ ID NO: 650908 - protein, 9 aa, Homo Sapiens
PNFTLDQYC

SEQ ID NO: 650909 - protein, 9 aa, Homo Sapiens
VAICPGLGA

SEQ ID NO: 650910 - protein, 9 aa, Homo Sapiens
THVLQVSEA

SEQ ID NO: 650911 - protein, 9 aa, Homo Sapiens
NRSLHVCSN

SEQ ID NO: 650912 - protein, 9 aa, Homo Sapiens
MEDWKMKDN

SEQ ID NO: 650913 - protein, 9 aa, Homo Sapiens
KFGQWVHHT

SEQ ID NO: 650914 - protein, 9 aa, Homo Sapiens
PLYYELKIT

SEQ ID NO: 650915 - protein, 9 aa, Homo Sapiens
QDEMVSTKL

SEQ ID NO: 650916 - protein, 9 aa, Homo Sapiens
NLEDRCPRR

SEQ ID NO: 650917 - protein, 9 aa, Homo Sapiens
AGGEKSWAL

SEQ ID NO: 650918 - protein, 9 aa, Homo Sapiens
GSIREDTLA

SEQ ID NO: 650919 - protein, 9 aa, Homo Sapiens
LVKTLIVAE

SEQ ID NO: 650920 - protein, 9 aa, Homo Sapiens
KKCGNLQPT

SEQ ID NO: 650921 - protein, 9 aa, Homo Sapiens
LALLDRDSL

SEQ ID NO: 650922 - protein, 9 aa, Homo Sapiens
RELLRIAHK

SEQ ID NO: 650923 - protein, 9 aa, Homo Sapiens
GQDPLGLQL

SEQ ID NO: 650924 - protein, 9 aa, Homo Sapiens
CLEPGAAPH

SEQ ID NO: 650925 - protein, 9 aa, Homo Sapiens
LASFCQTLK

SEQ ID NO: 650926 - protein, 9 aa, Homo Sapiens
GLLCQGEQL

SEQ ID NO: 650927 - protein, 9 aa, Homo Sapiens
WLLFGSDSQ

SEQ ID NO: 650928 - protein, 9 aa, Homo Sapiens
QYIEDMAMK

SEQ ID NO: 650929 - protein, 9 aa, Homo Sapiens
AGVDKHGRP

SEQ ID NO: 650930 - protein, 9 aa, Homo Sapiens
DVAPSSLRC

SEQ ID NO: 650931 - protein, 9 aa, Homo Sapiens
AANRESQGE

SEQ ID NO: 650932 - protein, 9 aa, Homo Sapiens
MGIPETQSR

SEQ ID NO: 650933 - protein, 9 aa, Homo Sapiens
IWKHQNLQR

SEQ ID NO: 650934 - protein, 9 aa, Homo Sapiens
LLRQPPAKL

SEQ ID NO: 650935 - protein, 9 aa, Homo Sapiens
RLAFRFAGT

SEQ ID NO: 650936 - protein, 9 aa, Homo Sapiens
WGALVSFDA

SEQ ID NO: 650937 - protein, 9 aa, Homo Sapiens
FKGISRKHA

SEQ ID NO: 650938 - protein, 9 aa, Homo Sapiens
VHSPLELCD

SEQ ID NO: 650939 - protein, 9 aa, Homo Sapiens
LLPTPCKKC

SEQ ID NO: 650940 - protein, 9 aa, Homo Sapiens
VIRVAGFRM

SEQ ID NO: 650941 - protein, 9 aa, Homo Sapiens
STLKKVSIF

SEQ ID NO: 650942 - protein, 9 aa, Homo Sapiens
LFAPLKRKD

SEQ ID NO: 650943 - protein, 9 aa, Homo Sapiens
GGALLPLRA

SEQ ID NO: 650944 - protein, 9 aa, Homo Sapiens
HVRVSSRLR

SEQ ID NO: 650945 - protein, 9 aa, Homo Sapiens
MIEKLPKAC

SEQ ID NO: 650946 - protein, 9 aa, Homo Sapiens
LLPVATRLP

SEQ ID NO: 650947 - protein, 9 aa, Homo Sapiens
KCPGAPAAS

SEQ ID NO: 650948 - protein, 9 aa, Homo Sapiens
NPQGSKSPD

SEQ ID NO: 650949 - protein, 9 aa, Homo Sapiens
GRVAAAVSK

SEQ ID NO: 650950 - protein, 9 aa, Homo Sapiens
PKMLSNIIS

SEQ ID NO: 650951 - protein, 9 aa, Homo Sapiens
PILVWLFTH

SEQ ID NO: 650952 - protein, 9 aa, Homo Sapiens
SLCIRDAAA

SEQ ID NO: 650953 - protein, 9 aa, Homo Sapiens
PEHPAFQSN

SEQ ID NO: 650954 - protein, 9 aa, Homo Sapiens
QEALVDKAE

SEQ ID NO: 650955 - protein, 9 aa, Homo Sapiens
ARGLVHYFV

SEQ ID NO: 650956 - protein, 9 aa, Homo Sapiens
FDAGDYSFV

SEQ ID NO: 650957 - protein, 9 aa, Homo Sapiens
ITIKFFAPD

SEQ ID NO: 650958 - protein, 9 aa, Homo Sapiens
WRACQFHLL

SEQ ID NO: 650959 - protein, 9 aa, Homo Sapiens
FHIPQEDLV

SEQ ID NO: 650960 - protein, 9 aa, Homo Sapiens
IIVIMAVSM

SEQ ID NO: 650961 - protein, 9 aa, Homo Sapiens
LVIRVAGFR

SEQ ID NO: 650962 - protein, 9 aa, Homo Sapiens
HPRKWYMIS

SEQ ID NO: 650963 - protein, 9 aa, Homo Sapiens
LCTKDKLLA

SEQ ID NO: 650964 - protein, 9 aa, Homo Sapiens
PQSLWGVPD

SEQ ID NO: 650965 - protein, 9 aa, Homo Sapiens
VGSIPLVDT

SEQ ID NO: 650966 - protein, 9 aa, Homo Sapiens
VTLLSHDAL

SEQ ID NO: 650967 - protein, 9 aa, Homo Sapiens
LHHPIHVKN

SEQ ID NO: 650968 - protein, 9 aa, Homo Sapiens
DEILAHTGK

SEQ ID NO: 650969 - protein, 9 aa, Homo Sapiens
AYSPSTVEP

SEQ ID NO: 650970 - protein, 9 aa, Homo Sapiens
KETEKFGQW

SEQ ID NO: 650971 - protein, 9 aa, Homo Sapiens
LQNHLNTSH

SEQ ID NO: 650972 - protein, 9 aa, Homo Sapiens
NPSLCRGLV

SEQ ID NO: 650973 - protein, 9 aa, Homo Sapiens
KRHEKQLAQ

SEQ ID NO: 650974 - protein, 9 aa, Homo Sapiens
LLLVVLQGV

SEQ ID NO: 650975 - protein, 9 aa, Homo Sapiens
IITGPNKSG

SEQ ID NO: 650976 - protein, 9 aa, Homo Sapiens
LRSMGWGEE

SEQ ID NO: 650977 - protein, 9 aa, Homo Sapiens
TQWQKIGVG

SEQ ID NO: 650978 - protein, 9 aa, Homo Sapiens
GMKYIKLQC

SEQ ID NO: 650979 - protein, 9 aa, Homo Sapiens
LSMEQKNRA

SEQ ID NO: 650980 - protein, 9 aa, Homo Sapiens
IPFFPSANG

SEQ ID NO: 650981 - protein, 9 aa, Homo Sapiens
SAGPPGERG

SEQ ID NO: 650982 - protein, 9 aa, Homo Sapiens
KKEGTYSVG

SEQ ID NO: 650983 - protein, 9 aa, Homo Sapiens
GHWEQLNLP

SEQ ID NO: 650984 - protein, 9 aa, Homo Sapiens
LNKITFNSR

SEQ ID NO: 650985 - protein, 9 aa, Homo Sapiens
PLVVQVIKY

SEQ ID NO: 650986 - protein, 9 aa, Homo Sapiens
SRPDKVLEC

SEQ ID NO: 650987 - protein, 9 aa, Homo Sapiens
VLENGSSDE

SEQ ID NO: 650988 - protein, 9 aa, Homo Sapiens
QVITKRCPD

SEQ ID NO: 650989 - protein, 9 aa, Homo Sapiens
GSSWPGTWN

SEQ ID NO: 650990 - protein, 9 aa, Homo Sapiens
DLGLLSQQA

SEQ ID NO: 650991 - protein, 9 aa, Homo Sapiens
DKVLECIER

SEQ ID NO: 650992 - protein, 9 aa, Homo Sapiens
PDNSKSMKP

SEQ ID NO: 650993 - protein, 9 aa, Homo Sapiens
GQAWLPRGP

SEQ ID NO: 650994 - protein, 9 aa, Homo Sapiens
EIEVFQLNV

SEQ ID NO: 650995 - protein, 9 aa, Homo Sapiens
CDPETLICQ

SEQ ID NO: 650996 - protein, 9 aa, Homo Sapiens
IQDKKGIPP

SEQ ID NO: 650997 - protein, 9 aa, Homo Sapiens
EGIVNLPDG

SEQ ID NO: 650998 - protein, 9 aa, Homo Sapiens
MSYYYSPGL

SEQ ID NO: 650999 - protein, 9 aa, Homo Sapiens
GSAAFKFLC

SEQ ID NO: 651000 - protein, 9 aa, Homo Sapiens
EVFQLNVYD

SEQ ID NO: 651001 - protein, 9 aa, Homo Sapiens
QKAQGMPVS

SEQ ID NO: 651002 - protein, 9 aa, Homo Sapiens
NFENSSQFR

SEQ ID NO: 651003 - protein, 9 aa, Homo Sapiens
WQVYIEKFI

SEQ ID NO: 651004 - protein, 9 aa, Homo Sapiens
EQQYIAQFT

SEQ ID NO: 651005 - protein, 9 aa, Homo Sapiens
LKATMSLPL

SEQ ID NO: 651006 - protein, 9 aa, Homo Sapiens
LVAVLELGH

SEQ ID NO: 651007 - protein, 9 aa, Homo Sapiens
SLRAWLPHW

SEQ ID NO: 651008 - protein, 9 aa, Homo Sapiens
GQVITKRCP

SEQ ID NO: 651009 - protein, 9 aa, Homo Sapiens
YIPQSLWGV

SEQ ID NO: 651010 - protein, 9 aa, Homo Sapiens
VKDCDGSDF

SEQ ID NO: 651011 - protein, 9 aa, Homo Sapiens
QENKKGKLG

SEQ ID NO: 651012 - protein, 9 aa, Homo Sapiens
YIVGVVVKA

SEQ ID NO: 651013 - protein, 9 aa, Homo Sapiens
SGDPQEIRM

SEQ ID NO: 651014 - protein, 9 aa, Homo Sapiens
FVVFLAIYL

SEQ ID NO: 651015 - protein, 9 aa, Homo Sapiens
AVEKPYKCE

SEQ ID NO: 651016 - protein, 9 aa, Homo Sapiens
LSNMFLQAS

SEQ ID NO: 651017 - protein, 9 aa, Homo Sapiens
PELPNTLTF

SEQ ID NO: 651018 - protein, 9 aa, Homo Sapiens
YLDSGIHCG

SEQ ID NO: 651019 - protein, 9 aa, Homo Sapiens
HYMVIMNPS

SEQ ID NO: 651020 - protein, 9 aa, Homo Sapiens
SMEQKNRAI

SEQ ID NO: 651021 - protein, 9 aa, Homo Sapiens
DSFLYLEPL

SEQ ID NO: 651022 - protein, 9 aa, Homo Sapiens
KETKTFGGV

SEQ ID NO: 651023 - protein, 9 aa, Homo Sapiens
VFELMEAPG

SEQ ID NO: 651024 - protein, 9 aa, Homo Sapiens
NQSCSLTKH

SEQ ID NO: 651025 - protein, 9 aa, Homo Sapiens
RLNKPMYFF

SEQ ID NO: 651026 - protein, 9 aa, Homo Sapiens
RESRKALRA

SEQ ID NO: 651027 - protein, 9 aa, Homo Sapiens
GFIDLPEFT

SEQ ID NO: 651028 - protein, 9 aa, Homo Sapiens
ESRNHIDRA

SEQ ID NO: 651029 - protein, 9 aa, Homo Sapiens
DAKCHIVIE

SEQ ID NO: 651030 - protein, 9 aa, Homo Sapiens
ELLRIAHKF

SEQ ID NO: 651031 - protein, 9 aa, Homo Sapiens
AQIYDVVLV

SEQ ID NO: 651032 - protein, 9 aa, Homo Sapiens
VLNAIEEEE

SEQ ID NO: 651033 - protein, 9 aa, Homo Sapiens
CKKSGLDTS

SEQ ID NO: 651034 - protein, 9 aa, Homo Sapiens
FCLVMSMMH

SEQ ID NO: 651035 - protein, 9 aa, Homo Sapiens
IKACKKLAY

SEQ ID NO: 651036 - protein, 9 aa, Homo Sapiens
ATGFIILRN

SEQ ID NO: 651037 - protein, 9 aa, Homo Sapiens
GGASQADGT

SEQ ID NO: 651038 - protein, 9 aa, Homo Sapiens
VEHGAIEER

SEQ ID NO: 651039 - protein, 9 aa, Homo Sapiens
LILEKASDK

SEQ ID NO: 651040 - protein, 9 aa, Homo Sapiens
GHTAVAICP

SEQ ID NO: 651041 - protein, 9 aa, Homo Sapiens
ISFTVTSAP

SEQ ID NO: 651042 - protein, 9 aa, Homo Sapiens
ERELQAFQN

SEQ ID NO: 651043 - protein, 9 aa, Homo Sapiens
ELLVKTLIV

SEQ ID NO: 651044 - protein, 9 aa, Homo Sapiens
RSCGSGTTM

SEQ ID NO: 651045 - protein, 9 aa, Homo Sapiens
CGAKTVRYA

SEQ ID NO: 651046 - protein, 9 aa, Homo Sapiens
FSQEELGLL

SEQ ID NO: 651047 - protein, 9 aa, Homo Sapiens
MISITQWQK

SEQ ID NO: 651048 - protein, 9 aa, Homo Sapiens
VVVKLLSEE

SEQ ID NO: 651049 - protein, 9 aa, Homo Sapiens
MATTYISVT

SEQ ID NO: 651050 - protein, 9 aa, Homo Sapiens
FKRFSTSAS

SEQ ID NO: 651051 - protein, 9 aa, Homo Sapiens
TAVAICPGL

SEQ ID NO: 651052 - protein, 9 aa, Homo Sapiens
FAEMKQNFE

SEQ ID NO: 651053 - protein, 9 aa, Homo Sapiens
AYNSVELHQ

SEQ ID NO: 651054 - protein, 9 aa, Homo Sapiens
VDVNIPTDF

SEQ ID NO: 651055 - protein, 9 aa, Homo Sapiens
FQWHKIMIG

SEQ ID NO: 651056 - protein, 9 aa, Homo Sapiens
MNHVTLDRG

SEQ ID NO: 651057 - protein, 9 aa, Homo Sapiens
GNGLVIRVA

SEQ ID NO: 651058 - protein, 9 aa, Homo Sapiens
CHIVIEKPT

SEQ ID NO: 651059 - protein, 9 aa, Homo Sapiens
SVKESSRSF

SEQ ID NO: 651060 - protein, 9 aa, Homo Sapiens
WYRQFLKQS

SEQ ID NO: 651061 - protein, 9 aa, Homo Sapiens
PRGTRESRK

SEQ ID NO: 651062 - protein, 9 aa, Homo Sapiens
CDITQVVWI

SEQ ID NO: 651063 - protein, 9 aa, Homo Sapiens
KMKDNQKCS

SEQ ID NO: 651064 - protein, 9 aa, Homo Sapiens
CLTVPRYKQ

SEQ ID NO: 651065 - protein, 9 aa, Homo Sapiens
FPGAIFQGR

SEQ ID NO: 651066 - protein, 9 aa, Homo Sapiens
VEHQEEQSV

SEQ ID NO: 651067 - protein, 9 aa, Homo Sapiens
VSGQDDSSD

SEQ ID NO: 651068 - protein, 9 aa, Homo Sapiens
QPVASFAKA

SEQ ID NO: 651069 - protein, 9 aa, Homo Sapiens
VSVNFYEFV

SEQ ID NO: 651070 - protein, 9 aa, Homo Sapiens
LKHGANIRD

SEQ ID NO: 651071 - protein, 9 aa, Homo Sapiens
SAGLLCQGE

SEQ ID NO: 651072 - protein, 9 aa, Homo Sapiens
VSQGAHLSS

SEQ ID NO: 651073 - protein, 9 aa, Homo Sapiens
GFPLGTHGD

SEQ ID NO: 651074 - protein, 9 aa, Homo Sapiens
MTFRERTVR

SEQ ID NO: 651075 - protein, 9 aa, Homo Sapiens
LRKSLQASL

SEQ ID NO: 651076 - protein, 9 aa, Homo Sapiens
PTEESVEKG

SEQ ID NO: 651077 - protein, 9 aa, Homo Sapiens
LSEEHWKVV

SEQ ID NO: 651078 - protein, 9 aa, Homo Sapiens
PCGGHDCSG

SEQ ID NO: 651079 - protein, 9 aa, Homo Sapiens
TDGTIVRYF

SEQ ID NO: 651080 - protein, 9 aa, Homo Sapiens
EYRLQAGVP

SEQ ID NO: 651081 - protein, 9 aa, Homo Sapiens
FENLNTEKF

SEQ ID NO: 651082 - protein, 9 aa, Homo Sapiens
CLDWWQEWP

SEQ ID NO: 651083 - protein, 9 aa, Homo Sapiens
NKNKKCGNL

SEQ ID NO: 651084 - protein, 9 aa, Homo Sapiens
TNFNQGRSS

SEQ ID NO: 651085 - protein, 9 aa, Homo Sapiens
LLRLRHACC

SEQ ID NO: 651086 - protein, 9 aa, Homo Sapiens
PPSGLEEVS

SEQ ID NO: 651087 - protein, 9 aa, Homo Sapiens
KLTLGSATN

SEQ ID NO: 651088 - protein, 9 aa, Homo Sapiens
QHLGECGHL

SEQ ID NO: 651089 - protein, 9 aa, Homo Sapiens
LPLVVQVIK

SEQ ID NO: 651090 - protein, 9 aa, Homo Sapiens
PMRDMGHPQ

SEQ ID NO: 651091 - protein, 9 aa, Homo Sapiens
AHRTQGFPL

SEQ ID NO: 651092 - protein, 9 aa, Homo Sapiens
FVCKSAYHP

SEQ ID NO: 651093 - protein, 9 aa, Homo Sapiens
YTPRYYPRG

SEQ ID NO: 651094 - protein, 9 aa, Homo Sapiens
VLELGHALG

SEQ ID NO: 651095 - protein, 9 aa, Homo Sapiens
GVDVNIPTD

SEQ ID NO: 651096 - protein, 9 aa, Homo Sapiens
NYVIWAKVK

SEQ ID NO: 651097 - protein, 9 aa, Homo Sapiens
WGVPDSPQR

SEQ ID NO: 651098 - protein, 9 aa, Homo Sapiens
RHIHDVLVS

SEQ ID NO: 651099 - protein, 9 aa, Homo Sapiens
VDMPTYNPE

SEQ ID NO: 651100 - protein, 9 aa, Homo Sapiens
SPEEHVMLG

SEQ ID NO: 651101 - protein, 9 aa, Homo Sapiens
LEGIVNLPD

SEQ ID NO: 651102 - protein, 9 aa, Homo Sapiens
LKKGTWRPC

SEQ ID NO: 651103 - protein, 9 aa, Homo Sapiens
VTLERSPGG

SEQ ID NO: 651104 - protein, 9 aa, Homo Sapiens
KSISVSVNF

SEQ ID NO: 651105 - protein, 9 aa, Homo Sapiens
QRAMKLQKL

SEQ ID NO: 651106 - protein, 9 aa, Homo Sapiens
YDGLVDALI

SEQ ID NO: 651107 - protein, 9 aa, Homo Sapiens
VDSAPQLEA

SEQ ID NO: 651108 - protein, 9 aa, Homo Sapiens
YVLLLTLAV

SEQ ID NO: 651109 - protein, 9 aa, Homo Sapiens
ISKTGMILS

SEQ ID NO: 651110 - protein, 9 aa, Homo Sapiens
FDLAETKAE

SEQ ID NO: 651111 - protein, 9 aa, Homo Sapiens
EAAAECPSF

SEQ ID NO: 651112 - protein, 9 aa, Homo Sapiens
QTGSCCMTQ

SEQ ID NO: 651113 - protein, 9 aa, Homo Sapiens
TVSAFAAFS

SEQ ID NO: 651114 - protein, 9 aa, Homo Sapiens
QDLYTIRSN

SEQ ID NO: 651115 - protein, 9 aa, Homo Sapiens
LGLRLDWFR

SEQ ID NO: 651116 - protein, 9 aa, Homo Sapiens
NQDAKLSNM

SEQ ID NO: 651117 - protein, 9 aa, Homo Sapiens
HQKIHNGQK

SEQ ID NO: 651118 - protein, 9 aa, Homo Sapiens
RNLGKRSQG

SEQ ID NO: 651119 - protein, 9 aa, Homo Sapiens
TLATQFDLA

SEQ ID NO: 651120 - protein, 9 aa, Homo Sapiens
SSEDNFENS

SEQ ID NO: 651121 - protein, 9 aa, Homo Sapiens
TNSSPLFLH

SEQ ID NO: 651122 - protein, 9 aa, Homo Sapiens
GKEAVTLVE

SEQ ID NO: 651123 - protein, 9 aa, Homo Sapiens
DFERIIMPG

SEQ ID NO: 651124 - protein, 9 aa, Homo Sapiens
LTAKRCLFC

SEQ ID NO: 651125 - protein, 9 aa, Homo Sapiens
GECGHLDPA

SEQ ID NO: 651126 - protein, 9 aa, Homo Sapiens
SSLGAAGRT

SEQ ID NO: 651127 - protein, 9 aa, Homo Sapiens
KMDGYNLSL

SEQ ID NO: 651128 - protein, 9 aa, Homo Sapiens
WEPTSWQTS

SEQ ID NO: 651129 - protein, 9 aa, Homo Sapiens
TTMDSRVQV

SEQ ID NO: 651130 - protein, 9 aa, Homo Sapiens
EEEVASKLD

SEQ ID NO: 651131 - protein, 9 aa, Homo Sapiens
TVNGPREPR

SEQ ID NO: 651132 - protein, 9 aa, Homo Sapiens
PEQCMQDLF

SEQ ID NO: 651133 - protein, 9 aa, Homo Sapiens
SVLSYDISA

SEQ ID NO: 651134 - protein, 9 aa, Homo Sapiens
NSSREKSEL

SEQ ID NO: 651135 - protein, 9 aa, Homo Sapiens
LGGNPFWKT

SEQ ID NO: 651136 - protein, 9 aa, Homo Sapiens
NFLQLICQV

SEQ ID NO: 651137 - protein, 9 aa, Homo Sapiens
QQPAIHPVA

SEQ ID NO: 651138 - protein, 9 aa, Homo Sapiens
ILDSQLSLH

SEQ ID NO: 651139 - protein, 9 aa, Homo Sapiens
TTGSASPKN

SEQ ID NO: 651140 - protein, 9 aa, Homo Sapiens
ASLQKELQD

SEQ ID NO: 651141 - protein, 9 aa, Homo Sapiens
ESVDLLDEA

SEQ ID NO: 651142 - protein, 9 aa, Homo Sapiens
ILWFHLDWV

SEQ ID NO: 651143 - protein, 9 aa, Homo Sapiens
HESLEPNSG

SEQ ID NO: 651144 - protein, 9 aa, Homo Sapiens
HAQTTSGSS

SEQ ID NO: 651145 - protein, 9 aa, Homo Sapiens
GNQFPKILW

SEQ ID NO: 651146 - protein, 9 aa, Homo Sapiens
NSCTCPNDQ

SEQ ID NO: 651147 - protein, 9 aa, Homo Sapiens
QMAERKSKK

SEQ ID NO: 651148 - protein, 9 aa, Homo Sapiens
ETGSEISSD

SEQ ID NO: 651149 - protein, 9 aa, Homo Sapiens
TVSFNLMFK

SEQ ID NO: 651150 - protein, 9 aa, Homo Sapiens
DPRLNKPMY

SEQ ID NO: 651151 - protein, 9 aa, Homo Sapiens
NEENWKSKE

SEQ ID NO: 651152 - protein, 9 aa, Homo Sapiens
SPNENVAIH

SEQ ID NO: 651153 - protein, 9 aa, Homo Sapiens
DYLYNFTCT

SEQ ID NO: 651154 - protein, 9 aa, Homo Sapiens
LTVRIVFNK

SEQ ID NO: 651155 - protein, 9 aa, Homo Sapiens
IQFADDIQE

SEQ ID NO: 651156 - protein, 9 aa, Homo Sapiens
FSTNLLTDS

SEQ ID NO: 651157 - protein, 9 aa, Homo Sapiens
RIADCTMAF

SEQ ID NO: 651158 - protein, 9 aa, Homo Sapiens
IIQSFGRKV

SEQ ID NO: 651159 - protein, 9 aa, Homo Sapiens
SLGRPLSAE

SEQ ID NO: 651160 - protein, 9 aa, Homo Sapiens
KQGLVKLTL

SEQ ID NO: 651161 - protein, 9 aa, Homo Sapiens
AKSSVKESS

SEQ ID NO: 651162 - protein, 9 aa, Homo Sapiens
LDLFKKLSG

SEQ ID NO: 651163 - protein, 9 aa, Homo Sapiens
RAGPVTLEP

SEQ ID NO: 651164 - protein, 9 aa, Homo Sapiens
LHQKIHNGQ

SEQ ID NO: 651165 - protein, 9 aa, Homo Sapiens
YSLIIKDLT

SEQ ID NO: 651166 - protein, 9 aa, Homo Sapiens
DHGAAEIQV

SEQ ID NO: 651167 - protein, 9 aa, Homo Sapiens
AAFKFLCLP

SEQ ID NO: 651168 - protein, 9 aa, Homo Sapiens
NVEEGNEEG

SEQ ID NO: 651169 - protein, 9 aa, Homo Sapiens
AKNLVSITK

SEQ ID NO: 651170 - protein, 9 aa, Homo Sapiens
PVQLPFPPC

SEQ ID NO: 651171 - protein, 9 aa, Homo Sapiens
FKHKKSFII

SEQ ID NO: 651172 - protein, 9 aa, Homo Sapiens
HVQEYEFIV

SEQ ID NO: 651173 - protein, 9 aa, Homo Sapiens
LGEQNDNRN

SEQ ID NO: 651174 - protein, 9 aa, Homo Sapiens
PELMASFLP

SEQ ID NO: 651175 - protein, 9 aa, Homo Sapiens
LYEENIFMY

SEQ ID NO: 651176 - protein, 9 aa, Homo Sapiens
QTTIVLVVS

SEQ ID NO: 651177 - protein, 9 aa, Homo Sapiens
EHQEEQSVC

SEQ ID NO: 651178 - protein, 9 aa, Homo Sapiens
LSHESLEPN

SEQ ID NO: 651179 - protein, 9 aa, Homo Sapiens
VKKEASEDA

SEQ ID NO: 651180 - protein, 9 aa, Homo Sapiens
GNLASPNAA

SEQ ID NO: 651181 - protein, 9 aa, Homo Sapiens
LSMTSKAGL

SEQ ID NO: 651182 - protein, 9 aa, Homo Sapiens
IMLDLSNLQ

SEQ ID NO: 651183 - protein, 9 aa, Homo Sapiens
VNKCLDFNN

SEQ ID NO: 651184 - protein, 9 aa, Homo Sapiens
PALQPVASF

SEQ ID NO: 651185 - protein, 9 aa, Homo Sapiens
RNDLLDLVA

SEQ ID NO: 651186 - protein, 9 aa, Homo Sapiens
RMVSGQDDS

SEQ ID NO: 651187 - protein, 9 aa, Homo Sapiens
QIYDVVLVG

SEQ ID NO: 651188 - protein, 9 aa, Homo Sapiens
YNGVIPFDD

SEQ ID NO: 651189 - protein, 9 aa, Homo Sapiens
AYHPTKSHS

SEQ ID NO: 651190 - protein, 9 aa, Homo Sapiens
ERSVADSHL

SEQ ID NO: 651191 - protein, 9 aa, Homo Sapiens
FIKELVSDA

SEQ ID NO: 651192 - protein, 9 aa, Homo Sapiens
NKITFNSRF

SEQ ID NO: 651193 - protein, 9 aa, Homo Sapiens
VSQDLYTIR

SEQ ID NO: 651194 - protein, 9 aa, Homo Sapiens
FQTLVIEMV

SEQ ID NO: 651195 - protein, 9 aa, Homo Sapiens
EDAKCHIVI

SEQ ID NO: 651196 - protein, 9 aa, Homo Sapiens
PLENGHVGL

SEQ ID NO: 651197 - protein, 9 aa, Homo Sapiens
DGCVTDHFS

SEQ ID NO: 651198 - protein, 9 aa, Homo Sapiens
YQLVAQIKE

SEQ ID NO: 651199 - protein, 9 aa, Homo Sapiens
KLLSEEHWK

SEQ ID NO: 651200 - protein, 9 aa, Homo Sapiens
DKARNENKP

SEQ ID NO: 651201 - protein, 9 aa, Homo Sapiens
LTLLWTELF

SEQ ID NO: 651202 - protein, 9 aa, Homo Sapiens
WRNLLWHQV

SEQ ID NO: 651203 - protein, 9 aa, Homo Sapiens
RVPRSDCKI

SEQ ID NO: 651204 - protein, 9 aa, Homo Sapiens
GMSYYYSPG

SEQ ID NO: 651205 - protein, 9 aa, Homo Sapiens
LRRRYESSP

SEQ ID NO: 651206 - protein, 9 aa, Homo Sapiens
AVMSCSGYD

SEQ ID NO: 651207 - protein, 9 aa, Homo Sapiens
HTAVAICPG

SEQ ID NO: 651208 - protein, 9 aa, Homo Sapiens
SQRCGAKTV

SEQ ID NO: 651209 - protein, 9 aa, Homo Sapiens
TMQVGFIVG

SEQ ID NO: 651210 - protein, 9 aa, Homo Sapiens
VICKKSGLD

SEQ ID NO: 651211 - protein, 9 aa, Homo Sapiens
SLHVCSNNS

SEQ ID NO: 651212 - protein, 9 aa, Homo Sapiens
ASPKNQKKS

SEQ ID NO: 651213 - protein, 9 aa, Homo Sapiens
TSKAGLPCL

SEQ ID NO: 651214 - protein, 9 aa, Homo Sapiens
CDFAAREWV

SEQ ID NO: 651215 - protein, 9 aa, Homo Sapiens
GNNFGYVVA

SEQ ID NO: 651216 - protein, 9 aa, Homo Sapiens
FEVQWQLAQ

SEQ ID NO: 651217 - protein, 9 aa, Homo Sapiens
PVSGVALAE

SEQ ID NO: 651218 - protein, 9 aa, Homo Sapiens
GQKREDDHG

SEQ ID NO: 651219 - protein, 9 aa, Homo Sapiens
LSLIHAVMP

SEQ ID NO: 651220 - protein, 9 aa, Homo Sapiens
SAYRLTIRA

SEQ ID NO: 651221 - protein, 9 aa, Homo Sapiens
LYYCFTSLW

SEQ ID NO: 651222 - protein, 9 aa, Homo Sapiens
VRVSSRLRL

SEQ ID NO: 651223 - protein, 9 aa, Homo Sapiens
HTNLDPVSP

SEQ ID NO: 651224 - protein, 9 aa, Homo Sapiens
MKSNFLQLI

SEQ ID NO: 651225 - protein, 9 aa, Homo Sapiens
FQKSGHCTA

SEQ ID NO: 651226 - protein, 9 aa, Homo Sapiens
GYSVMVLLI

SEQ ID NO: 651227 - protein, 9 aa, Homo Sapiens
GGNIIVIMA

SEQ ID NO: 651228 - protein, 9 aa, Homo Sapiens
ANWGHRTSL

SEQ ID NO: 651229 - protein, 9 aa, Homo Sapiens
NPYRYVVVL

SEQ ID NO: 651230 - protein, 9 aa, Homo Sapiens
ECEKTFRQS

SEQ ID NO: 651231 - protein, 9 aa, Homo Sapiens
QLAESVDLL

SEQ ID NO: 651232 - protein, 9 aa, Homo Sapiens
NESTQKKNK

SEQ ID NO: 651233 - protein, 9 aa, Homo Sapiens
TLIRVRNPR

SEQ ID NO: 651234 - protein, 9 aa, Homo Sapiens
TKKIGTLHT

SEQ ID NO: 651235 - protein, 9 aa, Homo Sapiens
CLDGRAALS

SEQ ID NO: 651236 - protein, 9 aa, Homo Sapiens
LEAVLRRQK

SEQ ID NO: 651237 - protein, 9 aa, Homo Sapiens
AAVADHYLA

SEQ ID NO: 651238 - protein, 9 aa, Homo Sapiens
SLPLAGSED

SEQ ID NO: 651239 - protein, 9 aa, Homo Sapiens
ALPSLRAWL

SEQ ID NO: 651240 - protein, 9 aa, Homo Sapiens
QAKCEASHP

SEQ ID NO: 651241 - protein, 9 aa, Homo Sapiens
TGHWEQLNL

SEQ ID NO: 651242 - protein, 9 aa, Homo Sapiens
SPGIPNPSP

SEQ ID NO: 651243 - protein, 9 aa, Homo Sapiens
RLGSEPIRA

SEQ ID NO: 651244 - protein, 9 aa, Homo Sapiens
IEKPMGIFP

SEQ ID NO: 651245 - protein, 9 aa, Homo Sapiens
EPIRASNPD

SEQ ID NO: 651246 - protein, 9 aa, Homo Sapiens
LTLVSRASF

SEQ ID NO: 651247 - protein, 9 aa, Homo Sapiens
GIYITGVDS

SEQ ID NO: 651248 - protein, 9 aa, Homo Sapiens
GTRVALNPW

SEQ ID NO: 651249 - protein, 9 aa, Homo Sapiens
DLTEEDAGN

SEQ ID NO: 651250 - protein, 9 aa, Homo Sapiens
KGALLKVLW

SEQ ID NO: 651251 - protein, 9 aa, Homo Sapiens
EKSWALPQQ

SEQ ID NO: 651252 - protein, 9 aa, Homo Sapiens
LTQEEDYQG

SEQ ID NO: 651253 - protein, 9 aa, Homo Sapiens
VDLLDEAGS

SEQ ID NO: 651254 - protein, 9 aa, Homo Sapiens
RIERSVADS

SEQ ID NO: 651255 - protein, 9 aa, Homo Sapiens
KEGTYSVGT

SEQ ID NO: 651256 - protein, 9 aa, Homo Sapiens
LLGKPPLRC

SEQ ID NO: 651257 - protein, 9 aa, Homo Sapiens
HCSAEGERL

SEQ ID NO: 651258 - protein, 9 aa, Homo Sapiens
GPPKTDLTA

SEQ ID NO: 651259 - protein, 9 aa, Homo Sapiens
RHWAVKIVT

SEQ ID NO: 651260 - protein, 9 aa, Homo Sapiens
EGSNCGESR

SEQ ID NO: 651261 - protein, 9 aa, Homo Sapiens
IWGFGKHGF

SEQ ID NO: 651262 - protein, 9 aa, Homo Sapiens
ASQPTEANW

SEQ ID NO: 651263 - protein, 9 aa, Homo Sapiens
ERIGFQYGV

SEQ ID NO: 651264 - protein, 9 aa, Homo Sapiens
LIRVRNPRG

SEQ ID NO: 651265 - protein, 9 aa, Homo Sapiens
AWQALGPWN

SEQ ID NO: 651266 - protein, 9 aa, Homo Sapiens
EILAHTGKE

SEQ ID NO: 651267 - protein, 9 aa, Homo Sapiens
KPQEVHMVN

SEQ ID NO: 651268 - protein, 9 aa, Homo Sapiens
PGMTNVFSY

SEQ ID NO: 651269 - protein, 9 aa, Homo Sapiens
EGMKYIKLQ

SEQ ID NO: 651270 - protein, 9 aa, Homo Sapiens
RNLNIIITH

SEQ ID NO: 651271 - protein, 9 aa, Homo Sapiens
AEETPGGRL

SEQ ID NO: 651272 - protein, 9 aa, Homo Sapiens
THDLAFEEL

SEQ ID NO: 651273 - protein, 9 aa, Homo Sapiens
QQVQQVADY

SEQ ID NO: 651274 - protein, 9 aa, Homo Sapiens
DSATTNDTA

SEQ ID NO: 651275 - protein, 9 aa, Homo Sapiens
ITGVNASMR

SEQ ID NO: 651276 - protein, 9 aa, Homo Sapiens
PFQQIYEKR

SEQ ID NO: 651277 - protein, 9 aa, Homo Sapiens
IEQFWDFID

SEQ ID NO: 651278 - protein, 9 aa, Homo Sapiens
KFQENQKEF

SEQ ID NO: 651279 - protein, 9 aa, Homo Sapiens
FEQEKKHRP

SEQ ID NO: 651280 - protein, 9 aa, Homo Sapiens
GIQGDKGLK

SEQ ID NO: 651281 - protein, 9 aa, Homo Sapiens
DSFVPPSGH

SEQ ID NO: 651282 - protein, 9 aa, Homo Sapiens
PHVRVSSRL

SEQ ID NO: 651283 - protein, 9 aa, Homo Sapiens
QGTGDMNSP

SEQ ID NO: 651284 - protein, 9 aa, Homo Sapiens
EGQDPLGLQ

SEQ ID NO: 651285 - protein, 9 aa, Homo Sapiens
NIQEPPLQG

SEQ ID NO: 651286 - protein, 9 aa, Homo Sapiens
MRMHTGVRP

SEQ ID NO: 651287 - protein, 9 aa, Homo Sapiens
VSGGYPQFA

SEQ ID NO: 651288 - protein, 9 aa, Homo Sapiens
MNSFVNNIF

SEQ ID NO: 651289 - protein, 9 aa, Homo Sapiens
RLVPIGKCM

SEQ ID NO: 651290 - protein, 9 aa, Homo Sapiens
DSANEEMEW

SEQ ID NO: 651291 - protein, 9 aa, Homo Sapiens
TETASQPNS

SEQ ID NO: 651292 - protein, 9 aa, Homo Sapiens
FFGAGTNTY

SEQ ID NO: 651293 - protein, 9 aa, Homo Sapiens
PRFKRFSTS

SEQ ID NO: 651294 - protein, 9 aa, Homo Sapiens
TQFDLAETK

SEQ ID NO: 651295 - protein, 9 aa, Homo Sapiens
LIVRRRLSK

SEQ ID NO: 651296 - protein, 9 aa, Homo Sapiens
VSYDQNEIK

SEQ ID NO: 651297 - protein, 9 aa, Homo Sapiens
SVFEEDGCV

SEQ ID NO: 651298 - protein, 9 aa, Homo Sapiens
PSPSSPTPL

SEQ ID NO: 651299 - protein, 9 aa, Homo Sapiens
FEFLGLRLD

SEQ ID NO: 651300 - protein, 9 aa, Homo Sapiens
VLDGEAEEV

SEQ ID NO: 651301 - protein, 9 aa, Homo Sapiens
VSQYSAWYT

SEQ ID NO: 651302 - protein, 9 aa, Homo Sapiens
SGSAAFKFL

SEQ ID NO: 651303 - protein, 9 aa, Homo Sapiens
ISCYMEHRF

SEQ ID NO: 651304 - protein, 9 aa, Homo Sapiens
WREHRSGEP

SEQ ID NO: 651305 - protein, 9 aa, Homo Sapiens
ESSSSNSSS

SEQ ID NO: 651306 - protein, 9 aa, Homo Sapiens
LVEVLYQGS

SEQ ID NO: 651307 - protein, 9 aa, Homo Sapiens
FPSDTFDTM

SEQ ID NO: 651308 - protein, 9 aa, Homo Sapiens
EWPMYQIYP

SEQ ID NO: 651309 - protein, 9 aa, Homo Sapiens
AIQEALVDK

SEQ ID NO: 651310 - protein, 9 aa, Homo Sapiens
WDSIFGDFE

SEQ ID NO: 651311 - protein, 9 aa, Homo Sapiens
NKEKKKEKH

SEQ ID NO: 651312 - protein, 9 aa, Homo Sapiens
LGKPPLRCT

SEQ ID NO: 651313 - protein, 9 aa, Homo Sapiens
LVTYSEVLG

SEQ ID NO: 651314 - protein, 9 aa, Homo Sapiens
TSTVFKSPL

SEQ ID NO: 651315 - protein, 9 aa, Homo Sapiens
LYQLFTLTS

SEQ ID NO: 651316 - protein, 9 aa, Homo Sapiens
RKLIYETLS

SEQ ID NO: 651317 - protein, 9 aa, Homo Sapiens
PSGGAPMRD

SEQ ID NO: 651318 - protein, 9 aa, Homo Sapiens
RNYLIQTEE

SEQ ID NO: 651319 - protein, 9 aa, Homo Sapiens
VGTVGTQDV

SEQ ID NO: 651320 - protein, 9 aa, Homo Sapiens
DLAFEELFG

SEQ ID NO: 651321 - protein, 9 aa, Homo Sapiens
LNEDLHHPI

SEQ ID NO: 651322 - protein, 9 aa, Homo Sapiens
NSGGDGSAG

SEQ ID NO: 651323 - protein, 9 aa, Homo Sapiens
GGDNPLVLH

SEQ ID NO: 651324 - protein, 9 aa, Homo Sapiens
SYDQNEIKE

SEQ ID NO: 651325 - protein, 9 aa, Homo Sapiens
ERLVPIGKC

SEQ ID NO: 651326 - protein, 9 aa, Homo Sapiens
QKKNKDLQI

SEQ ID NO: 651327 - protein, 9 aa, Homo Sapiens
EKFGQWVHH

SEQ ID NO: 651328 - protein, 9 aa, Homo Sapiens
DISVDRYWA

SEQ ID NO: 651329 - protein, 9 aa, Homo Sapiens
TCCKCRKKN

SEQ ID NO: 651330 - protein, 9 aa, Homo Sapiens
STVEEGDTA

SEQ ID NO: 651331 - protein, 9 aa, Homo Sapiens
QHLKETFCR

SEQ ID NO: 651332 - protein, 9 aa, Homo Sapiens
YFSQEELGL

SEQ ID NO: 651333 - protein, 9 aa, Homo Sapiens
SEEHWKVVK

SEQ ID NO: 651334 - protein, 9 aa, Homo Sapiens
QEAFDKARN

SEQ ID NO: 651335 - protein, 9 aa, Homo Sapiens
DQNEIKEQL

SEQ ID NO: 651336 - protein, 9 aa, Homo Sapiens
LLSQQAQVE

SEQ ID NO: 651337 - protein, 9 aa, Homo Sapiens
ELWDLTEAW

SEQ ID NO: 651338 - protein, 9 aa, Homo Sapiens
NGNGLECFQ

SEQ ID NO: 651339 - protein, 9 aa, Homo Sapiens
FLLDLFKKL

SEQ ID NO: 651340 - protein, 9 aa, Homo Sapiens
ALSPGLSWH

SEQ ID NO: 651341 - protein, 9 aa, Homo Sapiens
LQKLHLWVT

SEQ ID NO: 651342 - protein, 9 aa, Homo Sapiens
LLPLRALPS

SEQ ID NO: 651343 - protein, 9 aa, Homo Sapiens
SYWIPKKLP

SEQ ID NO: 651344 - protein, 9 aa, Homo Sapiens
HIPQEDLVR

SEQ ID NO: 651345 - protein, 9 aa, Homo Sapiens
EERLETPQE

SEQ ID NO: 651346 - protein, 9 aa, Homo Sapiens
RNKKGDHAN

SEQ ID NO: 651347 - protein, 9 aa, Homo Sapiens
EPQMAIHIY

SEQ ID NO: 651348 - protein, 9 aa, Homo Sapiens
GIMAFDRYV

SEQ ID NO: 651349 - protein, 9 aa, Homo Sapiens
HDVLVSGIP

SEQ ID NO: 651350 - protein, 9 aa, Homo Sapiens
DMAMKAYDG

SEQ ID NO: 651351 - protein, 9 aa, Homo Sapiens
TGHQRTSML

SEQ ID NO: 651352 - protein, 9 aa, Homo Sapiens
PVVMSRKIC

SEQ ID NO: 651353 - protein, 9 aa, Homo Sapiens
ADMWSVACT

SEQ ID NO: 651354 - protein, 9 aa, Homo Sapiens
FSKFEKNTS

SEQ ID NO: 651355 - protein, 9 aa, Homo Sapiens
RLPGIESRV

SEQ ID NO: 651356 - protein, 9 aa, Homo Sapiens
TQGFPLGTH

SEQ ID NO: 651357 - protein, 9 aa, Homo Sapiens
EGQASSWSR

SEQ ID NO: 651358 - protein, 9 aa, Homo Sapiens
EPLRNIERI

SEQ ID NO: 651359 - protein, 9 aa, Homo Sapiens
WEVLVTYSE

SEQ ID NO: 651360 - protein, 9 aa, Homo Sapiens
PLQSTLFRS

SEQ ID NO: 651361 - protein, 9 aa, Homo Sapiens
CHSNAIDHF

SEQ ID NO: 651362 - protein, 9 aa, Homo Sapiens
QNGQLISYW

SEQ ID NO: 651363 - protein, 9 aa, Homo Sapiens
VLVTNVICA

SEQ ID NO: 651364 - protein, 9 aa, Homo Sapiens
LPEGPAGVL

SEQ ID NO: 651365 - protein, 9 aa, Homo Sapiens
YSSSNNFYK

SEQ ID NO: 651366 - protein, 9 aa, Homo Sapiens
TEHESIHTG

SEQ ID NO: 651367 - protein, 9 aa, Homo Sapiens
LKTTVFGIT

SEQ ID NO: 651368 - protein, 9 aa, Homo Sapiens
KEQQYIAQF

SEQ ID NO: 651369 - protein, 9 aa, Homo Sapiens
FTHDLAFEE

SEQ ID NO: 651370 - protein, 9 aa, Homo Sapiens
VLVSLESAE

SEQ ID NO: 651371 - protein, 9 aa, Homo Sapiens
KDLLAGRVA

SEQ ID NO: 651372 - protein, 9 aa, Homo Sapiens
SSSPSSSTI

SEQ ID NO: 651373 - protein, 9 aa, Homo Sapiens
LIVMSHDRY

SEQ ID NO: 651374 - protein, 9 aa, Homo Sapiens
VMSCSGYDI

SEQ ID NO: 651375 - protein, 9 aa, Homo Sapiens
QKSFYRVSY

SEQ ID NO: 651376 - protein, 9 aa, Homo Sapiens
LYNFTCTGD

SEQ ID NO: 651377 - protein, 9 aa, Homo Sapiens
FHECGKVFR

SEQ ID NO: 651378 - protein, 9 aa, Homo Sapiens
LVYPCGACQ

SEQ ID NO: 651379 - protein, 9 aa, Homo Sapiens
VLRTACSPD

SEQ ID NO: 651380 - protein, 9 aa, Homo Sapiens
CQRKSATAA

SEQ ID NO: 651381 - protein, 9 aa, Homo Sapiens
LTAKSNSSL

SEQ ID NO: 651382 - protein, 9 aa, Homo Sapiens
GKESCDVFL

SEQ ID NO: 651383 - protein, 9 aa, Homo Sapiens
LFDFQWHKI

SEQ ID NO: 651384 - protein, 9 aa, Homo Sapiens
KLQKLHLWV

SEQ ID NO: 651385 - protein, 9 aa, Homo Sapiens
IQIRNKKGD

SEQ ID NO: 651386 - protein, 9 aa, Homo Sapiens
FIDDIEVQG

SEQ ID NO: 651387 - protein, 9 aa, Homo Sapiens
GCKINALRA

SEQ ID NO: 651388 - protein, 9 aa, Homo Sapiens
RGMLRRLHE

SEQ ID NO: 651389 - protein, 9 aa, Homo Sapiens
SNLEKIYNG

SEQ ID NO: 651390 - protein, 9 aa, Homo Sapiens
PPSESSSSN

SEQ ID NO: 651391 - protein, 9 aa, Homo Sapiens
GFSTYSLLS

SEQ ID NO: 651392 - protein, 9 aa, Homo Sapiens
NGLVIRVAG

SEQ ID NO: 651393 - protein, 9 aa, Homo Sapiens
PQEVHMVNG

SEQ ID NO: 651394 - protein, 9 aa, Homo Sapiens
FYSCIGNAQ

SEQ ID NO: 651395 - protein, 9 aa, Homo Sapiens
CNLFGVMSS

SEQ ID NO: 651396 - protein, 9 aa, Homo Sapiens
LRIEIEMVG

SEQ ID NO: 651397 - protein, 9 aa, Homo Sapiens
NSGGALLPL

SEQ ID NO: 651398 - protein, 9 aa, Homo Sapiens
RKMFDDEPT

SEQ ID NO: 651399 - protein, 9 aa, Homo Sapiens
GWCYVAWAR

SEQ ID NO: 651400 - protein, 9 aa, Homo Sapiens
YPLLRLRHA

SEQ ID NO: 651401 - protein, 9 aa, Homo Sapiens
KREDDHGAA

SEQ ID NO: 651402 - protein, 9 aa, Homo Sapiens
SRKALRARL

SEQ ID NO: 651403 - protein, 9 aa, Homo Sapiens
TQAKKCQAI

SEQ ID NO: 651404 - protein, 9 aa, Homo Sapiens
RTQGFPLGT

SEQ ID NO: 651405 - protein, 9 aa, Homo Sapiens
ISERLPRDL

SEQ ID NO: 651406 - protein, 9 aa, Homo Sapiens
ISIQPPSAD

SEQ ID NO: 651407 - protein, 9 aa, Homo Sapiens
NDNRNPGGL

SEQ ID NO: 651408 - protein, 9 aa, Homo Sapiens
LKDPLQSTL

SEQ ID NO: 651409 - protein, 9 aa, Homo Sapiens
WVTMSKKNQ

SEQ ID NO: 651410 - protein, 9 aa, Homo Sapiens
HQDEILAHT

SEQ ID NO: 651411 - protein, 9 aa, Homo Sapiens
NSPPGSRES

SEQ ID NO: 651412 - protein, 9 aa, Homo Sapiens
KSGKSTYLK

SEQ ID NO: 651413 - protein, 9 aa, Homo Sapiens
TLEDALHSF

SEQ ID NO: 651414 - protein, 9 aa, Homo Sapiens
VASLQKELQ

SEQ ID NO: 651415 - protein, 9 aa, Homo Sapiens
YKQDLVQKL

SEQ ID NO: 651416 - protein, 9 aa, Homo Sapiens
SVPGQSSRA

SEQ ID NO: 651417 - protein, 9 aa, Homo Sapiens
SCIGQWRKM

SEQ ID NO: 651418 - protein, 9 aa, Homo Sapiens
TNLDPVSPE

SEQ ID NO: 651419 - protein, 9 aa, Homo Sapiens
WESYWVMEG

SEQ ID NO: 651420 - protein, 9 aa, Homo Sapiens
SPPESFAVS

SEQ ID NO: 651421 - protein, 9 aa, Homo Sapiens
YSFLTEHES

SEQ ID NO: 651422 - protein, 9 aa, Homo Sapiens
KVAHIMELH

SEQ ID NO: 651423 - protein, 9 aa, Homo Sapiens
LEGGEERLE

SEQ ID NO: 651424 - protein, 9 aa, Homo Sapiens
QEEDYQGLR

SEQ ID NO: 651425 - protein, 9 aa, Homo Sapiens
IYEDKNRKK

SEQ ID NO: 651426 - protein, 9 aa, Homo Sapiens
VADSHLNAI

SEQ ID NO: 651427 - protein, 9 aa, Homo Sapiens
TRVSTASKG

SEQ ID NO: 651428 - protein, 9 aa, Homo Sapiens
CEFCALSFR

SEQ ID NO: 651429 - protein, 9 aa, Homo Sapiens
ISEKPSLFN

SEQ ID NO: 651430 - protein, 9 aa, Homo Sapiens
NLGKRSQGH

SEQ ID NO: 651431 - protein, 9 aa, Homo Sapiens
EVTSAYRLT

SEQ ID NO: 651432 - protein, 9 aa, Homo Sapiens
IPQEDLVRF

SEQ ID NO: 651433 - protein, 9 aa, Homo Sapiens
GGHPHKGNG

SEQ ID NO: 651434 - protein, 9 aa, Homo Sapiens
SIECDKCQR

SEQ ID NO: 651435 - protein, 9 aa, Homo Sapiens
GLQLATPVW

SEQ ID NO: 651436 - protein, 9 aa, Homo Sapiens
LVAIFYDRW

SEQ ID NO: 651437 - protein, 9 aa, Homo Sapiens
NIQMNSKEI

SEQ ID NO: 651438 - protein, 9 aa, Homo Sapiens
GQKEKFKFS

SEQ ID NO: 651439 - protein, 9 aa, Homo Sapiens
YFSQSAGCQ

SEQ ID NO: 651440 - protein, 9 aa, Homo Sapiens
VAGFSTYSL

SEQ ID NO: 651441 - protein, 9 aa, Homo Sapiens
LMAPLPVFM

SEQ ID NO: 651442 - protein, 9 aa, Homo Sapiens
SMKSNFLQL

SEQ ID NO: 651443 - protein, 9 aa, Homo Sapiens
MGQICQRKS

SEQ ID NO: 651444 - protein, 9 aa, Homo Sapiens
EICWEPTSW

SEQ ID NO: 651445 - protein, 9 aa, Homo Sapiens
MNLIKEAQW

SEQ ID NO: 651446 - protein, 9 aa, Homo Sapiens
SSLQAVDLL

SEQ ID NO: 651447 - protein, 9 aa, Homo Sapiens
EGGEERLET

SEQ ID NO: 651448 - protein, 9 aa, Homo Sapiens
HELSQQTNG

SEQ ID NO: 651449 - protein, 9 aa, Homo Sapiens
IDSTVSQYS

SEQ ID NO: 651450 - protein, 9 aa, Homo Sapiens
QDVIEQFWD

SEQ ID NO: 651451 - protein, 9 aa, Homo Sapiens
ACENQRRAC

SEQ ID NO: 651452 - protein, 9 aa, Homo Sapiens
TLDSVTAFL

SEQ ID NO: 651453 - protein, 9 aa, Homo Sapiens
VVSQDEKRD

SEQ ID NO: 651454 - protein, 9 aa, Homo Sapiens
YQENKKGKL

SEQ ID NO: 651455 - protein, 9 aa, Homo Sapiens
SDGTETGSE

SEQ ID NO: 651456 - protein, 9 aa, Homo Sapiens
QEMMVQLLR

SEQ ID NO: 651457 - protein, 9 aa, Homo Sapiens
STRPPGPMT

SEQ ID NO: 651458 - protein, 9 aa, Homo Sapiens
GLHSKARDS

SEQ ID NO: 651459 - protein, 9 aa, Homo Sapiens
STLDLSGST

SEQ ID NO: 651460 - protein, 9 aa, Homo Sapiens
EPPLQGEDE

SEQ ID NO: 651461 - protein, 9 aa, Homo Sapiens
EFCHSNAID

SEQ ID NO: 651462 - protein, 9 aa, Homo Sapiens
ATPLHVTSL

SEQ ID NO: 651463 - protein, 9 aa, Homo Sapiens
CINNQGSYP

SEQ ID NO: 651464 - protein, 9 aa, Homo Sapiens
AVNKCLDFN

SEQ ID NO: 651465 - protein, 9 aa, Homo Sapiens
RRGSGGGIM

SEQ ID NO: 651466 - protein, 9 aa, Homo Sapiens
QGDLKATDI

SEQ ID NO: 651467 - protein, 9 aa, Homo Sapiens
SFVAHLAKH

SEQ ID NO: 651468 - protein, 9 aa, Homo Sapiens
LAPVSAYQY

SEQ ID NO: 651469 - protein, 9 aa, Homo Sapiens
ELIIADRQT

SEQ ID NO: 651470 - protein, 9 aa, Homo Sapiens
STSCRRLHS

SEQ ID NO: 651471 - protein, 9 aa, Homo Sapiens
CLSIYYEME

SEQ ID NO: 651472 - protein, 9 aa, Homo Sapiens
ASLSTITNW

SEQ ID NO: 651473 - protein, 9 aa, Homo Sapiens
SVADSHLNA

SEQ ID NO: 651474 - protein, 9 aa, Homo Sapiens
AEALIVRRR

SEQ ID NO: 651475 - protein, 9 aa, Homo Sapiens
LAEETPGGR

SEQ ID NO: 651476 - protein, 9 aa, Homo Sapiens
MKDNQKCSQ

SEQ ID NO: 651477 - protein, 9 aa, Homo Sapiens
LLFGSDSQV

SEQ ID NO: 651478 - protein, 9 aa, Homo Sapiens
KKSLATCSS

SEQ ID NO: 651479 - protein, 9 aa, Homo Sapiens
YSPSTVEPP

SEQ ID NO: 651480 - protein, 9 aa, Homo Sapiens
IHPVASNQS

SEQ ID NO: 651481 - protein, 9 aa, Homo Sapiens
IASLSTITN

SEQ ID NO: 651482 - protein, 9 aa, Homo Sapiens
SATNFNQGR

SEQ ID NO: 651483 - protein, 9 aa, Homo Sapiens
EFYYWESYW

SEQ ID NO: 651484 - protein, 9 aa, Homo Sapiens
QEVHMVNGT

SEQ ID NO: 651485 - protein, 9 aa, Homo Sapiens
VTYSEVLGI

SEQ ID NO: 651486 - protein, 9 aa, Homo Sapiens
VQGAQKQFN

SEQ ID NO: 651487 - protein, 9 aa, Homo Sapiens
CRIRLTWAL

SEQ ID NO: 651488 - protein, 9 aa, Homo Sapiens
KIYSSSNNF

SEQ ID NO: 651489 - protein, 9 aa, Homo Sapiens
SNTGISALR

SEQ ID NO: 651490 - protein, 9 aa, Homo Sapiens
ADHYLAQLA

SEQ ID NO: 651491 - protein, 9 aa, Homo Sapiens
PVLGEQNDN

SEQ ID NO: 651492 - protein, 9 aa, Homo Sapiens
RLEEGQASS

SEQ ID NO: 651493 - protein, 9 aa, Homo Sapiens
SDENSFEDA

SEQ ID NO: 651494 - protein, 9 aa, Homo Sapiens
HFPGAIFQG

SEQ ID NO: 651495 - protein, 9 aa, Homo Sapiens
VYWVFMLHK

SEQ ID NO: 651496 - protein, 9 aa, Homo Sapiens
TGISFTVTS

SEQ ID NO: 651497 - protein, 9 aa, Homo Sapiens
GTPVVSQDE

SEQ ID NO: 651498 - protein, 9 aa, Homo Sapiens
DTFDLQTIG

SEQ ID NO: 651499 - protein, 9 aa, Homo Sapiens
RGLVEVLYQ

SEQ ID NO: 651500 - protein, 9 aa, Homo Sapiens
QKIGQFCMV

SEQ ID NO: 651501 - protein, 9 aa, Homo Sapiens
AFVLFQFLF

SEQ ID NO: 651502 - protein, 9 aa, Homo Sapiens
KNLKKLQVI

SEQ ID NO: 651503 - protein, 9 aa, Homo Sapiens
QCMQDLFQK

SEQ ID NO: 651504 - protein, 9 aa, Homo Sapiens
EKSLRKSLQ

SEQ ID NO: 651505 - protein, 9 aa, Homo Sapiens
LEYCKERYT

SEQ ID NO: 651506 - protein, 9 aa, Homo Sapiens
TNPDVQQKV

SEQ ID NO: 651507 - protein, 9 aa, Homo Sapiens
CVHLYYCFT

SEQ ID NO: 651508 - protein, 9 aa, Homo Sapiens
DNEENTLNS

SEQ ID NO: 651509 - protein, 9 aa, Homo Sapiens
IVIADLRKD

SEQ ID NO: 651510 - protein, 9 aa, Homo Sapiens
VDPESRTFL

SEQ ID NO: 651511 - protein, 9 aa, Homo Sapiens
DDTSKKIAH

SEQ ID NO: 651512 - protein, 9 aa, Homo Sapiens
PPKGQDEGV

SEQ ID NO: 651513 - protein, 9 aa, Homo Sapiens
KIQDKKGIP

SEQ ID NO: 651514 - protein, 9 aa, Homo Sapiens
SRCEWEDGY

SEQ ID NO: 651515 - protein, 9 aa, Homo Sapiens
VHLYYCFTS

SEQ ID NO: 651516 - protein, 9 aa, Homo Sapiens
SVSALRMTI

SEQ ID NO: 651517 - protein, 9 aa, Homo Sapiens
QNQYIYRIP

SEQ ID NO: 651518 - protein, 9 aa, Homo Sapiens
VSTKLQNNT

SEQ ID NO: 651519 - protein, 9 aa, Homo Sapiens
NCVHLYYCF

SEQ ID NO: 651520 - protein, 9 aa, Homo Sapiens
LMSYAFLLD

SEQ ID NO: 651521 - protein, 9 aa, Homo Sapiens
SGIPALHAL

SEQ ID NO: 651522 - protein, 9 aa, Homo Sapiens
NPWGARIPA

SEQ ID NO: 651523 - protein, 9 aa, Homo Sapiens
TDFGICKEN

SEQ ID NO: 651524 - protein, 9 aa, Homo Sapiens
GPTAWRACQ

SEQ ID NO: 651525 - protein, 9 aa, Homo Sapiens
KKDACSICE

SEQ ID NO: 651526 - protein, 9 aa, Homo Sapiens
NAELQITLK

SEQ ID NO: 651527 - protein, 9 aa, Homo Sapiens
EKNAELQIT

SEQ ID NO: 651528 - protein, 9 aa, Homo Sapiens
NQGSYPCQC

SEQ ID NO: 651529 - protein, 9 aa, Homo Sapiens
LKRKKRHEK

SEQ ID NO: 651530 - protein, 9 aa, Homo Sapiens
GGNIGVRTV

SEQ ID NO: 651531 - protein, 9 aa, Homo Sapiens
CQLLLQHLQ

SEQ ID NO: 651532 - protein, 9 aa, Homo Sapiens
SYGKPCGGH

SEQ ID NO: 651533 - protein, 9 aa, Homo Sapiens
ACSICECKD

SEQ ID NO: 651534 - protein, 9 aa, Homo Sapiens
NSTVLEKCN

SEQ ID NO: 651535 - protein, 9 aa, Homo Sapiens
YTIRSNINN

SEQ ID NO: 651536 - protein, 9 aa, Homo Sapiens
ALSFRTSSN

SEQ ID NO: 651537 - protein, 9 aa, Homo Sapiens
LLRYSDSLL

SEQ ID NO: 651538 - protein, 9 aa, Homo Sapiens
VEEGNEEGD

SEQ ID NO: 651539 - protein, 9 aa, Homo Sapiens
DNKEKKKEK

SEQ ID NO: 651540 - protein, 9 aa, Homo Sapiens
NDNNLAVTY

SEQ ID NO: 651541 - protein, 9 aa, Homo Sapiens
AYMEVAISN

SEQ ID NO: 651542 - protein, 9 aa, Homo Sapiens
HGANIRDQL

SEQ ID NO: 651543 - protein, 9 aa, Homo Sapiens
SCSGYDIED

SEQ ID NO: 651544 - protein, 9 aa, Homo Sapiens
MKKQPKGYC

SEQ ID NO: 651545 - protein, 9 aa, Homo Sapiens
TLHQKIHNG

SEQ ID NO: 651546 - protein, 9 aa, Homo Sapiens
FPILEEECM

SEQ ID NO: 651547 - protein, 9 aa, Homo Sapiens
VAALEQAAC

SEQ ID NO: 651548 - protein, 9 aa, Homo Sapiens
EENIFMYGG

SEQ ID NO: 651549 - protein, 9 aa, Homo Sapiens
QENQKEFER

SEQ ID NO: 651550 - protein, 9 aa, Homo Sapiens
KLHLWVTGI

SEQ ID NO: 651551 - protein, 9 aa, Homo Sapiens
CKPLIRAIN

SEQ ID NO: 651552 - protein, 9 aa, Homo Sapiens
CHRAAQSLG

SEQ ID NO: 651553 - protein, 9 aa, Homo Sapiens
TKDKLLASF

SEQ ID NO: 651554 - protein, 9 aa, Homo Sapiens
LLGLLSAYT

SEQ ID NO: 651555 - protein, 9 aa, Homo Sapiens
IHRFGKHVS

SEQ ID NO: 651556 - protein, 9 aa, Homo Sapiens
QWEGLTVRI

SEQ ID NO: 651557 - protein, 9 aa, Homo Sapiens
MVCPHKCRC

SEQ ID NO: 651558 - protein, 9 aa, Homo Sapiens
LCIRDAAAA

SEQ ID NO: 651559 - protein, 9 aa, Homo Sapiens
RNLLWHQVF

SEQ ID NO: 651560 - protein, 9 aa, Homo Sapiens
HPPSGLEEV

SEQ ID NO: 651561 - protein, 9 aa, Homo Sapiens
YDTCYYWEK

SEQ ID NO: 651562 - protein, 9 aa, Homo Sapiens
WARKQHMNT

SEQ ID NO: 651563 - protein, 9 aa, Homo Sapiens
PLQIFLCDK

SEQ ID NO: 651564 - protein, 9 aa, Homo Sapiens
DLRKDSKNL

SEQ ID NO: 651565 - protein, 9 aa, Homo Sapiens
IVRRRLSKL

SEQ ID NO: 651566 - protein, 9 aa, Homo Sapiens
KVKPPEDIQ

SEQ ID NO: 651567 - protein, 9 aa, Homo Sapiens
EKEQQYIAQ

SEQ ID NO: 651568 - protein, 9 aa, Homo Sapiens
TMSLPLAGS

SEQ ID NO: 651569 - protein, 9 aa, Homo Sapiens
VGCESANTH

SEQ ID NO: 651570 - protein, 9 aa, Homo Sapiens
YKSAYSPST

SEQ ID NO: 651571 - protein, 9 aa, Homo Sapiens
QQLTAKRAG

SEQ ID NO: 651572 - protein, 9 aa, Homo Sapiens
ECGHLDPAE

SEQ ID NO: 651573 - protein, 9 aa, Homo Sapiens
GAGTNTYLQ

SEQ ID NO: 651574 - protein, 9 aa, Homo Sapiens
AALTLLWTE

SEQ ID NO: 651575 - protein, 9 aa, Homo Sapiens
AMKLQKLHL

SEQ ID NO: 651576 - protein, 9 aa, Homo Sapiens
FLQLICQVL

SEQ ID NO: 651577 - protein, 9 aa, Homo Sapiens
NASIECDKC

SEQ ID NO: 651578 - protein, 9 aa, Homo Sapiens
FMAEHLEKT

SEQ ID NO: 651579 - protein, 9 aa, Homo Sapiens
LGPWNSGGA

SEQ ID NO: 651580 - protein, 9 aa, Homo Sapiens
EMAITEKLT

SEQ ID NO: 651581 - protein, 9 aa, Homo Sapiens
QMNSKEISR

SEQ ID NO: 651582 - protein, 9 aa, Homo Sapiens
FQFLFTSCG

SEQ ID NO: 651583 - protein, 9 aa, Homo Sapiens
VWIACANTF

SEQ ID NO: 651584 - protein, 9 aa, Homo Sapiens
IFLLPTPCK

SEQ ID NO: 651585 - protein, 9 aa, Homo Sapiens
YRYVVVLVT

SEQ ID NO: 651586 - protein, 9 aa, Homo Sapiens
YPPVDPESR

SEQ ID NO: 651587 - protein, 9 aa, Homo Sapiens
CRCFCNCND

SEQ ID NO: 651588 - protein, 9 aa, Homo Sapiens
KSPLYISPI

SEQ ID NO: 651589 - protein, 9 aa, Homo Sapiens
PFWKTANPK

SEQ ID NO: 651590 - protein, 9 aa, Homo Sapiens
APCKGSGSL

SEQ ID NO: 651591 - protein, 9 aa, Homo Sapiens
LRALPSLRA

SEQ ID NO: 651592 - protein, 9 aa, Homo Sapiens
VLVVSVLFL

SEQ ID NO: 651593 - protein, 9 aa, Homo Sapiens
MDESLGLIE

SEQ ID NO: 651594 - protein, 9 aa, Homo Sapiens
GNIQMNSKE

SEQ ID NO: 651595 - protein, 9 aa, Homo Sapiens
CVILVFNVP

SEQ ID NO: 651596 - protein, 9 aa, Homo Sapiens
CQSEVNDDQ

SEQ ID NO: 651597 - protein, 9 aa, Homo Sapiens
KLPSFSKQT

SEQ ID NO: 651598 - protein, 9 aa, Homo Sapiens
QASGNIVYW

SEQ ID NO: 651599 - protein, 9 aa, Homo Sapiens
FYEFVAGVS

SEQ ID NO: 651600 - protein, 9 aa, Homo Sapiens
TETGSEISS

SEQ ID NO: 651601 - protein, 9 aa, Homo Sapiens
QALGRCWQR

SEQ ID NO: 651602 - protein, 9 aa, Homo Sapiens
THHAHRTQG

SEQ ID NO: 651603 - protein, 9 aa, Homo Sapiens
LKIWKHQNL

SEQ ID NO: 651604 - protein, 9 aa, Homo Sapiens
IRISKQLSE

SEQ ID NO: 651605 - protein, 9 aa, Homo Sapiens
GFGKHGFQC

SEQ ID NO: 651606 - protein, 9 aa, Homo Sapiens
DTYEAAHNL

SEQ ID NO: 651607 - protein, 9 aa, Homo Sapiens
LVMSMMHLQ

SEQ ID NO: 651608 - protein, 9 aa, Homo Sapiens
KDNKEKKKE

SEQ ID NO: 651609 - protein, 9 aa, Homo Sapiens
TPVVSQDEK

SEQ ID NO: 651610 - protein, 9 aa, Homo Sapiens
KPLSEMQTD

SEQ ID NO: 651611 - protein, 9 aa, Homo Sapiens
GSSRCEWED

SEQ ID NO: 651612 - protein, 9 aa, Homo Sapiens
KSEVENLKQ

SEQ ID NO: 651613 - protein, 9 aa, Homo Sapiens
FFQVHCQIS

SEQ ID NO: 651614 - protein, 9 aa, Homo Sapiens
GTHGDLCQL

SEQ ID NO: 651615 - protein, 9 aa, Homo Sapiens
LQPDISERL

SEQ ID NO: 651616 - protein, 9 aa, Homo Sapiens
HAERQLLAP

SEQ ID NO: 651617 - protein, 9 aa, Homo Sapiens
CRSPRRRLQ

SEQ ID NO: 651618 - protein, 9 aa, Homo Sapiens
THQLVEGES

SEQ ID NO: 651619 - protein, 9 aa, Homo Sapiens
GALVSFDAW

SEQ ID NO: 651620 - protein, 9 aa, Homo Sapiens
NSKEISRQK

SEQ ID NO: 651621 - protein, 9 aa, Homo Sapiens
YMEQGRTEP

SEQ ID NO: 651622 - protein, 9 aa, Homo Sapiens
NQKCSQCEE

SEQ ID NO: 651623 - protein, 9 aa, Homo Sapiens
NIIITHAYN

SEQ ID NO: 651624 - protein, 9 aa, Homo Sapiens
QAWLPRGPP

SEQ ID NO: 651625 - protein, 9 aa, Homo Sapiens
IFPILEEEC

SEQ ID NO: 651626 - protein, 9 aa, Homo Sapiens
PNSPSPTTL

SEQ ID NO: 651627 - protein, 9 aa, Homo Sapiens
MPDLHTKEQ

SEQ ID NO: 651628 - protein, 9 aa, Homo Sapiens
QCLENEENW

SEQ ID NO: 651629 - protein, 9 aa, Homo Sapiens
SATLRPETM

SEQ ID NO: 651630 - protein, 9 aa, Homo Sapiens
NSPSPTTLA

SEQ ID NO: 651631 - protein, 9 aa, Homo Sapiens
YLKTTVFGI

SEQ ID NO: 651632 - protein, 9 aa, Homo Sapiens
GFAPQTGSR

SEQ ID NO: 651633 - protein, 9 aa, Homo Sapiens
NLQDPWVPT

SEQ ID NO: 651634 - protein, 9 aa, Homo Sapiens
FNAWAIFKG

SEQ ID NO: 651635 - protein, 9 aa, Homo Sapiens
TPRYYPRGS

SEQ ID NO: 651636 - protein, 9 aa, Homo Sapiens
RFSKACNTK

SEQ ID NO: 651637 - protein, 9 aa, Homo Sapiens
FCSDQNESQ

SEQ ID NO: 651638 - protein, 9 aa, Homo Sapiens
LLAPVSAYQ

SEQ ID NO: 651639 - protein, 9 aa, Homo Sapiens
SNSSSSSRQ

SEQ ID NO: 651640 - protein, 9 aa, Homo Sapiens
ITVSVLHGS

SEQ ID NO: 651641 - protein, 9 aa, Homo Sapiens
HRAAQSLGA

SEQ ID NO: 651642 - protein, 9 aa, Homo Sapiens
VVVPENKNV

SEQ ID NO: 651643 - protein, 9 aa, Homo Sapiens
FKKNADNSS

SEQ ID NO: 651644 - protein, 9 aa, Homo Sapiens
AAFFNAWAI

SEQ ID NO: 651645 - protein, 9 aa, Homo Sapiens
NVACATKKF

SEQ ID NO: 651646 - protein, 9 aa, Homo Sapiens
NTHHLSPST

SEQ ID NO: 651647 - protein, 9 aa, Homo Sapiens
PSLRAWLPH

SEQ ID NO: 651648 - protein, 9 aa, Homo Sapiens
GGNTAFNHQ

SEQ ID NO: 651649 - protein, 9 aa, Homo Sapiens
YWVIVRSEG

SEQ ID NO: 651650 - protein, 9 aa, Homo Sapiens
LVNVVKLIE

SEQ ID NO: 651651 - protein, 9 aa, Homo Sapiens
HSEDINATR

SEQ ID NO: 651652 - protein, 9 aa, Homo Sapiens
DDANQRATK

SEQ ID NO: 651653 - protein, 9 aa, Homo Sapiens
GSSSFSGTS

SEQ ID NO: 651654 - protein, 9 aa, Homo Sapiens
NNLHKNKPD

SEQ ID NO: 651655 - protein, 9 aa, Homo Sapiens
MPTYNPELD

SEQ ID NO: 651656 - protein, 9 aa, Homo Sapiens
QDPLGLQLG

SEQ ID NO: 651657 - protein, 9 aa, Homo Sapiens
METLKNIME

SEQ ID NO: 651658 - protein, 9 aa, Homo Sapiens
RVAGFSTYS

SEQ ID NO: 651659 - protein, 9 aa, Homo Sapiens
LLRAGVYAD

SEQ ID NO: 651660 - protein, 9 aa, Homo Sapiens
RLDQDISGL

SEQ ID NO: 651661 - protein, 9 aa, Homo Sapiens
SSLRCALRS

SEQ ID NO: 651662 - protein, 9 aa, Homo Sapiens
LCDISVDRY

SEQ ID NO: 651663 - protein, 9 aa, Homo Sapiens
QFDLAETKA

SEQ ID NO: 651664 - protein, 9 aa, Homo Sapiens
LFAKHALEK

SEQ ID NO: 651665 - protein, 9 aa, Homo Sapiens
YGRKADMWS

SEQ ID NO: 651666 - protein, 9 aa, Homo Sapiens
LTTVSAFAA

SEQ ID NO: 651667 - protein, 9 aa, Homo Sapiens
MEKPLPLLT

SEQ ID NO: 651668 - protein, 9 aa, Homo Sapiens
TQSRSAGSR

SEQ ID NO: 651669 - protein, 9 aa, Homo Sapiens
LLRRRYESS

SEQ ID NO: 651670 - protein, 9 aa, Homo Sapiens
EQTISLASS

SEQ ID NO: 651671 - protein, 9 aa, Homo Sapiens
TGVRPHKCK

SEQ ID NO: 651672 - protein, 9 aa, Homo Sapiens
EQLNLPGAP

SEQ ID NO: 651673 - protein, 9 aa, Homo Sapiens
ANEEMEWVK

SEQ ID NO: 651674 - protein, 9 aa, Homo Sapiens
TASILNLCD

SEQ ID NO: 651675 - protein, 9 aa, Homo Sapiens
SYPCQCRAG

SEQ ID NO: 651676 - protein, 9 aa, Homo Sapiens
GDLQKIGQF

SEQ ID NO: 651677 - protein, 9 aa, Homo Sapiens
CGNITLDSV

SEQ ID NO: 651678 - protein, 9 aa, Homo Sapiens
NKKCGNLQP

SEQ ID NO: 651679 - protein, 9 aa, Homo Sapiens
PVNGWMYCT

SEQ ID NO: 651680 - protein, 9 aa, Homo Sapiens
YSLLSLGPR

SEQ ID NO: 651681 - protein, 9 aa, Homo Sapiens
ILVIIVSIP

SEQ ID NO: 651682 - protein, 9 aa, Homo Sapiens
CVTLHQKIH

SEQ ID NO: 651683 - protein, 9 aa, Homo Sapiens
KKRSKDGQK

SEQ ID NO: 651684 - protein, 9 aa, Homo Sapiens
PENKNVSTV

SEQ ID NO: 651685 - protein, 9 aa, Homo Sapiens
AIFTKAFKR

SEQ ID NO: 651686 - protein, 9 aa, Homo Sapiens
GAGVQGPII

SEQ ID NO: 651687 - protein, 9 aa, Homo Sapiens
TLDQYCEQM

SEQ ID NO: 651688 - protein, 9 aa, Homo Sapiens
SSYQQDCCV

SEQ ID NO: 651689 - protein, 9 aa, Homo Sapiens
GASQADGTP

SEQ ID NO: 651690 - protein, 9 aa, Homo Sapiens
TRDLGHHRV

SEQ ID NO: 651691 - protein, 9 aa, Homo Sapiens
SIEILNPNF

SEQ ID NO: 651692 - protein, 9 aa, Homo Sapiens
LAPERIADC

SEQ ID NO: 651693 - protein, 9 aa, Homo Sapiens
MVGRLLPHL

SEQ ID NO: 651694 - protein, 9 aa, Homo Sapiens
SSSPPPLER

SEQ ID NO: 651695 - protein, 9 aa, Homo Sapiens
PGQSSRAGG

SEQ ID NO: 651696 - protein, 9 aa, Homo Sapiens
TVRHEMQIL

SEQ ID NO: 651697 - protein, 9 aa, Homo Sapiens
WMVHPPSGL

SEQ ID NO: 651698 - protein, 9 aa, Homo Sapiens
DDLDPNTSI

SEQ ID NO: 651699 - protein, 9 aa, Homo Sapiens
YMVIMNPSL

SEQ ID NO: 651700 - protein, 9 aa, Homo Sapiens
YAIFTKAFK

SEQ ID NO: 651701 - protein, 9 aa, Homo Sapiens
ANIRDQLYD

SEQ ID NO: 651702 - protein, 9 aa, Homo Sapiens
KIPALQPVA

SEQ ID NO: 651703 - protein, 9 aa, Homo Sapiens
HQDFPVNKR

SEQ ID NO: 651704 - protein, 9 aa, Homo Sapiens
PPLQGEDEP

SEQ ID NO: 651705 - protein, 9 aa, Homo Sapiens
IPLPPPTAP

SEQ ID NO: 651706 - protein, 9 aa, Homo Sapiens
AIEEEESNN

SEQ ID NO: 651707 - protein, 9 aa, Homo Sapiens
SGKEAVTLV

SEQ ID NO: 651708 - protein, 9 aa, Homo Sapiens
FIWGFGKHG

SEQ ID NO: 651709 - protein, 9 aa, Homo Sapiens
LSARCSVLI

SEQ ID NO: 651710 - protein, 9 aa, Homo Sapiens
ELIAQKSEV

SEQ ID NO: 651711 - protein, 9 aa, Homo Sapiens
SCHRAAQSL

SEQ ID NO: 651712 - protein, 9 aa, Homo Sapiens
SRFVMKTLM

SEQ ID NO: 651713 - protein, 9 aa, Homo Sapiens
TRWTLKNIN

SEQ ID NO: 651714 - protein, 9 aa, Homo Sapiens
FIIFSQRCG

SEQ ID NO: 651715 - protein, 9 aa, Homo Sapiens
FMAFRNTDS

SEQ ID NO: 651716 - protein, 9 aa, Homo Sapiens
MVKMTRWKT

SEQ ID NO: 651717 - protein, 9 aa, Homo Sapiens
MRRVSYIKA

SEQ ID NO: 651718 - protein, 9 aa, Homo Sapiens
GDNPLVLHQ

SEQ ID NO: 651719 - protein, 9 aa, Homo Sapiens
SFVNNIFER

SEQ ID NO: 651720 - protein, 9 aa, Homo Sapiens
SERLPRDLR

SEQ ID NO: 651721 - protein, 9 aa, Homo Sapiens
SQMKLQMDA

SEQ ID NO: 651722 - protein, 9 aa, Homo Sapiens
DSIFGDFER

SEQ ID NO: 651723 - protein, 9 aa, Homo Sapiens
VKIVTCFII

SEQ ID NO: 651724 - protein, 9 aa, Homo Sapiens
WHASVPGQS

SEQ ID NO: 651725 - protein, 9 aa, Homo Sapiens
KGNPAPELM

SEQ ID NO: 651726 - protein, 9 aa, Homo Sapiens
RWALGEEHC

SEQ ID NO: 651727 - protein, 9 aa, Homo Sapiens
SEYERIGFQ

SEQ ID NO: 651728 - protein, 9 aa, Homo Sapiens
RKLREYDGL

SEQ ID NO: 651729 - protein, 9 aa, Homo Sapiens
DPETLICQN

SEQ ID NO: 651730 - protein, 9 aa, Homo Sapiens
SLLFLPAFS

SEQ ID NO: 651731 - protein, 9 aa, Homo Sapiens
SYLMMAVDD

SEQ ID NO: 651732 - protein, 9 aa, Homo Sapiens
EQNSQMNIV

SEQ ID NO: 651733 - protein, 9 aa, Homo Sapiens
WVTHFAAGP

SEQ ID NO: 651734 - protein, 9 aa, Homo Sapiens
MKYIKLQCK

SEQ ID NO: 651735 - protein, 9 aa, Homo Sapiens
VMTLLHEKF

SEQ ID NO: 651736 - protein, 9 aa, Homo Sapiens
QLLGLLSAY

SEQ ID NO: 651737 - protein, 9 aa, Homo Sapiens
NENKPIFLS

SEQ ID NO: 651738 - protein, 9 aa, Homo Sapiens
PVNNPTGAN

SEQ ID NO: 651739 - protein, 9 aa, Homo Sapiens
VLVTYSEVL

SEQ ID NO: 651740 - protein, 9 aa, Homo Sapiens
PLHQVTESA

SEQ ID NO: 651741 - protein, 9 aa, Homo Sapiens
RDPSVIVMA

SEQ ID NO: 651742 - protein, 9 aa, Homo Sapiens
NTAFNHQVR

SEQ ID NO: 651743 - protein, 9 aa, Homo Sapiens
INVRKCIHE

SEQ ID NO: 651744 - protein, 9 aa, Homo Sapiens
LLQSFGFQI

SEQ ID NO: 651745 - protein, 9 aa, Homo Sapiens
GVGNLASPN

SEQ ID NO: 651746 - protein, 9 aa, Homo Sapiens
EAQTIKELK

SEQ ID NO: 651747 - protein, 9 aa, Homo Sapiens
LLQRNESTQ

SEQ ID NO: 651748 - protein, 9 aa, Homo Sapiens
QPDISERLP

SEQ ID NO: 651749 - protein, 9 aa, Homo Sapiens
NMFLQASSP

SEQ ID NO: 651750 - protein, 9 aa, Homo Sapiens
EKILFVVFL

SEQ ID NO: 651751 - protein, 9 aa, Homo Sapiens
WSDLAVEAG

SEQ ID NO: 651752 - protein, 9 aa, Homo Sapiens
ETASQPNSH

SEQ ID NO: 651753 - protein, 9 aa, Homo Sapiens
SSNAYCSTE

SEQ ID NO: 651754 - protein, 9 aa, Homo Sapiens
KSYECQAEQ

SEQ ID NO: 651755 - protein, 9 aa, Homo Sapiens
IGQFCMVYS

SEQ ID NO: 651756 - protein, 9 aa, Homo Sapiens
SSPNENVAI

SEQ ID NO: 651757 - protein, 9 aa, Homo Sapiens
GVRPHKCKI

SEQ ID NO: 651758 - protein, 9 aa, Homo Sapiens
VAELAASSL

SEQ ID NO: 651759 - protein, 9 aa, Homo Sapiens
LLFLNSQTL

SEQ ID NO: 651760 - protein, 9 aa, Homo Sapiens
VNGVASGLR

SEQ ID NO: 651761 - protein, 9 aa, Homo Sapiens
PGGGRFGEL

SEQ ID NO: 651762 - protein, 9 aa, Homo Sapiens
IHDVLVSGI

SEQ ID NO: 651763 - protein, 9 aa, Homo Sapiens
SAPSGGAPM

SEQ ID NO: 651764 - protein, 9 aa, Homo Sapiens
APTVETSNP

SEQ ID NO: 651765 - protein, 9 aa, Homo Sapiens
STIGALCLE

SEQ ID NO: 651766 - protein, 9 aa, Homo Sapiens
EHKRIHAVE

SEQ ID NO: 651767 - protein, 9 aa, Homo Sapiens
DHRFSKACN

SEQ ID NO: 651768 - protein, 9 aa, Homo Sapiens
DIEQPNVAC

SEQ ID NO: 651769 - protein, 9 aa, Homo Sapiens
PVVQVRLVG

SEQ ID NO: 651770 - protein, 9 aa, Homo Sapiens
TIKELKQQK

SEQ ID NO: 651771 - protein, 9 aa, Homo Sapiens
HTTPKQGFA

SEQ ID NO: 651772 - protein, 9 aa, Homo Sapiens
LEGQDPLGL

SEQ ID NO: 651773 - protein, 9 aa, Homo Sapiens
CGLAVDFFI

SEQ ID NO: 651774 - protein, 9 aa, Homo Sapiens
LQRNESTQK

SEQ ID NO: 651775 - protein, 9 aa, Homo Sapiens
GCVTDHFSQ

SEQ ID NO: 651776 - protein, 9 aa, Homo Sapiens
DFHTLKLQE

SEQ ID NO: 651777 - protein, 9 aa, Homo Sapiens
LTVPRYKQD

SEQ ID NO: 651778 - protein, 9 aa, Homo Sapiens
DNFENSSQF

SEQ ID NO: 651779 - protein, 9 aa, Homo Sapiens
FTHDHMSGW

SEQ ID NO: 651780 - protein, 9 aa, Homo Sapiens
NVLLIFFIY

SEQ ID NO: 651781 - protein, 9 aa, Homo Sapiens
TGFIILRNG

SEQ ID NO: 651782 - protein, 9 aa, Homo Sapiens
ELGLLDEAQ

SEQ ID NO: 651783 - protein, 9 aa, Homo Sapiens
DSPGDSPHT

SEQ ID NO: 651784 - protein, 9 aa, Homo Sapiens
LILWFHLDW

SEQ ID NO: 651785 - protein, 9 aa, Homo Sapiens
CGGHDCSGS

SEQ ID NO: 651786 - protein, 9 aa, Homo Sapiens
QQLTAKRCL

SEQ ID NO: 651787 - protein, 9 aa, Homo Sapiens
ACQFHLLLP

SEQ ID NO: 651788 - protein, 9 aa, Homo Sapiens
NVFNPQTEE

SEQ ID NO: 651789 - protein, 9 aa, Homo Sapiens
FEKNTSNSQ

SEQ ID NO: 651790 - protein, 9 aa, Homo Sapiens
TAKRAGFPS

SEQ ID NO: 651791 - protein, 9 aa, Homo Sapiens
PISCYMEHR

SEQ ID NO: 651792 - protein, 9 aa, Homo Sapiens
LTRIHPSYT

SEQ ID NO: 651793 - protein, 9 aa, Homo Sapiens
IRLTWALAL

SEQ ID NO: 651794 - protein, 9 aa, Homo Sapiens
QASLKVYGT

SEQ ID NO: 651795 - protein, 8 aa, Homo Sapiens
QTSSSRSV

SEQ ID NO: 651796 - protein, 9 aa, Homo Sapiens
EAVKEKIAE

SEQ ID NO: 651797 - protein, 9 aa, Homo Sapiens
SHQALGRCW

SEQ ID NO: 651798 - protein, 9 aa, Homo Sapiens
CVLLIVMSH

SEQ ID NO: 651799 - protein, 9 aa, Homo Sapiens
GTETGSEIS

SEQ ID NO: 651800 - protein, 9 aa, Homo Sapiens
PLPFSSCIR

SEQ ID NO: 651801 - protein, 9 aa, Homo Sapiens
RLLKCVHHN

SEQ ID NO: 651802 - protein, 9 aa, Homo Sapiens
CDGCFLNWR

SEQ ID NO: 651803 - protein, 9 aa, Homo Sapiens
PNKYSRFNV

SEQ ID NO: 651804 - protein, 9 aa, Homo Sapiens
PGSPAAASG

SEQ ID NO: 651805 - protein, 9 aa, Homo Sapiens
YDGEWCAED

SEQ ID NO: 651806 - protein, 9 aa, Homo Sapiens
GHGTPDNSK

SEQ ID NO: 651807 - protein, 9 aa, Homo Sapiens
KDPLQSTLF

SEQ ID NO: 651808 - protein, 9 aa, Homo Sapiens
VTQAKKCQA

SEQ ID NO: 651809 - protein, 9 aa, Homo Sapiens
PPLENGHVG

SEQ ID NO: 651810 - protein, 9 aa, Homo Sapiens
LRFPTKQDS

SEQ ID NO: 651811 - protein, 9 aa, Homo Sapiens
TVPRYKQDL

SEQ ID NO: 651812 - protein, 9 aa, Homo Sapiens
LQYQIIFSI

SEQ ID NO: 651813 - protein, 9 aa, Homo Sapiens
NGSARATGS

SEQ ID NO: 651814 - protein, 9 aa, Homo Sapiens
LFPIVYILV

SEQ ID NO: 651815 - protein, 9 aa, Homo Sapiens
DTEALTWLH

SEQ ID NO: 651816 - protein, 9 aa, Homo Sapiens
TMSKKNQDN

SEQ ID NO: 651817 - protein, 9 aa, Homo Sapiens
HLKETFCRL

SEQ ID NO: 651818 - protein, 9 aa, Homo Sapiens
GEPGVVEPG

SEQ ID NO: 651819 - protein, 9 aa, Homo Sapiens
IESRVEEPL

SEQ ID NO: 651820 - protein, 9 aa, Homo Sapiens
RVALNPWGA

SEQ ID NO: 651821 - protein, 9 aa, Homo Sapiens
YERIGFQYG

SEQ ID NO: 651822 - protein, 9 aa, Homo Sapiens
VIMNPSLCR

SEQ ID NO: 651823 - protein, 9 aa, Homo Sapiens
IRNHLPTQG

SEQ ID NO: 651824 - protein, 9 aa, Homo Sapiens
LLLVGRMDE

SEQ ID NO: 651825 - protein, 9 aa, Homo Sapiens
TNGITRLGP

SEQ ID NO: 651826 - protein, 9 aa, Homo Sapiens
SDTFDTMNT

SEQ ID NO: 651827 - protein, 9 aa, Homo Sapiens
VGNLASPNA

SEQ ID NO: 651828 - protein, 9 aa, Homo Sapiens
ESEERPNYL

SEQ ID NO: 651829 - protein, 9 aa, Homo Sapiens
CQECGLAVD

SEQ ID NO: 651830 - protein, 9 aa, Homo Sapiens
ECGLAVDFF

SEQ ID NO: 651831 - protein, 9 aa, Homo Sapiens
PGGASQADG

SEQ ID NO: 651832 - protein, 9 aa, Homo Sapiens
QDSQLRNEV

SEQ ID NO: 651833 - protein, 9 aa, Homo Sapiens
FIDLPEFTF

SEQ ID NO: 651834 - protein, 9 aa, Homo Sapiens
LTAKRAGFP

SEQ ID NO: 651835 - protein, 9 aa, Homo Sapiens
KESSSVLSY

SEQ ID NO: 651836 - protein, 9 aa, Homo Sapiens
LREYDGLVD

SEQ ID NO: 651837 - protein, 9 aa, Homo Sapiens
PKKKEKDNK

SEQ ID NO: 651838 - protein, 9 aa, Homo Sapiens
DFKHKKSFI

SEQ ID NO: 651839 - protein, 9 aa, Homo Sapiens
TLERSPGGG

SEQ ID NO: 651840 - protein, 9 aa, Homo Sapiens
ASYLMMAVD

SEQ ID NO: 651841 - protein, 9 aa, Homo Sapiens
GMAMVKALC

SEQ ID NO: 651842 - protein, 9 aa, Homo Sapiens
QALKRKKRH

SEQ ID NO: 651843 - protein, 9 aa, Homo Sapiens
CKERYTLDL

SEQ ID NO: 651844 - protein, 9 aa, Homo Sapiens
PTAPETYEE

SEQ ID NO: 651845 - protein, 9 aa, Homo Sapiens
QVLGLQLAT

SEQ ID NO: 651846 - protein, 9 aa, Homo Sapiens
DRWALGEEH

SEQ ID NO: 651847 - protein, 9 aa, Homo Sapiens
RANSISLLS

SEQ ID NO: 651848 - protein, 9 aa, Homo Sapiens
GLEEVSGYD

SEQ ID NO: 651849 - protein, 9 aa, Homo Sapiens
SCVTLHQKI

SEQ ID NO: 651850 - protein, 9 aa, Homo Sapiens
SLQGYQTYV

SEQ ID NO: 651851 - protein, 9 aa, Homo Sapiens
WNSGGALLP

SEQ ID NO: 651852 - protein, 9 aa, Homo Sapiens
SKKILLKIW

SEQ ID NO: 651853 - protein, 9 aa, Homo Sapiens
AGVGAGVQG

SEQ ID NO: 651854 - protein, 9 aa, Homo Sapiens
CSRGLRNGS

SEQ ID NO: 651855 - protein, 9 aa, Homo Sapiens
PIESLSLIH

SEQ ID NO: 651856 - protein, 9 aa, Homo Sapiens
FLGRSVIQD

SEQ ID NO: 651857 - protein, 9 aa, Homo Sapiens
IPSWEKGSV

SEQ ID NO: 651858 - protein, 9 aa, Homo Sapiens
SGLMGPPGI

SEQ ID NO: 651859 - protein, 9 aa, Homo Sapiens
EEEGEGNSD

SEQ ID NO: 651860 - protein, 9 aa, Homo Sapiens
RLHEMKKEQ

SEQ ID NO: 651861 - protein, 9 aa, Homo Sapiens
EVHMVNGTI

SEQ ID NO: 651862 - protein, 9 aa, Homo Sapiens
ELHVQEYEF

SEQ ID NO: 651863 - protein, 9 aa, Homo Sapiens
VPGQSSRAG

SEQ ID NO: 651864 - protein, 9 aa, Homo Sapiens
VLLLTLAVV

SEQ ID NO: 651865 - protein, 9 aa, Homo Sapiens
SEMDLRFAE

SEQ ID NO: 651866 - protein, 9 aa, Homo Sapiens
FGKDLLAGR

SEQ ID NO: 651867 - protein, 9 aa, Homo Sapiens
VFSELWDLT

SEQ ID NO: 651868 - protein, 9 aa, Homo Sapiens
APELMASFL

SEQ ID NO: 651869 - protein, 9 aa, Homo Sapiens
EGLTVRIVF

SEQ ID NO: 651870 - protein, 9 aa, Homo Sapiens
KNRKKIPQQ

SEQ ID NO: 651871 - protein, 9 aa, Homo Sapiens
SEKKTGHQR

SEQ ID NO: 651872 - protein, 9 aa, Homo Sapiens
ATNPDVQQK

SEQ ID NO: 651873 - protein, 9 aa, Homo Sapiens
AQAWKKSLA

SEQ ID NO: 651874 - protein, 9 aa, Homo Sapiens
MGPASWLRP

SEQ ID NO: 651875 - protein, 9 aa, Homo Sapiens
WDVVEGLRG

SEQ ID NO: 651876 - protein, 9 aa, Homo Sapiens
CKCVDFHTL

SEQ ID NO: 651877 - protein, 9 aa, Homo Sapiens
YYIESTLQM

SEQ ID NO: 651878 - protein, 9 aa, Homo Sapiens
AAVAASQDM

SEQ ID NO: 651879 - protein, 9 aa, Homo Sapiens
CGYDTCYYW

SEQ ID NO: 651880 - protein, 9 aa, Homo Sapiens
GILSGHTDG

SEQ ID NO: 651881 - protein, 9 aa, Homo Sapiens
VRVIKLIGQ

SEQ ID NO: 651882 - protein, 9 aa, Homo Sapiens
KSSVKESSR

SEQ ID NO: 651883 - protein, 9 aa, Homo Sapiens
LQELVARFR

SEQ ID NO: 651884 - protein, 9 aa, Homo Sapiens
GQGLIESAA

SEQ ID NO: 651885 - protein, 9 aa, Homo Sapiens
YCVAGTALL

SEQ ID NO: 651886 - protein, 9 aa, Homo Sapiens
LTRTLSTSC

SEQ ID NO: 651887 - protein, 9 aa, Homo Sapiens
ISKQLSEFV

SEQ ID NO: 651888 - protein, 9 aa, Homo Sapiens
KTGHQRTSM

SEQ ID NO: 651889 - protein, 9 aa, Homo Sapiens
MPTCKLLFE

SEQ ID NO: 651890 - protein, 9 aa, Homo Sapiens
NKIDQELEH

SEQ ID NO: 651891 - protein, 9 aa, Homo Sapiens
TAFNHQVRA

SEQ ID NO: 651892 - protein, 9 aa, Homo Sapiens
TLSTSCRRL

SEQ ID NO: 651893 - protein, 9 aa, Homo Sapiens
GQICQRKSA

SEQ ID NO: 651894 - protein, 9 aa, Homo Sapiens
NLASPNAAT

SEQ ID NO: 651895 - protein, 9 aa, Homo Sapiens
KLIYETLSW

SEQ ID NO: 651896 - protein, 9 aa, Homo Sapiens
PFMAEHLEK

SEQ ID NO: 651897 - protein, 9 aa, Homo Sapiens
SLFAKHALE

SEQ ID NO: 651898 - protein, 9 aa, Homo Sapiens
KKHRPSHGD

SEQ ID NO: 651899 - protein, 9 aa, Homo Sapiens
CQAEQTISL

SEQ ID NO: 651900 - protein, 9 aa, Homo Sapiens
CKGSGSLAP

SEQ ID NO: 651901 - protein, 9 aa, Homo Sapiens
SGTTMDSRV

SEQ ID NO: 651902 - protein, 9 aa, Homo Sapiens
LPGSRVLAL

SEQ ID NO: 651903 - protein, 9 aa, Homo Sapiens
SNPYADDPV

SEQ ID NO: 651904 - protein, 9 aa, Homo Sapiens
ARNENKPIF

SEQ ID NO: 651905 - protein, 9 aa, Homo Sapiens
LRTACSPDY

SEQ ID NO: 651906 - protein, 9 aa, Homo Sapiens
KKVSIFHDC

SEQ ID NO: 651907 - protein, 9 aa, Homo Sapiens
THISDAWTY

SEQ ID NO: 651908 - protein, 9 aa, Homo Sapiens
EKDKDVEEG

SEQ ID NO: 651909 - protein, 9 aa, Homo Sapiens
EMVSTKLQN

SEQ ID NO: 651910 - protein, 9 aa, Homo Sapiens
KPPLRCTNF

SEQ ID NO: 651911 - protein, 9 aa, Homo Sapiens
PPESFAVSD

SEQ ID NO: 651912 - protein, 9 aa, Homo Sapiens
LSFRTSSNL

SEQ ID NO: 651913 - protein, 9 aa, Homo Sapiens
NAIIIVVMW

SEQ ID NO: 651914 - protein, 9 aa, Homo Sapiens
ATGISFTVT

SEQ ID NO: 651915 - protein, 9 aa, Homo Sapiens
AHVSGFVGK

SEQ ID NO: 651916 - protein, 9 aa, Homo Sapiens
SWDVVEGLR

SEQ ID NO: 651917 - protein, 9 aa, Homo Sapiens
DAWQALGPW

SEQ ID NO: 651918 - protein, 9 aa, Homo Sapiens
SAHLQNEKK

SEQ ID NO: 651919 - protein, 9 aa, Homo Sapiens
GSVNNEFGK

SEQ ID NO: 651920 - protein, 9 aa, Homo Sapiens
QAMFHIEYF

SEQ ID NO: 651921 - protein, 9 aa, Homo Sapiens
KGQKGIVGR

SEQ ID NO: 651922 - protein, 9 aa, Homo Sapiens
ESLGLIEVV

SEQ ID NO: 651923 - protein, 9 aa, Homo Sapiens
EKPLPLLTD

SEQ ID NO: 651924 - protein, 9 aa, Homo Sapiens
KEQNSQMNI

SEQ ID NO: 651925 - protein, 9 aa, Homo Sapiens
PGAMGIPET

SEQ ID NO: 651926 - protein, 9 aa, Homo Sapiens
FQNIEDEIK

SEQ ID NO: 651927 - protein, 9 aa, Homo Sapiens
ENAEALIVR

SEQ ID NO: 651928 - protein, 9 aa, Homo Sapiens
SKGRKYPPV

SEQ ID NO: 651929 - protein, 9 aa, Homo Sapiens
LVCNECEKT

SEQ ID NO: 651930 - protein, 9 aa, Homo Sapiens
DLVRFMYSL

SEQ ID NO: 651931 - protein, 9 aa, Homo Sapiens
LVVVKLLSE

SEQ ID NO: 651932 - protein, 9 aa, Homo Sapiens
VFSYIFQPA

SEQ ID NO: 651933 - protein, 9 aa, Homo Sapiens
GPPGIQGDK

SEQ ID NO: 651934 - protein, 9 aa, Homo Sapiens
MTQLPEAVK

SEQ ID NO: 651935 - protein, 9 aa, Homo Sapiens
VWLISKTGM

SEQ ID NO: 651936 - protein, 9 aa, Homo Sapiens
RSKDGQKEK

SEQ ID NO: 651937 - protein, 9 aa, Homo Sapiens
SFLTEHESI

SEQ ID NO: 651938 - protein, 9 aa, Homo Sapiens
ETLSWKYPK

SEQ ID NO: 651939 - protein, 9 aa, Homo Sapiens
CFAAVADHY

SEQ ID NO: 651940 - protein, 9 aa, Homo Sapiens
VSADVLSSL

SEQ ID NO: 651941 - protein, 9 aa, Homo Sapiens
SPNFTLDQY

SEQ ID NO: 651942 - protein, 9 aa, Homo Sapiens
IWAKVKEIK

SEQ ID NO: 651943 - protein, 9 aa, Homo Sapiens
LAFRFAGTH

SEQ ID NO: 651944 - protein, 9 aa, Homo Sapiens
GLEYCKERY

SEQ ID NO: 651945 - protein, 9 aa, Homo Sapiens
HLSTLKKVS

SEQ ID NO: 651946 - protein, 9 aa, Homo Sapiens
LFEVQWQLA

SEQ ID NO: 651947 - protein, 9 aa, Homo Sapiens
PVDPESRTF

SEQ ID NO: 651948 - protein, 9 aa, Homo Sapiens
RWTLKNINF

SEQ ID NO: 651949 - protein, 9 aa, Homo Sapiens
AERKSKKKV

SEQ ID NO: 651950 - protein, 9 aa, Homo Sapiens
DETSSNAYC

SEQ ID NO: 651951 - protein, 9 aa, Homo Sapiens
TTIVLVVSV

SEQ ID NO: 651952 - protein, 9 aa, Homo Sapiens
VDSGSEAEG

SEQ ID NO: 651953 - protein, 9 aa, Homo Sapiens
EVVGIWSDL

SEQ ID NO: 651954 - protein, 9 aa, Homo Sapiens
RPIEDAKCH

SEQ ID NO: 651955 - protein, 9 aa, Homo Sapiens
LYYELKITF

SEQ ID NO: 651956 - protein, 9 aa, Homo Sapiens
LLASFCQTL

SEQ ID NO: 651957 - protein, 9 aa, Homo Sapiens
KPNKTKTYF

SEQ ID NO: 651958 - protein, 9 aa, Homo Sapiens
IEKLPKACS

SEQ ID NO: 651959 - protein, 9 aa, Homo Sapiens
AACKLDAYS

SEQ ID NO: 651960 - protein, 9 aa, Homo Sapiens
IKYQTFLLH

SEQ ID NO: 651961 - protein, 9 aa, Homo Sapiens
WSPSVLPPQ

SEQ ID NO: 651962 - protein, 9 aa, Homo Sapiens
VALNPWGAR

SEQ ID NO: 651963 - protein, 9 aa, Homo Sapiens
GDLEEDIPK

SEQ ID NO: 651964 - protein, 9 aa, Homo Sapiens
CQSDAISPP

SEQ ID NO: 651965 - protein, 9 aa, Homo Sapiens
ERKSKKKVE

SEQ ID NO: 651966 - protein, 9 aa, Homo Sapiens
AYESQTLKE

SEQ ID NO: 651967 - protein, 9 aa, Homo Sapiens
SHIRNHLPT

SEQ ID NO: 651968 - protein, 9 aa, Homo Sapiens
VPVVQVRLV

SEQ ID NO: 651969 - protein, 9 aa, Homo Sapiens
RTQRNYLIQ

SEQ ID NO: 651970 - protein, 9 aa, Homo Sapiens
SLGAAGRTG

SEQ ID NO: 651971 - protein, 9 aa, Homo Sapiens
EIEVQPRVV

SEQ ID NO: 651972 - protein, 9 aa, Homo Sapiens
EGYGRKADM

SEQ ID NO: 651973 - protein, 9 aa, Homo Sapiens
WVHSKCENI

SEQ ID NO: 651974 - protein, 9 aa, Homo Sapiens
HHRVLVEGI

SEQ ID NO: 651975 - protein, 9 aa, Homo Sapiens
QVTQAKKCQ

SEQ ID NO: 651976 - protein, 9 aa, Homo Sapiens
ILVSVSSEG

SEQ ID NO: 651977 - protein, 9 aa, Homo Sapiens
DGHRHEGVK

SEQ ID NO: 651978 - protein, 9 aa, Homo Sapiens
ACVEPISCY

SEQ ID NO: 651979 - protein, 9 aa, Homo Sapiens
TGKNHMDVM

SEQ ID NO: 651980 - protein, 9 aa, Homo Sapiens
WGQPSDENS

SEQ ID NO: 651981 - protein, 9 aa, Homo Sapiens
VFMKQLPFC

SEQ ID NO: 651982 - protein, 9 aa, Homo Sapiens
VAHLAKHLG

SEQ ID NO: 651983 - protein, 9 aa, Homo Sapiens
LVLLRQPPA

SEQ ID NO: 651984 - protein, 9 aa, Homo Sapiens
EKPMGIFPI

SEQ ID NO: 651985 - protein, 9 aa, Homo Sapiens
CATKKFSYK

SEQ ID NO: 651986 - protein, 9 aa, Homo Sapiens
LKLCRELSD

SEQ ID NO: 651987 - protein, 9 aa, Homo Sapiens
AMGIPETQS

SEQ ID NO: 651988 - protein, 9 aa, Homo Sapiens
SVNFYEFVA

SEQ ID NO: 651989 - protein, 9 aa, Homo Sapiens
PSGHSNPMN

SEQ ID NO: 651990 - protein, 9 aa, Homo Sapiens
SVGGNIGVR

SEQ ID NO: 651991 - protein, 9 aa, Homo Sapiens
TVETSNPYA

SEQ ID NO: 651992 - protein, 9 aa, Homo Sapiens
ILDGFHSKE

SEQ ID NO: 651993 - protein, 9 aa, Homo Sapiens
FLNWREHRS

SEQ ID NO: 651994 - protein, 9 aa, Homo Sapiens
SFNFAPLLF

SEQ ID NO: 651995 - protein, 9 aa, Homo Sapiens
WTLKNINFS

SEQ ID NO: 651996 - protein, 9 aa, Homo Sapiens
KEVVKCPGA

SEQ ID NO: 651997 - protein, 9 aa, Homo Sapiens
FELNKLLQN

SEQ ID NO: 651998 - protein, 9 aa, Homo Sapiens
MGYSVMVLL

SEQ ID NO: 651999 - protein, 9 aa, Homo Sapiens
PEHQEKCRE

SEQ ID NO: 652000 - protein, 9 aa, Homo Sapiens
YRALAHNLL

SEQ ID NO: 652001 - protein, 9 aa, Homo Sapiens
DDSSDKEIT

SEQ ID NO: 652002 - protein, 9 aa, Homo Sapiens
KLAYGEEKK

SEQ ID NO: 652003 - protein, 9 aa, Homo Sapiens
RAAQSLGAS

SEQ ID NO: 652004 - protein, 9 aa, Homo Sapiens
KHGFQCQVC

SEQ ID NO: 652005 - protein, 9 aa, Homo Sapiens
HTGVRPHKC

SEQ ID NO: 652006 - protein, 9 aa, Homo Sapiens
TYIVGVVVK

SEQ ID NO: 652007 - protein, 9 aa, Homo Sapiens
ADTPQEPFA

SEQ ID NO: 652008 - protein, 9 aa, Homo Sapiens
IQEFTKFPT

SEQ ID NO: 652009 - protein, 9 aa, Homo Sapiens
HGRPLQPHV

SEQ ID NO: 652010 - protein, 9 aa, Homo Sapiens
IQGDKGLKG

SEQ ID NO: 652011 - protein, 9 aa, Homo Sapiens
QDMQQGATV

SEQ ID NO: 652012 - protein, 9 aa, Homo Sapiens
ITTPPGYPG

SEQ ID NO: 652013 - protein, 9 aa, Homo Sapiens
EFLRKLEEL

SEQ ID NO: 652014 - protein, 9 aa, Homo Sapiens
ADRQTGKTS

SEQ ID NO: 652015 - protein, 9 aa, Homo Sapiens
KEKDNKEKK

SEQ ID NO: 652016 - protein, 9 aa, Homo Sapiens
SKSESRKEP

SEQ ID NO: 652017 - protein, 9 aa, Homo Sapiens
GHVGLQEKE

SEQ ID NO: 652018 - protein, 9 aa, Homo Sapiens
NKDVKGALL

SEQ ID NO: 652019 - protein, 9 aa, Homo Sapiens
HMAYNSVEL

SEQ ID NO: 652020 - protein, 9 aa, Homo Sapiens
NSQMNIVHK

SEQ ID NO: 652021 - protein, 9 aa, Homo Sapiens
DKGQKGIVG

SEQ ID NO: 652022 - protein, 9 aa, Homo Sapiens
PSEYERIGF

SEQ ID NO: 652023 - protein, 9 aa, Homo Sapiens
QSEDYHHEL

SEQ ID NO: 652024 - protein, 9 aa, Homo Sapiens
PIEDAKCHI

SEQ ID NO: 652025 - protein, 9 aa, Homo Sapiens
KSFYRVSYG

SEQ ID NO: 652026 - protein, 9 aa, Homo Sapiens
AHNKALWKS

SEQ ID NO: 652027 - protein, 9 aa, Homo Sapiens
LLSDSKVKS

SEQ ID NO: 652028 - protein, 9 aa, Homo Sapiens
VCLSCSQAR

SEQ ID NO: 652029 - protein, 9 aa, Homo Sapiens
EHFQPNDDL

SEQ ID NO: 652030 - protein, 9 aa, Homo Sapiens
IYYIESTLQ

SEQ ID NO: 652031 - protein, 9 aa, Homo Sapiens
ITKRCPDST

SEQ ID NO: 652032 - protein, 9 aa, Homo Sapiens
FQNMLRNSI

SEQ ID NO: 652033 - protein, 9 aa, Homo Sapiens
QPGGHTAVA

SEQ ID NO: 652034 - protein, 9 aa, Homo Sapiens
SLFAAENKQ

SEQ ID NO: 652035 - protein, 9 aa, Homo Sapiens
AGTNTYLQP

SEQ ID NO: 652036 - protein, 9 aa, Homo Sapiens
AVAICPGLG

SEQ ID NO: 652037 - protein, 9 aa, Homo Sapiens
SCSISAGLL

SEQ ID NO: 652038 - protein, 9 aa, Homo Sapiens
ACSPDYTLA

SEQ ID NO: 652039 - protein, 9 aa, Homo Sapiens
PAGVLYGID

SEQ ID NO: 652040 - protein, 9 aa, Homo Sapiens
KFFQVHCQI

SEQ ID NO: 652041 - protein, 9 aa, Homo Sapiens
HYEALRGSP

SEQ ID NO: 652042 - protein, 9 aa, Homo Sapiens
CSQARCLPG

SEQ ID NO: 652043 - protein, 9 aa, Homo Sapiens
ALLAFLSGE

SEQ ID NO: 652044 - protein, 9 aa, Homo Sapiens
QLPEAVKEK

SEQ ID NO: 652045 - protein, 9 aa, Homo Sapiens
KPTEDSANE

SEQ ID NO: 652046 - protein, 9 aa, Homo Sapiens
MHTGVRPHK

SEQ ID NO: 652047 - protein, 9 aa, Homo Sapiens
IYSGNTMNI

SEQ ID NO: 652048 - protein, 9 aa, Homo Sapiens
LQVLDEQTA

SEQ ID NO: 652049 - protein, 9 aa, Homo Sapiens
AGVYADKSV

SEQ ID NO: 652050 - protein, 9 aa, Homo Sapiens
RGTRESRKA

SEQ ID NO: 652051 - protein, 9 aa, Homo Sapiens
KKKRKHQLW

SEQ ID NO: 652052 - protein, 9 aa, Homo Sapiens
AQTIKELKQ

SEQ ID NO: 652053 - protein, 9 aa, Homo Sapiens
DINFAMKGR

SEQ ID NO: 652054 - protein, 9 aa, Homo Sapiens
ILKKLDLVN

SEQ ID NO: 652055 - protein, 9 aa, Homo Sapiens
VDFFIFCLK

SEQ ID NO: 652056 - protein, 9 aa, Homo Sapiens
EVKWTIEVI

SEQ ID NO: 652057 - protein, 9 aa, Homo Sapiens
MAYNSVELH

SEQ ID NO: 652058 - protein, 9 aa, Homo Sapiens
FTYRALAHN

SEQ ID NO: 652059 - protein, 9 aa, Homo Sapiens
NVSIPKTST

SEQ ID NO: 652060 - protein, 9 aa, Homo Sapiens
FCRLDQDIS

SEQ ID NO: 652061 - protein, 9 aa, Homo Sapiens
GICCPKPHV

SEQ ID NO: 652062 - protein, 9 aa, Homo Sapiens
LGASLLQRL

SEQ ID NO: 652063 - protein, 9 aa, Homo Sapiens
PQQLTAKRA

SEQ ID NO: 652064 - protein, 9 aa, Homo Sapiens
RKIEALSAE

SEQ ID NO: 652065 - protein, 9 aa, Homo Sapiens
PQQLTAKRC

SEQ ID NO: 652066 - protein, 9 aa, Homo Sapiens
SPVNNPTGA

SEQ ID NO: 652067 - protein, 9 aa, Homo Sapiens
VKHGIKKVD

SEQ ID NO: 652068 - protein, 9 aa, Homo Sapiens
TAILALLLV

SEQ ID NO: 652069 - protein, 9 aa, Homo Sapiens
HGIKKVDTV

SEQ ID NO: 652070 - protein, 9 aa, Homo Sapiens
PPGHGTPDN

SEQ ID NO: 652071 - protein, 9 aa, Homo Sapiens
QKELQDITP

SEQ ID NO: 652072 - protein, 9 aa, Homo Sapiens
PLVCNECEK

SEQ ID NO: 652073 - protein, 9 aa, Homo Sapiens
TRLPQGAPG

SEQ ID NO: 652074 - protein, 9 aa, Homo Sapiens
SIFGDFERI

SEQ ID NO: 652075 - protein, 9 aa, Homo Sapiens
AAGPGLPWG

SEQ ID NO: 652076 - protein, 9 aa, Homo Sapiens
ERVFWLLFG

SEQ ID NO: 652077 - protein, 9 aa, Homo Sapiens
LQLEFCHSN

SEQ ID NO: 652078 - protein, 9 aa, Homo Sapiens
DVFLLDENL

SEQ ID NO: 652079 - protein, 9 aa, Homo Sapiens
ERIIQSFGR

SEQ ID NO: 652080 - protein, 9 aa, Homo Sapiens
ATPVWFHVL

SEQ ID NO: 652081 - protein, 9 aa, Homo Sapiens
QFMIEKLPK

SEQ ID NO: 652082 - protein, 9 aa, Homo Sapiens
IERSVADSH

SEQ ID NO: 652083 - protein, 9 aa, Homo Sapiens
LKDCVGGEV

SEQ ID NO: 652084 - protein, 9 aa, Homo Sapiens
VGQVITKRC

SEQ ID NO: 652085 - protein, 9 aa, Homo Sapiens
TSSLGAAGR

SEQ ID NO: 652086 - protein, 9 aa, Homo Sapiens
WLSLFPRGT

SEQ ID NO: 652087 - protein, 9 aa, Homo Sapiens
VKLLSEEHW

SEQ ID NO: 652088 - protein, 9 aa, Homo Sapiens
QEEKDKDVE

SEQ ID NO: 652089 - protein, 9 aa, Homo Sapiens
ENQRRACVK

SEQ ID NO: 652090 - protein, 9 aa, Homo Sapiens
PPTAPETYE

SEQ ID NO: 652091 - protein, 9 aa, Homo Sapiens
RCPRRTQRI

SEQ ID NO: 652092 - protein, 9 aa, Homo Sapiens
QHSEDINAT

SEQ ID NO: 652093 - protein, 9 aa, Homo Sapiens
VCYSTPSMY

SEQ ID NO: 652094 - protein, 9 aa, Homo Sapiens
NGGDRCRGL

SEQ ID NO: 652095 - protein, 9 aa, Homo Sapiens
GVSLGAHVS

SEQ ID NO: 652096 - protein, 9 aa, Homo Sapiens
VSSLVLVSL

SEQ ID NO: 652097 - protein, 9 aa, Homo Sapiens
VPFLSVGGN

SEQ ID NO: 652098 - protein, 9 aa, Homo Sapiens
LNTNTELCQ

SEQ ID NO: 652099 - protein, 9 aa, Homo Sapiens
DDIQEFTKF

SEQ ID NO: 652100 - protein, 9 aa, Homo Sapiens
AIEYRLQAG

SEQ ID NO: 652101 - protein, 9 aa, Homo Sapiens
NVAFSTNLL

SEQ ID NO: 652102 - protein, 9 aa, Homo Sapiens
NFAMKGRKG

SEQ ID NO: 652103 - protein, 9 aa, Homo Sapiens
TNASLCDPT

SEQ ID NO: 652104 - protein, 9 aa, Homo Sapiens
PDYLQVLDE

SEQ ID NO: 652105 - protein, 9 aa, Homo Sapiens
EKFSSESDM

SEQ ID NO: 652106 - protein, 9 aa, Homo Sapiens
YFFMAFRNT

SEQ ID NO: 652107 - protein, 9 aa, Homo Sapiens
ALLVELTRK

SEQ ID NO: 652108 - protein, 9 aa, Homo Sapiens
YGKPCGGHD

SEQ ID NO: 652109 - protein, 9 aa, Homo Sapiens
GRIERSVAD

SEQ ID NO: 652110 - protein, 9 aa, Homo Sapiens
DCTMAFMFE

SEQ ID NO: 652111 - protein, 9 aa, Homo Sapiens
WKTANPKEV

SEQ ID NO: 652112 - protein, 9 aa, Homo Sapiens
KYKNSSREK

SEQ ID NO: 652113 - protein, 9 aa, Homo Sapiens
VKVTAPETQ

SEQ ID NO: 652114 - protein, 9 aa, Homo Sapiens
SLRKSLQAS

SEQ ID NO: 652115 - protein, 9 aa, Homo Sapiens
IHEEVVQVL

SEQ ID NO: 652116 - protein, 9 aa, Homo Sapiens
GLVEVLYQG

SEQ ID NO: 652117 - protein, 9 aa, Homo Sapiens
HVWVEVVLD

SEQ ID NO: 652118 - protein, 9 aa, Homo Sapiens
KNLGGNPFW

SEQ ID NO: 652119 - protein, 9 aa, Homo Sapiens
TSMESLSPL

SEQ ID NO: 652120 - protein, 9 aa, Homo Sapiens
SHVVHITMS

SEQ ID NO: 652121 - protein, 9 aa, Homo Sapiens
QVIKYCSCP

SEQ ID NO: 652122 - protein, 9 aa, Homo Sapiens
KTTVFGITG

SEQ ID NO: 652123 - protein, 9 aa, Homo Sapiens
LLVNAIIIV

SEQ ID NO: 652124 - protein, 9 aa, Homo Sapiens
GKEKRLNMA

SEQ ID NO: 652125 - protein, 9 aa, Homo Sapiens
FAMKGRKGM

SEQ ID NO: 652126 - protein, 9 aa, Homo Sapiens
NRSGNDTYE

SEQ ID NO: 652127 - protein, 9 aa, Homo Sapiens
IVINTHHLS

SEQ ID NO: 652128 - protein, 9 aa, Homo Sapiens
LAESVDLLD

SEQ ID NO: 652129 - protein, 9 aa, Homo Sapiens
YVVVLVTNV

SEQ ID NO: 652130 - protein, 9 aa, Homo Sapiens
ETCHRSKNL

SEQ ID NO: 652131 - protein, 9 aa, Homo Sapiens
YNFTCTGDG

SEQ ID NO: 652132 - protein, 9 aa, Homo Sapiens
VNNNLHKNK

SEQ ID NO: 652133 - protein, 9 aa, Homo Sapiens
SEGYLHLST

SEQ ID NO: 652134 - protein, 9 aa, Homo Sapiens
NHGDSDDDV

SEQ ID NO: 652135 - protein, 9 aa, Homo Sapiens
IQMNSKEIS

SEQ ID NO: 652136 - protein, 9 aa, Homo Sapiens
LMAAAGHFP

SEQ ID NO: 652137 - protein, 9 aa, Homo Sapiens
KCENISGTE

SEQ ID NO: 652138 - protein, 9 aa, Homo Sapiens
PVIKVESMQ

SEQ ID NO: 652139 - protein, 9 aa, Homo Sapiens
FMQTFVLSP

SEQ ID NO: 652140 - protein, 9 aa, Homo Sapiens
SCKVDNEEN

SEQ ID NO: 652141 - protein, 9 aa, Homo Sapiens
RGSQHLISR

SEQ ID NO: 652142 - protein, 9 aa, Homo Sapiens
KAFNQSCSL

SEQ ID NO: 652143 - protein, 9 aa, Homo Sapiens
YQIIFSIWL

SEQ ID NO: 652144 - protein, 9 aa, Homo Sapiens
RAINSSNLK

SEQ ID NO: 652145 - protein, 9 aa, Homo Sapiens
SMWAHQAVL

SEQ ID NO: 652146 - protein, 9 aa, Homo Sapiens
TKLQNNTSQ

SEQ ID NO: 652147 - protein, 9 aa, Homo Sapiens
MTLKGQSED

SEQ ID NO: 652148 - protein, 9 aa, Homo Sapiens
YSPGLHVQH

SEQ ID NO: 652149 - protein, 9 aa, Homo Sapiens
AHKFTQHNF

SEQ ID NO: 652150 - protein, 9 aa, Homo Sapiens
LLFLPAFSG

SEQ ID NO: 652151 - protein, 9 aa, Homo Sapiens
FRCVVVPEN

SEQ ID NO: 652152 - protein, 9 aa, Homo Sapiens
GKDLLAGRV

SEQ ID NO: 652153 - protein, 9 aa, Homo Sapiens
APMRDMGHP

SEQ ID NO: 652154 - protein, 9 aa, Homo Sapiens
RIRANSISL

SEQ ID NO: 652155 - protein, 9 aa, Homo Sapiens
DTEDDPTLE

SEQ ID NO: 652156 - protein, 9 aa, Homo Sapiens
PFSSCIRPC

SEQ ID NO: 652157 - protein, 9 aa, Homo Sapiens
EFTVQIKHE

SEQ ID NO: 652158 - protein, 9 aa, Homo Sapiens
KKCQAIASD

SEQ ID NO: 652159 - protein, 9 aa, Homo Sapiens
QVYIEKFIV

SEQ ID NO: 652160 - protein, 9 aa, Homo Sapiens
TEESVEKGK

SEQ ID NO: 652161 - protein, 9 aa, Homo Sapiens
TRESRKALR

SEQ ID NO: 652162 - protein, 9 aa, Homo Sapiens
YGIKYQTFL

SEQ ID NO: 652163 - protein, 9 aa, Homo Sapiens
DKLVERSHI

SEQ ID NO: 652164 - protein, 9 aa, Homo Sapiens
VNNPTGANL

SEQ ID NO: 652165 - protein, 9 aa, Homo Sapiens
QLWAAHCRK

SEQ ID NO: 652166 - protein, 9 aa, Homo Sapiens
GTGDMNSPP

SEQ ID NO: 652167 - protein, 9 aa, Homo Sapiens
FLGLRLDWF

SEQ ID NO: 652168 - protein, 9 aa, Homo Sapiens
KSLATCSSH

SEQ ID NO: 652169 - protein, 9 aa, Homo Sapiens
KATGFIILR

SEQ ID NO: 652170 - protein, 9 aa, Homo Sapiens
LGPGGGTLV

SEQ ID NO: 652171 - protein, 9 aa, Homo Sapiens
INFAMKGRK

SEQ ID NO: 652172 - protein, 9 aa, Homo Sapiens
MNFFTNPAK

SEQ ID NO: 652173 - protein, 9 aa, Homo Sapiens
KQKAQGMPV

SEQ ID NO: 652174 - protein, 9 aa, Homo Sapiens
VVCGNITLD

SEQ ID NO: 652175 - protein, 9 aa, Homo Sapiens
LLEGGEERL

SEQ ID NO: 652176 - protein, 9 aa, Homo Sapiens
YLYMPKWLY

SEQ ID NO: 652177 - protein, 9 aa, Homo Sapiens
TWRCPSPCW

SEQ ID NO: 652178 - protein, 9 aa, Homo Sapiens
SSVASKEEQ

SEQ ID NO: 652179 - protein, 9 aa, Homo Sapiens
VLTDINFAM

SEQ ID NO: 652180 - protein, 9 aa, Homo Sapiens
KCKCVDFHT

SEQ ID NO: 652181 - protein, 9 aa, Homo Sapiens
ALVTSTVFK

SEQ ID NO: 652182 - protein, 9 aa, Homo Sapiens
EALNHLLTQ

SEQ ID NO: 652183 - protein, 9 aa, Homo Sapiens
NPLVLHQDS

SEQ ID NO: 652184 - protein, 9 aa, Homo Sapiens
AAQSLGASL

SEQ ID NO: 652185 - protein, 9 aa, Homo Sapiens
LQITLKLKQ

SEQ ID NO: 652186 - protein, 9 aa, Homo Sapiens
HCGATTTAP

SEQ ID NO: 652187 - protein, 9 aa, Homo Sapiens
KGIVGRHGK

SEQ ID NO: 652188 - protein, 9 aa, Homo Sapiens
ALLHHTIIL

SEQ ID NO: 652189 - protein, 9 aa, Homo Sapiens
ASVWLISKT

SEQ ID NO: 652190 - protein, 9 aa, Homo Sapiens
KIESGDSGN

SEQ ID NO: 652191 - protein, 9 aa, Homo Sapiens
YSRFNVYCF

SEQ ID NO: 652192 - protein, 9 aa, Homo Sapiens
STIRDPSVI

SEQ ID NO: 652193 - protein, 9 aa, Homo Sapiens
TASQPNSHP

SEQ ID NO: 652194 - protein, 9 aa, Homo Sapiens
QEKCREEVR

SEQ ID NO: 652195 - protein, 9 aa, Homo Sapiens
KLSNMFLQA

SEQ ID NO: 652196 - protein, 9 aa, Homo Sapiens
AAVHSPLEL

SEQ ID NO: 652197 - protein, 9 aa, Homo Sapiens
LLDEAGSTV

SEQ ID NO: 652198 - protein, 9 aa, Homo Sapiens
TWRPCRSIV

SEQ ID NO: 652199 - protein, 9 aa, Homo Sapiens
TVFKSPLYI

SEQ ID NO: 652200 - protein, 9 aa, Homo Sapiens
VMSRKICWL

SEQ ID NO: 652201 - protein, 9 aa, Homo Sapiens
FSSRPWLSL

SEQ ID NO: 652202 - protein, 9 aa, Homo Sapiens
KASDKLVER

SEQ ID NO: 652203 - protein, 9 aa, Homo Sapiens
QFPKILWED

SEQ ID NO: 652204 - protein, 9 aa, Homo Sapiens
MDTDDTSKK

SEQ ID NO: 652205 - protein, 9 aa, Homo Sapiens
CFQLSNVFN

SEQ ID NO: 652206 - protein, 9 aa, Homo Sapiens
RLKRREMAR

SEQ ID NO: 652207 - protein, 9 aa, Homo Sapiens
EVLVTYSEV

SEQ ID NO: 652208 - protein, 9 aa, Homo Sapiens
MVSTKLQNN

SEQ ID NO: 652209 - protein, 9 aa, Homo Sapiens
LDSQLSLHL

SEQ ID NO: 652210 - protein, 9 aa, Homo Sapiens
TDRAALTLL

SEQ ID NO: 652211 - protein, 9 aa, Homo Sapiens
NASMRRVSY

SEQ ID NO: 652212 - protein, 9 aa, Homo Sapiens
CTGDGDITL

SEQ ID NO: 652213 - protein, 9 aa, Homo Sapiens
EKKHRPSHG

SEQ ID NO: 652214 - protein, 9 aa, Homo Sapiens
TGEIEVQPR

SEQ ID NO: 652215 - protein, 9 aa, Homo Sapiens
SGEISYSLF

SEQ ID NO: 652216 - protein, 9 aa, Homo Sapiens
EEKIQSEDY

SEQ ID NO: 652217 - protein, 9 aa, Homo Sapiens
ETSSNAYCS

SEQ ID NO: 652218 - protein, 9 aa, Homo Sapiens
TKAFKRDVF

SEQ ID NO: 652219 - protein, 9 aa, Homo Sapiens
EDINATRSE

SEQ ID NO: 652220 - protein, 9 aa, Homo Sapiens
EFTFGLEPR

SEQ ID NO: 652221 - protein, 9 aa, Homo Sapiens
HSAQAWKKS

SEQ ID NO: 652222 - protein, 9 aa, Homo Sapiens
TVPGADQPP

SEQ ID NO: 652223 - protein, 9 aa, Homo Sapiens
LGRSVIQDF

SEQ ID NO: 652224 - protein, 9 aa, Homo Sapiens
INDTEDDPT

SEQ ID NO: 652225 - protein, 9 aa, Homo Sapiens
HIVIEKPTY

SEQ ID NO: 652226 - protein, 9 aa, Homo Sapiens
ESVEKGKMV

SEQ ID NO: 652227 - protein, 9 aa, Homo Sapiens
NDLEPLPRI

SEQ ID NO: 652228 - protein, 9 aa, Homo Sapiens
NEENTLNSQ

SEQ ID NO: 652229 - protein, 9 aa, Homo Sapiens
FNQGRSSLQ

SEQ ID NO: 652230 - protein, 9 aa, Homo Sapiens
FWLLFGSDS

SEQ ID NO: 652231 - protein, 9 aa, Homo Sapiens
KKNADNSSS

SEQ ID NO: 652232 - protein, 9 aa, Homo Sapiens
YRGMLRRLH

SEQ ID NO: 652233 - protein, 9 aa, Homo Sapiens
VKLTLGSAT

SEQ ID NO: 652234 - protein, 9 aa, Homo Sapiens
LEFCHSNAI

SEQ ID NO: 652235 - protein, 9 aa, Homo Sapiens
MDGYNLSLV

SEQ ID NO: 652236 - protein, 9 aa, Homo Sapiens
EVASKLDHY

SEQ ID NO: 652237 - protein, 9 aa, Homo Sapiens
EEMEWVKQY

SEQ ID NO: 652238 - protein, 9 aa, Homo Sapiens
EVRVIKLIG

SEQ ID NO: 652239 - protein, 9 aa, Homo Sapiens
QSFGFQIVQ

SEQ ID NO: 652240 - protein, 9 aa, Homo Sapiens
PAKNLVSIT

SEQ ID NO: 652241 - protein, 9 aa, Homo Sapiens
VFQLNVYDV

SEQ ID NO: 652242 - protein, 9 aa, Homo Sapiens
CSGVESTIS

SEQ ID NO: 652243 - protein, 9 aa, Homo Sapiens
GSEPIRASN

SEQ ID NO: 652244 - protein, 9 aa, Homo Sapiens
LDSGIHCGA

SEQ ID NO: 652245 - protein, 9 aa, Homo Sapiens
LEDEGTPTL

SEQ ID NO: 652246 - protein, 9 aa, Homo Sapiens
DFHPRKWYM

SEQ ID NO: 652247 - protein, 9 aa, Homo Sapiens
LYPLLRLRH

SEQ ID NO: 652248 - protein, 9 aa, Homo Sapiens
LHVCSNNSD

SEQ ID NO: 652249 - protein, 9 aa, Homo Sapiens
HYFVAELAA

SEQ ID NO: 652250 - protein, 9 aa, Homo Sapiens
QRNFKLRSM

SEQ ID NO: 652251 - protein, 9 aa, Homo Sapiens
ERLKRREMA

SEQ ID NO: 652252 - protein, 9 aa, Homo Sapiens
LVKLTLGSA

SEQ ID NO: 652253 - protein, 9 aa, Homo Sapiens
FLSVGGNIG

SEQ ID NO: 652254 - protein, 9 aa, Homo Sapiens
LFTSCGTTR

SEQ ID NO: 652255 - protein, 9 aa, Homo Sapiens
LLPTRKSYT

SEQ ID NO: 652256 - protein, 9 aa, Homo Sapiens
VKVKRITPR

SEQ ID NO: 652257 - protein, 9 aa, Homo Sapiens
DVLVSGIPA

SEQ ID NO: 652258 - protein, 9 aa, Homo Sapiens
NRAETLVFS

SEQ ID NO: 652259 - protein, 9 aa, Homo Sapiens
NYNYVIWAK

SEQ ID NO: 652260 - protein, 9 aa, Homo Sapiens
ERYLNEMAI

SEQ ID NO: 652261 - protein, 9 aa, Homo Sapiens
ICEFCALSF

SEQ ID NO: 652262 - protein, 9 aa, Homo Sapiens
IEILNPNFI

SEQ ID NO: 652263 - protein, 9 aa, Homo Sapiens
PKGKENNGG

SEQ ID NO: 652264 - protein, 9 aa, Homo Sapiens
SLATCSSHL

SEQ ID NO: 652265 - protein, 9 aa, Homo Sapiens
KKGTWRPCR

SEQ ID NO: 652266 - protein, 9 aa, Homo Sapiens
YYEMEPLTI

SEQ ID NO: 652267 - protein, 9 aa, Homo Sapiens
KSCRSPRRR

SEQ ID NO: 652268 - protein, 9 aa, Homo Sapiens
DLTAFSPSL

SEQ ID NO: 652269 - protein, 9 aa, Homo Sapiens
QQYEDVSIT

SEQ ID NO: 652270 - protein, 9 aa, Homo Sapiens
KSWALPQQY

SEQ ID NO: 652271 - protein, 9 aa, Homo Sapiens
NELQQQYED

SEQ ID NO: 652272 - protein, 9 aa, Homo Sapiens
RTHHAHRTQ

SEQ ID NO: 652273 - protein, 9 aa, Homo Sapiens
QKIHNGQKP

SEQ ID NO: 652274 - protein, 9 aa, Homo Sapiens
MEQGRTEPQ

SEQ ID NO: 652275 - protein, 9 aa, Homo Sapiens
LCQLQNLLP

SEQ ID NO: 652276 - protein, 9 aa, Homo Sapiens
LQNKIDQEL

SEQ ID NO: 652277 - protein, 9 aa, Homo Sapiens
KASTVVNGV

SEQ ID NO: 652278 - protein, 9 aa, Homo Sapiens
ELMASFLPR

SEQ ID NO: 652279 - protein, 9 aa, Homo Sapiens
EVRVTKEVH

SEQ ID NO: 652280 - protein, 9 aa, Homo Sapiens
CVDFHTLKL

SEQ ID NO: 652281 - protein, 9 aa, Homo Sapiens
LRAGVYADK

SEQ ID NO: 652282 - protein, 9 aa, Homo Sapiens
TEKFGQWVH

SEQ ID NO: 652283 - protein, 9 aa, Homo Sapiens
TTMQVGFIV

SEQ ID NO: 652284 - protein, 9 aa, Homo Sapiens
FTDLILADF

SEQ ID NO: 652285 - protein, 9 aa, Homo Sapiens
EELGLLDEA

SEQ ID NO: 652286 - protein, 9 aa, Homo Sapiens
FDTMNTQQS

SEQ ID NO: 652287 - protein, 9 aa, Homo Sapiens
LPHWTPLAL

SEQ ID NO: 652288 - protein, 9 aa, Homo Sapiens
HFAAGPGLP

SEQ ID NO: 652289 - protein, 9 aa, Homo Sapiens
DLDPNTSIE

SEQ ID NO: 652290 - protein, 9 aa, Homo Sapiens
LSEMQTDLK

SEQ ID NO: 652291 - protein, 9 aa, Homo Sapiens
VIEQFWDFI

SEQ ID NO: 652292 - protein, 9 aa, Homo Sapiens
SVTDRAALT

SEQ ID NO: 652293 - protein, 9 aa, Homo Sapiens
WLYFMMFLK

SEQ ID NO: 652294 - protein, 9 aa, Homo Sapiens
DWVSSILNV

SEQ ID NO: 652295 - protein, 9 aa, Homo Sapiens
GNIMATTYI

SEQ ID NO: 652296 - protein, 9 aa, Homo Sapiens
SGLHSKARD

SEQ ID NO: 652297 - protein, 9 aa, Homo Sapiens
ICHSSFTVP

SEQ ID NO: 652298 - protein, 9 aa, Homo Sapiens
QIKEGGKSN

SEQ ID NO: 652299 - protein, 9 aa, Homo Sapiens
KKKKVSARL

SEQ ID NO: 652300 - protein, 9 aa, Homo Sapiens
IPVISEKPS

SEQ ID NO: 652301 - protein, 9 aa, Homo Sapiens
RYESSPAKP

SEQ ID NO: 652302 - protein, 9 aa, Homo Sapiens
PMGIFPILE

SEQ ID NO: 652303 - protein, 9 aa, Homo Sapiens
MAFRNTDSY

SEQ ID NO: 652304 - protein, 9 aa, Homo Sapiens
GLILNTNTE

SEQ ID NO: 652305 - protein, 9 aa, Homo Sapiens
LFPRGTRES

SEQ ID NO: 652306 - protein, 9 aa, Homo Sapiens
VDENDNAPA

SEQ ID NO: 652307 - protein, 9 aa, Homo Sapiens
IWDLESRCC

SEQ ID NO: 652308 - protein, 9 aa, Homo Sapiens
RRRHWAVKI

SEQ ID NO: 652309 - protein, 9 aa, Homo Sapiens
QKEKFKFSL

SEQ ID NO: 652310 - protein, 9 aa, Homo Sapiens
LLQNWTEEC

SEQ ID NO: 652311 - protein, 9 aa, Homo Sapiens
SVLIKVLDS

SEQ ID NO: 652312 - protein, 9 aa, Homo Sapiens
GHHRVLVEG

SEQ ID NO: 652313 - protein, 9 aa, Homo Sapiens
VSLGAHVSG

SEQ ID NO: 652314 - protein, 9 aa, Homo Sapiens
ELSSVSALR

SEQ ID NO: 652315 - protein, 9 aa, Homo Sapiens
NSRFVMKTL

SEQ ID NO: 652316 - protein, 9 aa, Homo Sapiens
PKGQDEGVW

SEQ ID NO: 652317 - protein, 9 aa, Homo Sapiens
ISFLFRILA

SEQ ID NO: 652318 - protein, 9 aa, Homo Sapiens
AQWDGLTGH

SEQ ID NO: 652319 - protein, 9 aa, Homo Sapiens
VRRPSRADP

SEQ ID NO: 652320 - protein, 9 aa, Homo Sapiens
FLFTSCGTT

SEQ ID NO: 652321 - protein, 9 aa, Homo Sapiens
CALRSQRGR

SEQ ID NO: 652322 - protein, 9 aa, Homo Sapiens
RKSLQASLK

SEQ ID NO: 652323 - protein, 9 aa, Homo Sapiens
SGHSNPMNP

SEQ ID NO: 652324 - protein, 9 aa, Homo Sapiens
SGLDTSQCE

SEQ ID NO: 652325 - protein, 9 aa, Homo Sapiens
PTADPHQEY

SEQ ID NO: 652326 - protein, 9 aa, Homo Sapiens
SEIPPDLQR

SEQ ID NO: 652327 - protein, 9 aa, Homo Sapiens
ADGTPAKAG

SEQ ID NO: 652328 - protein, 9 aa, Homo Sapiens
VHPPSGLEE

SEQ ID NO: 652329 - protein, 9 aa, Homo Sapiens
VGIWSDLAV

SEQ ID NO: 652330 - protein, 9 aa, Homo Sapiens
SSRAGGTRV

SEQ ID NO: 652331 - protein, 9 aa, Homo Sapiens
WAHQAVLPA

SEQ ID NO: 652332 - protein, 9 aa, Homo Sapiens
KEVHATSKE

SEQ ID NO: 652333 - protein, 9 aa, Homo Sapiens
MAITEKLTD

SEQ ID NO: 652334 - protein, 9 aa, Homo Sapiens
GMPVSGVAL

SEQ ID NO: 652335 - protein, 9 aa, Homo Sapiens
RSVADSHLN

SEQ ID NO: 652336 - protein, 9 aa, Homo Sapiens
DGCFLNWRE

SEQ ID NO: 652337 - protein, 9 aa, Homo Sapiens
LEWVTMSKK

SEQ ID NO: 652338 - protein, 9 aa, Homo Sapiens
HLVATLEDE

SEQ ID NO: 652339 - protein, 9 aa, Homo Sapiens
SCSQARCLP

SEQ ID NO: 652340 - protein, 9 aa, Homo Sapiens
HIPLQKFCL

SEQ ID NO: 652341 - protein, 9 aa, Homo Sapiens
PDLTRIHPS

SEQ ID NO: 652342 - protein, 9 aa, Homo Sapiens
HNKALWKSL

SEQ ID NO: 652343 - protein, 9 aa, Homo Sapiens
ISPPTLTWL

SEQ ID NO: 652344 - protein, 9 aa, Homo Sapiens
FSKQTASSK

SEQ ID NO: 652345 - protein, 9 aa, Homo Sapiens
KSNDLYQLF

SEQ ID NO: 652346 - protein, 9 aa, Homo Sapiens
FLQYIEDMA

SEQ ID NO: 652347 - protein, 9 aa, Homo Sapiens
GSRQDSWDV

SEQ ID NO: 652348 - protein, 9 aa, Homo Sapiens
EVVLRTACS

SEQ ID NO: 652349 - protein, 9 aa, Homo Sapiens
YYWEKCSAS

SEQ ID NO: 652350 - protein, 9 aa, Homo Sapiens
AGHFPGAIF

SEQ ID NO: 652351 - protein, 9 aa, Homo Sapiens
LEDKKIEIR

SEQ ID NO: 652352 - protein, 9 aa, Homo Sapiens
WMYCTDWEE

SEQ ID NO: 652353 - protein, 9 aa, Homo Sapiens
TQVNKNKKC

SEQ ID NO: 652354 - protein, 9 aa, Homo Sapiens
CSGYDIEDA

SEQ ID NO: 652355 - protein, 9 aa, Homo Sapiens
ISAGLLCQG

SEQ ID NO: 652356 - protein, 9 aa, Homo Sapiens
GIPETQSRS

SEQ ID NO: 652357 - protein, 9 aa, Homo Sapiens
GGGLSARCS

SEQ ID NO: 652358 - protein, 9 aa, Homo Sapiens
DVSGGYPQF

SEQ ID NO: 652359 - protein, 9 aa, Homo Sapiens
ETCPEGSNC

SEQ ID NO: 652360 - protein, 9 aa, Homo Sapiens
SCFERIIQS

SEQ ID NO: 652361 - protein, 9 aa, Homo Sapiens
GFPNKYSRF

SEQ ID NO: 652362 - protein, 9 aa, Homo Sapiens
GCLSIYYEM

SEQ ID NO: 652363 - protein, 9 aa, Homo Sapiens
ITGHLPDFC

SEQ ID NO: 652364 - protein, 9 aa, Homo Sapiens
AGSSSFSGT

SEQ ID NO: 652365 - protein, 9 aa, Homo Sapiens
YNSVELHQI

SEQ ID NO: 652366 - protein, 9 aa, Homo Sapiens
PSESSSSNS

SEQ ID NO: 652367 - protein, 9 aa, Homo Sapiens
NAYCSTESQ

SEQ ID NO: 652368 - protein, 9 aa, Homo Sapiens
LAMTNPTSE

SEQ ID NO: 652369 - protein, 9 aa, Homo Sapiens
LSTLKKVSI

SEQ ID NO: 652370 - protein, 9 aa, Homo Sapiens
VPRNRGYLS

SEQ ID NO: 652371 - protein, 9 aa, Homo Sapiens
EQANLEDRC

SEQ ID NO: 652372 - protein, 9 aa, Homo Sapiens
SVYRALLFL

SEQ ID NO: 652373 - protein, 9 aa, Homo Sapiens
VITKRCPDS

SEQ ID NO: 652374 - protein, 9 aa, Homo Sapiens
YLNEMAITE

SEQ ID NO: 652375 - protein, 9 aa, Homo Sapiens
VIWAKVKEI

SEQ ID NO: 652376 - protein, 9 aa, Homo Sapiens
EDPQHLGEC

SEQ ID NO: 652377 - protein, 9 aa, Homo Sapiens
KQLSEFVPL

SEQ ID NO: 652378 - protein, 9 aa, Homo Sapiens
LFAAENKQM

SEQ ID NO: 652379 - protein, 9 aa, Homo Sapiens
GIWSDLAVE

SEQ ID NO: 652380 - protein, 9 aa, Homo Sapiens
HVSHVVHIT

SEQ ID NO: 652381 - protein, 9 aa, Homo Sapiens
DKLQNKIDQ

SEQ ID NO: 652382 - protein, 9 aa, Homo Sapiens
GSLCIRDAA

SEQ ID NO: 652383 - protein, 9 aa, Homo Sapiens
MAMKAYDGL

SEQ ID NO: 652384 - protein, 9 aa, Homo Sapiens
PSSCGKTNL

SEQ ID NO: 652385 - protein, 9 aa, Homo Sapiens
SVLHGSHSG

SEQ ID NO: 652386 - protein, 9 aa, Homo Sapiens
PGGNTAFNH

SEQ ID NO: 652387 - protein, 9 aa, Homo Sapiens
ITFNSRFVM

SEQ ID NO: 652388 - protein, 9 aa, Homo Sapiens
KTDLTAFSP

SEQ ID NO: 652389 - protein, 9 aa, Homo Sapiens
FFNAWAIFK

SEQ ID NO: 652390 - protein, 9 aa, Homo Sapiens
STKVNNNLH

SEQ ID NO: 652391 - protein, 9 aa, Homo Sapiens
DYICEFCAL

SEQ ID NO: 652392 - protein, 9 aa, Homo Sapiens
LLTQEEDYQ

SEQ ID NO: 652393 - protein, 9 aa, Homo Sapiens
FVKISQPKN

SEQ ID NO: 652394 - protein, 9 aa, Homo Sapiens
CRLDQDISG

SEQ ID NO: 652395 - protein, 9 aa, Homo Sapiens
EEILLNDNN

SEQ ID NO: 652396 - protein, 9 aa, Homo Sapiens
TEPLRSPSS

SEQ ID NO: 652397 - protein, 9 aa, Homo Sapiens
GGEVEKACA

SEQ ID NO: 652398 - protein, 9 aa, Homo Sapiens
ELATNPDVQ

SEQ ID NO: 652399 - protein, 9 aa, Homo Sapiens
SSSAFTALS

SEQ ID NO: 652400 - protein, 9 aa, Homo Sapiens
VKESSRSFQ

SEQ ID NO: 652401 - protein, 9 aa, Homo Sapiens
IQETCESRN

SEQ ID NO: 652402 - protein, 9 aa, Homo Sapiens
DLAEETPGG

SEQ ID NO: 652403 - protein, 9 aa, Homo Sapiens
QLSLHLLDN

SEQ ID NO: 652404 - protein, 9 aa, Homo Sapiens
NFFTNPAKN

SEQ ID NO: 652405 - protein, 9 aa, Homo Sapiens
PEVIRASLF

SEQ ID NO: 652406 - protein, 9 aa, Homo Sapiens
KELAYESQT

SEQ ID NO: 652407 - protein, 9 aa, Homo Sapiens
QRHIHDVLV

SEQ ID NO: 652408 - protein, 9 aa, Homo Sapiens
LALYEENIF

SEQ ID NO: 652409 - protein, 9 aa, Homo Sapiens
DPQEIRMLI

SEQ ID NO: 652410 - protein, 9 aa, Homo Sapiens
QDDSSDKEI

SEQ ID NO: 652411 - protein, 9 aa, Homo Sapiens
MLAMDTDDT

SEQ ID NO: 652412 - protein, 9 aa, Homo Sapiens
LQKELQDIT

SEQ ID NO: 652413 - protein, 9 aa, Homo Sapiens
CLQNHLNTS

SEQ ID NO: 652414 - protein, 9 aa, Homo Sapiens
KPTNVLNVS

SEQ ID NO: 652415 - protein, 9 aa, Homo Sapiens
ICCPKPHVR

SEQ ID NO: 652416 - protein, 9 aa, Homo Sapiens
LCDFAAREW

SEQ ID NO: 652417 - protein, 9 aa, Homo Sapiens
SCIQIRNKK

SEQ ID NO: 652418 - protein, 9 aa, Homo Sapiens
FNHQVRARI

SEQ ID NO: 652419 - protein, 9 aa, Homo Sapiens
PGAIFQGRE

SEQ ID NO: 652420 - protein, 9 aa, Homo Sapiens
KYPPVDPES

SEQ ID NO: 652421 - protein, 9 aa, Homo Sapiens
DRCRGLVEV

SEQ ID NO: 652422 - protein, 9 aa, Homo Sapiens
EKGSVNNEF

SEQ ID NO: 652423 - protein, 9 aa, Homo Sapiens
RKLANRHNH

SEQ ID NO: 652424 - protein, 9 aa, Homo Sapiens
TPKEVVKCP

SEQ ID NO: 652425 - protein, 9 aa, Homo Sapiens
ASFCPRLAW

SEQ ID NO: 652426 - protein, 9 aa, Homo Sapiens
AAVPAQLRP

SEQ ID NO: 652427 - protein, 9 aa, Homo Sapiens
TLKNAMKIE

SEQ ID NO: 652428 - protein, 9 aa, Homo Sapiens
TFVLSPEGS

SEQ ID NO: 652429 - protein, 9 aa, Homo Sapiens
SICECKDGQ

SEQ ID NO: 652430 - protein, 9 aa, Homo Sapiens
TIEVICYGL

SEQ ID NO: 652431 - protein, 9 aa, Homo Sapiens
NIVEFLRKL

SEQ ID NO: 652432 - protein, 9 aa, Homo Sapiens
GVDKHGRPL

SEQ ID NO: 652433 - protein, 9 aa, Homo Sapiens
KLIGQTPIS

SEQ ID NO: 652434 - protein, 9 aa, Homo Sapiens
SGDSPGDSP

SEQ ID NO: 652435 - protein, 9 aa, Homo Sapiens
ADCTMAFMF

SEQ ID NO: 652436 - protein, 9 aa, Homo Sapiens
LSQQTNGIT

SEQ ID NO: 652437 - protein, 9 aa, Homo Sapiens
CRELLRIAH

SEQ ID NO: 652438 - protein, 9 aa, Homo Sapiens
ETLKNIMEY

SEQ ID NO: 652439 - protein, 9 aa, Homo Sapiens
TQTDLFTCC

SEQ ID NO: 652440 - protein, 9 aa, Homo Sapiens
EPLTISKLV

SEQ ID NO: 652441 - protein, 9 aa, Homo Sapiens
KKEKDNKEK

SEQ ID NO: 652442 - protein, 9 aa, Homo Sapiens
LTEAWMQAN

SEQ ID NO: 652443 - protein, 9 aa, Homo Sapiens
SSNNFYKLV

SEQ ID NO: 652444 - protein, 9 aa, Homo Sapiens
QRIPLPPPT

SEQ ID NO: 652445 - protein, 9 aa, Homo Sapiens
KITFVIWLL

SEQ ID NO: 652446 - protein, 9 aa, Homo Sapiens
TECLLLGIM

SEQ ID NO: 652447 - protein, 9 aa, Homo Sapiens
ETQSRSAGS

SEQ ID NO: 652448 - protein, 9 aa, Homo Sapiens
ISKLVYNPS

SEQ ID NO: 652449 - protein, 9 aa, Homo Sapiens
KITVNGPRE

SEQ ID NO: 652450 - protein, 9 aa, Homo Sapiens
VNKNKKCGN

SEQ ID NO: 652451 - protein, 9 aa, Homo Sapiens
NWGHRTSLQ

SEQ ID NO: 652452 - protein, 9 aa, Homo Sapiens
PDIVKGGAV

SEQ ID NO: 652453 - protein, 9 aa, Homo Sapiens
FENSSQFRP

SEQ ID NO: 652454 - protein, 9 aa, Homo Sapiens
FAAVADHYL

SEQ ID NO: 652455 - protein, 9 aa, Homo Sapiens
DLESRCCLD

SEQ ID NO: 652456 - protein, 9 aa, Homo Sapiens
YSNLVALGY

SEQ ID NO: 652457 - protein, 9 aa, Homo Sapiens
GVVEPGMLV

SEQ ID NO: 652458 - protein, 9 aa, Homo Sapiens
CPSFLSLRK

SEQ ID NO: 652459 - protein, 9 aa, Homo Sapiens
LSDGTETGS

SEQ ID NO: 652460 - protein, 9 aa, Homo Sapiens
CKSAYHPTK

SEQ ID NO: 652461 - protein, 9 aa, Homo Sapiens
LYLACENQR

SEQ ID NO: 652462 - protein, 9 aa, Homo Sapiens
NVSQDLYTI

SEQ ID NO: 652463 - protein, 9 aa, Homo Sapiens
IMELHVQEY

SEQ ID NO: 652464 - protein, 9 aa, Homo Sapiens
PPGTPVVSQ

SEQ ID NO: 652465 - protein, 9 aa, Homo Sapiens
FQSNTGISA

SEQ ID NO: 652466 - protein, 9 aa, Homo Sapiens
AGNIMATTY

SEQ ID NO: 652467 - protein, 9 aa, Homo Sapiens
SYYYSPGLH

SEQ ID NO: 652468 - protein, 9 aa, Homo Sapiens
MGGMLLALL

SEQ ID NO: 652469 - protein, 9 aa, Homo Sapiens
IESTLQMVW

SEQ ID NO: 652470 - protein, 9 aa, Homo Sapiens
YELATNPDV

SEQ ID NO: 652471 - protein, 9 aa, Homo Sapiens
LNWREHRSG

SEQ ID NO: 652472 - protein, 9 aa, Homo Sapiens
KNGIITGYH

SEQ ID NO: 652473 - protein, 9 aa, Homo Sapiens
SGSIRTNSS

SEQ ID NO: 652474 - protein, 9 aa, Homo Sapiens
PYRYVVVLV

SEQ ID NO: 652475 - protein, 9 aa, Homo Sapiens
ECLDYNSPV

SEQ ID NO: 652476 - protein, 9 aa, Homo Sapiens
CYPRPCRDP

SEQ ID NO: 652477 - protein, 9 aa, Homo Sapiens
QRCGAKTVR

SEQ ID NO: 652478 - protein, 9 aa, Homo Sapiens
LKIMLPSPG

SEQ ID NO: 652479 - protein, 9 aa, Homo Sapiens
RADTFDLQT

SEQ ID NO: 652480 - protein, 9 aa, Homo Sapiens
SEPIRASNP

SEQ ID NO: 652481 - protein, 9 aa, Homo Sapiens
SLCDPTFIL

SEQ ID NO: 652482 - protein, 9 aa, Homo Sapiens
CFSGQLSKK

SEQ ID NO: 652483 - protein, 9 aa, Homo Sapiens
TGKESCDVF

SEQ ID NO: 652484 - protein, 9 aa, Homo Sapiens
PQGAPGQGT

SEQ ID NO: 652485 - protein, 9 aa, Homo Sapiens
FTVPKMLEG

SEQ ID NO: 652486 - protein, 9 aa, Homo Sapiens
GAPIVSRML

SEQ ID NO: 652487 - protein, 9 aa, Homo Sapiens
GLNLVRQHH

SEQ ID NO: 652488 - protein, 9 aa, Homo Sapiens
LDSVTAFLR

SEQ ID NO: 652489 - protein, 9 aa, Homo Sapiens
KHAERQLLA

SEQ ID NO: 652490 - protein, 9 aa, Homo Sapiens
AGWCYVAWA

SEQ ID NO: 652491 - protein, 9 aa, Homo Sapiens
LVVLQGVCA

SEQ ID NO: 652492 - protein, 9 aa, Homo Sapiens
QQAELVDFL

SEQ ID NO: 652493 - protein, 9 aa, Homo Sapiens
IADALFYQG

SEQ ID NO: 652494 - protein, 9 aa, Homo Sapiens
AIEEREMRF

SEQ ID NO: 652495 - protein, 9 aa, Homo Sapiens
KESCDVFLL

SEQ ID NO: 652496 - protein, 9 aa, Homo Sapiens
DSLDVCYST

SEQ ID NO: 652497 - protein, 9 aa, Homo Sapiens
HVGQVITKR

SEQ ID NO: 652498 - protein, 9 aa, Homo Sapiens
RPPGPMTTS

SEQ ID NO: 652499 - protein, 9 aa, Homo Sapiens
DLLHIPLQK

SEQ ID NO: 652500 - protein, 9 aa, Homo Sapiens
LAHNKALWK

SEQ ID NO: 652501 - protein, 9 aa, Homo Sapiens
MQKYQLVAQ

SEQ ID NO: 652502 - protein, 9 aa, Homo Sapiens
KLDKAQIYD

SEQ ID NO: 652503 - protein, 9 aa, Homo Sapiens
KAKIQDKKG

SEQ ID NO: 652504 - protein, 9 aa, Homo Sapiens
GSSEDNFEN

SEQ ID NO: 652505 - protein, 9 aa, Homo Sapiens
INATRSEEQ

SEQ ID NO: 652506 - protein, 9 aa, Homo Sapiens
KDACSICEC

SEQ ID NO: 652507 - protein, 9 aa, Homo Sapiens
FFFLHKEFL

SEQ ID NO: 652508 - protein, 9 aa, Homo Sapiens
NKSCRSPRR

SEQ ID NO: 652509 - protein, 9 aa, Homo Sapiens
PLLRLRHAC

SEQ ID NO: 652510 - protein, 9 aa, Homo Sapiens
NHLLTQEED

SEQ ID NO: 652511 - protein, 9 aa, Homo Sapiens
KILEPPKGQ

SEQ ID NO: 652512 - protein, 9 aa, Homo Sapiens
YRGNGKNLS

SEQ ID NO: 652513 - protein, 9 aa, Homo Sapiens
LWLRTQLGS

SEQ ID NO: 652514 - protein, 9 aa, Homo Sapiens
IIITHAYNQ

SEQ ID NO: 652515 - protein, 9 aa, Homo Sapiens
VEKGKMVAV

SEQ ID NO: 652516 - protein, 9 aa, Homo Sapiens
VQVSSPNEN

SEQ ID NO: 652517 - protein, 9 aa, Homo Sapiens
HRQCLENEE

SEQ ID NO: 652518 - protein, 9 aa, Homo Sapiens
DNQKCSQCE

SEQ ID NO: 652519 - protein, 9 aa, Homo Sapiens
AVDLLHIPL

SEQ ID NO: 652520 - protein, 9 aa, Homo Sapiens
YRQFLKQSL

SEQ ID NO: 652521 - protein, 9 aa, Homo Sapiens
AMDTDDTSK

SEQ ID NO: 652522 - protein, 9 aa, Homo Sapiens
ITQWQKIGV

SEQ ID NO: 652523 - protein, 9 aa, Homo Sapiens
LSLRYSVTV

SEQ ID NO: 652524 - protein, 9 aa, Homo Sapiens
VLWLRTQLG

SEQ ID NO: 652525 - protein, 9 aa, Homo Sapiens
PWEVLVTYS

SEQ ID NO: 652526 - protein, 9 aa, Homo Sapiens
VKEKIAEQV

SEQ ID NO: 652527 - protein, 9 aa, Homo Sapiens
DVWARKQHM

SEQ ID NO: 652528 - protein, 9 aa, Homo Sapiens
EDTEALTWL

SEQ ID NO: 652529 - protein, 9 aa, Homo Sapiens
FVRKTTKKI

SEQ ID NO: 652530 - protein, 9 aa, Homo Sapiens
PTVSFNLMF

SEQ ID NO: 652531 - protein, 9 aa, Homo Sapiens
VNPTADPHQ

SEQ ID NO: 652532 - protein, 9 aa, Homo Sapiens
PPSEYERIG

SEQ ID NO: 652533 - protein, 9 aa, Homo Sapiens
RIRLTWALA

SEQ ID NO: 652534 - protein, 9 aa, Homo Sapiens
PQPQAPCKG

SEQ ID NO: 652535 - protein, 9 aa, Homo Sapiens
LSGSIRTNS

SEQ ID NO: 652536 - protein, 9 aa, Homo Sapiens
EGVKDCDGS

SEQ ID NO: 652537 - protein, 9 aa, Homo Sapiens
ADSHLNAIE

SEQ ID NO: 652538 - protein, 9 aa, Homo Sapiens
DLYTIRSNI

SEQ ID NO: 652539 - protein, 9 aa, Homo Sapiens
AENKQMLKP

SEQ ID NO: 652540 - protein, 9 aa, Homo Sapiens
HGPDLTRIH

SEQ ID NO: 652541 - protein, 9 aa, Homo Sapiens
FRERTVRHE

SEQ ID NO: 652542 - protein, 9 aa, Homo Sapiens
GPPAALQLS

SEQ ID NO: 652543 - protein, 9 aa, Homo Sapiens
TEDDYYDGE

SEQ ID NO: 652544 - protein, 9 aa, Homo Sapiens
PGLPWGALV

SEQ ID NO: 652545 - protein, 9 aa, Homo Sapiens
DPLQSTLFR

SEQ ID NO: 652546 - protein, 9 aa, Homo Sapiens
NKELAYESQ

SEQ ID NO: 652547 - protein, 9 aa, Homo Sapiens
KTFGGVGGG

SEQ ID NO: 652548 - protein, 9 aa, Homo Sapiens
LPSFSKQTA

SEQ ID NO: 652549 - protein, 9 aa, Homo Sapiens
QTFVLSPEG

SEQ ID NO: 652550 - protein, 9 aa, Homo Sapiens
STTRAQVDL

SEQ ID NO: 652551 - protein, 9 aa, Homo Sapiens
LNNKFAFFI

SEQ ID NO: 652552 - protein, 9 aa, Homo Sapiens
PTAWRACQF

SEQ ID NO: 652553 - protein, 9 aa, Homo Sapiens
EDIQDLGVR

SEQ ID NO: 652554 - protein, 9 aa, Homo Sapiens
IADCTMAFM

SEQ ID NO: 652555 - protein, 9 aa, Homo Sapiens
APCSQMKLQ

SEQ ID NO: 652556 - protein, 9 aa, Homo Sapiens
NASKDVKVK

SEQ ID NO: 652557 - protein, 9 aa, Homo Sapiens
KERIKCSRD

SEQ ID NO: 652558 - protein, 9 aa, Homo Sapiens
NPTADPHQE

SEQ ID NO: 652559 - protein, 9 aa, Homo Sapiens
HHPIHVKNI

SEQ ID NO: 652560 - protein, 9 aa, Homo Sapiens
PFPPCTSSP

SEQ ID NO: 652561 - protein, 9 aa, Homo Sapiens
VMHAQTTSG

SEQ ID NO: 652562 - protein, 9 aa, Homo Sapiens
NIFERIAGE

SEQ ID NO: 652563 - protein, 9 aa, Homo Sapiens
PRRRLQGSI

SEQ ID NO: 652564 - protein, 9 aa, Homo Sapiens
YCKERYTLD

SEQ ID NO: 652565 - protein, 9 aa, Homo Sapiens
MSQILPFIK

SEQ ID NO: 652566 - protein, 9 aa, Homo Sapiens
LLGATAIEY

SEQ ID NO: 652567 - protein, 9 aa, Homo Sapiens
LDLSNLQHQ

SEQ ID NO: 652568 - protein, 9 aa, Homo Sapiens
SCDVFLLDE

SEQ ID NO: 652569 - protein, 9 aa, Homo Sapiens
EYDGLVDAL

SEQ ID NO: 652570 - protein, 9 aa, Homo Sapiens
KVSARLLKI

SEQ ID NO: 652571 - protein, 9 aa, Homo Sapiens
QVNKNKKCG

SEQ ID NO: 652572 - protein, 9 aa, Homo Sapiens
HCEPQGLLS

SEQ ID NO: 652573 - protein, 9 aa, Homo Sapiens
IISLEDKKI

SEQ ID NO: 652574 - protein, 9 aa, Homo Sapiens
LRPMRTLPM

SEQ ID NO: 652575 - protein, 9 aa, Homo Sapiens
PPPLERRSF

SEQ ID NO: 652576 - protein, 9 aa, Homo Sapiens
QPNDDLLFS

SEQ ID NO: 652577 - protein, 9 aa, Homo Sapiens
GKYMEQGRT

SEQ ID NO: 652578 - protein, 9 aa, Homo Sapiens
IMNPSLCRG

SEQ ID NO: 652579 - protein, 9 aa, Homo Sapiens
NCNDLEPLP

SEQ ID NO: 652580 - protein, 9 aa, Homo Sapiens
PVASVWLIS

SEQ ID NO: 652581 - protein, 9 aa, Homo Sapiens
STSELQEAM

SEQ ID NO: 652582 - protein, 9 aa, Homo Sapiens
MFWYRQFLK

SEQ ID NO: 652583 - protein, 9 aa, Homo Sapiens
RVFWLLFGS

SEQ ID NO: 652584 - protein, 9 aa, Homo Sapiens
TRRWFFTIH

SEQ ID NO: 652585 - protein, 9 aa, Homo Sapiens
RLITIADAL

SEQ ID NO: 652586 - protein, 9 aa, Homo Sapiens
KYQENKKGK

SEQ ID NO: 652587 - protein, 9 aa, Homo Sapiens
QGFPLGTHG

SEQ ID NO: 652588 - protein, 9 aa, Homo Sapiens
SKQLSEFVP

SEQ ID NO: 652589 - protein, 9 aa, Homo Sapiens
HICVILVFN

SEQ ID NO: 652590 - protein, 9 aa, Homo Sapiens
TTFLKIMLP

SEQ ID NO: 652591 - protein, 9 aa, Homo Sapiens
LGAAGRTGW

SEQ ID NO: 652592 - protein, 9 aa, Homo Sapiens
SLGASLLQR

SEQ ID NO: 652593 - protein, 9 aa, Homo Sapiens
DYYDGEWCA

SEQ ID NO: 652594 - protein, 9 aa, Homo Sapiens
TYSVICKKS

SEQ ID NO: 652595 - protein, 9 aa, Homo Sapiens
LLNDNNLAV

SEQ ID NO: 652596 - protein, 9 aa, Homo Sapiens
QQTNGITRL

SEQ ID NO: 652597 - protein, 9 aa, Homo Sapiens
FAAGPGLPW

SEQ ID NO: 652598 - protein, 9 aa, Homo Sapiens
LKAEPAHTA

SEQ ID NO: 652599 - protein, 9 aa, Homo Sapiens
DCGSNFYHP

SEQ ID NO: 652600 - protein, 9 aa, Homo Sapiens
ESGKEAVTL

SEQ ID NO: 652601 - protein, 9 aa, Homo Sapiens
WREFQTLVI

SEQ ID NO: 652602 - protein, 9 aa, Homo Sapiens
LWGVPDSPQ

SEQ ID NO: 652603 - protein, 9 aa, Homo Sapiens
ETQAKPSAA

SEQ ID NO: 652604 - protein, 9 aa, Homo Sapiens
AATGISFTV

SEQ ID NO: 652605 - protein, 9 aa, Homo Sapiens
HATSKEAKS

SEQ ID NO: 652606 - protein, 9 aa, Homo Sapiens
GNEEGDLEE

SEQ ID NO: 652607 - protein, 9 aa, Homo Sapiens
KNFVKPNKT

SEQ ID NO: 652608 - protein, 9 aa, Homo Sapiens
DFQWHKIMI

SEQ ID NO: 652609 - protein, 9 aa, Homo Sapiens
DIQEFTKFP

SEQ ID NO: 652610 - protein, 9 aa, Homo Sapiens
SSVSALRMT

SEQ ID NO: 652611 - protein, 9 aa, Homo Sapiens
DGTETGSEI

SEQ ID NO: 652612 - protein, 9 aa, Homo Sapiens
FSSAHLQNE

SEQ ID NO: 652613 - protein, 9 aa, Homo Sapiens
HLQDLETED

SEQ ID NO: 652614 - protein, 9 aa, Homo Sapiens
TESQSSSFH

SEQ ID NO: 652615 - protein, 9 aa, Homo Sapiens
PCNTSCSPV

SEQ ID NO: 652616 - protein, 9 aa, Homo Sapiens
LADTPQEPF

SEQ ID NO: 652617 - protein, 9 aa, Homo Sapiens
MLDKLQNKI

SEQ ID NO: 652618 - protein, 9 aa, Homo Sapiens
LLWWWWCCY

SEQ ID NO: 652619 - protein, 9 aa, Homo Sapiens
AGTHAESAE

SEQ ID NO: 652620 - protein, 9 aa, Homo Sapiens
MKQLPFCRS

SEQ ID NO: 652621 - protein, 9 aa, Homo Sapiens
PSPSSSSLS

SEQ ID NO: 652622 - protein, 9 aa, Homo Sapiens
RVLALLDRD

SEQ ID NO: 652623 - protein, 9 aa, Homo Sapiens
VNGWMYCTD

SEQ ID NO: 652624 - protein, 9 aa, Homo Sapiens
VSIFHDCEA

SEQ ID NO: 652625 - protein, 9 aa, Homo Sapiens
EDLVRFMYS

SEQ ID NO: 652626 - protein, 9 aa, Homo Sapiens
YLACENQRR

SEQ ID NO: 652627 - protein, 9 aa, Homo Sapiens
AYRLTIRAS

SEQ ID NO: 652628 - protein, 9 aa, Homo Sapiens
CGSNFYHPT

SEQ ID NO: 652629 - protein, 9 aa, Homo Sapiens
DLETEDPLP

SEQ ID NO: 652630 - protein, 9 aa, Homo Sapiens
GHLAHNKAL

SEQ ID NO: 652631 - protein, 9 aa, Homo Sapiens
LGPHQAEPI

SEQ ID NO: 652632 - protein, 9 aa, Homo Sapiens
KFAFFIDKV

SEQ ID NO: 652633 - protein, 9 aa, Homo Sapiens
LVNAIIIVV

SEQ ID NO: 652634 - protein, 9 aa, Homo Sapiens
GRTRRWFFT

SEQ ID NO: 652635 - protein, 9 aa, Homo Sapiens
VESGEEEVA

SEQ ID NO: 652636 - protein, 9 aa, Homo Sapiens
CSSKSERTP

SEQ ID NO: 652637 - protein, 9 aa, Homo Sapiens
GYSLIIKDL

SEQ ID NO: 652638 - protein, 9 aa, Homo Sapiens
CLRCHRAII

SEQ ID NO: 652639 - protein, 9 aa, Homo Sapiens
SKFFQVHCQ

SEQ ID NO: 652640 - protein, 9 aa, Homo Sapiens
GSLFEVQWQ

SEQ ID NO: 652641 - protein, 9 aa, Homo Sapiens
VDTIWDMRN

SEQ ID NO: 652642 - protein, 9 aa, Homo Sapiens
LLELHYEAL

SEQ ID NO: 652643 - protein, 9 aa, Homo Sapiens
FHELSQQTN

SEQ ID NO: 652644 - protein, 9 aa, Homo Sapiens
GLPWGALVS

SEQ ID NO: 652645 - protein, 9 aa, Homo Sapiens
FLVAFMGYS

SEQ ID NO: 652646 - protein, 9 aa, Homo Sapiens
KLANRHNHG

SEQ ID NO: 652647 - protein, 9 aa, Homo Sapiens
LGNIEETCQ

SEQ ID NO: 652648 - protein, 9 aa, Homo Sapiens
CPRRTQRIT

SEQ ID NO: 652649 - protein, 9 aa, Homo Sapiens
IQSFGRKVV

SEQ ID NO: 652650 - protein, 9 aa, Homo Sapiens
SFTVPKMLE

SEQ ID NO: 652651 - protein, 9 aa, Homo Sapiens
LNKYWCRPL

SEQ ID NO: 652652 - protein, 9 aa, Homo Sapiens
DTLADLTLA

SEQ ID NO: 652653 - protein, 9 aa, Homo Sapiens
EKEGMKYIK

SEQ ID NO: 652654 - protein, 9 aa, Homo Sapiens
YRHMMDRRY

SEQ ID NO: 652655 - protein, 9 aa, Homo Sapiens
VRASALSSH

SEQ ID NO: 652656 - protein, 9 aa, Homo Sapiens
LLWRNLLWH

SEQ ID NO: 652657 - protein, 9 aa, Homo Sapiens
FLFRILADT

SEQ ID NO: 652658 - protein, 9 aa, Homo Sapiens
RGSGGGIMS

SEQ ID NO: 652659 - protein, 9 aa, Homo Sapiens
HSCVTLHQK

SEQ ID NO: 652660 - protein, 9 aa, Homo Sapiens
QSSRAGGTR

SEQ ID NO: 652661 - protein, 9 aa, Homo Sapiens
SANTHVLQV

SEQ ID NO: 652662 - protein, 9 aa, Homo Sapiens
YEAAHNLLV

SEQ ID NO: 652663 - protein, 9 aa, Homo Sapiens
LSNIISEKK

SEQ ID NO: 652664 - protein, 9 aa, Homo Sapiens
VPGADQPPT

SEQ ID NO: 652665 - protein, 9 aa, Homo Sapiens
VVMLVMFGH

SEQ ID NO: 652666 - protein, 9 aa, Homo Sapiens
SIHTGEKLY

SEQ ID NO: 652667 - protein, 9 aa, Homo Sapiens
GKNIFLVSA

SEQ ID NO: 652668 - protein, 9 aa, Homo Sapiens
YGVQMMNKV

SEQ ID NO: 652669 - protein, 9 aa, Homo Sapiens
AKCHIVIEK

SEQ ID NO: 652670 - protein, 9 aa, Homo Sapiens
LDTQHSEDI

SEQ ID NO: 652671 - protein, 9 aa, Homo Sapiens
TDVDTGVSG

SEQ ID NO: 652672 - protein, 9 aa, Homo Sapiens
GLALLAFLS

SEQ ID NO: 652673 - protein, 9 aa, Homo Sapiens
LGCTGHWEQ

SEQ ID NO: 652674 - protein, 9 aa, Homo Sapiens
HFQPNDDLL

SEQ ID NO: 652675 - protein, 9 aa, Homo Sapiens
SLLRAGVYA

SEQ ID NO: 652676 - protein, 9 aa, Homo Sapiens
HSLYPFTYR

SEQ ID NO: 652677 - protein, 9 aa, Homo Sapiens
PVSPEGQLV

SEQ ID NO: 652678 - protein, 9 aa, Homo Sapiens
DFAAREWVG

SEQ ID NO: 652679 - protein, 9 aa, Homo Sapiens
ASILNLCDI

SEQ ID NO: 652680 - protein, 9 aa, Homo Sapiens
NKYWCRPLQ

SEQ ID NO: 652681 - protein, 9 aa, Homo Sapiens
ELVARFRQL

SEQ ID NO: 652682 - protein, 9 aa, Homo Sapiens
DCKILHRQK

SEQ ID NO: 652683 - protein, 9 aa, Homo Sapiens
FKSNDLYQL

SEQ ID NO: 652684 - protein, 9 aa, Homo Sapiens
HKFTQHNFQ

SEQ ID NO: 652685 - protein, 9 aa, Homo Sapiens
GTWRPCRSI

SEQ ID NO: 652686 - protein, 9 aa, Homo Sapiens
HRLEEGQAS

SEQ ID NO: 652687 - protein, 9 aa, Homo Sapiens
FSKACNTKR

SEQ ID NO: 652688 - protein, 9 aa, Homo Sapiens
VRNPRGRIE

SEQ ID NO: 652689 - protein, 9 aa, Homo Sapiens
LEKILFVVF

SEQ ID NO: 652690 - protein, 9 aa, Homo Sapiens
DLPEFTFGL

SEQ ID NO: 652691 - protein, 9 aa, Homo Sapiens
GTHAESAEI

SEQ ID NO: 652692 - protein, 9 aa, Homo Sapiens
HSNAIDHFS

SEQ ID NO: 652693 - protein, 9 aa, Homo Sapiens
PETQSRSAG

SEQ ID NO: 652694 - protein, 9 aa, Homo Sapiens
PSFSKQTAS

SEQ ID NO: 652695 - protein, 9 aa, Homo Sapiens
VLLQAGWCY

SEQ ID NO: 652696 - protein, 9 aa, Homo Sapiens
STECLLLGI

SEQ ID NO: 652697 - protein, 9 aa, Homo Sapiens
RAGMSYYYS

SEQ ID NO: 652698 - protein, 9 aa, Homo Sapiens
AFRNTDSYL

SEQ ID NO: 652699 - protein, 9 aa, Homo Sapiens
SSAHLQNEK

SEQ ID NO: 652700 - protein, 9 aa, Homo Sapiens
DMWSVACTV

SEQ ID NO: 652701 - protein, 9 aa, Homo Sapiens
PWVTHFAAG

SEQ ID NO: 652702 - protein, 9 aa, Homo Sapiens
ELQEAMRKL

SEQ ID NO: 652703 - protein, 9 aa, Homo Sapiens
ALSEDSATT

SEQ ID NO: 652704 - protein, 9 aa, Homo Sapiens
THHLSPSTH

SEQ ID NO: 652705 - protein, 9 aa, Homo Sapiens
VTDRAALTL

SEQ ID NO: 652706 - protein, 9 aa, Homo Sapiens
NIISLEDKK

SEQ ID NO: 652707 - protein, 9 aa, Homo Sapiens
GEAGHPWVT

SEQ ID NO: 652708 - protein, 9 aa, Homo Sapiens
QQDCCVPVC

SEQ ID NO: 652709 - protein, 9 aa, Homo Sapiens
KKIEIREME

SEQ ID NO: 652710 - protein, 9 aa, Homo Sapiens
KLVLLRQPP

SEQ ID NO: 652711 - protein, 9 aa, Homo Sapiens
DEQTALNKI

SEQ ID NO: 652712 - protein, 9 aa, Homo Sapiens
LRQLTVWNT

SEQ ID NO: 652713 - protein, 9 aa, Homo Sapiens
VLVSGIPAL

SEQ ID NO: 652714 - protein, 9 aa, Homo Sapiens
ALLDRDSLV

SEQ ID NO: 652715 - protein, 9 aa, Homo Sapiens
VAFMGYSVM

SEQ ID NO: 652716 - protein, 9 aa, Homo Sapiens
VACATKKFS

SEQ ID NO: 652717 - protein, 9 aa, Homo Sapiens
SQQAQVEDS

SEQ ID NO: 652718 - protein, 9 aa, Homo Sapiens
ALRARLTLV

SEQ ID NO: 652719 - protein, 9 aa, Homo Sapiens
PPLPFSSCI

SEQ ID NO: 652720 - protein, 9 aa, Homo Sapiens
RSPGGGRFG

SEQ ID NO: 652721 - protein, 9 aa, Homo Sapiens
YCFTSLWWI

SEQ ID NO: 652722 - protein, 9 aa, Homo Sapiens
CIRPCMLAT

SEQ ID NO: 652723 - protein, 9 aa, Homo Sapiens
RIEIEMVGL

SEQ ID NO: 652724 - protein, 9 aa, Homo Sapiens
VAAVSTIGA

SEQ ID NO: 652725 - protein, 9 aa, Homo Sapiens
ELVGNFYSC

SEQ ID NO: 652726 - protein, 9 aa, Homo Sapiens
GWTVSPRVL

SEQ ID NO: 652727 - protein, 9 aa, Homo Sapiens
SGQDDSSDK

SEQ ID NO: 652728 - protein, 9 aa, Homo Sapiens
ASSWSRRLK

SEQ ID NO: 652729 - protein, 9 aa, Homo Sapiens
WVEVVLDGE

SEQ ID NO: 652730 - protein, 9 aa, Homo Sapiens
SDAWTYTCL

SEQ ID NO: 652731 - protein, 9 aa, Homo Sapiens
PGSLCIRDA

SEQ ID NO: 652732 - protein, 9 aa, Homo Sapiens
EWCAEDDAR

SEQ ID NO: 652733 - protein, 9 aa, Homo Sapiens
SEDNFENSS

SEQ ID NO: 652734 - protein, 9 aa, Homo Sapiens
FTLDQYCEQ

SEQ ID NO: 652735 - protein, 9 aa, Homo Sapiens
WERLKRREM

SEQ ID NO: 652736 - protein, 9 aa, Homo Sapiens
QAVDLLHIP

SEQ ID NO: 652737 - protein, 9 aa, Homo Sapiens
SREKSELRR

SEQ ID NO: 652738 - protein, 9 aa, Homo Sapiens
TNVLNVSIP

SEQ ID NO: 652739 - protein, 9 aa, Homo Sapiens
ADLRKDSKN

SEQ ID NO: 652740 - protein, 9 aa, Homo Sapiens
PHQAEPISD

SEQ ID NO: 652741 - protein, 9 aa, Homo Sapiens
VSPEGQLVL

SEQ ID NO: 652742 - protein, 9 aa, Homo Sapiens
RAIKITVNG

SEQ ID NO: 652743 - protein, 9 aa, Homo Sapiens
HGPPWAPSN

SEQ ID NO: 652744 - protein, 9 aa, Homo Sapiens
TRKSYTYWW

SEQ ID NO: 652745 - protein, 9 aa, Homo Sapiens
VTVFIDDIE

SEQ ID NO: 652746 - protein, 9 aa, Homo Sapiens
ALTLLWTEL

SEQ ID NO: 652747 - protein, 9 aa, Homo Sapiens
SLHSTLLNP

SEQ ID NO: 652748 - protein, 9 aa, Homo Sapiens
TAFSPSLPD

SEQ ID NO: 652749 - protein, 9 aa, Homo Sapiens
TLFQSKSNE

SEQ ID NO: 652750 - protein, 9 aa, Homo Sapiens
FKSKKNLEV

SEQ ID NO: 652751 - protein, 9 aa, Homo Sapiens
IVDMPTYNP

SEQ ID NO: 652752 - protein, 9 aa, Homo Sapiens
IKHTNLDPV

SEQ ID NO: 652753 - protein, 9 aa, Homo Sapiens
TVSQYSAWY

SEQ ID NO: 652754 - protein, 9 aa, Homo Sapiens
VKGALLKVL

SEQ ID NO: 652755 - protein, 9 aa, Homo Sapiens
YICEFCALS

SEQ ID NO: 652756 - protein, 9 aa, Homo Sapiens
GHPHKGNGL

SEQ ID NO: 652757 - protein, 9 aa, Homo Sapiens
DEKDHRFSK

SEQ ID NO: 652758 - protein, 9 aa, Homo Sapiens
LLTTVSAFA

SEQ ID NO: 652759 - protein, 9 aa, Homo Sapiens
EVQPRVVPN

SEQ ID NO: 652760 - protein, 9 aa, Homo Sapiens
DLKATDISI

SEQ ID NO: 652761 - protein, 9 aa, Homo Sapiens
FPPCTSSPV

SEQ ID NO: 652762 - protein, 9 aa, Homo Sapiens
TFDLQTIGF

SEQ ID NO: 652763 - protein, 9 aa, Homo Sapiens
VFIDDIEVQ

SEQ ID NO: 652764 - protein, 9 aa, Homo Sapiens
GAQKQFNNF

SEQ ID NO: 652765 - protein, 9 aa, Homo Sapiens
SLRCCRIRL

SEQ ID NO: 652766 - protein, 9 aa, Homo Sapiens
VGRMDESLG

SEQ ID NO: 652767 - protein, 9 aa, Homo Sapiens
DKQQAELVD

SEQ ID NO: 652768 - protein, 9 aa, Homo Sapiens
ELLEGTVRL

SEQ ID NO: 652769 - protein, 9 aa, Homo Sapiens
GSPGSLCIR

SEQ ID NO: 652770 - protein, 9 aa, Homo Sapiens
SSEKKTGHQ

SEQ ID NO: 652771 - protein, 9 aa, Homo Sapiens
VFKATGFII

SEQ ID NO: 652772 - protein, 9 aa, Homo Sapiens
ACVVVVKIP

SEQ ID NO: 652773 - protein, 9 aa, Homo Sapiens
QDKKGIPPD

SEQ ID NO: 652774 - protein, 9 aa, Homo Sapiens
TLNNKFAFF

SEQ ID NO: 652775 - protein, 9 aa, Homo Sapiens
QLVEGESYS

SEQ ID NO: 652776 - protein, 9 aa, Homo Sapiens
PGPLKAEPA

SEQ ID NO: 652777 - protein, 9 aa, Homo Sapiens
ALVTLLSHD

SEQ ID NO: 652778 - protein, 9 aa, Homo Sapiens
LDGASWRVS

SEQ ID NO: 652779 - protein, 9 aa, Homo Sapiens
VLSSLHSTL

SEQ ID NO: 652780 - protein, 9 aa, Homo Sapiens
QAPCKGSGS

SEQ ID NO: 652781 - protein, 9 aa, Homo Sapiens
TDITSIICM

SEQ ID NO: 652782 - protein, 9 aa, Homo Sapiens
RTTMQVGFI

SEQ ID NO: 652783 - protein, 9 aa, Homo Sapiens
VRKCIHEEV

SEQ ID NO: 652784 - protein, 9 aa, Homo Sapiens
LGPRLAGLA

SEQ ID NO: 652785 - protein, 9 aa, Homo Sapiens
SYAFLLDLF

SEQ ID NO: 652786 - protein, 9 aa, Homo Sapiens
IAGVDKHGR

SEQ ID NO: 652787 - protein, 9 aa, Homo Sapiens
HIEYFRKDP

SEQ ID NO: 652788 - protein, 9 aa, Homo Sapiens
VKCPGAPAA

SEQ ID NO: 652789 - protein, 9 aa, Homo Sapiens
FPLGTHGDL

SEQ ID NO: 652790 - protein, 9 aa, Homo Sapiens
WWCCYSGWY

SEQ ID NO: 652791 - protein, 9 aa, Homo Sapiens
SPDYTLAMR

SEQ ID NO: 652792 - protein, 9 aa, Homo Sapiens
YEALRGSPL

SEQ ID NO: 652793 - protein, 9 aa, Homo Sapiens
REKSELRRT

SEQ ID NO: 652794 - protein, 9 aa, Homo Sapiens
DVCYSTPSM

SEQ ID NO: 652795 - protein, 9 aa, Homo Sapiens
REDTLADLT

SEQ ID NO: 652796 - protein, 9 aa, Homo Sapiens
KLLQNWTEE

SEQ ID NO: 652797 - protein, 9 aa, Homo Sapiens
SESRKEPEQ

SEQ ID NO: 652798 - protein, 9 aa, Homo Sapiens
VGGGARSNL

SEQ ID NO: 652799 - protein, 9 aa, Homo Sapiens
QLNVYDVQL

SEQ ID NO: 652800 - protein, 9 aa, Homo Sapiens
NWREHRSGE

SEQ ID NO: 652801 - protein, 9 aa, Homo Sapiens
NPRGRIEWN

SEQ ID NO: 652802 - protein, 9 aa, Homo Sapiens
NFTLDQYCE

SEQ ID NO: 652803 - protein, 9 aa, Homo Sapiens
GVKDCDGSD

SEQ ID NO: 652804 - protein, 9 aa, Homo Sapiens
DSGSEAEGS

SEQ ID NO: 652805 - protein, 9 aa, Homo Sapiens
LTISKLVYN

SEQ ID NO: 652806 - protein, 9 aa, Homo Sapiens
MSASGVFQT

SEQ ID NO: 652807 - protein, 9 aa, Homo Sapiens
SCSPVFELM

SEQ ID NO: 652808 - protein, 9 aa, Homo Sapiens
DVVEGLRGE

SEQ ID NO: 652809 - protein, 9 aa, Homo Sapiens
VKAKIQDKK

SEQ ID NO: 652810 - protein, 9 aa, Homo Sapiens
YGHSLALYE

SEQ ID NO: 652811 - protein, 9 aa, Homo Sapiens
LSCSQARCL

SEQ ID NO: 652812 - protein, 9 aa, Homo Sapiens
GYVVAFKPF

SEQ ID NO: 652813 - protein, 9 aa, Homo Sapiens
QGLIESAAK

SEQ ID NO: 652814 - protein, 9 aa, Homo Sapiens
HKVLRGSVY

SEQ ID NO: 652815 - protein, 9 aa, Homo Sapiens
INCVHLYYC

SEQ ID NO: 652816 - protein, 9 aa, Homo Sapiens
TFLKIMLPS

SEQ ID NO: 652817 - protein, 9 aa, Homo Sapiens
LRCTNFDPL

SEQ ID NO: 652818 - protein, 9 aa, Homo Sapiens
AVAASQDMQ

SEQ ID NO: 652819 - protein, 9 aa, Homo Sapiens
DNRNPGGLQ

SEQ ID NO: 652820 - protein, 9 aa, Homo Sapiens
AKKCQAIAS

SEQ ID NO: 652821 - protein, 9 aa, Homo Sapiens
LVTNVICAI

SEQ ID NO: 652822 - protein, 9 aa, Homo Sapiens
MQVGFIVGQ

SEQ ID NO: 652823 - protein, 9 aa, Homo Sapiens
LTCSDKQQA

SEQ ID NO: 652824 - protein, 9 aa, Homo Sapiens
TNDFLLQQT

SEQ ID NO: 652825 - protein, 9 aa, Homo Sapiens
KSGLDTSQC

SEQ ID NO: 652826 - protein, 9 aa, Homo Sapiens
HRVLVEGIV

SEQ ID NO: 652827 - protein, 9 aa, Homo Sapiens
GELYVHCEP

SEQ ID NO: 652828 - protein, 9 aa, Homo Sapiens
LELQSLLFV

SEQ ID NO: 652829 - protein, 9 aa, Homo Sapiens
LIIASLSTI

SEQ ID NO: 652830 - protein, 9 aa, Homo Sapiens
LDWWQEWPM

SEQ ID NO: 652831 - protein, 9 aa, Homo Sapiens
LIKEAQWDG

SEQ ID NO: 652832 - protein, 9 aa, Homo Sapiens
HEKFYCLLN

SEQ ID NO: 652833 - protein, 9 aa, Homo Sapiens
VGNFYSCIG

SEQ ID NO: 652834 - protein, 9 aa, Homo Sapiens
PPVIKVESM

SEQ ID NO: 652835 - protein, 9 aa, Homo Sapiens
EVQWQLAQL

SEQ ID NO: 652836 - protein, 9 aa, Homo Sapiens
RDQLYDGAT

SEQ ID NO: 652837 - protein, 9 aa, Homo Sapiens
NPQPQAPCK

SEQ ID NO: 652838 - protein, 9 aa, Homo Sapiens
ERSPGGGRF

SEQ ID NO: 652839 - protein, 9 aa, Homo Sapiens
AQQPAIHPV

SEQ ID NO: 652840 - protein, 9 aa, Homo Sapiens
NNKFAFFID

SEQ ID NO: 652841 - protein, 9 aa, Homo Sapiens
LGNGLVIRV

SEQ ID NO: 652842 - protein, 9 aa, Homo Sapiens
TPMYVLLLT

SEQ ID NO: 652843 - protein, 9 aa, Homo Sapiens
HGWALTMLS

SEQ ID NO: 652844 - protein, 9 aa, Homo Sapiens
KNRAETLVF

SEQ ID NO: 652845 - protein, 9 aa, Homo Sapiens
VLYGIDSMP

SEQ ID NO: 652846 - protein, 9 aa, Homo Sapiens
NKCLDFNNC

SEQ ID NO: 652847 - protein, 9 aa, Homo Sapiens
VFLLDENLL

SEQ ID NO: 652848 - protein, 9 aa, Homo Sapiens
VCDGCFLNW

SEQ ID NO: 652849 - protein, 9 aa, Homo Sapiens
NKRKKLSTW

SEQ ID NO: 652850 - protein, 9 aa, Homo Sapiens
NNFQIEVQK

SEQ ID NO: 652851 - protein, 9 aa, Homo Sapiens
LDKLQNKID

SEQ ID NO: 652852 - protein, 9 aa, Homo Sapiens
LQVLGLQLA

SEQ ID NO: 652853 - protein, 9 aa, Homo Sapiens
CTMAFMFES

SEQ ID NO: 652854 - protein, 9 aa, Homo Sapiens
HISWEVYGR

SEQ ID NO: 652855 - protein, 9 aa, Homo Sapiens
LGAHVSGFV

SEQ ID NO: 652856 - protein, 9 aa, Homo Sapiens
YLFPIVYIL

SEQ ID NO: 652857 - protein, 9 aa, Homo Sapiens
GTSSSRAVV

SEQ ID NO: 652858 - protein, 9 aa, Homo Sapiens
WGIVNVAFS

SEQ ID NO: 652859 - protein, 9 aa, Homo Sapiens
GRPLSAESD

SEQ ID NO: 652860 - protein, 9 aa, Homo Sapiens
FMETLKNIM

SEQ ID NO: 652861 - protein, 9 aa, Homo Sapiens
GTTMDSRVQ

SEQ ID NO: 652862 - protein, 9 aa, Homo Sapiens
GGMLLALLR

SEQ ID NO: 652863 - protein, 9 aa, Homo Sapiens
SKACNTKRL

SEQ ID NO: 652864 - protein, 9 aa, Homo Sapiens
DKKIEIREM

SEQ ID NO: 652865 - protein, 9 aa, Homo Sapiens
QECGLAVDF

SEQ ID NO: 652866 - protein, 9 aa, Homo Sapiens
TNVFSYIFQ

SEQ ID NO: 652867 - protein, 9 aa, Homo Sapiens
VMFGHCPLY

SEQ ID NO: 652868 - protein, 9 aa, Homo Sapiens
NDLLDLVAS

SEQ ID NO: 652869 - protein, 9 aa, Homo Sapiens
FFKSNDLYQ

SEQ ID NO: 652870 - protein, 9 aa, Homo Sapiens
QSLSHESLE

SEQ ID NO: 652871 - protein, 9 aa, Homo Sapiens
LCQLLLQHL

SEQ ID NO: 652872 - protein, 9 aa, Homo Sapiens
QMYFFMAFR

SEQ ID NO: 652873 - protein, 9 aa, Homo Sapiens
QQVADYYGK

SEQ ID NO: 652874 - protein, 9 aa, Homo Sapiens
VHMVNGTIT

SEQ ID NO: 652875 - protein, 9 aa, Homo Sapiens
VFNPQTEEE

SEQ ID NO: 652876 - protein, 9 aa, Homo Sapiens
TGELYVHCE

SEQ ID NO: 652877 - protein, 9 aa, Homo Sapiens
WTYTCLATN

SEQ ID NO: 652878 - protein, 9 aa, Homo Sapiens
LDLSGSTET

SEQ ID NO: 652879 - protein, 9 aa, Homo Sapiens
SQATHQLVE

SEQ ID NO: 652880 - protein, 9 aa, Homo Sapiens
HRTQGFPLG

SEQ ID NO: 652881 - protein, 9 aa, Homo Sapiens
SNSSLGELH

SEQ ID NO: 652882 - protein, 9 aa, Homo Sapiens
CSPVFELME

SEQ ID NO: 652883 - protein, 9 aa, Homo Sapiens
IKKVDTVVI

SEQ ID NO: 652884 - protein, 9 aa, Homo Sapiens
KALCQLQNL

SEQ ID NO: 652885 - protein, 9 aa, Homo Sapiens
RETWRCPSP

SEQ ID NO: 652886 - protein, 9 aa, Homo Sapiens
YIYRIPCLD

SEQ ID NO: 652887 - protein, 9 aa, Homo Sapiens
FQQIYEKRM

SEQ ID NO: 652888 - protein, 9 aa, Homo Sapiens
LGRLLLRAS

SEQ ID NO: 652889 - protein, 9 aa, Homo Sapiens
DSLSMTSKA

SEQ ID NO: 652890 - protein, 9 aa, Homo Sapiens
FCPRLAWHT

SEQ ID NO: 652891 - protein, 9 aa, Homo Sapiens
CSDKQQAEL

SEQ ID NO: 652892 - protein, 9 aa, Homo Sapiens
RRSCGSGTT

SEQ ID NO: 652893 - protein, 9 aa, Homo Sapiens
IQALQELVA

SEQ ID NO: 652894 - protein, 9 aa, Homo Sapiens
HLAHNKALW

SEQ ID NO: 652895 - protein, 9 aa, Homo Sapiens
LQSTLFRSS

SEQ ID NO: 652896 - protein, 9 aa, Homo Sapiens
GYDTCYYWE

SEQ ID NO: 652897 - protein, 9 aa, Homo Sapiens
KGISCKVDN

SEQ ID NO: 652898 - protein, 9 aa, Homo Sapiens
CGLVFNLQD

SEQ ID NO: 652899 - protein, 9 aa, Homo Sapiens
LRGSVYRRS

SEQ ID NO: 652900 - protein, 9 aa, Homo Sapiens
AREWVGLVK

SEQ ID NO: 652901 - protein, 9 aa, Homo Sapiens
YIFQPAKNS

SEQ ID NO: 652902 - protein, 9 aa, Homo Sapiens
NWKYKNFAT

SEQ ID NO: 652903 - protein, 9 aa, Homo Sapiens
PNDDLLFSD

SEQ ID NO: 652904 - protein, 9 aa, Homo Sapiens
KIVYSKYFG

SEQ ID NO: 652905 - protein, 9 aa, Homo Sapiens
VPCSKFFQV

SEQ ID NO: 652906 - protein, 9 aa, Homo Sapiens
IITGYHISW

SEQ ID NO: 652907 - protein, 9 aa, Homo Sapiens
PESFAVSDN

SEQ ID NO: 652908 - protein, 9 aa, Homo Sapiens
PQAFKNLKK

SEQ ID NO: 652909 - protein, 9 aa, Homo Sapiens
AAFPSSCGK

SEQ ID NO: 652910 - protein, 9 aa, Homo Sapiens
VENGLLAPV

SEQ ID NO: 652911 - protein, 9 aa, Homo Sapiens
RFPTKQDSQ

SEQ ID NO: 652912 - protein, 9 aa, Homo Sapiens
SIPTPIVTW

SEQ ID NO: 652913 - protein, 9 aa, Homo Sapiens
QTLAAVPAQ

SEQ ID NO: 652914 - protein, 9 aa, Homo Sapiens
IPAGARVAG

SEQ ID NO: 652915 - protein, 9 aa, Homo Sapiens
NIMATTYIS

SEQ ID NO: 652916 - protein, 9 aa, Homo Sapiens
DYEVTSAYR

SEQ ID NO: 652917 - protein, 9 aa, Homo Sapiens
RRLQGSIWG

SEQ ID NO: 652918 - protein, 9 aa, Homo Sapiens
LCDPTFILG

SEQ ID NO: 652919 - protein, 9 aa, Homo Sapiens
LEDALHSFF

SEQ ID NO: 652920 - protein, 9 aa, Homo Sapiens
VLCNLFGVM

SEQ ID NO: 652921 - protein, 9 aa, Homo Sapiens
DPNTSIEIL

SEQ ID NO: 652922 - protein, 9 aa, Homo Sapiens
LRQPPAKLS

SEQ ID NO: 652923 - protein, 9 aa, Homo Sapiens
VLNVSIPKT

SEQ ID NO: 652924 - protein, 9 aa, Homo Sapiens
CWEPTSWQT

SEQ ID NO: 652925 - protein, 9 aa, Homo Sapiens
DSGIHCGAT

SEQ ID NO: 652926 - protein, 9 aa, Homo Sapiens
SWEKGSVNN

SEQ ID NO: 652927 - protein, 9 aa, Homo Sapiens
LVDIELSSV

SEQ ID NO: 652928 - protein, 9 aa, Homo Sapiens
PRNRGYLSI

SEQ ID NO: 652929 - protein, 9 aa, Homo Sapiens
ARVAGFSTY

SEQ ID NO: 652930 - protein, 9 aa, Homo Sapiens
QRPESGKEA

SEQ ID NO: 652931 - protein, 9 aa, Homo Sapiens
TVEEGDTAL

SEQ ID NO: 652932 - protein, 9 aa, Homo Sapiens
NGNIQMNSK

SEQ ID NO: 652933 - protein, 9 aa, Homo Sapiens
NKDELVGNF

SEQ ID NO: 652934 - protein, 9 aa, Homo Sapiens
DCLELQSLL

SEQ ID NO: 652935 - protein, 9 aa, Homo Sapiens
MQPSPSSSS

SEQ ID NO: 652936 - protein, 9 aa, Homo Sapiens
PVTLEPTED

SEQ ID NO: 652937 - protein, 9 aa, Homo Sapiens
YLGQPHSRS

SEQ ID NO: 652938 - protein, 9 aa, Homo Sapiens
QCILGNIEE

SEQ ID NO: 652939 - protein, 9 aa, Homo Sapiens
TNPLNEDLH

SEQ ID NO: 652940 - protein, 9 aa, Homo Sapiens
MLSNIISEK

SEQ ID NO: 652941 - protein, 9 aa, Homo Sapiens
VSALKDPLQ

SEQ ID NO: 652942 - protein, 9 aa, Homo Sapiens
LFLNSQTLL

SEQ ID NO: 652943 - protein, 9 aa, Homo Sapiens
KEGSSRCEW

SEQ ID NO: 652944 - protein, 9 aa, Homo Sapiens
QSLGASLLQ

SEQ ID NO: 652945 - protein, 9 aa, Homo Sapiens
MNIVHKKKE

SEQ ID NO: 652946 - protein, 9 aa, Homo Sapiens
SLEWVTMSK

SEQ ID NO: 652947 - protein, 9 aa, Homo Sapiens
RLTLVSRAS

SEQ ID NO: 652948 - protein, 9 aa, Homo Sapiens
LQLAESVDL

SEQ ID NO: 652949 - protein, 9 aa, Homo Sapiens
ASTVEEGDT

SEQ ID NO: 652950 - protein, 9 aa, Homo Sapiens
FTCCKCRKK

SEQ ID NO: 652951 - protein, 9 aa, Homo Sapiens
IRESLFAKH

SEQ ID NO: 652952 - protein, 9 aa, Homo Sapiens
NFKLRSMGW

SEQ ID NO: 652953 - protein, 9 aa, Homo Sapiens
CAVKPQEVH

SEQ ID NO: 652954 - protein, 9 aa, Homo Sapiens
EKIQSEDYH

SEQ ID NO: 652955 - protein, 9 aa, Homo Sapiens
DETCHRSKN

SEQ ID NO: 652956 - protein, 9 aa, Homo Sapiens
RQLPELPNT

SEQ ID NO: 652957 - protein, 9 aa, Homo Sapiens
GIMRFINMP

SEQ ID NO: 652958 - protein, 9 aa, Homo Sapiens
GSPAAASGW

SEQ ID NO: 652959 - protein, 9 aa, Homo Sapiens
TYEAAHNLL

SEQ ID NO: 652960 - protein, 9 aa, Homo Sapiens
FKKFYLIST

SEQ ID NO: 652961 - protein, 9 aa, Homo Sapiens
TIPSWEKGS

SEQ ID NO: 652962 - protein, 9 aa, Homo Sapiens
TTPPGYPGQ

SEQ ID NO: 652963 - protein, 9 aa, Homo Sapiens
TFCRLDQDI

SEQ ID NO: 652964 - protein, 9 aa, Homo Sapiens
LRNLNIIIT

SEQ ID NO: 652965 - protein, 9 aa, Homo Sapiens
KIDSTVSQY

SEQ ID NO: 652966 - protein, 9 aa, Homo Sapiens
DPTLEFDKK

SEQ ID NO: 652967 - protein, 9 aa, Homo Sapiens
FFIDKVRFL

SEQ ID NO: 652968 - protein, 9 aa, Homo Sapiens
IITHAYNQP

SEQ ID NO: 652969 - protein, 9 aa, Homo Sapiens
MELHVQEYE

SEQ ID NO: 652970 - protein, 9 aa, Homo Sapiens
CAVLGLTVL

SEQ ID NO: 652971 - protein, 9 aa, Homo Sapiens
WQALGPWNS

SEQ ID NO: 652972 - protein, 9 aa, Homo Sapiens
VTSAYRLTI

SEQ ID NO: 652973 - protein, 9 aa, Homo Sapiens
EGSSRCEWE

SEQ ID NO: 652974 - protein, 9 aa, Homo Sapiens
TGVSGEISY

SEQ ID NO: 652975 - protein, 9 aa, Homo Sapiens
LEGFSKFEK

SEQ ID NO: 652976 - protein, 9 aa, Homo Sapiens
SLSTITNWE

SEQ ID NO: 652977 - protein, 9 aa, Homo Sapiens
EPTSWQTSY

SEQ ID NO: 652978 - protein, 9 aa, Homo Sapiens
ERIADCTMA

SEQ ID NO: 652979 - protein, 9 aa, Homo Sapiens
SDETCHRSK

SEQ ID NO: 652980 - protein, 9 aa, Homo Sapiens
NFLASYLMM

SEQ ID NO: 652981 - protein, 9 aa, Homo Sapiens
EGDTALLPE

SEQ ID NO: 652982 - protein, 9 aa, Homo Sapiens
TSIEILNPN

SEQ ID NO: 652983 - protein, 9 aa, Homo Sapiens
NGLLAPVSA

SEQ ID NO: 652984 - protein, 9 aa, Homo Sapiens
LPFSSCIRP

SEQ ID NO: 652985 - protein, 9 aa, Homo Sapiens
RCRGLVEVL

SEQ ID NO: 652986 - protein, 9 aa, Homo Sapiens
NSFVNNIFE

SEQ ID NO: 652987 - protein, 9 aa, Homo Sapiens
VEKLQEPLF

SEQ ID NO: 652988 - protein, 9 aa, Homo Sapiens
ERIKCSRDF

SEQ ID NO: 652989 - protein, 9 aa, Homo Sapiens
LPEQCMQDL

SEQ ID NO: 652990 - protein, 9 aa, Homo Sapiens
KCIHEEVVQ

SEQ ID NO: 652991 - protein, 9 aa, Homo Sapiens
AEQTISLAS

SEQ ID NO: 652992 - protein, 9 aa, Homo Sapiens
RVASLQKEL

SEQ ID NO: 652993 - protein, 9 aa, Homo Sapiens
VVFLAIYLI

SEQ ID NO: 652994 - protein, 9 aa, Homo Sapiens
RKSYTYWWT

SEQ ID NO: 652995 - protein, 9 aa, Homo Sapiens
IYYEMEPLT

SEQ ID NO: 652996 - protein, 9 aa, Homo Sapiens
RTNSSPLFL

SEQ ID NO: 652997 - protein, 9 aa, Homo Sapiens
TLLHEKFYC

SEQ ID NO: 652998 - protein, 9 aa, Homo Sapiens
VASVWLISK

SEQ ID NO: 652999 - protein, 9 aa, Homo Sapiens
ASLRLREVS

SEQ ID NO: 653000 - protein, 9 aa, Homo Sapiens
GCFLNWREH

SEQ ID NO: 653001 - protein, 9 aa, Homo Sapiens
FSLTKSSVR

SEQ ID NO: 653002 - protein, 9 aa, Homo Sapiens
IGGNIIVIM

SEQ ID NO: 653003 - protein, 9 aa, Homo Sapiens
TTPPGHGTP

SEQ ID NO: 653004 - protein, 9 aa, Homo Sapiens
FAAENKQML

SEQ ID NO: 653005 - protein, 9 aa, Homo Sapiens
TSCSPVFEL

SEQ ID NO: 653006 - protein, 9 aa, Homo Sapiens
GAMGIPETQ

SEQ ID NO: 653007 - protein, 9 aa, Homo Sapiens
QVDLVVQDL

SEQ ID NO: 653008 - protein, 9 aa, Homo Sapiens
QICQRKSAT

SEQ ID NO: 653009 - protein, 9 aa, Homo Sapiens
ENLNTEKFS

SEQ ID NO: 653010 - protein, 9 aa, Homo Sapiens
GAAPHGPPW

SEQ ID NO: 653011 - protein, 9 aa, Homo Sapiens
GVSGEISYS

SEQ ID NO: 653012 - protein, 9 aa, Homo Sapiens
QAKKCQAIA

SEQ ID NO: 653013 - protein, 9 aa, Homo Sapiens
ELRKTNASL

SEQ ID NO: 653014 - protein, 9 aa, Homo Sapiens
LDPVSPEGQ

SEQ ID NO: 653015 - protein, 9 aa, Homo Sapiens
IVYILVIIV

SEQ ID NO: 653016 - protein, 9 aa, Homo Sapiens
SEVSVTFKS

SEQ ID NO: 653017 - protein, 9 aa, Homo Sapiens
APAGGEKSW

SEQ ID NO: 653018 - protein, 9 aa, Homo Sapiens
EGPAGVLYG

SEQ ID NO: 653019 - protein, 9 aa, Homo Sapiens
NLCDISVDR

SEQ ID NO: 653020 - protein, 9 aa, Homo Sapiens
WTPLALVTL

SEQ ID NO: 653021 - protein, 9 aa, Homo Sapiens
GVQVSSPNE

SEQ ID NO: 653022 - protein, 9 aa, Homo Sapiens
QILSSPNFT

SEQ ID NO: 653023 - protein, 9 aa, Homo Sapiens
AAREWVGLV

SEQ ID NO: 653024 - protein, 9 aa, Homo Sapiens
ISRKHAERQ

SEQ ID NO: 653025 - protein, 9 aa, Homo Sapiens
NTNTELCQY

SEQ ID NO: 653026 - protein, 9 aa, Homo Sapiens
GQTLAAVPA

SEQ ID NO: 653027 - protein, 9 aa, Homo Sapiens
QVSSPNENV

SEQ ID NO: 653028 - protein, 9 aa, Homo Sapiens
AELLRYSDS

SEQ ID NO: 653029 - protein, 9 aa, Homo Sapiens
CAYMEVAIS

SEQ ID NO: 653030 - protein, 9 aa, Homo Sapiens
FCNCNDLEP

SEQ ID NO: 653031 - protein, 9 aa, Homo Sapiens
RKADMWSVA

SEQ ID NO: 653032 - protein, 9 aa, Homo Sapiens
STPLAANRE

SEQ ID NO: 653033 - protein, 9 aa, Homo Sapiens
VSFDAWQAL

SEQ ID NO: 653034 - protein, 9 aa, Homo Sapiens
PWGALVSFD

SEQ ID NO: 653035 - protein, 9 aa, Homo Sapiens
MVDSAPQLE

SEQ ID NO: 653036 - protein, 9 aa, Homo Sapiens
AFQNIEDEI

SEQ ID NO: 653037 - protein, 9 aa, Homo Sapiens
LLLTLAVVD

SEQ ID NO: 653038 - protein, 9 aa, Homo Sapiens
MPVENGLLA

SEQ ID NO: 653039 - protein, 9 aa, Homo Sapiens
MSENDFKHK

SEQ ID NO: 653040 - protein, 9 aa, Homo Sapiens
CVSQGAHLS

SEQ ID NO: 653041 - protein, 9 aa, Homo Sapiens
KFEFLGLRL

SEQ ID NO: 653042 - protein, 9 aa, Homo Sapiens
LSAEDSFTG

SEQ ID NO: 653043 - protein, 9 aa, Homo Sapiens
PQGSKSPDN

SEQ ID NO: 653044 - protein, 9 aa, Homo Sapiens
FYRGNGKNL

SEQ ID NO: 653045 - protein, 9 aa, Homo Sapiens
AKHLGLGIG

SEQ ID NO: 653046 - protein, 9 aa, Homo Sapiens
QLVAQIKEG

SEQ ID NO: 653047 - protein, 9 aa, Homo Sapiens
RPESGKEAV

SEQ ID NO: 653048 - protein, 9 aa, Homo Sapiens
PGLSWHASV

SEQ ID NO: 653049 - protein, 9 aa, Homo Sapiens
RVAGFRMTR

SEQ ID NO: 653050 - protein, 9 aa, Homo Sapiens
ILFVVFLAI

SEQ ID NO: 653051 - protein, 9 aa, Homo Sapiens
GQWVHHTAG

SEQ ID NO: 653052 - protein, 9 aa, Homo Sapiens
ISIDTSSLG

SEQ ID NO: 653053 - protein, 9 aa, Homo Sapiens
PCKGSGSLA

SEQ ID NO: 653054 - protein, 9 aa, Homo Sapiens
KKVSARLLK

SEQ ID NO: 653055 - protein, 9 aa, Homo Sapiens
YLYNFTCTG

SEQ ID NO: 653056 - protein, 9 aa, Homo Sapiens
ISGTEDEMY

SEQ ID NO: 653057 - protein, 9 aa, Homo Sapiens
QQYIAQFTS

SEQ ID NO: 653058 - protein, 9 aa, Homo Sapiens
YDRWALGEE

SEQ ID NO: 653059 - protein, 9 aa, Homo Sapiens
CCPKPHVRV

SEQ ID NO: 653060 - protein, 9 aa, Homo Sapiens
DVDTGVSGE

SEQ ID NO: 653061 - protein, 9 aa, Homo Sapiens
ARIPAGARV

SEQ ID NO: 653062 - protein, 9 aa, Homo Sapiens
EAFDKARNE

SEQ ID NO: 653063 - protein, 9 aa, Homo Sapiens
GIMSKTCTY

SEQ ID NO: 653064 - protein, 9 aa, Homo Sapiens
DKILEPPKG

SEQ ID NO: 653065 - protein, 9 aa, Homo Sapiens
GIFPILEEE

SEQ ID NO: 653066 - protein, 9 aa, Homo Sapiens
SHMGSIRED

SEQ ID NO: 653067 - protein, 9 aa, Homo Sapiens
GWMYCTDWE

SEQ ID NO: 653068 - protein, 9 aa, Homo Sapiens
IIKDLTEED

SEQ ID NO: 653069 - protein, 9 aa, Homo Sapiens
TQKKNKDLQ

SEQ ID NO: 653070 - protein, 9 aa, Homo Sapiens
IFLVAFMGY

SEQ ID NO: 653071 - protein, 9 aa, Homo Sapiens
YQTFLLHLL

SEQ ID NO: 653072 - protein, 9 aa, Homo Sapiens
RPWLSLFPR

SEQ ID NO: 653073 - protein, 9 aa, Homo Sapiens
KNFSLTKSS

SEQ ID NO: 653074 - protein, 9 aa, Homo Sapiens
QWRKMFDDE

SEQ ID NO: 653075 - protein, 9 aa, Homo Sapiens
MGDKGQKGI

SEQ ID NO: 653076 - protein, 9 aa, Homo Sapiens
LQDGRKHAR

SEQ ID NO: 653077 - protein, 9 aa, Homo Sapiens
LPQGAPGQG

SEQ ID NO: 653078 - protein, 9 aa, Homo Sapiens
SCRSPRRRL

SEQ ID NO: 653079 - protein, 9 aa, Homo Sapiens
LGHHRVLVE

SEQ ID NO: 653080 - protein, 9 aa, Homo Sapiens
QNEIKEQLK

SEQ ID NO: 653081 - protein, 9 aa, Homo Sapiens
FYHLVATLE

SEQ ID NO: 653082 - protein, 9 aa, Homo Sapiens
VSSEGYLHL

SEQ ID NO: 653083 - protein, 9 aa, Homo Sapiens
GEERLETPQ

SEQ ID NO: 653084 - protein, 9 aa, Homo Sapiens
LDWVSSILN

SEQ ID NO: 653085 - protein, 9 aa, Homo Sapiens
ISVSVNFYE

SEQ ID NO: 653086 - protein, 9 aa, Homo Sapiens
VGVSNPQLI

SEQ ID NO: 653087 - protein, 9 aa, Homo Sapiens
KSVTDRAAL

SEQ ID NO: 653088 - protein, 9 aa, Homo Sapiens
RIAHKFTQH

SEQ ID NO: 653089 - protein, 9 aa, Homo Sapiens
HAHRTQGFP

SEQ ID NO: 653090 - protein, 9 aa, Homo Sapiens
MAPLPVFMK

SEQ ID NO: 653091 - protein, 9 aa, Homo Sapiens
IVLKLPSFS

SEQ ID NO: 653092 - protein, 9 aa, Homo Sapiens
IADRQTGKT

SEQ ID NO: 653093 - protein, 9 aa, Homo Sapiens
DMVDSAPQL

SEQ ID NO: 653094 - protein, 9 aa, Homo Sapiens
HPHKGNGLD

SEQ ID NO: 653095 - protein, 9 aa, Homo Sapiens
EQMAERKSK

SEQ ID NO: 653096 - protein, 9 aa, Homo Sapiens
ADPHQEYLD

SEQ ID NO: 653097 - protein, 9 aa, Homo Sapiens
PDKNDDDEN

SEQ ID NO: 653098 - protein, 9 aa, Homo Sapiens
LFGSDSQVT

SEQ ID NO: 653099 - protein, 9 aa, Homo Sapiens
KSAYSPSTV

SEQ ID NO: 653100 - protein, 9 aa, Homo Sapiens
TLQEVVGIW

SEQ ID NO: 653101 - protein, 9 aa, Homo Sapiens
CCMTQAGVQ

SEQ ID NO: 653102 - protein, 9 aa, Homo Sapiens
VTFKSKKNL

SEQ ID NO: 653103 - protein, 9 aa, Homo Sapiens
SPDNIWISK

SEQ ID NO: 653104 - protein, 9 aa, Homo Sapiens
KQLSMEQKN

SEQ ID NO: 653105 - protein, 9 aa, Homo Sapiens
FTKAFKRDV

SEQ ID NO: 653106 - protein, 9 aa, Homo Sapiens
PQIYYIEST

SEQ ID NO: 653107 - protein, 9 aa, Homo Sapiens
KAHLTSHIR

SEQ ID NO: 653108 - protein, 9 aa, Homo Sapiens
KGKMVAVFY

SEQ ID NO: 653109 - protein, 9 aa, Homo Sapiens
HTLKLQELP

SEQ ID NO: 653110 - protein, 9 aa, Homo Sapiens
SQVEPSVNA

SEQ ID NO: 653111 - protein, 9 aa, Homo Sapiens
NFVKPNKTK

SEQ ID NO: 653112 - protein, 9 aa, Homo Sapiens
SNVFNPQTE

SEQ ID NO: 653113 - protein, 9 aa, Homo Sapiens
LRHACCHPQ

SEQ ID NO: 653114 - protein, 9 aa, Homo Sapiens
TVFIDDIEV

SEQ ID NO: 653115 - protein, 9 aa, Homo Sapiens
EEKDKDVEE

SEQ ID NO: 653116 - protein, 9 aa, Homo Sapiens
GKHGFQCQV

SEQ ID NO: 653117 - protein, 9 aa, Homo Sapiens
KYQLVAQIK

SEQ ID NO: 653118 - protein, 9 aa, Homo Sapiens
VVQVRLVGS

SEQ ID NO: 653119 - protein, 9 aa, Homo Sapiens
LVMKDSFLY

SEQ ID NO: 653120 - protein, 9 aa, Homo Sapiens
ETFCRLDQD

SEQ ID NO: 653121 - protein, 9 aa, Homo Sapiens
SDMVCPHKC

SEQ ID NO: 653122 - protein, 9 aa, Homo Sapiens
LNVSQDLYT

SEQ ID NO: 653123 - protein, 9 aa, Homo Sapiens
TPASGSAAF

SEQ ID NO: 653124 - protein, 9 aa, Homo Sapiens
KLEELQQIL

SEQ ID NO: 653125 - protein, 9 aa, Homo Sapiens
QDIAVHGWA

SEQ ID NO: 653126 - protein, 9 aa, Homo Sapiens
IYITGVDSG

SEQ ID NO: 653127 - protein, 9 aa, Homo Sapiens
DLRFAEMKQ

SEQ ID NO: 653128 - protein, 9 aa, Homo Sapiens
NLQRAMKLQ

SEQ ID NO: 653129 - protein, 9 aa, Homo Sapiens
IGFQYGVTD

SEQ ID NO: 653130 - protein, 9 aa, Homo Sapiens
QSEVNDDQD

SEQ ID NO: 653131 - protein, 9 aa, Homo Sapiens
FSQRCGAKT

SEQ ID NO: 653132 - protein, 9 aa, Homo Sapiens
MWAHQAVLP

SEQ ID NO: 653133 - protein, 9 aa, Homo Sapiens
GIPNPSPSS

SEQ ID NO: 653134 - protein, 9 aa, Homo Sapiens
RCVVVPENK

SEQ ID NO: 653135 - protein, 9 aa, Homo Sapiens
NPSPSSPTP

SEQ ID NO: 653136 - protein, 9 aa, Homo Sapiens
MTDPRLNKP

SEQ ID NO: 653137 - protein, 9 aa, Homo Sapiens
VVRASALSS

SEQ ID NO: 653138 - protein, 9 aa, Homo Sapiens
VSLFAAENK

SEQ ID NO: 653139 - protein, 9 aa, Homo Sapiens
CTDWEEDEI

SEQ ID NO: 653140 - protein, 9 aa, Homo Sapiens
MAIHIYSGN

SEQ ID NO: 653141 - protein, 9 aa, Homo Sapiens
FGLTDDPNL

SEQ ID NO: 653142 - protein, 9 aa, Homo Sapiens
QEPPLQGED

SEQ ID NO: 653143 - protein, 9 aa, Homo Sapiens
EKCREEVRG

SEQ ID NO: 653144 - protein, 9 aa, Homo Sapiens
LNVSIPKTS

SEQ ID NO: 653145 - protein, 9 aa, Homo Sapiens
DIFMETLKN

SEQ ID NO: 653146 - protein, 9 aa, Homo Sapiens
SVNNEFGKS

SEQ ID NO: 653147 - protein, 9 aa, Homo Sapiens
GNIGVRTVQ

SEQ ID NO: 653148 - protein, 9 aa, Homo Sapiens
SANMTLKGQ

SEQ ID NO: 653149 - protein, 9 aa, Homo Sapiens
VKIMLDLSN

SEQ ID NO: 653150 - protein, 9 aa, Homo Sapiens
MNSPPGSRE

SEQ ID NO: 653151 - protein, 9 aa, Homo Sapiens
IVEFLRKLE

SEQ ID NO: 653152 - protein, 9 aa, Homo Sapiens
NKALWKSLL

SEQ ID NO: 653153 - protein, 9 aa, Homo Sapiens
STISSLDYI

SEQ ID NO: 653154 - protein, 9 aa, Homo Sapiens
QAIFSGDPQ

SEQ ID NO: 653155 - protein, 9 aa, Homo Sapiens
RKKKRKHQL

SEQ ID NO: 653156 - protein, 9 aa, Homo Sapiens
VELTRKLTY

SEQ ID NO: 653157 - protein, 9 aa, Homo Sapiens
TELCHLWLM

SEQ ID NO: 653158 - protein, 9 aa, Homo Sapiens
MLRNSIPTP

SEQ ID NO: 653159 - protein, 9 aa, Homo Sapiens
MVCAVLGLT

SEQ ID NO: 653160 - protein, 9 aa, Homo Sapiens
FLVGGDNPL

SEQ ID NO: 653161 - protein, 9 aa, Homo Sapiens
ITQVVWIAC

SEQ ID NO: 653162 - protein, 9 aa, Homo Sapiens
ACTDITSII

SEQ ID NO: 653163 - protein, 9 aa, Homo Sapiens
GVESTISSL

SEQ ID NO: 653164 - protein, 9 aa, Homo Sapiens
HMVNGTITN

SEQ ID NO: 653165 - protein, 9 aa, Homo Sapiens
DFNGPYLGQ

SEQ ID NO: 653166 - protein, 9 aa, Homo Sapiens
EVFITETAS

SEQ ID NO: 653167 - protein, 9 aa, Homo Sapiens
KHGRPLQPH

SEQ ID NO: 653168 - protein, 9 aa, Homo Sapiens
KDVEEGSEV

SEQ ID NO: 653169 - protein, 9 aa, Homo Sapiens
TTKKIGTLH

SEQ ID NO: 653170 - protein, 9 aa, Homo Sapiens
NMQPSPSSS

SEQ ID NO: 653171 - protein, 9 aa, Homo Sapiens
DFPVNKRKK

SEQ ID NO: 653172 - protein, 9 aa, Homo Sapiens
FNGPYLGQP

SEQ ID NO: 653173 - protein, 9 aa, Homo Sapiens
KIMLPSPGL

SEQ ID NO: 653174 - protein, 9 aa, Homo Sapiens
NDTYEAAHN

SEQ ID NO: 653175 - protein, 9 aa, Homo Sapiens
GNPFWKTAN

SEQ ID NO: 653176 - protein, 9 aa, Homo Sapiens
PTYNPELDL

SEQ ID NO: 653177 - protein, 9 aa, Homo Sapiens
AASAGRTRR

SEQ ID NO: 653178 - protein, 9 aa, Homo Sapiens
TASKGASSF

SEQ ID NO: 653179 - protein, 9 aa, Homo Sapiens
PKAISGVPT

SEQ ID NO: 653180 - protein, 9 aa, Homo Sapiens
CGLILNTNT

SEQ ID NO: 653181 - protein, 9 aa, Homo Sapiens
PHKGNGLDL

SEQ ID NO: 653182 - protein, 9 aa, Homo Sapiens
FAPAVYSGN

SEQ ID NO: 653183 - protein, 9 aa, Homo Sapiens
QEKKHRPSH

SEQ ID NO: 653184 - protein, 9 aa, Homo Sapiens
IHAVEKPYK

SEQ ID NO: 653185 - protein, 9 aa, Homo Sapiens
VSANMTLKG

SEQ ID NO: 653186 - protein, 9 aa, Homo Sapiens
ALIVRRRLS

SEQ ID NO: 653187 - protein, 9 aa, Homo Sapiens
TIGFAAEQL

SEQ ID NO: 653188 - protein, 9 aa, Homo Sapiens
YLMMAVDDP

SEQ ID NO: 653189 - protein, 9 aa, Homo Sapiens
VFDAGDYSF

SEQ ID NO: 653190 - protein, 9 aa, Homo Sapiens
TRAGMSYYY

SEQ ID NO: 653191 - protein, 9 aa, Homo Sapiens
RFIIFSQRC

SEQ ID NO: 653192 - protein, 9 aa, Homo Sapiens
VGRIERSVA

SEQ ID NO: 653193 - protein, 9 aa, Homo Sapiens
SYISPEKEQ

SEQ ID NO: 653194 - protein, 9 aa, Homo Sapiens
GDMNSPPGS

SEQ ID NO: 653195 - protein, 9 aa, Homo Sapiens
DVTVFIDDI

SEQ ID NO: 653196 - protein, 9 aa, Homo Sapiens
LGLLDEAQR

SEQ ID NO: 653197 - protein, 9 aa, Homo Sapiens
LSSVSALRM

SEQ ID NO: 653198 - protein, 9 aa, Homo Sapiens
YNLSLVQKK

SEQ ID NO: 653199 - protein, 9 aa, Homo Sapiens
RCTNFDPLE

SEQ ID NO: 653200 - protein, 9 aa, Homo Sapiens
FSGDPQEIR

SEQ ID NO: 653201 - protein, 9 aa, Homo Sapiens
GLECFQKSG

SEQ ID NO: 653202 - protein, 9 aa, Homo Sapiens
ETNSCTCPN

SEQ ID NO: 653203 - protein, 9 aa, Homo Sapiens
GKHVSHVVH

SEQ ID NO: 653204 - protein, 9 aa, Homo Sapiens
QYQIIFSIW

SEQ ID NO: 653205 - protein, 9 aa, Homo Sapiens
SLIHAVMPD

SEQ ID NO: 653206 - protein, 9 aa, Homo Sapiens
PLLVNAIII

SEQ ID NO: 653207 - protein, 9 aa, Homo Sapiens
QWDGLTGHI

SEQ ID NO: 653208 - protein, 9 aa, Homo Sapiens
QYRHMMDRR

SEQ ID NO: 653209 - protein, 9 aa, Homo Sapiens
GNGLDLSGL

SEQ ID NO: 653210 - protein, 9 aa, Homo Sapiens
AYCSTESQS

SEQ ID NO: 653211 - protein, 9 aa, Homo Sapiens
KTTKKIGTL

SEQ ID NO: 653212 - protein, 9 aa, Homo Sapiens
SCGKTNLAM

SEQ ID NO: 653213 - protein, 9 aa, Homo Sapiens
RNPRGRIEW

SEQ ID NO: 653214 - protein, 9 aa, Homo Sapiens
IYELATNPD

SEQ ID NO: 653215 - protein, 9 aa, Homo Sapiens
ILFGLTDDP

SEQ ID NO: 653216 - protein, 9 aa, Homo Sapiens
RSLHVCSNN

SEQ ID NO: 653217 - protein, 9 aa, Homo Sapiens
HAREPLRNI

SEQ ID NO: 653218 - protein, 9 aa, Homo Sapiens
KLGILQDAE

SEQ ID NO: 653219 - protein, 9 aa, Homo Sapiens
SLSGEPELE

SEQ ID NO: 653220 - protein, 9 aa, Homo Sapiens
KNIMEYYND

SEQ ID NO: 653221 - protein, 9 aa, Homo Sapiens
AKLDKAQIY

SEQ ID NO: 653222 - protein, 9 aa, Homo Sapiens
SLLQSFGFQ

SEQ ID NO: 653223 - protein, 9 aa, Homo Sapiens
NRKKIPQQL

SEQ ID NO: 653224 - protein, 9 aa, Homo Sapiens
IEVFQLNVY

SEQ ID NO: 653225 - protein, 9 aa, Homo Sapiens
SFFQPRELS

SEQ ID NO: 653226 - protein, 9 aa, Homo Sapiens
VTEFILFGL

SEQ ID NO: 653227 - protein, 9 aa, Homo Sapiens
KPDKNDDDE

SEQ ID NO: 653228 - protein, 9 aa, Homo Sapiens
CDRYFSQSA

SEQ ID NO: 653229 - protein, 9 aa, Homo Sapiens
KIPPQAFKN

SEQ ID NO: 653230 - protein, 9 aa, Homo Sapiens
YDVVLVGGS

SEQ ID NO: 653231 - protein, 9 aa, Homo Sapiens
IISEKKAIS

SEQ ID NO: 653232 - protein, 9 aa, Homo Sapiens
EPPKGQDEG

SEQ ID NO: 653233 - protein, 9 aa, Homo Sapiens
QTNGITRLG

SEQ ID NO: 653234 - protein, 9 aa, Homo Sapiens
HQVRARIYE

SEQ ID NO: 653235 - protein, 9 aa, Homo Sapiens
PGRSNCPCV

SEQ ID NO: 653236 - protein, 9 aa, Homo Sapiens
LHVQEYEFI

SEQ ID NO: 653237 - protein, 9 aa, Homo Sapiens
GQDDSSDKE

SEQ ID NO: 653238 - protein, 9 aa, Homo Sapiens
NILIVDEND

SEQ ID NO: 653239 - protein, 9 aa, Homo Sapiens
FPGRSNCPC

SEQ ID NO: 653240 - protein, 9 aa, Homo Sapiens
DMQQGATVT

SEQ ID NO: 653241 - protein, 9 aa, Homo Sapiens
LNQKSFYRV

SEQ ID NO: 653242 - protein, 9 aa, Homo Sapiens
TSKIPALQP

SEQ ID NO: 653243 - protein, 9 aa, Homo Sapiens
SPTVSFNLM

SEQ ID NO: 653244 - protein, 9 aa, Homo Sapiens
ILNLCDISV

SEQ ID NO: 653245 - protein, 9 aa, Homo Sapiens
KGKENNGGA

SEQ ID NO: 653246 - protein, 9 aa, Homo Sapiens
RRACVKKLL

SEQ ID NO: 653247 - protein, 9 aa, Homo Sapiens
QLICQVLRK

SEQ ID NO: 653248 - protein, 9 aa, Homo Sapiens
YQTYVHFPS

SEQ ID NO: 653249 - protein, 9 aa, Homo Sapiens
EESVEKGKM

SEQ ID NO: 653250 - protein, 9 aa, Homo Sapiens
VDFHTLKLQ

SEQ ID NO: 653251 - protein, 9 aa, Homo Sapiens
HGAIEEREM

SEQ ID NO: 653252 - protein, 9 aa, Homo Sapiens
SKDDWREFQ

SEQ ID NO: 653253 - protein, 9 aa, Homo Sapiens
NPLHYPVVM

SEQ ID NO: 653254 - protein, 9 aa, Homo Sapiens
TPATSMESL

SEQ ID NO: 653255 - protein, 9 aa, Homo Sapiens
IKCSRDFLL

SEQ ID NO: 653256 - protein, 9 aa, Homo Sapiens
YCLRCHRAI

SEQ ID NO: 653257 - protein, 9 aa, Homo Sapiens
VGLSKRLQE

SEQ ID NO: 653258 - protein, 9 aa, Homo Sapiens
ARKQHMNTK

SEQ ID NO: 653259 - protein, 9 aa, Homo Sapiens
RRRLSKLQG

SEQ ID NO: 653260 - protein, 9 aa, Homo Sapiens
LVSGIPALH

SEQ ID NO: 653261 - protein, 9 aa, Homo Sapiens
CALSFRTSS

SEQ ID NO: 653262 - protein, 9 aa, Homo Sapiens
LVAFMGYSV

SEQ ID NO: 653263 - protein, 9 aa, Homo Sapiens
HKGYTHDAG

SEQ ID NO: 653264 - protein, 9 aa, Homo Sapiens
RAALTLLWT

SEQ ID NO: 653265 - protein, 9 aa, Homo Sapiens
FFKGISRKH

SEQ ID NO: 653266 - protein, 9 aa, Homo Sapiens
ELAGETRPL

SEQ ID NO: 653267 - protein, 9 aa, Homo Sapiens
DLSPTVSFN

SEQ ID NO: 653268 - protein, 9 aa, Homo Sapiens
KAVNKCLDF

SEQ ID NO: 653269 - protein, 9 aa, Homo Sapiens
GSFSEETNS

SEQ ID NO: 653270 - protein, 9 aa, Homo Sapiens
KACNTKRLN

SEQ ID NO: 653271 - protein, 9 aa, Homo Sapiens
LEEVKPLSE

SEQ ID NO: 653272 - protein, 9 aa, Homo Sapiens
FKFLCLPPG

SEQ ID NO: 653273 - protein, 9 aa, Homo Sapiens
QPSDENSFE

SEQ ID NO: 653274 - protein, 9 aa, Homo Sapiens
ECPSFLSLR

SEQ ID NO: 653275 - protein, 9 aa, Homo Sapiens
RNHLPTQGH

SEQ ID NO: 653276 - protein, 9 aa, Homo Sapiens
PPKTDLTAF

SEQ ID NO: 653277 - protein, 9 aa, Homo Sapiens
LRCCRIRLT

SEQ ID NO: 653278 - protein, 9 aa, Homo Sapiens
QGLVKLTLG

SEQ ID NO: 653279 - protein, 9 aa, Homo Sapiens
EGERLVPIG

SEQ ID NO: 653280 - protein, 9 aa, Homo Sapiens
KAGLPCLSD

SEQ ID NO: 653281 - protein, 9 aa, Homo Sapiens
GYGRKADMW

SEQ ID NO: 653282 - protein, 9 aa, Homo Sapiens
FQPNDDLLF

SEQ ID NO: 653283 - protein, 9 aa, Homo Sapiens
RSNCPCVCA

SEQ ID NO: 653284 - protein, 9 aa, Homo Sapiens
VLLIVMSHD

SEQ ID NO: 653285 - protein, 9 aa, Homo Sapiens
NNQGSYPCQ

SEQ ID NO: 653286 - protein, 9 aa, Homo Sapiens
VLQDGRKHA

SEQ ID NO: 653287 - protein, 9 aa, Homo Sapiens
KLVYNPSAS

SEQ ID NO: 653288 - protein, 9 aa, Homo Sapiens
DRRYRTRIH

SEQ ID NO: 653289 - protein, 9 aa, Homo Sapiens
SVIQDFWRR

SEQ ID NO: 653290 - protein, 9 aa, Homo Sapiens
PQYCVAGTA

SEQ ID NO: 653291 - protein, 9 aa, Homo Sapiens
PIVYILVII

SEQ ID NO: 653292 - protein, 9 aa, Homo Sapiens
LQLICQVLR

SEQ ID NO: 653293 - protein, 9 aa, Homo Sapiens
VSLEWVTMS

SEQ ID NO: 653294 - protein, 9 aa, Homo Sapiens
LCQGEQLLN

SEQ ID NO: 653295 - protein, 9 aa, Homo Sapiens
RVRNPRGRI

SEQ ID NO: 653296 - protein, 9 aa, Homo Sapiens
VRVTKEVHA

SEQ ID NO: 653297 - protein, 9 aa, Homo Sapiens
TSMWAHQAV

SEQ ID NO: 653298 - protein, 9 aa, Homo Sapiens
VSIPKTSTE

SEQ ID NO: 653299 - protein, 9 aa, Homo Sapiens
EVLNAIEEE

SEQ ID NO: 653300 - protein, 9 aa, Homo Sapiens
DINATRSEE

SEQ ID NO: 653301 - protein, 9 aa, Homo Sapiens
EWVGLVKHY

SEQ ID NO: 653302 - protein, 9 aa, Homo Sapiens
KDKDVEEGS

SEQ ID NO: 653303 - protein, 9 aa, Homo Sapiens
QNMSLLQSF

SEQ ID NO: 653304 - protein, 9 aa, Homo Sapiens
QRKSATAAE

SEQ ID NO: 653305 - protein, 9 aa, Homo Sapiens
FNQSCSLTK

SEQ ID NO: 653306 - protein, 9 aa, Homo Sapiens
RREWERLKR

SEQ ID NO: 653307 - protein, 9 aa, Homo Sapiens
PGVVEPGML

SEQ ID NO: 653308 - protein, 9 aa, Homo Sapiens
PASGSAAFK

SEQ ID NO: 653309 - protein, 9 aa, Homo Sapiens
ELERAFMDG

SEQ ID NO: 653310 - protein, 9 aa, Homo Sapiens
TNPAKNLVS

SEQ ID NO: 653311 - protein, 9 aa, Homo Sapiens
APGGASQAD

SEQ ID NO: 653312 - protein, 9 aa, Homo Sapiens
EVTEEELLE

SEQ ID NO: 653313 - protein, 9 aa, Homo Sapiens
QGCKINALR

SEQ ID NO: 653314 - protein, 9 aa, Homo Sapiens
AVPAQLRPP

SEQ ID NO: 653315 - protein, 9 aa, Homo Sapiens
DENSFEDAV

SEQ ID NO: 653316 - protein, 9 aa, Homo Sapiens
PPGIQGDKG

SEQ ID NO: 653317 - protein, 9 aa, Homo Sapiens
GGIMSKTCT

SEQ ID NO: 653318 - protein, 9 aa, Homo Sapiens
MLVMFGHCP

SEQ ID NO: 653319 - protein, 9 aa, Homo Sapiens
EARRKLREY

SEQ ID NO: 653320 - protein, 9 aa, Homo Sapiens
GLGSSSPPP

SEQ ID NO: 653321 - protein, 9 aa, Homo Sapiens
QEDLVRFMY

SEQ ID NO: 653322 - protein, 9 aa, Homo Sapiens
NNFYKLVTD

SEQ ID NO: 653323 - protein, 9 aa, Homo Sapiens
LLGLTDCLE

SEQ ID NO: 653324 - protein, 9 aa, Homo Sapiens
GFHSKEVWA

SEQ ID NO: 653325 - protein, 9 aa, Homo Sapiens
AMTNPTSEI

SEQ ID NO: 653326 - protein, 9 aa, Homo Sapiens
LDLVNVVKL

SEQ ID NO: 653327 - protein, 9 aa, Homo Sapiens
RIWVDAVPC

SEQ ID NO: 653328 - protein, 9 aa, Homo Sapiens
LTEHESIHT

SEQ ID NO: 653329 - protein, 9 aa, Homo Sapiens
GEEEVASKL

SEQ ID NO: 653330 - protein, 9 aa, Homo Sapiens
SHSGPSYTP

SEQ ID NO: 653331 - protein, 9 aa, Homo Sapiens
TRAQVDLVV

SEQ ID NO: 653332 - protein, 9 aa, Homo Sapiens
PLRNIERIC

SEQ ID NO: 653333 - protein, 9 aa, Homo Sapiens
TLKGQSEDP

SEQ ID NO: 653334 - protein, 9 aa, Homo Sapiens
GSRVLALLD

SEQ ID NO: 653335 - protein, 9 aa, Homo Sapiens
NKPTNVLNV

SEQ ID NO: 653336 - protein, 9 aa, Homo Sapiens
CQLQNLLPL

SEQ ID NO: 653337 - protein, 9 aa, Homo Sapiens
LFLPAFSGL

SEQ ID NO: 653338 - protein, 9 aa, Homo Sapiens
SISVSVNFY

SEQ ID NO: 653339 - protein, 9 aa, Homo Sapiens
TEVTEFILF

SEQ ID NO: 653340 - protein, 9 aa, Homo Sapiens
RKNFVKPNK

SEQ ID NO: 653341 - protein, 9 aa, Homo Sapiens
VVLRTACSP

SEQ ID NO: 653342 - protein, 9 aa, Homo Sapiens
ASGNIVYWV

SEQ ID NO: 653343 - protein, 9 aa, Homo Sapiens
HMNTKRAIH

SEQ ID NO: 653344 - protein, 9 aa, Homo Sapiens
YSDSLLGVP

SEQ ID NO: 653345 - protein, 9 aa, Homo Sapiens
SLLSDSKVK

SEQ ID NO: 653346 - protein, 9 aa, Homo Sapiens
HLGLGIGEL

SEQ ID NO: 653347 - protein, 9 aa, Homo Sapiens
VLSYDISAD

SEQ ID NO: 653348 - protein, 9 aa, Homo Sapiens
IWSDLAVEA

SEQ ID NO: 653349 - protein, 9 aa, Homo Sapiens
EKDHRFSKA

SEQ ID NO: 653350 - protein, 9 aa, Homo Sapiens
WALPQQYPA

SEQ ID NO: 653351 - protein, 9 aa, Homo Sapiens
GHQRTSMLQ

SEQ ID NO: 653352 - protein, 9 aa, Homo Sapiens
KGISRKHAE

SEQ ID NO: 653353 - protein, 9 aa, Homo Sapiens
GNASKDVKV

SEQ ID NO: 653354 - protein, 9 aa, Homo Sapiens
KFHIPQEDL

SEQ ID NO: 653355 - protein, 9 aa, Homo Sapiens
IRARRGLPH

SEQ ID NO: 653356 - protein, 9 aa, Homo Sapiens
SLQAVDLLH

SEQ ID NO: 653357 - protein, 9 aa, Homo Sapiens
VKPQEVHMV

SEQ ID NO: 653358 - protein, 9 aa, Homo Sapiens
LGRRRKTLK

SEQ ID NO: 653359 - protein, 9 aa, Homo Sapiens
RIHAVEKPY

SEQ ID NO: 653360 - protein, 9 aa, Homo Sapiens
TYSEVLGIK

SEQ ID NO: 653361 - protein, 9 aa, Homo Sapiens
TLDLSGSTE

SEQ ID NO: 653362 - protein, 9 aa, Homo Sapiens
YCSGVESTI

SEQ ID NO: 653363 - protein, 9 aa, Homo Sapiens
DANQRATKM

SEQ ID NO: 653364 - protein, 9 aa, Homo Sapiens
IQEALVDKA

SEQ ID NO: 653365 - protein, 9 aa, Homo Sapiens
EKFEFLGLR

SEQ ID NO: 653366 - protein, 9 aa, Homo Sapiens
LFKKFYLIS

SEQ ID NO: 653367 - protein, 9 aa, Homo Sapiens
TVFGITGHL

SEQ ID NO: 653368 - protein, 9 aa, Homo Sapiens
GKSKGFVFV

SEQ ID NO: 653369 - protein, 9 aa, Homo Sapiens
RAGFPSIPV

SEQ ID NO: 653370 - protein, 9 aa, Homo Sapiens
HRFGKHVSH

SEQ ID NO: 653371 - protein, 9 aa, Homo Sapiens
AVGVSNPQL

SEQ ID NO: 653372 - protein, 9 aa, Homo Sapiens
GLMGPPGIQ

SEQ ID NO: 653373 - protein, 9 aa, Homo Sapiens
KGSGSLAPG

SEQ ID NO: 653374 - protein, 9 aa, Homo Sapiens
QSDAISPPT

SEQ ID NO: 653375 - protein, 9 aa, Homo Sapiens
SPAAASGWT

SEQ ID NO: 653376 - protein, 9 aa, Homo Sapiens
CKVDNEENT

SEQ ID NO: 653377 - protein, 9 aa, Homo Sapiens
PDNIWISKS

SEQ ID NO: 653378 - protein, 9 aa, Homo Sapiens
LAFEELFGI

SEQ ID NO: 653379 - protein, 9 aa, Homo Sapiens
IMATTYISV

SEQ ID NO: 653380 - protein, 9 aa, Homo Sapiens
PLNEDLHHP

SEQ ID NO: 653381 - protein, 9 aa, Homo Sapiens
GFQYGVTDL

SEQ ID NO: 653382 - protein, 9 aa, Homo Sapiens
TLSDETCHR

SEQ ID NO: 653383 - protein, 9 aa, Homo Sapiens
MRFINMPTC

SEQ ID NO: 653384 - protein, 9 aa, Homo Sapiens
INTHHLSPS

SEQ ID NO: 653385 - protein, 9 aa, Homo Sapiens
SSLHSTLLN

SEQ ID NO: 653386 - protein, 9 aa, Homo Sapiens
LACENQRRA

SEQ ID NO: 653387 - protein, 9 aa, Homo Sapiens
SGKSKGFVF

SEQ ID NO: 653388 - protein, 9 aa, Homo Sapiens
TGSRPSETF

SEQ ID NO: 653389 - protein, 9 aa, Homo Sapiens
QVVWIACAN

SEQ ID NO: 653390 - protein, 9 aa, Homo Sapiens
VLALLDRDS

SEQ ID NO: 653391 - protein, 9 aa, Homo Sapiens
LHGPDLTRI

SEQ ID NO: 653392 - protein, 9 aa, Homo Sapiens
HLTSHIRNH

SEQ ID NO: 653393 - protein, 9 aa, Homo Sapiens
TQHSEDINA

SEQ ID NO: 653394 - protein, 9 aa, Homo Sapiens
CGFQLQYQI

SEQ ID NO: 653395 - protein, 9 aa, Homo Sapiens
DLFLVAVLE

SEQ ID NO: 653396 - protein, 9 aa, Homo Sapiens
LHQVTESAR

SEQ ID NO: 653397 - protein, 9 aa, Homo Sapiens
LKETFCRLD

SEQ ID NO: 653398 - protein, 9 aa, Homo Sapiens
IMGGMLLAL

SEQ ID NO: 653399 - protein, 9 aa, Homo Sapiens
EFKKNADNS

SEQ ID NO: 653400 - protein, 9 aa, Homo Sapiens
GIMNSFVNN

SEQ ID NO: 653401 - protein, 9 aa, Homo Sapiens
LQYIEDMAM

SEQ ID NO: 653402 - protein, 9 aa, Homo Sapiens
KKLAYGEEK

SEQ ID NO: 653403 - protein, 9 aa, Homo Sapiens
GSCCMTQAG

SEQ ID NO: 653404 - protein, 9 aa, Homo Sapiens
AVDFFIFCL

SEQ ID NO: 653405 - protein, 9 aa, Homo Sapiens
FLVAVLELG

SEQ ID NO: 653406 - protein, 9 aa, Homo Sapiens
WGARIPAGA

SEQ ID NO: 653407 - protein, 9 aa, Homo Sapiens
KWKKDACSI

SEQ ID NO: 653408 - protein, 9 aa, Homo Sapiens
NLVRQHHEL

SEQ ID NO: 653409 - protein, 9 aa, Homo Sapiens
PESGKEAVT

SEQ ID NO: 653410 - protein, 9 aa, Homo Sapiens
DVLENGSSD

SEQ ID NO: 653411 - protein, 9 aa, Homo Sapiens
GIVGRHGKI

SEQ ID NO: 653412 - protein, 9 aa, Homo Sapiens
FYLISTSYL

SEQ ID NO: 653413 - protein, 9 aa, Homo Sapiens
IPETQSRSA

SEQ ID NO: 653414 - protein, 9 aa, Homo Sapiens
RSGNDTYEA

SEQ ID NO: 653415 - protein, 9 aa, Homo Sapiens
TKEQNSQMN

SEQ ID NO: 653416 - protein, 9 aa, Homo Sapiens
TLNELQQQY

SEQ ID NO: 653417 - protein, 9 aa, Homo Sapiens
DISELLVKT

SEQ ID NO: 653418 - protein, 9 aa, Homo Sapiens
FERIIMPGV

SEQ ID NO: 653419 - protein, 9 aa, Homo Sapiens
PTTFLKIML

SEQ ID NO: 653420 - protein, 9 aa, Homo Sapiens
RKIVYSKYF

SEQ ID NO: 653421 - protein, 9 aa, Homo Sapiens
MVHPPSGLE

SEQ ID NO: 653422 - protein, 9 aa, Homo Sapiens
QSKSQSLSH

SEQ ID NO: 653423 - protein, 9 aa, Homo Sapiens
RFINMPTCK

SEQ ID NO: 653424 - protein, 9 aa, Homo Sapiens
YSGWYCYGL

SEQ ID NO: 653425 - protein, 9 aa, Homo Sapiens
VCAVLGLTV

SEQ ID NO: 653426 - protein, 9 aa, Homo Sapiens
GSSSPPPLE

SEQ ID NO: 653427 - protein, 9 aa, Homo Sapiens
QKLHLWVTG

SEQ ID NO: 653428 - protein, 9 aa, Homo Sapiens
FWYIPQSLW

SEQ ID NO: 653429 - protein, 9 aa, Homo Sapiens
VLQDSLDVC

SEQ ID NO: 653430 - protein, 9 aa, Homo Sapiens
LQRHIHDVL

SEQ ID NO: 653431 - protein, 9 aa, Homo Sapiens
MESLSPLHN

SEQ ID NO: 653432 - protein, 9 aa, Homo Sapiens
SVLPPQSRN

SEQ ID NO: 653433 - protein, 9 aa, Homo Sapiens
MVIMNPSLC

SEQ ID NO: 653434 - protein, 9 aa, Homo Sapiens
TRSWSPSVL

SEQ ID NO: 653435 - protein, 9 aa, Homo Sapiens
SVICKKSGL

SEQ ID NO: 653436 - protein, 9 aa, Homo Sapiens
EQCMQDLFQ

SEQ ID NO: 653437 - protein, 9 aa, Homo Sapiens
PLFDVLQKL

SEQ ID NO: 653438 - protein, 9 aa, Homo Sapiens
MIQIVSAAD

SEQ ID NO: 653439 - protein, 9 aa, Homo Sapiens
SPSVLPPQS

SEQ ID NO: 653440 - protein, 9 aa, Homo Sapiens
MKIESGDSG

SEQ ID NO: 653441 - protein, 9 aa, Homo Sapiens
PNVACATKK

SEQ ID NO: 653442 - protein, 9 aa, Homo Sapiens
QRNLGKRSQ

SEQ ID NO: 653443 - protein, 9 aa, Homo Sapiens
CLDFNNCGL

SEQ ID NO: 653444 - protein, 9 aa, Homo Sapiens
CKCRKKNCT

SEQ ID NO: 653445 - protein, 9 aa, Homo Sapiens
LSSHFTPDL

SEQ ID NO: 653446 - protein, 9 aa, Homo Sapiens
QPTSMWAHQ

SEQ ID NO: 653447 - protein, 9 aa, Homo Sapiens
GINVRKCIH

SEQ ID NO: 653448 - protein, 9 aa, Homo Sapiens
SFSGTSSSR

SEQ ID NO: 653449 - protein, 9 aa, Homo Sapiens
LHHTIILAQ

SEQ ID NO: 653450 - protein, 9 aa, Homo Sapiens
AGVQGPIIT

SEQ ID NO: 653451 - protein, 9 aa, Homo Sapiens
WEQLNLPGA

SEQ ID NO: 653452 - protein, 9 aa, Homo Sapiens
DLASTRPPG

SEQ ID NO: 653453 - protein, 9 aa, Homo Sapiens
NLNTEKFSS

SEQ ID NO: 653454 - protein, 9 aa, Homo Sapiens
LKATDISIQ

SEQ ID NO: 653455 - protein, 9 aa, Homo Sapiens
NAWAIFKGK

SEQ ID NO: 653456 - protein, 9 aa, Homo Sapiens
NGLDLSGLG

SEQ ID NO: 653457 - protein, 9 aa, Homo Sapiens
LDFNNCGLT

SEQ ID NO: 653458 - protein, 9 aa, Homo Sapiens
SPSTVEPPS

SEQ ID NO: 653459 - protein, 9 aa, Homo Sapiens
FGITGHLPD

SEQ ID NO: 653460 - protein, 9 aa, Homo Sapiens
LSSASTGHT

SEQ ID NO: 653461 - protein, 9 aa, Homo Sapiens
IKYCSCPQL

SEQ ID NO: 653462 - protein, 9 aa, Homo Sapiens
VPRYKQDLV

SEQ ID NO: 653463 - protein, 9 aa, Homo Sapiens
LAMDTDDTS

SEQ ID NO: 653464 - protein, 9 aa, Homo Sapiens
VLRGSVYRR

SEQ ID NO: 653465 - protein, 9 aa, Homo Sapiens
LFLKDCVGG

SEQ ID NO: 653466 - protein, 9 aa, Homo Sapiens
TEDPLPPEA

SEQ ID NO: 653467 - protein, 9 aa, Homo Sapiens
GLLSQQAQV

SEQ ID NO: 653468 - protein, 9 aa, Homo Sapiens
HMRMHTGVR

SEQ ID NO: 653469 - protein, 9 aa, Homo Sapiens
LSDETCHRS

SEQ ID NO: 653470 - protein, 9 aa, Homo Sapiens
IFELNKLLQ

SEQ ID NO: 653471 - protein, 9 aa, Homo Sapiens
NQFPKILWE

SEQ ID NO: 653472 - protein, 9 aa, Homo Sapiens
NQKKSKLHG

SEQ ID NO: 653473 - protein, 9 aa, Homo Sapiens
NFSSRPWLS

SEQ ID NO: 653474 - protein, 9 aa, Homo Sapiens
NPVHAREPL

SEQ ID NO: 653475 - protein, 9 aa, Homo Sapiens
SLSSASTGH

SEQ ID NO: 653476 - protein, 9 aa, Homo Sapiens
QIRISKQLS

SEQ ID NO: 653477 - protein, 9 aa, Homo Sapiens
SFLQPDISE

SEQ ID NO: 653478 - protein, 9 aa, Homo Sapiens
VNIPTDFEG

SEQ ID NO: 653479 - protein, 9 aa, Homo Sapiens
DELIAQKSE

SEQ ID NO: 653480 - protein, 9 aa, Homo Sapiens
CENISGTED

SEQ ID NO: 653481 - protein, 9 aa, Homo Sapiens
PLQGEDEPS

SEQ ID NO: 653482 - protein, 9 aa, Homo Sapiens
IEKEGMKYI

SEQ ID NO: 653483 - protein, 9 aa, Homo Sapiens
RKYPPVDPE

SEQ ID NO: 653484 - protein, 9 aa, Homo Sapiens
RHACCHPQA

SEQ ID NO: 653485 - protein, 9 aa, Homo Sapiens
LLALLHHTI

SEQ ID NO: 653486 - protein, 9 aa, Homo Sapiens
SLDVCYSTP

SEQ ID NO: 653487 - protein, 9 aa, Homo Sapiens
SRPWLSLFP

SEQ ID NO: 653488 - protein, 9 aa, Homo Sapiens
SASPKNQKK

SEQ ID NO: 653489 - protein, 9 aa, Homo Sapiens
KHGANIRDQ

SEQ ID NO: 653490 - protein, 9 aa, Homo Sapiens
TPPGHGTPD

SEQ ID NO: 653491 - protein, 9 aa, Homo Sapiens
ILALLLVVL

SEQ ID NO: 653492 - protein, 9 aa, Homo Sapiens
LCNLFGVMS

SEQ ID NO: 653493 - protein, 9 aa, Homo Sapiens
RIPCLDLGE

SEQ ID NO: 653494 - protein, 9 aa, Homo Sapiens
YPRPCRDPL

SEQ ID NO: 653495 - protein, 9 aa, Homo Sapiens
SIYYEMEPL

SEQ ID NO: 653496 - protein, 9 aa, Homo Sapiens
GVQGPIITG

SEQ ID NO: 653497 - protein, 9 aa, Homo Sapiens
RKTNASLCD

SEQ ID NO: 653498 - protein, 9 aa, Homo Sapiens
CNDLEPLPR

SEQ ID NO: 653499 - protein, 9 aa, Homo Sapiens
TTRVSTASK

SEQ ID NO: 653500 - protein, 9 aa, Homo Sapiens
RASLFSKGS

SEQ ID NO: 653501 - protein, 9 aa, Homo Sapiens
ILADTPQEP

SEQ ID NO: 653502 - protein, 9 aa, Homo Sapiens
EHPAFQSNT

SEQ ID NO: 653503 - protein, 9 aa, Homo Sapiens
MSKKNQDNK

SEQ ID NO: 653504 - protein, 9 aa, Homo Sapiens
SPVFELMEA

SEQ ID NO: 653505 - protein, 9 aa, Homo Sapiens
GNIVYWVFM

SEQ ID NO: 653506 - protein, 9 aa, Homo Sapiens
FVKPNKTKT

SEQ ID NO: 653507 - protein, 9 aa, Homo Sapiens
KPSLFNGLN

SEQ ID NO: 653508 - protein, 9 aa, Homo Sapiens
KARREWERL

SEQ ID NO: 653509 - protein, 9 aa, Homo Sapiens
SNFYHPTTF

SEQ ID NO: 653510 - protein, 9 aa, Homo Sapiens
AECPSFLSL

SEQ ID NO: 653511 - protein, 9 aa, Homo Sapiens
EDSANEEME

SEQ ID NO: 653512 - protein, 9 aa, Homo Sapiens
FVAELAASS

SEQ ID NO: 653513 - protein, 9 aa, Homo Sapiens
DHYLAQLAF

SEQ ID NO: 653514 - protein, 9 aa, Homo Sapiens
VKPLSEMQT

SEQ ID NO: 653515 - protein, 9 aa, Homo Sapiens
SEEDMVGRL

SEQ ID NO: 653516 - protein, 9 aa, Homo Sapiens
LWLMPDLHT

SEQ ID NO: 653517 - protein, 9 aa, Homo Sapiens
ECNSDMVCP

SEQ ID NO: 653518 - protein, 9 aa, Homo Sapiens
LFLGRSVIQ

SEQ ID NO: 653519 - protein, 9 aa, Homo Sapiens
TEFILFGLT

SEQ ID NO: 653520 - protein, 9 aa, Homo Sapiens
NKYSRFNVY

SEQ ID NO: 653521 - protein, 9 aa, Homo Sapiens
ELLRRRYES

SEQ ID NO: 653522 - protein, 9 aa, Homo Sapiens
VRIVFNKTS

SEQ ID NO: 653523 - protein, 9 aa, Homo Sapiens
YLISTSYLD

SEQ ID NO: 653524 - protein, 9 aa, Homo Sapiens
GPRLAGLAL

SEQ ID NO: 653525 - protein, 9 aa, Homo Sapiens
PENGGYICY

SEQ ID NO: 653526 - protein, 9 aa, Homo Sapiens
CTGHWEQLN

SEQ ID NO: 653527 - protein, 9 aa, Homo Sapiens
HGAAEIQVP

SEQ ID NO: 653528 - protein, 9 aa, Homo Sapiens
RPTEESVEK

SEQ ID NO: 653529 - protein, 9 aa, Homo Sapiens
LGICYGVQM

SEQ ID NO: 653530 - protein, 9 aa, Homo Sapiens
ATTYISVTP

SEQ ID NO: 653531 - protein, 9 aa, Homo Sapiens
DTSNITIPK

SEQ ID NO: 653532 - protein, 9 aa, Homo Sapiens
SVYRRSHSQ

SEQ ID NO: 653533 - protein, 9 aa, Homo Sapiens
SPPTLTWLK

SEQ ID NO: 653534 - protein, 9 aa, Homo Sapiens
LNEMAITEK

SEQ ID NO: 653535 - protein, 9 aa, Homo Sapiens
PASWLRPMR

SEQ ID NO: 653536 - protein, 9 aa, Homo Sapiens
NDFLLQQTM

SEQ ID NO: 653537 - protein, 9 aa, Homo Sapiens
RGLVHYFVA

SEQ ID NO: 653538 - protein, 9 aa, Homo Sapiens
PGAPRDATS

SEQ ID NO: 653539 - protein, 9 aa, Homo Sapiens
IFGDFERII

SEQ ID NO: 653540 - protein, 9 aa, Homo Sapiens
NPEHQEKCR

SEQ ID NO: 653541 - protein, 9 aa, Homo Sapiens
HGFQCQVCC

SEQ ID NO: 653542 - protein, 9 aa, Homo Sapiens
LWKSLLPRQ

SEQ ID NO: 653543 - protein, 9 aa, Homo Sapiens
FQRKLIYET

SEQ ID NO: 653544 - protein, 9 aa, Homo Sapiens
AAAECPSFL

SEQ ID NO: 653545 - protein, 9 aa, Homo Sapiens
DACSICECK

SEQ ID NO: 653546 - protein, 9 aa, Homo Sapiens
TAVPRATIS

SEQ ID NO: 653547 - protein, 9 aa, Homo Sapiens
SPSSPEEHV

SEQ ID NO: 653548 - protein, 9 aa, Homo Sapiens
QFWDFIDQL

SEQ ID NO: 653549 - protein, 9 aa, Homo Sapiens
ALSSHFTPD

SEQ ID NO: 653550 - protein, 9 aa, Homo Sapiens
LEVLNAIEE

SEQ ID NO: 653551 - protein, 9 aa, Homo Sapiens
SGVESTISS

SEQ ID NO: 653552 - protein, 9 aa, Homo Sapiens
VWARKQHMN

SEQ ID NO: 653553 - protein, 9 aa, Homo Sapiens
RRGLPHLAV

SEQ ID NO: 653554 - protein, 9 aa, Homo Sapiens
RVQDVIEQF

SEQ ID NO: 653555 - protein, 9 aa, Homo Sapiens
KVDNEENTL

SEQ ID NO: 653556 - protein, 9 aa, Homo Sapiens
NDDLLFSDP

SEQ ID NO: 653557 - protein, 9 aa, Homo Sapiens
FLTEHESIH

SEQ ID NO: 653558 - protein, 9 aa, Homo Sapiens
QVIQETCES

SEQ ID NO: 653559 - protein, 9 aa, Homo Sapiens
PCQCRAGYQ

SEQ ID NO: 653560 - protein, 9 aa, Homo Sapiens
ITLKLKQKT

SEQ ID NO: 653561 - protein, 9 aa, Homo Sapiens
VADYYGKCS

SEQ ID NO: 653562 - protein, 9 aa, Homo Sapiens
GTGELYVHC

SEQ ID NO: 653563 - protein, 9 aa, Homo Sapiens
EIVEHGAIE

SEQ ID NO: 653564 - protein, 9 aa, Homo Sapiens
SLCRGLVSV

SEQ ID NO: 653565 - protein, 9 aa, Homo Sapiens
IRNDLLDLV

SEQ ID NO: 653566 - protein, 9 aa, Homo Sapiens
KKGDHANVN

SEQ ID NO: 653567 - protein, 9 aa, Homo Sapiens
HSSVSTESQ

SEQ ID NO: 653568 - protein, 9 aa, Homo Sapiens
IPTPIVTWL

SEQ ID NO: 653569 - protein, 9 aa, Homo Sapiens
FAAREWVGL

SEQ ID NO: 653570 - protein, 9 aa, Homo Sapiens
AAAPKGKEN

SEQ ID NO: 653571 - protein, 9 aa, Homo Sapiens
DLFKKLSGS

SEQ ID NO: 653572 - protein, 9 aa, Homo Sapiens
VDLLHIPLQ

SEQ ID NO: 653573 - protein, 9 aa, Homo Sapiens
KNAELQITL

SEQ ID NO: 653574 - protein, 9 aa, Homo Sapiens
VKPPEDIQD

SEQ ID NO: 653575 - protein, 9 aa, Homo Sapiens
NITLDSVTA

SEQ ID NO: 653576 - protein, 9 aa, Homo Sapiens
FHTLKLQEL

SEQ ID NO: 653577 - protein, 9 aa, Homo Sapiens
DDLLFSDPS

SEQ ID NO: 653578 - protein, 9 aa, Homo Sapiens
CNASIECDK

SEQ ID NO: 653579 - protein, 9 aa, Homo Sapiens
ESGKSKGFV

SEQ ID NO: 653580 - protein, 9 aa, Homo Sapiens
RLAGLALLA

SEQ ID NO: 653581 - protein, 9 aa, Homo Sapiens
GVYADKSVG

SEQ ID NO: 653582 - protein, 9 aa, Homo Sapiens
AIHPVASNQ

SEQ ID NO: 653583 - protein, 9 aa, Homo Sapiens
ELLSTIRDP

SEQ ID NO: 653584 - protein, 9 aa, Homo Sapiens
DSSDKEITH

SEQ ID NO: 653585 - protein, 9 aa, Homo Sapiens
KATMSLPLA

SEQ ID NO: 653586 - protein, 9 aa, Homo Sapiens
KAPCSQMKL

SEQ ID NO: 653587 - protein, 9 aa, Homo Sapiens
DLTRIHPSY

SEQ ID NO: 653588 - protein, 9 aa, Homo Sapiens
EEELLEGTV

SEQ ID NO: 653589 - protein, 9 aa, Homo Sapiens
WWWCCYSGW

SEQ ID NO: 653590 - protein, 9 aa, Homo Sapiens
AICPGLGAR

SEQ ID NO: 653591 - protein, 9 aa, Homo Sapiens
PAGGEKSWA

SEQ ID NO: 653592 - protein, 9 aa, Homo Sapiens
MGSIREDTL

SEQ ID NO: 653593 - protein, 9 aa, Homo Sapiens
LAYLAGVWG

SEQ ID NO: 653594 - protein, 9 aa, Homo Sapiens
LVSFDAWQA

SEQ ID NO: 653595 - protein, 9 aa, Homo Sapiens
QLVDIELSS

SEQ ID NO: 653596 - protein, 9 aa, Homo Sapiens
RYSVTVPGA

SEQ ID NO: 653597 - protein, 9 aa, Homo Sapiens
HRFSKACNT

SEQ ID NO: 653598 - protein, 9 aa, Homo Sapiens
DNSSSAFTA

SEQ ID NO: 653599 - protein, 9 aa, Homo Sapiens
KINALRAKT

SEQ ID NO: 653600 - protein, 9 aa, Homo Sapiens
LETPQEDHL

SEQ ID NO: 653601 - protein, 9 aa, Homo Sapiens
NIEETCQLL

SEQ ID NO: 653602 - protein, 9 aa, Homo Sapiens
AEGERLVPI

SEQ ID NO: 653603 - protein, 9 aa, Homo Sapiens
GRIWVDAVP

SEQ ID NO: 653604 - protein, 9 aa, Homo Sapiens
QALQELVAR

SEQ ID NO: 653605 - protein, 9 aa, Homo Sapiens
ASFPSDTFD

SEQ ID NO: 653606 - protein, 9 aa, Homo Sapiens
VTLEPTEDG

SEQ ID NO: 653607 - protein, 9 aa, Homo Sapiens
FDAWQALGP

SEQ ID NO: 653608 - protein, 9 aa, Homo Sapiens
DRVYGIKYQ

SEQ ID NO: 653609 - protein, 9 aa, Homo Sapiens
VSATLRPET

SEQ ID NO: 653610 - protein, 9 aa, Homo Sapiens
EELLEGTVR

SEQ ID NO: 653611 - protein, 9 aa, Homo Sapiens
KENNGGARL

SEQ ID NO: 653612 - protein, 9 aa, Homo Sapiens
TLAMTNPTS

SEQ ID NO: 653613 - protein, 9 aa, Homo Sapiens
NSVELHQIV

SEQ ID NO: 653614 - protein, 9 aa, Homo Sapiens
GSFLQPDIS

SEQ ID NO: 653615 - protein, 9 aa, Homo Sapiens
FPQYCVAGT

SEQ ID NO: 653616 - protein, 9 aa, Homo Sapiens
KILLKIWKH

SEQ ID NO: 653617 - protein, 9 aa, Homo Sapiens
WGFGKHGFQ

SEQ ID NO: 653618 - protein, 9 aa, Homo Sapiens
DLGHHRVLV

SEQ ID NO: 653619 - protein, 9 aa, Homo Sapiens
KSPDNIWIS

SEQ ID NO: 653620 - protein, 9 aa, Homo Sapiens
KPLIRAINS

SEQ ID NO: 653621 - protein, 9 aa, Homo Sapiens
LEKTLSAVT

SEQ ID NO: 653622 - protein, 9 aa, Homo Sapiens
SDGVMVCAV

SEQ ID NO: 653623 - protein, 9 aa, Homo Sapiens
AVADHYLAQ

SEQ ID NO: 653624 - protein, 9 aa, Homo Sapiens
ALKRKKRHE

SEQ ID NO: 653625 - protein, 9 aa, Homo Sapiens
FMNLIKEAQ

SEQ ID NO: 653626 - protein, 9 aa, Homo Sapiens
DAGDYSFVV

SEQ ID NO: 653627 - protein, 9 aa, Homo Sapiens
LDPFQQIYE

SEQ ID NO: 653628 - protein, 9 aa, Homo Sapiens
CDVFLLDEN

SEQ ID NO: 653629 - protein, 9 aa, Homo Sapiens
VYGIKYQTF

SEQ ID NO: 653630 - protein, 9 aa, Homo Sapiens
TKWKKDACS

SEQ ID NO: 653631 - protein, 9 aa, Homo Sapiens
TSNPYADDP

SEQ ID NO: 653632 - protein, 9 aa, Homo Sapiens
REYDGLVDA

SEQ ID NO: 653633 - protein, 9 aa, Homo Sapiens
TEHKRIHAV

SEQ ID NO: 653634 - protein, 9 aa, Homo Sapiens
LISTSYLDS

SEQ ID NO: 653635 - protein, 9 aa, Homo Sapiens
GICYGVQMM

SEQ ID NO: 653636 - protein, 9 aa, Homo Sapiens
MRISPEPLH

SEQ ID NO: 653637 - protein, 9 aa, Homo Sapiens
PHGPPWAPS

SEQ ID NO: 653638 - protein, 9 aa, Homo Sapiens
SQEELGLLD

SEQ ID NO: 653639 - protein, 9 aa, Homo Sapiens
ESTISSLDY

SEQ ID NO: 653640 - protein, 9 aa, Homo Sapiens
TTVFGITGH

SEQ ID NO: 653641 - protein, 9 aa, Homo Sapiens
HIYSGNTMN

SEQ ID NO: 653642 - protein, 9 aa, Homo Sapiens
RCGAKTVRY

SEQ ID NO: 653643 - protein, 9 aa, Homo Sapiens
LASYLMMAV

SEQ ID NO: 653644 - protein, 9 aa, Homo Sapiens
QMLLTTVSA

SEQ ID NO: 653645 - protein, 9 aa, Homo Sapiens
TISSLDYIS

SEQ ID NO: 653646 - protein, 9 aa, Homo Sapiens
GISCKVDNE

SEQ ID NO: 653647 - protein, 9 aa, Homo Sapiens
PCGACQSEV

SEQ ID NO: 653648 - protein, 9 aa, Homo Sapiens
MDLRFAEMK

SEQ ID NO: 653649 - protein, 9 aa, Homo Sapiens
ISKTVNPTA

SEQ ID NO: 653650 - protein, 9 aa, Homo Sapiens
SPGDSPHTV

SEQ ID NO: 653651 - protein, 9 aa, Homo Sapiens
AKSNSSLGE

SEQ ID NO: 653652 - protein, 9 aa, Homo Sapiens
SLQKELQDI

SEQ ID NO: 653653 - protein, 9 aa, Homo Sapiens
LGQPHSRSL

SEQ ID NO: 653654 - protein, 9 aa, Homo Sapiens
KTLNNKFAF

SEQ ID NO: 653655 - protein, 9 aa, Homo Sapiens
VTVPGADQP

SEQ ID NO: 653656 - protein, 9 aa, Homo Sapiens
GFQRKLIYE

SEQ ID NO: 653657 - protein, 9 aa, Homo Sapiens
TYRALAHNL

SEQ ID NO: 653658 - protein, 9 aa, Homo Sapiens
KYMEQGRTE

SEQ ID NO: 653659 - protein, 9 aa, Homo Sapiens
ADGVDVNIP

SEQ ID NO: 653660 - protein, 9 aa, Homo Sapiens
IPQSLWGVP

SEQ ID NO: 653661 - protein, 9 aa, Homo Sapiens
LDVCYSTPS

SEQ ID NO: 653662 - protein, 9 aa, Homo Sapiens
VYADKSVGN

SEQ ID NO: 653663 - protein, 9 aa, Homo Sapiens
YPQFAPAVY

SEQ ID NO: 653664 - protein, 9 aa, Homo Sapiens
RMHTGVRPH

SEQ ID NO: 653665 - protein, 9 aa, Homo Sapiens
PRGRIEWNG

SEQ ID NO: 653666 - protein, 9 aa, Homo Sapiens
KHRPSHGDK

SEQ ID NO: 653667 - protein, 9 aa, Homo Sapiens
NGINVRKCI

SEQ ID NO: 653668 - protein, 9 aa, Homo Sapiens
NPAPELMAS

SEQ ID NO: 653669 - protein, 9 aa, Homo Sapiens
GIESRVEEP

SEQ ID NO: 653670 - protein, 9 aa, Homo Sapiens
IVSRMLLQQ

SEQ ID NO: 653671 - protein, 9 aa, Homo Sapiens
THAESAEIP

SEQ ID NO: 653672 - protein, 9 aa, Homo Sapiens
QAEQTISLA

SEQ ID NO: 653673 - protein, 9 aa, Homo Sapiens
LGIMAFDRY

SEQ ID NO: 653674 - protein, 9 aa, Homo Sapiens
TVLEKCNRN

SEQ ID NO: 653675 - protein, 9 aa, Homo Sapiens
IHAVMPDVV

SEQ ID NO: 653676 - protein, 9 aa, Homo Sapiens
WLGQGLIES

SEQ ID NO: 653677 - protein, 9 aa, Homo Sapiens
MYFFMAFRN

SEQ ID NO: 653678 - protein, 9 aa, Homo Sapiens
ILEPPKGQD

SEQ ID NO: 653679 - protein, 9 aa, Homo Sapiens
TSEIPPDLQ

SEQ ID NO: 653680 - protein, 9 aa, Homo Sapiens
YYPRGSQHL

SEQ ID NO: 653681 - protein, 9 aa, Homo Sapiens
AAGHFPGAI

SEQ ID NO: 653682 - protein, 9 aa, Homo Sapiens
VQDVIEQFW

SEQ ID NO: 653683 - protein, 9 aa, Homo Sapiens
DLFLVGGDN

SEQ ID NO: 653684 - protein, 9 aa, Homo Sapiens
NDGLGSSSP

SEQ ID NO: 653685 - protein, 9 aa, Homo Sapiens
LIMGGMLLA

SEQ ID NO: 653686 - protein, 9 aa, Homo Sapiens
STLVLCNLF

SEQ ID NO: 653687 - protein, 9 aa, Homo Sapiens
ELQITLKLK

SEQ ID NO: 653688 - protein, 9 aa, Homo Sapiens
VKALCQLQN

SEQ ID NO: 653689 - protein, 9 aa, Homo Sapiens
YVAFAKFQE

SEQ ID NO: 653690 - protein, 9 aa, Homo Sapiens
KPMGIFPIL

SEQ ID NO: 653691 - protein, 9 aa, Homo Sapiens
FKSDGVMVC

SEQ ID NO: 653692 - protein, 9 aa, Homo Sapiens
KHQLWAAHC

SEQ ID NO: 653693 - protein, 9 aa, Homo Sapiens
RCSVLIKVL

SEQ ID NO: 653694 - protein, 9 aa, Homo Sapiens
QKGEPGVVE

SEQ ID NO: 653695 - protein, 9 aa, Homo Sapiens
DTPPGTPVV

SEQ ID NO: 653696 - protein, 9 aa, Homo Sapiens
NSFEDAVYW

SEQ ID NO: 653697 - protein, 9 aa, Homo Sapiens
VKSHVGQVI

SEQ ID NO: 653698 - protein, 9 aa, Homo Sapiens
NSPVNNPTG

SEQ ID NO: 653699 - protein, 9 aa, Homo Sapiens
GTPDNSKSM

SEQ ID NO: 653700 - protein, 9 aa, Homo Sapiens
SKEVWAGHT

SEQ ID NO: 653701 - protein, 9 aa, Homo Sapiens
SQPKNRAET

SEQ ID NO: 653702 - protein, 9 aa, Homo Sapiens
ESFAVSDNE

SEQ ID NO: 653703 - protein, 9 aa, Homo Sapiens
SEQLFSSAH

SEQ ID NO: 653704 - protein, 9 aa, Homo Sapiens
IEMVGLSKR

SEQ ID NO: 653705 - protein, 9 aa, Homo Sapiens
LLKCVHHNP

SEQ ID NO: 653706 - protein, 9 aa, Homo Sapiens
KYWCRPLQI

SEQ ID NO: 653707 - protein, 9 aa, Homo Sapiens
APQLEAVLR

SEQ ID NO: 653708 - protein, 9 aa, Homo Sapiens
SSSSPSSST

SEQ ID NO: 653709 - protein, 9 aa, Homo Sapiens
AATQDIAVH

SEQ ID NO: 653710 - protein, 9 aa, Homo Sapiens
SFVRKTTKK

SEQ ID NO: 653711 - protein, 9 aa, Homo Sapiens
DTSEVNYII

SEQ ID NO: 653712 - protein, 9 aa, Homo Sapiens
VQRKIEALS

SEQ ID NO: 653713 - protein, 9 aa, Homo Sapiens
GNIIVIMAV

SEQ ID NO: 653714 - protein, 9 aa, Homo Sapiens
RCCRIRLTW

SEQ ID NO: 653715 - protein, 9 aa, Homo Sapiens
LSEFVPLDY

SEQ ID NO: 653716 - protein, 9 aa, Homo Sapiens
FMLDKLQNK

SEQ ID NO: 653717 - protein, 9 aa, Homo Sapiens
STECVLLIV

SEQ ID NO: 653718 - protein, 9 aa, Homo Sapiens
AADGIPFFP

SEQ ID NO: 653719 - protein, 9 aa, Homo Sapiens
DSLLGVPIA

SEQ ID NO: 653720 - protein, 9 aa, Homo Sapiens
FSQSAGCQN

SEQ ID NO: 653721 - protein, 9 aa, Homo Sapiens
DVPRNRGYL

SEQ ID NO: 653722 - protein, 9 aa, Homo Sapiens
DNSGFELFT

SEQ ID NO: 653723 - protein, 9 aa, Homo Sapiens
RATISTYLN

SEQ ID NO: 653724 - protein, 9 aa, Homo Sapiens
AWLPHWTPL

SEQ ID NO: 653725 - protein, 9 aa, Homo Sapiens
SWSPSVLPP

SEQ ID NO: 653726 - protein, 9 aa, Homo Sapiens
QLFSSAHLQ

SEQ ID NO: 653727 - protein, 9 aa, Homo Sapiens
CLLLGIMAF

SEQ ID NO: 653728 - protein, 9 aa, Homo Sapiens
WVGLVKHYL

SEQ ID NO: 653729 - protein, 9 aa, Homo Sapiens
QRNYLIQTE

SEQ ID NO: 653730 - protein, 9 aa, Homo Sapiens
TPGGRLGEA

SEQ ID NO: 653731 - protein, 9 aa, Homo Sapiens
TYHHIQEMM

SEQ ID NO: 653732 - protein, 9 aa, Homo Sapiens
NKKGKLGIL

SEQ ID NO: 653733 - protein, 9 aa, Homo Sapiens
GARVAGFST

SEQ ID NO: 653734 - protein, 9 aa, Homo Sapiens
CNCGLVFNL

SEQ ID NO: 653735 - protein, 9 aa, Homo Sapiens
YYWESYWVM

SEQ ID NO: 653736 - protein, 9 aa, Homo Sapiens
FTYHHIQEM

SEQ ID NO: 653737 - protein, 9 aa, Homo Sapiens
IVTCFIIGL

SEQ ID NO: 653738 - protein, 9 aa, Homo Sapiens
FDLQTIGFA

SEQ ID NO: 653739 - protein, 9 aa, Homo Sapiens
QGSRQDSWD

SEQ ID NO: 653740 - protein, 9 aa, Homo Sapiens
IFMETLKNI

SEQ ID NO: 653741 - protein, 9 aa, Homo Sapiens
AVHSPLELC

SEQ ID NO: 653742 - protein, 9 aa, Homo Sapiens
GVFQTTDTK

SEQ ID NO: 653743 - protein, 9 aa, Homo Sapiens
EKNTSNSQW

SEQ ID NO: 653744 - protein, 9 aa, Homo Sapiens
ESQVEPSVN

SEQ ID NO: 653745 - protein, 9 aa, Homo Sapiens
LIESAAKST

SEQ ID NO: 653746 - protein, 9 aa, Homo Sapiens
QLNLPGAPE

SEQ ID NO: 653747 - protein, 9 aa, Homo Sapiens
MNPSLCRGL

SEQ ID NO: 653748 - protein, 9 aa, Homo Sapiens
MDLGLLSQQ

SEQ ID NO: 653749 - protein, 9 aa, Homo Sapiens
PKPPLENGH

SEQ ID NO: 653750 - protein, 9 aa, Homo Sapiens
LRLREVSMS

SEQ ID NO: 653751 - protein, 9 aa, Homo Sapiens
SSRPWLSLF

SEQ ID NO: 653752 - protein, 9 aa, Homo Sapiens
TGEKPYKFH

SEQ ID NO: 653753 - protein, 9 aa, Homo Sapiens
CGNLQPTSM

SEQ ID NO: 653754 - protein, 9 aa, Homo Sapiens
SGEEEVASK

SEQ ID NO: 653755 - protein, 9 aa, Homo Sapiens
DLTEAWMQA

SEQ ID NO: 653756 - protein, 9 aa, Homo Sapiens
YHLVATLED

SEQ ID NO: 653757 - protein, 9 aa, Homo Sapiens
LTKSSVRIG

SEQ ID NO: 653758 - protein, 9 aa, Homo Sapiens
QLATPVWFH

SEQ ID NO: 653759 - protein, 9 aa, Homo Sapiens
LVTSTVFKS

SEQ ID NO: 653760 - protein, 9 aa, Homo Sapiens
ATDISIQPP

SEQ ID NO: 653761 - protein, 9 aa, Homo Sapiens
YIITTFDSI

SEQ ID NO: 653762 - protein, 9 aa, Homo Sapiens
VDEAAAECP

SEQ ID NO: 653763 - protein, 9 aa, Homo Sapiens
LIRAINSSN

SEQ ID NO: 653764 - protein, 9 aa, Homo Sapiens
NKPMYFFLG

SEQ ID NO: 653765 - protein, 9 aa, Homo Sapiens
EDWKMKDNQ

SEQ ID NO: 653766 - protein, 9 aa, Homo Sapiens
RQCLENEEN

SEQ ID NO: 653767 - protein, 9 aa, Homo Sapiens
VEKRSNVGL

SEQ ID NO: 653768 - protein, 9 aa, Homo Sapiens
LPVFMKQLP

SEQ ID NO: 653769 - protein, 9 aa, Homo Sapiens
KHARFPSTF

SEQ ID NO: 653770 - protein, 9 aa, Homo Sapiens
RATPVQLPF

SEQ ID NO: 653771 - protein, 9 aa, Homo Sapiens
NQYIYRIPC

SEQ ID NO: 653772 - protein, 9 aa, Homo Sapiens
YEMEPLTIV

SEQ ID NO: 653773 - protein, 9 aa, Homo Sapiens
RGNGKNLSP

SEQ ID NO: 653774 - protein, 9 aa, Homo Sapiens
RSQRNLGKR

SEQ ID NO: 653775 - protein, 9 aa, Homo Sapiens
VVNGVASGL

SEQ ID NO: 653776 - protein, 9 aa, Homo Sapiens
AWRACQFHL

SEQ ID NO: 653777 - protein, 9 aa, Homo Sapiens
IHCGATTTA

SEQ ID NO: 653778 - protein, 9 aa, Homo Sapiens
PAAASGWTV

SEQ ID NO: 653779 - protein, 9 aa, Homo Sapiens
VIINDTEDD

SEQ ID NO: 653780 - protein, 9 aa, Homo Sapiens
GHSLALYEE

SEQ ID NO: 653781 - protein, 9 aa, Homo Sapiens
CGACQSEVN

SEQ ID NO: 653782 - protein, 9 aa, Homo Sapiens
KNDDDENGP

SEQ ID NO: 653783 - protein, 9 aa, Homo Sapiens
DGTPAKAGS

SEQ ID NO: 653784 - protein, 9 aa, Homo Sapiens
ELQAFQNIE

SEQ ID NO: 653785 - protein, 9 aa, Homo Sapiens
TSPSSPEEH

SEQ ID NO: 653786 - protein, 9 aa, Homo Sapiens
VVKCPGAPA

SEQ ID NO: 653787 - protein, 9 aa, Homo Sapiens
LSGSTETPS

SEQ ID NO: 653788 - protein, 9 aa, Homo Sapiens
HARFPSTFS

SEQ ID NO: 653789 - protein, 9 aa, Homo Sapiens
LKSDTNWKY

SEQ ID NO: 653790 - protein, 9 aa, Homo Sapiens
SASGVFQTT

SEQ ID NO: 653791 - protein, 9 aa, Homo Sapiens
IEQPNVACA

SEQ ID NO: 653792 - protein, 9 aa, Homo Sapiens
PQAMFHIEY

SEQ ID NO: 653793 - protein, 9 aa, Homo Sapiens
SGEAGHPWV

SEQ ID NO: 653794 - protein, 9 aa, Homo Sapiens
DEAAAECPS

SEQ ID NO: 653795 - protein, 9 aa, Homo Sapiens
IDDANQRAT

SEQ ID NO: 653796 - protein, 9 aa, Homo Sapiens
DLFQKVILR

SEQ ID NO: 653797 - protein, 9 aa, Homo Sapiens
YDISADDKY

SEQ ID NO: 653798 - protein, 9 aa, Homo Sapiens
GGDRCRGLV

SEQ ID NO: 653799 - protein, 9 aa, Homo Sapiens
LQAGWCYVA

SEQ ID NO: 653800 - protein, 9 aa, Homo Sapiens
TFPNKELAY

SEQ ID NO: 653801 - protein, 9 aa, Homo Sapiens
CNCNDLEPL

SEQ ID NO: 653802 - protein, 9 aa, Homo Sapiens
RKTLKLCRE

SEQ ID NO: 653803 - protein, 9 aa, Homo Sapiens
CCKCRKKNC

SEQ ID NO: 653804 - protein, 9 aa, Homo Sapiens
TRTLSTSCR

SEQ ID NO: 653805 - protein, 9 aa, Homo Sapiens
CPPLPFSSC

SEQ ID NO: 653806 - protein, 9 aa, Homo Sapiens
FTVQIKHEE

SEQ ID NO: 653807 - protein, 9 aa, Homo Sapiens
PVISEKPSL

SEQ ID NO: 653808 - protein, 9 aa, Homo Sapiens
KMLSNIISE

SEQ ID NO: 653809 - protein, 9 aa, Homo Sapiens
GRKADMWSV

SEQ ID NO: 653810 - protein, 9 aa, Homo Sapiens
EAQQPAIHP

SEQ ID NO: 653811 - protein, 9 aa, Homo Sapiens
DCCVPVCCK

SEQ ID NO: 653812 - protein, 9 aa, Homo Sapiens
VLEKILFVV

SEQ ID NO: 653813 - protein, 9 aa, Homo Sapiens
MASFLPRTL

SEQ ID NO: 653814 - protein, 9 aa, Homo Sapiens
AELQITLKL

SEQ ID NO: 653815 - protein, 9 aa, Homo Sapiens
ITIADALFY

SEQ ID NO: 653816 - protein, 9 aa, Homo Sapiens
ARLLKIWLY

SEQ ID NO: 653817 - protein, 9 aa, Homo Sapiens
RLLPHLAAD

SEQ ID NO: 653818 - protein, 9 aa, Homo Sapiens
MSHQALGRC

SEQ ID NO: 653819 - protein, 9 aa, Homo Sapiens
PDKVLECIE

SEQ ID NO: 653820 - protein, 9 aa, Homo Sapiens
GVEAIQEAL

SEQ ID NO: 653821 - protein, 9 aa, Homo Sapiens
SQLSLHLLD

SEQ ID NO: 653822 - protein, 9 aa, Homo Sapiens
QRLDGASWR

SEQ ID NO: 653823 - protein, 9 aa, Homo Sapiens
DGRKHARFP

SEQ ID NO: 653824 - protein, 9 aa, Homo Sapiens
GRSSLQAVD

SEQ ID NO: 653825 - protein, 9 aa, Homo Sapiens
LLGPHQAEP

SEQ ID NO: 653826 - protein, 9 aa, Homo Sapiens
PPSGHSNPM

SEQ ID NO: 653827 - protein, 9 aa, Homo Sapiens
TNTYLQPKP

SEQ ID NO: 653828 - protein, 9 aa, Homo Sapiens
EPGVVEPGM

SEQ ID NO: 653829 - protein, 9 aa, Homo Sapiens
TVCLSCSQA

SEQ ID NO: 653830 - protein, 9 aa, Homo Sapiens
VPRSDCKIL

SEQ ID NO: 653831 - protein, 9 aa, Homo Sapiens
LGKYMEQGR

SEQ ID NO: 653832 - protein, 9 aa, Homo Sapiens
LLHIPLQKF

SEQ ID NO: 653833 - protein, 9 aa, Homo Sapiens
IDTSSLGAA

SEQ ID NO: 653834 - protein, 9 aa, Homo Sapiens
FNMQPSPSS

SEQ ID NO: 653835 - protein, 9 aa, Homo Sapiens
LPSLRAWLP

SEQ ID NO: 653836 - protein, 9 aa, Homo Sapiens
LLIFFIYLD

SEQ ID NO: 653837 - protein, 9 aa, Homo Sapiens
GPYLGQPHS

SEQ ID NO: 653838 - protein, 9 aa, Homo Sapiens
VNASMRRVS

SEQ ID NO: 653839 - protein, 9 aa, Homo Sapiens
QGEDEPSSQ

SEQ ID NO: 653840 - protein, 9 aa, Homo Sapiens
DSLTLFQSK

SEQ ID NO: 653841 - protein, 9 aa, Homo Sapiens
SSLFDFQWH

SEQ ID NO: 653842 - protein, 9 aa, Homo Sapiens
WKTFQAYLP

SEQ ID NO: 653843 - protein, 9 aa, Homo Sapiens
AGETSATAV

SEQ ID NO: 653844 - protein, 9 aa, Homo Sapiens
PETLICQNC

SEQ ID NO: 653845 - protein, 9 aa, Homo Sapiens
VHATSKEAK

SEQ ID NO: 653846 - protein, 9 aa, Homo Sapiens
APEVIRASL

SEQ ID NO: 653847 - protein, 9 aa, Homo Sapiens
EPLRSPSSS

SEQ ID NO: 653848 - protein, 9 aa, Homo Sapiens
PVGSPVGEI

SEQ ID NO: 653849 - protein, 9 aa, Homo Sapiens
SKKMDGYNL

SEQ ID NO: 653850 - protein, 9 aa, Homo Sapiens
IFTLNELQQ

SEQ ID NO: 653851 - protein, 9 aa, Homo Sapiens
HKNKPDLKD

SEQ ID NO: 653852 - protein, 9 aa, Homo Sapiens
SKAGLPCLS

SEQ ID NO: 653853 - protein, 9 aa, Homo Sapiens
MPKWLYFMM

SEQ ID NO: 653854 - protein, 9 aa, Homo Sapiens
GQIAGVDKH

SEQ ID NO: 653855 - protein, 9 aa, Homo Sapiens
MFDDEPTII

SEQ ID NO: 653856 - protein, 9 aa, Homo Sapiens
SDAISPPTL

SEQ ID NO: 653857 - protein, 9 aa, Homo Sapiens
NMPTCKLLF

SEQ ID NO: 653858 - protein, 9 aa, Homo Sapiens
LSEDSATTN

SEQ ID NO: 653859 - protein, 9 aa, Homo Sapiens
LQPVASFAK

SEQ ID NO: 653860 - protein, 9 aa, Homo Sapiens
SNKTRIDDA

SEQ ID NO: 653861 - protein, 9 aa, Homo Sapiens
AKHPCNASI

SEQ ID NO: 653862 - protein, 9 aa, Homo Sapiens
MHCSAEGER

SEQ ID NO: 653863 - protein, 9 aa, Homo Sapiens
SGVSRPDKV

SEQ ID NO: 653864 - protein, 9 aa, Homo Sapiens
QSLWGVPDS

SEQ ID NO: 653865 - protein, 9 aa, Homo Sapiens
MHAQTTSGS

SEQ ID NO: 653866 - protein, 9 aa, Homo Sapiens
VVSVLFLFL

SEQ ID NO: 653867 - protein, 9 aa, Homo Sapiens
KKGKLGILQ

SEQ ID NO: 653868 - protein, 9 aa, Homo Sapiens
HIMELHVQE

SEQ ID NO: 653869 - protein, 9 aa, Homo Sapiens
EEPLTISKL

SEQ ID NO: 653870 - protein, 9 aa, Homo Sapiens
AFNQSCSLT

SEQ ID NO: 653871 - protein, 9 aa, Homo Sapiens
RLGRRRKTL

SEQ ID NO: 653872 - protein, 9 aa, Homo Sapiens
YEYSEINIT

SEQ ID NO: 653873 - protein, 9 aa, Homo Sapiens
SLFNGLNSI

SEQ ID NO: 653874 - protein, 9 aa, Homo Sapiens
KPCGGHDCS

SEQ ID NO: 653875 - protein, 9 aa, Homo Sapiens
CNPLHYPVV

SEQ ID NO: 653876 - protein, 9 aa, Homo Sapiens
FQDITVSDF

SEQ ID NO: 653877 - protein, 9 aa, Homo Sapiens
QSFGRKVVY

SEQ ID NO: 653878 - protein, 9 aa, Homo Sapiens
SHESLEPNS

SEQ ID NO: 653879 - protein, 9 aa, Homo Sapiens
HSKCENISG

SEQ ID NO: 653880 - protein, 9 aa, Homo Sapiens
QGVGNLASP

SEQ ID NO: 653881 - protein, 9 aa, Homo Sapiens
NATVAVMSC

SEQ ID NO: 653882 - protein, 9 aa, Homo Sapiens
AAPKGKENN

SEQ ID NO: 653883 - protein, 9 aa, Homo Sapiens
HLSPSTHVM

SEQ ID NO: 653884 - protein, 9 aa, Homo Sapiens
PSLCRGLVS

SEQ ID NO: 653885 - protein, 9 aa, Homo Sapiens
YYELKITFV

SEQ ID NO: 653886 - protein, 9 aa, Homo Sapiens
FQGTGDMNS

SEQ ID NO: 653887 - protein, 9 aa, Homo Sapiens
MMVQLLRTV

SEQ ID NO: 653888 - protein, 9 aa, Homo Sapiens
CDISVDRYW

SEQ ID NO: 653889 - protein, 9 aa, Homo Sapiens
QGMPVSGVA

SEQ ID NO: 653890 - protein, 9 aa, Homo Sapiens
QHLQRHIHD

SEQ ID NO: 653891 - protein, 9 aa, Homo Sapiens
VKPTSVSGL

SEQ ID NO: 653892 - protein, 9 aa, Homo Sapiens
VFEEDGCVT

SEQ ID NO: 653893 - protein, 9 aa, Homo Sapiens
TVAVMSCSG

SEQ ID NO: 653894 - protein, 9 aa, Homo Sapiens
DLHHPIHVK

SEQ ID NO: 653895 - protein, 9 aa, Homo Sapiens
LLIVMSHDR

SEQ ID NO: 653896 - protein, 9 aa, Homo Sapiens
LAKHLGLGI

SEQ ID NO: 653897 - protein, 9 aa, Homo Sapiens
FIHKGYTHD

SEQ ID NO: 653898 - protein, 9 aa, Homo Sapiens
PPRFKRFST

SEQ ID NO: 653899 - protein, 9 aa, Homo Sapiens
LSPGLSWHA

SEQ ID NO: 653900 - protein, 9 aa, Homo Sapiens
KVLRGSVYR

SEQ ID NO: 653901 - protein, 9 aa, Homo Sapiens
NECEKTFRQ

SEQ ID NO: 653902 - protein, 9 aa, Homo Sapiens
IVMSHDRYV

SEQ ID NO: 653903 - protein, 9 aa, Homo Sapiens
FLIIASLST

SEQ ID NO: 653904 - protein, 9 aa, Homo Sapiens
GNPAPELMA

SEQ ID NO: 653905 - protein, 9 aa, Homo Sapiens
KANSGTIAL

SEQ ID NO: 653906 - protein, 9 aa, Homo Sapiens
GDGSAGPPG

SEQ ID NO: 653907 - protein, 9 aa, Homo Sapiens
CRSIVFASW

SEQ ID NO: 653908 - protein, 9 aa, Homo Sapiens
KKERIKCSR

SEQ ID NO: 653909 - protein, 9 aa, Homo Sapiens
TCPEGSNCG

SEQ ID NO: 653910 - protein, 9 aa, Homo Sapiens
LTLASLRLR

SEQ ID NO: 653911 - protein, 9 aa, Homo Sapiens
MTNPTSEIP

SEQ ID NO: 653912 - protein, 9 aa, Homo Sapiens
DLSGSTETP

SEQ ID NO: 653913 - protein, 9 aa, Homo Sapiens
KDCDGSDFG

SEQ ID NO: 653914 - protein, 9 aa, Homo Sapiens
EPGAAPHGP

SEQ ID NO: 653915 - protein, 9 aa, Homo Sapiens
VNILIVDEN

SEQ ID NO: 653916 - protein, 9 aa, Homo Sapiens
TGVDSGSEA

SEQ ID NO: 653917 - protein, 9 aa, Homo Sapiens
VQWQLAQLE

SEQ ID NO: 653918 - protein, 9 aa, Homo Sapiens
TDPRLNKPM

SEQ ID NO: 653919 - protein, 9 aa, Homo Sapiens
KADMWSVAC

SEQ ID NO: 653920 - protein, 9 aa, Homo Sapiens
SNPQLIIKP

SEQ ID NO: 653921 - protein, 9 aa, Homo Sapiens
MTSKAGLPC

SEQ ID NO: 653922 - protein, 9 aa, Homo Sapiens
VTHFAAGPG

SEQ ID NO: 653923 - protein, 9 aa, Homo Sapiens
LQPTSMWAH

SEQ ID NO: 653924 - protein, 9 aa, Homo Sapiens
HPQDLASTR

SEQ ID NO: 653925 - protein, 9 aa, Homo Sapiens
KKSGLDTSQ

SEQ ID NO: 653926 - protein, 9 aa, Homo Sapiens
TETPSSILL

SEQ ID NO: 653927 - protein, 9 aa, Homo Sapiens
GEPELERAF

SEQ ID NO: 653928 - protein, 9 aa, Homo Sapiens
RNDIEKEGM

SEQ ID NO: 653929 - protein, 9 aa, Homo Sapiens
LCDRYFSQS

SEQ ID NO: 653930 - protein, 9 aa, Homo Sapiens
ESLFAKHAL

SEQ ID NO: 653931 - protein, 9 aa, Homo Sapiens
SRMVSGQDD

SEQ ID NO: 653932 - protein, 9 aa, Homo Sapiens
AGDYSFVVF

SEQ ID NO: 653933 - protein, 9 aa, Homo Sapiens
RTHTGKNHM

SEQ ID NO: 653934 - protein, 9 aa, Homo Sapiens
TVSDFTDRN

SEQ ID NO: 653935 - protein, 9 aa, Homo Sapiens
IEDMAMKAY

SEQ ID NO: 653936 - protein, 9 aa, Homo Sapiens
TAWRACQFH

SEQ ID NO: 653937 - protein, 9 aa, Homo Sapiens
FFTHDLAFE

SEQ ID NO: 653938 - protein, 9 aa, Homo Sapiens
TYNPELDLF

SEQ ID NO: 653939 - protein, 9 aa, Homo Sapiens
IHKGYTHDA

SEQ ID NO: 653940 - protein, 9 aa, Homo Sapiens
LPDPQAMFH

SEQ ID NO: 653941 - protein, 9 aa, Homo Sapiens
YETLSWKYP

SEQ ID NO: 653942 - protein, 9 aa, Homo Sapiens
KRIHAVEKP

SEQ ID NO: 653943 - protein, 9 aa, Homo Sapiens
STNDFLLQQ

SEQ ID NO: 653944 - protein, 9 aa, Homo Sapiens
ETEDPLPPE

SEQ ID NO: 653945 - protein, 9 aa, Homo Sapiens
DKFHIPQED

SEQ ID NO: 653946 - protein, 9 aa, Homo Sapiens
SALSSHFTP

SEQ ID NO: 653947 - protein, 9 aa, Homo Sapiens
ALVSFDAWQ

SEQ ID NO: 653948 - protein, 9 aa, Homo Sapiens
FPSSCGKTN

SEQ ID NO: 653949 - protein, 9 aa, Homo Sapiens
QWQLAQLEA

SEQ ID NO: 653950 - protein, 9 aa, Homo Sapiens
NISGTEDEM

SEQ ID NO: 653951 - protein, 9 aa, Homo Sapiens
VASKLDHYK

SEQ ID NO: 653952 - protein, 9 aa, Homo Sapiens
LVGGDNPLV

SEQ ID NO: 653953 - protein, 9 aa, Homo Sapiens
PLPVFMKQL

SEQ ID NO: 653954 - protein, 9 aa, Homo Sapiens
LRAGPVTLE

SEQ ID NO: 653955 - protein, 9 aa, Homo Sapiens
GGAPMRDMG

SEQ ID NO: 653956 - protein, 9 aa, Homo Sapiens
VDIELSSVS

SEQ ID NO: 653957 - protein, 9 aa, Homo Sapiens
NTHVLQVSE

SEQ ID NO: 653958 - protein, 9 aa, Homo Sapiens
KTVNPTADP

SEQ ID NO: 653959 - protein, 9 aa, Homo Sapiens
GLSWHASVP

SEQ ID NO: 653960 - protein, 9 aa, Homo Sapiens
LFQFLFTSC

SEQ ID NO: 653961 - protein, 9 aa, Homo Sapiens
TLLSHDALG

SEQ ID NO: 653962 - protein, 9 aa, Homo Sapiens
LLVGRMDES

SEQ ID NO: 653963 - protein, 9 aa, Homo Sapiens
NFGMNHVTL

SEQ ID NO: 653964 - protein, 9 aa, Homo Sapiens
KLRSMGWGE

SEQ ID NO: 653965 - protein, 9 aa, Homo Sapiens
QKFCLVMSM

SEQ ID NO: 653966 - protein, 9 aa, Homo Sapiens
WCSSKSERT

SEQ ID NO: 653967 - protein, 9 aa, Homo Sapiens
VHAREPLRN

SEQ ID NO: 653968 - protein, 9 aa, Homo Sapiens
QQNMSLLQS

SEQ ID NO: 653969 - protein, 9 aa, Homo Sapiens
QGLNLVRQH

SEQ ID NO: 653970 - protein, 9 aa, Homo Sapiens
KGEPGVVEP

SEQ ID NO: 653971 - protein, 9 aa, Homo Sapiens
QDLFQKVIL

SEQ ID NO: 653972 - protein, 9 aa, Homo Sapiens
GAAGRTGWE

SEQ ID NO: 653973 - protein, 9 aa, Homo Sapiens
MNSKEISRQ

SEQ ID NO: 653974 - protein, 9 aa, Homo Sapiens
IMNSFVNNI

SEQ ID NO: 653975 - protein, 9 aa, Homo Sapiens
ISDAWTYTC

SEQ ID NO: 653976 - protein, 9 aa, Homo Sapiens
QSCSLTKHK

SEQ ID NO: 653977 - protein, 9 aa, Homo Sapiens
GLRAGPVTL

SEQ ID NO: 653978 - protein, 9 aa, Homo Sapiens
LQHLQRHIH

SEQ ID NO: 653979 - protein, 9 aa, Homo Sapiens
LLCQGEQLL

SEQ ID NO: 653980 - protein, 9 aa, Homo Sapiens
HDLAFEELF

SEQ ID NO: 653981 - protein, 9 aa, Homo Sapiens
TRVALNPWG

SEQ ID NO: 653982 - protein, 9 aa, Homo Sapiens
ISITQWQKI

SEQ ID NO: 653983 - protein, 9 aa, Homo Sapiens
GCESANTHV

SEQ ID NO: 653984 - protein, 9 aa, Homo Sapiens
LQGEDEPSS

SEQ ID NO: 653985 - protein, 9 aa, Homo Sapiens
PLLFVLSSS

SEQ ID NO: 653986 - protein, 9 aa, Homo Sapiens
VINTHHLSP

SEQ ID NO: 653987 - protein, 9 aa, Homo Sapiens
ESCDVFLLD

SEQ ID NO: 653988 - protein, 9 aa, Homo Sapiens
ARCSVLIKV

SEQ ID NO: 653989 - protein, 9 aa, Homo Sapiens
KFHECGKVF

SEQ ID NO: 653990 - protein, 9 aa, Homo Sapiens
GLLSAYTRP

SEQ ID NO: 653991 - protein, 9 aa, Homo Sapiens
CDVTVFIDD

SEQ ID NO: 653992 - protein, 9 aa, Homo Sapiens
LEKQLSMEQ

SEQ ID NO: 653993 - protein, 9 aa, Homo Sapiens
PHLTRTLST

SEQ ID NO: 653994 - protein, 9 aa, Homo Sapiens
TVVNGVASG

SEQ ID NO: 653995 - protein, 9 aa, Homo Sapiens
EEEEEGEGN

SEQ ID NO: 653996 - protein, 9 aa, Homo Sapiens
RYYPRGSQH

SEQ ID NO: 653997 - protein, 9 aa, Homo Sapiens
KHTNLDPVS

SEQ ID NO: 653998 - protein, 9 aa, Homo Sapiens
AVSDNESDE

SEQ ID NO: 653999 - protein, 9 aa, Homo Sapiens
PYLGQPHSR

SEQ ID NO: 654000 - protein, 9 aa, Homo Sapiens
KSVTLERSP

SEQ ID NO: 654001 - protein, 9 aa, Homo Sapiens
LGRPLSAES

SEQ ID NO: 654002 - protein, 9 aa, Homo Sapiens
RGQRPESGK

SEQ ID NO: 654003 - protein, 9 aa, Homo Sapiens
LAFLSGEAG

SEQ ID NO: 654004 - protein, 9 aa, Homo Sapiens
LFQSKSNED

SEQ ID NO: 654005 - protein, 9 aa, Homo Sapiens
KVLECIERG

SEQ ID NO: 654006 - protein, 9 aa, Homo Sapiens
AMKGRKGMV

SEQ ID NO: 654007 - protein, 9 aa, Homo Sapiens
KRSNVGLRQ

SEQ ID NO: 654008 - protein, 9 aa, Homo Sapiens
HKRIHAVEK

SEQ ID NO: 654009 - protein, 9 aa, Homo Sapiens
ELGPGGGTL

SEQ ID NO: 654010 - protein, 9 aa, Homo Sapiens
GAGSSSFSG

SEQ ID NO: 654011 - protein, 9 aa, Homo Sapiens
WGNQFPKIL

SEQ ID NO: 654012 - protein, 9 aa, Homo Sapiens
EGTYSVGTV

SEQ ID NO: 654013 - protein, 9 aa, Homo Sapiens
SAGNIMATT

SEQ ID NO: 654014 - protein, 9 aa, Homo Sapiens
SHDALGTNF

SEQ ID NO: 654015 - protein, 9 aa, Homo Sapiens
NDIEKEGMK

SEQ ID NO: 654016 - protein, 9 aa, Homo Sapiens
PSEAQQPAI

SEQ ID NO: 654017 - protein, 9 aa, Homo Sapiens
QVEHQEEQS

SEQ ID NO: 654018 - protein, 9 aa, Homo Sapiens
PDTPPGTPV

SEQ ID NO: 654019 - protein, 9 aa, Homo Sapiens
LFLVGGDNP

SEQ ID NO: 654020 - protein, 9 aa, Homo Sapiens
APLKRKDQS

SEQ ID NO: 654021 - protein, 9 aa, Homo Sapiens
NYLIQTEEQ

SEQ ID NO: 654022 - protein, 9 aa, Homo Sapiens
SMMGAPIVS

SEQ ID NO: 654023 - protein, 9 aa, Homo Sapiens
QLQYQIIFS

SEQ ID NO: 654024 - protein, 9 aa, Homo Sapiens
MMGAPIVSR

SEQ ID NO: 654025 - protein, 9 aa, Homo Sapiens
HWTPLALVT

SEQ ID NO: 654026 - protein, 9 aa, Homo Sapiens
TPCKKCLSP

SEQ ID NO: 654027 - protein, 9 aa, Homo Sapiens
PATSMESLS

SEQ ID NO: 654028 - protein, 9 aa, Homo Sapiens
SNLSSLFDF

SEQ ID NO: 654029 - protein, 9 aa, Homo Sapiens
AQTTSGSSA

SEQ ID NO: 654030 - protein, 9 aa, Homo Sapiens
AVFIHKGYT

SEQ ID NO: 654031 - protein, 9 aa, Homo Sapiens
VSGEISYSL

SEQ ID NO: 654032 - protein, 9 aa, Homo Sapiens
GKKRSKDGQ

SEQ ID NO: 654033 - protein, 9 aa, Homo Sapiens
LVELTRKLT

SEQ ID NO: 654034 - protein, 9 aa, Homo Sapiens
SARLLKIWL

SEQ ID NO: 654035 - protein, 9 aa, Homo Sapiens
GRLLLRASS

SEQ ID NO: 654036 - protein, 9 aa, Homo Sapiens
LGSEPIRAS

SEQ ID NO: 654037 - protein, 9 aa, Homo Sapiens
HVGLQEKED

SEQ ID NO: 654038 - protein, 9 aa, Homo Sapiens
HPAFQSNTG

SEQ ID NO: 654039 - protein, 9 aa, Homo Sapiens
YPCQCRAGY

SEQ ID NO: 654040 - protein, 9 aa, Homo Sapiens
IIFSIWLLA

SEQ ID NO: 654041 - protein, 9 aa, Homo Sapiens
SFAVSDNES

SEQ ID NO: 654042 - protein, 9 aa, Homo Sapiens
QVLDEQTAL

SEQ ID NO: 654043 - protein, 9 aa, Homo Sapiens
ALQLSSAVN

SEQ ID NO: 654044 - protein, 9 aa, Homo Sapiens
EKETLATQF

SEQ ID NO: 654045 - protein, 9 aa, Homo Sapiens
LPLAGSEDG

SEQ ID NO: 654046 - protein, 9 aa, Homo Sapiens
GVGAGVQGP

SEQ ID NO: 654047 - protein, 9 aa, Homo Sapiens
APSGGAPMR

SEQ ID NO: 654048 - protein, 9 aa, Homo Sapiens
PERIADCTM

SEQ ID NO: 654049 - protein, 9 aa, Homo Sapiens
AFRFAGTHA

SEQ ID NO: 654050 - protein, 9 aa, Homo Sapiens
RIGFQYGVT

SEQ ID NO: 654051 - protein, 9 aa, Homo Sapiens
GQLISYWIP

SEQ ID NO: 654052 - protein, 9 aa, Homo Sapiens
PALHALSPG

SEQ ID NO: 654053 - protein, 9 aa, Homo Sapiens
QVRLVGSTS

SEQ ID NO: 654054 - protein, 9 aa, Homo Sapiens
NDDDENGPK

SEQ ID NO: 654055 - protein, 9 aa, Homo Sapiens
RPLSAESDI

SEQ ID NO: 654056 - protein, 9 aa, Homo Sapiens
PLRALPSLR

SEQ ID NO: 654057 - protein, 9 aa, Homo Sapiens
PLALVTLLS

SEQ ID NO: 654058 - protein, 9 aa, Homo Sapiens
LPPPTAPET

SEQ ID NO: 654059 - protein, 9 aa, Homo Sapiens
SLVLVSLES

SEQ ID NO: 654060 - protein, 9 aa, Homo Sapiens
AYLAGVWGS

SEQ ID NO: 654061 - protein, 9 aa, Homo Sapiens
EVIRASLFS

SEQ ID NO: 654062 - protein, 9 aa, Homo Sapiens
NSISLLSDS

SEQ ID NO: 654063 - protein, 9 aa, Homo Sapiens
KFYLISTSY

SEQ ID NO: 654064 - protein, 9 aa, Homo Sapiens
GSNFYHPTT

SEQ ID NO: 654065 - protein, 9 aa, Homo Sapiens
TECVLLIVM

SEQ ID NO: 654066 - protein, 9 aa, Homo Sapiens
LRFAEMKQN

SEQ ID NO: 654067 - protein, 9 aa, Homo Sapiens
GMLRRLHEM

SEQ ID NO: 654068 - protein, 9 aa, Homo Sapiens
NKNVSTVEL

SEQ ID NO: 654069 - protein, 9 aa, Homo Sapiens
PSTVKKEAS

SEQ ID NO: 654070 - protein, 9 aa, Homo Sapiens
LATPVWFHV

SEQ ID NO: 654071 - protein, 9 aa, Homo Sapiens
CFCNCNDLE

SEQ ID NO: 654072 - protein, 9 aa, Homo Sapiens
LGSSSPPPL

SEQ ID NO: 654073 - protein, 9 aa, Homo Sapiens
GSTETPSSI

SEQ ID NO: 654074 - protein, 9 aa, Homo Sapiens
SQSAGCQNT

SEQ ID NO: 654075 - protein, 9 aa, Homo Sapiens
GTALLLYSR

SEQ ID NO: 654076 - protein, 9 aa, Homo Sapiens
HGDLCQLLL

SEQ ID NO: 654077 - protein, 9 aa, Homo Sapiens
EKPYKFHEC

SEQ ID NO: 654078 - protein, 9 aa, Homo Sapiens
AVKEKIAEQ

SEQ ID NO: 654079 - protein, 9 aa, Homo Sapiens
LLRASSKAS

SEQ ID NO: 654080 - protein, 9 aa, Homo Sapiens
ARREWERLK

SEQ ID NO: 654081 - protein, 9 aa, Homo Sapiens
EMSEDDVLE

SEQ ID NO: 654082 - protein, 9 aa, Homo Sapiens
PVLLQAGWC

SEQ ID NO: 654083 - protein, 9 aa, Homo Sapiens
GAGVGAGVQ

SEQ ID NO: 654084 - protein, 9 aa, Homo Sapiens
VFWLLFGSD

SEQ ID NO: 654085 - protein, 9 aa, Homo Sapiens
HRAIKITVN

SEQ ID NO: 654086 - protein, 9 aa, Homo Sapiens
HPGKITSNM

SEQ ID NO: 654087 - protein, 9 aa, Homo Sapiens
FSELWDLTE

SEQ ID NO: 654088 - protein, 9 aa, Homo Sapiens
LVMFGHCPL

SEQ ID NO: 654089 - protein, 9 aa, Homo Sapiens
DTGVSGEIS

SEQ ID NO: 654090 - protein, 9 aa, Homo Sapiens
MGAPIVSRM

SEQ ID NO: 654091 - protein, 9 aa, Homo Sapiens
SRQDSWDVV

SEQ ID NO: 654092 - protein, 9 aa, Homo Sapiens
QDLVQKLKI

SEQ ID NO: 654093 - protein, 9 aa, Homo Sapiens
AWTYTCLAT

SEQ ID NO: 654094 - protein, 9 aa, Homo Sapiens
ENLMSASGV

SEQ ID NO: 654095 - protein, 9 aa, Homo Sapiens
SVSSEGYLH

SEQ ID NO: 654096 - protein, 9 aa, Homo Sapiens
NSSSSSRQS

SEQ ID NO: 654097 - protein, 9 aa, Homo Sapiens
LEKASDKLV

SEQ ID NO: 654098 - protein, 9 aa, Homo Sapiens
DKLLASFCQ

SEQ ID NO: 654099 - protein, 9 aa, Homo Sapiens
PAFQSNTGI

SEQ ID NO: 654100 - protein, 9 aa, Homo Sapiens
DAELLRYSD

SEQ ID NO: 654101 - protein, 9 aa, Homo Sapiens
KSDGVMVCA

SEQ ID NO: 654102 - protein, 9 aa, Homo Sapiens
QIYYIESTL

SEQ ID NO: 654103 - protein, 9 aa, Homo Sapiens
EWERLKRRE

SEQ ID NO: 654104 - protein, 9 aa, Homo Sapiens
GVWGSSWPG

SEQ ID NO: 654105 - protein, 9 aa, Homo Sapiens
PTVCLSCSQ

SEQ ID NO: 654106 - protein, 9 aa, Homo Sapiens
TSQPDIVKG

SEQ ID NO: 654107 - protein, 9 aa, Homo Sapiens
NNNLHKNKP

SEQ ID NO: 654108 - protein, 9 aa, Homo Sapiens
LMGPPGIQG

SEQ ID NO: 654109 - protein, 9 aa, Homo Sapiens
RVVMLVMFG

SEQ ID NO: 654110 - protein, 9 aa, Homo Sapiens
PRLGSEPIR

SEQ ID NO: 654111 - protein, 9 aa, Homo Sapiens
ERFFPGRSN

SEQ ID NO: 654112 - protein, 9 aa, Homo Sapiens
VNYIITTFD

SEQ ID NO: 654113 - protein, 9 aa, Homo Sapiens
RKAPCSQMK

SEQ ID NO: 654114 - protein, 9 aa, Homo Sapiens
AGETRPLPL

SEQ ID NO: 654115 - protein, 9 aa, Homo Sapiens
LHHRILDFS

SEQ ID NO: 654116 - protein, 9 aa, Homo Sapiens
LGLTDCLEL

SEQ ID NO: 654117 - protein, 9 aa, Homo Sapiens
YPDANLLNA

SEQ ID NO: 654118 - protein, 9 aa, Homo Sapiens
STYSLLSLG

SEQ ID NO: 654119 - protein, 9 aa, Homo Sapiens
HTPMYVLLL

SEQ ID NO: 654120 - protein, 9 aa, Homo Sapiens
SRPSETFAR

SEQ ID NO: 654121 - protein, 9 aa, Homo Sapiens
SKGFVFVSF

SEQ ID NO: 654122 - protein, 9 aa, Homo Sapiens
QDLETEDPL

SEQ ID NO: 654123 - protein, 9 aa, Homo Sapiens
VNVAFSTNL

SEQ ID NO: 654124 - protein, 9 aa, Homo Sapiens
LQLSSAVNI

SEQ ID NO: 654125 - protein, 9 aa, Homo Sapiens
MGIFPILEE

SEQ ID NO: 654126 - protein, 9 aa, Homo Sapiens
IGKEKRLNM

SEQ ID NO: 654127 - protein, 9 aa, Homo Sapiens
KETEQMAER

SEQ ID NO: 654128 - protein, 9 aa, Homo Sapiens
CGATTTAPS

SEQ ID NO: 654129 - protein, 9 aa, Homo Sapiens
SISAGLLCQ

SEQ ID NO: 654130 - protein, 9 aa, Homo Sapiens
PKKLEYFIN

SEQ ID NO: 654131 - protein, 9 aa, Homo Sapiens
LQLHHRILD

SEQ ID NO: 654132 - protein, 9 aa, Homo Sapiens
QIIFSIWLL

SEQ ID NO: 654133 - protein, 9 aa, Homo Sapiens
PRGSQHLIS

SEQ ID NO: 654134 - protein, 9 aa, Homo Sapiens
PAALQLSSA

SEQ ID NO: 654135 - protein, 9 aa, Homo Sapiens
QEAMRKLLG

SEQ ID NO: 654136 - protein, 9 aa, Homo Sapiens
KAQIYDVVL

SEQ ID NO: 654137 - protein, 9 aa, Homo Sapiens
EIQALQELV

SEQ ID NO: 654138 - protein, 9 aa, Homo Sapiens
VQMLLTTVS

SEQ ID NO: 654139 - protein, 9 aa, Homo Sapiens
DIELSSVSA

SEQ ID NO: 654140 - protein, 9 aa, Homo Sapiens
QETCESRNH

SEQ ID NO: 654141 - protein, 9 aa, Homo Sapiens
HVMLGSLTF

SEQ ID NO: 654142 - protein, 9 aa, Homo Sapiens
TQVVWIACA

SEQ ID NO: 654143 - protein, 9 aa, Homo Sapiens
LQKIGQFCM

SEQ ID NO: 654144 - protein, 9 aa, Homo Sapiens
SKIPALQPV

SEQ ID NO: 654145 - protein, 9 aa, Homo Sapiens
SSRVPRSDC

SEQ ID NO: 654146 - protein, 9 aa, Homo Sapiens
DSTVSQYSA

SEQ ID NO: 654147 - protein, 9 aa, Homo Sapiens
NSIPTPIVT

SEQ ID NO: 654148 - protein, 9 aa, Homo Sapiens
DDHGAAEIQ

SEQ ID NO: 654149 - protein, 9 aa, Homo Sapiens
GRSVIQDFW

SEQ ID NO: 654150 - protein, 9 aa, Homo Sapiens
DLSNLQHQK

SEQ ID NO: 654151 - protein, 9 aa, Homo Sapiens
LSPSTHVMP

SEQ ID NO: 654152 - protein, 9 aa, Homo Sapiens
QAEPISDHR

SEQ ID NO: 654153 - protein, 9 aa, Homo Sapiens
AVLWLRTQL

SEQ ID NO: 654154 - protein, 9 aa, Homo Sapiens
NFYSCIGNA

SEQ ID NO: 654155 - protein, 9 aa, Homo Sapiens
CVVVPENKN

SEQ ID NO: 654156 - protein, 9 aa, Homo Sapiens
DSAPQLEAV

SEQ ID NO: 654157 - protein, 9 aa, Homo Sapiens
AAVSTIGAL

SEQ ID NO: 654158 - protein, 9 aa, Homo Sapiens
KSNSSLGEL

SEQ ID NO: 654159 - protein, 9 aa, Homo Sapiens
SNDLYQLFT

SEQ ID NO: 654160 - protein, 9 aa, Homo Sapiens
HQAEPISDH

SEQ ID NO: 654161 - protein, 9 aa, Homo Sapiens
PGGHTAVAI

SEQ ID NO: 654162 - protein, 9 aa, Homo Sapiens
QNESQVEPS

SEQ ID NO: 654163 - protein, 9 aa, Homo Sapiens
LRLPGIESR

SEQ ID NO: 654164 - protein, 9 aa, Homo Sapiens
NMSLLQSFG

SEQ ID NO: 654165 - protein, 9 aa, Homo Sapiens
SNMFLQASS

SEQ ID NO: 654166 - protein, 9 aa, Homo Sapiens
FHLRLLWRN

SEQ ID NO: 654167 - protein, 9 aa, Homo Sapiens
TNPTSEIPP

SEQ ID NO: 654168 - protein, 9 aa, Homo Sapiens
KKKEKDNKE

SEQ ID NO: 654169 - protein, 9 aa, Homo Sapiens
WEDGYYRAP

SEQ ID NO: 654170 - protein, 9 aa, Homo Sapiens
KAQGMPVSG

SEQ ID NO: 654171 - protein, 9 aa, Homo Sapiens
NLLWHQVFF

SEQ ID NO: 654172 - protein, 9 aa, Homo Sapiens
EVEAQTIKE

SEQ ID NO: 654173 - protein, 9 aa, Homo Sapiens
QDITVSDFT

SEQ ID NO: 654174 - protein, 9 aa, Homo Sapiens
ASLCDPTFI

SEQ ID NO: 654175 - protein, 9 aa, Homo Sapiens
RIDDANQRA

SEQ ID NO: 654176 - protein, 9 aa, Homo Sapiens
ICRCFCNCN

SEQ ID NO: 654177 - protein, 9 aa, Homo Sapiens
KNTSNSQWH

SEQ ID NO: 654178 - protein, 9 aa, Homo Sapiens
GYNLSLVQK

SEQ ID NO: 654179 - protein, 9 aa, Homo Sapiens
VSVLHGSHS

SEQ ID NO: 654180 - protein, 9 aa, Homo Sapiens
RRKAPCSQM

SEQ ID NO: 654181 - protein, 9 aa, Homo Sapiens
FPNKYSRFN

SEQ ID NO: 654182 - protein, 9 aa, Homo Sapiens
LRSPSSSSP

SEQ ID NO: 654183 - protein, 9 aa, Homo Sapiens
EGEGNSDQL

SEQ ID NO: 654184 - protein, 9 aa, Homo Sapiens
DKNDDDENG

SEQ ID NO: 654185 - protein, 9 aa, Homo Sapiens
KTGTMYWVI

SEQ ID NO: 654186 - protein, 9 aa, Homo Sapiens
DVKVKRITP

SEQ ID NO: 654187 - protein, 9 aa, Homo Sapiens
SQPTEANWG

SEQ ID NO: 654188 - protein, 9 aa, Homo Sapiens
LQGQHHKMR

SEQ ID NO: 654189 - protein, 9 aa, Homo Sapiens
ELTRKLTYC

SEQ ID NO: 654190 - protein, 9 aa, Homo Sapiens
MSEDDVLEN

SEQ ID NO: 654191 - protein, 9 aa, Homo Sapiens
NHHRQCLEN

SEQ ID NO: 654192 - protein, 9 aa, Homo Sapiens
QPKNRAETL

SEQ ID NO: 654193 - protein, 9 aa, Homo Sapiens
VVQVIKYCS

SEQ ID NO: 654194 - protein, 9 aa, Homo Sapiens
SENDFKHKK

SEQ ID NO: 654195 - protein, 9 aa, Homo Sapiens
KIVTCFIIG

SEQ ID NO: 654196 - protein, 9 aa, Homo Sapiens
ITGPNKSGK

SEQ ID NO: 654197 - protein, 9 aa, Homo Sapiens
LALLLVVLQ

SEQ ID NO: 654198 - protein, 9 aa, Homo Sapiens
TFRERTVRH

SEQ ID NO: 654199 - protein, 9 aa, Homo Sapiens
VMVCAVLGL

SEQ ID NO: 654200 - protein, 9 aa, Homo Sapiens
EKKTGHQRT

SEQ ID NO: 654201 - protein, 9 aa, Homo Sapiens
NLTCSDKQQ

SEQ ID NO: 654202 - protein, 9 aa, Homo Sapiens
SHVGQVITK

SEQ ID NO: 654203 - protein, 9 aa, Homo Sapiens
IKEAQWDGL

SEQ ID NO: 654204 - protein, 9 aa, Homo Sapiens
GEIAFEKPN

SEQ ID NO: 654205 - protein, 9 aa, Homo Sapiens
AVSANMTLK

SEQ ID NO: 654206 - protein, 9 aa, Homo Sapiens
DTMNTQQST

SEQ ID NO: 654207 - protein, 9 aa, Homo Sapiens
HLYYCFTSL

SEQ ID NO: 654208 - protein, 9 aa, Homo Sapiens
LIQTEEQYI

SEQ ID NO: 654209 - protein, 9 aa, Homo Sapiens
RNENKPIFL

SEQ ID NO: 654210 - protein, 9 aa, Homo Sapiens
NINFSTRYK

SEQ ID NO: 654211 - protein, 9 aa, Homo Sapiens
VHGWALTML

SEQ ID NO: 654212 - protein, 9 aa, Homo Sapiens
LATNPDVQQ

SEQ ID NO: 654213 - protein, 9 aa, Homo Sapiens
FVPPSGHSN

SEQ ID NO: 654214 - protein, 9 aa, Homo Sapiens
HRHEGVKDC

SEQ ID NO: 654215 - protein, 9 aa, Homo Sapiens
PAIHPVASN

SEQ ID NO: 654216 - protein, 9 aa, Homo Sapiens
LNAIEEEES

SEQ ID NO: 654217 - protein, 9 aa, Homo Sapiens
GTRESRKAL

SEQ ID NO: 654218 - protein, 9 aa, Homo Sapiens
EIEMVGLSK

SEQ ID NO: 654219 - protein, 9 aa, Homo Sapiens
RLLPTRKSY

SEQ ID NO: 654220 - protein, 9 aa, Homo Sapiens
NDFKHKKSF

SEQ ID NO: 654221 - protein, 9 aa, Homo Sapiens
SFYRVSYGP

SEQ ID NO: 654222 - protein, 9 aa, Homo Sapiens
LVSVSSEGY

SEQ ID NO: 654223 - protein, 9 aa, Homo Sapiens
GDPQEIRML

SEQ ID NO: 654224 - protein, 9 aa, Homo Sapiens
SLEDKKIEI

SEQ ID NO: 654225 - protein, 9 aa, Homo Sapiens
LQAVDLLHI

SEQ ID NO: 654226 - protein, 9 aa, Homo Sapiens
ALLFLNSQT

SEQ ID NO: 654227 - protein, 9 aa, Homo Sapiens
GQEEKDKDV

SEQ ID NO: 654228 - protein, 9 aa, Homo Sapiens
VLSPEGSVA

SEQ ID NO: 654229 - protein, 9 aa, Homo Sapiens
LQCTAKSSV

SEQ ID NO: 654230 - protein, 9 aa, Homo Sapiens
QITLKLKQK

SEQ ID NO: 654231 - protein, 9 aa, Homo Sapiens
LQRAMKLQK

SEQ ID NO: 654232 - protein, 9 aa, Homo Sapiens
APQTGSRPS

SEQ ID NO: 654233 - protein, 9 aa, Homo Sapiens
PMYVLLLTL

SEQ ID NO: 654234 - protein, 9 aa, Homo Sapiens
TATGEIEVQ

SEQ ID NO: 654235 - protein, 9 aa, Homo Sapiens
LYVAFAKFQ

SEQ ID NO: 654236 - protein, 9 aa, Homo Sapiens
HYTRDLGHH

SEQ ID NO: 654237 - protein, 9 aa, Homo Sapiens
VYDEIEVFQ

SEQ ID NO: 654238 - protein, 9 aa, Homo Sapiens
IHRLITIAD

SEQ ID NO: 654239 - protein, 9 aa, Homo Sapiens
STPTVCLSC

SEQ ID NO: 654240 - protein, 9 aa, Homo Sapiens
LLSHDALGT

SEQ ID NO: 654241 - protein, 9 aa, Homo Sapiens
KCVHHNPSK

SEQ ID NO: 654242 - protein, 9 aa, Homo Sapiens
LQTIGFAAE

SEQ ID NO: 654243 - protein, 9 aa, Homo Sapiens
GKPCGGHDC

SEQ ID NO: 654244 - protein, 9 aa, Homo Sapiens
YLAGVWGSS

SEQ ID NO: 654245 - protein, 9 aa, Homo Sapiens
RVYGIKYQT

SEQ ID NO: 654246 - protein, 9 aa, Homo Sapiens
DGQEEKDKD

SEQ ID NO: 654247 - protein, 9 aa, Homo Sapiens
TETCPEGSN

SEQ ID NO: 654248 - protein, 9 aa, Homo Sapiens
CTDITSIIC

SEQ ID NO: 654249 - protein, 9 aa, Homo Sapiens
HLGECGHLD

SEQ ID NO: 654250 - protein, 9 aa, Homo Sapiens
RSPRRRLQG

SEQ ID NO: 654251 - protein, 9 aa, Homo Sapiens
QVSYDQNEI

SEQ ID NO: 654252 - protein, 9 aa, Homo Sapiens
IQDLGVRFL

SEQ ID NO: 654253 - protein, 9 aa, Homo Sapiens
GRKHARFPS

SEQ ID NO: 654254 - protein, 9 aa, Homo Sapiens
AHIMELHVQ

SEQ ID NO: 654255 - protein, 9 aa, Homo Sapiens
NFYHPTTFS

SEQ ID NO: 654256 - protein, 9 aa, Homo Sapiens
SALKDPLQS

SEQ ID NO: 654257 - protein, 9 aa, Homo Sapiens
YPFTYRALA

SEQ ID NO: 654258 - protein, 9 aa, Homo Sapiens
LQASLKVYG

SEQ ID NO: 654259 - protein, 9 aa, Homo Sapiens
CGVEAIQEA

SEQ ID NO: 654260 - protein, 9 aa, Homo Sapiens
ECLLLGIMA

SEQ ID NO: 654261 - protein, 9 aa, Homo Sapiens
QLSEFVPLD

SEQ ID NO: 654262 - protein, 9 aa, Homo Sapiens
PFTYRALAH

SEQ ID NO: 654263 - protein, 9 aa, Homo Sapiens
QLEAVLRRQ

SEQ ID NO: 654264 - protein, 9 aa, Homo Sapiens
YSEVLGIKM

SEQ ID NO: 654265 - protein, 9 aa, Homo Sapiens
EVDEAAAEC

SEQ ID NO: 654266 - protein, 9 aa, Homo Sapiens
YRIPCLDLG

SEQ ID NO: 654267 - protein, 9 aa, Homo Sapiens
REDDHGAAE

SEQ ID NO: 654268 - protein, 9 aa, Homo Sapiens
HPCNASIEC

SEQ ID NO: 654269 - protein, 9 aa, Homo Sapiens
DTFRKIVYS

SEQ ID NO: 654270 - protein, 9 aa, Homo Sapiens
AGTALLLYS

SEQ ID NO: 654271 - protein, 9 aa, Homo Sapiens
RRPSRADPN

SEQ ID NO: 654272 - protein, 9 aa, Homo Sapiens
KEFTVQIKH

SEQ ID NO: 654273 - protein, 9 aa, Homo Sapiens
RYVVVLVTN

SEQ ID NO: 654274 - protein, 9 aa, Homo Sapiens
DGSAGPPGE

SEQ ID NO: 654275 - protein, 9 aa, Homo Sapiens
GPLKAEPAH

SEQ ID NO: 654276 - protein, 9 aa, Homo Sapiens
EMVGLSKRL

SEQ ID NO: 654277 - protein, 9 aa, Homo Sapiens
SSTPLAANR

SEQ ID NO: 654278 - protein, 9 aa, Homo Sapiens
DWEWCSSKS

SEQ ID NO: 654279 - protein, 9 aa, Homo Sapiens
LPSTVKKEA

SEQ ID NO: 654280 - protein, 9 aa, Homo Sapiens
RFKRFSTSA

SEQ ID NO: 654281 - protein, 9 aa, Homo Sapiens
SEVLGIKMP

SEQ ID NO: 654282 - protein, 9 aa, Homo Sapiens
QLACTDITS

SEQ ID NO: 654283 - protein, 9 aa, Homo Sapiens
MASQPTEAN

SEQ ID NO: 654284 - protein, 9 aa, Homo Sapiens
RRWFFTIHP

SEQ ID NO: 654285 - protein, 9 aa, Homo Sapiens
HYPVVMSRK

SEQ ID NO: 654286 - protein, 9 aa, Homo Sapiens
LRNSIPTPI

SEQ ID NO: 654287 - protein, 9 aa, Homo Sapiens
IGLIMGGML

SEQ ID NO: 654288 - protein, 9 aa, Homo Sapiens
AQYRHMMDR

SEQ ID NO: 654289 - protein, 9 aa, Homo Sapiens
SAYHPTKSH

SEQ ID NO: 654290 - protein, 9 aa, Homo Sapiens
EETNSCTCP

SEQ ID NO: 654291 - protein, 9 aa, Homo Sapiens
VYSKYFGRG

SEQ ID NO: 654292 - protein, 9 aa, Homo Sapiens
ARRKLREYD

SEQ ID NO: 654293 - protein, 9 aa, Homo Sapiens
FGAGTNTYL

SEQ ID NO: 654294 - protein, 9 aa, Homo Sapiens
LNPWGARIP

SEQ ID NO: 654295 - protein, 9 aa, Homo Sapiens
SFLYLEPLG

SEQ ID NO: 654296 - protein, 9 aa, Homo Sapiens
NFSLTKSSV

SEQ ID NO: 654297 - protein, 9 aa, Homo Sapiens
SRKEPEQLR

SEQ ID NO: 654298 - protein, 9 aa, Homo Sapiens
ILGKYMEQG

SEQ ID NO: 654299 - protein, 9 aa, Homo Sapiens
KKMDGYNLS

SEQ ID NO: 654300 - protein, 9 aa, Homo Sapiens
KVRRPSRAD

SEQ ID NO: 654301 - protein, 9 aa, Homo Sapiens
NPTSEIPPD

SEQ ID NO: 654302 - protein, 9 aa, Homo Sapiens
SGGYPQFAP

SEQ ID NO: 654303 - protein, 9 aa, Homo Sapiens
SNLVALGYQ

SEQ ID NO: 654304 - protein, 9 aa, Homo Sapiens
IIIVVMWVW

SEQ ID NO: 654305 - protein, 9 aa, Homo Sapiens
NADNSSSAF

SEQ ID NO: 654306 - protein, 9 aa, Homo Sapiens
VTMSKKNQD

SEQ ID NO: 654307 - protein, 9 aa, Homo Sapiens
IFYDRWALG

SEQ ID NO: 654308 - protein, 9 aa, Homo Sapiens
SMGWGEEFS

SEQ ID NO: 654309 - protein, 9 aa, Homo Sapiens
GETRPLPLG

SEQ ID NO: 654310 - protein, 9 aa, Homo Sapiens
FIIYELATN

SEQ ID NO: 654311 - protein, 9 aa, Homo Sapiens
QNKIDQELE

SEQ ID NO: 654312 - protein, 9 aa, Homo Sapiens
PYKFHECGK

SEQ ID NO: 654313 - protein, 9 aa, Homo Sapiens
HSNPMNPTI

SEQ ID NO: 654314 - protein, 9 aa, Homo Sapiens
PTKQDSQLR

SEQ ID NO: 654315 - protein, 9 aa, Homo Sapiens
NPDLLQLHH

SEQ ID NO: 654316 - protein, 9 aa, Homo Sapiens
QVGSIPLVD

SEQ ID NO: 654317 - protein, 9 aa, Homo Sapiens
NIVHKKKER

SEQ ID NO: 654318 - protein, 9 aa, Homo Sapiens
ANMTLKGQS

SEQ ID NO: 654319 - protein, 9 aa, Homo Sapiens
IVGVVVKAN

SEQ ID NO: 654320 - protein, 9 aa, Homo Sapiens
SLVMKDSFL

SEQ ID NO: 654321 - protein, 9 aa, Homo Sapiens
LVVSVLFLF

SEQ ID NO: 654322 - protein, 9 aa, Homo Sapiens
HLLTQEEDY

SEQ ID NO: 654323 - protein, 9 aa, Homo Sapiens
WLPHWTPLA

SEQ ID NO: 654324 - protein, 9 aa, Homo Sapiens
EMLKATMSL

SEQ ID NO: 654325 - protein, 9 aa, Homo Sapiens
HCVKYDFHP

SEQ ID NO: 654326 - protein, 9 aa, Homo Sapiens
CEWEDGYYR

SEQ ID NO: 654327 - protein, 9 aa, Homo Sapiens
GLVIRVAGF

SEQ ID NO: 654328 - protein, 9 aa, Homo Sapiens
LIIKDLTEE

SEQ ID NO: 654329 - protein, 9 aa, Homo Sapiens
IINDTEDDP

SEQ ID NO: 654330 - protein, 9 aa, Homo Sapiens
LVFNVPGIF

SEQ ID NO: 654331 - protein, 9 aa, Homo Sapiens
LNPEHQEKC

SEQ ID NO: 654332 - protein, 9 aa, Homo Sapiens
WVSSILNVE

SEQ ID NO: 654333 - protein, 9 aa, Homo Sapiens
LQVTQAKKC

SEQ ID NO: 654334 - protein, 9 aa, Homo Sapiens
ACKLDAYSK

SEQ ID NO: 654335 - protein, 9 aa, Homo Sapiens
VLGEQNDNR

SEQ ID NO: 654336 - protein, 9 aa, Homo Sapiens
GRMDESLGL

SEQ ID NO: 654337 - protein, 9 aa, Homo Sapiens
DDWREFQTL

SEQ ID NO: 654338 - protein, 9 aa, Homo Sapiens
SPHTVSSPL

SEQ ID NO: 654339 - protein, 9 aa, Homo Sapiens
LIFNFLASY

SEQ ID NO: 654340 - protein, 9 aa, Homo Sapiens
CSISAGLLC

SEQ ID NO: 654341 - protein, 9 aa, Homo Sapiens
SEFVPLDYS

SEQ ID NO: 654342 - protein, 9 aa, Homo Sapiens
PSSPEEHVM

SEQ ID NO: 654343 - protein, 9 aa, Homo Sapiens
NLSSLFDFQ

SEQ ID NO: 654344 - protein, 9 aa, Homo Sapiens
LGKRSQGHS

SEQ ID NO: 654345 - protein, 9 aa, Homo Sapiens
EANWGHRTS

SEQ ID NO: 654346 - protein, 9 aa, Homo Sapiens
TQDIAVHGW

SEQ ID NO: 654347 - protein, 9 aa, Homo Sapiens
YRLTIRASD

SEQ ID NO: 654348 - protein, 9 aa, Homo Sapiens
IEEREMRFP

SEQ ID NO: 654349 - protein, 9 aa, Homo Sapiens
IADLRKDSK

SEQ ID NO: 654350 - protein, 9 aa, Homo Sapiens
GPAGVLYGI

SEQ ID NO: 654351 - protein, 9 aa, Homo Sapiens
AFAKFQENQ

SEQ ID NO: 654352 - protein, 9 aa, Homo Sapiens
ESSPAKPDS

SEQ ID NO: 654353 - protein, 9 aa, Homo Sapiens
GAPKAISGV

SEQ ID NO: 654354 - protein, 9 aa, Homo Sapiens
KKKVSARLL

SEQ ID NO: 654355 - protein, 9 aa, Homo Sapiens
VSNPQLIIK

SEQ ID NO: 654356 - protein, 9 aa, Homo Sapiens
LLFVLSSSS

SEQ ID NO: 654357 - protein, 9 aa, Homo Sapiens
LLRIAHKFT

SEQ ID NO: 654358 - protein, 9 aa, Homo Sapiens
RNTDSYLLA

SEQ ID NO: 654359 - protein, 9 aa, Homo Sapiens
LQKFCLVMS

SEQ ID NO: 654360 - protein, 9 aa, Homo Sapiens
AQVDLVVQD

SEQ ID NO: 654361 - protein, 9 aa, Homo Sapiens
HHAHRTQGF

SEQ ID NO: 654362 - protein, 9 aa, Homo Sapiens
NDLFLVAVL

SEQ ID NO: 654363 - protein, 9 aa, Homo Sapiens
IKFFAPDPE

SEQ ID NO: 654364 - protein, 9 aa, Homo Sapiens
VAPTVETSN

SEQ ID NO: 654365 - protein, 9 aa, Homo Sapiens
TPPGTPVVS

SEQ ID NO: 654366 - protein, 9 aa, Homo Sapiens
PKMGPASWL

SEQ ID NO: 654367 - protein, 9 aa, Homo Sapiens
EKGKMVAVF

SEQ ID NO: 654368 - protein, 9 aa, Homo Sapiens
EMDLRFAEM

SEQ ID NO: 654369 - protein, 9 aa, Homo Sapiens
DTCYYWEKC

SEQ ID NO: 654370 - protein, 9 aa, Homo Sapiens
MEVAISNIM

SEQ ID NO: 654371 - protein, 9 aa, Homo Sapiens
QYCSGVEST

SEQ ID NO: 654372 - protein, 9 aa, Homo Sapiens
GDSPHTVSS

SEQ ID NO: 654373 - protein, 9 aa, Homo Sapiens
ALEQAACKL

SEQ ID NO: 654374 - protein, 9 aa, Homo Sapiens
ETLATQFDL

SEQ ID NO: 654375 - protein, 9 aa, Homo Sapiens
YYCFTSLWW

SEQ ID NO: 654376 - protein, 9 aa, Homo Sapiens
RVAAAVSKT

SEQ ID NO: 654377 - protein, 9 aa, Homo Sapiens
HYGNNFGYV

SEQ ID NO: 654378 - protein, 9 aa, Homo Sapiens
QLSMEQKNR

SEQ ID NO: 654379 - protein, 9 aa, Homo Sapiens
LLAFLSGEA

SEQ ID NO: 654380 - protein, 9 aa, Homo Sapiens
IVKGGAVYY

SEQ ID NO: 654381 - protein, 9 aa, Homo Sapiens
DLYQLFTLT

SEQ ID NO: 654382 - protein, 9 aa, Homo Sapiens
STETPSSIL

SEQ ID NO: 654383 - protein, 9 aa, Homo Sapiens
DEVTEEELL

SEQ ID NO: 654384 - protein, 9 aa, Homo Sapiens
FWKTANPKE

SEQ ID NO: 654385 - protein, 9 aa, Homo Sapiens
VAVLELGHA

SEQ ID NO: 654386 - protein, 9 aa, Homo Sapiens
DEEKIQSED

SEQ ID NO: 654387 - protein, 9 aa, Homo Sapiens
LEDRCPRRT

SEQ ID NO: 654388 - protein, 9 aa, Homo Sapiens
AKNILGKYM

SEQ ID NO: 654389 - protein, 9 aa, Homo Sapiens
CLELQSLLF

SEQ ID NO: 654390 - protein, 9 aa, Homo Sapiens
KCSRDFLLK

SEQ ID NO: 654391 - protein, 9 aa, Homo Sapiens
EALIVRRRL

SEQ ID NO: 654392 - protein, 9 aa, Homo Sapiens
PHSLYPFTY

SEQ ID NO: 654393 - protein, 9 aa, Homo Sapiens
IKNFSLTKS

SEQ ID NO: 654394 - protein, 9 aa, Homo Sapiens
LVHYFVAEL

SEQ ID NO: 654395 - protein, 9 aa, Homo Sapiens
SLYPFTYRA

SEQ ID NO: 654396 - protein, 9 aa, Homo Sapiens
TVKKEASED

SEQ ID NO: 654397 - protein, 9 aa, Homo Sapiens
SPSPTTLAF

SEQ ID NO: 654398 - protein, 9 aa, Homo Sapiens
KGRKYPPVD

SEQ ID NO: 654399 - protein, 9 aa, Homo Sapiens
PEAVKEKIA

SEQ ID NO: 654400 - protein, 9 aa, Homo Sapiens
LFLVAVLEL

SEQ ID NO: 654401 - protein, 9 aa, Homo Sapiens
YLAYLAGVW

SEQ ID NO: 654402 - protein, 9 aa, Homo Sapiens
PQFAPAVYS

SEQ ID NO: 654403 - protein, 9 aa, Homo Sapiens
HDALGTNFS

SEQ ID NO: 654404 - protein, 9 aa, Homo Sapiens
LNKLLQNWT

SEQ ID NO: 654405 - protein, 9 aa, Homo Sapiens
SSAGNIMAT

SEQ ID NO: 654406 - protein, 9 aa, Homo Sapiens
GKGILSGHT

SEQ ID NO: 654407 - protein, 9 aa, Homo Sapiens
SRKPTAGET

SEQ ID NO: 654408 - protein, 9 aa, Homo Sapiens
GSGGGIMSK

SEQ ID NO: 654409 - protein, 9 aa, Homo Sapiens
ENGGYICYP

SEQ ID NO: 654410 - protein, 9 aa, Homo Sapiens
VVKVTAPET

SEQ ID NO: 654411 - protein, 9 aa, Homo Sapiens
TFDTMNTQQ

SEQ ID NO: 654412 - protein, 9 aa, Homo Sapiens
RRRGSGGGI

SEQ ID NO: 654413 - protein, 9 aa, Homo Sapiens
DENDNAPAI

SEQ ID NO: 654414 - protein, 9 aa, Homo Sapiens
KFCLVMSMM

SEQ ID NO: 654415 - protein, 9 aa, Homo Sapiens
AGARVAGFS

SEQ ID NO: 654416 - protein, 9 aa, Homo Sapiens
LRKDSKNLG

SEQ ID NO: 654417 - protein, 9 aa, Homo Sapiens
TIGALCLEL

SEQ ID NO: 654418 - protein, 9 aa, Homo Sapiens
TMRLLPTRK

SEQ ID NO: 654419 - protein, 9 aa, Homo Sapiens
DLLDLVASI

SEQ ID NO: 654420 - protein, 9 aa, Homo Sapiens
NVGLRQLTV

SEQ ID NO: 654421 - protein, 9 aa, Homo Sapiens
EPLHQVTES

SEQ ID NO: 654422 - protein, 9 aa, Homo Sapiens
VFITETASQ

SEQ ID NO: 654423 - protein, 9 aa, Homo Sapiens
SLRLPGIES

SEQ ID NO: 654424 - protein, 9 aa, Homo Sapiens
NYIITTFDS

SEQ ID NO: 654425 - protein, 9 aa, Homo Sapiens
FRILADTPQ

SEQ ID NO: 654426 - protein, 9 aa, Homo Sapiens
LNIIITHAY

SEQ ID NO: 654427 - protein, 9 aa, Homo Sapiens
AQKQFNNFQ

SEQ ID NO: 654428 - protein, 9 aa, Homo Sapiens
GQRPESGKE

SEQ ID NO: 654429 - protein, 9 aa, Homo Sapiens
VGRLLPHLA

SEQ ID NO: 654430 - protein, 9 aa, Homo Sapiens
NRHNHGDSD

SEQ ID NO: 654431 - protein, 9 aa, Homo Sapiens
TLGSATNFN

SEQ ID NO: 654432 - protein, 9 aa, Homo Sapiens
AVHGWALTM

SEQ ID NO: 654433 - protein, 9 aa, Homo Sapiens
DTDDTSKKI

SEQ ID NO: 654434 - protein, 9 aa, Homo Sapiens
NTYLQPKPH

SEQ ID NO: 654435 - protein, 9 aa, Homo Sapiens
SIDTSSLGA

SEQ ID NO: 654436 - protein, 9 aa, Homo Sapiens
CKINALRAK

SEQ ID NO: 654437 - protein, 9 aa, Homo Sapiens
FCDITQVVW

SEQ ID NO: 654438 - protein, 9 aa, Homo Sapiens
SNVGLRQLT

SEQ ID NO: 654439 - protein, 9 aa, Homo Sapiens
QNHLNTSHH

SEQ ID NO: 654440 - protein, 9 aa, Homo Sapiens
QTGFPNKYS

SEQ ID NO: 654441 - protein, 9 aa, Homo Sapiens
SATTNDTAA

SEQ ID NO: 654442 - protein, 9 aa, Homo Sapiens
TNDSLTLFQ

SEQ ID NO: 654443 - protein, 9 aa, Homo Sapiens
QLISYWIPK

SEQ ID NO: 654444 - protein, 9 aa, Homo Sapiens
LAAAFPSSC

SEQ ID NO: 654445 - protein, 9 aa, Homo Sapiens
HDHMSGWCE

SEQ ID NO: 654446 - protein, 9 aa, Homo Sapiens
RSWSPSVLP

SEQ ID NO: 654447 - protein, 9 aa, Homo Sapiens
LEPPKGQDE

SEQ ID NO: 654448 - protein, 9 aa, Homo Sapiens
GTNFSSRPW

SEQ ID NO: 654449 - protein, 9 aa, Homo Sapiens
QHMNTKRAI

SEQ ID NO: 654450 - protein, 9 aa, Homo Sapiens
RNKVMTLLH

SEQ ID NO: 654451 - protein, 9 aa, Homo Sapiens
FVLSPEGSV

SEQ ID NO: 654452 - protein, 9 aa, Homo Sapiens
FHSKEVWAG

SEQ ID NO: 654453 - protein, 9 aa, Homo Sapiens
AFFIDKVRF

SEQ ID NO: 654454 - protein, 9 aa, Homo Sapiens
GGYPQFAPA

SEQ ID NO: 654455 - protein, 9 aa, Homo Sapiens
LHIPLQKFC

SEQ ID NO: 654456 - protein, 9 aa, Homo Sapiens
SSNSSSSSR

SEQ ID NO: 654457 - protein, 9 aa, Homo Sapiens
KGTWRPCRS

SEQ ID NO: 654458 - protein, 9 aa, Homo Sapiens
DGVMVCAVL

SEQ ID NO: 654459 - protein, 9 aa, Homo Sapiens
PGSRVLALL

SEQ ID NO: 654460 - protein, 9 aa, Homo Sapiens
NIVYWVFML

SEQ ID NO: 654461 - protein, 9 aa, Homo Sapiens
KPLPLLTDF

SEQ ID NO: 654462 - protein, 9 aa, Homo Sapiens
PLTISKLVY

SEQ ID NO: 654463 - protein, 9 aa, Homo Sapiens
SKTVNPTAD

SEQ ID NO: 654464 - protein, 9 aa, Homo Sapiens
FFLHKEFLL

SEQ ID NO: 654465 - protein, 9 aa, Homo Sapiens
DAISPPTLT

SEQ ID NO: 654466 - protein, 9 aa, Homo Sapiens
LECFQKSGH

SEQ ID NO: 654467 - protein, 9 aa, Homo Sapiens
SEVENLKQK

SEQ ID NO: 654468 - protein, 9 aa, Homo Sapiens
FGKHVSHVV

SEQ ID NO: 654469 - protein, 9 aa, Homo Sapiens
KCLDFNNCG

SEQ ID NO: 654470 - protein, 9 aa, Homo Sapiens
ATTNDTAAN

SEQ ID NO: 654471 - protein, 9 aa, Homo Sapiens
TLASLRLRE

SEQ ID NO: 654472 - protein, 9 aa, Homo Sapiens
VAIFYDRWA

SEQ ID NO: 654473 - protein, 9 aa, Homo Sapiens
AAATGISFT

SEQ ID NO: 654474 - protein, 9 aa, Homo Sapiens
QKSGHCTAC

SEQ ID NO: 654475 - protein, 9 aa, Homo Sapiens
SQGAHLSSV

SEQ ID NO: 654476 - protein, 9 aa, Homo Sapiens
EPISDHRMP

SEQ ID NO: 654477 - protein, 9 aa, Homo Sapiens
YEENIFMYG

SEQ ID NO: 654478 - protein, 9 aa, Homo Sapiens
LRKTNASLC

SEQ ID NO: 654479 - protein, 9 aa, Homo Sapiens
IEIEMVGLS

SEQ ID NO: 654480 - protein, 9 aa, Homo Sapiens
RKALRARLT

SEQ ID NO: 654481 - protein, 9 aa, Homo Sapiens
AVMHAQTTS

SEQ ID NO: 654482 - protein, 9 aa, Homo Sapiens
QEIRMLIHK

SEQ ID NO: 654483 - protein, 9 aa, Homo Sapiens
NPYADDPVR

SEQ ID NO: 654484 - protein, 9 aa, Homo Sapiens
ILGNIEETC

SEQ ID NO: 654485 - protein, 9 aa, Homo Sapiens
TSHHALEIR

SEQ ID NO: 654486 - protein, 9 aa, Homo Sapiens
MYWVIVRSE

SEQ ID NO: 654487 - protein, 9 aa, Homo Sapiens
QLVELGPGG

SEQ ID NO: 654488 - protein, 9 aa, Homo Sapiens
GPVTLEPTE

SEQ ID NO: 654489 - protein, 9 aa, Homo Sapiens
RPDKVLECI

SEQ ID NO: 654490 - protein, 9 aa, Homo Sapiens
GQRELIIAD

SEQ ID NO: 654491 - protein, 9 aa, Homo Sapiens
PRDATSSPP

SEQ ID NO: 654492 - protein, 9 aa, Homo Sapiens
KPYKFHECG

SEQ ID NO: 654493 - protein, 9 aa, Homo Sapiens
SRKHAERQL

SEQ ID NO: 654494 - protein, 9 aa, Homo Sapiens
NDLYQLFTL

SEQ ID NO: 654495 - protein, 9 aa, Homo Sapiens
QFNNFQIEV

SEQ ID NO: 654496 - protein, 9 aa, Homo Sapiens
VKISQPKNR

SEQ ID NO: 654497 - protein, 9 aa, Homo Sapiens
KIEALSAED

SEQ ID NO: 654498 - protein, 9 aa, Homo Sapiens
ISLLVPWLY

SEQ ID NO: 654499 - protein, 9 aa, Homo Sapiens
TCESRNHID

SEQ ID NO: 654500 - protein, 9 aa, Homo Sapiens
DFNNCGLTT

SEQ ID NO: 654501 - protein, 9 aa, Homo Sapiens
SIFHDCEAG

SEQ ID NO: 654502 - protein, 9 aa, Homo Sapiens
YLQVEHQEE

SEQ ID NO: 654503 - protein, 9 aa, Homo Sapiens
RLRHACCHP

SEQ ID NO: 654504 - protein, 9 aa, Homo Sapiens
RIPAGARVA

SEQ ID NO: 654505 - protein, 9 aa, Homo Sapiens
VRQHHELCD

SEQ ID NO: 654506 - protein, 9 aa, Homo Sapiens
KMGPASWLR

SEQ ID NO: 654507 - protein, 9 aa, Homo Sapiens
DQNESQVEP

SEQ ID NO: 654508 - protein, 9 aa, Homo Sapiens
VRRRLSKLQ

SEQ ID NO: 654509 - protein, 9 aa, Homo Sapiens
CYSGWYCYG

SEQ ID NO: 654510 - protein, 9 aa, Homo Sapiens
AHLSSVASK

SEQ ID NO: 654511 - protein, 9 aa, Homo Sapiens
IEEEESNNN

SEQ ID NO: 654512 - protein, 9 aa, Homo Sapiens
SLRNLNIII

SEQ ID NO: 654513 - protein, 9 aa, Homo Sapiens
QTIKELKQQ

SEQ ID NO: 654514 - protein, 9 aa, Homo Sapiens
QFHLLLPGL

SEQ ID NO: 654515 - protein, 9 aa, Homo Sapiens
PETQAKPSA

SEQ ID NO: 654516 - protein, 9 aa, Homo Sapiens
RHMRMHTGV

SEQ ID NO: 654517 - protein, 9 aa, Homo Sapiens
SLHLLDNAD

SEQ ID NO: 654518 - protein, 9 aa, Homo Sapiens
AIFYDRWAL

SEQ ID NO: 654519 - protein, 9 aa, Homo Sapiens
SGGDGSAGP

SEQ ID NO: 654520 - protein, 9 aa, Homo Sapiens
DIGKEKRLN

SEQ ID NO: 654521 - protein, 9 aa, Homo Sapiens
PCRSIVFAS

SEQ ID NO: 654522 - protein, 9 aa, Homo Sapiens
IVLFKKFYL

SEQ ID NO: 654523 - protein, 9 aa, Homo Sapiens
AITACVEPI

SEQ ID NO: 654524 - protein, 9 aa, Homo Sapiens
QRKIEALSA

SEQ ID NO: 654525 - protein, 9 aa, Homo Sapiens
APRDATSSP

SEQ ID NO: 654526 - protein, 9 aa, Homo Sapiens
TEDSANEEM

SEQ ID NO: 654527 - protein, 9 aa, Homo Sapiens
VYRRSHSQA

SEQ ID NO: 654528 - protein, 9 aa, Homo Sapiens
EEDTEALTW

SEQ ID NO: 654529 - protein, 9 aa, Homo Sapiens
RSSLQAVDL

SEQ ID NO: 654530 - protein, 9 aa, Homo Sapiens
IFTKAFKRD

SEQ ID NO: 654531 - protein, 9 aa, Homo Sapiens
ITGYHISWE

SEQ ID NO: 654532 - protein, 9 aa, Homo Sapiens
LKKLDLVNV

SEQ ID NO: 654533 - protein, 9 aa, Homo Sapiens
RAGGTRVAL

SEQ ID NO: 654534 - protein, 9 aa, Homo Sapiens
CGHLDPAEE

SEQ ID NO: 654535 - protein, 9 aa, Homo Sapiens
LAAVPAQLR

SEQ ID NO: 654536 - protein, 9 aa, Homo Sapiens
TVQIKHEEG

SEQ ID NO: 654537 - protein, 9 aa, Homo Sapiens
SVWLISKTG

SEQ ID NO: 654538 - protein, 9 aa, Homo Sapiens
MSLGRLLLR

SEQ ID NO: 654539 - protein, 9 aa, Homo Sapiens
MTLLHEKFY

SEQ ID NO: 654540 - protein, 9 aa, Homo Sapiens
CSDADPSTN

SEQ ID NO: 654541 - protein, 9 aa, Homo Sapiens
EEDEEKIQS

SEQ ID NO: 654542 - protein, 9 aa, Homo Sapiens
HHTIILAQQ

SEQ ID NO: 654543 - protein, 9 aa, Homo Sapiens
LFTCCKCRK

SEQ ID NO: 654544 - protein, 9 aa, Homo Sapiens
LSSVASKEE

SEQ ID NO: 654545 - protein, 9 aa, Homo Sapiens
YLIQTEEQY

SEQ ID NO: 654546 - protein, 9 aa, Homo Sapiens
AGLRAGPVT

SEQ ID NO: 654547 - protein, 9 aa, Homo Sapiens
ALNPEHQEK

SEQ ID NO: 654548 - protein, 9 aa, Homo Sapiens
WKYKNFATS

SEQ ID NO: 654549 - protein, 9 aa, Homo Sapiens
SQDLYTIRS

SEQ ID NO: 654550 - protein, 9 aa, Homo Sapiens
TAKSSVKES

SEQ ID NO: 654551 - protein, 9 aa, Homo Sapiens
NQKSFYRVS

SEQ ID NO: 654552 - protein, 9 aa, Homo Sapiens
IKELKQQKS

SEQ ID NO: 654553 - protein, 9 aa, Homo Sapiens
WIACANTFP

SEQ ID NO: 654554 - protein, 9 aa, Homo Sapiens
LCHLWLMPD

SEQ ID NO: 654555 - protein, 9 aa, Homo Sapiens
TLICQNCQH

SEQ ID NO: 654556 - protein, 9 aa, Homo Sapiens
SQRNLGKRS

SEQ ID NO: 654557 - protein, 9 aa, Homo Sapiens
ATAVPRATI

SEQ ID NO: 654558 - protein, 9 aa, Homo Sapiens
VDTVVIYMP

SEQ ID NO: 654559 - protein, 9 aa, Homo Sapiens
TYSLLSLGP

SEQ ID NO: 654560 - protein, 9 aa, Homo Sapiens
CVGGEVEKA

SEQ ID NO: 654561 - protein, 9 aa, Homo Sapiens
IDKILEPPK

SEQ ID NO: 654562 - protein, 9 aa, Homo Sapiens
KILWEDLHN

SEQ ID NO: 654563 - protein, 9 aa, Homo Sapiens
DEMVSTKLQ

SEQ ID NO: 654564 - protein, 9 aa, Homo Sapiens
HGSHSGPSY

SEQ ID NO: 654565 - protein, 9 aa, Homo Sapiens
VSRASFCPR

SEQ ID NO: 654566 - protein, 9 aa, Homo Sapiens
KDGQKEKFK

SEQ ID NO: 654567 - protein, 9 aa, Homo Sapiens
ETEKFGQWV

SEQ ID NO: 654568 - protein, 9 aa, Homo Sapiens
TDLFTCCKC

SEQ ID NO: 654569 - protein, 9 aa, Homo Sapiens
LRLLWRNLL

SEQ ID NO: 654570 - protein, 9 aa, Homo Sapiens
VESTISSLD

SEQ ID NO: 654571 - protein, 9 aa, Homo Sapiens
CQAIASDVD

SEQ ID NO: 654572 - protein, 9 aa, Homo Sapiens
GLRQLTVWN

SEQ ID NO: 654573 - protein, 9 aa, Homo Sapiens
LRCALRSQR

SEQ ID NO: 654574 - protein, 9 aa, Homo Sapiens
VLLIFFIYL

SEQ ID NO: 654575 - protein, 9 aa, Homo Sapiens
DKEVKWTIE

SEQ ID NO: 654576 - protein, 9 aa, Homo Sapiens
PQEIRMLIH

SEQ ID NO: 654577 - protein, 9 aa, Homo Sapiens
GSATNFNQG

SEQ ID NO: 654578 - protein, 9 aa, Homo Sapiens
FPTKQDSQL

SEQ ID NO: 654579 - protein, 9 aa, Homo Sapiens
LNKPMYFFL

SEQ ID NO: 654580 - protein, 9 aa, Homo Sapiens
KQDSQLRNE

SEQ ID NO: 654581 - protein, 9 aa, Homo Sapiens
QKYQLVAQI

SEQ ID NO: 654582 - protein, 9 aa, Homo Sapiens
REWVGLVKH

SEQ ID NO: 654583 - protein, 9 aa, Homo Sapiens
LDGFHSKEV

SEQ ID NO: 654584 - protein, 9 aa, Homo Sapiens
WDLTEAWMQ

SEQ ID NO: 654585 - protein, 9 aa, Homo Sapiens
ICYPRPCRD

SEQ ID NO: 654586 - protein, 9 aa, Homo Sapiens
ENDNAPAIV

SEQ ID NO: 654587 - protein, 9 aa, Homo Sapiens
ENGLLAPVS

SEQ ID NO: 654588 - protein, 9 aa, Homo Sapiens
ATQDIAVHG

SEQ ID NO: 654589 - protein, 9 aa, Homo Sapiens
VYIEKFIVP

SEQ ID NO: 654590 - protein, 9 aa, Homo Sapiens
ESSSVLSYD

SEQ ID NO: 654591 - protein, 9 aa, Homo Sapiens
SIVLKLPSF

SEQ ID NO: 654592 - protein, 9 aa, Homo Sapiens
KISQPKNRA

SEQ ID NO: 654593 - protein, 9 aa, Homo Sapiens
DTNWKYKNF

SEQ ID NO: 654594 - protein, 9 aa, Homo Sapiens
FLQPDISER

SEQ ID NO: 654595 - protein, 9 aa, Homo Sapiens
RRYESSPAK

SEQ ID NO: 654596 - protein, 9 aa, Homo Sapiens
WIIFLLPTP

SEQ ID NO: 654597 - protein, 9 aa, Homo Sapiens
QEMLSDGTE

SEQ ID NO: 654598 - protein, 9 aa, Homo Sapiens
SVSVNFYEF

SEQ ID NO: 654599 - protein, 9 aa, Homo Sapiens
APGAPRDAT

SEQ ID NO: 654600 - protein, 9 aa, Homo Sapiens
GMTNVFSYI

SEQ ID NO: 654601 - protein, 9 aa, Homo Sapiens
SSVKESSRS

SEQ ID NO: 654602 - protein, 9 aa, Homo Sapiens
PSWEKGSVN

SEQ ID NO: 654603 - protein, 9 aa, Homo Sapiens
GVGGGARSN

SEQ ID NO: 654604 - protein, 9 aa, Homo Sapiens
ETLEKQLSM

SEQ ID NO: 654605 - protein, 9 aa, Homo Sapiens
TLEDEGTPT

SEQ ID NO: 654606 - protein, 9 aa, Homo Sapiens
NSSSAFTAL

SEQ ID NO: 654607 - protein, 9 aa, Homo Sapiens
LSTSCRRLH

SEQ ID NO: 654608 - protein, 9 aa, Homo Sapiens
WLMPDLHTK

SEQ ID NO: 654609 - protein, 9 aa, Homo Sapiens
NEEGDLEED

SEQ ID NO: 654610 - protein, 9 aa, Homo Sapiens
TPLHVTSLS

SEQ ID NO: 654611 - protein, 9 aa, Homo Sapiens
STLQMVWIN

SEQ ID NO: 654612 - protein, 9 aa, Homo Sapiens
GQKGEPGVV

SEQ ID NO: 654613 - protein, 9 aa, Homo Sapiens
ADGIPFFPS

SEQ ID NO: 654614 - protein, 9 aa, Homo Sapiens
LSAESDISI

SEQ ID NO: 654615 - protein, 9 aa, Homo Sapiens
ESIHTGEKL

SEQ ID NO: 654616 - protein, 9 aa, Homo Sapiens
ESRCCLDPS

SEQ ID NO: 654617 - protein, 9 aa, Homo Sapiens
KLLASFCQT

SEQ ID NO: 654618 - protein, 9 aa, Homo Sapiens
ISCKVDNEE

SEQ ID NO: 654619 - protein, 9 aa, Homo Sapiens
QGYQTYVHF

SEQ ID NO: 654620 - protein, 9 aa, Homo Sapiens
PKGYCLRCH

SEQ ID NO: 654621 - protein, 9 aa, Homo Sapiens
VKMTRWKTF

SEQ ID NO: 654622 - protein, 9 aa, Homo Sapiens
AITEKLTDV

SEQ ID NO: 654623 - protein, 9 aa, Homo Sapiens
FKATGFIIL

SEQ ID NO: 654624 - protein, 9 aa, Homo Sapiens
CPKPHVRVS

SEQ ID NO: 654625 - protein, 9 aa, Homo Sapiens
DEMSEDDVL

SEQ ID NO: 654626 - protein, 9 aa, Homo Sapiens
SSFVRKTTK

SEQ ID NO: 654627 - protein, 9 aa, Homo Sapiens
PPLVPVVQV

SEQ ID NO: 654628 - protein, 9 aa, Homo Sapiens
GKLGILQDA

SEQ ID NO: 654629 - protein, 9 aa, Homo Sapiens
LNHLLTQEE

SEQ ID NO: 654630 - protein, 9 aa, Homo Sapiens
KLPKACSIG

SEQ ID NO: 654631 - protein, 9 aa, Homo Sapiens
DEIEVFQLN

SEQ ID NO: 654632 - protein, 9 aa, Homo Sapiens
QKGIVGRHG

SEQ ID NO: 654633 - protein, 9 aa, Homo Sapiens
CFLNWREHR

SEQ ID NO: 654634 - protein, 9 aa, Homo Sapiens
NTSQPDIVK

SEQ ID NO: 654635 - protein, 9 aa, Homo Sapiens
KTLKLCREL

SEQ ID NO: 654636 - protein, 9 aa, Homo Sapiens
PGDSPHTVS

SEQ ID NO: 654637 - protein, 9 aa, Homo Sapiens
DYYGKCSRL

SEQ ID NO: 654638 - protein, 9 aa, Homo Sapiens
KPPLENGHV

SEQ ID NO: 654639 - protein, 9 aa, Homo Sapiens
RIFELNKLL

SEQ ID NO: 654640 - protein, 9 aa, Homo Sapiens
RIIQSFGRK

SEQ ID NO: 654641 - protein, 9 aa, Homo Sapiens
LLVVLQGVC

SEQ ID NO: 654642 - protein, 9 aa, Homo Sapiens
LVGRMDESL

SEQ ID NO: 654643 - protein, 9 aa, Homo Sapiens
QDCCVPVCC

SEQ ID NO: 654644 - protein, 9 aa, Homo Sapiens
LNLVRQHHE

SEQ ID NO: 654645 - protein, 9 aa, Homo Sapiens
QNDNRNPGG

SEQ ID NO: 654646 - protein, 9 aa, Homo Sapiens
RSVIQDFWR

SEQ ID NO: 654647 - protein, 9 aa, Homo Sapiens
DTQHSEDIN

SEQ ID NO: 654648 - protein, 9 aa, Homo Sapiens
TRLFAPLKR

SEQ ID NO: 654649 - protein, 9 aa, Homo Sapiens
KARNENKPI

SEQ ID NO: 654650 - protein, 9 aa, Homo Sapiens
IRANSISLL

SEQ ID NO: 654651 - protein, 9 aa, Homo Sapiens
KELKQQKSF

SEQ ID NO: 654652 - protein, 9 aa, Homo Sapiens
DGRAALSIL

SEQ ID NO: 654653 - protein, 9 aa, Homo Sapiens
FQSLDCGSN

SEQ ID NO: 654654 - protein, 9 aa, Homo Sapiens
TFVIWLLSP

SEQ ID NO: 654655 - protein, 9 aa, Homo Sapiens
SELLVKTLI

SEQ ID NO: 654656 - protein, 9 aa, Homo Sapiens
LGECGHLDP

SEQ ID NO: 654657 - protein, 9 aa, Homo Sapiens
LQSFGFQIV

SEQ ID NO: 654658 - protein, 9 aa, Homo Sapiens
TQIRESLFA

SEQ ID NO: 654659 - protein, 9 aa, Homo Sapiens
GNIEETCQL

SEQ ID NO: 654660 - protein, 9 aa, Homo Sapiens
EGLEYCKER

SEQ ID NO: 654661 - protein, 9 aa, Homo Sapiens
NGITRLGPY

SEQ ID NO: 654662 - protein, 9 aa, Homo Sapiens
PQDLASTRP

SEQ ID NO: 654663 - protein, 9 aa, Homo Sapiens
KETFCRLDQ

SEQ ID NO: 654664 - protein, 9 aa, Homo Sapiens
GSASPKNQK

SEQ ID NO: 654665 - protein, 9 aa, Homo Sapiens
KQQAELVDF

SEQ ID NO: 654666 - protein, 9 aa, Homo Sapiens
LTSHIRNHL

SEQ ID NO: 654667 - protein, 9 aa, Homo Sapiens
SFSKQTASS

SEQ ID NO: 654668 - protein, 9 aa, Homo Sapiens
KNKKCGNLQ

SEQ ID NO: 654669 - protein, 9 aa, Homo Sapiens
GIITGYHIS

SEQ ID NO: 654670 - protein, 9 aa, Homo Sapiens
QAFKNLKKL

SEQ ID NO: 654671 - protein, 9 aa, Homo Sapiens
LRIAHKFTQ

SEQ ID NO: 654672 - protein, 9 aa, Homo Sapiens
LLKVLWRGR

SEQ ID NO: 654673 - protein, 9 aa, Homo Sapiens
GNTAFNHQV

SEQ ID NO: 654674 - protein, 9 aa, Homo Sapiens
KTQIRESLF

SEQ ID NO: 654675 - protein, 9 aa, Homo Sapiens
LGGHPHKGN

SEQ ID NO: 654676 - protein, 9 aa, Homo Sapiens
VDAVPCLEE

SEQ ID NO: 654677 - protein, 9 aa, Homo Sapiens
VESMQFPVT

SEQ ID NO: 654678 - protein, 9 aa, Homo Sapiens
YYGKCSRLK

SEQ ID NO: 654679 - protein, 9 aa, Homo Sapiens
SAFAAFSLM

SEQ ID NO: 654680 - protein, 9 aa, Homo Sapiens
KMYLYMPKW

SEQ ID NO: 654681 - protein, 9 aa, Homo Sapiens
ELHQIVYPL

SEQ ID NO: 654682 - protein, 9 aa, Homo Sapiens
CSICECKDG

SEQ ID NO: 654683 - protein, 9 aa, Homo Sapiens
VDGQEEKDK

SEQ ID NO: 654684 - protein, 9 aa, Homo Sapiens
KIWKHQNLQ

SEQ ID NO: 654685 - protein, 9 aa, Homo Sapiens
KVDTVVIYM

SEQ ID NO: 654686 - protein, 9 aa, Homo Sapiens
NSPTPATSM

SEQ ID NO: 654687 - protein, 9 aa, Homo Sapiens
ASTRPPGPM

SEQ ID NO: 654688 - protein, 9 aa, Homo Sapiens
HQKLHTACM

SEQ ID NO: 654689 - protein, 9 aa, Homo Sapiens
WEWCSSKSE

SEQ ID NO: 654690 - protein, 9 aa, Homo Sapiens
KATDISIQP

SEQ ID NO: 654691 - protein, 9 aa, Homo Sapiens
LALVTLLSH

SEQ ID NO: 654692 - protein, 9 aa, Homo Sapiens
PNKSGKSTY

SEQ ID NO: 654693 - protein, 9 aa, Homo Sapiens
TGDMNSPPG

SEQ ID NO: 654694 - protein, 9 aa, Homo Sapiens
EMEPLTIVK

SEQ ID NO: 654695 - protein, 9 aa, Homo Sapiens
KDSLSMTSK

SEQ ID NO: 654696 - protein, 9 aa, Homo Sapiens
VSRMLLQQD

SEQ ID NO: 654697 - protein, 9 aa, Homo Sapiens
NLMSASGVF

SEQ ID NO: 654698 - protein, 9 aa, Homo Sapiens
AFKFLCLPP

SEQ ID NO: 654699 - protein, 9 aa, Homo Sapiens
INMPTCKLL

SEQ ID NO: 654700 - protein, 9 aa, Homo Sapiens
THGDLCQLL

SEQ ID NO: 654701 - protein, 9 aa, Homo Sapiens
SKLVYNPSA

SEQ ID NO: 654702 - protein, 9 aa, Homo Sapiens
GERELQAFQ

SEQ ID NO: 654703 - protein, 9 aa, Homo Sapiens
SAQAWKKSL

SEQ ID NO: 654704 - protein, 9 aa, Homo Sapiens
CTAKSSVKE

SEQ ID NO: 654705 - protein, 9 aa, Homo Sapiens
PEGPAGVLY

SEQ ID NO: 654706 - protein, 9 aa, Homo Sapiens
LTLGSATNF

SEQ ID NO: 654707 - protein, 9 aa, Homo Sapiens
EYERIGFQY

SEQ ID NO: 654708 - protein, 9 aa, Homo Sapiens
GYLHLSTAS

SEQ ID NO: 654709 - protein, 9 aa, Homo Sapiens
AINSSNLKD

SEQ ID NO: 654710 - protein, 9 aa, Homo Sapiens
VGTGELYVH

SEQ ID NO: 654711 - protein, 9 aa, Homo Sapiens
SAGRTRRWF

SEQ ID NO: 654712 - protein, 9 aa, Homo Sapiens
GYICYPRPC

SEQ ID NO: 654713 - protein, 9 aa, Homo Sapiens
QMKLQMDAL

SEQ ID NO: 654714 - protein, 9 aa, Homo Sapiens
ISGVSRPDK

SEQ ID NO: 654715 - protein, 9 aa, Homo Sapiens
GVNASMRRV

SEQ ID NO: 654716 - protein, 9 aa, Homo Sapiens
EEGNEEGDL

SEQ ID NO: 654717 - protein, 9 aa, Homo Sapiens
EQLFSSAHL

SEQ ID NO: 654718 - protein, 9 aa, Homo Sapiens
LHQIVYPLL

SEQ ID NO: 654719 - protein, 9 aa, Homo Sapiens
SYDISADDK

SEQ ID NO: 654720 - protein, 9 aa, Homo Sapiens
GQPHSRSLP

SEQ ID NO: 654721 - protein, 9 aa, Homo Sapiens
PISDHRMPV

SEQ ID NO: 654722 - protein, 9 aa, Homo Sapiens
SFCPRLAWH

SEQ ID NO: 654723 - protein, 9 aa, Homo Sapiens
LVDTIWDMR

SEQ ID NO: 654724 - protein, 9 aa, Homo Sapiens
FLVSATLRP

SEQ ID NO: 654725 - protein, 9 aa, Homo Sapiens
SANEEMEWV

SEQ ID NO: 654726 - protein, 9 aa, Homo Sapiens
GNFYSCIGN

SEQ ID NO: 654727 - protein, 9 aa, Homo Sapiens
ALKDPLQST

SEQ ID NO: 654728 - protein, 9 aa, Homo Sapiens
QLHHRILDF

SEQ ID NO: 654729 - protein, 9 aa, Homo Sapiens
TGSCCMTQA

SEQ ID NO: 654730 - protein, 9 aa, Homo Sapiens
ALLLVVLQG

SEQ ID NO: 654731 - protein, 9 aa, Homo Sapiens
KPKKKEKDN

SEQ ID NO: 654732 - protein, 9 aa, Homo Sapiens
MKLQMDALT

SEQ ID NO: 654733 - protein, 9 aa, Homo Sapiens
FKLRSMGWG

SEQ ID NO: 654734 - protein, 9 aa, Homo Sapiens
PGTWNKSCR

SEQ ID NO: 654735 - protein, 9 aa, Homo Sapiens
LSNLQHQKI

SEQ ID NO: 654736 - protein, 9 aa, Homo Sapiens
QYSAWYTAT

SEQ ID NO: 654737 - protein, 9 aa, Homo Sapiens
AFNHQVRAR

SEQ ID NO: 654738 - protein, 9 aa, Homo Sapiens
SEPRSQRNL

SEQ ID NO: 654739 - protein, 9 aa, Homo Sapiens
KGKNIFLVS

SEQ ID NO: 654740 - protein, 9 aa, Homo Sapiens
HMMDRRYRT

SEQ ID NO: 654741 - protein, 9 aa, Homo Sapiens
PFRMAEGIE

SEQ ID NO: 654742 - protein, 9 aa, Homo Sapiens
LLVKTLIVA

SEQ ID NO: 654743 - protein, 9 aa, Homo Sapiens
VAFSTNLLT

SEQ ID NO: 654744 - protein, 9 aa, Homo Sapiens
DFENLNTEK

SEQ ID NO: 654745 - protein, 9 aa, Homo Sapiens
TPPGYPGQE

SEQ ID NO: 654746 - protein, 9 aa, Homo Sapiens
DLLQLHHRI

SEQ ID NO: 654747 - protein, 9 aa, Homo Sapiens
RYSDSLLGV

SEQ ID NO: 654748 - protein, 9 aa, Homo Sapiens
VFNVPGIFS

SEQ ID NO: 654749 - protein, 9 aa, Homo Sapiens
HASVPGQSS

SEQ ID NO: 654750 - protein, 9 aa, Homo Sapiens
LLKIWLYQM

SEQ ID NO: 654751 - protein, 9 aa, Homo Sapiens
QANLEDRCP

SEQ ID NO: 654752 - protein, 9 aa, Homo Sapiens
CYVAWARVS

SEQ ID NO: 654753 - protein, 9 aa, Homo Sapiens
TDKEVKWTI

SEQ ID NO: 654754 - protein, 9 aa, Homo Sapiens
ILCSRGLRN

SEQ ID NO: 654755 - protein, 9 aa, Homo Sapiens
VIRASLFSK

SEQ ID NO: 654756 - protein, 9 aa, Homo Sapiens
GRQGCKINA

SEQ ID NO: 654757 - protein, 9 aa, Homo Sapiens
GQASSWSRR

SEQ ID NO: 654758 - protein, 9 aa, Homo Sapiens
HLQRHIHDV

SEQ ID NO: 654759 - protein, 9 aa, Homo Sapiens
LQGSIWGPS

SEQ ID NO: 654760 - protein, 9 aa, Homo Sapiens
SSSAGNIMA

SEQ ID NO: 654761 - protein, 9 aa, Homo Sapiens
DDPTLEFDK

SEQ ID NO: 654762 - protein, 9 aa, Homo Sapiens
LFSKGSDVW

SEQ ID NO: 654763 - protein, 9 aa, Homo Sapiens
CMQDLFQKV

SEQ ID NO: 654764 - protein, 9 aa, Homo Sapiens
SEMQTDLKA

SEQ ID NO: 654765 - protein, 9 aa, Homo Sapiens
IKEQLKAFA

SEQ ID NO: 654766 - protein, 9 aa, Homo Sapiens
SDQNESQVE

SEQ ID NO: 654767 - protein, 9 aa, Homo Sapiens
VSTIGALCL

SEQ ID NO: 654768 - protein, 9 aa, Homo Sapiens
NLDPVSPEG

SEQ ID NO: 654769 - protein, 9 aa, Homo Sapiens
CKILHRQKR

SEQ ID NO: 654770 - protein, 9 aa, Homo Sapiens
KPTSVSGLH

SEQ ID NO: 654771 - protein, 9 aa, Homo Sapiens
TEKFSSESD

SEQ ID NO: 654772 - protein, 9 aa, Homo Sapiens
KGYTHDAGF

SEQ ID NO: 654773 - protein, 9 aa, Homo Sapiens
LALLAFLSG

SEQ ID NO: 654774 - protein, 9 aa, Homo Sapiens
PSTVEPPSK

SEQ ID NO: 654775 - protein, 9 aa, Homo Sapiens
VPEDLAEET

SEQ ID NO: 654776 - protein, 9 aa, Homo Sapiens
VIQETCESR

SEQ ID NO: 654777 - protein, 9 aa, Homo Sapiens
LGLLSQQAQ

SEQ ID NO: 654778 - protein, 9 aa, Homo Sapiens
SPNAATSSA

SEQ ID NO: 654779 - protein, 9 aa, Homo Sapiens
LFCAYMEVA

SEQ ID NO: 654780 - protein, 9 aa, Homo Sapiens
VSDNESDEE

SEQ ID NO: 654781 - protein, 9 aa, Homo Sapiens
SQYSAWYTA

SEQ ID NO: 654782 - protein, 9 aa, Homo Sapiens
GTNTYLQPK

SEQ ID NO: 654783 - protein, 9 aa, Homo Sapiens
QGFASLGGA

SEQ ID NO: 654784 - protein, 9 aa, Homo Sapiens
DNNLAVTYF

SEQ ID NO: 654785 - protein, 9 aa, Homo Sapiens
QFCMVYSEV

SEQ ID NO: 654786 - protein, 9 aa, Homo Sapiens
SCCMTQAGV

SEQ ID NO: 654787 - protein, 9 aa, Homo Sapiens
FPKILWEDL

SEQ ID NO: 654788 - protein, 9 aa, Homo Sapiens
GRAALSILV

SEQ ID NO: 654789 - protein, 9 aa, Homo Sapiens
ILNTNTELC

SEQ ID NO: 654790 - protein, 9 aa, Homo Sapiens
NLGGNPFWK

SEQ ID NO: 654791 - protein, 9 aa, Homo Sapiens
GRSNCPCVC

SEQ ID NO: 654792 - protein, 9 aa, Homo Sapiens
HLSSVASKE

SEQ ID NO: 654793 - protein, 9 aa, Homo Sapiens
RTVRHEMQI

SEQ ID NO: 654794 - protein, 9 aa, Homo Sapiens
ICYGVQMMN

SEQ ID NO: 654795 - protein, 9 aa, Homo Sapiens
GVSRPDKVL

SEQ ID NO: 654796 - protein, 9 aa, Homo Sapiens
RFMQTFVLS

SEQ ID NO: 654797 - protein, 9 aa, Homo Sapiens
AMFHIEYFR

SEQ ID NO: 654798 - protein, 9 aa, Homo Sapiens
GIVNVAFST

SEQ ID NO: 654799 - protein, 9 aa, Homo Sapiens
KPLVCNECE

SEQ ID NO: 654800 - protein, 9 aa, Homo Sapiens
LVSALKDPL

SEQ ID NO: 654801 - protein, 9 aa, Homo Sapiens
KTLSAVTNN

SEQ ID NO: 654802 - protein, 9 aa, Homo Sapiens
STVEPPSKD

SEQ ID NO: 654803 - protein, 9 aa, Homo Sapiens
SSKKMDGYN

SEQ ID NO: 654804 - protein, 9 aa, Homo Sapiens
YEDKNRKKI

SEQ ID NO: 654805 - protein, 9 aa, Homo Sapiens
RTACSPDYT

SEQ ID NO: 654806 - protein, 9 aa, Homo Sapiens
KSKGFVFVS

SEQ ID NO: 654807 - protein, 9 aa, Homo Sapiens
TDINFAMKG

SEQ ID NO: 654808 - protein, 9 aa, Homo Sapiens
AGFAPQTGS

SEQ ID NO: 654809 - protein, 9 aa, Homo Sapiens
LEPGAAPHG

SEQ ID NO: 654810 - protein, 9 aa, Homo Sapiens
KETLATQFD

SEQ ID NO: 654811 - protein, 9 aa, Homo Sapiens
KNILGKYME

SEQ ID NO: 654812 - protein, 9 aa, Homo Sapiens
QAACKLDAY

SEQ ID NO: 654813 - protein, 9 aa, Homo Sapiens
VLFKKFYLI

SEQ ID NO: 654814 - protein, 9 aa, Homo Sapiens
STASKGASS

SEQ ID NO: 654815 - protein, 9 aa, Homo Sapiens
TGFPNKYSR

SEQ ID NO: 654816 - protein, 9 aa, Homo Sapiens
AFFNAWAIF

SEQ ID NO: 654817 - protein, 9 aa, Homo Sapiens
GALLPLRAL

SEQ ID NO: 654818 - protein, 9 aa, Homo Sapiens
CNIISLEDK

SEQ ID NO: 654819 - protein, 9 aa, Homo Sapiens
AISPPTLTW

SEQ ID NO: 654820 - protein, 9 aa, Homo Sapiens
PLKAEPAHT

SEQ ID NO: 654821 - protein, 9 aa, Homo Sapiens
CGSGTTMDS

SEQ ID NO: 654822 - protein, 9 aa, Homo Sapiens
CKLDAYSKK

SEQ ID NO: 654823 - protein, 9 aa, Homo Sapiens
VIMSQILPF

SEQ ID NO: 654824 - protein, 9 aa, Homo Sapiens
GQSSRAGGT

SEQ ID NO: 654825 - protein, 9 aa, Homo Sapiens
MTVVRASAL

SEQ ID NO: 654826 - protein, 9 aa, Homo Sapiens
EIKEQLKAF

SEQ ID NO: 654827 - protein, 9 aa, Homo Sapiens
IVLVVSVLF

SEQ ID NO: 654828 - protein, 9 aa, Homo Sapiens
KNADNSSSA

SEQ ID NO: 654829 - protein, 9 aa, Homo Sapiens
YMEVAISNI

SEQ ID NO: 654830 - protein, 9 aa, Homo Sapiens
KSLRKSLQA

SEQ ID NO: 654831 - protein, 9 aa, Homo Sapiens
EAAVAASQD

SEQ ID NO: 654832 - protein, 9 aa, Homo Sapiens
FCHSNAIDH

SEQ ID NO: 654833 - protein, 9 aa, Homo Sapiens
SIHRLITIA

SEQ ID NO: 654834 - protein, 9 aa, Homo Sapiens
LWWWWCCYS

SEQ ID NO: 654835 - protein, 9 aa, Homo Sapiens
GPNKSGKST

SEQ ID NO: 654836 - protein, 9 aa, Homo Sapiens
PLRSPSSSS

SEQ ID NO: 654837 - protein, 9 aa, Homo Sapiens
IAVHGWALT

SEQ ID NO: 654838 - protein, 9 aa, Homo Sapiens
PGSFNFAPL

SEQ ID NO: 654839 - protein, 9 aa, Homo Sapiens
PGIPNPSPS

SEQ ID NO: 654840 - protein, 9 aa, Homo Sapiens
AHQAVLPAP

SEQ ID NO: 654841 - protein, 9 aa, Homo Sapiens
SLLVPWLYL

SEQ ID NO: 654842 - protein, 9 aa, Homo Sapiens
KRSKDGQKE

SEQ ID NO: 654843 - protein, 9 aa, Homo Sapiens
VQQVADYYG

SEQ ID NO: 654844 - protein, 9 aa, Homo Sapiens
GHDCSGSCQ

SEQ ID NO: 654845 - protein, 9 aa, Homo Sapiens
IESGDSGNL

SEQ ID NO: 654846 - protein, 9 aa, Homo Sapiens
ADKSVGNNK

SEQ ID NO: 654847 - protein, 9 aa, Homo Sapiens
LFFGAGTNT

SEQ ID NO: 654848 - protein, 9 aa, Homo Sapiens
TKQDSQLRN

SEQ ID NO: 654849 - protein, 9 aa, Homo Sapiens
NALRAKTNT

SEQ ID NO: 654850 - protein, 9 aa, Homo Sapiens
MSLPLAGSE

SEQ ID NO: 654851 - protein, 9 aa, Homo Sapiens
ISYWIPKKL

SEQ ID NO: 654852 - protein, 9 aa, Homo Sapiens
IKDLTEEDA

SEQ ID NO: 654853 - protein, 9 aa, Homo Sapiens
NVFSYIFQP

SEQ ID NO: 654854 - protein, 9 aa, Homo Sapiens
EQNDNRNPG

SEQ ID NO: 654855 - protein, 9 aa, Homo Sapiens
TFGGVGGGA

SEQ ID NO: 654856 - protein, 9 aa, Homo Sapiens
AKNPKPDKN

SEQ ID NO: 654857 - protein, 9 aa, Homo Sapiens
KGIPPDQQR

SEQ ID NO: 654858 - protein, 9 aa, Homo Sapiens
FRMAEGIEE

SEQ ID NO: 654859 - protein, 9 aa, Homo Sapiens
LCDPETLIC

SEQ ID NO: 654860 - protein, 9 aa, Homo Sapiens
EVVLDGEAE

SEQ ID NO: 654861 - protein, 9 aa, Homo Sapiens
KHVSHVVHI

SEQ ID NO: 654862 - protein, 9 aa, Homo Sapiens
VQIKHEEGL

SEQ ID NO: 654863 - protein, 9 aa, Homo Sapiens
NPKPDKNDD

SEQ ID NO: 654864 - protein, 9 aa, Homo Sapiens
AQGMPVSGV

SEQ ID NO: 654865 - protein, 9 aa, Homo Sapiens
FAKHALEKQ

SEQ ID NO: 654866 - protein, 9 aa, Homo Sapiens
IEDAKCHIV

SEQ ID NO: 654867 - protein, 9 aa, Homo Sapiens
KKRKHQLWA

SEQ ID NO: 654868 - protein, 9 aa, Homo Sapiens
KRDVFILLS

SEQ ID NO: 654869 - protein, 9 aa, Homo Sapiens
NGWMYCTDW

SEQ ID NO: 654870 - protein, 9 aa, Homo Sapiens
HAVEKPYKC

SEQ ID NO: 654871 - protein, 9 aa, Homo Sapiens
SPPPLERRS

SEQ ID NO: 654872 - protein, 9 aa, Homo Sapiens
LVELGPGGG

SEQ ID NO: 654873 - protein, 9 aa, Homo Sapiens
HNHGDSDDD

SEQ ID NO: 654874 - protein, 9 aa, Homo Sapiens
RAWLPHWTP

SEQ ID NO: 654875 - protein, 9 aa, Homo Sapiens
VVAFKPFDG

SEQ ID NO: 654876 - protein, 9 aa, Homo Sapiens
AAAFPSSCG

SEQ ID NO: 654877 - protein, 9 aa, Homo Sapiens
SGSKDVPRN

SEQ ID NO: 654878 - protein, 9 aa, Homo Sapiens
LQDLETEDP

SEQ ID NO: 654879 - protein, 9 aa, Homo Sapiens
PVFMKQLPF

SEQ ID NO: 654880 - protein, 9 aa, Homo Sapiens
IFNFLASYL

SEQ ID NO: 654881 - protein, 9 aa, Homo Sapiens
FSYIFQPAK

SEQ ID NO: 654882 - protein, 9 aa, Homo Sapiens
PRLAGLALL

SEQ ID NO: 654883 - protein, 9 aa, Homo Sapiens
KQMLKPHLH

SEQ ID NO: 654884 - protein, 9 aa, Homo Sapiens
SPVGEIAFE

SEQ ID NO: 654885 - protein, 9 aa, Homo Sapiens
EPRSQRNLG

SEQ ID NO: 654886 - protein, 9 aa, Homo Sapiens
LSSLFDFQW

SEQ ID NO: 654887 - protein, 9 aa, Homo Sapiens
NCGLVFNLQ

SEQ ID NO: 654888 - protein, 9 aa, Homo Sapiens
WSEAVFIHK

SEQ ID NO: 654889 - protein, 9 aa, Homo Sapiens
GLAVDFFIF

SEQ ID NO: 654890 - protein, 9 aa, Homo Sapiens
QNSQMNIVH

SEQ ID NO: 654891 - protein, 9 aa, Homo Sapiens
ATHQLVEGE

SEQ ID NO: 654892 - protein, 9 aa, Homo Sapiens
SSKSERTPR

SEQ ID NO: 654893 - protein, 9 aa, Homo Sapiens
RRKLREYDG

SEQ ID NO: 654894 - protein, 9 aa, Homo Sapiens
SSPEEHVML

SEQ ID NO: 654895 - protein, 9 aa, Homo Sapiens
SEETNSCTC

SEQ ID NO: 654896 - protein, 9 aa, Homo Sapiens
ALAAVHSPL

SEQ ID NO: 654897 - protein, 9 aa, Homo Sapiens
CLDPSAVVS

SEQ ID NO: 654898 - protein, 9 aa, Homo Sapiens
PSANGVILT

SEQ ID NO: 654899 - protein, 9 aa, Homo Sapiens
YRRSHSQAE

SEQ ID NO: 654900 - protein, 9 aa, Homo Sapiens
SNIISEKKA

SEQ ID NO: 654901 - protein, 9 aa, Homo Sapiens
YVHCEPQGL

SEQ ID NO: 654902 - protein, 9 aa, Homo Sapiens
MSLLQSFGF

SEQ ID NO: 654903 - protein, 9 aa, Homo Sapiens
PSDTFDTMN

SEQ ID NO: 654904 - protein, 9 aa, Homo Sapiens
TAILDSQLS

SEQ ID NO: 654905 - protein, 9 aa, Homo Sapiens
KFEKNTSNS

SEQ ID NO: 654906 - protein, 9 aa, Homo Sapiens
ESLGRPLSA

SEQ ID NO: 654907 - protein, 9 aa, Homo Sapiens
SGGALLPLR

SEQ ID NO: 654908 - protein, 9 aa, Homo Sapiens
AKRAGFPSI

SEQ ID NO: 654909 - protein, 9 aa, Homo Sapiens
KRVQDVIEQ

SEQ ID NO: 654910 - protein, 9 aa, Homo Sapiens
YHHIQEMMV

SEQ ID NO: 654911 - protein, 9 aa, Homo Sapiens
KEEPLTISK

SEQ ID NO: 654912 - protein, 9 aa, Homo Sapiens
KNINFSTRY

SEQ ID NO: 654913 - protein, 9 aa, Homo Sapiens
ANSISLLSD

SEQ ID NO: 654914 - protein, 9 aa, Homo Sapiens
PFLSVGGNI

SEQ ID NO: 654915 - protein, 9 aa, Homo Sapiens
FSGQLSKKI

SEQ ID NO: 654916 - protein, 9 aa, Homo Sapiens
SLTLFQSKS

SEQ ID NO: 654917 - protein, 9 aa, Homo Sapiens
TGTMYWVIV

SEQ ID NO: 654918 - protein, 9 aa, Homo Sapiens
IPPQAFKNL

SEQ ID NO: 654919 - protein, 9 aa, Homo Sapiens
VEFYYWESY

SEQ ID NO: 654920 - protein, 9 aa, Homo Sapiens
IKITVNGPR

SEQ ID NO: 654921 - protein, 9 aa, Homo Sapiens
ETCESRNHI

SEQ ID NO: 654922 - protein, 9 aa, Homo Sapiens
EETPGGRLG

SEQ ID NO: 654923 - protein, 9 aa, Homo Sapiens
VEVVLDGEA

SEQ ID NO: 654924 - protein, 9 aa, Homo Sapiens
LKITFVIWL

SEQ ID NO: 654925 - protein, 9 aa, Homo Sapiens
CIKACKKLA

SEQ ID NO: 654926 - protein, 9 aa, Homo Sapiens
SDWEWCSSK

SEQ ID NO: 654927 - protein, 9 aa, Homo Sapiens
ALNHLLTQE

SEQ ID NO: 654928 - protein, 9 aa, Homo Sapiens
NSSNLKDDY

SEQ ID NO: 654929 - protein, 9 aa, Homo Sapiens
FQSKSNEDS

SEQ ID NO: 654930 - protein, 9 aa, Homo Sapiens
VEAQTIKEL

SEQ ID NO: 654931 - protein, 9 aa, Homo Sapiens
DLHLQDLET

SEQ ID NO: 654932 - protein, 9 aa, Homo Sapiens
VAISNIMSV

SEQ ID NO: 654933 - protein, 9 aa, Homo Sapiens
ASVPGQSSR

SEQ ID NO: 654934 - protein, 9 aa, Homo Sapiens
ADDIQEFTK

SEQ ID NO: 654935 - protein, 9 aa, Homo Sapiens
HEMKKEQED

SEQ ID NO: 654936 - protein, 9 aa, Homo Sapiens
AHLAKHLGL

SEQ ID NO: 654937 - protein, 9 aa, Homo Sapiens
LIVDENDNA

SEQ ID NO: 654938 - protein, 9 aa, Homo Sapiens
VELHQIVYP

SEQ ID NO: 654939 - protein, 9 aa, Homo Sapiens
TVVRASALS

SEQ ID NO: 654940 - protein, 9 aa, Homo Sapiens
ETRPLPLGV

SEQ ID NO: 654941 - protein, 9 aa, Homo Sapiens
KHEEGLKLT

SEQ ID NO: 654942 - protein, 9 aa, Homo Sapiens
EFCALSFRT

SEQ ID NO: 654943 - protein, 9 aa, Homo Sapiens
TIGLIMGGM

SEQ ID NO: 654944 - protein, 9 aa, Homo Sapiens
IVEFVCKSA

SEQ ID NO: 654945 - protein, 9 aa, Homo Sapiens
RACQFHLLL

SEQ ID NO: 654946 - protein, 9 aa, Homo Sapiens
VFKSPLYIS

SEQ ID NO: 654947 - protein, 9 aa, Homo Sapiens
TPKQGFASL

SEQ ID NO: 654948 - protein, 9 aa, Homo Sapiens
LRYSVTVPG

SEQ ID NO: 654949 - protein, 9 aa, Homo Sapiens
QAFQNIEDE

SEQ ID NO: 654950 - protein, 9 aa, Homo Sapiens
VKGGAVYYC

SEQ ID NO: 654951 - protein, 9 aa, Homo Sapiens
ILLGLTDCL

SEQ ID NO: 654952 - protein, 9 aa, Homo Sapiens
HIQEMMVQL

SEQ ID NO: 654953 - protein, 9 aa, Homo Sapiens
SSCIRPCML

SEQ ID NO: 654954 - protein, 9 aa, Homo Sapiens
WAKVKEIKT

SEQ ID NO: 654955 - protein, 9 aa, Homo Sapiens
PIHQDEILA

SEQ ID NO: 654956 - protein, 9 aa, Homo Sapiens
KHQNLQRAM

SEQ ID NO: 654957 - protein, 9 aa, Homo Sapiens
CTKDKLLAS

SEQ ID NO: 654958 - protein, 9 aa, Homo Sapiens
VSVSSEGYL

SEQ ID NO: 654959 - protein, 9 aa, Homo Sapiens
TYVHFPSRA

SEQ ID NO: 654960 - protein, 9 aa, Homo Sapiens
PSSLRCALR

SEQ ID NO: 654961 - protein, 9 aa, Homo Sapiens
TFKSKKNLE

SEQ ID NO: 654962 - protein, 9 aa, Homo Sapiens
MGPPGIQGD

SEQ ID NO: 654963 - protein, 9 aa, Homo Sapiens
GLEEVKPLS

SEQ ID NO: 654964 - protein, 9 aa, Homo Sapiens
NEIKEQLKA

SEQ ID NO: 654965 - protein, 9 aa, Homo Sapiens
FPIVYILVI

SEQ ID NO: 654966 - protein, 9 aa, Homo Sapiens
VISEKPSLF

SEQ ID NO: 654967 - protein, 9 aa, Homo Sapiens
NAVLWLRTQ

SEQ ID NO: 654968 - protein, 9 aa, Homo Sapiens
KEVKWTIEV

SEQ ID NO: 654969 - protein, 9 aa, Homo Sapiens
PVFELMEAP

SEQ ID NO: 654970 - protein, 9 aa, Homo Sapiens
LEEGQASSW

SEQ ID NO: 654971 - protein, 9 aa, Homo Sapiens
PVQRKIEAL

SEQ ID NO: 654972 - protein, 9 aa, Homo Sapiens
LICQNCQHH

SEQ ID NO: 654973 - protein, 9 aa, Homo Sapiens
CPSPCWGPN

SEQ ID NO: 654974 - protein, 9 aa, Homo Sapiens
QCTAKSSVK

SEQ ID NO: 654975 - protein, 9 aa, Homo Sapiens
VVVLVTNVI

SEQ ID NO: 654976 - protein, 9 aa, Homo Sapiens
SVELHQIVY

SEQ ID NO: 654977 - protein, 9 aa, Homo Sapiens
LNDNNLAVT

SEQ ID NO: 654978 - protein, 9 aa, Homo Sapiens
HVTLDRGCS

SEQ ID NO: 654979 - protein, 9 aa, Homo Sapiens
ATAIEYRLQ

SEQ ID NO: 654980 - protein, 9 aa, Homo Sapiens
SILIRTTMQ

SEQ ID NO: 654981 - protein, 9 aa, Homo Sapiens
FRGFIRLEG

SEQ ID NO: 654982 - protein, 9 aa, Homo Sapiens
KGILSGHTD

SEQ ID NO: 654983 - protein, 9 aa, Homo Sapiens
GHNFGMNHV

SEQ ID NO: 654984 - protein, 9 aa, Homo Sapiens
SRCCLDPSA

SEQ ID NO: 654985 - protein, 9 aa, Homo Sapiens
PTSWQTSYV

SEQ ID NO: 654986 - protein, 9 aa, Homo Sapiens
MYKRLLKCV

SEQ ID NO: 654987 - protein, 9 aa, Homo Sapiens
SSLCDPETL

SEQ ID NO: 654988 - protein, 9 aa, Homo Sapiens
PPLRCTNFD

SEQ ID NO: 654989 - protein, 9 aa, Homo Sapiens
EGNEEGDLE

SEQ ID NO: 654990 - protein, 9 aa, Homo Sapiens
AFLSGEAGH

SEQ ID NO: 654991 - protein, 9 aa, Homo Sapiens
YESSPAKPD

SEQ ID NO: 654992 - protein, 9 aa, Homo Sapiens
SLDCGSNFY

SEQ ID NO: 654993 - protein, 9 aa, Homo Sapiens
GNDTYEAAH

SEQ ID NO: 654994 - protein, 9 aa, Homo Sapiens
VEFLRKLEE

SEQ ID NO: 654995 - protein, 9 aa, Homo Sapiens
TRKLTYCVK

SEQ ID NO: 654996 - protein, 9 aa, Homo Sapiens
PAGARVAGF

SEQ ID NO: 654997 - protein, 9 aa, Homo Sapiens
ITACVEPIS

SEQ ID NO: 654998 - protein, 9 aa, Homo Sapiens
ESANTHVLQ

SEQ ID NO: 654999 - protein, 9 aa, Homo Sapiens
IKHEEGLKL

SEQ ID NO: 655000 - protein, 9 aa, Homo Sapiens
LENGHVGLQ

SEQ ID NO: 655001 - protein, 9 aa, Homo Sapiens
VVLQGVCAE

SEQ ID NO: 655002 - protein, 9 aa, Homo Sapiens
APLPVFMKQ

SEQ ID NO: 655003 - protein, 9 aa, Homo Sapiens
HMGSIREDT

SEQ ID NO: 655004 - protein, 9 aa, Homo Sapiens
ELSQQTNGI

SEQ ID NO: 655005 - protein, 9 aa, Homo Sapiens
DMNSPPGSR

SEQ ID NO: 655006 - protein, 9 aa, Homo Sapiens
YITGVDSGS

SEQ ID NO: 655007 - protein, 9 aa, Homo Sapiens
LWRNLLWHQ

SEQ ID NO: 655008 - protein, 9 aa, Homo Sapiens
RLPQGAPGQ

SEQ ID NO: 655009 - protein, 9 aa, Homo Sapiens
HLQNEKKTI

SEQ ID NO: 655010 - protein, 9 aa, Homo Sapiens
VVGIWSDLA

SEQ ID NO: 655011 - protein, 9 aa, Homo Sapiens
EVAISNIMS

SEQ ID NO: 655012 - protein, 9 aa, Homo Sapiens
IPLVDTIWD

SEQ ID NO: 655013 - protein, 9 aa, Homo Sapiens
KLQNNTSQE

SEQ ID NO: 655014 - protein, 9 aa, Homo Sapiens
GMLLALLRK

SEQ ID NO: 655015 - protein, 9 aa, Homo Sapiens
HQLWAAHCR

SEQ ID NO: 655016 - protein, 9 aa, Homo Sapiens
CEASHPGKI

SEQ ID NO: 655017 - protein, 9 aa, Homo Sapiens
LQGYQTYVH

SEQ ID NO: 655018 - protein, 9 aa, Homo Sapiens
ATPVQLPFP

SEQ ID NO: 655019 - protein, 9 aa, Homo Sapiens
NMLRNSIPT

SEQ ID NO: 655020 - protein, 9 aa, Homo Sapiens
RPGALAAVH

SEQ ID NO: 655021 - protein, 9 aa, Homo Sapiens
LVGNFYSCI

SEQ ID NO: 655022 - protein, 9 aa, Homo Sapiens
GDLLELHYE

SEQ ID NO: 655023 - protein, 9 aa, Homo Sapiens
DALGTNFSS

SEQ ID NO: 655024 - protein, 9 aa, Homo Sapiens
YLAQLAFWP

SEQ ID NO: 655025 - protein, 9 aa, Homo Sapiens
KGNSGGDGS

SEQ ID NO: 655026 - protein, 9 aa, Homo Sapiens
RGQRELIIA

SEQ ID NO: 655027 - protein, 9 aa, Homo Sapiens
IFSGDPQEI

SEQ ID NO: 655028 - protein, 9 aa, Homo Sapiens
DITVSDFTD

SEQ ID NO: 655029 - protein, 9 aa, Homo Sapiens
RLEGIVNLP

SEQ ID NO: 655030 - protein, 9 aa, Homo Sapiens
RRYRTRIHE

SEQ ID NO: 655031 - protein, 9 aa, Homo Sapiens
PHWTPLALV

SEQ ID NO: 655032 - protein, 9 aa, Homo Sapiens
FAKFQENQK

SEQ ID NO: 655033 - protein, 9 aa, Homo Sapiens
TISTYLNEK

SEQ ID NO: 655034 - protein, 9 aa, Homo Sapiens
EKQLSMEQK

SEQ ID NO: 655035 - protein, 9 aa, Homo Sapiens
EDTSEVNYI

SEQ ID NO: 655036 - protein, 9 aa, Homo Sapiens
RARRGLPHL

SEQ ID NO: 655037 - protein, 9 aa, Homo Sapiens
EKASDKLVE

SEQ ID NO: 655038 - protein, 9 aa, Homo Sapiens
NVLQDGRKH

SEQ ID NO: 655039 - protein, 9 aa, Homo Sapiens
SQDMQQGAT

SEQ ID NO: 655040 - protein, 9 aa, Homo Sapiens
QESEERPNY

SEQ ID NO: 655041 - protein, 9 aa, Homo Sapiens
MTNVFSYIF

SEQ ID NO: 655042 - protein, 9 aa, Homo Sapiens
ATISTYLNE

SEQ ID NO: 655043 - protein, 9 aa, Homo Sapiens
SPKNQKKSK

SEQ ID NO: 655044 - protein, 9 aa, Homo Sapiens
FIVIADLRK

SEQ ID NO: 655045 - protein, 9 aa, Homo Sapiens
QPSPSSSSL

SEQ ID NO: 655046 - protein, 9 aa, Homo Sapiens
WRCPSPCWG

SEQ ID NO: 655047 - protein, 9 aa, Homo Sapiens
TKEVHATSK

SEQ ID NO: 655048 - protein, 9 aa, Homo Sapiens
SGSEAEGSG

SEQ ID NO: 655049 - protein, 9 aa, Homo Sapiens
QRKLIYETL

SEQ ID NO: 655050 - protein, 9 aa, Homo Sapiens
NVESGEEEV

SEQ ID NO: 655051 - protein, 9 aa, Homo Sapiens
LWDLTEAWM

SEQ ID NO: 655052 - protein, 9 aa, Homo Sapiens
RNFKLRSMG

SEQ ID NO: 655053 - protein, 9 aa, Homo Sapiens
LSVGGNIGV

SEQ ID NO: 655054 - protein, 9 aa, Homo Sapiens
LNTSHHALE

SEQ ID NO: 655055 - protein, 9 aa, Homo Sapiens
LLQGLNLVR

SEQ ID NO: 655056 - protein, 9 aa, Homo Sapiens
LALLHHTII

SEQ ID NO: 655057 - protein, 9 aa, Homo Sapiens
IEYRLQAGV

SEQ ID NO: 655058 - protein, 9 aa, Homo Sapiens
NGVASGLRE

SEQ ID NO: 655059 - protein, 9 aa, Homo Sapiens
LDCGSNFYH

SEQ ID NO: 655060 - protein, 9 aa, Homo Sapiens
TNTELCQYL

SEQ ID NO: 655061 - protein, 9 aa, Homo Sapiens
KACSIGDGK

SEQ ID NO: 655062 - protein, 9 aa, Homo Sapiens
SFLFRILAD

SEQ ID NO: 655063 - protein, 9 aa, Homo Sapiens
MDIGKEKRL

SEQ ID NO: 655064 - protein, 9 aa, Homo Sapiens
VSGIPALHA

SEQ ID NO: 655065 - protein, 9 aa, Homo Sapiens
KRPIYEDKN

SEQ ID NO: 655066 - protein, 9 aa, Homo Sapiens
RYFSQSAGC

SEQ ID NO: 655067 - protein, 9 aa, Homo Sapiens
CGNVLLIFF

SEQ ID NO: 655068 - protein, 9 aa, Homo Sapiens
PLPLLTDFS

SEQ ID NO: 655069 - protein, 9 aa, Homo Sapiens
KSQSLSHES

SEQ ID NO: 655070 - protein, 9 aa, Homo Sapiens
SPTTLAFGD

SEQ ID NO: 655071 - protein, 9 aa, Homo Sapiens
GPASWLRPM

SEQ ID NO: 655072 - protein, 9 aa, Homo Sapiens
LLEVLNAIE

SEQ ID NO: 655073 - protein, 9 aa, Homo Sapiens
LFRILADTP

SEQ ID NO: 655074 - protein, 9 aa, Homo Sapiens
AGMSYYYSP

SEQ ID NO: 655075 - protein, 9 aa, Homo Sapiens
VGRQGCKIN

SEQ ID NO: 655076 - protein, 9 aa, Homo Sapiens
FLSGEAGHP

SEQ ID NO: 655077 - protein, 9 aa, Homo Sapiens
EYSEINITK

SEQ ID NO: 655078 - protein, 9 aa, Homo Sapiens
GGDGSAGPP

SEQ ID NO: 655079 - protein, 9 aa, Homo Sapiens
CCLDPSAVV

SEQ ID NO: 655080 - protein, 9 aa, Homo Sapiens
SDTNWKYKN

SEQ ID NO: 655081 - protein, 9 aa, Homo Sapiens
KIHNGQKPY

SEQ ID NO: 655082 - protein, 9 aa, Homo Sapiens
KVMTLLHEK

SEQ ID NO: 655083 - protein, 9 aa, Homo Sapiens
FSGSKDVPR

SEQ ID NO: 655084 - protein, 9 aa, Homo Sapiens
EWCSSKSER

SEQ ID NO: 655085 - protein, 9 aa, Homo Sapiens
GGVGGGARS

SEQ ID NO: 655086 - protein, 9 aa, Homo Sapiens
FKRDVFILL

SEQ ID NO: 655087 - protein, 9 aa, Homo Sapiens
KSYTYWWTP

SEQ ID NO: 655088 - protein, 9 aa, Homo Sapiens
QGAHLSSVA

SEQ ID NO: 655089 - protein, 9 aa, Homo Sapiens
LCLQNHLNT

SEQ ID NO: 655090 - protein, 9 aa, Homo Sapiens
PSQATHQLV

SEQ ID NO: 655091 - protein, 9 aa, Homo Sapiens
VWLFTHDHM

SEQ ID NO: 655092 - protein, 9 aa, Homo Sapiens
GGEKSWALP

SEQ ID NO: 655093 - protein, 9 aa, Homo Sapiens
SMESLSPLH

SEQ ID NO: 655094 - protein, 9 aa, Homo Sapiens
EYCKERYTL

SEQ ID NO: 655095 - protein, 9 aa, Homo Sapiens
THFKKVRRP

SEQ ID NO: 655096 - protein, 9 aa, Homo Sapiens
TQEEDYQGL

SEQ ID NO: 655097 - protein, 9 aa, Homo Sapiens
LYTIRSNIN

SEQ ID NO: 655098 - protein, 9 aa, Homo Sapiens
SNCGESREL

SEQ ID NO: 655099 - protein, 9 aa, Homo Sapiens
SADVLSSLH

SEQ ID NO: 655100 - protein, 9 aa, Homo Sapiens
INFSTRYKF

SEQ ID NO: 655101 - protein, 9 aa, Homo Sapiens
NLEKIYNGV

SEQ ID NO: 655102 - protein, 9 aa, Homo Sapiens
ENDFKHKKS

SEQ ID NO: 655103 - protein, 9 aa, Homo Sapiens
EAAHNLLVA

SEQ ID NO: 655104 - protein, 9 aa, Homo Sapiens
SMQFPVTVH

SEQ ID NO: 655105 - protein, 9 aa, Homo Sapiens
WLISKTGMI

SEQ ID NO: 655106 - protein, 9 aa, Homo Sapiens
NEMAITEKL

SEQ ID NO: 655107 - protein, 9 aa, Homo Sapiens
CVHHNPSKF

SEQ ID NO: 655108 - protein, 9 aa, Homo Sapiens
TCTGDGDIT

SEQ ID NO: 655109 - protein, 9 aa, Homo Sapiens
RLLLRASSK

SEQ ID NO: 655110 - protein, 9 aa, Homo Sapiens
SVLFLFLVL

SEQ ID NO: 655111 - protein, 9 aa, Homo Sapiens
ASIECDKCQ

SEQ ID NO: 655112 - protein, 9 aa, Homo Sapiens
YTRDLGHHR

SEQ ID NO: 655113 - protein, 9 aa, Homo Sapiens
CSPDYTLAM

SEQ ID NO: 655114 - protein, 9 aa, Homo Sapiens
KGKLGILQD

SEQ ID NO: 655115 - protein, 9 aa, Homo Sapiens
SQSLSHESL

SEQ ID NO: 655116 - protein, 9 aa, Homo Sapiens
TMYKRLLKC

SEQ ID NO: 655117 - protein, 9 aa, Homo Sapiens
EDDPTLEFD

SEQ ID NO: 655118 - protein, 9 aa, Homo Sapiens
YSVTVPGAD

SEQ ID NO: 655119 - protein, 9 aa, Homo Sapiens
SSPNFTLDQ

SEQ ID NO: 655120 - protein, 9 aa, Homo Sapiens
IRTNSSPLF

SEQ ID NO: 655121 - protein, 9 aa, Homo Sapiens
IEVQPRVVP

SEQ ID NO: 655122 - protein, 9 aa, Homo Sapiens
LAGNASKDV

SEQ ID NO: 655123 - protein, 9 aa, Homo Sapiens
ECVLLIVMS

SEQ ID NO: 655124 - protein, 9 aa, Homo Sapiens
TNRSLHVCS

SEQ ID NO: 655125 - protein, 9 aa, Homo Sapiens
LILNTNTEL

SEQ ID NO: 655126 - protein, 9 aa, Homo Sapiens
VQPRVVPNA

SEQ ID NO: 655127 - protein, 9 aa, Homo Sapiens
HPMFFTHDL

SEQ ID NO: 655128 - protein, 9 aa, Homo Sapiens
YSVMVLLIY

SEQ ID NO: 655129 - protein, 9 aa, Homo Sapiens
ALHSFFQPR

SEQ ID NO: 655130 - protein, 9 aa, Homo Sapiens
NLNIIITHA

SEQ ID NO: 655131 - protein, 9 aa, Homo Sapiens
YIESTLQMV

SEQ ID NO: 655132 - protein, 9 aa, Homo Sapiens
RRHWAVKIV

SEQ ID NO: 655133 - protein, 9 aa, Homo Sapiens
RFAEMKQNF

SEQ ID NO: 655134 - protein, 9 aa, Homo Sapiens
VQGPIITGL

SEQ ID NO: 655135 - protein, 9 aa, Homo Sapiens
PPQGPPAAL

SEQ ID NO: 655136 - protein, 9 aa, Homo Sapiens
YSVGTVGTQ

SEQ ID NO: 655137 - protein, 9 aa, Homo Sapiens
GGYICYPRP

SEQ ID NO: 655138 - protein, 9 aa, Homo Sapiens
TLAFGDHPI

SEQ ID NO: 655139 - protein, 9 aa, Homo Sapiens
DANLLNARV

SEQ ID NO: 655140 - protein, 9 aa, Homo Sapiens
DKHGRPLQP

SEQ ID NO: 655141 - protein, 9 aa, Homo Sapiens
EDMAMKAYD

SEQ ID NO: 655142 - protein, 9 aa, Homo Sapiens
ATLEDEGTP

SEQ ID NO: 655143 - protein, 9 aa, Homo Sapiens
KIYNGVIPF

SEQ ID NO: 655144 - protein, 9 aa, Homo Sapiens
LDLVASIHL

SEQ ID NO: 655145 - protein, 9 aa, Homo Sapiens
LGLLSAYTR

SEQ ID NO: 655146 - protein, 9 aa, Homo Sapiens
FLNSQTLLV

SEQ ID NO: 655147 - protein, 9 aa, Homo Sapiens
GPGLPWGAL

SEQ ID NO: 655148 - protein, 9 aa, Homo Sapiens
DATSSPPTP

SEQ ID NO: 655149 - protein, 9 aa, Homo Sapiens
LRAWLPHWT

SEQ ID NO: 655150 - protein, 9 aa, Homo Sapiens
QWQKIGVGI

SEQ ID NO: 655151 - protein, 9 aa, Homo Sapiens
YWEKCSAST

SEQ ID NO: 655152 - protein, 9 aa, Homo Sapiens
NPDVQQKVQ

SEQ ID NO: 655153 - protein, 9 aa, Homo Sapiens
SEAQQPAIH

SEQ ID NO: 655154 - protein, 9 aa, Homo Sapiens
CNSDMVCPH

SEQ ID NO: 655155 - protein, 9 aa, Homo Sapiens
KIDQELEHN

SEQ ID NO: 655156 - protein, 9 aa, Homo Sapiens
DKCKCVDFH

SEQ ID NO: 655157 - protein, 9 aa, Homo Sapiens
ALNKITFNS

SEQ ID NO: 655158 - protein, 9 aa, Homo Sapiens
STKLQNNTS

SEQ ID NO: 655159 - protein, 9 aa, Homo Sapiens
QLLQGLNLV

SEQ ID NO: 655160 - protein, 9 aa, Homo Sapiens
RQGCKINAL

SEQ ID NO: 655161 - protein, 9 aa, Homo Sapiens
QKLHTACMQ

SEQ ID NO: 655162 - protein, 9 aa, Homo Sapiens
LYLEPLGAI

SEQ ID NO: 655163 - protein, 9 aa, Homo Sapiens
TTPKEVVKC

SEQ ID NO: 655164 - protein, 9 aa, Homo Sapiens
FCAYMEVAI

SEQ ID NO: 655165 - protein, 9 aa, Homo Sapiens
VKPNKTKTY

SEQ ID NO: 655166 - protein, 9 aa, Homo Sapiens
VSRPDKVLE

SEQ ID NO: 655167 - protein, 9 aa, Homo Sapiens
TSELQEAMR

SEQ ID NO: 655168 - protein, 9 aa, Homo Sapiens
LPFPPCTSS

SEQ ID NO: 655169 - protein, 9 aa, Homo Sapiens
PCLTLASLR

SEQ ID NO: 655170 - protein, 9 aa, Homo Sapiens
IMTDPRLNK

SEQ ID NO: 655171 - protein, 9 aa, Homo Sapiens
RMAEGIEEV

SEQ ID NO: 655172 - protein, 9 aa, Homo Sapiens
CHRSKNLKV

SEQ ID NO: 655173 - protein, 9 aa, Homo Sapiens
LQDSLDVCY

SEQ ID NO: 655174 - protein, 9 aa, Homo Sapiens
NIFLVSATL

SEQ ID NO: 655175 - protein, 9 aa, Homo Sapiens
NIRDQLYDG

SEQ ID NO: 655176 - protein, 9 aa, Homo Sapiens
AESVDLLDE

SEQ ID NO: 655177 - protein, 9 aa, Homo Sapiens
VTKEVHATS

SEQ ID NO: 655178 - protein, 9 aa, Homo Sapiens
SGVFQTTDT

SEQ ID NO: 655179 - protein, 9 aa, Homo Sapiens
TKLVLLRQP

SEQ ID NO: 655180 - protein, 9 aa, Homo Sapiens
NLIKEAQWD

SEQ ID NO: 655181 - protein, 9 aa, Homo Sapiens
IRNKKGDHA

SEQ ID NO: 655182 - protein, 9 aa, Homo Sapiens
GVMVCAVLG

SEQ ID NO: 655183 - protein, 9 aa, Homo Sapiens
IEVICYGLT

SEQ ID NO: 655184 - protein, 9 aa, Homo Sapiens
DSQLRNEVA

SEQ ID NO: 655185 - protein, 9 aa, Homo Sapiens
TSEVNYIIT

SEQ ID NO: 655186 - protein, 9 aa, Homo Sapiens
LLHHTIILA

SEQ ID NO: 655187 - protein, 9 aa, Homo Sapiens
QLTAKRCLF

SEQ ID NO: 655188 - protein, 9 aa, Homo Sapiens
LYVHCEPQG

SEQ ID NO: 655189 - protein, 9 aa, Homo Sapiens
ETWRCPSPC

SEQ ID NO: 655190 - protein, 9 aa, Homo Sapiens
KVTAPETQA

SEQ ID NO: 655191 - protein, 9 aa, Homo Sapiens
LPIHQDEIL

SEQ ID NO: 655192 - protein, 9 aa, Homo Sapiens
TPLALVTLL

SEQ ID NO: 655193 - protein, 9 aa, Homo Sapiens
HQLLGLLSA

SEQ ID NO: 655194 - protein, 9 aa, Homo Sapiens
LWFHLDWVS

SEQ ID NO: 655195 - protein, 9 aa, Homo Sapiens
PLRCTNFDP

SEQ ID NO: 655196 - protein, 9 aa, Homo Sapiens
GSYPCQCRA

SEQ ID NO: 655197 - protein, 9 aa, Homo Sapiens
IRTQRNYLI

SEQ ID NO: 655198 - protein, 9 aa, Homo Sapiens
KERYTLDLT

SEQ ID NO: 655199 - protein, 9 aa, Homo Sapiens
KVSSLVLVS

SEQ ID NO: 655200 - protein, 9 aa, Homo Sapiens
YILVIIVSI

SEQ ID NO: 655201 - protein, 9 aa, Homo Sapiens
TNFSSRPWL

SEQ ID NO: 655202 - protein, 9 aa, Homo Sapiens
HEGVKDCDG

SEQ ID NO: 655203 - protein, 9 aa, Homo Sapiens
NGLECFQKS

SEQ ID NO: 655204 - protein, 9 aa, Homo Sapiens
KWTIEVICY

SEQ ID NO: 655205 - protein, 9 aa, Homo Sapiens
MEPLTIVKL

SEQ ID NO: 655206 - protein, 9 aa, Homo Sapiens
YRLQAGVPE

SEQ ID NO: 655207 - protein, 9 aa, Homo Sapiens
LLKHGANIR

SEQ ID NO: 655208 - protein, 9 aa, Homo Sapiens
DLCQLLLQH

SEQ ID NO: 655209 - protein, 9 aa, Homo Sapiens
ENISGTEDE

SEQ ID NO: 655210 - protein, 9 aa, Homo Sapiens
LFTHDHMSG

SEQ ID NO: 655211 - protein, 9 aa, Homo Sapiens
RNGSARATG

SEQ ID NO: 655212 - protein, 9 aa, Homo Sapiens
WEGLTVRIV

SEQ ID NO: 655213 - protein, 9 aa, Homo Sapiens
VGSPVGEIA

SEQ ID NO: 655214 - protein, 9 aa, Homo Sapiens
YNSPVNNPT

SEQ ID NO: 655215 - protein, 9 aa, Homo Sapiens
EEGQASSWS

SEQ ID NO: 655216 - protein, 9 aa, Homo Sapiens
GALAAVHSP

SEQ ID NO: 655217 - protein, 9 aa, Homo Sapiens
PNKELAYES

SEQ ID NO: 655218 - protein, 9 aa, Homo Sapiens
WTIEVICYG

SEQ ID NO: 655219 - protein, 9 aa, Homo Sapiens
QAWKKSLAT

SEQ ID NO: 655220 - protein, 9 aa, Homo Sapiens
WCYVAWARV

SEQ ID NO: 655221 - protein, 9 aa, Homo Sapiens
SPGGGRFGE

SEQ ID NO: 655222 - protein, 9 aa, Homo Sapiens
TDCLELQSL

SEQ ID NO: 655223 - protein, 9 aa, Homo Sapiens
GEKSWALPQ

SEQ ID NO: 655224 - protein, 9 aa, Homo Sapiens
LQGVGNLAS

SEQ ID NO: 655225 - protein, 9 aa, Homo Sapiens
GGTRVALNP

SEQ ID NO: 655226 - protein, 9 aa, Homo Sapiens
RGRIEWNGA

SEQ ID NO: 655227 - protein, 9 aa, Homo Sapiens
FIILRNGLL

SEQ ID NO: 655228 - protein, 9 aa, Homo Sapiens
LQQQYEDVS

SEQ ID NO: 655229 - protein, 9 aa, Homo Sapiens
GNLQPTSMW

SEQ ID NO: 655230 - protein, 9 aa, Homo Sapiens
EKDNKEKKK

SEQ ID NO: 655231 - protein, 9 aa, Homo Sapiens
LLPHLAADM

SEQ ID NO: 655232 - protein, 9 aa, Homo Sapiens
SDADPSTND

SEQ ID NO: 655233 - protein, 9 aa, Homo Sapiens
GFELFTDLI

SEQ ID NO: 655234 - protein, 9 aa, Homo Sapiens
PVHAREPLR

SEQ ID NO: 655235 - protein, 9 aa, Homo Sapiens
CSRDFLLKL

SEQ ID NO: 655236 - protein, 9 aa, Homo Sapiens
SIPLVDTIW

SEQ ID NO: 655237 - protein, 9 aa, Homo Sapiens
LASLRLREV

SEQ ID NO: 655238 - protein, 9 aa, Homo Sapiens
VPRATISTY

SEQ ID NO: 655239 - protein, 9 aa, Homo Sapiens
MLDLSNLQH

SEQ ID NO: 655240 - protein, 9 aa, Homo Sapiens
SELQEAMRK

SEQ ID NO: 655241 - protein, 9 aa, Homo Sapiens
RAMKLQKLH

SEQ ID NO: 655242 - protein, 9 aa, Homo Sapiens
ALNPWGARI

SEQ ID NO: 655243 - protein, 9 aa, Homo Sapiens
WKKDACSIC

SEQ ID NO: 655244 - protein, 9 aa, Homo Sapiens
ECFQKSGHC

SEQ ID NO: 655245 - protein, 9 aa, Homo Sapiens
DLQKIGQFC

SEQ ID NO: 655246 - protein, 9 aa, Homo Sapiens
ITETASQPN

SEQ ID NO: 655247 - protein, 9 aa, Homo Sapiens
GLTVRIVFN

SEQ ID NO: 655248 - protein, 9 aa, Homo Sapiens
GQWRKMFDD

SEQ ID NO: 655249 - protein, 9 aa, Homo Sapiens
KYDFHPRKW

SEQ ID NO: 655250 - protein, 9 aa, Homo Sapiens
IPCLDLGEQ

SEQ ID NO: 655251 - protein, 9 aa, Homo Sapiens
TSVFEEDGC

SEQ ID NO: 655252 - protein, 9 aa, Homo Sapiens
GIKKVDTVV

SEQ ID NO: 655253 - protein, 9 aa, Homo Sapiens
NPFWKTANP

SEQ ID NO: 655254 - protein, 9 aa, Homo Sapiens
QILPFIKEL

SEQ ID NO: 655255 - protein, 9 aa, Homo Sapiens
RALSEDSAT

SEQ ID NO: 655256 - protein, 9 aa, Homo Sapiens
TQCFQLSNV

SEQ ID NO: 655257 - protein, 9 aa, Homo Sapiens
LVATLEDEG

SEQ ID NO: 655258 - protein, 9 aa, Homo Sapiens
VGEIAFEKP

SEQ ID NO: 655259 - protein, 9 aa, Homo Sapiens
PLHYPVVMS

SEQ ID NO: 655260 - protein, 9 aa, Homo Sapiens
KLQEPLFDV

SEQ ID NO: 655261 - protein, 9 aa, Homo Sapiens
AGGTRVALN

SEQ ID NO: 655262 - protein, 9 aa, Homo Sapiens
KLLEVLNAI

SEQ ID NO: 655263 - protein, 9 aa, Homo Sapiens
LETEDPLPP

SEQ ID NO: 655264 - protein, 9 aa, Homo Sapiens
HQRTSMLQK

SEQ ID NO: 655265 - protein, 9 aa, Homo Sapiens
MLRRLHEMK

SEQ ID NO: 655266 - protein, 9 aa, Homo Sapiens
FYRVSYGPL

SEQ ID NO: 655267 - protein, 9 aa, Homo Sapiens
SAPLLVNAI

SEQ ID NO: 655268 - protein, 9 aa, Homo Sapiens
IREDTLADL

SEQ ID NO: 655269 - protein, 9 aa, Homo Sapiens
HSFFQPREL

SEQ ID NO: 655270 - protein, 9 aa, Homo Sapiens
GNSGGDGSA

SEQ ID NO: 655271 - protein, 9 aa, Homo Sapiens
QAGWCYVAW

SEQ ID NO: 655272 - protein, 9 aa, Homo Sapiens
PKPHVRVSS

SEQ ID NO: 655273 - protein, 9 aa, Homo Sapiens
KFIVPYMKQ

SEQ ID NO: 655274 - protein, 9 aa, Homo Sapiens
LRNGSARAT

SEQ ID NO: 655275 - protein, 9 aa, Homo Sapiens
QELVARFRQ

SEQ ID NO: 655276 - protein, 9 aa, Homo Sapiens
NVRKCIHEE

SEQ ID NO: 655277 - protein, 9 aa, Homo Sapiens
NKFCDVTVF

SEQ ID NO: 655278 - protein, 9 aa, Homo Sapiens
ITDFGICKE

SEQ ID NO: 655279 - protein, 9 aa, Homo Sapiens
SVTVPGADQ

SEQ ID NO: 655280 - protein, 9 aa, Homo Sapiens
GSVYRRSHS

SEQ ID NO: 655281 - protein, 9 aa, Homo Sapiens
RTRRWFFTI

SEQ ID NO: 655282 - protein, 9 aa, Homo Sapiens
DLVNVVKLI

SEQ ID NO: 655283 - protein, 9 aa, Homo Sapiens
LLLGIMAFD

SEQ ID NO: 655284 - protein, 9 aa, Homo Sapiens
LISKTGMIL

SEQ ID NO: 655285 - protein, 9 aa, Homo Sapiens
PCLDLGEQV

SEQ ID NO: 655286 - protein, 9 aa, Homo Sapiens
PKTDLTAFS

SEQ ID NO: 655287 - protein, 9 aa, Homo Sapiens
TTLAFGDHP

SEQ ID NO: 655288 - protein, 9 aa, Homo Sapiens
SSNPDLLQL

SEQ ID NO: 655289 - protein, 9 aa, Homo Sapiens
SLWGVPDSP

SEQ ID NO: 655290 - protein, 9 aa, Homo Sapiens
LVASIHLSK

SEQ ID NO: 655291 - protein, 9 aa, Homo Sapiens
QRTSMLQKS

SEQ ID NO: 655292 - protein, 9 aa, Homo Sapiens
LHYEALRGS

SEQ ID NO: 655293 - protein, 9 aa, Homo Sapiens
VIKYCSCPQ

SEQ ID NO: 655294 - protein, 9 aa, Homo Sapiens
RLDGASWRV

SEQ ID NO: 655295 - protein, 9 aa, Homo Sapiens
ITIPKKLEY

SEQ ID NO: 655296 - protein, 9 aa, Homo Sapiens
HIRNHLPTQ

SEQ ID NO: 655297 - protein, 9 aa, Homo Sapiens
AHLQNEKKT

SEQ ID NO: 655298 - protein, 9 aa, Homo Sapiens
VCSNNSDPM

SEQ ID NO: 655299 - protein, 9 aa, Homo Sapiens
AMKAYDGLV

SEQ ID NO: 655300 - protein, 9 aa, Homo Sapiens
TTATGEIEV

SEQ ID NO: 655301 - protein, 9 aa, Homo Sapiens
QSNTGISAL

SEQ ID NO: 655302 - protein, 8 aa, Homo Sapiens
GTEKESPE

SEQ ID NO: 655303 - protein, 9 aa, Homo Sapiens
DSFQDITVS

SEQ ID NO: 655304 - protein, 9 aa, Homo Sapiens
GAVSANMTL

SEQ ID NO: 655305 - protein, 9 aa, Homo Sapiens
ATHFKKVRR

SEQ ID NO: 655306 - protein, 9 aa, Homo Sapiens
EWVTMSKKN

SEQ ID NO: 655307 - protein, 9 aa, Homo Sapiens
KGYCLRCHR

SEQ ID NO: 655308 - protein, 9 aa, Homo Sapiens
VMLVMFGHC

SEQ ID NO: 655309 - protein, 9 aa, Homo Sapiens
PEDLAEETP

SEQ ID NO: 655310 - protein, 9 aa, Homo Sapiens
VSGVALAEG

SEQ ID NO: 655311 - protein, 9 aa, Homo Sapiens
IESAAKSTS

SEQ ID NO: 655312 - protein, 9 aa, Homo Sapiens
RQPPAKLSI

SEQ ID NO: 655313 - protein, 9 aa, Homo Sapiens
SKDGQKEKF

SEQ ID NO: 655314 - protein, 9 aa, Homo Sapiens
LSGHTDGTI

SEQ ID NO: 655315 - protein, 9 aa, Homo Sapiens
KALRARLTL

SEQ ID NO: 655316 - protein, 9 aa, Homo Sapiens
TTSGSSAPT

SEQ ID NO: 655317 - protein, 9 aa, Homo Sapiens
ASHPGKITS

SEQ ID NO: 655318 - protein, 9 aa, Homo Sapiens
VYILVIIVS

SEQ ID NO: 655319 - protein, 9 aa, Homo Sapiens
ISLLSDSKV

SEQ ID NO: 655320 - protein, 9 aa, Homo Sapiens
LLSEEHWKV

SEQ ID NO: 655321 - protein, 9 aa, Homo Sapiens
DVKGALLKV

SEQ ID NO: 655322 - protein, 9 aa, Homo Sapiens
LVVQVIKYC

SEQ ID NO: 655323 - protein, 9 aa, Homo Sapiens
RAQVDLVVQ

SEQ ID NO: 655324 - protein, 9 aa, Homo Sapiens
PEGSNCGES

SEQ ID NO: 655325 - protein, 9 aa, Homo Sapiens
QIKHEEGLK

SEQ ID NO: 655326 - protein, 9 aa, Homo Sapiens
ASWLRPMRT

SEQ ID NO: 655327 - protein, 9 aa, Homo Sapiens
RKCIHEEVV

SEQ ID NO: 655328 - protein, 9 aa, Homo Sapiens
KDVKGALLK

SEQ ID NO: 655329 - protein, 9 aa, Homo Sapiens
GLIESAAKS

SEQ ID NO: 655330 - protein, 9 aa, Homo Sapiens
GDLCQLLLQ

SEQ ID NO: 655331 - protein, 9 aa, Homo Sapiens
KCLDWWQEW

SEQ ID NO: 655332 - protein, 9 aa, Homo Sapiens
VMKDSFLYL

SEQ ID NO: 655333 - protein, 9 aa, Homo Sapiens
NHMDVMNVE

SEQ ID NO: 655334 - protein, 9 aa, Homo Sapiens
GLSARCSVL

SEQ ID NO: 655335 - protein, 9 aa, Homo Sapiens
RKSATAAEK

SEQ ID NO: 655336 - protein, 9 aa, Homo Sapiens
QNRVASLQK

SEQ ID NO: 655337 - protein, 9 aa, Homo Sapiens
FLIITGPNK

SEQ ID NO: 655338 - protein, 9 aa, Homo Sapiens
PSTNDFLLQ

SEQ ID NO: 655339 - protein, 9 aa, Homo Sapiens
MYLYMPKWL

SEQ ID NO: 655340 - protein, 9 aa, Homo Sapiens
CDTFRKIVY

SEQ ID NO: 655341 - protein, 9 aa, Homo Sapiens
RKHAERQLL

SEQ ID NO: 655342 - protein, 9 aa, Homo Sapiens
LNARVLRAM

SEQ ID NO: 655343 - protein, 9 aa, Homo Sapiens
PTHISDAWT

SEQ ID NO: 655344 - protein, 9 aa, Homo Sapiens
AWKKSLATC

SEQ ID NO: 655345 - protein, 9 aa, Homo Sapiens
DRYFSQSAG

SEQ ID NO: 655346 - protein, 9 aa, Homo Sapiens
VGGEVEKAC

SEQ ID NO: 655347 - protein, 9 aa, Homo Sapiens
SEDSATTND

SEQ ID NO: 655348 - protein, 9 aa, Homo Sapiens
LTLFQSKSN

SEQ ID NO: 655349 - protein, 9 aa, Homo Sapiens
PTSVSGLHS

SEQ ID NO: 655350 - protein, 9 aa, Homo Sapiens
RFFPGRSNC

SEQ ID NO: 655351 - protein, 9 aa, Homo Sapiens
AMNFFTNPA

SEQ ID NO: 655352 - protein, 9 aa, Homo Sapiens
APLLVNAII

SEQ ID NO: 655353 - protein, 9 aa, Homo Sapiens
NAKPGQMIQ

SEQ ID NO: 655354 - protein, 9 aa, Homo Sapiens
PQLIIKPDC

SEQ ID NO: 655355 - protein, 9 aa, Homo Sapiens
PTPCKKCLS

SEQ ID NO: 655356 - protein, 9 aa, Homo Sapiens
DGIPFFPSA

SEQ ID NO: 655357 - protein, 9 aa, Homo Sapiens
RGLRNGSAR

SEQ ID NO: 655358 - protein, 9 aa, Homo Sapiens
AGVWGSSWP

SEQ ID NO: 655359 - protein, 9 aa, Homo Sapiens
KELQDITPE

SEQ ID NO: 655360 - protein, 9 aa, Homo Sapiens
EEDMVGRLL

SEQ ID NO: 655361 - protein, 9 aa, Homo Sapiens
DLMSLLFLP

SEQ ID NO: 655362 - protein, 9 aa, Homo Sapiens
HESIHTGEK

SEQ ID NO: 655363 - protein, 9 aa, Homo Sapiens
MPVSGVALA

SEQ ID NO: 655364 - protein, 9 aa, Homo Sapiens
HHLSPSTHV

SEQ ID NO: 655365 - protein, 9 aa, Homo Sapiens
AQWEGLTVR

SEQ ID NO: 655366 - protein, 9 aa, Homo Sapiens
LTDCLELQS

SEQ ID NO: 655367 - protein, 9 aa, Homo Sapiens
MSYAFLLDL

SEQ ID NO: 655368 - protein, 9 aa, Homo Sapiens
ATNFNQGRS

SEQ ID NO: 655369 - protein, 9 aa, Homo Sapiens
RERTVRHEM

SEQ ID NO: 655370 - protein, 9 aa, Homo Sapiens
RPLPLGVIS

SEQ ID NO: 655371 - protein, 9 aa, Homo Sapiens
IELSSVSAL

SEQ ID NO: 655372 - protein, 9 aa, Homo Sapiens
TEDDPTLEF

SEQ ID NO: 655373 - protein, 9 aa, Homo Sapiens
QGRSSLQAV

SEQ ID NO: 655374 - protein, 9 aa, Homo Sapiens
KKVRRPSRA

SEQ ID NO: 655375 - protein, 9 aa, Homo Sapiens
VYSTLVLCN

SEQ ID NO: 655376 - protein, 9 aa, Homo Sapiens
LHVTSLSSA

SEQ ID NO: 655377 - protein, 9 aa, Homo Sapiens
KDSFLYLEP

SEQ ID NO: 655378 - protein, 9 aa, Homo Sapiens
QIYEKRMGG

SEQ ID NO: 655379 - protein, 9 aa, Homo Sapiens
PPAALQLSS

SEQ ID NO: 655380 - protein, 9 aa, Homo Sapiens
NGEKFEFLG

SEQ ID NO: 655381 - protein, 9 aa, Homo Sapiens
VPPSGHSNP

SEQ ID NO: 655382 - protein, 9 aa, Homo Sapiens
TFFFLHKEF

SEQ ID NO: 655383 - protein, 9 aa, Homo Sapiens
PQLEAVLRR

SEQ ID NO: 655384 - protein, 9 aa, Homo Sapiens
NKVMTLLHE

SEQ ID NO: 655385 - protein, 9 aa, Homo Sapiens
SWQTSYVES

SEQ ID NO: 655386 - protein, 9 aa, Homo Sapiens
NRVASLQKE

SEQ ID NO: 655387 - protein, 9 aa, Homo Sapiens
TVSVLHGSH

SEQ ID NO: 655388 - protein, 9 aa, Homo Sapiens
AFQSNTGIS

SEQ ID NO: 655389 - protein, 9 aa, Homo Sapiens
TKVNNNLHK

SEQ ID NO: 655390 - protein, 9 aa, Homo Sapiens
RELLRRRYE

SEQ ID NO: 655391 - protein, 9 aa, Homo Sapiens
TIADALFYQ

SEQ ID NO: 655392 - protein, 9 aa, Homo Sapiens
LGSFSEETN

SEQ ID NO: 655393 - protein, 9 aa, Homo Sapiens
QLIIKPDCN

SEQ ID NO: 655394 - protein, 9 aa, Homo Sapiens
QCFQLSNVF

SEQ ID NO: 655395 - protein, 9 aa, Homo Sapiens
GTYSVGTVG

SEQ ID NO: 655396 - protein, 9 aa, Homo Sapiens
RDLGHHRVL

SEQ ID NO: 655397 - protein, 9 aa, Homo Sapiens
ELFTDLILA

SEQ ID NO: 655398 - protein, 9 aa, Homo Sapiens
GMNHVTLDR

SEQ ID NO: 655399 - protein, 9 aa, Homo Sapiens
ACQSEVNDD

SEQ ID NO: 655400 - protein, 9 aa, Homo Sapiens
SSEMDLRFA

SEQ ID NO: 655401 - protein, 9 aa, Homo Sapiens
LSYDISADD

SEQ ID NO: 655402 - protein, 9 aa, Homo Sapiens
ENKQMLKPH

SEQ ID NO: 655403 - protein, 9 aa, Homo Sapiens
EPELERAFM

SEQ ID NO: 655404 - protein, 9 aa, Homo Sapiens
KITDFGICK

SEQ ID NO: 655405 - protein, 9 aa, Homo Sapiens
EVVKCPGAP

SEQ ID NO: 655406 - protein, 9 aa, Homo Sapiens
KFSSESDME

SEQ ID NO: 655407 - protein, 9 aa, Homo Sapiens
QCTFFFLHK

SEQ ID NO: 655408 - protein, 9 aa, Homo Sapiens
RHNHGDSDD

SEQ ID NO: 655409 - protein, 9 aa, Homo Sapiens
ASGWTVSPR

SEQ ID NO: 655410 - protein, 9 aa, Homo Sapiens
KPGQMIQIV

SEQ ID NO: 655411 - protein, 9 aa, Homo Sapiens
SGEPELERA

SEQ ID NO: 655412 - protein, 9 aa, Homo Sapiens
TLAAVPAQL

SEQ ID NO: 655413 - protein, 9 aa, Homo Sapiens
PPGPLKAEP

SEQ ID NO: 655414 - protein, 9 aa, Homo Sapiens
LEGTVRLGV

SEQ ID NO: 655415 - protein, 9 aa, Homo Sapiens
SKSPDNIWI

SEQ ID NO: 655416 - protein, 9 aa, Homo Sapiens
KALWKSLLP

SEQ ID NO: 655417 - protein, 9 aa, Homo Sapiens
YQQDCCVPV

SEQ ID NO: 655418 - protein, 9 aa, Homo Sapiens
NNGGARLGM

SEQ ID NO: 655419 - protein, 9 aa, Homo Sapiens
FTNPAKNLV

SEQ ID NO: 655420 - protein, 9 aa, Homo Sapiens
RMDESLGLI

SEQ ID NO: 655421 - protein, 9 aa, Homo Sapiens
GLIMGGMLL

SEQ ID NO: 655422 - protein, 9 aa, Homo Sapiens
QLSNVFNPQ

SEQ ID NO: 655423 - protein, 9 aa, Homo Sapiens
ENGHVGLQE

SEQ ID NO: 655424 - protein, 9 aa, Homo Sapiens
LLHGPDLTR

SEQ ID NO: 655425 - protein, 9 aa, Homo Sapiens
GLVKLTLGS

SEQ ID NO: 655426 - protein, 9 aa, Homo Sapiens
ALEGQDPLG

SEQ ID NO: 655427 - protein, 9 aa, Homo Sapiens
NLLHGPDLT

SEQ ID NO: 655428 - protein, 9 aa, Homo Sapiens
NRESQGEKA

SEQ ID NO: 655429 - protein, 9 aa, Homo Sapiens
QRTHTGKNH

SEQ ID NO: 655430 - protein, 9 aa, Homo Sapiens
MYVLLLTLA

SEQ ID NO: 655431 - protein, 9 aa, Homo Sapiens
MQFPVTVHF

SEQ ID NO: 655432 - protein, 9 aa, Homo Sapiens
ELHYEALRG

SEQ ID NO: 655433 - protein, 9 aa, Homo Sapiens
HISDAWTYT

SEQ ID NO: 655434 - protein, 9 aa, Homo Sapiens
KGFVFVSFE

SEQ ID NO: 655435 - protein, 9 aa, Homo Sapiens
PLKRKDQSQ

SEQ ID NO: 655436 - protein, 9 aa, Homo Sapiens
QRRACVKKL

SEQ ID NO: 655437 - protein, 9 aa, Homo Sapiens
KTKTYFWKV

SEQ ID NO: 655438 - protein, 9 aa, Homo Sapiens
CFQKSGHCT

SEQ ID NO: 655439 - protein, 9 aa, Homo Sapiens
EHGAIEERE

SEQ ID NO: 655440 - protein, 9 aa, Homo Sapiens
FSGTSSSRA

SEQ ID NO: 655441 - protein, 9 aa, Homo Sapiens
SSSNNFYKL

SEQ ID NO: 655442 - protein, 9 aa, Homo Sapiens
PAPELMASF

SEQ ID NO: 655443 - protein, 9 aa, Homo Sapiens
VKYDFHPRK

SEQ ID NO: 655444 - protein, 9 aa, Homo Sapiens
PSDENSFED

SEQ ID NO: 655445 - protein, 9 aa, Homo Sapiens
ELLRYSDSL

SEQ ID NO: 655446 - protein, 9 aa, Homo Sapiens
LPTPCKKCL

SEQ ID NO: 655447 - protein, 9 aa, Homo Sapiens
LATQFDLAE

SEQ ID NO: 655448 - protein, 9 aa, Homo Sapiens
VCKSAYHPT

SEQ ID NO: 655449 - protein, 9 aa, Homo Sapiens
LLQAGWCYV

SEQ ID NO: 655450 - protein, 9 aa, Homo Sapiens
IPNPSPSSP

SEQ ID NO: 655451 - protein, 9 aa, Homo Sapiens
YVSLEWVTM

SEQ ID NO: 655452 - protein, 9 aa, Homo Sapiens
LSIYYEMEP

SEQ ID NO: 655453 - protein, 9 aa, Homo Sapiens
FMKQLPFCR

SEQ ID NO: 655454 - protein, 9 aa, Homo Sapiens
ANLLNARVL

SEQ ID NO: 655455 - protein, 9 aa, Homo Sapiens
LYPFTYRAL

SEQ ID NO: 655456 - protein, 9 aa, Homo Sapiens
NLHKNKPDL

SEQ ID NO: 655457 - protein, 9 aa, Homo Sapiens
QRNESTQKK

SEQ ID NO: 655458 - protein, 9 aa, Homo Sapiens
KFCDVTVFI

SEQ ID NO: 655459 - protein, 9 aa, Homo Sapiens
LCQSDAISP

SEQ ID NO: 655460 - protein, 9 aa, Homo Sapiens
GVQMMNKVF

SEQ ID NO: 655461 - protein, 9 aa, Homo Sapiens
VFVSFERHE

SEQ ID NO: 655462 - protein, 9 aa, Homo Sapiens
KGASSFSPL

SEQ ID NO: 655463 - protein, 9 aa, Homo Sapiens
DESLGLIEV

SEQ ID NO: 655464 - protein, 9 aa, Homo Sapiens
EPQQLTAKR

SEQ ID NO: 655465 - protein, 9 aa, Homo Sapiens
EPQQLTAKS

SEQ ID NO: 655466 - protein, 9 aa, Homo Sapiens
FAPLLFVLS

SEQ ID NO: 655467 - protein, 9 aa, Homo Sapiens
YIEDMAMKA

SEQ ID NO: 655468 - protein, 9 aa, Homo Sapiens
GGGIMSKTC

SEQ ID NO: 655469 - protein, 9 aa, Homo Sapiens
SRGLRNGSA

SEQ ID NO: 655470 - protein, 9 aa, Homo Sapiens
QSLDCGSNF

SEQ ID NO: 655471 - protein, 9 aa, Homo Sapiens
PQQLTAKSN

SEQ ID NO: 655472 - protein, 9 aa, Homo Sapiens
GPDLTRIHP

SEQ ID NO: 655473 - protein, 9 aa, Homo Sapiens
AAASGWTVS

SEQ ID NO: 655474 - protein, 9 aa, Homo Sapiens
SFYHLVATL

SEQ ID NO: 655475 - protein, 9 aa, Homo Sapiens
VFGITGHLP

SEQ ID NO: 655476 - protein, 9 aa, Homo Sapiens
HEEGLKLTF

SEQ ID NO: 655477 - protein, 9 aa, Homo Sapiens
CSNNSDPMG

SEQ ID NO: 655478 - protein, 9 aa, Homo Sapiens
LVSRASFCP

SEQ ID NO: 655479 - protein, 9 aa, Homo Sapiens
FPSANGVIL

SEQ ID NO: 655480 - protein, 9 aa, Homo Sapiens
HGDSDDDVE

SEQ ID NO: 655481 - protein, 9 aa, Homo Sapiens
RKLEELQQI

SEQ ID NO: 655482 - protein, 9 aa, Homo Sapiens
ALQELVARF

SEQ ID NO: 655483 - protein, 9 aa, Homo Sapiens
GDSPGDSPH

SEQ ID NO: 655484 - protein, 9 aa, Homo Sapiens
EWQVYIEKF

SEQ ID NO: 655485 - protein, 9 aa, Homo Sapiens
QTYVHFPSR

SEQ ID NO: 655486 - protein, 9 aa, Homo Sapiens
GACQSEVND

SEQ ID NO: 655487 - protein, 9 aa, Homo Sapiens
KYQTFLLHL

SEQ ID NO: 655488 - protein, 9 aa, Homo Sapiens
IKVESMQFP

SEQ ID NO: 655489 - protein, 9 aa, Homo Sapiens
VHFPSRAIK

SEQ ID NO: 655490 - protein, 9 aa, Homo Sapiens
GEVEKACAN

SEQ ID NO: 655491 - protein, 9 aa, Homo Sapiens
SNFLQLICQ

SEQ ID NO: 655492 - protein, 9 aa, Homo Sapiens
SLSLIHAVM

SEQ ID NO: 655493 - protein, 9 aa, Homo Sapiens
YKKEGTYSV

SEQ ID NO: 655494 - protein, 9 aa, Homo Sapiens
SSVRIGQLM

SEQ ID NO: 655495 - protein, 9 aa, Homo Sapiens
AAAGHFPGA

SEQ ID NO: 655496 - protein, 9 aa, Homo Sapiens
LFDVLQKLC

SEQ ID NO: 655497 - protein, 9 aa, Homo Sapiens
IRVRNPRGR

SEQ ID NO: 655498 - protein, 9 aa, Homo Sapiens
KITIKFFAP

SEQ ID NO: 655499 - protein, 9 aa, Homo Sapiens
RCCLDPSAV

SEQ ID NO: 655500 - protein, 9 aa, Homo Sapiens
ATQFDLAET

SEQ ID NO: 655501 - protein, 9 aa, Homo Sapiens
GAPMRDMGH

SEQ ID NO: 655502 - protein, 9 aa, Homo Sapiens
SITQWQKIG

SEQ ID NO: 655503 - protein, 9 aa, Homo Sapiens
GEKFEFLGL

SEQ ID NO: 655504 - protein, 9 aa, Homo Sapiens
TLKNINFST

SEQ ID NO: 655505 - protein, 9 aa, Homo Sapiens
LFVVFLAIY

SEQ ID NO: 655506 - protein, 9 aa, Homo Sapiens
HDCSGSCQC

SEQ ID NO: 655507 - protein, 9 aa, Homo Sapiens
VGGDNPLVL

SEQ ID NO: 655508 - protein, 9 aa, Homo Sapiens
WWWWCCYSG

SEQ ID NO: 655509 - protein, 9 aa, Homo Sapiens
MLSDGTETG

SEQ ID NO: 655510 - protein, 9 aa, Homo Sapiens
SFTVTSAPG

SEQ ID NO: 655511 - protein, 9 aa, Homo Sapiens
VLHGSHSGP

SEQ ID NO: 655512 - protein, 9 aa, Homo Sapiens
AIYFSQEEL

SEQ ID NO: 655513 - protein, 9 aa, Homo Sapiens
NPQLIIKPD

SEQ ID NO: 655514 - protein, 9 aa, Homo Sapiens
WCRPLQIFL

SEQ ID NO: 655515 - protein, 9 aa, Homo Sapiens
IVVCGNITL

SEQ ID NO: 655516 - protein, 9 aa, Homo Sapiens
PTPATSMES

SEQ ID NO: 655517 - protein, 9 aa, Homo Sapiens
LAYESQTLK

SEQ ID NO: 655518 - protein, 9 aa, Homo Sapiens
KNHMDVMNV

SEQ ID NO: 655519 - protein, 9 aa, Homo Sapiens
CPVLGEQND

SEQ ID NO: 655520 - protein, 9 aa, Homo Sapiens
ASDKLVERS

SEQ ID NO: 655521 - protein, 9 aa, Homo Sapiens
VLGICYGVQ

SEQ ID NO: 655522 - protein, 9 aa, Homo Sapiens
AIIIVVMWV

SEQ ID NO: 655523 - protein, 9 aa, Homo Sapiens
FQLQYQIIF

SEQ ID NO: 655524 - protein, 9 aa, Homo Sapiens
TGYHISWEV

SEQ ID NO: 655525 - protein, 9 aa, Homo Sapiens
FYLQVEHQE

SEQ ID NO: 655526 - protein, 9 aa, Homo Sapiens
LGERFFPGR

SEQ ID NO: 655527 - protein, 9 aa, Homo Sapiens
IDLPEFTFG

SEQ ID NO: 655528 - protein, 9 aa, Homo Sapiens
FLRKLEELQ

SEQ ID NO: 655529 - protein, 9 aa, Homo Sapiens
GIKYQTFLL

SEQ ID NO: 655530 - protein, 9 aa, Homo Sapiens
TSHIRNHLP

SEQ ID NO: 655531 - protein, 9 aa, Homo Sapiens
LPHLTRTLS

SEQ ID NO: 655532 - protein, 9 aa, Homo Sapiens
FGMNHVTLD

SEQ ID NO: 655533 - protein, 9 aa, Homo Sapiens
KNSSREKSE

SEQ ID NO: 655534 - protein, 9 aa, Homo Sapiens
SPSSPTPLN

SEQ ID NO: 655535 - protein, 9 aa, Homo Sapiens
GGAPKAISG

SEQ ID NO: 655536 - protein, 9 aa, Homo Sapiens
RLLWRNLLW

SEQ ID NO: 655537 - protein, 9 aa, Homo Sapiens
ENEENWKSK

SEQ ID NO: 655538 - protein, 9 aa, Homo Sapiens
KDCVGGEVE

SEQ ID NO: 655539 - protein, 9 aa, Homo Sapiens
QAFVLFQFL

SEQ ID NO: 655540 - protein, 9 aa, Homo Sapiens
MFHIEYFRK

SEQ ID NO: 655541 - protein, 9 aa, Homo Sapiens
TGSPGSLCI

SEQ ID NO: 655542 - protein, 9 aa, Homo Sapiens
IHIYSGNTM

SEQ ID NO: 655543 - protein, 9 aa, Homo Sapiens
CIHEEVVQV

SEQ ID NO: 655544 - protein, 9 aa, Homo Sapiens
SGTSSSRAV

SEQ ID NO: 655545 - protein, 9 aa, Homo Sapiens
ANGNIQMNS

SEQ ID NO: 655546 - protein, 9 aa, Homo Sapiens
QQIYEKRMG

SEQ ID NO: 655547 - protein, 9 aa, Homo Sapiens
AFDKARNEN

SEQ ID NO: 655548 - protein, 9 aa, Homo Sapiens
FNNCGLTTA

SEQ ID NO: 655549 - protein, 9 aa, Homo Sapiens
VCNECEKTF

SEQ ID NO: 655550 - protein, 9 aa, Homo Sapiens
HIKITDFGI

SEQ ID NO: 655551 - protein, 9 aa, Homo Sapiens
DQDAAFFNA

SEQ ID NO: 655552 - protein, 9 aa, Homo Sapiens
WGSSWPGTW

SEQ ID NO: 655553 - protein, 9 aa, Homo Sapiens
GLVFNLQDP

SEQ ID NO: 655554 - protein, 9 aa, Homo Sapiens
EFVCKSAYH

SEQ ID NO: 655555 - protein, 9 aa, Homo Sapiens
QASSWSRRL

SEQ ID NO: 655556 - protein, 9 aa, Homo Sapiens
GIPALHALS

SEQ ID NO: 655557 - protein, 9 aa, Homo Sapiens
IVEHGAIEE

SEQ ID NO: 655558 - protein, 9 aa, Homo Sapiens
ALFCAYMEV

SEQ ID NO: 655559 - protein, 9 aa, Homo Sapiens
HLWLMPDLH

SEQ ID NO: 655560 - protein, 9 aa, Homo Sapiens
QQQYEDVSI

SEQ ID NO: 655561 - protein, 9 aa, Homo Sapiens
KILFVVFLA

SEQ ID NO: 655562 - protein, 9 aa, Homo Sapiens
EHESIHTGE

SEQ ID NO: 655563 - protein, 9 aa, Homo Sapiens
ADNSSSAFT

SEQ ID NO: 655564 - protein, 9 aa, Homo Sapiens
LRLRHACCH

SEQ ID NO: 655565 - protein, 9 aa, Homo Sapiens
HAVMPDVVQ

SEQ ID NO: 655566 - protein, 9 aa, Homo Sapiens
IPLQKFCLV

SEQ ID NO: 655567 - protein, 9 aa, Homo Sapiens
QPAIHPVAS

SEQ ID NO: 655568 - protein, 9 aa, Homo Sapiens
GSPVGEIAF

SEQ ID NO: 655569 - protein, 9 aa, Homo Sapiens
LCGVEAIQE

SEQ ID NO: 655570 - protein, 9 aa, Homo Sapiens
TPKASTVVN

SEQ ID NO: 655571 - protein, 9 aa, Homo Sapiens
ENAKPGQMI

SEQ ID NO: 655572 - protein, 9 aa, Homo Sapiens
QLFTLTSPD

SEQ ID NO: 655573 - protein, 9 aa, Homo Sapiens
VSGFVGKIF

SEQ ID NO: 655574 - protein, 9 aa, Homo Sapiens
VTLHQKIHN

SEQ ID NO: 655575 - protein, 9 aa, Homo Sapiens
FAGTHAESA

SEQ ID NO: 655576 - protein, 9 aa, Homo Sapiens
DGFHSKEVW

SEQ ID NO: 655577 - protein, 9 aa, Homo Sapiens
LTWALALLQ

SEQ ID NO: 655578 - protein, 9 aa, Homo Sapiens
KEAVTLVEG

SEQ ID NO: 655579 - protein, 9 aa, Homo Sapiens
LELGHALGL

SEQ ID NO: 655580 - protein, 9 aa, Homo Sapiens
FHIEYFRKD

SEQ ID NO: 655581 - protein, 9 aa, Homo Sapiens
PKWLYFMMF

SEQ ID NO: 655582 - protein, 9 aa, Homo Sapiens
TAPETYEEY

SEQ ID NO: 655583 - protein, 9 aa, Homo Sapiens
PKACSIGDG

SEQ ID NO: 655584 - protein, 9 aa, Homo Sapiens
WRKMFDDEP

SEQ ID NO: 655585 - protein, 9 aa, Homo Sapiens
DLVVVKLLS

SEQ ID NO: 655586 - protein, 9 aa, Homo Sapiens
ARVLRAMLK

SEQ ID NO: 655587 - protein, 9 aa, Homo Sapiens
HSSFTVPKM

SEQ ID NO: 655588 - protein, 9 aa, Homo Sapiens
PVKKERIKC

SEQ ID NO: 655589 - protein, 9 aa, Homo Sapiens
DGLGSSSPP

SEQ ID NO: 655590 - protein, 9 aa, Homo Sapiens
RINCVHLYY

SEQ ID NO: 655591 - protein, 9 aa, Homo Sapiens
HGTPDNSKS

SEQ ID NO: 655592 - protein, 9 aa, Homo Sapiens
QIRESLFAK

SEQ ID NO: 655593 - protein, 9 aa, Homo Sapiens
ALGTNFSSR

SEQ ID NO: 655594 - protein, 9 aa, Homo Sapiens
TRIDDANQR

SEQ ID NO: 655595 - protein, 9 aa, Homo Sapiens
MDVWARKQH

SEQ ID NO: 655596 - protein, 9 aa, Homo Sapiens
LLDLVASIH

SEQ ID NO: 655597 - protein, 9 aa, Homo Sapiens
TVRIVFNKT

SEQ ID NO: 655598 - protein, 9 aa, Homo Sapiens
QTLVIEMVM

SEQ ID NO: 655599 - protein, 9 aa, Homo Sapiens
DMVCPHKCR

SEQ ID NO: 655600 - protein, 9 aa, Homo Sapiens
EFILFGLTD

SEQ ID NO: 655601 - protein, 9 aa, Homo Sapiens
LDEQTALNK

SEQ ID NO: 655602 - protein, 9 aa, Homo Sapiens
KMFDDEPTI

SEQ ID NO: 655603 - protein, 9 aa, Homo Sapiens
LQLATPVWF

SEQ ID NO: 655604 - protein, 9 aa, Homo Sapiens
DFIWGFGKH

SEQ ID NO: 655605 - protein, 9 aa, Homo Sapiens
PKPDKNDDD

SEQ ID NO: 655606 - protein, 9 aa, Homo Sapiens
IYEKRMGGL

SEQ ID NO: 655607 - protein, 9 aa, Homo Sapiens
QMNIVHKKK

SEQ ID NO: 655608 - protein, 9 aa, Homo Sapiens
LHTPMYVLL

SEQ ID NO: 655609 - protein, 9 aa, Homo Sapiens
EEDTSEVNY

SEQ ID NO: 655610 - protein, 9 aa, Homo Sapiens
IQEPPLQGE

SEQ ID NO: 655611 - protein, 9 aa, Homo Sapiens
LTRKLTYCV

SEQ ID NO: 655612 - protein, 9 aa, Homo Sapiens
ENKKGKLGI

SEQ ID NO: 655613 - protein, 9 aa, Homo Sapiens
HMDVMNVEK

SEQ ID NO: 655614 - protein, 9 aa, Homo Sapiens
DFYLQVEHQ

SEQ ID NO: 655615 - protein, 9 aa, Homo Sapiens
CRPLQIFLC

SEQ ID NO: 655616 - protein, 9 aa, Homo Sapiens
RISKQLSEF

SEQ ID NO: 655617 - protein, 9 aa, Homo Sapiens
AEGGAPKAI

SEQ ID NO: 655618 - protein, 9 aa, Homo Sapiens
RLTWALALL

SEQ ID NO: 655619 - protein, 9 aa, Homo Sapiens
ENKNVSTVE

SEQ ID NO: 655620 - protein, 9 aa, Homo Sapiens
NKSGKSTYL

SEQ ID NO: 655621 - protein, 9 aa, Homo Sapiens
WSGDSPGDS

SEQ ID NO: 655622 - protein, 9 aa, Homo Sapiens
TFNSRFVMK

SEQ ID NO: 655623 - protein, 9 aa, Homo Sapiens
EICIKACKK

SEQ ID NO: 655624 - protein, 9 aa, Homo Sapiens
FNNFQIEVQ

SEQ ID NO: 655625 - protein, 9 aa, Homo Sapiens
YVIWAKVKE

SEQ ID NO: 655626 - protein, 9 aa, Homo Sapiens
FADDIQEFT

SEQ ID NO: 655627 - protein, 9 aa, Homo Sapiens
PQQNMSLLQ

SEQ ID NO: 655628 - protein, 9 aa, Homo Sapiens
ALCQLQNLL

SEQ ID NO: 655629 - protein, 9 aa, Homo Sapiens
AVLELGHAL

SEQ ID NO: 655630 - protein, 9 aa, Homo Sapiens
LRYSDSLLG

SEQ ID NO: 655631 - protein, 9 aa, Homo Sapiens
VSVLFLFLV

SEQ ID NO: 655632 - protein, 9 aa, Homo Sapiens
AQKSEVENL

SEQ ID NO: 655633 - protein, 9 aa, Homo Sapiens
RKKRHEKQL

SEQ ID NO: 655634 - protein, 9 aa, Homo Sapiens
VAPSSLRCA

SEQ ID NO: 655635 - protein, 9 aa, Homo Sapiens
SLGPRLAGL

SEQ ID NO: 655636 - protein, 9 aa, Homo Sapiens
SKGASSFSP

SEQ ID NO: 655637 - protein, 9 aa, Homo Sapiens
QDLASTRPP

SEQ ID NO: 655638 - protein, 9 aa, Homo Sapiens
GFIRLEGIV

SEQ ID NO: 655639 - protein, 9 aa, Homo Sapiens
AVSTIGALC

SEQ ID NO: 655640 - protein, 9 aa, Homo Sapiens
KKIGTLHTS

SEQ ID NO: 655641 - protein, 9 aa, Homo Sapiens
NKQMLKPHL

SEQ ID NO: 655642 - protein, 9 aa, Homo Sapiens
SPPGSRESQ

SEQ ID NO: 655643 - protein, 9 aa, Homo Sapiens
MLLTTVSAF

SEQ ID NO: 655644 - protein, 9 aa, Homo Sapiens
LHVLPSTVK

SEQ ID NO: 655645 - protein, 9 aa, Homo Sapiens
AAAATGISF

SEQ ID NO: 655646 - protein, 9 aa, Homo Sapiens
SVTFKSKKN

SEQ ID NO: 655647 - protein, 9 aa, Homo Sapiens
LFGLTDDPN

SEQ ID NO: 655648 - protein, 9 aa, Homo Sapiens
AGVLYGIDS

SEQ ID NO: 655649 - protein, 9 aa, Homo Sapiens
CVTDHFSQT

SEQ ID NO: 655650 - protein, 9 aa, Homo Sapiens
KMTQLPEAV

SEQ ID NO: 655651 - protein, 9 aa, Homo Sapiens
QNLQRAMKL

SEQ ID NO: 655652 - protein, 9 aa, Homo Sapiens
TLKSDTNWK

SEQ ID NO: 655653 - protein, 9 aa, Homo Sapiens
TGSASPKNQ

SEQ ID NO: 655654 - protein, 9 aa, Homo Sapiens
LQGLNLVRQ

SEQ ID NO: 655655 - protein, 9 aa, Homo Sapiens
NMTLKGQSE

SEQ ID NO: 655656 - protein, 9 aa, Homo Sapiens
PTAGETSAT

SEQ ID NO: 655657 - protein, 9 aa, Homo Sapiens
DMVGRLLPH

SEQ ID NO: 655658 - protein, 9 aa, Homo Sapiens
QQLTAKSNS

SEQ ID NO: 655659 - protein, 9 aa, Homo Sapiens
ITGNDLSPT

SEQ ID NO: 655660 - protein, 9 aa, Homo Sapiens
PSLFNGLNS

SEQ ID NO: 655661 - protein, 9 aa, Homo Sapiens
LSQQAQVED

SEQ ID NO: 655662 - protein, 9 aa, Homo Sapiens
RGQAWLPRG

SEQ ID NO: 655663 - protein, 9 aa, Homo Sapiens
WWGIVNVAF

SEQ ID NO: 655664 - protein, 9 aa, Homo Sapiens
FAPLKRKDQ

SEQ ID NO: 655665 - protein, 9 aa, Homo Sapiens
LPFIKELVS

SEQ ID NO: 655666 - protein, 9 aa, Homo Sapiens
RRRYESSPA

SEQ ID NO: 655667 - protein, 9 aa, Homo Sapiens
QFLFTSCGT

SEQ ID NO: 655668 - protein, 9 aa, Homo Sapiens
PVGEIAFEK

SEQ ID NO: 655669 - protein, 9 aa, Homo Sapiens
ILLKIWKHQ

SEQ ID NO: 655670 - protein, 9 aa, Homo Sapiens
DITQVVWIA

SEQ ID NO: 655671 - protein, 9 aa, Homo Sapiens
YLAAAFPSS

SEQ ID NO: 655672 - protein, 9 aa, Homo Sapiens
NITIPKKLE

SEQ ID NO: 655673 - protein, 9 aa, Homo Sapiens
EDLHHPIHV

SEQ ID NO: 655674 - protein, 9 aa, Homo Sapiens
KNAMKIESG

SEQ ID NO: 655675 - protein, 9 aa, Homo Sapiens
NGPYLGQPH

SEQ ID NO: 655676 - protein, 9 aa, Homo Sapiens
SLFEVQWQL

SEQ ID NO: 655677 - protein, 9 aa, Homo Sapiens
AAECPSFLS

SEQ ID NO: 655678 - protein, 9 aa, Homo Sapiens
EEDGCVTDH

SEQ ID NO: 655679 - protein, 9 aa, Homo Sapiens
KAFKRDVFI

SEQ ID NO: 655680 - protein, 9 aa, Homo Sapiens
KYSRFNVYC

SEQ ID NO: 655681 - protein, 9 aa, Homo Sapiens
CVAGTALLL

SEQ ID NO: 655682 - protein, 9 aa, Homo Sapiens
APKAISGVP

SEQ ID NO: 655683 - protein, 9 aa, Homo Sapiens
QALGPWNSG

SEQ ID NO: 655684 - protein, 9 aa, Homo Sapiens
IAILKKLDL

SEQ ID NO: 655685 - protein, 9 aa, Homo Sapiens
SAAFKFLCL

SEQ ID NO: 655686 - protein, 9 aa, Homo Sapiens
TADPHQEYL

SEQ ID NO: 655687 - protein, 9 aa, Homo Sapiens
HSLRLPGIE

SEQ ID NO: 655688 - protein, 9 aa, Homo Sapiens
SDSLLGVPI

SEQ ID NO: 655689 - protein, 9 aa, Homo Sapiens
QIAGVDKHG

SEQ ID NO: 655690 - protein, 9 aa, Homo Sapiens
ASQDMQQGA

SEQ ID NO: 655691 - protein, 9 aa, Homo Sapiens
EQFWDFIDQ

SEQ ID NO: 655692 - protein, 9 aa, Homo Sapiens
SSREKSELR

SEQ ID NO: 655693 - protein, 9 aa, Homo Sapiens
FNSRFVMKT

SEQ ID NO: 655694 - protein, 9 aa, Homo Sapiens
PPAKLSIGH

SEQ ID NO: 655695 - protein, 9 aa, Homo Sapiens
YYYSPGLHV

SEQ ID NO: 655696 - protein, 9 aa, Homo Sapiens
EVKPLSEMQ

SEQ ID NO: 655697 - protein, 9 aa, Homo Sapiens
KDDWREFQT

SEQ ID NO: 655698 - protein, 9 aa, Homo Sapiens
KLDLVNVVK

SEQ ID NO: 655699 - protein, 9 aa, Homo Sapiens
SDISELLVK

SEQ ID NO: 655700 - protein, 9 aa, Homo Sapiens
LLLRASSKA

SEQ ID NO: 655701 - protein, 9 aa, Homo Sapiens
NTGISALRR

SEQ ID NO: 655702 - protein, 9 aa, Homo Sapiens
NSPGIPNPS

SEQ ID NO: 655703 - protein, 9 aa, Homo Sapiens
QGPPAALQL

SEQ ID NO: 655704 - protein, 9 aa, Homo Sapiens
FDVLQKLCK

SEQ ID NO: 655705 - protein, 9 aa, Homo Sapiens
EKFIVPYMK

SEQ ID NO: 655706 - protein, 9 aa, Homo Sapiens
EKIYNGVIP

SEQ ID NO: 655707 - protein, 9 aa, Homo Sapiens
SQILPFIKE

SEQ ID NO: 655708 - protein, 9 aa, Homo Sapiens
KQDLVQKLK

SEQ ID NO: 655709 - protein, 9 aa, Homo Sapiens
ASALSSHFT

SEQ ID NO: 655710 - protein, 9 aa, Homo Sapiens
FKEKVSSLV

SEQ ID NO: 655711 - protein, 9 aa, Homo Sapiens
LEEVSGYDE

SEQ ID NO: 655712 - protein, 9 aa, Homo Sapiens
QGQHHKMRH

SEQ ID NO: 655713 - protein, 9 aa, Homo Sapiens
SWALPQQYP

SEQ ID NO: 655714 - protein, 9 aa, Homo Sapiens
CVEPISCYM

SEQ ID NO: 655715 - protein, 9 aa, Homo Sapiens
AALQLSSAV

SEQ ID NO: 655716 - protein, 9 aa, Homo Sapiens
CNECEKTFR

SEQ ID NO: 655717 - protein, 9 aa, Homo Sapiens
MVSGQDDSS

SEQ ID NO: 655718 - protein, 9 aa, Homo Sapiens
WVDAVPCLE

SEQ ID NO: 655719 - protein, 9 aa, Homo Sapiens
QDSWDVVEG

SEQ ID NO: 655720 - protein, 9 aa, Homo Sapiens
FLPAFSGLT

SEQ ID NO: 655721 - protein, 9 aa, Homo Sapiens
SQPDIVKGG

SEQ ID NO: 655722 - protein, 9 aa, Homo Sapiens
HVAAVSTIG

SEQ ID NO: 655723 - protein, 9 aa, Homo Sapiens
MSCSGYDIE

SEQ ID NO: 655724 - protein, 9 aa, Homo Sapiens
LIFFIYLDA

SEQ ID NO: 655725 - protein, 9 aa, Homo Sapiens
TSVSGLHSK

SEQ ID NO: 655726 - protein, 9 aa, Homo Sapiens
KSKKNLEVR

SEQ ID NO: 655727 - protein, 9 aa, Homo Sapiens
SAEGERLVP

SEQ ID NO: 655728 - protein, 9 aa, Homo Sapiens
SEVNYIITT

SEQ ID NO: 655729 - protein, 9 aa, Homo Sapiens
QHQKLHTAC

SEQ ID NO: 655730 - protein, 9 aa, Homo Sapiens
VFNLQDPWV

SEQ ID NO: 655731 - protein, 9 aa, Homo Sapiens
LLLALLHHT

SEQ ID NO: 655732 - protein, 9 aa, Homo Sapiens
CLDYNSPVN

SEQ ID NO: 655733 - protein, 9 aa, Homo Sapiens
DIEKEGMKY

SEQ ID NO: 655734 - protein, 9 aa, Homo Sapiens
EAAAATGIS

SEQ ID NO: 655735 - protein, 9 aa, Homo Sapiens
FCALSFRTS

SEQ ID NO: 655736 - protein, 9 aa, Homo Sapiens
ILIVDENDN

SEQ ID NO: 655737 - protein, 9 aa, Homo Sapiens
IPKMLSNII

SEQ ID NO: 655738 - protein, 9 aa, Homo Sapiens
PLPPPTAPE

SEQ ID NO: 655739 - protein, 9 aa, Homo Sapiens
KSAYHPTKS

SEQ ID NO: 655740 - protein, 9 aa, Homo Sapiens
WVIVRSEGE

SEQ ID NO: 655741 - protein, 9 aa, Homo Sapiens
NGQLISYWI

SEQ ID NO: 655742 - protein, 9 aa, Homo Sapiens
GITGHLPDF

SEQ ID NO: 655743 - protein, 9 aa, Homo Sapiens
NPAKNLVSI

SEQ ID NO: 655744 - protein, 9 aa, Homo Sapiens
IQEMMVQLL

SEQ ID NO: 655745 - protein, 9 aa, Homo Sapiens
AFKNLKKLQ

SEQ ID NO: 655746 - protein, 9 aa, Homo Sapiens
SVEKGKMVA

SEQ ID NO: 655747 - protein, 9 aa, Homo Sapiens
DYLQVLDEQ

SEQ ID NO: 655748 - protein, 9 aa, Homo Sapiens
GISRKHAER

SEQ ID NO: 655749 - protein, 9 aa, Homo Sapiens
PEPLHQVTE

SEQ ID NO: 655750 - protein, 9 aa, Homo Sapiens
VTLDRGCSC

SEQ ID NO: 655751 - protein, 9 aa, Homo Sapiens
ALLPLRALP

SEQ ID NO: 655752 - protein, 9 aa, Homo Sapiens
FQENQKEFE

SEQ ID NO: 655753 - protein, 9 aa, Homo Sapiens
LPELPNTLT

SEQ ID NO: 655754 - protein, 9 aa, Homo Sapiens
FKSPLYISP

SEQ ID NO: 655755 - protein, 9 aa, Homo Sapiens
PFFPSANGV

SEQ ID NO: 655756 - protein, 9 aa, Homo Sapiens
RKHQLWAAH

SEQ ID NO: 655757 - protein, 9 aa, Homo Sapiens
LLSLGPRLA

SEQ ID NO: 655758 - protein, 9 aa, Homo Sapiens
VEPISCYME

SEQ ID NO: 655759 - protein, 9 aa, Homo Sapiens
VYPCGACQS

SEQ ID NO: 655760 - protein, 9 aa, Homo Sapiens
QTTRLFAPL

SEQ ID NO: 655761 - protein, 9 aa, Homo Sapiens
RCPSPCWGP

SEQ ID NO: 655762 - protein, 9 aa, Homo Sapiens
RKPTAGETS

SEQ ID NO: 655763 - protein, 9 aa, Homo Sapiens
LKNIMEYYN

SEQ ID NO: 655764 - protein, 9 aa, Homo Sapiens
QDGRKHARF

SEQ ID NO: 655765 - protein, 9 aa, Homo Sapiens
KPTAGETSA

SEQ ID NO: 655766 - protein, 9 aa, Homo Sapiens
SGHTDGTIV

SEQ ID NO: 655767 - protein, 9 aa, Homo Sapiens
SRVPRSDCK

SEQ ID NO: 655768 - protein, 9 aa, Homo Sapiens
MRDMGHPQG

SEQ ID NO: 655769 - protein, 9 aa, Homo Sapiens
GGVQVSSPN

SEQ ID NO: 655770 - protein, 9 aa, Homo Sapiens
ISLEDKKIE

SEQ ID NO: 655771 - protein, 9 aa, Homo Sapiens
VVKLLSEEH

SEQ ID NO: 655772 - protein, 9 aa, Homo Sapiens
VLGNGLVIR

SEQ ID NO: 655773 - protein, 9 aa, Homo Sapiens
VIVINTHHL

SEQ ID NO: 655774 - protein, 9 aa, Homo Sapiens
LKNINFSTR

SEQ ID NO: 655775 - protein, 9 aa, Homo Sapiens
CKKLAYGEE

SEQ ID NO: 655776 - protein, 9 aa, Homo Sapiens
KCEASHPGK

SEQ ID NO: 655777 - protein, 9 aa, Homo Sapiens
WPGTWNKSC

SEQ ID NO: 655778 - protein, 9 aa, Homo Sapiens
WFHLDWVSS

SEQ ID NO: 655779 - protein, 9 aa, Homo Sapiens
GHPWVTHFA

SEQ ID NO: 655780 - protein, 9 aa, Homo Sapiens
SPEPLHQVT

SEQ ID NO: 655781 - protein, 9 aa, Homo Sapiens
LTAFSPSLP

SEQ ID NO: 655782 - protein, 9 aa, Homo Sapiens
PDPQAMFHI

SEQ ID NO: 655783 - protein, 9 aa, Homo Sapiens
LSPVGSPVG

SEQ ID NO: 655784 - protein, 9 aa, Homo Sapiens
NVPGIFSFL

SEQ ID NO: 655785 - protein, 9 aa, Homo Sapiens
IRAINSSNL

SEQ ID NO: 655786 - protein, 9 aa, Homo Sapiens
PTSEIPPDL

SEQ ID NO: 655787 - protein, 9 aa, Homo Sapiens
APHGPPWAP

SEQ ID NO: 655788 - protein, 9 aa, Homo Sapiens
SLIIKDLTE

SEQ ID NO: 655789 - protein, 9 aa, Homo Sapiens
SKKNLEVRK

SEQ ID NO: 655790 - protein, 9 aa, Homo Sapiens
LPLRALPSL

SEQ ID NO: 655791 - protein, 9 aa, Homo Sapiens
LRASSKASD

SEQ ID NO: 655792 - protein, 9 aa, Homo Sapiens
QADGTPAKA

SEQ ID NO: 655793 - protein, 9 aa, Homo Sapiens
NHLNTSHHA

SEQ ID NO: 655794 - protein, 9 aa, Homo Sapiens
HSPLELCDD

SEQ ID NO: 655795 - protein, 9 aa, Homo Sapiens
TNSTVLEKC

SEQ ID NO: 655796 - protein, 9 aa, Homo Sapiens
FRNTDSYLL

SEQ ID NO: 655797 - protein, 9 aa, Homo Sapiens
SLNQKSFYR

SEQ ID NO: 655798 - protein, 9 aa, Homo Sapiens
TIKFFAPDP

SEQ ID NO: 655799 - protein, 9 aa, Homo Sapiens
FRKIVYSKY

SEQ ID NO: 655800 - protein, 9 aa, Homo Sapiens
EEGDTALLP

SEQ ID NO: 655801 - protein, 9 aa, Homo Sapiens
PLGLQLGLT

SEQ ID NO: 655802 - protein, 9 aa, Homo Sapiens
KRAGFPSIP

SEQ ID NO: 655803 - protein, 9 aa, Homo Sapiens
TTPKQGFAS

SEQ ID NO: 655804 - protein, 9 aa, Homo Sapiens
ARLTLVSRA

SEQ ID NO: 655805 - protein, 9 aa, Homo Sapiens
RALLFLNSQ

SEQ ID NO: 655806 - protein, 9 aa, Homo Sapiens
YSVICKKSG

SEQ ID NO: 655807 - protein, 9 aa, Homo Sapiens
LTNRSLHVC

SEQ ID NO: 655808 - protein, 9 aa, Homo Sapiens
HVSGFVGKI

SEQ ID NO: 655809 - protein, 9 aa, Homo Sapiens
NLQPTSMWA

SEQ ID NO: 655810 - protein, 9 aa, Homo Sapiens
WPMYQIYPR

SEQ ID NO: 655811 - protein, 9 aa, Homo Sapiens
EETCQLLKK

SEQ ID NO: 655812 - protein, 9 aa, Homo Sapiens
GSHSGPSYT

SEQ ID NO: 655813 - protein, 9 aa, Homo Sapiens
TAGLRAGPV

SEQ ID NO: 655814 - protein, 9 aa, Homo Sapiens
NLSLVQKKT

SEQ ID NO: 655815 - protein, 9 aa, Homo Sapiens
YSGNTMNIT

SEQ ID NO: 655816 - protein, 9 aa, Homo Sapiens
GAGQTLAAV

SEQ ID NO: 655817 - protein, 9 aa, Homo Sapiens
VQMMNKVFG

SEQ ID NO: 655818 - protein, 9 aa, Homo Sapiens
DPFQQIYEK

SEQ ID NO: 655819 - protein, 9 aa, Homo Sapiens
IPKKLEYFI

SEQ ID NO: 655820 - protein, 9 aa, Homo Sapiens
EHVMLGSLT

SEQ ID NO: 655821 - protein, 9 aa, Homo Sapiens
AQSLGASLL

SEQ ID NO: 655822 - protein, 9 aa, Homo Sapiens
HQEEQSVCI

SEQ ID NO: 655823 - protein, 9 aa, Homo Sapiens
MQDLFQKVI

SEQ ID NO: 655824 - protein, 9 aa, Homo Sapiens
GFQLQYQII

SEQ ID NO: 655825 - protein, 9 aa, Homo Sapiens
EDDHGAAEI

SEQ ID NO: 655826 - protein, 9 aa, Homo Sapiens
VEFVCKSAY

SEQ ID NO: 655827 - protein, 9 aa, Homo Sapiens
LIHAVMPDV

SEQ ID NO: 655828 - protein, 9 aa, Homo Sapiens
INSSNLKDD

SEQ ID NO: 655829 - protein, 9 aa, Homo Sapiens
LPNTLTFID

SEQ ID NO: 655830 - protein, 9 aa, Homo Sapiens
PKYKNSSRE

SEQ ID NO: 655831 - protein, 9 aa, Homo Sapiens
YDFHPRKWY

SEQ ID NO: 655832 - protein, 9 aa, Homo Sapiens
GKNHMDVMN

SEQ ID NO: 655833 - protein, 9 aa, Homo Sapiens
RDATSSPPT

SEQ ID NO: 655834 - protein, 9 aa, Homo Sapiens
VLFQFLFTS

SEQ ID NO: 655835 - protein, 9 aa, Homo Sapiens
FWYRQFLKQ

SEQ ID NO: 655836 - protein, 9 aa, Homo Sapiens
DRCPRRTQR

SEQ ID NO: 655837 - protein, 9 aa, Homo Sapiens
TMFWYRQFL

SEQ ID NO: 655838 - protein, 9 aa, Homo Sapiens
LHSKARDSD

SEQ ID NO: 655839 - protein, 9 aa, Homo Sapiens
GICKENVFP

SEQ ID NO: 655840 - protein, 9 aa, Homo Sapiens
GERFFPGRS

SEQ ID NO: 655841 - protein, 9 aa, Homo Sapiens
DMPVENGLL

SEQ ID NO: 655842 - protein, 9 aa, Homo Sapiens
KQGFASLGG

SEQ ID NO: 655843 - protein, 9 aa, Homo Sapiens
VGVVVKANS

SEQ ID NO: 655844 - protein, 9 aa, Homo Sapiens
QMIQIVSAA

SEQ ID NO: 655845 - protein, 9 aa, Homo Sapiens
PPPLVPVVQ

SEQ ID NO: 655846 - protein, 9 aa, Homo Sapiens
KPMYFFLGN

SEQ ID NO: 655847 - protein, 9 aa, Homo Sapiens
IIFSQRCGA

SEQ ID NO: 655848 - protein, 9 aa, Homo Sapiens
FPNKELAYE

SEQ ID NO: 655849 - protein, 9 aa, Homo Sapiens
YYDGEWCAE

SEQ ID NO: 655850 - protein, 9 aa, Homo Sapiens
FFPSANGVI

SEQ ID NO: 655851 - protein, 9 aa, Homo Sapiens
STQKKNKDL

SEQ ID NO: 655852 - protein, 9 aa, Homo Sapiens
ARRGLPHLA

SEQ ID NO: 655853 - protein, 9 aa, Homo Sapiens
IGALCLELL

SEQ ID NO: 655854 - protein, 9 aa, Homo Sapiens
RFGKHVSHV

SEQ ID NO: 655855 - protein, 9 aa, Homo Sapiens
RARLTLVSR

SEQ ID NO: 655856 - protein, 9 aa, Homo Sapiens
NFYEFVAGV

SEQ ID NO: 655857 - protein, 9 aa, Homo Sapiens
RELQAFQNI

SEQ ID NO: 655858 - protein, 9 aa, Homo Sapiens
VAQIKEGGK

SEQ ID NO: 655859 - protein, 9 aa, Homo Sapiens
SVDLLDEAG

SEQ ID NO: 655860 - protein, 9 aa, Homo Sapiens
YHISWEVYG

SEQ ID NO: 655861 - protein, 9 aa, Homo Sapiens
LHKNKPDLK

SEQ ID NO: 655862 - protein, 9 aa, Homo Sapiens
FIVPYMKQY

SEQ ID NO: 655863 - protein, 9 aa, Homo Sapiens
GISFTVTSA

SEQ ID NO: 655864 - protein, 9 aa, Homo Sapiens
QLLLQHLQR

SEQ ID NO: 655865 - protein, 9 aa, Homo Sapiens
RYLNEMAIT

SEQ ID NO: 655866 - protein, 9 aa, Homo Sapiens
GGNPFWKTA

SEQ ID NO: 655867 - protein, 9 aa, Homo Sapiens
EEGEGNSDQ

SEQ ID NO: 655868 - protein, 9 aa, Homo Sapiens
KSNFLQLIC

SEQ ID NO: 655869 - protein, 9 aa, Homo Sapiens
MFGHCPLYG

SEQ ID NO: 655870 - protein, 9 aa, Homo Sapiens
GGLSARCSV

SEQ ID NO: 655871 - protein, 9 aa, Homo Sapiens
QNMLRNSIP

SEQ ID NO: 655872 - protein, 9 aa, Homo Sapiens
VFIHKGYTH

SEQ ID NO: 655873 - protein, 9 aa, Homo Sapiens
VIKLIGQTP

SEQ ID NO: 655874 - protein, 9 aa, Homo Sapiens
ETSATAVDS

SEQ ID NO: 655875 - protein, 9 aa, Homo Sapiens
NAMKIESGD

SEQ ID NO: 655876 - protein, 9 aa, Homo Sapiens
YGAEVRVIK

SEQ ID NO: 655877 - protein, 9 aa, Homo Sapiens
DTSSLGAAG

SEQ ID NO: 655878 - protein, 9 aa, Homo Sapiens
QDAAFFNAW

SEQ ID NO: 655879 - protein, 9 aa, Homo Sapiens
KIQSEDYHH

SEQ ID NO: 655880 - protein, 9 aa, Homo Sapiens
YNYVIWAKV

SEQ ID NO: 655881 - protein, 9 aa, Homo Sapiens
MQTFVLSPE

SEQ ID NO: 655882 - protein, 9 aa, Homo Sapiens
TSSSYQQDC

SEQ ID NO: 655883 - protein, 9 aa, Homo Sapiens
VEAIQEALV

SEQ ID NO: 655884 - protein, 9 aa, Homo Sapiens
AKIQDKKGI

SEQ ID NO: 655885 - protein, 9 aa, Homo Sapiens
QLPFPPCTS

SEQ ID NO: 655886 - protein, 9 aa, Homo Sapiens
VILVFNVPG

SEQ ID NO: 655887 - protein, 9 aa, Homo Sapiens
MGWGEEFSL

SEQ ID NO: 655888 - protein, 9 aa, Homo Sapiens
YRIFELNKL

SEQ ID NO: 655889 - protein, 9 aa, Homo Sapiens
KGSVNNEFG

SEQ ID NO: 655890 - protein, 9 aa, Homo Sapiens
GSIRTNSSP

SEQ ID NO: 655891 - protein, 9 aa, Homo Sapiens
TPVQLPFPP

SEQ ID NO: 655892 - protein, 9 aa, Homo Sapiens
LSNVFNPQT

SEQ ID NO: 655893 - protein, 9 aa, Homo Sapiens
PLGTHGDLC

SEQ ID NO: 655894 - protein, 9 aa, Homo Sapiens
FERIIQSFG

SEQ ID NO: 655895 - protein, 9 aa, Homo Sapiens
PRLNKPMYF

SEQ ID NO: 655896 - protein, 9 aa, Homo Sapiens
VIKVESMQF

SEQ ID NO: 655897 - protein, 9 aa, Homo Sapiens
ISELLVKTL

SEQ ID NO: 655898 - protein, 9 aa, Homo Sapiens
TLVLCNLFG

SEQ ID NO: 655899 - protein, 9 aa, Homo Sapiens
ACATKKFSY

SEQ ID NO: 655900 - protein, 9 aa, Homo Sapiens
DNGEKFEFL

SEQ ID NO: 655901 - protein, 9 aa, Homo Sapiens
PGHGTPDNS

SEQ ID NO: 655902 - protein, 9 aa, Homo Sapiens
YPVVMSRKI

SEQ ID NO: 655903 - protein, 9 aa, Homo Sapiens
LAANRESQG

SEQ ID NO: 655904 - protein, 9 aa, Homo Sapiens
STVFKSPLY

SEQ ID NO: 655905 - protein, 9 aa, Homo Sapiens
QKVKPPEDI

SEQ ID NO: 655906 - protein, 9 aa, Homo Sapiens
NHQVRARIY

SEQ ID NO: 655907 - protein, 9 aa, Homo Sapiens
LGATAIEYR

SEQ ID NO: 655908 - protein, 9 aa, Homo Sapiens
DICHSSFTV

SEQ ID NO: 655909 - protein, 9 aa, Homo Sapiens
GFSKFEKNT

SEQ ID NO: 655910 - protein, 9 aa, Homo Sapiens
PLAANRESQ

SEQ ID NO: 655911 - protein, 9 aa, Homo Sapiens
TACVEPISC

SEQ ID NO: 655912 - protein, 9 aa, Homo Sapiens
KDKLLASFC

SEQ ID NO: 655913 - protein, 9 aa, Homo Sapiens
AVKIVTCFI

SEQ ID NO: 655914 - protein, 9 aa, Homo Sapiens
TIRDPSVIV

SEQ ID NO: 655915 - protein, 9 aa, Homo Sapiens
DLVASIHLS

SEQ ID NO: 655916 - protein, 9 aa, Homo Sapiens
PRYKQDLVQ

SEQ ID NO: 655917 - protein, 9 aa, Homo Sapiens
QFADDIQEF

SEQ ID NO: 655918 - protein, 9 aa, Homo Sapiens
PRSDCKILH

SEQ ID NO: 655919 - protein, 9 aa, Homo Sapiens
PKQGFASLG

SEQ ID NO: 655920 - protein, 9 aa, Homo Sapiens
SWPGTWNKS

SEQ ID NO: 655921 - protein, 9 aa, Homo Sapiens
DLLAGRVAA

SEQ ID NO: 655922 - protein, 9 aa, Homo Sapiens
SGFELFTDL

SEQ ID NO: 655923 - protein, 9 aa, Homo Sapiens
GPWNSGGAL

SEQ ID NO: 655924 - protein, 9 aa, Homo Sapiens
ETLICQNCQ

SEQ ID NO: 655925 - protein, 9 aa, Homo Sapiens
LDPNTSIEI

SEQ ID NO: 655926 - protein, 9 aa, Homo Sapiens
LESRCCLDP

SEQ ID NO: 655927 - protein, 9 aa, Homo Sapiens
YECQAEQTI

SEQ ID NO: 655928 - protein, 9 aa, Homo Sapiens
ISTYLNEKS

SEQ ID NO: 655929 - protein, 9 aa, Homo Sapiens
MRLLPTRKS

SEQ ID NO: 655930 - protein, 9 aa, Homo Sapiens
GANIRDQLY

SEQ ID NO: 655931 - protein, 9 aa, Homo Sapiens
VSARLLKIW

SEQ ID NO: 655932 - protein, 9 aa, Homo Sapiens
EGDLEEDIP

SEQ ID NO: 655933 - protein, 9 aa, Homo Sapiens
RSDCKILHR

SEQ ID NO: 655934 - protein, 9 aa, Homo Sapiens
HLNTSHHAL

SEQ ID NO: 655935 - protein, 9 aa, Homo Sapiens
IRDAAAAAA

SEQ ID NO: 655936 - protein, 9 aa, Homo Sapiens
HALSPGLSW

SEQ ID NO: 655937 - protein, 9 aa, Homo Sapiens
ILFFGAGTN

SEQ ID NO: 655938 - protein, 9 aa, Homo Sapiens
INALRAKTN

SEQ ID NO: 655939 - protein, 9 aa, Homo Sapiens
VDKHGRPLQ

SEQ ID NO: 655940 - protein, 9 aa, Homo Sapiens
SRNHIDRAL

SEQ ID NO: 655941 - protein, 9 aa, Homo Sapiens
TLKLCRELS

SEQ ID NO: 655942 - protein, 9 aa, Homo Sapiens
VAHIMELHV

SEQ ID NO: 655943 - protein, 9 aa, Homo Sapiens
VHSKCENIS

SEQ ID NO: 655944 - protein, 9 aa, Homo Sapiens
GSKDVPRNR

SEQ ID NO: 655945 - protein, 9 aa, Homo Sapiens
LGQGLIESA

SEQ ID NO: 655946 - protein, 9 aa, Homo Sapiens
PVENGLLAP

SEQ ID NO: 655947 - protein, 9 aa, Homo Sapiens
THTGKNHMD

SEQ ID NO: 655948 - protein, 9 aa, Homo Sapiens
VGAGVQGPI

SEQ ID NO: 655949 - protein, 9 aa, Homo Sapiens
ASMRRVSYI

SEQ ID NO: 655950 - protein, 9 aa, Homo Sapiens
ESRKALRAR

SEQ ID NO: 655951 - protein, 9 aa, Homo Sapiens
LCSRGLRNG

SEQ ID NO: 655952 - protein, 9 aa, Homo Sapiens
YGNNFGYVV

SEQ ID NO: 655953 - protein, 9 aa, Homo Sapiens
QKQFNNFQI

SEQ ID NO: 655954 - protein, 9 aa, Homo Sapiens
AALEGQDPL

SEQ ID NO: 655955 - protein, 9 aa, Homo Sapiens
YSPPESFAV

SEQ ID NO: 655956 - protein, 9 aa, Homo Sapiens
AEVRVIKLI

SEQ ID NO: 655957 - protein, 9 aa, Homo Sapiens
RASFCPRLA

SEQ ID NO: 655958 - protein, 9 aa, Homo Sapiens
RKEPEQLRK

SEQ ID NO: 655959 - protein, 9 aa, Homo Sapiens
SSPPPLERR

SEQ ID NO: 655960 - protein, 9 aa, Homo Sapiens
MSKSESRKE

SEQ ID NO: 655961 - protein, 9 aa, Homo Sapiens
QLEFCHSNA

SEQ ID NO: 655962 - protein, 9 aa, Homo Sapiens
GMEKPLPLL

SEQ ID NO: 655963 - protein, 9 aa, Homo Sapiens
RRRKTLKLC

SEQ ID NO: 655964 - protein, 9 aa, Homo Sapiens
TSWQTSYVE

SEQ ID NO: 655965 - protein, 9 aa, Homo Sapiens
RVTKEVHAT

SEQ ID NO: 655966 - protein, 9 aa, Homo Sapiens
AGRVAAAVS

SEQ ID NO: 655967 - protein, 9 aa, Homo Sapiens
DSPHTVSSP

SEQ ID NO: 655968 - protein, 9 aa, Homo Sapiens
ATSMESLSP

SEQ ID NO: 655969 - protein, 9 aa, Homo Sapiens
VSAFAAFSL

SEQ ID NO: 655970 - protein, 9 aa, Homo Sapiens
SSVSTESQS

SEQ ID NO: 655971 - protein, 9 aa, Homo Sapiens
MASTVEEGD

SEQ ID NO: 655972 - protein, 9 aa, Homo Sapiens
QELAGETRP

SEQ ID NO: 655973 - protein, 9 aa, Homo Sapiens
SILNLCDIS

SEQ ID NO: 655974 - protein, 9 aa, Homo Sapiens
LQNNTSQER

SEQ ID NO: 655975 - protein, 9 aa, Homo Sapiens
LDRVYGIKY

SEQ ID NO: 655976 - protein, 9 aa, Homo Sapiens
LVEGESYSM

SEQ ID NO: 655977 - protein, 9 aa, Homo Sapiens
QGAQKQFNN

SEQ ID NO: 655978 - protein, 9 aa, Homo Sapiens
ETKTFGGVG

SEQ ID NO: 655979 - protein, 9 aa, Homo Sapiens
GLVHYFVAE

SEQ ID NO: 655980 - protein, 9 aa, Homo Sapiens
RFAGTHAES

SEQ ID NO: 655981 - protein, 9 aa, Homo Sapiens
VEVFITETA

SEQ ID NO: 655982 - protein, 9 aa, Homo Sapiens
KQFNNFQIE

SEQ ID NO: 655983 - protein, 9 aa, Homo Sapiens
IIYELATNP

SEQ ID NO: 655984 - protein, 9 aa, Homo Sapiens
KPPEDIQDL

SEQ ID NO: 655985 - protein, 9 aa, Homo Sapiens
TEAWMQANY

SEQ ID NO: 655986 - protein, 9 aa, Homo Sapiens
EAIQEALVD

SEQ ID NO: 655987 - protein, 9 aa, Homo Sapiens
ASDLMSLLF

SEQ ID NO: 655988 - protein, 9 aa, Homo Sapiens
DITSIICMD

SEQ ID NO: 655989 - protein, 9 aa, Homo Sapiens
VAVMSCSGY

SEQ ID NO: 655990 - protein, 9 aa, Homo Sapiens
PTEANWGHR

SEQ ID NO: 655991 - protein, 9 aa, Homo Sapiens
RGFIRLEGI

SEQ ID NO: 655992 - protein, 9 aa, Homo Sapiens
LANRHNHGD

SEQ ID NO: 655993 - protein, 9 aa, Homo Sapiens
LSPTVSFNL

SEQ ID NO: 655994 - protein, 9 aa, Homo Sapiens
TQAKPSAAR

SEQ ID NO: 655995 - protein, 9 aa, Homo Sapiens
IDICHSSFT

SEQ ID NO: 655996 - protein, 9 aa, Homo Sapiens
QQLQTGSCC

SEQ ID NO: 655997 - protein, 9 aa, Homo Sapiens
AASQDMQQG

SEQ ID NO: 655998 - protein, 9 aa, Homo Sapiens
FLLPTPCKK

SEQ ID NO: 655999 - protein, 9 aa, Homo Sapiens
GEWCAEDDA

SEQ ID NO: 656000 - protein, 9 aa, Homo Sapiens
IEETCQLLK

SEQ ID NO: 656001 - protein, 9 aa, Homo Sapiens
HLAKHLGLG

SEQ ID NO: 656002 - protein, 9 aa, Homo Sapiens
LSTIRDPSV

SEQ ID NO: 656003 - protein, 9 aa, Homo Sapiens
SDLMSLLFL

SEQ ID NO: 656004 - protein, 9 aa, Homo Sapiens
IRDQLYDGA

SEQ ID NO: 656005 - protein, 9 aa, Homo Sapiens
SEDINATRS

SEQ ID NO: 656006 - protein, 9 aa, Homo Sapiens
ELNKLLQNW

SEQ ID NO: 656007 - protein, 9 aa, Homo Sapiens
QEKNAELQI

SEQ ID NO: 656008 - protein, 9 aa, Homo Sapiens
ILAHTGKEF

SEQ ID NO: 656009 - protein, 9 aa, Homo Sapiens
NGGYICYPR

SEQ ID NO: 656010 - protein, 9 aa, Homo Sapiens
QDSLDVCYS

SEQ ID NO: 656011 - protein, 9 aa, Homo Sapiens
SSRCEWEDG

SEQ ID NO: 656012 - protein, 9 aa, Homo Sapiens
AGPGLPWGA

SEQ ID NO: 656013 - protein, 9 aa, Homo Sapiens
HRPSHGDKT

SEQ ID NO: 656014 - protein, 9 aa, Homo Sapiens
QWVHHTAGQ

SEQ ID NO: 656015 - protein, 9 aa, Homo Sapiens
GLPHLAVSD

SEQ ID NO: 656016 - protein, 9 aa, Homo Sapiens
GNVLLIFFI

SEQ ID NO: 656017 - protein, 9 aa, Homo Sapiens
ATGEIEVQP

SEQ ID NO: 656018 - protein, 9 aa, Homo Sapiens
MMDRRYRTR

SEQ ID NO: 656019 - protein, 9 aa, Homo Sapiens
LMPDLHTKE

SEQ ID NO: 656020 - protein, 9 aa, Homo Sapiens
PTEDSANEE

SEQ ID NO: 656021 - protein, 9 aa, Homo Sapiens
IESLSLIHA

SEQ ID NO: 656022 - protein, 9 aa, Homo Sapiens
EQPNVACAT

SEQ ID NO: 656023 - protein, 9 aa, Homo Sapiens
YELKITFVI

SEQ ID NO: 656024 - protein, 9 aa, Homo Sapiens
KSESRKEPE

SEQ ID NO: 656025 - protein, 9 aa, Homo Sapiens
YVHFPSRAI

SEQ ID NO: 656026 - protein, 9 aa, Homo Sapiens
WNKSCRSPR

SEQ ID NO: 656027 - protein, 9 aa, Homo Sapiens
VNAIIIVVM

SEQ ID NO: 656028 - protein, 9 aa, Homo Sapiens
EDLAEETPG

SEQ ID NO: 656029 - protein, 9 aa, Homo Sapiens
VVWIACANT

SEQ ID NO: 656030 - protein, 9 aa, Homo Sapiens
DAKLSNMFL

SEQ ID NO: 656031 - protein, 9 aa, Homo Sapiens
LMSASGVFQ

SEQ ID NO: 656032 - protein, 9 aa, Homo Sapiens
WVFMLHKKT

SEQ ID NO: 656033 - protein, 9 aa, Homo Sapiens
DPVNGWMYC

SEQ ID NO: 656034 - protein, 9 aa, Homo Sapiens
FMIEKLPKA

SEQ ID NO: 656035 - protein, 9 aa, Homo Sapiens
CCYSGWYCY

SEQ ID NO: 656036 - protein, 9 aa, Homo Sapiens
SFRGFIRLE

SEQ ID NO: 656037 - protein, 9 aa, Homo Sapiens
EAVGVSNPQ

SEQ ID NO: 656038 - protein, 9 aa, Homo Sapiens
SYIFQPAKN

SEQ ID NO: 656039 - protein, 9 aa, Homo Sapiens
TPDNSKSMK

SEQ ID NO: 656040 - protein, 9 aa, Homo Sapiens
LYMPKWLYF

SEQ ID NO: 656041 - protein, 9 aa, Homo Sapiens
LMSLLFLPA

SEQ ID NO: 656042 - protein, 9 aa, Homo Sapiens
YSAWYTATA

SEQ ID NO: 656043 - protein, 9 aa, Homo Sapiens
CYYWEKCSA

SEQ ID NO: 656044 - protein, 9 aa, Homo Sapiens
LLVELTRKL

SEQ ID NO: 656045 - protein, 9 aa, Homo Sapiens
IWIIFLLPT

SEQ ID NO: 656046 - protein, 9 aa, Homo Sapiens
RMTFRERTV

SEQ ID NO: 656047 - protein, 9 aa, Homo Sapiens
NHVTLDRGC

SEQ ID NO: 656048 - protein, 9 aa, Homo Sapiens
LDNSGFELF

SEQ ID NO: 656049 - protein, 9 aa, Homo Sapiens
LTLKSDTNW

SEQ ID NO: 656050 - protein, 9 aa, Homo Sapiens
APIVSRMLL

SEQ ID NO: 656051 - protein, 9 aa, Homo Sapiens
FKNLKKLQV

SEQ ID NO: 656052 - protein, 9 aa, Homo Sapiens
HIHDVLVSG

SEQ ID NO: 656053 - protein, 9 aa, Homo Sapiens
NDSLTLFQS

SEQ ID NO: 656054 - protein, 9 aa, Homo Sapiens
LLGIMAFDR

SEQ ID NO: 656055 - protein, 9 aa, Homo Sapiens
KDLTEEDAG

SEQ ID NO: 656056 - protein, 9 aa, Homo Sapiens
CSVLIKVLD

SEQ ID NO: 656057 - protein, 9 aa, Homo Sapiens
EDALHSFFQ

SEQ ID NO: 656058 - protein, 9 aa, Homo Sapiens
MFLQASSPT

SEQ ID NO: 656059 - protein, 9 aa, Homo Sapiens
KACKKLAYG

SEQ ID NO: 656060 - protein, 9 aa, Homo Sapiens
QIQFADDIQ

SEQ ID NO: 656061 - protein, 9 aa, Homo Sapiens
ICQRKSATA

SEQ ID NO: 656062 - protein, 9 aa, Homo Sapiens
HNFGMNHVT

SEQ ID NO: 656063 - protein, 9 aa, Homo Sapiens
TMYWVIVRS

SEQ ID NO: 656064 - protein, 9 aa, Homo Sapiens
KTNASLCDP

SEQ ID NO: 656065 - protein, 9 aa, Homo Sapiens
GEGNSDQLM

SEQ ID NO: 656066 - protein, 9 aa, Homo Sapiens
HVTSLSSAS

SEQ ID NO: 656067 - protein, 9 aa, Homo Sapiens
EPCRETWRC

SEQ ID NO: 656068 - protein, 9 aa, Homo Sapiens
FAPQTGSRP

SEQ ID NO: 656069 - protein, 9 aa, Homo Sapiens
RYKQDLVQK

SEQ ID NO: 656070 - protein, 9 aa, Homo Sapiens
AIKITVNGP

SEQ ID NO: 656071 - protein, 9 aa, Homo Sapiens
SMRRVSYIK

SEQ ID NO: 656072 - protein, 9 aa, Homo Sapiens
ATRLPQGAP

SEQ ID NO: 656073 - protein, 9 aa, Homo Sapiens
VKKERIKCS

SEQ ID NO: 656074 - protein, 9 aa, Homo Sapiens
DTSKKIAHA

SEQ ID NO: 656075 - protein, 9 aa, Homo Sapiens
TSAYRLTIR

SEQ ID NO: 656076 - protein, 9 aa, Homo Sapiens
ILSSPNFTL

SEQ ID NO: 656077 - protein, 9 aa, Homo Sapiens
GGTLVGDIL

SEQ ID NO: 656078 - protein, 9 aa, Homo Sapiens
SIRTNSSPL

SEQ ID NO: 656079 - protein, 9 aa, Homo Sapiens
IEHFQPNDD

SEQ ID NO: 656080 - protein, 9 aa, Homo Sapiens
SEDYHHELS

SEQ ID NO: 656081 - protein, 9 aa, Homo Sapiens
RLTIRASDA

SEQ ID NO: 656082 - protein, 9 aa, Homo Sapiens
FLKQSLMLM

SEQ ID NO: 656083 - protein, 9 aa, Homo Sapiens
REWERLKRR

SEQ ID NO: 656084 - protein, 9 aa, Homo Sapiens
LPPQSRNVE

SEQ ID NO: 656085 - protein, 9 aa, Homo Sapiens
WEKGSVNNE

SEQ ID NO: 656086 - protein, 9 aa, Homo Sapiens
NGHVGLQEK

SEQ ID NO: 656087 - protein, 9 aa, Homo Sapiens
RHEGVKDCD

SEQ ID NO: 656088 - protein, 9 aa, Homo Sapiens
CRETWRCPS

SEQ ID NO: 656089 - protein, 9 aa, Homo Sapiens
FFIYLDAGL

SEQ ID NO: 656090 - protein, 9 aa, Homo Sapiens
PKILWEDLH

SEQ ID NO: 656091 - protein, 9 aa, Homo Sapiens
GGHDCSGSC

SEQ ID NO: 656092 - protein, 9 aa, Homo Sapiens
NSNLEKIYN

SEQ ID NO: 656093 - protein, 9 aa, Homo Sapiens
GFVFVSFER

SEQ ID NO: 656094 - protein, 9 aa, Homo Sapiens
GHFPGAIFQ

SEQ ID NO: 656095 - protein, 9 aa, Homo Sapiens
NLAVTYFFH

SEQ ID NO: 656096 - protein, 9 aa, Homo Sapiens
LSKKILLKI

SEQ ID NO: 656097 - protein, 9 aa, Homo Sapiens
PKEVVKCPG

SEQ ID NO: 656098 - protein, 9 aa, Homo Sapiens
GNGLECFQK

SEQ ID NO: 656099 - protein, 9 aa, Homo Sapiens
KGQDEGVWK

SEQ ID NO: 656100 - protein, 9 aa, Homo Sapiens
EKLPKACSI

SEQ ID NO: 656101 - protein, 9 aa, Homo Sapiens
GLLSGSIRT

SEQ ID NO: 656102 - protein, 9 aa, Homo Sapiens
ISAPGAPRD

SEQ ID NO: 656103 - protein, 9 aa, Homo Sapiens
CGKAFNQSC

SEQ ID NO: 656104 - protein, 9 aa, Homo Sapiens
FWSDISELL

SEQ ID NO: 656105 - protein, 9 aa, Homo Sapiens
AKLSNMFLQ

SEQ ID NO: 656106 - protein, 9 aa, Homo Sapiens
LLSTIRDPS

SEQ ID NO: 656107 - protein, 9 aa, Homo Sapiens
AILDSQLSL

SEQ ID NO: 656108 - protein, 9 aa, Homo Sapiens
SIREDTLAD

SEQ ID NO: 656109 - protein, 9 aa, Homo Sapiens
EGFSKFEKN

SEQ ID NO: 656110 - protein, 9 aa, Homo Sapiens
CPGAPAASS

SEQ ID NO: 656111 - protein, 9 aa, Homo Sapiens
MYCTDWEED

SEQ ID NO: 656112 - protein, 9 aa, Homo Sapiens
GTMYWVIVR

SEQ ID NO: 656113 - protein, 9 aa, Homo Sapiens
TAEGGAPKA

SEQ ID NO: 656114 - protein, 9 aa, Homo Sapiens
ESTLQMVWI

SEQ ID NO: 656115 - protein, 9 aa, Homo Sapiens
ANTHVLQVS

SEQ ID NO: 656116 - protein, 9 aa, Homo Sapiens
YEVTSAYRL

SEQ ID NO: 656117 - protein, 9 aa, Homo Sapiens
ITHAYNQPE

SEQ ID NO: 656118 - protein, 9 aa, Homo Sapiens
RGLPHLAVS

SEQ ID NO: 656119 - protein, 9 aa, Homo Sapiens
GALLKVLWR

SEQ ID NO: 656120 - protein, 9 aa, Homo Sapiens
HRSKNLKVG

SEQ ID NO: 656121 - protein, 9 aa, Homo Sapiens
RNSIPTPIV

SEQ ID NO: 656122 - protein, 9 aa, Homo Sapiens
EKPSLFNGL

SEQ ID NO: 656123 - protein, 9 aa, Homo Sapiens
FELFEISKK

SEQ ID NO: 656124 - protein, 9 aa, Homo Sapiens
SEGEGQGPL

SEQ ID NO: 656125 - protein, 9 aa, Homo Sapiens
LPPPRPRRP

SEQ ID NO: 656126 - protein, 9 aa, Homo Sapiens
GGILYEFAA

SEQ ID NO: 656127 - protein, 9 aa, Homo Sapiens
LADFSALEA

SEQ ID NO: 656128 - protein, 9 aa, Homo Sapiens
TQERRHRLR

SEQ ID NO: 656129 - protein, 9 aa, Homo Sapiens
KWQWQLESK

SEQ ID NO: 656130 - protein, 9 aa, Homo Sapiens
RYHVTECTG

SEQ ID NO: 656131 - protein, 9 aa, Homo Sapiens
PNCKVVGVD

SEQ ID NO: 656132 - protein, 9 aa, Homo Sapiens
QVLVRALRD

SEQ ID NO: 656133 - protein, 9 aa, Homo Sapiens
EDLPMVAPW

SEQ ID NO: 656134 - protein, 9 aa, Homo Sapiens
PGDCGPPAL

SEQ ID NO: 656135 - protein, 9 aa, Homo Sapiens
KGIGRGMVQ

SEQ ID NO: 656136 - protein, 9 aa, Homo Sapiens
DLLMDFLKE

SEQ ID NO: 656137 - protein, 9 aa, Homo Sapiens
ILGVGRNPA

SEQ ID NO: 656138 - protein, 9 aa, Homo Sapiens
ELVEEKNIL

SEQ ID NO: 656139 - protein, 9 aa, Homo Sapiens
NRSQASLQG

SEQ ID NO: 656140 - protein, 9 aa, Homo Sapiens
RSARDLVLY

SEQ ID NO: 656141 - protein, 9 aa, Homo Sapiens
LLQVHENNI

SEQ ID NO: 656142 - protein, 9 aa, Homo Sapiens
VASWSGFIV

SEQ ID NO: 656143 - protein, 9 aa, Homo Sapiens
QESSNISTE

SEQ ID NO: 656144 - protein, 9 aa, Homo Sapiens
LNIATHVLS

SEQ ID NO: 656145 - protein, 9 aa, Homo Sapiens
IGRGMVQAL

SEQ ID NO: 656146 - protein, 9 aa, Homo Sapiens
ISTNAEFMD

SEQ ID NO: 656147 - protein, 9 aa, Homo Sapiens
ENFPDLNSV

SEQ ID NO: 656148 - protein, 9 aa, Homo Sapiens
KMPKFSMSG

SEQ ID NO: 656149 - protein, 9 aa, Homo Sapiens
VRREACIIN

SEQ ID NO: 656150 - protein, 9 aa, Homo Sapiens
CFGTFNGQK

SEQ ID NO: 656151 - protein, 9 aa, Homo Sapiens
RGRGRGCGR

SEQ ID NO: 656152 - protein, 9 aa, Homo Sapiens
RVKNLMKMM

SEQ ID NO: 656153 - protein, 9 aa, Homo Sapiens
TNPKVSSSS

SEQ ID NO: 656154 - protein, 9 aa, Homo Sapiens
LSQPNGFKT

SEQ ID NO: 656155 - protein, 9 aa, Homo Sapiens
PDSVHVSQE

SEQ ID NO: 656156 - protein, 9 aa, Homo Sapiens
VRTQHLQDL

SEQ ID NO: 656157 - protein, 9 aa, Homo Sapiens
AQVAILPVS

SEQ ID NO: 656158 - protein, 9 aa, Homo Sapiens
PPAAGPGDT

SEQ ID NO: 656159 - protein, 9 aa, Homo Sapiens
GRSQSKGRL

SEQ ID NO: 656160 - protein, 9 aa, Homo Sapiens
HRFGGREPP

SEQ ID NO: 656161 - protein, 9 aa, Homo Sapiens
LQDQKAEFQ

SEQ ID NO: 656162 - protein, 9 aa, Homo Sapiens
IFTDRREDI

SEQ ID NO: 656163 - protein, 9 aa, Homo Sapiens
VHGSRYGHD

SEQ ID NO: 656164 - protein, 9 aa, Homo Sapiens
PLDRCYSTP

SEQ ID NO: 656165 - protein, 9 aa, Homo Sapiens
QMQCCQTLV

SEQ ID NO: 656166 - protein, 9 aa, Homo Sapiens
PAYKDPIGP

SEQ ID NO: 656167 - protein, 9 aa, Homo Sapiens
AALWPRYSE

SEQ ID NO: 656168 - protein, 9 aa, Homo Sapiens
SQASEANFF

SEQ ID NO: 656169 - protein, 9 aa, Homo Sapiens
KMMHIRYCQ

SEQ ID NO: 656170 - protein, 9 aa, Homo Sapiens
PPPDPIPPR

SEQ ID NO: 656171 - protein, 9 aa, Homo Sapiens
VLVRALRDF

SEQ ID NO: 656172 - protein, 9 aa, Homo Sapiens
LMEGCQVPG

SEQ ID NO: 656173 - protein, 9 aa, Homo Sapiens
VISGSGEKR

SEQ ID NO: 656174 - protein, 9 aa, Homo Sapiens
GVQLRNLGA

SEQ ID NO: 656175 - protein, 9 aa, Homo Sapiens
GEQWLQVDL

SEQ ID NO: 656176 - protein, 9 aa, Homo Sapiens
LAVCFTPGE

SEQ ID NO: 656177 - protein, 9 aa, Homo Sapiens
PKTKDQRPQ

SEQ ID NO: 656178 - protein, 9 aa, Homo Sapiens
IKPKADPTS

SEQ ID NO: 656179 - protein, 9 aa, Homo Sapiens
WVVWNSSTV

SEQ ID NO: 656180 - protein, 9 aa, Homo Sapiens
LGDCFMLLS

SEQ ID NO: 656181 - protein, 9 aa, Homo Sapiens
FLKIFCKRV

SEQ ID NO: 656182 - protein, 9 aa, Homo Sapiens
KFHKYILQL

SEQ ID NO: 656183 - protein, 9 aa, Homo Sapiens
VLAEDGSRL

SEQ ID NO: 656184 - protein, 9 aa, Homo Sapiens
PLFRQESSN

SEQ ID NO: 656185 - protein, 9 aa, Homo Sapiens
HLAESVDVL

SEQ ID NO: 656186 - protein, 9 aa, Homo Sapiens
EHTAHIHTT

SEQ ID NO: 656187 - protein, 9 aa, Homo Sapiens
SLPSAPAYK

SEQ ID NO: 656188 - protein, 9 aa, Homo Sapiens
PILPSFSWG

SEQ ID NO: 656189 - protein, 9 aa, Homo Sapiens
QQPRQSVAY

SEQ ID NO: 656190 - protein, 9 aa, Homo Sapiens
GIPVHGSRY

SEQ ID NO: 656191 - protein, 9 aa, Homo Sapiens
MHRNAFSIY

SEQ ID NO: 656192 - protein, 9 aa, Homo Sapiens
WGFHDRNLV

SEQ ID NO: 656193 - protein, 9 aa, Homo Sapiens
GFWGIHSTP

SEQ ID NO: 656194 - protein, 9 aa, Homo Sapiens
AAFSVKKPF

SEQ ID NO: 656195 - protein, 9 aa, Homo Sapiens
EEGFDIFEN

SEQ ID NO: 656196 - protein, 9 aa, Homo Sapiens
INTCGGISF

SEQ ID NO: 656197 - protein, 9 aa, Homo Sapiens
KRKEKRKNK

SEQ ID NO: 656198 - protein, 9 aa, Homo Sapiens
IYNQRRYIR

SEQ ID NO: 656199 - protein, 9 aa, Homo Sapiens
HRNAFSIYI

SEQ ID NO: 656200 - protein, 9 aa, Homo Sapiens
CCTPTVAEV

SEQ ID NO: 656201 - protein, 9 aa, Homo Sapiens
VNRSQASLQ

SEQ ID NO: 656202 - protein, 9 aa, Homo Sapiens
CKAATNSYS

SEQ ID NO: 656203 - protein, 9 aa, Homo Sapiens
VVLADFSAL

SEQ ID NO: 656204 - protein, 9 aa, Homo Sapiens
RLDYFICEV

SEQ ID NO: 656205 - protein, 9 aa, Homo Sapiens
QRRYIRSEL

SEQ ID NO: 656206 - protein, 9 aa, Homo Sapiens
SLHLVFQIG

SEQ ID NO: 656207 - protein, 9 aa, Homo Sapiens
EACIINLES

SEQ ID NO: 656208 - protein, 9 aa, Homo Sapiens
WSGFIVSED

SEQ ID NO: 656209 - protein, 9 aa, Homo Sapiens
SCTGSHVRS

SEQ ID NO: 656210 - protein, 9 aa, Homo Sapiens
VKFELFEIS

SEQ ID NO: 656211 - protein, 9 aa, Homo Sapiens
SYTLVIIAV

SEQ ID NO: 656212 - protein, 9 aa, Homo Sapiens
MYLFLSHLS

SEQ ID NO: 656213 - protein, 9 aa, Homo Sapiens
KENLVHEEV

SEQ ID NO: 656214 - protein, 9 aa, Homo Sapiens
KREVPVASW

SEQ ID NO: 656215 - protein, 9 aa, Homo Sapiens
FRQESSNIS

SEQ ID NO: 656216 - protein, 9 aa, Homo Sapiens
IRSELTAFW

SEQ ID NO: 656217 - protein, 9 aa, Homo Sapiens
RVCGGANRL

SEQ ID NO: 656218 - protein, 9 aa, Homo Sapiens
TPARRGAGT

SEQ ID NO: 656219 - protein, 9 aa, Homo Sapiens
VAVLPHYHA

SEQ ID NO: 656220 - protein, 9 aa, Homo Sapiens
VVLAEDGSR

SEQ ID NO: 656221 - protein, 9 aa, Homo Sapiens
TNNEMTVTH

SEQ ID NO: 656222 - protein, 9 aa, Homo Sapiens
MYVAIVIIS

SEQ ID NO: 656223 - protein, 9 aa, Homo Sapiens
SGFKGEGRE

SEQ ID NO: 656224 - protein, 9 aa, Homo Sapiens
GGGYGGGFI

SEQ ID NO: 656225 - protein, 9 aa, Homo Sapiens
YERGPAAPR

SEQ ID NO: 656226 - protein, 9 aa, Homo Sapiens
HKKRQGATR

SEQ ID NO: 656227 - protein, 9 aa, Homo Sapiens
LNFCKQVDA

SEQ ID NO: 656228 - protein, 9 aa, Homo Sapiens
GECNIAGHE

SEQ ID NO: 656229 - protein, 9 aa, Homo Sapiens
DLVLYFDDE

SEQ ID NO: 656230 - protein, 9 aa, Homo Sapiens
PVKFELFEI

SEQ ID NO: 656231 - protein, 9 aa, Homo Sapiens
MPAAFSVKK

SEQ ID NO: 656232 - protein, 9 aa, Homo Sapiens
DELENRRRP

SEQ ID NO: 656233 - protein, 9 aa, Homo Sapiens
YRPGTVELR

SEQ ID NO: 656234 - protein, 9 aa, Homo Sapiens
WQLESKADA

SEQ ID NO: 656235 - protein, 9 aa, Homo Sapiens
SHMYVAIVI

SEQ ID NO: 656236 - protein, 9 aa, Homo Sapiens
GGVEEDTEA

SEQ ID NO: 656237 - protein, 9 aa, Homo Sapiens
FYTDPHHIS

SEQ ID NO: 656238 - protein, 9 aa, Homo Sapiens
VVLSTLTLN

SEQ ID NO: 656239 - protein, 9 aa, Homo Sapiens
CYDKNLEAS

SEQ ID NO: 656240 - protein, 9 aa, Homo Sapiens
CTPTVAEVY

SEQ ID NO: 656241 - protein, 9 aa, Homo Sapiens
DVIAQVAIL

SEQ ID NO: 656242 - protein, 9 aa, Homo Sapiens
ALLDKYNAK

SEQ ID NO: 656243 - protein, 9 aa, Homo Sapiens
AAENGQMQC

SEQ ID NO: 656244 - protein, 9 aa, Homo Sapiens
SMSGFKGEG

SEQ ID NO: 656245 - protein, 9 aa, Homo Sapiens
QRTPLQMMY

SEQ ID NO: 656246 - protein, 9 aa, Homo Sapiens
LNRDFRTWY

SEQ ID NO: 656247 - protein, 8 aa, Homo Sapiens
SIEKFWDR

SEQ ID NO: 656248 - protein, 9 aa, Homo Sapiens
NEDKQKQNE

SEQ ID NO: 656249 - protein, 9 aa, Homo Sapiens
GSHRHRYER

SEQ ID NO: 656250 - protein, 9 aa, Homo Sapiens
FLHVHQEGG

SEQ ID NO: 656251 - protein, 9 aa, Homo Sapiens
KILEGICLL

SEQ ID NO: 656252 - protein, 9 aa, Homo Sapiens
PHSEEFQQV

SEQ ID NO: 656253 - protein, 9 aa, Homo Sapiens
VHIDGDDVF

SEQ ID NO: 656254 - protein, 9 aa, Homo Sapiens
KRVSKFKAS

SEQ ID NO: 656255 - protein, 9 aa, Homo Sapiens
RRGEDIMHP

SEQ ID NO: 656256 - protein, 9 aa, Homo Sapiens
NTILYAWQV

SEQ ID NO: 656257 - protein, 9 aa, Homo Sapiens
IQLHLAESV

SEQ ID NO: 656258 - protein, 9 aa, Homo Sapiens
NDNAPALQA

SEQ ID NO: 656259 - protein, 9 aa, Homo Sapiens
FLRYGQHPN

SEQ ID NO: 656260 - protein, 9 aa, Homo Sapiens
PEVLQDPLD

SEQ ID NO: 656261 - protein, 9 aa, Homo Sapiens
ECSVGNGGG

SEQ ID NO: 656262 - protein, 9 aa, Homo Sapiens
KQQPRQSVA

SEQ ID NO: 656263 - protein, 9 aa, Homo Sapiens
VRDQNECSV

SEQ ID NO: 656264 - protein, 9 aa, Homo Sapiens
VVRMHFGDG

SEQ ID NO: 656265 - protein, 9 aa, Homo Sapiens
ILILGVGRN

SEQ ID NO: 656266 - protein, 9 aa, Homo Sapiens
LCTPCGPQP

SEQ ID NO: 656267 - protein, 9 aa, Homo Sapiens
KDPEGMDIS

SEQ ID NO: 656268 - protein, 9 aa, Homo Sapiens
YTKEKIKIL

SEQ ID NO: 656269 - protein, 9 aa, Homo Sapiens
GPQRAMRVP

SEQ ID NO: 656270 - protein, 9 aa, Homo Sapiens
TTEYAVGIY

SEQ ID NO: 656271 - protein, 9 aa, Homo Sapiens
VIEAVGSSS

SEQ ID NO: 656272 - protein, 9 aa, Homo Sapiens
CNQQPRCSR

SEQ ID NO: 656273 - protein, 9 aa, Homo Sapiens
NILLIILFN

SEQ ID NO: 656274 - protein, 9 aa, Homo Sapiens
IEAVGSSSA

SEQ ID NO: 656275 - protein, 9 aa, Homo Sapiens
ASFCNSGLL

SEQ ID NO: 656276 - protein, 9 aa, Homo Sapiens
DCFMLLSDA

SEQ ID NO: 656277 - protein, 9 aa, Homo Sapiens
IIDTQGFSD

SEQ ID NO: 656278 - protein, 9 aa, Homo Sapiens
QLSPISSPE

SEQ ID NO: 656279 - protein, 9 aa, Homo Sapiens
RTAIAPGYK

SEQ ID NO: 656280 - protein, 9 aa, Homo Sapiens
EKFHKYILQ

SEQ ID NO: 656281 - protein, 9 aa, Homo Sapiens
LCIVAVLPH

SEQ ID NO: 656282 - protein, 9 aa, Homo Sapiens
ELLLQTQER

SEQ ID NO: 656283 - protein, 9 aa, Homo Sapiens
AAMQFGNTE

SEQ ID NO: 656284 - protein, 9 aa, Homo Sapiens
PSSSSDIKV

SEQ ID NO: 656285 - protein, 9 aa, Homo Sapiens
VEEMLPNCK

SEQ ID NO: 656286 - protein, 9 aa, Homo Sapiens
GYKPQIQEV

SEQ ID NO: 656287 - protein, 9 aa, Homo Sapiens
AERSSPCQT

SEQ ID NO: 656288 - protein, 9 aa, Homo Sapiens
RGMVQALHA

SEQ ID NO: 656289 - protein, 9 aa, Homo Sapiens
EPGGPTFTI

SEQ ID NO: 656290 - protein, 9 aa, Homo Sapiens
NIADGSVKR

SEQ ID NO: 656291 - protein, 9 aa, Homo Sapiens
PEAVPGEEA

SEQ ID NO: 656292 - protein, 9 aa, Homo Sapiens
DEGGVEEDT

SEQ ID NO: 656293 - protein, 9 aa, Homo Sapiens
KRVKNLMKM

SEQ ID NO: 656294 - protein, 9 aa, Homo Sapiens
ELPPPRPRR

SEQ ID NO: 656295 - protein, 9 aa, Homo Sapiens
HVIKENLVH

SEQ ID NO: 656296 - protein, 9 aa, Homo Sapiens
RVPAMVVAV

SEQ ID NO: 656297 - protein, 9 aa, Homo Sapiens
FKEGKGRYL

SEQ ID NO: 656298 - protein, 9 aa, Homo Sapiens
QQTTPSSSS

SEQ ID NO: 656299 - protein, 9 aa, Homo Sapiens
EYLINTRKE

SEQ ID NO: 656300 - protein, 9 aa, Homo Sapiens
RIETAQRFF

SEQ ID NO: 656301 - protein, 9 aa, Homo Sapiens
RIINLNFCK

SEQ ID NO: 656302 - protein, 9 aa, Homo Sapiens
PVYHQEEIA

SEQ ID NO: 656303 - protein, 9 aa, Homo Sapiens
PSAPAYKDP

SEQ ID NO: 656304 - protein, 9 aa, Homo Sapiens
ASIFTDRRE

SEQ ID NO: 656305 - protein, 9 aa, Homo Sapiens
NTCGGISFP

SEQ ID NO: 656306 - protein, 9 aa, Homo Sapiens
FPDEREEWM

SEQ ID NO: 656307 - protein, 9 aa, Homo Sapiens
ETAQRFFSW

SEQ ID NO: 656308 - protein, 9 aa, Homo Sapiens
SAAYAMLFL

SEQ ID NO: 656309 - protein, 9 aa, Homo Sapiens
CLCIVAVLP

SEQ ID NO: 656310 - protein, 9 aa, Homo Sapiens
RTWSYRCYA

SEQ ID NO: 656311 - protein, 9 aa, Homo Sapiens
LAKGKRKPR

SEQ ID NO: 656312 - protein, 9 aa, Homo Sapiens
DLQYAAKVY

SEQ ID NO: 656313 - protein, 9 aa, Homo Sapiens
PVHGSRYGH

SEQ ID NO: 656314 - protein, 9 aa, Homo Sapiens
VLADFSALE

SEQ ID NO: 656315 - protein, 9 aa, Homo Sapiens
YSCHRFGGR

SEQ ID NO: 656316 - protein, 9 aa, Homo Sapiens
VVGFWGIHS

SEQ ID NO: 656317 - protein, 9 aa, Homo Sapiens
APVYHQEEI

SEQ ID NO: 656318 - protein, 9 aa, Homo Sapiens
HHLLTVRRH

SEQ ID NO: 656319 - protein, 9 aa, Homo Sapiens
DSYQGANYN

SEQ ID NO: 656320 - protein, 9 aa, Homo Sapiens
ECFLLDELE

SEQ ID NO: 656321 - protein, 9 aa, Homo Sapiens
CNIAGHESG

SEQ ID NO: 656322 - protein, 9 aa, Homo Sapiens
SGASGSKAE

SEQ ID NO: 656323 - protein, 9 aa, Homo Sapiens
HTTEYAVGI

SEQ ID NO: 656324 - protein, 9 aa, Homo Sapiens
TGRGCLLCC

SEQ ID NO: 656325 - protein, 9 aa, Homo Sapiens
AIGKHAKGT

SEQ ID NO: 656326 - protein, 9 aa, Homo Sapiens
QQIHTRMIR

SEQ ID NO: 656327 - protein, 9 aa, Homo Sapiens
SEEFQQVSL

SEQ ID NO: 656328 - protein, 9 aa, Homo Sapiens
ELDSGLQDQ

SEQ ID NO: 656329 - protein, 9 aa, Homo Sapiens
QHKMVKSLK

SEQ ID NO: 656330 - protein, 9 aa, Homo Sapiens
TFHVDFPDE

SEQ ID NO: 656331 - protein, 9 aa, Homo Sapiens
DKQKQNEDK

SEQ ID NO: 656332 - protein, 9 aa, Homo Sapiens
HFGDGKLPC

SEQ ID NO: 656333 - protein, 9 aa, Homo Sapiens
VVPKIQLHL

SEQ ID NO: 656334 - protein, 9 aa, Homo Sapiens
NIAGHESGK

SEQ ID NO: 656335 - protein, 9 aa, Homo Sapiens
SLIMQPLKH

SEQ ID NO: 656336 - protein, 9 aa, Homo Sapiens
RRYIRSELT

SEQ ID NO: 656337 - protein, 9 aa, Homo Sapiens
NGFKTQCLL

SEQ ID NO: 656338 - protein, 9 aa, Homo Sapiens
ANSVVLSTL

SEQ ID NO: 656339 - protein, 9 aa, Homo Sapiens
GLAIRSNIA

SEQ ID NO: 656340 - protein, 9 aa, Homo Sapiens
DQKAEFQIL

SEQ ID NO: 656341 - protein, 9 aa, Homo Sapiens
MKKRIFAAV

SEQ ID NO: 656342 - protein, 9 aa, Homo Sapiens
QQVSLLTQE

SEQ ID NO: 656343 - protein, 9 aa, Homo Sapiens
FENFPDLNS

SEQ ID NO: 656344 - protein, 9 aa, Homo Sapiens
EIKEILKNM

SEQ ID NO: 656345 - protein, 9 aa, Homo Sapiens
MDIKPKADP

SEQ ID NO: 656346 - protein, 9 aa, Homo Sapiens
TRTGPPSAP

SEQ ID NO: 656347 - protein, 9 aa, Homo Sapiens
THVLSQGAA

SEQ ID NO: 656348 - protein, 9 aa, Homo Sapiens
NLVHEEVTR

SEQ ID NO: 656349 - protein, 9 aa, Homo Sapiens
KWHCSLRDL

SEQ ID NO: 656350 - protein, 9 aa, Homo Sapiens
KKRFKEGKG

SEQ ID NO: 656351 - protein, 9 aa, Homo Sapiens
IINLNFCKQ

SEQ ID NO: 656352 - protein, 9 aa, Homo Sapiens
KSLPSAPAY

SEQ ID NO: 656353 - protein, 9 aa, Homo Sapiens
IEIFLRYGQ

SEQ ID NO: 656354 - protein, 9 aa, Homo Sapiens
ARRWPRQAG

SEQ ID NO: 656355 - protein, 9 aa, Homo Sapiens
RNLVLRKAL

SEQ ID NO: 656356 - protein, 9 aa, Homo Sapiens
DFQCVVGFW

SEQ ID NO: 656357 - protein, 9 aa, Homo Sapiens
GASGSKAEA

SEQ ID NO: 656358 - protein, 9 aa, Homo Sapiens
EVPVASWSG

SEQ ID NO: 656359 - protein, 9 aa, Homo Sapiens
GERLQHKMV

SEQ ID NO: 656360 - protein, 9 aa, Homo Sapiens
ELFEISKKR

SEQ ID NO: 656361 - protein, 9 aa, Homo Sapiens
GRGMVQALH

SEQ ID NO: 656362 - protein, 9 aa, Homo Sapiens
FSALEAHWS

SEQ ID NO: 656363 - protein, 9 aa, Homo Sapiens
DCVMDIKPK

SEQ ID NO: 656364 - protein, 9 aa, Homo Sapiens
GVGRNPAVS

SEQ ID NO: 656365 - protein, 9 aa, Homo Sapiens
FNQKLVKIK

SEQ ID NO: 656366 - protein, 9 aa, Homo Sapiens
KHAKGTLQV

SEQ ID NO: 656367 - protein, 9 aa, Homo Sapiens
NFFYTDPHH

SEQ ID NO: 656368 - protein, 9 aa, Homo Sapiens
QEEVVLADF

SEQ ID NO: 656369 - protein, 9 aa, Homo Sapiens
HFQLQDCKA

SEQ ID NO: 656370 - protein, 9 aa, Homo Sapiens
NLMKMMHIR

SEQ ID NO: 656371 - protein, 9 aa, Homo Sapiens
EGEADEAGC

SEQ ID NO: 656372 - protein, 9 aa, Homo Sapiens
MGCCTPTVA

SEQ ID NO: 656373 - protein, 9 aa, Homo Sapiens
HDRNLVLRK

SEQ ID NO: 656374 - protein, 9 aa, Homo Sapiens
IRAAMQFGN

SEQ ID NO: 656375 - protein, 9 aa, Homo Sapiens
FFYTDPHHI

SEQ ID NO: 656376 - protein, 9 aa, Homo Sapiens
SSSHFSPRP

SEQ ID NO: 656377 - protein, 9 aa, Homo Sapiens
NRSAGIYQG

SEQ ID NO: 656378 - protein, 9 aa, Homo Sapiens
ITWWPIGAS

SEQ ID NO: 656379 - protein, 9 aa, Homo Sapiens
HVLSQGAAL

SEQ ID NO: 656380 - protein, 9 aa, Homo Sapiens
WPRYSEAGM

SEQ ID NO: 656381 - protein, 9 aa, Homo Sapiens
APWNVRVNV

SEQ ID NO: 656382 - protein, 9 aa, Homo Sapiens
RGEDIMHPL

SEQ ID NO: 656383 - protein, 9 aa, Homo Sapiens
PAAGPGDTA

SEQ ID NO: 656384 - protein, 9 aa, Homo Sapiens
CFMLLSDAV

SEQ ID NO: 656385 - protein, 9 aa, Homo Sapiens
GVEEDTEAF

SEQ ID NO: 656386 - protein, 9 aa, Homo Sapiens
SSKWSSELA

SEQ ID NO: 656387 - protein, 9 aa, Homo Sapiens
VGFWGIHST

SEQ ID NO: 656388 - protein, 9 aa, Homo Sapiens
DNLTGFLKI

SEQ ID NO: 656389 - protein, 9 aa, Homo Sapiens
KAAKWHCSL

SEQ ID NO: 656390 - protein, 9 aa, Homo Sapiens
AFIYHAPAS

SEQ ID NO: 656391 - protein, 9 aa, Homo Sapiens
IKILEGICL

SEQ ID NO: 656392 - protein, 9 aa, Homo Sapiens
IFENFPDLN

SEQ ID NO: 656393 - protein, 9 aa, Homo Sapiens
VLCYAASVK

SEQ ID NO: 656394 - protein, 9 aa, Homo Sapiens
KRRMKKRIF

SEQ ID NO: 656395 - protein, 9 aa, Homo Sapiens
PGKHKKRQG

SEQ ID NO: 656396 - protein, 9 aa, Homo Sapiens
PGTVELREI

SEQ ID NO: 656397 - protein, 9 aa, Homo Sapiens
IAASIFTDR

SEQ ID NO: 656398 - protein, 9 aa, Homo Sapiens
TNKTKGGRY

SEQ ID NO: 656399 - protein, 9 aa, Homo Sapiens
VDEISMMGL

SEQ ID NO: 656400 - protein, 9 aa, Homo Sapiens
MQPLKHPTV

SEQ ID NO: 656401 - protein, 9 aa, Homo Sapiens
TILYAWQVN

SEQ ID NO: 656402 - protein, 9 aa, Homo Sapiens
FSAVEARCN

SEQ ID NO: 656403 - protein, 9 aa, Homo Sapiens
VIIAVLCIP

SEQ ID NO: 656404 - protein, 9 aa, Homo Sapiens
QSVAYNREE

SEQ ID NO: 656405 - protein, 9 aa, Homo Sapiens
VRSVCIYGA

SEQ ID NO: 656406 - protein, 9 aa, Homo Sapiens
LANSVVLST

SEQ ID NO: 656407 - protein, 9 aa, Homo Sapiens
EAPGKKKEM

SEQ ID NO: 656408 - protein, 9 aa, Homo Sapiens
KFELFEISK

SEQ ID NO: 656409 - protein, 9 aa, Homo Sapiens
YHRLWASPE

SEQ ID NO: 656410 - protein, 9 aa, Homo Sapiens
ADFSALEAH

SEQ ID NO: 656411 - protein, 9 aa, Homo Sapiens
HGDIYASFC

SEQ ID NO: 656412 - protein, 9 aa, Homo Sapiens
GRVCGGANR

SEQ ID NO: 656413 - protein, 9 aa, Homo Sapiens
YIQKVRFLE

SEQ ID NO: 656414 - protein, 9 aa, Homo Sapiens
LHLATRTTK

SEQ ID NO: 656415 - protein, 9 aa, Homo Sapiens
ISGSGEKRV

SEQ ID NO: 656416 - protein, 9 aa, Homo Sapiens
ALNRDFRTW

SEQ ID NO: 656417 - protein, 9 aa, Homo Sapiens
VHVSQEPKS

SEQ ID NO: 656418 - protein, 9 aa, Homo Sapiens
SVVLSTLTL

SEQ ID NO: 656419 - protein, 9 aa, Homo Sapiens
EDDIQSLHT

SEQ ID NO: 656420 - protein, 9 aa, Homo Sapiens
DSGFLHVHQ

SEQ ID NO: 656421 - protein, 9 aa, Homo Sapiens
LQSLDHEEV

SEQ ID NO: 656422 - protein, 9 aa, Homo Sapiens
RMLSGLAWG

SEQ ID NO: 656423 - protein, 9 aa, Homo Sapiens
FQQVSLLTQ

SEQ ID NO: 656424 - protein, 9 aa, Homo Sapiens
RAAPDESIR

SEQ ID NO: 656425 - protein, 9 aa, Homo Sapiens
GSKVAIVSA

SEQ ID NO: 656426 - protein, 9 aa, Homo Sapiens
LFNINSSLQ

SEQ ID NO: 656427 - protein, 9 aa, Homo Sapiens
FCTRHPLPT

SEQ ID NO: 656428 - protein, 9 aa, Homo Sapiens
GFISSSSSF

SEQ ID NO: 656429 - protein, 9 aa, Homo Sapiens
LCGNHRLDY

SEQ ID NO: 656430 - protein, 9 aa, Homo Sapiens
VLQVTNSVG

SEQ ID NO: 656431 - protein, 9 aa, Homo Sapiens
PSRTWSYRC

SEQ ID NO: 656432 - protein, 9 aa, Homo Sapiens
GSMPAAFSV

SEQ ID NO: 656433 - protein, 9 aa, Homo Sapiens
PARRGAGTS

SEQ ID NO: 656434 - protein, 9 aa, Homo Sapiens
VSPSRTWSY

SEQ ID NO: 656435 - protein, 9 aa, Homo Sapiens
DDEGGVEED

SEQ ID NO: 656436 - protein, 9 aa, Homo Sapiens
LTVRRHISR

SEQ ID NO: 656437 - protein, 9 aa, Homo Sapiens
TVVPKIQLH

SEQ ID NO: 656438 - protein, 9 aa, Homo Sapiens
PVSPSRTWS

SEQ ID NO: 656439 - protein, 9 aa, Homo Sapiens
AANRSAGIY

SEQ ID NO: 656440 - protein, 9 aa, Homo Sapiens
WPRQAGGCV

SEQ ID NO: 656441 - protein, 9 aa, Homo Sapiens
AAPDESIRE

SEQ ID NO: 656442 - protein, 9 aa, Homo Sapiens
AASIFTDRR

SEQ ID NO: 656443 - protein, 9 aa, Homo Sapiens
MSGFKGEGR

SEQ ID NO: 656444 - protein, 9 aa, Homo Sapiens
LTLVLHLAR

SEQ ID NO: 656445 - protein, 9 aa, Homo Sapiens
MPKFSMSGF

SEQ ID NO: 656446 - protein, 9 aa, Homo Sapiens
DVIIDTQGF

SEQ ID NO: 656447 - protein, 9 aa, Homo Sapiens
STVPKTKDQ

SEQ ID NO: 656448 - protein, 9 aa, Homo Sapiens
YDSYQGANY

SEQ ID NO: 656449 - protein, 9 aa, Homo Sapiens
WGDQAISYV

SEQ ID NO: 656450 - protein, 9 aa, Homo Sapiens
LGEKFHKYI

SEQ ID NO: 656451 - protein, 9 aa, Homo Sapiens
GFAIWGLSG

SEQ ID NO: 656452 - protein, 9 aa, Homo Sapiens
AACRLMEGC

SEQ ID NO: 656453 - protein, 9 aa, Homo Sapiens
EAACLAALV

SEQ ID NO: 656454 - protein, 9 aa, Homo Sapiens
KTRSARDLV

SEQ ID NO: 656455 - protein, 9 aa, Homo Sapiens
KGQNVLQVT

SEQ ID NO: 656456 - protein, 9 aa, Homo Sapiens
RAAMQFGNT

SEQ ID NO: 656457 - protein, 9 aa, Homo Sapiens
SSNISTEDL

SEQ ID NO: 656458 - protein, 9 aa, Homo Sapiens
AVEARCNFE

SEQ ID NO: 656459 - protein, 9 aa, Homo Sapiens
QQKTDLQYA

SEQ ID NO: 656460 - protein, 9 aa, Homo Sapiens
QSQQFNQKL

SEQ ID NO: 656461 - protein, 9 aa, Homo Sapiens
TQQIHTRMI

SEQ ID NO: 656462 - protein, 9 aa, Homo Sapiens
EEKNILKGQ

SEQ ID NO: 656463 - protein, 9 aa, Homo Sapiens
QSGDVSRHS

SEQ ID NO: 656464 - protein, 9 aa, Homo Sapiens
KYNAKKPKN

SEQ ID NO: 656465 - protein, 9 aa, Homo Sapiens
LLLHHLLTV

SEQ ID NO: 656466 - protein, 9 aa, Homo Sapiens
KWSSELAFS

SEQ ID NO: 656467 - protein, 9 aa, Homo Sapiens
RSRAIGKHA

SEQ ID NO: 656468 - protein, 9 aa, Homo Sapiens
DGEKDCEGE

SEQ ID NO: 656469 - protein, 9 aa, Homo Sapiens
CEGEADEAG

SEQ ID NO: 656470 - protein, 9 aa, Homo Sapiens
SPRWPVVVS

SEQ ID NO: 656471 - protein, 9 aa, Homo Sapiens
EILKNMAGF

SEQ ID NO: 656472 - protein, 9 aa, Homo Sapiens
VEARCNFEQ

SEQ ID NO: 656473 - protein, 9 aa, Homo Sapiens
SIRERVANL

SEQ ID NO: 656474 - protein, 9 aa, Homo Sapiens
AKQKSHRQV

SEQ ID NO: 656475 - protein, 9 aa, Homo Sapiens
DRFASYIQK

SEQ ID NO: 656476 - protein, 9 aa, Homo Sapiens
NFCKQVDAG

SEQ ID NO: 656477 - protein, 9 aa, Homo Sapiens
GMARYHVTE

SEQ ID NO: 656478 - protein, 9 aa, Homo Sapiens
VLAKGKRKP

SEQ ID NO: 656479 - protein, 9 aa, Homo Sapiens
DKLLHLATR

SEQ ID NO: 656480 - protein, 9 aa, Homo Sapiens
CGARRWPRQ

SEQ ID NO: 656481 - protein, 9 aa, Homo Sapiens
LYEFAASAC

SEQ ID NO: 656482 - protein, 9 aa, Homo Sapiens
AVVNLGLVP

SEQ ID NO: 656483 - protein, 9 aa, Homo Sapiens
RDALHGFVA

SEQ ID NO: 656484 - protein, 9 aa, Homo Sapiens
QPARRAVVN

SEQ ID NO: 656485 - protein, 9 aa, Homo Sapiens
VFQIGVIFP

SEQ ID NO: 656486 - protein, 9 aa, Homo Sapiens
REEAACLAA

SEQ ID NO: 656487 - protein, 9 aa, Homo Sapiens
FLGEKFHKY

SEQ ID NO: 656488 - protein, 9 aa, Homo Sapiens
SKAAKWHCS

SEQ ID NO: 656489 - protein, 9 aa, Homo Sapiens
NQLSPISSP

SEQ ID NO: 656490 - protein, 9 aa, Homo Sapiens
QPNGFKTQC

SEQ ID NO: 656491 - protein, 9 aa, Homo Sapiens
LWASPEAPG

SEQ ID NO: 656492 - protein, 9 aa, Homo Sapiens
NCKVVGVDW

SEQ ID NO: 656493 - protein, 9 aa, Homo Sapiens
FHDRNLVLR

SEQ ID NO: 656494 - protein, 9 aa, Homo Sapiens
PSRLAVISG

SEQ ID NO: 656495 - protein, 9 aa, Homo Sapiens
RFASYIQKV

SEQ ID NO: 656496 - protein, 9 aa, Homo Sapiens
DFPDEREEW

SEQ ID NO: 656497 - protein, 9 aa, Homo Sapiens
STLTLNLPT

SEQ ID NO: 656498 - protein, 9 aa, Homo Sapiens
GREPGGPTF

SEQ ID NO: 656499 - protein, 9 aa, Homo Sapiens
IPVHGSRYG

SEQ ID NO: 656500 - protein, 9 aa, Homo Sapiens
GGVLAKGKR

SEQ ID NO: 656501 - protein, 9 aa, Homo Sapiens
HSEEFQQVS

SEQ ID NO: 656502 - protein, 9 aa, Homo Sapiens
GNTEIKVTA

SEQ ID NO: 656503 - protein, 9 aa, Homo Sapiens
AGKGIGRGM

SEQ ID NO: 656504 - protein, 9 aa, Homo Sapiens
LDSGLQDQK

SEQ ID NO: 656505 - protein, 9 aa, Homo Sapiens
PAALHELCP

SEQ ID NO: 656506 - protein, 9 aa, Homo Sapiens
RVLCLRELG

SEQ ID NO: 656507 - protein, 9 aa, Homo Sapiens
PTFNQLSPI

SEQ ID NO: 656508 - protein, 9 aa, Homo Sapiens
DLCTPCGPQ

SEQ ID NO: 656509 - protein, 9 aa, Homo Sapiens
LHSGASGSK

SEQ ID NO: 656510 - protein, 9 aa, Homo Sapiens
VPKIQLHLA

SEQ ID NO: 656511 - protein, 9 aa, Homo Sapiens
IYQGLAFGG

SEQ ID NO: 656512 - protein, 9 aa, Homo Sapiens
GLGELPPPR

SEQ ID NO: 656513 - protein, 9 aa, Homo Sapiens
VMPCYDKNL

SEQ ID NO: 656514 - protein, 9 aa, Homo Sapiens
PLQMMYLRE

SEQ ID NO: 656515 - protein, 9 aa, Homo Sapiens
GRYESESAY

SEQ ID NO: 656516 - protein, 9 aa, Homo Sapiens
FKTQCLLNR

SEQ ID NO: 656517 - protein, 9 aa, Homo Sapiens
GPSSLVLCL

SEQ ID NO: 656518 - protein, 9 aa, Homo Sapiens
WSSELAFSL

SEQ ID NO: 656519 - protein, 9 aa, Homo Sapiens
LTCEECGKI

SEQ ID NO: 656520 - protein, 9 aa, Homo Sapiens
EGEQKGSNE

SEQ ID NO: 656521 - protein, 9 aa, Homo Sapiens
LPSAPAYKD

SEQ ID NO: 656522 - protein, 9 aa, Homo Sapiens
CGGISFPYH

SEQ ID NO: 656523 - protein, 9 aa, Homo Sapiens
VCISSVIQT

SEQ ID NO: 656524 - protein, 9 aa, Homo Sapiens
IPGDCGPPA

SEQ ID NO: 656525 - protein, 9 aa, Homo Sapiens
RKEKRKNKK

SEQ ID NO: 656526 - protein, 9 aa, Homo Sapiens
AHIHTTEYA

SEQ ID NO: 656527 - protein, 9 aa, Homo Sapiens
LPHYHACLI

SEQ ID NO: 656528 - protein, 9 aa, Homo Sapiens
SCMNITLSE

SEQ ID NO: 656529 - protein, 9 aa, Homo Sapiens
SVMNPVIEA

SEQ ID NO: 656530 - protein, 9 aa, Homo Sapiens
SHFSPRPPL

SEQ ID NO: 656531 - protein, 9 aa, Homo Sapiens
IVILILGVG

SEQ ID NO: 656532 - protein, 9 aa, Homo Sapiens
QQICNQQPR

SEQ ID NO: 656533 - protein, 9 aa, Homo Sapiens
KQKQNEDKG

SEQ ID NO: 656534 - protein, 9 aa, Homo Sapiens
ACSVHIDGD

SEQ ID NO: 656535 - protein, 9 aa, Homo Sapiens
AMQFGNTEI

SEQ ID NO: 656536 - protein, 9 aa, Homo Sapiens
GDIYASFCN

SEQ ID NO: 656537 - protein, 9 aa, Homo Sapiens
SGLQDQKAE

SEQ ID NO: 656538 - protein, 9 aa, Homo Sapiens
TFNGQKRGI

SEQ ID NO: 656539 - protein, 9 aa, Homo Sapiens
SVAYNREEE

SEQ ID NO: 656540 - protein, 9 aa, Homo Sapiens
SMMGLVVKV

SEQ ID NO: 656541 - protein, 9 aa, Homo Sapiens
LGARFVSCL

SEQ ID NO: 656542 - protein, 9 aa, Homo Sapiens
LVVKVEKQV

SEQ ID NO: 656543 - protein, 9 aa, Homo Sapiens
QLIDELADN

SEQ ID NO: 656544 - protein, 9 aa, Homo Sapiens
TGTLELPPA

SEQ ID NO: 656545 - protein, 9 aa, Homo Sapiens
AAYAMLFLG

SEQ ID NO: 656546 - protein, 9 aa, Homo Sapiens
EKRKEKRKN

SEQ ID NO: 656547 - protein, 9 aa, Homo Sapiens
CRLMEGCQV

SEQ ID NO: 656548 - protein, 9 aa, Homo Sapiens
RCNFEQDLC

SEQ ID NO: 656549 - protein, 9 aa, Homo Sapiens
TVRRHISRS

SEQ ID NO: 656550 - protein, 9 aa, Homo Sapiens
ITLSESPFK

SEQ ID NO: 656551 - protein, 9 aa, Homo Sapiens
MARYHVTEC

SEQ ID NO: 656552 - protein, 9 aa, Homo Sapiens
AWGDQAISY

SEQ ID NO: 656553 - protein, 9 aa, Homo Sapiens
SARDLVLYF

SEQ ID NO: 656554 - protein, 9 aa, Homo Sapiens
SEEIEIFLR

SEQ ID NO: 656555 - protein, 9 aa, Homo Sapiens
NQRRYIRSE

SEQ ID NO: 656556 - protein, 9 aa, Homo Sapiens
YLINTRKEE

SEQ ID NO: 656557 - protein, 9 aa, Homo Sapiens
SNEEKEDLR

SEQ ID NO: 656558 - protein, 9 aa, Homo Sapiens
FPFPEAVPG

SEQ ID NO: 656559 - protein, 9 aa, Homo Sapiens
RIHAEEKPL

SEQ ID NO: 656560 - protein, 9 aa, Homo Sapiens
GGYGGGFIS

SEQ ID NO: 656561 - protein, 9 aa, Homo Sapiens
DDIQSLHTD

SEQ ID NO: 656562 - protein, 9 aa, Homo Sapiens
DVWFLSVLT

SEQ ID NO: 656563 - protein, 9 aa, Homo Sapiens
TDTSAKLRL

SEQ ID NO: 656564 - protein, 9 aa, Homo Sapiens
CNSGLLDTF

SEQ ID NO: 656565 - protein, 9 aa, Homo Sapiens
LQGGYDCKY

SEQ ID NO: 656566 - protein, 9 aa, Homo Sapiens
EPEVLQDPL

SEQ ID NO: 656567 - protein, 9 aa, Homo Sapiens
RYDDEGGVE

SEQ ID NO: 656568 - protein, 9 aa, Homo Sapiens
ALTGVLKTN

SEQ ID NO: 656569 - protein, 9 aa, Homo Sapiens
GCCTPTVAE

SEQ ID NO: 656570 - protein, 9 aa, Homo Sapiens
LQAPRVGGT

SEQ ID NO: 656571 - protein, 9 aa, Homo Sapiens
SYQGANYNE

SEQ ID NO: 656572 - protein, 9 aa, Homo Sapiens
LIWKLLSTY

SEQ ID NO: 656573 - protein, 9 aa, Homo Sapiens
PHHISRAVC

SEQ ID NO: 656574 - protein, 9 aa, Homo Sapiens
MECKGERGR

SEQ ID NO: 656575 - protein, 9 aa, Homo Sapiens
HLLTVRRHI

SEQ ID NO: 656576 - protein, 9 aa, Homo Sapiens
TVGCAKQKS

SEQ ID NO: 656577 - protein, 9 aa, Homo Sapiens
GRGCGRGRG

SEQ ID NO: 656578 - protein, 9 aa, Homo Sapiens
KGERGRVCG

SEQ ID NO: 656579 - protein, 9 aa, Homo Sapiens
KPLAMGVVR

SEQ ID NO: 656580 - protein, 9 aa, Homo Sapiens
ARYHVTECT

SEQ ID NO: 656581 - protein, 9 aa, Homo Sapiens
LSTYSDEVT

SEQ ID NO: 656582 - protein, 9 aa, Homo Sapiens
NYNELYQNQ

SEQ ID NO: 656583 - protein, 9 aa, Homo Sapiens
ASYIQKVRF

SEQ ID NO: 656584 - protein, 9 aa, Homo Sapiens
ERAAPDESI

SEQ ID NO: 656585 - protein, 9 aa, Homo Sapiens
LLGCRMHRN

SEQ ID NO: 656586 - protein, 9 aa, Homo Sapiens
KVAIVSARD

SEQ ID NO: 656587 - protein, 9 aa, Homo Sapiens
IYASFCNSG

SEQ ID NO: 656588 - protein, 9 aa, Homo Sapiens
PRCSRLHIC

SEQ ID NO: 656589 - protein, 9 aa, Homo Sapiens
LQDLQVIAA

SEQ ID NO: 656590 - protein, 9 aa, Homo Sapiens
STYSDEVTD

SEQ ID NO: 656591 - protein, 9 aa, Homo Sapiens
RFYSCHRFG

SEQ ID NO: 656592 - protein, 9 aa, Homo Sapiens
RLRREEAAC

SEQ ID NO: 656593 - protein, 9 aa, Homo Sapiens
NLEASRPDF

SEQ ID NO: 656594 - protein, 9 aa, Homo Sapiens
RTWYQQLFC

SEQ ID NO: 656595 - protein, 9 aa, Homo Sapiens
SKKLQGGYD

SEQ ID NO: 656596 - protein, 9 aa, Homo Sapiens
VYALQSLDH

SEQ ID NO: 656597 - protein, 9 aa, Homo Sapiens
QKTDLQYAA

SEQ ID NO: 656598 - protein, 9 aa, Homo Sapiens
LCFCTRHPL

SEQ ID NO: 656599 - protein, 9 aa, Homo Sapiens
KMNSGNLVS

SEQ ID NO: 656600 - protein, 9 aa, Homo Sapiens
AGVQLRNLG

SEQ ID NO: 656601 - protein, 9 aa, Homo Sapiens
ANFFETSQQ

SEQ ID NO: 656602 - protein, 9 aa, Homo Sapiens
LHLAESVDV

SEQ ID NO: 656603 - protein, 9 aa, Homo Sapiens
GSGGVLAKG

SEQ ID NO: 656604 - protein, 9 aa, Homo Sapiens
SRTVGCAKQ

SEQ ID NO: 656605 - protein, 9 aa, Homo Sapiens
PAERSSPCQ

SEQ ID NO: 656606 - protein, 9 aa, Homo Sapiens
VIIDTQGFS

SEQ ID NO: 656607 - protein, 9 aa, Homo Sapiens
EEMLPNCKV

SEQ ID NO: 656608 - protein, 9 aa, Homo Sapiens
LATRTTKKE

SEQ ID NO: 656609 - protein, 9 aa, Homo Sapiens
GQVRDQNEC

SEQ ID NO: 656610 - protein, 9 aa, Homo Sapiens
LKIFCKRVK

SEQ ID NO: 656611 - protein, 9 aa, Homo Sapiens
GFVAVFYTT

SEQ ID NO: 656612 - protein, 9 aa, Homo Sapiens
APALQAPRV

SEQ ID NO: 656613 - protein, 9 aa, Homo Sapiens
YDKNLEASR

SEQ ID NO: 656614 - protein, 9 aa, Homo Sapiens
AIVIISGLG

SEQ ID NO: 656615 - protein, 9 aa, Homo Sapiens
LGLLFISTN

SEQ ID NO: 656616 - protein, 9 aa, Homo Sapiens
TFEYLINTR

SEQ ID NO: 656617 - protein, 9 aa, Homo Sapiens
HLVFQIGVI

SEQ ID NO: 656618 - protein, 9 aa, Homo Sapiens
AIRSNIADG

SEQ ID NO: 656619 - protein, 9 aa, Homo Sapiens
SNISTEDLV

SEQ ID NO: 656620 - protein, 9 aa, Homo Sapiens
SYFCVCISS

SEQ ID NO: 656621 - protein, 9 aa, Homo Sapiens
RGPAPSAVA

SEQ ID NO: 656622 - protein, 9 aa, Homo Sapiens
QERRHRLRG

SEQ ID NO: 656623 - protein, 9 aa, Homo Sapiens
DIKPKADPT

SEQ ID NO: 656624 - protein, 9 aa, Homo Sapiens
RFTKGLYLL

SEQ ID NO: 656625 - protein, 9 aa, Homo Sapiens
CVMIAASIF

SEQ ID NO: 656626 - protein, 9 aa, Homo Sapiens
YHAPASKTW

SEQ ID NO: 656627 - protein, 9 aa, Homo Sapiens
LAVISGSGE

SEQ ID NO: 656628 - protein, 9 aa, Homo Sapiens
VILILGVGR

SEQ ID NO: 656629 - protein, 9 aa, Homo Sapiens
LPMVAPWNV

SEQ ID NO: 656630 - protein, 9 aa, Homo Sapiens
LSGLAWGDQ

SEQ ID NO: 656631 - protein, 9 aa, Homo Sapiens
RTVGCAKQK

SEQ ID NO: 656632 - protein, 9 aa, Homo Sapiens
LQHKMVKSL

SEQ ID NO: 656633 - protein, 9 aa, Homo Sapiens
QWLQVDLGT

SEQ ID NO: 656634 - protein, 9 aa, Homo Sapiens
TQHLQDLQV

SEQ ID NO: 656635 - protein, 9 aa, Homo Sapiens
TPLQMMYLR

SEQ ID NO: 656636 - protein, 9 aa, Homo Sapiens
RECFLLDEL

SEQ ID NO: 656637 - protein, 9 aa, Homo Sapiens
RTFHVDFPD

SEQ ID NO: 656638 - protein, 9 aa, Homo Sapiens
RRMKKRIFA

SEQ ID NO: 656639 - protein, 9 aa, Homo Sapiens
HVDDEGTLI

SEQ ID NO: 656640 - protein, 9 aa, Homo Sapiens
SPSRTWSYR

SEQ ID NO: 656641 - protein, 9 aa, Homo Sapiens
GAKLKYKSY

SEQ ID NO: 656642 - protein, 9 aa, Homo Sapiens
TRTTKKEAQ

SEQ ID NO: 656643 - protein, 9 aa, Homo Sapiens
QASEANFFE

SEQ ID NO: 656644 - protein, 9 aa, Homo Sapiens
GKHKKRQGA

SEQ ID NO: 656645 - protein, 9 aa, Homo Sapiens
ALHGFVAVF

SEQ ID NO: 656646 - protein, 9 aa, Homo Sapiens
ATRTTKKEA

SEQ ID NO: 656647 - protein, 9 aa, Homo Sapiens
ALWPRYSEA

SEQ ID NO: 656648 - protein, 9 aa, Homo Sapiens
SPGSSSHFS

SEQ ID NO: 656649 - protein, 9 aa, Homo Sapiens
TFTESSTRD

SEQ ID NO: 656650 - protein, 9 aa, Homo Sapiens
SVHIDGDDV

SEQ ID NO: 656651 - protein, 9 aa, Homo Sapiens
TRHPLPTSM

SEQ ID NO: 656652 - protein, 9 aa, Homo Sapiens
PMVAPWNVR

SEQ ID NO: 656653 - protein, 9 aa, Homo Sapiens
VSRHSGSRH

SEQ ID NO: 656654 - protein, 9 aa, Homo Sapiens
KDQRPQLDP

SEQ ID NO: 656655 - protein, 9 aa, Homo Sapiens
HSQASEANF

SEQ ID NO: 656656 - protein, 9 aa, Homo Sapiens
PVIEAVGSS

SEQ ID NO: 656657 - protein, 9 aa, Homo Sapiens
ENEDKQKQN

SEQ ID NO: 656658 - protein, 9 aa, Homo Sapiens
ARSVVLAED

SEQ ID NO: 656659 - protein, 9 aa, Homo Sapiens
LLETFHFQA

SEQ ID NO: 656660 - protein, 9 aa, Homo Sapiens
KADPTSLTV

SEQ ID NO: 656661 - protein, 9 aa, Homo Sapiens
EKPLTCEEC

SEQ ID NO: 656662 - protein, 9 aa, Homo Sapiens
GGGFISSSS

SEQ ID NO: 656663 - protein, 9 aa, Homo Sapiens
MRVPAMVVA

SEQ ID NO: 656664 - protein, 9 aa, Homo Sapiens
MMHIRYCQH

SEQ ID NO: 656665 - protein, 9 aa, Homo Sapiens
KNLEASRPD

SEQ ID NO: 656666 - protein, 9 aa, Homo Sapiens
RAVVNLGLV

SEQ ID NO: 656667 - protein, 9 aa, Homo Sapiens
MNITLSESP

SEQ ID NO: 656668 - protein, 9 aa, Homo Sapiens
IAPVYHQEE

SEQ ID NO: 656669 - protein, 9 aa, Homo Sapiens
LQDTRSQLK

SEQ ID NO: 656670 - protein, 9 aa, Homo Sapiens
SCGECNIAG

SEQ ID NO: 656671 - protein, 9 aa, Homo Sapiens
LTGVLKTNP

SEQ ID NO: 656672 - protein, 9 aa, Homo Sapiens
EANFFETSQ

SEQ ID NO: 656673 - protein, 9 aa, Homo Sapiens
PSEEIEIFL

SEQ ID NO: 656674 - protein, 9 aa, Homo Sapiens
HGLFGVWAH

SEQ ID NO: 656675 - protein, 9 aa, Homo Sapiens
VPPNTILYA

SEQ ID NO: 656676 - protein, 9 aa, Homo Sapiens
PLKHPTVLE

SEQ ID NO: 656677 - protein, 9 aa, Homo Sapiens
RQQKTDLQY

SEQ ID NO: 656678 - protein, 9 aa, Homo Sapiens
VCFTPGESQ

SEQ ID NO: 656679 - protein, 9 aa, Homo Sapiens
VSHMYVAIV

SEQ ID NO: 656680 - protein, 9 aa, Homo Sapiens
ARRAVVNLG

SEQ ID NO: 656681 - protein, 9 aa, Homo Sapiens
ILFNINSSL

SEQ ID NO: 656682 - protein, 9 aa, Homo Sapiens
PLPTFNQLS

SEQ ID NO: 656683 - protein, 9 aa, Homo Sapiens
DLPMVAPWN

SEQ ID NO: 656684 - protein, 9 aa, Homo Sapiens
QGAALWPRY

SEQ ID NO: 656685 - protein, 9 aa, Homo Sapiens
MDFLKEFYA

SEQ ID NO: 656686 - protein, 9 aa, Homo Sapiens
HMYVAIVII

SEQ ID NO: 656687 - protein, 9 aa, Homo Sapiens
KTQCLLNRP

SEQ ID NO: 656688 - protein, 9 aa, Homo Sapiens
TLVLHLART

SEQ ID NO: 656689 - protein, 9 aa, Homo Sapiens
DDEGTLIIY

SEQ ID NO: 656690 - protein, 9 aa, Homo Sapiens
DCKAATNSY

SEQ ID NO: 656691 - protein, 9 aa, Homo Sapiens
AKKPKNAIH

SEQ ID NO: 656692 - protein, 9 aa, Homo Sapiens
KLKYKSYCQ

SEQ ID NO: 656693 - protein, 9 aa, Homo Sapiens
RRNDGLGEL

SEQ ID NO: 656694 - protein, 9 aa, Homo Sapiens
YIRSELTAF

SEQ ID NO: 656695 - protein, 9 aa, Homo Sapiens
HAPASKTWP

SEQ ID NO: 656696 - protein, 9 aa, Homo Sapiens
EAPRLHPPF

SEQ ID NO: 656697 - protein, 9 aa, Homo Sapiens
GGPTFTIGK

SEQ ID NO: 656698 - protein, 9 aa, Homo Sapiens
DVSRHSGSR

SEQ ID NO: 656699 - protein, 9 aa, Homo Sapiens
QEVAEAPRL

SEQ ID NO: 656700 - protein, 9 aa, Homo Sapiens
FGDGKLPCR

SEQ ID NO: 656701 - protein, 9 aa, Homo Sapiens
TEHGLFGVW

SEQ ID NO: 656702 - protein, 9 aa, Homo Sapiens
AVPGEEAAG

SEQ ID NO: 656703 - protein, 9 aa, Homo Sapiens
HIYNQRRYI

SEQ ID NO: 656704 - protein, 9 aa, Homo Sapiens
DYFICEVPA

SEQ ID NO: 656705 - protein, 9 aa, Homo Sapiens
NLTGFLKIF

SEQ ID NO: 656706 - protein, 9 aa, Homo Sapiens
PAMVVAVYT

SEQ ID NO: 656707 - protein, 9 aa, Homo Sapiens
LQTQERRHR

SEQ ID NO: 656708 - protein, 9 aa, Homo Sapiens
TLELPPAAG

SEQ ID NO: 656709 - protein, 9 aa, Homo Sapiens
TRMIRLFSL

SEQ ID NO: 656710 - protein, 9 aa, Homo Sapiens
IAPGYKPQI

SEQ ID NO: 656711 - protein, 9 aa, Homo Sapiens
QGGYDCKYC

SEQ ID NO: 656712 - protein, 9 aa, Homo Sapiens
NIEDDIQSL

SEQ ID NO: 656713 - protein, 9 aa, Homo Sapiens
APRLHPPFP

SEQ ID NO: 656714 - protein, 9 aa, Homo Sapiens
IHAEEKPLT

SEQ ID NO: 656715 - protein, 9 aa, Homo Sapiens
AGQKTPDSV

SEQ ID NO: 656716 - protein, 9 aa, Homo Sapiens
AVQWVVWNS

SEQ ID NO: 656717 - protein, 9 aa, Homo Sapiens
TCLKSRAIC

SEQ ID NO: 656718 - protein, 9 aa, Homo Sapiens
GIAAWKLQL

SEQ ID NO: 656719 - protein, 9 aa, Homo Sapiens
SRLAVISGS

SEQ ID NO: 656720 - protein, 9 aa, Homo Sapiens
KPLTCEECG

SEQ ID NO: 656721 - protein, 9 aa, Homo Sapiens
QAQPGEQWL

SEQ ID NO: 656722 - protein, 9 aa, Homo Sapiens
RPEDQVLVR

SEQ ID NO: 656723 - protein, 9 aa, Homo Sapiens
TGPPSAPLG

SEQ ID NO: 656724 - protein, 9 aa, Homo Sapiens
DEGTLIIYD

SEQ ID NO: 656725 - protein, 9 aa, Homo Sapiens
MSSLEQLDQ

SEQ ID NO: 656726 - protein, 9 aa, Homo Sapiens
PIPPRAEFN

SEQ ID NO: 656727 - protein, 9 aa, Homo Sapiens
PKIQLHLAE

SEQ ID NO: 656728 - protein, 9 aa, Homo Sapiens
NILKGQSES

SEQ ID NO: 656729 - protein, 9 aa, Homo Sapiens
RTTKKEAQC

SEQ ID NO: 656730 - protein, 9 aa, Homo Sapiens
WGSCGECNI

SEQ ID NO: 656731 - protein, 9 aa, Homo Sapiens
MIAASIFTD

SEQ ID NO: 656732 - protein, 9 aa, Homo Sapiens
LQSKAAKWH

SEQ ID NO: 656733 - protein, 9 aa, Homo Sapiens
WRSRAIGKH

SEQ ID NO: 656734 - protein, 9 aa, Homo Sapiens
EKQRFYSCH

SEQ ID NO: 656735 - protein, 9 aa, Homo Sapiens
SQQFNQKLV

SEQ ID NO: 656736 - protein, 9 aa, Homo Sapiens
FVAVFYTTL

SEQ ID NO: 656737 - protein, 9 aa, Homo Sapiens
AKLRLSHCT

SEQ ID NO: 656738 - protein, 9 aa, Homo Sapiens
SGSKAEALL

SEQ ID NO: 656739 - protein, 9 aa, Homo Sapiens
LQGELAQLK

SEQ ID NO: 656740 - protein, 9 aa, Homo Sapiens
EERIETAQR

SEQ ID NO: 656741 - protein, 9 aa, Homo Sapiens
FRTWYQQLF

SEQ ID NO: 656742 - protein, 9 aa, Homo Sapiens
NFFETSQQQ

SEQ ID NO: 656743 - protein, 9 aa, Homo Sapiens
DADLYCQKM

SEQ ID NO: 656744 - protein, 9 aa, Homo Sapiens
RSNIADGSV

SEQ ID NO: 656745 - protein, 9 aa, Homo Sapiens
PSSLVLCLL

SEQ ID NO: 656746 - protein, 9 aa, Homo Sapiens
PVTCLKSRA

SEQ ID NO: 656747 - protein, 9 aa, Homo Sapiens
ENLVHEEVT

SEQ ID NO: 656748 - protein, 9 aa, Homo Sapiens
AEEKPLTCE

SEQ ID NO: 656749 - protein, 9 aa, Homo Sapiens
DKNLEASRP

SEQ ID NO: 656750 - protein, 9 aa, Homo Sapiens
EKKRFKEGK

SEQ ID NO: 656751 - protein, 9 aa, Homo Sapiens
GLYLLQVHE

SEQ ID NO: 656752 - protein, 9 aa, Homo Sapiens
VILLSGGFL

SEQ ID NO: 656753 - protein, 9 aa, Homo Sapiens
FSAVFKRTS

SEQ ID NO: 656754 - protein, 9 aa, Homo Sapiens
AEKERHLST

SEQ ID NO: 656755 - protein, 9 aa, Homo Sapiens
YNELYQNQN

SEQ ID NO: 656756 - protein, 9 aa, Homo Sapiens
KPKADPTSL

SEQ ID NO: 656757 - protein, 9 aa, Homo Sapiens
RHLSTMITQ

SEQ ID NO: 656758 - protein, 9 aa, Homo Sapiens
DEADVIIDT

SEQ ID NO: 656759 - protein, 9 aa, Homo Sapiens
AQRTPLQMM

SEQ ID NO: 656760 - protein, 9 aa, Homo Sapiens
AQPGEQWLQ

SEQ ID NO: 656761 - protein, 9 aa, Homo Sapiens
ERSSPCQTP

SEQ ID NO: 656762 - protein, 9 aa, Homo Sapiens
ASPEAPGKK

SEQ ID NO: 656763 - protein, 9 aa, Homo Sapiens
GAFIYHAPA

SEQ ID NO: 656764 - protein, 9 aa, Homo Sapiens
NLVLRKALY

SEQ ID NO: 656765 - protein, 9 aa, Homo Sapiens
CLRELGARF

SEQ ID NO: 656766 - protein, 9 aa, Homo Sapiens
REPGGPTFT

SEQ ID NO: 656767 - protein, 9 aa, Homo Sapiens
SSRTVGCAK

SEQ ID NO: 656768 - protein, 9 aa, Homo Sapiens
VAYSSSREI

SEQ ID NO: 656769 - protein, 9 aa, Homo Sapiens
ESIRERVAN

SEQ ID NO: 656770 - protein, 9 aa, Homo Sapiens
PDESIRERV

SEQ ID NO: 656771 - protein, 9 aa, Homo Sapiens
HTAHIHTTE

SEQ ID NO: 656772 - protein, 9 aa, Homo Sapiens
SELAFSLPA

SEQ ID NO: 656773 - protein, 9 aa, Homo Sapiens
EMLPNCKVV

SEQ ID NO: 656774 - protein, 9 aa, Homo Sapiens
GQMQCCQTL

SEQ ID NO: 656775 - protein, 9 aa, Homo Sapiens
AMLFLGACS

SEQ ID NO: 656776 - protein, 9 aa, Homo Sapiens
VIISGLGYC

SEQ ID NO: 656777 - protein, 9 aa, Homo Sapiens
GNILLIILF

SEQ ID NO: 656778 - protein, 9 aa, Homo Sapiens
LADNLTGFL

SEQ ID NO: 656779 - protein, 9 aa, Homo Sapiens
CHRFGGREP

SEQ ID NO: 656780 - protein, 9 aa, Homo Sapiens
KVYALQSLD

SEQ ID NO: 656781 - protein, 9 aa, Homo Sapiens
QSVRTQHLQ

SEQ ID NO: 656782 - protein, 9 aa, Homo Sapiens
LRELGARFV

SEQ ID NO: 656783 - protein, 9 aa, Homo Sapiens
HPLPTSMTS

SEQ ID NO: 656784 - protein, 9 aa, Homo Sapiens
YFLAGRDIT

SEQ ID NO: 656785 - protein, 9 aa, Homo Sapiens
NFPDLNSVL

SEQ ID NO: 656786 - protein, 9 aa, Homo Sapiens
STNAEFMDD

SEQ ID NO: 656787 - protein, 9 aa, Homo Sapiens
IAVLCIPSG

SEQ ID NO: 656788 - protein, 9 aa, Homo Sapiens
NHRLDYFIC

SEQ ID NO: 656789 - protein, 9 aa, Homo Sapiens
AGSYFCVCI

SEQ ID NO: 656790 - protein, 9 aa, Homo Sapiens
AVFKRTSTL

SEQ ID NO: 656791 - protein, 9 aa, Homo Sapiens
EFQQVSLLT

SEQ ID NO: 656792 - protein, 9 aa, Homo Sapiens
QDPLDRCYS

SEQ ID NO: 656793 - protein, 9 aa, Homo Sapiens
CKVVGVDWA

SEQ ID NO: 656794 - protein, 9 aa, Homo Sapiens
VAIVIISGL

SEQ ID NO: 656795 - protein, 9 aa, Homo Sapiens
AIGAFIYHA

SEQ ID NO: 656796 - protein, 9 aa, Homo Sapiens
QVAILPVSD

SEQ ID NO: 656797 - protein, 9 aa, Homo Sapiens
MKMMHIRYC

SEQ ID NO: 656798 - protein, 9 aa, Homo Sapiens
QSKGRLGAS

SEQ ID NO: 656799 - protein, 9 aa, Homo Sapiens
LGLWALAVC

SEQ ID NO: 656800 - protein, 9 aa, Homo Sapiens
QVGLAIRSN

SEQ ID NO: 656801 - protein, 9 aa, Homo Sapiens
INELVEEKN

SEQ ID NO: 656802 - protein, 9 aa, Homo Sapiens
MDISYSLRG

SEQ ID NO: 656803 - protein, 9 aa, Homo Sapiens
DFRTWYQQL

SEQ ID NO: 656804 - protein, 9 aa, Homo Sapiens
LGSYTLVII

SEQ ID NO: 656805 - protein, 9 aa, Homo Sapiens
VPKTKDQRP

SEQ ID NO: 656806 - protein, 9 aa, Homo Sapiens
KQSGDVSRH

SEQ ID NO: 656807 - protein, 9 aa, Homo Sapiens
EAGSMPAAF

SEQ ID NO: 656808 - protein, 9 aa, Homo Sapiens
NRPEDQVLV

SEQ ID NO: 656809 - protein, 9 aa, Homo Sapiens
VDADLYCQK

SEQ ID NO: 656810 - protein, 9 aa, Homo Sapiens
GPQPRSATG

SEQ ID NO: 656811 - protein, 9 aa, Homo Sapiens
RAICHPVFC

SEQ ID NO: 656812 - protein, 9 aa, Homo Sapiens
KLVKIKTKL

SEQ ID NO: 656813 - protein, 9 aa, Homo Sapiens
WQWQLESKA

SEQ ID NO: 656814 - protein, 9 aa, Homo Sapiens
APAYKDPIG

SEQ ID NO: 656815 - protein, 9 aa, Homo Sapiens
RDITWWPIG

SEQ ID NO: 656816 - protein, 9 aa, Homo Sapiens
LDELENRRR

SEQ ID NO: 656817 - protein, 9 aa, Homo Sapiens
RMIRLFSLK

SEQ ID NO: 656818 - protein, 9 aa, Homo Sapiens
GSYTLVIIA

SEQ ID NO: 656819 - protein, 9 aa, Homo Sapiens
NGRRRGEDI

SEQ ID NO: 656820 - protein, 9 aa, Homo Sapiens
LDKYNAKKP

SEQ ID NO: 656821 - protein, 9 aa, Homo Sapiens
TAHIHTTEY

SEQ ID NO: 656822 - protein, 9 aa, Homo Sapiens
VIKENLVHE

SEQ ID NO: 656823 - protein, 9 aa, Homo Sapiens
RRAVVNLGL

SEQ ID NO: 656824 - protein, 9 aa, Homo Sapiens
QTTPSSSSD

SEQ ID NO: 656825 - protein, 9 aa, Homo Sapiens
PSLAKGIAA

SEQ ID NO: 656826 - protein, 9 aa, Homo Sapiens
EEVVLADFS

SEQ ID NO: 656827 - protein, 9 aa, Homo Sapiens
ATHVLSQGA

SEQ ID NO: 656828 - protein, 9 aa, Homo Sapiens
KIQLHLAES

SEQ ID NO: 656829 - protein, 9 aa, Homo Sapiens
LYLLQVHEN

SEQ ID NO: 656830 - protein, 9 aa, Homo Sapiens
TVELREIRR

SEQ ID NO: 656831 - protein, 9 aa, Homo Sapiens
SKIAPVYHQ

SEQ ID NO: 656832 - protein, 9 aa, Homo Sapiens
GHQCCNNLY

SEQ ID NO: 656833 - protein, 9 aa, Homo Sapiens
SDIKVKLEG

SEQ ID NO: 656834 - protein, 9 aa, Homo Sapiens
QQAACRLME

SEQ ID NO: 656835 - protein, 9 aa, Homo Sapiens
TKGGRYESE

SEQ ID NO: 656836 - protein, 9 aa, Homo Sapiens
LKTNPKVSS

SEQ ID NO: 656837 - protein, 9 aa, Homo Sapiens
HLQDLQVIA

SEQ ID NO: 656838 - protein, 9 aa, Homo Sapiens
QPRQSVAYN

SEQ ID NO: 656839 - protein, 9 aa, Homo Sapiens
RSQSKGRLG

SEQ ID NO: 656840 - protein, 9 aa, Homo Sapiens
IKENLVHEE

SEQ ID NO: 656841 - protein, 9 aa, Homo Sapiens
IRSNIADGS

SEQ ID NO: 656842 - protein, 9 aa, Homo Sapiens
QDTRSQLKE

SEQ ID NO: 656843 - protein, 9 aa, Homo Sapiens
NNEMTVTHI

SEQ ID NO: 656844 - protein, 9 aa, Homo Sapiens
IINLESKLR

SEQ ID NO: 656845 - protein, 9 aa, Homo Sapiens
QQQAACRLM

SEQ ID NO: 656846 - protein, 9 aa, Homo Sapiens
EIFLRYGQH

SEQ ID NO: 656847 - protein, 9 aa, Homo Sapiens
VRALRDFNM

SEQ ID NO: 656848 - protein, 9 aa, Homo Sapiens
SSPCQTPEE

SEQ ID NO: 656849 - protein, 9 aa, Homo Sapiens
RQSVAYNRE

SEQ ID NO: 656850 - protein, 9 aa, Homo Sapiens
GPGKHKKRQ

SEQ ID NO: 656851 - protein, 9 aa, Homo Sapiens
IRLFSLKRY

SEQ ID NO: 656852 - protein, 9 aa, Homo Sapiens
FNQLSPISS

SEQ ID NO: 656853 - protein, 9 aa, Homo Sapiens
FVLDEADVI

SEQ ID NO: 656854 - protein, 9 aa, Homo Sapiens
AEAPRLHPP

SEQ ID NO: 656855 - protein, 9 aa, Homo Sapiens
TLPTGRGCL

SEQ ID NO: 656856 - protein, 9 aa, Homo Sapiens
DTLPPPDPI

SEQ ID NO: 656857 - protein, 9 aa, Homo Sapiens
VLDEADVII

SEQ ID NO: 656858 - protein, 9 aa, Homo Sapiens
QPVKFELFE

SEQ ID NO: 656859 - protein, 9 aa, Homo Sapiens
LFEISKKRN

SEQ ID NO: 656860 - protein, 9 aa, Homo Sapiens
EKIKILEGI

SEQ ID NO: 656861 - protein, 9 aa, Homo Sapiens
QLKTRSARD

SEQ ID NO: 656862 - protein, 9 aa, Homo Sapiens
RYRPGTVEL

SEQ ID NO: 656863 - protein, 9 aa, Homo Sapiens
PCYDKNLEA

SEQ ID NO: 656864 - protein, 9 aa, Homo Sapiens
KLQGGYDCK

SEQ ID NO: 656865 - protein, 9 aa, Homo Sapiens
ANRSAGIYQ

SEQ ID NO: 656866 - protein, 9 aa, Homo Sapiens
GPVSPSRTW

SEQ ID NO: 656867 - protein, 9 aa, Homo Sapiens
LPTFNQLSP

SEQ ID NO: 656868 - protein, 9 aa, Homo Sapiens
RRRGEDIMH

SEQ ID NO: 656869 - protein, 9 aa, Homo Sapiens
PLAMGVVRP

SEQ ID NO: 656870 - protein, 9 aa, Homo Sapiens
ESSNISTED

SEQ ID NO: 656871 - protein, 9 aa, Homo Sapiens
DAAENGQMQ

SEQ ID NO: 656872 - protein, 9 aa, Homo Sapiens
VGLAIRSNI

SEQ ID NO: 656873 - protein, 9 aa, Homo Sapiens
AALHELCPL

SEQ ID NO: 656874 - protein, 9 aa, Homo Sapiens
GGFISSSSS

SEQ ID NO: 656875 - protein, 9 aa, Homo Sapiens
FTDRREDIH

SEQ ID NO: 656876 - protein, 9 aa, Homo Sapiens
GYRGHQCCN

SEQ ID NO: 656877 - protein, 9 aa, Homo Sapiens
YDCKYCPYS

SEQ ID NO: 656878 - protein, 9 aa, Homo Sapiens
SSDIKVKLE

SEQ ID NO: 656879 - protein, 9 aa, Homo Sapiens
LVHEEVTRQ

SEQ ID NO: 656880 - protein, 9 aa, Homo Sapiens
SKADARQSK

SEQ ID NO: 656881 - protein, 9 aa, Homo Sapiens
NAKKPKNAI

SEQ ID NO: 656882 - protein, 9 aa, Homo Sapiens
SGFLHVHQE

SEQ ID NO: 656883 - protein, 9 aa, Homo Sapiens
AYAMLFLGA

SEQ ID NO: 656884 - protein, 9 aa, Homo Sapiens
EGMDISYSL

SEQ ID NO: 656885 - protein, 9 aa, Homo Sapiens
LQVTNSVGA

SEQ ID NO: 656886 - protein, 9 aa, Homo Sapiens
VLSTLTLNL

SEQ ID NO: 656887 - protein, 9 aa, Homo Sapiens
SGDVSRHSG

SEQ ID NO: 656888 - protein, 9 aa, Homo Sapiens
GAALWPRYS

SEQ ID NO: 656889 - protein, 9 aa, Homo Sapiens
LMKMMHIRY

SEQ ID NO: 656890 - protein, 9 aa, Homo Sapiens
FLGACSHSR

SEQ ID NO: 656891 - protein, 9 aa, Homo Sapiens
SVHVSQEPK

SEQ ID NO: 656892 - protein, 9 aa, Homo Sapiens
EEFQQVSLL

SEQ ID NO: 656893 - protein, 9 aa, Homo Sapiens
NRHFQLQDC

SEQ ID NO: 656894 - protein, 9 aa, Homo Sapiens
CVCISSVIQ

SEQ ID NO: 656895 - protein, 9 aa, Homo Sapiens
ASWSGFIVS

SEQ ID NO: 656896 - protein, 9 aa, Homo Sapiens
LEGEFQELL

SEQ ID NO: 656897 - protein, 9 aa, Homo Sapiens
EFAASACPS

SEQ ID NO: 656898 - protein, 9 aa, Homo Sapiens
SCHRFGGRE

SEQ ID NO: 656899 - protein, 9 aa, Homo Sapiens
SGGFLSKSL

SEQ ID NO: 656900 - protein, 9 aa, Homo Sapiens
ETFHFQAFW

SEQ ID NO: 656901 - protein, 9 aa, Homo Sapiens
GKGIGRGMV

SEQ ID NO: 656902 - protein, 9 aa, Homo Sapiens
KIFCKRVKN

SEQ ID NO: 656903 - protein, 9 aa, Homo Sapiens
PRWPVVVSE

SEQ ID NO: 656904 - protein, 9 aa, Homo Sapiens
IIAVLCIPS

SEQ ID NO: 656905 - protein, 9 aa, Homo Sapiens
AENGQMQCC

SEQ ID NO: 656906 - protein, 9 aa, Homo Sapiens
VELREIRRY

SEQ ID NO: 656907 - protein, 9 aa, Homo Sapiens
VTKGQNVLQ

SEQ ID NO: 656908 - protein, 9 aa, Homo Sapiens
KETAPAVQW

SEQ ID NO: 656909 - protein, 9 aa, Homo Sapiens
GSSSHFSPR

SEQ ID NO: 656910 - protein, 9 aa, Homo Sapiens
CQKMNSGNL

SEQ ID NO: 656911 - protein, 9 aa, Homo Sapiens
GYFLAGRDI

SEQ ID NO: 656912 - protein, 9 aa, Homo Sapiens
KDCEGEADE

SEQ ID NO: 656913 - protein, 9 aa, Homo Sapiens
KNLMKMMHI

SEQ ID NO: 656914 - protein, 9 aa, Homo Sapiens
LKTRSARDL

SEQ ID NO: 656915 - protein, 9 aa, Homo Sapiens
KSRAICHPV

SEQ ID NO: 656916 - protein, 9 aa, Homo Sapiens
LGDLLETFH

SEQ ID NO: 656917 - protein, 9 aa, Homo Sapiens
YKDPIGPGP

SEQ ID NO: 656918 - protein, 9 aa, Homo Sapiens
LLDKYNAKK

SEQ ID NO: 656919 - protein, 9 aa, Homo Sapiens
FKASRLQQK

SEQ ID NO: 656920 - protein, 9 aa, Homo Sapiens
PAPSAVAEK

SEQ ID NO: 656921 - protein, 9 aa, Homo Sapiens
YVTKGQNVL

SEQ ID NO: 656922 - protein, 9 aa, Homo Sapiens
TYSDEVTDS

SEQ ID NO: 656923 - protein, 9 aa, Homo Sapiens
VPGFAIWGL

SEQ ID NO: 656924 - protein, 9 aa, Homo Sapiens
CKGERGRVC

SEQ ID NO: 656925 - protein, 9 aa, Homo Sapiens
KRFKEGKGR

SEQ ID NO: 656926 - protein, 9 aa, Homo Sapiens
MLLSDAVLD

SEQ ID NO: 656927 - protein, 9 aa, Homo Sapiens
KIAPVYHQE

SEQ ID NO: 656928 - protein, 9 aa, Homo Sapiens
ENDNAPALQ

SEQ ID NO: 656929 - protein, 9 aa, Homo Sapiens
EEIEIFLRY

SEQ ID NO: 656930 - protein, 9 aa, Homo Sapiens
SRVLCLREL

SEQ ID NO: 656931 - protein, 9 aa, Homo Sapiens
TNAEFMDDD

SEQ ID NO: 656932 - protein, 9 aa, Homo Sapiens
PPNTILYAW

SEQ ID NO: 656933 - protein, 9 aa, Homo Sapiens
EQRRKKRRM

SEQ ID NO: 656934 - protein, 9 aa, Homo Sapiens
LKATEHGLF

SEQ ID NO: 656935 - protein, 9 aa, Homo Sapiens
GEDIMHPLK

SEQ ID NO: 656936 - protein, 9 aa, Homo Sapiens
LVFQIGVIF

SEQ ID NO: 656937 - protein, 9 aa, Homo Sapiens
VRYDDEGGV

SEQ ID NO: 656938 - protein, 9 aa, Homo Sapiens
HELCPLVMP

SEQ ID NO: 656939 - protein, 9 aa, Homo Sapiens
GQKRGICRP

SEQ ID NO: 656940 - protein, 9 aa, Homo Sapiens
SRYGHDFSI

SEQ ID NO: 656941 - protein, 9 aa, Homo Sapiens
DPSEEIEIF

SEQ ID NO: 656942 - protein, 9 aa, Homo Sapiens
TALQSKAAK

SEQ ID NO: 656943 - protein, 9 aa, Homo Sapiens
TFNQLSPIS

SEQ ID NO: 656944 - protein, 9 aa, Homo Sapiens
SRTWSYRCY

SEQ ID NO: 656945 - protein, 9 aa, Homo Sapiens
FHFQAFWQA

SEQ ID NO: 656946 - protein, 9 aa, Homo Sapiens
GSHVRSVCI

SEQ ID NO: 656947 - protein, 9 aa, Homo Sapiens
HLATRTTKK

SEQ ID NO: 656948 - protein, 9 aa, Homo Sapiens
DEKKRFKEG

SEQ ID NO: 656949 - protein, 9 aa, Homo Sapiens
MPCYDKNLE

SEQ ID NO: 656950 - protein, 9 aa, Homo Sapiens
LHGFVAVFY

SEQ ID NO: 656951 - protein, 9 aa, Homo Sapiens
VGRNPAVSG

SEQ ID NO: 656952 - protein, 9 aa, Homo Sapiens
TAKDPEGMD

SEQ ID NO: 656953 - protein, 9 aa, Homo Sapiens
LGASLAREP

SEQ ID NO: 656954 - protein, 9 aa, Homo Sapiens
VFNIVILLS

SEQ ID NO: 656955 - protein, 9 aa, Homo Sapiens
FHVDFPDER

SEQ ID NO: 656956 - protein, 9 aa, Homo Sapiens
SAKLRLSHC

SEQ ID NO: 656957 - protein, 9 aa, Homo Sapiens
DVVRMHFGD

SEQ ID NO: 656958 - protein, 9 aa, Homo Sapiens
VKKKTIPSN

SEQ ID NO: 656959 - protein, 9 aa, Homo Sapiens
GTLELPPAA

SEQ ID NO: 656960 - protein, 9 aa, Homo Sapiens
DNAPALQAP

SEQ ID NO: 656961 - protein, 9 aa, Homo Sapiens
IMHPLKVSL

SEQ ID NO: 656962 - protein, 9 aa, Homo Sapiens
LVIIAVLCI

SEQ ID NO: 656963 - protein, 9 aa, Homo Sapiens
PVVVSEGEG

SEQ ID NO: 656964 - protein, 9 aa, Homo Sapiens
AAGPGDTAF

SEQ ID NO: 656965 - protein, 9 aa, Homo Sapiens
TPCGPQPRS

SEQ ID NO: 656966 - protein, 9 aa, Homo Sapiens
IHTTEYAVG

SEQ ID NO: 656967 - protein, 9 aa, Homo Sapiens
DSPVGSKVA

SEQ ID NO: 656968 - protein, 9 aa, Homo Sapiens
RRGAGTSAR

SEQ ID NO: 656969 - protein, 9 aa, Homo Sapiens
RTQHLQDLQ

SEQ ID NO: 656970 - protein, 9 aa, Homo Sapiens
LAEDGSRLN

SEQ ID NO: 656971 - protein, 9 aa, Homo Sapiens
DACSVHIDG

SEQ ID NO: 656972 - protein, 9 aa, Homo Sapiens
APAVQWVVW

SEQ ID NO: 656973 - protein, 9 aa, Homo Sapiens
RHRYERGPA

SEQ ID NO: 656974 - protein, 9 aa, Homo Sapiens
CAKQKSHRQ

SEQ ID NO: 656975 - protein, 9 aa, Homo Sapiens
LLTVRRHIS

SEQ ID NO: 656976 - protein, 9 aa, Homo Sapiens
PFSAVFKRT

SEQ ID NO: 656977 - protein, 9 aa, Homo Sapiens
FNGQKRGIC

SEQ ID NO: 656978 - protein, 9 aa, Homo Sapiens
RCSRLHICD

SEQ ID NO: 656979 - protein, 9 aa, Homo Sapiens
GILYEFAAS

SEQ ID NO: 656980 - protein, 9 aa, Homo Sapiens
QASLQGELA

SEQ ID NO: 656981 - protein, 9 aa, Homo Sapiens
KHKKRQGAT

SEQ ID NO: 656982 - protein, 9 aa, Homo Sapiens
IILFNINSS

SEQ ID NO: 656983 - protein, 9 aa, Homo Sapiens
GCAKQKSHR

SEQ ID NO: 656984 - protein, 9 aa, Homo Sapiens
AKLKYKSYC

SEQ ID NO: 656985 - protein, 9 aa, Homo Sapiens
GFHDRNLVL

SEQ ID NO: 656986 - protein, 9 aa, Homo Sapiens
LDEADVIID

SEQ ID NO: 656987 - protein, 9 aa, Homo Sapiens
CGNHRLDYF

SEQ ID NO: 656988 - protein, 9 aa, Homo Sapiens
LHLARTEQP

SEQ ID NO: 656989 - protein, 9 aa, Homo Sapiens
LLDELENRR

SEQ ID NO: 656990 - protein, 9 aa, Homo Sapiens
LDYFICEVP

SEQ ID NO: 656991 - protein, 9 aa, Homo Sapiens
TLPPPDPIP

SEQ ID NO: 656992 - protein, 9 aa, Homo Sapiens
FQCVVGFWG

SEQ ID NO: 656993 - protein, 9 aa, Homo Sapiens
PWNVRVNVV

SEQ ID NO: 656994 - protein, 9 aa, Homo Sapiens
RQGATRERV

SEQ ID NO: 656995 - protein, 9 aa, Homo Sapiens
QGATRERVV

SEQ ID NO: 656996 - protein, 9 aa, Homo Sapiens
ACRLMEGCQ

SEQ ID NO: 656997 - protein, 9 aa, Homo Sapiens
YDDEGGVEE

SEQ ID NO: 656998 - protein, 9 aa, Homo Sapiens
GCLLCCFLL

SEQ ID NO: 656999 - protein, 9 aa, Homo Sapiens
MMGLVVKVE

SEQ ID NO: 657000 - protein, 9 aa, Homo Sapiens
LWLLGCRMH

SEQ ID NO: 657001 - protein, 9 aa, Homo Sapiens
GCRMHRNAF

SEQ ID NO: 657002 - protein, 9 aa, Homo Sapiens
AASACPSWC

SEQ ID NO: 657003 - protein, 9 aa, Homo Sapiens
TPMYLFLSH

SEQ ID NO: 657004 - protein, 9 aa, Homo Sapiens
VLKTNPKVS

SEQ ID NO: 657005 - protein, 9 aa, Homo Sapiens
SLAKGIAAW

SEQ ID NO: 657006 - protein, 9 aa, Homo Sapiens
KGIAAWKLQ

SEQ ID NO: 657007 - protein, 9 aa, Homo Sapiens
EGGVEEDTE

SEQ ID NO: 657008 - protein, 9 aa, Homo Sapiens
RRWPRQAGG

SEQ ID NO: 657009 - protein, 9 aa, Homo Sapiens
TPSLAKGIA

SEQ ID NO: 657010 - protein, 9 aa, Homo Sapiens
TFTIGKAIW

SEQ ID NO: 657011 - protein, 9 aa, Homo Sapiens
RKKRRMKKR

SEQ ID NO: 657012 - protein, 9 aa, Homo Sapiens
ISMMGLVVK

SEQ ID NO: 657013 - protein, 9 aa, Homo Sapiens
EGTLIIYDA

SEQ ID NO: 657014 - protein, 9 aa, Homo Sapiens
CCNNLYYTA

SEQ ID NO: 657015 - protein, 9 aa, Homo Sapiens
AVAEKGPPA

SEQ ID NO: 657016 - protein, 9 aa, Homo Sapiens
CSVHIDGDD

SEQ ID NO: 657017 - protein, 9 aa, Homo Sapiens
GPTFTIGKA

SEQ ID NO: 657018 - protein, 9 aa, Homo Sapiens
PSFSWGRWS

SEQ ID NO: 657019 - protein, 9 aa, Homo Sapiens
QAGVQLRNL

SEQ ID NO: 657020 - protein, 9 aa, Homo Sapiens
GSRDALHGF

SEQ ID NO: 657021 - protein, 9 aa, Homo Sapiens
LPSFSWGRW

SEQ ID NO: 657022 - protein, 9 aa, Homo Sapiens
EGEFQELLE

SEQ ID NO: 657023 - protein, 9 aa, Homo Sapiens
PGYKPQIQE

SEQ ID NO: 657024 - protein, 9 aa, Homo Sapiens
KEFYAHPRL

SEQ ID NO: 657025 - protein, 9 aa, Homo Sapiens
AGRDITWWP

SEQ ID NO: 657026 - protein, 9 aa, Homo Sapiens
FLKEFYAHP

SEQ ID NO: 657027 - protein, 9 aa, Homo Sapiens
DSRTPARRG

SEQ ID NO: 657028 - protein, 9 aa, Homo Sapiens
EKQSGDVSR

SEQ ID NO: 657029 - protein, 9 aa, Homo Sapiens
HEEVTRQFY

SEQ ID NO: 657030 - protein, 9 aa, Homo Sapiens
RMHFGDGKL

SEQ ID NO: 657031 - protein, 9 aa, Homo Sapiens
IGAFIYHAP

SEQ ID NO: 657032 - protein, 9 aa, Homo Sapiens
RYERGPAAP

SEQ ID NO: 657033 - protein, 9 aa, Homo Sapiens
NECSVGNGG

SEQ ID NO: 657034 - protein, 9 aa, Homo Sapiens
MLSDVWFLS

SEQ ID NO: 657035 - protein, 9 aa, Homo Sapiens
FQELLETHR

SEQ ID NO: 657036 - protein, 9 aa, Homo Sapiens
NKKEEQKRK

SEQ ID NO: 657037 - protein, 9 aa, Homo Sapiens
SGGVLAKGK

SEQ ID NO: 657038 - protein, 9 aa, Homo Sapiens
GYGGGFISS

SEQ ID NO: 657039 - protein, 9 aa, Homo Sapiens
YTDPHHISR

SEQ ID NO: 657040 - protein, 9 aa, Homo Sapiens
YLFLSHLSL

SEQ ID NO: 657041 - protein, 9 aa, Homo Sapiens
TAIAPGYKP

SEQ ID NO: 657042 - protein, 9 aa, Homo Sapiens
KATEHGLFG

SEQ ID NO: 657043 - protein, 9 aa, Homo Sapiens
TGFLKIFCK

SEQ ID NO: 657044 - protein, 9 aa, Homo Sapiens
LMEGERLQH

SEQ ID NO: 657045 - protein, 9 aa, Homo Sapiens
QLHLAESVD

SEQ ID NO: 657046 - protein, 9 aa, Homo Sapiens
FFLGEKFHK

SEQ ID NO: 657047 - protein, 9 aa, Homo Sapiens
SQASLQGEL

SEQ ID NO: 657048 - protein, 9 aa, Homo Sapiens
RDFRTWYQQ

SEQ ID NO: 657049 - protein, 9 aa, Homo Sapiens
YRGHQCCNN

SEQ ID NO: 657050 - protein, 9 aa, Homo Sapiens
WLLGCRMHR

SEQ ID NO: 657051 - protein, 9 aa, Homo Sapiens
SSELAFSLP

SEQ ID NO: 657052 - protein, 9 aa, Homo Sapiens
QPRCSRLHI

SEQ ID NO: 657053 - protein, 9 aa, Homo Sapiens
CFLLDELEN

SEQ ID NO: 657054 - protein, 9 aa, Homo Sapiens
ERQQKTDLQ

SEQ ID NO: 657055 - protein, 9 aa, Homo Sapiens
DIQSLHTDG

SEQ ID NO: 657056 - protein, 9 aa, Homo Sapiens
IVAVLPHYH

SEQ ID NO: 657057 - protein, 9 aa, Homo Sapiens
SLEQLDQNL

SEQ ID NO: 657058 - protein, 9 aa, Homo Sapiens
KKPKNAIHT

SEQ ID NO: 657059 - protein, 9 aa, Homo Sapiens
QKVRFLEQQ

SEQ ID NO: 657060 - protein, 9 aa, Homo Sapiens
MEGCQVPGG

SEQ ID NO: 657061 - protein, 9 aa, Homo Sapiens
HIDGDDVFN

SEQ ID NO: 657062 - protein, 9 aa, Homo Sapiens
CTPCGPQPR

SEQ ID NO: 657063 - protein, 9 aa, Homo Sapiens
SSSSDIKVK

SEQ ID NO: 657064 - protein, 9 aa, Homo Sapiens
RLGASLARE

SEQ ID NO: 657065 - protein, 9 aa, Homo Sapiens
GYGTHVAYS

SEQ ID NO: 657066 - protein, 9 aa, Homo Sapiens
HRLDYFICE

SEQ ID NO: 657067 - protein, 9 aa, Homo Sapiens
ISAAYAMLF

SEQ ID NO: 657068 - protein, 9 aa, Homo Sapiens
NELVEEKNI

SEQ ID NO: 657069 - protein, 9 aa, Homo Sapiens
FCKQVDAGL

SEQ ID NO: 657070 - protein, 9 aa, Homo Sapiens
RVSKFKASR

SEQ ID NO: 657071 - protein, 9 aa, Homo Sapiens
QDLQVIAAY

SEQ ID NO: 657072 - protein, 9 aa, Homo Sapiens
VDFPDEREE

SEQ ID NO: 657073 - protein, 9 aa, Homo Sapiens
HQEEIAEGA

SEQ ID NO: 657074 - protein, 9 aa, Homo Sapiens
QEEGEQKGS

SEQ ID NO: 657075 - protein, 9 aa, Homo Sapiens
HSGASGSKA

SEQ ID NO: 657076 - protein, 9 aa, Homo Sapiens
FQLQDCKAA

SEQ ID NO: 657077 - protein, 9 aa, Homo Sapiens
ADNLTGFLK

SEQ ID NO: 657078 - protein, 9 aa, Homo Sapiens
TDLQYAAKV

SEQ ID NO: 657079 - protein, 9 aa, Homo Sapiens
NISTEDLVK

SEQ ID NO: 657080 - protein, 9 aa, Homo Sapiens
IWGSCGECN

SEQ ID NO: 657081 - protein, 9 aa, Homo Sapiens
IFLRYGQHP

SEQ ID NO: 657082 - protein, 9 aa, Homo Sapiens
DPLDRCYST

SEQ ID NO: 657083 - protein, 9 aa, Homo Sapiens
VPAMVVAVY

SEQ ID NO: 657084 - protein, 9 aa, Homo Sapiens
IHTRMIRLF

SEQ ID NO: 657085 - protein, 9 aa, Homo Sapiens
TRSQLKEAQ

SEQ ID NO: 657086 - protein, 9 aa, Homo Sapiens
CLAALVQRG

SEQ ID NO: 657087 - protein, 9 aa, Homo Sapiens
FPEAVPGEE

SEQ ID NO: 657088 - protein, 9 aa, Homo Sapiens
PRQSVAYNR

SEQ ID NO: 657089 - protein, 9 aa, Homo Sapiens
SPEAPGKKK

SEQ ID NO: 657090 - protein, 9 aa, Homo Sapiens
ICNQQPRCS

SEQ ID NO: 657091 - protein, 9 aa, Homo Sapiens
QKLVKIKTK

SEQ ID NO: 657092 - protein, 9 aa, Homo Sapiens
RGPAAPRLG

SEQ ID NO: 657093 - protein, 9 aa, Homo Sapiens
GFLHVHQEG

SEQ ID NO: 657094 - protein, 9 aa, Homo Sapiens
FWGIHSTPS

SEQ ID NO: 657095 - protein, 9 aa, Homo Sapiens
LLIILFNIN

SEQ ID NO: 657096 - protein, 9 aa, Homo Sapiens
RSQASLQGE

SEQ ID NO: 657097 - protein, 9 aa, Homo Sapiens
QKPFSAVFK

SEQ ID NO: 657098 - protein, 9 aa, Homo Sapiens
GISCMNITL

SEQ ID NO: 657099 - protein, 9 aa, Homo Sapiens
VGSKVAIVS

SEQ ID NO: 657100 - protein, 9 aa, Homo Sapiens
KTDLQYAAK

SEQ ID NO: 657101 - protein, 9 aa, Homo Sapiens
AGIYQGLAF

SEQ ID NO: 657102 - protein, 9 aa, Homo Sapiens
GERGRVCGG

SEQ ID NO: 657103 - protein, 9 aa, Homo Sapiens
GIYQGLAFG

SEQ ID NO: 657104 - protein, 9 aa, Homo Sapiens
HIHTTEYAV

SEQ ID NO: 657105 - protein, 9 aa, Homo Sapiens
ISCMNITLS

SEQ ID NO: 657106 - protein, 9 aa, Homo Sapiens
IPPRAEFNY

SEQ ID NO: 657107 - protein, 9 aa, Homo Sapiens
AVIVILILG

SEQ ID NO: 657108 - protein, 9 aa, Homo Sapiens
AILPVSDIT

SEQ ID NO: 657109 - protein, 9 aa, Homo Sapiens
SEQPARRAV

SEQ ID NO: 657110 - protein, 9 aa, Homo Sapiens
VSKFKASRL

SEQ ID NO: 657111 - protein, 9 aa, Homo Sapiens
KKLQGGYDC

SEQ ID NO: 657112 - protein, 9 aa, Homo Sapiens
WYQQLFCCR

SEQ ID NO: 657113 - protein, 9 aa, Homo Sapiens
CKRVKNLMK

SEQ ID NO: 657114 - protein, 9 aa, Homo Sapiens
WGIHSTPST

SEQ ID NO: 657115 - protein, 9 aa, Homo Sapiens
HLSTMITQL

SEQ ID NO: 657116 - protein, 9 aa, Homo Sapiens
PNGFKTQCL

SEQ ID NO: 657117 - protein, 9 aa, Homo Sapiens
QLDQNLAAA

SEQ ID NO: 657118 - protein, 9 aa, Homo Sapiens
ARCNFEQDL

SEQ ID NO: 657119 - protein, 9 aa, Homo Sapiens
LGCRMHRNA

SEQ ID NO: 657120 - protein, 9 aa, Homo Sapiens
SRDALHGFV

SEQ ID NO: 657121 - protein, 9 aa, Homo Sapiens
DRNLVLRKA

SEQ ID NO: 657122 - protein, 9 aa, Homo Sapiens
IQKPFSAVF

SEQ ID NO: 657123 - protein, 9 aa, Homo Sapiens
KFKASRLQQ

SEQ ID NO: 657124 - protein, 9 aa, Homo Sapiens
IGKHAKGTL

SEQ ID NO: 657125 - protein, 9 aa, Homo Sapiens
ILRECFLLD

SEQ ID NO: 657126 - protein, 9 aa, Homo Sapiens
RNDGLGELP

SEQ ID NO: 657127 - protein, 9 aa, Homo Sapiens
PQRAMRVPA

SEQ ID NO: 657128 - protein, 9 aa, Homo Sapiens
FEYLINTRK

SEQ ID NO: 657129 - protein, 9 aa, Homo Sapiens
NQKLVKIKT

SEQ ID NO: 657130 - protein, 9 aa, Homo Sapiens
GLQDQKAEF

SEQ ID NO: 657131 - protein, 9 aa, Homo Sapiens
ISFPYHEEL

SEQ ID NO: 657132 - protein, 9 aa, Homo Sapiens
NSAQRTPLQ

SEQ ID NO: 657133 - protein, 9 aa, Homo Sapiens
GTLTNNEMT

SEQ ID NO: 657134 - protein, 9 aa, Homo Sapiens
PGEQWLQVD

SEQ ID NO: 657135 - protein, 9 aa, Homo Sapiens
FAASACPSW

SEQ ID NO: 657136 - protein, 9 aa, Homo Sapiens
MAAPILPSF

SEQ ID NO: 657137 - protein, 9 aa, Homo Sapiens
IDELADNLT

SEQ ID NO: 657138 - protein, 9 aa, Homo Sapiens
VFKRTSTLT

SEQ ID NO: 657139 - protein, 9 aa, Homo Sapiens
PPDPIPPRA

SEQ ID NO: 657140 - protein, 9 aa, Homo Sapiens
ASGSKAEAL

SEQ ID NO: 657141 - protein, 9 aa, Homo Sapiens
KEIKEILKN

SEQ ID NO: 657142 - protein, 9 aa, Homo Sapiens
LLQTQERRH

SEQ ID NO: 657143 - protein, 9 aa, Homo Sapiens
LEGICLLSG

SEQ ID NO: 657144 - protein, 9 aa, Homo Sapiens
APILPSFSW

SEQ ID NO: 657145 - protein, 9 aa, Homo Sapiens
SHVRSVCIY

SEQ ID NO: 657146 - protein, 9 aa, Homo Sapiens
KASRLQQKD

SEQ ID NO: 657147 - protein, 9 aa, Homo Sapiens
TSLIMQPLK

SEQ ID NO: 657148 - protein, 9 aa, Homo Sapiens
TAQRFFSWF

SEQ ID NO: 657149 - protein, 9 aa, Homo Sapiens
FIYHAPASK

SEQ ID NO: 657150 - protein, 9 aa, Homo Sapiens
KENEDKQKQ

SEQ ID NO: 657151 - protein, 9 aa, Homo Sapiens
LIMQPLKHP

SEQ ID NO: 657152 - protein, 9 aa, Homo Sapiens
HVEGSGGVL

SEQ ID NO: 657153 - protein, 9 aa, Homo Sapiens
PKADPTSLT

SEQ ID NO: 657154 - protein, 9 aa, Homo Sapiens
LHELCPLVM

SEQ ID NO: 657155 - protein, 9 aa, Homo Sapiens
VIAQVAILP

SEQ ID NO: 657156 - protein, 9 aa, Homo Sapiens
VEEKNILKG

SEQ ID NO: 657157 - protein, 9 aa, Homo Sapiens
TLVIIAVLC

SEQ ID NO: 657158 - protein, 9 aa, Homo Sapiens
LLFSAVEAR

SEQ ID NO: 657159 - protein, 9 aa, Homo Sapiens
YCQKMNSGN

SEQ ID NO: 657160 - protein, 9 aa, Homo Sapiens
SAPAYKDPI

SEQ ID NO: 657161 - protein, 9 aa, Homo Sapiens
ILLIILFNI

SEQ ID NO: 657162 - protein, 9 aa, Homo Sapiens
REPARSVVL

SEQ ID NO: 657163 - protein, 9 aa, Homo Sapiens
EVVLADFSA

SEQ ID NO: 657164 - protein, 9 aa, Homo Sapiens
FLLDELENR

SEQ ID NO: 657165 - protein, 9 aa, Homo Sapiens
EDKQKQNED

SEQ ID NO: 657166 - protein, 9 aa, Homo Sapiens
SPCQTPEEG

SEQ ID NO: 657167 - protein, 9 aa, Homo Sapiens
GSRYGHDFS

SEQ ID NO: 657168 - protein, 9 aa, Homo Sapiens
APDESIRER

SEQ ID NO: 657169 - protein, 9 aa, Homo Sapiens
YNIEDDIQS

SEQ ID NO: 657170 - protein, 9 aa, Homo Sapiens
PLTCEECGK

SEQ ID NO: 657171 - protein, 9 aa, Homo Sapiens
QAPRVGGTG

SEQ ID NO: 657172 - protein, 9 aa, Homo Sapiens
FMGCCTPTV

SEQ ID NO: 657173 - protein, 9 aa, Homo Sapiens
LSDVWFLSV

SEQ ID NO: 657174 - protein, 9 aa, Homo Sapiens
MKMPKFSMS

SEQ ID NO: 657175 - protein, 9 aa, Homo Sapiens
PKFSMSGFK

SEQ ID NO: 657176 - protein, 9 aa, Homo Sapiens
GMVQALHAT

SEQ ID NO: 657177 - protein, 9 aa, Homo Sapiens
SGYGTHVAY

SEQ ID NO: 657178 - protein, 9 aa, Homo Sapiens
SRAIGKHAK

SEQ ID NO: 657179 - protein, 9 aa, Homo Sapiens
TECTGELEG

SEQ ID NO: 657180 - protein, 9 aa, Homo Sapiens
DALHGFVAV

SEQ ID NO: 657181 - protein, 9 aa, Homo Sapiens
REKPLAMGV

SEQ ID NO: 657182 - protein, 9 aa, Homo Sapiens
SSSRTVGCA

SEQ ID NO: 657183 - protein, 9 aa, Homo Sapiens
YNAKKPKNA

SEQ ID NO: 657184 - protein, 9 aa, Homo Sapiens
QAANRSAGI

SEQ ID NO: 657185 - protein, 9 aa, Homo Sapiens
GDACSVHID

SEQ ID NO: 657186 - protein, 9 aa, Homo Sapiens
LDQNLAAAE

SEQ ID NO: 657187 - protein, 9 aa, Homo Sapiens
WALAVCFTP

SEQ ID NO: 657188 - protein, 9 aa, Homo Sapiens
RLHPPFPCL

SEQ ID NO: 657189 - protein, 9 aa, Homo Sapiens
MEGERLQHK

SEQ ID NO: 657190 - protein, 9 aa, Homo Sapiens
QCCQTLVSH

SEQ ID NO: 657191 - protein, 9 aa, Homo Sapiens
RSVVLAEDG

SEQ ID NO: 657192 - protein, 9 aa, Homo Sapiens
EAVGSSSAV

SEQ ID NO: 657193 - protein, 9 aa, Homo Sapiens
KTGTLTNNE

SEQ ID NO: 657194 - protein, 9 aa, Homo Sapiens
MGLVVKVEK

SEQ ID NO: 657195 - protein, 9 aa, Homo Sapiens
ALQSKAAKW

SEQ ID NO: 657196 - protein, 9 aa, Homo Sapiens
CIVAVLPHY

SEQ ID NO: 657197 - protein, 9 aa, Homo Sapiens
MWGFHDRNL

SEQ ID NO: 657198 - protein, 9 aa, Homo Sapiens
QVSLLTQET

SEQ ID NO: 657199 - protein, 9 aa, Homo Sapiens
SAVAEKGPP

SEQ ID NO: 657200 - protein, 9 aa, Homo Sapiens
KRKNKKEEQ

SEQ ID NO: 657201 - protein, 9 aa, Homo Sapiens
GEKFHKYIL

SEQ ID NO: 657202 - protein, 9 aa, Homo Sapiens
QRFFSWFAK

SEQ ID NO: 657203 - protein, 9 aa, Homo Sapiens
VAILPVSDI

SEQ ID NO: 657204 - protein, 9 aa, Homo Sapiens
PLGDCFMLL

SEQ ID NO: 657205 - protein, 9 aa, Homo Sapiens
INLESKLRR

SEQ ID NO: 657206 - protein, 9 aa, Homo Sapiens
IQSLHTDGP

SEQ ID NO: 657207 - protein, 9 aa, Homo Sapiens
TKGLYLLQV

SEQ ID NO: 657208 - protein, 9 aa, Homo Sapiens
QCCNNLYYT

SEQ ID NO: 657209 - protein, 9 aa, Homo Sapiens
QPRSATGEG

SEQ ID NO: 657210 - protein, 9 aa, Homo Sapiens
GDVSRHSGS

SEQ ID NO: 657211 - protein, 9 aa, Homo Sapiens
QLRNLGALQ

SEQ ID NO: 657212 - protein, 9 aa, Homo Sapiens
ALCVPPNTI

SEQ ID NO: 657213 - protein, 9 aa, Homo Sapiens
SVRTQHLQD

SEQ ID NO: 657214 - protein, 9 aa, Homo Sapiens
SAVFKRTST

SEQ ID NO: 657215 - protein, 9 aa, Homo Sapiens
RFLTLVLHL

SEQ ID NO: 657216 - protein, 9 aa, Homo Sapiens
QVRDQNECS

SEQ ID NO: 657217 - protein, 9 aa, Homo Sapiens
ALHELCPLV

SEQ ID NO: 657218 - protein, 9 aa, Homo Sapiens
LPPPDPIPP

SEQ ID NO: 657219 - protein, 9 aa, Homo Sapiens
WNFFYTDPH

SEQ ID NO: 657220 - protein, 9 aa, Homo Sapiens
PGIPVHGSR

SEQ ID NO: 657221 - protein, 9 aa, Homo Sapiens
CRMHRNAFS

SEQ ID NO: 657222 - protein, 9 aa, Homo Sapiens
DDSGFLHVH

SEQ ID NO: 657223 - protein, 9 aa, Homo Sapiens
PNTILYAWQ

SEQ ID NO: 657224 - protein, 9 aa, Homo Sapiens
GKVYALQSL

SEQ ID NO: 657225 - protein, 9 aa, Homo Sapiens
ISSSSSFGS

SEQ ID NO: 657226 - protein, 9 aa, Homo Sapiens
IVIISGLGY

SEQ ID NO: 657227 - protein, 9 aa, Homo Sapiens
ELADNLTGF

SEQ ID NO: 657228 - protein, 9 aa, Homo Sapiens
QDCKAATNS

SEQ ID NO: 657229 - protein, 9 aa, Homo Sapiens
SLQGELAQL

SEQ ID NO: 657230 - protein, 9 aa, Homo Sapiens
ASEANFFET

SEQ ID NO: 657231 - protein, 9 aa, Homo Sapiens
LQDPLDRCY

SEQ ID NO: 657232 - protein, 9 aa, Homo Sapiens
DITWWPIGA

SEQ ID NO: 657233 - protein, 9 aa, Homo Sapiens
HRYERGPAA

SEQ ID NO: 657234 - protein, 9 aa, Homo Sapiens
GDLLETFHF

SEQ ID NO: 657235 - protein, 9 aa, Homo Sapiens
SDKTGTLTN

SEQ ID NO: 657236 - protein, 9 aa, Homo Sapiens
AASVKKKTI

SEQ ID NO: 657237 - protein, 9 aa, Homo Sapiens
DKTGTLTNN

SEQ ID NO: 657238 - protein, 9 aa, Homo Sapiens
NQQPRCSRL

SEQ ID NO: 657239 - protein, 9 aa, Homo Sapiens
LLHLATRTT

SEQ ID NO: 657240 - protein, 9 aa, Homo Sapiens
ERLQHKMVK

SEQ ID NO: 657241 - protein, 9 aa, Homo Sapiens
TTPSSSSDI

SEQ ID NO: 657242 - protein, 9 aa, Homo Sapiens
ILPVSDITI

SEQ ID NO: 657243 - protein, 9 aa, Homo Sapiens
MVQALHATG

SEQ ID NO: 657244 - protein, 9 aa, Homo Sapiens
HRLWASPEA

SEQ ID NO: 657245 - protein, 9 aa, Homo Sapiens
EADVIIDTQ

SEQ ID NO: 657246 - protein, 9 aa, Homo Sapiens
VGCAKQKSH

SEQ ID NO: 657247 - protein, 9 aa, Homo Sapiens
YFCVCISSV

SEQ ID NO: 657248 - protein, 9 aa, Homo Sapiens
LKEFYAHPR

SEQ ID NO: 657249 - protein, 9 aa, Homo Sapiens
GEKDCEGEA

SEQ ID NO: 657250 - protein, 9 aa, Homo Sapiens
ASTSLIMQP

SEQ ID NO: 657251 - protein, 9 aa, Homo Sapiens
LCVPPNTIL

SEQ ID NO: 657252 - protein, 9 aa, Homo Sapiens
YLGDLLETF

SEQ ID NO: 657253 - protein, 9 aa, Homo Sapiens
DCCFGTFNG

SEQ ID NO: 657254 - protein, 9 aa, Homo Sapiens
YALQSLDHE

SEQ ID NO: 657255 - protein, 9 aa, Homo Sapiens
GSKAEALLQ

SEQ ID NO: 657256 - protein, 9 aa, Homo Sapiens
YNQRRYIRS

SEQ ID NO: 657257 - protein, 9 aa, Homo Sapiens
QKTPDSVHV

SEQ ID NO: 657258 - protein, 9 aa, Homo Sapiens
KEAQGKLRC

SEQ ID NO: 657259 - protein, 9 aa, Homo Sapiens
PLPTSMTSP

SEQ ID NO: 657260 - protein, 9 aa, Homo Sapiens
KNKKEEQKR

SEQ ID NO: 657261 - protein, 9 aa, Homo Sapiens
TVPKTKDQR

SEQ ID NO: 657262 - protein, 9 aa, Homo Sapiens
HVAYSSSRE

SEQ ID NO: 657263 - protein, 9 aa, Homo Sapiens
SRTPARRGA

SEQ ID NO: 657264 - protein, 9 aa, Homo Sapiens
KEILKNMAG

SEQ ID NO: 657265 - protein, 9 aa, Homo Sapiens
ANYNELYQN

SEQ ID NO: 657266 - protein, 9 aa, Homo Sapiens
SDVVRMHFG

SEQ ID NO: 657267 - protein, 9 aa, Homo Sapiens
QPGEQWLQV

SEQ ID NO: 657268 - protein, 9 aa, Homo Sapiens
GSCGECNIA

SEQ ID NO: 657269 - protein, 9 aa, Homo Sapiens
TSLHLVFQI

SEQ ID NO: 657270 - protein, 9 aa, Homo Sapiens
VEGSGGVLA

SEQ ID NO: 657271 - protein, 9 aa, Homo Sapiens
RSAGIYQGL

SEQ ID NO: 657272 - protein, 9 aa, Homo Sapiens
CSVGNGGGS

SEQ ID NO: 657273 - protein, 9 aa, Homo Sapiens
EGFDIFENF

SEQ ID NO: 657274 - protein, 9 aa, Homo Sapiens
AQRFFSWFA

SEQ ID NO: 657275 - protein, 9 aa, Homo Sapiens
VLQDPLDRC

SEQ ID NO: 657276 - protein, 9 aa, Homo Sapiens
ECNIAGHES

SEQ ID NO: 657277 - protein, 9 aa, Homo Sapiens
NPKVSSSSA

SEQ ID NO: 657278 - protein, 9 aa, Homo Sapiens
NDRFASYIQ

SEQ ID NO: 657279 - protein, 9 aa, Homo Sapiens
RMKKRIFAA

SEQ ID NO: 657280 - protein, 9 aa, Homo Sapiens
QKMNSGNLV

SEQ ID NO: 657281 - protein, 9 aa, Homo Sapiens
MNPVIEAVG

SEQ ID NO: 657282 - protein, 9 aa, Homo Sapiens
KPFSAVFKR

SEQ ID NO: 657283 - protein, 9 aa, Homo Sapiens
HRHRYERGP

SEQ ID NO: 657284 - protein, 9 aa, Homo Sapiens
QICNQQPRC

SEQ ID NO: 657285 - protein, 9 aa, Homo Sapiens
NGQKRGICR

SEQ ID NO: 657286 - protein, 9 aa, Homo Sapiens
LHLVFQIGV

SEQ ID NO: 657287 - protein, 9 aa, Homo Sapiens
YSDEVTDSI

SEQ ID NO: 657288 - protein, 9 aa, Homo Sapiens
LELPPAAGP

SEQ ID NO: 657289 - protein, 9 aa, Homo Sapiens
HKMVKSLKK

SEQ ID NO: 657290 - protein, 9 aa, Homo Sapiens
FGNTEIKVT

SEQ ID NO: 657291 - protein, 9 aa, Homo Sapiens
TSAKLRLSH

SEQ ID NO: 657292 - protein, 9 aa, Homo Sapiens
LLLQTQERR

SEQ ID NO: 657293 - protein, 9 aa, Homo Sapiens
YGGGFISSS

SEQ ID NO: 657294 - protein, 9 aa, Homo Sapiens
QQPRCSRLH

SEQ ID NO: 657295 - protein, 9 aa, Homo Sapiens
KLRLSHCTV

SEQ ID NO: 657296 - protein, 9 aa, Homo Sapiens
NTRKEESSK

SEQ ID NO: 657297 - protein, 9 aa, Homo Sapiens
ADVIIDTQG

SEQ ID NO: 657298 - protein, 9 aa, Homo Sapiens
LSPISSPEP

SEQ ID NO: 657299 - protein, 9 aa, Homo Sapiens
KKKTIPSNL

SEQ ID NO: 657300 - protein, 9 aa, Homo Sapiens
ALAVCFTPG

SEQ ID NO: 657301 - protein, 9 aa, Homo Sapiens
LGVGRNPAV

SEQ ID NO: 657302 - protein, 9 aa, Homo Sapiens
HVDFPDERE

SEQ ID NO: 657303 - protein, 9 aa, Homo Sapiens
LPTGRGCLL

SEQ ID NO: 657304 - protein, 9 aa, Homo Sapiens
KTPDSVHVS

SEQ ID NO: 657305 - protein, 9 aa, Homo Sapiens
EQKGSNEEK

SEQ ID NO: 657306 - protein, 9 aa, Homo Sapiens
CTGSHVRSV

SEQ ID NO: 657307 - protein, 9 aa, Homo Sapiens
KLLSTYSDE

SEQ ID NO: 657308 - protein, 9 aa, Homo Sapiens
DVPGFAIWG

SEQ ID NO: 657309 - protein, 9 aa, Homo Sapiens
RSQLKEAQG

SEQ ID NO: 657310 - protein, 9 aa, Homo Sapiens
RDQNECSVG

SEQ ID NO: 657311 - protein, 9 aa, Homo Sapiens
PGFAIWGLS

SEQ ID NO: 657312 - protein, 9 aa, Homo Sapiens
LSTLTLNLP

SEQ ID NO: 657313 - protein, 9 aa, Homo Sapiens
LKEIKEILK

SEQ ID NO: 657314 - protein, 9 aa, Homo Sapiens
ILLSGGFLS

SEQ ID NO: 657315 - protein, 9 aa, Homo Sapiens
DIYASFCNS

SEQ ID NO: 657316 - protein, 9 aa, Homo Sapiens
GRDITWWPI

SEQ ID NO: 657317 - protein, 9 aa, Homo Sapiens
EPARSVVLA

SEQ ID NO: 657318 - protein, 9 aa, Homo Sapiens
REACIINLE

SEQ ID NO: 657319 - protein, 9 aa, Homo Sapiens
LTNNEMTVT

SEQ ID NO: 657320 - protein, 9 aa, Homo Sapiens
TSPGSSSHF

SEQ ID NO: 657321 - protein, 9 aa, Homo Sapiens
VAIGAFIYH

SEQ ID NO: 657322 - protein, 9 aa, Homo Sapiens
GSNEEKEDL

SEQ ID NO: 657323 - protein, 9 aa, Homo Sapiens
KRQGATRER

SEQ ID NO: 657324 - protein, 9 aa, Homo Sapiens
QRAMRVPAM

SEQ ID NO: 657325 - protein, 9 aa, Homo Sapiens
ASLQGELAQ

SEQ ID NO: 657326 - protein, 9 aa, Homo Sapiens
MQFGNTEIK

SEQ ID NO: 657327 - protein, 9 aa, Homo Sapiens
VRMHFGDGK

SEQ ID NO: 657328 - protein, 9 aa, Homo Sapiens
AVISGSGEK

SEQ ID NO: 657329 - protein, 9 aa, Homo Sapiens
SIFTDRRED

SEQ ID NO: 657330 - protein, 9 aa, Homo Sapiens
GEQKGSNEE

SEQ ID NO: 657331 - protein, 9 aa, Homo Sapiens
NIATHVLSQ

SEQ ID NO: 657332 - protein, 9 aa, Homo Sapiens
KEKRKNKKE

SEQ ID NO: 657333 - protein, 9 aa, Homo Sapiens
MGVVRPSQP

SEQ ID NO: 657334 - protein, 9 aa, Homo Sapiens
LVKIKTKLF

SEQ ID NO: 657335 - protein, 9 aa, Homo Sapiens
FCKRVKNLM

SEQ ID NO: 657336 - protein, 9 aa, Homo Sapiens
ERHLSTMIT

SEQ ID NO: 657337 - protein, 9 aa, Homo Sapiens
DGREPGGPT

SEQ ID NO: 657338 - protein, 9 aa, Homo Sapiens
HAKGTLQVP

SEQ ID NO: 657339 - protein, 9 aa, Homo Sapiens
TTFEYLINT

SEQ ID NO: 657340 - protein, 9 aa, Homo Sapiens
CYAASVKKK

SEQ ID NO: 657341 - protein, 9 aa, Homo Sapiens
IDLLMDFLK

SEQ ID NO: 657342 - protein, 9 aa, Homo Sapiens
CTRHPLPTS

SEQ ID NO: 657343 - protein, 9 aa, Homo Sapiens
SKFKASRLQ

SEQ ID NO: 657344 - protein, 9 aa, Homo Sapiens
PQPRSATGE

SEQ ID NO: 657345 - protein, 9 aa, Homo Sapiens
EQLDQNLAA

SEQ ID NO: 657346 - protein, 9 aa, Homo Sapiens
CVPPNTILY

SEQ ID NO: 657347 - protein, 9 aa, Homo Sapiens
RWPRQAGGC

SEQ ID NO: 657348 - protein, 9 aa, Homo Sapiens
TEDEKKRFK

SEQ ID NO: 657349 - protein, 9 aa, Homo Sapiens
KADARQSKV

SEQ ID NO: 657350 - protein, 9 aa, Homo Sapiens
EGDACSVHI

SEQ ID NO: 657351 - protein, 9 aa, Homo Sapiens
IPQAQPGEQ

SEQ ID NO: 657352 - protein, 9 aa, Homo Sapiens
QAGGCVWAQ

SEQ ID NO: 657353 - protein, 9 aa, Homo Sapiens
LHHLLTVRR

SEQ ID NO: 657354 - protein, 9 aa, Homo Sapiens
KFSMSGFKG

SEQ ID NO: 657355 - protein, 9 aa, Homo Sapiens
CNNLYYTAG

SEQ ID NO: 657356 - protein, 9 aa, Homo Sapiens
DPAALHELC

SEQ ID NO: 657357 - protein, 9 aa, Homo Sapiens
FSVKKPFGL

SEQ ID NO: 657358 - protein, 9 aa, Homo Sapiens
FYSCHRFGG

SEQ ID NO: 657359 - protein, 9 aa, Homo Sapiens
RGCLLCCFL

SEQ ID NO: 657360 - protein, 9 aa, Homo Sapiens
LYCQKMNSG

SEQ ID NO: 657361 - protein, 9 aa, Homo Sapiens
AMRVPAMVV

SEQ ID NO: 657362 - protein, 9 aa, Homo Sapiens
QNECSVGNG

SEQ ID NO: 657363 - protein, 9 aa, Homo Sapiens
AVNRSQASL

SEQ ID NO: 657364 - protein, 9 aa, Homo Sapiens
VRRHISRSG

SEQ ID NO: 657365 - protein, 9 aa, Homo Sapiens
DCEGEADEA

SEQ ID NO: 657366 - protein, 9 aa, Homo Sapiens
GEADEAGCA

SEQ ID NO: 657367 - protein, 9 aa, Homo Sapiens
GSYFCVCIS

SEQ ID NO: 657368 - protein, 9 aa, Homo Sapiens
PEAPGKKKE

SEQ ID NO: 657369 - protein, 9 aa, Homo Sapiens
LLDSRTPAR

SEQ ID NO: 657370 - protein, 9 aa, Homo Sapiens
VTCLKSRAI

SEQ ID NO: 657371 - protein, 9 aa, Homo Sapiens
KGGRYESES

SEQ ID NO: 657372 - protein, 9 aa, Homo Sapiens
IQPVKFELF

SEQ ID NO: 657373 - protein, 9 aa, Homo Sapiens
RLAVISGSG

SEQ ID NO: 657374 - protein, 9 aa, Homo Sapiens
KTKGGRYES

SEQ ID NO: 657375 - protein, 9 aa, Homo Sapiens
YLLQVHENN

SEQ ID NO: 657376 - protein, 9 aa, Homo Sapiens
CGPQPRSAT

SEQ ID NO: 657377 - protein, 9 aa, Homo Sapiens
IQKVRFLEQ

SEQ ID NO: 657378 - protein, 9 aa, Homo Sapiens
FTESSTRDF

SEQ ID NO: 657379 - protein, 9 aa, Homo Sapiens
PARSVVLAE

SEQ ID NO: 657380 - protein, 9 aa, Homo Sapiens
PLFFMGCCT

SEQ ID NO: 657381 - protein, 9 aa, Homo Sapiens
FFETSQQQG

SEQ ID NO: 657382 - protein, 9 aa, Homo Sapiens
DKYNAKKPK

SEQ ID NO: 657383 - protein, 9 aa, Homo Sapiens
PTGRGCLLC

SEQ ID NO: 657384 - protein, 9 aa, Homo Sapiens
LLSTYSDEV

SEQ ID NO: 657385 - protein, 9 aa, Homo Sapiens
SYIQKVRFL

SEQ ID NO: 657386 - protein, 9 aa, Homo Sapiens
SAQRTPLQM

SEQ ID NO: 657387 - protein, 9 aa, Homo Sapiens
TGTLTNNEM

SEQ ID NO: 657388 - protein, 9 aa, Homo Sapiens
GRRRGEDIM

SEQ ID NO: 657389 - protein, 9 aa, Homo Sapiens
DQNECSVGN

SEQ ID NO: 657390 - protein, 9 aa, Homo Sapiens
VSEGEGQGP

SEQ ID NO: 657391 - protein, 9 aa, Homo Sapiens
KTKDQRPQL

SEQ ID NO: 657392 - protein, 9 aa, Homo Sapiens
SLGAKLKYK

SEQ ID NO: 657393 - protein, 9 aa, Homo Sapiens
RRKKRRMKK

SEQ ID NO: 657394 - protein, 9 aa, Homo Sapiens
VAEKGPPAL

SEQ ID NO: 657395 - protein, 9 aa, Homo Sapiens
ELPPAAGPG

SEQ ID NO: 657396 - protein, 9 aa, Homo Sapiens
EKERHLSTM

SEQ ID NO: 657397 - protein, 9 aa, Homo Sapiens
AAPILPSFS

SEQ ID NO: 657398 - protein, 9 aa, Homo Sapiens
GIGRGMVQA

SEQ ID NO: 657399 - protein, 9 aa, Homo Sapiens
LLFISTNAE

SEQ ID NO: 657400 - protein, 9 aa, Homo Sapiens
HKYILQLFK

SEQ ID NO: 657401 - protein, 9 aa, Homo Sapiens
LAIRSNIAD

SEQ ID NO: 657402 - protein, 9 aa, Homo Sapiens
EGERLQHKM

SEQ ID NO: 657403 - protein, 9 aa, Homo Sapiens
RFFSWFAKL

SEQ ID NO: 657404 - protein, 9 aa, Homo Sapiens
LSDAVLDFA

SEQ ID NO: 657405 - protein, 9 aa, Homo Sapiens
RWPVVVSEG

SEQ ID NO: 657406 - protein, 9 aa, Homo Sapiens
TRSARDLVL

SEQ ID NO: 657407 - protein, 9 aa, Homo Sapiens
FASYIQKVR

SEQ ID NO: 657408 - protein, 9 aa, Homo Sapiens
LFLGACSHS

SEQ ID NO: 657409 - protein, 9 aa, Homo Sapiens
EQPARRAVV

SEQ ID NO: 657410 - protein, 9 aa, Homo Sapiens
PEDQVLVRA

SEQ ID NO: 657411 - protein, 9 aa, Homo Sapiens
ELLETHRIY

SEQ ID NO: 657412 - protein, 9 aa, Homo Sapiens
CMNITLSES

SEQ ID NO: 657413 - protein, 9 aa, Homo Sapiens
QTKQQPRQS

SEQ ID NO: 657414 - protein, 9 aa, Homo Sapiens
RGRGRGRGC

SEQ ID NO: 657415 - protein, 9 aa, Homo Sapiens
VMIAASIFT

SEQ ID NO: 657416 - protein, 9 aa, Homo Sapiens
YHQEEIAEG

SEQ ID NO: 657417 - protein, 9 aa, Homo Sapiens
YQGANYNEL

SEQ ID NO: 657418 - protein, 9 aa, Homo Sapiens
SNIADGSVK

SEQ ID NO: 657419 - protein, 9 aa, Homo Sapiens
ILEGICLLS

SEQ ID NO: 657420 - protein, 9 aa, Homo Sapiens
YASFCNSGL

SEQ ID NO: 657421 - protein, 9 aa, Homo Sapiens
ASEQPARRA

SEQ ID NO: 657422 - protein, 9 aa, Homo Sapiens
LAWGDQAIS

SEQ ID NO: 657423 - protein, 9 aa, Homo Sapiens
HQCCNNLYY

SEQ ID NO: 657424 - protein, 9 aa, Homo Sapiens
TCGGISFPY

SEQ ID NO: 657425 - protein, 9 aa, Homo Sapiens
PMYLFLSHL

SEQ ID NO: 657426 - protein, 9 aa, Homo Sapiens
RTGPPSAPL

SEQ ID NO: 657427 - protein, 9 aa, Homo Sapiens
FTKGLYLLQ

SEQ ID NO: 657428 - protein, 9 aa, Homo Sapiens
QLLKATEHG

SEQ ID NO: 657429 - protein, 9 aa, Homo Sapiens
LLHHLLTVR

SEQ ID NO: 657430 - protein, 9 aa, Homo Sapiens
PFPEAVPGE

SEQ ID NO: 657431 - protein, 9 aa, Homo Sapiens
SSLVLCLLS

SEQ ID NO: 657432 - protein, 9 aa, Homo Sapiens
RELGARFVS

SEQ ID NO: 657433 - protein, 9 aa, Homo Sapiens
PQAQPGEQW

SEQ ID NO: 657434 - protein, 9 aa, Homo Sapiens
FDIFENFPD

SEQ ID NO: 657435 - protein, 9 aa, Homo Sapiens
WRGPAPSAV

SEQ ID NO: 657436 - protein, 9 aa, Homo Sapiens
CLGLLFIST

SEQ ID NO: 657437 - protein, 9 aa, Homo Sapiens
NLNFCKQVD

SEQ ID NO: 657438 - protein, 9 aa, Homo Sapiens
HVHQEGGEV

SEQ ID NO: 657439 - protein, 9 aa, Homo Sapiens
APGYKPQIQ

SEQ ID NO: 657440 - protein, 9 aa, Homo Sapiens
RREACIINL

SEQ ID NO: 657441 - protein, 9 aa, Homo Sapiens
VQWVVWNSS

SEQ ID NO: 657442 - protein, 9 aa, Homo Sapiens
SSTRDFQMQ

SEQ ID NO: 657443 - protein, 9 aa, Homo Sapiens
AGSMPAAFS

SEQ ID NO: 657444 - protein, 9 aa, Homo Sapiens
WKLLSTYSD

SEQ ID NO: 657445 - protein, 9 aa, Homo Sapiens
GKGISCMNI

SEQ ID NO: 657446 - protein, 9 aa, Homo Sapiens
LFLSHLSLV

SEQ ID NO: 657447 - protein, 9 aa, Homo Sapiens
ACLAALVQR

SEQ ID NO: 657448 - protein, 9 aa, Homo Sapiens
ERGPAAPRL

SEQ ID NO: 657449 - protein, 9 aa, Homo Sapiens
RGRVCGGAN

SEQ ID NO: 657450 - protein, 9 aa, Homo Sapiens
LESKADARQ

SEQ ID NO: 657451 - protein, 9 aa, Homo Sapiens
YFFLGEKFH

SEQ ID NO: 657452 - protein, 9 aa, Homo Sapiens
IMQPLKHPT

SEQ ID NO: 657453 - protein, 9 aa, Homo Sapiens
STRDFQMQD

SEQ ID NO: 657454 - protein, 9 aa, Homo Sapiens
NGQMQCCQT

SEQ ID NO: 657455 - protein, 9 aa, Homo Sapiens
NITLSESPF

SEQ ID NO: 657456 - protein, 9 aa, Homo Sapiens
LCYAASVKK

SEQ ID NO: 657457 - protein, 9 aa, Homo Sapiens
FNIVILLSG

SEQ ID NO: 657458 - protein, 9 aa, Homo Sapiens
AIWGLSGGE

SEQ ID NO: 657459 - protein, 9 aa, Homo Sapiens
GLWALAVCF

SEQ ID NO: 657460 - protein, 9 aa, Homo Sapiens
GRGCLLCCF

SEQ ID NO: 657461 - protein, 9 aa, Homo Sapiens
DPHHISRAV

SEQ ID NO: 657462 - protein, 9 aa, Homo Sapiens
DPEGMDISY

SEQ ID NO: 657463 - protein, 9 aa, Homo Sapiens
LDSRTPARR

SEQ ID NO: 657464 - protein, 9 aa, Homo Sapiens
PRMLSGLAW

SEQ ID NO: 657465 - protein, 9 aa, Homo Sapiens
VLSQGAALW

SEQ ID NO: 657466 - protein, 9 aa, Homo Sapiens
GISFPYHEE

SEQ ID NO: 657467 - protein, 9 aa, Homo Sapiens
LTLPTGRGC

SEQ ID NO: 657468 - protein, 9 aa, Homo Sapiens
GLAWGDQAI

SEQ ID NO: 657469 - protein, 9 aa, Homo Sapiens
ESSTRDFQM

SEQ ID NO: 657470 - protein, 9 aa, Homo Sapiens
IFCKRVKNL

SEQ ID NO: 657471 - protein, 9 aa, Homo Sapiens
SVKKKTIPS

SEQ ID NO: 657472 - protein, 9 aa, Homo Sapiens
IWGLSGGES

SEQ ID NO: 657473 - protein, 9 aa, Homo Sapiens
QRRKKRRMK

SEQ ID NO: 657474 - protein, 9 aa, Homo Sapiens
PVASWSGFI

SEQ ID NO: 657475 - protein, 9 aa, Homo Sapiens
ALQSLDHEE

SEQ ID NO: 657476 - protein, 9 aa, Homo Sapiens
TWYQQLFCC

SEQ ID NO: 657477 - protein, 9 aa, Homo Sapiens
TAFPFPEAV

SEQ ID NO: 657478 - protein, 9 aa, Homo Sapiens
ILPSFSWGR

SEQ ID NO: 657479 - protein, 9 aa, Homo Sapiens
DFSALEAHW

SEQ ID NO: 657480 - protein, 9 aa, Homo Sapiens
QSLDHEEVE

SEQ ID NO: 657481 - protein, 9 aa, Homo Sapiens
LHSSKWSSE

SEQ ID NO: 657482 - protein, 9 aa, Homo Sapiens
QGANYNELY

SEQ ID NO: 657483 - protein, 9 aa, Homo Sapiens
CKQVDAGLT

SEQ ID NO: 657484 - protein, 9 aa, Homo Sapiens
MGPSSLVLC

SEQ ID NO: 657485 - protein, 9 aa, Homo Sapiens
RYIRSELTA

SEQ ID NO: 657486 - protein, 9 aa, Homo Sapiens
AVCFTPGES

SEQ ID NO: 657487 - protein, 9 aa, Homo Sapiens
HGSRYGHDF

SEQ ID NO: 657488 - protein, 9 aa, Homo Sapiens
TPDSVHVSQ

SEQ ID NO: 657489 - protein, 9 aa, Homo Sapiens
SLAEKERHL

SEQ ID NO: 657490 - protein, 9 aa, Homo Sapiens
QCVVGFWGI

SEQ ID NO: 657491 - protein, 9 aa, Homo Sapiens
VLPHYHACL

SEQ ID NO: 657492 - protein, 9 aa, Homo Sapiens
QTQERRHRL

SEQ ID NO: 657493 - protein, 9 aa, Homo Sapiens
GRGRGRGCG

SEQ ID NO: 657494 - protein, 9 aa, Homo Sapiens
ETAPAVQWV

SEQ ID NO: 657495 - protein, 9 aa, Homo Sapiens
HLHSGASGS

SEQ ID NO: 657496 - protein, 9 aa, Homo Sapiens
NLLKEIKEI

SEQ ID NO: 657497 - protein, 9 aa, Homo Sapiens
RTPLQMMYL

SEQ ID NO: 657498 - protein, 9 aa, Homo Sapiens
LWALAVCFT

SEQ ID NO: 657499 - protein, 9 aa, Homo Sapiens
REVPVASWS

SEQ ID NO: 657500 - protein, 9 aa, Homo Sapiens
LTGFLKIFC

SEQ ID NO: 657501 - protein, 9 aa, Homo Sapiens
ADLYCQKMN

SEQ ID NO: 657502 - protein, 9 aa, Homo Sapiens
YIQPVKFEL

SEQ ID NO: 657503 - protein, 9 aa, Homo Sapiens
SLANSVVLS

SEQ ID NO: 657504 - protein, 9 aa, Homo Sapiens
FPYHEELWK

SEQ ID NO: 657505 - protein, 9 aa, Homo Sapiens
DSVHVSQEP

SEQ ID NO: 657506 - protein, 9 aa, Homo Sapiens
TRKEESSKH

SEQ ID NO: 657507 - protein, 9 aa, Homo Sapiens
RFKEGKGRY

SEQ ID NO: 657508 - protein, 9 aa, Homo Sapiens
PGGPTFTIG

SEQ ID NO: 657509 - protein, 9 aa, Homo Sapiens
TRDFQMQDT

SEQ ID NO: 657510 - protein, 9 aa, Homo Sapiens
DLYCQKMNS

SEQ ID NO: 657511 - protein, 9 aa, Homo Sapiens
TGSHVRSVC

SEQ ID NO: 657512 - protein, 9 aa, Homo Sapiens
EFQELLETH

SEQ ID NO: 657513 - protein, 9 aa, Homo Sapiens
RSSPCQTPE

SEQ ID NO: 657514 - protein, 9 aa, Homo Sapiens
DIFENFPDL

SEQ ID NO: 657515 - protein, 9 aa, Homo Sapiens
IAQVAILPV

SEQ ID NO: 657516 - protein, 9 aa, Homo Sapiens
WGLSGGESK

SEQ ID NO: 657517 - protein, 9 aa, Homo Sapiens
MQCCQTLVS

SEQ ID NO: 657518 - protein, 9 aa, Homo Sapiens
LLMDFLKEF

SEQ ID NO: 657519 - protein, 9 aa, Homo Sapiens
KKRQGATRE

SEQ ID NO: 657520 - protein, 9 aa, Homo Sapiens
NAPALQAPR

SEQ ID NO: 657521 - protein, 9 aa, Homo Sapiens
RLWASPEAP

SEQ ID NO: 657522 - protein, 9 aa, Homo Sapiens
VPLFFMGCC

SEQ ID NO: 657523 - protein, 9 aa, Homo Sapiens
YPSCTGSHV

SEQ ID NO: 657524 - protein, 9 aa, Homo Sapiens
FSVMNPVIE

SEQ ID NO: 657525 - protein, 9 aa, Homo Sapiens
SQPNGFKTQ

SEQ ID NO: 657526 - protein, 9 aa, Homo Sapiens
SKVAIVSAR

SEQ ID NO: 657527 - protein, 9 aa, Homo Sapiens
FMLLSDAVL

SEQ ID NO: 657528 - protein, 9 aa, Homo Sapiens
KERQQKTDL

SEQ ID NO: 657529 - protein, 9 aa, Homo Sapiens
RQESSNIST

SEQ ID NO: 657530 - protein, 9 aa, Homo Sapiens
PREKPLAMG

SEQ ID NO: 657531 - protein, 9 aa, Homo Sapiens
PAVQWVVWN

SEQ ID NO: 657532 - protein, 9 aa, Homo Sapiens
QDQKAEFQI

SEQ ID NO: 657533 - protein, 9 aa, Homo Sapiens
HTRMIRLFS

SEQ ID NO: 657534 - protein, 9 aa, Homo Sapiens
PDPIPPRAE

SEQ ID NO: 657535 - protein, 9 aa, Homo Sapiens
CIINLESKL

SEQ ID NO: 657536 - protein, 9 aa, Homo Sapiens
IRERVANLI

SEQ ID NO: 657537 - protein, 9 aa, Homo Sapiens
MRTAIAPGY

SEQ ID NO: 657538 - protein, 9 aa, Homo Sapiens
GVLKTNPKV

SEQ ID NO: 657539 - protein, 9 aa, Homo Sapiens
LILGVGRNP

SEQ ID NO: 657540 - protein, 9 aa, Homo Sapiens
MIRLFSLKR

SEQ ID NO: 657541 - protein, 9 aa, Homo Sapiens
DQVLVRALR

SEQ ID NO: 657542 - protein, 9 aa, Homo Sapiens
PCQTPEEGA

SEQ ID NO: 657543 - protein, 9 aa, Homo Sapiens
RALCVPPNT

SEQ ID NO: 657544 - protein, 9 aa, Homo Sapiens
ENGQMQCCQ

SEQ ID NO: 657545 - protein, 9 aa, Homo Sapiens
STFTESSTR

SEQ ID NO: 657546 - protein, 9 aa, Homo Sapiens
EVLQDPLDR

SEQ ID NO: 657547 - protein, 9 aa, Homo Sapiens
DELADNLTG

SEQ ID NO: 657548 - protein, 9 aa, Homo Sapiens
VAEAPRLHP

SEQ ID NO: 657549 - protein, 9 aa, Homo Sapiens
SQSKGRLGA

SEQ ID NO: 657550 - protein, 9 aa, Homo Sapiens
DYNIEDDIQ

SEQ ID NO: 657551 - protein, 9 aa, Homo Sapiens
ELCPLVMPS

SEQ ID NO: 657552 - protein, 9 aa, Homo Sapiens
EDQVLVRAL

SEQ ID NO: 657553 - protein, 9 aa, Homo Sapiens
NTEIKVTAV

SEQ ID NO: 657554 - protein, 9 aa, Homo Sapiens
VAPWNVRVN

SEQ ID NO: 657555 - protein, 9 aa, Homo Sapiens
DPGIPVHGS

SEQ ID NO: 657556 - protein, 9 aa, Homo Sapiens
RGRGCGRGR

SEQ ID NO: 657557 - protein, 9 aa, Homo Sapiens
QWQLESKAD

SEQ ID NO: 657558 - protein, 9 aa, Homo Sapiens
RNEKQSGDV

SEQ ID NO: 657559 - protein, 9 aa, Homo Sapiens
LAKGIAAWK

SEQ ID NO: 657560 - protein, 9 aa, Homo Sapiens
HRYRPGTVE

SEQ ID NO: 657561 - protein, 9 aa, Homo Sapiens
INTRKEESS

SEQ ID NO: 657562 - protein, 9 aa, Homo Sapiens
VTAKDPEGM

SEQ ID NO: 657563 - protein, 9 aa, Homo Sapiens
KLLHLATRT

SEQ ID NO: 657564 - protein, 9 aa, Homo Sapiens
TESSTRDFQ

SEQ ID NO: 657565 - protein, 9 aa, Homo Sapiens
LGELPPPRP

SEQ ID NO: 657566 - protein, 9 aa, Homo Sapiens
RGCGRGRGR

SEQ ID NO: 657567 - protein, 9 aa, Homo Sapiens
LRECFLLDE

SEQ ID NO: 657568 - protein, 9 aa, Homo Sapiens
GTVELREIR

SEQ ID NO: 657569 - protein, 9 aa, Homo Sapiens
FLAGRDITW

SEQ ID NO: 657570 - protein, 9 aa, Homo Sapiens
LCPLVMPSQ

SEQ ID NO: 657571 - protein, 9 aa, Homo Sapiens
VDDEGTLII

SEQ ID NO: 657572 - protein, 9 aa, Homo Sapiens
ERTFHVDFP

SEQ ID NO: 657573 - protein, 9 aa, Homo Sapiens
SGKVYALQS

SEQ ID NO: 657574 - protein, 9 aa, Homo Sapiens
VLCLRELGA

SEQ ID NO: 657575 - protein, 9 aa, Homo Sapiens
LWPRYSEAG

SEQ ID NO: 657576 - protein, 9 aa, Homo Sapiens
EQWLQVDLG

SEQ ID NO: 657577 - protein, 9 aa, Homo Sapiens
EVAEAPRLH

SEQ ID NO: 657578 - protein, 9 aa, Homo Sapiens
SSHFSPRPP

SEQ ID NO: 657579 - protein, 9 aa, Homo Sapiens
EIEIFLRYG

SEQ ID NO: 657580 - protein, 9 aa, Homo Sapiens
SKAEALLQE

SEQ ID NO: 657581 - protein, 9 aa, Homo Sapiens
GCGRGRGRG

SEQ ID NO: 657582 - protein, 9 aa, Homo Sapiens
ERIETAQRF

SEQ ID NO: 657583 - protein, 9 aa, Homo Sapiens
QSKAAKWHC

SEQ ID NO: 657584 - protein, 9 aa, Homo Sapiens
MLSGLAWGD

SEQ ID NO: 657585 - protein, 9 aa, Homo Sapiens
VGPVSPSRT

SEQ ID NO: 657586 - protein, 9 aa, Homo Sapiens
DLLETFHFQ

SEQ ID NO: 657587 - protein, 9 aa, Homo Sapiens
KQVDAGLTF

SEQ ID NO: 657588 - protein, 9 aa, Homo Sapiens
LHVHQEGGE

SEQ ID NO: 657589 - protein, 9 aa, Homo Sapiens
GLDDSGFLH

SEQ ID NO: 657590 - protein, 9 aa, Homo Sapiens
VYHQEEIAE

SEQ ID NO: 657591 - protein, 9 aa, Homo Sapiens
EEKPLTCEE

SEQ ID NO: 657592 - protein, 9 aa, Homo Sapiens
GEFQELLET

SEQ ID NO: 657593 - protein, 9 aa, Homo Sapiens
GVLAKGKRK

SEQ ID NO: 657594 - protein, 9 aa, Homo Sapiens
LRNLGALQL

SEQ ID NO: 657595 - protein, 9 aa, Homo Sapiens
IKEILKNMA

SEQ ID NO: 657596 - protein, 9 aa, Homo Sapiens
EPLPTFNQL

SEQ ID NO: 657597 - protein, 9 aa, Homo Sapiens
FAIWGLSGG

SEQ ID NO: 657598 - protein, 9 aa, Homo Sapiens
EKNILKGQS

SEQ ID NO: 657599 - protein, 9 aa, Homo Sapiens
NRDFRTWYQ

SEQ ID NO: 657600 - protein, 9 aa, Homo Sapiens
GKHAKGTLQ

SEQ ID NO: 657601 - protein, 9 aa, Homo Sapiens
TPSSSSDIK

SEQ ID NO: 657602 - protein, 9 aa, Homo Sapiens
TFHFQAFWQ

SEQ ID NO: 657603 - protein, 9 aa, Homo Sapiens
IERTFHVDF

SEQ ID NO: 657604 - protein, 9 aa, Homo Sapiens
AIAPGYKPQ

SEQ ID NO: 657605 - protein, 9 aa, Homo Sapiens
QFNQKLVKI

SEQ ID NO: 657606 - protein, 9 aa, Homo Sapiens
PSAVAEKGP

SEQ ID NO: 657607 - protein, 9 aa, Homo Sapiens
HAEEKPLTC

SEQ ID NO: 657608 - protein, 9 aa, Homo Sapiens
HVRSVCIYG

SEQ ID NO: 657609 - protein, 9 aa, Homo Sapiens
KVVGVDWAE

SEQ ID NO: 657610 - protein, 9 aa, Homo Sapiens
LCLRELGAR

SEQ ID NO: 657611 - protein, 9 aa, Homo Sapiens
PLRFLTLVL

SEQ ID NO: 657612 - protein, 9 aa, Homo Sapiens
LMDFLKEFY

SEQ ID NO: 657613 - protein, 9 aa, Homo Sapiens
YHVTECTGE

SEQ ID NO: 657614 - protein, 9 aa, Homo Sapiens
ILGLWALAV

SEQ ID NO: 657615 - protein, 9 aa, Homo Sapiens
ESLAEKERH

SEQ ID NO: 657616 - protein, 9 aa, Homo Sapiens
FNINSSLQI

SEQ ID NO: 657617 - protein, 9 aa, Homo Sapiens
LFSAVEARC

SEQ ID NO: 657618 - protein, 9 aa, Homo Sapiens
GTLIIYDAG

SEQ ID NO: 657619 - protein, 9 aa, Homo Sapiens
QRFYSCHRF

SEQ ID NO: 657620 - protein, 9 aa, Homo Sapiens
NPVIEAVGS

SEQ ID NO: 657621 - protein, 9 aa, Homo Sapiens
VPREKPLAM

SEQ ID NO: 657622 - protein, 9 aa, Homo Sapiens
FISTNAEFM

SEQ ID NO: 657623 - protein, 9 aa, Homo Sapiens
LFRQESSNI

SEQ ID NO: 657624 - protein, 9 aa, Homo Sapiens
ACIINLESK

SEQ ID NO: 657625 - protein, 9 aa, Homo Sapiens
KEPEVLQDP

SEQ ID NO: 657626 - protein, 9 aa, Homo Sapiens
ARRGAGTSA

SEQ ID NO: 657627 - protein, 9 aa, Homo Sapiens
ARDLVLYFD

SEQ ID NO: 657628 - protein, 9 aa, Homo Sapiens
TQAGVQLRN

SEQ ID NO: 657629 - protein, 9 aa, Homo Sapiens
AYSSSREIT

SEQ ID NO: 657630 - protein, 9 aa, Homo Sapiens
PEGMDISYS

SEQ ID NO: 657631 - protein, 9 aa, Homo Sapiens
EKTPSLAKG

SEQ ID NO: 657632 - protein, 9 aa, Homo Sapiens
GANYNELYQ

SEQ ID NO: 657633 - protein, 9 aa, Homo Sapiens
ATDTSAKLR

SEQ ID NO: 657634 - protein, 9 aa, Homo Sapiens
VQLRNLGAL

SEQ ID NO: 657635 - protein, 9 aa, Homo Sapiens
HVTECTGEL

SEQ ID NO: 657636 - protein, 9 aa, Homo Sapiens
GELLLQTQE

SEQ ID NO: 657637 - protein, 9 aa, Homo Sapiens
PHYHACLIL

SEQ ID NO: 657638 - protein, 9 aa, Homo Sapiens
AKDPEGMDI

SEQ ID NO: 657639 - protein, 9 aa, Homo Sapiens
VIVILILGV

SEQ ID NO: 657640 - protein, 9 aa, Homo Sapiens
LINTRKEES

SEQ ID NO: 657641 - protein, 9 aa, Homo Sapiens
FISSSSSFG

SEQ ID NO: 657642 - protein, 9 aa, Homo Sapiens
MLPNCKVVG

SEQ ID NO: 657643 - protein, 9 aa, Homo Sapiens
DCKYCPYST

SEQ ID NO: 657644 - protein, 9 aa, Homo Sapiens
SEANFFETS

SEQ ID NO: 657645 - protein, 9 aa, Homo Sapiens
KGLYLLQVH

SEQ ID NO: 657646 - protein, 9 aa, Homo Sapiens
GMSSLEQLD

SEQ ID NO: 657647 - protein, 9 aa, Homo Sapiens
SFCNSGLLD

SEQ ID NO: 657648 - protein, 9 aa, Homo Sapiens
CPLVMPSQA

SEQ ID NO: 657649 - protein, 9 aa, Homo Sapiens
SVVLAEDGS

SEQ ID NO: 657650 - protein, 9 aa, Homo Sapiens
SSLEQLDQN

SEQ ID NO: 657651 - protein, 9 aa, Homo Sapiens
AACLAALVQ

SEQ ID NO: 657652 - protein, 9 aa, Homo Sapiens
SFPYHEELW

SEQ ID NO: 657653 - protein, 9 aa, Homo Sapiens
TKEKIKILE

SEQ ID NO: 657654 - protein, 9 aa, Homo Sapiens
LAMGVVRPS

SEQ ID NO: 657655 - protein, 9 aa, Homo Sapiens
EEAACLAAL

SEQ ID NO: 657656 - protein, 9 aa, Homo Sapiens
LPPAAGPGD

SEQ ID NO: 657657 - protein, 9 aa, Homo Sapiens
QIHTRMIRL

SEQ ID NO: 657658 - protein, 9 aa, Homo Sapiens
WPVVVSEGE

SEQ ID NO: 657659 - protein, 9 aa, Homo Sapiens
CGRGRGRGG

SEQ ID NO: 657660 - protein, 9 aa, Homo Sapiens
DGLGELPPP

SEQ ID NO: 657661 - protein, 9 aa, Homo Sapiens
WNVRVNVVN

SEQ ID NO: 657662 - protein, 9 aa, Homo Sapiens
TLTNNEMTV

SEQ ID NO: 657663 - protein, 9 aa, Homo Sapiens
ERRHRLRGL

SEQ ID NO: 657664 - protein, 9 aa, Homo Sapiens
GARRWPRQA

SEQ ID NO: 657665 - protein, 9 aa, Homo Sapiens
KTPSLAKGI

SEQ ID NO: 657666 - protein, 9 aa, Homo Sapiens
GGRYESESA

SEQ ID NO: 657667 - protein, 9 aa, Homo Sapiens
TSDVVRMHF

SEQ ID NO: 657668 - protein, 9 aa, Homo Sapiens
DTRSQLKEA

SEQ ID NO: 657669 - protein, 9 aa, Homo Sapiens
YAMLFLGAC

SEQ ID NO: 657670 - protein, 9 aa, Homo Sapiens
VPVASWSGF

SEQ ID NO: 657671 - protein, 9 aa, Homo Sapiens
LQYAAKVYR

SEQ ID NO: 657672 - protein, 9 aa, Homo Sapiens
EEGEQKGSN

SEQ ID NO: 657673 - protein, 9 aa, Homo Sapiens
PCGPQPRSA

SEQ ID NO: 657674 - protein, 9 aa, Homo Sapiens
ERGRVCGGA

SEQ ID NO: 657675 - protein, 9 aa, Homo Sapiens
RDLVLYFDD

SEQ ID NO: 657676 - protein, 9 aa, Homo Sapiens
LKYKSYCQG

SEQ ID NO: 657677 - protein, 9 aa, Homo Sapiens
CCFGTFNGQ

SEQ ID NO: 657678 - protein, 9 aa, Homo Sapiens
RDVPGFAIW

SEQ ID NO: 657679 - protein, 9 aa, Homo Sapiens
HGFVAVFYT

SEQ ID NO: 657680 - protein, 9 aa, Homo Sapiens
RAIGKHAKG

SEQ ID NO: 657681 - protein, 9 aa, Homo Sapiens
GPAPSAVAE

SEQ ID NO: 657682 - protein, 9 aa, Homo Sapiens
DPIPPRAEF

SEQ ID NO: 657683 - protein, 9 aa, Homo Sapiens
VKNLMKMMH

SEQ ID NO: 657684 - protein, 9 aa, Homo Sapiens
VMNPVIEAV

SEQ ID NO: 657685 - protein, 9 aa, Homo Sapiens
KEGKGRYLQ

SEQ ID NO: 657686 - protein, 9 aa, Homo Sapiens
TDPHHISRA

SEQ ID NO: 657687 - protein, 9 aa, Homo Sapiens
GFKTQCLLN

SEQ ID NO: 657688 - protein, 9 aa, Homo Sapiens
KEKIKILEG

SEQ ID NO: 657689 - protein, 9 aa, Homo Sapiens
RREEAACLA

SEQ ID NO: 657690 - protein, 9 aa, Homo Sapiens
SAVEARCNF

SEQ ID NO: 657691 - protein, 9 aa, Homo Sapiens
GRLGASLAR

SEQ ID NO: 657692 - protein, 9 aa, Homo Sapiens
GEGDACSVH

SEQ ID NO: 657693 - protein, 9 aa, Homo Sapiens
QFGNTEIKV

SEQ ID NO: 657694 - protein, 9 aa, Homo Sapiens
IVILLSGGF

SEQ ID NO: 657695 - protein, 9 aa, Homo Sapiens
DQNLAAAEE

SEQ ID NO: 657696 - protein, 9 aa, Homo Sapiens
RGHQCCNNL

SEQ ID NO: 657697 - protein, 9 aa, Homo Sapiens
SWSGFIVSE

SEQ ID NO: 657698 - protein, 9 aa, Homo Sapiens
ATEHGLFGV

SEQ ID NO: 657699 - protein, 9 aa, Homo Sapiens
KGISCMNIT

SEQ ID NO: 657700 - protein, 9 aa, Homo Sapiens
SGSGEKRVT

SEQ ID NO: 657701 - protein, 9 aa, Homo Sapiens
LRLSHCTVH

SEQ ID NO: 657702 - protein, 9 aa, Homo Sapiens
PRQAGGCVW

SEQ ID NO: 657703 - protein, 9 aa, Homo Sapiens
GMWGFHDRN

SEQ ID NO: 657704 - protein, 9 aa, Homo Sapiens
RTPARRGAG

SEQ ID NO: 657705 - protein, 9 aa, Homo Sapiens
ECKGERGRV

SEQ ID NO: 657706 - protein, 9 aa, Homo Sapiens
YGTHVAYSS

SEQ ID NO: 657707 - protein, 9 aa, Homo Sapiens
APSAVAEKG

SEQ ID NO: 657708 - protein, 9 aa, Homo Sapiens
TLIIYDAGF

SEQ ID NO: 657709 - protein, 9 aa, Homo Sapiens
LSQGAALWP

SEQ ID NO: 657710 - protein, 9 aa, Homo Sapiens
LQMMYLREK

SEQ ID NO: 657711 - protein, 9 aa, Homo Sapiens
DPVTCLKSR

SEQ ID NO: 657712 - protein, 9 aa, Homo Sapiens
GDCFMLLSD

SEQ ID NO: 657713 - protein, 9 aa, Homo Sapiens
IIYDAGFPD

SEQ ID NO: 657714 - protein, 9 aa, Homo Sapiens
SHRHRYERG

SEQ ID NO: 657715 - protein, 9 aa, Homo Sapiens
VMDIKPKAD

SEQ ID NO: 657716 - protein, 9 aa, Homo Sapiens
MVRREACII

SEQ ID NO: 657717 - protein, 9 aa, Homo Sapiens
SGLAWGDQA

SEQ ID NO: 657718 - protein, 9 aa, Homo Sapiens
DIMHPLKVS

SEQ ID NO: 657719 - protein, 9 aa, Homo Sapiens
DESIRERVA

SEQ ID NO: 657720 - protein, 9 aa, Homo Sapiens
YEFAASACP

SEQ ID NO: 657721 - protein, 9 aa, Homo Sapiens
CVVGFWGIH

SEQ ID NO: 657722 - protein, 9 aa, Homo Sapiens
HHISRAVCN

SEQ ID NO: 657723 - protein, 9 aa, Homo Sapiens
DELDSGLQD

SEQ ID NO: 657724 - protein, 9 aa, Homo Sapiens
VTECTGELE

SEQ ID NO: 657725 - protein, 9 aa, Homo Sapiens
ASVKKKTIP

SEQ ID NO: 657726 - protein, 9 aa, Homo Sapiens
GRGRGCGRG

SEQ ID NO: 657727 - protein, 9 aa, Homo Sapiens
KGSNEEKED

SEQ ID NO: 657728 - protein, 9 aa, Homo Sapiens
LLHSSKWSS

SEQ ID NO: 657729 - protein, 9 aa, Homo Sapiens
PAAFSVKKP

SEQ ID NO: 657730 - protein, 9 aa, Homo Sapiens
FCNSGLLDT

SEQ ID NO: 657731 - protein, 9 aa, Homo Sapiens
AAKWHCSLR

SEQ ID NO: 657732 - protein, 9 aa, Homo Sapiens
YTLVIIAVL

SEQ ID NO: 657733 - protein, 9 aa, Homo Sapiens
NIVILLSGG

SEQ ID NO: 657734 - protein, 9 aa, Homo Sapiens
SMPAAFSVK

SEQ ID NO: 657735 - protein, 9 aa, Homo Sapiens
FSPRPPLGS

SEQ ID NO: 657736 - protein, 9 aa, Homo Sapiens
IWKLLSTYS

SEQ ID NO: 657737 - protein, 9 aa, Homo Sapiens
VVVSEGEGQ

SEQ ID NO: 657738 - protein, 9 aa, Homo Sapiens
RPAERSSPC

SEQ ID NO: 657739 - protein, 9 aa, Homo Sapiens
NVLQVTNSV

SEQ ID NO: 657740 - protein, 9 aa, Homo Sapiens
TKQQPRQSV

SEQ ID NO: 657741 - protein, 9 aa, Homo Sapiens
RYESESAYP

SEQ ID NO: 657742 - protein, 9 aa, Homo Sapiens
GSKIAPVYH

SEQ ID NO: 657743 - protein, 9 aa, Homo Sapiens
QWVVWNSST

SEQ ID NO: 657744 - protein, 9 aa, Homo Sapiens
KQRFYSCHR

SEQ ID NO: 657745 - protein, 9 aa, Homo Sapiens
SKWSSELAF

SEQ ID NO: 657746 - protein, 9 aa, Homo Sapiens
TWSYRCYAY

SEQ ID NO: 657747 - protein, 9 aa, Homo Sapiens
SQLKEAQGK

SEQ ID NO: 657748 - protein, 9 aa, Homo Sapiens
LAEKERHLS

SEQ ID NO: 657749 - protein, 9 aa, Homo Sapiens
LGAKLKYKS

SEQ ID NO: 657750 - protein, 9 aa, Homo Sapiens
CFCTRHPLP

SEQ ID NO: 657751 - protein, 9 aa, Homo Sapiens
QLQDCKAAT

SEQ ID NO: 657752 - protein, 9 aa, Homo Sapiens
LDDSGFLHV

SEQ ID NO: 657753 - protein, 9 aa, Homo Sapiens
CGECNIAGH

SEQ ID NO: 657754 - protein, 9 aa, Homo Sapiens
EDIMHPLKV

SEQ ID NO: 657755 - protein, 9 aa, Homo Sapiens
FSMSGFKGE

SEQ ID NO: 657756 - protein, 9 aa, Homo Sapiens
VHEEVTRQF

SEQ ID NO: 657757 - protein, 9 aa, Homo Sapiens
PVGSKVAIV

SEQ ID NO: 657758 - protein, 9 aa, Homo Sapiens
TKGQNVLQV

SEQ ID NO: 657759 - protein, 9 aa, Homo Sapiens
LIIYDAGFP

SEQ ID NO: 657760 - protein, 9 aa, Homo Sapiens
DTNKTKGGR

SEQ ID NO: 657761 - protein, 9 aa, Homo Sapiens
QLKEAQGKL

SEQ ID NO: 657762 - protein, 9 aa, Homo Sapiens
EDSPVGSKV

SEQ ID NO: 657763 - protein, 9 aa, Homo Sapiens
EGSGGVLAK

SEQ ID NO: 657764 - protein, 9 aa, Homo Sapiens
DFLKEFYAH

SEQ ID NO: 657765 - protein, 9 aa, Homo Sapiens
EARCNFEQD

SEQ ID NO: 657766 - protein, 9 aa, Homo Sapiens
NIQKPFSAV

SEQ ID NO: 657767 - protein, 9 aa, Homo Sapiens
AMGVVRPSQ

SEQ ID NO: 657768 - protein, 9 aa, Homo Sapiens
CLKSRAICH

SEQ ID NO: 657769 - protein, 9 aa, Homo Sapiens
LKEAQGKLR

SEQ ID NO: 657770 - protein, 9 aa, Homo Sapiens
HFSPRPPLG

SEQ ID NO: 657771 - protein, 9 aa, Homo Sapiens
WASPEAPGK

SEQ ID NO: 657772 - protein, 9 aa, Homo Sapiens
KPHSEEFQQ

SEQ ID NO: 657773 - protein, 9 aa, Homo Sapiens
PGSSSHFSP

SEQ ID NO: 657774 - protein, 9 aa, Homo Sapiens
LLETHRIYK

SEQ ID NO: 657775 - protein, 9 aa, Homo Sapiens
SPSTVPKTK

SEQ ID NO: 657776 - protein, 9 aa, Homo Sapiens
AKWHCSLRD

SEQ ID NO: 657777 - protein, 9 aa, Homo Sapiens
AKGIAAWKL

SEQ ID NO: 657778 - protein, 9 aa, Homo Sapiens
EKDCEGEAD

SEQ ID NO: 657779 - protein, 9 aa, Homo Sapiens
KNILKGQSE

SEQ ID NO: 657780 - protein, 9 aa, Homo Sapiens
IEDDIQSLH

SEQ ID NO: 657781 - protein, 9 aa, Homo Sapiens
IETAQRFFS

SEQ ID NO: 657782 - protein, 9 aa, Homo Sapiens
GQKTPDSVH

SEQ ID NO: 657783 - protein, 9 aa, Homo Sapiens
YKPQIQEVR

SEQ ID NO: 657784 - protein, 9 aa, Homo Sapiens
QQFNQKLVK

SEQ ID NO: 657785 - protein, 9 aa, Homo Sapiens
TQCLLNRPF

SEQ ID NO: 657786 - protein, 9 aa, Homo Sapiens
HSSKWSSEL

SEQ ID NO: 657787 - protein, 9 aa, Homo Sapiens
LETHRIYKQ

SEQ ID NO: 657788 - protein, 9 aa, Homo Sapiens
TAPAVQWVV

SEQ ID NO: 657789 - protein, 9 aa, Homo Sapiens
AFPFPEAVP

SEQ ID NO: 657790 - protein, 9 aa, Homo Sapiens
ELGARFVSC

SEQ ID NO: 657791 - protein, 9 aa, Homo Sapiens
SDVWFLSVL

SEQ ID NO: 657792 - protein, 9 aa, Homo Sapiens
SAGIYQGLA

SEQ ID NO: 657793 - protein, 9 aa, Homo Sapiens
FLTLVLHLA

SEQ ID NO: 657794 - protein, 9 aa, Homo Sapiens
PALQAPRVG

SEQ ID NO: 657795 - protein, 9 aa, Homo Sapiens
GFDIFENFP

SEQ ID NO: 657796 - protein, 9 aa, Homo Sapiens
RAMRVPAMV

SEQ ID NO: 657797 - protein, 9 aa, Homo Sapiens
IATHVLSQG

SEQ ID NO: 657798 - protein, 9 aa, Homo Sapiens
GQNVLQVTN

SEQ ID NO: 657799 - protein, 9 aa, Homo Sapiens
GTHVAYSSS

SEQ ID NO: 657800 - protein, 9 aa, Homo Sapiens
LAGRDITWW

SEQ ID NO: 657801 - protein, 9 aa, Homo Sapiens
GLLFISTNA

SEQ ID NO: 657802 - protein, 9 aa, Homo Sapiens
NNLLKEIKE

SEQ ID NO: 657803 - protein, 9 aa, Homo Sapiens
LFFMGCCTP

SEQ ID NO: 657804 - protein, 9 aa, Homo Sapiens
EKRKNKKEE

SEQ ID NO: 657805 - protein, 9 aa, Homo Sapiens
PRLHPPFPC

SEQ ID NO: 657806 - protein, 9 aa, Homo Sapiens
AFSVKKPFG

SEQ ID NO: 657807 - protein, 9 aa, Homo Sapiens
AVLPHYHAC

SEQ ID NO: 657808 - protein, 9 aa, Homo Sapiens
LLKATEHGL

SEQ ID NO: 657809 - protein, 9 aa, Homo Sapiens
FCVCISSVI

SEQ ID NO: 657810 - protein, 9 aa, Homo Sapiens
LSGGFLSKS

SEQ ID NO: 657811 - protein, 9 aa, Homo Sapiens
QELLETHRI

SEQ ID NO: 657812 - protein, 9 aa, Homo Sapiens
MHFGDGKLP

SEQ ID NO: 657813 - protein, 9 aa, Homo Sapiens
VEEDTEAFD

SEQ ID NO: 657814 - protein, 9 aa, Homo Sapiens
MLFLGACSH

SEQ ID NO: 657815 - protein, 9 aa, Homo Sapiens
EAVPGEEAA

SEQ ID NO: 657816 - protein, 9 aa, Homo Sapiens
FGTFNGQKR

SEQ ID NO: 657817 - protein, 9 aa, Homo Sapiens
ILYEFAASA

SEQ ID NO: 657818 - protein, 9 aa, Homo Sapiens
PRFTKGLYL

SEQ ID NO: 657819 - protein, 9 aa, Homo Sapiens
YFICEVPAL

SEQ ID NO: 657820 - protein, 9 aa, Homo Sapiens
FFMGCCTPT

SEQ ID NO: 657821 - protein, 9 aa, Homo Sapiens
QHLQDLQVI

SEQ ID NO: 657822 - protein, 9 aa, Homo Sapiens
RHFQLQDCK

SEQ ID NO: 657823 - protein, 9 aa, Homo Sapiens
LVLHLARTE

SEQ ID NO: 657824 - protein, 9 aa, Homo Sapiens
GTFNGQKRG

SEQ ID NO: 657825 - protein, 9 aa, Homo Sapiens
CQTPEEGAQ

SEQ ID NO: 657826 - protein, 9 aa, Homo Sapiens
VNSAQRTPL

SEQ ID NO: 657827 - protein, 9 aa, Homo Sapiens
RLMEGCQVP

SEQ ID NO: 657828 - protein, 9 aa, Homo Sapiens
KKRRMKKRI

SEQ ID NO: 657829 - protein, 9 aa, Homo Sapiens
GYDCKYCPY

SEQ ID NO: 657830 - protein, 9 aa, Homo Sapiens
THVAYSSSR

SEQ ID NO: 657831 - protein, 9 aa, Homo Sapiens
VLHLARTEQ

SEQ ID NO: 657832 - protein, 9 aa, Homo Sapiens
GSGEKRVTI

SEQ ID NO: 657833 - protein, 9 aa, Homo Sapiens
LVAGSYFCV

SEQ ID NO: 657834 - protein, 9 aa, Homo Sapiens
TKDQRPQLD

SEQ ID NO: 657835 - protein, 9 aa, Homo Sapiens
TVMPCYDKN

SEQ ID NO: 657836 - protein, 9 aa, Homo Sapiens
KTNPKVSSS

SEQ ID NO: 657837 - protein, 9 aa, Homo Sapiens
QLESKADAR

SEQ ID NO: 657838 - protein, 9 aa, Homo Sapiens
SATDTSAKL

SEQ ID NO: 657839 - protein, 9 aa, Homo Sapiens
LRFLTLVLH

SEQ ID NO: 657840 - protein, 9 aa, Homo Sapiens
ECTGELEGA

SEQ ID NO: 657841 - protein, 9 aa, Homo Sapiens
LEQLDQNLA

SEQ ID NO: 657842 - protein, 9 aa, Homo Sapiens
EADEAGCAT

SEQ ID NO: 657843 - protein, 9 aa, Homo Sapiens
CVMDIKPKA

SEQ ID NO: 657844 - protein, 9 aa, Homo Sapiens
GLVVKVEKQ

SEQ ID NO: 657845 - protein, 9 aa, Homo Sapiens
STSLIMQPL

SEQ ID NO: 657846 - protein, 9 aa, Homo Sapiens
SPVGSKVAI

SEQ ID NO: 657847 - protein, 9 aa, Homo Sapiens
VPGEEAAGA

SEQ ID NO: 657848 - protein, 9 aa, Homo Sapiens
AYKDPIGPG

SEQ ID NO: 657849 - protein, 9 aa, Homo Sapiens
TGVLKTNPK

SEQ ID NO: 657850 - protein, 9 aa, Homo Sapiens
ADVIAQVAI

SEQ ID NO: 657851 - protein, 9 aa, Homo Sapiens
VAGSYFCVC

SEQ ID NO: 657852 - protein, 9 aa, Homo Sapiens
LQDCKAATN

SEQ ID NO: 657853 - protein, 9 aa, Homo Sapiens
DTSAKLRLS

SEQ ID NO: 657854 - protein, 9 aa, Homo Sapiens
MVAPWNVRV

SEQ ID NO: 657855 - protein, 9 aa, Homo Sapiens
NEKQSGDVS

SEQ ID NO: 657856 - protein, 9 aa, Homo Sapiens
LIILFNINS

SEQ ID NO: 657857 - protein, 9 aa, Homo Sapiens
EHGLFGVWA

SEQ ID NO: 657858 - protein, 9 aa, Homo Sapiens
RHPLPTSMT

SEQ ID NO: 657859 - protein, 9 aa, Homo Sapiens
KERHLSTMI

SEQ ID NO: 657860 - protein, 9 aa, Homo Sapiens
IYHAPASKT

SEQ ID NO: 657861 - protein, 9 aa, Homo Sapiens
YVAIVIISG

SEQ ID NO: 657862 - protein, 9 aa, Homo Sapiens
QKQNEDKGK

SEQ ID NO: 657863 - protein, 9 aa, Homo Sapiens
WSGYGTHVA

SEQ ID NO: 657864 - protein, 9 aa, Homo Sapiens
QPLKHPTVL

SEQ ID NO: 657865 - protein, 9 aa, Homo Sapiens
GNHRLDYFI

SEQ ID NO: 657866 - protein, 9 aa, Homo Sapiens
YQLLKATEH

SEQ ID NO: 657867 - protein, 9 aa, Homo Sapiens
RQAGGCVWA

SEQ ID NO: 657868 - protein, 9 aa, Homo Sapiens
SQGAALWPR

SEQ ID NO: 657869 - protein, 9 aa, Homo Sapiens
KQNEDKGKE

SEQ ID NO: 657870 - protein, 9 aa, Homo Sapiens
YGYRGHQCC

SEQ ID NO: 657871 - protein, 9 aa, Homo Sapiens
QKGSNEEKE

SEQ ID NO: 657872 - protein, 9 aa, Homo Sapiens
RMHRNAFSI

SEQ ID NO: 657873 - protein, 9 aa, Homo Sapiens
GGISFPYHE

SEQ ID NO: 657874 - protein, 9 aa, Homo Sapiens
RKNKKEEQK

SEQ ID NO: 657875 - protein, 9 aa, Homo Sapiens
YAASVKKKT

SEQ ID NO: 657876 - protein, 9 aa, Homo Sapiens
SKGRLGASL

SEQ ID NO: 657877 - protein, 9 aa, Homo Sapiens
PSCTGSHVR

SEQ ID NO: 657878 - protein, 9 aa, Homo Sapiens
SLDHEEVEL

SEQ ID NO: 657879 - protein, 9 aa, Homo Sapiens
QNEDKGKEN

SEQ ID NO: 657880 - protein, 9 aa, Homo Sapiens
LVEEKNILK

SEQ ID NO: 657881 - protein, 9 aa, Homo Sapiens
LKSRAICHP

SEQ ID NO: 657882 - protein, 9 aa, Homo Sapiens
KGRLGASLA

SEQ ID NO: 657883 - protein, 9 aa, Homo Sapiens
TQEVAEAPR

SEQ ID NO: 657884 - protein, 9 aa, Homo Sapiens
PTFTIGKAI

SEQ ID NO: 657885 - protein, 9 aa, Homo Sapiens
EKPLAMGVV

SEQ ID NO: 657886 - protein, 9 aa, Homo Sapiens
EISMMGLVV

SEQ ID NO: 657887 - protein, 9 aa, Homo Sapiens
PARRAVVNL

SEQ ID NO: 657888 - protein, 9 aa, Homo Sapiens
LPNCKVVGV

SEQ ID NO: 657889 - protein, 9 aa, Homo Sapiens
LLSDAVLDF

SEQ ID NO: 657890 - protein, 9 aa, Homo Sapiens
FHKYILQLF

SEQ ID NO: 657891 - protein, 9 aa, Homo Sapiens
LRREEAACL

SEQ ID NO: 657892 - protein, 9 aa, Homo Sapiens
QNVLQVTNS

SEQ ID NO: 657893 - protein, 9 aa, Homo Sapiens
LETFHFQAF

SEQ ID NO: 657894 - protein, 9 aa, Homo Sapiens
KIKILEGIC

SEQ ID NO: 657895 - protein, 9 aa, Homo Sapiens
LFISTNAEF

SEQ ID NO: 657896 - protein, 9 aa, Homo Sapiens
ELREIRRYQ

SEQ ID NO: 657897 - protein, 9 aa, Homo Sapiens
GELPPPRPR

SEQ ID NO: 657898 - protein, 9 aa, Homo Sapiens
LVRALRDFN

SEQ ID NO: 657899 - protein, 9 aa, Homo Sapiens
INLNFCKQV

SEQ ID NO: 657900 - protein, 9 aa, Homo Sapiens
GFLKIFCKR

SEQ ID NO: 657901 - protein, 9 aa, Homo Sapiens
QSLHTDGPL

SEQ ID NO: 657902 - protein, 9 aa, Homo Sapiens
ESKADARQS

SEQ ID NO: 657903 - protein, 9 aa, Homo Sapiens
NSVVLSTLT

SEQ ID NO: 657904 - protein, 9 aa, Homo Sapiens
LLSGGFLSK

SEQ ID NO: 657905 - protein, 9 aa, Homo Sapiens
PEDSPVGSK

SEQ ID NO: 657906 - protein, 9 aa, Homo Sapiens
GMDISYSLR

SEQ ID NO: 657907 - protein, 9 aa, Homo Sapiens
QAACRLMEG

SEQ ID NO: 657908 - protein, 9 aa, Homo Sapiens
FQIGVIFPQ

SEQ ID NO: 657909 - protein, 9 aa, Homo Sapiens
EDEKKRFKE

SEQ ID NO: 657910 - protein, 9 aa, Homo Sapiens
SRAICHPVF

SEQ ID NO: 657911 - protein, 9 aa, Homo Sapiens
DSGLQDQKA

SEQ ID NO: 657912 - protein, 9 aa, Homo Sapiens
GGYDCKYCP

SEQ ID NO: 657913 - protein, 9 aa, Homo Sapiens
QEHTAHIHT

SEQ ID NO: 657914 - protein, 9 aa, Homo Sapiens
DEISMMGLV

SEQ ID NO: 657915 - protein, 9 aa, Homo Sapiens
PSTVPKTKD

SEQ ID NO: 657916 - protein, 9 aa, Homo Sapiens
LIDELADNL

SEQ ID NO: 657917 - protein, 9 aa, Homo Sapiens
RPGTVELRE

SEQ ID NO: 657918 - protein, 9 aa, Homo Sapiens
SSSDIKVKL

SEQ ID NO: 657919 - protein, 9 aa, Homo Sapiens
RDFQMQDTQ

SEQ ID NO: 657920 - protein, 9 aa, Homo Sapiens
RLQHKMVKS

SEQ ID NO: 657921 - protein, 9 aa, Homo Sapiens
ALQAPRVGG

SEQ ID NO: 657922 - protein, 9 aa, Homo Sapiens
NKTKGGRYE

SEQ ID NO: 657923 - protein, 9 aa, Homo Sapiens
LPTSMTSPS

SEQ ID NO: 657924 - protein, 9 aa, Homo Sapiens
NDGLGELPP

SEQ ID NO: 657925 - protein, 9 aa, Homo Sapiens
VVSEGEGQG

SEQ ID NO: 657926 - protein, 9 aa, Homo Sapiens
NKRCLHGAA

SEQ ID NO: 657927 - protein, 9 aa, Homo Sapiens
STVCFFHVA

SEQ ID NO: 657928 - protein, 9 aa, Homo Sapiens
LLRLGTGAE

SEQ ID NO: 657929 - protein, 9 aa, Homo Sapiens
ACYNKALDK

SEQ ID NO: 657930 - protein, 9 aa, Homo Sapiens
SAIMLGIMK

SEQ ID NO: 657931 - protein, 9 aa, Homo Sapiens
VNYNFEHET

SEQ ID NO: 657932 - protein, 9 aa, Homo Sapiens
NTSQRIVLE

SEQ ID NO: 657933 - protein, 9 aa, Homo Sapiens
FMYYCSGRQ

SEQ ID NO: 657934 - protein, 9 aa, Homo Sapiens
MEHCYDCFD

SEQ ID NO: 657935 - protein, 9 aa, Homo Sapiens
CPVWAPSMG

SEQ ID NO: 657936 - protein, 9 aa, Homo Sapiens
LHRRNTSVG

SEQ ID NO: 657937 - protein, 9 aa, Homo Sapiens
AIMEHCYDC

SEQ ID NO: 657938 - protein, 9 aa, Homo Sapiens
TECACMDLC

SEQ ID NO: 657939 - protein, 9 aa, Homo Sapiens
ERSKAMVSC

SEQ ID NO: 657940 - protein, 9 aa, Homo Sapiens
KPEPGLIGY

SEQ ID NO: 657941 - protein, 9 aa, Homo Sapiens
HNRGNGTFV

SEQ ID NO: 657942 - protein, 9 aa, Homo Sapiens
SWSPDLWKL

SEQ ID NO: 657943 - protein, 9 aa, Homo Sapiens
KCVMSEWGL

SEQ ID NO: 657944 - protein, 9 aa, Homo Sapiens
SRPLHLSDS

SEQ ID NO: 657945 - protein, 9 aa, Homo Sapiens
ALYCEFVNR

SEQ ID NO: 657946 - protein, 9 aa, Homo Sapiens
PSKSETLIR

SEQ ID NO: 657947 - protein, 9 aa, Homo Sapiens
WGKLYSLGN

SEQ ID NO: 657948 - protein, 9 aa, Homo Sapiens
QPPGRRDLE

SEQ ID NO: 657949 - protein, 9 aa, Homo Sapiens
AAVAAARML

SEQ ID NO: 657950 - protein, 9 aa, Homo Sapiens
QRLHTVERP

SEQ ID NO: 657951 - protein, 9 aa, Homo Sapiens
LQHLRGLPA

SEQ ID NO: 657952 - protein, 9 aa, Homo Sapiens
SLEESPLSP

SEQ ID NO: 657953 - protein, 9 aa, Homo Sapiens
NGHPVASVV

SEQ ID NO: 657954 - protein, 9 aa, Homo Sapiens
SRQGQSLWP

SEQ ID NO: 657955 - protein, 9 aa, Homo Sapiens
FECNSRQTG

SEQ ID NO: 657956 - protein, 9 aa, Homo Sapiens
ENKRKRENV

SEQ ID NO: 657957 - protein, 9 aa, Homo Sapiens
EIKSPTVGG

SEQ ID NO: 657958 - protein, 9 aa, Homo Sapiens
ASPYHTIVY

SEQ ID NO: 657959 - protein, 9 aa, Homo Sapiens
LLLTVEVSW

SEQ ID NO: 657960 - protein, 9 aa, Homo Sapiens
PACLPAASV

SEQ ID NO: 657961 - protein, 9 aa, Homo Sapiens
DPVLSSTTH

SEQ ID NO: 657962 - protein, 9 aa, Homo Sapiens
VITAGPGFI

SEQ ID NO: 657963 - protein, 9 aa, Homo Sapiens
ARPAPSHWK

SEQ ID NO: 657964 - protein, 9 aa, Homo Sapiens
IGVRSVGPS

SEQ ID NO: 657965 - protein, 9 aa, Homo Sapiens
VHEGWWRGR

SEQ ID NO: 657966 - protein, 9 aa, Homo Sapiens
GSLLVIVHA

SEQ ID NO: 657967 - protein, 9 aa, Homo Sapiens
VEPWDIAAC

SEQ ID NO: 657968 - protein, 9 aa, Homo Sapiens
ENASFSHAT

SEQ ID NO: 657969 - protein, 9 aa, Homo Sapiens
APYDAWRCP

SEQ ID NO: 657970 - protein, 9 aa, Homo Sapiens
VKQKQYPEK

SEQ ID NO: 657971 - protein, 9 aa, Homo Sapiens
RPLHLSDSL

SEQ ID NO: 657972 - protein, 9 aa, Homo Sapiens
PEIWEKLKR

SEQ ID NO: 657973 - protein, 9 aa, Homo Sapiens
EIAEKHDIG

SEQ ID NO: 657974 - protein, 9 aa, Homo Sapiens
NANGMVEKW

SEQ ID NO: 657975 - protein, 9 aa, Homo Sapiens
SRTQLLEGM

SEQ ID NO: 657976 - protein, 9 aa, Homo Sapiens
FTTFEFYMA

SEQ ID NO: 657977 - protein, 9 aa, Homo Sapiens
APSHWKLLR

SEQ ID NO: 657978 - protein, 9 aa, Homo Sapiens
QLLEGMGFT

SEQ ID NO: 657979 - protein, 9 aa, Homo Sapiens
SSPHEPSKS

SEQ ID NO: 657980 - protein, 9 aa, Homo Sapiens
DGQDRAAFT

SEQ ID NO: 657981 - protein, 9 aa, Homo Sapiens
LKDTEPGLF

SEQ ID NO: 657982 - protein, 9 aa, Homo Sapiens
IYLMNNFNG

SEQ ID NO: 657983 - protein, 9 aa, Homo Sapiens
SSSGHRKHL

SEQ ID NO: 657984 - protein, 9 aa, Homo Sapiens
TNTGDELRY

SEQ ID NO: 657985 - protein, 9 aa, Homo Sapiens
KRMFEKRWV

SEQ ID NO: 657986 - protein, 9 aa, Homo Sapiens
TKKSPLTAH

SEQ ID NO: 657987 - protein, 9 aa, Homo Sapiens
QVLRAIKQR

SEQ ID NO: 657988 - protein, 9 aa, Homo Sapiens
TYKFHPDKT

SEQ ID NO: 657989 - protein, 9 aa, Homo Sapiens
LVAEFRRTD

SEQ ID NO: 657990 - protein, 9 aa, Homo Sapiens
NKALDKDSP

SEQ ID NO: 657991 - protein, 9 aa, Homo Sapiens
TSQRIVLER

SEQ ID NO: 657992 - protein, 9 aa, Homo Sapiens
RCKLCENSL

SEQ ID NO: 657993 - protein, 9 aa, Homo Sapiens
IGKWHLVHH

SEQ ID NO: 657994 - protein, 9 aa, Homo Sapiens
LLFLYDAIG

SEQ ID NO: 657995 - protein, 9 aa, Homo Sapiens
MVHEGWWRG

SEQ ID NO: 657996 - protein, 9 aa, Homo Sapiens
KPQKKVPRS

SEQ ID NO: 657997 - protein, 9 aa, Homo Sapiens
GEIKSPTVG

SEQ ID NO: 657998 - protein, 9 aa, Homo Sapiens
ARKSAGEAK

SEQ ID NO: 657999 - protein, 9 aa, Homo Sapiens
RLILTIITL

SEQ ID NO: 658000 - protein, 9 aa, Homo Sapiens
LQGRAEGQG

SEQ ID NO: 658001 - protein, 9 aa, Homo Sapiens
NKIKSFRKK

SEQ ID NO: 658002 - protein, 9 aa, Homo Sapiens
PLVVVEMYD

SEQ ID NO: 658003 - protein, 9 aa, Homo Sapiens
INGGKVLAE

SEQ ID NO: 658004 - protein, 9 aa, Homo Sapiens
ILLAWLSVP

SEQ ID NO: 658005 - protein, 9 aa, Homo Sapiens
NLLTSYYIS

SEQ ID NO: 658006 - protein, 9 aa, Homo Sapiens
KVGLLEQLL

SEQ ID NO: 658007 - protein, 9 aa, Homo Sapiens
EHNLLSKGF

SEQ ID NO: 658008 - protein, 9 aa, Homo Sapiens
VATQETSTI

SEQ ID NO: 658009 - protein, 9 aa, Homo Sapiens
MARKSAGEA

SEQ ID NO: 658010 - protein, 9 aa, Homo Sapiens
VMDLLESQL

SEQ ID NO: 658011 - protein, 9 aa, Homo Sapiens
AAFTASTNS

SEQ ID NO: 658012 - protein, 9 aa, Homo Sapiens
QEAIPFSPI

SEQ ID NO: 658013 - protein, 9 aa, Homo Sapiens
LVNVCAPMV

SEQ ID NO: 658014 - protein, 9 aa, Homo Sapiens
ITDEEYERY

SEQ ID NO: 658015 - protein, 9 aa, Homo Sapiens
IINQAGATG

SEQ ID NO: 658016 - protein, 9 aa, Homo Sapiens
YNQGFCKDG

SEQ ID NO: 658017 - protein, 9 aa, Homo Sapiens
KAAAEAKAR

SEQ ID NO: 658018 - protein, 9 aa, Homo Sapiens
PTKCSSNTE

SEQ ID NO: 658019 - protein, 9 aa, Homo Sapiens
IYKMLGEEE

SEQ ID NO: 658020 - protein, 9 aa, Homo Sapiens
AWYNKTQFY

SEQ ID NO: 658021 - protein, 9 aa, Homo Sapiens
QGQKQSGSE

SEQ ID NO: 658022 - protein, 9 aa, Homo Sapiens
QLICSLLNS

SEQ ID NO: 658023 - protein, 9 aa, Homo Sapiens
SALPSADHN

SEQ ID NO: 658024 - protein, 9 aa, Homo Sapiens
VSWATFFCV

SEQ ID NO: 658025 - protein, 9 aa, Homo Sapiens
CHMEAQAGS

SEQ ID NO: 658026 - protein, 9 aa, Homo Sapiens
LVHHGSYHP

SEQ ID NO: 658027 - protein, 9 aa, Homo Sapiens
ELCENKPDN

SEQ ID NO: 658028 - protein, 9 aa, Homo Sapiens
DTLPGSLSR

SEQ ID NO: 658029 - protein, 9 aa, Homo Sapiens
LKAAAKAAA

SEQ ID NO: 658030 - protein, 9 aa, Homo Sapiens
WPPKKRQNV

SEQ ID NO: 658031 - protein, 9 aa, Homo Sapiens
RFFSMVRNL

SEQ ID NO: 658032 - protein, 9 aa, Homo Sapiens
VSSIHLEPP

SEQ ID NO: 658033 - protein, 9 aa, Homo Sapiens
KLQGPIGKA

SEQ ID NO: 658034 - protein, 9 aa, Homo Sapiens
EDMGNCKTI

SEQ ID NO: 658035 - protein, 9 aa, Homo Sapiens
RSKSRSQFS

SEQ ID NO: 658036 - protein, 9 aa, Homo Sapiens
QCKDHTYKF

SEQ ID NO: 658037 - protein, 9 aa, Homo Sapiens
PTVVDKVRT

SEQ ID NO: 658038 - protein, 9 aa, Homo Sapiens
GMNRRLILT

SEQ ID NO: 658039 - protein, 9 aa, Homo Sapiens
SQLETQLQE

SEQ ID NO: 658040 - protein, 9 aa, Homo Sapiens
ERGVKNKQE

SEQ ID NO: 658041 - protein, 9 aa, Homo Sapiens
PIGKAAERQ

SEQ ID NO: 658042 - protein, 9 aa, Homo Sapiens
YTKPNQEYE

SEQ ID NO: 658043 - protein, 9 aa, Homo Sapiens
STEGSEITK

SEQ ID NO: 658044 - protein, 9 aa, Homo Sapiens
PVRATIGRY

SEQ ID NO: 658045 - protein, 9 aa, Homo Sapiens
RLPSKTKKQ

SEQ ID NO: 658046 - protein, 9 aa, Homo Sapiens
CENKPDNVV

SEQ ID NO: 658047 - protein, 9 aa, Homo Sapiens
SAPPVILEQ

SEQ ID NO: 658048 - protein, 9 aa, Homo Sapiens
LCHQLLRPD

SEQ ID NO: 658049 - protein, 9 aa, Homo Sapiens
FSRKKPALK

SEQ ID NO: 658050 - protein, 9 aa, Homo Sapiens
QDTTIFFLG

SEQ ID NO: 658051 - protein, 9 aa, Homo Sapiens
STTRLPAGS

SEQ ID NO: 658052 - protein, 9 aa, Homo Sapiens
SPHLERIRE

SEQ ID NO: 658053 - protein, 9 aa, Homo Sapiens
SHATTSTES

SEQ ID NO: 658054 - protein, 9 aa, Homo Sapiens
ALKDLQTAD

SEQ ID NO: 658055 - protein, 9 aa, Homo Sapiens
YLGLANASA

SEQ ID NO: 658056 - protein, 9 aa, Homo Sapiens
VELEHNLLS

SEQ ID NO: 658057 - protein, 9 aa, Homo Sapiens
DSDNESDHD

SEQ ID NO: 658058 - protein, 9 aa, Homo Sapiens
HQDLLRLPC

SEQ ID NO: 658059 - protein, 9 aa, Homo Sapiens
LSGFQFVSG

SEQ ID NO: 658060 - protein, 9 aa, Homo Sapiens
AFFEIIRNE

SEQ ID NO: 658061 - protein, 9 aa, Homo Sapiens
TPFCRNAKL

SEQ ID NO: 658062 - protein, 9 aa, Homo Sapiens
IFFLGCATQ

SEQ ID NO: 658063 - protein, 9 aa, Homo Sapiens
SVTLVLQSS

SEQ ID NO: 658064 - protein, 9 aa, Homo Sapiens
LNSQIQRAT

SEQ ID NO: 658065 - protein, 9 aa, Homo Sapiens
EEPSGDGQL

SEQ ID NO: 658066 - protein, 9 aa, Homo Sapiens
RVRSVSLTC

SEQ ID NO: 658067 - protein, 9 aa, Homo Sapiens
SISALIKLV

SEQ ID NO: 658068 - protein, 9 aa, Homo Sapiens
TFATENNVI

SEQ ID NO: 658069 - protein, 9 aa, Homo Sapiens
KVLQIIVCG

SEQ ID NO: 658070 - protein, 9 aa, Homo Sapiens
EDTNHNQAT

SEQ ID NO: 658071 - protein, 9 aa, Homo Sapiens
TEGSEITKV

SEQ ID NO: 658072 - protein, 9 aa, Homo Sapiens
TCRATSSRG

SEQ ID NO: 658073 - protein, 9 aa, Homo Sapiens
GLGDSRPLH

SEQ ID NO: 658074 - protein, 9 aa, Homo Sapiens
LRMHHALKE

SEQ ID NO: 658075 - protein, 9 aa, Homo Sapiens
GEKSRTVFS

SEQ ID NO: 658076 - protein, 9 aa, Homo Sapiens
NAEKWTMGK

SEQ ID NO: 658077 - protein, 9 aa, Homo Sapiens
AAWQAVEPW

SEQ ID NO: 658078 - protein, 9 aa, Homo Sapiens
WAEGGRWVS

SEQ ID NO: 658079 - protein, 9 aa, Homo Sapiens
KLTVYDVMD

SEQ ID NO: 658080 - protein, 9 aa, Homo Sapiens
PWSSAVPQP

SEQ ID NO: 658081 - protein, 9 aa, Homo Sapiens
GTIFDYYVY

SEQ ID NO: 658082 - protein, 9 aa, Homo Sapiens
RRFFPDDSA

SEQ ID NO: 658083 - protein, 9 aa, Homo Sapiens
SDRVTRLLV

SEQ ID NO: 658084 - protein, 9 aa, Homo Sapiens
DRDYADFKI

SEQ ID NO: 658085 - protein, 9 aa, Homo Sapiens
GEGEPRVFR

SEQ ID NO: 658086 - protein, 9 aa, Homo Sapiens
GLLRLGTGA

SEQ ID NO: 658087 - protein, 9 aa, Homo Sapiens
KPDNVVLAF

SEQ ID NO: 658088 - protein, 9 aa, Homo Sapiens
NKTKVLKII

SEQ ID NO: 658089 - protein, 9 aa, Homo Sapiens
TKCSSNTEF

SEQ ID NO: 658090 - protein, 9 aa, Homo Sapiens
PKFASWGEG

SEQ ID NO: 658091 - protein, 9 aa, Homo Sapiens
RRGREAYEG

SEQ ID NO: 658092 - protein, 9 aa, Homo Sapiens
DIEDHVECL

SEQ ID NO: 658093 - protein, 9 aa, Homo Sapiens
CGDYGRMDH

SEQ ID NO: 658094 - protein, 9 aa, Homo Sapiens
PGDRDSQEH

SEQ ID NO: 658095 - protein, 9 aa, Homo Sapiens
TLSLSIRKQ

SEQ ID NO: 658096 - protein, 9 aa, Homo Sapiens
RRLSRAVQE

SEQ ID NO: 658097 - protein, 9 aa, Homo Sapiens
REEDEENDS

SEQ ID NO: 658098 - protein, 9 aa, Homo Sapiens
MQALKDLDY

SEQ ID NO: 658099 - protein, 9 aa, Homo Sapiens
KSPTVGGGL

SEQ ID NO: 658100 - protein, 9 aa, Homo Sapiens
AALGDVVLS

SEQ ID NO: 658101 - protein, 9 aa, Homo Sapiens
IRGDGRKYP

SEQ ID NO: 658102 - protein, 9 aa, Homo Sapiens
KSPASSTSS

SEQ ID NO: 658103 - protein, 9 aa, Homo Sapiens
VERLGNSVF

SEQ ID NO: 658104 - protein, 9 aa, Homo Sapiens
FQDSLDRCY

SEQ ID NO: 658105 - protein, 9 aa, Homo Sapiens
KRQNVPVIY

SEQ ID NO: 658106 - protein, 9 aa, Homo Sapiens
QAHFMYYCS

SEQ ID NO: 658107 - protein, 9 aa, Homo Sapiens
YPANANGMV

SEQ ID NO: 658108 - protein, 9 aa, Homo Sapiens
LLNSQIQRA

SEQ ID NO: 658109 - protein, 9 aa, Homo Sapiens
QQCSRPSLK

SEQ ID NO: 658110 - protein, 9 aa, Homo Sapiens
SFKNNSKQK

SEQ ID NO: 658111 - protein, 9 aa, Homo Sapiens
EVFQDSLDR

SEQ ID NO: 658112 - protein, 9 aa, Homo Sapiens
LANLLTSYY

SEQ ID NO: 658113 - protein, 9 aa, Homo Sapiens
TSRETGQTE

SEQ ID NO: 658114 - protein, 9 aa, Homo Sapiens
SSGHRKHLR

SEQ ID NO: 658115 - protein, 9 aa, Homo Sapiens
VASTPGDRD

SEQ ID NO: 658116 - protein, 9 aa, Homo Sapiens
SSAVPQPST

SEQ ID NO: 658117 - protein, 9 aa, Homo Sapiens
MLTPMLNPL

SEQ ID NO: 658118 - protein, 9 aa, Homo Sapiens
RGSEERTSR

SEQ ID NO: 658119 - protein, 9 aa, Homo Sapiens
APYFMASGK

SEQ ID NO: 658120 - protein, 9 aa, Homo Sapiens
KEGRIMAFS

SEQ ID NO: 658121 - protein, 9 aa, Homo Sapiens
VSQHALDLQ

SEQ ID NO: 658122 - protein, 9 aa, Homo Sapiens
MASGKSPAS

SEQ ID NO: 658123 - protein, 9 aa, Homo Sapiens
QRRLSRAVQ

SEQ ID NO: 658124 - protein, 9 aa, Homo Sapiens
QVKREPSEG

SEQ ID NO: 658125 - protein, 9 aa, Homo Sapiens
IVHAPNLPY

SEQ ID NO: 658126 - protein, 9 aa, Homo Sapiens
HALDLQNLR

SEQ ID NO: 658127 - protein, 9 aa, Homo Sapiens
RATIGRYVV

SEQ ID NO: 658128 - protein, 9 aa, Homo Sapiens
PEVFQDSLD

SEQ ID NO: 658129 - protein, 9 aa, Homo Sapiens
YKFVFDGND

SEQ ID NO: 658130 - protein, 9 aa, Homo Sapiens
RLLFIGDAI

SEQ ID NO: 658131 - protein, 9 aa, Homo Sapiens
EHLIQNEQC

SEQ ID NO: 658132 - protein, 9 aa, Homo Sapiens
ETGSESMVS

SEQ ID NO: 658133 - protein, 9 aa, Homo Sapiens
KVRTGTYRQ

SEQ ID NO: 658134 - protein, 9 aa, Homo Sapiens
QQCFSNNGM

SEQ ID NO: 658135 - protein, 9 aa, Homo Sapiens
LGSCFTYSS

SEQ ID NO: 658136 - protein, 9 aa, Homo Sapiens
ALTETCLVQ

SEQ ID NO: 658137 - protein, 9 aa, Homo Sapiens
DTEPGLFGV

SEQ ID NO: 658138 - protein, 9 aa, Homo Sapiens
LANLLHKQK

SEQ ID NO: 658139 - protein, 9 aa, Homo Sapiens
LMDVVSEWR

SEQ ID NO: 658140 - protein, 9 aa, Homo Sapiens
KQVRIQVLT

SEQ ID NO: 658141 - protein, 9 aa, Homo Sapiens
CCKILNGEG

SEQ ID NO: 658142 - protein, 9 aa, Homo Sapiens
YGYVSQSFC

SEQ ID NO: 658143 - protein, 9 aa, Homo Sapiens
IKNPEIWEK

SEQ ID NO: 658144 - protein, 9 aa, Homo Sapiens
EEDEENDSD

SEQ ID NO: 658145 - protein, 9 aa, Homo Sapiens
FCESDPKST

SEQ ID NO: 658146 - protein, 9 aa, Homo Sapiens
SELMSQTGY

SEQ ID NO: 658147 - protein, 9 aa, Homo Sapiens
ESVTWIIYK

SEQ ID NO: 658148 - protein, 9 aa, Homo Sapiens
PEALMQALK

SEQ ID NO: 658149 - protein, 9 aa, Homo Sapiens
EIFPEDYLM

SEQ ID NO: 658150 - protein, 9 aa, Homo Sapiens
LEEEIAEKH

SEQ ID NO: 658151 - protein, 9 aa, Homo Sapiens
TRAFITHCG

SEQ ID NO: 658152 - protein, 9 aa, Homo Sapiens
CSRPSLKDG

SEQ ID NO: 658153 - protein, 9 aa, Homo Sapiens
GLLEGDTNK

SEQ ID NO: 658154 - protein, 9 aa, Homo Sapiens
ELPKKYHKM

SEQ ID NO: 658155 - protein, 9 aa, Homo Sapiens
KILNGEGEP

SEQ ID NO: 658156 - protein, 9 aa, Homo Sapiens
TRFSPSPRN

SEQ ID NO: 658157 - protein, 9 aa, Homo Sapiens
VSTVCFFHV

SEQ ID NO: 658158 - protein, 9 aa, Homo Sapiens
AIEEGKVET

SEQ ID NO: 658159 - protein, 9 aa, Homo Sapiens
AVAAARMLP

SEQ ID NO: 658160 - protein, 9 aa, Homo Sapiens
ALGAAFPEI

SEQ ID NO: 658161 - protein, 9 aa, Homo Sapiens
INNIVDIRV

SEQ ID NO: 658162 - protein, 9 aa, Homo Sapiens
SRETGQTEC

SEQ ID NO: 658163 - protein, 9 aa, Homo Sapiens
IEHVDYSEM

SEQ ID NO: 658164 - protein, 9 aa, Homo Sapiens
AVHDRKDGS

SEQ ID NO: 658165 - protein, 9 aa, Homo Sapiens
FHKGRGRDS

SEQ ID NO: 658166 - protein, 9 aa, Homo Sapiens
IHDLTPEDR

SEQ ID NO: 658167 - protein, 9 aa, Homo Sapiens
PQMGSPLPN

SEQ ID NO: 658168 - protein, 9 aa, Homo Sapiens
CCHMEAQAG

SEQ ID NO: 658169 - protein, 9 aa, Homo Sapiens
FPFQGKPKP

SEQ ID NO: 658170 - protein, 9 aa, Homo Sapiens
RFHQIMASV

SEQ ID NO: 658171 - protein, 9 aa, Homo Sapiens
NATEIEVPF

SEQ ID NO: 658172 - protein, 9 aa, Homo Sapiens
TTFEFYMAY

SEQ ID NO: 658173 - protein, 9 aa, Homo Sapiens
SIRKQILKF

SEQ ID NO: 658174 - protein, 9 aa, Homo Sapiens
GNTNTGDEL

SEQ ID NO: 658175 - protein, 9 aa, Homo Sapiens
HLTAVCEFV

SEQ ID NO: 658176 - protein, 9 aa, Homo Sapiens
SYRDTIVLL

SEQ ID NO: 658177 - protein, 9 aa, Homo Sapiens
KQAKLPYAN

SEQ ID NO: 658178 - protein, 9 aa, Homo Sapiens
DMGNCKTIS

SEQ ID NO: 658179 - protein, 9 aa, Homo Sapiens
SKRKNPAPQ

SEQ ID NO: 658180 - protein, 9 aa, Homo Sapiens
GGSLGACYN

SEQ ID NO: 658181 - protein, 9 aa, Homo Sapiens
PIESTVDVG

SEQ ID NO: 658182 - protein, 9 aa, Homo Sapiens
MVDKDQAYR

SEQ ID NO: 658183 - protein, 9 aa, Homo Sapiens
NVFSRVKVF

SEQ ID NO: 658184 - protein, 9 aa, Homo Sapiens
VYFHGCLVD

SEQ ID NO: 658185 - protein, 9 aa, Homo Sapiens
RDSQEHVDS

SEQ ID NO: 658186 - protein, 9 aa, Homo Sapiens
TQNEHLIQN

SEQ ID NO: 658187 - protein, 9 aa, Homo Sapiens
HLIQNEQCP

SEQ ID NO: 658188 - protein, 9 aa, Homo Sapiens
LPKKYHKMV

SEQ ID NO: 658189 - protein, 9 aa, Homo Sapiens
MGKAHGLIT

SEQ ID NO: 658190 - protein, 9 aa, Homo Sapiens
KREKTPSED

SEQ ID NO: 658191 - protein, 9 aa, Homo Sapiens
FKFSPVCCH

SEQ ID NO: 658192 - protein, 9 aa, Homo Sapiens
PPKKRQNVP

SEQ ID NO: 658193 - protein, 9 aa, Homo Sapiens
IMLGIMKEL

SEQ ID NO: 658194 - protein, 9 aa, Homo Sapiens
EHCYDCFDF

SEQ ID NO: 658195 - protein, 9 aa, Homo Sapiens
IPGPTANGA

SEQ ID NO: 658196 - protein, 9 aa, Homo Sapiens
LLEQLLLYK

SEQ ID NO: 658197 - protein, 9 aa, Homo Sapiens
PDILDTMLK

SEQ ID NO: 658198 - protein, 9 aa, Homo Sapiens
GDVVLSEQQ

SEQ ID NO: 658199 - protein, 9 aa, Homo Sapiens
VLRAIKQRL

SEQ ID NO: 658200 - protein, 9 aa, Homo Sapiens
LYCFRKDID

SEQ ID NO: 658201 - protein, 9 aa, Homo Sapiens
LMCPNKCVM

SEQ ID NO: 658202 - protein, 9 aa, Homo Sapiens
DASLNHPRY

SEQ ID NO: 658203 - protein, 9 aa, Homo Sapiens
GAGDAEDTL

SEQ ID NO: 658204 - protein, 9 aa, Homo Sapiens
SKQKCSLKH

SEQ ID NO: 658205 - protein, 9 aa, Homo Sapiens
NIADHTVQE

SEQ ID NO: 658206 - protein, 9 aa, Homo Sapiens
RCLHGAASL

SEQ ID NO: 658207 - protein, 9 aa, Homo Sapiens
VSYFSQTTK

SEQ ID NO: 658208 - protein, 9 aa, Homo Sapiens
VNTPIVIDL

SEQ ID NO: 658209 - protein, 9 aa, Homo Sapiens
DLTELPKCA

SEQ ID NO: 658210 - protein, 9 aa, Homo Sapiens
IPVRVLRSW

SEQ ID NO: 658211 - protein, 9 aa, Homo Sapiens
QTKEGRIMA

SEQ ID NO: 658212 - protein, 9 aa, Homo Sapiens
IKDPDFTRA

SEQ ID NO: 658213 - protein, 9 aa, Homo Sapiens
QEFMDLSIC

SEQ ID NO: 658214 - protein, 9 aa, Homo Sapiens
EDLLLTVEV

SEQ ID NO: 658215 - protein, 9 aa, Homo Sapiens
ALKSSRTLI

SEQ ID NO: 658216 - protein, 9 aa, Homo Sapiens
SANLTLLTQ

SEQ ID NO: 658217 - protein, 9 aa, Homo Sapiens
HYLRSTVSY

SEQ ID NO: 658218 - protein, 9 aa, Homo Sapiens
SEGPPSGPW

SEQ ID NO: 658219 - protein, 9 aa, Homo Sapiens
TSMKEHIKY

SEQ ID NO: 658220 - protein, 9 aa, Homo Sapiens
EFSPIESTV

SEQ ID NO: 658221 - protein, 9 aa, Homo Sapiens
DSTDEGIFI

SEQ ID NO: 658222 - protein, 9 aa, Homo Sapiens
LVVVEMYDS

SEQ ID NO: 658223 - protein, 9 aa, Homo Sapiens
ISRAESGAD

SEQ ID NO: 658224 - protein, 9 aa, Homo Sapiens
VCGDYGRMD

SEQ ID NO: 658225 - protein, 9 aa, Homo Sapiens
TIMIILTYY

SEQ ID NO: 658226 - protein, 9 aa, Homo Sapiens
AWKPQKKVP

SEQ ID NO: 658227 - protein, 9 aa, Homo Sapiens
DIEMVHEGW

SEQ ID NO: 658228 - protein, 9 aa, Homo Sapiens
SWYKDYDSF

SEQ ID NO: 658229 - protein, 9 aa, Homo Sapiens
PKAVSFNKI

SEQ ID NO: 658230 - protein, 9 aa, Homo Sapiens
SEKGLESEQ

SEQ ID NO: 658231 - protein, 9 aa, Homo Sapiens
GANEPMAEV

SEQ ID NO: 658232 - protein, 9 aa, Homo Sapiens
MNRRLILTI

SEQ ID NO: 658233 - protein, 9 aa, Homo Sapiens
LRSTVSYRY

SEQ ID NO: 658234 - protein, 9 aa, Homo Sapiens
WYNKTQFYD

SEQ ID NO: 658235 - protein, 9 aa, Homo Sapiens
LGILLAWLS

SEQ ID NO: 658236 - protein, 9 aa, Homo Sapiens
NPEIWEKLK

SEQ ID NO: 658237 - protein, 9 aa, Homo Sapiens
QCSRPSLKD

SEQ ID NO: 658238 - protein, 9 aa, Homo Sapiens
CINGGKVLA

SEQ ID NO: 658239 - protein, 9 aa, Homo Sapiens
TGEIKSPTV

SEQ ID NO: 658240 - protein, 9 aa, Homo Sapiens
TIKYSVIEE

SEQ ID NO: 658241 - protein, 9 aa, Homo Sapiens
SATIKYSVI

SEQ ID NO: 658242 - protein, 9 aa, Homo Sapiens
IQVISAPPV

SEQ ID NO: 658243 - protein, 9 aa, Homo Sapiens
GGWAEGGRW

SEQ ID NO: 658244 - protein, 9 aa, Homo Sapiens
IRPKGIEDG

SEQ ID NO: 658245 - protein, 9 aa, Homo Sapiens
RKRENVKQK

SEQ ID NO: 658246 - protein, 9 aa, Homo Sapiens
LNALYCEFV

SEQ ID NO: 658247 - protein, 9 aa, Homo Sapiens
EMLRMHHAL

SEQ ID NO: 658248 - protein, 9 aa, Homo Sapiens
SYHSQPERQ

SEQ ID NO: 658249 - protein, 9 aa, Homo Sapiens
AVYPAVTRF

SEQ ID NO: 658250 - protein, 9 aa, Homo Sapiens
NSQKEDTNH

SEQ ID NO: 658251 - protein, 9 aa, Homo Sapiens
ARREHGPRR

SEQ ID NO: 658252 - protein, 9 aa, Homo Sapiens
TRFRRQIPG

SEQ ID NO: 658253 - protein, 9 aa, Homo Sapiens
ERNLQAHFM

SEQ ID NO: 658254 - protein, 9 aa, Homo Sapiens
ALQEACKAY

SEQ ID NO: 658255 - protein, 9 aa, Homo Sapiens
TSKKLAGTN

SEQ ID NO: 658256 - protein, 9 aa, Homo Sapiens
EEIHDLTPE

SEQ ID NO: 658257 - protein, 9 aa, Homo Sapiens
ELRYITARS

SEQ ID NO: 658258 - protein, 9 aa, Homo Sapiens
VKSSKEKPK

SEQ ID NO: 658259 - protein, 9 aa, Homo Sapiens
YANIPSATS

SEQ ID NO: 658260 - protein, 9 aa, Homo Sapiens
IMIILTYYL

SEQ ID NO: 658261 - protein, 9 aa, Homo Sapiens
AVVSFPVIT

SEQ ID NO: 658262 - protein, 9 aa, Homo Sapiens
SCYPGNGTG

SEQ ID NO: 658263 - protein, 9 aa, Homo Sapiens
CTRLHENNW

SEQ ID NO: 658264 - protein, 9 aa, Homo Sapiens
IANCSQTCR

SEQ ID NO: 658265 - protein, 9 aa, Homo Sapiens
FFCVAFPLA

SEQ ID NO: 658266 - protein, 9 aa, Homo Sapiens
VCTGCLALL

SEQ ID NO: 658267 - protein, 9 aa, Homo Sapiens
GKVETEGEA

SEQ ID NO: 658268 - protein, 9 aa, Homo Sapiens
HPQMGSPLP

SEQ ID NO: 658269 - protein, 9 aa, Homo Sapiens
QEVSTTRLP

SEQ ID NO: 658270 - protein, 9 aa, Homo Sapiens
ANLLHKQKS

SEQ ID NO: 658271 - protein, 9 aa, Homo Sapiens
CSSVGALLL

SEQ ID NO: 658272 - protein, 9 aa, Homo Sapiens
FDRDYADFK

SEQ ID NO: 658273 - protein, 9 aa, Homo Sapiens
KKLLEIYKM

SEQ ID NO: 658274 - protein, 9 aa, Homo Sapiens
SQHALDLQN

SEQ ID NO: 658275 - protein, 9 aa, Homo Sapiens
AQLTSTLHR

SEQ ID NO: 658276 - protein, 9 aa, Homo Sapiens
TVERPYECT

SEQ ID NO: 658277 - protein, 9 aa, Homo Sapiens
VRNLMLWME

SEQ ID NO: 658278 - protein, 9 aa, Homo Sapiens
ASSAGKKQL

SEQ ID NO: 658279 - protein, 9 aa, Homo Sapiens
SRLLFIGDA

SEQ ID NO: 658280 - protein, 9 aa, Homo Sapiens
QVISAPPVI

SEQ ID NO: 658281 - protein, 9 aa, Homo Sapiens
NRGNGTFVD

SEQ ID NO: 658282 - protein, 9 aa, Homo Sapiens
IEERDSGSF

SEQ ID NO: 658283 - protein, 9 aa, Homo Sapiens
REGGKGVRS

SEQ ID NO: 658284 - protein, 9 aa, Homo Sapiens
YSSYNEQNG

SEQ ID NO: 658285 - protein, 9 aa, Homo Sapiens
TLITPQVPA

SEQ ID NO: 658286 - protein, 9 aa, Homo Sapiens
SKKLAGTNS

SEQ ID NO: 658287 - protein, 9 aa, Homo Sapiens
PVECRSESR

SEQ ID NO: 658288 - protein, 9 aa, Homo Sapiens
RLEKAYEAW

SEQ ID NO: 658289 - protein, 9 aa, Homo Sapiens
LQVLRAIKQ

SEQ ID NO: 658290 - protein, 9 aa, Homo Sapiens
LPKPRVSSI

SEQ ID NO: 658291 - protein, 9 aa, Homo Sapiens
RRRREGRHE

SEQ ID NO: 658292 - protein, 9 aa, Homo Sapiens
FSRVKVFGS

SEQ ID NO: 658293 - protein, 9 aa, Homo Sapiens
LLRPYIEYS

SEQ ID NO: 658294 - protein, 9 aa, Homo Sapiens
HNLLSKGFR

SEQ ID NO: 658295 - protein, 9 aa, Homo Sapiens
SPPLVVVEM

SEQ ID NO: 658296 - protein, 9 aa, Homo Sapiens
NNALKDIQT

SEQ ID NO: 658297 - protein, 9 aa, Homo Sapiens
EVSTTRLPA

SEQ ID NO: 658298 - protein, 9 aa, Homo Sapiens
TKKQFICKF

SEQ ID NO: 658299 - protein, 9 aa, Homo Sapiens
SALKSSRTL

SEQ ID NO: 658300 - protein, 9 aa, Homo Sapiens
GITDEEYER

SEQ ID NO: 658301 - protein, 9 aa, Homo Sapiens
WPRAGRSRD

SEQ ID NO: 658302 - protein, 9 aa, Homo Sapiens
NLLFLYDAI

SEQ ID NO: 658303 - protein, 9 aa, Homo Sapiens
IPIIMCSSV

SEQ ID NO: 658304 - protein, 9 aa, Homo Sapiens
AQGPIGSSG

SEQ ID NO: 658305 - protein, 9 aa, Homo Sapiens
YCTRLHENN

SEQ ID NO: 658306 - protein, 9 aa, Homo Sapiens
FHFNALMDV

SEQ ID NO: 658307 - protein, 9 aa, Homo Sapiens
GDPVLSSTT

SEQ ID NO: 658308 - protein, 9 aa, Homo Sapiens
SPFSSLEES

SEQ ID NO: 658309 - protein, 9 aa, Homo Sapiens
KECYQSYRD

SEQ ID NO: 658310 - protein, 9 aa, Homo Sapiens
ETEGDAQPE

SEQ ID NO: 658311 - protein, 9 aa, Homo Sapiens
VKVGIYNNK

SEQ ID NO: 658312 - protein, 9 aa, Homo Sapiens
GDCGLYRCV

SEQ ID NO: 658313 - protein, 9 aa, Homo Sapiens
KHSIPGPTA

SEQ ID NO: 658314 - protein, 9 aa, Homo Sapiens
AGNPRDSTD

SEQ ID NO: 658315 - protein, 9 aa, Homo Sapiens
KTRAFITHC

SEQ ID NO: 658316 - protein, 9 aa, Homo Sapiens
IKEKNDIDH

SEQ ID NO: 658317 - protein, 9 aa, Homo Sapiens
PRDSTDEGI

SEQ ID NO: 658318 - protein, 9 aa, Homo Sapiens
GGLAGRFHQ

SEQ ID NO: 658319 - protein, 9 aa, Homo Sapiens
HQLLRPDLN

SEQ ID NO: 658320 - protein, 9 aa, Homo Sapiens
KLCENSLHV

SEQ ID NO: 658321 - protein, 9 aa, Homo Sapiens
ILTYYLLIL

SEQ ID NO: 658322 - protein, 9 aa, Homo Sapiens
ASTEGKHKA

SEQ ID NO: 658323 - protein, 9 aa, Homo Sapiens
VVEMYDSDA

SEQ ID NO: 658324 - protein, 9 aa, Homo Sapiens
FYQRRRFFP

SEQ ID NO: 658325 - protein, 9 aa, Homo Sapiens
LLTSYYISF

SEQ ID NO: 658326 - protein, 9 aa, Homo Sapiens
YLNTSQRIV

SEQ ID NO: 658327 - protein, 9 aa, Homo Sapiens
YRYKVFVDL

SEQ ID NO: 658328 - protein, 9 aa, Homo Sapiens
TVLPGGSAS

SEQ ID NO: 658329 - protein, 9 aa, Homo Sapiens
KSPLTAHRG

SEQ ID NO: 658330 - protein, 9 aa, Homo Sapiens
VDIRVDAWK

SEQ ID NO: 658331 - protein, 9 aa, Homo Sapiens
SGCCPVWAP

SEQ ID NO: 658332 - protein, 9 aa, Homo Sapiens
SSSSGHRKH

SEQ ID NO: 658333 - protein, 9 aa, Homo Sapiens
WEARREHGP

SEQ ID NO: 658334 - protein, 9 aa, Homo Sapiens
SKFFMGKVV

SEQ ID NO: 658335 - protein, 9 aa, Homo Sapiens
YQAFPNTSA

SEQ ID NO: 658336 - protein, 9 aa, Homo Sapiens
NCKVYPSMI

SEQ ID NO: 658337 - protein, 9 aa, Homo Sapiens
NASFSHATT

SEQ ID NO: 658338 - protein, 9 aa, Homo Sapiens
HMEAQAGST

SEQ ID NO: 658339 - protein, 9 aa, Homo Sapiens
DCIEGFCCS

SEQ ID NO: 658340 - protein, 9 aa, Homo Sapiens
FDYYVYHKT

SEQ ID NO: 658341 - protein, 9 aa, Homo Sapiens
PGANEPMAE

SEQ ID NO: 658342 - protein, 9 aa, Homo Sapiens
SQTGYLGLA

SEQ ID NO: 658343 - protein, 9 aa, Homo Sapiens
RKGVCTGCL

SEQ ID NO: 658344 - protein, 9 aa, Homo Sapiens
KFVFDGNDH

SEQ ID NO: 658345 - protein, 9 aa, Homo Sapiens
LCENSLHVS

SEQ ID NO: 658346 - protein, 9 aa, Homo Sapiens
VSGWYNITD

SEQ ID NO: 658347 - protein, 9 aa, Homo Sapiens
CFQRCSGRS

SEQ ID NO: 658348 - protein, 9 aa, Homo Sapiens
PVPTLRLEV

SEQ ID NO: 658349 - protein, 9 aa, Homo Sapiens
CRSESRLRP

SEQ ID NO: 658350 - protein, 9 aa, Homo Sapiens
MDTEKSPLY

SEQ ID NO: 658351 - protein, 9 aa, Homo Sapiens
FGKAHEFIA

SEQ ID NO: 658352 - protein, 9 aa, Homo Sapiens
APKPRGLFM

SEQ ID NO: 658353 - protein, 9 aa, Homo Sapiens
YPPVTVMSL

SEQ ID NO: 658354 - protein, 9 aa, Homo Sapiens
ASVVTTKEI

SEQ ID NO: 658355 - protein, 9 aa, Homo Sapiens
RNLMLWMED

SEQ ID NO: 658356 - protein, 9 aa, Homo Sapiens
GKRMFEKRW

SEQ ID NO: 658357 - protein, 9 aa, Homo Sapiens
QTEGGFHKG

SEQ ID NO: 658358 - protein, 9 aa, Homo Sapiens
STGPDSQGS

SEQ ID NO: 658359 - protein, 9 aa, Homo Sapiens
GHARKTAVH

SEQ ID NO: 658360 - protein, 9 aa, Homo Sapiens
YYISFTGCF

SEQ ID NO: 658361 - protein, 9 aa, Homo Sapiens
MCPNKCVMS

SEQ ID NO: 658362 - protein, 9 aa, Homo Sapiens
TAHRGGLTL

SEQ ID NO: 658363 - protein, 9 aa, Homo Sapiens
CFLRFCFSA

SEQ ID NO: 658364 - protein, 9 aa, Homo Sapiens
TQLLEGMGF

SEQ ID NO: 658365 - protein, 9 aa, Homo Sapiens
PGESDLDRE

SEQ ID NO: 658366 - protein, 9 aa, Homo Sapiens
VNGSLLVIV

SEQ ID NO: 658367 - protein, 9 aa, Homo Sapiens
SASVTLVLQ

SEQ ID NO: 658368 - protein, 9 aa, Homo Sapiens
ELMSQTGYL

SEQ ID NO: 658369 - protein, 9 aa, Homo Sapiens
FKIKIQDLD

SEQ ID NO: 658370 - protein, 9 aa, Homo Sapiens
EPSGDGQLP

SEQ ID NO: 658371 - protein, 9 aa, Homo Sapiens
CMGGMNRRL

SEQ ID NO: 658372 - protein, 9 aa, Homo Sapiens
QPSDSWYKD

SEQ ID NO: 658373 - protein, 9 aa, Homo Sapiens
EVGELSWGK

SEQ ID NO: 658374 - protein, 9 aa, Homo Sapiens
SRSKSRSQF

SEQ ID NO: 658375 - protein, 9 aa, Homo Sapiens
SKTKKQFIC

SEQ ID NO: 658376 - protein, 9 aa, Homo Sapiens
QDCPWYNQG

SEQ ID NO: 658377 - protein, 9 aa, Homo Sapiens
YNVSQHALD

SEQ ID NO: 658378 - protein, 9 aa, Homo Sapiens
SYRYKVFVD

SEQ ID NO: 658379 - protein, 9 aa, Homo Sapiens
RRSKFGIKG

SEQ ID NO: 658380 - protein, 9 aa, Homo Sapiens
GNGHPVASV

SEQ ID NO: 658381 - protein, 9 aa, Homo Sapiens
INQAGATGV

SEQ ID NO: 658382 - protein, 9 aa, Homo Sapiens
AVCLERMDE

SEQ ID NO: 658383 - protein, 9 aa, Homo Sapiens
YNKALDKDS

SEQ ID NO: 658384 - protein, 9 aa, Homo Sapiens
HKQIDDFLC

SEQ ID NO: 658385 - protein, 9 aa, Homo Sapiens
NNSKQKCSL

SEQ ID NO: 658386 - protein, 9 aa, Homo Sapiens
ATAGLPSFL

SEQ ID NO: 658387 - protein, 9 aa, Homo Sapiens
DFDLMKFQV

SEQ ID NO: 658388 - protein, 9 aa, Homo Sapiens
FTSQIEFSL

SEQ ID NO: 658389 - protein, 9 aa, Homo Sapiens
HNPEFTTFE

SEQ ID NO: 658390 - protein, 9 aa, Homo Sapiens
ATEIEVPFV

SEQ ID NO: 658391 - protein, 9 aa, Homo Sapiens
GVKNKQEFM

SEQ ID NO: 658392 - protein, 9 aa, Homo Sapiens
LQEACKAYL

SEQ ID NO: 658393 - protein, 9 aa, Homo Sapiens
DPERKLEDD

SEQ ID NO: 658394 - protein, 9 aa, Homo Sapiens
DVPGITDEE

SEQ ID NO: 658395 - protein, 9 aa, Homo Sapiens
MLNFLSHKN

SEQ ID NO: 658396 - protein, 9 aa, Homo Sapiens
HLYGTYCTR

SEQ ID NO: 658397 - protein, 9 aa, Homo Sapiens
EPSKSETLI

SEQ ID NO: 658398 - protein, 9 aa, Homo Sapiens
EFVTQFVYT

SEQ ID NO: 658399 - protein, 9 aa, Homo Sapiens
KAYLVGLFE

SEQ ID NO: 658400 - protein, 9 aa, Homo Sapiens
PFLFGGSGE

SEQ ID NO: 658401 - protein, 9 aa, Homo Sapiens
KWTMGKNGF

SEQ ID NO: 658402 - protein, 9 aa, Homo Sapiens
YLMNNFNGR

SEQ ID NO: 658403 - protein, 9 aa, Homo Sapiens
PEIPRWKGG

SEQ ID NO: 658404 - protein, 9 aa, Homo Sapiens
SQSFCGCGY

SEQ ID NO: 658405 - protein, 9 aa, Homo Sapiens
AQVTYSLLQ

SEQ ID NO: 658406 - protein, 9 aa, Homo Sapiens
MLFFWMLFT

SEQ ID NO: 658407 - protein, 9 aa, Homo Sapiens
VRRGQLADI

SEQ ID NO: 658408 - protein, 9 aa, Homo Sapiens
PCSDIRFNS

SEQ ID NO: 658409 - protein, 9 aa, Homo Sapiens
PEFTTFEFY

SEQ ID NO: 658410 - protein, 9 aa, Homo Sapiens
QSKRKNPAP

SEQ ID NO: 658411 - protein, 9 aa, Homo Sapiens
LSEQQIPLS

SEQ ID NO: 658412 - protein, 9 aa, Homo Sapiens
SCFTYSSAY

SEQ ID NO: 658413 - protein, 9 aa, Homo Sapiens
DKVRTGTYR

SEQ ID NO: 658414 - protein, 9 aa, Homo Sapiens
HATTSTESS

SEQ ID NO: 658415 - protein, 9 aa, Homo Sapiens
LTELPKCAV

SEQ ID NO: 658416 - protein, 9 aa, Homo Sapiens
AGWGREQDS

SEQ ID NO: 658417 - protein, 9 aa, Homo Sapiens
SCMPDSRFA

SEQ ID NO: 658418 - protein, 9 aa, Homo Sapiens
LEKAYEAWR

SEQ ID NO: 658419 - protein, 9 aa, Homo Sapiens
GSASVTLVL

SEQ ID NO: 658420 - protein, 9 aa, Homo Sapiens
DETTYQETE

SEQ ID NO: 658421 - protein, 9 aa, Homo Sapiens
ETTYQETED

SEQ ID NO: 658422 - protein, 9 aa, Homo Sapiens
TADEIKYFI

SEQ ID NO: 658423 - protein, 9 aa, Homo Sapiens
SHFHVSTRI

SEQ ID NO: 658424 - protein, 9 aa, Homo Sapiens
NVVGIEGFT

SEQ ID NO: 658425 - protein, 9 aa, Homo Sapiens
QIVLSPHLE

SEQ ID NO: 658426 - protein, 9 aa, Homo Sapiens
YNFEHETVR

SEQ ID NO: 658427 - protein, 9 aa, Homo Sapiens
CKVYPSMIS

SEQ ID NO: 658428 - protein, 9 aa, Homo Sapiens
IQVLTGNVQ

SEQ ID NO: 658429 - protein, 9 aa, Homo Sapiens
YLGLLRLGT

SEQ ID NO: 658430 - protein, 9 aa, Homo Sapiens
EASSAGKKQ

SEQ ID NO: 658431 - protein, 9 aa, Homo Sapiens
QRAELSRLL

SEQ ID NO: 658432 - protein, 9 aa, Homo Sapiens
DYADFKIKI

SEQ ID NO: 658433 - protein, 9 aa, Homo Sapiens
FPEIPRWKG

SEQ ID NO: 658434 - protein, 9 aa, Homo Sapiens
EHPQMGSPL

SEQ ID NO: 658435 - protein, 9 aa, Homo Sapiens
YNAIPIIMC

SEQ ID NO: 658436 - protein, 9 aa, Homo Sapiens
QFPFQGKPK

SEQ ID NO: 658437 - protein, 9 aa, Homo Sapiens
HRGGLTLNE

SEQ ID NO: 658438 - protein, 9 aa, Homo Sapiens
RLHTVERPY

SEQ ID NO: 658439 - protein, 9 aa, Homo Sapiens
KQKCSLKHQ

SEQ ID NO: 658440 - protein, 9 aa, Homo Sapiens
EEPVECRSE

SEQ ID NO: 658441 - protein, 9 aa, Homo Sapiens
QDRAAFTAS

SEQ ID NO: 658442 - protein, 9 aa, Homo Sapiens
AANVSLGIL

SEQ ID NO: 658443 - protein, 9 aa, Homo Sapiens
NLANLLHKQ

SEQ ID NO: 658444 - protein, 9 aa, Homo Sapiens
CIEGFCCSR

SEQ ID NO: 658445 - protein, 9 aa, Homo Sapiens
QARCGQALH

SEQ ID NO: 658446 - protein, 9 aa, Homo Sapiens
VFQDSLDRC

SEQ ID NO: 658447 - protein, 9 aa, Homo Sapiens
PERKLEDDW

SEQ ID NO: 658448 - protein, 9 aa, Homo Sapiens
VWAPSMGGG

SEQ ID NO: 658449 - protein, 9 aa, Homo Sapiens
VGLLEGDTN

SEQ ID NO: 658450 - protein, 9 aa, Homo Sapiens
YHTIVYFHG

SEQ ID NO: 658451 - protein, 9 aa, Homo Sapiens
GPEVFQDSL

SEQ ID NO: 658452 - protein, 9 aa, Homo Sapiens
ATYVKVNIR

SEQ ID NO: 658453 - protein, 9 aa, Homo Sapiens
LEIYKMLGE

SEQ ID NO: 658454 - protein, 9 aa, Homo Sapiens
GRFHQIMAS

SEQ ID NO: 658455 - protein, 9 aa, Homo Sapiens
SYQLLKDTE

SEQ ID NO: 658456 - protein, 9 aa, Homo Sapiens
DNETGSESM

SEQ ID NO: 658457 - protein, 9 aa, Homo Sapiens
IFDYYVYHK

SEQ ID NO: 658458 - protein, 9 aa, Homo Sapiens
VEMYDSDAV

SEQ ID NO: 658459 - protein, 9 aa, Homo Sapiens
SFPVITAGP

SEQ ID NO: 658460 - protein, 9 aa, Homo Sapiens
KFQVKREPS

SEQ ID NO: 658461 - protein, 9 aa, Homo Sapiens
AAAKAAAEA

SEQ ID NO: 658462 - protein, 9 aa, Homo Sapiens
HFNALMDVV

SEQ ID NO: 658463 - protein, 9 aa, Homo Sapiens
LTYYLLILT

SEQ ID NO: 658464 - protein, 9 aa, Homo Sapiens
FEIIRNEGI

SEQ ID NO: 658465 - protein, 9 aa, Homo Sapiens
AGMLNKRCL

SEQ ID NO: 658466 - protein, 9 aa, Homo Sapiens
KGIEDGGKE

SEQ ID NO: 658467 - protein, 9 aa, Homo Sapiens
KCFRCKLCE

SEQ ID NO: 658468 - protein, 9 aa, Homo Sapiens
WATFFCVAF

SEQ ID NO: 658469 - protein, 9 aa, Homo Sapiens
ISHMNFRMF

SEQ ID NO: 658470 - protein, 9 aa, Homo Sapiens
LPFCPHKQI

SEQ ID NO: 658471 - protein, 9 aa, Homo Sapiens
ISREAADHL

SEQ ID NO: 658472 - protein, 9 aa, Homo Sapiens
CSQTCRATS

SEQ ID NO: 658473 - protein, 9 aa, Homo Sapiens
VSEESRRGR

SEQ ID NO: 658474 - protein, 9 aa, Homo Sapiens
GLQGRAEGQ

SEQ ID NO: 658475 - protein, 9 aa, Homo Sapiens
CGYGYVSQS

SEQ ID NO: 658476 - protein, 9 aa, Homo Sapiens
NAVFVKNAT

SEQ ID NO: 658477 - protein, 9 aa, Homo Sapiens
GQARCGQAL

SEQ ID NO: 658478 - protein, 9 aa, Homo Sapiens
HKNLLFLYD

SEQ ID NO: 658479 - protein, 9 aa, Homo Sapiens
SLMCPNKCV

SEQ ID NO: 658480 - protein, 9 aa, Homo Sapiens
GVCTGCLAL

SEQ ID NO: 658481 - protein, 9 aa, Homo Sapiens
GVVINFKKT

SEQ ID NO: 658482 - protein, 9 aa, Homo Sapiens
VLQIIVCGD

SEQ ID NO: 658483 - protein, 9 aa, Homo Sapiens
YNKTQFYDF

SEQ ID NO: 658484 - protein, 9 aa, Homo Sapiens
REHGPRRAA

SEQ ID NO: 658485 - protein, 9 aa, Homo Sapiens
SWGEGEDDE

SEQ ID NO: 658486 - protein, 9 aa, Homo Sapiens
TNENCSTGP

SEQ ID NO: 658487 - protein, 9 aa, Homo Sapiens
RIQVLTGNV

SEQ ID NO: 658488 - protein, 9 aa, Homo Sapiens
GYGYVSQSF

SEQ ID NO: 658489 - protein, 9 aa, Homo Sapiens
ALKDIQTGA

SEQ ID NO: 658490 - protein, 9 aa, Homo Sapiens
LCRTYYNNS

SEQ ID NO: 658491 - protein, 9 aa, Homo Sapiens
QKEDTNHNQ

SEQ ID NO: 658492 - protein, 9 aa, Homo Sapiens
ELRKPSWSP

SEQ ID NO: 658493 - protein, 9 aa, Homo Sapiens
IQTKEGRIM

SEQ ID NO: 658494 - protein, 9 aa, Homo Sapiens
EPWDIAACF

SEQ ID NO: 658495 - protein, 9 aa, Homo Sapiens
QHLYGTYCT

SEQ ID NO: 658496 - protein, 9 aa, Homo Sapiens
QARHAVMGI

SEQ ID NO: 658497 - protein, 9 aa, Homo Sapiens
DLQDLDSMD

SEQ ID NO: 658498 - protein, 9 aa, Homo Sapiens
TIPMSAIIN

SEQ ID NO: 658499 - protein, 9 aa, Homo Sapiens
EEAYTADEI

SEQ ID NO: 658500 - protein, 9 aa, Homo Sapiens
LSWGKLYSL

SEQ ID NO: 658501 - protein, 9 aa, Homo Sapiens
NETGSESMV

SEQ ID NO: 658502 - protein, 9 aa, Homo Sapiens
ACGQARCGQ

SEQ ID NO: 658503 - protein, 9 aa, Homo Sapiens
GEGEDDEPR

SEQ ID NO: 658504 - protein, 9 aa, Homo Sapiens
HQPSSDRVT

SEQ ID NO: 658505 - protein, 9 aa, Homo Sapiens
FFPDDSAGA

SEQ ID NO: 658506 - protein, 9 aa, Homo Sapiens
RLQDDPPAG

SEQ ID NO: 658507 - protein, 9 aa, Homo Sapiens
NVPVIYKHR

SEQ ID NO: 658508 - protein, 9 aa, Homo Sapiens
IGRYVVRYT

SEQ ID NO: 658509 - protein, 9 aa, Homo Sapiens
FTSMKEHIK

SEQ ID NO: 658510 - protein, 9 aa, Homo Sapiens
LPGGSASVT

SEQ ID NO: 658511 - protein, 9 aa, Homo Sapiens
IAEKHDIGV

SEQ ID NO: 658512 - protein, 9 aa, Homo Sapiens
LVPNPFTSQ

SEQ ID NO: 658513 - protein, 9 aa, Homo Sapiens
LGIMKELSR

SEQ ID NO: 658514 - protein, 9 aa, Homo Sapiens
CPTHGAWAN

SEQ ID NO: 658515 - protein, 9 aa, Homo Sapiens
AIINQAGAT

SEQ ID NO: 658516 - protein, 9 aa, Homo Sapiens
ARHAVMGIW

SEQ ID NO: 658517 - protein, 9 aa, Homo Sapiens
GELSWGKLY

SEQ ID NO: 658518 - protein, 9 aa, Homo Sapiens
GNNALKDIQ

SEQ ID NO: 658519 - protein, 9 aa, Homo Sapiens
LLNMKRWIC

SEQ ID NO: 658520 - protein, 9 aa, Homo Sapiens
DAFFEIIRN

SEQ ID NO: 658521 - protein, 9 aa, Homo Sapiens
MGNGHPVAS

SEQ ID NO: 658522 - protein, 9 aa, Homo Sapiens
RKLQGPIGK

SEQ ID NO: 658523 - protein, 9 aa, Homo Sapiens
VPNPFTSQI

SEQ ID NO: 658524 - protein, 9 aa, Homo Sapiens
CKDHTYKFH

SEQ ID NO: 658525 - protein, 9 aa, Homo Sapiens
PEISHMNFR

SEQ ID NO: 658526 - protein, 9 aa, Homo Sapiens
IRKVYLEDF

SEQ ID NO: 658527 - protein, 9 aa, Homo Sapiens
IMKKPEPGL

SEQ ID NO: 658528 - protein, 9 aa, Homo Sapiens
ALMDVVSEW

SEQ ID NO: 658529 - protein, 9 aa, Homo Sapiens
AHEFIALIF

SEQ ID NO: 658530 - protein, 9 aa, Homo Sapiens
KTKVLKIIF

SEQ ID NO: 658531 - protein, 9 aa, Homo Sapiens
VRSVGPSLT

SEQ ID NO: 658532 - protein, 9 aa, Homo Sapiens
VKPFVSVTD

SEQ ID NO: 658533 - protein, 9 aa, Homo Sapiens
PPSGPWRRV

SEQ ID NO: 658534 - protein, 9 aa, Homo Sapiens
RGKLGLQEY

SEQ ID NO: 658535 - protein, 9 aa, Homo Sapiens
SLWPRAGRS

SEQ ID NO: 658536 - protein, 9 aa, Homo Sapiens
MISREAADH

SEQ ID NO: 658537 - protein, 9 aa, Homo Sapiens
MNNFNGRFS

SEQ ID NO: 658538 - protein, 9 aa, Homo Sapiens
VDLLEDTDL

SEQ ID NO: 658539 - protein, 9 aa, Homo Sapiens
HNLKTPAEC

SEQ ID NO: 658540 - protein, 9 aa, Homo Sapiens
IVYFHGCLV

SEQ ID NO: 658541 - protein, 9 aa, Homo Sapiens
WRRVRSVSL

SEQ ID NO: 658542 - protein, 9 aa, Homo Sapiens
VASVVTTKE

SEQ ID NO: 658543 - protein, 9 aa, Homo Sapiens
DWPRRVKVS

SEQ ID NO: 658544 - protein, 9 aa, Homo Sapiens
VIVHAPNLP

SEQ ID NO: 658545 - protein, 9 aa, Homo Sapiens
VYQCMARKS

SEQ ID NO: 658546 - protein, 9 aa, Homo Sapiens
NPEFTTFEF

SEQ ID NO: 658547 - protein, 9 aa, Homo Sapiens
QNVPVIYKH

SEQ ID NO: 658548 - protein, 9 aa, Homo Sapiens
TAPWSSAVP

SEQ ID NO: 658549 - protein, 9 aa, Homo Sapiens
GDSRPLHLS

SEQ ID NO: 658550 - protein, 9 aa, Homo Sapiens
QNSYHSQPE

SEQ ID NO: 658551 - protein, 9 aa, Homo Sapiens
PSALPSADH

SEQ ID NO: 658552 - protein, 9 aa, Homo Sapiens
ERLAPYDAW

SEQ ID NO: 658553 - protein, 9 aa, Homo Sapiens
QCMARKSAG

SEQ ID NO: 658554 - protein, 9 aa, Homo Sapiens
HTIVYFHGC

SEQ ID NO: 658555 - protein, 9 aa, Homo Sapiens
RDYADFKIK

SEQ ID NO: 658556 - protein, 9 aa, Homo Sapiens
SSALKSSRT

SEQ ID NO: 658557 - protein, 9 aa, Homo Sapiens
TGSESMVSH

SEQ ID NO: 658558 - protein, 9 aa, Homo Sapiens
PKGIEDGGK

SEQ ID NO: 658559 - protein, 9 aa, Homo Sapiens
EFTTFEFYM

SEQ ID NO: 658560 - protein, 9 aa, Homo Sapiens
MLRMHHALK

SEQ ID NO: 658561 - protein, 9 aa, Homo Sapiens
LRVRNLQHL

SEQ ID NO: 658562 - protein, 9 aa, Homo Sapiens
RDLEEVEAP

SEQ ID NO: 658563 - protein, 9 aa, Homo Sapiens
IKGPVAVIS

SEQ ID NO: 658564 - protein, 9 aa, Homo Sapiens
DDKEDSAWK

SEQ ID NO: 658565 - protein, 9 aa, Homo Sapiens
GAAFPEIPR

SEQ ID NO: 658566 - protein, 9 aa, Homo Sapiens
EDLQDLDSM

SEQ ID NO: 658567 - protein, 9 aa, Homo Sapiens
THTTEHPQM

SEQ ID NO: 658568 - protein, 9 aa, Homo Sapiens
QVRIQVLTG

SEQ ID NO: 658569 - protein, 9 aa, Homo Sapiens
PKCINGGKV

SEQ ID NO: 658570 - protein, 9 aa, Homo Sapiens
ALLNMKRWI

SEQ ID NO: 658571 - protein, 9 aa, Homo Sapiens
QEEEEEGDG

SEQ ID NO: 658572 - protein, 9 aa, Homo Sapiens
STIRLKVSS

SEQ ID NO: 658573 - protein, 9 aa, Homo Sapiens
FLFHNRGNG

SEQ ID NO: 658574 - protein, 9 aa, Homo Sapiens
DFKIKIQDL

SEQ ID NO: 658575 - protein, 9 aa, Homo Sapiens
PAASVRPSS

SEQ ID NO: 658576 - protein, 9 aa, Homo Sapiens
SEESRRGRE

SEQ ID NO: 658577 - protein, 9 aa, Homo Sapiens
LILTIITLE

SEQ ID NO: 658578 - protein, 9 aa, Homo Sapiens
PAPSHWKLL

SEQ ID NO: 658579 - protein, 9 aa, Homo Sapiens
NAQGPIGSS

SEQ ID NO: 658580 - protein, 9 aa, Homo Sapiens
ISNATEGDC

SEQ ID NO: 658581 - protein, 9 aa, Homo Sapiens
DLLEDPDFL

SEQ ID NO: 658582 - protein, 9 aa, Homo Sapiens
YCGVDHELL

SEQ ID NO: 658583 - protein, 9 aa, Homo Sapiens
TPTKCSSNT

SEQ ID NO: 658584 - protein, 9 aa, Homo Sapiens
MKELSRLGL

SEQ ID NO: 658585 - protein, 9 aa, Homo Sapiens
VGIEGFTNF

SEQ ID NO: 658586 - protein, 9 aa, Homo Sapiens
HEPSKSETL

SEQ ID NO: 658587 - protein, 9 aa, Homo Sapiens
ENDSDNESD

SEQ ID NO: 658588 - protein, 9 aa, Homo Sapiens
LQPQDPHLP

SEQ ID NO: 658589 - protein, 9 aa, Homo Sapiens
AQDTTIFFL

SEQ ID NO: 658590 - protein, 9 aa, Homo Sapiens
VNRVNEVGV

SEQ ID NO: 658591 - protein, 9 aa, Homo Sapiens
AFAPATVFT

SEQ ID NO: 658592 - protein, 9 aa, Homo Sapiens
VWDDKQKDF

SEQ ID NO: 658593 - protein, 9 aa, Homo Sapiens
VTSRETGQT

SEQ ID NO: 658594 - protein, 9 aa, Homo Sapiens
SKSRSQFSS

SEQ ID NO: 658595 - protein, 9 aa, Homo Sapiens
DDPPAGVSG

SEQ ID NO: 658596 - protein, 9 aa, Homo Sapiens
RLSRAVQET

SEQ ID NO: 658597 - protein, 9 aa, Homo Sapiens
GRIMAFSTC

SEQ ID NO: 658598 - protein, 9 aa, Homo Sapiens
HLEDWPRRV

SEQ ID NO: 658599 - protein, 9 aa, Homo Sapiens
TPGDRDSQE

SEQ ID NO: 658600 - protein, 9 aa, Homo Sapiens
FLRFCFSAT

SEQ ID NO: 658601 - protein, 9 aa, Homo Sapiens
ASDQEPGAN

SEQ ID NO: 658602 - protein, 9 aa, Homo Sapiens
CSLMCPNKC

SEQ ID NO: 658603 - protein, 9 aa, Homo Sapiens
SQTCRATSS

SEQ ID NO: 658604 - protein, 9 aa, Homo Sapiens
KIQVISAPP

SEQ ID NO: 658605 - protein, 9 aa, Homo Sapiens
DPEISHMNF

SEQ ID NO: 658606 - protein, 9 aa, Homo Sapiens
SESEKGLES

SEQ ID NO: 658607 - protein, 9 aa, Homo Sapiens
DTDKWIQKE

SEQ ID NO: 658608 - protein, 9 aa, Homo Sapiens
VLKIIFVHL

SEQ ID NO: 658609 - protein, 9 aa, Homo Sapiens
VSHCVPNVS

SEQ ID NO: 658610 - protein, 9 aa, Homo Sapiens
SFSHATTST

SEQ ID NO: 658611 - protein, 9 aa, Homo Sapiens
AAKGGVSPS

SEQ ID NO: 658612 - protein, 9 aa, Homo Sapiens
TYSLLQPQD

SEQ ID NO: 658613 - protein, 9 aa, Homo Sapiens
SNATEGDCG

SEQ ID NO: 658614 - protein, 9 aa, Homo Sapiens
MLPLQGGRE

SEQ ID NO: 658615 - protein, 9 aa, Homo Sapiens
RLGTGAEGA

SEQ ID NO: 658616 - protein, 9 aa, Homo Sapiens
KPIGVRSVG

SEQ ID NO: 658617 - protein, 9 aa, Homo Sapiens
CRPKCINGG

SEQ ID NO: 658618 - protein, 9 aa, Homo Sapiens
AMVSCYPGN

SEQ ID NO: 658619 - protein, 9 aa, Homo Sapiens
HQEAIPFSP

SEQ ID NO: 658620 - protein, 9 aa, Homo Sapiens
HFMYYCSGR

SEQ ID NO: 658621 - protein, 9 aa, Homo Sapiens
RQCWVLRHW

SEQ ID NO: 658622 - protein, 9 aa, Homo Sapiens
RPAPSHWKL

SEQ ID NO: 658623 - protein, 9 aa, Homo Sapiens
VTRFSPSPR

SEQ ID NO: 658624 - protein, 9 aa, Homo Sapiens
RRGQLADIC

SEQ ID NO: 658625 - protein, 9 aa, Homo Sapiens
PSFLFLLLC

SEQ ID NO: 658626 - protein, 9 aa, Homo Sapiens
SCAGLQGRA

SEQ ID NO: 658627 - protein, 9 aa, Homo Sapiens
STVSYRYKV

SEQ ID NO: 658628 - protein, 9 aa, Homo Sapiens
IIGETTSHV

SEQ ID NO: 658629 - protein, 9 aa, Homo Sapiens
LFGGSGEGV

SEQ ID NO: 658630 - protein, 9 aa, Homo Sapiens
AAARMLPLQ

SEQ ID NO: 658631 - protein, 9 aa, Homo Sapiens
FQSKRKNPA

SEQ ID NO: 658632 - protein, 9 aa, Homo Sapiens
TGCKNVCFD

SEQ ID NO: 658633 - protein, 9 aa, Homo Sapiens
TQTEGGFHK

SEQ ID NO: 658634 - protein, 9 aa, Homo Sapiens
TGCLALLVA

SEQ ID NO: 658635 - protein, 9 aa, Homo Sapiens
KLVNKSIDG

SEQ ID NO: 658636 - protein, 9 aa, Homo Sapiens
LAIKHSIPG

SEQ ID NO: 658637 - protein, 9 aa, Homo Sapiens
EFIALIFGI

SEQ ID NO: 658638 - protein, 9 aa, Homo Sapiens
YGRTSENGF

SEQ ID NO: 658639 - protein, 9 aa, Homo Sapiens
VPVIYKHRS

SEQ ID NO: 658640 - protein, 9 aa, Homo Sapiens
FDLMKFQVK

SEQ ID NO: 658641 - protein, 9 aa, Homo Sapiens
QSRIIRKVY

SEQ ID NO: 658642 - protein, 9 aa, Homo Sapiens
SVVTTKEIA

SEQ ID NO: 658643 - protein, 9 aa, Homo Sapiens
AGEIMKKPE

SEQ ID NO: 658644 - protein, 9 aa, Homo Sapiens
LNTSQRIVL

SEQ ID NO: 658645 - protein, 9 aa, Homo Sapiens
ANWGPWTPC

SEQ ID NO: 658646 - protein, 9 aa, Homo Sapiens
LNLANLLHK

SEQ ID NO: 658647 - protein, 9 aa, Homo Sapiens
NHKALQLLR

SEQ ID NO: 658648 - protein, 9 aa, Homo Sapiens
VYNAQGPIG

SEQ ID NO: 658649 - protein, 9 aa, Homo Sapiens
PSKPIGVRS

SEQ ID NO: 658650 - protein, 9 aa, Homo Sapiens
LIPVRVLRS

SEQ ID NO: 658651 - protein, 9 aa, Homo Sapiens
FDETTYQET

SEQ ID NO: 658652 - protein, 9 aa, Homo Sapiens
EALMQALKD

SEQ ID NO: 658653 - protein, 9 aa, Homo Sapiens
QNCKVYPSM

SEQ ID NO: 658654 - protein, 9 aa, Homo Sapiens
TLESAPSEV

SEQ ID NO: 658655 - protein, 9 aa, Homo Sapiens
GLQEYAVFY

SEQ ID NO: 658656 - protein, 9 aa, Homo Sapiens
DHDSCAGLQ

SEQ ID NO: 658657 - protein, 9 aa, Homo Sapiens
AELSRLLFI

SEQ ID NO: 658658 - protein, 9 aa, Homo Sapiens
TMLTPMLNP

SEQ ID NO: 658659 - protein, 9 aa, Homo Sapiens
EVWDDKQKD

SEQ ID NO: 658660 - protein, 9 aa, Homo Sapiens
TGYLGLANA

SEQ ID NO: 658661 - protein, 9 aa, Homo Sapiens
EDTDLLEDP

SEQ ID NO: 658662 - protein, 9 aa, Homo Sapiens
TTIFFLGCA

SEQ ID NO: 658663 - protein, 9 aa, Homo Sapiens
EHETVRKFL

SEQ ID NO: 658664 - protein, 9 aa, Homo Sapiens
AVSWATFFC

SEQ ID NO: 658665 - protein, 9 aa, Homo Sapiens
RIASTEGKH

SEQ ID NO: 658666 - protein, 9 aa, Homo Sapiens
EHVDYSEMR

SEQ ID NO: 658667 - protein, 9 aa, Homo Sapiens
QGQSLWPRA

SEQ ID NO: 658668 - protein, 9 aa, Homo Sapiens
WYNQGFCKD

SEQ ID NO: 658669 - protein, 9 aa, Homo Sapiens
VSCYPGNGT

SEQ ID NO: 658670 - protein, 9 aa, Homo Sapiens
NVLPFPHQG

SEQ ID NO: 658671 - protein, 9 aa, Homo Sapiens
VGLLEQLLL

SEQ ID NO: 658672 - protein, 9 aa, Homo Sapiens
VISAPPVIL

SEQ ID NO: 658673 - protein, 9 aa, Homo Sapiens
LRKLQGPIG

SEQ ID NO: 658674 - protein, 9 aa, Homo Sapiens
CYNKALDKD

SEQ ID NO: 658675 - protein, 9 aa, Homo Sapiens
EHGPRRAAV

SEQ ID NO: 658676 - protein, 9 aa, Homo Sapiens
SDPDTRHRR

SEQ ID NO: 658677 - protein, 9 aa, Homo Sapiens
RVSSIHLEP

SEQ ID NO: 658678 - protein, 9 aa, Homo Sapiens
EADLKAAAK

SEQ ID NO: 658679 - protein, 9 aa, Homo Sapiens
KDIDKVETF

SEQ ID NO: 658680 - protein, 9 aa, Homo Sapiens
RDEMLRMHH

SEQ ID NO: 658681 - protein, 9 aa, Homo Sapiens
GDELRYITA

SEQ ID NO: 658682 - protein, 9 aa, Homo Sapiens
QWETAAPAV

SEQ ID NO: 658683 - protein, 9 aa, Homo Sapiens
IHSSIAKQI

SEQ ID NO: 658684 - protein, 9 aa, Homo Sapiens
IKQRLLAEE

SEQ ID NO: 658685 - protein, 9 aa, Homo Sapiens
QMGSPLPNL

SEQ ID NO: 658686 - protein, 9 aa, Homo Sapiens
YPAVTRFSP

SEQ ID NO: 658687 - protein, 9 aa, Homo Sapiens
LPCSDIRFN

SEQ ID NO: 658688 - protein, 9 aa, Homo Sapiens
STCFFLCFL

SEQ ID NO: 658689 - protein, 9 aa, Homo Sapiens
DIAVMGKAH

SEQ ID NO: 658690 - protein, 9 aa, Homo Sapiens
EENKVKNVV

SEQ ID NO: 658691 - protein, 9 aa, Homo Sapiens
VLNCVYKVL

SEQ ID NO: 658692 - protein, 9 aa, Homo Sapiens
CLALLVASV

SEQ ID NO: 658693 - protein, 9 aa, Homo Sapiens
IADHTVQEA

SEQ ID NO: 658694 - protein, 9 aa, Homo Sapiens
IPRWKGGKE

SEQ ID NO: 658695 - protein, 9 aa, Homo Sapiens
VSQSFCGCG

SEQ ID NO: 658696 - protein, 9 aa, Homo Sapiens
AGRFHQIMA

SEQ ID NO: 658697 - protein, 9 aa, Homo Sapiens
LTAVCEFVT

SEQ ID NO: 658698 - protein, 9 aa, Homo Sapiens
CFRCKLCEN

SEQ ID NO: 658699 - protein, 9 aa, Homo Sapiens
ECNSRQTGC

SEQ ID NO: 658700 - protein, 9 aa, Homo Sapiens
NKPDNVVLA

SEQ ID NO: 658701 - protein, 9 aa, Homo Sapiens
RDASLNHPR

SEQ ID NO: 658702 - protein, 9 aa, Homo Sapiens
SREAADHLL

SEQ ID NO: 658703 - protein, 9 aa, Homo Sapiens
RIIVVRTNL

SEQ ID NO: 658704 - protein, 9 aa, Homo Sapiens
EGGRWVSIW

SEQ ID NO: 658705 - protein, 9 aa, Homo Sapiens
MAAAGWGRE

SEQ ID NO: 658706 - protein, 9 aa, Homo Sapiens
NHNQATESC

SEQ ID NO: 658707 - protein, 9 aa, Homo Sapiens
GILLAWLSV

SEQ ID NO: 658708 - protein, 9 aa, Homo Sapiens
VLSSTTHIR

SEQ ID NO: 658709 - protein, 9 aa, Homo Sapiens
FVNRVNEVG

SEQ ID NO: 658710 - protein, 9 aa, Homo Sapiens
WRFTRIAVD

SEQ ID NO: 658711 - protein, 9 aa, Homo Sapiens
VPKFASWGE

SEQ ID NO: 658712 - protein, 9 aa, Homo Sapiens
VSLGILLAW

SEQ ID NO: 658713 - protein, 9 aa, Homo Sapiens
EAYTADEIK

SEQ ID NO: 658714 - protein, 9 aa, Homo Sapiens
LFVKLKSCM

SEQ ID NO: 658715 - protein, 9 aa, Homo Sapiens
ATFSSLRAV

SEQ ID NO: 658716 - protein, 9 aa, Homo Sapiens
GYKRFTSMK

SEQ ID NO: 658717 - protein, 9 aa, Homo Sapiens
AISLVAEFR

SEQ ID NO: 658718 - protein, 9 aa, Homo Sapiens
VREESTSKK

SEQ ID NO: 658719 - protein, 9 aa, Homo Sapiens
GQHLYGTYC

SEQ ID NO: 658720 - protein, 9 aa, Homo Sapiens
RMFEKRWVK

SEQ ID NO: 658721 - protein, 9 aa, Homo Sapiens
TPVREESTS

SEQ ID NO: 658722 - protein, 9 aa, Homo Sapiens
VLVFAALVS

SEQ ID NO: 658723 - protein, 9 aa, Homo Sapiens
LWTNMAISL

SEQ ID NO: 658724 - protein, 9 aa, Homo Sapiens
YVSQSFCGC

SEQ ID NO: 658725 - protein, 9 aa, Homo Sapiens
DFHFNALMD

SEQ ID NO: 658726 - protein, 9 aa, Homo Sapiens
PPESSPFSS

SEQ ID NO: 658727 - protein, 9 aa, Homo Sapiens
SELCENKPD

SEQ ID NO: 658728 - protein, 9 aa, Homo Sapiens
WEEAYTADE

SEQ ID NO: 658729 - protein, 9 aa, Homo Sapiens
LLYLGLLRL

SEQ ID NO: 658730 - protein, 9 aa, Homo Sapiens
CQQGQKQSG

SEQ ID NO: 658731 - protein, 9 aa, Homo Sapiens
ADQSANLTL

SEQ ID NO: 658732 - protein, 9 aa, Homo Sapiens
HRSRPISDV

SEQ ID NO: 658733 - protein, 9 aa, Homo Sapiens
PYEIFPEDY

SEQ ID NO: 658734 - protein, 9 aa, Homo Sapiens
IRLKVSSTA

SEQ ID NO: 658735 - protein, 9 aa, Homo Sapiens
REGRHESSR

SEQ ID NO: 658736 - protein, 9 aa, Homo Sapiens
PVWAPSMGG

SEQ ID NO: 658737 - protein, 9 aa, Homo Sapiens
TCLVQRDPA

SEQ ID NO: 658738 - protein, 9 aa, Homo Sapiens
GGFHKGRGR

SEQ ID NO: 658739 - protein, 9 aa, Homo Sapiens
RQNSYHSQP

SEQ ID NO: 658740 - protein, 9 aa, Homo Sapiens
IMCSSVGAL

SEQ ID NO: 658741 - protein, 9 aa, Homo Sapiens
IKHSIPGPT

SEQ ID NO: 658742 - protein, 9 aa, Homo Sapiens
NLGNNALKD

SEQ ID NO: 658743 - protein, 9 aa, Homo Sapiens
RLPCSDIRF

SEQ ID NO: 658744 - protein, 9 aa, Homo Sapiens
CGQALHLLP

SEQ ID NO: 658745 - protein, 9 aa, Homo Sapiens
IEMVHEGWW

SEQ ID NO: 658746 - protein, 9 aa, Homo Sapiens
AHVDLRGNR

SEQ ID NO: 658747 - protein, 9 aa, Homo Sapiens
GFCCSRHFW

SEQ ID NO: 658748 - protein, 9 aa, Homo Sapiens
RKDIDKVET

SEQ ID NO: 658749 - protein, 9 aa, Homo Sapiens
ATSSRGWTI

SEQ ID NO: 658750 - protein, 9 aa, Homo Sapiens
PRYMPHLES

SEQ ID NO: 658751 - protein, 9 aa, Homo Sapiens
IVLSPHLER

SEQ ID NO: 658752 - protein, 9 aa, Homo Sapiens
SQIVLSPHL

SEQ ID NO: 658753 - protein, 9 aa, Homo Sapiens
GIEDGGKEG

SEQ ID NO: 658754 - protein, 9 aa, Homo Sapiens
VSTTRLPAG

SEQ ID NO: 658755 - protein, 9 aa, Homo Sapiens
LWPRAGRSR

SEQ ID NO: 658756 - protein, 9 aa, Homo Sapiens
LNRQCWVLR

SEQ ID NO: 658757 - protein, 9 aa, Homo Sapiens
IMEHCYDCF

SEQ ID NO: 658758 - protein, 9 aa, Homo Sapiens
KNKQEFMDL

SEQ ID NO: 658759 - protein, 9 aa, Homo Sapiens
IYGRTSENG

SEQ ID NO: 658760 - protein, 9 aa, Homo Sapiens
KFGIKGPVA

SEQ ID NO: 658761 - protein, 9 aa, Homo Sapiens
IEDHVECLD

SEQ ID NO: 658762 - protein, 9 aa, Homo Sapiens
STRIRGDGR

SEQ ID NO: 658763 - protein, 9 aa, Homo Sapiens
PPDILDTML

SEQ ID NO: 658764 - protein, 9 aa, Homo Sapiens
FVKNATEIE

SEQ ID NO: 658765 - protein, 9 aa, Homo Sapiens
STPEEAHVD

SEQ ID NO: 658766 - protein, 9 aa, Homo Sapiens
VLNVSTSCP

SEQ ID NO: 658767 - protein, 9 aa, Homo Sapiens
ENGFNFNDV

SEQ ID NO: 658768 - protein, 9 aa, Homo Sapiens
CEFVNRVNE

SEQ ID NO: 658769 - protein, 9 aa, Homo Sapiens
QRRRFFPDD

SEQ ID NO: 658770 - protein, 9 aa, Homo Sapiens
TVSYRYKVF

SEQ ID NO: 658771 - protein, 9 aa, Homo Sapiens
RCPAPYEIF

SEQ ID NO: 658772 - protein, 9 aa, Homo Sapiens
KVETEGEAA

SEQ ID NO: 658773 - protein, 9 aa, Homo Sapiens
FGSKFFMGK

SEQ ID NO: 658774 - protein, 9 aa, Homo Sapiens
TVYDVMDKS

SEQ ID NO: 658775 - protein, 9 aa, Homo Sapiens
TSMCSEGPP

SEQ ID NO: 658776 - protein, 9 aa, Homo Sapiens
KQKDFVCNT

SEQ ID NO: 658777 - protein, 9 aa, Homo Sapiens
SRSQFSSRS

SEQ ID NO: 658778 - protein, 9 aa, Homo Sapiens
REEPSGDGQ

SEQ ID NO: 658779 - protein, 9 aa, Homo Sapiens
TVFTPLGAL

SEQ ID NO: 658780 - protein, 9 aa, Homo Sapiens
EGGFHKGRG

SEQ ID NO: 658781 - protein, 9 aa, Homo Sapiens
SHMNFRMFS

SEQ ID NO: 658782 - protein, 9 aa, Homo Sapiens
MTSLNLANL

SEQ ID NO: 658783 - protein, 9 aa, Homo Sapiens
AEAAIEEGK

SEQ ID NO: 658784 - protein, 9 aa, Homo Sapiens
VLSPHLERI

SEQ ID NO: 658785 - protein, 9 aa, Homo Sapiens
FFLGCATQM

SEQ ID NO: 658786 - protein, 9 aa, Homo Sapiens
RPKCINGGK

SEQ ID NO: 658787 - protein, 9 aa, Homo Sapiens
LKDLDYLAA

SEQ ID NO: 658788 - protein, 9 aa, Homo Sapiens
QKCSLKHQT

SEQ ID NO: 658789 - protein, 9 aa, Homo Sapiens
QSYRDTIVL

SEQ ID NO: 658790 - protein, 9 aa, Homo Sapiens
SYPLPLQLC

SEQ ID NO: 658791 - protein, 9 aa, Homo Sapiens
EIHDLTPED

SEQ ID NO: 658792 - protein, 9 aa, Homo Sapiens
ANVTPTKCS

SEQ ID NO: 658793 - protein, 9 aa, Homo Sapiens
RLEVVESSE

SEQ ID NO: 658794 - protein, 9 aa, Homo Sapiens
NDSDNESDH

SEQ ID NO: 658795 - protein, 9 aa, Homo Sapiens
KKQARHAVM

SEQ ID NO: 658796 - protein, 9 aa, Homo Sapiens
EVELIVLEK

SEQ ID NO: 658797 - protein, 9 aa, Homo Sapiens
SPQGKRMFE

SEQ ID NO: 658798 - protein, 9 aa, Homo Sapiens
LSELCENKP

SEQ ID NO: 658799 - protein, 9 aa, Homo Sapiens
GMDNETGSE

SEQ ID NO: 658800 - protein, 9 aa, Homo Sapiens
ECLDDEEEG

SEQ ID NO: 658801 - protein, 9 aa, Homo Sapiens
KIKSFRKKT

SEQ ID NO: 658802 - protein, 9 aa, Homo Sapiens
FSNNGMALK

SEQ ID NO: 658803 - protein, 9 aa, Homo Sapiens
YSVKTAAKG

SEQ ID NO: 658804 - protein, 9 aa, Homo Sapiens
AIKQRLLAE

SEQ ID NO: 658805 - protein, 9 aa, Homo Sapiens
MSQTGYLGL

SEQ ID NO: 658806 - protein, 9 aa, Homo Sapiens
EEVGELSWG

SEQ ID NO: 658807 - protein, 9 aa, Homo Sapiens
LKSSRTLIT

SEQ ID NO: 658808 - protein, 9 aa, Homo Sapiens
DDKQKDFVC

SEQ ID NO: 658809 - protein, 9 aa, Homo Sapiens
PIGSSGKAF

SEQ ID NO: 658810 - protein, 9 aa, Homo Sapiens
KEPMTTVRG

SEQ ID NO: 658811 - protein, 9 aa, Homo Sapiens
TYCTRLHEN

SEQ ID NO: 658812 - protein, 9 aa, Homo Sapiens
SYQNSPGSD

SEQ ID NO: 658813 - protein, 9 aa, Homo Sapiens
VMALQEACK

SEQ ID NO: 658814 - protein, 9 aa, Homo Sapiens
DYYVYHKTK

SEQ ID NO: 658815 - protein, 9 aa, Homo Sapiens
IVDIRVDAW

SEQ ID NO: 658816 - protein, 9 aa, Homo Sapiens
AARMLPLQG

SEQ ID NO: 658817 - protein, 9 aa, Homo Sapiens
NEIKNPEIW

SEQ ID NO: 658818 - protein, 9 aa, Homo Sapiens
DLDREAHPF

SEQ ID NO: 658819 - protein, 9 aa, Homo Sapiens
MAISLVAEF

SEQ ID NO: 658820 - protein, 9 aa, Homo Sapiens
VVESSEKLN

SEQ ID NO: 658821 - protein, 9 aa, Homo Sapiens
FHQIMASVN

SEQ ID NO: 658822 - protein, 9 aa, Homo Sapiens
EYSSYNEQN

SEQ ID NO: 658823 - protein, 9 aa, Homo Sapiens
EVVESSEKL

SEQ ID NO: 658824 - protein, 9 aa, Homo Sapiens
GGSASVTLV

SEQ ID NO: 658825 - protein, 9 aa, Homo Sapiens
ADLKAAAKA

SEQ ID NO: 658826 - protein, 9 aa, Homo Sapiens
GCGYGYVSQ

SEQ ID NO: 658827 - protein, 9 aa, Homo Sapiens
RIIRKVYLE

SEQ ID NO: 658828 - protein, 9 aa, Homo Sapiens
SFRKKTFLG

SEQ ID NO: 658829 - protein, 9 aa, Homo Sapiens
LEDTDLLED

SEQ ID NO: 658830 - protein, 9 aa, Homo Sapiens
KERSKAMVS

SEQ ID NO: 658831 - protein, 9 aa, Homo Sapiens
YESVTWIIY

SEQ ID NO: 658832 - protein, 9 aa, Homo Sapiens
ATQETSTIR

SEQ ID NO: 658833 - protein, 9 aa, Homo Sapiens
PSKTKKQFI

SEQ ID NO: 658834 - protein, 9 aa, Homo Sapiens
QRGGNNPLR

SEQ ID NO: 658835 - protein, 9 aa, Homo Sapiens
SGDQPKRTR

SEQ ID NO: 658836 - protein, 9 aa, Homo Sapiens
CMPDSRFAS

SEQ ID NO: 658837 - protein, 9 aa, Homo Sapiens
FFHVALADF

SEQ ID NO: 658838 - protein, 9 aa, Homo Sapiens
KMVGVIFSD

SEQ ID NO: 658839 - protein, 9 aa, Homo Sapiens
LKLEEEIAE

SEQ ID NO: 658840 - protein, 9 aa, Homo Sapiens
ENCSTGPDS

SEQ ID NO: 658841 - protein, 9 aa, Homo Sapiens
VPSLQPRAC

SEQ ID NO: 658842 - protein, 9 aa, Homo Sapiens
DHLLIVAEG

SEQ ID NO: 658843 - protein, 9 aa, Homo Sapiens
CPWYNQGFC

SEQ ID NO: 658844 - protein, 9 aa, Homo Sapiens
NRQCWVLRH

SEQ ID NO: 658845 - protein, 9 aa, Homo Sapiens
SDPKSTDDG

SEQ ID NO: 658846 - protein, 9 aa, Homo Sapiens
CKILNGEGE

SEQ ID NO: 658847 - protein, 9 aa, Homo Sapiens
DPDFTRAAE

SEQ ID NO: 658848 - protein, 9 aa, Homo Sapiens
GGSGEGVDP

SEQ ID NO: 658849 - protein, 9 aa, Homo Sapiens
KSAGEAKTQ

SEQ ID NO: 658850 - protein, 9 aa, Homo Sapiens
PYHTIVYFH

SEQ ID NO: 658851 - protein, 9 aa, Homo Sapiens
CFRKDIDKV

SEQ ID NO: 658852 - protein, 9 aa, Homo Sapiens
DSQEHVDSQ

SEQ ID NO: 658853 - protein, 9 aa, Homo Sapiens
SERNLQAHF

SEQ ID NO: 658854 - protein, 9 aa, Homo Sapiens
AWQAVEPWD

SEQ ID NO: 658855 - protein, 9 aa, Homo Sapiens
GRHESSRIP

SEQ ID NO: 658856 - protein, 9 aa, Homo Sapiens
CNSRQTGCK

SEQ ID NO: 658857 - protein, 9 aa, Homo Sapiens
YRDTIVLLC

SEQ ID NO: 658858 - protein, 9 aa, Homo Sapiens
AIPIIMCSS

SEQ ID NO: 658859 - protein, 9 aa, Homo Sapiens
GKYSVKTAA

SEQ ID NO: 658860 - protein, 9 aa, Homo Sapiens
IIMCSSVGA

SEQ ID NO: 658861 - protein, 9 aa, Homo Sapiens
YADFKIKIQ

SEQ ID NO: 658862 - protein, 9 aa, Homo Sapiens
QETCREVRR

SEQ ID NO: 658863 - protein, 9 aa, Homo Sapiens
FSHATTSTE

SEQ ID NO: 658864 - protein, 9 aa, Homo Sapiens
YQPVNTPIV

SEQ ID NO: 658865 - protein, 9 aa, Homo Sapiens
NFLSHKNMH

SEQ ID NO: 658866 - protein, 9 aa, Homo Sapiens
VDPEISHMN

SEQ ID NO: 658867 - protein, 9 aa, Homo Sapiens
RSKKAVCHK

SEQ ID NO: 658868 - protein, 9 aa, Homo Sapiens
SCSPLSESE

SEQ ID NO: 658869 - protein, 9 aa, Homo Sapiens
WAMLFFWML

SEQ ID NO: 658870 - protein, 9 aa, Homo Sapiens
SCSLMCPNK

SEQ ID NO: 658871 - protein, 9 aa, Homo Sapiens
KDQAYRCTI

SEQ ID NO: 658872 - protein, 9 aa, Homo Sapiens
SDLDREAHP

SEQ ID NO: 658873 - protein, 9 aa, Homo Sapiens
QNMTADQSA

SEQ ID NO: 658874 - protein, 9 aa, Homo Sapiens
LKQVRIQVL

SEQ ID NO: 658875 - protein, 9 aa, Homo Sapiens
GETFAFENM

SEQ ID NO: 658876 - protein, 9 aa, Homo Sapiens
ELEHNLLSK

SEQ ID NO: 658877 - protein, 9 aa, Homo Sapiens
FGSGCCPVW

SEQ ID NO: 658878 - protein, 9 aa, Homo Sapiens
NAGMVAGIE

SEQ ID NO: 658879 - protein, 9 aa, Homo Sapiens
NAKKQARHA

SEQ ID NO: 658880 - protein, 9 aa, Homo Sapiens
VSAQLTSTL

SEQ ID NO: 658881 - protein, 9 aa, Homo Sapiens
KLEEEIAEK

SEQ ID NO: 658882 - protein, 9 aa, Homo Sapiens
SMVRNLMLW

SEQ ID NO: 658883 - protein, 9 aa, Homo Sapiens
LFFWMLFTL

SEQ ID NO: 658884 - protein, 9 aa, Homo Sapiens
DVVLSEQQI

SEQ ID NO: 658885 - protein, 9 aa, Homo Sapiens
TKEERLAPY

SEQ ID NO: 658886 - protein, 9 aa, Homo Sapiens
SVRPSSSVT

SEQ ID NO: 658887 - protein, 9 aa, Homo Sapiens
TEGDCGLYR

SEQ ID NO: 658888 - protein, 9 aa, Homo Sapiens
LTAHRGGLT

SEQ ID NO: 658889 - protein, 9 aa, Homo Sapiens
NNGMALKEE

SEQ ID NO: 658890 - protein, 9 aa, Homo Sapiens
PHQEAIPFS

SEQ ID NO: 658891 - protein, 9 aa, Homo Sapiens
AYTADEIKY

SEQ ID NO: 658892 - protein, 9 aa, Homo Sapiens
HVALADFML

SEQ ID NO: 658893 - protein, 9 aa, Homo Sapiens
QVTYSLLQP

SEQ ID NO: 658894 - protein, 9 aa, Homo Sapiens
DPKSTDDGS

SEQ ID NO: 658895 - protein, 9 aa, Homo Sapiens
AAGWGREQD

SEQ ID NO: 658896 - protein, 9 aa, Homo Sapiens
EAPETEGDA

SEQ ID NO: 658897 - protein, 9 aa, Homo Sapiens
LSSTTHIRV

SEQ ID NO: 658898 - protein, 9 aa, Homo Sapiens
SSKEKPKRE

SEQ ID NO: 658899 - protein, 9 aa, Homo Sapiens
IIRKVYLED

SEQ ID NO: 658900 - protein, 9 aa, Homo Sapiens
HPVASVVTT

SEQ ID NO: 658901 - protein, 9 aa, Homo Sapiens
QRIVLERII

SEQ ID NO: 658902 - protein, 9 aa, Homo Sapiens
IKVGLLEQL

SEQ ID NO: 658903 - protein, 9 aa, Homo Sapiens
QKDGNVLPF

SEQ ID NO: 658904 - protein, 9 aa, Homo Sapiens
SLGKPFTAY

SEQ ID NO: 658905 - protein, 9 aa, Homo Sapiens
FRKKTFLGL

SEQ ID NO: 658906 - protein, 9 aa, Homo Sapiens
KCCKILNGE

SEQ ID NO: 658907 - protein, 9 aa, Homo Sapiens
LLRCFPLDI

SEQ ID NO: 658908 - protein, 9 aa, Homo Sapiens
DIRVDAWKL

SEQ ID NO: 658909 - protein, 9 aa, Homo Sapiens
PWYNQGFCK

SEQ ID NO: 658910 - protein, 9 aa, Homo Sapiens
ETTSHVPPT

SEQ ID NO: 658911 - protein, 9 aa, Homo Sapiens
RREGRHESS

SEQ ID NO: 658912 - protein, 9 aa, Homo Sapiens
SSRGWTITS

SEQ ID NO: 658913 - protein, 9 aa, Homo Sapiens
MFQSKRKNP

SEQ ID NO: 658914 - protein, 9 aa, Homo Sapiens
DFKRLQDDP

SEQ ID NO: 658915 - protein, 9 aa, Homo Sapiens
RSTPEEAHV

SEQ ID NO: 658916 - protein, 9 aa, Homo Sapiens
LAPYDAWRC

SEQ ID NO: 658917 - protein, 9 aa, Homo Sapiens
LEHNLLSKG

SEQ ID NO: 658918 - protein, 9 aa, Homo Sapiens
LLQPQDPHL

SEQ ID NO: 658919 - protein, 9 aa, Homo Sapiens
EGDTNKRKK

SEQ ID NO: 658920 - protein, 9 aa, Homo Sapiens
ESEKGLESE

SEQ ID NO: 658921 - protein, 9 aa, Homo Sapiens
ELSWGKLYS

SEQ ID NO: 658922 - protein, 9 aa, Homo Sapiens
FHVSTRIRG

SEQ ID NO: 658923 - protein, 9 aa, Homo Sapiens
VDHELLSHK

SEQ ID NO: 658924 - protein, 9 aa, Homo Sapiens
GTYCTRLHE

SEQ ID NO: 658925 - protein, 9 aa, Homo Sapiens
SVSAGYPPV

SEQ ID NO: 658926 - protein, 9 aa, Homo Sapiens
LEEPVECRS

SEQ ID NO: 658927 - protein, 9 aa, Homo Sapiens
ANCSQTCRA

SEQ ID NO: 658928 - protein, 9 aa, Homo Sapiens
GEDLLLTVE

SEQ ID NO: 658929 - protein, 9 aa, Homo Sapiens
KIYPANANG

SEQ ID NO: 658930 - protein, 9 aa, Homo Sapiens
HGPRRAAVR

SEQ ID NO: 658931 - protein, 9 aa, Homo Sapiens
QSFCGCGYR

SEQ ID NO: 658932 - protein, 9 aa, Homo Sapiens
QLRALCHQL

SEQ ID NO: 658933 - protein, 9 aa, Homo Sapiens
KCAVCLERM

SEQ ID NO: 658934 - protein, 9 aa, Homo Sapiens
LVKIQVISA

SEQ ID NO: 658935 - protein, 9 aa, Homo Sapiens
NENCSTGPD

SEQ ID NO: 658936 - protein, 9 aa, Homo Sapiens
GLLLLLLVT

SEQ ID NO: 658937 - protein, 9 aa, Homo Sapiens
AVPQPSTSD

SEQ ID NO: 658938 - protein, 9 aa, Homo Sapiens
PGFSAPRIL

SEQ ID NO: 658939 - protein, 9 aa, Homo Sapiens
EKSRTVFSR

SEQ ID NO: 658940 - protein, 9 aa, Homo Sapiens
ELPGLDTMQ

SEQ ID NO: 658941 - protein, 9 aa, Homo Sapiens
DYSEMRPLD

SEQ ID NO: 658942 - protein, 9 aa, Homo Sapiens
RPFDETTYQ

SEQ ID NO: 658943 - protein, 9 aa, Homo Sapiens
AEEVWDDKQ

SEQ ID NO: 658944 - protein, 9 aa, Homo Sapiens
MESGDQPKR

SEQ ID NO: 658945 - protein, 9 aa, Homo Sapiens
TADQSANLT

SEQ ID NO: 658946 - protein, 9 aa, Homo Sapiens
DHELLSHKS

SEQ ID NO: 658947 - protein, 9 aa, Homo Sapiens
AYEAWRFTR

SEQ ID NO: 658948 - protein, 9 aa, Homo Sapiens
DGNDHSLII

SEQ ID NO: 658949 - protein, 9 aa, Homo Sapiens
SIAKQIKSE

SEQ ID NO: 658950 - protein, 9 aa, Homo Sapiens
IKSPTVGGG

SEQ ID NO: 658951 - protein, 9 aa, Homo Sapiens
YHKTKKLLP

SEQ ID NO: 658952 - protein, 9 aa, Homo Sapiens
KNGFNLFTV

SEQ ID NO: 658953 - protein, 9 aa, Homo Sapiens
LGKPFTAYQ

SEQ ID NO: 658954 - protein, 9 aa, Homo Sapiens
TSYYISFTG

SEQ ID NO: 658955 - protein, 9 aa, Homo Sapiens
RGPPGEALA

SEQ ID NO: 658956 - protein, 9 aa, Homo Sapiens
ITSMCSEGP

SEQ ID NO: 658957 - protein, 9 aa, Homo Sapiens
TMQRGGNNP

SEQ ID NO: 658958 - protein, 9 aa, Homo Sapiens
LGNNALKDI

SEQ ID NO: 658959 - protein, 9 aa, Homo Sapiens
FGGSGEGVD

SEQ ID NO: 658960 - protein, 9 aa, Homo Sapiens
GQTECACMD

SEQ ID NO: 658961 - protein, 9 aa, Homo Sapiens
ADVSEESRR

SEQ ID NO: 658962 - protein, 9 aa, Homo Sapiens
MSAIINQAG

SEQ ID NO: 658963 - protein, 9 aa, Homo Sapiens
FHVALADFM

SEQ ID NO: 658964 - protein, 9 aa, Homo Sapiens
ATILRIAST

SEQ ID NO: 658965 - protein, 9 aa, Homo Sapiens
LEPTVVDKV

SEQ ID NO: 658966 - protein, 9 aa, Homo Sapiens
AAAGWGREQ

SEQ ID NO: 658967 - protein, 9 aa, Homo Sapiens
DFTRAAERR

SEQ ID NO: 658968 - protein, 9 aa, Homo Sapiens
DGEKSRTVF

SEQ ID NO: 658969 - protein, 9 aa, Homo Sapiens
YEIFPEDYL

SEQ ID NO: 658970 - protein, 9 aa, Homo Sapiens
GHCQQGQKQ

SEQ ID NO: 658971 - protein, 9 aa, Homo Sapiens
NQAGATGVT

SEQ ID NO: 658972 - protein, 9 aa, Homo Sapiens
SPELRKPSW

SEQ ID NO: 658973 - protein, 9 aa, Homo Sapiens
IRGKLGLQE

SEQ ID NO: 658974 - protein, 9 aa, Homo Sapiens
EGKVETEGE

SEQ ID NO: 658975 - protein, 9 aa, Homo Sapiens
SESMVSHRR

SEQ ID NO: 658976 - protein, 9 aa, Homo Sapiens
ITKVSTTGS

SEQ ID NO: 658977 - protein, 9 aa, Homo Sapiens
TNLRKLQGP

SEQ ID NO: 658978 - protein, 9 aa, Homo Sapiens
GKVVKKYEE

SEQ ID NO: 658979 - protein, 9 aa, Homo Sapiens
VSAGYPPVT

SEQ ID NO: 658980 - protein, 9 aa, Homo Sapiens
AAEASSAGK

SEQ ID NO: 658981 - protein, 9 aa, Homo Sapiens
IQKEPMTTV

SEQ ID NO: 658982 - protein, 9 aa, Homo Sapiens
QGRAEGQGG

SEQ ID NO: 658983 - protein, 9 aa, Homo Sapiens
FTRAAERRQ

SEQ ID NO: 658984 - protein, 9 aa, Homo Sapiens
SSVSHCVPN

SEQ ID NO: 658985 - protein, 9 aa, Homo Sapiens
PFSSLEESP

SEQ ID NO: 658986 - protein, 9 aa, Homo Sapiens
LKQAKLPYA

SEQ ID NO: 658987 - protein, 9 aa, Homo Sapiens
TGQTECACM

SEQ ID NO: 658988 - protein, 9 aa, Homo Sapiens
GIKGPVAVI

SEQ ID NO: 658989 - protein, 9 aa, Homo Sapiens
SGQLVNVCA

SEQ ID NO: 658990 - protein, 9 aa, Homo Sapiens
DLQTADYPV

SEQ ID NO: 658991 - protein, 9 aa, Homo Sapiens
YCFRKDIDK

SEQ ID NO: 658992 - protein, 9 aa, Homo Sapiens
CSSNTEFKS

SEQ ID NO: 658993 - protein, 9 aa, Homo Sapiens
SLLNSQIQR

SEQ ID NO: 658994 - protein, 9 aa, Homo Sapiens
VIEERDSGS

SEQ ID NO: 658995 - protein, 9 aa, Homo Sapiens
LMQALKDLD

SEQ ID NO: 658996 - protein, 9 aa, Homo Sapiens
RQNCKVYPS

SEQ ID NO: 658997 - protein, 9 aa, Homo Sapiens
ASVTLVLQS

SEQ ID NO: 658998 - protein, 9 aa, Homo Sapiens
LSKAQLRQF

SEQ ID NO: 658999 - protein, 9 aa, Homo Sapiens
DQAYRCTIK

SEQ ID NO: 659000 - protein, 9 aa, Homo Sapiens
YQCMARKSA

SEQ ID NO: 659001 - protein, 9 aa, Homo Sapiens
IESTVDVGQ

SEQ ID NO: 659002 - protein, 9 aa, Homo Sapiens
RQIPGAGRS

SEQ ID NO: 659003 - protein, 9 aa, Homo Sapiens
YEAWRFTRI

SEQ ID NO: 659004 - protein, 9 aa, Homo Sapiens
MLGIMKELS

SEQ ID NO: 659005 - protein, 9 aa, Homo Sapiens
KSRTVFSRK

SEQ ID NO: 659006 - protein, 9 aa, Homo Sapiens
EEGKVETEG

SEQ ID NO: 659007 - protein, 9 aa, Homo Sapiens
SFLFLLLCY

SEQ ID NO: 659008 - protein, 9 aa, Homo Sapiens
LVFAALVSY

SEQ ID NO: 659009 - protein, 9 aa, Homo Sapiens
HQRLHTVER

SEQ ID NO: 659010 - protein, 9 aa, Homo Sapiens
SFRQNCKVY

SEQ ID NO: 659011 - protein, 9 aa, Homo Sapiens
PTISYCGVD

SEQ ID NO: 659012 - protein, 9 aa, Homo Sapiens
FSMVRNLML

SEQ ID NO: 659013 - protein, 9 aa, Homo Sapiens
PTSITTLES

SEQ ID NO: 659014 - protein, 9 aa, Homo Sapiens
TLKQVRIQV

SEQ ID NO: 659015 - protein, 9 aa, Homo Sapiens
LYGTYCTRL

SEQ ID NO: 659016 - protein, 9 aa, Homo Sapiens
FRQNCKVYP

SEQ ID NO: 659017 - protein, 9 aa, Homo Sapiens
CSLLNSQIQ

SEQ ID NO: 659018 - protein, 9 aa, Homo Sapiens
GSAIVVVLN

SEQ ID NO: 659019 - protein, 9 aa, Homo Sapiens
WGMLNFLSH

SEQ ID NO: 659020 - protein, 9 aa, Homo Sapiens
EVKVGIYNN

SEQ ID NO: 659021 - protein, 9 aa, Homo Sapiens
AWEARREHG

SEQ ID NO: 659022 - protein, 9 aa, Homo Sapiens
LKDLQTADY

SEQ ID NO: 659023 - protein, 9 aa, Homo Sapiens
LFPHQEAIP

SEQ ID NO: 659024 - protein, 9 aa, Homo Sapiens
KSETLIRAT

SEQ ID NO: 659025 - protein, 9 aa, Homo Sapiens
ADHLLIVAE

SEQ ID NO: 659026 - protein, 9 aa, Homo Sapiens
KWIQKEPMT

SEQ ID NO: 659027 - protein, 9 aa, Homo Sapiens
HDSCAGLQG

SEQ ID NO: 659028 - protein, 9 aa, Homo Sapiens
RREHGPRRA

SEQ ID NO: 659029 - protein, 9 aa, Homo Sapiens
FDSTSDPDT

SEQ ID NO: 659030 - protein, 9 aa, Homo Sapiens
GAGRSTPEE

SEQ ID NO: 659031 - protein, 9 aa, Homo Sapiens
DHVECLDDE

SEQ ID NO: 659032 - protein, 9 aa, Homo Sapiens
SPLTAHRGG

SEQ ID NO: 659033 - protein, 9 aa, Homo Sapiens
AFENMLESQ

SEQ ID NO: 659034 - protein, 9 aa, Homo Sapiens
DCPWYNQGF

SEQ ID NO: 659035 - protein, 9 aa, Homo Sapiens
NLQHLRGLP

SEQ ID NO: 659036 - protein, 9 aa, Homo Sapiens
SVWSQQCSR

SEQ ID NO: 659037 - protein, 9 aa, Homo Sapiens
DGGDPVLSS

SEQ ID NO: 659038 - protein, 9 aa, Homo Sapiens
PWRRVRSVS

SEQ ID NO: 659039 - protein, 9 aa, Homo Sapiens
VHHGSYHPN

SEQ ID NO: 659040 - protein, 9 aa, Homo Sapiens
HLVHHGSYH

SEQ ID NO: 659041 - protein, 9 aa, Homo Sapiens
HRKHLRTDA

SEQ ID NO: 659042 - protein, 9 aa, Homo Sapiens
GACYNKALD

SEQ ID NO: 659043 - protein, 9 aa, Homo Sapiens
VSTSCPNHF

SEQ ID NO: 659044 - protein, 9 aa, Homo Sapiens
LTVEVSWRP

SEQ ID NO: 659045 - protein, 9 aa, Homo Sapiens
PVCCHMEAQ

SEQ ID NO: 659046 - protein, 9 aa, Homo Sapiens
VYDVMDKSH

SEQ ID NO: 659047 - protein, 9 aa, Homo Sapiens
NVSQHALDL

SEQ ID NO: 659048 - protein, 9 aa, Homo Sapiens
KDGNVLPFP

SEQ ID NO: 659049 - protein, 9 aa, Homo Sapiens
PKPRGLFMH

SEQ ID NO: 659050 - protein, 9 aa, Homo Sapiens
VLPGGSASV

SEQ ID NO: 659051 - protein, 9 aa, Homo Sapiens
GLIPVRVLR

SEQ ID NO: 659052 - protein, 9 aa, Homo Sapiens
FLFLLLCYG

SEQ ID NO: 659053 - protein, 9 aa, Homo Sapiens
KVYLEDFYT

SEQ ID NO: 659054 - protein, 9 aa, Homo Sapiens
EKRWVKFDG

SEQ ID NO: 659055 - protein, 9 aa, Homo Sapiens
LLKLEEEIA

SEQ ID NO: 659056 - protein, 9 aa, Homo Sapiens
ASVRPSSSV

SEQ ID NO: 659057 - protein, 9 aa, Homo Sapiens
KNVVGIEGF

SEQ ID NO: 659058 - protein, 9 aa, Homo Sapiens
EMYDSDAVG

SEQ ID NO: 659059 - protein, 9 aa, Homo Sapiens
LLKDTEPGL

SEQ ID NO: 659060 - protein, 9 aa, Homo Sapiens
YQNSPGSDL

SEQ ID NO: 659061 - protein, 9 aa, Homo Sapiens
IALIFGIAL

SEQ ID NO: 659062 - protein, 9 aa, Homo Sapiens
LINNIVDIR

SEQ ID NO: 659063 - protein, 9 aa, Homo Sapiens
ALCHQLLRP

SEQ ID NO: 659064 - protein, 9 aa, Homo Sapiens
PSHWKLLRQ

SEQ ID NO: 659065 - protein, 9 aa, Homo Sapiens
ETGQTECAC

SEQ ID NO: 659066 - protein, 9 aa, Homo Sapiens
DTMLKEKKL

SEQ ID NO: 659067 - protein, 9 aa, Homo Sapiens
YGTYCTRLH

SEQ ID NO: 659068 - protein, 9 aa, Homo Sapiens
FLYDAIGTL

SEQ ID NO: 659069 - protein, 9 aa, Homo Sapiens
REESTSKKL

SEQ ID NO: 659070 - protein, 9 aa, Homo Sapiens
LEDWPRRVK

SEQ ID NO: 659071 - protein, 9 aa, Homo Sapiens
FFMGKVVKK

SEQ ID NO: 659072 - protein, 9 aa, Homo Sapiens
LPLLVPNPF

SEQ ID NO: 659073 - protein, 9 aa, Homo Sapiens
DFKVIPTFA

SEQ ID NO: 659074 - protein, 9 aa, Homo Sapiens
VNLQTFGLE

SEQ ID NO: 659075 - protein, 9 aa, Homo Sapiens
ASTPGDRDS

SEQ ID NO: 659076 - protein, 9 aa, Homo Sapiens
EERTSRVLH

SEQ ID NO: 659077 - protein, 9 aa, Homo Sapiens
QLLKDTEPG

SEQ ID NO: 659078 - protein, 9 aa, Homo Sapiens
LRPYIEYSS

SEQ ID NO: 659079 - protein, 9 aa, Homo Sapiens
PHLFPHQEA

SEQ ID NO: 659080 - protein, 9 aa, Homo Sapiens
SEITKVSTT

SEQ ID NO: 659081 - protein, 9 aa, Homo Sapiens
NSKQKCSLK

SEQ ID NO: 659082 - protein, 9 aa, Homo Sapiens
PNVSTITEE

SEQ ID NO: 659083 - protein, 9 aa, Homo Sapiens
REQLICSLL

SEQ ID NO: 659084 - protein, 9 aa, Homo Sapiens
DAEDTLPGS

SEQ ID NO: 659085 - protein, 9 aa, Homo Sapiens
TEHPQMGSP

SEQ ID NO: 659086 - protein, 9 aa, Homo Sapiens
SIHLEPPKT

SEQ ID NO: 659087 - protein, 9 aa, Homo Sapiens
PRVSSIHLE

SEQ ID NO: 659088 - protein, 9 aa, Homo Sapiens
QLLRPDLNT

SEQ ID NO: 659089 - protein, 9 aa, Homo Sapiens
QTGYLGLAN

SEQ ID NO: 659090 - protein, 9 aa, Homo Sapiens
LLGSCFTYS

SEQ ID NO: 659091 - protein, 9 aa, Homo Sapiens
THGAWANWG

SEQ ID NO: 659092 - protein, 9 aa, Homo Sapiens
VLRSWLAVN

SEQ ID NO: 659093 - protein, 9 aa, Homo Sapiens
QALKDLDYL

SEQ ID NO: 659094 - protein, 9 aa, Homo Sapiens
EPMTTVRGL

SEQ ID NO: 659095 - protein, 9 aa, Homo Sapiens
REAADHLLI

SEQ ID NO: 659096 - protein, 9 aa, Homo Sapiens
IDKVETFLR

SEQ ID NO: 659097 - protein, 9 aa, Homo Sapiens
CATYVKVNI

SEQ ID NO: 659098 - protein, 9 aa, Homo Sapiens
YIEYSSYNE

SEQ ID NO: 659099 - protein, 9 aa, Homo Sapiens
ILCATYVKV

SEQ ID NO: 659100 - protein, 9 aa, Homo Sapiens
INKTKVLKI

SEQ ID NO: 659101 - protein, 9 aa, Homo Sapiens
GEENASFSH

SEQ ID NO: 659102 - protein, 9 aa, Homo Sapiens
VVSFPVITA

SEQ ID NO: 659103 - protein, 9 aa, Homo Sapiens
LTVYDVMDK

SEQ ID NO: 659104 - protein, 9 aa, Homo Sapiens
SDIEDHVEC

SEQ ID NO: 659105 - protein, 9 aa, Homo Sapiens
LQTADYPVP

SEQ ID NO: 659106 - protein, 9 aa, Homo Sapiens
SKSETLIRA

SEQ ID NO: 659107 - protein, 9 aa, Homo Sapiens
LSAPKPRGL

SEQ ID NO: 659108 - protein, 9 aa, Homo Sapiens
NMTADQSAN

SEQ ID NO: 659109 - protein, 9 aa, Homo Sapiens
TPFEVKVGI

SEQ ID NO: 659110 - protein, 9 aa, Homo Sapiens
SPGSDLSNQ

SEQ ID NO: 659111 - protein, 9 aa, Homo Sapiens
VNVCAPMVR

SEQ ID NO: 659112 - protein, 9 aa, Homo Sapiens
VITDIEMVH

SEQ ID NO: 659113 - protein, 9 aa, Homo Sapiens
VVVEMYDSD

SEQ ID NO: 659114 - protein, 9 aa, Homo Sapiens
GHPVASVVT

SEQ ID NO: 659115 - protein, 9 aa, Homo Sapiens
EIIRNEGIK

SEQ ID NO: 659116 - protein, 9 aa, Homo Sapiens
GMLNKRCLH

SEQ ID NO: 659117 - protein, 9 aa, Homo Sapiens
EKWTMGKNG

SEQ ID NO: 659118 - protein, 9 aa, Homo Sapiens
LVSYFSQTT

SEQ ID NO: 659119 - protein, 9 aa, Homo Sapiens
EDWPRRVKV

SEQ ID NO: 659120 - protein, 9 aa, Homo Sapiens
RKVYLEDFY

SEQ ID NO: 659121 - protein, 9 aa, Homo Sapiens
CFSNNGMAL

SEQ ID NO: 659122 - protein, 9 aa, Homo Sapiens
YDCFDFSLS

SEQ ID NO: 659123 - protein, 9 aa, Homo Sapiens
QTFGLEVCL

SEQ ID NO: 659124 - protein, 9 aa, Homo Sapiens
KEKNDIDHY

SEQ ID NO: 659125 - protein, 9 aa, Homo Sapiens
KKRQNVPVI

SEQ ID NO: 659126 - protein, 9 aa, Homo Sapiens
AVCHKLLSK

SEQ ID NO: 659127 - protein, 9 aa, Homo Sapiens
STTHIRVTV

SEQ ID NO: 659128 - protein, 9 aa, Homo Sapiens
GCCPVWAPS

SEQ ID NO: 659129 - protein, 9 aa, Homo Sapiens
NQEYEDLKA

SEQ ID NO: 659130 - protein, 9 aa, Homo Sapiens
NGSLLVIVH

SEQ ID NO: 659131 - protein, 9 aa, Homo Sapiens
LLVKIQVIS

SEQ ID NO: 659132 - protein, 9 aa, Homo Sapiens
SDQEPGANE

SEQ ID NO: 659133 - protein, 9 aa, Homo Sapiens
EKPKREKTP

SEQ ID NO: 659134 - protein, 9 aa, Homo Sapiens
YFHGCLVDG

SEQ ID NO: 659135 - protein, 9 aa, Homo Sapiens
TAYQAFPNT

SEQ ID NO: 659136 - protein, 9 aa, Homo Sapiens
RHNQTLSLS

SEQ ID NO: 659137 - protein, 9 aa, Homo Sapiens
RFFPDDSAG

SEQ ID NO: 659138 - protein, 9 aa, Homo Sapiens
EWIRQISES

SEQ ID NO: 659139 - protein, 9 aa, Homo Sapiens
VWAMLFFWM

SEQ ID NO: 659140 - protein, 9 aa, Homo Sapiens
EACKAYLVG

SEQ ID NO: 659141 - protein, 9 aa, Homo Sapiens
TQWETAAPA

SEQ ID NO: 659142 - protein, 9 aa, Homo Sapiens
TEKSVLNCV

SEQ ID NO: 659143 - protein, 9 aa, Homo Sapiens
TDIEMVHEG

SEQ ID NO: 659144 - protein, 9 aa, Homo Sapiens
SHCVPNVST

SEQ ID NO: 659145 - protein, 9 aa, Homo Sapiens
LSLSIRKQI

SEQ ID NO: 659146 - protein, 9 aa, Homo Sapiens
CLDDEEEGE

SEQ ID NO: 659147 - protein, 9 aa, Homo Sapiens
KTISRAESG

SEQ ID NO: 659148 - protein, 9 aa, Homo Sapiens
SRQTGCKNV

SEQ ID NO: 659149 - protein, 9 aa, Homo Sapiens
KVNYNFEHE

SEQ ID NO: 659150 - protein, 9 aa, Homo Sapiens
LFDSTSDPD

SEQ ID NO: 659151 - protein, 9 aa, Homo Sapiens
LLEIYKMLG

SEQ ID NO: 659152 - protein, 9 aa, Homo Sapiens
GLDTMQRGG

SEQ ID NO: 659153 - protein, 9 aa, Homo Sapiens
FVFDGNDHS

SEQ ID NO: 659154 - protein, 9 aa, Homo Sapiens
ASFSHATTS

SEQ ID NO: 659155 - protein, 9 aa, Homo Sapiens
EERQNSYHS

SEQ ID NO: 659156 - protein, 9 aa, Homo Sapiens
ACLPAASVR

SEQ ID NO: 659157 - protein, 9 aa, Homo Sapiens
CLPAASVRP

SEQ ID NO: 659158 - protein, 9 aa, Homo Sapiens
EERLAPYDA

SEQ ID NO: 659159 - protein, 9 aa, Homo Sapiens
DEMLRMHHA

SEQ ID NO: 659160 - protein, 9 aa, Homo Sapiens
IIVCGDYGR

SEQ ID NO: 659161 - protein, 9 aa, Homo Sapiens
RRRFFPDDS

SEQ ID NO: 659162 - protein, 9 aa, Homo Sapiens
ELIVLEKPF

SEQ ID NO: 659163 - protein, 9 aa, Homo Sapiens
VRIQVLTGN

SEQ ID NO: 659164 - protein, 9 aa, Homo Sapiens
TVFSRKKPA

SEQ ID NO: 659165 - protein, 9 aa, Homo Sapiens
WGEGEDDEP

SEQ ID NO: 659166 - protein, 9 aa, Homo Sapiens
TAGLPSFLF

SEQ ID NO: 659167 - protein, 9 aa, Homo Sapiens
QYLEFSPIE

SEQ ID NO: 659168 - protein, 9 aa, Homo Sapiens
VMGKAHGLI

SEQ ID NO: 659169 - protein, 9 aa, Homo Sapiens
GESDLDREA

SEQ ID NO: 659170 - protein, 9 aa, Homo Sapiens
SKPIGVRSV

SEQ ID NO: 659171 - protein, 9 aa, Homo Sapiens
MTADQSANL

SEQ ID NO: 659172 - protein, 9 aa, Homo Sapiens
GDAQPESEG

SEQ ID NO: 659173 - protein, 9 aa, Homo Sapiens
PFCPHKQID

SEQ ID NO: 659174 - protein, 9 aa, Homo Sapiens
EMVHEGWWR

SEQ ID NO: 659175 - protein, 9 aa, Homo Sapiens
FTPLGALSV

SEQ ID NO: 659176 - protein, 9 aa, Homo Sapiens
KVNIRDIDK

SEQ ID NO: 659177 - protein, 9 aa, Homo Sapiens
MKRWICNIP

SEQ ID NO: 659178 - protein, 9 aa, Homo Sapiens
PNQEYEDLK

SEQ ID NO: 659179 - protein, 9 aa, Homo Sapiens
KYQHKNLLF

SEQ ID NO: 659180 - protein, 9 aa, Homo Sapiens
VECRSESRL

SEQ ID NO: 659181 - protein, 9 aa, Homo Sapiens
ALMQALKDL

SEQ ID NO: 659182 - protein, 9 aa, Homo Sapiens
GCLALLVAS

SEQ ID NO: 659183 - protein, 9 aa, Homo Sapiens
LNMKRWICN

SEQ ID NO: 659184 - protein, 9 aa, Homo Sapiens
YCEFVNRVN

SEQ ID NO: 659185 - protein, 9 aa, Homo Sapiens
HSAIMLGIM

SEQ ID NO: 659186 - protein, 9 aa, Homo Sapiens
GKAHGLITD

SEQ ID NO: 659187 - protein, 9 aa, Homo Sapiens
KDIQTGAFN

SEQ ID NO: 659188 - protein, 9 aa, Homo Sapiens
LADICLDTP

SEQ ID NO: 659189 - protein, 9 aa, Homo Sapiens
QGTLDAFFE

SEQ ID NO: 659190 - protein, 9 aa, Homo Sapiens
THNPEFTTF

SEQ ID NO: 659191 - protein, 9 aa, Homo Sapiens
IGSSGKAFK

SEQ ID NO: 659192 - protein, 9 aa, Homo Sapiens
SSLEESPLS

SEQ ID NO: 659193 - protein, 9 aa, Homo Sapiens
SIPGPTANG

SEQ ID NO: 659194 - protein, 9 aa, Homo Sapiens
IYPANANGM

SEQ ID NO: 659195 - protein, 9 aa, Homo Sapiens
PATVFTPLG

SEQ ID NO: 659196 - protein, 9 aa, Homo Sapiens
KRKNPAPQC

SEQ ID NO: 659197 - protein, 9 aa, Homo Sapiens
WVSIWDPRR

SEQ ID NO: 659198 - protein, 9 aa, Homo Sapiens
FCCSRHFWT

SEQ ID NO: 659199 - protein, 9 aa, Homo Sapiens
WSQQCSRPS

SEQ ID NO: 659200 - protein, 9 aa, Homo Sapiens
KDHTYKFHP

SEQ ID NO: 659201 - protein, 9 aa, Homo Sapiens
ITTLESAPS

SEQ ID NO: 659202 - protein, 9 aa, Homo Sapiens
DHTVQEADE

SEQ ID NO: 659203 - protein, 9 aa, Homo Sapiens
GRTSENGFN

SEQ ID NO: 659204 - protein, 9 aa, Homo Sapiens
ATEGDCGLY

SEQ ID NO: 659205 - protein, 9 aa, Homo Sapiens
RSTVSYRYK

SEQ ID NO: 659206 - protein, 9 aa, Homo Sapiens
LQLLRCFPL

SEQ ID NO: 659207 - protein, 9 aa, Homo Sapiens
VKNVVGIEG

SEQ ID NO: 659208 - protein, 9 aa, Homo Sapiens
LIQNEQCPQ

SEQ ID NO: 659209 - protein, 9 aa, Homo Sapiens
KQIDDFLCE

SEQ ID NO: 659210 - protein, 9 aa, Homo Sapiens
EPGANEPMA

SEQ ID NO: 659211 - protein, 9 aa, Homo Sapiens
CAGLQGRAE

SEQ ID NO: 659212 - protein, 9 aa, Homo Sapiens
EGDCGLYRC

SEQ ID NO: 659213 - protein, 9 aa, Homo Sapiens
ATENNVIKS

SEQ ID NO: 659214 - protein, 9 aa, Homo Sapiens
ALINNIVDI

SEQ ID NO: 659215 - protein, 9 aa, Homo Sapiens
IIFVHLIIF

SEQ ID NO: 659216 - protein, 9 aa, Homo Sapiens
SGKSPASST

SEQ ID NO: 659217 - protein, 9 aa, Homo Sapiens
CMARKSAGE

SEQ ID NO: 659218 - protein, 9 aa, Homo Sapiens
NCSQTCRAT

SEQ ID NO: 659219 - protein, 9 aa, Homo Sapiens
LHQDLLRLP

SEQ ID NO: 659220 - protein, 9 aa, Homo Sapiens
HLLIVAEGS

SEQ ID NO: 659221 - protein, 9 aa, Homo Sapiens
DMVIIGETT

SEQ ID NO: 659222 - protein, 9 aa, Homo Sapiens
VTYSLLQPQ

SEQ ID NO: 659223 - protein, 9 aa, Homo Sapiens
DLEEVEAPG

SEQ ID NO: 659224 - protein, 9 aa, Homo Sapiens
LLLVNLQTF

SEQ ID NO: 659225 - protein, 9 aa, Homo Sapiens
ANGMVEKWL

SEQ ID NO: 659226 - protein, 9 aa, Homo Sapiens
YKMLGEEED

SEQ ID NO: 659227 - protein, 9 aa, Homo Sapiens
MVAGIENND

SEQ ID NO: 659228 - protein, 9 aa, Homo Sapiens
PTQTEGGFH

SEQ ID NO: 659229 - protein, 9 aa, Homo Sapiens
RMHHALKEA

SEQ ID NO: 659230 - protein, 9 aa, Homo Sapiens
KCINGGKVL

SEQ ID NO: 659231 - protein, 9 aa, Homo Sapiens
WDPVRATIG

SEQ ID NO: 659232 - protein, 9 aa, Homo Sapiens
VKNKQEFMD

SEQ ID NO: 659233 - protein, 9 aa, Homo Sapiens
PTHGAWANW

SEQ ID NO: 659234 - protein, 9 aa, Homo Sapiens
ITAWYNKTQ

SEQ ID NO: 659235 - protein, 9 aa, Homo Sapiens
PFTSQIEFS

SEQ ID NO: 659236 - protein, 9 aa, Homo Sapiens
DQEEEEEGD

SEQ ID NO: 659237 - protein, 9 aa, Homo Sapiens
RYMPHLESR

SEQ ID NO: 659238 - protein, 9 aa, Homo Sapiens
SLLQPQDPH

SEQ ID NO: 659239 - protein, 9 aa, Homo Sapiens
FWMLFTLGL

SEQ ID NO: 659240 - protein, 9 aa, Homo Sapiens
TDLLEDPDF

SEQ ID NO: 659241 - protein, 9 aa, Homo Sapiens
LNCVYKVLH

SEQ ID NO: 659242 - protein, 9 aa, Homo Sapiens
NFNGRFSLD

SEQ ID NO: 659243 - protein, 9 aa, Homo Sapiens
YEDLKARSR

SEQ ID NO: 659244 - protein, 9 aa, Homo Sapiens
HPDGSAIVV

SEQ ID NO: 659245 - protein, 9 aa, Homo Sapiens
LMHPDGSAI

SEQ ID NO: 659246 - protein, 9 aa, Homo Sapiens
MLESQQGLF

SEQ ID NO: 659247 - protein, 9 aa, Homo Sapiens
GGKGVRSLS

SEQ ID NO: 659248 - protein, 9 aa, Homo Sapiens
LSNAKKQAR

SEQ ID NO: 659249 - protein, 9 aa, Homo Sapiens
VCHKLLSKQ

SEQ ID NO: 659250 - protein, 9 aa, Homo Sapiens
DLMKFQVKR

SEQ ID NO: 659251 - protein, 9 aa, Homo Sapiens
SRHFWTKIC

SEQ ID NO: 659252 - protein, 9 aa, Homo Sapiens
YAFAPATVF

SEQ ID NO: 659253 - protein, 9 aa, Homo Sapiens
AQLLLVNLQ

SEQ ID NO: 659254 - protein, 9 aa, Homo Sapiens
VCRPKCING

SEQ ID NO: 659255 - protein, 9 aa, Homo Sapiens
RVTRLLVSV

SEQ ID NO: 659256 - protein, 9 aa, Homo Sapiens
FATENNVIK

SEQ ID NO: 659257 - protein, 9 aa, Homo Sapiens
LHTVERPYE

SEQ ID NO: 659258 - protein, 9 aa, Homo Sapiens
MHHALKEAL

SEQ ID NO: 659259 - protein, 9 aa, Homo Sapiens
PKSTDDGSL

SEQ ID NO: 659260 - protein, 9 aa, Homo Sapiens
DLDSMDTEK

SEQ ID NO: 659261 - protein, 9 aa, Homo Sapiens
YDVMDKSHD

SEQ ID NO: 659262 - protein, 9 aa, Homo Sapiens
SLGACYNKA

SEQ ID NO: 659263 - protein, 9 aa, Homo Sapiens
CDQKDGNVL

SEQ ID NO: 659264 - protein, 9 aa, Homo Sapiens
FSSLEESPL

SEQ ID NO: 659265 - protein, 9 aa, Homo Sapiens
DRVTRLLVS

SEQ ID NO: 659266 - protein, 9 aa, Homo Sapiens
KWHLVHHGS

SEQ ID NO: 659267 - protein, 9 aa, Homo Sapiens
TLRLEVVES

SEQ ID NO: 659268 - protein, 9 aa, Homo Sapiens
RWVSIWDPR

SEQ ID NO: 659269 - protein, 9 aa, Homo Sapiens
RTVFSRKKP

SEQ ID NO: 659270 - protein, 9 aa, Homo Sapiens
FEKRWVKFD

SEQ ID NO: 659271 - protein, 9 aa, Homo Sapiens
TLHRRNTSV

SEQ ID NO: 659272 - protein, 9 aa, Homo Sapiens
ERTSRVLHA

SEQ ID NO: 659273 - protein, 9 aa, Homo Sapiens
KRLQDDPPA

SEQ ID NO: 659274 - protein, 9 aa, Homo Sapiens
SAPKPRGLF

SEQ ID NO: 659275 - protein, 9 aa, Homo Sapiens
VHHSDVPVQ

SEQ ID NO: 659276 - protein, 9 aa, Homo Sapiens
IHLEPPKTR

SEQ ID NO: 659277 - protein, 9 aa, Homo Sapiens
GPIGSSGKA

SEQ ID NO: 659278 - protein, 9 aa, Homo Sapiens
IIVVRTNLR

SEQ ID NO: 659279 - protein, 9 aa, Homo Sapiens
RIRGDGRKY

SEQ ID NO: 659280 - protein, 9 aa, Homo Sapiens
FVKLKSCMP

SEQ ID NO: 659281 - protein, 9 aa, Homo Sapiens
VKNATEIEV

SEQ ID NO: 659282 - protein, 9 aa, Homo Sapiens
SLVAEFRRT

SEQ ID NO: 659283 - protein, 9 aa, Homo Sapiens
VPGFSAPRI

SEQ ID NO: 659284 - protein, 9 aa, Homo Sapiens
SGFQFVSGW

SEQ ID NO: 659285 - protein, 9 aa, Homo Sapiens
DVHHSDVPV

SEQ ID NO: 659286 - protein, 9 aa, Homo Sapiens
AEASSAGKK

SEQ ID NO: 659287 - protein, 9 aa, Homo Sapiens
GRRSKFGIK

SEQ ID NO: 659288 - protein, 9 aa, Homo Sapiens
KVCRPKCIN

SEQ ID NO: 659289 - protein, 9 aa, Homo Sapiens
KRFTSMKEH

SEQ ID NO: 659290 - protein, 9 aa, Homo Sapiens
CLVQRDPAT

SEQ ID NO: 659291 - protein, 9 aa, Homo Sapiens
CEFVTQFVY

SEQ ID NO: 659292 - protein, 9 aa, Homo Sapiens
DWARCEARE

SEQ ID NO: 659293 - protein, 9 aa, Homo Sapiens
FHSGQLVNV

SEQ ID NO: 659294 - protein, 9 aa, Homo Sapiens
CCPVWAPSM

SEQ ID NO: 659295 - protein, 9 aa, Homo Sapiens
CGQARCGQA

SEQ ID NO: 659296 - protein, 9 aa, Homo Sapiens
EARREHGPR

SEQ ID NO: 659297 - protein, 9 aa, Homo Sapiens
DLAIKHSIP

SEQ ID NO: 659298 - protein, 9 aa, Homo Sapiens
CHKLLSKQR

SEQ ID NO: 659299 - protein, 9 aa, Homo Sapiens
PGEALAGMD

SEQ ID NO: 659300 - protein, 9 aa, Homo Sapiens
LSTCFFLCF

SEQ ID NO: 659301 - protein, 9 aa, Homo Sapiens
GKVLQIIVC

SEQ ID NO: 659302 - protein, 9 aa, Homo Sapiens
TSENGFNFN

SEQ ID NO: 659303 - protein, 9 aa, Homo Sapiens
EIKNPEIWE

SEQ ID NO: 659304 - protein, 9 aa, Homo Sapiens
SQRIVLERI

SEQ ID NO: 659305 - protein, 9 aa, Homo Sapiens
LSRLLFIGD

SEQ ID NO: 659306 - protein, 9 aa, Homo Sapiens
LGGLAGRFH

SEQ ID NO: 659307 - protein, 9 aa, Homo Sapiens
GNGTFVDAA

SEQ ID NO: 659308 - protein, 9 aa, Homo Sapiens
LSAVVSFPV

SEQ ID NO: 659309 - protein, 9 aa, Homo Sapiens
IGETTSHVP

SEQ ID NO: 659310 - protein, 9 aa, Homo Sapiens
MIEHVDYSE

SEQ ID NO: 659311 - protein, 9 aa, Homo Sapiens
DKEDSAWKP

SEQ ID NO: 659312 - protein, 9 aa, Homo Sapiens
CTGCLALLV

SEQ ID NO: 659313 - protein, 9 aa, Homo Sapiens
KEDTNHNQA

SEQ ID NO: 659314 - protein, 9 aa, Homo Sapiens
GAWANWGPW

SEQ ID NO: 659315 - protein, 9 aa, Homo Sapiens
PKREKTPSE

SEQ ID NO: 659316 - protein, 9 aa, Homo Sapiens
SQPSDSWYK

SEQ ID NO: 659317 - protein, 9 aa, Homo Sapiens
TSLNLANLL

SEQ ID NO: 659318 - protein, 9 aa, Homo Sapiens
LDTMLKEKK

SEQ ID NO: 659319 - protein, 9 aa, Homo Sapiens
DSCAGLQGR

SEQ ID NO: 659320 - protein, 9 aa, Homo Sapiens
ESTSKKLAG

SEQ ID NO: 659321 - protein, 9 aa, Homo Sapiens
SPHEPSKSE

SEQ ID NO: 659322 - protein, 9 aa, Homo Sapiens
IAKQIKSEV

SEQ ID NO: 659323 - protein, 9 aa, Homo Sapiens
KVFGSKKRR

SEQ ID NO: 659324 - protein, 9 aa, Homo Sapiens
WQAVEPWDI

SEQ ID NO: 659325 - protein, 9 aa, Homo Sapiens
SAGYPPVTV

SEQ ID NO: 659326 - protein, 9 aa, Homo Sapiens
WICNIPRAM

SEQ ID NO: 659327 - protein, 9 aa, Homo Sapiens
RLAQHLEDW

SEQ ID NO: 659328 - protein, 9 aa, Homo Sapiens
YKESISVSS

SEQ ID NO: 659329 - protein, 9 aa, Homo Sapiens
FPHQEAIPF

SEQ ID NO: 659330 - protein, 9 aa, Homo Sapiens
GEEVGELSW

SEQ ID NO: 659331 - protein, 9 aa, Homo Sapiens
FPVITAGPG

SEQ ID NO: 659332 - protein, 9 aa, Homo Sapiens
EDAALCRTY

SEQ ID NO: 659333 - protein, 9 aa, Homo Sapiens
NVSTSCPNH

SEQ ID NO: 659334 - protein, 9 aa, Homo Sapiens
HSGQLVNVC

SEQ ID NO: 659335 - protein, 9 aa, Homo Sapiens
EIPRWKGGK

SEQ ID NO: 659336 - protein, 9 aa, Homo Sapiens
SDSWYKDYD

SEQ ID NO: 659337 - protein, 9 aa, Homo Sapiens
QHKNLLFLY

SEQ ID NO: 659338 - protein, 9 aa, Homo Sapiens
PQGKRMFEK

SEQ ID NO: 659339 - protein, 9 aa, Homo Sapiens
CGLYRCVVE

SEQ ID NO: 659340 - protein, 9 aa, Homo Sapiens
FRFFSMVRN

SEQ ID NO: 659341 - protein, 9 aa, Homo Sapiens
NPRDSTDEG

SEQ ID NO: 659342 - protein, 9 aa, Homo Sapiens
LRAIKQRLL

SEQ ID NO: 659343 - protein, 9 aa, Homo Sapiens
LRCFPLDIR

SEQ ID NO: 659344 - protein, 9 aa, Homo Sapiens
LLESQLETQ

SEQ ID NO: 659345 - protein, 9 aa, Homo Sapiens
SVKTAAKGG

SEQ ID NO: 659346 - protein, 9 aa, Homo Sapiens
HSSIAKQIK

SEQ ID NO: 659347 - protein, 9 aa, Homo Sapiens
KLEDDWARC

SEQ ID NO: 659348 - protein, 9 aa, Homo Sapiens
PHEPSKSET

SEQ ID NO: 659349 - protein, 9 aa, Homo Sapiens
SLSIRKQIL

SEQ ID NO: 659350 - protein, 9 aa, Homo Sapiens
WIIYKESIS

SEQ ID NO: 659351 - protein, 9 aa, Homo Sapiens
LEQLLLYKF

SEQ ID NO: 659352 - protein, 9 aa, Homo Sapiens
ENMLESQQG

SEQ ID NO: 659353 - protein, 9 aa, Homo Sapiens
LVIVHAPNL

SEQ ID NO: 659354 - protein, 9 aa, Homo Sapiens
WATAGLPSF

SEQ ID NO: 659355 - protein, 9 aa, Homo Sapiens
NWGPWTPCS

SEQ ID NO: 659356 - protein, 9 aa, Homo Sapiens
GSGCCPVWA

SEQ ID NO: 659357 - protein, 9 aa, Homo Sapiens
TVNLQFPFQ

SEQ ID NO: 659358 - protein, 9 aa, Homo Sapiens
NRRLILTII

SEQ ID NO: 659359 - protein, 9 aa, Homo Sapiens
FRCKLCENS

SEQ ID NO: 659360 - protein, 9 aa, Homo Sapiens
VAVAVKPFV

SEQ ID NO: 659361 - protein, 9 aa, Homo Sapiens
NGTFVDAAA

SEQ ID NO: 659362 - protein, 9 aa, Homo Sapiens
TRAAERRQK

SEQ ID NO: 659363 - protein, 9 aa, Homo Sapiens
EIMKKPEPG

SEQ ID NO: 659364 - protein, 9 aa, Homo Sapiens
GNPRDSTDE

SEQ ID NO: 659365 - protein, 9 aa, Homo Sapiens
DEENDSDNE

SEQ ID NO: 659366 - protein, 9 aa, Homo Sapiens
KEQRAELSR

SEQ ID NO: 659367 - protein, 9 aa, Homo Sapiens
ERLGNSVFS

SEQ ID NO: 659368 - protein, 9 aa, Homo Sapiens
VPLYLNTSQ

SEQ ID NO: 659369 - protein, 9 aa, Homo Sapiens
SRGWTITSM

SEQ ID NO: 659370 - protein, 9 aa, Homo Sapiens
VECLDDEEE

SEQ ID NO: 659371 - protein, 9 aa, Homo Sapiens
NSYHSQPER

SEQ ID NO: 659372 - protein, 9 aa, Homo Sapiens
FNGRFSLDD

SEQ ID NO: 659373 - protein, 9 aa, Homo Sapiens
LSIRKQILK

SEQ ID NO: 659374 - protein, 9 aa, Homo Sapiens
VMDKSHDTV

SEQ ID NO: 659375 - protein, 9 aa, Homo Sapiens
VERPYECTV

SEQ ID NO: 659376 - protein, 9 aa, Homo Sapiens
GFQFVSGWY

SEQ ID NO: 659377 - protein, 9 aa, Homo Sapiens
HDRKDGSSP

SEQ ID NO: 659378 - protein, 9 aa, Homo Sapiens
NYQPVNTPI

SEQ ID NO: 659379 - protein, 9 aa, Homo Sapiens
LLAQDTTIF

SEQ ID NO: 659380 - protein, 9 aa, Homo Sapiens
HVDYSEMRP

SEQ ID NO: 659381 - protein, 9 aa, Homo Sapiens
KSCMPDSRF

SEQ ID NO: 659382 - protein, 9 aa, Homo Sapiens
PDGSAIVVV

SEQ ID NO: 659383 - protein, 9 aa, Homo Sapiens
PHKQIDDFL

SEQ ID NO: 659384 - protein, 9 aa, Homo Sapiens
LRALCHQLL

SEQ ID NO: 659385 - protein, 9 aa, Homo Sapiens
TAVHDRKDG

SEQ ID NO: 659386 - protein, 9 aa, Homo Sapiens
EDGGKEGDK

SEQ ID NO: 659387 - protein, 9 aa, Homo Sapiens
LRKPSWSPD

SEQ ID NO: 659388 - protein, 9 aa, Homo Sapiens
KAMVSCYPG

SEQ ID NO: 659389 - protein, 9 aa, Homo Sapiens
DQSANLTLL

SEQ ID NO: 659390 - protein, 9 aa, Homo Sapiens
ESDLDREAH

SEQ ID NO: 659391 - protein, 9 aa, Homo Sapiens
DRDSQEHVD

SEQ ID NO: 659392 - protein, 9 aa, Homo Sapiens
LENIADHTV

SEQ ID NO: 659393 - protein, 9 aa, Homo Sapiens
YQHKNLLFL

SEQ ID NO: 659394 - protein, 9 aa, Homo Sapiens
RVKVFGSKK

SEQ ID NO: 659395 - protein, 9 aa, Homo Sapiens
VFAALVSYF

SEQ ID NO: 659396 - protein, 9 aa, Homo Sapiens
AEKWTMGKN

SEQ ID NO: 659397 - protein, 9 aa, Homo Sapiens
RQISESKSL

SEQ ID NO: 659398 - protein, 9 aa, Homo Sapiens
RTAPWSSAV

SEQ ID NO: 659399 - protein, 9 aa, Homo Sapiens
CYDCFDFSL

SEQ ID NO: 659400 - protein, 9 aa, Homo Sapiens
KNATEIEVP

SEQ ID NO: 659401 - protein, 9 aa, Homo Sapiens
PKKRQNVPV

SEQ ID NO: 659402 - protein, 9 aa, Homo Sapiens
FLCFLRFCF

SEQ ID NO: 659403 - protein, 9 aa, Homo Sapiens
DGSAIVVVL

SEQ ID NO: 659404 - protein, 9 aa, Homo Sapiens
MVRNLMLWM

SEQ ID NO: 659405 - protein, 9 aa, Homo Sapiens
GPSFRQNCK

SEQ ID NO: 659406 - protein, 9 aa, Homo Sapiens
TNHNQATES

SEQ ID NO: 659407 - protein, 9 aa, Homo Sapiens
GSEITKVST

SEQ ID NO: 659408 - protein, 9 aa, Homo Sapiens
YKRFTSMKE

SEQ ID NO: 659409 - protein, 9 aa, Homo Sapiens
QCWVLRHWV

SEQ ID NO: 659410 - protein, 9 aa, Homo Sapiens
SPLSESEKG

SEQ ID NO: 659411 - protein, 9 aa, Homo Sapiens
DTMQRGGNN

SEQ ID NO: 659412 - protein, 9 aa, Homo Sapiens
RRLILTIIT

SEQ ID NO: 659413 - protein, 9 aa, Homo Sapiens
TIGRYVVRY

SEQ ID NO: 659414 - protein, 9 aa, Homo Sapiens
GIYNNKGDG

SEQ ID NO: 659415 - protein, 9 aa, Homo Sapiens
KSFRKKTFL

SEQ ID NO: 659416 - protein, 9 aa, Homo Sapiens
TRIRGDGRK

SEQ ID NO: 659417 - protein, 9 aa, Homo Sapiens
EQLICSLLN

SEQ ID NO: 659418 - protein, 9 aa, Homo Sapiens
HVSTRIRGD

SEQ ID NO: 659419 - protein, 9 aa, Homo Sapiens
EDDWARCEA

SEQ ID NO: 659420 - protein, 9 aa, Homo Sapiens
PEPGLIGYP

SEQ ID NO: 659421 - protein, 9 aa, Homo Sapiens
PPGEALAGM

SEQ ID NO: 659422 - protein, 9 aa, Homo Sapiens
FPEDYLMSM

SEQ ID NO: 659423 - protein, 9 aa, Homo Sapiens
AVSFNKIES

SEQ ID NO: 659424 - protein, 9 aa, Homo Sapiens
LQDDPPAGV

SEQ ID NO: 659425 - protein, 9 aa, Homo Sapiens
GEIMKKPEP

SEQ ID NO: 659426 - protein, 9 aa, Homo Sapiens
EYEDLKARS

SEQ ID NO: 659427 - protein, 9 aa, Homo Sapiens
TPIVIDLPT

SEQ ID NO: 659428 - protein, 9 aa, Homo Sapiens
QIPGAGRST

SEQ ID NO: 659429 - protein, 9 aa, Homo Sapiens
TISYCGVDH

SEQ ID NO: 659430 - protein, 9 aa, Homo Sapiens
YVKVNIRDI

SEQ ID NO: 659431 - protein, 9 aa, Homo Sapiens
LLVPNPFTS

SEQ ID NO: 659432 - protein, 9 aa, Homo Sapiens
DTDLLEDPD

SEQ ID NO: 659433 - protein, 9 aa, Homo Sapiens
NHPRYMPHL

SEQ ID NO: 659434 - protein, 9 aa, Homo Sapiens
LGLQEYAVF

SEQ ID NO: 659435 - protein, 9 aa, Homo Sapiens
TLDQEVSTT

SEQ ID NO: 659436 - protein, 9 aa, Homo Sapiens
RGAGDAEDT

SEQ ID NO: 659437 - protein, 9 aa, Homo Sapiens
FTAYQAFPN

SEQ ID NO: 659438 - protein, 9 aa, Homo Sapiens
GKGVRSLSF

SEQ ID NO: 659439 - protein, 9 aa, Homo Sapiens
NKVKNVVGI

SEQ ID NO: 659440 - protein, 9 aa, Homo Sapiens
QETSTIRLK

SEQ ID NO: 659441 - protein, 9 aa, Homo Sapiens
KSTDDGSLS

SEQ ID NO: 659442 - protein, 9 aa, Homo Sapiens
RAAERRQKR

SEQ ID NO: 659443 - protein, 9 aa, Homo Sapiens
DADVSEESR

SEQ ID NO: 659444 - protein, 9 aa, Homo Sapiens
KDLDYLAAL

SEQ ID NO: 659445 - protein, 9 aa, Homo Sapiens
FYTMLTPML

SEQ ID NO: 659446 - protein, 9 aa, Homo Sapiens
TADYPVPFH

SEQ ID NO: 659447 - protein, 9 aa, Homo Sapiens
VNIANCSQT

SEQ ID NO: 659448 - protein, 9 aa, Homo Sapiens
LRGLPASFH

SEQ ID NO: 659449 - protein, 9 aa, Homo Sapiens
ESSVWSQQC

SEQ ID NO: 659450 - protein, 9 aa, Homo Sapiens
GNCKTISRA

SEQ ID NO: 659451 - protein, 9 aa, Homo Sapiens
GETTSHVPP

SEQ ID NO: 659452 - protein, 9 aa, Homo Sapiens
RLGNSVFSM

SEQ ID NO: 659453 - protein, 9 aa, Homo Sapiens
EAIMEHCYD

SEQ ID NO: 659454 - protein, 9 aa, Homo Sapiens
TKPNQEYED

SEQ ID NO: 659455 - protein, 9 aa, Homo Sapiens
TIFDYYVYH

SEQ ID NO: 659456 - protein, 9 aa, Homo Sapiens
RPYIEYSSY

SEQ ID NO: 659457 - protein, 9 aa, Homo Sapiens
AIVVVLNRS

SEQ ID NO: 659458 - protein, 9 aa, Homo Sapiens
AGVMDLLES

SEQ ID NO: 659459 - protein, 9 aa, Homo Sapiens
IVVRTNLRK

SEQ ID NO: 659460 - protein, 9 aa, Homo Sapiens
AVFATRCDE

SEQ ID NO: 659461 - protein, 9 aa, Homo Sapiens
KEDSAWKPQ

SEQ ID NO: 659462 - protein, 9 aa, Homo Sapiens
LEGDTNKRK

SEQ ID NO: 659463 - protein, 9 aa, Homo Sapiens
DLEPTVVDK

SEQ ID NO: 659464 - protein, 9 aa, Homo Sapiens
MFEKRWVKF

SEQ ID NO: 659465 - protein, 9 aa, Homo Sapiens
RGQLADICL

SEQ ID NO: 659466 - protein, 9 aa, Homo Sapiens
VFDGNDHSL

SEQ ID NO: 659467 - protein, 9 aa, Homo Sapiens
LYCEFVNRV

SEQ ID NO: 659468 - protein, 9 aa, Homo Sapiens
GDTNKRKKS

SEQ ID NO: 659469 - protein, 9 aa, Homo Sapiens
MDNETGSES

SEQ ID NO: 659470 - protein, 9 aa, Homo Sapiens
VNLQFPFQG

SEQ ID NO: 659471 - protein, 9 aa, Homo Sapiens
NKRYNVSQH

SEQ ID NO: 659472 - protein, 9 aa, Homo Sapiens
VIIGETTSH

SEQ ID NO: 659473 - protein, 9 aa, Homo Sapiens
RTNLRKLQG

SEQ ID NO: 659474 - protein, 9 aa, Homo Sapiens
PLSESEKGL

SEQ ID NO: 659475 - protein, 9 aa, Homo Sapiens
NDFDLMKFQ

SEQ ID NO: 659476 - protein, 9 aa, Homo Sapiens
KPFVSVTDL

SEQ ID NO: 659477 - protein, 9 aa, Homo Sapiens
NDIDHYLEV

SEQ ID NO: 659478 - protein, 9 aa, Homo Sapiens
PGSDLSNQD

SEQ ID NO: 659479 - protein, 9 aa, Homo Sapiens
PYIEYSSYN

SEQ ID NO: 659480 - protein, 9 aa, Homo Sapiens
GGNTNTGDE

SEQ ID NO: 659481 - protein, 9 aa, Homo Sapiens
ATFFCVAFP

SEQ ID NO: 659482 - protein, 9 aa, Homo Sapiens
ESQLETQLQ

SEQ ID NO: 659483 - protein, 9 aa, Homo Sapiens
GKAHEFIAL

SEQ ID NO: 659484 - protein, 9 aa, Homo Sapiens
VGETVNLQF

SEQ ID NO: 659485 - protein, 9 aa, Homo Sapiens
AVAVKPFVS

SEQ ID NO: 659486 - protein, 9 aa, Homo Sapiens
WSSAVPQPS

SEQ ID NO: 659487 - protein, 9 aa, Homo Sapiens
SSYNEQNGT

SEQ ID NO: 659488 - protein, 9 aa, Homo Sapiens
KFHPDKTKF

SEQ ID NO: 659489 - protein, 9 aa, Homo Sapiens
LRLEVVESS

SEQ ID NO: 659490 - protein, 9 aa, Homo Sapiens
YPLPLQLCS

SEQ ID NO: 659491 - protein, 9 aa, Homo Sapiens
SLGILLAWL

SEQ ID NO: 659492 - protein, 9 aa, Homo Sapiens
EITKVSTTG

SEQ ID NO: 659493 - protein, 9 aa, Homo Sapiens
ERQNSYHSQ

SEQ ID NO: 659494 - protein, 9 aa, Homo Sapiens
PANANGMVE

SEQ ID NO: 659495 - protein, 9 aa, Homo Sapiens
TIVERLGNS

SEQ ID NO: 659496 - protein, 9 aa, Homo Sapiens
TSFKNNSKQ

SEQ ID NO: 659497 - protein, 9 aa, Homo Sapiens
KSVLNCVYK

SEQ ID NO: 659498 - protein, 9 aa, Homo Sapiens
LQTFGLEVC

SEQ ID NO: 659499 - protein, 9 aa, Homo Sapiens
STSCPNHFE

SEQ ID NO: 659500 - protein, 9 aa, Homo Sapiens
VVDKVRTGT

SEQ ID NO: 659501 - protein, 9 aa, Homo Sapiens
DVDPEISHM

SEQ ID NO: 659502 - protein, 9 aa, Homo Sapiens
LQIIVCGDY

SEQ ID NO: 659503 - protein, 9 aa, Homo Sapiens
VTIMIILTY

SEQ ID NO: 659504 - protein, 9 aa, Homo Sapiens
FEDAALCRT

SEQ ID NO: 659505 - protein, 9 aa, Homo Sapiens
SYYISFTGC

SEQ ID NO: 659506 - protein, 9 aa, Homo Sapiens
DEEIHDLTP

SEQ ID NO: 659507 - protein, 9 aa, Homo Sapiens
IAVMGKAHG

SEQ ID NO: 659508 - protein, 9 aa, Homo Sapiens
LEGMGFTLT

SEQ ID NO: 659509 - protein, 9 aa, Homo Sapiens
QVLTGNVQF

SEQ ID NO: 659510 - protein, 9 aa, Homo Sapiens
YDAWRCPHC

SEQ ID NO: 659511 - protein, 9 aa, Homo Sapiens
CKAYLVGLF

SEQ ID NO: 659512 - protein, 9 aa, Homo Sapiens
GIIGKWHLV

SEQ ID NO: 659513 - protein, 9 aa, Homo Sapiens
VSTRIRGDG

SEQ ID NO: 659514 - protein, 9 aa, Homo Sapiens
DAQPESEGI

SEQ ID NO: 659515 - protein, 9 aa, Homo Sapiens
ALKDLDYLA

SEQ ID NO: 659516 - protein, 9 aa, Homo Sapiens
LPGPGESDL

SEQ ID NO: 659517 - protein, 9 aa, Homo Sapiens
TTSHVPPTT

SEQ ID NO: 659518 - protein, 9 aa, Homo Sapiens
VAIFYTMLT

SEQ ID NO: 659519 - protein, 9 aa, Homo Sapiens
PDNVVLAFK

SEQ ID NO: 659520 - protein, 9 aa, Homo Sapiens
LGGQGLWII

SEQ ID NO: 659521 - protein, 9 aa, Homo Sapiens
RRVRSVSLT

SEQ ID NO: 659522 - protein, 9 aa, Homo Sapiens
NEPMAEVTP

SEQ ID NO: 659523 - protein, 9 aa, Homo Sapiens
VTLLGSCFT

SEQ ID NO: 659524 - protein, 9 aa, Homo Sapiens
NTGDELRYI

SEQ ID NO: 659525 - protein, 9 aa, Homo Sapiens
IPGAGRSTP

SEQ ID NO: 659526 - protein, 9 aa, Homo Sapiens
QTADYPVPF

SEQ ID NO: 659527 - protein, 9 aa, Homo Sapiens
RRREGRHES

SEQ ID NO: 659528 - protein, 9 aa, Homo Sapiens
KVYPSMISS

SEQ ID NO: 659529 - protein, 9 aa, Homo Sapiens
AITAWYNKT

SEQ ID NO: 659530 - protein, 9 aa, Homo Sapiens
VFSRKKPAL

SEQ ID NO: 659531 - protein, 9 aa, Homo Sapiens
SENGFNFND

SEQ ID NO: 659532 - protein, 9 aa, Homo Sapiens
LRQIFRLSK

SEQ ID NO: 659533 - protein, 9 aa, Homo Sapiens
VFGSKKRRR

SEQ ID NO: 659534 - protein, 9 aa, Homo Sapiens
TELPKCAVC

SEQ ID NO: 659535 - protein, 9 aa, Homo Sapiens
SVAVAVKPF

SEQ ID NO: 659536 - protein, 9 aa, Homo Sapiens
ICLDTPLCN

SEQ ID NO: 659537 - protein, 9 aa, Homo Sapiens
TAVLNVSTS

SEQ ID NO: 659538 - protein, 9 aa, Homo Sapiens
NCSTGPDSQ

SEQ ID NO: 659539 - protein, 9 aa, Homo Sapiens
SQSSSSGHR

SEQ ID NO: 659540 - protein, 9 aa, Homo Sapiens
DKWIQKEPM

SEQ ID NO: 659541 - protein, 9 aa, Homo Sapiens
GRSTPEEAH

SEQ ID NO: 659542 - protein, 9 aa, Homo Sapiens
KKQFICKFC

SEQ ID NO: 659543 - protein, 9 aa, Homo Sapiens
HAGNPRDST

SEQ ID NO: 659544 - protein, 9 aa, Homo Sapiens
GFGSGCCPV

SEQ ID NO: 659545 - protein, 9 aa, Homo Sapiens
IYNNKGDGP

SEQ ID NO: 659546 - protein, 9 aa, Homo Sapiens
AGYPPVTVM

SEQ ID NO: 659547 - protein, 9 aa, Homo Sapiens
SNNGMALKE

SEQ ID NO: 659548 - protein, 9 aa, Homo Sapiens
EKSVLNCVY

SEQ ID NO: 659549 - protein, 9 aa, Homo Sapiens
SAIINQAGA

SEQ ID NO: 659550 - protein, 9 aa, Homo Sapiens
DTNKRKKSP

SEQ ID NO: 659551 - protein, 9 aa, Homo Sapiens
QCFSNNGMA

SEQ ID NO: 659552 - protein, 9 aa, Homo Sapiens
PTLRLEVVE

SEQ ID NO: 659553 - protein, 9 aa, Homo Sapiens
IFPEDYLMS

SEQ ID NO: 659554 - protein, 9 aa, Homo Sapiens
NQTLSLSIR

SEQ ID NO: 659555 - protein, 9 aa, Homo Sapiens
AMLFFWMLF

SEQ ID NO: 659556 - protein, 9 aa, Homo Sapiens
PELRKPSWS

SEQ ID NO: 659557 - protein, 9 aa, Homo Sapiens
FFWMLFTLG

SEQ ID NO: 659558 - protein, 9 aa, Homo Sapiens
TNKRKKSPQ

SEQ ID NO: 659559 - protein, 9 aa, Homo Sapiens
TFFCVAFPL

SEQ ID NO: 659560 - protein, 9 aa, Homo Sapiens
NLQFPFQGK

SEQ ID NO: 659561 - protein, 9 aa, Homo Sapiens
DDWARCEAR

SEQ ID NO: 659562 - protein, 9 aa, Homo Sapiens
AMFQSKRKN

SEQ ID NO: 659563 - protein, 9 aa, Homo Sapiens
LYLGLLRLG

SEQ ID NO: 659564 - protein, 9 aa, Homo Sapiens
DVSEESRRG

SEQ ID NO: 659565 - protein, 9 aa, Homo Sapiens
YSQPSDSWY

SEQ ID NO: 659566 - protein, 9 aa, Homo Sapiens
SSIAKQIKS

SEQ ID NO: 659567 - protein, 9 aa, Homo Sapiens
GPPSGPWRR

SEQ ID NO: 659568 - protein, 9 aa, Homo Sapiens
PIIMCSSVG

SEQ ID NO: 659569 - protein, 9 aa, Homo Sapiens
RKPSWSPDL

SEQ ID NO: 659570 - protein, 9 aa, Homo Sapiens
RKSAGEAKT

SEQ ID NO: 659571 - protein, 9 aa, Homo Sapiens
KEKPKREKT

SEQ ID NO: 659572 - protein, 9 aa, Homo Sapiens
SGEGVDPQL

SEQ ID NO: 659573 - protein, 9 aa, Homo Sapiens
APETEGDAQ

SEQ ID NO: 659574 - protein, 9 aa, Homo Sapiens
IEAPETEGD

SEQ ID NO: 659575 - protein, 9 aa, Homo Sapiens
ATGEIKSPT

SEQ ID NO: 659576 - protein, 9 aa, Homo Sapiens
ALAGMDTTL

SEQ ID NO: 659577 - protein, 9 aa, Homo Sapiens
GVMDLLESQ

SEQ ID NO: 659578 - protein, 9 aa, Homo Sapiens
AKLPYANIP

SEQ ID NO: 659579 - protein, 9 aa, Homo Sapiens
KQARHAVMG

SEQ ID NO: 659580 - protein, 9 aa, Homo Sapiens
STSDPDTRH

SEQ ID NO: 659581 - protein, 9 aa, Homo Sapiens
LCSRFPVAP

SEQ ID NO: 659582 - protein, 9 aa, Homo Sapiens
LPAASVRPS

SEQ ID NO: 659583 - protein, 9 aa, Homo Sapiens
VVLSEQQIP

SEQ ID NO: 659584 - protein, 9 aa, Homo Sapiens
PSDSWYKDY

SEQ ID NO: 659585 - protein, 9 aa, Homo Sapiens
SKAMVSCYP

SEQ ID NO: 659586 - protein, 9 aa, Homo Sapiens
QDDPPAGVS

SEQ ID NO: 659587 - protein, 9 aa, Homo Sapiens
QIFRLSKAQ

SEQ ID NO: 659588 - protein, 9 aa, Homo Sapiens
VPVQVELLG

SEQ ID NO: 659589 - protein, 9 aa, Homo Sapiens
LGLLRLGTG

SEQ ID NO: 659590 - protein, 9 aa, Homo Sapiens
LICSLLNSQ

SEQ ID NO: 659591 - protein, 9 aa, Homo Sapiens
ENKVKNVVG

SEQ ID NO: 659592 - protein, 9 aa, Homo Sapiens
VPQPSTSDP

SEQ ID NO: 659593 - protein, 9 aa, Homo Sapiens
VELIVLEKP

SEQ ID NO: 659594 - protein, 9 aa, Homo Sapiens
WDDKQKDFV

SEQ ID NO: 659595 - protein, 9 aa, Homo Sapiens
VYHKTKKLL

SEQ ID NO: 659596 - protein, 9 aa, Homo Sapiens
VAVKPFVSV

SEQ ID NO: 659597 - protein, 9 aa, Homo Sapiens
DICLDTPLC

SEQ ID NO: 659598 - protein, 9 aa, Homo Sapiens
SSPFSSLEE

SEQ ID NO: 659599 - protein, 9 aa, Homo Sapiens
KVIPTFATE

SEQ ID NO: 659600 - protein, 9 aa, Homo Sapiens
VLSEQQIPL

SEQ ID NO: 659601 - protein, 9 aa, Homo Sapiens
LLEDTDLLE

SEQ ID NO: 659602 - protein, 9 aa, Homo Sapiens
QRDPATYNI

SEQ ID NO: 659603 - protein, 9 aa, Homo Sapiens
TVVDKVRTG

SEQ ID NO: 659604 - protein, 9 aa, Homo Sapiens
LDAFFEIIR

SEQ ID NO: 659605 - protein, 9 aa, Homo Sapiens
VTPTKCSSN

SEQ ID NO: 659606 - protein, 9 aa, Homo Sapiens
ATIGRYVVR

SEQ ID NO: 659607 - protein, 9 aa, Homo Sapiens
HCVPNVSTI

SEQ ID NO: 659608 - protein, 9 aa, Homo Sapiens
AGRSTPEEA

SEQ ID NO: 659609 - protein, 9 aa, Homo Sapiens
PLTAHRGGL

SEQ ID NO: 659610 - protein, 9 aa, Homo Sapiens
LQPRACFQR

SEQ ID NO: 659611 - protein, 9 aa, Homo Sapiens
RSKAMVSCY

SEQ ID NO: 659612 - protein, 9 aa, Homo Sapiens
NFEHETVRK

SEQ ID NO: 659613 - protein, 9 aa, Homo Sapiens
LYLNTSQRI

SEQ ID NO: 659614 - protein, 9 aa, Homo Sapiens
EEEIAEKHD

SEQ ID NO: 659615 - protein, 9 aa, Homo Sapiens
VHDRKDGSS

SEQ ID NO: 659616 - protein, 9 aa, Homo Sapiens
ESRRGREAY

SEQ ID NO: 659617 - protein, 9 aa, Homo Sapiens
IVVVLNRSS

SEQ ID NO: 659618 - protein, 9 aa, Homo Sapiens
LAGRFHQIM

SEQ ID NO: 659619 - protein, 9 aa, Homo Sapiens
PGLDTMQRG

SEQ ID NO: 659620 - protein, 9 aa, Homo Sapiens
VLTGNVQFD

SEQ ID NO: 659621 - protein, 9 aa, Homo Sapiens
NKRKRENVK

SEQ ID NO: 659622 - protein, 9 aa, Homo Sapiens
LGDVVLSEQ

SEQ ID NO: 659623 - protein, 9 aa, Homo Sapiens
EGDAQPESE

SEQ ID NO: 659624 - protein, 9 aa, Homo Sapiens
IENNDRFSR

SEQ ID NO: 659625 - protein, 9 aa, Homo Sapiens
RQIFRLSKA

SEQ ID NO: 659626 - protein, 9 aa, Homo Sapiens
SLRAVFATR

SEQ ID NO: 659627 - protein, 9 aa, Homo Sapiens
SMDTEKSPL

SEQ ID NO: 659628 - protein, 9 aa, Homo Sapiens
MHPDGSAIV

SEQ ID NO: 659629 - protein, 9 aa, Homo Sapiens
RPKGIEDGG

SEQ ID NO: 659630 - protein, 9 aa, Homo Sapiens
YSSPRSPAT

SEQ ID NO: 659631 - protein, 9 aa, Homo Sapiens
EGMGFTLTV

SEQ ID NO: 659632 - protein, 9 aa, Homo Sapiens
DTTIFFLGC

SEQ ID NO: 659633 - protein, 9 aa, Homo Sapiens
SFYQRRRFF

SEQ ID NO: 659634 - protein, 9 aa, Homo Sapiens
KFSPVCCHM

SEQ ID NO: 659635 - protein, 9 aa, Homo Sapiens
LNVFSRVKV

SEQ ID NO: 659636 - protein, 9 aa, Homo Sapiens
QHLRGLPAS

SEQ ID NO: 659637 - protein, 9 aa, Homo Sapiens
ATIKYSVIE

SEQ ID NO: 659638 - protein, 9 aa, Homo Sapiens
YTADEIKYF

SEQ ID NO: 659639 - protein, 9 aa, Homo Sapiens
EQLLLYKFK

SEQ ID NO: 659640 - protein, 9 aa, Homo Sapiens
HEEERQNSY

SEQ ID NO: 659641 - protein, 9 aa, Homo Sapiens
NMAISLVAE

SEQ ID NO: 659642 - protein, 9 aa, Homo Sapiens
ITAVLNVST

SEQ ID NO: 659643 - protein, 9 aa, Homo Sapiens
DLLRLPCSD

SEQ ID NO: 659644 - protein, 9 aa, Homo Sapiens
GPWRRVRSV

SEQ ID NO: 659645 - protein, 9 aa, Homo Sapiens
KLGLQEYAV

SEQ ID NO: 659646 - protein, 9 aa, Homo Sapiens
QEYEDLKAR

SEQ ID NO: 659647 - protein, 9 aa, Homo Sapiens
FTASTNSAI

SEQ ID NO: 659648 - protein, 9 aa, Homo Sapiens
AFITHCGAN

SEQ ID NO: 659649 - protein, 9 aa, Homo Sapiens
DLKAAAKAA

SEQ ID NO: 659650 - protein, 9 aa, Homo Sapiens
YSVIEERDS

SEQ ID NO: 659651 - protein, 9 aa, Homo Sapiens
LICQQCFSN

SEQ ID NO: 659652 - protein, 9 aa, Homo Sapiens
HKALQLLRC

SEQ ID NO: 659653 - protein, 9 aa, Homo Sapiens
KIIFVHLII

SEQ ID NO: 659654 - protein, 9 aa, Homo Sapiens
FAFENMLES

SEQ ID NO: 659655 - protein, 9 aa, Homo Sapiens
YRHQRLHTV

SEQ ID NO: 659656 - protein, 9 aa, Homo Sapiens
TFAFENMLE

SEQ ID NO: 659657 - protein, 9 aa, Homo Sapiens
SLQPRACFQ

SEQ ID NO: 659658 - protein, 9 aa, Homo Sapiens
GGDVPGITD

SEQ ID NO: 659659 - protein, 9 aa, Homo Sapiens
LEKPFTVEI

SEQ ID NO: 659660 - protein, 9 aa, Homo Sapiens
TMLKEKKLA

SEQ ID NO: 659661 - protein, 9 aa, Homo Sapiens
QEKLHRSRP

SEQ ID NO: 659662 - protein, 9 aa, Homo Sapiens
SRRGREAYE

SEQ ID NO: 659663 - protein, 9 aa, Homo Sapiens
IYTKPNQEY

SEQ ID NO: 659664 - protein, 9 aa, Homo Sapiens
LVNKSIDGT

SEQ ID NO: 659665 - protein, 9 aa, Homo Sapiens
AGLQGRAEG

SEQ ID NO: 659666 - protein, 9 aa, Homo Sapiens
KNPEIWEKL

SEQ ID NO: 659667 - protein, 9 aa, Homo Sapiens
LHLPFCPHK

SEQ ID NO: 659668 - protein, 9 aa, Homo Sapiens
DTNHNQATE

SEQ ID NO: 659669 - protein, 9 aa, Homo Sapiens
WMLFTLGLS

SEQ ID NO: 659670 - protein, 9 aa, Homo Sapiens
KKYHKMVGV

SEQ ID NO: 659671 - protein, 9 aa, Homo Sapiens
KILCATYVK

SEQ ID NO: 659672 - protein, 9 aa, Homo Sapiens
FIALIFGIA

SEQ ID NO: 659673 - protein, 9 aa, Homo Sapiens
INLGNNALK

SEQ ID NO: 659674 - protein, 9 aa, Homo Sapiens
LIVLEKPFT

SEQ ID NO: 659675 - protein, 9 aa, Homo Sapiens
ALKQAKLPY

SEQ ID NO: 659676 - protein, 9 aa, Homo Sapiens
VRVLRSWLA

SEQ ID NO: 659677 - protein, 9 aa, Homo Sapiens
CYQSYRDTI

SEQ ID NO: 659678 - protein, 9 aa, Homo Sapiens
TTEHPQMGS

SEQ ID NO: 659679 - protein, 9 aa, Homo Sapiens
QGPIGSSGK

SEQ ID NO: 659680 - protein, 9 aa, Homo Sapiens
GHRKHLRTD

SEQ ID NO: 659681 - protein, 9 aa, Homo Sapiens
GQDRAAFTA

SEQ ID NO: 659682 - protein, 9 aa, Homo Sapiens
TITSMCSEG

SEQ ID NO: 659683 - protein, 9 aa, Homo Sapiens
LAQDTTIFF

SEQ ID NO: 659684 - protein, 9 aa, Homo Sapiens
EAWRFTRIA

SEQ ID NO: 659685 - protein, 9 aa, Homo Sapiens
ALIKLVNKS

SEQ ID NO: 659686 - protein, 9 aa, Homo Sapiens
LPKCAVCLE

SEQ ID NO: 659687 - protein, 9 aa, Homo Sapiens
KKSPLTAHR

SEQ ID NO: 659688 - protein, 9 aa, Homo Sapiens
KAQLRQFTL

SEQ ID NO: 659689 - protein, 9 aa, Homo Sapiens
LDTMQRGGN

SEQ ID NO: 659690 - protein, 9 aa, Homo Sapiens
NIVDIRVDA

SEQ ID NO: 659691 - protein, 9 aa, Homo Sapiens
GKWHLVHHG

SEQ ID NO: 659692 - protein, 9 aa, Homo Sapiens
KQEFMDLSI

SEQ ID NO: 659693 - protein, 9 aa, Homo Sapiens
PYDAWRCPH

SEQ ID NO: 659694 - protein, 9 aa, Homo Sapiens
LIAVSWATF

SEQ ID NO: 659695 - protein, 9 aa, Homo Sapiens
QNEHLIQNE

SEQ ID NO: 659696 - protein, 9 aa, Homo Sapiens
TSSRGWTIT

SEQ ID NO: 659697 - protein, 9 aa, Homo Sapiens
PSSDRVTRL

SEQ ID NO: 659698 - protein, 9 aa, Homo Sapiens
DILDTMLKE

SEQ ID NO: 659699 - protein, 9 aa, Homo Sapiens
TEIEVPFVT

SEQ ID NO: 659700 - protein, 9 aa, Homo Sapiens
LDLFDSTSD

SEQ ID NO: 659701 - protein, 9 aa, Homo Sapiens
QTECACMDL

SEQ ID NO: 659702 - protein, 9 aa, Homo Sapiens
KTIVERLGN

SEQ ID NO: 659703 - protein, 9 aa, Homo Sapiens
AVAIFYTML

SEQ ID NO: 659704 - protein, 9 aa, Homo Sapiens
FSPVCCHME

SEQ ID NO: 659705 - protein, 9 aa, Homo Sapiens
LGNSVFSMA

SEQ ID NO: 659706 - protein, 9 aa, Homo Sapiens
GGRWVSIWD

SEQ ID NO: 659707 - protein, 9 aa, Homo Sapiens
RSQFSSRSR

SEQ ID NO: 659708 - protein, 9 aa, Homo Sapiens
AALCRTYYN

SEQ ID NO: 659709 - protein, 9 aa, Homo Sapiens
FVTQFVYTA

SEQ ID NO: 659710 - protein, 9 aa, Homo Sapiens
SVTWIIYKE

SEQ ID NO: 659711 - protein, 9 aa, Homo Sapiens
RQTGCKNVC

SEQ ID NO: 659712 - protein, 9 aa, Homo Sapiens
FENMLESQQ

SEQ ID NO: 659713 - protein, 9 aa, Homo Sapiens
CFFLCFLRF

SEQ ID NO: 659714 - protein, 9 aa, Homo Sapiens
FTYSSAYLF

SEQ ID NO: 659715 - protein, 9 aa, Homo Sapiens
PDFTRAAER

SEQ ID NO: 659716 - protein, 9 aa, Homo Sapiens
KCSSNTEFK

SEQ ID NO: 659717 - protein, 9 aa, Homo Sapiens
RAVQETCRE

SEQ ID NO: 659718 - protein, 9 aa, Homo Sapiens
QNSPGSDLS

SEQ ID NO: 659719 - protein, 9 aa, Homo Sapiens
AEGGRWVSI

SEQ ID NO: 659720 - protein, 9 aa, Homo Sapiens
PKCAVCLER

SEQ ID NO: 659721 - protein, 9 aa, Homo Sapiens
TVNYQPVNT

SEQ ID NO: 659722 - protein, 9 aa, Homo Sapiens
SDMVIIGET

SEQ ID NO: 659723 - protein, 9 aa, Homo Sapiens
NALMDVVSE

SEQ ID NO: 659724 - protein, 9 aa, Homo Sapiens
SDPAAEASS

SEQ ID NO: 659725 - protein, 9 aa, Homo Sapiens
LPLQGGRED

SEQ ID NO: 659726 - protein, 9 aa, Homo Sapiens
LRSKKAVCH

SEQ ID NO: 659727 - protein, 9 aa, Homo Sapiens
RKKTFLGLD

SEQ ID NO: 659728 - protein, 9 aa, Homo Sapiens
DIKDPDFTR

SEQ ID NO: 659729 - protein, 9 aa, Homo Sapiens
MVSCYPGNG

SEQ ID NO: 659730 - protein, 9 aa, Homo Sapiens
WPRRVKVSH

SEQ ID NO: 659731 - protein, 9 aa, Homo Sapiens
VEVSWRPLV

SEQ ID NO: 659732 - protein, 9 aa, Homo Sapiens
YQRRRFFPD

SEQ ID NO: 659733 - protein, 9 aa, Homo Sapiens
TIFFLGCAT

SEQ ID NO: 659734 - protein, 9 aa, Homo Sapiens
ACKAYLVGL

SEQ ID NO: 659735 - protein, 9 aa, Homo Sapiens
TETCLVQRD

SEQ ID NO: 659736 - protein, 9 aa, Homo Sapiens
ACFQRCSGR

SEQ ID NO: 659737 - protein, 9 aa, Homo Sapiens
LHRSRPISD

SEQ ID NO: 659738 - protein, 9 aa, Homo Sapiens
YSVSAGYPP

SEQ ID NO: 659739 - protein, 9 aa, Homo Sapiens
DYKFVFDGN

SEQ ID NO: 659740 - protein, 9 aa, Homo Sapiens
ALPSADHNL

SEQ ID NO: 659741 - protein, 9 aa, Homo Sapiens
LVNLQTFGL

SEQ ID NO: 659742 - protein, 9 aa, Homo Sapiens
FASWGEGED

SEQ ID NO: 659743 - protein, 9 aa, Homo Sapiens
TGDELRYIT

SEQ ID NO: 659744 - protein, 9 aa, Homo Sapiens
QIIVCGDYG

SEQ ID NO: 659745 - protein, 9 aa, Homo Sapiens
YQSYRDTIV

SEQ ID NO: 659746 - protein, 9 aa, Homo Sapiens
IEEGKVETE

SEQ ID NO: 659747 - protein, 9 aa, Homo Sapiens
LFHNRGNGT

SEQ ID NO: 659748 - protein, 9 aa, Homo Sapiens
FFEIIRNEG

SEQ ID NO: 659749 - protein, 9 aa, Homo Sapiens
LSHKNMHSR

SEQ ID NO: 659750 - protein, 9 aa, Homo Sapiens
RGNGTFVDA

SEQ ID NO: 659751 - protein, 9 aa, Homo Sapiens
TLANLLTSY

SEQ ID NO: 659752 - protein, 9 aa, Homo Sapiens
FAALVSYFS

SEQ ID NO: 659753 - protein, 9 aa, Homo Sapiens
KEERLAPYD

SEQ ID NO: 659754 - protein, 9 aa, Homo Sapiens
NMLESQQGL

SEQ ID NO: 659755 - protein, 9 aa, Homo Sapiens
SADHNLKTP

SEQ ID NO: 659756 - protein, 9 aa, Homo Sapiens
KIRPKGIED

SEQ ID NO: 659757 - protein, 9 aa, Homo Sapiens
TYYLLILTT

SEQ ID NO: 659758 - protein, 9 aa, Homo Sapiens
HNQTLSLSI

SEQ ID NO: 659759 - protein, 9 aa, Homo Sapiens
ADFKIKIQD

SEQ ID NO: 659760 - protein, 9 aa, Homo Sapiens
LLEGDTNKR

SEQ ID NO: 659761 - protein, 9 aa, Homo Sapiens
CSTGPDSQG

SEQ ID NO: 659762 - protein, 9 aa, Homo Sapiens
LSYQLLKDT

SEQ ID NO: 659763 - protein, 9 aa, Homo Sapiens
DGGKEGDKH

SEQ ID NO: 659764 - protein, 9 aa, Homo Sapiens
EQLENIADH

SEQ ID NO: 659765 - protein, 9 aa, Homo Sapiens
RGLFMHGDR

SEQ ID NO: 659766 - protein, 9 aa, Homo Sapiens
VLEKPFTVE

SEQ ID NO: 659767 - protein, 9 aa, Homo Sapiens
VVINFKKTG

SEQ ID NO: 659768 - protein, 9 aa, Homo Sapiens
AAEEVWDDK

SEQ ID NO: 659769 - protein, 9 aa, Homo Sapiens
SPYHTIVYF

SEQ ID NO: 659770 - protein, 9 aa, Homo Sapiens
RGVKNKQEF

SEQ ID NO: 659771 - protein, 9 aa, Homo Sapiens
AKCFRCKLC

SEQ ID NO: 659772 - protein, 9 aa, Homo Sapiens
SRIIRKVYL

SEQ ID NO: 659773 - protein, 9 aa, Homo Sapiens
SYCGVDHEL

SEQ ID NO: 659774 - protein, 9 aa, Homo Sapiens
IESQEEMLQ

SEQ ID NO: 659775 - protein, 9 aa, Homo Sapiens
TGPDSQGSD

SEQ ID NO: 659776 - protein, 9 aa, Homo Sapiens
DIDKVETFL

SEQ ID NO: 659777 - protein, 9 aa, Homo Sapiens
SEERTSRVL

SEQ ID NO: 659778 - protein, 9 aa, Homo Sapiens
ESAPSEVSP

SEQ ID NO: 659779 - protein, 9 aa, Homo Sapiens
GIMKELSRL

SEQ ID NO: 659780 - protein, 9 aa, Homo Sapiens
HAVYPAVTR

SEQ ID NO: 659781 - protein, 9 aa, Homo Sapiens
KAVSFNKIE

SEQ ID NO: 659782 - protein, 9 aa, Homo Sapiens
YFMASGKSP

SEQ ID NO: 659783 - protein, 9 aa, Homo Sapiens
QAVEPWDIA

SEQ ID NO: 659784 - protein, 9 aa, Homo Sapiens
SLNHPRYMP

SEQ ID NO: 659785 - protein, 9 aa, Homo Sapiens
ESGDQPKRT

SEQ ID NO: 659786 - protein, 9 aa, Homo Sapiens
SSTLGGQGL

SEQ ID NO: 659787 - protein, 9 aa, Homo Sapiens
RCGQALHLL

SEQ ID NO: 659788 - protein, 9 aa, Homo Sapiens
CVYKVLHGC

SEQ ID NO: 659789 - protein, 9 aa, Homo Sapiens
GGGDVPGIT

SEQ ID NO: 659790 - protein, 9 aa, Homo Sapiens
GIENNDRFS

SEQ ID NO: 659791 - protein, 9 aa, Homo Sapiens
KYHKMVGVI

SEQ ID NO: 659792 - protein, 9 aa, Homo Sapiens
KNLLFLYDA

SEQ ID NO: 659793 - protein, 9 aa, Homo Sapiens
LFLYDAIGT

SEQ ID NO: 659794 - protein, 9 aa, Homo Sapiens
MGKNGFNLF

SEQ ID NO: 659795 - protein, 9 aa, Homo Sapiens
QIKSEVATL

SEQ ID NO: 659796 - protein, 9 aa, Homo Sapiens
APWSSAVPQ

SEQ ID NO: 659797 - protein, 9 aa, Homo Sapiens
IKSEVATLT

SEQ ID NO: 659798 - protein, 9 aa, Homo Sapiens
AIKHSIPGP

SEQ ID NO: 659799 - protein, 9 aa, Homo Sapiens
EGPPSGPWR

SEQ ID NO: 659800 - protein, 9 aa, Homo Sapiens
NVKQKQYPE

SEQ ID NO: 659801 - protein, 9 aa, Homo Sapiens
SITTLESAP

SEQ ID NO: 659802 - protein, 9 aa, Homo Sapiens
DSQSSSSGH

SEQ ID NO: 659803 - protein, 9 aa, Homo Sapiens
PVRVLRSWL

SEQ ID NO: 659804 - protein, 9 aa, Homo Sapiens
DHNLKTPAE

SEQ ID NO: 659805 - protein, 9 aa, Homo Sapiens
CAVCLERMD

SEQ ID NO: 659806 - protein, 9 aa, Homo Sapiens
VQVELLGCE

SEQ ID NO: 659807 - protein, 9 aa, Homo Sapiens
RSVGPSLTS

SEQ ID NO: 659808 - protein, 9 aa, Homo Sapiens
FKVIPTFAT

SEQ ID NO: 659809 - protein, 9 aa, Homo Sapiens
MIILTYYLL

SEQ ID NO: 659810 - protein, 9 aa, Homo Sapiens
AVQETCREV

SEQ ID NO: 659811 - protein, 9 aa, Homo Sapiens
GLTRFRRQI

SEQ ID NO: 659812 - protein, 9 aa, Homo Sapiens
LCFLRFCFS

SEQ ID NO: 659813 - protein, 9 aa, Homo Sapiens
DLSVAVAVK

SEQ ID NO: 659814 - protein, 9 aa, Homo Sapiens
RRGAGDAED

SEQ ID NO: 659815 - protein, 9 aa, Homo Sapiens
LNKRCLHGA

SEQ ID NO: 659816 - protein, 9 aa, Homo Sapiens
QPVNTPIVI

SEQ ID NO: 659817 - protein, 9 aa, Homo Sapiens
RFTSMKEHI

SEQ ID NO: 659818 - protein, 9 aa, Homo Sapiens
QFICKFCGR

SEQ ID NO: 659819 - protein, 9 aa, Homo Sapiens
EGRIMAFST

SEQ ID NO: 659820 - protein, 9 aa, Homo Sapiens
KDPDFTRAA

SEQ ID NO: 659821 - protein, 9 aa, Homo Sapiens
IPMSAIINQ

SEQ ID NO: 659822 - protein, 9 aa, Homo Sapiens
IELSAPKPR

SEQ ID NO: 659823 - protein, 9 aa, Homo Sapiens
NNFNGRFSL

SEQ ID NO: 659824 - protein, 9 aa, Homo Sapiens
LVQRDPATY

SEQ ID NO: 659825 - protein, 9 aa, Homo Sapiens
RAAFTASTN

SEQ ID NO: 659826 - protein, 9 aa, Homo Sapiens
RHAVMGIWM

SEQ ID NO: 659827 - protein, 9 aa, Homo Sapiens
TNMAISLVA

SEQ ID NO: 659828 - protein, 9 aa, Homo Sapiens
YKDYDSFVL

SEQ ID NO: 659829 - protein, 9 aa, Homo Sapiens
MGNCKTISR

SEQ ID NO: 659830 - protein, 9 aa, Homo Sapiens
HKMVGVIFS

SEQ ID NO: 659831 - protein, 9 aa, Homo Sapiens
PNKCVMSEW

SEQ ID NO: 659832 - protein, 9 aa, Homo Sapiens
WNTLDQEVS

SEQ ID NO: 659833 - protein, 9 aa, Homo Sapiens
TVDIAVMGK

SEQ ID NO: 659834 - protein, 9 aa, Homo Sapiens
SQDCPWYNQ

SEQ ID NO: 659835 - protein, 9 aa, Homo Sapiens
LGGGDVPGI

SEQ ID NO: 659836 - protein, 9 aa, Homo Sapiens
QSANLTLLT

SEQ ID NO: 659837 - protein, 9 aa, Homo Sapiens
SSDRVTRLL

SEQ ID NO: 659838 - protein, 9 aa, Homo Sapiens
KCQEKLHRS

SEQ ID NO: 659839 - protein, 9 aa, Homo Sapiens
SMKEHIKYR

SEQ ID NO: 659840 - protein, 9 aa, Homo Sapiens
GPDSQGSDC

SEQ ID NO: 659841 - protein, 9 aa, Homo Sapiens
MGGMNRRLI

SEQ ID NO: 659842 - protein, 9 aa, Homo Sapiens
VKIQVISAP

SEQ ID NO: 659843 - protein, 9 aa, Homo Sapiens
FGIKGPVAV

SEQ ID NO: 659844 - protein, 9 aa, Homo Sapiens
TDGQDRAAF

SEQ ID NO: 659845 - protein, 9 aa, Homo Sapiens
VPACLPAAS

SEQ ID NO: 659846 - protein, 9 aa, Homo Sapiens
WTQNEHLIQ

SEQ ID NO: 659847 - protein, 9 aa, Homo Sapiens
KGLGDSRPL

SEQ ID NO: 659848 - protein, 9 aa, Homo Sapiens
FSAPRILRS

SEQ ID NO: 659849 - protein, 9 aa, Homo Sapiens
MDLLESQLE

SEQ ID NO: 659850 - protein, 9 aa, Homo Sapiens
FHNRGNGTF

SEQ ID NO: 659851 - protein, 9 aa, Homo Sapiens
LLSGFQFVS

SEQ ID NO: 659852 - protein, 9 aa, Homo Sapiens
SSLRAVFAT

SEQ ID NO: 659853 - protein, 9 aa, Homo Sapiens
AIMLGIMKE

SEQ ID NO: 659854 - protein, 9 aa, Homo Sapiens
NGEDLLLTV

SEQ ID NO: 659855 - protein, 9 aa, Homo Sapiens
KAVCHKLLS

SEQ ID NO: 659856 - protein, 9 aa, Homo Sapiens
NCKTISRAE

SEQ ID NO: 659857 - protein, 9 aa, Homo Sapiens
VSFNKIESQ

SEQ ID NO: 659858 - protein, 9 aa, Homo Sapiens
GLLEQLLLY

SEQ ID NO: 659859 - protein, 9 aa, Homo Sapiens
MVIIGETTS

SEQ ID NO: 659860 - protein, 9 aa, Homo Sapiens
TLPGPGESD

SEQ ID NO: 659861 - protein, 9 aa, Homo Sapiens
HLPFCPHKQ

SEQ ID NO: 659862 - protein, 9 aa, Homo Sapiens
KLKGHCQQG

SEQ ID NO: 659863 - protein, 9 aa, Homo Sapiens
FEHETVRKF

SEQ ID NO: 659864 - protein, 9 aa, Homo Sapiens
VDKVRTGTY

SEQ ID NO: 659865 - protein, 9 aa, Homo Sapiens
SAVVSFPVI

SEQ ID NO: 659866 - protein, 9 aa, Homo Sapiens
PEEAHVDLR

SEQ ID NO: 659867 - protein, 9 aa, Homo Sapiens
LCATYVKVN

SEQ ID NO: 659868 - protein, 9 aa, Homo Sapiens
AWRFTRIAV

SEQ ID NO: 659869 - protein, 9 aa, Homo Sapiens
SVGLLEGDT

SEQ ID NO: 659870 - protein, 9 aa, Homo Sapiens
KYSVKTAAK

SEQ ID NO: 659871 - protein, 9 aa, Homo Sapiens
ADICLDTPL

SEQ ID NO: 659872 - protein, 9 aa, Homo Sapiens
SSIHLEPPK

SEQ ID NO: 659873 - protein, 9 aa, Homo Sapiens
QAKLPYANI

SEQ ID NO: 659874 - protein, 9 aa, Homo Sapiens
QISESKSLP

SEQ ID NO: 659875 - protein, 9 aa, Homo Sapiens
DYPVPFHDK

SEQ ID NO: 659876 - protein, 9 aa, Homo Sapiens
SVIEERDSG

SEQ ID NO: 659877 - protein, 9 aa, Homo Sapiens
QLADICLDT

SEQ ID NO: 659878 - protein, 9 aa, Homo Sapiens
MCSSVGALL

SEQ ID NO: 659879 - protein, 9 aa, Homo Sapiens
FPDDSAGAS

SEQ ID NO: 659880 - protein, 9 aa, Homo Sapiens
GNVLPFPHQ

SEQ ID NO: 659881 - protein, 9 aa, Homo Sapiens
RQGQSLWPR

SEQ ID NO: 659882 - protein, 9 aa, Homo Sapiens
LVKEWIRQI

SEQ ID NO: 659883 - protein, 9 aa, Homo Sapiens
DELRYITAR

SEQ ID NO: 659884 - protein, 9 aa, Homo Sapiens
GVDHELLSH

SEQ ID NO: 659885 - protein, 9 aa, Homo Sapiens
FRKDIDKVE

SEQ ID NO: 659886 - protein, 9 aa, Homo Sapiens
PSGPWRRVR

SEQ ID NO: 659887 - protein, 9 aa, Homo Sapiens
FMGKVVKKY

SEQ ID NO: 659888 - protein, 9 aa, Homo Sapiens
LRAVFATRC

SEQ ID NO: 659889 - protein, 9 aa, Homo Sapiens
HKGRGRDSE

SEQ ID NO: 659890 - protein, 9 aa, Homo Sapiens
RSKFGIKGP

SEQ ID NO: 659891 - protein, 9 aa, Homo Sapiens
GKSPASSTS

SEQ ID NO: 659892 - protein, 9 aa, Homo Sapiens
MCSEGPPSG

SEQ ID NO: 659893 - protein, 9 aa, Homo Sapiens
KPNQEYEDL

SEQ ID NO: 659894 - protein, 9 aa, Homo Sapiens
NTNTGDELR

SEQ ID NO: 659895 - protein, 9 aa, Homo Sapiens
KRYNVSQHA

SEQ ID NO: 659896 - protein, 9 aa, Homo Sapiens
ICQQCFSNN

SEQ ID NO: 659897 - protein, 9 aa, Homo Sapiens
VCFFHVALA

SEQ ID NO: 659898 - protein, 9 aa, Homo Sapiens
DRAAFTAST

SEQ ID NO: 659899 - protein, 9 aa, Homo Sapiens
AASVRPSSS

SEQ ID NO: 659900 - protein, 9 aa, Homo Sapiens
CKLCENSLH

SEQ ID NO: 659901 - protein, 9 aa, Homo Sapiens
RYNVSQHAL

SEQ ID NO: 659902 - protein, 9 aa, Homo Sapiens
PVREESTSK

SEQ ID NO: 659903 - protein, 9 aa, Homo Sapiens
NGRFSLDDC

SEQ ID NO: 659904 - protein, 9 aa, Homo Sapiens
LRIASTEGK

SEQ ID NO: 659905 - protein, 9 aa, Homo Sapiens
KALQLLRCF

SEQ ID NO: 659906 - protein, 9 aa, Homo Sapiens
YAALGDVVL

SEQ ID NO: 659907 - protein, 9 aa, Homo Sapiens
ESTVDVGQS

SEQ ID NO: 659908 - protein, 9 aa, Homo Sapiens
TIRLKVSST

SEQ ID NO: 659909 - protein, 9 aa, Homo Sapiens
HTVQEADED

SEQ ID NO: 659910 - protein, 9 aa, Homo Sapiens
PLYLNTSQR

SEQ ID NO: 659911 - protein, 9 aa, Homo Sapiens
SKFGIKGPV

SEQ ID NO: 659912 - protein, 9 aa, Homo Sapiens
ENIADHTVQ

SEQ ID NO: 659913 - protein, 9 aa, Homo Sapiens
ILRIASTEG

SEQ ID NO: 659914 - protein, 9 aa, Homo Sapiens
EGEPRVFRP

SEQ ID NO: 659915 - protein, 9 aa, Homo Sapiens
ADYPVPFHD

SEQ ID NO: 659916 - protein, 9 aa, Homo Sapiens
PDSQGSDCD

SEQ ID NO: 659917 - protein, 9 aa, Homo Sapiens
ESDPKSTDD

SEQ ID NO: 659918 - protein, 9 aa, Homo Sapiens
SEMRPLDRA

SEQ ID NO: 659919 - protein, 9 aa, Homo Sapiens
HAITAWYNK

SEQ ID NO: 659920 - protein, 9 aa, Homo Sapiens
EESRRGREA

SEQ ID NO: 659921 - protein, 9 aa, Homo Sapiens
SAGKKQLRG

SEQ ID NO: 659922 - protein, 9 aa, Homo Sapiens
VKVNIRDID

SEQ ID NO: 659923 - protein, 9 aa, Homo Sapiens
PFCESDPKS

SEQ ID NO: 659924 - protein, 9 aa, Homo Sapiens
SNAKKQARH

SEQ ID NO: 659925 - protein, 9 aa, Homo Sapiens
TSDPDTRHR

SEQ ID NO: 659926 - protein, 9 aa, Homo Sapiens
VALADFMLS

SEQ ID NO: 659927 - protein, 9 aa, Homo Sapiens
DSTSDPDTR

SEQ ID NO: 659928 - protein, 9 aa, Homo Sapiens
QGKRMFEKR

SEQ ID NO: 659929 - protein, 9 aa, Homo Sapiens
IMAFSTCSS

SEQ ID NO: 659930 - protein, 9 aa, Homo Sapiens
PPGRRDLEE

SEQ ID NO: 659931 - protein, 9 aa, Homo Sapiens
LRPFLFGGS

SEQ ID NO: 659932 - protein, 9 aa, Homo Sapiens
EIKYFINHV

SEQ ID NO: 659933 - protein, 9 aa, Homo Sapiens
EEAHVDLRG

SEQ ID NO: 659934 - protein, 9 aa, Homo Sapiens
SGHRKHLRT

SEQ ID NO: 659935 - protein, 9 aa, Homo Sapiens
GGLLLLLLV

SEQ ID NO: 659936 - protein, 9 aa, Homo Sapiens
EALAGMDTT

SEQ ID NO: 659937 - protein, 9 aa, Homo Sapiens
VKEWIRQIS

SEQ ID NO: 659938 - protein, 9 aa, Homo Sapiens
MGFTLTVVP

SEQ ID NO: 659939 - protein, 9 aa, Homo Sapiens
PAVTRFSPS

SEQ ID NO: 659940 - protein, 9 aa, Homo Sapiens
GRFSLDDCS

SEQ ID NO: 659941 - protein, 9 aa, Homo Sapiens
QTGCKNVCF

SEQ ID NO: 659942 - protein, 9 aa, Homo Sapiens
YSEMRPLDR

SEQ ID NO: 659943 - protein, 9 aa, Homo Sapiens
AVFVKNATE

SEQ ID NO: 659944 - protein, 9 aa, Homo Sapiens
CSKCQEKLH

SEQ ID NO: 659945 - protein, 9 aa, Homo Sapiens
PYANIPSAT

SEQ ID NO: 659946 - protein, 9 aa, Homo Sapiens
NSPGSDLSN

SEQ ID NO: 659947 - protein, 9 aa, Homo Sapiens
FAPATVFTP

SEQ ID NO: 659948 - protein, 9 aa, Homo Sapiens
PVASVVTTK

SEQ ID NO: 659949 - protein, 9 aa, Homo Sapiens
KSSRTLITP

SEQ ID NO: 659950 - protein, 9 aa, Homo Sapiens
PYFMASGKS

SEQ ID NO: 659951 - protein, 9 aa, Homo Sapiens
SRTVFSRKK

SEQ ID NO: 659952 - protein, 9 aa, Homo Sapiens
EFECNSRQT

SEQ ID NO: 659953 - protein, 9 aa, Homo Sapiens
VRGPPGEAL

SEQ ID NO: 659954 - protein, 9 aa, Homo Sapiens
LRLPCSDIR

SEQ ID NO: 659955 - protein, 9 aa, Homo Sapiens
RACFQRCSG

SEQ ID NO: 659956 - protein, 9 aa, Homo Sapiens
GKTIVERLG

SEQ ID NO: 659957 - protein, 9 aa, Homo Sapiens
GKPFTAYQA

SEQ ID NO: 659958 - protein, 9 aa, Homo Sapiens
LLRPDLNTK

SEQ ID NO: 659959 - protein, 9 aa, Homo Sapiens
RHQRLHTVE

SEQ ID NO: 659960 - protein, 9 aa, Homo Sapiens
MTPFCRNAK

SEQ ID NO: 659961 - protein, 9 aa, Homo Sapiens
RTQLLEGMG

SEQ ID NO: 659962 - protein, 9 aa, Homo Sapiens
LLEGMGFTL

SEQ ID NO: 659963 - protein, 9 aa, Homo Sapiens
CPAPYEIFP

SEQ ID NO: 659964 - protein, 9 aa, Homo Sapiens
LCSREGGKG

SEQ ID NO: 659965 - protein, 9 aa, Homo Sapiens
GSCFTYSSA

SEQ ID NO: 659966 - protein, 9 aa, Homo Sapiens
QVKECYQSY

SEQ ID NO: 659967 - protein, 9 aa, Homo Sapiens
ILNGEGEPR

SEQ ID NO: 659968 - protein, 9 aa, Homo Sapiens
KPRGLFMHG

SEQ ID NO: 659969 - protein, 9 aa, Homo Sapiens
YYLLILTTI

SEQ ID NO: 659970 - protein, 9 aa, Homo Sapiens
FYSSPRSPA

SEQ ID NO: 659971 - protein, 9 aa, Homo Sapiens
PPLVVVEMY

SEQ ID NO: 659972 - protein, 9 aa, Homo Sapiens
VCEFVTQFV

SEQ ID NO: 659973 - protein, 9 aa, Homo Sapiens
AHFMYYCSG

SEQ ID NO: 659974 - protein, 9 aa, Homo Sapiens
KTFLGLDDL

SEQ ID NO: 659975 - protein, 9 aa, Homo Sapiens
SPACGQARC

SEQ ID NO: 659976 - protein, 9 aa, Homo Sapiens
CSRHFWTKI

SEQ ID NO: 659977 - protein, 9 aa, Homo Sapiens
AVEPWDIAA

SEQ ID NO: 659978 - protein, 9 aa, Homo Sapiens
SDNESDHDE

SEQ ID NO: 659979 - protein, 9 aa, Homo Sapiens
AKQIKSEVA

SEQ ID NO: 659980 - protein, 9 aa, Homo Sapiens
TILRIASTE

SEQ ID NO: 659981 - protein, 9 aa, Homo Sapiens
RRDLEEVEA

SEQ ID NO: 659982 - protein, 9 aa, Homo Sapiens
KEWIRQISE

SEQ ID NO: 659983 - protein, 9 aa, Homo Sapiens
IKSFRKKTF

SEQ ID NO: 659984 - protein, 9 aa, Homo Sapiens
GGDPVLSST

SEQ ID NO: 659985 - protein, 9 aa, Homo Sapiens
RAFITHCGA

SEQ ID NO: 659986 - protein, 9 aa, Homo Sapiens
RVRNLQHLR

SEQ ID NO: 659987 - protein, 9 aa, Homo Sapiens
AAKAAAEAK

SEQ ID NO: 659988 - protein, 9 aa, Homo Sapiens
EGRHESSRI

SEQ ID NO: 659989 - protein, 9 aa, Homo Sapiens
EGLIPVRVL

SEQ ID NO: 659990 - protein, 9 aa, Homo Sapiens
QHLEDWPRR

SEQ ID NO: 659991 - protein, 9 aa, Homo Sapiens
ETSTIRLKV

SEQ ID NO: 659992 - protein, 9 aa, Homo Sapiens
LKDIQTGAF

SEQ ID NO: 659993 - protein, 9 aa, Homo Sapiens
DSMDTEKSP

SEQ ID NO: 659994 - protein, 9 aa, Homo Sapiens
FLSHKNMHS

SEQ ID NO: 659995 - protein, 9 aa, Homo Sapiens
LNHPRYMPH

SEQ ID NO: 659996 - protein, 9 aa, Homo Sapiens
VYLEDFYTR

SEQ ID NO: 659997 - protein, 9 aa, Homo Sapiens
DQEVSTTRL

SEQ ID NO: 659998 - protein, 9 aa, Homo Sapiens
DEIKYFINH

SEQ ID NO: 659999 - protein, 9 aa, Homo Sapiens
AVCEFVTQF

SEQ ID NO: 660000 - protein, 9 aa, Homo Sapiens
AVLNVSTSC

SEQ ID NO: 660001 - protein, 9 aa, Homo Sapiens
VAGIENNDR

SEQ ID NO: 660002 - protein, 9 aa, Homo Sapiens
KVKNVVGIE

SEQ ID NO: 660003 - protein, 9 aa, Homo Sapiens
ILDTMLKEK

SEQ ID NO: 660004 - protein, 9 aa, Homo Sapiens
LMNNFNGRF

SEQ ID NO: 660005 - protein, 9 aa, Homo Sapiens
YQLLKDTEP

SEQ ID NO: 660006 - protein, 9 aa, Homo Sapiens
EENASFSHA

SEQ ID NO: 660007 - protein, 9 aa, Homo Sapiens
EDHVECLDD

SEQ ID NO: 660008 - protein, 9 aa, Homo Sapiens
IELPKKYHK

SEQ ID NO: 660009 - protein, 9 aa, Homo Sapiens
QEACKAYLV

SEQ ID NO: 660010 - protein, 9 aa, Homo Sapiens
EAIPFSPIQ

SEQ ID NO: 660011 - protein, 9 aa, Homo Sapiens
LIKEKNDID

SEQ ID NO: 660012 - protein, 9 aa, Homo Sapiens
FSPIESTVD

SEQ ID NO: 660013 - protein, 9 aa, Homo Sapiens
LTETCLVQR

SEQ ID NO: 660014 - protein, 9 aa, Homo Sapiens
CKTISRAES

SEQ ID NO: 660015 - protein, 9 aa, Homo Sapiens
KVLKIIFVH

SEQ ID NO: 660016 - protein, 9 aa, Homo Sapiens
LTSYYISFT

SEQ ID NO: 660017 - protein, 9 aa, Homo Sapiens
WIRQISESK

SEQ ID NO: 660018 - protein, 9 aa, Homo Sapiens
LMKFQVKRE

SEQ ID NO: 660019 - protein, 9 aa, Homo Sapiens
TVCFFHVAL

SEQ ID NO: 660020 - protein, 9 aa, Homo Sapiens
NCVYKVLHG

SEQ ID NO: 660021 - protein, 9 aa, Homo Sapiens
KPKREKTPS

SEQ ID NO: 660022 - protein, 9 aa, Homo Sapiens
KIKIQDLDR

SEQ ID NO: 660023 - protein, 9 aa, Homo Sapiens
GQSLWPRAG

SEQ ID NO: 660024 - protein, 9 aa, Homo Sapiens
GNSVFSMAA

SEQ ID NO: 660025 - protein, 9 aa, Homo Sapiens
TLGGQGLWI

SEQ ID NO: 660026 - protein, 9 aa, Homo Sapiens
KLKSCMPDS

SEQ ID NO: 660027 - protein, 9 aa, Homo Sapiens
FNALMDVVS

SEQ ID NO: 660028 - protein, 9 aa, Homo Sapiens
MYDSDAVGK

SEQ ID NO: 660029 - protein, 9 aa, Homo Sapiens
KQIKSEVAT

SEQ ID NO: 660030 - protein, 9 aa, Homo Sapiens
LLRLPCSDI

SEQ ID NO: 660031 - protein, 9 aa, Homo Sapiens
CQQCFSNNG

SEQ ID NO: 660032 - protein, 9 aa, Homo Sapiens
KTQFYDFDS

SEQ ID NO: 660033 - protein, 9 aa, Homo Sapiens
RFRRQIPGA

SEQ ID NO: 660034 - protein, 9 aa, Homo Sapiens
RNLQHLRGL

SEQ ID NO: 660035 - protein, 9 aa, Homo Sapiens
RVLRSWLAV

SEQ ID NO: 660036 - protein, 9 aa, Homo Sapiens
FDGNDHSLI

SEQ ID NO: 660037 - protein, 9 aa, Homo Sapiens
HEFIALIFG

SEQ ID NO: 660038 - protein, 9 aa, Homo Sapiens
APATVFTPL

SEQ ID NO: 660039 - protein, 9 aa, Homo Sapiens
ERKLEDDWA

SEQ ID NO: 660040 - protein, 9 aa, Homo Sapiens
GDVPGITDE

SEQ ID NO: 660041 - protein, 9 aa, Homo Sapiens
APRILRSLF

SEQ ID NO: 660042 - protein, 9 aa, Homo Sapiens
IVATILRIA

SEQ ID NO: 660043 - protein, 9 aa, Homo Sapiens
SLLVIVHAP

SEQ ID NO: 660044 - protein, 9 aa, Homo Sapiens
KFASWGEGE

SEQ ID NO: 660045 - protein, 9 aa, Homo Sapiens
SQFSSRSRS

SEQ ID NO: 660046 - protein, 9 aa, Homo Sapiens
KLVELEHNL

SEQ ID NO: 660047 - protein, 9 aa, Homo Sapiens
LPSADHNLK

SEQ ID NO: 660048 - protein, 9 aa, Homo Sapiens
VHAPNLPYR

SEQ ID NO: 660049 - protein, 9 aa, Homo Sapiens
CLLKLEEEI

SEQ ID NO: 660050 - protein, 9 aa, Homo Sapiens
GYVSQSFCG

SEQ ID NO: 660051 - protein, 9 aa, Homo Sapiens
ELPKCAVCL

SEQ ID NO: 660052 - protein, 9 aa, Homo Sapiens
FKNNSKQKC

SEQ ID NO: 660053 - protein, 9 aa, Homo Sapiens
TSQIVLSPH

SEQ ID NO: 660054 - protein, 9 aa, Homo Sapiens
WIQKEPMTT

SEQ ID NO: 660055 - protein, 9 aa, Homo Sapiens
YIRGKLGLQ

SEQ ID NO: 660056 - protein, 9 aa, Homo Sapiens
MKFQVKREP

SEQ ID NO: 660057 - protein, 9 aa, Homo Sapiens
LPSFLFLLL

SEQ ID NO: 660058 - protein, 9 aa, Homo Sapiens
QPRACFQRC

SEQ ID NO: 660059 - protein, 9 aa, Homo Sapiens
HHALKEALS

SEQ ID NO: 660060 - protein, 9 aa, Homo Sapiens
DQKDGNVLP

SEQ ID NO: 660061 - protein, 9 aa, Homo Sapiens
SQQCSRPSL

SEQ ID NO: 660062 - protein, 9 aa, Homo Sapiens
NALYCEFVN

SEQ ID NO: 660063 - protein, 9 aa, Homo Sapiens
NSRQTGCKN

SEQ ID NO: 660064 - protein, 9 aa, Homo Sapiens
NQGFCKDGP

SEQ ID NO: 660065 - protein, 9 aa, Homo Sapiens
MKKPEPGLI

SEQ ID NO: 660066 - protein, 9 aa, Homo Sapiens
IPTFATENN

SEQ ID NO: 660067 - protein, 9 aa, Homo Sapiens
NVCAPMVRY

SEQ ID NO: 660068 - protein, 9 aa, Homo Sapiens
TLLGSCFTY

SEQ ID NO: 660069 - protein, 9 aa, Homo Sapiens
AYRCTIKKE

SEQ ID NO: 660070 - protein, 9 aa, Homo Sapiens
QEPGANEPM

SEQ ID NO: 660071 - protein, 9 aa, Homo Sapiens
TPEEAHVDL

SEQ ID NO: 660072 - protein, 9 aa, Homo Sapiens
PVITAGPGF

SEQ ID NO: 660073 - protein, 9 aa, Homo Sapiens
NKIESQEEM

SEQ ID NO: 660074 - protein, 9 aa, Homo Sapiens
PVNTPIVID

SEQ ID NO: 660075 - protein, 9 aa, Homo Sapiens
GLPSFLFLL

SEQ ID NO: 660076 - protein, 9 aa, Homo Sapiens
ESISALIKL

SEQ ID NO: 660077 - protein, 9 aa, Homo Sapiens
SGVVINFKK

SEQ ID NO: 660078 - protein, 9 aa, Homo Sapiens
KGHCQQGQK

SEQ ID NO: 660079 - protein, 9 aa, Homo Sapiens
EEIAEKHDI

SEQ ID NO: 660080 - protein, 9 aa, Homo Sapiens
GNDHSLIIL

SEQ ID NO: 660081 - protein, 9 aa, Homo Sapiens
LDQEVSTTR

SEQ ID NO: 660082 - protein, 9 aa, Homo Sapiens
SVRNCYFGM

SEQ ID NO: 660083 - protein, 9 aa, Homo Sapiens
ALVSYFSQT

SEQ ID NO: 660084 - protein, 9 aa, Homo Sapiens
GQLVNVCAP

SEQ ID NO: 660085 - protein, 9 aa, Homo Sapiens
PESSPFSSL

SEQ ID NO: 660086 - protein, 9 aa, Homo Sapiens
YLEFSPIES

SEQ ID NO: 660087 - protein, 9 aa, Homo Sapiens
EAAIEEGKV

SEQ ID NO: 660088 - protein, 9 aa, Homo Sapiens
RDSTDEGIF

SEQ ID NO: 660089 - protein, 9 aa, Homo Sapiens
ALGDVVLSE

SEQ ID NO: 660090 - protein, 9 aa, Homo Sapiens
VVYNAQGPI

SEQ ID NO: 660091 - protein, 9 aa, Homo Sapiens
PNPFTSQIE

SEQ ID NO: 660092 - protein, 9 aa, Homo Sapiens
QGPIGKAAE

SEQ ID NO: 660093 - protein, 9 aa, Homo Sapiens
SDLSNQDAE

SEQ ID NO: 660094 - protein, 9 aa, Homo Sapiens
GRWVSIWDP

SEQ ID NO: 660095 - protein, 9 aa, Homo Sapiens
KQRLLAEEL

SEQ ID NO: 660096 - protein, 9 aa, Homo Sapiens
AFPEIPRWK

SEQ ID NO: 660097 - protein, 9 aa, Homo Sapiens
PGPGESDLD

SEQ ID NO: 660098 - protein, 9 aa, Homo Sapiens
EPHQPSSDR

SEQ ID NO: 660099 - protein, 9 aa, Homo Sapiens
EKNDIDHYL

SEQ ID NO: 660100 - protein, 9 aa, Homo Sapiens
KKAVCHKLL

SEQ ID NO: 660101 - protein, 9 aa, Homo Sapiens
RALCHQLLR

SEQ ID NO: 660102 - protein, 9 aa, Homo Sapiens
RILRSLFVC

SEQ ID NO: 660103 - protein, 9 aa, Homo Sapiens
DHTYKFHPD

SEQ ID NO: 660104 - protein, 9 aa, Homo Sapiens
IFYTMLTPM

SEQ ID NO: 660105 - protein, 9 aa, Homo Sapiens
VFVKNATEI

SEQ ID NO: 660106 - protein, 9 aa, Homo Sapiens
VAAARMLPL

SEQ ID NO: 660107 - protein, 9 aa, Homo Sapiens
TTLESAPSE

SEQ ID NO: 660108 - protein, 9 aa, Homo Sapiens
APSKPIGVR

SEQ ID NO: 660109 - protein, 9 aa, Homo Sapiens
WTMGKNGFN

SEQ ID NO: 660110 - protein, 9 aa, Homo Sapiens
KIESQEEML

SEQ ID NO: 660111 - protein, 9 aa, Homo Sapiens
RRDEMLRMH

SEQ ID NO: 660112 - protein, 9 aa, Homo Sapiens
HETVRKFLL

SEQ ID NO: 660113 - protein, 9 aa, Homo Sapiens
GDRDSQEHV

SEQ ID NO: 660114 - protein, 9 aa, Homo Sapiens
IVTLLGSCF

SEQ ID NO: 660115 - protein, 9 aa, Homo Sapiens
IAVSWATFF

SEQ ID NO: 660116 - protein, 9 aa, Homo Sapiens
DSAWKPQKK

SEQ ID NO: 660117 - protein, 9 aa, Homo Sapiens
FLFGGSGEG

SEQ ID NO: 660118 - protein, 9 aa, Homo Sapiens
ENKPDNVVL

SEQ ID NO: 660119 - protein, 9 aa, Homo Sapiens
GYLGLANAS

SEQ ID NO: 660120 - protein, 9 aa, Homo Sapiens
SRVKVFGSK

SEQ ID NO: 660121 - protein, 9 aa, Homo Sapiens
ANLLTSYYI

SEQ ID NO: 660122 - protein, 9 aa, Homo Sapiens
RRQIPGAGR

SEQ ID NO: 660123 - protein, 9 aa, Homo Sapiens
KLLEIYKML

SEQ ID NO: 660124 - protein, 9 aa, Homo Sapiens
WTNMAISLV

SEQ ID NO: 660125 - protein, 9 aa, Homo Sapiens
TDKWIQKEP

SEQ ID NO: 660126 - protein, 9 aa, Homo Sapiens
IFRLSKAQL

SEQ ID NO: 660127 - protein, 9 aa, Homo Sapiens
FHPDKTKFT

SEQ ID NO: 660128 - protein, 9 aa, Homo Sapiens
GSEERTSRV

SEQ ID NO: 660129 - protein, 9 aa, Homo Sapiens
AEDTLPGSL

SEQ ID NO: 660130 - protein, 9 aa, Homo Sapiens
WSPDLWKLS

SEQ ID NO: 660131 - protein, 9 aa, Homo Sapiens
YYVYHKTKK

SEQ ID NO: 660132 - protein, 9 aa, Homo Sapiens
HHAVYPAVT

SEQ ID NO: 660133 - protein, 9 aa, Homo Sapiens
VNSQKEDTN

SEQ ID NO: 660134 - protein, 9 aa, Homo Sapiens
QSGVVINFK

SEQ ID NO: 660135 - protein, 9 aa, Homo Sapiens
GEALAGMDT

SEQ ID NO: 660136 - protein, 9 aa, Homo Sapiens
KLHRSRPIS

SEQ ID NO: 660137 - protein, 9 aa, Homo Sapiens
THCGANGIY

SEQ ID NO: 660138 - protein, 9 aa, Homo Sapiens
VFTPLGALS

SEQ ID NO: 660139 - protein, 9 aa, Homo Sapiens
MFHSGQLVN

SEQ ID NO: 660140 - protein, 9 aa, Homo Sapiens
SRRRREGRH

SEQ ID NO: 660141 - protein, 9 aa, Homo Sapiens
HHSDVPVQV

SEQ ID NO: 660142 - protein, 9 aa, Homo Sapiens
PRGLFMHGD

SEQ ID NO: 660143 - protein, 9 aa, Homo Sapiens
HCQQGQKQS

SEQ ID NO: 660144 - protein, 9 aa, Homo Sapiens
HPRYMPHLE

SEQ ID NO: 660145 - protein, 9 aa, Homo Sapiens
SDVPVQVEL

SEQ ID NO: 660146 - protein, 9 aa, Homo Sapiens
SLRRVIDFT

SEQ ID NO: 660147 - protein, 9 aa, Homo Sapiens
DLLEDTDLL

SEQ ID NO: 660148 - protein, 9 aa, Homo Sapiens
SRAVQETCR

SEQ ID NO: 660149 - protein, 9 aa, Homo Sapiens
ANANGMVEK

SEQ ID NO: 660150 - protein, 9 aa, Homo Sapiens
IKYSVIEER

SEQ ID NO: 660151 - protein, 9 aa, Homo Sapiens
ELSAPKPRG

SEQ ID NO: 660152 - protein, 9 aa, Homo Sapiens
VLERIIVVR

SEQ ID NO: 660153 - protein, 9 aa, Homo Sapiens
SAQLTSTLH

SEQ ID NO: 660154 - protein, 9 aa, Homo Sapiens
HLFPHQEAI

SEQ ID NO: 660155 - protein, 9 aa, Homo Sapiens
SQNMTADQS

SEQ ID NO: 660156 - protein, 9 aa, Homo Sapiens
AGLPSFLFL

SEQ ID NO: 660157 - protein, 9 aa, Homo Sapiens
MAFSTCSSH

SEQ ID NO: 660158 - protein, 9 aa, Homo Sapiens
KQFICKFCG

SEQ ID NO: 660159 - protein, 9 aa, Homo Sapiens
RLAPYDAWR

SEQ ID NO: 660160 - protein, 9 aa, Homo Sapiens
LEDDWARCE

SEQ ID NO: 660161 - protein, 9 aa, Homo Sapiens
QEYAVFYPP

SEQ ID NO: 660162 - protein, 9 aa, Homo Sapiens
KTAAKGGVS

SEQ ID NO: 660163 - protein, 9 aa, Homo Sapiens
LERIIVVRT

SEQ ID NO: 660164 - protein, 9 aa, Homo Sapiens
KNYSVSAGY

SEQ ID NO: 660165 - protein, 9 aa, Homo Sapiens
QTLSLSIRK

SEQ ID NO: 660166 - protein, 9 aa, Homo Sapiens
HSDVPVQVE

SEQ ID NO: 660167 - protein, 9 aa, Homo Sapiens
ADEIKYFIN

SEQ ID NO: 660168 - protein, 9 aa, Homo Sapiens
CCSRHFWTK

SEQ ID NO: 660169 - protein, 9 aa, Homo Sapiens
SKAQLRQFT

SEQ ID NO: 660170 - protein, 9 aa, Homo Sapiens
MRDFKRLQD

SEQ ID NO: 660171 - protein, 9 aa, Homo Sapiens
QLVNVCAPM

SEQ ID NO: 660172 - protein, 9 aa, Homo Sapiens
NAIPIIMCS

SEQ ID NO: 660173 - protein, 9 aa, Homo Sapiens
TCFFLCFLR

SEQ ID NO: 660174 - protein, 9 aa, Homo Sapiens
EISHMNFRM

SEQ ID NO: 660175 - protein, 9 aa, Homo Sapiens
TFEFYMAYA

SEQ ID NO: 660176 - protein, 9 aa, Homo Sapiens
PLRSKKAVC

SEQ ID NO: 660177 - protein, 9 aa, Homo Sapiens
ALCRTYYNN

SEQ ID NO: 660178 - protein, 9 aa, Homo Sapiens
AGDAEDTLP

SEQ ID NO: 660179 - protein, 9 aa, Homo Sapiens
KAHEFIALI

SEQ ID NO: 660180 - protein, 9 aa, Homo Sapiens
WKVNYNFEH

SEQ ID NO: 660181 - protein, 9 aa, Homo Sapiens
SAPRILRSL

SEQ ID NO: 660182 - protein, 9 aa, Homo Sapiens
FNKIESQEE

SEQ ID NO: 660183 - protein, 9 aa, Homo Sapiens
LQGPIGKAA

SEQ ID NO: 660184 - protein, 9 aa, Homo Sapiens
MKEHIKYRH

SEQ ID NO: 660185 - protein, 9 aa, Homo Sapiens
AWANWGPWT

SEQ ID NO: 660186 - protein, 9 aa, Homo Sapiens
DLFDSTSDP

SEQ ID NO: 660187 - protein, 9 aa, Homo Sapiens
NFLFHNRGN

SEQ ID NO: 660188 - protein, 9 aa, Homo Sapiens
PVWAMLFFW

SEQ ID NO: 660189 - protein, 9 aa, Homo Sapiens
KNDIDHYLE

SEQ ID NO: 660190 - protein, 9 aa, Homo Sapiens
YHKMVGVIF

SEQ ID NO: 660191 - protein, 9 aa, Homo Sapiens
NKQEFMDLS

SEQ ID NO: 660192 - protein, 9 aa, Homo Sapiens
EAADHLLIV

SEQ ID NO: 660193 - protein, 9 aa, Homo Sapiens
SKCQEKLHR

SEQ ID NO: 660194 - protein, 9 aa, Homo Sapiens
NIANCSQTC

SEQ ID NO: 660195 - protein, 9 aa, Homo Sapiens
EEVWDDKQK

SEQ ID NO: 660196 - protein, 9 aa, Homo Sapiens
AADHLLIVA

SEQ ID NO: 660197 - protein, 9 aa, Homo Sapiens
VATILRIAS

SEQ ID NO: 660198 - protein, 9 aa, Homo Sapiens
PETEGDAQP

SEQ ID NO: 660199 - protein, 9 aa, Homo Sapiens
ADHTVQEAD

SEQ ID NO: 660200 - protein, 9 aa, Homo Sapiens
GYPPVTVMS

SEQ ID NO: 660201 - protein, 9 aa, Homo Sapiens
CGVDHELLS

SEQ ID NO: 660202 - protein, 9 aa, Homo Sapiens
AIFYTMLTP

SEQ ID NO: 660203 - protein, 9 aa, Homo Sapiens
EGSEITKVS

SEQ ID NO: 660204 - protein, 9 aa, Homo Sapiens
EESTSKKLA

SEQ ID NO: 660205 - protein, 9 aa, Homo Sapiens
DPAAEASSA

SEQ ID NO: 660206 - protein, 9 aa, Homo Sapiens
MDVVSEWRK

SEQ ID NO: 660207 - protein, 9 aa, Homo Sapiens
KLPYANIPS

SEQ ID NO: 660208 - protein, 9 aa, Homo Sapiens
KRWICNIPR

SEQ ID NO: 660209 - protein, 9 aa, Homo Sapiens
IVLERIIVV

SEQ ID NO: 660210 - protein, 9 aa, Homo Sapiens
CVPNVSTIT

SEQ ID NO: 660211 - protein, 9 aa, Homo Sapiens
NVSTITEEG

SEQ ID NO: 660212 - protein, 9 aa, Homo Sapiens
YNAQGPIGS

SEQ ID NO: 660213 - protein, 9 aa, Homo Sapiens
APYEIFPED

SEQ ID NO: 660214 - protein, 9 aa, Homo Sapiens
KKPEPGLIG

SEQ ID NO: 660215 - protein, 9 aa, Homo Sapiens
PPFCESDPK

SEQ ID NO: 660216 - protein, 9 aa, Homo Sapiens
AIPFSPIQN

SEQ ID NO: 660217 - protein, 9 aa, Homo Sapiens
ISAPPVILE

SEQ ID NO: 660218 - protein, 9 aa, Homo Sapiens
KRKRENVKQ

SEQ ID NO: 660219 - protein, 9 aa, Homo Sapiens
NMKRWICNI

SEQ ID NO: 660220 - protein, 9 aa, Homo Sapiens
GGMNRRLIL

SEQ ID NO: 660221 - protein, 9 aa, Homo Sapiens
SAWKPQKKV

SEQ ID NO: 660222 - protein, 9 aa, Homo Sapiens
EDTLPGSLS

SEQ ID NO: 660223 - protein, 9 aa, Homo Sapiens
SETLIRATQ

SEQ ID NO: 660224 - protein, 9 aa, Homo Sapiens
ALIFGIALT

SEQ ID NO: 660225 - protein, 9 aa, Homo Sapiens
QDLDSMDTE

SEQ ID NO: 660226 - protein, 9 aa, Homo Sapiens
CRTYYNNSM

SEQ ID NO: 660227 - protein, 9 aa, Homo Sapiens
LHGAASLGS

SEQ ID NO: 660228 - protein, 9 aa, Homo Sapiens
NLRKLQGPI

SEQ ID NO: 660229 - protein, 9 aa, Homo Sapiens
GWAEGGRWV

SEQ ID NO: 660230 - protein, 9 aa, Homo Sapiens
AVKPFVSVT

SEQ ID NO: 660231 - protein, 9 aa, Homo Sapiens
KDLQTADYP

SEQ ID NO: 660232 - protein, 9 aa, Homo Sapiens
EFMDLSICT

SEQ ID NO: 660233 - protein, 9 aa, Homo Sapiens
LKIIFVHLI

SEQ ID NO: 660234 - protein, 9 aa, Homo Sapiens
SALIKLVNK

SEQ ID NO: 660235 - protein, 9 aa, Homo Sapiens
VWSQQCSRP

SEQ ID NO: 660236 - protein, 9 aa, Homo Sapiens
IASTEGKHK

SEQ ID NO: 660237 - protein, 9 aa, Homo Sapiens
IIYKESISV

SEQ ID NO: 660238 - protein, 9 aa, Homo Sapiens
HARKTAVHD

SEQ ID NO: 660239 - protein, 9 aa, Homo Sapiens
SAVPQPSTS

SEQ ID NO: 660240 - protein, 9 aa, Homo Sapiens
GSGEGVDPQ

SEQ ID NO: 660241 - protein, 9 aa, Homo Sapiens
EENDSDNES

SEQ ID NO: 660242 - protein, 9 aa, Homo Sapiens
IGKAAERQF

SEQ ID NO: 660243 - protein, 9 aa, Homo Sapiens
ASWGEGEDD

SEQ ID NO: 660244 - protein, 9 aa, Homo Sapiens
LRKGVCTGC

SEQ ID NO: 660245 - protein, 9 aa, Homo Sapiens
RSRQGQSLW

SEQ ID NO: 660246 - protein, 9 aa, Homo Sapiens
INFKKTGPD

SEQ ID NO: 660247 - protein, 9 aa, Homo Sapiens
SSRTLITPQ

SEQ ID NO: 660248 - protein, 9 aa, Homo Sapiens
DVMDKSHDT

SEQ ID NO: 660249 - protein, 9 aa, Homo Sapiens
IYKESISVS

SEQ ID NO: 660250 - protein, 9 aa, Homo Sapiens
LQFPFQGKP

SEQ ID NO: 660251 - protein, 9 aa, Homo Sapiens
CEAIMEHCY

SEQ ID NO: 660252 - protein, 9 aa, Homo Sapiens
CESDPKSTD

SEQ ID NO: 660253 - protein, 9 aa, Homo Sapiens
FKKTGPDPL

SEQ ID NO: 660254 - protein, 9 aa, Homo Sapiens
FKRLQDDPP

SEQ ID NO: 660255 - protein, 9 aa, Homo Sapiens
VDKDQAYRC

SEQ ID NO: 660256 - protein, 9 aa, Homo Sapiens
ITHCGANGI

SEQ ID NO: 660257 - protein, 9 aa, Homo Sapiens
EDQEEEEEG

SEQ ID NO: 660258 - protein, 9 aa, Homo Sapiens
RATSSRGWT

SEQ ID NO: 660259 - protein, 9 aa, Homo Sapiens
IVCGDYGRM

SEQ ID NO: 660260 - protein, 9 aa, Homo Sapiens
FQFVSGWYN

SEQ ID NO: 660261 - protein, 9 aa, Homo Sapiens
PAPYEIFPE

SEQ ID NO: 660262 - protein, 9 aa, Homo Sapiens
CLHGAASLG

SEQ ID NO: 660263 - protein, 9 aa, Homo Sapiens
DKDQAYRCT

SEQ ID NO: 660264 - protein, 9 aa, Homo Sapiens
TSCPNHFEG

SEQ ID NO: 660265 - protein, 9 aa, Homo Sapiens
NFKKTGPDP

SEQ ID NO: 660266 - protein, 9 aa, Homo Sapiens
SSVWSQQCS

SEQ ID NO: 660267 - protein, 9 aa, Homo Sapiens
DLLESQLET

SEQ ID NO: 660268 - protein, 9 aa, Homo Sapiens
YHSQPERQD

SEQ ID NO: 660269 - protein, 9 aa, Homo Sapiens
GNAGMVAGI

SEQ ID NO: 660270 - protein, 9 aa, Homo Sapiens
IQNEQCPQV

SEQ ID NO: 660271 - protein, 9 aa, Homo Sapiens
WTITSMCSE

SEQ ID NO: 660272 - protein, 9 aa, Homo Sapiens
GETVNLQFP

SEQ ID NO: 660273 - protein, 9 aa, Homo Sapiens
RDFKRLQDD

SEQ ID NO: 660274 - protein, 9 aa, Homo Sapiens
AGMVAGIEN

SEQ ID NO: 660275 - protein, 9 aa, Homo Sapiens
HTVERPYEC

SEQ ID NO: 660276 - protein, 9 aa, Homo Sapiens
HLRGLPASF

SEQ ID NO: 660277 - protein, 9 aa, Homo Sapiens
GVYQCMARK

SEQ ID NO: 660278 - protein, 9 aa, Homo Sapiens
PGAGRSTPE

SEQ ID NO: 660279 - protein, 9 aa, Homo Sapiens
PIGVRSVGP

SEQ ID NO: 660280 - protein, 9 aa, Homo Sapiens
RETGQTECA

SEQ ID NO: 660281 - protein, 9 aa, Homo Sapiens
CPHKQIDDF

SEQ ID NO: 660282 - protein, 9 aa, Homo Sapiens
PKPRVSSIH

SEQ ID NO: 660283 - protein, 9 aa, Homo Sapiens
VKVFGSKKR

SEQ ID NO: 660284 - protein, 9 aa, Homo Sapiens
AFTASTNSA

SEQ ID NO: 660285 - protein, 9 aa, Homo Sapiens
KMTSLNLAN

SEQ ID NO: 660286 - protein, 9 aa, Homo Sapiens
MGKVVKKYE

SEQ ID NO: 660287 - protein, 9 aa, Homo Sapiens
HVECLDDEE

SEQ ID NO: 660288 - protein, 9 aa, Homo Sapiens
PSLQPRACF

SEQ ID NO: 660289 - protein, 9 aa, Homo Sapiens
NVSLGILLA

SEQ ID NO: 660290 - protein, 9 aa, Homo Sapiens
MQRGGNNPL

SEQ ID NO: 660291 - protein, 9 aa, Homo Sapiens
RLSKAQLRQ

SEQ ID NO: 660292 - protein, 9 aa, Homo Sapiens
NPFTSQIEF

SEQ ID NO: 660293 - protein, 9 aa, Homo Sapiens
GSLGACYNK

SEQ ID NO: 660294 - protein, 9 aa, Homo Sapiens
EAHVDLRGN

SEQ ID NO: 660295 - protein, 9 aa, Homo Sapiens
EDEENDSDN

SEQ ID NO: 660296 - protein, 9 aa, Homo Sapiens
WGREQDSAR

SEQ ID NO: 660297 - protein, 9 aa, Homo Sapiens
LPFPHQGSL

SEQ ID NO: 660298 - protein, 9 aa, Homo Sapiens
HWKLLRQEL

SEQ ID NO: 660299 - protein, 9 aa, Homo Sapiens
ECYQSYRDT

SEQ ID NO: 660300 - protein, 9 aa, Homo Sapiens
TISRAESGA

SEQ ID NO: 660301 - protein, 9 aa, Homo Sapiens
DTSQIVLSP

SEQ ID NO: 660302 - protein, 9 aa, Homo Sapiens
RKLEDDWAR

SEQ ID NO: 660303 - protein, 9 aa, Homo Sapiens
LLLYKFKMK

SEQ ID NO: 660304 - protein, 9 aa, Homo Sapiens
VGELSWGKL

SEQ ID NO: 660305 - protein, 9 aa, Homo Sapiens
PRILRSLFV

SEQ ID NO: 660306 - protein, 9 aa, Homo Sapiens
VKECYQSYR

SEQ ID NO: 660307 - protein, 9 aa, Homo Sapiens
FEFYMAYAD

SEQ ID NO: 660308 - protein, 9 aa, Homo Sapiens
PRACFQRCS

SEQ ID NO: 660309 - protein, 9 aa, Homo Sapiens
QLCSRFPVA

SEQ ID NO: 660310 - protein, 9 aa, Homo Sapiens
VVRTNLRKL

SEQ ID NO: 660311 - protein, 9 aa, Homo Sapiens
IEYSSYNEQ

SEQ ID NO: 660312 - protein, 9 aa, Homo Sapiens
MDFHFNALM

SEQ ID NO: 660313 - protein, 9 aa, Homo Sapiens
HGAWANWGP

SEQ ID NO: 660314 - protein, 9 aa, Homo Sapiens
VDYSEMRPL

SEQ ID NO: 660315 - protein, 9 aa, Homo Sapiens
NATEGDCGL

SEQ ID NO: 660316 - protein, 9 aa, Homo Sapiens
DPVRATIGR

SEQ ID NO: 660317 - protein, 9 aa, Homo Sapiens
PIYGRTSEN

SEQ ID NO: 660318 - protein, 9 aa, Homo Sapiens
TKVLKIIFV

SEQ ID NO: 660319 - protein, 9 aa, Homo Sapiens
LPGLDTMQR

SEQ ID NO: 660320 - protein, 9 aa, Homo Sapiens
WEKLKRLYG

SEQ ID NO: 660321 - protein, 9 aa, Homo Sapiens
SWGKLYSLG

SEQ ID NO: 660322 - protein, 9 aa, Homo Sapiens
LGDSRPLHL

SEQ ID NO: 660323 - protein, 9 aa, Homo Sapiens
KPRVSSIHL

SEQ ID NO: 660324 - protein, 9 aa, Homo Sapiens
HEGWWRGRC

SEQ ID NO: 660325 - protein, 9 aa, Homo Sapiens
KVGIYNNKG

SEQ ID NO: 660326 - protein, 9 aa, Homo Sapiens
EIYKMLGEE

SEQ ID NO: 660327 - protein, 9 aa, Homo Sapiens
LNFLSHKNM

SEQ ID NO: 660328 - protein, 9 aa, Homo Sapiens
RARPAPSHW

SEQ ID NO: 660329 - protein, 9 aa, Homo Sapiens
AHRGGLTLN

SEQ ID NO: 660330 - protein, 9 aa, Homo Sapiens
GFHKGRGRD

SEQ ID NO: 660331 - protein, 9 aa, Homo Sapiens
RWICNIPRA

SEQ ID NO: 660332 - protein, 9 aa, Homo Sapiens
VRATIGRYV

SEQ ID NO: 660333 - protein, 9 aa, Homo Sapiens
YSLLQPQDP

SEQ ID NO: 660334 - protein, 9 aa, Homo Sapiens
QPQDPHLPL

SEQ ID NO: 660335 - protein, 9 aa, Homo Sapiens
STSKKLAGT

SEQ ID NO: 660336 - protein, 9 aa, Homo Sapiens
RTSENGFNF

SEQ ID NO: 660337 - protein, 9 aa, Homo Sapiens
SQLIKEKND

SEQ ID NO: 660338 - protein, 9 aa, Homo Sapiens
FSSRSRSRS

SEQ ID NO: 660339 - protein, 9 aa, Homo Sapiens
TKEGRIMAF

SEQ ID NO: 660340 - protein, 9 aa, Homo Sapiens
DGMDNETGS

SEQ ID NO: 660341 - protein, 9 aa, Homo Sapiens
CPNKCVMSE

SEQ ID NO: 660342 - protein, 9 aa, Homo Sapiens
DGNVLPFPH

SEQ ID NO: 660343 - protein, 9 aa, Homo Sapiens
PLCSREGGK

SEQ ID NO: 660344 - protein, 9 aa, Homo Sapiens
IMKELSRLG

SEQ ID NO: 660345 - protein, 9 aa, Homo Sapiens
VFSRVKVFG

SEQ ID NO: 660346 - protein, 9 aa, Homo Sapiens
LSVAVAVKP

SEQ ID NO: 660347 - protein, 9 aa, Homo Sapiens
ELSRLLFIG

SEQ ID NO: 660348 - protein, 9 aa, Homo Sapiens
LTSTLHRRN

SEQ ID NO: 660349 - protein, 9 aa, Homo Sapiens
LVELEHNLL

SEQ ID NO: 660350 - protein, 9 aa, Homo Sapiens
GWTITSMCS

SEQ ID NO: 660351 - protein, 9 aa, Homo Sapiens
GRYVVRYTS

SEQ ID NO: 660352 - protein, 9 aa, Homo Sapiens
LIKLVNKSI

SEQ ID NO: 660353 - protein, 9 aa, Homo Sapiens
GHAGNPRDS

SEQ ID NO: 660354 - protein, 9 aa, Homo Sapiens
QQGQKQSGS

SEQ ID NO: 660355 - protein, 9 aa, Homo Sapiens
TWIIYKESI

SEQ ID NO: 660356 - protein, 9 aa, Homo Sapiens
EGEDDEPRS

SEQ ID NO: 660357 - protein, 9 aa, Homo Sapiens
AGIENNDRF

SEQ ID NO: 660358 - protein, 9 aa, Homo Sapiens
LMSQTGYLG

SEQ ID NO: 660359 - protein, 9 aa, Homo Sapiens
PWDIAACFR

SEQ ID NO: 660360 - protein, 9 aa, Homo Sapiens
RTSRVLHAP

SEQ ID NO: 660361 - protein, 9 aa, Homo Sapiens
QHALDLQNL

SEQ ID NO: 660362 - protein, 9 aa, Homo Sapiens
LSPHLERIR

SEQ ID NO: 660363 - protein, 9 aa, Homo Sapiens
PACGQARCG

SEQ ID NO: 660364 - protein, 9 aa, Homo Sapiens
PSFRQNCKV

SEQ ID NO: 660365 - protein, 9 aa, Homo Sapiens
GKLGLQEYA

SEQ ID NO: 660366 - protein, 9 aa, Homo Sapiens
MTQWETAAP

SEQ ID NO: 660367 - protein, 9 aa, Homo Sapiens
EGFCCSRHF

SEQ ID NO: 660368 - protein, 9 aa, Homo Sapiens
LSESEKGLE

SEQ ID NO: 660369 - protein, 9 aa, Homo Sapiens
WANWGPWTP

SEQ ID NO: 660370 - protein, 9 aa, Homo Sapiens
RCFPLDIRL

SEQ ID NO: 660371 - protein, 9 aa, Homo Sapiens
CSREGGKGV

SEQ ID NO: 660372 - protein, 9 aa, Homo Sapiens
PVLSSTTHI

SEQ ID NO: 660373 - protein, 9 aa, Homo Sapiens
LGTGAEGAE

SEQ ID NO: 660374 - protein, 9 aa, Homo Sapiens
LNVSTSCPN

SEQ ID NO: 660375 - protein, 9 aa, Homo Sapiens
ETVNLQFPF

SEQ ID NO: 660376 - protein, 9 aa, Homo Sapiens
EGGKGVRSL

SEQ ID NO: 660377 - protein, 9 aa, Homo Sapiens
VGIYNNKGD

SEQ ID NO: 660378 - protein, 9 aa, Homo Sapiens
LNGEGEPRV

SEQ ID NO: 660379 - protein, 9 aa, Homo Sapiens
GFSAPRILR

SEQ ID NO: 660380 - protein, 9 aa, Homo Sapiens
AANVTPTKC

SEQ ID NO: 660381 - protein, 9 aa, Homo Sapiens
DCGLYRCVV

SEQ ID NO: 660382 - protein, 9 aa, Homo Sapiens
ICNIPRAME

SEQ ID NO: 660383 - protein, 9 aa, Homo Sapiens
TAVCEFVTQ

SEQ ID NO: 660384 - protein, 9 aa, Homo Sapiens
STLHRRNTS

SEQ ID NO: 660385 - protein, 9 aa, Homo Sapiens
KKTFLGLDD

SEQ ID NO: 660386 - protein, 9 aa, Homo Sapiens
RAIKQRLLA

SEQ ID NO: 660387 - protein, 9 aa, Homo Sapiens
EDSAWKPQK

SEQ ID NO: 660388 - protein, 9 aa, Homo Sapiens
TVEVSWRPL

SEQ ID NO: 660389 - protein, 9 aa, Homo Sapiens
LLVIVHAPN

SEQ ID NO: 660390 - protein, 9 aa, Homo Sapiens
EKAYEAWRF

SEQ ID NO: 660391 - protein, 9 aa, Homo Sapiens
RQNVPVIYK

SEQ ID NO: 660392 - protein, 9 aa, Homo Sapiens
STDEGIFIS

SEQ ID NO: 660393 - protein, 9 aa, Homo Sapiens
VPNVSTITE

SEQ ID NO: 660394 - protein, 9 aa, Homo Sapiens
IEGFCCSRH

SEQ ID NO: 660395 - protein, 9 aa, Homo Sapiens
LSAAMFQSK

SEQ ID NO: 660396 - protein, 9 aa, Homo Sapiens
ETFAFENML

SEQ ID NO: 660397 - protein, 9 aa, Homo Sapiens
GATGEIKSP

SEQ ID NO: 660398 - protein, 9 aa, Homo Sapiens
EEERQNSYH

SEQ ID NO: 660399 - protein, 9 aa, Homo Sapiens
NALKDIQTG

SEQ ID NO: 660400 - protein, 9 aa, Homo Sapiens
TEGGFHKGR

SEQ ID NO: 660401 - protein, 9 aa, Homo Sapiens
GSKFFMGKV

SEQ ID NO: 660402 - protein, 9 aa, Homo Sapiens
ASGKSPASS

SEQ ID NO: 660403 - protein, 9 aa, Homo Sapiens
KGVCTGCLA

SEQ ID NO: 660404 - protein, 9 aa, Homo Sapiens
NTLDQEVST

SEQ ID NO: 660405 - protein, 9 aa, Homo Sapiens
MPDSRFASL

SEQ ID NO: 660406 - protein, 9 aa, Homo Sapiens
RSQLIKEKN

SEQ ID NO: 660407 - protein, 9 aa, Homo Sapiens
AYQAFPNTS

SEQ ID NO: 660408 - protein, 9 aa, Homo Sapiens
TKLKGHCQQ

SEQ ID NO: 660409 - protein, 9 aa, Homo Sapiens
KEVELIVLE

SEQ ID NO: 660410 - protein, 9 aa, Homo Sapiens
LDSMDTEKS

SEQ ID NO: 660411 - protein, 9 aa, Homo Sapiens
ISLVAEFRR

SEQ ID NO: 660412 - protein, 9 aa, Homo Sapiens
VIPTFATEN

SEQ ID NO: 660413 - protein, 9 aa, Homo Sapiens
PGITDEEYE

SEQ ID NO: 660414 - protein, 9 aa, Homo Sapiens
EQRAELSRL

SEQ ID NO: 660415 - protein, 9 aa, Homo Sapiens
ARARPAPSH

SEQ ID NO: 660416 - protein, 9 aa, Homo Sapiens
QLLRCFPLD

SEQ ID NO: 660417 - protein, 9 aa, Homo Sapiens
LTRFRRQIP

SEQ ID NO: 660418 - protein, 9 aa, Homo Sapiens
CHQLLRPDL

SEQ ID NO: 660419 - protein, 9 aa, Homo Sapiens
AKKQARHAV

SEQ ID NO: 660420 - protein, 9 aa, Homo Sapiens
SSYPLPLQL

SEQ ID NO: 660421 - protein, 9 aa, Homo Sapiens
RGWTITSMC

SEQ ID NO: 660422 - protein, 9 aa, Homo Sapiens
FCPHKQIDD

SEQ ID NO: 660423 - protein, 9 aa, Homo Sapiens
PLPLQLCSR

SEQ ID NO: 660424 - protein, 9 aa, Homo Sapiens
ANEPMAEVT

SEQ ID NO: 660425 - protein, 9 aa, Homo Sapiens
HTYKFHPDK

SEQ ID NO: 660426 - protein, 9 aa, Homo Sapiens
FRLSKAQLR

SEQ ID NO: 660427 - protein, 9 aa, Homo Sapiens
QFSSRSRSR

SEQ ID NO: 660428 - protein, 9 aa, Homo Sapiens
PFDETTYQE

SEQ ID NO: 660429 - protein, 9 aa, Homo Sapiens
TSTLHRRNT

SEQ ID NO: 660430 - protein, 9 aa, Homo Sapiens
RAANVSLGI

SEQ ID NO: 660431 - protein, 9 aa, Homo Sapiens
WDIAACFRE

SEQ ID NO: 660432 - protein, 9 aa, Homo Sapiens
ALQLLRCFP

SEQ ID NO: 660433 - protein, 9 aa, Homo Sapiens
TIVYFHGCL

SEQ ID NO: 660434 - protein, 9 aa, Homo Sapiens
MDKSHDTVR

SEQ ID NO: 660435 - protein, 9 aa, Homo Sapiens
LPLQLCSRF

SEQ ID NO: 660436 - protein, 9 aa, Homo Sapiens
RMLPLQGGR

SEQ ID NO: 660437 - protein, 9 aa, Homo Sapiens
IVLEKPFTV

SEQ ID NO: 660438 - protein, 9 aa, Homo Sapiens
PFEVKVGIY

SEQ ID NO: 660439 - protein, 9 aa, Homo Sapiens
TLDAFFEII

SEQ ID NO: 660440 - protein, 9 aa, Homo Sapiens
DLLLTVEVS

SEQ ID NO: 660441 - protein, 9 aa, Homo Sapiens
KFFMGKVVK

SEQ ID NO: 660442 - protein, 9 aa, Homo Sapiens
HESSRIPTS

SEQ ID NO: 660443 - protein, 9 aa, Homo Sapiens
KGVRSLSFY

SEQ ID NO: 660444 - protein, 9 aa, Homo Sapiens
YTHTTEHPQ

SEQ ID NO: 660445 - protein, 9 aa, Homo Sapiens
EKGLESEQA

SEQ ID NO: 660446 - protein, 9 aa, Homo Sapiens
NKTQFYDFD

SEQ ID NO: 660447 - protein, 9 aa, Homo Sapiens
RKEVELIVL

SEQ ID NO: 660448 - protein, 9 aa, Homo Sapiens
PGRRDLEEV

SEQ ID NO: 660449 - protein, 9 aa, Homo Sapiens
YMVDKDQAY

SEQ ID NO: 660450 - protein, 9 aa, Homo Sapiens
LRSWLAVNQ

SEQ ID NO: 660451 - protein, 9 aa, Homo Sapiens
NLQAHFMYY

SEQ ID NO: 660452 - protein, 9 aa, Homo Sapiens
CGANGIYET

SEQ ID NO: 660453 - protein, 9 aa, Homo Sapiens
KPSWSPDLW

SEQ ID NO: 660454 - protein, 9 aa, Homo Sapiens
TYVKVNIRD

SEQ ID NO: 660455 - protein, 9 aa, Homo Sapiens
KSQDCPWYN

SEQ ID NO: 660456 - protein, 9 aa, Homo Sapiens
YPPDILDTM

SEQ ID NO: 660457 - protein, 9 aa, Homo Sapiens
LEVVESSEK

SEQ ID NO: 660458 - protein, 9 aa, Homo Sapiens
VYKVLHGCV

SEQ ID NO: 660459 - protein, 9 aa, Homo Sapiens
KVVKKYEEN

SEQ ID NO: 660460 - protein, 9 aa, Homo Sapiens
SKKAVCHKL

SEQ ID NO: 660461 - protein, 9 aa, Homo Sapiens
EIWEKLKRL

SEQ ID NO: 660462 - protein, 9 aa, Homo Sapiens
CSEGPPSGP

SEQ ID NO: 660463 - protein, 9 aa, Homo Sapiens
ISALIKLVN

SEQ ID NO: 660464 - protein, 9 aa, Homo Sapiens
SSAGKKQLR

SEQ ID NO: 660465 - protein, 9 aa, Homo Sapiens
EKLHRSRPI

SEQ ID NO: 660466 - protein, 9 aa, Homo Sapiens
LAQHLEDWP

SEQ ID NO: 660467 - protein, 9 aa, Homo Sapiens
YKFHPDKTK

SEQ ID NO: 660468 - protein, 9 aa, Homo Sapiens
LESQLETQL

SEQ ID NO: 660469 - protein, 9 aa, Homo Sapiens
DAALCRTYY

SEQ ID NO: 660470 - protein, 9 aa, Homo Sapiens
QLTSTLHRR

SEQ ID NO: 660471 - protein, 9 aa, Homo Sapiens
VTWIIYKES

SEQ ID NO: 660472 - protein, 9 aa, Homo Sapiens
PVQVELLGC

SEQ ID NO: 660473 - protein, 9 aa, Homo Sapiens
KTKKQFICK

SEQ ID NO: 660474 - protein, 9 aa, Homo Sapiens
RTLITPQVP

SEQ ID NO: 660475 - protein, 9 aa, Homo Sapiens
GQLADICLD

SEQ ID NO: 660476 - protein, 9 aa, Homo Sapiens
RGYKRFTSM

SEQ ID NO: 660477 - protein, 9 aa, Homo Sapiens
IVNIANCSQ

SEQ ID NO: 660478 - protein, 9 aa, Homo Sapiens
ESSPFSSLE

SEQ ID NO: 660479 - protein, 9 aa, Homo Sapiens
VQRDPATYN

SEQ ID NO: 660480 - protein, 9 aa, Homo Sapiens
RPFLFGGSG

SEQ ID NO: 660481 - protein, 9 aa, Homo Sapiens
AQHLEDWPR

SEQ ID NO: 660482 - protein, 9 aa, Homo Sapiens
TMGKNGFNL

SEQ ID NO: 660483 - protein, 9 aa, Homo Sapiens
TSITTLESA

SEQ ID NO: 660484 - protein, 9 aa, Homo Sapiens
YTMLTPMLN

SEQ ID NO: 660485 - protein, 9 aa, Homo Sapiens
GWGREQDSA

SEQ ID NO: 660486 - protein, 9 aa, Homo Sapiens
LEFSPIEST

SEQ ID NO: 660487 - protein, 9 aa, Homo Sapiens
KAHGLITDL

SEQ ID NO: 660488 - protein, 9 aa, Homo Sapiens
IVERLGNSV

SEQ ID NO: 660489 - protein, 9 aa, Homo Sapiens
DLSNQDAEN

SEQ ID NO: 660490 - protein, 9 aa, Homo Sapiens
TAAKGGVSP

SEQ ID NO: 660491 - protein, 9 aa, Homo Sapiens
LCFEDAALC

SEQ ID NO: 660492 - protein, 9 aa, Homo Sapiens
SDEEIHDLT

SEQ ID NO: 660493 - protein, 9 aa, Homo Sapiens
SWATFFCVA

SEQ ID NO: 660494 - protein, 9 aa, Homo Sapiens
VDIAVMGKA

SEQ ID NO: 660495 - protein, 9 aa, Homo Sapiens
STPGDRDSQ

SEQ ID NO: 660496 - protein, 9 aa, Homo Sapiens
SPIESTVDV

SEQ ID NO: 660497 - protein, 9 aa, Homo Sapiens
LEEVEAPGP

SEQ ID NO: 660498 - protein, 9 aa, Homo Sapiens
SVLNCVYKV

SEQ ID NO: 660499 - protein, 9 aa, Homo Sapiens
VNYQPVNTP

SEQ ID NO: 660500 - protein, 9 aa, Homo Sapiens
TLQVLRAIK

SEQ ID NO: 660501 - protein, 9 aa, Homo Sapiens
KKTGPDPLP

SEQ ID NO: 660502 - protein, 9 aa, Homo Sapiens
IKLTVYDVM

SEQ ID NO: 660503 - protein, 9 aa, Homo Sapiens
PFTAYQAFP

SEQ ID NO: 660504 - protein, 9 aa, Homo Sapiens
ARMLPLQGG

SEQ ID NO: 660505 - protein, 9 aa, Homo Sapiens
QLENIADHT

SEQ ID NO: 660506 - protein, 9 aa, Homo Sapiens
EEVEAPGPE

SEQ ID NO: 660507 - protein, 9 aa, Homo Sapiens
LALINNIVD

SEQ ID NO: 660508 - protein, 9 aa, Homo Sapiens
QPSSDRVTR

SEQ ID NO: 660509 - protein, 9 aa, Homo Sapiens
NGEGEPRVF

SEQ ID NO: 660510 - protein, 9 aa, Homo Sapiens
LQDLDSMDT

SEQ ID NO: 660511 - protein, 9 aa, Homo Sapiens
ITDIEMVHE

SEQ ID NO: 660512 - protein, 9 aa, Homo Sapiens
LLYCFRKDI

SEQ ID NO: 660513 - protein, 9 aa, Homo Sapiens
KRENVKQKQ

SEQ ID NO: 660514 - protein, 9 aa, Homo Sapiens
FRRQIPGAG

SEQ ID NO: 660515 - protein, 9 aa, Homo Sapiens
VLPFPHQGS

SEQ ID NO: 660516 - protein, 9 aa, Homo Sapiens
IEDGGKEGD

SEQ ID NO: 660517 - protein, 9 aa, Homo Sapiens
CRATSSRGW

SEQ ID NO: 660518 - protein, 9 aa, Homo Sapiens
LQLCSRFPV

SEQ ID NO: 660519 - protein, 9 aa, Homo Sapiens
VSYRYKVFV

SEQ ID NO: 660520 - protein, 9 aa, Homo Sapiens
FEVKVGIYN

SEQ ID NO: 660521 - protein, 9 aa, Homo Sapiens
SPVCCHMEA

SEQ ID NO: 660522 - protein, 9 aa, Homo Sapiens
KPFTAYQAF

SEQ ID NO: 660523 - protein, 9 aa, Homo Sapiens
SGWYNITDF

SEQ ID NO: 660524 - protein, 9 aa, Homo Sapiens
LKKLLEIYK

SEQ ID NO: 660525 - protein, 9 aa, Homo Sapiens
FFSMVRNLM

SEQ ID NO: 660526 - protein, 9 aa, Homo Sapiens
FMASGKSPA

SEQ ID NO: 660527 - protein, 9 aa, Homo Sapiens
ARKTAVHDR

SEQ ID NO: 660528 - protein, 9 aa, Homo Sapiens
SAAMFQSKR

SEQ ID NO: 660529 - protein, 9 aa, Homo Sapiens
HSIPGPTAN

SEQ ID NO: 660530 - protein, 9 aa, Homo Sapiens
SRVLHAPVG

SEQ ID NO: 660531 - protein, 9 aa, Homo Sapiens
GKNGFNLFT

SEQ ID NO: 660532 - protein, 9 aa, Homo Sapiens
GLAGRFHQI

SEQ ID NO: 660533 - protein, 9 aa, Homo Sapiens
KTAVHDRKD

SEQ ID NO: 660534 - protein, 9 aa, Homo Sapiens
RKTAVHDRK

SEQ ID NO: 660535 - protein, 9 aa, Homo Sapiens
LPYANIPSA

SEQ ID NO: 660536 - protein, 9 aa, Homo Sapiens
WYKDYDSFV

SEQ ID NO: 660537 - protein, 9 aa, Homo Sapiens
FSSLRAVFA

SEQ ID NO: 660538 - protein, 9 aa, Homo Sapiens
IWEKLKRLY

SEQ ID NO: 660539 - protein, 9 aa, Homo Sapiens
ERIIVVRTN

SEQ ID NO: 660540 - protein, 9 aa, Homo Sapiens
QLLLYKFKM

SEQ ID NO: 660541 - protein, 9 aa, Homo Sapiens
VVGIEGFTN

SEQ ID NO: 660542 - protein, 9 aa, Homo Sapiens
ECRSESRLR

SEQ ID NO: 660543 - protein, 9 aa, Homo Sapiens
QLLLVNLQT

SEQ ID NO: 660544 - protein, 9 aa, Homo Sapiens
SAIVVVLNR

SEQ ID NO: 660545 - protein, 9 aa, Homo Sapiens
QDLLRLPCS

SEQ ID NO: 660546 - protein, 9 aa, Homo Sapiens
LHLSDSLDP

SEQ ID NO: 660547 - protein, 9 aa, Homo Sapiens
AVMGKAHGL

SEQ ID NO: 660548 - protein, 9 aa, Homo Sapiens
KRCLHGAAS

SEQ ID NO: 660549 - protein, 9 aa, Homo Sapiens
LKSCMPDSR

SEQ ID NO: 660550 - protein, 9 aa, Homo Sapiens
GTLDAFFEI

SEQ ID NO: 660551 - protein, 9 aa, Homo Sapiens
EMRPLDRAV

SEQ ID NO: 660552 - protein, 9 aa, Homo Sapiens
RENVKQKQY

SEQ ID NO: 660553 - protein, 9 aa, Homo Sapiens
NTPIVIDLP

SEQ ID NO: 660554 - protein, 9 aa, Homo Sapiens
ARCGQALHL

SEQ ID NO: 660555 - protein, 9 aa, Homo Sapiens
SRTLITPQV

SEQ ID NO: 660556 - protein, 9 aa, Homo Sapiens
LRLGTGAEG

SEQ ID NO: 660557 - protein, 9 aa, Homo Sapiens
QKIYPANAN

SEQ ID NO: 660558 - protein, 9 aa, Homo Sapiens
CFTYSSAYL

SEQ ID NO: 660559 - protein, 9 aa, Homo Sapiens
AKAAAEAKA

SEQ ID NO: 660560 - protein, 9 aa, Homo Sapiens
VRTNLRKLQ

SEQ ID NO: 660561 - protein, 9 aa, Homo Sapiens
QSSSSGHRK

SEQ ID NO: 660562 - protein, 9 aa, Homo Sapiens
MALQEACKA

SEQ ID NO: 660563 - protein, 9 aa, Homo Sapiens
LGATGEIKS

SEQ ID NO: 660564 - protein, 9 aa, Homo Sapiens
GPPGEALAG

SEQ ID NO: 660565 - protein, 9 aa, Homo Sapiens
GMLNFLSHK

SEQ ID NO: 660566 - protein, 9 aa, Homo Sapiens
RRGSEERTS

SEQ ID NO: 660567 - protein, 9 aa, Homo Sapiens
WLSYQLLKD

SEQ ID NO: 660568 - protein, 9 aa, Homo Sapiens
GMGFTLTVV

SEQ ID NO: 660569 - protein, 9 aa, Homo Sapiens
HQIMASVNT

SEQ ID NO: 660570 - protein, 9 aa, Homo Sapiens
LLEDPDFLE

SEQ ID NO: 660571 - protein, 9 aa, Homo Sapiens
VPTLRLEVV

SEQ ID NO: 660572 - protein, 9 aa, Homo Sapiens
RHESSRIPT

SEQ ID NO: 660573 - protein, 9 aa, Homo Sapiens
VKLKSCMPD

SEQ ID NO: 660574 - protein, 9 aa, Homo Sapiens
NNIVDIRVD

SEQ ID NO: 660575 - protein, 9 aa, Homo Sapiens
DSWYKDYDS

SEQ ID NO: 660576 - protein, 9 aa, Homo Sapiens
EPGLIGYPV

SEQ ID NO: 660577 - protein, 9 aa, Homo Sapiens
SKEKPKREK

SEQ ID NO: 660578 - protein, 9 aa, Homo Sapiens
LYPPDILDT

SEQ ID NO: 660579 - protein, 9 aa, Homo Sapiens
RIVLERIIV

SEQ ID NO: 660580 - protein, 9 aa, Homo Sapiens
NLLSKGFRG

SEQ ID NO: 660581 - protein, 9 aa, Homo Sapiens
GRRDLEEVE

SEQ ID NO: 660582 - protein, 9 aa, Homo Sapiens
LSRAVQETC

SEQ ID NO: 660583 - protein, 9 aa, Homo Sapiens
VRNLQHLRG

SEQ ID NO: 660584 - protein, 9 aa, Homo Sapiens
ANVSLGILL

SEQ ID NO: 660585 - protein, 9 aa, Homo Sapiens
GGKYSVKTA

SEQ ID NO: 660586 - protein, 9 aa, Homo Sapiens
RAELSRLLF

SEQ ID NO: 660587 - protein, 9 aa, Homo Sapiens
EVRGPPGEA

SEQ ID NO: 660588 - protein, 9 aa, Homo Sapiens
NEHLIQNEQ

SEQ ID NO: 660589 - protein, 9 aa, Homo Sapiens
VKTAAKGGV

SEQ ID NO: 660590 - protein, 9 aa, Homo Sapiens
SVSHCVPNV

SEQ ID NO: 660591 - protein, 9 aa, Homo Sapiens
LQAHFMYYC

SEQ ID NO: 660592 - protein, 9 aa, Homo Sapiens
PHQPSSDRV

SEQ ID NO: 660593 - protein, 9 aa, Homo Sapiens
EPVECRSES

SEQ ID NO: 660594 - protein, 9 aa, Homo Sapiens
PSADHNLKT

SEQ ID NO: 660595 - protein, 9 aa, Homo Sapiens
EPTVVDKVR

SEQ ID NO: 660596 - protein, 9 aa, Homo Sapiens
ENVKQKQYP

SEQ ID NO: 660597 - protein, 9 aa, Homo Sapiens
GMVAGIENN

SEQ ID NO: 660598 - protein, 9 aa, Homo Sapiens
TAWYNKTQF

SEQ ID NO: 660599 - protein, 9 aa, Homo Sapiens
SREGGKGVR

SEQ ID NO: 660600 - protein, 9 aa, Homo Sapiens
NLMLWMEDV

SEQ ID NO: 660601 - protein, 9 aa, Homo Sapiens
AAMFQSKRK

SEQ ID NO: 660602 - protein, 9 aa, Homo Sapiens
PLHLSDSLD

SEQ ID NO: 660603 - protein, 9 aa, Homo Sapiens
MAWEARREH

SEQ ID NO: 660604 - protein, 9 aa, Homo Sapiens
QTCRATSSR

SEQ ID NO: 660605 - protein, 9 aa, Homo Sapiens
CVPGFSAPR

SEQ ID NO: 660606 - protein, 9 aa, Homo Sapiens
NDHSLIILF

SEQ ID NO: 660607 - protein, 9 aa, Homo Sapiens
CENSLHVSK

SEQ ID NO: 660608 - protein, 9 aa, Homo Sapiens
RNLQAHFMY

SEQ ID NO: 660609 - protein, 9 aa, Homo Sapiens
HCGANGIYE

SEQ ID NO: 660610 - protein, 9 aa, Homo Sapiens
NLVKEWIRQ

SEQ ID NO: 660611 - protein, 9 aa, Homo Sapiens
ASLNHPRYM

SEQ ID NO: 660612 - protein, 9 aa, Homo Sapiens
FITHCGANG

SEQ ID NO: 660613 - protein, 9 aa, Homo Sapiens
AVTRFSPSP

SEQ ID NO: 660614 - protein, 9 aa, Homo Sapiens
TSTIRLKVS

SEQ ID NO: 660615 - protein, 9 aa, Homo Sapiens
GQSRIIRKV

SEQ ID NO: 660616 - protein, 9 aa, Homo Sapiens
ETCLVQRDP

SEQ ID NO: 660617 - protein, 9 aa, Homo Sapiens
YRCTIKKEN

SEQ ID NO: 660618 - protein, 9 aa, Homo Sapiens
RIMAFSTCS

SEQ ID NO: 660619 - protein, 9 aa, Homo Sapiens
LCENKPDNV

SEQ ID NO: 660620 - protein, 9 aa, Homo Sapiens
SGPWRRVRS

SEQ ID NO: 660621 - protein, 9 aa, Homo Sapiens
ADHNLKTPA

SEQ ID NO: 660622 - protein, 9 aa, Homo Sapiens
NVTPTKCSS

SEQ ID NO: 660623 - protein, 9 aa, Homo Sapiens
SYFSQTTKT

SEQ ID NO: 660624 - protein, 9 aa, Homo Sapiens
VINFKKTGP

SEQ ID NO: 660625 - protein, 9 aa, Homo Sapiens
SFNKIESQE

SEQ ID NO: 660626 - protein, 9 aa, Homo Sapiens
RAVFATRCD

SEQ ID NO: 660627 - protein, 9 aa, Homo Sapiens
KYSVIEERD

SEQ ID NO: 660628 - protein, 9 aa, Homo Sapiens
PLQLCSRFP

SEQ ID NO: 660629 - protein, 9 aa, Homo Sapiens
GPGESDLDR

SEQ ID NO: 660630 - protein, 9 aa, Homo Sapiens
SMCSEGPPS

SEQ ID NO: 660631 - protein, 9 aa, Homo Sapiens
VFATRCDEY

SEQ ID NO: 660632 - protein, 9 aa, Homo Sapiens
SLNLANLLH

SEQ ID NO: 660633 - protein, 9 aa, Homo Sapiens
CSPLSESEK

SEQ ID NO: 660634 - protein, 9 aa, Homo Sapiens
FFLCFLRFC

SEQ ID NO: 660635 - protein, 9 aa, Homo Sapiens
NGMVEKWLQ

SEQ ID NO: 660636 - protein, 9 aa, Homo Sapiens
QFVSGWYNI

SEQ ID NO: 660637 - protein, 9 aa, Homo Sapiens
GSESMVSHR

SEQ ID NO: 660638 - protein, 9 aa, Homo Sapiens
CFEDAALCR

SEQ ID NO: 660639 - protein, 9 aa, Homo Sapiens
AAIEEGKVE

SEQ ID NO: 660640 - protein, 9 aa, Homo Sapiens
NYNFEHETV

SEQ ID NO: 660641 - protein, 9 aa, Homo Sapiens
PGGSASVTL

SEQ ID NO: 660642 - protein, 9 aa, Homo Sapiens
ILDLFDSTS

SEQ ID NO: 660643 - protein, 9 aa, Homo Sapiens
KAYEAWRFT

SEQ ID NO: 660644 - protein, 9 aa, Homo Sapiens
NKLVELEHN

SEQ ID NO: 660645 - protein, 9 aa, Homo Sapiens
KAAAKAAAE

SEQ ID NO: 660646 - protein, 9 aa, Homo Sapiens
ICSLLNSQI

SEQ ID NO: 660647 - protein, 9 aa, Homo Sapiens
LGACYNKAL

SEQ ID NO: 660648 - protein, 9 aa, Homo Sapiens
VYPAVTRFS

SEQ ID NO: 660649 - protein, 9 aa, Homo Sapiens
GSDLSNQDA

SEQ ID NO: 660650 - protein, 9 aa, Homo Sapiens
WHLVHHGSY

SEQ ID NO: 660651 - protein, 9 aa, Homo Sapiens
MLNKRCLHG

SEQ ID NO: 660652 - protein, 9 aa, Homo Sapiens
LGAAFPEIP

SEQ ID NO: 660653 - protein, 9 aa, Homo Sapiens
VDTSQIVLS

SEQ ID NO: 660654 - protein, 9 aa, Homo Sapiens
FVSGWYNIT

SEQ ID NO: 660655 - protein, 9 aa, Homo Sapiens
STLGGQGLW

SEQ ID NO: 660656 - protein, 9 aa, Homo Sapiens
ISYCGVDHE

SEQ ID NO: 660657 - protein, 9 aa, Homo Sapiens
QAYRCTIKK

SEQ ID NO: 660658 - protein, 9 aa, Homo Sapiens
EFVNRVNEV

SEQ ID NO: 660659 - protein, 9 aa, Homo Sapiens
GVRSVGPSL

SEQ ID NO: 660660 - protein, 9 aa, Homo Sapiens
IKLVNKSID

SEQ ID NO: 660661 - protein, 9 aa, Homo Sapiens
NGGKVLAEG

SEQ ID NO: 660662 - protein, 9 aa, Homo Sapiens
PMSAIINQA

SEQ ID NO: 660663 - protein, 9 aa, Homo Sapiens
QSLWPRAGR

SEQ ID NO: 660664 - protein, 9 aa, Homo Sapiens
LLTVEVSWR

SEQ ID NO: 660665 - protein, 9 aa, Homo Sapiens
SSTTHIRVT

SEQ ID NO: 660666 - protein, 9 aa, Homo Sapiens
TSRVLHAPV

SEQ ID NO: 660667 - protein, 9 aa, Homo Sapiens
SPTVGGGLP

SEQ ID NO: 660668 - protein, 9 aa, Homo Sapiens
ATVFTPLGA

SEQ ID NO: 660669 - protein, 9 aa, Homo Sapiens
TQETSTIRL

SEQ ID NO: 660670 - protein, 9 aa, Homo Sapiens
VPGITDEEY

SEQ ID NO: 660671 - protein, 9 aa, Homo Sapiens
YVYHKTKKL

SEQ ID NO: 660672 - protein, 9 aa, Homo Sapiens
DQEPGANEP

SEQ ID NO: 660673 - protein, 9 aa, Homo Sapiens
TFSSLRAVF

SEQ ID NO: 660674 - protein, 9 aa, Homo Sapiens
DSRPLHLSD

SEQ ID NO: 660675 - protein, 9 aa, Homo Sapiens
SAPSEVSPP

SEQ ID NO: 660676 - protein, 9 aa, Homo Sapiens
RWTQNEHLI

SEQ ID NO: 660677 - protein, 9 aa, Homo Sapiens
SHWKLLRQE

SEQ ID NO: 660678 - protein, 9 aa, Homo Sapiens
CQEKLHRSR

SEQ ID NO: 660679 - protein, 9 aa, Homo Sapiens
GPIGKAAER

SEQ ID NO: 660680 - protein, 9 aa, Homo Sapiens
NKCVMSEWG

SEQ ID NO: 660681 - protein, 9 aa, Homo Sapiens
VPLEEPVEC

SEQ ID NO: 660682 - protein, 9 aa, Homo Sapiens
KNNSKQKCS

SEQ ID NO: 660683 - protein, 9 aa, Homo Sapiens
LLVNLQTFG

SEQ ID NO: 660684 - protein, 9 aa, Homo Sapiens
KSSKEKPKR

SEQ ID NO: 660685 - protein, 9 aa, Homo Sapiens
QLIKEKNDI

SEQ ID NO: 660686 - protein, 9 aa, Homo Sapiens
VCCHMEAQA

SEQ ID NO: 660687 - protein, 9 aa, Homo Sapiens
NYSVSAGYP

SEQ ID NO: 660688 - protein, 9 aa, Homo Sapiens
PLEEPVECR

SEQ ID NO: 660689 - protein, 9 aa, Homo Sapiens
SPIYGRTSE

SEQ ID NO: 660690 - protein, 9 aa, Homo Sapiens
PTFATENNV

SEQ ID NO: 660691 - protein, 9 aa, Homo Sapiens
DVPVQVELL

SEQ ID NO: 660692 - protein, 9 aa, Homo Sapiens
IILTYYLLI

SEQ ID NO: 660693 - protein, 9 aa, Homo Sapiens
SQKEDTNHN

SEQ ID NO: 660694 - protein, 9 aa, Homo Sapiens
GDAEDTLPG

SEQ ID NO: 660695 - protein, 9 aa, Homo Sapiens
QKEPMTTVR

SEQ ID NO: 660696 - protein, 9 aa, Homo Sapiens
HCYDCFDFS

SEQ ID NO: 660697 - protein, 9 aa, Homo Sapiens
CFFHVALAD

SEQ ID NO: 660698 - protein, 9 aa, Homo Sapiens
KSRSQFSSR

SEQ ID NO: 660699 - protein, 9 aa, Homo Sapiens
VQETCREVR

SEQ ID NO: 660700 - protein, 9 aa, Homo Sapiens
NHLTAVCEF

SEQ ID NO: 660701 - protein, 9 aa, Homo Sapiens
PKKYHKMVG

SEQ ID NO: 660702 - protein, 9 aa, Homo Sapiens
LKGHCQQGQ

SEQ ID NO: 660703 - protein, 9 aa, Homo Sapiens
LDLAIKHSI

SEQ ID NO: 660704 - protein, 9 aa, Homo Sapiens
VSFPVITAG

SEQ ID NO: 660705 - protein, 9 aa, Homo Sapiens
PAAEASSAG

SEQ ID NO: 660706 - protein, 9 aa, Homo Sapiens
AALVSYFSQ

SEQ ID NO: 660707 - protein, 9 aa, Homo Sapiens
YGRRSKFGI

SEQ ID NO: 660708 - protein, 9 aa, Homo Sapiens
YLRSTVSYR

SEQ ID NO: 660709 - protein, 9 aa, Homo Sapiens
PSWSPDLWK

SEQ ID NO: 660710 - protein, 9 aa, Homo Sapiens
HFHVSTRIR

SEQ ID NO: 660711 - protein, 9 aa, Homo Sapiens
LQEYAVFYP

SEQ ID NO: 660712 - protein, 9 aa, Homo Sapiens
DKQKDFVCN

SEQ ID NO: 660713 - protein, 9 aa, Homo Sapiens
LPSKTKKQF

SEQ ID NO: 660714 - protein, 9 aa, Homo Sapiens
WKPQKKVPR

SEQ ID NO: 660715 - protein, 9 aa, Homo Sapiens
LESAPSEVS

SEQ ID NO: 660716 - protein, 9 aa, Homo Sapiens
NLQTFGLEV

SEQ ID NO: 660717 - protein, 9 aa, Homo Sapiens
PLLVPNPFT

SEQ ID NO: 660718 - protein, 9 aa, Homo Sapiens
KMLGEEEDI

SEQ ID NO: 660719 - protein, 9 aa, Homo Sapiens
IRQISESKS

SEQ ID NO: 660720 - protein, 9 aa, Homo Sapiens
HTTEHPQMG

SEQ ID NO: 660721 - protein, 9 aa, Homo Sapiens
IIGKWHLVH

SEQ ID NO: 660722 - protein, 9 aa, Homo Sapiens
AAFPEIPRW

SEQ ID NO: 660723 - protein, 9 aa, Homo Sapiens
KDTEPGLFG

SEQ ID NO: 660724 - protein, 9 aa, Homo Sapiens
FQVKREPSE

SEQ ID NO: 660725 - protein, 9 aa, Homo Sapiens
RARTAAGHC

SEQ ID NO: 660726 - protein, 9 aa, Homo Sapiens
TSACNKCPD

SEQ ID NO: 660727 - protein, 9 aa, Homo Sapiens
VPSHSAEQL

SEQ ID NO: 660728 - protein, 9 aa, Homo Sapiens
PITGWLFEL

SEQ ID NO: 660729 - protein, 9 aa, Homo Sapiens
PMSKKEMIQ

SEQ ID NO: 660730 - protein, 9 aa, Homo Sapiens
FTEWNRSCA

SEQ ID NO: 660731 - protein, 9 aa, Homo Sapiens
WRSSRRSAS

SEQ ID NO: 660732 - protein, 9 aa, Homo Sapiens
SGSHHGWPG

SEQ ID NO: 660733 - protein, 9 aa, Homo Sapiens
HARLRTPTP

SEQ ID NO: 660734 - protein, 9 aa, Homo Sapiens
VTRLSRRQG

SEQ ID NO: 660735 - protein, 9 aa, Homo Sapiens
DGSVEENID

SEQ ID NO: 660736 - protein, 9 aa, Homo Sapiens
DAVLLIFAN

SEQ ID NO: 660737 - protein, 9 aa, Homo Sapiens
GEYSDETDT

SEQ ID NO: 660738 - protein, 9 aa, Homo Sapiens
WTKSQFWRK

SEQ ID NO: 660739 - protein, 9 aa, Homo Sapiens
LQHFFNHHM

SEQ ID NO: 660740 - protein, 9 aa, Homo Sapiens
ECLTHAIYA

SEQ ID NO: 660741 - protein, 9 aa, Homo Sapiens
RDAVLLIFA

SEQ ID NO: 660742 - protein, 9 aa, Homo Sapiens
GTDPVPWTT

SEQ ID NO: 660743 - protein, 9 aa, Homo Sapiens
GADGVGKSA

SEQ ID NO: 660744 - protein, 9 aa, Homo Sapiens
QQHQHQHQQ

SEQ ID NO: 660745 - protein, 9 aa, Homo Sapiens
SRGMEGTDP

SEQ ID NO: 660746 - protein, 9 aa, Homo Sapiens
RQTLNGELT

SEQ ID NO: 660747 - protein, 9 aa, Homo Sapiens
HAIYAKLRN

SEQ ID NO: 660748 - protein, 9 aa, Homo Sapiens
IQLVLGNAG

SEQ ID NO: 660749 - protein, 9 aa, Homo Sapiens
WNRSCALQM

SEQ ID NO: 660750 - protein, 9 aa, Homo Sapiens
QQQHQHQHQ

SEQ ID NO: 660751 - protein, 9 aa, Homo Sapiens
STKEEPLEG

SEQ ID NO: 660752 - protein, 9 aa, Homo Sapiens
GTATNVRTI

SEQ ID NO: 660753 - protein, 9 aa, Homo Sapiens
VGGPSRGME

SEQ ID NO: 660754 - protein, 9 aa, Homo Sapiens
MPQVFATAA

SEQ ID NO: 660755 - protein, 9 aa, Homo Sapiens
GDRTGTHMC

SEQ ID NO: 660756 - protein, 9 aa, Homo Sapiens
WPWRSSRRS

SEQ ID NO: 660757 - protein, 9 aa, Homo Sapiens
PVCPFLSQF

SEQ ID NO: 660758 - protein, 9 aa, Homo Sapiens
PTPPLSHAH

SEQ ID NO: 660759 - protein, 9 aa, Homo Sapiens
ARTAAGHCP

SEQ ID NO: 660760 - protein, 9 aa, Homo Sapiens
CIPIEEQIQ

SEQ ID NO: 660761 - protein, 9 aa, Homo Sapiens
GPLCPWASG

SEQ ID NO: 660762 - protein, 9 aa, Homo Sapiens
EEPLEGEAT

SEQ ID NO: 660763 - protein, 9 aa, Homo Sapiens
RLGLSPKIV

SEQ ID NO: 660764 - protein, 9 aa, Homo Sapiens
CSYTSGPGS

SEQ ID NO: 660765 - protein, 9 aa, Homo Sapiens
ALLFGTATN

SEQ ID NO: 660766 - protein, 9 aa, Homo Sapiens
SEASDEDIL

SEQ ID NO: 660767 - protein, 9 aa, Homo Sapiens
SAEQLEEVM

SEQ ID NO: 660768 - protein, 9 aa, Homo Sapiens
KEEPLEGEA

SEQ ID NO: 660769 - protein, 9 aa, Homo Sapiens
SFPVCPFLS

SEQ ID NO: 660770 - protein, 9 aa, Homo Sapiens
AALKLSDGR

SEQ ID NO: 660771 - protein, 9 aa, Homo Sapiens
LAISQGRVQ

SEQ ID NO: 660772 - protein, 9 aa, Homo Sapiens
VVVGADGVG

SEQ ID NO: 660773 - protein, 9 aa, Homo Sapiens
VWELEVMPQ

SEQ ID NO: 660774 - protein, 9 aa, Homo Sapiens
TDTSACNKC

SEQ ID NO: 660775 - protein, 9 aa, Homo Sapiens
AKPGDDLRE

SEQ ID NO: 660776 - protein, 9 aa, Homo Sapiens
PGPVMETVT

SEQ ID NO: 660777 - protein, 9 aa, Homo Sapiens
PRAFSSCSY

SEQ ID NO: 660778 - protein, 9 aa, Homo Sapiens
NCIPIEEQI

SEQ ID NO: 660779 - protein, 9 aa, Homo Sapiens
SASAVGGPS

SEQ ID NO: 660780 - protein, 9 aa, Homo Sapiens
ETDTSACNK

SEQ ID NO: 660781 - protein, 9 aa, Homo Sapiens
TTRGPLCPW

SEQ ID NO: 660782 - protein, 9 aa, Homo Sapiens
IPIEEQIQL

SEQ ID NO: 660783 - protein, 9 aa, Homo Sapiens
GGYRPPPEE

SEQ ID NO: 660784 - protein, 9 aa, Homo Sapiens
LPGCAALKL

SEQ ID NO: 660785 - protein, 9 aa, Homo Sapiens
CSIHLDVIV

SEQ ID NO: 660786 - protein, 9 aa, Homo Sapiens
ATAAYSKGF

SEQ ID NO: 660787 - protein, 9 aa, Homo Sapiens
LFGTATNVR

SEQ ID NO: 660788 - protein, 9 aa, Homo Sapiens
HSAEQLEEV

SEQ ID NO: 660789 - protein, 9 aa, Homo Sapiens
IEGLAWAWP

SEQ ID NO: 660790 - protein, 9 aa, Homo Sapiens
CRAKITSEL

SEQ ID NO: 660791 - protein, 9 aa, Homo Sapiens
QIQLVLGNA

SEQ ID NO: 660792 - protein, 9 aa, Homo Sapiens
SAKPGDDLR

SEQ ID NO: 660793 - protein, 9 aa, Homo Sapiens
IALLFGTAT

SEQ ID NO: 660794 - protein, 9 aa, Homo Sapiens
PSFPVCPFL

SEQ ID NO: 660795 - protein, 9 aa, Homo Sapiens
GVMLAISQG

SEQ ID NO: 660796 - protein, 9 aa, Homo Sapiens
IEEQIQLVL

SEQ ID NO: 660797 - protein, 9 aa, Homo Sapiens
ECSIHLDVI

SEQ ID NO: 660798 - protein, 9 aa, Homo Sapiens
DGDMCHSTA

SEQ ID NO: 660799 - protein, 9 aa, Homo Sapiens
FSPSLCDQR

SEQ ID NO: 660800 - protein, 9 aa, Homo Sapiens
PWTTRGPLC

SEQ ID NO: 660801 - protein, 9 aa, Homo Sapiens
VCPFLSQFS

SEQ ID NO: 660802 - protein, 9 aa, Homo Sapiens
CIEKLSKTG

SEQ ID NO: 660803 - protein, 9 aa, Homo Sapiens
SMPQVFATA

SEQ ID NO: 660804 - protein, 9 aa, Homo Sapiens
TWYGVPSHS

SEQ ID NO: 660805 - protein, 9 aa, Homo Sapiens
GDDLRERII

SEQ ID NO: 660806 - protein, 9 aa, Homo Sapiens
TSAVFEDGS

SEQ ID NO: 660807 - protein, 9 aa, Homo Sapiens
IEKLSKTGS

SEQ ID NO: 660808 - protein, 9 aa, Homo Sapiens
GRDGDMCHS

SEQ ID NO: 660809 - protein, 9 aa, Homo Sapiens
LLNFTEWNR

SEQ ID NO: 660810 - protein, 9 aa, Homo Sapiens
SLPGCAALK

SEQ ID NO: 660811 - protein, 9 aa, Homo Sapiens
EGTDPVPWT

SEQ ID NO: 660812 - protein, 9 aa, Homo Sapiens
ARPGLGGYR

SEQ ID NO: 660813 - protein, 9 aa, Homo Sapiens
PSHSAEQLE

SEQ ID NO: 660814 - protein, 9 aa, Homo Sapiens
TRLSRRQGE

SEQ ID NO: 660815 - protein, 9 aa, Homo Sapiens
VADNISRQT

SEQ ID NO: 660816 - protein, 9 aa, Homo Sapiens
CPFLSQFSF

SEQ ID NO: 660817 - protein, 9 aa, Homo Sapiens
CRFASSCHL

SEQ ID NO: 660818 - protein, 9 aa, Homo Sapiens
DTSACNKCP

SEQ ID NO: 660819 - protein, 9 aa, Homo Sapiens
LGLSPKIVI

SEQ ID NO: 660820 - protein, 9 aa, Homo Sapiens
CAALKLSDG

SEQ ID NO: 660821 - protein, 9 aa, Homo Sapiens
GLSPKIVIG

SEQ ID NO: 660822 - protein, 9 aa, Homo Sapiens
ELIQQLEVL

SEQ ID NO: 660823 - protein, 9 aa, Homo Sapiens
WASGSHHGW

SEQ ID NO: 660824 - protein, 9 aa, Homo Sapiens
DMCHSTAVT

SEQ ID NO: 660825 - protein, 9 aa, Homo Sapiens
TGTHMCRAK

SEQ ID NO: 660826 - protein, 9 aa, Homo Sapiens
RAFSSCSYT

SEQ ID NO: 660827 - protein, 9 aa, Homo Sapiens
LCDQRRPRT

SEQ ID NO: 660828 - protein, 9 aa, Homo Sapiens
GWLFELDGL

SEQ ID NO: 660829 - protein, 9 aa, Homo Sapiens
GWPGPVMET

SEQ ID NO: 660830 - protein, 9 aa, Homo Sapiens
VLLIFANKQ

SEQ ID NO: 660831 - protein, 9 aa, Homo Sapiens
TATNVRTIR

SEQ ID NO: 660832 - protein, 9 aa, Homo Sapiens
DEDILFSRE

SEQ ID NO: 660833 - protein, 9 aa, Homo Sapiens
VFEDGSVEE

SEQ ID NO: 660834 - protein, 9 aa, Homo Sapiens
FTANWTSVK

SEQ ID NO: 660835 - protein, 9 aa, Homo Sapiens
ELRDAVLLI

SEQ ID NO: 660836 - protein, 9 aa, Homo Sapiens
SDETDTSAC

SEQ ID NO: 660837 - protein, 9 aa, Homo Sapiens
THAIYAKLR

SEQ ID NO: 660838 - protein, 9 aa, Homo Sapiens
RTGTHMCRA

SEQ ID NO: 660839 - protein, 9 aa, Homo Sapiens
SPSLCDQRR

SEQ ID NO: 660840 - protein, 9 aa, Homo Sapiens
GHCPYGGKV

SEQ ID NO: 660841 - protein, 9 aa, Homo Sapiens
LNPGRDGDM

SEQ ID NO: 660842 - protein, 9 aa, Homo Sapiens
GPSFPVCPF

SEQ ID NO: 660843 - protein, 9 aa, Homo Sapiens
TAAYSKGFA

SEQ ID NO: 660844 - protein, 9 aa, Homo Sapiens
RSEASDEDI

SEQ ID NO: 660845 - protein, 9 aa, Homo Sapiens
ATPQRAQRL

SEQ ID NO: 660846 - protein, 9 aa, Homo Sapiens
FFMMISSLM

SEQ ID NO: 660847 - protein, 9 aa, Homo Sapiens
TGWLFELDG

SEQ ID NO: 660848 - protein, 9 aa, Homo Sapiens
IGPSFPVCP

SEQ ID NO: 660849 - protein, 9 aa, Homo Sapiens
QRRPRTSGA

SEQ ID NO: 660850 - protein, 9 aa, Homo Sapiens
DQRRPRTSG

SEQ ID NO: 660851 - protein, 9 aa, Homo Sapiens
IQKNKPMSK

SEQ ID NO: 660852 - protein, 9 aa, Homo Sapiens
RPGLGGYRP

SEQ ID NO: 660853 - protein, 9 aa, Homo Sapiens
SPSSASTGQ

SEQ ID NO: 660854 - protein, 9 aa, Homo Sapiens
DNISRQTLN

SEQ ID NO: 660855 - protein, 9 aa, Homo Sapiens
EWNRSCALQ

SEQ ID NO: 660856 - protein, 9 aa, Homo Sapiens
YIYTWTKSQ

SEQ ID NO: 660857 - protein, 9 aa, Homo Sapiens
GSISVPTSD

SEQ ID NO: 660858 - protein, 9 aa, Homo Sapiens
RRPRTSGAS

SEQ ID NO: 660859 - protein, 9 aa, Homo Sapiens
SCHLAKETL

SEQ ID NO: 660860 - protein, 9 aa, Homo Sapiens
VGADGVGKS

SEQ ID NO: 660861 - protein, 9 aa, Homo Sapiens
PSLCDQRRP

SEQ ID NO: 660862 - protein, 9 aa, Homo Sapiens
CPYGGKVYF

SEQ ID NO: 660863 - protein, 9 aa, Homo Sapiens
KSVWELEVM

SEQ ID NO: 660864 - protein, 9 aa, Homo Sapiens
FPVCPFLSQ

SEQ ID NO: 660865 - protein, 9 aa, Homo Sapiens
NFTEWNRSC

SEQ ID NO: 660866 - protein, 9 aa, Homo Sapiens
TNEKLQHFF

SEQ ID NO: 660867 - protein, 9 aa, Homo Sapiens
PIEEQIQLV

SEQ ID NO: 660868 - protein, 9 aa, Homo Sapiens
LEGEATTQS

SEQ ID NO: 660869 - protein, 9 aa, Homo Sapiens
DGVGKSALT

SEQ ID NO: 660870 - protein, 9 aa, Homo Sapiens
VPWTTRGPL

SEQ ID NO: 660871 - protein, 9 aa, Homo Sapiens
SDEDILFSR

SEQ ID NO: 660872 - protein, 9 aa, Homo Sapiens
PLEGEATTQ

SEQ ID NO: 660873 - protein, 9 aa, Homo Sapiens
KSAKPGDDL

SEQ ID NO: 660874 - protein, 9 aa, Homo Sapiens
EKLSKTGSI

SEQ ID NO: 660875 - protein, 9 aa, Homo Sapiens
SHHGWPGPV

SEQ ID NO: 660876 - protein, 9 aa, Homo Sapiens
PVMETVTRL

SEQ ID NO: 660877 - protein, 9 aa, Homo Sapiens
SSRRSASAV

SEQ ID NO: 660878 - protein, 9 aa, Homo Sapiens
PQVFATAAY

SEQ ID NO: 660879 - protein, 9 aa, Homo Sapiens
PVPWTTRGP

SEQ ID NO: 660880 - protein, 9 aa, Homo Sapiens
SRQTLNGEL

SEQ ID NO: 660881 - protein, 9 aa, Homo Sapiens
LRDAVLLIF

SEQ ID NO: 660882 - protein, 9 aa, Homo Sapiens
LNFTEWNRS

SEQ ID NO: 660883 - protein, 9 aa, Homo Sapiens
LGGYRPPPE

SEQ ID NO: 660884 - protein, 9 aa, Homo Sapiens
MCHSTAVTP

SEQ ID NO: 660885 - protein, 9 aa, Homo Sapiens
LSRRQGEER

SEQ ID NO: 660886 - protein, 9 aa, Homo Sapiens
TPPLSHAHT

SEQ ID NO: 660887 - protein, 9 aa, Homo Sapiens
VVGADGVGK

SEQ ID NO: 660888 - protein, 9 aa, Homo Sapiens
MSKKEMIQR

SEQ ID NO: 660889 - protein, 9 aa, Homo Sapiens
SYVPITGWL

SEQ ID NO: 660890 - protein, 9 aa, Homo Sapiens
DRTGTHMCR

SEQ ID NO: 660891 - protein, 9 aa, Homo Sapiens
NCMAECLTH

SEQ ID NO: 660892 - protein, 9 aa, Homo Sapiens
QHFFNHHMF

SEQ ID NO: 660893 - protein, 9 aa, Homo Sapiens
ASDEDILFS

SEQ ID NO: 660894 - protein, 9 aa, Homo Sapiens
SGPRAFSSC

SEQ ID NO: 660895 - protein, 9 aa, Homo Sapiens
QVFATAAYS

SEQ ID NO: 660896 - protein, 9 aa, Homo Sapiens
ASGSHHGWP

SEQ ID NO: 660897 - protein, 9 aa, Homo Sapiens
AVFEDGSVE

SEQ ID NO: 660898 - protein, 9 aa, Homo Sapiens
RDGDMCHST

SEQ ID NO: 660899 - protein, 9 aa, Homo Sapiens
NRSCALQMK

SEQ ID NO: 660900 - protein, 9 aa, Homo Sapiens
GEATTQSRA

SEQ ID NO: 660901 - protein, 9 aa, Homo Sapiens
KPGDDLRER

SEQ ID NO: 660902 - protein, 9 aa, Homo Sapiens
AVGGPSRGM

SEQ ID NO: 660903 - protein, 9 aa, Homo Sapiens
VLGAPGLAT

SEQ ID NO: 660904 - protein, 9 aa, Homo Sapiens
SFFMMISSL

SEQ ID NO: 660905 - protein, 9 aa, Homo Sapiens
HLDVIVDRP

SEQ ID NO: 660906 - protein, 9 aa, Homo Sapiens
HFFNHHMFV

SEQ ID NO: 660907 - protein, 9 aa, Homo Sapiens
RGMEGTDPV

SEQ ID NO: 660908 - protein, 9 aa, Homo Sapiens
CDQRRPRTS

SEQ ID NO: 660909 - protein, 9 aa, Homo Sapiens
APGLATPQR

SEQ ID NO: 660910 - protein, 9 aa, Homo Sapiens
DVIVDRPLQ

SEQ ID NO: 660911 - protein, 9 aa, Homo Sapiens
LSPKIVIGY

SEQ ID NO: 660912 - protein, 9 aa, Homo Sapiens
ARLRTPTPP

SEQ ID NO: 660913 - protein, 9 aa, Homo Sapiens
TEKELRDAV

SEQ ID NO: 660914 - protein, 9 aa, Homo Sapiens
SLKFSPGPS

SEQ ID NO: 660915 - protein, 9 aa, Homo Sapiens
ELEVMPQDT

SEQ ID NO: 660916 - protein, 9 aa, Homo Sapiens
EDGSVEENI

SEQ ID NO: 660917 - protein, 9 aa, Homo Sapiens
EDILFSRED

SEQ ID NO: 660918 - protein, 9 aa, Homo Sapiens
WYGVPSHSA

SEQ ID NO: 660919 - protein, 9 aa, Homo Sapiens
METVTRLSR

SEQ ID NO: 660920 - protein, 9 aa, Homo Sapiens
MCRAKITSE

SEQ ID NO: 660921 - protein, 9 aa, Homo Sapiens
NISRQTLNG

SEQ ID NO: 660922 - protein, 9 aa, Homo Sapiens
VSYVPITGW

SEQ ID NO: 660923 - protein, 9 aa, Homo Sapiens
HCPYGGKVY

SEQ ID NO: 660924 - protein, 9 aa, Homo Sapiens
FTNEKLQHF

SEQ ID NO: 660925 - protein, 9 aa, Homo Sapiens
NIGPSFPVC

SEQ ID NO: 660926 - protein, 9 aa, Homo Sapiens
FATAAYSKG

SEQ ID NO: 660927 - protein, 9 aa, Homo Sapiens
FEDGSVEEN

SEQ ID NO: 660928 - protein, 9 aa, Homo Sapiens
GCAALKLSD

SEQ ID NO: 660929 - protein, 9 aa, Homo Sapiens
LTHAIYAKL

SEQ ID NO: 660930 - protein, 9 aa, Homo Sapiens
LSKTGSISV

SEQ ID NO: 660931 - protein, 9 aa, Homo Sapiens
ISQGRVQTN

SEQ ID NO: 660932 - protein, 9 aa, Homo Sapiens
SAVGGPSRG

SEQ ID NO: 660933 - protein, 9 aa, Homo Sapiens
TDPVPWTTR

SEQ ID NO: 660934 - protein, 9 aa, Homo Sapiens
LAWAWPWRS

SEQ ID NO: 660935 - protein, 9 aa, Homo Sapiens
GAPGLATPQ

SEQ ID NO: 660936 - protein, 9 aa, Homo Sapiens
LEVMPQDTY

SEQ ID NO: 660937 - protein, 9 aa, Homo Sapiens
PLCPWASGS

SEQ ID NO: 660938 - protein, 9 aa, Homo Sapiens
AELIQQLEV

SEQ ID NO: 660939 - protein, 9 aa, Homo Sapiens
TNVRTIRTT

SEQ ID NO: 660940 - protein, 9 aa, Homo Sapiens
MISSLMFLS

SEQ ID NO: 660941 - protein, 9 aa, Homo Sapiens
NEKLQHFFN

SEQ ID NO: 660942 - protein, 9 aa, Homo Sapiens
PSRGMEGTD

SEQ ID NO: 660943 - protein, 9 aa, Homo Sapiens
RSASAVGGP

SEQ ID NO: 660944 - protein, 9 aa, Homo Sapiens
TPTPPLSHA

SEQ ID NO: 660945 - protein, 9 aa, Homo Sapiens
GLATPQRAQ

SEQ ID NO: 660946 - protein, 9 aa, Homo Sapiens
GPRAFSSCS

SEQ ID NO: 660947 - protein, 9 aa, Homo Sapiens
AGHCPYGGK

SEQ ID NO: 660948 - protein, 9 aa, Homo Sapiens
PGLGGYRPP

SEQ ID NO: 660949 - protein, 9 aa, Homo Sapiens
LRTPTPPLS

SEQ ID NO: 660950 - protein, 9 aa, Homo Sapiens
CMAECLTHA

SEQ ID NO: 660951 - protein, 9 aa, Homo Sapiens
DDLRERIIK

SEQ ID NO: 660952 - protein, 9 aa, Homo Sapiens
TGSISVPTS

SEQ ID NO: 660953 - protein, 9 aa, Homo Sapiens
YGVPSHSAE

SEQ ID NO: 660954 - protein, 9 aa, Homo Sapiens
GSVEENIDV

SEQ ID NO: 660955 - protein, 9 aa, Homo Sapiens
KTGSISVPT

SEQ ID NO: 660956 - protein, 9 aa, Homo Sapiens
ETVTRLSRR

SEQ ID NO: 660957 - protein, 9 aa, Homo Sapiens
TNSFFMMIS

SEQ ID NO: 660958 - protein, 9 aa, Homo Sapiens
GPVMETVTR

SEQ ID NO: 660959 - protein, 9 aa, Homo Sapiens
FGTATNVRT

SEQ ID NO: 660960 - protein, 9 aa, Homo Sapiens
HQHQHQQQQ

SEQ ID NO: 660961 - protein, 9 aa, Homo Sapiens
MSMPQVFAT

SEQ ID NO: 660962 - protein, 9 aa, Homo Sapiens
RTAAGHCPY

SEQ ID NO: 660963 - protein, 9 aa, Homo Sapiens
AISQGRVQT

SEQ ID NO: 660964 - protein, 9 aa, Homo Sapiens
GGPSRGMEG

SEQ ID NO: 660965 - protein, 9 aa, Homo Sapiens
YVPITGWLF

SEQ ID NO: 660966 - protein, 9 aa, Homo Sapiens
SHSAEQLEE

SEQ ID NO: 660967 - protein, 9 aa, Homo Sapiens
LKFSPGPSP

SEQ ID NO: 660968 - protein, 9 aa, Homo Sapiens
EKSVWELEV

SEQ ID NO: 660969 - protein, 9 aa, Homo Sapiens
NSFFMMISS

SEQ ID NO: 660970 - protein, 9 aa, Homo Sapiens
CHLAKETLL

SEQ ID NO: 660971 - protein, 9 aa, Homo Sapiens
CNSFLLNCL

SEQ ID NO: 660972 - protein, 9 aa, Homo Sapiens
VMLAISQGR

SEQ ID NO: 660973 - protein, 9 aa, Homo Sapiens
EVLNMDTQK

SEQ ID NO: 660974 - protein, 9 aa, Homo Sapiens
RRQGEERLW

SEQ ID NO: 660975 - protein, 9 aa, Homo Sapiens
PWRSSRRSA

SEQ ID NO: 660976 - protein, 9 aa, Homo Sapiens
QQQQHQHQH

SEQ ID NO: 660977 - protein, 9 aa, Homo Sapiens
RRSASAVGG

SEQ ID NO: 660978 - protein, 9 aa, Homo Sapiens
PSSASTGQA

SEQ ID NO: 660979 - protein, 9 aa, Homo Sapiens
LIQQLEVLN

SEQ ID NO: 660980 - protein, 9 aa, Homo Sapiens
ADNISRQTL

SEQ ID NO: 660981 - protein, 9 aa, Homo Sapiens
IGKGVMLAI

SEQ ID NO: 660982 - protein, 9 aa, Homo Sapiens
RSSRRSASA

SEQ ID NO: 660983 - protein, 9 aa, Homo Sapiens
QFWRKTRST

SEQ ID NO: 660984 - protein, 9 aa, Homo Sapiens
THMCRAKIT

SEQ ID NO: 660985 - protein, 9 aa, Homo Sapiens
EGEATTQSR

SEQ ID NO: 660986 - protein, 9 aa, Homo Sapiens
VMETVTRLS

SEQ ID NO: 660987 - protein, 9 aa, Homo Sapiens
LDVIVDRPL

SEQ ID NO: 660988 - protein, 9 aa, Homo Sapiens
SVWELEVMP

SEQ ID NO: 660989 - protein, 9 aa, Homo Sapiens
GLGGYRPPP

SEQ ID NO: 660990 - protein, 9 aa, Homo Sapiens
SPKIVIGYQ

SEQ ID NO: 660991 - protein, 9 aa, Homo Sapiens
CLTHAIYAK

SEQ ID NO: 660992 - protein, 9 aa, Homo Sapiens
ATNVRTIRT

SEQ ID NO: 660993 - protein, 9 aa, Homo Sapiens
EVMPQDTYS

SEQ ID NO: 660994 - protein, 9 aa, Homo Sapiens
RFASSCHLA

SEQ ID NO: 660995 - protein, 9 aa, Homo Sapiens
DLRERIIKR

SEQ ID NO: 660996 - protein, 9 aa, Homo Sapiens
MAECLTHAI

SEQ ID NO: 660997 - protein, 9 aa, Homo Sapiens
QTLNGELTG

SEQ ID NO: 660998 - protein, 9 aa, Homo Sapiens
SSCSYTSGP

SEQ ID NO: 660999 - protein, 9 aa, Homo Sapiens
TEWNRSCAL

SEQ ID NO: 661000 - protein, 8 aa, Homo Sapiens
ASSLPWLC

SEQ ID NO: 661001 - protein, 9 aa, Homo Sapiens
PGLATPQRA

SEQ ID NO: 661002 - protein, 9 aa, Homo Sapiens
TLNGELTGG

SEQ ID NO: 661003 - protein, 9 aa, Homo Sapiens
RLRTPTPPL

SEQ ID NO: 661004 - protein, 9 aa, Homo Sapiens
TVTRLSRRQ

SEQ ID NO: 661005 - protein, 9 aa, Homo Sapiens
EGLAWAWPW

SEQ ID NO: 661006 - protein, 9 aa, Homo Sapiens
LAIQKNKPM

SEQ ID NO: 661007 - protein, 9 aa, Homo Sapiens
LCPWASGSH

SEQ ID NO: 661008 - protein, 9 aa, Homo Sapiens
SQFWRKTRS

SEQ ID NO: 661009 - protein, 9 aa, Homo Sapiens
MFTANWTSV

SEQ ID NO: 661010 - protein, 9 aa, Homo Sapiens
QAELIQQLE

SEQ ID NO: 661011 - protein, 9 aa, Homo Sapiens
GDMCHSTAV

SEQ ID NO: 661012 - protein, 9 aa, Homo Sapiens
GSLPGCAAL

SEQ ID NO: 661013 - protein, 9 aa, Homo Sapiens
GTHMCRAKI

SEQ ID NO: 661014 - protein, 9 aa, Homo Sapiens
MEGTDPVPW

SEQ ID NO: 661015 - protein, 9 aa, Homo Sapiens
ERLGLSPKI

SEQ ID NO: 661016 - protein, 9 aa, Homo Sapiens
SVEENIDVV

SEQ ID NO: 661017 - protein, 9 aa, Homo Sapiens
EKLQHFFNH

SEQ ID NO: 661018 - protein, 9 aa, Homo Sapiens
TSCNSFLLN

SEQ ID NO: 661019 - protein, 9 aa, Homo Sapiens
SPGPSPGPG

SEQ ID NO: 661020 - protein, 9 aa, Homo Sapiens
KNKPMSKKE

SEQ ID NO: 661021 - protein, 9 aa, Homo Sapiens
ADGVGKSAL

SEQ ID NO: 661022 - protein, 9 aa, Homo Sapiens
AWAWPWRSS

SEQ ID NO: 661023 - protein, 9 aa, Homo Sapiens
GLAWAWPWR

SEQ ID NO: 661024 - protein, 9 aa, Homo Sapiens
MLAISQGRV

SEQ ID NO: 661025 - protein, 9 aa, Homo Sapiens
EYSDETDTS

SEQ ID NO: 661026 - protein, 9 aa, Homo Sapiens
PRAIEGLAW

SEQ ID NO: 661027 - protein, 9 aa, Homo Sapiens
TPQRAQRLE

SEQ ID NO: 661028 - protein, 9 aa, Homo Sapiens
WPGPVMETV

SEQ ID NO: 661029 - protein, 9 aa, Homo Sapiens
GKGVMLAIS

SEQ ID NO: 661030 - protein, 9 aa, Homo Sapiens
SRRSASAVG

SEQ ID NO: 661031 - protein, 9 aa, Homo Sapiens
AAGHCPYGG

SEQ ID NO: 661032 - protein, 9 aa, Homo Sapiens
YRPPPEEAM

SEQ ID NO: 661033 - protein, 9 aa, Homo Sapiens
TRGPLCPWA

SEQ ID NO: 661034 - protein, 9 aa, Homo Sapiens
LEVLNMDTQ

SEQ ID NO: 661035 - protein, 9 aa, Homo Sapiens
SRRQGEERL

SEQ ID NO: 661036 - protein, 9 aa, Homo Sapiens
YTWTKSQFW

SEQ ID NO: 661037 - protein, 9 aa, Homo Sapiens
FASSCHLAK

SEQ ID NO: 661038 - protein, 9 aa, Homo Sapiens
TKEEPLEGE

SEQ ID NO: 661039 - protein, 9 aa, Homo Sapiens
DPVPWTTRG

SEQ ID NO: 661040 - protein, 9 aa, Homo Sapiens
SSCHLAKET

SEQ ID NO: 661041 - protein, 9 aa, Homo Sapiens
EASDEDILF

SEQ ID NO: 661042 - protein, 9 aa, Homo Sapiens
AECLTHAIY

SEQ ID NO: 661043 - protein, 9 aa, Homo Sapiens
PWASGSHHG

SEQ ID NO: 661044 - protein, 9 aa, Homo Sapiens
TAAGHCPYG

SEQ ID NO: 661045 - protein, 9 aa, Homo Sapiens
GSHHGWPGP

SEQ ID NO: 661046 - protein, 9 aa, Homo Sapiens
AWPWRSSRR

SEQ ID NO: 661047 - protein, 9 aa, Homo Sapiens
TANWTSVKV

SEQ ID NO: 661048 - protein, 9 aa, Homo Sapiens
AECSIHLDV

SEQ ID NO: 661049 - protein, 9 aa, Homo Sapiens
DETDTSACN

SEQ ID NO: 661050 - protein, 9 aa, Homo Sapiens
KELRDAVLL

SEQ ID NO: 661051 - protein, 9 aa, Homo Sapiens
LGAPGLATP

SEQ ID NO: 661052 - protein, 9 aa, Homo Sapiens
SAECSIHLD

SEQ ID NO: 661053 - protein, 9 aa, Homo Sapiens
VMPQDTYSQ

SEQ ID NO: 661054 - protein, 9 aa, Homo Sapiens
PGCAALKLS

SEQ ID NO: 661055 - protein, 9 aa, Homo Sapiens
CPWASGSHH

SEQ ID NO: 661056 - protein, 9 aa, Homo Sapiens
RTPTPPLSH

SEQ ID NO: 661057 - protein, 9 aa, Homo Sapiens
GVPSHSAEQ

SEQ ID NO: 661058 - protein, 9 aa, Homo Sapiens
RPPPEEAMP

SEQ ID NO: 661059 - protein, 9 aa, Homo Sapiens
KGVMLAISQ

SEQ ID NO: 661060 - protein, 9 aa, Homo Sapiens
YSDETDTSA

SEQ ID NO: 661061 - protein, 9 aa, Homo Sapiens
SIHLDVIVD

SEQ ID NO: 661062 - protein, 9 aa, Homo Sapiens
RAIEGLAWA

SEQ ID NO: 661063 - protein, 9 aa, Homo Sapiens
EKELRDAVL

SEQ ID NO: 661064 - protein, 9 aa, Homo Sapiens
ASAVGGPSR

SEQ ID NO: 661065 - protein, 9 aa, Homo Sapiens
PGDDLRERI

SEQ ID NO: 661066 - protein, 9 aa, Homo Sapiens
QTNSFFMMI

SEQ ID NO: 661067 - protein, 9 aa, Homo Sapiens
WTTRGPLCP

SEQ ID NO: 661068 - protein, 9 aa, Homo Sapiens
PGRDGDMCH

SEQ ID NO: 661069 - protein, 9 aa, Homo Sapiens
AQTNSFFMM

SEQ ID NO: 661070 - protein, 9 aa, Homo Sapiens
KFSPGPSPG

SEQ ID NO: 661071 - protein, 9 aa, Homo Sapiens
QQLEVLNMD

SEQ ID NO: 661072 - protein, 9 aa, Homo Sapiens
WAWPWRSSR

SEQ ID NO: 661073 - protein, 9 aa, Homo Sapiens
QKNKPMSKK

SEQ ID NO: 661074 - protein, 9 aa, Homo Sapiens
LATPQRAQR

SEQ ID NO: 661075 - protein, 9 aa, Homo Sapiens
LRERIIKRA

SEQ ID NO: 661076 - protein, 9 aa, Homo Sapiens
DGSLPGCAA

SEQ ID NO: 661077 - protein, 9 aa, Homo Sapiens
QLEVLNMDT

SEQ ID NO: 661078 - protein, 9 aa, Homo Sapiens
LLFGTATNV

SEQ ID NO: 661079 - protein, 9 aa, Homo Sapiens
SCSYTSGPG

SEQ ID NO: 661080 - protein, 9 aa, Homo Sapiens
KSQFWRKTR

SEQ ID NO: 661081 - protein, 9 aa, Homo Sapiens
NFTNEKLQH

SEQ ID NO: 661082 - protein, 9 aa, Homo Sapiens
SCRFASSCH

SEQ ID NO: 661083 - protein, 9 aa, Homo Sapiens
HHGWPGPVM

SEQ ID NO: 661084 - protein, 9 aa, Homo Sapiens
KLSKTGSIS

SEQ ID NO: 661085 - protein, 9 aa, Homo Sapiens
AIEGLAWAW

SEQ ID NO: 661086 - protein, 9 aa, Homo Sapiens
IHLDVIVDR

SEQ ID NO: 661087 - protein, 9 aa, Homo Sapiens
SKTGSISVP

SEQ ID NO: 661088 - protein, 9 aa, Homo Sapiens
GPSRGMEGT

SEQ ID NO: 661089 - protein, 9 aa, Homo Sapiens
WLFELDGLK

SEQ ID NO: 661090 - protein, 9 aa, Homo Sapiens
ALLNFTEWN

SEQ ID NO: 661091 - protein, 9 aa, Homo Sapiens
HGWPGPVME

SEQ ID NO: 661092 - protein, 9 aa, Homo Sapiens
TLRSEASDE

SEQ ID NO: 661093 - protein, 9 aa, Homo Sapiens
HMCRAKITS

SEQ ID NO: 661094 - protein, 9 aa, Homo Sapiens
WELEVMPQD

SEQ ID NO: 661095 - protein, 9 aa, Homo Sapiens
EEQIQLVLG

SEQ ID NO: 661096 - protein, 9 aa, Homo Sapiens
EPLEGEATT

SEQ ID NO: 661097 - protein, 9 aa, Homo Sapiens
YKLVVVGAD

SEQ ID NO: 661098 - protein, 9 aa, Homo Sapiens
GYRPPPEEA

SEQ ID NO: 661099 - protein, 9 aa, Homo Sapiens
ISRQTLNGE

SEQ ID NO: 661100 - protein, 9 aa, Homo Sapiens
KLVVVGADG

SEQ ID NO: 661101 - protein, 9 aa, Homo Sapiens
ASSCHLAKE

SEQ ID NO: 661102 - protein, 9 aa, Homo Sapiens
NPGRDGDMC

SEQ ID NO: 661103 - protein, 9 aa, Homo Sapiens
IYTWTKSQF

SEQ ID NO: 661104 - protein, 9 aa, Homo Sapiens
RLSRRQGEE

SEQ ID NO: 661105 - protein, 9 aa, Homo Sapiens
GMEGTDPVP

SEQ ID NO: 661106 - protein, 9 aa, Homo Sapiens
AIQKNKPMS

SEQ ID NO: 661107 - protein, 9 aa, Homo Sapiens
IQQLEVLNM

SEQ ID NO: 661108 - protein, 9 aa, Homo Sapiens
EQIQLVLGN

SEQ ID NO: 661109 - protein, 9 aa, Homo Sapiens
AVLLIFANK

SEQ ID NO: 661110 - protein, 9 aa, Homo Sapiens
NHARLRTPT

SEQ ID NO: 661111 - protein, 9 aa, Homo Sapiens
SAVFEDGSV

SEQ ID NO: 661112 - protein, 9 aa, Homo Sapiens
FMMISSLMF

SEQ ID NO: 661113 - protein, 9 aa, Homo Sapiens
LVVVGADGV

SEQ ID NO: 661114 - protein, 9 aa, Homo Sapiens
RGPLCPWAS

SEQ ID NO: 661115 - protein, 9 aa, Homo Sapiens
QHQHQHQQQ

SEQ ID NO: 661116 - protein, 9 aa, Homo Sapiens
ALKLSDGRK

SEQ ID NO: 661117 - protein, 9 aa, Homo Sapiens
TKSQFWRKT

SEQ ID NO: 661118 - protein, 9 aa, Homo Sapiens
VPITGWLFE

SEQ ID NO: 661119 - protein, 9 aa, Homo Sapiens
SCNSFLLNC

SEQ ID NO: 661120 - protein, 9 aa, Homo Sapiens
ITGWLFELD

SEQ ID NO: 661121 - protein, 9 aa, Homo Sapiens
TWTKSQFWR

SEQ ID NO: 661122 - protein, 9 aa, Homo Sapiens
LRSEASDED

SEQ ID NO: 661123 - protein, 9 aa, Homo Sapiens
FSPGPSPGP

SEQ ID NO: 661124 - protein, 9 aa, Homo Sapiens
SLCDQRRPR

SEQ ID NO: 661125 - protein, 9 aa, Homo Sapiens
AFSSCSYTS

SEQ ID NO: 661126 - protein, 9 aa, Homo Sapiens
MMISSLMFL

SEQ ID NO: 661127 - protein, 9 aa, Homo Sapiens
KLQHFFNHH

SEQ ID NO: 661128 - protein, 9 aa, Homo Sapiens
VFATAAYSK

SEQ ID NO: 661129 - protein, 9 aa, Homo Sapiens
FSSCSYTSG

SEQ ID NO: 661130 - protein, 9 aa, Homo Sapiens
RSQFSSRSR

SEQ ID NO: 661131 - protein, 9 aa, Homo Sapiens
LHPGSLLFR

SEQ ID NO: 661132 - protein, 9 aa, Homo Sapiens
SRSQFSSRS

SEQ ID NO: 661133 - protein, 9 aa, Homo Sapiens
ITPSYNYAQ

SEQ ID NO: 661134 - protein, 9 aa, Homo Sapiens
VHIMKNRNG

SEQ ID NO: 661135 - protein, 9 aa, Homo Sapiens
QFSSRSRSR

SEQ ID NO: 661136 - protein, 9 aa, Homo Sapiens
GHSFPVGPF

SEQ ID NO: 661137 - protein, 9 aa, Homo Sapiens
LGSLHPGSL

SEQ ID NO: 661138 - protein, 9 aa, Homo Sapiens
PNIGHSFPV

SEQ ID NO: 661139 - protein, 9 aa, Homo Sapiens
HPGSLLFRA

SEQ ID NO: 661140 - protein, 9 aa, Homo Sapiens
SLLFRASGH

SEQ ID NO: 661141 - protein, 9 aa, Homo Sapiens
QPNIGHSFP

SEQ ID NO: 661142 - protein, 9 aa, Homo Sapiens
YAQNMDKHW

SEQ ID NO: 661143 - protein, 9 aa, Homo Sapiens
RSKSRSQFS

SEQ ID NO: 661144 - protein, 9 aa, Homo Sapiens
SRSKSRSQF

SEQ ID NO: 661145 - protein, 9 aa, Homo Sapiens
QNMDKHWIM

SEQ ID NO: 661146 - protein, 9 aa, Homo Sapiens
NIGHSFPVG

SEQ ID NO: 661147 - protein, 9 aa, Homo Sapiens
GSLHPGSLL

SEQ ID NO: 661148 - protein, 9 aa, Homo Sapiens
KSRSQFSSR

SEQ ID NO: 661149 - protein, 9 aa, Homo Sapiens
HIMKNRNGG

SEQ ID NO: 661150 - protein, 9 aa, Homo Sapiens
DLGSLHPGS

SEQ ID NO: 661151 - protein, 9 aa, Homo Sapiens
GSLLFRASG

SEQ ID NO: 661152 - protein, 9 aa, Homo Sapiens
YNYAQNMDK

SEQ ID NO: 661153 - protein, 9 aa, Homo Sapiens
TPSYNYAQN

SEQ ID NO: 661154 - protein, 9 aa, Homo Sapiens
MKNRNGGGS

SEQ ID NO: 661155 - protein, 9 aa, Homo Sapiens
TVHIMKNRN

SEQ ID NO: 661156 - protein, 9 aa, Homo Sapiens
IGHSFPVGP

SEQ ID NO: 661157 - protein, 9 aa, Homo Sapiens
VQPNIGHSF

SEQ ID NO: 661158 - protein, 9 aa, Homo Sapiens
PVQPNIGHS

SEQ ID NO: 661159 - protein, 9 aa, Homo Sapiens
PSYNYAQNM

SEQ ID NO: 661160 - protein, 9 aa, Homo Sapiens
SQFSSRSRS

SEQ ID NO: 661161 - protein, 9 aa, Homo Sapiens
NYAQNMDKH

SEQ ID NO: 661162 - protein, 9 aa, Homo Sapiens
HSFPVGPFL

SEQ ID NO: 661163 - protein, 9 aa, Homo Sapiens
SPVQPNIGH

SEQ ID NO: 661164 - protein, 9 aa, Homo Sapiens
STVHIMKNR

SEQ ID NO: 661165 - protein, 9 aa, Homo Sapiens
FSSRSRSRS

SEQ ID NO: 661166 - protein, 9 aa, Homo Sapiens
VSTVHIMKN

SEQ ID NO: 661167 - protein, 9 aa, Homo Sapiens
IMKNRNGGG

SEQ ID NO: 661168 - protein, 9 aa, Homo Sapiens
SKSRSQFSS

SEQ ID NO: 661169 - protein, 9 aa, Homo Sapiens
PGSLLFRAS

SEQ ID NO: 661170 - protein, 9 aa, Homo Sapiens
SYNYAQNMD

SEQ ID NO: 661171 - protein, 9 aa, Homo Sapiens
SLHPGSLLF

SEQ ID NO: 661172 - protein, 9 aa, Homo Sapiens
AQNMDKHWI

SEQ ID NO: 661173 - protein, 9 aa, Homo Sapiens
LLIVVTITV

SEQ ID NO: 661174 - protein, 9 aa, Homo Sapiens
VEPDGSNDE

SEQ ID NO: 661175 - protein, 9 aa, Homo Sapiens
VYMTAEQSA

SEQ ID NO: 661176 - protein, 9 aa, Homo Sapiens
DQVGFNDEE

SEQ ID NO: 661177 - protein, 9 aa, Homo Sapiens
HRSSFVTST

SEQ ID NO: 661178 - protein, 9 aa, Homo Sapiens
NKWSQPVAN

SEQ ID NO: 661179 - protein, 9 aa, Homo Sapiens
LLAIFYTVF

SEQ ID NO: 661180 - protein, 9 aa, Homo Sapiens
MRRNTILCQ

SEQ ID NO: 661181 - protein, 9 aa, Homo Sapiens
EGDSNRRRV

SEQ ID NO: 661182 - protein, 9 aa, Homo Sapiens
MKRPDFSET

SEQ ID NO: 661183 - protein, 9 aa, Homo Sapiens
LDDGVQRLC

SEQ ID NO: 661184 - protein, 9 aa, Homo Sapiens
EPPQKLKLA

SEQ ID NO: 661185 - protein, 9 aa, Homo Sapiens
KTTVCSIMK

SEQ ID NO: 661186 - protein, 9 aa, Homo Sapiens
APNCPRASY

SEQ ID NO: 661187 - protein, 9 aa, Homo Sapiens
SRDMGILGD

SEQ ID NO: 661188 - protein, 9 aa, Homo Sapiens
NRRRVSPYP

SEQ ID NO: 661189 - protein, 9 aa, Homo Sapiens
IEYPELQIN

SEQ ID NO: 661190 - protein, 9 aa, Homo Sapiens
QVGFNDEEF

SEQ ID NO: 661191 - protein, 9 aa, Homo Sapiens
AYEVRVFLP

SEQ ID NO: 661192 - protein, 9 aa, Homo Sapiens
AWMIALHSP

SEQ ID NO: 661193 - protein, 9 aa, Homo Sapiens
YVRMVCQWT

SEQ ID NO: 661194 - protein, 9 aa, Homo Sapiens
HSPIHTIAH

SEQ ID NO: 661195 - protein, 9 aa, Homo Sapiens
IALISVRVF

SEQ ID NO: 661196 - protein, 9 aa, Homo Sapiens
EPEVLQDSQ

SEQ ID NO: 661197 - protein, 9 aa, Homo Sapiens
DQGQGPNGG

SEQ ID NO: 661198 - protein, 9 aa, Homo Sapiens
FPHKEMISS

SEQ ID NO: 661199 - protein, 9 aa, Homo Sapiens
NDNDVYRAP

SEQ ID NO: 661200 - protein, 9 aa, Homo Sapiens
RPPKYNDSC

SEQ ID NO: 661201 - protein, 9 aa, Homo Sapiens
PPGPGQASC

SEQ ID NO: 661202 - protein, 9 aa, Homo Sapiens
VKIPVAIKT

SEQ ID NO: 661203 - protein, 9 aa, Homo Sapiens
EIWRKYDAD

SEQ ID NO: 661204 - protein, 9 aa, Homo Sapiens
NNYYEAPNC

SEQ ID NO: 661205 - protein, 9 aa, Homo Sapiens
LHHWHGFPV

SEQ ID NO: 661206 - protein, 9 aa, Homo Sapiens
WHSNDNDVY

SEQ ID NO: 661207 - protein, 9 aa, Homo Sapiens
APGKAGTVG

SEQ ID NO: 661208 - protein, 9 aa, Homo Sapiens
VYHLSVFAT

SEQ ID NO: 661209 - protein, 9 aa, Homo Sapiens
LRRREVSGC

SEQ ID NO: 661210 - protein, 9 aa, Homo Sapiens
VPWEYSFLS

SEQ ID NO: 661211 - protein, 9 aa, Homo Sapiens
LNNYNAESS

SEQ ID NO: 661212 - protein, 9 aa, Homo Sapiens
FCRSPSRHC

SEQ ID NO: 661213 - protein, 9 aa, Homo Sapiens
PCPLVKSEE

SEQ ID NO: 661214 - protein, 9 aa, Homo Sapiens
CRSPSRHCY

SEQ ID NO: 661215 - protein, 9 aa, Homo Sapiens
RPNQNNQEE

SEQ ID NO: 661216 - protein, 9 aa, Homo Sapiens
IGLDACFGQ

SEQ ID NO: 661217 - protein, 9 aa, Homo Sapiens
KSLSSEALS

SEQ ID NO: 661218 - protein, 9 aa, Homo Sapiens
TISPLDKLL

SEQ ID NO: 661219 - protein, 9 aa, Homo Sapiens
SKGSPAFLP

SEQ ID NO: 661220 - protein, 9 aa, Homo Sapiens
DNDVYRAPP

SEQ ID NO: 661221 - protein, 9 aa, Homo Sapiens
GGLPAMPLL

SEQ ID NO: 661222 - protein, 9 aa, Homo Sapiens
LVVFRVKIY

SEQ ID NO: 661223 - protein, 9 aa, Homo Sapiens
ATAYEVRVF

SEQ ID NO: 661224 - protein, 9 aa, Homo Sapiens
GDGAPAAAG

SEQ ID NO: 661225 - protein, 9 aa, Homo Sapiens
PIHCGGIQF

SEQ ID NO: 661226 - protein, 9 aa, Homo Sapiens
CEYSTTDAT

SEQ ID NO: 661227 - protein, 9 aa, Homo Sapiens
REKDMEVYL

SEQ ID NO: 661228 - protein, 9 aa, Homo Sapiens
SHCYCKRLV

SEQ ID NO: 661229 - protein, 9 aa, Homo Sapiens
SKRVGKEKC

SEQ ID NO: 661230 - protein, 9 aa, Homo Sapiens
AMAVAGFLQ

SEQ ID NO: 661231 - protein, 9 aa, Homo Sapiens
SEKPGQEAT

SEQ ID NO: 661232 - protein, 9 aa, Homo Sapiens
DATAYEVRV

SEQ ID NO: 661233 - protein, 9 aa, Homo Sapiens
CRLTVHFNP

SEQ ID NO: 661234 - protein, 9 aa, Homo Sapiens
LPLHRSTIQ

SEQ ID NO: 661235 - protein, 9 aa, Homo Sapiens
QVDSMGGPN

SEQ ID NO: 661236 - protein, 9 aa, Homo Sapiens
MEVYLQKLL

SEQ ID NO: 661237 - protein, 9 aa, Homo Sapiens
HGLLGKPQL

SEQ ID NO: 661238 - protein, 9 aa, Homo Sapiens
HGTPFNAAQ

SEQ ID NO: 661239 - protein, 9 aa, Homo Sapiens
VFRVKIYRK

SEQ ID NO: 661240 - protein, 9 aa, Homo Sapiens
NVECLITDH

SEQ ID NO: 661241 - protein, 9 aa, Homo Sapiens
LLSLGAQSN

SEQ ID NO: 661242 - protein, 9 aa, Homo Sapiens
RRRGGDGAP

SEQ ID NO: 661243 - protein, 9 aa, Homo Sapiens
PHCLLLPAH

SEQ ID NO: 661244 - protein, 9 aa, Homo Sapiens
TDATGFKRH

SEQ ID NO: 661245 - protein, 9 aa, Homo Sapiens
NRVQSCYQQ

SEQ ID NO: 661246 - protein, 9 aa, Homo Sapiens
KENVMLLSQ

SEQ ID NO: 661247 - protein, 9 aa, Homo Sapiens
EGLNNYNAE

SEQ ID NO: 661248 - protein, 9 aa, Homo Sapiens
QFIFREIIA

SEQ ID NO: 661249 - protein, 9 aa, Homo Sapiens
LEAQVAHGD

SEQ ID NO: 661250 - protein, 9 aa, Homo Sapiens
TGFKVGISY

SEQ ID NO: 661251 - protein, 9 aa, Homo Sapiens
CSIMKRPDF

SEQ ID NO: 661252 - protein, 9 aa, Homo Sapiens
DSNRRRVSP

SEQ ID NO: 661253 - protein, 9 aa, Homo Sapiens
QASCVAPSS

SEQ ID NO: 661254 - protein, 9 aa, Homo Sapiens
RNTRRMRHL

SEQ ID NO: 661255 - protein, 9 aa, Homo Sapiens
MENRVQSCY

SEQ ID NO: 661256 - protein, 9 aa, Homo Sapiens
KVAIKTLEP

SEQ ID NO: 661257 - protein, 9 aa, Homo Sapiens
PPVPSPSSG

SEQ ID NO: 661258 - protein, 9 aa, Homo Sapiens
TTRHGQTGH

SEQ ID NO: 661259 - protein, 9 aa, Homo Sapiens
LGCPSGRLS

SEQ ID NO: 661260 - protein, 9 aa, Homo Sapiens
SRAFPSPFC

SEQ ID NO: 661261 - protein, 9 aa, Homo Sapiens
CTGLSSPAQ

SEQ ID NO: 661262 - protein, 9 aa, Homo Sapiens
GQPWGQQEI

SEQ ID NO: 661263 - protein, 9 aa, Homo Sapiens
WVTIDPSCE

SEQ ID NO: 661264 - protein, 9 aa, Homo Sapiens
TTVCSIMKR

SEQ ID NO: 661265 - protein, 9 aa, Homo Sapiens
GVPVSWVTI

SEQ ID NO: 661266 - protein, 9 aa, Homo Sapiens
KEMISSPPF

SEQ ID NO: 661267 - protein, 9 aa, Homo Sapiens
CEGLNNYNA

SEQ ID NO: 661268 - protein, 9 aa, Homo Sapiens
LDEQLHHWH

SEQ ID NO: 661269 - protein, 9 aa, Homo Sapiens
PSMPPTRFF

SEQ ID NO: 661270 - protein, 9 aa, Homo Sapiens
SPCVNGGSC

SEQ ID NO: 661271 - protein, 9 aa, Homo Sapiens
VEKREKDME

SEQ ID NO: 661272 - protein, 9 aa, Homo Sapiens
FEVQKDQFI

SEQ ID NO: 661273 - protein, 9 aa, Homo Sapiens
IKNHLVLSN

SEQ ID NO: 661274 - protein, 9 aa, Homo Sapiens
IVVTITVSE

SEQ ID NO: 661275 - protein, 9 aa, Homo Sapiens
TVLPKDGAV

SEQ ID NO: 661276 - protein, 9 aa, Homo Sapiens
TITVSETLG

SEQ ID NO: 661277 - protein, 9 aa, Homo Sapiens
SNVGISVAT

SEQ ID NO: 661278 - protein, 9 aa, Homo Sapiens
QIPGISIPS

SEQ ID NO: 661279 - protein, 9 aa, Homo Sapiens
GKPQLYLTV

SEQ ID NO: 661280 - protein, 9 aa, Homo Sapiens
SLEVLIEYP

SEQ ID NO: 661281 - protein, 9 aa, Homo Sapiens
TGLSSPAQP

SEQ ID NO: 661282 - protein, 9 aa, Homo Sapiens
GRPPKYNDS

SEQ ID NO: 661283 - protein, 9 aa, Homo Sapiens
YIFVTGRIA

SEQ ID NO: 661284 - protein, 9 aa, Homo Sapiens
STLPLHRST

SEQ ID NO: 661285 - protein, 9 aa, Homo Sapiens
PELRRREVS

SEQ ID NO: 661286 - protein, 9 aa, Homo Sapiens
GQEATVLPK

SEQ ID NO: 661287 - protein, 9 aa, Homo Sapiens
FGNHTPLER

SEQ ID NO: 661288 - protein, 9 aa, Homo Sapiens
PDLSHMTLS

SEQ ID NO: 661289 - protein, 9 aa, Homo Sapiens
VLGTGTDAR

SEQ ID NO: 661290 - protein, 9 aa, Homo Sapiens
GDQQLRDLG

SEQ ID NO: 661291 - protein, 9 aa, Homo Sapiens
APSEEHLGR

SEQ ID NO: 661292 - protein, 9 aa, Homo Sapiens
NPCDSETSH

SEQ ID NO: 661293 - protein, 9 aa, Homo Sapiens
RRREVSGCY

SEQ ID NO: 661294 - protein, 9 aa, Homo Sapiens
VEFMEIWRK

SEQ ID NO: 661295 - protein, 9 aa, Homo Sapiens
EVQKDQFIF

SEQ ID NO: 661296 - protein, 9 aa, Homo Sapiens
NHTPLERVS

SEQ ID NO: 661297 - protein, 9 aa, Homo Sapiens
LKGLGVHGS

SEQ ID NO: 661298 - protein, 9 aa, Homo Sapiens
CGGYGALRL

SEQ ID NO: 661299 - protein, 9 aa, Homo Sapiens
KAYRHGEKT

SEQ ID NO: 661300 - protein, 9 aa, Homo Sapiens
DRLREPPQK

SEQ ID NO: 661301 - protein, 9 aa, Homo Sapiens
NQEETSTEG

SEQ ID NO: 661302 - protein, 9 aa, Homo Sapiens
GISYQPPTV

SEQ ID NO: 661303 - protein, 9 aa, Homo Sapiens
STTDATGFK

SEQ ID NO: 661304 - protein, 9 aa, Homo Sapiens
TVDAAGSRG

SEQ ID NO: 661305 - protein, 9 aa, Homo Sapiens
LSKVSLTNL

SEQ ID NO: 661306 - protein, 9 aa, Homo Sapiens
NWSSARNSA

SEQ ID NO: 661307 - protein, 9 aa, Homo Sapiens
SVEFMEIWR

SEQ ID NO: 661308 - protein, 9 aa, Homo Sapiens
LQDSQDRCY

SEQ ID NO: 661309 - protein, 9 aa, Homo Sapiens
RGDLCPGAL

SEQ ID NO: 661310 - protein, 9 aa, Homo Sapiens
LPAMPLLFH

SEQ ID NO: 661311 - protein, 9 aa, Homo Sapiens
LESNVGISV

SEQ ID NO: 661312 - protein, 9 aa, Homo Sapiens
HPSYNFYRY

SEQ ID NO: 661313 - protein, 9 aa, Homo Sapiens
AQGRVRGDL

SEQ ID NO: 661314 - protein, 9 aa, Homo Sapiens
PSFLEGLCM

SEQ ID NO: 661315 - protein, 9 aa, Homo Sapiens
CGRPPKYND

SEQ ID NO: 661316 - protein, 9 aa, Homo Sapiens
SPKQRAKSK

SEQ ID NO: 661317 - protein, 9 aa, Homo Sapiens
MIRVRQNLH

SEQ ID NO: 661318 - protein, 9 aa, Homo Sapiens
FHPSYNFYR

SEQ ID NO: 661319 - protein, 9 aa, Homo Sapiens
GLENQMFII

SEQ ID NO: 661320 - protein, 9 aa, Homo Sapiens
GCPSGRLSS

SEQ ID NO: 661321 - protein, 9 aa, Homo Sapiens
PEQSHCNTS

SEQ ID NO: 661322 - protein, 9 aa, Homo Sapiens
AVIVYHLSV

SEQ ID NO: 661323 - protein, 9 aa, Homo Sapiens
YLDLPWYVR

SEQ ID NO: 661324 - protein, 9 aa, Homo Sapiens
HCLLLPAHT

SEQ ID NO: 661325 - protein, 9 aa, Homo Sapiens
GCGPGRLVL

SEQ ID NO: 661326 - protein, 9 aa, Homo Sapiens
AQVAHGDQQ

SEQ ID NO: 661327 - protein, 9 aa, Homo Sapiens
LCTGLSSPA

SEQ ID NO: 661328 - protein, 9 aa, Homo Sapiens
GLVEQVQRD

SEQ ID NO: 661329 - protein, 9 aa, Homo Sapiens
PGQEATVLP

SEQ ID NO: 661330 - protein, 9 aa, Homo Sapiens
RNTILCQAR

SEQ ID NO: 661331 - protein, 9 aa, Homo Sapiens
SKHGLLGKP

SEQ ID NO: 661332 - protein, 9 aa, Homo Sapiens
VQKEQAPSE

SEQ ID NO: 661333 - protein, 9 aa, Homo Sapiens
VAVIVYHLS

SEQ ID NO: 661334 - protein, 9 aa, Homo Sapiens
MRHLANTAP

SEQ ID NO: 661335 - protein, 9 aa, Homo Sapiens
DVNPRNPGE

SEQ ID NO: 661336 - protein, 9 aa, Homo Sapiens
CDKTFKWSS

SEQ ID NO: 661337 - protein, 9 aa, Homo Sapiens
DLPECVQVD

SEQ ID NO: 661338 - protein, 9 aa, Homo Sapiens
IPGISIPSD

SEQ ID NO: 661339 - protein, 9 aa, Homo Sapiens
EATVLPKDG

SEQ ID NO: 661340 - protein, 9 aa, Homo Sapiens
FSQTNLSPD

SEQ ID NO: 661341 - protein, 9 aa, Homo Sapiens
KCEECDKTF

SEQ ID NO: 661342 - protein, 9 aa, Homo Sapiens
TTWHSNDND

SEQ ID NO: 661343 - protein, 9 aa, Homo Sapiens
KNAVLVHSN

SEQ ID NO: 661344 - protein, 9 aa, Homo Sapiens
ISEARGFSR

SEQ ID NO: 661345 - protein, 9 aa, Homo Sapiens
GHPLHLVAV

SEQ ID NO: 661346 - protein, 9 aa, Homo Sapiens
VPTGLLSAQ

SEQ ID NO: 661347 - protein, 9 aa, Homo Sapiens
GNHTPLERV

SEQ ID NO: 661348 - protein, 9 aa, Homo Sapiens
GISIPSDTS

SEQ ID NO: 661349 - protein, 9 aa, Homo Sapiens
LHLVAVTPF

SEQ ID NO: 661350 - protein, 9 aa, Homo Sapiens
EWPLQVFHV

SEQ ID NO: 661351 - protein, 9 aa, Homo Sapiens
REGRQPSYS

SEQ ID NO: 661352 - protein, 9 aa, Homo Sapiens
PCEGLNNYN

SEQ ID NO: 661353 - protein, 9 aa, Homo Sapiens
FRVKIYRKE

SEQ ID NO: 661354 - protein, 9 aa, Homo Sapiens
KKTESSAPG

SEQ ID NO: 661355 - protein, 9 aa, Homo Sapiens
PSLLAHPCP

SEQ ID NO: 661356 - protein, 9 aa, Homo Sapiens
LLELEHQME

SEQ ID NO: 661357 - protein, 9 aa, Homo Sapiens
SPLDKLLAI

SEQ ID NO: 661358 - protein, 9 aa, Homo Sapiens
TFNVECLIT

SEQ ID NO: 661359 - protein, 9 aa, Homo Sapiens
PSYNFYRYN

SEQ ID NO: 661360 - protein, 9 aa, Homo Sapiens
VQKDQFIFR

SEQ ID NO: 661361 - protein, 9 aa, Homo Sapiens
PGKAGTVGP

SEQ ID NO: 661362 - protein, 9 aa, Homo Sapiens
YLYEHEIAD

SEQ ID NO: 661363 - protein, 9 aa, Homo Sapiens
WPLQVFHVD

SEQ ID NO: 661364 - protein, 9 aa, Homo Sapiens
GDLCPGALA

SEQ ID NO: 661365 - protein, 9 aa, Homo Sapiens
FKVGISYQP

SEQ ID NO: 661366 - protein, 9 aa, Homo Sapiens
KIATTCRLT

SEQ ID NO: 661367 - protein, 9 aa, Homo Sapiens
MIALHSPIH

SEQ ID NO: 661368 - protein, 9 aa, Homo Sapiens
GEENKGAGE

SEQ ID NO: 661369 - protein, 9 aa, Homo Sapiens
AAGGGGLLL

SEQ ID NO: 661370 - protein, 9 aa, Homo Sapiens
EVLIEYPEL

SEQ ID NO: 661371 - protein, 9 aa, Homo Sapiens
GAGAGGEEN

SEQ ID NO: 661372 - protein, 9 aa, Homo Sapiens
AEQSANLLK

SEQ ID NO: 661373 - protein, 9 aa, Homo Sapiens
GTVGPKGDR

SEQ ID NO: 661374 - protein, 9 aa, Homo Sapiens
CYGIQDIKN

SEQ ID NO: 661375 - protein, 9 aa, Homo Sapiens
AQSNTSALI

SEQ ID NO: 661376 - protein, 9 aa, Homo Sapiens
SLESNVGIS

SEQ ID NO: 661377 - protein, 9 aa, Homo Sapiens
WTHGTPFNA

SEQ ID NO: 661378 - protein, 9 aa, Homo Sapiens
WYRSLSYPQ

SEQ ID NO: 661379 - protein, 9 aa, Homo Sapiens
GFSRDMGIL

SEQ ID NO: 661380 - protein, 9 aa, Homo Sapiens
QCKFPHKEM

SEQ ID NO: 661381 - protein, 9 aa, Homo Sapiens
FLQLDEQLH

SEQ ID NO: 661382 - protein, 9 aa, Homo Sapiens
EKSLSSEAL

SEQ ID NO: 661383 - protein, 9 aa, Homo Sapiens
KGNRRNKRA

SEQ ID NO: 661384 - protein, 9 aa, Homo Sapiens
SSSLLEIDL

SEQ ID NO: 661385 - protein, 9 aa, Homo Sapiens
LLLLLPGPE

SEQ ID NO: 661386 - protein, 9 aa, Homo Sapiens
FTKNMKLED

SEQ ID NO: 661387 - protein, 9 aa, Homo Sapiens
MGTFPVPYD

SEQ ID NO: 661388 - protein, 9 aa, Homo Sapiens
KYFDGIDSH

SEQ ID NO: 661389 - protein, 9 aa, Homo Sapiens
PNVQKEQAP

SEQ ID NO: 661390 - protein, 9 aa, Homo Sapiens
PCVNGGSCR

SEQ ID NO: 661391 - protein, 9 aa, Homo Sapiens
SSTLPLHRS

SEQ ID NO: 661392 - protein, 9 aa, Homo Sapiens
KESKGSPAF

SEQ ID NO: 661393 - protein, 9 aa, Homo Sapiens
HGQTGHGQS

SEQ ID NO: 661394 - protein, 9 aa, Homo Sapiens
TVGPKGDRG

SEQ ID NO: 661395 - protein, 9 aa, Homo Sapiens
RDMGILGDT

SEQ ID NO: 661396 - protein, 9 aa, Homo Sapiens
QKIATTCRL

SEQ ID NO: 661397 - protein, 9 aa, Homo Sapiens
LTGLFSGTE

SEQ ID NO: 661398 - protein, 9 aa, Homo Sapiens
GHYNNFFFC

SEQ ID NO: 661399 - protein, 9 aa, Homo Sapiens
MKGLENQMF

SEQ ID NO: 661400 - protein, 9 aa, Homo Sapiens
CAQGYAPAS

SEQ ID NO: 661401 - protein, 9 aa, Homo Sapiens
VGPAACLCT

SEQ ID NO: 661402 - protein, 9 aa, Homo Sapiens
RVQSCYQQE

SEQ ID NO: 661403 - protein, 9 aa, Homo Sapiens
IHRSSFVTS

SEQ ID NO: 661404 - protein, 9 aa, Homo Sapiens
FTISPLDKL

SEQ ID NO: 661405 - protein, 9 aa, Homo Sapiens
CIALISVRV

SEQ ID NO: 661406 - protein, 9 aa, Homo Sapiens
PCDSETSHC

SEQ ID NO: 661407 - protein, 9 aa, Homo Sapiens
HHWHGFPVC

SEQ ID NO: 661408 - protein, 9 aa, Homo Sapiens
QPSYSSSLF

SEQ ID NO: 661409 - protein, 9 aa, Homo Sapiens
GALRLPSIC

SEQ ID NO: 661410 - protein, 9 aa, Homo Sapiens
NYYEAPNCP

SEQ ID NO: 661411 - protein, 9 aa, Homo Sapiens
TGKGNRRNK

SEQ ID NO: 661412 - protein, 9 aa, Homo Sapiens
ICHQILLLA

SEQ ID NO: 661413 - protein, 9 aa, Homo Sapiens
IPSDTSNMD

SEQ ID NO: 661414 - protein, 9 aa, Homo Sapiens
HWHGFPVCC

SEQ ID NO: 661415 - protein, 9 aa, Homo Sapiens
ECDKTFKWS

SEQ ID NO: 661416 - protein, 9 aa, Homo Sapiens
ARYGKSPYF

SEQ ID NO: 661417 - protein, 9 aa, Homo Sapiens
AHGDQQLRD

SEQ ID NO: 661418 - protein, 9 aa, Homo Sapiens
ESNVGISVA

SEQ ID NO: 661419 - protein, 9 aa, Homo Sapiens
WSIGARALG

SEQ ID NO: 661420 - protein, 9 aa, Homo Sapiens
PSRHCYGIQ

SEQ ID NO: 661421 - protein, 9 aa, Homo Sapiens
VTITVSETL

SEQ ID NO: 661422 - protein, 9 aa, Homo Sapiens
WSQPVANIS

SEQ ID NO: 661423 - protein, 9 aa, Homo Sapiens
GARALGAAA

SEQ ID NO: 661424 - protein, 9 aa, Homo Sapiens
QAPSEEHLG

SEQ ID NO: 661425 - protein, 9 aa, Homo Sapiens
PSGRLSSLC

SEQ ID NO: 661426 - protein, 9 aa, Homo Sapiens
PQKLKLAVS

SEQ ID NO: 661427 - protein, 9 aa, Homo Sapiens
ALHSPIHTI

SEQ ID NO: 661428 - protein, 9 aa, Homo Sapiens
CCIPIHCGG

SEQ ID NO: 661429 - protein, 9 aa, Homo Sapiens
RGFSRDMGI

SEQ ID NO: 661430 - protein, 9 aa, Homo Sapiens
GAGGEENKG

SEQ ID NO: 661431 - protein, 9 aa, Homo Sapiens
IATTCRLTV

SEQ ID NO: 661432 - protein, 9 aa, Homo Sapiens
AESDQGQGP

SEQ ID NO: 661433 - protein, 9 aa, Homo Sapiens
KQKQKKTES

SEQ ID NO: 661434 - protein, 9 aa, Homo Sapiens
DHMANTVEP

SEQ ID NO: 661435 - protein, 9 aa, Homo Sapiens
LEGLCMIMN

SEQ ID NO: 661436 - protein, 9 aa, Homo Sapiens
LCPSMKGTH

SEQ ID NO: 661437 - protein, 9 aa, Homo Sapiens
PWEYSFLSY

SEQ ID NO: 661438 - protein, 9 aa, Homo Sapiens
KYNDSCSVP

SEQ ID NO: 661439 - protein, 9 aa, Homo Sapiens
KAHITAESD

SEQ ID NO: 661440 - protein, 9 aa, Homo Sapiens
IPVAIKTSP

SEQ ID NO: 661441 - protein, 9 aa, Homo Sapiens
RYVCGTGAF

SEQ ID NO: 661442 - protein, 9 aa, Homo Sapiens
LHSPIHTIA

SEQ ID NO: 661443 - protein, 9 aa, Homo Sapiens
TRGWAPPVP

SEQ ID NO: 661444 - protein, 9 aa, Homo Sapiens
SSVEFMEIW

SEQ ID NO: 661445 - protein, 9 aa, Homo Sapiens
ELEHQMEEN

SEQ ID NO: 661446 - protein, 9 aa, Homo Sapiens
VKSQQEQSD

SEQ ID NO: 661447 - protein, 9 aa, Homo Sapiens
GTHLPHTIL

SEQ ID NO: 661448 - protein, 9 aa, Homo Sapiens
AKKKTKVAI

SEQ ID NO: 661449 - protein, 9 aa, Homo Sapiens
DGASSFAVY

SEQ ID NO: 661450 - protein, 9 aa, Homo Sapiens
WLISCCCIP

SEQ ID NO: 661451 - protein, 9 aa, Homo Sapiens
LVPWEYSFL

SEQ ID NO: 661452 - protein, 9 aa, Homo Sapiens
SVSSLESNV

SEQ ID NO: 661453 - protein, 9 aa, Homo Sapiens
WHGFPVCCG

SEQ ID NO: 661454 - protein, 9 aa, Homo Sapiens
SCSFHPSYN

SEQ ID NO: 661455 - protein, 9 aa, Homo Sapiens
VQRLCEALR

SEQ ID NO: 661456 - protein, 9 aa, Homo Sapiens
AMPLLFHPH

SEQ ID NO: 661457 - protein, 9 aa, Homo Sapiens
KWSQPVANI

SEQ ID NO: 661458 - protein, 9 aa, Homo Sapiens
AKSKRVGKE

SEQ ID NO: 661459 - protein, 9 aa, Homo Sapiens
CVNGGSCRQ

SEQ ID NO: 661460 - protein, 9 aa, Homo Sapiens
SYNFYRYNF

SEQ ID NO: 661461 - protein, 9 aa, Homo Sapiens
GAPAAAGRE

SEQ ID NO: 661462 - protein, 9 aa, Homo Sapiens
SLSYPQQGW

SEQ ID NO: 661463 - protein, 9 aa, Homo Sapiens
RLCEALRHP

SEQ ID NO: 661464 - protein, 9 aa, Homo Sapiens
HITAESDQG

SEQ ID NO: 661465 - protein, 9 aa, Homo Sapiens
QEETSTEGI

SEQ ID NO: 661466 - protein, 9 aa, Homo Sapiens
GTPLAVPTG

SEQ ID NO: 661467 - protein, 9 aa, Homo Sapiens
HCGGIQFFP

SEQ ID NO: 661468 - protein, 9 aa, Homo Sapiens
VPVSWVTID

SEQ ID NO: 661469 - protein, 9 aa, Homo Sapiens
AGTVGPKGD

SEQ ID NO: 661470 - protein, 9 aa, Homo Sapiens
CPLVKSEET

SEQ ID NO: 661471 - protein, 9 aa, Homo Sapiens
WSSARNSAS

SEQ ID NO: 661472 - protein, 9 aa, Homo Sapiens
EENKGAGEG

SEQ ID NO: 661473 - protein, 9 aa, Homo Sapiens
PLDKLLAIF

SEQ ID NO: 661474 - protein, 9 aa, Homo Sapiens
LVLGTGTDA

SEQ ID NO: 661475 - protein, 9 aa, Homo Sapiens
GFLQLDEQL

SEQ ID NO: 661476 - protein, 9 aa, Homo Sapiens
DDRLREPPQ

SEQ ID NO: 661477 - protein, 9 aa, Homo Sapiens
AHITAESDQ

SEQ ID NO: 661478 - protein, 9 aa, Homo Sapiens
DGIDSHMLL

SEQ ID NO: 661479 - protein, 9 aa, Homo Sapiens
DAAGSRGQG

SEQ ID NO: 661480 - protein, 9 aa, Homo Sapiens
ENLHDYFMI

SEQ ID NO: 661481 - protein, 9 aa, Homo Sapiens
LLLLPGPEA

SEQ ID NO: 661482 - protein, 9 aa, Homo Sapiens
SFHPSYNFY

SEQ ID NO: 661483 - protein, 9 aa, Homo Sapiens
ITAESDQGQ

SEQ ID NO: 661484 - protein, 9 aa, Homo Sapiens
SFLEGLCMI

SEQ ID NO: 661485 - protein, 9 aa, Homo Sapiens
GLPAMPLLF

SEQ ID NO: 661486 - protein, 9 aa, Homo Sapiens
TGFKRHVIS

SEQ ID NO: 661487 - protein, 9 aa, Homo Sapiens
LLPGPEASQ

SEQ ID NO: 661488 - protein, 9 aa, Homo Sapiens
PAACLCTGL

SEQ ID NO: 661489 - protein, 9 aa, Homo Sapiens
WYVRMVCQW

SEQ ID NO: 661490 - protein, 9 aa, Homo Sapiens
QNKNAVLVH

SEQ ID NO: 661491 - protein, 9 aa, Homo Sapiens
NNYNAESSM

SEQ ID NO: 661492 - protein, 9 aa, Homo Sapiens
QEPMGTFPV

SEQ ID NO: 661493 - protein, 9 aa, Homo Sapiens
KLLAIFYTV

SEQ ID NO: 661494 - protein, 9 aa, Homo Sapiens
IKTSPKANK

SEQ ID NO: 661495 - protein, 9 aa, Homo Sapiens
LPGPEASQL

SEQ ID NO: 661496 - protein, 9 aa, Homo Sapiens
ASDGRSCLD

SEQ ID NO: 661497 - protein, 9 aa, Homo Sapiens
RLREPPQKL

SEQ ID NO: 661498 - protein, 9 aa, Homo Sapiens
SICGPPAGL

SEQ ID NO: 661499 - protein, 9 aa, Homo Sapiens
PDGSNDEGY

SEQ ID NO: 661500 - protein, 9 aa, Homo Sapiens
VAGFLQLDE

SEQ ID NO: 661501 - protein, 9 aa, Homo Sapiens
VAHVACDVL

SEQ ID NO: 661502 - protein, 9 aa, Homo Sapiens
LVHSNLNSE

SEQ ID NO: 661503 - protein, 9 aa, Homo Sapiens
IATLTGTPP

SEQ ID NO: 661504 - protein, 9 aa, Homo Sapiens
YFMIRVRQN

SEQ ID NO: 661505 - protein, 9 aa, Homo Sapiens
SLSSEALSK

SEQ ID NO: 661506 - protein, 9 aa, Homo Sapiens
ATTCRLTVH

SEQ ID NO: 661507 - protein, 9 aa, Homo Sapiens
NFYRYNFSM

SEQ ID NO: 661508 - protein, 9 aa, Homo Sapiens
IVAHVACDV

SEQ ID NO: 661509 - protein, 9 aa, Homo Sapiens
EAGDFGYIF

SEQ ID NO: 661510 - protein, 9 aa, Homo Sapiens
CSFHPSYNF

SEQ ID NO: 661511 - protein, 9 aa, Homo Sapiens
RRGGDGAPA

SEQ ID NO: 661512 - protein, 9 aa, Homo Sapiens
EQSHCNTST

SEQ ID NO: 661513 - protein, 9 aa, Homo Sapiens
RREVSGCYN

SEQ ID NO: 661514 - protein, 9 aa, Homo Sapiens
ESKGSPAFL

SEQ ID NO: 661515 - protein, 9 aa, Homo Sapiens
EQVQRDPRR

SEQ ID NO: 661516 - protein, 9 aa, Homo Sapiens
VLVHSNLNS

SEQ ID NO: 661517 - protein, 9 aa, Homo Sapiens
ITVSETLGS

SEQ ID NO: 661518 - protein, 9 aa, Homo Sapiens
RMRHLANTA

SEQ ID NO: 661519 - protein, 9 aa, Homo Sapiens
PKIHRSSFV

SEQ ID NO: 661520 - protein, 9 aa, Homo Sapiens
PKQRAKSKR

SEQ ID NO: 661521 - protein, 9 aa, Homo Sapiens
YNDSCSVPE

SEQ ID NO: 661522 - protein, 9 aa, Homo Sapiens
TSHCYCKRL

SEQ ID NO: 661523 - protein, 9 aa, Homo Sapiens
YLWYRSLSY

SEQ ID NO: 661524 - protein, 9 aa, Homo Sapiens
EMISSPPFR

SEQ ID NO: 661525 - protein, 9 aa, Homo Sapiens
GEGDSNRRR

SEQ ID NO: 661526 - protein, 9 aa, Homo Sapiens
HRYVCGTGA

SEQ ID NO: 661527 - protein, 9 aa, Homo Sapiens
IVYHLSVFA

SEQ ID NO: 661528 - protein, 9 aa, Homo Sapiens
GVFGNHTPL

SEQ ID NO: 661529 - protein, 9 aa, Homo Sapiens
EASQLRYSV

SEQ ID NO: 661530 - protein, 9 aa, Homo Sapiens
HRSTIQLIK

SEQ ID NO: 661531 - protein, 9 aa, Homo Sapiens
FMIRVRQNL

SEQ ID NO: 661532 - protein, 9 aa, Homo Sapiens
EVLQDSQDR

SEQ ID NO: 661533 - protein, 9 aa, Homo Sapiens
GRLVLGTGT

SEQ ID NO: 661534 - protein, 9 aa, Homo Sapiens
EDGYLYEHE

SEQ ID NO: 661535 - protein, 9 aa, Homo Sapiens
IEEDDGTGL

SEQ ID NO: 661536 - protein, 9 aa, Homo Sapiens
EYSTTDATG

SEQ ID NO: 661537 - protein, 9 aa, Homo Sapiens
AFLPRKENS

SEQ ID NO: 661538 - protein, 9 aa, Homo Sapiens
TWHSNDNDV

SEQ ID NO: 661539 - protein, 9 aa, Homo Sapiens
QMEENIVIS

SEQ ID NO: 661540 - protein, 9 aa, Homo Sapiens
RALGAAALA

SEQ ID NO: 661541 - protein, 9 aa, Homo Sapiens
FPSPFCPEL

SEQ ID NO: 661542 - protein, 9 aa, Homo Sapiens
ELLIEEDDG

SEQ ID NO: 661543 - protein, 9 aa, Homo Sapiens
EQLHHWHGF

SEQ ID NO: 661544 - protein, 9 aa, Homo Sapiens
HVACDVLQL

SEQ ID NO: 661545 - protein, 9 aa, Homo Sapiens
GPAACLCTG

SEQ ID NO: 661546 - protein, 9 aa, Homo Sapiens
AGSQEPMGT

SEQ ID NO: 661547 - protein, 9 aa, Homo Sapiens
SGLGEGDSN

SEQ ID NO: 661548 - protein, 9 aa, Homo Sapiens
SSLLEIDLS

SEQ ID NO: 661549 - protein, 9 aa, Homo Sapiens
VRGDLCPGA

SEQ ID NO: 661550 - protein, 9 aa, Homo Sapiens
YRKAYRHGE

SEQ ID NO: 661551 - protein, 9 aa, Homo Sapiens
LDSSVEFME

SEQ ID NO: 661552 - protein, 9 aa, Homo Sapiens
ETSHCYCKR

SEQ ID NO: 661553 - protein, 9 aa, Homo Sapiens
ECLITDHYT

SEQ ID NO: 661554 - protein, 9 aa, Homo Sapiens
CCPELRRRE

SEQ ID NO: 661555 - protein, 9 aa, Homo Sapiens
YKYFDGIDS

SEQ ID NO: 661556 - protein, 9 aa, Homo Sapiens
EGRQPSYSS

SEQ ID NO: 661557 - protein, 9 aa, Homo Sapiens
MSCKQNQQQ

SEQ ID NO: 661558 - protein, 9 aa, Homo Sapiens
KSPYFYPLY

SEQ ID NO: 661559 - protein, 9 aa, Homo Sapiens
CQARNHKLR

SEQ ID NO: 661560 - protein, 9 aa, Homo Sapiens
SLEAQVAHG

SEQ ID NO: 661561 - protein, 9 aa, Homo Sapiens
TPLAVPTGL

SEQ ID NO: 661562 - protein, 9 aa, Homo Sapiens
GQASCVAPS

SEQ ID NO: 661563 - protein, 9 aa, Homo Sapiens
KIYRKEARK

SEQ ID NO: 661564 - protein, 9 aa, Homo Sapiens
SYPQQGWLG

SEQ ID NO: 661565 - protein, 9 aa, Homo Sapiens
LAHPCPLVK

SEQ ID NO: 661566 - protein, 9 aa, Homo Sapiens
KVGISYQPP

SEQ ID NO: 661567 - protein, 9 aa, Homo Sapiens
DYFMIRVRQ

SEQ ID NO: 661568 - protein, 9 aa, Homo Sapiens
SWVTIDPSC

SEQ ID NO: 661569 - protein, 9 aa, Homo Sapiens
ICGPPAGLL

SEQ ID NO: 661570 - protein, 9 aa, Homo Sapiens
GNRRNKRAA

SEQ ID NO: 661571 - protein, 9 aa, Homo Sapiens
RTGKGNRRN

SEQ ID NO: 661572 - protein, 9 aa, Homo Sapiens
HLVAVTPFH

SEQ ID NO: 661573 - protein, 9 aa, Homo Sapiens
QTARINRWL

SEQ ID NO: 661574 - protein, 9 aa, Homo Sapiens
MAVAGFLQL

SEQ ID NO: 661575 - protein, 9 aa, Homo Sapiens
LEHQMEENI

SEQ ID NO: 661576 - protein, 9 aa, Homo Sapiens
APGQPWGQQ

SEQ ID NO: 661577 - protein, 9 aa, Homo Sapiens
LHRSTIQLI

SEQ ID NO: 661578 - protein, 9 aa, Homo Sapiens
EHQMEENIV

SEQ ID NO: 661579 - protein, 9 aa, Homo Sapiens
RLPSICGPP

SEQ ID NO: 661580 - protein, 9 aa, Homo Sapiens
ARNSASAAE

SEQ ID NO: 661581 - protein, 9 aa, Homo Sapiens
NRWLISCCC

SEQ ID NO: 661582 - protein, 9 aa, Homo Sapiens
TCRLTVHFN

SEQ ID NO: 661583 - protein, 9 aa, Homo Sapiens
LSSEALSKV

SEQ ID NO: 661584 - protein, 9 aa, Homo Sapiens
LPAHTLQGE

SEQ ID NO: 661585 - protein, 9 aa, Homo Sapiens
NKIVAHVAC

SEQ ID NO: 661586 - protein, 9 aa, Homo Sapiens
RGWAPPVPS

SEQ ID NO: 661587 - protein, 9 aa, Homo Sapiens
IKTLEPLYQ

SEQ ID NO: 661588 - protein, 9 aa, Homo Sapiens
SPVPKIHRS

SEQ ID NO: 661589 - protein, 9 aa, Homo Sapiens
ARGFSRDMG

SEQ ID NO: 661590 - protein, 9 aa, Homo Sapiens
FPNKIVAHV

SEQ ID NO: 661591 - protein, 9 aa, Homo Sapiens
LIEYPELQI

SEQ ID NO: 661592 - protein, 9 aa, Homo Sapiens
HTPLERVSG

SEQ ID NO: 661593 - protein, 9 aa, Homo Sapiens
LLHLHLLKS

SEQ ID NO: 661594 - protein, 9 aa, Homo Sapiens
RSSFVTSTV

SEQ ID NO: 661595 - protein, 9 aa, Homo Sapiens
YRSLSYPQQ

SEQ ID NO: 661596 - protein, 9 aa, Homo Sapiens
HLANTAPAW

SEQ ID NO: 661597 - protein, 9 aa, Homo Sapiens
YPQQGWLGR

SEQ ID NO: 661598 - protein, 9 aa, Homo Sapiens
DGAPAAAGR

SEQ ID NO: 661599 - protein, 9 aa, Homo Sapiens
VLKENVMLL

SEQ ID NO: 661600 - protein, 9 aa, Homo Sapiens
HLEVIVEWP

SEQ ID NO: 661601 - protein, 9 aa, Homo Sapiens
MTAEQSANL

SEQ ID NO: 661602 - protein, 9 aa, Homo Sapiens
APASDGRSC

SEQ ID NO: 661603 - protein, 9 aa, Homo Sapiens
GLLGKPQLY

SEQ ID NO: 661604 - protein, 9 aa, Homo Sapiens
PSGGLPAMP

SEQ ID NO: 661605 - protein, 9 aa, Homo Sapiens
KHGLLGKPQ

SEQ ID NO: 661606 - protein, 9 aa, Homo Sapiens
SASAAEARS

SEQ ID NO: 661607 - protein, 9 aa, Homo Sapiens
GSRGQGPEP

SEQ ID NO: 661608 - protein, 9 aa, Homo Sapiens
FSGTEKKPH

SEQ ID NO: 661609 - protein, 9 aa, Homo Sapiens
PGQASCVAP

SEQ ID NO: 661610 - protein, 9 aa, Homo Sapiens
VCCGGYGAL

SEQ ID NO: 661611 - protein, 9 aa, Homo Sapiens
SSAPGQPWG

SEQ ID NO: 661612 - protein, 9 aa, Homo Sapiens
LLLPGPEAS

SEQ ID NO: 661613 - protein, 9 aa, Homo Sapiens
KIPVAIKTS

SEQ ID NO: 661614 - protein, 9 aa, Homo Sapiens
ARALGAAAL

SEQ ID NO: 661615 - protein, 9 aa, Homo Sapiens
ECVLVYMTA

SEQ ID NO: 661616 - protein, 9 aa, Homo Sapiens
CIPIHCGGI

SEQ ID NO: 661617 - protein, 9 aa, Homo Sapiens
TANFVDQVG

SEQ ID NO: 661618 - protein, 9 aa, Homo Sapiens
SRHCYGIQD

SEQ ID NO: 661619 - protein, 9 aa, Homo Sapiens
SDTSNMDLN

SEQ ID NO: 661620 - protein, 9 aa, Homo Sapiens
PWYVRMVCQ

SEQ ID NO: 661621 - protein, 9 aa, Homo Sapiens
YHLSVFATF

SEQ ID NO: 661622 - protein, 9 aa, Homo Sapiens
THLPHTILC

SEQ ID NO: 661623 - protein, 9 aa, Homo Sapiens
EHEIADLMD

SEQ ID NO: 661624 - protein, 9 aa, Homo Sapiens
DSCSVPEKE

SEQ ID NO: 661625 - protein, 9 aa, Homo Sapiens
GNPCDSETS

SEQ ID NO: 661626 - protein, 9 aa, Homo Sapiens
VAVTGKASS

SEQ ID NO: 661627 - protein, 9 aa, Homo Sapiens
MKLEDVNPR

SEQ ID NO: 661628 - protein, 9 aa, Homo Sapiens
KDMEVYLQK

SEQ ID NO: 661629 - protein, 9 aa, Homo Sapiens
MAARRRGGD

SEQ ID NO: 661630 - protein, 9 aa, Homo Sapiens
VQVDSMGGP

SEQ ID NO: 661631 - protein, 9 aa, Homo Sapiens
RRMRHLANT

SEQ ID NO: 661632 - protein, 9 aa, Homo Sapiens
AHVACDVLQ

SEQ ID NO: 661633 - protein, 9 aa, Homo Sapiens
CKFPHKEMI

SEQ ID NO: 661634 - protein, 9 aa, Homo Sapiens
VDQVGFNDE

SEQ ID NO: 661635 - protein, 9 aa, Homo Sapiens
RGGDGAPAA

SEQ ID NO: 661636 - protein, 9 aa, Homo Sapiens
SQPVANISD

SEQ ID NO: 661637 - protein, 9 aa, Homo Sapiens
DLCPGALAR

SEQ ID NO: 661638 - protein, 9 aa, Homo Sapiens
SQQEQSDCP

SEQ ID NO: 661639 - protein, 9 aa, Homo Sapiens
VIVEWPLQV

SEQ ID NO: 661640 - protein, 9 aa, Homo Sapiens
NVMLLSQKA

SEQ ID NO: 661641 - protein, 9 aa, Homo Sapiens
LKENVMLLS

SEQ ID NO: 661642 - protein, 9 aa, Homo Sapiens
AAGSRGQGP

SEQ ID NO: 661643 - protein, 9 aa, Homo Sapiens
VAHGDQQLR

SEQ ID NO: 661644 - protein, 9 aa, Homo Sapiens
ECVQVDSMG

SEQ ID NO: 661645 - protein, 9 aa, Homo Sapiens
PSPCVNGGS

SEQ ID NO: 661646 - protein, 9 aa, Homo Sapiens
LSNSQWQTA

SEQ ID NO: 661647 - protein, 9 aa, Homo Sapiens
TLPLHRSTI

SEQ ID NO: 661648 - protein, 9 aa, Homo Sapiens
SIGARALGA

SEQ ID NO: 661649 - protein, 9 aa, Homo Sapiens
PVPSPSSGA

SEQ ID NO: 661650 - protein, 9 aa, Homo Sapiens
LMENRVQSC

SEQ ID NO: 661651 - protein, 9 aa, Homo Sapiens
CPSMKGTHL

SEQ ID NO: 661652 - protein, 9 aa, Homo Sapiens
YGIQDIKNH

SEQ ID NO: 661653 - protein, 9 aa, Homo Sapiens
TGKASSAIA

SEQ ID NO: 661654 - protein, 9 aa, Homo Sapiens
VGAPGSPSM

SEQ ID NO: 661655 - protein, 9 aa, Homo Sapiens
LCQARNHKL

SEQ ID NO: 661656 - protein, 9 aa, Homo Sapiens
QNNQEETST

SEQ ID NO: 661657 - protein, 9 aa, Homo Sapiens
PVAPTSRAF

SEQ ID NO: 661658 - protein, 9 aa, Homo Sapiens
NMKLEDVNP

SEQ ID NO: 661659 - protein, 9 aa, Homo Sapiens
MEIWRKYDA

SEQ ID NO: 661660 - protein, 9 aa, Homo Sapiens
PASDGRSCL

SEQ ID NO: 661661 - protein, 9 aa, Homo Sapiens
QGYAPASDG

SEQ ID NO: 661662 - protein, 9 aa, Homo Sapiens
GPPAGLLHL

SEQ ID NO: 661663 - protein, 9 aa, Homo Sapiens
SEVAVTGKA

SEQ ID NO: 661664 - protein, 9 aa, Homo Sapiens
TRHRVSYRK

SEQ ID NO: 661665 - protein, 9 aa, Homo Sapiens
PNQNNQEET

SEQ ID NO: 661666 - protein, 9 aa, Homo Sapiens
PAFLPRKEN

SEQ ID NO: 661667 - protein, 9 aa, Homo Sapiens
KSKRVGKEK

SEQ ID NO: 661668 - protein, 9 aa, Homo Sapiens
PNKIVAHVA

SEQ ID NO: 661669 - protein, 9 aa, Homo Sapiens
ISPLDKLLA

SEQ ID NO: 661670 - protein, 9 aa, Homo Sapiens
IPIHCGGIQ

SEQ ID NO: 661671 - protein, 9 aa, Homo Sapiens
DDGVQRLCE

SEQ ID NO: 661672 - protein, 9 aa, Homo Sapiens
LEIDLSYNQ

SEQ ID NO: 661673 - protein, 9 aa, Homo Sapiens
GQTGHGQST

SEQ ID NO: 661674 - protein, 9 aa, Homo Sapiens
PVCCGGYGA

SEQ ID NO: 661675 - protein, 9 aa, Homo Sapiens
LPSICGPPA

SEQ ID NO: 661676 - protein, 9 aa, Homo Sapiens
HLPHTILCL

SEQ ID NO: 661677 - protein, 9 aa, Homo Sapiens
QICHQILLL

SEQ ID NO: 661678 - protein, 9 aa, Homo Sapiens
TEGSWRWTH

SEQ ID NO: 661679 - protein, 9 aa, Homo Sapiens
LFSGTEKKP

SEQ ID NO: 661680 - protein, 9 aa, Homo Sapiens
FDGIDSHML

SEQ ID NO: 661681 - protein, 9 aa, Homo Sapiens
TPLERVSGV

SEQ ID NO: 661682 - protein, 9 aa, Homo Sapiens
AVAGFLQLD

SEQ ID NO: 661683 - protein, 9 aa, Homo Sapiens
EPMGTFPVP

SEQ ID NO: 661684 - protein, 9 aa, Homo Sapiens
RREGRQPSY

SEQ ID NO: 661685 - protein, 9 aa, Homo Sapiens
RKAYRHGEK

SEQ ID NO: 661686 - protein, 9 aa, Homo Sapiens
SPSRHCYGI

SEQ ID NO: 661687 - protein, 9 aa, Homo Sapiens
TILCQARNH

SEQ ID NO: 661688 - protein, 9 aa, Homo Sapiens
HEIADLMDL

SEQ ID NO: 661689 - protein, 9 aa, Homo Sapiens
HCYGIQDIK

SEQ ID NO: 661690 - protein, 9 aa, Homo Sapiens
DGYLYEHEI

SEQ ID NO: 661691 - protein, 9 aa, Homo Sapiens
MGMWSIGAR

SEQ ID NO: 661692 - protein, 9 aa, Homo Sapiens
LPECVQVDS

SEQ ID NO: 661693 - protein, 9 aa, Homo Sapiens
IGARALGAA

SEQ ID NO: 661694 - protein, 9 aa, Homo Sapiens
RRNTILCQA

SEQ ID NO: 661695 - protein, 9 aa, Homo Sapiens
ALRLPSICG

SEQ ID NO: 661696 - protein, 9 aa, Homo Sapiens
NLLDDGVQR

SEQ ID NO: 661697 - protein, 9 aa, Homo Sapiens
QLDEQLHHW

SEQ ID NO: 661698 - protein, 9 aa, Homo Sapiens
MQKIATTCR

SEQ ID NO: 661699 - protein, 9 aa, Homo Sapiens
YFYPLYGLG

SEQ ID NO: 661700 - protein, 9 aa, Homo Sapiens
LVAVTPFHP

SEQ ID NO: 661701 - protein, 9 aa, Homo Sapiens
KPGQEATVL

SEQ ID NO: 661702 - protein, 9 aa, Homo Sapiens
RYSWPSVKS

SEQ ID NO: 661703 - protein, 9 aa, Homo Sapiens
VIVYHLSVF

SEQ ID NO: 661704 - protein, 9 aa, Homo Sapiens
RNSASAAEA

SEQ ID NO: 661705 - protein, 9 aa, Homo Sapiens
APAAAGREH

SEQ ID NO: 661706 - protein, 9 aa, Homo Sapiens
KFPHKEMIS

SEQ ID NO: 661707 - protein, 9 aa, Homo Sapiens
QVQRDPRRM

SEQ ID NO: 661708 - protein, 9 aa, Homo Sapiens
YPELQINGF

SEQ ID NO: 661709 - protein, 9 aa, Homo Sapiens
RHCYGIQDI

SEQ ID NO: 661710 - protein, 9 aa, Homo Sapiens
GSPVPKIHR

SEQ ID NO: 661711 - protein, 9 aa, Homo Sapiens
NLSPDLSHM

SEQ ID NO: 661712 - protein, 9 aa, Homo Sapiens
AFPSPFCPE

SEQ ID NO: 661713 - protein, 9 aa, Homo Sapiens
VNGGSCRQT

SEQ ID NO: 661714 - protein, 9 aa, Homo Sapiens
AYKYFDGID

SEQ ID NO: 661715 - protein, 9 aa, Homo Sapiens
KNLTGLFSG

SEQ ID NO: 661716 - protein, 9 aa, Homo Sapiens
SMKGTHLPH

SEQ ID NO: 661717 - protein, 9 aa, Homo Sapiens
LLIEEDDGT

SEQ ID NO: 661718 - protein, 9 aa, Homo Sapiens
ARINRWLIS

SEQ ID NO: 661719 - protein, 9 aa, Homo Sapiens
SARNSASAA

SEQ ID NO: 661720 - protein, 9 aa, Homo Sapiens
AIKTSPKAN

SEQ ID NO: 661721 - protein, 9 aa, Homo Sapiens
SNRRRVSPY

SEQ ID NO: 661722 - protein, 9 aa, Homo Sapiens
QPYNKTHRY

SEQ ID NO: 661723 - protein, 9 aa, Homo Sapiens
ISCCCIPIH

SEQ ID NO: 661724 - protein, 9 aa, Homo Sapiens
NNNYYEAPN

SEQ ID NO: 661725 - protein, 9 aa, Homo Sapiens
SSEALSKVS

SEQ ID NO: 661726 - protein, 9 aa, Homo Sapiens
LIEQICHQI

SEQ ID NO: 661727 - protein, 9 aa, Homo Sapiens
ANFVDQVGF

SEQ ID NO: 661728 - protein, 9 aa, Homo Sapiens
PTRGWAPPV

SEQ ID NO: 661729 - protein, 9 aa, Homo Sapiens
PGPEASQLR

SEQ ID NO: 661730 - protein, 9 aa, Homo Sapiens
PKYNDSCSV

SEQ ID NO: 661731 - protein, 9 aa, Homo Sapiens
KQKKTESSA

SEQ ID NO: 661732 - protein, 9 aa, Homo Sapiens
VQSCYQQEL

SEQ ID NO: 661733 - protein, 9 aa, Homo Sapiens
PYFYPLYGL

SEQ ID NO: 661734 - protein, 9 aa, Homo Sapiens
KGLGVHGSF

SEQ ID NO: 661735 - protein, 9 aa, Homo Sapiens
PHKEMISSP

SEQ ID NO: 661736 - protein, 9 aa, Homo Sapiens
SNDNDVYRA

SEQ ID NO: 661737 - protein, 9 aa, Homo Sapiens
ANTVEPDGS

SEQ ID NO: 661738 - protein, 9 aa, Homo Sapiens
FGQMFLIHC

SEQ ID NO: 661739 - protein, 9 aa, Homo Sapiens
GKGNRRNKR

SEQ ID NO: 661740 - protein, 9 aa, Homo Sapiens
LLEIDLSYN

SEQ ID NO: 661741 - protein, 9 aa, Homo Sapiens
HRVSYRKAY

SEQ ID NO: 661742 - protein, 9 aa, Homo Sapiens
RATCVGILR

SEQ ID NO: 661743 - protein, 9 aa, Homo Sapiens
TKNMKLEDV

SEQ ID NO: 661744 - protein, 9 aa, Homo Sapiens
TRHHGLVEQ

SEQ ID NO: 661745 - protein, 9 aa, Homo Sapiens
HSNDNDVYR

SEQ ID NO: 661746 - protein, 9 aa, Homo Sapiens
ADGASSFAV

SEQ ID NO: 661747 - protein, 9 aa, Homo Sapiens
PECVQVDSM

SEQ ID NO: 661748 - protein, 9 aa, Homo Sapiens
KTSPKANKE

SEQ ID NO: 661749 - protein, 9 aa, Homo Sapiens
SGRLSSLCF

SEQ ID NO: 661750 - protein, 9 aa, Homo Sapiens
LSLGAQSNT

SEQ ID NO: 661751 - protein, 9 aa, Homo Sapiens
HGPLLDSKH

SEQ ID NO: 661752 - protein, 9 aa, Homo Sapiens
HYNNFFFCR

SEQ ID NO: 661753 - protein, 9 aa, Homo Sapiens
DACFGQMFL

SEQ ID NO: 661754 - protein, 9 aa, Homo Sapiens
FNSSSLLEI

SEQ ID NO: 661755 - protein, 9 aa, Homo Sapiens
FFLGCPSGR

SEQ ID NO: 661756 - protein, 9 aa, Homo Sapiens
NRRNKRAAG

SEQ ID NO: 661757 - protein, 9 aa, Homo Sapiens
RRRTVDAAG

SEQ ID NO: 661758 - protein, 9 aa, Homo Sapiens
EVIVEWPLQ

SEQ ID NO: 661759 - protein, 9 aa, Homo Sapiens
PEVLQDSQD

SEQ ID NO: 661760 - protein, 9 aa, Homo Sapiens
MKGTHLPHT

SEQ ID NO: 661761 - protein, 9 aa, Homo Sapiens
QRLCEALRH

SEQ ID NO: 661762 - protein, 9 aa, Homo Sapiens
PPQKLKLAV

SEQ ID NO: 661763 - protein, 9 aa, Homo Sapiens
FLEGLCMIM

SEQ ID NO: 661764 - protein, 9 aa, Homo Sapiens
LISVRVFYK

SEQ ID NO: 661765 - protein, 9 aa, Homo Sapiens
APCEGLNNY

SEQ ID NO: 661766 - protein, 9 aa, Homo Sapiens
TVAADGASS

SEQ ID NO: 661767 - protein, 9 aa, Homo Sapiens
LSQKAGSPP

SEQ ID NO: 661768 - protein, 9 aa, Homo Sapiens
DQFIFREII

SEQ ID NO: 661769 - protein, 9 aa, Homo Sapiens
TVEPDGSND

SEQ ID NO: 661770 - protein, 9 aa, Homo Sapiens
GYLYEHEIA

SEQ ID NO: 661771 - protein, 9 aa, Homo Sapiens
APSFLEGLC

SEQ ID NO: 661772 - protein, 9 aa, Homo Sapiens
KHNQELQDL

SEQ ID NO: 661773 - protein, 9 aa, Homo Sapiens
QDIKNHLVL

SEQ ID NO: 661774 - protein, 9 aa, Homo Sapiens
LLLPAHTLQ

SEQ ID NO: 661775 - protein, 9 aa, Homo Sapiens
SLGAQSNTS

SEQ ID NO: 661776 - protein, 9 aa, Homo Sapiens
YMTAEQSAN

SEQ ID NO: 661777 - protein, 9 aa, Homo Sapiens
QEATVLPKD

SEQ ID NO: 661778 - protein, 9 aa, Homo Sapiens
EYPELQING

SEQ ID NO: 661779 - protein, 9 aa, Homo Sapiens
SKHNQELQD

SEQ ID NO: 661780 - protein, 9 aa, Homo Sapiens
RRTVDAAGS

SEQ ID NO: 661781 - protein, 9 aa, Homo Sapiens
LELEHQMEE

SEQ ID NO: 661782 - protein, 9 aa, Homo Sapiens
CCCIPIHCG

SEQ ID NO: 661783 - protein, 9 aa, Homo Sapiens
SEDGYLYEH

SEQ ID NO: 661784 - protein, 9 aa, Homo Sapiens
LELLIEEDD

SEQ ID NO: 661785 - protein, 9 aa, Homo Sapiens
KPQLYLTVN

SEQ ID NO: 661786 - protein, 9 aa, Homo Sapiens
NTILCQARN

SEQ ID NO: 661787 - protein, 9 aa, Homo Sapiens
VAADGASSF

SEQ ID NO: 661788 - protein, 9 aa, Homo Sapiens
KFPNKIVAH

SEQ ID NO: 661789 - protein, 9 aa, Homo Sapiens
QPVANISDV

SEQ ID NO: 661790 - protein, 9 aa, Homo Sapiens
IQDIKNHLV

SEQ ID NO: 661791 - protein, 9 aa, Homo Sapiens
YYEAPNCPR

SEQ ID NO: 661792 - protein, 9 aa, Homo Sapiens
ALSKVSLTN

SEQ ID NO: 661793 - protein, 9 aa, Homo Sapiens
IMKRPDFSE

SEQ ID NO: 661794 - protein, 9 aa, Homo Sapiens
SCYQQELEM

SEQ ID NO: 661795 - protein, 9 aa, Homo Sapiens
RAKSKRVGK

SEQ ID NO: 661796 - protein, 9 aa, Homo Sapiens
QLQLIEQIC

SEQ ID NO: 661797 - protein, 9 aa, Homo Sapiens
DMEVYLQKL

SEQ ID NO: 661798 - protein, 9 aa, Homo Sapiens
VPSPSSGAL

SEQ ID NO: 661799 - protein, 9 aa, Homo Sapiens
KGTHLPHTI

SEQ ID NO: 661800 - protein, 9 aa, Homo Sapiens
GPEASQLRY

SEQ ID NO: 661801 - protein, 9 aa, Homo Sapiens
EQICHQILL

SEQ ID NO: 661802 - protein, 9 aa, Homo Sapiens
MLLSQKAGS

SEQ ID NO: 661803 - protein, 9 aa, Homo Sapiens
VTGKASSAI

SEQ ID NO: 661804 - protein, 9 aa, Homo Sapiens
GLDACFGQM

SEQ ID NO: 661805 - protein, 9 aa, Homo Sapiens
LDKLLAIFY

SEQ ID NO: 661806 - protein, 9 aa, Homo Sapiens
RHHGLVEQV

SEQ ID NO: 661807 - protein, 9 aa, Homo Sapiens
GLLHLHLLK

SEQ ID NO: 661808 - protein, 9 aa, Homo Sapiens
QLHHWHGFP

SEQ ID NO: 661809 - protein, 9 aa, Homo Sapiens
TCVGILRTT

SEQ ID NO: 661810 - protein, 9 aa, Homo Sapiens
PYNKTHRYV

SEQ ID NO: 661811 - protein, 9 aa, Homo Sapiens
DIGACIALI

SEQ ID NO: 661812 - protein, 9 aa, Homo Sapiens
TRHGQTGHG

SEQ ID NO: 661813 - protein, 9 aa, Homo Sapiens
PGQPWGQQE

SEQ ID NO: 661814 - protein, 9 aa, Homo Sapiens
SIMKRPDFS

SEQ ID NO: 661815 - protein, 9 aa, Homo Sapiens
AGDFGYIFV

SEQ ID NO: 661816 - protein, 9 aa, Homo Sapiens
VSWVTIDPS

SEQ ID NO: 661817 - protein, 9 aa, Homo Sapiens
SPIHTIAHL

SEQ ID NO: 661818 - protein, 9 aa, Homo Sapiens
VEQVQRDPR

SEQ ID NO: 661819 - protein, 9 aa, Homo Sapiens
EGLCMIMND

SEQ ID NO: 661820 - protein, 9 aa, Homo Sapiens
SDGRSCLDV

SEQ ID NO: 661821 - protein, 9 aa, Homo Sapiens
FSEMKMKGL

SEQ ID NO: 661822 - protein, 9 aa, Homo Sapiens
HHGLVEQVQ

SEQ ID NO: 661823 - protein, 9 aa, Homo Sapiens
HAPCEGLNN

SEQ ID NO: 661824 - protein, 9 aa, Homo Sapiens
EAPNCPRAS

SEQ ID NO: 661825 - protein, 9 aa, Homo Sapiens
LLELLIEED

SEQ ID NO: 661826 - protein, 9 aa, Homo Sapiens
QKKTESSAP

SEQ ID NO: 661827 - protein, 9 aa, Homo Sapiens
LSSTLPLHR

SEQ ID NO: 661828 - protein, 9 aa, Homo Sapiens
TARINRWLI

SEQ ID NO: 661829 - protein, 9 aa, Homo Sapiens
MPLLFHPHT

SEQ ID NO: 661830 - protein, 9 aa, Homo Sapiens
YEHEIADLM

SEQ ID NO: 661831 - protein, 9 aa, Homo Sapiens
IHLEVIVEW

SEQ ID NO: 661832 - protein, 9 aa, Homo Sapiens
AGLLHLHLL

SEQ ID NO: 661833 - protein, 9 aa, Homo Sapiens
SSARNSASA

SEQ ID NO: 661834 - protein, 9 aa, Homo Sapiens
VPKIHRSSF

SEQ ID NO: 661835 - protein, 9 aa, Homo Sapiens
PGPGQASCV

SEQ ID NO: 661836 - protein, 9 aa, Homo Sapiens
PQNKNAVLV

SEQ ID NO: 661837 - protein, 9 aa, Homo Sapiens
RLVLGTGTD

SEQ ID NO: 661838 - protein, 9 aa, Homo Sapiens
EKPGQEATV

SEQ ID NO: 661839 - protein, 9 aa, Homo Sapiens
GAQSNTSAL

SEQ ID NO: 661840 - protein, 9 aa, Homo Sapiens
PIHTIAHLF

SEQ ID NO: 661841 - protein, 9 aa, Homo Sapiens
VVFRVKIYR

SEQ ID NO: 661842 - protein, 9 aa, Homo Sapiens
LITDHYTGG

SEQ ID NO: 661843 - protein, 9 aa, Homo Sapiens
SPYFYPLYG

SEQ ID NO: 661844 - protein, 9 aa, Homo Sapiens
CKQNQQQCQ

SEQ ID NO: 661845 - protein, 9 aa, Homo Sapiens
DGVQRLCEA

SEQ ID NO: 661846 - protein, 9 aa, Homo Sapiens
GTFPVPYDL

SEQ ID NO: 661847 - protein, 9 aa, Homo Sapiens
NDSCSVPEK

SEQ ID NO: 661848 - protein, 9 aa, Homo Sapiens
CLCTGLSSP

SEQ ID NO: 661849 - protein, 9 aa, Homo Sapiens
SGVFGNHTP

SEQ ID NO: 661850 - protein, 9 aa, Homo Sapiens
CGPPAGLLH

SEQ ID NO: 661851 - protein, 9 aa, Homo Sapiens
VMLLSQKAG

SEQ ID NO: 661852 - protein, 9 aa, Homo Sapiens
TKNLTGLFS

SEQ ID NO: 661853 - protein, 9 aa, Homo Sapiens
SVKSQQEQS

SEQ ID NO: 661854 - protein, 9 aa, Homo Sapiens
LCMIMNDRL

SEQ ID NO: 661855 - protein, 9 aa, Homo Sapiens
GDSNRRRVS

SEQ ID NO: 661856 - protein, 9 aa, Homo Sapiens
VGFNDEEFA

SEQ ID NO: 661857 - protein, 9 aa, Homo Sapiens
TTDATGFKR

SEQ ID NO: 661858 - protein, 9 aa, Homo Sapiens
LDSKHNQEL

SEQ ID NO: 661859 - protein, 9 aa, Homo Sapiens
SIPSDTSNM

SEQ ID NO: 661860 - protein, 9 aa, Homo Sapiens
PGISIPSDT

SEQ ID NO: 661861 - protein, 9 aa, Homo Sapiens
LEVIVEWPL

SEQ ID NO: 661862 - protein, 9 aa, Homo Sapiens
ATVLPKDGA

SEQ ID NO: 661863 - protein, 9 aa, Homo Sapiens
QKQKKTESS

SEQ ID NO: 661864 - protein, 9 aa, Homo Sapiens
LVYMTAEQS

SEQ ID NO: 661865 - protein, 9 aa, Homo Sapiens
FSGYNKWSQ

SEQ ID NO: 661866 - protein, 9 aa, Homo Sapiens
LGVHGSFLA

SEQ ID NO: 661867 - protein, 9 aa, Homo Sapiens
YNFYRYNFS

SEQ ID NO: 661868 - protein, 9 aa, Homo Sapiens
QSHCNTSTL

SEQ ID NO: 661869 - protein, 9 aa, Homo Sapiens
APGSPSMPP

SEQ ID NO: 661870 - protein, 9 aa, Homo Sapiens
LWYRSLSYP

SEQ ID NO: 661871 - protein, 9 aa, Homo Sapiens
TAEQSANLL

SEQ ID NO: 661872 - protein, 9 aa, Homo Sapiens
GKASSAIAA

SEQ ID NO: 661873 - protein, 9 aa, Homo Sapiens
STTWHSNDN

SEQ ID NO: 661874 - protein, 9 aa, Homo Sapiens
IVEWPLQVF

SEQ ID NO: 661875 - protein, 9 aa, Homo Sapiens
SPDLSHMTL

SEQ ID NO: 661876 - protein, 9 aa, Homo Sapiens
YSEAGDFGY

SEQ ID NO: 661877 - protein, 9 aa, Homo Sapiens
FNVECLITD

SEQ ID NO: 661878 - protein, 9 aa, Homo Sapiens
EPEQSHCNT

SEQ ID NO: 661879 - protein, 9 aa, Homo Sapiens
KREKDMEVY

SEQ ID NO: 661880 - protein, 9 aa, Homo Sapiens
GKESKGSPA

SEQ ID NO: 661881 - protein, 9 aa, Homo Sapiens
VRMVCQWTQ

SEQ ID NO: 661882 - protein, 9 aa, Homo Sapiens
LVEKREKDM

SEQ ID NO: 661883 - protein, 9 aa, Homo Sapiens
CVLVYMTAE

SEQ ID NO: 661884 - protein, 9 aa, Homo Sapiens
IYRKEARKR

SEQ ID NO: 661885 - protein, 9 aa, Homo Sapiens
LQPYNKTHR

SEQ ID NO: 661886 - protein, 9 aa, Homo Sapiens
VFGNHTPLE

SEQ ID NO: 661887 - protein, 9 aa, Homo Sapiens
GVQRLCEAL

SEQ ID NO: 661888 - protein, 9 aa, Homo Sapiens
QWQTARINR

SEQ ID NO: 661889 - protein, 9 aa, Homo Sapiens
VLVPWEYSF

SEQ ID NO: 661890 - protein, 9 aa, Homo Sapiens
NSQWQTARI

SEQ ID NO: 661891 - protein, 9 aa, Homo Sapiens
TLLKGLGVH

SEQ ID NO: 661892 - protein, 9 aa, Homo Sapiens
GLLLAALCF

SEQ ID NO: 661893 - protein, 9 aa, Homo Sapiens
GKAGTVGPK

SEQ ID NO: 661894 - protein, 9 aa, Homo Sapiens
TTEPEQSHC

SEQ ID NO: 661895 - protein, 9 aa, Homo Sapiens
KQRAKSKRV

SEQ ID NO: 661896 - protein, 9 aa, Homo Sapiens
NVGISVATL

SEQ ID NO: 661897 - protein, 9 aa, Homo Sapiens
NCPRASYGR

SEQ ID NO: 661898 - protein, 9 aa, Homo Sapiens
GYAPASDGR

SEQ ID NO: 661899 - protein, 9 aa, Homo Sapiens
QTGHGQSTQ

SEQ ID NO: 661900 - protein, 9 aa, Homo Sapiens
CGGIQFFPK

SEQ ID NO: 661901 - protein, 9 aa, Homo Sapiens
KQNQQQCQP

SEQ ID NO: 661902 - protein, 9 aa, Homo Sapiens
TAESDQGQG

SEQ ID NO: 661903 - protein, 9 aa, Homo Sapiens
TLTGTPPNL

SEQ ID NO: 661904 - protein, 9 aa, Homo Sapiens
VAVTPFHPS

SEQ ID NO: 661905 - protein, 9 aa, Homo Sapiens
HPLHLVAVT

SEQ ID NO: 661906 - protein, 9 aa, Homo Sapiens
KNHRATCVG

SEQ ID NO: 661907 - protein, 9 aa, Homo Sapiens
LLGKPQLYL

SEQ ID NO: 661908 - protein, 9 aa, Homo Sapiens
CDIGLDACF

SEQ ID NO: 661909 - protein, 9 aa, Homo Sapiens
SYQPPTVVP

SEQ ID NO: 661910 - protein, 9 aa, Homo Sapiens
GGIQFFPKI

SEQ ID NO: 661911 - protein, 9 aa, Homo Sapiens
ETAYKYFDG

SEQ ID NO: 661912 - protein, 9 aa, Homo Sapiens
TKVAIKTLE

SEQ ID NO: 661913 - protein, 9 aa, Homo Sapiens
PLHLVAVTP

SEQ ID NO: 661914 - protein, 9 aa, Homo Sapiens
VCSIMKRPD

SEQ ID NO: 661915 - protein, 9 aa, Homo Sapiens
ESSAPGQPW

SEQ ID NO: 661916 - protein, 9 aa, Homo Sapiens
RWTHGTPFN

SEQ ID NO: 661917 - protein, 9 aa, Homo Sapiens
ACLCTGLSS

SEQ ID NO: 661918 - protein, 9 aa, Homo Sapiens
AETLLKGLG

SEQ ID NO: 661919 - protein, 9 aa, Homo Sapiens
TAYEVRVFL

SEQ ID NO: 661920 - protein, 9 aa, Homo Sapiens
NTVEPDGSN

SEQ ID NO: 661921 - protein, 9 aa, Homo Sapiens
KNHLVLSNS

SEQ ID NO: 661922 - protein, 9 aa, Homo Sapiens
REPPQKLKL

SEQ ID NO: 661923 - protein, 9 aa, Homo Sapiens
IDPSCEVGM

SEQ ID NO: 661924 - protein, 9 aa, Homo Sapiens
AGGEENKGA

SEQ ID NO: 661925 - protein, 9 aa, Homo Sapiens
PQLYLTVNP

SEQ ID NO: 661926 - protein, 9 aa, Homo Sapiens
GSCRQTGDF

SEQ ID NO: 661927 - protein, 9 aa, Homo Sapiens
IQFFPKILQ

SEQ ID NO: 661928 - protein, 9 aa, Homo Sapiens
THGTPFNAA

SEQ ID NO: 661929 - protein, 9 aa, Homo Sapiens
SEALSKVSL

SEQ ID NO: 661930 - protein, 9 aa, Homo Sapiens
GYNKWSQPV

SEQ ID NO: 661931 - protein, 9 aa, Homo Sapiens
AARRRGGDG

SEQ ID NO: 661932 - protein, 9 aa, Homo Sapiens
IAKMDATAY

SEQ ID NO: 661933 - protein, 9 aa, Homo Sapiens
AGAGGEENK

SEQ ID NO: 661934 - protein, 9 aa, Homo Sapiens
HGFPVCCGG

SEQ ID NO: 661935 - protein, 9 aa, Homo Sapiens
RYGKSPYFY

SEQ ID NO: 661936 - protein, 9 aa, Homo Sapiens
FQCKFPHKE

SEQ ID NO: 661937 - protein, 9 aa, Homo Sapiens
GSPSMPPTR

SEQ ID NO: 661938 - protein, 9 aa, Homo Sapiens
AQGYAPASD

SEQ ID NO: 661939 - protein, 9 aa, Homo Sapiens
IALHSPIHT

SEQ ID NO: 661940 - protein, 9 aa, Homo Sapiens
HGDQQLRDL

SEQ ID NO: 661941 - protein, 9 aa, Homo Sapiens
NRREGRQPS

SEQ ID NO: 661942 - protein, 9 aa, Homo Sapiens
WPSVKSQQE

SEQ ID NO: 661943 - protein, 9 aa, Homo Sapiens
AKMDATAYE

SEQ ID NO: 661944 - protein, 9 aa, Homo Sapiens
SPAFLPRKE

SEQ ID NO: 661945 - protein, 9 aa, Homo Sapiens
VGISYQPPT

SEQ ID NO: 661946 - protein, 9 aa, Homo Sapiens
GAPGKAGTV

SEQ ID NO: 661947 - protein, 9 aa, Homo Sapiens
DLSHMTLSP

SEQ ID NO: 661948 - protein, 9 aa, Homo Sapiens
HPCPLVKSE

SEQ ID NO: 661949 - protein, 9 aa, Homo Sapiens
PGRLVLGTG

SEQ ID NO: 661950 - protein, 9 aa, Homo Sapiens
RHRVSYRKA

SEQ ID NO: 661951 - protein, 9 aa, Homo Sapiens
AGFLQLDEQ

SEQ ID NO: 661952 - protein, 9 aa, Homo Sapiens
HNQELQDLK

SEQ ID NO: 661953 - protein, 9 aa, Homo Sapiens
RAFPSPFCP

SEQ ID NO: 661954 - protein, 9 aa, Homo Sapiens
LLAHPCPLV

SEQ ID NO: 661955 - protein, 9 aa, Homo Sapiens
DIGLDACFG

SEQ ID NO: 661956 - protein, 9 aa, Homo Sapiens
PNCPRASYG

SEQ ID NO: 661957 - protein, 9 aa, Homo Sapiens
PGCGPGRLV

SEQ ID NO: 661958 - protein, 9 aa, Homo Sapiens
AGGTPLAVP

SEQ ID NO: 661959 - protein, 9 aa, Homo Sapiens
LAAGGGGLL

SEQ ID NO: 661960 - protein, 9 aa, Homo Sapiens
QALLELLIE

SEQ ID NO: 661961 - protein, 9 aa, Homo Sapiens
CLITDHYTG

SEQ ID NO: 661962 - protein, 9 aa, Homo Sapiens
AADGASSFA

SEQ ID NO: 661963 - protein, 9 aa, Homo Sapiens
RVKIYRKEA

SEQ ID NO: 661964 - protein, 9 aa, Homo Sapiens
CNTSTLTER

SEQ ID NO: 661965 - protein, 9 aa, Homo Sapiens
KMKGLENQM

SEQ ID NO: 661966 - protein, 9 aa, Homo Sapiens
FMEIWRKYD

SEQ ID NO: 661967 - protein, 9 aa, Homo Sapiens
YSTTDATGF

SEQ ID NO: 661968 - protein, 9 aa, Homo Sapiens
CYQQELEMV

SEQ ID NO: 661969 - protein, 9 aa, Homo Sapiens
NKRAAGRGA

SEQ ID NO: 661970 - protein, 9 aa, Homo Sapiens
AIKTLEPLY

SEQ ID NO: 661971 - protein, 9 aa, Homo Sapiens
RHAPCEGLN

SEQ ID NO: 661972 - protein, 9 aa, Homo Sapiens
EARGFSRDM

SEQ ID NO: 661973 - protein, 9 aa, Homo Sapiens
GPLLDSKHN

SEQ ID NO: 661974 - protein, 9 aa, Homo Sapiens
SGYNKWSQP

SEQ ID NO: 661975 - protein, 9 aa, Homo Sapiens
PAGLLHLHL

SEQ ID NO: 661976 - protein, 9 aa, Homo Sapiens
FLLELEHQM

SEQ ID NO: 661977 - protein, 9 aa, Homo Sapiens
GTPPNLVLQ

SEQ ID NO: 661978 - protein, 9 aa, Homo Sapiens
CMIMNDRLT

SEQ ID NO: 661979 - protein, 9 aa, Homo Sapiens
YKCEECDKT

SEQ ID NO: 661980 - protein, 9 aa, Homo Sapiens
FPVCCGGYG

SEQ ID NO: 661981 - protein, 9 aa, Homo Sapiens
LAVPTGLLS

SEQ ID NO: 661982 - protein, 9 aa, Homo Sapiens
SNTSALILE

SEQ ID NO: 661983 - protein, 9 aa, Homo Sapiens
KIHRSSFVT

SEQ ID NO: 661984 - protein, 9 aa, Homo Sapiens
MKNHRATCV

SEQ ID NO: 661985 - protein, 9 aa, Homo Sapiens
TIDPSCEVG

SEQ ID NO: 661986 - protein, 9 aa, Homo Sapiens
NSSSLLEID

SEQ ID NO: 661987 - protein, 9 aa, Homo Sapiens
GIATLTGTP

SEQ ID NO: 661988 - protein, 9 aa, Homo Sapiens
GSQEPMGTF

SEQ ID NO: 661989 - protein, 9 aa, Homo Sapiens
PVPKIHRSS

SEQ ID NO: 661990 - protein, 9 aa, Homo Sapiens
YFDGIDSHM

SEQ ID NO: 661991 - protein, 9 aa, Homo Sapiens
DSSVEFMEI

SEQ ID NO: 661992 - protein, 9 aa, Homo Sapiens
FGYIFVTGR

SEQ ID NO: 661993 - protein, 9 aa, Homo Sapiens
DLPWYVRMV

SEQ ID NO: 661994 - protein, 9 aa, Homo Sapiens
AVPTGLLSA

SEQ ID NO: 661995 - protein, 9 aa, Homo Sapiens
GKSPYFYPL

SEQ ID NO: 661996 - protein, 9 aa, Homo Sapiens
EECDKTFKW

SEQ ID NO: 661997 - protein, 9 aa, Homo Sapiens
LSYPQQGWL

SEQ ID NO: 661998 - protein, 9 aa, Homo Sapiens
FFCRSPSRH

SEQ ID NO: 661999 - protein, 9 aa, Homo Sapiens
CVAPSSTNV

SEQ ID NO: 662000 - protein, 9 aa, Homo Sapiens
CPELRRREV

SEQ ID NO: 662001 - protein, 9 aa, Homo Sapiens
NKTHRYVCG

SEQ ID NO: 662002 - protein, 9 aa, Homo Sapiens
LLDSKHNQE

SEQ ID NO: 662003 - protein, 9 aa, Homo Sapiens
GSWRWTHGT

SEQ ID NO: 662004 - protein, 9 aa, Homo Sapiens
VSSLESNVG

SEQ ID NO: 662005 - protein, 9 aa, Homo Sapiens
VAIKTSPKA

SEQ ID NO: 662006 - protein, 9 aa, Homo Sapiens
IRVRQNLHI

SEQ ID NO: 662007 - protein, 9 aa, Homo Sapiens
GGYGALRLP

SEQ ID NO: 662008 - protein, 9 aa, Homo Sapiens
DGNRREGRQ

SEQ ID NO: 662009 - protein, 9 aa, Homo Sapiens
HKEMISSPP

SEQ ID NO: 662010 - protein, 9 aa, Homo Sapiens
THRYVCGTG

SEQ ID NO: 662011 - protein, 9 aa, Homo Sapiens
PSVKSQQEQ

SEQ ID NO: 662012 - protein, 9 aa, Homo Sapiens
LYEHEIADL

SEQ ID NO: 662013 - protein, 9 aa, Homo Sapiens
SDQGQGPNG

SEQ ID NO: 662014 - protein, 9 aa, Homo Sapiens
SCVAPSSTN

SEQ ID NO: 662015 - protein, 9 aa, Homo Sapiens
QRLAAGGGG

SEQ ID NO: 662016 - protein, 9 aa, Homo Sapiens
AAKQKQKKT

SEQ ID NO: 662017 - protein, 9 aa, Homo Sapiens
LISCCCIPI

SEQ ID NO: 662018 - protein, 9 aa, Homo Sapiens
LVLSNSQWQ

SEQ ID NO: 662019 - protein, 9 aa, Homo Sapiens
GNRREGRQP

SEQ ID NO: 662020 - protein, 9 aa, Homo Sapiens
LIVVTITVS

SEQ ID NO: 662021 - protein, 9 aa, Homo Sapiens
NDVYRAPPI

SEQ ID NO: 662022 - protein, 9 aa, Homo Sapiens
CVQVDSMGG

SEQ ID NO: 662023 - protein, 9 aa, Homo Sapiens
GLFSGTEKK

SEQ ID NO: 662024 - protein, 9 aa, Homo Sapiens
VLQDSQDRC

SEQ ID NO: 662025 - protein, 9 aa, Homo Sapiens
LEDVNPRNP

SEQ ID NO: 662026 - protein, 9 aa, Homo Sapiens
LPWYVRMVC

SEQ ID NO: 662027 - protein, 9 aa, Homo Sapiens
APTSRAFPS

SEQ ID NO: 662028 - protein, 9 aa, Homo Sapiens
DIKNHLVLS

SEQ ID NO: 662029 - protein, 9 aa, Homo Sapiens
GFPVCCGGY

SEQ ID NO: 662030 - protein, 9 aa, Homo Sapiens
LRLPSICGP

SEQ ID NO: 662031 - protein, 9 aa, Homo Sapiens
CMKNHRATC

SEQ ID NO: 662032 - protein, 9 aa, Homo Sapiens
GSPAFLPRK

SEQ ID NO: 662033 - protein, 9 aa, Homo Sapiens
ISIPSDTSN

SEQ ID NO: 662034 - protein, 9 aa, Homo Sapiens
GYIFVTGRI

SEQ ID NO: 662035 - protein, 9 aa, Homo Sapiens
GGTPLAVPT

SEQ ID NO: 662036 - protein, 9 aa, Homo Sapiens
MTVAADGAS

SEQ ID NO: 662037 - protein, 9 aa, Homo Sapiens
NSASAAEAR

SEQ ID NO: 662038 - protein, 9 aa, Homo Sapiens
FIFREIIAD

SEQ ID NO: 662039 - protein, 9 aa, Homo Sapiens
QLIEQICHQ

SEQ ID NO: 662040 - protein, 9 aa, Homo Sapiens
TPQNKNAVL

SEQ ID NO: 662041 - protein, 9 aa, Homo Sapiens
VDSMGGPNR

SEQ ID NO: 662042 - protein, 9 aa, Homo Sapiens
ESDQGQGPN

SEQ ID NO: 662043 - protein, 9 aa, Homo Sapiens
GDFGYIFVT

SEQ ID NO: 662044 - protein, 9 aa, Homo Sapiens
RSLSYPQQG

SEQ ID NO: 662045 - protein, 9 aa, Homo Sapiens
AVTPFHPSH

SEQ ID NO: 662046 - protein, 9 aa, Homo Sapiens
TGLFSGTEK

SEQ ID NO: 662047 - protein, 9 aa, Homo Sapiens
TRRMRHLAN

SEQ ID NO: 662048 - protein, 9 aa, Homo Sapiens
QVAHGDQQL

SEQ ID NO: 662049 - protein, 9 aa, Homo Sapiens
FAGGTPLAV

SEQ ID NO: 662050 - protein, 9 aa, Homo Sapiens
SHCNTSTLT

SEQ ID NO: 662051 - protein, 9 aa, Homo Sapiens
GGGLLLAAL

SEQ ID NO: 662052 - protein, 9 aa, Homo Sapiens
YNKTHRYVC

SEQ ID NO: 662053 - protein, 9 aa, Homo Sapiens
SSEVAVTGK

SEQ ID NO: 662054 - protein, 9 aa, Homo Sapiens
PVSWVTIDP

SEQ ID NO: 662055 - protein, 9 aa, Homo Sapiens
EKDMEVYLQ

SEQ ID NO: 662056 - protein, 9 aa, Homo Sapiens
AAMAVAGFL

SEQ ID NO: 662057 - protein, 9 aa, Homo Sapiens
STKNLTGLF

SEQ ID NO: 662058 - protein, 9 aa, Homo Sapiens
GDTTRHGQT

SEQ ID NO: 662059 - protein, 9 aa, Homo Sapiens
RLAAGGGGL

SEQ ID NO: 662060 - protein, 9 aa, Homo Sapiens
LQLDEQLHH

SEQ ID NO: 662061 - protein, 9 aa, Homo Sapiens
ALLSLGAQS

SEQ ID NO: 662062 - protein, 9 aa, Homo Sapiens
AQALLELLI

SEQ ID NO: 662063 - protein, 9 aa, Homo Sapiens
YEAPNCPRA

SEQ ID NO: 662064 - protein, 9 aa, Homo Sapiens
VAPTSRAFP

SEQ ID NO: 662065 - protein, 9 aa, Homo Sapiens
NTRRMRHLA

SEQ ID NO: 662066 - protein, 9 aa, Homo Sapiens
EVAVTGKAS

SEQ ID NO: 662067 - protein, 9 aa, Homo Sapiens
KMDATAYEV

SEQ ID NO: 662068 - protein, 9 aa, Homo Sapiens
YGALRLPSI

SEQ ID NO: 662069 - protein, 9 aa, Homo Sapiens
PAMPLLFHP

SEQ ID NO: 662070 - protein, 9 aa, Homo Sapiens
RFLLELEHQ

SEQ ID NO: 662071 - protein, 9 aa, Homo Sapiens
TGTPPNLVL

SEQ ID NO: 662072 - protein, 9 aa, Homo Sapiens
PLHRSTIQL

SEQ ID NO: 662073 - protein, 9 aa, Homo Sapiens
WAPPVPSPS

SEQ ID NO: 662074 - protein, 9 aa, Homo Sapiens
PSMKGTHLP

SEQ ID NO: 662075 - protein, 9 aa, Homo Sapiens
ALLELLIEE

SEQ ID NO: 662076 - protein, 9 aa, Homo Sapiens
WQTARINRW

SEQ ID NO: 662077 - protein, 9 aa, Homo Sapiens
TEPEQSHCN

SEQ ID NO: 662078 - protein, 9 aa, Homo Sapiens
KTKVAIKTL

SEQ ID NO: 662079 - protein, 9 aa, Homo Sapiens
EALSKVSLT

SEQ ID NO: 662080 - protein, 9 aa, Homo Sapiens
ATLTGTPPN

SEQ ID NO: 662081 - protein, 9 aa, Homo Sapiens
SYRKAYRHG

SEQ ID NO: 662082 - protein, 9 aa, Homo Sapiens
EIDLSYNQL

SEQ ID NO: 662083 - protein, 9 aa, Homo Sapiens
KEQAPSEEH

SEQ ID NO: 662084 - protein, 9 aa, Homo Sapiens
MDATAYEVR

SEQ ID NO: 662085 - protein, 9 aa, Homo Sapiens
KSQQEQSDC

SEQ ID NO: 662086 - protein, 9 aa, Homo Sapiens
SLLEIDLSY

SEQ ID NO: 662087 - protein, 9 aa, Homo Sapiens
LPSGGLPAM

SEQ ID NO: 662088 - protein, 9 aa, Homo Sapiens
RRNKRAAGR

SEQ ID NO: 662089 - protein, 9 aa, Homo Sapiens
CVGILRTTH

SEQ ID NO: 662090 - protein, 9 aa, Homo Sapiens
LDLPWYVRM

SEQ ID NO: 662091 - protein, 9 aa, Homo Sapiens
NVQKEQAPS

SEQ ID NO: 662092 - protein, 9 aa, Homo Sapiens
RHGQTGHGQ

SEQ ID NO: 662093 - protein, 9 aa, Homo Sapiens
PLLDSKHNQ

SEQ ID NO: 662094 - protein, 9 aa, Homo Sapiens
HLSVFATFA

SEQ ID NO: 662095 - protein, 9 aa, Homo Sapiens
SEMKMKGLE

SEQ ID NO: 662096 - protein, 9 aa, Homo Sapiens
RNKRAAGRG

SEQ ID NO: 662097 - protein, 9 aa, Homo Sapiens
TVCSIMKRP

SEQ ID NO: 662098 - protein, 9 aa, Homo Sapiens
VVTITVSET

SEQ ID NO: 662099 - protein, 9 aa, Homo Sapiens
WEYSFLSYK

SEQ ID NO: 662100 - protein, 9 aa, Homo Sapiens
GRVRGDLCP

SEQ ID NO: 662101 - protein, 9 aa, Homo Sapiens
SEAGDFGYI

SEQ ID NO: 662102 - protein, 9 aa, Homo Sapiens
LREPPQKLK

SEQ ID NO: 662103 - protein, 9 aa, Homo Sapiens
LFSEMKMKG

SEQ ID NO: 662104 - protein, 9 aa, Homo Sapiens
ALISVRVFY

SEQ ID NO: 662105 - protein, 9 aa, Homo Sapiens
VFMTVAADG

SEQ ID NO: 662106 - protein, 9 aa, Homo Sapiens
KNMKLEDVN

SEQ ID NO: 662107 - protein, 9 aa, Homo Sapiens
TTCRLTVHF

SEQ ID NO: 662108 - protein, 9 aa, Homo Sapiens
PPAGLLHLH

SEQ ID NO: 662109 - protein, 9 aa, Homo Sapiens
NLTGLFSGT

SEQ ID NO: 662110 - protein, 9 aa, Homo Sapiens
ETSTEGIYV

SEQ ID NO: 662111 - protein, 9 aa, Homo Sapiens
PMGTFPVPY

SEQ ID NO: 662112 - protein, 9 aa, Homo Sapiens
DSETSHCYC

SEQ ID NO: 662113 - protein, 9 aa, Homo Sapiens
LVEQVQRDP

SEQ ID NO: 662114 - protein, 9 aa, Homo Sapiens
DAETLLKGL

SEQ ID NO: 662115 - protein, 9 aa, Homo Sapiens
HMANTVEPD

SEQ ID NO: 662116 - protein, 9 aa, Homo Sapiens
GGEENKGAG

SEQ ID NO: 662117 - protein, 9 aa, Homo Sapiens
GLNNYNAES

SEQ ID NO: 662118 - protein, 9 aa, Homo Sapiens
ESGVFGNHT

SEQ ID NO: 662119 - protein, 9 aa, Homo Sapiens
GACIALISV

SEQ ID NO: 662120 - protein, 9 aa, Homo Sapiens
GLGEGDSNR

SEQ ID NO: 662121 - protein, 9 aa, Homo Sapiens
REVSGCYNI

SEQ ID NO: 662122 - protein, 9 aa, Homo Sapiens
ASAAEARSM

SEQ ID NO: 662123 - protein, 9 aa, Homo Sapiens
AMQKIATTC

SEQ ID NO: 662124 - protein, 9 aa, Homo Sapiens
GWAPPVPSP

SEQ ID NO: 662125 - protein, 9 aa, Homo Sapiens
DTTRHGQTG

SEQ ID NO: 662126 - protein, 9 aa, Homo Sapiens
DRNTRRMRH

SEQ ID NO: 662127 - protein, 9 aa, Homo Sapiens
QDDRLREPP

SEQ ID NO: 662128 - protein, 9 aa, Homo Sapiens
EDVNPRNPG

SEQ ID NO: 662129 - protein, 9 aa, Homo Sapiens
KPSLLAHPC

SEQ ID NO: 662130 - protein, 9 aa, Homo Sapiens
RVRGDLCPG

SEQ ID NO: 662131 - protein, 9 aa, Homo Sapiens
DKLLAIFYT

SEQ ID NO: 662132 - protein, 9 aa, Homo Sapiens
HQMEENIVI

SEQ ID NO: 662133 - protein, 9 aa, Homo Sapiens
EGSWRWTHG

SEQ ID NO: 662134 - protein, 9 aa, Homo Sapiens
DATGFKRHV

SEQ ID NO: 662135 - protein, 9 aa, Homo Sapiens
MVAVIVYHL

SEQ ID NO: 662136 - protein, 9 aa, Homo Sapiens
LETAYKYFD

SEQ ID NO: 662137 - protein, 9 aa, Homo Sapiens
LGEGDSNRR

SEQ ID NO: 662138 - protein, 9 aa, Homo Sapiens
VVFMTVAAD

SEQ ID NO: 662139 - protein, 9 aa, Homo Sapiens
FLGCPSGRL

SEQ ID NO: 662140 - protein, 9 aa, Homo Sapiens
GGDGAPAAA

SEQ ID NO: 662141 - protein, 9 aa, Homo Sapiens
GFKVGISYQ

SEQ ID NO: 662142 - protein, 9 aa, Homo Sapiens
HLVLSNSQW

SEQ ID NO: 662143 - protein, 9 aa, Homo Sapiens
PSEEHLGRA

SEQ ID NO: 662144 - protein, 9 aa, Homo Sapiens
SSLESNVGI

SEQ ID NO: 662145 - protein, 9 aa, Homo Sapiens
ARRRGGDGA

SEQ ID NO: 662146 - protein, 9 aa, Homo Sapiens
ENRVQSCYQ

SEQ ID NO: 662147 - protein, 9 aa, Homo Sapiens
GLGVHGSFL

SEQ ID NO: 662148 - protein, 9 aa, Homo Sapiens
LTGTPPNLV

SEQ ID NO: 662149 - protein, 9 aa, Homo Sapiens
INRWLISCC

SEQ ID NO: 662150 - protein, 9 aa, Homo Sapiens
NKGAGEGGK

SEQ ID NO: 662151 - protein, 9 aa, Homo Sapiens
SETSHCYCK

SEQ ID NO: 662152 - protein, 9 aa, Homo Sapiens
RSPSRHCYG

SEQ ID NO: 662153 - protein, 9 aa, Homo Sapiens
FYPLYGLGE

SEQ ID NO: 662154 - protein, 9 aa, Homo Sapiens
GIQDIKNHL

SEQ ID NO: 662155 - protein, 9 aa, Homo Sapiens
YNNFFFCRS

SEQ ID NO: 662156 - protein, 9 aa, Homo Sapiens
SMVAVIVYH

SEQ ID NO: 662157 - protein, 9 aa, Homo Sapiens
GAPGSPSMP

SEQ ID NO: 662158 - protein, 9 aa, Homo Sapiens
IHCGGIQFF

SEQ ID NO: 662159 - protein, 9 aa, Homo Sapiens
WRWTHGTPF

SEQ ID NO: 662160 - protein, 9 aa, Homo Sapiens
TSRAFPSPF

SEQ ID NO: 662161 - protein, 9 aa, Homo Sapiens
YRKEARKRA

SEQ ID NO: 662162 - protein, 9 aa, Homo Sapiens
FKTTVCSIM

SEQ ID NO: 662163 - protein, 9 aa, Homo Sapiens
ISVRVFYKK

SEQ ID NO: 662164 - protein, 9 aa, Homo Sapiens
EMKMKGLEN

SEQ ID NO: 662165 - protein, 9 aa, Homo Sapiens
QCCPELRRR

SEQ ID NO: 662166 - protein, 9 aa, Homo Sapiens
LQLIEQICH

SEQ ID NO: 662167 - protein, 9 aa, Homo Sapiens
EPDGSNDEG

SEQ ID NO: 662168 - protein, 9 aa, Homo Sapiens
DSKHNQELQ

SEQ ID NO: 662169 - protein, 9 aa, Homo Sapiens
LLDDGVQRL

SEQ ID NO: 662170 - protein, 9 aa, Homo Sapiens
MWSIGARAL

SEQ ID NO: 662171 - protein, 9 aa, Homo Sapiens
QSCYQQELE

SEQ ID NO: 662172 - protein, 9 aa, Homo Sapiens
AGSRGQGPE

SEQ ID NO: 662173 - protein, 9 aa, Homo Sapiens
GYGALRLPS

SEQ ID NO: 662174 - protein, 9 aa, Homo Sapiens
QKEQAPSEE

SEQ ID NO: 662175 - protein, 9 aa, Homo Sapiens
PVAIKTSPK

SEQ ID NO: 662176 - protein, 9 aa, Homo Sapiens
KGSPAFLPR

SEQ ID NO: 662177 - protein, 9 aa, Homo Sapiens
IEQICHQIL

SEQ ID NO: 662178 - protein, 9 aa, Homo Sapiens
LSPDLSHMT

SEQ ID NO: 662179 - protein, 9 aa, Homo Sapiens
SWRWTHGTP

SEQ ID NO: 662180 - protein, 9 aa, Homo Sapiens
EAQVAHGDQ

SEQ ID NO: 662181 - protein, 9 aa, Homo Sapiens
DVLVPWEYS

SEQ ID NO: 662182 - protein, 9 aa, Homo Sapiens
SMPPTRFFT

SEQ ID NO: 662183 - protein, 9 aa, Homo Sapiens
FVDQVGFND

SEQ ID NO: 662184 - protein, 9 aa, Homo Sapiens
SPSMPPTRF

SEQ ID NO: 662185 - protein, 9 aa, Homo Sapiens
NQNNQEETS

SEQ ID NO: 662186 - protein, 9 aa, Homo Sapiens
KLEDVNPRN

SEQ ID NO: 662187 - protein, 9 aa, Homo Sapiens
FAGSQEPMG

SEQ ID NO: 662188 - protein, 9 aa, Homo Sapiens
ASCVAPSST

SEQ ID NO: 662189 - protein, 9 aa, Homo Sapiens
PLAVPTGLL

SEQ ID NO: 662190 - protein, 9 aa, Homo Sapiens
PTSRAFPSP

SEQ ID NO: 662191 - protein, 9 aa, Homo Sapiens
QRAKSKRVG

SEQ ID NO: 662192 - protein, 9 aa, Homo Sapiens
CHQILLLAS

SEQ ID NO: 662193 - protein, 9 aa, Homo Sapiens
DSMGGPNRF

SEQ ID NO: 662194 - protein, 9 aa, Homo Sapiens
VSYRKAYRH

SEQ ID NO: 662195 - protein, 9 aa, Homo Sapiens
CEECDKTFK

SEQ ID NO: 662196 - protein, 9 aa, Homo Sapiens
IGACIALIS

SEQ ID NO: 662197 - protein, 9 aa, Homo Sapiens
PSICGPPAG

SEQ ID NO: 662198 - protein, 9 aa, Homo Sapiens
FFFCRSPSR

SEQ ID NO: 662199 - protein, 9 aa, Homo Sapiens
KKTKVAIKT

SEQ ID NO: 662200 - protein, 9 aa, Homo Sapiens
YSWPSVKSQ

SEQ ID NO: 662201 - protein, 9 aa, Homo Sapiens
PGAPGKAGT

SEQ ID NO: 662202 - protein, 9 aa, Homo Sapiens
EFMEIWRKY

SEQ ID NO: 662203 - protein, 9 aa, Homo Sapiens
PEASQLRYS

SEQ ID NO: 662204 - protein, 9 aa, Homo Sapiens
AGGGGLLLA

SEQ ID NO: 662205 - protein, 9 aa, Homo Sapiens
LEVLIEYPE

SEQ ID NO: 662206 - protein, 9 aa, Homo Sapiens
PGSPSMPPT

SEQ ID NO: 662207 - protein, 9 aa, Homo Sapiens
RINRWLISC

SEQ ID NO: 662208 - protein, 9 aa, Homo Sapiens
AHPCPLVKS

SEQ ID NO: 662209 - protein, 9 aa, Homo Sapiens
DEQLHHWHG

SEQ ID NO: 662210 - protein, 9 aa, Homo Sapiens
KAQGRVRGD

SEQ ID NO: 662211 - protein, 9 aa, Homo Sapiens
NNQEETSTE

SEQ ID NO: 662212 - protein, 9 aa, Homo Sapiens
PPNLVLQGQ

SEQ ID NO: 662213 - protein, 9 aa, Homo Sapiens
GRQPSYSSS

SEQ ID NO: 662214 - protein, 9 aa, Homo Sapiens
NAVLVHSNL

SEQ ID NO: 662215 - protein, 9 aa, Homo Sapiens
LDACFGQMF

SEQ ID NO: 662216 - protein, 9 aa, Homo Sapiens
CDSETSHCY

SEQ ID NO: 662217 - protein, 9 aa, Homo Sapiens
MPPTRFFTE

SEQ ID NO: 662218 - protein, 9 aa, Homo Sapiens
NLHDYFMIR

SEQ ID NO: 662219 - protein, 9 aa, Homo Sapiens
KTHRYVCGT

SEQ ID NO: 662220 - protein, 9 aa, Homo Sapiens
KAGTVGPKG

SEQ ID NO: 662221 - protein, 9 aa, Homo Sapiens
VKIYRKEAR

SEQ ID NO: 662222 - protein, 9 aa, Homo Sapiens
ATCVGILRT

SEQ ID NO: 662223 - protein, 9 aa, Homo Sapiens
QGRVRGDLC

SEQ ID NO: 662224 - protein, 9 aa, Homo Sapiens
GGSCRQTGD

SEQ ID NO: 662225 - protein, 9 aa, Homo Sapiens
MANTVEPDG

SEQ ID NO: 662226 - protein, 9 aa, Homo Sapiens
SNSQWQTAR

SEQ ID NO: 662227 - protein, 9 aa, Homo Sapiens
GPGRLVLGT

SEQ ID NO: 662228 - protein, 9 aa, Homo Sapiens
YGKSPYFYP

SEQ ID NO: 662229 - protein, 9 aa, Homo Sapiens
TPPNLVLQG

SEQ ID NO: 662230 - protein, 9 aa, Homo Sapiens
ENVMLLSQK

SEQ ID NO: 662231 - protein, 9 aa, Homo Sapiens
LLSQKAGSP

SEQ ID NO: 662232 - protein, 9 aa, Homo Sapiens
PTGFKVGIS

SEQ ID NO: 662233 - protein, 9 aa, Homo Sapiens
SEARGFSRD

SEQ ID NO: 662234 - protein, 9 aa, Homo Sapiens
ISYQPPTVV

SEQ ID NO: 662235 - protein, 9 aa, Homo Sapiens
RWLISCCCI

SEQ ID NO: 662236 - protein, 9 aa, Homo Sapiens
VLVYMTAEQ

SEQ ID NO: 662237 - protein, 9 aa, Homo Sapiens
VECLITDHY

SEQ ID NO: 662238 - protein, 9 aa, Homo Sapiens
KKKTKVAIK

SEQ ID NO: 662239 - protein, 9 aa, Homo Sapiens
LGKPQLYLT

SEQ ID NO: 662240 - protein, 9 aa, Homo Sapiens
QSNTSALIL

SEQ ID NO: 662241 - protein, 9 aa, Homo Sapiens
GLCMIMNDR

SEQ ID NO: 662242 - protein, 9 aa, Homo Sapiens
ILCQARNHK

SEQ ID NO: 662243 - protein, 9 aa, Homo Sapiens
FSRDMGILG

SEQ ID NO: 662244 - protein, 9 aa, Homo Sapiens
GSSSSSSSI

SEQ ID NO: 662245 - protein, 9 aa, Homo Sapiens
DKTFKWSST

SEQ ID NO: 662246 - protein, 9 aa, Homo Sapiens
CPSGRLSSL

SEQ ID NO: 662247 - protein, 9 aa, Homo Sapiens
ATGFKRHVI

SEQ ID NO: 662248 - protein, 9 aa, Homo Sapiens
EYSFLSYKC

SEQ ID NO: 662249 - protein, 9 aa, Homo Sapiens
SCKQNQQQC

SEQ ID NO: 662250 - protein, 9 aa, Homo Sapiens
SLLAHPCPL

SEQ ID NO: 662251 - protein, 9 aa, Homo Sapiens
SGGLPAMPL

SEQ ID NO: 662252 - protein, 9 aa, Homo Sapiens
SQWQTARIN

SEQ ID NO: 662253 - protein, 9 aa, Homo Sapiens
CFGQMFLIH

SEQ ID NO: 662254 - protein, 9 aa, Homo Sapiens
KASSAIAAQ

SEQ ID NO: 662255 - protein, 9 aa, Homo Sapiens
NGGSCRQTG

SEQ ID NO: 662256 - protein, 9 aa, Homo Sapiens
PSDTSNMDL

SEQ ID NO: 662257 - protein, 9 aa, Homo Sapiens
RVSYRKAYR

SEQ ID NO: 662258 - protein, 9 aa, Homo Sapiens
TESSAPGQP

SEQ ID NO: 662259 - protein, 9 aa, Homo Sapiens
EETSTEGIY

SEQ ID NO: 662260 - protein, 9 aa, Homo Sapiens
SCRQTGDFT

SEQ ID NO: 662261 - protein, 9 aa, Homo Sapiens
KGLENQMFI

SEQ ID NO: 662262 - protein, 9 aa, Homo Sapiens
MKMKGLENQ

SEQ ID NO: 662263 - protein, 9 aa, Homo Sapiens
SQEPMGTFP

SEQ ID NO: 662264 - protein, 9 aa, Homo Sapiens
RQPSYSSSL

SEQ ID NO: 662265 - protein, 9 aa, Homo Sapiens
ELRRREVSG

SEQ ID NO: 662266 - protein, 9 aa, Homo Sapiens
PPKYNDSCS

SEQ ID NO: 662267 - protein, 9 aa, Homo Sapiens
ENKGAGEGG

SEQ ID NO: 662268 - protein, 9 aa, Homo Sapiens
LGAQSNTSA

SEQ ID NO: 662269 - protein, 9 aa, Homo Sapiens
TMRRNTILC

SEQ ID NO: 662270 - protein, 9 aa, Homo Sapiens
DFGYIFVTG

SEQ ID NO: 662271 - protein, 9 aa, Homo Sapiens
VEWPLQVFH

SEQ ID NO: 662272 - protein, 9 aa, Homo Sapiens
NFVDQVGFN

SEQ ID NO: 662273 - protein, 9 aa, Homo Sapiens
LLKGLGVHG

SEQ ID NO: 662274 - protein, 9 aa, Homo Sapiens
SCCCIPIHC

SEQ ID NO: 662275 - protein, 9 aa, Homo Sapiens
EQAPSEEHL

SEQ ID NO: 662276 - protein, 9 aa, Homo Sapiens
VAIKTLEPL

SEQ ID NO: 662277 - protein, 9 aa, Homo Sapiens
ETLLKGLGV

SEQ ID NO: 662278 - protein, 9 aa, Homo Sapiens
EKREKDMEV

SEQ ID NO: 662279 - protein, 9 aa, Homo Sapiens
HGLVEQVQR

SEQ ID NO: 662280 - protein, 9 aa, Homo Sapiens
QKDQFIFRE

SEQ ID NO: 662281 - protein, 9 aa, Homo Sapiens
IFREIIADV

SEQ ID NO: 662282 - protein, 9 aa, Homo Sapiens
VTIDPSCEV

SEQ ID NO: 662283 - protein, 9 aa, Homo Sapiens
AVLVHSNLN

SEQ ID NO: 662284 - protein, 9 aa, Homo Sapiens
YSFLSYKCS

SEQ ID NO: 662285 - protein, 9 aa, Homo Sapiens
CLLLPAHTL

SEQ ID NO: 662286 - protein, 9 aa, Homo Sapiens
WMIALHSPI

SEQ ID NO: 662287 - protein, 9 aa, Homo Sapiens
RHLANTAPA

SEQ ID NO: 662288 - protein, 9 aa, Homo Sapiens
GGGGLLLAA

SEQ ID NO: 662289 - protein, 9 aa, Homo Sapiens
IYLDLPWYV

SEQ ID NO: 662290 - protein, 9 aa, Homo Sapiens
HRATCVGIL

SEQ ID NO: 662291 - protein, 9 aa, Homo Sapiens
LHLHLLKST

SEQ ID NO: 662292 - protein, 9 aa, Homo Sapiens
GPGQASCVA

SEQ ID NO: 662293 - protein, 9 aa, Homo Sapiens
TAYKYFDGI

SEQ ID NO: 662294 - protein, 9 aa, Homo Sapiens
SDVLVPWEY

SEQ ID NO: 662295 - protein, 9 aa, Homo Sapiens
GIQFFPKIL

SEQ ID NO: 662296 - protein, 9 aa, Homo Sapiens
PSPKQRAKS

SEQ ID NO: 662297 - protein, 9 aa, Homo Sapiens
TGHGQSTQT

SEQ ID NO: 662298 - protein, 9 aa, Homo Sapiens
MTANFVDQV

SEQ ID NO: 662299 - protein, 9 aa, Homo Sapiens
SLSSTLPLH

SEQ ID NO: 662300 - protein, 9 aa, Homo Sapiens
NNFFFCRSP

SEQ ID NO: 662301 - protein, 9 aa, Homo Sapiens
NKNAVLVHS

SEQ ID NO: 662302 - protein, 9 aa, Homo Sapiens
VDAAGSRGQ

SEQ ID NO: 662303 - protein, 9 aa, Homo Sapiens
GTFNVECLI

SEQ ID NO: 662304 - protein, 9 aa, Homo Sapiens
KIVAHVACD

SEQ ID NO: 662305 - protein, 9 aa, Homo Sapiens
VTPFHPSHI

SEQ ID NO: 662306 - protein, 9 aa, Homo Sapiens
HDYFMIRVR

SEQ ID NO: 662307 - protein, 9 aa, Homo Sapiens
AACLCTGLS

SEQ ID NO: 662308 - protein, 9 aa, Homo Sapiens
HCNTSTLTE

SEQ ID NO: 662309 - protein, 9 aa, Homo Sapiens
FMTVAADGA

SEQ ID NO: 662310 - protein, 9 aa, Homo Sapiens
KDQFIFREI

SEQ ID NO: 662311 - protein, 9 aa, Homo Sapiens
AVTGKASSA

SEQ ID NO: 662312 - protein, 9 aa, Homo Sapiens
YAPASDGRS

SEQ ID NO: 662313 - protein, 9 aa, Homo Sapiens
NFFFCRSPS

SEQ ID NO: 662314 - protein, 9 aa, Homo Sapiens
SAPGQPWGQ

SEQ ID NO: 662315 - protein, 9 aa, Homo Sapiens
LHDYFMIRV

SEQ ID NO: 662316 - protein, 9 aa, Homo Sapiens
ACIALISVR

SEQ ID NO: 662317 - protein, 9 aa, Homo Sapiens
AKQKQKKTE

SEQ ID NO: 662318 - protein, 9 aa, Homo Sapiens
GGLLLAALC

SEQ ID NO: 662319 - protein, 9 aa, Homo Sapiens
ACFGQMFLI

SEQ ID NO: 662320 - protein, 9 aa, Homo Sapiens
VLSNSQWQT

SEQ ID NO: 662321 - protein, 9 aa, Homo Sapiens
ITDHYTGGM

SEQ ID NO: 662322 - protein, 9 aa, Homo Sapiens
GMWSIGARA

SEQ ID NO: 662323 - protein, 9 aa, Homo Sapiens
SWPSVKSQQ

SEQ ID NO: 662324 - protein, 9 aa, Homo Sapiens
IDLSYNQLQ

SEQ ID NO: 662325 - protein, 9 aa, Homo Sapiens
NHRATCVGI

SEQ ID NO: 662326 - protein, 9 aa, Homo Sapiens
VLIEYPELQ

SEQ ID NO: 662327 - protein, 9 aa, Homo Sapiens
LLPAHTLQG

SEQ ID NO: 662328 - protein, 9 aa, Homo Sapiens
RTVDAAGSR

SEQ ID NO: 662329 - protein, 9 aa, Homo Sapiens
CGPGRLVLG

SEQ ID NO: 662330 - protein, 9 aa, Homo Sapiens
LSLEVLIEY

SEQ ID NO: 662331 - protein, 9 aa, Homo Sapiens
YNKWSQPVA

SEQ ID NO: 662332 - protein, 9 aa, Homo Sapiens
APPVPSPSS

SEQ ID NO: 662333 - protein, 9 aa, Homo Sapiens
NHLVLSNSQ

SEQ ID NO: 662334 - protein, 9 aa, Homo Sapiens
DPHCLLLPA

SEQ ID NO: 662335 - protein, 9 aa, Homo Sapiens
LIEEDDGTG

SEQ ID NO: 662336 - protein, 9 aa, Homo Sapiens
CCGGYGALR

SEQ ID NO: 662337 - protein, 9 aa, Homo Sapiens
KTESSAPGQ

SEQ ID NO: 662338 - protein, 9 aa, Homo Sapiens
SVIEKNNKN

SEQ ID NO: 662339 - protein, 9 aa, Homo Sapiens
HVLTPLNHE

SEQ ID NO: 662340 - protein, 9 aa, Homo Sapiens
RYETSASHP

SEQ ID NO: 662341 - protein, 9 aa, Homo Sapiens
STAYNLHPR

SEQ ID NO: 662342 - protein, 9 aa, Homo Sapiens
CESSPLNWE

SEQ ID NO: 662343 - protein, 9 aa, Homo Sapiens
EVHRWAHVL

SEQ ID NO: 662344 - protein, 9 aa, Homo Sapiens
FRISTIRSF

SEQ ID NO: 662345 - protein, 9 aa, Homo Sapiens
MTPKSQFSW

SEQ ID NO: 662346 - protein, 9 aa, Homo Sapiens
IAERLISTA

SEQ ID NO: 662347 - protein, 9 aa, Homo Sapiens
ITDFGRAKL

SEQ ID NO: 662348 - protein, 9 aa, Homo Sapiens
IEKNNKNLL

SEQ ID NO: 662349 - protein, 9 aa, Homo Sapiens
SPLNWEESQ

SEQ ID NO: 662350 - protein, 9 aa, Homo Sapiens
GDQLGQITG

SEQ ID NO: 662351 - protein, 9 aa, Homo Sapiens
KPVFERLQS

SEQ ID NO: 662352 - protein, 9 aa, Homo Sapiens
MMRRYETSA

SEQ ID NO: 662353 - protein, 9 aa, Homo Sapiens
PPTQYWNGW

SEQ ID NO: 662354 - protein, 9 aa, Homo Sapiens
STIRSFEGI

SEQ ID NO: 662355 - protein, 9 aa, Homo Sapiens
NNKNLLEVV

SEQ ID NO: 662356 - protein, 9 aa, Homo Sapiens
KLYVFWPFS

SEQ ID NO: 662357 - protein, 9 aa, Homo Sapiens
FERLQSVII

SEQ ID NO: 662358 - protein, 9 aa, Homo Sapiens
LNHELEFST

SEQ ID NO: 662359 - protein, 9 aa, Homo Sapiens
RAKLLGAEE

SEQ ID NO: 662360 - protein, 9 aa, Homo Sapiens
SQFSWSKDY

SEQ ID NO: 662361 - protein, 9 aa, Homo Sapiens
LQSVIITSG

SEQ ID NO: 662362 - protein, 9 aa, Homo Sapiens
AHVLTPLNH

SEQ ID NO: 662363 - protein, 9 aa, Homo Sapiens
QSVIEKNNK

SEQ ID NO: 662364 - protein, 9 aa, Homo Sapiens
HRWAHVLTP

SEQ ID NO: 662365 - protein, 9 aa, Homo Sapiens
LTPLNHELE

SEQ ID NO: 662366 - protein, 9 aa, Homo Sapiens
LFGDQLGQI

SEQ ID NO: 662367 - protein, 9 aa, Homo Sapiens
VKLYVFWPF

SEQ ID NO: 662368 - protein, 9 aa, Homo Sapiens
PPGTRGPPG

SEQ ID NO: 662369 - protein, 9 aa, Homo Sapiens
VHRWAHVLT

SEQ ID NO: 662370 - protein, 9 aa, Homo Sapiens
SSPLNWEES

SEQ ID NO: 662371 - protein, 9 aa, Homo Sapiens
AERLISTAY

SEQ ID NO: 662372 - protein, 9 aa, Homo Sapiens
PSIPGPPGT

SEQ ID NO: 662373 - protein, 9 aa, Homo Sapiens
GEEVHRWAH

SEQ ID NO: 662374 - protein, 9 aa, Homo Sapiens
SMGEEVHRW

SEQ ID NO: 662375 - protein, 9 aa, Homo Sapiens
GYHRTEVMQ

SEQ ID NO: 662376 - protein, 9 aa, Homo Sapiens
NHELEFSTF

SEQ ID NO: 662377 - protein, 9 aa, Homo Sapiens
LHPRSMGEE

SEQ ID NO: 662378 - protein, 9 aa, Homo Sapiens
RSMGEEVHR

SEQ ID NO: 662379 - protein, 9 aa, Homo Sapiens
ISTAYNLHP

SEQ ID NO: 662380 - protein, 9 aa, Homo Sapiens
TLFRISTIR

SEQ ID NO: 662381 - protein, 9 aa, Homo Sapiens
HPRSMGEEV

SEQ ID NO: 662382 - protein, 9 aa, Homo Sapiens
RLQSVIITS

SEQ ID NO: 662383 - protein, 9 aa, Homo Sapiens
DFGRAKLLG

SEQ ID NO: 662384 - protein, 9 aa, Homo Sapiens
SYFRVLTHK

SEQ ID NO: 662385 - protein, 9 aa, Homo Sapiens
YFRVLTHKR

SEQ ID NO: 662386 - protein, 9 aa, Homo Sapiens
GRAKLLGAE

SEQ ID NO: 662387 - protein, 9 aa, Homo Sapiens
MGEEVHRWA

SEQ ID NO: 662388 - protein, 9 aa, Homo Sapiens
EFSTFKDLL

SEQ ID NO: 662389 - protein, 9 aa, Homo Sapiens
VGQLFGDQL

SEQ ID NO: 662390 - protein, 9 aa, Homo Sapiens
NSYFRVLTH

SEQ ID NO: 662391 - protein, 9 aa, Homo Sapiens
MKCESSPLN

SEQ ID NO: 662392 - protein, 9 aa, Homo Sapiens
ETSASHPPP

SEQ ID NO: 662393 - protein, 9 aa, Homo Sapiens
RWAHVLTPL

SEQ ID NO: 662394 - protein, 9 aa, Homo Sapiens
VLTPLNHEL

SEQ ID NO: 662395 - protein, 9 aa, Homo Sapiens
HELEFSTFK

SEQ ID NO: 662396 - protein, 9 aa, Homo Sapiens
VFERLQSVI

SEQ ID NO: 662397 - protein, 9 aa, Homo Sapiens
KSQFSWSKD

SEQ ID NO: 662398 - protein, 9 aa, Homo Sapiens
FRVLTHKRS

SEQ ID NO: 662399 - protein, 9 aa, Homo Sapiens
YMMRRYETS

SEQ ID NO: 662400 - protein, 9 aa, Homo Sapiens
RISTIRSFE

SEQ ID NO: 662401 - protein, 9 aa, Homo Sapiens
LCKNVKLYV

SEQ ID NO: 662402 - protein, 9 aa, Homo Sapiens
KNNKNLLEV

SEQ ID NO: 662403 - protein, 9 aa, Homo Sapiens
GPPGTRGPP

SEQ ID NO: 662404 - protein, 9 aa, Homo Sapiens
RTEVMQKSS

SEQ ID NO: 662405 - protein, 9 aa, Homo Sapiens
HKRSDGRKY

SEQ ID NO: 662406 - protein, 9 aa, Homo Sapiens
PKSQFSWSK

SEQ ID NO: 662407 - protein, 9 aa, Homo Sapiens
KNVKLYVFW

SEQ ID NO: 662408 - protein, 9 aa, Homo Sapiens
PLNHELEFS

SEQ ID NO: 662409 - protein, 9 aa, Homo Sapiens
LIAERLIST

SEQ ID NO: 662410 - protein, 9 aa, Homo Sapiens
IKPVFERLQ

SEQ ID NO: 662411 - protein, 9 aa, Homo Sapiens
LFRISTIRS

SEQ ID NO: 662412 - protein, 9 aa, Homo Sapiens
TAYNLHPRS

SEQ ID NO: 662413 - protein, 9 aa, Homo Sapiens
DKMTPKSQF

SEQ ID NO: 662414 - protein, 9 aa, Homo Sapiens
LNWEESQGL

SEQ ID NO: 662415 - protein, 9 aa, Homo Sapiens
LYVFWPFSK

SEQ ID NO: 662416 - protein, 9 aa, Homo Sapiens
QYWNGWACF

SEQ ID NO: 662417 - protein, 9 aa, Homo Sapiens
FGRAKLLGA

SEQ ID NO: 662418 - protein, 9 aa, Homo Sapiens
LIQSVIEKN

SEQ ID NO: 662419 - protein, 9 aa, Homo Sapiens
PLNWEESQG

SEQ ID NO: 662420 - protein, 9 aa, Homo Sapiens
PTQYWNGWA

SEQ ID NO: 662421 - protein, 9 aa, Homo Sapiens
SIPGPPGTR

SEQ ID NO: 662422 - protein, 9 aa, Homo Sapiens
QMKCESSPL

SEQ ID NO: 662423 - protein, 9 aa, Homo Sapiens
ESSPLNWEE

SEQ ID NO: 662424 - protein, 9 aa, Homo Sapiens
DQLGQITGL

SEQ ID NO: 662425 - protein, 9 aa, Homo Sapiens
EEVHRWAHV

SEQ ID NO: 662426 - protein, 9 aa, Homo Sapiens
PGTRGPPGE

SEQ ID NO: 662427 - protein, 9 aa, Homo Sapiens
AFVPPTQYW

SEQ ID NO: 662428 - protein, 9 aa, Homo Sapiens
AIKPVFERL

SEQ ID NO: 662429 - protein, 9 aa, Homo Sapiens
ETLFRISTI

SEQ ID NO: 662430 - protein, 9 aa, Homo Sapiens
VKITDFGRA

SEQ ID NO: 662431 - protein, 9 aa, Homo Sapiens
VLTHKRSDG

SEQ ID NO: 662432 - protein, 9 aa, Homo Sapiens
PVFERLQSV

SEQ ID NO: 662433 - protein, 9 aa, Homo Sapiens
KMTPKSQFS

SEQ ID NO: 662434 - protein, 9 aa, Homo Sapiens
PRSMGEEVH

SEQ ID NO: 662435 - protein, 9 aa, Homo Sapiens
GQLFGDQLG

SEQ ID NO: 662436 - protein, 9 aa, Homo Sapiens
LISTAYNLH

SEQ ID NO: 662437 - protein, 9 aa, Homo Sapiens
KITDFGRAK

SEQ ID NO: 662438 - protein, 9 aa, Homo Sapiens
TPKSQFSWS

SEQ ID NO: 662439 - protein, 9 aa, Homo Sapiens
YYMMRRYET

SEQ ID NO: 662440 - protein, 9 aa, Homo Sapiens
CDKMTPKSQ

SEQ ID NO: 662441 - protein, 9 aa, Homo Sapiens
FGDQLGQIT

SEQ ID NO: 662442 - protein, 9 aa, Homo Sapiens
VPPTQYWNG

SEQ ID NO: 662443 - protein, 9 aa, Homo Sapiens
TRGPPGEGL

SEQ ID NO: 662444 - protein, 9 aa, Homo Sapiens
HVKITDFGR

SEQ ID NO: 662445 - protein, 9 aa, Homo Sapiens
QFSWSKDYV

SEQ ID NO: 662446 - protein, 9 aa, Homo Sapiens
EKNNKNLLE

SEQ ID NO: 662447 - protein, 9 aa, Homo Sapiens
KCESSPLNW

SEQ ID NO: 662448 - protein, 9 aa, Homo Sapiens
TQYWNGWAC

SEQ ID NO: 662449 - protein, 9 aa, Homo Sapiens
GMVGQLFGD

SEQ ID NO: 662450 - protein, 9 aa, Homo Sapiens
SGYHRTEVM

SEQ ID NO: 662451 - protein, 9 aa, Homo Sapiens
KLSGYHRTE

SEQ ID NO: 662452 - protein, 9 aa, Homo Sapiens
LFAFVPPTQ

SEQ ID NO: 662453 - protein, 9 aa, Homo Sapiens
WAHVLTPLN

SEQ ID NO: 662454 - protein, 9 aa, Homo Sapiens
YNLHPRSMG

SEQ ID NO: 662455 - protein, 9 aa, Homo Sapiens
VIEKNNKNL

SEQ ID NO: 662456 - protein, 9 aa, Homo Sapiens
VFWPFSKTV

SEQ ID NO: 662457 - protein, 9 aa, Homo Sapiens
THKRSDGRK

SEQ ID NO: 662458 - protein, 9 aa, Homo Sapiens
YHRTEVMQK

SEQ ID NO: 662459 - protein, 9 aa, Homo Sapiens
LSGYHRTEV

SEQ ID NO: 662460 - protein, 9 aa, Homo Sapiens
YVFWPFSKT

SEQ ID NO: 662461 - protein, 9 aa, Homo Sapiens
TSASHPPPR

SEQ ID NO: 662462 - protein, 9 aa, Homo Sapiens
LTHKRSDGR

SEQ ID NO: 662463 - protein, 9 aa, Homo Sapiens
YETSASHPP

SEQ ID NO: 662464 - protein, 9 aa, Homo Sapiens
QLFGDQLGQ

SEQ ID NO: 662465 - protein, 9 aa, Homo Sapiens
NLHPRSMGE

SEQ ID NO: 662466 - protein, 9 aa, Homo Sapiens
IPGPPGTRG

SEQ ID NO: 662467 - protein, 9 aa, Homo Sapiens
RVLTHKRSD

SEQ ID NO: 662468 - protein, 9 aa, Homo Sapiens
CKLSGYHRT

SEQ ID NO: 662469 - protein, 9 aa, Homo Sapiens
RLISTAYNL

SEQ ID NO: 662470 - protein, 9 aa, Homo Sapiens
CKNVKLYVF

SEQ ID NO: 662471 - protein, 9 aa, Homo Sapiens
GTRGPPGEG

SEQ ID NO: 662472 - protein, 9 aa, Homo Sapiens
ELEFSTFKD

SEQ ID NO: 662473 - protein, 9 aa, Homo Sapiens
TDFGRAKLL

SEQ ID NO: 662474 - protein, 9 aa, Homo Sapiens
TPLNHELEF

SEQ ID NO: 662475 - protein, 9 aa, Homo Sapiens
LETLFRIST

SEQ ID NO: 662476 - protein, 9 aa, Homo Sapiens
IQSVIEKNN

SEQ ID NO: 662477 - protein, 9 aa, Homo Sapiens
ISTIRSFEG

SEQ ID NO: 662478 - protein, 9 aa, Homo Sapiens
LEFSTFKDL

SEQ ID NO: 662479 - protein, 9 aa, Homo Sapiens
AYNLHPRSM

SEQ ID NO: 662480 - protein, 9 aa, Homo Sapiens
PGPPGTRGP

SEQ ID NO: 662481 - protein, 9 aa, Homo Sapiens
ERLQSVIIT

SEQ ID NO: 662482 - protein, 9 aa, Homo Sapiens
HRTEVMQKS

SEQ ID NO: 662483 - protein, 9 aa, Homo Sapiens
TEVMQKSST

SEQ ID NO: 662484 - protein, 9 aa, Homo Sapiens
ERLISTAYN

SEQ ID NO: 662485 - protein, 9 aa, Homo Sapiens
FAFVPPTQY

SEQ ID NO: 662486 - protein, 9 aa, Homo Sapiens
FVPPTQYWN

SEQ ID NO: 662487 - protein, 9 aa, Homo Sapiens
MVGQLFGDQ

SEQ ID NO: 662488 - protein, 9 aa, Homo Sapiens
MRRYETSAS

SEQ ID NO: 662489 - protein, 9 aa, Homo Sapiens
RRYETSASH

SEQ ID NO: 662490 - protein, 9 aa, Homo Sapiens
ELETLFRIS

SEQ ID NO: 662491 - protein, 9 aa, Homo Sapiens
NVKLYVFWP

SEQ ID NO: 662492 - protein, 9 aa, Homo Sapiens
EKANRIVAK

SEQ ID NO: 662493 - protein, 9 aa, Homo Sapiens
LFQSSDPTL

SEQ ID NO: 662494 - protein, 9 aa, Homo Sapiens
PFPLEPRDA

SEQ ID NO: 662495 - protein, 9 aa, Homo Sapiens
VSEFVQGST

SEQ ID NO: 662496 - protein, 9 aa, Homo Sapiens
FSISKEHIE

SEQ ID NO: 662497 - protein, 9 aa, Homo Sapiens
GGRLLRQGE

SEQ ID NO: 662498 - protein, 9 aa, Homo Sapiens
EKISLLCSD

SEQ ID NO: 662499 - protein, 9 aa, Homo Sapiens
NNITDKLRE

SEQ ID NO: 662500 - protein, 9 aa, Homo Sapiens
LPVSIPADL

SEQ ID NO: 662501 - protein, 9 aa, Homo Sapiens
SVEENSALM

SEQ ID NO: 662502 - protein, 9 aa, Homo Sapiens
LWQDFEDRE

SEQ ID NO: 662503 - protein, 9 aa, Homo Sapiens
CVAATNAGT

SEQ ID NO: 662504 - protein, 9 aa, Homo Sapiens
WQQMENYPK

SEQ ID NO: 662505 - protein, 9 aa, Homo Sapiens
HEDFEEVAH

SEQ ID NO: 662506 - protein, 9 aa, Homo Sapiens
QHLATDVCY

SEQ ID NO: 662507 - protein, 9 aa, Homo Sapiens
AVNNWLIST

SEQ ID NO: 662508 - protein, 9 aa, Homo Sapiens
REEGNSTTE

SEQ ID NO: 662509 - protein, 9 aa, Homo Sapiens
YTETTLLPD

SEQ ID NO: 662510 - protein, 9 aa, Homo Sapiens
EVTAQKCHP

SEQ ID NO: 662511 - protein, 9 aa, Homo Sapiens
IKNKPILNI

SEQ ID NO: 662512 - protein, 9 aa, Homo Sapiens
LKHREDADI

SEQ ID NO: 662513 - protein, 9 aa, Homo Sapiens
EVLRVKKKI

SEQ ID NO: 662514 - protein, 9 aa, Homo Sapiens
VYADHADSR

SEQ ID NO: 662515 - protein, 9 aa, Homo Sapiens
TGSQLDLSE

SEQ ID NO: 662516 - protein, 9 aa, Homo Sapiens
HMIDDRMIC

SEQ ID NO: 662517 - protein, 9 aa, Homo Sapiens
LDKEASECC

SEQ ID NO: 662518 - protein, 9 aa, Homo Sapiens
LSLHSQQFL

SEQ ID NO: 662519 - protein, 9 aa, Homo Sapiens
MFETKPLDI

SEQ ID NO: 662520 - protein, 9 aa, Homo Sapiens
MLPTSETTF

SEQ ID NO: 662521 - protein, 9 aa, Homo Sapiens
SFYQVLQEH

SEQ ID NO: 662522 - protein, 9 aa, Homo Sapiens
PEQDPTEEP

SEQ ID NO: 662523 - protein, 9 aa, Homo Sapiens
SLPPNSERN

SEQ ID NO: 662524 - protein, 9 aa, Homo Sapiens
NLYISDTLG

SEQ ID NO: 662525 - protein, 9 aa, Homo Sapiens
ALGYSRHGH

SEQ ID NO: 662526 - protein, 9 aa, Homo Sapiens
LQRFCSLLV

SEQ ID NO: 662527 - protein, 9 aa, Homo Sapiens
QRALGCCAP

SEQ ID NO: 662528 - protein, 9 aa, Homo Sapiens
EGALKQDKG

SEQ ID NO: 662529 - protein, 9 aa, Homo Sapiens
DKHTIRFMP

SEQ ID NO: 662530 - protein, 9 aa, Homo Sapiens
MTIPNLTSR

SEQ ID NO: 662531 - protein, 9 aa, Homo Sapiens
INLSLYQSE

SEQ ID NO: 662532 - protein, 9 aa, Homo Sapiens
IQRREAENV

SEQ ID NO: 662533 - protein, 9 aa, Homo Sapiens
CGHDVTCSV

SEQ ID NO: 662534 - protein, 9 aa, Homo Sapiens
YTYYSSFYQ

SEQ ID NO: 662535 - protein, 9 aa, Homo Sapiens
CTTVTKMAF

SEQ ID NO: 662536 - protein, 9 aa, Homo Sapiens
GIMNTKCTC

SEQ ID NO: 662537 - protein, 9 aa, Homo Sapiens
GQRAGEAFP

SEQ ID NO: 662538 - protein, 9 aa, Homo Sapiens
THTTMEHSD

SEQ ID NO: 662539 - protein, 9 aa, Homo Sapiens
SAGLVALSY

SEQ ID NO: 662540 - protein, 9 aa, Homo Sapiens
ETLQDINNI

SEQ ID NO: 662541 - protein, 9 aa, Homo Sapiens
HPAGGCVIQ

SEQ ID NO: 662542 - protein, 9 aa, Homo Sapiens
KEIVSLLPT

SEQ ID NO: 662543 - protein, 9 aa, Homo Sapiens
AEVSGKGPA

SEQ ID NO: 662544 - protein, 9 aa, Homo Sapiens
VPTCLSCCP

SEQ ID NO: 662545 - protein, 9 aa, Homo Sapiens
KNCNSNQAT

SEQ ID NO: 662546 - protein, 9 aa, Homo Sapiens
LDLVRGGRQ

SEQ ID NO: 662547 - protein, 9 aa, Homo Sapiens
AALPGAEVS

SEQ ID NO: 662548 - protein, 9 aa, Homo Sapiens
PSFPMVTAP

SEQ ID NO: 662549 - protein, 9 aa, Homo Sapiens
TKALLQSIG

SEQ ID NO: 662550 - protein, 9 aa, Homo Sapiens
SLKIDGTRT

SEQ ID NO: 662551 - protein, 9 aa, Homo Sapiens
AEFGKTSAD

SEQ ID NO: 662552 - protein, 9 aa, Homo Sapiens
CGYVLLSVT

SEQ ID NO: 662553 - protein, 9 aa, Homo Sapiens
PNMYERNPV

SEQ ID NO: 662554 - protein, 9 aa, Homo Sapiens
QRFCSLLVK

SEQ ID NO: 662555 - protein, 9 aa, Homo Sapiens
LIARHCFSL

SEQ ID NO: 662556 - protein, 9 aa, Homo Sapiens
FINIYNRPI

SEQ ID NO: 662557 - protein, 9 aa, Homo Sapiens
PGGGGARPW

SEQ ID NO: 662558 - protein, 9 aa, Homo Sapiens
ITLTFEGKT

SEQ ID NO: 662559 - protein, 9 aa, Homo Sapiens
SRPARRALA

SEQ ID NO: 662560 - protein, 9 aa, Homo Sapiens
FPSVPGPRV

SEQ ID NO: 662561 - protein, 9 aa, Homo Sapiens
RPARRALAG

SEQ ID NO: 662562 - protein, 9 aa, Homo Sapiens
LKPRSTPRE

SEQ ID NO: 662563 - protein, 9 aa, Homo Sapiens
LHKGERNKR

SEQ ID NO: 662564 - protein, 9 aa, Homo Sapiens
IADPLIHMT

SEQ ID NO: 662565 - protein, 9 aa, Homo Sapiens
SDKHTIRFM

SEQ ID NO: 662566 - protein, 9 aa, Homo Sapiens
TEVNGMTIP

SEQ ID NO: 662567 - protein, 9 aa, Homo Sapiens
TKSLMNASY

SEQ ID NO: 662568 - protein, 9 aa, Homo Sapiens
GALKQDKGE

SEQ ID NO: 662569 - protein, 9 aa, Homo Sapiens
IGVEQLLPS

SEQ ID NO: 662570 - protein, 9 aa, Homo Sapiens
DNAIPKSEK

SEQ ID NO: 662571 - protein, 9 aa, Homo Sapiens
LNSKSRELE

SEQ ID NO: 662572 - protein, 9 aa, Homo Sapiens
SIPEEYSEA

SEQ ID NO: 662573 - protein, 9 aa, Homo Sapiens
TTEVNGMTI

SEQ ID NO: 662574 - protein, 9 aa, Homo Sapiens
WGRGLLAGQ

SEQ ID NO: 662575 - protein, 9 aa, Homo Sapiens
TTEEVTAQK

SEQ ID NO: 662576 - protein, 9 aa, Homo Sapiens
LPTIEVRIN

SEQ ID NO: 662577 - protein, 9 aa, Homo Sapiens
IVAKAIARA

SEQ ID NO: 662578 - protein, 9 aa, Homo Sapiens
RREAENVYG

SEQ ID NO: 662579 - protein, 9 aa, Homo Sapiens
SFQTEYSRM

SEQ ID NO: 662580 - protein, 9 aa, Homo Sapiens
VVGTVAAAA

SEQ ID NO: 662581 - protein, 9 aa, Homo Sapiens
AIPKSEKLL

SEQ ID NO: 662582 - protein, 9 aa, Homo Sapiens
WELPVSIPA

SEQ ID NO: 662583 - protein, 9 aa, Homo Sapiens
DVTCSVAKE

SEQ ID NO: 662584 - protein, 9 aa, Homo Sapiens
HGRKVLGAF

SEQ ID NO: 662585 - protein, 9 aa, Homo Sapiens
LPPNSERNK

SEQ ID NO: 662586 - protein, 9 aa, Homo Sapiens
ISTQNASRA

SEQ ID NO: 662587 - protein, 9 aa, Homo Sapiens
IPDFWVLPS

SEQ ID NO: 662588 - protein, 9 aa, Homo Sapiens
FYTARQNHG

SEQ ID NO: 662589 - protein, 9 aa, Homo Sapiens
TQWELPVSI

SEQ ID NO: 662590 - protein, 9 aa, Homo Sapiens
TQPELSSGY

SEQ ID NO: 662591 - protein, 9 aa, Homo Sapiens
LGYSRHGHH

SEQ ID NO: 662592 - protein, 9 aa, Homo Sapiens
MTHYSADCC

SEQ ID NO: 662593 - protein, 9 aa, Homo Sapiens
AHLQQKNPR

SEQ ID NO: 662594 - protein, 9 aa, Homo Sapiens
PELSSGYLI

SEQ ID NO: 662595 - protein, 9 aa, Homo Sapiens
GEGGAGLGD

SEQ ID NO: 662596 - protein, 9 aa, Homo Sapiens
AKQVVHWDR

SEQ ID NO: 662597 - protein, 9 aa, Homo Sapiens
NCNSNQATD

SEQ ID NO: 662598 - protein, 9 aa, Homo Sapiens
KFLLCSPFD

SEQ ID NO: 662599 - protein, 9 aa, Homo Sapiens
GIYEKQNLT

SEQ ID NO: 662600 - protein, 9 aa, Homo Sapiens
PHNLKICCL

SEQ ID NO: 662601 - protein, 9 aa, Homo Sapiens
FQYCGAHEI

SEQ ID NO: 662602 - protein, 9 aa, Homo Sapiens
VKELFIQIE

SEQ ID NO: 662603 - protein, 9 aa, Homo Sapiens
PKCDNKARA

SEQ ID NO: 662604 - protein, 9 aa, Homo Sapiens
KGEEAEEEP

SEQ ID NO: 662605 - protein, 9 aa, Homo Sapiens
SRMTWCVAA

SEQ ID NO: 662606 - protein, 9 aa, Homo Sapiens
VTVNPYKRL

SEQ ID NO: 662607 - protein, 9 aa, Homo Sapiens
GERNKRKLW

SEQ ID NO: 662608 - protein, 9 aa, Homo Sapiens
LSQALISSF

SEQ ID NO: 662609 - protein, 9 aa, Homo Sapiens
IEEAIQEYP

SEQ ID NO: 662610 - protein, 9 aa, Homo Sapiens
LLAGQAEVE

SEQ ID NO: 662611 - protein, 9 aa, Homo Sapiens
GEKPYQCKK

SEQ ID NO: 662612 - protein, 9 aa, Homo Sapiens
EDEAEELGH

SEQ ID NO: 662613 - protein, 9 aa, Homo Sapiens
TLSFQYCGA

SEQ ID NO: 662614 - protein, 9 aa, Homo Sapiens
VKAHGRKVL

SEQ ID NO: 662615 - protein, 9 aa, Homo Sapiens
KKIEGDLNE

SEQ ID NO: 662616 - protein, 9 aa, Homo Sapiens
RKRRETKAL

SEQ ID NO: 662617 - protein, 9 aa, Homo Sapiens
PSDFHWSAG

SEQ ID NO: 662618 - protein, 9 aa, Homo Sapiens
EKQNLTKIP

SEQ ID NO: 662619 - protein, 9 aa, Homo Sapiens
PSLPEQDPT

SEQ ID NO: 662620 - protein, 9 aa, Homo Sapiens
RSDPNLSRY

SEQ ID NO: 662621 - protein, 9 aa, Homo Sapiens
RMICAGNLQ

SEQ ID NO: 662622 - protein, 9 aa, Homo Sapiens
MYERNPVTP

SEQ ID NO: 662623 - protein, 9 aa, Homo Sapiens
RKCWMFETK

SEQ ID NO: 662624 - protein, 9 aa, Homo Sapiens
QLERQVSEF

SEQ ID NO: 662625 - protein, 9 aa, Homo Sapiens
LITMNCRVC

SEQ ID NO: 662626 - protein, 9 aa, Homo Sapiens
AAPAPLTAR

SEQ ID NO: 662627 - protein, 9 aa, Homo Sapiens
TVTTEVNGM

SEQ ID NO: 662628 - protein, 9 aa, Homo Sapiens
TWGRGLLAG

SEQ ID NO: 662629 - protein, 9 aa, Homo Sapiens
KKKIEGDLN

SEQ ID NO: 662630 - protein, 9 aa, Homo Sapiens
TDRLTLLKT

SEQ ID NO: 662631 - protein, 9 aa, Homo Sapiens
SEFNNNFWQ

SEQ ID NO: 662632 - protein, 9 aa, Homo Sapiens
PAPFPLEPR

SEQ ID NO: 662633 - protein, 9 aa, Homo Sapiens
LVLWLCAAV

SEQ ID NO: 662634 - protein, 9 aa, Homo Sapiens
VTIPSVARS

SEQ ID NO: 662635 - protein, 9 aa, Homo Sapiens
CVTVNPYKR

SEQ ID NO: 662636 - protein, 9 aa, Homo Sapiens
NINIRFGTI

SEQ ID NO: 662637 - protein, 9 aa, Homo Sapiens
KPYQCKKCG

SEQ ID NO: 662638 - protein, 9 aa, Homo Sapiens
SRSRRYLER

SEQ ID NO: 662639 - protein, 9 aa, Homo Sapiens
PATFINIYN

SEQ ID NO: 662640 - protein, 9 aa, Homo Sapiens
GKNCNSNQA

SEQ ID NO: 662641 - protein, 9 aa, Homo Sapiens
YSEARAYVN

SEQ ID NO: 662642 - protein, 9 aa, Homo Sapiens
NNNFWQQME

SEQ ID NO: 662643 - protein, 9 aa, Homo Sapiens
PDFWVLPSC

SEQ ID NO: 662644 - protein, 9 aa, Homo Sapiens
CCLYRGWRG

SEQ ID NO: 662645 - protein, 9 aa, Homo Sapiens
TAQKCHPAG

SEQ ID NO: 662646 - protein, 9 aa, Homo Sapiens
MIQFVEGQF

SEQ ID NO: 662647 - protein, 9 aa, Homo Sapiens
DFHWSAGLV

SEQ ID NO: 662648 - protein, 9 aa, Homo Sapiens
RLTLLKTKP

SEQ ID NO: 662649 - protein, 9 aa, Homo Sapiens
VLTDQAKLK

SEQ ID NO: 662650 - protein, 9 aa, Homo Sapiens
HDVTCSVAK

SEQ ID NO: 662651 - protein, 9 aa, Homo Sapiens
MRRRLSNVS

SEQ ID NO: 662652 - protein, 9 aa, Homo Sapiens
GCVIQRREA

SEQ ID NO: 662653 - protein, 9 aa, Homo Sapiens
YREPGGGGA

SEQ ID NO: 662654 - protein, 9 aa, Homo Sapiens
ANETGHVLG

SEQ ID NO: 662655 - protein, 9 aa, Homo Sapiens
EEELVKVVV

SEQ ID NO: 662656 - protein, 9 aa, Homo Sapiens
LERRYGFTR

SEQ ID NO: 662657 - protein, 9 aa, Homo Sapiens
ISSFADIQL

SEQ ID NO: 662658 - protein, 9 aa, Homo Sapiens
SPECWKATQ

SEQ ID NO: 662659 - protein, 9 aa, Homo Sapiens
SCGIMNTKC

SEQ ID NO: 662660 - protein, 9 aa, Homo Sapiens
ARKKAFDTC

SEQ ID NO: 662661 - protein, 9 aa, Homo Sapiens
ISAYRTQGN

SEQ ID NO: 662662 - protein, 9 aa, Homo Sapiens
TFEGKTYFQ

SEQ ID NO: 662663 - protein, 9 aa, Homo Sapiens
PAAADFLFL

SEQ ID NO: 662664 - protein, 9 aa, Homo Sapiens
TIPSVARSI

SEQ ID NO: 662665 - protein, 9 aa, Homo Sapiens
TSTDRLTLL

SEQ ID NO: 662666 - protein, 9 aa, Homo Sapiens
ERTGEGWGI

SEQ ID NO: 662667 - protein, 9 aa, Homo Sapiens
LRKAEFGKT

SEQ ID NO: 662668 - protein, 9 aa, Homo Sapiens
QATVDTNSQ

SEQ ID NO: 662669 - protein, 9 aa, Homo Sapiens
LGCKDGKNC

SEQ ID NO: 662670 - protein, 9 aa, Homo Sapiens
AFSVVKILR

SEQ ID NO: 662671 - protein, 9 aa, Homo Sapiens
LLQKETTSL

SEQ ID NO: 662672 - protein, 9 aa, Homo Sapiens
FGMTHYSAD

SEQ ID NO: 662673 - protein, 9 aa, Homo Sapiens
AAGCCCLYR

SEQ ID NO: 662674 - protein, 9 aa, Homo Sapiens
SDYTYYSSF

SEQ ID NO: 662675 - protein, 9 aa, Homo Sapiens
AFAHSGPSS

SEQ ID NO: 662676 - protein, 9 aa, Homo Sapiens
EDFEEVAHN

SEQ ID NO: 662677 - protein, 9 aa, Homo Sapiens
DPLIHMTLA

SEQ ID NO: 662678 - protein, 9 aa, Homo Sapiens
NVRDAACYL

SEQ ID NO: 662679 - protein, 9 aa, Homo Sapiens
QRATAFCIL

SEQ ID NO: 662680 - protein, 9 aa, Homo Sapiens
KMQGVGERF

SEQ ID NO: 662681 - protein, 9 aa, Homo Sapiens
QNRYRGHKI

SEQ ID NO: 662682 - protein, 9 aa, Homo Sapiens
VRYDREQGV

SEQ ID NO: 662683 - protein, 9 aa, Homo Sapiens
MNASYTPEV

SEQ ID NO: 662684 - protein, 9 aa, Homo Sapiens
YERNPVTPA

SEQ ID NO: 662685 - protein, 9 aa, Homo Sapiens
RKLSLHSQQ

SEQ ID NO: 662686 - protein, 9 aa, Homo Sapiens
YCMIFTLVS

SEQ ID NO: 662687 - protein, 9 aa, Homo Sapiens
SAFSVVKIL

SEQ ID NO: 662688 - protein, 9 aa, Homo Sapiens
EGNSTTEEV

SEQ ID NO: 662689 - protein, 9 aa, Homo Sapiens
VGKSSLMIQ

SEQ ID NO: 662690 - protein, 9 aa, Homo Sapiens
TDQAKLKKL

SEQ ID NO: 662691 - protein, 9 aa, Homo Sapiens
EECQNRYRG

SEQ ID NO: 662692 - protein, 9 aa, Homo Sapiens
AGEAFPSVP

SEQ ID NO: 662693 - protein, 9 aa, Homo Sapiens
ERNKRKLWQ

SEQ ID NO: 662694 - protein, 9 aa, Homo Sapiens
VRLKHREDA

SEQ ID NO: 662695 - protein, 9 aa, Homo Sapiens
PPLPMVASV

SEQ ID NO: 662696 - protein, 9 aa, Homo Sapiens
GTTQWELPV

SEQ ID NO: 662697 - protein, 9 aa, Homo Sapiens
GAGLGDAVQ

SEQ ID NO: 662698 - protein, 9 aa, Homo Sapiens
SLNSKSREL

SEQ ID NO: 662699 - protein, 9 aa, Homo Sapiens
DPQEEEVAK

SEQ ID NO: 662700 - protein, 9 aa, Homo Sapiens
LLLCMMVVV

SEQ ID NO: 662701 - protein, 9 aa, Homo Sapiens
VWHAGNAGQ

SEQ ID NO: 662702 - protein, 9 aa, Homo Sapiens
LEEGERGWQ

SEQ ID NO: 662703 - protein, 9 aa, Homo Sapiens
NNWLISTQN

SEQ ID NO: 662704 - protein, 9 aa, Homo Sapiens
AENVYGDGV

SEQ ID NO: 662705 - protein, 9 aa, Homo Sapiens
PMVASVPSI

SEQ ID NO: 662706 - protein, 9 aa, Homo Sapiens
IVKKPPTPI

SEQ ID NO: 662707 - protein, 9 aa, Homo Sapiens
PLLVKECTV

SEQ ID NO: 662708 - protein, 9 aa, Homo Sapiens
FVVANETGH

SEQ ID NO: 662709 - protein, 9 aa, Homo Sapiens
GCKDGKNCN

SEQ ID NO: 662710 - protein, 9 aa, Homo Sapiens
IVSLLPTKM

SEQ ID NO: 662711 - protein, 9 aa, Homo Sapiens
ILIARHCFS

SEQ ID NO: 662712 - protein, 9 aa, Homo Sapiens
ISFYQVLQE

SEQ ID NO: 662713 - protein, 9 aa, Homo Sapiens
VKKKIEGDL

SEQ ID NO: 662714 - protein, 9 aa, Homo Sapiens
RISFYQVLQ

SEQ ID NO: 662715 - protein, 9 aa, Homo Sapiens
IGGDLHKGE

SEQ ID NO: 662716 - protein, 9 aa, Homo Sapiens
QYWDAASSS

SEQ ID NO: 662717 - protein, 9 aa, Homo Sapiens
KLPQILSQP

SEQ ID NO: 662718 - protein, 9 aa, Homo Sapiens
LQQDVQTGS

SEQ ID NO: 662719 - protein, 9 aa, Homo Sapiens
QTEYSRMTW

SEQ ID NO: 662720 - protein, 9 aa, Homo Sapiens
DYKTTSILL

SEQ ID NO: 662721 - protein, 9 aa, Homo Sapiens
RKAEFGKTS

SEQ ID NO: 662722 - protein, 9 aa, Homo Sapiens
SLEEGERGW

SEQ ID NO: 662723 - protein, 9 aa, Homo Sapiens
VTKMAFNYL

SEQ ID NO: 662724 - protein, 9 aa, Homo Sapiens
EWGNTSRNT

SEQ ID NO: 662725 - protein, 9 aa, Homo Sapiens
DLSEPGTLS

SEQ ID NO: 662726 - protein, 9 aa, Homo Sapiens
STIPDFWVL

SEQ ID NO: 662727 - protein, 9 aa, Homo Sapiens
HNFGMTHYS

SEQ ID NO: 662728 - protein, 9 aa, Homo Sapiens
NSERNKSQR

SEQ ID NO: 662729 - protein, 9 aa, Homo Sapiens
EEVAHNTYT

SEQ ID NO: 662730 - protein, 9 aa, Homo Sapiens
HLATDVCYK

SEQ ID NO: 662731 - protein, 9 aa, Homo Sapiens
PYKRLPVYK

SEQ ID NO: 662732 - protein, 9 aa, Homo Sapiens
ALPGAEVSG

SEQ ID NO: 662733 - protein, 9 aa, Homo Sapiens
KCHPAGGCV

SEQ ID NO: 662734 - protein, 9 aa, Homo Sapiens
LRKQLERQV

SEQ ID NO: 662735 - protein, 9 aa, Homo Sapiens
LRFNGDSDS

SEQ ID NO: 662736 - protein, 9 aa, Homo Sapiens
PLLDKVRPV

SEQ ID NO: 662737 - protein, 9 aa, Homo Sapiens
RMTWCVAAT

SEQ ID NO: 662738 - protein, 9 aa, Homo Sapiens
SAHLQQKNP

SEQ ID NO: 662739 - protein, 9 aa, Homo Sapiens
RSRSRRYLE

SEQ ID NO: 662740 - protein, 9 aa, Homo Sapiens
QEQSGANDQ

SEQ ID NO: 662741 - protein, 9 aa, Homo Sapiens
SLGPIAKAL

SEQ ID NO: 662742 - protein, 9 aa, Homo Sapiens
FETKPLDIL

SEQ ID NO: 662743 - protein, 9 aa, Homo Sapiens
ECQNRYRGH

SEQ ID NO: 662744 - protein, 9 aa, Homo Sapiens
KIEGDLNEM

SEQ ID NO: 662745 - protein, 9 aa, Homo Sapiens
SLRSLELDV

SEQ ID NO: 662746 - protein, 9 aa, Homo Sapiens
LVSSEWGNT

SEQ ID NO: 662747 - protein, 9 aa, Homo Sapiens
RGWQEPLLP

SEQ ID NO: 662748 - protein, 9 aa, Homo Sapiens
GVEQLLPSL

SEQ ID NO: 662749 - protein, 9 aa, Homo Sapiens
LQQKNPRDK

SEQ ID NO: 662750 - protein, 9 aa, Homo Sapiens
FEEVAHNTY

SEQ ID NO: 662751 - protein, 9 aa, Homo Sapiens
IRFMPHENG

SEQ ID NO: 662752 - protein, 9 aa, Homo Sapiens
LSHQDKLPQ

SEQ ID NO: 662753 - protein, 9 aa, Homo Sapiens
SDPTLRRMC

SEQ ID NO: 662754 - protein, 9 aa, Homo Sapiens
TRLQPLDIL

SEQ ID NO: 662755 - protein, 9 aa, Homo Sapiens
ARQNHGKLN

SEQ ID NO: 662756 - protein, 9 aa, Homo Sapiens
VELELSKEI

SEQ ID NO: 662757 - protein, 9 aa, Homo Sapiens
SGFLKKVEK

SEQ ID NO: 662758 - protein, 9 aa, Homo Sapiens
CMIFTLVSS

SEQ ID NO: 662759 - protein, 9 aa, Homo Sapiens
NEECQNRYR

SEQ ID NO: 662760 - protein, 9 aa, Homo Sapiens
VLRVKKKIE

SEQ ID NO: 662761 - protein, 9 aa, Homo Sapiens
PRSTPREDD

SEQ ID NO: 662762 - protein, 9 aa, Homo Sapiens
TQSLRSLEL

SEQ ID NO: 662763 - protein, 9 aa, Homo Sapiens
TDVCYKTAE

SEQ ID NO: 662764 - protein, 9 aa, Homo Sapiens
RTEYGQRIV

SEQ ID NO: 662765 - protein, 9 aa, Homo Sapiens
VFWTVSLRD

SEQ ID NO: 662766 - protein, 9 aa, Homo Sapiens
MNNNELPLQ

SEQ ID NO: 662767 - protein, 9 aa, Homo Sapiens
TAFCILNGL

SEQ ID NO: 662768 - protein, 9 aa, Homo Sapiens
GSSLPPNSE

SEQ ID NO: 662769 - protein, 9 aa, Homo Sapiens
PALMGCPAS

SEQ ID NO: 662770 - protein, 9 aa, Homo Sapiens
SILLDGRRV

SEQ ID NO: 662771 - protein, 9 aa, Homo Sapiens
YILNPAAAD

SEQ ID NO: 662772 - protein, 9 aa, Homo Sapiens
IEVRINVSR

SEQ ID NO: 662773 - protein, 9 aa, Homo Sapiens
NCTRLQPLD

SEQ ID NO: 662774 - protein, 9 aa, Homo Sapiens
NCSGVMRRR

SEQ ID NO: 662775 - protein, 9 aa, Homo Sapiens
SDTLGIYFT

SEQ ID NO: 662776 - protein, 9 aa, Homo Sapiens
HQDKLPQIL

SEQ ID NO: 662777 - protein, 9 aa, Homo Sapiens
DPQRGGQRE

SEQ ID NO: 662778 - protein, 9 aa, Homo Sapiens
SSTIPDFWV

SEQ ID NO: 662779 - protein, 9 aa, Homo Sapiens
LTFCKLKDA

SEQ ID NO: 662780 - protein, 9 aa, Homo Sapiens
LSKEIVSLL

SEQ ID NO: 662781 - protein, 9 aa, Homo Sapiens
KRLPVYKPE

SEQ ID NO: 662782 - protein, 9 aa, Homo Sapiens
QNQQRKRCP

SEQ ID NO: 662783 - protein, 9 aa, Homo Sapiens
EEEVAKDPQ

SEQ ID NO: 662784 - protein, 9 aa, Homo Sapiens
KAFDTCSSH

SEQ ID NO: 662785 - protein, 9 aa, Homo Sapiens
QQFLGNSHS

SEQ ID NO: 662786 - protein, 9 aa, Homo Sapiens
PLDILGTRM

SEQ ID NO: 662787 - protein, 9 aa, Homo Sapiens
KHREDADIQ

SEQ ID NO: 662788 - protein, 9 aa, Homo Sapiens
RNPVTPASS

SEQ ID NO: 662789 - protein, 9 aa, Homo Sapiens
HLQQKNPRD

SEQ ID NO: 662790 - protein, 9 aa, Homo Sapiens
SSVSSMLPT

SEQ ID NO: 662791 - protein, 9 aa, Homo Sapiens
GDGVLRVWH

SEQ ID NO: 662792 - protein, 9 aa, Homo Sapiens
KCDNKARAH

SEQ ID NO: 662793 - protein, 9 aa, Homo Sapiens
DAACYLCWA

SEQ ID NO: 662794 - protein, 9 aa, Homo Sapiens
QFRSNYLHS

SEQ ID NO: 662795 - protein, 9 aa, Homo Sapiens
RETKALLQS

SEQ ID NO: 662796 - protein, 9 aa, Homo Sapiens
DRMICAGNL

SEQ ID NO: 662797 - protein, 9 aa, Homo Sapiens
LVNGEVVQS

SEQ ID NO: 662798 - protein, 9 aa, Homo Sapiens
RKKAFDTCS

SEQ ID NO: 662799 - protein, 9 aa, Homo Sapiens
DNKARAHPA

SEQ ID NO: 662800 - protein, 9 aa, Homo Sapiens
QIPEGKPKT

SEQ ID NO: 662801 - protein, 9 aa, Homo Sapiens
GLPTIEVRI

SEQ ID NO: 662802 - protein, 9 aa, Homo Sapiens
PQWQLLLCM

SEQ ID NO: 662803 - protein, 9 aa, Homo Sapiens
LAGQAEVEM

SEQ ID NO: 662804 - protein, 9 aa, Homo Sapiens
LVIPNMYER

SEQ ID NO: 662805 - protein, 9 aa, Homo Sapiens
RLTFCKLKD

SEQ ID NO: 662806 - protein, 9 aa, Homo Sapiens
FLGNSHSRF

SEQ ID NO: 662807 - protein, 9 aa, Homo Sapiens
RDSLNSKSR

SEQ ID NO: 662808 - protein, 9 aa, Homo Sapiens
VVDGDFIPA

SEQ ID NO: 662809 - protein, 9 aa, Homo Sapiens
LNPAAADFL

SEQ ID NO: 662810 - protein, 9 aa, Homo Sapiens
WYLAVYADH

SEQ ID NO: 662811 - protein, 9 aa, Homo Sapiens
NYAELIVKK

SEQ ID NO: 662812 - protein, 9 aa, Homo Sapiens
NSKSRELED

SEQ ID NO: 662813 - protein, 9 aa, Homo Sapiens
IPNNCSGVM

SEQ ID NO: 662814 - protein, 9 aa, Homo Sapiens
EYSRMTWCV

SEQ ID NO: 662815 - protein, 9 aa, Homo Sapiens
YDHMIDDRM

SEQ ID NO: 662816 - protein, 9 aa, Homo Sapiens
SLMNASYTP

SEQ ID NO: 662817 - protein, 9 aa, Homo Sapiens
FSSAFVVAN

SEQ ID NO: 662818 - protein, 9 aa, Homo Sapiens
RIQLTTELV

SEQ ID NO: 662819 - protein, 9 aa, Homo Sapiens
QKNPRDKAV

SEQ ID NO: 662820 - protein, 9 aa, Homo Sapiens
YLAVYADHA

SEQ ID NO: 662821 - protein, 9 aa, Homo Sapiens
YFTVKLHWC

SEQ ID NO: 662822 - protein, 9 aa, Homo Sapiens
AGGCVIQRR

SEQ ID NO: 662823 - protein, 9 aa, Homo Sapiens
LSSGYLIST

SEQ ID NO: 662824 - protein, 9 aa, Homo Sapiens
DGVLRVWHA

SEQ ID NO: 662825 - protein, 9 aa, Homo Sapiens
GSQRQWVGR

SEQ ID NO: 662826 - protein, 9 aa, Homo Sapiens
SACPSVGPS

SEQ ID NO: 662827 - protein, 9 aa, Homo Sapiens
RPGYTETTL

SEQ ID NO: 662828 - protein, 9 aa, Homo Sapiens
TMEHSDCAF

SEQ ID NO: 662829 - protein, 9 aa, Homo Sapiens
AYRTQGNIG

SEQ ID NO: 662830 - protein, 9 aa, Homo Sapiens
SVRLKHRED

SEQ ID NO: 662831 - protein, 9 aa, Homo Sapiens
GGISAYRTQ

SEQ ID NO: 662832 - protein, 9 aa, Homo Sapiens
QPKCDNKAR

SEQ ID NO: 662833 - protein, 9 aa, Homo Sapiens
LMGCPASLH

SEQ ID NO: 662834 - protein, 9 aa, Homo Sapiens
AAPRLRRTP

SEQ ID NO: 662835 - protein, 9 aa, Homo Sapiens
YVGFVPVVD

SEQ ID NO: 662836 - protein, 9 aa, Homo Sapiens
SMLPTSETT

SEQ ID NO: 662837 - protein, 9 aa, Homo Sapiens
FIKKSESGF

SEQ ID NO: 662838 - protein, 9 aa, Homo Sapiens
NSALMDISE

SEQ ID NO: 662839 - protein, 9 aa, Homo Sapiens
QWELPVSIP

SEQ ID NO: 662840 - protein, 9 aa, Homo Sapiens
SQRQWVGRS

SEQ ID NO: 662841 - protein, 9 aa, Homo Sapiens
ERNPVTPAS

SEQ ID NO: 662842 - protein, 9 aa, Homo Sapiens
GWLYREPGG

SEQ ID NO: 662843 - protein, 9 aa, Homo Sapiens
YGDGVLRVW

SEQ ID NO: 662844 - protein, 9 aa, Homo Sapiens
LRQGEGGAG

SEQ ID NO: 662845 - protein, 9 aa, Homo Sapiens
RPRGDGQYW

SEQ ID NO: 662846 - protein, 9 aa, Homo Sapiens
MQGVGERFS

SEQ ID NO: 662847 - protein, 9 aa, Homo Sapiens
FPWVRNYGV

SEQ ID NO: 662848 - protein, 9 aa, Homo Sapiens
GEAFPSVPG

SEQ ID NO: 662849 - protein, 9 aa, Homo Sapiens
GLGDAVQEG

SEQ ID NO: 662850 - protein, 9 aa, Homo Sapiens
PSLGVCKAL

SEQ ID NO: 662851 - protein, 9 aa, Homo Sapiens
NILAGYKES

SEQ ID NO: 662852 - protein, 9 aa, Homo Sapiens
AHSGPSSPS

SEQ ID NO: 662853 - protein, 9 aa, Homo Sapiens
LCMMVVVIV

SEQ ID NO: 662854 - protein, 9 aa, Homo Sapiens
YGDMDGFPW

SEQ ID NO: 662855 - protein, 9 aa, Homo Sapiens
GVGERFSTW

SEQ ID NO: 662856 - protein, 9 aa, Homo Sapiens
FPGLDQFRS

SEQ ID NO: 662857 - protein, 9 aa, Homo Sapiens
KGRGILDTL

SEQ ID NO: 662858 - protein, 9 aa, Homo Sapiens
IMNTKCTCP

SEQ ID NO: 662859 - protein, 9 aa, Homo Sapiens
LISSFADIQ

SEQ ID NO: 662860 - protein, 9 aa, Homo Sapiens
EQLLPSLGV

SEQ ID NO: 662861 - protein, 9 aa, Homo Sapiens
IPSVARSIR

SEQ ID NO: 662862 - protein, 9 aa, Homo Sapiens
SQQFLGNSH

SEQ ID NO: 662863 - protein, 9 aa, Homo Sapiens
RTAAPLVLW

SEQ ID NO: 662864 - protein, 9 aa, Homo Sapiens
DYTYYSSFY

SEQ ID NO: 662865 - protein, 9 aa, Homo Sapiens
GAGGSQRQW

SEQ ID NO: 662866 - protein, 9 aa, Homo Sapiens
NLSLYQSEG

SEQ ID NO: 662867 - protein, 9 aa, Homo Sapiens
RATAFCILN

SEQ ID NO: 662868 - protein, 9 aa, Homo Sapiens
GLMALGYSR

SEQ ID NO: 662869 - protein, 9 aa, Homo Sapiens
RASSLDKEA

SEQ ID NO: 662870 - protein, 9 aa, Homo Sapiens
GAAPAPLTA

SEQ ID NO: 662871 - protein, 9 aa, Homo Sapiens
LVTNEECQN

SEQ ID NO: 662872 - protein, 9 aa, Homo Sapiens
RFCSLLVKR

SEQ ID NO: 662873 - protein, 9 aa, Homo Sapiens
VYLVGIADP

SEQ ID NO: 662874 - protein, 9 aa, Homo Sapiens
EPRDAATAA

SEQ ID NO: 662875 - protein, 9 aa, Homo Sapiens
VAHNTYTNA

SEQ ID NO: 662876 - protein, 9 aa, Homo Sapiens
EADAQEQSG

SEQ ID NO: 662877 - protein, 9 aa, Homo Sapiens
ICCLVNGEV

SEQ ID NO: 662878 - protein, 9 aa, Homo Sapiens
QEFDQTFHS

SEQ ID NO: 662879 - protein, 9 aa, Homo Sapiens
ERKVKELFI

SEQ ID NO: 662880 - protein, 9 aa, Homo Sapiens
VEQLLPSLG

SEQ ID NO: 662881 - protein, 9 aa, Homo Sapiens
HSHFISDTD

SEQ ID NO: 662882 - protein, 9 aa, Homo Sapiens
CYKTAEHHF

SEQ ID NO: 662883 - protein, 9 aa, Homo Sapiens
SQALISSFA

SEQ ID NO: 662884 - protein, 9 aa, Homo Sapiens
VKKTSLLVN

SEQ ID NO: 662885 - protein, 9 aa, Homo Sapiens
HQWYLAVYA

SEQ ID NO: 662886 - protein, 9 aa, Homo Sapiens
LVNCQAPRR

SEQ ID NO: 662887 - protein, 9 aa, Homo Sapiens
LDENDKAPA

SEQ ID NO: 662888 - protein, 9 aa, Homo Sapiens
ERQVSEFVQ

SEQ ID NO: 662889 - protein, 9 aa, Homo Sapiens
QVRTAAPLV

SEQ ID NO: 662890 - protein, 9 aa, Homo Sapiens
FIQIEDERQ

SEQ ID NO: 662891 - protein, 9 aa, Homo Sapiens
PNINLSLYQ

SEQ ID NO: 662892 - protein, 9 aa, Homo Sapiens
LESSAFSVV

SEQ ID NO: 662893 - protein, 9 aa, Homo Sapiens
MTWCVAATN

SEQ ID NO: 662894 - protein, 9 aa, Homo Sapiens
DPNLSRYPV

SEQ ID NO: 662895 - protein, 9 aa, Homo Sapiens
DTCSSHVAV

SEQ ID NO: 662896 - protein, 9 aa, Homo Sapiens
DQAKLKKLQ

SEQ ID NO: 662897 - protein, 9 aa, Homo Sapiens
LLCMMVVVI

SEQ ID NO: 662898 - protein, 9 aa, Homo Sapiens
ALMGCPASL

SEQ ID NO: 662899 - protein, 9 aa, Homo Sapiens
WQDFEDREC

SEQ ID NO: 662900 - protein, 9 aa, Homo Sapiens
TQNASRAWG

SEQ ID NO: 662901 - protein, 9 aa, Homo Sapiens
VIMNNNELP

SEQ ID NO: 662902 - protein, 9 aa, Homo Sapiens
TFHSRPGYT

SEQ ID NO: 662903 - protein, 9 aa, Homo Sapiens
ECGHDVTCS

SEQ ID NO: 662904 - protein, 9 aa, Homo Sapiens
VAKAIARAR

SEQ ID NO: 662905 - protein, 9 aa, Homo Sapiens
YHMVTIPSV

SEQ ID NO: 662906 - protein, 9 aa, Homo Sapiens
VLRVWHAGN

SEQ ID NO: 662907 - protein, 9 aa, Homo Sapiens
SSAPMGIYE

SEQ ID NO: 662908 - protein, 9 aa, Homo Sapiens
GNTSRNTDV

SEQ ID NO: 662909 - protein, 9 aa, Homo Sapiens
SHQDKLPQI

SEQ ID NO: 662910 - protein, 9 aa, Homo Sapiens
DFEEVAHNT

SEQ ID NO: 662911 - protein, 9 aa, Homo Sapiens
GFVPVVDGD

SEQ ID NO: 662912 - protein, 9 aa, Homo Sapiens
SRYSRRASS

SEQ ID NO: 662913 - protein, 9 aa, Homo Sapiens
YLYCMIFTL

SEQ ID NO: 662914 - protein, 9 aa, Homo Sapiens
ILNPAAADF

SEQ ID NO: 662915 - protein, 9 aa, Homo Sapiens
AICDKARQN

SEQ ID NO: 662916 - protein, 9 aa, Homo Sapiens
IRFGTILRE

SEQ ID NO: 662917 - protein, 9 aa, Homo Sapiens
RRASSLDKE

SEQ ID NO: 662918 - protein, 9 aa, Homo Sapiens
GLLQRFCSL

SEQ ID NO: 662919 - protein, 9 aa, Homo Sapiens
WALGAGGSQ

SEQ ID NO: 662920 - protein, 9 aa, Homo Sapiens
YRKLRKAEF

SEQ ID NO: 662921 - protein, 9 aa, Homo Sapiens
YRTQGNIGC

SEQ ID NO: 662922 - protein, 9 aa, Homo Sapiens
EAFPSVPGP

SEQ ID NO: 662923 - protein, 9 aa, Homo Sapiens
RRETKALLQ

SEQ ID NO: 662924 - protein, 9 aa, Homo Sapiens
FWQQMENYP

SEQ ID NO: 662925 - protein, 9 aa, Homo Sapiens
ATAFCILNG

SEQ ID NO: 662926 - protein, 9 aa, Homo Sapiens
GMVVGTVAA

SEQ ID NO: 662927 - protein, 9 aa, Homo Sapiens
NINLSLYQS

SEQ ID NO: 662928 - protein, 9 aa, Homo Sapiens
IMNNNELPL

SEQ ID NO: 662929 - protein, 9 aa, Homo Sapiens
GYLISTGST

SEQ ID NO: 662930 - protein, 9 aa, Homo Sapiens
PEEYSEARA

SEQ ID NO: 662931 - protein, 9 aa, Homo Sapiens
ATQRALGCC

SEQ ID NO: 662932 - protein, 9 aa, Homo Sapiens
HNTYTNADK

SEQ ID NO: 662933 - protein, 9 aa, Homo Sapiens
QIVRLRTEY

SEQ ID NO: 662934 - protein, 9 aa, Homo Sapiens
STDRLTLLK

SEQ ID NO: 662935 - protein, 9 aa, Homo Sapiens
DFEDRECLL

SEQ ID NO: 662936 - protein, 9 aa, Homo Sapiens
QWQLLLCMM

SEQ ID NO: 662937 - protein, 9 aa, Homo Sapiens
ALLASNKEP

SEQ ID NO: 662938 - protein, 9 aa, Homo Sapiens
CRFLVIWIL

SEQ ID NO: 662939 - protein, 9 aa, Homo Sapiens
KNKPILNID

SEQ ID NO: 662940 - protein, 9 aa, Homo Sapiens
VVTLSFQYC

SEQ ID NO: 662941 - protein, 9 aa, Homo Sapiens
WGNTSRNTD

SEQ ID NO: 662942 - protein, 9 aa, Homo Sapiens
RLRRTPCGG

SEQ ID NO: 662943 - protein, 9 aa, Homo Sapiens
TLTWGRGLL

SEQ ID NO: 662944 - protein, 9 aa, Homo Sapiens
ACNCTRLQP

SEQ ID NO: 662945 - protein, 9 aa, Homo Sapiens
VRLRTEYGQ

SEQ ID NO: 662946 - protein, 9 aa, Homo Sapiens
TLQDINNIT

SEQ ID NO: 662947 - protein, 9 aa, Homo Sapiens
QTFKGRGIL

SEQ ID NO: 662948 - protein, 9 aa, Homo Sapiens
LMGGPAGGR

SEQ ID NO: 662949 - protein, 9 aa, Homo Sapiens
TGLFASLGP

SEQ ID NO: 662950 - protein, 9 aa, Homo Sapiens
LERQVSEFV

SEQ ID NO: 662951 - protein, 9 aa, Homo Sapiens
KCGKGFNNN

SEQ ID NO: 662952 - protein, 9 aa, Homo Sapiens
CKKCGKGFN

SEQ ID NO: 662953 - protein, 9 aa, Homo Sapiens
FIAILIARH

SEQ ID NO: 662954 - protein, 9 aa, Homo Sapiens
GGGGARPWL

SEQ ID NO: 662955 - protein, 9 aa, Homo Sapiens
IARHCFSLE

SEQ ID NO: 662956 - protein, 9 aa, Homo Sapiens
NASYTPEVI

SEQ ID NO: 662957 - protein, 9 aa, Homo Sapiens
MVASVPSID

SEQ ID NO: 662958 - protein, 9 aa, Homo Sapiens
ASLGPIAKA

SEQ ID NO: 662959 - protein, 9 aa, Homo Sapiens
KLYQTFKGR

SEQ ID NO: 662960 - protein, 9 aa, Homo Sapiens
PTCLSCCPI

SEQ ID NO: 662961 - protein, 9 aa, Homo Sapiens
DGKNCNSNQ

SEQ ID NO: 662962 - protein, 9 aa, Homo Sapiens
ACPSVGPSS

SEQ ID NO: 662963 - protein, 9 aa, Homo Sapiens
DSVIMNNNE

SEQ ID NO: 662964 - protein, 9 aa, Homo Sapiens
VAATNAGTW

SEQ ID NO: 662965 - protein, 9 aa, Homo Sapiens
CLSCCPISA

SEQ ID NO: 662966 - protein, 9 aa, Homo Sapiens
NNCSGVMRR

SEQ ID NO: 662967 - protein, 9 aa, Homo Sapiens
LRSLELDVV

SEQ ID NO: 662968 - protein, 9 aa, Homo Sapiens
DINNITDKL

SEQ ID NO: 662969 - protein, 9 aa, Homo Sapiens
NTPDLVSDY

SEQ ID NO: 662970 - protein, 9 aa, Homo Sapiens
ACYLCWAFA

SEQ ID NO: 662971 - protein, 9 aa, Homo Sapiens
YEADAQEQS

SEQ ID NO: 662972 - protein, 9 aa, Homo Sapiens
MLICTTVTK

SEQ ID NO: 662973 - protein, 9 aa, Homo Sapiens
WVRNYGVVD

SEQ ID NO: 662974 - protein, 9 aa, Homo Sapiens
HTIRFMPHE

SEQ ID NO: 662975 - protein, 9 aa, Homo Sapiens
HLQQDVQTG

SEQ ID NO: 662976 - protein, 9 aa, Homo Sapiens
QQEFDQTFH

SEQ ID NO: 662977 - protein, 9 aa, Homo Sapiens
MTQSLRSLE

SEQ ID NO: 662978 - protein, 9 aa, Homo Sapiens
KLFQSSDPT

SEQ ID NO: 662979 - protein, 9 aa, Homo Sapiens
YKESGMKGQ

SEQ ID NO: 662980 - protein, 9 aa, Homo Sapiens
FKGRGILDT

SEQ ID NO: 662981 - protein, 9 aa, Homo Sapiens
HSGPSSPST

SEQ ID NO: 662982 - protein, 9 aa, Homo Sapiens
TVNPYKRLP

SEQ ID NO: 662983 - protein, 9 aa, Homo Sapiens
LKEGVRLDL

SEQ ID NO: 662984 - protein, 9 aa, Homo Sapiens
MFYTARQNH

SEQ ID NO: 662985 - protein, 9 aa, Homo Sapiens
HAGNAGQRA

SEQ ID NO: 662986 - protein, 9 aa, Homo Sapiens
LVNIVLQCQ

SEQ ID NO: 662987 - protein, 9 aa, Homo Sapiens
LASNKEPML

SEQ ID NO: 662988 - protein, 9 aa, Homo Sapiens
DKAPALLVP

SEQ ID NO: 662989 - protein, 9 aa, Homo Sapiens
WCRFLVIWI

SEQ ID NO: 662990 - protein, 9 aa, Homo Sapiens
LPEQDPTEE

SEQ ID NO: 662991 - protein, 9 aa, Homo Sapiens
PMGIYEKQN

SEQ ID NO: 662992 - protein, 9 aa, Homo Sapiens
ATRIGKNVE

SEQ ID NO: 662993 - protein, 9 aa, Homo Sapiens
STQNASRAW

SEQ ID NO: 662994 - protein, 9 aa, Homo Sapiens
TFHSHFISD

SEQ ID NO: 662995 - protein, 9 aa, Homo Sapiens
TPATAAPPW

SEQ ID NO: 662996 - protein, 9 aa, Homo Sapiens
CDKARQNQQ

SEQ ID NO: 662997 - protein, 9 aa, Homo Sapiens
KSLMNASYT

SEQ ID NO: 662998 - protein, 9 aa, Homo Sapiens
LDQFRSNYL

SEQ ID NO: 662999 - protein, 9 aa, Homo Sapiens
EDPATRIGK

SEQ ID NO: 663000 - protein, 9 aa, Homo Sapiens
FCILNGLCK

SEQ ID NO: 663001 - protein, 9 aa, Homo Sapiens
LRRLRKALL

SEQ ID NO: 663002 - protein, 9 aa, Homo Sapiens
KVKAHGRKV

SEQ ID NO: 663003 - protein, 9 aa, Homo Sapiens
IYEKQNLTK

SEQ ID NO: 663004 - protein, 9 aa, Homo Sapiens
TEYSRMTWC

SEQ ID NO: 663005 - protein, 9 aa, Homo Sapiens
LLVNCQAPR

SEQ ID NO: 663006 - protein, 9 aa, Homo Sapiens
KAPALLVPR

SEQ ID NO: 663007 - protein, 9 aa, Homo Sapiens
KSSLMIQFV

SEQ ID NO: 663008 - protein, 9 aa, Homo Sapiens
RKLRKAEFG

SEQ ID NO: 663009 - protein, 9 aa, Homo Sapiens
STSTDRLTL

SEQ ID NO: 663010 - protein, 9 aa, Homo Sapiens
APRLRRTPC

SEQ ID NO: 663011 - protein, 9 aa, Homo Sapiens
LVKECTVPC

SEQ ID NO: 663012 - protein, 9 aa, Homo Sapiens
AVQEGRQDP

SEQ ID NO: 663013 - protein, 9 aa, Homo Sapiens
RQGEGGAGL

SEQ ID NO: 663014 - protein, 9 aa, Homo Sapiens
CWALGAGGS

SEQ ID NO: 663015 - protein, 9 aa, Homo Sapiens
LAVYADHAD

SEQ ID NO: 663016 - protein, 9 aa, Homo Sapiens
RIVAKAIAR

SEQ ID NO: 663017 - protein, 9 aa, Homo Sapiens
KELFIQIED

SEQ ID NO: 663018 - protein, 9 aa, Homo Sapiens
ELFIQIEDE

SEQ ID NO: 663019 - protein, 9 aa, Homo Sapiens
LVGIADPLI

SEQ ID NO: 663020 - protein, 9 aa, Homo Sapiens
NQRATAFCI

SEQ ID NO: 663021 - protein, 9 aa, Homo Sapiens
HSRPGYTET

SEQ ID NO: 663022 - protein, 9 aa, Homo Sapiens
YSRRASSLD

SEQ ID NO: 663023 - protein, 9 aa, Homo Sapiens
PSSFQTEYS

SEQ ID NO: 663024 - protein, 9 aa, Homo Sapiens
VANETGHVL

SEQ ID NO: 663025 - protein, 9 aa, Homo Sapiens
SLELDVVTI

SEQ ID NO: 663026 - protein, 9 aa, Homo Sapiens
NGMFYTARQ

SEQ ID NO: 663027 - protein, 9 aa, Homo Sapiens
HLPAAPRLR

SEQ ID NO: 663028 - protein, 9 aa, Homo Sapiens
TTGMVVGTV

SEQ ID NO: 663029 - protein, 9 aa, Homo Sapiens
RLGRLTFCK

SEQ ID NO: 663030 - protein, 9 aa, Homo Sapiens
KTLLRDERL

SEQ ID NO: 663031 - protein, 9 aa, Homo Sapiens
RKIKNKPIL

SEQ ID NO: 663032 - protein, 9 aa, Homo Sapiens
SERNKSQRL

SEQ ID NO: 663033 - protein, 9 aa, Homo Sapiens
KSVLTDQAK

SEQ ID NO: 663034 - protein, 9 aa, Homo Sapiens
YSRMTWCVA

SEQ ID NO: 663035 - protein, 9 aa, Homo Sapiens
QPTGSQLDL

SEQ ID NO: 663036 - protein, 9 aa, Homo Sapiens
EVNGMTIPN

SEQ ID NO: 663037 - protein, 9 aa, Homo Sapiens
LIGKYLMGG

SEQ ID NO: 663038 - protein, 9 aa, Homo Sapiens
SLYQSEGSI

SEQ ID NO: 663039 - protein, 9 aa, Homo Sapiens
PAALPGAEV

SEQ ID NO: 663040 - protein, 9 aa, Homo Sapiens
LMALGYSRH

SEQ ID NO: 663041 - protein, 9 aa, Homo Sapiens
SRRYLERRY

SEQ ID NO: 663042 - protein, 9 aa, Homo Sapiens
ECWKATQRA

SEQ ID NO: 663043 - protein, 9 aa, Homo Sapiens
GGDLHKGER

SEQ ID NO: 663044 - protein, 9 aa, Homo Sapiens
WSAGLVALS

SEQ ID NO: 663045 - protein, 9 aa, Homo Sapiens
QSGANDQDF

SEQ ID NO: 663046 - protein, 9 aa, Homo Sapiens
LMNASYTPE

SEQ ID NO: 663047 - protein, 9 aa, Homo Sapiens
SHSRFSRYS

SEQ ID NO: 663048 - protein, 9 aa, Homo Sapiens
MVVGTVAAA

SEQ ID NO: 663049 - protein, 9 aa, Homo Sapiens
VDTNSQQNG

SEQ ID NO: 663050 - protein, 9 aa, Homo Sapiens
SQLDLSEPG

SEQ ID NO: 663051 - protein, 9 aa, Homo Sapiens
LHWCRFLVI

SEQ ID NO: 663052 - protein, 9 aa, Homo Sapiens
LLASNKEPM

SEQ ID NO: 663053 - protein, 9 aa, Homo Sapiens
PLVLWLCAA

SEQ ID NO: 663054 - protein, 9 aa, Homo Sapiens
QGVGERFST

SEQ ID NO: 663055 - protein, 9 aa, Homo Sapiens
QKCHPAGGC

SEQ ID NO: 663056 - protein, 9 aa, Homo Sapiens
TQRALGCCA

SEQ ID NO: 663057 - protein, 9 aa, Homo Sapiens
SSLMIQFVE

SEQ ID NO: 663058 - protein, 9 aa, Homo Sapiens
PSPAALPGA

SEQ ID NO: 663059 - protein, 9 aa, Homo Sapiens
RVWHAGNAG

SEQ ID NO: 663060 - protein, 9 aa, Homo Sapiens
YQTFKGRGI

SEQ ID NO: 663061 - protein, 9 aa, Homo Sapiens
KKAFDTCSS

SEQ ID NO: 663062 - protein, 9 aa, Homo Sapiens
VKLHWCRFL

SEQ ID NO: 663063 - protein, 9 aa, Homo Sapiens
IYNRPIHIT

SEQ ID NO: 663064 - protein, 9 aa, Homo Sapiens
AHNTYTNAD

SEQ ID NO: 663065 - protein, 9 aa, Homo Sapiens
RFSRYSRRA

SEQ ID NO: 663066 - protein, 9 aa, Homo Sapiens
KLHWCRFLV

SEQ ID NO: 663067 - protein, 9 aa, Homo Sapiens
IGKYLMGGP

SEQ ID NO: 663068 - protein, 9 aa, Homo Sapiens
LFSISKEHI

SEQ ID NO: 663069 - protein, 9 aa, Homo Sapiens
TSILLDGRR

SEQ ID NO: 663070 - protein, 9 aa, Homo Sapiens
MALASRPAR

SEQ ID NO: 663071 - protein, 9 aa, Homo Sapiens
ARQNQQRKR

SEQ ID NO: 663072 - protein, 9 aa, Homo Sapiens
EEYSEARAY

SEQ ID NO: 663073 - protein, 9 aa, Homo Sapiens
EGVRLDLVR

SEQ ID NO: 663074 - protein, 9 aa, Homo Sapiens
IQLTTELVF

SEQ ID NO: 663075 - protein, 9 aa, Homo Sapiens
EAKQVVHWD

SEQ ID NO: 663076 - protein, 9 aa, Homo Sapiens
GNAGQRAGE

SEQ ID NO: 663077 - protein, 9 aa, Homo Sapiens
DFHQWYLAV

SEQ ID NO: 663078 - protein, 9 aa, Homo Sapiens
KAIARARAR

SEQ ID NO: 663079 - protein, 9 aa, Homo Sapiens
LYQTFKGRG

SEQ ID NO: 663080 - protein, 9 aa, Homo Sapiens
QLLPSLGVC

SEQ ID NO: 663081 - protein, 9 aa, Homo Sapiens
EPGGGGARP

SEQ ID NO: 663082 - protein, 9 aa, Homo Sapiens
KSLEDPATR

SEQ ID NO: 663083 - protein, 9 aa, Homo Sapiens
VLPSCPPQQ

SEQ ID NO: 663084 - protein, 9 aa, Homo Sapiens
FCKLKDAHD

SEQ ID NO: 663085 - protein, 9 aa, Homo Sapiens
ELSSGYLIS

SEQ ID NO: 663086 - protein, 9 aa, Homo Sapiens
AQHLATDVC

SEQ ID NO: 663087 - protein, 9 aa, Homo Sapiens
GDAVQEGRQ

SEQ ID NO: 663088 - protein, 9 aa, Homo Sapiens
QLLLCMMVV

SEQ ID NO: 663089 - protein, 9 aa, Homo Sapiens
LIVKKPPTP

SEQ ID NO: 663090 - protein, 9 aa, Homo Sapiens
SGYLISTGS

SEQ ID NO: 663091 - protein, 9 aa, Homo Sapiens
KKTSLLVNC

SEQ ID NO: 663092 - protein, 9 aa, Homo Sapiens
VSIYILNPA

SEQ ID NO: 663093 - protein, 9 aa, Homo Sapiens
SRFSRYSRR

SEQ ID NO: 663094 - protein, 9 aa, Homo Sapiens
KPKLDSTHL

SEQ ID NO: 663095 - protein, 9 aa, Homo Sapiens
VARSIRIYE

SEQ ID NO: 663096 - protein, 9 aa, Homo Sapiens
VCYKTAEHH

SEQ ID NO: 663097 - protein, 9 aa, Homo Sapiens
HGSAHLQQK

SEQ ID NO: 663098 - protein, 9 aa, Homo Sapiens
PKAKSGAAQ

SEQ ID NO: 663099 - protein, 9 aa, Homo Sapiens
KAHGRKVLG

SEQ ID NO: 663100 - protein, 9 aa, Homo Sapiens
GIDYKTTSI

SEQ ID NO: 663101 - protein, 9 aa, Homo Sapiens
PGQRKLSLH

SEQ ID NO: 663102 - protein, 9 aa, Homo Sapiens
GQRKLSLHS

SEQ ID NO: 663103 - protein, 9 aa, Homo Sapiens
YISDTLGIY

SEQ ID NO: 663104 - protein, 9 aa, Homo Sapiens
HSRFSRYSR

SEQ ID NO: 663105 - protein, 9 aa, Homo Sapiens
EQDPTEEPQ

SEQ ID NO: 663106 - protein, 9 aa, Homo Sapiens
ALMDISESV

SEQ ID NO: 663107 - protein, 9 aa, Homo Sapiens
QDVQTGSGQ

SEQ ID NO: 663108 - protein, 9 aa, Homo Sapiens
QQKNPRDKA

SEQ ID NO: 663109 - protein, 9 aa, Homo Sapiens
LPQILSQPA

SEQ ID NO: 663110 - protein, 9 aa, Homo Sapiens
QQNGDKLQK

SEQ ID NO: 663111 - protein, 9 aa, Homo Sapiens
YSLLKFLLC

SEQ ID NO: 663112 - protein, 9 aa, Homo Sapiens
DKARQNQQR

SEQ ID NO: 663113 - protein, 9 aa, Homo Sapiens
RQNQQRKRC

SEQ ID NO: 663114 - protein, 9 aa, Homo Sapiens
VKKPPTPIA

SEQ ID NO: 663115 - protein, 9 aa, Homo Sapiens
EAENVYGDG

SEQ ID NO: 663116 - protein, 9 aa, Homo Sapiens
PGPRVLLSA

SEQ ID NO: 663117 - protein, 9 aa, Homo Sapiens
VGTVAAAAL

SEQ ID NO: 663118 - protein, 9 aa, Homo Sapiens
DPATRIGKN

SEQ ID NO: 663119 - protein, 9 aa, Homo Sapiens
CHLPAAPRL

SEQ ID NO: 663120 - protein, 9 aa, Homo Sapiens
RLPLEALLA

SEQ ID NO: 663121 - protein, 9 aa, Homo Sapiens
WNKIGGDLH

SEQ ID NO: 663122 - protein, 9 aa, Homo Sapiens
EELVKVVVA

SEQ ID NO: 663123 - protein, 9 aa, Homo Sapiens
ITDKLRERD

SEQ ID NO: 663124 - protein, 9 aa, Homo Sapiens
GYKESGMKG

SEQ ID NO: 663125 - protein, 9 aa, Homo Sapiens
STQPELSSG

SEQ ID NO: 663126 - protein, 9 aa, Homo Sapiens
RKQLERQVS

SEQ ID NO: 663127 - protein, 9 aa, Homo Sapiens
VRTAAPLVL

SEQ ID NO: 663128 - protein, 9 aa, Homo Sapiens
RLRTEYGQR

SEQ ID NO: 663129 - protein, 9 aa, Homo Sapiens
PPNSERNKS

SEQ ID NO: 663130 - protein, 9 aa, Homo Sapiens
QPLDILGTR

SEQ ID NO: 663131 - protein, 9 aa, Homo Sapiens
VGFVPVVDG

SEQ ID NO: 663132 - protein, 9 aa, Homo Sapiens
STPATAAPP

SEQ ID NO: 663133 - protein, 9 aa, Homo Sapiens
VLGRHIFLR

SEQ ID NO: 663134 - protein, 9 aa, Homo Sapiens
YLERRYGFT

SEQ ID NO: 663135 - protein, 9 aa, Homo Sapiens
CCLVNGEVV

SEQ ID NO: 663136 - protein, 9 aa, Homo Sapiens
KALLQSIGI

SEQ ID NO: 663137 - protein, 9 aa, Homo Sapiens
EFDQTFHSH

SEQ ID NO: 663138 - protein, 9 aa, Homo Sapiens
CSLLVKRQH

SEQ ID NO: 663139 - protein, 9 aa, Homo Sapiens
TVKLHWCRF

SEQ ID NO: 663140 - protein, 9 aa, Homo Sapiens
KDPQRGGQR

SEQ ID NO: 663141 - protein, 9 aa, Homo Sapiens
GIADPLIHM

SEQ ID NO: 663142 - protein, 9 aa, Homo Sapiens
SRRASSLDK

SEQ ID NO: 663143 - protein, 9 aa, Homo Sapiens
LPAAPRLRR

SEQ ID NO: 663144 - protein, 9 aa, Homo Sapiens
ESIPEEYSE

SEQ ID NO: 663145 - protein, 9 aa, Homo Sapiens
LYRGWRGRL

SEQ ID NO: 663146 - protein, 9 aa, Homo Sapiens
KPPTPIAPP

SEQ ID NO: 663147 - protein, 9 aa, Homo Sapiens
QDGAPSLPE

SEQ ID NO: 663148 - protein, 9 aa, Homo Sapiens
GCCCLYRGW

SEQ ID NO: 663149 - protein, 9 aa, Homo Sapiens
KPLDILKEV

SEQ ID NO: 663150 - protein, 9 aa, Homo Sapiens
FYYLYCMIF

SEQ ID NO: 663151 - protein, 9 aa, Homo Sapiens
LADERPSFP

SEQ ID NO: 663152 - protein, 9 aa, Homo Sapiens
PSTGGISAY

SEQ ID NO: 663153 - protein, 9 aa, Homo Sapiens
QRAGEAFPS

SEQ ID NO: 663154 - protein, 9 aa, Homo Sapiens
APFPLEPRD

SEQ ID NO: 663155 - protein, 9 aa, Homo Sapiens
SFQYCGAHE

SEQ ID NO: 663156 - protein, 9 aa, Homo Sapiens
NKIGGDLHK

SEQ ID NO: 663157 - protein, 9 aa, Homo Sapiens
ADERPSFPM

SEQ ID NO: 663158 - protein, 9 aa, Homo Sapiens
HHLQQDVQT

SEQ ID NO: 663159 - protein, 9 aa, Homo Sapiens
VTCSVAKEI

SEQ ID NO: 663160 - protein, 9 aa, Homo Sapiens
ANRIVAKAI

SEQ ID NO: 663161 - protein, 9 aa, Homo Sapiens
DLVRGGRQK

SEQ ID NO: 663162 - protein, 9 aa, Homo Sapiens
VNPYKRLPV

SEQ ID NO: 663163 - protein, 9 aa, Homo Sapiens
LVKVVVAPF

SEQ ID NO: 663164 - protein, 9 aa, Homo Sapiens
MNILAGYKE

SEQ ID NO: 663165 - protein, 9 aa, Homo Sapiens
RGLLAGQAE

SEQ ID NO: 663166 - protein, 9 aa, Homo Sapiens
LTARPPRRR

SEQ ID NO: 663167 - protein, 9 aa, Homo Sapiens
EARKKAFDT

SEQ ID NO: 663168 - protein, 9 aa, Homo Sapiens
NRIVAKAIA

SEQ ID NO: 663169 - protein, 9 aa, Homo Sapiens
CTRLQPLDI

SEQ ID NO: 663170 - protein, 9 aa, Homo Sapiens
AHGRKVLGA

SEQ ID NO: 663171 - protein, 9 aa, Homo Sapiens
DRECLLPGQ

SEQ ID NO: 663172 - protein, 9 aa, Homo Sapiens
RSRRYLERR

SEQ ID NO: 663173 - protein, 9 aa, Homo Sapiens
GLLAGQAEV

SEQ ID NO: 663174 - protein, 9 aa, Homo Sapiens
PLEALLASN

SEQ ID NO: 663175 - protein, 9 aa, Homo Sapiens
GQYWDAASS

SEQ ID NO: 663176 - protein, 9 aa, Homo Sapiens
CDNKARAHP

SEQ ID NO: 663177 - protein, 9 aa, Homo Sapiens
RGGQREEGN

SEQ ID NO: 663178 - protein, 9 aa, Homo Sapiens
INIYNRPIH

SEQ ID NO: 663179 - protein, 9 aa, Homo Sapiens
MGLESSAFS

SEQ ID NO: 663180 - protein, 9 aa, Homo Sapiens
KARQNQQRK

SEQ ID NO: 663181 - protein, 9 aa, Homo Sapiens
LFIQIEDER

SEQ ID NO: 663182 - protein, 9 aa, Homo Sapiens
TTELVFWTV

SEQ ID NO: 663183 - protein, 9 aa, Homo Sapiens
NIRFGTILR

SEQ ID NO: 663184 - protein, 9 aa, Homo Sapiens
IDDRMICAG

SEQ ID NO: 663185 - protein, 9 aa, Homo Sapiens
QYCGAHEID

SEQ ID NO: 663186 - protein, 9 aa, Homo Sapiens
HCFSLEDVV

SEQ ID NO: 663187 - protein, 9 aa, Homo Sapiens
QDKGEEAEE

SEQ ID NO: 663188 - protein, 9 aa, Homo Sapiens
GDKLQIPEG

SEQ ID NO: 663189 - protein, 9 aa, Homo Sapiens
ADAQEQSGA

SEQ ID NO: 663190 - protein, 9 aa, Homo Sapiens
TSRNTDVEK

SEQ ID NO: 663191 - protein, 9 aa, Homo Sapiens
TEARKKAFD

SEQ ID NO: 663192 - protein, 9 aa, Homo Sapiens
WAPTQCHLP

SEQ ID NO: 663193 - protein, 9 aa, Homo Sapiens
LPTSETTFV

SEQ ID NO: 663194 - protein, 9 aa, Homo Sapiens
VNCQAPRRP

SEQ ID NO: 663195 - protein, 9 aa, Homo Sapiens
AMTKLFQSS

SEQ ID NO: 663196 - protein, 9 aa, Homo Sapiens
LEALLASNK

SEQ ID NO: 663197 - protein, 9 aa, Homo Sapiens
TPDLVSDYT

SEQ ID NO: 663198 - protein, 9 aa, Homo Sapiens
ELYLGLRFN

SEQ ID NO: 663199 - protein, 9 aa, Homo Sapiens
AGCCCLYRG

SEQ ID NO: 663200 - protein, 9 aa, Homo Sapiens
LGNSHSRFS

SEQ ID NO: 663201 - protein, 9 aa, Homo Sapiens
FQTEYSRMT

SEQ ID NO: 663202 - protein, 9 aa, Homo Sapiens
FPLEPRDAA

SEQ ID NO: 663203 - protein, 9 aa, Homo Sapiens
NAGQRAGEA

SEQ ID NO: 663204 - protein, 9 aa, Homo Sapiens
YRSDPNLSR

SEQ ID NO: 663205 - protein, 9 aa, Homo Sapiens
SRYPVKPQP

SEQ ID NO: 663206 - protein, 9 aa, Homo Sapiens
IQEYPKAKS

SEQ ID NO: 663207 - protein, 9 aa, Homo Sapiens
GGAGLGDAV

SEQ ID NO: 663208 - protein, 9 aa, Homo Sapiens
WHAGNAGQR

SEQ ID NO: 663209 - protein, 9 aa, Homo Sapiens
LMIQFVEGQ

SEQ ID NO: 663210 - protein, 9 aa, Homo Sapiens
NPKVKAHGR

SEQ ID NO: 663211 - protein, 9 aa, Homo Sapiens
LRDERLNIF

SEQ ID NO: 663212 - protein, 9 aa, Homo Sapiens
MNTKCTCPQ

SEQ ID NO: 663213 - protein, 9 aa, Homo Sapiens
VNIVLQCQQ

SEQ ID NO: 663214 - protein, 9 aa, Homo Sapiens
ESCGIMNTK

SEQ ID NO: 663215 - protein, 9 aa, Homo Sapiens
TGTTQWELP

SEQ ID NO: 663216 - protein, 9 aa, Homo Sapiens
APSLPEQDP

SEQ ID NO: 663217 - protein, 9 aa, Homo Sapiens
LCSPFDEFN

SEQ ID NO: 663218 - protein, 9 aa, Homo Sapiens
RQDPQEEEV

SEQ ID NO: 663219 - protein, 9 aa, Homo Sapiens
GKTSADPEC

SEQ ID NO: 663220 - protein, 9 aa, Homo Sapiens
TMNCRVCVL

SEQ ID NO: 663221 - protein, 9 aa, Homo Sapiens
RDAACYLCW

SEQ ID NO: 663222 - protein, 9 aa, Homo Sapiens
LGDAVQEGR

SEQ ID NO: 663223 - protein, 9 aa, Homo Sapiens
QDFEDRECL

SEQ ID NO: 663224 - protein, 9 aa, Homo Sapiens
VEENSALMD

SEQ ID NO: 663225 - protein, 9 aa, Homo Sapiens
MGGPAGGRL

SEQ ID NO: 663226 - protein, 9 aa, Homo Sapiens
RAGEAFPSV

SEQ ID NO: 663227 - protein, 9 aa, Homo Sapiens
GYTETTLLP

SEQ ID NO: 663228 - protein, 9 aa, Homo Sapiens
SLLCSDITK

SEQ ID NO: 663229 - protein, 9 aa, Homo Sapiens
DGFPWVRNY

SEQ ID NO: 663230 - protein, 9 aa, Homo Sapiens
LLRDERLNI

SEQ ID NO: 663231 - protein, 9 aa, Homo Sapiens
EAIQEYPKA

SEQ ID NO: 663232 - protein, 9 aa, Homo Sapiens
NPAAADFLF

SEQ ID NO: 663233 - protein, 9 aa, Homo Sapiens
PAGGCVIQR

SEQ ID NO: 663234 - protein, 9 aa, Homo Sapiens
APRTHPYSL

SEQ ID NO: 663235 - protein, 9 aa, Homo Sapiens
ICTTVTKMA

SEQ ID NO: 663236 - protein, 9 aa, Homo Sapiens
PLTARPPRR

SEQ ID NO: 663237 - protein, 9 aa, Homo Sapiens
EEGERGWQE

SEQ ID NO: 663238 - protein, 9 aa, Homo Sapiens
NPYKRLPVY

SEQ ID NO: 663239 - protein, 9 aa, Homo Sapiens
HVTISADKS

SEQ ID NO: 663240 - protein, 9 aa, Homo Sapiens
ENDKAPALL

SEQ ID NO: 663241 - protein, 9 aa, Homo Sapiens
KLKDAHDAT

SEQ ID NO: 663242 - protein, 9 aa, Homo Sapiens
TNEECQNRY

SEQ ID NO: 663243 - protein, 9 aa, Homo Sapiens
NEKISLLCS

SEQ ID NO: 663244 - protein, 9 aa, Homo Sapiens
YVKKTSLLV

SEQ ID NO: 663245 - protein, 9 aa, Homo Sapiens
LVFWTVSLR

SEQ ID NO: 663246 - protein, 9 aa, Homo Sapiens
EENSALMDI

SEQ ID NO: 663247 - protein, 9 aa, Homo Sapiens
VGIADPLIH

SEQ ID NO: 663248 - protein, 9 aa, Homo Sapiens
SIYILNPAA

SEQ ID NO: 663249 - protein, 9 aa, Homo Sapiens
DPATFINIY

SEQ ID NO: 663250 - protein, 9 aa, Homo Sapiens
SLGVCKALY

SEQ ID NO: 663251 - protein, 9 aa, Homo Sapiens
GYSRHGHHG

SEQ ID NO: 663252 - protein, 9 aa, Homo Sapiens
LLVKRQHPG

SEQ ID NO: 663253 - protein, 9 aa, Homo Sapiens
ATFINIYNR

SEQ ID NO: 663254 - protein, 9 aa, Homo Sapiens
DENDKAPAL

SEQ ID NO: 663255 - protein, 9 aa, Homo Sapiens
AVVTLSFQY

SEQ ID NO: 663256 - protein, 9 aa, Homo Sapiens
RHVEEAKQV

SEQ ID NO: 663257 - protein, 9 aa, Homo Sapiens
FTVKLHWCR

SEQ ID NO: 663258 - protein, 9 aa, Homo Sapiens
DERPSFPMV

SEQ ID NO: 663259 - protein, 9 aa, Homo Sapiens
PTGSQLDLS

SEQ ID NO: 663260 - protein, 9 aa, Homo Sapiens
AGYKESGMK

SEQ ID NO: 663261 - protein, 9 aa, Homo Sapiens
LDSVIMNNN

SEQ ID NO: 663262 - protein, 9 aa, Homo Sapiens
PGYTETTLL

SEQ ID NO: 663263 - protein, 9 aa, Homo Sapiens
GWQEPLLPL

SEQ ID NO: 663264 - protein, 9 aa, Homo Sapiens
RYSRRASSL

SEQ ID NO: 663265 - protein, 9 aa, Homo Sapiens
AKPKLDSTH

SEQ ID NO: 663266 - protein, 9 aa, Homo Sapiens
EQPKCDNKA

SEQ ID NO: 663267 - protein, 9 aa, Homo Sapiens
PNNCSGVMR

SEQ ID NO: 663268 - protein, 9 aa, Homo Sapiens
LKICCLVNG

SEQ ID NO: 663269 - protein, 9 aa, Homo Sapiens
TGEGWGISV

SEQ ID NO: 663270 - protein, 9 aa, Homo Sapiens
HYVGFVPVV

SEQ ID NO: 663271 - protein, 9 aa, Homo Sapiens
DRKRRETKA

SEQ ID NO: 663272 - protein, 9 aa, Homo Sapiens
THPYSLKID

SEQ ID NO: 663273 - protein, 9 aa, Homo Sapiens
GVLRVWHAG

SEQ ID NO: 663274 - protein, 9 aa, Homo Sapiens
SFADIQLPQ

SEQ ID NO: 663275 - protein, 9 aa, Homo Sapiens
LMLICTTVT

SEQ ID NO: 663276 - protein, 9 aa, Homo Sapiens
DEAEELGHT

SEQ ID NO: 663277 - protein, 9 aa, Homo Sapiens
KIKNKPILN

SEQ ID NO: 663278 - protein, 9 aa, Homo Sapiens
AGIDYKTTS

SEQ ID NO: 663279 - protein, 9 aa, Homo Sapiens
GLRFNGDSD

SEQ ID NO: 663280 - protein, 9 aa, Homo Sapiens
WQEPLLPLR

SEQ ID NO: 663281 - protein, 9 aa, Homo Sapiens
LLRQGEGGA

SEQ ID NO: 663282 - protein, 9 aa, Homo Sapiens
TELVFWTVS

SEQ ID NO: 663283 - protein, 9 aa, Homo Sapiens
VSSMLPTSE

SEQ ID NO: 663284 - protein, 9 aa, Homo Sapiens
IRDSLNSKS

SEQ ID NO: 663285 - protein, 9 aa, Homo Sapiens
FWVLPSCPP

SEQ ID NO: 663286 - protein, 9 aa, Homo Sapiens
ATVDTNSQQ

SEQ ID NO: 663287 - protein, 9 aa, Homo Sapiens
PECWKATQR

SEQ ID NO: 663288 - protein, 9 aa, Homo Sapiens
HNLKICCLV

SEQ ID NO: 663289 - protein, 9 aa, Homo Sapiens
LDSTHLQQL

SEQ ID NO: 663290 - protein, 9 aa, Homo Sapiens
YEQPKCDNK

SEQ ID NO: 663291 - protein, 9 aa, Homo Sapiens
YTARQNHGK

SEQ ID NO: 663292 - protein, 9 aa, Homo Sapiens
CKDGKNCNS

SEQ ID NO: 663293 - protein, 9 aa, Homo Sapiens
VCLEVSDSS

SEQ ID NO: 663294 - protein, 9 aa, Homo Sapiens
KQDKGEEAE

SEQ ID NO: 663295 - protein, 9 aa, Homo Sapiens
NGMPLLVKE

SEQ ID NO: 663296 - protein, 9 aa, Homo Sapiens
KGERNKRKL

SEQ ID NO: 663297 - protein, 9 aa, Homo Sapiens
DQFRSNYLH

SEQ ID NO: 663298 - protein, 9 aa, Homo Sapiens
EALLASNKE

SEQ ID NO: 663299 - protein, 9 aa, Homo Sapiens
KPILNIDPH

SEQ ID NO: 663300 - protein, 9 aa, Homo Sapiens
PNSERNKSQ

SEQ ID NO: 663301 - protein, 9 aa, Homo Sapiens
ALASRPARR

SEQ ID NO: 663302 - protein, 9 aa, Homo Sapiens
TILREDIKE

SEQ ID NO: 663303 - protein, 9 aa, Homo Sapiens
FHWSAGLVA

SEQ ID NO: 663304 - protein, 9 aa, Homo Sapiens
KSEKLLLQK

SEQ ID NO: 663305 - protein, 9 aa, Homo Sapiens
PKLDSTHLQ

SEQ ID NO: 663306 - protein, 9 aa, Homo Sapiens
LKIDGTRTP

SEQ ID NO: 663307 - protein, 9 aa, Homo Sapiens
ELSKEIVSL

SEQ ID NO: 663308 - protein, 9 aa, Homo Sapiens
MMVVVIVLY

SEQ ID NO: 663309 - protein, 9 aa, Homo Sapiens
YSADCCSAS

SEQ ID NO: 663310 - protein, 9 aa, Homo Sapiens
LKQDKGEEA

SEQ ID NO: 663311 - protein, 9 aa, Homo Sapiens
QAVVTLSFQ

SEQ ID NO: 663312 - protein, 9 aa, Homo Sapiens
NVYGDGVLR

SEQ ID NO: 663313 - protein, 9 aa, Homo Sapiens
SAFVVANET

SEQ ID NO: 663314 - protein, 9 aa, Homo Sapiens
EKLLLQKET

SEQ ID NO: 663315 - protein, 9 aa, Homo Sapiens
CLDSVIMNN

SEQ ID NO: 663316 - protein, 9 aa, Homo Sapiens
IDYKTTSIL

SEQ ID NO: 663317 - protein, 9 aa, Homo Sapiens
TTGLFASLG

SEQ ID NO: 663318 - protein, 9 aa, Homo Sapiens
WVLPSCPPQ

SEQ ID NO: 663319 - protein, 9 aa, Homo Sapiens
GHNFGMTHY

SEQ ID NO: 663320 - protein, 9 aa, Homo Sapiens
FLTTGLFAS

SEQ ID NO: 663321 - protein, 9 aa, Homo Sapiens
RQNHGKLNG

SEQ ID NO: 663322 - protein, 9 aa, Homo Sapiens
LPMVASVPS

SEQ ID NO: 663323 - protein, 9 aa, Homo Sapiens
ELPVSIPAD

SEQ ID NO: 663324 - protein, 9 aa, Homo Sapiens
YPKAKSGAA

SEQ ID NO: 663325 - protein, 9 aa, Homo Sapiens
LGIYFTLAM

SEQ ID NO: 663326 - protein, 9 aa, Homo Sapiens
GRLLRQGEG

SEQ ID NO: 663327 - protein, 9 aa, Homo Sapiens
YRLPALMGC

SEQ ID NO: 663328 - protein, 9 aa, Homo Sapiens
TVTKMAFNY

SEQ ID NO: 663329 - protein, 9 aa, Homo Sapiens
KPRSTPRED

SEQ ID NO: 663330 - protein, 9 aa, Homo Sapiens
RLDLVRGGR

SEQ ID NO: 663331 - protein, 9 aa, Homo Sapiens
KAEFGKTSA

SEQ ID NO: 663332 - protein, 9 aa, Homo Sapiens
EQSGANDQD

SEQ ID NO: 663333 - protein, 9 aa, Homo Sapiens
DGQYWDAAS

SEQ ID NO: 663334 - protein, 9 aa, Homo Sapiens
GPAGGRLLR

SEQ ID NO: 663335 - protein, 9 aa, Homo Sapiens
RGAAPAPLT

SEQ ID NO: 663336 - protein, 9 aa, Homo Sapiens
MDPATFINI

SEQ ID NO: 663337 - protein, 9 aa, Homo Sapiens
SEWGNTSRN

SEQ ID NO: 663338 - protein, 9 aa, Homo Sapiens
TAAPLVLWL

SEQ ID NO: 663339 - protein, 9 aa, Homo Sapiens
ELITMNCRV

SEQ ID NO: 663340 - protein, 9 aa, Homo Sapiens
TGSGLVNIV

SEQ ID NO: 663341 - protein, 9 aa, Homo Sapiens
FNNNFWQQM

SEQ ID NO: 663342 - protein, 9 aa, Homo Sapiens
MEHSDCAFM

SEQ ID NO: 663343 - protein, 9 aa, Homo Sapiens
NKARAHPAK

SEQ ID NO: 663344 - protein, 9 aa, Homo Sapiens
QVSEFVQGS

SEQ ID NO: 663345 - protein, 9 aa, Homo Sapiens
GFPWVRNYG

SEQ ID NO: 663346 - protein, 9 aa, Homo Sapiens
EFGKTSADP

SEQ ID NO: 663347 - protein, 9 aa, Homo Sapiens
NSTTEEVTA

SEQ ID NO: 663348 - protein, 9 aa, Homo Sapiens
LCWAFARAY

SEQ ID NO: 663349 - protein, 9 aa, Homo Sapiens
MGIYEKQNL

SEQ ID NO: 663350 - protein, 9 aa, Homo Sapiens
YAELIVKKP

SEQ ID NO: 663351 - protein, 9 aa, Homo Sapiens
EEAKQVVHW

SEQ ID NO: 663352 - protein, 9 aa, Homo Sapiens
PILNIDPHT

SEQ ID NO: 663353 - protein, 9 aa, Homo Sapiens
ERPSFPMVT

SEQ ID NO: 663354 - protein, 9 aa, Homo Sapiens
LTTELVFWT

SEQ ID NO: 663355 - protein, 9 aa, Homo Sapiens
GERFSTWEP

SEQ ID NO: 663356 - protein, 9 aa, Homo Sapiens
IYILNPAAA

SEQ ID NO: 663357 - protein, 9 aa, Homo Sapiens
KICCLVNGE

SEQ ID NO: 663358 - protein, 9 aa, Homo Sapiens
PAPLTARPP

SEQ ID NO: 663359 - protein, 9 aa, Homo Sapiens
NGMTIPNLT

SEQ ID NO: 663360 - protein, 9 aa, Homo Sapiens
TKMAFNYLS

SEQ ID NO: 663361 - protein, 9 aa, Homo Sapiens
SRKSVLTDQ

SEQ ID NO: 663362 - protein, 9 aa, Homo Sapiens
RNKRKLWQD

SEQ ID NO: 663363 - protein, 9 aa, Homo Sapiens
ELIVKKPPT

SEQ ID NO: 663364 - protein, 9 aa, Homo Sapiens
EEEDEAEEL

SEQ ID NO: 663365 - protein, 9 aa, Homo Sapiens
FQSSDPTLR

SEQ ID NO: 663366 - protein, 9 aa, Homo Sapiens
TPREDDSSA

SEQ ID NO: 663367 - protein, 9 aa, Homo Sapiens
SSGYLISTG

SEQ ID NO: 663368 - protein, 9 aa, Homo Sapiens
PWAPTQCHL

SEQ ID NO: 663369 - protein, 9 aa, Homo Sapiens
REDDSSAST

SEQ ID NO: 663370 - protein, 9 aa, Homo Sapiens
ILNIDPHTA

SEQ ID NO: 663371 - protein, 9 aa, Homo Sapiens
CGIMNTKCT

SEQ ID NO: 663372 - protein, 9 aa, Homo Sapiens
LGRLTFCKL

SEQ ID NO: 663373 - protein, 9 aa, Homo Sapiens
QQDVQTGSG

SEQ ID NO: 663374 - protein, 9 aa, Homo Sapiens
FYQVLQEHL

SEQ ID NO: 663375 - protein, 9 aa, Homo Sapiens
LQIPEGKPK

SEQ ID NO: 663376 - protein, 9 aa, Homo Sapiens
VTTEVNGMT

SEQ ID NO: 663377 - protein, 9 aa, Homo Sapiens
NIYNRPIHI

SEQ ID NO: 663378 - protein, 9 aa, Homo Sapiens
SLPEQDPTE

SEQ ID NO: 663379 - protein, 9 aa, Homo Sapiens
APPLPMVAS

SEQ ID NO: 663380 - protein, 9 aa, Homo Sapiens
VDGDFIPAD

SEQ ID NO: 663381 - protein, 9 aa, Homo Sapiens
DKGEEAEEE

SEQ ID NO: 663382 - protein, 9 aa, Homo Sapiens
KANRIVAKA

SEQ ID NO: 663383 - protein, 9 aa, Homo Sapiens
ENCGYVLLS

SEQ ID NO: 663384 - protein, 9 aa, Homo Sapiens
KCWMFETKP

SEQ ID NO: 663385 - protein, 9 aa, Homo Sapiens
LLLQKETTS

SEQ ID NO: 663386 - protein, 9 aa, Homo Sapiens
LTTGLFASL

SEQ ID NO: 663387 - protein, 9 aa, Homo Sapiens
ASRPARRAL

SEQ ID NO: 663388 - protein, 9 aa, Homo Sapiens
PSVPGPRVL

SEQ ID NO: 663389 - protein, 9 aa, Homo Sapiens
PQILSQPAV

SEQ ID NO: 663390 - protein, 9 aa, Homo Sapiens
KATQRALGC

SEQ ID NO: 663391 - protein, 9 aa, Homo Sapiens
LDLSEPGTL

SEQ ID NO: 663392 - protein, 9 aa, Homo Sapiens
SSGLPTIEV

SEQ ID NO: 663393 - protein, 9 aa, Homo Sapiens
VAKDPQRGG

SEQ ID NO: 663394 - protein, 9 aa, Homo Sapiens
ESSAFSVVK

SEQ ID NO: 663395 - protein, 9 aa, Homo Sapiens
SGVMRRRLS

SEQ ID NO: 663396 - protein, 9 aa, Homo Sapiens
RTHPYSLKI

SEQ ID NO: 663397 - protein, 9 aa, Homo Sapiens
LNEKISLLC

SEQ ID NO: 663398 - protein, 9 aa, Homo Sapiens
SSEWGNTSR

SEQ ID NO: 663399 - protein, 9 aa, Homo Sapiens
AVYADHADS

SEQ ID NO: 663400 - protein, 9 aa, Homo Sapiens
VKECTVPCR

SEQ ID NO: 663401 - protein, 9 aa, Homo Sapiens
SLHSQQFLG

SEQ ID NO: 663402 - protein, 9 aa, Homo Sapiens
ETKSLMNAS

SEQ ID NO: 663403 - protein, 9 aa, Homo Sapiens
AFCILNGLC

SEQ ID NO: 663404 - protein, 9 aa, Homo Sapiens
TKPLDILKE

SEQ ID NO: 663405 - protein, 9 aa, Homo Sapiens
EGKTYFQTT

SEQ ID NO: 663406 - protein, 9 aa, Homo Sapiens
SMGLESSAF

SEQ ID NO: 663407 - protein, 9 aa, Homo Sapiens
LTLLKTKPQ

SEQ ID NO: 663408 - protein, 9 aa, Homo Sapiens
RSTPREDDS

SEQ ID NO: 663409 - protein, 9 aa, Homo Sapiens
CLYRGWRGR

SEQ ID NO: 663410 - protein, 9 aa, Homo Sapiens
QRREAENVY

SEQ ID NO: 663411 - protein, 9 aa, Homo Sapiens
EEVTAQKCH

SEQ ID NO: 663412 - protein, 9 aa, Homo Sapiens
CSGVMRRRL

SEQ ID NO: 663413 - protein, 9 aa, Homo Sapiens
NSQQNGDKL

SEQ ID NO: 663414 - protein, 9 aa, Homo Sapiens
CNSNQATDI

SEQ ID NO: 663415 - protein, 9 aa, Homo Sapiens
LYREPGGGG

SEQ ID NO: 663416 - protein, 9 aa, Homo Sapiens
KTSADPECT

SEQ ID NO: 663417 - protein, 9 aa, Homo Sapiens
LYCMIFTLV

SEQ ID NO: 663418 - protein, 9 aa, Homo Sapiens
KLQIPEGKP

SEQ ID NO: 663419 - protein, 9 aa, Homo Sapiens
SSFADIQLP

SEQ ID NO: 663420 - protein, 9 aa, Homo Sapiens
APLTARPPR

SEQ ID NO: 663421 - protein, 9 aa, Homo Sapiens
IPKSEKLLL

SEQ ID NO: 663422 - protein, 9 aa, Homo Sapiens
GLVNIVLQC

SEQ ID NO: 663423 - protein, 9 aa, Homo Sapiens
FVLDENDKA

SEQ ID NO: 663424 - protein, 9 aa, Homo Sapiens
GSGLVNIVL

SEQ ID NO: 663425 - protein, 9 aa, Homo Sapiens
TDRHVEEAK

SEQ ID NO: 663426 - protein, 9 aa, Homo Sapiens
AVSIYILNP

SEQ ID NO: 663427 - protein, 9 aa, Homo Sapiens
SSLDKEASE

SEQ ID NO: 663428 - protein, 9 aa, Homo Sapiens
TIPDFWVLP

SEQ ID NO: 663429 - protein, 9 aa, Homo Sapiens
ENSALMDIS

SEQ ID NO: 663430 - protein, 9 aa, Homo Sapiens
LYLGLRFNG

SEQ ID NO: 663431 - protein, 9 aa, Homo Sapiens
CSDITKLEV

SEQ ID NO: 663432 - protein, 9 aa, Homo Sapiens
QEEEVAKDP

SEQ ID NO: 663433 - protein, 9 aa, Homo Sapiens
TAAPPWAPT

SEQ ID NO: 663434 - protein, 9 aa, Homo Sapiens
DRHVEEAKQ

SEQ ID NO: 663435 - protein, 9 aa, Homo Sapiens
HCLENCGYV

SEQ ID NO: 663436 - protein, 9 aa, Homo Sapiens
FHSRPGYTE

SEQ ID NO: 663437 - protein, 9 aa, Homo Sapiens
HMVTIPSVA

SEQ ID NO: 663438 - protein, 9 aa, Homo Sapiens
LLCSDITKL

SEQ ID NO: 663439 - protein, 9 aa, Homo Sapiens
ESGFLKKVE

SEQ ID NO: 663440 - protein, 9 aa, Homo Sapiens
REAENVYGD

SEQ ID NO: 663441 - protein, 9 aa, Homo Sapiens
LTFEGKTYF

SEQ ID NO: 663442 - protein, 9 aa, Homo Sapiens
ALGAGGSQR

SEQ ID NO: 663443 - protein, 9 aa, Homo Sapiens
TFKGRGILD

SEQ ID NO: 663444 - protein, 9 aa, Homo Sapiens
SSMLPTSET

SEQ ID NO: 663445 - protein, 9 aa, Homo Sapiens
KSESGFLKK

SEQ ID NO: 663446 - protein, 9 aa, Homo Sapiens
VRLDLVRGG

SEQ ID NO: 663447 - protein, 9 aa, Homo Sapiens
CWMFETKPL

SEQ ID NO: 663448 - protein, 9 aa, Homo Sapiens
SEKLLLQKE

SEQ ID NO: 663449 - protein, 9 aa, Homo Sapiens
THLQQLHNQ

SEQ ID NO: 663450 - protein, 9 aa, Homo Sapiens
LRRTPCGGR

SEQ ID NO: 663451 - protein, 9 aa, Homo Sapiens
QEGRQDPQE

SEQ ID NO: 663452 - protein, 9 aa, Homo Sapiens
EETKSLMNA

SEQ ID NO: 663453 - protein, 9 aa, Homo Sapiens
CKLKDAHDA

SEQ ID NO: 663454 - protein, 9 aa, Homo Sapiens
PAAPRLRRT

SEQ ID NO: 663455 - protein, 9 aa, Homo Sapiens
DVQTGSGQR

SEQ ID NO: 663456 - protein, 9 aa, Homo Sapiens
SPSTPATAA

SEQ ID NO: 663457 - protein, 9 aa, Homo Sapiens
QGCLDSVIM

SEQ ID NO: 663458 - protein, 9 aa, Homo Sapiens
LRVKKKIEG

SEQ ID NO: 663459 - protein, 9 aa, Homo Sapiens
INNITDKLR

SEQ ID NO: 663460 - protein, 9 aa, Homo Sapiens
PSTPATAAP

SEQ ID NO: 663461 - protein, 9 aa, Homo Sapiens
KYLMGGPAG

SEQ ID NO: 663462 - protein, 9 aa, Homo Sapiens
EFNNNFWQQ

SEQ ID NO: 663463 - protein, 9 aa, Homo Sapiens
SVPGPRVLL

SEQ ID NO: 663464 - protein, 9 aa, Homo Sapiens
NCRVCVLML

SEQ ID NO: 663465 - protein, 9 aa, Homo Sapiens
TKLFQSSDP

SEQ ID NO: 663466 - protein, 9 aa, Homo Sapiens
NTSRNTDVE

SEQ ID NO: 663467 - protein, 9 aa, Homo Sapiens
IVRLRTEYG

SEQ ID NO: 663468 - protein, 9 aa, Homo Sapiens
RSLELDVVT

SEQ ID NO: 663469 - protein, 9 aa, Homo Sapiens
FLLCSPFDE

SEQ ID NO: 663470 - protein, 9 aa, Homo Sapiens
VFVLDENDK

SEQ ID NO: 663471 - protein, 9 aa, Homo Sapiens
LGAGGSQRQ

SEQ ID NO: 663472 - protein, 9 aa, Homo Sapiens
SSLPPNSER

SEQ ID NO: 663473 - protein, 9 aa, Homo Sapiens
FRSNYLHSR

SEQ ID NO: 663474 - protein, 9 aa, Homo Sapiens
QTFHSHFIS

SEQ ID NO: 663475 - protein, 9 aa, Homo Sapiens
TLLKTKPQS

SEQ ID NO: 663476 - protein, 9 aa, Homo Sapiens
FSVVKILRV

SEQ ID NO: 663477 - protein, 9 aa, Homo Sapiens
DLHKGERNK

SEQ ID NO: 663478 - protein, 9 aa, Homo Sapiens
GGPAGGRLL

SEQ ID NO: 663479 - protein, 9 aa, Homo Sapiens
LLSHQDKLP

SEQ ID NO: 663480 - protein, 9 aa, Homo Sapiens
KESGMKGQI

SEQ ID NO: 663481 - protein, 9 aa, Homo Sapiens
QEYPKAKSG

SEQ ID NO: 663482 - protein, 9 aa, Homo Sapiens
KKLYQTFKG

SEQ ID NO: 663483 - protein, 9 aa, Homo Sapiens
YLVGIADPL

SEQ ID NO: 663484 - protein, 9 aa, Homo Sapiens
ECLLPGQRK

SEQ ID NO: 663485 - protein, 9 aa, Homo Sapiens
HWCRFLVIW

SEQ ID NO: 663486 - protein, 9 aa, Homo Sapiens
GSQLDLSEP

SEQ ID NO: 663487 - protein, 9 aa, Homo Sapiens
IPNMYERNP

SEQ ID NO: 663488 - protein, 9 aa, Homo Sapiens
IFLRRLRKA

SEQ ID NO: 663489 - protein, 9 aa, Homo Sapiens
SSAFSVVKI

SEQ ID NO: 663490 - protein, 9 aa, Homo Sapiens
KDGKNCNSN

SEQ ID NO: 663491 - protein, 9 aa, Homo Sapiens
YSRHGHHGP

SEQ ID NO: 663492 - protein, 9 aa, Homo Sapiens
YLGLRFNGD

SEQ ID NO: 663493 - protein, 9 aa, Homo Sapiens
FLKKVEKGD

SEQ ID NO: 663494 - protein, 9 aa, Homo Sapiens
GLDQFRSNY

SEQ ID NO: 663495 - protein, 9 aa, Homo Sapiens
PTSETTFVS

SEQ ID NO: 663496 - protein, 9 aa, Homo Sapiens
CNCTRLQPL

SEQ ID NO: 663497 - protein, 9 aa, Homo Sapiens
DLVSDYTYY

SEQ ID NO: 663498 - protein, 9 aa, Homo Sapiens
HELITMNCR

SEQ ID NO: 663499 - protein, 9 aa, Homo Sapiens
LERKVKELF

SEQ ID NO: 663500 - protein, 9 aa, Homo Sapiens
NSHSRFSRY

SEQ ID NO: 663501 - protein, 9 aa, Homo Sapiens
RRTPCGGRG

SEQ ID NO: 663502 - protein, 9 aa, Homo Sapiens
LHHHLQQDV

SEQ ID NO: 663503 - protein, 9 aa, Homo Sapiens
VKVVVAPFK

SEQ ID NO: 663504 - protein, 9 aa, Homo Sapiens
VSVEENSAL

SEQ ID NO: 663505 - protein, 9 aa, Homo Sapiens
SLMIQFVEG

SEQ ID NO: 663506 - protein, 9 aa, Homo Sapiens
PQEEEVAKD

SEQ ID NO: 663507 - protein, 9 aa, Homo Sapiens
EGMTQSLRS

SEQ ID NO: 663508 - protein, 9 aa, Homo Sapiens
EEGYRLPAL

SEQ ID NO: 663509 - protein, 9 aa, Homo Sapiens
DHMIDDRMI

SEQ ID NO: 663510 - protein, 9 aa, Homo Sapiens
AKAIARARA

SEQ ID NO: 663511 - protein, 9 aa, Homo Sapiens
RSNYLHSRD

SEQ ID NO: 663512 - protein, 9 aa, Homo Sapiens
KLRKAEFGK

SEQ ID NO: 663513 - protein, 9 aa, Homo Sapiens
QDPQEEEVA

SEQ ID NO: 663514 - protein, 9 aa, Homo Sapiens
GMTIPNLTS

SEQ ID NO: 663515 - protein, 9 aa, Homo Sapiens
GELADERPS

SEQ ID NO: 663516 - protein, 9 aa, Homo Sapiens
DKLPQILSQ

SEQ ID NO: 663517 - protein, 9 aa, Homo Sapiens
QCKKCGKGF

SEQ ID NO: 663518 - protein, 9 aa, Homo Sapiens
APAPLTARP

SEQ ID NO: 663519 - protein, 9 aa, Homo Sapiens
NLKICCLVN

SEQ ID NO: 663520 - protein, 9 aa, Homo Sapiens
SDPNLSRYP

SEQ ID NO: 663521 - protein, 9 aa, Homo Sapiens
KISLLCSDI

SEQ ID NO: 663522 - protein, 9 aa, Homo Sapiens
HSQQFLGNS

SEQ ID NO: 663523 - protein, 9 aa, Homo Sapiens
KLDSTHLQQ

SEQ ID NO: 663524 - protein, 9 aa, Homo Sapiens
VYGDGVLRV

SEQ ID NO: 663525 - protein, 9 aa, Homo Sapiens
RTESCGIMN

SEQ ID NO: 663526 - protein, 9 aa, Homo Sapiens
DNETFRISF

SEQ ID NO: 663527 - protein, 9 aa, Homo Sapiens
QRGGQREEG

SEQ ID NO: 663528 - protein, 9 aa, Homo Sapiens
FEDRECLLP

SEQ ID NO: 663529 - protein, 9 aa, Homo Sapiens
SLLKFLLCS

SEQ ID NO: 663530 - protein, 9 aa, Homo Sapiens
YKTTSILLD

SEQ ID NO: 663531 - protein, 9 aa, Homo Sapiens
WVRYDREQG

SEQ ID NO: 663532 - protein, 9 aa, Homo Sapiens
EEGNSTTEE

SEQ ID NO: 663533 - protein, 9 aa, Homo Sapiens
AEETKSLMN

SEQ ID NO: 663534 - protein, 9 aa, Homo Sapiens
KLWQDFEDR

SEQ ID NO: 663535 - protein, 9 aa, Homo Sapiens
TQCHLPAAP

SEQ ID NO: 663536 - protein, 9 aa, Homo Sapiens
TWCVAATNA

SEQ ID NO: 663537 - protein, 9 aa, Homo Sapiens
TEYGQRIVG

SEQ ID NO: 663538 - protein, 9 aa, Homo Sapiens
FGKTSADPE

SEQ ID NO: 663539 - protein, 9 aa, Homo Sapiens
GRGILDTLK

SEQ ID NO: 663540 - protein, 9 aa, Homo Sapiens
REQGVPTCL

SEQ ID NO: 663541 - protein, 9 aa, Homo Sapiens
SVLTDQAKL

SEQ ID NO: 663542 - protein, 9 aa, Homo Sapiens
GDGQYWDAA

SEQ ID NO: 663543 - protein, 9 aa, Homo Sapiens
RYLERRYGF

SEQ ID NO: 663544 - protein, 9 aa, Homo Sapiens
PHGSAHLQQ

SEQ ID NO: 663545 - protein, 9 aa, Homo Sapiens
NDKAPALLV

SEQ ID NO: 663546 - protein, 9 aa, Homo Sapiens
KSRELEDPG

SEQ ID NO: 663547 - protein, 9 aa, Homo Sapiens
LYDHMIDDR

SEQ ID NO: 663548 - protein, 9 aa, Homo Sapiens
KEGVRLDLV

SEQ ID NO: 663549 - protein, 9 aa, Homo Sapiens
EYPKAKSGA

SEQ ID NO: 663550 - protein, 9 aa, Homo Sapiens
VTLSFQYCG

SEQ ID NO: 663551 - protein, 9 aa, Homo Sapiens
REPGGGGAR

SEQ ID NO: 663552 - protein, 9 aa, Homo Sapiens
GAPSLPEQD

SEQ ID NO: 663553 - protein, 9 aa, Homo Sapiens
STPREDDSS

SEQ ID NO: 663554 - protein, 9 aa, Homo Sapiens
TLTFEGKTY

SEQ ID NO: 663555 - protein, 9 aa, Homo Sapiens
KTSLLVNCQ

SEQ ID NO: 663556 - protein, 9 aa, Homo Sapiens
CQNRYRGHK

SEQ ID NO: 663557 - protein, 9 aa, Homo Sapiens
LMDISESVE

SEQ ID NO: 663558 - protein, 9 aa, Homo Sapiens
NKPILNIDP

SEQ ID NO: 663559 - protein, 9 aa, Homo Sapiens
APPWAPTQC

SEQ ID NO: 663560 - protein, 9 aa, Homo Sapiens
DQTFHSHFI

SEQ ID NO: 663561 - protein, 9 aa, Homo Sapiens
ELVFWTVSL

SEQ ID NO: 663562 - protein, 9 aa, Homo Sapiens
ILTTHTTME

SEQ ID NO: 663563 - protein, 9 aa, Homo Sapiens
LASRPARRA

SEQ ID NO: 663564 - protein, 9 aa, Homo Sapiens
RLQPLDILG

SEQ ID NO: 663565 - protein, 9 aa, Homo Sapiens
KQLERQVSE

SEQ ID NO: 663566 - protein, 9 aa, Homo Sapiens
ENVYGDGVL

SEQ ID NO: 663567 - protein, 9 aa, Homo Sapiens
YWDAASSSG

SEQ ID NO: 663568 - protein, 9 aa, Homo Sapiens
SDFHWSAGL

SEQ ID NO: 663569 - protein, 9 aa, Homo Sapiens
TGGISAYRT

SEQ ID NO: 663570 - protein, 9 aa, Homo Sapiens
QAKLKKLQQ

SEQ ID NO: 663571 - protein, 9 aa, Homo Sapiens
FNGDSDSDS

SEQ ID NO: 663572 - protein, 9 aa, Homo Sapiens
CLVNGEVVQ

SEQ ID NO: 663573 - protein, 9 aa, Homo Sapiens
STTEEVTAQ

SEQ ID NO: 663574 - protein, 9 aa, Homo Sapiens
YEKQNLTKI

SEQ ID NO: 663575 - protein, 9 aa, Homo Sapiens
GGCVIQRRE

SEQ ID NO: 663576 - protein, 9 aa, Homo Sapiens
RPSFPMVTA

SEQ ID NO: 663577 - protein, 9 aa, Homo Sapiens
LHSVRLKHR

SEQ ID NO: 663578 - protein, 9 aa, Homo Sapiens
VRDAACYLC

SEQ ID NO: 663579 - protein, 9 aa, Homo Sapiens
VSDYTYYSS

SEQ ID NO: 663580 - protein, 9 aa, Homo Sapiens
QGEGGAGLG

SEQ ID NO: 663581 - protein, 9 aa, Homo Sapiens
ASSLDKEAS

SEQ ID NO: 663582 - protein, 9 aa, Homo Sapiens
HVEEAKQVV

SEQ ID NO: 663583 - protein, 9 aa, Homo Sapiens
HYSADCCSA

SEQ ID NO: 663584 - protein, 9 aa, Homo Sapiens
SSDPTLRRM

SEQ ID NO: 663585 - protein, 9 aa, Homo Sapiens
YVLLSVTCQ

SEQ ID NO: 663586 - protein, 9 aa, Homo Sapiens
LLKTKPQSI

SEQ ID NO: 663587 - protein, 9 aa, Homo Sapiens
LEDPATRIG

SEQ ID NO: 663588 - protein, 9 aa, Homo Sapiens
RYRSDPNLS

SEQ ID NO: 663589 - protein, 9 aa, Homo Sapiens
SVGKSSLMI

SEQ ID NO: 663590 - protein, 9 aa, Homo Sapiens
LSLYQSEGS

SEQ ID NO: 663591 - protein, 9 aa, Homo Sapiens
APTQCHLPA

SEQ ID NO: 663592 - protein, 9 aa, Homo Sapiens
LTDQAKLKK

SEQ ID NO: 663593 - protein, 9 aa, Homo Sapiens
KRRETKALL

SEQ ID NO: 663594 - protein, 9 aa, Homo Sapiens
SGANDQDFA

SEQ ID NO: 663595 - protein, 9 aa, Homo Sapiens
QALISSFAD

SEQ ID NO: 663596 - protein, 9 aa, Homo Sapiens
ISLLCSDIT

SEQ ID NO: 663597 - protein, 9 aa, Homo Sapiens
PAGGRLLRQ

SEQ ID NO: 663598 - protein, 9 aa, Homo Sapiens
GDLHKGERN

SEQ ID NO: 663599 - protein, 9 aa, Homo Sapiens
ITMNCRVCV

SEQ ID NO: 663600 - protein, 9 aa, Homo Sapiens
LFASLGPIA

SEQ ID NO: 663601 - protein, 9 aa, Homo Sapiens
KKSESGFLK

SEQ ID NO: 663602 - protein, 9 aa, Homo Sapiens
GAFAHSGPS

SEQ ID NO: 663603 - protein, 9 aa, Homo Sapiens
SALMDISES

SEQ ID NO: 663604 - protein, 9 aa, Homo Sapiens
CCCLYRGWR

SEQ ID NO: 663605 - protein, 9 aa, Homo Sapiens
KHTIRFMPH

SEQ ID NO: 663606 - protein, 9 aa, Homo Sapiens
GPSSPSTPA

SEQ ID NO: 663607 - protein, 9 aa, Homo Sapiens
FDTCSSHVA

SEQ ID NO: 663608 - protein, 9 aa, Homo Sapiens
TTHTTMEHS

SEQ ID NO: 663609 - protein, 9 aa, Homo Sapiens
SLLVNCQAP

SEQ ID NO: 663610 - protein, 9 aa, Homo Sapiens
GNSHSRFSR

SEQ ID NO: 663611 - protein, 9 aa, Homo Sapiens
DREQGVPTC

SEQ ID NO: 663612 - protein, 9 aa, Homo Sapiens
SVLGRHIFL

SEQ ID NO: 663613 - protein, 9 aa, Homo Sapiens
MVTIPSVAR

SEQ ID NO: 663614 - protein, 9 aa, Homo Sapiens
VAPPLPMVA

SEQ ID NO: 663615 - protein, 9 aa, Homo Sapiens
EEVAKDPQR

SEQ ID NO: 663616 - protein, 9 aa, Homo Sapiens
PREDDSSAS

SEQ ID NO: 663617 - protein, 9 aa, Homo Sapiens
NLKPRSTPR

SEQ ID NO: 663618 - protein, 9 aa, Homo Sapiens
DSLNSKSRE

SEQ ID NO: 663619 - protein, 9 aa, Homo Sapiens
YLCWAFARA

SEQ ID NO: 663620 - protein, 9 aa, Homo Sapiens
SRELEDPGA

SEQ ID NO: 663621 - protein, 9 aa, Homo Sapiens
QWYLAVYAD

SEQ ID NO: 663622 - protein, 9 aa, Homo Sapiens
SPAALPGAE

SEQ ID NO: 663623 - protein, 9 aa, Homo Sapiens
IEGDLNEME

SEQ ID NO: 663624 - protein, 9 aa, Homo Sapiens
LQDINNITD

SEQ ID NO: 663625 - protein, 9 aa, Homo Sapiens
RFGTILRED

SEQ ID NO: 663626 - protein, 9 aa, Homo Sapiens
FSRYSRRAS

SEQ ID NO: 663627 - protein, 9 aa, Homo Sapiens
TSLLVNCQA

SEQ ID NO: 663628 - protein, 9 aa, Homo Sapiens
FAHSGPSSP

SEQ ID NO: 663629 - protein, 9 aa, Homo Sapiens
PRTHPYSLK

SEQ ID NO: 663630 - protein, 9 aa, Homo Sapiens
PWVRNYGVV

SEQ ID NO: 663631 - protein, 9 aa, Homo Sapiens
GRGLLAGQA

SEQ ID NO: 663632 - protein, 9 aa, Homo Sapiens
LELSKEIVS

SEQ ID NO: 663633 - protein, 9 aa, Homo Sapiens
LKSLEDPAT

SEQ ID NO: 663634 - protein, 9 aa, Homo Sapiens
GERGWQEPL

SEQ ID NO: 663635 - protein, 9 aa, Homo Sapiens
TARQNHGKL

SEQ ID NO: 663636 - protein, 9 aa, Homo Sapiens
GMTQSLRSL

SEQ ID NO: 663637 - protein, 9 aa, Homo Sapiens
QRKLSLHSQ

SEQ ID NO: 663638 - protein, 9 aa, Homo Sapiens
PVVDGDFIP

SEQ ID NO: 663639 - protein, 9 aa, Homo Sapiens
CRVCVLMLL

SEQ ID NO: 663640 - protein, 9 aa, Homo Sapiens
VTAQKCHPA

SEQ ID NO: 663641 - protein, 9 aa, Homo Sapiens
EYSEARAYV

SEQ ID NO: 663642 - protein, 9 aa, Homo Sapiens
LTWGRGLLA

SEQ ID NO: 663643 - protein, 9 aa, Homo Sapiens
GRHIFLRRL

SEQ ID NO: 663644 - protein, 9 aa, Homo Sapiens
NKRKLWQDF

SEQ ID NO: 663645 - protein, 9 aa, Homo Sapiens
QLDLSEPGT

SEQ ID NO: 663646 - protein, 9 aa, Homo Sapiens
TSSVSSMLP

SEQ ID NO: 663647 - protein, 9 aa, Homo Sapiens
LKFLLCSPF

SEQ ID NO: 663648 - protein, 9 aa, Homo Sapiens
MYSLLKFLL

SEQ ID NO: 663649 - protein, 9 aa, Homo Sapiens
APNINLSLY

SEQ ID NO: 663650 - protein, 9 aa, Homo Sapiens
YGQRIVGLI

SEQ ID NO: 663651 - protein, 9 aa, Homo Sapiens
KKCGKGFNN

SEQ ID NO: 663652 - protein, 9 aa, Homo Sapiens
VVANETGHV

SEQ ID NO: 663653 - protein, 9 aa, Homo Sapiens
SVIMNNNEL

SEQ ID NO: 663654 - protein, 9 aa, Homo Sapiens
RQVSEFVQG

SEQ ID NO: 663655 - protein, 9 aa, Homo Sapiens
FMNILAGYK

SEQ ID NO: 663656 - protein, 9 aa, Homo Sapiens
ATAAPPWAP

SEQ ID NO: 663657 - protein, 9 aa, Homo Sapiens
LPGQRKLSL

SEQ ID NO: 663658 - protein, 9 aa, Homo Sapiens
FDQTFHSHF

SEQ ID NO: 663659 - protein, 9 aa, Homo Sapiens
SKEIVSLLP

SEQ ID NO: 663660 - protein, 9 aa, Homo Sapiens
NNFWQQMEN

SEQ ID NO: 663661 - protein, 9 aa, Homo Sapiens
DDRMICAGN

SEQ ID NO: 663662 - protein, 9 aa, Homo Sapiens
PRGAAPAPL

SEQ ID NO: 663663 - protein, 9 aa, Homo Sapiens
NWLISTQNA

SEQ ID NO: 663664 - protein, 9 aa, Homo Sapiens
AQKCHPAGG

SEQ ID NO: 663665 - protein, 9 aa, Homo Sapiens
CVIQRREAE

SEQ ID NO: 663666 - protein, 9 aa, Homo Sapiens
IAILIARHC

SEQ ID NO: 663667 - protein, 9 aa, Homo Sapiens
SLDKEASEC

SEQ ID NO: 663668 - protein, 9 aa, Homo Sapiens
RTGEGWGIS

SEQ ID NO: 663669 - protein, 9 aa, Homo Sapiens
DVCYKTAEH

SEQ ID NO: 663670 - protein, 9 aa, Homo Sapiens
VLDENDKAP

SEQ ID NO: 663671 - protein, 9 aa, Homo Sapiens
FGTILREDI

SEQ ID NO: 663672 - protein, 9 aa, Homo Sapiens
KARAHPAKA

SEQ ID NO: 663673 - protein, 9 aa, Homo Sapiens
GPRVLLSAD

SEQ ID NO: 663674 - protein, 9 aa, Homo Sapiens
AACYLCWAF

SEQ ID NO: 663675 - protein, 9 aa, Homo Sapiens
VPVVDGDFI

SEQ ID NO: 663676 - protein, 9 aa, Homo Sapiens
NETFRISFY

SEQ ID NO: 663677 - protein, 9 aa, Homo Sapiens
AGNAGQRAG

SEQ ID NO: 663678 - protein, 9 aa, Homo Sapiens
APMGIYEKQ

SEQ ID NO: 663679 - protein, 9 aa, Homo Sapiens
AGQRAGEAF

SEQ ID NO: 663680 - protein, 9 aa, Homo Sapiens
PGAEVSGKG

SEQ ID NO: 663681 - protein, 9 aa, Homo Sapiens
KVKELFIQI

SEQ ID NO: 663682 - protein, 9 aa, Homo Sapiens
RHCFSLEDV

SEQ ID NO: 663683 - protein, 9 aa, Homo Sapiens
GLESSAFSV

SEQ ID NO: 663684 - protein, 9 aa, Homo Sapiens
QLTTELVFW

SEQ ID NO: 663685 - protein, 9 aa, Homo Sapiens
SGLVNIVLQ

SEQ ID NO: 663686 - protein, 9 aa, Homo Sapiens
TIRFMPHEN

SEQ ID NO: 663687 - protein, 9 aa, Homo Sapiens
CYLCWAFAR

SEQ ID NO: 663688 - protein, 9 aa, Homo Sapiens
HPYSLKIDG

SEQ ID NO: 663689 - protein, 9 aa, Homo Sapiens
SRSRSRRYL

SEQ ID NO: 663690 - protein, 9 aa, Homo Sapiens
GSSGLPTIE

SEQ ID NO: 663691 - protein, 9 aa, Homo Sapiens
SRPGYTETT

SEQ ID NO: 663692 - protein, 9 aa, Homo Sapiens
VLQCQQLRS

SEQ ID NO: 663693 - protein, 9 aa, Homo Sapiens
VGERFSTWE

SEQ ID NO: 663694 - protein, 9 aa, Homo Sapiens
RLNIFQNLN

SEQ ID NO: 663695 - protein, 9 aa, Homo Sapiens
SVSSMLPTS

SEQ ID NO: 663696 - protein, 9 aa, Homo Sapiens
QGVPTCLSC

SEQ ID NO: 663697 - protein, 9 aa, Homo Sapiens
LKAGDKLQI

SEQ ID NO: 663698 - protein, 9 aa, Homo Sapiens
FHQWYLAVY

SEQ ID NO: 663699 - protein, 9 aa, Homo Sapiens
FMPHENGVH

SEQ ID NO: 663700 - protein, 9 aa, Homo Sapiens
VGPSSFQTE

SEQ ID NO: 663701 - protein, 9 aa, Homo Sapiens
GFLKKVEKG

SEQ ID NO: 663702 - protein, 9 aa, Homo Sapiens
VMRRRLSNV

SEQ ID NO: 663703 - protein, 9 aa, Homo Sapiens
GLFASLGPI

SEQ ID NO: 663704 - protein, 9 aa, Homo Sapiens
PLEPRDAAT

SEQ ID NO: 663705 - protein, 9 aa, Homo Sapiens
QFLGNSHSR

SEQ ID NO: 663706 - protein, 9 aa, Homo Sapiens
TTQWELPVS

SEQ ID NO: 663707 - protein, 9 aa, Homo Sapiens
KTYFQTTLT

SEQ ID NO: 663708 - protein, 9 aa, Homo Sapiens
GCLDSVIMN

SEQ ID NO: 663709 - protein, 9 aa, Homo Sapiens
WMFETKPLD

SEQ ID NO: 663710 - protein, 9 aa, Homo Sapiens
PGLDQFRSN

SEQ ID NO: 663711 - protein, 9 aa, Homo Sapiens
STHLQQLHN

SEQ ID NO: 663712 - protein, 9 aa, Homo Sapiens
ELADERPSF

SEQ ID NO: 663713 - protein, 9 aa, Homo Sapiens
GMFYTARQN

SEQ ID NO: 663714 - protein, 9 aa, Homo Sapiens
PATAAPPWA

SEQ ID NO: 663715 - protein, 9 aa, Homo Sapiens
MVCLEVSDS

SEQ ID NO: 663716 - protein, 9 aa, Homo Sapiens
LPGAEVSGK

SEQ ID NO: 663717 - protein, 9 aa, Homo Sapiens
PLPMVASVP

SEQ ID NO: 663718 - protein, 9 aa, Homo Sapiens
HREDADIQR

SEQ ID NO: 663719 - protein, 9 aa, Homo Sapiens
MALGYSRHG

SEQ ID NO: 663720 - protein, 9 aa, Homo Sapiens
TTMEHSDCA

SEQ ID NO: 663721 - protein, 9 aa, Homo Sapiens
WKATQRALG

SEQ ID NO: 663722 - protein, 9 aa, Homo Sapiens
QEEELVKVV

SEQ ID NO: 663723 - protein, 9 aa, Homo Sapiens
VQEGRQDPQ

SEQ ID NO: 663724 - protein, 9 aa, Homo Sapiens
FASLGPIAK

SEQ ID NO: 663725 - protein, 9 aa, Homo Sapiens
VQTGSGQRS

SEQ ID NO: 663726 - protein, 9 aa, Homo Sapiens
GISAYRTQG

SEQ ID NO: 663727 - protein, 9 aa, Homo Sapiens
ELVKVVVAP

SEQ ID NO: 663728 - protein, 9 aa, Homo Sapiens
GEGWGISVS

SEQ ID NO: 663729 - protein, 9 aa, Homo Sapiens
GSAHLQQKN

SEQ ID NO: 663730 - protein, 9 aa, Homo Sapiens
EVAKDPQRG

SEQ ID NO: 663731 - protein, 9 aa, Homo Sapiens
GRKVLGAFS

SEQ ID NO: 663732 - protein, 9 aa, Homo Sapiens
VTNEECQNR

SEQ ID NO: 663733 - protein, 9 aa, Homo Sapiens
ADPLIHMTL

SEQ ID NO: 663734 - protein, 9 aa, Homo Sapiens
TYFQTTLTP

SEQ ID NO: 663735 - protein, 9 aa, Homo Sapiens
NFWQQMENY

SEQ ID NO: 663736 - protein, 9 aa, Homo Sapiens
TTVTKMAFN

SEQ ID NO: 663737 - protein, 9 aa, Homo Sapiens
THYSADCCS

SEQ ID NO: 663738 - protein, 9 aa, Homo Sapiens
LLQRFCSLL

SEQ ID NO: 663739 - protein, 9 aa, Homo Sapiens
LPSLGVCKA

SEQ ID NO: 663740 - protein, 9 aa, Homo Sapiens
SSAFVVANE

SEQ ID NO: 663741 - protein, 9 aa, Homo Sapiens
ARHCFSLED

SEQ ID NO: 663742 - protein, 9 aa, Homo Sapiens
YNLYISDTL

SEQ ID NO: 663743 - protein, 9 aa, Homo Sapiens
NETGHVLGM

SEQ ID NO: 663744 - protein, 9 aa, Homo Sapiens
LLPSLGVCK

SEQ ID NO: 663745 - protein, 9 aa, Homo Sapiens
TLLRDERLN

SEQ ID NO: 663746 - protein, 9 aa, Homo Sapiens
EGERGWQEP

SEQ ID NO: 663747 - protein, 9 aa, Homo Sapiens
PTGTTQWEL

SEQ ID NO: 663748 - protein, 9 aa, Homo Sapiens
ERNKSQRLE

SEQ ID NO: 663749 - protein, 9 aa, Homo Sapiens
MPHENGVHS

SEQ ID NO: 663750 - protein, 9 aa, Homo Sapiens
ERGWQEPLL

SEQ ID NO: 663751 - protein, 9 aa, Homo Sapiens
RRYLERRYG

SEQ ID NO: 663752 - protein, 9 aa, Homo Sapiens
QRPRGDGQY

SEQ ID NO: 663753 - protein, 9 aa, Homo Sapiens
RFMPHENGV

SEQ ID NO: 663754 - protein, 9 aa, Homo Sapiens
KKPPTPIAP

SEQ ID NO: 663755 - protein, 9 aa, Homo Sapiens
PQRGGQREE

SEQ ID NO: 663756 - protein, 9 aa, Homo Sapiens
LLCSPFDEF

SEQ ID NO: 663757 - protein, 9 aa, Homo Sapiens
KIGGDLHKG

SEQ ID NO: 663758 - protein, 9 aa, Homo Sapiens
HKGERNKRK

SEQ ID NO: 663759 - protein, 9 aa, Homo Sapiens
RHIFLRRLR

SEQ ID NO: 663760 - protein, 9 aa, Homo Sapiens
AQEQSGAND

SEQ ID NO: 663761 - protein, 9 aa, Homo Sapiens
PKSEKLLLQ

SEQ ID NO: 663762 - protein, 9 aa, Homo Sapiens
EEDEAEELG

SEQ ID NO: 663763 - protein, 9 aa, Homo Sapiens
QDKLPQILS

SEQ ID NO: 663764 - protein, 9 aa, Homo Sapiens
RDERLNIFQ

SEQ ID NO: 663765 - protein, 9 aa, Homo Sapiens
NMYERNPVT

SEQ ID NO: 663766 - protein, 9 aa, Homo Sapiens
SAYRTQGNI

SEQ ID NO: 663767 - protein, 9 aa, Homo Sapiens
LQKETTSLQ

SEQ ID NO: 663768 - protein, 9 aa, Homo Sapiens
PLIHMTLAF

SEQ ID NO: 663769 - protein, 9 aa, Homo Sapiens
TIEVRINVS

SEQ ID NO: 663770 - protein, 9 aa, Homo Sapiens
YYLYCMIFT

SEQ ID NO: 663771 - protein, 9 aa, Homo Sapiens
PTIEVRINV

SEQ ID NO: 663772 - protein, 9 aa, Homo Sapiens
ISDTLGIYF

SEQ ID NO: 663773 - protein, 9 aa, Homo Sapiens
SLLVKRQHP

SEQ ID NO: 663774 - protein, 9 aa, Homo Sapiens
VNNWLISTQ

SEQ ID NO: 663775 - protein, 9 aa, Homo Sapiens
RGDGQYWDA

SEQ ID NO: 663776 - protein, 9 aa, Homo Sapiens
QPELSSGYL

SEQ ID NO: 663777 - protein, 9 aa, Homo Sapiens
YLMGGPAGG

SEQ ID NO: 663778 - protein, 9 aa, Homo Sapiens
AGLGDAVQE

SEQ ID NO: 663779 - protein, 9 aa, Homo Sapiens
RFSTWEPTK

SEQ ID NO: 663780 - protein, 9 aa, Homo Sapiens
RKVKELFIQ

SEQ ID NO: 663781 - protein, 9 aa, Homo Sapiens
QCHLPAAPR

SEQ ID NO: 663782 - protein, 9 aa, Homo Sapiens
CSVAKEIIY

SEQ ID NO: 663783 - protein, 9 aa, Homo Sapiens
LLPGQRKLS

SEQ ID NO: 663784 - protein, 9 aa, Homo Sapiens
GDMDGFPWV

SEQ ID NO: 663785 - protein, 9 aa, Homo Sapiens
LSEPGTLSS

SEQ ID NO: 663786 - protein, 9 aa, Homo Sapiens
MPLLVKECT

SEQ ID NO: 663787 - protein, 9 aa, Homo Sapiens
AAPLVLWLC

SEQ ID NO: 663788 - protein, 9 aa, Homo Sapiens
AGGRLLRQG

SEQ ID NO: 663789 - protein, 9 aa, Homo Sapiens
QSLRSLELD

SEQ ID NO: 663790 - protein, 9 aa, Homo Sapiens
MDGFPWVRN

SEQ ID NO: 663791 - protein, 9 aa, Homo Sapiens
CESIPEEYS

SEQ ID NO: 663792 - protein, 9 aa, Homo Sapiens
ISKEHIECR

SEQ ID NO: 663793 - protein, 9 aa, Homo Sapiens
SGPSSPSTP

SEQ ID NO: 663794 - protein, 9 aa, Homo Sapiens
AFVVANETG

SEQ ID NO: 663795 - protein, 9 aa, Homo Sapiens
DGSSGLPTI

SEQ ID NO: 663796 - protein, 9 aa, Homo Sapiens
HWSAGLVAL

SEQ ID NO: 663797 - protein, 9 aa, Homo Sapiens
TPCGGRGGT

SEQ ID NO: 663798 - protein, 9 aa, Homo Sapiens
TEEVTAQKC

SEQ ID NO: 663799 - protein, 9 aa, Homo Sapiens
PSVARSIRI

SEQ ID NO: 663800 - protein, 9 aa, Homo Sapiens
FCSLLVKRQ

SEQ ID NO: 663801 - protein, 9 aa, Homo Sapiens
TNQRATAFC

SEQ ID NO: 663802 - protein, 9 aa, Homo Sapiens
LQPLDILGT

SEQ ID NO: 663803 - protein, 9 aa, Homo Sapiens
SAPMGIYEK

SEQ ID NO: 663804 - protein, 9 aa, Homo Sapiens
FADIQLPQM

SEQ ID NO: 663805 - protein, 9 aa, Homo Sapiens
SCESIPEEY

SEQ ID NO: 663806 - protein, 9 aa, Homo Sapiens
NQQRKRCPN

SEQ ID NO: 663807 - protein, 9 aa, Homo Sapiens
FRISFYQVL

SEQ ID NO: 663808 - protein, 9 aa, Homo Sapiens
TTFHSRPGY

SEQ ID NO: 663809 - protein, 9 aa, Homo Sapiens
IPEEYSEAR

SEQ ID NO: 663810 - protein, 9 aa, Homo Sapiens
SSPSTPATA

SEQ ID NO: 663811 - protein, 9 aa, Homo Sapiens
AILIARHCF

SEQ ID NO: 663812 - protein, 9 aa, Homo Sapiens
HTTMEHSDC

SEQ ID NO: 663813 - protein, 9 aa, Homo Sapiens
GRQDPQEEE

SEQ ID NO: 663814 - protein, 9 aa, Homo Sapiens
SKSRELEDP

SEQ ID NO: 663815 - protein, 9 aa, Homo Sapiens
GTILREDIK

SEQ ID NO: 663816 - protein, 9 aa, Homo Sapiens
KTTSILLDG

SEQ ID NO: 663817 - protein, 9 aa, Homo Sapiens
DAVQEGRQD

SEQ ID NO: 663818 - protein, 9 aa, Homo Sapiens
SGLPTIEVR

SEQ ID NO: 663819 - protein, 9 aa, Homo Sapiens
EVAHNTYTN

SEQ ID NO: 663820 - protein, 9 aa, Homo Sapiens
YDREQGVPT

SEQ ID NO: 663821 - protein, 9 aa, Homo Sapiens
LPALMGCPA

SEQ ID NO: 663822 - protein, 9 aa, Homo Sapiens
GQREEGNST

SEQ ID NO: 663823 - protein, 9 aa, Homo Sapiens
CCPISACPS

SEQ ID NO: 663824 - protein, 9 aa, Homo Sapiens
GTVAAAALC

SEQ ID NO: 663825 - protein, 9 aa, Homo Sapiens
GGSQRQWVG

SEQ ID NO: 663826 - protein, 9 aa, Homo Sapiens
FEGKTYFQT

SEQ ID NO: 663827 - protein, 9 aa, Homo Sapiens
ALISSFADI

SEQ ID NO: 663828 - protein, 9 aa, Homo Sapiens
VEEAKQVVH

SEQ ID NO: 663829 - protein, 9 aa, Homo Sapiens
LAGYKESGM

SEQ ID NO: 663830 - protein, 9 aa, Homo Sapiens
GKTLLRDER

SEQ ID NO: 663831 - protein, 9 aa, Homo Sapiens
NTKCTCPQH

SEQ ID NO: 663832 - protein, 9 aa, Homo Sapiens
IVLQCQQLR

SEQ ID NO: 663833 - protein, 9 aa, Homo Sapiens
QREEGNSTT

SEQ ID NO: 663834 - protein, 9 aa, Homo Sapiens
LDRKRRETK

SEQ ID NO: 663835 - protein, 9 aa, Homo Sapiens
HIFLRRLRK

SEQ ID NO: 663836 - protein, 9 aa, Homo Sapiens
AFPSVPGPR

SEQ ID NO: 663837 - protein, 9 aa, Homo Sapiens
ASNKEPMLP

SEQ ID NO: 663838 - protein, 9 aa, Homo Sapiens
TCLSCCPIS

SEQ ID NO: 663839 - protein, 9 aa, Homo Sapiens
GHVTISADK

SEQ ID NO: 663840 - protein, 9 aa, Homo Sapiens
DAQEQSGAN

SEQ ID NO: 663841 - protein, 9 aa, Homo Sapiens
PKVKAHGRK

SEQ ID NO: 663842 - protein, 9 aa, Homo Sapiens
LNIDPHTAE

SEQ ID NO: 663843 - protein, 9 aa, Homo Sapiens
GLVALSYSS

SEQ ID NO: 663844 - protein, 9 aa, Homo Sapiens
RECLLPGQR

SEQ ID NO: 663845 - protein, 9 aa, Homo Sapiens
LPLEALLAS

SEQ ID NO: 663846 - protein, 9 aa, Homo Sapiens
LENCGYVLL

SEQ ID NO: 663847 - protein, 9 aa, Homo Sapiens
EYGQRIVGL

SEQ ID NO: 663848 - protein, 9 aa, Homo Sapiens
NGDSDSDSQ

SEQ ID NO: 663849 - protein, 9 aa, Homo Sapiens
SFPMVTAPL

SEQ ID NO: 663850 - protein, 9 aa, Homo Sapiens
CHPAGGCVI

SEQ ID NO: 663851 - protein, 9 aa, Homo Sapiens
NITDKLRER

SEQ ID NO: 663852 - protein, 9 aa, Homo Sapiens
GKTYFQTTL

SEQ ID NO: 663853 - protein, 9 aa, Homo Sapiens
EVAPPLPMV

SEQ ID NO: 663854 - protein, 9 aa, Homo Sapiens
GPSSFQTEY

SEQ ID NO: 663855 - protein, 9 aa, Homo Sapiens
NLSRYPVKP

SEQ ID NO: 663856 - protein, 9 aa, Homo Sapiens
TTSILLDGR

SEQ ID NO: 663857 - protein, 9 aa, Homo Sapiens
CILNGLCKF

SEQ ID NO: 663858 - protein, 9 aa, Homo Sapiens
LATDVCYKT

SEQ ID NO: 663859 - protein, 9 aa, Homo Sapiens
SLEDPATRI

SEQ ID NO: 663860 - protein, 9 aa, Homo Sapiens
NRYRGHKIT

SEQ ID NO: 663861 - protein, 9 aa, Homo Sapiens
YQCKKCGKG

SEQ ID NO: 663862 - protein, 9 aa, Homo Sapiens
WCVAATNAG

SEQ ID NO: 663863 - protein, 9 aa, Homo Sapiens
ETKPLDILK

SEQ ID NO: 663864 - protein, 9 aa, Homo Sapiens
LRVWHAGNA

SEQ ID NO: 663865 - protein, 9 aa, Homo Sapiens
ATDVCYKTA

SEQ ID NO: 663866 - protein, 9 aa, Homo Sapiens
PSVGPSSFQ

SEQ ID NO: 663867 - protein, 9 aa, Homo Sapiens
VIPNMYERN

SEQ ID NO: 663868 - protein, 9 aa, Homo Sapiens
GRLTFCKLK

SEQ ID NO: 663869 - protein, 9 aa, Homo Sapiens
RLLRQGEGG

SEQ ID NO: 663870 - protein, 9 aa, Homo Sapiens
LHSQQFLGN

SEQ ID NO: 663871 - protein, 9 aa, Homo Sapiens
PISACPSVG

SEQ ID NO: 663872 - protein, 9 aa, Homo Sapiens
AKDPQRGGQ

SEQ ID NO: 663873 - protein, 9 aa, Homo Sapiens
DERLNIFQN

SEQ ID NO: 663874 - protein, 9 aa, Homo Sapiens
MTKLFQSSD

SEQ ID NO: 663875 - protein, 9 aa, Homo Sapiens
YKRLPVYKP

SEQ ID NO: 663876 - protein, 9 aa, Homo Sapiens
AFDTCSSHV

SEQ ID NO: 663877 - protein, 9 aa, Homo Sapiens
LVRGGRQKY

SEQ ID NO: 663878 - protein, 9 aa, Homo Sapiens
EQGVPTCLS

SEQ ID NO: 663879 - protein, 9 aa, Homo Sapiens
MNCRVCVLM

SEQ ID NO: 663880 - protein, 9 aa, Homo Sapiens
LSCCPISAC

SEQ ID NO: 663881 - protein, 9 aa, Homo Sapiens
QSSDPTLRR

SEQ ID NO: 663882 - protein, 9 aa, Homo Sapiens
GYVLLSVTC

SEQ ID NO: 663883 - protein, 9 aa, Homo Sapiens
KLLLQKETT

SEQ ID NO: 663884 - protein, 9 aa, Homo Sapiens
TFCKLKDAH

SEQ ID NO: 663885 - protein, 9 aa, Homo Sapiens
FHSHFISDT

SEQ ID NO: 663886 - protein, 9 aa, Homo Sapiens
EGRQDPQEE

SEQ ID NO: 663887 - protein, 9 aa, Homo Sapiens
GVRLDLVRG

SEQ ID NO: 663888 - protein, 9 aa, Homo Sapiens
ICDKARQNQ

SEQ ID NO: 663889 - protein, 9 aa, Homo Sapiens
IWAAGCCCL

SEQ ID NO: 663890 - protein, 9 aa, Homo Sapiens
RLPALMGCP

SEQ ID NO: 663891 - protein, 9 aa, Homo Sapiens
SESGFLKKV

SEQ ID NO: 663892 - protein, 9 aa, Homo Sapiens
DRLTLLKTK

SEQ ID NO: 663893 - protein, 9 aa, Homo Sapiens
LISTQNASR

SEQ ID NO: 663894 - protein, 9 aa, Homo Sapiens
LYQSEGSIL

SEQ ID NO: 663895 - protein, 9 aa, Homo Sapiens
TLGIYFTLA

SEQ ID NO: 663896 - protein, 9 aa, Homo Sapiens
TCSVAKEII

SEQ ID NO: 663897 - protein, 9 aa, Homo Sapiens
YSLKIDGTR

SEQ ID NO: 663898 - protein, 9 aa, Homo Sapiens
LRTEYGQRI

SEQ ID NO: 663899 - protein, 9 aa, Homo Sapiens
GAEVSGKGP

SEQ ID NO: 663900 - protein, 9 aa, Homo Sapiens
SNYLHSRDY

SEQ ID NO: 663901 - protein, 9 aa, Homo Sapiens
SGLMALGYS

SEQ ID NO: 663902 - protein, 9 aa, Homo Sapiens
PDLVSDYTY

SEQ ID NO: 663903 - protein, 9 aa, Homo Sapiens
LLVKECTVP

SEQ ID NO: 663904 - protein, 9 aa, Homo Sapiens
STGGISAYR

SEQ ID NO: 663905 - protein, 9 aa, Homo Sapiens
WQLLLCMMV

SEQ ID NO: 663906 - protein, 9 aa, Homo Sapiens
LGLRFNGDS

SEQ ID NO: 663907 - protein, 9 aa, Homo Sapiens
ETKALLQSI

SEQ ID NO: 663908 - protein, 9 aa, Homo Sapiens
PRDAATAAA

SEQ ID NO: 663909 - protein, 9 aa, Homo Sapiens
RYDREQGVP

SEQ ID NO: 663910 - protein, 9 aa, Homo Sapiens
KRKLWQDFE

SEQ ID NO: 663911 - protein, 9 aa, Homo Sapiens
GNSTTEEVT

SEQ ID NO: 663912 - protein, 9 aa, Homo Sapiens
LSFQYCGAH

SEQ ID NO: 663913 - protein, 9 aa, Homo Sapiens
CMMVVVIVL

SEQ ID NO: 663914 - protein, 9 aa, Homo Sapiens
IKKSESGFL

SEQ ID NO: 663915 - protein, 9 aa, Homo Sapiens
LICTTVTKM

SEQ ID NO: 663916 - protein, 9 aa, Homo Sapiens
VASVPSIDS

SEQ ID NO: 663917 - protein, 9 aa, Homo Sapiens
KGWLYREPG

SEQ ID NO: 663918 - protein, 9 aa, Homo Sapiens
CWKATQRAL

SEQ ID NO: 663919 - protein, 9 aa, Homo Sapiens
VSSEWGNTS

SEQ ID NO: 663920 - protein, 9 aa, Homo Sapiens
VPGPRVLLS

SEQ ID NO: 663921 - protein, 9 aa, Homo Sapiens
PRLRRTPCG

SEQ ID NO: 663922 - protein, 9 aa, Homo Sapiens
GKSSLMIQF

SEQ ID NO: 663923 - protein, 9 aa, Homo Sapiens
CLENCGYVL

SEQ ID NO: 663924 - protein, 9 aa, Homo Sapiens
RSVGKSSLM

SEQ ID NO: 663925 - protein, 9 aa, Homo Sapiens
RVKKKIEGD

SEQ ID NO: 663926 - protein, 9 aa, Homo Sapiens
NIVLQCQQL

SEQ ID NO: 663927 - protein, 9 aa, Homo Sapiens
GGQREEGNS

SEQ ID NO: 663928 - protein, 9 aa, Homo Sapiens
YHCLENCGY

SEQ ID NO: 663929 - protein, 9 aa, Homo Sapiens
DFWVLPSCP

SEQ ID NO: 663930 - protein, 9 aa, Homo Sapiens
LCSDITKLE

SEQ ID NO: 663931 - protein, 9 aa, Homo Sapiens
RKSVLTDQA

SEQ ID NO: 663932 - protein, 9 aa, Homo Sapiens
RDAATAAAR

SEQ ID NO: 663933 - protein, 9 aa, Homo Sapiens
ALKQDKGEE

SEQ ID NO: 663934 - protein, 9 aa, Homo Sapiens
ILAGYKESG

SEQ ID NO: 663935 - protein, 9 aa, Homo Sapiens
LEPRDAATA

SEQ ID NO: 663936 - protein, 9 aa, Homo Sapiens
TFINIYNRP

SEQ ID NO: 663937 - protein, 9 aa, Homo Sapiens
SQQNGDKLQ

SEQ ID NO: 663938 - protein, 9 aa, Homo Sapiens
SILTTHTTM

SEQ ID NO: 663939 - protein, 9 aa, Homo Sapiens
HLQQLHNQV

SEQ ID NO: 663940 - protein, 9 aa, Homo Sapiens
PNLSRYPVK

SEQ ID NO: 663941 - protein, 9 aa, Homo Sapiens
AGDKLQIPE

SEQ ID NO: 663942 - protein, 9 aa, Homo Sapiens
DTLGIYFTL

SEQ ID NO: 663943 - protein, 9 aa, Homo Sapiens
MIDDRMICA

SEQ ID NO: 663944 - protein, 9 aa, Homo Sapiens
CLLPGQRKL

SEQ ID NO: 663945 - protein, 9 aa, Homo Sapiens
WSGLMALGY

SEQ ID NO: 663946 - protein, 9 aa, Homo Sapiens
LGRHIFLRR

SEQ ID NO: 663947 - protein, 9 aa, Homo Sapiens
GVMRRRLSN

SEQ ID NO: 663948 - protein, 9 aa, Homo Sapiens
LHELITMNC

SEQ ID NO: 663949 - protein, 9 aa, Homo Sapiens
SVAKEIIYT

SEQ ID NO: 663950 - protein, 9 aa, Homo Sapiens
EIVSLLPTK

SEQ ID NO: 663951 - protein, 9 aa, Homo Sapiens
KECTVPCRE

SEQ ID NO: 663952 - protein, 9 aa, Homo Sapiens
PTQCHLPAA

SEQ ID NO: 663953 - protein, 9 aa, Homo Sapiens
DKLQIPEGK

SEQ ID NO: 663954 - protein, 9 aa, Homo Sapiens
RKVLGAFSD

SEQ ID NO: 663955 - protein, 9 aa, Homo Sapiens
AGGSQRQWV

SEQ ID NO: 663956 - protein, 9 aa, Homo Sapiens
FLRRLRKAL

SEQ ID NO: 663957 - protein, 9 aa, Homo Sapiens
LYISDTLGI

SEQ ID NO: 663958 - protein, 9 aa, Homo Sapiens
LTTHTTMEH

SEQ ID NO: 663959 - protein, 9 aa, Homo Sapiens
SQEEELVKV

SEQ ID NO: 663960 - protein, 9 aa, Homo Sapiens
EKPYQCKKC

SEQ ID NO: 663961 - protein, 9 aa, Homo Sapiens
DLKSLEDPA

SEQ ID NO: 663962 - protein, 9 aa, Homo Sapiens
WLISTQNAS

SEQ ID NO: 663963 - protein, 9 aa, Homo Sapiens
KLSLHSQQF

SEQ ID NO: 663964 - protein, 9 aa, Homo Sapiens
KAGDKLQIP

SEQ ID NO: 663965 - protein, 9 aa, Homo Sapiens
SVARSIRIY

SEQ ID NO: 663966 - protein, 9 aa, Homo Sapiens
CPSVGPSSF

SEQ ID NO: 663967 - protein, 9 aa, Homo Sapiens
INIRFGTIL

SEQ ID NO: 663968 - protein, 9 aa, Homo Sapiens
APLVLWLCA

SEQ ID NO: 663969 - protein, 9 aa, Homo Sapiens
WKMQGVGER

SEQ ID NO: 663970 - protein, 9 aa, Homo Sapiens
SCCPISACP

SEQ ID NO: 663971 - protein, 9 aa, Homo Sapiens
STTGMVVGT

SEQ ID NO: 663972 - protein, 9 aa, Homo Sapiens
LQVRTAAPL

SEQ ID NO: 663973 - protein, 9 aa, Homo Sapiens
GVPTCLSCC

SEQ ID NO: 663974 - protein, 9 aa, Homo Sapiens
ERLNIFQNL

SEQ ID NO: 663975 - protein, 9 aa, Homo Sapiens
RKLWQDFED

SEQ ID NO: 663976 - protein, 9 aa, Homo Sapiens
WAAGCCCLY

SEQ ID NO: 663977 - protein, 9 aa, Homo Sapiens
DMDGFPWVR

SEQ ID NO: 663978 - protein, 9 aa, Homo Sapiens
AIQEYPKAK

SEQ ID NO: 663979 - protein, 9 aa, Homo Sapiens
QDINNITDK

SEQ ID NO: 663980 - protein, 9 aa, Homo Sapiens
SNINIRFGT

SEQ ID NO: 663981 - protein, 9 aa, Homo Sapiens
AAPPWAPTQ

SEQ ID NO: 663982 - protein, 9 aa, Homo Sapiens
ETFRISFYQ

SEQ ID NO: 663983 - protein, 9 aa, Homo Sapiens
EGYRLPALM

SEQ ID NO: 663984 - protein, 9 aa, Homo Sapiens
NCGYVLLSV

SEQ ID NO: 663985 - protein, 9 aa, Homo Sapiens
NAIPKSEKL

SEQ ID NO: 663986 - protein, 9 aa, Homo Sapiens
EDRECLLPG

SEQ ID NO: 663987 - protein, 9 aa, Homo Sapiens
TFRISFYQV

SEQ ID NO: 663988 - protein, 9 aa, Homo Sapiens
HEGALKQDK

SEQ ID NO: 663989 - protein, 9 aa, Homo Sapiens
VNGMTIPNL

SEQ ID NO: 663990 - protein, 9 aa, Homo Sapiens
MSEFNNNFW

SEQ ID NO: 663991 - protein, 9 aa, Homo Sapiens
HSVRLKHRE

SEQ ID NO: 663992 - protein, 9 aa, Homo Sapiens
GYRLPALMG

SEQ ID NO: 663993 - protein, 9 aa, Homo Sapiens
TNSQQNGDK

SEQ ID NO: 663994 - protein, 9 aa, Homo Sapiens
PYSLKIDGT

SEQ ID NO: 663995 - protein, 9 aa, Homo Sapiens
GHDVTCSVA

SEQ ID NO: 663996 - protein, 9 aa, Homo Sapiens
PRGDGQYWD

SEQ ID NO: 663997 - protein, 9 aa, Homo Sapiens
KQVVHWDRQ

SEQ ID NO: 663998 - protein, 9 aa, Homo Sapiens
PPWAPTQCH

SEQ ID NO: 663999 - protein, 9 aa, Homo Sapiens
VIQRREAEN

SEQ ID NO: 664000 - protein, 9 aa, Homo Sapiens
CPISACPSV

SEQ ID NO: 664001 - protein, 9 aa, Homo Sapiens
TVAAAALCI

SEQ ID NO: 664002 - protein, 9 aa, Homo Sapiens
RLPVYKPEV

SEQ ID NO: 664003 - protein, 9 aa, Homo Sapiens
DSTHLQQLH

SEQ ID NO: 664004 - protein, 9 aa, Homo Sapiens
TNGMPLLVK

SEQ ID NO: 664005 - protein, 9 aa, Homo Sapiens
TESCGIMNT

SEQ ID NO: 664006 - protein, 9 aa, Homo Sapiens
GKYLMGGPA

SEQ ID NO: 664007 - protein, 9 aa, Homo Sapiens
RLKHREDAD

SEQ ID NO: 664008 - protein, 9 aa, Homo Sapiens
PSSPSTPAT

SEQ ID NO: 664009 - protein, 9 aa, Homo Sapiens
LSRYPVKPQ

SEQ ID NO: 664010 - protein, 9 aa, Homo Sapiens
LNGMFYTAR

SEQ ID NO: 664011 - protein, 9 aa, Homo Sapiens
GMTHYSADC

SEQ ID NO: 664012 - protein, 9 aa, Homo Sapiens
RTPCGGRGG

SEQ ID NO: 664013 - protein, 9 aa, Homo Sapiens
LLHSVRLKH

SEQ ID NO: 664014 - protein, 9 aa, Homo Sapiens
AGLVALSYS

SEQ ID NO: 664015 - protein, 9 aa, Homo Sapiens
ISACPSVGP

SEQ ID NO: 664016 - protein, 9 aa, Homo Sapiens
NFGMTHYSA

SEQ ID NO: 664017 - protein, 9 aa, Homo Sapiens
HHHLQQDVQ

SEQ ID NO: 664018 - protein, 9 aa, Homo Sapiens
SVGPSSFQT

SEQ ID NO: 664019 - protein, 9 aa, Homo Sapiens
DGAPSLPEQ

SEQ ID NO: 664020 - protein, 9 aa, Homo Sapiens
ELELSKEIV

SEQ ID NO: 664021 - protein, 9 aa, Homo Sapiens
SSFQTEYSR

SEQ ID NO: 664022 - protein, 9 aa, Homo Sapiens
YQSEGSILS

SEQ ID NO: 664023 - protein, 9 aa, Homo Sapiens
WLYREPGGG

SEQ ID NO: 664024 - protein, 9 aa, Homo Sapiens
EEAIQEYPK

SEQ ID NO: 664025 - protein, 9 aa, Homo Sapiens
TGMVVGTVA

SEQ ID NO: 664026 - protein, 9 aa, Homo Sapiens
ERFSTWEPT

SEQ ID NO: 664027 - protein, 9 aa, Homo Sapiens
DKEASECCV

SEQ ID NO: 664028 - protein, 9 aa, Homo Sapiens
IPEGKPKTG

SEQ ID NO: 664029 - protein, 9 aa, Homo Sapiens
EGGAGLGDA

SEQ ID NO: 664030 - protein, 9 aa, Homo Sapiens
DTNSQQNGD

SEQ ID NO: 664031 - protein, 9 aa, Homo Sapiens
AELIVKKPP

SEQ ID NO: 664032 - protein, 9 aa, Homo Sapiens
LVSDYTYYS

SEQ ID NO: 664033 - protein, 9 aa, Homo Sapiens
GMPLLVKEC

SEQ ID NO: 664034 - protein, 9 aa, Homo Sapiens
PATRIGKNV

SEQ ID NO: 664035 - protein, 9 aa, Homo Sapiens
SISKEHIEC

SEQ ID NO: 664036 - protein, 9 aa, Homo Sapiens
TVDTNSQQN

SEQ ID NO: 664037 - protein, 9 aa, Homo Sapiens
LLKFLLCSP

SEQ ID NO: 664038 - protein, 9 aa, Homo Sapiens
RFNGDSDSD

SEQ ID NO: 664039 - protein, 9 aa, Homo Sapiens
LLYPDIKDD

SEQ ID NO: 664040 - protein, 9 aa, Homo Sapiens
YDTDQEAVA

SEQ ID NO: 664041 - protein, 9 aa, Homo Sapiens
YLLECKKSD

SEQ ID NO: 664042 - protein, 9 aa, Homo Sapiens
DDETGAPAS

SEQ ID NO: 664043 - protein, 9 aa, Homo Sapiens
KRTQSVTSA

SEQ ID NO: 664044 - protein, 9 aa, Homo Sapiens
HQHKCPEND

SEQ ID NO: 664045 - protein, 9 aa, Homo Sapiens
LLKGGVLYP

SEQ ID NO: 664046 - protein, 9 aa, Homo Sapiens
TPDNILEFQ

SEQ ID NO: 664047 - protein, 9 aa, Homo Sapiens
WTVLQAVRT

SEQ ID NO: 664048 - protein, 9 aa, Homo Sapiens
EECSCVSDI

SEQ ID NO: 664049 - protein, 9 aa, Homo Sapiens
SPGARQYLS

SEQ ID NO: 664050 - protein, 9 aa, Homo Sapiens
LLPLHKAFF

SEQ ID NO: 664051 - protein, 9 aa, Homo Sapiens
IQRKISLPS

SEQ ID NO: 664052 - protein, 9 aa, Homo Sapiens
QVRFASLLQ

SEQ ID NO: 664053 - protein, 9 aa, Homo Sapiens
CMARLARLV

SEQ ID NO: 664054 - protein, 9 aa, Homo Sapiens
GASSDLGTG

SEQ ID NO: 664055 - protein, 9 aa, Homo Sapiens
PDVGSDCTT

SEQ ID NO: 664056 - protein, 9 aa, Homo Sapiens
QAGLCLSLT

SEQ ID NO: 664057 - protein, 9 aa, Homo Sapiens
QVHSLLSQD

SEQ ID NO: 664058 - protein, 9 aa, Homo Sapiens
HQIENTLIR

SEQ ID NO: 664059 - protein, 9 aa, Homo Sapiens
WQAVDITPQ

SEQ ID NO: 664060 - protein, 9 aa, Homo Sapiens
PTCPHCAMT

SEQ ID NO: 664061 - protein, 9 aa, Homo Sapiens
EQLKQAEKL

SEQ ID NO: 664062 - protein, 9 aa, Homo Sapiens
AVPFCTLSS

SEQ ID NO: 664063 - protein, 9 aa, Homo Sapiens
VQLDLHDLS

SEQ ID NO: 664064 - protein, 9 aa, Homo Sapiens
SSGSSPPGC

SEQ ID NO: 664065 - protein, 9 aa, Homo Sapiens
DEKTQGQGT

SEQ ID NO: 664066 - protein, 9 aa, Homo Sapiens
PLFPYGADP

SEQ ID NO: 664067 - protein, 9 aa, Homo Sapiens
KLVSNMVAK

SEQ ID NO: 664068 - protein, 9 aa, Homo Sapiens
ITVPAVPYS

SEQ ID NO: 664069 - protein, 9 aa, Homo Sapiens
SFKCNFSNT

SEQ ID NO: 664070 - protein, 9 aa, Homo Sapiens
DVFGHDGDS

SEQ ID NO: 664071 - protein, 9 aa, Homo Sapiens
NVLRDQMRR

SEQ ID NO: 664072 - protein, 9 aa, Homo Sapiens
DGTLMIRKT

SEQ ID NO: 664073 - protein, 9 aa, Homo Sapiens
FGRDLCRGT

SEQ ID NO: 664074 - protein, 9 aa, Homo Sapiens
ASAAGPVSP

SEQ ID NO: 664075 - protein, 9 aa, Homo Sapiens
SFTPADCSG

SEQ ID NO: 664076 - protein, 9 aa, Homo Sapiens
STVSAPVSK

SEQ ID NO: 664077 - protein, 9 aa, Homo Sapiens
GSRVTKVPQ

SEQ ID NO: 664078 - protein, 9 aa, Homo Sapiens
FAGGFPTGG

SEQ ID NO: 664079 - protein, 9 aa, Homo Sapiens
TCPHCAMTF

SEQ ID NO: 664080 - protein, 9 aa, Homo Sapiens
KKSLYFDEE

SEQ ID NO: 664081 - protein, 9 aa, Homo Sapiens
SDGIVRLLD

SEQ ID NO: 664082 - protein, 9 aa, Homo Sapiens
ARITGNSPR

SEQ ID NO: 664083 - protein, 9 aa, Homo Sapiens
DCFPYVQVL

SEQ ID NO: 664084 - protein, 9 aa, Homo Sapiens
VKHDMEMVQ

SEQ ID NO: 664085 - protein, 9 aa, Homo Sapiens
LRHNKQHAM

SEQ ID NO: 664086 - protein, 9 aa, Homo Sapiens
PFRFALEAG

SEQ ID NO: 664087 - protein, 9 aa, Homo Sapiens
TTLQKAQSF

SEQ ID NO: 664088 - protein, 9 aa, Homo Sapiens
RLLVMVKDH

SEQ ID NO: 664089 - protein, 9 aa, Homo Sapiens
MRVRNESFL

SEQ ID NO: 664090 - protein, 9 aa, Homo Sapiens
NEELNKLLG

SEQ ID NO: 664091 - protein, 9 aa, Homo Sapiens
RSLESLDPA

SEQ ID NO: 664092 - protein, 9 aa, Homo Sapiens
ARGSTGLDA

SEQ ID NO: 664093 - protein, 9 aa, Homo Sapiens
PPVQLPAQH

SEQ ID NO: 664094 - protein, 9 aa, Homo Sapiens
RSDAKHPAV

SEQ ID NO: 664095 - protein, 9 aa, Homo Sapiens
WDADALENA

SEQ ID NO: 664096 - protein, 9 aa, Homo Sapiens
RLAISHYQI

SEQ ID NO: 664097 - protein, 9 aa, Homo Sapiens
ARFKYVTEL

SEQ ID NO: 664098 - protein, 9 aa, Homo Sapiens
YPDIKDDQI

SEQ ID NO: 664099 - protein, 9 aa, Homo Sapiens
DAFVSEELA

SEQ ID NO: 664100 - protein, 9 aa, Homo Sapiens
QPQHRHESV

SEQ ID NO: 664101 - protein, 9 aa, Homo Sapiens
SPLVTSNIM

SEQ ID NO: 664102 - protein, 9 aa, Homo Sapiens
KPPDGEEEE

SEQ ID NO: 664103 - protein, 9 aa, Homo Sapiens
KILIPFLLV

SEQ ID NO: 664104 - protein, 9 aa, Homo Sapiens
QPIAQDLLP

SEQ ID NO: 664105 - protein, 9 aa, Homo Sapiens
TPDEAAPFV

SEQ ID NO: 664106 - protein, 9 aa, Homo Sapiens
SSRGRFAES

SEQ ID NO: 664107 - protein, 9 aa, Homo Sapiens
QREQKERQK

SEQ ID NO: 664108 - protein, 9 aa, Homo Sapiens
GTQVSIFQQ

SEQ ID NO: 664109 - protein, 9 aa, Homo Sapiens
RHESVRRDT

SEQ ID NO: 664110 - protein, 9 aa, Homo Sapiens
TDRVTENMS

SEQ ID NO: 664111 - protein, 9 aa, Homo Sapiens
HRFSLLPTY

SEQ ID NO: 664112 - protein, 9 aa, Homo Sapiens
DGEEEEEGR

SEQ ID NO: 664113 - protein, 9 aa, Homo Sapiens
CNEYGKSCK

SEQ ID NO: 664114 - protein, 9 aa, Homo Sapiens
KGVNLSCLR

SEQ ID NO: 664115 - protein, 9 aa, Homo Sapiens
VLYPALPQP

SEQ ID NO: 664116 - protein, 9 aa, Homo Sapiens
DNQNITLTV

SEQ ID NO: 664117 - protein, 9 aa, Homo Sapiens
EAFLTQNQK

SEQ ID NO: 664118 - protein, 9 aa, Homo Sapiens
KDEKNGKKD

SEQ ID NO: 664119 - protein, 9 aa, Homo Sapiens
KKKYFRQTT

SEQ ID NO: 664120 - protein, 9 aa, Homo Sapiens
QPLALSHKY

SEQ ID NO: 664121 - protein, 9 aa, Homo Sapiens
QKWYTYYAR

SEQ ID NO: 664122 - protein, 9 aa, Homo Sapiens
TLLCALVVF

SEQ ID NO: 664123 - protein, 9 aa, Homo Sapiens
SFPVIVSQP

SEQ ID NO: 664124 - protein, 9 aa, Homo Sapiens
KREEMHESM

SEQ ID NO: 664125 - protein, 9 aa, Homo Sapiens
FWPRGTVGK

SEQ ID NO: 664126 - protein, 9 aa, Homo Sapiens
LLNAGNVGP

SEQ ID NO: 664127 - protein, 9 aa, Homo Sapiens
RQANIRKQC

SEQ ID NO: 664128 - protein, 9 aa, Homo Sapiens
IVKLYVHKG

SEQ ID NO: 664129 - protein, 9 aa, Homo Sapiens
MSLLEKVLL

SEQ ID NO: 664130 - protein, 9 aa, Homo Sapiens
AHQHKCPEN

SEQ ID NO: 664131 - protein, 9 aa, Homo Sapiens
HYVTIMNQC

SEQ ID NO: 664132 - protein, 9 aa, Homo Sapiens
VFGHDGDSL

SEQ ID NO: 664133 - protein, 9 aa, Homo Sapiens
NVIHNKLKI

SEQ ID NO: 664134 - protein, 9 aa, Homo Sapiens
THWNKKPRR

SEQ ID NO: 664135 - protein, 9 aa, Homo Sapiens
HKDWQPLQE

SEQ ID NO: 664136 - protein, 9 aa, Homo Sapiens
TNTVANTSP

SEQ ID NO: 664137 - protein, 9 aa, Homo Sapiens
ADTDIALNT

SEQ ID NO: 664138 - protein, 9 aa, Homo Sapiens
ANCIEDMDT

SEQ ID NO: 664139 - protein, 9 aa, Homo Sapiens
GNAFEIWLG

SEQ ID NO: 664140 - protein, 9 aa, Homo Sapiens
HLLALRELP

SEQ ID NO: 664141 - protein, 9 aa, Homo Sapiens
RRELHQFAH

SEQ ID NO: 664142 - protein, 9 aa, Homo Sapiens
SYSGHNTKE

SEQ ID NO: 664143 - protein, 9 aa, Homo Sapiens
RLSKESNNL

SEQ ID NO: 664144 - protein, 9 aa, Homo Sapiens
AETIAWLRI

SEQ ID NO: 664145 - protein, 9 aa, Homo Sapiens
EKNGKKDSK

SEQ ID NO: 664146 - protein, 9 aa, Homo Sapiens
PPPPPSPRS

SEQ ID NO: 664147 - protein, 9 aa, Homo Sapiens
GPFSFTQRR

SEQ ID NO: 664148 - protein, 9 aa, Homo Sapiens
RSTHWNKKP

SEQ ID NO: 664149 - protein, 9 aa, Homo Sapiens
KPVELLENS

SEQ ID NO: 664150 - protein, 9 aa, Homo Sapiens
STSGGGGGL

SEQ ID NO: 664151 - protein, 9 aa, Homo Sapiens
LICVQLCDL

SEQ ID NO: 664152 - protein, 9 aa, Homo Sapiens
TVSAPVSKT

SEQ ID NO: 664153 - protein, 9 aa, Homo Sapiens
VSRSQEELR

SEQ ID NO: 664154 - protein, 9 aa, Homo Sapiens
QSWHTTCFV

SEQ ID NO: 664155 - protein, 9 aa, Homo Sapiens
PPPSSPSEV

SEQ ID NO: 664156 - protein, 9 aa, Homo Sapiens
STTHQEKPL

SEQ ID NO: 664157 - protein, 9 aa, Homo Sapiens
KEMEEFVLS

SEQ ID NO: 664158 - protein, 9 aa, Homo Sapiens
DSYVAICHP

SEQ ID NO: 664159 - protein, 9 aa, Homo Sapiens
VVDVNDNTP

SEQ ID NO: 664160 - protein, 9 aa, Homo Sapiens
GHLFNDLGL

SEQ ID NO: 664161 - protein, 9 aa, Homo Sapiens
MPIDIVYTW

SEQ ID NO: 664162 - protein, 9 aa, Homo Sapiens
YVYKRYLAG

SEQ ID NO: 664163 - protein, 9 aa, Homo Sapiens
CCRHSCCVS

SEQ ID NO: 664164 - protein, 9 aa, Homo Sapiens
GSTAPRELK

SEQ ID NO: 664165 - protein, 9 aa, Homo Sapiens
AVPGSSPAC

SEQ ID NO: 664166 - protein, 9 aa, Homo Sapiens
NNEELNKLL

SEQ ID NO: 664167 - protein, 9 aa, Homo Sapiens
FERKGLLIA

SEQ ID NO: 664168 - protein, 9 aa, Homo Sapiens
PHLVRESPP

SEQ ID NO: 664169 - protein, 9 aa, Homo Sapiens
LQVLGMRKT

SEQ ID NO: 664170 - protein, 9 aa, Homo Sapiens
MFTYYLAWA

SEQ ID NO: 664171 - protein, 9 aa, Homo Sapiens
HTASVHLYF

SEQ ID NO: 664172 - protein, 9 aa, Homo Sapiens
PMKDDITGK

SEQ ID NO: 664173 - protein, 9 aa, Homo Sapiens
ATSPLVTSN

SEQ ID NO: 664174 - protein, 9 aa, Homo Sapiens
ESFVLVAFS

SEQ ID NO: 664175 - protein, 9 aa, Homo Sapiens
QEVKNLLSG

SEQ ID NO: 664176 - protein, 9 aa, Homo Sapiens
NRSLESLDP

SEQ ID NO: 664177 - protein, 9 aa, Homo Sapiens
NRNLWENLC

SEQ ID NO: 664178 - protein, 9 aa, Homo Sapiens
EIDIRVEDT

SEQ ID NO: 664179 - protein, 9 aa, Homo Sapiens
PLIVKNIRK

SEQ ID NO: 664180 - protein, 9 aa, Homo Sapiens
RCFRCPRKS

SEQ ID NO: 664181 - protein, 9 aa, Homo Sapiens
WKILIPFLL

SEQ ID NO: 664182 - protein, 9 aa, Homo Sapiens
GETSKTDAS

SEQ ID NO: 664183 - protein, 9 aa, Homo Sapiens
CGDVSRSQE

SEQ ID NO: 664184 - protein, 9 aa, Homo Sapiens
CLTRKGRGR

SEQ ID NO: 664185 - protein, 9 aa, Homo Sapiens
LAFDQPTIS

SEQ ID NO: 664186 - protein, 9 aa, Homo Sapiens
LENSLKKRV

SEQ ID NO: 664187 - protein, 9 aa, Homo Sapiens
VFIQRKISL

SEQ ID NO: 664188 - protein, 9 aa, Homo Sapiens
RPVPIKLFN

SEQ ID NO: 664189 - protein, 9 aa, Homo Sapiens
NFLQSGETS

SEQ ID NO: 664190 - protein, 9 aa, Homo Sapiens
VDVNDNTPE

SEQ ID NO: 664191 - protein, 9 aa, Homo Sapiens
RVRTTYGFW

SEQ ID NO: 664192 - protein, 9 aa, Homo Sapiens
TVAHCVQLK

SEQ ID NO: 664193 - protein, 9 aa, Homo Sapiens
VNLSCLRTC

SEQ ID NO: 664194 - protein, 9 aa, Homo Sapiens
EGLSPNQNR

SEQ ID NO: 664195 - protein, 9 aa, Homo Sapiens
AACVNLSGW

SEQ ID NO: 664196 - protein, 9 aa, Homo Sapiens
LPSQRPKTP

SEQ ID NO: 664197 - protein, 9 aa, Homo Sapiens
RAVMFITKR

SEQ ID NO: 664198 - protein, 9 aa, Homo Sapiens
KALDEDKDA

SEQ ID NO: 664199 - protein, 9 aa, Homo Sapiens
GGWQAVDIT

SEQ ID NO: 664200 - protein, 9 aa, Homo Sapiens
YCFITFTTI

SEQ ID NO: 664201 - protein, 9 aa, Homo Sapiens
KPLNFNLDN

SEQ ID NO: 664202 - protein, 9 aa, Homo Sapiens
LCVLMPEPY

SEQ ID NO: 664203 - protein, 9 aa, Homo Sapiens
QAEKLRQYK

SEQ ID NO: 664204 - protein, 9 aa, Homo Sapiens
GPRPVAMRL

SEQ ID NO: 664205 - protein, 9 aa, Homo Sapiens
VSHDDVSSI

SEQ ID NO: 664206 - protein, 9 aa, Homo Sapiens
SVSNGAITP

SEQ ID NO: 664207 - protein, 9 aa, Homo Sapiens
EMCREEGER

SEQ ID NO: 664208 - protein, 9 aa, Homo Sapiens
LHYVTIMNQ

SEQ ID NO: 664209 - protein, 9 aa, Homo Sapiens
KFCKCEECG

SEQ ID NO: 664210 - protein, 9 aa, Homo Sapiens
PFLLVMCAF

SEQ ID NO: 664211 - protein, 9 aa, Homo Sapiens
VFPGTICIT

SEQ ID NO: 664212 - protein, 9 aa, Homo Sapiens
IFQGTLLFL

SEQ ID NO: 664213 - protein, 9 aa, Homo Sapiens
NSRMKWKRV

SEQ ID NO: 664214 - protein, 9 aa, Homo Sapiens
RFKYVTELN

SEQ ID NO: 664215 - protein, 9 aa, Homo Sapiens
TGKPLIRRS

SEQ ID NO: 664216 - protein, 9 aa, Homo Sapiens
PLGPYCYYD

SEQ ID NO: 664217 - protein, 9 aa, Homo Sapiens
SPYPASQLD

SEQ ID NO: 664218 - protein, 9 aa, Homo Sapiens
MSTVSWDPV

SEQ ID NO: 664219 - protein, 9 aa, Homo Sapiens
LGYGPFSFT

SEQ ID NO: 664220 - protein, 9 aa, Homo Sapiens
DVEMEQMIE

SEQ ID NO: 664221 - protein, 9 aa, Homo Sapiens
LLKKHKSTS

SEQ ID NO: 664222 - protein, 9 aa, Homo Sapiens
EDNMAFGMP

SEQ ID NO: 664223 - protein, 9 aa, Homo Sapiens
ATTPGLSSK

SEQ ID NO: 664224 - protein, 9 aa, Homo Sapiens
GDFFVAAFL

SEQ ID NO: 664225 - protein, 9 aa, Homo Sapiens
IRTRSFGHF

SEQ ID NO: 664226 - protein, 9 aa, Homo Sapiens
VVQAREALV

SEQ ID NO: 664227 - protein, 9 aa, Homo Sapiens
PPVSHDDVS

SEQ ID NO: 664228 - protein, 9 aa, Homo Sapiens
NLWENLCTI

SEQ ID NO: 664229 - protein, 9 aa, Homo Sapiens
HVTRSLCRG

SEQ ID NO: 664230 - protein, 9 aa, Homo Sapiens
VAQQVKKST

SEQ ID NO: 664231 - protein, 9 aa, Homo Sapiens
QPHLVRESP

SEQ ID NO: 664232 - protein, 9 aa, Homo Sapiens
CKPLHYVTI

SEQ ID NO: 664233 - protein, 9 aa, Homo Sapiens
RGILESIHR

SEQ ID NO: 664234 - protein, 9 aa, Homo Sapiens
WFQNSRMKW

SEQ ID NO: 664235 - protein, 9 aa, Homo Sapiens
NNKTANMCR

SEQ ID NO: 664236 - protein, 9 aa, Homo Sapiens
YYPMGHTAS

SEQ ID NO: 664237 - protein, 9 aa, Homo Sapiens
RYLAGKQRG

SEQ ID NO: 664238 - protein, 9 aa, Homo Sapiens
ALKQWSLNP

SEQ ID NO: 664239 - protein, 9 aa, Homo Sapiens
QLEILQLAH

SEQ ID NO: 664240 - protein, 9 aa, Homo Sapiens
VTIMNQCVC

SEQ ID NO: 664241 - protein, 9 aa, Homo Sapiens
SPNQNRFLG

SEQ ID NO: 664242 - protein, 9 aa, Homo Sapiens
CSSKLTVHK

SEQ ID NO: 664243 - protein, 9 aa, Homo Sapiens
RASAAGPVS

SEQ ID NO: 664244 - protein, 9 aa, Homo Sapiens
NPSPENRNL

SEQ ID NO: 664245 - protein, 9 aa, Homo Sapiens
PSPRSVAVP

SEQ ID NO: 664246 - protein, 9 aa, Homo Sapiens
LASTVSAPV

SEQ ID NO: 664247 - protein, 9 aa, Homo Sapiens
FLGEKASAK

SEQ ID NO: 664248 - protein, 9 aa, Homo Sapiens
SLHGFFMLL

SEQ ID NO: 664249 - protein, 9 aa, Homo Sapiens
LFHNTIMCE

SEQ ID NO: 664250 - protein, 9 aa, Homo Sapiens
KKGYNPTGL

SEQ ID NO: 664251 - protein, 9 aa, Homo Sapiens
TPSSKLTVY

SEQ ID NO: 664252 - protein, 9 aa, Homo Sapiens
LVTNIVPMY

SEQ ID NO: 664253 - protein, 9 aa, Homo Sapiens
DAFLVTNIV

SEQ ID NO: 664254 - protein, 9 aa, Homo Sapiens
TKNNNKTAN

SEQ ID NO: 664255 - protein, 9 aa, Homo Sapiens
ENLQKLNVI

SEQ ID NO: 664256 - protein, 9 aa, Homo Sapiens
SFTQRRSFR

SEQ ID NO: 664257 - protein, 9 aa, Homo Sapiens
PPTCPHCAM

SEQ ID NO: 664258 - protein, 9 aa, Homo Sapiens
PESEDVITS

SEQ ID NO: 664259 - protein, 9 aa, Homo Sapiens
VLGMRKTDF

SEQ ID NO: 664260 - protein, 9 aa, Homo Sapiens
DGTQVSIFQ

SEQ ID NO: 664261 - protein, 9 aa, Homo Sapiens
KKKSLYFDE

SEQ ID NO: 664262 - protein, 9 aa, Homo Sapiens
SDLGTGAVA

SEQ ID NO: 664263 - protein, 9 aa, Homo Sapiens
LSKESNNLD

SEQ ID NO: 664264 - protein, 9 aa, Homo Sapiens
MRKTDFDEE

SEQ ID NO: 664265 - protein, 9 aa, Homo Sapiens
NCVVIFSKK

SEQ ID NO: 664266 - protein, 9 aa, Homo Sapiens
SKCGKDFTQ

SEQ ID NO: 664267 - protein, 9 aa, Homo Sapiens
KDRNFYFGK

SEQ ID NO: 664268 - protein, 9 aa, Homo Sapiens
FSGRSYLSK

SEQ ID NO: 664269 - protein, 9 aa, Homo Sapiens
ELFHNTIMC

SEQ ID NO: 664270 - protein, 9 aa, Homo Sapiens
VVFADSKCL

SEQ ID NO: 664271 - protein, 9 aa, Homo Sapiens
HDGLICQDM

SEQ ID NO: 664272 - protein, 9 aa, Homo Sapiens
GHTASVHLY

SEQ ID NO: 664273 - protein, 9 aa, Homo Sapiens
LCRGTKHYG

SEQ ID NO: 664274 - protein, 9 aa, Homo Sapiens
PLNKRSTHW

SEQ ID NO: 664275 - protein, 9 aa, Homo Sapiens
KNMSGWFLR

SEQ ID NO: 664276 - protein, 9 aa, Homo Sapiens
SIYTYLRPS

SEQ ID NO: 664277 - protein, 9 aa, Homo Sapiens
TAAETIAWL

SEQ ID NO: 664278 - protein, 9 aa, Homo Sapiens
HAMTLTKAR

SEQ ID NO: 664279 - protein, 9 aa, Homo Sapiens
HLLFSLIGM

SEQ ID NO: 664280 - protein, 9 aa, Homo Sapiens
SMCVRHLIT

SEQ ID NO: 664281 - protein, 9 aa, Homo Sapiens
TLVRKQLQE

SEQ ID NO: 664282 - protein, 9 aa, Homo Sapiens
AFLVTNIVP

SEQ ID NO: 664283 - protein, 9 aa, Homo Sapiens
AKHPAVFTR

SEQ ID NO: 664284 - protein, 9 aa, Homo Sapiens
PLNLFLSSA

SEQ ID NO: 664285 - protein, 9 aa, Homo Sapiens
TQSVTSAEN

SEQ ID NO: 664286 - protein, 9 aa, Homo Sapiens
SRASVGPAG

SEQ ID NO: 664287 - protein, 9 aa, Homo Sapiens
LSSLSPYPA

SEQ ID NO: 664288 - protein, 9 aa, Homo Sapiens
YLLCCHQKW

SEQ ID NO: 664289 - protein, 9 aa, Homo Sapiens
LSCLRTCMV

SEQ ID NO: 664290 - protein, 9 aa, Homo Sapiens
IQPHCVFFR

SEQ ID NO: 664291 - protein, 9 aa, Homo Sapiens
AAGVDWGCG

SEQ ID NO: 664292 - protein, 9 aa, Homo Sapiens
QNQKVGELK

SEQ ID NO: 664293 - protein, 9 aa, Homo Sapiens
SNEFFKCDQ

SEQ ID NO: 664294 - protein, 9 aa, Homo Sapiens
QAMFMAPSQ

SEQ ID NO: 664295 - protein, 9 aa, Homo Sapiens
CLWPDPSHF

SEQ ID NO: 664296 - protein, 9 aa, Homo Sapiens
DQYRFRRCL

SEQ ID NO: 664297 - protein, 9 aa, Homo Sapiens
KLRISEYKA

SEQ ID NO: 664298 - protein, 9 aa, Homo Sapiens
MQLPLVSDK

SEQ ID NO: 664299 - protein, 9 aa, Homo Sapiens
LWSVSNGAI

SEQ ID NO: 664300 - protein, 9 aa, Homo Sapiens
ATPCSLPYA

SEQ ID NO: 664301 - protein, 9 aa, Homo Sapiens
CHGAAPCLV

SEQ ID NO: 664302 - protein, 9 aa, Homo Sapiens
FVREEVIDF

SEQ ID NO: 664303 - protein, 9 aa, Homo Sapiens
DGDFFVAAF

SEQ ID NO: 664304 - protein, 9 aa, Homo Sapiens
KMDDTKPTK

SEQ ID NO: 664305 - protein, 9 aa, Homo Sapiens
GHRTLNVLR

SEQ ID NO: 664306 - protein, 9 aa, Homo Sapiens
RTMNCMEVE

SEQ ID NO: 664307 - protein, 9 aa, Homo Sapiens
ILFYATSIY

SEQ ID NO: 664308 - protein, 9 aa, Homo Sapiens
KRYLAGKQR

SEQ ID NO: 664309 - protein, 9 aa, Homo Sapiens
FDCSMCRHY

SEQ ID NO: 664310 - protein, 9 aa, Homo Sapiens
RVRNQTEVT

SEQ ID NO: 664311 - protein, 9 aa, Homo Sapiens
QPLFPYGAD

SEQ ID NO: 664312 - protein, 9 aa, Homo Sapiens
LLGQDEKTQ

SEQ ID NO: 664313 - protein, 9 aa, Homo Sapiens
PMYDEGKPV

SEQ ID NO: 664314 - protein, 9 aa, Homo Sapiens
TLTLFPMRE

SEQ ID NO: 664315 - protein, 9 aa, Homo Sapiens
DLHDLSKKP

SEQ ID NO: 664316 - protein, 9 aa, Homo Sapiens
WGKLTLCTY

SEQ ID NO: 664317 - protein, 9 aa, Homo Sapiens
PRTMNCMEV

SEQ ID NO: 664318 - protein, 9 aa, Homo Sapiens
YENLSGLQQ

SEQ ID NO: 664319 - protein, 9 aa, Homo Sapiens
GSQLNTTLQ

SEQ ID NO: 664320 - protein, 9 aa, Homo Sapiens
RITGNSPRR

SEQ ID NO: 664321 - protein, 9 aa, Homo Sapiens
GTVSCLAPS

SEQ ID NO: 664322 - protein, 9 aa, Homo Sapiens
PNNPQNKPP

SEQ ID NO: 664323 - protein, 9 aa, Homo Sapiens
AAFLATTLT

SEQ ID NO: 664324 - protein, 9 aa, Homo Sapiens
GRDLCRGTK

SEQ ID NO: 664325 - protein, 9 aa, Homo Sapiens
CSGTAEGGS

SEQ ID NO: 664326 - protein, 9 aa, Homo Sapiens
VAVDVVQAR

SEQ ID NO: 664327 - protein, 9 aa, Homo Sapiens
VTLRSGVII

SEQ ID NO: 664328 - protein, 9 aa, Homo Sapiens
IFSKKSCSY

SEQ ID NO: 664329 - protein, 9 aa, Homo Sapiens
KLNRDRMQY

SEQ ID NO: 664330 - protein, 9 aa, Homo Sapiens
VKRQQEPLC

SEQ ID NO: 664331 - protein, 9 aa, Homo Sapiens
FLATTLTKI

SEQ ID NO: 664332 - protein, 9 aa, Homo Sapiens
VPFCTLSSA

SEQ ID NO: 664333 - protein, 9 aa, Homo Sapiens
FKCNFSNTF

SEQ ID NO: 664334 - protein, 9 aa, Homo Sapiens
DCVQLDLHD

SEQ ID NO: 664335 - protein, 9 aa, Homo Sapiens
KNLLSGVSR

SEQ ID NO: 664336 - protein, 9 aa, Homo Sapiens
SLESNTSDS

SEQ ID NO: 664337 - protein, 9 aa, Homo Sapiens
QNGYAPCTE

SEQ ID NO: 664338 - protein, 9 aa, Homo Sapiens
YKYLLECKK

SEQ ID NO: 664339 - protein, 9 aa, Homo Sapiens
RKPQVEKVD

SEQ ID NO: 664340 - protein, 9 aa, Homo Sapiens
GRGREGAEP

SEQ ID NO: 664341 - protein, 9 aa, Homo Sapiens
PPGCLPSAR

SEQ ID NO: 664342 - protein, 9 aa, Homo Sapiens
HGFFMLLFP

SEQ ID NO: 664343 - protein, 9 aa, Homo Sapiens
DGDSLSVDG

SEQ ID NO: 664344 - protein, 9 aa, Homo Sapiens
YIFAIYLLC

SEQ ID NO: 664345 - protein, 9 aa, Homo Sapiens
FIGSRVTKV

SEQ ID NO: 664346 - protein, 9 aa, Homo Sapiens
HNGTIEFTI

SEQ ID NO: 664347 - protein, 9 aa, Homo Sapiens
QRIANARAL

SEQ ID NO: 664348 - protein, 9 aa, Homo Sapiens
RPSIQQAEM

SEQ ID NO: 664349 - protein, 9 aa, Homo Sapiens
REYNLHSVA

SEQ ID NO: 664350 - protein, 9 aa, Homo Sapiens
NTSDSDQNF

SEQ ID NO: 664351 - protein, 9 aa, Homo Sapiens
YDEGKPVTG

SEQ ID NO: 664352 - protein, 9 aa, Homo Sapiens
VTLETKPLN

SEQ ID NO: 664353 - protein, 9 aa, Homo Sapiens
SLCAFYTHV

SEQ ID NO: 664354 - protein, 9 aa, Homo Sapiens
PVSPSWCGS

SEQ ID NO: 664355 - protein, 9 aa, Homo Sapiens
ELVQHVFAA

SEQ ID NO: 664356 - protein, 9 aa, Homo Sapiens
AKQFPDLHS

SEQ ID NO: 664357 - protein, 9 aa, Homo Sapiens
KVPQGEQAC

SEQ ID NO: 664358 - protein, 9 aa, Homo Sapiens
RYYPMGHTA

SEQ ID NO: 664359 - protein, 9 aa, Homo Sapiens
LSPYPASQL

SEQ ID NO: 664360 - protein, 9 aa, Homo Sapiens
IKDIMEKLH

SEQ ID NO: 664361 - protein, 9 aa, Homo Sapiens
VIRQAPPEI

SEQ ID NO: 664362 - protein, 9 aa, Homo Sapiens
FSQRGLPTI

SEQ ID NO: 664363 - protein, 9 aa, Homo Sapiens
RQRLVLALK

SEQ ID NO: 664364 - protein, 9 aa, Homo Sapiens
FLLVMCAFE

SEQ ID NO: 664365 - protein, 9 aa, Homo Sapiens
LPHQPLEGQ

SEQ ID NO: 664366 - protein, 9 aa, Homo Sapiens
IDSSSVMVL

SEQ ID NO: 664367 - protein, 9 aa, Homo Sapiens
ALRELPRAM

SEQ ID NO: 664368 - protein, 9 aa, Homo Sapiens
IVSQPALPF

SEQ ID NO: 664369 - protein, 9 aa, Homo Sapiens
LVSNMVAKN

SEQ ID NO: 664370 - protein, 9 aa, Homo Sapiens
KSTIDSSSV

SEQ ID NO: 664371 - protein, 9 aa, Homo Sapiens
GTIEFTILD

SEQ ID NO: 664372 - protein, 9 aa, Homo Sapiens
GSFRGQLFA

SEQ ID NO: 664373 - protein, 9 aa, Homo Sapiens
GRGRKCSAR

SEQ ID NO: 664374 - protein, 9 aa, Homo Sapiens
RKTRESDQG

SEQ ID NO: 664375 - protein, 9 aa, Homo Sapiens
LNAGNVGPF

SEQ ID NO: 664376 - protein, 9 aa, Homo Sapiens
QQQKICLNR

SEQ ID NO: 664377 - protein, 9 aa, Homo Sapiens
LQLPREPGV

SEQ ID NO: 664378 - protein, 9 aa, Homo Sapiens
NILERFSAK

SEQ ID NO: 664379 - protein, 9 aa, Homo Sapiens
REEGERARQ

SEQ ID NO: 664380 - protein, 9 aa, Homo Sapiens
NPQNKPPAA

SEQ ID NO: 664381 - protein, 9 aa, Homo Sapiens
FSAKQFPDL

SEQ ID NO: 664382 - protein, 9 aa, Homo Sapiens
PNTRYGGKF

SEQ ID NO: 664383 - protein, 9 aa, Homo Sapiens
QTHQVRFAS

SEQ ID NO: 664384 - protein, 9 aa, Homo Sapiens
ITPGSQAAA

SEQ ID NO: 664385 - protein, 9 aa, Homo Sapiens
LAPALDVDW

SEQ ID NO: 664386 - protein, 9 aa, Homo Sapiens
VNLCDCHLH

SEQ ID NO: 664387 - protein, 9 aa, Homo Sapiens
KFPAWQNSV

SEQ ID NO: 664388 - protein, 9 aa, Homo Sapiens
TEGSLRAVM

SEQ ID NO: 664389 - protein, 9 aa, Homo Sapiens
LLEKVLLVK

SEQ ID NO: 664390 - protein, 9 aa, Homo Sapiens
SLPEPLVTY

SEQ ID NO: 664391 - protein, 9 aa, Homo Sapiens
PHQAGLCLS

SEQ ID NO: 664392 - protein, 9 aa, Homo Sapiens
WILTVAHCV

SEQ ID NO: 664393 - protein, 9 aa, Homo Sapiens
MWKILIPFL

SEQ ID NO: 664394 - protein, 9 aa, Homo Sapiens
PVQLPAQHR

SEQ ID NO: 664395 - protein, 9 aa, Homo Sapiens
SPEENECLK

SEQ ID NO: 664396 - protein, 9 aa, Homo Sapiens
RSYLSKHQK

SEQ ID NO: 664397 - protein, 9 aa, Homo Sapiens
WLQKWYGGS

SEQ ID NO: 664398 - protein, 9 aa, Homo Sapiens
ERKKTVKEV

SEQ ID NO: 664399 - protein, 9 aa, Homo Sapiens
FFIHAFGGT

SEQ ID NO: 664400 - protein, 9 aa, Homo Sapiens
TLPLDTRTS

SEQ ID NO: 664401 - protein, 9 aa, Homo Sapiens
GFWALLESP

SEQ ID NO: 664402 - protein, 9 aa, Homo Sapiens
ETGAAGVDW

SEQ ID NO: 664403 - protein, 9 aa, Homo Sapiens
ECSCVSDIG

SEQ ID NO: 664404 - protein, 9 aa, Homo Sapiens
IAWLRICRP

SEQ ID NO: 664405 - protein, 9 aa, Homo Sapiens
DSKCLSLTA

SEQ ID NO: 664406 - protein, 9 aa, Homo Sapiens
AVPTSDEGK

SEQ ID NO: 664407 - protein, 9 aa, Homo Sapiens
YIFLAMLAD

SEQ ID NO: 664408 - protein, 9 aa, Homo Sapiens
PQVEKVDVI

SEQ ID NO: 664409 - protein, 9 aa, Homo Sapiens
MTFKDCVIL

SEQ ID NO: 664410 - protein, 9 aa, Homo Sapiens
KEKMDDTKP

SEQ ID NO: 664411 - protein, 9 aa, Homo Sapiens
LMPDNQNIT

SEQ ID NO: 664412 - protein, 9 aa, Homo Sapiens
LFNGDVLSP

SEQ ID NO: 664413 - protein, 9 aa, Homo Sapiens
VWGKLTLCT

SEQ ID NO: 664414 - protein, 9 aa, Homo Sapiens
ENRNLWENL

SEQ ID NO: 664415 - protein, 9 aa, Homo Sapiens
PFSFTQRRS

SEQ ID NO: 664416 - protein, 9 aa, Homo Sapiens
GQLPDEQLG

SEQ ID NO: 664417 - protein, 9 aa, Homo Sapiens
LAGKQRGMI

SEQ ID NO: 664418 - protein, 9 aa, Homo Sapiens
MVKDHGEPA

SEQ ID NO: 664419 - protein, 9 aa, Homo Sapiens
YGRSDAKHP

SEQ ID NO: 664420 - protein, 9 aa, Homo Sapiens
SKGSVTLTE

SEQ ID NO: 664421 - protein, 9 aa, Homo Sapiens
PPRCFRCPR

SEQ ID NO: 664422 - protein, 9 aa, Homo Sapiens
NDNTPELII

SEQ ID NO: 664423 - protein, 9 aa, Homo Sapiens
SAWDADALE

SEQ ID NO: 664424 - protein, 9 aa, Homo Sapiens
GKAFSGRSY

SEQ ID NO: 664425 - protein, 9 aa, Homo Sapiens
GYDTDQEAV

SEQ ID NO: 664426 - protein, 9 aa, Homo Sapiens
GEPLPLKLN

SEQ ID NO: 664427 - protein, 9 aa, Homo Sapiens
HLFNDLGLG

SEQ ID NO: 664428 - protein, 9 aa, Homo Sapiens
NGYKSDAKG

SEQ ID NO: 664429 - protein, 9 aa, Homo Sapiens
DITLVRKQL

SEQ ID NO: 664430 - protein, 9 aa, Homo Sapiens
KYCRMANFA

SEQ ID NO: 664431 - protein, 9 aa, Homo Sapiens
WRALVVEMS

SEQ ID NO: 664432 - protein, 9 aa, Homo Sapiens
VNICLRELD

SEQ ID NO: 664433 - protein, 9 aa, Homo Sapiens
VGDVSVLSS

SEQ ID NO: 664434 - protein, 9 aa, Homo Sapiens
YTYYARLNK

SEQ ID NO: 664435 - protein, 9 aa, Homo Sapiens
HSHLGCCLP

SEQ ID NO: 664436 - protein, 9 aa, Homo Sapiens
FEIWLGSEY

SEQ ID NO: 664437 - protein, 9 aa, Homo Sapiens
REPGVSAQF

SEQ ID NO: 664438 - protein, 9 aa, Homo Sapiens
ISLLQSCSG

SEQ ID NO: 664439 - protein, 9 aa, Homo Sapiens
WDGCGWKFS

SEQ ID NO: 664440 - protein, 9 aa, Homo Sapiens
SRVTKVPQG

SEQ ID NO: 664441 - protein, 9 aa, Homo Sapiens
QYLYTVEPN

SEQ ID NO: 664442 - protein, 9 aa, Homo Sapiens
ECGDVSRSQ

SEQ ID NO: 664443 - protein, 9 aa, Homo Sapiens
RQYLSVNVT

SEQ ID NO: 664444 - protein, 9 aa, Homo Sapiens
PEWDGLIFW

SEQ ID NO: 664445 - protein, 9 aa, Homo Sapiens
KKPPVSHDD

SEQ ID NO: 664446 - protein, 9 aa, Homo Sapiens
TVEAIKRPS

SEQ ID NO: 664447 - protein, 9 aa, Homo Sapiens
AKNGYKSDA

SEQ ID NO: 664448 - protein, 9 aa, Homo Sapiens
GWQAVDITP

SEQ ID NO: 664449 - protein, 9 aa, Homo Sapiens
APLTITFVR

SEQ ID NO: 664450 - protein, 9 aa, Homo Sapiens
ERIGCGKRP

SEQ ID NO: 664451 - protein, 9 aa, Homo Sapiens
VRESPPHQP

SEQ ID NO: 664452 - protein, 9 aa, Homo Sapiens
PKVSSQIRT

SEQ ID NO: 664453 - protein, 9 aa, Homo Sapiens
ICITRYSAG

SEQ ID NO: 664454 - protein, 9 aa, Homo Sapiens
PEITWHKDW

SEQ ID NO: 664455 - protein, 9 aa, Homo Sapiens
RSRSSSRGR

SEQ ID NO: 664456 - protein, 9 aa, Homo Sapiens
FTPADCSGT

SEQ ID NO: 664457 - protein, 9 aa, Homo Sapiens
VGIALVEKA

SEQ ID NO: 664458 - protein, 9 aa, Homo Sapiens
RFALEAGCQ

SEQ ID NO: 664459 - protein, 9 aa, Homo Sapiens
QYLSVNVTT

SEQ ID NO: 664460 - protein, 9 aa, Homo Sapiens
RNDFDRLQA

SEQ ID NO: 664461 - protein, 9 aa, Homo Sapiens
GYKSDAKGV

SEQ ID NO: 664462 - protein, 9 aa, Homo Sapiens
ISLHGFFML

SEQ ID NO: 664463 - protein, 9 aa, Homo Sapiens
GKEGPNNPQ

SEQ ID NO: 664464 - protein, 9 aa, Homo Sapiens
PVAQQVKKS

SEQ ID NO: 664465 - protein, 9 aa, Homo Sapiens
LPRLDGSGA

SEQ ID NO: 664466 - protein, 9 aa, Homo Sapiens
ESSVSSPLP

SEQ ID NO: 664467 - protein, 9 aa, Homo Sapiens
IANARALVR

SEQ ID NO: 664468 - protein, 9 aa, Homo Sapiens
AIVSSVLFV

SEQ ID NO: 664469 - protein, 9 aa, Homo Sapiens
PLLRPPRCF

SEQ ID NO: 664470 - protein, 9 aa, Homo Sapiens
KGSPLKMSK

SEQ ID NO: 664471 - protein, 9 aa, Homo Sapiens
KKLNRDRMQ

SEQ ID NO: 664472 - protein, 9 aa, Homo Sapiens
WAQAVLPSV

SEQ ID NO: 664473 - protein, 9 aa, Homo Sapiens
IQAPKTVEA

SEQ ID NO: 664474 - protein, 9 aa, Homo Sapiens
GSLSSLESN

SEQ ID NO: 664475 - protein, 9 aa, Homo Sapiens
KSCKKSTLS

SEQ ID NO: 664476 - protein, 9 aa, Homo Sapiens
LWQTFLTIR

SEQ ID NO: 664477 - protein, 9 aa, Homo Sapiens
PPDVGSDCT

SEQ ID NO: 664478 - protein, 9 aa, Homo Sapiens
FQPIAQDLL

SEQ ID NO: 664479 - protein, 9 aa, Homo Sapiens
QANIRKQCK

SEQ ID NO: 664480 - protein, 9 aa, Homo Sapiens
FPMREESVT

SEQ ID NO: 664481 - protein, 9 aa, Homo Sapiens
LQRTYLYAW

SEQ ID NO: 664482 - protein, 9 aa, Homo Sapiens
NLCSCNGQC

SEQ ID NO: 664483 - protein, 9 aa, Homo Sapiens
AWDADALEN

SEQ ID NO: 664484 - protein, 9 aa, Homo Sapiens
APSPRPRGP

SEQ ID NO: 664485 - protein, 9 aa, Homo Sapiens
MHESMRRFL

SEQ ID NO: 664486 - protein, 9 aa, Homo Sapiens
KKLGRKPLP

SEQ ID NO: 664487 - protein, 9 aa, Homo Sapiens
EIRVANLHF

SEQ ID NO: 664488 - protein, 9 aa, Homo Sapiens
RPPRCFRCP

SEQ ID NO: 664489 - protein, 9 aa, Homo Sapiens
LHSVAAHEL

SEQ ID NO: 664490 - protein, 9 aa, Homo Sapiens
ELASTVSAP

SEQ ID NO: 664491 - protein, 9 aa, Homo Sapiens
SQILLLSNQ

SEQ ID NO: 664492 - protein, 9 aa, Homo Sapiens
TGAPASALL

SEQ ID NO: 664493 - protein, 9 aa, Homo Sapiens
KCRFFSGEC

SEQ ID NO: 664494 - protein, 9 aa, Homo Sapiens
GKDFTQSSN

SEQ ID NO: 664495 - protein, 9 aa, Homo Sapiens
HMLRLICVQ

SEQ ID NO: 664496 - protein, 9 aa, Homo Sapiens
AGGFPTGGF

SEQ ID NO: 664497 - protein, 9 aa, Homo Sapiens
SRVTRRLRG

SEQ ID NO: 664498 - protein, 9 aa, Homo Sapiens
VEDTEICLQ

SEQ ID NO: 664499 - protein, 9 aa, Homo Sapiens
VMVKDHGEP

SEQ ID NO: 664500 - protein, 9 aa, Homo Sapiens
RFRRCLLLK

SEQ ID NO: 664501 - protein, 9 aa, Homo Sapiens
ALYGVFGRC

SEQ ID NO: 664502 - protein, 9 aa, Homo Sapiens
LLELGEEAI

SEQ ID NO: 664503 - protein, 9 aa, Homo Sapiens
PDNQNITLT

SEQ ID NO: 664504 - protein, 9 aa, Homo Sapiens
FTKNNNKTA

SEQ ID NO: 664505 - protein, 9 aa, Homo Sapiens
SGICAAESF

SEQ ID NO: 664506 - protein, 9 aa, Homo Sapiens
GPAGPEAAL

SEQ ID NO: 664507 - protein, 9 aa, Homo Sapiens
RKQCKIYDS

SEQ ID NO: 664508 - protein, 9 aa, Homo Sapiens
ELERQCLLR

SEQ ID NO: 664509 - protein, 9 aa, Homo Sapiens
KICLNRARK

SEQ ID NO: 664510 - protein, 9 aa, Homo Sapiens
SVWVQSKPH

SEQ ID NO: 664511 - protein, 9 aa, Homo Sapiens
LQNLQATLS

SEQ ID NO: 664512 - protein, 9 aa, Homo Sapiens
AAGRGREGA

SEQ ID NO: 664513 - protein, 9 aa, Homo Sapiens
MLADTDIAL

SEQ ID NO: 664514 - protein, 9 aa, Homo Sapiens
FSGECSEFC

SEQ ID NO: 664515 - protein, 9 aa, Homo Sapiens
CSLGMRTLQ

SEQ ID NO: 664516 - protein, 9 aa, Homo Sapiens
SYVAICHPL

SEQ ID NO: 664517 - protein, 9 aa, Homo Sapiens
KQQFPFHLA

SEQ ID NO: 664518 - protein, 9 aa, Homo Sapiens
IGSRVTKVP

SEQ ID NO: 664519 - protein, 9 aa, Homo Sapiens
QQTHQVRFA

SEQ ID NO: 664520 - protein, 9 aa, Homo Sapiens
QAFGRDLCR

SEQ ID NO: 664521 - protein, 9 aa, Homo Sapiens
HFSQTPLMF

SEQ ID NO: 664522 - protein, 9 aa, Homo Sapiens
AYYYCFITF

SEQ ID NO: 664523 - protein, 9 aa, Homo Sapiens
KQLQELQNL

SEQ ID NO: 664524 - protein, 9 aa, Homo Sapiens
VSAWDADAL

SEQ ID NO: 664525 - protein, 9 aa, Homo Sapiens
LALIPRTMN

SEQ ID NO: 664526 - protein, 9 aa, Homo Sapiens
LTITFVREE

SEQ ID NO: 664527 - protein, 9 aa, Homo Sapiens
KSGKEILNR

SEQ ID NO: 664528 - protein, 9 aa, Homo Sapiens
IEIHEWTVL

SEQ ID NO: 664529 - protein, 9 aa, Homo Sapiens
FRCPRKSLV

SEQ ID NO: 664530 - protein, 9 aa, Homo Sapiens
LLSGVSRAA

SEQ ID NO: 664531 - protein, 9 aa, Homo Sapiens
TSSLLGYGP

SEQ ID NO: 664532 - protein, 9 aa, Homo Sapiens
EFAYGTVSC

SEQ ID NO: 664533 - protein, 9 aa, Homo Sapiens
LVLPEGGAQ

SEQ ID NO: 664534 - protein, 9 aa, Homo Sapiens
PVVGDEEPP

SEQ ID NO: 664535 - protein, 9 aa, Homo Sapiens
LRSGVIIDR

SEQ ID NO: 664536 - protein, 9 aa, Homo Sapiens
DRYLAIYRP

SEQ ID NO: 664537 - protein, 9 aa, Homo Sapiens
ILERFSAKQ

SEQ ID NO: 664538 - protein, 9 aa, Homo Sapiens
PLVNLCDCH

SEQ ID NO: 664539 - protein, 9 aa, Homo Sapiens
DVVQAREAL

SEQ ID NO: 664540 - protein, 9 aa, Homo Sapiens
AAESFVLVA

SEQ ID NO: 664541 - protein, 9 aa, Homo Sapiens
LFAGGFPTG

SEQ ID NO: 664542 - protein, 9 aa, Homo Sapiens
WDEDGFQGL

SEQ ID NO: 664543 - protein, 9 aa, Homo Sapiens
LRDQYRFRR

SEQ ID NO: 664544 - protein, 9 aa, Homo Sapiens
LAFSQRGLP

SEQ ID NO: 664545 - protein, 9 aa, Homo Sapiens
HLDRMRLHG

SEQ ID NO: 664546 - protein, 9 aa, Homo Sapiens
WNGNAFEIW

SEQ ID NO: 664547 - protein, 9 aa, Homo Sapiens
KQHAMTLTK

SEQ ID NO: 664548 - protein, 9 aa, Homo Sapiens
VVSVFYTLV

SEQ ID NO: 664549 - protein, 9 aa, Homo Sapiens
ESNTSDSDQ

SEQ ID NO: 664550 - protein, 9 aa, Homo Sapiens
EESVTVTMD

SEQ ID NO: 664551 - protein, 9 aa, Homo Sapiens
TTGHRTLNV

SEQ ID NO: 664552 - protein, 9 aa, Homo Sapiens
SEDNMAFGM

SEQ ID NO: 664553 - protein, 9 aa, Homo Sapiens
LSPGARQYL

SEQ ID NO: 664554 - protein, 9 aa, Homo Sapiens
VRNQTEVTE

SEQ ID NO: 664555 - protein, 9 aa, Homo Sapiens
INRSLESLD

SEQ ID NO: 664556 - protein, 9 aa, Homo Sapiens
QQEPLCEDC

SEQ ID NO: 664557 - protein, 9 aa, Homo Sapiens
LLPLIVKNI

SEQ ID NO: 664558 - protein, 9 aa, Homo Sapiens
VPTSDEGKC

SEQ ID NO: 664559 - protein, 9 aa, Homo Sapiens
VWVQSKPHR

SEQ ID NO: 664560 - protein, 9 aa, Homo Sapiens
DTLTDLSMC

SEQ ID NO: 664561 - protein, 9 aa, Homo Sapiens
EFTILDAHK

SEQ ID NO: 664562 - protein, 9 aa, Homo Sapiens
SWAQAVLPS

SEQ ID NO: 664563 - protein, 9 aa, Homo Sapiens
SSSSNEFFK

SEQ ID NO: 664564 - protein, 9 aa, Homo Sapiens
PLKMSKIKL

SEQ ID NO: 664565 - protein, 9 aa, Homo Sapiens
RHQYRKSGK

SEQ ID NO: 664566 - protein, 9 aa, Homo Sapiens
SAESSQKKK

SEQ ID NO: 664567 - protein, 9 aa, Homo Sapiens
FLSCASPFV

SEQ ID NO: 664568 - protein, 9 aa, Homo Sapiens
AVFPGTICI

SEQ ID NO: 664569 - protein, 9 aa, Homo Sapiens
LLALRELPR

SEQ ID NO: 664570 - protein, 9 aa, Homo Sapiens
SLSSLESNT

SEQ ID NO: 664571 - protein, 9 aa, Homo Sapiens
VLFGSCTFF

SEQ ID NO: 664572 - protein, 9 aa, Homo Sapiens
LRSLPEPLV

SEQ ID NO: 664573 - protein, 9 aa, Homo Sapiens
GEKASAKRQ

SEQ ID NO: 664574 - protein, 9 aa, Homo Sapiens
CSEFCKLVL

SEQ ID NO: 664575 - protein, 9 aa, Homo Sapiens
RHWGRQLHP

SEQ ID NO: 664576 - protein, 9 aa, Homo Sapiens
APRHRLLVM

SEQ ID NO: 664577 - protein, 9 aa, Homo Sapiens
SKRHGPRPV

SEQ ID NO: 664578 - protein, 9 aa, Homo Sapiens
LLCVISLHG

SEQ ID NO: 664579 - protein, 9 aa, Homo Sapiens
DSNSWAQAV

SEQ ID NO: 664580 - protein, 9 aa, Homo Sapiens
KLRRLSKES

SEQ ID NO: 664581 - protein, 9 aa, Homo Sapiens
LSMCVRHLI

SEQ ID NO: 664582 - protein, 9 aa, Homo Sapiens
CSRKAISCV

SEQ ID NO: 664583 - protein, 9 aa, Homo Sapiens
SSLTGASSD

SEQ ID NO: 664584 - protein, 9 aa, Homo Sapiens
GRLAFSQRG

SEQ ID NO: 664585 - protein, 9 aa, Homo Sapiens
FPGSFRGQL

SEQ ID NO: 664586 - protein, 9 aa, Homo Sapiens
GLPASEEKS

SEQ ID NO: 664587 - protein, 9 aa, Homo Sapiens
YGVFGRCYL

SEQ ID NO: 664588 - protein, 9 aa, Homo Sapiens
NILEFQESG

SEQ ID NO: 664589 - protein, 9 aa, Homo Sapiens
VPLVNLCDC

SEQ ID NO: 664590 - protein, 9 aa, Homo Sapiens
VSTFLAFDQ

SEQ ID NO: 664591 - protein, 9 aa, Homo Sapiens
YGGKFLVFP

SEQ ID NO: 664592 - protein, 9 aa, Homo Sapiens
GSVTLTEIR

SEQ ID NO: 664593 - protein, 9 aa, Homo Sapiens
LCSRKAISC

SEQ ID NO: 664594 - protein, 9 aa, Homo Sapiens
SEDVITSQS

SEQ ID NO: 664595 - protein, 9 aa, Homo Sapiens
PPSSPSEVK

SEQ ID NO: 664596 - protein, 9 aa, Homo Sapiens
TKVPQGEQA

SEQ ID NO: 664597 - protein, 9 aa, Homo Sapiens
HTLFTDFER

SEQ ID NO: 664598 - protein, 9 aa, Homo Sapiens
SVSSPLPGQ

SEQ ID NO: 664599 - protein, 9 aa, Homo Sapiens
GAQDDSLSD

SEQ ID NO: 664600 - protein, 9 aa, Homo Sapiens
KTANMCRFL

SEQ ID NO: 664601 - protein, 9 aa, Homo Sapiens
YAPCTELVP

SEQ ID NO: 664602 - protein, 9 aa, Homo Sapiens
ALLARELYD

SEQ ID NO: 664603 - protein, 9 aa, Homo Sapiens
VLMALLIVA

SEQ ID NO: 664604 - protein, 9 aa, Homo Sapiens
EIRQAPPVI

SEQ ID NO: 664605 - protein, 9 aa, Homo Sapiens
FYATSIYTY

SEQ ID NO: 664606 - protein, 9 aa, Homo Sapiens
VEILRDLPH

SEQ ID NO: 664607 - protein, 9 aa, Homo Sapiens
DVGSDCTTI

SEQ ID NO: 664608 - protein, 9 aa, Homo Sapiens
KCLSLTAIH

SEQ ID NO: 664609 - protein, 9 aa, Homo Sapiens
PKPQGVIRS

SEQ ID NO: 664610 - protein, 9 aa, Homo Sapiens
SPRSVAVPV

SEQ ID NO: 664611 - protein, 9 aa, Homo Sapiens
LLFDQSLEI

SEQ ID NO: 664612 - protein, 9 aa, Homo Sapiens
SQIRTRSFG

SEQ ID NO: 664613 - protein, 9 aa, Homo Sapiens
VFAAVCTRA

SEQ ID NO: 664614 - protein, 9 aa, Homo Sapiens
VKAYKEIRV

SEQ ID NO: 664615 - protein, 9 aa, Homo Sapiens
GSPLKMSKI

SEQ ID NO: 664616 - protein, 9 aa, Homo Sapiens
MASTTHQEK

SEQ ID NO: 664617 - protein, 9 aa, Homo Sapiens
LNVLRDQMR

SEQ ID NO: 664618 - protein, 9 aa, Homo Sapiens
VSPSWCGSS

SEQ ID NO: 664619 - protein, 9 aa, Homo Sapiens
LAVIANCIE

SEQ ID NO: 664620 - protein, 9 aa, Homo Sapiens
VAPLTITFV

SEQ ID NO: 664621 - protein, 9 aa, Homo Sapiens
FQQTHQVRF

SEQ ID NO: 664622 - protein, 9 aa, Homo Sapiens
NQPEPLNLF

SEQ ID NO: 664623 - protein, 9 aa, Homo Sapiens
WCGSSRHLT

SEQ ID NO: 664624 - protein, 9 aa, Homo Sapiens
KVSSQIRTR

SEQ ID NO: 664625 - protein, 9 aa, Homo Sapiens
CAAESFVLV

SEQ ID NO: 664626 - protein, 9 aa, Homo Sapiens
YKSDAKGVK

SEQ ID NO: 664627 - protein, 9 aa, Homo Sapiens
ANARITGNS

SEQ ID NO: 664628 - protein, 9 aa, Homo Sapiens
KAVVVNNLV

SEQ ID NO: 664629 - protein, 9 aa, Homo Sapiens
DVSVLSSGS

SEQ ID NO: 664630 - protein, 9 aa, Homo Sapiens
KKSCSYCTM

SEQ ID NO: 664631 - protein, 9 aa, Homo Sapiens
LLGEVNICL

SEQ ID NO: 664632 - protein, 9 aa, Homo Sapiens
VFLICGYSQ

SEQ ID NO: 664633 - protein, 9 aa, Homo Sapiens
NMSTVSWDP

SEQ ID NO: 664634 - protein, 9 aa, Homo Sapiens
VAQFLSCAS

SEQ ID NO: 664635 - protein, 9 aa, Homo Sapiens
CCLPKDYKV

SEQ ID NO: 664636 - protein, 9 aa, Homo Sapiens
KRLSSSVTM

SEQ ID NO: 664637 - protein, 9 aa, Homo Sapiens
VVYGALSIG

SEQ ID NO: 664638 - protein, 9 aa, Homo Sapiens
ITLVRKQLQ

SEQ ID NO: 664639 - protein, 9 aa, Homo Sapiens
YPASQLDVF

SEQ ID NO: 664640 - protein, 9 aa, Homo Sapiens
TVEPAARGS

SEQ ID NO: 664641 - protein, 9 aa, Homo Sapiens
QKERQKEEG

SEQ ID NO: 664642 - protein, 9 aa, Homo Sapiens
IFQQTHQVR

SEQ ID NO: 664643 - protein, 9 aa, Homo Sapiens
QVSVEILRD

SEQ ID NO: 664644 - protein, 9 aa, Homo Sapiens
FLQSGETSK

SEQ ID NO: 664645 - protein, 9 aa, Homo Sapiens
IGETAILCT

SEQ ID NO: 664646 - protein, 9 aa, Homo Sapiens
ITGNSPRRT

SEQ ID NO: 664647 - protein, 9 aa, Homo Sapiens
LPEPLVTYE

SEQ ID NO: 664648 - protein, 9 aa, Homo Sapiens
SQEELRKKQ

SEQ ID NO: 664649 - protein, 9 aa, Homo Sapiens
MYDEGKPVT

SEQ ID NO: 664650 - protein, 9 aa, Homo Sapiens
ADSKCLSLT

SEQ ID NO: 664651 - protein, 9 aa, Homo Sapiens
ESFLCLTRK

SEQ ID NO: 664652 - protein, 9 aa, Homo Sapiens
EEMHESMRR

SEQ ID NO: 664653 - protein, 9 aa, Homo Sapiens
QTPLMFTYY

SEQ ID NO: 664654 - protein, 9 aa, Homo Sapiens
AVDITPQEN

SEQ ID NO: 664655 - protein, 9 aa, Homo Sapiens
QDEKTQGQG

SEQ ID NO: 664656 - protein, 9 aa, Homo Sapiens
DAKHPAVFT

SEQ ID NO: 664657 - protein, 9 aa, Homo Sapiens
ELLENSLKK

SEQ ID NO: 664658 - protein, 9 aa, Homo Sapiens
YGGSSSISR

SEQ ID NO: 664659 - protein, 9 aa, Homo Sapiens
GVFGRCYLA

SEQ ID NO: 664660 - protein, 9 aa, Homo Sapiens
DFSNQLSDY

SEQ ID NO: 664661 - protein, 9 aa, Homo Sapiens
VEDPFRFAL

SEQ ID NO: 664662 - protein, 9 aa, Homo Sapiens
NCIEDMDTM

SEQ ID NO: 664663 - protein, 9 aa, Homo Sapiens
NLHSVAAHE

SEQ ID NO: 664664 - protein, 9 aa, Homo Sapiens
DTATLSCGL

SEQ ID NO: 664665 - protein, 9 aa, Homo Sapiens
QHAMTLTKA

SEQ ID NO: 664666 - protein, 9 aa, Homo Sapiens
RQSFWQSAV

SEQ ID NO: 664667 - protein, 9 aa, Homo Sapiens
RKPAARLTW

SEQ ID NO: 664668 - protein, 9 aa, Homo Sapiens
TTLPLDTRT

SEQ ID NO: 664669 - protein, 9 aa, Homo Sapiens
VVGDEEPPL

SEQ ID NO: 664670 - protein, 9 aa, Homo Sapiens
FADSKCLSL

SEQ ID NO: 664671 - protein, 9 aa, Homo Sapiens
HLESMQLPL

SEQ ID NO: 664672 - protein, 9 aa, Homo Sapiens
KRLGSTAPR

SEQ ID NO: 664673 - protein, 9 aa, Homo Sapiens
ASTVSAPVS

SEQ ID NO: 664674 - protein, 9 aa, Homo Sapiens
IHEWTVLQA

SEQ ID NO: 664675 - protein, 9 aa, Homo Sapiens
DHSHLGCCL

SEQ ID NO: 664676 - protein, 9 aa, Homo Sapiens
LGEVNICLR

SEQ ID NO: 664677 - protein, 9 aa, Homo Sapiens
REEMHESMR

SEQ ID NO: 664678 - protein, 9 aa, Homo Sapiens
PSWCGSSRH

SEQ ID NO: 664679 - protein, 9 aa, Homo Sapiens
VAGECWTRP

SEQ ID NO: 664680 - protein, 9 aa, Homo Sapiens
SFGADCFPY

SEQ ID NO: 664681 - protein, 9 aa, Homo Sapiens
AARGSTGLD

SEQ ID NO: 664682 - protein, 9 aa, Homo Sapiens
GPLHLLFSL

SEQ ID NO: 664683 - protein, 9 aa, Homo Sapiens
EPGVSAQFT

SEQ ID NO: 664684 - protein, 9 aa, Homo Sapiens
LLQQQKICL

SEQ ID NO: 664685 - protein, 9 aa, Homo Sapiens
DSKKKYFRQ

SEQ ID NO: 664686 - protein, 9 aa, Homo Sapiens
TGEKFCKCE

SEQ ID NO: 664687 - protein, 9 aa, Homo Sapiens
LIDAVPTSD

SEQ ID NO: 664688 - protein, 9 aa, Homo Sapiens
HYPDAFVSE

SEQ ID NO: 664689 - protein, 9 aa, Homo Sapiens
RLRVLDINE

SEQ ID NO: 664690 - protein, 9 aa, Homo Sapiens
CLPSARPLS

SEQ ID NO: 664691 - protein, 9 aa, Homo Sapiens
SLIGMLFAR

SEQ ID NO: 664692 - protein, 9 aa, Homo Sapiens
RHRLLVMVK

SEQ ID NO: 664693 - protein, 9 aa, Homo Sapiens
WALLESPHT

SEQ ID NO: 664694 - protein, 9 aa, Homo Sapiens
AGFDKLAAE

SEQ ID NO: 664695 - protein, 9 aa, Homo Sapiens
LQQQKICLN

SEQ ID NO: 664696 - protein, 9 aa, Homo Sapiens
LLPRLDGSG

SEQ ID NO: 664697 - protein, 9 aa, Homo Sapiens
HSVAAHELG

SEQ ID NO: 664698 - protein, 9 aa, Homo Sapiens
VRFASLLQR

SEQ ID NO: 664699 - protein, 9 aa, Homo Sapiens
KLTVYTDAL

SEQ ID NO: 664700 - protein, 9 aa, Homo Sapiens
EKLRQYKVL

SEQ ID NO: 664701 - protein, 9 aa, Homo Sapiens
KQLSFKCNF

SEQ ID NO: 664702 - protein, 9 aa, Homo Sapiens
FPGFIGSRV

SEQ ID NO: 664703 - protein, 9 aa, Homo Sapiens
LGALIHNVS

SEQ ID NO: 664704 - protein, 9 aa, Homo Sapiens
RSFRPLLRP

SEQ ID NO: 664705 - protein, 9 aa, Homo Sapiens
WPDPSHFLY

SEQ ID NO: 664706 - protein, 9 aa, Homo Sapiens
SMRRFLEHM

SEQ ID NO: 664707 - protein, 9 aa, Homo Sapiens
CIEDMDTMV

SEQ ID NO: 664708 - protein, 9 aa, Homo Sapiens
QDFSNQLSD

SEQ ID NO: 664709 - protein, 9 aa, Homo Sapiens
SPENRNLWE

SEQ ID NO: 664710 - protein, 9 aa, Homo Sapiens
REQKERQKE

SEQ ID NO: 664711 - protein, 9 aa, Homo Sapiens
EKNFARFKY

SEQ ID NO: 664712 - protein, 9 aa, Homo Sapiens
AQQVKKSTL

SEQ ID NO: 664713 - protein, 9 aa, Homo Sapiens
LKSWGLTLL

SEQ ID NO: 664714 - protein, 9 aa, Homo Sapiens
FTSSLLGYG

SEQ ID NO: 664715 - protein, 9 aa, Homo Sapiens
RLAFSQRGL

SEQ ID NO: 664716 - protein, 9 aa, Homo Sapiens
SSLLGYGPF

SEQ ID NO: 664717 - protein, 9 aa, Homo Sapiens
ICAAESFVL

SEQ ID NO: 664718 - protein, 9 aa, Homo Sapiens
SSSISREEY

SEQ ID NO: 664719 - protein, 9 aa, Homo Sapiens
WHKDWQPLQ

SEQ ID NO: 664720 - protein, 9 aa, Homo Sapiens
HSAVAQLPV

SEQ ID NO: 664721 - protein, 9 aa, Homo Sapiens
PEELKEKMD

SEQ ID NO: 664722 - protein, 9 aa, Homo Sapiens
HGLVFGYDT

SEQ ID NO: 664723 - protein, 9 aa, Homo Sapiens
LENALVSYS

SEQ ID NO: 664724 - protein, 9 aa, Homo Sapiens
SIQLSPEEN

SEQ ID NO: 664725 - protein, 9 aa, Homo Sapiens
EKKLNRDRM

SEQ ID NO: 664726 - protein, 9 aa, Homo Sapiens
DFERKGLLI

SEQ ID NO: 664727 - protein, 9 aa, Homo Sapiens
KQCKIYDSL

SEQ ID NO: 664728 - protein, 9 aa, Homo Sapiens
ECSSYSGHN

SEQ ID NO: 664729 - protein, 9 aa, Homo Sapiens
QSLRDQYRF

SEQ ID NO: 664730 - protein, 9 aa, Homo Sapiens
SSDLGTGAV

SEQ ID NO: 664731 - protein, 9 aa, Homo Sapiens
EEPAAEEPS

SEQ ID NO: 664732 - protein, 9 aa, Homo Sapiens
KKHKSTSGG

SEQ ID NO: 664733 - protein, 9 aa, Homo Sapiens
KWYGGSSSI

SEQ ID NO: 664734 - protein, 9 aa, Homo Sapiens
RAKQLLLEL

SEQ ID NO: 664735 - protein, 9 aa, Homo Sapiens
VGDEEPPLH

SEQ ID NO: 664736 - protein, 9 aa, Homo Sapiens
GRGLACDPD

SEQ ID NO: 664737 - protein, 9 aa, Homo Sapiens
ISLPSQRPK

SEQ ID NO: 664738 - protein, 9 aa, Homo Sapiens
LSKRHGPRP

SEQ ID NO: 664739 - protein, 9 aa, Homo Sapiens
YTACATSLQ

SEQ ID NO: 664740 - protein, 9 aa, Homo Sapiens
GFQGLRHEF

SEQ ID NO: 664741 - protein, 9 aa, Homo Sapiens
KHPAVFTRI

SEQ ID NO: 664742 - protein, 9 aa, Homo Sapiens
NTTLQKAQS

SEQ ID NO: 664743 - protein, 9 aa, Homo Sapiens
LGRDVEMEQ

SEQ ID NO: 664744 - protein, 9 aa, Homo Sapiens
IRVEDTEIC

SEQ ID NO: 664745 - protein, 9 aa, Homo Sapiens
ILIPFLLVM

SEQ ID NO: 664746 - protein, 9 aa, Homo Sapiens
NVSACDATI

SEQ ID NO: 664747 - protein, 9 aa, Homo Sapiens
ASSKKPPVS

SEQ ID NO: 664748 - protein, 9 aa, Homo Sapiens
TNSQTLIPH

SEQ ID NO: 664749 - protein, 9 aa, Homo Sapiens
NQLCSKTKG

SEQ ID NO: 664750 - protein, 9 aa, Homo Sapiens
RVTKVPQGE

SEQ ID NO: 664751 - protein, 9 aa, Homo Sapiens
VDGKKLRIS

SEQ ID NO: 664752 - protein, 9 aa, Homo Sapiens
FPTGGFTSS

SEQ ID NO: 664753 - protein, 9 aa, Homo Sapiens
QVEKVDVIA

SEQ ID NO: 664754 - protein, 9 aa, Homo Sapiens
LARLVISVT

SEQ ID NO: 664755 - protein, 9 aa, Homo Sapiens
SSSVTMRKS

SEQ ID NO: 664756 - protein, 9 aa, Homo Sapiens
ENTLIRRLS

SEQ ID NO: 664757 - protein, 9 aa, Homo Sapiens
AAGPVSPSW

SEQ ID NO: 664758 - protein, 9 aa, Homo Sapiens
QCSLGMRTL

SEQ ID NO: 664759 - protein, 9 aa, Homo Sapiens
VMHALRQSW

SEQ ID NO: 664760 - protein, 9 aa, Homo Sapiens
SVAVPVLVK

SEQ ID NO: 664761 - protein, 9 aa, Homo Sapiens
ESNNLDQSL

SEQ ID NO: 664762 - protein, 9 aa, Homo Sapiens
DCHLHCEDG

SEQ ID NO: 664763 - protein, 9 aa, Homo Sapiens
EQMIEQLQE

SEQ ID NO: 664764 - protein, 9 aa, Homo Sapiens
AKPHLTWWK

SEQ ID NO: 664765 - protein, 9 aa, Homo Sapiens
SSSSTALLL

SEQ ID NO: 664766 - protein, 9 aa, Homo Sapiens
FVQEKIPSP

SEQ ID NO: 664767 - protein, 9 aa, Homo Sapiens
IFAIYLLCC

SEQ ID NO: 664768 - protein, 9 aa, Homo Sapiens
KYLLECKKS

SEQ ID NO: 664769 - protein, 9 aa, Homo Sapiens
GNSPRRTDV

SEQ ID NO: 664770 - protein, 9 aa, Homo Sapiens
EQMKKGYNP

SEQ ID NO: 664771 - protein, 9 aa, Homo Sapiens
LESIHRFSL

SEQ ID NO: 664772 - protein, 9 aa, Homo Sapiens
ENECLKGKI

SEQ ID NO: 664773 - protein, 9 aa, Homo Sapiens
HPAVFTRIS

SEQ ID NO: 664774 - protein, 9 aa, Homo Sapiens
ANLNDTMTF

SEQ ID NO: 664775 - protein, 9 aa, Homo Sapiens
EAKNGYKSD

SEQ ID NO: 664776 - protein, 9 aa, Homo Sapiens
FNDLGLGYS

SEQ ID NO: 664777 - protein, 9 aa, Homo Sapiens
TLNCQSSGR

SEQ ID NO: 664778 - protein, 9 aa, Homo Sapiens
TLQKAQSFD

SEQ ID NO: 664779 - protein, 9 aa, Homo Sapiens
SHFLYWSGF

SEQ ID NO: 664780 - protein, 9 aa, Homo Sapiens
MEHGIITNC

SEQ ID NO: 664781 - protein, 9 aa, Homo Sapiens
LHPAGRGGA

SEQ ID NO: 664782 - protein, 9 aa, Homo Sapiens
PSPRPRGPA

SEQ ID NO: 664783 - protein, 9 aa, Homo Sapiens
LKQCGEAFT

SEQ ID NO: 664784 - protein, 9 aa, Homo Sapiens
AEEAHQHKC

SEQ ID NO: 664785 - protein, 9 aa, Homo Sapiens
EPAARGSTG

SEQ ID NO: 664786 - protein, 9 aa, Homo Sapiens
FAGFDKLAA

SEQ ID NO: 664787 - protein, 9 aa, Homo Sapiens
RGRKCSARS

SEQ ID NO: 664788 - protein, 9 aa, Homo Sapiens
EWDGLIFWP

SEQ ID NO: 664789 - protein, 9 aa, Homo Sapiens
PPPSPRSVA

SEQ ID NO: 664790 - protein, 9 aa, Homo Sapiens
NFYFGKLDG

SEQ ID NO: 664791 - protein, 9 aa, Homo Sapiens
QLPVQPVYP

SEQ ID NO: 664792 - protein, 9 aa, Homo Sapiens
GTLLFLYFR

SEQ ID NO: 664793 - protein, 9 aa, Homo Sapiens
SVEILRDLP

SEQ ID NO: 664794 - protein, 9 aa, Homo Sapiens
EKHYRCKEC

SEQ ID NO: 664795 - protein, 9 aa, Homo Sapiens
NRDRMQYFT

SEQ ID NO: 664796 - protein, 9 aa, Homo Sapiens
SNGAITPGS

SEQ ID NO: 664797 - protein, 9 aa, Homo Sapiens
VELVQHVFA

SEQ ID NO: 664798 - protein, 9 aa, Homo Sapiens
SGEKLNELK

SEQ ID NO: 664799 - protein, 9 aa, Homo Sapiens
EKLHQQIPP

SEQ ID NO: 664800 - protein, 9 aa, Homo Sapiens
LGQDEKTQG

SEQ ID NO: 664801 - protein, 9 aa, Homo Sapiens
LQKLNVIHN

SEQ ID NO: 664802 - protein, 9 aa, Homo Sapiens
FGGWQAVDI

SEQ ID NO: 664803 - protein, 9 aa, Homo Sapiens
QIKPVELLE

SEQ ID NO: 664804 - protein, 9 aa, Homo Sapiens
HVGDVSVLS

SEQ ID NO: 664805 - protein, 9 aa, Homo Sapiens
GALTLANCV

SEQ ID NO: 664806 - protein, 9 aa, Homo Sapiens
CRHWGRQLH

SEQ ID NO: 664807 - protein, 9 aa, Homo Sapiens
ARQYLSVNV

SEQ ID NO: 664808 - protein, 9 aa, Homo Sapiens
QWGEESSVS

SEQ ID NO: 664809 - protein, 9 aa, Homo Sapiens
GAIVFFLSV

SEQ ID NO: 664810 - protein, 9 aa, Homo Sapiens
VPYEPPDVG

SEQ ID NO: 664811 - protein, 9 aa, Homo Sapiens
QKQRIANAR

SEQ ID NO: 664812 - protein, 9 aa, Homo Sapiens
TLSCGLPKK

SEQ ID NO: 664813 - protein, 9 aa, Homo Sapiens
FVSEELARR

SEQ ID NO: 664814 - protein, 9 aa, Homo Sapiens
VQLDHRHLV

SEQ ID NO: 664815 - protein, 9 aa, Homo Sapiens
KVVSVFYTL

SEQ ID NO: 664816 - protein, 9 aa, Homo Sapiens
EPPDVGSDC

SEQ ID NO: 664817 - protein, 9 aa, Homo Sapiens
SSFGADCFP

SEQ ID NO: 664818 - protein, 9 aa, Homo Sapiens
TDCYVALHA

SEQ ID NO: 664819 - protein, 9 aa, Homo Sapiens
PLKLNSSTE

SEQ ID NO: 664820 - protein, 9 aa, Homo Sapiens
TFVREEVID

SEQ ID NO: 664821 - protein, 9 aa, Homo Sapiens
GFCFVFLIC

SEQ ID NO: 664822 - protein, 9 aa, Homo Sapiens
AITPGSQAA

SEQ ID NO: 664823 - protein, 9 aa, Homo Sapiens
FWQSAVETN

SEQ ID NO: 664824 - protein, 9 aa, Homo Sapiens
HWNKKPRRS

SEQ ID NO: 664825 - protein, 9 aa, Homo Sapiens
CLSLTAIHV

SEQ ID NO: 664826 - protein, 9 aa, Homo Sapiens
HGAAPCLVL

SEQ ID NO: 664827 - protein, 9 aa, Homo Sapiens
FCFVFLICG

SEQ ID NO: 664828 - protein, 9 aa, Homo Sapiens
DSSSVMVLV

SEQ ID NO: 664829 - protein, 9 aa, Homo Sapiens
TISLGEAEG

SEQ ID NO: 664830 - protein, 9 aa, Homo Sapiens
KIKPQFECR

SEQ ID NO: 664831 - protein, 9 aa, Homo Sapiens
CSLPYACRR

SEQ ID NO: 664832 - protein, 9 aa, Homo Sapiens
RVLDINEAF

SEQ ID NO: 664833 - protein, 9 aa, Homo Sapiens
CASPFVSKV

SEQ ID NO: 664834 - protein, 9 aa, Homo Sapiens
QPIQHMLRL

SEQ ID NO: 664835 - protein, 9 aa, Homo Sapiens
DITPQENSD

SEQ ID NO: 664836 - protein, 9 aa, Homo Sapiens
YKEIRVANL

SEQ ID NO: 664837 - protein, 9 aa, Homo Sapiens
LMIRKTRES

SEQ ID NO: 664838 - protein, 9 aa, Homo Sapiens
LLGHLFNDL

SEQ ID NO: 664839 - protein, 9 aa, Homo Sapiens
VAMRLHPAG

SEQ ID NO: 664840 - protein, 9 aa, Homo Sapiens
NVSDGIVRL

SEQ ID NO: 664841 - protein, 9 aa, Homo Sapiens
TLLPRLDGS

SEQ ID NO: 664842 - protein, 9 aa, Homo Sapiens
TIAWLRICR

SEQ ID NO: 664843 - protein, 9 aa, Homo Sapiens
LTLCTYISL

SEQ ID NO: 664844 - protein, 9 aa, Homo Sapiens
TICITRYSA

SEQ ID NO: 664845 - protein, 9 aa, Homo Sapiens
STNTVANTS

SEQ ID NO: 664846 - protein, 9 aa, Homo Sapiens
IEDMDTMVQ

SEQ ID NO: 664847 - protein, 9 aa, Homo Sapiens
KRQQEPLCE

SEQ ID NO: 664848 - protein, 9 aa, Homo Sapiens
AFRRRWRRR

SEQ ID NO: 664849 - protein, 9 aa, Homo Sapiens
TGAAGVDWG

SEQ ID NO: 664850 - protein, 9 aa, Homo Sapiens
LWRALYGVF

SEQ ID NO: 664851 - protein, 9 aa, Homo Sapiens
VQCSLGMRT

SEQ ID NO: 664852 - protein, 9 aa, Homo Sapiens
VVVNNLVSG

SEQ ID NO: 664853 - protein, 9 aa, Homo Sapiens
RMQYFTGNP

SEQ ID NO: 664854 - protein, 9 aa, Homo Sapiens
GRKPAARLT

SEQ ID NO: 664855 - protein, 9 aa, Homo Sapiens
DVEGHKPPD

SEQ ID NO: 664856 - protein, 9 aa, Homo Sapiens
HRVLRHSSA

SEQ ID NO: 664857 - protein, 9 aa, Homo Sapiens
KVWFQNSRM

SEQ ID NO: 664858 - protein, 9 aa, Homo Sapiens
QYRKSGKEI

SEQ ID NO: 664859 - protein, 9 aa, Homo Sapiens
LHGHELRPW

SEQ ID NO: 664860 - protein, 9 aa, Homo Sapiens
QHMLRLICV

SEQ ID NO: 664861 - protein, 9 aa, Homo Sapiens
LGRKPLPPE

SEQ ID NO: 664862 - protein, 9 aa, Homo Sapiens
VANTSPTAA

SEQ ID NO: 664863 - protein, 9 aa, Homo Sapiens
LHDLSKKPP

SEQ ID NO: 664864 - protein, 9 aa, Homo Sapiens
SGETSKTDA

SEQ ID NO: 664865 - protein, 9 aa, Homo Sapiens
ENNQPEPLN

SEQ ID NO: 664866 - protein, 9 aa, Homo Sapiens
VQPVYPAAF

SEQ ID NO: 664867 - protein, 9 aa, Homo Sapiens
FSYPCCQPL

SEQ ID NO: 664868 - protein, 9 aa, Homo Sapiens
QLDLHDLSK

SEQ ID NO: 664869 - protein, 9 aa, Homo Sapiens
AFVSEELAR

SEQ ID NO: 664870 - protein, 9 aa, Homo Sapiens
SGECSEFCK

SEQ ID NO: 664871 - protein, 9 aa, Homo Sapiens
LQNCILTLM

SEQ ID NO: 664872 - protein, 9 aa, Homo Sapiens
QHRPGDQSD

SEQ ID NO: 664873 - protein, 9 aa, Homo Sapiens
SKRLSSSVT

SEQ ID NO: 664874 - protein, 9 aa, Homo Sapiens
RLAKNMSGW

SEQ ID NO: 664875 - protein, 9 aa, Homo Sapiens
PFVERTPDT

SEQ ID NO: 664876 - protein, 9 aa, Homo Sapiens
LYAIFTKKF

SEQ ID NO: 664877 - protein, 9 aa, Homo Sapiens
HLQRTYLYA

SEQ ID NO: 664878 - protein, 9 aa, Homo Sapiens
ATSIYTYLR

SEQ ID NO: 664879 - protein, 9 aa, Homo Sapiens
WQTFLTIRL

SEQ ID NO: 664880 - protein, 9 aa, Homo Sapiens
RLVLALKEE

SEQ ID NO: 664881 - protein, 9 aa, Homo Sapiens
LCLPMPIDI

SEQ ID NO: 664882 - protein, 9 aa, Homo Sapiens
GKAFKCSSK

SEQ ID NO: 664883 - protein, 9 aa, Homo Sapiens
IQHMLRLIC

SEQ ID NO: 664884 - protein, 9 aa, Homo Sapiens
SGPGHGQVT

SEQ ID NO: 664885 - protein, 9 aa, Homo Sapiens
LGMRTLQRR

SEQ ID NO: 664886 - protein, 9 aa, Homo Sapiens
HVEALKQWS

SEQ ID NO: 664887 - protein, 9 aa, Homo Sapiens
GVNLSCLRT

SEQ ID NO: 664888 - protein, 9 aa, Homo Sapiens
PRAMCKELP

SEQ ID NO: 664889 - protein, 9 aa, Homo Sapiens
LPIQTTSVG

SEQ ID NO: 664890 - protein, 9 aa, Homo Sapiens
IHTGEKFCK

SEQ ID NO: 664891 - protein, 9 aa, Homo Sapiens
ELSFCLGAL

SEQ ID NO: 664892 - protein, 9 aa, Homo Sapiens
LIPRTMNCM

SEQ ID NO: 664893 - protein, 9 aa, Homo Sapiens
NGKKDSKKD

SEQ ID NO: 664894 - protein, 9 aa, Homo Sapiens
STFLAFDQP

SEQ ID NO: 664895 - protein, 9 aa, Homo Sapiens
VLRHSSAKV

SEQ ID NO: 664896 - protein, 9 aa, Homo Sapiens
LVMVKDHGE

SEQ ID NO: 664897 - protein, 9 aa, Homo Sapiens
RSRVTRRLR

SEQ ID NO: 664898 - protein, 9 aa, Homo Sapiens
TEIRLPLKA

SEQ ID NO: 664899 - protein, 9 aa, Homo Sapiens
QTLIPHCQK

SEQ ID NO: 664900 - protein, 9 aa, Homo Sapiens
QRKISLPSQ

SEQ ID NO: 664901 - protein, 9 aa, Homo Sapiens
LEHDCCQDF

SEQ ID NO: 664902 - protein, 9 aa, Homo Sapiens
DGLPGLPVD

SEQ ID NO: 664903 - protein, 9 aa, Homo Sapiens
TAPRELKQP

SEQ ID NO: 664904 - protein, 9 aa, Homo Sapiens
STNYWELKN

SEQ ID NO: 664905 - protein, 9 aa, Homo Sapiens
NELFAGFDK

SEQ ID NO: 664906 - protein, 9 aa, Homo Sapiens
GAVFPGTIC

SEQ ID NO: 664907 - protein, 9 aa, Homo Sapiens
HGHELRPWR

SEQ ID NO: 664908 - protein, 9 aa, Homo Sapiens
IFTKKFRRD

SEQ ID NO: 664909 - protein, 9 aa, Homo Sapiens
HRHLVEAGK

SEQ ID NO: 664910 - protein, 9 aa, Homo Sapiens
AFLTQNQKV

SEQ ID NO: 664911 - protein, 9 aa, Homo Sapiens
VVSFPVIVS

SEQ ID NO: 664912 - protein, 9 aa, Homo Sapiens
PEENECLKG

SEQ ID NO: 664913 - protein, 9 aa, Homo Sapiens
PEVGSLPGS

SEQ ID NO: 664914 - protein, 9 aa, Homo Sapiens
AFSGRSYLS

SEQ ID NO: 664915 - protein, 9 aa, Homo Sapiens
GCLPSARPL

SEQ ID NO: 664916 - protein, 9 aa, Homo Sapiens
PLPLKLNSS

SEQ ID NO: 664917 - protein, 9 aa, Homo Sapiens
VKEVPCCWH

SEQ ID NO: 664918 - protein, 9 aa, Homo Sapiens
LVRESPPHQ

SEQ ID NO: 664919 - protein, 9 aa, Homo Sapiens
MIRKTRESD

SEQ ID NO: 664920 - protein, 9 aa, Homo Sapiens
QRTYLYAWA

SEQ ID NO: 664921 - protein, 9 aa, Homo Sapiens
QLPLVSDKN

SEQ ID NO: 664922 - protein, 9 aa, Homo Sapiens
VDIYEKYQY

SEQ ID NO: 664923 - protein, 9 aa, Homo Sapiens
TQVSIFQQT

SEQ ID NO: 664924 - protein, 9 aa, Homo Sapiens
RSVAQFLSC

SEQ ID NO: 664925 - protein, 9 aa, Homo Sapiens
NITLTVGTN

SEQ ID NO: 664926 - protein, 9 aa, Homo Sapiens
EGHKPPDGE

SEQ ID NO: 664927 - protein, 9 aa, Homo Sapiens
LALSHKYGG

SEQ ID NO: 664928 - protein, 9 aa, Homo Sapiens
IRKKLGRKP

SEQ ID NO: 664929 - protein, 9 aa, Homo Sapiens
PQFECRAGQ

SEQ ID NO: 664930 - protein, 9 aa, Homo Sapiens
FILFGGVLF

SEQ ID NO: 664931 - protein, 9 aa, Homo Sapiens
EKMDDTKPT

SEQ ID NO: 664932 - protein, 9 aa, Homo Sapiens
LLENSLKKR

SEQ ID NO: 664933 - protein, 9 aa, Homo Sapiens
WIGETAILC

SEQ ID NO: 664934 - protein, 9 aa, Homo Sapiens
DITGKPLIR

SEQ ID NO: 664935 - protein, 9 aa, Homo Sapiens
GRGGAFPGS

SEQ ID NO: 664936 - protein, 9 aa, Homo Sapiens
PDEAAPFVE

SEQ ID NO: 664937 - protein, 9 aa, Homo Sapiens
PCLVLPEGG

SEQ ID NO: 664938 - protein, 9 aa, Homo Sapiens
RFSKFLVHE

SEQ ID NO: 664939 - protein, 9 aa, Homo Sapiens
GGSSSISRE

SEQ ID NO: 664940 - protein, 9 aa, Homo Sapiens
HDMEMVQAI

SEQ ID NO: 664941 - protein, 9 aa, Homo Sapiens
LVRKQLQEL

SEQ ID NO: 664942 - protein, 9 aa, Homo Sapiens
IHRFSLLPT

SEQ ID NO: 664943 - protein, 9 aa, Homo Sapiens
DKDTATLSC

SEQ ID NO: 664944 - protein, 9 aa, Homo Sapiens
SSSVMVLVN

SEQ ID NO: 664945 - protein, 9 aa, Homo Sapiens
TEDEGRAKP

SEQ ID NO: 664946 - protein, 9 aa, Homo Sapiens
PGSFRGQLF

SEQ ID NO: 664947 - protein, 9 aa, Homo Sapiens
PLVTSNIMG

SEQ ID NO: 664948 - protein, 9 aa, Homo Sapiens
PDEQLGRLL

SEQ ID NO: 664949 - protein, 9 aa, Homo Sapiens
PHVGDVSVL

SEQ ID NO: 664950 - protein, 9 aa, Homo Sapiens
EFFKCDQYG

SEQ ID NO: 664951 - protein, 9 aa, Homo Sapiens
VEALKQWSL

SEQ ID NO: 664952 - protein, 9 aa, Homo Sapiens
LEGQLPDEQ

SEQ ID NO: 664953 - protein, 9 aa, Homo Sapiens
KPALASGPK

SEQ ID NO: 664954 - protein, 9 aa, Homo Sapiens
SFSIMIEFN

SEQ ID NO: 664955 - protein, 9 aa, Homo Sapiens
PPDGEEEEE

SEQ ID NO: 664956 - protein, 9 aa, Homo Sapiens
PGVSAQFTK

SEQ ID NO: 664957 - protein, 9 aa, Homo Sapiens
EVPCCWHCE

SEQ ID NO: 664958 - protein, 9 aa, Homo Sapiens
LERFSAKQF

SEQ ID NO: 664959 - protein, 9 aa, Homo Sapiens
KLTLCTYIS

SEQ ID NO: 664960 - protein, 9 aa, Homo Sapiens
NGSSFGADC

SEQ ID NO: 664961 - protein, 9 aa, Homo Sapiens
GLSSKSTIL

SEQ ID NO: 664962 - protein, 9 aa, Homo Sapiens
RLGSTAPRE

SEQ ID NO: 664963 - protein, 9 aa, Homo Sapiens
RELHQFAHD

SEQ ID NO: 664964 - protein, 9 aa, Homo Sapiens
YFRQTTTPL

SEQ ID NO: 664965 - protein, 9 aa, Homo Sapiens
KQRIANARA

SEQ ID NO: 664966 - protein, 9 aa, Homo Sapiens
RCPRKSLVN

SEQ ID NO: 664967 - protein, 9 aa, Homo Sapiens
MEMVQAIAP

SEQ ID NO: 664968 - protein, 9 aa, Homo Sapiens
CLNRARKYF

SEQ ID NO: 664969 - protein, 9 aa, Homo Sapiens
CHLHCEDGS

SEQ ID NO: 664970 - protein, 9 aa, Homo Sapiens
YGFWALLES

SEQ ID NO: 664971 - protein, 9 aa, Homo Sapiens
SNECCETSD

SEQ ID NO: 664972 - protein, 9 aa, Homo Sapiens
GKLTLCTYI

SEQ ID NO: 664973 - protein, 9 aa, Homo Sapiens
VRKQLQELQ

SEQ ID NO: 664974 - protein, 9 aa, Homo Sapiens
ELALIPRTM

SEQ ID NO: 664975 - protein, 9 aa, Homo Sapiens
HKCPENDIR

SEQ ID NO: 664976 - protein, 9 aa, Homo Sapiens
LTEIRLPLK

SEQ ID NO: 664977 - protein, 9 aa, Homo Sapiens
SQMAYPTAY

SEQ ID NO: 664978 - protein, 9 aa, Homo Sapiens
QAPKTVEAI

SEQ ID NO: 664979 - protein, 9 aa, Homo Sapiens
QRGLPTITP

SEQ ID NO: 664980 - protein, 9 aa, Homo Sapiens
RPVAMRLHP

SEQ ID NO: 664981 - protein, 9 aa, Homo Sapiens
GMRTLQRRA

SEQ ID NO: 664982 - protein, 9 aa, Homo Sapiens
ASALLSGAE

SEQ ID NO: 664983 - protein, 9 aa, Homo Sapiens
SAVSSALPF

SEQ ID NO: 664984 - protein, 9 aa, Homo Sapiens
HYEDALKDE

SEQ ID NO: 664985 - protein, 9 aa, Homo Sapiens
RECGDVSRS

SEQ ID NO: 664986 - protein, 9 aa, Homo Sapiens
EEFVLSSGE

SEQ ID NO: 664987 - protein, 9 aa, Homo Sapiens
TVANTSPTA

SEQ ID NO: 664988 - protein, 9 aa, Homo Sapiens
NSSSSNEFF

SEQ ID NO: 664989 - protein, 9 aa, Homo Sapiens
QSVTSAENS

SEQ ID NO: 664990 - protein, 9 aa, Homo Sapiens
LADTDIALN

SEQ ID NO: 664991 - protein, 9 aa, Homo Sapiens
EAHQHKCPE

SEQ ID NO: 664992 - protein, 9 aa, Homo Sapiens
YRKSGKEIL

SEQ ID NO: 664993 - protein, 9 aa, Homo Sapiens
QLPAQHRPG

SEQ ID NO: 664994 - protein, 9 aa, Homo Sapiens
GHVEALKQW

SEQ ID NO: 664995 - protein, 9 aa, Homo Sapiens
PQGEQACMA

SEQ ID NO: 664996 - protein, 9 aa, Homo Sapiens
VIARRDSFR

SEQ ID NO: 664997 - protein, 9 aa, Homo Sapiens
YFKVAMDTT

SEQ ID NO: 664998 - protein, 9 aa, Homo Sapiens
TNCDDMEKI

SEQ ID NO: 664999 - protein, 9 aa, Homo Sapiens
NNNKTANMC

SEQ ID NO: 665000 - protein, 9 aa, Homo Sapiens
PEGLSPNQN

SEQ ID NO: 665001 - protein, 9 aa, Homo Sapiens
VVPYEPPDV

SEQ ID NO: 665002 - protein, 9 aa, Homo Sapiens
VRQANIRKQ

SEQ ID NO: 665003 - protein, 9 aa, Homo Sapiens
PAQHRPGDQ

SEQ ID NO: 665004 - protein, 9 aa, Homo Sapiens
YGKSCKKST

SEQ ID NO: 665005 - protein, 9 aa, Homo Sapiens
LKEKMDDTK

SEQ ID NO: 665006 - protein, 9 aa, Homo Sapiens
ELFAGFDKL

SEQ ID NO: 665007 - protein, 9 aa, Homo Sapiens
DLPHQPLEG

SEQ ID NO: 665008 - protein, 9 aa, Homo Sapiens
ELLRRATIK

SEQ ID NO: 665009 - protein, 9 aa, Homo Sapiens
FGFCFVFLI

SEQ ID NO: 665010 - protein, 9 aa, Homo Sapiens
NESFLCLTR

SEQ ID NO: 665011 - protein, 9 aa, Homo Sapiens
IIQAPKTVE

SEQ ID NO: 665012 - protein, 9 aa, Homo Sapiens
QDLLKGGVL

SEQ ID NO: 665013 - protein, 9 aa, Homo Sapiens
DRESRQRLV

SEQ ID NO: 665014 - protein, 9 aa, Homo Sapiens
SYTACATSL

SEQ ID NO: 665015 - protein, 9 aa, Homo Sapiens
QLFAGGFPT

SEQ ID NO: 665016 - protein, 9 aa, Homo Sapiens
LDGSGAVTD

SEQ ID NO: 665017 - protein, 9 aa, Homo Sapiens
GSCTFFLNI

SEQ ID NO: 665018 - protein, 9 aa, Homo Sapiens
CLLRCPPPP

SEQ ID NO: 665019 - protein, 9 aa, Homo Sapiens
KPQFECRAG

SEQ ID NO: 665020 - protein, 9 aa, Homo Sapiens
CLPMPIDIV

SEQ ID NO: 665021 - protein, 9 aa, Homo Sapiens
RLEAFLTQN

SEQ ID NO: 665022 - protein, 9 aa, Homo Sapiens
LFGLQKWYT

SEQ ID NO: 665023 - protein, 9 aa, Homo Sapiens
HGPRPVAMR

SEQ ID NO: 665024 - protein, 9 aa, Homo Sapiens
SSPHQAGLC

SEQ ID NO: 665025 - protein, 9 aa, Homo Sapiens
ARERLRVLD

SEQ ID NO: 665026 - protein, 9 aa, Homo Sapiens
LSSSVTMRK

SEQ ID NO: 665027 - protein, 9 aa, Homo Sapiens
GCALKPQVS

SEQ ID NO: 665028 - protein, 9 aa, Homo Sapiens
QATFRENAV

SEQ ID NO: 665029 - protein, 9 aa, Homo Sapiens
AANARITGN

SEQ ID NO: 665030 - protein, 9 aa, Homo Sapiens
PWSQTLAFR

SEQ ID NO: 665031 - protein, 9 aa, Homo Sapiens
YLAGKQRGM

SEQ ID NO: 665032 - protein, 9 aa, Homo Sapiens
SWCGSSRHL

SEQ ID NO: 665033 - protein, 9 aa, Homo Sapiens
KTDAFRRRW

SEQ ID NO: 665034 - protein, 9 aa, Homo Sapiens
TMKLWCAAC

SEQ ID NO: 665035 - protein, 9 aa, Homo Sapiens
IVPMYPAFK

SEQ ID NO: 665036 - protein, 9 aa, Homo Sapiens
TLFTDFERK

SEQ ID NO: 665037 - protein, 9 aa, Homo Sapiens
ILEFQESGE

SEQ ID NO: 665038 - protein, 9 aa, Homo Sapiens
DGKKLRISE

SEQ ID NO: 665039 - protein, 9 aa, Homo Sapiens
FFSGECSEF

SEQ ID NO: 665040 - protein, 9 aa, Homo Sapiens
APKRKDGLK

SEQ ID NO: 665041 - protein, 9 aa, Homo Sapiens
PGHVEALKQ

SEQ ID NO: 665042 - protein, 9 aa, Homo Sapiens
KLFNSVKWG

SEQ ID NO: 665043 - protein, 9 aa, Homo Sapiens
CYVALHAVP

SEQ ID NO: 665044 - protein, 9 aa, Homo Sapiens
SGSSPPGCL

SEQ ID NO: 665045 - protein, 9 aa, Homo Sapiens
CLCRHWGRQ

SEQ ID NO: 665046 - protein, 9 aa, Homo Sapiens
QYRFRRCLL

SEQ ID NO: 665047 - protein, 9 aa, Homo Sapiens
RIGCGKRPS

SEQ ID NO: 665048 - protein, 9 aa, Homo Sapiens
GSNLQNCIL

SEQ ID NO: 665049 - protein, 9 aa, Homo Sapiens
AGPSPGPFV

SEQ ID NO: 665050 - protein, 9 aa, Homo Sapiens
KKTVKEVPC

SEQ ID NO: 665051 - protein, 9 aa, Homo Sapiens
FGYDTDQEA

SEQ ID NO: 665052 - protein, 9 aa, Homo Sapiens
FLVFPPKKP

SEQ ID NO: 665053 - protein, 9 aa, Homo Sapiens
VEKVDVIAG

SEQ ID NO: 665054 - protein, 9 aa, Homo Sapiens
EGELAVIED

SEQ ID NO: 665055 - protein, 9 aa, Homo Sapiens
YPMGHTASV

SEQ ID NO: 665056 - protein, 9 aa, Homo Sapiens
GPNNPQNKP

SEQ ID NO: 665057 - protein, 9 aa, Homo Sapiens
LAIYRPLHY

SEQ ID NO: 665058 - protein, 9 aa, Homo Sapiens
LHQFAHDGL

SEQ ID NO: 665059 - protein, 9 aa, Homo Sapiens
LKNQLLYPD

SEQ ID NO: 665060 - protein, 9 aa, Homo Sapiens
IFLAMLADT

SEQ ID NO: 665061 - protein, 9 aa, Homo Sapiens
EEECSCVSD

SEQ ID NO: 665062 - protein, 9 aa, Homo Sapiens
QKWYGGSSS

SEQ ID NO: 665063 - protein, 9 aa, Homo Sapiens
SSSRGRFAE

SEQ ID NO: 665064 - protein, 9 aa, Homo Sapiens
FGMPAKYWK

SEQ ID NO: 665065 - protein, 9 aa, Homo Sapiens
VQIFFIHAF

SEQ ID NO: 665066 - protein, 9 aa, Homo Sapiens
AVLPSVSQS

SEQ ID NO: 665067 - protein, 9 aa, Homo Sapiens
TGTEPKPQG

SEQ ID NO: 665068 - protein, 9 aa, Homo Sapiens
SNTSDSDQN

SEQ ID NO: 665069 - protein, 9 aa, Homo Sapiens
CQPLALSHK

SEQ ID NO: 665070 - protein, 9 aa, Homo Sapiens
DKDAEGDLR

SEQ ID NO: 665071 - protein, 9 aa, Homo Sapiens
LDHRHLVEA

SEQ ID NO: 665072 - protein, 9 aa, Homo Sapiens
DFFVAAFLA

SEQ ID NO: 665073 - protein, 9 aa, Homo Sapiens
RFPSQILLL

SEQ ID NO: 665074 - protein, 9 aa, Homo Sapiens
PKINQLCSK

SEQ ID NO: 665075 - protein, 9 aa, Homo Sapiens
YVGSIQPHC

SEQ ID NO: 665076 - protein, 9 aa, Homo Sapiens
KGEPLPLKL

SEQ ID NO: 665077 - protein, 9 aa, Homo Sapiens
LQNPAITVP

SEQ ID NO: 665078 - protein, 9 aa, Homo Sapiens
DNAAPQSLC

SEQ ID NO: 665079 - protein, 9 aa, Homo Sapiens
SRVAGECWT

SEQ ID NO: 665080 - protein, 9 aa, Homo Sapiens
LHGVNYVQD

SEQ ID NO: 665081 - protein, 9 aa, Homo Sapiens
LLAAMAYDS

SEQ ID NO: 665082 - protein, 9 aa, Homo Sapiens
DWQPLQEDE

SEQ ID NO: 665083 - protein, 9 aa, Homo Sapiens
KQWSLNPET

SEQ ID NO: 665084 - protein, 9 aa, Homo Sapiens
KVAMDTTLP

SEQ ID NO: 665085 - protein, 9 aa, Homo Sapiens
AQDLLPLHK

SEQ ID NO: 665086 - protein, 9 aa, Homo Sapiens
ASSDLGTGA

SEQ ID NO: 665087 - protein, 9 aa, Homo Sapiens
VELLENSLK

SEQ ID NO: 665088 - protein, 9 aa, Homo Sapiens
LDRMRLHGV

SEQ ID NO: 665089 - protein, 9 aa, Homo Sapiens
FLICGYSQI

SEQ ID NO: 665090 - protein, 9 aa, Homo Sapiens
NIRKKQAKK

SEQ ID NO: 665091 - protein, 9 aa, Homo Sapiens
LKLNSSTEA

SEQ ID NO: 665092 - protein, 9 aa, Homo Sapiens
ETIAWLRIC

SEQ ID NO: 665093 - protein, 9 aa, Homo Sapiens
ICGYSQILI

SEQ ID NO: 665094 - protein, 9 aa, Homo Sapiens
PQPLFPYGA

SEQ ID NO: 665095 - protein, 9 aa, Homo Sapiens
SNLQNCILT

SEQ ID NO: 665096 - protein, 9 aa, Homo Sapiens
VQHVFAAVC

SEQ ID NO: 665097 - protein, 9 aa, Homo Sapiens
KKLRISEYK

SEQ ID NO: 665098 - protein, 9 aa, Homo Sapiens
PCCQPLALS

SEQ ID NO: 665099 - protein, 9 aa, Homo Sapiens
DGLSPQARN

SEQ ID NO: 665100 - protein, 9 aa, Homo Sapiens
AIFTKKFRR

SEQ ID NO: 665101 - protein, 9 aa, Homo Sapiens
GFPTGGFTS

SEQ ID NO: 665102 - protein, 9 aa, Homo Sapiens
SNQLSDYYE

SEQ ID NO: 665103 - protein, 9 aa, Homo Sapiens
GERKKTVKE

SEQ ID NO: 665104 - protein, 9 aa, Homo Sapiens
CGLPKKLNG

SEQ ID NO: 665105 - protein, 9 aa, Homo Sapiens
RLSSSVTMR

SEQ ID NO: 665106 - protein, 9 aa, Homo Sapiens
FANLNQLGL

SEQ ID NO: 665107 - protein, 9 aa, Homo Sapiens
AIVFFLSVM

SEQ ID NO: 665108 - protein, 9 aa, Homo Sapiens
FVVSFPVIV

SEQ ID NO: 665109 - protein, 9 aa, Homo Sapiens
APCLVLPEG

SEQ ID NO: 665110 - protein, 9 aa, Homo Sapiens
RDSFRKGPN

SEQ ID NO: 665111 - protein, 9 aa, Homo Sapiens
RTYLYAWAN

SEQ ID NO: 665112 - protein, 9 aa, Homo Sapiens
DGCALKPQV

SEQ ID NO: 665113 - protein, 9 aa, Homo Sapiens
RVAGECWTR

SEQ ID NO: 665114 - protein, 9 aa, Homo Sapiens
YNPTGLLAL

SEQ ID NO: 665115 - protein, 9 aa, Homo Sapiens
ELPRAMCKE

SEQ ID NO: 665116 - protein, 9 aa, Homo Sapiens
QSSGRKPAA

SEQ ID NO: 665117 - protein, 9 aa, Homo Sapiens
LSCASPFVS

SEQ ID NO: 665118 - protein, 9 aa, Homo Sapiens
THQVRFASL

SEQ ID NO: 665119 - protein, 9 aa, Homo Sapiens
QILLLSNQL

SEQ ID NO: 665120 - protein, 9 aa, Homo Sapiens
PDRESRQRL

SEQ ID NO: 665121 - protein, 9 aa, Homo Sapiens
DLLPLHKAF

SEQ ID NO: 665122 - protein, 9 aa, Homo Sapiens
GHWGLLGQD

SEQ ID NO: 665123 - protein, 9 aa, Homo Sapiens
VQLPAQHRP

SEQ ID NO: 665124 - protein, 9 aa, Homo Sapiens
YPDAFVSEE

SEQ ID NO: 665125 - protein, 9 aa, Homo Sapiens
HIEIHEWTV

SEQ ID NO: 665126 - protein, 9 aa, Homo Sapiens
VKNLLSGVS

SEQ ID NO: 665127 - protein, 9 aa, Homo Sapiens
FHNTIMCEK

SEQ ID NO: 665128 - protein, 9 aa, Homo Sapiens
ESMRRFLEH

SEQ ID NO: 665129 - protein, 9 aa, Homo Sapiens
KTPDEAAPF

SEQ ID NO: 665130 - protein, 9 aa, Homo Sapiens
RGALEHDCC

SEQ ID NO: 665131 - protein, 9 aa, Homo Sapiens
RDRMQYFTG

SEQ ID NO: 665132 - protein, 9 aa, Homo Sapiens
CILTLMSIV

SEQ ID NO: 665133 - protein, 9 aa, Homo Sapiens
DIMEKLHQQ

SEQ ID NO: 665134 - protein, 9 aa, Homo Sapiens
QLLYPDIKD

SEQ ID NO: 665135 - protein, 9 aa, Homo Sapiens
YNSNECCET

SEQ ID NO: 665136 - protein, 9 aa, Homo Sapiens
FLGGAIVFF

SEQ ID NO: 665137 - protein, 9 aa, Homo Sapiens
KDWQPLQED

SEQ ID NO: 665138 - protein, 9 aa, Homo Sapiens
LPLKLNSST

SEQ ID NO: 665139 - protein, 9 aa, Homo Sapiens
ATILSSSRS

SEQ ID NO: 665140 - protein, 9 aa, Homo Sapiens
SAKQFPDLH

SEQ ID NO: 665141 - protein, 9 aa, Homo Sapiens
LKDPIRKKL

SEQ ID NO: 665142 - protein, 9 aa, Homo Sapiens
TWEYIFAIY

SEQ ID NO: 665143 - protein, 9 aa, Homo Sapiens
AAPFVERTP

SEQ ID NO: 665144 - protein, 9 aa, Homo Sapiens
PWRALVVEM

SEQ ID NO: 665145 - protein, 9 aa, Homo Sapiens
WKFSRSDEL

SEQ ID NO: 665146 - protein, 9 aa, Homo Sapiens
NQNITLTVG

SEQ ID NO: 665147 - protein, 9 aa, Homo Sapiens
PQARNDFDR

SEQ ID NO: 665148 - protein, 9 aa, Homo Sapiens
PFCTLSSAA

SEQ ID NO: 665149 - protein, 9 aa, Homo Sapiens
EGKPVTGYL

SEQ ID NO: 665150 - protein, 9 aa, Homo Sapiens
LFGSCTFFL

SEQ ID NO: 665151 - protein, 9 aa, Homo Sapiens
NSQTLIPHC

SEQ ID NO: 665152 - protein, 9 aa, Homo Sapiens
KEHHFVGIA

SEQ ID NO: 665153 - protein, 9 aa, Homo Sapiens
QQQTMAVKF

SEQ ID NO: 665154 - protein, 9 aa, Homo Sapiens
RYWKEHHFV

SEQ ID NO: 665155 - protein, 9 aa, Homo Sapiens
YLSVNVTTN

SEQ ID NO: 665156 - protein, 9 aa, Homo Sapiens
PRSVAVPVL

SEQ ID NO: 665157 - protein, 9 aa, Homo Sapiens
SLCRGIVQN

SEQ ID NO: 665158 - protein, 9 aa, Homo Sapiens
KNQLLYPDI

SEQ ID NO: 665159 - protein, 9 aa, Homo Sapiens
RFFSGECSE

SEQ ID NO: 665160 - protein, 9 aa, Homo Sapiens
YDSYVAICH

SEQ ID NO: 665161 - protein, 9 aa, Homo Sapiens
GGAIVFFLS

SEQ ID NO: 665162 - protein, 9 aa, Homo Sapiens
TLIPHCQKK

SEQ ID NO: 665163 - protein, 9 aa, Homo Sapiens
FRFALEAGC

SEQ ID NO: 665164 - protein, 9 aa, Homo Sapiens
VVIFSKKSC

SEQ ID NO: 665165 - protein, 9 aa, Homo Sapiens
GYGPFSFTQ

SEQ ID NO: 665166 - protein, 9 aa, Homo Sapiens
NARALVRNP

SEQ ID NO: 665167 - protein, 9 aa, Homo Sapiens
CFVFLICGY

SEQ ID NO: 665168 - protein, 9 aa, Homo Sapiens
TSPLVTSNI

SEQ ID NO: 665169 - protein, 9 aa, Homo Sapiens
QHRHESVRR

SEQ ID NO: 665170 - protein, 9 aa, Homo Sapiens
VQPQHRHES

SEQ ID NO: 665171 - protein, 9 aa, Homo Sapiens
LITTNLSKR

SEQ ID NO: 665172 - protein, 9 aa, Homo Sapiens
QIENTLIRR

SEQ ID NO: 665173 - protein, 9 aa, Homo Sapiens
LRKKRKPQV

SEQ ID NO: 665174 - protein, 9 aa, Homo Sapiens
NTRYGGKFL

SEQ ID NO: 665175 - protein, 9 aa, Homo Sapiens
KAYPKLFNS

SEQ ID NO: 665176 - protein, 9 aa, Homo Sapiens
LCTYISLIA

SEQ ID NO: 665177 - protein, 9 aa, Homo Sapiens
GPGSQLNTT

SEQ ID NO: 665178 - protein, 9 aa, Homo Sapiens
EDKDAEGDL

SEQ ID NO: 665179 - protein, 9 aa, Homo Sapiens
KSCSYCTMA

SEQ ID NO: 665180 - protein, 9 aa, Homo Sapiens
TFLAFDQPT

SEQ ID NO: 665181 - protein, 9 aa, Homo Sapiens
AHAQGLDPP

SEQ ID NO: 665182 - protein, 9 aa, Homo Sapiens
KGGVLYPAL

SEQ ID NO: 665183 - protein, 9 aa, Homo Sapiens
AMQRLAKNM

SEQ ID NO: 665184 - protein, 9 aa, Homo Sapiens
HAVPGSSPA

SEQ ID NO: 665185 - protein, 9 aa, Homo Sapiens
NLSKRHGPR

SEQ ID NO: 665186 - protein, 9 aa, Homo Sapiens
GERIGCGKR

SEQ ID NO: 665187 - protein, 9 aa, Homo Sapiens
SPQARNDFD

SEQ ID NO: 665188 - protein, 9 aa, Homo Sapiens
QPLEGQLPD

SEQ ID NO: 665189 - protein, 9 aa, Homo Sapiens
PRHRLLVMV

SEQ ID NO: 665190 - protein, 9 aa, Homo Sapiens
RNNEELNKL

SEQ ID NO: 665191 - protein, 9 aa, Homo Sapiens
SIGMAALAS

SEQ ID NO: 665192 - protein, 9 aa, Homo Sapiens
MPDNQNITL

SEQ ID NO: 665193 - protein, 9 aa, Homo Sapiens
QIFFIHAFG

SEQ ID NO: 665194 - protein, 9 aa, Homo Sapiens
EVEDPFRFA

SEQ ID NO: 665195 - protein, 9 aa, Homo Sapiens
GSTGLDAGG

SEQ ID NO: 665196 - protein, 9 aa, Homo Sapiens
QLKQAEKLR

SEQ ID NO: 665197 - protein, 9 aa, Homo Sapiens
EKFCKCEEC

SEQ ID NO: 665198 - protein, 9 aa, Homo Sapiens
EQLGRLLIT

SEQ ID NO: 665199 - protein, 9 aa, Homo Sapiens
RISEYKAIM

SEQ ID NO: 665200 - protein, 9 aa, Homo Sapiens
SFLKLVSNM

SEQ ID NO: 665201 - protein, 9 aa, Homo Sapiens
QSLCAFYTH

SEQ ID NO: 665202 - protein, 9 aa, Homo Sapiens
VIANCIEDM

SEQ ID NO: 665203 - protein, 9 aa, Homo Sapiens
SAGSTNYWE

SEQ ID NO: 665204 - protein, 9 aa, Homo Sapiens
ALASGPKAR

SEQ ID NO: 665205 - protein, 9 aa, Homo Sapiens
VLLGEVNIC

SEQ ID NO: 665206 - protein, 9 aa, Homo Sapiens
GVVKAYKEI

SEQ ID NO: 665207 - protein, 9 aa, Homo Sapiens
PHCVFFRLG

SEQ ID NO: 665208 - protein, 9 aa, Homo Sapiens
NLCDCHLHC

SEQ ID NO: 665209 - protein, 9 aa, Homo Sapiens
HYGRLAFSQ

SEQ ID NO: 665210 - protein, 9 aa, Homo Sapiens
FRPLLRPPR

SEQ ID NO: 665211 - protein, 9 aa, Homo Sapiens
GGFPTGGFT

SEQ ID NO: 665212 - protein, 9 aa, Homo Sapiens
LLLELGEEA

SEQ ID NO: 665213 - protein, 9 aa, Homo Sapiens
AKQLLLELG

SEQ ID NO: 665214 - protein, 9 aa, Homo Sapiens
MANSSVWVQ

SEQ ID NO: 665215 - protein, 9 aa, Homo Sapiens
PIQTTSVGK

SEQ ID NO: 665216 - protein, 9 aa, Homo Sapiens
AMDTTLPLD

SEQ ID NO: 665217 - protein, 9 aa, Homo Sapiens
PAVQPQHRH

SEQ ID NO: 665218 - protein, 9 aa, Homo Sapiens
RRPVPIKLF

SEQ ID NO: 665219 - protein, 9 aa, Homo Sapiens
AGSTNYWEL

SEQ ID NO: 665220 - protein, 9 aa, Homo Sapiens
VWEPPMYDE

SEQ ID NO: 665221 - protein, 9 aa, Homo Sapiens
VFADSKCLS

SEQ ID NO: 665222 - protein, 9 aa, Homo Sapiens
IPMASTTHQ

SEQ ID NO: 665223 - protein, 9 aa, Homo Sapiens
SIPGRKRGR

SEQ ID NO: 665224 - protein, 9 aa, Homo Sapiens
LYPLQNGYA

SEQ ID NO: 665225 - protein, 9 aa, Homo Sapiens
NAAPQSLCA

SEQ ID NO: 665226 - protein, 9 aa, Homo Sapiens
LGPYCYYDK

SEQ ID NO: 665227 - protein, 9 aa, Homo Sapiens
PLQPHLVRE

SEQ ID NO: 665228 - protein, 9 aa, Homo Sapiens
LRELPRAMC

SEQ ID NO: 665229 - protein, 9 aa, Homo Sapiens
SAKRKASMV

SEQ ID NO: 665230 - protein, 9 aa, Homo Sapiens
THQEKPLVT

SEQ ID NO: 665231 - protein, 9 aa, Homo Sapiens
SRPAPEVGS

SEQ ID NO: 665232 - protein, 9 aa, Homo Sapiens
PIAQDLLPL

SEQ ID NO: 665233 - protein, 9 aa, Homo Sapiens
GAPASALLS

SEQ ID NO: 665234 - protein, 9 aa, Homo Sapiens
LRFLGEKAS

SEQ ID NO: 665235 - protein, 9 aa, Homo Sapiens
SSRHLTTRC

SEQ ID NO: 665236 - protein, 9 aa, Homo Sapiens
HDCCQDFIY

SEQ ID NO: 665237 - protein, 9 aa, Homo Sapiens
WTAVLAVLM

SEQ ID NO: 665238 - protein, 9 aa, Homo Sapiens
IRKTRESDQ

SEQ ID NO: 665239 - protein, 9 aa, Homo Sapiens
NLIFYECSS

SEQ ID NO: 665240 - protein, 9 aa, Homo Sapiens
LLITTNLSK

SEQ ID NO: 665241 - protein, 9 aa, Homo Sapiens
CVRQANIRK

SEQ ID NO: 665242 - protein, 9 aa, Homo Sapiens
SWGLTLLCA

SEQ ID NO: 665243 - protein, 9 aa, Homo Sapiens
YDAFLVTNI

SEQ ID NO: 665244 - protein, 9 aa, Homo Sapiens
TTVEPAARG

SEQ ID NO: 665245 - protein, 9 aa, Homo Sapiens
SKKKYFRQT

SEQ ID NO: 665246 - protein, 9 aa, Homo Sapiens
VTLTEIRLP

SEQ ID NO: 665247 - protein, 9 aa, Homo Sapiens
CLLCVISLH

SEQ ID NO: 665248 - protein, 9 aa, Homo Sapiens
ILCTPSVAK

SEQ ID NO: 665249 - protein, 9 aa, Homo Sapiens
LEILQLAHA

SEQ ID NO: 665250 - protein, 9 aa, Homo Sapiens
SLVNVKHLI

SEQ ID NO: 665251 - protein, 9 aa, Homo Sapiens
RSLPEPLVT

SEQ ID NO: 665252 - protein, 9 aa, Homo Sapiens
TRYGGKFLV

SEQ ID NO: 665253 - protein, 9 aa, Homo Sapiens
DIRVEDTEI

SEQ ID NO: 665254 - protein, 9 aa, Homo Sapiens
GKFLVFPPK

SEQ ID NO: 665255 - protein, 9 aa, Homo Sapiens
FKCDQYGSG

SEQ ID NO: 665256 - protein, 9 aa, Homo Sapiens
LYVHKGDAV

SEQ ID NO: 665257 - protein, 9 aa, Homo Sapiens
HFVGIALVE

SEQ ID NO: 665258 - protein, 9 aa, Homo Sapiens
AFGMPAKYW

SEQ ID NO: 665259 - protein, 9 aa, Homo Sapiens
GKHLESMQL

SEQ ID NO: 665260 - protein, 9 aa, Homo Sapiens
RVEDTEICL

SEQ ID NO: 665261 - protein, 9 aa, Homo Sapiens
GHKPPDGEE

SEQ ID NO: 665262 - protein, 9 aa, Homo Sapiens
ASQLDVFGH

SEQ ID NO: 665263 - protein, 9 aa, Homo Sapiens
LVHESMRIS

SEQ ID NO: 665264 - protein, 9 aa, Homo Sapiens
PSSEEAVAP

SEQ ID NO: 665265 - protein, 9 aa, Homo Sapiens
EEKNFARFK

SEQ ID NO: 665266 - protein, 9 aa, Homo Sapiens
FHFLGGAIV

SEQ ID NO: 665267 - protein, 9 aa, Homo Sapiens
WYGGSSSIS

SEQ ID NO: 665268 - protein, 9 aa, Homo Sapiens
KDAEGDLRR

SEQ ID NO: 665269 - protein, 9 aa, Homo Sapiens
DETGAPASA

SEQ ID NO: 665270 - protein, 9 aa, Homo Sapiens
REGAEPREP

SEQ ID NO: 665271 - protein, 9 aa, Homo Sapiens
RSVAVPVLV

SEQ ID NO: 665272 - protein, 9 aa, Homo Sapiens
PMREESVTV

SEQ ID NO: 665273 - protein, 9 aa, Homo Sapiens
VKNIRKKQA

SEQ ID NO: 665274 - protein, 9 aa, Homo Sapiens
SSFDPAVPF

SEQ ID NO: 665275 - protein, 9 aa, Homo Sapiens
SAIPKAMQK

SEQ ID NO: 665276 - protein, 9 aa, Homo Sapiens
VKKGEPLPL

SEQ ID NO: 665277 - protein, 9 aa, Homo Sapiens
SVVYGALSI

SEQ ID NO: 665278 - protein, 9 aa, Homo Sapiens
FSQTPLMFT

SEQ ID NO: 665279 - protein, 9 aa, Homo Sapiens
VTSNIMGDI

SEQ ID NO: 665280 - protein, 9 aa, Homo Sapiens
SNIMGDITS

SEQ ID NO: 665281 - protein, 9 aa, Homo Sapiens
IDAVPTSDE

SEQ ID NO: 665282 - protein, 9 aa, Homo Sapiens
DGSGAVTDS

SEQ ID NO: 665283 - protein, 9 aa, Homo Sapiens
RRAKQLLLE

SEQ ID NO: 665284 - protein, 9 aa, Homo Sapiens
RKSLVNVKH

SEQ ID NO: 665285 - protein, 9 aa, Homo Sapiens
TLNVLRDQM

SEQ ID NO: 665286 - protein, 9 aa, Homo Sapiens
WLRICRPGS

SEQ ID NO: 665287 - protein, 9 aa, Homo Sapiens
CDDMEKIWH

SEQ ID NO: 665288 - protein, 9 aa, Homo Sapiens
IFFIHAFGG

SEQ ID NO: 665289 - protein, 9 aa, Homo Sapiens
TYLYAWAND

SEQ ID NO: 665290 - protein, 9 aa, Homo Sapiens
VHSLWQTFL

SEQ ID NO: 665291 - protein, 9 aa, Homo Sapiens
CCRTTCCRH

SEQ ID NO: 665292 - protein, 9 aa, Homo Sapiens
RLVISVTSG

SEQ ID NO: 665293 - protein, 9 aa, Homo Sapiens
LQATLSLNS

SEQ ID NO: 665294 - protein, 9 aa, Homo Sapiens
FGLQKWYTY

SEQ ID NO: 665295 - protein, 9 aa, Homo Sapiens
CLRTCMVVA

SEQ ID NO: 665296 - protein, 9 aa, Homo Sapiens
PGLPVDKGH

SEQ ID NO: 665297 - protein, 9 aa, Homo Sapiens
TGVVTLRSG

SEQ ID NO: 665298 - protein, 9 aa, Homo Sapiens
MSVVYGALS

SEQ ID NO: 665299 - protein, 9 aa, Homo Sapiens
FDGLPGLPV

SEQ ID NO: 665300 - protein, 9 aa, Homo Sapiens
LGEKASAKR

SEQ ID NO: 665301 - protein, 9 aa, Homo Sapiens
LKPQVSVEI

SEQ ID NO: 665302 - protein, 9 aa, Homo Sapiens
FLVHESMRI

SEQ ID NO: 665303 - protein, 9 aa, Homo Sapiens
TSNIMGDIT

SEQ ID NO: 665304 - protein, 9 aa, Homo Sapiens
AMTLTKARC

SEQ ID NO: 665305 - protein, 9 aa, Homo Sapiens
AAWTAVLAV

SEQ ID NO: 665306 - protein, 9 aa, Homo Sapiens
GYAPCTELV

SEQ ID NO: 665307 - protein, 9 aa, Homo Sapiens
GHLQRTYLY

SEQ ID NO: 665308 - protein, 9 aa, Homo Sapiens
SFRPLLRPP

SEQ ID NO: 665309 - protein, 9 aa, Homo Sapiens
PRPVAMRLH

SEQ ID NO: 665310 - protein, 9 aa, Homo Sapiens
YGPFSFTQR

SEQ ID NO: 665311 - protein, 9 aa, Homo Sapiens
GETAILCTP

SEQ ID NO: 665312 - protein, 9 aa, Homo Sapiens
LMFTYYLAW

SEQ ID NO: 665313 - protein, 9 aa, Homo Sapiens
KNGYKSDAK

SEQ ID NO: 665314 - protein, 9 aa, Homo Sapiens
DPGKEGPNN

SEQ ID NO: 665315 - protein, 9 aa, Homo Sapiens
RNFYFGKLD

SEQ ID NO: 665316 - protein, 9 aa, Homo Sapiens
RLQNPAITV

SEQ ID NO: 665317 - protein, 9 aa, Homo Sapiens
SVAQFLSCA

SEQ ID NO: 665318 - protein, 9 aa, Homo Sapiens
QGEQACMAR

SEQ ID NO: 665319 - protein, 9 aa, Homo Sapiens
CVQLDLHDL

SEQ ID NO: 665320 - protein, 9 aa, Homo Sapiens
TIEFTILDA

SEQ ID NO: 665321 - protein, 9 aa, Homo Sapiens
PTGGFTSSL

SEQ ID NO: 665322 - protein, 9 aa, Homo Sapiens
HQPLEGQLP

SEQ ID NO: 665323 - protein, 9 aa, Homo Sapiens
KHLESMQLP

SEQ ID NO: 665324 - protein, 9 aa, Homo Sapiens
GLQKWYTYY

SEQ ID NO: 665325 - protein, 9 aa, Homo Sapiens
CFRCPRKSL

SEQ ID NO: 665326 - protein, 9 aa, Homo Sapiens
DTTLPLDTR

SEQ ID NO: 665327 - protein, 9 aa, Homo Sapiens
ALDEDKDAE

SEQ ID NO: 665328 - protein, 9 aa, Homo Sapiens
STRFPSQIL

SEQ ID NO: 665329 - protein, 9 aa, Homo Sapiens
NGEIDIRVE

SEQ ID NO: 665330 - protein, 9 aa, Homo Sapiens
SPSWCGSSR

SEQ ID NO: 665331 - protein, 9 aa, Homo Sapiens
IHNKLKILP

SEQ ID NO: 665332 - protein, 9 aa, Homo Sapiens
LCLTRKGRG

SEQ ID NO: 665333 - protein, 9 aa, Homo Sapiens
TEPKPQGVI

SEQ ID NO: 665334 - protein, 9 aa, Homo Sapiens
PQVSVEILR

SEQ ID NO: 665335 - protein, 9 aa, Homo Sapiens
GALSIGMAA

SEQ ID NO: 665336 - protein, 9 aa, Homo Sapiens
GLPVDKGHR

SEQ ID NO: 665337 - protein, 9 aa, Homo Sapiens
DPLGPYCYY

SEQ ID NO: 665338 - protein, 9 aa, Homo Sapiens
VNDNTPELI

SEQ ID NO: 665339 - protein, 9 aa, Homo Sapiens
GSTNYWELK

SEQ ID NO: 665340 - protein, 9 aa, Homo Sapiens
AFLDHRVLR

SEQ ID NO: 665341 - protein, 9 aa, Homo Sapiens
LETKPLNFN

SEQ ID NO: 665342 - protein, 9 aa, Homo Sapiens
PPSPRSVAV

SEQ ID NO: 665343 - protein, 9 aa, Homo Sapiens
GVSAQFTKA

SEQ ID NO: 665344 - protein, 9 aa, Homo Sapiens
AFSQRGLPT

SEQ ID NO: 665345 - protein, 9 aa, Homo Sapiens
SGKEILNRL

SEQ ID NO: 665346 - protein, 9 aa, Homo Sapiens
PYAAACANH

SEQ ID NO: 665347 - protein, 9 aa, Homo Sapiens
SINRSLESL

SEQ ID NO: 665348 - protein, 9 aa, Homo Sapiens
ANTSPTAAS

SEQ ID NO: 665349 - protein, 9 aa, Homo Sapiens
YEPPDVGSD

SEQ ID NO: 665350 - protein, 9 aa, Homo Sapiens
PLNFNLDNS

SEQ ID NO: 665351 - protein, 9 aa, Homo Sapiens
FAHDGLICQ

SEQ ID NO: 665352 - protein, 9 aa, Homo Sapiens
LVEKYKYLL

SEQ ID NO: 665353 - protein, 9 aa, Homo Sapiens
PVELLENSL

SEQ ID NO: 665354 - protein, 9 aa, Homo Sapiens
LLVKKKEEK

SEQ ID NO: 665355 - protein, 9 aa, Homo Sapiens
INRLPLPIQ

SEQ ID NO: 665356 - protein, 9 aa, Homo Sapiens
LFAGFDKLA

SEQ ID NO: 665357 - protein, 9 aa, Homo Sapiens
YQIAHLEER

SEQ ID NO: 665358 - protein, 9 aa, Homo Sapiens
MQYFTGNPL

SEQ ID NO: 665359 - protein, 9 aa, Homo Sapiens
KELERQCLL

SEQ ID NO: 665360 - protein, 9 aa, Homo Sapiens
LQKWYGGSS

SEQ ID NO: 665361 - protein, 9 aa, Homo Sapiens
SSTGVVTLR

SEQ ID NO: 665362 - protein, 9 aa, Homo Sapiens
GAAGVDWGC

SEQ ID NO: 665363 - protein, 9 aa, Homo Sapiens
RQAPPEIRQ

SEQ ID NO: 665364 - protein, 9 aa, Homo Sapiens
QHIEIHEWT

SEQ ID NO: 665365 - protein, 9 aa, Homo Sapiens
SCGLPKKLN

SEQ ID NO: 665366 - protein, 9 aa, Homo Sapiens
RPLLRPPRC

SEQ ID NO: 665367 - protein, 9 aa, Homo Sapiens
ADALENALV

SEQ ID NO: 665368 - protein, 9 aa, Homo Sapiens
LHGFFMLLF

SEQ ID NO: 665369 - protein, 9 aa, Homo Sapiens
PLTITFVRE

SEQ ID NO: 665370 - protein, 9 aa, Homo Sapiens
ALENALVSY

SEQ ID NO: 665371 - protein, 9 aa, Homo Sapiens
FLYAIFTKK

SEQ ID NO: 665372 - protein, 9 aa, Homo Sapiens
LTDLSMCVR

SEQ ID NO: 665373 - protein, 9 aa, Homo Sapiens
AQLPVQPVY

SEQ ID NO: 665374 - protein, 9 aa, Homo Sapiens
NPAITVPAV

SEQ ID NO: 665375 - protein, 9 aa, Homo Sapiens
MPAKYWKLD

SEQ ID NO: 665376 - protein, 9 aa, Homo Sapiens
TTWSPWSQT

SEQ ID NO: 665377 - protein, 9 aa, Homo Sapiens
SKESNNLDQ

SEQ ID NO: 665378 - protein, 9 aa, Homo Sapiens
TSALELLRR

SEQ ID NO: 665379 - protein, 9 aa, Homo Sapiens
GDSLSVDGT

SEQ ID NO: 665380 - protein, 9 aa, Homo Sapiens
LAISHYQIA

SEQ ID NO: 665381 - protein, 9 aa, Homo Sapiens
FSKFLVHES

SEQ ID NO: 665382 - protein, 9 aa, Homo Sapiens
MIPASNKAV

SEQ ID NO: 665383 - protein, 9 aa, Homo Sapiens
EELKEKMDD

SEQ ID NO: 665384 - protein, 9 aa, Homo Sapiens
SDELSFCLG

SEQ ID NO: 665385 - protein, 9 aa, Homo Sapiens
PDNILEFQE

SEQ ID NO: 665386 - protein, 9 aa, Homo Sapiens
SSPSEVKME

SEQ ID NO: 665387 - protein, 9 aa, Homo Sapiens
DPVTLETKP

SEQ ID NO: 665388 - protein, 9 aa, Homo Sapiens
KRPSIQQAE

SEQ ID NO: 665389 - protein, 9 aa, Homo Sapiens
VYKRYLAGK

SEQ ID NO: 665390 - protein, 9 aa, Homo Sapiens
LVNLCDCHL

SEQ ID NO: 665391 - protein, 9 aa, Homo Sapiens
CTYISLIAE

SEQ ID NO: 665392 - protein, 9 aa, Homo Sapiens
DADALENAL

SEQ ID NO: 665393 - protein, 9 aa, Homo Sapiens
EMIHQREQK

SEQ ID NO: 665394 - protein, 9 aa, Homo Sapiens
QPEPLNLFL

SEQ ID NO: 665395 - protein, 9 aa, Homo Sapiens
QLPREPGVS

SEQ ID NO: 665396 - protein, 9 aa, Homo Sapiens
YECNEYGKS

SEQ ID NO: 665397 - protein, 9 aa, Homo Sapiens
LRHQYRKSG

SEQ ID NO: 665398 - protein, 9 aa, Homo Sapiens
RSDELSFCL

SEQ ID NO: 665399 - protein, 9 aa, Homo Sapiens
QPHCVFFRL

SEQ ID NO: 665400 - protein, 9 aa, Homo Sapiens
TNLSKRHGP

SEQ ID NO: 665401 - protein, 9 aa, Homo Sapiens
DEAAPFVER

SEQ ID NO: 665402 - protein, 9 aa, Homo Sapiens
GLPGLPVDK

SEQ ID NO: 665403 - protein, 9 aa, Homo Sapiens
AYGTVSCLA

SEQ ID NO: 665404 - protein, 9 aa, Homo Sapiens
GTICITRYS

SEQ ID NO: 665405 - protein, 9 aa, Homo Sapiens
RLPLPIQTT

SEQ ID NO: 665406 - protein, 9 aa, Homo Sapiens
LSFCLGALI

SEQ ID NO: 665407 - protein, 9 aa, Homo Sapiens
GVQLDHRHL

SEQ ID NO: 665408 - protein, 9 aa, Homo Sapiens
PVSHDDVSS

SEQ ID NO: 665409 - protein, 9 aa, Homo Sapiens
KSLVNVKHL

SEQ ID NO: 665410 - protein, 9 aa, Homo Sapiens
FSKKSCSYC

SEQ ID NO: 665411 - protein, 9 aa, Homo Sapiens
IQLSPEENE

SEQ ID NO: 665412 - protein, 9 aa, Homo Sapiens
EVGSLPGSR

SEQ ID NO: 665413 - protein, 9 aa, Homo Sapiens
LAHAQGLDP

SEQ ID NO: 665414 - protein, 9 aa, Homo Sapiens
GAITPGSQA

SEQ ID NO: 665415 - protein, 9 aa, Homo Sapiens
FLDHRVLRH

SEQ ID NO: 665416 - protein, 9 aa, Homo Sapiens
GRSYLSKHQ

SEQ ID NO: 665417 - protein, 9 aa, Homo Sapiens
QLPDEQLGR

SEQ ID NO: 665418 - protein, 9 aa, Homo Sapiens
GKRQRSVTV

SEQ ID NO: 665419 - protein, 9 aa, Homo Sapiens
NPVWILTVA

SEQ ID NO: 665420 - protein, 9 aa, Homo Sapiens
SYGRSDAKH

SEQ ID NO: 665421 - protein, 9 aa, Homo Sapiens
PLALSHKYG

SEQ ID NO: 665422 - protein, 9 aa, Homo Sapiens
NSSTGVVTL

SEQ ID NO: 665423 - protein, 9 aa, Homo Sapiens
RTQSVTSAE

SEQ ID NO: 665424 - protein, 9 aa, Homo Sapiens
LVQATFREN

SEQ ID NO: 665425 - protein, 9 aa, Homo Sapiens
LPVQPVYPA

SEQ ID NO: 665426 - protein, 9 aa, Homo Sapiens
GLSPQARND

SEQ ID NO: 665427 - protein, 9 aa, Homo Sapiens
PPESMKPAL

SEQ ID NO: 665428 - protein, 9 aa, Homo Sapiens
FPGTICITR

SEQ ID NO: 665429 - protein, 9 aa, Homo Sapiens
SSVLFVSQI

SEQ ID NO: 665430 - protein, 9 aa, Homo Sapiens
NLQATLSLN

SEQ ID NO: 665431 - protein, 9 aa, Homo Sapiens
FDQPTISYC

SEQ ID NO: 665432 - protein, 9 aa, Homo Sapiens
PAIAGASCS

SEQ ID NO: 665433 - protein, 9 aa, Homo Sapiens
KTKGSFVNG

SEQ ID NO: 665434 - protein, 9 aa, Homo Sapiens
ENLSGLQQQ

SEQ ID NO: 665435 - protein, 9 aa, Homo Sapiens
KMSKIKLPS

SEQ ID NO: 665436 - protein, 9 aa, Homo Sapiens
LGMRKTDFD

SEQ ID NO: 665437 - protein, 9 aa, Homo Sapiens
RHNKQHAMT

SEQ ID NO: 665438 - protein, 9 aa, Homo Sapiens
NCILTLMSI

SEQ ID NO: 665439 - protein, 9 aa, Homo Sapiens
PGLSSKSTI

SEQ ID NO: 665440 - protein, 9 aa, Homo Sapiens
GGTVHSLWQ

SEQ ID NO: 665441 - protein, 9 aa, Homo Sapiens
TPLMFTYYL

SEQ ID NO: 665442 - protein, 9 aa, Homo Sapiens
SLRAVMFIT

SEQ ID NO: 665443 - protein, 9 aa, Homo Sapiens
RVVFADSKC

SEQ ID NO: 665444 - protein, 9 aa, Homo Sapiens
LEIIEERNA

SEQ ID NO: 665445 - protein, 9 aa, Homo Sapiens
LCSCNGQCM

SEQ ID NO: 665446 - protein, 9 aa, Homo Sapiens
RSVTVVSQY

SEQ ID NO: 665447 - protein, 9 aa, Homo Sapiens
SLGHVTRSL

SEQ ID NO: 665448 - protein, 9 aa, Homo Sapiens
ESLDPAGLL

SEQ ID NO: 665449 - protein, 9 aa, Homo Sapiens
KAFKCSSKL

SEQ ID NO: 665450 - protein, 9 aa, Homo Sapiens
CWTRPPTPP

SEQ ID NO: 665451 - protein, 9 aa, Homo Sapiens
PVFYQSFDF

SEQ ID NO: 665452 - protein, 9 aa, Homo Sapiens
DSLSVDGTQ

SEQ ID NO: 665453 - protein, 9 aa, Homo Sapiens
KLFNGDVLS

SEQ ID NO: 665454 - protein, 9 aa, Homo Sapiens
GSIQPHCVF

SEQ ID NO: 665455 - protein, 9 aa, Homo Sapiens
RALYGVFGR

SEQ ID NO: 665456 - protein, 9 aa, Homo Sapiens
GDVMANSSV

SEQ ID NO: 665457 - protein, 9 aa, Homo Sapiens
GNVSACDAT

SEQ ID NO: 665458 - protein, 9 aa, Homo Sapiens
EDGFQGLRH

SEQ ID NO: 665459 - protein, 9 aa, Homo Sapiens
PLVQATFRE

SEQ ID NO: 665460 - protein, 9 aa, Homo Sapiens
GHELRPWRA

SEQ ID NO: 665461 - protein, 9 aa, Homo Sapiens
KQAEKLRQY

SEQ ID NO: 665462 - protein, 9 aa, Homo Sapiens
IHAFGGTEM

SEQ ID NO: 665463 - protein, 9 aa, Homo Sapiens
PIKLFNGDV

SEQ ID NO: 665464 - protein, 9 aa, Homo Sapiens
ELLKNQLLY

SEQ ID NO: 665465 - protein, 8 aa, Homo Sapiens
SADNSSTI

SEQ ID NO: 665466 - protein, 9 aa, Homo Sapiens
YGALSIGMA

SEQ ID NO: 665467 - protein, 9 aa, Homo Sapiens
DVELVQHVF

SEQ ID NO: 665468 - protein, 9 aa, Homo Sapiens
KNNNKTANM

SEQ ID NO: 665469 - protein, 9 aa, Homo Sapiens
AVMFITKRG

SEQ ID NO: 665470 - protein, 9 aa, Homo Sapiens
AREALVHII

SEQ ID NO: 665471 - protein, 9 aa, Homo Sapiens
FKCSSKLTV

SEQ ID NO: 665472 - protein, 9 aa, Homo Sapiens
TYYARLNKK

SEQ ID NO: 665473 - protein, 9 aa, Homo Sapiens
LAVLMALLI

SEQ ID NO: 665474 - protein, 9 aa, Homo Sapiens
PAARGSTGL

SEQ ID NO: 665475 - protein, 9 aa, Homo Sapiens
LKQAEKLRQ

SEQ ID NO: 665476 - protein, 9 aa, Homo Sapiens
VSSQIRTRS

SEQ ID NO: 665477 - protein, 9 aa, Homo Sapiens
MRTLQRRAR

SEQ ID NO: 665478 - protein, 9 aa, Homo Sapiens
EEVAQPESE

SEQ ID NO: 665479 - protein, 9 aa, Homo Sapiens
PYNSNECCE

SEQ ID NO: 665480 - protein, 9 aa, Homo Sapiens
ENPSPENRN

SEQ ID NO: 665481 - protein, 9 aa, Homo Sapiens
EPKPQGVIR

SEQ ID NO: 665482 - protein, 9 aa, Homo Sapiens
AGRGGAFPG

SEQ ID NO: 665483 - protein, 9 aa, Homo Sapiens
YRFRRCLLL

SEQ ID NO: 665484 - protein, 9 aa, Homo Sapiens
DGFQGLRHE

SEQ ID NO: 665485 - protein, 9 aa, Homo Sapiens
TGASSDLGT

SEQ ID NO: 665486 - protein, 9 aa, Homo Sapiens
SVTLTEIRL

SEQ ID NO: 665487 - protein, 9 aa, Homo Sapiens
TPLPPPSSP

SEQ ID NO: 665488 - protein, 9 aa, Homo Sapiens
ERQCLLRCP

SEQ ID NO: 665489 - protein, 9 aa, Homo Sapiens
HTGEKHYRC

SEQ ID NO: 665490 - protein, 9 aa, Homo Sapiens
QVLGMRKTD

SEQ ID NO: 665491 - protein, 9 aa, Homo Sapiens
DLPNPHVGD

SEQ ID NO: 665492 - protein, 9 aa, Homo Sapiens
GLIFWPRGT

SEQ ID NO: 665493 - protein, 9 aa, Homo Sapiens
EGQLPDEQL

SEQ ID NO: 665494 - protein, 9 aa, Homo Sapiens
SKYCRMANF

SEQ ID NO: 665495 - protein, 9 aa, Homo Sapiens
MNVSTFLAF

SEQ ID NO: 665496 - protein, 9 aa, Homo Sapiens
DLCRGTKHY

SEQ ID NO: 665497 - protein, 9 aa, Homo Sapiens
ASVGPAGPE

SEQ ID NO: 665498 - protein, 9 aa, Homo Sapiens
NHTLFTDFE

SEQ ID NO: 665499 - protein, 9 aa, Homo Sapiens
RGLACDPDQ

SEQ ID NO: 665500 - protein, 9 aa, Homo Sapiens
DQSLEIIEE

SEQ ID NO: 665501 - protein, 9 aa, Homo Sapiens
QHVFAAVCT

SEQ ID NO: 665502 - protein, 9 aa, Homo Sapiens
EHHFVGIAL

SEQ ID NO: 665503 - protein, 9 aa, Homo Sapiens
QTLAFRTKP

SEQ ID NO: 665504 - protein, 9 aa, Homo Sapiens
DATILSSSR

SEQ ID NO: 665505 - protein, 9 aa, Homo Sapiens
KLHQQIPPR

SEQ ID NO: 665506 - protein, 9 aa, Homo Sapiens
RFLGEKASA

SEQ ID NO: 665507 - protein, 9 aa, Homo Sapiens
GEESSVSSP

SEQ ID NO: 665508 - protein, 9 aa, Homo Sapiens
GKSTIDSSS

SEQ ID NO: 665509 - protein, 9 aa, Homo Sapiens
ILESIHRFS

SEQ ID NO: 665510 - protein, 9 aa, Homo Sapiens
LAKNMSGWF

SEQ ID NO: 665511 - protein, 9 aa, Homo Sapiens
AGVDWGCGG

SEQ ID NO: 665512 - protein, 9 aa, Homo Sapiens
LVLALKEET

SEQ ID NO: 665513 - protein, 9 aa, Homo Sapiens
LYPALPQPN

SEQ ID NO: 665514 - protein, 9 aa, Homo Sapiens
TATTPGLSS

SEQ ID NO: 665515 - protein, 9 aa, Homo Sapiens
WEYIFAIYL

SEQ ID NO: 665516 - protein, 9 aa, Homo Sapiens
MAFGMPAKY

SEQ ID NO: 665517 - protein, 9 aa, Homo Sapiens
APVSKTAEL

SEQ ID NO: 665518 - protein, 9 aa, Homo Sapiens
FREYNLHSV

SEQ ID NO: 665519 - protein, 9 aa, Homo Sapiens
LESNTSDSD

SEQ ID NO: 665520 - protein, 9 aa, Homo Sapiens
RELPRAMCK

SEQ ID NO: 665521 - protein, 9 aa, Homo Sapiens
CDCHLHCED

SEQ ID NO: 665522 - protein, 9 aa, Homo Sapiens
GRKCSARSL

SEQ ID NO: 665523 - protein, 9 aa, Homo Sapiens
FFLNIFRVG

SEQ ID NO: 665524 - protein, 9 aa, Homo Sapiens
SCKKSTLSL

SEQ ID NO: 665525 - protein, 9 aa, Homo Sapiens
NELASTVSA

SEQ ID NO: 665526 - protein, 9 aa, Homo Sapiens
LYFRPSSSY

SEQ ID NO: 665527 - protein, 9 aa, Homo Sapiens
RGQLFAGGF

SEQ ID NO: 665528 - protein, 9 aa, Homo Sapiens
AMRLHPAGR

SEQ ID NO: 665529 - protein, 9 aa, Homo Sapiens
RNESFLCLT

SEQ ID NO: 665530 - protein, 9 aa, Homo Sapiens
SSQIRTRSF

SEQ ID NO: 665531 - protein, 9 aa, Homo Sapiens
AIYLLCCHQ

SEQ ID NO: 665532 - protein, 9 aa, Homo Sapiens
KDGLKLNAI

SEQ ID NO: 665533 - protein, 9 aa, Homo Sapiens
ETKPLNFNL

SEQ ID NO: 665534 - protein, 9 aa, Homo Sapiens
KSTSGGGGG

SEQ ID NO: 665535 - protein, 9 aa, Homo Sapiens
CASSSSTAL

SEQ ID NO: 665536 - protein, 9 aa, Homo Sapiens
VNGEIDIRV

SEQ ID NO: 665537 - protein, 9 aa, Homo Sapiens
SLPSQRPKT

SEQ ID NO: 665538 - protein, 9 aa, Homo Sapiens
AGRGREGAE

SEQ ID NO: 665539 - protein, 9 aa, Homo Sapiens
CVFFRLGPS

SEQ ID NO: 665540 - protein, 9 aa, Homo Sapiens
TLFPMREES

SEQ ID NO: 665541 - protein, 9 aa, Homo Sapiens
KCGKDFTQS

SEQ ID NO: 665542 - protein, 9 aa, Homo Sapiens
YPCCQPLAL

SEQ ID NO: 665543 - protein, 9 aa, Homo Sapiens
VGSIQPHCV

SEQ ID NO: 665544 - protein, 9 aa, Homo Sapiens
MCRHYMPAS

SEQ ID NO: 665545 - protein, 9 aa, Homo Sapiens
KPLIRRSDD

SEQ ID NO: 665546 - protein, 9 aa, Homo Sapiens
FAYGTVSCL

SEQ ID NO: 665547 - protein, 9 aa, Homo Sapiens
DAEGDLRRS

SEQ ID NO: 665548 - protein, 9 aa, Homo Sapiens
TRFPSQILL

SEQ ID NO: 665549 - protein, 9 aa, Homo Sapiens
FRGQLFAGG

SEQ ID NO: 665550 - protein, 9 aa, Homo Sapiens
HFLGGAIVF

SEQ ID NO: 665551 - protein, 9 aa, Homo Sapiens
DEGRAKPHL

SEQ ID NO: 665552 - protein, 9 aa, Homo Sapiens
ITFVREEVI

SEQ ID NO: 665553 - protein, 9 aa, Homo Sapiens
TDTGTEPKP

SEQ ID NO: 665554 - protein, 9 aa, Homo Sapiens
SSPPGCLPS

SEQ ID NO: 665555 - protein, 9 aa, Homo Sapiens
SLLGYGPFS

SEQ ID NO: 665556 - protein, 9 aa, Homo Sapiens
VEGHKPPDG

SEQ ID NO: 665557 - protein, 9 aa, Homo Sapiens
TLTDLSMCV

SEQ ID NO: 665558 - protein, 9 aa, Homo Sapiens
ANLNQLGLP

SEQ ID NO: 665559 - protein, 9 aa, Homo Sapiens
LGSTAPREL

SEQ ID NO: 665560 - protein, 9 aa, Homo Sapiens
ITGKPLIRR

SEQ ID NO: 665561 - protein, 9 aa, Homo Sapiens
CLLPLIVKN

SEQ ID NO: 665562 - protein, 9 aa, Homo Sapiens
LAAMAYDSY

SEQ ID NO: 665563 - protein, 9 aa, Homo Sapiens
HYMPASNVP

SEQ ID NO: 665564 - protein, 9 aa, Homo Sapiens
QNSVRHNLS

SEQ ID NO: 665565 - protein, 9 aa, Homo Sapiens
CLSLTPSPE

SEQ ID NO: 665566 - protein, 9 aa, Homo Sapiens
AEGELAVIE

SEQ ID NO: 665567 - protein, 9 aa, Homo Sapiens
GRGILESIH

SEQ ID NO: 665568 - protein, 9 aa, Homo Sapiens
KERQKEEGK

SEQ ID NO: 665569 - protein, 9 aa, Homo Sapiens
VRNESFLCL

SEQ ID NO: 665570 - protein, 9 aa, Homo Sapiens
EILQLAHAQ

SEQ ID NO: 665571 - protein, 9 aa, Homo Sapiens
SWAPSPRPR

SEQ ID NO: 665572 - protein, 9 aa, Homo Sapiens
FPVIVSQPA

SEQ ID NO: 665573 - protein, 9 aa, Homo Sapiens
WNEIRHQIE

SEQ ID NO: 665574 - protein, 9 aa, Homo Sapiens
TWHKDWQPL

SEQ ID NO: 665575 - protein, 9 aa, Homo Sapiens
FPTHYEDAL

SEQ ID NO: 665576 - protein, 9 aa, Homo Sapiens
AVIANCIED

SEQ ID NO: 665577 - protein, 9 aa, Homo Sapiens
KCPNLCSCN

SEQ ID NO: 665578 - protein, 9 aa, Homo Sapiens
CAMTFTHPS

SEQ ID NO: 665579 - protein, 9 aa, Homo Sapiens
GRDVEMEQM

SEQ ID NO: 665580 - protein, 9 aa, Homo Sapiens
LTQNQKVGE

SEQ ID NO: 665581 - protein, 9 aa, Homo Sapiens
NLNQLGLPA

SEQ ID NO: 665582 - protein, 9 aa, Homo Sapiens
EKVLLVKKK

SEQ ID NO: 665583 - protein, 9 aa, Homo Sapiens
AEQLKQAEK

SEQ ID NO: 665584 - protein, 9 aa, Homo Sapiens
RRSFRPLLR

SEQ ID NO: 665585 - protein, 9 aa, Homo Sapiens
SKKSCSYCT

SEQ ID NO: 665586 - protein, 9 aa, Homo Sapiens
LLVMVKDHG

SEQ ID NO: 665587 - protein, 9 aa, Homo Sapiens
SPRPRGPAQ

SEQ ID NO: 665588 - protein, 9 aa, Homo Sapiens
EVVDVNDNT

SEQ ID NO: 665589 - protein, 9 aa, Homo Sapiens
HFCGVQLDH

SEQ ID NO: 665590 - protein, 9 aa, Homo Sapiens
RAIVSSVLF

SEQ ID NO: 665591 - protein, 9 aa, Homo Sapiens
SALELLRRA

SEQ ID NO: 665592 - protein, 9 aa, Homo Sapiens
DGLIFWPRG

SEQ ID NO: 665593 - protein, 9 aa, Homo Sapiens
CFPYVQVLK

SEQ ID NO: 665594 - protein, 9 aa, Homo Sapiens
VPQGEQACM

SEQ ID NO: 665595 - protein, 9 aa, Homo Sapiens
ARLARLVIS

SEQ ID NO: 665596 - protein, 9 aa, Homo Sapiens
VWILTVAHC

SEQ ID NO: 665597 - protein, 9 aa, Homo Sapiens
PNSRPAPEV

SEQ ID NO: 665598 - protein, 9 aa, Homo Sapiens
AEKLRQYKV

SEQ ID NO: 665599 - protein, 9 aa, Homo Sapiens
ITWHKDWQP

SEQ ID NO: 665600 - protein, 9 aa, Homo Sapiens
FGKSTIDSS

SEQ ID NO: 665601 - protein, 9 aa, Homo Sapiens
QLDVFGHDG

SEQ ID NO: 665602 - protein, 9 aa, Homo Sapiens
SDAKHPAVF

SEQ ID NO: 665603 - protein, 9 aa, Homo Sapiens
RRDSFRKGP

SEQ ID NO: 665604 - protein, 9 aa, Homo Sapiens
FTYYLAWAI

SEQ ID NO: 665605 - protein, 9 aa, Homo Sapiens
IRKQCKIYD

SEQ ID NO: 665606 - protein, 9 aa, Homo Sapiens
YLSKHQKTH

SEQ ID NO: 665607 - protein, 9 aa, Homo Sapiens
GCCLPKDYK

SEQ ID NO: 665608 - protein, 9 aa, Homo Sapiens
FARFKYVTE

SEQ ID NO: 665609 - protein, 9 aa, Homo Sapiens
SQPEELKEK

SEQ ID NO: 665610 - protein, 9 aa, Homo Sapiens
DCSGTAEGG

SEQ ID NO: 665611 - protein, 9 aa, Homo Sapiens
SQLNTTLQK

SEQ ID NO: 665612 - protein, 9 aa, Homo Sapiens
LRISEYKAI

SEQ ID NO: 665613 - protein, 9 aa, Homo Sapiens
RRASAAGPV

SEQ ID NO: 665614 - protein, 9 aa, Homo Sapiens
LPFSLLCEA

SEQ ID NO: 665615 - protein, 9 aa, Homo Sapiens
ITEFAYGTV

SEQ ID NO: 665616 - protein, 9 aa, Homo Sapiens
RYGGKFLVF

SEQ ID NO: 665617 - protein, 9 aa, Homo Sapiens
PSSPSEVKM

SEQ ID NO: 665618 - protein, 9 aa, Homo Sapiens
VAQPESEDV

SEQ ID NO: 665619 - protein, 9 aa, Homo Sapiens
SSKLTVYTD

SEQ ID NO: 665620 - protein, 9 aa, Homo Sapiens
AENSHIMPH

SEQ ID NO: 665621 - protein, 9 aa, Homo Sapiens
WCAACVNLS

SEQ ID NO: 665622 - protein, 9 aa, Homo Sapiens
PMGHTASVH

SEQ ID NO: 665623 - protein, 9 aa, Homo Sapiens
NEIRHQIEN

SEQ ID NO: 665624 - protein, 9 aa, Homo Sapiens
SCSGMNDPD

SEQ ID NO: 665625 - protein, 9 aa, Homo Sapiens
SKLTVYTDA

SEQ ID NO: 665626 - protein, 9 aa, Homo Sapiens
FCLGALIHN

SEQ ID NO: 665627 - protein, 9 aa, Homo Sapiens
GLRHEFTAE

SEQ ID NO: 665628 - protein, 9 aa, Homo Sapiens
KASMVMLRA

SEQ ID NO: 665629 - protein, 9 aa, Homo Sapiens
LDINEAFKE

SEQ ID NO: 665630 - protein, 9 aa, Homo Sapiens
TITFVREEV

SEQ ID NO: 665631 - protein, 9 aa, Homo Sapiens
NPHVGDVSV

SEQ ID NO: 665632 - protein, 9 aa, Homo Sapiens
TANLNDTMT

SEQ ID NO: 665633 - protein, 9 aa, Homo Sapiens
IPASNKAVV

SEQ ID NO: 665634 - protein, 9 aa, Homo Sapiens
ELKEKMDDT

SEQ ID NO: 665635 - protein, 9 aa, Homo Sapiens
GSSFGADCF

SEQ ID NO: 665636 - protein, 9 aa, Homo Sapiens
PESMKPALA

SEQ ID NO: 665637 - protein, 9 aa, Homo Sapiens
RLRGGSGYH

SEQ ID NO: 665638 - protein, 9 aa, Homo Sapiens
GMPAKYWKL

SEQ ID NO: 665639 - protein, 9 aa, Homo Sapiens
HDLSKKPPD

SEQ ID NO: 665640 - protein, 9 aa, Homo Sapiens
VHSLLSQDQ

SEQ ID NO: 665641 - protein, 9 aa, Homo Sapiens
TDAFRRRWR

SEQ ID NO: 665642 - protein, 9 aa, Homo Sapiens
LYPDIKDDQ

SEQ ID NO: 665643 - protein, 9 aa, Homo Sapiens
RVLRHSSAK

SEQ ID NO: 665644 - protein, 9 aa, Homo Sapiens
GQKQRIANA

SEQ ID NO: 665645 - protein, 9 aa, Homo Sapiens
APASALLSG

SEQ ID NO: 665646 - protein, 9 aa, Homo Sapiens
QLLKKHKST

SEQ ID NO: 665647 - protein, 9 aa, Homo Sapiens
TIMCEKPNN

SEQ ID NO: 665648 - protein, 9 aa, Homo Sapiens
VISLHGFFM

SEQ ID NO: 665649 - protein, 9 aa, Homo Sapiens
VKTDTGTEP

SEQ ID NO: 665650 - protein, 9 aa, Homo Sapiens
ILQLAHAQG

SEQ ID NO: 665651 - protein, 9 aa, Homo Sapiens
LRLICVQLC

SEQ ID NO: 665652 - protein, 9 aa, Homo Sapiens
SIHRFSLLP

SEQ ID NO: 665653 - protein, 9 aa, Homo Sapiens
PIRKKLGRK

SEQ ID NO: 665654 - protein, 9 aa, Homo Sapiens
WYENLSGLQ

SEQ ID NO: 665655 - protein, 9 aa, Homo Sapiens
SAVETNPLI

SEQ ID NO: 665656 - protein, 9 aa, Homo Sapiens
TLNELFAGF

SEQ ID NO: 665657 - protein, 9 aa, Homo Sapiens
GVLYPALPQ

SEQ ID NO: 665658 - protein, 9 aa, Homo Sapiens
GSSPPGCLP

SEQ ID NO: 665659 - protein, 9 aa, Homo Sapiens
KLRQYKVLV

SEQ ID NO: 665660 - protein, 9 aa, Homo Sapiens
NIVPMYPAF

SEQ ID NO: 665661 - protein, 9 aa, Homo Sapiens
LVTSNIMGD

SEQ ID NO: 665662 - protein, 9 aa, Homo Sapiens
IFILFGGVL

SEQ ID NO: 665663 - protein, 9 aa, Homo Sapiens
VPNVSDGIV

SEQ ID NO: 665664 - protein, 9 aa, Homo Sapiens
ESMQLPLVS

SEQ ID NO: 665665 - protein, 9 aa, Homo Sapiens
GFDCSMCRH

SEQ ID NO: 665666 - protein, 9 aa, Homo Sapiens
LSIGMAALA

SEQ ID NO: 665667 - protein, 9 aa, Homo Sapiens
GGKFLVFPP

SEQ ID NO: 665668 - protein, 9 aa, Homo Sapiens
FIQRKISLP

SEQ ID NO: 665669 - protein, 9 aa, Homo Sapiens
AVLAVLMAL

SEQ ID NO: 665670 - protein, 9 aa, Homo Sapiens
GVWGKLTLC

SEQ ID NO: 665671 - protein, 9 aa, Homo Sapiens
DRMRLHGVN

SEQ ID NO: 665672 - protein, 9 aa, Homo Sapiens
CVVIFSKKS

SEQ ID NO: 665673 - protein, 9 aa, Homo Sapiens
HNKQHAMTL

SEQ ID NO: 665674 - protein, 9 aa, Homo Sapiens
PELALIPRT

SEQ ID NO: 665675 - protein, 9 aa, Homo Sapiens
YYCFITFTT

SEQ ID NO: 665676 - protein, 9 aa, Homo Sapiens
ACMARLARL

SEQ ID NO: 665677 - protein, 9 aa, Homo Sapiens
IVSSVLFVS

SEQ ID NO: 665678 - protein, 9 aa, Homo Sapiens
AGTSALELL

SEQ ID NO: 665679 - protein, 9 aa, Homo Sapiens
LVSGICAAE

SEQ ID NO: 665680 - protein, 9 aa, Homo Sapiens
YKYVYKRYL

SEQ ID NO: 665681 - protein, 9 aa, Homo Sapiens
NSSVWVQSK

SEQ ID NO: 665682 - protein, 9 aa, Homo Sapiens
SQTPLMFTY

SEQ ID NO: 665683 - protein, 9 aa, Homo Sapiens
PAAEEPSSE

SEQ ID NO: 665684 - protein, 9 aa, Homo Sapiens
QPLSVGFVE

SEQ ID NO: 665685 - protein, 9 aa, Homo Sapiens
QFPISLLQS

SEQ ID NO: 665686 - protein, 9 aa, Homo Sapiens
YWKEHHFVG

SEQ ID NO: 665687 - protein, 9 aa, Homo Sapiens
VFGYDTDQE

SEQ ID NO: 665688 - protein, 9 aa, Homo Sapiens
LPAQHRPGD

SEQ ID NO: 665689 - protein, 9 aa, Homo Sapiens
ANSSVWVQS

SEQ ID NO: 665690 - protein, 9 aa, Homo Sapiens
MGHTASVHL

SEQ ID NO: 665691 - protein, 9 aa, Homo Sapiens
MSKIKLPSF

SEQ ID NO: 665692 - protein, 9 aa, Homo Sapiens
SACDATILS

SEQ ID NO: 665693 - protein, 9 aa, Homo Sapiens
ILLLSNQLH

SEQ ID NO: 665694 - protein, 9 aa, Homo Sapiens
IGCGKRPSI

SEQ ID NO: 665695 - protein, 9 aa, Homo Sapiens
TLETKPLNF

SEQ ID NO: 665696 - protein, 9 aa, Homo Sapiens
ASAKRQVLN

SEQ ID NO: 665697 - protein, 9 aa, Homo Sapiens
ERLRVLDIN

SEQ ID NO: 665698 - protein, 9 aa, Homo Sapiens
LLECKKSDA

SEQ ID NO: 665699 - protein, 9 aa, Homo Sapiens
ACATSLQER

SEQ ID NO: 665700 - protein, 9 aa, Homo Sapiens
ALELLRRAT

SEQ ID NO: 665701 - protein, 9 aa, Homo Sapiens
YATSIYTYL

SEQ ID NO: 665702 - protein, 9 aa, Homo Sapiens
DALENALVS

SEQ ID NO: 665703 - protein, 9 aa, Homo Sapiens
LSSKSTILY

SEQ ID NO: 665704 - protein, 9 aa, Homo Sapiens
RIANARALV

SEQ ID NO: 665705 - protein, 9 aa, Homo Sapiens
PGCLPSARP

SEQ ID NO: 665706 - protein, 9 aa, Homo Sapiens
YLYAWANDD

SEQ ID NO: 665707 - protein, 9 aa, Homo Sapiens
SSYSGHNTK

SEQ ID NO: 665708 - protein, 9 aa, Homo Sapiens
AKPLQPHLV

SEQ ID NO: 665709 - protein, 9 aa, Homo Sapiens
QATLSLNSQ

SEQ ID NO: 665710 - protein, 9 aa, Homo Sapiens
CSSYSGHNT

SEQ ID NO: 665711 - protein, 9 aa, Homo Sapiens
GKPLIRRSD

SEQ ID NO: 665712 - protein, 9 aa, Homo Sapiens
PGPFVQEKI

SEQ ID NO: 665713 - protein, 9 aa, Homo Sapiens
LAMLADTDI

SEQ ID NO: 665714 - protein, 9 aa, Homo Sapiens
DEGPVAQQV

SEQ ID NO: 665715 - protein, 9 aa, Homo Sapiens
SIQPHCVFF

SEQ ID NO: 665716 - protein, 9 aa, Homo Sapiens
VQATFRENA

SEQ ID NO: 665717 - protein, 9 aa, Homo Sapiens
KHDMEMVQA

SEQ ID NO: 665718 - protein, 9 aa, Homo Sapiens
PEPLVTYEL

SEQ ID NO: 665719 - protein, 9 aa, Homo Sapiens
NYWELKNKQ

SEQ ID NO: 665720 - protein, 9 aa, Homo Sapiens
VISISWAPS

SEQ ID NO: 665721 - protein, 9 aa, Homo Sapiens
REEECSCVS

SEQ ID NO: 665722 - protein, 9 aa, Homo Sapiens
MLRLICVQL

SEQ ID NO: 665723 - protein, 9 aa, Homo Sapiens
AAMAYDSYV

SEQ ID NO: 665724 - protein, 9 aa, Homo Sapiens
WAPSPRPRG

SEQ ID NO: 665725 - protein, 9 aa, Homo Sapiens
CTFFLNIFR

SEQ ID NO: 665726 - protein, 9 aa, Homo Sapiens
WKEHHFVGI

SEQ ID NO: 665727 - protein, 9 aa, Homo Sapiens
GSAIPKAMQ

SEQ ID NO: 665728 - protein, 9 aa, Homo Sapiens
HQYRKSGKE

SEQ ID NO: 665729 - protein, 9 aa, Homo Sapiens
EFVLSSGEN

SEQ ID NO: 665730 - protein, 9 aa, Homo Sapiens
VSFPVIVSQ

SEQ ID NO: 665731 - protein, 9 aa, Homo Sapiens
VTKVPQGEQ

SEQ ID NO: 665732 - protein, 9 aa, Homo Sapiens
DCSMCRHYM

SEQ ID NO: 665733 - protein, 9 aa, Homo Sapiens
KEVRVRNQT

SEQ ID NO: 665734 - protein, 9 aa, Homo Sapiens
AIFLSFSIM

SEQ ID NO: 665735 - protein, 9 aa, Homo Sapiens
VSAQFTKAL

SEQ ID NO: 665736 - protein, 9 aa, Homo Sapiens
PPEIRQAPP

SEQ ID NO: 665737 - protein, 9 aa, Homo Sapiens
LLMPDNQNI

SEQ ID NO: 665738 - protein, 9 aa, Homo Sapiens
MKGVNLSCL

SEQ ID NO: 665739 - protein, 9 aa, Homo Sapiens
QRLVLALKE

SEQ ID NO: 665740 - protein, 9 aa, Homo Sapiens
KPYNSNECC

SEQ ID NO: 665741 - protein, 9 aa, Homo Sapiens
VVTLRSGVI

SEQ ID NO: 665742 - protein, 9 aa, Homo Sapiens
SGRKPAARL

SEQ ID NO: 665743 - protein, 9 aa, Homo Sapiens
RHSCCVSSC

SEQ ID NO: 665744 - protein, 9 aa, Homo Sapiens
RMRLHGVNY

SEQ ID NO: 665745 - protein, 9 aa, Homo Sapiens
LLCALVVFT

SEQ ID NO: 665746 - protein, 9 aa, Homo Sapiens
IPHCQKKWI

SEQ ID NO: 665747 - protein, 9 aa, Homo Sapiens
VEMEQMIEQ

SEQ ID NO: 665748 - protein, 9 aa, Homo Sapiens
FVAAFLATT

SEQ ID NO: 665749 - protein, 9 aa, Homo Sapiens
ALVEKYKYL

SEQ ID NO: 665750 - protein, 9 aa, Homo Sapiens
VHREHCLCR

SEQ ID NO: 665751 - protein, 9 aa, Homo Sapiens
EHIIQAPKT

SEQ ID NO: 665752 - protein, 9 aa, Homo Sapiens
NIVKLYVHK

SEQ ID NO: 665753 - protein, 9 aa, Homo Sapiens
AHGSNLQNC

SEQ ID NO: 665754 - protein, 9 aa, Homo Sapiens
NFARFKYVT

SEQ ID NO: 665755 - protein, 9 aa, Homo Sapiens
QRLAKNMSG

SEQ ID NO: 665756 - protein, 9 aa, Homo Sapiens
TQNQKVGEL

SEQ ID NO: 665757 - protein, 9 aa, Homo Sapiens
NIMGDITSS

SEQ ID NO: 665758 - protein, 9 aa, Homo Sapiens
QRSVTVVSQ

SEQ ID NO: 665759 - protein, 9 aa, Homo Sapiens
SKSTILYSS

SEQ ID NO: 665760 - protein, 9 aa, Homo Sapiens
PKALLAREL

SEQ ID NO: 665761 - protein, 9 aa, Homo Sapiens
IYEKYQYLY

SEQ ID NO: 665762 - protein, 9 aa, Homo Sapiens
NMAFGMPAK

SEQ ID NO: 665763 - protein, 9 aa, Homo Sapiens
VVRSYTACA

SEQ ID NO: 665764 - protein, 9 aa, Homo Sapiens
ELYDNCPDC

SEQ ID NO: 665765 - protein, 9 aa, Homo Sapiens
RLHGVNYVQ

SEQ ID NO: 665766 - protein, 9 aa, Homo Sapiens
LLKNQLLYP

SEQ ID NO: 665767 - protein, 9 aa, Homo Sapiens
NFQPIAQDL

SEQ ID NO: 665768 - protein, 9 aa, Homo Sapiens
VTATSWART

SEQ ID NO: 665769 - protein, 9 aa, Homo Sapiens
QEQMKKGYN

SEQ ID NO: 665770 - protein, 9 aa, Homo Sapiens
FTTIGFGDY

SEQ ID NO: 665771 - protein, 9 aa, Homo Sapiens
KSAHTGEKH

SEQ ID NO: 665772 - protein, 9 aa, Homo Sapiens
SQAFGRDLC

SEQ ID NO: 665773 - protein, 9 aa, Homo Sapiens
ESFLKLVSN

SEQ ID NO: 665774 - protein, 9 aa, Homo Sapiens
ALIPRTMNC

SEQ ID NO: 665775 - protein, 9 aa, Homo Sapiens
VIFSKKSCS

SEQ ID NO: 665776 - protein, 9 aa, Homo Sapiens
VVQEVKNLL

SEQ ID NO: 665777 - protein, 9 aa, Homo Sapiens
CLRELDLAQ

SEQ ID NO: 665778 - protein, 9 aa, Homo Sapiens
FEECGKAFI

SEQ ID NO: 665779 - protein, 9 aa, Homo Sapiens
RLWRALYGV

SEQ ID NO: 665780 - protein, 9 aa, Homo Sapiens
ALQVLGMRK

SEQ ID NO: 665781 - protein, 9 aa, Homo Sapiens
KVHLDRMRL

SEQ ID NO: 665782 - protein, 9 aa, Homo Sapiens
MWIGETAIL

SEQ ID NO: 665783 - protein, 9 aa, Homo Sapiens
LQLAIRNNE

SEQ ID NO: 665784 - protein, 9 aa, Homo Sapiens
HYRCKECGK

SEQ ID NO: 665785 - protein, 9 aa, Homo Sapiens
GSKRLSSSV

SEQ ID NO: 665786 - protein, 9 aa, Homo Sapiens
KRHGPRPVA

SEQ ID NO: 665787 - protein, 9 aa, Homo Sapiens
SALLSGAEG

SEQ ID NO: 665788 - protein, 9 aa, Homo Sapiens
VYGALSIGM

SEQ ID NO: 665789 - protein, 9 aa, Homo Sapiens
ARLVISVTS

SEQ ID NO: 665790 - protein, 9 aa, Homo Sapiens
QCEAKNGYK

SEQ ID NO: 665791 - protein, 9 aa, Homo Sapiens
VPFTKNNNK

SEQ ID NO: 665792 - protein, 9 aa, Homo Sapiens
KVQEQVHSL

SEQ ID NO: 665793 - protein, 9 aa, Homo Sapiens
SKFLVHESM

SEQ ID NO: 665794 - protein, 9 aa, Homo Sapiens
VQEVKNLLS

SEQ ID NO: 665795 - protein, 9 aa, Homo Sapiens
KEVPCCWHC

SEQ ID NO: 665796 - protein, 9 aa, Homo Sapiens
GQLFAGGFP

SEQ ID NO: 665797 - protein, 9 aa, Homo Sapiens
LGHLFNDLG

SEQ ID NO: 665798 - protein, 9 aa, Homo Sapiens
VAAFLATTL

SEQ ID NO: 665799 - protein, 9 aa, Homo Sapiens
IILFYATSI

SEQ ID NO: 665800 - protein, 9 aa, Homo Sapiens
DEDKDAEGD

SEQ ID NO: 665801 - protein, 9 aa, Homo Sapiens
QACMARLAR

SEQ ID NO: 665802 - protein, 9 aa, Homo Sapiens
ISWAPSPRP

SEQ ID NO: 665803 - protein, 9 aa, Homo Sapiens
IDIVYTWVN

SEQ ID NO: 665804 - protein, 9 aa, Homo Sapiens
GELAVIEDD

SEQ ID NO: 665805 - protein, 9 aa, Homo Sapiens
QAVDITPQE

SEQ ID NO: 665806 - protein, 9 aa, Homo Sapiens
PLHLLFSLI

SEQ ID NO: 665807 - protein, 9 aa, Homo Sapiens
RKDGLKLNA

SEQ ID NO: 665808 - protein, 9 aa, Homo Sapiens
EVRVRNQTE

SEQ ID NO: 665809 - protein, 9 aa, Homo Sapiens
AHTGEKHYR

SEQ ID NO: 665810 - protein, 9 aa, Homo Sapiens
QSGEKLNEL

SEQ ID NO: 665811 - protein, 9 aa, Homo Sapiens
TIIFILFGG

SEQ ID NO: 665812 - protein, 9 aa, Homo Sapiens
FSFTQRRSF

SEQ ID NO: 665813 - protein, 9 aa, Homo Sapiens
RAKPHLTWW

SEQ ID NO: 665814 - protein, 9 aa, Homo Sapiens
REHCLCRHW

SEQ ID NO: 665815 - protein, 9 aa, Homo Sapiens
PCLWPDPSH

SEQ ID NO: 665816 - protein, 9 aa, Homo Sapiens
QNCILTLMS

SEQ ID NO: 665817 - protein, 9 aa, Homo Sapiens
TLTEIRLPL

SEQ ID NO: 665818 - protein, 9 aa, Homo Sapiens
VLYAIFLSF

SEQ ID NO: 665819 - protein, 9 aa, Homo Sapiens
PDAFVSEEL

SEQ ID NO: 665820 - protein, 9 aa, Homo Sapiens
PGTICITRY

SEQ ID NO: 665821 - protein, 9 aa, Homo Sapiens
AILCTPSVA

SEQ ID NO: 665822 - protein, 9 aa, Homo Sapiens
SLSPYPASQ

SEQ ID NO: 665823 - protein, 9 aa, Homo Sapiens
EHGIITNCD

SEQ ID NO: 665824 - protein, 9 aa, Homo Sapiens
HCQKKWIQS

SEQ ID NO: 665825 - protein, 9 aa, Homo Sapiens
DEDGFQGLR

SEQ ID NO: 665826 - protein, 9 aa, Homo Sapiens
EILRDLPHQ

SEQ ID NO: 665827 - protein, 9 aa, Homo Sapiens
MRLHGVNYV

SEQ ID NO: 665828 - protein, 9 aa, Homo Sapiens
FQESGEYRC

SEQ ID NO: 665829 - protein, 9 aa, Homo Sapiens
PLEGQLPDE

SEQ ID NO: 665830 - protein, 9 aa, Homo Sapiens
KFRRDFFIL

SEQ ID NO: 665831 - protein, 9 aa, Homo Sapiens
PVQPVYPAA

SEQ ID NO: 665832 - protein, 9 aa, Homo Sapiens
KDDITGKPL

SEQ ID NO: 665833 - protein, 9 aa, Homo Sapiens
HSINDTHFY

SEQ ID NO: 665834 - protein, 9 aa, Homo Sapiens
NTVANTSPT

SEQ ID NO: 665835 - protein, 9 aa, Homo Sapiens
FCGVQLDHR

SEQ ID NO: 665836 - protein, 9 aa, Homo Sapiens
LCAFYTHVQ

SEQ ID NO: 665837 - protein, 9 aa, Homo Sapiens
AVLMALLIV

SEQ ID NO: 665838 - protein, 9 aa, Homo Sapiens
VTRRLRGGS

SEQ ID NO: 665839 - protein, 9 aa, Homo Sapiens
GVDWGCGGR

SEQ ID NO: 665840 - protein, 9 aa, Homo Sapiens
YQYLYTVEP

SEQ ID NO: 665841 - protein, 9 aa, Homo Sapiens
MTLTKARCC

SEQ ID NO: 665842 - protein, 9 aa, Homo Sapiens
LVLYAIFLS

SEQ ID NO: 665843 - protein, 9 aa, Homo Sapiens
WYTYYARLN

SEQ ID NO: 665844 - protein, 9 aa, Homo Sapiens
QLAIRNNEE

SEQ ID NO: 665845 - protein, 9 aa, Homo Sapiens
GEKHYRCKE

SEQ ID NO: 665846 - protein, 9 aa, Homo Sapiens
YLCASSSST

SEQ ID NO: 665847 - protein, 9 aa, Homo Sapiens
AFLATTLTK

SEQ ID NO: 665848 - protein, 9 aa, Homo Sapiens
LGGTVHSLW

SEQ ID NO: 665849 - protein, 9 aa, Homo Sapiens
YNLHSVAAH

SEQ ID NO: 665850 - protein, 9 aa, Homo Sapiens
ETAILCTPS

SEQ ID NO: 665851 - protein, 9 aa, Homo Sapiens
EPPMYDEGK

SEQ ID NO: 665852 - protein, 9 aa, Homo Sapiens
MEEFVLSSG

SEQ ID NO: 665853 - protein, 9 aa, Homo Sapiens
APFVERTPD

SEQ ID NO: 665854 - protein, 9 aa, Homo Sapiens
TYGFWALLE

SEQ ID NO: 665855 - protein, 9 aa, Homo Sapiens
IFLSFSIMI

SEQ ID NO: 665856 - protein, 9 aa, Homo Sapiens
AFGRDLCRG

SEQ ID NO: 665857 - protein, 9 aa, Homo Sapiens
IYRPLHYPT

SEQ ID NO: 665858 - protein, 9 aa, Homo Sapiens
RSYTACATS

SEQ ID NO: 665859 - protein, 9 aa, Homo Sapiens
LPLPIQTTS

SEQ ID NO: 665860 - protein, 9 aa, Homo Sapiens
HQQIPPRPF

SEQ ID NO: 665861 - protein, 9 aa, Homo Sapiens
ICKPLHYVT

SEQ ID NO: 665862 - protein, 9 aa, Homo Sapiens
HLGCCLPKD

SEQ ID NO: 665863 - protein, 9 aa, Homo Sapiens
FLKLVSNMV

SEQ ID NO: 665864 - protein, 9 aa, Homo Sapiens
DQRLAISHY

SEQ ID NO: 665865 - protein, 9 aa, Homo Sapiens
GRLLITTNL

SEQ ID NO: 665866 - protein, 9 aa, Homo Sapiens
RKQLQELQN

SEQ ID NO: 665867 - protein, 9 aa, Homo Sapiens
YLAIYRPLH

SEQ ID NO: 665868 - protein, 9 aa, Homo Sapiens
VVVPYEPPD

SEQ ID NO: 665869 - protein, 9 aa, Homo Sapiens
THYPDAFVS

SEQ ID NO: 665870 - protein, 9 aa, Homo Sapiens
ASPAALPCP

SEQ ID NO: 665871 - protein, 9 aa, Homo Sapiens
QQVKKSTLN

SEQ ID NO: 665872 - protein, 9 aa, Homo Sapiens
LPGLPVDKG

SEQ ID NO: 665873 - protein, 9 aa, Homo Sapiens
SLEIIEERN

SEQ ID NO: 665874 - protein, 9 aa, Homo Sapiens
DIVYTWVNG

SEQ ID NO: 665875 - protein, 9 aa, Homo Sapiens
NKRSTHWNK

SEQ ID NO: 665876 - protein, 9 aa, Homo Sapiens
KDFTQSSNL

SEQ ID NO: 665877 - protein, 9 aa, Homo Sapiens
QKELERQCL

SEQ ID NO: 665878 - protein, 9 aa, Homo Sapiens
CGKRPSIQQ

SEQ ID NO: 665879 - protein, 9 aa, Homo Sapiens
QGTLLFLYF

SEQ ID NO: 665880 - protein, 9 aa, Homo Sapiens
DEEDPLGPY

SEQ ID NO: 665881 - protein, 9 aa, Homo Sapiens
RNLWENLCT

SEQ ID NO: 665882 - protein, 9 aa, Homo Sapiens
KCNFSNTFS

SEQ ID NO: 665883 - protein, 9 aa, Homo Sapiens
CVRHLITCI

SEQ ID NO: 665884 - protein, 9 aa, Homo Sapiens
VSSPLPGQF

SEQ ID NO: 665885 - protein, 9 aa, Homo Sapiens
SQTLAFRTK

SEQ ID NO: 665886 - protein, 9 aa, Homo Sapiens
LIVKNIRKK

SEQ ID NO: 665887 - protein, 9 aa, Homo Sapiens
ESEDVITSQ

SEQ ID NO: 665888 - protein, 9 aa, Homo Sapiens
LNLFLSSAT

SEQ ID NO: 665889 - protein, 9 aa, Homo Sapiens
LLQPLPAIA

SEQ ID NO: 665890 - protein, 9 aa, Homo Sapiens
EIHEWTVLQ

SEQ ID NO: 665891 - protein, 9 aa, Homo Sapiens
SQHIEIHEW

SEQ ID NO: 665892 - protein, 9 aa, Homo Sapiens
QMKKGYNPT

SEQ ID NO: 665893 - protein, 9 aa, Homo Sapiens
PEPLNLFLS

SEQ ID NO: 665894 - protein, 9 aa, Homo Sapiens
VFYQSFDFS

SEQ ID NO: 665895 - protein, 9 aa, Homo Sapiens
LRQSWHTTC

SEQ ID NO: 665896 - protein, 9 aa, Homo Sapiens
SVDGTQVSI

SEQ ID NO: 665897 - protein, 9 aa, Homo Sapiens
QGLRHEFTA

SEQ ID NO: 665898 - protein, 9 aa, Homo Sapiens
TSAENSHIM

SEQ ID NO: 665899 - protein, 9 aa, Homo Sapiens
EDNAAPQSL

SEQ ID NO: 665900 - protein, 9 aa, Homo Sapiens
MTLNELFAG

SEQ ID NO: 665901 - protein, 9 aa, Homo Sapiens
QIVKHDMEM

SEQ ID NO: 665902 - protein, 9 aa, Homo Sapiens
LPAIAGASC

SEQ ID NO: 665903 - protein, 9 aa, Homo Sapiens
FRAIVSSVL

SEQ ID NO: 665904 - protein, 9 aa, Homo Sapiens
AWLRICRPG

SEQ ID NO: 665905 - protein, 9 aa, Homo Sapiens
LIGMLFARK

SEQ ID NO: 665906 - protein, 9 aa, Homo Sapiens
KQLLLELGE

SEQ ID NO: 665907 - protein, 9 aa, Homo Sapiens
RLICVQLCD

SEQ ID NO: 665908 - protein, 9 aa, Homo Sapiens
EDPLGPYCY

SEQ ID NO: 665909 - protein, 9 aa, Homo Sapiens
EVAQPESED

SEQ ID NO: 665910 - protein, 9 aa, Homo Sapiens
GTLMIRKTR

SEQ ID NO: 665911 - protein, 9 aa, Homo Sapiens
HHFVGIALV

SEQ ID NO: 665912 - protein, 9 aa, Homo Sapiens
AYDRYLAIY

SEQ ID NO: 665913 - protein, 9 aa, Homo Sapiens
ECNEYGKSC

SEQ ID NO: 665914 - protein, 9 aa, Homo Sapiens
FDPAVPFCT

SEQ ID NO: 665915 - protein, 9 aa, Homo Sapiens
SASPAALPC

SEQ ID NO: 665916 - protein, 9 aa, Homo Sapiens
HAQGLDPPT

SEQ ID NO: 665917 - protein, 9 aa, Homo Sapiens
KNFARFKYV

SEQ ID NO: 665918 - protein, 9 aa, Homo Sapiens
LDLHDLSKK

SEQ ID NO: 665919 - protein, 9 aa, Homo Sapiens
LMAFLDHRV

SEQ ID NO: 665920 - protein, 9 aa, Homo Sapiens
PRLDGSGAV

SEQ ID NO: 665921 - protein, 9 aa, Homo Sapiens
YVTIMNQCV

SEQ ID NO: 665922 - protein, 9 aa, Homo Sapiens
FIHAFGGTE

SEQ ID NO: 665923 - protein, 9 aa, Homo Sapiens
CRHSCCVSS

SEQ ID NO: 665924 - protein, 9 aa, Homo Sapiens
TQRRSFRPL

SEQ ID NO: 665925 - protein, 9 aa, Homo Sapiens
NSAGSTNYW

SEQ ID NO: 665926 - protein, 9 aa, Homo Sapiens
ICLNRARKY

SEQ ID NO: 665927 - protein, 9 aa, Homo Sapiens
WNKKPRRSS

SEQ ID NO: 665928 - protein, 9 aa, Homo Sapiens
PKAMQKLVV

SEQ ID NO: 665929 - protein, 9 aa, Homo Sapiens
FTQRRSFRP

SEQ ID NO: 665930 - protein, 9 aa, Homo Sapiens
ARNDFDRLQ

SEQ ID NO: 665931 - protein, 9 aa, Homo Sapiens
DCYVALHAV

SEQ ID NO: 665932 - protein, 9 aa, Homo Sapiens
AIYRPLHYP

SEQ ID NO: 665933 - protein, 9 aa, Homo Sapiens
LKCPNLCSC

SEQ ID NO: 665934 - protein, 9 aa, Homo Sapiens
HGKRQRSVT

SEQ ID NO: 665935 - protein, 9 aa, Homo Sapiens
QPHGKRQRS

SEQ ID NO: 665936 - protein, 9 aa, Homo Sapiens
VIHNKLKIL

SEQ ID NO: 665937 - protein, 9 aa, Homo Sapiens
LCLSLTPSP

SEQ ID NO: 665938 - protein, 9 aa, Homo Sapiens
ISHYQIAHL

SEQ ID NO: 665939 - protein, 9 aa, Homo Sapiens
APPEIRQAP

SEQ ID NO: 665940 - protein, 9 aa, Homo Sapiens
QLAHAQGLD

SEQ ID NO: 665941 - protein, 9 aa, Homo Sapiens
FRENAVTKR

SEQ ID NO: 665942 - protein, 9 aa, Homo Sapiens
RENAVTKRV

SEQ ID NO: 665943 - protein, 9 aa, Homo Sapiens
GDVSVLSSG

SEQ ID NO: 665944 - protein, 9 aa, Homo Sapiens
TLMIRKTRE

SEQ ID NO: 665945 - protein, 9 aa, Homo Sapiens
QEPLCEDCP

SEQ ID NO: 665946 - protein, 9 aa, Homo Sapiens
AVDVVQARE

SEQ ID NO: 665947 - protein, 9 aa, Homo Sapiens
LCSKTKGSF

SEQ ID NO: 665948 - protein, 9 aa, Homo Sapiens
TENMSTVSW

SEQ ID NO: 665949 - protein, 9 aa, Homo Sapiens
EYIFAIYLL

SEQ ID NO: 665950 - protein, 9 aa, Homo Sapiens
CVVSTPGGP

SEQ ID NO: 665951 - protein, 9 aa, Homo Sapiens
LSSLESNTS

SEQ ID NO: 665952 - protein, 9 aa, Homo Sapiens
AITVPAVPY

SEQ ID NO: 665953 - protein, 9 aa, Homo Sapiens
KASAKRQVL

SEQ ID NO: 665954 - protein, 9 aa, Homo Sapiens
DPFRFALEA

SEQ ID NO: 665955 - protein, 9 aa, Homo Sapiens
RKSGKEILN

SEQ ID NO: 665956 - protein, 9 aa, Homo Sapiens
FVFLICGYS

SEQ ID NO: 665957 - protein, 9 aa, Homo Sapiens
TLNPVFYQS

SEQ ID NO: 665958 - protein, 9 aa, Homo Sapiens
LKQWSLNPE

SEQ ID NO: 665959 - protein, 9 aa, Homo Sapiens
LSGLQQQTM

SEQ ID NO: 665960 - protein, 9 aa, Homo Sapiens
MCREEGERA

SEQ ID NO: 665961 - protein, 9 aa, Homo Sapiens
AKRKASMVM

SEQ ID NO: 665962 - protein, 9 aa, Homo Sapiens
RGGAFPGSF

SEQ ID NO: 665963 - protein, 9 aa, Homo Sapiens
PHCAMTFTH

SEQ ID NO: 665964 - protein, 9 aa, Homo Sapiens
FLSFSIMIE

SEQ ID NO: 665965 - protein, 9 aa, Homo Sapiens
YWELKNKQF

SEQ ID NO: 665966 - protein, 9 aa, Homo Sapiens
LFYATSIYT

SEQ ID NO: 665967 - protein, 9 aa, Homo Sapiens
SSALPFSLL

SEQ ID NO: 665968 - protein, 9 aa, Homo Sapiens
GEVNICLRE

SEQ ID NO: 665969 - protein, 9 aa, Homo Sapiens
SLTGASSDL

SEQ ID NO: 665970 - protein, 9 aa, Homo Sapiens
FGHDGDSLS

SEQ ID NO: 665971 - protein, 9 aa, Homo Sapiens
FFVAAFLAT

SEQ ID NO: 665972 - protein, 9 aa, Homo Sapiens
QGKHLESMQ

SEQ ID NO: 665973 - protein, 9 aa, Homo Sapiens
VSNGAITPG

SEQ ID NO: 665974 - protein, 9 aa, Homo Sapiens
YEKYQYLYT

SEQ ID NO: 665975 - protein, 9 aa, Homo Sapiens
LPRAMCKEL

SEQ ID NO: 665976 - protein, 9 aa, Homo Sapiens
KKRKPQVEK

SEQ ID NO: 665977 - protein, 9 aa, Homo Sapiens
LPMPIDIVY

SEQ ID NO: 665978 - protein, 9 aa, Homo Sapiens
PVIRQAPPE

SEQ ID NO: 665979 - protein, 9 aa, Homo Sapiens
HGIITNCDD

SEQ ID NO: 665980 - protein, 9 aa, Homo Sapiens
LQPLPAIAG

SEQ ID NO: 665981 - protein, 9 aa, Homo Sapiens
VKALDEDKD

SEQ ID NO: 665982 - protein, 9 aa, Homo Sapiens
QHKCPENDI

SEQ ID NO: 665983 - protein, 9 aa, Homo Sapiens
SPSEVKMEP

SEQ ID NO: 665984 - protein, 9 aa, Homo Sapiens
VHKGDAVTV

SEQ ID NO: 665985 - protein, 9 aa, Homo Sapiens
LPREPGVSA

SEQ ID NO: 665986 - protein, 9 aa, Homo Sapiens
HCVFFRLGP

SEQ ID NO: 665987 - protein, 9 aa, Homo Sapiens
ELRPWRALV

SEQ ID NO: 665988 - protein, 9 aa, Homo Sapiens
PLPIQTTSV

SEQ ID NO: 665989 - protein, 9 aa, Homo Sapiens
RGREGAEPR

SEQ ID NO: 665990 - protein, 9 aa, Homo Sapiens
LPDEQLGRL

SEQ ID NO: 665991 - protein, 9 aa, Homo Sapiens
FAIYLLCCH

SEQ ID NO: 665992 - protein, 9 aa, Homo Sapiens
HSPKVSSQI

SEQ ID NO: 665993 - protein, 9 aa, Homo Sapiens
IARRDSFRK

SEQ ID NO: 665994 - protein, 9 aa, Homo Sapiens
FASLLQRTD

SEQ ID NO: 665995 - protein, 9 aa, Homo Sapiens
KLGRKPLPP

SEQ ID NO: 665996 - protein, 9 aa, Homo Sapiens
SAENSHIMP

SEQ ID NO: 665997 - protein, 9 aa, Homo Sapiens
LTVAHCVQL

SEQ ID NO: 665998 - protein, 9 aa, Homo Sapiens
ALSFTPADC

SEQ ID NO: 665999 - protein, 9 aa, Homo Sapiens
YDRYLAIYR

SEQ ID NO: 666000 - protein, 9 aa, Homo Sapiens
LKMSKIKLP

SEQ ID NO: 666001 - protein, 9 aa, Homo Sapiens
FQGSAIPKA

SEQ ID NO: 666002 - protein, 9 aa, Homo Sapiens
SQRGLPTIT

SEQ ID NO: 666003 - protein, 9 aa, Homo Sapiens
PDGEEEEEG

SEQ ID NO: 666004 - protein, 9 aa, Homo Sapiens
GPVSPSWCG

SEQ ID NO: 666005 - protein, 9 aa, Homo Sapiens
LFPMREESV

SEQ ID NO: 666006 - protein, 9 aa, Homo Sapiens
KKDEKNGKK

SEQ ID NO: 666007 - protein, 9 aa, Homo Sapiens
RVRNESFLC

SEQ ID NO: 666008 - protein, 9 aa, Homo Sapiens
RRRPVPIKL

SEQ ID NO: 666009 - protein, 9 aa, Homo Sapiens
EPLPLKLNS

SEQ ID NO: 666010 - protein, 9 aa, Homo Sapiens
ELHQFAHDG

SEQ ID NO: 666011 - protein, 9 aa, Homo Sapiens
KYVTELNND

SEQ ID NO: 666012 - protein, 9 aa, Homo Sapiens
DHRHLVEAG

SEQ ID NO: 666013 - protein, 9 aa, Homo Sapiens
QLLLELGEE

SEQ ID NO: 666014 - protein, 9 aa, Homo Sapiens
CVNLSGWRP

SEQ ID NO: 666015 - protein, 9 aa, Homo Sapiens
ADCSGTAEG

SEQ ID NO: 666016 - protein, 9 aa, Homo Sapiens
RDLPHQPLE

SEQ ID NO: 666017 - protein, 9 aa, Homo Sapiens
CRFFSGECS

SEQ ID NO: 666018 - protein, 9 aa, Homo Sapiens
TGALTLANC

SEQ ID NO: 666019 - protein, 9 aa, Homo Sapiens
DGLKLNAIC

SEQ ID NO: 666020 - protein, 9 aa, Homo Sapiens
KPNSRPAPE

SEQ ID NO: 666021 - protein, 9 aa, Homo Sapiens
CETSDPFSK

SEQ ID NO: 666022 - protein, 9 aa, Homo Sapiens
STGVVTLRS

SEQ ID NO: 666023 - protein, 9 aa, Homo Sapiens
MYTSKDRNF

SEQ ID NO: 666024 - protein, 9 aa, Homo Sapiens
LGEAEGELA

SEQ ID NO: 666025 - protein, 9 aa, Homo Sapiens
VAHCVQLKN

SEQ ID NO: 666026 - protein, 9 aa, Homo Sapiens
GWKFSRSDE

SEQ ID NO: 666027 - protein, 9 aa, Homo Sapiens
CGWKFSRSD

SEQ ID NO: 666028 - protein, 9 aa, Homo Sapiens
HWGLLGQDE

SEQ ID NO: 666029 - protein, 9 aa, Homo Sapiens
GGVLFVALP

SEQ ID NO: 666030 - protein, 9 aa, Homo Sapiens
EVMHALRQS

SEQ ID NO: 666031 - protein, 9 aa, Homo Sapiens
IKLFNGDVL

SEQ ID NO: 666032 - protein, 9 aa, Homo Sapiens
QNRFLGDRD

SEQ ID NO: 666033 - protein, 9 aa, Homo Sapiens
GICAAESFV

SEQ ID NO: 666034 - protein, 9 aa, Homo Sapiens
AESFVLVAF

SEQ ID NO: 666035 - protein, 9 aa, Homo Sapiens
NDFDRLQAG

SEQ ID NO: 666036 - protein, 9 aa, Homo Sapiens
TRSLCRGIV

SEQ ID NO: 666037 - protein, 9 aa, Homo Sapiens
THYEDALKD

SEQ ID NO: 666038 - protein, 9 aa, Homo Sapiens
KEIRVANLH

SEQ ID NO: 666039 - protein, 9 aa, Homo Sapiens
ECCETSDPF

SEQ ID NO: 666040 - protein, 9 aa, Homo Sapiens
RLLITTNLS

SEQ ID NO: 666041 - protein, 9 aa, Homo Sapiens
QLSFKCNFS

SEQ ID NO: 666042 - protein, 9 aa, Homo Sapiens
QLDHRHLVE

SEQ ID NO: 666043 - protein, 9 aa, Homo Sapiens
TKPLNFNLD

SEQ ID NO: 666044 - protein, 9 aa, Homo Sapiens
PPPPSPRSV

SEQ ID NO: 666045 - protein, 9 aa, Homo Sapiens
FDQSLEIIE

SEQ ID NO: 666046 - protein, 9 aa, Homo Sapiens
LRRLSKESN

SEQ ID NO: 666047 - protein, 9 aa, Homo Sapiens
PTHYEDALK

SEQ ID NO: 666048 - protein, 9 aa, Homo Sapiens
FQIKPVELL

SEQ ID NO: 666049 - protein, 9 aa, Homo Sapiens
AVVVNNLVS

SEQ ID NO: 666050 - protein, 9 aa, Homo Sapiens
CATSLQERT

SEQ ID NO: 666051 - protein, 9 aa, Homo Sapiens
WSQTLAFRT

SEQ ID NO: 666052 - protein, 9 aa, Homo Sapiens
EPSSEEAVA

SEQ ID NO: 666053 - protein, 9 aa, Homo Sapiens
LSPQARNDF

SEQ ID NO: 666054 - protein, 9 aa, Homo Sapiens
LSLNSQLQQ

SEQ ID NO: 666055 - protein, 9 aa, Homo Sapiens
LQPHLVRES

SEQ ID NO: 666056 - protein, 9 aa, Homo Sapiens
VWFQNSRMK

SEQ ID NO: 666057 - protein, 9 aa, Homo Sapiens
KRKDGLKLN

SEQ ID NO: 666058 - protein, 9 aa, Homo Sapiens
ESMKPALAS

SEQ ID NO: 666059 - protein, 9 aa, Homo Sapiens
RIHGLVFGY

SEQ ID NO: 666060 - protein, 9 aa, Homo Sapiens
SFCLGALIH

SEQ ID NO: 666061 - protein, 9 aa, Homo Sapiens
CSSLTGASS

SEQ ID NO: 666062 - protein, 9 aa, Homo Sapiens
PHQPLEGQL

SEQ ID NO: 666063 - protein, 9 aa, Homo Sapiens
LSCGLPKKL

SEQ ID NO: 666064 - protein, 9 aa, Homo Sapiens
MEKLHQQIP

SEQ ID NO: 666065 - protein, 9 aa, Homo Sapiens
SPWSQTLAF

SEQ ID NO: 666066 - protein, 9 aa, Homo Sapiens
VRSYTACAT

SEQ ID NO: 666067 - protein, 9 aa, Homo Sapiens
GTSALELLR

SEQ ID NO: 666068 - protein, 9 aa, Homo Sapiens
HSCCVSSCC

SEQ ID NO: 666069 - protein, 9 aa, Homo Sapiens
PAPEVGSLP

SEQ ID NO: 666070 - protein, 9 aa, Homo Sapiens
LQSCSGMND

SEQ ID NO: 666071 - protein, 9 aa, Homo Sapiens
QLSPEENEC

SEQ ID NO: 666072 - protein, 9 aa, Homo Sapiens
DMEMVQAIA

SEQ ID NO: 666073 - protein, 9 aa, Homo Sapiens
CDATILSSS

SEQ ID NO: 666074 - protein, 9 aa, Homo Sapiens
NMSGWFLRR

SEQ ID NO: 666075 - protein, 9 aa, Homo Sapiens
SNKAVVVNN

SEQ ID NO: 666076 - protein, 9 aa, Homo Sapiens
ECWTRPPTP

SEQ ID NO: 666077 - protein, 9 aa, Homo Sapiens
EINRLPLPI

SEQ ID NO: 666078 - protein, 9 aa, Homo Sapiens
NQLLYPDIK

SEQ ID NO: 666079 - protein, 9 aa, Homo Sapiens
RRLSKESNN

SEQ ID NO: 666080 - protein, 9 aa, Homo Sapiens
LIPFLLVMC

SEQ ID NO: 666081 - protein, 9 aa, Homo Sapiens
SMQLPLVSD

SEQ ID NO: 666082 - protein, 9 aa, Homo Sapiens
KNIRKKQAK

SEQ ID NO: 666083 - protein, 9 aa, Homo Sapiens
VVKAYKEIR

SEQ ID NO: 666084 - protein, 9 aa, Homo Sapiens
RKASMVMLR

SEQ ID NO: 666085 - protein, 9 aa, Homo Sapiens
PGFIGSRVT

SEQ ID NO: 666086 - protein, 9 aa, Homo Sapiens
DTMTFKDCV

SEQ ID NO: 666087 - protein, 9 aa, Homo Sapiens
PPMYDEGKP

SEQ ID NO: 666088 - protein, 9 aa, Homo Sapiens
NEYGKSCKK

SEQ ID NO: 666089 - protein, 9 aa, Homo Sapiens
MHSINDTHF

SEQ ID NO: 666090 - protein, 9 aa, Homo Sapiens
RPWRALVVE

SEQ ID NO: 666091 - protein, 9 aa, Homo Sapiens
FTILDAHKG

SEQ ID NO: 666092 - protein, 9 aa, Homo Sapiens
TTCCRHSCC

SEQ ID NO: 666093 - protein, 9 aa, Homo Sapiens
DGIVRLLDP

SEQ ID NO: 666094 - protein, 9 aa, Homo Sapiens
ITFTTIGFG

SEQ ID NO: 666095 - protein, 9 aa, Homo Sapiens
HDGDSLSVD

SEQ ID NO: 666096 - protein, 9 aa, Homo Sapiens
DAFRRRWRR

SEQ ID NO: 666097 - protein, 9 aa, Homo Sapiens
KPEGLSPNQ

SEQ ID NO: 666098 - protein, 9 aa, Homo Sapiens
NAGNVGPFS

SEQ ID NO: 666099 - protein, 9 aa, Homo Sapiens
KKGEPLPLK

SEQ ID NO: 666100 - protein, 9 aa, Homo Sapiens
AEEKRLGST

SEQ ID NO: 666101 - protein, 9 aa, Homo Sapiens
FSLIGMLFA

SEQ ID NO: 666102 - protein, 9 aa, Homo Sapiens
LCEDCPSEL

SEQ ID NO: 666103 - protein, 9 aa, Homo Sapiens
LERQCLLRC

SEQ ID NO: 666104 - protein, 9 aa, Homo Sapiens
YQSFDFSVS

SEQ ID NO: 666105 - protein, 9 aa, Homo Sapiens
SRKAISCVK

SEQ ID NO: 666106 - protein, 9 aa, Homo Sapiens
NVSTFLAFD

SEQ ID NO: 666107 - protein, 9 aa, Homo Sapiens
LMKEVRVRN

SEQ ID NO: 666108 - protein, 9 aa, Homo Sapiens
PVIVSQPAL

SEQ ID NO: 666109 - protein, 9 aa, Homo Sapiens
LGHVTRSLC

SEQ ID NO: 666110 - protein, 9 aa, Homo Sapiens
NFREYNLHS

SEQ ID NO: 666111 - protein, 9 aa, Homo Sapiens
APEVGSLPG

SEQ ID NO: 666112 - protein, 9 aa, Homo Sapiens
SFRGQLFAG

SEQ ID NO: 666113 - protein, 9 aa, Homo Sapiens
MEQMIEQLQ

SEQ ID NO: 666114 - protein, 9 aa, Homo Sapiens
WDGWNGNAF

SEQ ID NO: 666115 - protein, 9 aa, Homo Sapiens
ALHAVPGSS

SEQ ID NO: 666116 - protein, 9 aa, Homo Sapiens
QFECRAGQK

SEQ ID NO: 666117 - protein, 9 aa, Homo Sapiens
PREPGVSAQ

SEQ ID NO: 666118 - protein, 9 aa, Homo Sapiens
FLVTNIVPM

SEQ ID NO: 666119 - protein, 9 aa, Homo Sapiens
SKTDASFHA

SEQ ID NO: 666120 - protein, 9 aa, Homo Sapiens
CAACVNLSG

SEQ ID NO: 666121 - protein, 9 aa, Homo Sapiens
NPVFYQSFD

SEQ ID NO: 666122 - protein, 9 aa, Homo Sapiens
VSIFQQTHQ

SEQ ID NO: 666123 - protein, 9 aa, Homo Sapiens
GLCLSLTPS

SEQ ID NO: 666124 - protein, 9 aa, Homo Sapiens
LHQQIPPRP

SEQ ID NO: 666125 - protein, 9 aa, Homo Sapiens
EPLNLFLSS

SEQ ID NO: 666126 - protein, 9 aa, Homo Sapiens
MIHQREQKE

SEQ ID NO: 666127 - protein, 9 aa, Homo Sapiens
FKIKPQFEC

SEQ ID NO: 666128 - protein, 9 aa, Homo Sapiens
AAVQCSLGM

SEQ ID NO: 666129 - protein, 9 aa, Homo Sapiens
MKPALASGP

SEQ ID NO: 666130 - protein, 9 aa, Homo Sapiens
LQPLSVGFV

SEQ ID NO: 666131 - protein, 9 aa, Homo Sapiens
IVKNIRKKQ

SEQ ID NO: 666132 - protein, 9 aa, Homo Sapiens
KHKSTSGGG

SEQ ID NO: 666133 - protein, 9 aa, Homo Sapiens
SLGMRTLQR

SEQ ID NO: 666134 - protein, 9 aa, Homo Sapiens
PKTVEAIKR

SEQ ID NO: 666135 - protein, 9 aa, Homo Sapiens
IVFFLSVMA

SEQ ID NO: 666136 - protein, 9 aa, Homo Sapiens
GQDEKTQGQ

SEQ ID NO: 666137 - protein, 9 aa, Homo Sapiens
VMFITKRGL

SEQ ID NO: 666138 - protein, 9 aa, Homo Sapiens
FSNQLSDYY

SEQ ID NO: 666139 - protein, 9 aa, Homo Sapiens
SVGFVEIRA

SEQ ID NO: 666140 - protein, 9 aa, Homo Sapiens
MAFLDHRVL

SEQ ID NO: 666141 - protein, 9 aa, Homo Sapiens
ELNIVKLYV

SEQ ID NO: 666142 - protein, 9 aa, Homo Sapiens
PAWQNSVRH

SEQ ID NO: 666143 - protein, 9 aa, Homo Sapiens
LSVGFVEIR

SEQ ID NO: 666144 - protein, 9 aa, Homo Sapiens
HQFAHDGLI

SEQ ID NO: 666145 - protein, 9 aa, Homo Sapiens
PALASGPKA

SEQ ID NO: 666146 - protein, 9 aa, Homo Sapiens
GADCFPYVQ

SEQ ID NO: 666147 - protein, 9 aa, Homo Sapiens
QGSAIPKAM

SEQ ID NO: 666148 - protein, 9 aa, Homo Sapiens
DEGKPVTGY

SEQ ID NO: 666149 - protein, 9 aa, Homo Sapiens
DTGTEPKPQ

SEQ ID NO: 666150 - protein, 9 aa, Homo Sapiens
LFTDFERKG

SEQ ID NO: 666151 - protein, 9 aa, Homo Sapiens
FITFTTIGF

SEQ ID NO: 666152 - protein, 9 aa, Homo Sapiens
ETSTNTVAN

SEQ ID NO: 666153 - protein, 9 aa, Homo Sapiens
SAAGPVSPS

SEQ ID NO: 666154 - protein, 9 aa, Homo Sapiens
CAFPTHYED

SEQ ID NO: 666155 - protein, 9 aa, Homo Sapiens
LTLANCVVS

SEQ ID NO: 666156 - protein, 9 aa, Homo Sapiens
LNQLGLPAS

SEQ ID NO: 666157 - protein, 9 aa, Homo Sapiens
QRTDGCALK

SEQ ID NO: 666158 - protein, 9 aa, Homo Sapiens
TGGFTSSLL

SEQ ID NO: 666159 - protein, 9 aa, Homo Sapiens
ANIRKQCKI

SEQ ID NO: 666160 - protein, 9 aa, Homo Sapiens
IRQAPPEIR

SEQ ID NO: 666161 - protein, 9 aa, Homo Sapiens
GPYCYYDKT

SEQ ID NO: 666162 - protein, 9 aa, Homo Sapiens
TGHRTLNVL

SEQ ID NO: 666163 - protein, 9 aa, Homo Sapiens
RTLNVLRDQ

SEQ ID NO: 666164 - protein, 9 aa, Homo Sapiens
MMVESGIET

SEQ ID NO: 666165 - protein, 9 aa, Homo Sapiens
PNVSDGIVR

SEQ ID NO: 666166 - protein, 9 aa, Homo Sapiens
LHAVPGSSP

SEQ ID NO: 666167 - protein, 9 aa, Homo Sapiens
AVAPLTITF

SEQ ID NO: 666168 - protein, 9 aa, Homo Sapiens
QSGETSKTD

SEQ ID NO: 666169 - protein, 9 aa, Homo Sapiens
GSSSISREE

SEQ ID NO: 666170 - protein, 9 aa, Homo Sapiens
ARELYDNCP

SEQ ID NO: 666171 - protein, 9 aa, Homo Sapiens
HAFGGTEMV

SEQ ID NO: 666172 - protein, 9 aa, Homo Sapiens
TVHSLWQTF

SEQ ID NO: 666173 - protein, 9 aa, Homo Sapiens
DPSHFLYWS

SEQ ID NO: 666174 - protein, 9 aa, Homo Sapiens
LVTYELHGD

SEQ ID NO: 666175 - protein, 9 aa, Homo Sapiens
HGQVTATSW

SEQ ID NO: 666176 - protein, 9 aa, Homo Sapiens
DEKNGKKDS

SEQ ID NO: 666177 - protein, 9 aa, Homo Sapiens
SVAAHELGH

SEQ ID NO: 666178 - protein, 9 aa, Homo Sapiens
VKVWFQNSR

SEQ ID NO: 666179 - protein, 9 aa, Homo Sapiens
EFQESGEYR

SEQ ID NO: 666180 - protein, 9 aa, Homo Sapiens
ESIHRFSLL

SEQ ID NO: 666181 - protein, 9 aa, Homo Sapiens
SPLKMSKIK

SEQ ID NO: 666182 - protein, 9 aa, Homo Sapiens
APSQMAYPT

SEQ ID NO: 666183 - protein, 9 aa, Homo Sapiens
VSACDATIL

SEQ ID NO: 666184 - protein, 9 aa, Homo Sapiens
IFWPRGTVG

SEQ ID NO: 666185 - protein, 9 aa, Homo Sapiens
KKFRRDFFI

SEQ ID NO: 666186 - protein, 9 aa, Homo Sapiens
LQRTDGCAL

SEQ ID NO: 666187 - protein, 9 aa, Homo Sapiens
EKYKYLLEC

SEQ ID NO: 666188 - protein, 9 aa, Homo Sapiens
GFTSSLLGY

SEQ ID NO: 666189 - protein, 9 aa, Homo Sapiens
MAPSQMAYP

SEQ ID NO: 666190 - protein, 9 aa, Homo Sapiens
IKPVELLEN

SEQ ID NO: 666191 - protein, 9 aa, Homo Sapiens
ISEYKAIMR

SEQ ID NO: 666192 - protein, 9 aa, Homo Sapiens
EYNLHSVAA

SEQ ID NO: 666193 - protein, 9 aa, Homo Sapiens
KSWGLTLLC

SEQ ID NO: 666194 - protein, 9 aa, Homo Sapiens
LTRKGRGRK

SEQ ID NO: 666195 - protein, 9 aa, Homo Sapiens
FLYFRPSSS

SEQ ID NO: 666196 - protein, 9 aa, Homo Sapiens
LGAAGRGRE

SEQ ID NO: 666197 - protein, 9 aa, Homo Sapiens
TDGCALKPQ

SEQ ID NO: 666198 - protein, 9 aa, Homo Sapiens
YVALHAVPG

SEQ ID NO: 666199 - protein, 9 aa, Homo Sapiens
NECLKGKIM

SEQ ID NO: 666200 - protein, 9 aa, Homo Sapiens
LCRHWGRQL

SEQ ID NO: 666201 - protein, 9 aa, Homo Sapiens
RYLAIYRPL

SEQ ID NO: 666202 - protein, 9 aa, Homo Sapiens
RDQYRFRRC

SEQ ID NO: 666203 - protein, 9 aa, Homo Sapiens
RRLRGGSGY

SEQ ID NO: 666204 - protein, 9 aa, Homo Sapiens
NILRFSKFL

SEQ ID NO: 666205 - protein, 9 aa, Homo Sapiens
LNKRSTHWN

SEQ ID NO: 666206 - protein, 9 aa, Homo Sapiens
AFPGSFRGQ

SEQ ID NO: 666207 - protein, 9 aa, Homo Sapiens
PAGRGGAFP

SEQ ID NO: 666208 - protein, 9 aa, Homo Sapiens
KVLLVKKKE

SEQ ID NO: 666209 - protein, 9 aa, Homo Sapiens
CEDCPSELR

SEQ ID NO: 666210 - protein, 9 aa, Homo Sapiens
HELRPWRAL

SEQ ID NO: 666211 - protein, 9 aa, Homo Sapiens
DEGKCEKGL

SEQ ID NO: 666212 - protein, 9 aa, Homo Sapiens
LCDCHLHCE

SEQ ID NO: 666213 - protein, 9 aa, Homo Sapiens
SLPYACRRC

SEQ ID NO: 666214 - protein, 9 aa, Homo Sapiens
MVMLRAFLS

SEQ ID NO: 666215 - protein, 9 aa, Homo Sapiens
STIDSSSVM

SEQ ID NO: 666216 - protein, 9 aa, Homo Sapiens
KGKKDEKNG

SEQ ID NO: 666217 - protein, 9 aa, Homo Sapiens
ITPQENSDG

SEQ ID NO: 666218 - protein, 9 aa, Homo Sapiens
QSCSGMNDP

SEQ ID NO: 666219 - protein, 9 aa, Homo Sapiens
RGSKRLSSS

SEQ ID NO: 666220 - protein, 9 aa, Homo Sapiens
PNPHVGDVS

SEQ ID NO: 666221 - protein, 9 aa, Homo Sapiens
AHDGLICQD

SEQ ID NO: 666222 - protein, 9 aa, Homo Sapiens
LRFSKFLVH

SEQ ID NO: 666223 - protein, 9 aa, Homo Sapiens
KAEEAHQHK

SEQ ID NO: 666224 - protein, 9 aa, Homo Sapiens
LHLLFSLIG

SEQ ID NO: 666225 - protein, 9 aa, Homo Sapiens
LTLLCALVV

SEQ ID NO: 666226 - protein, 9 aa, Homo Sapiens
IRVANLHFP

SEQ ID NO: 666227 - protein, 9 aa, Homo Sapiens
FAAVCTRAA

SEQ ID NO: 666228 - protein, 9 aa, Homo Sapiens
EPLVTYELH

SEQ ID NO: 666229 - protein, 9 aa, Homo Sapiens
PENRNLWEN

SEQ ID NO: 666230 - protein, 9 aa, Homo Sapiens
HLAPALDVD

SEQ ID NO: 666231 - protein, 9 aa, Homo Sapiens
PYACRRCCP

SEQ ID NO: 666232 - protein, 9 aa, Homo Sapiens
SRHLTTRCP

SEQ ID NO: 666233 - protein, 9 aa, Homo Sapiens
FHLAPALDV

SEQ ID NO: 666234 - protein, 9 aa, Homo Sapiens
SIFQQTHQV

SEQ ID NO: 666235 - protein, 9 aa, Homo Sapiens
EGAEPREPA

SEQ ID NO: 666236 - protein, 9 aa, Homo Sapiens
ARGALEHDC

SEQ ID NO: 666237 - protein, 9 aa, Homo Sapiens
LKLVSNMVA

SEQ ID NO: 666238 - protein, 9 aa, Homo Sapiens
SVGPAGPEA

SEQ ID NO: 666239 - protein, 9 aa, Homo Sapiens
FGGVLFVAL

SEQ ID NO: 666240 - protein, 9 aa, Homo Sapiens
QLGRLLITT

SEQ ID NO: 666241 - protein, 9 aa, Homo Sapiens
LRVLDINEA

SEQ ID NO: 666242 - protein, 9 aa, Homo Sapiens
VQAREALVH

SEQ ID NO: 666243 - protein, 9 aa, Homo Sapiens
KNGKKDSKK

SEQ ID NO: 666244 - protein, 9 aa, Homo Sapiens
LRICRPGSV

SEQ ID NO: 666245 - protein, 9 aa, Homo Sapiens
ACVNLSGWR

SEQ ID NO: 666246 - protein, 9 aa, Homo Sapiens
QFAHDGLIC

SEQ ID NO: 666247 - protein, 9 aa, Homo Sapiens
NQNRFLGDR

SEQ ID NO: 666248 - protein, 9 aa, Homo Sapiens
PTSDEGKCE

SEQ ID NO: 666249 - protein, 9 aa, Homo Sapiens
ILRFSKFLV

SEQ ID NO: 666250 - protein, 9 aa, Homo Sapiens
VDITPQENS

SEQ ID NO: 666251 - protein, 9 aa, Homo Sapiens
SMCRHYMPA

SEQ ID NO: 666252 - protein, 9 aa, Homo Sapiens
TEFAYGTVS

SEQ ID NO: 666253 - protein, 9 aa, Homo Sapiens
KPQVSVEIL

SEQ ID NO: 666254 - protein, 9 aa, Homo Sapiens
LFGKSTIDS

SEQ ID NO: 666255 - protein, 9 aa, Homo Sapiens
SNSAGSTNY

SEQ ID NO: 666256 - protein, 9 aa, Homo Sapiens
QVSIFQQTH

SEQ ID NO: 666257 - protein, 9 aa, Homo Sapiens
LRRAKQLLL

SEQ ID NO: 666258 - protein, 9 aa, Homo Sapiens
FCKCEECGK

SEQ ID NO: 666259 - protein, 9 aa, Homo Sapiens
TPELIISSL

SEQ ID NO: 666260 - protein, 9 aa, Homo Sapiens
AFEIWLGSE

SEQ ID NO: 666261 - protein, 9 aa, Homo Sapiens
QSAVETNPL

SEQ ID NO: 666262 - protein, 9 aa, Homo Sapiens
DIYEKYQYL

SEQ ID NO: 666263 - protein, 9 aa, Homo Sapiens
YPLQNGYAP

SEQ ID NO: 666264 - protein, 9 aa, Homo Sapiens
SISWAPSPR

SEQ ID NO: 666265 - protein, 9 aa, Homo Sapiens
VLAVLMALL

SEQ ID NO: 666266 - protein, 9 aa, Homo Sapiens
QVKVWFQNS

SEQ ID NO: 666267 - protein, 9 aa, Homo Sapiens
FNSVKWGQQ

SEQ ID NO: 666268 - protein, 9 aa, Homo Sapiens
VRVRNQTEV

SEQ ID NO: 666269 - protein, 9 aa, Homo Sapiens
RFASLLQRT

SEQ ID NO: 666270 - protein, 9 aa, Homo Sapiens
DNTPELIIS

SEQ ID NO: 666271 - protein, 9 aa, Homo Sapiens
DHRVLRHSS

SEQ ID NO: 666272 - protein, 9 aa, Homo Sapiens
LPYACRRCC

SEQ ID NO: 666273 - protein, 9 aa, Homo Sapiens
ANARALVRN

SEQ ID NO: 666274 - protein, 9 aa, Homo Sapiens
LWCAACVNL

SEQ ID NO: 666275 - protein, 9 aa, Homo Sapiens
SAHTGEKHY

SEQ ID NO: 666276 - protein, 9 aa, Homo Sapiens
SFLCLTRKG

SEQ ID NO: 666277 - protein, 9 aa, Homo Sapiens
LAIRNNEEL

SEQ ID NO: 666278 - protein, 9 aa, Homo Sapiens
AIRNNEELN

SEQ ID NO: 666279 - protein, 9 aa, Homo Sapiens
PLPAIAGAS

SEQ ID NO: 666280 - protein, 9 aa, Homo Sapiens
EHCLCRHWG

SEQ ID NO: 666281 - protein, 9 aa, Homo Sapiens
LPVDKGHRG

SEQ ID NO: 666282 - protein, 9 aa, Homo Sapiens
LSPNQNRFL

SEQ ID NO: 666283 - protein, 9 aa, Homo Sapiens
LGLPASEEK

SEQ ID NO: 666284 - protein, 9 aa, Homo Sapiens
EEAHQHKCP

SEQ ID NO: 666285 - protein, 9 aa, Homo Sapiens
SRSRVTRRL

SEQ ID NO: 666286 - protein, 9 aa, Homo Sapiens
IMCEKPNNH

SEQ ID NO: 666287 - protein, 9 aa, Homo Sapiens
LPASEEKSP

SEQ ID NO: 666288 - protein, 9 aa, Homo Sapiens
RTTCCRHSC

SEQ ID NO: 666289 - protein, 9 aa, Homo Sapiens
NCQSSGRKP

SEQ ID NO: 666290 - protein, 9 aa, Homo Sapiens
LSLGHVTRS

SEQ ID NO: 666291 - protein, 9 aa, Homo Sapiens
PRCFRCPRK

SEQ ID NO: 666292 - protein, 9 aa, Homo Sapiens
LPPPSSPSE

SEQ ID NO: 666293 - protein, 9 aa, Homo Sapiens
IRNNEELNK

SEQ ID NO: 666294 - protein, 9 aa, Homo Sapiens
ISAVSSALP

SEQ ID NO: 666295 - protein, 9 aa, Homo Sapiens
MCVRHLITC

SEQ ID NO: 666296 - protein, 9 aa, Homo Sapiens
ILRDLPHQP

SEQ ID NO: 666297 - protein, 9 aa, Homo Sapiens
LEAFLTQNQ

SEQ ID NO: 666298 - protein, 9 aa, Homo Sapiens
KDTATLSCG

SEQ ID NO: 666299 - protein, 9 aa, Homo Sapiens
RHLTTRCPS

SEQ ID NO: 666300 - protein, 9 aa, Homo Sapiens
SSKKPPVSH

SEQ ID NO: 666301 - protein, 9 aa, Homo Sapiens
SKTKGSFVN

SEQ ID NO: 666302 - protein, 9 aa, Homo Sapiens
TDLSMCVRH

SEQ ID NO: 666303 - protein, 9 aa, Homo Sapiens
TRPPTPPAT

SEQ ID NO: 666304 - protein, 9 aa, Homo Sapiens
LDEDKDAEG

SEQ ID NO: 666305 - protein, 9 aa, Homo Sapiens
LRPPRCFRC

SEQ ID NO: 666306 - protein, 9 aa, Homo Sapiens
HKSTSGGGG

SEQ ID NO: 666307 - protein, 9 aa, Homo Sapiens
RVTRRLRGG

SEQ ID NO: 666308 - protein, 9 aa, Homo Sapiens
SRSSSRGRF

SEQ ID NO: 666309 - protein, 9 aa, Homo Sapiens
EAEGELAVI

SEQ ID NO: 666310 - protein, 9 aa, Homo Sapiens
KESNNLDQS

SEQ ID NO: 666311 - protein, 9 aa, Homo Sapiens
KDEGPVAQQ

SEQ ID NO: 666312 - protein, 9 aa, Homo Sapiens
AVAQLPVQP

SEQ ID NO: 666313 - protein, 9 aa, Homo Sapiens
SKIKLPSFR

SEQ ID NO: 666314 - protein, 9 aa, Homo Sapiens
GRGSKRLSS

SEQ ID NO: 666315 - protein, 9 aa, Homo Sapiens
ETGAPASAL

SEQ ID NO: 666316 - protein, 9 aa, Homo Sapiens
FQKELERQC

SEQ ID NO: 666317 - protein, 9 aa, Homo Sapiens
RSSSRGRFA

SEQ ID NO: 666318 - protein, 9 aa, Homo Sapiens
AQFLSCASP

SEQ ID NO: 666319 - protein, 9 aa, Homo Sapiens
QFPFHLAPA

SEQ ID NO: 666320 - protein, 9 aa, Homo Sapiens
MKEVRVRNQ

SEQ ID NO: 666321 - protein, 9 aa, Homo Sapiens
NLQKLNVIH

SEQ ID NO: 666322 - protein, 9 aa, Homo Sapiens
FQGTLLFLY

SEQ ID NO: 666323 - protein, 9 aa, Homo Sapiens
LDHRVLRHS

SEQ ID NO: 666324 - protein, 9 aa, Homo Sapiens
MQRLAKNMS

SEQ ID NO: 666325 - protein, 9 aa, Homo Sapiens
TDFERKGLL

SEQ ID NO: 666326 - protein, 9 aa, Homo Sapiens
HSLLSQDQA

SEQ ID NO: 666327 - protein, 9 aa, Homo Sapiens
AASSKKPPV

SEQ ID NO: 666328 - protein, 9 aa, Homo Sapiens
IKPQFECRA

SEQ ID NO: 666329 - protein, 9 aa, Homo Sapiens
KCSSKLTVH

SEQ ID NO: 666330 - protein, 9 aa, Homo Sapiens
EMEQMIEQL

SEQ ID NO: 666331 - protein, 9 aa, Homo Sapiens
DNILEFQES

SEQ ID NO: 666332 - protein, 9 aa, Homo Sapiens
LFGGVLFVA

SEQ ID NO: 666333 - protein, 9 aa, Homo Sapiens
YKRYLAGKQ

SEQ ID NO: 666334 - protein, 9 aa, Homo Sapiens
KPHLTWWKI

SEQ ID NO: 666335 - protein, 9 aa, Homo Sapiens
PVTLETKPL

SEQ ID NO: 666336 - protein, 9 aa, Homo Sapiens
VSGICAAES

SEQ ID NO: 666337 - protein, 9 aa, Homo Sapiens
SLLQSCSGM

SEQ ID NO: 666338 - protein, 9 aa, Homo Sapiens
PASALLSGA

SEQ ID NO: 666339 - protein, 9 aa, Homo Sapiens
VGFVEIRAR

SEQ ID NO: 666340 - protein, 9 aa, Homo Sapiens
FTKKFRRDF

SEQ ID NO: 666341 - protein, 9 aa, Homo Sapiens
EHDCCQDFI

SEQ ID NO: 666342 - protein, 9 aa, Homo Sapiens
WGLTLLCAL

SEQ ID NO: 666343 - protein, 9 aa, Homo Sapiens
DMRVRNESF

SEQ ID NO: 666344 - protein, 9 aa, Homo Sapiens
RSLCRGIVQ

SEQ ID NO: 666345 - protein, 9 aa, Homo Sapiens
VISVTSGTL

SEQ ID NO: 666346 - protein, 9 aa, Homo Sapiens
EGPVAQQVK

SEQ ID NO: 666347 - protein, 9 aa, Homo Sapiens
PFSLLCEAS

SEQ ID NO: 666348 - protein, 9 aa, Homo Sapiens
TKKFRRDFF

SEQ ID NO: 666349 - protein, 9 aa, Homo Sapiens
QSQSIPGRK

SEQ ID NO: 666350 - protein, 9 aa, Homo Sapiens
SRSQEELRK

SEQ ID NO: 666351 - protein, 9 aa, Homo Sapiens
VEPAARGST

SEQ ID NO: 666352 - protein, 9 aa, Homo Sapiens
SLESLDPAG

SEQ ID NO: 666353 - protein, 9 aa, Homo Sapiens
LFSLIGMLF

SEQ ID NO: 666354 - protein, 9 aa, Homo Sapiens
PFVQEKIPS

SEQ ID NO: 666355 - protein, 9 aa, Homo Sapiens
CEAKNGYKS

SEQ ID NO: 666356 - protein, 9 aa, Homo Sapiens
VSVEILRDL

SEQ ID NO: 666357 - protein, 9 aa, Homo Sapiens
GGQKQRIAN

SEQ ID NO: 666358 - protein, 9 aa, Homo Sapiens
CNFSNTFSS

SEQ ID NO: 666359 - protein, 9 aa, Homo Sapiens
SRMKWKRVK

SEQ ID NO: 666360 - protein, 9 aa, Homo Sapiens
ASTTHQEKP

SEQ ID NO: 666361 - protein, 9 aa, Homo Sapiens
YECSSYSGH

SEQ ID NO: 666362 - protein, 9 aa, Homo Sapiens
QEQVHSLLS

SEQ ID NO: 666363 - protein, 9 aa, Homo Sapiens
PGSQLNTTL

SEQ ID NO: 666364 - protein, 9 aa, Homo Sapiens
IFYECSSYS

SEQ ID NO: 666365 - protein, 9 aa, Homo Sapiens
GAFPGSFRG

SEQ ID NO: 666366 - protein, 9 aa, Homo Sapiens
LLQSCSGMN

SEQ ID NO: 666367 - protein, 9 aa, Homo Sapiens
TILSSSRSL

SEQ ID NO: 666368 - protein, 9 aa, Homo Sapiens
SRRRSRSSS

SEQ ID NO: 666369 - protein, 9 aa, Homo Sapiens
CLPKDYKVI

SEQ ID NO: 666370 - protein, 9 aa, Homo Sapiens
APQSLCAFY

SEQ ID NO: 666371 - protein, 9 aa, Homo Sapiens
SDSKKKYFR

SEQ ID NO: 666372 - protein, 9 aa, Homo Sapiens
VSSVLFVSQ

SEQ ID NO: 666373 - protein, 9 aa, Homo Sapiens
RKGRGRKCS

SEQ ID NO: 666374 - protein, 9 aa, Homo Sapiens
YCRMANFAA

SEQ ID NO: 666375 - protein, 9 aa, Homo Sapiens
PNQNRFLGD

SEQ ID NO: 666376 - protein, 9 aa, Homo Sapiens
CLGALIHNV

SEQ ID NO: 666377 - protein, 9 aa, Homo Sapiens
QNITLTVGT

SEQ ID NO: 666378 - protein, 9 aa, Homo Sapiens
RPAPEVGSL

SEQ ID NO: 666379 - protein, 9 aa, Homo Sapiens
ISLGEAEGE

SEQ ID NO: 666380 - protein, 9 aa, Homo Sapiens
SSRASVGPA

SEQ ID NO: 666381 - protein, 9 aa, Homo Sapiens
YGRLAFSQR

SEQ ID NO: 666382 - protein, 9 aa, Homo Sapiens
GEKLNELKQ

SEQ ID NO: 666383 - protein, 9 aa, Homo Sapiens
IMEKLHQQI

SEQ ID NO: 666384 - protein, 9 aa, Homo Sapiens
DSFRKGPNY

SEQ ID NO: 666385 - protein, 9 aa, Homo Sapiens
IENTLIRRL

SEQ ID NO: 666386 - protein, 9 aa, Homo Sapiens
ERFSAKQFP

SEQ ID NO: 666387 - protein, 9 aa, Homo Sapiens
ALPFSLLCE

SEQ ID NO: 666388 - protein, 9 aa, Homo Sapiens
EITWHKDWQ

SEQ ID NO: 666389 - protein, 9 aa, Homo Sapiens
LVFGYDTDQ

SEQ ID NO: 666390 - protein, 9 aa, Homo Sapiens
REESVTVTM

SEQ ID NO: 666391 - protein, 9 aa, Homo Sapiens
KLRRAKQLL

SEQ ID NO: 666392 - protein, 9 aa, Homo Sapiens
SAKRQVLNA

SEQ ID NO: 666393 - protein, 9 aa, Homo Sapiens
YRPLHYPTL

SEQ ID NO: 666394 - protein, 9 aa, Homo Sapiens
ALRQSWHTT

SEQ ID NO: 666395 - protein, 9 aa, Homo Sapiens
SEYKAIMRN

SEQ ID NO: 666396 - protein, 9 aa, Homo Sapiens
HYQIAHLEE

SEQ ID NO: 666397 - protein, 9 aa, Homo Sapiens
NGAITPGSQ

SEQ ID NO: 666398 - protein, 9 aa, Homo Sapiens
SCNGQCMEW

SEQ ID NO: 666399 - protein, 9 aa, Homo Sapiens
PAGPEAALV

SEQ ID NO: 666400 - protein, 9 aa, Homo Sapiens
GSLRAVMFI

SEQ ID NO: 666401 - protein, 9 aa, Homo Sapiens
TNYWELKNK

SEQ ID NO: 666402 - protein, 9 aa, Homo Sapiens
QSFWQSAVE

SEQ ID NO: 666403 - protein, 9 aa, Homo Sapiens
VDGTQVSIF

SEQ ID NO: 666404 - protein, 9 aa, Homo Sapiens
GLTLLCALV

SEQ ID NO: 666405 - protein, 9 aa, Homo Sapiens
LWPDPSHFL

SEQ ID NO: 666406 - protein, 9 aa, Homo Sapiens
HSLWQTFLT

SEQ ID NO: 666407 - protein, 9 aa, Homo Sapiens
YPKLFNSVK

SEQ ID NO: 666408 - protein, 9 aa, Homo Sapiens
STVSWDPVR

SEQ ID NO: 666409 - protein, 9 aa, Homo Sapiens
WGEESSVSS

SEQ ID NO: 666410 - protein, 9 aa, Homo Sapiens
KKGKKDEKN

SEQ ID NO: 666411 - protein, 9 aa, Homo Sapiens
LSVPNVSDG

SEQ ID NO: 666412 - protein, 9 aa, Homo Sapiens
PSQILLLSN

SEQ ID NO: 666413 - protein, 9 aa, Homo Sapiens
QEKPLVTEG

SEQ ID NO: 666414 - protein, 9 aa, Homo Sapiens
FPEWDGLIF

SEQ ID NO: 666415 - protein, 9 aa, Homo Sapiens
LTLLPRLDG

SEQ ID NO: 666416 - protein, 9 aa, Homo Sapiens
TTPGLSSKS

SEQ ID NO: 666417 - protein, 9 aa, Homo Sapiens
YAIFTKKFR

SEQ ID NO: 666418 - protein, 9 aa, Homo Sapiens
RTDGCALKP

SEQ ID NO: 666419 - protein, 9 aa, Homo Sapiens
LLQRTDGCA

SEQ ID NO: 666420 - protein, 9 aa, Homo Sapiens
SSLESNTSD

SEQ ID NO: 666421 - protein, 9 aa, Homo Sapiens
SLSVDGTQV

SEQ ID NO: 666422 - protein, 9 aa, Homo Sapiens
IAQDLLPLH

SEQ ID NO: 666423 - protein, 9 aa, Homo Sapiens
QRLAISHYQ

SEQ ID NO: 666424 - protein, 9 aa, Homo Sapiens
SPQPLFPYG

SEQ ID NO: 666425 - protein, 9 aa, Homo Sapiens
EKRLGSTAP

SEQ ID NO: 666426 - protein, 9 aa, Homo Sapiens
FPAWQNSVR

SEQ ID NO: 666427 - protein, 9 aa, Homo Sapiens
RKKTVKEVP

SEQ ID NO: 666428 - protein, 9 aa, Homo Sapiens
TPAVQPQHR

SEQ ID NO: 666429 - protein, 9 aa, Homo Sapiens
HGSNLQNCI

SEQ ID NO: 666430 - protein, 9 aa, Homo Sapiens
PKEMEEFVL

SEQ ID NO: 666431 - protein, 9 aa, Homo Sapiens
DCCQDFIYH

SEQ ID NO: 666432 - protein, 9 aa, Homo Sapiens
LLGYGPFSF

SEQ ID NO: 666433 - protein, 9 aa, Homo Sapiens
AGPVSPSWC

SEQ ID NO: 666434 - protein, 9 aa, Homo Sapiens
ALTLANCVV

SEQ ID NO: 666435 - protein, 9 aa, Homo Sapiens
CRFRAIVSS

SEQ ID NO: 666436 - protein, 9 aa, Homo Sapiens
GALEHDCCQ

SEQ ID NO: 666437 - protein, 9 aa, Homo Sapiens
WSPWSQTLA

SEQ ID NO: 666438 - protein, 9 aa, Homo Sapiens
SPHQAGLCL

SEQ ID NO: 666439 - protein, 9 aa, Homo Sapiens
VSCLAPSNC

SEQ ID NO: 666440 - protein, 9 aa, Homo Sapiens
AAPCLVLPE

SEQ ID NO: 666441 - protein, 9 aa, Homo Sapiens
LNRARKYFV

SEQ ID NO: 666442 - protein, 9 aa, Homo Sapiens
NARITGNSP

SEQ ID NO: 666443 - protein, 9 aa, Homo Sapiens
GLLGQDEKT

SEQ ID NO: 666444 - protein, 9 aa, Homo Sapiens
HCLCRHWGR

SEQ ID NO: 666445 - protein, 9 aa, Homo Sapiens
SSSTALLLQ

SEQ ID NO: 666446 - protein, 9 aa, Homo Sapiens
IANCIEDMD

SEQ ID NO: 666447 - protein, 9 aa, Homo Sapiens
QNSRMKWKR

SEQ ID NO: 666448 - protein, 9 aa, Homo Sapiens
PVDKGHRGE

SEQ ID NO: 666449 - protein, 9 aa, Homo Sapiens
EQACMARLA

SEQ ID NO: 666450 - protein, 9 aa, Homo Sapiens
NCDDMEKIW

SEQ ID NO: 666451 - protein, 9 aa, Homo Sapiens
PLQNLQATL

SEQ ID NO: 666452 - protein, 9 aa, Homo Sapiens
FVEIRARLL

SEQ ID NO: 666453 - protein, 9 aa, Homo Sapiens
EWTVLQAVR

SEQ ID NO: 666454 - protein, 9 aa, Homo Sapiens
TLCTYISLI

SEQ ID NO: 666455 - protein, 9 aa, Homo Sapiens
MAPKRKDGL

SEQ ID NO: 666456 - protein, 9 aa, Homo Sapiens
TLSVPNVSD

SEQ ID NO: 666457 - protein, 9 aa, Homo Sapiens
LQKWYTYYA

SEQ ID NO: 666458 - protein, 9 aa, Homo Sapiens
ICLRELDLA

SEQ ID NO: 666459 - protein, 9 aa, Homo Sapiens
KLNVIHNKL

SEQ ID NO: 666460 - protein, 9 aa, Homo Sapiens
WQSAVETNP

SEQ ID NO: 666461 - protein, 9 aa, Homo Sapiens
PYEPPDVGS

SEQ ID NO: 666462 - protein, 9 aa, Homo Sapiens
LNDTMTFKD

SEQ ID NO: 666463 - protein, 9 aa, Homo Sapiens
PSKGSVTLT

SEQ ID NO: 666464 - protein, 9 aa, Homo Sapiens
ETTGHRTLN

SEQ ID NO: 666465 - protein, 9 aa, Homo Sapiens
VFGRCYLAL

SEQ ID NO: 666466 - protein, 9 aa, Homo Sapiens
NSVKWGQQE

SEQ ID NO: 666467 - protein, 9 aa, Homo Sapiens
AGLCLSLTP

SEQ ID NO: 666468 - protein, 9 aa, Homo Sapiens
IPRTMNCME

SEQ ID NO: 666469 - protein, 9 aa, Homo Sapiens
GAAPCLVLP

SEQ ID NO: 666470 - protein, 9 aa, Homo Sapiens
HRTLNVLRD

SEQ ID NO: 666471 - protein, 9 aa, Homo Sapiens
RLARLVISV

SEQ ID NO: 666472 - protein, 9 aa, Homo Sapiens
SYLSKHQKT

SEQ ID NO: 666473 - protein, 9 aa, Homo Sapiens
VTRSLCRGI

SEQ ID NO: 666474 - protein, 9 aa, Homo Sapiens
TQAMFMAPS

SEQ ID NO: 666475 - protein, 9 aa, Homo Sapiens
DELSFCLGA

SEQ ID NO: 666476 - protein, 9 aa, Homo Sapiens
TATLSCGLP

SEQ ID NO: 666477 - protein, 9 aa, Homo Sapiens
CPNLCSCNG

SEQ ID NO: 666478 - protein, 9 aa, Homo Sapiens
WDGLIFWPR

SEQ ID NO: 666479 - protein, 9 aa, Homo Sapiens
AVETNPLIG

SEQ ID NO: 666480 - protein, 9 aa, Homo Sapiens
EEKRLGSTA

SEQ ID NO: 666481 - protein, 9 aa, Homo Sapiens
IQEQMKKGY

SEQ ID NO: 666482 - protein, 9 aa, Homo Sapiens
SHYQIAHLE

SEQ ID NO: 666483 - protein, 9 aa, Homo Sapiens
AAEEPSSEE

SEQ ID NO: 666484 - protein, 9 aa, Homo Sapiens
CALQVLGMR

SEQ ID NO: 666485 - protein, 9 aa, Homo Sapiens
RFSAKQFPD

SEQ ID NO: 666486 - protein, 9 aa, Homo Sapiens
TATPCSLPY

SEQ ID NO: 666487 - protein, 9 aa, Homo Sapiens
RQQEPLCED

SEQ ID NO: 666488 - protein, 9 aa, Homo Sapiens
LSVDGTQVS

SEQ ID NO: 666489 - protein, 9 aa, Homo Sapiens
VHLDRMRLH

SEQ ID NO: 666490 - protein, 9 aa, Homo Sapiens
FGGTEMVLL

SEQ ID NO: 666491 - protein, 9 aa, Homo Sapiens
EGRAKPHLT

SEQ ID NO: 666492 - protein, 9 aa, Homo Sapiens
QDLLPLHKA

SEQ ID NO: 666493 - protein, 9 aa, Homo Sapiens
QFLSCASPF

SEQ ID NO: 666494 - protein, 9 aa, Homo Sapiens
LVISVTSGT

SEQ ID NO: 666495 - protein, 9 aa, Homo Sapiens
VSDGIVRLL

SEQ ID NO: 666496 - protein, 9 aa, Homo Sapiens
AQPESEDVI

SEQ ID NO: 666497 - protein, 9 aa, Homo Sapiens
KAMQKLVVT

SEQ ID NO: 666498 - protein, 9 aa, Homo Sapiens
HLVRESPPH

SEQ ID NO: 666499 - protein, 9 aa, Homo Sapiens
ETPDNILEF

SEQ ID NO: 666500 - protein, 9 aa, Homo Sapiens
KSDAKGVKT

SEQ ID NO: 666501 - protein, 9 aa, Homo Sapiens
KGYNPTGLL

SEQ ID NO: 666502 - protein, 9 aa, Homo Sapiens
RASVGPAGP

SEQ ID NO: 666503 - protein, 9 aa, Homo Sapiens
SEMCREEGE

SEQ ID NO: 666504 - protein, 9 aa, Homo Sapiens
ATFRENAVT

SEQ ID NO: 666505 - protein, 9 aa, Homo Sapiens
FVGIALVEK

SEQ ID NO: 666506 - protein, 9 aa, Homo Sapiens
SQSIPGRKR

SEQ ID NO: 666507 - protein, 9 aa, Homo Sapiens
EALKQWSLN

SEQ ID NO: 666508 - protein, 9 aa, Homo Sapiens
ISISWAPSP

SEQ ID NO: 666509 - protein, 9 aa, Homo Sapiens
SLLQPLPAI

SEQ ID NO: 666510 - protein, 9 aa, Homo Sapiens
LVQHVFAAV

SEQ ID NO: 666511 - protein, 9 aa, Homo Sapiens
DNMAFGMPA

SEQ ID NO: 666512 - protein, 9 aa, Homo Sapiens
ETSKTDASF

SEQ ID NO: 666513 - protein, 9 aa, Homo Sapiens
GHDGDSLSV

SEQ ID NO: 666514 - protein, 9 aa, Homo Sapiens
FTDFERKGL

SEQ ID NO: 666515 - protein, 9 aa, Homo Sapiens
NTPELIISS

SEQ ID NO: 666516 - protein, 9 aa, Homo Sapiens
LEFQESGEY

SEQ ID NO: 666517 - protein, 9 aa, Homo Sapiens
YTDALTPSS

SEQ ID NO: 666518 - protein, 9 aa, Homo Sapiens
QLGLPASEE

SEQ ID NO: 666519 - protein, 9 aa, Homo Sapiens
CRAGQKLMD

SEQ ID NO: 666520 - protein, 9 aa, Homo Sapiens
SHLGCCLPK

SEQ ID NO: 666521 - protein, 9 aa, Homo Sapiens
ECSEFCKLV

SEQ ID NO: 666522 - protein, 9 aa, Homo Sapiens
SLRDQYRFR

SEQ ID NO: 666523 - protein, 9 aa, Homo Sapiens
CSMCRHYMP

SEQ ID NO: 666524 - protein, 9 aa, Homo Sapiens
TFTTIGFGD

SEQ ID NO: 666525 - protein, 9 aa, Homo Sapiens
EQKERQKEE

SEQ ID NO: 666526 - protein, 9 aa, Homo Sapiens
SVPNVSDGI

SEQ ID NO: 666527 - protein, 9 aa, Homo Sapiens
VKLYVHKGD

SEQ ID NO: 666528 - protein, 9 aa, Homo Sapiens
VLYPLQNGY

SEQ ID NO: 666529 - protein, 9 aa, Homo Sapiens
LTVYTDALT

SEQ ID NO: 666530 - protein, 9 aa, Homo Sapiens
FCTLSSAAS

SEQ ID NO: 666531 - protein, 9 aa, Homo Sapiens
SFWQSAVET

SEQ ID NO: 666532 - protein, 9 aa, Homo Sapiens
CRGTKHYGL

SEQ ID NO: 666533 - protein, 9 aa, Homo Sapiens
HQREQKERQ

SEQ ID NO: 666534 - protein, 9 aa, Homo Sapiens
GRAKPHLTW

SEQ ID NO: 666535 - protein, 9 aa, Homo Sapiens
SPGPFVQEK

SEQ ID NO: 666536 - protein, 9 aa, Homo Sapiens
VESGIETTP

SEQ ID NO: 666537 - protein, 9 aa, Homo Sapiens
KKYFRQTTT

SEQ ID NO: 666538 - protein, 9 aa, Homo Sapiens
LDVFGHDGD

SEQ ID NO: 666539 - protein, 9 aa, Homo Sapiens
VQEKIPSPS

SEQ ID NO: 666540 - protein, 9 aa, Homo Sapiens
RGSTGLDAG

SEQ ID NO: 666541 - protein, 9 aa, Homo Sapiens
LKGGVLYPA

SEQ ID NO: 666542 - protein, 9 aa, Homo Sapiens
VSDIGYGGA

SEQ ID NO: 666543 - protein, 9 aa, Homo Sapiens
VMLRAFLSE

SEQ ID NO: 666544 - protein, 9 aa, Homo Sapiens
SDEGKCEKG

SEQ ID NO: 666545 - protein, 9 aa, Homo Sapiens
SQLDVFGHD

SEQ ID NO: 666546 - protein, 9 aa, Homo Sapiens
VLMPEPYAA

SEQ ID NO: 666547 - protein, 9 aa, Homo Sapiens
RHYMPASNV

SEQ ID NO: 666548 - protein, 9 aa, Homo Sapiens
STAPRELKQ

SEQ ID NO: 666549 - protein, 9 aa, Homo Sapiens
DFTQSSNLT

SEQ ID NO: 666550 - protein, 9 aa, Homo Sapiens
SSLSPYPAS

SEQ ID NO: 666551 - protein, 9 aa, Homo Sapiens
NCVVSTPGG

SEQ ID NO: 666552 - protein, 9 aa, Homo Sapiens
LELLRRATI

SEQ ID NO: 666553 - protein, 9 aa, Homo Sapiens
KDIMEKLHQ

SEQ ID NO: 666554 - protein, 9 aa, Homo Sapiens
PSSKLTVYT

SEQ ID NO: 666555 - protein, 9 aa, Homo Sapiens
TPCSLPYAC

SEQ ID NO: 666556 - protein, 9 aa, Homo Sapiens
EGPNNPQNK

SEQ ID NO: 666557 - protein, 9 aa, Homo Sapiens
AKQQFPFHL

SEQ ID NO: 666558 - protein, 9 aa, Homo Sapiens
RRLLGHLFN

SEQ ID NO: 666559 - protein, 9 aa, Homo Sapiens
LDCVQLDLH

SEQ ID NO: 666560 - protein, 9 aa, Homo Sapiens
KRSTHWNKK

SEQ ID NO: 666561 - protein, 9 aa, Homo Sapiens
LFDQSLEII

SEQ ID NO: 666562 - protein, 9 aa, Homo Sapiens
RDVEMEQMI

SEQ ID NO: 666563 - protein, 9 aa, Homo Sapiens
QSLEIIEER

SEQ ID NO: 666564 - protein, 9 aa, Homo Sapiens
TLSLNSQLQ

SEQ ID NO: 666565 - protein, 9 aa, Homo Sapiens
KRQRSVTVV

SEQ ID NO: 666566 - protein, 9 aa, Homo Sapiens
CRHYMPASN

SEQ ID NO: 666567 - protein, 9 aa, Homo Sapiens
PCHGAAPCL

SEQ ID NO: 666568 - protein, 9 aa, Homo Sapiens
LTGASSDLG

SEQ ID NO: 666569 - protein, 9 aa, Homo Sapiens
NIRKQCKIY

SEQ ID NO: 666570 - protein, 9 aa, Homo Sapiens
QMIEQLQEK

SEQ ID NO: 666571 - protein, 9 aa, Homo Sapiens
MRLHPAGRG

SEQ ID NO: 666572 - protein, 9 aa, Homo Sapiens
SAVAQLPVQ

SEQ ID NO: 666573 - protein, 9 aa, Homo Sapiens
EKLNELKQC

SEQ ID NO: 666574 - protein, 9 aa, Homo Sapiens
SAPVSKTAE

SEQ ID NO: 666575 - protein, 9 aa, Homo Sapiens
GGAFPGSFR

SEQ ID NO: 666576 - protein, 9 aa, Homo Sapiens
AEEPSSEEA

SEQ ID NO: 666577 - protein, 9 aa, Homo Sapiens
SSVSSPLPG

SEQ ID NO: 666578 - protein, 9 aa, Homo Sapiens
SGLQQQTMA

SEQ ID NO: 666579 - protein, 9 aa, Homo Sapiens
KYFRQTTTP

SEQ ID NO: 666580 - protein, 9 aa, Homo Sapiens
DLSMCVRHL

SEQ ID NO: 666581 - protein, 9 aa, Homo Sapiens
AGECWTRPP

SEQ ID NO: 666582 - protein, 9 aa, Homo Sapiens
QKKKSLYFD

SEQ ID NO: 666583 - protein, 9 aa, Homo Sapiens
YKLQDFSNQ

SEQ ID NO: 666584 - protein, 9 aa, Homo Sapiens
VALHAVPGS

SEQ ID NO: 666585 - protein, 9 aa, Homo Sapiens
IPKAMQKLV

SEQ ID NO: 666586 - protein, 9 aa, Homo Sapiens
DRVTENMST

SEQ ID NO: 666587 - protein, 9 aa, Homo Sapiens
GGVLYPALP

SEQ ID NO: 666588 - protein, 9 aa, Homo Sapiens
PKRKDGLKL

SEQ ID NO: 666589 - protein, 9 aa, Homo Sapiens
QEVEDPFRF

SEQ ID NO: 666590 - protein, 9 aa, Homo Sapiens
FKVAMDTTL

SEQ ID NO: 666591 - protein, 9 aa, Homo Sapiens
ARRDSFRKG

SEQ ID NO: 666592 - protein, 9 aa, Homo Sapiens
WQNSVRHNL

SEQ ID NO: 666593 - protein, 9 aa, Homo Sapiens
PKLFNSVKW

SEQ ID NO: 666594 - protein, 9 aa, Homo Sapiens
KDPIRKKLG

SEQ ID NO: 666595 - protein, 9 aa, Homo Sapiens
EGSLRAVMF

SEQ ID NO: 666596 - protein, 9 aa, Homo Sapiens
GFVEIRARL

SEQ ID NO: 666597 - protein, 9 aa, Homo Sapiens
KAMQRLAKN

SEQ ID NO: 666598 - protein, 9 aa, Homo Sapiens
HLTTRCPSW

SEQ ID NO: 666599 - protein, 9 aa, Homo Sapiens
GCGWKFSRS

SEQ ID NO: 666600 - protein, 9 aa, Homo Sapiens
DRNFYFGKL

SEQ ID NO: 666601 - protein, 9 aa, Homo Sapiens
CPRKSLVNV

SEQ ID NO: 666602 - protein, 9 aa, Homo Sapiens
NLSCLRTCM

SEQ ID NO: 666603 - protein, 9 aa, Homo Sapiens
QLCSKTKGS

SEQ ID NO: 666604 - protein, 9 aa, Homo Sapiens
LANCVVSTP

SEQ ID NO: 666605 - protein, 9 aa, Homo Sapiens
ANCVVSTPG

SEQ ID NO: 666606 - protein, 9 aa, Homo Sapiens
LLFSLIGML

SEQ ID NO: 666607 - protein, 9 aa, Homo Sapiens
QQFPFHLAP

SEQ ID NO: 666608 - protein, 9 aa, Homo Sapiens
RQSWHTTCF

SEQ ID NO: 666609 - protein, 9 aa, Homo Sapiens
KYVYKRYLA

SEQ ID NO: 666610 - protein, 9 aa, Homo Sapiens
TSDEGKCEK

SEQ ID NO: 666611 - protein, 9 aa, Homo Sapiens
CSKTKGSFV

SEQ ID NO: 666612 - protein, 9 aa, Homo Sapiens
ALAVIANCI

SEQ ID NO: 666613 - protein, 9 aa, Homo Sapiens
DSTRFPSQI

SEQ ID NO: 666614 - protein, 9 aa, Homo Sapiens
DDITGKPLI

SEQ ID NO: 666615 - protein, 9 aa, Homo Sapiens
CREEGERAR

SEQ ID NO: 666616 - protein, 9 aa, Homo Sapiens
TTYGFWALL

SEQ ID NO: 666617 - protein, 9 aa, Homo Sapiens
CGSSRHLTT

SEQ ID NO: 666618 - protein, 9 aa, Homo Sapiens
VDWGCGGRH

SEQ ID NO: 666619 - protein, 9 aa, Homo Sapiens
VGPAGPEAA

SEQ ID NO: 666620 - protein, 9 aa, Homo Sapiens
ADCFPYVQV

SEQ ID NO: 666621 - protein, 9 aa, Homo Sapiens
KTDTGTEPK

SEQ ID NO: 666622 - protein, 9 aa, Homo Sapiens
NLQNCILTL

SEQ ID NO: 666623 - protein, 9 aa, Homo Sapiens
HRPGDQSDS

SEQ ID NO: 666624 - protein, 9 aa, Homo Sapiens
SLTLLPRLD

SEQ ID NO: 666625 - protein, 9 aa, Homo Sapiens
VQEQVHSLL

SEQ ID NO: 666626 - protein, 9 aa, Homo Sapiens
CVLMPEPYA

SEQ ID NO: 666627 - protein, 9 aa, Homo Sapiens
VPIKLFNGD

SEQ ID NO: 666628 - protein, 9 aa, Homo Sapiens
CFITFTTIG

SEQ ID NO: 666629 - protein, 9 aa, Homo Sapiens
HIIQAPKTV

SEQ ID NO: 666630 - protein, 9 aa, Homo Sapiens
HRLLVMVKD

SEQ ID NO: 666631 - protein, 9 aa, Homo Sapiens
TFFLNIFRV

SEQ ID NO: 666632 - protein, 9 aa, Homo Sapiens
LQLAHAQGL

SEQ ID NO: 666633 - protein, 9 aa, Homo Sapiens
FLTQNQKVG

SEQ ID NO: 666634 - protein, 9 aa, Homo Sapiens
LSVNVTTNQ

SEQ ID NO: 666635 - protein, 9 aa, Homo Sapiens
QAVLPSVSQ

SEQ ID NO: 666636 - protein, 9 aa, Homo Sapiens
HKPPDGEEE

SEQ ID NO: 666637 - protein, 9 aa, Homo Sapiens
SGRSYLSKH

SEQ ID NO: 666638 - protein, 9 aa, Homo Sapiens
QCLLRCPPP

SEQ ID NO: 666639 - protein, 9 aa, Homo Sapiens
TSKDRNFYF

SEQ ID NO: 666640 - protein, 9 aa, Homo Sapiens
TACATSLQE

SEQ ID NO: 666641 - protein, 9 aa, Homo Sapiens
RLDGSGAVT

SEQ ID NO: 666642 - protein, 9 aa, Homo Sapiens
STALLLQCQ

SEQ ID NO: 666643 - protein, 9 aa, Homo Sapiens
RRSRSSSRG

SEQ ID NO: 666644 - protein, 9 aa, Homo Sapiens
GLVFGYDTD

SEQ ID NO: 666645 - protein, 9 aa, Homo Sapiens
YLYTVEPNN

SEQ ID NO: 666646 - protein, 9 aa, Homo Sapiens
QPELALIPR

SEQ ID NO: 666647 - protein, 9 aa, Homo Sapiens
LKQIVKHDM

SEQ ID NO: 666648 - protein, 9 aa, Homo Sapiens
MDITLVRKQ

SEQ ID NO: 666649 - protein, 9 aa, Homo Sapiens
FVERTPDTA

SEQ ID NO: 666650 - protein, 9 aa, Homo Sapiens
RDLCRGTKH

SEQ ID NO: 666651 - protein, 9 aa, Homo Sapiens
EVNICLREL

SEQ ID NO: 666652 - protein, 9 aa, Homo Sapiens
NDTMTFKDC

SEQ ID NO: 666653 - protein, 9 aa, Homo Sapiens
FFHFLGGAI

SEQ ID NO: 666654 - protein, 9 aa, Homo Sapiens
QAREALVHI

SEQ ID NO: 666655 - protein, 9 aa, Homo Sapiens
GWNGNAFEI

SEQ ID NO: 666656 - protein, 9 aa, Homo Sapiens
KSLYFDEEP

SEQ ID NO: 666657 - protein, 9 aa, Homo Sapiens
FYQSFDFSV

SEQ ID NO: 666658 - protein, 9 aa, Homo Sapiens
AQHRPGDQS

SEQ ID NO: 666659 - protein, 9 aa, Homo Sapiens
QNPAITVPA

SEQ ID NO: 666660 - protein, 9 aa, Homo Sapiens
NNQPEPLNL

SEQ ID NO: 666661 - protein, 9 aa, Homo Sapiens
DVMANSSVW

SEQ ID NO: 666662 - protein, 9 aa, Homo Sapiens
VTYELHGDF

SEQ ID NO: 666663 - protein, 9 aa, Homo Sapiens
TILDAHKGV

SEQ ID NO: 666664 - protein, 9 aa, Homo Sapiens
TNIVPMYPA

SEQ ID NO: 666665 - protein, 9 aa, Homo Sapiens
VTNIVPMYP

SEQ ID NO: 666666 - protein, 9 aa, Homo Sapiens
RLLGHLFND

SEQ ID NO: 666667 - protein, 9 aa, Homo Sapiens
PGHGQVTAT

SEQ ID NO: 666668 - protein, 9 aa, Homo Sapiens
EKASAKRQV

SEQ ID NO: 666669 - protein, 9 aa, Homo Sapiens
SLQPLSVGF

SEQ ID NO: 666670 - protein, 9 aa, Homo Sapiens
KQIVKHDME

SEQ ID NO: 666671 - protein, 9 aa, Homo Sapiens
SYPCCQPLA

SEQ ID NO: 666672 - protein, 9 aa, Homo Sapiens
QAPPEIRQA

SEQ ID NO: 666673 - protein, 9 aa, Homo Sapiens
FLAFDQPTI

SEQ ID NO: 666674 - protein, 9 aa, Homo Sapiens
QKICLNRAR

SEQ ID NO: 666675 - protein, 9 aa, Homo Sapiens
AVSSALPFS

SEQ ID NO: 666676 - protein, 9 aa, Homo Sapiens
FSNTFSSLA

SEQ ID NO: 666677 - protein, 9 aa, Homo Sapiens
PHCQKKWIQ

SEQ ID NO: 666678 - protein, 9 aa, Homo Sapiens
YVHKGDAVT

SEQ ID NO: 666679 - protein, 9 aa, Homo Sapiens
ECALQVLGM

SEQ ID NO: 666680 - protein, 9 aa, Homo Sapiens
GARQYLSVN

SEQ ID NO: 666681 - protein, 9 aa, Homo Sapiens
GMRKTDFDE

SEQ ID NO: 666682 - protein, 9 aa, Homo Sapiens
KFLVFPPKK

SEQ ID NO: 666683 - protein, 9 aa, Homo Sapiens
SSVWVQSKP

SEQ ID NO: 666684 - protein, 9 aa, Homo Sapiens
NLSGLQQQT

SEQ ID NO: 666685 - protein, 9 aa, Homo Sapiens
SRQRLVLAL

SEQ ID NO: 666686 - protein, 9 aa, Homo Sapiens
LGGAIVFFL

SEQ ID NO: 666687 - protein, 9 aa, Homo Sapiens
NGTIEFTIL

SEQ ID NO: 666688 - protein, 9 aa, Homo Sapiens
KFLVHESMR

SEQ ID NO: 666689 - protein, 9 aa, Homo Sapiens
NKAVVVNNL

SEQ ID NO: 666690 - protein, 9 aa, Homo Sapiens
HALRQSWHT

SEQ ID NO: 666691 - protein, 9 aa, Homo Sapiens
NNHTLFTDF

SEQ ID NO: 666692 - protein, 9 aa, Homo Sapiens
KAFSGRSYL

SEQ ID NO: 666693 - protein, 9 aa, Homo Sapiens
EEDPLGPYC

SEQ ID NO: 666694 - protein, 9 aa, Homo Sapiens
QPLPAIAGA

SEQ ID NO: 666695 - protein, 9 aa, Homo Sapiens
SCTFFLNIF

SEQ ID NO: 666696 - protein, 9 aa, Homo Sapiens
TQWGEESSV

SEQ ID NO: 666697 - protein, 9 aa, Homo Sapiens
PELFHNTIM

SEQ ID NO: 666698 - protein, 9 aa, Homo Sapiens
APKALLARE

SEQ ID NO: 666699 - protein, 9 aa, Homo Sapiens
TTNLSKRHG

SEQ ID NO: 666700 - protein, 9 aa, Homo Sapiens
LALRELPRA

SEQ ID NO: 666701 - protein, 9 aa, Homo Sapiens
GKRPSIQQA

SEQ ID NO: 666702 - protein, 9 aa, Homo Sapiens
CCQPLALSH

SEQ ID NO: 666703 - protein, 9 aa, Homo Sapiens
GKEILNRLL

SEQ ID NO: 666704 - protein, 9 aa, Homo Sapiens
QARNDFDRL

SEQ ID NO: 666705 - protein, 9 aa, Homo Sapiens
PTPLPPPSS

SEQ ID NO: 666706 - protein, 9 aa, Homo Sapiens
WTRPPTPPA

SEQ ID NO: 666707 - protein, 9 aa, Homo Sapiens
PVPIKLFNG

SEQ ID NO: 666708 - protein, 9 aa, Homo Sapiens
WSVSNGAIT

SEQ ID NO: 666709 - protein, 9 aa, Homo Sapiens
AFKCSSKLT

SEQ ID NO: 666710 - protein, 9 aa, Homo Sapiens
GECSEFCKL

SEQ ID NO: 666711 - protein, 9 aa, Homo Sapiens
NARERLRVL

SEQ ID NO: 666712 - protein, 9 aa, Homo Sapiens
KISLPSQRP

SEQ ID NO: 666713 - protein, 9 aa, Homo Sapiens
EKYQYLYTV

SEQ ID NO: 666714 - protein, 9 aa, Homo Sapiens
DGCGWKFSR

SEQ ID NO: 666715 - protein, 9 aa, Homo Sapiens
DKDEGPVAQ

SEQ ID NO: 666716 - protein, 9 aa, Homo Sapiens
GLSPNQNRF

SEQ ID NO: 666717 - protein, 9 aa, Homo Sapiens
TLAFRTKPA

SEQ ID NO: 666718 - protein, 9 aa, Homo Sapiens
RVTENMSTV

SEQ ID NO: 666719 - protein, 9 aa, Homo Sapiens
CPHCAMTFT

SEQ ID NO: 666720 - protein, 9 aa, Homo Sapiens
LGCCLPKDY

SEQ ID NO: 666721 - protein, 9 aa, Homo Sapiens
VSSALPFSL

SEQ ID NO: 666722 - protein, 9 aa, Homo Sapiens
GRSDAKHPA

SEQ ID NO: 666723 - protein, 9 aa, Homo Sapiens
AWQNSVRHN

SEQ ID NO: 666724 - protein, 9 aa, Homo Sapiens
TRRLRGGSG

SEQ ID NO: 666725 - protein, 9 aa, Homo Sapiens
NLLSGVSRA

SEQ ID NO: 666726 - protein, 9 aa, Homo Sapiens
NNPQNKPPA

SEQ ID NO: 666727 - protein, 9 aa, Homo Sapiens
AIAGASCSR

SEQ ID NO: 666728 - protein, 9 aa, Homo Sapiens
AFDQPTISY

SEQ ID NO: 666729 - protein, 9 aa, Homo Sapiens
GREGAEPRE

SEQ ID NO: 666730 - protein, 9 aa, Homo Sapiens
MKLWCAACV

SEQ ID NO: 666731 - protein, 9 aa, Homo Sapiens
AKNMSGWFL

SEQ ID NO: 666732 - protein, 9 aa, Homo Sapiens
EPAAEEPSS

SEQ ID NO: 666733 - protein, 9 aa, Homo Sapiens
WRALYGVFG

SEQ ID NO: 666734 - protein, 9 aa, Homo Sapiens
IAGASCSRC

SEQ ID NO: 666735 - protein, 9 aa, Homo Sapiens
ENMSTVSWD

SEQ ID NO: 666736 - protein, 9 aa, Homo Sapiens
NEFFKCDQY

SEQ ID NO: 666737 - protein, 9 aa, Homo Sapiens
NICLRELDL

SEQ ID NO: 666738 - protein, 9 aa, Homo Sapiens
IEFTILDAH

SEQ ID NO: 666739 - protein, 9 aa, Homo Sapiens
VSVFYTLVI

SEQ ID NO: 666740 - protein, 9 aa, Homo Sapiens
ALEHDCCQD

SEQ ID NO: 666741 - protein, 9 aa, Homo Sapiens
SWHTTCFVC

SEQ ID NO: 666742 - protein, 9 aa, Homo Sapiens
VLLVKKKEE

SEQ ID NO: 666743 - protein, 9 aa, Homo Sapiens
PIQHMLRLI

SEQ ID NO: 666744 - protein, 9 aa, Homo Sapiens
VLSSGENGV

SEQ ID NO: 666745 - protein, 9 aa, Homo Sapiens
CVISLHGFF

SEQ ID NO: 666746 - protein, 9 aa, Homo Sapiens
FGSCTFFLN

SEQ ID NO: 666747 - protein, 9 aa, Homo Sapiens
ILFGGVLFV

SEQ ID NO: 666748 - protein, 9 aa, Homo Sapiens
FLCLTRKGR

SEQ ID NO: 666749 - protein, 9 aa, Homo Sapiens
TSGGGGGLL

SEQ ID NO: 666750 - protein, 9 aa, Homo Sapiens
DAVPTSDEG

SEQ ID NO: 666751 - protein, 9 aa, Homo Sapiens
GLACDPDQV

SEQ ID NO: 666752 - protein, 9 aa, Homo Sapiens
KLYVHKGDA

SEQ ID NO: 666753 - protein, 9 aa, Homo Sapiens
PFTKNNNKT

SEQ ID NO: 666754 - protein, 9 aa, Homo Sapiens
PFVVSFPVI

SEQ ID NO: 666755 - protein, 9 aa, Homo Sapiens
LYGVFGRCY

SEQ ID NO: 666756 - protein, 9 aa, Homo Sapiens
ACDATILSS

SEQ ID NO: 666757 - protein, 9 aa, Homo Sapiens
PQHRHESVR

SEQ ID NO: 666758 - protein, 9 aa, Homo Sapiens
TGEKHYRCK

SEQ ID NO: 666759 - protein, 9 aa, Homo Sapiens
AFGGTEMVL

SEQ ID NO: 666760 - protein, 9 aa, Homo Sapiens
KINQLCSKT

SEQ ID NO: 666761 - protein, 9 aa, Homo Sapiens
ESRRRSRSS

SEQ ID NO: 666762 - protein, 9 aa, Homo Sapiens
TPGLSSKST

SEQ ID NO: 666763 - protein, 9 aa, Homo Sapiens
DPAVPFCTL

SEQ ID NO: 666764 - protein, 9 aa, Homo Sapiens
PQSLCAFYT

SEQ ID NO: 666765 - protein, 9 aa, Homo Sapiens
HREHCLCRH

SEQ ID NO: 666766 - protein, 9 aa, Homo Sapiens
VYLCASSSS

SEQ ID NO: 666767 - protein, 9 aa, Homo Sapiens
YEDALKDEE

SEQ ID NO: 666768 - protein, 9 aa, Homo Sapiens
DVSRSQEEL

SEQ ID NO: 666769 - protein, 9 aa, Homo Sapiens
FKYVTELNN

SEQ ID NO: 666770 - protein, 9 aa, Homo Sapiens
CSCNGQCME

SEQ ID NO: 666771 - protein, 9 aa, Homo Sapiens
GTVHSLWQT

SEQ ID NO: 666772 - protein, 9 aa, Homo Sapiens
RQRSVTVVS

SEQ ID NO: 666773 - protein, 9 aa, Homo Sapiens
GECWTRPPT

SEQ ID NO: 666774 - protein, 9 aa, Homo Sapiens
FLNIFRVGY

SEQ ID NO: 666775 - protein, 9 aa, Homo Sapiens
LSPEENECL

SEQ ID NO: 666776 - protein, 9 aa, Homo Sapiens
IIFILFGGV

SEQ ID NO: 666777 - protein, 9 aa, Homo Sapiens
EVKNLLSGV

SEQ ID NO: 666778 - protein, 9 aa, Homo Sapiens
MRLMKEVRV

SEQ ID NO: 666779 - protein, 9 aa, Homo Sapiens
QQKICLNRA

SEQ ID NO: 666780 - protein, 9 aa, Homo Sapiens
GDVSRSQEE

SEQ ID NO: 666781 - protein, 9 aa, Homo Sapiens
IQTTSVGKT

SEQ ID NO: 666782 - protein, 9 aa, Homo Sapiens
KPPVSHDDV

SEQ ID NO: 666783 - protein, 9 aa, Homo Sapiens
IRHQIENTL

SEQ ID NO: 666784 - protein, 9 aa, Homo Sapiens
GKSCKKSTL

SEQ ID NO: 666785 - protein, 9 aa, Homo Sapiens
GPVAQQVKK

SEQ ID NO: 666786 - protein, 9 aa, Homo Sapiens
IIHTGEKFC

SEQ ID NO: 666787 - protein, 9 aa, Homo Sapiens
NLNDTMTFK

SEQ ID NO: 666788 - protein, 9 aa, Homo Sapiens
CGKDFTQSS

SEQ ID NO: 666789 - protein, 9 aa, Homo Sapiens
NFSNTFSSL

SEQ ID NO: 666790 - protein, 9 aa, Homo Sapiens
QIRTRSFGH

SEQ ID NO: 666791 - protein, 9 aa, Homo Sapiens
SETSTNTVA

SEQ ID NO: 666792 - protein, 9 aa, Homo Sapiens
CSKCGKDFT

SEQ ID NO: 666793 - protein, 9 aa, Homo Sapiens
KHYRCKECG

SEQ ID NO: 666794 - protein, 9 aa, Homo Sapiens
IDIRVEDTE

SEQ ID NO: 666795 - protein, 9 aa, Homo Sapiens
QSGPGHGQV

SEQ ID NO: 666796 - protein, 9 aa, Homo Sapiens
LESLDPAGL

SEQ ID NO: 666797 - protein, 9 aa, Homo Sapiens
GILESIHRF

SEQ ID NO: 666798 - protein, 9 aa, Homo Sapiens
YAAACANHP

SEQ ID NO: 666799 - protein, 9 aa, Homo Sapiens
TWSPWSQTL

SEQ ID NO: 666800 - protein, 9 aa, Homo Sapiens
TVKEVPCCW

SEQ ID NO: 666801 - protein, 9 aa, Homo Sapiens
TVSCLAPSN

SEQ ID NO: 666802 - protein, 9 aa, Homo Sapiens
TAILCTPSV

SEQ ID NO: 666803 - protein, 9 aa, Homo Sapiens
TAVLAVLMA

SEQ ID NO: 666804 - protein, 9 aa, Homo Sapiens
PGARQYLSV

SEQ ID NO: 666805 - protein, 9 aa, Homo Sapiens
LNELKQCGE

SEQ ID NO: 666806 - protein, 9 aa, Homo Sapiens
KTVEAIKRP

SEQ ID NO: 666807 - protein, 9 aa, Homo Sapiens
SFDPAVPFC

SEQ ID NO: 666808 - protein, 9 aa, Homo Sapiens
FECRAGQKL

SEQ ID NO: 666809 - protein, 9 aa, Homo Sapiens
GPSPGPFVQ

SEQ ID NO: 666810 - protein, 9 aa, Homo Sapiens
CVSDIGYGG

SEQ ID NO: 666811 - protein, 9 aa, Homo Sapiens
GKKLRISEY

SEQ ID NO: 666812 - protein, 9 aa, Homo Sapiens
LEKVLLVKK

SEQ ID NO: 666813 - protein, 9 aa, Homo Sapiens
LRAVMFITK

SEQ ID NO: 666814 - protein, 9 aa, Homo Sapiens
ITNCDDMEK

SEQ ID NO: 666815 - protein, 9 aa, Homo Sapiens
PAVPFCTLS

SEQ ID NO: 666816 - protein, 9 aa, Homo Sapiens
KEGPNNPQN

SEQ ID NO: 666817 - protein, 9 aa, Homo Sapiens
MCEKPNNHL

SEQ ID NO: 666818 - protein, 9 aa, Homo Sapiens
VMYTSKDRN

SEQ ID NO: 666819 - protein, 9 aa, Homo Sapiens
NGYAPCTEL

SEQ ID NO: 666820 - protein, 9 aa, Homo Sapiens
PLMFTYYLA

SEQ ID NO: 666821 - protein, 9 aa, Homo Sapiens
QRRSFRPLL

SEQ ID NO: 666822 - protein, 9 aa, Homo Sapiens
TVYTDALTP

SEQ ID NO: 666823 - protein, 9 aa, Homo Sapiens
NLLFDQSLE

SEQ ID NO: 666824 - protein, 9 aa, Homo Sapiens
EDALKDEEK

SEQ ID NO: 666825 - protein, 9 aa, Homo Sapiens
AMLADTDIA

SEQ ID NO: 666826 - protein, 9 aa, Homo Sapiens
TSIYTYLRP

SEQ ID NO: 666827 - protein, 9 aa, Homo Sapiens
LPNPHVGDV

SEQ ID NO: 666828 - protein, 9 aa, Homo Sapiens
IPFLLVMCA

SEQ ID NO: 666829 - protein, 9 aa, Homo Sapiens
YQPHGKRQR

SEQ ID NO: 666830 - protein, 9 aa, Homo Sapiens
AAETIAWLR

SEQ ID NO: 666831 - protein, 9 aa, Homo Sapiens
CLVLPEGGA

SEQ ID NO: 666832 - protein, 9 aa, Homo Sapiens
EMHESMRRF

SEQ ID NO: 666833 - protein, 9 aa, Homo Sapiens
ASMVMLRAF

SEQ ID NO: 666834 - protein, 9 aa, Homo Sapiens
VDVVQAREA

SEQ ID NO: 666835 - protein, 9 aa, Homo Sapiens
LCTPSVAKG

SEQ ID NO: 666836 - protein, 9 aa, Homo Sapiens
KRKASMVML

SEQ ID NO: 666837 - protein, 9 aa, Homo Sapiens
ASSSSTALL

SEQ ID NO: 666838 - protein, 9 aa, Homo Sapiens
YCYYDKTKS

SEQ ID NO: 666839 - protein, 9 aa, Homo Sapiens
LNPVFYQSF

SEQ ID NO: 666840 - protein, 9 aa, Homo Sapiens
TMTFKDCVI

SEQ ID NO: 666841 - protein, 9 aa, Homo Sapiens
VSEELARRV

SEQ ID NO: 666842 - protein, 9 aa, Homo Sapiens
NGNAFEIWL

SEQ ID NO: 666843 - protein, 9 aa, Homo Sapiens
ESRQRLVLA

SEQ ID NO: 666844 - protein, 9 aa, Homo Sapiens
VEKYKYLLE

SEQ ID NO: 666845 - protein, 9 aa, Homo Sapiens
EENECLKGK

SEQ ID NO: 666846 - protein, 9 aa, Homo Sapiens
LQQQTMAVK

SEQ ID NO: 666847 - protein, 9 aa, Homo Sapiens
RKKRKPQVE

SEQ ID NO: 666848 - protein, 9 aa, Homo Sapiens
YAIFLSFSI

SEQ ID NO: 666849 - protein, 9 aa, Homo Sapiens
GFIGSRVTK

SEQ ID NO: 666850 - protein, 9 aa, Homo Sapiens
HQEKPLVTE

SEQ ID NO: 666851 - protein, 9 aa, Homo Sapiens
SLLSQDQAQ

SEQ ID NO: 666852 - protein, 9 aa, Homo Sapiens
NKTANMCRF

SEQ ID NO: 666853 - protein, 9 aa, Homo Sapiens
EVSINRSLE

SEQ ID NO: 666854 - protein, 9 aa, Homo Sapiens
VYTDALTPS

SEQ ID NO: 666855 - protein, 9 aa, Homo Sapiens
SDIGYGGAQ

SEQ ID NO: 666856 - protein, 9 aa, Homo Sapiens
GQVTATSWA

SEQ ID NO: 666857 - protein, 9 aa, Homo Sapiens
LRPWRALVV

SEQ ID NO: 666858 - protein, 9 aa, Homo Sapiens
EPLCEDCPS

SEQ ID NO: 666859 - protein, 9 aa, Homo Sapiens
SKDRNFYFG

SEQ ID NO: 666860 - protein, 9 aa, Homo Sapiens
KTRESDQGV

SEQ ID NO: 666861 - protein, 9 aa, Homo Sapiens
IHGLVFGYD

SEQ ID NO: 666862 - protein, 9 aa, Homo Sapiens
SVTSAENSH

SEQ ID NO: 666863 - protein, 9 aa, Homo Sapiens
SKKPPVSHD

SEQ ID NO: 666864 - protein, 9 aa, Homo Sapiens
LIFWPRGTV

SEQ ID NO: 666865 - protein, 9 aa, Homo Sapiens
NKQHAMTLT

SEQ ID NO: 666866 - protein, 9 aa, Homo Sapiens
FFKCDQYGS

SEQ ID NO: 666867 - protein, 9 aa, Homo Sapiens
PASQLDVFG

SEQ ID NO: 666868 - protein, 9 aa, Homo Sapiens
NSPRRTDVR

SEQ ID NO: 666869 - protein, 9 aa, Homo Sapiens
VIVSQPALP

SEQ ID NO: 666870 - protein, 9 aa, Homo Sapiens
QWSLNPETG

SEQ ID NO: 666871 - protein, 9 aa, Homo Sapiens
LCASSSSTA

SEQ ID NO: 666872 - protein, 9 aa, Homo Sapiens
PSPGPFVQE

SEQ ID NO: 666873 - protein, 9 aa, Homo Sapiens
MQSQSIPGR

SEQ ID NO: 666874 - protein, 9 aa, Homo Sapiens
GEIDIRVED

SEQ ID NO: 666875 - protein, 9 aa, Homo Sapiens
WEPPMYDEG

SEQ ID NO: 666876 - protein, 9 aa, Homo Sapiens
LTLFPMREE

SEQ ID NO: 666877 - protein, 9 aa, Homo Sapiens
YYYCFITFT

SEQ ID NO: 666878 - protein, 9 aa, Homo Sapiens
KWYTYYARL

SEQ ID NO: 666879 - protein, 9 aa, Homo Sapiens
RSASPAALP

SEQ ID NO: 666880 - protein, 9 aa, Homo Sapiens
NSNECCETS

SEQ ID NO: 666881 - protein, 9 aa, Homo Sapiens
CSCVSDIGY

SEQ ID NO: 666882 - protein, 9 aa, Homo Sapiens
DLLNAGNVG

SEQ ID NO: 666883 - protein, 9 aa, Homo Sapiens
NRLPLPIQT

SEQ ID NO: 666884 - protein, 9 aa, Homo Sapiens
QPEELKEKM

SEQ ID NO: 666885 - protein, 9 aa, Homo Sapiens
EMEEFVLSS

SEQ ID NO: 666886 - protein, 9 aa, Homo Sapiens
HCAMTFTHP

SEQ ID NO: 666887 - protein, 9 aa, Homo Sapiens
HRHESVRRD

SEQ ID NO: 666888 - protein, 9 aa, Homo Sapiens
QSIPGRKRG

SEQ ID NO: 666889 - protein, 9 aa, Homo Sapiens
EIRHQIENT

SEQ ID NO: 666890 - protein, 9 aa, Homo Sapiens
SMVMLRAFL

SEQ ID NO: 666891 - protein, 9 aa, Homo Sapiens
GLQQQTMAV

SEQ ID NO: 666892 - protein, 9 aa, Homo Sapiens
SLLEKVLLV

SEQ ID NO: 666893 - protein, 9 aa, Homo Sapiens
VDKGHRGER

SEQ ID NO: 666894 - protein, 9 aa, Homo Sapiens
EESSVSSPL

SEQ ID NO: 666895 - protein, 9 aa, Homo Sapiens
KALLARELY

SEQ ID NO: 666896 - protein, 9 aa, Homo Sapiens
ASLLQRTDG

SEQ ID NO: 666897 - protein, 9 aa, Homo Sapiens
LFNDLGLGY

SEQ ID NO: 666898 - protein, 9 aa, Homo Sapiens
ATLSCGLPK

SEQ ID NO: 666899 - protein, 9 aa, Homo Sapiens
KYKYLLECK

SEQ ID NO: 666900 - protein, 9 aa, Homo Sapiens
STHWNKKPR

SEQ ID NO: 666901 - protein, 9 aa, Homo Sapiens
MVESGIETT

SEQ ID NO: 666902 - protein, 9 aa, Homo Sapiens
GVLFVALPA

SEQ ID NO: 666903 - protein, 9 aa, Homo Sapiens
LNTTLQKAQ

SEQ ID NO: 666904 - protein, 9 aa, Homo Sapiens
SSNEFFKCD

SEQ ID NO: 666905 - protein, 9 aa, Homo Sapiens
PLSVGFVEI

SEQ ID NO: 666906 - protein, 9 aa, Homo Sapiens
APKTVEAIK

SEQ ID NO: 666907 - protein, 9 aa, Homo Sapiens
SSSNEFFKC

SEQ ID NO: 666908 - protein, 9 aa, Homo Sapiens
FMAPSQMAY

SEQ ID NO: 666909 - protein, 9 aa, Homo Sapiens
PLCEDCPSE

SEQ ID NO: 666910 - protein, 9 aa, Homo Sapiens
SEELARRVN

SEQ ID NO: 666911 - protein, 9 aa, Homo Sapiens
LFNSVKWGQ

SEQ ID NO: 666912 - protein, 9 aa, Homo Sapiens
FRRCLLLKR

SEQ ID NO: 666913 - protein, 9 aa, Homo Sapiens
MPEPYAAAC

SEQ ID NO: 666914 - protein, 9 aa, Homo Sapiens
NQLGLPASE

SEQ ID NO: 666915 - protein, 9 aa, Homo Sapiens
CNGQCMEWG

SEQ ID NO: 666916 - protein, 9 aa, Homo Sapiens
NAGTSALEL

SEQ ID NO: 666917 - protein, 9 aa, Homo Sapiens
INPVWILTV

SEQ ID NO: 666918 - protein, 9 aa, Homo Sapiens
ASSRASVGP

SEQ ID NO: 666919 - protein, 9 aa, Homo Sapiens
SCASPFVSK

SEQ ID NO: 666920 - protein, 9 aa, Homo Sapiens
LRDLPHQPL

SEQ ID NO: 666921 - protein, 9 aa, Homo Sapiens
PGKEGPNNP

SEQ ID NO: 666922 - protein, 9 aa, Homo Sapiens
ECRAGQKLM

SEQ ID NO: 666923 - protein, 9 aa, Homo Sapiens
VRTTYGFWA

SEQ ID NO: 666924 - protein, 9 aa, Homo Sapiens
HPAGRGGAF

SEQ ID NO: 666925 - protein, 9 aa, Homo Sapiens
LNVIHNKLK

SEQ ID NO: 666926 - protein, 9 aa, Homo Sapiens
EDEGRAKPH

SEQ ID NO: 666927 - protein, 9 aa, Homo Sapiens
LGRLLITTN

SEQ ID NO: 666928 - protein, 9 aa, Homo Sapiens
GCGKRPSIQ

SEQ ID NO: 666929 - protein, 9 aa, Homo Sapiens
KPQVEKVDV

SEQ ID NO: 666930 - protein, 9 aa, Homo Sapiens
KTLNPVFYQ

SEQ ID NO: 666931 - protein, 9 aa, Homo Sapiens
RHQIENTLI

SEQ ID NO: 666932 - protein, 9 aa, Homo Sapiens
ITTNLSKRH

SEQ ID NO: 666933 - protein, 9 aa, Homo Sapiens
SQTLIPHCQ

SEQ ID NO: 666934 - protein, 9 aa, Homo Sapiens
LTANLNDTM

SEQ ID NO: 666935 - protein, 9 aa, Homo Sapiens
ERRLLGHLF

SEQ ID NO: 666936 - protein, 9 aa, Homo Sapiens
EDVITSQSD

SEQ ID NO: 666937 - protein, 9 aa, Homo Sapiens
LICGYSQIL

SEQ ID NO: 666938 - protein, 9 aa, Homo Sapiens
FVLSSGENG

SEQ ID NO: 666939 - protein, 9 aa, Homo Sapiens
QPESEDVIT

SEQ ID NO: 666940 - protein, 9 aa, Homo Sapiens
PDPSHFLYW

SEQ ID NO: 666941 - protein, 9 aa, Homo Sapiens
ILTVAHCVQ

SEQ ID NO: 666942 - protein, 9 aa, Homo Sapiens
MARLARLVI

SEQ ID NO: 666943 - protein, 9 aa, Homo Sapiens
ASNKAVVVN

SEQ ID NO: 666944 - protein, 9 aa, Homo Sapiens
PHLTWWKIV

SEQ ID NO: 666945 - protein, 9 aa, Homo Sapiens
YACRRCCPP

SEQ ID NO: 666946 - protein, 9 aa, Homo Sapiens
DVNDNTPEL

SEQ ID NO: 666947 - protein, 9 aa, Homo Sapiens
LLVMCAFEA

SEQ ID NO: 666948 - protein, 9 aa, Homo Sapiens
ALSIGMAAL

SEQ ID NO: 666949 - protein, 9 aa, Homo Sapiens
MREESVTVT

SEQ ID NO: 666950 - protein, 9 aa, Homo Sapiens
FYECSSYSG

SEQ ID NO: 666951 - protein, 9 aa, Homo Sapiens
TLLFLYFRP

SEQ ID NO: 666952 - protein, 9 aa, Homo Sapiens
LESMQLPLV

SEQ ID NO: 666953 - protein, 9 aa, Homo Sapiens
RGHLQRTYL

SEQ ID NO: 666954 - protein, 9 aa, Homo Sapiens
KTVKEVPCC

SEQ ID NO: 666955 - protein, 9 aa, Homo Sapiens
RLHPAGRGG

SEQ ID NO: 666956 - protein, 9 aa, Homo Sapiens
YVCSKCGKD

SEQ ID NO: 666957 - protein, 9 aa, Homo Sapiens
RKKLGRKPL

SEQ ID NO: 666958 - protein, 9 aa, Homo Sapiens
SPPGCLPSA

SEQ ID NO: 666959 - protein, 9 aa, Homo Sapiens
TFRENAVTK

SEQ ID NO: 666960 - protein, 9 aa, Homo Sapiens
GYNPTGLLA

SEQ ID NO: 666961 - protein, 9 aa, Homo Sapiens
PNLCSCNGQ

SEQ ID NO: 666962 - protein, 9 aa, Homo Sapiens
MKDDITGKP

SEQ ID NO: 666963 - protein, 9 aa, Homo Sapiens
RKISLPSQR

SEQ ID NO: 666964 - protein, 9 aa, Homo Sapiens
PSQMAYPTA

SEQ ID NO: 666965 - protein, 9 aa, Homo Sapiens
GHGQVTATS

SEQ ID NO: 666966 - protein, 9 aa, Homo Sapiens
TTHQEKPLV

SEQ ID NO: 666967 - protein, 9 aa, Homo Sapiens
FGADCFPYV

SEQ ID NO: 666968 - protein, 9 aa, Homo Sapiens
PASNKAVVV

SEQ ID NO: 666969 - protein, 9 aa, Homo Sapiens
KQFPDLHSE

SEQ ID NO: 666970 - protein, 9 aa, Homo Sapiens
DLLKGGVLY

SEQ ID NO: 666971 - protein, 9 aa, Homo Sapiens
CCQDFIYHL

SEQ ID NO: 666972 - protein, 9 aa, Homo Sapiens
PYPASQLDV

SEQ ID NO: 666973 - protein, 9 aa, Homo Sapiens
TPADCSGTA

SEQ ID NO: 666974 - protein, 9 aa, Homo Sapiens
GEKFCKCEE

SEQ ID NO: 666975 - protein, 9 aa, Homo Sapiens
ILDAHKGVA

SEQ ID NO: 666976 - protein, 9 aa, Homo Sapiens
MFITKRGLK

SEQ ID NO: 666977 - protein, 9 aa, Homo Sapiens
AISHYQIAH

SEQ ID NO: 666978 - protein, 9 aa, Homo Sapiens
YTSKDRNFY

SEQ ID NO: 666979 - protein, 9 aa, Homo Sapiens
KRKPQVEKV

SEQ ID NO: 666980 - protein, 9 aa, Homo Sapiens
PKAYPKLFN

SEQ ID NO: 666981 - protein, 9 aa, Homo Sapiens
MTFTHPSRL

SEQ ID NO: 666982 - protein, 9 aa, Homo Sapiens
QNLQATLSL

SEQ ID NO: 666983 - protein, 9 aa, Homo Sapiens
PVWILTVAH

SEQ ID NO: 666984 - protein, 9 aa, Homo Sapiens
VNLLFDQSL

SEQ ID NO: 666985 - protein, 9 aa, Homo Sapiens
GPFVQEKIP

SEQ ID NO: 666986 - protein, 9 aa, Homo Sapiens
KKTLNPVFY

SEQ ID NO: 666987 - protein, 9 aa, Homo Sapiens
LNCQSSGRK

SEQ ID NO: 666988 - protein, 9 aa, Homo Sapiens
VAQLPVQPV

SEQ ID NO: 666989 - protein, 9 aa, Homo Sapiens
FPISLLQSC

SEQ ID NO: 666990 - protein, 9 aa, Homo Sapiens
LMPEPYAAA

SEQ ID NO: 666991 - protein, 9 aa, Homo Sapiens
PYCYYDKTK

SEQ ID NO: 666992 - protein, 9 aa, Homo Sapiens
AWTAVLAVL

SEQ ID NO: 666993 - protein, 9 aa, Homo Sapiens
CRYYPMGHT

SEQ ID NO: 666994 - protein, 9 aa, Homo Sapiens
CRTTCCRHS

SEQ ID NO: 666995 - protein, 9 aa, Homo Sapiens
TVPAVPYSR

SEQ ID NO: 666996 - protein, 9 aa, Homo Sapiens
PRKSLVNVK

SEQ ID NO: 666997 - protein, 9 aa, Homo Sapiens
LESFLKLVS

SEQ ID NO: 666998 - protein, 9 aa, Homo Sapiens
LQDFSNQLS

SEQ ID NO: 666999 - protein, 9 aa, Homo Sapiens
MHALRQSWH

SEQ ID NO: 667000 - protein, 9 aa, Homo Sapiens
CALKPQVSV

SEQ ID NO: 667001 - protein, 9 aa, Homo Sapiens
NTIMCEKPN

SEQ ID NO: 667002 - protein, 9 aa, Homo Sapiens
HTGEKFCKC

SEQ ID NO: 667003 - protein, 9 aa, Homo Sapiens
MRRFLEHMQ

SEQ ID NO: 667004 - protein, 9 aa, Homo Sapiens
EYGKSCKKS

SEQ ID NO: 667005 - protein, 9 aa, Homo Sapiens
GEQACMARL

SEQ ID NO: 667006 - protein, 9 aa, Homo Sapiens
PMPIDIVYT

SEQ ID NO: 667007 - protein, 9 aa, Homo Sapiens
RHGPRPVAM

SEQ ID NO: 667008 - protein, 9 aa, Homo Sapiens
ALESFLKLV

SEQ ID NO: 667009 - protein, 9 aa, Homo Sapiens
ELKQCGEAF

SEQ ID NO: 667010 - protein, 9 aa, Homo Sapiens
SALESFLKL

SEQ ID NO: 667011 - protein, 9 aa, Homo Sapiens
SMKPALASG

SEQ ID NO: 667012 - protein, 9 aa, Homo Sapiens
PAITVPAVP

SEQ ID NO: 667013 - protein, 9 aa, Homo Sapiens
VMANSSVWV

SEQ ID NO: 667014 - protein, 9 aa, Homo Sapiens
LASGPKARP

SEQ ID NO: 667015 - protein, 9 aa, Homo Sapiens
TASVHLYFL

SEQ ID NO: 667016 - protein, 9 aa, Homo Sapiens
AFPTHYEDA

SEQ ID NO: 667017 - protein, 9 aa, Homo Sapiens
VSAPVSKTA

SEQ ID NO: 667018 - protein, 9 aa, Homo Sapiens
LSGVSRAAV

SEQ ID NO: 667019 - protein, 9 aa, Homo Sapiens
PSPENRNLW

SEQ ID NO: 667020 - protein, 9 aa, Homo Sapiens
FWALLESPH

SEQ ID NO: 667021 - protein, 9 aa, Homo Sapiens
PCSLPYACR

SEQ ID NO: 667022 - protein, 9 aa, Homo Sapiens
MDTTLPLDT

SEQ ID NO: 667023 - protein, 9 aa, Homo Sapiens
KLNELKQCG

SEQ ID NO: 667024 - protein, 9 aa, Homo Sapiens
EQVHSLLSQ

SEQ ID NO: 667025 - protein, 9 aa, Homo Sapiens
SCLRTCMVV

SEQ ID NO: 667026 - protein, 9 aa, Homo Sapiens
AIILFYATS

SEQ ID NO: 667027 - protein, 9 aa, Homo Sapiens
PLHYVTIMN

SEQ ID NO: 667028 - protein, 9 aa, Homo Sapiens
LNRDRMQYF

SEQ ID NO: 667029 - protein, 9 aa, Homo Sapiens
VETNPLIGS

SEQ ID NO: 667030 - protein, 9 aa, Homo Sapiens
GSSRHLTTR

SEQ ID NO: 667031 - protein, 9 aa, Homo Sapiens
AVQCSLGMR

SEQ ID NO: 667032 - protein, 9 aa, Homo Sapiens
LYAIFLSFS

SEQ ID NO: 667033 - protein, 9 aa, Homo Sapiens
ESSQKKKSL

SEQ ID NO: 667034 - protein, 9 aa, Homo Sapiens
LNELFAGFD

SEQ ID NO: 667035 - protein, 9 aa, Homo Sapiens
FRQTTTPLD

SEQ ID NO: 667036 - protein, 9 aa, Homo Sapiens
LCALVVFTL

SEQ ID NO: 667037 - protein, 9 aa, Homo Sapiens
TLRSGVIID

SEQ ID NO: 667038 - protein, 9 aa, Homo Sapiens
FPSQILLLS

SEQ ID NO: 667039 - protein, 9 aa, Homo Sapiens
PEPYAAACA

SEQ ID NO: 667040 - protein, 9 aa, Homo Sapiens
HQVRFASLL

SEQ ID NO: 667041 - protein, 9 aa, Homo Sapiens
SALPFSLLC

SEQ ID NO: 667042 - protein, 9 aa, Homo Sapiens
TRKGRGRKC

SEQ ID NO: 667043 - protein, 9 aa, Homo Sapiens
TCCRHSCCV

SEQ ID NO: 667044 - protein, 9 aa, Homo Sapiens
PEIRQAPPV

SEQ ID NO: 667045 - protein, 9 aa, Homo Sapiens
RLMKEVRVR

SEQ ID NO: 667046 - protein, 9 aa, Homo Sapiens
SSQKKKSLY

SEQ ID NO: 667047 - protein, 9 aa, Homo Sapiens
RSQEELRKK

SEQ ID NO: 667048 - protein, 9 aa, Homo Sapiens
GKGSPLKMS

SEQ ID NO: 667049 - protein, 9 aa, Homo Sapiens
SLWQTFLTI

SEQ ID NO: 667050 - protein, 9 aa, Homo Sapiens
RFRAIVSSV

SEQ ID NO: 667051 - protein, 9 aa, Homo Sapiens
PMASTTHQE

SEQ ID NO: 667052 - protein, 9 aa, Homo Sapiens
LPKDYKVIR

SEQ ID NO: 667053 - protein, 9 aa, Homo Sapiens
NSRPAPEVG

SEQ ID NO: 667054 - protein, 9 aa, Homo Sapiens
GHVTRSLCR

SEQ ID NO: 667055 - protein, 9 aa, Homo Sapiens
LRGGSGYHS

SEQ ID NO: 667056 - protein, 9 aa, Homo Sapiens
LIPHCQKKW

SEQ ID NO: 667057 - protein, 9 aa, Homo Sapiens
GIITNCDDM

SEQ ID NO: 667058 - protein, 9 aa, Homo Sapiens
LSSGENGVV

SEQ ID NO: 667059 - protein, 9 aa, Homo Sapiens
SLLQRTDGC

SEQ ID NO: 667060 - protein, 9 aa, Homo Sapiens
NQKVGELKD

SEQ ID NO: 667061 - protein, 9 aa, Homo Sapiens
FRRRWRRRM

SEQ ID NO: 667062 - protein, 9 aa, Homo Sapiens
TIDSSSVMV

SEQ ID NO: 667063 - protein, 9 aa, Homo Sapiens
RQTTTPLDY

SEQ ID NO: 667064 - protein, 9 aa, Homo Sapiens
QLQELQNLY

SEQ ID NO: 667065 - protein, 9 aa, Homo Sapiens
LKKHKSTSG

SEQ ID NO: 667066 - protein, 9 aa, Homo Sapiens
LIFYECSSY

SEQ ID NO: 667067 - protein, 9 aa, Homo Sapiens
IVKHDMEMV

SEQ ID NO: 667068 - protein, 9 aa, Homo Sapiens
RESRQRLVL

SEQ ID NO: 667069 - protein, 9 aa, Homo Sapiens
LSFKCNFSN

SEQ ID NO: 667070 - protein, 9 aa, Homo Sapiens
KPLQPHLVR

SEQ ID NO: 667071 - protein, 9 aa, Homo Sapiens
WGLLGQDEK

SEQ ID NO: 667072 - protein, 9 aa, Homo Sapiens
SCVSDIGYG

SEQ ID NO: 667073 - protein, 9 aa, Homo Sapiens
SSGRKPAAR

SEQ ID NO: 667074 - protein, 9 aa, Homo Sapiens
NLFLSSATP

SEQ ID NO: 667075 - protein, 9 aa, Homo Sapiens
FQGLRHEFT

SEQ ID NO: 667076 - protein, 9 aa, Homo Sapiens
IITNCDDME

SEQ ID NO: 667077 - protein, 9 aa, Homo Sapiens
SQKKKSLYF

SEQ ID NO: 667078 - protein, 9 aa, Homo Sapiens
SPKVSSQIR

SEQ ID NO: 667079 - protein, 9 aa, Homo Sapiens
CQSSGRKPA

SEQ ID NO: 667080 - protein, 9 aa, Homo Sapiens
AVQPQHRHE

SEQ ID NO: 667081 - protein, 9 aa, Homo Sapiens
FQNSRMKWK

SEQ ID NO: 667082 - protein, 9 aa, Homo Sapiens
EDPFRFALE

SEQ ID NO: 667083 - protein, 9 aa, Homo Sapiens
LPLIVKNIR

SEQ ID NO: 667084 - protein, 9 aa, Homo Sapiens
LSFSIMIEF

SEQ ID NO: 667085 - protein, 9 aa, Homo Sapiens
GFDKLAAEN

SEQ ID NO: 667086 - protein, 9 aa, Homo Sapiens
PAMAPKRKD

SEQ ID NO: 667087 - protein, 9 aa, Homo Sapiens
GGFTSSLLG

SEQ ID NO: 667088 - protein, 9 aa, Homo Sapiens
SKCLSLTAI

SEQ ID NO: 667089 - protein, 9 aa, Homo Sapiens
RYKLQDFSN

SEQ ID NO: 667090 - protein, 9 aa, Homo Sapiens
GKKDEKNGK

SEQ ID NO: 667091 - protein, 9 aa, Homo Sapiens
VTSAENSHI

SEQ ID NO: 667092 - protein, 9 aa, Homo Sapiens
LSFTPADCS

SEQ ID NO: 667093 - protein, 9 aa, Homo Sapiens
RELYDNCPD

SEQ ID NO: 667094 - protein, 9 aa, Homo Sapiens
LYAWANDDI

SEQ ID NO: 667095 - protein, 9 aa, Homo Sapiens
KCRFRAIVS

SEQ ID NO: 667096 - protein, 9 aa, Homo Sapiens
HVFAAVCTR

SEQ ID NO: 667097 - protein, 9 aa, Homo Sapiens
VAMDTTLPL

SEQ ID NO: 667098 - protein, 9 aa, Homo Sapiens
QLNTTLQKA

SEQ ID NO: 667099 - protein, 9 aa, Homo Sapiens
GVVTLRSGV

SEQ ID NO: 667100 - protein, 9 aa, Homo Sapiens
RQCLLRCPP

SEQ ID NO: 667101 - protein, 9 aa, Homo Sapiens
QKVQEQVHS

SEQ ID NO: 667102 - protein, 9 aa, Homo Sapiens
AYPKLFNSV

SEQ ID NO: 667103 - protein, 9 aa, Homo Sapiens
GPGHGQVTA

SEQ ID NO: 667104 - protein, 9 aa, Homo Sapiens
IHQREQKER

SEQ ID NO: 667105 - protein, 9 aa, Homo Sapiens
FPFHLAPAL

SEQ ID NO: 667106 - protein, 9 aa, Homo Sapiens
AMFMAPSQM

SEQ ID NO: 667107 - protein, 9 aa, Homo Sapiens
LGAVFPGTI

SEQ ID NO: 667108 - protein, 9 aa, Homo Sapiens
LQSGETSKT

SEQ ID NO: 667109 - protein, 9 aa, Homo Sapiens
LNIVKLYVH

SEQ ID NO: 667110 - protein, 9 aa, Homo Sapiens
AVVRSYTAC

SEQ ID NO: 667111 - protein, 9 aa, Homo Sapiens
CCETSDPFS

SEQ ID NO: 667112 - protein, 9 aa, Homo Sapiens
MKAEEAHQH

SEQ ID NO: 667113 - protein, 9 aa, Homo Sapiens
SLGEAEGEL

SEQ ID NO: 667114 - protein, 9 aa, Homo Sapiens
QPCLWPDPS

SEQ ID NO: 667115 - protein, 9 aa, Homo Sapiens
SSVTMRKSQ

SEQ ID NO: 667116 - protein, 9 aa, Homo Sapiens
PIDIVYTWV

SEQ ID NO: 667117 - protein, 9 aa, Homo Sapiens
VLPSVSQSA

SEQ ID NO: 667118 - protein, 9 aa, Homo Sapiens
LFLYFRPSS

SEQ ID NO: 667119 - protein, 9 aa, Homo Sapiens
TLANCVVST

SEQ ID NO: 667120 - protein, 9 aa, Homo Sapiens
IVYTWVNGT

SEQ ID NO: 667121 - protein, 9 aa, Homo Sapiens
VSINRSLES

SEQ ID NO: 667122 - protein, 9 aa, Homo Sapiens
DPIRKKLGR

SEQ ID NO: 667123 - protein, 9 aa, Homo Sapiens
TSTNTVANT

SEQ ID NO: 667124 - protein, 9 aa, Homo Sapiens
EEPSSEEAV

SEQ ID NO: 667125 - protein, 9 aa, Homo Sapiens
AMAPKRKDG

SEQ ID NO: 667126 - protein, 9 aa, Homo Sapiens
PVAMRLHPA

SEQ ID NO: 667127 - protein, 9 aa, Homo Sapiens
SSEEAVAPE

SEQ ID NO: 667128 - protein, 9 aa, Homo Sapiens
PADCSGTAE

SEQ ID NO: 667129 - protein, 9 aa, Homo Sapiens
LRTCMVVAE

SEQ ID NO: 667130 - protein, 9 aa, Homo Sapiens
LQNGYAPCT

SEQ ID NO: 667131 - protein, 9 aa, Homo Sapiens
FSVIARRDS

SEQ ID NO: 667132 - protein, 9 aa, Homo Sapiens
ATLSLNSQL

SEQ ID NO: 667133 - protein, 9 aa, Homo Sapiens
DDGTLMIRK

SEQ ID NO: 667134 - protein, 9 aa, Homo Sapiens
KYQYLYTVE

SEQ ID NO: 667135 - protein, 9 aa, Homo Sapiens
HESMRRFLE

SEQ ID NO: 667136 - protein, 9 aa, Homo Sapiens
KAYKEIRVA

SEQ ID NO: 667137 - protein, 9 aa, Homo Sapiens
AESSQKKKS

SEQ ID NO: 667138 - protein, 9 aa, Homo Sapiens
PFHLAPALD

SEQ ID NO: 667139 - protein, 9 aa, Homo Sapiens
RTTYGFWAL

SEQ ID NO: 667140 - protein, 9 aa, Homo Sapiens
MFMAPSQMA

SEQ ID NO: 667141 - protein, 9 aa, Homo Sapiens
NECCETSDP

SEQ ID NO: 667142 - protein, 9 aa, Homo Sapiens
PLQNGYAPC

SEQ ID NO: 667143 - protein, 9 aa, Homo Sapiens
AQAVLPSVS

SEQ ID NO: 667144 - protein, 9 aa, Homo Sapiens
WQPLQEDEA

SEQ ID NO: 667145 - protein, 9 aa, Homo Sapiens
NQLSDYYEK

SEQ ID NO: 667146 - protein, 9 aa, Homo Sapiens
LLFLYFRPS

SEQ ID NO: 667147 - protein, 9 aa, Homo Sapiens
GAAGRGREG

SEQ ID NO: 667148 - protein, 9 aa, Homo Sapiens
QKLNVIHNK

SEQ ID NO: 667149 - protein, 9 aa, Homo Sapiens
IYLLCCHQK

SEQ ID NO: 667150 - protein, 9 aa, Homo Sapiens
LLRRATIKR

SEQ ID NO: 667151 - protein, 9 aa, Homo Sapiens
LRHEFTAEC

SEQ ID NO: 667152 - protein, 9 aa, Homo Sapiens
AAPQSLCAF

SEQ ID NO: 667153 - protein, 9 aa, Homo Sapiens
AMTFTHPSR

SEQ ID NO: 667154 - protein, 9 aa, Homo Sapiens
AYKEIRVAN

SEQ ID NO: 667155 - protein, 9 aa, Homo Sapiens
PSHFLYWSG

SEQ ID NO: 667156 - protein, 9 aa, Homo Sapiens
KLWCAACVN

SEQ ID NO: 667157 - protein, 9 aa, Homo Sapiens
HQAGLCLSL

SEQ ID NO: 667158 - protein, 9 aa, Homo Sapiens
SVIARRDSF

SEQ ID NO: 667159 - protein, 9 aa, Homo Sapiens
RERLRVLDI

SEQ ID NO: 667160 - protein, 9 aa, Homo Sapiens
VTENMSTVS

SEQ ID NO: 667161 - protein, 9 aa, Homo Sapiens
LLRPPRCFR

SEQ ID NO: 667162 - protein, 9 aa, Homo Sapiens
HNTIMCEKP

SEQ ID NO: 667163 - protein, 9 aa, Homo Sapiens
LCVISLHGF

SEQ ID NO: 667164 - protein, 9 aa, Homo Sapiens
MKKGYNPTG

SEQ ID NO: 667165 - protein, 9 aa, Homo Sapiens
SSTALLLQC

SEQ ID NO: 667166 - protein, 9 aa, Homo Sapiens
PLVTYELHG

SEQ ID NO: 667167 - protein, 9 aa, Homo Sapiens
HEWTVLQAV

SEQ ID NO: 667168 - protein, 9 aa, Homo Sapiens
LMSLLEKVL

SEQ ID NO: 667169 - protein, 9 aa, Homo Sapiens
SKLRRLSKE

SEQ ID NO: 667170 - protein, 9 aa, Homo Sapiens
DALKDEEKA

SEQ ID NO: 667171 - protein, 9 aa, Homo Sapiens
DFQGSAIPK

SEQ ID NO: 667172 - protein, 9 aa, Homo Sapiens
EAAPFVERT

SEQ ID NO: 667173 - protein, 9 aa, Homo Sapiens
QVTATSWAR

SEQ ID NO: 667174 - protein, 9 aa, Homo Sapiens
ALKPQVSVE

SEQ ID NO: 667175 - protein, 9 aa, Homo Sapiens
VPAVPYSRE

SEQ ID NO: 667176 - protein, 9 aa, Homo Sapiens
DGWNGNAFE

SEQ ID NO: 667177 - protein, 9 aa, Homo Sapiens
GTEPKPQGV

SEQ ID NO: 667178 - protein, 9 aa, Homo Sapiens
PHGKRQRSV

SEQ ID NO: 667179 - protein, 9 aa, Homo Sapiens
PISLLQSCS

SEQ ID NO: 667180 - protein, 9 aa, Homo Sapiens
VLDINEAFK

SEQ ID NO: 667181 - protein, 9 aa, Homo Sapiens
KLQDFSNQL

SEQ ID NO: 667182 - protein, 9 aa, Homo Sapiens
PLPPPSSPS

SEQ ID NO: 667183 - protein, 9 aa, Homo Sapiens
NAFEIWLGS

SEQ ID NO: 667184 - protein, 9 aa, Homo Sapiens
HLQLAIRNN

SEQ ID NO: 667185 - protein, 9 aa, Homo Sapiens
TSKTDASFH

SEQ ID NO: 667186 - protein, 9 aa, Homo Sapiens
TGNSPRRTD

SEQ ID NO: 667187 - protein, 9 aa, Homo Sapiens
KGRGRKCSA

SEQ ID NO: 667188 - protein, 9 aa, Homo Sapiens
DEQLGRLLI

SEQ ID NO: 667189 - protein, 9 aa, Homo Sapiens
LLARELYDN

SEQ ID NO: 667190 - protein, 9 aa, Homo Sapiens
EPYAAACAN

SEQ ID NO: 667191 - protein, 9 aa, Homo Sapiens
LARELYDNC

SEQ ID NO: 667192 - protein, 9 aa, Homo Sapiens
YGTVSCLAP

SEQ ID NO: 667193 - protein, 9 aa, Homo Sapiens
NELKQCGEA

SEQ ID NO: 667194 - protein, 9 aa, Homo Sapiens
KGSVTLTEI

SEQ ID NO: 667195 - protein, 9 aa, Homo Sapiens
DTDIALNTC

SEQ ID NO: 667196 - protein, 9 aa, Homo Sapiens
VPLVQATFR

SEQ ID NO: 667197 - protein, 9 aa, Homo Sapiens
AIPKAMQKL

SEQ ID NO: 667198 - protein, 9 aa, Homo Sapiens
HLLMPDNQN

SEQ ID NO: 667199 - protein, 9 aa, Homo Sapiens
HVAVDVVQA

SEQ ID NO: 667200 - protein, 9 aa, Homo Sapiens
DRMQYFTGN

SEQ ID NO: 667201 - protein, 9 aa, Homo Sapiens
CGVQLDHRH

SEQ ID NO: 667202 - protein, 9 aa, Homo Sapiens
INQLCSKTK

SEQ ID NO: 667203 - protein, 9 aa, Homo Sapiens
SSKSTILYS

SEQ ID NO: 667204 - protein, 9 aa, Homo Sapiens
RKSAKEVID

SEQ ID NO: 667205 - protein, 9 aa, Homo Sapiens
FPSRALQRA

SEQ ID NO: 667206 - protein, 9 aa, Homo Sapiens
KLRLQDLAD

SEQ ID NO: 667207 - protein, 9 aa, Homo Sapiens
YCAIAFIHG

SEQ ID NO: 667208 - protein, 9 aa, Homo Sapiens
ESKLQKLKQ

SEQ ID NO: 667209 - protein, 9 aa, Homo Sapiens
QDTPEFLID

SEQ ID NO: 667210 - protein, 9 aa, Homo Sapiens
RGVTINPTV

SEQ ID NO: 667211 - protein, 9 aa, Homo Sapiens
STPKRPSTL

SEQ ID NO: 667212 - protein, 9 aa, Homo Sapiens
PGSGICVDC

SEQ ID NO: 667213 - protein, 9 aa, Homo Sapiens
YSSPSSTTN

SEQ ID NO: 667214 - protein, 9 aa, Homo Sapiens
PSINVKCVQ

SEQ ID NO: 667215 - protein, 9 aa, Homo Sapiens
CPSINVKCV

SEQ ID NO: 667216 - protein, 9 aa, Homo Sapiens
CQIKVFKAK

SEQ ID NO: 667217 - protein, 9 aa, Homo Sapiens
KDIPFKTQR

SEQ ID NO: 667218 - protein, 9 aa, Homo Sapiens
SRKSAKEVI

SEQ ID NO: 667219 - protein, 9 aa, Homo Sapiens
RCLPGSGIC

SEQ ID NO: 667220 - protein, 9 aa, Homo Sapiens
TLAGMHHFA

SEQ ID NO: 667221 - protein, 9 aa, Homo Sapiens
FVCPSINVK

SEQ ID NO: 667222 - protein, 9 aa, Homo Sapiens
GFSCEWKIQ

SEQ ID NO: 667223 - protein, 9 aa, Homo Sapiens
EKQKALKII

SEQ ID NO: 667224 - protein, 9 aa, Homo Sapiens
GSTDSKLKF

SEQ ID NO: 667225 - protein, 9 aa, Homo Sapiens
LSDSHCSPS

SEQ ID NO: 667226 - protein, 9 aa, Homo Sapiens
DRSLRVTFP

SEQ ID NO: 667227 - protein, 9 aa, Homo Sapiens
LFEMRDISL

SEQ ID NO: 667228 - protein, 9 aa, Homo Sapiens
LQEELQWRR

SEQ ID NO: 667229 - protein, 9 aa, Homo Sapiens
LQRAFALYN

SEQ ID NO: 667230 - protein, 9 aa, Homo Sapiens
LGQSKMNCD

SEQ ID NO: 667231 - protein, 9 aa, Homo Sapiens
PRRKLRLQD

SEQ ID NO: 667232 - protein, 9 aa, Homo Sapiens
QPHRRTKIT

SEQ ID NO: 667233 - protein, 9 aa, Homo Sapiens
GNAGMSSVT

SEQ ID NO: 667234 - protein, 9 aa, Homo Sapiens
NGNAGMSSV

SEQ ID NO: 667235 - protein, 9 aa, Homo Sapiens
DTPEFLIDQ

SEQ ID NO: 667236 - protein, 9 aa, Homo Sapiens
PDKVIILWI

SEQ ID NO: 667237 - protein, 9 aa, Homo Sapiens
YDEPPMDMQ

SEQ ID NO: 667238 - protein, 9 aa, Homo Sapiens
LAISQSVKE

SEQ ID NO: 667239 - protein, 9 aa, Homo Sapiens
DYNYMWAQC

SEQ ID NO: 667240 - protein, 9 aa, Homo Sapiens
SQFGHDFET

SEQ ID NO: 667241 - protein, 9 aa, Homo Sapiens
KACDLKCYS

SEQ ID NO: 667242 - protein, 9 aa, Homo Sapiens
YVPIITLAG

SEQ ID NO: 667243 - protein, 9 aa, Homo Sapiens
RGYTAEIVC

SEQ ID NO: 667244 - protein, 9 aa, Homo Sapiens
RVTFPLPSS

SEQ ID NO: 667245 - protein, 9 aa, Homo Sapiens
PSTLQTVST

SEQ ID NO: 667246 - protein, 9 aa, Homo Sapiens
SCEWKIQIF

SEQ ID NO: 667247 - protein, 9 aa, Homo Sapiens
VYGLGQSKM

SEQ ID NO: 667248 - protein, 9 aa, Homo Sapiens
DLKCYSSPS

SEQ ID NO: 667249 - protein, 9 aa, Homo Sapiens
VLMVYGLGQ

SEQ ID NO: 667250 - protein, 9 aa, Homo Sapiens
FLIDQGHAK

SEQ ID NO: 667251 - protein, 9 aa, Homo Sapiens
IELQKIISK

SEQ ID NO: 667252 - protein, 9 aa, Homo Sapiens
DKSDLDTEG

SEQ ID NO: 667253 - protein, 9 aa, Homo Sapiens
CVNEEQLEA

SEQ ID NO: 667254 - protein, 9 aa, Homo Sapiens
FRGYTAEIV

SEQ ID NO: 667255 - protein, 9 aa, Homo Sapiens
ERGKKMVEE

SEQ ID NO: 667256 - protein, 9 aa, Homo Sapiens
AISQSVKET

SEQ ID NO: 667257 - protein, 9 aa, Homo Sapiens
FGHDFETTY

SEQ ID NO: 667258 - protein, 9 aa, Homo Sapiens
FSQPPFDKL

SEQ ID NO: 667259 - protein, 9 aa, Homo Sapiens
FSCEWKIQI

SEQ ID NO: 667260 - protein, 9 aa, Homo Sapiens
FLFGVIYCA

SEQ ID NO: 667261 - protein, 9 aa, Homo Sapiens
SINVKCVQY

SEQ ID NO: 667262 - protein, 9 aa, Homo Sapiens
HPDKVIILW

SEQ ID NO: 667263 - protein, 9 aa, Homo Sapiens
TERGKKMVE

SEQ ID NO: 667264 - protein, 9 aa, Homo Sapiens
RKLRIFSQP

SEQ ID NO: 667265 - protein, 9 aa, Homo Sapiens
CEMCQNSFI

SEQ ID NO: 667266 - protein, 9 aa, Homo Sapiens
FPNPRRKLR

SEQ ID NO: 667267 - protein, 9 aa, Homo Sapiens
NHSLSDVRC

SEQ ID NO: 667268 - protein, 9 aa, Homo Sapiens
RKLRLQDLA

SEQ ID NO: 667269 - protein, 9 aa, Homo Sapiens
MGSTDSKLK

SEQ ID NO: 667270 - protein, 9 aa, Homo Sapiens
PLPSQFGHD

SEQ ID NO: 667271 - protein, 9 aa, Homo Sapiens
PEFLIDQGH

SEQ ID NO: 667272 - protein, 9 aa, Homo Sapiens
FGVIYCAIA

SEQ ID NO: 667273 - protein, 9 aa, Homo Sapiens
ELQWRRTFL

SEQ ID NO: 667274 - protein, 9 aa, Homo Sapiens
EWKIQIFLF

SEQ ID NO: 667275 - protein, 9 aa, Homo Sapiens
IKVFKAKGA

SEQ ID NO: 667276 - protein, 9 aa, Homo Sapiens
HRRTKITFE

SEQ ID NO: 667277 - protein, 9 aa, Homo Sapiens
SQICCNGVG

SEQ ID NO: 667278 - protein, 9 aa, Homo Sapiens
IDKLLELHV

SEQ ID NO: 667279 - protein, 9 aa, Homo Sapiens
QKLKETLGN

SEQ ID NO: 667280 - protein, 9 aa, Homo Sapiens
VRCRTTFYT

SEQ ID NO: 667281 - protein, 9 aa, Homo Sapiens
FFDLHETGM

SEQ ID NO: 667282 - protein, 9 aa, Homo Sapiens
SQRKALLHI

SEQ ID NO: 667283 - protein, 9 aa, Homo Sapiens
SLSDVRCRT

SEQ ID NO: 667284 - protein, 9 aa, Homo Sapiens
GSGICVDCQ

SEQ ID NO: 667285 - protein, 9 aa, Homo Sapiens
TDSKLKFRK

SEQ ID NO: 667286 - protein, 9 aa, Homo Sapiens
DRCLPGSGI

SEQ ID NO: 667287 - protein, 9 aa, Homo Sapiens
YEDRDPLQV

SEQ ID NO: 667288 - protein, 9 aa, Homo Sapiens
DVRCRTTFY

SEQ ID NO: 667289 - protein, 9 aa, Homo Sapiens
QWRRTFLHA

SEQ ID NO: 667290 - protein, 9 aa, Homo Sapiens
SQSVKETRI

SEQ ID NO: 667291 - protein, 9 aa, Homo Sapiens
LDRDKSDLD

SEQ ID NO: 667292 - protein, 9 aa, Homo Sapiens
HIGEPKSHL

SEQ ID NO: 667293 - protein, 9 aa, Homo Sapiens
AGMHHFAKH

SEQ ID NO: 667294 - protein, 9 aa, Homo Sapiens
LQGFSCEWK

SEQ ID NO: 667295 - protein, 9 aa, Homo Sapiens
EAATTYVQN

SEQ ID NO: 667296 - protein, 9 aa, Homo Sapiens
ISQSVKETR

SEQ ID NO: 667297 - protein, 9 aa, Homo Sapiens
HSLSDVRCR

SEQ ID NO: 667298 - protein, 9 aa, Homo Sapiens
VNEEQLEAE

SEQ ID NO: 667299 - protein, 9 aa, Homo Sapiens
QEITERGKK

SEQ ID NO: 667300 - protein, 9 aa, Homo Sapiens
RLHFERDSK

SEQ ID NO: 667301 - protein, 9 aa, Homo Sapiens
AKGADRKQK

SEQ ID NO: 667302 - protein, 9 aa, Homo Sapiens
EEQLEAEVG

SEQ ID NO: 667303 - protein, 9 aa, Homo Sapiens
YNYMWAQCF

SEQ ID NO: 667304 - protein, 9 aa, Homo Sapiens
KLKQSLSFK

SEQ ID NO: 667305 - protein, 9 aa, Homo Sapiens
RPRPQDSQR

SEQ ID NO: 667306 - protein, 9 aa, Homo Sapiens
VPIITLAGM

SEQ ID NO: 667307 - protein, 9 aa, Homo Sapiens
VIYCAIAFI

SEQ ID NO: 667308 - protein, 9 aa, Homo Sapiens
NQPHRRTKI

SEQ ID NO: 667309 - protein, 9 aa, Homo Sapiens
LHFERDSKE

SEQ ID NO: 667310 - protein, 9 aa, Homo Sapiens
LKFRKAVIQ

SEQ ID NO: 667311 - protein, 9 aa, Homo Sapiens
ERDSKEEVE

SEQ ID NO: 667312 - protein, 9 aa, Homo Sapiens
MRDISLIKQ

SEQ ID NO: 667313 - protein, 9 aa, Homo Sapiens
DEPPMDMQF

SEQ ID NO: 667314 - protein, 9 aa, Homo Sapiens
KALKIILTC

SEQ ID NO: 667315 - protein, 9 aa, Homo Sapiens
EITERGKKM

SEQ ID NO: 667316 - protein, 9 aa, Homo Sapiens
TLQTVSTPA

SEQ ID NO: 667317 - protein, 9 aa, Homo Sapiens
LLFEMRDIS

SEQ ID NO: 667318 - protein, 9 aa, Homo Sapiens
HALSDSHCS

SEQ ID NO: 667319 - protein, 9 aa, Homo Sapiens
TFPLPSSVP

SEQ ID NO: 667320 - protein, 9 aa, Homo Sapiens
HCSPSSTSF

SEQ ID NO: 667321 - protein, 9 aa, Homo Sapiens
LIPKSQICC

SEQ ID NO: 667322 - protein, 9 aa, Homo Sapiens
VIDKLLELH

SEQ ID NO: 667323 - protein, 9 aa, Homo Sapiens
LHETGMFKK

SEQ ID NO: 667324 - protein, 9 aa, Homo Sapiens
MCQNSFIDS

SEQ ID NO: 667325 - protein, 9 aa, Homo Sapiens
ERPRPQDSQ

SEQ ID NO: 667326 - protein, 9 aa, Homo Sapiens
VIELQKIIS

SEQ ID NO: 667327 - protein, 9 aa, Homo Sapiens
LQKLKQSLS

SEQ ID NO: 667328 - protein, 9 aa, Homo Sapiens
SHALSDSHC

SEQ ID NO: 667329 - protein, 9 aa, Homo Sapiens
SKLQKLKQS

SEQ ID NO: 667330 - protein, 9 aa, Homo Sapiens
NEEQLEAEV

SEQ ID NO: 667331 - protein, 9 aa, Homo Sapiens
SLSKNQSLL

SEQ ID NO: 667332 - protein, 9 aa, Homo Sapiens
LDTEGLLFS

SEQ ID NO: 667333 - protein, 9 aa, Homo Sapiens
GYTAEIVCL

SEQ ID NO: 667334 - protein, 9 aa, Homo Sapiens
VTFPLPSSV

SEQ ID NO: 667335 - protein, 9 aa, Homo Sapiens
KVFKAKGAD

SEQ ID NO: 667336 - protein, 9 aa, Homo Sapiens
EVIDKLLEL

SEQ ID NO: 667337 - protein, 9 aa, Homo Sapiens
YDSNQPHRR

SEQ ID NO: 667338 - protein, 9 aa, Homo Sapiens
IQEITERGK

SEQ ID NO: 667339 - protein, 9 aa, Homo Sapiens
TQRSHGSQG

SEQ ID NO: 667340 - protein, 9 aa, Homo Sapiens
NALNSLSKN

SEQ ID NO: 667341 - protein, 9 aa, Homo Sapiens
RRKLRLQDL

SEQ ID NO: 667342 - protein, 9 aa, Homo Sapiens
TTYVQNQSE

SEQ ID NO: 667343 - protein, 9 aa, Homo Sapiens
ACDLKCYSS

SEQ ID NO: 667344 - protein, 9 aa, Homo Sapiens
CYSSPSSTT

SEQ ID NO: 667345 - protein, 9 aa, Homo Sapiens
QRSHGSQGA

SEQ ID NO: 667346 - protein, 9 aa, Homo Sapiens
SNCVNEEQL

SEQ ID NO: 667347 - protein, 9 aa, Homo Sapiens
SDLDTEGLL

SEQ ID NO: 667348 - protein, 9 aa, Homo Sapiens
CEWKIQIFL

SEQ ID NO: 667349 - protein, 9 aa, Homo Sapiens
IYEDRDPLQ

SEQ ID NO: 667350 - protein, 9 aa, Homo Sapiens
CDLKCYSSP

SEQ ID NO: 667351 - protein, 9 aa, Homo Sapiens
VIILWILWQ

SEQ ID NO: 667352 - protein, 9 aa, Homo Sapiens
WRKFVCPSI

SEQ ID NO: 667353 - protein, 9 aa, Homo Sapiens
YTAEIVCLS

SEQ ID NO: 667354 - protein, 9 aa, Homo Sapiens
GVTINPTVD

SEQ ID NO: 667355 - protein, 9 aa, Homo Sapiens
ELIPKSQIC

SEQ ID NO: 667356 - protein, 9 aa, Homo Sapiens
GDTIFRSEN

SEQ ID NO: 667357 - protein, 9 aa, Homo Sapiens
KEEVERRKR

SEQ ID NO: 667358 - protein, 9 aa, Homo Sapiens
TPEFLIDQG

SEQ ID NO: 667359 - protein, 9 aa, Homo Sapiens
KVIELQKII

SEQ ID NO: 667360 - protein, 9 aa, Homo Sapiens
YMWAQCFEI

SEQ ID NO: 667361 - protein, 9 aa, Homo Sapiens
GLGQSKMNC

SEQ ID NO: 667362 - protein, 9 aa, Homo Sapiens
DSNQPHRRT

SEQ ID NO: 667363 - protein, 9 aa, Homo Sapiens
RPSTLQTVS

SEQ ID NO: 667364 - protein, 9 aa, Homo Sapiens
PTSHIGEPK

SEQ ID NO: 667365 - protein, 9 aa, Homo Sapiens
LEAEVGISQ

SEQ ID NO: 667366 - protein, 9 aa, Homo Sapiens
IYDEPPMDM

SEQ ID NO: 667367 - protein, 9 aa, Homo Sapiens
PKRPSTLQT

SEQ ID NO: 667368 - protein, 9 aa, Homo Sapiens
QPPFDKLEQ

SEQ ID NO: 667369 - protein, 9 aa, Homo Sapiens
SVKETRIRA

SEQ ID NO: 667370 - protein, 9 aa, Homo Sapiens
DPLQVSISR

SEQ ID NO: 667371 - protein, 9 aa, Homo Sapiens
MFKKHLLLD

SEQ ID NO: 667372 - protein, 9 aa, Homo Sapiens
PSFPNPRRK

SEQ ID NO: 667373 - protein, 9 aa, Homo Sapiens
FERDSKEEV

SEQ ID NO: 667374 - protein, 9 aa, Homo Sapiens
IFSQPPFDK

SEQ ID NO: 667375 - protein, 9 aa, Homo Sapiens
LQWRRTFLH

SEQ ID NO: 667376 - protein, 9 aa, Homo Sapiens
QSLSFKTKS

SEQ ID NO: 667377 - protein, 9 aa, Homo Sapiens
KLQEELQWR

SEQ ID NO: 667378 - protein, 9 aa, Homo Sapiens
RDKSDLDTE

SEQ ID NO: 667379 - protein, 9 aa, Homo Sapiens
CQNSFIDSC

SEQ ID NO: 667380 - protein, 9 aa, Homo Sapiens
SFPNPRRKL

SEQ ID NO: 667381 - protein, 9 aa, Homo Sapiens
DEEKEEEEK

SEQ ID NO: 667382 - protein, 9 aa, Homo Sapiens
DSQRKALLH

SEQ ID NO: 667383 - protein, 9 aa, Homo Sapiens
MTPTSHIGE

SEQ ID NO: 667384 - protein, 9 aa, Homo Sapiens
SKEEVERRK

SEQ ID NO: 667385 - protein, 9 aa, Homo Sapiens
AKEVIDKLL

SEQ ID NO: 667386 - protein, 9 aa, Homo Sapiens
KRPSTLQTV

SEQ ID NO: 667387 - protein, 9 aa, Homo Sapiens
PSQFGHDFE

SEQ ID NO: 667388 - protein, 9 aa, Homo Sapiens
LNGNAGMSS

SEQ ID NO: 667389 - protein, 9 aa, Homo Sapiens
HTFRGYTAE

SEQ ID NO: 667390 - protein, 9 aa, Homo Sapiens
EPKSHLRKT

SEQ ID NO: 667391 - protein, 9 aa, Homo Sapiens
RSHGSQGAD

SEQ ID NO: 667392 - protein, 9 aa, Homo Sapiens
ATTYVQNQS

SEQ ID NO: 667393 - protein, 9 aa, Homo Sapiens
LQKIISKQS

SEQ ID NO: 667394 - protein, 9 aa, Homo Sapiens
DMQFEAGGG

SEQ ID NO: 667395 - protein, 9 aa, Homo Sapiens
QEELQWRRT

SEQ ID NO: 667396 - protein, 9 aa, Homo Sapiens
QKALKIILT

SEQ ID NO: 667397 - protein, 9 aa, Homo Sapiens
LLNGNAGMS

SEQ ID NO: 667398 - protein, 9 aa, Homo Sapiens
NSFIDSCAA

SEQ ID NO: 667399 - protein, 9 aa, Homo Sapiens
PVLMVYGLG

SEQ ID NO: 667400 - protein, 9 aa, Homo Sapiens
KEVIDKLLE

SEQ ID NO: 667401 - protein, 9 aa, Homo Sapiens
TGMFKKHLL

SEQ ID NO: 667402 - protein, 9 aa, Homo Sapiens
RSLRVTFPL

SEQ ID NO: 667403 - protein, 9 aa, Homo Sapiens
TPTSHIGEP

SEQ ID NO: 667404 - protein, 9 aa, Homo Sapiens
RPQDSQRKA

SEQ ID NO: 667405 - protein, 9 aa, Homo Sapiens
KTQRSHGSQ

SEQ ID NO: 667406 - protein, 9 aa, Homo Sapiens
SLKLLFEMR

SEQ ID NO: 667407 - protein, 9 aa, Homo Sapiens
SIDLGDTIF

SEQ ID NO: 667408 - protein, 9 aa, Homo Sapiens
DRDPLQVSI

SEQ ID NO: 667409 - protein, 9 aa, Homo Sapiens
MVYGLGQSK

SEQ ID NO: 667410 - protein, 9 aa, Homo Sapiens
YGLGQSKMN

SEQ ID NO: 667411 - protein, 9 aa, Homo Sapiens
KAKGADRKQ

SEQ ID NO: 667412 - protein, 9 aa, Homo Sapiens
EELQWRRTF

SEQ ID NO: 667413 - protein, 9 aa, Homo Sapiens
EPPMDMQFE

SEQ ID NO: 667414 - protein, 9 aa, Homo Sapiens
AFPSRALQR

SEQ ID NO: 667415 - protein, 9 aa, Homo Sapiens
PRPQDSQRK

SEQ ID NO: 667416 - protein, 9 aa, Homo Sapiens
FKAKGADRK

SEQ ID NO: 667417 - protein, 9 aa, Homo Sapiens
FDLHETGMF

SEQ ID NO: 667418 - protein, 9 aa, Homo Sapiens
GVIYCAIAF

SEQ ID NO: 667419 - protein, 9 aa, Homo Sapiens
DRDKSDLDT

SEQ ID NO: 667420 - protein, 9 aa, Homo Sapiens
NAGMSSVTL

SEQ ID NO: 667421 - protein, 9 aa, Homo Sapiens
HETGMFKKH

SEQ ID NO: 667422 - protein, 9 aa, Homo Sapiens
PMDMQFEAG

SEQ ID NO: 667423 - protein, 9 aa, Homo Sapiens
RDSKEEVER

SEQ ID NO: 667424 - protein, 9 aa, Homo Sapiens
FTDNLEAAT

SEQ ID NO: 667425 - protein, 9 aa, Homo Sapiens
KQKALKIIL

SEQ ID NO: 667426 - protein, 9 aa, Homo Sapiens
IFRSENQFV

SEQ ID NO: 667427 - protein, 9 aa, Homo Sapiens
YCEMCQNSF

SEQ ID NO: 667428 - protein, 9 aa, Homo Sapiens
IPFKTQRSH

SEQ ID NO: 667429 - protein, 9 aa, Homo Sapiens
LTQDTPEFL

SEQ ID NO: 667430 - protein, 9 aa, Homo Sapiens
PIITLAGMH

SEQ ID NO: 667431 - protein, 9 aa, Homo Sapiens
AKVIELQKI

SEQ ID NO: 667432 - protein, 9 aa, Homo Sapiens
QICCNGVGY

SEQ ID NO: 667433 - protein, 9 aa, Homo Sapiens
QGFSCEWKI

SEQ ID NO: 667434 - protein, 9 aa, Homo Sapiens
IWDRSLRVT

SEQ ID NO: 667435 - protein, 9 aa, Homo Sapiens
RALQRAFAL

SEQ ID NO: 667436 - protein, 9 aa, Homo Sapiens
RIFSQPPFD

SEQ ID NO: 667437 - protein, 9 aa, Homo Sapiens
QKLKQSLSF

SEQ ID NO: 667438 - protein, 9 aa, Homo Sapiens
SQPPFDKLE

SEQ ID NO: 667439 - protein, 9 aa, Homo Sapiens
IQLAISQSV

SEQ ID NO: 667440 - protein, 9 aa, Homo Sapiens
HFERDSKEE

SEQ ID NO: 667441 - protein, 9 aa, Homo Sapiens
LRIFSQPPF

SEQ ID NO: 667442 - protein, 9 aa, Homo Sapiens
IPKSQICCN

SEQ ID NO: 667443 - protein, 9 aa, Homo Sapiens
RKACDLKCY

SEQ ID NO: 667444 - protein, 9 aa, Homo Sapiens
GKKMVEEGH

SEQ ID NO: 667445 - protein, 9 aa, Homo Sapiens
MWAQCFEIT

SEQ ID NO: 667446 - protein, 9 aa, Homo Sapiens
NYMWAQCFE

SEQ ID NO: 667447 - protein, 9 aa, Homo Sapiens
RTKITFEED

SEQ ID NO: 667448 - protein, 9 aa, Homo Sapiens
HDFETTYDT

SEQ ID NO: 667449 - protein, 9 aa, Homo Sapiens
KEKLQEELQ

SEQ ID NO: 667450 - protein, 9 aa, Homo Sapiens
KCYSSPSST

SEQ ID NO: 667451 - protein, 9 aa, Homo Sapiens
KLQKLKQSL

SEQ ID NO: 667452 - protein, 9 aa, Homo Sapiens
LFGVIYCAI

SEQ ID NO: 667453 - protein, 9 aa, Homo Sapiens
KFRKAVIQL

SEQ ID NO: 667454 - protein, 9 aa, Homo Sapiens
SNQPHRRTK

SEQ ID NO: 667455 - protein, 9 aa, Homo Sapiens
TIFRSENQF

SEQ ID NO: 667456 - protein, 9 aa, Homo Sapiens
ELDRDKSDL

SEQ ID NO: 667457 - protein, 9 aa, Homo Sapiens
PNPRRKLRL

SEQ ID NO: 667458 - protein, 9 aa, Homo Sapiens
ALQRAFALY

SEQ ID NO: 667459 - protein, 9 aa, Homo Sapiens
DLDTEGLLF

SEQ ID NO: 667460 - protein, 9 aa, Homo Sapiens
KIISKQSRE

SEQ ID NO: 667461 - protein, 9 aa, Homo Sapiens
TELIPKSQI

SEQ ID NO: 667462 - protein, 9 aa, Homo Sapiens
KQSLSFKTK

SEQ ID NO: 667463 - protein, 9 aa, Homo Sapiens
NPRRKLRLQ

SEQ ID NO: 667464 - protein, 9 aa, Homo Sapiens
IILTCAGVF

SEQ ID NO: 667465 - protein, 9 aa, Homo Sapiens
QDYNYMWAQ

SEQ ID NO: 667466 - protein, 9 aa, Homo Sapiens
SDSHCSPSS

SEQ ID NO: 667467 - protein, 9 aa, Homo Sapiens
LEAATTYVQ

SEQ ID NO: 667468 - protein, 9 aa, Homo Sapiens
IRRGVTINP

SEQ ID NO: 667469 - protein, 9 aa, Homo Sapiens
TPKRPSTLQ

SEQ ID NO: 667470 - protein, 9 aa, Homo Sapiens
KFVCPSINV

SEQ ID NO: 667471 - protein, 9 aa, Homo Sapiens
ALNSLSKNQ

SEQ ID NO: 667472 - protein, 9 aa, Homo Sapiens
VSIDLGDTI

SEQ ID NO: 667473 - protein, 9 aa, Homo Sapiens
QSVKETRIR

SEQ ID NO: 667474 - protein, 9 aa, Homo Sapiens
TINPTVDDD

SEQ ID NO: 667475 - protein, 9 aa, Homo Sapiens
LAGMHHFAK

SEQ ID NO: 667476 - protein, 9 aa, Homo Sapiens
SAKEVIDKL

SEQ ID NO: 667477 - protein, 9 aa, Homo Sapiens
SHCSPSSTS

SEQ ID NO: 667478 - protein, 9 aa, Homo Sapiens
LKCYSSPSS

SEQ ID NO: 667479 - protein, 9 aa, Homo Sapiens
QKIISKQSR

SEQ ID NO: 667480 - protein, 9 aa, Homo Sapiens
MQFEAGGGY

SEQ ID NO: 667481 - protein, 9 aa, Homo Sapiens
TQDTPEFLI

SEQ ID NO: 667482 - protein, 9 aa, Homo Sapiens
DNLEAATTY

SEQ ID NO: 667483 - protein, 9 aa, Homo Sapiens
PPFDKLEQL

SEQ ID NO: 667484 - protein, 9 aa, Homo Sapiens
FEMRDISLI

SEQ ID NO: 667485 - protein, 9 aa, Homo Sapiens
LQTVSTPAP

SEQ ID NO: 667486 - protein, 9 aa, Homo Sapiens
KLLFEMRDI

SEQ ID NO: 667487 - protein, 9 aa, Homo Sapiens
RDPLQVSIS

SEQ ID NO: 667488 - protein, 9 aa, Homo Sapiens
KSQICCNGV

SEQ ID NO: 667489 - protein, 9 aa, Homo Sapiens
CLPGSGICV

SEQ ID NO: 667490 - protein, 9 aa, Homo Sapiens
ALKIILTCA

SEQ ID NO: 667491 - protein, 9 aa, Homo Sapiens
CAIAFIHGD

SEQ ID NO: 667492 - protein, 9 aa, Homo Sapiens
GMHHFAKHK

SEQ ID NO: 667493 - protein, 9 aa, Homo Sapiens
NSLSKNQSL

SEQ ID NO: 667494 - protein, 9 aa, Homo Sapiens
ALSDSHCSP

SEQ ID NO: 667495 - protein, 9 aa, Homo Sapiens
QFGHDFETT

SEQ ID NO: 667496 - protein, 9 aa, Homo Sapiens
EFLIDQGHA

SEQ ID NO: 667497 - protein, 9 aa, Homo Sapiens
EMRDISLIK

SEQ ID NO: 667498 - protein, 9 aa, Homo Sapiens
DLGDTIFRS

SEQ ID NO: 667499 - protein, 9 aa, Homo Sapiens
FKTQRSHGS

SEQ ID NO: 667500 - protein, 9 aa, Homo Sapiens
ETGMFKKHL

SEQ ID NO: 667501 - protein, 9 aa, Homo Sapiens
LPSQFGHDF

SEQ ID NO: 667502 - protein, 9 aa, Homo Sapiens
QIKVFKAKG

SEQ ID NO: 667503 - protein, 9 aa, Homo Sapiens
MDMQFEAGG

SEQ ID NO: 667504 - protein, 9 aa, Homo Sapiens
PHRRTKITF

SEQ ID NO: 667505 - protein, 9 aa, Homo Sapiens
QLAISQSVK

SEQ ID NO: 667506 - protein, 9 aa, Homo Sapiens
PFKTQRSHG

SEQ ID NO: 667507 - protein, 9 aa, Homo Sapiens
QNSFIDSCA

SEQ ID NO: 667508 - protein, 9 aa, Homo Sapiens
VKETRIRAM

SEQ ID NO: 667509 - protein, 9 aa, Homo Sapiens
DKVIILWIL

SEQ ID NO: 667510 - protein, 9 aa, Homo Sapiens
TDNLEAATT

SEQ ID NO: 667511 - protein, 9 aa, Homo Sapiens
CNALNSLSK

SEQ ID NO: 667512 - protein, 9 aa, Homo Sapiens
VTINPTVDD

SEQ ID NO: 667513 - protein, 9 aa, Homo Sapiens
VFKAKGADR

SEQ ID NO: 667514 - protein, 9 aa, Homo Sapiens
IWRKFVCPS

SEQ ID NO: 667515 - protein, 9 aa, Homo Sapiens
KIILTCAGV

SEQ ID NO: 667516 - protein, 9 aa, Homo Sapiens
STLQTVSTP

SEQ ID NO: 667517 - protein, 9 aa, Homo Sapiens
RSLKLLFEM

SEQ ID NO: 667518 - protein, 9 aa, Homo Sapiens
EKLQEELQW

SEQ ID NO: 667519 - protein, 9 aa, Homo Sapiens
DLHETGMFK

SEQ ID NO: 667520 - protein, 9 aa, Homo Sapiens
ITLAGMHHF

SEQ ID NO: 667521 - protein, 9 aa, Homo Sapiens
KSAKEVIDK

SEQ ID NO: 667522 - protein, 9 aa, Homo Sapiens
PKSQICCNG

SEQ ID NO: 667523 - protein, 9 aa, Homo Sapiens
CSPSSTSFL

SEQ ID NO: 667524 - protein, 9 aa, Homo Sapiens
EERPRPQDS

SEQ ID NO: 667525 - protein, 9 aa, Homo Sapiens
IDLGDTIFR

SEQ ID NO: 667526 - protein, 9 aa, Homo Sapiens
LKQSLSFKT

SEQ ID NO: 667527 - protein, 9 aa, Homo Sapiens
TSHIGEPKS

SEQ ID NO: 667528 - protein, 9 aa, Homo Sapiens
RGKKMVEEG

SEQ ID NO: 667529 - protein, 9 aa, Homo Sapiens
KLKFRKAVI

SEQ ID NO: 667530 - protein, 9 aa, Homo Sapiens
EQLEAEVGI

SEQ ID NO: 667531 - protein, 9 aa, Homo Sapiens
LNSLSKNQS

SEQ ID NO: 667532 - protein, 9 aa, Homo Sapiens
LSDVRCRTT

SEQ ID NO: 667533 - protein, 9 aa, Homo Sapiens
STDSKLKFR

SEQ ID NO: 667534 - protein, 9 aa, Homo Sapiens
SCQIKVFKA

SEQ ID NO: 667535 - protein, 9 aa, Homo Sapiens
NCVNEEQLE

SEQ ID NO: 667536 - protein, 9 aa, Homo Sapiens
LSKNQSLLR

SEQ ID NO: 667537 - protein, 9 aa, Homo Sapiens
LKLLFEMRD

SEQ ID NO: 667538 - protein, 9 aa, Homo Sapiens
KCYHTFRGY

SEQ ID NO: 667539 - protein, 9 aa, Homo Sapiens
PQDSQRKAL

SEQ ID NO: 667540 - protein, 9 aa, Homo Sapiens
PLQVSISRE

SEQ ID NO: 667541 - protein, 9 aa, Homo Sapiens
LAKVIELQK

SEQ ID NO: 667542 - protein, 9 aa, Homo Sapiens
SRALQRAFA

SEQ ID NO: 667543 - protein, 9 aa, Homo Sapiens
WFLFGVIYC

SEQ ID NO: 667544 - protein, 9 aa, Homo Sapiens
KVIILWILW

SEQ ID NO: 667545 - protein, 9 aa, Homo Sapiens
KEEEEKEEE

SEQ ID NO: 667546 - protein, 9 aa, Homo Sapiens
LGDTIFRSE

SEQ ID NO: 667547 - protein, 9 aa, Homo Sapiens
DTIFRSENQ

SEQ ID NO: 667548 - protein, 9 aa, Homo Sapiens
RKFVCPSIN

SEQ ID NO: 667549 - protein, 9 aa, Homo Sapiens
SGICVDCQH

SEQ ID NO: 667550 - protein, 9 aa, Homo Sapiens
SKNQSLLRM

SEQ ID NO: 667551 - protein, 9 aa, Homo Sapiens
SDVRCRTTF

SEQ ID NO: 667552 - protein, 9 aa, Homo Sapiens
ITERGKKMV

SEQ ID NO: 667553 - protein, 9 aa, Homo Sapiens
PPMDMQFEA

SEQ ID NO: 667554 - protein, 9 aa, Homo Sapiens
ICCNGVGYN

SEQ ID NO: 667555 - protein, 9 aa, Homo Sapiens
SKLKFRKAV

SEQ ID NO: 667556 - protein, 9 aa, Homo Sapiens
PSRALQRAF

SEQ ID NO: 667557 - protein, 9 aa, Homo Sapiens
LPGSGICVD

SEQ ID NO: 667558 - protein, 9 aa, Homo Sapiens
EAFPSRALQ

SEQ ID NO: 667559 - protein, 9 aa, Homo Sapiens
IYCAIAFIH

SEQ ID NO: 667560 - protein, 9 aa, Homo Sapiens
ELQKIISKQ

SEQ ID NO: 667561 - protein, 9 aa, Homo Sapiens
LYCEMCQNS

SEQ ID NO: 667562 - protein, 9 aa, Homo Sapiens
MQDYNYMWA

SEQ ID NO: 667563 - protein, 9 aa, Homo Sapiens
KSDLDTEGL

SEQ ID NO: 667564 - protein, 9 aa, Homo Sapiens
EMCQNSFID

SEQ ID NO: 667565 - protein, 9 aa, Homo Sapiens
SLLNGNAGM

SEQ ID NO: 667566 - protein, 9 aa, Homo Sapiens
GEKQKALKI

SEQ ID NO: 667567 - protein, 9 aa, Homo Sapiens
SDNHSLSDV

SEQ ID NO: 667568 - protein, 9 aa, Homo Sapiens
QLEAEVGIS

SEQ ID NO: 667569 - protein, 9 aa, Homo Sapiens
LIDQGHAKV

SEQ ID NO: 667570 - protein, 9 aa, Homo Sapiens
NLEAATTYV

SEQ ID NO: 667571 - protein, 9 aa, Homo Sapiens
LQVSISREQ

SEQ ID NO: 667572 - protein, 9 aa, Homo Sapiens
KLRIFSQPP

SEQ ID NO: 667573 - protein, 9 aa, Homo Sapiens
SFIDSCAAH

SEQ ID NO: 667574 - protein, 9 aa, Homo Sapiens
GGMQDYNYM

SEQ ID NO: 667575 - protein, 9 aa, Homo Sapiens
IGEPKSHLR

SEQ ID NO: 667576 - protein, 9 aa, Homo Sapiens
SHIGEPKSH

SEQ ID NO: 667577 - protein, 9 aa, Homo Sapiens
DNHSLSDVR

SEQ ID NO: 667578 - protein, 9 aa, Homo Sapiens
GICVDCQHN

SEQ ID NO: 667579 - protein, 9 aa, Homo Sapiens
RRGVTINPT

SEQ ID NO: 667580 - protein, 9 aa, Homo Sapiens
GMFKKHLLL

SEQ ID NO: 667581 - protein, 9 aa, Homo Sapiens
QRAFALYNL

SEQ ID NO: 667582 - protein, 9 aa, Homo Sapiens
DFETTYDTS

SEQ ID NO: 667583 - protein, 9 aa, Homo Sapiens
GMQDYNYMW

SEQ ID NO: 667584 - protein, 9 aa, Homo Sapiens
AATTYVQNQ

SEQ ID NO: 667585 - protein, 9 aa, Homo Sapiens
LMVYGLGQS

SEQ ID NO: 667586 - protein, 9 aa, Homo Sapiens
LRVTFPLPS

SEQ ID NO: 667587 - protein, 9 aa, Homo Sapiens
SLRVTFPLP

SEQ ID NO: 667588 - protein, 9 aa, Homo Sapiens
QIRRGVTIN

SEQ ID NO: 667589 - protein, 9 aa, Homo Sapiens
GEPKSHLRK

SEQ ID NO: 667590 - protein, 9 aa, Homo Sapiens
QDSQRKALL

SEQ ID NO: 667591 - protein, 9 aa, Homo Sapiens
KKMVEEGHF

SEQ ID NO: 667592 - protein, 9 aa, Homo Sapiens
KNQSLLRMP

SEQ ID NO: 667593 - protein, 9 aa, Homo Sapiens
GHDFETTYD

SEQ ID NO: 667594 - protein, 9 aa, Homo Sapiens
DSHCSPSST

SEQ ID NO: 667595 - protein, 9 aa, Homo Sapiens
YHTFRGYTA

SEQ ID NO: 667596 - protein, 9 aa, Homo Sapiens
WDRSLRVTF

SEQ ID NO: 667597 - protein, 9 aa, Homo Sapiens
DSKEEVERR

SEQ ID NO: 667598 - protein, 9 aa, Homo Sapiens
CYHTFRGYT

SEQ ID NO: 667599 - protein, 9 aa, Homo Sapiens
ICVDCQHNT

SEQ ID NO: 667600 - protein, 9 aa, Homo Sapiens
EDRDPLQVS

SEQ ID NO: 667601 - protein, 9 aa, Homo Sapiens
TFRGYTAEI

SEQ ID NO: 667602 - protein, 9 aa, Homo Sapiens
QVSISREQS

SEQ ID NO: 667603 - protein, 9 aa, Homo Sapiens
VCPSINVKC

SEQ ID NO: 667604 - protein, 9 aa, Homo Sapiens
IITLAGMHH

SEQ ID NO: 667605 - protein, 9 aa, Homo Sapiens
RRTKITFEE

SEQ ID NO: 667606 - protein, 9 aa, Homo Sapiens
GQSKMNCDR

SEQ ID NO: 667607 - protein, 9 aa, Homo Sapiens
DIPFKTQRS

SEQ ID NO: 667608 - protein, 9 aa, Homo Sapiens
LKIILTCAG

SEQ ID NO: 667609 - protein, 9 aa, Homo Sapiens
DSKLKFRKA

SEQ ID NO: 667610 - protein, 9 aa, Homo Sapiens
LEFKLCLDI

SEQ ID NO: 667611 - protein, 9 aa, Homo Sapiens
HTGDKPFKC

SEQ ID NO: 667612 - protein, 9 aa, Homo Sapiens
VTSRGTIRV

SEQ ID NO: 667613 - protein, 9 aa, Homo Sapiens
CKTEFTGLT

SEQ ID NO: 667614 - protein, 9 aa, Homo Sapiens
SVMASAPIP

SEQ ID NO: 667615 - protein, 9 aa, Homo Sapiens
RVPQRFSIP

SEQ ID NO: 667616 - protein, 9 aa, Homo Sapiens
LRNSPPHPK

SEQ ID NO: 667617 - protein, 9 aa, Homo Sapiens
FLGPSAAVQ

SEQ ID NO: 667618 - protein, 9 aa, Homo Sapiens
RKVQALKKS

SEQ ID NO: 667619 - protein, 9 aa, Homo Sapiens
LDILLKNTN

SEQ ID NO: 667620 - protein, 9 aa, Homo Sapiens
TAFSPSSSP

SEQ ID NO: 667621 - protein, 9 aa, Homo Sapiens
RGKTSLDTA

SEQ ID NO: 667622 - protein, 9 aa, Homo Sapiens
VCVSPEVPL

SEQ ID NO: 667623 - protein, 9 aa, Homo Sapiens
TAAATAATM

SEQ ID NO: 667624 - protein, 9 aa, Homo Sapiens
VGSAPAHTL

SEQ ID NO: 667625 - protein, 9 aa, Homo Sapiens
LDDETLRKV

SEQ ID NO: 667626 - protein, 9 aa, Homo Sapiens
DTEVVCAPL

SEQ ID NO: 667627 - protein, 9 aa, Homo Sapiens
YKVLKHVHP

SEQ ID NO: 667628 - protein, 9 aa, Homo Sapiens
DYPEGMRKI

SEQ ID NO: 667629 - protein, 9 aa, Homo Sapiens
RAVGGHLCQ

SEQ ID NO: 667630 - protein, 9 aa, Homo Sapiens
RRVPQRFSI

SEQ ID NO: 667631 - protein, 9 aa, Homo Sapiens
SPPHPKHMT

SEQ ID NO: 667632 - protein, 9 aa, Homo Sapiens
PDMSNSSTI

SEQ ID NO: 667633 - protein, 9 aa, Homo Sapiens
PWTSPDEAP

SEQ ID NO: 667634 - protein, 9 aa, Homo Sapiens
PSVMASAPI

SEQ ID NO: 667635 - protein, 9 aa, Homo Sapiens
GLREEPIDL

SEQ ID NO: 667636 - protein, 9 aa, Homo Sapiens
NYLEDRRVV

SEQ ID NO: 667637 - protein, 9 aa, Homo Sapiens
GTGLSLTAA

SEQ ID NO: 667638 - protein, 9 aa, Homo Sapiens
REATKAVRE

SEQ ID NO: 667639 - protein, 9 aa, Homo Sapiens
GDGNADELK

SEQ ID NO: 667640 - protein, 9 aa, Homo Sapiens
AYRELFEFF

SEQ ID NO: 667641 - protein, 9 aa, Homo Sapiens
ATAATMTSA

SEQ ID NO: 667642 - protein, 9 aa, Homo Sapiens
NRTYHFKAE

SEQ ID NO: 667643 - protein, 9 aa, Homo Sapiens
NSSTIEGCM

SEQ ID NO: 667644 - protein, 9 aa, Homo Sapiens
LIEFHRAYR

SEQ ID NO: 667645 - protein, 9 aa, Homo Sapiens
RVIDGTSGA

SEQ ID NO: 667646 - protein, 9 aa, Homo Sapiens
IKRASQLAY

SEQ ID NO: 667647 - protein, 9 aa, Homo Sapiens
GYQGTITCM

SEQ ID NO: 667648 - protein, 9 aa, Homo Sapiens
DDETLRKVQ

SEQ ID NO: 667649 - protein, 9 aa, Homo Sapiens
FLEEIQRLA

SEQ ID NO: 667650 - protein, 9 aa, Homo Sapiens
AFSPSSSPS

SEQ ID NO: 667651 - protein, 9 aa, Homo Sapiens
REVRRVPQR

SEQ ID NO: 667652 - protein, 9 aa, Homo Sapiens
LREVRRVPQ

SEQ ID NO: 667653 - protein, 9 aa, Homo Sapiens
FLMLSQPVP

SEQ ID NO: 667654 - protein, 9 aa, Homo Sapiens
VRLLRLRAV

SEQ ID NO: 667655 - protein, 9 aa, Homo Sapiens
YELDGLREE

SEQ ID NO: 667656 - protein, 9 aa, Homo Sapiens
RAYRELFEF

SEQ ID NO: 667657 - protein, 9 aa, Homo Sapiens
QLAYKMHSL

SEQ ID NO: 667658 - protein, 9 aa, Homo Sapiens
ATMTSAGVS

SEQ ID NO: 667659 - protein, 9 aa, Homo Sapiens
LFRPKGPPG

SEQ ID NO: 667660 - protein, 9 aa, Homo Sapiens
ASPVGSAPA

SEQ ID NO: 667661 - protein, 9 aa, Homo Sapiens
YECLCKTEF

SEQ ID NO: 667662 - protein, 9 aa, Homo Sapiens
LDLPGSCTT

SEQ ID NO: 667663 - protein, 9 aa, Homo Sapiens
EATKAVREA

SEQ ID NO: 667664 - protein, 9 aa, Homo Sapiens
LSAPAPWTS

SEQ ID NO: 667665 - protein, 9 aa, Homo Sapiens
SATFLEEIQ

SEQ ID NO: 667666 - protein, 9 aa, Homo Sapiens
STIVPNMLV

SEQ ID NO: 667667 - protein, 9 aa, Homo Sapiens
MVDRFGPSG

SEQ ID NO: 667668 - protein, 9 aa, Homo Sapiens
FSQVWQPLL

SEQ ID NO: 667669 - protein, 9 aa, Homo Sapiens
AEHPTWGDK

SEQ ID NO: 667670 - protein, 9 aa, Homo Sapiens
VDYVNATQK

SEQ ID NO: 667671 - protein, 9 aa, Homo Sapiens
CTTFDSQNP

SEQ ID NO: 667672 - protein, 9 aa, Homo Sapiens
ECLCKTEFT

SEQ ID NO: 667673 - protein, 9 aa, Homo Sapiens
KMVDRFGPS

SEQ ID NO: 667674 - protein, 9 aa, Homo Sapiens
HHHHTSQVA

SEQ ID NO: 667675 - protein, 9 aa, Homo Sapiens
KAEDEHECE

SEQ ID NO: 667676 - protein, 9 aa, Homo Sapiens
IEFHRAYRE

SEQ ID NO: 667677 - protein, 9 aa, Homo Sapiens
YVYKVLKHV

SEQ ID NO: 667678 - protein, 9 aa, Homo Sapiens
VADRYLLIN

SEQ ID NO: 667679 - protein, 9 aa, Homo Sapiens
PPLRNSPPH

SEQ ID NO: 667680 - protein, 9 aa, Homo Sapiens
RFFLMLSQP

SEQ ID NO: 667681 - protein, 9 aa, Homo Sapiens
LDTANDLGP

SEQ ID NO: 667682 - protein, 9 aa, Homo Sapiens
EEQLHQVKT

SEQ ID NO: 667683 - protein, 9 aa, Homo Sapiens
PQEKSPSGR

SEQ ID NO: 667684 - protein, 9 aa, Homo Sapiens
IRSFHCLEG

SEQ ID NO: 667685 - protein, 9 aa, Homo Sapiens
LTAALSAPA

SEQ ID NO: 667686 - protein, 9 aa, Homo Sapiens
TTFDSQNPE

SEQ ID NO: 667687 - protein, 9 aa, Homo Sapiens
HNRTYHFKA

SEQ ID NO: 667688 - protein, 9 aa, Homo Sapiens
GPSAAVQLF

SEQ ID NO: 667689 - protein, 9 aa, Homo Sapiens
EFKLCLDIL

SEQ ID NO: 667690 - protein, 9 aa, Homo Sapiens
KISVLPIFS

SEQ ID NO: 667691 - protein, 9 aa, Homo Sapiens
KVFDIEDTE

SEQ ID NO: 667692 - protein, 9 aa, Homo Sapiens
DRRVVHRDL

SEQ ID NO: 667693 - protein, 9 aa, Homo Sapiens
DSISSSSSA

SEQ ID NO: 667694 - protein, 9 aa, Homo Sapiens
EKSPSGRFH

SEQ ID NO: 667695 - protein, 9 aa, Homo Sapiens
SQVWQPLLR

SEQ ID NO: 667696 - protein, 9 aa, Homo Sapiens
LGPSAAVQL

SEQ ID NO: 667697 - protein, 9 aa, Homo Sapiens
PSGRFHFDY

SEQ ID NO: 667698 - protein, 9 aa, Homo Sapiens
GMRKISVLP

SEQ ID NO: 667699 - protein, 9 aa, Homo Sapiens
GNADELKEP

SEQ ID NO: 667700 - protein, 9 aa, Homo Sapiens
AVREALLSS

SEQ ID NO: 667701 - protein, 9 aa, Homo Sapiens
TLRKVQALK

SEQ ID NO: 667702 - protein, 9 aa, Homo Sapiens
AVVCVSPEV

SEQ ID NO: 667703 - protein, 9 aa, Homo Sapiens
LPGSCTTFD

SEQ ID NO: 667704 - protein, 9 aa, Homo Sapiens
LPGDGNADE

SEQ ID NO: 667705 - protein, 9 aa, Homo Sapiens
LHQVKTETE

SEQ ID NO: 667706 - protein, 9 aa, Homo Sapiens
KTETEGQKL

SEQ ID NO: 667707 - protein, 9 aa, Homo Sapiens
QVWQPLLRG

SEQ ID NO: 667708 - protein, 9 aa, Homo Sapiens
YSPVCGSGG

SEQ ID NO: 667709 - protein, 9 aa, Homo Sapiens
GLSLTAALS

SEQ ID NO: 667710 - protein, 9 aa, Homo Sapiens
VWQPLLRGL

SEQ ID NO: 667711 - protein, 9 aa, Homo Sapiens
EDRRVVHRD

SEQ ID NO: 667712 - protein, 9 aa, Homo Sapiens
RGTIRVIDG

SEQ ID NO: 667713 - protein, 9 aa, Homo Sapiens
MEDTQDKGL

SEQ ID NO: 667714 - protein, 9 aa, Homo Sapiens
GLFRPKGPP

SEQ ID NO: 667715 - protein, 9 aa, Homo Sapiens
PSGPPEKPE

SEQ ID NO: 667716 - protein, 9 aa, Homo Sapiens
VSVHVDNSQ

SEQ ID NO: 667717 - protein, 9 aa, Homo Sapiens
GWREATKAV

SEQ ID NO: 667718 - protein, 9 aa, Homo Sapiens
HTYIIPRSV

SEQ ID NO: 667719 - protein, 9 aa, Homo Sapiens
IAPPSVMAS

SEQ ID NO: 667720 - protein, 9 aa, Homo Sapiens
TANDLGPLP

SEQ ID NO: 667721 - protein, 9 aa, Homo Sapiens
PEGMRKISV

SEQ ID NO: 667722 - protein, 9 aa, Homo Sapiens
QDKGLVNRG

SEQ ID NO: 667723 - protein, 9 aa, Homo Sapiens
VSYECLCKT

SEQ ID NO: 667724 - protein, 9 aa, Homo Sapiens
KIRAVGGHL

SEQ ID NO: 667725 - protein, 9 aa, Homo Sapiens
GSIRSFHCL

SEQ ID NO: 667726 - protein, 9 aa, Homo Sapiens
YHFKAEDEH

SEQ ID NO: 667727 - protein, 9 aa, Homo Sapiens
CLDILLKNT

SEQ ID NO: 667728 - protein, 9 aa, Homo Sapiens
SQVASYGGA

SEQ ID NO: 667729 - protein, 9 aa, Homo Sapiens
YVNATQKQG

SEQ ID NO: 667730 - protein, 9 aa, Homo Sapiens
ASQLAYKMH

SEQ ID NO: 667731 - protein, 9 aa, Homo Sapiens
PKPFSQVWQ

SEQ ID NO: 667732 - protein, 9 aa, Homo Sapiens
TQKQGIYEE

SEQ ID NO: 667733 - protein, 9 aa, Homo Sapiens
EFHRAYREL

SEQ ID NO: 667734 - protein, 9 aa, Homo Sapiens
PLGLKAVVG

SEQ ID NO: 667735 - protein, 9 aa, Homo Sapiens
FRPKGPPGD

SEQ ID NO: 667736 - protein, 9 aa, Homo Sapiens
APWTSPDEA

SEQ ID NO: 667737 - protein, 9 aa, Homo Sapiens
VCTRIFGGY

SEQ ID NO: 667738 - protein, 9 aa, Homo Sapiens
GMAGLFRPK

SEQ ID NO: 667739 - protein, 9 aa, Homo Sapiens
IVKEMTKVF

SEQ ID NO: 667740 - protein, 9 aa, Homo Sapiens
APPSVMASA

SEQ ID NO: 667741 - protein, 9 aa, Homo Sapiens
SKECGKAFA

SEQ ID NO: 667742 - protein, 9 aa, Homo Sapiens
KLCLDILLK

SEQ ID NO: 667743 - protein, 9 aa, Homo Sapiens
VASYGGAAS

SEQ ID NO: 667744 - protein, 9 aa, Homo Sapiens
DKQLFQTTR

SEQ ID NO: 667745 - protein, 9 aa, Homo Sapiens
GSNLLPQRH

SEQ ID NO: 667746 - protein, 9 aa, Homo Sapiens
HTGEKPYKS

SEQ ID NO: 667747 - protein, 9 aa, Homo Sapiens
MAGLFRPKG

SEQ ID NO: 667748 - protein, 9 aa, Homo Sapiens
FFLMLSQPV

SEQ ID NO: 667749 - protein, 9 aa, Homo Sapiens
LEEIQRLAA

SEQ ID NO: 667750 - protein, 9 aa, Homo Sapiens
YDKIRAVGG

SEQ ID NO: 667751 - protein, 9 aa, Homo Sapiens
PHPKHMTVA

SEQ ID NO: 667752 - protein, 9 aa, Homo Sapiens
ISTIVPNML

SEQ ID NO: 667753 - protein, 9 aa, Homo Sapiens
GNIIITDIT

SEQ ID NO: 667754 - protein, 9 aa, Homo Sapiens
RSFHCLEGQ

SEQ ID NO: 667755 - protein, 9 aa, Homo Sapiens
PVRFLGPSA

SEQ ID NO: 667756 - protein, 9 aa, Homo Sapiens
LSMIAPPSV

SEQ ID NO: 667757 - protein, 9 aa, Homo Sapiens
TFYRTTLAV

SEQ ID NO: 667758 - protein, 9 aa, Homo Sapiens
SYECLCKTE

SEQ ID NO: 667759 - protein, 9 aa, Homo Sapiens
PASPVGSAP

SEQ ID NO: 667760 - protein, 9 aa, Homo Sapiens
VVCAPLTAY

SEQ ID NO: 667761 - protein, 9 aa, Homo Sapiens
PYKSKECGK

SEQ ID NO: 667762 - protein, 9 aa, Homo Sapiens
DTQDKGLVN

SEQ ID NO: 667763 - protein, 9 aa, Homo Sapiens
KSKECGKAF

SEQ ID NO: 667764 - protein, 9 aa, Homo Sapiens
DFLLGHNLH

SEQ ID NO: 667765 - protein, 9 aa, Homo Sapiens
GPVRFLGPS

SEQ ID NO: 667766 - protein, 9 aa, Homo Sapiens
EDTQDKGLV

SEQ ID NO: 667767 - protein, 9 aa, Homo Sapiens
DETLRKVQA

SEQ ID NO: 667768 - protein, 9 aa, Homo Sapiens
GHNLHTYII

SEQ ID NO: 667769 - protein, 9 aa, Homo Sapiens
AEIVKEMTK

SEQ ID NO: 667770 - protein, 9 aa, Homo Sapiens
PFSQVWQPL

SEQ ID NO: 667771 - protein, 9 aa, Homo Sapiens
LAVLFWQWI

SEQ ID NO: 667772 - protein, 9 aa, Homo Sapiens
YPEGMRKIS

SEQ ID NO: 667773 - protein, 9 aa, Homo Sapiens
ATQKQGIYE

SEQ ID NO: 667774 - protein, 9 aa, Homo Sapiens
MTKVFDIED

SEQ ID NO: 667775 - protein, 9 aa, Homo Sapiens
CQKHFCVAD

SEQ ID NO: 667776 - protein, 9 aa, Homo Sapiens
LTAYIDFAR

SEQ ID NO: 667777 - protein, 9 aa, Homo Sapiens
KHVHPDTGI

SEQ ID NO: 667778 - protein, 9 aa, Homo Sapiens
VGSNLLPQR

SEQ ID NO: 667779 - protein, 9 aa, Homo Sapiens
LMLSQPVPG

SEQ ID NO: 667780 - protein, 9 aa, Homo Sapiens
LCKTEFTGL

SEQ ID NO: 667781 - protein, 9 aa, Homo Sapiens
HEKIHTGDK

SEQ ID NO: 667782 - protein, 9 aa, Homo Sapiens
HHTSQVASY

SEQ ID NO: 667783 - protein, 9 aa, Homo Sapiens
SAPAHTLTL

SEQ ID NO: 667784 - protein, 9 aa, Homo Sapiens
LGHNLHTYI

SEQ ID NO: 667785 - protein, 9 aa, Homo Sapiens
SSTIEGCMG

SEQ ID NO: 667786 - protein, 9 aa, Homo Sapiens
LEDRRVVHR

SEQ ID NO: 667787 - protein, 9 aa, Homo Sapiens
TIRVIDGTS

SEQ ID NO: 667788 - protein, 9 aa, Homo Sapiens
ESYDKIRAV

SEQ ID NO: 667789 - protein, 9 aa, Homo Sapiens
QEKSPSGRF

SEQ ID NO: 667790 - protein, 9 aa, Homo Sapiens
HHHTSQVAS

SEQ ID NO: 667791 - protein, 9 aa, Homo Sapiens
RAVLTLLGE

SEQ ID NO: 667792 - protein, 9 aa, Homo Sapiens
QPVPGRTGD

SEQ ID NO: 667793 - protein, 9 aa, Homo Sapiens
RMEDTQDKG

SEQ ID NO: 667794 - protein, 9 aa, Homo Sapiens
EVVCAPLTA

SEQ ID NO: 667795 - protein, 9 aa, Homo Sapiens
DITANCLTV

SEQ ID NO: 667796 - protein, 9 aa, Homo Sapiens
VYKVLKHVH

SEQ ID NO: 667797 - protein, 9 aa, Homo Sapiens
TWGDKQLFQ

SEQ ID NO: 667798 - protein, 9 aa, Homo Sapiens
FGNIIITDI

SEQ ID NO: 667799 - protein, 9 aa, Homo Sapiens
TNQLILCAS

SEQ ID NO: 667800 - protein, 9 aa, Homo Sapiens
LLTNQLILC

SEQ ID NO: 667801 - protein, 9 aa, Homo Sapiens
CVADRYLLI

SEQ ID NO: 667802 - protein, 9 aa, Homo Sapiens
NATQKQGIY

SEQ ID NO: 667803 - protein, 9 aa, Homo Sapiens
RFLGPSAAV

SEQ ID NO: 667804 - protein, 9 aa, Homo Sapiens
LAYKMHSLL

SEQ ID NO: 667805 - protein, 9 aa, Homo Sapiens
VNATQKQGI

SEQ ID NO: 667806 - protein, 9 aa, Homo Sapiens
GQSRMEDTQ

SEQ ID NO: 667807 - protein, 9 aa, Homo Sapiens
SCTTFDSQN

SEQ ID NO: 667808 - protein, 9 aa, Homo Sapiens
SVHVDNSQD

SEQ ID NO: 667809 - protein, 9 aa, Homo Sapiens
SRGTIRVID

SEQ ID NO: 667810 - protein, 9 aa, Homo Sapiens
PLTAYIDFA

SEQ ID NO: 667811 - protein, 9 aa, Homo Sapiens
LHTYIIPRS

SEQ ID NO: 667812 - protein, 9 aa, Homo Sapiens
ADRYLLINS

SEQ ID NO: 667813 - protein, 9 aa, Homo Sapiens
GPSGPPEKP

SEQ ID NO: 667814 - protein, 9 aa, Homo Sapiens
MTSAGVSHQ

SEQ ID NO: 667815 - protein, 9 aa, Homo Sapiens
WTSPDEAPW

SEQ ID NO: 667816 - protein, 9 aa, Homo Sapiens
FSYGSIRSF

SEQ ID NO: 667817 - protein, 9 aa, Homo Sapiens
TGEKPYKSK

SEQ ID NO: 667818 - protein, 9 aa, Homo Sapiens
LEEQLHQVK

SEQ ID NO: 667819 - protein, 9 aa, Homo Sapiens
IRVIDGTSG

SEQ ID NO: 667820 - protein, 9 aa, Homo Sapiens
SRMEDTQDK

SEQ ID NO: 667821 - protein, 9 aa, Homo Sapiens
AVGGHLCQQ

SEQ ID NO: 667822 - protein, 9 aa, Homo Sapiens
QPGGTGLSL

SEQ ID NO: 667823 - protein, 9 aa, Homo Sapiens
GDKQLFQTT

SEQ ID NO: 667824 - protein, 9 aa, Homo Sapiens
IITDITANC

SEQ ID NO: 667825 - protein, 9 aa, Homo Sapiens
KIHTGDKPF

SEQ ID NO: 667826 - protein, 9 aa, Homo Sapiens
LREEPIDLG

SEQ ID NO: 667827 - protein, 9 aa, Homo Sapiens
VLKHVHPDT

SEQ ID NO: 667828 - protein, 9 aa, Homo Sapiens
RKISVLPIF

SEQ ID NO: 667829 - protein, 9 aa, Homo Sapiens
TQKAVVCVS

SEQ ID NO: 667830 - protein, 9 aa, Homo Sapiens
MRKISVLPI

SEQ ID NO: 667831 - protein, 9 aa, Homo Sapiens
DLPGSCTTF

SEQ ID NO: 667832 - protein, 9 aa, Homo Sapiens
HPTWGDKQL

SEQ ID NO: 667833 - protein, 9 aa, Homo Sapiens
YQGTITCMD

SEQ ID NO: 667834 - protein, 9 aa, Homo Sapiens
EHPTWGDKQ

SEQ ID NO: 667835 - protein, 9 aa, Homo Sapiens
GKTSLDTAN

SEQ ID NO: 667836 - protein, 9 aa, Homo Sapiens
LLGHNLHTY

SEQ ID NO: 667837 - protein, 9 aa, Homo Sapiens
VDNSQDLGN

SEQ ID NO: 667838 - protein, 9 aa, Homo Sapiens
EKPYKSKEC

SEQ ID NO: 667839 - protein, 9 aa, Homo Sapiens
DKIRAVGGH

SEQ ID NO: 667840 - protein, 9 aa, Homo Sapiens
EQLHQVKTE

SEQ ID NO: 667841 - protein, 9 aa, Homo Sapiens
VDRFGPSGP

SEQ ID NO: 667842 - protein, 9 aa, Homo Sapiens
TAALSAPAP

SEQ ID NO: 667843 - protein, 9 aa, Homo Sapiens
NGTAFSPSS

SEQ ID NO: 667844 - protein, 9 aa, Homo Sapiens
KQLFQTTRL

SEQ ID NO: 667845 - protein, 9 aa, Homo Sapiens
QSRMEDTQD

SEQ ID NO: 667846 - protein, 9 aa, Homo Sapiens
QLHQVKTET

SEQ ID NO: 667847 - protein, 9 aa, Homo Sapiens
APLTAYIDF

SEQ ID NO: 667848 - protein, 9 aa, Homo Sapiens
AATAATMTS

SEQ ID NO: 667849 - protein, 9 aa, Homo Sapiens
QRHPATGTP

SEQ ID NO: 667850 - protein, 9 aa, Homo Sapiens
ANDLGPLPP

SEQ ID NO: 667851 - protein, 9 aa, Homo Sapiens
IRAVGGHLC

SEQ ID NO: 667852 - protein, 9 aa, Homo Sapiens
IFGGYQGTI

SEQ ID NO: 667853 - protein, 9 aa, Homo Sapiens
KTSLDTAND

SEQ ID NO: 667854 - protein, 9 aa, Homo Sapiens
PQRHPATGT

SEQ ID NO: 667855 - protein, 9 aa, Homo Sapiens
HRAYRELFE

SEQ ID NO: 667856 - protein, 9 aa, Homo Sapiens
EVRRVPQRF

SEQ ID NO: 667857 - protein, 9 aa, Homo Sapiens
HVHPDTGIS

SEQ ID NO: 667858 - protein, 9 aa, Homo Sapiens
LSQPVPGRT

SEQ ID NO: 667859 - protein, 9 aa, Homo Sapiens
KAVVCVSPE

SEQ ID NO: 667860 - protein, 9 aa, Homo Sapiens
DTANDLGPL

SEQ ID NO: 667861 - protein, 9 aa, Homo Sapiens
KRASQLAYK

SEQ ID NO: 667862 - protein, 9 aa, Homo Sapiens
VRFLGPSAA

SEQ ID NO: 667863 - protein, 9 aa, Homo Sapiens
TEVVCAPLT

SEQ ID NO: 667864 - protein, 9 aa, Homo Sapiens
FHRAYRELF

SEQ ID NO: 667865 - protein, 9 aa, Homo Sapiens
TKAVREALL

SEQ ID NO: 667866 - protein, 9 aa, Homo Sapiens
TLMFSATFL

SEQ ID NO: 667867 - protein, 9 aa, Homo Sapiens
SPDEAPWWA

SEQ ID NO: 667868 - protein, 9 aa, Homo Sapiens
VCAPLTAYI

SEQ ID NO: 667869 - protein, 9 aa, Homo Sapiens
CLCKTEFTG

SEQ ID NO: 667870 - protein, 9 aa, Homo Sapiens
VVCVSPEVP

SEQ ID NO: 667871 - protein, 9 aa, Homo Sapiens
LRKVQALKK

SEQ ID NO: 667872 - protein, 9 aa, Homo Sapiens
HPKHMTVAF

SEQ ID NO: 667873 - protein, 9 aa, Homo Sapiens
TIVPNMLVN

SEQ ID NO: 667874 - protein, 9 aa, Homo Sapiens
KEMTKVFDI

SEQ ID NO: 667875 - protein, 9 aa, Homo Sapiens
HTSQVASYG

SEQ ID NO: 667876 - protein, 9 aa, Homo Sapiens
LRAVLTLLG

SEQ ID NO: 667877 - protein, 9 aa, Homo Sapiens
TSQVASYGG

SEQ ID NO: 667878 - protein, 9 aa, Homo Sapiens
SQDLGNKVT

SEQ ID NO: 667879 - protein, 9 aa, Homo Sapiens
SRFFLMLSQ

SEQ ID NO: 667880 - protein, 9 aa, Homo Sapiens
MLSQPVPGR

SEQ ID NO: 667881 - protein, 9 aa, Homo Sapiens
STIEGCMGP

SEQ ID NO: 667882 - protein, 9 aa, Homo Sapiens
NLLPQRHPA

SEQ ID NO: 667883 - protein, 9 aa, Homo Sapiens
ATKAVREAL

SEQ ID NO: 667884 - protein, 9 aa, Homo Sapiens
REEPIDLGA

SEQ ID NO: 667885 - protein, 9 aa, Homo Sapiens
LALDDETLR

SEQ ID NO: 667886 - protein, 9 aa, Homo Sapiens
QKHFCVADR

SEQ ID NO: 667887 - protein, 9 aa, Homo Sapiens
SMIAPPSVM

SEQ ID NO: 667888 - protein, 9 aa, Homo Sapiens
GTAFSPSSS

SEQ ID NO: 667889 - protein, 9 aa, Homo Sapiens
FSATFLEEI

SEQ ID NO: 667890 - protein, 9 aa, Homo Sapiens
SQPVPGRTG

SEQ ID NO: 667891 - protein, 9 aa, Homo Sapiens
YISTIVPNM

SEQ ID NO: 667892 - protein, 9 aa, Homo Sapiens
LKHVHPDTG

SEQ ID NO: 667893 - protein, 9 aa, Homo Sapiens
ALDDETLRK

SEQ ID NO: 667894 - protein, 9 aa, Homo Sapiens
WGDKQLFQT

SEQ ID NO: 667895 - protein, 9 aa, Homo Sapiens
MMTFYRTTL

SEQ ID NO: 667896 - protein, 9 aa, Homo Sapiens
GGTGLSLTA

SEQ ID NO: 667897 - protein, 9 aa, Homo Sapiens
FSPSSSPSP

SEQ ID NO: 667898 - protein, 9 aa, Homo Sapiens
TQDKGLVNR

SEQ ID NO: 667899 - protein, 9 aa, Homo Sapiens
NSQDLGNKV

SEQ ID NO: 667900 - protein, 9 aa, Homo Sapiens
LGLKAVVGE

SEQ ID NO: 667901 - protein, 9 aa, Homo Sapiens
RLRAVLTLL

SEQ ID NO: 667902 - protein, 9 aa, Homo Sapiens
AVTSRGTIR

SEQ ID NO: 667903 - protein, 9 aa, Homo Sapiens
KPYKSKECG

SEQ ID NO: 667904 - protein, 9 aa, Homo Sapiens
TLAVLFWQW

SEQ ID NO: 667905 - protein, 9 aa, Homo Sapiens
MIAPPSVMA

SEQ ID NO: 667906 - protein, 9 aa, Homo Sapiens
LCLDILLKN

SEQ ID NO: 667907 - protein, 9 aa, Homo Sapiens
KAVREALLS

SEQ ID NO: 667908 - protein, 9 aa, Homo Sapiens
EEPIDLGAC

SEQ ID NO: 667909 - protein, 9 aa, Homo Sapiens
PPHPKHMTV

SEQ ID NO: 667910 - protein, 9 aa, Homo Sapiens
IHTGDKPFK

SEQ ID NO: 667911 - protein, 9 aa, Homo Sapiens
YLEDRRVVH

SEQ ID NO: 667912 - protein, 9 aa, Homo Sapiens
AYKMHSLLA

SEQ ID NO: 667913 - protein, 9 aa, Homo Sapiens
NSPPHPKHM

SEQ ID NO: 667914 - protein, 9 aa, Homo Sapiens
PVGSAPAHT

SEQ ID NO: 667915 - protein, 9 aa, Homo Sapiens
RVGSNLLPQ

SEQ ID NO: 667916 - protein, 9 aa, Homo Sapiens
SGPPEKPEV

SEQ ID NO: 667917 - protein, 9 aa, Homo Sapiens
LDGLREEPI

SEQ ID NO: 667918 - protein, 9 aa, Homo Sapiens
LRLRAVLTL

SEQ ID NO: 667919 - protein, 9 aa, Homo Sapiens
QLILCASNV

SEQ ID NO: 667920 - protein, 9 aa, Homo Sapiens
VHVDNSQDL

SEQ ID NO: 667921 - protein, 9 aa, Homo Sapiens
VCGSGGLMY

SEQ ID NO: 667922 - protein, 9 aa, Homo Sapiens
ATFLEEIQR

SEQ ID NO: 667923 - protein, 9 aa, Homo Sapiens
TAATMTSAG

SEQ ID NO: 667924 - protein, 9 aa, Homo Sapiens
LVDYVNATQ

SEQ ID NO: 667925 - protein, 9 aa, Homo Sapiens
RFGPSGPPE

SEQ ID NO: 667926 - protein, 9 aa, Homo Sapiens
APLGLKAVV

SEQ ID NO: 667927 - protein, 9 aa, Homo Sapiens
LSLTAALSA

SEQ ID NO: 667928 - protein, 9 aa, Homo Sapiens
RPKGPPGDI

SEQ ID NO: 667929 - protein, 9 aa, Homo Sapiens
CTRIFGGYQ

SEQ ID NO: 667930 - protein, 9 aa, Homo Sapiens
ILLTNQLIL

SEQ ID NO: 667931 - protein, 9 aa, Homo Sapiens
NIIITDITA

SEQ ID NO: 667932 - protein, 9 aa, Homo Sapiens
DNSQDLGNK

SEQ ID NO: 667933 - protein, 9 aa, Homo Sapiens
VKEMTKVFD

SEQ ID NO: 667934 - protein, 9 aa, Homo Sapiens
FYRTTLAVL

SEQ ID NO: 667935 - protein, 9 aa, Homo Sapiens
VPNMLVNYL

SEQ ID NO: 667936 - protein, 9 aa, Homo Sapiens
LPQRHPATG

SEQ ID NO: 667937 - protein, 9 aa, Homo Sapiens
LLPQRHPAT

SEQ ID NO: 667938 - protein, 9 aa, Homo Sapiens
EMTKVFDIE

SEQ ID NO: 667939 - protein, 9 aa, Homo Sapiens
ITANCLTVT

SEQ ID NO: 667940 - protein, 9 aa, Homo Sapiens
ISVLPIFSE

SEQ ID NO: 667941 - protein, 9 aa, Homo Sapiens
IVPNMLVNY

SEQ ID NO: 667942 - protein, 9 aa, Homo Sapiens
HQVKTETEG

SEQ ID NO: 667943 - protein, 9 aa, Homo Sapiens
FGPSGPPEK

SEQ ID NO: 667944 - protein, 9 aa, Homo Sapiens
SAPAPWTSP

SEQ ID NO: 667945 - protein, 9 aa, Homo Sapiens
FKAEDEHEC

SEQ ID NO: 667946 - protein, 9 aa, Homo Sapiens
ITDITANCL

SEQ ID NO: 667947 - protein, 9 aa, Homo Sapiens
QRFSIPPTN

SEQ ID NO: 667948 - protein, 9 aa, Homo Sapiens
YRTTLAVLF

SEQ ID NO: 667949 - protein, 9 aa, Homo Sapiens
FGGYQGTIT

SEQ ID NO: 667950 - protein, 9 aa, Homo Sapiens
TEFTGLTCV

SEQ ID NO: 667951 - protein, 9 aa, Homo Sapiens
FLLGHNLHT

SEQ ID NO: 667952 - protein, 9 aa, Homo Sapiens
PGMAGLFRP

SEQ ID NO: 667953 - protein, 9 aa, Homo Sapiens
RTTLAVLFW

SEQ ID NO: 667954 - protein, 9 aa, Homo Sapiens
ASYGGAASA

SEQ ID NO: 667955 - protein, 9 aa, Homo Sapiens
PVCGSGGLM

SEQ ID NO: 667956 - protein, 9 aa, Homo Sapiens
PAPWTSPDE

SEQ ID NO: 667957 - protein, 9 aa, Homo Sapiens
NQLILCASN

SEQ ID NO: 667958 - protein, 9 aa, Homo Sapiens
DRFGPSGPP

SEQ ID NO: 667959 - protein, 9 aa, Homo Sapiens
RTYHFKAED

SEQ ID NO: 667960 - protein, 9 aa, Homo Sapiens
MFSATFLEE

SEQ ID NO: 667961 - protein, 9 aa, Homo Sapiens
PNMLVNYLL

SEQ ID NO: 667962 - protein, 9 aa, Homo Sapiens
ADELKEPLS

SEQ ID NO: 667963 - protein, 9 aa, Homo Sapiens
DGNADELKE

SEQ ID NO: 667964 - protein, 9 aa, Homo Sapiens
RLLRLRAVL

SEQ ID NO: 667965 - protein, 9 aa, Homo Sapiens
HYSPVCGSG

SEQ ID NO: 667966 - protein, 9 aa, Homo Sapiens
HNLHTYIIP

SEQ ID NO: 667967 - protein, 9 aa, Homo Sapiens
GGLMYFSLC

SEQ ID NO: 667968 - protein, 9 aa, Homo Sapiens
TKVFDIEDT

SEQ ID NO: 667969 - protein, 9 aa, Homo Sapiens
ELKEPLSFH

SEQ ID NO: 667970 - protein, 9 aa, Homo Sapiens
NLHTYIIPR

SEQ ID NO: 667971 - protein, 9 aa, Homo Sapiens
QVKTETEGQ

SEQ ID NO: 667972 - protein, 9 aa, Homo Sapiens
PLRNSPPHP

SEQ ID NO: 667973 - protein, 9 aa, Homo Sapiens
TGLSLTAAL

SEQ ID NO: 667974 - protein, 9 aa, Homo Sapiens
MLEFKLCLD

SEQ ID NO: 667975 - protein, 9 aa, Homo Sapiens
IIITDITAN

SEQ ID NO: 667976 - protein, 9 aa, Homo Sapiens
GSCTTFDSQ

SEQ ID NO: 667977 - protein, 9 aa, Homo Sapiens
KSPSGRFHF

SEQ ID NO: 667978 - protein, 9 aa, Homo Sapiens
DGLREEPID

SEQ ID NO: 667979 - protein, 9 aa, Homo Sapiens
VPQRFSIPP

SEQ ID NO: 667980 - protein, 9 aa, Homo Sapiens
EHEKIHTGD

SEQ ID NO: 667981 - protein, 9 aa, Homo Sapiens
MTFYRTTLA

SEQ ID NO: 667982 - protein, 9 aa, Homo Sapiens
PGDGNADEL

SEQ ID NO: 667983 - protein, 9 aa, Homo Sapiens
GGYQGTITC

SEQ ID NO: 667984 - protein, 9 aa, Homo Sapiens
GEKPYKSKE

SEQ ID NO: 667985 - protein, 9 aa, Homo Sapiens
VRRVPQRFS

SEQ ID NO: 667986 - protein, 9 aa, Homo Sapiens
SNLLPQRHP

SEQ ID NO: 667987 - protein, 9 aa, Homo Sapiens
MYISTIVPN

SEQ ID NO: 667988 - protein, 9 aa, Homo Sapiens
APAPWTSPD

SEQ ID NO: 667989 - protein, 9 aa, Homo Sapiens
LLRLRAVLT

SEQ ID NO: 667990 - protein, 9 aa, Homo Sapiens
TYHFKAEDE

SEQ ID NO: 667991 - protein, 9 aa, Homo Sapiens
TSRGTIRVI

SEQ ID NO: 667992 - protein, 9 aa, Homo Sapiens
FKLCLDILL

SEQ ID NO: 667993 - protein, 9 aa, Homo Sapiens
NMLVNYLLD

SEQ ID NO: 667994 - protein, 9 aa, Homo Sapiens
TFLEEIQRL

SEQ ID NO: 667995 - protein, 9 aa, Homo Sapiens
SISSSSSAD

SEQ ID NO: 667996 - protein, 9 aa, Homo Sapiens
SIRSFHCLE

SEQ ID NO: 667997 - protein, 9 aa, Homo Sapiens
SQLAYKMHS

SEQ ID NO: 667998 - protein, 9 aa, Homo Sapiens
LAPASPVGS

SEQ ID NO: 667999 - protein, 9 aa, Homo Sapiens
LMFSATFLE

SEQ ID NO: 668000 - protein, 9 aa, Homo Sapiens
TLSMIAPPS

SEQ ID NO: 668001 - protein, 9 aa, Homo Sapiens
CAPLTAYID

SEQ ID NO: 668002 - protein, 9 aa, Homo Sapiens
SYDKIRAVG

SEQ ID NO: 668003 - protein, 9 aa, Homo Sapiens
RRVVHRDLA

SEQ ID NO: 668004 - protein, 9 aa, Homo Sapiens
LRTQKAVVC

SEQ ID NO: 668005 - protein, 9 aa, Homo Sapiens
ELDGLREEP

SEQ ID NO: 668006 - protein, 9 aa, Homo Sapiens
PSAAVQLFR

SEQ ID NO: 668007 - protein, 9 aa, Homo Sapiens
KVLKHVHPD

SEQ ID NO: 668008 - protein, 9 aa, Homo Sapiens
YKMHSLLAL

SEQ ID NO: 668009 - protein, 9 aa, Homo Sapiens
VLTLLGEVP

SEQ ID NO: 668010 - protein, 9 aa, Homo Sapiens
ILCASNVIH

SEQ ID NO: 668011 - protein, 9 aa, Homo Sapiens
SLDTANDLG

SEQ ID NO: 668012 - protein, 9 aa, Homo Sapiens
APASPVGSA

SEQ ID NO: 668013 - protein, 9 aa, Homo Sapiens
LTNQLILCA

SEQ ID NO: 668014 - protein, 9 aa, Homo Sapiens
VREALLSSA

SEQ ID NO: 668015 - protein, 9 aa, Homo Sapiens
DMSNSSTIE

SEQ ID NO: 668016 - protein, 9 aa, Homo Sapiens
VPKPFSQVW

SEQ ID NO: 668017 - protein, 9 aa, Homo Sapiens
IYVYKVLKH

SEQ ID NO: 668018 - protein, 9 aa, Homo Sapiens
SPVGSAPAH

SEQ ID NO: 668019 - protein, 9 aa, Homo Sapiens
QVASYGGAA

SEQ ID NO: 668020 - protein, 9 aa, Homo Sapiens
CVSPEVPLQ

SEQ ID NO: 668021 - protein, 9 aa, Homo Sapiens
SAAVQLFRG

SEQ ID NO: 668022 - protein, 9 aa, Homo Sapiens
HFCVADRYL

SEQ ID NO: 668023 - protein, 9 aa, Homo Sapiens
FPGMAGLFR

SEQ ID NO: 668024 - protein, 9 aa, Homo Sapiens
ETLRKVQAL

SEQ ID NO: 668025 - protein, 9 aa, Homo Sapiens
YKSKECGKA

SEQ ID NO: 668026 - protein, 9 aa, Homo Sapiens
PQRFSIPPT

SEQ ID NO: 668027 - protein, 9 aa, Homo Sapiens
KHFCVADRY

SEQ ID NO: 668028 - protein, 9 aa, Homo Sapiens
WREATKAVR

SEQ ID NO: 668029 - protein, 9 aa, Homo Sapiens
GSGGLMYFS

SEQ ID NO: 668030 - protein, 9 aa, Homo Sapiens
KPFSQVWQP

SEQ ID NO: 668031 - protein, 9 aa, Homo Sapiens
GSAPAHTLT

SEQ ID NO: 668032 - protein, 9 aa, Homo Sapiens
EIVKEMTKV

SEQ ID NO: 668033 - protein, 9 aa, Homo Sapiens
SPSGRFHFD

SEQ ID NO: 668034 - protein, 9 aa, Homo Sapiens
VGGHLCQQP

SEQ ID NO: 668035 - protein, 9 aa, Homo Sapiens
SGRFHFDYE

SEQ ID NO: 668036 - protein, 9 aa, Homo Sapiens
TMTSAGVSH

SEQ ID NO: 668037 - protein, 9 aa, Homo Sapiens
TIEGCMGPV

SEQ ID NO: 668038 - protein, 9 aa, Homo Sapiens
HVDNSQDLG

SEQ ID NO: 668039 - protein, 9 aa, Homo Sapiens
TSLDTANDL

SEQ ID NO: 668040 - protein, 9 aa, Homo Sapiens
VKTETEGQK

SEQ ID NO: 668041 - protein, 9 aa, Homo Sapiens
HFKAEDEHE

SEQ ID NO: 668042 - protein, 9 aa, Homo Sapiens
NADELKEPL

SEQ ID NO: 668043 - protein, 9 aa, Homo Sapiens
TTLAVLFWQ

SEQ ID NO: 668044 - protein, 9 aa, Homo Sapiens
SYGSIRSFH

SEQ ID NO: 668045 - protein, 9 aa, Homo Sapiens
LILCASNVI

SEQ ID NO: 668046 - protein, 9 aa, Homo Sapiens
PGSCTTFDS

SEQ ID NO: 668047 - protein, 9 aa, Homo Sapiens
AAATAATMT

SEQ ID NO: 668048 - protein, 9 aa, Homo Sapiens
EGMRKISVL

SEQ ID NO: 668049 - protein, 9 aa, Homo Sapiens
NFSYGSIRS

SEQ ID NO: 668050 - protein, 9 aa, Homo Sapiens
EALIEFHRA

SEQ ID NO: 668051 - protein, 9 aa, Homo Sapiens
DELKEPLSF

SEQ ID NO: 668052 - protein, 9 aa, Homo Sapiens
PGGTGLSLT

SEQ ID NO: 668053 - protein, 9 aa, Homo Sapiens
SNSSTIEGC

SEQ ID NO: 668054 - protein, 9 aa, Homo Sapiens
AATMTSAGV

SEQ ID NO: 668055 - protein, 9 aa, Homo Sapiens
FCVADRYLL

SEQ ID NO: 668056 - protein, 9 aa, Homo Sapiens
SPVCGSGGL

SEQ ID NO: 668057 - protein, 9 aa, Homo Sapiens
QKAVVCVSP

SEQ ID NO: 668058 - protein, 9 aa, Homo Sapiens
RASQLAYKM

SEQ ID NO: 668059 - protein, 9 aa, Homo Sapiens
RNSPPHPKH

SEQ ID NO: 668060 - protein, 9 aa, Homo Sapiens
QDLGNKVTS

SEQ ID NO: 668061 - protein, 9 aa, Homo Sapiens
MAPLGLKAV

SEQ ID NO: 668062 - protein, 9 aa, Homo Sapiens
AALSAPAPW

SEQ ID NO: 668063 - protein, 9 aa, Homo Sapiens
GNFSYGSIR

SEQ ID NO: 668064 - protein, 9 aa, Homo Sapiens
DYVNATQKQ

SEQ ID NO: 668065 - protein, 9 aa, Homo Sapiens
LCASNVIHH

SEQ ID NO: 668066 - protein, 9 aa, Homo Sapiens
MNYLEDRRV

SEQ ID NO: 668067 - protein, 9 aa, Homo Sapiens
ALSAPAPWT

SEQ ID NO: 668068 - protein, 9 aa, Homo Sapiens
TGDKPFKCN

SEQ ID NO: 668069 - protein, 9 aa, Homo Sapiens
NMLEFKLCL

SEQ ID NO: 668070 - protein, 9 aa, Homo Sapiens
TRIFGGYQG

SEQ ID NO: 668071 - protein, 9 aa, Homo Sapiens
PNGTAFSPS

SEQ ID NO: 668072 - protein, 9 aa, Homo Sapiens
PTWGDKQLF

SEQ ID NO: 668073 - protein, 9 aa, Homo Sapiens
PPSVMASAP

SEQ ID NO: 668074 - protein, 9 aa, Homo Sapiens
RIFGGYQGT

SEQ ID NO: 668075 - protein, 9 aa, Homo Sapiens
GRFHFDYEV

SEQ ID NO: 668076 - protein, 9 aa, Homo Sapiens
AVLTLLGEV

SEQ ID NO: 668077 - protein, 9 aa, Homo Sapiens
IEGCMGPVM

SEQ ID NO: 668078 - protein, 9 aa, Homo Sapiens
MFPNGTAFS

SEQ ID NO: 668079 - protein, 9 aa, Homo Sapiens
TDITANCLT

SEQ ID NO: 668080 - protein, 9 aa, Homo Sapiens
SGGLMYFSL

SEQ ID NO: 668081 - protein, 9 aa, Homo Sapiens
FPNGTAFSP

SEQ ID NO: 668082 - protein, 9 aa, Homo Sapiens
ALIEFHRAY

SEQ ID NO: 668083 - protein, 9 aa, Homo Sapiens
RFHFDYEVP

SEQ ID NO: 668084 - protein, 9 aa, Homo Sapiens
EKIHTGDKP

SEQ ID NO: 668085 - protein, 9 aa, Homo Sapiens
THNRTYHFK

SEQ ID NO: 668086 - protein, 9 aa, Homo Sapiens
SLTAALSAP

SEQ ID NO: 668087 - protein, 9 aa, Homo Sapiens
EPIDLGACN

SEQ ID NO: 668088 - protein, 9 aa, Homo Sapiens
YGSIRSFHC

SEQ ID NO: 668089 - protein, 9 aa, Homo Sapiens
RTQKAVVCV

SEQ ID NO: 668090 - protein, 9 aa, Homo Sapiens
CGSGGLMYF

SEQ ID NO: 668091 - protein, 9 aa, Homo Sapiens
ACQKHFCVA

SEQ ID NO: 668092 - protein, 9 aa, Homo Sapiens
KTEFTGLTC

SEQ ID NO: 668093 - protein, 9 aa, Homo Sapiens
LVPKPFSQV

SEQ ID NO: 668094 - protein, 9 aa, Homo Sapiens
ELVDYVNAT

SEQ ID NO: 668095 - protein, 9 aa, Homo Sapiens
TSPDEAPWW

SEQ ID NO: 668096 - protein, 9 aa, Homo Sapiens
MSNSSTIEG

SEQ ID NO: 668097 - protein, 9 aa, Homo Sapiens
GTIRVIDGT

SEQ ID NO: 668098 - protein, 9 aa, Homo Sapiens
AGLFRPKGP

SEQ ID NO: 668099 - protein, 9 aa, Homo Sapiens
ISSSSSADD

SEQ ID NO: 668100 - protein, 9 aa, Homo Sapiens
YLNATDADE

SEQ ID NO: 668101 - protein, 9 aa, Homo Sapiens
GRDERETVI

SEQ ID NO: 668102 - protein, 9 aa, Homo Sapiens
KCAFSSHEP

SEQ ID NO: 668103 - protein, 9 aa, Homo Sapiens
IVLSNCSYL

SEQ ID NO: 668104 - protein, 9 aa, Homo Sapiens
GNHISLEQK

SEQ ID NO: 668105 - protein, 9 aa, Homo Sapiens
NYYQINWTT

SEQ ID NO: 668106 - protein, 9 aa, Homo Sapiens
GTVVIYLNA

SEQ ID NO: 668107 - protein, 9 aa, Homo Sapiens
DQYAEVTHN

SEQ ID NO: 668108 - protein, 9 aa, Homo Sapiens
AFISGERDL

SEQ ID NO: 668109 - protein, 9 aa, Homo Sapiens
TKDYEQQRG

SEQ ID NO: 668110 - protein, 9 aa, Homo Sapiens
SDRCHLCDH

SEQ ID NO: 668111 - protein, 9 aa, Homo Sapiens
NCSYLERHT

SEQ ID NO: 668112 - protein, 9 aa, Homo Sapiens
DGYDYSPGQ

SEQ ID NO: 668113 - protein, 9 aa, Homo Sapiens
SSSQEGLKS

SEQ ID NO: 668114 - protein, 9 aa, Homo Sapiens
IDLKFKDFG

SEQ ID NO: 668115 - protein, 9 aa, Homo Sapiens
FREAESVRS

SEQ ID NO: 668116 - protein, 9 aa, Homo Sapiens
SRYWLNVDF

SEQ ID NO: 668117 - protein, 9 aa, Homo Sapiens
EAVQGHGTG

SEQ ID NO: 668118 - protein, 9 aa, Homo Sapiens
LDTVSMGPG

SEQ ID NO: 668119 - protein, 9 aa, Homo Sapiens
KYQGGWTDG

SEQ ID NO: 668120 - protein, 9 aa, Homo Sapiens
DLLNEEDIL

SEQ ID NO: 668121 - protein, 9 aa, Homo Sapiens
LVTEEESSK

SEQ ID NO: 668122 - protein, 9 aa, Homo Sapiens
DSTEASSPV

SEQ ID NO: 668123 - protein, 9 aa, Homo Sapiens
IIDLKFKDF

SEQ ID NO: 668124 - protein, 9 aa, Homo Sapiens
KRYSPLSIF

SEQ ID NO: 668125 - protein, 9 aa, Homo Sapiens
IVHHNKEIE

SEQ ID NO: 668126 - protein, 9 aa, Homo Sapiens
TWPPSIHKD

SEQ ID NO: 668127 - protein, 9 aa, Homo Sapiens
PSQNQGLGR

SEQ ID NO: 668128 - protein, 9 aa, Homo Sapiens
RLLKNHSQY

SEQ ID NO: 668129 - protein, 9 aa, Homo Sapiens
IARCEHMAQ

SEQ ID NO: 668130 - protein, 9 aa, Homo Sapiens
GICYTNLTG

SEQ ID NO: 668131 - protein, 9 aa, Homo Sapiens
PSKLKRLLE

SEQ ID NO: 668132 - protein, 9 aa, Homo Sapiens
YILLLWLSV

SEQ ID NO: 668133 - protein, 9 aa, Homo Sapiens
GKAFTNLSA

SEQ ID NO: 668134 - protein, 9 aa, Homo Sapiens
PPRSPNLSP

SEQ ID NO: 668135 - protein, 9 aa, Homo Sapiens
AQAEDTGES

SEQ ID NO: 668136 - protein, 9 aa, Homo Sapiens
VCTPVSRES

SEQ ID NO: 668137 - protein, 9 aa, Homo Sapiens
HWPKTSGSS

SEQ ID NO: 668138 - protein, 9 aa, Homo Sapiens
VVSYNHLGN

SEQ ID NO: 668139 - protein, 9 aa, Homo Sapiens
PFFTRPLLP

SEQ ID NO: 668140 - protein, 9 aa, Homo Sapiens
RLACAGCCL

SEQ ID NO: 668141 - protein, 9 aa, Homo Sapiens
MDAIARCEH

SEQ ID NO: 668142 - protein, 9 aa, Homo Sapiens
FVIFICGFL

SEQ ID NO: 668143 - protein, 9 aa, Homo Sapiens
MAPWGKRRL

SEQ ID NO: 668144 - protein, 9 aa, Homo Sapiens
HMYFFHSLE

SEQ ID NO: 668145 - protein, 9 aa, Homo Sapiens
PALKIETQA

SEQ ID NO: 668146 - protein, 9 aa, Homo Sapiens
SLPIASSFS

SEQ ID NO: 668147 - protein, 9 aa, Homo Sapiens
SYLERHTFL

SEQ ID NO: 668148 - protein, 9 aa, Homo Sapiens
KMFLKREGK

SEQ ID NO: 668149 - protein, 9 aa, Homo Sapiens
SFDAGMCRA

SEQ ID NO: 668150 - protein, 9 aa, Homo Sapiens
SAGERAWTP

SEQ ID NO: 668151 - protein, 9 aa, Homo Sapiens
LIRTLVTLK

SEQ ID NO: 668152 - protein, 9 aa, Homo Sapiens
PGCGVEGVG

SEQ ID NO: 668153 - protein, 9 aa, Homo Sapiens
NPNMLTDLP

SEQ ID NO: 668154 - protein, 9 aa, Homo Sapiens
RGMYETPAG

SEQ ID NO: 668155 - protein, 9 aa, Homo Sapiens
IPRRAAARF

SEQ ID NO: 668156 - protein, 9 aa, Homo Sapiens
CSCVSSSLK

SEQ ID NO: 668157 - protein, 9 aa, Homo Sapiens
PYTSEKHYE

SEQ ID NO: 668158 - protein, 9 aa, Homo Sapiens
ERKIGNPKI

SEQ ID NO: 668159 - protein, 9 aa, Homo Sapiens
AMRKCGVVK

SEQ ID NO: 668160 - protein, 9 aa, Homo Sapiens
PEPAPGCGV

SEQ ID NO: 668161 - protein, 9 aa, Homo Sapiens
SPQNISNCT

SEQ ID NO: 668162 - protein, 9 aa, Homo Sapiens
PSAHGGSAA

SEQ ID NO: 668163 - protein, 9 aa, Homo Sapiens
YLSQAVLTE

SEQ ID NO: 668164 - protein, 9 aa, Homo Sapiens
LLITSMTSE

SEQ ID NO: 668165 - protein, 9 aa, Homo Sapiens
EDLAEVTVA

SEQ ID NO: 668166 - protein, 9 aa, Homo Sapiens
DEVYAAPWN

SEQ ID NO: 668167 - protein, 9 aa, Homo Sapiens
KIEGCHICS

SEQ ID NO: 668168 - protein, 9 aa, Homo Sapiens
HDGGPRLRV

SEQ ID NO: 668169 - protein, 9 aa, Homo Sapiens
NNLRMEQEE

SEQ ID NO: 668170 - protein, 9 aa, Homo Sapiens
GMEACVQAS

SEQ ID NO: 668171 - protein, 9 aa, Homo Sapiens
VNLTYSATH

SEQ ID NO: 668172 - protein, 9 aa, Homo Sapiens
GLAPELALE

SEQ ID NO: 668173 - protein, 9 aa, Homo Sapiens
PDLLSEKKT

SEQ ID NO: 668174 - protein, 9 aa, Homo Sapiens
LGLLTEAAS

SEQ ID NO: 668175 - protein, 9 aa, Homo Sapiens
QFVLGRLMI

SEQ ID NO: 668176 - protein, 9 aa, Homo Sapiens
FGGRDPITG

SEQ ID NO: 668177 - protein, 9 aa, Homo Sapiens
GTFPKPTLW

SEQ ID NO: 668178 - protein, 9 aa, Homo Sapiens
KSASAAVTR

SEQ ID NO: 668179 - protein, 9 aa, Homo Sapiens
KVVRFVSDS

SEQ ID NO: 668180 - protein, 9 aa, Homo Sapiens
QVGNSFWYL

SEQ ID NO: 668181 - protein, 9 aa, Homo Sapiens
RESLDTVSM

SEQ ID NO: 668182 - protein, 9 aa, Homo Sapiens
RQIVTAGRG

SEQ ID NO: 668183 - protein, 9 aa, Homo Sapiens
ARSPFLSST

SEQ ID NO: 668184 - protein, 9 aa, Homo Sapiens
GTLQKFVYD

SEQ ID NO: 668185 - protein, 9 aa, Homo Sapiens
INCGEKPYK

SEQ ID NO: 668186 - protein, 9 aa, Homo Sapiens
PCHGGSSCA

SEQ ID NO: 668187 - protein, 9 aa, Homo Sapiens
NKYQGGWTD

SEQ ID NO: 668188 - protein, 9 aa, Homo Sapiens
CFMVQFGPR

SEQ ID NO: 668189 - protein, 9 aa, Homo Sapiens
GDSTEASSP

SEQ ID NO: 668190 - protein, 9 aa, Homo Sapiens
GCILHMYFF

SEQ ID NO: 668191 - protein, 9 aa, Homo Sapiens
KNLGNSPQS

SEQ ID NO: 668192 - protein, 9 aa, Homo Sapiens
VQVSEFLLI

SEQ ID NO: 668193 - protein, 9 aa, Homo Sapiens
IHKYRTDLI

SEQ ID NO: 668194 - protein, 9 aa, Homo Sapiens
CTTAARAAA

SEQ ID NO: 668195 - protein, 9 aa, Homo Sapiens
RLSRDVTFA

SEQ ID NO: 668196 - protein, 9 aa, Homo Sapiens
TLFGSNSLA

SEQ ID NO: 668197 - protein, 9 aa, Homo Sapiens
REETRGDCT

SEQ ID NO: 668198 - protein, 9 aa, Homo Sapiens
IYTSPEISE

SEQ ID NO: 668199 - protein, 9 aa, Homo Sapiens
MRPSRPLVF

SEQ ID NO: 668200 - protein, 9 aa, Homo Sapiens
VREDKVFPM

SEQ ID NO: 668201 - protein, 9 aa, Homo Sapiens
CVSSSLKLI

SEQ ID NO: 668202 - protein, 9 aa, Homo Sapiens
HVQAGTFPK

SEQ ID NO: 668203 - protein, 9 aa, Homo Sapiens
YEINMLSEQ

SEQ ID NO: 668204 - protein, 9 aa, Homo Sapiens
LRFPATYSL

SEQ ID NO: 668205 - protein, 9 aa, Homo Sapiens
LLETQHAEL

SEQ ID NO: 668206 - protein, 9 aa, Homo Sapiens
FDKIYSTKR

SEQ ID NO: 668207 - protein, 9 aa, Homo Sapiens
EFLTTHTNE

SEQ ID NO: 668208 - protein, 9 aa, Homo Sapiens
LIKALEDDE

SEQ ID NO: 668209 - protein, 9 aa, Homo Sapiens
FFQHFQGNM

SEQ ID NO: 668210 - protein, 9 aa, Homo Sapiens
WPKTSGSSS

SEQ ID NO: 668211 - protein, 9 aa, Homo Sapiens
ASPSGSEYL

SEQ ID NO: 668212 - protein, 9 aa, Homo Sapiens
LDDALKLSE

SEQ ID NO: 668213 - protein, 9 aa, Homo Sapiens
LDKMASLYN

SEQ ID NO: 668214 - protein, 9 aa, Homo Sapiens
DPRTGAGGC

SEQ ID NO: 668215 - protein, 9 aa, Homo Sapiens
SHSVINHHA

SEQ ID NO: 668216 - protein, 9 aa, Homo Sapiens
LGLQCSARP

SEQ ID NO: 668217 - protein, 9 aa, Homo Sapiens
QFSTSSTDL

SEQ ID NO: 668218 - protein, 9 aa, Homo Sapiens
GADGKPSGD

SEQ ID NO: 668219 - protein, 9 aa, Homo Sapiens
PAPGCGVEG

SEQ ID NO: 668220 - protein, 9 aa, Homo Sapiens
TPKMLPDLL

SEQ ID NO: 668221 - protein, 9 aa, Homo Sapiens
FSSHEPYFS

SEQ ID NO: 668222 - protein, 9 aa, Homo Sapiens
PLPQSRLAQ

SEQ ID NO: 668223 - protein, 9 aa, Homo Sapiens
ECGPAFQPL

SEQ ID NO: 668224 - protein, 9 aa, Homo Sapiens
HEEEIVHHN

SEQ ID NO: 668225 - protein, 9 aa, Homo Sapiens
LGNSPQSAV

SEQ ID NO: 668226 - protein, 9 aa, Homo Sapiens
AGTFPKPTL

SEQ ID NO: 668227 - protein, 9 aa, Homo Sapiens
NVSQLVYGT

SEQ ID NO: 668228 - protein, 9 aa, Homo Sapiens
KKLMLCFMV

SEQ ID NO: 668229 - protein, 9 aa, Homo Sapiens
PVQPASPCS

SEQ ID NO: 668230 - protein, 9 aa, Homo Sapiens
VNGSFKCLD

SEQ ID NO: 668231 - protein, 9 aa, Homo Sapiens
LLSLASLLF

SEQ ID NO: 668232 - protein, 9 aa, Homo Sapiens
SSGKVNGLK

SEQ ID NO: 668233 - protein, 9 aa, Homo Sapiens
NGTGTVHKG

SEQ ID NO: 668234 - protein, 9 aa, Homo Sapiens
ETVLNSLVG

SEQ ID NO: 668235 - protein, 9 aa, Homo Sapiens
FKDFGTYTC

SEQ ID NO: 668236 - protein, 9 aa, Homo Sapiens
LLDPLNMLT

SEQ ID NO: 668237 - protein, 9 aa, Homo Sapiens
LWPAESETW

SEQ ID NO: 668238 - protein, 9 aa, Homo Sapiens
SGDQVLPSC

SEQ ID NO: 668239 - protein, 9 aa, Homo Sapiens
DYVNMTGLY

SEQ ID NO: 668240 - protein, 9 aa, Homo Sapiens
DSEVHSWVS

SEQ ID NO: 668241 - protein, 9 aa, Homo Sapiens
EIKRSDCVD

SEQ ID NO: 668242 - protein, 9 aa, Homo Sapiens
HRQSFYSTW

SEQ ID NO: 668243 - protein, 9 aa, Homo Sapiens
SQLVYGTEG

SEQ ID NO: 668244 - protein, 9 aa, Homo Sapiens
SGHSSRNDW

SEQ ID NO: 668245 - protein, 9 aa, Homo Sapiens
ELGILSPSI

SEQ ID NO: 668246 - protein, 9 aa, Homo Sapiens
LKPSKLKRL

SEQ ID NO: 668247 - protein, 9 aa, Homo Sapiens
DDLILVRVS

SEQ ID NO: 668248 - protein, 9 aa, Homo Sapiens
ECGKAFTNL

SEQ ID NO: 668249 - protein, 9 aa, Homo Sapiens
DFVLLGLSQ

SEQ ID NO: 668250 - protein, 9 aa, Homo Sapiens
FDPLEAETP

SEQ ID NO: 668251 - protein, 9 aa, Homo Sapiens
DCTDLDSRC

SEQ ID NO: 668252 - protein, 9 aa, Homo Sapiens
KLLCGMEAC

SEQ ID NO: 668253 - protein, 9 aa, Homo Sapiens
GDHIVRFWA

SEQ ID NO: 668254 - protein, 9 aa, Homo Sapiens
FFLAILSFS

SEQ ID NO: 668255 - protein, 9 aa, Homo Sapiens
GGASSGKVN

SEQ ID NO: 668256 - protein, 9 aa, Homo Sapiens
VRVSSERYL

SEQ ID NO: 668257 - protein, 9 aa, Homo Sapiens
TLVTLKAEQ

SEQ ID NO: 668258 - protein, 9 aa, Homo Sapiens
KKSLGQTSA

SEQ ID NO: 668259 - protein, 9 aa, Homo Sapiens
RRLRHLAEG

SEQ ID NO: 668260 - protein, 9 aa, Homo Sapiens
ICYTNLTGD

SEQ ID NO: 668261 - protein, 9 aa, Homo Sapiens
KIYSTKRDV

SEQ ID NO: 668262 - protein, 9 aa, Homo Sapiens
FGICAGDST

SEQ ID NO: 668263 - protein, 9 aa, Homo Sapiens
CGLPDKQET

SEQ ID NO: 668264 - protein, 9 aa, Homo Sapiens
QVNADFATR

SEQ ID NO: 668265 - protein, 9 aa, Homo Sapiens
VSRESSPCC

SEQ ID NO: 668266 - protein, 9 aa, Homo Sapiens
LAFYLCFLP

SEQ ID NO: 668267 - protein, 9 aa, Homo Sapiens
GPRSAGLDL

SEQ ID NO: 668268 - protein, 9 aa, Homo Sapiens
PPPAASAAA

SEQ ID NO: 668269 - protein, 9 aa, Homo Sapiens
SFKREECPA

SEQ ID NO: 668270 - protein, 9 aa, Homo Sapiens
ARLLKNHSQ

SEQ ID NO: 668271 - protein, 9 aa, Homo Sapiens
VLWQRRLRH

SEQ ID NO: 668272 - protein, 9 aa, Homo Sapiens
QPCQSGVQF

SEQ ID NO: 668273 - protein, 9 aa, Homo Sapiens
VNMTGLYLS

SEQ ID NO: 668274 - protein, 9 aa, Homo Sapiens
HATIKILFI

SEQ ID NO: 668275 - protein, 9 aa, Homo Sapiens
YLSSVSSSP

SEQ ID NO: 668276 - protein, 9 aa, Homo Sapiens
RNFYDQLKF

SEQ ID NO: 668277 - protein, 9 aa, Homo Sapiens
FLILMVIAF

SEQ ID NO: 668278 - protein, 9 aa, Homo Sapiens
STFFGSEEP

SEQ ID NO: 668279 - protein, 9 aa, Homo Sapiens
PEQCGDNTG

SEQ ID NO: 668280 - protein, 9 aa, Homo Sapiens
LAQEALDKA

SEQ ID NO: 668281 - protein, 9 aa, Homo Sapiens
LTPLYLGGA

SEQ ID NO: 668282 - protein, 9 aa, Homo Sapiens
TAKGTPCED

SEQ ID NO: 668283 - protein, 9 aa, Homo Sapiens
ETWKRTKQL

SEQ ID NO: 668284 - protein, 9 aa, Homo Sapiens
NGLAAFLKA

SEQ ID NO: 668285 - protein, 9 aa, Homo Sapiens
LGLNPGTVN

SEQ ID NO: 668286 - protein, 9 aa, Homo Sapiens
GKSYVSMVP

SEQ ID NO: 668287 - protein, 9 aa, Homo Sapiens
QVLGDHIVR

SEQ ID NO: 668288 - protein, 9 aa, Homo Sapiens
DLAEVTVAV

SEQ ID NO: 668289 - protein, 9 aa, Homo Sapiens
LKGQQVREP

SEQ ID NO: 668290 - protein, 9 aa, Homo Sapiens
RTGVCISFD

SEQ ID NO: 668291 - protein, 9 aa, Homo Sapiens
GYRTGLVLM

SEQ ID NO: 668292 - protein, 9 aa, Homo Sapiens
AHGESAFRN

SEQ ID NO: 668293 - protein, 9 aa, Homo Sapiens
VIFICGFLV

SEQ ID NO: 668294 - protein, 9 aa, Homo Sapiens
GNPKPVCHL

SEQ ID NO: 668295 - protein, 9 aa, Homo Sapiens
IFLTGNHIS

SEQ ID NO: 668296 - protein, 9 aa, Homo Sapiens
DVRYTKDYE

SEQ ID NO: 668297 - protein, 9 aa, Homo Sapiens
LKLIHSGIQ

SEQ ID NO: 668298 - protein, 9 aa, Homo Sapiens
DVLPLVPIL

SEQ ID NO: 668299 - protein, 9 aa, Homo Sapiens
SKLKRLLET

SEQ ID NO: 668300 - protein, 9 aa, Homo Sapiens
LVNMPPYYR

SEQ ID NO: 668301 - protein, 9 aa, Homo Sapiens
HTGVAEGGK

SEQ ID NO: 668302 - protein, 9 aa, Homo Sapiens
ETPMASLRK

SEQ ID NO: 668303 - protein, 9 aa, Homo Sapiens
QKFVYDLFE

SEQ ID NO: 668304 - protein, 9 aa, Homo Sapiens
LCDINITEI

SEQ ID NO: 668305 - protein, 9 aa, Homo Sapiens
CAFSSHEPY

SEQ ID NO: 668306 - protein, 9 aa, Homo Sapiens
TAPCWFPHG

SEQ ID NO: 668307 - protein, 9 aa, Homo Sapiens
SLGQTSAAN

SEQ ID NO: 668308 - protein, 9 aa, Homo Sapiens
GPPGDTGLP

SEQ ID NO: 668309 - protein, 9 aa, Homo Sapiens
DAVQAAHRA

SEQ ID NO: 668310 - protein, 9 aa, Homo Sapiens
EKKVLEEHL

SEQ ID NO: 668311 - protein, 9 aa, Homo Sapiens
GNSPQSAVG

SEQ ID NO: 668312 - protein, 9 aa, Homo Sapiens
RPLLPKWCP

SEQ ID NO: 668313 - protein, 9 aa, Homo Sapiens
HQRTQTGEK

SEQ ID NO: 668314 - protein, 9 aa, Homo Sapiens
NELRGMGTD

SEQ ID NO: 668315 - protein, 9 aa, Homo Sapiens
LQGSESSPA

SEQ ID NO: 668316 - protein, 9 aa, Homo Sapiens
KSEGYYNFD

SEQ ID NO: 668317 - protein, 9 aa, Homo Sapiens
MAPSKEEDD

SEQ ID NO: 668318 - protein, 9 aa, Homo Sapiens
DNTTNSGLL

SEQ ID NO: 668319 - protein, 9 aa, Homo Sapiens
SSLPIASSF

SEQ ID NO: 668320 - protein, 9 aa, Homo Sapiens
PNTPFDLEL

SEQ ID NO: 668321 - protein, 9 aa, Homo Sapiens
TTRSEPIRI

SEQ ID NO: 668322 - protein, 9 aa, Homo Sapiens
LNTMRPLLR

SEQ ID NO: 668323 - protein, 9 aa, Homo Sapiens
PARWRRWPD

SEQ ID NO: 668324 - protein, 9 aa, Homo Sapiens
FHVAKMEFR

SEQ ID NO: 668325 - protein, 9 aa, Homo Sapiens
GICAGDSTE

SEQ ID NO: 668326 - protein, 9 aa, Homo Sapiens
QKQEPLHSP

SEQ ID NO: 668327 - protein, 9 aa, Homo Sapiens
QRRLRHLAE

SEQ ID NO: 668328 - protein, 9 aa, Homo Sapiens
RHLAEGISE

SEQ ID NO: 668329 - protein, 9 aa, Homo Sapiens
CQSGVQFVL

SEQ ID NO: 668330 - protein, 9 aa, Homo Sapiens
VLDVKPQGL

SEQ ID NO: 668331 - protein, 9 aa, Homo Sapiens
WGKRRLACA

SEQ ID NO: 668332 - protein, 9 aa, Homo Sapiens
LESDHECYH

SEQ ID NO: 668333 - protein, 9 aa, Homo Sapiens
RDQYAEVTH

SEQ ID NO: 668334 - protein, 9 aa, Homo Sapiens
WAQCSEAVP

SEQ ID NO: 668335 - protein, 9 aa, Homo Sapiens
EDEENSLVT

SEQ ID NO: 668336 - protein, 9 aa, Homo Sapiens
RPTRPKTSG

SEQ ID NO: 668337 - protein, 9 aa, Homo Sapiens
QVYDDELGQ

SEQ ID NO: 668338 - protein, 9 aa, Homo Sapiens
FFQFREAES

SEQ ID NO: 668339 - protein, 9 aa, Homo Sapiens
GYIYIFGGR

SEQ ID NO: 668340 - protein, 9 aa, Homo Sapiens
GSFKCLDSP

SEQ ID NO: 668341 - protein, 9 aa, Homo Sapiens
GLKTMSVVS

SEQ ID NO: 668342 - protein, 9 aa, Homo Sapiens
PQSRLAQLV

SEQ ID NO: 668343 - protein, 9 aa, Homo Sapiens
ALCLLTLVH

SEQ ID NO: 668344 - protein, 9 aa, Homo Sapiens
PPGEIVAKG

SEQ ID NO: 668345 - protein, 9 aa, Homo Sapiens
NTLFGSNSL

SEQ ID NO: 668346 - protein, 9 aa, Homo Sapiens
KVFPMNPPK

SEQ ID NO: 668347 - protein, 9 aa, Homo Sapiens
MLPDLLSEK

SEQ ID NO: 668348 - protein, 9 aa, Homo Sapiens
MVKVTLNSA

SEQ ID NO: 668349 - protein, 9 aa, Homo Sapiens
ADMHSDMPM

SEQ ID NO: 668350 - protein, 9 aa, Homo Sapiens
EKAVVYKLT

SEQ ID NO: 668351 - protein, 9 aa, Homo Sapiens
AQLHVLSPQ

SEQ ID NO: 668352 - protein, 9 aa, Homo Sapiens
MRPLLRYSP

SEQ ID NO: 668353 - protein, 9 aa, Homo Sapiens
VSRPFYLEA

SEQ ID NO: 668354 - protein, 9 aa, Homo Sapiens
HSSHSVINH

SEQ ID NO: 668355 - protein, 9 aa, Homo Sapiens
MLCFMVQFG

SEQ ID NO: 668356 - protein, 9 aa, Homo Sapiens
VQGHGTGSP

SEQ ID NO: 668357 - protein, 9 aa, Homo Sapiens
VNQYRMLGL

SEQ ID NO: 668358 - protein, 9 aa, Homo Sapiens
SRKQIKGVS

SEQ ID NO: 668359 - protein, 9 aa, Homo Sapiens
LPPTSRKDH

SEQ ID NO: 668360 - protein, 9 aa, Homo Sapiens
LSLLLGLAS

SEQ ID NO: 668361 - protein, 9 aa, Homo Sapiens
LMIQHEQEG

SEQ ID NO: 668362 - protein, 9 aa, Homo Sapiens
VMSTLNLFI

SEQ ID NO: 668363 - protein, 9 aa, Homo Sapiens
GCGGSPCTK

SEQ ID NO: 668364 - protein, 9 aa, Homo Sapiens
LLRRSYPAA

SEQ ID NO: 668365 - protein, 9 aa, Homo Sapiens
LKSKANDAV

SEQ ID NO: 668366 - protein, 9 aa, Homo Sapiens
MTQLTQVNA

SEQ ID NO: 668367 - protein, 9 aa, Homo Sapiens
DGRESLDTV

SEQ ID NO: 668368 - protein, 9 aa, Homo Sapiens
CVGVFQHRK

SEQ ID NO: 668369 - protein, 9 aa, Homo Sapiens
THSRKQIKG

SEQ ID NO: 668370 - protein, 9 aa, Homo Sapiens
SLVGDRDKN

SEQ ID NO: 668371 - protein, 9 aa, Homo Sapiens
EIVAKGSKG

SEQ ID NO: 668372 - protein, 9 aa, Homo Sapiens
GRGNKYQGG

SEQ ID NO: 668373 - protein, 9 aa, Homo Sapiens
QKWLLSLAS

SEQ ID NO: 668374 - protein, 9 aa, Homo Sapiens
AARQLGICY

SEQ ID NO: 668375 - protein, 9 aa, Homo Sapiens
HEAWETRYI

SEQ ID NO: 668376 - protein, 9 aa, Homo Sapiens
RCLPLEVSS

SEQ ID NO: 668377 - protein, 9 aa, Homo Sapiens
LIVSATELG

SEQ ID NO: 668378 - protein, 9 aa, Homo Sapiens
RERPVAFEA

SEQ ID NO: 668379 - protein, 9 aa, Homo Sapiens
TKVVTTPDL

SEQ ID NO: 668380 - protein, 9 aa, Homo Sapiens
FVYDLFETI

SEQ ID NO: 668381 - protein, 9 aa, Homo Sapiens
VHSQQPCQS

SEQ ID NO: 668382 - protein, 9 aa, Homo Sapiens
RMAIAAEPR

SEQ ID NO: 668383 - protein, 9 aa, Homo Sapiens
ERHPTHRLP

SEQ ID NO: 668384 - protein, 9 aa, Homo Sapiens
SLEQKKLML

SEQ ID NO: 668385 - protein, 9 aa, Homo Sapiens
LQDMGFTVY

SEQ ID NO: 668386 - protein, 9 aa, Homo Sapiens
HNKEIERLQ

SEQ ID NO: 668387 - protein, 9 aa, Homo Sapiens
NGCCSIVGT

SEQ ID NO: 668388 - protein, 9 aa, Homo Sapiens
LARPAKLHV

SEQ ID NO: 668389 - protein, 9 aa, Homo Sapiens
ISMTGCILH

SEQ ID NO: 668390 - protein, 9 aa, Homo Sapiens
LPGTHVSAL

SEQ ID NO: 668391 - protein, 9 aa, Homo Sapiens
VLGRLMIQH

SEQ ID NO: 668392 - protein, 9 aa, Homo Sapiens
LQLPGSSNP

SEQ ID NO: 668393 - protein, 9 aa, Homo Sapiens
REDKVFPMN

SEQ ID NO: 668394 - protein, 9 aa, Homo Sapiens
PTGYKKNSY

SEQ ID NO: 668395 - protein, 9 aa, Homo Sapiens
QQPCQSGVQ

SEQ ID NO: 668396 - protein, 9 aa, Homo Sapiens
RFFEPAILS

SEQ ID NO: 668397 - protein, 9 aa, Homo Sapiens
VRIPRRAAA

SEQ ID NO: 668398 - protein, 9 aa, Homo Sapiens
AQDLQGLAQ

SEQ ID NO: 668399 - protein, 9 aa, Homo Sapiens
ANNLRMEQE

SEQ ID NO: 668400 - protein, 9 aa, Homo Sapiens
PHMAPSKEE

SEQ ID NO: 668401 - protein, 9 aa, Homo Sapiens
ELQAQIRRL

SEQ ID NO: 668402 - protein, 9 aa, Homo Sapiens
PSDASGHSS

SEQ ID NO: 668403 - protein, 9 aa, Homo Sapiens
RSQQNVANY

SEQ ID NO: 668404 - protein, 9 aa, Homo Sapiens
TGVSGDTIP

SEQ ID NO: 668405 - protein, 9 aa, Homo Sapiens
LNSLVGDRD

SEQ ID NO: 668406 - protein, 9 aa, Homo Sapiens
YAGPVPSLT

SEQ ID NO: 668407 - protein, 9 aa, Homo Sapiens
STYTANLVA

SEQ ID NO: 668408 - protein, 9 aa, Homo Sapiens
NFLILMVIA

SEQ ID NO: 668409 - protein, 9 aa, Homo Sapiens
QVLPPETFL

SEQ ID NO: 668410 - protein, 9 aa, Homo Sapiens
TTPAALPTK

SEQ ID NO: 668411 - protein, 9 aa, Homo Sapiens
RLRAANGSL

SEQ ID NO: 668412 - protein, 9 aa, Homo Sapiens
TMGMAVAAG

SEQ ID NO: 668413 - protein, 9 aa, Homo Sapiens
QHEQEGALD

SEQ ID NO: 668414 - protein, 9 aa, Homo Sapiens
CEWYQCVYQ

SEQ ID NO: 668415 - protein, 9 aa, Homo Sapiens
IATIDRSAA

SEQ ID NO: 668416 - protein, 9 aa, Homo Sapiens
AWETRYILL

SEQ ID NO: 668417 - protein, 9 aa, Homo Sapiens
ARAAARPSP

SEQ ID NO: 668418 - protein, 9 aa, Homo Sapiens
HHNKEIERL

SEQ ID NO: 668419 - protein, 9 aa, Homo Sapiens
TVEGNLLIV

SEQ ID NO: 668420 - protein, 9 aa, Homo Sapiens
ATLCDINIT

SEQ ID NO: 668421 - protein, 9 aa, Homo Sapiens
APGCGVEGV

SEQ ID NO: 668422 - protein, 9 aa, Homo Sapiens
VHESSLQGS

SEQ ID NO: 668423 - protein, 9 aa, Homo Sapiens
AQKWLLSLA

SEQ ID NO: 668424 - protein, 9 aa, Homo Sapiens
SEYLSSVSS

SEQ ID NO: 668425 - protein, 9 aa, Homo Sapiens
GFTSEEKAV

SEQ ID NO: 668426 - protein, 9 aa, Homo Sapiens
FFTRPLLPK

SEQ ID NO: 668427 - protein, 9 aa, Homo Sapiens
VHSWVSHTH

SEQ ID NO: 668428 - protein, 9 aa, Homo Sapiens
YGHVSYGGQ

SEQ ID NO: 668429 - protein, 9 aa, Homo Sapiens
CLYQLHENG

SEQ ID NO: 668430 - protein, 9 aa, Homo Sapiens
FCYSSNVTP

SEQ ID NO: 668431 - protein, 9 aa, Homo Sapiens
LEEHLVAKG

SEQ ID NO: 668432 - protein, 9 aa, Homo Sapiens
REQKQEPLH

SEQ ID NO: 668433 - protein, 9 aa, Homo Sapiens
SSQSPEQCG

SEQ ID NO: 668434 - protein, 9 aa, Homo Sapiens
PVNLTYSAT

SEQ ID NO: 668435 - protein, 9 aa, Homo Sapiens
GLWAQCSEA

SEQ ID NO: 668436 - protein, 9 aa, Homo Sapiens
SVLESDHEC

SEQ ID NO: 668437 - protein, 9 aa, Homo Sapiens
EDEVAQKKK

SEQ ID NO: 668438 - protein, 9 aa, Homo Sapiens
SSPVPKRPG

SEQ ID NO: 668439 - protein, 9 aa, Homo Sapiens
WAHLGTTGL

SEQ ID NO: 668440 - protein, 9 aa, Homo Sapiens
LAPLLITSM

SEQ ID NO: 668441 - protein, 9 aa, Homo Sapiens
VSDFVLLGL

SEQ ID NO: 668442 - protein, 9 aa, Homo Sapiens
REGKYIWSK

SEQ ID NO: 668443 - protein, 9 aa, Homo Sapiens
AIALERSQQ

SEQ ID NO: 668444 - protein, 9 aa, Homo Sapiens
VLRSNGCCS

SEQ ID NO: 668445 - protein, 9 aa, Homo Sapiens
FGPRSAGLD

SEQ ID NO: 668446 - protein, 9 aa, Homo Sapiens
EPFGICAGD

SEQ ID NO: 668447 - protein, 9 aa, Homo Sapiens
TTEDLAEVT

SEQ ID NO: 668448 - protein, 9 aa, Homo Sapiens
IDGKSKDIR

SEQ ID NO: 668449 - protein, 9 aa, Homo Sapiens
ARKPTPAAD

SEQ ID NO: 668450 - protein, 9 aa, Homo Sapiens
MSEISPIYT

SEQ ID NO: 668451 - protein, 9 aa, Homo Sapiens
TDTMTNSSI

SEQ ID NO: 668452 - protein, 9 aa, Homo Sapiens
SDTRICKLV

SEQ ID NO: 668453 - protein, 9 aa, Homo Sapiens
TPCLKLIIL

SEQ ID NO: 668454 - protein, 9 aa, Homo Sapiens
CHGGSSCAV

SEQ ID NO: 668455 - protein, 9 aa, Homo Sapiens
YICGLPDKQ

SEQ ID NO: 668456 - protein, 9 aa, Homo Sapiens
SAQCQLGLL

SEQ ID NO: 668457 - protein, 9 aa, Homo Sapiens
ATPRDFHPI

SEQ ID NO: 668458 - protein, 9 aa, Homo Sapiens
SLDDALKLS

SEQ ID NO: 668459 - protein, 9 aa, Homo Sapiens
ALVNMPPYY

SEQ ID NO: 668460 - protein, 9 aa, Homo Sapiens
SETWKRTKQ

SEQ ID NO: 668461 - protein, 9 aa, Homo Sapiens
ISNCTYAQT

SEQ ID NO: 668462 - protein, 9 aa, Homo Sapiens
KNHSQYEKQ

SEQ ID NO: 668463 - protein, 9 aa, Homo Sapiens
KAQNNGSNF

SEQ ID NO: 668464 - protein, 9 aa, Homo Sapiens
CYTNLTGDV

SEQ ID NO: 668465 - protein, 9 aa, Homo Sapiens
MEMTQLTQV

SEQ ID NO: 668466 - protein, 9 aa, Homo Sapiens
TAGRGDHLA

SEQ ID NO: 668467 - protein, 9 aa, Homo Sapiens
LTSRACCTT

SEQ ID NO: 668468 - protein, 9 aa, Homo Sapiens
VCLYQLHEN

SEQ ID NO: 668469 - protein, 9 aa, Homo Sapiens
VQERRADFN

SEQ ID NO: 668470 - protein, 9 aa, Homo Sapiens
EISPIYTSP

SEQ ID NO: 668471 - protein, 9 aa, Homo Sapiens
SRLVHKLRQ

SEQ ID NO: 668472 - protein, 9 aa, Homo Sapiens
ANNGLWAQC

SEQ ID NO: 668473 - protein, 9 aa, Homo Sapiens
RKCILYQLS

SEQ ID NO: 668474 - protein, 9 aa, Homo Sapiens
LLSDQPHNF

SEQ ID NO: 668475 - protein, 9 aa, Homo Sapiens
RTCKGCVFG

SEQ ID NO: 668476 - protein, 9 aa, Homo Sapiens
QGCLQCSHS

SEQ ID NO: 668477 - protein, 9 aa, Homo Sapiens
SMEQLAQDL

SEQ ID NO: 668478 - protein, 9 aa, Homo Sapiens
CSLQLPGSS

SEQ ID NO: 668479 - protein, 9 aa, Homo Sapiens
NRLVQTADL

SEQ ID NO: 668480 - protein, 9 aa, Homo Sapiens
LRSIKSKVT

SEQ ID NO: 668481 - protein, 9 aa, Homo Sapiens
PCPELGILS

SEQ ID NO: 668482 - protein, 9 aa, Homo Sapiens
GGPRLRVHS

SEQ ID NO: 668483 - protein, 9 aa, Homo Sapiens
RREHLLRER

SEQ ID NO: 668484 - protein, 9 aa, Homo Sapiens
TIRRQTVRG

SEQ ID NO: 668485 - protein, 9 aa, Homo Sapiens
GHPVPLHQV

SEQ ID NO: 668486 - protein, 9 aa, Homo Sapiens
KGYNTYASF

SEQ ID NO: 668487 - protein, 9 aa, Homo Sapiens
AAAGPAPAS

SEQ ID NO: 668488 - protein, 9 aa, Homo Sapiens
IPYRCDLLN

SEQ ID NO: 668489 - protein, 9 aa, Homo Sapiens
GASSGKVNG

SEQ ID NO: 668490 - protein, 9 aa, Homo Sapiens
TFPKPTLWA

SEQ ID NO: 668491 - protein, 9 aa, Homo Sapiens
EYLIELFFF

SEQ ID NO: 668492 - protein, 9 aa, Homo Sapiens
KKSTVLHTH

SEQ ID NO: 668493 - protein, 9 aa, Homo Sapiens
ILMVIAFDR

SEQ ID NO: 668494 - protein, 9 aa, Homo Sapiens
HKLRQAGAM

SEQ ID NO: 668495 - protein, 9 aa, Homo Sapiens
ALGNAALAL

SEQ ID NO: 668496 - protein, 9 aa, Homo Sapiens
LHQVIVRPV

SEQ ID NO: 668497 - protein, 9 aa, Homo Sapiens
HLLRHQRTQ

SEQ ID NO: 668498 - protein, 9 aa, Homo Sapiens
QHWPKTSGS

SEQ ID NO: 668499 - protein, 9 aa, Homo Sapiens
FLTPLYLGG

SEQ ID NO: 668500 - protein, 9 aa, Homo Sapiens
HARLLKNHS

SEQ ID NO: 668501 - protein, 9 aa, Homo Sapiens
CEHMAQERG

SEQ ID NO: 668502 - protein, 9 aa, Homo Sapiens
VGRLRRRHM

SEQ ID NO: 668503 - protein, 9 aa, Homo Sapiens
VQFVLGRLM

SEQ ID NO: 668504 - protein, 9 aa, Homo Sapiens
DASGHSSRN

SEQ ID NO: 668505 - protein, 9 aa, Homo Sapiens
TLFNYYQIN

SEQ ID NO: 668506 - protein, 9 aa, Homo Sapiens
KETPCLKLI

SEQ ID NO: 668507 - protein, 9 aa, Homo Sapiens
FTLRPGTRA

SEQ ID NO: 668508 - protein, 9 aa, Homo Sapiens
YRGALTGGY

SEQ ID NO: 668509 - protein, 9 aa, Homo Sapiens
DLEKAPKLL

SEQ ID NO: 668510 - protein, 9 aa, Homo Sapiens
VSVEMLSSV

SEQ ID NO: 668511 - protein, 9 aa, Homo Sapiens
RYSPLSIFH

SEQ ID NO: 668512 - protein, 9 aa, Homo Sapiens
FSPPSHHAL

SEQ ID NO: 668513 - protein, 9 aa, Homo Sapiens
LVPSDASGH

SEQ ID NO: 668514 - protein, 9 aa, Homo Sapiens
AYSFTHAFD

SEQ ID NO: 668515 - protein, 9 aa, Homo Sapiens
KSTVLHTHS

SEQ ID NO: 668516 - protein, 9 aa, Homo Sapiens
RPSRPLVFM

SEQ ID NO: 668517 - protein, 9 aa, Homo Sapiens
QKLRWREDR

SEQ ID NO: 668518 - protein, 9 aa, Homo Sapiens
TRINCGEKP

SEQ ID NO: 668519 - protein, 9 aa, Homo Sapiens
MTGLYLSAI

SEQ ID NO: 668520 - protein, 9 aa, Homo Sapiens
LKDLARLSR

SEQ ID NO: 668521 - protein, 9 aa, Homo Sapiens
KKASGPNLG

SEQ ID NO: 668522 - protein, 9 aa, Homo Sapiens
YGKSYVSMV

SEQ ID NO: 668523 - protein, 9 aa, Homo Sapiens
SNCASHLTA

SEQ ID NO: 668524 - protein, 9 aa, Homo Sapiens
KPVLAPRMG

SEQ ID NO: 668525 - protein, 9 aa, Homo Sapiens
ERAQKWLLS

SEQ ID NO: 668526 - protein, 9 aa, Homo Sapiens
FGSEEPTVT

SEQ ID NO: 668527 - protein, 9 aa, Homo Sapiens
QPASPCSHN

SEQ ID NO: 668528 - protein, 9 aa, Homo Sapiens
EECGKAFTN

SEQ ID NO: 668529 - protein, 9 aa, Homo Sapiens
EVALGNAAL

SEQ ID NO: 668530 - protein, 9 aa, Homo Sapiens
VINHHASIH

SEQ ID NO: 668531 - protein, 9 aa, Homo Sapiens
LRKYLTSEA

SEQ ID NO: 668532 - protein, 9 aa, Homo Sapiens
LCLLTLVHS

SEQ ID NO: 668533 - protein, 9 aa, Homo Sapiens
LEALKDLAR

SEQ ID NO: 668534 - protein, 9 aa, Homo Sapiens
LNMLTTPEK

SEQ ID NO: 668535 - protein, 9 aa, Homo Sapiens
HHPDYTAMS

SEQ ID NO: 668536 - protein, 9 aa, Homo Sapiens
FAASAGGFW

SEQ ID NO: 668537 - protein, 9 aa, Homo Sapiens
SDASGHSSR

SEQ ID NO: 668538 - protein, 9 aa, Homo Sapiens
KDFGTYTCV

SEQ ID NO: 668539 - protein, 9 aa, Homo Sapiens
GYDYSPGQL

SEQ ID NO: 668540 - protein, 9 aa, Homo Sapiens
PEEEDSLSP

SEQ ID NO: 668541 - protein, 9 aa, Homo Sapiens
TSRQARCLP

SEQ ID NO: 668542 - protein, 9 aa, Homo Sapiens
DYSPGQLIE

SEQ ID NO: 668543 - protein, 9 aa, Homo Sapiens
LGETESATT

SEQ ID NO: 668544 - protein, 9 aa, Homo Sapiens
NLVMSTLNL

SEQ ID NO: 668545 - protein, 9 aa, Homo Sapiens
LPIASSFSG

SEQ ID NO: 668546 - protein, 9 aa, Homo Sapiens
HTNEKVELQ

SEQ ID NO: 668547 - protein, 9 aa, Homo Sapiens
APLGTVVIY

SEQ ID NO: 668548 - protein, 9 aa, Homo Sapiens
LRQIVTAGR

SEQ ID NO: 668549 - protein, 9 aa, Homo Sapiens
LGICYTNLT

SEQ ID NO: 668550 - protein, 9 aa, Homo Sapiens
LTGNHISLE

SEQ ID NO: 668551 - protein, 9 aa, Homo Sapiens
TSQRISCTP

SEQ ID NO: 668552 - protein, 9 aa, Homo Sapiens
ALADPNKDE

SEQ ID NO: 668553 - protein, 9 aa, Homo Sapiens
FISGERDLE

SEQ ID NO: 668554 - protein, 9 aa, Homo Sapiens
TRYILLLWL

SEQ ID NO: 668555 - protein, 9 aa, Homo Sapiens
FLTTHTNEK

SEQ ID NO: 668556 - protein, 9 aa, Homo Sapiens
KREECPAGS

SEQ ID NO: 668557 - protein, 9 aa, Homo Sapiens
QLPGSSNPP

SEQ ID NO: 668558 - protein, 9 aa, Homo Sapiens
RQTVRGFGL

SEQ ID NO: 668559 - protein, 9 aa, Homo Sapiens
TRGNARTSK

SEQ ID NO: 668560 - protein, 9 aa, Homo Sapiens
SPGQLIEDV

SEQ ID NO: 668561 - protein, 9 aa, Homo Sapiens
SQLLTLKQQ

SEQ ID NO: 668562 - protein, 9 aa, Homo Sapiens
SRKDHKFEE

SEQ ID NO: 668563 - protein, 9 aa, Homo Sapiens
RLSEFLSVQ

SEQ ID NO: 668564 - protein, 9 aa, Homo Sapiens
TVHKGRPRK

SEQ ID NO: 668565 - protein, 9 aa, Homo Sapiens
EHARLLKNH

SEQ ID NO: 668566 - protein, 9 aa, Homo Sapiens
IGADGKPSG

SEQ ID NO: 668567 - protein, 9 aa, Homo Sapiens
DPLNMLTTP

SEQ ID NO: 668568 - protein, 9 aa, Homo Sapiens
ESDHECYHP

SEQ ID NO: 668569 - protein, 9 aa, Homo Sapiens
GCCLTSRAC

SEQ ID NO: 668570 - protein, 9 aa, Homo Sapiens
LSIFHNLKD

SEQ ID NO: 668571 - protein, 9 aa, Homo Sapiens
TLSAAQLYY

SEQ ID NO: 668572 - protein, 9 aa, Homo Sapiens
KSKDIRQMA

SEQ ID NO: 668573 - protein, 9 aa, Homo Sapiens
GPEPAPGCG

SEQ ID NO: 668574 - protein, 9 aa, Homo Sapiens
LQRANNLRM

SEQ ID NO: 668575 - protein, 9 aa, Homo Sapiens
QVRERPVAF

SEQ ID NO: 668576 - protein, 9 aa, Homo Sapiens
NSSSQEGLK

SEQ ID NO: 668577 - protein, 9 aa, Homo Sapiens
ILSFSEICY

SEQ ID NO: 668578 - protein, 9 aa, Homo Sapiens
VNMPPYYRY

SEQ ID NO: 668579 - protein, 9 aa, Homo Sapiens
SPSNSSTVQ

SEQ ID NO: 668580 - protein, 9 aa, Homo Sapiens
ERARQAQSL

SEQ ID NO: 668581 - protein, 9 aa, Homo Sapiens
WEAQVGNSF

SEQ ID NO: 668582 - protein, 9 aa, Homo Sapiens
HSCFQTIDR

SEQ ID NO: 668583 - protein, 9 aa, Homo Sapiens
QARCLPLEV

SEQ ID NO: 668584 - protein, 9 aa, Homo Sapiens
TGVCISFDA

SEQ ID NO: 668585 - protein, 9 aa, Homo Sapiens
QMKIDDEVY

SEQ ID NO: 668586 - protein, 9 aa, Homo Sapiens
LAPLPSAGK

SEQ ID NO: 668587 - protein, 9 aa, Homo Sapiens
SLDTVSMGP

SEQ ID NO: 668588 - protein, 9 aa, Homo Sapiens
GCCSIVGTG

SEQ ID NO: 668589 - protein, 9 aa, Homo Sapiens
GFWGPHGHT

SEQ ID NO: 668590 - protein, 9 aa, Homo Sapiens
IELFFFQHF

SEQ ID NO: 668591 - protein, 9 aa, Homo Sapiens
TELGPERRK

SEQ ID NO: 668592 - protein, 9 aa, Homo Sapiens
ISPIYTSPE

SEQ ID NO: 668593 - protein, 9 aa, Homo Sapiens
VGNSFWYLY

SEQ ID NO: 668594 - protein, 9 aa, Homo Sapiens
REECPAGSH

SEQ ID NO: 668595 - protein, 9 aa, Homo Sapiens
VDNIKSSQP

SEQ ID NO: 668596 - protein, 9 aa, Homo Sapiens
VQAGTFPKP

SEQ ID NO: 668597 - protein, 9 aa, Homo Sapiens
GLEPFGICA

SEQ ID NO: 668598 - protein, 9 aa, Homo Sapiens
DMPTRTAHG

SEQ ID NO: 668599 - protein, 9 aa, Homo Sapiens
SPVPKRPGS

SEQ ID NO: 668600 - protein, 9 aa, Homo Sapiens
KMYLTRSEK

SEQ ID NO: 668601 - protein, 9 aa, Homo Sapiens
RSITAVSKF

SEQ ID NO: 668602 - protein, 9 aa, Homo Sapiens
KAFSNCASH

SEQ ID NO: 668603 - protein, 9 aa, Homo Sapiens
TLLGETPMA

SEQ ID NO: 668604 - protein, 9 aa, Homo Sapiens
AARPSPARW

SEQ ID NO: 668605 - protein, 9 aa, Homo Sapiens
EVATLLGET

SEQ ID NO: 668606 - protein, 9 aa, Homo Sapiens
FLSLLVDIA

SEQ ID NO: 668607 - protein, 9 aa, Homo Sapiens
AAVTRNLPF

SEQ ID NO: 668608 - protein, 9 aa, Homo Sapiens
ESLNTVCIT

SEQ ID NO: 668609 - protein, 9 aa, Homo Sapiens
LACAGCCLT

SEQ ID NO: 668610 - protein, 9 aa, Homo Sapiens
YQGGWTDGG

SEQ ID NO: 668611 - protein, 9 aa, Homo Sapiens
TCARKPTPA

SEQ ID NO: 668612 - protein, 9 aa, Homo Sapiens
ERAWTPTPP

SEQ ID NO: 668613 - protein, 9 aa, Homo Sapiens
PLHQVIVRP

SEQ ID NO: 668614 - protein, 9 aa, Homo Sapiens
IFICGFLVL

SEQ ID NO: 668615 - protein, 9 aa, Homo Sapiens
TSMEQLAQD

SEQ ID NO: 668616 - protein, 9 aa, Homo Sapiens
CLLTLVHSL

SEQ ID NO: 668617 - protein, 9 aa, Homo Sapiens
TWNTLSAAQ

SEQ ID NO: 668618 - protein, 9 aa, Homo Sapiens
RGNGLAAFL

SEQ ID NO: 668619 - protein, 9 aa, Homo Sapiens
NKMYLTRSE

SEQ ID NO: 668620 - protein, 9 aa, Homo Sapiens
KIETQAILP

SEQ ID NO: 668621 - protein, 9 aa, Homo Sapiens
QHRGNGLAA

SEQ ID NO: 668622 - protein, 9 aa, Homo Sapiens
WPAVTMGMA

SEQ ID NO: 668623 - protein, 9 aa, Homo Sapiens
KIQLLRRSY

SEQ ID NO: 668624 - protein, 9 aa, Homo Sapiens
FGTQSAEIY

SEQ ID NO: 668625 - protein, 9 aa, Homo Sapiens
HRGNGLAAF

SEQ ID NO: 668626 - protein, 9 aa, Homo Sapiens
GCHICSSVT

SEQ ID NO: 668627 - protein, 9 aa, Homo Sapiens
NGSLSAKSF

SEQ ID NO: 668628 - protein, 9 aa, Homo Sapiens
FVLLGLSQT

SEQ ID NO: 668629 - protein, 9 aa, Homo Sapiens
GLTKDRKES

SEQ ID NO: 668630 - protein, 9 aa, Homo Sapiens
LTVREDKVF

SEQ ID NO: 668631 - protein, 9 aa, Homo Sapiens
GREQKQEPL

SEQ ID NO: 668632 - protein, 9 aa, Homo Sapiens
LGGGHPVPL

SEQ ID NO: 668633 - protein, 9 aa, Homo Sapiens
QCETVLNSL

SEQ ID NO: 668634 - protein, 9 aa, Homo Sapiens
ASAAATAYG

SEQ ID NO: 668635 - protein, 9 aa, Homo Sapiens
PDNTTNSGL

SEQ ID NO: 668636 - protein, 9 aa, Homo Sapiens
GERAWTPTP

SEQ ID NO: 668637 - protein, 9 aa, Homo Sapiens
ELGQCCQRP

SEQ ID NO: 668638 - protein, 9 aa, Homo Sapiens
ETESATTED

SEQ ID NO: 668639 - protein, 9 aa, Homo Sapiens
TSRKDHKFE

SEQ ID NO: 668640 - protein, 9 aa, Homo Sapiens
LWAQCSEAV

SEQ ID NO: 668641 - protein, 9 aa, Homo Sapiens
SQLDKMASL

SEQ ID NO: 668642 - protein, 9 aa, Homo Sapiens
AIIHKYRTD

SEQ ID NO: 668643 - protein, 9 aa, Homo Sapiens
ATAHYNLFF

SEQ ID NO: 668644 - protein, 9 aa, Homo Sapiens
RFSALELQF

SEQ ID NO: 668645 - protein, 9 aa, Homo Sapiens
GAECGPAFQ

SEQ ID NO: 668646 - protein, 9 aa, Homo Sapiens
ALGGLSLLL

SEQ ID NO: 668647 - protein, 9 aa, Homo Sapiens
AFFQFREAE

SEQ ID NO: 668648 - protein, 9 aa, Homo Sapiens
EGDQVSYRG

SEQ ID NO: 668649 - protein, 9 aa, Homo Sapiens
IQVLPPETF

SEQ ID NO: 668650 - protein, 9 aa, Homo Sapiens
AQSLAQEAL

SEQ ID NO: 668651 - protein, 9 aa, Homo Sapiens
CARKPTPAA

SEQ ID NO: 668652 - protein, 9 aa, Homo Sapiens
LLAPQAYLT

SEQ ID NO: 668653 - protein, 9 aa, Homo Sapiens
AFQPLRPCP

SEQ ID NO: 668654 - protein, 9 aa, Homo Sapiens
PILQLVVLD

SEQ ID NO: 668655 - protein, 9 aa, Homo Sapiens
IKSSQPSQN

SEQ ID NO: 668656 - protein, 9 aa, Homo Sapiens
GGGHPVPLH

SEQ ID NO: 668657 - protein, 9 aa, Homo Sapiens
GKSKDIRQM

SEQ ID NO: 668658 - protein, 9 aa, Homo Sapiens
FKAQNNGSN

SEQ ID NO: 668659 - protein, 9 aa, Homo Sapiens
VEKLQDECR

SEQ ID NO: 668660 - protein, 9 aa, Homo Sapiens
PNLSPERPR

SEQ ID NO: 668661 - protein, 9 aa, Homo Sapiens
IYIFGGRDP

SEQ ID NO: 668662 - protein, 9 aa, Homo Sapiens
EAETPACEL

SEQ ID NO: 668663 - protein, 9 aa, Homo Sapiens
NTLRSIKSK

SEQ ID NO: 668664 - protein, 9 aa, Homo Sapiens
VYDDELGQC

SEQ ID NO: 668665 - protein, 9 aa, Homo Sapiens
FQMGLLVPA

SEQ ID NO: 668666 - protein, 9 aa, Homo Sapiens
RRSYPAAFE

SEQ ID NO: 668667 - protein, 9 aa, Homo Sapiens
KMVTDIFLT

SEQ ID NO: 668668 - protein, 9 aa, Homo Sapiens
ATIKILFIC

SEQ ID NO: 668669 - protein, 9 aa, Homo Sapiens
DRRAPGIPG

SEQ ID NO: 668670 - protein, 9 aa, Homo Sapiens
ILHMYFFHS

SEQ ID NO: 668671 - protein, 9 aa, Homo Sapiens
TTNSGLLEA

SEQ ID NO: 668672 - protein, 9 aa, Homo Sapiens
KSYVSMVPS

SEQ ID NO: 668673 - protein, 9 aa, Homo Sapiens
KLRWREDRE

SEQ ID NO: 668674 - protein, 9 aa, Homo Sapiens
KPPRCWAAP

SEQ ID NO: 668675 - protein, 9 aa, Homo Sapiens
NCLIIAVMG

SEQ ID NO: 668676 - protein, 9 aa, Homo Sapiens
FAILTEFCS

SEQ ID NO: 668677 - protein, 9 aa, Homo Sapiens
KRKKSLGQT

SEQ ID NO: 668678 - protein, 9 aa, Homo Sapiens
FPHGYPEAK

SEQ ID NO: 668679 - protein, 9 aa, Homo Sapiens
YDLFETIFS

SEQ ID NO: 668680 - protein, 9 aa, Homo Sapiens
FWGPHGHTD

SEQ ID NO: 668681 - protein, 9 aa, Homo Sapiens
RICKLVVFV

SEQ ID NO: 668682 - protein, 9 aa, Homo Sapiens
AYEREKKVL

SEQ ID NO: 668683 - protein, 9 aa, Homo Sapiens
VYDVPNTPF

SEQ ID NO: 668684 - protein, 9 aa, Homo Sapiens
HHALQLSVL

SEQ ID NO: 668685 - protein, 9 aa, Homo Sapiens
DPLEAETPA

SEQ ID NO: 668686 - protein, 9 aa, Homo Sapiens
FSEFLSLLV

SEQ ID NO: 668687 - protein, 9 aa, Homo Sapiens
LMSEISPIY

SEQ ID NO: 668688 - protein, 9 aa, Homo Sapiens
RFDAVQAAH

SEQ ID NO: 668689 - protein, 9 aa, Homo Sapiens
PPYYRYLCI

SEQ ID NO: 668690 - protein, 9 aa, Homo Sapiens
RCWAAPLCL

SEQ ID NO: 668691 - protein, 9 aa, Homo Sapiens
RETVIPPCF

SEQ ID NO: 668692 - protein, 9 aa, Homo Sapiens
GGFLHATIK

SEQ ID NO: 668693 - protein, 9 aa, Homo Sapiens
PTPAADSLQ

SEQ ID NO: 668694 - protein, 9 aa, Homo Sapiens
LVYGTEGSD

SEQ ID NO: 668695 - protein, 9 aa, Homo Sapiens
MYLKAKKST

SEQ ID NO: 668696 - protein, 9 aa, Homo Sapiens
EPPPCPELG

SEQ ID NO: 668697 - protein, 9 aa, Homo Sapiens
TDIFLTGNH

SEQ ID NO: 668698 - protein, 9 aa, Homo Sapiens
EQLRSQLLT

SEQ ID NO: 668699 - protein, 9 aa, Homo Sapiens
HESSLQGSE

SEQ ID NO: 668700 - protein, 9 aa, Homo Sapiens
ESAAAAAEE

SEQ ID NO: 668701 - protein, 9 aa, Homo Sapiens
VVYKLTGAI

SEQ ID NO: 668702 - protein, 9 aa, Homo Sapiens
LRVNILLLL

SEQ ID NO: 668703 - protein, 9 aa, Homo Sapiens
QSPEQCGDN

SEQ ID NO: 668704 - protein, 9 aa, Homo Sapiens
TVEKLQDEC

SEQ ID NO: 668705 - protein, 9 aa, Homo Sapiens
AAHRAATRG

SEQ ID NO: 668706 - protein, 9 aa, Homo Sapiens
SMRMAIAAE

SEQ ID NO: 668707 - protein, 9 aa, Homo Sapiens
AQRGPGCVW

SEQ ID NO: 668708 - protein, 9 aa, Homo Sapiens
PVYDVPNTP

SEQ ID NO: 668709 - protein, 9 aa, Homo Sapiens
FKREECPAG

SEQ ID NO: 668710 - protein, 9 aa, Homo Sapiens
ITAHCSLQL

SEQ ID NO: 668711 - protein, 9 aa, Homo Sapiens
HVSYGGQRS

SEQ ID NO: 668712 - protein, 9 aa, Homo Sapiens
TITPKMLPD

SEQ ID NO: 668713 - protein, 9 aa, Homo Sapiens
QAQSLAQEA

SEQ ID NO: 668714 - protein, 9 aa, Homo Sapiens
AEDAQRVLI

SEQ ID NO: 668715 - protein, 9 aa, Homo Sapiens
SPLSIFHNL

SEQ ID NO: 668716 - protein, 9 aa, Homo Sapiens
DTLPSDDVF

SEQ ID NO: 668717 - protein, 9 aa, Homo Sapiens
PYRCDLLNE

SEQ ID NO: 668718 - protein, 9 aa, Homo Sapiens
GLIRTLVTL

SEQ ID NO: 668719 - protein, 9 aa, Homo Sapiens
FFFQHFQGN

SEQ ID NO: 668720 - protein, 9 aa, Homo Sapiens
SLNGTCWLN

SEQ ID NO: 668721 - protein, 9 aa, Homo Sapiens
TNSGLLEAS

SEQ ID NO: 668722 - protein, 9 aa, Homo Sapiens
AAGPAPASP

SEQ ID NO: 668723 - protein, 9 aa, Homo Sapiens
RTLVTLKAE

SEQ ID NO: 668724 - protein, 9 aa, Homo Sapiens
EVHSWVSHT

SEQ ID NO: 668725 - protein, 9 aa, Homo Sapiens
STSSTDLTP

SEQ ID NO: 668726 - protein, 9 aa, Homo Sapiens
KLHVQDQLM

SEQ ID NO: 668727 - protein, 9 aa, Homo Sapiens
RLAPLLITS

SEQ ID NO: 668728 - protein, 9 aa, Homo Sapiens
QAEDTGESA

SEQ ID NO: 668729 - protein, 9 aa, Homo Sapiens
LPLVPILQL

SEQ ID NO: 668730 - protein, 9 aa, Homo Sapiens
TAESLNTVC

SEQ ID NO: 668731 - protein, 9 aa, Homo Sapiens
SHEPYFSYS

SEQ ID NO: 668732 - protein, 9 aa, Homo Sapiens
CTCARKPTP

SEQ ID NO: 668733 - protein, 9 aa, Homo Sapiens
FGSNSLASK

SEQ ID NO: 668734 - protein, 9 aa, Homo Sapiens
DLKVHYSNI

SEQ ID NO: 668735 - protein, 9 aa, Homo Sapiens
PIRIAGKSG

SEQ ID NO: 668736 - protein, 9 aa, Homo Sapiens
ACCTTAARA

SEQ ID NO: 668737 - protein, 9 aa, Homo Sapiens
GRLRRRHMA

SEQ ID NO: 668738 - protein, 9 aa, Homo Sapiens
KILFICQLP

SEQ ID NO: 668739 - protein, 9 aa, Homo Sapiens
AHYNLFFPT

SEQ ID NO: 668740 - protein, 9 aa, Homo Sapiens
LITSMTSER

SEQ ID NO: 668741 - protein, 9 aa, Homo Sapiens
QYAEVTHNI

SEQ ID NO: 668742 - protein, 9 aa, Homo Sapiens
RGHIQRRHT

SEQ ID NO: 668743 - protein, 9 aa, Homo Sapiens
RVHSQQPCQ

SEQ ID NO: 668744 - protein, 9 aa, Homo Sapiens
DAQRVLIKA

SEQ ID NO: 668745 - protein, 9 aa, Homo Sapiens
PPVQPASPC

SEQ ID NO: 668746 - protein, 9 aa, Homo Sapiens
KTSGMPSGN

SEQ ID NO: 668747 - protein, 9 aa, Homo Sapiens
RVYSQQDAQ

SEQ ID NO: 668748 - protein, 9 aa, Homo Sapiens
TSWLLNNCH

SEQ ID NO: 668749 - protein, 9 aa, Homo Sapiens
SLAQEALDK

SEQ ID NO: 668750 - protein, 9 aa, Homo Sapiens
DVFKTQVSS

SEQ ID NO: 668751 - protein, 9 aa, Homo Sapiens
DNADLRKCI

SEQ ID NO: 668752 - protein, 9 aa, Homo Sapiens
EDRESRRSE

SEQ ID NO: 668753 - protein, 9 aa, Homo Sapiens
APLPSAGKK

SEQ ID NO: 668754 - protein, 9 aa, Homo Sapiens
AAQRGPGCV

SEQ ID NO: 668755 - protein, 9 aa, Homo Sapiens
TVREDKVFP

SEQ ID NO: 668756 - protein, 9 aa, Homo Sapiens
GLVLQDMGF

SEQ ID NO: 668757 - protein, 9 aa, Homo Sapiens
VPASLSMRM

SEQ ID NO: 668758 - protein, 9 aa, Homo Sapiens
TSTQPHMAP

SEQ ID NO: 668759 - protein, 9 aa, Homo Sapiens
GVLRSNGCC

SEQ ID NO: 668760 - protein, 9 aa, Homo Sapiens
PKRPGSLAL

SEQ ID NO: 668761 - protein, 9 aa, Homo Sapiens
HKFEELQKV

SEQ ID NO: 668762 - protein, 9 aa, Homo Sapiens
RRHTGVAEG

SEQ ID NO: 668763 - protein, 9 aa, Homo Sapiens
HPTHRLPFV

SEQ ID NO: 668764 - protein, 9 aa, Homo Sapiens
DECRKLEEN

SEQ ID NO: 668765 - protein, 9 aa, Homo Sapiens
FDSGQPSPD

SEQ ID NO: 668766 - protein, 9 aa, Homo Sapiens
TAARAAARP

SEQ ID NO: 668767 - protein, 9 aa, Homo Sapiens
YDDELGQCC

SEQ ID NO: 668768 - protein, 9 aa, Homo Sapiens
NIKSSQPSQ

SEQ ID NO: 668769 - protein, 9 aa, Homo Sapiens
GGHPVPLHQ

SEQ ID NO: 668770 - protein, 9 aa, Homo Sapiens
ELKSKANDA

SEQ ID NO: 668771 - protein, 9 aa, Homo Sapiens
LKTMSVVSY

SEQ ID NO: 668772 - protein, 9 aa, Homo Sapiens
GALDVEVSR

SEQ ID NO: 668773 - protein, 9 aa, Homo Sapiens
THRLPFVDV

SEQ ID NO: 668774 - protein, 9 aa, Homo Sapiens
GTSRQARCL

SEQ ID NO: 668775 - protein, 9 aa, Homo Sapiens
LMVIAFDRY

SEQ ID NO: 668776 - protein, 9 aa, Homo Sapiens
ARTGVCISF

SEQ ID NO: 668777 - protein, 9 aa, Homo Sapiens
PGQLIEDVE

SEQ ID NO: 668778 - protein, 9 aa, Homo Sapiens
TDLPGPLVK

SEQ ID NO: 668779 - protein, 9 aa, Homo Sapiens
GNSFWYLYD

SEQ ID NO: 668780 - protein, 9 aa, Homo Sapiens
TLPSDDVFK

SEQ ID NO: 668781 - protein, 9 aa, Homo Sapiens
QQRHSFKRE

SEQ ID NO: 668782 - protein, 9 aa, Homo Sapiens
KQCGKAFKS

SEQ ID NO: 668783 - protein, 9 aa, Homo Sapiens
SQQNVANYL

SEQ ID NO: 668784 - protein, 9 aa, Homo Sapiens
MFAILTEFC

SEQ ID NO: 668785 - protein, 9 aa, Homo Sapiens
VTMGMAVAA

SEQ ID NO: 668786 - protein, 9 aa, Homo Sapiens
SGPNLGPDP

SEQ ID NO: 668787 - protein, 9 aa, Homo Sapiens
IIGYSQLDK

SEQ ID NO: 668788 - protein, 9 aa, Homo Sapiens
LVQTADLTK

SEQ ID NO: 668789 - protein, 9 aa, Homo Sapiens
IPHSSHSVI

SEQ ID NO: 668790 - protein, 9 aa, Homo Sapiens
LTLVHSLLP

SEQ ID NO: 668791 - protein, 9 aa, Homo Sapiens
KGIRQHRGN

SEQ ID NO: 668792 - protein, 9 aa, Homo Sapiens
EAAKNSLEA

SEQ ID NO: 668793 - protein, 9 aa, Homo Sapiens
RKETPCLKL

SEQ ID NO: 668794 - protein, 9 aa, Homo Sapiens
APASPTGGS

SEQ ID NO: 668795 - protein, 9 aa, Homo Sapiens
AGGFWGPHG

SEQ ID NO: 668796 - protein, 9 aa, Homo Sapiens
QKELHGLVL

SEQ ID NO: 668797 - protein, 9 aa, Homo Sapiens
ADLTKVFEI

SEQ ID NO: 668798 - protein, 9 aa, Homo Sapiens
PKPVCHLVQ

SEQ ID NO: 668799 - protein, 9 aa, Homo Sapiens
GYEINMLSE

SEQ ID NO: 668800 - protein, 9 aa, Homo Sapiens
ERRADFNQQ

SEQ ID NO: 668801 - protein, 9 aa, Homo Sapiens
VSQLVYGTE

SEQ ID NO: 668802 - protein, 9 aa, Homo Sapiens
LDVKPQGLH

SEQ ID NO: 668803 - protein, 9 aa, Homo Sapiens
LIVLSNCSY

SEQ ID NO: 668804 - protein, 9 aa, Homo Sapiens
LILVRVSSE

SEQ ID NO: 668805 - protein, 9 aa, Homo Sapiens
RAWTPTPPV

SEQ ID NO: 668806 - protein, 9 aa, Homo Sapiens
QLPGTHVSA

SEQ ID NO: 668807 - protein, 9 aa, Homo Sapiens
YYRYLCISH

SEQ ID NO: 668808 - protein, 9 aa, Homo Sapiens
ESSPCCRVT

SEQ ID NO: 668809 - protein, 9 aa, Homo Sapiens
TGLYLSAIQ

SEQ ID NO: 668810 - protein, 9 aa, Homo Sapiens
PLLRYSPYS

SEQ ID NO: 668811 - protein, 9 aa, Homo Sapiens
VVLDVKPQG

SEQ ID NO: 668812 - protein, 9 aa, Homo Sapiens
AGCCLTSRA

SEQ ID NO: 668813 - protein, 9 aa, Homo Sapiens
SDFEKIKAA

SEQ ID NO: 668814 - protein, 9 aa, Homo Sapiens
QNLLQRANN

SEQ ID NO: 668815 - protein, 9 aa, Homo Sapiens
QEFLTTHTN

SEQ ID NO: 668816 - protein, 9 aa, Homo Sapiens
RFPATYSLF

SEQ ID NO: 668817 - protein, 9 aa, Homo Sapiens
NSLVGDRDK

SEQ ID NO: 668818 - protein, 9 aa, Homo Sapiens
LLTLKQQHQ

SEQ ID NO: 668819 - protein, 9 aa, Homo Sapiens
FWYLYDGED

SEQ ID NO: 668820 - protein, 9 aa, Homo Sapiens
LMSPGTRWG

SEQ ID NO: 668821 - protein, 9 aa, Homo Sapiens
LRHLAEGIS

SEQ ID NO: 668822 - protein, 9 aa, Homo Sapiens
KQEPLHSPT

SEQ ID NO: 668823 - protein, 9 aa, Homo Sapiens
EPIRIAGKS

SEQ ID NO: 668824 - protein, 9 aa, Homo Sapiens
RDYGHVSYG

SEQ ID NO: 668825 - protein, 9 aa, Homo Sapiens
ATELGPERR

SEQ ID NO: 668826 - protein, 9 aa, Homo Sapiens
TGVLRSNGC

SEQ ID NO: 668827 - protein, 9 aa, Homo Sapiens
TADLTKVFE

SEQ ID NO: 668828 - protein, 9 aa, Homo Sapiens
SSTDLTPLD

SEQ ID NO: 668829 - protein, 9 aa, Homo Sapiens
SAGKKDDKA

SEQ ID NO: 668830 - protein, 9 aa, Homo Sapiens
SLDDLLPSL

SEQ ID NO: 668831 - protein, 9 aa, Homo Sapiens
PKPEDEVAQ

SEQ ID NO: 668832 - protein, 9 aa, Homo Sapiens
VERKETPCL

SEQ ID NO: 668833 - protein, 9 aa, Homo Sapiens
YTSPEISEA

SEQ ID NO: 668834 - protein, 9 aa, Homo Sapiens
SATELGPER

SEQ ID NO: 668835 - protein, 9 aa, Homo Sapiens
DIFLTGNHI

SEQ ID NO: 668836 - protein, 9 aa, Homo Sapiens
THVQAGTFP

SEQ ID NO: 668837 - protein, 9 aa, Homo Sapiens
MSVVSYNHL

SEQ ID NO: 668838 - protein, 9 aa, Homo Sapiens
EDKTDTMTN

SEQ ID NO: 668839 - protein, 9 aa, Homo Sapiens
RVSSERYLH

SEQ ID NO: 668840 - protein, 9 aa, Homo Sapiens
AARAAARPS

SEQ ID NO: 668841 - protein, 9 aa, Homo Sapiens
GKVNGLKMV

SEQ ID NO: 668842 - protein, 9 aa, Homo Sapiens
SPQSAVGVP

SEQ ID NO: 668843 - protein, 9 aa, Homo Sapiens
APPYTSEKH

SEQ ID NO: 668844 - protein, 9 aa, Homo Sapiens
LRKCILYQL

SEQ ID NO: 668845 - protein, 9 aa, Homo Sapiens
SSSGYRTGL

SEQ ID NO: 668846 - protein, 9 aa, Homo Sapiens
MVQFGPRSA

SEQ ID NO: 668847 - protein, 9 aa, Homo Sapiens
LVMYFLFLL

SEQ ID NO: 668848 - protein, 9 aa, Homo Sapiens
KEPPPCPEL

SEQ ID NO: 668849 - protein, 9 aa, Homo Sapiens
APVYDVPNT

SEQ ID NO: 668850 - protein, 9 aa, Homo Sapiens
QRDREAAKN

SEQ ID NO: 668851 - protein, 9 aa, Homo Sapiens
QVSYRGALT

SEQ ID NO: 668852 - protein, 9 aa, Homo Sapiens
VKPQGLHDG

SEQ ID NO: 668853 - protein, 9 aa, Homo Sapiens
NLGPDPGPT

SEQ ID NO: 668854 - protein, 9 aa, Homo Sapiens
VLESDHECY

SEQ ID NO: 668855 - protein, 9 aa, Homo Sapiens
CGVEGVGAR

SEQ ID NO: 668856 - protein, 9 aa, Homo Sapiens
PQNISNCTY

SEQ ID NO: 668857 - protein, 9 aa, Homo Sapiens
GNAALALDL

SEQ ID NO: 668858 - protein, 9 aa, Homo Sapiens
ALKDLARLS

SEQ ID NO: 668859 - protein, 9 aa, Homo Sapiens
TVQVSEFLL

SEQ ID NO: 668860 - protein, 9 aa, Homo Sapiens
QGRTGPRVG

SEQ ID NO: 668861 - protein, 9 aa, Homo Sapiens
HNELRGMGT

SEQ ID NO: 668862 - protein, 9 aa, Homo Sapiens
IRIAGKSGT

SEQ ID NO: 668863 - protein, 9 aa, Homo Sapiens
STRDQYAEV

SEQ ID NO: 668864 - protein, 9 aa, Homo Sapiens
APCWFPHGY

SEQ ID NO: 668865 - protein, 9 aa, Homo Sapiens
GGKKKPVLA

SEQ ID NO: 668866 - protein, 9 aa, Homo Sapiens
FTRPLLPKW

SEQ ID NO: 668867 - protein, 9 aa, Homo Sapiens
SKVELKSKA

SEQ ID NO: 668868 - protein, 9 aa, Homo Sapiens
FICGFLVLV

SEQ ID NO: 668869 - protein, 9 aa, Homo Sapiens
NRFDAVQAA

SEQ ID NO: 668870 - protein, 9 aa, Homo Sapiens
KPLRKYLTS

SEQ ID NO: 668871 - protein, 9 aa, Homo Sapiens
SYFKNLGNS

SEQ ID NO: 668872 - protein, 9 aa, Homo Sapiens
EDTVEKLQD

SEQ ID NO: 668873 - protein, 9 aa, Homo Sapiens
NHISLEQKK

SEQ ID NO: 668874 - protein, 9 aa, Homo Sapiens
SCVSSSLKL

SEQ ID NO: 668875 - protein, 9 aa, Homo Sapiens
FSRDQPTGY

SEQ ID NO: 668876 - protein, 9 aa, Homo Sapiens
SAGGFWGPH

SEQ ID NO: 668877 - protein, 9 aa, Homo Sapiens
SFWYLYDGE

SEQ ID NO: 668878 - protein, 9 aa, Homo Sapiens
DIPCTPVLG

SEQ ID NO: 668879 - protein, 9 aa, Homo Sapiens
CYKYSSMID

SEQ ID NO: 668880 - protein, 9 aa, Homo Sapiens
LYLAATAHY

SEQ ID NO: 668881 - protein, 9 aa, Homo Sapiens
KVELKSKAN

SEQ ID NO: 668882 - protein, 9 aa, Homo Sapiens
LVFWAACTC

SEQ ID NO: 668883 - protein, 9 aa, Homo Sapiens
NSDFEKIKA

SEQ ID NO: 668884 - protein, 9 aa, Homo Sapiens
NLGNSPQSA

SEQ ID NO: 668885 - protein, 9 aa, Homo Sapiens
THPELSVSV

SEQ ID NO: 668886 - protein, 9 aa, Homo Sapiens
LVPILQLVV

SEQ ID NO: 668887 - protein, 9 aa, Homo Sapiens
QQVREPVCK

SEQ ID NO: 668888 - protein, 9 aa, Homo Sapiens
PGSSQSPEQ

SEQ ID NO: 668889 - protein, 9 aa, Homo Sapiens
PTSWLLNNC

SEQ ID NO: 668890 - protein, 9 aa, Homo Sapiens
CVQASCMQE

SEQ ID NO: 668891 - protein, 9 aa, Homo Sapiens
LVAPPSALP

SEQ ID NO: 668892 - protein, 9 aa, Homo Sapiens
EWYQCVYQS

SEQ ID NO: 668893 - protein, 9 aa, Homo Sapiens
VLLGLSQTR

SEQ ID NO: 668894 - protein, 9 aa, Homo Sapiens
STEASSPVP

SEQ ID NO: 668895 - protein, 9 aa, Homo Sapiens
TLTVREDKV

SEQ ID NO: 668896 - protein, 9 aa, Homo Sapiens
NISNCTYAQ

SEQ ID NO: 668897 - protein, 9 aa, Homo Sapiens
NDSVLESDH

SEQ ID NO: 668898 - protein, 9 aa, Homo Sapiens
RARQAQSLA

SEQ ID NO: 668899 - protein, 9 aa, Homo Sapiens
ESLDTVSMG

SEQ ID NO: 668900 - protein, 9 aa, Homo Sapiens
HKGRPRKRK

SEQ ID NO: 668901 - protein, 9 aa, Homo Sapiens
ANTLRSIKS

SEQ ID NO: 668902 - protein, 9 aa, Homo Sapiens
PQKPPRCWA

SEQ ID NO: 668903 - protein, 9 aa, Homo Sapiens
YSTWPPSIH

SEQ ID NO: 668904 - protein, 9 aa, Homo Sapiens
SSHEPYFSY

SEQ ID NO: 668905 - protein, 9 aa, Homo Sapiens
PLNMLTTPE

SEQ ID NO: 668906 - protein, 9 aa, Homo Sapiens
SIKSKVTAF

SEQ ID NO: 668907 - protein, 9 aa, Homo Sapiens
CGPAFQPLR

SEQ ID NO: 668908 - protein, 9 aa, Homo Sapiens
LLGETPMAS

SEQ ID NO: 668909 - protein, 9 aa, Homo Sapiens
EKSASAAVT

SEQ ID NO: 668910 - protein, 9 aa, Homo Sapiens
SFIATIDRS

SEQ ID NO: 668911 - protein, 9 aa, Homo Sapiens
HICSSVTPG

SEQ ID NO: 668912 - protein, 9 aa, Homo Sapiens
DPALKIETQ

SEQ ID NO: 668913 - protein, 9 aa, Homo Sapiens
LVHSLLPPQ

SEQ ID NO: 668914 - protein, 9 aa, Homo Sapiens
KNLVMSTLN

SEQ ID NO: 668915 - protein, 9 aa, Homo Sapiens
RPVQLLVQL

SEQ ID NO: 668916 - protein, 9 aa, Homo Sapiens
KLMLCFMVQ

SEQ ID NO: 668917 - protein, 9 aa, Homo Sapiens
GDQVLPSCN

SEQ ID NO: 668918 - protein, 9 aa, Homo Sapiens
FQTIDRLYF

SEQ ID NO: 668919 - protein, 9 aa, Homo Sapiens
CHICSSVTP

SEQ ID NO: 668920 - protein, 9 aa, Homo Sapiens
EIVHHNKEI

SEQ ID NO: 668921 - protein, 9 aa, Homo Sapiens
GDCTDLDSR

SEQ ID NO: 668922 - protein, 9 aa, Homo Sapiens
GKFTHSRKQ

SEQ ID NO: 668923 - protein, 9 aa, Homo Sapiens
EMTQLTQVN

SEQ ID NO: 668924 - protein, 9 aa, Homo Sapiens
HSDRCHLCD

SEQ ID NO: 668925 - protein, 9 aa, Homo Sapiens
KCILYQLSQ

SEQ ID NO: 668926 - protein, 9 aa, Homo Sapiens
SIFHNLKDV

SEQ ID NO: 668927 - protein, 9 aa, Homo Sapiens
AKLHVQDQL

SEQ ID NO: 668928 - protein, 9 aa, Homo Sapiens
IDRSAAPAI

SEQ ID NO: 668929 - protein, 9 aa, Homo Sapiens
NLNTMRPLL

SEQ ID NO: 668930 - protein, 9 aa, Homo Sapiens
GNARTSKPT

SEQ ID NO: 668931 - protein, 9 aa, Homo Sapiens
VRYTKDYEQ

SEQ ID NO: 668932 - protein, 9 aa, Homo Sapiens
KKKPVLAPR

SEQ ID NO: 668933 - protein, 9 aa, Homo Sapiens
EVGRLRRRH

SEQ ID NO: 668934 - protein, 9 aa, Homo Sapiens
LQDECRKLE

SEQ ID NO: 668935 - protein, 9 aa, Homo Sapiens
MIQHEQEGA

SEQ ID NO: 668936 - protein, 9 aa, Homo Sapiens
RKKSLGQTS

SEQ ID NO: 668937 - protein, 9 aa, Homo Sapiens
CETVLNSLV

SEQ ID NO: 668938 - protein, 9 aa, Homo Sapiens
IAPPYTSEK

SEQ ID NO: 668939 - protein, 9 aa, Homo Sapiens
ESATTEDLA

SEQ ID NO: 668940 - protein, 9 aa, Homo Sapiens
GPAPASPTG

SEQ ID NO: 668941 - protein, 9 aa, Homo Sapiens
GGGRGNKYQ

SEQ ID NO: 668942 - protein, 9 aa, Homo Sapiens
VSMVPSNEN

SEQ ID NO: 668943 - protein, 9 aa, Homo Sapiens
EGLKSHSSS

SEQ ID NO: 668944 - protein, 9 aa, Homo Sapiens
AAARPSPAR

SEQ ID NO: 668945 - protein, 9 aa, Homo Sapiens
PPCPELGIL

SEQ ID NO: 668946 - protein, 9 aa, Homo Sapiens
WEDLQGLTK

SEQ ID NO: 668947 - protein, 9 aa, Homo Sapiens
VMYFLFLLA

SEQ ID NO: 668948 - protein, 9 aa, Homo Sapiens
PCPCHGGSS

SEQ ID NO: 668949 - protein, 9 aa, Homo Sapiens
NTMRPLLRY

SEQ ID NO: 668950 - protein, 9 aa, Homo Sapiens
LVTSSLPIA

SEQ ID NO: 668951 - protein, 9 aa, Homo Sapiens
NCASHLTAI

SEQ ID NO: 668952 - protein, 9 aa, Homo Sapiens
LHVQDQLMN

SEQ ID NO: 668953 - protein, 9 aa, Homo Sapiens
LVQLNDEAL

SEQ ID NO: 668954 - protein, 9 aa, Homo Sapiens
IRRQTVRGF

SEQ ID NO: 668955 - protein, 9 aa, Homo Sapiens
ELVTSSLPI

SEQ ID NO: 668956 - protein, 9 aa, Homo Sapiens
LGPDPGPTS

SEQ ID NO: 668957 - protein, 9 aa, Homo Sapiens
CKPLRKYLT

SEQ ID NO: 668958 - protein, 9 aa, Homo Sapiens
LAPRMGTFM

SEQ ID NO: 668959 - protein, 9 aa, Homo Sapiens
KSKANDAVN

SEQ ID NO: 668960 - protein, 9 aa, Homo Sapiens
QLHENGLIQ

SEQ ID NO: 668961 - protein, 9 aa, Homo Sapiens
GCLQCSHSD

SEQ ID NO: 668962 - protein, 9 aa, Homo Sapiens
PCTQQVLGD

SEQ ID NO: 668963 - protein, 9 aa, Homo Sapiens
SSSDSATSD

SEQ ID NO: 668964 - protein, 9 aa, Homo Sapiens
LSNCSYLER

SEQ ID NO: 668965 - protein, 9 aa, Homo Sapiens
QRLAPLLIT

SEQ ID NO: 668966 - protein, 9 aa, Homo Sapiens
AEVTVAVDV

SEQ ID NO: 668967 - protein, 9 aa, Homo Sapiens
LKRLLETQH

SEQ ID NO: 668968 - protein, 9 aa, Homo Sapiens
TEGSDLVLM

SEQ ID NO: 668969 - protein, 9 aa, Homo Sapiens
GSLDDLLPS

SEQ ID NO: 668970 - protein, 9 aa, Homo Sapiens
YEEPVLHFG

SEQ ID NO: 668971 - protein, 9 aa, Homo Sapiens
VSYRGALTG

SEQ ID NO: 668972 - protein, 9 aa, Homo Sapiens
GLICIDSLN

SEQ ID NO: 668973 - protein, 9 aa, Homo Sapiens
AGLAPELAL

SEQ ID NO: 668974 - protein, 9 aa, Homo Sapiens
DAIARCEHM

SEQ ID NO: 668975 - protein, 9 aa, Homo Sapiens
YTSEKHYEH

SEQ ID NO: 668976 - protein, 9 aa, Homo Sapiens
ARLRAANGS

SEQ ID NO: 668977 - protein, 9 aa, Homo Sapiens
GLGATLCDI

SEQ ID NO: 668978 - protein, 9 aa, Homo Sapiens
GTPCEDIDE

SEQ ID NO: 668979 - protein, 9 aa, Homo Sapiens
LEQVRWVEV

SEQ ID NO: 668980 - protein, 9 aa, Homo Sapiens
SGLKTMSVV

SEQ ID NO: 668981 - protein, 9 aa, Homo Sapiens
CWAAPLCLW

SEQ ID NO: 668982 - protein, 9 aa, Homo Sapiens
GATLCDINI

SEQ ID NO: 668983 - protein, 9 aa, Homo Sapiens
NAGPVRDSI

SEQ ID NO: 668984 - protein, 9 aa, Homo Sapiens
ARCEHMAQE

SEQ ID NO: 668985 - protein, 9 aa, Homo Sapiens
QIVPKPEDE

SEQ ID NO: 668986 - protein, 9 aa, Homo Sapiens
LPDNTTNSG

SEQ ID NO: 668987 - protein, 9 aa, Homo Sapiens
PIYTSPEIS

SEQ ID NO: 668988 - protein, 9 aa, Homo Sapiens
PVYIQVLPP

SEQ ID NO: 668989 - protein, 9 aa, Homo Sapiens
TLMYLRFPA

SEQ ID NO: 668990 - protein, 9 aa, Homo Sapiens
NLLQRANNL

SEQ ID NO: 668991 - protein, 9 aa, Homo Sapiens
EQLAQDLQG

SEQ ID NO: 668992 - protein, 9 aa, Homo Sapiens
EEKGYNTYA

SEQ ID NO: 668993 - protein, 9 aa, Homo Sapiens
VTRNLPFQF

SEQ ID NO: 668994 - protein, 9 aa, Homo Sapiens
NMTGLYLSA

SEQ ID NO: 668995 - protein, 9 aa, Homo Sapiens
LKAKKSTVL

SEQ ID NO: 668996 - protein, 9 aa, Homo Sapiens
AALALDLLR

SEQ ID NO: 668997 - protein, 9 aa, Homo Sapiens
CFWPAVTMG

SEQ ID NO: 668998 - protein, 9 aa, Homo Sapiens
RKCGVVKYS

SEQ ID NO: 668999 - protein, 9 aa, Homo Sapiens
SGGEAKCVF

SEQ ID NO: 669000 - protein, 9 aa, Homo Sapiens
DKVFPMNPP

SEQ ID NO: 669001 - protein, 9 aa, Homo Sapiens
FKCLDSPQH

SEQ ID NO: 669002 - protein, 9 aa, Homo Sapiens
TLRPGTRAA

SEQ ID NO: 669003 - protein, 9 aa, Homo Sapiens
PESRLVHKL

SEQ ID NO: 669004 - protein, 9 aa, Homo Sapiens
RLYNTMDDL

SEQ ID NO: 669005 - protein, 9 aa, Homo Sapiens
DVIYICGLP

SEQ ID NO: 669006 - protein, 9 aa, Homo Sapiens
IASSFSGEI

SEQ ID NO: 669007 - protein, 9 aa, Homo Sapiens
SKVTAFPGS

SEQ ID NO: 669008 - protein, 9 aa, Homo Sapiens
EQKKLMLCF

SEQ ID NO: 669009 - protein, 9 aa, Homo Sapiens
EHMAQERGE

SEQ ID NO: 669010 - protein, 9 aa, Homo Sapiens
HQVIVRPVQ

SEQ ID NO: 669011 - protein, 9 aa, Homo Sapiens
TGNHISLEQ

SEQ ID NO: 669012 - protein, 9 aa, Homo Sapiens
GRTGPRVGD

SEQ ID NO: 669013 - protein, 9 aa, Homo Sapiens
PGCVWAAKL

SEQ ID NO: 669014 - protein, 9 aa, Homo Sapiens
KVVTTPDLT

SEQ ID NO: 669015 - protein, 9 aa, Homo Sapiens
VLGAATRGN

SEQ ID NO: 669016 - protein, 9 aa, Homo Sapiens
VLEEHLVAK

SEQ ID NO: 669017 - protein, 9 aa, Homo Sapiens
LRSQLLTLK

SEQ ID NO: 669018 - protein, 9 aa, Homo Sapiens
TEASSPVPK

SEQ ID NO: 669019 - protein, 9 aa, Homo Sapiens
AMSSGDLGG

SEQ ID NO: 669020 - protein, 9 aa, Homo Sapiens
TLYLAATAH

SEQ ID NO: 669021 - protein, 9 aa, Homo Sapiens
KGTLQKFVY

SEQ ID NO: 669022 - protein, 9 aa, Homo Sapiens
RSYPAAFES

SEQ ID NO: 669023 - protein, 9 aa, Homo Sapiens
SPEQCGDNT

SEQ ID NO: 669024 - protein, 9 aa, Homo Sapiens
HEPYFSYSG

SEQ ID NO: 669025 - protein, 9 aa, Homo Sapiens
EEIVHHNKE

SEQ ID NO: 669026 - protein, 9 aa, Homo Sapiens
LRWREDRES

SEQ ID NO: 669027 - protein, 9 aa, Homo Sapiens
QTADLTKVF

SEQ ID NO: 669028 - protein, 9 aa, Homo Sapiens
SVVSYNHLG

SEQ ID NO: 669029 - protein, 9 aa, Homo Sapiens
QGLTKDRKE

SEQ ID NO: 669030 - protein, 9 aa, Homo Sapiens
QEGLKSHSS

SEQ ID NO: 669031 - protein, 9 aa, Homo Sapiens
SVSVEMLSS

SEQ ID NO: 669032 - protein, 9 aa, Homo Sapiens
KQIKGVSQN

SEQ ID NO: 669033 - protein, 9 aa, Homo Sapiens
DFTNSDFEK

SEQ ID NO: 669034 - protein, 9 aa, Homo Sapiens
TSDPSTSVP

SEQ ID NO: 669035 - protein, 9 aa, Homo Sapiens
GKPSGDQVL

SEQ ID NO: 669036 - protein, 9 aa, Homo Sapiens
GPAFQPLRP

SEQ ID NO: 669037 - protein, 9 aa, Homo Sapiens
ELRGMGTDW

SEQ ID NO: 669038 - protein, 9 aa, Homo Sapiens
TIDRSAAPA

SEQ ID NO: 669039 - protein, 9 aa, Homo Sapiens
LLKNHSQYE

SEQ ID NO: 669040 - protein, 9 aa, Homo Sapiens
LLHSMPSAH

SEQ ID NO: 669041 - protein, 9 aa, Homo Sapiens
ETRGDCTDL

SEQ ID NO: 669042 - protein, 9 aa, Homo Sapiens
ATRGNARTS

SEQ ID NO: 669043 - protein, 9 aa, Homo Sapiens
SMPSAHGGS

SEQ ID NO: 669044 - protein, 9 aa, Homo Sapiens
RMLGLNPGT

SEQ ID NO: 669045 - protein, 9 aa, Homo Sapiens
WETRYILLL

SEQ ID NO: 669046 - protein, 9 aa, Homo Sapiens
KPTPAADSL

SEQ ID NO: 669047 - protein, 9 aa, Homo Sapiens
PQGLHDGGP

SEQ ID NO: 669048 - protein, 9 aa, Homo Sapiens
HRKVEIIAN

SEQ ID NO: 669049 - protein, 9 aa, Homo Sapiens
QRGPGCVWA

SEQ ID NO: 669050 - protein, 9 aa, Homo Sapiens
AKGLIRTLV

SEQ ID NO: 669051 - protein, 9 aa, Homo Sapiens
FTLTAYLSQ

SEQ ID NO: 669052 - protein, 9 aa, Homo Sapiens
RISCTPKTH

SEQ ID NO: 669053 - protein, 9 aa, Homo Sapiens
EGKYIWSKA

SEQ ID NO: 669054 - protein, 9 aa, Homo Sapiens
YDSGMFAIL

SEQ ID NO: 669055 - protein, 9 aa, Homo Sapiens
QYRMLGLNP

SEQ ID NO: 669056 - protein, 9 aa, Homo Sapiens
RCDLLNEED

SEQ ID NO: 669057 - protein, 9 aa, Homo Sapiens
VAKMEFRHF

SEQ ID NO: 669058 - protein, 9 aa, Homo Sapiens
LCLWLLEFL

SEQ ID NO: 669059 - protein, 9 aa, Homo Sapiens
VYNAGPVRD

SEQ ID NO: 669060 - protein, 9 aa, Homo Sapiens
ALKLSERPE

SEQ ID NO: 669061 - protein, 9 aa, Homo Sapiens
NNGLWAQCS

SEQ ID NO: 669062 - protein, 9 aa, Homo Sapiens
STPQAEVYL

SEQ ID NO: 669063 - protein, 9 aa, Homo Sapiens
LAILSFSEI

SEQ ID NO: 669064 - protein, 9 aa, Homo Sapiens
FQSDPRGVR

SEQ ID NO: 669065 - protein, 9 aa, Homo Sapiens
ATAPCWFPH

SEQ ID NO: 669066 - protein, 9 aa, Homo Sapiens
TIKILFICQ

SEQ ID NO: 669067 - protein, 9 aa, Homo Sapiens
LEDKTDTMT

SEQ ID NO: 669068 - protein, 9 aa, Homo Sapiens
LHMYFFHSL

SEQ ID NO: 669069 - protein, 9 aa, Homo Sapiens
FQHFQGNMM

SEQ ID NO: 669070 - protein, 9 aa, Homo Sapiens
SGGGASSGK

SEQ ID NO: 669071 - protein, 9 aa, Homo Sapiens
SQRISCTPK

SEQ ID NO: 669072 - protein, 9 aa, Homo Sapiens
FVSDSTPQA

SEQ ID NO: 669073 - protein, 9 aa, Homo Sapiens
TQQVLGDHI

SEQ ID NO: 669074 - protein, 9 aa, Homo Sapiens
DNIKSSQPS

SEQ ID NO: 669075 - protein, 9 aa, Homo Sapiens
HTRINCGEK

SEQ ID NO: 669076 - protein, 9 aa, Homo Sapiens
PLVFWAACT

SEQ ID NO: 669077 - protein, 9 aa, Homo Sapiens
RTGREAVQG

SEQ ID NO: 669078 - protein, 9 aa, Homo Sapiens
ETRYILLLW

SEQ ID NO: 669079 - protein, 9 aa, Homo Sapiens
LIPVYIQVL

SEQ ID NO: 669080 - protein, 9 aa, Homo Sapiens
RQGREQKQE

SEQ ID NO: 669081 - protein, 9 aa, Homo Sapiens
VYSQQDAQE

SEQ ID NO: 669082 - protein, 9 aa, Homo Sapiens
HLLRERQQM

SEQ ID NO: 669083 - protein, 9 aa, Homo Sapiens
TRSEKHMLL

SEQ ID NO: 669084 - protein, 9 aa, Homo Sapiens
HRLPFVDVA

SEQ ID NO: 669085 - protein, 9 aa, Homo Sapiens
TYLVTVEGN

SEQ ID NO: 669086 - protein, 9 aa, Homo Sapiens
LPSDDVFKT

SEQ ID NO: 669087 - protein, 9 aa, Homo Sapiens
VRDSICRAW

SEQ ID NO: 669088 - protein, 9 aa, Homo Sapiens
FLTGNHISL

SEQ ID NO: 669089 - protein, 9 aa, Homo Sapiens
PAQLHVLSP

SEQ ID NO: 669090 - protein, 9 aa, Homo Sapiens
FLFLLAPQA

SEQ ID NO: 669091 - protein, 9 aa, Homo Sapiens
YLVTVEGNL

SEQ ID NO: 669092 - protein, 9 aa, Homo Sapiens
LDDLLPSLP

SEQ ID NO: 669093 - protein, 9 aa, Homo Sapiens
TSRYWLNVD

SEQ ID NO: 669094 - protein, 9 aa, Homo Sapiens
YFNGTGTVH

SEQ ID NO: 669095 - protein, 9 aa, Homo Sapiens
PKSEGYYNF

SEQ ID NO: 669096 - protein, 9 aa, Homo Sapiens
RDLEKAPKL

SEQ ID NO: 669097 - protein, 9 aa, Homo Sapiens
PCSHNALKL

SEQ ID NO: 669098 - protein, 9 aa, Homo Sapiens
AQRDREAAK

SEQ ID NO: 669099 - protein, 9 aa, Homo Sapiens
SLQGSESSP

SEQ ID NO: 669100 - protein, 9 aa, Homo Sapiens
DREAAKNSL

SEQ ID NO: 669101 - protein, 9 aa, Homo Sapiens
MSTRDQYAE

SEQ ID NO: 669102 - protein, 9 aa, Homo Sapiens
QLNFQMGLL

SEQ ID NO: 669103 - protein, 9 aa, Homo Sapiens
PLLPKWCPK

SEQ ID NO: 669104 - protein, 9 aa, Homo Sapiens
LGILSPSIV

SEQ ID NO: 669105 - protein, 9 aa, Homo Sapiens
PASPSGSEY

SEQ ID NO: 669106 - protein, 9 aa, Homo Sapiens
PHNFLPLIP

SEQ ID NO: 669107 - protein, 9 aa, Homo Sapiens
TQLTQVNAD

SEQ ID NO: 669108 - protein, 9 aa, Homo Sapiens
AESLNTVCI

SEQ ID NO: 669109 - protein, 9 aa, Homo Sapiens
PKTSGMPSG

SEQ ID NO: 669110 - protein, 9 aa, Homo Sapiens
SIPHSSHSV

SEQ ID NO: 669111 - protein, 9 aa, Homo Sapiens
NSPQSAVGV

SEQ ID NO: 669112 - protein, 9 aa, Homo Sapiens
RPNSPFSTD

SEQ ID NO: 669113 - protein, 9 aa, Homo Sapiens
TQVNADFAT

SEQ ID NO: 669114 - protein, 9 aa, Homo Sapiens
RACCTTAAR

SEQ ID NO: 669115 - protein, 9 aa, Homo Sapiens
QKPESRLVH

SEQ ID NO: 669116 - protein, 9 aa, Homo Sapiens
GYSQLDKMA

SEQ ID NO: 669117 - protein, 9 aa, Homo Sapiens
RYILLLWLS

SEQ ID NO: 669118 - protein, 9 aa, Homo Sapiens
CSHSDRCHL

SEQ ID NO: 669119 - protein, 9 aa, Homo Sapiens
EDKVFPMNP

SEQ ID NO: 669120 - protein, 9 aa, Homo Sapiens
KDYEQQRGK

SEQ ID NO: 669121 - protein, 9 aa, Homo Sapiens
PRSPNLSPE

SEQ ID NO: 669122 - protein, 9 aa, Homo Sapiens
DHSFIATID

SEQ ID NO: 669123 - protein, 9 aa, Homo Sapiens
PSPARWRRW

SEQ ID NO: 669124 - protein, 9 aa, Homo Sapiens
PPTSRKDHK

SEQ ID NO: 669125 - protein, 9 aa, Homo Sapiens
NGTCWLNIQ

SEQ ID NO: 669126 - protein, 9 aa, Homo Sapiens
HSWVSHTHS

SEQ ID NO: 669127 - protein, 9 aa, Homo Sapiens
LLTYLVTVE

SEQ ID NO: 669128 - protein, 9 aa, Homo Sapiens
YSTEEIKRS

SEQ ID NO: 669129 - protein, 9 aa, Homo Sapiens
GHLSFVDFC

SEQ ID NO: 669130 - protein, 9 aa, Homo Sapiens
QSRLAQLVI

SEQ ID NO: 669131 - protein, 9 aa, Homo Sapiens
ARQLGICYT

SEQ ID NO: 669132 - protein, 9 aa, Homo Sapiens
TTHTNEKVE

SEQ ID NO: 669133 - protein, 9 aa, Homo Sapiens
VFKTQVSSR

SEQ ID NO: 669134 - protein, 9 aa, Homo Sapiens
FLSSTSPEN

SEQ ID NO: 669135 - protein, 9 aa, Homo Sapiens
RPKTSGMPS

SEQ ID NO: 669136 - protein, 9 aa, Homo Sapiens
VTLMYLRFP

SEQ ID NO: 669137 - protein, 9 aa, Homo Sapiens
SRQARCLPL

SEQ ID NO: 669138 - protein, 9 aa, Homo Sapiens
LLTLLLIAL

SEQ ID NO: 669139 - protein, 9 aa, Homo Sapiens
FYLCFLPFH

SEQ ID NO: 669140 - protein, 9 aa, Homo Sapiens
EQVRWVEVL

SEQ ID NO: 669141 - protein, 9 aa, Homo Sapiens
SPTKAMKKF

SEQ ID NO: 669142 - protein, 9 aa, Homo Sapiens
PRVGDRQLP

SEQ ID NO: 669143 - protein, 9 aa, Homo Sapiens
FYSTWPPSI

SEQ ID NO: 669144 - protein, 9 aa, Homo Sapiens
GSGLKTMSV

SEQ ID NO: 669145 - protein, 9 aa, Homo Sapiens
QEGALDVEV

SEQ ID NO: 669146 - protein, 9 aa, Homo Sapiens
ASGPNLGPD

SEQ ID NO: 669147 - protein, 9 aa, Homo Sapiens
EAFHVAKME

SEQ ID NO: 669148 - protein, 9 aa, Homo Sapiens
LRLSEFLSV

SEQ ID NO: 669149 - protein, 9 aa, Homo Sapiens
IQRRHTGVA

SEQ ID NO: 669150 - protein, 9 aa, Homo Sapiens
SCTPKTHIS

SEQ ID NO: 669151 - protein, 9 aa, Homo Sapiens
LCALGGLSL

SEQ ID NO: 669152 - protein, 9 aa, Homo Sapiens
DKTDTMTNS

SEQ ID NO: 669153 - protein, 9 aa, Homo Sapiens
TRGKVVGYE

SEQ ID NO: 669154 - protein, 9 aa, Homo Sapiens
PVAFEAELA

SEQ ID NO: 669155 - protein, 9 aa, Homo Sapiens
LKSHSSSAE

SEQ ID NO: 669156 - protein, 9 aa, Homo Sapiens
GDEGPPGDT

SEQ ID NO: 669157 - protein, 9 aa, Homo Sapiens
CILHMYFFH

SEQ ID NO: 669158 - protein, 9 aa, Homo Sapiens
LADRYEEPV

SEQ ID NO: 669159 - protein, 9 aa, Homo Sapiens
NRNFYDQLK

SEQ ID NO: 669160 - protein, 9 aa, Homo Sapiens
VAYSFTHAF

SEQ ID NO: 669161 - protein, 9 aa, Homo Sapiens
EQTSTQPHM

SEQ ID NO: 669162 - protein, 9 aa, Homo Sapiens
LIPSLEQVR

SEQ ID NO: 669163 - protein, 9 aa, Homo Sapiens
TDLTPLDID

SEQ ID NO: 669164 - protein, 9 aa, Homo Sapiens
ENCKPLRKY

SEQ ID NO: 669165 - protein, 9 aa, Homo Sapiens
ISVCEWYQC

SEQ ID NO: 669166 - protein, 9 aa, Homo Sapiens
YNFDSGQPS

SEQ ID NO: 669167 - protein, 9 aa, Homo Sapiens
PLSIFHNLK

SEQ ID NO: 669168 - protein, 9 aa, Homo Sapiens
QINWTTGTA

SEQ ID NO: 669169 - protein, 9 aa, Homo Sapiens
VSDSTPQAE

SEQ ID NO: 669170 - protein, 9 aa, Homo Sapiens
LRRRHMALK

SEQ ID NO: 669171 - protein, 9 aa, Homo Sapiens
PDYTAMSSG

SEQ ID NO: 669172 - protein, 9 aa, Homo Sapiens
VTFTWNTLS

SEQ ID NO: 669173 - protein, 9 aa, Homo Sapiens
CILYQLSQK

SEQ ID NO: 669174 - protein, 9 aa, Homo Sapiens
YLRFPATYS

SEQ ID NO: 669175 - protein, 9 aa, Homo Sapiens
QCGKAFKSS

SEQ ID NO: 669176 - protein, 9 aa, Homo Sapiens
VGLGATLCD

SEQ ID NO: 669177 - protein, 9 aa, Homo Sapiens
GVCISFDAG

SEQ ID NO: 669178 - protein, 9 aa, Homo Sapiens
GDRQLPGTH

SEQ ID NO: 669179 - protein, 9 aa, Homo Sapiens
TIPFKNCYK

SEQ ID NO: 669180 - protein, 9 aa, Homo Sapiens
ITFLTPLYL

SEQ ID NO: 669181 - protein, 9 aa, Homo Sapiens
DCQPCPCHG

SEQ ID NO: 669182 - protein, 9 aa, Homo Sapiens
GVDGYDYSP

SEQ ID NO: 669183 - protein, 9 aa, Homo Sapiens
NFQMGLLVP

SEQ ID NO: 669184 - protein, 9 aa, Homo Sapiens
QCVKGDRRA

SEQ ID NO: 669185 - protein, 9 aa, Homo Sapiens
LQAQIRRLK

SEQ ID NO: 669186 - protein, 9 aa, Homo Sapiens
FLKREGKYI

SEQ ID NO: 669187 - protein, 9 aa, Homo Sapiens
LIGSLDDLL

SEQ ID NO: 669188 - protein, 9 aa, Homo Sapiens
PKTSGSSSH

SEQ ID NO: 669189 - protein, 9 aa, Homo Sapiens
GTRWGDLTA

SEQ ID NO: 669190 - protein, 9 aa, Homo Sapiens
LTEFCSRGS

SEQ ID NO: 669191 - protein, 9 aa, Homo Sapiens
EPAILSPNL

SEQ ID NO: 669192 - protein, 9 aa, Homo Sapiens
PVRDSICRA

SEQ ID NO: 669193 - protein, 9 aa, Homo Sapiens
CSHNALKLA

SEQ ID NO: 669194 - protein, 9 aa, Homo Sapiens
HISLEQKKL

SEQ ID NO: 669195 - protein, 9 aa, Homo Sapiens
SAAATAYGP

SEQ ID NO: 669196 - protein, 9 aa, Homo Sapiens
YTKDYEQQR

SEQ ID NO: 669197 - protein, 9 aa, Homo Sapiens
TGAGGCGGS

SEQ ID NO: 669198 - protein, 9 aa, Homo Sapiens
ELSVSVEML

SEQ ID NO: 669199 - protein, 9 aa, Homo Sapiens
VPILQLVVL

SEQ ID NO: 669200 - protein, 9 aa, Homo Sapiens
AASAGGFWG

SEQ ID NO: 669201 - protein, 9 aa, Homo Sapiens
NAIIHKYRT

SEQ ID NO: 669202 - protein, 9 aa, Homo Sapiens
KRLLETQHA

SEQ ID NO: 669203 - protein, 9 aa, Homo Sapiens
IKSKVTAFP

SEQ ID NO: 669204 - protein, 9 aa, Homo Sapiens
LNVDFRKGD

SEQ ID NO: 669205 - protein, 9 aa, Homo Sapiens
MYLRFPATY

SEQ ID NO: 669206 - protein, 9 aa, Homo Sapiens
LLPKWCPKS

SEQ ID NO: 669207 - protein, 9 aa, Homo Sapiens
LSFSEICYT

SEQ ID NO: 669208 - protein, 9 aa, Homo Sapiens
CDINITEIP

SEQ ID NO: 669209 - protein, 9 aa, Homo Sapiens
RGMGTDWIE

SEQ ID NO: 669210 - protein, 9 aa, Homo Sapiens
AAIALERSQ

SEQ ID NO: 669211 - protein, 9 aa, Homo Sapiens
CAGDSTEAS

SEQ ID NO: 669212 - protein, 9 aa, Homo Sapiens
DRESRRSEQ

SEQ ID NO: 669213 - protein, 9 aa, Homo Sapiens
LNGTCWLNI

SEQ ID NO: 669214 - protein, 9 aa, Homo Sapiens
HGESAFRNG

SEQ ID NO: 669215 - protein, 9 aa, Homo Sapiens
CTPKTHISK

SEQ ID NO: 669216 - protein, 9 aa, Homo Sapiens
SRILEDKTD

SEQ ID NO: 669217 - protein, 9 aa, Homo Sapiens
GVFQHRKVE

SEQ ID NO: 669218 - protein, 9 aa, Homo Sapiens
KLQDECRKL

SEQ ID NO: 669219 - protein, 9 aa, Homo Sapiens
CAGCCLTSR

SEQ ID NO: 669220 - protein, 9 aa, Homo Sapiens
INPNMLTDL

SEQ ID NO: 669221 - protein, 9 aa, Homo Sapiens
RLMSPGTRW

SEQ ID NO: 669222 - protein, 9 aa, Homo Sapiens
QGLHDGGPR

SEQ ID NO: 669223 - protein, 9 aa, Homo Sapiens
KIGNPKISV

SEQ ID NO: 669224 - protein, 9 aa, Homo Sapiens
ENSLVTEEE

SEQ ID NO: 669225 - protein, 9 aa, Homo Sapiens
GDTGLPGKA

SEQ ID NO: 669226 - protein, 9 aa, Homo Sapiens
YENKMYLTR

SEQ ID NO: 669227 - protein, 9 aa, Homo Sapiens
DTIPFDENG

SEQ ID NO: 669228 - protein, 9 aa, Homo Sapiens
VPLHQVIVR

SEQ ID NO: 669229 - protein, 9 aa, Homo Sapiens
ILLLLAFYL

SEQ ID NO: 669230 - protein, 9 aa, Homo Sapiens
LSEFLSVQL

SEQ ID NO: 669231 - protein, 9 aa, Homo Sapiens
HMAQERGES

SEQ ID NO: 669232 - protein, 9 aa, Homo Sapiens
TSEEKAVVY

SEQ ID NO: 669233 - protein, 9 aa, Homo Sapiens
TEKSASAAV

SEQ ID NO: 669234 - protein, 9 aa, Homo Sapiens
QQNVANYLI

SEQ ID NO: 669235 - protein, 9 aa, Homo Sapiens
SATSDPSTS

SEQ ID NO: 669236 - protein, 9 aa, Homo Sapiens
MVTDIFLTG

SEQ ID NO: 669237 - protein, 9 aa, Homo Sapiens
IVAKGSKGY

SEQ ID NO: 669238 - protein, 9 aa, Homo Sapiens
EEEIVHHNK

SEQ ID NO: 669239 - protein, 9 aa, Homo Sapiens
VQLLVQLND

SEQ ID NO: 669240 - protein, 9 aa, Homo Sapiens
KKVLEEHLV

SEQ ID NO: 669241 - protein, 9 aa, Homo Sapiens
FNYYQINWT

SEQ ID NO: 669242 - protein, 9 aa, Homo Sapiens
DFDPLEAET

SEQ ID NO: 669243 - protein, 9 aa, Homo Sapiens
HSDMPMGPG

SEQ ID NO: 669244 - protein, 9 aa, Homo Sapiens
RPVAFEAEL

SEQ ID NO: 669245 - protein, 9 aa, Homo Sapiens
DLFIDGKSK

SEQ ID NO: 669246 - protein, 9 aa, Homo Sapiens
STQPHMAPS

SEQ ID NO: 669247 - protein, 9 aa, Homo Sapiens
ASLLSDQPH

SEQ ID NO: 669248 - protein, 9 aa, Homo Sapiens
SSQEGLKSH

SEQ ID NO: 669249 - protein, 9 aa, Homo Sapiens
EDAQRVLIK

SEQ ID NO: 669250 - protein, 9 aa, Homo Sapiens
MKIDDEVYA

SEQ ID NO: 669251 - protein, 9 aa, Homo Sapiens
VALGNAALA

SEQ ID NO: 669252 - protein, 9 aa, Homo Sapiens
QLHVLSPQK

SEQ ID NO: 669253 - protein, 9 aa, Homo Sapiens
LTQVNADFA

SEQ ID NO: 669254 - protein, 9 aa, Homo Sapiens
QQQRHSFKR

SEQ ID NO: 669255 - protein, 9 aa, Homo Sapiens
GNKYQGGWT

SEQ ID NO: 669256 - protein, 9 aa, Homo Sapiens
ACVQASCMQ

SEQ ID NO: 669257 - protein, 9 aa, Homo Sapiens
PCTPVLGCC

SEQ ID NO: 669258 - protein, 9 aa, Homo Sapiens
TLCDINITE

SEQ ID NO: 669259 - protein, 9 aa, Homo Sapiens
LPKWCPKSL

SEQ ID NO: 669260 - protein, 9 aa, Homo Sapiens
LLRLSEFLS

SEQ ID NO: 669261 - protein, 9 aa, Homo Sapiens
DLILVRVSS

SEQ ID NO: 669262 - protein, 9 aa, Homo Sapiens
DQERKIGNP

SEQ ID NO: 669263 - protein, 9 aa, Homo Sapiens
LHSCFQTID

SEQ ID NO: 669264 - protein, 9 aa, Homo Sapiens
ACTNCLIIA

SEQ ID NO: 669265 - protein, 9 aa, Homo Sapiens
CWFPHGYPE

SEQ ID NO: 669266 - protein, 9 aa, Homo Sapiens
YEECGKAFT

SEQ ID NO: 669267 - protein, 9 aa, Homo Sapiens
KFTHSRKQI

SEQ ID NO: 669268 - protein, 9 aa, Homo Sapiens
LFIDGKSKD

SEQ ID NO: 669269 - protein, 9 aa, Homo Sapiens
ESRLVHKLR

SEQ ID NO: 669270 - protein, 9 aa, Homo Sapiens
QAAHRAATR

SEQ ID NO: 669271 - protein, 9 aa, Homo Sapiens
DLARLSRDV

SEQ ID NO: 669272 - protein, 9 aa, Homo Sapiens
RHPTHRLPF

SEQ ID NO: 669273 - protein, 9 aa, Homo Sapiens
VLAPRMGTF

SEQ ID NO: 669274 - protein, 9 aa, Homo Sapiens
ELFFFQHFQ

SEQ ID NO: 669275 - protein, 9 aa, Homo Sapiens
LARLSRDVT

SEQ ID NO: 669276 - protein, 9 aa, Homo Sapiens
NTPFDLELT

SEQ ID NO: 669277 - protein, 9 aa, Homo Sapiens
TVRGFGLSI

SEQ ID NO: 669278 - protein, 9 aa, Homo Sapiens
LKNHSQYEK

SEQ ID NO: 669279 - protein, 9 aa, Homo Sapiens
SRACCTTAA

SEQ ID NO: 669280 - protein, 9 aa, Homo Sapiens
QKKLMLCFM

SEQ ID NO: 669281 - protein, 9 aa, Homo Sapiens
VSMGPGDCR

SEQ ID NO: 669282 - protein, 9 aa, Homo Sapiens
DSATSDPST

SEQ ID NO: 669283 - protein, 9 aa, Homo Sapiens
FQFREAESV

SEQ ID NO: 669284 - protein, 9 aa, Homo Sapiens
LWQRRLRHL

SEQ ID NO: 669285 - protein, 9 aa, Homo Sapiens
YSFTHAFDG

SEQ ID NO: 669286 - protein, 9 aa, Homo Sapiens
SGSEYLSSV

SEQ ID NO: 669287 - protein, 9 aa, Homo Sapiens
EAKCVFWNF

SEQ ID NO: 669288 - protein, 9 aa, Homo Sapiens
LFFFQHFQG

SEQ ID NO: 669289 - protein, 9 aa, Homo Sapiens
LTTHTNEKV

SEQ ID NO: 669290 - protein, 9 aa, Homo Sapiens
GDDLILVRV

SEQ ID NO: 669291 - protein, 9 aa, Homo Sapiens
GEIVAKGSK

SEQ ID NO: 669292 - protein, 9 aa, Homo Sapiens
RPAKLHVQD

SEQ ID NO: 669293 - protein, 9 aa, Homo Sapiens
RTAHGESAF

SEQ ID NO: 669294 - protein, 9 aa, Homo Sapiens
TGTVHKGRP

SEQ ID NO: 669295 - protein, 9 aa, Homo Sapiens
EEIKRSDCV

SEQ ID NO: 669296 - protein, 9 aa, Homo Sapiens
RGDCTDLDS

SEQ ID NO: 669297 - protein, 9 aa, Homo Sapiens
ADPNKDEES

SEQ ID NO: 669298 - protein, 9 aa, Homo Sapiens
EEPVLHFGD

SEQ ID NO: 669299 - protein, 9 aa, Homo Sapiens
SKANDAVNS

SEQ ID NO: 669300 - protein, 9 aa, Homo Sapiens
NFDSGQPSP

SEQ ID NO: 669301 - protein, 9 aa, Homo Sapiens
GFLVLVVPF

SEQ ID NO: 669302 - protein, 9 aa, Homo Sapiens
RLPDNTTNS

SEQ ID NO: 669303 - protein, 9 aa, Homo Sapiens
TESATTEDL

SEQ ID NO: 669304 - protein, 9 aa, Homo Sapiens
EQCGDNTGA

SEQ ID NO: 669305 - protein, 9 aa, Homo Sapiens
EALLRLSEF

SEQ ID NO: 669306 - protein, 9 aa, Homo Sapiens
VLGDHIVRF

SEQ ID NO: 669307 - protein, 9 aa, Homo Sapiens
VELKSKAND

SEQ ID NO: 669308 - protein, 9 aa, Homo Sapiens
SFIFLRFFE

SEQ ID NO: 669309 - protein, 9 aa, Homo Sapiens
MVIAFDRYV

SEQ ID NO: 669310 - protein, 9 aa, Homo Sapiens
DVKPQGLHD

SEQ ID NO: 669311 - protein, 9 aa, Homo Sapiens
GPETSSPSP

SEQ ID NO: 669312 - protein, 9 aa, Homo Sapiens
QPSQNQGLG

SEQ ID NO: 669313 - protein, 9 aa, Homo Sapiens
HGLVLQDMG

SEQ ID NO: 669314 - protein, 9 aa, Homo Sapiens
HCSLQLPGS

SEQ ID NO: 669315 - protein, 9 aa, Homo Sapiens
VSATELGPE

SEQ ID NO: 669316 - protein, 9 aa, Homo Sapiens
SSSHHHHCP

SEQ ID NO: 669317 - protein, 9 aa, Homo Sapiens
LKIETQAIL

SEQ ID NO: 669318 - protein, 9 aa, Homo Sapiens
PDMHADMHS

SEQ ID NO: 669319 - protein, 9 aa, Homo Sapiens
DSTPQAEVY

SEQ ID NO: 669320 - protein, 9 aa, Homo Sapiens
CEANNGLWA

SEQ ID NO: 669321 - protein, 9 aa, Homo Sapiens
NTTNSGLLE

SEQ ID NO: 669322 - protein, 9 aa, Homo Sapiens
SRPLVFMSL

SEQ ID NO: 669323 - protein, 9 aa, Homo Sapiens
GPPPAASAA

SEQ ID NO: 669324 - protein, 9 aa, Homo Sapiens
RAGLAPELA

SEQ ID NO: 669325 - protein, 9 aa, Homo Sapiens
SAPEEEDSL

SEQ ID NO: 669326 - protein, 9 aa, Homo Sapiens
VEGNLLIVV

SEQ ID NO: 669327 - protein, 9 aa, Homo Sapiens
DSGMFAILT

SEQ ID NO: 669328 - protein, 9 aa, Homo Sapiens
GDTIPFDEN

SEQ ID NO: 669329 - protein, 9 aa, Homo Sapiens
SLSMRMAIA

SEQ ID NO: 669330 - protein, 9 aa, Homo Sapiens
QPDHGDSDL

SEQ ID NO: 669331 - protein, 9 aa, Homo Sapiens
IPVYIQVLP

SEQ ID NO: 669332 - protein, 9 aa, Homo Sapiens
YQMDTYNLF

SEQ ID NO: 669333 - protein, 9 aa, Homo Sapiens
YIYIFGGRD

SEQ ID NO: 669334 - protein, 9 aa, Homo Sapiens
CQPCPCHGG

SEQ ID NO: 669335 - protein, 9 aa, Homo Sapiens
VNQEFLTTH

SEQ ID NO: 669336 - protein, 9 aa, Homo Sapiens
LLTEAASSL

SEQ ID NO: 669337 - protein, 9 aa, Homo Sapiens
LLQRANNLR

SEQ ID NO: 669338 - protein, 9 aa, Homo Sapiens
PLLITSMTS

SEQ ID NO: 669339 - protein, 9 aa, Homo Sapiens
VVNQYRMLG

SEQ ID NO: 669340 - protein, 9 aa, Homo Sapiens
VLNSLVGDR

SEQ ID NO: 669341 - protein, 9 aa, Homo Sapiens
SRPFYLEAI

SEQ ID NO: 669342 - protein, 9 aa, Homo Sapiens
PSDDVFKTQ

SEQ ID NO: 669343 - protein, 9 aa, Homo Sapiens
AWTPTPPVF

SEQ ID NO: 669344 - protein, 9 aa, Homo Sapiens
SPLVAPPSA

SEQ ID NO: 669345 - protein, 9 aa, Homo Sapiens
HSPLVAPPS

SEQ ID NO: 669346 - protein, 9 aa, Homo Sapiens
FDAVQAAHR

SEQ ID NO: 669347 - protein, 9 aa, Homo Sapiens
VLQDMGFTV

SEQ ID NO: 669348 - protein, 9 aa, Homo Sapiens
PVQLLVQLN

SEQ ID NO: 669349 - protein, 9 aa, Homo Sapiens
DTYNLFQSD

SEQ ID NO: 669350 - protein, 9 aa, Homo Sapiens
PNLGPDPGP

SEQ ID NO: 669351 - protein, 9 aa, Homo Sapiens
KGDVIYICG

SEQ ID NO: 669352 - protein, 9 aa, Homo Sapiens
QLVVLDVKP

SEQ ID NO: 669353 - protein, 9 aa, Homo Sapiens
QERKIGNPK

SEQ ID NO: 669354 - protein, 9 aa, Homo Sapiens
VSSSLKLIH

SEQ ID NO: 669355 - protein, 9 aa, Homo Sapiens
YQCVYQSLC

SEQ ID NO: 669356 - protein, 9 aa, Homo Sapiens
SVINHHASI

SEQ ID NO: 669357 - protein, 9 aa, Homo Sapiens
VIVRPVQLL

SEQ ID NO: 669358 - protein, 9 aa, Homo Sapiens
PWGKRRLAC

SEQ ID NO: 669359 - protein, 9 aa, Homo Sapiens
APEEEDSLS

SEQ ID NO: 669360 - protein, 9 aa, Homo Sapiens
IEEKGYNTY

SEQ ID NO: 669361 - protein, 9 aa, Homo Sapiens
PSNSSTVQV

SEQ ID NO: 669362 - protein, 9 aa, Homo Sapiens
RTGLVLMWK

SEQ ID NO: 669363 - protein, 9 aa, Homo Sapiens
TYAQTPANM

SEQ ID NO: 669364 - protein, 9 aa, Homo Sapiens
LVRVSSERY

SEQ ID NO: 669365 - protein, 9 aa, Homo Sapiens
KGLIRTLVT

SEQ ID NO: 669366 - protein, 9 aa, Homo Sapiens
EPLHSPTSK

SEQ ID NO: 669367 - protein, 9 aa, Homo Sapiens
MDTYNLFQS

SEQ ID NO: 669368 - protein, 9 aa, Homo Sapiens
PLVPILQLV

SEQ ID NO: 669369 - protein, 9 aa, Homo Sapiens
LTDLPGPLV

SEQ ID NO: 669370 - protein, 9 aa, Homo Sapiens
DTGLPGKAG

SEQ ID NO: 669371 - protein, 9 aa, Homo Sapiens
GLDLRVNIL

SEQ ID NO: 669372 - protein, 9 aa, Homo Sapiens
LHGLVLQDM

SEQ ID NO: 669373 - protein, 9 aa, Homo Sapiens
RAANGSLSA

SEQ ID NO: 669374 - protein, 9 aa, Homo Sapiens
IKILFICQL

SEQ ID NO: 669375 - protein, 9 aa, Homo Sapiens
LVTVEGNLL

SEQ ID NO: 669376 - protein, 9 aa, Homo Sapiens
AANGSLSAK

SEQ ID NO: 669377 - protein, 9 aa, Homo Sapiens
LVAVMVGEK

SEQ ID NO: 669378 - protein, 9 aa, Homo Sapiens
HYSNIYIKP

SEQ ID NO: 669379 - protein, 9 aa, Homo Sapiens
PSGDQVLPS

SEQ ID NO: 669380 - protein, 9 aa, Homo Sapiens
VTVEGNLLI

SEQ ID NO: 669381 - protein, 9 aa, Homo Sapiens
EAWETRYIL

SEQ ID NO: 669382 - protein, 9 aa, Homo Sapiens
FEAELALTL

SEQ ID NO: 669383 - protein, 9 aa, Homo Sapiens
LTWVSDFVL

SEQ ID NO: 669384 - protein, 9 aa, Homo Sapiens
PPYTSEKHY

SEQ ID NO: 669385 - protein, 9 aa, Homo Sapiens
LKNLVMSTL

SEQ ID NO: 669386 - protein, 9 aa, Homo Sapiens
VHKGRPRKR

SEQ ID NO: 669387 - protein, 9 aa, Homo Sapiens
VRTGREAVQ

SEQ ID NO: 669388 - protein, 9 aa, Homo Sapiens
MVRIPRRAA

SEQ ID NO: 669389 - protein, 9 aa, Homo Sapiens
VLHTLLDPL

SEQ ID NO: 669390 - protein, 9 aa, Homo Sapiens
CGFLVLVVP

SEQ ID NO: 669391 - protein, 9 aa, Homo Sapiens
LLIVLSNCS

SEQ ID NO: 669392 - protein, 9 aa, Homo Sapiens
EQIVPKPED

SEQ ID NO: 669393 - protein, 9 aa, Homo Sapiens
FTSEEKAVV

SEQ ID NO: 669394 - protein, 9 aa, Homo Sapiens
PIASSFSGE

SEQ ID NO: 669395 - protein, 9 aa, Homo Sapiens
IPCTPVLGC

SEQ ID NO: 669396 - protein, 9 aa, Homo Sapiens
SDSATSDPS

SEQ ID NO: 669397 - protein, 9 aa, Homo Sapiens
PVPKRPGSL

SEQ ID NO: 669398 - protein, 9 aa, Homo Sapiens
CHLVQERRA

SEQ ID NO: 669399 - protein, 9 aa, Homo Sapiens
YSTKRDVWS

SEQ ID NO: 669400 - protein, 9 aa, Homo Sapiens
RRREHLLRE

SEQ ID NO: 669401 - protein, 9 aa, Homo Sapiens
IRTLVTLKA

SEQ ID NO: 669402 - protein, 9 aa, Homo Sapiens
IFGGRDPIT

SEQ ID NO: 669403 - protein, 9 aa, Homo Sapiens
QPCPCHGGS

SEQ ID NO: 669404 - protein, 9 aa, Homo Sapiens
VHHNKEIER

SEQ ID NO: 669405 - protein, 9 aa, Homo Sapiens
VTAGRGDHL

SEQ ID NO: 669406 - protein, 9 aa, Homo Sapiens
NKEIERLQK

SEQ ID NO: 669407 - protein, 9 aa, Homo Sapiens
GPGCVWAAK

SEQ ID NO: 669408 - protein, 9 aa, Homo Sapiens
CGMEACVQA

SEQ ID NO: 669409 - protein, 9 aa, Homo Sapiens
LGRSITAVS

SEQ ID NO: 669410 - protein, 9 aa, Homo Sapiens
GTQSAEIYR

SEQ ID NO: 669411 - protein, 9 aa, Homo Sapiens
LAGLEPFGI

SEQ ID NO: 669412 - protein, 9 aa, Homo Sapiens
LLCGMEACV

SEQ ID NO: 669413 - protein, 9 aa, Homo Sapiens
QFGPRSAGL

SEQ ID NO: 669414 - protein, 9 aa, Homo Sapiens
PESAPEEED

SEQ ID NO: 669415 - protein, 9 aa, Homo Sapiens
GPVRDSICR

SEQ ID NO: 669416 - protein, 9 aa, Homo Sapiens
TRPLLPKWC

SEQ ID NO: 669417 - protein, 9 aa, Homo Sapiens
NLGETESAT

SEQ ID NO: 669418 - protein, 9 aa, Homo Sapiens
VRFVSDSTP

SEQ ID NO: 669419 - protein, 9 aa, Homo Sapiens
RDERETVIP

SEQ ID NO: 669420 - protein, 9 aa, Homo Sapiens
EMKNAMRKC

SEQ ID NO: 669421 - protein, 9 aa, Homo Sapiens
EEDEENSLV

SEQ ID NO: 669422 - protein, 9 aa, Homo Sapiens
DEGPPGDTG

SEQ ID NO: 669423 - protein, 9 aa, Homo Sapiens
QVSEFLLIC

SEQ ID NO: 669424 - protein, 9 aa, Homo Sapiens
KTSGSSSHH

SEQ ID NO: 669425 - protein, 9 aa, Homo Sapiens
CCTTAARAA

SEQ ID NO: 669426 - protein, 9 aa, Homo Sapiens
TRPKTSGMP

SEQ ID NO: 669427 - protein, 9 aa, Homo Sapiens
SPLKGQQVR

SEQ ID NO: 669428 - protein, 9 aa, Homo Sapiens
KYLTSEAEE

SEQ ID NO: 669429 - protein, 9 aa, Homo Sapiens
AEVTHNIRE

SEQ ID NO: 669430 - protein, 9 aa, Homo Sapiens
LIELFFFQH

SEQ ID NO: 669431 - protein, 9 aa, Homo Sapiens
TFLTPLYLG

SEQ ID NO: 669432 - protein, 9 aa, Homo Sapiens
SPIYTSPEI

SEQ ID NO: 669433 - protein, 9 aa, Homo Sapiens
ICLLGGGHP

SEQ ID NO: 669434 - protein, 9 aa, Homo Sapiens
RGFGLSIKG

SEQ ID NO: 669435 - protein, 9 aa, Homo Sapiens
DGKPSGDQV

SEQ ID NO: 669436 - protein, 9 aa, Homo Sapiens
AFSSHEPYF

SEQ ID NO: 669437 - protein, 9 aa, Homo Sapiens
SQVCLYQLH

SEQ ID NO: 669438 - protein, 9 aa, Homo Sapiens
SRGMNRNFY

SEQ ID NO: 669439 - protein, 9 aa, Homo Sapiens
YCSCVSSSL

SEQ ID NO: 669440 - protein, 9 aa, Homo Sapiens
SSHSVINHH

SEQ ID NO: 669441 - protein, 9 aa, Homo Sapiens
LSMVRIPRR

SEQ ID NO: 669442 - protein, 9 aa, Homo Sapiens
ISGERDLEK

SEQ ID NO: 669443 - protein, 9 aa, Homo Sapiens
EACVQASCM

SEQ ID NO: 669444 - protein, 9 aa, Homo Sapiens
IGNPKISVA

SEQ ID NO: 669445 - protein, 9 aa, Homo Sapiens
TPKTHISKN

SEQ ID NO: 669446 - protein, 9 aa, Homo Sapiens
EARSPFLSS

SEQ ID NO: 669447 - protein, 9 aa, Homo Sapiens
RPFYLEAIC

SEQ ID NO: 669448 - protein, 9 aa, Homo Sapiens
YYRLYNTMD

SEQ ID NO: 669449 - protein, 9 aa, Homo Sapiens
SWLLNNCHP

SEQ ID NO: 669450 - protein, 9 aa, Homo Sapiens
AHCSLQLPG

SEQ ID NO: 669451 - protein, 9 aa, Homo Sapiens
NLVAVMVGE

SEQ ID NO: 669452 - protein, 9 aa, Homo Sapiens
TYDFTNSDF

SEQ ID NO: 669453 - protein, 9 aa, Homo Sapiens
KFVYDLFET

SEQ ID NO: 669454 - protein, 9 aa, Homo Sapiens
NQEFLTTHT

SEQ ID NO: 669455 - protein, 9 aa, Homo Sapiens
DLQGLAQAQ

SEQ ID NO: 669456 - protein, 9 aa, Homo Sapiens
YSQLDKMAS

SEQ ID NO: 669457 - protein, 9 aa, Homo Sapiens
SPQKPPRCW

SEQ ID NO: 669458 - protein, 9 aa, Homo Sapiens
LGKFTHSRK

SEQ ID NO: 669459 - protein, 9 aa, Homo Sapiens
HDLKVHYSN

SEQ ID NO: 669460 - protein, 9 aa, Homo Sapiens
PLEAETPAC

SEQ ID NO: 669461 - protein, 9 aa, Homo Sapiens
QPTGYKKNS

SEQ ID NO: 669462 - protein, 9 aa, Homo Sapiens
LFNYYQINW

SEQ ID NO: 669463 - protein, 9 aa, Homo Sapiens
VAKGSKGYQ

SEQ ID NO: 669464 - protein, 9 aa, Homo Sapiens
EAWEDLQGL

SEQ ID NO: 669465 - protein, 9 aa, Homo Sapiens
RPRPNSPFS

SEQ ID NO: 669466 - protein, 9 aa, Homo Sapiens
DFCYSSNVT

SEQ ID NO: 669467 - protein, 9 aa, Homo Sapiens
LSLLAPLPS

SEQ ID NO: 669468 - protein, 9 aa, Homo Sapiens
AETPACELK

SEQ ID NO: 669469 - protein, 9 aa, Homo Sapiens
SLEQVRWVE

SEQ ID NO: 669470 - protein, 9 aa, Homo Sapiens
ILVRVSSER

SEQ ID NO: 669471 - protein, 9 aa, Homo Sapiens
CLQCSHSDR

SEQ ID NO: 669472 - protein, 9 aa, Homo Sapiens
VIYICGLPD

SEQ ID NO: 669473 - protein, 9 aa, Homo Sapiens
SRGMYETPA

SEQ ID NO: 669474 - protein, 9 aa, Homo Sapiens
DSVLESDHE

SEQ ID NO: 669475 - protein, 9 aa, Homo Sapiens
VVRFVSDST

SEQ ID NO: 669476 - protein, 9 aa, Homo Sapiens
SCVGVFQHR

SEQ ID NO: 669477 - protein, 9 aa, Homo Sapiens
HKYRTDLID

SEQ ID NO: 669478 - protein, 9 aa, Homo Sapiens
ELSMVRIPR

SEQ ID NO: 669479 - protein, 9 aa, Homo Sapiens
RTDLIDMNT

SEQ ID NO: 669480 - protein, 9 aa, Homo Sapiens
GLWPAESET

SEQ ID NO: 669481 - protein, 9 aa, Homo Sapiens
VTIRRQTVR

SEQ ID NO: 669482 - protein, 9 aa, Homo Sapiens
CTNCLIIAV

SEQ ID NO: 669483 - protein, 9 aa, Homo Sapiens
GSSSHHHHC

SEQ ID NO: 669484 - protein, 9 aa, Homo Sapiens
IYLNATDAD

SEQ ID NO: 669485 - protein, 9 aa, Homo Sapiens
SEEKAVVYK

SEQ ID NO: 669486 - protein, 9 aa, Homo Sapiens
NTLSAAQLY

SEQ ID NO: 669487 - protein, 9 aa, Homo Sapiens
ARQAQSLAQ

SEQ ID NO: 669488 - protein, 9 aa, Homo Sapiens
HELTAKGTP

SEQ ID NO: 669489 - protein, 9 aa, Homo Sapiens
WPPSIHKDY

SEQ ID NO: 669490 - protein, 9 aa, Homo Sapiens
QLLRRSYPA

SEQ ID NO: 669491 - protein, 9 aa, Homo Sapiens
DTMTNSSIT

SEQ ID NO: 669492 - protein, 9 aa, Homo Sapiens
GCVWAAKLI

SEQ ID NO: 669493 - protein, 9 aa, Homo Sapiens
TYNLFQSDP

SEQ ID NO: 669494 - protein, 9 aa, Homo Sapiens
AVVNQYRML

SEQ ID NO: 669495 - protein, 9 aa, Homo Sapiens
KLKRLLETQ

SEQ ID NO: 669496 - protein, 9 aa, Homo Sapiens
VYGTEGSDL

SEQ ID NO: 669497 - protein, 9 aa, Homo Sapiens
LESYGKSYV

SEQ ID NO: 669498 - protein, 9 aa, Homo Sapiens
HSVINHHAS

SEQ ID NO: 669499 - protein, 9 aa, Homo Sapiens
KGDRRAPGI

SEQ ID NO: 669500 - protein, 9 aa, Homo Sapiens
FTWNTLSAA

SEQ ID NO: 669501 - protein, 9 aa, Homo Sapiens
SLVTEEESS

SEQ ID NO: 669502 - protein, 9 aa, Homo Sapiens
FLLAPQAYL

SEQ ID NO: 669503 - protein, 9 aa, Homo Sapiens
LILMVIAFD

SEQ ID NO: 669504 - protein, 9 aa, Homo Sapiens
FRVYSQQDA

SEQ ID NO: 669505 - protein, 9 aa, Homo Sapiens
GMGTDWIED

SEQ ID NO: 669506 - protein, 9 aa, Homo Sapiens
RFFGTQSAE

SEQ ID NO: 669507 - protein, 9 aa, Homo Sapiens
PHGYPEAKK

SEQ ID NO: 669508 - protein, 9 aa, Homo Sapiens
KQFSTSSTD

SEQ ID NO: 669509 - protein, 9 aa, Homo Sapiens
SLLSDQPHN

SEQ ID NO: 669510 - protein, 9 aa, Homo Sapiens
LRAANGSLS

SEQ ID NO: 669511 - protein, 9 aa, Homo Sapiens
IEGCHICSS

SEQ ID NO: 669512 - protein, 9 aa, Homo Sapiens
LLVQLNDEA

SEQ ID NO: 669513 - protein, 9 aa, Homo Sapiens
GDHDLKVHY

SEQ ID NO: 669514 - protein, 9 aa, Homo Sapiens
AVQAAHRAA

SEQ ID NO: 669515 - protein, 9 aa, Homo Sapiens
CISFDAGMC

SEQ ID NO: 669516 - protein, 9 aa, Homo Sapiens
PSRPLVFMS

SEQ ID NO: 669517 - protein, 9 aa, Homo Sapiens
PFLSSTSPE

SEQ ID NO: 669518 - protein, 9 aa, Homo Sapiens
KVLEEHLVA

SEQ ID NO: 669519 - protein, 9 aa, Homo Sapiens
EGCHICSSV

SEQ ID NO: 669520 - protein, 9 aa, Homo Sapiens
PASPTGGSG

SEQ ID NO: 669521 - protein, 9 aa, Homo Sapiens
NTVCITEYE

SEQ ID NO: 669522 - protein, 9 aa, Homo Sapiens
VDFCYSSNV

SEQ ID NO: 669523 - protein, 9 aa, Homo Sapiens
HSLIPVYIQ

SEQ ID NO: 669524 - protein, 9 aa, Homo Sapiens
NSGLLEAST

SEQ ID NO: 669525 - protein, 9 aa, Homo Sapiens
TYSATHPWV

SEQ ID NO: 669526 - protein, 9 aa, Homo Sapiens
ETPCLKLII

SEQ ID NO: 669527 - protein, 9 aa, Homo Sapiens
LLLTLLLIA

SEQ ID NO: 669528 - protein, 9 aa, Homo Sapiens
MLGLNPGTV

SEQ ID NO: 669529 - protein, 9 aa, Homo Sapiens
KAKKSTVLH

SEQ ID NO: 669530 - protein, 9 aa, Homo Sapiens
STVQVSEFL

SEQ ID NO: 669531 - protein, 9 aa, Homo Sapiens
GDSDLGLQC

SEQ ID NO: 669532 - protein, 9 aa, Homo Sapiens
KLIGSLDDL

SEQ ID NO: 669533 - protein, 9 aa, Homo Sapiens
EQKQEPLHS

SEQ ID NO: 669534 - protein, 9 aa, Homo Sapiens
SDSTPQAEV

SEQ ID NO: 669535 - protein, 9 aa, Homo Sapiens
QTVRGFGLS

SEQ ID NO: 669536 - protein, 9 aa, Homo Sapiens
VDFRKGDVS

SEQ ID NO: 669537 - protein, 9 aa, Homo Sapiens
VYIQVLPPE

SEQ ID NO: 669538 - protein, 9 aa, Homo Sapiens
DQPHNFLPL

SEQ ID NO: 669539 - protein, 9 aa, Homo Sapiens
TFTLFNYYQ

SEQ ID NO: 669540 - protein, 9 aa, Homo Sapiens
VPNTPFDLE

SEQ ID NO: 669541 - protein, 9 aa, Homo Sapiens
SEVHSWVSH

SEQ ID NO: 669542 - protein, 9 aa, Homo Sapiens
RGKVVGYEI

SEQ ID NO: 669543 - protein, 9 aa, Homo Sapiens
SNSSTVQVS

SEQ ID NO: 669544 - protein, 9 aa, Homo Sapiens
LPTKVVTTP

SEQ ID NO: 669545 - protein, 9 aa, Homo Sapiens
KCLDSPQHI

SEQ ID NO: 669546 - protein, 9 aa, Homo Sapiens
CCSIVGTGE

SEQ ID NO: 669547 - protein, 9 aa, Homo Sapiens
PFKNCYKYS

SEQ ID NO: 669548 - protein, 9 aa, Homo Sapiens
AGRGDHLAR

SEQ ID NO: 669549 - protein, 9 aa, Homo Sapiens
CALGGLSLL

SEQ ID NO: 669550 - protein, 9 aa, Homo Sapiens
DRDYGHVSY

SEQ ID NO: 669551 - protein, 9 aa, Homo Sapiens
SCFQTIDRL

SEQ ID NO: 669552 - protein, 9 aa, Homo Sapiens
GPNLGPDPG

SEQ ID NO: 669553 - protein, 9 aa, Homo Sapiens
CQVPLVFWA

SEQ ID NO: 669554 - protein, 9 aa, Homo Sapiens
LKFKDFGTY

SEQ ID NO: 669555 - protein, 9 aa, Homo Sapiens
RSIKSKVTA

SEQ ID NO: 669556 - protein, 9 aa, Homo Sapiens
VALQIAPPY

SEQ ID NO: 669557 - protein, 9 aa, Homo Sapiens
LHDGGPRLR

SEQ ID NO: 669558 - protein, 9 aa, Homo Sapiens
RHKAFSNCA

SEQ ID NO: 669559 - protein, 9 aa, Homo Sapiens
TQPHMAPSK

SEQ ID NO: 669560 - protein, 9 aa, Homo Sapiens
SAEIYRNHF

SEQ ID NO: 669561 - protein, 9 aa, Homo Sapiens
YDQLKFVSN

SEQ ID NO: 669562 - protein, 9 aa, Homo Sapiens
AQCQLGLLT

SEQ ID NO: 669563 - protein, 9 aa, Homo Sapiens
RVNILLLLC

SEQ ID NO: 669564 - protein, 9 aa, Homo Sapiens
ESYGKSYVS

SEQ ID NO: 669565 - protein, 9 aa, Homo Sapiens
TLNSALAQK

SEQ ID NO: 669566 - protein, 9 aa, Homo Sapiens
GQYSKITFL

SEQ ID NO: 669567 - protein, 9 aa, Homo Sapiens
GRHKAFSNC

SEQ ID NO: 669568 - protein, 9 aa, Homo Sapiens
FDAGMCRAY

SEQ ID NO: 669569 - protein, 9 aa, Homo Sapiens
LSMRMAIAA

SEQ ID NO: 669570 - protein, 9 aa, Homo Sapiens
LSDQPHNFL

SEQ ID NO: 669571 - protein, 9 aa, Homo Sapiens
IRRLKNSVP

SEQ ID NO: 669572 - protein, 9 aa, Homo Sapiens
ASSPVPKRP

SEQ ID NO: 669573 - protein, 9 aa, Homo Sapiens
NLIVSATEL

SEQ ID NO: 669574 - protein, 9 aa, Homo Sapiens
ISLEQKKLM

SEQ ID NO: 669575 - protein, 9 aa, Homo Sapiens
FWPAVTMGM

SEQ ID NO: 669576 - protein, 9 aa, Homo Sapiens
QDEARSPFL

SEQ ID NO: 669577 - protein, 9 aa, Homo Sapiens
KASGNPKPV

SEQ ID NO: 669578 - protein, 9 aa, Homo Sapiens
ASAAVTRNL

SEQ ID NO: 669579 - protein, 9 aa, Homo Sapiens
SPSGSEYLS

SEQ ID NO: 669580 - protein, 9 aa, Homo Sapiens
CPCHGGSSC

SEQ ID NO: 669581 - protein, 9 aa, Homo Sapiens
PPPCPELGI

SEQ ID NO: 669582 - protein, 9 aa, Homo Sapiens
SSLSESSPT

SEQ ID NO: 669583 - protein, 9 aa, Homo Sapiens
ARPAKLHVQ

SEQ ID NO: 669584 - protein, 9 aa, Homo Sapiens
LGGLSLLLG

SEQ ID NO: 669585 - protein, 9 aa, Homo Sapiens
AHLGTTGLL

SEQ ID NO: 669586 - protein, 9 aa, Homo Sapiens
LGETPMASL

SEQ ID NO: 669587 - protein, 9 aa, Homo Sapiens
HGYPEAKKV

SEQ ID NO: 669588 - protein, 9 aa, Homo Sapiens
NVDFRKGDV

SEQ ID NO: 669589 - protein, 9 aa, Homo Sapiens
FTLFNYYQI

SEQ ID NO: 669590 - protein, 9 aa, Homo Sapiens
KSQVCLYQL

SEQ ID NO: 669591 - protein, 9 aa, Homo Sapiens
TWVSDFVLL

SEQ ID NO: 669592 - protein, 9 aa, Homo Sapiens
GKRRLACAG

SEQ ID NO: 669593 - protein, 9 aa, Homo Sapiens
VYDLFETIF

SEQ ID NO: 669594 - protein, 9 aa, Homo Sapiens
RAQKWLLSL

SEQ ID NO: 669595 - protein, 9 aa, Homo Sapiens
CLDSPQHIK

SEQ ID NO: 669596 - protein, 9 aa, Homo Sapiens
LRKKDVTGA

SEQ ID NO: 669597 - protein, 9 aa, Homo Sapiens
ALLRLSEFL

SEQ ID NO: 669598 - protein, 9 aa, Homo Sapiens
ATSDIPCTP

SEQ ID NO: 669599 - protein, 9 aa, Homo Sapiens
VLIKALEDD

SEQ ID NO: 669600 - protein, 9 aa, Homo Sapiens
EEDSLSPLQ

SEQ ID NO: 669601 - protein, 9 aa, Homo Sapiens
LSPQKPPRC

SEQ ID NO: 669602 - protein, 9 aa, Homo Sapiens
SIATSDIPC

SEQ ID NO: 669603 - protein, 9 aa, Homo Sapiens
PCLKLIILM

SEQ ID NO: 669604 - protein, 9 aa, Homo Sapiens
DSERAQKWL

SEQ ID NO: 669605 - protein, 9 aa, Homo Sapiens
YLCFLPFHI

SEQ ID NO: 669606 - protein, 9 aa, Homo Sapiens
SFQGRTGPR

SEQ ID NO: 669607 - protein, 9 aa, Homo Sapiens
PSLEQVRWV

SEQ ID NO: 669608 - protein, 9 aa, Homo Sapiens
MYFLFLLAP

SEQ ID NO: 669609 - protein, 9 aa, Homo Sapiens
CITEYEEES

SEQ ID NO: 669610 - protein, 9 aa, Homo Sapiens
RRAPGIPGS

SEQ ID NO: 669611 - protein, 9 aa, Homo Sapiens
ALKIETQAI

SEQ ID NO: 669612 - protein, 9 aa, Homo Sapiens
KYRTDLIDM

SEQ ID NO: 669613 - protein, 9 aa, Homo Sapiens
QRTQTGEKP

SEQ ID NO: 669614 - protein, 9 aa, Homo Sapiens
SGSSSHHHH

SEQ ID NO: 669615 - protein, 9 aa, Homo Sapiens
CLLGGGHPV

SEQ ID NO: 669616 - protein, 9 aa, Homo Sapiens
SDSEVHSWV

SEQ ID NO: 669617 - protein, 9 aa, Homo Sapiens
IPSLEQVRW

SEQ ID NO: 669618 - protein, 9 aa, Homo Sapiens
QLHSCFQTI

SEQ ID NO: 669619 - protein, 9 aa, Homo Sapiens
YYNFDSGQP

SEQ ID NO: 669620 - protein, 9 aa, Homo Sapiens
AVFTLTAYL

SEQ ID NO: 669621 - protein, 9 aa, Homo Sapiens
KLKERIEEK

SEQ ID NO: 669622 - protein, 9 aa, Homo Sapiens
QLDKMASLY

SEQ ID NO: 669623 - protein, 9 aa, Homo Sapiens
FIATIDRSA

SEQ ID NO: 669624 - protein, 9 aa, Homo Sapiens
ASLSMRMAI

SEQ ID NO: 669625 - protein, 9 aa, Homo Sapiens
MRMAIAAEP

SEQ ID NO: 669626 - protein, 9 aa, Homo Sapiens
PLPSAGKKD

SEQ ID NO: 669627 - protein, 9 aa, Homo Sapiens
KAFTNLSAL

SEQ ID NO: 669628 - protein, 9 aa, Homo Sapiens
QSPESAPEE

SEQ ID NO: 669629 - protein, 9 aa, Homo Sapiens
LDPLNMLTT

SEQ ID NO: 669630 - protein, 9 aa, Homo Sapiens
PRTGAGGCG

SEQ ID NO: 669631 - protein, 9 aa, Homo Sapiens
PPPRSPNLS

SEQ ID NO: 669632 - protein, 9 aa, Homo Sapiens
RILEDKTDT

SEQ ID NO: 669633 - protein, 9 aa, Homo Sapiens
TSGMPSGNG

SEQ ID NO: 669634 - protein, 9 aa, Homo Sapiens
TVSMGPGDC

SEQ ID NO: 669635 - protein, 9 aa, Homo Sapiens
KITFLTPLY

SEQ ID NO: 669636 - protein, 9 aa, Homo Sapiens
MDDLLLYIN

SEQ ID NO: 669637 - protein, 9 aa, Homo Sapiens
AYLSQAVLT

SEQ ID NO: 669638 - protein, 9 aa, Homo Sapiens
SGERDLEKA

SEQ ID NO: 669639 - protein, 9 aa, Homo Sapiens
KVHYSNIYI

SEQ ID NO: 669640 - protein, 9 aa, Homo Sapiens
LAAFKAQNN

SEQ ID NO: 669641 - protein, 9 aa, Homo Sapiens
LHSMPSAHG

SEQ ID NO: 669642 - protein, 9 aa, Homo Sapiens
GESAAAAAE

SEQ ID NO: 669643 - protein, 9 aa, Homo Sapiens
PTFRVYSQQ

SEQ ID NO: 669644 - protein, 9 aa, Homo Sapiens
GGFWGPHGH

SEQ ID NO: 669645 - protein, 9 aa, Homo Sapiens
TVLCALGGL

SEQ ID NO: 669646 - protein, 9 aa, Homo Sapiens
QVIVRPVQL

SEQ ID NO: 669647 - protein, 9 aa, Homo Sapiens
SYEDYANKP

SEQ ID NO: 669648 - protein, 9 aa, Homo Sapiens
TRWGDLTAT

SEQ ID NO: 669649 - protein, 9 aa, Homo Sapiens
DEENSLVTE

SEQ ID NO: 669650 - protein, 9 aa, Homo Sapiens
TSDIPCTPV

SEQ ID NO: 669651 - protein, 9 aa, Homo Sapiens
PKWCPKSLF

SEQ ID NO: 669652 - protein, 9 aa, Homo Sapiens
PLVAPPSAL

SEQ ID NO: 669653 - protein, 9 aa, Homo Sapiens
SVEMLSSVA

SEQ ID NO: 669654 - protein, 9 aa, Homo Sapiens
SFYSTWPPS

SEQ ID NO: 669655 - protein, 9 aa, Homo Sapiens
SGDTIPFDE

SEQ ID NO: 669656 - protein, 9 aa, Homo Sapiens
VDVLPLVPI

SEQ ID NO: 669657 - protein, 9 aa, Homo Sapiens
DGKSKDIRQ

SEQ ID NO: 669658 - protein, 9 aa, Homo Sapiens
AGLEPFGIC

SEQ ID NO: 669659 - protein, 9 aa, Homo Sapiens
RRRHMALKE

SEQ ID NO: 669660 - protein, 9 aa, Homo Sapiens
SITAVSKFD

SEQ ID NO: 669661 - protein, 9 aa, Homo Sapiens
LSENPLLST

SEQ ID NO: 669662 - protein, 9 aa, Homo Sapiens
YSPGQLIED

SEQ ID NO: 669663 - protein, 9 aa, Homo Sapiens
ESETWKRTK

SEQ ID NO: 669664 - protein, 9 aa, Homo Sapiens
SCSDTRICK

SEQ ID NO: 669665 - protein, 9 aa, Homo Sapiens
RLVQTADLT

SEQ ID NO: 669666 - protein, 9 aa, Homo Sapiens
RLMIQHEQE

SEQ ID NO: 669667 - protein, 9 aa, Homo Sapiens
VQFGPRSAG

SEQ ID NO: 669668 - protein, 9 aa, Homo Sapiens
PPRCWAAPL

SEQ ID NO: 669669 - protein, 9 aa, Homo Sapiens
WFPHGYPEA

SEQ ID NO: 669670 - protein, 9 aa, Homo Sapiens
RDFHPIMKR

SEQ ID NO: 669671 - protein, 9 aa, Homo Sapiens
EAICLLGGG

SEQ ID NO: 669672 - protein, 9 aa, Homo Sapiens
QSDVRYTKD

SEQ ID NO: 669673 - protein, 9 aa, Homo Sapiens
IDDEVYAAP

SEQ ID NO: 669674 - protein, 9 aa, Homo Sapiens
PTSRKDHKF

SEQ ID NO: 669675 - protein, 9 aa, Homo Sapiens
TSSTDLTPL

SEQ ID NO: 669676 - protein, 9 aa, Homo Sapiens
VRWVEVLGF

SEQ ID NO: 669677 - protein, 9 aa, Homo Sapiens
CKGCVFGGL

SEQ ID NO: 669678 - protein, 9 aa, Homo Sapiens
AQDEARSPF

SEQ ID NO: 669679 - protein, 9 aa, Homo Sapiens
QLVYGTEGS

SEQ ID NO: 669680 - protein, 9 aa, Homo Sapiens
LMLCFMVQF

SEQ ID NO: 669681 - protein, 9 aa, Homo Sapiens
FFGTQSAEI

SEQ ID NO: 669682 - protein, 9 aa, Homo Sapiens
LKERIEEKG

SEQ ID NO: 669683 - protein, 9 aa, Homo Sapiens
NLRMEQEEE

SEQ ID NO: 669684 - protein, 9 aa, Homo Sapiens
RTHVQAGTF

SEQ ID NO: 669685 - protein, 9 aa, Homo Sapiens
TGESAAAAA

SEQ ID NO: 669686 - protein, 9 aa, Homo Sapiens
RQAQSLAQE

SEQ ID NO: 669687 - protein, 9 aa, Homo Sapiens
STVLHTHSF

SEQ ID NO: 669688 - protein, 9 aa, Homo Sapiens
NKPLEKPLK

SEQ ID NO: 669689 - protein, 9 aa, Homo Sapiens
CFQTIDRLY

SEQ ID NO: 669690 - protein, 9 aa, Homo Sapiens
SALELQFYT

SEQ ID NO: 669691 - protein, 9 aa, Homo Sapiens
PLRKYLTSE

SEQ ID NO: 669692 - protein, 9 aa, Homo Sapiens
LRGMGTDWI

SEQ ID NO: 669693 - protein, 9 aa, Homo Sapiens
LKLSERPEL

SEQ ID NO: 669694 - protein, 9 aa, Homo Sapiens
DSDLGLQCS

SEQ ID NO: 669695 - protein, 9 aa, Homo Sapiens
HLVQERRAD

SEQ ID NO: 669696 - protein, 9 aa, Homo Sapiens
QLLTLKQQH

SEQ ID NO: 669697 - protein, 9 aa, Homo Sapiens
KKPVLAPRM

SEQ ID NO: 669698 - protein, 9 aa, Homo Sapiens
RDREAAKNS

SEQ ID NO: 669699 - protein, 9 aa, Homo Sapiens
TRGDCTDLD

SEQ ID NO: 669700 - protein, 9 aa, Homo Sapiens
YQLHENGLI

SEQ ID NO: 669701 - protein, 9 aa, Homo Sapiens
SWVSHTHSG

SEQ ID NO: 669702 - protein, 9 aa, Homo Sapiens
HGGSSCAVV

SEQ ID NO: 669703 - protein, 9 aa, Homo Sapiens
HGLSENPLL

SEQ ID NO: 669704 - protein, 9 aa, Homo Sapiens
NNSPSGGEA

SEQ ID NO: 669705 - protein, 9 aa, Homo Sapiens
CLIIAVMGY

SEQ ID NO: 669706 - protein, 9 aa, Homo Sapiens
DVPNTPFDL

SEQ ID NO: 669707 - protein, 9 aa, Homo Sapiens
VNPTFRVYS

SEQ ID NO: 669708 - protein, 9 aa, Homo Sapiens
AVTRNLPFQ

SEQ ID NO: 669709 - protein, 9 aa, Homo Sapiens
SGMFAILTE

SEQ ID NO: 669710 - protein, 9 aa, Homo Sapiens
NIIGYSQLD

SEQ ID NO: 669711 - protein, 9 aa, Homo Sapiens
PVPSLTQAC

SEQ ID NO: 669712 - protein, 9 aa, Homo Sapiens
QVRWVEVLG

SEQ ID NO: 669713 - protein, 9 aa, Homo Sapiens
MDPNTLFGS

SEQ ID NO: 669714 - protein, 9 aa, Homo Sapiens
GSEYLSSVS

SEQ ID NO: 669715 - protein, 9 aa, Homo Sapiens
SAAAAAEEP

SEQ ID NO: 669716 - protein, 9 aa, Homo Sapiens
TEQLRSQLL

SEQ ID NO: 669717 - protein, 9 aa, Homo Sapiens
TPMASLRKQ

SEQ ID NO: 669718 - protein, 9 aa, Homo Sapiens
VTDIFLTGN

SEQ ID NO: 669719 - protein, 9 aa, Homo Sapiens
NTMDDLLLY

SEQ ID NO: 669720 - protein, 9 aa, Homo Sapiens
HSRKQIKGV

SEQ ID NO: 669721 - protein, 9 aa, Homo Sapiens
PLKGQQVRE

SEQ ID NO: 669722 - protein, 9 aa, Homo Sapiens
ATLTVREDK

SEQ ID NO: 669723 - protein, 9 aa, Homo Sapiens
DLKFKDFGT

SEQ ID NO: 669724 - protein, 9 aa, Homo Sapiens
AGLDLRVNI

SEQ ID NO: 669725 - protein, 9 aa, Homo Sapiens
HALQLSVLA

SEQ ID NO: 669726 - protein, 9 aa, Homo Sapiens
RENCKPLRK

SEQ ID NO: 669727 - protein, 9 aa, Homo Sapiens
RSAGLDLRV

SEQ ID NO: 669728 - protein, 9 aa, Homo Sapiens
GRLMIQHEQ

SEQ ID NO: 669729 - protein, 9 aa, Homo Sapiens
DRSAAPAIY

SEQ ID NO: 669730 - protein, 9 aa, Homo Sapiens
PSLTQACQI

SEQ ID NO: 669731 - protein, 9 aa, Homo Sapiens
YFFLAILSF

SEQ ID NO: 669732 - protein, 9 aa, Homo Sapiens
GDRRAPGIP

SEQ ID NO: 669733 - protein, 9 aa, Homo Sapiens
VCITEYEEE

SEQ ID NO: 669734 - protein, 9 aa, Homo Sapiens
SAGLDLRVN

SEQ ID NO: 669735 - protein, 9 aa, Homo Sapiens
PKMLPDLLS

SEQ ID NO: 669736 - protein, 9 aa, Homo Sapiens
CDLLNEEDI

SEQ ID NO: 669737 - protein, 9 aa, Homo Sapiens
YNTMDDLLL

SEQ ID NO: 669738 - protein, 9 aa, Homo Sapiens
PVPLHQVIV

SEQ ID NO: 669739 - protein, 9 aa, Homo Sapiens
SSLKLIHSG

SEQ ID NO: 669740 - protein, 9 aa, Homo Sapiens
LEAICLLGG

SEQ ID NO: 669741 - protein, 9 aa, Homo Sapiens
RQELWAHLG

SEQ ID NO: 669742 - protein, 9 aa, Homo Sapiens
SLLAPLPSA

SEQ ID NO: 669743 - protein, 9 aa, Homo Sapiens
ICSSVTPGE

SEQ ID NO: 669744 - protein, 9 aa, Homo Sapiens
MSPGTRWGD

SEQ ID NO: 669745 - protein, 9 aa, Homo Sapiens
AFHVAKMEF

SEQ ID NO: 669746 - protein, 9 aa, Homo Sapiens
YRFSALELQ

SEQ ID NO: 669747 - protein, 9 aa, Homo Sapiens
PYPDPALKI

SEQ ID NO: 669748 - protein, 9 aa, Homo Sapiens
DFHPIMKRL

SEQ ID NO: 669749 - protein, 9 aa, Homo Sapiens
MFSRDQPTG

SEQ ID NO: 669750 - protein, 9 aa, Homo Sapiens
TAHYNLFFP

SEQ ID NO: 669751 - protein, 9 aa, Homo Sapiens
LQKFVYDLF

SEQ ID NO: 669752 - protein, 9 aa, Homo Sapiens
NCTYAQTPA

SEQ ID NO: 669753 - protein, 9 aa, Homo Sapiens
RGMNRNFYD

SEQ ID NO: 669754 - protein, 9 aa, Homo Sapiens
GMYETPAGT

SEQ ID NO: 669755 - protein, 9 aa, Homo Sapiens
EKGYNTYAS

SEQ ID NO: 669756 - protein, 9 aa, Homo Sapiens
ARPSPARWR

SEQ ID NO: 669757 - protein, 9 aa, Homo Sapiens
QTSTQPHMA

SEQ ID NO: 669758 - protein, 9 aa, Homo Sapiens
SGKVNGLKM

SEQ ID NO: 669759 - protein, 9 aa, Homo Sapiens
THTNEKVEL

SEQ ID NO: 669760 - protein, 9 aa, Homo Sapiens
QGPEPAPGC

SEQ ID NO: 669761 - protein, 9 aa, Homo Sapiens
PRCWAAPLC

SEQ ID NO: 669762 - protein, 9 aa, Homo Sapiens
EVTVAVDVL

SEQ ID NO: 669763 - protein, 9 aa, Homo Sapiens
NPKPVCHLV

SEQ ID NO: 669764 - protein, 9 aa, Homo Sapiens
LVTFTWNTL

SEQ ID NO: 669765 - protein, 9 aa, Homo Sapiens
LEEALLRLS

SEQ ID NO: 669766 - protein, 9 aa, Homo Sapiens
RIPRRAAAR

SEQ ID NO: 669767 - protein, 9 aa, Homo Sapiens
LLRHQRTQT

SEQ ID NO: 669768 - protein, 9 aa, Homo Sapiens
CVKGDRRAP

SEQ ID NO: 669769 - protein, 9 aa, Homo Sapiens
GLYLSAIQE

SEQ ID NO: 669770 - protein, 9 aa, Homo Sapiens
LVQERRADF

SEQ ID NO: 669771 - protein, 9 aa, Homo Sapiens
SDHECYHPN

SEQ ID NO: 669772 - protein, 9 aa, Homo Sapiens
MSSGDLGGQ

SEQ ID NO: 669773 - protein, 9 aa, Homo Sapiens
QRHSFKREE

SEQ ID NO: 669774 - protein, 9 aa, Homo Sapiens
KVAYSFTHA

SEQ ID NO: 669775 - protein, 9 aa, Homo Sapiens
SERAQKWLL

SEQ ID NO: 669776 - protein, 9 aa, Homo Sapiens
CTYAQTPAN

SEQ ID NO: 669777 - protein, 9 aa, Homo Sapiens
SPPSHHALQ

SEQ ID NO: 669778 - protein, 9 aa, Homo Sapiens
IVLAGLEPF

SEQ ID NO: 669779 - protein, 9 aa, Homo Sapiens
VTLNSALAQ

SEQ ID NO: 669780 - protein, 9 aa, Homo Sapiens
LGATLCDIN

SEQ ID NO: 669781 - protein, 9 aa, Homo Sapiens
RGNKYQGGW

SEQ ID NO: 669782 - protein, 9 aa, Homo Sapiens
TNCLIIAVM

SEQ ID NO: 669783 - protein, 9 aa, Homo Sapiens
GGCGGSPCT

SEQ ID NO: 669784 - protein, 9 aa, Homo Sapiens
HIQRRHTGV

SEQ ID NO: 669785 - protein, 9 aa, Homo Sapiens
RKIGNPKIS

SEQ ID NO: 669786 - protein, 9 aa, Homo Sapiens
YSATHPWVA

SEQ ID NO: 669787 - protein, 9 aa, Homo Sapiens
SDDVFKTQV

SEQ ID NO: 669788 - protein, 9 aa, Homo Sapiens
ANFLILMVI

SEQ ID NO: 669789 - protein, 9 aa, Homo Sapiens
VSGDTIPFD

SEQ ID NO: 669790 - protein, 9 aa, Homo Sapiens
ITAVSKFDR

SEQ ID NO: 669791 - protein, 9 aa, Homo Sapiens
STKRDVWSY

SEQ ID NO: 669792 - protein, 9 aa, Homo Sapiens
LGAATRGNA

SEQ ID NO: 669793 - protein, 9 aa, Homo Sapiens
RSNGCCSIV

SEQ ID NO: 669794 - protein, 9 aa, Homo Sapiens
QCVYQSLCP

SEQ ID NO: 669795 - protein, 9 aa, Homo Sapiens
SPVSPREPS

SEQ ID NO: 669796 - protein, 9 aa, Homo Sapiens
DVEVSRPFY

SEQ ID NO: 669797 - protein, 9 aa, Homo Sapiens
TEDLAEVTV

SEQ ID NO: 669798 - protein, 9 aa, Homo Sapiens
DMHADMHSD

SEQ ID NO: 669799 - protein, 9 aa, Homo Sapiens
CIDSLNGTC

SEQ ID NO: 669800 - protein, 9 aa, Homo Sapiens
LEPFGICAG

SEQ ID NO: 669801 - protein, 9 aa, Homo Sapiens
IAFDRYVAI

SEQ ID NO: 669802 - protein, 9 aa, Homo Sapiens
LVMSTLNLF

SEQ ID NO: 669803 - protein, 9 aa, Homo Sapiens
QELWAHLGT

SEQ ID NO: 669804 - protein, 9 aa, Homo Sapiens
STEEIKRSD

SEQ ID NO: 669805 - protein, 9 aa, Homo Sapiens
GCGVEGVGA

SEQ ID NO: 669806 - protein, 9 aa, Homo Sapiens
GSNSLASKS

SEQ ID NO: 669807 - protein, 9 aa, Homo Sapiens
QRPRPNSPF

SEQ ID NO: 669808 - protein, 9 aa, Homo Sapiens
FKNLGNSPQ

SEQ ID NO: 669809 - protein, 9 aa, Homo Sapiens
REAVQGHGT

SEQ ID NO: 669810 - protein, 9 aa, Homo Sapiens
GDQVSYRGA

SEQ ID NO: 669811 - protein, 9 aa, Homo Sapiens
EKLQDECRK

SEQ ID NO: 669812 - protein, 9 aa, Homo Sapiens
LEGDQVSYR

SEQ ID NO: 669813 - protein, 9 aa, Homo Sapiens
PRPNSPFST

SEQ ID NO: 669814 - protein, 9 aa, Homo Sapiens
AVSKFDREI

SEQ ID NO: 669815 - protein, 9 aa, Homo Sapiens
PTRPKTSGM

SEQ ID NO: 669816 - protein, 9 aa, Homo Sapiens
VPKRPGSLA

SEQ ID NO: 669817 - protein, 9 aa, Homo Sapiens
GNIIGYSQL

SEQ ID NO: 669818 - protein, 9 aa, Homo Sapiens
LNEEDILSM

SEQ ID NO: 669819 - protein, 9 aa, Homo Sapiens
ATTEDLAEV

SEQ ID NO: 669820 - protein, 9 aa, Homo Sapiens
EASSPVPKR

SEQ ID NO: 669821 - protein, 9 aa, Homo Sapiens
ESAPEEEDS

SEQ ID NO: 669822 - protein, 9 aa, Homo Sapiens
SEEPTVTCV

SEQ ID NO: 669823 - protein, 9 aa, Homo Sapiens
KMEFRHFKI

SEQ ID NO: 669824 - protein, 9 aa, Homo Sapiens
RWREDRESR

SEQ ID NO: 669825 - protein, 9 aa, Homo Sapiens
NCKPLRKYL

SEQ ID NO: 669826 - protein, 9 aa, Homo Sapiens
KKDVTGALQ

SEQ ID NO: 669827 - protein, 9 aa, Homo Sapiens
SSYEDYANK

SEQ ID NO: 669828 - protein, 9 aa, Homo Sapiens
STWPPSIHK

SEQ ID NO: 669829 - protein, 9 aa, Homo Sapiens
TAYLSQAVL

SEQ ID NO: 669830 - protein, 9 aa, Homo Sapiens
PGDTGLPGK

SEQ ID NO: 669831 - protein, 9 aa, Homo Sapiens
SMCQVPLVF

SEQ ID NO: 669832 - protein, 9 aa, Homo Sapiens
DHDLKVHYS

SEQ ID NO: 669833 - protein, 9 aa, Homo Sapiens
GPRVGDRQL

SEQ ID NO: 669834 - protein, 9 aa, Homo Sapiens
QPHMAPSKE

SEQ ID NO: 669835 - protein, 9 aa, Homo Sapiens
LQSDVRYTK

SEQ ID NO: 669836 - protein, 9 aa, Homo Sapiens
LGQCCQRPG

SEQ ID NO: 669837 - protein, 9 aa, Homo Sapiens
SGLWPAESE

SEQ ID NO: 669838 - protein, 9 aa, Homo Sapiens
IRDLFIDGK

SEQ ID NO: 669839 - protein, 9 aa, Homo Sapiens
TPFDLELTD

SEQ ID NO: 669840 - protein, 9 aa, Homo Sapiens
YRCDLLNEE

SEQ ID NO: 669841 - protein, 9 aa, Homo Sapiens
DTYVPTSWL

SEQ ID NO: 669842 - protein, 9 aa, Homo Sapiens
LAQDLQGLA

SEQ ID NO: 669843 - protein, 9 aa, Homo Sapiens
NGATPRDFH

SEQ ID NO: 669844 - protein, 9 aa, Homo Sapiens
DLGLQCSAR

SEQ ID NO: 669845 - protein, 9 aa, Homo Sapiens
MKVHESSLQ

SEQ ID NO: 669846 - protein, 9 aa, Homo Sapiens
DTGESAAAA

SEQ ID NO: 669847 - protein, 9 aa, Homo Sapiens
MNRNFYDQL

SEQ ID NO: 669848 - protein, 9 aa, Homo Sapiens
PASLSMRMA

SEQ ID NO: 669849 - protein, 9 aa, Homo Sapiens
YTAMSSGDL

SEQ ID NO: 669850 - protein, 9 aa, Homo Sapiens
LRPGTRAAF

SEQ ID NO: 669851 - protein, 9 aa, Homo Sapiens
FPATYSLFW

SEQ ID NO: 669852 - protein, 9 aa, Homo Sapiens
TQSAEIYRN

SEQ ID NO: 669853 - protein, 9 aa, Homo Sapiens
ICAGDSTEA

SEQ ID NO: 669854 - protein, 9 aa, Homo Sapiens
PFGICAGDS

SEQ ID NO: 669855 - protein, 9 aa, Homo Sapiens
IGSLDDLLP

SEQ ID NO: 669856 - protein, 9 aa, Homo Sapiens
FKNCYKYSS

SEQ ID NO: 669857 - protein, 9 aa, Homo Sapiens
FFGSEEPTV

SEQ ID NO: 669858 - protein, 9 aa, Homo Sapiens
HPELSVSVE

SEQ ID NO: 669859 - protein, 9 aa, Homo Sapiens
FSNCASHLT

SEQ ID NO: 669860 - protein, 9 aa, Homo Sapiens
KLSERPELA

SEQ ID NO: 669861 - protein, 9 aa, Homo Sapiens
LTHPELSVS

SEQ ID NO: 669862 - protein, 9 aa, Homo Sapiens
LLIVLAGLE

SEQ ID NO: 669863 - protein, 9 aa, Homo Sapiens
TPRDFHPIM

SEQ ID NO: 669864 - protein, 9 aa, Homo Sapiens
RLRVHSQQP

SEQ ID NO: 669865 - protein, 9 aa, Homo Sapiens
NMLTDLPGP

SEQ ID NO: 669866 - protein, 9 aa, Homo Sapiens
PPSHHALQL

SEQ ID NO: 669867 - protein, 9 aa, Homo Sapiens
DINITEIPL

SEQ ID NO: 669868 - protein, 9 aa, Homo Sapiens
PDTYVPTSW

SEQ ID NO: 669869 - protein, 9 aa, Homo Sapiens
MKNAMRKCG

SEQ ID NO: 669870 - protein, 9 aa, Homo Sapiens
ILHDQERKI

SEQ ID NO: 669871 - protein, 9 aa, Homo Sapiens
FKTQVSSRF

SEQ ID NO: 669872 - protein, 9 aa, Homo Sapiens
LGTTGLLAG

SEQ ID NO: 669873 - protein, 9 aa, Homo Sapiens
LDVEVSRPF

SEQ ID NO: 669874 - protein, 9 aa, Homo Sapiens
NSPFSTDSN

SEQ ID NO: 669875 - protein, 9 aa, Homo Sapiens
HDQERKIGN

SEQ ID NO: 669876 - protein, 9 aa, Homo Sapiens
YGTEGSDLV

SEQ ID NO: 669877 - protein, 9 aa, Homo Sapiens
PEDEVAQKK

SEQ ID NO: 669878 - protein, 9 aa, Homo Sapiens
SSQRPRPNS

SEQ ID NO: 669879 - protein, 9 aa, Homo Sapiens
DLERHPTHR

SEQ ID NO: 669880 - protein, 9 aa, Homo Sapiens
GAFFQFREA

SEQ ID NO: 669881 - protein, 9 aa, Homo Sapiens
SFSEICYTF

SEQ ID NO: 669882 - protein, 9 aa, Homo Sapiens
RSDCVDQFR

SEQ ID NO: 669883 - protein, 9 aa, Homo Sapiens
RINCGEKPY

SEQ ID NO: 669884 - protein, 9 aa, Homo Sapiens
GETPMASLR

SEQ ID NO: 669885 - protein, 9 aa, Homo Sapiens
VLTYDFTNS

SEQ ID NO: 669886 - protein, 9 aa, Homo Sapiens
EDMPTRTAH

SEQ ID NO: 669887 - protein, 9 aa, Homo Sapiens
SGNPKPVCH

SEQ ID NO: 669888 - protein, 9 aa, Homo Sapiens
LTRSEKHML

SEQ ID NO: 669889 - protein, 9 aa, Homo Sapiens
ELGPERRKS

SEQ ID NO: 669890 - protein, 9 aa, Homo Sapiens
RRLACAGCC

SEQ ID NO: 669891 - protein, 9 aa, Homo Sapiens
ACAGCCLTS

SEQ ID NO: 669892 - protein, 9 aa, Homo Sapiens
LLRYSPYSI

SEQ ID NO: 669893 - protein, 9 aa, Homo Sapiens
ENPLLSTSL

SEQ ID NO: 669894 - protein, 9 aa, Homo Sapiens
QYSKITFLT

SEQ ID NO: 669895 - protein, 9 aa, Homo Sapiens
ILQLVVLDV

SEQ ID NO: 669896 - protein, 9 aa, Homo Sapiens
IATSDIPCT

SEQ ID NO: 669897 - protein, 9 aa, Homo Sapiens
LKVHYSNIY

SEQ ID NO: 669898 - protein, 9 aa, Homo Sapiens
KAALAAFKA

SEQ ID NO: 669899 - protein, 9 aa, Homo Sapiens
IDSLNGTCW

SEQ ID NO: 669900 - protein, 9 aa, Homo Sapiens
QEPLHSPTS

SEQ ID NO: 669901 - protein, 9 aa, Homo Sapiens
RSPNLSPER

SEQ ID NO: 669902 - protein, 9 aa, Homo Sapiens
NAALALDLL

SEQ ID NO: 669903 - protein, 9 aa, Homo Sapiens
DHKFEELQK

SEQ ID NO: 669904 - protein, 9 aa, Homo Sapiens
IFLRFFEPA

SEQ ID NO: 669905 - protein, 9 aa, Homo Sapiens
VCHLVQERR

SEQ ID NO: 669906 - protein, 9 aa, Homo Sapiens
QERRADFNQ

SEQ ID NO: 669907 - protein, 9 aa, Homo Sapiens
KRDVWSYGV

SEQ ID NO: 669908 - protein, 9 aa, Homo Sapiens
SFKCLDSPQ

SEQ ID NO: 669909 - protein, 9 aa, Homo Sapiens
SNCSYLERH

SEQ ID NO: 669910 - protein, 9 aa, Homo Sapiens
WGPHGHTDA

SEQ ID NO: 669911 - protein, 9 aa, Homo Sapiens
ASGHSSRND

SEQ ID NO: 669912 - protein, 9 aa, Homo Sapiens
LDLRVNILL

SEQ ID NO: 669913 - protein, 9 aa, Homo Sapiens
FLRFFEPAI

SEQ ID NO: 669914 - protein, 9 aa, Homo Sapiens
ALELQFYTS

SEQ ID NO: 669915 - protein, 9 aa, Homo Sapiens
QGREQKQEP

SEQ ID NO: 669916 - protein, 9 aa, Homo Sapiens
GPVPSLTQA

SEQ ID NO: 669917 - protein, 9 aa, Homo Sapiens
PGEIVAKGS

SEQ ID NO: 669918 - protein, 9 aa, Homo Sapiens
PLGTVVIYL

SEQ ID NO: 669919 - protein, 9 aa, Homo Sapiens
VDIATDYHK

SEQ ID NO: 669920 - protein, 9 aa, Homo Sapiens
VFTLTAYLS

SEQ ID NO: 669921 - protein, 9 aa, Homo Sapiens
RCEHMAQER

SEQ ID NO: 669922 - protein, 9 aa, Homo Sapiens
LNTVCITEY

SEQ ID NO: 669923 - protein, 9 aa, Homo Sapiens
PVLAPRMGT

SEQ ID NO: 669924 - protein, 9 aa, Homo Sapiens
TFRVYSQQD

SEQ ID NO: 669925 - protein, 9 aa, Homo Sapiens
MGLLVPAHI

SEQ ID NO: 669926 - protein, 9 aa, Homo Sapiens
VEVSRPFYL

SEQ ID NO: 669927 - protein, 9 aa, Homo Sapiens
RDVWSYGVL

SEQ ID NO: 669928 - protein, 9 aa, Homo Sapiens
GPRLRVHSQ

SEQ ID NO: 669929 - protein, 9 aa, Homo Sapiens
RQHRGNGLA

SEQ ID NO: 669930 - protein, 9 aa, Homo Sapiens
VHSLLPPQA

SEQ ID NO: 669931 - protein, 9 aa, Homo Sapiens
TEEIKRSDC

SEQ ID NO: 669932 - protein, 9 aa, Homo Sapiens
YRMLGLNPG

SEQ ID NO: 669933 - protein, 9 aa, Homo Sapiens
VAFEAELAL

SEQ ID NO: 669934 - protein, 9 aa, Homo Sapiens
SASAAVTRN

SEQ ID NO: 669935 - protein, 9 aa, Homo Sapiens
AKHTRINCG

SEQ ID NO: 669936 - protein, 9 aa, Homo Sapiens
TRSEPIRIA

SEQ ID NO: 669937 - protein, 9 aa, Homo Sapiens
KTVNPTFRV

SEQ ID NO: 669938 - protein, 9 aa, Homo Sapiens
GRFFGTQSA

SEQ ID NO: 669939 - protein, 9 aa, Homo Sapiens
ITPKMLPDL

SEQ ID NO: 669940 - protein, 9 aa, Homo Sapiens
TVLNSLVGD

SEQ ID NO: 669941 - protein, 9 aa, Homo Sapiens
ADGKPSGDQ

SEQ ID NO: 669942 - protein, 9 aa, Homo Sapiens
PDHGDSDLG

SEQ ID NO: 669943 - protein, 9 aa, Homo Sapiens
ENKMYLTRS

SEQ ID NO: 669944 - protein, 9 aa, Homo Sapiens
SQSPEQCGD

SEQ ID NO: 669945 - protein, 9 aa, Homo Sapiens
IRQHRGNGL

SEQ ID NO: 669946 - protein, 9 aa, Homo Sapiens
PNSPFSTDS

SEQ ID NO: 669947 - protein, 9 aa, Homo Sapiens
FLVLVVPFL

SEQ ID NO: 669948 - protein, 9 aa, Homo Sapiens
RDLFIDGKS

SEQ ID NO: 669949 - protein, 9 aa, Homo Sapiens
IPFKNCYKY

SEQ ID NO: 669950 - protein, 9 aa, Homo Sapiens
ILADRYEEP

SEQ ID NO: 669951 - protein, 9 aa, Homo Sapiens
ASAGERAWT

SEQ ID NO: 669952 - protein, 9 aa, Homo Sapiens
VTLYLAATA

SEQ ID NO: 669953 - protein, 9 aa, Homo Sapiens
QVTVPRAGL

SEQ ID NO: 669954 - protein, 9 aa, Homo Sapiens
SLTQACQIP

SEQ ID NO: 669955 - protein, 9 aa, Homo Sapiens
ERDLEKAPK

SEQ ID NO: 669956 - protein, 9 aa, Homo Sapiens
NSLVTEEES

SEQ ID NO: 669957 - protein, 9 aa, Homo Sapiens
PPGDTGLPG

SEQ ID NO: 669958 - protein, 9 aa, Homo Sapiens
SSPLKGQQV

SEQ ID NO: 669959 - protein, 9 aa, Homo Sapiens
PTRTAHGES

SEQ ID NO: 669960 - protein, 9 aa, Homo Sapiens
KSLGQTSAA

SEQ ID NO: 669961 - protein, 9 aa, Homo Sapiens
QELQAQIRR

SEQ ID NO: 669962 - protein, 9 aa, Homo Sapiens
GEAKCVFWN

SEQ ID NO: 669963 - protein, 9 aa, Homo Sapiens
VQAAHRAAT

SEQ ID NO: 669964 - protein, 9 aa, Homo Sapiens
VPSDASGHS

SEQ ID NO: 669965 - protein, 9 aa, Homo Sapiens
QRRHTGVAE

SEQ ID NO: 669966 - protein, 9 aa, Homo Sapiens
NAMRKCGVV

SEQ ID NO: 669967 - protein, 9 aa, Homo Sapiens
FTNSDFEKI

SEQ ID NO: 669968 - protein, 9 aa, Homo Sapiens
GMFSRDQPT

SEQ ID NO: 669969 - protein, 9 aa, Homo Sapiens
MGMAVAAGC

SEQ ID NO: 669970 - protein, 9 aa, Homo Sapiens
LVTLKAEQT

SEQ ID NO: 669971 - protein, 9 aa, Homo Sapiens
NGLWAQCSE

SEQ ID NO: 669972 - protein, 9 aa, Homo Sapiens
YLNGYIYIF

SEQ ID NO: 669973 - protein, 9 aa, Homo Sapiens
PGTRWGDLT

SEQ ID NO: 669974 - protein, 9 aa, Homo Sapiens
IKKASGPNL

SEQ ID NO: 669975 - protein, 9 aa, Homo Sapiens
QKKRKKSLG

SEQ ID NO: 669976 - protein, 9 aa, Homo Sapiens
YSNIYIKPF

SEQ ID NO: 669977 - protein, 9 aa, Homo Sapiens
KTDTMTNSS

SEQ ID NO: 669978 - protein, 9 aa, Homo Sapiens
TSSLPIASS

SEQ ID NO: 669979 - protein, 9 aa, Homo Sapiens
AILTEFCSR

SEQ ID NO: 669980 - protein, 9 aa, Homo Sapiens
YRTGLVLMW

SEQ ID NO: 669981 - protein, 9 aa, Homo Sapiens
IIHKYRTDL

SEQ ID NO: 669982 - protein, 9 aa, Homo Sapiens
LPDLLSEKK

SEQ ID NO: 669983 - protein, 9 aa, Homo Sapiens
TGVAEGGKQ

SEQ ID NO: 669984 - protein, 9 aa, Homo Sapiens
RTQTGEKPY

SEQ ID NO: 669985 - protein, 9 aa, Homo Sapiens
ENKCAFSSH

SEQ ID NO: 669986 - protein, 9 aa, Homo Sapiens
EFRHFKIHV

SEQ ID NO: 669987 - protein, 9 aa, Homo Sapiens
AKCVFWNFR

SEQ ID NO: 669988 - protein, 9 aa, Homo Sapiens
RIEEKGYNT

SEQ ID NO: 669989 - protein, 9 aa, Homo Sapiens
TNSDFEKIK

SEQ ID NO: 669990 - protein, 9 aa, Homo Sapiens
FFEPAILSP

SEQ ID NO: 669991 - protein, 9 aa, Homo Sapiens
GMKSRGMYE

SEQ ID NO: 669992 - protein, 9 aa, Homo Sapiens
ESSLQGSES

SEQ ID NO: 669993 - protein, 9 aa, Homo Sapiens
GAVFTLTAY

SEQ ID NO: 669994 - protein, 9 aa, Homo Sapiens
ERPVAFEAE

SEQ ID NO: 669995 - protein, 9 aa, Homo Sapiens
ERSQQNVAN

SEQ ID NO: 669996 - protein, 9 aa, Homo Sapiens
LFGSNSLAS

SEQ ID NO: 669997 - protein, 9 aa, Homo Sapiens
SLKLIHSGI

SEQ ID NO: 669998 - protein, 9 aa, Homo Sapiens
LALDLLRRR

SEQ ID NO: 669999 - protein, 9 aa, Homo Sapiens
LPQSRLAQL

SEQ ID NO: 670000 - protein, 9 aa, Homo Sapiens
PNTLFGSNS

SEQ ID NO: 670001 - protein, 9 aa, Homo Sapiens
HVLSPQKPP

SEQ ID NO: 670002 - protein, 9 aa, Homo Sapiens
PRLRVHSQQ

SEQ ID NO: 670003 - protein, 9 aa, Homo Sapiens
WTSRYWLNV

SEQ ID NO: 670004 - protein, 9 aa, Homo Sapiens
GKVVGYEIN

SEQ ID NO: 670005 - protein, 9 aa, Homo Sapiens
HSSRNDWQV

SEQ ID NO: 670006 - protein, 9 aa, Homo Sapiens
MHADMHSDM

SEQ ID NO: 670007 - protein, 9 aa, Homo Sapiens
LELQFYTSA

SEQ ID NO: 670008 - protein, 9 aa, Homo Sapiens
TGLPGKAGE

SEQ ID NO: 670009 - protein, 9 aa, Homo Sapiens
LSCSDTRIC

SEQ ID NO: 670010 - protein, 9 aa, Homo Sapiens
TLTIPFKNC

SEQ ID NO: 670011 - protein, 9 aa, Homo Sapiens
PCEDIDECS

SEQ ID NO: 670012 - protein, 9 aa, Homo Sapiens
KPSGDQVLP

SEQ ID NO: 670013 - protein, 9 aa, Homo Sapiens
KPSKLKRLL

SEQ ID NO: 670014 - protein, 9 aa, Homo Sapiens
IYSTKRDVW

SEQ ID NO: 670015 - protein, 9 aa, Homo Sapiens
CESSSGYRT

SEQ ID NO: 670016 - protein, 9 aa, Homo Sapiens
LNSALAQKE

SEQ ID NO: 670017 - protein, 9 aa, Homo Sapiens
ASGNPKPVC

SEQ ID NO: 670018 - protein, 9 aa, Homo Sapiens
TVNPTFRVY

SEQ ID NO: 670019 - protein, 9 aa, Homo Sapiens
SLRKKDVTG

SEQ ID NO: 670020 - protein, 9 aa, Homo Sapiens
EFLSLLVDI

SEQ ID NO: 670021 - protein, 9 aa, Homo Sapiens
DAAQRGPGC

SEQ ID NO: 670022 - protein, 9 aa, Homo Sapiens
GHIQRRHTG

SEQ ID NO: 670023 - protein, 9 aa, Homo Sapiens
SSVTPGEPQ

SEQ ID NO: 670024 - protein, 9 aa, Homo Sapiens
AKGTPCEDI

SEQ ID NO: 670025 - protein, 9 aa, Homo Sapiens
KPESRLVHK

SEQ ID NO: 670026 - protein, 9 aa, Homo Sapiens
TIDRLYFVM

SEQ ID NO: 670027 - protein, 9 aa, Homo Sapiens
IETQAILPM

SEQ ID NO: 670028 - protein, 9 aa, Homo Sapiens
GMAVAAGCV

SEQ ID NO: 670029 - protein, 9 aa, Homo Sapiens
DSPQHIKNR

SEQ ID NO: 670030 - protein, 9 aa, Homo Sapiens
SSPSPVSPR

SEQ ID NO: 670031 - protein, 9 aa, Homo Sapiens
RIAGKSGTS

SEQ ID NO: 670032 - protein, 9 aa, Homo Sapiens
SLSESSPTK

SEQ ID NO: 670033 - protein, 9 aa, Homo Sapiens
YANKPLEKP

SEQ ID NO: 670034 - protein, 9 aa, Homo Sapiens
LTEAASSLR

SEQ ID NO: 670035 - protein, 9 aa, Homo Sapiens
AGPVPSLTQ

SEQ ID NO: 670036 - protein, 9 aa, Homo Sapiens
EENSLVTEE

SEQ ID NO: 670037 - protein, 9 aa, Homo Sapiens
TAHCSLQLP

SEQ ID NO: 670038 - protein, 9 aa, Homo Sapiens
AKMEFRHFK

SEQ ID NO: 670039 - protein, 9 aa, Homo Sapiens
HMALKEFSS

SEQ ID NO: 670040 - protein, 9 aa, Homo Sapiens
KAVVYKLTG

SEQ ID NO: 670041 - protein, 9 aa, Homo Sapiens
ISCTPKTHI

SEQ ID NO: 670042 - protein, 9 aa, Homo Sapiens
VTVAVDVLP

SEQ ID NO: 670043 - protein, 9 aa, Homo Sapiens
STSQRISCT

SEQ ID NO: 670044 - protein, 9 aa, Homo Sapiens
SLIPVYIQV

SEQ ID NO: 670045 - protein, 9 aa, Homo Sapiens
FNGTGTVHK

SEQ ID NO: 670046 - protein, 9 aa, Homo Sapiens
LVLQDMGFT

SEQ ID NO: 670047 - protein, 9 aa, Homo Sapiens
YNLIVSATE

SEQ ID NO: 670048 - protein, 9 aa, Homo Sapiens
CTQQVLGDH

SEQ ID NO: 670049 - protein, 9 aa, Homo Sapiens
SHHPDYTAM

SEQ ID NO: 670050 - protein, 9 aa, Homo Sapiens
SYGKSYVSM

SEQ ID NO: 670051 - protein, 9 aa, Homo Sapiens
MVLLLLTLL

SEQ ID NO: 670052 - protein, 9 aa, Homo Sapiens
LSPERPRSA

SEQ ID NO: 670053 - protein, 9 aa, Homo Sapiens
GVQFVLGRL

SEQ ID NO: 670054 - protein, 9 aa, Homo Sapiens
KDEESVTDM

SEQ ID NO: 670055 - protein, 9 aa, Homo Sapiens
VTVPRAGLA

SEQ ID NO: 670056 - protein, 9 aa, Homo Sapiens
ELWAHLGTT

SEQ ID NO: 670057 - protein, 9 aa, Homo Sapiens
MFLKREGKY

SEQ ID NO: 670058 - protein, 9 aa, Homo Sapiens
DDVFKTQVS

SEQ ID NO: 670059 - protein, 9 aa, Homo Sapiens
RPLLRYSPY

SEQ ID NO: 670060 - protein, 9 aa, Homo Sapiens
REAAKNSLE

SEQ ID NO: 670061 - protein, 9 aa, Homo Sapiens
ASSGKVNGL

SEQ ID NO: 670062 - protein, 9 aa, Homo Sapiens
RGNARTSKP

SEQ ID NO: 670063 - protein, 9 aa, Homo Sapiens
YPDPALKIE

SEQ ID NO: 670064 - protein, 9 aa, Homo Sapiens
GGRGNKYQG

SEQ ID NO: 670065 - protein, 9 aa, Homo Sapiens
PELSVSVEM

SEQ ID NO: 670066 - protein, 9 aa, Homo Sapiens
VQRLAPLLI

SEQ ID NO: 670067 - protein, 9 aa, Homo Sapiens
VKVTLNSAL

SEQ ID NO: 670068 - protein, 9 aa, Homo Sapiens
GGPPPAASA

SEQ ID NO: 670069 - protein, 9 aa, Homo Sapiens
NADLRKCIL

SEQ ID NO: 670070 - protein, 9 aa, Homo Sapiens
ISFDAGMCR

SEQ ID NO: 670071 - protein, 9 aa, Homo Sapiens
EPAPGCGVE

SEQ ID NO: 670072 - protein, 9 aa, Homo Sapiens
EDYANKPLE

SEQ ID NO: 670073 - protein, 9 aa, Homo Sapiens
YNAGPVRDS

SEQ ID NO: 670074 - protein, 9 aa, Homo Sapiens
TMSVVSYNH

SEQ ID NO: 670075 - protein, 9 aa, Homo Sapiens
MAEDAQRVL

SEQ ID NO: 670076 - protein, 9 aa, Homo Sapiens
PAALPTKVV

SEQ ID NO: 670077 - protein, 9 aa, Homo Sapiens
KHTRINCGE

SEQ ID NO: 670078 - protein, 9 aa, Homo Sapiens
AATRGNART

SEQ ID NO: 670079 - protein, 9 aa, Homo Sapiens
VSKFDREIW

SEQ ID NO: 670080 - protein, 9 aa, Homo Sapiens
GRSITAVSK

SEQ ID NO: 670081 - protein, 9 aa, Homo Sapiens
QCSHSDRCH

SEQ ID NO: 670082 - protein, 9 aa, Homo Sapiens
TGPRVGDRQ

SEQ ID NO: 670083 - protein, 9 aa, Homo Sapiens
ICGFLVLVV

SEQ ID NO: 670084 - protein, 9 aa, Homo Sapiens
FSTSSTDLT

SEQ ID NO: 670085 - protein, 9 aa, Homo Sapiens
WVSHTHSGH

SEQ ID NO: 670086 - protein, 9 aa, Homo Sapiens
THYQLNFQM

SEQ ID NO: 670087 - protein, 9 aa, Homo Sapiens
IGYSQLDKM

SEQ ID NO: 670088 - protein, 9 aa, Homo Sapiens
TANLVAVMV

SEQ ID NO: 670089 - protein, 9 aa, Homo Sapiens
YIQVLPPET

SEQ ID NO: 670090 - protein, 9 aa, Homo Sapiens
HPDYTAMSS

SEQ ID NO: 670091 - protein, 9 aa, Homo Sapiens
LLVDIATDY

SEQ ID NO: 670092 - protein, 9 aa, Homo Sapiens
IQCETVLNS

SEQ ID NO: 670093 - protein, 9 aa, Homo Sapiens
LHTLLDPLN

SEQ ID NO: 670094 - protein, 9 aa, Homo Sapiens
FQPLRPCPI

SEQ ID NO: 670095 - protein, 9 aa, Homo Sapiens
LFTGRTCKG

SEQ ID NO: 670096 - protein, 9 aa, Homo Sapiens
SEPIRIAGK

SEQ ID NO: 670097 - protein, 9 aa, Homo Sapiens
SPARWRRWP

SEQ ID NO: 670098 - protein, 9 aa, Homo Sapiens
PLCLWLLEF

SEQ ID NO: 670099 - protein, 9 aa, Homo Sapiens
DPGSSQSPE

SEQ ID NO: 670100 - protein, 9 aa, Homo Sapiens
PAESETWKR

SEQ ID NO: 670101 - protein, 9 aa, Homo Sapiens
TYTANLVAV

SEQ ID NO: 670102 - protein, 9 aa, Homo Sapiens
DARLRAANG

SEQ ID NO: 670103 - protein, 9 aa, Homo Sapiens
PTKAMKKFQ

SEQ ID NO: 670104 - protein, 9 aa, Homo Sapiens
ETPACELKP

SEQ ID NO: 670105 - protein, 9 aa, Homo Sapiens
SDQPHNFLP

SEQ ID NO: 670106 - protein, 9 aa, Homo Sapiens
AVVYKLTGA

SEQ ID NO: 670107 - protein, 9 aa, Homo Sapiens
RSSYEDYAN

SEQ ID NO: 670108 - protein, 9 aa, Homo Sapiens
EANNGLWAQ

SEQ ID NO: 670109 - protein, 9 aa, Homo Sapiens
LGNAALALD

SEQ ID NO: 670110 - protein, 9 aa, Homo Sapiens
AVDVLPLVP

SEQ ID NO: 670111 - protein, 9 aa, Homo Sapiens
DEKMFLKRE

SEQ ID NO: 670112 - protein, 9 aa, Homo Sapiens
EHLLRERQQ

SEQ ID NO: 670113 - protein, 9 aa, Homo Sapiens
MPSAHGGSA

SEQ ID NO: 670114 - protein, 9 aa, Homo Sapiens
SEISPIYTS

SEQ ID NO: 670115 - protein, 9 aa, Homo Sapiens
QLTQVNADF

SEQ ID NO: 670116 - protein, 9 aa, Homo Sapiens
LRKLIGSLD

SEQ ID NO: 670117 - protein, 9 aa, Homo Sapiens
QSAPLPQSR

SEQ ID NO: 670118 - protein, 9 aa, Homo Sapiens
DTVEKLQDE

SEQ ID NO: 670119 - protein, 9 aa, Homo Sapiens
CCLTSRACC

SEQ ID NO: 670120 - protein, 9 aa, Homo Sapiens
PHSSHSVIN

SEQ ID NO: 670121 - protein, 9 aa, Homo Sapiens
VYAAPWNTT

SEQ ID NO: 670122 - protein, 9 aa, Homo Sapiens
TLQKFVYDL

SEQ ID NO: 670123 - protein, 9 aa, Homo Sapiens
DSLNGTCWL

SEQ ID NO: 670124 - protein, 9 aa, Homo Sapiens
IQKLRWRED

SEQ ID NO: 670125 - protein, 9 aa, Homo Sapiens
EEPTVTCVT

SEQ ID NO: 670126 - protein, 9 aa, Homo Sapiens
KDHKFEELQ

SEQ ID NO: 670127 - protein, 9 aa, Homo Sapiens
RRGPPGEIV

SEQ ID NO: 670128 - protein, 9 aa, Homo Sapiens
CVWAAKLIS

SEQ ID NO: 670129 - protein, 9 aa, Homo Sapiens
GMFAILTEF

SEQ ID NO: 670130 - protein, 9 aa, Homo Sapiens
YDVPNTPFD

SEQ ID NO: 670131 - protein, 9 aa, Homo Sapiens
IALERSQQN

SEQ ID NO: 670132 - protein, 9 aa, Homo Sapiens
REDRESRRS

SEQ ID NO: 670133 - protein, 9 aa, Homo Sapiens
RLLETQHAE

SEQ ID NO: 670134 - protein, 9 aa, Homo Sapiens
MDRDYGHVS

SEQ ID NO: 670135 - protein, 9 aa, Homo Sapiens
VVIYLNATD

SEQ ID NO: 670136 - protein, 9 aa, Homo Sapiens
HGDSDLGLQ

SEQ ID NO: 670137 - protein, 9 aa, Homo Sapiens
AGGCGGSPC

SEQ ID NO: 670138 - protein, 9 aa, Homo Sapiens
AVQGHGTGS

SEQ ID NO: 670139 - protein, 9 aa, Homo Sapiens
ESSSGYRTG

SEQ ID NO: 670140 - protein, 9 aa, Homo Sapiens
YFKNLGNSP

SEQ ID NO: 670141 - protein, 9 aa, Homo Sapiens
LVVLDVKPQ

SEQ ID NO: 670142 - protein, 9 aa, Homo Sapiens
LTIPFKNCY

SEQ ID NO: 670143 - protein, 9 aa, Homo Sapiens
SPNLSPERP

SEQ ID NO: 670144 - protein, 9 aa, Homo Sapiens
DPNKDEESV

SEQ ID NO: 670145 - protein, 9 aa, Homo Sapiens
EEALLRLSE

SEQ ID NO: 670146 - protein, 9 aa, Homo Sapiens
CKLVVFVAG

SEQ ID NO: 670147 - protein, 9 aa, Homo Sapiens
ILKRYSPLS

SEQ ID NO: 670148 - protein, 9 aa, Homo Sapiens
TLRKLIGSL

SEQ ID NO: 670149 - protein, 9 aa, Homo Sapiens
QCCQRPGPD

SEQ ID NO: 670150 - protein, 9 aa, Homo Sapiens
TAHGESAFR

SEQ ID NO: 670151 - protein, 9 aa, Homo Sapiens
AQVGNSFWY

SEQ ID NO: 670152 - protein, 9 aa, Homo Sapiens
YLKNLVMST

SEQ ID NO: 670153 - protein, 9 aa, Homo Sapiens
IVTAGRGDH

SEQ ID NO: 670154 - protein, 9 aa, Homo Sapiens
HNRFDAVQA

SEQ ID NO: 670155 - protein, 9 aa, Homo Sapiens
HMAPSKEED

SEQ ID NO: 670156 - protein, 9 aa, Homo Sapiens
PSSSDSATS

SEQ ID NO: 670157 - protein, 9 aa, Homo Sapiens
VSSPLKGQQ

SEQ ID NO: 670158 - protein, 9 aa, Homo Sapiens
HSMPSAHGG

SEQ ID NO: 670159 - protein, 9 aa, Homo Sapiens
EPTVTCVTV

SEQ ID NO: 670160 - protein, 9 aa, Homo Sapiens
DKIYSTKRD

SEQ ID NO: 670161 - protein, 9 aa, Homo Sapiens
PAFQPLRPC

SEQ ID NO: 670162 - protein, 9 aa, Homo Sapiens
SQQPCQSGV

SEQ ID NO: 670163 - protein, 9 aa, Homo Sapiens
PRDFHPIMK

SEQ ID NO: 670164 - protein, 9 aa, Homo Sapiens
TMRPLLRYS

SEQ ID NO: 670165 - protein, 9 aa, Homo Sapiens
NLSPERPRS

SEQ ID NO: 670166 - protein, 9 aa, Homo Sapiens
ADRYEEPVL

SEQ ID NO: 670167 - protein, 9 aa, Homo Sapiens
AALPTKVVT

SEQ ID NO: 670168 - protein, 9 aa, Homo Sapiens
LRSNGCCSI

SEQ ID NO: 670169 - protein, 9 aa, Homo Sapiens
QKPPRCWAA

SEQ ID NO: 670170 - protein, 9 aa, Homo Sapiens
IRLMSPGTR

SEQ ID NO: 670171 - protein, 9 aa, Homo Sapiens
LLFTGRTCK

SEQ ID NO: 670172 - protein, 9 aa, Homo Sapiens
ICKLVVFVA

SEQ ID NO: 670173 - protein, 9 aa, Homo Sapiens
VHYSNIYIK

SEQ ID NO: 670174 - protein, 9 aa, Homo Sapiens
HYSTEEIKR

SEQ ID NO: 670175 - protein, 9 aa, Homo Sapiens
AILSFSEIC

SEQ ID NO: 670176 - protein, 9 aa, Homo Sapiens
VGVFQHRKV

SEQ ID NO: 670177 - protein, 9 aa, Homo Sapiens
PSALPSDGR

SEQ ID NO: 670178 - protein, 9 aa, Homo Sapiens
EALKDLARL

SEQ ID NO: 670179 - protein, 9 aa, Homo Sapiens
GDKYRFSAL

SEQ ID NO: 670180 - protein, 9 aa, Homo Sapiens
YLKAKKSTV

SEQ ID NO: 670181 - protein, 9 aa, Homo Sapiens
LQIAPPYTS

SEQ ID NO: 670182 - protein, 9 aa, Homo Sapiens
RGPPGEIVA

SEQ ID NO: 670183 - protein, 9 aa, Homo Sapiens
LEQKKLMLC

SEQ ID NO: 670184 - protein, 9 aa, Homo Sapiens
QIAPPYTSE

SEQ ID NO: 670185 - protein, 9 aa, Homo Sapiens
RKPTPAADS

SEQ ID NO: 670186 - protein, 9 aa, Homo Sapiens
YTANLVAVM

SEQ ID NO: 670187 - protein, 9 aa, Homo Sapiens
YQLNFQMGL

SEQ ID NO: 670188 - protein, 9 aa, Homo Sapiens
DYANKPLEK

SEQ ID NO: 670189 - protein, 9 aa, Homo Sapiens
KDLARLSRD

SEQ ID NO: 670190 - protein, 9 aa, Homo Sapiens
RGPGCVWAA

SEQ ID NO: 670191 - protein, 9 aa, Homo Sapiens
RQLPGTHVS

SEQ ID NO: 670192 - protein, 9 aa, Homo Sapiens
LTLKQQHQQ

SEQ ID NO: 670193 - protein, 9 aa, Homo Sapiens
DTRICKLVV

SEQ ID NO: 670194 - protein, 9 aa, Homo Sapiens
YLTRSEKHM

SEQ ID NO: 670195 - protein, 9 aa, Homo Sapiens
RHSFKREEC

SEQ ID NO: 670196 - protein, 9 aa, Homo Sapiens
IVREETRGD

SEQ ID NO: 670197 - protein, 9 aa, Homo Sapiens
PNMLTDLPG

SEQ ID NO: 670198 - protein, 9 aa, Homo Sapiens
YYQINWTTG

SEQ ID NO: 670199 - protein, 9 aa, Homo Sapiens
QLAKHTRIN

SEQ ID NO: 670200 - protein, 9 aa, Homo Sapiens
LDSPQHIKN

SEQ ID NO: 670201 - protein, 9 aa, Homo Sapiens
IQHEQEGAL

SEQ ID NO: 670202 - protein, 9 aa, Homo Sapiens
STDLTPLDI

SEQ ID NO: 670203 - protein, 9 aa, Homo Sapiens
SRRREHLLR

SEQ ID NO: 670204 - protein, 9 aa, Homo Sapiens
KWLLSLASL

SEQ ID NO: 670205 - protein, 9 aa, Homo Sapiens
TPAALPTKV

SEQ ID NO: 670206 - protein, 9 aa, Homo Sapiens
TRLPDNTTN

SEQ ID NO: 670207 - protein, 9 aa, Homo Sapiens
MYLTRSEKH

SEQ ID NO: 670208 - protein, 9 aa, Homo Sapiens
VKVAYSFTH

SEQ ID NO: 670209 - protein, 9 aa, Homo Sapiens
LQLVVLDVK

SEQ ID NO: 670210 - protein, 9 aa, Homo Sapiens
PAASAAATA

SEQ ID NO: 670211 - protein, 9 aa, Homo Sapiens
REKKVLEEH

SEQ ID NO: 670212 - protein, 9 aa, Homo Sapiens
TTAARAAAR

SEQ ID NO: 670213 - protein, 9 aa, Homo Sapiens
ASPCSHNAL

SEQ ID NO: 670214 - protein, 9 aa, Homo Sapiens
RKLIGSLDD

SEQ ID NO: 670215 - protein, 9 aa, Homo Sapiens
DIIDLKFKD

SEQ ID NO: 670216 - protein, 9 aa, Homo Sapiens
CQLGLLTEA

SEQ ID NO: 670217 - protein, 9 aa, Homo Sapiens
APLPQSRLA

SEQ ID NO: 670218 - protein, 9 aa, Homo Sapiens
CLKLIILMD

SEQ ID NO: 670219 - protein, 9 aa, Homo Sapiens
QDECRKLEE

SEQ ID NO: 670220 - protein, 9 aa, Homo Sapiens
QTIDRLYFV

SEQ ID NO: 670221 - protein, 9 aa, Homo Sapiens
TMDPNTLFG

SEQ ID NO: 670222 - protein, 9 aa, Homo Sapiens
MEQLAQDLQ

SEQ ID NO: 670223 - protein, 9 aa, Homo Sapiens
PETSSPSPV

SEQ ID NO: 670224 - protein, 9 aa, Homo Sapiens
FVDFCYSSN

SEQ ID NO: 670225 - protein, 9 aa, Homo Sapiens
PAPASPTGG

SEQ ID NO: 670226 - protein, 9 aa, Homo Sapiens
TAVSKFDRE

SEQ ID NO: 670227 - protein, 9 aa, Homo Sapiens
VTSSLPIAS

SEQ ID NO: 670228 - protein, 9 aa, Homo Sapiens
FIDGKSKDI

SEQ ID NO: 670229 - protein, 9 aa, Homo Sapiens
IGMKSRGMY

SEQ ID NO: 670230 - protein, 9 aa, Homo Sapiens
EINMLSEQS

SEQ ID NO: 670231 - protein, 9 aa, Homo Sapiens
LAKHTRINC

SEQ ID NO: 670232 - protein, 9 aa, Homo Sapiens
MMVEVDSMP

SEQ ID NO: 670233 - protein, 9 aa, Homo Sapiens
TKRDVWSYG

SEQ ID NO: 670234 - protein, 9 aa, Homo Sapiens
EGGKKKPVL

SEQ ID NO: 670235 - protein, 9 aa, Homo Sapiens
TNLSALRKH

SEQ ID NO: 670236 - protein, 9 aa, Homo Sapiens
YLEAICLLG

SEQ ID NO: 670237 - protein, 9 aa, Homo Sapiens
QLAQDLQGL

SEQ ID NO: 670238 - protein, 9 aa, Homo Sapiens
GAGGCGGSP

SEQ ID NO: 670239 - protein, 9 aa, Homo Sapiens
LAEVTVAVD

SEQ ID NO: 670240 - protein, 9 aa, Homo Sapiens
VATLLGETP

SEQ ID NO: 670241 - protein, 9 aa, Homo Sapiens
ALQIAPPYT

SEQ ID NO: 670242 - protein, 9 aa, Homo Sapiens
SQKKRKKSL

SEQ ID NO: 670243 - protein, 9 aa, Homo Sapiens
AFSNCASHL

SEQ ID NO: 670244 - protein, 9 aa, Homo Sapiens
DERETVIPP

SEQ ID NO: 670245 - protein, 9 aa, Homo Sapiens
DQVSYRGAL

SEQ ID NO: 670246 - protein, 9 aa, Homo Sapiens
QVREPVCKV

SEQ ID NO: 670247 - protein, 9 aa, Homo Sapiens
QQVLGDHIV

SEQ ID NO: 670248 - protein, 9 aa, Homo Sapiens
NFYDQLKFV

SEQ ID NO: 670249 - protein, 9 aa, Homo Sapiens
NSKVELKSK

SEQ ID NO: 670250 - protein, 9 aa, Homo Sapiens
LAFISGERD

SEQ ID NO: 670251 - protein, 9 aa, Homo Sapiens
NGYIYIFGG

SEQ ID NO: 670252 - protein, 9 aa, Homo Sapiens
HADMHSDMP

SEQ ID NO: 670253 - protein, 9 aa, Homo Sapiens
AGDSTEASS

SEQ ID NO: 670254 - protein, 9 aa, Homo Sapiens
ESSPTKAMK

SEQ ID NO: 670255 - protein, 9 aa, Homo Sapiens
SGYRTGLVL

SEQ ID NO: 670256 - protein, 9 aa, Homo Sapiens
SPTGGSGGS

SEQ ID NO: 670257 - protein, 9 aa, Homo Sapiens
TFFGSEEPT

SEQ ID NO: 670258 - protein, 9 aa, Homo Sapiens
TIPFDENGD

SEQ ID NO: 670259 - protein, 9 aa, Homo Sapiens
AFEAELALT

SEQ ID NO: 670260 - protein, 9 aa, Homo Sapiens
QLGICYTNL

SEQ ID NO: 670261 - protein, 9 aa, Homo Sapiens
FSALELQFY

SEQ ID NO: 670262 - protein, 9 aa, Homo Sapiens
TSGSSSHHH

SEQ ID NO: 670263 - protein, 9 aa, Homo Sapiens
WASRRREHL

SEQ ID NO: 670264 - protein, 9 aa, Homo Sapiens
GETESATTE

SEQ ID NO: 670265 - protein, 9 aa, Homo Sapiens
PVPASLSMR

SEQ ID NO: 670266 - protein, 9 aa, Homo Sapiens
AGERAWTPT

SEQ ID NO: 670267 - protein, 9 aa, Homo Sapiens
PYYRYLCIS

SEQ ID NO: 670268 - protein, 9 aa, Homo Sapiens
MEFRHFKIH

SEQ ID NO: 670269 - protein, 9 aa, Homo Sapiens
AICLLGGGH

SEQ ID NO: 670270 - protein, 9 aa, Homo Sapiens
ICGLPDKQE

SEQ ID NO: 670271 - protein, 9 aa, Homo Sapiens
VLSNCSYLE

SEQ ID NO: 670272 - protein, 9 aa, Homo Sapiens
YVNMTGLYL

SEQ ID NO: 670273 - protein, 9 aa, Homo Sapiens
LHDQERKIG

SEQ ID NO: 670274 - protein, 9 aa, Homo Sapiens
AESETWKRT

SEQ ID NO: 670275 - protein, 9 aa, Homo Sapiens
EDTGESAAA

SEQ ID NO: 670276 - protein, 9 aa, Homo Sapiens
NLVMYFLFL

SEQ ID NO: 670277 - protein, 9 aa, Homo Sapiens
DLRVNILLL

SEQ ID NO: 670278 - protein, 9 aa, Homo Sapiens
RALVNMPPY

SEQ ID NO: 670279 - protein, 9 aa, Homo Sapiens
LTAYLSQAV

SEQ ID NO: 670280 - protein, 9 aa, Homo Sapiens
ARCLPLEVS

SEQ ID NO: 670281 - protein, 9 aa, Homo Sapiens
RKVEIIAND

SEQ ID NO: 670282 - protein, 9 aa, Homo Sapiens
SYRGALTGG

SEQ ID NO: 670283 - protein, 9 aa, Homo Sapiens
DKYRFSALE

SEQ ID NO: 670284 - protein, 9 aa, Homo Sapiens
SQRPRPNSP

SEQ ID NO: 670285 - protein, 9 aa, Homo Sapiens
DRQLPGTHV

SEQ ID NO: 670286 - protein, 9 aa, Homo Sapiens
KGQQVREPV

SEQ ID NO: 670287 - protein, 9 aa, Homo Sapiens
HSFIATIDR

SEQ ID NO: 670288 - protein, 9 aa, Homo Sapiens
TQTGEKPYV

SEQ ID NO: 670289 - protein, 9 aa, Homo Sapiens
RGDHLARRV

SEQ ID NO: 670290 - protein, 9 aa, Homo Sapiens
SRDQPTGYK

SEQ ID NO: 670291 - protein, 9 aa, Homo Sapiens
AASAAATAY

SEQ ID NO: 670292 - protein, 9 aa, Homo Sapiens
FYDQLKFVS

SEQ ID NO: 670293 - protein, 9 aa, Homo Sapiens
LTAKGTPCE

SEQ ID NO: 670294 - protein, 9 aa, Homo Sapiens
NMPPYYRYL

SEQ ID NO: 670295 - protein, 9 aa, Homo Sapiens
CLTSRACCT

SEQ ID NO: 670296 - protein, 9 aa, Homo Sapiens
HTLLDPLNM

SEQ ID NO: 670297 - protein, 9 aa, Homo Sapiens
PAKLHVQDQ

SEQ ID NO: 670298 - protein, 9 aa, Homo Sapiens
RAPGIPGSP

SEQ ID NO: 670299 - protein, 9 aa, Homo Sapiens
GQCVKGDRR

SEQ ID NO: 670300 - protein, 9 aa, Homo Sapiens
TDLIDMNTV

SEQ ID NO: 670301 - protein, 9 aa, Homo Sapiens
CLWLLEFLR

SEQ ID NO: 670302 - protein, 9 aa, Homo Sapiens
GMNRNFYDQ

SEQ ID NO: 670303 - protein, 9 aa, Homo Sapiens
TSSQRPRPN

SEQ ID NO: 670304 - protein, 9 aa, Homo Sapiens
SPSGGEAKC

SEQ ID NO: 670305 - protein, 9 aa, Homo Sapiens
YDYSPGQLI

SEQ ID NO: 670306 - protein, 9 aa, Homo Sapiens
HGGSAAEEE

SEQ ID NO: 670307 - protein, 9 aa, Homo Sapiens
FFINPNMLT

SEQ ID NO: 670308 - protein, 9 aa, Homo Sapiens
YVPTSWLLN

SEQ ID NO: 670309 - protein, 9 aa, Homo Sapiens
VNADFATRD

SEQ ID NO: 670310 - protein, 9 aa, Homo Sapiens
GFACTNCLI

SEQ ID NO: 670311 - protein, 9 aa, Homo Sapiens
PTVTCVTVV

SEQ ID NO: 670312 - protein, 9 aa, Homo Sapiens
SAAVTRNLP

SEQ ID NO: 670313 - protein, 9 aa, Homo Sapiens
TPACELKPP

SEQ ID NO: 670314 - protein, 9 aa, Homo Sapiens
SSGYRTGLV

SEQ ID NO: 670315 - protein, 9 aa, Homo Sapiens
PTHRLPFVD

SEQ ID NO: 670316 - protein, 9 aa, Homo Sapiens
PVCHLVQER

SEQ ID NO: 670317 - protein, 9 aa, Homo Sapiens
VAPPSALPS

SEQ ID NO: 670318 - protein, 9 aa, Homo Sapiens
ILGRSITAV

SEQ ID NO: 670319 - protein, 9 aa, Homo Sapiens
QPLRPCPIS

SEQ ID NO: 670320 - protein, 9 aa, Homo Sapiens
RDQPTGYKK

SEQ ID NO: 670321 - protein, 9 aa, Homo Sapiens
SPFLSSTSP

SEQ ID NO: 670322 - protein, 9 aa, Homo Sapiens
QRISCTPKT

SEQ ID NO: 670323 - protein, 9 aa, Homo Sapiens
LLAPLPSAG

SEQ ID NO: 670324 - protein, 9 aa, Homo Sapiens
ATIDRSAAP

SEQ ID NO: 670325 - protein, 9 aa, Homo Sapiens
TSRACCTTA

SEQ ID NO: 670326 - protein, 9 aa, Homo Sapiens
FQHRKVEII

SEQ ID NO: 670327 - protein, 9 aa, Homo Sapiens
SSTVQVSEF

SEQ ID NO: 670328 - protein, 9 aa, Homo Sapiens
VRERPVAFE

SEQ ID NO: 670329 - protein, 9 aa, Homo Sapiens
LHVLSPQKP

SEQ ID NO: 670330 - protein, 9 aa, Homo Sapiens
PPAASAAAT

SEQ ID NO: 670331 - protein, 9 aa, Homo Sapiens
AIARCEHMA

SEQ ID NO: 670332 - protein, 9 aa, Homo Sapiens
YLIELFFFQ

SEQ ID NO: 670333 - protein, 9 aa, Homo Sapiens
LTYSATHPW

SEQ ID NO: 670334 - protein, 9 aa, Homo Sapiens
CLPLEVSSE

SEQ ID NO: 670335 - protein, 9 aa, Homo Sapiens
TILADRYEE

SEQ ID NO: 670336 - protein, 9 aa, Homo Sapiens
LLVTFTWNT

SEQ ID NO: 670337 - protein, 9 aa, Homo Sapiens
FYLKNLVMS

SEQ ID NO: 670338 - protein, 9 aa, Homo Sapiens
NLFQSDPRG

SEQ ID NO: 670339 - protein, 9 aa, Homo Sapiens
AGPETSSPS

SEQ ID NO: 670340 - protein, 9 aa, Homo Sapiens
ETVIPPCFD

SEQ ID NO: 670341 - protein, 9 aa, Homo Sapiens
QHRKVEIIA

SEQ ID NO: 670342 - protein, 9 aa, Homo Sapiens
TGYKKNSYG

SEQ ID NO: 670343 - protein, 9 aa, Homo Sapiens
SSPTKAMKK

SEQ ID NO: 670344 - protein, 9 aa, Homo Sapiens
TPVSRESSP

SEQ ID NO: 670345 - protein, 9 aa, Homo Sapiens
GMDRDYGHV

SEQ ID NO: 670346 - protein, 9 aa, Homo Sapiens
YNLFQSDPR

SEQ ID NO: 670347 - protein, 9 aa, Homo Sapiens
DTVSMGPGD

SEQ ID NO: 670348 - protein, 9 aa, Homo Sapiens
YWLNVDFRK

SEQ ID NO: 670349 - protein, 9 aa, Homo Sapiens
KVTLNSALA

SEQ ID NO: 670350 - protein, 9 aa, Homo Sapiens
KPQGLHDGG

SEQ ID NO: 670351 - protein, 9 aa, Homo Sapiens
ERKETPCLK

SEQ ID NO: 670352 - protein, 9 aa, Homo Sapiens
ERIEEKGYN

SEQ ID NO: 670353 - protein, 9 aa, Homo Sapiens
SDVRYTKDY

SEQ ID NO: 670354 - protein, 9 aa, Homo Sapiens
AGPVRDSIC

SEQ ID NO: 670355 - protein, 9 aa, Homo Sapiens
PNKDEESVT

SEQ ID NO: 670356 - protein, 9 aa, Homo Sapiens
QRANNLRME

SEQ ID NO: 670357 - protein, 9 aa, Homo Sapiens
KNAMRKCGV

SEQ ID NO: 670358 - protein, 9 aa, Homo Sapiens
GGLSLLLGL

SEQ ID NO: 670359 - protein, 9 aa, Homo Sapiens
TLEGDQVSY

SEQ ID NO: 670360 - protein, 9 aa, Homo Sapiens
GGGASSGKV

SEQ ID NO: 670361 - protein, 9 aa, Homo Sapiens
WNTLSAAQL

SEQ ID NO: 670362 - protein, 9 aa, Homo Sapiens
SEGYYNFDS

SEQ ID NO: 670363 - protein, 9 aa, Homo Sapiens
MVYNAGPVR

SEQ ID NO: 670364 - protein, 9 aa, Homo Sapiens
IPFDENGDS

SEQ ID NO: 670365 - protein, 9 aa, Homo Sapiens
FTNLSALRK

SEQ ID NO: 670366 - protein, 9 aa, Homo Sapiens
CPELGILSP

SEQ ID NO: 670367 - protein, 9 aa, Homo Sapiens
GLKSHSSSA

SEQ ID NO: 670368 - protein, 9 aa, Homo Sapiens
QRVLIKALE

SEQ ID NO: 670369 - protein, 9 aa, Homo Sapiens
VREETRGDC

SEQ ID NO: 670370 - protein, 9 aa, Homo Sapiens
TRICKLVVF

SEQ ID NO: 670371 - protein, 9 aa, Homo Sapiens
NCYKYSSMI

SEQ ID NO: 670372 - protein, 9 aa, Homo Sapiens
RRHMALKEF

SEQ ID NO: 670373 - protein, 9 aa, Homo Sapiens
QCQLGLLTE

SEQ ID NO: 670374 - protein, 9 aa, Homo Sapiens
LGQTSAANG

SEQ ID NO: 670375 - protein, 9 aa, Homo Sapiens
DDEVYAAPW

SEQ ID NO: 670376 - protein, 9 aa, Homo Sapiens
NGSFKCLDS

SEQ ID NO: 670377 - protein, 9 aa, Homo Sapiens
ALPTKVVTT

SEQ ID NO: 670378 - protein, 9 aa, Homo Sapiens
ATLLGETPM

SEQ ID NO: 670379 - protein, 9 aa, Homo Sapiens
DPNTLFGSN

SEQ ID NO: 670380 - protein, 9 aa, Homo Sapiens
KTMSVVSYN

SEQ ID NO: 670381 - protein, 9 aa, Homo Sapiens
QLNDEALKE

SEQ ID NO: 670382 - protein, 9 aa, Homo Sapiens
WTPTPPVFQ

SEQ ID NO: 670383 - protein, 9 aa, Homo Sapiens
YAAPWNTTR

SEQ ID NO: 670384 - protein, 9 aa, Homo Sapiens
TTRPTRPKT

SEQ ID NO: 670385 - protein, 9 aa, Homo Sapiens
EQEGALDVE

SEQ ID NO: 670386 - protein, 9 aa, Homo Sapiens
GVSGDTIPF

SEQ ID NO: 670387 - protein, 9 aa, Homo Sapiens
HEQEGALDV

SEQ ID NO: 670388 - protein, 9 aa, Homo Sapiens
WAAPLCLWL

SEQ ID NO: 670389 - protein, 9 aa, Homo Sapiens
VRPVQLLVQ

SEQ ID NO: 670390 - protein, 9 aa, Homo Sapiens
IQLLRRSYP

SEQ ID NO: 670391 - protein, 9 aa, Homo Sapiens
HSLLPPQAA

SEQ ID NO: 670392 - protein, 9 aa, Homo Sapiens
REAESVRSP

SEQ ID NO: 670393 - protein, 9 aa, Homo Sapiens
LVCTPVSRE

SEQ ID NO: 670394 - protein, 9 aa, Homo Sapiens
LHATIKILF

SEQ ID NO: 670395 - protein, 9 aa, Homo Sapiens
LKREGKYIW

SEQ ID NO: 670396 - protein, 9 aa, Homo Sapiens
TVCITEYEE

SEQ ID NO: 670397 - protein, 9 aa, Homo Sapiens
GATPRDFHP

SEQ ID NO: 670398 - protein, 9 aa, Homo Sapiens
ITSMTSERP

SEQ ID NO: 670399 - protein, 9 aa, Homo Sapiens
TRAAFCYQI

SEQ ID NO: 670400 - protein, 9 aa, Homo Sapiens
LRHQRTQTG

SEQ ID NO: 670401 - protein, 9 aa, Homo Sapiens
KMLPDLLSE

SEQ ID NO: 670402 - protein, 9 aa, Homo Sapiens
DHECYHPNM

SEQ ID NO: 670403 - protein, 9 aa, Homo Sapiens
ILTEFCSRG

SEQ ID NO: 670404 - protein, 9 aa, Homo Sapiens
YLSAIQERQ

SEQ ID NO: 670405 - protein, 9 aa, Homo Sapiens
LTYLVTVEG

SEQ ID NO: 670406 - protein, 9 aa, Homo Sapiens
LYQLHENGL

SEQ ID NO: 670407 - protein, 9 aa, Homo Sapiens
LWAHLGTTG

SEQ ID NO: 670408 - protein, 9 aa, Homo Sapiens
VPTSWLLNN

SEQ ID NO: 670409 - protein, 9 aa, Homo Sapiens
GKKKPVLAP

SEQ ID NO: 670410 - protein, 9 aa, Homo Sapiens
CGKAFTNLS

SEQ ID NO: 670411 - protein, 9 aa, Homo Sapiens
SQEGLKSHS

SEQ ID NO: 670412 - protein, 9 aa, Homo Sapiens
QVCLYQLHE

SEQ ID NO: 670413 - protein, 9 aa, Homo Sapiens
QSLAQEALD

SEQ ID NO: 670414 - protein, 9 aa, Homo Sapiens
TRDQYAEVT

SEQ ID NO: 670415 - protein, 9 aa, Homo Sapiens
RLVHKLRQA

SEQ ID NO: 670416 - protein, 9 aa, Homo Sapiens
RTGAGGCGG

SEQ ID NO: 670417 - protein, 9 aa, Homo Sapiens
NSSTVQVSE

SEQ ID NO: 670418 - protein, 9 aa, Homo Sapiens
PRAGLAPEL

SEQ ID NO: 670419 - protein, 9 aa, Homo Sapiens
KIDDEVYAA

SEQ ID NO: 670420 - protein, 9 aa, Homo Sapiens
SGVQFVLGR

SEQ ID NO: 670421 - protein, 9 aa, Homo Sapiens
DLTKVFEIR

SEQ ID NO: 670422 - protein, 9 aa, Homo Sapiens
LQGLTKDRK

SEQ ID NO: 670423 - protein, 9 aa, Homo Sapiens
KNCYKYSSM

SEQ ID NO: 670424 - protein, 9 aa, Homo Sapiens
WQRRLRHLA

SEQ ID NO: 670425 - protein, 9 aa, Homo Sapiens
MCQVPLVFW

SEQ ID NO: 670426 - protein, 9 aa, Homo Sapiens
IYICGLPDK

SEQ ID NO: 670427 - protein, 9 aa, Homo Sapiens
MDHNELRGM

SEQ ID NO: 670428 - protein, 9 aa, Homo Sapiens
CTPVLGCCI

SEQ ID NO: 670429 - protein, 9 aa, Homo Sapiens
RVLIKALED

SEQ ID NO: 670430 - protein, 9 aa, Homo Sapiens
KRRLACAGC

SEQ ID NO: 670431 - protein, 9 aa, Homo Sapiens
RSQLLTLKQ

SEQ ID NO: 670432 - protein, 9 aa, Homo Sapiens
LQLSVLARK

SEQ ID NO: 670433 - protein, 9 aa, Homo Sapiens
SERPELANK

SEQ ID NO: 670434 - protein, 9 aa, Homo Sapiens
QSFYSTWPP

SEQ ID NO: 670435 - protein, 9 aa, Homo Sapiens
ANLVAVMVG

SEQ ID NO: 670436 - protein, 9 aa, Homo Sapiens
SQPSQNQGL

SEQ ID NO: 670437 - protein, 9 aa, Homo Sapiens
RLRRRHMAL

SEQ ID NO: 670438 - protein, 9 aa, Homo Sapiens
EGALDVEVS

SEQ ID NO: 670439 - protein, 9 aa, Homo Sapiens
KYRFSALEL

SEQ ID NO: 670440 - protein, 9 aa, Homo Sapiens
LRRSYPAAF

SEQ ID NO: 670441 - protein, 9 aa, Homo Sapiens
PFDENGDSP

SEQ ID NO: 670442 - protein, 9 aa, Homo Sapiens
LCFMVQFGP

SEQ ID NO: 670443 - protein, 9 aa, Homo Sapiens
QLLVQLNDE

SEQ ID NO: 670444 - protein, 9 aa, Homo Sapiens
IIAVMGYDR

SEQ ID NO: 670445 - protein, 9 aa, Homo Sapiens
DEAQRDREA

SEQ ID NO: 670446 - protein, 9 aa, Homo Sapiens
GTVHKGRPR

SEQ ID NO: 670447 - protein, 9 aa, Homo Sapiens
DHNELRGMG

SEQ ID NO: 670448 - protein, 9 aa, Homo Sapiens
CTPVSRESS

SEQ ID NO: 670449 - protein, 9 aa, Homo Sapiens
FIFLRFFEP

SEQ ID NO: 670450 - protein, 9 aa, Homo Sapiens
EREKKVLEE

SEQ ID NO: 670451 - protein, 9 aa, Homo Sapiens
LLGGGHPVP

SEQ ID NO: 670452 - protein, 9 aa, Homo Sapiens
LIIAVMGYD

SEQ ID NO: 670453 - protein, 9 aa, Homo Sapiens
SESSPTKAM

SEQ ID NO: 670454 - protein, 9 aa, Homo Sapiens
QMGLLVPAH

SEQ ID NO: 670455 - protein, 9 aa, Homo Sapiens
ERLSVKVAY

SEQ ID NO: 670456 - protein, 9 aa, Homo Sapiens
RWGDLTATE

SEQ ID NO: 670457 - protein, 9 aa, Homo Sapiens
YDFTNSDFE

SEQ ID NO: 670458 - protein, 9 aa, Homo Sapiens
CSYLERHTF

SEQ ID NO: 670459 - protein, 9 aa, Homo Sapiens
VGYEINMLS

SEQ ID NO: 670460 - protein, 9 aa, Homo Sapiens
RAAARPSPA

SEQ ID NO: 670461 - protein, 9 aa, Homo Sapiens
LPSAGKKDD

SEQ ID NO: 670462 - protein, 9 aa, Homo Sapiens
HLGTTGLLA

SEQ ID NO: 670463 - protein, 9 aa, Homo Sapiens
LSESSPTKA

SEQ ID NO: 670464 - protein, 9 aa, Homo Sapiens
LGRLMIQHE

SEQ ID NO: 670465 - protein, 9 aa, Homo Sapiens
ALDVEVSRP

SEQ ID NO: 670466 - protein, 9 aa, Homo Sapiens
VLAGLEPFG

SEQ ID NO: 670467 - protein, 9 aa, Homo Sapiens
LLLLAFYLC

SEQ ID NO: 670468 - protein, 9 aa, Homo Sapiens
VAVDVLPLV

SEQ ID NO: 670469 - protein, 9 aa, Homo Sapiens
FMVQFGPRS

SEQ ID NO: 670470 - protein, 9 aa, Homo Sapiens
AEDTGESAA

SEQ ID NO: 670471 - protein, 9 aa, Homo Sapiens
NKCAFSSHE

SEQ ID NO: 670472 - protein, 9 aa, Homo Sapiens
APWGKRRLA

SEQ ID NO: 670473 - protein, 9 aa, Homo Sapiens
VIYLNATDA

SEQ ID NO: 670474 - protein, 9 aa, Homo Sapiens
RKKDVTGAL

SEQ ID NO: 670475 - protein, 9 aa, Homo Sapiens
PRRAAARFL

SEQ ID NO: 670476 - protein, 9 aa, Homo Sapiens
DMHSDMPMG

SEQ ID NO: 670477 - protein, 9 aa, Homo Sapiens
LGDHIVRFW

SEQ ID NO: 670478 - protein, 9 aa, Homo Sapiens
LGTVVIYLN

SEQ ID NO: 670479 - protein, 9 aa, Homo Sapiens
EKGDVIYIC

SEQ ID NO: 670480 - protein, 9 aa, Homo Sapiens
EEKAVVYKL

SEQ ID NO: 670481 - protein, 9 aa, Homo Sapiens
GFLHATIKI

SEQ ID NO: 670482 - protein, 9 aa, Homo Sapiens
RRADFNQQC

SEQ ID NO: 670483 - protein, 9 aa, Homo Sapiens
PSHHALQLS

SEQ ID NO: 670484 - protein, 9 aa, Homo Sapiens
EKMFLKREG

SEQ ID NO: 670485 - protein, 9 aa, Homo Sapiens
EVRTGREAV

SEQ ID NO: 670486 - protein, 9 aa, Homo Sapiens
KFKDFGTYT

SEQ ID NO: 670487 - protein, 9 aa, Homo Sapiens
AQIRRLKNS

SEQ ID NO: 670488 - protein, 9 aa, Homo Sapiens
KPEDEVAQK

SEQ ID NO: 670489 - protein, 9 aa, Homo Sapiens
AFYLCFLPF

SEQ ID NO: 670490 - protein, 9 aa, Homo Sapiens
APLCLWLLE

SEQ ID NO: 670491 - protein, 9 aa, Homo Sapiens
HVERKETPC

SEQ ID NO: 670492 - protein, 9 aa, Homo Sapiens
IKRSDCVDQ

SEQ ID NO: 670493 - protein, 9 aa, Homo Sapiens
EGYYNFDSG

SEQ ID NO: 670494 - protein, 9 aa, Homo Sapiens
SATTEDLAE

SEQ ID NO: 670495 - protein, 9 aa, Homo Sapiens
ETSSPSPVS

SEQ ID NO: 670496 - protein, 9 aa, Homo Sapiens
RHMALKEFS

SEQ ID NO: 670497 - protein, 9 aa, Homo Sapiens
LDARLRAAN

SEQ ID NO: 670498 - protein, 9 aa, Homo Sapiens
FVLGRLMIQ

SEQ ID NO: 670499 - protein, 9 aa, Homo Sapiens
TVAVDVLPL

SEQ ID NO: 670500 - protein, 9 aa, Homo Sapiens
EGPPGDTGL

SEQ ID NO: 670501 - protein, 9 aa, Homo Sapiens
RPSPARWRR

SEQ ID NO: 670502 - protein, 9 aa, Homo Sapiens
LCFLPFHIL

SEQ ID NO: 670503 - protein, 9 aa, Homo Sapiens
GERDLEKAP

SEQ ID NO: 670504 - protein, 9 aa, Homo Sapiens
RSEPIRIAG

SEQ ID NO: 670505 - protein, 9 aa, Homo Sapiens
QLRSQLLTL

SEQ ID NO: 670506 - protein, 9 aa, Homo Sapiens
RPGTRAAFC

SEQ ID NO: 670507 - protein, 9 aa, Homo Sapiens
KPDTYVPTS

SEQ ID NO: 670508 - protein, 9 aa, Homo Sapiens
AATAHYNLF

SEQ ID NO: 670509 - protein, 9 aa, Homo Sapiens
EYLSSVSSS

SEQ ID NO: 670510 - protein, 9 aa, Homo Sapiens
GPPGEIVAK

SEQ ID NO: 670511 - protein, 9 aa, Homo Sapiens
SPESAPEEE

SEQ ID NO: 670512 - protein, 9 aa, Homo Sapiens
PSAGKKDDK

SEQ ID NO: 670513 - protein, 9 aa, Homo Sapiens
QMDTYNLFQ

SEQ ID NO: 670514 - protein, 9 aa, Homo Sapiens
YVSMVPSNE

SEQ ID NO: 670515 - protein, 9 aa, Homo Sapiens
SRQELWAHL

SEQ ID NO: 670516 - protein, 9 aa, Homo Sapiens
DDALKLSER

SEQ ID NO: 670517 - protein, 9 aa, Homo Sapiens
GRTCKGCVF

SEQ ID NO: 670518 - protein, 9 aa, Homo Sapiens
ALAAFKAQN

SEQ ID NO: 670519 - protein, 9 aa, Homo Sapiens
EETRGDCTD

SEQ ID NO: 670520 - protein, 9 aa, Homo Sapiens
LCGMEACVQ

SEQ ID NO: 670521 - protein, 9 aa, Homo Sapiens
ILEDKTDTM

SEQ ID NO: 670522 - protein, 9 aa, Homo Sapiens
YSKITFLTP

SEQ ID NO: 670523 - protein, 9 aa, Homo Sapiens
FTHSRKQIK

SEQ ID NO: 670524 - protein, 9 aa, Homo Sapiens
LQCSHSDRC

SEQ ID NO: 670525 - protein, 9 aa, Homo Sapiens
REHLLRERQ

SEQ ID NO: 670526 - protein, 9 aa, Homo Sapiens
EDLQGLTKD

SEQ ID NO: 670527 - protein, 9 aa, Homo Sapiens
MKSRGMYET

SEQ ID NO: 670528 - protein, 9 aa, Homo Sapiens
LLSTSLRAI

SEQ ID NO: 670529 - protein, 9 aa, Homo Sapiens
FYLEAICLL

SEQ ID NO: 670530 - protein, 9 aa, Homo Sapiens
ANKPLEKPL

SEQ ID NO: 670531 - protein, 9 aa, Homo Sapiens
KKRKKSLGQ

SEQ ID NO: 670532 - protein, 9 aa, Homo Sapiens
AECGPAFQP

SEQ ID NO: 670533 - protein, 9 aa, Homo Sapiens
TAMSSGDLG

SEQ ID NO: 670534 - protein, 9 aa, Homo Sapiens
TVIPPCFDE

SEQ ID NO: 670535 - protein, 9 aa, Homo Sapiens
MPTRTAHGE

SEQ ID NO: 670536 - protein, 9 aa, Homo Sapiens
EFVIFICGF

SEQ ID NO: 670537 - protein, 9 aa, Homo Sapiens
EITDNLTFR

SEQ ID NO: 670538 - protein, 9 aa, Homo Sapiens
DYTAMSSGD

SEQ ID NO: 670539 - protein, 9 aa, Homo Sapiens
RQARCLPLE

SEQ ID NO: 670540 - protein, 9 aa, Homo Sapiens
VVGYEINML

SEQ ID NO: 670541 - protein, 9 aa, Homo Sapiens
VCEWYQCVY

SEQ ID NO: 670542 - protein, 9 aa, Homo Sapiens
FEPAILSPN

SEQ ID NO: 670543 - protein, 9 aa, Homo Sapiens
HKAFSNCAS

SEQ ID NO: 670544 - protein, 9 aa, Homo Sapiens
SSQPSQNQG

SEQ ID NO: 670545 - protein, 9 aa, Homo Sapiens
DEVAQKKKL

SEQ ID NO: 670546 - protein, 9 aa, Homo Sapiens
VQPASPCSH

SEQ ID NO: 670547 - protein, 9 aa, Homo Sapiens
TLTAYLSQA

SEQ ID NO: 670548 - protein, 9 aa, Homo Sapiens
EEEDSLSPL

SEQ ID NO: 670549 - protein, 9 aa, Homo Sapiens
GASAGERAW

SEQ ID NO: 670550 - protein, 9 aa, Homo Sapiens
KSSQPSQNQ

SEQ ID NO: 670551 - protein, 9 aa, Homo Sapiens
GSSQSPEQC

SEQ ID NO: 670552 - protein, 9 aa, Homo Sapiens
LYLSAIQER

SEQ ID NO: 670553 - protein, 9 aa, Homo Sapiens
DGGPRLRVH

SEQ ID NO: 670554 - protein, 9 aa, Homo Sapiens
AKAALAAFK

SEQ ID NO: 670555 - protein, 9 aa, Homo Sapiens
SVKVAYSFT

SEQ ID NO: 670556 - protein, 9 aa, Homo Sapiens
SDMPMGPGM

SEQ ID NO: 670557 - protein, 9 aa, Homo Sapiens
ICIDSLNGT

SEQ ID NO: 670558 - protein, 9 aa, Homo Sapiens
VGDDLILVR

SEQ ID NO: 670559 - protein, 9 aa, Homo Sapiens
SRLAQLVIQ

SEQ ID NO: 670560 - protein, 9 aa, Homo Sapiens
LLGLSQTRE

SEQ ID NO: 670561 - protein, 9 aa, Homo Sapiens
LNGYIYIFG

SEQ ID NO: 670562 - protein, 9 aa, Homo Sapiens
WLLSLASLL

SEQ ID NO: 670563 - protein, 9 aa, Homo Sapiens
RGGGRGNKY

SEQ ID NO: 670564 - protein, 9 aa, Homo Sapiens
SALPSDGRD

SEQ ID NO: 670565 - protein, 9 aa, Homo Sapiens
GQQVREPVC

SEQ ID NO: 670566 - protein, 9 aa, Homo Sapiens
TCKGCVFGG

SEQ ID NO: 670567 - protein, 9 aa, Homo Sapiens
GTEGSDLVL

SEQ ID NO: 670568 - protein, 9 aa, Homo Sapiens
SPCSHNALK

SEQ ID NO: 670569 - protein, 9 aa, Homo Sapiens
MLLFTGRTC

SEQ ID NO: 670570 - protein, 9 aa, Homo Sapiens
GREAVQGHG

SEQ ID NO: 670571 - protein, 9 aa, Homo Sapiens
VGDRQLPGT

SEQ ID NO: 670572 - protein, 9 aa, Homo Sapiens
HVQDQLMNE

SEQ ID NO: 670573 - protein, 9 aa, Homo Sapiens
DLRKCILYQ

SEQ ID NO: 670574 - protein, 9 aa, Homo Sapiens
RQSFYSTWP

SEQ ID NO: 670575 - protein, 9 aa, Homo Sapiens
YQVTVPRAG

SEQ ID NO: 670576 - protein, 9 aa, Homo Sapiens
SHSDRCHLC

SEQ ID NO: 670577 - protein, 9 aa, Homo Sapiens
LQYAGPVPS

SEQ ID NO: 670578 - protein, 9 aa, Homo Sapiens
IVSATELGP

SEQ ID NO: 670579 - protein, 9 aa, Homo Sapiens
QFREAESVR

SEQ ID NO: 670580 - protein, 9 aa, Homo Sapiens
VDGYDYSPG

SEQ ID NO: 670581 - protein, 9 aa, Homo Sapiens
WYQCVYQSL

SEQ ID NO: 670582 - protein, 9 aa, Homo Sapiens
WREDRESRR

SEQ ID NO: 670583 - protein, 9 aa, Homo Sapiens
LIVLAGLEP

SEQ ID NO: 670584 - protein, 9 aa, Homo Sapiens
LDIIDLKFK

SEQ ID NO: 670585 - protein, 9 aa, Homo Sapiens
RLKNSVPKT

SEQ ID NO: 670586 - protein, 9 aa, Homo Sapiens
DELGQCCQR

SEQ ID NO: 670587 - protein, 9 aa, Homo Sapiens
KSRGMYETP

SEQ ID NO: 670588 - protein, 9 aa, Homo Sapiens
MRKCGVVKY

SEQ ID NO: 670589 - protein, 9 aa, Homo Sapiens
PDPALKIET

SEQ ID NO: 670590 - protein, 9 aa, Homo Sapiens
QSGVQFVLG

SEQ ID NO: 670591 - protein, 9 aa, Homo Sapiens
FLAILSFSE

SEQ ID NO: 670592 - protein, 9 aa, Homo Sapiens
ATSDPSTSV

SEQ ID NO: 670593 - protein, 9 aa, Homo Sapiens
KANDAVNSS

SEQ ID NO: 670594 - protein, 9 aa, Homo Sapiens
GHSSRNDWQ

SEQ ID NO: 670595 - protein, 9 aa, Homo Sapiens
CGGSPCTKA

SEQ ID NO: 670596 - protein, 9 aa, Homo Sapiens
TVLHTHSFS

SEQ ID NO: 670597 - protein, 9 aa, Homo Sapiens
SDLERHPTH

SEQ ID NO: 670598 - protein, 9 aa, Homo Sapiens
GAATRGNAR

SEQ ID NO: 670599 - protein, 9 aa, Homo Sapiens
NLIPSLEQV

SEQ ID NO: 670600 - protein, 9 aa, Homo Sapiens
RANNLRMEQ

SEQ ID NO: 670601 - protein, 9 aa, Homo Sapiens
SLNTVCITE

SEQ ID NO: 670602 - protein, 9 aa, Homo Sapiens
IVPKPEDEV

SEQ ID NO: 670603 - protein, 9 aa, Homo Sapiens
EGNLLIVVD

SEQ ID NO: 670604 - protein, 9 aa, Homo Sapiens
HSFKREECP

SEQ ID NO: 670605 - protein, 9 aa, Homo Sapiens
CWASRRREH

SEQ ID NO: 670606 - protein, 9 aa, Homo Sapiens
LGHLSFVDF

SEQ ID NO: 670607 - protein, 9 aa, Homo Sapiens
NQYRMLGLN

SEQ ID NO: 670608 - protein, 9 aa, Homo Sapiens
QAGTFPKPT

SEQ ID NO: 670609 - protein, 9 aa, Homo Sapiens
SHHALQLSV

SEQ ID NO: 670610 - protein, 9 aa, Homo Sapiens
SDIPCTPVL

SEQ ID NO: 670611 - protein, 9 aa, Homo Sapiens
FNDSVLESD

SEQ ID NO: 670612 - protein, 9 aa, Homo Sapiens
AESVRSPTP

SEQ ID NO: 670613 - protein, 9 aa, Homo Sapiens
VSYGGQRSM

SEQ ID NO: 670614 - protein, 9 aa, Homo Sapiens
APPSALPSD

SEQ ID NO: 670615 - protein, 9 aa, Homo Sapiens
PPSALPSDG

SEQ ID NO: 670616 - protein, 9 aa, Homo Sapiens
DYGHVSYGG

SEQ ID NO: 670617 - protein, 9 aa, Homo Sapiens
LRFFEPAIL

SEQ ID NO: 670618 - protein, 9 aa, Homo Sapiens
GRGDHLARR

SEQ ID NO: 670619 - protein, 9 aa, Homo Sapiens
SEFLSLLVD

SEQ ID NO: 670620 - protein, 9 aa, Homo Sapiens
VHKLRQAGA

SEQ ID NO: 670621 - protein, 9 aa, Homo Sapiens
TPCEDIDEC

SEQ ID NO: 670622 - protein, 9 aa, Homo Sapiens
HSQQPCQSG

SEQ ID NO: 670623 - protein, 9 aa, Homo Sapiens
PVSRESSPC

SEQ ID NO: 670624 - protein, 9 aa, Homo Sapiens
EAQVGNSFW

SEQ ID NO: 670625 - protein, 9 aa, Homo Sapiens
LSVSVEMLS

SEQ ID NO: 670626 - protein, 9 aa, Homo Sapiens
NSFWYLYDG

SEQ ID NO: 670627 - protein, 9 aa, Homo Sapiens
TPPPRSPNL

SEQ ID NO: 670628 - protein, 9 aa, Homo Sapiens
MVEVDSMPA

SEQ ID NO: 670629 - protein, 9 aa, Homo Sapiens
PLLSTSLRA

SEQ ID NO: 670630 - protein, 9 aa, Homo Sapiens
VPRAGLAPE

SEQ ID NO: 670631 - protein, 9 aa, Homo Sapiens
DALKLSERP

SEQ ID NO: 670632 - protein, 9 aa, Homo Sapiens
IPPCFDEYK

SEQ ID NO: 670633 - protein, 9 aa, Homo Sapiens
SAPLPQSRL

SEQ ID NO: 670634 - protein, 9 aa, Homo Sapiens
KGTPCEDID

SEQ ID NO: 670635 - protein, 9 aa, Homo Sapiens
LSTYTANLV

SEQ ID NO: 670636 - protein, 9 aa, Homo Sapiens
AGPAPASPT

SEQ ID NO: 670637 - protein, 9 aa, Homo Sapiens
WVSDFVLLG

SEQ ID NO: 670638 - protein, 9 aa, Homo Sapiens
GQCCQRPGP

SEQ ID NO: 670639 - protein, 9 aa, Homo Sapiens
QYAGPVPSL

SEQ ID NO: 670640 - protein, 9 aa, Homo Sapiens
EDEAQRDRE

SEQ ID NO: 670641 - protein, 9 aa, Homo Sapiens
PCQSGVQFV

SEQ ID NO: 670642 - protein, 9 aa, Homo Sapiens
HVAKMEFRH

SEQ ID NO: 670643 - protein, 9 aa, Homo Sapiens
THLTQHRKI

SEQ ID NO: 670644 - protein, 9 aa, Homo Sapiens
LLTLVHSLL

SEQ ID NO: 670645 - protein, 9 aa, Homo Sapiens
YAEVTHNIR

SEQ ID NO: 670646 - protein, 9 aa, Homo Sapiens
YEREKKVLE

SEQ ID NO: 670647 - protein, 9 aa, Homo Sapiens
YLAATAHYN

SEQ ID NO: 670648 - protein, 9 aa, Homo Sapiens
LVDIATDYH

SEQ ID NO: 670649 - protein, 9 aa, Homo Sapiens
RKQIKGVSQ

SEQ ID NO: 670650 - protein, 9 aa, Homo Sapiens
RSPFLSSTS

SEQ ID NO: 670651 - protein, 8 aa, Homo Sapiens
ESKRPRLL

SEQ ID NO: 670652 - protein, 9 aa, Homo Sapiens
MEACVQASC

SEQ ID NO: 670653 - protein, 9 aa, Homo Sapiens
NKDEESVTD

SEQ ID NO: 670654 - protein, 9 aa, Homo Sapiens
NSPSGGEAK

SEQ ID NO: 670655 - protein, 9 aa, Homo Sapiens
VIAFDRYVA

SEQ ID NO: 670656 - protein, 9 aa, Homo Sapiens
LLLAFYLCF

SEQ ID NO: 670657 - protein, 9 aa, Homo Sapiens
YEDYANKPL

SEQ ID NO: 670658 - protein, 9 aa, Homo Sapiens
FSEICYTFI

SEQ ID NO: 670659 - protein, 9 aa, Homo Sapiens
LMYLRFPAT

SEQ ID NO: 670660 - protein, 9 aa, Homo Sapiens
DQPTGYKKN

SEQ ID NO: 670661 - protein, 9 aa, Homo Sapiens
GHVSYGGQR

SEQ ID NO: 670662 - protein, 9 aa, Homo Sapiens
TLRSIKSKV

SEQ ID NO: 670663 - protein, 9 aa, Homo Sapiens
GTGTVHKGR

SEQ ID NO: 670664 - protein, 9 aa, Homo Sapiens
QIRRLKNSV

SEQ ID NO: 670665 - protein, 9 aa, Homo Sapiens
LNLNTMRPL

SEQ ID NO: 670666 - protein, 9 aa, Homo Sapiens
VGRFFGTQS

SEQ ID NO: 670667 - protein, 9 aa, Homo Sapiens
VPSLTQACQ

SEQ ID NO: 670668 - protein, 9 aa, Homo Sapiens
LRVHSQQPC

SEQ ID NO: 670669 - protein, 9 aa, Homo Sapiens
SKITFLTPL

SEQ ID NO: 670670 - protein, 9 aa, Homo Sapiens
SSLQGSESS

SEQ ID NO: 670671 - protein, 9 aa, Homo Sapiens
CSSVTPGEP

SEQ ID NO: 670672 - protein, 9 aa, Homo Sapiens
KVVGYEINM

SEQ ID NO: 670673 - protein, 9 aa, Homo Sapiens
AHGGSAAEE

SEQ ID NO: 670674 - protein, 9 aa, Homo Sapiens
HKQFSTSST

SEQ ID NO: 670675 - protein, 9 aa, Homo Sapiens
QVPLVFWAA

SEQ ID NO: 670676 - protein, 9 aa, Homo Sapiens
YPAAFESRL

SEQ ID NO: 670677 - protein, 9 aa, Homo Sapiens
GDVIYICGL

SEQ ID NO: 670678 - protein, 9 aa, Homo Sapiens
IDRLYFVME

SEQ ID NO: 670679 - protein, 9 aa, Homo Sapiens
SENPLLSTS

SEQ ID NO: 670680 - protein, 9 aa, Homo Sapiens
DHIVRFWAK

SEQ ID NO: 670681 - protein, 9 aa, Homo Sapiens
RLSVKVAYS

SEQ ID NO: 670682 - protein, 9 aa, Homo Sapiens
RVGDRQLPG

SEQ ID NO: 670683 - protein, 9 aa, Homo Sapiens
LKRYSPLSI

SEQ ID NO: 670684 - protein, 9 aa, Homo Sapiens
ELHGLVLQD

SEQ ID NO: 670685 - protein, 9 aa, Homo Sapiens
RKDHKFEEL

SEQ ID NO: 670686 - protein, 9 aa, Homo Sapiens
SMTGCILHM

SEQ ID NO: 670687 - protein, 9 aa, Homo Sapiens
TVPRAGLAP

SEQ ID NO: 670688 - protein, 9 aa, Homo Sapiens
RHQRTQTGE

SEQ ID NO: 670689 - protein, 9 aa, Homo Sapiens
TGCILHMYF

SEQ ID NO: 670690 - protein, 9 aa, Homo Sapiens
ARLSRDVTF

SEQ ID NO: 670691 - protein, 9 aa, Homo Sapiens
AAPLCLWLL

SEQ ID NO: 670692 - protein, 9 aa, Homo Sapiens
NCGEKPYKC

SEQ ID NO: 670693 - protein, 9 aa, Homo Sapiens
KELHGLVLQ

SEQ ID NO: 670694 - protein, 9 aa, Homo Sapiens
RSEKHMLLK

SEQ ID NO: 670695 - protein, 9 aa, Homo Sapiens
RHTGVAEGG

SEQ ID NO: 670696 - protein, 9 aa, Homo Sapiens
HPVPLHQVI

SEQ ID NO: 670697 - protein, 9 aa, Homo Sapiens
FINPNMLTD

SEQ ID NO: 670698 - protein, 9 aa, Homo Sapiens
GNGLAAFLK

SEQ ID NO: 670699 - protein, 9 aa, Homo Sapiens
KERIEEKGY

SEQ ID NO: 670700 - protein, 9 aa, Homo Sapiens
RFVSDSTPQ

SEQ ID NO: 670701 - protein, 9 aa, Homo Sapiens
RLAQLVIQQ

SEQ ID NO: 670702 - protein, 9 aa, Homo Sapiens
KSKVTAFPG

SEQ ID NO: 670703 - protein, 9 aa, Homo Sapiens
PSPVSPREP

SEQ ID NO: 670704 - protein, 9 aa, Homo Sapiens
MHSDMPMGP

SEQ ID NO: 670705 - protein, 9 aa, Homo Sapiens
QTGEKPYVC

SEQ ID NO: 670706 - protein, 9 aa, Homo Sapiens
QPHNFLPLI

SEQ ID NO: 670707 - protein, 9 aa, Homo Sapiens
VLSPQKPPR

SEQ ID NO: 670708 - protein, 9 aa, Homo Sapiens
TTITPKMLP

SEQ ID NO: 670709 - protein, 9 aa, Homo Sapiens
FIGMKSRGM

SEQ ID NO: 670710 - protein, 9 aa, Homo Sapiens
VPKPEDEVA

SEQ ID NO: 670711 - protein, 9 aa, Homo Sapiens
PCWFPHGYP

SEQ ID NO: 670712 - protein, 9 aa, Homo Sapiens
EAQRDREAA

SEQ ID NO: 670713 - protein, 9 aa, Homo Sapiens
RRQTVRGFG

SEQ ID NO: 670714 - protein, 9 aa, Homo Sapiens
VQTADLTKV

SEQ ID NO: 670715 - protein, 9 aa, Homo Sapiens
GTRAAFCYQ

SEQ ID NO: 670716 - protein, 9 aa, Homo Sapiens
HLAEGISEK

SEQ ID NO: 670717 - protein, 9 aa, Homo Sapiens
EYYRLYNTM

SEQ ID NO: 670718 - protein, 9 aa, Homo Sapiens
QIVTAGRGD

SEQ ID NO: 670719 - protein, 9 aa, Homo Sapiens
QCESSSGYR

SEQ ID NO: 670720 - protein, 9 aa, Homo Sapiens
RYEEPVLHF

SEQ ID NO: 670721 - protein, 9 aa, Homo Sapiens
VLPLVPILQ

SEQ ID NO: 670722 - protein, 9 aa, Homo Sapiens
RYTKDYEQQ

SEQ ID NO: 670723 - protein, 9 aa, Homo Sapiens
RQLGICYTN

SEQ ID NO: 670724 - protein, 9 aa, Homo Sapiens
RKYLTSEAE

SEQ ID NO: 670725 - protein, 9 aa, Homo Sapiens
YSLRKKDVT

SEQ ID NO: 670726 - protein, 9 aa, Homo Sapiens
LAATAHYNL

SEQ ID NO: 670727 - protein, 9 aa, Homo Sapiens
QDLQGLAQA

SEQ ID NO: 670728 - protein, 9 aa, Homo Sapiens
YRTDLIDMN

SEQ ID NO: 670729 - protein, 9 aa, Homo Sapiens
VFWAACTCL

SEQ ID NO: 670730 - protein, 9 aa, Homo Sapiens
RPAQLHVLS

SEQ ID NO: 670731 - protein, 9 aa, Homo Sapiens
AQRVLIKAL

SEQ ID NO: 670732 - protein, 9 aa, Homo Sapiens
ILLLWLSVT

SEQ ID NO: 670733 - protein, 9 aa, Homo Sapiens
FQGRTGPRV

SEQ ID NO: 670734 - protein, 9 aa, Homo Sapiens
HMKVHESSL

SEQ ID NO: 670735 - protein, 9 aa, Homo Sapiens
EAKGLIRTL

SEQ ID NO: 670736 - protein, 9 aa, Homo Sapiens
SMVRIPRRA

SEQ ID NO: 670737 - protein, 9 aa, Homo Sapiens
CSDTRICKL

SEQ ID NO: 670738 - protein, 9 aa, Homo Sapiens
LTKDRKESL

SEQ ID NO: 670739 - protein, 9 aa, Homo Sapiens
ANGSLSAKS

SEQ ID NO: 670740 - protein, 9 aa, Homo Sapiens
VLLLLTLLL

SEQ ID NO: 670741 - protein, 9 aa, Homo Sapiens
KALADPNKD

SEQ ID NO: 670742 - protein, 9 aa, Homo Sapiens
TGREAVQGH

SEQ ID NO: 670743 - protein, 9 aa, Homo Sapiens
RESSPCCRV

SEQ ID NO: 670744 - protein, 9 aa, Homo Sapiens
VLCALGGLS

SEQ ID NO: 670745 - protein, 9 aa, Homo Sapiens
SSSLKLIHS

SEQ ID NO: 670746 - protein, 9 aa, Homo Sapiens
PELGILSPS

SEQ ID NO: 670747 - protein, 9 aa, Homo Sapiens
ASPTGGSGG

SEQ ID NO: 670748 - protein, 9 aa, Homo Sapiens
WLNVDFRKG

SEQ ID NO: 670749 - protein, 9 aa, Homo Sapiens
YIFGGRDPI

SEQ ID NO: 670750 - protein, 9 aa, Homo Sapiens
AVTMGMAVA

SEQ ID NO: 670751 - protein, 9 aa, Homo Sapiens
TMDDLLLYI

SEQ ID NO: 670752 - protein, 9 aa, Homo Sapiens
KPVCHLVQE

SEQ ID NO: 670753 - protein, 9 aa, Homo Sapiens
RRLKNSVPK

SEQ ID NO: 670754 - protein, 9 aa, Homo Sapiens
ALALDLLRR

SEQ ID NO: 670755 - protein, 9 aa, Homo Sapiens
PRSAGLDLR

SEQ ID NO: 670756 - protein, 9 aa, Homo Sapiens
GLLTEAASS

SEQ ID NO: 670757 - protein, 9 aa, Homo Sapiens
CVYQSLCPT

SEQ ID NO: 670758 - protein, 9 aa, Homo Sapiens
EKALADPNK

SEQ ID NO: 670759 - protein, 9 aa, Homo Sapiens
QLGLLTEAA

SEQ ID NO: 670760 - protein, 9 aa, Homo Sapiens
VTEEESSKQ

SEQ ID NO: 670761 - protein, 9 aa, Homo Sapiens
AFTNLSALR

SEQ ID NO: 670762 - protein, 9 aa, Homo Sapiens
SNGCCSIVG

SEQ ID NO: 670763 - protein, 9 aa, Homo Sapiens
GGEAKCVFW

SEQ ID NO: 670764 - protein, 9 aa, Homo Sapiens
RTGPRVGDR

SEQ ID NO: 670765 - protein, 9 aa, Homo Sapiens
SVCEWYQCV

SEQ ID NO: 670766 - protein, 9 aa, Homo Sapiens
ALQLSVLAR

SEQ ID NO: 670767 - protein, 9 aa, Homo Sapiens
PATYSLFWD

SEQ ID NO: 670768 - protein, 9 aa, Homo Sapiens
MPPYYRYLC

SEQ ID NO: 670769 - protein, 9 aa, Homo Sapiens
AITAHCSLQ

SEQ ID NO: 670770 - protein, 9 aa, Homo Sapiens
ADLRKCILY

SEQ ID NO: 670771 - protein, 9 aa, Homo Sapiens
YSPLSIFHN

SEQ ID NO: 670772 - protein, 9 aa, Homo Sapiens
YMDHNELRG

SEQ ID NO: 670773 - protein, 9 aa, Homo Sapiens
GIRQHRGNG

SEQ ID NO: 670774 - protein, 9 aa, Homo Sapiens
ELTAKGTPC

SEQ ID NO: 670775 - protein, 9 aa, Homo Sapiens
AAFKAQNNG

SEQ ID NO: 670776 - protein, 9 aa, Homo Sapiens
STHLTQHRK

SEQ ID NO: 670777 - protein, 9 aa, Homo Sapiens
LSERPELAN

SEQ ID NO: 670778 - protein, 9 aa, Homo Sapiens
SAHGGSAAE

SEQ ID NO: 670779 - protein, 9 aa, Homo Sapiens
LSLLVDIAT

SEQ ID NO: 670780 - protein, 9 aa, Homo Sapiens
LLARPAKLH

SEQ ID NO: 670781 - protein, 9 aa, Homo Sapiens
FGTSRQARC

SEQ ID NO: 670782 - protein, 9 aa, Homo Sapiens
YFLFLLAPQ

SEQ ID NO: 670783 - protein, 9 aa, Homo Sapiens
PSGSEYLSS

SEQ ID NO: 670784 - protein, 9 aa, Homo Sapiens
NHSQYEKQL

SEQ ID NO: 670785 - protein, 9 aa, Homo Sapiens
GSEEPTVTC

SEQ ID NO: 670786 - protein, 9 aa, Homo Sapiens
LYNTMDDLL

SEQ ID NO: 670787 - protein, 9 aa, Homo Sapiens
TYVPTSWLL

SEQ ID NO: 670788 - protein, 9 aa, Homo Sapiens
KNRLVQTAD

SEQ ID NO: 670789 - protein, 9 aa, Homo Sapiens
LVHKLRQAG

SEQ ID NO: 670790 - protein, 9 aa, Homo Sapiens
LADPNKDEE

SEQ ID NO: 670791 - protein, 9 aa, Homo Sapiens
VIPPCFDEY

SEQ ID NO: 670792 - protein, 9 aa, Homo Sapiens
SYPAAFESR

SEQ ID NO: 670793 - protein, 9 aa, Homo Sapiens
KASGPNLGP

SEQ ID NO: 670794 - protein, 9 aa, Homo Sapiens
NLTYSATHP

SEQ ID NO: 670795 - protein, 9 aa, Homo Sapiens
LLAFYLCFL

SEQ ID NO: 670796 - protein, 9 aa, Homo Sapiens
FLHATIKIL

SEQ ID NO: 670797 - protein, 9 aa, Homo Sapiens
EVSRPFYLE

SEQ ID NO: 670798 - protein, 9 aa, Homo Sapiens
AFKAQNNGS

SEQ ID NO: 670799 - protein, 9 aa, Homo Sapiens
EAESVRSPT

SEQ ID NO: 670800 - protein, 9 aa, Homo Sapiens
KVHESSLQG

SEQ ID NO: 670801 - protein, 9 aa, Homo Sapiens
MLTDLPGPL

SEQ ID NO: 670802 - protein, 9 aa, Homo Sapiens
TRPTRPKTS

SEQ ID NO: 670803 - protein, 9 aa, Homo Sapiens
VKGDRRAPG

SEQ ID NO: 670804 - protein, 9 aa, Homo Sapiens
DDELGQCCQ

SEQ ID NO: 670805 - protein, 9 aa, Homo Sapiens
SEFLSVQLG

SEQ ID NO: 670806 - protein, 9 aa, Homo Sapiens
AKKSTVLHT

SEQ ID NO: 670807 - protein, 9 aa, Homo Sapiens
LIPYRCDLL

SEQ ID NO: 670808 - protein, 9 aa, Homo Sapiens
EGRHKAFSN

SEQ ID NO: 670809 - protein, 9 aa, Homo Sapiens
EVYAAPWNT

SEQ ID NO: 670810 - protein, 9 aa, Homo Sapiens
KREGKYIWS

SEQ ID NO: 670811 - protein, 9 aa, Homo Sapiens
FACTNCLII

SEQ ID NO: 670812 - protein, 9 aa, Homo Sapiens
PSGGEAKCV

SEQ ID NO: 670813 - protein, 9 aa, Homo Sapiens
VTILADRYE

SEQ ID NO: 670814 - protein, 9 aa, Homo Sapiens
SCEANNGLW

SEQ ID NO: 670815 - protein, 9 aa, Homo Sapiens
TLLDPLNML

SEQ ID NO: 670816 - protein, 9 aa, Homo Sapiens
MTGCILHMY

SEQ ID NO: 670817 - protein, 9 aa, Homo Sapiens
LERSQQNVA

SEQ ID NO: 670818 - protein, 9 aa, Homo Sapiens
WPAESETWK

SEQ ID NO: 670819 - protein, 9 aa, Homo Sapiens
QAQIRRLKN

SEQ ID NO: 670820 - protein, 9 aa, Homo Sapiens
TLVHSLLPP

SEQ ID NO: 670821 - protein, 9 aa, Homo Sapiens
LICIDSLNG

SEQ ID NO: 670822 - protein, 9 aa, Homo Sapiens
LLNEEDILS

SEQ ID NO: 670823 - protein, 9 aa, Homo Sapiens
TPAADSLQR

SEQ ID NO: 670824 - protein, 9 aa, Homo Sapiens
YRLYNTMDD

SEQ ID NO: 670825 - protein, 9 aa, Homo Sapiens
SSDSATSDP

SEQ ID NO: 670826 - protein, 9 aa, Homo Sapiens
DEARSPFLS

SEQ ID NO: 670827 - protein, 9 aa, Homo Sapiens
TFTWNTLSA

SEQ ID NO: 670828 - protein, 9 aa, Homo Sapiens
GLSLLLGLA

SEQ ID NO: 670829 - protein, 9 aa, Homo Sapiens
NARTSKPTT

SEQ ID NO: 670830 - protein, 9 aa, Homo Sapiens
SDLGLQCSA

SEQ ID NO: 670831 - protein, 9 aa, Homo Sapiens
SNCTYAQTP

SEQ ID NO: 670832 - protein, 9 aa, Homo Sapiens
APLLITSMT

SEQ ID NO: 670833 - protein, 9 aa, Homo Sapiens
FTGRTCKGC

SEQ ID NO: 670834 - protein, 9 aa, Homo Sapiens
VFQHRKVEI

SEQ ID NO: 670835 - protein, 9 aa, Homo Sapiens
ASAGGFWGP

SEQ ID NO: 670836 - protein, 9 aa, Homo Sapiens
AWEDLQGLT

SEQ ID NO: 670837 - protein, 9 aa, Homo Sapiens
EAARQLGIC

SEQ ID NO: 670838 - protein, 9 aa, Homo Sapiens
GYYNFDSGQ

SEQ ID NO: 670839 - protein, 9 aa, Homo Sapiens
ACTCARKPT

SEQ ID NO: 670840 - protein, 9 aa, Homo Sapiens
NPLLSTSLR

SEQ ID NO: 670841 - protein, 9 aa, Homo Sapiens
QMVYNAGPV

SEQ ID NO: 670842 - protein, 9 aa, Homo Sapiens
TGRTCKGCV

SEQ ID NO: 670843 - protein, 9 aa, Homo Sapiens
VPLVFWAAC

SEQ ID NO: 670844 - protein, 9 aa, Homo Sapiens
TRTAHGESA

SEQ ID NO: 670845 - protein, 9 aa, Homo Sapiens
QEITDNLTF

SEQ ID NO: 670846 - protein, 9 aa, Homo Sapiens
VRGFGLSIK

SEQ ID NO: 670847 - protein, 9 aa, Homo Sapiens
YQINWTTGT

SEQ ID NO: 670848 - protein, 9 aa, Homo Sapiens
GLSENPLLS

SEQ ID NO: 670849 - protein, 9 aa, Homo Sapiens
SYVSMVPSN

SEQ ID NO: 670850 - protein, 9 aa, Homo Sapiens
FWAACTCLK

SEQ ID NO: 670851 - protein, 9 aa, Homo Sapiens
PASPCSHNA

SEQ ID NO: 670852 - protein, 9 aa, Homo Sapiens
NPTFRVYSQ

SEQ ID NO: 670853 - protein, 9 aa, Homo Sapiens
GLHDGGPRL

SEQ ID NO: 670854 - protein, 9 aa, Homo Sapiens
ERETVIPPC

SEQ ID NO: 670855 - protein, 9 aa, Homo Sapiens
DHGDSDLGL

SEQ ID NO: 670856 - protein, 9 aa, Homo Sapiens
LTYDFTNSD

SEQ ID NO: 670857 - protein, 9 aa, Homo Sapiens
PGTRAAFCY

SEQ ID NO: 670858 - protein, 9 aa, Homo Sapiens
LNFQMGLLV

SEQ ID NO: 670859 - protein, 9 aa, Homo Sapiens
AGGPPPAAS

SEQ ID NO: 670860 - protein, 9 aa, Homo Sapiens
RLRHLAEGI

SEQ ID NO: 670861 - protein, 9 aa, Homo Sapiens
NHGLSENPL

SEQ ID NO: 670862 - protein, 9 aa, Homo Sapiens
LFQSDPRGV

SEQ ID NO: 670863 - protein, 9 aa, Homo Sapiens
QSAEIYRNH

SEQ ID NO: 670864 - protein, 9 aa, Homo Sapiens
TSSPSPVSP

SEQ ID NO: 670865 - protein, 9 aa, Homo Sapiens
SLQLPGSSN

SEQ ID NO: 670866 - protein, 9 aa, Homo Sapiens
VAVMVGEKI

SEQ ID NO: 670867 - protein, 9 aa, Homo Sapiens
AALAAFKAQ

SEQ ID NO: 670868 - protein, 9 aa, Homo Sapiens
SDPSTSVPA

SEQ ID NO: 670869 - protein, 9 aa, Homo Sapiens
PAVTMGMAV

SEQ ID NO: 670870 - protein, 9 aa, Homo Sapiens
HYQLNFQMG

SEQ ID NO: 670871 - protein, 9 aa, Homo Sapiens
SDFVLLGLS

SEQ ID NO: 670872 - protein, 9 aa, Homo Sapiens
LWLLEFLRT

SEQ ID NO: 670873 - protein, 9 aa, Homo Sapiens
SDCQPCPCH

SEQ ID NO: 670874 - protein, 9 aa, Homo Sapiens
PFYLEAICL

SEQ ID NO: 670875 - protein, 9 aa, Homo Sapiens
ALERSQQNV

SEQ ID NO: 670876 - protein, 9 aa, Homo Sapiens
HSQYEKQLK

SEQ ID NO: 670877 - protein, 9 aa, Homo Sapiens
MYETPAGTI

SEQ ID NO: 670878 - protein, 9 aa, Homo Sapiens
IAGKSGTST

SEQ ID NO: 670879 - protein, 9 aa, Homo Sapiens
DLQGLTKDR

SEQ ID NO: 670880 - protein, 9 aa, Homo Sapiens
ASRRREHLL

SEQ ID NO: 670881 - protein, 9 aa, Homo Sapiens
VQLNDEALK

SEQ ID NO: 670882 - protein, 9 aa, Homo Sapiens
VCISFDAGM

SEQ ID NO: 670883 - protein, 9 aa, Homo Sapiens
SRESSPCCR

SEQ ID NO: 670884 - protein, 9 aa, Homo Sapiens
LLLLTLLLI

SEQ ID NO: 670885 - protein, 9 aa, Homo Sapiens
PTKVVTTPD

SEQ ID NO: 670886 - protein, 9 aa, Homo Sapiens
SPGTRWGDL

SEQ ID NO: 670887 - protein, 9 aa, Homo Sapiens
SLLVDIATD

SEQ ID NO: 670888 - protein, 9 aa, Homo Sapiens
RRAAARFLA

SEQ ID NO: 670889 - protein, 9 aa, Homo Sapiens
KRSDCVDQF

SEQ ID NO: 670890 - protein, 9 aa, Homo Sapiens
KSHSSSAES

SEQ ID NO: 670891 - protein, 9 aa, Homo Sapiens
SPSPVSPRE

SEQ ID NO: 670892 - protein, 9 aa, Homo Sapiens
IVRPVQLLV

SEQ ID NO: 670893 - protein, 9 aa, Homo Sapiens
LEAETPACE

SEQ ID NO: 670894 - protein, 9 aa, Homo Sapiens
LERHPTHRL

SEQ ID NO: 670895 - protein, 9 aa, Homo Sapiens
ILYQLSQKT

SEQ ID NO: 670896 - protein, 9 aa, Homo Sapiens
GRESLDTVS

SEQ ID NO: 670897 - protein, 9 aa, Homo Sapiens
DRYEEPVLH

SEQ ID NO: 670898 - protein, 9 aa, Homo Sapiens
TVVIYLNAT

SEQ ID NO: 670899 - protein, 9 aa, Homo Sapiens
TKAMKKFQA

SEQ ID NO: 670900 - protein, 9 aa, Homo Sapiens
LFLLAPQAY

SEQ ID NO: 670901 - protein, 9 aa, Homo Sapiens
LSVKVAYSF

SEQ ID NO: 670902 - protein, 9 aa, Homo Sapiens
RYWLNVDFR

SEQ ID NO: 670903 - protein, 9 aa, Homo Sapiens
EVTHNIREE

SEQ ID NO: 670904 - protein, 9 aa, Homo Sapiens
NETLSQEVV

SEQ ID NO: 670905 - protein, 9 aa, Homo Sapiens
TNPEYGYLA

SEQ ID NO: 670906 - protein, 9 aa, Homo Sapiens
NMMDQCYFE

SEQ ID NO: 670907 - protein, 9 aa, Homo Sapiens
LSFVNFCYS

SEQ ID NO: 670908 - protein, 9 aa, Homo Sapiens
APAGLSAAP

SEQ ID NO: 670909 - protein, 9 aa, Homo Sapiens
ILHFPQNQR

SEQ ID NO: 670910 - protein, 9 aa, Homo Sapiens
HFWDPHNFK

SEQ ID NO: 670911 - protein, 9 aa, Homo Sapiens
DVQGKGLMI

SEQ ID NO: 670912 - protein, 9 aa, Homo Sapiens
DFHRAFTNM

SEQ ID NO: 670913 - protein, 9 aa, Homo Sapiens
RDLGVNGQV

SEQ ID NO: 670914 - protein, 9 aa, Homo Sapiens
TVLGIASKN

SEQ ID NO: 670915 - protein, 9 aa, Homo Sapiens
TGSPTPLSW

SEQ ID NO: 670916 - protein, 9 aa, Homo Sapiens
TGKKIIGTW

SEQ ID NO: 670917 - protein, 9 aa, Homo Sapiens
FKSLPVGYN

SEQ ID NO: 670918 - protein, 9 aa, Homo Sapiens
ERLSRLPVG

SEQ ID NO: 670919 - protein, 9 aa, Homo Sapiens
NAILALQRR

SEQ ID NO: 670920 - protein, 9 aa, Homo Sapiens
PSSSAPPQT

SEQ ID NO: 670921 - protein, 9 aa, Homo Sapiens
KSLPVGYNI

SEQ ID NO: 670922 - protein, 9 aa, Homo Sapiens
PTLDDSSEK

SEQ ID NO: 670923 - protein, 9 aa, Homo Sapiens
PGQLHSSLP

SEQ ID NO: 670924 - protein, 9 aa, Homo Sapiens
SPISEQPAA

SEQ ID NO: 670925 - protein, 9 aa, Homo Sapiens
PHNFKSVTL

SEQ ID NO: 670926 - protein, 9 aa, Homo Sapiens
RPQPELPVH

SEQ ID NO: 670927 - protein, 9 aa, Homo Sapiens
STKKTRRRG

SEQ ID NO: 670928 - protein, 9 aa, Homo Sapiens
PSGSEPWLC

SEQ ID NO: 670929 - protein, 9 aa, Homo Sapiens
KSVEIEKVA

SEQ ID NO: 670930 - protein, 9 aa, Homo Sapiens
SVPAWGSQW

SEQ ID NO: 670931 - protein, 9 aa, Homo Sapiens
PSELGKTDA

SEQ ID NO: 670932 - protein, 9 aa, Homo Sapiens
AIEQTSLTM

SEQ ID NO: 670933 - protein, 9 aa, Homo Sapiens
LERREPECE

SEQ ID NO: 670934 - protein, 9 aa, Homo Sapiens
LLGKPLLRW

SEQ ID NO: 670935 - protein, 9 aa, Homo Sapiens
IIGTWKDAR

SEQ ID NO: 670936 - protein, 9 aa, Homo Sapiens
VLGIASKNE

SEQ ID NO: 670937 - protein, 8 aa, Homo Sapiens
IWRSRAGA

SEQ ID NO: 670938 - protein, 9 aa, Homo Sapiens
DPAQRIASD

SEQ ID NO: 670939 - protein, 9 aa, Homo Sapiens
KSHCLKNEV

SEQ ID NO: 670940 - protein, 9 aa, Homo Sapiens
LRSSFLNAK

SEQ ID NO: 670941 - protein, 9 aa, Homo Sapiens
WGSGGKGNS

SEQ ID NO: 670942 - protein, 9 aa, Homo Sapiens
PPSSSAPPQ

SEQ ID NO: 670943 - protein, 9 aa, Homo Sapiens
TSNCEKEGF

SEQ ID NO: 670944 - protein, 9 aa, Homo Sapiens
WVYPNITNP

SEQ ID NO: 670945 - protein, 9 aa, Homo Sapiens
TSNVVRMHV

SEQ ID NO: 670946 - protein, 9 aa, Homo Sapiens
GVHVHKDAL

SEQ ID NO: 670947 - protein, 9 aa, Homo Sapiens
ERREPECEH

SEQ ID NO: 670948 - protein, 9 aa, Homo Sapiens
STFCFMVSR

SEQ ID NO: 670949 - protein, 9 aa, Homo Sapiens
GLLMAVQQD

SEQ ID NO: 670950 - protein, 9 aa, Homo Sapiens
EIKELKETF

SEQ ID NO: 670951 - protein, 9 aa, Homo Sapiens
EKRMATEKT

SEQ ID NO: 670952 - protein, 9 aa, Homo Sapiens
LWRTPQPGS

SEQ ID NO: 670953 - protein, 9 aa, Homo Sapiens
TNREAFQGC

SEQ ID NO: 670954 - protein, 9 aa, Homo Sapiens
SPAFRKLSL

SEQ ID NO: 670955 - protein, 9 aa, Homo Sapiens
RFYVQALPR

SEQ ID NO: 670956 - protein, 9 aa, Homo Sapiens
VWVLTGDTM

SEQ ID NO: 670957 - protein, 9 aa, Homo Sapiens
EVIAPSGSE

SEQ ID NO: 670958 - protein, 9 aa, Homo Sapiens
KAEDNCKVE

SEQ ID NO: 670959 - protein, 9 aa, Homo Sapiens
CFKMSKVAE

SEQ ID NO: 670960 - protein, 9 aa, Homo Sapiens
KRVLRSSFL

SEQ ID NO: 670961 - protein, 9 aa, Homo Sapiens
TVVPASPEL

SEQ ID NO: 670962 - protein, 9 aa, Homo Sapiens
DFKNSLPDA

SEQ ID NO: 670963 - protein, 9 aa, Homo Sapiens
YPWVNDDGL

SEQ ID NO: 670964 - protein, 9 aa, Homo Sapiens
HPAYRDGIR

SEQ ID NO: 670965 - protein, 9 aa, Homo Sapiens
DDFAHEELG

SEQ ID NO: 670966 - protein, 9 aa, Homo Sapiens
PFFSWKTQI

SEQ ID NO: 670967 - protein, 9 aa, Homo Sapiens
GMYFEHYRS

SEQ ID NO: 670968 - protein, 9 aa, Homo Sapiens
IGTWKDARI

SEQ ID NO: 670969 - protein, 9 aa, Homo Sapiens
QAAAYGRCV

SEQ ID NO: 670970 - protein, 9 aa, Homo Sapiens
QGILSTTVL

SEQ ID NO: 670971 - protein, 9 aa, Homo Sapiens
HFPQNQRLL

SEQ ID NO: 670972 - protein, 9 aa, Homo Sapiens
RSPQERLSR

SEQ ID NO: 670973 - protein, 9 aa, Homo Sapiens
EQPAAGQLR

SEQ ID NO: 670974 - protein, 9 aa, Homo Sapiens
EQSPIERKK

SEQ ID NO: 670975 - protein, 9 aa, Homo Sapiens
LGPPVMEKQ

SEQ ID NO: 670976 - protein, 9 aa, Homo Sapiens
ARKSQWNKW

SEQ ID NO: 670977 - protein, 9 aa, Homo Sapiens
MALYTTKHA

SEQ ID NO: 670978 - protein, 9 aa, Homo Sapiens
LEETETQLR

SEQ ID NO: 670979 - protein, 9 aa, Homo Sapiens
RFYSQPQQA

SEQ ID NO: 670980 - protein, 9 aa, Homo Sapiens
FGPVIDCDV

SEQ ID NO: 670981 - protein, 9 aa, Homo Sapiens
RVEKFGHGS

SEQ ID NO: 670982 - protein, 9 aa, Homo Sapiens
DGGGVGQGK

SEQ ID NO: 670983 - protein, 9 aa, Homo Sapiens
VRSAFTTSN

SEQ ID NO: 670984 - protein, 9 aa, Homo Sapiens
NPTAATDMG

SEQ ID NO: 670985 - protein, 9 aa, Homo Sapiens
VIQAKDMCG

SEQ ID NO: 670986 - protein, 9 aa, Homo Sapiens
DFQKFQTQN

SEQ ID NO: 670987 - protein, 9 aa, Homo Sapiens
ACVLGKDCR

SEQ ID NO: 670988 - protein, 9 aa, Homo Sapiens
RALVNMMVG

SEQ ID NO: 670989 - protein, 9 aa, Homo Sapiens
EQLHRIFKQ

SEQ ID NO: 670990 - protein, 9 aa, Homo Sapiens
APGMYFEHY

SEQ ID NO: 670991 - protein, 9 aa, Homo Sapiens
LQGILSTTV

SEQ ID NO: 670992 - protein, 9 aa, Homo Sapiens
DSTTLEIKK

SEQ ID NO: 670993 - protein, 9 aa, Homo Sapiens
RKAHKPWAK

SEQ ID NO: 670994 - protein, 9 aa, Homo Sapiens
ETSHKISPT

SEQ ID NO: 670995 - protein, 9 aa, Homo Sapiens
PLQAPGMYF

SEQ ID NO: 670996 - protein, 9 aa, Homo Sapiens
PIIVSIKEG

SEQ ID NO: 670997 - protein, 9 aa, Homo Sapiens
ALRSNRLLI

SEQ ID NO: 670998 - protein, 9 aa, Homo Sapiens
ICFYININK

SEQ ID NO: 670999 - protein, 9 aa, Homo Sapiens
VGAMLEKRW

SEQ ID NO: 671000 - protein, 9 aa, Homo Sapiens
PACCTASCF

SEQ ID NO: 671001 - protein, 9 aa, Homo Sapiens
AKKTSCFKT

SEQ ID NO: 671002 - protein, 9 aa, Homo Sapiens
GQRLLRVLQ

SEQ ID NO: 671003 - protein, 9 aa, Homo Sapiens
SWNRSLLNK

SEQ ID NO: 671004 - protein, 9 aa, Homo Sapiens
VIRFIPKKE

SEQ ID NO: 671005 - protein, 9 aa, Homo Sapiens
TVAALQVLG

SEQ ID NO: 671006 - protein, 9 aa, Homo Sapiens
LVKRHSALW

SEQ ID NO: 671007 - protein, 9 aa, Homo Sapiens
HLELKPLAI

SEQ ID NO: 671008 - protein, 9 aa, Homo Sapiens
LQDDEVDDE

SEQ ID NO: 671009 - protein, 9 aa, Homo Sapiens
TTLEIKKDE

SEQ ID NO: 671010 - protein, 9 aa, Homo Sapiens
RGCKAGPLA

SEQ ID NO: 671011 - protein, 9 aa, Homo Sapiens
LSNRPSFNG

SEQ ID NO: 671012 - protein, 9 aa, Homo Sapiens
RRALRSNRL

SEQ ID NO: 671013 - protein, 9 aa, Homo Sapiens
QFTFTPSEL

SEQ ID NO: 671014 - protein, 9 aa, Homo Sapiens
HGGGNPTAA

SEQ ID NO: 671015 - protein, 9 aa, Homo Sapiens
DSWNRSLLN

SEQ ID NO: 671016 - protein, 9 aa, Homo Sapiens
SQPQQAREK

SEQ ID NO: 671017 - protein, 9 aa, Homo Sapiens
IIVSIKEGG

SEQ ID NO: 671018 - protein, 9 aa, Homo Sapiens
STVLPWSAS

SEQ ID NO: 671019 - protein, 9 aa, Homo Sapiens
ECATPSNKQ

SEQ ID NO: 671020 - protein, 9 aa, Homo Sapiens
VLTGDTMET

SEQ ID NO: 671021 - protein, 9 aa, Homo Sapiens
DFAHEELGD

SEQ ID NO: 671022 - protein, 9 aa, Homo Sapiens
HSYPWGTKS

SEQ ID NO: 671023 - protein, 9 aa, Homo Sapiens
VDKQLLSAL

SEQ ID NO: 671024 - protein, 9 aa, Homo Sapiens
FRVTRAAIL

SEQ ID NO: 671025 - protein, 9 aa, Homo Sapiens
INKEENSAF

SEQ ID NO: 671026 - protein, 9 aa, Homo Sapiens
VFERAKKAS

SEQ ID NO: 671027 - protein, 9 aa, Homo Sapiens
SKMPEAKEN

SEQ ID NO: 671028 - protein, 9 aa, Homo Sapiens
PLADALLSG

SEQ ID NO: 671029 - protein, 9 aa, Homo Sapiens
LQWEQAAQI

SEQ ID NO: 671030 - protein, 9 aa, Homo Sapiens
APTILLWGA

SEQ ID NO: 671031 - protein, 9 aa, Homo Sapiens
LRVLQTPGH

SEQ ID NO: 671032 - protein, 9 aa, Homo Sapiens
AEDVEEINH

SEQ ID NO: 671033 - protein, 9 aa, Homo Sapiens
VHKDALTVT

SEQ ID NO: 671034 - protein, 9 aa, Homo Sapiens
IGFLNHKMP

SEQ ID NO: 671035 - protein, 9 aa, Homo Sapiens
GRRGHEPWR

SEQ ID NO: 671036 - protein, 9 aa, Homo Sapiens
LVSVLDTTF

SEQ ID NO: 671037 - protein, 9 aa, Homo Sapiens
GGMEAQVGE

SEQ ID NO: 671038 - protein, 9 aa, Homo Sapiens
YLVCPQDTF

SEQ ID NO: 671039 - protein, 9 aa, Homo Sapiens
EIEKVAQLK

SEQ ID NO: 671040 - protein, 9 aa, Homo Sapiens
GHKKRVLRS

SEQ ID NO: 671041 - protein, 9 aa, Homo Sapiens
KTIQMVSFR

SEQ ID NO: 671042 - protein, 9 aa, Homo Sapiens
QDQVNRRPS

SEQ ID NO: 671043 - protein, 9 aa, Homo Sapiens
PAYQVFGSV

SEQ ID NO: 671044 - protein, 9 aa, Homo Sapiens
PVPPPPPLS

SEQ ID NO: 671045 - protein, 9 aa, Homo Sapiens
TGGMEAQVG

SEQ ID NO: 671046 - protein, 9 aa, Homo Sapiens
RRWQEQIQA

SEQ ID NO: 671047 - protein, 9 aa, Homo Sapiens
EGDDDPVPV

SEQ ID NO: 671048 - protein, 9 aa, Homo Sapiens
LLMAVQQDL

SEQ ID NO: 671049 - protein, 9 aa, Homo Sapiens
RWQEQIQAM

SEQ ID NO: 671050 - protein, 9 aa, Homo Sapiens
YIFHHRLPP

SEQ ID NO: 671051 - protein, 9 aa, Homo Sapiens
LFLQDDEVD

SEQ ID NO: 671052 - protein, 9 aa, Homo Sapiens
CSIQSSATL

SEQ ID NO: 671053 - protein, 9 aa, Homo Sapiens
QQRQQPLNV

SEQ ID NO: 671054 - protein, 9 aa, Homo Sapiens
TFSLTLNTH

SEQ ID NO: 671055 - protein, 9 aa, Homo Sapiens
SRGCKAGPL

SEQ ID NO: 671056 - protein, 9 aa, Homo Sapiens
WSASAPGAP

SEQ ID NO: 671057 - protein, 9 aa, Homo Sapiens
NGIIIRYEV

SEQ ID NO: 671058 - protein, 9 aa, Homo Sapiens
EDAVDFGIS

SEQ ID NO: 671059 - protein, 9 aa, Homo Sapiens
GPTQVPLSS

SEQ ID NO: 671060 - protein, 9 aa, Homo Sapiens
MLMLKEYWQ

SEQ ID NO: 671061 - protein, 9 aa, Homo Sapiens
LKETFEEKT

SEQ ID NO: 671062 - protein, 9 aa, Homo Sapiens
PSNKQGMPV

SEQ ID NO: 671063 - protein, 9 aa, Homo Sapiens
GVGQFQAGS

SEQ ID NO: 671064 - protein, 9 aa, Homo Sapiens
TNDHMALLL

SEQ ID NO: 671065 - protein, 9 aa, Homo Sapiens
ELEQKVVLV

SEQ ID NO: 671066 - protein, 9 aa, Homo Sapiens
EGSVLDQGG

SEQ ID NO: 671067 - protein, 9 aa, Homo Sapiens
GQAVTAVLT

SEQ ID NO: 671068 - protein, 9 aa, Homo Sapiens
TILHFPQNQ

SEQ ID NO: 671069 - protein, 9 aa, Homo Sapiens
KLRRIKATF

SEQ ID NO: 671070 - protein, 9 aa, Homo Sapiens
FGVTLLFIL

SEQ ID NO: 671071 - protein, 9 aa, Homo Sapiens
PAWGSQWFW

SEQ ID NO: 671072 - protein, 9 aa, Homo Sapiens
KTQIDSPLN

SEQ ID NO: 671073 - protein, 9 aa, Homo Sapiens
ELSRPGCLW

SEQ ID NO: 671074 - protein, 9 aa, Homo Sapiens
LMKAEDNCK

SEQ ID NO: 671075 - protein, 9 aa, Homo Sapiens
IRYEVYMRR

SEQ ID NO: 671076 - protein, 9 aa, Homo Sapiens
PLGPGKSPK

SEQ ID NO: 671077 - protein, 9 aa, Homo Sapiens
PLNEFCSSD

SEQ ID NO: 671078 - protein, 9 aa, Homo Sapiens
LINNPLVFL

SEQ ID NO: 671079 - protein, 9 aa, Homo Sapiens
MCFSRSDHL

SEQ ID NO: 671080 - protein, 9 aa, Homo Sapiens
ELVEQTLSY

SEQ ID NO: 671081 - protein, 9 aa, Homo Sapiens
SLGPLSSSV

SEQ ID NO: 671082 - protein, 9 aa, Homo Sapiens
QKVVLVQQQ

SEQ ID NO: 671083 - protein, 9 aa, Homo Sapiens
AQGYVLFFK

SEQ ID NO: 671084 - protein, 9 aa, Homo Sapiens
GDVQGKGLM

SEQ ID NO: 671085 - protein, 9 aa, Homo Sapiens
DSDKRDDAS

SEQ ID NO: 671086 - protein, 9 aa, Homo Sapiens
GIGFLNHKM

SEQ ID NO: 671087 - protein, 9 aa, Homo Sapiens
MLEKRWKLC

SEQ ID NO: 671088 - protein, 9 aa, Homo Sapiens
TPLSEAKKT

SEQ ID NO: 671089 - protein, 9 aa, Homo Sapiens
RSRKWPFDR

SEQ ID NO: 671090 - protein, 9 aa, Homo Sapiens
REVIAPSGS

SEQ ID NO: 671091 - protein, 9 aa, Homo Sapiens
PCLSLGPLS

SEQ ID NO: 671092 - protein, 9 aa, Homo Sapiens
VFGVTLLFI

SEQ ID NO: 671093 - protein, 9 aa, Homo Sapiens
SPLQAPGMY

SEQ ID NO: 671094 - protein, 9 aa, Homo Sapiens
LHLLQWEQA

SEQ ID NO: 671095 - protein, 9 aa, Homo Sapiens
RGLLWVSTF

SEQ ID NO: 671096 - protein, 9 aa, Homo Sapiens
SFNGTPIPW

SEQ ID NO: 671097 - protein, 9 aa, Homo Sapiens
RCRSRSRSR

SEQ ID NO: 671098 - protein, 9 aa, Homo Sapiens
KWLLQGILS

SEQ ID NO: 671099 - protein, 9 aa, Homo Sapiens
FVCEKSKAD

SEQ ID NO: 671100 - protein, 9 aa, Homo Sapiens
PLIQQQNMM

SEQ ID NO: 671101 - protein, 9 aa, Homo Sapiens
CSSKSPDFG

SEQ ID NO: 671102 - protein, 9 aa, Homo Sapiens
TSLTMMQAV

SEQ ID NO: 671103 - protein, 9 aa, Homo Sapiens
QIRSKVFSI

SEQ ID NO: 671104 - protein, 9 aa, Homo Sapiens
AFTTSNVVR

SEQ ID NO: 671105 - protein, 9 aa, Homo Sapiens
LWGARYDKI

SEQ ID NO: 671106 - protein, 9 aa, Homo Sapiens
GERTVAALQ

SEQ ID NO: 671107 - protein, 9 aa, Homo Sapiens
AMLEKRWKL

SEQ ID NO: 671108 - protein, 9 aa, Homo Sapiens
SLLQLTCGD

SEQ ID NO: 671109 - protein, 9 aa, Homo Sapiens
KNISALMKT

SEQ ID NO: 671110 - protein, 9 aa, Homo Sapiens
FEIVGDVQG

SEQ ID NO: 671111 - protein, 9 aa, Homo Sapiens
PKYISSHNG

SEQ ID NO: 671112 - protein, 9 aa, Homo Sapiens
YVSVATMKA

SEQ ID NO: 671113 - protein, 9 aa, Homo Sapiens
AFLFGVDKQ

SEQ ID NO: 671114 - protein, 9 aa, Homo Sapiens
SNKQGMPVL

SEQ ID NO: 671115 - protein, 9 aa, Homo Sapiens
PCGNSTYLV

SEQ ID NO: 671116 - protein, 9 aa, Homo Sapiens
DRVLWRSRK

SEQ ID NO: 671117 - protein, 9 aa, Homo Sapiens
KPLNATYLE

SEQ ID NO: 671118 - protein, 9 aa, Homo Sapiens
GTASGPSSA

SEQ ID NO: 671119 - protein, 9 aa, Homo Sapiens
PNCQIRSKV

SEQ ID NO: 671120 - protein, 9 aa, Homo Sapiens
GAFYCVSTG

SEQ ID NO: 671121 - protein, 9 aa, Homo Sapiens
RLLRVLQTP

SEQ ID NO: 671122 - protein, 9 aa, Homo Sapiens
PFCEFAKTV

SEQ ID NO: 671123 - protein, 9 aa, Homo Sapiens
AGRSPQERL

SEQ ID NO: 671124 - protein, 9 aa, Homo Sapiens
ALGDWLAEA

SEQ ID NO: 671125 - protein, 9 aa, Homo Sapiens
SNMSAHLRE

SEQ ID NO: 671126 - protein, 9 aa, Homo Sapiens
RIASDDALN

SEQ ID NO: 671127 - protein, 9 aa, Homo Sapiens
RQQPLNVTV

SEQ ID NO: 671128 - protein, 9 aa, Homo Sapiens
LQKMIRSSV

SEQ ID NO: 671129 - protein, 9 aa, Homo Sapiens
GHTNDHMAL

SEQ ID NO: 671130 - protein, 9 aa, Homo Sapiens
RFIPKKEEE

SEQ ID NO: 671131 - protein, 9 aa, Homo Sapiens
QFQAIQRRL

SEQ ID NO: 671132 - protein, 9 aa, Homo Sapiens
PRPAYQVFG

SEQ ID NO: 671133 - protein, 9 aa, Homo Sapiens
GAQAAAYGR

SEQ ID NO: 671134 - protein, 9 aa, Homo Sapiens
DRTVGWILS

SEQ ID NO: 671135 - protein, 9 aa, Homo Sapiens
KMPPDIILQ

SEQ ID NO: 671136 - protein, 9 aa, Homo Sapiens
KNKIGEEQR

SEQ ID NO: 671137 - protein, 9 aa, Homo Sapiens
MSGDRFRSR

SEQ ID NO: 671138 - protein, 9 aa, Homo Sapiens
HRLVPSQLP

SEQ ID NO: 671139 - protein, 9 aa, Homo Sapiens
KMVSHLEKH

SEQ ID NO: 671140 - protein, 9 aa, Homo Sapiens
SIQSSATLR

SEQ ID NO: 671141 - protein, 9 aa, Homo Sapiens
EAGHFWDPH

SEQ ID NO: 671142 - protein, 9 aa, Homo Sapiens
FCEFAKTVS

SEQ ID NO: 671143 - protein, 9 aa, Homo Sapiens
VQFQAIQRR

SEQ ID NO: 671144 - protein, 9 aa, Homo Sapiens
RYEVYMRRL

SEQ ID NO: 671145 - protein, 9 aa, Homo Sapiens
GNGEAIRIR

SEQ ID NO: 671146 - protein, 9 aa, Homo Sapiens
TRPTPGAGQ

SEQ ID NO: 671147 - protein, 9 aa, Homo Sapiens
GGGGSGGKS

SEQ ID NO: 671148 - protein, 9 aa, Homo Sapiens
RLSRLPVGG

SEQ ID NO: 671149 - protein, 9 aa, Homo Sapiens
NTKNEEWSC

SEQ ID NO: 671150 - protein, 9 aa, Homo Sapiens
LLRWTNFDP

SEQ ID NO: 671151 - protein, 9 aa, Homo Sapiens
QGKDISTIT

SEQ ID NO: 671152 - protein, 9 aa, Homo Sapiens
PPYNLSPRT

SEQ ID NO: 671153 - protein, 9 aa, Homo Sapiens
RLLHPAYRD

SEQ ID NO: 671154 - protein, 9 aa, Homo Sapiens
VAIEQTSLT

SEQ ID NO: 671155 - protein, 9 aa, Homo Sapiens
DMCFSRSDH

SEQ ID NO: 671156 - protein, 9 aa, Homo Sapiens
VAALQVLGT

SEQ ID NO: 671157 - protein, 9 aa, Homo Sapiens
WFEQSPIER

SEQ ID NO: 671158 - protein, 9 aa, Homo Sapiens
SSNEIFKSL

SEQ ID NO: 671159 - protein, 9 aa, Homo Sapiens
PADVFERAK

SEQ ID NO: 671160 - protein, 9 aa, Homo Sapiens
AEDGFRKAH

SEQ ID NO: 671161 - protein, 9 aa, Homo Sapiens
LPRAVRCHS

SEQ ID NO: 671162 - protein, 9 aa, Homo Sapiens
GLLWVSTFC

SEQ ID NO: 671163 - protein, 9 aa, Homo Sapiens
SLMKAEDNC

SEQ ID NO: 671164 - protein, 9 aa, Homo Sapiens
NKWEVVAER

SEQ ID NO: 671165 - protein, 9 aa, Homo Sapiens
RMECATPSN

SEQ ID NO: 671166 - protein, 9 aa, Homo Sapiens
QTVIRENYL

SEQ ID NO: 671167 - protein, 9 aa, Homo Sapiens
LPSSGPRPR

SEQ ID NO: 671168 - protein, 9 aa, Homo Sapiens
EEINHAERE

SEQ ID NO: 671169 - protein, 9 aa, Homo Sapiens
ELKETFEEK

SEQ ID NO: 671170 - protein, 9 aa, Homo Sapiens
LNKYCVEYG

SEQ ID NO: 671171 - protein, 9 aa, Homo Sapiens
KENKQIIRK

SEQ ID NO: 671172 - protein, 9 aa, Homo Sapiens
LNGRLRMND

SEQ ID NO: 671173 - protein, 9 aa, Homo Sapiens
AFGPVIDCD

SEQ ID NO: 671174 - protein, 9 aa, Homo Sapiens
NMSAHLRET

SEQ ID NO: 671175 - protein, 9 aa, Homo Sapiens
QEFTGVGAM

SEQ ID NO: 671176 - protein, 9 aa, Homo Sapiens
PVADSIPDP

SEQ ID NO: 671177 - protein, 9 aa, Homo Sapiens
GAEKDSAFL

SEQ ID NO: 671178 - protein, 9 aa, Homo Sapiens
DDDPVPVPN

SEQ ID NO: 671179 - protein, 9 aa, Homo Sapiens
KMIRSSVFH

SEQ ID NO: 671180 - protein, 9 aa, Homo Sapiens
AQPKKVNKM

SEQ ID NO: 671181 - protein, 9 aa, Homo Sapiens
QDKLRRIKA

SEQ ID NO: 671182 - protein, 9 aa, Homo Sapiens
PELPVHVPA

SEQ ID NO: 671183 - protein, 9 aa, Homo Sapiens
GKELLWGRP

SEQ ID NO: 671184 - protein, 9 aa, Homo Sapiens
PLAHQDQVN

SEQ ID NO: 671185 - protein, 9 aa, Homo Sapiens
QGPLPKETA

SEQ ID NO: 671186 - protein, 9 aa, Homo Sapiens
QLWQKAQRL

SEQ ID NO: 671187 - protein, 9 aa, Homo Sapiens
NKYCVEYGV

SEQ ID NO: 671188 - protein, 9 aa, Homo Sapiens
PLTHGGCPL

SEQ ID NO: 671189 - protein, 9 aa, Homo Sapiens
DPGEWLPHT

SEQ ID NO: 671190 - protein, 9 aa, Homo Sapiens
TYLVCPQDT

SEQ ID NO: 671191 - protein, 9 aa, Homo Sapiens
LLQGILSTT

SEQ ID NO: 671192 - protein, 9 aa, Homo Sapiens
LCRDPRGAP

SEQ ID NO: 671193 - protein, 9 aa, Homo Sapiens
MKAEDNCKV

SEQ ID NO: 671194 - protein, 9 aa, Homo Sapiens
HEPWRRLLH

SEQ ID NO: 671195 - protein, 9 aa, Homo Sapiens
GHFLPRELN

SEQ ID NO: 671196 - protein, 9 aa, Homo Sapiens
HHRLPPSRG

SEQ ID NO: 671197 - protein, 9 aa, Homo Sapiens
YVQALPRAV

SEQ ID NO: 671198 - protein, 9 aa, Homo Sapiens
DIPIECRYP

SEQ ID NO: 671199 - protein, 9 aa, Homo Sapiens
DALLSGSLE

SEQ ID NO: 671200 - protein, 9 aa, Homo Sapiens
TPGQLHSSL

SEQ ID NO: 671201 - protein, 9 aa, Homo Sapiens
LQEGIMVII

SEQ ID NO: 671202 - protein, 9 aa, Homo Sapiens
QKLPFLFIL

SEQ ID NO: 671203 - protein, 9 aa, Homo Sapiens
RSTQDSEGD

SEQ ID NO: 671204 - protein, 9 aa, Homo Sapiens
WRTPQPGSP

SEQ ID NO: 671205 - protein, 9 aa, Homo Sapiens
GTKSHPTKR

SEQ ID NO: 671206 - protein, 9 aa, Homo Sapiens
QAKDMCGHS

SEQ ID NO: 671207 - protein, 9 aa, Homo Sapiens
GDTAFPETG

SEQ ID NO: 671208 - protein, 9 aa, Homo Sapiens
EYTLTHLQP

SEQ ID NO: 671209 - protein, 9 aa, Homo Sapiens
RSNPSELLC

SEQ ID NO: 671210 - protein, 9 aa, Homo Sapiens
VIDCDVIPD

SEQ ID NO: 671211 - protein, 9 aa, Homo Sapiens
QRQAARDRN

SEQ ID NO: 671212 - protein, 9 aa, Homo Sapiens
NGMGQCRLS

SEQ ID NO: 671213 - protein, 9 aa, Homo Sapiens
PSPPADVFE

SEQ ID NO: 671214 - protein, 9 aa, Homo Sapiens
TRGAQSPPP

SEQ ID NO: 671215 - protein, 9 aa, Homo Sapiens
HKISPTEDG

SEQ ID NO: 671216 - protein, 9 aa, Homo Sapiens
LHFAQLAHE

SEQ ID NO: 671217 - protein, 9 aa, Homo Sapiens
FCCFDDCRT

SEQ ID NO: 671218 - protein, 9 aa, Homo Sapiens
TPGHTNDHM

SEQ ID NO: 671219 - protein, 9 aa, Homo Sapiens
ALPRAVRCH

SEQ ID NO: 671220 - protein, 9 aa, Homo Sapiens
AQVGEFPWQ

SEQ ID NO: 671221 - protein, 9 aa, Homo Sapiens
VWSLCRDPR

SEQ ID NO: 671222 - protein, 9 aa, Homo Sapiens
CPLPLGLLL

SEQ ID NO: 671223 - protein, 9 aa, Homo Sapiens
LIQRTNREA

SEQ ID NO: 671224 - protein, 9 aa, Homo Sapiens
TSGGFVEDS

SEQ ID NO: 671225 - protein, 9 aa, Homo Sapiens
PLTRPTPGA

SEQ ID NO: 671226 - protein, 9 aa, Homo Sapiens
QERLSRLPV

SEQ ID NO: 671227 - protein, 9 aa, Homo Sapiens
GPQGPATMG

SEQ ID NO: 671228 - protein, 9 aa, Homo Sapiens
EDNCKVERK

SEQ ID NO: 671229 - protein, 9 aa, Homo Sapiens
KAHSCYKCR

SEQ ID NO: 671230 - protein, 9 aa, Homo Sapiens
EQEALVKRH

SEQ ID NO: 671231 - protein, 9 aa, Homo Sapiens
IPVLHSLQS

SEQ ID NO: 671232 - protein, 9 aa, Homo Sapiens
FEEKTKEAD

SEQ ID NO: 671233 - protein, 9 aa, Homo Sapiens
QLPPLTHGG

SEQ ID NO: 671234 - protein, 9 aa, Homo Sapiens
QPAAGQLRP

SEQ ID NO: 671235 - protein, 9 aa, Homo Sapiens
KKEEEAYAL

SEQ ID NO: 671236 - protein, 9 aa, Homo Sapiens
CRDPRGAPA

SEQ ID NO: 671237 - protein, 9 aa, Homo Sapiens
TSTVLPWSA

SEQ ID NO: 671238 - protein, 9 aa, Homo Sapiens
PTDKTVFLV

SEQ ID NO: 671239 - protein, 9 aa, Homo Sapiens
ELLWGRPEE

SEQ ID NO: 671240 - protein, 9 aa, Homo Sapiens
GTVYPVIKE

SEQ ID NO: 671241 - protein, 9 aa, Homo Sapiens
HGTKMVSHL

SEQ ID NO: 671242 - protein, 9 aa, Homo Sapiens
PLGLLLPGY

SEQ ID NO: 671243 - protein, 9 aa, Homo Sapiens
IDAMRKFLG

SEQ ID NO: 671244 - protein, 9 aa, Homo Sapiens
CRKAKGEGE

SEQ ID NO: 671245 - protein, 9 aa, Homo Sapiens
LGKPLLRWT

SEQ ID NO: 671246 - protein, 9 aa, Homo Sapiens
ADIPIECRY

SEQ ID NO: 671247 - protein, 9 aa, Homo Sapiens
RIFVIIPKS

SEQ ID NO: 671248 - protein, 9 aa, Homo Sapiens
AGNGEAIRI

SEQ ID NO: 671249 - protein, 9 aa, Homo Sapiens
KYISSHNGC

SEQ ID NO: 671250 - protein, 9 aa, Homo Sapiens
MAMLTLTSN

SEQ ID NO: 671251 - protein, 9 aa, Homo Sapiens
GARSNPSEL

SEQ ID NO: 671252 - protein, 9 aa, Homo Sapiens
FIGERTVAA

SEQ ID NO: 671253 - protein, 9 aa, Homo Sapiens
CAGELLGEA

SEQ ID NO: 671254 - protein, 9 aa, Homo Sapiens
CRQHSHSYS

SEQ ID NO: 671255 - protein, 9 aa, Homo Sapiens
LSSSSFRSK

SEQ ID NO: 671256 - protein, 9 aa, Homo Sapiens
TIIVETSHK

SEQ ID NO: 671257 - protein, 9 aa, Homo Sapiens
VEDSACPSE

SEQ ID NO: 671258 - protein, 9 aa, Homo Sapiens
PETGGFSAT

SEQ ID NO: 671259 - protein, 9 aa, Homo Sapiens
TLRAPAHKG

SEQ ID NO: 671260 - protein, 9 aa, Homo Sapiens
CGDHSDPRQ

SEQ ID NO: 671261 - protein, 9 aa, Homo Sapiens
LRRIKATFQ

SEQ ID NO: 671262 - protein, 9 aa, Homo Sapiens
TLTSNCEKE

SEQ ID NO: 671263 - protein, 9 aa, Homo Sapiens
QDDEVDDEL

SEQ ID NO: 671264 - protein, 9 aa, Homo Sapiens
DDSSEKEHA

SEQ ID NO: 671265 - protein, 9 aa, Homo Sapiens
LRSNRLLIG

SEQ ID NO: 671266 - protein, 9 aa, Homo Sapiens
PKTMRKFLH

SEQ ID NO: 671267 - protein, 9 aa, Homo Sapiens
TLSYLEQSK

SEQ ID NO: 671268 - protein, 9 aa, Homo Sapiens
DCRFLGKCP

SEQ ID NO: 671269 - protein, 9 aa, Homo Sapiens
RACVLGKDC

SEQ ID NO: 671270 - protein, 9 aa, Homo Sapiens
FKETCSSKS

SEQ ID NO: 671271 - protein, 9 aa, Homo Sapiens
FYSQPQQAR

SEQ ID NO: 671272 - protein, 9 aa, Homo Sapiens
EAKKTSCFK

SEQ ID NO: 671273 - protein, 9 aa, Homo Sapiens
QFQAGSGST

SEQ ID NO: 671274 - protein, 9 aa, Homo Sapiens
CDVIPDDPQ

SEQ ID NO: 671275 - protein, 9 aa, Homo Sapiens
HGIGFLNHK

SEQ ID NO: 671276 - protein, 9 aa, Homo Sapiens
NHAERELRR

SEQ ID NO: 671277 - protein, 9 aa, Homo Sapiens
KIILINNPL

SEQ ID NO: 671278 - protein, 9 aa, Homo Sapiens
RQAARDRNT

SEQ ID NO: 671279 - protein, 9 aa, Homo Sapiens
YIKLEKPQE

SEQ ID NO: 671280 - protein, 9 aa, Homo Sapiens
RLIKDSLQH

SEQ ID NO: 671281 - protein, 9 aa, Homo Sapiens
ETAAPGVQD

SEQ ID NO: 671282 - protein, 9 aa, Homo Sapiens
ELWGGPEPW

SEQ ID NO: 671283 - protein, 9 aa, Homo Sapiens
LLHFAQLAH

SEQ ID NO: 671284 - protein, 9 aa, Homo Sapiens
LTLTSNCEK

SEQ ID NO: 671285 - protein, 9 aa, Homo Sapiens
RLLHFAQLA

SEQ ID NO: 671286 - protein, 9 aa, Homo Sapiens
RKAKGEGEN

SEQ ID NO: 671287 - protein, 9 aa, Homo Sapiens
LEMYPPLNE

SEQ ID NO: 671288 - protein, 9 aa, Homo Sapiens
MPEAKENKQ

SEQ ID NO: 671289 - protein, 9 aa, Homo Sapiens
CPLEPPYNL

SEQ ID NO: 671290 - protein, 9 aa, Homo Sapiens
TFVCEKSKA

SEQ ID NO: 671291 - protein, 9 aa, Homo Sapiens
IRSSVFHMF

SEQ ID NO: 671292 - protein, 9 aa, Homo Sapiens
TDTLIQRTN

SEQ ID NO: 671293 - protein, 9 aa, Homo Sapiens
EKSKADQLI

SEQ ID NO: 671294 - protein, 9 aa, Homo Sapiens
NRADIPIEC

SEQ ID NO: 671295 - protein, 9 aa, Homo Sapiens
KSRRAGAAD

SEQ ID NO: 671296 - protein, 9 aa, Homo Sapiens
QPQQAREKK

SEQ ID NO: 671297 - protein, 9 aa, Homo Sapiens
SPSPPADVF

SEQ ID NO: 671298 - protein, 9 aa, Homo Sapiens
ACYIFHHRL

SEQ ID NO: 671299 - protein, 9 aa, Homo Sapiens
RYRSRCRSR

SEQ ID NO: 671300 - protein, 9 aa, Homo Sapiens
FDFKNSLPD

SEQ ID NO: 671301 - protein, 9 aa, Homo Sapiens
EQADLKMLT

SEQ ID NO: 671302 - protein, 9 aa, Homo Sapiens
LISVSDRDL

SEQ ID NO: 671303 - protein, 9 aa, Homo Sapiens
DTMETAKST

SEQ ID NO: 671304 - protein, 9 aa, Homo Sapiens
ERLAACGAQ

SEQ ID NO: 671305 - protein, 9 aa, Homo Sapiens
EQAAQIGLD

SEQ ID NO: 671306 - protein, 9 aa, Homo Sapiens
PVMEKQVFA

SEQ ID NO: 671307 - protein, 9 aa, Homo Sapiens
KGQDAGYIF

SEQ ID NO: 671308 - protein, 9 aa, Homo Sapiens
PQERLSRLP

SEQ ID NO: 671309 - protein, 9 aa, Homo Sapiens
ALVNMMVGD

SEQ ID NO: 671310 - protein, 9 aa, Homo Sapiens
PPPSPCLSL

SEQ ID NO: 671311 - protein, 9 aa, Homo Sapiens
GGKSRRAGA

SEQ ID NO: 671312 - protein, 9 aa, Homo Sapiens
GPECNTPIQ

SEQ ID NO: 671313 - protein, 9 aa, Homo Sapiens
VMEKQVFAY

SEQ ID NO: 671314 - protein, 9 aa, Homo Sapiens
ELLTRGAQS

SEQ ID NO: 671315 - protein, 9 aa, Homo Sapiens
PTPGAGQRL

SEQ ID NO: 671316 - protein, 9 aa, Homo Sapiens
VSFRINPDG

SEQ ID NO: 671317 - protein, 9 aa, Homo Sapiens
AALQVLGTE

SEQ ID NO: 671318 - protein, 9 aa, Homo Sapiens
VPARPGGAL

SEQ ID NO: 671319 - protein, 9 aa, Homo Sapiens
CCCRKAKGE

SEQ ID NO: 671320 - protein, 9 aa, Homo Sapiens
YTLTHLQPS

SEQ ID NO: 671321 - protein, 9 aa, Homo Sapiens
DEGPECNTP

SEQ ID NO: 671322 - protein, 9 aa, Homo Sapiens
DVHEYTLTH

SEQ ID NO: 671323 - protein, 9 aa, Homo Sapiens
KEEPVEIQD

SEQ ID NO: 671324 - protein, 9 aa, Homo Sapiens
VLRSSFLNA

SEQ ID NO: 671325 - protein, 9 aa, Homo Sapiens
CEFAKTVSK

SEQ ID NO: 671326 - protein, 9 aa, Homo Sapiens
PQQAREKKS

SEQ ID NO: 671327 - protein, 9 aa, Homo Sapiens
CRSRSRSRG

SEQ ID NO: 671328 - protein, 9 aa, Homo Sapiens
KQSPGARQP

SEQ ID NO: 671329 - protein, 9 aa, Homo Sapiens
TGVIGISSK

SEQ ID NO: 671330 - protein, 9 aa, Homo Sapiens
ALYTTKHAN

SEQ ID NO: 671331 - protein, 9 aa, Homo Sapiens
WFCDKPLNA

SEQ ID NO: 671332 - protein, 9 aa, Homo Sapiens
RTRTPGQLH

SEQ ID NO: 671333 - protein, 9 aa, Homo Sapiens
PCLLSSPRP

SEQ ID NO: 671334 - protein, 9 aa, Homo Sapiens
RTNRADIPI

SEQ ID NO: 671335 - protein, 9 aa, Homo Sapiens
MDPGEWLPH

SEQ ID NO: 671336 - protein, 9 aa, Homo Sapiens
VLEYPWVND

SEQ ID NO: 671337 - protein, 9 aa, Homo Sapiens
ITNPEYGYL

SEQ ID NO: 671338 - protein, 9 aa, Homo Sapiens
MGKTLGDSP

SEQ ID NO: 671339 - protein, 9 aa, Homo Sapiens
SAVQVLEYP

SEQ ID NO: 671340 - protein, 9 aa, Homo Sapiens
DSLQHLQTL

SEQ ID NO: 671341 - protein, 9 aa, Homo Sapiens
IPFCEFAKT

SEQ ID NO: 671342 - protein, 9 aa, Homo Sapiens
SSLPPVLGK

SEQ ID NO: 671343 - protein, 9 aa, Homo Sapiens
TSAGWDVLL

SEQ ID NO: 671344 - protein, 9 aa, Homo Sapiens
SGGFVEDSA

SEQ ID NO: 671345 - protein, 9 aa, Homo Sapiens
MTGSAREKA

SEQ ID NO: 671346 - protein, 9 aa, Homo Sapiens
KQKMELEQK

SEQ ID NO: 671347 - protein, 9 aa, Homo Sapiens
HRLPPSRGC

SEQ ID NO: 671348 - protein, 9 aa, Homo Sapiens
SIFDFKNSL

SEQ ID NO: 671349 - protein, 9 aa, Homo Sapiens
SQFTFTPSE

SEQ ID NO: 671350 - protein, 9 aa, Homo Sapiens
LLHHGGGNP

SEQ ID NO: 671351 - protein, 9 aa, Homo Sapiens
PKWLLQGIL

SEQ ID NO: 671352 - protein, 9 aa, Homo Sapiens
PAAGQLRPQ

SEQ ID NO: 671353 - protein, 9 aa, Homo Sapiens
QALPRAVRC

SEQ ID NO: 671354 - protein, 9 aa, Homo Sapiens
YLLGKPLLR

SEQ ID NO: 671355 - protein, 9 aa, Homo Sapiens
GCLWRTPQP

SEQ ID NO: 671356 - protein, 9 aa, Homo Sapiens
WVSTFCFMV

SEQ ID NO: 671357 - protein, 9 aa, Homo Sapiens
CLWRTPQPG

SEQ ID NO: 671358 - protein, 9 aa, Homo Sapiens
FTGVGAMLE

SEQ ID NO: 671359 - protein, 9 aa, Homo Sapiens
FPETGGFSA

SEQ ID NO: 671360 - protein, 9 aa, Homo Sapiens
ERKKQEEPF

SEQ ID NO: 671361 - protein, 9 aa, Homo Sapiens
CQERFCCCR

SEQ ID NO: 671362 - protein, 9 aa, Homo Sapiens
LSSNEIFKS

SEQ ID NO: 671363 - protein, 9 aa, Homo Sapiens
VMMLALMAY

SEQ ID NO: 671364 - protein, 9 aa, Homo Sapiens
KRDDASVCS

SEQ ID NO: 671365 - protein, 9 aa, Homo Sapiens
CVSSLIQHE

SEQ ID NO: 671366 - protein, 9 aa, Homo Sapiens
KEHAIEITT

SEQ ID NO: 671367 - protein, 9 aa, Homo Sapiens
RMLTWLVFF

SEQ ID NO: 671368 - protein, 9 aa, Homo Sapiens
SVSQRALVN

SEQ ID NO: 671369 - protein, 9 aa, Homo Sapiens
PWTQLYDWP

SEQ ID NO: 671370 - protein, 9 aa, Homo Sapiens
LKVYVYCSP

SEQ ID NO: 671371 - protein, 9 aa, Homo Sapiens
PYNLSPRTR

SEQ ID NO: 671372 - protein, 9 aa, Homo Sapiens
YVSRPTDKT

SEQ ID NO: 671373 - protein, 9 aa, Homo Sapiens
SGSFRYRSS

SEQ ID NO: 671374 - protein, 9 aa, Homo Sapiens
ETASLPIIV

SEQ ID NO: 671375 - protein, 9 aa, Homo Sapiens
YDGQDLAYT

SEQ ID NO: 671376 - protein, 9 aa, Homo Sapiens
EALVKRHSA

SEQ ID NO: 671377 - protein, 9 aa, Homo Sapiens
KQRRALRSN

SEQ ID NO: 671378 - protein, 9 aa, Homo Sapiens
NISALMKTA

SEQ ID NO: 671379 - protein, 9 aa, Homo Sapiens
KVAQLKQFL

SEQ ID NO: 671380 - protein, 9 aa, Homo Sapiens
PMAMLTLTS

SEQ ID NO: 671381 - protein, 9 aa, Homo Sapiens
FENKMANGN

SEQ ID NO: 671382 - protein, 9 aa, Homo Sapiens
HLKEGRNLF

SEQ ID NO: 671383 - protein, 9 aa, Homo Sapiens
SALMKTARV

SEQ ID NO: 671384 - protein, 9 aa, Homo Sapiens
VRTNRADIP

SEQ ID NO: 671385 - protein, 9 aa, Homo Sapiens
ETQCESKVV

SEQ ID NO: 671386 - protein, 9 aa, Homo Sapiens
QPSLPLSKD

SEQ ID NO: 671387 - protein, 9 aa, Homo Sapiens
VPPPPPLSP

SEQ ID NO: 671388 - protein, 9 aa, Homo Sapiens
LAPPGSPPP

SEQ ID NO: 671389 - protein, 9 aa, Homo Sapiens
SGILVSVLD

SEQ ID NO: 671390 - protein, 9 aa, Homo Sapiens
RKFLGELHD

SEQ ID NO: 671391 - protein, 9 aa, Homo Sapiens
TNMPFQTND

SEQ ID NO: 671392 - protein, 9 aa, Homo Sapiens
GAGQRLLRV

SEQ ID NO: 671393 - protein, 9 aa, Homo Sapiens
PGVQDISGL

SEQ ID NO: 671394 - protein, 9 aa, Homo Sapiens
FHRAFTNMP

SEQ ID NO: 671395 - protein, 9 aa, Homo Sapiens
QRLLPPEDT

SEQ ID NO: 671396 - protein, 9 aa, Homo Sapiens
INFETPEAS

SEQ ID NO: 671397 - protein, 9 aa, Homo Sapiens
STFSPISEQ

SEQ ID NO: 671398 - protein, 9 aa, Homo Sapiens
NSTVPVADS

SEQ ID NO: 671399 - protein, 9 aa, Homo Sapiens
SAFTTSNVV

SEQ ID NO: 671400 - protein, 9 aa, Homo Sapiens
GQGVGSLEE

SEQ ID NO: 671401 - protein, 9 aa, Homo Sapiens
GMGQCRLSM

SEQ ID NO: 671402 - protein, 9 aa, Homo Sapiens
AVRSTQDSE

SEQ ID NO: 671403 - protein, 9 aa, Homo Sapiens
QSQTTCVNA

SEQ ID NO: 671404 - protein, 9 aa, Homo Sapiens
NRFYSQPQQ

SEQ ID NO: 671405 - protein, 9 aa, Homo Sapiens
VRSTQDSEG

SEQ ID NO: 671406 - protein, 9 aa, Homo Sapiens
PKKEEEAYA

SEQ ID NO: 671407 - protein, 9 aa, Homo Sapiens
AEDNCKVER

SEQ ID NO: 671408 - protein, 9 aa, Homo Sapiens
RVVKNKIGE

SEQ ID NO: 671409 - protein, 9 aa, Homo Sapiens
SDQPLNEFC

SEQ ID NO: 671410 - protein, 9 aa, Homo Sapiens
ESMGLPGTV

SEQ ID NO: 671411 - protein, 9 aa, Homo Sapiens
GSFRYRSSC

SEQ ID NO: 671412 - protein, 9 aa, Homo Sapiens
PLSKDAHPS

SEQ ID NO: 671413 - protein, 9 aa, Homo Sapiens
EKEHAIEIT

SEQ ID NO: 671414 - protein, 9 aa, Homo Sapiens
CASFFCCFD

SEQ ID NO: 671415 - protein, 9 aa, Homo Sapiens
QQDLPEQPV

SEQ ID NO: 671416 - protein, 9 aa, Homo Sapiens
PPPPPLSPS

SEQ ID NO: 671417 - protein, 9 aa, Homo Sapiens
YGEDTVVHK

SEQ ID NO: 671418 - protein, 9 aa, Homo Sapiens
LKNEVTDLS

SEQ ID NO: 671419 - protein, 9 aa, Homo Sapiens
TVCYGPQGP

SEQ ID NO: 671420 - protein, 9 aa, Homo Sapiens
ILVSVLDTT

SEQ ID NO: 671421 - protein, 9 aa, Homo Sapiens
CSPAPAGLS

SEQ ID NO: 671422 - protein, 9 aa, Homo Sapiens
GNPFRVTRA

SEQ ID NO: 671423 - protein, 9 aa, Homo Sapiens
PFEIPVLHS

SEQ ID NO: 671424 - protein, 9 aa, Homo Sapiens
GGSGGKSRR

SEQ ID NO: 671425 - protein, 9 aa, Homo Sapiens
LEYPWVNDD

SEQ ID NO: 671426 - protein, 9 aa, Homo Sapiens
GDWLAEAFA

SEQ ID NO: 671427 - protein, 9 aa, Homo Sapiens
NFETPEASI

SEQ ID NO: 671428 - protein, 9 aa, Homo Sapiens
QQFLCVHEG

SEQ ID NO: 671429 - protein, 9 aa, Homo Sapiens
IIRYEVYMR

SEQ ID NO: 671430 - protein, 9 aa, Homo Sapiens
VNKMKRVTA

SEQ ID NO: 671431 - protein, 9 aa, Homo Sapiens
TAVLTEPPT

SEQ ID NO: 671432 - protein, 9 aa, Homo Sapiens
GSQWFWWHW

SEQ ID NO: 671433 - protein, 9 aa, Homo Sapiens
VPRLTLKKL

SEQ ID NO: 671434 - protein, 9 aa, Homo Sapiens
SVLDQGGSG

SEQ ID NO: 671435 - protein, 9 aa, Homo Sapiens
NLVSYPRIH

SEQ ID NO: 671436 - protein, 9 aa, Homo Sapiens
AYLLGKPLL

SEQ ID NO: 671437 - protein, 9 aa, Homo Sapiens
PLPLGLLLP

SEQ ID NO: 671438 - protein, 9 aa, Homo Sapiens
LLQWEQAAQ

SEQ ID NO: 671439 - protein, 9 aa, Homo Sapiens
PGARSNPSE

SEQ ID NO: 671440 - protein, 9 aa, Homo Sapiens
GDDRRSRLV

SEQ ID NO: 671441 - protein, 9 aa, Homo Sapiens
PFRVTRAAI

SEQ ID NO: 671442 - protein, 9 aa, Homo Sapiens
PECEHGYAS

SEQ ID NO: 671443 - protein, 9 aa, Homo Sapiens
IIPKSYTEE

SEQ ID NO: 671444 - protein, 9 aa, Homo Sapiens
ECGKAFNCV

SEQ ID NO: 671445 - protein, 9 aa, Homo Sapiens
IDCDVIPDD

SEQ ID NO: 671446 - protein, 9 aa, Homo Sapiens
PPSRGCKAG

SEQ ID NO: 671447 - protein, 9 aa, Homo Sapiens
FKIKPEDAV

SEQ ID NO: 671448 - protein, 9 aa, Homo Sapiens
TPEASISLP

SEQ ID NO: 671449 - protein, 9 aa, Homo Sapiens
SLPIIVSIK

SEQ ID NO: 671450 - protein, 9 aa, Homo Sapiens
WACSIFDFK

SEQ ID NO: 671451 - protein, 9 aa, Homo Sapiens
GGNPTAATD

SEQ ID NO: 671452 - protein, 9 aa, Homo Sapiens
FRKAHKPWA

SEQ ID NO: 671453 - protein, 9 aa, Homo Sapiens
EFTGVGAML

SEQ ID NO: 671454 - protein, 9 aa, Homo Sapiens
TLTGKKIIG

SEQ ID NO: 671455 - protein, 9 aa, Homo Sapiens
TMMQAVGGA

SEQ ID NO: 671456 - protein, 9 aa, Homo Sapiens
SKADQLIQT

SEQ ID NO: 671457 - protein, 9 aa, Homo Sapiens
GDRFRSRGG

SEQ ID NO: 671458 - protein, 9 aa, Homo Sapiens
MMDQCYFEN

SEQ ID NO: 671459 - protein, 9 aa, Homo Sapiens
DGNGVGQFQ

SEQ ID NO: 671460 - protein, 9 aa, Homo Sapiens
TVIRENYLV

SEQ ID NO: 671461 - protein, 9 aa, Homo Sapiens
GWDVLLAPI

SEQ ID NO: 671462 - protein, 9 aa, Homo Sapiens
FFISQHALM

SEQ ID NO: 671463 - protein, 9 aa, Homo Sapiens
NITNPEYGY

SEQ ID NO: 671464 - protein, 9 aa, Homo Sapiens
FLFILDAKS

SEQ ID NO: 671465 - protein, 9 aa, Homo Sapiens
KPLLRWTNF

SEQ ID NO: 671466 - protein, 9 aa, Homo Sapiens
LPRELNGRL

SEQ ID NO: 671467 - protein, 9 aa, Homo Sapiens
GGKGNSAGG

SEQ ID NO: 671468 - protein, 9 aa, Homo Sapiens
PPLNETLSQ

SEQ ID NO: 671469 - protein, 9 aa, Homo Sapiens
VNFCYSSII

SEQ ID NO: 671470 - protein, 9 aa, Homo Sapiens
WLLQGILST

SEQ ID NO: 671471 - protein, 9 aa, Homo Sapiens
FTFSLTLNT

SEQ ID NO: 671472 - protein, 9 aa, Homo Sapiens
IFKSLPVGY

SEQ ID NO: 671473 - protein, 9 aa, Homo Sapiens
TRRRGRKEG

SEQ ID NO: 671474 - protein, 9 aa, Homo Sapiens
ITGGMEAQV

SEQ ID NO: 671475 - protein, 9 aa, Homo Sapiens
SSLQGPLPK

SEQ ID NO: 671476 - protein, 9 aa, Homo Sapiens
KQTVIRENY

SEQ ID NO: 671477 - protein, 9 aa, Homo Sapiens
YPPLNETLS

SEQ ID NO: 671478 - protein, 9 aa, Homo Sapiens
GFLNHKMPP

SEQ ID NO: 671479 - protein, 9 aa, Homo Sapiens
LWQKAQRLH

SEQ ID NO: 671480 - protein, 9 aa, Homo Sapiens
LGVLIDLAY

SEQ ID NO: 671481 - protein, 9 aa, Homo Sapiens
STTLEIKKD

SEQ ID NO: 671482 - protein, 9 aa, Homo Sapiens
SKSPKTMRK

SEQ ID NO: 671483 - protein, 9 aa, Homo Sapiens
MVSFRINPD

SEQ ID NO: 671484 - protein, 9 aa, Homo Sapiens
PARPGGALC

SEQ ID NO: 671485 - protein, 9 aa, Homo Sapiens
VPAWGSQWF

SEQ ID NO: 671486 - protein, 9 aa, Homo Sapiens
ARLLHPAYR

SEQ ID NO: 671487 - protein, 9 aa, Homo Sapiens
QALSALSHL

SEQ ID NO: 671488 - protein, 9 aa, Homo Sapiens
GGVGQGKDI

SEQ ID NO: 671489 - protein, 9 aa, Homo Sapiens
QLRPQPELP

SEQ ID NO: 671490 - protein, 9 aa, Homo Sapiens
IETNSTVPV

SEQ ID NO: 671491 - protein, 9 aa, Homo Sapiens
LTRIFVIIP

SEQ ID NO: 671492 - protein, 9 aa, Homo Sapiens
VSDRDLGVN

SEQ ID NO: 671493 - protein, 9 aa, Homo Sapiens
AVTAVLTEP

SEQ ID NO: 671494 - protein, 9 aa, Homo Sapiens
REDPAEAAQ

SEQ ID NO: 671495 - protein, 9 aa, Homo Sapiens
WNKWEVVAE

SEQ ID NO: 671496 - protein, 9 aa, Homo Sapiens
TLDDSSEKE

SEQ ID NO: 671497 - protein, 9 aa, Homo Sapiens
KNPAEQADL

SEQ ID NO: 671498 - protein, 9 aa, Homo Sapiens
AWPAGPFEI

SEQ ID NO: 671499 - protein, 9 aa, Homo Sapiens
VKIILINNP

SEQ ID NO: 671500 - protein, 9 aa, Homo Sapiens
HCLKNEVTD

SEQ ID NO: 671501 - protein, 9 aa, Homo Sapiens
PLEPPYNLS

SEQ ID NO: 671502 - protein, 9 aa, Homo Sapiens
RHFKVWSLC

SEQ ID NO: 671503 - protein, 9 aa, Homo Sapiens
MELEQKVVL

SEQ ID NO: 671504 - protein, 9 aa, Homo Sapiens
GVQDISGLP

SEQ ID NO: 671505 - protein, 9 aa, Homo Sapiens
TLGGQGVGS

SEQ ID NO: 671506 - protein, 9 aa, Homo Sapiens
SLVDLGPPV

SEQ ID NO: 671507 - protein, 9 aa, Homo Sapiens
GAPGNREDP

SEQ ID NO: 671508 - protein, 9 aa, Homo Sapiens
VYVYCSPVT

SEQ ID NO: 671509 - protein, 9 aa, Homo Sapiens
PETVVPASP

SEQ ID NO: 671510 - protein, 9 aa, Homo Sapiens
GILVSVLDT

SEQ ID NO: 671511 - protein, 9 aa, Homo Sapiens
DVLLAPILN

SEQ ID NO: 671512 - protein, 9 aa, Homo Sapiens
PPQTTAAPP

SEQ ID NO: 671513 - protein, 9 aa, Homo Sapiens
VDLGPPVME

SEQ ID NO: 671514 - protein, 9 aa, Homo Sapiens
LDPAQRIAS

SEQ ID NO: 671515 - protein, 9 aa, Homo Sapiens
VGKRLGPRG

SEQ ID NO: 671516 - protein, 9 aa, Homo Sapiens
LDDSSEKEH

SEQ ID NO: 671517 - protein, 9 aa, Homo Sapiens
EPECEHGYA

SEQ ID NO: 671518 - protein, 9 aa, Homo Sapiens
KSVSQPLNT

SEQ ID NO: 671519 - protein, 9 aa, Homo Sapiens
WGSQWFWWH

SEQ ID NO: 671520 - protein, 9 aa, Homo Sapiens
MKTARVEIN

SEQ ID NO: 671521 - protein, 9 aa, Homo Sapiens
VPASPELQP

SEQ ID NO: 671522 - protein, 9 aa, Homo Sapiens
DGDDRRSRL

SEQ ID NO: 671523 - protein, 9 aa, Homo Sapiens
YRSRCRSRS

SEQ ID NO: 671524 - protein, 9 aa, Homo Sapiens
DQPLNEFCS

SEQ ID NO: 671525 - protein, 9 aa, Homo Sapiens
LLRVVKNKI

SEQ ID NO: 671526 - protein, 9 aa, Homo Sapiens
AAVFGVTLL

SEQ ID NO: 671527 - protein, 9 aa, Homo Sapiens
GNERPYCQI

SEQ ID NO: 671528 - protein, 9 aa, Homo Sapiens
VCEKSKADQ

SEQ ID NO: 671529 - protein, 9 aa, Homo Sapiens
GGGVGQGKD

SEQ ID NO: 671530 - protein, 9 aa, Homo Sapiens
SFFCCFDDC

SEQ ID NO: 671531 - protein, 9 aa, Homo Sapiens
IDLAYVSVA

SEQ ID NO: 671532 - protein, 9 aa, Homo Sapiens
EAQVGEFPW

SEQ ID NO: 671533 - protein, 9 aa, Homo Sapiens
RILACGGDR

SEQ ID NO: 671534 - protein, 9 aa, Homo Sapiens
IVGDVQGKG

SEQ ID NO: 671535 - protein, 9 aa, Homo Sapiens
TMRKFLHKR

SEQ ID NO: 671536 - protein, 9 aa, Homo Sapiens
KTRSGKVFE

SEQ ID NO: 671537 - protein, 9 aa, Homo Sapiens
TARKSQWNK

SEQ ID NO: 671538 - protein, 9 aa, Homo Sapiens
PCAGELLGE

SEQ ID NO: 671539 - protein, 9 aa, Homo Sapiens
SGPRPRKQS

SEQ ID NO: 671540 - protein, 9 aa, Homo Sapiens
FRVEKFGHG

SEQ ID NO: 671541 - protein, 9 aa, Homo Sapiens
RVCQERFCC

SEQ ID NO: 671542 - protein, 9 aa, Homo Sapiens
PGHRLVPSQ

SEQ ID NO: 671543 - protein, 9 aa, Homo Sapiens
PTTGVIGIS

SEQ ID NO: 671544 - protein, 9 aa, Homo Sapiens
CTASCFRPS

SEQ ID NO: 671545 - protein, 9 aa, Homo Sapiens
WRRLLHFAQ

SEQ ID NO: 671546 - protein, 9 aa, Homo Sapiens
SCSVNEFAK

SEQ ID NO: 671547 - protein, 9 aa, Homo Sapiens
PPPLSPSSV

SEQ ID NO: 671548 - protein, 9 aa, Homo Sapiens
DEDDFAHEE

SEQ ID NO: 671549 - protein, 9 aa, Homo Sapiens
VYCSPVTKE

SEQ ID NO: 671550 - protein, 9 aa, Homo Sapiens
AGDTAFPET

SEQ ID NO: 671551 - protein, 9 aa, Homo Sapiens
NGEAIRIRS

SEQ ID NO: 671552 - protein, 9 aa, Homo Sapiens
ACGGDRTVG

SEQ ID NO: 671553 - protein, 9 aa, Homo Sapiens
TQCESKVVA

SEQ ID NO: 671554 - protein, 9 aa, Homo Sapiens
SSGYKFSKS

SEQ ID NO: 671555 - protein, 9 aa, Homo Sapiens
VYPVIKEET

SEQ ID NO: 671556 - protein, 9 aa, Homo Sapiens
PVPVPNVNA

SEQ ID NO: 671557 - protein, 9 aa, Homo Sapiens
VSQPLNTDA

SEQ ID NO: 671558 - protein, 9 aa, Homo Sapiens
EQTLSYLEQ

SEQ ID NO: 671559 - protein, 9 aa, Homo Sapiens
GLRRTLHLL

SEQ ID NO: 671560 - protein, 9 aa, Homo Sapiens
TKHANKITL

SEQ ID NO: 671561 - protein, 9 aa, Homo Sapiens
CESKVVAGT

SEQ ID NO: 671562 - protein, 9 aa, Homo Sapiens
LSLTGSPTP

SEQ ID NO: 671563 - protein, 9 aa, Homo Sapiens
EISRHYRKA

SEQ ID NO: 671564 - protein, 9 aa, Homo Sapiens
EKNGMGQCR

SEQ ID NO: 671565 - protein, 9 aa, Homo Sapiens
ALLDSSLQG

SEQ ID NO: 671566 - protein, 9 aa, Homo Sapiens
APCAGELLG

SEQ ID NO: 671567 - protein, 9 aa, Homo Sapiens
AHEELGDDL

SEQ ID NO: 671568 - protein, 9 aa, Homo Sapiens
AGAGAPGNR

SEQ ID NO: 671569 - protein, 9 aa, Homo Sapiens
ETVVPASPE

SEQ ID NO: 671570 - protein, 9 aa, Homo Sapiens
PFKCSHCDM

SEQ ID NO: 671571 - protein, 9 aa, Homo Sapiens
AHKPWAKKM

SEQ ID NO: 671572 - protein, 9 aa, Homo Sapiens
FKTKSTQEG

SEQ ID NO: 671573 - protein, 9 aa, Homo Sapiens
MRYNRRNRW

SEQ ID NO: 671574 - protein, 9 aa, Homo Sapiens
LDGNPFRVT

SEQ ID NO: 671575 - protein, 9 aa, Homo Sapiens
DVEEINHAE

SEQ ID NO: 671576 - protein, 9 aa, Homo Sapiens
WKTQIDSPL

SEQ ID NO: 671577 - protein, 9 aa, Homo Sapiens
PASPELQPS

SEQ ID NO: 671578 - protein, 9 aa, Homo Sapiens
CCINRQSQT

SEQ ID NO: 671579 - protein, 9 aa, Homo Sapiens
AGWDVLLAP

SEQ ID NO: 671580 - protein, 9 aa, Homo Sapiens
VATTDSDKR

SEQ ID NO: 671581 - protein, 9 aa, Homo Sapiens
LYDTLNQYY

SEQ ID NO: 671582 - protein, 9 aa, Homo Sapiens
KGYSIAFMG

SEQ ID NO: 671583 - protein, 9 aa, Homo Sapiens
FSWKTQIDS

SEQ ID NO: 671584 - protein, 9 aa, Homo Sapiens
TWVYPNITN

SEQ ID NO: 671585 - protein, 9 aa, Homo Sapiens
RELKGYSIA

SEQ ID NO: 671586 - protein, 9 aa, Homo Sapiens
PEDFQKFQT

SEQ ID NO: 671587 - protein, 9 aa, Homo Sapiens
PGGGGSGGK

SEQ ID NO: 671588 - protein, 9 aa, Homo Sapiens
LPWSASAPG

SEQ ID NO: 671589 - protein, 9 aa, Homo Sapiens
PISEQPAAG

SEQ ID NO: 671590 - protein, 9 aa, Homo Sapiens
RKQSPGARQ

SEQ ID NO: 671591 - protein, 9 aa, Homo Sapiens
VIAPSGSEP

SEQ ID NO: 671592 - protein, 9 aa, Homo Sapiens
NGVFRVEKF

SEQ ID NO: 671593 - protein, 9 aa, Homo Sapiens
KAKGEGENK

SEQ ID NO: 671594 - protein, 9 aa, Homo Sapiens
WRSRKWPFD

SEQ ID NO: 671595 - protein, 9 aa, Homo Sapiens
SRYRSRCRS

SEQ ID NO: 671596 - protein, 9 aa, Homo Sapiens
MIRSSVFHM

SEQ ID NO: 671597 - protein, 9 aa, Homo Sapiens
SQEMRYNRR

SEQ ID NO: 671598 - protein, 9 aa, Homo Sapiens
HGRCVSVPC

SEQ ID NO: 671599 - protein, 9 aa, Homo Sapiens
AFNCVSSLI

SEQ ID NO: 671600 - protein, 9 aa, Homo Sapiens
IMVKALGDW

SEQ ID NO: 671601 - protein, 9 aa, Homo Sapiens
RCLMMALSQ

SEQ ID NO: 671602 - protein, 9 aa, Homo Sapiens
SSGPRPRKQ

SEQ ID NO: 671603 - protein, 9 aa, Homo Sapiens
DTLNQYYVH

SEQ ID NO: 671604 - protein, 9 aa, Homo Sapiens
DSPRCLMMA

SEQ ID NO: 671605 - protein, 9 aa, Homo Sapiens
WGARYDKII

SEQ ID NO: 671606 - protein, 9 aa, Homo Sapiens
IKDSLQHLQ

SEQ ID NO: 671607 - protein, 9 aa, Homo Sapiens
LDQGGSGTV

SEQ ID NO: 671608 - protein, 9 aa, Homo Sapiens
GDHSDPRQT

SEQ ID NO: 671609 - protein, 9 aa, Homo Sapiens
DPHNFKSVT

SEQ ID NO: 671610 - protein, 9 aa, Homo Sapiens
PLLRWTNFD

SEQ ID NO: 671611 - protein, 9 aa, Homo Sapiens
KELKETFEE

SEQ ID NO: 671612 - protein, 9 aa, Homo Sapiens
PPVLGKELL

SEQ ID NO: 671613 - protein, 9 aa, Homo Sapiens
IVRTNRADI

SEQ ID NO: 671614 - protein, 9 aa, Homo Sapiens
MAVQQDLYC

SEQ ID NO: 671615 - protein, 9 aa, Homo Sapiens
FQAIQRRLL

SEQ ID NO: 671616 - protein, 9 aa, Homo Sapiens
YTTKHANKI

SEQ ID NO: 671617 - protein, 9 aa, Homo Sapiens
RQSQTTCVN

SEQ ID NO: 671618 - protein, 9 aa, Homo Sapiens
YISIDAMRK

SEQ ID NO: 671619 - protein, 9 aa, Homo Sapiens
ERFYRKCRQ

SEQ ID NO: 671620 - protein, 9 aa, Homo Sapiens
EDEGSVLDQ

SEQ ID NO: 671621 - protein, 9 aa, Homo Sapiens
LLGTVTVIS

SEQ ID NO: 671622 - protein, 9 aa, Homo Sapiens
SNRPSFNGT

SEQ ID NO: 671623 - protein, 9 aa, Homo Sapiens
VSTFCFMVS

SEQ ID NO: 671624 - protein, 9 aa, Homo Sapiens
STTRATDLN

SEQ ID NO: 671625 - protein, 9 aa, Homo Sapiens
SLTMMQAVG

SEQ ID NO: 671626 - protein, 9 aa, Homo Sapiens
MRKFLHKRK

SEQ ID NO: 671627 - protein, 9 aa, Homo Sapiens
CKAGPLAHQ

SEQ ID NO: 671628 - protein, 9 aa, Homo Sapiens
CQAGRSPQE

SEQ ID NO: 671629 - protein, 9 aa, Homo Sapiens
LSHLPESLA

SEQ ID NO: 671630 - protein, 9 aa, Homo Sapiens
LLWVSTFCF

SEQ ID NO: 671631 - protein, 9 aa, Homo Sapiens
KKTIQMVSF

SEQ ID NO: 671632 - protein, 9 aa, Homo Sapiens
RRFYVQALP

SEQ ID NO: 671633 - protein, 9 aa, Homo Sapiens
SYPWGTKSH

SEQ ID NO: 671634 - protein, 9 aa, Homo Sapiens
PPPPLSPSS

SEQ ID NO: 671635 - protein, 9 aa, Homo Sapiens
NCQIRSKVF

SEQ ID NO: 671636 - protein, 9 aa, Homo Sapiens
SGPTQVPLS

SEQ ID NO: 671637 - protein, 9 aa, Homo Sapiens
QEMRYNRRN

SEQ ID NO: 671638 - protein, 9 aa, Homo Sapiens
SQHALMDLM

SEQ ID NO: 671639 - protein, 9 aa, Homo Sapiens
KTLGDSPID

SEQ ID NO: 671640 - protein, 9 aa, Homo Sapiens
QPPQQRQQP

SEQ ID NO: 671641 - protein, 9 aa, Homo Sapiens
PSNMSAHLR

SEQ ID NO: 671642 - protein, 9 aa, Homo Sapiens
GAMLEKRWK

SEQ ID NO: 671643 - protein, 9 aa, Homo Sapiens
AVQFQAIQR

SEQ ID NO: 671644 - protein, 9 aa, Homo Sapiens
LDGGRRGHE

SEQ ID NO: 671645 - protein, 9 aa, Homo Sapiens
ILSLTGSPT

SEQ ID NO: 671646 - protein, 9 aa, Homo Sapiens
ASGSFRYRS

SEQ ID NO: 671647 - protein, 9 aa, Homo Sapiens
PRTRTPGQL

SEQ ID NO: 671648 - protein, 9 aa, Homo Sapiens
ASKNEQLKA

SEQ ID NO: 671649 - protein, 9 aa, Homo Sapiens
LNQLWQKAQ

SEQ ID NO: 671650 - protein, 9 aa, Homo Sapiens
TAAPGVQDI

SEQ ID NO: 671651 - protein, 9 aa, Homo Sapiens
GALCRCQAG

SEQ ID NO: 671652 - protein, 9 aa, Homo Sapiens
HLIHAGNGE

SEQ ID NO: 671653 - protein, 9 aa, Homo Sapiens
SWACSIFDF

SEQ ID NO: 671654 - protein, 9 aa, Homo Sapiens
PWRRLLHFA

SEQ ID NO: 671655 - protein, 9 aa, Homo Sapiens
ENKMANGNQ

SEQ ID NO: 671656 - protein, 9 aa, Homo Sapiens
LIDLAYVSV

SEQ ID NO: 671657 - protein, 9 aa, Homo Sapiens
SPRTRTPGQ

SEQ ID NO: 671658 - protein, 9 aa, Homo Sapiens
SQRALVNMM

SEQ ID NO: 671659 - protein, 9 aa, Homo Sapiens
NRQSQTTCV

SEQ ID NO: 671660 - protein, 9 aa, Homo Sapiens
QFKETCSSK

SEQ ID NO: 671661 - protein, 9 aa, Homo Sapiens
PPSPCLSLG

SEQ ID NO: 671662 - protein, 9 aa, Homo Sapiens
QEALVKRHS

SEQ ID NO: 671663 - protein, 9 aa, Homo Sapiens
SKSPDFGLL

SEQ ID NO: 671664 - protein, 9 aa, Homo Sapiens
QTSLTMMQA

SEQ ID NO: 671665 - protein, 9 aa, Homo Sapiens
TEAVTFFAN

SEQ ID NO: 671666 - protein, 9 aa, Homo Sapiens
GLDGGRRGH

SEQ ID NO: 671667 - protein, 9 aa, Homo Sapiens
WNRSLLNKY

SEQ ID NO: 671668 - protein, 9 aa, Homo Sapiens
VQVLEYPWV

SEQ ID NO: 671669 - protein, 9 aa, Homo Sapiens
LPPSRGCKA

SEQ ID NO: 671670 - protein, 9 aa, Homo Sapiens
MASYFNSCS

SEQ ID NO: 671671 - protein, 9 aa, Homo Sapiens
APPQTTAAP

SEQ ID NO: 671672 - protein, 9 aa, Homo Sapiens
MLTLTSNCE

SEQ ID NO: 671673 - protein, 9 aa, Homo Sapiens
AEFLERREP

SEQ ID NO: 671674 - protein, 9 aa, Homo Sapiens
EAAENYRRL

SEQ ID NO: 671675 - protein, 9 aa, Homo Sapiens
GKELLTRGA

SEQ ID NO: 671676 - protein, 9 aa, Homo Sapiens
PTILLWGAR

SEQ ID NO: 671677 - protein, 9 aa, Homo Sapiens
KVFENKMAN

SEQ ID NO: 671678 - protein, 9 aa, Homo Sapiens
IERKKQEEP

SEQ ID NO: 671679 - protein, 9 aa, Homo Sapiens
QTPGHRLVP

SEQ ID NO: 671680 - protein, 9 aa, Homo Sapiens
KDAHPSVAK

SEQ ID NO: 671681 - protein, 9 aa, Homo Sapiens
VEEINHAER

SEQ ID NO: 671682 - protein, 9 aa, Homo Sapiens
THGGCPLEP

SEQ ID NO: 671683 - protein, 9 aa, Homo Sapiens
YVYCSPVTK

SEQ ID NO: 671684 - protein, 9 aa, Homo Sapiens
PAGPFEIPV

SEQ ID NO: 671685 - protein, 9 aa, Homo Sapiens
MCGHSGGLS

SEQ ID NO: 671686 - protein, 9 aa, Homo Sapiens
KNEQLKALN

SEQ ID NO: 671687 - protein, 9 aa, Homo Sapiens
SRPGCLWRT

SEQ ID NO: 671688 - protein, 9 aa, Homo Sapiens
APGNREDPA

SEQ ID NO: 671689 - protein, 9 aa, Homo Sapiens
GFKPKYDGQ

SEQ ID NO: 671690 - protein, 9 aa, Homo Sapiens
WGRPEESRV

SEQ ID NO: 671691 - protein, 9 aa, Homo Sapiens
NLFVRDRCG

SEQ ID NO: 671692 - protein, 9 aa, Homo Sapiens
DRSREDMIY

SEQ ID NO: 671693 - protein, 9 aa, Homo Sapiens
CVPRLTLKK

SEQ ID NO: 671694 - protein, 9 aa, Homo Sapiens
DTIPEDFQK

SEQ ID NO: 671695 - protein, 9 aa, Homo Sapiens
HCFKMSKVA

SEQ ID NO: 671696 - protein, 9 aa, Homo Sapiens
EPWRRLLHF

SEQ ID NO: 671697 - protein, 9 aa, Homo Sapiens
TASCFRPSS

SEQ ID NO: 671698 - protein, 9 aa, Homo Sapiens
FSVPAWGSQ

SEQ ID NO: 671699 - protein, 9 aa, Homo Sapiens
VPCLLSSPR

SEQ ID NO: 671700 - protein, 9 aa, Homo Sapiens
VTFFANHDD

SEQ ID NO: 671701 - protein, 9 aa, Homo Sapiens
AVRLIKDSL

SEQ ID NO: 671702 - protein, 9 aa, Homo Sapiens
LLWGARYDK

SEQ ID NO: 671703 - protein, 9 aa, Homo Sapiens
RPTPGAGQR

SEQ ID NO: 671704 - protein, 9 aa, Homo Sapiens
IYIKLEKPQ

SEQ ID NO: 671705 - protein, 9 aa, Homo Sapiens
LGDWLAEAF

SEQ ID NO: 671706 - protein, 9 aa, Homo Sapiens
MRKFLGELH

SEQ ID NO: 671707 - protein, 9 aa, Homo Sapiens
RITGGMEAQ

SEQ ID NO: 671708 - protein, 9 aa, Homo Sapiens
RSSCEFSCE

SEQ ID NO: 671709 - protein, 9 aa, Homo Sapiens
ELPVHVPAR

SEQ ID NO: 671710 - protein, 9 aa, Homo Sapiens
NKIGEEQRK

SEQ ID NO: 671711 - protein, 9 aa, Homo Sapiens
PGARQPPLT

SEQ ID NO: 671712 - protein, 9 aa, Homo Sapiens
AEKDSAFLA

SEQ ID NO: 671713 - protein, 9 aa, Homo Sapiens
QVLEYPWVN

SEQ ID NO: 671714 - protein, 9 aa, Homo Sapiens
GFRKAHKPW

SEQ ID NO: 671715 - protein, 9 aa, Homo Sapiens
NAQIDRHCF

SEQ ID NO: 671716 - protein, 9 aa, Homo Sapiens
DSSYLQEGI

SEQ ID NO: 671717 - protein, 9 aa, Homo Sapiens
GGDRTVGWI

SEQ ID NO: 671718 - protein, 9 aa, Homo Sapiens
QQPLNVTVC

SEQ ID NO: 671719 - protein, 9 aa, Homo Sapiens
DARRWQEQI

SEQ ID NO: 671720 - protein, 9 aa, Homo Sapiens
ASETASLPI

SEQ ID NO: 671721 - protein, 9 aa, Homo Sapiens
HFLPRELNG

SEQ ID NO: 671722 - protein, 9 aa, Homo Sapiens
YFNSCSVNE

SEQ ID NO: 671723 - protein, 9 aa, Homo Sapiens
PRLTLKKLV

SEQ ID NO: 671724 - protein, 9 aa, Homo Sapiens
GGPEPWTQL

SEQ ID NO: 671725 - protein, 9 aa, Homo Sapiens
LQDARRWQE

SEQ ID NO: 671726 - protein, 9 aa, Homo Sapiens
PSRGCKAGP

SEQ ID NO: 671727 - protein, 9 aa, Homo Sapiens
ELKGYSIAF

SEQ ID NO: 671728 - protein, 9 aa, Homo Sapiens
LDTTFILRL

SEQ ID NO: 671729 - protein, 9 aa, Homo Sapiens
ETPEASISL

SEQ ID NO: 671730 - protein, 9 aa, Homo Sapiens
HSPLQAPGM

SEQ ID NO: 671731 - protein, 9 aa, Homo Sapiens
LALQRRKAP

SEQ ID NO: 671732 - protein, 9 aa, Homo Sapiens
NPAEQADLK

SEQ ID NO: 671733 - protein, 9 aa, Homo Sapiens
TTSAGWDVL

SEQ ID NO: 671734 - protein, 9 aa, Homo Sapiens
LQHLQTLTQ

SEQ ID NO: 671735 - protein, 9 aa, Homo Sapiens
TDSDKRDDA

SEQ ID NO: 671736 - protein, 9 aa, Homo Sapiens
VHVPARPGG

SEQ ID NO: 671737 - protein, 9 aa, Homo Sapiens
KAGPLAHQD

SEQ ID NO: 671738 - protein, 9 aa, Homo Sapiens
TGGHKKRVL

SEQ ID NO: 671739 - protein, 9 aa, Homo Sapiens
TPETVVPAS

SEQ ID NO: 671740 - protein, 9 aa, Homo Sapiens
KDMCGHSGG

SEQ ID NO: 671741 - protein, 9 aa, Homo Sapiens
EDQGAQGYV

SEQ ID NO: 671742 - protein, 9 aa, Homo Sapiens
DTLIQRTNR

SEQ ID NO: 671743 - protein, 9 aa, Homo Sapiens
SEDEGSVLD

SEQ ID NO: 671744 - protein, 9 aa, Homo Sapiens
CYIFHHRLP

SEQ ID NO: 671745 - protein, 9 aa, Homo Sapiens
TGVGAMLEK

SEQ ID NO: 671746 - protein, 9 aa, Homo Sapiens
QAARDRNTK

SEQ ID NO: 671747 - protein, 9 aa, Homo Sapiens
STLGGQGVG

SEQ ID NO: 671748 - protein, 9 aa, Homo Sapiens
HTEHCVHLT

SEQ ID NO: 671749 - protein, 9 aa, Homo Sapiens
MEEQQDLPE

SEQ ID NO: 671750 - protein, 9 aa, Homo Sapiens
FSLTLNTHK

SEQ ID NO: 671751 - protein, 9 aa, Homo Sapiens
VHKGQDAGY

SEQ ID NO: 671752 - protein, 9 aa, Homo Sapiens
VETSHKISP

SEQ ID NO: 671753 - protein, 9 aa, Homo Sapiens
SSKSPDFGL

SEQ ID NO: 671754 - protein, 9 aa, Homo Sapiens
YETFVCEKS

SEQ ID NO: 671755 - protein, 9 aa, Homo Sapiens
SYFNSCSVN

SEQ ID NO: 671756 - protein, 9 aa, Homo Sapiens
RYRSSCEFS

SEQ ID NO: 671757 - protein, 9 aa, Homo Sapiens
PKDSTTLEI

SEQ ID NO: 671758 - protein, 9 aa, Homo Sapiens
RQPPLTRPT

SEQ ID NO: 671759 - protein, 9 aa, Homo Sapiens
GKAFNCVSS

SEQ ID NO: 671760 - protein, 9 aa, Homo Sapiens
YCVSTGTAS

SEQ ID NO: 671761 - protein, 9 aa, Homo Sapiens
SAGWDVLLA

SEQ ID NO: 671762 - protein, 9 aa, Homo Sapiens
MATEKTQLR

SEQ ID NO: 671763 - protein, 9 aa, Homo Sapiens
SVLDTTFIL

SEQ ID NO: 671764 - protein, 9 aa, Homo Sapiens
SISLPKWNT

SEQ ID NO: 671765 - protein, 9 aa, Homo Sapiens
SPTPLSWRL

SEQ ID NO: 671766 - protein, 9 aa, Homo Sapiens
DVFERAKKA

SEQ ID NO: 671767 - protein, 9 aa, Homo Sapiens
IKNPAEQAD

SEQ ID NO: 671768 - protein, 9 aa, Homo Sapiens
RLAACGAQA

SEQ ID NO: 671769 - protein, 9 aa, Homo Sapiens
VGQGKDIST

SEQ ID NO: 671770 - protein, 9 aa, Homo Sapiens
EIVGDVQGK

SEQ ID NO: 671771 - protein, 9 aa, Homo Sapiens
CGKAFNCVS

SEQ ID NO: 671772 - protein, 9 aa, Homo Sapiens
QSPIERKKQ

SEQ ID NO: 671773 - protein, 9 aa, Homo Sapiens
LNHKMPPDI

SEQ ID NO: 671774 - protein, 9 aa, Homo Sapiens
PVDVHEYTL

SEQ ID NO: 671775 - protein, 9 aa, Homo Sapiens
GAGAPGNRE

SEQ ID NO: 671776 - protein, 9 aa, Homo Sapiens
VWGRMLTWL

SEQ ID NO: 671777 - protein, 9 aa, Homo Sapiens
EWLPHTEHC

SEQ ID NO: 671778 - protein, 9 aa, Homo Sapiens
GCPLEPPYN

SEQ ID NO: 671779 - protein, 9 aa, Homo Sapiens
VLDTTFILR

SEQ ID NO: 671780 - protein, 9 aa, Homo Sapiens
CDGTVCYGP

SEQ ID NO: 671781 - protein, 9 aa, Homo Sapiens
CINRQSQTT

SEQ ID NO: 671782 - protein, 9 aa, Homo Sapiens
LSYLEQSKC

SEQ ID NO: 671783 - protein, 9 aa, Homo Sapiens
KQIENLEET

SEQ ID NO: 671784 - protein, 9 aa, Homo Sapiens
VEPTTGVIG

SEQ ID NO: 671785 - protein, 9 aa, Homo Sapiens
TLEIKKDEK

SEQ ID NO: 671786 - protein, 9 aa, Homo Sapiens
MYPPLNETL

SEQ ID NO: 671787 - protein, 9 aa, Homo Sapiens
GKGNSAGGA

SEQ ID NO: 671788 - protein, 9 aa, Homo Sapiens
PRPRKQSPG

SEQ ID NO: 671789 - protein, 9 aa, Homo Sapiens
RNLFVRDRC

SEQ ID NO: 671790 - protein, 9 aa, Homo Sapiens
KVIRFIPKK

SEQ ID NO: 671791 - protein, 9 aa, Homo Sapiens
FGVDKQLLS

SEQ ID NO: 671792 - protein, 9 aa, Homo Sapiens
TSHKISPTE

SEQ ID NO: 671793 - protein, 9 aa, Homo Sapiens
SPSSVEDDW

SEQ ID NO: 671794 - protein, 9 aa, Homo Sapiens
GPATMGAFY

SEQ ID NO: 671795 - protein, 9 aa, Homo Sapiens
NCTSPAFRK

SEQ ID NO: 671796 - protein, 9 aa, Homo Sapiens
DDEVDDELA

SEQ ID NO: 671797 - protein, 9 aa, Homo Sapiens
FNFVGKRLG

SEQ ID NO: 671798 - protein, 9 aa, Homo Sapiens
ELNGRLRMN

SEQ ID NO: 671799 - protein, 9 aa, Homo Sapiens
SNPSELLCP

SEQ ID NO: 671800 - protein, 9 aa, Homo Sapiens
TSGILVSVL

SEQ ID NO: 671801 - protein, 9 aa, Homo Sapiens
PREVIAPSG

SEQ ID NO: 671802 - protein, 9 aa, Homo Sapiens
VLDQGGSGT

SEQ ID NO: 671803 - protein, 9 aa, Homo Sapiens
VHGTKMVSH

SEQ ID NO: 671804 - protein, 9 aa, Homo Sapiens
PPLSPSSVE

SEQ ID NO: 671805 - protein, 9 aa, Homo Sapiens
SDRDLGVNG

SEQ ID NO: 671806 - protein, 9 aa, Homo Sapiens
SPELQPSTS

SEQ ID NO: 671807 - protein, 9 aa, Homo Sapiens
MMALSQSDP

SEQ ID NO: 671808 - protein, 9 aa, Homo Sapiens
AYQVFGSVC

SEQ ID NO: 671809 - protein, 9 aa, Homo Sapiens
IRFIPKKEE

SEQ ID NO: 671810 - protein, 9 aa, Homo Sapiens
SIAFMGSDV

SEQ ID NO: 671811 - protein, 9 aa, Homo Sapiens
VQGKGLMIG

SEQ ID NO: 671812 - protein, 9 aa, Homo Sapiens
LDSSLQGPL

SEQ ID NO: 671813 - protein, 9 aa, Homo Sapiens
KPEDAVDFG

SEQ ID NO: 671814 - protein, 9 aa, Homo Sapiens
AAPGVQDIS

SEQ ID NO: 671815 - protein, 9 aa, Homo Sapiens
LNEFCSSDS

SEQ ID NO: 671816 - protein, 9 aa, Homo Sapiens
LQRRKAPPA

SEQ ID NO: 671817 - protein, 9 aa, Homo Sapiens
VCQERFCCC

SEQ ID NO: 671818 - protein, 9 aa, Homo Sapiens
PLSSSSFRS

SEQ ID NO: 671819 - protein, 9 aa, Homo Sapiens
RVLQTPGHR

SEQ ID NO: 671820 - protein, 9 aa, Homo Sapiens
IRSKVFSIF

SEQ ID NO: 671821 - protein, 9 aa, Homo Sapiens
PVLGKELLT

SEQ ID NO: 671822 - protein, 9 aa, Homo Sapiens
ASLPIIVSI

SEQ ID NO: 671823 - protein, 9 aa, Homo Sapiens
FYININKEE

SEQ ID NO: 671824 - protein, 9 aa, Homo Sapiens
CGAQAAAYG

SEQ ID NO: 671825 - protein, 9 aa, Homo Sapiens
CFRPSSSVS

SEQ ID NO: 671826 - protein, 9 aa, Homo Sapiens
YSQPQQARE

SEQ ID NO: 671827 - protein, 9 aa, Homo Sapiens
KVFSIFPEE

SEQ ID NO: 671828 - protein, 9 aa, Homo Sapiens
SSAPPQTTA

SEQ ID NO: 671829 - protein, 9 aa, Homo Sapiens
SYLQEGIMV

SEQ ID NO: 671830 - protein, 9 aa, Homo Sapiens
EMYPPLNET

SEQ ID NO: 671831 - protein, 9 aa, Homo Sapiens
KSSGYKFSK

SEQ ID NO: 671832 - protein, 9 aa, Homo Sapiens
NLEETETQL

SEQ ID NO: 671833 - protein, 9 aa, Homo Sapiens
LSPRTRTPG

SEQ ID NO: 671834 - protein, 9 aa, Homo Sapiens
QDISGLPSG

SEQ ID NO: 671835 - protein, 9 aa, Homo Sapiens
GEWLPHTEH

SEQ ID NO: 671836 - protein, 9 aa, Homo Sapiens
SPMAMLTLT

SEQ ID NO: 671837 - protein, 9 aa, Homo Sapiens
WDPHNFKSV

SEQ ID NO: 671838 - protein, 9 aa, Homo Sapiens
QWNKWEVVA

SEQ ID NO: 671839 - protein, 9 aa, Homo Sapiens
APSGSEPWL

SEQ ID NO: 671840 - protein, 9 aa, Homo Sapiens
CVLGKDCRF

SEQ ID NO: 671841 - protein, 9 aa, Homo Sapiens
LSPSSVEDD

SEQ ID NO: 671842 - protein, 9 aa, Homo Sapiens
DLGPPVMEK

SEQ ID NO: 671843 - protein, 9 aa, Homo Sapiens
GQLHSSLPP

SEQ ID NO: 671844 - protein, 9 aa, Homo Sapiens
VYPNITNPE

SEQ ID NO: 671845 - protein, 9 aa, Homo Sapiens
HQDQVNRRP

SEQ ID NO: 671846 - protein, 9 aa, Homo Sapiens
YTPGHTNDH

SEQ ID NO: 671847 - protein, 9 aa, Homo Sapiens
AFRKLSLLL

SEQ ID NO: 671848 - protein, 9 aa, Homo Sapiens
AYVSVATMK

SEQ ID NO: 671849 - protein, 9 aa, Homo Sapiens
VLTEPPTLQ

SEQ ID NO: 671850 - protein, 9 aa, Homo Sapiens
FKNSLPDAL

SEQ ID NO: 671851 - protein, 9 aa, Homo Sapiens
VQALPRAVR

SEQ ID NO: 671852 - protein, 9 aa, Homo Sapiens
EPTTGVIGI

SEQ ID NO: 671853 - protein, 9 aa, Homo Sapiens
MMLALMAYD

SEQ ID NO: 671854 - protein, 9 aa, Homo Sapiens
DRDLGVNGQ

SEQ ID NO: 671855 - protein, 9 aa, Homo Sapiens
GKTLGDSPI

SEQ ID NO: 671856 - protein, 9 aa, Homo Sapiens
ATLRAPAHK

SEQ ID NO: 671857 - protein, 9 aa, Homo Sapiens
LLDSSLQGP

SEQ ID NO: 671858 - protein, 9 aa, Homo Sapiens
KGEKNGMGQ

SEQ ID NO: 671859 - protein, 9 aa, Homo Sapiens
LPLSKDAHP

SEQ ID NO: 671860 - protein, 9 aa, Homo Sapiens
LYTPGHTND

SEQ ID NO: 671861 - protein, 9 aa, Homo Sapiens
APEPLLAPP

SEQ ID NO: 671862 - protein, 9 aa, Homo Sapiens
LPPVLGKEL

SEQ ID NO: 671863 - protein, 9 aa, Homo Sapiens
SALSHLPES

SEQ ID NO: 671864 - protein, 9 aa, Homo Sapiens
AVQQDLYCF

SEQ ID NO: 671865 - protein, 9 aa, Homo Sapiens
LWAVRSTQD

SEQ ID NO: 671866 - protein, 9 aa, Homo Sapiens
NPFRVTRAA

SEQ ID NO: 671867 - protein, 9 aa, Homo Sapiens
QRRALRSNR

SEQ ID NO: 671868 - protein, 9 aa, Homo Sapiens
HSLMKAEDN

SEQ ID NO: 671869 - protein, 9 aa, Homo Sapiens
EYPWVNDDG

SEQ ID NO: 671870 - protein, 9 aa, Homo Sapiens
SVSDRDLGV

SEQ ID NO: 671871 - protein, 9 aa, Homo Sapiens
EEQQDLPEQ

SEQ ID NO: 671872 - protein, 9 aa, Homo Sapiens
LPVHVPARP

SEQ ID NO: 671873 - protein, 9 aa, Homo Sapiens
ISRHYRKAH

SEQ ID NO: 671874 - protein, 9 aa, Homo Sapiens
KAFNCVSSL

SEQ ID NO: 671875 - protein, 9 aa, Homo Sapiens
RVLWRSRKW

SEQ ID NO: 671876 - protein, 9 aa, Homo Sapiens
LQTPGHRLV

SEQ ID NO: 671877 - protein, 9 aa, Homo Sapiens
CEKSKADQL

SEQ ID NO: 671878 - protein, 9 aa, Homo Sapiens
EPVEIQDGL

SEQ ID NO: 671879 - protein, 9 aa, Homo Sapiens
GGRRGHEPW

SEQ ID NO: 671880 - protein, 9 aa, Homo Sapiens
RAFTNMPFQ

SEQ ID NO: 671881 - protein, 9 aa, Homo Sapiens
GAAAPCAGE

SEQ ID NO: 671882 - protein, 9 aa, Homo Sapiens
SMGLPGTVY

SEQ ID NO: 671883 - protein, 9 aa, Homo Sapiens
KTVSKDPQN

SEQ ID NO: 671884 - protein, 9 aa, Homo Sapiens
SCVPRLTLK

SEQ ID NO: 671885 - protein, 9 aa, Homo Sapiens
MALSQSDPT

SEQ ID NO: 671886 - protein, 9 aa, Homo Sapiens
ARRWQEQIQ

SEQ ID NO: 671887 - protein, 9 aa, Homo Sapiens
FKVWSLCRD

SEQ ID NO: 671888 - protein, 9 aa, Homo Sapiens
RRTLHLLQW

SEQ ID NO: 671889 - protein, 9 aa, Homo Sapiens
PQPELPVHV

SEQ ID NO: 671890 - protein, 9 aa, Homo Sapiens
SLFLQDDEV

SEQ ID NO: 671891 - protein, 9 aa, Homo Sapiens
QVPLSSSSF

SEQ ID NO: 671892 - protein, 9 aa, Homo Sapiens
HSSLPPVLG

SEQ ID NO: 671893 - protein, 9 aa, Homo Sapiens
GVFRVEKFG

SEQ ID NO: 671894 - protein, 9 aa, Homo Sapiens
ILALQRRKA

SEQ ID NO: 671895 - protein, 9 aa, Homo Sapiens
EEISRHYRK

SEQ ID NO: 671896 - protein, 9 aa, Homo Sapiens
EGPECNTPI

SEQ ID NO: 671897 - protein, 9 aa, Homo Sapiens
KKTSCFKTK

SEQ ID NO: 671898 - protein, 9 aa, Homo Sapiens
AMLTLTSNC

SEQ ID NO: 671899 - protein, 9 aa, Homo Sapiens
LSAAPPAPV

SEQ ID NO: 671900 - protein, 9 aa, Homo Sapiens
TVLPWSASA

SEQ ID NO: 671901 - protein, 9 aa, Homo Sapiens
LRVVKNKIG

SEQ ID NO: 671902 - protein, 9 aa, Homo Sapiens
TGDTMETAK

SEQ ID NO: 671903 - protein, 9 aa, Homo Sapiens
LTGSPTPLS

SEQ ID NO: 671904 - protein, 9 aa, Homo Sapiens
CYGPQGPAT

SEQ ID NO: 671905 - protein, 9 aa, Homo Sapiens
GVLIDLAYV

SEQ ID NO: 671906 - protein, 9 aa, Homo Sapiens
PGEWLPHTE

SEQ ID NO: 671907 - protein, 9 aa, Homo Sapiens
LLQLTCGDH

SEQ ID NO: 671908 - protein, 9 aa, Homo Sapiens
KDSAFLAKD

SEQ ID NO: 671909 - protein, 9 aa, Homo Sapiens
SIVRTNRAD

SEQ ID NO: 671910 - protein, 9 aa, Homo Sapiens
RDGDDRRSR

SEQ ID NO: 671911 - protein, 9 aa, Homo Sapiens
TAFARLLHP

SEQ ID NO: 671912 - protein, 9 aa, Homo Sapiens
SIDAMRKFL

SEQ ID NO: 671913 - protein, 9 aa, Homo Sapiens
QSPPPSPCL

SEQ ID NO: 671914 - protein, 9 aa, Homo Sapiens
DWLAEAFAE

SEQ ID NO: 671915 - protein, 9 aa, Homo Sapiens
TSCFKTKST

SEQ ID NO: 671916 - protein, 9 aa, Homo Sapiens
NSTYLVCPQ

SEQ ID NO: 671917 - protein, 9 aa, Homo Sapiens
TAQPKKVNK

SEQ ID NO: 671918 - protein, 9 aa, Homo Sapiens
IEQLHRIFK

SEQ ID NO: 671919 - protein, 9 aa, Homo Sapiens
PGAGQRLLR

SEQ ID NO: 671920 - protein, 9 aa, Homo Sapiens
SPKTMRKFL

SEQ ID NO: 671921 - protein, 9 aa, Homo Sapiens
EFEIVGDVQ

SEQ ID NO: 671922 - protein, 9 aa, Homo Sapiens
CQIRSKVFS

SEQ ID NO: 671923 - protein, 9 aa, Homo Sapiens
ALVKRHSAL

SEQ ID NO: 671924 - protein, 9 aa, Homo Sapiens
KLNQLWQKA

SEQ ID NO: 671925 - protein, 9 aa, Homo Sapiens
WLLHHGGGN

SEQ ID NO: 671926 - protein, 9 aa, Homo Sapiens
YAPTILLWG

SEQ ID NO: 671927 - protein, 9 aa, Homo Sapiens
LRKWFCDKP

SEQ ID NO: 671928 - protein, 9 aa, Homo Sapiens
GSLLQLTCG

SEQ ID NO: 671929 - protein, 9 aa, Homo Sapiens
CLIKNPAEQ

SEQ ID NO: 671930 - protein, 9 aa, Homo Sapiens
RPAYQVFGS

SEQ ID NO: 671931 - protein, 9 aa, Homo Sapiens
GKSPKYISS

SEQ ID NO: 671932 - protein, 9 aa, Homo Sapiens
LNETLSQEV

SEQ ID NO: 671933 - protein, 9 aa, Homo Sapiens
QAGRSPQER

SEQ ID NO: 671934 - protein, 9 aa, Homo Sapiens
DSSLQGPLP

SEQ ID NO: 671935 - protein, 9 aa, Homo Sapiens
AKTVSKDPQ

SEQ ID NO: 671936 - protein, 9 aa, Homo Sapiens
PEDAVDFGI

SEQ ID NO: 671937 - protein, 9 aa, Homo Sapiens
EPGPKRQRG

SEQ ID NO: 671938 - protein, 9 aa, Homo Sapiens
NGVGQFQAG

SEQ ID NO: 671939 - protein, 9 aa, Homo Sapiens
NEIFKSLPV

SEQ ID NO: 671940 - protein, 9 aa, Homo Sapiens
DCDVIPDDP

SEQ ID NO: 671941 - protein, 9 aa, Homo Sapiens
IKELKETFE

SEQ ID NO: 671942 - protein, 9 aa, Homo Sapiens
TTDSDKRDD

SEQ ID NO: 671943 - protein, 9 aa, Homo Sapiens
FFSWKTQID

SEQ ID NO: 671944 - protein, 9 aa, Homo Sapiens
NFVGKRLGP

SEQ ID NO: 671945 - protein, 9 aa, Homo Sapiens
RREPECEHG

SEQ ID NO: 671946 - protein, 9 aa, Homo Sapiens
RALRSNRLL

SEQ ID NO: 671947 - protein, 9 aa, Homo Sapiens
SWGNERPYC

SEQ ID NO: 671948 - protein, 9 aa, Homo Sapiens
KKTRRRGRK

SEQ ID NO: 671949 - protein, 9 aa, Homo Sapiens
VLWRSRKWP

SEQ ID NO: 671950 - protein, 9 aa, Homo Sapiens
VKSVEIEKV

SEQ ID NO: 671951 - protein, 9 aa, Homo Sapiens
KELLTRGAQ

SEQ ID NO: 671952 - protein, 9 aa, Homo Sapiens
RPEESRVSS

SEQ ID NO: 671953 - protein, 9 aa, Homo Sapiens
MECATPSNK

SEQ ID NO: 671954 - protein, 9 aa, Homo Sapiens
CGGDRTVGW

SEQ ID NO: 671955 - protein, 9 aa, Homo Sapiens
GAGAAAPCA

SEQ ID NO: 671956 - protein, 9 aa, Homo Sapiens
FLNHKMPPD

SEQ ID NO: 671957 - protein, 9 aa, Homo Sapiens
NPSELLCPP

SEQ ID NO: 671958 - protein, 9 aa, Homo Sapiens
QKMELEQKV

SEQ ID NO: 671959 - protein, 9 aa, Homo Sapiens
VSRPTDKTV

SEQ ID NO: 671960 - protein, 9 aa, Homo Sapiens
HKDALTVTS

SEQ ID NO: 671961 - protein, 9 aa, Homo Sapiens
IQAKDMCGH

SEQ ID NO: 671962 - protein, 9 aa, Homo Sapiens
EQKVVLVQQ

SEQ ID NO: 671963 - protein, 9 aa, Homo Sapiens
NQQFLCVHE

SEQ ID NO: 671964 - protein, 9 aa, Homo Sapiens
VPSQLPPLT

SEQ ID NO: 671965 - protein, 9 aa, Homo Sapiens
AFPETGGFS

SEQ ID NO: 671966 - protein, 9 aa, Homo Sapiens
SQTEAVTFF

SEQ ID NO: 671967 - protein, 9 aa, Homo Sapiens
EIPVLHSLQ

SEQ ID NO: 671968 - protein, 9 aa, Homo Sapiens
NEQLKALNT

SEQ ID NO: 671969 - protein, 9 aa, Homo Sapiens
NSCSVNEFA

SEQ ID NO: 671970 - protein, 9 aa, Homo Sapiens
DQIEQLHRI

SEQ ID NO: 671971 - protein, 9 aa, Homo Sapiens
SLQHLQTLT

SEQ ID NO: 671972 - protein, 9 aa, Homo Sapiens
SNRFYSQPQ

SEQ ID NO: 671973 - protein, 9 aa, Homo Sapiens
FKCSHCDMC

SEQ ID NO: 671974 - protein, 9 aa, Homo Sapiens
VSQRALVNM

SEQ ID NO: 671975 - protein, 9 aa, Homo Sapiens
PPADVFERA

SEQ ID NO: 671976 - protein, 9 aa, Homo Sapiens
KKVNKMKRV

SEQ ID NO: 671977 - protein, 9 aa, Homo Sapiens
AAENYRRLF

SEQ ID NO: 671978 - protein, 9 aa, Homo Sapiens
DEGSVLDQG

SEQ ID NO: 671979 - protein, 9 aa, Homo Sapiens
CDKPLNATY

SEQ ID NO: 671980 - protein, 9 aa, Homo Sapiens
SREDMIYIK

SEQ ID NO: 671981 - protein, 9 aa, Homo Sapiens
RKWFCDKPL

SEQ ID NO: 671982 - protein, 9 aa, Homo Sapiens
GTVCYGPQG

SEQ ID NO: 671983 - protein, 9 aa, Homo Sapiens
ACPLPLGLL

SEQ ID NO: 671984 - protein, 9 aa, Homo Sapiens
PGGALCRCQ

SEQ ID NO: 671985 - protein, 9 aa, Homo Sapiens
SIEQEALVK

SEQ ID NO: 671986 - protein, 9 aa, Homo Sapiens
FLCVHEGMS

SEQ ID NO: 671987 - protein, 9 aa, Homo Sapiens
IIVETSHKI

SEQ ID NO: 671988 - protein, 9 aa, Homo Sapiens
NFCYSSIIV

SEQ ID NO: 671989 - protein, 9 aa, Homo Sapiens
CLLSSPRPN

SEQ ID NO: 671990 - protein, 9 aa, Homo Sapiens
FETPEASIS

SEQ ID NO: 671991 - protein, 9 aa, Homo Sapiens
LRPQPELPV

SEQ ID NO: 671992 - protein, 9 aa, Homo Sapiens
IEQEALVKR

SEQ ID NO: 671993 - protein, 9 aa, Homo Sapiens
QRTNREAFQ

SEQ ID NO: 671994 - protein, 9 aa, Homo Sapiens
YNRRNRWKR

SEQ ID NO: 671995 - protein, 9 aa, Homo Sapiens
YESLYDTLN

SEQ ID NO: 671996 - protein, 9 aa, Homo Sapiens
QEGRVCQER

SEQ ID NO: 671997 - protein, 9 aa, Homo Sapiens
CGHSGGLSG

SEQ ID NO: 671998 - protein, 9 aa, Homo Sapiens
AAPCAGELL

SEQ ID NO: 671999 - protein, 9 aa, Homo Sapiens
ESLYDTLNQ

SEQ ID NO: 672000 - protein, 9 aa, Homo Sapiens
FANHDDSRA

SEQ ID NO: 672001 - protein, 9 aa, Homo Sapiens
RSAFTTSNV

SEQ ID NO: 672002 - protein, 9 aa, Homo Sapiens
MPFQTNDFI

SEQ ID NO: 672003 - protein, 9 aa, Homo Sapiens
FAHEELGDD

SEQ ID NO: 672004 - protein, 9 aa, Homo Sapiens
GVGAMLEKR

SEQ ID NO: 672005 - protein, 9 aa, Homo Sapiens
GKPLLRWTN

SEQ ID NO: 672006 - protein, 9 aa, Homo Sapiens
DSSEKEHAI

SEQ ID NO: 672007 - protein, 9 aa, Homo Sapiens
KEEEAYALK

SEQ ID NO: 672008 - protein, 9 aa, Homo Sapiens
DQVNRRPSR

SEQ ID NO: 672009 - protein, 9 aa, Homo Sapiens
QTTAAPPTP

SEQ ID NO: 672010 - protein, 9 aa, Homo Sapiens
TILLWGARY

SEQ ID NO: 672011 - protein, 9 aa, Homo Sapiens
VVKNKIGEE

SEQ ID NO: 672012 - protein, 9 aa, Homo Sapiens
ISIDAMRKF

SEQ ID NO: 672013 - protein, 9 aa, Homo Sapiens
LECSLKVYV

SEQ ID NO: 672014 - protein, 9 aa, Homo Sapiens
MGLPGTVYP

SEQ ID NO: 672015 - protein, 9 aa, Homo Sapiens
HWGACPLPL

SEQ ID NO: 672016 - protein, 9 aa, Homo Sapiens
ILINNPLVF

SEQ ID NO: 672017 - protein, 9 aa, Homo Sapiens
TRIFVIIPK

SEQ ID NO: 672018 - protein, 9 aa, Homo Sapiens
SERFYRKCR

SEQ ID NO: 672019 - protein, 9 aa, Homo Sapiens
KAFTFSLTL

SEQ ID NO: 672020 - protein, 9 aa, Homo Sapiens
VHEYTLTHL

SEQ ID NO: 672021 - protein, 9 aa, Homo Sapiens
ECYVSRPTD

SEQ ID NO: 672022 - protein, 9 aa, Homo Sapiens
AKFKEEPVE

SEQ ID NO: 672023 - protein, 9 aa, Homo Sapiens
TTSNVVRMH

SEQ ID NO: 672024 - protein, 9 aa, Homo Sapiens
TQEGRVCQE

SEQ ID NO: 672025 - protein, 9 aa, Homo Sapiens
PRELNGRLR

SEQ ID NO: 672026 - protein, 9 aa, Homo Sapiens
PAEQADLKM

SEQ ID NO: 672027 - protein, 9 aa, Homo Sapiens
FRPSSSVSL

SEQ ID NO: 672028 - protein, 9 aa, Homo Sapiens
MEKLNQLWQ

SEQ ID NO: 672029 - protein, 9 aa, Homo Sapiens
SYLEQSKCI

SEQ ID NO: 672030 - protein, 9 aa, Homo Sapiens
KDSSYLQEG

SEQ ID NO: 672031 - protein, 9 aa, Homo Sapiens
LQGPLPKET

SEQ ID NO: 672032 - protein, 9 aa, Homo Sapiens
IQMVSFRIN

SEQ ID NO: 672033 - protein, 9 aa, Homo Sapiens
EPWTQLYDW

SEQ ID NO: 672034 - protein, 9 aa, Homo Sapiens
VDGNGVGQF

SEQ ID NO: 672035 - protein, 9 aa, Homo Sapiens
GHRLVPSQL

SEQ ID NO: 672036 - protein, 8 aa, Homo Sapiens
AAEDVIIC

SEQ ID NO: 672037 - protein, 9 aa, Homo Sapiens
PEPLLAPPG

SEQ ID NO: 672038 - protein, 9 aa, Homo Sapiens
SPSCVPRLT

SEQ ID NO: 672039 - protein, 9 aa, Homo Sapiens
YGPQGPATM

SEQ ID NO: 672040 - protein, 9 aa, Homo Sapiens
QIDRHCFKM

SEQ ID NO: 672041 - protein, 9 aa, Homo Sapiens
GGGSGGKSR

SEQ ID NO: 672042 - protein, 9 aa, Homo Sapiens
QTNLVSYPR

SEQ ID NO: 672043 - protein, 9 aa, Homo Sapiens
EVMMLALMA

SEQ ID NO: 672044 - protein, 9 aa, Homo Sapiens
SPAPAGLSA

SEQ ID NO: 672045 - protein, 9 aa, Homo Sapiens
DALPSSGPR

SEQ ID NO: 672046 - protein, 9 aa, Homo Sapiens
SPIERKKQE

SEQ ID NO: 672047 - protein, 9 aa, Homo Sapiens
HFKVWSLCR

SEQ ID NO: 672048 - protein, 9 aa, Homo Sapiens
WPAGPFEIP

SEQ ID NO: 672049 - protein, 9 aa, Homo Sapiens
KDCRFLGKC

SEQ ID NO: 672050 - protein, 9 aa, Homo Sapiens
LGKDCRFLG

SEQ ID NO: 672051 - protein, 9 aa, Homo Sapiens
IASDDALNH

SEQ ID NO: 672052 - protein, 9 aa, Homo Sapiens
ISVSDRDLG

SEQ ID NO: 672053 - protein, 9 aa, Homo Sapiens
FTPSELGKT

SEQ ID NO: 672054 - protein, 9 aa, Homo Sapiens
TPSNKQGMP

SEQ ID NO: 672055 - protein, 9 aa, Homo Sapiens
CCYLWAVRS

SEQ ID NO: 672056 - protein, 9 aa, Homo Sapiens
ACSIFDFKN

SEQ ID NO: 672057 - protein, 9 aa, Homo Sapiens
KETFEEKTK

SEQ ID NO: 672058 - protein, 9 aa, Homo Sapiens
NINKEENSA

SEQ ID NO: 672059 - protein, 9 aa, Homo Sapiens
QPLNEFCSS

SEQ ID NO: 672060 - protein, 9 aa, Homo Sapiens
TDKTVFLVF

SEQ ID NO: 672061 - protein, 9 aa, Homo Sapiens
CSSDSQDKA

SEQ ID NO: 672062 - protein, 9 aa, Homo Sapiens
SSYLQEGIM

SEQ ID NO: 672063 - protein, 9 aa, Homo Sapiens
DTVVHKGQD

SEQ ID NO: 672064 - protein, 9 aa, Homo Sapiens
LHSSLPPVL

SEQ ID NO: 672065 - protein, 9 aa, Homo Sapiens
DDRRSRLVL

SEQ ID NO: 672066 - protein, 9 aa, Homo Sapiens
RELNGRLRM

SEQ ID NO: 672067 - protein, 9 aa, Homo Sapiens
SEAKKTSCF

SEQ ID NO: 672068 - protein, 9 aa, Homo Sapiens
RSRLVLSFD

SEQ ID NO: 672069 - protein, 9 aa, Homo Sapiens
TAFPETGGF

SEQ ID NO: 672070 - protein, 9 aa, Homo Sapiens
RLTLKKLVV

SEQ ID NO: 672071 - protein, 9 aa, Homo Sapiens
WQGAEKDSA

SEQ ID NO: 672072 - protein, 9 aa, Homo Sapiens
KVWVLTGDT

SEQ ID NO: 672073 - protein, 9 aa, Homo Sapiens
PMYFFISQH

SEQ ID NO: 672074 - protein, 9 aa, Homo Sapiens
GNGVGQFQA

SEQ ID NO: 672075 - protein, 9 aa, Homo Sapiens
FISQHALMD

SEQ ID NO: 672076 - protein, 9 aa, Homo Sapiens
VPVDVHEYT

SEQ ID NO: 672077 - protein, 9 aa, Homo Sapiens
QDARRWQEQ

SEQ ID NO: 672078 - protein, 9 aa, Homo Sapiens
CSIFDFKNS

SEQ ID NO: 672079 - protein, 9 aa, Homo Sapiens
PGTVYPVIK

SEQ ID NO: 672080 - protein, 9 aa, Homo Sapiens
SNAILALQR

SEQ ID NO: 672081 - protein, 9 aa, Homo Sapiens
RVLRSSFLN

SEQ ID NO: 672082 - protein, 9 aa, Homo Sapiens
LIKNPAEQA

SEQ ID NO: 672083 - protein, 9 aa, Homo Sapiens
LGLLLPGYL

SEQ ID NO: 672084 - protein, 9 aa, Homo Sapiens
RSGKVFENK

SEQ ID NO: 672085 - protein, 9 aa, Homo Sapiens
KRLGPRGNS

SEQ ID NO: 672086 - protein, 9 aa, Homo Sapiens
RHCFKMSKV

SEQ ID NO: 672087 - protein, 9 aa, Homo Sapiens
AVDFGISLL

SEQ ID NO: 672088 - protein, 9 aa, Homo Sapiens
GLPGTVYPV

SEQ ID NO: 672089 - protein, 9 aa, Homo Sapiens
WSWGNERPY

SEQ ID NO: 672090 - protein, 9 aa, Homo Sapiens
YPWGTKSHP

SEQ ID NO: 672091 - protein, 9 aa, Homo Sapiens
HALMDLMYL

SEQ ID NO: 672092 - protein, 9 aa, Homo Sapiens
SSSAPPQTT

SEQ ID NO: 672093 - protein, 9 aa, Homo Sapiens
STQEGRVCQ

SEQ ID NO: 672094 - protein, 9 aa, Homo Sapiens
APGLLMAVQ

SEQ ID NO: 672095 - protein, 9 aa, Homo Sapiens
FQKFQTQNF

SEQ ID NO: 672096 - protein, 9 aa, Homo Sapiens
KLSLLLDGL

SEQ ID NO: 672097 - protein, 9 aa, Homo Sapiens
TFCFMVSRM

SEQ ID NO: 672098 - protein, 9 aa, Homo Sapiens
PSIEQEALV

SEQ ID NO: 672099 - protein, 9 aa, Homo Sapiens
LSHLSFVNF

SEQ ID NO: 672100 - protein, 9 aa, Homo Sapiens
WVLTGDTME

SEQ ID NO: 672101 - protein, 9 aa, Homo Sapiens
IQDKLRRIK

SEQ ID NO: 672102 - protein, 9 aa, Homo Sapiens
SHKISPTED

SEQ ID NO: 672103 - protein, 9 aa, Homo Sapiens
HYRKAHSCY

SEQ ID NO: 672104 - protein, 9 aa, Homo Sapiens
FTFTPSELG

SEQ ID NO: 672105 - protein, 9 aa, Homo Sapiens
VIIPKSYTE

SEQ ID NO: 672106 - protein, 9 aa, Homo Sapiens
WLAEAFAEE

SEQ ID NO: 672107 - protein, 9 aa, Homo Sapiens
SHCLKNEVT

SEQ ID NO: 672108 - protein, 9 aa, Homo Sapiens
RGKELLWGR

SEQ ID NO: 672109 - protein, 9 aa, Homo Sapiens
TFEEKTKEA

SEQ ID NO: 672110 - protein, 9 aa, Homo Sapiens
HKMPPDIIL

SEQ ID NO: 672111 - protein, 9 aa, Homo Sapiens
PNITNPEYG

SEQ ID NO: 672112 - protein, 9 aa, Homo Sapiens
SPSRYRSRC

SEQ ID NO: 672113 - protein, 9 aa, Homo Sapiens
VHEGMSPEI

SEQ ID NO: 672114 - protein, 9 aa, Homo Sapiens
TPIQTVRMK

SEQ ID NO: 672115 - protein, 9 aa, Homo Sapiens
LWGGPEPWT

SEQ ID NO: 672116 - protein, 9 aa, Homo Sapiens
NRSLLNKYC

SEQ ID NO: 672117 - protein, 9 aa, Homo Sapiens
LAHQDQVNR

SEQ ID NO: 672118 - protein, 9 aa, Homo Sapiens
NEFCSSDSQ

SEQ ID NO: 672119 - protein, 9 aa, Homo Sapiens
KGNSAGGAE

SEQ ID NO: 672120 - protein, 9 aa, Homo Sapiens
PAGLSAAPP

SEQ ID NO: 672121 - protein, 9 aa, Homo Sapiens
SRPTDKTVF

SEQ ID NO: 672122 - protein, 9 aa, Homo Sapiens
LNTDAAKPT

SEQ ID NO: 672123 - protein, 9 aa, Homo Sapiens
EFLERREPE

SEQ ID NO: 672124 - protein, 9 aa, Homo Sapiens
PPLTHGGCP

SEQ ID NO: 672125 - protein, 9 aa, Homo Sapiens
PMVAGALAL

SEQ ID NO: 672126 - protein, 9 aa, Homo Sapiens
LGIASKNEQ

SEQ ID NO: 672127 - protein, 9 aa, Homo Sapiens
IPKKEEEAY

SEQ ID NO: 672128 - protein, 9 aa, Homo Sapiens
IGISSKMDR

SEQ ID NO: 672129 - protein, 9 aa, Homo Sapiens
SGKVFENKM

SEQ ID NO: 672130 - protein, 9 aa, Homo Sapiens
DPQKLPFLF

SEQ ID NO: 672131 - protein, 9 aa, Homo Sapiens
GFVEDSACP

SEQ ID NO: 672132 - protein, 9 aa, Homo Sapiens
CATPSNKQG

SEQ ID NO: 672133 - protein, 9 aa, Homo Sapiens
ALSHLPESL

SEQ ID NO: 672134 - protein, 9 aa, Homo Sapiens
HEELGDDLL

SEQ ID NO: 672135 - protein, 9 aa, Homo Sapiens
LPNGTWSWG

SEQ ID NO: 672136 - protein, 9 aa, Homo Sapiens
EMRYNRRNR

SEQ ID NO: 672137 - protein, 9 aa, Homo Sapiens
ILACGGDRT

SEQ ID NO: 672138 - protein, 9 aa, Homo Sapiens
GHEPWRRLL

SEQ ID NO: 672139 - protein, 9 aa, Homo Sapiens
AVFGVTLLF

SEQ ID NO: 672140 - protein, 9 aa, Homo Sapiens
WETWGSGGK

SEQ ID NO: 672141 - protein, 9 aa, Homo Sapiens
PGPKRQRGG

SEQ ID NO: 672142 - protein, 9 aa, Homo Sapiens
VFENKMANG

SEQ ID NO: 672143 - protein, 9 aa, Homo Sapiens
LFILDAKSF

SEQ ID NO: 672144 - protein, 9 aa, Homo Sapiens
GGCPLEPPY

SEQ ID NO: 672145 - protein, 9 aa, Homo Sapiens
MVKALGDWL

SEQ ID NO: 672146 - protein, 9 aa, Homo Sapiens
PKFNFVGKR

SEQ ID NO: 672147 - protein, 9 aa, Homo Sapiens
NCRSPSNMS

SEQ ID NO: 672148 - protein, 9 aa, Homo Sapiens
LTGKKIIGT

SEQ ID NO: 672149 - protein, 9 aa, Homo Sapiens
FNSCSVNEF

SEQ ID NO: 672150 - protein, 9 aa, Homo Sapiens
SPCLSLGPL

SEQ ID NO: 672151 - protein, 9 aa, Homo Sapiens
NPEYGYLAR

SEQ ID NO: 672152 - protein, 9 aa, Homo Sapiens
HKPWAKKMK

SEQ ID NO: 672153 - protein, 9 aa, Homo Sapiens
PSQLPPLTH

SEQ ID NO: 672154 - protein, 9 aa, Homo Sapiens
GPGKSPKYI

SEQ ID NO: 672155 - protein, 9 aa, Homo Sapiens
AALLDSSLQ

SEQ ID NO: 672156 - protein, 9 aa, Homo Sapiens
TPGAGQRLL

SEQ ID NO: 672157 - protein, 9 aa, Homo Sapiens
VVPASPELQ

SEQ ID NO: 672158 - protein, 9 aa, Homo Sapiens
GLAPEPLLA

SEQ ID NO: 672159 - protein, 9 aa, Homo Sapiens
AVTFFANHD

SEQ ID NO: 672160 - protein, 9 aa, Homo Sapiens
GKVFENKMA

SEQ ID NO: 672161 - protein, 9 aa, Homo Sapiens
SLQGPLPKE

SEQ ID NO: 672162 - protein, 9 aa, Homo Sapiens
QDEGPECNT

SEQ ID NO: 672163 - protein, 9 aa, Homo Sapiens
KTKSTQEGR

SEQ ID NO: 672164 - protein, 9 aa, Homo Sapiens
FCSSDSQDK

SEQ ID NO: 672165 - protein, 9 aa, Homo Sapiens
VSSLIQHER

SEQ ID NO: 672166 - protein, 9 aa, Homo Sapiens
SDKRDDASV

SEQ ID NO: 672167 - protein, 9 aa, Homo Sapiens
ENYRRLFQE

SEQ ID NO: 672168 - protein, 9 aa, Homo Sapiens
AFYCVSTGT

SEQ ID NO: 672169 - protein, 9 aa, Homo Sapiens
LACGGDRTV

SEQ ID NO: 672170 - protein, 9 aa, Homo Sapiens
LIQQQNMMD

SEQ ID NO: 672171 - protein, 9 aa, Homo Sapiens
LTAFARLLH

SEQ ID NO: 672172 - protein, 9 aa, Homo Sapiens
AKENKQIIR

SEQ ID NO: 672173 - protein, 9 aa, Homo Sapiens
CDMCFSRSD

SEQ ID NO: 672174 - protein, 9 aa, Homo Sapiens
IHAGNGEAI

SEQ ID NO: 672175 - protein, 9 aa, Homo Sapiens
WLPHTEHCV

SEQ ID NO: 672176 - protein, 9 aa, Homo Sapiens
PSLPLSKDA

SEQ ID NO: 672177 - protein, 9 aa, Homo Sapiens
ATEKTQLRC

SEQ ID NO: 672178 - protein, 9 aa, Homo Sapiens
RADIPIECR

SEQ ID NO: 672179 - protein, 9 aa, Homo Sapiens
PSRYRSRCR

SEQ ID NO: 672180 - protein, 9 aa, Homo Sapiens
EQQDLPEQP

SEQ ID NO: 672181 - protein, 9 aa, Homo Sapiens
QEGIMVIIN

SEQ ID NO: 672182 - protein, 9 aa, Homo Sapiens
GARQPPLTR

SEQ ID NO: 672183 - protein, 9 aa, Homo Sapiens
TVVHKGQDA

SEQ ID NO: 672184 - protein, 9 aa, Homo Sapiens
PPVMEKQVF

SEQ ID NO: 672185 - protein, 9 aa, Homo Sapiens
TNRADIPIE

SEQ ID NO: 672186 - protein, 9 aa, Homo Sapiens
QTLSYLEQS

SEQ ID NO: 672187 - protein, 9 aa, Homo Sapiens
FRYRSSCEF

SEQ ID NO: 672188 - protein, 9 aa, Homo Sapiens
WDVLLAPIL

SEQ ID NO: 672189 - protein, 9 aa, Homo Sapiens
KPKYDGQDL

SEQ ID NO: 672190 - protein, 9 aa, Homo Sapiens
KTMRKFLHK

SEQ ID NO: 672191 - protein, 9 aa, Homo Sapiens
LHPAYRDGI

SEQ ID NO: 672192 - protein, 9 aa, Homo Sapiens
FDDCRTGAW

SEQ ID NO: 672193 - protein, 9 aa, Homo Sapiens
TRTPGQLHS

SEQ ID NO: 672194 - protein, 9 aa, Homo Sapiens
TKKTRRRGR

SEQ ID NO: 672195 - protein, 9 aa, Homo Sapiens
TGTASGPSS

SEQ ID NO: 672196 - protein, 9 aa, Homo Sapiens
LMMALSQSD

SEQ ID NO: 672197 - protein, 9 aa, Homo Sapiens
DKQLLSALV

SEQ ID NO: 672198 - protein, 9 aa, Homo Sapiens
GILSTTVLC

SEQ ID NO: 672199 - protein, 9 aa, Homo Sapiens
ERNPPLADA

SEQ ID NO: 672200 - protein, 9 aa, Homo Sapiens
VEKFGHGSV

SEQ ID NO: 672201 - protein, 9 aa, Homo Sapiens
NGRLRMNDQ

SEQ ID NO: 672202 - protein, 9 aa, Homo Sapiens
LYESLYDTL

SEQ ID NO: 672203 - protein, 9 aa, Homo Sapiens
ADGGGVGQG

SEQ ID NO: 672204 - protein, 9 aa, Homo Sapiens
SLLNKYCVE

SEQ ID NO: 672205 - protein, 9 aa, Homo Sapiens
GPVIDCDVI

SEQ ID NO: 672206 - protein, 9 aa, Homo Sapiens
FLFGVDKQL

SEQ ID NO: 672207 - protein, 9 aa, Homo Sapiens
RHYRKAHSC

SEQ ID NO: 672208 - protein, 9 aa, Homo Sapiens
LTCGDHSDP

SEQ ID NO: 672209 - protein, 9 aa, Homo Sapiens
EGRNLFVRD

SEQ ID NO: 672210 - protein, 9 aa, Homo Sapiens
APGVQDISG

SEQ ID NO: 672211 - protein, 9 aa, Homo Sapiens
SVPCLLSSP

SEQ ID NO: 672212 - protein, 9 aa, Homo Sapiens
KSVSQRALV

SEQ ID NO: 672213 - protein, 9 aa, Homo Sapiens
GMEAQVGEF

SEQ ID NO: 672214 - protein, 9 aa, Homo Sapiens
PEPWTQLYD

SEQ ID NO: 672215 - protein, 9 aa, Homo Sapiens
ALLGTVTVI

SEQ ID NO: 672216 - protein, 9 aa, Homo Sapiens
KVVLVQQQS

SEQ ID NO: 672217 - protein, 9 aa, Homo Sapiens
RTVAALQVL

SEQ ID NO: 672218 - protein, 9 aa, Homo Sapiens
VLLAPILNS

SEQ ID NO: 672219 - protein, 9 aa, Homo Sapiens
LSRPGCLWR

SEQ ID NO: 672220 - protein, 9 aa, Homo Sapiens
AGPLAHQDQ

SEQ ID NO: 672221 - protein, 9 aa, Homo Sapiens
SHLAVWGRM

SEQ ID NO: 672222 - protein, 9 aa, Homo Sapiens
QLTCGDHSD

SEQ ID NO: 672223 - protein, 9 aa, Homo Sapiens
DMCGHSGGL

SEQ ID NO: 672224 - protein, 9 aa, Homo Sapiens
DGFRKAHKP

SEQ ID NO: 672225 - protein, 9 aa, Homo Sapiens
SSATLRAPA

SEQ ID NO: 672226 - protein, 9 aa, Homo Sapiens
YLQEGIMVI

SEQ ID NO: 672227 - protein, 9 aa, Homo Sapiens
LTLNTHKRI

SEQ ID NO: 672228 - protein, 9 aa, Homo Sapiens
LEPPYNLSP

SEQ ID NO: 672229 - protein, 9 aa, Homo Sapiens
LLNKYCVEY

SEQ ID NO: 672230 - protein, 9 aa, Homo Sapiens
RNRWKRQNF

SEQ ID NO: 672231 - protein, 9 aa, Homo Sapiens
CCRKAKGEG

SEQ ID NO: 672232 - protein, 9 aa, Homo Sapiens
RENYLVRWG

SEQ ID NO: 672233 - protein, 9 aa, Homo Sapiens
KETCSSKSP

SEQ ID NO: 672234 - protein, 9 aa, Homo Sapiens
GVGQGKDIS

SEQ ID NO: 672235 - protein, 9 aa, Homo Sapiens
LTHGGCPLE

SEQ ID NO: 672236 - protein, 9 aa, Homo Sapiens
NGTWSWGNE

SEQ ID NO: 672237 - protein, 9 aa, Homo Sapiens
QRGGCCPPD

SEQ ID NO: 672238 - protein, 9 aa, Homo Sapiens
DPNKQTVIR

SEQ ID NO: 672239 - protein, 9 aa, Homo Sapiens
MEAQVGEFP

SEQ ID NO: 672240 - protein, 9 aa, Homo Sapiens
KIDVHGTKM

SEQ ID NO: 672241 - protein, 9 aa, Homo Sapiens
ELLRVVKNK

SEQ ID NO: 672242 - protein, 9 aa, Homo Sapiens
LAPEPLLAP

SEQ ID NO: 672243 - protein, 9 aa, Homo Sapiens
ETNSTVPVA

SEQ ID NO: 672244 - protein, 9 aa, Homo Sapiens
DPKKTIQMV

SEQ ID NO: 672245 - protein, 9 aa, Homo Sapiens
CPREVIAPS

SEQ ID NO: 672246 - protein, 9 aa, Homo Sapiens
FCCCRKAKG

SEQ ID NO: 672247 - protein, 9 aa, Homo Sapiens
ETGGFSATF

SEQ ID NO: 672248 - protein, 9 aa, Homo Sapiens
IFHHRLPPS

SEQ ID NO: 672249 - protein, 9 aa, Homo Sapiens
GYSIAFMGS

SEQ ID NO: 672250 - protein, 9 aa, Homo Sapiens
LHHGGGNPT

SEQ ID NO: 672251 - protein, 9 aa, Homo Sapiens
VLYTPGHTN

SEQ ID NO: 672252 - protein, 9 aa, Homo Sapiens
DLNNLFSKY

SEQ ID NO: 672253 - protein, 9 aa, Homo Sapiens
PEASISLPK

SEQ ID NO: 672254 - protein, 9 aa, Homo Sapiens
GEDTVVHKG

SEQ ID NO: 672255 - protein, 9 aa, Homo Sapiens
CFDDCRTGA

SEQ ID NO: 672256 - protein, 9 aa, Homo Sapiens
QCRLSMKVW

SEQ ID NO: 672257 - protein, 9 aa, Homo Sapiens
NEVTDLSMP

SEQ ID NO: 672258 - protein, 9 aa, Homo Sapiens
DTAFPETGG

SEQ ID NO: 672259 - protein, 9 aa, Homo Sapiens
LMLKEYWQK

SEQ ID NO: 672260 - protein, 9 aa, Homo Sapiens
LSEAKKTSC

SEQ ID NO: 672261 - protein, 9 aa, Homo Sapiens
TRAAILMKG

SEQ ID NO: 672262 - protein, 9 aa, Homo Sapiens
GTKMVSHLE

SEQ ID NO: 672263 - protein, 9 aa, Homo Sapiens
LHFPQNQRL

SEQ ID NO: 672264 - protein, 9 aa, Homo Sapiens
LMKTARVEI

SEQ ID NO: 672265 - protein, 9 aa, Homo Sapiens
ADVFERAKK

SEQ ID NO: 672266 - protein, 9 aa, Homo Sapiens
GMALYTTKH

SEQ ID NO: 672267 - protein, 9 aa, Homo Sapiens
VLQTPGHRL

SEQ ID NO: 672268 - protein, 9 aa, Homo Sapiens
NNLFSKYGK

SEQ ID NO: 672269 - protein, 9 aa, Homo Sapiens
AQRIASDDA

SEQ ID NO: 672270 - protein, 9 aa, Homo Sapiens
CSLKVYVYC

SEQ ID NO: 672271 - protein, 9 aa, Homo Sapiens
ASNAILALQ

SEQ ID NO: 672272 - protein, 9 aa, Homo Sapiens
EVTDLSMPR

SEQ ID NO: 672273 - protein, 9 aa, Homo Sapiens
FLSKMPEAK

SEQ ID NO: 672274 - protein, 9 aa, Homo Sapiens
VSVLDTTFI

SEQ ID NO: 672275 - protein, 9 aa, Homo Sapiens
KDALTVTSP

SEQ ID NO: 672276 - protein, 9 aa, Homo Sapiens
PLSPSSVED

SEQ ID NO: 672277 - protein, 9 aa, Homo Sapiens
IEKVAQLKQ

SEQ ID NO: 672278 - protein, 9 aa, Homo Sapiens
SGGKSRRAG

SEQ ID NO: 672279 - protein, 9 aa, Homo Sapiens
ACLQKMIRS

SEQ ID NO: 672280 - protein, 9 aa, Homo Sapiens
SELGKTDAV

SEQ ID NO: 672281 - protein, 9 aa, Homo Sapiens
SAFLAKDFN

SEQ ID NO: 672282 - protein, 9 aa, Homo Sapiens
PRAVRCHSL

SEQ ID NO: 672283 - protein, 9 aa, Homo Sapiens
YRSSCEFSC

SEQ ID NO: 672284 - protein, 9 aa, Homo Sapiens
CCFDDCRTG

SEQ ID NO: 672285 - protein, 9 aa, Homo Sapiens
MHLIHAGNG

SEQ ID NO: 672286 - protein, 9 aa, Homo Sapiens
FYCVSTGTA

SEQ ID NO: 672287 - protein, 9 aa, Homo Sapiens
AGPFEIPVL

SEQ ID NO: 672288 - protein, 9 aa, Homo Sapiens
PVIDCDVIP

SEQ ID NO: 672289 - protein, 9 aa, Homo Sapiens
ISQHALMDL

SEQ ID NO: 672290 - protein, 9 aa, Homo Sapiens
KALGDWLAE

SEQ ID NO: 672291 - protein, 9 aa, Homo Sapiens
ETESKSSGY

SEQ ID NO: 672292 - protein, 9 aa, Homo Sapiens
VTAQPKKVN

SEQ ID NO: 672293 - protein, 9 aa, Homo Sapiens
PNCRSPSNM

SEQ ID NO: 672294 - protein, 9 aa, Homo Sapiens
RKCRQHSHS

SEQ ID NO: 672295 - protein, 9 aa, Homo Sapiens
FYVQALPRA

SEQ ID NO: 672296 - protein, 9 aa, Homo Sapiens
PTSTVLPWS

SEQ ID NO: 672297 - protein, 9 aa, Homo Sapiens
NKQGMPVLS

SEQ ID NO: 672298 - protein, 9 aa, Homo Sapiens
QVNRRPSRE

SEQ ID NO: 672299 - protein, 9 aa, Homo Sapiens
WEQAAQIGL

SEQ ID NO: 672300 - protein, 9 aa, Homo Sapiens
GYVLFFKTR

SEQ ID NO: 672301 - protein, 9 aa, Homo Sapiens
GGQGVGSLE

SEQ ID NO: 672302 - protein, 9 aa, Homo Sapiens
VHVHKDALT

SEQ ID NO: 672303 - protein, 9 aa, Homo Sapiens
PGHTNDHMA

SEQ ID NO: 672304 - protein, 9 aa, Homo Sapiens
HTNDHMALL

SEQ ID NO: 672305 - protein, 9 aa, Homo Sapiens
SQWFWWHWQ

SEQ ID NO: 672306 - protein, 9 aa, Homo Sapiens
FPQNQRLLP

SEQ ID NO: 672307 - protein, 9 aa, Homo Sapiens
PVPNVNAAI

SEQ ID NO: 672308 - protein, 9 aa, Homo Sapiens
VPVPNVNAA

SEQ ID NO: 672309 - protein, 9 aa, Homo Sapiens
CVSVPCLLS

SEQ ID NO: 672310 - protein, 9 aa, Homo Sapiens
AEPETQCES

SEQ ID NO: 672311 - protein, 9 aa, Homo Sapiens
PHTEHCVHL

SEQ ID NO: 672312 - protein, 9 aa, Homo Sapiens
RKFLHKRKT

SEQ ID NO: 672313 - protein, 9 aa, Homo Sapiens
KCRQHSHSY

SEQ ID NO: 672314 - protein, 9 aa, Homo Sapiens
SKNEQLKAL

SEQ ID NO: 672315 - protein, 9 aa, Homo Sapiens
LSLGPLSSS

SEQ ID NO: 672316 - protein, 9 aa, Homo Sapiens
ALMKTARVE

SEQ ID NO: 672317 - protein, 9 aa, Homo Sapiens
SVEIEKVAQ

SEQ ID NO: 672318 - protein, 9 aa, Homo Sapiens
LSKMPEAKE

SEQ ID NO: 672319 - protein, 9 aa, Homo Sapiens
AFMGSDVSV

SEQ ID NO: 672320 - protein, 9 aa, Homo Sapiens
FTTSNVVRM

SEQ ID NO: 672321 - protein, 9 aa, Homo Sapiens
IENLEETET

SEQ ID NO: 672322 - protein, 9 aa, Homo Sapiens
DGQDLAYTV

SEQ ID NO: 672323 - protein, 9 aa, Homo Sapiens
QRIASDDAL

SEQ ID NO: 672324 - protein, 9 aa, Homo Sapiens
CLMMALSQS

SEQ ID NO: 672325 - protein, 9 aa, Homo Sapiens
QPKKVNKMK

SEQ ID NO: 672326 - protein, 9 aa, Homo Sapiens
IVAKFKEEP

SEQ ID NO: 672327 - protein, 9 aa, Homo Sapiens
NCVSSLIQH

SEQ ID NO: 672328 - protein, 9 aa, Homo Sapiens
EPETQCESK

SEQ ID NO: 672329 - protein, 9 aa, Homo Sapiens
SPKYISSHN

SEQ ID NO: 672330 - protein, 9 aa, Homo Sapiens
ALALLGTVT

SEQ ID NO: 672331 - protein, 9 aa, Homo Sapiens
WGGPEPWTQ

SEQ ID NO: 672332 - protein, 9 aa, Homo Sapiens
NREDPAEAA

SEQ ID NO: 672333 - protein, 9 aa, Homo Sapiens
VTSGGFVED

SEQ ID NO: 672334 - protein, 9 aa, Homo Sapiens
KGEGENKSH

SEQ ID NO: 672335 - protein, 9 aa, Homo Sapiens
RSLLNKYCV

SEQ ID NO: 672336 - protein, 9 aa, Homo Sapiens
IDEDDFAHE

SEQ ID NO: 672337 - protein, 9 aa, Homo Sapiens
LAILSSHFI

SEQ ID NO: 672338 - protein, 9 aa, Homo Sapiens
NVATTDSDK

SEQ ID NO: 672339 - protein, 9 aa, Homo Sapiens
GGGNPTAAT

SEQ ID NO: 672340 - protein, 9 aa, Homo Sapiens
STVPVADSI

SEQ ID NO: 672341 - protein, 9 aa, Homo Sapiens
NRPSFNGTP

SEQ ID NO: 672342 - protein, 9 aa, Homo Sapiens
RTLHLLQWE

SEQ ID NO: 672343 - protein, 9 aa, Homo Sapiens
EASISLPKW

SEQ ID NO: 672344 - protein, 9 aa, Homo Sapiens
GIMVIINKV

SEQ ID NO: 672345 - protein, 9 aa, Homo Sapiens
DIPFCEFAK

SEQ ID NO: 672346 - protein, 9 aa, Homo Sapiens
ISALMKTAR

SEQ ID NO: 672347 - protein, 9 aa, Homo Sapiens
EAKENKQII

SEQ ID NO: 672348 - protein, 9 aa, Homo Sapiens
DKPLNATYL

SEQ ID NO: 672349 - protein, 9 aa, Homo Sapiens
LKPLAILSS

SEQ ID NO: 672350 - protein, 9 aa, Homo Sapiens
VGDVQGKGL

SEQ ID NO: 672351 - protein, 9 aa, Homo Sapiens
KYDGQDLAY

SEQ ID NO: 672352 - protein, 9 aa, Homo Sapiens
EDVEEINHA

SEQ ID NO: 672353 - protein, 9 aa, Homo Sapiens
SQPLNTDAA

SEQ ID NO: 672354 - protein, 9 aa, Homo Sapiens
NLSPRTRTP

SEQ ID NO: 672355 - protein, 9 aa, Homo Sapiens
GIVAKFKEE

SEQ ID NO: 672356 - protein, 9 aa, Homo Sapiens
QPPKDSTTL

SEQ ID NO: 672357 - protein, 9 aa, Homo Sapiens
FLERREPEC

SEQ ID NO: 672358 - protein, 9 aa, Homo Sapiens
AGQLRPQPE

SEQ ID NO: 672359 - protein, 9 aa, Homo Sapiens
DDCRTGAWR

SEQ ID NO: 672360 - protein, 9 aa, Homo Sapiens
SRKWPFDRS

SEQ ID NO: 672361 - protein, 9 aa, Homo Sapiens
TFSPISEQP

SEQ ID NO: 672362 - protein, 9 aa, Homo Sapiens
CRFLGKCPK

SEQ ID NO: 672363 - protein, 9 aa, Homo Sapiens
IKPEDAVDF

SEQ ID NO: 672364 - protein, 9 aa, Homo Sapiens
LKGYSIAFM

SEQ ID NO: 672365 - protein, 9 aa, Homo Sapiens
LVDLGPPVM

SEQ ID NO: 672366 - protein, 9 aa, Homo Sapiens
LLFILTLAV

SEQ ID NO: 672367 - protein, 9 aa, Homo Sapiens
GTWSWGNER

SEQ ID NO: 672368 - protein, 9 aa, Homo Sapiens
LFGVDKQLL

SEQ ID NO: 672369 - protein, 9 aa, Homo Sapiens
KTQLRCRQQ

SEQ ID NO: 672370 - protein, 9 aa, Homo Sapiens
RSNRLLIGI

SEQ ID NO: 672371 - protein, 9 aa, Homo Sapiens
EPLLAPPGS

SEQ ID NO: 672372 - protein, 9 aa, Homo Sapiens
DGGRRGHEP

SEQ ID NO: 672373 - protein, 9 aa, Homo Sapiens
WQEQIQAMP

SEQ ID NO: 672374 - protein, 9 aa, Homo Sapiens
QMVSFRINP

SEQ ID NO: 672375 - protein, 9 aa, Homo Sapiens
LIKDSLQHL

SEQ ID NO: 672376 - protein, 9 aa, Homo Sapiens
AAGQLRPQP

SEQ ID NO: 672377 - protein, 9 aa, Homo Sapiens
PWGTKSHPT

SEQ ID NO: 672378 - protein, 9 aa, Homo Sapiens
AVWGRMLTW

SEQ ID NO: 672379 - protein, 9 aa, Homo Sapiens
RNPPLADAL

SEQ ID NO: 672380 - protein, 9 aa, Homo Sapiens
SWKTQIDSP

SEQ ID NO: 672381 - protein, 9 aa, Homo Sapiens
NDHMALLLE

SEQ ID NO: 672382 - protein, 9 aa, Homo Sapiens
ELTRIFVII

SEQ ID NO: 672383 - protein, 9 aa, Homo Sapiens
EDTVVHKGQ

SEQ ID NO: 672384 - protein, 9 aa, Homo Sapiens
SCFKTKSTQ

SEQ ID NO: 672385 - protein, 9 aa, Homo Sapiens
PQTTAAPPT

SEQ ID NO: 672386 - protein, 9 aa, Homo Sapiens
AAAPCAGEL

SEQ ID NO: 672387 - protein, 9 aa, Homo Sapiens
TFIGERTVA

SEQ ID NO: 672388 - protein, 9 aa, Homo Sapiens
EELTRIFVI

SEQ ID NO: 672389 - protein, 9 aa, Homo Sapiens
SASGSFRYR

SEQ ID NO: 672390 - protein, 9 aa, Homo Sapiens
ECNTPIQTV

SEQ ID NO: 672391 - protein, 9 aa, Homo Sapiens
SRLVLSFDE

SEQ ID NO: 672392 - protein, 9 aa, Homo Sapiens
SILSLTGSP

SEQ ID NO: 672393 - protein, 9 aa, Homo Sapiens
TLHLLQWEQ

SEQ ID NO: 672394 - protein, 9 aa, Homo Sapiens
QRQQPLNVT

SEQ ID NO: 672395 - protein, 9 aa, Homo Sapiens
FKMSKVAES

SEQ ID NO: 672396 - protein, 9 aa, Homo Sapiens
GIIIRYEVY

SEQ ID NO: 672397 - protein, 9 aa, Homo Sapiens
PTQVPLSSS

SEQ ID NO: 672398 - protein, 9 aa, Homo Sapiens
YVLFFKTRE

SEQ ID NO: 672399 - protein, 9 aa, Homo Sapiens
ATPSNKQGM

SEQ ID NO: 672400 - protein, 9 aa, Homo Sapiens
ETFVCEKSK

SEQ ID NO: 672401 - protein, 9 aa, Homo Sapiens
KFNFVGKRL

SEQ ID NO: 672402 - protein, 9 aa, Homo Sapiens
LCRCQAGRS

SEQ ID NO: 672403 - protein, 9 aa, Homo Sapiens
TSPAFRKLS

SEQ ID NO: 672404 - protein, 9 aa, Homo Sapiens
QKAQRLHLP

SEQ ID NO: 672405 - protein, 9 aa, Homo Sapiens
ECSLKVYVY

SEQ ID NO: 672406 - protein, 9 aa, Homo Sapiens
RTNREAFQG

SEQ ID NO: 672407 - protein, 9 aa, Homo Sapiens
KNGMGQCRL

SEQ ID NO: 672408 - protein, 9 aa, Homo Sapiens
ELHLELKPL

SEQ ID NO: 672409 - protein, 9 aa, Homo Sapiens
HHGGGNPTA

SEQ ID NO: 672410 - protein, 9 aa, Homo Sapiens
RYNRRNRWK

SEQ ID NO: 672411 - protein, 9 aa, Homo Sapiens
HRIFKQLSG

SEQ ID NO: 672412 - protein, 9 aa, Homo Sapiens
EAVTFFANH

SEQ ID NO: 672413 - protein, 9 aa, Homo Sapiens
LPFLFILDA

SEQ ID NO: 672414 - protein, 9 aa, Homo Sapiens
CYLWAVRST

SEQ ID NO: 672415 - protein, 9 aa, Homo Sapiens
SNVVRMHVG

SEQ ID NO: 672416 - protein, 9 aa, Homo Sapiens
APLIQQQNM

SEQ ID NO: 672417 - protein, 9 aa, Homo Sapiens
IVETSHKIS

SEQ ID NO: 672418 - protein, 9 aa, Homo Sapiens
DAVDFGISL

SEQ ID NO: 672419 - protein, 9 aa, Homo Sapiens
EPPYNLSPR

SEQ ID NO: 672420 - protein, 9 aa, Homo Sapiens
SNEIFKSLP

SEQ ID NO: 672421 - protein, 9 aa, Homo Sapiens
AHQDQVNRR

SEQ ID NO: 672422 - protein, 9 aa, Homo Sapiens
LPIIVSIKE

SEQ ID NO: 672423 - protein, 9 aa, Homo Sapiens
TIQMVSFRI

SEQ ID NO: 672424 - protein, 9 aa, Homo Sapiens
QVKIILINN

SEQ ID NO: 672425 - protein, 9 aa, Homo Sapiens
RLPPSRGCK

SEQ ID NO: 672426 - protein, 9 aa, Homo Sapiens
ALPSSGPRP

SEQ ID NO: 672427 - protein, 9 aa, Homo Sapiens
RPGGALCRC

SEQ ID NO: 672428 - protein, 9 aa, Homo Sapiens
GPRPRKQSP

SEQ ID NO: 672429 - protein, 9 aa, Homo Sapiens
QEVTSGGFV

SEQ ID NO: 672430 - protein, 9 aa, Homo Sapiens
EGRVCQERF

SEQ ID NO: 672431 - protein, 9 aa, Homo Sapiens
TKSVSQRAL

SEQ ID NO: 672432 - protein, 9 aa, Homo Sapiens
IIPPRPAYQ

SEQ ID NO: 672433 - protein, 9 aa, Homo Sapiens
IQQQNMMDQ

SEQ ID NO: 672434 - protein, 9 aa, Homo Sapiens
RKLSLLLDG

SEQ ID NO: 672435 - protein, 9 aa, Homo Sapiens
LRGLLWVST

SEQ ID NO: 672436 - protein, 9 aa, Homo Sapiens
CFYININKE

SEQ ID NO: 672437 - protein, 9 aa, Homo Sapiens
RPGCLWRTP

SEQ ID NO: 672438 - protein, 9 aa, Homo Sapiens
REPECEHGY

SEQ ID NO: 672439 - protein, 9 aa, Homo Sapiens
AFTNMPFQT

SEQ ID NO: 672440 - protein, 9 aa, Homo Sapiens
ARDRNTKNE

SEQ ID NO: 672441 - protein, 9 aa, Homo Sapiens
AGLSAAPPA

SEQ ID NO: 672442 - protein, 9 aa, Homo Sapiens
LLHPAYRDG

SEQ ID NO: 672443 - protein, 9 aa, Homo Sapiens
HLLQWEQAA

SEQ ID NO: 672444 - protein, 9 aa, Homo Sapiens
LADALLSGS

SEQ ID NO: 672445 - protein, 9 aa, Homo Sapiens
DKRDDASVC

SEQ ID NO: 672446 - protein, 9 aa, Homo Sapiens
SKSSGYKFS

SEQ ID NO: 672447 - protein, 9 aa, Homo Sapiens
GKDCRFLGK

SEQ ID NO: 672448 - protein, 9 aa, Homo Sapiens
EADGGGVGQ

SEQ ID NO: 672449 - protein, 9 aa, Homo Sapiens
KVNKMKRVT

SEQ ID NO: 672450 - protein, 9 aa, Homo Sapiens
ESPFFSWKT

SEQ ID NO: 672451 - protein, 9 aa, Homo Sapiens
CRCQAGRSP

SEQ ID NO: 672452 - protein, 9 aa, Homo Sapiens
FVEDSACPS

SEQ ID NO: 672453 - protein, 9 aa, Homo Sapiens
YININKEEN

SEQ ID NO: 672454 - protein, 9 aa, Homo Sapiens
FVNFCYSSI

SEQ ID NO: 672455 - protein, 9 aa, Homo Sapiens
RKSQWNKWE

SEQ ID NO: 672456 - protein, 9 aa, Homo Sapiens
RSRCRSRSR

SEQ ID NO: 672457 - protein, 9 aa, Homo Sapiens
TEKTQLRCR

SEQ ID NO: 672458 - protein, 9 aa, Homo Sapiens
YQVFGSVCA

SEQ ID NO: 672459 - protein, 9 aa, Homo Sapiens
KDSTTLEIK

SEQ ID NO: 672460 - protein, 9 aa, Homo Sapiens
ALTVTSPVL

SEQ ID NO: 672461 - protein, 9 aa, Homo Sapiens
LMAVQQDLY

SEQ ID NO: 672462 - protein, 9 aa, Homo Sapiens
LAYVSVATM

SEQ ID NO: 672463 - protein, 9 aa, Homo Sapiens
KSPKYISSH

SEQ ID NO: 672464 - protein, 9 aa, Homo Sapiens
CLQKMIRSS

SEQ ID NO: 672465 - protein, 9 aa, Homo Sapiens
QLHRIFKQL

SEQ ID NO: 672466 - protein, 9 aa, Homo Sapiens
IASKNEQLK

SEQ ID NO: 672467 - protein, 9 aa, Homo Sapiens
VTRAAILMK

SEQ ID NO: 672468 - protein, 9 aa, Homo Sapiens
LGPGKSPKY

SEQ ID NO: 672469 - protein, 9 aa, Homo Sapiens
SLPLSKDAH

SEQ ID NO: 672470 - protein, 9 aa, Homo Sapiens
PGLAPEPLL

SEQ ID NO: 672471 - protein, 9 aa, Homo Sapiens
ETLSQEVVN

SEQ ID NO: 672472 - protein, 9 aa, Homo Sapiens
YLEQSKCIS

SEQ ID NO: 672473 - protein, 9 aa, Homo Sapiens
TWSWGNERP

SEQ ID NO: 672474 - protein, 9 aa, Homo Sapiens
PGCLWRTPQ

SEQ ID NO: 672475 - protein, 9 aa, Homo Sapiens
PLSEAKKTS

SEQ ID NO: 672476 - protein, 9 aa, Homo Sapiens
TMGAFYCVS

SEQ ID NO: 672477 - protein, 9 aa, Homo Sapiens
PGKSPKYIS

SEQ ID NO: 672478 - protein, 9 aa, Homo Sapiens
GDDDPVPVP

SEQ ID NO: 672479 - protein, 9 aa, Homo Sapiens
GVTLLFILT

SEQ ID NO: 672480 - protein, 9 aa, Homo Sapiens
KPLAILSSH

SEQ ID NO: 672481 - protein, 9 aa, Homo Sapiens
YNLSPRTRT

SEQ ID NO: 672482 - protein, 9 aa, Homo Sapiens
RPTDKTVFL

SEQ ID NO: 672483 - protein, 9 aa, Homo Sapiens
GRNLFVRDR

SEQ ID NO: 672484 - protein, 9 aa, Homo Sapiens
LAVWGRMLT

SEQ ID NO: 672485 - protein, 9 aa, Homo Sapiens
AGQRLLRVL

SEQ ID NO: 672486 - protein, 9 aa, Homo Sapiens
SGGKGNSAG

SEQ ID NO: 672487 - protein, 9 aa, Homo Sapiens
SVSQPLNTD

SEQ ID NO: 672488 - protein, 9 aa, Homo Sapiens
ASFFCCFDD

SEQ ID NO: 672489 - protein, 9 aa, Homo Sapiens
TTRATDLNN

SEQ ID NO: 672490 - protein, 9 aa, Homo Sapiens
KIKPEDAVD

SEQ ID NO: 672491 - protein, 9 aa, Homo Sapiens
TPSELGKTD

SEQ ID NO: 672492 - protein, 9 aa, Homo Sapiens
QRALVNMMV

SEQ ID NO: 672493 - protein, 9 aa, Homo Sapiens
WGRMLTWLV

SEQ ID NO: 672494 - protein, 9 aa, Homo Sapiens
PQKLPFLFI

SEQ ID NO: 672495 - protein, 9 aa, Homo Sapiens
EDDFAHEEL

SEQ ID NO: 672496 - protein, 9 aa, Homo Sapiens
LSTTVLCQK

SEQ ID NO: 672497 - protein, 9 aa, Homo Sapiens
AASNAILAL

SEQ ID NO: 672498 - protein, 9 aa, Homo Sapiens
FSPISEQPA

SEQ ID NO: 672499 - protein, 9 aa, Homo Sapiens
LVSYPRIHF

SEQ ID NO: 672500 - protein, 9 aa, Homo Sapiens
LLTRGAQSP

SEQ ID NO: 672501 - protein, 9 aa, Homo Sapiens
PQGPATMGA

SEQ ID NO: 672502 - protein, 9 aa, Homo Sapiens
GAQGYVLFF

SEQ ID NO: 672503 - protein, 9 aa, Homo Sapiens
GHFWDPHNF

SEQ ID NO: 672504 - protein, 9 aa, Homo Sapiens
QIENLEETE

SEQ ID NO: 672505 - protein, 9 aa, Homo Sapiens
VTLLFILTL

SEQ ID NO: 672506 - protein, 9 aa, Homo Sapiens
LKEGRNLFV

SEQ ID NO: 672507 - protein, 9 aa, Homo Sapiens
KDSLQHLQT

SEQ ID NO: 672508 - protein, 9 aa, Homo Sapiens
PWSASAPGA

SEQ ID NO: 672509 - protein, 9 aa, Homo Sapiens
ADALLSGSL

SEQ ID NO: 672510 - protein, 9 aa, Homo Sapiens
NTPIQTVRM

SEQ ID NO: 672511 - protein, 9 aa, Homo Sapiens
VLPWSASAP

SEQ ID NO: 672512 - protein, 9 aa, Homo Sapiens
EQALSALSH

SEQ ID NO: 672513 - protein, 9 aa, Homo Sapiens
FTNMPFQTN

SEQ ID NO: 672514 - protein, 9 aa, Homo Sapiens
QAIQRRLLA

SEQ ID NO: 672515 - protein, 9 aa, Homo Sapiens
TQLRCRQQQ

SEQ ID NO: 672516 - protein, 9 aa, Homo Sapiens
MVAGALALL

SEQ ID NO: 672517 - protein, 9 aa, Homo Sapiens
NYRRLFQEI

SEQ ID NO: 672518 - protein, 9 aa, Homo Sapiens
QGAEKDSAF

SEQ ID NO: 672519 - protein, 9 aa, Homo Sapiens
FCDKPLNAT

SEQ ID NO: 672520 - protein, 9 aa, Homo Sapiens
TKSTQEGRV

SEQ ID NO: 672521 - protein, 9 aa, Homo Sapiens
LVNMMVGDL

SEQ ID NO: 672522 - protein, 9 aa, Homo Sapiens
EKVAQLKQF

SEQ ID NO: 672523 - protein, 9 aa, Homo Sapiens
FEQSPIERK

SEQ ID NO: 672524 - protein, 9 aa, Homo Sapiens
SFVNFCYSS

SEQ ID NO: 672525 - protein, 9 aa, Homo Sapiens
RQRGGCCPP

SEQ ID NO: 672526 - protein, 9 aa, Homo Sapiens
EVYMRRLRS

SEQ ID NO: 672527 - protein, 9 aa, Homo Sapiens
TLLFILTLA

SEQ ID NO: 672528 - protein, 9 aa, Homo Sapiens
QGVGSLEEV

SEQ ID NO: 672529 - protein, 9 aa, Homo Sapiens
RRSRLVLSF

SEQ ID NO: 672530 - protein, 9 aa, Homo Sapiens
QHALMDLMY

SEQ ID NO: 672531 - protein, 9 aa, Homo Sapiens
GSPTPLSWR

SEQ ID NO: 672532 - protein, 9 aa, Homo Sapiens
LSERAVQFQ

SEQ ID NO: 672533 - protein, 9 aa, Homo Sapiens
FILDAKSFT

SEQ ID NO: 672534 - protein, 9 aa, Homo Sapiens
GISSKMDRE

SEQ ID NO: 672535 - protein, 9 aa, Homo Sapiens
TGSAREKAH

SEQ ID NO: 672536 - protein, 9 aa, Homo Sapiens
FLQDDEVDD

SEQ ID NO: 672537 - protein, 9 aa, Homo Sapiens
CCTASCFRP

SEQ ID NO: 672538 - protein, 9 aa, Homo Sapiens
QNQRLLPPE

SEQ ID NO: 672539 - protein, 9 aa, Homo Sapiens
EKFGHGSVE

SEQ ID NO: 672540 - protein, 9 aa, Homo Sapiens
SSQFTFTPS

SEQ ID NO: 672541 - protein, 9 aa, Homo Sapiens
ETCSSKSPD

SEQ ID NO: 672542 - protein, 9 aa, Homo Sapiens
LHLELKPLA

SEQ ID NO: 672543 - protein, 9 aa, Homo Sapiens
GYKFSKSQS

SEQ ID NO: 672544 - protein, 9 aa, Homo Sapiens
KIQDKLRRI

SEQ ID NO: 672545 - protein, 9 aa, Homo Sapiens
IPPRPAYQV

SEQ ID NO: 672546 - protein, 9 aa, Homo Sapiens
KTSCFKTKS

SEQ ID NO: 672547 - protein, 9 aa, Homo Sapiens
QIGLDGGRR

SEQ ID NO: 672548 - protein, 9 aa, Homo Sapiens
CESPFFSWK

SEQ ID NO: 672549 - protein, 9 aa, Homo Sapiens
SPRCLMMAL

SEQ ID NO: 672550 - protein, 9 aa, Homo Sapiens
PACLQKMIR

SEQ ID NO: 672551 - protein, 9 aa, Homo Sapiens
RSILSLTGS

SEQ ID NO: 672552 - protein, 9 aa, Homo Sapiens
FLPRELNGR

SEQ ID NO: 672553 - protein, 9 aa, Homo Sapiens
AQIDRHCFK

SEQ ID NO: 672554 - protein, 9 aa, Homo Sapiens
TWGSGGKGN

SEQ ID NO: 672555 - protein, 9 aa, Homo Sapiens
FAFLFGVDK

SEQ ID NO: 672556 - protein, 9 aa, Homo Sapiens
CRSPSNMSA

SEQ ID NO: 672557 - protein, 9 aa, Homo Sapiens
KGMALYTTK

SEQ ID NO: 672558 - protein, 9 aa, Homo Sapiens
ETFEEKTKE

SEQ ID NO: 672559 - protein, 9 aa, Homo Sapiens
EQTSLTMMQ

SEQ ID NO: 672560 - protein, 9 aa, Homo Sapiens
IPEDFQKFQ

SEQ ID NO: 672561 - protein, 9 aa, Homo Sapiens
NGTPIPWLS

SEQ ID NO: 672562 - protein, 9 aa, Homo Sapiens
GAQSPPPSP

SEQ ID NO: 672563 - protein, 9 aa, Homo Sapiens
YRKCRQHSH

SEQ ID NO: 672564 - protein, 9 aa, Homo Sapiens
EDMIYIKLE

SEQ ID NO: 672565 - protein, 9 aa, Homo Sapiens
KFQTQNFDR

SEQ ID NO: 672566 - protein, 9 aa, Homo Sapiens
GARYDKIIP

SEQ ID NO: 672567 - protein, 9 aa, Homo Sapiens
VSYPRIHFP

SEQ ID NO: 672568 - protein, 9 aa, Homo Sapiens
ENLEETETQ

SEQ ID NO: 672569 - protein, 9 aa, Homo Sapiens
AFARLLHPA

SEQ ID NO: 672570 - protein, 9 aa, Homo Sapiens
SLPPVLGKE

SEQ ID NO: 672571 - protein, 9 aa, Homo Sapiens
QRLLRVLQT

SEQ ID NO: 672572 - protein, 9 aa, Homo Sapiens
ASDDALNHD

SEQ ID NO: 672573 - protein, 9 aa, Homo Sapiens
MLKEYWQKN

SEQ ID NO: 672574 - protein, 9 aa, Homo Sapiens
EFAKTVSKD

SEQ ID NO: 672575 - protein, 9 aa, Homo Sapiens
IAFMGSDVS

SEQ ID NO: 672576 - protein, 9 aa, Homo Sapiens
YDTLNQYYV

SEQ ID NO: 672577 - protein, 9 aa, Homo Sapiens
DVHGTKMVS

SEQ ID NO: 672578 - protein, 9 aa, Homo Sapiens
IAFGPVIDC

SEQ ID NO: 672579 - protein, 9 aa, Homo Sapiens
HLPESLAAE

SEQ ID NO: 672580 - protein, 9 aa, Homo Sapiens
SPGARQPPL

SEQ ID NO: 672581 - protein, 9 aa, Homo Sapiens
LTRGAQSPP

SEQ ID NO: 672582 - protein, 9 aa, Homo Sapiens
KVYVYCSPV

SEQ ID NO: 672583 - protein, 9 aa, Homo Sapiens
NQLWQKAQR

SEQ ID NO: 672584 - protein, 9 aa, Homo Sapiens
ERAVQFQAI

SEQ ID NO: 672585 - protein, 9 aa, Homo Sapiens
VLFFKTREL

SEQ ID NO: 672586 - protein, 9 aa, Homo Sapiens
LVEQTLSYL

SEQ ID NO: 672587 - protein, 9 aa, Homo Sapiens
QGAQGYVLF

SEQ ID NO: 672588 - protein, 9 aa, Homo Sapiens
PKKVNKMKR

SEQ ID NO: 672589 - protein, 9 aa, Homo Sapiens
EKDSAFLAK

SEQ ID NO: 672590 - protein, 9 aa, Homo Sapiens
AQIGLDGGR

SEQ ID NO: 672591 - protein, 9 aa, Homo Sapiens
EVTSGGFVE

SEQ ID NO: 672592 - protein, 9 aa, Homo Sapiens
IAPSGSEPW

SEQ ID NO: 672593 - protein, 9 aa, Homo Sapiens
GRMLTWLVF

SEQ ID NO: 672594 - protein, 9 aa, Homo Sapiens
RSKVFSIFP

SEQ ID NO: 672595 - protein, 9 aa, Homo Sapiens
CVHEGMSPE

SEQ ID NO: 672596 - protein, 9 aa, Homo Sapiens
KSKADQLIQ

SEQ ID NO: 672597 - protein, 9 aa, Homo Sapiens
FERAKKASA

SEQ ID NO: 672598 - protein, 9 aa, Homo Sapiens
DRNTKNEEW

SEQ ID NO: 672599 - protein, 9 aa, Homo Sapiens
RLFQEILNT

SEQ ID NO: 672600 - protein, 9 aa, Homo Sapiens
RKAHSCYKC

SEQ ID NO: 672601 - protein, 9 aa, Homo Sapiens
TLRKWFCDK

SEQ ID NO: 672602 - protein, 9 aa, Homo Sapiens
FVRDRCGTS

SEQ ID NO: 672603 - protein, 9 aa, Homo Sapiens
AAQIGLDGG

SEQ ID NO: 672604 - protein, 9 aa, Homo Sapiens
GPKRQRGGC

SEQ ID NO: 672605 - protein, 9 aa, Homo Sapiens
DPVPVPNVN

SEQ ID NO: 672606 - protein, 9 aa, Homo Sapiens
CNTPIQTVR

SEQ ID NO: 672607 - protein, 9 aa, Homo Sapiens
RLVPSQLPP

SEQ ID NO: 672608 - protein, 9 aa, Homo Sapiens
ELKPLAILS

SEQ ID NO: 672609 - protein, 9 aa, Homo Sapiens
PGMYFEHYR

SEQ ID NO: 672610 - protein, 9 aa, Homo Sapiens
VLIDLAYVS

SEQ ID NO: 672611 - protein, 9 aa, Homo Sapiens
VPVADSIPD

SEQ ID NO: 672612 - protein, 9 aa, Homo Sapiens
SKDAHPSVA

SEQ ID NO: 672613 - protein, 9 aa, Homo Sapiens
ALSALSHLP

SEQ ID NO: 672614 - protein, 9 aa, Homo Sapiens
VCYGPQGPA

SEQ ID NO: 672615 - protein, 9 aa, Homo Sapiens
PSSGPRPRK

SEQ ID NO: 672616 - protein, 9 aa, Homo Sapiens
PSFNGTPIP

SEQ ID NO: 672617 - protein, 9 aa, Homo Sapiens
PIERKKQEE

SEQ ID NO: 672618 - protein, 9 aa, Homo Sapiens
QQQNMMDQC

SEQ ID NO: 672619 - protein, 9 aa, Homo Sapiens
VSVPCLLSS

SEQ ID NO: 672620 - protein, 9 aa, Homo Sapiens
LTEPPTLQG

SEQ ID NO: 672621 - protein, 9 aa, Homo Sapiens
HKKRVLRSS

SEQ ID NO: 672622 - protein, 9 aa, Homo Sapiens
LWVSTFCFM

SEQ ID NO: 672623 - protein, 9 aa, Homo Sapiens
VPNVNAAIL

SEQ ID NO: 672624 - protein, 9 aa, Homo Sapiens
PECNTPIQT

SEQ ID NO: 672625 - protein, 9 aa, Homo Sapiens
SAPPQTTAA

SEQ ID NO: 672626 - protein, 9 aa, Homo Sapiens
GALALLGTV

SEQ ID NO: 672627 - protein, 9 aa, Homo Sapiens
ISEQPAAGQ

SEQ ID NO: 672628 - protein, 9 aa, Homo Sapiens
GQGKDISTI

SEQ ID NO: 672629 - protein, 9 aa, Homo Sapiens
RRNRWKRQN

SEQ ID NO: 672630 - protein, 9 aa, Homo Sapiens
VLDPAQRIA

SEQ ID NO: 672631 - protein, 9 aa, Homo Sapiens
CYVSRPTDK

SEQ ID NO: 672632 - protein, 9 aa, Homo Sapiens
SQTTCVNAN

SEQ ID NO: 672633 - protein, 9 aa, Homo Sapiens
QNMMDQCYF

SEQ ID NO: 672634 - protein, 9 aa, Homo Sapiens
GTPIPWLSS

SEQ ID NO: 672635 - protein, 9 aa, Homo Sapiens
PLNETLSQE

SEQ ID NO: 672636 - protein, 9 aa, Homo Sapiens
PFLFILDAK

SEQ ID NO: 672637 - protein, 9 aa, Homo Sapiens
AGHFWDPHN

SEQ ID NO: 672638 - protein, 9 aa, Homo Sapiens
GRVCQERFC

SEQ ID NO: 672639 - protein, 9 aa, Homo Sapiens
RGRRSTKKT

SEQ ID NO: 672640 - protein, 9 aa, Homo Sapiens
VRLIKDSLQ

SEQ ID NO: 672641 - protein, 9 aa, Homo Sapiens
VTAVLTEPP

SEQ ID NO: 672642 - protein, 9 aa, Homo Sapiens
KTRRRGRKE

SEQ ID NO: 672643 - protein, 9 aa, Homo Sapiens
SQLPPLTHG

SEQ ID NO: 672644 - protein, 9 aa, Homo Sapiens
NCKVERKHT

SEQ ID NO: 672645 - protein, 9 aa, Homo Sapiens
VSTGTASGP

SEQ ID NO: 672646 - protein, 9 aa, Homo Sapiens
ASCFRPSSS

SEQ ID NO: 672647 - protein, 9 aa, Homo Sapiens
MSAHLRETT

SEQ ID NO: 672648 - protein, 9 aa, Homo Sapiens
WSLCRDPRG

SEQ ID NO: 672649 - protein, 9 aa, Homo Sapiens
PSPCLSLGP

SEQ ID NO: 672650 - protein, 9 aa, Homo Sapiens
VFRVEKFGH

SEQ ID NO: 672651 - protein, 9 aa, Homo Sapiens
LKSVSQPLN

SEQ ID NO: 672652 - protein, 9 aa, Homo Sapiens
PKYDGQDLA

SEQ ID NO: 672653 - protein, 9 aa, Homo Sapiens
ALCRCQAGR

SEQ ID NO: 672654 - protein, 9 aa, Homo Sapiens
IQRTNREAF

SEQ ID NO: 672655 - protein, 9 aa, Homo Sapiens
KSTFSPISE

SEQ ID NO: 672656 - protein, 9 aa, Homo Sapiens
IGERTVAAL

SEQ ID NO: 672657 - protein, 9 aa, Homo Sapiens
VLGKDCRFL

SEQ ID NO: 672658 - protein, 9 aa, Homo Sapiens
FQAGSGSTP

SEQ ID NO: 672659 - protein, 9 aa, Homo Sapiens
CFKTKSTQE

SEQ ID NO: 672660 - protein, 9 aa, Homo Sapiens
FSAVQVLEY

SEQ ID NO: 672661 - protein, 9 aa, Homo Sapiens
WQKAQRLHL

SEQ ID NO: 672662 - protein, 9 aa, Homo Sapiens
PPGARSNPS

SEQ ID NO: 672663 - protein, 9 aa, Homo Sapiens
EKTQLRCRQ

SEQ ID NO: 672664 - protein, 9 aa, Homo Sapiens
TGLRRTLHL

SEQ ID NO: 672665 - protein, 9 aa, Homo Sapiens
RNTKNEEWS

SEQ ID NO: 672666 - protein, 9 aa, Homo Sapiens
LKQIENLEE

SEQ ID NO: 672667 - protein, 9 aa, Homo Sapiens
ASISLPKWN

SEQ ID NO: 672668 - protein, 9 aa, Homo Sapiens
DGNPFRVTR

SEQ ID NO: 672669 - protein, 9 aa, Homo Sapiens
DGTVCYGPQ

SEQ ID NO: 672670 - protein, 9 aa, Homo Sapiens
DQGGSGTVI

SEQ ID NO: 672671 - protein, 9 aa, Homo Sapiens
SLTGSPTPL

SEQ ID NO: 672672 - protein, 9 aa, Homo Sapiens
WAVRSTQDS

SEQ ID NO: 672673 - protein, 9 aa, Homo Sapiens
ARQPPLTRP

SEQ ID NO: 672674 - protein, 9 aa, Homo Sapiens
LNNLFSKYG

SEQ ID NO: 672675 - protein, 9 aa, Homo Sapiens
KLPFLFILD

SEQ ID NO: 672676 - protein, 9 aa, Homo Sapiens
RETESKSSG

SEQ ID NO: 672677 - protein, 9 aa, Homo Sapiens
VKGMALYTT

SEQ ID NO: 672678 - protein, 9 aa, Homo Sapiens
PPKDSTTLE

SEQ ID NO: 672679 - protein, 9 aa, Homo Sapiens
TNLVSYPRI

SEQ ID NO: 672680 - protein, 9 aa, Homo Sapiens
LGKELLTRG

SEQ ID NO: 672681 - protein, 9 aa, Homo Sapiens
PAPAGLSAA

SEQ ID NO: 672682 - protein, 9 aa, Homo Sapiens
HLSFVNFCY

SEQ ID NO: 672683 - protein, 9 aa, Homo Sapiens
IFVIIPKSY

SEQ ID NO: 672684 - protein, 9 aa, Homo Sapiens
LYTTKHANK

SEQ ID NO: 672685 - protein, 9 aa, Homo Sapiens
VDVHEYTLT

SEQ ID NO: 672686 - protein, 9 aa, Homo Sapiens
WGNERPYCQ

SEQ ID NO: 672687 - protein, 9 aa, Homo Sapiens
LPPLTHGGC

SEQ ID NO: 672688 - protein, 9 aa, Homo Sapiens
HNFKSVTLG

SEQ ID NO: 672689 - protein, 9 aa, Homo Sapiens
SPPADVFER

SEQ ID NO: 672690 - protein, 9 aa, Homo Sapiens
LPLGLLLPG

SEQ ID NO: 672691 - protein, 9 aa, Homo Sapiens
TLNQYYVHL

SEQ ID NO: 672692 - protein, 9 aa, Homo Sapiens
QQAREKKSK

SEQ ID NO: 672693 - protein, 9 aa, Homo Sapiens
SSEKEHAIE

SEQ ID NO: 672694 - protein, 9 aa, Homo Sapiens
KERNPPLAD

SEQ ID NO: 672695 - protein, 9 aa, Homo Sapiens
ILSTTVLCQ

SEQ ID NO: 672696 - protein, 9 aa, Homo Sapiens
PLNTDAAKP

SEQ ID NO: 672697 - protein, 9 aa, Homo Sapiens
LETAAPGVQ

SEQ ID NO: 672698 - protein, 9 aa, Homo Sapiens
FARLLHPAY

SEQ ID NO: 672699 - protein, 9 aa, Homo Sapiens
SEKEHAIEI

SEQ ID NO: 672700 - protein, 9 aa, Homo Sapiens
SRCRSRSRS

SEQ ID NO: 672701 - protein, 9 aa, Homo Sapiens
ATMGAFYCV

SEQ ID NO: 672702 - protein, 9 aa, Homo Sapiens
MGAFYCVST

SEQ ID NO: 672703 - protein, 9 aa, Homo Sapiens
SCSPAPAGL

SEQ ID NO: 672704 - protein, 9 aa, Homo Sapiens
FRKLSLLLD

SEQ ID NO: 672705 - protein, 9 aa, Homo Sapiens
RDRNTKNEE

SEQ ID NO: 672706 - protein, 9 aa, Homo Sapiens
EGMSPEITS

SEQ ID NO: 672707 - protein, 9 aa, Homo Sapiens
LWRSRKWPF

SEQ ID NO: 672708 - protein, 9 aa, Homo Sapiens
FWDPHNFKS

SEQ ID NO: 672709 - protein, 9 aa, Homo Sapiens
PKNGVFRVE

SEQ ID NO: 672710 - protein, 9 aa, Homo Sapiens
TTGVIGISS

SEQ ID NO: 672711 - protein, 9 aa, Homo Sapiens
RDSPRCLMM

SEQ ID NO: 672712 - protein, 9 aa, Homo Sapiens
IEQTSLTMM

SEQ ID NO: 672713 - protein, 9 aa, Homo Sapiens
SHLPESLAA

SEQ ID NO: 672714 - protein, 9 aa, Homo Sapiens
APACLQKMI

SEQ ID NO: 672715 - protein, 9 aa, Homo Sapiens
HAGNGEAIR

SEQ ID NO: 672716 - protein, 9 aa, Homo Sapiens
GRPEESRVS

SEQ ID NO: 672717 - protein, 9 aa, Homo Sapiens
YEVYMRRLR

SEQ ID NO: 672718 - protein, 9 aa, Homo Sapiens
AWGSQWFWW

SEQ ID NO: 672719 - protein, 9 aa, Homo Sapiens
TFTPSELGK

SEQ ID NO: 672720 - protein, 9 aa, Homo Sapiens
KAHKPWAKK

SEQ ID NO: 672721 - protein, 9 aa, Homo Sapiens
PLAILSSHF

SEQ ID NO: 672722 - protein, 9 aa, Homo Sapiens
DEVDDELAG

SEQ ID NO: 672723 - protein, 9 aa, Homo Sapiens
EDFQKFQTQ

SEQ ID NO: 672724 - protein, 9 aa, Homo Sapiens
QIEQLHRIF

SEQ ID NO: 672725 - protein, 9 aa, Homo Sapiens
ARSNPSELL

SEQ ID NO: 672726 - protein, 9 aa, Homo Sapiens
QAVTAVLTE

SEQ ID NO: 672727 - protein, 9 aa, Homo Sapiens
QLHSSLPPV

SEQ ID NO: 672728 - protein, 9 aa, Homo Sapiens
QSPGARQPP

SEQ ID NO: 672729 - protein, 9 aa, Homo Sapiens
EGIMVIINK

SEQ ID NO: 672730 - protein, 9 aa, Homo Sapiens
FVIIPKSYT

SEQ ID NO: 672731 - protein, 9 aa, Homo Sapiens
IRENYLVRW

SEQ ID NO: 672732 - protein, 9 aa, Homo Sapiens
NREAFQGCT

SEQ ID NO: 672733 - protein, 9 aa, Homo Sapiens
RFCCCRKAK

SEQ ID NO: 672734 - protein, 9 aa, Homo Sapiens
GQDLAYTVK

SEQ ID NO: 672735 - protein, 9 aa, Homo Sapiens
GAGDTAFPE

SEQ ID NO: 672736 - protein, 9 aa, Homo Sapiens
GQPPQQRQQ

SEQ ID NO: 672737 - protein, 9 aa, Homo Sapiens
KPTSTVLPW

SEQ ID NO: 672738 - protein, 9 aa, Homo Sapiens
ARPGGALCR

SEQ ID NO: 672739 - protein, 9 aa, Homo Sapiens
SEVMMLALM

SEQ ID NO: 672740 - protein, 9 aa, Homo Sapiens
SGQPPQQRQ

SEQ ID NO: 672741 - protein, 9 aa, Homo Sapiens
HLAVWGRML

SEQ ID NO: 672742 - protein, 9 aa, Homo Sapiens
TFFANHDDS

SEQ ID NO: 672743 - protein, 9 aa, Homo Sapiens
QGYVLFFKT

SEQ ID NO: 672744 - protein, 9 aa, Homo Sapiens
STGLRRTLH

SEQ ID NO: 672745 - protein, 9 aa, Homo Sapiens
EIFKSLPVG

SEQ ID NO: 672746 - protein, 9 aa, Homo Sapiens
SLCRDPRGA

SEQ ID NO: 672747 - protein, 9 aa, Homo Sapiens
SEQPAAGQL

SEQ ID NO: 672748 - protein, 9 aa, Homo Sapiens
SETASLPII

SEQ ID NO: 672749 - protein, 9 aa, Homo Sapiens
AWLQDARRW

SEQ ID NO: 672750 - protein, 9 aa, Homo Sapiens
PQQRQQPLN

SEQ ID NO: 672751 - protein, 9 aa, Homo Sapiens
GVGSLEEVR

SEQ ID NO: 672752 - protein, 9 aa, Homo Sapiens
GYISIDAMR

SEQ ID NO: 672753 - protein, 9 aa, Homo Sapiens
QQNMMDQCY

SEQ ID NO: 672754 - protein, 9 aa, Homo Sapiens
RMATEKTQL

SEQ ID NO: 672755 - protein, 9 aa, Homo Sapiens
GRSPQERLS

SEQ ID NO: 672756 - protein, 9 aa, Homo Sapiens
GKRLGPRGN

SEQ ID NO: 672757 - protein, 9 aa, Homo Sapiens
FEIPVLHSL

SEQ ID NO: 672758 - protein, 9 aa, Homo Sapiens
VPLSSSSFR

SEQ ID NO: 672759 - protein, 9 aa, Homo Sapiens
IGLDGGRRG

SEQ ID NO: 672760 - protein, 9 aa, Homo Sapiens
SATLRAPAH

SEQ ID NO: 672761 - protein, 9 aa, Homo Sapiens
LPHTEHCVH

SEQ ID NO: 672762 - protein, 9 aa, Homo Sapiens
TNSTVPVAD

SEQ ID NO: 672763 - protein, 9 aa, Homo Sapiens
FFANHDDSR

SEQ ID NO: 672764 - protein, 9 aa, Homo Sapiens
RIFKQLSGD

SEQ ID NO: 672765 - protein, 9 aa, Homo Sapiens
ATDLNNLFS

SEQ ID NO: 672766 - protein, 9 aa, Homo Sapiens
DRHCFKMSK

SEQ ID NO: 672767 - protein, 9 aa, Homo Sapiens
GKAFTFSLT

SEQ ID NO: 672768 - protein, 9 aa, Homo Sapiens
TKMVSHLEK

SEQ ID NO: 672769 - protein, 9 aa, Homo Sapiens
RSTKKTRRR

SEQ ID NO: 672770 - protein, 9 aa, Homo Sapiens
DDPVPVPNV

SEQ ID NO: 672771 - protein, 9 aa, Homo Sapiens
NWQGAEKDS

SEQ ID NO: 672772 - protein, 9 aa, Homo Sapiens
QPLNTDAAK

SEQ ID NO: 672773 - protein, 9 aa, Homo Sapiens
CSVNEFAKH

SEQ ID NO: 672774 - protein, 9 aa, Homo Sapiens
HVPARPGGA

SEQ ID NO: 672775 - protein, 9 aa, Homo Sapiens
VDFGISLLF

SEQ ID NO: 672776 - protein, 9 aa, Homo Sapiens
FAKTVSKDP

SEQ ID NO: 672777 - protein, 9 aa, Homo Sapiens
RRGHEPWRR

SEQ ID NO: 672778 - protein, 9 aa, Homo Sapiens
SKVFSIFPE

SEQ ID NO: 672779 - protein, 9 aa, Homo Sapiens
REDMIYIKL

SEQ ID NO: 672780 - protein, 9 aa, Homo Sapiens
KIIGTWKDA

SEQ ID NO: 672781 - protein, 9 aa, Homo Sapiens
LTMMQAVGG

SEQ ID NO: 672782 - protein, 9 aa, Homo Sapiens
PAQRIASDD

SEQ ID NO: 672783 - protein, 9 aa, Homo Sapiens
KQPSLPLSK

SEQ ID NO: 672784 - protein, 9 aa, Homo Sapiens
QERFCCCRK

SEQ ID NO: 672785 - protein, 9 aa, Homo Sapiens
CLKNEVTDL

SEQ ID NO: 672786 - protein, 9 aa, Homo Sapiens
IQSSATLRA

SEQ ID NO: 672787 - protein, 9 aa, Homo Sapiens
DMIYIKLEK

SEQ ID NO: 672788 - protein, 9 aa, Homo Sapiens
MKSHCLKNE

SEQ ID NO: 672789 - protein, 9 aa, Homo Sapiens
SLKVYVYCS

SEQ ID NO: 672790 - protein, 9 aa, Homo Sapiens
TCGDHSDPR

SEQ ID NO: 672791 - protein, 9 aa, Homo Sapiens
NHKMPPDII

SEQ ID NO: 672792 - protein, 9 aa, Homo Sapiens
LAACGAQAA

SEQ ID NO: 672793 - protein, 9 aa, Homo Sapiens
SGSEPWLCQ

SEQ ID NO: 672794 - protein, 9 aa, Homo Sapiens
DAMRKFLGE

SEQ ID NO: 672795 - protein, 9 aa, Homo Sapiens
GKKIIGTWK

SEQ ID NO: 672796 - protein, 9 aa, Homo Sapiens
TLQQVKIIL

SEQ ID NO: 672797 - protein, 9 aa, Homo Sapiens
PNKQTVIRE

SEQ ID NO: 672798 - protein, 9 aa, Homo Sapiens
IDVHGTKMV

SEQ ID NO: 672799 - protein, 9 aa, Homo Sapiens
EGQAVTAVL

SEQ ID NO: 672800 - protein, 9 aa, Homo Sapiens
KWFCDKPLN

SEQ ID NO: 672801 - protein, 9 aa, Homo Sapiens
KCSHCDMCF

SEQ ID NO: 672802 - protein, 9 aa, Homo Sapiens
TAYLLGKPL

SEQ ID NO: 672803 - protein, 9 aa, Homo Sapiens
IFDFKNSLP

SEQ ID NO: 672804 - protein, 9 aa, Homo Sapiens
GQFQAGSGS

SEQ ID NO: 672805 - protein, 9 aa, Homo Sapiens
QAAQIGLDG

SEQ ID NO: 672806 - protein, 9 aa, Homo Sapiens
TESKSSGYK

SEQ ID NO: 672807 - protein, 9 aa, Homo Sapiens
ESERFYRKC

SEQ ID NO: 672808 - protein, 9 aa, Homo Sapiens
VIGISSKMD

SEQ ID NO: 672809 - protein, 9 aa, Homo Sapiens
AGALALLGT

SEQ ID NO: 672810 - protein, 9 aa, Homo Sapiens
LLWGRPEES

SEQ ID NO: 672811 - protein, 9 aa, Homo Sapiens
RCQAGRSPQ

SEQ ID NO: 672812 - protein, 9 aa, Homo Sapiens
VGSLEEVRD

SEQ ID NO: 672813 - protein, 9 aa, Homo Sapiens
TQVPLSSSS

SEQ ID NO: 672814 - protein, 9 aa, Homo Sapiens
VSEVMMLAL

SEQ ID NO: 672815 - protein, 9 aa, Homo Sapiens
VADSIPDPE

SEQ ID NO: 672816 - protein, 9 aa, Homo Sapiens
DKLRRIKAT

SEQ ID NO: 672817 - protein, 9 aa, Homo Sapiens
SGDRFRSRG

SEQ ID NO: 672818 - protein, 9 aa, Homo Sapiens
KFKEEPVEI

SEQ ID NO: 672819 - protein, 9 aa, Homo Sapiens
GVDKQLLSA

SEQ ID NO: 672820 - protein, 9 aa, Homo Sapiens
FIPKKEEEA

SEQ ID NO: 672821 - protein, 9 aa, Homo Sapiens
GDRTVGWIL

SEQ ID NO: 672822 - protein, 9 aa, Homo Sapiens
GNPTAATDM

SEQ ID NO: 672823 - protein, 9 aa, Homo Sapiens
LLRVLQTPG

SEQ ID NO: 672824 - protein, 9 aa, Homo Sapiens
QEAAENYRR

SEQ ID NO: 672825 - protein, 9 aa, Homo Sapiens
ITTSAGWDV

SEQ ID NO: 672826 - protein, 9 aa, Homo Sapiens
CVSTGTASG

SEQ ID NO: 672827 - protein, 9 aa, Homo Sapiens
FQTNLVSYP

SEQ ID NO: 672828 - protein, 9 aa, Homo Sapiens
QTEAVTFFA

SEQ ID NO: 672829 - protein, 9 aa, Homo Sapiens
VFSIFPEED

SEQ ID NO: 672830 - protein, 9 aa, Homo Sapiens
RRLLHFAQL

SEQ ID NO: 672831 - protein, 9 aa, Homo Sapiens
SQWNKWEVV

SEQ ID NO: 672832 - protein, 9 aa, Homo Sapiens
RIDEDDFAH

SEQ ID NO: 672833 - protein, 9 aa, Homo Sapiens
LFVRDRCGT

SEQ ID NO: 672834 - protein, 9 aa, Homo Sapiens
PEAKENKQI

SEQ ID NO: 672835 - protein, 9 aa, Homo Sapiens
SGYKFSKSQ

SEQ ID NO: 672836 - protein, 9 aa, Homo Sapiens
DICFYININ

SEQ ID NO: 672837 - protein, 9 aa, Homo Sapiens
CLSLGPLSS

SEQ ID NO: 672838 - protein, 9 aa, Homo Sapiens
RTVGWILSI

SEQ ID NO: 672839 - protein, 9 aa, Homo Sapiens
GLSAAPPAP

SEQ ID NO: 672840 - protein, 9 aa, Homo Sapiens
AKDMCGHSG

SEQ ID NO: 672841 - protein, 9 aa, Homo Sapiens
EKLNQLWQK

SEQ ID NO: 672842 - protein, 9 aa, Homo Sapiens
LTSNCEKEG

SEQ ID NO: 672843 - protein, 9 aa, Homo Sapiens
YLWAVRSTQ

SEQ ID NO: 672844 - protein, 9 aa, Homo Sapiens
EINHAEREL

SEQ ID NO: 672845 - protein, 9 aa, Homo Sapiens
FLSHLSFVN

SEQ ID NO: 672846 - protein, 9 aa, Homo Sapiens
HKGQDAGYI

SEQ ID NO: 672847 - protein, 9 aa, Homo Sapiens
RTPGQLHSS

SEQ ID NO: 672848 - protein, 9 aa, Homo Sapiens
EEPVEIQDG

SEQ ID NO: 672849 - protein, 9 aa, Homo Sapiens
GPFEIPVLH

SEQ ID NO: 672850 - protein, 9 aa, Homo Sapiens
RAVQFQAIQ

SEQ ID NO: 672851 - protein, 9 aa, Homo Sapiens
LEIKKDEKK

SEQ ID NO: 672852 - protein, 9 aa, Homo Sapiens
RLGPRGNSL

SEQ ID NO: 672853 - protein, 9 aa, Homo Sapiens
ALQRRKAPP

SEQ ID NO: 672854 - protein, 9 aa, Homo Sapiens
SFRYRSSCE

SEQ ID NO: 672855 - protein, 9 aa, Homo Sapiens
VQDISGLPS

SEQ ID NO: 672856 - protein, 9 aa, Homo Sapiens
TDLNNLFSK

SEQ ID NO: 672857 - protein, 9 aa, Homo Sapiens
FKEEPVEIQ

SEQ ID NO: 672858 - protein, 9 aa, Homo Sapiens
TVYPVIKEE

SEQ ID NO: 672859 - protein, 9 aa, Homo Sapiens
AACGAQAAA

SEQ ID NO: 672860 - protein, 9 aa, Homo Sapiens
NKQTVIREN

SEQ ID NO: 672861 - protein, 9 aa, Homo Sapiens
QPPLTRPTP

SEQ ID NO: 672862 - protein, 9 aa, Homo Sapiens
LGPLSSSVI

SEQ ID NO: 672863 - protein, 9 aa, Homo Sapiens
SLYDTLNQY

SEQ ID NO: 672864 - protein, 9 aa, Homo Sapiens
STYLVCPQD

SEQ ID NO: 672865 - protein, 9 aa, Homo Sapiens
GSAREKAHI

SEQ ID NO: 672866 - protein, 9 aa, Homo Sapiens
TLIQRTNRE

SEQ ID NO: 672867 - protein, 9 aa, Homo Sapiens
VEIEKVAQL

SEQ ID NO: 672868 - protein, 9 aa, Homo Sapiens
RPSFNGTPI

SEQ ID NO: 672869 - protein, 9 aa, Homo Sapiens
YPNITNPEY

SEQ ID NO: 672870 - protein, 9 aa, Homo Sapiens
GNREDPAEA

SEQ ID NO: 672871 - protein, 9 aa, Homo Sapiens
PKRQRGGCC

SEQ ID NO: 672872 - protein, 9 aa, Homo Sapiens
LCVHEGMSP

SEQ ID NO: 672873 - protein, 9 aa, Homo Sapiens
ETARKSQWN

SEQ ID NO: 672874 - protein, 9 aa, Homo Sapiens
ILLWGARYD

SEQ ID NO: 672875 - protein, 9 aa, Homo Sapiens
PPRPAYQVF

SEQ ID NO: 672876 - protein, 9 aa, Homo Sapiens
VEQTLSYLE

SEQ ID NO: 672877 - protein, 9 aa, Homo Sapiens
AENYRRLFQ

SEQ ID NO: 672878 - protein, 9 aa, Homo Sapiens
AQSPPPSPC

SEQ ID NO: 672879 - protein, 9 aa, Homo Sapiens
TTKHANKIT

SEQ ID NO: 672880 - protein, 9 aa, Homo Sapiens
MYFEHYRSI

SEQ ID NO: 672881 - protein, 9 aa, Homo Sapiens
ICCINRQSQ

SEQ ID NO: 672882 - protein, 9 aa, Homo Sapiens
LAEDVEEIN

SEQ ID NO: 672883 - protein, 9 aa, Homo Sapiens
MIYIKLEKP

SEQ ID NO: 672884 - protein, 9 aa, Homo Sapiens
TLTHLQPST

SEQ ID NO: 672885 - protein, 9 aa, Homo Sapiens
GSGGKSRRA

SEQ ID NO: 672886 - protein, 9 aa, Homo Sapiens
DRRSRLVLS

SEQ ID NO: 672887 - protein, 9 aa, Homo Sapiens
SPPPSPCLS

SEQ ID NO: 672888 - protein, 9 aa, Homo Sapiens
KNGVFRVEK

SEQ ID NO: 672889 - protein, 9 aa, Homo Sapiens
QCESKVVAG

SEQ ID NO: 672890 - protein, 9 aa, Homo Sapiens
HEGMSPEIT

SEQ ID NO: 672891 - protein, 9 aa, Homo Sapiens
QKMIRSSVF

SEQ ID NO: 672892 - protein, 9 aa, Homo Sapiens
PPLTRPTPG

SEQ ID NO: 672893 - protein, 9 aa, Homo Sapiens
MGQCRLSMK

SEQ ID NO: 672894 - protein, 9 aa, Homo Sapiens
GGAGAAAPC

SEQ ID NO: 672895 - protein, 9 aa, Homo Sapiens
AKGEGENKS

SEQ ID NO: 672896 - protein, 9 aa, Homo Sapiens
KQLLSALVM

SEQ ID NO: 672897 - protein, 9 aa, Homo Sapiens
FNGTPIPWL

SEQ ID NO: 672898 - protein, 9 aa, Homo Sapiens
ACSIQSSAT

SEQ ID NO: 672899 - protein, 9 aa, Homo Sapiens
DHEPGPKRQ

SEQ ID NO: 672900 - protein, 9 aa, Homo Sapiens
TPGHRLVPS

SEQ ID NO: 672901 - protein, 9 aa, Homo Sapiens
PGLLMAVQQ

SEQ ID NO: 672902 - protein, 9 aa, Homo Sapiens
EPCGNSTYL

SEQ ID NO: 672903 - protein, 9 aa, Homo Sapiens
CGNSTYLVC

SEQ ID NO: 672904 - protein, 9 aa, Homo Sapiens
PPQQRQQPL

SEQ ID NO: 672905 - protein, 9 aa, Homo Sapiens
LEQKVVLVQ

SEQ ID NO: 672906 - protein, 9 aa, Homo Sapiens
EETETQLRN

SEQ ID NO: 672907 - protein, 9 aa, Homo Sapiens
INHAERELR

SEQ ID NO: 672908 - protein, 9 aa, Homo Sapiens
RGHEPWRRL

SEQ ID NO: 672909 - protein, 9 aa, Homo Sapiens
RVTRAAILM

SEQ ID NO: 672910 - protein, 9 aa, Homo Sapiens
GAEPETQCE

SEQ ID NO: 672911 - protein, 9 aa, Homo Sapiens
AEQADLKML

SEQ ID NO: 672912 - protein, 9 aa, Homo Sapiens
DSAFLAKDF

SEQ ID NO: 672913 - protein, 9 aa, Homo Sapiens
AVLTEPPTL

SEQ ID NO: 672914 - protein, 9 aa, Homo Sapiens
VAKFKEEPV

SEQ ID NO: 672915 - protein, 9 aa, Homo Sapiens
VDDELAGKS

SEQ ID NO: 672916 - protein, 9 aa, Homo Sapiens
NRLLIGIIR

SEQ ID NO: 672917 - protein, 9 aa, Homo Sapiens
SSSSFRSKQ

SEQ ID NO: 672918 - protein, 9 aa, Homo Sapiens
EMASYFNSC

SEQ ID NO: 672919 - protein, 9 aa, Homo Sapiens
KRMATEKTQ

SEQ ID NO: 672920 - protein, 9 aa, Homo Sapiens
QVFGSVCAA

SEQ ID NO: 672921 - protein, 9 aa, Homo Sapiens
SLTLNTHKR

SEQ ID NO: 672922 - protein, 9 aa, Homo Sapiens
IILINNPLV

SEQ ID NO: 672923 - protein, 9 aa, Homo Sapiens
AQAAAYGRC

SEQ ID NO: 672924 - protein, 9 aa, Homo Sapiens
HRAFTNMPF

SEQ ID NO: 672925 - protein, 9 aa, Homo Sapiens
TMETAKSTC

SEQ ID NO: 672926 - protein, 9 aa, Homo Sapiens
RPRKQSPGA

SEQ ID NO: 672927 - protein, 9 aa, Homo Sapiens
WGTKSHPTK

SEQ ID NO: 672928 - protein, 9 aa, Homo Sapiens
QWFWWHWQG

SEQ ID NO: 672929 - protein, 9 aa, Homo Sapiens
KVWSLCRDP

SEQ ID NO: 672930 - protein, 9 aa, Homo Sapiens
VLGKELLTR

SEQ ID NO: 672931 - protein, 9 aa, Homo Sapiens
DLAYVSVAT

SEQ ID NO: 672932 - protein, 9 aa, Homo Sapiens
IDRHCFKMS

SEQ ID NO: 672933 - protein, 9 aa, Homo Sapiens
HVHKDALTV

SEQ ID NO: 672934 - protein, 9 aa, Homo Sapiens
EMHLIHAGN

SEQ ID NO: 672935 - protein, 9 aa, Homo Sapiens
KKRVLRSSF

SEQ ID NO: 672936 - protein, 9 aa, Homo Sapiens
HEPGPKRQR

SEQ ID NO: 672937 - protein, 9 aa, Homo Sapiens
SRHYRKAHS

SEQ ID NO: 672938 - protein, 9 aa, Homo Sapiens
GPEPWTQLY

SEQ ID NO: 672939 - protein, 9 aa, Homo Sapiens
VKRHSALWE

SEQ ID NO: 672940 - protein, 9 aa, Homo Sapiens
PKKTIQMVS

SEQ ID NO: 672941 - protein, 9 aa, Homo Sapiens
RRLFQEILN

SEQ ID NO: 672942 - protein, 9 aa, Homo Sapiens
ERTVAALQV

SEQ ID NO: 672943 - protein, 9 aa, Homo Sapiens
KSPKTMRKF

SEQ ID NO: 672944 - protein, 9 aa, Homo Sapiens
RSPSNMSAH

SEQ ID NO: 672945 - protein, 9 aa, Homo Sapiens
QDLAYTVKN

SEQ ID NO: 672946 - protein, 9 aa, Homo Sapiens
KRDGDDRRS

SEQ ID NO: 672947 - protein, 9 aa, Homo Sapiens
GNSTYLVCP

SEQ ID NO: 672948 - protein, 9 aa, Homo Sapiens
NQRLLPPED

SEQ ID NO: 672949 - protein, 9 aa, Homo Sapiens
RATDLNNLF

SEQ ID NO: 672950 - protein, 9 aa, Homo Sapiens
RSREDMIYI

SEQ ID NO: 672951 - protein, 9 aa, Homo Sapiens
GTIIVETSH

SEQ ID NO: 672952 - protein, 9 aa, Homo Sapiens
GQCRLSMKV

SEQ ID NO: 672953 - protein, 9 aa, Homo Sapiens
GEKNGMGQC

SEQ ID NO: 672954 - protein, 9 aa, Homo Sapiens
ASPELQPST

SEQ ID NO: 672955 - protein, 9 aa, Homo Sapiens
ETWGSGGKG

SEQ ID NO: 672956 - protein, 9 aa, Homo Sapiens
VGAEPETQC

SEQ ID NO: 672957 - protein, 9 aa, Homo Sapiens
DLGVNGQVT

SEQ ID NO: 672958 - protein, 9 aa, Homo Sapiens
QQDLYCFPF

SEQ ID NO: 672959 - protein, 9 aa, Homo Sapiens
GTWKDARIH

SEQ ID NO: 672960 - protein, 9 aa, Homo Sapiens
AARDRNTKN

SEQ ID NO: 672961 - protein, 9 aa, Homo Sapiens
GKSRRAGAA

SEQ ID NO: 672962 - protein, 9 aa, Homo Sapiens
QTTCVNANM

SEQ ID NO: 672963 - protein, 9 aa, Homo Sapiens
EDGFRKAHK

SEQ ID NO: 672964 - protein, 9 aa, Homo Sapiens
INRQSQTTC

SEQ ID NO: 672965 - protein, 9 aa, Homo Sapiens
PGNREDPAE

SEQ ID NO: 672966 - protein, 9 aa, Homo Sapiens
FYRKCRQHS

SEQ ID NO: 672967 - protein, 9 aa, Homo Sapiens
PATMGAFYC

SEQ ID NO: 672968 - protein, 9 aa, Homo Sapiens
YFFISQHAL

SEQ ID NO: 672969 - protein, 9 aa, Homo Sapiens
KKNISALMK

SEQ ID NO: 672970 - protein, 9 aa, Homo Sapiens
AMRKFLGEL

SEQ ID NO: 672971 - protein, 9 aa, Homo Sapiens
PSELLCPPS

SEQ ID NO: 672972 - protein, 9 aa, Homo Sapiens
AVQVLEYPW

SEQ ID NO: 672973 - protein, 9 aa, Homo Sapiens
KRQRGGCCP

SEQ ID NO: 672974 - protein, 9 aa, Homo Sapiens
PRCLMMALS

SEQ ID NO: 672975 - protein, 9 aa, Homo Sapiens
HGGCPLEPP

SEQ ID NO: 672976 - protein, 9 aa, Homo Sapiens
QQVKIILIN

SEQ ID NO: 672977 - protein, 9 aa, Homo Sapiens
LQLTCGDHS

SEQ ID NO: 672978 - protein, 9 aa, Homo Sapiens
YRKAHSCYK

SEQ ID NO: 672979 - protein, 9 aa, Homo Sapiens
KELLWGRPE

SEQ ID NO: 672980 - protein, 9 aa, Homo Sapiens
NCCYLWAVR

SEQ ID NO: 672981 - protein, 9 aa, Homo Sapiens
YRRLFQEIL

SEQ ID NO: 672982 - protein, 9 aa, Homo Sapiens
SPSNMSAHL

SEQ ID NO: 672983 - protein, 9 aa, Homo Sapiens
GRCVSVPCL

SEQ ID NO: 672984 - protein, 9 aa, Homo Sapiens
LSALSHLPE

SEQ ID NO: 672985 - protein, 9 aa, Homo Sapiens
IIIRYEVYM

SEQ ID NO: 672986 - protein, 9 aa, Homo Sapiens
VNRRPSRES

SEQ ID NO: 672987 - protein, 9 aa, Homo Sapiens
LQQVKIILI

SEQ ID NO: 672988 - protein, 9 aa, Homo Sapiens
WAAVFGVTL

SEQ ID NO: 672989 - protein, 9 aa, Homo Sapiens
LPGTVYPVI

SEQ ID NO: 672990 - protein, 9 aa, Homo Sapiens
QKFQTQNFD

SEQ ID NO: 672991 - protein, 9 aa, Homo Sapiens
PETQCESKV

SEQ ID NO: 672992 - protein, 9 aa, Homo Sapiens
SHCDMCFSR

SEQ ID NO: 672993 - protein, 9 aa, Homo Sapiens
TCSSKSPDF

SEQ ID NO: 672994 - protein, 9 aa, Homo Sapiens
LLAPPGSPP

SEQ ID NO: 672995 - protein, 9 aa, Homo Sapiens
DKTVFLVFM

SEQ ID NO: 672996 - protein, 9 aa, Homo Sapiens
LTRPTPGAG

SEQ ID NO: 672997 - protein, 9 aa, Homo Sapiens
LELKPLAIL

SEQ ID NO: 672998 - protein, 9 aa, Homo Sapiens
VIRENYLVR

SEQ ID NO: 672999 - protein, 9 aa, Homo Sapiens
KSTQEGRVC

SEQ ID NO: 673000 - protein, 9 aa, Homo Sapiens
LKKNISALM

SEQ ID NO: 673001 - protein, 9 aa, Homo Sapiens
NRRNRWKRQ

SEQ ID NO: 673002 - protein, 9 aa, Homo Sapiens
LSKDAHPSV

SEQ ID NO: 673003 - protein, 9 aa, Homo Sapiens
DQGAQGYVL

SEQ ID NO: 673004 - protein, 9 aa, Homo Sapiens
CGKAFTFSL

SEQ ID NO: 673005 - protein, 9 aa, Homo Sapiens
WLQDARRWQ

SEQ ID NO: 673006 - protein, 9 aa, Homo Sapiens
LGVNGQVTC

SEQ ID NO: 673007 - protein, 9 aa, Homo Sapiens
FNCVSSLIQ

SEQ ID NO: 673008 - protein, 9 aa, Homo Sapiens
GGVHVHKDA

SEQ ID NO: 673009 - protein, 9 aa, Homo Sapiens
GPPVMEKQV

SEQ ID NO: 673010 - protein, 9 aa, Homo Sapiens
ASYFNSCSV

SEQ ID NO: 673011 - protein, 9 aa, Homo Sapiens
NKEENSAFK

SEQ ID NO: 673012 - protein, 9 aa, Homo Sapiens
KSQWNKWEV

SEQ ID NO: 673013 - protein, 9 aa, Homo Sapiens
GPLAHQDQV

SEQ ID NO: 673014 - protein, 9 aa, Homo Sapiens
DNCKVERKH

SEQ ID NO: 673015 - protein, 9 aa, Homo Sapiens
ACGAQAAAY

SEQ ID NO: 673016 - protein, 9 aa, Homo Sapiens
LALLGTVTV

SEQ ID NO: 673017 - protein, 9 aa, Homo Sapiens
LVPSQLPPL

SEQ ID NO: 673018 - protein, 9 aa, Homo Sapiens
SNRLLIGII

SEQ ID NO: 673019 - protein, 9 aa, Homo Sapiens
DALTVTSPV

SEQ ID NO: 673020 - protein, 9 aa, Homo Sapiens
TWFEQSPIE

SEQ ID NO: 673021 - protein, 9 aa, Homo Sapiens
HEYTLTHLQ

SEQ ID NO: 673022 - protein, 9 aa, Homo Sapiens
GVIGISSKM

SEQ ID NO: 673023 - protein, 9 aa, Homo Sapiens
YSIAFMGSD

SEQ ID NO: 673024 - protein, 9 aa, Homo Sapiens
TIPEDFQKF

SEQ ID NO: 673025 - protein, 9 aa, Homo Sapiens
KNEVTDLSM

SEQ ID NO: 673026 - protein, 9 aa, Homo Sapiens
SERAVQFQA

SEQ ID NO: 673027 - protein, 9 aa, Homo Sapiens
SPFFSWKTQ

SEQ ID NO: 673028 - protein, 9 aa, Homo Sapiens
LGGQGVGSL

SEQ ID NO: 673029 - protein, 9 aa, Homo Sapiens
WTDRVLWRS

SEQ ID NO: 673030 - protein, 9 aa, Homo Sapiens
KKIIGTWKD

SEQ ID NO: 673031 - protein, 9 aa, Homo Sapiens
EVDDELAGK

SEQ ID NO: 673032 - protein, 9 aa, Homo Sapiens
GDTMETAKS

SEQ ID NO: 673033 - protein, 9 aa, Homo Sapiens
HCDMCFSRS

SEQ ID NO: 673034 - protein, 9 aa, Homo Sapiens
LQAPGMYFE

SEQ ID NO: 673035 - protein, 9 aa, Homo Sapiens
GIASKNEQL

SEQ ID NO: 673036 - protein, 9 aa, Homo Sapiens
FVGKRLGPR

SEQ ID NO: 673037 - protein, 9 aa, Homo Sapiens
AILALQRRK

SEQ ID NO: 673038 - protein, 9 aa, Homo Sapiens
SYPRIHFPL

SEQ ID NO: 673039 - protein, 9 aa, Homo Sapiens
IFKQLSGDQ

SEQ ID NO: 673040 - protein, 9 aa, Homo Sapiens
EFCSSDSQD

SEQ ID NO: 673041 - protein, 9 aa, Homo Sapiens
GACPLPLGL

SEQ ID NO: 673042 - protein, 9 aa, Homo Sapiens
QAPGMYFEH

SEQ ID NO: 673043 - protein, 9 aa, Homo Sapiens
TVPVADSIP

SEQ ID NO: 673044 - protein, 9 aa, Homo Sapiens
GSGGKGNSA

SEQ ID NO: 673045 - protein, 9 aa, Homo Sapiens
AFTFSLTLN

SEQ ID NO: 673046 - protein, 9 aa, Homo Sapiens
SSKSPKTMR

SEQ ID NO: 673047 - protein, 9 aa, Homo Sapiens
PAFRKLSLL

SEQ ID NO: 673048 - protein, 9 aa, Homo Sapiens
STGTASGPS

SEQ ID NO: 673049 - protein, 9 aa, Homo Sapiens
NPPLADALL

SEQ ID NO: 673050 - protein, 9 aa, Homo Sapiens
PQNQRLLPP

SEQ ID NO: 673051 - protein, 9 aa, Homo Sapiens
WTQLYDWPY

SEQ ID NO: 673052 - protein, 9 aa, Homo Sapiens
NLYESLYDT

SEQ ID NO: 673053 - protein, 9 aa, Homo Sapiens
QSSATLRAP

SEQ ID NO: 673054 - protein, 9 aa, Homo Sapiens
MLKQIENLE

SEQ ID NO: 673055 - protein, 9 aa, Homo Sapiens
SPQERLSRL

SEQ ID NO: 673056 - protein, 9 aa, Homo Sapiens
LHRIFKQLS

SEQ ID NO: 673057 - protein, 9 aa, Homo Sapiens
VVIQAKDMC

SEQ ID NO: 673058 - protein, 9 aa, Homo Sapiens
RGAQSPPPS

SEQ ID NO: 673059 - protein, 9 aa, Homo Sapiens
VYMRRLRST

SEQ ID NO: 673060 - protein, 9 aa, Homo Sapiens
GQLRPQPEL

SEQ ID NO: 673061 - protein, 9 aa, Homo Sapiens
LIHAGNGEA

SEQ ID NO: 673062 - protein, 9 aa, Homo Sapiens
GCKAGPLAH

SEQ ID NO: 673063 - protein, 9 aa, Homo Sapiens
VKALGDWLA

SEQ ID NO: 673064 - protein, 9 aa, Homo Sapiens
FSHLAVWGR

SEQ ID NO: 673065 - protein, 9 aa, Homo Sapiens
ACCTASCFR

SEQ ID NO: 673066 - protein, 9 aa, Homo Sapiens
PLSSNEIFK

SEQ ID NO: 673067 - protein, 9 aa, Homo Sapiens
ESKSSGYKF

SEQ ID NO: 673068 - protein, 9 aa, Homo Sapiens
GRRSTKKTR

SEQ ID NO: 673069 - protein, 9 aa, Homo Sapiens
PLLAPPGSP

SEQ ID NO: 673070 - protein, 9 aa, Homo Sapiens
PRKQSPGAR

SEQ ID NO: 673071 - protein, 9 aa, Homo Sapiens
AGAPGNRED

SEQ ID NO: 673072 - protein, 9 aa, Homo Sapiens
QVGEFPWQV

SEQ ID NO: 673073 - protein, 9 aa, Homo Sapiens
SHLSFVNFC

SEQ ID NO: 673074 - protein, 9 aa, Homo Sapiens
LTGDTMETA

SEQ ID NO: 673075 - protein, 9 aa, Homo Sapiens
QGPATMGAF

SEQ ID NO: 673076 - protein, 9 aa, Homo Sapiens
LRRTLHLLQ

SEQ ID NO: 673077 - protein, 9 aa, Homo Sapiens
QPELPVHVP

SEQ ID NO: 673078 - protein, 9 aa, Homo Sapiens
SCFRPSSSV

SEQ ID NO: 673079 - protein, 9 aa, Homo Sapiens
PVHVPARPG

SEQ ID NO: 673080 - protein, 9 aa, Homo Sapiens
CTSPAFRKL

SEQ ID NO: 673081 - protein, 9 aa, Homo Sapiens
FFCCFDDCR

SEQ ID NO: 673082 - protein, 9 aa, Homo Sapiens
QWEQAAQIG

SEQ ID NO: 673083 - protein, 9 aa, Homo Sapiens
QKIDVHGTK

SEQ ID NO: 673084 - protein, 9 aa, Homo Sapiens
VAGALALLG

SEQ ID NO: 673085 - protein, 9 aa, Homo Sapiens
ININKEENS

SEQ ID NO: 673086 - protein, 9 aa, Homo Sapiens
QADLKMLTN

SEQ ID NO: 673087 - protein, 9 aa, Homo Sapiens
KMPEAKENK

SEQ ID NO: 673088 - protein, 9 aa, Homo Sapiens
VAQLKQFLT

SEQ ID NO: 673089 - protein, 9 aa, Homo Sapiens
TRSGKVFEN

SEQ ID NO: 673090 - protein, 9 aa, Homo Sapiens
TRATDLNNL

SEQ ID NO: 673091 - protein, 9 aa, Homo Sapiens
RRSTKKTRR

SEQ ID NO: 673092 - protein, 9 aa, Homo Sapiens
AGAAAPCAG

SEQ ID NO: 673093 - protein, 9 aa, Homo Sapiens
GGHKKRVLR

SEQ ID NO: 673094 - protein, 9 aa, Homo Sapiens
TDRVLWRSR

SEQ ID NO: 673095 - protein, 9 aa, Homo Sapiens
GGFVEDSAC

SEQ ID NO: 673096 - protein, 9 aa, Homo Sapiens
NVVRMHVGD

SEQ ID NO: 673097 - protein, 9 aa, Homo Sapiens
VKNKIGEEQ

SEQ ID NO: 673098 - protein, 9 aa, Homo Sapiens
SVTAQPKKV

SEQ ID NO: 673099 - protein, 9 aa, Homo Sapiens
MYFFISQHA

SEQ ID NO: 673100 - protein, 9 aa, Homo Sapiens
TASLPIIVS

SEQ ID NO: 673101 - protein, 9 aa, Homo Sapiens
VGQFQAGSG

SEQ ID NO: 673102 - protein, 9 aa, Homo Sapiens
NMPFQTNDF

SEQ ID NO: 673103 - protein, 9 aa, Homo Sapiens
TEPCGNSTY

SEQ ID NO: 673104 - protein, 9 aa, Homo Sapiens
QFLCVHEGM

SEQ ID NO: 673105 - protein, 9 aa, Homo Sapiens
KSPDFGLLV

SEQ ID NO: 673106 - protein, 9 aa, Homo Sapiens
CSHCDMCFS

SEQ ID NO: 673107 - protein, 9 aa, Homo Sapiens
PPLADALLS

SEQ ID NO: 673108 - protein, 9 aa, Homo Sapiens
PSCVPRLTL

SEQ ID NO: 673109 - protein, 9 aa, Homo Sapiens
QGKGLMIGI

SEQ ID NO: 673110 - protein, 9 aa, Homo Sapiens
VVHKGQDAG

SEQ ID NO: 673111 - protein, 9 aa, Homo Sapiens
GGALCRCQA

SEQ ID NO: 673112 - protein, 9 aa, Homo Sapiens
SELLCPPSP

SEQ ID NO: 673113 - protein, 9 aa, Homo Sapiens
KMELEQKVV

SEQ ID NO: 673114 - protein, 9 aa, Homo Sapiens
PNGTWSWGN

SEQ ID NO: 673115 - protein, 9 aa, Homo Sapiens
EELLRVVKN

SEQ ID NO: 673116 - protein, 9 aa, Homo Sapiens
FKPKYDGQD

SEQ ID NO: 673117 - protein, 9 aa, Homo Sapiens
WGACPLPLG

SEQ ID NO: 673118 - protein, 9 aa, Homo Sapiens
RCVSVPCLL

SEQ ID NO: 673119 - protein, 9 aa, Homo Sapiens
ATTDSDKRD

SEQ ID NO: 673120 - protein, 9 aa, Homo Sapiens
RFYRKCRQH

SEQ ID NO: 673121 - protein, 9 aa, Homo Sapiens
KLKSVSQPL

SEQ ID NO: 673122 - protein, 9 aa, Homo Sapiens
NRRPSRESA

SEQ ID NO: 673123 - protein, 9 aa, Homo Sapiens
LWGRPEESR

SEQ ID NO: 673124 - protein, 9 aa, Homo Sapiens
ERFCCCRKA

SEQ ID NO: 673125 - protein, 9 aa, Homo Sapiens
KEGRNLFVR

SEQ ID NO: 673126 - protein, 9 aa, Homo Sapiens
VQQDLYCFP

SEQ ID NO: 673127 - protein, 9 aa, Homo Sapiens
SAREKAHIA

SEQ ID NO: 673128 - protein, 9 aa, Homo Sapiens
FHHRLPPSR

SEQ ID NO: 673129 - protein, 9 aa, Homo Sapiens
GSVLDQGGS

SEQ ID NO: 673130 - protein, 9 aa, Homo Sapiens
ARLSDCLHL

SEQ ID NO: 673131 - protein, 9 aa, Homo Sapiens
VIMLIVFIY

SEQ ID NO: 673132 - protein, 9 aa, Homo Sapiens
ISAELSSFL

SEQ ID NO: 673133 - protein, 9 aa, Homo Sapiens
PTDETMCKS

SEQ ID NO: 673134 - protein, 9 aa, Homo Sapiens
GLGVGDTVD

SEQ ID NO: 673135 - protein, 9 aa, Homo Sapiens
SDEYSFAGR

SEQ ID NO: 673136 - protein, 9 aa, Homo Sapiens
LLTEAPINP

SEQ ID NO: 673137 - protein, 9 aa, Homo Sapiens
TVLYFGVSN

SEQ ID NO: 673138 - protein, 9 aa, Homo Sapiens
GSHSDIKNH

SEQ ID NO: 673139 - protein, 9 aa, Homo Sapiens
DPGTSGHGS

SEQ ID NO: 673140 - protein, 9 aa, Homo Sapiens
PVLLTEAPI

SEQ ID NO: 673141 - protein, 9 aa, Homo Sapiens
VGGPGDASI

SEQ ID NO: 673142 - protein, 9 aa, Homo Sapiens
SLITARYHR

SEQ ID NO: 673143 - protein, 9 aa, Homo Sapiens
LRRVACKHQ

SEQ ID NO: 673144 - protein, 9 aa, Homo Sapiens
ATGVQGEQG

SEQ ID NO: 673145 - protein, 9 aa, Homo Sapiens
LDYETVSAT

SEQ ID NO: 673146 - protein, 9 aa, Homo Sapiens
MLIVFIYDE

SEQ ID NO: 673147 - protein, 9 aa, Homo Sapiens
EHVCCFQPP

SEQ ID NO: 673148 - protein, 9 aa, Homo Sapiens
INPSKNREK

SEQ ID NO: 673149 - protein, 9 aa, Homo Sapiens
VKIPVAIKT

SEQ ID NO: 673150 - protein, 9 aa, Homo Sapiens
GPCLAAPIF

SEQ ID NO: 673151 - protein, 9 aa, Homo Sapiens
ISVIMLIVF

SEQ ID NO: 673152 - protein, 9 aa, Homo Sapiens
VCCFQPPIH

SEQ ID NO: 673153 - protein, 9 aa, Homo Sapiens
FTGGKYPVG

SEQ ID NO: 673154 - protein, 9 aa, Homo Sapiens
GQKCFNTRG

SEQ ID NO: 673155 - protein, 9 aa, Homo Sapiens
LPGPLPASH

SEQ ID NO: 673156 - protein, 9 aa, Homo Sapiens
LSKTRAKFH

SEQ ID NO: 673157 - protein, 9 aa, Homo Sapiens
WADRLEFTG

SEQ ID NO: 673158 - protein, 9 aa, Homo Sapiens
LDKTSRVST

SEQ ID NO: 673159 - protein, 9 aa, Homo Sapiens
GEGGGGSDG

SEQ ID NO: 673160 - protein, 9 aa, Homo Sapiens
HDGSAGKNL

SEQ ID NO: 673161 - protein, 9 aa, Homo Sapiens
MRINVGNNH

SEQ ID NO: 673162 - protein, 9 aa, Homo Sapiens
AQKQVKMID

SEQ ID NO: 673163 - protein, 9 aa, Homo Sapiens
KDLVLEPLS

SEQ ID NO: 673164 - protein, 9 aa, Homo Sapiens
FLRRVACKH

SEQ ID NO: 673165 - protein, 9 aa, Homo Sapiens
NHDIALLHL

SEQ ID NO: 673166 - protein, 9 aa, Homo Sapiens
KTRAKFHGK

SEQ ID NO: 673167 - protein, 9 aa, Homo Sapiens
LPTDETMCK

SEQ ID NO: 673168 - protein, 9 aa, Homo Sapiens
GDASIDAIY

SEQ ID NO: 673169 - protein, 9 aa, Homo Sapiens
FVVPSLITA

SEQ ID NO: 673170 - protein, 9 aa, Homo Sapiens
PGQKCFNTR

SEQ ID NO: 673171 - protein, 9 aa, Homo Sapiens
IMLIVFIYD

SEQ ID NO: 673172 - protein, 9 aa, Homo Sapiens
GPGDASIDA

SEQ ID NO: 673173 - protein, 9 aa, Homo Sapiens
DYLSKTRAK

SEQ ID NO: 673174 - protein, 9 aa, Homo Sapiens
LLTALHIEP

SEQ ID NO: 673175 - protein, 9 aa, Homo Sapiens
YLFGSHSDI

SEQ ID NO: 673176 - protein, 9 aa, Homo Sapiens
YLDSVIHSG

SEQ ID NO: 673177 - protein, 9 aa, Homo Sapiens
ILVDSFIWG

SEQ ID NO: 673178 - protein, 9 aa, Homo Sapiens
AGKNLREPG

SEQ ID NO: 673179 - protein, 9 aa, Homo Sapiens
LALQPTDGV

SEQ ID NO: 673180 - protein, 9 aa, Homo Sapiens
YYTISVIML

SEQ ID NO: 673181 - protein, 9 aa, Homo Sapiens
NEVMPLQDN

SEQ ID NO: 673182 - protein, 9 aa, Homo Sapiens
SGILVDSFI

SEQ ID NO: 673183 - protein, 9 aa, Homo Sapiens
QELNSHWGS

SEQ ID NO: 673184 - protein, 9 aa, Homo Sapiens
RLSDCLHLG

SEQ ID NO: 673185 - protein, 9 aa, Homo Sapiens
SGHGSRQES

SEQ ID NO: 673186 - protein, 9 aa, Homo Sapiens
SHSDIKNHD

SEQ ID NO: 673187 - protein, 9 aa, Homo Sapiens
VLLTEAPIN

SEQ ID NO: 673188 - protein, 9 aa, Homo Sapiens
EEAQAGPCL

SEQ ID NO: 673189 - protein, 9 aa, Homo Sapiens
SAGKNLREP

SEQ ID NO: 673190 - protein, 9 aa, Homo Sapiens
VDSFIWGLL

SEQ ID NO: 673191 - protein, 9 aa, Homo Sapiens
KTSPKANKE

SEQ ID NO: 673192 - protein, 9 aa, Homo Sapiens
TSDEYSFAG

SEQ ID NO: 673193 - protein, 9 aa, Homo Sapiens
NAANRGPRG

SEQ ID NO: 673194 - protein, 9 aa, Homo Sapiens
MGHDGSAGK

SEQ ID NO: 673195 - protein, 9 aa, Homo Sapiens
ESSSRPAPC

SEQ ID NO: 673196 - protein, 9 aa, Homo Sapiens
SSSRPAPCP

SEQ ID NO: 673197 - protein, 9 aa, Homo Sapiens
NECFLRRVA

SEQ ID NO: 673198 - protein, 9 aa, Homo Sapiens
PDLDHQFVR

SEQ ID NO: 673199 - protein, 9 aa, Homo Sapiens
KLPEAHDIQ

SEQ ID NO: 673200 - protein, 9 aa, Homo Sapiens
PGTSGHGSR

SEQ ID NO: 673201 - protein, 9 aa, Homo Sapiens
RAARSDDVP

SEQ ID NO: 673202 - protein, 9 aa, Homo Sapiens
ESYLFGSHS

SEQ ID NO: 673203 - protein, 9 aa, Homo Sapiens
LHLHQPVVL

SEQ ID NO: 673204 - protein, 9 aa, Homo Sapiens
EYSFAGRTL

SEQ ID NO: 673205 - protein, 9 aa, Homo Sapiens
HSDIKNHDL

SEQ ID NO: 673206 - protein, 9 aa, Homo Sapiens
VMPLQDNIS

SEQ ID NO: 673207 - protein, 9 aa, Homo Sapiens
IDAIYKAVV

SEQ ID NO: 673208 - protein, 9 aa, Homo Sapiens
DHQFVREFY

SEQ ID NO: 673209 - protein, 9 aa, Homo Sapiens
LHYYEMPTG

SEQ ID NO: 673210 - protein, 9 aa, Homo Sapiens
AGMRINVGN

SEQ ID NO: 673211 - protein, 9 aa, Homo Sapiens
ADRLEFTGG

SEQ ID NO: 673212 - protein, 9 aa, Homo Sapiens
VFSTICLLG

SEQ ID NO: 673213 - protein, 9 aa, Homo Sapiens
LLHLHQPVV

SEQ ID NO: 673214 - protein, 9 aa, Homo Sapiens
SRPAPCPLP

SEQ ID NO: 673215 - protein, 9 aa, Homo Sapiens
VIHSGATTT

SEQ ID NO: 673216 - protein, 9 aa, Homo Sapiens
GILVDSFIW

SEQ ID NO: 673217 - protein, 9 aa, Homo Sapiens
DIALLHLHQ

SEQ ID NO: 673218 - protein, 9 aa, Homo Sapiens
MFISGVPGT

SEQ ID NO: 673219 - protein, 9 aa, Homo Sapiens
LVLEPLSDL

SEQ ID NO: 673220 - protein, 9 aa, Homo Sapiens
YKLHYYEMP

SEQ ID NO: 673221 - protein, 9 aa, Homo Sapiens
RWKLPSLPT

SEQ ID NO: 673222 - protein, 9 aa, Homo Sapiens
VSTGDQRRL

SEQ ID NO: 673223 - protein, 9 aa, Homo Sapiens
DDVPGVEHI

SEQ ID NO: 673224 - protein, 9 aa, Homo Sapiens
PVTRNLHEG

SEQ ID NO: 673225 - protein, 9 aa, Homo Sapiens
GCMFISGVP

SEQ ID NO: 673226 - protein, 9 aa, Homo Sapiens
HIEPSLWPS

SEQ ID NO: 673227 - protein, 9 aa, Homo Sapiens
HSFDTLLQN

SEQ ID NO: 673228 - protein, 9 aa, Homo Sapiens
SSFLATKNL

SEQ ID NO: 673229 - protein, 9 aa, Homo Sapiens
HWGSLQRLA

SEQ ID NO: 673230 - protein, 9 aa, Homo Sapiens
FGSHSDIKN

SEQ ID NO: 673231 - protein, 9 aa, Homo Sapiens
VQGEQGPPG

SEQ ID NO: 673232 - protein, 9 aa, Homo Sapiens
CLHLGWGQH

SEQ ID NO: 673233 - protein, 9 aa, Homo Sapiens
TRNLHEGNP

SEQ ID NO: 673234 - protein, 9 aa, Homo Sapiens
IPVAIKTSP

SEQ ID NO: 673235 - protein, 9 aa, Homo Sapiens
SQPTEGNTV

SEQ ID NO: 673236 - protein, 9 aa, Homo Sapiens
LKCLAFRNL

SEQ ID NO: 673237 - protein, 9 aa, Homo Sapiens
TGKEPVTRN

SEQ ID NO: 673238 - protein, 9 aa, Homo Sapiens
GVQGEQGPP

SEQ ID NO: 673239 - protein, 9 aa, Homo Sapiens
RNLHEGNPE

SEQ ID NO: 673240 - protein, 9 aa, Homo Sapiens
AGPCLAAPI

SEQ ID NO: 673241 - protein, 9 aa, Homo Sapiens
PTDGVLASR

SEQ ID NO: 673242 - protein, 9 aa, Homo Sapiens
KCFNTRGSY

SEQ ID NO: 673243 - protein, 9 aa, Homo Sapiens
RVQNVQPLM

SEQ ID NO: 673244 - protein, 9 aa, Homo Sapiens
GTCGDPGTS

SEQ ID NO: 673245 - protein, 9 aa, Homo Sapiens
CAHSPCVNG

SEQ ID NO: 673246 - protein, 9 aa, Homo Sapiens
HNAANRGPR

SEQ ID NO: 673247 - protein, 9 aa, Homo Sapiens
PLGELKSHS

SEQ ID NO: 673248 - protein, 9 aa, Homo Sapiens
QDNISLLLE

SEQ ID NO: 673249 - protein, 9 aa, Homo Sapiens
SDCLHLGWG

SEQ ID NO: 673250 - protein, 9 aa, Homo Sapiens
GGSADGGGS

SEQ ID NO: 673251 - protein, 9 aa, Homo Sapiens
IIMPSVFST

SEQ ID NO: 673252 - protein, 9 aa, Homo Sapiens
VPSLITARY

SEQ ID NO: 673253 - protein, 9 aa, Homo Sapiens
PGPLPASHP

SEQ ID NO: 673254 - protein, 9 aa, Homo Sapiens
DLANGFHCH

SEQ ID NO: 673255 - protein, 9 aa, Homo Sapiens
LTEAPINPS

SEQ ID NO: 673256 - protein, 9 aa, Homo Sapiens
NVKLPEAHD

SEQ ID NO: 673257 - protein, 9 aa, Homo Sapiens
QGEQGPPGL

SEQ ID NO: 673258 - protein, 9 aa, Homo Sapiens
CEDLANGFH

SEQ ID NO: 673259 - protein, 9 aa, Homo Sapiens
PCAHSPCVN

SEQ ID NO: 673260 - protein, 9 aa, Homo Sapiens
DSFIWGLLS

SEQ ID NO: 673261 - protein, 9 aa, Homo Sapiens
PGAGDPGVG

SEQ ID NO: 673262 - protein, 9 aa, Homo Sapiens
IKTSPKANK

SEQ ID NO: 673263 - protein, 9 aa, Homo Sapiens
ALLHLHQPV

SEQ ID NO: 673264 - protein, 9 aa, Homo Sapiens
LPASHPLFG

SEQ ID NO: 673265 - protein, 9 aa, Homo Sapiens
HNVKLPEAH

SEQ ID NO: 673266 - protein, 9 aa, Homo Sapiens
MSGILVDSF

SEQ ID NO: 673267 - protein, 9 aa, Homo Sapiens
VEYLDYETV

SEQ ID NO: 673268 - protein, 9 aa, Homo Sapiens
LYVPCAHSP

SEQ ID NO: 673269 - protein, 9 aa, Homo Sapiens
PGVGGCGRR

SEQ ID NO: 673270 - protein, 9 aa, Homo Sapiens
DEYSFAGRT

SEQ ID NO: 673271 - protein, 9 aa, Homo Sapiens
AAVISAELS

SEQ ID NO: 673272 - protein, 9 aa, Homo Sapiens
GGGGSADGG

SEQ ID NO: 673273 - protein, 9 aa, Homo Sapiens
LVDSFIWGL

SEQ ID NO: 673274 - protein, 9 aa, Homo Sapiens
DNISLLLEA

SEQ ID NO: 673275 - protein, 9 aa, Homo Sapiens
ELHRAARSD

SEQ ID NO: 673276 - protein, 9 aa, Homo Sapiens
FISGVPGTG

SEQ ID NO: 673277 - protein, 9 aa, Homo Sapiens
RGLGVGDTV

SEQ ID NO: 673278 - protein, 9 aa, Homo Sapiens
QAGPCLAAP

SEQ ID NO: 673279 - protein, 9 aa, Homo Sapiens
EARLSDCLH

SEQ ID NO: 673280 - protein, 9 aa, Homo Sapiens
TDGVLASRL

SEQ ID NO: 673281 - protein, 9 aa, Homo Sapiens
PEAHDIQYP

SEQ ID NO: 673282 - protein, 9 aa, Homo Sapiens
GMRINVGNN

SEQ ID NO: 673283 - protein, 9 aa, Homo Sapiens
QVEYLDYET

SEQ ID NO: 673284 - protein, 9 aa, Homo Sapiens
HQQQQQQMQ

SEQ ID NO: 673285 - protein, 9 aa, Homo Sapiens
YTISVIMLI

SEQ ID NO: 673286 - protein, 9 aa, Homo Sapiens
TSRVSTGDQ

SEQ ID NO: 673287 - protein, 9 aa, Homo Sapiens
SIECGPGQK

SEQ ID NO: 673288 - protein, 9 aa, Homo Sapiens
DKTSRVSTG

SEQ ID NO: 673289 - protein, 9 aa, Homo Sapiens
LCEDLANGF

SEQ ID NO: 673290 - protein, 9 aa, Homo Sapiens
DYRVQVNKP

SEQ ID NO: 673291 - protein, 9 aa, Homo Sapiens
KPARGLGVG

SEQ ID NO: 673292 - protein, 9 aa, Homo Sapiens
FILLTALHI

SEQ ID NO: 673293 - protein, 9 aa, Homo Sapiens
RYKLHYYEM

SEQ ID NO: 673294 - protein, 9 aa, Homo Sapiens
TEGNTVNLS

SEQ ID NO: 673295 - protein, 9 aa, Homo Sapiens
GHLALQPTD

SEQ ID NO: 673296 - protein, 9 aa, Homo Sapiens
PTEGNTVNL

SEQ ID NO: 673297 - protein, 9 aa, Homo Sapiens
EYLDYETVS

SEQ ID NO: 673298 - protein, 9 aa, Homo Sapiens
GESYLFGSH

SEQ ID NO: 673299 - protein, 9 aa, Homo Sapiens
LGAGEGGGG

SEQ ID NO: 673300 - protein, 9 aa, Homo Sapiens
DVFFVVPSL

SEQ ID NO: 673301 - protein, 9 aa, Homo Sapiens
NSHWGSLQR

SEQ ID NO: 673302 - protein, 9 aa, Homo Sapiens
SFAGRTLTG

SEQ ID NO: 673303 - protein, 9 aa, Homo Sapiens
GNNHQAKQN

SEQ ID NO: 673304 - protein, 9 aa, Homo Sapiens
STGDQRRLH

SEQ ID NO: 673305 - protein, 9 aa, Homo Sapiens
RWADRLEFT

SEQ ID NO: 673306 - protein, 9 aa, Homo Sapiens
AARSDDVPG

SEQ ID NO: 673307 - protein, 9 aa, Homo Sapiens
KEKDLVLEP

SEQ ID NO: 673308 - protein, 9 aa, Homo Sapiens
GDPGVGGCG

SEQ ID NO: 673309 - protein, 9 aa, Homo Sapiens
SHWGSLQRL

SEQ ID NO: 673310 - protein, 9 aa, Homo Sapiens
SIDAIYKAV

SEQ ID NO: 673311 - protein, 9 aa, Homo Sapiens
GEQGPPGLV

SEQ ID NO: 673312 - protein, 9 aa, Homo Sapiens
PGDASIDAI

SEQ ID NO: 673313 - protein, 9 aa, Homo Sapiens
KIPVAIKTS

SEQ ID NO: 673314 - protein, 9 aa, Homo Sapiens
YEMPTGIKV

SEQ ID NO: 673315 - protein, 9 aa, Homo Sapiens
GAGEGGGGS

SEQ ID NO: 673316 - protein, 9 aa, Homo Sapiens
CGDPGTSGH

SEQ ID NO: 673317 - protein, 9 aa, Homo Sapiens
TCGDPGTSG

SEQ ID NO: 673318 - protein, 9 aa, Homo Sapiens
MIDSCERRF

SEQ ID NO: 673319 - protein, 9 aa, Homo Sapiens
GHDGSAGKN

SEQ ID NO: 673320 - protein, 9 aa, Homo Sapiens
NRGPRGPGL

SEQ ID NO: 673321 - protein, 9 aa, Homo Sapiens
GGLCEDLAN

SEQ ID NO: 673322 - protein, 9 aa, Homo Sapiens
TVNLSCETQ

SEQ ID NO: 673323 - protein, 9 aa, Homo Sapiens
ELSSFLATK

SEQ ID NO: 673324 - protein, 9 aa, Homo Sapiens
GNTVNLSCE

SEQ ID NO: 673325 - protein, 9 aa, Homo Sapiens
GTRMDYRVQ

SEQ ID NO: 673326 - protein, 9 aa, Homo Sapiens
MPLQDNISL

SEQ ID NO: 673327 - protein, 9 aa, Homo Sapiens
GGCMFISGV

SEQ ID NO: 673328 - protein, 9 aa, Homo Sapiens
PSLITARYH

SEQ ID NO: 673329 - protein, 9 aa, Homo Sapiens
SFDTLLQNL

SEQ ID NO: 673330 - protein, 9 aa, Homo Sapiens
RMDYRVQVN

SEQ ID NO: 673331 - protein, 9 aa, Homo Sapiens
CGTSDEYSF

SEQ ID NO: 673332 - protein, 9 aa, Homo Sapiens
QIRQELNSH

SEQ ID NO: 673333 - protein, 9 aa, Homo Sapiens
ECGPGQKCF

SEQ ID NO: 673334 - protein, 9 aa, Homo Sapiens
PCGTSDEYS

SEQ ID NO: 673335 - protein, 9 aa, Homo Sapiens
VQNVQPLMA

SEQ ID NO: 673336 - protein, 9 aa, Homo Sapiens
GGGSADGGG

SEQ ID NO: 673337 - protein, 9 aa, Homo Sapiens
IRQELNSHW

SEQ ID NO: 673338 - protein, 9 aa, Homo Sapiens
YLSKTRAKF

SEQ ID NO: 673339 - protein, 9 aa, Homo Sapiens
GPRGPGLII

SEQ ID NO: 673340 - protein, 9 aa, Homo Sapiens
CGPGQKCFN

SEQ ID NO: 673341 - protein, 9 aa, Homo Sapiens
TRMDYRVQV

SEQ ID NO: 673342 - protein, 9 aa, Homo Sapiens
TALHIEPSL

SEQ ID NO: 673343 - protein, 9 aa, Homo Sapiens
VFFVVPSLI

SEQ ID NO: 673344 - protein, 9 aa, Homo Sapiens
DERKTVLYF

SEQ ID NO: 673345 - protein, 9 aa, Homo Sapiens
EQGPPGLVL

SEQ ID NO: 673346 - protein, 9 aa, Homo Sapiens
MPSVFSTIC

SEQ ID NO: 673347 - protein, 9 aa, Homo Sapiens
DDERKTVLY

SEQ ID NO: 673348 - protein, 9 aa, Homo Sapiens
VTRNLHEGN

SEQ ID NO: 673349 - protein, 9 aa, Homo Sapiens
REAQKQVKM

SEQ ID NO: 673350 - protein, 9 aa, Homo Sapiens
LLPGPLPAS

SEQ ID NO: 673351 - protein, 9 aa, Homo Sapiens
EFTGGKYPV

SEQ ID NO: 673352 - protein, 9 aa, Homo Sapiens
HLHQPVVLT

SEQ ID NO: 673353 - protein, 9 aa, Homo Sapiens
AIKTSPKAN

SEQ ID NO: 673354 - protein, 9 aa, Homo Sapiens
DPGVGGCGR

SEQ ID NO: 673355 - protein, 9 aa, Homo Sapiens
SVFSTICLL

SEQ ID NO: 673356 - protein, 9 aa, Homo Sapiens
VISAELSSF

SEQ ID NO: 673357 - protein, 9 aa, Homo Sapiens
DSLYVPCAH

SEQ ID NO: 673358 - protein, 9 aa, Homo Sapiens
GPLPASHPL

SEQ ID NO: 673359 - protein, 9 aa, Homo Sapiens
PLQDNISLL

SEQ ID NO: 673360 - protein, 9 aa, Homo Sapiens
NTVNLSCET

SEQ ID NO: 673361 - protein, 9 aa, Homo Sapiens
CGSGTRMDY

SEQ ID NO: 673362 - protein, 9 aa, Homo Sapiens
PASHPLFGR

SEQ ID NO: 673363 - protein, 9 aa, Homo Sapiens
KLHYYEMPT

SEQ ID NO: 673364 - protein, 9 aa, Homo Sapiens
IECGPGQKC

SEQ ID NO: 673365 - protein, 9 aa, Homo Sapiens
VEHVCCFQP

SEQ ID NO: 673366 - protein, 9 aa, Homo Sapiens
DSSTVEHVC

SEQ ID NO: 673367 - protein, 9 aa, Homo Sapiens
RRVACKHQK

SEQ ID NO: 673368 - protein, 9 aa, Homo Sapiens
QGPPGLVLP

SEQ ID NO: 673369 - protein, 9 aa, Homo Sapiens
PLPASHPLF

SEQ ID NO: 673370 - protein, 9 aa, Homo Sapiens
EAQKQVKMI

SEQ ID NO: 673371 - protein, 9 aa, Homo Sapiens
LKSHSFDTL

SEQ ID NO: 673372 - protein, 9 aa, Homo Sapiens
EPVTRNLHE

SEQ ID NO: 673373 - protein, 9 aa, Homo Sapiens
QVKMIDSCE

SEQ ID NO: 673374 - protein, 9 aa, Homo Sapiens
AGDPGVGGC

SEQ ID NO: 673375 - protein, 9 aa, Homo Sapiens
GDPGTSGHG

SEQ ID NO: 673376 - protein, 9 aa, Homo Sapiens
PSVFSTICL

SEQ ID NO: 673377 - protein, 9 aa, Homo Sapiens
AGEGGGGSD

SEQ ID NO: 673378 - protein, 9 aa, Homo Sapiens
LSDCLHLGW

SEQ ID NO: 673379 - protein, 9 aa, Homo Sapiens
ELKSHSFDT

SEQ ID NO: 673380 - protein, 9 aa, Homo Sapiens
LDSVIHSGA

SEQ ID NO: 673381 - protein, 9 aa, Homo Sapiens
DQPDLDHQF

SEQ ID NO: 673382 - protein, 9 aa, Homo Sapiens
TISVIMLIV

SEQ ID NO: 673383 - protein, 9 aa, Homo Sapiens
DSQPTEGNT

SEQ ID NO: 673384 - protein, 9 aa, Homo Sapiens
SGTRMDYRV

SEQ ID NO: 673385 - protein, 9 aa, Homo Sapiens
INVGNNHQA

SEQ ID NO: 673386 - protein, 9 aa, Homo Sapiens
SADGGGSVL

SEQ ID NO: 673387 - protein, 9 aa, Homo Sapiens
TEARLSDCL

SEQ ID NO: 673388 - protein, 9 aa, Homo Sapiens
PAPCPLPST

SEQ ID NO: 673389 - protein, 9 aa, Homo Sapiens
VTQVEYLDY

SEQ ID NO: 673390 - protein, 9 aa, Homo Sapiens
LEFTGGKYP

SEQ ID NO: 673391 - protein, 9 aa, Homo Sapiens
MHQQQQQQM

SEQ ID NO: 673392 - protein, 9 aa, Homo Sapiens
LPEAHDIQY

SEQ ID NO: 673393 - protein, 9 aa, Homo Sapiens
CPLPSTTQP

SEQ ID NO: 673394 - protein, 9 aa, Homo Sapiens
KEPVTRNLH

SEQ ID NO: 673395 - protein, 9 aa, Homo Sapiens
EGGGGSDGS

SEQ ID NO: 673396 - protein, 9 aa, Homo Sapiens
YETVSATFI

SEQ ID NO: 673397 - protein, 9 aa, Homo Sapiens
APSLGAGEG

SEQ ID NO: 673398 - protein, 9 aa, Homo Sapiens
LDHTGGCMF

SEQ ID NO: 673399 - protein, 9 aa, Homo Sapiens
RSDDVPGVE

SEQ ID NO: 673400 - protein, 9 aa, Homo Sapiens
RKTVLYFGV

SEQ ID NO: 673401 - protein, 9 aa, Homo Sapiens
KCLAFRNLD

SEQ ID NO: 673402 - protein, 9 aa, Homo Sapiens
DHTGGCMFI

SEQ ID NO: 673403 - protein, 9 aa, Homo Sapiens
QDYLSKTRA

SEQ ID NO: 673404 - protein, 9 aa, Homo Sapiens
EKDLVLEPL

SEQ ID NO: 673405 - protein, 9 aa, Homo Sapiens
APINPSKNR

SEQ ID NO: 673406 - protein, 9 aa, Homo Sapiens
ARGLGVGDT

SEQ ID NO: 673407 - protein, 9 aa, Homo Sapiens
AELSSFLAT

SEQ ID NO: 673408 - protein, 9 aa, Homo Sapiens
FSTICLLGI

SEQ ID NO: 673409 - protein, 9 aa, Homo Sapiens
NGFHCHCPQ

SEQ ID NO: 673410 - protein, 9 aa, Homo Sapiens
VYYTISVIM

SEQ ID NO: 673411 - protein, 9 aa, Homo Sapiens
FMSGILVDS

SEQ ID NO: 673412 - protein, 9 aa, Homo Sapiens
PCLAAPIFK

SEQ ID NO: 673413 - protein, 9 aa, Homo Sapiens
HRAARSDDV

SEQ ID NO: 673414 - protein, 9 aa, Homo Sapiens
LPGGGGSAD

SEQ ID NO: 673415 - protein, 9 aa, Homo Sapiens
GATGVQGEQ

SEQ ID NO: 673416 - protein, 9 aa, Homo Sapiens
NVGNNHQAK

SEQ ID NO: 673417 - protein, 9 aa, Homo Sapiens
FGHLALQPT

SEQ ID NO: 673418 - protein, 9 aa, Homo Sapiens
VGGCGRRWR

SEQ ID NO: 673419 - protein, 9 aa, Homo Sapiens
TQVEYLDYE

SEQ ID NO: 673420 - protein, 9 aa, Homo Sapiens
EAQAGPCLA

SEQ ID NO: 673421 - protein, 9 aa, Homo Sapiens
IFMSGILVD

SEQ ID NO: 673422 - protein, 9 aa, Homo Sapiens
YVPCAHSPC

SEQ ID NO: 673423 - protein, 9 aa, Homo Sapiens
ASHPLFGRL

SEQ ID NO: 673424 - protein, 9 aa, Homo Sapiens
IEPSLWPST

SEQ ID NO: 673425 - protein, 9 aa, Homo Sapiens
NISLLLEAV

SEQ ID NO: 673426 - protein, 9 aa, Homo Sapiens
DGSAGKNLR

SEQ ID NO: 673427 - protein, 9 aa, Homo Sapiens
YYEMPTGIK

SEQ ID NO: 673428 - protein, 9 aa, Homo Sapiens
GPMGHDGSA

SEQ ID NO: 673429 - protein, 9 aa, Homo Sapiens
AHSPCVNGG

SEQ ID NO: 673430 - protein, 9 aa, Homo Sapiens
ERKTVLYFG

SEQ ID NO: 673431 - protein, 9 aa, Homo Sapiens
KTVLYFGVS

SEQ ID NO: 673432 - protein, 9 aa, Homo Sapiens
CCFQPPIHQ

SEQ ID NO: 673433 - protein, 9 aa, Homo Sapiens
QSYLDSVIH

SEQ ID NO: 673434 - protein, 9 aa, Homo Sapiens
PRGPGLIIS

SEQ ID NO: 673435 - protein, 9 aa, Homo Sapiens
ERWADRLEF

SEQ ID NO: 673436 - protein, 9 aa, Homo Sapiens
ILLTALHIE

SEQ ID NO: 673437 - protein, 9 aa, Homo Sapiens
GSGTRMDYR

SEQ ID NO: 673438 - protein, 9 aa, Homo Sapiens
QKCFNTRGS

SEQ ID NO: 673439 - protein, 9 aa, Homo Sapiens
KLPSLPTDE

SEQ ID NO: 673440 - protein, 9 aa, Homo Sapiens
RVSTGDQRR

SEQ ID NO: 673441 - protein, 9 aa, Homo Sapiens
DLDHQFVRE

SEQ ID NO: 673442 - protein, 9 aa, Homo Sapiens
PAGMRINVG

SEQ ID NO: 673443 - protein, 9 aa, Homo Sapiens
DCLHLGWGQ

SEQ ID NO: 673444 - protein, 9 aa, Homo Sapiens
LHLGWGQHN

SEQ ID NO: 673445 - protein, 9 aa, Homo Sapiens
PMGHDGSAG

SEQ ID NO: 673446 - protein, 9 aa, Homo Sapiens
SDDVPGVEH

SEQ ID NO: 673447 - protein, 9 aa, Homo Sapiens
SHPLFGRLV

SEQ ID NO: 673448 - protein, 9 aa, Homo Sapiens
LANGFHCHC

SEQ ID NO: 673449 - protein, 9 aa, Homo Sapiens
SSTVEHVCC

SEQ ID NO: 673450 - protein, 9 aa, Homo Sapiens
SAELSSFLA

SEQ ID NO: 673451 - protein, 9 aa, Homo Sapiens
GQDYLSKTR

SEQ ID NO: 673452 - protein, 9 aa, Homo Sapiens
PINPSKNRE

SEQ ID NO: 673453 - protein, 9 aa, Homo Sapiens
LPSLPTDET

SEQ ID NO: 673454 - protein, 9 aa, Homo Sapiens
LGELKSHSF

SEQ ID NO: 673455 - protein, 9 aa, Homo Sapiens
GPGQKCFNT

SEQ ID NO: 673456 - protein, 9 aa, Homo Sapiens
RVACKHQKE

SEQ ID NO: 673457 - protein, 9 aa, Homo Sapiens
DASIDAIYK

SEQ ID NO: 673458 - protein, 9 aa, Homo Sapiens
HYYEMPTGI

SEQ ID NO: 673459 - protein, 9 aa, Homo Sapiens
EAHDIQYPS

SEQ ID NO: 673460 - protein, 9 aa, Homo Sapiens
QQQSYLDSV

SEQ ID NO: 673461 - protein, 9 aa, Homo Sapiens
KTGKEPVTR

SEQ ID NO: 673462 - protein, 9 aa, Homo Sapiens
EMPTGIKVV

SEQ ID NO: 673463 - protein, 9 aa, Homo Sapiens
SRVSTGDQR

SEQ ID NO: 673464 - protein, 9 aa, Homo Sapiens
VAIKTSPKA

SEQ ID NO: 673465 - protein, 9 aa, Homo Sapiens
ALPGGGGSA

SEQ ID NO: 673466 - protein, 9 aa, Homo Sapiens
TEAPINPSK

SEQ ID NO: 673467 - protein, 9 aa, Homo Sapiens
YRVQVNKPG

SEQ ID NO: 673468 - protein, 9 aa, Homo Sapiens
GTSGHGSRQ

SEQ ID NO: 673469 - protein, 9 aa, Homo Sapiens
EGNTVNLSC

SEQ ID NO: 673470 - protein, 9 aa, Homo Sapiens
GELKSHSFD

SEQ ID NO: 673471 - protein, 9 aa, Homo Sapiens
HDIALLHLH

SEQ ID NO: 673472 - protein, 9 aa, Homo Sapiens
QPTDGVLAS

SEQ ID NO: 673473 - protein, 9 aa, Homo Sapiens
TGGCMFISG

SEQ ID NO: 673474 - protein, 9 aa, Homo Sapiens
EKEKEKDLV

SEQ ID NO: 673475 - protein, 9 aa, Homo Sapiens
PSLGAGEGG

SEQ ID NO: 673476 - protein, 9 aa, Homo Sapiens
QNVQPLMAT

SEQ ID NO: 673477 - protein, 9 aa, Homo Sapiens
HTGGCMFIS

SEQ ID NO: 673478 - protein, 9 aa, Homo Sapiens
AVISAELSS

SEQ ID NO: 673479 - protein, 9 aa, Homo Sapiens
HQFVREFYS

SEQ ID NO: 673480 - protein, 9 aa, Homo Sapiens
TNHDIALLH

SEQ ID NO: 673481 - protein, 9 aa, Homo Sapiens
KMIDSCERR

SEQ ID NO: 673482 - protein, 9 aa, Homo Sapiens
TGVQGEQGP

SEQ ID NO: 673483 - protein, 9 aa, Homo Sapiens
RLEFTGGKY

SEQ ID NO: 673484 - protein, 9 aa, Homo Sapiens
SLPTDETMC

SEQ ID NO: 673485 - protein, 9 aa, Homo Sapiens
GDVFFVVPS

SEQ ID NO: 673486 - protein, 9 aa, Homo Sapiens
ECFLRRVAC

SEQ ID NO: 673487 - protein, 9 aa, Homo Sapiens
YSFAGRTLT

SEQ ID NO: 673488 - protein, 9 aa, Homo Sapiens
KQVKMIDSC

SEQ ID NO: 673489 - protein, 9 aa, Homo Sapiens
CLAAPIFKG

SEQ ID NO: 673490 - protein, 9 aa, Homo Sapiens
KSHSFDTLL

SEQ ID NO: 673491 - protein, 9 aa, Homo Sapiens
DSVIHSGAT

SEQ ID NO: 673492 - protein, 9 aa, Homo Sapiens
ALHIEPSLW

SEQ ID NO: 673493 - protein, 9 aa, Homo Sapiens
AQAGPCLAA

SEQ ID NO: 673494 - protein, 9 aa, Homo Sapiens
ANRGPRGPG

SEQ ID NO: 673495 - protein, 9 aa, Homo Sapiens
GTSDEYSFA

SEQ ID NO: 673496 - protein, 9 aa, Homo Sapiens
LQPTDGVLA

SEQ ID NO: 673497 - protein, 9 aa, Homo Sapiens
SYDDERKTV

SEQ ID NO: 673498 - protein, 9 aa, Homo Sapiens
WKLPSLPTD

SEQ ID NO: 673499 - protein, 9 aa, Homo Sapiens
PPGAGDPGV

SEQ ID NO: 673500 - protein, 9 aa, Homo Sapiens
VGNNHQAKQ

SEQ ID NO: 673501 - protein, 9 aa, Homo Sapiens
LRWKLPSLP

SEQ ID NO: 673502 - protein, 9 aa, Homo Sapiens
LHIEPSLWP

SEQ ID NO: 673503 - protein, 9 aa, Homo Sapiens
APCPLPSTT

SEQ ID NO: 673504 - protein, 9 aa, Homo Sapiens
LDHQFVREF

SEQ ID NO: 673505 - protein, 9 aa, Homo Sapiens
KKPARGLGV

SEQ ID NO: 673506 - protein, 9 aa, Homo Sapiens
TGDQRRLHR

SEQ ID NO: 673507 - protein, 9 aa, Homo Sapiens
YDDERKTVL

SEQ ID NO: 673508 - protein, 9 aa, Homo Sapiens
EVMPLQDNI

SEQ ID NO: 673509 - protein, 9 aa, Homo Sapiens
YLDYETVSA

SEQ ID NO: 673510 - protein, 9 aa, Homo Sapiens
LHRAARSDD

SEQ ID NO: 673511 - protein, 9 aa, Homo Sapiens
QQSYLDSVI

SEQ ID NO: 673512 - protein, 9 aa, Homo Sapiens
VVPSLITAR

SEQ ID NO: 673513 - protein, 9 aa, Homo Sapiens
SVIHSGATT

SEQ ID NO: 673514 - protein, 9 aa, Homo Sapiens
IALLHLHQP

SEQ ID NO: 673515 - protein, 9 aa, Homo Sapiens
ELNSHWGSL

SEQ ID NO: 673516 - protein, 9 aa, Homo Sapiens
LNSHWGSLQ

SEQ ID NO: 673517 - protein, 9 aa, Homo Sapiens
KTSRVSTGD

SEQ ID NO: 673518 - protein, 9 aa, Homo Sapiens
DLVLEPLSD

SEQ ID NO: 673519 - protein, 9 aa, Homo Sapiens
LSSFLATKN

SEQ ID NO: 673520 - protein, 9 aa, Homo Sapiens
SVIMLIVFI

SEQ ID NO: 673521 - protein, 9 aa, Homo Sapiens
VLEPLSDLE

SEQ ID NO: 673522 - protein, 9 aa, Homo Sapiens
ANGFHCHCP

SEQ ID NO: 673523 - protein, 9 aa, Homo Sapiens
LTALHIEPS

SEQ ID NO: 673524 - protein, 9 aa, Homo Sapiens
EAPINPSKN

SEQ ID NO: 673525 - protein, 9 aa, Homo Sapiens
STVEHVCCF

SEQ ID NO: 673526 - protein, 9 aa, Homo Sapiens
GSADGGGSV

SEQ ID NO: 673527 - protein, 9 aa, Homo Sapiens
VKMIDSCER

SEQ ID NO: 673528 - protein, 9 aa, Homo Sapiens
AHNAANRGP

SEQ ID NO: 673529 - protein, 9 aa, Homo Sapiens
GGPGDASID

SEQ ID NO: 673530 - protein, 9 aa, Homo Sapiens
PVAIKTSPK

SEQ ID NO: 673531 - protein, 9 aa, Homo Sapiens
AANRGPRGP

SEQ ID NO: 673532 - protein, 9 aa, Homo Sapiens
PCPLPSTTQ

SEQ ID NO: 673533 - protein, 9 aa, Homo Sapiens
VVDQPDLDH

SEQ ID NO: 673534 - protein, 9 aa, Homo Sapiens
ASIDAIYKA

SEQ ID NO: 673535 - protein, 9 aa, Homo Sapiens
QKQVKMIDS

SEQ ID NO: 673536 - protein, 9 aa, Homo Sapiens
SHSFDTLLQ

SEQ ID NO: 673537 - protein, 9 aa, Homo Sapiens
TSGHGSRQE

SEQ ID NO: 673538 - protein, 9 aa, Homo Sapiens
TRAKFHGKM

SEQ ID NO: 673539 - protein, 9 aa, Homo Sapiens
SSRPAPCPL

SEQ ID NO: 673540 - protein, 9 aa, Homo Sapiens
RINVGNNHQ

SEQ ID NO: 673541 - protein, 9 aa, Homo Sapiens
FFVVPSLIT

SEQ ID NO: 673542 - protein, 9 aa, Homo Sapiens
CMFISGVPG

SEQ ID NO: 673543 - protein, 9 aa, Homo Sapiens
LFGSHSDIK

SEQ ID NO: 673544 - protein, 9 aa, Homo Sapiens
YALPGGGGS

SEQ ID NO: 673545 - protein, 9 aa, Homo Sapiens
KEKEKDLVL

SEQ ID NO: 673546 - protein, 9 aa, Homo Sapiens
RAKFHGKME

SEQ ID NO: 673547 - protein, 9 aa, Homo Sapiens
MDYRVQVNK

SEQ ID NO: 673548 - protein, 9 aa, Homo Sapiens
GAGDPGVGG

SEQ ID NO: 673549 - protein, 9 aa, Homo Sapiens
NIIMPSVFS

SEQ ID NO: 673550 - protein, 9 aa, Homo Sapiens
EKEKDLVLE

SEQ ID NO: 673551 - protein, 9 aa, Homo Sapiens
IMPSVFSTI

SEQ ID NO: 673552 - protein, 9 aa, Homo Sapiens
VACKHQKEI

SEQ ID NO: 673553 - protein, 9 aa, Homo Sapiens
TVEHVCCFQ

SEQ ID NO: 673554 - protein, 9 aa, Homo Sapiens
RQELNSHWG

SEQ ID NO: 673555 - protein, 9 aa, Homo Sapiens
SYLDSVIHS

SEQ ID NO: 673556 - protein, 9 aa, Homo Sapiens
ALQPTDGVL

SEQ ID NO: 673557 - protein, 9 aa, Homo Sapiens
RGPRGPGLI

SEQ ID NO: 673558 - protein, 9 aa, Homo Sapiens
PGGGGSADG

SEQ ID NO: 673559 - protein, 9 aa, Homo Sapiens
HDIQYPSML

SEQ ID NO: 673560 - protein, 9 aa, Homo Sapiens
VPCAHSPCV

SEQ ID NO: 673561 - protein, 9 aa, Homo Sapiens
LAFRNLDHR

SEQ ID NO: 673562 - protein, 9 aa, Homo Sapiens
PARGLGVGD

SEQ ID NO: 673563 - protein, 9 aa, Homo Sapiens
LQDNISLLL

SEQ ID NO: 673564 - protein, 9 aa, Homo Sapiens
HLALQPTDG

SEQ ID NO: 673565 - protein, 9 aa, Homo Sapiens
VGDTVDSSI

SEQ ID NO: 673566 - protein, 9 aa, Homo Sapiens
CLAFRNLDH

SEQ ID NO: 673567 - protein, 9 aa, Homo Sapiens
STICLLGII

SEQ ID NO: 673568 - protein, 9 aa, Homo Sapiens
LAAPIFKGC

SEQ ID NO: 673569 - protein, 9 aa, Homo Sapiens
AHDIQYPSM

SEQ ID NO: 673570 - protein, 9 aa, Homo Sapiens
GVGGCGRRW

SEQ ID NO: 673571 - protein, 9 aa, Homo Sapiens
GVGDTVDSS

SEQ ID NO: 673572 - protein, 9 aa, Homo Sapiens
ARSDDVPGV

SEQ ID NO: 673573 - protein, 9 aa, Homo Sapiens
HSPCVNGGT

SEQ ID NO: 673574 - protein, 9 aa, Homo Sapiens
SKTRAKFHG

SEQ ID NO: 673575 - protein, 9 aa, Homo Sapiens
EDLANGFHC

SEQ ID NO: 673576 - protein, 9 aa, Homo Sapiens
SLYVPCAHS

SEQ ID NO: 673577 - protein, 9 aa, Homo Sapiens
QPDLDHQFV

SEQ ID NO: 673578 - protein, 9 aa, Homo Sapiens
TAPSLGAGE

SEQ ID NO: 673579 - protein, 9 aa, Homo Sapiens
QPTEGNTVN

SEQ ID NO: 673580 - protein, 9 aa, Homo Sapiens
GSAGKNLRE

SEQ ID NO: 673581 - protein, 9 aa, Homo Sapiens
DYETVSATF

SEQ ID NO: 673582 - protein, 9 aa, Homo Sapiens
MPTGIKVVM

SEQ ID NO: 673583 - protein, 9 aa, Homo Sapiens
RPAPCPLPS

SEQ ID NO: 673584 - protein, 9 aa, Homo Sapiens
GKEPVTRNL

SEQ ID NO: 673585 - protein, 9 aa, Homo Sapiens
DRLEFTGGK

SEQ ID NO: 673586 - protein, 9 aa, Homo Sapiens
VLYFGVSNN

SEQ ID NO: 673587 - protein, 9 aa, Homo Sapiens
SLGAGEGGG

SEQ ID NO: 673588 - protein, 9 aa, Homo Sapiens
VKLPEAHDI

SEQ ID NO: 673589 - protein, 9 aa, Homo Sapiens
CFLRRVACK

SEQ ID NO: 673590 - protein, 9 aa, Homo Sapiens
QNECFLRRV

SEQ ID NO: 673591 - protein, 9 aa, Homo Sapiens
LGVGDTVDS

SEQ ID NO: 673592 - protein, 9 aa, Homo Sapiens
VDQPDLDHQ

SEQ ID NO: 673593 - protein, 9 aa, Homo Sapiens
PSLPTDETM

SEQ ID NO: 673594 - protein, 9 aa, Homo Sapiens
GLCEDLANG

SEQ ID NO: 673595 - protein, 9 aa, Homo Sapiens
HVCCFQPPI

SEQ ID NO: 673596 - protein, 9 aa, Homo Sapiens
SYLFGSHSD

SEQ ID NO: 673597 - protein, 9 aa, Homo Sapiens
SLALKCLSV

SEQ ID NO: 673598 - protein, 9 aa, Homo Sapiens
SGQYPTSTM

SEQ ID NO: 673599 - protein, 9 aa, Homo Sapiens
TLQCGSQKG

SEQ ID NO: 673600 - protein, 9 aa, Homo Sapiens
VWLEWRHVQ

SEQ ID NO: 673601 - protein, 9 aa, Homo Sapiens
PWESHTAVV

SEQ ID NO: 673602 - protein, 9 aa, Homo Sapiens
PVRGGGGAL

SEQ ID NO: 673603 - protein, 9 aa, Homo Sapiens
GQYPTSTMQ

SEQ ID NO: 673604 - protein, 9 aa, Homo Sapiens
FLRPAQRAL

SEQ ID NO: 673605 - protein, 9 aa, Homo Sapiens
RSLSLSVQA

SEQ ID NO: 673606 - protein, 9 aa, Homo Sapiens
RISNAENKH

SEQ ID NO: 673607 - protein, 9 aa, Homo Sapiens
EWGFLRPAQ

SEQ ID NO: 673608 - protein, 9 aa, Homo Sapiens
GGNMTLQCG

SEQ ID NO: 673609 - protein, 9 aa, Homo Sapiens
ASGGNMTLQ

SEQ ID NO: 673610 - protein, 9 aa, Homo Sapiens
GNMTLQCGS

SEQ ID NO: 673611 - protein, 9 aa, Homo Sapiens
FLISSRQDG

SEQ ID NO: 673612 - protein, 9 aa, Homo Sapiens
KQKLANIIL

SEQ ID NO: 673613 - protein, 9 aa, Homo Sapiens
LISSRQDGH

SEQ ID NO: 673614 - protein, 9 aa, Homo Sapiens
NYTSSSTTL

SEQ ID NO: 673615 - protein, 9 aa, Homo Sapiens
SSTTLTRKS

SEQ ID NO: 673616 - protein, 9 aa, Homo Sapiens
LPPPWESHT

SEQ ID NO: 673617 - protein, 9 aa, Homo Sapiens
LGFQIKKKN

SEQ ID NO: 673618 - protein, 9 aa, Homo Sapiens
YPTSTMQQY

SEQ ID NO: 673619 - protein, 9 aa, Homo Sapiens
AHRWPHITQ

SEQ ID NO: 673620 - protein, 9 aa, Homo Sapiens
QANYTSSST

SEQ ID NO: 673621 - protein, 9 aa, Homo Sapiens
PNWRISNAE

SEQ ID NO: 673622 - protein, 9 aa, Homo Sapiens
AEGGTVWLE

SEQ ID NO: 673623 - protein, 9 aa, Homo Sapiens
KKRSLSLSV

SEQ ID NO: 673624 - protein, 9 aa, Homo Sapiens
SSRQDGHQW

SEQ ID NO: 673625 - protein, 9 aa, Homo Sapiens
VGLCMQTAP

SEQ ID NO: 673626 - protein, 9 aa, Homo Sapiens
YTSSSTTLT

SEQ ID NO: 673627 - protein, 9 aa, Homo Sapiens
CYQIRCCTD

SEQ ID NO: 673628 - protein, 9 aa, Homo Sapiens
KIVDGLGGK

SEQ ID NO: 673629 - protein, 9 aa, Homo Sapiens
VRGGGGALK

SEQ ID NO: 673630 - protein, 9 aa, Homo Sapiens
SSSTTLTRK

SEQ ID NO: 673631 - protein, 9 aa, Homo Sapiens
WGFLRPAQR

SEQ ID NO: 673632 - protein, 9 aa, Homo Sapiens
TYGVLPPPW

SEQ ID NO: 673633 - protein, 9 aa, Homo Sapiens
LVVAEGGTV

SEQ ID NO: 673634 - protein, 9 aa, Homo Sapiens
LSVSPRSSC

SEQ ID NO: 673635 - protein, 9 aa, Homo Sapiens
LFKKKRSLS

SEQ ID NO: 673636 - protein, 9 aa, Homo Sapiens
KKKRSLSLS

SEQ ID NO: 673637 - protein, 9 aa, Homo Sapiens
STMQQYRPM

SEQ ID NO: 673638 - protein, 9 aa, Homo Sapiens
TSTMQQYRP

SEQ ID NO: 673639 - protein, 9 aa, Homo Sapiens
ALRCVRADP

SEQ ID NO: 673640 - protein, 9 aa, Homo Sapiens
SKNCTVGLC

SEQ ID NO: 673641 - protein, 9 aa, Homo Sapiens
PPWESHTAV

SEQ ID NO: 673642 - protein, 9 aa, Homo Sapiens
ISNAENKHI

SEQ ID NO: 673643 - protein, 9 aa, Homo Sapiens
VSPRSSCSV

SEQ ID NO: 673644 - protein, 9 aa, Homo Sapiens
YSLALKCLS

SEQ ID NO: 673645 - protein, 9 aa, Homo Sapiens
NAENKHILE

SEQ ID NO: 673646 - protein, 9 aa, Homo Sapiens
ANIILELQF

SEQ ID NO: 673647 - protein, 9 aa, Homo Sapiens
KHQEMTTFH

SEQ ID NO: 673648 - protein, 9 aa, Homo Sapiens
TTLTRKSRY

SEQ ID NO: 673649 - protein, 9 aa, Homo Sapiens
GTVWLEWRH

SEQ ID NO: 673650 - protein, 9 aa, Homo Sapiens
SRQDGHQWT

SEQ ID NO: 673651 - protein, 9 aa, Homo Sapiens
VGFCYQIRC

SEQ ID NO: 673652 - protein, 9 aa, Homo Sapiens
GKHQEMTTF

SEQ ID NO: 673653 - protein, 9 aa, Homo Sapiens
AYQLALRCV

SEQ ID NO: 673654 - protein, 9 aa, Homo Sapiens
ISKQKLANI

SEQ ID NO: 673655 - protein, 9 aa, Homo Sapiens
TRKSRYFFN

SEQ ID NO: 673656 - protein, 9 aa, Homo Sapiens
WESHTAVVY

SEQ ID NO: 673657 - protein, 9 aa, Homo Sapiens
SPNWRISNA

SEQ ID NO: 673658 - protein, 9 aa, Homo Sapiens
QIRCCTDDV

SEQ ID NO: 673659 - protein, 9 aa, Homo Sapiens
VVAEGGTVW

SEQ ID NO: 673660 - protein, 9 aa, Homo Sapiens
NRYISKQKL

SEQ ID NO: 673661 - protein, 9 aa, Homo Sapiens
EEAHRWPHI

SEQ ID NO: 673662 - protein, 9 aa, Homo Sapiens
QCGSQKGYH

SEQ ID NO: 673663 - protein, 9 aa, Homo Sapiens
WRISNAENK

SEQ ID NO: 673664 - protein, 9 aa, Homo Sapiens
KSRYFFNRY

SEQ ID NO: 673665 - protein, 9 aa, Homo Sapiens
RQDGHQWTL

SEQ ID NO: 673666 - protein, 9 aa, Homo Sapiens
SGGNMTLQC

SEQ ID NO: 673667 - protein, 9 aa, Homo Sapiens
VDGLGGKHQ

SEQ ID NO: 673668 - protein, 9 aa, Homo Sapiens
MTLQCGSQK

SEQ ID NO: 673669 - protein, 9 aa, Homo Sapiens
QKSRPGVYT

SEQ ID NO: 673670 - protein, 9 aa, Homo Sapiens
LTRKSRYFF

SEQ ID NO: 673671 - protein, 9 aa, Homo Sapiens
YQIRCCTDD

SEQ ID NO: 673672 - protein, 9 aa, Homo Sapiens
PTSTMQQYR

SEQ ID NO: 673673 - protein, 9 aa, Homo Sapiens
ERLFKKKRS

SEQ ID NO: 673674 - protein, 9 aa, Homo Sapiens
VLPPPWESH

SEQ ID NO: 673675 - protein, 9 aa, Homo Sapiens
IRCCTDDVR

SEQ ID NO: 673676 - protein, 9 aa, Homo Sapiens
TLTRKSRYF

SEQ ID NO: 673677 - protein, 9 aa, Homo Sapiens
QLALRCVRA

SEQ ID NO: 673678 - protein, 9 aa, Homo Sapiens
GGTVWLEWR

SEQ ID NO: 673679 - protein, 9 aa, Homo Sapiens
KRSLSLSVQ

SEQ ID NO: 673680 - protein, 9 aa, Homo Sapiens
CCTDDVRPQ

SEQ ID NO: 673681 - protein, 9 aa, Homo Sapiens
CAQKSRPGV

SEQ ID NO: 673682 - protein, 9 aa, Homo Sapiens
PSPNWRISN

SEQ ID NO: 673683 - protein, 9 aa, Homo Sapiens
GLGGKHQEM

SEQ ID NO: 673684 - protein, 9 aa, Homo Sapiens
SVSPRSSCS

SEQ ID NO: 673685 - protein, 9 aa, Homo Sapiens
NWRISNAEN

SEQ ID NO: 673686 - protein, 9 aa, Homo Sapiens
HITQPVLKR

SEQ ID NO: 673687 - protein, 9 aa, Homo Sapiens
KEEEEEEDE

SEQ ID NO: 673688 - protein, 9 aa, Homo Sapiens
LKCLSVSPR

SEQ ID NO: 673689 - protein, 9 aa, Homo Sapiens
CTVGLCMQT

SEQ ID NO: 673690 - protein, 9 aa, Homo Sapiens
QYPTSTMQQ

SEQ ID NO: 673691 - protein, 9 aa, Homo Sapiens
LRCVRADPP

SEQ ID NO: 673692 - protein, 9 aa, Homo Sapiens
PEEAHRWPH

SEQ ID NO: 673693 - protein, 9 aa, Homo Sapiens
SKQKLANII

SEQ ID NO: 673694 - protein, 9 aa, Homo Sapiens
EAHRWPHIT

SEQ ID NO: 673695 - protein, 9 aa, Homo Sapiens
YGCAQKSRP

SEQ ID NO: 673696 - protein, 9 aa, Homo Sapiens
SLSLSVQAN

SEQ ID NO: 673697 - protein, 9 aa, Homo Sapiens
RGGGGALKA

SEQ ID NO: 673698 - protein, 9 aa, Homo Sapiens
NMTLQCGSQ

SEQ ID NO: 673699 - protein, 9 aa, Homo Sapiens
IVDGLGGKH

SEQ ID NO: 673700 - protein, 9 aa, Homo Sapiens
TMQQYRPMA

SEQ ID NO: 673701 - protein, 9 aa, Homo Sapiens
EGGTVWLEW

SEQ ID NO: 673702 - protein, 9 aa, Homo Sapiens
CLSVSPRSS

SEQ ID NO: 673703 - protein, 9 aa, Homo Sapiens
RLFKKKRSL

SEQ ID NO: 673704 - protein, 9 aa, Homo Sapiens
LALKCLSVS

SEQ ID NO: 673705 - protein, 9 aa, Homo Sapiens
KEFLISSRQ

SEQ ID NO: 673706 - protein, 9 aa, Homo Sapiens
TSSSTTLTR

SEQ ID NO: 673707 - protein, 9 aa, Homo Sapiens
YGVLPPPWE

SEQ ID NO: 673708 - protein, 9 aa, Homo Sapiens
KNCTVGLCM

SEQ ID NO: 673709 - protein, 9 aa, Homo Sapiens
LGGKHQEMT

SEQ ID NO: 673710 - protein, 9 aa, Homo Sapiens
FCYQIRCCT

SEQ ID NO: 673711 - protein, 9 aa, Homo Sapiens
RYISKQKLA

SEQ ID NO: 673712 - protein, 9 aa, Homo Sapiens
TVGLCMQTA

SEQ ID NO: 673713 - protein, 9 aa, Homo Sapiens
NIILELQFS

SEQ ID NO: 673714 - protein, 9 aa, Homo Sapiens
EFLISSRQD

SEQ ID NO: 673715 - protein, 9 aa, Homo Sapiens
SPEEWGFLR

SEQ ID NO: 673716 - protein, 9 aa, Homo Sapiens
AERLFKKKR

SEQ ID NO: 673717 - protein, 9 aa, Homo Sapiens
TVWLEWRHV

SEQ ID NO: 673718 - protein, 9 aa, Homo Sapiens
KCLSVSPRS

SEQ ID NO: 673719 - protein, 9 aa, Homo Sapiens
PEEWGFLRP

SEQ ID NO: 673720 - protein, 9 aa, Homo Sapiens
QKLANIILE

SEQ ID NO: 673721 - protein, 9 aa, Homo Sapiens
EEWGFLRPA

SEQ ID NO: 673722 - protein, 9 aa, Homo Sapiens
GGKHQEMTT

SEQ ID NO: 673723 - protein, 9 aa, Homo Sapiens
WPHITQPVL

SEQ ID NO: 673724 - protein, 9 aa, Homo Sapiens
LSLSVQANY

SEQ ID NO: 673725 - protein, 9 aa, Homo Sapiens
ALKCLSVSP

SEQ ID NO: 673726 - protein, 9 aa, Homo Sapiens
MQQYRPMAP

SEQ ID NO: 673727 - protein, 9 aa, Homo Sapiens
SNAENKHIL

SEQ ID NO: 673728 - protein, 9 aa, Homo Sapiens
PPPWESHTA

SEQ ID NO: 673729 - protein, 9 aa, Homo Sapiens
SRYFFNRYI

SEQ ID NO: 673730 - protein, 9 aa, Homo Sapiens
NCTVGLCMQ

SEQ ID NO: 673731 - protein, 9 aa, Homo Sapiens
AAYQLALRC

SEQ ID NO: 673732 - protein, 9 aa, Homo Sapiens
RWPHITQPV

SEQ ID NO: 673733 - protein, 9 aa, Homo Sapiens
SVQANYTSS

SEQ ID NO: 673734 - protein, 9 aa, Homo Sapiens
GCAQKSRPG

SEQ ID NO: 673735 - protein, 9 aa, Homo Sapiens
RKSRYFFNR

SEQ ID NO: 673736 - protein, 9 aa, Homo Sapiens
GFCYQIRCC

SEQ ID NO: 673737 - protein, 9 aa, Homo Sapiens
SRPGVYTKV

SEQ ID NO: 673738 - protein, 9 aa, Homo Sapiens
VLQSKNCTV

SEQ ID NO: 673739 - protein, 9 aa, Homo Sapiens
CVRADPPRR

SEQ ID NO: 673740 - protein, 9 aa, Homo Sapiens
FFNRYISKQ

SEQ ID NO: 673741 - protein, 9 aa, Homo Sapiens
RYFFNRYIS

SEQ ID NO: 673742 - protein, 9 aa, Homo Sapiens
PHITQPVLK

SEQ ID NO: 673743 - protein, 9 aa, Homo Sapiens
LQSKNCTVG

SEQ ID NO: 673744 - protein, 9 aa, Homo Sapiens
LSVQANYTS

SEQ ID NO: 673745 - protein, 9 aa, Homo Sapiens
VQANYTSSS

SEQ ID NO: 673746 - protein, 9 aa, Homo Sapiens
SLSVQANYT

SEQ ID NO: 673747 - protein, 9 aa, Homo Sapiens
RCCTDDVRP

SEQ ID NO: 673748 - protein, 9 aa, Homo Sapiens
QSKNCTVGL

SEQ ID NO: 673749 - protein, 9 aa, Homo Sapiens
FNRYISKQK

SEQ ID NO: 673750 - protein, 9 aa, Homo Sapiens
DKEEEEEED

SEQ ID NO: 673751 - protein, 9 aa, Homo Sapiens
YFSPEEWGF

SEQ ID NO: 673752 - protein, 9 aa, Homo Sapiens
KSRPGVYTK

SEQ ID NO: 673753 - protein, 9 aa, Homo Sapiens
RCVRADPPR

SEQ ID NO: 673754 - protein, 9 aa, Homo Sapiens
ISSRQDGHQ

SEQ ID NO: 673755 - protein, 9 aa, Homo Sapiens
YISKQKLAN

SEQ ID NO: 673756 - protein, 9 aa, Homo Sapiens
KLANIILEL

SEQ ID NO: 673757 - protein, 9 aa, Homo Sapiens
DGLGGKHQE

SEQ ID NO: 673758 - protein, 9 aa, Homo Sapiens
VAEGGTVWL

SEQ ID NO: 673759 - protein, 9 aa, Homo Sapiens
GYGCAQKSR

SEQ ID NO: 673760 - protein, 9 aa, Homo Sapiens
GVLPPPWES

SEQ ID NO: 673761 - protein, 9 aa, Homo Sapiens
YFFNRYISK

SEQ ID NO: 673762 - protein, 9 aa, Homo Sapiens
MPVRGGGGA

SEQ ID NO: 673763 - protein, 9 aa, Homo Sapiens
AQKSRPGVY

SEQ ID NO: 673764 - protein, 9 aa, Homo Sapiens
LALRCVRAD

SEQ ID NO: 673765 - protein, 9 aa, Homo Sapiens
WGYGCAQKS

SEQ ID NO: 673766 - protein, 9 aa, Homo Sapiens
FKKKRSLSL

SEQ ID NO: 673767 - protein, 9 aa, Homo Sapiens
GFLRPAQRA

SEQ ID NO: 673768 - protein, 9 aa, Homo Sapiens
ANYTSSSTT

SEQ ID NO: 673769 - protein, 9 aa, Homo Sapiens
LQCGSQKGY

SEQ ID NO: 673770 - protein, 9 aa, Homo Sapiens
FSPEEWGFL

SEQ ID NO: 673771 - protein, 9 aa, Homo Sapiens
YQLALRCVR

SEQ ID NO: 673772 - protein, 9 aa, Homo Sapiens
VKEFLISSR

SEQ ID NO: 673773 - protein, 9 aa, Homo Sapiens
STTLTRKSR

SEQ ID NO: 673774 - protein, 9 aa, Homo Sapiens
LANIILELQ

SEQ ID NO: 673775 - protein, 9 aa, Homo Sapiens
HRWPHITQP

SEQ ID NO: 673776 - protein, 9 aa, Homo Sapiens
TGIPGPVGG

SEQ ID NO: 673777 - protein, 9 aa, Homo Sapiens
SGASAIARE

SEQ ID NO: 673778 - protein, 9 aa, Homo Sapiens
FPVIYLCHR

SEQ ID NO: 673779 - protein, 9 aa, Homo Sapiens
LFCHLGSSL

SEQ ID NO: 673780 - protein, 9 aa, Homo Sapiens
NPVGLVGFI

SEQ ID NO: 673781 - protein, 9 aa, Homo Sapiens
SSIQAPRSP

SEQ ID NO: 673782 - protein, 9 aa, Homo Sapiens
CHLGSSLGN

SEQ ID NO: 673783 - protein, 9 aa, Homo Sapiens
TTYHKRKTM

SEQ ID NO: 673784 - protein, 9 aa, Homo Sapiens
VWCQLHVDH

SEQ ID NO: 673785 - protein, 9 aa, Homo Sapiens
GNKDSVMAL

SEQ ID NO: 673786 - protein, 9 aa, Homo Sapiens
QPRLFPVYP

SEQ ID NO: 673787 - protein, 9 aa, Homo Sapiens
DSVMALVFN

SEQ ID NO: 673788 - protein, 9 aa, Homo Sapiens
VHYMLYKYQ

SEQ ID NO: 673789 - protein, 9 aa, Homo Sapiens
LWRLPITGT

SEQ ID NO: 673790 - protein, 9 aa, Homo Sapiens
GIPGPVGGP

SEQ ID NO: 673791 - protein, 9 aa, Homo Sapiens
VSEAVLSIN

SEQ ID NO: 673792 - protein, 9 aa, Homo Sapiens
EKLLIKEDE

SEQ ID NO: 673793 - protein, 9 aa, Homo Sapiens
TTEDLRLVL

SEQ ID NO: 673794 - protein, 9 aa, Homo Sapiens
SGEGAFGNM

SEQ ID NO: 673795 - protein, 9 aa, Homo Sapiens
TSNFKGPER

SEQ ID NO: 673796 - protein, 9 aa, Homo Sapiens
VLSINLLIG

SEQ ID NO: 673797 - protein, 9 aa, Homo Sapiens
AREKVMREL

SEQ ID NO: 673798 - protein, 9 aa, Homo Sapiens
RYHDEDRAS

SEQ ID NO: 673799 - protein, 9 aa, Homo Sapiens
VVDYKGKNR

SEQ ID NO: 673800 - protein, 9 aa, Homo Sapiens
IAEEVYDYV

SEQ ID NO: 673801 - protein, 9 aa, Homo Sapiens
KKHFKLWRL

SEQ ID NO: 673802 - protein, 9 aa, Homo Sapiens
AGIHSRNVG

SEQ ID NO: 673803 - protein, 9 aa, Homo Sapiens
GHGPSGMPM

SEQ ID NO: 673804 - protein, 9 aa, Homo Sapiens
RDCTDPLYK

SEQ ID NO: 673805 - protein, 9 aa, Homo Sapiens
RYRRTEEEN

SEQ ID NO: 673806 - protein, 9 aa, Homo Sapiens
FGHLKEMHR

SEQ ID NO: 673807 - protein, 9 aa, Homo Sapiens
MDASTTYHK

SEQ ID NO: 673808 - protein, 9 aa, Homo Sapiens
VHYPDSERM

SEQ ID NO: 673809 - protein, 9 aa, Homo Sapiens
CACPGRYRR

SEQ ID NO: 673810 - protein, 9 aa, Homo Sapiens
DLVVHASMD

SEQ ID NO: 673811 - protein, 9 aa, Homo Sapiens
AHIQAQSSS

SEQ ID NO: 673812 - protein, 9 aa, Homo Sapiens
RTSILWDGI

SEQ ID NO: 673813 - protein, 9 aa, Homo Sapiens
DNLGPLHEN

SEQ ID NO: 673814 - protein, 9 aa, Homo Sapiens
LFLFCHLGS

SEQ ID NO: 673815 - protein, 9 aa, Homo Sapiens
TSISGVFND

SEQ ID NO: 673816 - protein, 9 aa, Homo Sapiens
MYPQTLSGM

SEQ ID NO: 673817 - protein, 9 aa, Homo Sapiens
TDPLYKEKA

SEQ ID NO: 673818 - protein, 9 aa, Homo Sapiens
AAREEVAGH

SEQ ID NO: 673819 - protein, 9 aa, Homo Sapiens
DQDKAVSEH

SEQ ID NO: 673820 - protein, 9 aa, Homo Sapiens
ILQVNEDML

SEQ ID NO: 673821 - protein, 9 aa, Homo Sapiens
ELFLFCHLG

SEQ ID NO: 673822 - protein, 9 aa, Homo Sapiens
VMRELKALA

SEQ ID NO: 673823 - protein, 9 aa, Homo Sapiens
IHSRNVGVR

SEQ ID NO: 673824 - protein, 9 aa, Homo Sapiens
EAVLSINLL

SEQ ID NO: 673825 - protein, 9 aa, Homo Sapiens
PNRKNEKKK

SEQ ID NO: 673826 - protein, 9 aa, Homo Sapiens
TGPSLTMPQ

SEQ ID NO: 673827 - protein, 9 aa, Homo Sapiens
LAESETMSQ

SEQ ID NO: 673828 - protein, 9 aa, Homo Sapiens
FLREYDGRC

SEQ ID NO: 673829 - protein, 9 aa, Homo Sapiens
HASMDQNDP

SEQ ID NO: 673830 - protein, 9 aa, Homo Sapiens
HVDHLSDGF

SEQ ID NO: 673831 - protein, 9 aa, Homo Sapiens
ETVYSHDMR

SEQ ID NO: 673832 - protein, 9 aa, Homo Sapiens
LREYDGRCD

SEQ ID NO: 673833 - protein, 9 aa, Homo Sapiens
VGVVDYKGK

SEQ ID NO: 673834 - protein, 9 aa, Homo Sapiens
SVMALVFNP

SEQ ID NO: 673835 - protein, 9 aa, Homo Sapiens
HQVIVNVLQ

SEQ ID NO: 673836 - protein, 9 aa, Homo Sapiens
QLYWQLQLF

SEQ ID NO: 673837 - protein, 9 aa, Homo Sapiens
EYDGRCDLH

SEQ ID NO: 673838 - protein, 9 aa, Homo Sapiens
VLPSSELSD

SEQ ID NO: 673839 - protein, 9 aa, Homo Sapiens
MEAVIACSL

SEQ ID NO: 673840 - protein, 9 aa, Homo Sapiens
PVYPNLHFP

SEQ ID NO: 673841 - protein, 9 aa, Homo Sapiens
DSGASAIAR

SEQ ID NO: 673842 - protein, 9 aa, Homo Sapiens
QRTVCRTTT

SEQ ID NO: 673843 - protein, 9 aa, Homo Sapiens
PFRDDGRSK

SEQ ID NO: 673844 - protein, 9 aa, Homo Sapiens
KPDEALYQC

SEQ ID NO: 673845 - protein, 9 aa, Homo Sapiens
QLVDQSVPL

SEQ ID NO: 673846 - protein, 9 aa, Homo Sapiens
GRCDLHVGI

SEQ ID NO: 673847 - protein, 9 aa, Homo Sapiens
SILSPQRLM

SEQ ID NO: 673848 - protein, 9 aa, Homo Sapiens
VENICKSLT

SEQ ID NO: 673849 - protein, 9 aa, Homo Sapiens
VGLVGFITA

SEQ ID NO: 673850 - protein, 9 aa, Homo Sapiens
IQHMHMAAT

SEQ ID NO: 673851 - protein, 9 aa, Homo Sapiens
YTVIGYSPL

SEQ ID NO: 673852 - protein, 9 aa, Homo Sapiens
FISALQLYW

SEQ ID NO: 673853 - protein, 9 aa, Homo Sapiens
PSSELSDPG

SEQ ID NO: 673854 - protein, 9 aa, Homo Sapiens
YHDEDRASH

SEQ ID NO: 673855 - protein, 9 aa, Homo Sapiens
KGADTSTSQ

SEQ ID NO: 673856 - protein, 9 aa, Homo Sapiens
NRKNEKKKV

SEQ ID NO: 673857 - protein, 9 aa, Homo Sapiens
KEMHRVVIS

SEQ ID NO: 673858 - protein, 9 aa, Homo Sapiens
PHSVPGLMY

SEQ ID NO: 673859 - protein, 9 aa, Homo Sapiens
GVFNDRCGG

SEQ ID NO: 673860 - protein, 9 aa, Homo Sapiens
GADTSTSQR

SEQ ID NO: 673861 - protein, 9 aa, Homo Sapiens
WKYPPKKNA

SEQ ID NO: 673862 - protein, 9 aa, Homo Sapiens
ERAKRPKFE

SEQ ID NO: 673863 - protein, 9 aa, Homo Sapiens
YPDSERMLM

SEQ ID NO: 673864 - protein, 9 aa, Homo Sapiens
TLYTVIGYS

SEQ ID NO: 673865 - protein, 9 aa, Homo Sapiens
SFCFIPLLT

SEQ ID NO: 673866 - protein, 9 aa, Homo Sapiens
TIIRDFEFW

SEQ ID NO: 673867 - protein, 9 aa, Homo Sapiens
ARTLSFVDV

SEQ ID NO: 673868 - protein, 9 aa, Homo Sapiens
DHLRRREER

SEQ ID NO: 673869 - protein, 9 aa, Homo Sapiens
YVGVVDYKG

SEQ ID NO: 673870 - protein, 9 aa, Homo Sapiens
LNFFLFFSI

SEQ ID NO: 673871 - protein, 9 aa, Homo Sapiens
GMPMLHHGE

SEQ ID NO: 673872 - protein, 9 aa, Homo Sapiens
IDKVDLDFL

SEQ ID NO: 673873 - protein, 9 aa, Homo Sapiens
IIQFISALQ

SEQ ID NO: 673874 - protein, 9 aa, Homo Sapiens
HESLKGADT

SEQ ID NO: 673875 - protein, 9 aa, Homo Sapiens
TKCTEILNL

SEQ ID NO: 673876 - protein, 9 aa, Homo Sapiens
RQPRLFPVY

SEQ ID NO: 673877 - protein, 9 aa, Homo Sapiens
VNQRLSTTQ

SEQ ID NO: 673878 - protein, 9 aa, Homo Sapiens
EEVYDYVMH

SEQ ID NO: 673879 - protein, 9 aa, Homo Sapiens
AQSSSIQAP

SEQ ID NO: 673880 - protein, 9 aa, Homo Sapiens
ADGVSAARE

SEQ ID NO: 673881 - protein, 9 aa, Homo Sapiens
KQEKRNQDH

SEQ ID NO: 673882 - protein, 9 aa, Homo Sapiens
EGAFGNMCR

SEQ ID NO: 673883 - protein, 9 aa, Homo Sapiens
GGTHRSGEG

SEQ ID NO: 673884 - protein, 9 aa, Homo Sapiens
NSMIPTHAG

SEQ ID NO: 673885 - protein, 9 aa, Homo Sapiens
PLLTLSKPP

SEQ ID NO: 673886 - protein, 9 aa, Homo Sapiens
SNDMGLNSW

SEQ ID NO: 673887 - protein, 9 aa, Homo Sapiens
RHPRYHDED

SEQ ID NO: 673888 - protein, 9 aa, Homo Sapiens
DVQVENICK

SEQ ID NO: 673889 - protein, 9 aa, Homo Sapiens
PAPGVNESS

SEQ ID NO: 673890 - protein, 9 aa, Homo Sapiens
ENGDLISEG

SEQ ID NO: 673891 - protein, 9 aa, Homo Sapiens
RELKALAKL

SEQ ID NO: 673892 - protein, 9 aa, Homo Sapiens
ARGYLSCAL

SEQ ID NO: 673893 - protein, 9 aa, Homo Sapiens
LYTVIGYSP

SEQ ID NO: 673894 - protein, 9 aa, Homo Sapiens
SGVFNDRCG

SEQ ID NO: 673895 - protein, 9 aa, Homo Sapiens
THPLHTPVN

SEQ ID NO: 673896 - protein, 9 aa, Homo Sapiens
FQRTVCRTT

SEQ ID NO: 673897 - protein, 9 aa, Homo Sapiens
GRKTKCTEI

SEQ ID NO: 673898 - protein, 9 aa, Homo Sapiens
CQLHVDHLS

SEQ ID NO: 673899 - protein, 9 aa, Homo Sapiens
RRHIQHMHM

SEQ ID NO: 673900 - protein, 9 aa, Homo Sapiens
LPVNGELLA

SEQ ID NO: 673901 - protein, 9 aa, Homo Sapiens
REEFGDQIG

SEQ ID NO: 673902 - protein, 9 aa, Homo Sapiens
LEHLNFFLF

SEQ ID NO: 673903 - protein, 9 aa, Homo Sapiens
QRQVWCQLH

SEQ ID NO: 673904 - protein, 9 aa, Homo Sapiens
IQAQSSSIQ

SEQ ID NO: 673905 - protein, 9 aa, Homo Sapiens
FIIKIRDIN

SEQ ID NO: 673906 - protein, 9 aa, Homo Sapiens
REYDGRCDL

SEQ ID NO: 673907 - protein, 9 aa, Homo Sapiens
EDLRLVLQC

SEQ ID NO: 673908 - protein, 9 aa, Homo Sapiens
TMPQRNLTG

SEQ ID NO: 673909 - protein, 9 aa, Homo Sapiens
ETWREEFGD

SEQ ID NO: 673910 - protein, 9 aa, Homo Sapiens
CKAGIHSRN

SEQ ID NO: 673911 - protein, 9 aa, Homo Sapiens
LQLYWQLQL

SEQ ID NO: 673912 - protein, 9 aa, Homo Sapiens
DYVGVVDYK

SEQ ID NO: 673913 - protein, 9 aa, Homo Sapiens
LYKEKACEA

SEQ ID NO: 673914 - protein, 9 aa, Homo Sapiens
ASAIARESH

SEQ ID NO: 673915 - protein, 9 aa, Homo Sapiens
SLESILSPQ

SEQ ID NO: 673916 - protein, 9 aa, Homo Sapiens
LNSMIPTHA

SEQ ID NO: 673917 - protein, 9 aa, Homo Sapiens
LKIMKDYDW

SEQ ID NO: 673918 - protein, 9 aa, Homo Sapiens
FIPLLTLSK

SEQ ID NO: 673919 - protein, 9 aa, Homo Sapiens
QKERAKRPK

SEQ ID NO: 673920 - protein, 9 aa, Homo Sapiens
VCACPGRYR

SEQ ID NO: 673921 - protein, 9 aa, Homo Sapiens
KAVRVLPSS

SEQ ID NO: 673922 - protein, 9 aa, Homo Sapiens
PSGMPMLHH

SEQ ID NO: 673923 - protein, 9 aa, Homo Sapiens
LQCILQGLD

SEQ ID NO: 673924 - protein, 9 aa, Homo Sapiens
ALQLYWQLQ

SEQ ID NO: 673925 - protein, 9 aa, Homo Sapiens
VVHASMDQN

SEQ ID NO: 673926 - protein, 9 aa, Homo Sapiens
AKRPKFEQI

SEQ ID NO: 673927 - protein, 9 aa, Homo Sapiens
NKLFMFEIF

SEQ ID NO: 673928 - protein, 9 aa, Homo Sapiens
ILVHYMLYK

SEQ ID NO: 673929 - protein, 9 aa, Homo Sapiens
LGPLHENWE

SEQ ID NO: 673930 - protein, 9 aa, Homo Sapiens
EEPECNDII

SEQ ID NO: 673931 - protein, 9 aa, Homo Sapiens
GYLSCALGC

SEQ ID NO: 673932 - protein, 9 aa, Homo Sapiens
FITAFNFPV

SEQ ID NO: 673933 - protein, 9 aa, Homo Sapiens
LSGLKLEFE

SEQ ID NO: 673934 - protein, 9 aa, Homo Sapiens
IRDINDNEP

SEQ ID NO: 673935 - protein, 9 aa, Homo Sapiens
AVIACSLYA

SEQ ID NO: 673936 - protein, 9 aa, Homo Sapiens
SLPVNGELL

SEQ ID NO: 673937 - protein, 9 aa, Homo Sapiens
SLPSLEKYE

SEQ ID NO: 673938 - protein, 9 aa, Homo Sapiens
PSLTMPQRN

SEQ ID NO: 673939 - protein, 9 aa, Homo Sapiens
RAKRPKFEQ

SEQ ID NO: 673940 - protein, 9 aa, Homo Sapiens
QVWCQLHVD

SEQ ID NO: 673941 - protein, 9 aa, Homo Sapiens
KAGIHSRNV

SEQ ID NO: 673942 - protein, 9 aa, Homo Sapiens
ARTRFKLIS

SEQ ID NO: 673943 - protein, 9 aa, Homo Sapiens
PECNDIIAR

SEQ ID NO: 673944 - protein, 9 aa, Homo Sapiens
VINHFQEEL

SEQ ID NO: 673945 - protein, 9 aa, Homo Sapiens
RMHPFRDDG

SEQ ID NO: 673946 - protein, 9 aa, Homo Sapiens
IKIRDINDN

SEQ ID NO: 673947 - protein, 9 aa, Homo Sapiens
RNVILQVNE

SEQ ID NO: 673948 - protein, 9 aa, Homo Sapiens
GLTGIPGPV

SEQ ID NO: 673949 - protein, 9 aa, Homo Sapiens
LHTPVNAKV

SEQ ID NO: 673950 - protein, 9 aa, Homo Sapiens
DCEARTLSF

SEQ ID NO: 673951 - protein, 9 aa, Homo Sapiens
EEMDASTTY

SEQ ID NO: 673952 - protein, 9 aa, Homo Sapiens
PRHGSLRIS

SEQ ID NO: 673953 - protein, 9 aa, Homo Sapiens
KRNQDHLRR

SEQ ID NO: 673954 - protein, 9 aa, Homo Sapiens
IFISNDMGL

SEQ ID NO: 673955 - protein, 9 aa, Homo Sapiens
VYVLTVLGT

SEQ ID NO: 673956 - protein, 9 aa, Homo Sapiens
HLKEMHRVV

SEQ ID NO: 673957 - protein, 9 aa, Homo Sapiens
SLSGLKLEF

SEQ ID NO: 673958 - protein, 9 aa, Homo Sapiens
SSLESILSP

SEQ ID NO: 673959 - protein, 9 aa, Homo Sapiens
QFISALQLY

SEQ ID NO: 673960 - protein, 9 aa, Homo Sapiens
VFNDRCGGW

SEQ ID NO: 673961 - protein, 9 aa, Homo Sapiens
TLSFVDVNQ

SEQ ID NO: 673962 - protein, 9 aa, Homo Sapiens
TSYVESSTC

SEQ ID NO: 673963 - protein, 9 aa, Homo Sapiens
GEGAFGNMC

SEQ ID NO: 673964 - protein, 9 aa, Homo Sapiens
KKGKVLPEE

SEQ ID NO: 673965 - protein, 9 aa, Homo Sapiens
RHGHGPSGM

SEQ ID NO: 673966 - protein, 9 aa, Homo Sapiens
LTGIPGPVG

SEQ ID NO: 673967 - protein, 9 aa, Homo Sapiens
WSCILIFTT

SEQ ID NO: 673968 - protein, 9 aa, Homo Sapiens
WYDKVGHQV

SEQ ID NO: 673969 - protein, 9 aa, Homo Sapiens
KERAKRPKF

SEQ ID NO: 673970 - protein, 9 aa, Homo Sapiens
QVENICKSL

SEQ ID NO: 673971 - protein, 9 aa, Homo Sapiens
CWQKERAKR

SEQ ID NO: 673972 - protein, 9 aa, Homo Sapiens
HRSGEGAFG

SEQ ID NO: 673973 - protein, 9 aa, Homo Sapiens
RMQSLSQQA

SEQ ID NO: 673974 - protein, 9 aa, Homo Sapiens
SRHPRYHDE

SEQ ID NO: 673975 - protein, 9 aa, Homo Sapiens
ELKALAKLE

SEQ ID NO: 673976 - protein, 9 aa, Homo Sapiens
TSTSQRIEV

SEQ ID NO: 673977 - protein, 9 aa, Homo Sapiens
FYFPVIYLC

SEQ ID NO: 673978 - protein, 9 aa, Homo Sapiens
SPLGPVVCD

SEQ ID NO: 673979 - protein, 9 aa, Homo Sapiens
ILIFTTFIL

SEQ ID NO: 673980 - protein, 9 aa, Homo Sapiens
KTKCTEILN

SEQ ID NO: 673981 - protein, 9 aa, Homo Sapiens
FWSCILIFT

SEQ ID NO: 673982 - protein, 9 aa, Homo Sapiens
GKVLPEEQG

SEQ ID NO: 673983 - protein, 9 aa, Homo Sapiens
FNDRCGGWS

SEQ ID NO: 673984 - protein, 9 aa, Homo Sapiens
GELLAESET

SEQ ID NO: 673985 - protein, 9 aa, Homo Sapiens
QLFVTNQRP

SEQ ID NO: 673986 - protein, 9 aa, Homo Sapiens
DGRSKSIEE

SEQ ID NO: 673987 - protein, 9 aa, Homo Sapiens
RGYLSCALG

SEQ ID NO: 673988 - protein, 9 aa, Homo Sapiens
QHMHMAATF

SEQ ID NO: 673989 - protein, 9 aa, Homo Sapiens
IPTHAGDIN

SEQ ID NO: 673990 - protein, 9 aa, Homo Sapiens
VNHTPTRLL

SEQ ID NO: 673991 - protein, 9 aa, Homo Sapiens
LMYPGIIPP

SEQ ID NO: 673992 - protein, 9 aa, Homo Sapiens
MALVFNPSV

SEQ ID NO: 673993 - protein, 9 aa, Homo Sapiens
PGRKTKCTE

SEQ ID NO: 673994 - protein, 9 aa, Homo Sapiens
TKENVCEAK

SEQ ID NO: 673995 - protein, 9 aa, Homo Sapiens
FIMEAVIAC

SEQ ID NO: 673996 - protein, 9 aa, Homo Sapiens
IPARGYLSC

SEQ ID NO: 673997 - protein, 9 aa, Homo Sapiens
QVIVNVLQA

SEQ ID NO: 673998 - protein, 9 aa, Homo Sapiens
FRDDGRSKS

SEQ ID NO: 673999 - protein, 9 aa, Homo Sapiens
MGLNSWFDP

SEQ ID NO: 674000 - protein, 9 aa, Homo Sapiens
VNGELLAES

SEQ ID NO: 674001 - protein, 9 aa, Homo Sapiens
LEFESIYKI

SEQ ID NO: 674002 - protein, 9 aa, Homo Sapiens
LVHYMLYKY

SEQ ID NO: 674003 - protein, 9 aa, Homo Sapiens
MLKIMKDYD

SEQ ID NO: 674004 - protein, 9 aa, Homo Sapiens
QLHVDHLSD

SEQ ID NO: 674005 - protein, 9 aa, Homo Sapiens
KYEPRGPGR

SEQ ID NO: 674006 - protein, 9 aa, Homo Sapiens
VHASMDQND

SEQ ID NO: 674007 - protein, 9 aa, Homo Sapiens
QISARTRFK

SEQ ID NO: 674008 - protein, 9 aa, Homo Sapiens
ECNDIIARL

SEQ ID NO: 674009 - protein, 9 aa, Homo Sapiens
STTYHKRKT

SEQ ID NO: 674010 - protein, 9 aa, Homo Sapiens
HENWEMAYT

SEQ ID NO: 674011 - protein, 9 aa, Homo Sapiens
RDDGRSKSI

SEQ ID NO: 674012 - protein, 9 aa, Homo Sapiens
LVGFITAFN

SEQ ID NO: 674013 - protein, 9 aa, Homo Sapiens
IMKDYDWHV

SEQ ID NO: 674014 - protein, 9 aa, Homo Sapiens
ESSMMTWGE

SEQ ID NO: 674015 - protein, 9 aa, Homo Sapiens
PLYKEKACE

SEQ ID NO: 674016 - protein, 9 aa, Homo Sapiens
TQLFVTNQR

SEQ ID NO: 674017 - protein, 9 aa, Homo Sapiens
ATGAAFSSS

SEQ ID NO: 674018 - protein, 9 aa, Homo Sapiens
ESSTCQTSC

SEQ ID NO: 674019 - protein, 9 aa, Homo Sapiens
GDMYPQTLS

SEQ ID NO: 674020 - protein, 9 aa, Homo Sapiens
VIVNVLQAT

SEQ ID NO: 674021 - protein, 9 aa, Homo Sapiens
YSPLGPVVC

SEQ ID NO: 674022 - protein, 9 aa, Homo Sapiens
VSAAREEVA

SEQ ID NO: 674023 - protein, 9 aa, Homo Sapiens
RDLPNTHPL

SEQ ID NO: 674024 - protein, 9 aa, Homo Sapiens
AKKGKVLPE

SEQ ID NO: 674025 - protein, 9 aa, Homo Sapiens
VGFITAFNF

SEQ ID NO: 674026 - protein, 9 aa, Homo Sapiens
VETVYSHDM

SEQ ID NO: 674027 - protein, 9 aa, Homo Sapiens
DDGRSKSIE

SEQ ID NO: 674028 - protein, 9 aa, Homo Sapiens
RSGEGAFGN

SEQ ID NO: 674029 - protein, 9 aa, Homo Sapiens
FVTNQRPEI

SEQ ID NO: 674030 - protein, 9 aa, Homo Sapiens
ASMDQNDPL

SEQ ID NO: 674031 - protein, 9 aa, Homo Sapiens
IMEAVIACS

SEQ ID NO: 674032 - protein, 9 aa, Homo Sapiens
EKVMRELKA

SEQ ID NO: 674033 - protein, 9 aa, Homo Sapiens
TVLGTSSSC

SEQ ID NO: 674034 - protein, 9 aa, Homo Sapiens
TTGRWKYPP

SEQ ID NO: 674035 - protein, 9 aa, Homo Sapiens
VYDYVMHIL

SEQ ID NO: 674036 - protein, 9 aa, Homo Sapiens
KCTEILNLP

SEQ ID NO: 674037 - protein, 9 aa, Homo Sapiens
CRPELFLFC

SEQ ID NO: 674038 - protein, 9 aa, Homo Sapiens
ISPGRKTKC

SEQ ID NO: 674039 - protein, 9 aa, Homo Sapiens
WNPVGLVGF

SEQ ID NO: 674040 - protein, 9 aa, Homo Sapiens
WQKERAKRP

SEQ ID NO: 674041 - protein, 9 aa, Homo Sapiens
PERMQSLSQ

SEQ ID NO: 674042 - protein, 9 aa, Homo Sapiens
ALVFNPSVG

SEQ ID NO: 674043 - protein, 9 aa, Homo Sapiens
YGDMYPQTL

SEQ ID NO: 674044 - protein, 9 aa, Homo Sapiens
QRLSTTQNK

SEQ ID NO: 674045 - protein, 9 aa, Homo Sapiens
DMYPQTLSG

SEQ ID NO: 674046 - protein, 9 aa, Homo Sapiens
KKKVKDHKS

SEQ ID NO: 674047 - protein, 9 aa, Homo Sapiens
EMHRVVIST

SEQ ID NO: 674048 - protein, 9 aa, Homo Sapiens
ADTSTSQRI

SEQ ID NO: 674049 - protein, 9 aa, Homo Sapiens
LFPVYPNLH

SEQ ID NO: 674050 - protein, 9 aa, Homo Sapiens
DEALYQCEA

SEQ ID NO: 674051 - protein, 9 aa, Homo Sapiens
MYPGIIPPT

SEQ ID NO: 674052 - protein, 9 aa, Homo Sapiens
PDEALYQCE

SEQ ID NO: 674053 - protein, 9 aa, Homo Sapiens
HPRYHDEDR

SEQ ID NO: 674054 - protein, 9 aa, Homo Sapiens
INHFQEELG

SEQ ID NO: 674055 - protein, 9 aa, Homo Sapiens
VDSGASAIA

SEQ ID NO: 674056 - protein, 9 aa, Homo Sapiens
LHVFIMEAV

SEQ ID NO: 674057 - protein, 9 aa, Homo Sapiens
LDCEARTLS

SEQ ID NO: 674058 - protein, 9 aa, Homo Sapiens
WRLPITGTH

SEQ ID NO: 674059 - protein, 9 aa, Homo Sapiens
VNCVINHFQ

SEQ ID NO: 674060 - protein, 9 aa, Homo Sapiens
ENICKSLTN

SEQ ID NO: 674061 - protein, 9 aa, Homo Sapiens
KDHILTENQ

SEQ ID NO: 674062 - protein, 9 aa, Homo Sapiens
DNVNCVINH

SEQ ID NO: 674063 - protein, 9 aa, Homo Sapiens
YFGHLKEMH

SEQ ID NO: 674064 - protein, 9 aa, Homo Sapiens
YKGKNRHTV

SEQ ID NO: 674065 - protein, 9 aa, Homo Sapiens
AIARESHTH

SEQ ID NO: 674066 - protein, 9 aa, Homo Sapiens
VIGYSPLGP

SEQ ID NO: 674067 - protein, 9 aa, Homo Sapiens
ILSPQRLMI

SEQ ID NO: 674068 - protein, 9 aa, Homo Sapiens
VILQVNEDM

SEQ ID NO: 674069 - protein, 9 aa, Homo Sapiens
IARESHTHR

SEQ ID NO: 674070 - protein, 9 aa, Homo Sapiens
GPMGLTGIP

SEQ ID NO: 674071 - protein, 9 aa, Homo Sapiens
ISNDMGLNS

SEQ ID NO: 674072 - protein, 9 aa, Homo Sapiens
LIKEDEKHA

SEQ ID NO: 674073 - protein, 9 aa, Homo Sapiens
HGPSGMPML

SEQ ID NO: 674074 - protein, 9 aa, Homo Sapiens
HAGDINDIK

SEQ ID NO: 674075 - protein, 9 aa, Homo Sapiens
LCKAGIHSR

SEQ ID NO: 674076 - protein, 9 aa, Homo Sapiens
GVVDYKGKN

SEQ ID NO: 674077 - protein, 9 aa, Homo Sapiens
QTLSGMLVG

SEQ ID NO: 674078 - protein, 9 aa, Homo Sapiens
NVCEAKSYE

SEQ ID NO: 674079 - protein, 9 aa, Homo Sapiens
ISARTRFKL

SEQ ID NO: 674080 - protein, 9 aa, Homo Sapiens
SAIARESHT

SEQ ID NO: 674081 - protein, 9 aa, Homo Sapiens
SAVNHTPTR

SEQ ID NO: 674082 - protein, 9 aa, Homo Sapiens
PAKKGKVLP

SEQ ID NO: 674083 - protein, 9 aa, Homo Sapiens
DHILTENQC

SEQ ID NO: 674084 - protein, 9 aa, Homo Sapiens
QTSYVESST

SEQ ID NO: 674085 - protein, 9 aa, Homo Sapiens
PRYHDEDRA

SEQ ID NO: 674086 - protein, 9 aa, Homo Sapiens
RNVGVRVNV

SEQ ID NO: 674087 - protein, 9 aa, Homo Sapiens
CSEKDHILT

SEQ ID NO: 674088 - protein, 9 aa, Homo Sapiens
MGLTGIPGP

SEQ ID NO: 674089 - protein, 9 aa, Homo Sapiens
SRHHKPDEA

SEQ ID NO: 674090 - protein, 9 aa, Homo Sapiens
DKAVSEHIP

SEQ ID NO: 674091 - protein, 9 aa, Homo Sapiens
QRNLTGSCN

SEQ ID NO: 674092 - protein, 9 aa, Homo Sapiens
TENQCCRVC

SEQ ID NO: 674093 - protein, 9 aa, Homo Sapiens
YFPVIYLCH

SEQ ID NO: 674094 - protein, 9 aa, Homo Sapiens
VMLKIMKDY

SEQ ID NO: 674095 - protein, 9 aa, Homo Sapiens
CFIPLLTLS

SEQ ID NO: 674096 - protein, 9 aa, Homo Sapiens
SKAVRVLPS

SEQ ID NO: 674097 - protein, 9 aa, Homo Sapiens
YVLTVLGTS

SEQ ID NO: 674098 - protein, 9 aa, Homo Sapiens
MPMLHHGEK

SEQ ID NO: 674099 - protein, 9 aa, Homo Sapiens
VLTVLGTSS

SEQ ID NO: 674100 - protein, 9 aa, Homo Sapiens
SILWDGITA

SEQ ID NO: 674101 - protein, 9 aa, Homo Sapiens
IPLLTLSKP

SEQ ID NO: 674102 - protein, 9 aa, Homo Sapiens
IQFISALQL

SEQ ID NO: 674103 - protein, 9 aa, Homo Sapiens
HYMLYKYQM

SEQ ID NO: 674104 - protein, 9 aa, Homo Sapiens
VCEAKSYER

SEQ ID NO: 674105 - protein, 9 aa, Homo Sapiens
GGYSEVNQR

SEQ ID NO: 674106 - protein, 9 aa, Homo Sapiens
LLTLSKPPV

SEQ ID NO: 674107 - protein, 9 aa, Homo Sapiens
LPITGTHLY

SEQ ID NO: 674108 - protein, 9 aa, Homo Sapiens
KNEKKKVKD

SEQ ID NO: 674109 - protein, 9 aa, Homo Sapiens
SGQISARTR

SEQ ID NO: 674110 - protein, 9 aa, Homo Sapiens
HMAATFIKA

SEQ ID NO: 674111 - protein, 9 aa, Homo Sapiens
VLFWSCILI

SEQ ID NO: 674112 - protein, 9 aa, Homo Sapiens
APGVNESSM

SEQ ID NO: 674113 - protein, 9 aa, Homo Sapiens
SKLPDQDKA

SEQ ID NO: 674114 - protein, 9 aa, Homo Sapiens
DIRNVILQV

SEQ ID NO: 674115 - protein, 9 aa, Homo Sapiens
SALQLYWQL

SEQ ID NO: 674116 - protein, 9 aa, Homo Sapiens
KEDEKHASQ

SEQ ID NO: 674117 - protein, 9 aa, Homo Sapiens
IIARLQYVK

SEQ ID NO: 674118 - protein, 9 aa, Homo Sapiens
RHHKPDEAL

SEQ ID NO: 674119 - protein, 9 aa, Homo Sapiens
LKEMHRVVI

SEQ ID NO: 674120 - protein, 9 aa, Homo Sapiens
EPECNDIIA

SEQ ID NO: 674121 - protein, 9 aa, Homo Sapiens
TPTRLLKEI

SEQ ID NO: 674122 - protein, 9 aa, Homo Sapiens
YMLYKYQMK

SEQ ID NO: 674123 - protein, 9 aa, Homo Sapiens
SSTCQTSCY

SEQ ID NO: 674124 - protein, 9 aa, Homo Sapiens
GRWKYPPKK

SEQ ID NO: 674125 - protein, 9 aa, Homo Sapiens
FLDCEARTL

SEQ ID NO: 674126 - protein, 9 aa, Homo Sapiens
CEKKTQLFV

SEQ ID NO: 674127 - protein, 9 aa, Homo Sapiens
SNFKGPERM

SEQ ID NO: 674128 - protein, 9 aa, Homo Sapiens
TCQTSCYRP

SEQ ID NO: 674129 - protein, 9 aa, Homo Sapiens
PTHAGDIND

SEQ ID NO: 674130 - protein, 9 aa, Homo Sapiens
HGHGPSGMP

SEQ ID NO: 674131 - protein, 9 aa, Homo Sapiens
TLSGMLVGA

SEQ ID NO: 674132 - protein, 9 aa, Homo Sapiens
FLFCHLGSS

SEQ ID NO: 674133 - protein, 9 aa, Homo Sapiens
DMGLNSWFD

SEQ ID NO: 674134 - protein, 9 aa, Homo Sapiens
GPSLTMPQR

SEQ ID NO: 674135 - protein, 9 aa, Homo Sapiens
KRPKFEQIV

SEQ ID NO: 674136 - protein, 9 aa, Homo Sapiens
DISPGRKTK

SEQ ID NO: 674137 - protein, 9 aa, Homo Sapiens
HIQHMHMAA

SEQ ID NO: 674138 - protein, 9 aa, Homo Sapiens
KGPERMQSL

SEQ ID NO: 674139 - protein, 9 aa, Homo Sapiens
PQRNLTGSC

SEQ ID NO: 674140 - protein, 9 aa, Homo Sapiens
KKVDLVVHA

SEQ ID NO: 674141 - protein, 9 aa, Homo Sapiens
EFGDQIGGP

SEQ ID NO: 674142 - protein, 9 aa, Homo Sapiens
LFWSCILIF

SEQ ID NO: 674143 - protein, 9 aa, Homo Sapiens
EVYDYVMHI

SEQ ID NO: 674144 - protein, 9 aa, Homo Sapiens
VSFQRTVCR

SEQ ID NO: 674145 - protein, 9 aa, Homo Sapiens
RGRTSILWD

SEQ ID NO: 674146 - protein, 9 aa, Homo Sapiens
MHRVVISTE

SEQ ID NO: 674147 - protein, 9 aa, Homo Sapiens
ERMLMKKAR

SEQ ID NO: 674148 - protein, 9 aa, Homo Sapiens
PMGLTGIPG

SEQ ID NO: 674149 - protein, 9 aa, Homo Sapiens
QEKRNQDHL

SEQ ID NO: 674150 - protein, 9 aa, Homo Sapiens
RRSEPRHGS

SEQ ID NO: 674151 - protein, 9 aa, Homo Sapiens
SPNRKNEKK

SEQ ID NO: 674152 - protein, 9 aa, Homo Sapiens
VDQSVPLPS

SEQ ID NO: 674153 - protein, 9 aa, Homo Sapiens
KVLPEEQGP

SEQ ID NO: 674154 - protein, 9 aa, Homo Sapiens
DPAKKGKVL

SEQ ID NO: 674155 - protein, 9 aa, Homo Sapiens
YRGRTSILW

SEQ ID NO: 674156 - protein, 9 aa, Homo Sapiens
MIPTHAGDI

SEQ ID NO: 674157 - protein, 9 aa, Homo Sapiens
EPRHGSLRI

SEQ ID NO: 674158 - protein, 9 aa, Homo Sapiens
EKKKVKDHK

SEQ ID NO: 674159 - protein, 9 aa, Homo Sapiens
LSSLESILS

SEQ ID NO: 674160 - protein, 9 aa, Homo Sapiens
PTRLLKEII

SEQ ID NO: 674161 - protein, 9 aa, Homo Sapiens
RCDLHVGIT

SEQ ID NO: 674162 - protein, 9 aa, Homo Sapiens
DTVLEHLNF

SEQ ID NO: 674163 - protein, 9 aa, Homo Sapiens
KYPPKKNAM

SEQ ID NO: 674164 - protein, 9 aa, Homo Sapiens
RTLSFVDVN

SEQ ID NO: 674165 - protein, 9 aa, Homo Sapiens
ESEFIIKIR

SEQ ID NO: 674166 - protein, 9 aa, Homo Sapiens
RTVCRTTTA

SEQ ID NO: 674167 - protein, 9 aa, Homo Sapiens
NHTPTRLLK

SEQ ID NO: 674168 - protein, 9 aa, Homo Sapiens
VTSISGVFN

SEQ ID NO: 674169 - protein, 9 aa, Homo Sapiens
SEKDHILTE

SEQ ID NO: 674170 - protein, 9 aa, Homo Sapiens
VDLVVHASM

SEQ ID NO: 674171 - protein, 9 aa, Homo Sapiens
PCQLSSSAC

SEQ ID NO: 674172 - protein, 9 aa, Homo Sapiens
AVLSINLLI

SEQ ID NO: 674173 - protein, 9 aa, Homo Sapiens
EKYEPRGPG

SEQ ID NO: 674174 - protein, 9 aa, Homo Sapiens
CDLHVGITN

SEQ ID NO: 674175 - protein, 9 aa, Homo Sapiens
FPVYPNLHF

SEQ ID NO: 674176 - protein, 9 aa, Homo Sapiens
SIQAPRSPR

SEQ ID NO: 674177 - protein, 9 aa, Homo Sapiens
HVFIMEAVI

SEQ ID NO: 674178 - protein, 9 aa, Homo Sapiens
ICKSLTNLS

SEQ ID NO: 674179 - protein, 9 aa, Homo Sapiens
LPSSELSDP

SEQ ID NO: 674180 - protein, 9 aa, Homo Sapiens
KVDLVVHAS

SEQ ID NO: 674181 - protein, 9 aa, Homo Sapiens
SLEKYEPRG

SEQ ID NO: 674182 - protein, 9 aa, Homo Sapiens
KLLIKEDEK

SEQ ID NO: 674183 - protein, 9 aa, Homo Sapiens
LESILSPQR

SEQ ID NO: 674184 - protein, 9 aa, Homo Sapiens
SMMTWGEVE

SEQ ID NO: 674185 - protein, 9 aa, Homo Sapiens
STCQTSCYR

SEQ ID NO: 674186 - protein, 9 aa, Homo Sapiens
IIKIRDIND

SEQ ID NO: 674187 - protein, 9 aa, Homo Sapiens
ADGLATGAA

SEQ ID NO: 674188 - protein, 9 aa, Homo Sapiens
VIACSLYAV

SEQ ID NO: 674189 - protein, 9 aa, Homo Sapiens
PRLFPVYPN

SEQ ID NO: 674190 - protein, 9 aa, Homo Sapiens
FCHLGSSLG

SEQ ID NO: 674191 - protein, 9 aa, Homo Sapiens
RDGSRHPRY

SEQ ID NO: 674192 - protein, 9 aa, Homo Sapiens
RQQRFNTII

SEQ ID NO: 674193 - protein, 9 aa, Homo Sapiens
KEKACEAPQ

SEQ ID NO: 674194 - protein, 9 aa, Homo Sapiens
KGKVLPEEQ

SEQ ID NO: 674195 - protein, 9 aa, Homo Sapiens
LLAESETMS

SEQ ID NO: 674196 - protein, 9 aa, Homo Sapiens
GVTSISGVF

SEQ ID NO: 674197 - protein, 9 aa, Homo Sapiens
HSSRRSEPR

SEQ ID NO: 674198 - protein, 9 aa, Homo Sapiens
PGRYRRTEE

SEQ ID NO: 674199 - protein, 9 aa, Homo Sapiens
EHLNFFLFF

SEQ ID NO: 674200 - protein, 9 aa, Homo Sapiens
DEKHASQMI

SEQ ID NO: 674201 - protein, 9 aa, Homo Sapiens
EDIRNVILQ

SEQ ID NO: 674202 - protein, 9 aa, Homo Sapiens
GASAIARES

SEQ ID NO: 674203 - protein, 9 aa, Homo Sapiens
IGYSPLGPV

SEQ ID NO: 674204 - protein, 9 aa, Homo Sapiens
KKTQLFVTN

SEQ ID NO: 674205 - protein, 9 aa, Homo Sapiens
VMHILMHFQ

SEQ ID NO: 674206 - protein, 9 aa, Homo Sapiens
SEPRHGSLR

SEQ ID NO: 674207 - protein, 9 aa, Homo Sapiens
LPSLEKYEP

SEQ ID NO: 674208 - protein, 9 aa, Homo Sapiens
NKDSVMALV

SEQ ID NO: 674209 - protein, 9 aa, Homo Sapiens
HILTENQCC

SEQ ID NO: 674210 - protein, 9 aa, Homo Sapiens
GYSPLGPVV

SEQ ID NO: 674211 - protein, 9 aa, Homo Sapiens
KLEFESIYK

SEQ ID NO: 674212 - protein, 9 aa, Homo Sapiens
HYPDSERML

SEQ ID NO: 674213 - protein, 9 aa, Homo Sapiens
PLHTPVNAK

SEQ ID NO: 674214 - protein, 9 aa, Homo Sapiens
YHKRKTMND

SEQ ID NO: 674215 - protein, 9 aa, Homo Sapiens
MRELKALAK

SEQ ID NO: 674216 - protein, 9 aa, Homo Sapiens
GGGTHRSGE

SEQ ID NO: 674217 - protein, 9 aa, Homo Sapiens
KIMKDYDWH

SEQ ID NO: 674218 - protein, 9 aa, Homo Sapiens
SSELSDPGL

SEQ ID NO: 674219 - protein, 9 aa, Homo Sapiens
SISGVFNDR

SEQ ID NO: 674220 - protein, 9 aa, Homo Sapiens
ENVCEAKSY

SEQ ID NO: 674221 - protein, 9 aa, Homo Sapiens
DGLATGAAF

SEQ ID NO: 674222 - protein, 9 aa, Homo Sapiens
DSGQISART

SEQ ID NO: 674223 - protein, 9 aa, Homo Sapiens
AIFISNDMG

SEQ ID NO: 674224 - protein, 9 aa, Homo Sapiens
EAVIACSLY

SEQ ID NO: 674225 - protein, 9 aa, Homo Sapiens
DKVDLDFLM

SEQ ID NO: 674226 - protein, 9 aa, Homo Sapiens
KDYDWHVFS

SEQ ID NO: 674227 - protein, 9 aa, Homo Sapiens
GDTVLEHLN

SEQ ID NO: 674228 - protein, 9 aa, Homo Sapiens
GQISARTRF

SEQ ID NO: 674229 - protein, 9 aa, Homo Sapiens
PLPSCVPYK

SEQ ID NO: 674230 - protein, 9 aa, Homo Sapiens
YLSCALGCP

SEQ ID NO: 674231 - protein, 9 aa, Homo Sapiens
LSINLLIGK

SEQ ID NO: 674232 - protein, 9 aa, Homo Sapiens
LHENWEMAY

SEQ ID NO: 674233 - protein, 9 aa, Homo Sapiens
PGPMGLTGI

SEQ ID NO: 674234 - protein, 9 aa, Homo Sapiens
KVDLDFLMD

SEQ ID NO: 674235 - protein, 9 aa, Homo Sapiens
YDKVGHQVI

SEQ ID NO: 674236 - protein, 9 aa, Homo Sapiens
NEKKKVKDH

SEQ ID NO: 674237 - protein, 9 aa, Homo Sapiens
TRLLKEIIL

SEQ ID NO: 674238 - protein, 9 aa, Homo Sapiens
EMDASTTYH

SEQ ID NO: 674239 - protein, 9 aa, Homo Sapiens
DQSVPLPSC

SEQ ID NO: 674240 - protein, 9 aa, Homo Sapiens
ISGVFNDRC

SEQ ID NO: 674241 - protein, 9 aa, Homo Sapiens
YPQTLSGML

SEQ ID NO: 674242 - protein, 9 aa, Homo Sapiens
RPELFLFCH

SEQ ID NO: 674243 - protein, 9 aa, Homo Sapiens
LPDQDKAVS

SEQ ID NO: 674244 - protein, 9 aa, Homo Sapiens
GHLKEMHRV

SEQ ID NO: 674245 - protein, 9 aa, Homo Sapiens
KVIILVHYM

SEQ ID NO: 674246 - protein, 9 aa, Homo Sapiens
DCTDPLYKE

SEQ ID NO: 674247 - protein, 9 aa, Homo Sapiens
HLRRREERE

SEQ ID NO: 674248 - protein, 9 aa, Homo Sapiens
LDFLMDGST

SEQ ID NO: 674249 - protein, 9 aa, Homo Sapiens
FCFIPLLTL

SEQ ID NO: 674250 - protein, 9 aa, Homo Sapiens
NGELLAESE

SEQ ID NO: 674251 - protein, 9 aa, Homo Sapiens
GRYRRTEEE

SEQ ID NO: 674252 - protein, 9 aa, Homo Sapiens
EKKTQLFVT

SEQ ID NO: 674253 - protein, 9 aa, Homo Sapiens
RTTTAEGPN

SEQ ID NO: 674254 - protein, 9 aa, Homo Sapiens
REKVMRELK

SEQ ID NO: 674255 - protein, 9 aa, Homo Sapiens
DLRLVLQCI

SEQ ID NO: 674256 - protein, 9 aa, Homo Sapiens
YVMHILMHF

SEQ ID NO: 674257 - protein, 9 aa, Homo Sapiens
PVGLVGFIT

SEQ ID NO: 674258 - protein, 9 aa, Homo Sapiens
SRRSEPRHG

SEQ ID NO: 674259 - protein, 9 aa, Homo Sapiens
NFADGLATG

SEQ ID NO: 674260 - protein, 9 aa, Homo Sapiens
HIQAQSSSI

SEQ ID NO: 674261 - protein, 9 aa, Homo Sapiens
LSCALGCPY

SEQ ID NO: 674262 - protein, 9 aa, Homo Sapiens
RVLPSSELS

SEQ ID NO: 674263 - protein, 9 aa, Homo Sapiens
CTDPLYKEK

SEQ ID NO: 674264 - protein, 9 aa, Homo Sapiens
QSSSIQAPR

SEQ ID NO: 674265 - protein, 9 aa, Homo Sapiens
GVSAAREEV

SEQ ID NO: 674266 - protein, 9 aa, Homo Sapiens
LVDQSVPLP

SEQ ID NO: 674267 - protein, 9 aa, Homo Sapiens
NESSMMTWG

SEQ ID NO: 674268 - protein, 9 aa, Homo Sapiens
YRRTEEENL

SEQ ID NO: 674269 - protein, 9 aa, Homo Sapiens
DFLMDGSTS

SEQ ID NO: 674270 - protein, 9 aa, Homo Sapiens
WDGITAGKA

SEQ ID NO: 674271 - protein, 9 aa, Homo Sapiens
IFTTFILSS

SEQ ID NO: 674272 - protein, 9 aa, Homo Sapiens
GLKLEFESI

SEQ ID NO: 674273 - protein, 9 aa, Homo Sapiens
SARTRFKLI

SEQ ID NO: 674274 - protein, 9 aa, Homo Sapiens
MHMAATFIK

SEQ ID NO: 674275 - protein, 9 aa, Homo Sapiens
NQDHLRRRE

SEQ ID NO: 674276 - protein, 9 aa, Homo Sapiens
EIDKVDLDF

SEQ ID NO: 674277 - protein, 9 aa, Homo Sapiens
ATVMLKIMK

SEQ ID NO: 674278 - protein, 9 aa, Homo Sapiens
QVNEDMLSE

SEQ ID NO: 674279 - protein, 9 aa, Homo Sapiens
VPGLMYPGI

SEQ ID NO: 674280 - protein, 9 aa, Homo Sapiens
DTSTSQRIE

SEQ ID NO: 674281 - protein, 9 aa, Homo Sapiens
SHDMRKKTF

SEQ ID NO: 674282 - protein, 9 aa, Homo Sapiens
RHIQHMHMA

SEQ ID NO: 674283 - protein, 9 aa, Homo Sapiens
ESILSPQRL

SEQ ID NO: 674284 - protein, 9 aa, Homo Sapiens
KHFKLWRLP

SEQ ID NO: 674285 - protein, 9 aa, Homo Sapiens
NICKSLTNL

SEQ ID NO: 674286 - protein, 9 aa, Homo Sapiens
PGVNESSMM

SEQ ID NO: 674287 - protein, 9 aa, Homo Sapiens
DGSRHPRYH

SEQ ID NO: 674288 - protein, 9 aa, Homo Sapiens
HNFADGLAT

SEQ ID NO: 674289 - protein, 9 aa, Homo Sapiens
IRNVILQVN

SEQ ID NO: 674290 - protein, 9 aa, Homo Sapiens
VESSTCQTS

SEQ ID NO: 674291 - protein, 9 aa, Homo Sapiens
VDLDFLMDG

SEQ ID NO: 674292 - protein, 9 aa, Homo Sapiens
LIFTTFILS

SEQ ID NO: 674293 - protein, 9 aa, Homo Sapiens
QTDPAKKGK

SEQ ID NO: 674294 - protein, 9 aa, Homo Sapiens
SVPLPSCVP

SEQ ID NO: 674295 - protein, 9 aa, Homo Sapiens
EGSKLPDQD

SEQ ID NO: 674296 - protein, 9 aa, Homo Sapiens
CKSLTNLSQ

SEQ ID NO: 674297 - protein, 9 aa, Homo Sapiens
NIPARGYLS

SEQ ID NO: 674298 - protein, 9 aa, Homo Sapiens
RLVLQCILQ

SEQ ID NO: 674299 - protein, 9 aa, Homo Sapiens
GYSEVNQRL

SEQ ID NO: 674300 - protein, 9 aa, Homo Sapiens
NFKGPERMQ

SEQ ID NO: 674301 - protein, 9 aa, Homo Sapiens
SSLPSLEKY

SEQ ID NO: 674302 - protein, 9 aa, Homo Sapiens
NVILQVNED

SEQ ID NO: 674303 - protein, 9 aa, Homo Sapiens
SEGAKKMLA

SEQ ID NO: 674304 - protein, 9 aa, Homo Sapiens
SFQRTVCRT

SEQ ID NO: 674305 - protein, 9 aa, Homo Sapiens
SERMLMKKA

SEQ ID NO: 674306 - protein, 9 aa, Homo Sapiens
QRFNTIIRD

SEQ ID NO: 674307 - protein, 9 aa, Homo Sapiens
VTNQRPEIQ

SEQ ID NO: 674308 - protein, 9 aa, Homo Sapiens
LFMFEIFYF

SEQ ID NO: 674309 - protein, 9 aa, Homo Sapiens
QSVPLPSCV

SEQ ID NO: 674310 - protein, 9 aa, Homo Sapiens
NLGPLHENW

SEQ ID NO: 674311 - protein, 9 aa, Homo Sapiens
FEIFYFAFP

SEQ ID NO: 674312 - protein, 9 aa, Homo Sapiens
HSRNVGVRV

SEQ ID NO: 674313 - protein, 9 aa, Homo Sapiens
GRSKSIEER

SEQ ID NO: 674314 - protein, 9 aa, Homo Sapiens
AEDNLGPLH

SEQ ID NO: 674315 - protein, 9 aa, Homo Sapiens
KDSVMALVF

SEQ ID NO: 674316 - protein, 9 aa, Homo Sapiens
EALYQCEAS

SEQ ID NO: 674317 - protein, 9 aa, Homo Sapiens
MHPFRDDGR

SEQ ID NO: 674318 - protein, 9 aa, Homo Sapiens
LCHRSFGPI

SEQ ID NO: 674319 - protein, 9 aa, Homo Sapiens
DGVSAAREE

SEQ ID NO: 674320 - protein, 9 aa, Homo Sapiens
VMALVFNPS

SEQ ID NO: 674321 - protein, 9 aa, Homo Sapiens
GVNESSMMT

SEQ ID NO: 674322 - protein, 9 aa, Homo Sapiens
FKGPERMQS

SEQ ID NO: 674323 - protein, 9 aa, Homo Sapiens
SGNKDSVMA

SEQ ID NO: 674324 - protein, 9 aa, Homo Sapiens
FNTIIRDFE

SEQ ID NO: 674325 - protein, 9 aa, Homo Sapiens
YEKLLIKED

SEQ ID NO: 674326 - protein, 9 aa, Homo Sapiens
ASFCFIPLL

SEQ ID NO: 674327 - protein, 9 aa, Homo Sapiens
NTHPLHTPV

SEQ ID NO: 674328 - protein, 9 aa, Homo Sapiens
AQVSEAVLS

SEQ ID NO: 674329 - protein, 9 aa, Homo Sapiens
EDEKHASQM

SEQ ID NO: 674330 - protein, 9 aa, Homo Sapiens
IIETWREEF

SEQ ID NO: 674331 - protein, 9 aa, Homo Sapiens
VGHQVIVNV

SEQ ID NO: 674332 - protein, 9 aa, Homo Sapiens
ERMQSLSQQ

SEQ ID NO: 674333 - protein, 9 aa, Homo Sapiens
FMFEIFYFA

SEQ ID NO: 674334 - protein, 9 aa, Homo Sapiens
GDLVETVYS

SEQ ID NO: 674335 - protein, 9 aa, Homo Sapiens
PDSERMLMK

SEQ ID NO: 674336 - protein, 9 aa, Homo Sapiens
PGLMYPGII

SEQ ID NO: 674337 - protein, 9 aa, Homo Sapiens
KLWRLPITG

SEQ ID NO: 674338 - protein, 9 aa, Homo Sapiens
SVPGLMYPG

SEQ ID NO: 674339 - protein, 9 aa, Homo Sapiens
PVIYLCHRS

SEQ ID NO: 674340 - protein, 9 aa, Homo Sapiens
NQRLSTTQN

SEQ ID NO: 674341 - protein, 9 aa, Homo Sapiens
SLTMPQRNL

SEQ ID NO: 674342 - protein, 9 aa, Homo Sapiens
NDMGLNSWF

SEQ ID NO: 674343 - protein, 9 aa, Homo Sapiens
AADGVSAAR

SEQ ID NO: 674344 - protein, 9 aa, Homo Sapiens
SGLKLEFES

SEQ ID NO: 674345 - protein, 9 aa, Homo Sapiens
DLPNTHPLH

SEQ ID NO: 674346 - protein, 9 aa, Homo Sapiens
HHKPDEALY

SEQ ID NO: 674347 - protein, 9 aa, Homo Sapiens
VQVENICKS

SEQ ID NO: 674348 - protein, 9 aa, Homo Sapiens
AANKLFMFE

SEQ ID NO: 674349 - protein, 9 aa, Homo Sapiens
LKLEFESIY

SEQ ID NO: 674350 - protein, 9 aa, Homo Sapiens
NGDLISEGA

SEQ ID NO: 674351 - protein, 9 aa, Homo Sapiens
DASTTYHKR

SEQ ID NO: 674352 - protein, 9 aa, Homo Sapiens
MPQRNLTGS

SEQ ID NO: 674353 - protein, 9 aa, Homo Sapiens
PQTLSGMLV

SEQ ID NO: 674354 - protein, 9 aa, Homo Sapiens
RDINDNEPK

SEQ ID NO: 674355 - protein, 9 aa, Homo Sapiens
SSRRSEPRH

SEQ ID NO: 674356 - protein, 9 aa, Homo Sapiens
PNTHPLHTP

SEQ ID NO: 674357 - protein, 9 aa, Homo Sapiens
NDIIARLQY

SEQ ID NO: 674358 - protein, 9 aa, Homo Sapiens
SCILIFTTF

SEQ ID NO: 674359 - protein, 9 aa, Homo Sapiens
PSLEKYEPR

SEQ ID NO: 674360 - protein, 9 aa, Homo Sapiens
GSRHPRYHD

SEQ ID NO: 674361 - protein, 9 aa, Homo Sapiens
GLNSWFDPS

SEQ ID NO: 674362 - protein, 9 aa, Homo Sapiens
TWREEFGDQ

SEQ ID NO: 674363 - protein, 9 aa, Homo Sapiens
IYLCHRSFG

SEQ ID NO: 674364 - protein, 9 aa, Homo Sapiens
PARGYLSCA

SEQ ID NO: 674365 - protein, 9 aa, Homo Sapiens
CHRSFGPIE

SEQ ID NO: 674366 - protein, 9 aa, Homo Sapiens
CEAKSYERS

SEQ ID NO: 674367 - protein, 9 aa, Homo Sapiens
LVLQCILQG

SEQ ID NO: 674368 - protein, 9 aa, Homo Sapiens
DPLYKEKAC

SEQ ID NO: 674369 - protein, 9 aa, Homo Sapiens
GRTSILWDG

SEQ ID NO: 674370 - protein, 9 aa, Homo Sapiens
IPTKENVCE

SEQ ID NO: 674371 - protein, 9 aa, Homo Sapiens
KIRDINDNE

SEQ ID NO: 674372 - protein, 9 aa, Homo Sapiens
GSKLPDQDK

SEQ ID NO: 674373 - protein, 9 aa, Homo Sapiens
RQVWCQLHV

SEQ ID NO: 674374 - protein, 9 aa, Homo Sapiens
LKALAKLEH

SEQ ID NO: 674375 - protein, 9 aa, Homo Sapiens
EFESIYKIP

SEQ ID NO: 674376 - protein, 9 aa, Homo Sapiens
LPSCVPYKY

SEQ ID NO: 674377 - protein, 9 aa, Homo Sapiens
SAAREEVAG

SEQ ID NO: 674378 - protein, 9 aa, Homo Sapiens
SEFIIKIRD

SEQ ID NO: 674379 - protein, 9 aa, Homo Sapiens
QDHLRRREE

SEQ ID NO: 674380 - protein, 9 aa, Homo Sapiens
DLDFLMDGS

SEQ ID NO: 674381 - protein, 9 aa, Homo Sapiens
RSEPRHGSL

SEQ ID NO: 674382 - protein, 9 aa, Homo Sapiens
QQRFNTIIR

SEQ ID NO: 674383 - protein, 9 aa, Homo Sapiens
CILIFTTFI

SEQ ID NO: 674384 - protein, 9 aa, Homo Sapiens
RTRFKLISQ

SEQ ID NO: 674385 - protein, 9 aa, Homo Sapiens
DLVETVYSH

SEQ ID NO: 674386 - protein, 9 aa, Homo Sapiens
TVYSHDMRK

SEQ ID NO: 674387 - protein, 9 aa, Homo Sapiens
HPLHTPVNA

SEQ ID NO: 674388 - protein, 9 aa, Homo Sapiens
PVNGELLAE

SEQ ID NO: 674389 - protein, 9 aa, Homo Sapiens
RHGSLRISN

SEQ ID NO: 674390 - protein, 9 aa, Homo Sapiens
DIIARLQYV

SEQ ID NO: 674391 - protein, 9 aa, Homo Sapiens
TVLEHLNFF

SEQ ID NO: 674392 - protein, 9 aa, Homo Sapiens
VLEHLNFFL

SEQ ID NO: 674393 - protein, 9 aa, Homo Sapiens
LTENQCCRV

SEQ ID NO: 674394 - protein, 9 aa, Homo Sapiens
YSEVNQRLS

SEQ ID NO: 674395 - protein, 9 aa, Homo Sapiens
WCQLHVDHL

SEQ ID NO: 674396 - protein, 9 aa, Homo Sapiens
ISEGAKKML

SEQ ID NO: 674397 - protein, 9 aa, Homo Sapiens
MFEIFYFAF

SEQ ID NO: 674398 - protein, 9 aa, Homo Sapiens
FGDTVLEHL

SEQ ID NO: 674399 - protein, 9 aa, Homo Sapiens
PLHENWEMA

SEQ ID NO: 674400 - protein, 9 aa, Homo Sapiens
CEIDKVDLD

SEQ ID NO: 674401 - protein, 9 aa, Homo Sapiens
SSMMTWGEV

SEQ ID NO: 674402 - protein, 9 aa, Homo Sapiens
VYSHDMRKK

SEQ ID NO: 674403 - protein, 9 aa, Homo Sapiens
HTPTRLLKE

SEQ ID NO: 674404 - protein, 9 aa, Homo Sapiens
YPPKKNAMN

SEQ ID NO: 674405 - protein, 9 aa, Homo Sapiens
VLQCILQGL

SEQ ID NO: 674406 - protein, 9 aa, Homo Sapiens
QAQSSSIQA

SEQ ID NO: 674407 - protein, 9 aa, Homo Sapiens
DYKGKNRHT

SEQ ID NO: 674408 - protein, 9 aa, Homo Sapiens
LHVDHLSDG

SEQ ID NO: 674409 - protein, 9 aa, Homo Sapiens
TGRWKYPPK

SEQ ID NO: 674410 - protein, 9 aa, Homo Sapiens
LSGMLVGAL

SEQ ID NO: 674411 - protein, 9 aa, Homo Sapiens
LFVTNQRPE

SEQ ID NO: 674412 - protein, 9 aa, Homo Sapiens
GDLISEGAK

SEQ ID NO: 674413 - protein, 9 aa, Homo Sapiens
IIRDFEFWL

SEQ ID NO: 674414 - protein, 9 aa, Homo Sapiens
TYHKRKTMN

SEQ ID NO: 674415 - protein, 9 aa, Homo Sapiens
PSLSGLKLE

SEQ ID NO: 674416 - protein, 9 aa, Homo Sapiens
RVCACPGRY

SEQ ID NO: 674417 - protein, 9 aa, Homo Sapiens
FISNDMGLN

SEQ ID NO: 674418 - protein, 9 aa, Homo Sapiens
IPGPVGGPG

SEQ ID NO: 674419 - protein, 9 aa, Homo Sapiens
GHQVIVNVL

SEQ ID NO: 674420 - protein, 9 aa, Homo Sapiens
KLFMFEIFY

SEQ ID NO: 674421 - protein, 9 aa, Homo Sapiens
TSILWDGIT

SEQ ID NO: 674422 - protein, 9 aa, Homo Sapiens
FADGLATGA

SEQ ID NO: 674423 - protein, 9 aa, Homo Sapiens
VNESSMMTW

SEQ ID NO: 674424 - protein, 9 aa, Homo Sapiens
REEVAGHHA

SEQ ID NO: 674425 - protein, 9 aa, Homo Sapiens
VFIMEAVIA

SEQ ID NO: 674426 - protein, 9 aa, Homo Sapiens
WREEFGDQI

SEQ ID NO: 674427 - protein, 9 aa, Homo Sapiens
KENVCEAKS

SEQ ID NO: 674428 - protein, 9 aa, Homo Sapiens
KTQLFVTNQ

SEQ ID NO: 674429 - protein, 9 aa, Homo Sapiens
LAANKLFMF

SEQ ID NO: 674430 - protein, 9 aa, Homo Sapiens
GLVGFITAF

SEQ ID NO: 674431 - protein, 9 aa, Homo Sapiens
EDVQVENIC

SEQ ID NO: 674432 - protein, 9 aa, Homo Sapiens
QDKAVSEHI

SEQ ID NO: 674433 - protein, 9 aa, Homo Sapiens
RKNEKKKVK

SEQ ID NO: 674434 - protein, 9 aa, Homo Sapiens
RLPITGTHL

SEQ ID NO: 674435 - protein, 9 aa, Homo Sapiens
GPERMQSLS

SEQ ID NO: 674436 - protein, 9 aa, Homo Sapiens
THAGDINDI

SEQ ID NO: 674437 - protein, 9 aa, Homo Sapiens
KGKNRHTVI

SEQ ID NO: 674438 - protein, 9 aa, Homo Sapiens
CEARTLSFV

SEQ ID NO: 674439 - protein, 9 aa, Homo Sapiens
EDNLGPLHE

SEQ ID NO: 674440 - protein, 9 aa, Homo Sapiens
SMIPTHAGD

SEQ ID NO: 674441 - protein, 9 aa, Homo Sapiens
DYVMHILMH

SEQ ID NO: 674442 - protein, 9 aa, Homo Sapiens
SRQQRFNTI

SEQ ID NO: 674443 - protein, 9 aa, Homo Sapiens
HAENGDLIS

SEQ ID NO: 674444 - protein, 9 aa, Homo Sapiens
TVCRTTTAE

SEQ ID NO: 674445 - protein, 9 aa, Homo Sapiens
DCWQKERAK

SEQ ID NO: 674446 - protein, 9 aa, Homo Sapiens
LATGAAFSS

SEQ ID NO: 674447 - protein, 9 aa, Homo Sapiens
VLGTSSSCW

SEQ ID NO: 674448 - protein, 9 aa, Homo Sapiens
HMHMAATFI

SEQ ID NO: 674449 - protein, 9 aa, Homo Sapiens
GIHSRNVGV

SEQ ID NO: 674450 - protein, 9 aa, Homo Sapiens
IILVHYMLY

SEQ ID NO: 674451 - protein, 9 aa, Homo Sapiens
VYFGHLKEM

SEQ ID NO: 674452 - protein, 9 aa, Homo Sapiens
EFIIKIRDI

SEQ ID NO: 674453 - protein, 9 aa, Homo Sapiens
SPGRKTKCT

SEQ ID NO: 674454 - protein, 9 aa, Homo Sapiens
HPFRDDGRS

SEQ ID NO: 674455 - protein, 9 aa, Homo Sapiens
AVRVLPSSE

SEQ ID NO: 674456 - protein, 9 aa, Homo Sapiens
VIYLCHRSF

SEQ ID NO: 674457 - protein, 9 aa, Homo Sapiens
NCVINHFQE

SEQ ID NO: 674458 - protein, 9 aa, Homo Sapiens
TVIGYSPLG

SEQ ID NO: 674459 - protein, 9 aa, Homo Sapiens
DGRCDLHVG

SEQ ID NO: 674460 - protein, 9 aa, Homo Sapiens
LTVLGTSSS

SEQ ID NO: 674461 - protein, 9 aa, Homo Sapiens
YLCHRSFGP

SEQ ID NO: 674462 - protein, 9 aa, Homo Sapiens
ASTTYHKRK

SEQ ID NO: 674463 - protein, 9 aa, Homo Sapiens
AVNHTPTRL

SEQ ID NO: 674464 - protein, 9 aa, Homo Sapiens
GFITAFNFP

SEQ ID NO: 674465 - protein, 9 aa, Homo Sapiens
GLMYPGIIP

SEQ ID NO: 674466 - protein, 9 aa, Homo Sapiens
SLKGADTST

SEQ ID NO: 674467 - protein, 9 aa, Homo Sapiens
AREEVAGHH

SEQ ID NO: 674468 - protein, 9 aa, Homo Sapiens
QVSEAVLSI

SEQ ID NO: 674469 - protein, 9 aa, Homo Sapiens
RMLMKKARV

SEQ ID NO: 674470 - protein, 9 aa, Homo Sapiens
HKPDEALYQ

SEQ ID NO: 674471 - protein, 9 aa, Homo Sapiens
DKVGHQVIV

SEQ ID NO: 674472 - protein, 9 aa, Homo Sapiens
GPLHENWEM

SEQ ID NO: 674473 - protein, 9 aa, Homo Sapiens
AGDINDIKK

SEQ ID NO: 674474 - protein, 9 aa, Homo Sapiens
YSHDMRKKT

SEQ ID NO: 674475 - protein, 9 aa, Homo Sapiens
LRLVLQCIL

SEQ ID NO: 674476 - protein, 9 aa, Homo Sapiens
YKEKACEAP

SEQ ID NO: 674477 - protein, 9 aa, Homo Sapiens
NHFQEELGY

SEQ ID NO: 674478 - protein, 9 aa, Homo Sapiens
AEEVYDYVM

SEQ ID NO: 674479 - protein, 9 aa, Homo Sapiens
ARESHTHRD

SEQ ID NO: 674480 - protein, 9 aa, Homo Sapiens
DLISEGAKK

SEQ ID NO: 674481 - protein, 9 aa, Homo Sapiens
TEDLRLVLQ

SEQ ID NO: 674482 - protein, 9 aa, Homo Sapiens
YDGRCDLHV

SEQ ID NO: 674483 - protein, 9 aa, Homo Sapiens
VCRTTTAEG

SEQ ID NO: 674484 - protein, 9 aa, Homo Sapiens
TDPAKKGKV

SEQ ID NO: 674485 - protein, 9 aa, Homo Sapiens
FKLWRLPIT

SEQ ID NO: 674486 - protein, 9 aa, Homo Sapiens
CRTTTAEGP

SEQ ID NO: 674487 - protein, 9 aa, Homo Sapiens
IKEDEKHAS

SEQ ID NO: 674488 - protein, 9 aa, Homo Sapiens
VDYKGKNRH

SEQ ID NO: 674489 - protein, 9 aa, Homo Sapiens
ESLKGADTS

SEQ ID NO: 674490 - protein, 9 aa, Homo Sapiens
LTMPQRNLT

SEQ ID NO: 674491 - protein, 9 aa, Homo Sapiens
LVETVYSHD

SEQ ID NO: 674492 - protein, 9 aa, Homo Sapiens
CVINHFQEE

SEQ ID NO: 674493 - protein, 9 aa, Homo Sapiens
MKDYDWHVF

SEQ ID NO: 674494 - protein, 9 aa, Homo Sapiens
EVNQRLSTT

SEQ ID NO: 674495 - protein, 9 aa, Homo Sapiens
HSVPGLMYP

SEQ ID NO: 674496 - protein, 9 aa, Homo Sapiens
PTKENVCEA

SEQ ID NO: 674497 - protein, 9 aa, Homo Sapiens
RLFPVYPNL

SEQ ID NO: 674498 - protein, 9 aa, Homo Sapiens
GTHRSGEGA

SEQ ID NO: 674499 - protein, 9 aa, Homo Sapiens
SPQRLMISD

SEQ ID NO: 674500 - protein, 9 aa, Homo Sapiens
NTIIRDFEF

SEQ ID NO: 674501 - protein, 9 aa, Homo Sapiens
ANKLFMFEI

SEQ ID NO: 674502 - protein, 9 aa, Homo Sapiens
VIILVHYML

SEQ ID NO: 674503 - protein, 9 aa, Homo Sapiens
CNDIIARLQ

SEQ ID NO: 674504 - protein, 9 aa, Homo Sapiens
RNQDHLRRR

SEQ ID NO: 674505 - protein, 9 aa, Homo Sapiens
VPLPSCVPY

SEQ ID NO: 674506 - protein, 9 aa, Homo Sapiens
SRNVGVRVN

SEQ ID NO: 674507 - protein, 9 aa, Homo Sapiens
EKRNQDHLR

SEQ ID NO: 674508 - protein, 9 aa, Homo Sapiens
TGAAFSSSS

SEQ ID NO: 674509 - protein, 9 aa, Homo Sapiens
RFNTIIRDF

SEQ ID NO: 674510 - protein, 9 aa, Homo Sapiens
AENGDLISE

SEQ ID NO: 674511 - protein, 9 aa, Homo Sapiens
SEVNQRLST

SEQ ID NO: 674512 - protein, 9 aa, Homo Sapiens
KVGHQVIVN

SEQ ID NO: 674513 - protein, 9 aa, Homo Sapiens
LWDGITAGK

SEQ ID NO: 674514 - protein, 9 aa, Homo Sapiens
SINLLIGKK

SEQ ID NO: 674515 - protein, 9 aa, Homo Sapiens
SSSIQAPRS

SEQ ID NO: 674516 - protein, 9 aa, Homo Sapiens
YPGIIPPTG

SEQ ID NO: 674517 - protein, 9 aa, Homo Sapiens
GLATGAAFS

SEQ ID NO: 674518 - protein, 9 aa, Homo Sapiens
ISALQLYWQ

SEQ ID NO: 674519 - protein, 9 aa, Homo Sapiens
RTTGRWKYP

SEQ ID NO: 674520 - protein, 9 aa, Homo Sapiens
MLYKYQMKE

SEQ ID NO: 674521 - protein, 9 aa, Homo Sapiens
ILWDGITAG

SEQ ID NO: 674522 - protein, 9 aa, Homo Sapiens
FGDQIGGPA

SEQ ID NO: 674523 - protein, 9 aa, Homo Sapiens
KIPTKENVC

SEQ ID NO: 674524 - protein, 9 aa, Homo Sapiens
MLMKKARVL

SEQ ID NO: 674525 - protein, 9 aa, Homo Sapiens
KVMRELKAL

SEQ ID NO: 674526 - protein, 9 aa, Homo Sapiens
MAATFIKAM

SEQ ID NO: 674527 - protein, 9 aa, Homo Sapiens
TASFCFIPL

SEQ ID NO: 674528 - protein, 9 aa, Homo Sapiens
LKGADTSTS

SEQ ID NO: 674529 - protein, 9 aa, Homo Sapiens
CPGRYRRTE

SEQ ID NO: 674530 - protein, 9 aa, Homo Sapiens
GPSGMPMLH

SEQ ID NO: 674531 - protein, 9 aa, Homo Sapiens
DSERMLMKK

SEQ ID NO: 674532 - protein, 9 aa, Homo Sapiens
LEKYEPRGP

SEQ ID NO: 674533 - protein, 9 aa, Homo Sapiens
THRSGEGAF

SEQ ID NO: 674534 - protein, 9 aa, Homo Sapiens
SYVESSTCQ

SEQ ID NO: 674535 - protein, 9 aa, Homo Sapiens
LLIKEDEKH

SEQ ID NO: 674536 - protein, 9 aa, Homo Sapiens
VRVLPSSEL

SEQ ID NO: 674537 - protein, 9 aa, Homo Sapiens
PELFLFCHL

SEQ ID NO: 674538 - protein, 9 aa, Homo Sapiens
ALYQCEASL

SEQ ID NO: 674539 - protein, 9 aa, Homo Sapiens
LSFVDVNQS

SEQ ID NO: 674540 - protein, 9 aa, Homo Sapiens
EKDHILTEN

SEQ ID NO: 674541 - protein, 9 aa, Homo Sapiens
LVVHASMDQ

SEQ ID NO: 674542 - protein, 9 aa, Homo Sapiens
HLNFFLFFS

SEQ ID NO: 674543 - protein, 9 aa, Homo Sapiens
ACPGRYRRT

SEQ ID NO: 674544 - protein, 9 aa, Homo Sapiens
YVESSTCQT

SEQ ID NO: 674545 - protein, 9 aa, Homo Sapiens
YDYVMHILM

SEQ ID NO: 674546 - protein, 9 aa, Homo Sapiens
KLPDQDKAV

SEQ ID NO: 674547 - protein, 9 aa, Homo Sapiens
SSSLPSLEK

SEQ ID NO: 674548 - protein, 9 aa, Homo Sapiens
SEAVLSINL

SEQ ID NO: 674549 - protein, 9 aa, Homo Sapiens
NVNCVINHF

SEQ ID NO: 674550 - protein, 9 aa, Homo Sapiens
EARTLSFVD

SEQ ID NO: 674551 - protein, 9 aa, Homo Sapiens
IRQPRLFPV

SEQ ID NO: 674552 - protein, 9 aa, Homo Sapiens
HFKLWRLPI

SEQ ID NO: 674553 - protein, 9 aa, Homo Sapiens
TVMLKIMKD

SEQ ID NO: 674554 - protein, 9 aa, Homo Sapiens
LDSGQISAR

SEQ ID NO: 674555 - protein, 9 aa, Homo Sapiens
IARLQYVKV

SEQ ID NO: 674556 - protein, 9 aa, Homo Sapiens
ELLAESETM

SEQ ID NO: 674557 - protein, 9 aa, Homo Sapiens
SGMPMLHHG

SEQ ID NO: 674558 - protein, 9 aa, Homo Sapiens
VYPNLHFPL

SEQ ID NO: 674559 - protein, 9 aa, Homo Sapiens
PDQDKAVSE

SEQ ID NO: 674560 - protein, 9 aa, Homo Sapiens
LSPQRLMIS

SEQ ID NO: 674561 - protein, 9 aa, Homo Sapiens
LQVNEDMLS

SEQ ID NO: 674562 - protein, 9 aa, Homo Sapiens
LISEGAKKM

SEQ ID NO: 674563 - protein, 9 aa, Homo Sapiens
EEFGDQIGG

SEQ ID NO: 674564 - protein, 9 aa, Homo Sapiens
IETWREEFG

SEQ ID NO: 674565 - protein, 9 aa, Homo Sapiens
HFQEELGYD

SEQ ID NO: 674566 - protein, 9 aa, Homo Sapiens
ARTTGRWKY

SEQ ID NO: 674567 - protein, 9 aa, Homo Sapiens
RWKYPPKKN

SEQ ID NO: 674568 - protein, 9 aa, Homo Sapiens
LPNTHPLHT

SEQ ID NO: 674569 - protein, 9 aa, Homo Sapiens
RKTKCTEIL

SEQ ID NO: 674570 - protein, 9 aa, Homo Sapiens
RLSTTQNKI

SEQ ID NO: 674571 - protein, 9 aa, Homo Sapiens
ILTENQCCR

SEQ ID NO: 674572 - protein, 9 aa, Homo Sapiens
CQALPWGPL

SEQ ID NO: 674573 - protein, 9 aa, Homo Sapiens
YKPCTGAMG

SEQ ID NO: 674574 - protein, 9 aa, Homo Sapiens
LFEPAAKWQ

SEQ ID NO: 674575 - protein, 9 aa, Homo Sapiens
GDQEWIPFV

SEQ ID NO: 674576 - protein, 9 aa, Homo Sapiens
MDIMYEAVD

SEQ ID NO: 674577 - protein, 9 aa, Homo Sapiens
LHQSTASEK

SEQ ID NO: 674578 - protein, 9 aa, Homo Sapiens
PEGLQLNKE

SEQ ID NO: 674579 - protein, 9 aa, Homo Sapiens
VAHWVQQQI

SEQ ID NO: 674580 - protein, 9 aa, Homo Sapiens
DSGPPEESV

SEQ ID NO: 674581 - protein, 9 aa, Homo Sapiens
IDCHKDEKG

SEQ ID NO: 674582 - protein, 9 aa, Homo Sapiens
LGLTIKDNG

SEQ ID NO: 674583 - protein, 9 aa, Homo Sapiens
VAIDEESQN

SEQ ID NO: 674584 - protein, 9 aa, Homo Sapiens
KNQAKFFLV

SEQ ID NO: 674585 - protein, 9 aa, Homo Sapiens
RAEWMRMRM

SEQ ID NO: 674586 - protein, 9 aa, Homo Sapiens
YTVRFKNEL

SEQ ID NO: 674587 - protein, 9 aa, Homo Sapiens
PRSLLLQAS

SEQ ID NO: 674588 - protein, 9 aa, Homo Sapiens
DLVNVINDV

SEQ ID NO: 674589 - protein, 9 aa, Homo Sapiens
STAEHIEPP

SEQ ID NO: 674590 - protein, 9 aa, Homo Sapiens
KTDDRAVGG

SEQ ID NO: 674591 - protein, 9 aa, Homo Sapiens
SEKIMLAII

SEQ ID NO: 674592 - protein, 9 aa, Homo Sapiens
ALQRTHSAS

SEQ ID NO: 674593 - protein, 9 aa, Homo Sapiens
YDIQTWVPL

SEQ ID NO: 674594 - protein, 9 aa, Homo Sapiens
HRCFFLLLL

SEQ ID NO: 674595 - protein, 9 aa, Homo Sapiens
VPGSTMNMG

SEQ ID NO: 674596 - protein, 9 aa, Homo Sapiens
SLGLTIKDN

SEQ ID NO: 674597 - protein, 9 aa, Homo Sapiens
SFDHSLQPS

SEQ ID NO: 674598 - protein, 9 aa, Homo Sapiens
SKTRFAYRI

SEQ ID NO: 674599 - protein, 9 aa, Homo Sapiens
KMYFFILFA

SEQ ID NO: 674600 - protein, 9 aa, Homo Sapiens
LLALLQGVC

SEQ ID NO: 674601 - protein, 9 aa, Homo Sapiens
QRGRLPSKP

SEQ ID NO: 674602 - protein, 9 aa, Homo Sapiens
SMRLSFSTI

SEQ ID NO: 674603 - protein, 9 aa, Homo Sapiens
VYNNMIAKI

SEQ ID NO: 674604 - protein, 9 aa, Homo Sapiens
VRNFEVQRG

SEQ ID NO: 674605 - protein, 9 aa, Homo Sapiens
ALRHSSYAA

SEQ ID NO: 674606 - protein, 9 aa, Homo Sapiens
LQLALQDWY

SEQ ID NO: 674607 - protein, 9 aa, Homo Sapiens
QLSDLDSSV

SEQ ID NO: 674608 - protein, 9 aa, Homo Sapiens
GISKSKVDK

SEQ ID NO: 674609 - protein, 9 aa, Homo Sapiens
EMGLLEQLD

SEQ ID NO: 674610 - protein, 9 aa, Homo Sapiens
SQNGTILVD

SEQ ID NO: 674611 - protein, 9 aa, Homo Sapiens
KLTRHYRKH

SEQ ID NO: 674612 - protein, 9 aa, Homo Sapiens
PTQLGRLDS

SEQ ID NO: 674613 - protein, 9 aa, Homo Sapiens
ESLKALDIA

SEQ ID NO: 674614 - protein, 9 aa, Homo Sapiens
QPNIPVRSS

SEQ ID NO: 674615 - protein, 9 aa, Homo Sapiens
IGQEYQIIT

SEQ ID NO: 674616 - protein, 9 aa, Homo Sapiens
RNHRKASLE

SEQ ID NO: 674617 - protein, 9 aa, Homo Sapiens
SVLLLLAYL

SEQ ID NO: 674618 - protein, 9 aa, Homo Sapiens
GAGEDSVAA

SEQ ID NO: 674619 - protein, 9 aa, Homo Sapiens
EAYKPCTGA

SEQ ID NO: 674620 - protein, 9 aa, Homo Sapiens
SHGTQGLLR

SEQ ID NO: 674621 - protein, 9 aa, Homo Sapiens
HLKQFLGHP

SEQ ID NO: 674622 - protein, 9 aa, Homo Sapiens
VSEQRPGTL

SEQ ID NO: 674623 - protein, 9 aa, Homo Sapiens
QFKQSKTQM

SEQ ID NO: 674624 - protein, 9 aa, Homo Sapiens
LDLDSIISE

SEQ ID NO: 674625 - protein, 9 aa, Homo Sapiens
TDPSSMRLS

SEQ ID NO: 674626 - protein, 9 aa, Homo Sapiens
VLAPYLQLE

SEQ ID NO: 674627 - protein, 9 aa, Homo Sapiens
LIVTPPTKQ

SEQ ID NO: 674628 - protein, 9 aa, Homo Sapiens
LSHPVVQRR

SEQ ID NO: 674629 - protein, 9 aa, Homo Sapiens
VELGRQPGQ

SEQ ID NO: 674630 - protein, 9 aa, Homo Sapiens
QEVHSFASC

SEQ ID NO: 674631 - protein, 9 aa, Homo Sapiens
EPRVATVTS

SEQ ID NO: 674632 - protein, 9 aa, Homo Sapiens
LTTVSRKKK

SEQ ID NO: 674633 - protein, 9 aa, Homo Sapiens
IPGEAEYKV

SEQ ID NO: 674634 - protein, 9 aa, Homo Sapiens
LPSLFQIPH

SEQ ID NO: 674635 - protein, 9 aa, Homo Sapiens
IFNLFYMES

SEQ ID NO: 674636 - protein, 9 aa, Homo Sapiens
VTLGLLMEE

SEQ ID NO: 674637 - protein, 9 aa, Homo Sapiens
SKLDIQRKT

SEQ ID NO: 674638 - protein, 9 aa, Homo Sapiens
ADVWILVLS

SEQ ID NO: 674639 - protein, 9 aa, Homo Sapiens
DAATLYCIN

SEQ ID NO: 674640 - protein, 9 aa, Homo Sapiens
VQAVLLPLT

SEQ ID NO: 674641 - protein, 9 aa, Homo Sapiens
TCVFNNQEN

SEQ ID NO: 674642 - protein, 9 aa, Homo Sapiens
EIFNLFYME

SEQ ID NO: 674643 - protein, 9 aa, Homo Sapiens
YPGIPGPHG

SEQ ID NO: 674644 - protein, 9 aa, Homo Sapiens
NLDYLVNRY

SEQ ID NO: 674645 - protein, 9 aa, Homo Sapiens
YEAVDSREV

SEQ ID NO: 674646 - protein, 9 aa, Homo Sapiens
TQPPLEAAD

SEQ ID NO: 674647 - protein, 9 aa, Homo Sapiens
HAIVRACTS

SEQ ID NO: 674648 - protein, 9 aa, Homo Sapiens
ERELHLLCV

SEQ ID NO: 674649 - protein, 9 aa, Homo Sapiens
NQKEGHFQR

SEQ ID NO: 674650 - protein, 9 aa, Homo Sapiens
HLDGFLFCK

SEQ ID NO: 674651 - protein, 9 aa, Homo Sapiens
VPSSVLLLL

SEQ ID NO: 674652 - protein, 9 aa, Homo Sapiens
QMADTLFKR

SEQ ID NO: 674653 - protein, 9 aa, Homo Sapiens
DASILQLSL

SEQ ID NO: 674654 - protein, 9 aa, Homo Sapiens
HDLKREAGS

SEQ ID NO: 674655 - protein, 9 aa, Homo Sapiens
QNGTILVDN

SEQ ID NO: 674656 - protein, 9 aa, Homo Sapiens
AYPRAVLML

SEQ ID NO: 674657 - protein, 9 aa, Homo Sapiens
REKIMKLSL

SEQ ID NO: 674658 - protein, 9 aa, Homo Sapiens
MSSPPVRAL

SEQ ID NO: 674659 - protein, 9 aa, Homo Sapiens
EEFEKLLSS

SEQ ID NO: 674660 - protein, 9 aa, Homo Sapiens
QKREEQQRR

SEQ ID NO: 674661 - protein, 9 aa, Homo Sapiens
SKVQSLVAV

SEQ ID NO: 674662 - protein, 9 aa, Homo Sapiens
DWYQTVETA

SEQ ID NO: 674663 - protein, 9 aa, Homo Sapiens
SSIYNGCQE

SEQ ID NO: 674664 - protein, 9 aa, Homo Sapiens
DRHVQQHNL

SEQ ID NO: 674665 - protein, 9 aa, Homo Sapiens
NHERIGQDS

SEQ ID NO: 674666 - protein, 9 aa, Homo Sapiens
LQPKPGLFE

SEQ ID NO: 674667 - protein, 9 aa, Homo Sapiens
FLISLDSVP

SEQ ID NO: 674668 - protein, 9 aa, Homo Sapiens
AMHFRATIR

SEQ ID NO: 674669 - protein, 9 aa, Homo Sapiens
PQHLKQFLG

SEQ ID NO: 674670 - protein, 9 aa, Homo Sapiens
LLLLELQNV

SEQ ID NO: 674671 - protein, 9 aa, Homo Sapiens
SEKLDEHRT

SEQ ID NO: 674672 - protein, 9 aa, Homo Sapiens
PEPHSPPAS

SEQ ID NO: 674673 - protein, 9 aa, Homo Sapiens
PYALWQRKD

SEQ ID NO: 674674 - protein, 9 aa, Homo Sapiens
QLMHEGLFG

SEQ ID NO: 674675 - protein, 9 aa, Homo Sapiens
LFVQKGVSV

SEQ ID NO: 674676 - protein, 9 aa, Homo Sapiens
TPVKPREPC

SEQ ID NO: 674677 - protein, 9 aa, Homo Sapiens
HHQGGWKGV

SEQ ID NO: 674678 - protein, 9 aa, Homo Sapiens
STMNMGSLE

SEQ ID NO: 674679 - protein, 9 aa, Homo Sapiens
PAATASAAY

SEQ ID NO: 674680 - protein, 9 aa, Homo Sapiens
CLMKMYFFI

SEQ ID NO: 674681 - protein, 9 aa, Homo Sapiens
KLWRDFVNS

SEQ ID NO: 674682 - protein, 9 aa, Homo Sapiens
RGLWKAKDI

SEQ ID NO: 674683 - protein, 9 aa, Homo Sapiens
AEPRDLQIS

SEQ ID NO: 674684 - protein, 9 aa, Homo Sapiens
HMQGTCPVL

SEQ ID NO: 674685 - protein, 9 aa, Homo Sapiens
LVHLKTHPV

SEQ ID NO: 674686 - protein, 9 aa, Homo Sapiens
HIIILATTR

SEQ ID NO: 674687 - protein, 9 aa, Homo Sapiens
LSCKKGASL

SEQ ID NO: 674688 - protein, 9 aa, Homo Sapiens
KLVVVGACG

SEQ ID NO: 674689 - protein, 9 aa, Homo Sapiens
GLQLNKENK

SEQ ID NO: 674690 - protein, 9 aa, Homo Sapiens
TAGTAAARG

SEQ ID NO: 674691 - protein, 9 aa, Homo Sapiens
ALMKQKREE

SEQ ID NO: 674692 - protein, 9 aa, Homo Sapiens
DSSVQKTVA

SEQ ID NO: 674693 - protein, 9 aa, Homo Sapiens
GRSARELSC

SEQ ID NO: 674694 - protein, 9 aa, Homo Sapiens
WGGTPLHHA

SEQ ID NO: 674695 - protein, 9 aa, Homo Sapiens
NNQSPAALT

SEQ ID NO: 674696 - protein, 9 aa, Homo Sapiens
EVVWEAIKP

SEQ ID NO: 674697 - protein, 9 aa, Homo Sapiens
QASFDHSLQ

SEQ ID NO: 674698 - protein, 9 aa, Homo Sapiens
EGLQLNKEN

SEQ ID NO: 674699 - protein, 9 aa, Homo Sapiens
MKQKREEQQ

SEQ ID NO: 674700 - protein, 9 aa, Homo Sapiens
NVFSWLQWL

SEQ ID NO: 674701 - protein, 9 aa, Homo Sapiens
SRSQDSCCP

SEQ ID NO: 674702 - protein, 9 aa, Homo Sapiens
HGTQGLLRK

SEQ ID NO: 674703 - protein, 9 aa, Homo Sapiens
QLFMGNLKN

SEQ ID NO: 674704 - protein, 9 aa, Homo Sapiens
KEDDEIKED

SEQ ID NO: 674705 - protein, 9 aa, Homo Sapiens
YQTVETAQR

SEQ ID NO: 674706 - protein, 9 aa, Homo Sapiens
FGDIAFYCC

SEQ ID NO: 674707 - protein, 9 aa, Homo Sapiens
EREHWRSGR

SEQ ID NO: 674708 - protein, 9 aa, Homo Sapiens
GYSYLPFQL

SEQ ID NO: 674709 - protein, 9 aa, Homo Sapiens
LITDESLKA

SEQ ID NO: 674710 - protein, 9 aa, Homo Sapiens
ELNIRPKTI

SEQ ID NO: 674711 - protein, 9 aa, Homo Sapiens
NLVLFRFSI

SEQ ID NO: 674712 - protein, 9 aa, Homo Sapiens
PKYAYGTLG

SEQ ID NO: 674713 - protein, 9 aa, Homo Sapiens
ISHAIVRAC

SEQ ID NO: 674714 - protein, 9 aa, Homo Sapiens
SIVDSKPNS

SEQ ID NO: 674715 - protein, 9 aa, Homo Sapiens
DDAEAILAP

SEQ ID NO: 674716 - protein, 9 aa, Homo Sapiens
IMGTVTAIK

SEQ ID NO: 674717 - protein, 9 aa, Homo Sapiens
SSLVELGRQ

SEQ ID NO: 674718 - protein, 9 aa, Homo Sapiens
NARFSVIYR

SEQ ID NO: 674719 - protein, 9 aa, Homo Sapiens
CWLILFLKI

SEQ ID NO: 674720 - protein, 9 aa, Homo Sapiens
NTLWFFAVP

SEQ ID NO: 674721 - protein, 9 aa, Homo Sapiens
QTRGATETS

SEQ ID NO: 674722 - protein, 9 aa, Homo Sapiens
GPACKGPAL

SEQ ID NO: 674723 - protein, 9 aa, Homo Sapiens
GHLQLVDVC

SEQ ID NO: 674724 - protein, 9 aa, Homo Sapiens
WQGLRATRP

SEQ ID NO: 674725 - protein, 9 aa, Homo Sapiens
ITNSQAEIY

SEQ ID NO: 674726 - protein, 9 aa, Homo Sapiens
TLRKSMKGL

SEQ ID NO: 674727 - protein, 9 aa, Homo Sapiens
EDLEPLAGR

SEQ ID NO: 674728 - protein, 9 aa, Homo Sapiens
LLNKEKNTL

SEQ ID NO: 674729 - protein, 9 aa, Homo Sapiens
PDFEIGHFL

SEQ ID NO: 674730 - protein, 9 aa, Homo Sapiens
MADTLFKRA

SEQ ID NO: 674731 - protein, 9 aa, Homo Sapiens
RYTNLLRPK

SEQ ID NO: 674732 - protein, 9 aa, Homo Sapiens
QHHLLPLAD

SEQ ID NO: 674733 - protein, 9 aa, Homo Sapiens
LNGLDKALQ

SEQ ID NO: 674734 - protein, 9 aa, Homo Sapiens
HVRAARPEP

SEQ ID NO: 674735 - protein, 9 aa, Homo Sapiens
KLQEFNARV

SEQ ID NO: 674736 - protein, 9 aa, Homo Sapiens
SVPRARLKS

SEQ ID NO: 674737 - protein, 9 aa, Homo Sapiens
RLAEKSFRN

SEQ ID NO: 674738 - protein, 9 aa, Homo Sapiens
ILALLLALL

SEQ ID NO: 674739 - protein, 9 aa, Homo Sapiens
QSAAATINQ

SEQ ID NO: 674740 - protein, 9 aa, Homo Sapiens
EMGLTQGSF

SEQ ID NO: 674741 - protein, 9 aa, Homo Sapiens
ESVQEMMEE

SEQ ID NO: 674742 - protein, 9 aa, Homo Sapiens
EFEKLLSSN

SEQ ID NO: 674743 - protein, 9 aa, Homo Sapiens
SARELSCKK

SEQ ID NO: 674744 - protein, 9 aa, Homo Sapiens
RGVAHWVQQ

SEQ ID NO: 674745 - protein, 9 aa, Homo Sapiens
ASKVQSLVA

SEQ ID NO: 674746 - protein, 9 aa, Homo Sapiens
AYRIKWRII

SEQ ID NO: 674747 - protein, 9 aa, Homo Sapiens
VPQDLQEQQ

SEQ ID NO: 674748 - protein, 9 aa, Homo Sapiens
SSQGHLDLT

SEQ ID NO: 674749 - protein, 9 aa, Homo Sapiens
NGRNHQGSK

SEQ ID NO: 674750 - protein, 9 aa, Homo Sapiens
HHPGLILLL

SEQ ID NO: 674751 - protein, 9 aa, Homo Sapiens
YPVVKELVV

SEQ ID NO: 674752 - protein, 9 aa, Homo Sapiens
YVDTGMDFR

SEQ ID NO: 674753 - protein, 9 aa, Homo Sapiens
NTSLSGTAN

SEQ ID NO: 674754 - protein, 9 aa, Homo Sapiens
LLMEEMIFN

SEQ ID NO: 674755 - protein, 9 aa, Homo Sapiens
SDLDSSVQK

SEQ ID NO: 674756 - protein, 9 aa, Homo Sapiens
TDEDATVNH

SEQ ID NO: 674757 - protein, 9 aa, Homo Sapiens
TSNPLVPPE

SEQ ID NO: 674758 - protein, 9 aa, Homo Sapiens
EEDTGPAPG

SEQ ID NO: 674759 - protein, 9 aa, Homo Sapiens
GLAPPFCNT

SEQ ID NO: 674760 - protein, 9 aa, Homo Sapiens
TITEFVIGN

SEQ ID NO: 674761 - protein, 9 aa, Homo Sapiens
LNKHVRIHT

SEQ ID NO: 674762 - protein, 9 aa, Homo Sapiens
PRGLWKAKD

SEQ ID NO: 674763 - protein, 9 aa, Homo Sapiens
LNAAIRKME

SEQ ID NO: 674764 - protein, 9 aa, Homo Sapiens
AQLTQHHPG

SEQ ID NO: 674765 - protein, 9 aa, Homo Sapiens
PCTGAMGDR

SEQ ID NO: 674766 - protein, 9 aa, Homo Sapiens
DIMYEAVDS

SEQ ID NO: 674767 - protein, 9 aa, Homo Sapiens
PARRADSGE

SEQ ID NO: 674768 - protein, 9 aa, Homo Sapiens
CADWETPSN

SEQ ID NO: 674769 - protein, 9 aa, Homo Sapiens
VFKAKFLPN

SEQ ID NO: 674770 - protein, 9 aa, Homo Sapiens
NNYEIIKLF

SEQ ID NO: 674771 - protein, 9 aa, Homo Sapiens
PVRSSSFNN

SEQ ID NO: 674772 - protein, 9 aa, Homo Sapiens
PPSSREMPE

SEQ ID NO: 674773 - protein, 9 aa, Homo Sapiens
TLLGEVYVN

SEQ ID NO: 674774 - protein, 9 aa, Homo Sapiens
FAYRIKWRI

SEQ ID NO: 674775 - protein, 9 aa, Homo Sapiens
RSAIKDIVT

SEQ ID NO: 674776 - protein, 9 aa, Homo Sapiens
GQRGRLPSK

SEQ ID NO: 674777 - protein, 9 aa, Homo Sapiens
WVLGTCKEI

SEQ ID NO: 674778 - protein, 9 aa, Homo Sapiens
SWQKINPFH

SEQ ID NO: 674779 - protein, 9 aa, Homo Sapiens
GLILLLLIT

SEQ ID NO: 674780 - protein, 9 aa, Homo Sapiens
NHLKFLNML

SEQ ID NO: 674781 - protein, 9 aa, Homo Sapiens
KNQHQTENL

SEQ ID NO: 674782 - protein, 9 aa, Homo Sapiens
QLHLGLCPD

SEQ ID NO: 674783 - protein, 9 aa, Homo Sapiens
LLCQNPSRS

SEQ ID NO: 674784 - protein, 9 aa, Homo Sapiens
RSSSFNNPL

SEQ ID NO: 674785 - protein, 9 aa, Homo Sapiens
AYKPCTGAM

SEQ ID NO: 674786 - protein, 9 aa, Homo Sapiens
VAAAAPGAG

SEQ ID NO: 674787 - protein, 9 aa, Homo Sapiens
EQRPGTLGP

SEQ ID NO: 674788 - protein, 9 aa, Homo Sapiens
FIPTNTLNL

SEQ ID NO: 674789 - protein, 9 aa, Homo Sapiens
VRQAALRIM

SEQ ID NO: 674790 - protein, 9 aa, Homo Sapiens
GPGACVPLL

SEQ ID NO: 674791 - protein, 9 aa, Homo Sapiens
PQRTLQEAL

SEQ ID NO: 674792 - protein, 9 aa, Homo Sapiens
KAVFTEYTD

SEQ ID NO: 674793 - protein, 9 aa, Homo Sapiens
SSVLLLLAY

SEQ ID NO: 674794 - protein, 9 aa, Homo Sapiens
HIYPLYFFL

SEQ ID NO: 674795 - protein, 9 aa, Homo Sapiens
IERVRPLKS

SEQ ID NO: 674796 - protein, 9 aa, Homo Sapiens
AFSMMILYS

SEQ ID NO: 674797 - protein, 9 aa, Homo Sapiens
LKNRPVGLW

SEQ ID NO: 674798 - protein, 9 aa, Homo Sapiens
SFLPVSASL

SEQ ID NO: 674799 - protein, 9 aa, Homo Sapiens
LSNIERNLQ

SEQ ID NO: 674800 - protein, 9 aa, Homo Sapiens
GHVVAKVLA

SEQ ID NO: 674801 - protein, 9 aa, Homo Sapiens
RLKRCGLEH

SEQ ID NO: 674802 - protein, 9 aa, Homo Sapiens
LFSTQPPLE

SEQ ID NO: 674803 - protein, 9 aa, Homo Sapiens
RMHEFHSEV

SEQ ID NO: 674804 - protein, 9 aa, Homo Sapiens
PSQLHLGLC

SEQ ID NO: 674805 - protein, 9 aa, Homo Sapiens
PCTCISGFT

SEQ ID NO: 674806 - protein, 9 aa, Homo Sapiens
NLDSIIQFV

SEQ ID NO: 674807 - protein, 9 aa, Homo Sapiens
TCKEIFNLF

SEQ ID NO: 674808 - protein, 9 aa, Homo Sapiens
QEYQIITQI

SEQ ID NO: 674809 - protein, 9 aa, Homo Sapiens
FQRVTTVSE

SEQ ID NO: 674810 - protein, 9 aa, Homo Sapiens
GRQPGQRQH

SEQ ID NO: 674811 - protein, 9 aa, Homo Sapiens
HQELLGPEE

SEQ ID NO: 674812 - protein, 9 aa, Homo Sapiens
GLKSKVTLK

SEQ ID NO: 674813 - protein, 9 aa, Homo Sapiens
CGCVSAGST

SEQ ID NO: 674814 - protein, 9 aa, Homo Sapiens
HCLAGVSRR

SEQ ID NO: 674815 - protein, 9 aa, Homo Sapiens
GLLMEEMIF

SEQ ID NO: 674816 - protein, 9 aa, Homo Sapiens
YQKGPILME

SEQ ID NO: 674817 - protein, 9 aa, Homo Sapiens
HRDSYLGVL

SEQ ID NO: 674818 - protein, 9 aa, Homo Sapiens
NRREVEQCF

SEQ ID NO: 674819 - protein, 9 aa, Homo Sapiens
STSAPYPVV

SEQ ID NO: 674820 - protein, 9 aa, Homo Sapiens
GRLSTETLG

SEQ ID NO: 674821 - protein, 9 aa, Homo Sapiens
HLYESLAVL

SEQ ID NO: 674822 - protein, 9 aa, Homo Sapiens
PVPQDLQEQ

SEQ ID NO: 674823 - protein, 9 aa, Homo Sapiens
CHEYWKRLA

SEQ ID NO: 674824 - protein, 9 aa, Homo Sapiens
MTQLHATDA

SEQ ID NO: 674825 - protein, 9 aa, Homo Sapiens
TPLPNPVVY

SEQ ID NO: 674826 - protein, 9 aa, Homo Sapiens
AYKKLITVL

SEQ ID NO: 674827 - protein, 9 aa, Homo Sapiens
YQKSRMQLF

SEQ ID NO: 674828 - protein, 9 aa, Homo Sapiens
FVIGNEYYF

SEQ ID NO: 674829 - protein, 9 aa, Homo Sapiens
KYPGIPGPH

SEQ ID NO: 674830 - protein, 9 aa, Homo Sapiens
NFEVQRGDI

SEQ ID NO: 674831 - protein, 9 aa, Homo Sapiens
GRSPEATSP

SEQ ID NO: 674832 - protein, 9 aa, Homo Sapiens
QIITQINGN

SEQ ID NO: 674833 - protein, 9 aa, Homo Sapiens
VQSGTEMEI

SEQ ID NO: 674834 - protein, 9 aa, Homo Sapiens
KTSQFLLSA

SEQ ID NO: 674835 - protein, 9 aa, Homo Sapiens
AVLAPYLQL

SEQ ID NO: 674836 - protein, 9 aa, Homo Sapiens
SLPGFEDHL

SEQ ID NO: 674837 - protein, 9 aa, Homo Sapiens
WNLSRNGSV

SEQ ID NO: 674838 - protein, 9 aa, Homo Sapiens
HSKLTRLLQ

SEQ ID NO: 674839 - protein, 9 aa, Homo Sapiens
TEPLLEGPE

SEQ ID NO: 674840 - protein, 9 aa, Homo Sapiens
VSASLPPTW

SEQ ID NO: 674841 - protein, 9 aa, Homo Sapiens
KCTNHERIG

SEQ ID NO: 674842 - protein, 9 aa, Homo Sapiens
EEHKKEHSS

SEQ ID NO: 674843 - protein, 9 aa, Homo Sapiens
QPPSILNGL

SEQ ID NO: 674844 - protein, 9 aa, Homo Sapiens
WLGLCFWTA

SEQ ID NO: 674845 - protein, 9 aa, Homo Sapiens
VWSISTGSF

SEQ ID NO: 674846 - protein, 9 aa, Homo Sapiens
ELSCKKGAS

SEQ ID NO: 674847 - protein, 9 aa, Homo Sapiens
EHKKEHSSG

SEQ ID NO: 674848 - protein, 9 aa, Homo Sapiens
GTVTAIKLL

SEQ ID NO: 674849 - protein, 9 aa, Homo Sapiens
NARVSLRQR

SEQ ID NO: 674850 - protein, 9 aa, Homo Sapiens
DNDSTTSVE

SEQ ID NO: 674851 - protein, 9 aa, Homo Sapiens
HAHQHRDSY

SEQ ID NO: 674852 - protein, 9 aa, Homo Sapiens
DAKAFWMEL

SEQ ID NO: 674853 - protein, 9 aa, Homo Sapiens
NNYKEEPLI

SEQ ID NO: 674854 - protein, 9 aa, Homo Sapiens
YEIIKLFVQ

SEQ ID NO: 674855 - protein, 9 aa, Homo Sapiens
QLTQHHPGL

SEQ ID NO: 674856 - protein, 9 aa, Homo Sapiens
AEAILAPDF

SEQ ID NO: 674857 - protein, 9 aa, Homo Sapiens
IIILATTRS

SEQ ID NO: 674858 - protein, 9 aa, Homo Sapiens
AETLIKLSD

SEQ ID NO: 674859 - protein, 9 aa, Homo Sapiens
VALHDGTQI

SEQ ID NO: 674860 - protein, 9 aa, Homo Sapiens
PFHLSDVQH

SEQ ID NO: 674861 - protein, 9 aa, Homo Sapiens
MANHEKPVL

SEQ ID NO: 674862 - protein, 9 aa, Homo Sapiens
ITDESLKAL

SEQ ID NO: 674863 - protein, 9 aa, Homo Sapiens
VLNDTDTCQ

SEQ ID NO: 674864 - protein, 9 aa, Homo Sapiens
QQITNSQAE

SEQ ID NO: 674865 - protein, 9 aa, Homo Sapiens
ITEPLLEGP

SEQ ID NO: 674866 - protein, 9 aa, Homo Sapiens
DHVVPILII

SEQ ID NO: 674867 - protein, 9 aa, Homo Sapiens
LKEIMKHDF

SEQ ID NO: 674868 - protein, 9 aa, Homo Sapiens
QRVAMIDET

SEQ ID NO: 674869 - protein, 9 aa, Homo Sapiens
PGTLGPPPP

SEQ ID NO: 674870 - protein, 9 aa, Homo Sapiens
HVVPILIIF

SEQ ID NO: 674871 - protein, 9 aa, Homo Sapiens
KSKVDKHSP

SEQ ID NO: 674872 - protein, 9 aa, Homo Sapiens
IYNGCQETY

SEQ ID NO: 674873 - protein, 9 aa, Homo Sapiens
CLSLVKENY

SEQ ID NO: 674874 - protein, 9 aa, Homo Sapiens
AANTLWFFA

SEQ ID NO: 674875 - protein, 9 aa, Homo Sapiens
MMSSGSQHN

SEQ ID NO: 674876 - protein, 9 aa, Homo Sapiens
EWMRMRMTW

SEQ ID NO: 674877 - protein, 9 aa, Homo Sapiens
ACLMKMYFF

SEQ ID NO: 674878 - protein, 9 aa, Homo Sapiens
DATVNHQKS

SEQ ID NO: 674879 - protein, 9 aa, Homo Sapiens
KRATNSSWV

SEQ ID NO: 674880 - protein, 9 aa, Homo Sapiens
RDFVSAGPA

SEQ ID NO: 674881 - protein, 9 aa, Homo Sapiens
QLSLQKCWS

SEQ ID NO: 674882 - protein, 9 aa, Homo Sapiens
SEVKAQYEE

SEQ ID NO: 674883 - protein, 9 aa, Homo Sapiens
AARPEPWNA

SEQ ID NO: 674884 - protein, 9 aa, Homo Sapiens
DQEWIPFVE

SEQ ID NO: 674885 - protein, 9 aa, Homo Sapiens
QQLDNSAAI

SEQ ID NO: 674886 - protein, 9 aa, Homo Sapiens
LQEQQRRQV

SEQ ID NO: 674887 - protein, 9 aa, Homo Sapiens
IINENGNPI

SEQ ID NO: 674888 - protein, 9 aa, Homo Sapiens
TSQFLLSAL

SEQ ID NO: 674889 - protein, 9 aa, Homo Sapiens
VRYSPELTA

SEQ ID NO: 674890 - protein, 9 aa, Homo Sapiens
AQLYVFLWL

SEQ ID NO: 674891 - protein, 9 aa, Homo Sapiens
KGWMDIMYE

SEQ ID NO: 674892 - protein, 9 aa, Homo Sapiens
HYYDQITLK

SEQ ID NO: 674893 - protein, 9 aa, Homo Sapiens
QNCHCLPGL

SEQ ID NO: 674894 - protein, 9 aa, Homo Sapiens
HLGLCPDRH

SEQ ID NO: 674895 - protein, 9 aa, Homo Sapiens
ASTNEDAGD

SEQ ID NO: 674896 - protein, 9 aa, Homo Sapiens
EYCPIHILW

SEQ ID NO: 674897 - protein, 9 aa, Homo Sapiens
CSGNCCFWK

SEQ ID NO: 674898 - protein, 9 aa, Homo Sapiens
YKWQEEDTG

SEQ ID NO: 674899 - protein, 9 aa, Homo Sapiens
EHSSGDSVV

SEQ ID NO: 674900 - protein, 9 aa, Homo Sapiens
ALLLLLCFV

SEQ ID NO: 674901 - protein, 9 aa, Homo Sapiens
HGVPGQVNA

SEQ ID NO: 674902 - protein, 9 aa, Homo Sapiens
HHAAENGQM

SEQ ID NO: 674903 - protein, 9 aa, Homo Sapiens
RFQLFESDI

SEQ ID NO: 674904 - protein, 9 aa, Homo Sapiens
KSPTPVKPR

SEQ ID NO: 674905 - protein, 9 aa, Homo Sapiens
FTIVGDAFG

SEQ ID NO: 674906 - protein, 9 aa, Homo Sapiens
SKNNAFCTH

SEQ ID NO: 674907 - protein, 9 aa, Homo Sapiens
GRLKCASSS

SEQ ID NO: 674908 - protein, 9 aa, Homo Sapiens
LGTCKEIFN

SEQ ID NO: 674909 - protein, 9 aa, Homo Sapiens
TCISGFTEK

SEQ ID NO: 674910 - protein, 9 aa, Homo Sapiens
SYLPFQLLA

SEQ ID NO: 674911 - protein, 9 aa, Homo Sapiens
TLFQSRSSS

SEQ ID NO: 674912 - protein, 9 aa, Homo Sapiens
HRTATIIEE

SEQ ID NO: 674913 - protein, 9 aa, Homo Sapiens
SFKKPLESK

SEQ ID NO: 674914 - protein, 9 aa, Homo Sapiens
MQKWWKGPN

SEQ ID NO: 674915 - protein, 9 aa, Homo Sapiens
CNCQLLGLK

SEQ ID NO: 674916 - protein, 9 aa, Homo Sapiens
STASEKEHL

SEQ ID NO: 674917 - protein, 9 aa, Homo Sapiens
IVVLLAIIQ

SEQ ID NO: 674918 - protein, 9 aa, Homo Sapiens
APVGTSMTQ

SEQ ID NO: 674919 - protein, 9 aa, Homo Sapiens
LTRNGFYLS

SEQ ID NO: 674920 - protein, 9 aa, Homo Sapiens
VQRGDIVSL

SEQ ID NO: 674921 - protein, 9 aa, Homo Sapiens
WRALVHLKT

SEQ ID NO: 674922 - protein, 9 aa, Homo Sapiens
KQVEDEKNT

SEQ ID NO: 674923 - protein, 9 aa, Homo Sapiens
FYQTLLARP

SEQ ID NO: 674924 - protein, 9 aa, Homo Sapiens
KAVADRIGI

SEQ ID NO: 674925 - protein, 9 aa, Homo Sapiens
LWLEPAQQI

SEQ ID NO: 674926 - protein, 9 aa, Homo Sapiens
ATITEFVIG

SEQ ID NO: 674927 - protein, 9 aa, Homo Sapiens
ELRRGTDAA

SEQ ID NO: 674928 - protein, 9 aa, Homo Sapiens
PGSTMNMGS

SEQ ID NO: 674929 - protein, 9 aa, Homo Sapiens
GTRKASFLW

SEQ ID NO: 674930 - protein, 9 aa, Homo Sapiens
MQPSNHYAL

SEQ ID NO: 674931 - protein, 9 aa, Homo Sapiens
FQLLASGMK

SEQ ID NO: 674932 - protein, 9 aa, Homo Sapiens
PIMFESWLF

SEQ ID NO: 674933 - protein, 9 aa, Homo Sapiens
IAEPLHLPP

SEQ ID NO: 674934 - protein, 9 aa, Homo Sapiens
SVLQAKPLL

SEQ ID NO: 674935 - protein, 9 aa, Homo Sapiens
ISPFRFAKE

SEQ ID NO: 674936 - protein, 9 aa, Homo Sapiens
IGKRMRPNS

SEQ ID NO: 674937 - protein, 9 aa, Homo Sapiens
MSSLVELGR

SEQ ID NO: 674938 - protein, 9 aa, Homo Sapiens
VLTPLPNPV

SEQ ID NO: 674939 - protein, 9 aa, Homo Sapiens
LLPRRAAEP

SEQ ID NO: 674940 - protein, 9 aa, Homo Sapiens
NVSESNGEF

SEQ ID NO: 674941 - protein, 9 aa, Homo Sapiens
KPREPCTPS

SEQ ID NO: 674942 - protein, 9 aa, Homo Sapiens
LNLSFGLSF

SEQ ID NO: 674943 - protein, 9 aa, Homo Sapiens
YHIQACTTT

SEQ ID NO: 674944 - protein, 9 aa, Homo Sapiens
KKLKRPRRP

SEQ ID NO: 674945 - protein, 9 aa, Homo Sapiens
QIPHAHQHR

SEQ ID NO: 674946 - protein, 9 aa, Homo Sapiens
TNLLRPKIC

SEQ ID NO: 674947 - protein, 9 aa, Homo Sapiens
VAFLIPYAI

SEQ ID NO: 674948 - protein, 9 aa, Homo Sapiens
LHSFCKFQL

SEQ ID NO: 674949 - protein, 9 aa, Homo Sapiens
NGNPIYKYF

SEQ ID NO: 674950 - protein, 9 aa, Homo Sapiens
VEDEKNTFR

SEQ ID NO: 674951 - protein, 9 aa, Homo Sapiens
GLEQRHGTQ

SEQ ID NO: 674952 - protein, 9 aa, Homo Sapiens
EVVSENSHT

SEQ ID NO: 674953 - protein, 9 aa, Homo Sapiens
ASRGYVVRK

SEQ ID NO: 674954 - protein, 9 aa, Homo Sapiens
VSFLISLDS

SEQ ID NO: 674955 - protein, 9 aa, Homo Sapiens
APEQRLRVI

SEQ ID NO: 674956 - protein, 9 aa, Homo Sapiens
RYEIKNSVV

SEQ ID NO: 674957 - protein, 9 aa, Homo Sapiens
FRATIRLPE

SEQ ID NO: 674958 - protein, 9 aa, Homo Sapiens
AHSADGLTA

SEQ ID NO: 674959 - protein, 9 aa, Homo Sapiens
KSQKENVQQ

SEQ ID NO: 674960 - protein, 9 aa, Homo Sapiens
KQAGHQDKD

SEQ ID NO: 674961 - protein, 9 aa, Homo Sapiens
LDSIIQFVL

SEQ ID NO: 674962 - protein, 9 aa, Homo Sapiens
IQLNLDYLV

SEQ ID NO: 674963 - protein, 9 aa, Homo Sapiens
TSWCYQWKF

SEQ ID NO: 674964 - protein, 9 aa, Homo Sapiens
LFCKVRYSQ

SEQ ID NO: 674965 - protein, 9 aa, Homo Sapiens
ENKTCEIVD

SEQ ID NO: 674966 - protein, 9 aa, Homo Sapiens
IVGDAFGWG

SEQ ID NO: 674967 - protein, 9 aa, Homo Sapiens
WKSRTKYTF

SEQ ID NO: 674968 - protein, 9 aa, Homo Sapiens
CPVLKQMYI

SEQ ID NO: 674969 - protein, 9 aa, Homo Sapiens
WVWPSKQAG

SEQ ID NO: 674970 - protein, 9 aa, Homo Sapiens
LVGISKSKV

SEQ ID NO: 674971 - protein, 9 aa, Homo Sapiens
NPSRSQDSC

SEQ ID NO: 674972 - protein, 9 aa, Homo Sapiens
SGHTNNVFK

SEQ ID NO: 674973 - protein, 9 aa, Homo Sapiens
PPLEAADTQ

SEQ ID NO: 674974 - protein, 9 aa, Homo Sapiens
FKRATNSSW

SEQ ID NO: 674975 - protein, 9 aa, Homo Sapiens
WIKELNIRP

SEQ ID NO: 674976 - protein, 9 aa, Homo Sapiens
SLLLQASRG

SEQ ID NO: 674977 - protein, 9 aa, Homo Sapiens
IVCADVWIL

SEQ ID NO: 674978 - protein, 9 aa, Homo Sapiens
GSTCAHSAD

SEQ ID NO: 674979 - protein, 9 aa, Homo Sapiens
YVDSFVRTL

SEQ ID NO: 674980 - protein, 9 aa, Homo Sapiens
MCWKEGSGL

SEQ ID NO: 674981 - protein, 9 aa, Homo Sapiens
KLSLPESLK

SEQ ID NO: 674982 - protein, 9 aa, Homo Sapiens
RKTHIIILA

SEQ ID NO: 674983 - protein, 9 aa, Homo Sapiens
RPVGLWNLS

SEQ ID NO: 674984 - protein, 9 aa, Homo Sapiens
TLHIIMGHL

SEQ ID NO: 674985 - protein, 9 aa, Homo Sapiens
KTQMMSDGT

SEQ ID NO: 674986 - protein, 9 aa, Homo Sapiens
RLKCASSSM

SEQ ID NO: 674987 - protein, 9 aa, Homo Sapiens
QRGDIVSLV

SEQ ID NO: 674988 - protein, 9 aa, Homo Sapiens
PRTSISPLN

SEQ ID NO: 674989 - protein, 9 aa, Homo Sapiens
KNSTVDSNG

SEQ ID NO: 674990 - protein, 9 aa, Homo Sapiens
SICFLKPTA

SEQ ID NO: 674991 - protein, 9 aa, Homo Sapiens
MTASSSPSI

SEQ ID NO: 674992 - protein, 9 aa, Homo Sapiens
ILYSSLLDE

SEQ ID NO: 674993 - protein, 9 aa, Homo Sapiens
NLSRNGSVP

SEQ ID NO: 674994 - protein, 9 aa, Homo Sapiens
WVSFLISLD

SEQ ID NO: 674995 - protein, 9 aa, Homo Sapiens
LKVLLEPPS

SEQ ID NO: 674996 - protein, 9 aa, Homo Sapiens
DWRFARSDK

SEQ ID NO: 674997 - protein, 9 aa, Homo Sapiens
EIPSVFPRT

SEQ ID NO: 674998 - protein, 9 aa, Homo Sapiens
VLGTCKEIF

SEQ ID NO: 674999 - protein, 9 aa, Homo Sapiens
TIMFEVQDL

SEQ ID NO: 675000 - protein, 9 aa, Homo Sapiens
YLVNDVVSL

SEQ ID NO: 675001 - protein, 9 aa, Homo Sapiens
FHIELCREG

SEQ ID NO: 675002 - protein, 9 aa, Homo Sapiens
CQLVRCACK

SEQ ID NO: 675003 - protein, 9 aa, Homo Sapiens
ADVERDWEG

SEQ ID NO: 675004 - protein, 9 aa, Homo Sapiens
VDNDSTTSV

SEQ ID NO: 675005 - protein, 9 aa, Homo Sapiens
FPQHHLLPL

SEQ ID NO: 675006 - protein, 9 aa, Homo Sapiens
SCQALPWGP

SEQ ID NO: 675007 - protein, 9 aa, Homo Sapiens
EGLFGHSST

SEQ ID NO: 675008 - protein, 9 aa, Homo Sapiens
DWAKYFKGN

SEQ ID NO: 675009 - protein, 9 aa, Homo Sapiens
RLIYSSYLT

SEQ ID NO: 675010 - protein, 9 aa, Homo Sapiens
LWNLSRNGS

SEQ ID NO: 675011 - protein, 9 aa, Homo Sapiens
NNVSESNGE

SEQ ID NO: 675012 - protein, 9 aa, Homo Sapiens
KRCGLEHRV

SEQ ID NO: 675013 - protein, 9 aa, Homo Sapiens
YTFTPVKMR

SEQ ID NO: 675014 - protein, 9 aa, Homo Sapiens
HCWAGTGKN

SEQ ID NO: 675015 - protein, 9 aa, Homo Sapiens
STPQRSLRY

SEQ ID NO: 675016 - protein, 9 aa, Homo Sapiens
HQGSKRARE

SEQ ID NO: 675017 - protein, 9 aa, Homo Sapiens
SNRTREVVK

SEQ ID NO: 675018 - protein, 9 aa, Homo Sapiens
ETCARCCTR

SEQ ID NO: 675019 - protein, 9 aa, Homo Sapiens
VQEMMEEKE

SEQ ID NO: 675020 - protein, 9 aa, Homo Sapiens
WKGVPSQLH

SEQ ID NO: 675021 - protein, 9 aa, Homo Sapiens
PSIFSSDRP

SEQ ID NO: 675022 - protein, 9 aa, Homo Sapiens
KPRPGMSSL

SEQ ID NO: 675023 - protein, 9 aa, Homo Sapiens
RPGTLGPPP

SEQ ID NO: 675024 - protein, 9 aa, Homo Sapiens
VRRADSAAV

SEQ ID NO: 675025 - protein, 9 aa, Homo Sapiens
NGDAKAFWM

SEQ ID NO: 675026 - protein, 9 aa, Homo Sapiens
AVLLEVTDG

SEQ ID NO: 675027 - protein, 9 aa, Homo Sapiens
RQRQLMHEG

SEQ ID NO: 675028 - protein, 9 aa, Homo Sapiens
QVEDEKNTF

SEQ ID NO: 675029 - protein, 9 aa, Homo Sapiens
KLPYLPDLW

SEQ ID NO: 675030 - protein, 9 aa, Homo Sapiens
LRLACTDTL

SEQ ID NO: 675031 - protein, 9 aa, Homo Sapiens
GTRKRLRNS

SEQ ID NO: 675032 - protein, 9 aa, Homo Sapiens
VKDVRQYLI

SEQ ID NO: 675033 - protein, 9 aa, Homo Sapiens
MVDEQKQLR

SEQ ID NO: 675034 - protein, 9 aa, Homo Sapiens
DSIISEVKA

SEQ ID NO: 675035 - protein, 9 aa, Homo Sapiens
FSTQPPLEA

SEQ ID NO: 675036 - protein, 9 aa, Homo Sapiens
SENSHTLYD

SEQ ID NO: 675037 - protein, 9 aa, Homo Sapiens
EPVKVSFGD

SEQ ID NO: 675038 - protein, 9 aa, Homo Sapiens
TLIKLSDYD

SEQ ID NO: 675039 - protein, 9 aa, Homo Sapiens
EEGKEDDEI

SEQ ID NO: 675040 - protein, 9 aa, Homo Sapiens
WKCNCQLLG

SEQ ID NO: 675041 - protein, 9 aa, Homo Sapiens
NLEMGLTQG

SEQ ID NO: 675042 - protein, 9 aa, Homo Sapiens
RKRLRNSWP

SEQ ID NO: 675043 - protein, 9 aa, Homo Sapiens
LQEFNARVS

SEQ ID NO: 675044 - protein, 9 aa, Homo Sapiens
VVKELVVSA

SEQ ID NO: 675045 - protein, 9 aa, Homo Sapiens
VGLWNLSRN

SEQ ID NO: 675046 - protein, 9 aa, Homo Sapiens
RLACTDTLA

SEQ ID NO: 675047 - protein, 9 aa, Homo Sapiens
ALLFKAVAD

SEQ ID NO: 675048 - protein, 9 aa, Homo Sapiens
KHKEITSQS

SEQ ID NO: 675049 - protein, 9 aa, Homo Sapiens
FFLLLLELQ

SEQ ID NO: 675050 - protein, 9 aa, Homo Sapiens
HLARNQNGE

SEQ ID NO: 675051 - protein, 9 aa, Homo Sapiens
FSNSNRTRE

SEQ ID NO: 675052 - protein, 9 aa, Homo Sapiens
SPGQQSVLK

SEQ ID NO: 675053 - protein, 9 aa, Homo Sapiens
PSTAEHIEP

SEQ ID NO: 675054 - protein, 9 aa, Homo Sapiens
SLPQHLKQF

SEQ ID NO: 675055 - protein, 9 aa, Homo Sapiens
SRTKYTFTP

SEQ ID NO: 675056 - protein, 9 aa, Homo Sapiens
NMAMTGGSD

SEQ ID NO: 675057 - protein, 9 aa, Homo Sapiens
VKPRPCFHA

SEQ ID NO: 675058 - protein, 9 aa, Homo Sapiens
THIIILATT

SEQ ID NO: 675059 - protein, 9 aa, Homo Sapiens
AARESIAAM

SEQ ID NO: 675060 - protein, 9 aa, Homo Sapiens
IMFEVQDLA

SEQ ID NO: 675061 - protein, 9 aa, Homo Sapiens
LAALLLLLC

SEQ ID NO: 675062 - protein, 9 aa, Homo Sapiens
LDEVKMHLS

SEQ ID NO: 675063 - protein, 9 aa, Homo Sapiens
CQLLGLKLW

SEQ ID NO: 675064 - protein, 9 aa, Homo Sapiens
AQPAPPGPR

SEQ ID NO: 675065 - protein, 9 aa, Homo Sapiens
KQEKMKIDC

SEQ ID NO: 675066 - protein, 9 aa, Homo Sapiens
YFFLNLGRR

SEQ ID NO: 675067 - protein, 9 aa, Homo Sapiens
SLAVLLEVT

SEQ ID NO: 675068 - protein, 9 aa, Homo Sapiens
LLCVQVQQF

SEQ ID NO: 675069 - protein, 9 aa, Homo Sapiens
TRKRLRNSW

SEQ ID NO: 675070 - protein, 9 aa, Homo Sapiens
RASPTLFQS

SEQ ID NO: 675071 - protein, 9 aa, Homo Sapiens
LMLPFSPLW

SEQ ID NO: 675072 - protein, 9 aa, Homo Sapiens
LSDGPACKG

SEQ ID NO: 675073 - protein, 9 aa, Homo Sapiens
SMKKLWRDF

SEQ ID NO: 675074 - protein, 9 aa, Homo Sapiens
AVQKLAQRV

SEQ ID NO: 675075 - protein, 9 aa, Homo Sapiens
FLFCKVRYS

SEQ ID NO: 675076 - protein, 9 aa, Homo Sapiens
QNTSLSGTA

SEQ ID NO: 675077 - protein, 9 aa, Homo Sapiens
NLTTSKSRS

SEQ ID NO: 675078 - protein, 9 aa, Homo Sapiens
FLPVSASLP

SEQ ID NO: 675079 - protein, 9 aa, Homo Sapiens
GGNTRKAWE

SEQ ID NO: 675080 - protein, 9 aa, Homo Sapiens
AKIEHNEEN

SEQ ID NO: 675081 - protein, 9 aa, Homo Sapiens
QSLPGFEDH

SEQ ID NO: 675082 - protein, 9 aa, Homo Sapiens
SLNDLDSGA

SEQ ID NO: 675083 - protein, 9 aa, Homo Sapiens
QRQHLSDAQ

SEQ ID NO: 675084 - protein, 9 aa, Homo Sapiens
SFGDSASLQ

SEQ ID NO: 675085 - protein, 9 aa, Homo Sapiens
FAGYSRNLV

SEQ ID NO: 675086 - protein, 9 aa, Homo Sapiens
SASFSNSNR

SEQ ID NO: 675087 - protein, 9 aa, Homo Sapiens
VSTAGEISG

SEQ ID NO: 675088 - protein, 9 aa, Homo Sapiens
LAQRVAMID

SEQ ID NO: 675089 - protein, 9 aa, Homo Sapiens
LKTLNGIHL

SEQ ID NO: 675090 - protein, 9 aa, Homo Sapiens
KPAKIEHNE

SEQ ID NO: 675091 - protein, 9 aa, Homo Sapiens
ATCEYHRRL

SEQ ID NO: 675092 - protein, 9 aa, Homo Sapiens
NSVVVNGDG

SEQ ID NO: 675093 - protein, 9 aa, Homo Sapiens
LLEGPEEEP

SEQ ID NO: 675094 - protein, 9 aa, Homo Sapiens
SAAVPIVNL

SEQ ID NO: 675095 - protein, 9 aa, Homo Sapiens
RLEILDKGL

SEQ ID NO: 675096 - protein, 9 aa, Homo Sapiens
DVLMTQVDH

SEQ ID NO: 675097 - protein, 9 aa, Homo Sapiens
ESIAAMVDE

SEQ ID NO: 675098 - protein, 9 aa, Homo Sapiens
TSIEYVTKR

SEQ ID NO: 675099 - protein, 9 aa, Homo Sapiens
HQGGWKGVP

SEQ ID NO: 675100 - protein, 9 aa, Homo Sapiens
GMTCASCLS

SEQ ID NO: 675101 - protein, 9 aa, Homo Sapiens
MHEGLFGHS

SEQ ID NO: 675102 - protein, 9 aa, Homo Sapiens
QALSHPVVQ

SEQ ID NO: 675103 - protein, 9 aa, Homo Sapiens
PVSASLPPT

SEQ ID NO: 675104 - protein, 9 aa, Homo Sapiens
SLPESLKAY

SEQ ID NO: 675105 - protein, 9 aa, Homo Sapiens
KNKCLQWPP

SEQ ID NO: 675106 - protein, 9 aa, Homo Sapiens
GCYCKNDAN

SEQ ID NO: 675107 - protein, 9 aa, Homo Sapiens
VQLRGRCHH

SEQ ID NO: 675108 - protein, 9 aa, Homo Sapiens
LKREAGSGY

SEQ ID NO: 675109 - protein, 9 aa, Homo Sapiens
YGRIIVSVV

SEQ ID NO: 675110 - protein, 9 aa, Homo Sapiens
SATSQTIEQ

SEQ ID NO: 675111 - protein, 9 aa, Homo Sapiens
YVAALRHSS

SEQ ID NO: 675112 - protein, 9 aa, Homo Sapiens
LAIMNNVSE

SEQ ID NO: 675113 - protein, 9 aa, Homo Sapiens
RTHSASALD

SEQ ID NO: 675114 - protein, 9 aa, Homo Sapiens
FAMGSDVQS

SEQ ID NO: 675115 - protein, 9 aa, Homo Sapiens
HKTNLNKHV

SEQ ID NO: 675116 - protein, 9 aa, Homo Sapiens
ILYTEKIVC

SEQ ID NO: 675117 - protein, 9 aa, Homo Sapiens
QRTHSASAL

SEQ ID NO: 675118 - protein, 9 aa, Homo Sapiens
IKLTEAMTI

SEQ ID NO: 675119 - protein, 9 aa, Homo Sapiens
QHRDSYLGV

SEQ ID NO: 675120 - protein, 9 aa, Homo Sapiens
KENKTCEIV

SEQ ID NO: 675121 - protein, 9 aa, Homo Sapiens
YGLKSKVTL

SEQ ID NO: 675122 - protein, 9 aa, Homo Sapiens
KRFKAKQCQ

SEQ ID NO: 675123 - protein, 9 aa, Homo Sapiens
PPLGGKECQ

SEQ ID NO: 675124 - protein, 9 aa, Homo Sapiens
QNPSRSQDS

SEQ ID NO: 675125 - protein, 9 aa, Homo Sapiens
FGKVALHDG

SEQ ID NO: 675126 - protein, 9 aa, Homo Sapiens
PFVENLSGF

SEQ ID NO: 675127 - protein, 9 aa, Homo Sapiens
PLAGRSPEA

SEQ ID NO: 675128 - protein, 9 aa, Homo Sapiens
TSSQGHLDL

SEQ ID NO: 675129 - protein, 9 aa, Homo Sapiens
LEPAQQIYH

SEQ ID NO: 675130 - protein, 9 aa, Homo Sapiens
PRPGMSSLV

SEQ ID NO: 675131 - protein, 9 aa, Homo Sapiens
QLFVGTMDL

SEQ ID NO: 675132 - protein, 9 aa, Homo Sapiens
STEMGLLEQ

SEQ ID NO: 675133 - protein, 9 aa, Homo Sapiens
SQFLLSALN

SEQ ID NO: 675134 - protein, 9 aa, Homo Sapiens
KKLWRDFVN

SEQ ID NO: 675135 - protein, 9 aa, Homo Sapiens
GPLLPRRAA

SEQ ID NO: 675136 - protein, 9 aa, Homo Sapiens
GDAFGWGFV

SEQ ID NO: 675137 - protein, 9 aa, Homo Sapiens
EDVDLLEDK

SEQ ID NO: 675138 - protein, 9 aa, Homo Sapiens
GPRGPLLPR

SEQ ID NO: 675139 - protein, 9 aa, Homo Sapiens
PLYFFLNLG

SEQ ID NO: 675140 - protein, 9 aa, Homo Sapiens
TTAGATEAR

SEQ ID NO: 675141 - protein, 9 aa, Homo Sapiens
PVPSFHIEL

SEQ ID NO: 675142 - protein, 9 aa, Homo Sapiens
FYCCSDGYS

SEQ ID NO: 675143 - protein, 9 aa, Homo Sapiens
KKPLESKGR

SEQ ID NO: 675144 - protein, 9 aa, Homo Sapiens
PQKIPLSKE

SEQ ID NO: 675145 - protein, 9 aa, Homo Sapiens
TKYTFTPVK

SEQ ID NO: 675146 - protein, 9 aa, Homo Sapiens
EVPDPGTAA

SEQ ID NO: 675147 - protein, 9 aa, Homo Sapiens
QDLQEQQRR

SEQ ID NO: 675148 - protein, 9 aa, Homo Sapiens
SGVYTVRFK

SEQ ID NO: 675149 - protein, 9 aa, Homo Sapiens
NDVVSLQCE

SEQ ID NO: 675150 - protein, 9 aa, Homo Sapiens
VTDPSSMRL

SEQ ID NO: 675151 - protein, 9 aa, Homo Sapiens
HLAFSMMIL

SEQ ID NO: 675152 - protein, 9 aa, Homo Sapiens
LWDFKKTVK

SEQ ID NO: 675153 - protein, 9 aa, Homo Sapiens
HFQRVTTVS

SEQ ID NO: 675154 - protein, 9 aa, Homo Sapiens
FLQAHNWQG

SEQ ID NO: 675155 - protein, 9 aa, Homo Sapiens
YHFIMANHE

SEQ ID NO: 675156 - protein, 9 aa, Homo Sapiens
AGGGPSTAE

SEQ ID NO: 675157 - protein, 9 aa, Homo Sapiens
LLSSNDVVD

SEQ ID NO: 675158 - protein, 9 aa, Homo Sapiens
QKDLNTCVF

SEQ ID NO: 675159 - protein, 9 aa, Homo Sapiens
NRPVGLWNL

SEQ ID NO: 675160 - protein, 9 aa, Homo Sapiens
VAGAPSGCY

SEQ ID NO: 675161 - protein, 9 aa, Homo Sapiens
EDDYNYYYN

SEQ ID NO: 675162 - protein, 9 aa, Homo Sapiens
TQHVQPAEP

SEQ ID NO: 675163 - protein, 9 aa, Homo Sapiens
IAQLYVFLW

SEQ ID NO: 675164 - protein, 9 aa, Homo Sapiens
MNMGSLERK

SEQ ID NO: 675165 - protein, 9 aa, Homo Sapiens
KYAYGTLGC

SEQ ID NO: 675166 - protein, 9 aa, Homo Sapiens
PRGPLLPRR

SEQ ID NO: 675167 - protein, 9 aa, Homo Sapiens
IVDSKPNSV

SEQ ID NO: 675168 - protein, 9 aa, Homo Sapiens
APPGPRGPL

SEQ ID NO: 675169 - protein, 9 aa, Homo Sapiens
NKNQHQTEN

SEQ ID NO: 675170 - protein, 9 aa, Homo Sapiens
TVTSILRQT

SEQ ID NO: 675171 - protein, 9 aa, Homo Sapiens
PQMADTLFK

SEQ ID NO: 675172 - protein, 9 aa, Homo Sapiens
GLRKLQKLK

SEQ ID NO: 675173 - protein, 9 aa, Homo Sapiens
GGVECMLLA

SEQ ID NO: 675174 - protein, 9 aa, Homo Sapiens
RQLMHEGLF

SEQ ID NO: 675175 - protein, 9 aa, Homo Sapiens
YLPFQLLAS

SEQ ID NO: 675176 - protein, 9 aa, Homo Sapiens
WPSKQAGHQ

SEQ ID NO: 675177 - protein, 9 aa, Homo Sapiens
FLQSAAATI

SEQ ID NO: 675178 - protein, 9 aa, Homo Sapiens
AVLMLPFSP

SEQ ID NO: 675179 - protein, 9 aa, Homo Sapiens
VATVTSILR

SEQ ID NO: 675180 - protein, 9 aa, Homo Sapiens
SVIPGEAEY

SEQ ID NO: 675181 - protein, 9 aa, Homo Sapiens
TKRNCNLTQ

SEQ ID NO: 675182 - protein, 9 aa, Homo Sapiens
PRRLDQRPE

SEQ ID NO: 675183 - protein, 9 aa, Homo Sapiens
SRNLEMGLT

SEQ ID NO: 675184 - protein, 9 aa, Homo Sapiens
LSPQRVYLC

SEQ ID NO: 675185 - protein, 9 aa, Homo Sapiens
YEIKNSVVV

SEQ ID NO: 675186 - protein, 9 aa, Homo Sapiens
ELLAIMNNV

SEQ ID NO: 675187 - protein, 9 aa, Homo Sapiens
PCFHAMPSE

SEQ ID NO: 675188 - protein, 9 aa, Homo Sapiens
MKDDGELPK

SEQ ID NO: 675189 - protein, 9 aa, Homo Sapiens
FEKLLSSND

SEQ ID NO: 675190 - protein, 9 aa, Homo Sapiens
TASTNEDAG

SEQ ID NO: 675191 - protein, 9 aa, Homo Sapiens
IEYVTKRNC

SEQ ID NO: 675192 - protein, 9 aa, Homo Sapiens
LDSSVQKTV

SEQ ID NO: 675193 - protein, 9 aa, Homo Sapiens
LGKNQAKFF

SEQ ID NO: 675194 - protein, 9 aa, Homo Sapiens
KCASSSMFL

SEQ ID NO: 675195 - protein, 9 aa, Homo Sapiens
ARPLRKSSL

SEQ ID NO: 675196 - protein, 9 aa, Homo Sapiens
LALWVWPSK

SEQ ID NO: 675197 - protein, 9 aa, Homo Sapiens
SLSWTLNSH

SEQ ID NO: 675198 - protein, 9 aa, Homo Sapiens
EYQKGPILM

SEQ ID NO: 675199 - protein, 9 aa, Homo Sapiens
LSFYQTGEI

SEQ ID NO: 675200 - protein, 9 aa, Homo Sapiens
AMLLSSVLQ

SEQ ID NO: 675201 - protein, 9 aa, Homo Sapiens
LWVWPSKQA

SEQ ID NO: 675202 - protein, 9 aa, Homo Sapiens
LALQDWYQT

SEQ ID NO: 675203 - protein, 9 aa, Homo Sapiens
KKLITVLKT

SEQ ID NO: 675204 - protein, 9 aa, Homo Sapiens
AAAAPGAGA

SEQ ID NO: 675205 - protein, 9 aa, Homo Sapiens
REPCTPSKS

SEQ ID NO: 675206 - protein, 9 aa, Homo Sapiens
EITSQSDAS

SEQ ID NO: 675207 - protein, 9 aa, Homo Sapiens
YHRRLHGRA

SEQ ID NO: 675208 - protein, 9 aa, Homo Sapiens
EHRVYLVEE

SEQ ID NO: 675209 - protein, 9 aa, Homo Sapiens
NLWKCNCQL

SEQ ID NO: 675210 - protein, 9 aa, Homo Sapiens
YEAYKPCTG

SEQ ID NO: 675211 - protein, 9 aa, Homo Sapiens
AISHAIVRA

SEQ ID NO: 675212 - protein, 9 aa, Homo Sapiens
YQIITQING

SEQ ID NO: 675213 - protein, 9 aa, Homo Sapiens
QEIPSVFPR

SEQ ID NO: 675214 - protein, 9 aa, Homo Sapiens
RKLQKLKVL

SEQ ID NO: 675215 - protein, 9 aa, Homo Sapiens
TLSLHCWAG

SEQ ID NO: 675216 - protein, 9 aa, Homo Sapiens
FANNQSPAA

SEQ ID NO: 675217 - protein, 9 aa, Homo Sapiens
HLQLVDVCT

SEQ ID NO: 675218 - protein, 9 aa, Homo Sapiens
GEYSMSSRT

SEQ ID NO: 675219 - protein, 9 aa, Homo Sapiens
SRNGSVPRA

SEQ ID NO: 675220 - protein, 9 aa, Homo Sapiens
APKILEDTG

SEQ ID NO: 675221 - protein, 9 aa, Homo Sapiens
TIHYYDQIT

SEQ ID NO: 675222 - protein, 9 aa, Homo Sapiens
TPPHQPQQQ

SEQ ID NO: 675223 - protein, 9 aa, Homo Sapiens
AFYCCSDGY

SEQ ID NO: 675224 - protein, 9 aa, Homo Sapiens
PMVPPHSSL

SEQ ID NO: 675225 - protein, 9 aa, Homo Sapiens
AGSGYRCVA

SEQ ID NO: 675226 - protein, 9 aa, Homo Sapiens
STSIEYVTK

SEQ ID NO: 675227 - protein, 9 aa, Homo Sapiens
QPLLAKQYF

SEQ ID NO: 675228 - protein, 9 aa, Homo Sapiens
RAEAEYIAS

SEQ ID NO: 675229 - protein, 9 aa, Homo Sapiens
DKLTRHYRK

SEQ ID NO: 675230 - protein, 9 aa, Homo Sapiens
CPPRRLDQR

SEQ ID NO: 675231 - protein, 9 aa, Homo Sapiens
RCCTRPPRA

SEQ ID NO: 675232 - protein, 9 aa, Homo Sapiens
SSGDSVVSP

SEQ ID NO: 675233 - protein, 9 aa, Homo Sapiens
DGSFKKPLE

SEQ ID NO: 675234 - protein, 9 aa, Homo Sapiens
FYVPFFAAN

SEQ ID NO: 675235 - protein, 9 aa, Homo Sapiens
KNRFYAGGE

SEQ ID NO: 675236 - protein, 9 aa, Homo Sapiens
KILVLDSDK

SEQ ID NO: 675237 - protein, 9 aa, Homo Sapiens
VRTRLEILD

SEQ ID NO: 675238 - protein, 9 aa, Homo Sapiens
DMLAWLHQS

SEQ ID NO: 675239 - protein, 9 aa, Homo Sapiens
NNVFKAKFL

SEQ ID NO: 675240 - protein, 9 aa, Homo Sapiens
CFATQTEEL

SEQ ID NO: 675241 - protein, 9 aa, Homo Sapiens
LTIKDNGVG

SEQ ID NO: 675242 - protein, 9 aa, Homo Sapiens
ACGVGKSAL

SEQ ID NO: 675243 - protein, 9 aa, Homo Sapiens
CKCPGGYTG

SEQ ID NO: 675244 - protein, 9 aa, Homo Sapiens
HLPQLKRDH

SEQ ID NO: 675245 - protein, 9 aa, Homo Sapiens
EYSMSSRTL

SEQ ID NO: 675246 - protein, 9 aa, Homo Sapiens
RTKYTFTPV

SEQ ID NO: 675247 - protein, 9 aa, Homo Sapiens
FKGEREHWR

SEQ ID NO: 675248 - protein, 9 aa, Homo Sapiens
LLEELKQEV

SEQ ID NO: 675249 - protein, 9 aa, Homo Sapiens
RPARRADSG

SEQ ID NO: 675250 - protein, 9 aa, Homo Sapiens
KELNIRPKT

SEQ ID NO: 675251 - protein, 9 aa, Homo Sapiens
AVLLPLTFF

SEQ ID NO: 675252 - protein, 9 aa, Homo Sapiens
LYLGFCSCE

SEQ ID NO: 675253 - protein, 9 aa, Homo Sapiens
GRTGPPPPL

SEQ ID NO: 675254 - protein, 9 aa, Homo Sapiens
KRECQLVRC

SEQ ID NO: 675255 - protein, 9 aa, Homo Sapiens
GEAEYKVSS

SEQ ID NO: 675256 - protein, 9 aa, Homo Sapiens
CKKGASLLL

SEQ ID NO: 675257 - protein, 9 aa, Homo Sapiens
LHHAAENGQ

SEQ ID NO: 675258 - protein, 9 aa, Homo Sapiens
FARSDKLTR

SEQ ID NO: 675259 - protein, 9 aa, Homo Sapiens
VRAEWMRMR

SEQ ID NO: 675260 - protein, 9 aa, Homo Sapiens
FRFSIEHIS

SEQ ID NO: 675261 - protein, 9 aa, Homo Sapiens
LEHRVYLVE

SEQ ID NO: 675262 - protein, 9 aa, Homo Sapiens
LLITDESLK

SEQ ID NO: 675263 - protein, 9 aa, Homo Sapiens
LSLPESLKA

SEQ ID NO: 675264 - protein, 9 aa, Homo Sapiens
HSFCKFQLQ

SEQ ID NO: 675265 - protein, 9 aa, Homo Sapiens
GGYTGKYCE

SEQ ID NO: 675266 - protein, 9 aa, Homo Sapiens
EYFQNTSLS

SEQ ID NO: 675267 - protein, 9 aa, Homo Sapiens
LEILDKGLA

SEQ ID NO: 675268 - protein, 9 aa, Homo Sapiens
VVSENSHTL

SEQ ID NO: 675269 - protein, 9 aa, Homo Sapiens
GIGKRMRPN

SEQ ID NO: 675270 - protein, 9 aa, Homo Sapiens
ISMKKLWRD

SEQ ID NO: 675271 - protein, 9 aa, Homo Sapiens
GWRALVHLK

SEQ ID NO: 675272 - protein, 9 aa, Homo Sapiens
IILATTRSG

SEQ ID NO: 675273 - protein, 9 aa, Homo Sapiens
PDLWLEPAQ

SEQ ID NO: 675274 - protein, 9 aa, Homo Sapiens
NLNKHVRIH

SEQ ID NO: 675275 - protein, 9 aa, Homo Sapiens
LNCKTSQFL

SEQ ID NO: 675276 - protein, 9 aa, Homo Sapiens
QAALRIMEL

SEQ ID NO: 675277 - protein, 9 aa, Homo Sapiens
NSPQEPRNM

SEQ ID NO: 675278 - protein, 9 aa, Homo Sapiens
TGLYLTNLN

SEQ ID NO: 675279 - protein, 9 aa, Homo Sapiens
SRGVAHWVQ

SEQ ID NO: 675280 - protein, 9 aa, Homo Sapiens
LLSSVLQAK

SEQ ID NO: 675281 - protein, 9 aa, Homo Sapiens
LLFRGCNDS

SEQ ID NO: 675282 - protein, 9 aa, Homo Sapiens
DHSLQPSIT

SEQ ID NO: 675283 - protein, 9 aa, Homo Sapiens
VRTLEDLTE

SEQ ID NO: 675284 - protein, 9 aa, Homo Sapiens
TVPGSTMNM

SEQ ID NO: 675285 - protein, 9 aa, Homo Sapiens
DHSLSWTLN

SEQ ID NO: 675286 - protein, 9 aa, Homo Sapiens
VKELVVSAG

SEQ ID NO: 675287 - protein, 9 aa, Homo Sapiens
RCPVPSFHI

SEQ ID NO: 675288 - protein, 9 aa, Homo Sapiens
EKLLSSNDV

SEQ ID NO: 675289 - protein, 9 aa, Homo Sapiens
WSISTGSFT

SEQ ID NO: 675290 - protein, 9 aa, Homo Sapiens
CAHSADGLT

SEQ ID NO: 675291 - protein, 9 aa, Homo Sapiens
HVQPAEPRD

SEQ ID NO: 675292 - protein, 9 aa, Homo Sapiens
RHLAVLSPQ

SEQ ID NO: 675293 - protein, 9 aa, Homo Sapiens
RQAALRIME

SEQ ID NO: 675294 - protein, 9 aa, Homo Sapiens
INPFHLSDV

SEQ ID NO: 675295 - protein, 9 aa, Homo Sapiens
AAAISHAIV

SEQ ID NO: 675296 - protein, 9 aa, Homo Sapiens
DRAVGGARS

SEQ ID NO: 675297 - protein, 9 aa, Homo Sapiens
QQELKNRPV

SEQ ID NO: 675298 - protein, 9 aa, Homo Sapiens
KQFLGHPHH

SEQ ID NO: 675299 - protein, 9 aa, Homo Sapiens
WSISWQKIN

SEQ ID NO: 675300 - protein, 9 aa, Homo Sapiens
GGVAFLIPY

SEQ ID NO: 675301 - protein, 9 aa, Homo Sapiens
SSHLFVKIQ

SEQ ID NO: 675302 - protein, 9 aa, Homo Sapiens
EAILAPDFE

SEQ ID NO: 675303 - protein, 9 aa, Homo Sapiens
VINDVSPPP

SEQ ID NO: 675304 - protein, 9 aa, Homo Sapiens
APSGCYCKN

SEQ ID NO: 675305 - protein, 9 aa, Homo Sapiens
GHFQRVTTV

SEQ ID NO: 675306 - protein, 9 aa, Homo Sapiens
QAMCWKEGS

SEQ ID NO: 675307 - protein, 9 aa, Homo Sapiens
WHGVPGQVN

SEQ ID NO: 675308 - protein, 9 aa, Homo Sapiens
EPLAGRSPE

SEQ ID NO: 675309 - protein, 9 aa, Homo Sapiens
TLLIEQLKW

SEQ ID NO: 675310 - protein, 9 aa, Homo Sapiens
FEVQRGDIV

SEQ ID NO: 675311 - protein, 9 aa, Homo Sapiens
RLRNSWPWK

SEQ ID NO: 675312 - protein, 9 aa, Homo Sapiens
FLVGIGGQD

SEQ ID NO: 675313 - protein, 9 aa, Homo Sapiens
AFWMELEDD

SEQ ID NO: 675314 - protein, 9 aa, Homo Sapiens
TSQSDASEI

SEQ ID NO: 675315 - protein, 9 aa, Homo Sapiens
PDPGTAASG

SEQ ID NO: 675316 - protein, 9 aa, Homo Sapiens
AISGVYTVR

SEQ ID NO: 675317 - protein, 9 aa, Homo Sapiens
ITCSPDALH

SEQ ID NO: 675318 - protein, 9 aa, Homo Sapiens
ETPSNTKWS

SEQ ID NO: 675319 - protein, 9 aa, Homo Sapiens
LWKCNCQLL

SEQ ID NO: 675320 - protein, 9 aa, Homo Sapiens
ALLLALLQG

SEQ ID NO: 675321 - protein, 9 aa, Homo Sapiens
ISKENQIRI

SEQ ID NO: 675322 - protein, 9 aa, Homo Sapiens
RQPPQPITC

SEQ ID NO: 675323 - protein, 9 aa, Homo Sapiens
RRAAEPLRG

SEQ ID NO: 675324 - protein, 9 aa, Homo Sapiens
FESDIVNII

SEQ ID NO: 675325 - protein, 9 aa, Homo Sapiens
LAGRSPEAT

SEQ ID NO: 675326 - protein, 9 aa, Homo Sapiens
NTCQLGSSI

SEQ ID NO: 675327 - protein, 9 aa, Homo Sapiens
EEEFNHRLV

SEQ ID NO: 675328 - protein, 9 aa, Homo Sapiens
RALDDAQAV

SEQ ID NO: 675329 - protein, 9 aa, Homo Sapiens
TEARPLRKS

SEQ ID NO: 675330 - protein, 9 aa, Homo Sapiens
LRPARRADS

SEQ ID NO: 675331 - protein, 9 aa, Homo Sapiens
KYFKGNKIH

SEQ ID NO: 675332 - protein, 9 aa, Homo Sapiens
LDGFLFCKV

SEQ ID NO: 675333 - protein, 9 aa, Homo Sapiens
ASFSNSNRT

SEQ ID NO: 675334 - protein, 9 aa, Homo Sapiens
RIIVSVVKM

SEQ ID NO: 675335 - protein, 9 aa, Homo Sapiens
FESWLFDLR

SEQ ID NO: 675336 - protein, 9 aa, Homo Sapiens
YRPTQLGRL

SEQ ID NO: 675337 - protein, 9 aa, Homo Sapiens
VVSLQCEPG

SEQ ID NO: 675338 - protein, 9 aa, Homo Sapiens
IVCVVPSEC

SEQ ID NO: 675339 - protein, 9 aa, Homo Sapiens
AALRHSSYA

SEQ ID NO: 675340 - protein, 9 aa, Homo Sapiens
RSARELSCK

SEQ ID NO: 675341 - protein, 9 aa, Homo Sapiens
PHILVDGVS

SEQ ID NO: 675342 - protein, 9 aa, Homo Sapiens
KAVLICHLE

SEQ ID NO: 675343 - protein, 9 aa, Homo Sapiens
ALRNWSNTP

SEQ ID NO: 675344 - protein, 9 aa, Homo Sapiens
IDEESQNGT

SEQ ID NO: 675345 - protein, 9 aa, Homo Sapiens
VGLLRHMQG

SEQ ID NO: 675346 - protein, 9 aa, Homo Sapiens
VQFIPTNTL

SEQ ID NO: 675347 - protein, 9 aa, Homo Sapiens
LVRSAIKDI

SEQ ID NO: 675348 - protein, 9 aa, Homo Sapiens
VPSFHIELC

SEQ ID NO: 675349 - protein, 9 aa, Homo Sapiens
QRPGTLGPP

SEQ ID NO: 675350 - protein, 9 aa, Homo Sapiens
ILYLGFCSC

SEQ ID NO: 675351 - protein, 9 aa, Homo Sapiens
EFVIGNEYY

SEQ ID NO: 675352 - protein, 9 aa, Homo Sapiens
EPLLEGPEE

SEQ ID NO: 675353 - protein, 9 aa, Homo Sapiens
GTASTNEDA

SEQ ID NO: 675354 - protein, 9 aa, Homo Sapiens
KGSFVPYRH

SEQ ID NO: 675355 - protein, 9 aa, Homo Sapiens
VLLPLTFFC

SEQ ID NO: 675356 - protein, 9 aa, Homo Sapiens
QCQNKFLSE

SEQ ID NO: 675357 - protein, 9 aa, Homo Sapiens
DLLSGVLTL

SEQ ID NO: 675358 - protein, 9 aa, Homo Sapiens
ESADTELAK

SEQ ID NO: 675359 - protein, 9 aa, Homo Sapiens
ARLKSWPRS

SEQ ID NO: 675360 - protein, 9 aa, Homo Sapiens
LCVFTWYRT

SEQ ID NO: 675361 - protein, 9 aa, Homo Sapiens
PQHHLLPLA

SEQ ID NO: 675362 - protein, 9 aa, Homo Sapiens
WKGPNVTVT

SEQ ID NO: 675363 - protein, 9 aa, Homo Sapiens
VKKLKRPRR

SEQ ID NO: 675364 - protein, 9 aa, Homo Sapiens
EFYEPVMTQ

SEQ ID NO: 675365 - protein, 9 aa, Homo Sapiens
WYQTVETAQ

SEQ ID NO: 675366 - protein, 9 aa, Homo Sapiens
GLGGVECML

SEQ ID NO: 675367 - protein, 9 aa, Homo Sapiens
FGSTCAHSA

SEQ ID NO: 675368 - protein, 9 aa, Homo Sapiens
KDLNTCVFN

SEQ ID NO: 675369 - protein, 9 aa, Homo Sapiens
SSREMPEPH

SEQ ID NO: 675370 - protein, 9 aa, Homo Sapiens
PTNTLNLRS

SEQ ID NO: 675371 - protein, 9 aa, Homo Sapiens
KTNLNKHVR

SEQ ID NO: 675372 - protein, 9 aa, Homo Sapiens
GATETSSQG

SEQ ID NO: 675373 - protein, 9 aa, Homo Sapiens
VMSSPPVRA

SEQ ID NO: 675374 - protein, 9 aa, Homo Sapiens
TCQASFDHS

SEQ ID NO: 675375 - protein, 9 aa, Homo Sapiens
MGTVTAIKL

SEQ ID NO: 675376 - protein, 9 aa, Homo Sapiens
LAYQKSRMQ

SEQ ID NO: 675377 - protein, 9 aa, Homo Sapiens
LDSHPFAPS

SEQ ID NO: 675378 - protein, 9 aa, Homo Sapiens
RLSFYQTGE

SEQ ID NO: 675379 - protein, 9 aa, Homo Sapiens
KKVRAEWMR

SEQ ID NO: 675380 - protein, 9 aa, Homo Sapiens
LTILLAYQK

SEQ ID NO: 675381 - protein, 9 aa, Homo Sapiens
AKQCQNKFL

SEQ ID NO: 675382 - protein, 9 aa, Homo Sapiens
ILVDGVSGG

SEQ ID NO: 675383 - protein, 9 aa, Homo Sapiens
YFKGNKIHG

SEQ ID NO: 675384 - protein, 9 aa, Homo Sapiens
TRFAYRIKW

SEQ ID NO: 675385 - protein, 9 aa, Homo Sapiens
AEPLHLPPR

SEQ ID NO: 675386 - protein, 9 aa, Homo Sapiens
ITRHFANNQ

SEQ ID NO: 675387 - protein, 9 aa, Homo Sapiens
CAVPSSVLL

SEQ ID NO: 675388 - protein, 9 aa, Homo Sapiens
GTAPGPGAC

SEQ ID NO: 675389 - protein, 9 aa, Homo Sapiens
KEIFNLFYM

SEQ ID NO: 675390 - protein, 9 aa, Homo Sapiens
LFGDIAFYC

SEQ ID NO: 675391 - protein, 9 aa, Homo Sapiens
NSCINYEAF

SEQ ID NO: 675392 - protein, 9 aa, Homo Sapiens
LPRRAAEPL

SEQ ID NO: 675393 - protein, 9 aa, Homo Sapiens
GSKNNAFCT

SEQ ID NO: 675394 - protein, 9 aa, Homo Sapiens
VVQRRLDIA

SEQ ID NO: 675395 - protein, 9 aa, Homo Sapiens
GNTRKAWEA

SEQ ID NO: 675396 - protein, 9 aa, Homo Sapiens
LCPDRHVQQ

SEQ ID NO: 675397 - protein, 9 aa, Homo Sapiens
SLAMHFRAT

SEQ ID NO: 675398 - protein, 9 aa, Homo Sapiens
SILQLSLQK

SEQ ID NO: 675399 - protein, 9 aa, Homo Sapiens
TQHHPGLIL

SEQ ID NO: 675400 - protein, 9 aa, Homo Sapiens
CHCLPGLAP

SEQ ID NO: 675401 - protein, 9 aa, Homo Sapiens
ASKLDIQRK

SEQ ID NO: 675402 - protein, 9 aa, Homo Sapiens
ATQFNRALF

SEQ ID NO: 675403 - protein, 9 aa, Homo Sapiens
KWWKGPNVT

SEQ ID NO: 675404 - protein, 9 aa, Homo Sapiens
SSNDVVDFF

SEQ ID NO: 675405 - protein, 9 aa, Homo Sapiens
TKPRMHEFH

SEQ ID NO: 675406 - protein, 9 aa, Homo Sapiens
KAQQELKNR

SEQ ID NO: 675407 - protein, 9 aa, Homo Sapiens
YPCTCISGF

SEQ ID NO: 675408 - protein, 9 aa, Homo Sapiens
GEREHWRSG

SEQ ID NO: 675409 - protein, 9 aa, Homo Sapiens
FPYPAATAS

SEQ ID NO: 675410 - protein, 9 aa, Homo Sapiens
RNGFYLSFQ

SEQ ID NO: 675411 - protein, 9 aa, Homo Sapiens
SAGGSGGNT

SEQ ID NO: 675412 - protein, 9 aa, Homo Sapiens
MRLKVKDVR

SEQ ID NO: 675413 - protein, 9 aa, Homo Sapiens
NWSNTPILV

SEQ ID NO: 675414 - protein, 9 aa, Homo Sapiens
VGTSMTQLH

SEQ ID NO: 675415 - protein, 9 aa, Homo Sapiens
FLCPVLKQM

SEQ ID NO: 675416 - protein, 9 aa, Homo Sapiens
LTSNPLVPP

SEQ ID NO: 675417 - protein, 9 aa, Homo Sapiens
YIACLMKMY

SEQ ID NO: 675418 - protein, 9 aa, Homo Sapiens
MLSPRGVHI

SEQ ID NO: 675419 - protein, 9 aa, Homo Sapiens
HIELCREGK

SEQ ID NO: 675420 - protein, 9 aa, Homo Sapiens
AQQELKNRP

SEQ ID NO: 675421 - protein, 9 aa, Homo Sapiens
LKQFLGHPH

SEQ ID NO: 675422 - protein, 9 aa, Homo Sapiens
RAARPEPWN

SEQ ID NO: 675423 - protein, 9 aa, Homo Sapiens
DNYYGAVNQ

SEQ ID NO: 675424 - protein, 9 aa, Homo Sapiens
KDNGVGYAF

SEQ ID NO: 675425 - protein, 9 aa, Homo Sapiens
KFFLVGIGG

SEQ ID NO: 675426 - protein, 9 aa, Homo Sapiens
LAWLHQSTA

SEQ ID NO: 675427 - protein, 9 aa, Homo Sapiens
PSSMRLSFS

SEQ ID NO: 675428 - protein, 9 aa, Homo Sapiens
LCFWTAGTA

SEQ ID NO: 675429 - protein, 9 aa, Homo Sapiens
YQTLLARPR

SEQ ID NO: 675430 - protein, 9 aa, Homo Sapiens
LSDVQHRCF

SEQ ID NO: 675431 - protein, 9 aa, Homo Sapiens
NKEKNTLKN

SEQ ID NO: 675432 - protein, 9 aa, Homo Sapiens
SATITEFVI

SEQ ID NO: 675433 - protein, 9 aa, Homo Sapiens
PSKQAGHQD

SEQ ID NO: 675434 - protein, 9 aa, Homo Sapiens
DTGPAPGTF

SEQ ID NO: 675435 - protein, 9 aa, Homo Sapiens
NCKTSQFLL

SEQ ID NO: 675436 - protein, 9 aa, Homo Sapiens
TNHERIGQD

SEQ ID NO: 675437 - protein, 9 aa, Homo Sapiens
TNLNKHVRI

SEQ ID NO: 675438 - protein, 9 aa, Homo Sapiens
RLLEPCWLI

SEQ ID NO: 675439 - protein, 9 aa, Homo Sapiens
CTGAMGDRL

SEQ ID NO: 675440 - protein, 9 aa, Homo Sapiens
ILAVLAPYL

SEQ ID NO: 675441 - protein, 9 aa, Homo Sapiens
EDSNSCINY

SEQ ID NO: 675442 - protein, 9 aa, Homo Sapiens
HRLAEKSFR

SEQ ID NO: 675443 - protein, 9 aa, Homo Sapiens
ARALYEELL

SEQ ID NO: 675444 - protein, 9 aa, Homo Sapiens
EGHFQRVTT

SEQ ID NO: 675445 - protein, 9 aa, Homo Sapiens
SNTKWSLLM

SEQ ID NO: 675446 - protein, 9 aa, Homo Sapiens
GSTGLGGPL

SEQ ID NO: 675447 - protein, 9 aa, Homo Sapiens
VECMLLAVM

SEQ ID NO: 675448 - protein, 9 aa, Homo Sapiens
LLHSFCKFQ

SEQ ID NO: 675449 - protein, 9 aa, Homo Sapiens
SPSIFSSDR

SEQ ID NO: 675450 - protein, 9 aa, Homo Sapiens
PYPTKSEKI

SEQ ID NO: 675451 - protein, 9 aa, Homo Sapiens
PEQALSHPV

SEQ ID NO: 675452 - protein, 9 aa, Homo Sapiens
DTLAIVMIQ

SEQ ID NO: 675453 - protein, 9 aa, Homo Sapiens
KEGHFQRVT

SEQ ID NO: 675454 - protein, 9 aa, Homo Sapiens
QTIHYYDQI

SEQ ID NO: 675455 - protein, 9 aa, Homo Sapiens
RGATETSSQ

SEQ ID NO: 675456 - protein, 9 aa, Homo Sapiens
QEFYEPVMT

SEQ ID NO: 675457 - protein, 9 aa, Homo Sapiens
AKVALMKQK

SEQ ID NO: 675458 - protein, 9 aa, Homo Sapiens
KSFRNLRKA

SEQ ID NO: 675459 - protein, 9 aa, Homo Sapiens
HLLPLADSS

SEQ ID NO: 675460 - protein, 9 aa, Homo Sapiens
RGTDAATLY

SEQ ID NO: 675461 - protein, 9 aa, Homo Sapiens
DTPVQFIPT

SEQ ID NO: 675462 - protein, 9 aa, Homo Sapiens
SCINYEAFV

SEQ ID NO: 675463 - protein, 9 aa, Homo Sapiens
PACKGPALL

SEQ ID NO: 675464 - protein, 9 aa, Homo Sapiens
VPSQLHLGL

SEQ ID NO: 675465 - protein, 9 aa, Homo Sapiens
PLHHAAENG

SEQ ID NO: 675466 - protein, 9 aa, Homo Sapiens
APYLQLEGH

SEQ ID NO: 675467 - protein, 9 aa, Homo Sapiens
KSRMQLFQK

SEQ ID NO: 675468 - protein, 9 aa, Homo Sapiens
TYSNGGVAF

SEQ ID NO: 675469 - protein, 9 aa, Homo Sapiens
GWKGVPSQL

SEQ ID NO: 675470 - protein, 9 aa, Homo Sapiens
GRADRISST

SEQ ID NO: 675471 - protein, 9 aa, Homo Sapiens
RFSVIYRQD

SEQ ID NO: 675472 - protein, 9 aa, Homo Sapiens
LEDAVVARA

SEQ ID NO: 675473 - protein, 9 aa, Homo Sapiens
AQRAQPAPP

SEQ ID NO: 675474 - protein, 9 aa, Homo Sapiens
KLTEAMTIM

SEQ ID NO: 675475 - protein, 9 aa, Homo Sapiens
QKQPCTPPH

SEQ ID NO: 675476 - protein, 9 aa, Homo Sapiens
LHWPGTAST

SEQ ID NO: 675477 - protein, 9 aa, Homo Sapiens
ALLLTTVSR

SEQ ID NO: 675478 - protein, 9 aa, Homo Sapiens
LNMLSPRGV

SEQ ID NO: 675479 - protein, 9 aa, Homo Sapiens
LRKLQKLKV

SEQ ID NO: 675480 - protein, 9 aa, Homo Sapiens
RMRMTWRKN

SEQ ID NO: 675481 - protein, 9 aa, Homo Sapiens
MHLSALETK

SEQ ID NO: 675482 - protein, 9 aa, Homo Sapiens
EQALSHPVV

SEQ ID NO: 675483 - protein, 9 aa, Homo Sapiens
FFFFVIVVL

SEQ ID NO: 675484 - protein, 9 aa, Homo Sapiens
AVQAVLLPL

SEQ ID NO: 675485 - protein, 9 aa, Homo Sapiens
FFLVGIGGQ

SEQ ID NO: 675486 - protein, 9 aa, Homo Sapiens
ESESSSFHY

SEQ ID NO: 675487 - protein, 9 aa, Homo Sapiens
SGGNTRKAW

SEQ ID NO: 675488 - protein, 9 aa, Homo Sapiens
TAEHIEPPT

SEQ ID NO: 675489 - protein, 9 aa, Homo Sapiens
MSYSKAYGE

SEQ ID NO: 675490 - protein, 9 aa, Homo Sapiens
KLKVLLEPP

SEQ ID NO: 675491 - protein, 9 aa, Homo Sapiens
HSEVFMIIG

SEQ ID NO: 675492 - protein, 9 aa, Homo Sapiens
YAVQKLAQR

SEQ ID NO: 675493 - protein, 9 aa, Homo Sapiens
PHSSLGHQV

SEQ ID NO: 675494 - protein, 9 aa, Homo Sapiens
GGWKGVPSQ

SEQ ID NO: 675495 - protein, 9 aa, Homo Sapiens
QACTTTPCM

SEQ ID NO: 675496 - protein, 9 aa, Homo Sapiens
IEQSSVWAK

SEQ ID NO: 675497 - protein, 9 aa, Homo Sapiens
PLLEGPEEE

SEQ ID NO: 675498 - protein, 9 aa, Homo Sapiens
ATVNHQKSF

SEQ ID NO: 675499 - protein, 9 aa, Homo Sapiens
VYTVRFKNE

SEQ ID NO: 675500 - protein, 9 aa, Homo Sapiens
LQLEGHRLP

SEQ ID NO: 675501 - protein, 9 aa, Homo Sapiens
VAQLTQHHP

SEQ ID NO: 675502 - protein, 9 aa, Homo Sapiens
LHCWAGTGK

SEQ ID NO: 675503 - protein, 9 aa, Homo Sapiens
SKENQIRIR

SEQ ID NO: 675504 - protein, 9 aa, Homo Sapiens
RHVRAARPE

SEQ ID NO: 675505 - protein, 9 aa, Homo Sapiens
VLFRFSIEH

SEQ ID NO: 675506 - protein, 9 aa, Homo Sapiens
ILEDTGLYL

SEQ ID NO: 675507 - protein, 9 aa, Homo Sapiens
RRLDQRPES

SEQ ID NO: 675508 - protein, 9 aa, Homo Sapiens
HTNNVFKAK

SEQ ID NO: 675509 - protein, 9 aa, Homo Sapiens
NCQLLGLKL

SEQ ID NO: 675510 - protein, 9 aa, Homo Sapiens
SRYKKAVFT

SEQ ID NO: 675511 - protein, 9 aa, Homo Sapiens
DTFLCPVLK

SEQ ID NO: 675512 - protein, 9 aa, Homo Sapiens
TSMTQLHAT

SEQ ID NO: 675513 - protein, 9 aa, Homo Sapiens
LSLCVFTWY

SEQ ID NO: 675514 - protein, 9 aa, Homo Sapiens
FTDEDATVN

SEQ ID NO: 675515 - protein, 9 aa, Homo Sapiens
MTQVDHILS

SEQ ID NO: 675516 - protein, 9 aa, Homo Sapiens
TETSSQGHL

SEQ ID NO: 675517 - protein, 9 aa, Homo Sapiens
SKSKVDKHS

SEQ ID NO: 675518 - protein, 9 aa, Homo Sapiens
REVPDPGTA

SEQ ID NO: 675519 - protein, 9 aa, Homo Sapiens
GACGVGKSA

SEQ ID NO: 675520 - protein, 9 aa, Homo Sapiens
KKQTIHYYD

SEQ ID NO: 675521 - protein, 9 aa, Homo Sapiens
KTRFAYRIK

SEQ ID NO: 675522 - protein, 9 aa, Homo Sapiens
VQQQIRPIK

SEQ ID NO: 675523 - protein, 9 aa, Homo Sapiens
GPILMEGLT

SEQ ID NO: 675524 - protein, 9 aa, Homo Sapiens
DLEPLAGRS

SEQ ID NO: 675525 - protein, 9 aa, Homo Sapiens
AHRLAEKSF

SEQ ID NO: 675526 - protein, 9 aa, Homo Sapiens
RLPSLFQIP

SEQ ID NO: 675527 - protein, 9 aa, Homo Sapiens
PSRFIESAD

SEQ ID NO: 675528 - protein, 9 aa, Homo Sapiens
KVDKHSPKV

SEQ ID NO: 675529 - protein, 9 aa, Homo Sapiens
IQDPKILQM

SEQ ID NO: 675530 - protein, 9 aa, Homo Sapiens
AVPSSVLLL

SEQ ID NO: 675531 - protein, 9 aa, Homo Sapiens
HEGLFGHSS

SEQ ID NO: 675532 - protein, 9 aa, Homo Sapiens
QHIMGTVTA

SEQ ID NO: 675533 - protein, 9 aa, Homo Sapiens
VTSWCYQWK

SEQ ID NO: 675534 - protein, 9 aa, Homo Sapiens
VDSKPNSVR

SEQ ID NO: 675535 - protein, 9 aa, Homo Sapiens
TCAHSADGL

SEQ ID NO: 675536 - protein, 9 aa, Homo Sapiens
HTACAHCSG

SEQ ID NO: 675537 - protein, 9 aa, Homo Sapiens
LHLGLCPDR

SEQ ID NO: 675538 - protein, 9 aa, Homo Sapiens
KQTIHYYDQ

SEQ ID NO: 675539 - protein, 9 aa, Homo Sapiens
ICTMKNDHM

SEQ ID NO: 675540 - protein, 9 aa, Homo Sapiens
TLSRNLEMG

SEQ ID NO: 675541 - protein, 9 aa, Homo Sapiens
IACLMKMYF

SEQ ID NO: 675542 - protein, 9 aa, Homo Sapiens
QLLGLKLWL

SEQ ID NO: 675543 - protein, 9 aa, Homo Sapiens
ISEVKAQYE

SEQ ID NO: 675544 - protein, 9 aa, Homo Sapiens
LLARPRRAR

SEQ ID NO: 675545 - protein, 9 aa, Homo Sapiens
FWTAGTAAA

SEQ ID NO: 675546 - protein, 9 aa, Homo Sapiens
GSRMLQAMC

SEQ ID NO: 675547 - protein, 9 aa, Homo Sapiens
KLLSSNDVV

SEQ ID NO: 675548 - protein, 9 aa, Homo Sapiens
NSLPQHLKQ

SEQ ID NO: 675549 - protein, 9 aa, Homo Sapiens
NSVRQRPIA

SEQ ID NO: 675550 - protein, 9 aa, Homo Sapiens
SGLLEELKQ

SEQ ID NO: 675551 - protein, 9 aa, Homo Sapiens
EQLKWILTI

SEQ ID NO: 675552 - protein, 9 aa, Homo Sapiens
YESLAVLLE

SEQ ID NO: 675553 - protein, 9 aa, Homo Sapiens
AIVRACTSG

SEQ ID NO: 675554 - protein, 9 aa, Homo Sapiens
NGGVAFLIP

SEQ ID NO: 675555 - protein, 9 aa, Homo Sapiens
LMKMYFFIL

SEQ ID NO: 675556 - protein, 9 aa, Homo Sapiens
LVELGRQPG

SEQ ID NO: 675557 - protein, 9 aa, Homo Sapiens
ALHDGTQIN

SEQ ID NO: 675558 - protein, 9 aa, Homo Sapiens
AGAPSGCYC

SEQ ID NO: 675559 - protein, 9 aa, Homo Sapiens
NAFGSKNNA

SEQ ID NO: 675560 - protein, 9 aa, Homo Sapiens
DLDSSVQKT

SEQ ID NO: 675561 - protein, 9 aa, Homo Sapiens
QRSLRYSDG

SEQ ID NO: 675562 - protein, 9 aa, Homo Sapiens
YFQNTSLSG

SEQ ID NO: 675563 - protein, 9 aa, Homo Sapiens
SDEEKKVRA

SEQ ID NO: 675564 - protein, 9 aa, Homo Sapiens
SQAEIYQKN

SEQ ID NO: 675565 - protein, 9 aa, Homo Sapiens
LPGFEDHLK

SEQ ID NO: 675566 - protein, 9 aa, Homo Sapiens
TLAIVMIQV

SEQ ID NO: 675567 - protein, 9 aa, Homo Sapiens
TRPPRARPR

SEQ ID NO: 675568 - protein, 9 aa, Homo Sapiens
GLCPDRHVQ

SEQ ID NO: 675569 - protein, 9 aa, Homo Sapiens
MRMRMTWRK

SEQ ID NO: 675570 - protein, 9 aa, Homo Sapiens
ALWVWPSKQ

SEQ ID NO: 675571 - protein, 9 aa, Homo Sapiens
FQIPHAHQH

SEQ ID NO: 675572 - protein, 9 aa, Homo Sapiens
FGSPAVQAV

SEQ ID NO: 675573 - protein, 9 aa, Homo Sapiens
RLSTETLGK

SEQ ID NO: 675574 - protein, 9 aa, Homo Sapiens
WETPSNTKW

SEQ ID NO: 675575 - protein, 9 aa, Homo Sapiens
YSPELTAAR

SEQ ID NO: 675576 - protein, 9 aa, Homo Sapiens
CVFNNQENE

SEQ ID NO: 675577 - protein, 9 aa, Homo Sapiens
LRIMELSQE

SEQ ID NO: 675578 - protein, 9 aa, Homo Sapiens
TGPAPGTFQ

SEQ ID NO: 675579 - protein, 9 aa, Homo Sapiens
LLLCFVDYG

SEQ ID NO: 675580 - protein, 9 aa, Homo Sapiens
RYSDGEDGK

SEQ ID NO: 675581 - protein, 9 aa, Homo Sapiens
QGSATSQTI

SEQ ID NO: 675582 - protein, 9 aa, Homo Sapiens
VGISKSKVD

SEQ ID NO: 675583 - protein, 9 aa, Homo Sapiens
EDEKNTFRE

SEQ ID NO: 675584 - protein, 9 aa, Homo Sapiens
TDESLKALD

SEQ ID NO: 675585 - protein, 9 aa, Homo Sapiens
KREEQQRRR

SEQ ID NO: 675586 - protein, 9 aa, Homo Sapiens
QCFATQTEE

SEQ ID NO: 675587 - protein, 9 aa, Homo Sapiens
NNMQHIMGT

SEQ ID NO: 675588 - protein, 9 aa, Homo Sapiens
DWEGKCEEN

SEQ ID NO: 675589 - protein, 9 aa, Homo Sapiens
PLGGKECQP

SEQ ID NO: 675590 - protein, 9 aa, Homo Sapiens
EHWRSGRTI

SEQ ID NO: 675591 - protein, 9 aa, Homo Sapiens
MAGQEDSNS

SEQ ID NO: 675592 - protein, 9 aa, Homo Sapiens
CRPPGTRKR

SEQ ID NO: 675593 - protein, 9 aa, Homo Sapiens
RDRECEAAD

SEQ ID NO: 675594 - protein, 9 aa, Homo Sapiens
HSGLLEELK

SEQ ID NO: 675595 - protein, 9 aa, Homo Sapiens
RTSATITEF

SEQ ID NO: 675596 - protein, 9 aa, Homo Sapiens
ARELSCKKG

SEQ ID NO: 675597 - protein, 9 aa, Homo Sapiens
MVRMQPSNH

SEQ ID NO: 675598 - protein, 9 aa, Homo Sapiens
YNGRADRIS

SEQ ID NO: 675599 - protein, 9 aa, Homo Sapiens
YDNVKPRPC

SEQ ID NO: 675600 - protein, 9 aa, Homo Sapiens
IVSVVKMKS

SEQ ID NO: 675601 - protein, 9 aa, Homo Sapiens
SDIVNIISN

SEQ ID NO: 675602 - protein, 9 aa, Homo Sapiens
KCPGGYTGK

SEQ ID NO: 675603 - protein, 9 aa, Homo Sapiens
LLEKILVLD

SEQ ID NO: 675604 - protein, 9 aa, Homo Sapiens
SDVQSGTEM

SEQ ID NO: 675605 - protein, 9 aa, Homo Sapiens
EKMKIDCHK

SEQ ID NO: 675606 - protein, 9 aa, Homo Sapiens
KQCQNKFLS

SEQ ID NO: 675607 - protein, 9 aa, Homo Sapiens
SAPYPVVKE

SEQ ID NO: 675608 - protein, 9 aa, Homo Sapiens
IKELNIRPK

SEQ ID NO: 675609 - protein, 9 aa, Homo Sapiens
YQTGEIPRK

SEQ ID NO: 675610 - protein, 9 aa, Homo Sapiens
AGQEDSNSC

SEQ ID NO: 675611 - protein, 9 aa, Homo Sapiens
MHFRATIRL

SEQ ID NO: 675612 - protein, 9 aa, Homo Sapiens
YQQQLDNSA

SEQ ID NO: 675613 - protein, 9 aa, Homo Sapiens
FVIVVLLAI

SEQ ID NO: 675614 - protein, 9 aa, Homo Sapiens
HLKTHPVSE

SEQ ID NO: 675615 - protein, 9 aa, Homo Sapiens
TSQTIEQSS

SEQ ID NO: 675616 - protein, 9 aa, Homo Sapiens
RPEPWNALL

SEQ ID NO: 675617 - protein, 9 aa, Homo Sapiens
CKGPALLHS

SEQ ID NO: 675618 - protein, 9 aa, Homo Sapiens
LLPLTFFCC

SEQ ID NO: 675619 - protein, 9 aa, Homo Sapiens
WILAVLAPY

SEQ ID NO: 675620 - protein, 9 aa, Homo Sapiens
DHILSQAPT

SEQ ID NO: 675621 - protein, 9 aa, Homo Sapiens
AHIYPLYFF

SEQ ID NO: 675622 - protein, 9 aa, Homo Sapiens
EAMTIMFEV

SEQ ID NO: 675623 - protein, 9 aa, Homo Sapiens
PPRGLWKAK

SEQ ID NO: 675624 - protein, 9 aa, Homo Sapiens
NPIYKYFYV

SEQ ID NO: 675625 - protein, 9 aa, Homo Sapiens
GGSGGNTRK

SEQ ID NO: 675626 - protein, 9 aa, Homo Sapiens
CLKTLNGIH

SEQ ID NO: 675627 - protein, 9 aa, Homo Sapiens
QMVRKILYL

SEQ ID NO: 675628 - protein, 9 aa, Homo Sapiens
RFAYRIKWR

SEQ ID NO: 675629 - protein, 9 aa, Homo Sapiens
PGPGLEQRH

SEQ ID NO: 675630 - protein, 9 aa, Homo Sapiens
SSSPSIFSS

SEQ ID NO: 675631 - protein, 9 aa, Homo Sapiens
LDQRPESPL

SEQ ID NO: 675632 - protein, 9 aa, Homo Sapiens
TSAPYPVVK

SEQ ID NO: 675633 - protein, 9 aa, Homo Sapiens
TCSPDALHT

SEQ ID NO: 675634 - protein, 9 aa, Homo Sapiens
YLSFQDYGA

SEQ ID NO: 675635 - protein, 9 aa, Homo Sapiens
DLLEDKDFL

SEQ ID NO: 675636 - protein, 9 aa, Homo Sapiens
SLCVFTWYR

SEQ ID NO: 675637 - protein, 9 aa, Homo Sapiens
GRGIGKRMR

SEQ ID NO: 675638 - protein, 9 aa, Homo Sapiens
VERDWEGKC

SEQ ID NO: 675639 - protein, 9 aa, Homo Sapiens
KVLAVDADS

SEQ ID NO: 675640 - protein, 9 aa, Homo Sapiens
DTEKPGTPI

SEQ ID NO: 675641 - protein, 9 aa, Homo Sapiens
AQRCHEYWK

SEQ ID NO: 675642 - protein, 9 aa, Homo Sapiens
RNHQGSKRA

SEQ ID NO: 675643 - protein, 9 aa, Homo Sapiens
EKDALLLHS

SEQ ID NO: 675644 - protein, 9 aa, Homo Sapiens
HRLPSLFQI

SEQ ID NO: 675645 - protein, 9 aa, Homo Sapiens
EVKMHLSAL

SEQ ID NO: 675646 - protein, 9 aa, Homo Sapiens
NAAMAGRIY

SEQ ID NO: 675647 - protein, 9 aa, Homo Sapiens
SLQKCWSIS

SEQ ID NO: 675648 - protein, 9 aa, Homo Sapiens
VVVGACGVG

SEQ ID NO: 675649 - protein, 9 aa, Homo Sapiens
LSSVLQAKP

SEQ ID NO: 675650 - protein, 9 aa, Homo Sapiens
DSLGLTIKD

SEQ ID NO: 675651 - protein, 9 aa, Homo Sapiens
KVQSLVAVK

SEQ ID NO: 675652 - protein, 9 aa, Homo Sapiens
AVLSPQRVY

SEQ ID NO: 675653 - protein, 9 aa, Homo Sapiens
RMQLFQKNT

SEQ ID NO: 675654 - protein, 9 aa, Homo Sapiens
LGVLLHGVA

SEQ ID NO: 675655 - protein, 9 aa, Homo Sapiens
EIFHPEKPD

SEQ ID NO: 675656 - protein, 9 aa, Homo Sapiens
WGVLVLDDA

SEQ ID NO: 675657 - protein, 9 aa, Homo Sapiens
PFAPSICFL

SEQ ID NO: 675658 - protein, 9 aa, Homo Sapiens
TAGATEARP

SEQ ID NO: 675659 - protein, 9 aa, Homo Sapiens
VQNSPQEPR

SEQ ID NO: 675660 - protein, 9 aa, Homo Sapiens
LKVKDVRQY

SEQ ID NO: 675661 - protein, 9 aa, Homo Sapiens
AWNWIQLNL

SEQ ID NO: 675662 - protein, 9 aa, Homo Sapiens
ALLQGVCAE

SEQ ID NO: 675663 - protein, 9 aa, Homo Sapiens
LQSAAATIN

SEQ ID NO: 675664 - protein, 9 aa, Homo Sapiens
TPQRSLRYS

SEQ ID NO: 675665 - protein, 9 aa, Homo Sapiens
VLSFLDASI

SEQ ID NO: 675666 - protein, 9 aa, Homo Sapiens
TELYVYNNM

SEQ ID NO: 675667 - protein, 9 aa, Homo Sapiens
TNNVFKAKF

SEQ ID NO: 675668 - protein, 9 aa, Homo Sapiens
ACPIMFESW

SEQ ID NO: 675669 - protein, 9 aa, Homo Sapiens
SKPNSVRQR

SEQ ID NO: 675670 - protein, 9 aa, Homo Sapiens
SLQCEPGYA

SEQ ID NO: 675671 - protein, 9 aa, Homo Sapiens
AHCSGNCCF

SEQ ID NO: 675672 - protein, 9 aa, Homo Sapiens
QAHNWQGLR

SEQ ID NO: 675673 - protein, 9 aa, Homo Sapiens
RFIESADTE

SEQ ID NO: 675674 - protein, 9 aa, Homo Sapiens
TSEGTWAWD

SEQ ID NO: 675675 - protein, 9 aa, Homo Sapiens
AVLICHLEH

SEQ ID NO: 675676 - protein, 9 aa, Homo Sapiens
AHWVQQQIR

SEQ ID NO: 675677 - protein, 9 aa, Homo Sapiens
GMSIYSDKS

SEQ ID NO: 675678 - protein, 9 aa, Homo Sapiens
TSLSGTANS

SEQ ID NO: 675679 - protein, 9 aa, Homo Sapiens
YALWQRKDI

SEQ ID NO: 675680 - protein, 9 aa, Homo Sapiens
RGCAVPSSV

SEQ ID NO: 675681 - protein, 9 aa, Homo Sapiens
MAMTGGSDP

SEQ ID NO: 675682 - protein, 9 aa, Homo Sapiens
KLDEHRTAT

SEQ ID NO: 675683 - protein, 9 aa, Homo Sapiens
RFAKEAASL

SEQ ID NO: 675684 - protein, 9 aa, Homo Sapiens
HLSDVQHRC

SEQ ID NO: 675685 - protein, 9 aa, Homo Sapiens
RTDSLKGQR

SEQ ID NO: 675686 - protein, 9 aa, Homo Sapiens
LMEEMIFNL

SEQ ID NO: 675687 - protein, 9 aa, Homo Sapiens
YPTKSEKIM

SEQ ID NO: 675688 - protein, 9 aa, Homo Sapiens
DKKMVRMQP

SEQ ID NO: 675689 - protein, 9 aa, Homo Sapiens
FSIEHISRI

SEQ ID NO: 675690 - protein, 9 aa, Homo Sapiens
KQPCTPPHQ

SEQ ID NO: 675691 - protein, 9 aa, Homo Sapiens
VNVINDVSP

SEQ ID NO: 675692 - protein, 9 aa, Homo Sapiens
IYSSYLTRT

SEQ ID NO: 675693 - protein, 9 aa, Homo Sapiens
LSRNLEMGL

SEQ ID NO: 675694 - protein, 9 aa, Homo Sapiens
RPPGTRKRL

SEQ ID NO: 675695 - protein, 9 aa, Homo Sapiens
SILNGLDKA

SEQ ID NO: 675696 - protein, 9 aa, Homo Sapiens
FSMDEPVQL

SEQ ID NO: 675697 - protein, 9 aa, Homo Sapiens
LDYLVNRYT

SEQ ID NO: 675698 - protein, 9 aa, Homo Sapiens
PTPVKPREP

SEQ ID NO: 675699 - protein, 9 aa, Homo Sapiens
SFLISLDSV

SEQ ID NO: 675700 - protein, 9 aa, Homo Sapiens
VNGRNHQGS

SEQ ID NO: 675701 - protein, 9 aa, Homo Sapiens
DPSSMRLSF

SEQ ID NO: 675702 - protein, 9 aa, Homo Sapiens
VRMQPSNHY

SEQ ID NO: 675703 - protein, 9 aa, Homo Sapiens
VKVSFGDSA

SEQ ID NO: 675704 - protein, 9 aa, Homo Sapiens
TSRQGPHIL

SEQ ID NO: 675705 - protein, 9 aa, Homo Sapiens
VLGLTTGMS

SEQ ID NO: 675706 - protein, 9 aa, Homo Sapiens
CQASFDHSL

SEQ ID NO: 675707 - protein, 9 aa, Homo Sapiens
VSYRPTQLG

SEQ ID NO: 675708 - protein, 9 aa, Homo Sapiens
EKILVLDSD

SEQ ID NO: 675709 - protein, 9 aa, Homo Sapiens
MKMYFFILF

SEQ ID NO: 675710 - protein, 9 aa, Homo Sapiens
KEHSSGDSV

SEQ ID NO: 675711 - protein, 9 aa, Homo Sapiens
EEVSKEGFQ

SEQ ID NO: 675712 - protein, 9 aa, Homo Sapiens
VADRIGIGC

SEQ ID NO: 675713 - protein, 9 aa, Homo Sapiens
ADSAAVPIV

SEQ ID NO: 675714 - protein, 9 aa, Homo Sapiens
LVAVKYEVI

SEQ ID NO: 675715 - protein, 9 aa, Homo Sapiens
EEEEGKEDD

SEQ ID NO: 675716 - protein, 9 aa, Homo Sapiens
KCWSISWQK

SEQ ID NO: 675717 - protein, 9 aa, Homo Sapiens
GQEYQIITQ

SEQ ID NO: 675718 - protein, 9 aa, Homo Sapiens
HNEENDHKV

SEQ ID NO: 675719 - protein, 9 aa, Homo Sapiens
ARSDKLTRH

SEQ ID NO: 675720 - protein, 9 aa, Homo Sapiens
EKLDEHRTA

SEQ ID NO: 675721 - protein, 9 aa, Homo Sapiens
PQLKRDHVV

SEQ ID NO: 675722 - protein, 9 aa, Homo Sapiens
PSVFPRTSI

SEQ ID NO: 675723 - protein, 9 aa, Homo Sapiens
GSFKKPLES

SEQ ID NO: 675724 - protein, 9 aa, Homo Sapiens
RSLRYSDGE

SEQ ID NO: 675725 - protein, 9 aa, Homo Sapiens
VLHVALRNW

SEQ ID NO: 675726 - protein, 9 aa, Homo Sapiens
HPLNLSFGL

SEQ ID NO: 675727 - protein, 9 aa, Homo Sapiens
MQGTCPVLS

SEQ ID NO: 675728 - protein, 9 aa, Homo Sapiens
EESQNGTIL

SEQ ID NO: 675729 - protein, 9 aa, Homo Sapiens
ATSAGGSGG

SEQ ID NO: 675730 - protein, 9 aa, Homo Sapiens
PPGPRGPLL

SEQ ID NO: 675731 - protein, 9 aa, Homo Sapiens
LKSTEVWAS

SEQ ID NO: 675732 - protein, 9 aa, Homo Sapiens
PGTASTNED

SEQ ID NO: 675733 - protein, 9 aa, Homo Sapiens
LDKKMVRMQ

SEQ ID NO: 675734 - protein, 9 aa, Homo Sapiens
RFKAKQCQN

SEQ ID NO: 675735 - protein, 9 aa, Homo Sapiens
AVKYEVIVT

SEQ ID NO: 675736 - protein, 9 aa, Homo Sapiens
FAKEAASLF

SEQ ID NO: 675737 - protein, 9 aa, Homo Sapiens
PDRHVQQHN

SEQ ID NO: 675738 - protein, 9 aa, Homo Sapiens
AILAPDFEI

SEQ ID NO: 675739 - protein, 9 aa, Homo Sapiens
GQGRLSTET

SEQ ID NO: 675740 - protein, 9 aa, Homo Sapiens
LKIAEPLHL

SEQ ID NO: 675741 - protein, 9 aa, Homo Sapiens
LVLFRFSIE

SEQ ID NO: 675742 - protein, 9 aa, Homo Sapiens
ANLQTSKPV

SEQ ID NO: 675743 - protein, 9 aa, Homo Sapiens
LAGVSRRVT

SEQ ID NO: 675744 - protein, 9 aa, Homo Sapiens
DAEAILAPD

SEQ ID NO: 675745 - protein, 9 aa, Homo Sapiens
TGPPPPLGG

SEQ ID NO: 675746 - protein, 9 aa, Homo Sapiens
INDVSPPPL

SEQ ID NO: 675747 - protein, 9 aa, Homo Sapiens
GLLEELKQE

SEQ ID NO: 675748 - protein, 9 aa, Homo Sapiens
PVMTQSIPH

SEQ ID NO: 675749 - protein, 9 aa, Homo Sapiens
ELKNRPVGL

SEQ ID NO: 675750 - protein, 9 aa, Homo Sapiens
YSKTRFAYR

SEQ ID NO: 675751 - protein, 9 aa, Homo Sapiens
RSVKKLKRP

SEQ ID NO: 675752 - protein, 9 aa, Homo Sapiens
EAEYKVSSE

SEQ ID NO: 675753 - protein, 9 aa, Homo Sapiens
ASAAYRGAH

SEQ ID NO: 675754 - protein, 9 aa, Homo Sapiens
GPCCRQRLE

SEQ ID NO: 675755 - protein, 9 aa, Homo Sapiens
PTLFQSRSS

SEQ ID NO: 675756 - protein, 9 aa, Homo Sapiens
LLLLLCFVD

SEQ ID NO: 675757 - protein, 9 aa, Homo Sapiens
VPRARLKSW

SEQ ID NO: 675758 - protein, 9 aa, Homo Sapiens
LTPLPNPVV

SEQ ID NO: 675759 - protein, 9 aa, Homo Sapiens
AGHVVAKVL

SEQ ID NO: 675760 - protein, 9 aa, Homo Sapiens
EPRNMLLQN

SEQ ID NO: 675761 - protein, 9 aa, Homo Sapiens
QKIPLSKEL

SEQ ID NO: 675762 - protein, 9 aa, Homo Sapiens
PNIPVRSSS

SEQ ID NO: 675763 - protein, 9 aa, Homo Sapiens
KSWPRSVKK

SEQ ID NO: 675764 - protein, 9 aa, Homo Sapiens
NMLSPRGVH

SEQ ID NO: 675765 - protein, 9 aa, Homo Sapiens
LSTETLGKL

SEQ ID NO: 675766 - protein, 9 aa, Homo Sapiens
SMMILYSSL

SEQ ID NO: 675767 - protein, 9 aa, Homo Sapiens
TEMGLLEQL

SEQ ID NO: 675768 - protein, 9 aa, Homo Sapiens
TISYGGCIA

SEQ ID NO: 675769 - protein, 9 aa, Homo Sapiens
FNARVSLRQ

SEQ ID NO: 675770 - protein, 9 aa, Homo Sapiens
HLSDAQRAQ

SEQ ID NO: 675771 - protein, 9 aa, Homo Sapiens
GPGEEVSKE

SEQ ID NO: 675772 - protein, 9 aa, Homo Sapiens
DYNYYYNRS

SEQ ID NO: 675773 - protein, 9 aa, Homo Sapiens
FRFAKEAAS

SEQ ID NO: 675774 - protein, 9 aa, Homo Sapiens
TIRLPEHVT

SEQ ID NO: 675775 - protein, 9 aa, Homo Sapiens
CACKPECNS

SEQ ID NO: 675776 - protein, 9 aa, Homo Sapiens
KLQKLKVLL

SEQ ID NO: 675777 - protein, 9 aa, Homo Sapiens
LRNSWPWKW

SEQ ID NO: 675778 - protein, 9 aa, Homo Sapiens
MMSDGTSRF

SEQ ID NO: 675779 - protein, 9 aa, Homo Sapiens
RGLLDPQRT

SEQ ID NO: 675780 - protein, 9 aa, Homo Sapiens
VLVLDDAQE

SEQ ID NO: 675781 - protein, 9 aa, Homo Sapiens
SAGSTGLGG

SEQ ID NO: 675782 - protein, 9 aa, Homo Sapiens
CTCISGFTE

SEQ ID NO: 675783 - protein, 9 aa, Homo Sapiens
SNSNRTREV

SEQ ID NO: 675784 - protein, 9 aa, Homo Sapiens
NAFCTHVFP

SEQ ID NO: 675785 - protein, 9 aa, Homo Sapiens
PGLAPPFCN

SEQ ID NO: 675786 - protein, 9 aa, Homo Sapiens
GSKRARESQ

SEQ ID NO: 675787 - protein, 9 aa, Homo Sapiens
DEHRTATII

SEQ ID NO: 675788 - protein, 9 aa, Homo Sapiens
LEDKDFLED

SEQ ID NO: 675789 - protein, 9 aa, Homo Sapiens
KRDFVSAGP

SEQ ID NO: 675790 - protein, 9 aa, Homo Sapiens
SPTPVKPRE

SEQ ID NO: 675791 - protein, 9 aa, Homo Sapiens
CARCCTRPP

SEQ ID NO: 675792 - protein, 9 aa, Homo Sapiens
GSGYRCVAS

SEQ ID NO: 675793 - protein, 9 aa, Homo Sapiens
GPSTAEHIE

SEQ ID NO: 675794 - protein, 9 aa, Homo Sapiens
STGVTSWCY

SEQ ID NO: 675795 - protein, 9 aa, Homo Sapiens
EVQRGDIVS

SEQ ID NO: 675796 - protein, 9 aa, Homo Sapiens
QFIPTNTLN

SEQ ID NO: 675797 - protein, 9 aa, Homo Sapiens
KWILTILLA

SEQ ID NO: 675798 - protein, 9 aa, Homo Sapiens
SPELTAARF

SEQ ID NO: 675799 - protein, 9 aa, Homo Sapiens
SSSFNNPLG

SEQ ID NO: 675800 - protein, 9 aa, Homo Sapiens
QITNSQAEI

SEQ ID NO: 675801 - protein, 9 aa, Homo Sapiens
NLMASQPLL

SEQ ID NO: 675802 - protein, 9 aa, Homo Sapiens
KINSRWIKE

SEQ ID NO: 675803 - protein, 9 aa, Homo Sapiens
KENVQQYCR

SEQ ID NO: 675804 - protein, 9 aa, Homo Sapiens
LLQGVCAEV

SEQ ID NO: 675805 - protein, 9 aa, Homo Sapiens
DHLKLHGEK

SEQ ID NO: 675806 - protein, 9 aa, Homo Sapiens
SPQKIPLSK

SEQ ID NO: 675807 - protein, 9 aa, Homo Sapiens
EDDEIKEDD

SEQ ID NO: 675808 - protein, 9 aa, Homo Sapiens
EVHSFASCQ

SEQ ID NO: 675809 - protein, 9 aa, Homo Sapiens
SDPRLKQAD

SEQ ID NO: 675810 - protein, 9 aa, Homo Sapiens
CLSNIERNL

SEQ ID NO: 675811 - protein, 9 aa, Homo Sapiens
HCSGNCCFW

SEQ ID NO: 675812 - protein, 9 aa, Homo Sapiens
GRASPTLFQ

SEQ ID NO: 675813 - protein, 9 aa, Homo Sapiens
SFGSTCAHS

SEQ ID NO: 675814 - protein, 9 aa, Homo Sapiens
TCQLGSSIY

SEQ ID NO: 675815 - protein, 9 aa, Homo Sapiens
LAIVMIQVV

SEQ ID NO: 675816 - protein, 9 aa, Homo Sapiens
SEQRPGTLG

SEQ ID NO: 675817 - protein, 9 aa, Homo Sapiens
AATASAAYR

SEQ ID NO: 675818 - protein, 9 aa, Homo Sapiens
LPVSASLPP

SEQ ID NO: 675819 - protein, 9 aa, Homo Sapiens
SPPVRALDS

SEQ ID NO: 675820 - protein, 9 aa, Homo Sapiens
FYLSFQDYG

SEQ ID NO: 675821 - protein, 9 aa, Homo Sapiens
LAVDLLEKI

SEQ ID NO: 675822 - protein, 9 aa, Homo Sapiens
DEKNTFREQ

SEQ ID NO: 675823 - protein, 9 aa, Homo Sapiens
RMQPSNHYA

SEQ ID NO: 675824 - protein, 9 aa, Homo Sapiens
LQQITNSQA

SEQ ID NO: 675825 - protein, 9 aa, Homo Sapiens
LPQLKRDHV

SEQ ID NO: 675826 - protein, 9 aa, Homo Sapiens
LCQNPSRSQ

SEQ ID NO: 675827 - protein, 9 aa, Homo Sapiens
QTWVPLMGV

SEQ ID NO: 675828 - protein, 9 aa, Homo Sapiens
LLLQASRGY

SEQ ID NO: 675829 - protein, 9 aa, Homo Sapiens
DSKPNSVRQ

SEQ ID NO: 675830 - protein, 9 aa, Homo Sapiens
QTLLARPRR

SEQ ID NO: 675831 - protein, 9 aa, Homo Sapiens
DDAQAVNEQ

SEQ ID NO: 675832 - protein, 9 aa, Homo Sapiens
GVLLHGVAQ

SEQ ID NO: 675833 - protein, 9 aa, Homo Sapiens
PQEPRNMLL

SEQ ID NO: 675834 - protein, 9 aa, Homo Sapiens
TSATITEFV

SEQ ID NO: 675835 - protein, 9 aa, Homo Sapiens
AMGRASPTL

SEQ ID NO: 675836 - protein, 9 aa, Homo Sapiens
INSRWIKEL

SEQ ID NO: 675837 - protein, 9 aa, Homo Sapiens
LSLHCWAGT

SEQ ID NO: 675838 - protein, 9 aa, Homo Sapiens
VPFFAANTL

SEQ ID NO: 675839 - protein, 9 aa, Homo Sapiens
GMQKWWKGP

SEQ ID NO: 675840 - protein, 9 aa, Homo Sapiens
VPPEPWSSR

SEQ ID NO: 675841 - protein, 9 aa, Homo Sapiens
NLLNKEKNT

SEQ ID NO: 675842 - protein, 9 aa, Homo Sapiens
DPVPTVRWM

SEQ ID NO: 675843 - protein, 9 aa, Homo Sapiens
LQRTHSASA

SEQ ID NO: 675844 - protein, 9 aa, Homo Sapiens
ITDEKAFKA

SEQ ID NO: 675845 - protein, 9 aa, Homo Sapiens
MSSRTLHPV

SEQ ID NO: 675846 - protein, 9 aa, Homo Sapiens
AAFSPQKIP

SEQ ID NO: 675847 - protein, 9 aa, Homo Sapiens
AMTIMFEVQ

SEQ ID NO: 675848 - protein, 9 aa, Homo Sapiens
PGMSSLVEL

SEQ ID NO: 675849 - protein, 9 aa, Homo Sapiens
HERIGQDSA

SEQ ID NO: 675850 - protein, 9 aa, Homo Sapiens
SFSNSNRTR

SEQ ID NO: 675851 - protein, 9 aa, Homo Sapiens
NWQGLRATR

SEQ ID NO: 675852 - protein, 9 aa, Homo Sapiens
LEPLAGRSP

SEQ ID NO: 675853 - protein, 9 aa, Homo Sapiens
AEPLRGPVP

SEQ ID NO: 675854 - protein, 9 aa, Homo Sapiens
SGYRCVASV

SEQ ID NO: 675855 - protein, 9 aa, Homo Sapiens
QTEREVPDP

SEQ ID NO: 675856 - protein, 9 aa, Homo Sapiens
TYVDTGMDF

SEQ ID NO: 675857 - protein, 9 aa, Homo Sapiens
KAFWMELED

SEQ ID NO: 675858 - protein, 9 aa, Homo Sapiens
SSVLQAKPL

SEQ ID NO: 675859 - protein, 9 aa, Homo Sapiens
SFLWDFKKT

SEQ ID NO: 675860 - protein, 9 aa, Homo Sapiens
CCHHQGGWK

SEQ ID NO: 675861 - protein, 9 aa, Homo Sapiens
RLEKGAPPP

SEQ ID NO: 675862 - protein, 9 aa, Homo Sapiens
PGQVNAAMA

SEQ ID NO: 675863 - protein, 9 aa, Homo Sapiens
GITDEKAFK

SEQ ID NO: 675864 - protein, 9 aa, Homo Sapiens
RQRLEKGAP

SEQ ID NO: 675865 - protein, 9 aa, Homo Sapiens
KKAQQELKN

SEQ ID NO: 675866 - protein, 9 aa, Homo Sapiens
ADAETLRKS

SEQ ID NO: 675867 - protein, 9 aa, Homo Sapiens
PSGCYCKND

SEQ ID NO: 675868 - protein, 9 aa, Homo Sapiens
FYTVLTPLP

SEQ ID NO: 675869 - protein, 9 aa, Homo Sapiens
KEAGVEVVS

SEQ ID NO: 675870 - protein, 9 aa, Homo Sapiens
FVKIQDPKI

SEQ ID NO: 675871 - protein, 9 aa, Homo Sapiens
CYCKNDANC

SEQ ID NO: 675872 - protein, 9 aa, Homo Sapiens
SWCYQWKFY

SEQ ID NO: 675873 - protein, 9 aa, Homo Sapiens
CKYPGIPGP

SEQ ID NO: 675874 - protein, 9 aa, Homo Sapiens
NGIHLARNQ

SEQ ID NO: 675875 - protein, 9 aa, Homo Sapiens
AWGVLVLDD

SEQ ID NO: 675876 - protein, 9 aa, Homo Sapiens
ALDDAQAVN

SEQ ID NO: 675877 - protein, 9 aa, Homo Sapiens
AEHIEPPTQ

SEQ ID NO: 675878 - protein, 9 aa, Homo Sapiens
FQSLPGFED

SEQ ID NO: 675879 - protein, 9 aa, Homo Sapiens
GTSMTQLHA

SEQ ID NO: 675880 - protein, 9 aa, Homo Sapiens
PLRGPVPQD

SEQ ID NO: 675881 - protein, 9 aa, Homo Sapiens
PQLFVGTMD

SEQ ID NO: 675882 - protein, 9 aa, Homo Sapiens
SIAAMVDEQ

SEQ ID NO: 675883 - protein, 9 aa, Homo Sapiens
CCSDGYSLA

SEQ ID NO: 675884 - protein, 9 aa, Homo Sapiens
IMFESWLFD

SEQ ID NO: 675885 - protein, 9 aa, Homo Sapiens
NLQTSKPVA

SEQ ID NO: 675886 - protein, 9 aa, Homo Sapiens
LAGMDTEKP

SEQ ID NO: 675887 - protein, 9 aa, Homo Sapiens
LIATAAEHL

SEQ ID NO: 675888 - protein, 9 aa, Homo Sapiens
TDTLAIVMI

SEQ ID NO: 675889 - protein, 9 aa, Homo Sapiens
SAAFSPQKI

SEQ ID NO: 675890 - protein, 9 aa, Homo Sapiens
SKEGFQIPA

SEQ ID NO: 675891 - protein, 9 aa, Homo Sapiens
KVRNFEVQR

SEQ ID NO: 675892 - protein, 9 aa, Homo Sapiens
ILNGLDKAL

SEQ ID NO: 675893 - protein, 9 aa, Homo Sapiens
LFVKIQDPK

SEQ ID NO: 675894 - protein, 9 aa, Homo Sapiens
LWKAKDISP

SEQ ID NO: 675895 - protein, 9 aa, Homo Sapiens
LGYGLKSKV

SEQ ID NO: 675896 - protein, 9 aa, Homo Sapiens
MKLSLPESL

SEQ ID NO: 675897 - protein, 9 aa, Homo Sapiens
WWKGPNVTV

SEQ ID NO: 675898 - protein, 9 aa, Homo Sapiens
KFAGYSRNL

SEQ ID NO: 675899 - protein, 9 aa, Homo Sapiens
PQRSLRYSD

SEQ ID NO: 675900 - protein, 9 aa, Homo Sapiens
FDEMKEYCP

SEQ ID NO: 675901 - protein, 9 aa, Homo Sapiens
KGEREHWRS

SEQ ID NO: 675902 - protein, 9 aa, Homo Sapiens
QLDKKMVRM

SEQ ID NO: 675903 - protein, 9 aa, Homo Sapiens
FSWLQWLMI

SEQ ID NO: 675904 - protein, 9 aa, Homo Sapiens
VQSLVAVKY

SEQ ID NO: 675905 - protein, 9 aa, Homo Sapiens
FLWDFKKTV

SEQ ID NO: 675906 - protein, 9 aa, Homo Sapiens
MLQAMCWKE

SEQ ID NO: 675907 - protein, 9 aa, Homo Sapiens
GLTTGMSIY

SEQ ID NO: 675908 - protein, 9 aa, Homo Sapiens
CFWTAGTAA

SEQ ID NO: 675909 - protein, 9 aa, Homo Sapiens
IQPDIFSHG

SEQ ID NO: 675910 - protein, 9 aa, Homo Sapiens
IFHPEKPDS

SEQ ID NO: 675911 - protein, 9 aa, Homo Sapiens
GLWKAKDIS

SEQ ID NO: 675912 - protein, 9 aa, Homo Sapiens
RKSMKGLGT

SEQ ID NO: 675913 - protein, 9 aa, Homo Sapiens
KGPILMEGL

SEQ ID NO: 675914 - protein, 9 aa, Homo Sapiens
SMACPIMFE

SEQ ID NO: 675915 - protein, 9 aa, Homo Sapiens
MGHLQLVDV

SEQ ID NO: 675916 - protein, 9 aa, Homo Sapiens
DRECEAADR

SEQ ID NO: 675917 - protein, 9 aa, Homo Sapiens
SDGPACKGP

SEQ ID NO: 675918 - protein, 9 aa, Homo Sapiens
DSNGVVSLL

SEQ ID NO: 675919 - protein, 9 aa, Homo Sapiens
SSGSQHNNV

SEQ ID NO: 675920 - protein, 9 aa, Homo Sapiens
AMVDEQKQL

SEQ ID NO: 675921 - protein, 9 aa, Homo Sapiens
PLTFFCCHH

SEQ ID NO: 675922 - protein, 9 aa, Homo Sapiens
RGTQPPSIL

SEQ ID NO: 675923 - protein, 9 aa, Homo Sapiens
DSGEYRAAV

SEQ ID NO: 675924 - protein, 9 aa, Homo Sapiens
QHVQPAEPR

SEQ ID NO: 675925 - protein, 9 aa, Homo Sapiens
CTMKNDHME

SEQ ID NO: 675926 - protein, 9 aa, Homo Sapiens
RARLKSWPR

SEQ ID NO: 675927 - protein, 9 aa, Homo Sapiens
VVVNGDGKS

SEQ ID NO: 675928 - protein, 9 aa, Homo Sapiens
DALLLHSFC

SEQ ID NO: 675929 - protein, 9 aa, Homo Sapiens
SYLGVLLHG

SEQ ID NO: 675930 - protein, 9 aa, Homo Sapiens
KDVRQYLIL

SEQ ID NO: 675931 - protein, 9 aa, Homo Sapiens
AKFFLVGIG

SEQ ID NO: 675932 - protein, 9 aa, Homo Sapiens
PYPAATASA

SEQ ID NO: 675933 - protein, 9 aa, Homo Sapiens
PVGLWNLSR

SEQ ID NO: 675934 - protein, 9 aa, Homo Sapiens
DIQTWVPLM

SEQ ID NO: 675935 - protein, 9 aa, Homo Sapiens
RSCSLTNVK

SEQ ID NO: 675936 - protein, 9 aa, Homo Sapiens
CHHQGGWKG

SEQ ID NO: 675937 - protein, 9 aa, Homo Sapiens
IEEGDHSLS

SEQ ID NO: 675938 - protein, 9 aa, Homo Sapiens
APSICFLKP

SEQ ID NO: 675939 - protein, 9 aa, Homo Sapiens
TAGEISGAT

SEQ ID NO: 675940 - protein, 9 aa, Homo Sapiens
TTSVELEDW

SEQ ID NO: 675941 - protein, 9 aa, Homo Sapiens
LIEQLKWIL

SEQ ID NO: 675942 - protein, 9 aa, Homo Sapiens
RKNPYPTKS

SEQ ID NO: 675943 - protein, 9 aa, Homo Sapiens
KVRYSQLHG

SEQ ID NO: 675944 - protein, 9 aa, Homo Sapiens
LWVMPNHQE

SEQ ID NO: 675945 - protein, 9 aa, Homo Sapiens
APGPGACVP

SEQ ID NO: 675946 - protein, 9 aa, Homo Sapiens
SEKDALLLH

SEQ ID NO: 675947 - protein, 9 aa, Homo Sapiens
ACTTTPCML

SEQ ID NO: 675948 - protein, 9 aa, Homo Sapiens
GGGPSTAEH

SEQ ID NO: 675949 - protein, 9 aa, Homo Sapiens
PSISPFRFA

SEQ ID NO: 675950 - protein, 9 aa, Homo Sapiens
LSGTANSRQ

SEQ ID NO: 675951 - protein, 9 aa, Homo Sapiens
RCGLEHRVY

SEQ ID NO: 675952 - protein, 9 aa, Homo Sapiens
SKVDKHSPK

SEQ ID NO: 675953 - protein, 9 aa, Homo Sapiens
LSWVSFLIS

SEQ ID NO: 675954 - protein, 9 aa, Homo Sapiens
KKDTFLCPV

SEQ ID NO: 675955 - protein, 9 aa, Homo Sapiens
WVPLMGVIN

SEQ ID NO: 675956 - protein, 9 aa, Homo Sapiens
EKNGDAKAF

SEQ ID NO: 675957 - protein, 9 aa, Homo Sapiens
LRLIYSSYL

SEQ ID NO: 675958 - protein, 9 aa, Homo Sapiens
YPAATASAA

SEQ ID NO: 675959 - protein, 9 aa, Homo Sapiens
CWKEGSGLG

SEQ ID NO: 675960 - protein, 9 aa, Homo Sapiens
AHNWQGLRA

SEQ ID NO: 675961 - protein, 9 aa, Homo Sapiens
SKFAGYSRN

SEQ ID NO: 675962 - protein, 9 aa, Homo Sapiens
SSLGHQVSY

SEQ ID NO: 675963 - protein, 9 aa, Homo Sapiens
ELHLLCVQV

SEQ ID NO: 675964 - protein, 9 aa, Homo Sapiens
KILEDTGLY

SEQ ID NO: 675965 - protein, 9 aa, Homo Sapiens
VEVVSENSH

SEQ ID NO: 675966 - protein, 9 aa, Homo Sapiens
YIYNGRADR

SEQ ID NO: 675967 - protein, 9 aa, Homo Sapiens
DHPLNLSFG

SEQ ID NO: 675968 - protein, 9 aa, Homo Sapiens
QSKTQMMSD

SEQ ID NO: 675969 - protein, 9 aa, Homo Sapiens
AEHLNAAIR

SEQ ID NO: 675970 - protein, 9 aa, Homo Sapiens
LHLKAETLI

SEQ ID NO: 675971 - protein, 9 aa, Homo Sapiens
IMYEAVDSR

SEQ ID NO: 675972 - protein, 9 aa, Homo Sapiens
SRMQLFQKN

SEQ ID NO: 675973 - protein, 9 aa, Homo Sapiens
RSQDSCCPQ

SEQ ID NO: 675974 - protein, 9 aa, Homo Sapiens
VLQAKPLLG

SEQ ID NO: 675975 - protein, 9 aa, Homo Sapiens
EDAVVARAL

SEQ ID NO: 675976 - protein, 9 aa, Homo Sapiens
TETLGKLAS

SEQ ID NO: 675977 - protein, 9 aa, Homo Sapiens
KIPLSKELG

SEQ ID NO: 675978 - protein, 9 aa, Homo Sapiens
RPCLSLVKE

SEQ ID NO: 675979 - protein, 9 aa, Homo Sapiens
LFRFSIEHI

SEQ ID NO: 675980 - protein, 9 aa, Homo Sapiens
TAAEHLNAA

SEQ ID NO: 675981 - protein, 9 aa, Homo Sapiens
WQEEDTGPA

SEQ ID NO: 675982 - protein, 9 aa, Homo Sapiens
VGTMDLLSG

SEQ ID NO: 675983 - protein, 9 aa, Homo Sapiens
LQDWYQTVE

SEQ ID NO: 675984 - protein, 9 aa, Homo Sapiens
RDWEGKCEE

SEQ ID NO: 675985 - protein, 9 aa, Homo Sapiens
LLLHSFCKF

SEQ ID NO: 675986 - protein, 9 aa, Homo Sapiens
EKSFRNLRK

SEQ ID NO: 675987 - protein, 9 aa, Homo Sapiens
IHYYDQITL

SEQ ID NO: 675988 - protein, 9 aa, Homo Sapiens
ATASGVMSS

SEQ ID NO: 675989 - protein, 9 aa, Homo Sapiens
DYPCTCISG

SEQ ID NO: 675990 - protein, 9 aa, Homo Sapiens
HRRLHGRAV

SEQ ID NO: 675991 - protein, 9 aa, Homo Sapiens
KPDLVNVIN

SEQ ID NO: 675992 - protein, 9 aa, Homo Sapiens
ESDIVNIIS

SEQ ID NO: 675993 - protein, 9 aa, Homo Sapiens
AETLRKSMK

SEQ ID NO: 675994 - protein, 9 aa, Homo Sapiens
LKSWPRSVK

SEQ ID NO: 675995 - protein, 9 aa, Homo Sapiens
IFSSDRPQV

SEQ ID NO: 675996 - protein, 9 aa, Homo Sapiens
CVQVQQFQD

SEQ ID NO: 675997 - protein, 9 aa, Homo Sapiens
VLKILGQLT

SEQ ID NO: 675998 - protein, 9 aa, Homo Sapiens
NYSKTRFAY

SEQ ID NO: 675999 - protein, 9 aa, Homo Sapiens
PCTPPHQPQ

SEQ ID NO: 676000 - protein, 9 aa, Homo Sapiens
FKGNKIHGE

SEQ ID NO: 676001 - protein, 9 aa, Homo Sapiens
NRTREVVKV

SEQ ID NO: 676002 - protein, 9 aa, Homo Sapiens
PRSVKKLKR

SEQ ID NO: 676003 - protein, 9 aa, Homo Sapiens
RRGTDAATL

SEQ ID NO: 676004 - protein, 9 aa, Homo Sapiens
LELQNVFSW

SEQ ID NO: 676005 - protein, 9 aa, Homo Sapiens
CFFLLLLEL

SEQ ID NO: 676006 - protein, 9 aa, Homo Sapiens
RLRVITTNI

SEQ ID NO: 676007 - protein, 9 aa, Homo Sapiens
YLGVLLHGV

SEQ ID NO: 676008 - protein, 9 aa, Homo Sapiens
GFKGEREHW

SEQ ID NO: 676009 - protein, 9 aa, Homo Sapiens
AAMVDEQKQ

SEQ ID NO: 676010 - protein, 9 aa, Homo Sapiens
LAPDFEIGH

SEQ ID NO: 676011 - protein, 9 aa, Homo Sapiens
LHVALRNWS

SEQ ID NO: 676012 - protein, 9 aa, Homo Sapiens
LKSRLKIAE

SEQ ID NO: 676013 - protein, 9 aa, Homo Sapiens
RALVHLKTH

SEQ ID NO: 676014 - protein, 9 aa, Homo Sapiens
LNLSLCVFT

SEQ ID NO: 676015 - protein, 9 aa, Homo Sapiens
GPHILVDGV

SEQ ID NO: 676016 - protein, 9 aa, Homo Sapiens
SLVELGRQP

SEQ ID NO: 676017 - protein, 9 aa, Homo Sapiens
PKCKCPGGY

SEQ ID NO: 676018 - protein, 9 aa, Homo Sapiens
AYQKSRMQL

SEQ ID NO: 676019 - protein, 9 aa, Homo Sapiens
QGSKRARES

SEQ ID NO: 676020 - protein, 9 aa, Homo Sapiens
MGLLEQLDI

SEQ ID NO: 676021 - protein, 9 aa, Homo Sapiens
EKKVRAEWM

SEQ ID NO: 676022 - protein, 9 aa, Homo Sapiens
VMPNHQELL

SEQ ID NO: 676023 - protein, 9 aa, Homo Sapiens
LSDAQRAQP

SEQ ID NO: 676024 - protein, 9 aa, Homo Sapiens
LLEQLDIIK

SEQ ID NO: 676025 - protein, 9 aa, Homo Sapiens
SAMGRASPT

SEQ ID NO: 676026 - protein, 9 aa, Homo Sapiens
RELHLLCVQ

SEQ ID NO: 676027 - protein, 9 aa, Homo Sapiens
DAVVARALY

SEQ ID NO: 676028 - protein, 9 aa, Homo Sapiens
PGLILLLLI

SEQ ID NO: 676029 - protein, 8 aa, Homo Sapiens
HSPPRDQA

SEQ ID NO: 676030 - protein, 9 aa, Homo Sapiens
PEESVQEMM

SEQ ID NO: 676031 - protein, 9 aa, Homo Sapiens
KIEHNEEND

SEQ ID NO: 676032 - protein, 9 aa, Homo Sapiens
GLFGHSSTS

SEQ ID NO: 676033 - protein, 9 aa, Homo Sapiens
RLSFSTIRD

SEQ ID NO: 676034 - protein, 9 aa, Homo Sapiens
QEEDTGPAP

SEQ ID NO: 676035 - protein, 9 aa, Homo Sapiens
TPLHHAAEN

SEQ ID NO: 676036 - protein, 9 aa, Homo Sapiens
VDLLEDKDF

SEQ ID NO: 676037 - protein, 9 aa, Homo Sapiens
PAVQAVLLP

SEQ ID NO: 676038 - protein, 9 aa, Homo Sapiens
RFSIEHISR

SEQ ID NO: 676039 - protein, 9 aa, Homo Sapiens
LILLLLITD

SEQ ID NO: 676040 - protein, 9 aa, Homo Sapiens
RRADSGEYR

SEQ ID NO: 676041 - protein, 9 aa, Homo Sapiens
EREVPDPGT

SEQ ID NO: 676042 - protein, 9 aa, Homo Sapiens
NYEIIKLFV

SEQ ID NO: 676043 - protein, 9 aa, Homo Sapiens
KENQIRIRF

SEQ ID NO: 676044 - protein, 9 aa, Homo Sapiens
VRSAIKDIV

SEQ ID NO: 676045 - protein, 9 aa, Homo Sapiens
VSAGPAAGV

SEQ ID NO: 676046 - protein, 9 aa, Homo Sapiens
QLALQDWYQ

SEQ ID NO: 676047 - protein, 9 aa, Homo Sapiens
EMPEPHSPP

SEQ ID NO: 676048 - protein, 9 aa, Homo Sapiens
EYKVSSEPS

SEQ ID NO: 676049 - protein, 9 aa, Homo Sapiens
TGGSDPRLK

SEQ ID NO: 676050 - protein, 9 aa, Homo Sapiens
RLGRAGTLL

SEQ ID NO: 676051 - protein, 9 aa, Homo Sapiens
IHLARNQNG

SEQ ID NO: 676052 - protein, 9 aa, Homo Sapiens
TSAGGSGGN

SEQ ID NO: 676053 - protein, 9 aa, Homo Sapiens
HLLCVQVQQ

SEQ ID NO: 676054 - protein, 9 aa, Homo Sapiens
DAQRAQPAP

SEQ ID NO: 676055 - protein, 9 aa, Homo Sapiens
GKYHIQACT

SEQ ID NO: 676056 - protein, 9 aa, Homo Sapiens
SGTEMEIVV

SEQ ID NO: 676057 - protein, 9 aa, Homo Sapiens
GFYLSFQDY

SEQ ID NO: 676058 - protein, 9 aa, Homo Sapiens
YLTYSNGGV

SEQ ID NO: 676059 - protein, 9 aa, Homo Sapiens
VKSQKENVQ

SEQ ID NO: 676060 - protein, 9 aa, Homo Sapiens
VAVEQTCIL

SEQ ID NO: 676061 - protein, 9 aa, Homo Sapiens
ETLRKSMKG

SEQ ID NO: 676062 - protein, 9 aa, Homo Sapiens
HRKASLEIS

SEQ ID NO: 676063 - protein, 9 aa, Homo Sapiens
IRWKLNGTY

SEQ ID NO: 676064 - protein, 9 aa, Homo Sapiens
SRNLVSDIP

SEQ ID NO: 676065 - protein, 9 aa, Homo Sapiens
HCLPGLAPP

SEQ ID NO: 676066 - protein, 9 aa, Homo Sapiens
KCEKDYPCT

SEQ ID NO: 676067 - protein, 9 aa, Homo Sapiens
FKAVADRIG

SEQ ID NO: 676068 - protein, 9 aa, Homo Sapiens
PQPITCSPD

SEQ ID NO: 676069 - protein, 9 aa, Homo Sapiens
TFTPVKMRK

SEQ ID NO: 676070 - protein, 9 aa, Homo Sapiens
TKNRFYAGG

SEQ ID NO: 676071 - protein, 9 aa, Homo Sapiens
LPGLAPPFC

SEQ ID NO: 676072 - protein, 9 aa, Homo Sapiens
NGRADRISS

SEQ ID NO: 676073 - protein, 9 aa, Homo Sapiens
PREPCTPSK

SEQ ID NO: 676074 - protein, 9 aa, Homo Sapiens
MLAWLHQST

SEQ ID NO: 676075 - protein, 9 aa, Homo Sapiens
LLLALLQGV

SEQ ID NO: 676076 - protein, 9 aa, Homo Sapiens
SWPRSVKKL

SEQ ID NO: 676077 - protein, 9 aa, Homo Sapiens
LGLLMEEMI

SEQ ID NO: 676078 - protein, 9 aa, Homo Sapiens
FYQTGEIPR

SEQ ID NO: 676079 - protein, 9 aa, Homo Sapiens
VRCACKPEC

SEQ ID NO: 676080 - protein, 9 aa, Homo Sapiens
KKEHSSGDS

SEQ ID NO: 676081 - protein, 9 aa, Homo Sapiens
NHQELLGPE

SEQ ID NO: 676082 - protein, 9 aa, Homo Sapiens
GCAVPSSVL

SEQ ID NO: 676083 - protein, 9 aa, Homo Sapiens
EDTGPAPGT

SEQ ID NO: 676084 - protein, 9 aa, Homo Sapiens
TRLEILDKG

SEQ ID NO: 676085 - protein, 9 aa, Homo Sapiens
EKAFKALKE

SEQ ID NO: 676086 - protein, 9 aa, Homo Sapiens
AAAPGAGAL

SEQ ID NO: 676087 - protein, 9 aa, Homo Sapiens
SAIKDIVTS

SEQ ID NO: 676088 - protein, 9 aa, Homo Sapiens
LEMRNGRGI

SEQ ID NO: 676089 - protein, 9 aa, Homo Sapiens
CVSAGSTGL

SEQ ID NO: 676090 - protein, 9 aa, Homo Sapiens
ASPTLFQSR

SEQ ID NO: 676091 - protein, 9 aa, Homo Sapiens
ARFLFKPKY

SEQ ID NO: 676092 - protein, 9 aa, Homo Sapiens
SDVQHRCFF

SEQ ID NO: 676093 - protein, 9 aa, Homo Sapiens
KAISGVYTV

SEQ ID NO: 676094 - protein, 9 aa, Homo Sapiens
QQYCRKSGL

SEQ ID NO: 676095 - protein, 9 aa, Homo Sapiens
STTSVELED

SEQ ID NO: 676096 - protein, 9 aa, Homo Sapiens
NYQQQLDNS

SEQ ID NO: 676097 - protein, 9 aa, Homo Sapiens
IIQFVLNDT

SEQ ID NO: 676098 - protein, 9 aa, Homo Sapiens
IKRFKAKQC

SEQ ID NO: 676099 - protein, 9 aa, Homo Sapiens
SGCYCKNDA

SEQ ID NO: 676100 - protein, 9 aa, Homo Sapiens
GKQISKENQ

SEQ ID NO: 676101 - protein, 9 aa, Homo Sapiens
EDTGLYLTN

SEQ ID NO: 676102 - protein, 9 aa, Homo Sapiens
RAYVAALRH

SEQ ID NO: 676103 - protein, 9 aa, Homo Sapiens
LEDTGLYLT

SEQ ID NO: 676104 - protein, 9 aa, Homo Sapiens
CDLRLIYSS

SEQ ID NO: 676105 - protein, 9 aa, Homo Sapiens
ILLLLITDE

SEQ ID NO: 676106 - protein, 9 aa, Homo Sapiens
ISGVYTVRF

SEQ ID NO: 676107 - protein, 9 aa, Homo Sapiens
HLKFLNMLS

SEQ ID NO: 676108 - protein, 9 aa, Homo Sapiens
CPVPSFHIE

SEQ ID NO: 676109 - protein, 9 aa, Homo Sapiens
LLRPKICGL

SEQ ID NO: 676110 - protein, 9 aa, Homo Sapiens
QKINPFHLS

SEQ ID NO: 676111 - protein, 9 aa, Homo Sapiens
VIPGEAEYK

SEQ ID NO: 676112 - protein, 9 aa, Homo Sapiens
DTPMVPPHS

SEQ ID NO: 676113 - protein, 9 aa, Homo Sapiens
PGACVPLLT

SEQ ID NO: 676114 - protein, 9 aa, Homo Sapiens
PPHSSLGHQ

SEQ ID NO: 676115 - protein, 9 aa, Homo Sapiens
EWIPFVENL

SEQ ID NO: 676116 - protein, 9 aa, Homo Sapiens
YCDLRLIYS

SEQ ID NO: 676117 - protein, 9 aa, Homo Sapiens
RHGTQQAVP

SEQ ID NO: 676118 - protein, 9 aa, Homo Sapiens
KEGFQIPAT

SEQ ID NO: 676119 - protein, 9 aa, Homo Sapiens
QLGSSIYNG

SEQ ID NO: 676120 - protein, 9 aa, Homo Sapiens
PGQQSVLKI

SEQ ID NO: 676121 - protein, 9 aa, Homo Sapiens
MMFTDEDAT

SEQ ID NO: 676122 - protein, 9 aa, Homo Sapiens
RRVTLVIAY

SEQ ID NO: 676123 - protein, 9 aa, Homo Sapiens
ASQPLLAKQ

SEQ ID NO: 676124 - protein, 9 aa, Homo Sapiens
ASSSPSIFS

SEQ ID NO: 676125 - protein, 9 aa, Homo Sapiens
LTKNRFYAG

SEQ ID NO: 676126 - protein, 9 aa, Homo Sapiens
ALQDWYQTV

SEQ ID NO: 676127 - protein, 9 aa, Homo Sapiens
SESSSFHYS

SEQ ID NO: 676128 - protein, 9 aa, Homo Sapiens
LLAYQKSRM

SEQ ID NO: 676129 - protein, 9 aa, Homo Sapiens
SRMLQAMCW

SEQ ID NO: 676130 - protein, 9 aa, Homo Sapiens
EQQLSDLDS

SEQ ID NO: 676131 - protein, 9 aa, Homo Sapiens
EAGSGYRCV

SEQ ID NO: 676132 - protein, 9 aa, Homo Sapiens
ASILQLSLQ

SEQ ID NO: 676133 - protein, 9 aa, Homo Sapiens
YNKNQHQTE

SEQ ID NO: 676134 - protein, 9 aa, Homo Sapiens
VRPLKSTEV

SEQ ID NO: 676135 - protein, 9 aa, Homo Sapiens
RPGMSSLVE

SEQ ID NO: 676136 - protein, 9 aa, Homo Sapiens
EDEEEFNHR

SEQ ID NO: 676137 - protein, 9 aa, Homo Sapiens
HLSALETKS

SEQ ID NO: 676138 - protein, 9 aa, Homo Sapiens
QKSRMQLFQ

SEQ ID NO: 676139 - protein, 9 aa, Homo Sapiens
HVQQHNLAV

SEQ ID NO: 676140 - protein, 9 aa, Homo Sapiens
SRWIKELNI

SEQ ID NO: 676141 - protein, 9 aa, Homo Sapiens
NPSALLFRG

SEQ ID NO: 676142 - protein, 9 aa, Homo Sapiens
FRNVDNDST

SEQ ID NO: 676143 - protein, 9 aa, Homo Sapiens
QGGWKGVPS

SEQ ID NO: 676144 - protein, 9 aa, Homo Sapiens
YYDQITLKS

SEQ ID NO: 676145 - protein, 9 aa, Homo Sapiens
EKNTFREQL

SEQ ID NO: 676146 - protein, 9 aa, Homo Sapiens
SYGRIIVSV

SEQ ID NO: 676147 - protein, 9 aa, Homo Sapiens
QLTSNPLVP

SEQ ID NO: 676148 - protein, 9 aa, Homo Sapiens
TEYTDGTFR

SEQ ID NO: 676149 - protein, 9 aa, Homo Sapiens
GVSRRVTLV

SEQ ID NO: 676150 - protein, 9 aa, Homo Sapiens
GPALLHSQF

SEQ ID NO: 676151 - protein, 9 aa, Homo Sapiens
RAQPAPPGP

SEQ ID NO: 676152 - protein, 9 aa, Homo Sapiens
MTGGSDPRL

SEQ ID NO: 676153 - protein, 9 aa, Homo Sapiens
VKMHLSALE

SEQ ID NO: 676154 - protein, 9 aa, Homo Sapiens
MKNDHMEKE

SEQ ID NO: 676155 - protein, 9 aa, Homo Sapiens
LQNVFSWLQ

SEQ ID NO: 676156 - protein, 9 aa, Homo Sapiens
ATIRLPEHV

SEQ ID NO: 676157 - protein, 9 aa, Homo Sapiens
LLHGVAQLT

SEQ ID NO: 676158 - protein, 9 aa, Homo Sapiens
DEMKEYCPI

SEQ ID NO: 676159 - protein, 9 aa, Homo Sapiens
AVVARALYE

SEQ ID NO: 676160 - protein, 9 aa, Homo Sapiens
CPGGYTGKY

SEQ ID NO: 676161 - protein, 9 aa, Homo Sapiens
TTVSRKKKE

SEQ ID NO: 676162 - protein, 9 aa, Homo Sapiens
QAAATCEYH

SEQ ID NO: 676163 - protein, 9 aa, Homo Sapiens
TIVGDAFGW

SEQ ID NO: 676164 - protein, 9 aa, Homo Sapiens
MGLTQGSFA

SEQ ID NO: 676165 - protein, 9 aa, Homo Sapiens
LLIEQLKWI

SEQ ID NO: 676166 - protein, 9 aa, Homo Sapiens
TFCKYPGIP

SEQ ID NO: 676167 - protein, 9 aa, Homo Sapiens
QPAEPRDLQ

SEQ ID NO: 676168 - protein, 9 aa, Homo Sapiens
PSSREMPEP

SEQ ID NO: 676169 - protein, 9 aa, Homo Sapiens
WNWIQLNLD

SEQ ID NO: 676170 - protein, 9 aa, Homo Sapiens
SRKKKETEM

SEQ ID NO: 676171 - protein, 9 aa, Homo Sapiens
RAGTLLGEV

SEQ ID NO: 676172 - protein, 9 aa, Homo Sapiens
TCASCLSNI

SEQ ID NO: 676173 - protein, 9 aa, Homo Sapiens
AALLLLLCF

SEQ ID NO: 676174 - protein, 9 aa, Homo Sapiens
VGDAFGWGF

SEQ ID NO: 676175 - protein, 9 aa, Homo Sapiens
TDDRAVGGA

SEQ ID NO: 676176 - protein, 9 aa, Homo Sapiens
LQAMCWKEG

SEQ ID NO: 676177 - protein, 9 aa, Homo Sapiens
RQGPHILVD

SEQ ID NO: 676178 - protein, 9 aa, Homo Sapiens
TFLCPVLKQ

SEQ ID NO: 676179 - protein, 9 aa, Homo Sapiens
PVHVRSSSS

SEQ ID NO: 676180 - protein, 9 aa, Homo Sapiens
LEQRHGTQQ

SEQ ID NO: 676181 - protein, 9 aa, Homo Sapiens
TGARPKTDD

SEQ ID NO: 676182 - protein, 9 aa, Homo Sapiens
IIKLFVQKG

SEQ ID NO: 676183 - protein, 9 aa, Homo Sapiens
KSEKIMLAI

SEQ ID NO: 676184 - protein, 9 aa, Homo Sapiens
NSTVDSNGV

SEQ ID NO: 676185 - protein, 9 aa, Homo Sapiens
SPQEPRNML

SEQ ID NO: 676186 - protein, 9 aa, Homo Sapiens
YDQITLKSM

SEQ ID NO: 676187 - protein, 9 aa, Homo Sapiens
NQSPAALTF

SEQ ID NO: 676188 - protein, 9 aa, Homo Sapiens
GVYTVRFKN

SEQ ID NO: 676189 - protein, 9 aa, Homo Sapiens
LQLSLQKCW

SEQ ID NO: 676190 - protein, 9 aa, Homo Sapiens
CKVRYSQLH

SEQ ID NO: 676191 - protein, 9 aa, Homo Sapiens
VEQCFATQT

SEQ ID NO: 676192 - protein, 9 aa, Homo Sapiens
GSSIYNGCQ

SEQ ID NO: 676193 - protein, 9 aa, Homo Sapiens
SGPPEESVQ

SEQ ID NO: 676194 - protein, 9 aa, Homo Sapiens
KEEPLIVTP

SEQ ID NO: 676195 - protein, 9 aa, Homo Sapiens
VLICHLEHG

SEQ ID NO: 676196 - protein, 9 aa, Homo Sapiens
ANNQSPAAL

SEQ ID NO: 676197 - protein, 9 aa, Homo Sapiens
AGRSPEATS

SEQ ID NO: 676198 - protein, 9 aa, Homo Sapiens
QHLKQFLGH

SEQ ID NO: 676199 - protein, 9 aa, Homo Sapiens
LSALETKSV

SEQ ID NO: 676200 - protein, 9 aa, Homo Sapiens
AFSPYALWQ

SEQ ID NO: 676201 - protein, 9 aa, Homo Sapiens
EFNHRLVVL

SEQ ID NO: 676202 - protein, 9 aa, Homo Sapiens
MSASFSNSN

SEQ ID NO: 676203 - protein, 9 aa, Homo Sapiens
KTLNGIHLA

SEQ ID NO: 676204 - protein, 9 aa, Homo Sapiens
NYKEEPLIV

SEQ ID NO: 676205 - protein, 9 aa, Homo Sapiens
RNWSNTPIL

SEQ ID NO: 676206 - protein, 9 aa, Homo Sapiens
DIAFYCCSD

SEQ ID NO: 676207 - protein, 9 aa, Homo Sapiens
FRGCNDSDV

SEQ ID NO: 676208 - protein, 9 aa, Homo Sapiens
YPRAVLMLP

SEQ ID NO: 676209 - protein, 9 aa, Homo Sapiens
QSVLKILGQ

SEQ ID NO: 676210 - protein, 9 aa, Homo Sapiens
NRFYAGGEH

SEQ ID NO: 676211 - protein, 9 aa, Homo Sapiens
AFSMDEPVQ

SEQ ID NO: 676212 - protein, 9 aa, Homo Sapiens
NKGFKGERE

SEQ ID NO: 676213 - protein, 9 aa, Homo Sapiens
LMRLKVKDV

SEQ ID NO: 676214 - protein, 9 aa, Homo Sapiens
QFLGHPHHN

SEQ ID NO: 676215 - protein, 9 aa, Homo Sapiens
KGQRGRLPS

SEQ ID NO: 676216 - protein, 9 aa, Homo Sapiens
NHEKPVLPP

SEQ ID NO: 676217 - protein, 9 aa, Homo Sapiens
LYTEKIVCV

SEQ ID NO: 676218 - protein, 9 aa, Homo Sapiens
NYYGAVNQS

SEQ ID NO: 676219 - protein, 9 aa, Homo Sapiens
KERALDDAQ

SEQ ID NO: 676220 - protein, 9 aa, Homo Sapiens
MKPAKIEHN

SEQ ID NO: 676221 - protein, 9 aa, Homo Sapiens
VPTVRWMKD

SEQ ID NO: 676222 - protein, 9 aa, Homo Sapiens
ETLGKLASE

SEQ ID NO: 676223 - protein, 9 aa, Homo Sapiens
GPVHVRSSS

SEQ ID NO: 676224 - protein, 9 aa, Homo Sapiens
VGACGVGKS

SEQ ID NO: 676225 - protein, 9 aa, Homo Sapiens
ECMLLAVMA

SEQ ID NO: 676226 - protein, 9 aa, Homo Sapiens
PYLPDLWLE

SEQ ID NO: 676227 - protein, 9 aa, Homo Sapiens
AGSTGLGGP

SEQ ID NO: 676228 - protein, 9 aa, Homo Sapiens
YSSYLTRTA

SEQ ID NO: 676229 - protein, 9 aa, Homo Sapiens
KITEPLLEG

SEQ ID NO: 676230 - protein, 9 aa, Homo Sapiens
FFCCHHQGG

SEQ ID NO: 676231 - protein, 9 aa, Homo Sapiens
GTPLHHAAE

SEQ ID NO: 676232 - protein, 9 aa, Homo Sapiens
EGDHSLSWT

SEQ ID NO: 676233 - protein, 9 aa, Homo Sapiens
PRAVLMLPF

SEQ ID NO: 676234 - protein, 9 aa, Homo Sapiens
ASGVMSSPP

SEQ ID NO: 676235 - protein, 9 aa, Homo Sapiens
EGTWAWDKA

SEQ ID NO: 676236 - protein, 9 aa, Homo Sapiens
LLAKQYFSS

SEQ ID NO: 676237 - protein, 9 aa, Homo Sapiens
TQPPSILNG

SEQ ID NO: 676238 - protein, 9 aa, Homo Sapiens
GRPCLSLVK

SEQ ID NO: 676239 - protein, 9 aa, Homo Sapiens
DLRLIYSSY

SEQ ID NO: 676240 - protein, 9 aa, Homo Sapiens
QRPESPLQR

SEQ ID NO: 676241 - protein, 9 aa, Homo Sapiens
LFQIPHAHQ

SEQ ID NO: 676242 - protein, 9 aa, Homo Sapiens
WILTILLAY

SEQ ID NO: 676243 - protein, 9 aa, Homo Sapiens
NKIHGEIDI

SEQ ID NO: 676244 - protein, 9 aa, Homo Sapiens
QRAQPAPPG

SEQ ID NO: 676245 - protein, 9 aa, Homo Sapiens
KVSFGDSAS

SEQ ID NO: 676246 - protein, 9 aa, Homo Sapiens
MKIDCHKDE

SEQ ID NO: 676247 - protein, 9 aa, Homo Sapiens
LAPSQGRPC

SEQ ID NO: 676248 - protein, 9 aa, Homo Sapiens
RNLMASQPL

SEQ ID NO: 676249 - protein, 9 aa, Homo Sapiens
EDSLGLTIK

SEQ ID NO: 676250 - protein, 9 aa, Homo Sapiens
TNHTACAHC

SEQ ID NO: 676251 - protein, 9 aa, Homo Sapiens
ESQNGTILV

SEQ ID NO: 676252 - protein, 9 aa, Homo Sapiens
MSSGSQHNN

SEQ ID NO: 676253 - protein, 9 aa, Homo Sapiens
FEVVWEAIK

SEQ ID NO: 676254 - protein, 9 aa, Homo Sapiens
SVFPRTSIS

SEQ ID NO: 676255 - protein, 9 aa, Homo Sapiens
NKHVRIHTG

SEQ ID NO: 676256 - protein, 9 aa, Homo Sapiens
SMTQLHATD

SEQ ID NO: 676257 - protein, 9 aa, Homo Sapiens
GAPSGCYCK

SEQ ID NO: 676258 - protein, 9 aa, Homo Sapiens
FYAGGEHYR

SEQ ID NO: 676259 - protein, 9 aa, Homo Sapiens
PSNTKWSLL

SEQ ID NO: 676260 - protein, 9 aa, Homo Sapiens
MNYQQQLDN

SEQ ID NO: 676261 - protein, 9 aa, Homo Sapiens
QKSEKLDEH

SEQ ID NO: 676262 - protein, 9 aa, Homo Sapiens
PILMEGLTT

SEQ ID NO: 676263 - protein, 9 aa, Homo Sapiens
PGPRGPLLP

SEQ ID NO: 676264 - protein, 9 aa, Homo Sapiens
WEAIKPGSS

SEQ ID NO: 676265 - protein, 9 aa, Homo Sapiens
LNTCVFNNQ

SEQ ID NO: 676266 - protein, 9 aa, Homo Sapiens
NLDLDSIIS

SEQ ID NO: 676267 - protein, 9 aa, Homo Sapiens
QEDSNSCIN

SEQ ID NO: 676268 - protein, 9 aa, Homo Sapiens
EHLNAAIRK

SEQ ID NO: 676269 - protein, 9 aa, Homo Sapiens
PVKPREPCT

SEQ ID NO: 676270 - protein, 9 aa, Homo Sapiens
LEKGAPPPG

SEQ ID NO: 676271 - protein, 9 aa, Homo Sapiens
LNPSALLFR

SEQ ID NO: 676272 - protein, 9 aa, Homo Sapiens
QNVFSWLQW

SEQ ID NO: 676273 - protein, 9 aa, Homo Sapiens
LFVGTMDLL

SEQ ID NO: 676274 - protein, 9 aa, Homo Sapiens
KDALLLHSF

SEQ ID NO: 676275 - protein, 9 aa, Homo Sapiens
RKASLEISP

SEQ ID NO: 676276 - protein, 9 aa, Homo Sapiens
RSDKLTRHY

SEQ ID NO: 676277 - protein, 9 aa, Homo Sapiens
LTTGMSIYS

SEQ ID NO: 676278 - protein, 9 aa, Homo Sapiens
LQRHLAVLS

SEQ ID NO: 676279 - protein, 9 aa, Homo Sapiens
KSTEVWASS

SEQ ID NO: 676280 - protein, 9 aa, Homo Sapiens
IYKYFYVSA

SEQ ID NO: 676281 - protein, 9 aa, Homo Sapiens
EKIMKLSLP

SEQ ID NO: 676282 - protein, 9 aa, Homo Sapiens
RNSAIVCAD

SEQ ID NO: 676283 - protein, 9 aa, Homo Sapiens
VKAISGVYT

SEQ ID NO: 676284 - protein, 9 aa, Homo Sapiens
QDPKILQMV

SEQ ID NO: 676285 - protein, 9 aa, Homo Sapiens
SPAVQAVLL

SEQ ID NO: 676286 - protein, 9 aa, Homo Sapiens
KIVCVVPSE

SEQ ID NO: 676287 - protein, 9 aa, Homo Sapiens
KTHIIILAT

SEQ ID NO: 676288 - protein, 9 aa, Homo Sapiens
MAVTLGLLM

SEQ ID NO: 676289 - protein, 9 aa, Homo Sapiens
TWAWDKASG

SEQ ID NO: 676290 - protein, 9 aa, Homo Sapiens
NSNRTREVV

SEQ ID NO: 676291 - protein, 9 aa, Homo Sapiens
DLPKCKCPG

SEQ ID NO: 676292 - protein, 9 aa, Homo Sapiens
FYEPVMTQS

SEQ ID NO: 676293 - protein, 9 aa, Homo Sapiens
LARFLFKPK

SEQ ID NO: 676294 - protein, 9 aa, Homo Sapiens
SNSCINYEA

SEQ ID NO: 676295 - protein, 9 aa, Homo Sapiens
NTFREQLEE

SEQ ID NO: 676296 - protein, 9 aa, Homo Sapiens
VRAARPEPW

SEQ ID NO: 676297 - protein, 9 aa, Homo Sapiens
HILSQAPTL

SEQ ID NO: 676298 - protein, 9 aa, Homo Sapiens
TLFKRATNS

SEQ ID NO: 676299 - protein, 9 aa, Homo Sapiens
QLKWILTIL

SEQ ID NO: 676300 - protein, 9 aa, Homo Sapiens
SGRTGPPPP

SEQ ID NO: 676301 - protein, 9 aa, Homo Sapiens
APDFEIGHF

SEQ ID NO: 676302 - protein, 9 aa, Homo Sapiens
NGTYVDTGM

SEQ ID NO: 676303 - protein, 9 aa, Homo Sapiens
SMSSRTLHP

SEQ ID NO: 676304 - protein, 9 aa, Homo Sapiens
WMKDDGELP

SEQ ID NO: 676305 - protein, 9 aa, Homo Sapiens
ATASAAYRG

SEQ ID NO: 676306 - protein, 9 aa, Homo Sapiens
YGAVNQSEC

SEQ ID NO: 676307 - protein, 9 aa, Homo Sapiens
VVWEAIKPG

SEQ ID NO: 676308 - protein, 9 aa, Homo Sapiens
DSFVRTLED

SEQ ID NO: 676309 - protein, 9 aa, Homo Sapiens
MPNHQELLG

SEQ ID NO: 676310 - protein, 9 aa, Homo Sapiens
TLGPPPPEG

SEQ ID NO: 676311 - protein, 9 aa, Homo Sapiens
AGVSRRVTL

SEQ ID NO: 676312 - protein, 9 aa, Homo Sapiens
ARPEPWNAL

SEQ ID NO: 676313 - protein, 9 aa, Homo Sapiens
IFSHGTQGL

SEQ ID NO: 676314 - protein, 9 aa, Homo Sapiens
VIVVLLAII

SEQ ID NO: 676315 - protein, 9 aa, Homo Sapiens
VRACTSGDL

SEQ ID NO: 676316 - protein, 9 aa, Homo Sapiens
IPLSKELGF

SEQ ID NO: 676317 - protein, 9 aa, Homo Sapiens
PTKSEKIML

SEQ ID NO: 676318 - protein, 9 aa, Homo Sapiens
GGSDPRLKQ

SEQ ID NO: 676319 - protein, 9 aa, Homo Sapiens
TASGVMSSP

SEQ ID NO: 676320 - protein, 9 aa, Homo Sapiens
WEGKCEENP

SEQ ID NO: 676321 - protein, 9 aa, Homo Sapiens
SLLQPKPGL

SEQ ID NO: 676322 - protein, 9 aa, Homo Sapiens
LKAETLIKL

SEQ ID NO: 676323 - protein, 9 aa, Homo Sapiens
EQRLRVITT

SEQ ID NO: 676324 - protein, 9 aa, Homo Sapiens
EFNARVSLR

SEQ ID NO: 676325 - protein, 9 aa, Homo Sapiens
QHQTENLSQ

SEQ ID NO: 676326 - protein, 9 aa, Homo Sapiens
SIVRRADSA

SEQ ID NO: 676327 - protein, 9 aa, Homo Sapiens
GPAAGVSAA

SEQ ID NO: 676328 - protein, 9 aa, Homo Sapiens
DAQERSVAS

SEQ ID NO: 676329 - protein, 9 aa, Homo Sapiens
SNGRLKCAS

SEQ ID NO: 676330 - protein, 9 aa, Homo Sapiens
PGFEDHLKL

SEQ ID NO: 676331 - protein, 9 aa, Homo Sapiens
RPESPLQRC

SEQ ID NO: 676332 - protein, 9 aa, Homo Sapiens
RCFFLLLLE

SEQ ID NO: 676333 - protein, 9 aa, Homo Sapiens
KPCTGAMGD

SEQ ID NO: 676334 - protein, 9 aa, Homo Sapiens
VLFSTQPPL

SEQ ID NO: 676335 - protein, 9 aa, Homo Sapiens
ILTILLAYQ

SEQ ID NO: 676336 - protein, 9 aa, Homo Sapiens
QRLRVITTN

SEQ ID NO: 676337 - protein, 9 aa, Homo Sapiens
ITVLKTYLD

SEQ ID NO: 676338 - protein, 9 aa, Homo Sapiens
LHIIMGHLQ

SEQ ID NO: 676339 - protein, 9 aa, Homo Sapiens
VVLLAIIQG

SEQ ID NO: 676340 - protein, 9 aa, Homo Sapiens
TEKPGTPIV

SEQ ID NO: 676341 - protein, 9 aa, Homo Sapiens
DNSAAIRAE

SEQ ID NO: 676342 - protein, 9 aa, Homo Sapiens
QRYHFIMAN

SEQ ID NO: 676343 - protein, 9 aa, Homo Sapiens
RADSGEYRA

SEQ ID NO: 676344 - protein, 9 aa, Homo Sapiens
NQAKFFLVG

SEQ ID NO: 676345 - protein, 9 aa, Homo Sapiens
QQLSDLDSS

SEQ ID NO: 676346 - protein, 9 aa, Homo Sapiens
DGPACKGPA

SEQ ID NO: 676347 - protein, 9 aa, Homo Sapiens
TDSLKGQRG

SEQ ID NO: 676348 - protein, 9 aa, Homo Sapiens
ALISLNDLD

SEQ ID NO: 676349 - protein, 9 aa, Homo Sapiens
SIISEVKAQ

SEQ ID NO: 676350 - protein, 9 aa, Homo Sapiens
TPMVPPHSS

SEQ ID NO: 676351 - protein, 9 aa, Homo Sapiens
ARESIAAMV

SEQ ID NO: 676352 - protein, 9 aa, Homo Sapiens
TVIALISLN

SEQ ID NO: 676353 - protein, 9 aa, Homo Sapiens
AFGSKNNAF

SEQ ID NO: 676354 - protein, 9 aa, Homo Sapiens
SVFEVVWEA

SEQ ID NO: 676355 - protein, 9 aa, Homo Sapiens
PSKITEPLL

SEQ ID NO: 676356 - protein, 9 aa, Homo Sapiens
GSVPRARLK

SEQ ID NO: 676357 - protein, 9 aa, Homo Sapiens
DEEKKVRAE

SEQ ID NO: 676358 - protein, 9 aa, Homo Sapiens
GEKNGDAKA

SEQ ID NO: 676359 - protein, 9 aa, Homo Sapiens
PKTDDRAVG

SEQ ID NO: 676360 - protein, 9 aa, Homo Sapiens
EPVGMQKWW

SEQ ID NO: 676361 - protein, 9 aa, Homo Sapiens
WLQWLMITM

SEQ ID NO: 676362 - protein, 9 aa, Homo Sapiens
VVNGDGKSF

SEQ ID NO: 676363 - protein, 9 aa, Homo Sapiens
FHLSDVQHR

SEQ ID NO: 676364 - protein, 9 aa, Homo Sapiens
AEAEYIASK

SEQ ID NO: 676365 - protein, 9 aa, Homo Sapiens
ATVTSILRQ

SEQ ID NO: 676366 - protein, 9 aa, Homo Sapiens
EEPLIVTPP

SEQ ID NO: 676367 - protein, 9 aa, Homo Sapiens
HQTENLSQD

SEQ ID NO: 676368 - protein, 9 aa, Homo Sapiens
NEENDHKVF

SEQ ID NO: 676369 - protein, 9 aa, Homo Sapiens
HLAVLSPQR

SEQ ID NO: 676370 - protein, 9 aa, Homo Sapiens
GVPGQVNAA

SEQ ID NO: 676371 - protein, 9 aa, Homo Sapiens
KDYPCTCIS

SEQ ID NO: 676372 - protein, 9 aa, Homo Sapiens
VLTKNRFYA

SEQ ID NO: 676373 - protein, 9 aa, Homo Sapiens
AAISHAIVR

SEQ ID NO: 676374 - protein, 9 aa, Homo Sapiens
YCCSDGYSL

SEQ ID NO: 676375 - protein, 9 aa, Homo Sapiens
KKMVRMQPS

SEQ ID NO: 676376 - protein, 9 aa, Homo Sapiens
VQHRCFFLL

SEQ ID NO: 676377 - protein, 9 aa, Homo Sapiens
PVGLLRHMQ

SEQ ID NO: 676378 - protein, 9 aa, Homo Sapiens
VSAGSTGLG

SEQ ID NO: 676379 - protein, 9 aa, Homo Sapiens
RPTQLGRLD

SEQ ID NO: 676380 - protein, 9 aa, Homo Sapiens
CCTFCKYPG

SEQ ID NO: 676381 - protein, 9 aa, Homo Sapiens
NSAIVCADV

SEQ ID NO: 676382 - protein, 9 aa, Homo Sapiens
GTVIALISL

SEQ ID NO: 676383 - protein, 9 aa, Homo Sapiens
ELYVYNNMI

SEQ ID NO: 676384 - protein, 9 aa, Homo Sapiens
CCRPPGTRK

SEQ ID NO: 676385 - protein, 9 aa, Homo Sapiens
CLPGLAPPF

SEQ ID NO: 676386 - protein, 9 aa, Homo Sapiens
QFLLSALNA

SEQ ID NO: 676387 - protein, 9 aa, Homo Sapiens
IQFVLNDTD

SEQ ID NO: 676388 - protein, 9 aa, Homo Sapiens
STLTELYVY

SEQ ID NO: 676389 - protein, 9 aa, Homo Sapiens
GRAGTLLGE

SEQ ID NO: 676390 - protein, 9 aa, Homo Sapiens
KQSKTQMMS

SEQ ID NO: 676391 - protein, 9 aa, Homo Sapiens
SLEDAVVAR

SEQ ID NO: 676392 - protein, 9 aa, Homo Sapiens
VPKAVLICH

SEQ ID NO: 676393 - protein, 9 aa, Homo Sapiens
LPDLWLEPA

SEQ ID NO: 676394 - protein, 9 aa, Homo Sapiens
EQCFATQTE

SEQ ID NO: 676395 - protein, 9 aa, Homo Sapiens
SFVRTLEDL

SEQ ID NO: 676396 - protein, 9 aa, Homo Sapiens
QRHLAVLSP

SEQ ID NO: 676397 - protein, 9 aa, Homo Sapiens
IQACTTTPC

SEQ ID NO: 676398 - protein, 9 aa, Homo Sapiens
HKEITSQSD

SEQ ID NO: 676399 - protein, 9 aa, Homo Sapiens
PLPNPVVYT

SEQ ID NO: 676400 - protein, 9 aa, Homo Sapiens
HSLQPSITW

SEQ ID NO: 676401 - protein, 9 aa, Homo Sapiens
SLRYSDGED

SEQ ID NO: 676402 - protein, 9 aa, Homo Sapiens
WMRMRMTWR

SEQ ID NO: 676403 - protein, 9 aa, Homo Sapiens
GQQSVLKIL

SEQ ID NO: 676404 - protein, 9 aa, Homo Sapiens
DLNTCVFNN

SEQ ID NO: 676405 - protein, 9 aa, Homo Sapiens
VPGQVNAAM

SEQ ID NO: 676406 - protein, 9 aa, Homo Sapiens
IPVRSSSFN

SEQ ID NO: 676407 - protein, 9 aa, Homo Sapiens
TLNGIHLAR

SEQ ID NO: 676408 - protein, 9 aa, Homo Sapiens
RDHVVPILI

SEQ ID NO: 676409 - protein, 9 aa, Homo Sapiens
STETLGKLA

SEQ ID NO: 676410 - protein, 9 aa, Homo Sapiens
SLSGTANSR

SEQ ID NO: 676411 - protein, 9 aa, Homo Sapiens
GRLGRAGTL

SEQ ID NO: 676412 - protein, 9 aa, Homo Sapiens
AGEISGATP

SEQ ID NO: 676413 - protein, 9 aa, Homo Sapiens
DQITLKSMA

SEQ ID NO: 676414 - protein, 9 aa, Homo Sapiens
GDHSLSWTL

SEQ ID NO: 676415 - protein, 9 aa, Homo Sapiens
YSYLPFQLL

SEQ ID NO: 676416 - protein, 9 aa, Homo Sapiens
PPEESVQEM

SEQ ID NO: 676417 - protein, 9 aa, Homo Sapiens
LPFQLLASG

SEQ ID NO: 676418 - protein, 9 aa, Homo Sapiens
LSDLDSSVQ

SEQ ID NO: 676419 - protein, 9 aa, Homo Sapiens
PAAGVSAAF

SEQ ID NO: 676420 - protein, 9 aa, Homo Sapiens
YNQKEGHFQ

SEQ ID NO: 676421 - protein, 9 aa, Homo Sapiens
CRQRLEKGA

SEQ ID NO: 676422 - protein, 9 aa, Homo Sapiens
EEFNHRLVV

SEQ ID NO: 676423 - protein, 9 aa, Homo Sapiens
LKRCGLEHR

SEQ ID NO: 676424 - protein, 9 aa, Homo Sapiens
LLTTVSRKK

SEQ ID NO: 676425 - protein, 9 aa, Homo Sapiens
GKVALHDGT

SEQ ID NO: 676426 - protein, 9 aa, Homo Sapiens
SQTIEQSSV

SEQ ID NO: 676427 - protein, 9 aa, Homo Sapiens
RAVLMLPFS

SEQ ID NO: 676428 - protein, 9 aa, Homo Sapiens
LHGVAQLTQ

SEQ ID NO: 676429 - protein, 9 aa, Homo Sapiens
ALRIMELSQ

SEQ ID NO: 676430 - protein, 9 aa, Homo Sapiens
LLEPCWLIL

SEQ ID NO: 676431 - protein, 9 aa, Homo Sapiens
DKYVDSFVR

SEQ ID NO: 676432 - protein, 9 aa, Homo Sapiens
QKLAQRVAM

SEQ ID NO: 676433 - protein, 9 aa, Homo Sapiens
VSTEMGLLE

SEQ ID NO: 676434 - protein, 9 aa, Homo Sapiens
RFARSDKLT

SEQ ID NO: 676435 - protein, 9 aa, Homo Sapiens
DVQSGTEME

SEQ ID NO: 676436 - protein, 9 aa, Homo Sapiens
QKERALDDA

SEQ ID NO: 676437 - protein, 9 aa, Homo Sapiens
RQPGQRQHL

SEQ ID NO: 676438 - protein, 9 aa, Homo Sapiens
SSPPVRALD

SEQ ID NO: 676439 - protein, 9 aa, Homo Sapiens
REHWRSGRT

SEQ ID NO: 676440 - protein, 9 aa, Homo Sapiens
PSTLTELYV

SEQ ID NO: 676441 - protein, 9 aa, Homo Sapiens
ADTELAKDD

SEQ ID NO: 676442 - protein, 9 aa, Homo Sapiens
CKEIFNLFY

SEQ ID NO: 676443 - protein, 9 aa, Homo Sapiens
HIQACTTTP

SEQ ID NO: 676444 - protein, 9 aa, Homo Sapiens
LEPVKVSFG

SEQ ID NO: 676445 - protein, 9 aa, Homo Sapiens
AAATCEYHR

SEQ ID NO: 676446 - protein, 9 aa, Homo Sapiens
LFKRATNSS

SEQ ID NO: 676447 - protein, 9 aa, Homo Sapiens
LFRGCNDSD

SEQ ID NO: 676448 - protein, 9 aa, Homo Sapiens
ADWETPSNT

SEQ ID NO: 676449 - protein, 9 aa, Homo Sapiens
YSKAYGERY

SEQ ID NO: 676450 - protein, 9 aa, Homo Sapiens
VLTVRYSPE

SEQ ID NO: 676451 - protein, 9 aa, Homo Sapiens
IAFYCCSDG

SEQ ID NO: 676452 - protein, 9 aa, Homo Sapiens
KIMKLSLPE

SEQ ID NO: 676453 - protein, 9 aa, Homo Sapiens
LEKILVLDS

SEQ ID NO: 676454 - protein, 9 aa, Homo Sapiens
RELSCKKGA

SEQ ID NO: 676455 - protein, 9 aa, Homo Sapiens
AATINQATA

SEQ ID NO: 676456 - protein, 9 aa, Homo Sapiens
CCCTFCKYP

SEQ ID NO: 676457 - protein, 9 aa, Homo Sapiens
WTAGTAAAR

SEQ ID NO: 676458 - protein, 9 aa, Homo Sapiens
IGWRALVHL

SEQ ID NO: 676459 - protein, 9 aa, Homo Sapiens
KFLNMLSPR

SEQ ID NO: 676460 - protein, 9 aa, Homo Sapiens
CPALQRTHS

SEQ ID NO: 676461 - protein, 9 aa, Homo Sapiens
KNNAFCTHV

SEQ ID NO: 676462 - protein, 9 aa, Homo Sapiens
PGSKFAGYS

SEQ ID NO: 676463 - protein, 9 aa, Homo Sapiens
SMDEPVQLR

SEQ ID NO: 676464 - protein, 9 aa, Homo Sapiens
QTIEQSSVW

SEQ ID NO: 676465 - protein, 9 aa, Homo Sapiens
LAVLAPYLQ

SEQ ID NO: 676466 - protein, 9 aa, Homo Sapiens
KIAEPLHLP

SEQ ID NO: 676467 - protein, 9 aa, Homo Sapiens
DSAAVPIVN

SEQ ID NO: 676468 - protein, 9 aa, Homo Sapiens
QLGRLDSSV

SEQ ID NO: 676469 - protein, 9 aa, Homo Sapiens
QFNRALFTL

SEQ ID NO: 676470 - protein, 9 aa, Homo Sapiens
RQEFYEPVM

SEQ ID NO: 676471 - protein, 9 aa, Homo Sapiens
PCLSLVKEN

SEQ ID NO: 676472 - protein, 9 aa, Homo Sapiens
EKIVCVVPS

SEQ ID NO: 676473 - protein, 9 aa, Homo Sapiens
PVQFIPTNT

SEQ ID NO: 676474 - protein, 9 aa, Homo Sapiens
GVYDIQTWV

SEQ ID NO: 676475 - protein, 9 aa, Homo Sapiens
EAVDSREVN

SEQ ID NO: 676476 - protein, 9 aa, Homo Sapiens
HAAENGQME

SEQ ID NO: 676477 - protein, 9 aa, Homo Sapiens
YKKLITVLK

SEQ ID NO: 676478 - protein, 9 aa, Homo Sapiens
PDLVNVIND

SEQ ID NO: 676479 - protein, 9 aa, Homo Sapiens
NVKPRPCFH

SEQ ID NO: 676480 - protein, 9 aa, Homo Sapiens
TLIEEGDHS

SEQ ID NO: 676481 - protein, 9 aa, Homo Sapiens
SAFSPYALW

SEQ ID NO: 676482 - protein, 9 aa, Homo Sapiens
EERFQLFES

SEQ ID NO: 676483 - protein, 9 aa, Homo Sapiens
FLFKPKYAY

SEQ ID NO: 676484 - protein, 9 aa, Homo Sapiens
ENLSQDQEH

SEQ ID NO: 676485 - protein, 9 aa, Homo Sapiens
KLFVQKGVS

SEQ ID NO: 676486 - protein, 9 aa, Homo Sapiens
GLWNLSRNG

SEQ ID NO: 676487 - protein, 9 aa, Homo Sapiens
HRALLFKAV

SEQ ID NO: 676488 - protein, 9 aa, Homo Sapiens
RLQQITNSQ

SEQ ID NO: 676489 - protein, 9 aa, Homo Sapiens
TVRWMKDDG

SEQ ID NO: 676490 - protein, 9 aa, Homo Sapiens
LYVYNNMIA

SEQ ID NO: 676491 - protein, 9 aa, Homo Sapiens
RPCFYLNCK

SEQ ID NO: 676492 - protein, 9 aa, Homo Sapiens
GSPAVQAVL

SEQ ID NO: 676493 - protein, 9 aa, Homo Sapiens
AKVLAVDAD

SEQ ID NO: 676494 - protein, 9 aa, Homo Sapiens
SKVTLKRNL

SEQ ID NO: 676495 - protein, 9 aa, Homo Sapiens
SNPLVPPEP

SEQ ID NO: 676496 - protein, 9 aa, Homo Sapiens
WCYQWKFYI

SEQ ID NO: 676497 - protein, 9 aa, Homo Sapiens
VDSNGVVSL

SEQ ID NO: 676498 - protein, 9 aa, Homo Sapiens
CVQNSPQEP

SEQ ID NO: 676499 - protein, 9 aa, Homo Sapiens
AEWMRMRMT

SEQ ID NO: 676500 - protein, 9 aa, Homo Sapiens
MKKLWRDFV

SEQ ID NO: 676501 - protein, 9 aa, Homo Sapiens
EYWKRLARV

SEQ ID NO: 676502 - protein, 9 aa, Homo Sapiens
LLLELQNVF

SEQ ID NO: 676503 - protein, 9 aa, Homo Sapiens
ACTDTLAIV

SEQ ID NO: 676504 - protein, 9 aa, Homo Sapiens
LDNSAAIRA

SEQ ID NO: 676505 - protein, 9 aa, Homo Sapiens
GVAFLIPYA

SEQ ID NO: 676506 - protein, 9 aa, Homo Sapiens
SHPFAPSIC

SEQ ID NO: 676507 - protein, 9 aa, Homo Sapiens
LQAKPLLGD

SEQ ID NO: 676508 - protein, 9 aa, Homo Sapiens
PPPLGGKEC

SEQ ID NO: 676509 - protein, 9 aa, Homo Sapiens
TQMMSDGTS

SEQ ID NO: 676510 - protein, 9 aa, Homo Sapiens
SMVRQAALR

SEQ ID NO: 676511 - protein, 9 aa, Homo Sapiens
IKLFVQKGV

SEQ ID NO: 676512 - protein, 9 aa, Homo Sapiens
IYPLYFFLN

SEQ ID NO: 676513 - protein, 9 aa, Homo Sapiens
RYHFIMANH

SEQ ID NO: 676514 - protein, 9 aa, Homo Sapiens
YTEKIVCVV

SEQ ID NO: 676515 - protein, 9 aa, Homo Sapiens
GRNHQGSKR

SEQ ID NO: 676516 - protein, 9 aa, Homo Sapiens
SKPVAVEQT

SEQ ID NO: 676517 - protein, 9 aa, Homo Sapiens
VKIQDPKIL

SEQ ID NO: 676518 - protein, 9 aa, Homo Sapiens
ATAAEHLNA

SEQ ID NO: 676519 - protein, 9 aa, Homo Sapiens
PMAVTLGLL

SEQ ID NO: 676520 - protein, 9 aa, Homo Sapiens
EPLHLPPRP

SEQ ID NO: 676521 - protein, 9 aa, Homo Sapiens
PLTLSLHCW

SEQ ID NO: 676522 - protein, 9 aa, Homo Sapiens
WRDFVNSRE

SEQ ID NO: 676523 - protein, 9 aa, Homo Sapiens
YIASKLDIQ

SEQ ID NO: 676524 - protein, 9 aa, Homo Sapiens
YVYNNMIAK

SEQ ID NO: 676525 - protein, 9 aa, Homo Sapiens
IITQINGNY

SEQ ID NO: 676526 - protein, 9 aa, Homo Sapiens
DVVSLQCEP

SEQ ID NO: 676527 - protein, 9 aa, Homo Sapiens
RIMELSQEL

SEQ ID NO: 676528 - protein, 9 aa, Homo Sapiens
IAYPRAVLM

SEQ ID NO: 676529 - protein, 9 aa, Homo Sapiens
PNSVRQRPI

SEQ ID NO: 676530 - protein, 9 aa, Homo Sapiens
RILYTEKIV

SEQ ID NO: 676531 - protein, 9 aa, Homo Sapiens
ATSQTIEQS

SEQ ID NO: 676532 - protein, 9 aa, Homo Sapiens
CGVGKSALT

SEQ ID NO: 676533 - protein, 9 aa, Homo Sapiens
TASAAYRGA

SEQ ID NO: 676534 - protein, 9 aa, Homo Sapiens
IAAMVDEQK

SEQ ID NO: 676535 - protein, 9 aa, Homo Sapiens
YSRNLVSDI

SEQ ID NO: 676536 - protein, 9 aa, Homo Sapiens
HFANNQSPA

SEQ ID NO: 676537 - protein, 9 aa, Homo Sapiens
GKNQAKFFL

SEQ ID NO: 676538 - protein, 9 aa, Homo Sapiens
RNGRGIGKR

SEQ ID NO: 676539 - protein, 9 aa, Homo Sapiens
IMGHLQLVD

SEQ ID NO: 676540 - protein, 9 aa, Homo Sapiens
TMNMGSLER

SEQ ID NO: 676541 - protein, 9 aa, Homo Sapiens
LKFLNMLSP

SEQ ID NO: 676542 - protein, 9 aa, Homo Sapiens
GLLEQLDII

SEQ ID NO: 676543 - protein, 9 aa, Homo Sapiens
VIALISLND

SEQ ID NO: 676544 - protein, 9 aa, Homo Sapiens
ETLIKLSDY

SEQ ID NO: 676545 - protein, 9 aa, Homo Sapiens
ITYIACLMK

SEQ ID NO: 676546 - protein, 9 aa, Homo Sapiens
WVQQQIRPI

SEQ ID NO: 676547 - protein, 9 aa, Homo Sapiens
ALSHPVVQR

SEQ ID NO: 676548 - protein, 9 aa, Homo Sapiens
NGRLKCASS

SEQ ID NO: 676549 - protein, 9 aa, Homo Sapiens
FAPSICFLK

SEQ ID NO: 676550 - protein, 9 aa, Homo Sapiens
LEGPEEEPL

SEQ ID NO: 676551 - protein, 9 aa, Homo Sapiens
FMGNLKNKC

SEQ ID NO: 676552 - protein, 9 aa, Homo Sapiens
TLLARPRRA

SEQ ID NO: 676553 - protein, 9 aa, Homo Sapiens
TFTIVGDAF

SEQ ID NO: 676554 - protein, 9 aa, Homo Sapiens
EESVQEMME

SEQ ID NO: 676555 - protein, 9 aa, Homo Sapiens
GAVNQSECE

SEQ ID NO: 676556 - protein, 9 aa, Homo Sapiens
DEESQNGTI

SEQ ID NO: 676557 - protein, 9 aa, Homo Sapiens
DTLFKRATN

SEQ ID NO: 676558 - protein, 9 aa, Homo Sapiens
YSDHPLNLS

SEQ ID NO: 676559 - protein, 9 aa, Homo Sapiens
LPYLPDLWL

SEQ ID NO: 676560 - protein, 9 aa, Homo Sapiens
SCKKGASLL

SEQ ID NO: 676561 - protein, 9 aa, Homo Sapiens
ERVRPLKST

SEQ ID NO: 676562 - protein, 9 aa, Homo Sapiens
EMRNGRGIG

SEQ ID NO: 676563 - protein, 9 aa, Homo Sapiens
IPSVFPRTS

SEQ ID NO: 676564 - protein, 9 aa, Homo Sapiens
LGCPVPKAV

SEQ ID NO: 676565 - protein, 9 aa, Homo Sapiens
HQHRDSYLG

SEQ ID NO: 676566 - protein, 9 aa, Homo Sapiens
CPIMFESWL

SEQ ID NO: 676567 - protein, 9 aa, Homo Sapiens
QLFESDIVN

SEQ ID NO: 676568 - protein, 9 aa, Homo Sapiens
FGWGFVVRG

SEQ ID NO: 676569 - protein, 9 aa, Homo Sapiens
LEAADTQDL

SEQ ID NO: 676570 - protein, 9 aa, Homo Sapiens
VDKHSPKVV

SEQ ID NO: 676571 - protein, 9 aa, Homo Sapiens
GWMDIMYEA

SEQ ID NO: 676572 - protein, 9 aa, Homo Sapiens
LNDLDSGAN

SEQ ID NO: 676573 - protein, 9 aa, Homo Sapiens
FVPYRHSKL

SEQ ID NO: 676574 - protein, 9 aa, Homo Sapiens
QPITCSPDA

SEQ ID NO: 676575 - protein, 9 aa, Homo Sapiens
EPWNALLRR

SEQ ID NO: 676576 - protein, 9 aa, Homo Sapiens
MVPPHSSLG

SEQ ID NO: 676577 - protein, 9 aa, Homo Sapiens
TINQATALK

SEQ ID NO: 676578 - protein, 9 aa, Homo Sapiens
DNLWKCNCQ

SEQ ID NO: 676579 - protein, 9 aa, Homo Sapiens
ASCQALPWG

SEQ ID NO: 676580 - protein, 9 aa, Homo Sapiens
SFQDYGACM

SEQ ID NO: 676581 - protein, 9 aa, Homo Sapiens
QHNLAVWIL

SEQ ID NO: 676582 - protein, 9 aa, Homo Sapiens
VCVVPSECE

SEQ ID NO: 676583 - protein, 9 aa, Homo Sapiens
DVWILVLSG

SEQ ID NO: 676584 - protein, 9 aa, Homo Sapiens
RADRISSTF

SEQ ID NO: 676585 - protein, 9 aa, Homo Sapiens
EHIEPPTQE

SEQ ID NO: 676586 - protein, 9 aa, Homo Sapiens
NLSFGLSFD

SEQ ID NO: 676587 - protein, 9 aa, Homo Sapiens
KNMAMTGGS

SEQ ID NO: 676588 - protein, 9 aa, Homo Sapiens
VYDIQTWVP

SEQ ID NO: 676589 - protein, 9 aa, Homo Sapiens
QTSKPVAVE

SEQ ID NO: 676590 - protein, 9 aa, Homo Sapiens
SFASCQALP

SEQ ID NO: 676591 - protein, 9 aa, Homo Sapiens
SHPVVQRRL

SEQ ID NO: 676592 - protein, 9 aa, Homo Sapiens
CIAQLYVFL

SEQ ID NO: 676593 - protein, 9 aa, Homo Sapiens
LTTSKSRSC

SEQ ID NO: 676594 - protein, 9 aa, Homo Sapiens
KRNCNLTQI

SEQ ID NO: 676595 - protein, 9 aa, Homo Sapiens
MRMTWRKNT

SEQ ID NO: 676596 - protein, 9 aa, Homo Sapiens
EISGATPVL

SEQ ID NO: 676597 - protein, 9 aa, Homo Sapiens
VTKRNCNLT

SEQ ID NO: 676598 - protein, 9 aa, Homo Sapiens
SFVPYRHSK

SEQ ID NO: 676599 - protein, 9 aa, Homo Sapiens
LEMGLTQGS

SEQ ID NO: 676600 - protein, 9 aa, Homo Sapiens
QLNKENKTC

SEQ ID NO: 676601 - protein, 9 aa, Homo Sapiens
DAFGWGFVV

SEQ ID NO: 676602 - protein, 9 aa, Homo Sapiens
AVTLGLLME

SEQ ID NO: 676603 - protein, 9 aa, Homo Sapiens
KGPALLHSQ

SEQ ID NO: 676604 - protein, 9 aa, Homo Sapiens
ATEARPLRK

SEQ ID NO: 676605 - protein, 9 aa, Homo Sapiens
KVSTAGEIS

SEQ ID NO: 676606 - protein, 9 aa, Homo Sapiens
ILVLDSDKR

SEQ ID NO: 676607 - protein, 9 aa, Homo Sapiens
GTYVDTGMD

SEQ ID NO: 676608 - protein, 9 aa, Homo Sapiens
QKEKQPELP

SEQ ID NO: 676609 - protein, 9 aa, Homo Sapiens
STGLGGPLG

SEQ ID NO: 676610 - protein, 9 aa, Homo Sapiens
FVRTLEDLT

SEQ ID NO: 676611 - protein, 9 aa, Homo Sapiens
IGVYDIQTW

SEQ ID NO: 676612 - protein, 9 aa, Homo Sapiens
QPCTPPHQP

SEQ ID NO: 676613 - protein, 9 aa, Homo Sapiens
LDKGLATSL

SEQ ID NO: 676614 - protein, 9 aa, Homo Sapiens
HSADGLTAS

SEQ ID NO: 676615 - protein, 9 aa, Homo Sapiens
GLEHRVYLV

SEQ ID NO: 676616 - protein, 9 aa, Homo Sapiens
SISWQKINP

SEQ ID NO: 676617 - protein, 9 aa, Homo Sapiens
FGSKNNAFC

SEQ ID NO: 676618 - protein, 9 aa, Homo Sapiens
EARPLRKSS

SEQ ID NO: 676619 - protein, 9 aa, Homo Sapiens
GPPPPLGGK

SEQ ID NO: 676620 - protein, 9 aa, Homo Sapiens
NTKWSLLME

SEQ ID NO: 676621 - protein, 9 aa, Homo Sapiens
LTYSNGGVA

SEQ ID NO: 676622 - protein, 9 aa, Homo Sapiens
LAPPFCNTP

SEQ ID NO: 676623 - protein, 9 aa, Homo Sapiens
HILVDGVSG

SEQ ID NO: 676624 - protein, 9 aa, Homo Sapiens
TSILRQTLF

SEQ ID NO: 676625 - protein, 9 aa, Homo Sapiens
PLIVTPPTK

SEQ ID NO: 676626 - protein, 9 aa, Homo Sapiens
KEKQPELPE

SEQ ID NO: 676627 - protein, 9 aa, Homo Sapiens
YSMSSRTLH

SEQ ID NO: 676628 - protein, 9 aa, Homo Sapiens
TAPGPGACV

SEQ ID NO: 676629 - protein, 9 aa, Homo Sapiens
FEDHLKLHG

SEQ ID NO: 676630 - protein, 9 aa, Homo Sapiens
RQHLSDAQR

SEQ ID NO: 676631 - protein, 9 aa, Homo Sapiens
PNPVVYTLR

SEQ ID NO: 676632 - protein, 9 aa, Homo Sapiens
VVKAISGVY

SEQ ID NO: 676633 - protein, 9 aa, Homo Sapiens
KVALHDGTQ

SEQ ID NO: 676634 - protein, 9 aa, Homo Sapiens
PYPVVKELV

SEQ ID NO: 676635 - protein, 9 aa, Homo Sapiens
ISKSKVDKH

SEQ ID NO: 676636 - protein, 9 aa, Homo Sapiens
GPPSSREMP

SEQ ID NO: 676637 - protein, 9 aa, Homo Sapiens
LQAHNWQGL

SEQ ID NO: 676638 - protein, 9 aa, Homo Sapiens
KAKDISPIV

SEQ ID NO: 676639 - protein, 9 aa, Homo Sapiens
WVMPNHQEL

SEQ ID NO: 676640 - protein, 9 aa, Homo Sapiens
LPQHLKQFL

SEQ ID NO: 676641 - protein, 9 aa, Homo Sapiens
GSDVQSGTE

SEQ ID NO: 676642 - protein, 9 aa, Homo Sapiens
PNHQELLGP

SEQ ID NO: 676643 - protein, 9 aa, Homo Sapiens
FLLLLELQN

SEQ ID NO: 676644 - protein, 9 aa, Homo Sapiens
QGRLSTETL

SEQ ID NO: 676645 - protein, 9 aa, Homo Sapiens
LRRGTDAAT

SEQ ID NO: 676646 - protein, 9 aa, Homo Sapiens
NSPGQQSVL

SEQ ID NO: 676647 - protein, 9 aa, Homo Sapiens
SISPFRFAK

SEQ ID NO: 676648 - protein, 9 aa, Homo Sapiens
GTQGLLRKK

SEQ ID NO: 676649 - protein, 9 aa, Homo Sapiens
FVLNDTDTC

SEQ ID NO: 676650 - protein, 9 aa, Homo Sapiens
TQVDHILSQ

SEQ ID NO: 676651 - protein, 9 aa, Homo Sapiens
YSPDRDREC

SEQ ID NO: 676652 - protein, 9 aa, Homo Sapiens
DNVKPRPCF

SEQ ID NO: 676653 - protein, 9 aa, Homo Sapiens
RPCCRPPGT

SEQ ID NO: 676654 - protein, 9 aa, Homo Sapiens
VQPAEPRDL

SEQ ID NO: 676655 - protein, 9 aa, Homo Sapiens
HYSPDRDRE

SEQ ID NO: 676656 - protein, 9 aa, Homo Sapiens
YHLLHSGLL

SEQ ID NO: 676657 - protein, 9 aa, Homo Sapiens
AKATQFNRA

SEQ ID NO: 676658 - protein, 9 aa, Homo Sapiens
RHFANNQSP

SEQ ID NO: 676659 - protein, 9 aa, Homo Sapiens
KDTFLCPVL

SEQ ID NO: 676660 - protein, 9 aa, Homo Sapiens
IGQGRLSTE

SEQ ID NO: 676661 - protein, 9 aa, Homo Sapiens
IVRRADSAA

SEQ ID NO: 676662 - protein, 9 aa, Homo Sapiens
ERLSFYQTG

SEQ ID NO: 676663 - protein, 9 aa, Homo Sapiens
VALRNWSNT

SEQ ID NO: 676664 - protein, 9 aa, Homo Sapiens
PFQLLASGM

SEQ ID NO: 676665 - protein, 9 aa, Homo Sapiens
LLGYGLKSK

SEQ ID NO: 676666 - protein, 9 aa, Homo Sapiens
VRNHRKASL

SEQ ID NO: 676667 - protein, 9 aa, Homo Sapiens
RVSYRPTQL

SEQ ID NO: 676668 - protein, 9 aa, Homo Sapiens
AFGWGFVVR

SEQ ID NO: 676669 - protein, 9 aa, Homo Sapiens
NSQAEIYQK

SEQ ID NO: 676670 - protein, 9 aa, Homo Sapiens
DDAQERSVA

SEQ ID NO: 676671 - protein, 9 aa, Homo Sapiens
SPDRDRECE

SEQ ID NO: 676672 - protein, 9 aa, Homo Sapiens
GKEDDEIKE

SEQ ID NO: 676673 - protein, 9 aa, Homo Sapiens
DEDATVNHQ

SEQ ID NO: 676674 - protein, 9 aa, Homo Sapiens
TEFVIGNEY

SEQ ID NO: 676675 - protein, 9 aa, Homo Sapiens
GPPEESVQE

SEQ ID NO: 676676 - protein, 9 aa, Homo Sapiens
YLQLEGHRL

SEQ ID NO: 676677 - protein, 9 aa, Homo Sapiens
EEIFHPEKP

SEQ ID NO: 676678 - protein, 9 aa, Homo Sapiens
CQLGSSIYN

SEQ ID NO: 676679 - protein, 9 aa, Homo Sapiens
PPPRGLWKA

SEQ ID NO: 676680 - protein, 9 aa, Homo Sapiens
PPSILNGLD

SEQ ID NO: 676681 - protein, 9 aa, Homo Sapiens
IMANHEKPV

SEQ ID NO: 676682 - protein, 9 aa, Homo Sapiens
SAIVCADVW

SEQ ID NO: 676683 - protein, 9 aa, Homo Sapiens
TNTLNLRSF

SEQ ID NO: 676684 - protein, 9 aa, Homo Sapiens
YVPFFAANT

SEQ ID NO: 676685 - protein, 9 aa, Homo Sapiens
MLLAVMAYD

SEQ ID NO: 676686 - protein, 9 aa, Homo Sapiens
NGRGIGKRM

SEQ ID NO: 676687 - protein, 9 aa, Homo Sapiens
SSVQKTVAP

SEQ ID NO: 676688 - protein, 9 aa, Homo Sapiens
SPFRFAKEA

SEQ ID NO: 676689 - protein, 9 aa, Homo Sapiens
DVRQYLILR

SEQ ID NO: 676690 - protein, 9 aa, Homo Sapiens
SFRNLRKAL

SEQ ID NO: 676691 - protein, 9 aa, Homo Sapiens
ETLSRNLEM

SEQ ID NO: 676692 - protein, 9 aa, Homo Sapiens
HLLHSGLLE

SEQ ID NO: 676693 - protein, 9 aa, Homo Sapiens
DDRAVGGAR

SEQ ID NO: 676694 - protein, 9 aa, Homo Sapiens
CKTSQFLLS

SEQ ID NO: 676695 - protein, 9 aa, Homo Sapiens
NENGNPIYK

SEQ ID NO: 676696 - protein, 9 aa, Homo Sapiens
GVTSWCYQW

SEQ ID NO: 676697 - protein, 9 aa, Homo Sapiens
LYESLAVLL

SEQ ID NO: 676698 - protein, 9 aa, Homo Sapiens
GLLRHMQGT

SEQ ID NO: 676699 - protein, 9 aa, Homo Sapiens
EVEQCFATQ

SEQ ID NO: 676700 - protein, 9 aa, Homo Sapiens
SKTQMMSDG

SEQ ID NO: 676701 - protein, 9 aa, Homo Sapiens
SYSKAYGER

SEQ ID NO: 676702 - protein, 9 aa, Homo Sapiens
LLLLITDES

SEQ ID NO: 676703 - protein, 9 aa, Homo Sapiens
WDKASGGAW

SEQ ID NO: 676704 - protein, 9 aa, Homo Sapiens
NMGSLERKK

SEQ ID NO: 676705 - protein, 9 aa, Homo Sapiens
LSFQDYGAC

SEQ ID NO: 676706 - protein, 9 aa, Homo Sapiens
TLTELYVYN

SEQ ID NO: 676707 - protein, 9 aa, Homo Sapiens
PELTAARFG

SEQ ID NO: 676708 - protein, 9 aa, Homo Sapiens
LDKNARFSV

SEQ ID NO: 676709 - protein, 9 aa, Homo Sapiens
TLHPVLLTI

SEQ ID NO: 676710 - protein, 9 aa, Homo Sapiens
TFLVRNHRK

SEQ ID NO: 676711 - protein, 9 aa, Homo Sapiens
QDWYQTVET

SEQ ID NO: 676712 - protein, 9 aa, Homo Sapiens
PRVATVTSI

SEQ ID NO: 676713 - protein, 9 aa, Homo Sapiens
DSFLPVSAS

SEQ ID NO: 676714 - protein, 9 aa, Homo Sapiens
ILAPDFEIG

SEQ ID NO: 676715 - protein, 9 aa, Homo Sapiens
HEYWKRLAR

SEQ ID NO: 676716 - protein, 9 aa, Homo Sapiens
VPYRHSKLT

SEQ ID NO: 676717 - protein, 9 aa, Homo Sapiens
ARPKTDDRA

SEQ ID NO: 676718 - protein, 9 aa, Homo Sapiens
PLLPRRAAE

SEQ ID NO: 676719 - protein, 9 aa, Homo Sapiens
CQNPSRSQD

SEQ ID NO: 676720 - protein, 9 aa, Homo Sapiens
LGLCPDRHV

SEQ ID NO: 676721 - protein, 9 aa, Homo Sapiens
PFRFAKEAA

SEQ ID NO: 676722 - protein, 9 aa, Homo Sapiens
FQKDLNTCV

SEQ ID NO: 676723 - protein, 9 aa, Homo Sapiens
FASCQALPW

SEQ ID NO: 676724 - protein, 9 aa, Homo Sapiens
KKNSTVDSN

SEQ ID NO: 676725 - protein, 9 aa, Homo Sapiens
TLAYKKLIT

SEQ ID NO: 676726 - protein, 9 aa, Homo Sapiens
KCNCQLLGL

SEQ ID NO: 676727 - protein, 9 aa, Homo Sapiens
ASCLSNIER

SEQ ID NO: 676728 - protein, 9 aa, Homo Sapiens
LTQHHPGLI

SEQ ID NO: 676729 - protein, 9 aa, Homo Sapiens
SQKENVQQY

SEQ ID NO: 676730 - protein, 9 aa, Homo Sapiens
VRQKERALD

SEQ ID NO: 676731 - protein, 9 aa, Homo Sapiens
KSRTKYTFT

SEQ ID NO: 676732 - protein, 9 aa, Homo Sapiens
SADTELAKD

SEQ ID NO: 676733 - protein, 9 aa, Homo Sapiens
MGSDVQSGT

SEQ ID NO: 676734 - protein, 9 aa, Homo Sapiens
WAKYFKGNK

SEQ ID NO: 676735 - protein, 9 aa, Homo Sapiens
PVAVEQTCI

SEQ ID NO: 676736 - protein, 9 aa, Homo Sapiens
VDKYVDSFV

SEQ ID NO: 676737 - protein, 9 aa, Homo Sapiens
VSENSHTLY

SEQ ID NO: 676738 - protein, 9 aa, Homo Sapiens
QTGEIPRKN

SEQ ID NO: 676739 - protein, 9 aa, Homo Sapiens
LARPRRARQ

SEQ ID NO: 676740 - protein, 9 aa, Homo Sapiens
ATETSSQGH

SEQ ID NO: 676741 - protein, 9 aa, Homo Sapiens
KGMTCASCL

SEQ ID NO: 676742 - protein, 9 aa, Homo Sapiens
VLAALLLLL

SEQ ID NO: 676743 - protein, 9 aa, Homo Sapiens
DSLEDAVVA

SEQ ID NO: 676744 - protein, 9 aa, Homo Sapiens
TYIACLMKM

SEQ ID NO: 676745 - protein, 9 aa, Homo Sapiens
DLDSIISEV

SEQ ID NO: 676746 - protein, 9 aa, Homo Sapiens
EPAQQIYHL

SEQ ID NO: 676747 - protein, 9 aa, Homo Sapiens
ANTLWFFAV

SEQ ID NO: 676748 - protein, 9 aa, Homo Sapiens
TVRYSPELT

SEQ ID NO: 676749 - protein, 9 aa, Homo Sapiens
DFVSAGPAA

SEQ ID NO: 676750 - protein, 9 aa, Homo Sapiens
NDSTTSVEL

SEQ ID NO: 676751 - protein, 9 aa, Homo Sapiens
VLMTQVDHI

SEQ ID NO: 676752 - protein, 9 aa, Homo Sapiens
NYEAYKPCT

SEQ ID NO: 676753 - protein, 9 aa, Homo Sapiens
GIHLARNQN

SEQ ID NO: 676754 - protein, 9 aa, Homo Sapiens
HLNAAIRKM

SEQ ID NO: 676755 - protein, 9 aa, Homo Sapiens
SWGGTPLHH

SEQ ID NO: 676756 - protein, 9 aa, Homo Sapiens
PPHQPQQQQ

SEQ ID NO: 676757 - protein, 9 aa, Homo Sapiens
GDAKAFWME

SEQ ID NO: 676758 - protein, 9 aa, Homo Sapiens
PLVPPEPWS

SEQ ID NO: 676759 - protein, 9 aa, Homo Sapiens
AGMDTEKPG

SEQ ID NO: 676760 - protein, 9 aa, Homo Sapiens
KSKVTLKRN

SEQ ID NO: 676761 - protein, 9 aa, Homo Sapiens
SVLTKNRFY

SEQ ID NO: 676762 - protein, 9 aa, Homo Sapiens
PTVRWMKDD

SEQ ID NO: 676763 - protein, 9 aa, Homo Sapiens
KLAGMDTEK

SEQ ID NO: 676764 - protein, 9 aa, Homo Sapiens
RNLEMGLTQ

SEQ ID NO: 676765 - protein, 9 aa, Homo Sapiens
RTGPPPPLG

SEQ ID NO: 676766 - protein, 9 aa, Homo Sapiens
RREVEQCFA

SEQ ID NO: 676767 - protein, 9 aa, Homo Sapiens
ANHEKPVLP

SEQ ID NO: 676768 - protein, 9 aa, Homo Sapiens
NQHQTENLS

SEQ ID NO: 676769 - protein, 9 aa, Homo Sapiens
SDHPLNLSF

SEQ ID NO: 676770 - protein, 9 aa, Homo Sapiens
GNPIYKYFY

SEQ ID NO: 676771 - protein, 9 aa, Homo Sapiens
LPKCKCPGG

SEQ ID NO: 676772 - protein, 9 aa, Homo Sapiens
LRVITTNIR

SEQ ID NO: 676773 - protein, 9 aa, Homo Sapiens
TGLGGPLGS

SEQ ID NO: 676774 - protein, 9 aa, Homo Sapiens
KHLDQKEKQ

SEQ ID NO: 676775 - protein, 9 aa, Homo Sapiens
LKNKCLQWP

SEQ ID NO: 676776 - protein, 9 aa, Homo Sapiens
QKEGHFQRV

SEQ ID NO: 676777 - protein, 9 aa, Homo Sapiens
LPLTFFCCH

SEQ ID NO: 676778 - protein, 9 aa, Homo Sapiens
AVADRIGIG

SEQ ID NO: 676779 - protein, 9 aa, Homo Sapiens
NALLLTTVS

SEQ ID NO: 676780 - protein, 9 aa, Homo Sapiens
TFFFFVIVV

SEQ ID NO: 676781 - protein, 9 aa, Homo Sapiens
LNHLKFLNM

SEQ ID NO: 676782 - protein, 9 aa, Homo Sapiens
HPGLILLLL

SEQ ID NO: 676783 - protein, 9 aa, Homo Sapiens
EDHLKLHGE

SEQ ID NO: 676784 - protein, 9 aa, Homo Sapiens
GSKFAGYSR

SEQ ID NO: 676785 - protein, 9 aa, Homo Sapiens
QLEGHRLPS

SEQ ID NO: 676786 - protein, 9 aa, Homo Sapiens
LTELYVYNN

SEQ ID NO: 676787 - protein, 9 aa, Homo Sapiens
LCLHLKAET

SEQ ID NO: 676788 - protein, 9 aa, Homo Sapiens
GKKNSTVDS

SEQ ID NO: 676789 - protein, 9 aa, Homo Sapiens
LLDPQRTLQ

SEQ ID NO: 676790 - protein, 9 aa, Homo Sapiens
LVRNHRKAS

SEQ ID NO: 676791 - protein, 9 aa, Homo Sapiens
PGGYTGKYC

SEQ ID NO: 676792 - protein, 9 aa, Homo Sapiens
SALETKSVE

SEQ ID NO: 676793 - protein, 9 aa, Homo Sapiens
RVATVTSIL

SEQ ID NO: 676794 - protein, 9 aa, Homo Sapiens
AMTGGSDPR

SEQ ID NO: 676795 - protein, 9 aa, Homo Sapiens
SYRPTQLGR

SEQ ID NO: 676796 - protein, 9 aa, Homo Sapiens
KNGDAKAFW

SEQ ID NO: 676797 - protein, 9 aa, Homo Sapiens
LQTSKPVAV

SEQ ID NO: 676798 - protein, 9 aa, Homo Sapiens
DSYLGVLLH

SEQ ID NO: 676799 - protein, 9 aa, Homo Sapiens
GFEDHLKLH

SEQ ID NO: 676800 - protein, 9 aa, Homo Sapiens
SNYEAYKPC

SEQ ID NO: 676801 - protein, 9 aa, Homo Sapiens
FHPEKPDSV

SEQ ID NO: 676802 - protein, 9 aa, Homo Sapiens
VFLVRSAIK

SEQ ID NO: 676803 - protein, 9 aa, Homo Sapiens
VLMLPFSPL

SEQ ID NO: 676804 - protein, 9 aa, Homo Sapiens
IIMGHLQLV

SEQ ID NO: 676805 - protein, 9 aa, Homo Sapiens
ESDEEKKVR

SEQ ID NO: 676806 - protein, 9 aa, Homo Sapiens
ERDWEGKCE

SEQ ID NO: 676807 - protein, 9 aa, Homo Sapiens
HVVAKVLAV

SEQ ID NO: 676808 - protein, 9 aa, Homo Sapiens
PSFHIELCR

SEQ ID NO: 676809 - protein, 9 aa, Homo Sapiens
QQSVLKILG

SEQ ID NO: 676810 - protein, 9 aa, Homo Sapiens
NNAFGSKNN

SEQ ID NO: 676811 - protein, 9 aa, Homo Sapiens
EMKEYCPIH

SEQ ID NO: 676812 - protein, 9 aa, Homo Sapiens
YCPIHILWS

SEQ ID NO: 676813 - protein, 9 aa, Homo Sapiens
KINPFHLSD

SEQ ID NO: 676814 - protein, 9 aa, Homo Sapiens
FVENLSGFV

SEQ ID NO: 676815 - protein, 9 aa, Homo Sapiens
KIQDPKILQ

SEQ ID NO: 676816 - protein, 9 aa, Homo Sapiens
PYRHSKLTR

SEQ ID NO: 676817 - protein, 9 aa, Homo Sapiens
IATAAEHLN

SEQ ID NO: 676818 - protein, 9 aa, Homo Sapiens
RLKIAEPLH

SEQ ID NO: 676819 - protein, 9 aa, Homo Sapiens
SSRTLHPVL

SEQ ID NO: 676820 - protein, 9 aa, Homo Sapiens
KNARFSVIY

SEQ ID NO: 676821 - protein, 9 aa, Homo Sapiens
CCPALQRTH

SEQ ID NO: 676822 - protein, 9 aa, Homo Sapiens
CEKDYPCTC

SEQ ID NO: 676823 - protein, 9 aa, Homo Sapiens
TEKIVCVVP

SEQ ID NO: 676824 - protein, 9 aa, Homo Sapiens
VRSSSFNNP

SEQ ID NO: 676825 - protein, 9 aa, Homo Sapiens
VSRRVTLVI

SEQ ID NO: 676826 - protein, 9 aa, Homo Sapiens
AVWILAVLA

SEQ ID NO: 676827 - protein, 9 aa, Homo Sapiens
YFDEMKEYC

SEQ ID NO: 676828 - protein, 9 aa, Homo Sapiens
STNEDAGDA

SEQ ID NO: 676829 - protein, 9 aa, Homo Sapiens
RHKKDTFLC

SEQ ID NO: 676830 - protein, 9 aa, Homo Sapiens
ERLRGLLDP

SEQ ID NO: 676831 - protein, 9 aa, Homo Sapiens
SLKGQRGRL

SEQ ID NO: 676832 - protein, 9 aa, Homo Sapiens
YTNLLRPKI

SEQ ID NO: 676833 - protein, 9 aa, Homo Sapiens
PVVKELVVS

SEQ ID NO: 676834 - protein, 9 aa, Homo Sapiens
GLLDPQRTL

SEQ ID NO: 676835 - protein, 9 aa, Homo Sapiens
IKNSVVVNG

SEQ ID NO: 676836 - protein, 9 aa, Homo Sapiens
LGRAGTLLG

SEQ ID NO: 676837 - protein, 9 aa, Homo Sapiens
MFGKVALHD

SEQ ID NO: 676838 - protein, 9 aa, Homo Sapiens
GVLVLDDAQ

SEQ ID NO: 676839 - protein, 9 aa, Homo Sapiens
WKLNGTYVD

SEQ ID NO: 676840 - protein, 9 aa, Homo Sapiens
LPLADSSTE

SEQ ID NO: 676841 - protein, 9 aa, Homo Sapiens
SRSCSLTNV

SEQ ID NO: 676842 - protein, 9 aa, Homo Sapiens
QFVLNDTDT

SEQ ID NO: 676843 - protein, 9 aa, Homo Sapiens
ARCCTRPPR

SEQ ID NO: 676844 - protein, 9 aa, Homo Sapiens
QLDNSAAIR

SEQ ID NO: 676845 - protein, 9 aa, Homo Sapiens
SSSMFLKRR

SEQ ID NO: 676846 - protein, 9 aa, Homo Sapiens
RAAEPLRGP

SEQ ID NO: 676847 - protein, 9 aa, Homo Sapiens
LGRQPGQRQ

SEQ ID NO: 676848 - protein, 9 aa, Homo Sapiens
LAYKKLITV

SEQ ID NO: 676849 - protein, 9 aa, Homo Sapiens
TKKAQQELK

SEQ ID NO: 676850 - protein, 9 aa, Homo Sapiens
PPGTRKRLR

SEQ ID NO: 676851 - protein, 9 aa, Homo Sapiens
IPHAHQHRD

SEQ ID NO: 676852 - protein, 9 aa, Homo Sapiens
KWQEEDTGP

SEQ ID NO: 676853 - protein, 9 aa, Homo Sapiens
DYLNLSLCV

SEQ ID NO: 676854 - protein, 9 aa, Homo Sapiens
DSLKGQRGR

SEQ ID NO: 676855 - protein, 9 aa, Homo Sapiens
PGKQISKEN

SEQ ID NO: 676856 - protein, 9 aa, Homo Sapiens
EPCWLILFL

SEQ ID NO: 676857 - protein, 9 aa, Homo Sapiens
LPVWSISTG

SEQ ID NO: 676858 - protein, 9 aa, Homo Sapiens
MPEPHSPPA

SEQ ID NO: 676859 - protein, 9 aa, Homo Sapiens
NWIQLNLDY

SEQ ID NO: 676860 - protein, 9 aa, Homo Sapiens
SELLAIMNN

SEQ ID NO: 676861 - protein, 9 aa, Homo Sapiens
TVNHQKSFC

SEQ ID NO: 676862 - protein, 9 aa, Homo Sapiens
LKHLDQKEK

SEQ ID NO: 676863 - protein, 9 aa, Homo Sapiens
HVRSSSSPA

SEQ ID NO: 676864 - protein, 9 aa, Homo Sapiens
FLNMLSPRG

SEQ ID NO: 676865 - protein, 9 aa, Homo Sapiens
MMILYSSLL

SEQ ID NO: 676866 - protein, 9 aa, Homo Sapiens
QHRCFFLLL

SEQ ID NO: 676867 - protein, 9 aa, Homo Sapiens
KNTFREQLE

SEQ ID NO: 676868 - protein, 9 aa, Homo Sapiens
HPLRYTNLL

SEQ ID NO: 676869 - protein, 9 aa, Homo Sapiens
CTRPPRARP

SEQ ID NO: 676870 - protein, 9 aa, Homo Sapiens
REAGSGYRC

SEQ ID NO: 676871 - protein, 9 aa, Homo Sapiens
MASQPLLAK

SEQ ID NO: 676872 - protein, 9 aa, Homo Sapiens
FCKVRYSQL

SEQ ID NO: 676873 - protein, 9 aa, Homo Sapiens
SFLDASILQ

SEQ ID NO: 676874 - protein, 9 aa, Homo Sapiens
FGDSASLQC

SEQ ID NO: 676875 - protein, 9 aa, Homo Sapiens
PSLFQIPHA

SEQ ID NO: 676876 - protein, 9 aa, Homo Sapiens
SVQEMMEEK

SEQ ID NO: 676877 - protein, 9 aa, Homo Sapiens
SQDSCCPQC

SEQ ID NO: 676878 - protein, 9 aa, Homo Sapiens
TILLAYQKS

SEQ ID NO: 676879 - protein, 9 aa, Homo Sapiens
VAALRHSSY

SEQ ID NO: 676880 - protein, 9 aa, Homo Sapiens
AVNQSECEY

SEQ ID NO: 676881 - protein, 9 aa, Homo Sapiens
EHNEENDHK

SEQ ID NO: 676882 - protein, 9 aa, Homo Sapiens
TRGATETSS

SEQ ID NO: 676883 - protein, 9 aa, Homo Sapiens
AVDLLEKIL

SEQ ID NO: 676884 - protein, 9 aa, Homo Sapiens
HNFLQAHNW

SEQ ID NO: 676885 - protein, 9 aa, Homo Sapiens
VSLQCEPGY

SEQ ID NO: 676886 - protein, 9 aa, Homo Sapiens
PWLGLCFWT

SEQ ID NO: 676887 - protein, 9 aa, Homo Sapiens
KIDCHKDEK

SEQ ID NO: 676888 - protein, 9 aa, Homo Sapiens
ILKSLPVWS

SEQ ID NO: 676889 - protein, 9 aa, Homo Sapiens
PKILEDTGL

SEQ ID NO: 676890 - protein, 9 aa, Homo Sapiens
MFESWLFDL

SEQ ID NO: 676891 - protein, 9 aa, Homo Sapiens
LCVQVQQFQ

SEQ ID NO: 676892 - protein, 9 aa, Homo Sapiens
KKAVFTEYT

SEQ ID NO: 676893 - protein, 9 aa, Homo Sapiens
MDEPVQLRG

SEQ ID NO: 676894 - protein, 9 aa, Homo Sapiens
VDSFLPVSA

SEQ ID NO: 676895 - protein, 9 aa, Homo Sapiens
RKILYLGFC

SEQ ID NO: 676896 - protein, 9 aa, Homo Sapiens
KPRPCFHAM

SEQ ID NO: 676897 - protein, 9 aa, Homo Sapiens
DVQHRCFFL

SEQ ID NO: 676898 - protein, 9 aa, Homo Sapiens
TQFNRALFT

SEQ ID NO: 676899 - protein, 9 aa, Homo Sapiens
VEEIFHPEK

SEQ ID NO: 676900 - protein, 9 aa, Homo Sapiens
LLLTTVSRK

SEQ ID NO: 676901 - protein, 9 aa, Homo Sapiens
FSHGTQGLL

SEQ ID NO: 676902 - protein, 9 aa, Homo Sapiens
NMQHIMGTV

SEQ ID NO: 676903 - protein, 9 aa, Homo Sapiens
QEQQRRQVL

SEQ ID NO: 676904 - protein, 9 aa, Homo Sapiens
AGTLLGEVY

SEQ ID NO: 676905 - protein, 9 aa, Homo Sapiens
LVDGVSGGP

SEQ ID NO: 676906 - protein, 9 aa, Homo Sapiens
TFYQTLLAR

SEQ ID NO: 676907 - protein, 9 aa, Homo Sapiens
KPVAVEQTC

SEQ ID NO: 676908 - protein, 9 aa, Homo Sapiens
AGEDSVAAA

SEQ ID NO: 676909 - protein, 9 aa, Homo Sapiens
SLFQIPHAH

SEQ ID NO: 676910 - protein, 9 aa, Homo Sapiens
LNGTYVDTG

SEQ ID NO: 676911 - protein, 9 aa, Homo Sapiens
EIKNSVVVN

SEQ ID NO: 676912 - protein, 9 aa, Homo Sapiens
KNPYPTKSE

SEQ ID NO: 676913 - protein, 9 aa, Homo Sapiens
KNTLKNTIV

SEQ ID NO: 676914 - protein, 9 aa, Homo Sapiens
PSQGRPCLS

SEQ ID NO: 676915 - protein, 9 aa, Homo Sapiens
SSSSPATAD

SEQ ID NO: 676916 - protein, 9 aa, Homo Sapiens
VWEAIKPGS

SEQ ID NO: 676917 - protein, 9 aa, Homo Sapiens
TIKDNGVGY

SEQ ID NO: 676918 - protein, 9 aa, Homo Sapiens
NAPVGTSMT

SEQ ID NO: 676919 - protein, 9 aa, Homo Sapiens
GLFEPAAKW

SEQ ID NO: 676920 - protein, 9 aa, Homo Sapiens
VNNYKEEPL

SEQ ID NO: 676921 - protein, 9 aa, Homo Sapiens
KYHIQACTT

SEQ ID NO: 676922 - protein, 9 aa, Homo Sapiens
QMMSDGTSR

SEQ ID NO: 676923 - protein, 9 aa, Homo Sapiens
EILDKGLAT

SEQ ID NO: 676924 - protein, 9 aa, Homo Sapiens
PALQRTHSA

SEQ ID NO: 676925 - protein, 9 aa, Homo Sapiens
CLAGVSRRV

SEQ ID NO: 676926 - protein, 9 aa, Homo Sapiens
LLFKAVADR

SEQ ID NO: 676927 - protein, 9 aa, Homo Sapiens
PVKVSFGDS

SEQ ID NO: 676928 - protein, 9 aa, Homo Sapiens
GGPSTAEHI

SEQ ID NO: 676929 - protein, 9 aa, Homo Sapiens
SRLKIAEPL

SEQ ID NO: 676930 - protein, 9 aa, Homo Sapiens
LDASILQLS

SEQ ID NO: 676931 - protein, 9 aa, Homo Sapiens
GEISGATPV

SEQ ID NO: 676932 - protein, 9 aa, Homo Sapiens
YGGCIAQLY

SEQ ID NO: 676933 - protein, 9 aa, Homo Sapiens
LLLITDESL

SEQ ID NO: 676934 - protein, 9 aa, Homo Sapiens
EDKDFLEDL

SEQ ID NO: 676935 - protein, 9 aa, Homo Sapiens
KRLRNSWPW

SEQ ID NO: 676936 - protein, 9 aa, Homo Sapiens
RHSKLTRLL

SEQ ID NO: 676937 - protein, 9 aa, Homo Sapiens
LASTGVTSW

SEQ ID NO: 676938 - protein, 9 aa, Homo Sapiens
GVAHWVQQQ

SEQ ID NO: 676939 - protein, 9 aa, Homo Sapiens
SQLHLGLCP

SEQ ID NO: 676940 - protein, 9 aa, Homo Sapiens
RDSYLGVLL

SEQ ID NO: 676941 - protein, 9 aa, Homo Sapiens
MLLSSVLQA

SEQ ID NO: 676942 - protein, 9 aa, Homo Sapiens
CTNHERIGQ

SEQ ID NO: 676943 - protein, 9 aa, Homo Sapiens
LLLLCFVDY

SEQ ID NO: 676944 - protein, 9 aa, Homo Sapiens
LWRDFVNSR

SEQ ID NO: 676945 - protein, 9 aa, Homo Sapiens
INRREVEQC

SEQ ID NO: 676946 - protein, 9 aa, Homo Sapiens
CPVPKAVLI

SEQ ID NO: 676947 - protein, 9 aa, Homo Sapiens
QMFGKVALH

SEQ ID NO: 676948 - protein, 9 aa, Homo Sapiens
FIESADTEL

SEQ ID NO: 676949 - protein, 9 aa, Homo Sapiens
PPPPLGGKE

SEQ ID NO: 676950 - protein, 9 aa, Homo Sapiens
QQHNLAVWI

SEQ ID NO: 676951 - protein, 9 aa, Homo Sapiens
GTLGPPPPE

SEQ ID NO: 676952 - protein, 9 aa, Homo Sapiens
LKRDHVVPI

SEQ ID NO: 676953 - protein, 9 aa, Homo Sapiens
EQQRRQVLG

SEQ ID NO: 676954 - protein, 9 aa, Homo Sapiens
FEDEEEFNH

SEQ ID NO: 676955 - protein, 9 aa, Homo Sapiens
FPRTSISPL

SEQ ID NO: 676956 - protein, 9 aa, Homo Sapiens
QLNLDYLVN

SEQ ID NO: 676957 - protein, 9 aa, Homo Sapiens
RVTLVIAYI

SEQ ID NO: 676958 - protein, 9 aa, Homo Sapiens
PCCRPPGTR

SEQ ID NO: 676959 - protein, 9 aa, Homo Sapiens
QLVRCACKP

SEQ ID NO: 676960 - protein, 9 aa, Homo Sapiens
SHVKKCTNH

SEQ ID NO: 676961 - protein, 9 aa, Homo Sapiens
LDPQRTLQE

SEQ ID NO: 676962 - protein, 9 aa, Homo Sapiens
ADSGEYRAA

SEQ ID NO: 676963 - protein, 9 aa, Homo Sapiens
DHMEKENKY

SEQ ID NO: 676964 - protein, 9 aa, Homo Sapiens
SIFSSDRPQ

SEQ ID NO: 676965 - protein, 9 aa, Homo Sapiens
MRLSFSTIR

SEQ ID NO: 676966 - protein, 9 aa, Homo Sapiens
CPDRHVQQH

SEQ ID NO: 676967 - protein, 9 aa, Homo Sapiens
DGFLFCKVR

SEQ ID NO: 676968 - protein, 9 aa, Homo Sapiens
IPVLGLTTG

SEQ ID NO: 676969 - protein, 9 aa, Homo Sapiens
MEKENKYLK

SEQ ID NO: 676970 - protein, 9 aa, Homo Sapiens
HSFASCQAL

SEQ ID NO: 676971 - protein, 9 aa, Homo Sapiens
FERELHLLC

SEQ ID NO: 676972 - protein, 9 aa, Homo Sapiens
HKKEHSSGD

SEQ ID NO: 676973 - protein, 9 aa, Homo Sapiens
FYLNCKTSQ

SEQ ID NO: 676974 - protein, 9 aa, Homo Sapiens
GVMSSPPVR

SEQ ID NO: 676975 - protein, 9 aa, Homo Sapiens
DLKREAGSG

SEQ ID NO: 676976 - protein, 9 aa, Homo Sapiens
LRPKICGLM

SEQ ID NO: 676977 - protein, 9 aa, Homo Sapiens
PCCRQRLEK

SEQ ID NO: 676978 - protein, 9 aa, Homo Sapiens
WKVRNFEVQ

SEQ ID NO: 676979 - protein, 9 aa, Homo Sapiens
SLVAVKYEV

SEQ ID NO: 676980 - protein, 9 aa, Homo Sapiens
GSFVPYRHS

SEQ ID NO: 676981 - protein, 9 aa, Homo Sapiens
STVDSNGVV

SEQ ID NO: 676982 - protein, 9 aa, Homo Sapiens
YKLAGMDTE

SEQ ID NO: 676983 - protein, 9 aa, Homo Sapiens
WPGTASTNE

SEQ ID NO: 676984 - protein, 9 aa, Homo Sapiens
GGTPLHHAA

SEQ ID NO: 676985 - protein, 9 aa, Homo Sapiens
YRHSKLTRL

SEQ ID NO: 676986 - protein, 9 aa, Homo Sapiens
GTMDLLSGV

SEQ ID NO: 676987 - protein, 9 aa, Homo Sapiens
RSLLLQASR

SEQ ID NO: 676988 - protein, 9 aa, Homo Sapiens
KNRPVGLWN

SEQ ID NO: 676989 - protein, 9 aa, Homo Sapiens
KAKFLPNCG

SEQ ID NO: 676990 - protein, 9 aa, Homo Sapiens
GACVPLLTE

SEQ ID NO: 676991 - protein, 9 aa, Homo Sapiens
CSVLTKNRF

SEQ ID NO: 676992 - protein, 9 aa, Homo Sapiens
PGTRKASFL

SEQ ID NO: 676993 - protein, 9 aa, Homo Sapiens
DSVAAAAPG

SEQ ID NO: 676994 - protein, 9 aa, Homo Sapiens
LRGPVPQDL

SEQ ID NO: 676995 - protein, 9 aa, Homo Sapiens
STCAHSADG

SEQ ID NO: 676996 - protein, 9 aa, Homo Sapiens
PLRYTNLLR

SEQ ID NO: 676997 - protein, 9 aa, Homo Sapiens
VNDVVSLQC

SEQ ID NO: 676998 - protein, 9 aa, Homo Sapiens
SNGVVSLLG

SEQ ID NO: 676999 - protein, 9 aa, Homo Sapiens
MGRASPTLF

SEQ ID NO: 677000 - protein, 9 aa, Homo Sapiens
VRQYLILRN

SEQ ID NO: 677001 - protein, 9 aa, Homo Sapiens
AAQRCHEYW

SEQ ID NO: 677002 - protein, 9 aa, Homo Sapiens
VSFGDSASL

SEQ ID NO: 677003 - protein, 9 aa, Homo Sapiens
LCPVLKQMY

SEQ ID NO: 677004 - protein, 9 aa, Homo Sapiens
NHQGSKRAR

SEQ ID NO: 677005 - protein, 9 aa, Homo Sapiens
KGFKGEREH

SEQ ID NO: 677006 - protein, 9 aa, Homo Sapiens
SIEHISRIS

SEQ ID NO: 677007 - protein, 9 aa, Homo Sapiens
SKSRSCSLT

SEQ ID NO: 677008 - protein, 9 aa, Homo Sapiens
RKHKEITSQ

SEQ ID NO: 677009 - protein, 9 aa, Homo Sapiens
CTDTLAIVM

SEQ ID NO: 677010 - protein, 9 aa, Homo Sapiens
ITSQSDASE

SEQ ID NO: 677011 - protein, 9 aa, Homo Sapiens
EKDYPCTCI

SEQ ID NO: 677012 - protein, 9 aa, Homo Sapiens
NVFKAKFLP

SEQ ID NO: 677013 - protein, 9 aa, Homo Sapiens
AALRIMELS

SEQ ID NO: 677014 - protein, 9 aa, Homo Sapiens
RLRGLLDPQ

SEQ ID NO: 677015 - protein, 9 aa, Homo Sapiens
WLEPAQQIY

SEQ ID NO: 677016 - protein, 9 aa, Homo Sapiens
RCACKPECN

SEQ ID NO: 677017 - protein, 9 aa, Homo Sapiens
LSLQKCWSI

SEQ ID NO: 677018 - protein, 9 aa, Homo Sapiens
LFMGNLKNK

SEQ ID NO: 677019 - protein, 9 aa, Homo Sapiens
VSKEGFQIP

SEQ ID NO: 677020 - protein, 9 aa, Homo Sapiens
AIVCADVWI

SEQ ID NO: 677021 - protein, 9 aa, Homo Sapiens
LEQLDIIKI

SEQ ID NO: 677022 - protein, 9 aa, Homo Sapiens
KSLPVWSIS

SEQ ID NO: 677023 - protein, 9 aa, Homo Sapiens
IPFVENLSG

SEQ ID NO: 677024 - protein, 9 aa, Homo Sapiens
TCARCCTRP

SEQ ID NO: 677025 - protein, 9 aa, Homo Sapiens
KVALMKQKR

SEQ ID NO: 677026 - protein, 9 aa, Homo Sapiens
GTDAATLYC

SEQ ID NO: 677027 - protein, 9 aa, Homo Sapiens
FKAKFLPNC

SEQ ID NO: 677028 - protein, 9 aa, Homo Sapiens
TRKASFLWD

SEQ ID NO: 677029 - protein, 9 aa, Homo Sapiens
IADVERDWE

SEQ ID NO: 677030 - protein, 9 aa, Homo Sapiens
ENAPVGTSM

SEQ ID NO: 677031 - protein, 9 aa, Homo Sapiens
KPDSVDIEH

SEQ ID NO: 677032 - protein, 9 aa, Homo Sapiens
FKPKYAYGT

SEQ ID NO: 677033 - protein, 9 aa, Homo Sapiens
QKGPILMEG

SEQ ID NO: 677034 - protein, 9 aa, Homo Sapiens
VSVVKMKST

SEQ ID NO: 677035 - protein, 9 aa, Homo Sapiens
LRKSMKGLG

SEQ ID NO: 677036 - protein, 9 aa, Homo Sapiens
TVDSNGVVS

SEQ ID NO: 677037 - protein, 9 aa, Homo Sapiens
HSSYAAVST

SEQ ID NO: 677038 - protein, 9 aa, Homo Sapiens
QPKPGLFEP

SEQ ID NO: 677039 - protein, 9 aa, Homo Sapiens
IHLAFSMMI

SEQ ID NO: 677040 - protein, 9 aa, Homo Sapiens
LEPCWLILF

SEQ ID NO: 677041 - protein, 9 aa, Homo Sapiens
KYVDSFVRT

SEQ ID NO: 677042 - protein, 9 aa, Homo Sapiens
LVPPEPWSS

SEQ ID NO: 677043 - protein, 9 aa, Homo Sapiens
PRRAAEPLR

SEQ ID NO: 677044 - protein, 9 aa, Homo Sapiens
DKGLATSLQ

SEQ ID NO: 677045 - protein, 9 aa, Homo Sapiens
LSFLDASIL

SEQ ID NO: 677046 - protein, 9 aa, Homo Sapiens
AGVEVVSEN

SEQ ID NO: 677047 - protein, 9 aa, Homo Sapiens
DQKEKQPEL

SEQ ID NO: 677048 - protein, 9 aa, Homo Sapiens
QTSEGTWAW

SEQ ID NO: 677049 - protein, 9 aa, Homo Sapiens
FSPYALWQR

SEQ ID NO: 677050 - protein, 9 aa, Homo Sapiens
HSLSWTLNS

SEQ ID NO: 677051 - protein, 9 aa, Homo Sapiens
VNAAMAGRI

SEQ ID NO: 677052 - protein, 9 aa, Homo Sapiens
FDNYYGAVN

SEQ ID NO: 677053 - protein, 9 aa, Homo Sapiens
IPTNTLNLR

SEQ ID NO: 677054 - protein, 9 aa, Homo Sapiens
EEGDHSLSW

SEQ ID NO: 677055 - protein, 9 aa, Homo Sapiens
EAEYIASKL

SEQ ID NO: 677056 - protein, 9 aa, Homo Sapiens
AMGSDVQSG

SEQ ID NO: 677057 - protein, 9 aa, Homo Sapiens
RLDQRPESP

SEQ ID NO: 677058 - protein, 9 aa, Homo Sapiens
IESADTELA

SEQ ID NO: 677059 - protein, 9 aa, Homo Sapiens
VQQYCRKSG

SEQ ID NO: 677060 - protein, 9 aa, Homo Sapiens
SVKKLKRPR

SEQ ID NO: 677061 - protein, 9 aa, Homo Sapiens
YKVSSEPSG

SEQ ID NO: 677062 - protein, 9 aa, Homo Sapiens
ATLAYKKLI

SEQ ID NO: 677063 - protein, 9 aa, Homo Sapiens
MQLFQKNTY

SEQ ID NO: 677064 - protein, 9 aa, Homo Sapiens
CLHLKAETL

SEQ ID NO: 677065 - protein, 9 aa, Homo Sapiens
LNKEKNTLK

SEQ ID NO: 677066 - protein, 9 aa, Homo Sapiens
PHQPQQQQV

SEQ ID NO: 677067 - protein, 9 aa, Homo Sapiens
HNLAVWILA

SEQ ID NO: 677068 - protein, 9 aa, Homo Sapiens
FHSEVFMII

SEQ ID NO: 677069 - protein, 9 aa, Homo Sapiens
REYQKGPIL

SEQ ID NO: 677070 - protein, 9 aa, Homo Sapiens
AIDEESQNG

SEQ ID NO: 677071 - protein, 9 aa, Homo Sapiens
LWQRKDILF

SEQ ID NO: 677072 - protein, 9 aa, Homo Sapiens
LSRKTHIII

SEQ ID NO: 677073 - protein, 9 aa, Homo Sapiens
PLEAADTQD

SEQ ID NO: 677074 - protein, 9 aa, Homo Sapiens
YCKNDANCD

SEQ ID NO: 677075 - protein, 9 aa, Homo Sapiens
SAAYRGAHL

SEQ ID NO: 677076 - protein, 9 aa, Homo Sapiens
SAGPAAGVS

SEQ ID NO: 677077 - protein, 9 aa, Homo Sapiens
MGNLKNKCL

SEQ ID NO: 677078 - protein, 9 aa, Homo Sapiens
NSWPWKWQS

SEQ ID NO: 677079 - protein, 9 aa, Homo Sapiens
IYNGRADRI

SEQ ID NO: 677080 - protein, 9 aa, Homo Sapiens
LAMHFRATI

SEQ ID NO: 677081 - protein, 9 aa, Homo Sapiens
CPIHILWSA

SEQ ID NO: 677082 - protein, 9 aa, Homo Sapiens
FIMANHEKP

SEQ ID NO: 677083 - protein, 9 aa, Homo Sapiens
SPTLFQSRS

SEQ ID NO: 677084 - protein, 9 aa, Homo Sapiens
PAKIEHNEE

SEQ ID NO: 677085 - protein, 9 aa, Homo Sapiens
ITEFVIGNE

SEQ ID NO: 677086 - protein, 9 aa, Homo Sapiens
LVNDVVSLQ

SEQ ID NO: 677087 - protein, 9 aa, Homo Sapiens
SNGGVAFLI

SEQ ID NO: 677088 - protein, 9 aa, Homo Sapiens
RYKKAVFTE

SEQ ID NO: 677089 - protein, 9 aa, Homo Sapiens
ELLGPEEDQ

SEQ ID NO: 677090 - protein, 9 aa, Homo Sapiens
VQMVRKILY

SEQ ID NO: 677091 - protein, 9 aa, Homo Sapiens
YTVLTPLPN

SEQ ID NO: 677092 - protein, 9 aa, Homo Sapiens
DKDFLEDLD

SEQ ID NO: 677093 - protein, 9 aa, Homo Sapiens
SLPVWSIST

SEQ ID NO: 677094 - protein, 9 aa, Homo Sapiens
APPPRGLWK

SEQ ID NO: 677095 - protein, 9 aa, Homo Sapiens
NGSVPRARL

SEQ ID NO: 677096 - protein, 9 aa, Homo Sapiens
DSIIQFVLN

SEQ ID NO: 677097 - protein, 9 aa, Homo Sapiens
NGFYLSFQD

SEQ ID NO: 677098 - protein, 9 aa, Homo Sapiens
HFIMANHEK

SEQ ID NO: 677099 - protein, 9 aa, Homo Sapiens
RCHEYWKRL

SEQ ID NO: 677100 - protein, 9 aa, Homo Sapiens
EKPDSVDIE

SEQ ID NO: 677101 - protein, 9 aa, Homo Sapiens
DEVKMHLSA

SEQ ID NO: 677102 - protein, 9 aa, Homo Sapiens
LTFFCCHHQ

SEQ ID NO: 677103 - protein, 9 aa, Homo Sapiens
QVDHILSQA

SEQ ID NO: 677104 - protein, 9 aa, Homo Sapiens
VMTQSIPHP

SEQ ID NO: 677105 - protein, 9 aa, Homo Sapiens
ISYGGCIAQ

SEQ ID NO: 677106 - protein, 9 aa, Homo Sapiens
LFKPKYAYG

SEQ ID NO: 677107 - protein, 9 aa, Homo Sapiens
QPGQRQHLS

SEQ ID NO: 677108 - protein, 9 aa, Homo Sapiens
DFVNSREDT

SEQ ID NO: 677109 - protein, 9 aa, Homo Sapiens
KPLESKGRS

SEQ ID NO: 677110 - protein, 9 aa, Homo Sapiens
PGEAEYKVS

SEQ ID NO: 677111 - protein, 9 aa, Homo Sapiens
ACKGPALLH

SEQ ID NO: 677112 - protein, 9 aa, Homo Sapiens
AMCWKEGSG

SEQ ID NO: 677113 - protein, 9 aa, Homo Sapiens
LGSSIYNGC

SEQ ID NO: 677114 - protein, 9 aa, Homo Sapiens
GSGGNTRKA

SEQ ID NO: 677115 - protein, 9 aa, Homo Sapiens
RPKTDDRAV

SEQ ID NO: 677116 - protein, 9 aa, Homo Sapiens
VLLHGVAQL

SEQ ID NO: 677117 - protein, 9 aa, Homo Sapiens
QGPHILVDG

SEQ ID NO: 677118 - protein, 9 aa, Homo Sapiens
VAKVLAVDA

SEQ ID NO: 677119 - protein, 9 aa, Homo Sapiens
TQTEREVPD

SEQ ID NO: 677120 - protein, 9 aa, Homo Sapiens
RTVPGSTMN

SEQ ID NO: 677121 - protein, 9 aa, Homo Sapiens
EAIKPGSSF

SEQ ID NO: 677122 - protein, 9 aa, Homo Sapiens
TCCPALQRT

SEQ ID NO: 677123 - protein, 9 aa, Homo Sapiens
PVLGLTTGM

SEQ ID NO: 677124 - protein, 9 aa, Homo Sapiens
SSMRLSFST

SEQ ID NO: 677125 - protein, 9 aa, Homo Sapiens
AWDKASGGA

SEQ ID NO: 677126 - protein, 9 aa, Homo Sapiens
PRARLKSWP

SEQ ID NO: 677127 - protein, 9 aa, Homo Sapiens
YPLYFFLNL

SEQ ID NO: 677128 - protein, 9 aa, Homo Sapiens
ATINQATAL

SEQ ID NO: 677129 - protein, 9 aa, Homo Sapiens
TSKSRSCSL

SEQ ID NO: 677130 - protein, 9 aa, Homo Sapiens
HVALRNWSN

SEQ ID NO: 677131 - protein, 9 aa, Homo Sapiens
NHTACAHCS

SEQ ID NO: 677132 - protein, 9 aa, Homo Sapiens
VLLAIIQGL

SEQ ID NO: 677133 - protein, 9 aa, Homo Sapiens
FIAYPRAVL

SEQ ID NO: 677134 - protein, 9 aa, Homo Sapiens
PVGTSMTQL

SEQ ID NO: 677135 - protein, 9 aa, Homo Sapiens
NCHCLPGLA

SEQ ID NO: 677136 - protein, 9 aa, Homo Sapiens
EDYLNLSLC

SEQ ID NO: 677137 - protein, 9 aa, Homo Sapiens
FFVIVVLLA

SEQ ID NO: 677138 - protein, 9 aa, Homo Sapiens
WKAKDISPI

SEQ ID NO: 677139 - protein, 9 aa, Homo Sapiens
DESLKALDI

SEQ ID NO: 677140 - protein, 9 aa, Homo Sapiens
QRCHEYWKR

SEQ ID NO: 677141 - protein, 9 aa, Homo Sapiens
RPLRKSSLK

SEQ ID NO: 677142 - protein, 9 aa, Homo Sapiens
VLSWVSFLI

SEQ ID NO: 677143 - protein, 9 aa, Homo Sapiens
FTPVKMRKS

SEQ ID NO: 677144 - protein, 9 aa, Homo Sapiens
INQATALKE

SEQ ID NO: 677145 - protein, 9 aa, Homo Sapiens
YEPVMTQSI

SEQ ID NO: 677146 - protein, 9 aa, Homo Sapiens
GSTMNMGSL

SEQ ID NO: 677147 - protein, 9 aa, Homo Sapiens
FSVIYRQDS

SEQ ID NO: 677148 - protein, 9 aa, Homo Sapiens
ASFLWDFKK

SEQ ID NO: 677149 - protein, 9 aa, Homo Sapiens
TENLSQDQE

SEQ ID NO: 677150 - protein, 9 aa, Homo Sapiens
SVLSFLDAS

SEQ ID NO: 677151 - protein, 9 aa, Homo Sapiens
RTLHPVLLT

SEQ ID NO: 677152 - protein, 9 aa, Homo Sapiens
PAEPRDLQI

SEQ ID NO: 677153 - protein, 9 aa, Homo Sapiens
SYGGCIAQL

SEQ ID NO: 677154 - protein, 9 aa, Homo Sapiens
TFREQLEEE

SEQ ID NO: 677155 - protein, 9 aa, Homo Sapiens
SSFNNPLGN

SEQ ID NO: 677156 - protein, 9 aa, Homo Sapiens
PDRDRECEA

SEQ ID NO: 677157 - protein, 9 aa, Homo Sapiens
TTGMSIYSD

SEQ ID NO: 677158 - protein, 9 aa, Homo Sapiens
LLEDKDFLE

SEQ ID NO: 677159 - protein, 9 aa, Homo Sapiens
VFSWLQWLM

SEQ ID NO: 677160 - protein, 9 aa, Homo Sapiens
LQLNKENKT

SEQ ID NO: 677161 - protein, 9 aa, Homo Sapiens
LRGLLDPQR

SEQ ID NO: 677162 - protein, 9 aa, Homo Sapiens
VRKILYLGF

SEQ ID NO: 677163 - protein, 9 aa, Homo Sapiens
EYQIITQIN

SEQ ID NO: 677164 - protein, 9 aa, Homo Sapiens
PLLAKQYFS

SEQ ID NO: 677165 - protein, 9 aa, Homo Sapiens
GTLLGEVYV

SEQ ID NO: 677166 - protein, 9 aa, Homo Sapiens
GHRLPSLFQ

SEQ ID NO: 677167 - protein, 9 aa, Homo Sapiens
AKEAASLFC

SEQ ID NO: 677168 - protein, 9 aa, Homo Sapiens
VVAKVLAVD

SEQ ID NO: 677169 - protein, 9 aa, Homo Sapiens
LDDAQERSV

SEQ ID NO: 677170 - protein, 9 aa, Homo Sapiens
RVRPLKSTE

SEQ ID NO: 677171 - protein, 9 aa, Homo Sapiens
AQRVAMIDE

SEQ ID NO: 677172 - protein, 9 aa, Homo Sapiens
DRISSTFSQ

SEQ ID NO: 677173 - protein, 9 aa, Homo Sapiens
YLNLSLCVF

SEQ ID NO: 677174 - protein, 9 aa, Homo Sapiens
IEHNEENDH

SEQ ID NO: 677175 - protein, 9 aa, Homo Sapiens
MVRQAALRI

SEQ ID NO: 677176 - protein, 9 aa, Homo Sapiens
PIYKYFYVS

SEQ ID NO: 677177 - protein, 9 aa, Homo Sapiens
FSMMILYSS

SEQ ID NO: 677178 - protein, 9 aa, Homo Sapiens
SILRQTLFR

SEQ ID NO: 677179 - protein, 9 aa, Homo Sapiens
VFEDEEEFN

SEQ ID NO: 677180 - protein, 9 aa, Homo Sapiens
EKNTLKNTI

SEQ ID NO: 677181 - protein, 9 aa, Homo Sapiens
NNAFCTHVF

SEQ ID NO: 677182 - protein, 9 aa, Homo Sapiens
HIIMGHLQL

SEQ ID NO: 677183 - protein, 9 aa, Homo Sapiens
RECEAADRQ

SEQ ID NO: 677184 - protein, 9 aa, Homo Sapiens
FKKPLESKG

SEQ ID NO: 677185 - protein, 9 aa, Homo Sapiens
GLCFWTAGT

SEQ ID NO: 677186 - protein, 9 aa, Homo Sapiens
SWLQWLMIT

SEQ ID NO: 677187 - protein, 9 aa, Homo Sapiens
DQRPESPLQ

SEQ ID NO: 677188 - protein, 9 aa, Homo Sapiens
ESLAVLLEV

SEQ ID NO: 677189 - protein, 9 aa, Homo Sapiens
CASCLSNIE

SEQ ID NO: 677190 - protein, 9 aa, Homo Sapiens
DLQEQQRRQ

SEQ ID NO: 677191 - protein, 9 aa, Homo Sapiens
LTLSLHCWA

SEQ ID NO: 677192 - protein, 9 aa, Homo Sapiens
SGKVSTAGE

SEQ ID NO: 677193 - protein, 9 aa, Homo Sapiens
SIYNGCQET

SEQ ID NO: 677194 - protein, 9 aa, Homo Sapiens
KNDHMEKEN

SEQ ID NO: 677195 - protein, 9 aa, Homo Sapiens
ISLNDLDSG

SEQ ID NO: 677196 - protein, 9 aa, Homo Sapiens
PGEEVSKEG

SEQ ID NO: 677197 - protein, 9 aa, Homo Sapiens
AITFYQTLL

SEQ ID NO: 677198 - protein, 9 aa, Homo Sapiens
DEEEFNHRL

SEQ ID NO: 677199 - protein, 9 aa, Homo Sapiens
GNKIHGEID

SEQ ID NO: 677200 - protein, 9 aa, Homo Sapiens
CRPCFYLNC

SEQ ID NO: 677201 - protein, 9 aa, Homo Sapiens
SFHIELCRE

SEQ ID NO: 677202 - protein, 9 aa, Homo Sapiens
YVTKRNCNL

SEQ ID NO: 677203 - protein, 9 aa, Homo Sapiens
LLCFVDYGV

SEQ ID NO: 677204 - protein, 9 aa, Homo Sapiens
ECEAADRQP

SEQ ID NO: 677205 - protein, 9 aa, Homo Sapiens
YKKAVFTEY

SEQ ID NO: 677206 - protein, 9 aa, Homo Sapiens
WQKINPFHL

SEQ ID NO: 677207 - protein, 9 aa, Homo Sapiens
WRFARSDKL

SEQ ID NO: 677208 - protein, 9 aa, Homo Sapiens
SRQGPHILV

SEQ ID NO: 677209 - protein, 9 aa, Homo Sapiens
EPLIVTPPT

SEQ ID NO: 677210 - protein, 9 aa, Homo Sapiens
QEFNARVSL

SEQ ID NO: 677211 - protein, 9 aa, Homo Sapiens
DKNARFSVI

SEQ ID NO: 677212 - protein, 9 aa, Homo Sapiens
FLVRSAIKD

SEQ ID NO: 677213 - protein, 9 aa, Homo Sapiens
KEKNTLKNT

SEQ ID NO: 677214 - protein, 9 aa, Homo Sapiens
SLHCWAGTG

SEQ ID NO: 677215 - protein, 9 aa, Homo Sapiens
VELRRGTDA

SEQ ID NO: 677216 - protein, 9 aa, Homo Sapiens
RWKLNGTYV

SEQ ID NO: 677217 - protein, 9 aa, Homo Sapiens
NIPVRSSSF

SEQ ID NO: 677218 - protein, 9 aa, Homo Sapiens
SFYQTGEIP

SEQ ID NO: 677219 - protein, 9 aa, Homo Sapiens
NTCVFNNQE

SEQ ID NO: 677220 - protein, 9 aa, Homo Sapiens
KNSVVVNGD

SEQ ID NO: 677221 - protein, 9 aa, Homo Sapiens
SPKQEKMKI

SEQ ID NO: 677222 - protein, 9 aa, Homo Sapiens
AGYSRNLVS

SEQ ID NO: 677223 - protein, 9 aa, Homo Sapiens
RECQLVRCA

SEQ ID NO: 677224 - protein, 9 aa, Homo Sapiens
LYKWQEEDT

SEQ ID NO: 677225 - protein, 9 aa, Homo Sapiens
RAAHIYPLY

SEQ ID NO: 677226 - protein, 9 aa, Homo Sapiens
GVPSQLHLG

SEQ ID NO: 677227 - protein, 9 aa, Homo Sapiens
GGCIAQLYV

SEQ ID NO: 677228 - protein, 9 aa, Homo Sapiens
PGLEQRHGT

SEQ ID NO: 677229 - protein, 9 aa, Homo Sapiens
KDFLEDLDF

SEQ ID NO: 677230 - protein, 9 aa, Homo Sapiens
LALLQGVCA

SEQ ID NO: 677231 - protein, 9 aa, Homo Sapiens
GVECMLLAV

SEQ ID NO: 677232 - protein, 9 aa, Homo Sapiens
SQSDASEIR

SEQ ID NO: 677233 - protein, 9 aa, Homo Sapiens
AKYFKGNKI

SEQ ID NO: 677234 - protein, 9 aa, Homo Sapiens
ALLFRGCND

SEQ ID NO: 677235 - protein, 9 aa, Homo Sapiens
FKAKQCQNK

SEQ ID NO: 677236 - protein, 9 aa, Homo Sapiens
TACAHCSGN

SEQ ID NO: 677237 - protein, 9 aa, Homo Sapiens
ACVPLLTED

SEQ ID NO: 677238 - protein, 9 aa, Homo Sapiens
TEAMTIMFE

SEQ ID NO: 677239 - protein, 9 aa, Homo Sapiens
DRDRECEAA

SEQ ID NO: 677240 - protein, 9 aa, Homo Sapiens
SVLKILGQL

SEQ ID NO: 677241 - protein, 9 aa, Homo Sapiens
QSGTEMEIV

SEQ ID NO: 677242 - protein, 9 aa, Homo Sapiens
KGVPSQLHL

SEQ ID NO: 677243 - protein, 9 aa, Homo Sapiens
DVDLLEDKD

SEQ ID NO: 677244 - protein, 9 aa, Homo Sapiens
IALISLNDL

SEQ ID NO: 677245 - protein, 9 aa, Homo Sapiens
LTEAMTIMF

SEQ ID NO: 677246 - protein, 9 aa, Homo Sapiens
TNEDAGDAA

SEQ ID NO: 677247 - protein, 9 aa, Homo Sapiens
LEGHRLPSL

SEQ ID NO: 677248 - protein, 9 aa, Homo Sapiens
RWMKDDGEL

SEQ ID NO: 677249 - protein, 9 aa, Homo Sapiens
VGMQKWWKG

SEQ ID NO: 677250 - protein, 9 aa, Homo Sapiens
ASSSMFLKR

SEQ ID NO: 677251 - protein, 9 aa, Homo Sapiens
TASSSPSIF

SEQ ID NO: 677252 - protein, 9 aa, Homo Sapiens
REMPEPHSP

SEQ ID NO: 677253 - protein, 9 aa, Homo Sapiens
NDHMEKENK

SEQ ID NO: 677254 - protein, 9 aa, Homo Sapiens
QELLGPEED

SEQ ID NO: 677255 - protein, 9 aa, Homo Sapiens
MNLVLFRFS

SEQ ID NO: 677256 - protein, 9 aa, Homo Sapiens
CSPDALHTL

SEQ ID NO: 677257 - protein, 9 aa, Homo Sapiens
GCVSAGSTG

SEQ ID NO: 677258 - protein, 9 aa, Homo Sapiens
NVINDVSPP

SEQ ID NO: 677259 - protein, 9 aa, Homo Sapiens
RATIRLPEH

SEQ ID NO: 677260 - protein, 9 aa, Homo Sapiens
KGNKIHGEI

SEQ ID NO: 677261 - protein, 9 aa, Homo Sapiens
IASKLDIQR

SEQ ID NO: 677262 - protein, 9 aa, Homo Sapiens
KRPRRPCCR

SEQ ID NO: 677263 - protein, 9 aa, Homo Sapiens
PGLFEPAAK

SEQ ID NO: 677264 - protein, 9 aa, Homo Sapiens
MDLLSGVLT

SEQ ID NO: 677265 - protein, 9 aa, Homo Sapiens
AVFTEYTDG

SEQ ID NO: 677266 - protein, 9 aa, Homo Sapiens
QISKENQIR

SEQ ID NO: 677267 - protein, 9 aa, Homo Sapiens
GPVPQDLQE

SEQ ID NO: 677268 - protein, 9 aa, Homo Sapiens
RHMQGTCPV

SEQ ID NO: 677269 - protein, 9 aa, Homo Sapiens
VHSFASCQA

SEQ ID NO: 677270 - protein, 9 aa, Homo Sapiens
IKDNGVGYA

SEQ ID NO: 677271 - protein, 9 aa, Homo Sapiens
LLRHMQGTC

SEQ ID NO: 677272 - protein, 9 aa, Homo Sapiens
RRPCCRPPG

SEQ ID NO: 677273 - protein, 9 aa, Homo Sapiens
LSFSTIRDK

SEQ ID NO: 677274 - protein, 9 aa, Homo Sapiens
PVQLRGRCH

SEQ ID NO: 677275 - protein, 9 aa, Homo Sapiens
SRKTHIIIL

SEQ ID NO: 677276 - protein, 9 aa, Homo Sapiens
ACAHCSGNC

SEQ ID NO: 677277 - protein, 9 aa, Homo Sapiens
PAQQIYHLC

SEQ ID NO: 677278 - protein, 9 aa, Homo Sapiens
LAPKILEDT

SEQ ID NO: 677279 - protein, 9 aa, Homo Sapiens
ALWQRKDIL

SEQ ID NO: 677280 - protein, 9 aa, Homo Sapiens
ASVFLVRSA

SEQ ID NO: 677281 - protein, 9 aa, Homo Sapiens
MVDSFLPVS

SEQ ID NO: 677282 - protein, 9 aa, Homo Sapiens
KPNSVRQRP

SEQ ID NO: 677283 - protein, 9 aa, Homo Sapiens
QRVTTVSEL

SEQ ID NO: 677284 - protein, 9 aa, Homo Sapiens
HLDQKEKQP

SEQ ID NO: 677285 - protein, 9 aa, Homo Sapiens
ASTGVTSWC

SEQ ID NO: 677286 - protein, 9 aa, Homo Sapiens
HHLLPLADS

SEQ ID NO: 677287 - protein, 9 aa, Homo Sapiens
QRLEKGAPP

SEQ ID NO: 677288 - protein, 9 aa, Homo Sapiens
AHQHRDSYL

SEQ ID NO: 677289 - protein, 9 aa, Homo Sapiens
ISWQKINPF

SEQ ID NO: 677290 - protein, 9 aa, Homo Sapiens
VFPRTSISP

SEQ ID NO: 677291 - protein, 9 aa, Homo Sapiens
DDYNYYYNR

SEQ ID NO: 677292 - protein, 9 aa, Homo Sapiens
RTRLEILDK

SEQ ID NO: 677293 - protein, 9 aa, Homo Sapiens
IQTWVPLMG

SEQ ID NO: 677294 - protein, 9 aa, Homo Sapiens
LAVDADSGY

SEQ ID NO: 677295 - protein, 9 aa, Homo Sapiens
LISLDSVPA

SEQ ID NO: 677296 - protein, 9 aa, Homo Sapiens
KFQKDLNTC

SEQ ID NO: 677297 - protein, 9 aa, Homo Sapiens
QAKPLLGDQ

SEQ ID NO: 677298 - protein, 9 aa, Homo Sapiens
RSPEATSPD

SEQ ID NO: 677299 - protein, 9 aa, Homo Sapiens
THSASALDQ

SEQ ID NO: 677300 - protein, 9 aa, Homo Sapiens
DPQRTLQEA

SEQ ID NO: 677301 - protein, 9 aa, Homo Sapiens
QAVLLPLTF

SEQ ID NO: 677302 - protein, 9 aa, Homo Sapiens
PEPWNALLR

SEQ ID NO: 677303 - protein, 9 aa, Homo Sapiens
PRRPCCRPP

SEQ ID NO: 677304 - protein, 9 aa, Homo Sapiens
IISEVKAQY

SEQ ID NO: 677305 - protein, 9 aa, Homo Sapiens
ILDKGLATS

SEQ ID NO: 677306 - protein, 9 aa, Homo Sapiens
RNGSVPRAR

SEQ ID NO: 677307 - protein, 9 aa, Homo Sapiens
FSPQKIPLS

SEQ ID NO: 677308 - protein, 9 aa, Homo Sapiens
SRTLHPVLL

SEQ ID NO: 677309 - protein, 9 aa, Homo Sapiens
RRADSAAVP

SEQ ID NO: 677310 - protein, 9 aa, Homo Sapiens
NVDNDSTTS

SEQ ID NO: 677311 - protein, 9 aa, Homo Sapiens
LETCARCCT

SEQ ID NO: 677312 - protein, 9 aa, Homo Sapiens
QGITDEKAF

SEQ ID NO: 677313 - protein, 9 aa, Homo Sapiens
VRGCAVPSS

SEQ ID NO: 677314 - protein, 9 aa, Homo Sapiens
MHEFHSEVF

SEQ ID NO: 677315 - protein, 9 aa, Homo Sapiens
ASFDHSLQP

SEQ ID NO: 677316 - protein, 9 aa, Homo Sapiens
PEQRLRVIT

SEQ ID NO: 677317 - protein, 9 aa, Homo Sapiens
GLTIKDNGV

SEQ ID NO: 677318 - protein, 9 aa, Homo Sapiens
YYGAVNQSE

SEQ ID NO: 677319 - protein, 9 aa, Homo Sapiens
FKQSKTQMM

SEQ ID NO: 677320 - protein, 9 aa, Homo Sapiens
TWVPLMGVI

SEQ ID NO: 677321 - protein, 9 aa, Homo Sapiens
AGATEARPL

SEQ ID NO: 677322 - protein, 9 aa, Homo Sapiens
RPCFHAMPS

SEQ ID NO: 677323 - protein, 9 aa, Homo Sapiens
LQLTSNPLV

SEQ ID NO: 677324 - protein, 9 aa, Homo Sapiens
KRDHVVPIL

SEQ ID NO: 677325 - protein, 9 aa, Homo Sapiens
VVGACGVGK

SEQ ID NO: 677326 - protein, 9 aa, Homo Sapiens
FYAVQKLAQ

SEQ ID NO: 677327 - protein, 9 aa, Homo Sapiens
VFEVVWEAI

SEQ ID NO: 677328 - protein, 9 aa, Homo Sapiens
HGVAQLTQH

SEQ ID NO: 677329 - protein, 9 aa, Homo Sapiens
DSTTSVELE

SEQ ID NO: 677330 - protein, 9 aa, Homo Sapiens
HWVQQQIRP

SEQ ID NO: 677331 - protein, 9 aa, Homo Sapiens
QELKNRPVG

SEQ ID NO: 677332 - protein, 9 aa, Homo Sapiens
TGMSIYSDK

SEQ ID NO: 677333 - protein, 9 aa, Homo Sapiens
FVQKGVSVP

SEQ ID NO: 677334 - protein, 9 aa, Homo Sapiens
LIYSSYLTR

SEQ ID NO: 677335 - protein, 9 aa, Homo Sapiens
SHLFVKIQD

SEQ ID NO: 677336 - protein, 9 aa, Homo Sapiens
SREMPEPHS

SEQ ID NO: 677337 - protein, 9 aa, Homo Sapiens
NVQQYCRKS

SEQ ID NO: 677338 - protein, 9 aa, Homo Sapiens
EGLRKLQKL

SEQ ID NO: 677339 - protein, 9 aa, Homo Sapiens
SEGTWAWDK

SEQ ID NO: 677340 - protein, 9 aa, Homo Sapiens
KYSDHPLNL

SEQ ID NO: 677341 - protein, 9 aa, Homo Sapiens
EERLSFYQT

SEQ ID NO: 677342 - protein, 9 aa, Homo Sapiens
HSSGDSVVS

SEQ ID NO: 677343 - protein, 9 aa, Homo Sapiens
VGDQEWIPF

SEQ ID NO: 677344 - protein, 9 aa, Homo Sapiens
TLTQHVQPA

SEQ ID NO: 677345 - protein, 9 aa, Homo Sapiens
KREAGSGYR

SEQ ID NO: 677346 - protein, 9 aa, Homo Sapiens
GVAQLTQHH

SEQ ID NO: 677347 - protein, 9 aa, Homo Sapiens
LQASRGYVV

SEQ ID NO: 677348 - protein, 9 aa, Homo Sapiens
LAVLLEVTD

SEQ ID NO: 677349 - protein, 9 aa, Homo Sapiens
EHRTATIIE

SEQ ID NO: 677350 - protein, 9 aa, Homo Sapiens
GQLKHLDQK

SEQ ID NO: 677351 - protein, 9 aa, Homo Sapiens
QQQLDNSAA

SEQ ID NO: 677352 - protein, 9 aa, Homo Sapiens
NLLRPKICG

SEQ ID NO: 677353 - protein, 9 aa, Homo Sapiens
PRMHEFHSE

SEQ ID NO: 677354 - protein, 9 aa, Homo Sapiens
ECQLVRCAC

SEQ ID NO: 677355 - protein, 9 aa, Homo Sapiens
WMDIMYEAV

SEQ ID NO: 677356 - protein, 9 aa, Homo Sapiens
DVERDWEGK

SEQ ID NO: 677357 - protein, 9 aa, Homo Sapiens
RPRRPCCRP

SEQ ID NO: 677358 - protein, 9 aa, Homo Sapiens
FEEFEKLLS

SEQ ID NO: 677359 - protein, 9 aa, Homo Sapiens
LTVRYSPEL

SEQ ID NO: 677360 - protein, 9 aa, Homo Sapiens
MKEYCPIHI

SEQ ID NO: 677361 - protein, 9 aa, Homo Sapiens
YSEDGSFKK

SEQ ID NO: 677362 - protein, 9 aa, Homo Sapiens
YKEEPLIVT

SEQ ID NO: 677363 - protein, 9 aa, Homo Sapiens
WIQLNLDYL

SEQ ID NO: 677364 - protein, 9 aa, Homo Sapiens
HQPQQQQVK

SEQ ID NO: 677365 - protein, 9 aa, Homo Sapiens
KPLTLSLHC

SEQ ID NO: 677366 - protein, 9 aa, Homo Sapiens
QPPQPITCS

SEQ ID NO: 677367 - protein, 9 aa, Homo Sapiens
ARRADSGEY

SEQ ID NO: 677368 - protein, 9 aa, Homo Sapiens
HNWQGLRAT

SEQ ID NO: 677369 - protein, 9 aa, Homo Sapiens
KVRAEWMRM

SEQ ID NO: 677370 - protein, 9 aa, Homo Sapiens
TMDLLSGVL

SEQ ID NO: 677371 - protein, 9 aa, Homo Sapiens
NRALFTLSS

SEQ ID NO: 677372 - protein, 9 aa, Homo Sapiens
GGPCCRQRL

SEQ ID NO: 677373 - protein, 9 aa, Homo Sapiens
VNQSECEYT

SEQ ID NO: 677374 - protein, 9 aa, Homo Sapiens
MTIMFEVQD

SEQ ID NO: 677375 - protein, 9 aa, Homo Sapiens
ENVQQYCRK

SEQ ID NO: 677376 - protein, 9 aa, Homo Sapiens
VARALYEEL

SEQ ID NO: 677377 - protein, 9 aa, Homo Sapiens
GYSRNLVSD

SEQ ID NO: 677378 - protein, 9 aa, Homo Sapiens
EPVQLRGRC

SEQ ID NO: 677379 - protein, 9 aa, Homo Sapiens
TVSRKKKET

SEQ ID NO: 677380 - protein, 9 aa, Homo Sapiens
KSRLKIAEP

SEQ ID NO: 677381 - protein, 9 aa, Homo Sapiens
KPRMHEFHS

SEQ ID NO: 677382 - protein, 9 aa, Homo Sapiens
VWPSKQAGH

SEQ ID NO: 677383 - protein, 9 aa, Homo Sapiens
LNKENKTCE

SEQ ID NO: 677384 - protein, 9 aa, Homo Sapiens
QNSPQEPRN

SEQ ID NO: 677385 - protein, 9 aa, Homo Sapiens
HLKAETLIK

SEQ ID NO: 677386 - protein, 9 aa, Homo Sapiens
GPGLEQRHG

SEQ ID NO: 677387 - protein, 9 aa, Homo Sapiens
SVVKMKSTV

SEQ ID NO: 677388 - protein, 9 aa, Homo Sapiens
RGIGKRMRP

SEQ ID NO: 677389 - protein, 9 aa, Homo Sapiens
RFYAGGEHY

SEQ ID NO: 677390 - protein, 9 aa, Homo Sapiens
AKAFWMELE

SEQ ID NO: 677391 - protein, 9 aa, Homo Sapiens
QASRGYVVR

SEQ ID NO: 677392 - protein, 9 aa, Homo Sapiens
PQDLQEQQR

SEQ ID NO: 677393 - protein, 9 aa, Homo Sapiens
TRNGFYLSF

SEQ ID NO: 677394 - protein, 9 aa, Homo Sapiens
AFKALKEEG

SEQ ID NO: 677395 - protein, 9 aa, Homo Sapiens
PSRSQDSCC

SEQ ID NO: 677396 - protein, 9 aa, Homo Sapiens
SPYALWQRK

SEQ ID NO: 677397 - protein, 9 aa, Homo Sapiens
VCADVWILV

SEQ ID NO: 677398 - protein, 9 aa, Homo Sapiens
VLDDAQERS

SEQ ID NO: 677399 - protein, 9 aa, Homo Sapiens
VDSFVRTLE

SEQ ID NO: 677400 - protein, 9 aa, Homo Sapiens
SDAQRAQPA

SEQ ID NO: 677401 - protein, 9 aa, Homo Sapiens
PSICFLKPT

SEQ ID NO: 677402 - protein, 9 aa, Homo Sapiens
KNYSKTRFA

SEQ ID NO: 677403 - protein, 9 aa, Homo Sapiens
FQNTSLSGT

SEQ ID NO: 677404 - protein, 9 aa, Homo Sapiens
RQKERALDD

SEQ ID NO: 677405 - protein, 9 aa, Homo Sapiens
TQLGRLDSS

SEQ ID NO: 677406 - protein, 9 aa, Homo Sapiens
GEEVSKEGF

SEQ ID NO: 677407 - protein, 9 aa, Homo Sapiens
MTCASCLSN

SEQ ID NO: 677408 - protein, 9 aa, Homo Sapiens
FDHSLQPSI

SEQ ID NO: 677409 - protein, 9 aa, Homo Sapiens
LLPLADSST

SEQ ID NO: 677410 - protein, 9 aa, Homo Sapiens
SVRQRPIAF

SEQ ID NO: 677411 - protein, 9 aa, Homo Sapiens
GVFEDEEEF

SEQ ID NO: 677412 - protein, 9 aa, Homo Sapiens
AEKSFRNLR

SEQ ID NO: 677413 - protein, 9 aa, Homo Sapiens
LMKQKREEQ

SEQ ID NO: 677414 - protein, 9 aa, Homo Sapiens
CFYLNCKTS

SEQ ID NO: 677415 - protein, 9 aa, Homo Sapiens
STEVWASST

SEQ ID NO: 677416 - protein, 9 aa, Homo Sapiens
LALLLALLQ

SEQ ID NO: 677417 - protein, 9 aa, Homo Sapiens
NNLTTSKSR

SEQ ID NO: 677418 - protein, 9 aa, Homo Sapiens
DIADVERDW

SEQ ID NO: 677419 - protein, 9 aa, Homo Sapiens
LFESDIVNI

SEQ ID NO: 677420 - protein, 9 aa, Homo Sapiens
LDSIISEVK

SEQ ID NO: 677421 - protein, 9 aa, Homo Sapiens
PVGMQKWWK

SEQ ID NO: 677422 - protein, 9 aa, Homo Sapiens
SSPSIFSSD

SEQ ID NO: 677423 - protein, 9 aa, Homo Sapiens
QAKFFLVGI

SEQ ID NO: 677424 - protein, 9 aa, Homo Sapiens
SIEYVTKRN

SEQ ID NO: 677425 - protein, 9 aa, Homo Sapiens
TVLTPLPNP

SEQ ID NO: 677426 - protein, 9 aa, Homo Sapiens
STQPPLEAA

SEQ ID NO: 677427 - protein, 9 aa, Homo Sapiens
KATQFNRAL

SEQ ID NO: 677428 - protein, 9 aa, Homo Sapiens
LDQKEKQPE

SEQ ID NO: 677429 - protein, 9 aa, Homo Sapiens
ARFSVIYRQ

SEQ ID NO: 677430 - protein, 9 aa, Homo Sapiens
KVSTEMGLL

SEQ ID NO: 677431 - protein, 9 aa, Homo Sapiens
CMLLAVMAY

SEQ ID NO: 677432 - protein, 9 aa, Homo Sapiens
TVTAIKLLG

SEQ ID NO: 677433 - protein, 9 aa, Homo Sapiens
KASFLWDFK

SEQ ID NO: 677434 - protein, 9 aa, Homo Sapiens
CFHAMPSEI

SEQ ID NO: 677435 - protein, 9 aa, Homo Sapiens
FVQMVRKIL

SEQ ID NO: 677436 - protein, 9 aa, Homo Sapiens
APSQGRPCL

SEQ ID NO: 677437 - protein, 9 aa, Homo Sapiens
HPVVQRRLD

SEQ ID NO: 677438 - protein, 9 aa, Homo Sapiens
MQHIMGTVT

SEQ ID NO: 677439 - protein, 9 aa, Homo Sapiens
CTFCKYPGI

SEQ ID NO: 677440 - protein, 9 aa, Homo Sapiens
VVARALYEE

SEQ ID NO: 677441 - protein, 9 aa, Homo Sapiens
CASSSMFLK

SEQ ID NO: 677442 - protein, 9 aa, Homo Sapiens
REVEQCFAT

SEQ ID NO: 677443 - protein, 9 aa, Homo Sapiens
PGTRKRLRN

SEQ ID NO: 677444 - protein, 9 aa, Homo Sapiens
DAETLRKSM

SEQ ID NO: 677445 - protein, 9 aa, Homo Sapiens
TIEQSSVWA

SEQ ID NO: 677446 - protein, 9 aa, Homo Sapiens
PPQPITCSP

SEQ ID NO: 677447 - protein, 9 aa, Homo Sapiens
RESIAAMVD

SEQ ID NO: 677448 - protein, 9 aa, Homo Sapiens
KLQRHLAVL

SEQ ID NO: 677449 - protein, 9 aa, Homo Sapiens
RLKSWPRSV

SEQ ID NO: 677450 - protein, 9 aa, Homo Sapiens
LKRPRRPCC

SEQ ID NO: 677451 - protein, 9 aa, Homo Sapiens
QSLVAVKYE

SEQ ID NO: 677452 - protein, 9 aa, Homo Sapiens
QSPAALTFR

SEQ ID NO: 677453 - protein, 9 aa, Homo Sapiens
NPYPTKSEK

SEQ ID NO: 677454 - protein, 9 aa, Homo Sapiens
GTWAWDKAS

SEQ ID NO: 677455 - protein, 9 aa, Homo Sapiens
NKENKTCEI

SEQ ID NO: 677456 - protein, 9 aa, Homo Sapiens
KYCDLRLIY

SEQ ID NO: 677457 - protein, 9 aa, Homo Sapiens
VSYGRIIVS

SEQ ID NO: 677458 - protein, 9 aa, Homo Sapiens
LTQHVQPAE

SEQ ID NO: 677459 - protein, 9 aa, Homo Sapiens
PSALLFRGC

SEQ ID NO: 677460 - protein, 9 aa, Homo Sapiens
RYSPELTAA

SEQ ID NO: 677461 - protein, 9 aa, Homo Sapiens
SRRVTLVIA

SEQ ID NO: 677462 - protein, 9 aa, Homo Sapiens
ILQLSLQKC

SEQ ID NO: 677463 - protein, 9 aa, Homo Sapiens
STAGEISGA

SEQ ID NO: 677464 - protein, 9 aa, Homo Sapiens
YSDGEDGKI

SEQ ID NO: 677465 - protein, 9 aa, Homo Sapiens
NPVGLLRHM

SEQ ID NO: 677466 - protein, 9 aa, Homo Sapiens
GSATSQTIE

SEQ ID NO: 677467 - protein, 9 aa, Homo Sapiens
NDVSPPPLV

SEQ ID NO: 677468 - protein, 9 aa, Homo Sapiens
SQGYSYLPF

SEQ ID NO: 677469 - protein, 9 aa, Homo Sapiens
DLLEKILVL

SEQ ID NO: 677470 - protein, 9 aa, Homo Sapiens
SALLFRGCN

SEQ ID NO: 677471 - protein, 9 aa, Homo Sapiens
PSILNGLDK

SEQ ID NO: 677472 - protein, 9 aa, Homo Sapiens
DDEIKEDDG

SEQ ID NO: 677473 - protein, 9 aa, Homo Sapiens
TLGLLMEEM

SEQ ID NO: 677474 - protein, 9 aa, Homo Sapiens
VGKYHIQAC

SEQ ID NO: 677475 - protein, 9 aa, Homo Sapiens
YLNCKTSQF

SEQ ID NO: 677476 - protein, 9 aa, Homo Sapiens
QLKHLDQKE

SEQ ID NO: 677477 - protein, 9 aa, Homo Sapiens
HGTQQAVPL

SEQ ID NO: 677478 - protein, 9 aa, Homo Sapiens
GMDTEKPGT

SEQ ID NO: 677479 - protein, 9 aa, Homo Sapiens
GQRQHLSDA

SEQ ID NO: 677480 - protein, 9 aa, Homo Sapiens
RASVFLVRS

SEQ ID NO: 677481 - protein, 9 aa, Homo Sapiens
FNHRLVVLG

SEQ ID NO: 677482 - protein, 9 aa, Homo Sapiens
GKVSTAGEI

SEQ ID NO: 677483 - protein, 9 aa, Homo Sapiens
ADTLFKRAT

SEQ ID NO: 677484 - protein, 9 aa, Homo Sapiens
ENQIRIRFV

SEQ ID NO: 677485 - protein, 9 aa, Homo Sapiens
RGPVPQDLQ

SEQ ID NO: 677486 - protein, 9 aa, Homo Sapiens
VFPQHHLLP

SEQ ID NO: 677487 - protein, 9 aa, Homo Sapiens
AIMNNVSES

SEQ ID NO: 677488 - protein, 9 aa, Homo Sapiens
VPGKQISKE

SEQ ID NO: 677489 - protein, 9 aa, Homo Sapiens
VRTDSLKGQ

SEQ ID NO: 677490 - protein, 9 aa, Homo Sapiens
KAKQCQNKF

SEQ ID NO: 677491 - protein, 9 aa, Homo Sapiens
PPRRLDQRP

SEQ ID NO: 677492 - protein, 9 aa, Homo Sapiens
GYKLAGMDT

SEQ ID NO: 677493 - protein, 9 aa, Homo Sapiens
AGPAAGVSA

SEQ ID NO: 677494 - protein, 9 aa, Homo Sapiens
PFFAANTLW

SEQ ID NO: 677495 - protein, 9 aa, Homo Sapiens
QSTASEKEH

SEQ ID NO: 677496 - protein, 9 aa, Homo Sapiens
ALVHLKTHP

SEQ ID NO: 677497 - protein, 9 aa, Homo Sapiens
NHRKASLEI

SEQ ID NO: 677498 - protein, 9 aa, Homo Sapiens
LMTQVDHIL

SEQ ID NO: 677499 - protein, 9 aa, Homo Sapiens
LSSNDVVDF

SEQ ID NO: 677500 - protein, 9 aa, Homo Sapiens
RWIKELNIR

SEQ ID NO: 677501 - protein, 9 aa, Homo Sapiens
LRYSDGEDG

SEQ ID NO: 677502 - protein, 9 aa, Homo Sapiens
LGLCFWTAG

SEQ ID NO: 677503 - protein, 9 aa, Homo Sapiens
SVVVNGDGK

SEQ ID NO: 677504 - protein, 9 aa, Homo Sapiens
LLHSGLLEE

SEQ ID NO: 677505 - protein, 9 aa, Homo Sapiens
VITTNIRSA

SEQ ID NO: 677506 - protein, 9 aa, Homo Sapiens
RALFTLSSH

SEQ ID NO: 677507 - protein, 9 aa, Homo Sapiens
TDEKAFKAL

SEQ ID NO: 677508 - protein, 9 aa, Homo Sapiens
SGTANSRQF

SEQ ID NO: 677509 - protein, 9 aa, Homo Sapiens
TDAATLYCI

SEQ ID NO: 677510 - protein, 9 aa, Homo Sapiens
LSMACPIMF

SEQ ID NO: 677511 - protein, 9 aa, Homo Sapiens
QEWIPFVEN

SEQ ID NO: 677512 - protein, 9 aa, Homo Sapiens
QRHGTQQAV

SEQ ID NO: 677513 - protein, 9 aa, Homo Sapiens
RNSWPWKWQ

SEQ ID NO: 677514 - protein, 9 aa, Homo Sapiens
AYVAALRHS

SEQ ID NO: 677515 - protein, 9 aa, Homo Sapiens
KAETLIKLS

SEQ ID NO: 677516 - protein, 9 aa, Homo Sapiens
YLPDLWLEP

SEQ ID NO: 677517 - protein, 9 aa, Homo Sapiens
LKTHPVSEY

SEQ ID NO: 677518 - protein, 9 aa, Homo Sapiens
LGRLDSSVV

SEQ ID NO: 677519 - protein, 9 aa, Homo Sapiens
KSEKLDEHR

SEQ ID NO: 677520 - protein, 9 aa, Homo Sapiens
AGPVHVRSS

SEQ ID NO: 677521 - protein, 9 aa, Homo Sapiens
VLLEVTDGP

SEQ ID NO: 677522 - protein, 9 aa, Homo Sapiens
LRNWSNTPI

SEQ ID NO: 677523 - protein, 9 aa, Homo Sapiens
VEERLSFYQ

SEQ ID NO: 677524 - protein, 9 aa, Homo Sapiens
NLSRKTHII

SEQ ID NO: 677525 - protein, 9 aa, Homo Sapiens
RSSSSPATA

SEQ ID NO: 677526 - protein, 9 aa, Homo Sapiens
LKGQRGRLP

SEQ ID NO: 677527 - protein, 9 aa, Homo Sapiens
IMNNVSESN

SEQ ID NO: 677528 - protein, 9 aa, Homo Sapiens
LQLVDVCTF

SEQ ID NO: 677529 - protein, 9 aa, Homo Sapiens
FVGTMDLLS

SEQ ID NO: 677530 - protein, 9 aa, Homo Sapiens
GHTNNVFKA

SEQ ID NO: 677531 - protein, 9 aa, Homo Sapiens
IMKLSLPES

SEQ ID NO: 677532 - protein, 9 aa, Homo Sapiens
KYTFTPVKM

SEQ ID NO: 677533 - protein, 9 aa, Homo Sapiens
FQLFESDIV

SEQ ID NO: 677534 - protein, 9 aa, Homo Sapiens
VLAVDADSG

SEQ ID NO: 677535 - protein, 9 aa, Homo Sapiens
GARPKTDDR

SEQ ID NO: 677536 - protein, 9 aa, Homo Sapiens
QPPLEAADT

SEQ ID NO: 677537 - protein, 9 aa, Homo Sapiens
INENGNPIY

SEQ ID NO: 677538 - protein, 9 aa, Homo Sapiens
PYHLLHSGL

SEQ ID NO: 677539 - protein, 9 aa, Homo Sapiens
PVPTVRWMK

SEQ ID NO: 677540 - protein, 9 aa, Homo Sapiens
VKPREPCTP

SEQ ID NO: 677541 - protein, 9 aa, Homo Sapiens
WLHQSTASE

SEQ ID NO: 677542 - protein, 9 aa, Homo Sapiens
GSDPRLKQA

SEQ ID NO: 677543 - protein, 9 aa, Homo Sapiens
KAFKALKEE

SEQ ID NO: 677544 - protein, 9 aa, Homo Sapiens
PDIFSHGTQ

SEQ ID NO: 677545 - protein, 9 aa, Homo Sapiens
SKQAGHQDK

SEQ ID NO: 677546 - protein, 9 aa, Homo Sapiens
LHDGTQINR

SEQ ID NO: 677547 - protein, 9 aa, Homo Sapiens
SEDGSFKKP

SEQ ID NO: 677548 - protein, 9 aa, Homo Sapiens
TQINGNYAR

SEQ ID NO: 677549 - protein, 9 aa, Homo Sapiens
VHLKTHPVS

SEQ ID NO: 677550 - protein, 9 aa, Homo Sapiens
DTGLYLTNL

SEQ ID NO: 677551 - protein, 9 aa, Homo Sapiens
NFLQAHNWQ

SEQ ID NO: 677552 - protein, 9 aa, Homo Sapiens
EPLRGPVPQ

SEQ ID NO: 677553 - protein, 9 aa, Homo Sapiens
VSRGVAHWV

SEQ ID NO: 677554 - protein, 9 aa, Homo Sapiens
HDGTQINRN

SEQ ID NO: 677555 - protein, 9 aa, Homo Sapiens
LYFFLNLGR

SEQ ID NO: 677556 - protein, 9 aa, Homo Sapiens
VTSILRQTL

SEQ ID NO: 677557 - protein, 9 aa, Homo Sapiens
QKLKVLLEP

SEQ ID NO: 677558 - protein, 9 aa, Homo Sapiens
RFLFKPKYA

SEQ ID NO: 677559 - protein, 9 aa, Homo Sapiens
VQKLAQRVA

SEQ ID NO: 677560 - protein, 9 aa, Homo Sapiens
ADRISSTFS

SEQ ID NO: 677561 - protein, 9 aa, Homo Sapiens
LRHMQGTCP

SEQ ID NO: 677562 - protein, 9 aa, Homo Sapiens
MFTDEDATV

SEQ ID NO: 677563 - protein, 9 aa, Homo Sapiens
EFHSEVFMI

SEQ ID NO: 677564 - protein, 9 aa, Homo Sapiens
GTQPPSILN

SEQ ID NO: 677565 - protein, 9 aa, Homo Sapiens
KEEEEGKED

SEQ ID NO: 677566 - protein, 9 aa, Homo Sapiens
CVPLLTEDM

SEQ ID NO: 677567 - protein, 9 aa, Homo Sapiens
DWETPSNTK

SEQ ID NO: 677568 - protein, 9 aa, Homo Sapiens
ENGNPIYKY

SEQ ID NO: 677569 - protein, 9 aa, Homo Sapiens
TRLQQITNS

SEQ ID NO: 677570 - protein, 9 aa, Homo Sapiens
AGGSGGNTR

SEQ ID NO: 677571 - protein, 9 aa, Homo Sapiens
RNFEVQRGD

SEQ ID NO: 677572 - protein, 9 aa, Homo Sapiens
HQSTASEKE

SEQ ID NO: 677573 - protein, 9 aa, Homo Sapiens
MNNVSESNG

SEQ ID NO: 677574 - protein, 9 aa, Homo Sapiens
CWAGTGKNF

SEQ ID NO: 677575 - protein, 9 aa, Homo Sapiens
LLGEVYVNG

SEQ ID NO: 677576 - protein, 9 aa, Homo Sapiens
ETSSQGHLD

SEQ ID NO: 677577 - protein, 9 aa, Homo Sapiens
SGVMSSPPV

SEQ ID NO: 677578 - protein, 9 aa, Homo Sapiens
YWKRLARVM

SEQ ID NO: 677579 - protein, 9 aa, Homo Sapiens
PYLQLEGHR

SEQ ID NO: 677580 - protein, 9 aa, Homo Sapiens
EGHRLPSLF

SEQ ID NO: 677581 - protein, 9 aa, Homo Sapiens
GNLKNKCLQ

SEQ ID NO: 677582 - protein, 9 aa, Homo Sapiens
FRNLRKALL

SEQ ID NO: 677583 - protein, 9 aa, Homo Sapiens
SKITEPLLE

SEQ ID NO: 677584 - protein, 9 aa, Homo Sapiens
VHVRSSSSP

SEQ ID NO: 677585 - protein, 9 aa, Homo Sapiens
CEYHRRLHG

SEQ ID NO: 677586 - protein, 9 aa, Homo Sapiens
LLELQNVFS

SEQ ID NO: 677587 - protein, 9 aa, Homo Sapiens
RAAQRCHEY

SEQ ID NO: 677588 - protein, 9 aa, Homo Sapiens
GVEVVSENS

SEQ ID NO: 677589 - protein, 9 aa, Homo Sapiens
ERALDDAQA

SEQ ID NO: 677590 - protein, 9 aa, Homo Sapiens
VPPHSSLGH

SEQ ID NO: 677591 - protein, 9 aa, Homo Sapiens
VAVKYEVIV

SEQ ID NO: 677592 - protein, 9 aa, Homo Sapiens
LSRNGSVPR

SEQ ID NO: 677593 - protein, 9 aa, Homo Sapiens
AEYKVSSEP

SEQ ID NO: 677594 - protein, 9 aa, Homo Sapiens
HFRATIRLP

SEQ ID NO: 677595 - protein, 9 aa, Homo Sapiens
TSKPVAVEQ

SEQ ID NO: 677596 - protein, 9 aa, Homo Sapiens
RKASFLWDF

SEQ ID NO: 677597 - protein, 9 aa, Homo Sapiens
RHSSYAAVS

SEQ ID NO: 677598 - protein, 9 aa, Homo Sapiens
EQRHGTQQA

SEQ ID NO: 677599 - protein, 9 aa, Homo Sapiens
NVLTVRYSP

SEQ ID NO: 677600 - protein, 9 aa, Homo Sapiens
KVKDVRQYL

SEQ ID NO: 677601 - protein, 9 aa, Homo Sapiens
RNVDNDSTT

SEQ ID NO: 677602 - protein, 9 aa, Homo Sapiens
SGEYRAAVH

SEQ ID NO: 677603 - protein, 9 aa, Homo Sapiens
LDEHRTATI

SEQ ID NO: 677604 - protein, 9 aa, Homo Sapiens
PKPGLFEPA

SEQ ID NO: 677605 - protein, 9 aa, Homo Sapiens
WSAFSPYAL

SEQ ID NO: 677606 - protein, 9 aa, Homo Sapiens
PGPGACVPL

SEQ ID NO: 677607 - protein, 9 aa, Homo Sapiens
LAVLSPQRV

SEQ ID NO: 677608 - protein, 9 aa, Homo Sapiens
KNLLNKEKN

SEQ ID NO: 677609 - protein, 9 aa, Homo Sapiens
FCKYPGIPG

SEQ ID NO: 677610 - protein, 9 aa, Homo Sapiens
LLAIMNNVS

SEQ ID NO: 677611 - protein, 9 aa, Homo Sapiens
EDGSFKKPL

SEQ ID NO: 677612 - protein, 9 aa, Homo Sapiens
MYEAVDSRE

SEQ ID NO: 677613 - protein, 9 aa, Homo Sapiens
AILALLLAL

SEQ ID NO: 677614 - protein, 9 aa, Homo Sapiens
FLDASILQL

SEQ ID NO: 677615 - protein, 9 aa, Homo Sapiens
ALNPSALLF

SEQ ID NO: 677616 - protein, 9 aa, Homo Sapiens
ITFYQTLLA

SEQ ID NO: 677617 - protein, 9 aa, Homo Sapiens
TCEYHRRLH

SEQ ID NO: 677618 - protein, 9 aa, Homo Sapiens
RPLKSTEVW

SEQ ID NO: 677619 - protein, 9 aa, Homo Sapiens
DEPVQLRGR

SEQ ID NO: 677620 - protein, 9 aa, Homo Sapiens
WLILFLKIT

SEQ ID NO: 677621 - protein, 9 aa, Homo Sapiens
AAATINQAT

SEQ ID NO: 677622 - protein, 9 aa, Homo Sapiens
QPDIFSHGT

SEQ ID NO: 677623 - protein, 9 aa, Homo Sapiens
EYIASKLDI

SEQ ID NO: 677624 - protein, 9 aa, Homo Sapiens
GYGLKSKVT

SEQ ID NO: 677625 - protein, 9 aa, Homo Sapiens
WSNTPILVD

SEQ ID NO: 677626 - protein, 9 aa, Homo Sapiens
TGVTSWCYQ

SEQ ID NO: 677627 - protein, 9 aa, Homo Sapiens
KQKREEQQR

SEQ ID NO: 677628 - protein, 9 aa, Homo Sapiens
EAGVEVVSE

SEQ ID NO: 677629 - protein, 9 aa, Homo Sapiens
KEYCPIHIL

SEQ ID NO: 677630 - protein, 9 aa, Homo Sapiens
WIPFVENLS

SEQ ID NO: 677631 - protein, 9 aa, Homo Sapiens
LKWILTILL

SEQ ID NO: 677632 - protein, 9 aa, Homo Sapiens
LAVWILAVL

SEQ ID NO: 677633 - protein, 9 aa, Homo Sapiens
RVITTNIRS

SEQ ID NO: 677634 - protein, 9 aa, Homo Sapiens
PITCSPDAL

SEQ ID NO: 677635 - protein, 9 aa, Homo Sapiens
PAPPGPRGP

SEQ ID NO: 677636 - protein, 9 aa, Homo Sapiens
KPGLFEPAA

SEQ ID NO: 677637 - protein, 9 aa, Homo Sapiens
CCRQRLEKG

SEQ ID NO: 677638 - protein, 9 aa, Homo Sapiens
AWLHQSTAS

SEQ ID NO: 677639 - protein, 9 aa, Homo Sapiens
HPEKPDSVD

SEQ ID NO: 677640 - protein, 9 aa, Homo Sapiens
IEQLKWILT

SEQ ID NO: 677641 - protein, 9 aa, Homo Sapiens
HIMGTVTAI

SEQ ID NO: 677642 - protein, 9 aa, Homo Sapiens
QPAPPGPRG

SEQ ID NO: 677643 - protein, 9 aa, Homo Sapiens
RHVQQHNLA

SEQ ID NO: 677644 - protein, 9 aa, Homo Sapiens
KPKYAYGTL

SEQ ID NO: 677645 - protein, 9 aa, Homo Sapiens
SWVSFLISL

SEQ ID NO: 677646 - protein, 9 aa, Homo Sapiens
LRHSSYAAV

SEQ ID NO: 677647 - protein, 9 aa, Homo Sapiens
LRKHKEITS

SEQ ID NO: 677648 - protein, 9 aa, Homo Sapiens
FFFVIVVLL

SEQ ID NO: 677649 - protein, 9 aa, Homo Sapiens
EEKKVRAEW

SEQ ID NO: 677650 - protein, 9 aa, Homo Sapiens
FTCQASFDH

SEQ ID NO: 677651 - protein, 9 aa, Homo Sapiens
VKKCTNHER

SEQ ID NO: 677652 - protein, 9 aa, Homo Sapiens
LGGVECMLL

SEQ ID NO: 677653 - protein, 9 aa, Homo Sapiens
CADVWILVL

SEQ ID NO: 677654 - protein, 9 aa, Homo Sapiens
EEEGKEDDE

SEQ ID NO: 677655 - protein, 9 aa, Homo Sapiens
PVWSISTGS

SEQ ID NO: 677656 - protein, 9 aa, Homo Sapiens
NLSLCVFTW

SEQ ID NO: 677657 - protein, 9 aa, Homo Sapiens
PEKPDSVDI

SEQ ID NO: 677658 - protein, 9 aa, Homo Sapiens
VLSPQRVYL

SEQ ID NO: 677659 - protein, 9 aa, Homo Sapiens
GEDSVAAAA

SEQ ID NO: 677660 - protein, 9 aa, Homo Sapiens
EVFPQHHLL

SEQ ID NO: 677661 - protein, 9 aa, Homo Sapiens
KASLEISPI

SEQ ID NO: 677662 - protein, 9 aa, Homo Sapiens
SRFIESADT

SEQ ID NO: 677663 - protein, 9 aa, Homo Sapiens
FNRALFTLS

SEQ ID NO: 677664 - protein, 9 aa, Homo Sapiens
PRPCFHAMP

SEQ ID NO: 677665 - protein, 9 aa, Homo Sapiens
ILLAYQKSR

SEQ ID NO: 677666 - protein, 9 aa, Homo Sapiens
LGPPPPEGA

SEQ ID NO: 677667 - protein, 9 aa, Homo Sapiens
SVFLVRSAI

SEQ ID NO: 677668 - protein, 9 aa, Homo Sapiens
KSRSCSLTN

SEQ ID NO: 677669 - protein, 9 aa, Homo Sapiens
VALMKQKRE

SEQ ID NO: 677670 - protein, 9 aa, Homo Sapiens
QEPRNMLLQ

SEQ ID NO: 677671 - protein, 9 aa, Homo Sapiens
QTENLSQDQ

SEQ ID NO: 677672 - protein, 9 aa, Homo Sapiens
MILYSSLLD

SEQ ID NO: 677673 - protein, 9 aa, Homo Sapiens
QGYSYLPFQ

SEQ ID NO: 677674 - protein, 9 aa, Homo Sapiens
CTPPHQPQQ

SEQ ID NO: 677675 - protein, 9 aa, Homo Sapiens
FAANTLWFF

SEQ ID NO: 677676 - protein, 9 aa, Homo Sapiens
KQISKENQI

SEQ ID NO: 677677 - protein, 9 aa, Homo Sapiens
AFSPQKIPL

SEQ ID NO: 677678 - protein, 9 aa, Homo Sapiens
TKSEKIMLA

SEQ ID NO: 677679 - protein, 9 aa, Homo Sapiens
DEKAFKALK

SEQ ID NO: 677680 - protein, 9 aa, Homo Sapiens
KLKRPRRPC

SEQ ID NO: 677681 - protein, 9 aa, Homo Sapiens
LILFLKITS

SEQ ID NO: 677682 - protein, 9 aa, Homo Sapiens
LQKLKVLLE

SEQ ID NO: 677683 - protein, 9 aa, Homo Sapiens
GTCKEIFNL

SEQ ID NO: 677684 - protein, 9 aa, Homo Sapiens
ITQINGNYA

SEQ ID NO: 677685 - protein, 9 aa, Homo Sapiens
SSSPATADK

SEQ ID NO: 677686 - protein, 9 aa, Homo Sapiens
LKCASSSMF

SEQ ID NO: 677687 - protein, 9 aa, Homo Sapiens
PLKSTEVWA

SEQ ID NO: 677688 - protein, 9 aa, Homo Sapiens
RRLLEPCWL

SEQ ID NO: 677689 - protein, 9 aa, Homo Sapiens
NPLVPPEPW

SEQ ID NO: 677690 - protein, 9 aa, Homo Sapiens
LACTDTLAI

SEQ ID NO: 677691 - protein, 9 aa, Homo Sapiens
SKRARESQD

SEQ ID NO: 677692 - protein, 9 aa, Homo Sapiens
TNSQAEIYQ

SEQ ID NO: 677693 - protein, 9 aa, Homo Sapiens
LDDAQAVNE

SEQ ID NO: 677694 - protein, 9 aa, Homo Sapiens
LQKCWSISW

SEQ ID NO: 677695 - protein, 9 aa, Homo Sapiens
VRSSSSPAT

SEQ ID NO: 677696 - protein, 9 aa, Homo Sapiens
LAFSMMILY

SEQ ID NO: 677697 - protein, 9 aa, Homo Sapiens
LISLNDLDS

SEQ ID NO: 677698 - protein, 9 aa, Homo Sapiens
LNSPGQQSV

SEQ ID NO: 677699 - protein, 9 aa, Homo Sapiens
VRWMKDDGE

SEQ ID NO: 677700 - protein, 9 aa, Homo Sapiens
QKWWKGPNV

SEQ ID NO: 677701 - protein, 9 aa, Homo Sapiens
QGRPCLSLV

SEQ ID NO: 677702 - protein, 9 aa, Homo Sapiens
CGLEHRVYL

SEQ ID NO: 677703 - protein, 9 aa, Homo Sapiens
EGKEDDEIK

SEQ ID NO: 677704 - protein, 9 aa, Homo Sapiens
ALLLHSFCK

SEQ ID NO: 677705 - protein, 9 aa, Homo Sapiens
QEKMKIDCH

SEQ ID NO: 677706 - protein, 9 aa, Homo Sapiens
GMSSLVELG

SEQ ID NO: 677707 - protein, 9 aa, Homo Sapiens
LREKIMKLS

SEQ ID NO: 677708 - protein, 9 aa, Homo Sapiens
AEYIASKLD

SEQ ID NO: 677709 - protein, 9 aa, Homo Sapiens
LMHEGLFGH

SEQ ID NO: 677710 - protein, 9 aa, Homo Sapiens
PVGKYHIQA

SEQ ID NO: 677711 - protein, 9 aa, Homo Sapiens
LGLGGVECM

SEQ ID NO: 677712 - protein, 9 aa, Homo Sapiens
VSRKKKETE

SEQ ID NO: 677713 - protein, 9 aa, Homo Sapiens
LLEVTDGPP

SEQ ID NO: 677714 - protein, 9 aa, Homo Sapiens
GRIIVSVVK

SEQ ID NO: 677715 - protein, 9 aa, Homo Sapiens
QVNAAMAGR

SEQ ID NO: 677716 - protein, 9 aa, Homo Sapiens
TMKNDHMEK

SEQ ID NO: 677717 - protein, 9 aa, Homo Sapiens
HPFAPSICF

SEQ ID NO: 677718 - protein, 9 aa, Homo Sapiens
KEITSQSDA

SEQ ID NO: 677719 - protein, 9 aa, Homo Sapiens
EIIKLFVQK

SEQ ID NO: 677720 - protein, 9 aa, Homo Sapiens
RTSISPLNV

SEQ ID NO: 677721 - protein, 9 aa, Homo Sapiens
LMEGLTTSR

SEQ ID NO: 677722 - protein, 9 aa, Homo Sapiens
SCLSNIERN

SEQ ID NO: 677723 - protein, 9 aa, Homo Sapiens
ELGRQPGQR

SEQ ID NO: 677724 - protein, 9 aa, Homo Sapiens
KMVRMQPSN

SEQ ID NO: 677725 - protein, 9 aa, Homo Sapiens
LVRCACKPE

SEQ ID NO: 677726 - protein, 9 aa, Homo Sapiens
GCIAQLYVF

SEQ ID NO: 677727 - protein, 9 aa, Homo Sapiens
DSHPFAPSI

SEQ ID NO: 677728 - protein, 9 aa, Homo Sapiens
LNLDYLVNR

SEQ ID NO: 677729 - protein, 9 aa, Homo Sapiens
DGPGEEVSK

SEQ ID NO: 677730 - protein, 9 aa, Homo Sapiens
SQGRPCLSL

SEQ ID NO: 677731 - protein, 9 aa, Homo Sapiens
HVKKCTNHE

SEQ ID NO: 677732 - protein, 9 aa, Homo Sapiens
KLAQRVAMI

SEQ ID NO: 677733 - protein, 9 aa, Homo Sapiens
TEREVPDPG

SEQ ID NO: 677734 - protein, 9 aa, Homo Sapiens
EYHRRLHGR

SEQ ID NO: 677735 - protein, 9 aa, Homo Sapiens
GDIAFYCCS

SEQ ID NO: 677736 - protein, 9 aa, Homo Sapiens
EVSKEGFQI

SEQ ID NO: 677737 - protein, 9 aa, Homo Sapiens
HWPGTASTN

SEQ ID NO: 677738 - protein, 9 aa, Homo Sapiens
CWSISWQKI

SEQ ID NO: 677739 - protein, 9 aa, Homo Sapiens
NLAVWILAV

SEQ ID NO: 677740 - protein, 9 aa, Homo Sapiens
LKSLPVWSI

SEQ ID NO: 677741 - protein, 9 aa, Homo Sapiens
QLEPVKVSF

SEQ ID NO: 677742 - protein, 9 aa, Homo Sapiens
SRGYVVRKP

SEQ ID NO: 677743 - protein, 9 aa, Homo Sapiens
NLKNKCLQW

SEQ ID NO: 677744 - protein, 9 aa, Homo Sapiens
LHLLCVQVQ

SEQ ID NO: 677745 - protein, 9 aa, Homo Sapiens
IIVSVVKMK

SEQ ID NO: 677746 - protein, 9 aa, Homo Sapiens
CAHCSGNCC

SEQ ID NO: 677747 - protein, 9 aa, Homo Sapiens
CCTRPPRAR

SEQ ID NO: 677748 - protein, 9 aa, Homo Sapiens
TPSNTKWSL

SEQ ID NO: 677749 - protein, 9 aa, Homo Sapiens
KCKCPGGYT

SEQ ID NO: 677750 - protein, 9 aa, Homo Sapiens
QRQLMHEGL

SEQ ID NO: 677751 - protein, 9 aa, Homo Sapiens
TFFCCHHQG

SEQ ID NO: 677752 - protein, 9 aa, Homo Sapiens
PHAHQHRDS

SEQ ID NO: 677753 - protein, 9 aa, Homo Sapiens
AAEPLRGPV

SEQ ID NO: 677754 - protein, 9 aa, Homo Sapiens
QLKRDHVVP

SEQ ID NO: 677755 - protein, 9 aa, Homo Sapiens
RGPLLPRRA

SEQ ID NO: 677756 - protein, 9 aa, Homo Sapiens
ILMEGLTTS

SEQ ID NO: 677757 - protein, 9 aa, Homo Sapiens
WPRSVKKLK

SEQ ID NO: 677758 - protein, 9 aa, Homo Sapiens
KKCTNHERI

SEQ ID NO: 677759 - protein, 9 aa, Homo Sapiens
CSFGSTCAH

SEQ ID NO: 677760 - protein, 9 aa, Homo Sapiens
HKKDTFLCP

SEQ ID NO: 677761 - protein, 9 aa, Homo Sapiens
PSSVLLLLA

SEQ ID NO: 677762 - protein, 9 aa, Homo Sapiens
GSVFEVVWE

SEQ ID NO: 677763 - protein, 9 aa, Homo Sapiens
KLITVLKTY

SEQ ID NO: 677764 - protein, 9 aa, Homo Sapiens
KLNGTYVDT

SEQ ID NO: 677765 - protein, 9 aa, Homo Sapiens
VFTEYTDGT

SEQ ID NO: 677766 - protein, 9 aa, Homo Sapiens
SHAIVRACT

SEQ ID NO: 677767 - protein, 9 aa, Homo Sapiens
LMASQPLLA

SEQ ID NO: 677768 - protein, 9 aa, Homo Sapiens
MACPIMFES

SEQ ID NO: 677769 - protein, 9 aa, Homo Sapiens
DFDNYYGAV

SEQ ID NO: 677770 - protein, 9 aa, Homo Sapiens
LQCEPGYAL

SEQ ID NO: 677771 - protein, 9 aa, Homo Sapiens
DPGTAASGP

SEQ ID NO: 677772 - protein, 9 aa, Homo Sapiens
SVAAAAPGA

SEQ ID NO: 677773 - protein, 9 aa, Homo Sapiens
APYPVVKEL

SEQ ID NO: 677774 - protein, 9 aa, Homo Sapiens
PKAVLICHL

SEQ ID NO: 677775 - protein, 9 aa, Homo Sapiens
GQEDSNSCI

SEQ ID NO: 677776 - protein, 9 aa, Homo Sapiens
QHLSDAQRA

SEQ ID NO: 677777 - protein, 9 aa, Homo Sapiens
ELQNVFSWL

SEQ ID NO: 677778 - protein, 9 aa, Homo Sapiens
IEEHKKEHS

SEQ ID NO: 677779 - protein, 9 aa, Homo Sapiens
FVSAGPAAG

SEQ ID NO: 677780 - protein, 9 aa, Homo Sapiens
AATCEYHRR

SEQ ID NO: 677781 - protein, 9 aa, Homo Sapiens
LVNVINDVS

SEQ ID NO: 677782 - protein, 9 aa, Homo Sapiens
LAPYLQLEG

SEQ ID NO: 677783 - protein, 9 aa, Homo Sapiens
DTELAKDDA

SEQ ID NO: 677784 - protein, 9 aa, Homo Sapiens
IVRACTSGD

SEQ ID NO: 677785 - protein, 9 aa, Homo Sapiens
GFLFCKVRY

SEQ ID NO: 677786 - protein, 9 aa, Homo Sapiens
IVAIDEESQ

SEQ ID NO: 677787 - protein, 9 aa, Homo Sapiens
FCCHHQGGW

SEQ ID NO: 677788 - protein, 9 aa, Homo Sapiens
ITTNIRSAR

SEQ ID NO: 677789 - protein, 9 aa, Homo Sapiens
QQGITDEKA

SEQ ID NO: 677790 - protein, 9 aa, Homo Sapiens
RDFVNSRED

SEQ ID NO: 677791 - protein, 9 aa, Homo Sapiens
PCWLILFLK

SEQ ID NO: 677792 - protein, 9 aa, Homo Sapiens
RALLFKAVA

SEQ ID NO: 677793 - protein, 9 aa, Homo Sapiens
LGLTTGMSI

SEQ ID NO: 677794 - protein, 9 aa, Homo Sapiens
FFAANTLWF

SEQ ID NO: 677795 - protein, 9 aa, Homo Sapiens
HLFVKIQDP

SEQ ID NO: 677796 - protein, 9 aa, Homo Sapiens
PGQRQHLSD

SEQ ID NO: 677797 - protein, 9 aa, Homo Sapiens
KMKIDCHKD

SEQ ID NO: 677798 - protein, 9 aa, Homo Sapiens
LKSKVTLKR

SEQ ID NO: 677799 - protein, 9 aa, Homo Sapiens
VIYRQDSNK

SEQ ID NO: 677800 - protein, 9 aa, Homo Sapiens
ERFQLFESD

SEQ ID NO: 677801 - protein, 9 aa, Homo Sapiens
AATLYCINF

SEQ ID NO: 677802 - protein, 9 aa, Homo Sapiens
FLVRNHRKA

SEQ ID NO: 677803 - protein, 9 aa, Homo Sapiens
HEFHSEVFM

SEQ ID NO: 677804 - protein, 9 aa, Homo Sapiens
EPVMTQSIP

SEQ ID NO: 677805 - protein, 9 aa, Homo Sapiens
HRVYLVEEH

SEQ ID NO: 677806 - protein, 9 aa, Homo Sapiens
QAKATQFNR

SEQ ID NO: 677807 - protein, 9 aa, Homo Sapiens
DSNSCINYE

SEQ ID NO: 677808 - protein, 9 aa, Homo Sapiens
SVIYRQDSN

SEQ ID NO: 677809 - protein, 9 aa, Homo Sapiens
TCCCTFCKY

SEQ ID NO: 677810 - protein, 9 aa, Homo Sapiens
IVLAALLLL

SEQ ID NO: 677811 - protein, 9 aa, Homo Sapiens
PCFYLNCKT

SEQ ID NO: 677812 - protein, 9 aa, Homo Sapiens
LPNPVVYTL

SEQ ID NO: 677813 - protein, 9 aa, Homo Sapiens
TPVQFIPTN

SEQ ID NO: 677814 - protein, 9 aa, Homo Sapiens
LIEEGDHSL

SEQ ID NO: 677815 - protein, 9 aa, Homo Sapiens
PVVQRRLDI

SEQ ID NO: 677816 - protein, 9 aa, Homo Sapiens
YSNGGVAFL

SEQ ID NO: 677817 - protein, 9 aa, Homo Sapiens
HSSLGHQVS

SEQ ID NO: 677818 - protein, 9 aa, Homo Sapiens
EDSVAAAAP

SEQ ID NO: 677819 - protein, 9 aa, Homo Sapiens
EDATVNHQK

SEQ ID NO: 677820 - protein, 9 aa, Homo Sapiens
LRYTNLLRP

SEQ ID NO: 677821 - protein, 9 aa, Homo Sapiens
AAEHLNAAI

SEQ ID NO: 677822 - protein, 9 aa, Homo Sapiens
VVLSWVSFL

SEQ ID NO: 677823 - protein, 9 aa, Homo Sapiens
TTSKSRSCS

SEQ ID NO: 677824 - protein, 9 aa, Homo Sapiens
RADSAAVPI

SEQ ID NO: 677825 - protein, 9 aa, Homo Sapiens
LSFGLSFDY

SEQ ID NO: 677826 - protein, 9 aa, Homo Sapiens
KVTLKRNLY

SEQ ID NO: 677827 - protein, 9 aa, Homo Sapiens
PRNMLLQNP

SEQ ID NO: 677828 - protein, 9 aa, Homo Sapiens
GCPVPKAVL

SEQ ID NO: 677829 - protein, 9 aa, Homo Sapiens
AAHIYPLYF

SEQ ID NO: 677830 - protein, 9 aa, Homo Sapiens
MDTEKPGTP

SEQ ID NO: 677831 - protein, 9 aa, Homo Sapiens
VDLLEKILV

SEQ ID NO: 677832 - protein, 9 aa, Homo Sapiens
LVVVGACGV

SEQ ID NO: 677833 - protein, 9 aa, Homo Sapiens
SISTGSFTF

SEQ ID NO: 677834 - protein, 9 aa, Homo Sapiens
MRNGRGIGK

SEQ ID NO: 677835 - protein, 9 aa, Homo Sapiens
LNGIHLARN

SEQ ID NO: 677836 - protein, 9 aa, Homo Sapiens
QQRRQVLGL

SEQ ID NO: 677837 - protein, 9 aa, Homo Sapiens
QKENVQQYC

SEQ ID NO: 677838 - protein, 9 aa, Homo Sapiens
MTQSIPHPG

SEQ ID NO: 677839 - protein, 9 aa, Homo Sapiens
KILYLGFCS

SEQ ID NO: 677840 - protein, 9 aa, Homo Sapiens
FTEYTDGTF

SEQ ID NO: 677841 - protein, 9 aa, Homo Sapiens
LLQPKPGLF

SEQ ID NO: 677842 - protein, 9 aa, Homo Sapiens
CQNKFLSEI

SEQ ID NO: 677843 - protein, 9 aa, Homo Sapiens
PKQEKMKID

SEQ ID NO: 677844 - protein, 9 aa, Homo Sapiens
YSIVRRADS

SEQ ID NO: 677845 - protein, 9 aa, Homo Sapiens
PLNLSFGLS

SEQ ID NO: 677846 - protein, 9 aa, Homo Sapiens
SQPLLAKQY

SEQ ID NO: 677847 - protein, 9 aa, Homo Sapiens
SAAATINQA

SEQ ID NO: 677848 - protein, 9 aa, Homo Sapiens
RLKVKDVRQ

SEQ ID NO: 677849 - protein, 9 aa, Homo Sapiens
MVRKILYLG

SEQ ID NO: 677850 - protein, 9 aa, Homo Sapiens
DIFSHGTQG

SEQ ID NO: 677851 - protein, 9 aa, Homo Sapiens
LITVLKTYL

SEQ ID NO: 677852 - protein, 9 aa, Homo Sapiens
LAEKSFRNL

SEQ ID NO: 677853 - protein, 9 aa, Homo Sapiens
REDYLNLSL

SEQ ID NO: 677854 - protein, 9 aa, Homo Sapiens
RISSTFSQR

SEQ ID NO: 677855 - protein, 9 aa, Homo Sapiens
SIIQFVLND

SEQ ID NO: 677856 - protein, 9 aa, Homo Sapiens
PKNLLNKEK

SEQ ID NO: 677857 - protein, 9 aa, Homo Sapiens
LLQASRGYV

SEQ ID NO: 677858 - protein, 9 aa, Homo Sapiens
QHHPGLILL

SEQ ID NO: 677859 - protein, 9 aa, Homo Sapiens
KMHLSALET

SEQ ID NO: 677860 - protein, 9 aa, Homo Sapiens
GATEARPLR

SEQ ID NO: 677861 - protein, 9 aa, Homo Sapiens
LVLDDAQER

SEQ ID NO: 677862 - protein, 9 aa, Homo Sapiens
VQQHNLAVW

SEQ ID NO: 677863 - protein, 9 aa, Homo Sapiens
VDHILSQAP

SEQ ID NO: 677864 - protein, 9 aa, Homo Sapiens
NPFHLSDVQ

SEQ ID NO: 677865 - protein, 9 aa, Homo Sapiens
LHSGLLEEL

SEQ ID NO: 677866 - protein, 9 aa, Homo Sapiens
VWILAVLAP

SEQ ID NO: 677867 - protein, 9 aa, Homo Sapiens
VPDPGTAAS

SEQ ID NO: 677868 - protein, 9 aa, Homo Sapiens
NSRWIKELN

SEQ ID NO: 677869 - protein, 9 aa, Homo Sapiens
HMEKENKYL

SEQ ID NO: 677870 - protein, 9 aa, Homo Sapiens
YKLVVVGAC

SEQ ID NO: 677871 - protein, 9 aa, Homo Sapiens
GQVNAAMAG

SEQ ID NO: 677872 - protein, 9 aa, Homo Sapiens
PVPKAVLIC

SEQ ID NO: 677873 - protein, 9 aa, Homo Sapiens
RMLQAMCWK

SEQ ID NO: 677874 - protein, 9 aa, Homo Sapiens
IELCREGKN

SEQ ID NO: 677875 - protein, 9 aa, Homo Sapiens
EYVTKRNCN

SEQ ID NO: 677876 - protein, 9 aa, Homo Sapiens
TRHFANNQS

SEQ ID NO: 677877 - protein, 9 aa, Homo Sapiens
WAWDKASGG

SEQ ID NO: 677878 - protein, 9 aa, Homo Sapiens
LFKAVADRI

SEQ ID NO: 677879 - protein, 9 aa, Homo Sapiens
QKCWSISWQ

SEQ ID NO: 677880 - protein, 9 aa, Homo Sapiens
DLWLEPAQQ

SEQ ID NO: 677881 - protein, 9 aa, Homo Sapiens
SDKLTRHYR

SEQ ID NO: 677882 - protein, 9 aa, Homo Sapiens
VYFGTVRNC

SEQ ID NO: 677883 - protein, 9 aa, Homo Sapiens
PVGTDLNYI

SEQ ID NO: 677884 - protein, 9 aa, Homo Sapiens
YISTIRERF

SEQ ID NO: 677885 - protein, 9 aa, Homo Sapiens
DLGCELRPQ

SEQ ID NO: 677886 - protein, 9 aa, Homo Sapiens
EEEEKEGES

SEQ ID NO: 677887 - protein, 9 aa, Homo Sapiens
RQLQARVSR

SEQ ID NO: 677888 - protein, 9 aa, Homo Sapiens
LNKDNIEEL

SEQ ID NO: 677889 - protein, 9 aa, Homo Sapiens
DRYYHEQEL

SEQ ID NO: 677890 - protein, 9 aa, Homo Sapiens
EVIQNVERG

SEQ ID NO: 677891 - protein, 9 aa, Homo Sapiens
TTLQKEVPV

SEQ ID NO: 677892 - protein, 9 aa, Homo Sapiens
LFNNMTLVS

SEQ ID NO: 677893 - protein, 9 aa, Homo Sapiens
QFFPEETRQ

SEQ ID NO: 677894 - protein, 9 aa, Homo Sapiens
VSGKVRSEG

SEQ ID NO: 677895 - protein, 9 aa, Homo Sapiens
QDIPAVTNR

SEQ ID NO: 677896 - protein, 9 aa, Homo Sapiens
TRSLRKALE

SEQ ID NO: 677897 - protein, 9 aa, Homo Sapiens
KAIETKVNE

SEQ ID NO: 677898 - protein, 9 aa, Homo Sapiens
KELTMPEQT

SEQ ID NO: 677899 - protein, 9 aa, Homo Sapiens
WKIRKGNTK

SEQ ID NO: 677900 - protein, 9 aa, Homo Sapiens
LKAIETKVN

SEQ ID NO: 677901 - protein, 9 aa, Homo Sapiens
FGTVRNCYE

SEQ ID NO: 677902 - protein, 9 aa, Homo Sapiens
LSMEKNLDF

SEQ ID NO: 677903 - protein, 9 aa, Homo Sapiens
LLCRMLVFH

SEQ ID NO: 677904 - protein, 9 aa, Homo Sapiens
NRGHVENTP

SEQ ID NO: 677905 - protein, 9 aa, Homo Sapiens
EDHSSNMFN

SEQ ID NO: 677906 - protein, 9 aa, Homo Sapiens
TNPEVIQNV

SEQ ID NO: 677907 - protein, 9 aa, Homo Sapiens
KNGEAKITD

SEQ ID NO: 677908 - protein, 9 aa, Homo Sapiens
FEESAGADS

SEQ ID NO: 677909 - protein, 9 aa, Homo Sapiens
KLQNTYENN

SEQ ID NO: 677910 - protein, 9 aa, Homo Sapiens
FRHSVVVPC

SEQ ID NO: 677911 - protein, 9 aa, Homo Sapiens
SNMFNYEEY

SEQ ID NO: 677912 - protein, 9 aa, Homo Sapiens
VCMVSLVSS

SEQ ID NO: 677913 - protein, 9 aa, Homo Sapiens
SPEDLGCEL

SEQ ID NO: 677914 - protein, 9 aa, Homo Sapiens
RTSVMFNLP

SEQ ID NO: 677915 - protein, 9 aa, Homo Sapiens
LQSQHRQLQ

SEQ ID NO: 677916 - protein, 9 aa, Homo Sapiens
GLGQRETPP

SEQ ID NO: 677917 - protein, 9 aa, Homo Sapiens
LPHLAGTDQ

SEQ ID NO: 677918 - protein, 9 aa, Homo Sapiens
PDAPKVTLP

SEQ ID NO: 677919 - protein, 9 aa, Homo Sapiens
ILSCRGETE

SEQ ID NO: 677920 - protein, 9 aa, Homo Sapiens
IQKQLRSVV

SEQ ID NO: 677921 - protein, 9 aa, Homo Sapiens
QETVLSNDI

SEQ ID NO: 677922 - protein, 9 aa, Homo Sapiens
PRSGTVKLP

SEQ ID NO: 677923 - protein, 9 aa, Homo Sapiens
GGVCQTRAI

SEQ ID NO: 677924 - protein, 9 aa, Homo Sapiens
YTMQVGSSS

SEQ ID NO: 677925 - protein, 9 aa, Homo Sapiens
DGHQLSDFY

SEQ ID NO: 677926 - protein, 9 aa, Homo Sapiens
VVPCEPPEV

SEQ ID NO: 677927 - protein, 9 aa, Homo Sapiens
TVRNCYEAL

SEQ ID NO: 677928 - protein, 9 aa, Homo Sapiens
SSSKNKDPV

SEQ ID NO: 677929 - protein, 9 aa, Homo Sapiens
RVLLLAILL

SEQ ID NO: 677930 - protein, 9 aa, Homo Sapiens
FLSEHKTLL

SEQ ID NO: 677931 - protein, 9 aa, Homo Sapiens
ITDAPASEK

SEQ ID NO: 677932 - protein, 9 aa, Homo Sapiens
GTDQNFLLA

SEQ ID NO: 677933 - protein, 9 aa, Homo Sapiens
IVICHPLRY

SEQ ID NO: 677934 - protein, 9 aa, Homo Sapiens
KLKQRVLLL

SEQ ID NO: 677935 - protein, 9 aa, Homo Sapiens
NHNKLEVAE

SEQ ID NO: 677936 - protein, 9 aa, Homo Sapiens
LSDFYHRIQ

SEQ ID NO: 677937 - protein, 9 aa, Homo Sapiens
TVKLPKPSL

SEQ ID NO: 677938 - protein, 9 aa, Homo Sapiens
WLSLKYPSI

SEQ ID NO: 677939 - protein, 9 aa, Homo Sapiens
ENFQCNVPM

SEQ ID NO: 677940 - protein, 9 aa, Homo Sapiens
KTPAMAFRW

SEQ ID NO: 677941 - protein, 9 aa, Homo Sapiens
YLGCTSTLV

SEQ ID NO: 677942 - protein, 9 aa, Homo Sapiens
SCTPKTSPL

SEQ ID NO: 677943 - protein, 9 aa, Homo Sapiens
TGKLDIEFV

SEQ ID NO: 677944 - protein, 9 aa, Homo Sapiens
SQADEQAGT

SEQ ID NO: 677945 - protein, 9 aa, Homo Sapiens
GETEHHCSG

SEQ ID NO: 677946 - protein, 9 aa, Homo Sapiens
DLSVKLLAH

SEQ ID NO: 677947 - protein, 9 aa, Homo Sapiens
EDVRFRRAP

SEQ ID NO: 677948 - protein, 9 aa, Homo Sapiens
RSLIKNRRI

SEQ ID NO: 677949 - protein, 9 aa, Homo Sapiens
LGQRETPPP

SEQ ID NO: 677950 - protein, 9 aa, Homo Sapiens
REGTRSLRK

SEQ ID NO: 677951 - protein, 9 aa, Homo Sapiens
ENRQIMEEC

SEQ ID NO: 677952 - protein, 9 aa, Homo Sapiens
LLDMVPRAA

SEQ ID NO: 677953 - protein, 9 aa, Homo Sapiens
RNLVFEDNH

SEQ ID NO: 677954 - protein, 9 aa, Homo Sapiens
NDISTLSTS

SEQ ID NO: 677955 - protein, 9 aa, Homo Sapiens
TPAMAFRWW

SEQ ID NO: 677956 - protein, 9 aa, Homo Sapiens
AGADSTQQP

SEQ ID NO: 677957 - protein, 9 aa, Homo Sapiens
LRSRKIQKQ

SEQ ID NO: 677958 - protein, 9 aa, Homo Sapiens
RPLSDNPNV

SEQ ID NO: 677959 - protein, 9 aa, Homo Sapiens
SMEKNLDFL

SEQ ID NO: 677960 - protein, 9 aa, Homo Sapiens
QDAKTPAMA

SEQ ID NO: 677961 - protein, 9 aa, Homo Sapiens
PHLAGTDQN

SEQ ID NO: 677962 - protein, 9 aa, Homo Sapiens
HVPNIHWLV

SEQ ID NO: 677963 - protein, 9 aa, Homo Sapiens
RYNTISYWK

SEQ ID NO: 677964 - protein, 9 aa, Homo Sapiens
INTSIQSTI

SEQ ID NO: 677965 - protein, 9 aa, Homo Sapiens
LVFHPSKRI

SEQ ID NO: 677966 - protein, 9 aa, Homo Sapiens
KPRSGTVKL

SEQ ID NO: 677967 - protein, 9 aa, Homo Sapiens
AQPVNDLAL

SEQ ID NO: 677968 - protein, 9 aa, Homo Sapiens
KYLSQMMRD

SEQ ID NO: 677969 - protein, 9 aa, Homo Sapiens
NGEAKITDA

SEQ ID NO: 677970 - protein, 9 aa, Homo Sapiens
RRREQRWQA

SEQ ID NO: 677971 - protein, 9 aa, Homo Sapiens
GYGVGTLIG

SEQ ID NO: 677972 - protein, 9 aa, Homo Sapiens
IIPLILNVC

SEQ ID NO: 677973 - protein, 9 aa, Homo Sapiens
PIYKKPVGT

SEQ ID NO: 677974 - protein, 9 aa, Homo Sapiens
LCRMLVFHP

SEQ ID NO: 677975 - protein, 9 aa, Homo Sapiens
SSSCTPKTS

SEQ ID NO: 677976 - protein, 9 aa, Homo Sapiens
AYTFELLVD

SEQ ID NO: 677977 - protein, 9 aa, Homo Sapiens
ISTSLTIVH

SEQ ID NO: 677978 - protein, 9 aa, Homo Sapiens
GQRETPPPP

SEQ ID NO: 677979 - protein, 9 aa, Homo Sapiens
DPVTIVDVP

SEQ ID NO: 677980 - protein, 9 aa, Homo Sapiens
NKDPVTIVD

SEQ ID NO: 677981 - protein, 9 aa, Homo Sapiens
VFVDGHQLS

SEQ ID NO: 677982 - protein, 9 aa, Homo Sapiens
HFKLQNTYE

SEQ ID NO: 677983 - protein, 9 aa, Homo Sapiens
PLAGGDGGK

SEQ ID NO: 677984 - protein, 9 aa, Homo Sapiens
SLKYPSIIV

SEQ ID NO: 677985 - protein, 9 aa, Homo Sapiens
CLEGNCAKG

SEQ ID NO: 677986 - protein, 9 aa, Homo Sapiens
MRDLPSCPC

SEQ ID NO: 677987 - protein, 9 aa, Homo Sapiens
QFYNQVEIE

SEQ ID NO: 677988 - protein, 9 aa, Homo Sapiens
IILSCRGET

SEQ ID NO: 677989 - protein, 9 aa, Homo Sapiens
DIFYIIQNK

SEQ ID NO: 677990 - protein, 9 aa, Homo Sapiens
PVSGKVRSE

SEQ ID NO: 677991 - protein, 9 aa, Homo Sapiens
SYVPGPSSR

SEQ ID NO: 677992 - protein, 9 aa, Homo Sapiens
LTMPEQTFM

SEQ ID NO: 677993 - protein, 9 aa, Homo Sapiens
GSGQPSAPQ

SEQ ID NO: 677994 - protein, 9 aa, Homo Sapiens
TLPEKTPGY

SEQ ID NO: 677995 - protein, 9 aa, Homo Sapiens
EEKEGESEA

SEQ ID NO: 677996 - protein, 9 aa, Homo Sapiens
DELPLAGGD

SEQ ID NO: 677997 - protein, 9 aa, Homo Sapiens
NLDFLVNIY

SEQ ID NO: 677998 - protein, 9 aa, Homo Sapiens
NKPRSGTVK

SEQ ID NO: 677999 - protein, 9 aa, Homo Sapiens
RGLSLPVCM

SEQ ID NO: 678000 - protein, 9 aa, Homo Sapiens
QCNVPMGME

SEQ ID NO: 678001 - protein, 9 aa, Homo Sapiens
VIQLLGMLR

SEQ ID NO: 678002 - protein, 9 aa, Homo Sapiens
RNSDNMELY

SEQ ID NO: 678003 - protein, 9 aa, Homo Sapiens
SQHRQLQAR

SEQ ID NO: 678004 - protein, 9 aa, Homo Sapiens
QCSQIVKCS

SEQ ID NO: 678005 - protein, 9 aa, Homo Sapiens
FRQIYSLRH

SEQ ID NO: 678006 - protein, 9 aa, Homo Sapiens
APQHTHIHV

SEQ ID NO: 678007 - protein, 9 aa, Homo Sapiens
GTRSLRKAL

SEQ ID NO: 678008 - protein, 9 aa, Homo Sapiens
ANPFSFTEF

SEQ ID NO: 678009 - protein, 9 aa, Homo Sapiens
IPAVTNRGH

SEQ ID NO: 678010 - protein, 9 aa, Homo Sapiens
LIKNRRISG

SEQ ID NO: 678011 - protein, 9 aa, Homo Sapiens
VMGYDRYVT

SEQ ID NO: 678012 - protein, 9 aa, Homo Sapiens
RFHYMAALD

SEQ ID NO: 678013 - protein, 9 aa, Homo Sapiens
LTLCQFYNQ

SEQ ID NO: 678014 - protein, 9 aa, Homo Sapiens
LSLKYPSII

SEQ ID NO: 678015 - protein, 9 aa, Homo Sapiens
VCFAKNPDT

SEQ ID NO: 678016 - protein, 9 aa, Homo Sapiens
AVTNRGHVE

SEQ ID NO: 678017 - protein, 9 aa, Homo Sapiens
AMKDPCMQD

SEQ ID NO: 678018 - protein, 9 aa, Homo Sapiens
NPEVIQNVE

SEQ ID NO: 678019 - protein, 9 aa, Homo Sapiens
QTCWEWQEA

SEQ ID NO: 678020 - protein, 9 aa, Homo Sapiens
VRPLLKAIE

SEQ ID NO: 678021 - protein, 9 aa, Homo Sapiens
YSLRHHQRV

SEQ ID NO: 678022 - protein, 9 aa, Homo Sapiens
DHSSNMFNY

SEQ ID NO: 678023 - protein, 9 aa, Homo Sapiens
LVPNGPEAN

SEQ ID NO: 678024 - protein, 9 aa, Homo Sapiens
ERESRLKMW

SEQ ID NO: 678025 - protein, 9 aa, Homo Sapiens
SLIKNRRIS

SEQ ID NO: 678026 - protein, 9 aa, Homo Sapiens
GRFTVIQLL

SEQ ID NO: 678027 - protein, 9 aa, Homo Sapiens
HQCTALTAA

SEQ ID NO: 678028 - protein, 9 aa, Homo Sapiens
IQSFLSEHK

SEQ ID NO: 678029 - protein, 9 aa, Homo Sapiens
KNIDQCSQI

SEQ ID NO: 678030 - protein, 9 aa, Homo Sapiens
MPEQTFMGY

SEQ ID NO: 678031 - protein, 9 aa, Homo Sapiens
FDPLIIESK

SEQ ID NO: 678032 - protein, 9 aa, Homo Sapiens
SLAAEAAAA

SEQ ID NO: 678033 - protein, 9 aa, Homo Sapiens
VGTLIGSPY

SEQ ID NO: 678034 - protein, 9 aa, Homo Sapiens
VTIVDVPAH

SEQ ID NO: 678035 - protein, 9 aa, Homo Sapiens
HSLVSAYTF

SEQ ID NO: 678036 - protein, 9 aa, Homo Sapiens
EKVAEVDCS

SEQ ID NO: 678037 - protein, 9 aa, Homo Sapiens
KGLGTNYRG

SEQ ID NO: 678038 - protein, 9 aa, Homo Sapiens
SDNMELYNI

SEQ ID NO: 678039 - protein, 9 aa, Homo Sapiens
ELKERESRL

SEQ ID NO: 678040 - protein, 9 aa, Homo Sapiens
YPACRYHYF

SEQ ID NO: 678041 - protein, 9 aa, Homo Sapiens
CMVSLVSSV

SEQ ID NO: 678042 - protein, 9 aa, Homo Sapiens
TVMWLIEKR

SEQ ID NO: 678043 - protein, 9 aa, Homo Sapiens
LSDNPNVLV

SEQ ID NO: 678044 - protein, 9 aa, Homo Sapiens
YKKPVGTDL

SEQ ID NO: 678045 - protein, 9 aa, Homo Sapiens
NTISYWKIR

SEQ ID NO: 678046 - protein, 9 aa, Homo Sapiens
DNIEELKKN

SEQ ID NO: 678047 - protein, 9 aa, Homo Sapiens
GTVRNCYEA

SEQ ID NO: 678048 - protein, 9 aa, Homo Sapiens
VIQNVERGY

SEQ ID NO: 678049 - protein, 9 aa, Homo Sapiens
QNTYENNYL

SEQ ID NO: 678050 - protein, 9 aa, Homo Sapiens
MSAIYHKVR

SEQ ID NO: 678051 - protein, 9 aa, Homo Sapiens
NIEELKKNR

SEQ ID NO: 678052 - protein, 9 aa, Homo Sapiens
GYYPVKLFT

SEQ ID NO: 678053 - protein, 9 aa, Homo Sapiens
DTELSGRLR

SEQ ID NO: 678054 - protein, 9 aa, Homo Sapiens
EAAKGADEA

SEQ ID NO: 678055 - protein, 9 aa, Homo Sapiens
EGTRSLRKA

SEQ ID NO: 678056 - protein, 9 aa, Homo Sapiens
AAEAAAAQQ

SEQ ID NO: 678057 - protein, 9 aa, Homo Sapiens
MGMESGRIA

SEQ ID NO: 678058 - protein, 9 aa, Homo Sapiens
MVPNRNSDN

SEQ ID NO: 678059 - protein, 9 aa, Homo Sapiens
SGQPSAPQT

SEQ ID NO: 678060 - protein, 9 aa, Homo Sapiens
ACLEGNCAK

SEQ ID NO: 678061 - protein, 9 aa, Homo Sapiens
ACRYHYFPT

SEQ ID NO: 678062 - protein, 9 aa, Homo Sapiens
GSSSCTPKT

SEQ ID NO: 678063 - protein, 9 aa, Homo Sapiens
HGHFKLQNT

SEQ ID NO: 678064 - protein, 9 aa, Homo Sapiens
LIIGLFVGL

SEQ ID NO: 678065 - protein, 9 aa, Homo Sapiens
KERESRLKM

SEQ ID NO: 678066 - protein, 9 aa, Homo Sapiens
LGCELRPQS

SEQ ID NO: 678067 - protein, 9 aa, Homo Sapiens
ISYWKIRKG

SEQ ID NO: 678068 - protein, 9 aa, Homo Sapiens
IGSYVPGPS

SEQ ID NO: 678069 - protein, 9 aa, Homo Sapiens
LQKEVPVIF

SEQ ID NO: 678070 - protein, 9 aa, Homo Sapiens
ASLGEAAKG

SEQ ID NO: 678071 - protein, 9 aa, Homo Sapiens
DIEFVKGYY

SEQ ID NO: 678072 - protein, 9 aa, Homo Sapiens
IDQCSQIVK

SEQ ID NO: 678073 - protein, 9 aa, Homo Sapiens
PKVTLPEKT

SEQ ID NO: 678074 - protein, 9 aa, Homo Sapiens
EKRSPSATV

SEQ ID NO: 678075 - protein, 9 aa, Homo Sapiens
NVPMGMESG

SEQ ID NO: 678076 - protein, 9 aa, Homo Sapiens
EEEKEGESE

SEQ ID NO: 678077 - protein, 9 aa, Homo Sapiens
WTHQGWEPR

SEQ ID NO: 678078 - protein, 9 aa, Homo Sapiens
LPVCMVSLV

SEQ ID NO: 678079 - protein, 9 aa, Homo Sapiens
PNGPEANRS

SEQ ID NO: 678080 - protein, 9 aa, Homo Sapiens
NLVFEDNHN

SEQ ID NO: 678081 - protein, 9 aa, Homo Sapiens
PTLLGRPLS

SEQ ID NO: 678082 - protein, 9 aa, Homo Sapiens
PSATVCKAG

SEQ ID NO: 678083 - protein, 9 aa, Homo Sapiens
SQMMRDLPS

SEQ ID NO: 678084 - protein, 9 aa, Homo Sapiens
DAMPVIGPE

SEQ ID NO: 678085 - protein, 9 aa, Homo Sapiens
PEKRSPSAT

SEQ ID NO: 678086 - protein, 9 aa, Homo Sapiens
FVDGHQLSD

SEQ ID NO: 678087 - protein, 9 aa, Homo Sapiens
QQNHLLNNR

SEQ ID NO: 678088 - protein, 9 aa, Homo Sapiens
TLVITPLTD

SEQ ID NO: 678089 - protein, 9 aa, Homo Sapiens
KDVFDPLII

SEQ ID NO: 678090 - protein, 9 aa, Homo Sapiens
AKTPAMAFR

SEQ ID NO: 678091 - protein, 9 aa, Homo Sapiens
FWVINTSIQ

SEQ ID NO: 678092 - protein, 9 aa, Homo Sapiens
NSTDFNPDD

SEQ ID NO: 678093 - protein, 9 aa, Homo Sapiens
LGRPLSDNP

SEQ ID NO: 678094 - protein, 9 aa, Homo Sapiens
IQNVERGYR

SEQ ID NO: 678095 - protein, 9 aa, Homo Sapiens
QLRDMEDSN

SEQ ID NO: 678096 - protein, 9 aa, Homo Sapiens
HKTLLLAAV

SEQ ID NO: 678097 - protein, 9 aa, Homo Sapiens
FEDNHNKLE

SEQ ID NO: 678098 - protein, 9 aa, Homo Sapiens
AGWTHQGWE

SEQ ID NO: 678099 - protein, 9 aa, Homo Sapiens
GHSLVSAYT

SEQ ID NO: 678100 - protein, 9 aa, Homo Sapiens
VCQTRAIKI

SEQ ID NO: 678101 - protein, 9 aa, Homo Sapiens
LQARVSRQT

SEQ ID NO: 678102 - protein, 9 aa, Homo Sapiens
RMLVFHPSK

SEQ ID NO: 678103 - protein, 9 aa, Homo Sapiens
LVSAYTFEL

SEQ ID NO: 678104 - protein, 9 aa, Homo Sapiens
DCYIVICHP

SEQ ID NO: 678105 - protein, 9 aa, Homo Sapiens
QIYSLRHHQ

SEQ ID NO: 678106 - protein, 9 aa, Homo Sapiens
RYHYFPTEG

SEQ ID NO: 678107 - protein, 9 aa, Homo Sapiens
AKITDAPAS

SEQ ID NO: 678108 - protein, 9 aa, Homo Sapiens
ADEQAGTPP

SEQ ID NO: 678109 - protein, 9 aa, Homo Sapiens
KQRVLLLAI

SEQ ID NO: 678110 - protein, 9 aa, Homo Sapiens
ISTIRERFP

SEQ ID NO: 678111 - protein, 9 aa, Homo Sapiens
TVCKAGDKT

SEQ ID NO: 678112 - protein, 9 aa, Homo Sapiens
STQQPLSLP

SEQ ID NO: 678113 - protein, 9 aa, Homo Sapiens
SCRGETEHH

SEQ ID NO: 678114 - protein, 9 aa, Homo Sapiens
SLPVCMVSL

SEQ ID NO: 678115 - protein, 9 aa, Homo Sapiens
QTCLKQFLE

SEQ ID NO: 678116 - protein, 9 aa, Homo Sapiens
GHQLSDFYH

SEQ ID NO: 678117 - protein, 9 aa, Homo Sapiens
VMFNLPDQA

SEQ ID NO: 678118 - protein, 9 aa, Homo Sapiens
GEAKITDAP

SEQ ID NO: 678119 - protein, 9 aa, Homo Sapiens
IPLILNVCC

SEQ ID NO: 678120 - protein, 9 aa, Homo Sapiens
QRVLLLAIL

SEQ ID NO: 678121 - protein, 9 aa, Homo Sapiens
SKNKDPVTI

SEQ ID NO: 678122 - protein, 9 aa, Homo Sapiens
QVGSSSCTP

SEQ ID NO: 678123 - protein, 9 aa, Homo Sapiens
LKQRVLLLA

SEQ ID NO: 678124 - protein, 9 aa, Homo Sapiens
EVQLRDMED

SEQ ID NO: 678125 - protein, 9 aa, Homo Sapiens
YVYFGTVRN

SEQ ID NO: 678126 - protein, 9 aa, Homo Sapiens
VCCSSVVLR

SEQ ID NO: 678127 - protein, 9 aa, Homo Sapiens
EKNLDFLVN

SEQ ID NO: 678128 - protein, 9 aa, Homo Sapiens
KGADEAAPF

SEQ ID NO: 678129 - protein, 9 aa, Homo Sapiens
REFWVINTS

SEQ ID NO: 678130 - protein, 9 aa, Homo Sapiens
EGNCAKGLG

SEQ ID NO: 678131 - protein, 9 aa, Homo Sapiens
QLQARVSRQ

SEQ ID NO: 678132 - protein, 9 aa, Homo Sapiens
DSTQQPLSL

SEQ ID NO: 678133 - protein, 9 aa, Homo Sapiens
ESAGADSTQ

SEQ ID NO: 678134 - protein, 9 aa, Homo Sapiens
RHSVVVPCE

SEQ ID NO: 678135 - protein, 9 aa, Homo Sapiens
WRTQIDSPV

SEQ ID NO: 678136 - protein, 9 aa, Homo Sapiens
TVLSNDIST

SEQ ID NO: 678137 - protein, 9 aa, Homo Sapiens
KLDIEFVKG

SEQ ID NO: 678138 - protein, 9 aa, Homo Sapiens
FHYMAALDT

SEQ ID NO: 678139 - protein, 9 aa, Homo Sapiens
RESRLKMWE

SEQ ID NO: 678140 - protein, 9 aa, Homo Sapiens
QHRQLQARV

SEQ ID NO: 678141 - protein, 9 aa, Homo Sapiens
IYHKVRHRM

SEQ ID NO: 678142 - protein, 9 aa, Homo Sapiens
QTLPTEKVA

SEQ ID NO: 678143 - protein, 9 aa, Homo Sapiens
CCSSVVLRT

SEQ ID NO: 678144 - protein, 9 aa, Homo Sapiens
LSCRGETEH

SEQ ID NO: 678145 - protein, 9 aa, Homo Sapiens
DRYVTICHP

SEQ ID NO: 678146 - protein, 9 aa, Homo Sapiens
VQLAKELTM

SEQ ID NO: 678147 - protein, 9 aa, Homo Sapiens
IIESKKAAT

SEQ ID NO: 678148 - protein, 9 aa, Homo Sapiens
TFTGKLDIE

SEQ ID NO: 678149 - protein, 9 aa, Homo Sapiens
CELRPQSSG

SEQ ID NO: 678150 - protein, 9 aa, Homo Sapiens
KALEAESAW

SEQ ID NO: 678151 - protein, 9 aa, Homo Sapiens
TIRERFPKL

SEQ ID NO: 678152 - protein, 9 aa, Homo Sapiens
TALFNNMTL

SEQ ID NO: 678153 - protein, 9 aa, Homo Sapiens
VIGPETLVC

SEQ ID NO: 678154 - protein, 9 aa, Homo Sapiens
EEEVLHSPW

SEQ ID NO: 678155 - protein, 9 aa, Homo Sapiens
KFRQIYSLR

SEQ ID NO: 678156 - protein, 9 aa, Homo Sapiens
HSPWLTNSA

SEQ ID NO: 678157 - protein, 9 aa, Homo Sapiens
RDMEDSNRN

SEQ ID NO: 678158 - protein, 9 aa, Homo Sapiens
DFGLGQRET

SEQ ID NO: 678159 - protein, 9 aa, Homo Sapiens
EDEDAMPVI

SEQ ID NO: 678160 - protein, 9 aa, Homo Sapiens
RWLSLKYPS

SEQ ID NO: 678161 - protein, 9 aa, Homo Sapiens
EVLHSPWLT

SEQ ID NO: 678162 - protein, 9 aa, Homo Sapiens
NSDNMELYN

SEQ ID NO: 678163 - protein, 9 aa, Homo Sapiens
MEKNLDFLV

SEQ ID NO: 678164 - protein, 9 aa, Homo Sapiens
GDVAGSGQP

SEQ ID NO: 678165 - protein, 9 aa, Homo Sapiens
CTSTLVITP

SEQ ID NO: 678166 - protein, 9 aa, Homo Sapiens
SSKNKDPVT

SEQ ID NO: 678167 - protein, 9 aa, Homo Sapiens
GKDHVCFAK

SEQ ID NO: 678168 - protein, 9 aa, Homo Sapiens
VERGYRMVR

SEQ ID NO: 678169 - protein, 9 aa, Homo Sapiens
NNRLDLPFM

SEQ ID NO: 678170 - protein, 9 aa, Homo Sapiens
IYKKPVGTD

SEQ ID NO: 678171 - protein, 9 aa, Homo Sapiens
TDAPASEKE

SEQ ID NO: 678172 - protein, 9 aa, Homo Sapiens
SEHLFKLNQ

SEQ ID NO: 678173 - protein, 9 aa, Homo Sapiens
LVGDVAGSG

SEQ ID NO: 678174 - protein, 9 aa, Homo Sapiens
TGYYPVKLF

SEQ ID NO: 678175 - protein, 9 aa, Homo Sapiens
PLNKDNIEE

SEQ ID NO: 678176 - protein, 9 aa, Homo Sapiens
RGFEVQLRD

SEQ ID NO: 678177 - protein, 9 aa, Homo Sapiens
KLLAHQCTA

SEQ ID NO: 678178 - protein, 9 aa, Homo Sapiens
KITDAPASE

SEQ ID NO: 678179 - protein, 9 aa, Homo Sapiens
WVINTSIQS

SEQ ID NO: 678180 - protein, 9 aa, Homo Sapiens
SLTIVHLGA

SEQ ID NO: 678181 - protein, 9 aa, Homo Sapiens
HIQSFLSEH

SEQ ID NO: 678182 - protein, 9 aa, Homo Sapiens
GADSTQQPL

SEQ ID NO: 678183 - protein, 9 aa, Homo Sapiens
KDPCMQDQE

SEQ ID NO: 678184 - protein, 9 aa, Homo Sapiens
NVCCSSVVL

SEQ ID NO: 678185 - protein, 9 aa, Homo Sapiens
RAPVYMPTV

SEQ ID NO: 678186 - protein, 9 aa, Homo Sapiens
THQGWEPRA

SEQ ID NO: 678187 - protein, 9 aa, Homo Sapiens
LAKELTMPE

SEQ ID NO: 678188 - protein, 9 aa, Homo Sapiens
GEEDVRFRR

SEQ ID NO: 678189 - protein, 9 aa, Homo Sapiens
MVSLVSSVS

SEQ ID NO: 678190 - protein, 9 aa, Homo Sapiens
NIDQCSQIV

SEQ ID NO: 678191 - protein, 9 aa, Homo Sapiens
FSAEYQFFP

SEQ ID NO: 678192 - protein, 9 aa, Homo Sapiens
LPDQATVKK

SEQ ID NO: 678193 - protein, 9 aa, Homo Sapiens
IDSPVSGKV

SEQ ID NO: 678194 - protein, 9 aa, Homo Sapiens
GRPLSDNPN

SEQ ID NO: 678195 - protein, 9 aa, Homo Sapiens
QGWEPRAVL

SEQ ID NO: 678196 - protein, 9 aa, Homo Sapiens
QIDSPVSGK

SEQ ID NO: 678197 - protein, 9 aa, Homo Sapiens
GLSLPVCMV

SEQ ID NO: 678198 - protein, 9 aa, Homo Sapiens
LAHQCTALT

SEQ ID NO: 678199 - protein, 9 aa, Homo Sapiens
GHFKLQNTY

SEQ ID NO: 678200 - protein, 9 aa, Homo Sapiens
LCQFYNQVE

SEQ ID NO: 678201 - protein, 9 aa, Homo Sapiens
LPTEKVAEV

SEQ ID NO: 678202 - protein, 9 aa, Homo Sapiens
VKLPKPSLC

SEQ ID NO: 678203 - protein, 9 aa, Homo Sapiens
ALFNNMTLV

SEQ ID NO: 678204 - protein, 9 aa, Homo Sapiens
SALLDMVPR

SEQ ID NO: 678205 - protein, 9 aa, Homo Sapiens
GEAAKGADE

SEQ ID NO: 678206 - protein, 9 aa, Homo Sapiens
QPGLQEAQK

SEQ ID NO: 678207 - protein, 9 aa, Homo Sapiens
NPFSFTEFL

SEQ ID NO: 678208 - protein, 9 aa, Homo Sapiens
RHCFPWCRR

SEQ ID NO: 678209 - protein, 9 aa, Homo Sapiens
VSTFTGKLD

SEQ ID NO: 678210 - protein, 9 aa, Homo Sapiens
AMAFRWWQP

SEQ ID NO: 678211 - protein, 9 aa, Homo Sapiens
LLGRPLSDN

SEQ ID NO: 678212 - protein, 9 aa, Homo Sapiens
ATVCKAGDK

SEQ ID NO: 678213 - protein, 9 aa, Homo Sapiens
MLVFHPSKR

SEQ ID NO: 678214 - protein, 9 aa, Homo Sapiens
FYIIQNKLS

SEQ ID NO: 678215 - protein, 9 aa, Homo Sapiens
TSTLVITPL

SEQ ID NO: 678216 - protein, 9 aa, Homo Sapiens
FHVNKSEHL

SEQ ID NO: 678217 - protein, 9 aa, Homo Sapiens
SKGYGVGTL

SEQ ID NO: 678218 - protein, 9 aa, Homo Sapiens
AKGLGTNYR

SEQ ID NO: 678219 - protein, 9 aa, Homo Sapiens
QFDRYYHEQ

SEQ ID NO: 678220 - protein, 9 aa, Homo Sapiens
DAPKVTLPE

SEQ ID NO: 678221 - protein, 9 aa, Homo Sapiens
VFEDNHNKL

SEQ ID NO: 678222 - protein, 9 aa, Homo Sapiens
TLVSKLTIH

SEQ ID NO: 678223 - protein, 9 aa, Homo Sapiens
EQRWQAAPT

SEQ ID NO: 678224 - protein, 9 aa, Homo Sapiens
DAKTPAMAF

SEQ ID NO: 678225 - protein, 9 aa, Homo Sapiens
SPWLTNSAM

SEQ ID NO: 678226 - protein, 9 aa, Homo Sapiens
RRAPVYMPT

SEQ ID NO: 678227 - protein, 9 aa, Homo Sapiens
FEVQLRDME

SEQ ID NO: 678228 - protein, 9 aa, Homo Sapiens
VRFRRAPVY

SEQ ID NO: 678229 - protein, 9 aa, Homo Sapiens
FSFTEFLKT

SEQ ID NO: 678230 - protein, 9 aa, Homo Sapiens
KDFGLGQRE

SEQ ID NO: 678231 - protein, 9 aa, Homo Sapiens
MWLIEKRAF

SEQ ID NO: 678232 - protein, 9 aa, Homo Sapiens
LRRISAVNS

SEQ ID NO: 678233 - protein, 9 aa, Homo Sapiens
LEQIRAYCQ

SEQ ID NO: 678234 - protein, 9 aa, Homo Sapiens
AFFRWLSLK

SEQ ID NO: 678235 - protein, 9 aa, Homo Sapiens
CQFYNQVEI

SEQ ID NO: 678236 - protein, 9 aa, Homo Sapiens
NKDNIEELK

SEQ ID NO: 678237 - protein, 9 aa, Homo Sapiens
VPNIHWLVV

SEQ ID NO: 678238 - protein, 9 aa, Homo Sapiens
HVNKSEHLF

SEQ ID NO: 678239 - protein, 9 aa, Homo Sapiens
SEDHSSNMF

SEQ ID NO: 678240 - protein, 9 aa, Homo Sapiens
KKPVGTDLN

SEQ ID NO: 678241 - protein, 9 aa, Homo Sapiens
CLGAQPVND

SEQ ID NO: 678242 - protein, 9 aa, Homo Sapiens
EQELKERES

SEQ ID NO: 678243 - protein, 9 aa, Homo Sapiens
IKILMKVGQ

SEQ ID NO: 678244 - protein, 9 aa, Homo Sapiens
PDGSALLDM

SEQ ID NO: 678245 - protein, 9 aa, Homo Sapiens
LSLPVCMVS

SEQ ID NO: 678246 - protein, 9 aa, Homo Sapiens
MFSAEYQFF

SEQ ID NO: 678247 - protein, 9 aa, Homo Sapiens
LVSKLTIHN

SEQ ID NO: 678248 - protein, 9 aa, Homo Sapiens
MPVIGPETL

SEQ ID NO: 678249 - protein, 9 aa, Homo Sapiens
RNCYEALVI

SEQ ID NO: 678250 - protein, 9 aa, Homo Sapiens
RKIQKQLRS

SEQ ID NO: 678251 - protein, 9 aa, Homo Sapiens
HLGAKGTTA

SEQ ID NO: 678252 - protein, 9 aa, Homo Sapiens
GSYVPGPSS

SEQ ID NO: 678253 - protein, 9 aa, Homo Sapiens
VASQTLPTE

SEQ ID NO: 678254 - protein, 9 aa, Homo Sapiens
GNCAKGLGT

SEQ ID NO: 678255 - protein, 9 aa, Homo Sapiens
FHPSKRISA

SEQ ID NO: 678256 - protein, 9 aa, Homo Sapiens
TASLGEAAK

SEQ ID NO: 678257 - protein, 9 aa, Homo Sapiens
NRTSVMFNL

SEQ ID NO: 678258 - protein, 9 aa, Homo Sapiens
FQCNVPMGM

SEQ ID NO: 678259 - protein, 9 aa, Homo Sapiens
RRSRSLIKN

SEQ ID NO: 678260 - protein, 9 aa, Homo Sapiens
SSRSPSLNR

SEQ ID NO: 678261 - protein, 9 aa, Homo Sapiens
LGCTSTLVI

SEQ ID NO: 678262 - protein, 9 aa, Homo Sapiens
EEVLHSPWL

SEQ ID NO: 678263 - protein, 9 aa, Homo Sapiens
SILVPNGPE

SEQ ID NO: 678264 - protein, 9 aa, Homo Sapiens
GTVKLPKPS

SEQ ID NO: 678265 - protein, 9 aa, Homo Sapiens
VICHPLRYT

SEQ ID NO: 678266 - protein, 9 aa, Homo Sapiens
PVNDLALWP

SEQ ID NO: 678267 - protein, 9 aa, Homo Sapiens
YNQVEIEFL

SEQ ID NO: 678268 - protein, 9 aa, Homo Sapiens
YDCYIVICH

SEQ ID NO: 678269 - protein, 9 aa, Homo Sapiens
RYYHEQELE

SEQ ID NO: 678270 - protein, 9 aa, Homo Sapiens
AAKGADEAA

SEQ ID NO: 678271 - protein, 9 aa, Homo Sapiens
LIKYLSQMM

SEQ ID NO: 678272 - protein, 9 aa, Homo Sapiens
GWEPRAVLH

SEQ ID NO: 678273 - protein, 9 aa, Homo Sapiens
AGTDQNFLL

SEQ ID NO: 678274 - protein, 9 aa, Homo Sapiens
VNDLALWPV

SEQ ID NO: 678275 - protein, 9 aa, Homo Sapiens
AIYHKVRHR

SEQ ID NO: 678276 - protein, 9 aa, Homo Sapiens
YWKIRKGNT

SEQ ID NO: 678277 - protein, 9 aa, Homo Sapiens
VGDVAGSGQ

SEQ ID NO: 678278 - protein, 9 aa, Homo Sapiens
EQEQLNVEN

SEQ ID NO: 678279 - protein, 9 aa, Homo Sapiens
HYMAALDTE

SEQ ID NO: 678280 - protein, 9 aa, Homo Sapiens
LVFEDNHNK

SEQ ID NO: 678281 - protein, 9 aa, Homo Sapiens
PLILNVCCS

SEQ ID NO: 678282 - protein, 9 aa, Homo Sapiens
PQHTHIHVH

SEQ ID NO: 678283 - protein, 9 aa, Homo Sapiens
MKTMSAIYH

SEQ ID NO: 678284 - protein, 9 aa, Homo Sapiens
LGMLRGIGS

SEQ ID NO: 678285 - protein, 9 aa, Homo Sapiens
RSGTVKLPK

SEQ ID NO: 678286 - protein, 9 aa, Homo Sapiens
RSTTLQKEV

SEQ ID NO: 678287 - protein, 9 aa, Homo Sapiens
GVCQTRAIK

SEQ ID NO: 678288 - protein, 9 aa, Homo Sapiens
YVPGPSSRS

SEQ ID NO: 678289 - protein, 9 aa, Homo Sapiens
SRKIQKQLR

SEQ ID NO: 678290 - protein, 9 aa, Homo Sapiens
YTFELLVDR

SEQ ID NO: 678291 - protein, 9 aa, Homo Sapiens
AALDTELSG

SEQ ID NO: 678292 - protein, 9 aa, Homo Sapiens
SDFYHRIQT

SEQ ID NO: 678293 - protein, 9 aa, Homo Sapiens
DGSALLDMV

SEQ ID NO: 678294 - protein, 9 aa, Homo Sapiens
GYDRYVTIC

SEQ ID NO: 678295 - protein, 9 aa, Homo Sapiens
DVFDPLIIE

SEQ ID NO: 678296 - protein, 9 aa, Homo Sapiens
SQSQADEQA

SEQ ID NO: 678297 - protein, 9 aa, Homo Sapiens
ELPLAGGDG

SEQ ID NO: 678298 - protein, 9 aa, Homo Sapiens
IIQNKLSLN

SEQ ID NO: 678299 - protein, 9 aa, Homo Sapiens
VNSTDFNPD

SEQ ID NO: 678300 - protein, 9 aa, Homo Sapiens
LPLAGGDGG

SEQ ID NO: 678301 - protein, 9 aa, Homo Sapiens
RLQSQHRQL

SEQ ID NO: 678302 - protein, 9 aa, Homo Sapiens
PGPSSRSPS

SEQ ID NO: 678303 - protein, 9 aa, Homo Sapiens
SATVCKAGD

SEQ ID NO: 678304 - protein, 9 aa, Homo Sapiens
IFYIIQNKL

SEQ ID NO: 678305 - protein, 9 aa, Homo Sapiens
LLKAIETKV

SEQ ID NO: 678306 - protein, 9 aa, Homo Sapiens
LKQFLEDEY

SEQ ID NO: 678307 - protein, 9 aa, Homo Sapiens
MMVPNRNSD

SEQ ID NO: 678308 - protein, 9 aa, Homo Sapiens
GRSPDELPL

SEQ ID NO: 678309 - protein, 9 aa, Homo Sapiens
QIRAYCQTC

SEQ ID NO: 678310 - protein, 9 aa, Homo Sapiens
GPSSRSPSL

SEQ ID NO: 678311 - protein, 9 aa, Homo Sapiens
DSEDHSSNM

SEQ ID NO: 678312 - protein, 9 aa, Homo Sapiens
SNTVMWLIE

SEQ ID NO: 678313 - protein, 9 aa, Homo Sapiens
IRAYCQTCW

SEQ ID NO: 678314 - protein, 9 aa, Homo Sapiens
GCELRPQSS

SEQ ID NO: 678315 - protein, 9 aa, Homo Sapiens
VQLRDMEDS

SEQ ID NO: 678316 - protein, 9 aa, Homo Sapiens
FFHVNKSEH

SEQ ID NO: 678317 - protein, 9 aa, Homo Sapiens
SYDCYIVIC

SEQ ID NO: 678318 - protein, 9 aa, Homo Sapiens
RSRKIQKQL

SEQ ID NO: 678319 - protein, 9 aa, Homo Sapiens
EQLNVENRQ

SEQ ID NO: 678320 - protein, 9 aa, Homo Sapiens
AEAAAAQQL

SEQ ID NO: 678321 - protein, 9 aa, Homo Sapiens
TSVMFNLPD

SEQ ID NO: 678322 - protein, 9 aa, Homo Sapiens
NHLLNNRLD

SEQ ID NO: 678323 - protein, 9 aa, Homo Sapiens
VMSYDCYIV

SEQ ID NO: 678324 - protein, 9 aa, Homo Sapiens
SGTVKLPKP

SEQ ID NO: 678325 - protein, 9 aa, Homo Sapiens
FYNQVEIEF

SEQ ID NO: 678326 - protein, 9 aa, Homo Sapiens
KEDEDAMPV

SEQ ID NO: 678327 - protein, 9 aa, Homo Sapiens
SHASAMKDP

SEQ ID NO: 678328 - protein, 9 aa, Homo Sapiens
LAGTDQNFL

SEQ ID NO: 678329 - protein, 9 aa, Homo Sapiens
TMQVGSSSC

SEQ ID NO: 678330 - protein, 9 aa, Homo Sapiens
HCFPWCRRS

SEQ ID NO: 678331 - protein, 9 aa, Homo Sapiens
RPLLKAIET

SEQ ID NO: 678332 - protein, 9 aa, Homo Sapiens
TEHHCSGLH

SEQ ID NO: 678333 - protein, 9 aa, Homo Sapiens
VHLGAKGTT

SEQ ID NO: 678334 - protein, 9 aa, Homo Sapiens
SRYNTISYW

SEQ ID NO: 678335 - protein, 9 aa, Homo Sapiens
LALIIGLFV

SEQ ID NO: 678336 - protein, 9 aa, Homo Sapiens
TGRRREQRW

SEQ ID NO: 678337 - protein, 9 aa, Homo Sapiens
PESLAAEAA

SEQ ID NO: 678338 - protein, 9 aa, Homo Sapiens
VFHPSKRIS

SEQ ID NO: 678339 - protein, 9 aa, Homo Sapiens
RSLRKALEA

SEQ ID NO: 678340 - protein, 9 aa, Homo Sapiens
WLIEKRAFQ

SEQ ID NO: 678341 - protein, 9 aa, Homo Sapiens
NMTLVSKLT

SEQ ID NO: 678342 - protein, 9 aa, Homo Sapiens
MSYDCYIVI

SEQ ID NO: 678343 - protein, 9 aa, Homo Sapiens
LPEKTPGYY

SEQ ID NO: 678344 - protein, 9 aa, Homo Sapiens
NFQCNVPMG

SEQ ID NO: 678345 - protein, 9 aa, Homo Sapiens
YDRYVTICH

SEQ ID NO: 678346 - protein, 9 aa, Homo Sapiens
EQETVLSND

SEQ ID NO: 678347 - protein, 9 aa, Homo Sapiens
IIGLFVGLN

SEQ ID NO: 678348 - protein, 9 aa, Homo Sapiens
THIHVHIHQ

SEQ ID NO: 678349 - protein, 9 aa, Homo Sapiens
HYFPTEGFV

SEQ ID NO: 678350 - protein, 9 aa, Homo Sapiens
LRKALEAES

SEQ ID NO: 678351 - protein, 9 aa, Homo Sapiens
FFRWLSLKY

SEQ ID NO: 678352 - protein, 9 aa, Homo Sapiens
DQNFLLAKK

SEQ ID NO: 678353 - protein, 9 aa, Homo Sapiens
EHLFKLNQD

SEQ ID NO: 678354 - protein, 9 aa, Homo Sapiens
QIVKCSVSS

SEQ ID NO: 678355 - protein, 9 aa, Homo Sapiens
ETVLSNDIS

SEQ ID NO: 678356 - protein, 9 aa, Homo Sapiens
PVIGPETLV

SEQ ID NO: 678357 - protein, 9 aa, Homo Sapiens
KSEHLFKLN

SEQ ID NO: 678358 - protein, 9 aa, Homo Sapiens
QLNVENRQI

SEQ ID NO: 678359 - protein, 9 aa, Homo Sapiens
AVNSTDFNP

SEQ ID NO: 678360 - protein, 9 aa, Homo Sapiens
ALIIGLFVG

SEQ ID NO: 678361 - protein, 9 aa, Homo Sapiens
VDGHQLSDF

SEQ ID NO: 678362 - protein, 9 aa, Homo Sapiens
VLSMEKNLD

SEQ ID NO: 678363 - protein, 9 aa, Homo Sapiens
TYISTIRER

SEQ ID NO: 678364 - protein, 9 aa, Homo Sapiens
VTICHPLRY

SEQ ID NO: 678365 - protein, 9 aa, Homo Sapiens
MAFRWWQPQ

SEQ ID NO: 678366 - protein, 9 aa, Homo Sapiens
SRLKMWEQK

SEQ ID NO: 678367 - protein, 9 aa, Homo Sapiens
HIHVHIHQE

SEQ ID NO: 678368 - protein, 9 aa, Homo Sapiens
EAKITDAPA

SEQ ID NO: 678369 - protein, 9 aa, Homo Sapiens
PLSDNPNVL

SEQ ID NO: 678370 - protein, 9 aa, Homo Sapiens
QSQADEQAG

SEQ ID NO: 678371 - protein, 9 aa, Homo Sapiens
TSFSQTCLK

SEQ ID NO: 678372 - protein, 9 aa, Homo Sapiens
YFGTVRNCY

SEQ ID NO: 678373 - protein, 9 aa, Homo Sapiens
FDRYYHEQE

SEQ ID NO: 678374 - protein, 9 aa, Homo Sapiens
EQAGTPPPA

SEQ ID NO: 678375 - protein, 9 aa, Homo Sapiens
PLQQNHLLN

SEQ ID NO: 678376 - protein, 9 aa, Homo Sapiens
QKQLRSVVS

SEQ ID NO: 678377 - protein, 9 aa, Homo Sapiens
WLTLCQFYN

SEQ ID NO: 678378 - protein, 9 aa, Homo Sapiens
SNDISTLST

SEQ ID NO: 678379 - protein, 9 aa, Homo Sapiens
WEPRAVLHC

SEQ ID NO: 678380 - protein, 9 aa, Homo Sapiens
RSHASAMKD

SEQ ID NO: 678381 - protein, 9 aa, Homo Sapiens
LPLRSRKIQ

SEQ ID NO: 678382 - protein, 9 aa, Homo Sapiens
LWLTLCQFY

SEQ ID NO: 678383 - protein, 9 aa, Homo Sapiens
GAQPVNDLA

SEQ ID NO: 678384 - protein, 9 aa, Homo Sapiens
NVERGYRMV

SEQ ID NO: 678385 - protein, 9 aa, Homo Sapiens
LGEAAKGAD

SEQ ID NO: 678386 - protein, 9 aa, Homo Sapiens
EWAKSTGYY

SEQ ID NO: 678387 - protein, 9 aa, Homo Sapiens
QKEVPVIFI

SEQ ID NO: 678388 - protein, 9 aa, Homo Sapiens
DQCSQIVKC

SEQ ID NO: 678389 - protein, 9 aa, Homo Sapiens
RFRRAPVYM

SEQ ID NO: 678390 - protein, 9 aa, Homo Sapiens
KIQKQLRSV

SEQ ID NO: 678391 - protein, 9 aa, Homo Sapiens
LNVCCSSVV

SEQ ID NO: 678392 - protein, 9 aa, Homo Sapiens
CRGETEHHC

SEQ ID NO: 678393 - protein, 9 aa, Homo Sapiens
CRYHYFPTE

SEQ ID NO: 678394 - protein, 9 aa, Homo Sapiens
EDAMPVIGP

SEQ ID NO: 678395 - protein, 9 aa, Homo Sapiens
PVCMVSLVS

SEQ ID NO: 678396 - protein, 9 aa, Homo Sapiens
YLSQMMRDL

SEQ ID NO: 678397 - protein, 9 aa, Homo Sapiens
YFPTEGFVL

SEQ ID NO: 678398 - protein, 9 aa, Homo Sapiens
LSEHKTLLL

SEQ ID NO: 678399 - protein, 9 aa, Homo Sapiens
PKDVFDPLI

SEQ ID NO: 678400 - protein, 9 aa, Homo Sapiens
SAMKDPCMQ

SEQ ID NO: 678401 - protein, 9 aa, Homo Sapiens
PAFFRWLSL

SEQ ID NO: 678402 - protein, 9 aa, Homo Sapiens
QADEQAGTP

SEQ ID NO: 678403 - protein, 9 aa, Homo Sapiens
VNKSEHLFK

SEQ ID NO: 678404 - protein, 9 aa, Homo Sapiens
SVMFNLPDQ

SEQ ID NO: 678405 - protein, 9 aa, Homo Sapiens
YLDIFYIIQ

SEQ ID NO: 678406 - protein, 9 aa, Homo Sapiens
NKMFSAEYQ

SEQ ID NO: 678407 - protein, 9 aa, Homo Sapiens
LCQNPGQPG

SEQ ID NO: 678408 - protein, 9 aa, Homo Sapiens
LDTELSGRL

SEQ ID NO: 678409 - protein, 9 aa, Homo Sapiens
QMMRDLPSC

SEQ ID NO: 678410 - protein, 9 aa, Homo Sapiens
IKYLSQMMR

SEQ ID NO: 678411 - protein, 9 aa, Homo Sapiens
DISTLSTSC

SEQ ID NO: 678412 - protein, 9 aa, Homo Sapiens
APTLLGRPL

SEQ ID NO: 678413 - protein, 9 aa, Homo Sapiens
GYTMQVGSS

SEQ ID NO: 678414 - protein, 9 aa, Homo Sapiens
VPGPSSRSP

SEQ ID NO: 678415 - protein, 9 aa, Homo Sapiens
MGYDRYVTI

SEQ ID NO: 678416 - protein, 9 aa, Homo Sapiens
AKELTMPEQ

SEQ ID NO: 678417 - protein, 9 aa, Homo Sapiens
PNIHWLVVE

SEQ ID NO: 678418 - protein, 9 aa, Homo Sapiens
VAGSGQPSA

SEQ ID NO: 678419 - protein, 9 aa, Homo Sapiens
YQFFPEETR

SEQ ID NO: 678420 - protein, 9 aa, Homo Sapiens
SAEYQFFPE

SEQ ID NO: 678421 - protein, 9 aa, Homo Sapiens
STFTGKLDI

SEQ ID NO: 678422 - protein, 9 aa, Homo Sapiens
TISYWKIRK

SEQ ID NO: 678423 - protein, 9 aa, Homo Sapiens
EHKTLLLAA

SEQ ID NO: 678424 - protein, 9 aa, Homo Sapiens
YYHEQELES

SEQ ID NO: 678425 - protein, 9 aa, Homo Sapiens
YHYFPTEGF

SEQ ID NO: 678426 - protein, 9 aa, Homo Sapiens
RYVTICHPL

SEQ ID NO: 678427 - protein, 9 aa, Homo Sapiens
FSQTCLKQF

SEQ ID NO: 678428 - protein, 9 aa, Homo Sapiens
STTLQKEVP

SEQ ID NO: 678429 - protein, 9 aa, Homo Sapiens
QDSEDHSSN

SEQ ID NO: 678430 - protein, 9 aa, Homo Sapiens
NMFNYEEYC

SEQ ID NO: 678431 - protein, 9 aa, Homo Sapiens
PAVTNRGHV

SEQ ID NO: 678432 - protein, 9 aa, Homo Sapiens
DSPVSGKVR

SEQ ID NO: 678433 - protein, 9 aa, Homo Sapiens
SFSQTCLKQ

SEQ ID NO: 678434 - protein, 9 aa, Homo Sapiens
RISAVNSTD

SEQ ID NO: 678435 - protein, 9 aa, Homo Sapiens
RSPDELPLA

SEQ ID NO: 678436 - protein, 9 aa, Homo Sapiens
FPTEGFVLV

SEQ ID NO: 678437 - protein, 9 aa, Homo Sapiens
PNRNSDNME

SEQ ID NO: 678438 - protein, 9 aa, Homo Sapiens
EYLGCTSTL

SEQ ID NO: 678439 - protein, 9 aa, Homo Sapiens
KLPKPSLCH

SEQ ID NO: 678440 - protein, 9 aa, Homo Sapiens
YPVKLFTKL

SEQ ID NO: 678441 - protein, 9 aa, Homo Sapiens
LNNRLDLPF

SEQ ID NO: 678442 - protein, 9 aa, Homo Sapiens
AGSGQPSAP

SEQ ID NO: 678443 - protein, 9 aa, Homo Sapiens
VPNRNSDNM

SEQ ID NO: 678444 - protein, 9 aa, Homo Sapiens
LNVENRQIM

SEQ ID NO: 678445 - protein, 9 aa, Homo Sapiens
MMRDLPSCP

SEQ ID NO: 678446 - protein, 9 aa, Homo Sapiens
RRISAVNST

SEQ ID NO: 678447 - protein, 9 aa, Homo Sapiens
CEKKFRQIY

SEQ ID NO: 678448 - protein, 9 aa, Homo Sapiens
SQTCLKQFL

SEQ ID NO: 678449 - protein, 9 aa, Homo Sapiens
EDLGCELRP

SEQ ID NO: 678450 - protein, 9 aa, Homo Sapiens
CEPPEVGSD

SEQ ID NO: 678451 - protein, 9 aa, Homo Sapiens
TLLGRPLSD

SEQ ID NO: 678452 - protein, 9 aa, Homo Sapiens
AHQCTALTA

SEQ ID NO: 678453 - protein, 9 aa, Homo Sapiens
RREQRWQAA

SEQ ID NO: 678454 - protein, 9 aa, Homo Sapiens
GSALLDMVP

SEQ ID NO: 678455 - protein, 9 aa, Homo Sapiens
ILRRISAVN

SEQ ID NO: 678456 - protein, 9 aa, Homo Sapiens
QPVNDLALW

SEQ ID NO: 678457 - protein, 9 aa, Homo Sapiens
RQIYSLRHH

SEQ ID NO: 678458 - protein, 9 aa, Homo Sapiens
SLVSAYTFE

SEQ ID NO: 678459 - protein, 9 aa, Homo Sapiens
QLSDFYHRI

SEQ ID NO: 678460 - protein, 9 aa, Homo Sapiens
LLHVPNIHW

SEQ ID NO: 678461 - protein, 9 aa, Homo Sapiens
LSQMMRDLP

SEQ ID NO: 678462 - protein, 9 aa, Homo Sapiens
SAYTFELLV

SEQ ID NO: 678463 - protein, 9 aa, Homo Sapiens
FNLPDQATV

SEQ ID NO: 678464 - protein, 9 aa, Homo Sapiens
EYQFFPEET

SEQ ID NO: 678465 - protein, 9 aa, Homo Sapiens
TVIQLLGML

SEQ ID NO: 678466 - protein, 9 aa, Homo Sapiens
TMSAIYHKV

SEQ ID NO: 678467 - protein, 9 aa, Homo Sapiens
RAIKILMKV

SEQ ID NO: 678468 - protein, 9 aa, Homo Sapiens
GEPLNKDNI

SEQ ID NO: 678469 - protein, 9 aa, Homo Sapiens
WLTNSAMRA

SEQ ID NO: 678470 - protein, 9 aa, Homo Sapiens
VLLLAILLV

SEQ ID NO: 678471 - protein, 9 aa, Homo Sapiens
NCAKGLGTN

SEQ ID NO: 678472 - protein, 9 aa, Homo Sapiens
YIIQNKLSL

SEQ ID NO: 678473 - protein, 9 aa, Homo Sapiens
TLPTEKVAE

SEQ ID NO: 678474 - protein, 9 aa, Homo Sapiens
FTVIQLLGM

SEQ ID NO: 678475 - protein, 9 aa, Homo Sapiens
FTGKLDIEF

SEQ ID NO: 678476 - protein, 9 aa, Homo Sapiens
QRETPPPPP

SEQ ID NO: 678477 - protein, 9 aa, Homo Sapiens
DGHSLVSAY

SEQ ID NO: 678478 - protein, 9 aa, Homo Sapiens
KQFLEDEYP

SEQ ID NO: 678479 - protein, 9 aa, Homo Sapiens
ESPEDLGCE

SEQ ID NO: 678480 - protein, 9 aa, Homo Sapiens
PEDLGCELR

SEQ ID NO: 678481 - protein, 9 aa, Homo Sapiens
GLSNTVMWL

SEQ ID NO: 678482 - protein, 9 aa, Homo Sapiens
WCRRSGKSN

SEQ ID NO: 678483 - protein, 9 aa, Homo Sapiens
GPDGSALLD

SEQ ID NO: 678484 - protein, 9 aa, Homo Sapiens
FPWCRRSGK

SEQ ID NO: 678485 - protein, 9 aa, Homo Sapiens
SFLCQNPGQ

SEQ ID NO: 678486 - protein, 9 aa, Homo Sapiens
FKLQNTYEN

SEQ ID NO: 678487 - protein, 9 aa, Homo Sapiens
RRSGKSNVG

SEQ ID NO: 678488 - protein, 9 aa, Homo Sapiens
ILNVCCSSV

SEQ ID NO: 678489 - protein, 9 aa, Homo Sapiens
KNTGRRREQ

SEQ ID NO: 678490 - protein, 9 aa, Homo Sapiens
QRWQAAPTL

SEQ ID NO: 678491 - protein, 9 aa, Homo Sapiens
NDLALWPVI

SEQ ID NO: 678492 - protein, 9 aa, Homo Sapiens
CAKGLGTNY

SEQ ID NO: 678493 - protein, 9 aa, Homo Sapiens
HQLSDFYHR

SEQ ID NO: 678494 - protein, 9 aa, Homo Sapiens
SPSATVCKA

SEQ ID NO: 678495 - protein, 9 aa, Homo Sapiens
LGLSNTVMW

SEQ ID NO: 678496 - protein, 9 aa, Homo Sapiens
EQELESALR

SEQ ID NO: 678497 - protein, 9 aa, Homo Sapiens
NIHWLVVED

SEQ ID NO: 678498 - protein, 9 aa, Homo Sapiens
STYISTIRE

SEQ ID NO: 678499 - protein, 9 aa, Homo Sapiens
KGYGVGTLI

SEQ ID NO: 678500 - protein, 9 aa, Homo Sapiens
SVKLLAHQC

SEQ ID NO: 678501 - protein, 9 aa, Homo Sapiens
TIVHLGAKG

SEQ ID NO: 678502 - protein, 9 aa, Homo Sapiens
AKNPDTIKD

SEQ ID NO: 678503 - protein, 9 aa, Homo Sapiens
RGETEHHCS

SEQ ID NO: 678504 - protein, 9 aa, Homo Sapiens
MTLVSKLTI

SEQ ID NO: 678505 - protein, 9 aa, Homo Sapiens
VKLLAHQCT

SEQ ID NO: 678506 - protein, 9 aa, Homo Sapiens
YVTICHPLR

SEQ ID NO: 678507 - protein, 9 aa, Homo Sapiens
ALLDMVPRA

SEQ ID NO: 678508 - protein, 9 aa, Homo Sapiens
ASAMKDPCM

SEQ ID NO: 678509 - protein, 9 aa, Homo Sapiens
PDELPLAGG

SEQ ID NO: 678510 - protein, 9 aa, Homo Sapiens
LTIVHLGAK

SEQ ID NO: 678511 - protein, 9 aa, Homo Sapiens
AEYQFFPEE

SEQ ID NO: 678512 - protein, 9 aa, Homo Sapiens
ILVPNGPEA

SEQ ID NO: 678513 - protein, 9 aa, Homo Sapiens
KVTLPEKTP

SEQ ID NO: 678514 - protein, 9 aa, Homo Sapiens
SSNMFNYEE

SEQ ID NO: 678515 - protein, 9 aa, Homo Sapiens
SLGEAAKGA

SEQ ID NO: 678516 - protein, 9 aa, Homo Sapiens
DVRFRRAPV

SEQ ID NO: 678517 - protein, 9 aa, Homo Sapiens
SQTLPTEKV

SEQ ID NO: 678518 - protein, 9 aa, Homo Sapiens
GTDLNYIAA

SEQ ID NO: 678519 - protein, 9 aa, Homo Sapiens
PTEKVAEVD

SEQ ID NO: 678520 - protein, 9 aa, Homo Sapiens
PFSFTEFLK

SEQ ID NO: 678521 - protein, 9 aa, Homo Sapiens
HLAGTDQNF

SEQ ID NO: 678522 - protein, 9 aa, Homo Sapiens
NKSEHLFKL

SEQ ID NO: 678523 - protein, 9 aa, Homo Sapiens
VINTSIQST

SEQ ID NO: 678524 - protein, 9 aa, Homo Sapiens
NLPDQATVK

SEQ ID NO: 678525 - protein, 9 aa, Homo Sapiens
GFEVQLRDM

SEQ ID NO: 678526 - protein, 9 aa, Homo Sapiens
RRRSRSLIK

SEQ ID NO: 678527 - protein, 9 aa, Homo Sapiens
LSNDISTLS

SEQ ID NO: 678528 - protein, 9 aa, Homo Sapiens
VENRQIMEE

SEQ ID NO: 678529 - protein, 9 aa, Homo Sapiens
VTNRGHVEN

SEQ ID NO: 678530 - protein, 9 aa, Homo Sapiens
ELRPQSSGT

SEQ ID NO: 678531 - protein, 9 aa, Homo Sapiens
TNRGHVENT

SEQ ID NO: 678532 - protein, 9 aa, Homo Sapiens
HLLNNRLDL

SEQ ID NO: 678533 - protein, 9 aa, Homo Sapiens
CLKQFLEDE

SEQ ID NO: 678534 - protein, 9 aa, Homo Sapiens
KLPHLAGTD

SEQ ID NO: 678535 - protein, 9 aa, Homo Sapiens
EAAAAQQLQ

SEQ ID NO: 678536 - protein, 9 aa, Homo Sapiens
AKSTGYYPV

SEQ ID NO: 678537 - protein, 9 aa, Homo Sapiens
VFDPLIIES

SEQ ID NO: 678538 - protein, 9 aa, Homo Sapiens
CRRSGKSNV

SEQ ID NO: 678539 - protein, 9 aa, Homo Sapiens
IETKVNETK

SEQ ID NO: 678540 - protein, 9 aa, Homo Sapiens
YCQTCWEWQ

SEQ ID NO: 678541 - protein, 9 aa, Homo Sapiens
QNPGQPGLQ

SEQ ID NO: 678542 - protein, 9 aa, Homo Sapiens
VVVPCEPPE

SEQ ID NO: 678543 - protein, 9 aa, Homo Sapiens
RFTVIQLLG

SEQ ID NO: 678544 - protein, 9 aa, Homo Sapiens
EEDVRFRRA

SEQ ID NO: 678545 - protein, 9 aa, Homo Sapiens
KNPDTIKDS

SEQ ID NO: 678546 - protein, 9 aa, Homo Sapiens
LIIESKKAA

SEQ ID NO: 678547 - protein, 9 aa, Homo Sapiens
PGQPGLQEA

SEQ ID NO: 678548 - protein, 9 aa, Homo Sapiens
QLAKELTMP

SEQ ID NO: 678549 - protein, 9 aa, Homo Sapiens
DMEDSNRNS

SEQ ID NO: 678550 - protein, 9 aa, Homo Sapiens
KKNIDQCSQ

SEQ ID NO: 678551 - protein, 9 aa, Homo Sapiens
QSTYISTIR

SEQ ID NO: 678552 - protein, 9 aa, Homo Sapiens
HKVRHRMND

SEQ ID NO: 678553 - protein, 9 aa, Homo Sapiens
HSSNMFNYE

SEQ ID NO: 678554 - protein, 9 aa, Homo Sapiens
LGPDGSALL

SEQ ID NO: 678555 - protein, 9 aa, Homo Sapiens
SVVVPCEPP

SEQ ID NO: 678556 - protein, 9 aa, Homo Sapiens
DHVCFAKNP

SEQ ID NO: 678557 - protein, 9 aa, Homo Sapiens
IYSLRHHQR

SEQ ID NO: 678558 - protein, 9 aa, Homo Sapiens
FLCQNPGQP

SEQ ID NO: 678559 - protein, 9 aa, Homo Sapiens
YHEQELESA

SEQ ID NO: 678560 - protein, 9 aa, Homo Sapiens
TCLKQFLED

SEQ ID NO: 678561 - protein, 9 aa, Homo Sapiens
RSPSATVCK

SEQ ID NO: 678562 - protein, 9 aa, Homo Sapiens
KDHVCFAKN

SEQ ID NO: 678563 - protein, 9 aa, Homo Sapiens
ILALIIGLF

SEQ ID NO: 678564 - protein, 9 aa, Homo Sapiens
SRRRSRSLI

SEQ ID NO: 678565 - protein, 9 aa, Homo Sapiens
GQPSAPQTL

SEQ ID NO: 678566 - protein, 9 aa, Homo Sapiens
STLVITPLT

SEQ ID NO: 678567 - protein, 9 aa, Homo Sapiens
LMREFWVIN

SEQ ID NO: 678568 - protein, 9 aa, Homo Sapiens
DNHNKLEVA

SEQ ID NO: 678569 - protein, 9 aa, Homo Sapiens
QSQHRQLQA

SEQ ID NO: 678570 - protein, 9 aa, Homo Sapiens
CFPWCRRSG

SEQ ID NO: 678571 - protein, 9 aa, Homo Sapiens
EEANPFSFT

SEQ ID NO: 678572 - protein, 9 aa, Homo Sapiens
QNVERGYRM

SEQ ID NO: 678573 - protein, 9 aa, Homo Sapiens
CPIYKKPVG

SEQ ID NO: 678574 - protein, 9 aa, Homo Sapiens
LAGGDGGKS

SEQ ID NO: 678575 - protein, 9 aa, Homo Sapiens
TLCQFYNQV

SEQ ID NO: 678576 - protein, 9 aa, Homo Sapiens
SPVSGKVRS

SEQ ID NO: 678577 - protein, 9 aa, Homo Sapiens
EPLNKDNIE

SEQ ID NO: 678578 - protein, 9 aa, Homo Sapiens
LEGNCAKGL

SEQ ID NO: 678579 - protein, 9 aa, Homo Sapiens
IHVHIHQES

SEQ ID NO: 678580 - protein, 9 aa, Homo Sapiens
LLLAILLVI

SEQ ID NO: 678581 - protein, 9 aa, Homo Sapiens
LLAHQCTAL

SEQ ID NO: 678582 - protein, 9 aa, Homo Sapiens
NPGQPGLQE

SEQ ID NO: 678583 - protein, 9 aa, Homo Sapiens
QHTHIHVHI

SEQ ID NO: 678584 - protein, 9 aa, Homo Sapiens
NTVMWLIEK

SEQ ID NO: 678585 - protein, 9 aa, Homo Sapiens
PEVIQNVER

SEQ ID NO: 678586 - protein, 9 aa, Homo Sapiens
ALDTELSGR

SEQ ID NO: 678587 - protein, 9 aa, Homo Sapiens
YMAALDTEL

SEQ ID NO: 678588 - protein, 9 aa, Homo Sapiens
HTHIHVHIH

SEQ ID NO: 678589 - protein, 9 aa, Homo Sapiens
TICHPLRYN

SEQ ID NO: 678590 - protein, 9 aa, Homo Sapiens
QAGTPPPAP

SEQ ID NO: 678591 - protein, 9 aa, Homo Sapiens
TSLTIVHLG

SEQ ID NO: 678592 - protein, 9 aa, Homo Sapiens
EQIRAYCQT

SEQ ID NO: 678593 - protein, 9 aa, Homo Sapiens
QELKERESR

SEQ ID NO: 678594 - protein, 9 aa, Homo Sapiens
FNNMTLVSK

SEQ ID NO: 678595 - protein, 9 aa, Homo Sapiens
SLRKALEAE

SEQ ID NO: 678596 - protein, 9 aa, Homo Sapiens
IVHLGAKGT

SEQ ID NO: 678597 - protein, 9 aa, Homo Sapiens
NCYEALVIY

SEQ ID NO: 678598 - protein, 9 aa, Homo Sapiens
NTGRRREQR

SEQ ID NO: 678599 - protein, 9 aa, Homo Sapiens
LQQNHLLNN

SEQ ID NO: 678600 - protein, 9 aa, Homo Sapiens
DEDAMPVIG

SEQ ID NO: 678601 - protein, 9 aa, Homo Sapiens
TQIDSPVSG

SEQ ID NO: 678602 - protein, 9 aa, Homo Sapiens
RTQIDSPVS

SEQ ID NO: 678603 - protein, 9 aa, Homo Sapiens
DPLIIESKK

SEQ ID NO: 678604 - protein, 9 aa, Homo Sapiens
HVHIHQESA

SEQ ID NO: 678605 - protein, 9 aa, Homo Sapiens
QELESALRE

SEQ ID NO: 678606 - protein, 9 aa, Homo Sapiens
PACRYHYFP

SEQ ID NO: 678607 - protein, 9 aa, Homo Sapiens
LLGMLRGIG

SEQ ID NO: 678608 - protein, 9 aa, Homo Sapiens
SEHKTLLLA

SEQ ID NO: 678609 - protein, 9 aa, Homo Sapiens
SAIYHKVRH

SEQ ID NO: 678610 - protein, 9 aa, Homo Sapiens
PSSRSPSLN

SEQ ID NO: 678611 - protein, 9 aa, Homo Sapiens
SRSLIKNRR

SEQ ID NO: 678612 - protein, 9 aa, Homo Sapiens
YNTISYWKI

SEQ ID NO: 678613 - protein, 9 aa, Homo Sapiens
KDNIEELKK

SEQ ID NO: 678614 - protein, 9 aa, Homo Sapiens
GPEANRSSR

SEQ ID NO: 678615 - protein, 9 aa, Homo Sapiens
QEQLNVENR

SEQ ID NO: 678616 - protein, 9 aa, Homo Sapiens
LHVPNIHWL

SEQ ID NO: 678617 - protein, 9 aa, Homo Sapiens
HLFKLNQDL

SEQ ID NO: 678618 - protein, 9 aa, Homo Sapiens
QLLGMLRGI

SEQ ID NO: 678619 - protein, 9 aa, Homo Sapiens
AYCQTCWEW

SEQ ID NO: 678620 - protein, 9 aa, Homo Sapiens
NNMTLVSKL

SEQ ID NO: 678621 - protein, 9 aa, Homo Sapiens
TDQNFLLAK

SEQ ID NO: 678622 - protein, 9 aa, Homo Sapiens
QSFLSEHKT

SEQ ID NO: 678623 - protein, 9 aa, Homo Sapiens
QGEPLNKDN

SEQ ID NO: 678624 - protein, 9 aa, Homo Sapiens
CQTRAIKIL

SEQ ID NO: 678625 - protein, 9 aa, Homo Sapiens
AMPVIGPET

SEQ ID NO: 678626 - protein, 9 aa, Homo Sapiens
IQNKLSLNL

SEQ ID NO: 678627 - protein, 9 aa, Homo Sapiens
PLIIESKKA

SEQ ID NO: 678628 - protein, 9 aa, Homo Sapiens
LHSPWLTNS

SEQ ID NO: 678629 - protein, 9 aa, Homo Sapiens
GRRREQRWQ

SEQ ID NO: 678630 - protein, 9 aa, Homo Sapiens
PVTIVDVPA

SEQ ID NO: 678631 - protein, 9 aa, Homo Sapiens
ADSTQQPLS

SEQ ID NO: 678632 - protein, 9 aa, Homo Sapiens
LAAEAAAAQ

SEQ ID NO: 678633 - protein, 9 aa, Homo Sapiens
CQNPGQPGL

SEQ ID NO: 678634 - protein, 9 aa, Homo Sapiens
TCLGAQPVN

SEQ ID NO: 678635 - protein, 9 aa, Homo Sapiens
GTLIGSPYR

SEQ ID NO: 678636 - protein, 9 aa, Homo Sapiens
SQIVKCSVS

SEQ ID NO: 678637 - protein, 9 aa, Homo Sapiens
HVCFAKNPD

SEQ ID NO: 678638 - protein, 9 aa, Homo Sapiens
TLMREFWVI

SEQ ID NO: 678639 - protein, 9 aa, Homo Sapiens
ETEHHCSGL

SEQ ID NO: 678640 - protein, 9 aa, Homo Sapiens
VSAYTFELL

SEQ ID NO: 678641 - protein, 9 aa, Homo Sapiens
VTLPEKTPG

SEQ ID NO: 678642 - protein, 9 aa, Homo Sapiens
IPESLAAEA

SEQ ID NO: 678643 - protein, 9 aa, Homo Sapiens
GKLDIEFVK

SEQ ID NO: 678644 - protein, 9 aa, Homo Sapiens
PWLTNSAMR

SEQ ID NO: 678645 - protein, 9 aa, Homo Sapiens
CYIVICHPL

SEQ ID NO: 678646 - protein, 9 aa, Homo Sapiens
EVRPLLKAI

SEQ ID NO: 678647 - protein, 9 aa, Homo Sapiens
PMGMESGRI

SEQ ID NO: 678648 - protein, 9 aa, Homo Sapiens
YHKVRHRMN

SEQ ID NO: 678649 - protein, 9 aa, Homo Sapiens
PWCRRSGKS

SEQ ID NO: 678650 - protein, 9 aa, Homo Sapiens
TEFLKTKNL

SEQ ID NO: 678651 - protein, 9 aa, Homo Sapiens
KMFSAEYQF

SEQ ID NO: 678652 - protein, 9 aa, Homo Sapiens
SSCTPKTSP

SEQ ID NO: 678653 - protein, 9 aa, Homo Sapiens
SAGADSTQQ

SEQ ID NO: 678654 - protein, 9 aa, Homo Sapiens
VMWLIEKRA

SEQ ID NO: 678655 - protein, 9 aa, Homo Sapiens
CSQIVKCSV

SEQ ID NO: 678656 - protein, 9 aa, Homo Sapiens
MAALDTELS

SEQ ID NO: 678657 - protein, 9 aa, Homo Sapiens
TLIGSPYRD

SEQ ID NO: 678658 - protein, 9 aa, Homo Sapiens
NVENRQIME

SEQ ID NO: 678659 - protein, 9 aa, Homo Sapiens
EAPQHTHIH

SEQ ID NO: 678660 - protein, 9 aa, Homo Sapiens
WAKSTGYYP

SEQ ID NO: 678661 - protein, 9 aa, Homo Sapiens
YEYLGCTST

SEQ ID NO: 678662 - protein, 9 aa, Homo Sapiens
KQVLSMEKN

SEQ ID NO: 678663 - protein, 9 aa, Homo Sapiens
HQGWEPRAV

SEQ ID NO: 678664 - protein, 9 aa, Homo Sapiens
HNKLEVAEL

SEQ ID NO: 678665 - protein, 9 aa, Homo Sapiens
TSLRSTTLQ

SEQ ID NO: 678666 - protein, 9 aa, Homo Sapiens
IKNRRISGC

SEQ ID NO: 678667 - protein, 9 aa, Homo Sapiens
TMPEQTFMG

SEQ ID NO: 678668 - protein, 9 aa, Homo Sapiens
TRAIKILMK

SEQ ID NO: 678669 - protein, 9 aa, Homo Sapiens
MREFWVINT

SEQ ID NO: 678670 - protein, 9 aa, Homo Sapiens
STIRERFPK

SEQ ID NO: 678671 - protein, 9 aa, Homo Sapiens
VPMGMESGR

SEQ ID NO: 678672 - protein, 9 aa, Homo Sapiens
PIPESLAAE

SEQ ID NO: 678673 - protein, 9 aa, Homo Sapiens
PAMAFRWWQ

SEQ ID NO: 678674 - protein, 9 aa, Homo Sapiens
PQDAKTPAM

SEQ ID NO: 678675 - protein, 9 aa, Homo Sapiens
LGAQPVNDL

SEQ ID NO: 678676 - protein, 9 aa, Homo Sapiens
NRQIMEECE

SEQ ID NO: 678677 - protein, 9 aa, Homo Sapiens
MQVGSSSCT

SEQ ID NO: 678678 - protein, 9 aa, Homo Sapiens
NTLLHVPNI

SEQ ID NO: 678679 - protein, 9 aa, Homo Sapiens
EKKFRQIYS

SEQ ID NO: 678680 - protein, 9 aa, Homo Sapiens
REQRWQAAP

SEQ ID NO: 678681 - protein, 9 aa, Homo Sapiens
VGSSSCTPK

SEQ ID NO: 678682 - protein, 9 aa, Homo Sapiens
VLHSPWLTN

SEQ ID NO: 678683 - protein, 9 aa, Homo Sapiens
KDPVTIVDV

SEQ ID NO: 678684 - protein, 9 aa, Homo Sapiens
VLSNDISTL

SEQ ID NO: 678685 - protein, 9 aa, Homo Sapiens
QNKLSLNLS

SEQ ID NO: 678686 - protein, 9 aa, Homo Sapiens
VPNGPEANR

SEQ ID NO: 678687 - protein, 9 aa, Homo Sapiens
VGTDLNYIA

SEQ ID NO: 678688 - protein, 9 aa, Homo Sapiens
KNKDPVTIV

SEQ ID NO: 678689 - protein, 9 aa, Homo Sapiens
EANPFSFTE

SEQ ID NO: 678690 - protein, 9 aa, Homo Sapiens
NTYENNYLI

SEQ ID NO: 678691 - protein, 9 aa, Homo Sapiens
IQDIPAVTN

SEQ ID NO: 678692 - protein, 9 aa, Homo Sapiens
RDQSTYIST

SEQ ID NO: 678693 - protein, 9 aa, Homo Sapiens
MFNLPDQAT

SEQ ID NO: 678694 - protein, 9 aa, Homo Sapiens
GWTHQGWEP

SEQ ID NO: 678695 - protein, 9 aa, Homo Sapiens
HASAMKDPC

SEQ ID NO: 678696 - protein, 9 aa, Homo Sapiens
QTRAIKILM

SEQ ID NO: 678697 - protein, 9 aa, Homo Sapiens
LRSTTLQKE

SEQ ID NO: 678698 - protein, 9 aa, Homo Sapiens
DVAGSGQPS

SEQ ID NO: 678699 - protein, 9 aa, Homo Sapiens
SPDELPLAG

SEQ ID NO: 678700 - protein, 9 aa, Homo Sapiens
FAKNPDTIK

SEQ ID NO: 678701 - protein, 9 aa, Homo Sapiens
YGVGTLIGS

SEQ ID NO: 678702 - protein, 9 aa, Homo Sapiens
LDMVPRAAE

SEQ ID NO: 678703 - protein, 9 aa, Homo Sapiens
EKEGESEAE

SEQ ID NO: 678704 - protein, 9 aa, Homo Sapiens
KEGESEAEP

SEQ ID NO: 678705 - protein, 9 aa, Homo Sapiens
DAPASEKEI

SEQ ID NO: 678706 - protein, 9 aa, Homo Sapiens
TLLHVPNIH

SEQ ID NO: 678707 - protein, 9 aa, Homo Sapiens
EPRAVLHCS

SEQ ID NO: 678708 - protein, 9 aa, Homo Sapiens
STSLTIVHL

SEQ ID NO: 678709 - protein, 9 aa, Homo Sapiens
EANRSSRWP

SEQ ID NO: 678710 - protein, 9 aa, Homo Sapiens
FTEFLKTKN

SEQ ID NO: 678711 - protein, 9 aa, Homo Sapiens
PEANRSSRW

SEQ ID NO: 678712 - protein, 9 aa, Homo Sapiens
MKDPCMQDQ

SEQ ID NO: 678713 - protein, 9 aa, Homo Sapiens
PLRSRKIQK

SEQ ID NO: 678714 - protein, 9 aa, Homo Sapiens
CRMLVFHPS

SEQ ID NO: 678715 - protein, 9 aa, Homo Sapiens
VPDAPKVTL

SEQ ID NO: 678716 - protein, 9 aa, Homo Sapiens
TEKVAEVDC

SEQ ID NO: 678717 - protein, 9 aa, Homo Sapiens
DIPAVTNRG

SEQ ID NO: 678718 - protein, 9 aa, Homo Sapiens
LDIEFVKGY

SEQ ID NO: 678719 - protein, 9 aa, Homo Sapiens
IHWLVVEDA

SEQ ID NO: 678720 - protein, 9 aa, Homo Sapiens
AIKILMKVG

SEQ ID NO: 678721 - protein, 9 aa, Homo Sapiens
KTMSAIYHK

SEQ ID NO: 678722 - protein, 9 aa, Homo Sapiens
HSVVVPCEP

SEQ ID NO: 678723 - protein, 9 aa, Homo Sapiens
CQTCWEWQE

SEQ ID NO: 678724 - protein, 9 aa, Homo Sapiens
STGYYPVKL

SEQ ID NO: 678725 - protein, 9 aa, Homo Sapiens
KRSPSATVC

SEQ ID NO: 678726 - protein, 9 aa, Homo Sapiens
VRNCYEALV

SEQ ID NO: 678727 - protein, 9 aa, Homo Sapiens
LILNVCCSS

SEQ ID NO: 678728 - protein, 9 aa, Homo Sapiens
QSQSQADEQ

SEQ ID NO: 678729 - protein, 9 aa, Homo Sapiens
NRNSDNMEL

SEQ ID NO: 678730 - protein, 9 aa, Homo Sapiens
EESAGADST

SEQ ID NO: 678731 - protein, 9 aa, Homo Sapiens
RSRSLIKNR

SEQ ID NO: 678732 - protein, 9 aa, Homo Sapiens
QVLSMEKNL

SEQ ID NO: 678733 - protein, 9 aa, Homo Sapiens
CFAKNPDTI

SEQ ID NO: 678734 - protein, 9 aa, Homo Sapiens
ELTMPEQTF

SEQ ID NO: 678735 - protein, 9 aa, Homo Sapiens
KKFRQIYSL

SEQ ID NO: 678736 - protein, 9 aa, Homo Sapiens
LKERESRLK

SEQ ID NO: 678737 - protein, 9 aa, Homo Sapiens
MKLKQRVLL

SEQ ID NO: 678738 - protein, 9 aa, Homo Sapiens
VPCEPPEVG

SEQ ID NO: 678739 - protein, 9 aa, Homo Sapiens
ESRLKMWEQ

SEQ ID NO: 678740 - protein, 9 aa, Homo Sapiens
QNHLLNNRL

SEQ ID NO: 678741 - protein, 9 aa, Homo Sapiens
PCEPPEVGS

SEQ ID NO: 678742 - protein, 9 aa, Homo Sapiens
SAVNSTDFN

SEQ ID NO: 678743 - protein, 9 aa, Homo Sapiens
DNMELYNIS

SEQ ID NO: 678744 - protein, 9 aa, Homo Sapiens
ESLAAEAAA

SEQ ID NO: 678745 - protein, 9 aa, Homo Sapiens
GHGHFKLQN

SEQ ID NO: 678746 - protein, 9 aa, Homo Sapiens
LKYPSIIVN

SEQ ID NO: 678747 - protein, 9 aa, Homo Sapiens
SFTEFLKTK

SEQ ID NO: 678748 - protein, 9 aa, Homo Sapiens
RKALEAESA

SEQ ID NO: 678749 - protein, 9 aa, Homo Sapiens
LSNTVMWLI

SEQ ID NO: 678750 - protein, 9 aa, Homo Sapiens
LRDMEDSNR

SEQ ID NO: 678751 - protein, 9 aa, Homo Sapiens
YYPVKLFTK

SEQ ID NO: 678752 - protein, 9 aa, Homo Sapiens
GQPGLQEAQ

SEQ ID NO: 678753 - protein, 9 aa, Homo Sapiens
ISAVNSTDF

SEQ ID NO: 678754 - protein, 9 aa, Homo Sapiens
PLLKAIETK

SEQ ID NO: 678755 - protein, 9 aa, Homo Sapiens
RSGKSNVGT

SEQ ID NO: 678756 - protein, 9 aa, Homo Sapiens
HEQELESAL

SEQ ID NO: 678757 - protein, 9 aa, Homo Sapiens
HPSKRISAK

SEQ ID NO: 678758 - protein, 9 aa, Homo Sapiens
IQLLGMLRG

SEQ ID NO: 678759 - protein, 9 aa, Homo Sapiens
DEQAGTPPP

SEQ ID NO: 678760 - protein, 9 aa, Homo Sapiens
AKGADEAAP

SEQ ID NO: 678761 - protein, 9 aa, Homo Sapiens
LLNNRLDLP

SEQ ID NO: 678762 - protein, 9 aa, Homo Sapiens
APKVTLPEK

SEQ ID NO: 678763 - protein, 9 aa, Homo Sapiens
TLQKEVPVI

SEQ ID NO: 678764 - protein, 9 aa, Homo Sapiens
KPVGTDLNY

SEQ ID NO: 678765 - protein, 9 aa, Homo Sapiens
EDNHNKLEV

SEQ ID NO: 678766 - protein, 9 aa, Homo Sapiens
AIETKVNET

SEQ ID NO: 678767 - protein, 9 aa, Homo Sapiens
CNVPMGMES

SEQ ID NO: 678768 - protein, 9 aa, Homo Sapiens
FGLGQRETP

SEQ ID NO: 678769 - protein, 9 aa, Homo Sapiens
KSTGYYPVK

SEQ ID NO: 678770 - protein, 9 aa, Homo Sapiens
LIGSPYRDK

SEQ ID NO: 678771 - protein, 9 aa, Homo Sapiens
GVGTLIGSP

SEQ ID NO: 678772 - protein, 9 aa, Homo Sapiens
SYWKIRKGN

SEQ ID NO: 678773 - protein, 9 aa, Homo Sapiens
RAYCQTCWE

SEQ ID NO: 678774 - protein, 9 aa, Homo Sapiens
HRQLQARVS

SEQ ID NO: 678775 - protein, 9 aa, Homo Sapiens
LSVKLLAHQ

SEQ ID NO: 678776 - protein, 9 aa, Homo Sapiens
GCTSTLVIT

SEQ ID NO: 678777 - protein, 9 aa, Homo Sapiens
LQNTYENNY

SEQ ID NO: 678778 - protein, 9 aa, Homo Sapiens
ASQTLPTEK

SEQ ID NO: 678779 - protein, 9 aa, Homo Sapiens
FRWLSLKYP

SEQ ID NO: 678780 - protein, 9 aa, Homo Sapiens
SFLSEHKTL

SEQ ID NO: 678781 - protein, 9 aa, Homo Sapiens
LDIFYIIQN

SEQ ID NO: 678782 - protein, 9 aa, Homo Sapiens
DQSTYISTI

SEQ ID NO: 678783 - protein, 9 aa, Homo Sapiens
FRRAPVYMP

SEQ ID NO: 678784 - protein, 9 aa, Homo Sapiens
SLRSTTLQK

SEQ ID NO: 678785 - protein, 9 aa, Homo Sapiens
CRSHASAMK

SEQ ID NO: 678786 - protein, 9 aa, Homo Sapiens
YIVICHPLR

SEQ ID NO: 678787 - protein, 9 aa, Homo Sapiens
EFWVINTSI

SEQ ID NO: 678788 - protein, 9 aa, Homo Sapiens
NGPEANRSS

SEQ ID NO: 678789 - protein, 9 aa, Homo Sapiens
KNLDFLVNI

SEQ ID NO: 678790 - protein, 9 aa, Homo Sapiens
YMLVGADGS

SEQ ID NO: 678791 - protein, 9 aa, Homo Sapiens
KDCTIVGGM

SEQ ID NO: 678792 - protein, 9 aa, Homo Sapiens
IGDFGLATE

SEQ ID NO: 678793 - protein, 9 aa, Homo Sapiens
QTFHLERED

SEQ ID NO: 678794 - protein, 9 aa, Homo Sapiens
ETPTTDIAT

SEQ ID NO: 678795 - protein, 9 aa, Homo Sapiens
NPAISNILN

SEQ ID NO: 678796 - protein, 9 aa, Homo Sapiens
QKAMRPHPG

SEQ ID NO: 678797 - protein, 9 aa, Homo Sapiens
VITSPGPEA

SEQ ID NO: 678798 - protein, 9 aa, Homo Sapiens
MLVGADGSK

SEQ ID NO: 678799 - protein, 9 aa, Homo Sapiens
ALTHCTANM

SEQ ID NO: 678800 - protein, 9 aa, Homo Sapiens
GSLFEVQWQ

SEQ ID NO: 678801 - protein, 9 aa, Homo Sapiens
TPSETPTTD

SEQ ID NO: 678802 - protein, 9 aa, Homo Sapiens
INACKTMKC

SEQ ID NO: 678803 - protein, 9 aa, Homo Sapiens
LVSPISESM

SEQ ID NO: 678804 - protein, 9 aa, Homo Sapiens
SKVLTKIEE

SEQ ID NO: 678805 - protein, 9 aa, Homo Sapiens
AAMILNKLV

SEQ ID NO: 678806 - protein, 9 aa, Homo Sapiens
NEDGSEAAI

SEQ ID NO: 678807 - protein, 9 aa, Homo Sapiens
MSSLWDRFS

SEQ ID NO: 678808 - protein, 9 aa, Homo Sapiens
PVGVQTFHL

SEQ ID NO: 678809 - protein, 9 aa, Homo Sapiens
EISSSNPAI

SEQ ID NO: 678810 - protein, 9 aa, Homo Sapiens
CKTMKCRSF

SEQ ID NO: 678811 - protein, 9 aa, Homo Sapiens
FRILSGMAL

SEQ ID NO: 678812 - protein, 9 aa, Homo Sapiens
PISESMLER

SEQ ID NO: 678813 - protein, 9 aa, Homo Sapiens
LTKIEELRT

SEQ ID NO: 678814 - protein, 9 aa, Homo Sapiens
LRPLFSSTT

SEQ ID NO: 678815 - protein, 9 aa, Homo Sapiens
CKERGSDVL

SEQ ID NO: 678816 - protein, 9 aa, Homo Sapiens
RPLFSSTTY

SEQ ID NO: 678817 - protein, 9 aa, Homo Sapiens
TPTTDIATK

SEQ ID NO: 678818 - protein, 9 aa, Homo Sapiens
FHLEREDRA

SEQ ID NO: 678819 - protein, 9 aa, Homo Sapiens
LATEKSRWS

SEQ ID NO: 678820 - protein, 9 aa, Homo Sapiens
GEISSSNPA

SEQ ID NO: 678821 - protein, 9 aa, Homo Sapiens
LGLRSKVLT

SEQ ID NO: 678822 - protein, 9 aa, Homo Sapiens
QAAMILNKL

SEQ ID NO: 678823 - protein, 9 aa, Homo Sapiens
EACKERGSD

SEQ ID NO: 678824 - protein, 9 aa, Homo Sapiens
PVVITSPGP

SEQ ID NO: 678825 - protein, 9 aa, Homo Sapiens
AFRILSGMA

SEQ ID NO: 678826 - protein, 9 aa, Homo Sapiens
ATKHVFSVL

SEQ ID NO: 678827 - protein, 9 aa, Homo Sapiens
WQLAQLEAR

SEQ ID NO: 678828 - protein, 9 aa, Homo Sapiens
QWRSEHLDT

SEQ ID NO: 678829 - protein, 9 aa, Homo Sapiens
GDFGLATEK

SEQ ID NO: 678830 - protein, 9 aa, Homo Sapiens
KEKREYMLV

SEQ ID NO: 678831 - protein, 9 aa, Homo Sapiens
DKEKREYML

SEQ ID NO: 678832 - protein, 9 aa, Homo Sapiens
LTHCTANMV

SEQ ID NO: 678833 - protein, 9 aa, Homo Sapiens
VSPISESML

SEQ ID NO: 678834 - protein, 9 aa, Homo Sapiens
DGSEAAIST

SEQ ID NO: 678835 - protein, 9 aa, Homo Sapiens
AMILNKLVT

SEQ ID NO: 678836 - protein, 9 aa, Homo Sapiens
AISTGIHIP

SEQ ID NO: 678837 - protein, 9 aa, Homo Sapiens
LFSSTTYSV

SEQ ID NO: 678838 - protein, 9 aa, Homo Sapiens
IYCAFRILS

SEQ ID NO: 678839 - protein, 9 aa, Homo Sapiens
VFSVLKGQA

SEQ ID NO: 678840 - protein, 9 aa, Homo Sapiens
GDIDDVPAS

SEQ ID NO: 678841 - protein, 9 aa, Homo Sapiens
GYSSQKAMR

SEQ ID NO: 678842 - protein, 9 aa, Homo Sapiens
DDDGDIDDV

SEQ ID NO: 678843 - protein, 9 aa, Homo Sapiens
PSPGYSSQK

SEQ ID NO: 678844 - protein, 9 aa, Homo Sapiens
NACKTMKCR

SEQ ID NO: 678845 - protein, 9 aa, Homo Sapiens
CRSFVYSRG

SEQ ID NO: 678846 - protein, 9 aa, Homo Sapiens
PLGLKDCTI

SEQ ID NO: 678847 - protein, 9 aa, Homo Sapiens
SESMLERLS

SEQ ID NO: 678848 - protein, 9 aa, Homo Sapiens
ALVSPISES

SEQ ID NO: 678849 - protein, 9 aa, Homo Sapiens
QQREQWRSE

SEQ ID NO: 678850 - protein, 9 aa, Homo Sapiens
ESMLERLSK

SEQ ID NO: 678851 - protein, 9 aa, Homo Sapiens
EKSRWSGSH

SEQ ID NO: 678852 - protein, 9 aa, Homo Sapiens
EGSLFEVQW

SEQ ID NO: 678853 - protein, 9 aa, Homo Sapiens
TMKCRSFVY

SEQ ID NO: 678854 - protein, 9 aa, Homo Sapiens
THCTANMVQ

SEQ ID NO: 678855 - protein, 9 aa, Homo Sapiens
QREQWRSEH

SEQ ID NO: 678856 - protein, 9 aa, Homo Sapiens
NKLVTGAAG

SEQ ID NO: 678857 - protein, 9 aa, Homo Sapiens
LGLKDCTIV

SEQ ID NO: 678858 - protein, 9 aa, Homo Sapiens
SPGYSSQKA

SEQ ID NO: 678859 - protein, 9 aa, Homo Sapiens
DTTLPVVIT

SEQ ID NO: 678860 - protein, 9 aa, Homo Sapiens
LRSKVLTKI

SEQ ID NO: 678861 - protein, 9 aa, Homo Sapiens
QATKHVFSV

SEQ ID NO: 678862 - protein, 9 aa, Homo Sapiens
RGSDVLGPR

SEQ ID NO: 678863 - protein, 9 aa, Homo Sapiens
KSDTTLPVV

SEQ ID NO: 678864 - protein, 9 aa, Homo Sapiens
YCAFRILSG

SEQ ID NO: 678865 - protein, 9 aa, Homo Sapiens
QMQQREQWR

SEQ ID NO: 678866 - protein, 9 aa, Homo Sapiens
LNKLVTGAA

SEQ ID NO: 678867 - protein, 9 aa, Homo Sapiens
AALVSPISE

SEQ ID NO: 678868 - protein, 9 aa, Homo Sapiens
TDIATKGPF

SEQ ID NO: 678869 - protein, 9 aa, Homo Sapiens
DPSPGYSSQ

SEQ ID NO: 678870 - protein, 9 aa, Homo Sapiens
GSEAAISTG

SEQ ID NO: 678871 - protein, 9 aa, Homo Sapiens
RALTHCTAN

SEQ ID NO: 678872 - protein, 9 aa, Homo Sapiens
ERGSDVLGP

SEQ ID NO: 678873 - protein, 9 aa, Homo Sapiens
VGVQTFHLE

SEQ ID NO: 678874 - protein, 9 aa, Homo Sapiens
MILNKLVTG

SEQ ID NO: 678875 - protein, 9 aa, Homo Sapiens
VVITSPGPE

SEQ ID NO: 678876 - protein, 9 aa, Homo Sapiens
TDLQATKHV

SEQ ID NO: 678877 - protein, 9 aa, Homo Sapiens
CLVLLPFRA

SEQ ID NO: 678878 - protein, 9 aa, Homo Sapiens
GPVGVQTFH

SEQ ID NO: 678879 - protein, 9 aa, Homo Sapiens
GLATEKSRW

SEQ ID NO: 678880 - protein, 9 aa, Homo Sapiens
VQWQLAQLE

SEQ ID NO: 678881 - protein, 9 aa, Homo Sapiens
DFGLATEKS

SEQ ID NO: 678882 - protein, 9 aa, Homo Sapiens
RSKVLTKIE

SEQ ID NO: 678883 - protein, 9 aa, Homo Sapiens
EDGSEAAIS

SEQ ID NO: 678884 - protein, 9 aa, Homo Sapiens
EDDDDGDID

SEQ ID NO: 678885 - protein, 9 aa, Homo Sapiens
KERGSDVLG

SEQ ID NO: 678886 - protein, 9 aa, Homo Sapiens
KHVFSVLKG

SEQ ID NO: 678887 - protein, 9 aa, Homo Sapiens
DLQATKHVF

SEQ ID NO: 678888 - protein, 9 aa, Homo Sapiens
KPLGLKDCT

SEQ ID NO: 678889 - protein, 9 aa, Homo Sapiens
SSLWDRFSS

SEQ ID NO: 678890 - protein, 9 aa, Homo Sapiens
CAFRILSGM

SEQ ID NO: 678891 - protein, 9 aa, Homo Sapiens
YSSQKAMRP

SEQ ID NO: 678892 - protein, 9 aa, Homo Sapiens
SEAAISTGI

SEQ ID NO: 678893 - protein, 9 aa, Homo Sapiens
FPIYCAFRI

SEQ ID NO: 678894 - protein, 9 aa, Homo Sapiens
SLFEVQWQL

SEQ ID NO: 678895 - protein, 9 aa, Homo Sapiens
PGYSSQKAM

SEQ ID NO: 678896 - protein, 9 aa, Homo Sapiens
FVGEISSSN

SEQ ID NO: 678897 - protein, 9 aa, Homo Sapiens
SETPTTDIA

SEQ ID NO: 678898 - protein, 9 aa, Homo Sapiens
ISESMLERL

SEQ ID NO: 678899 - protein, 9 aa, Homo Sapiens
EKREYMLVG

SEQ ID NO: 678900 - protein, 9 aa, Homo Sapiens
GSDVLGPRL

SEQ ID NO: 678901 - protein, 9 aa, Homo Sapiens
LLPFRAGLT

SEQ ID NO: 678902 - protein, 9 aa, Homo Sapiens
VLLPFRAGL

SEQ ID NO: 678903 - protein, 9 aa, Homo Sapiens
DDVPASRRP

SEQ ID NO: 678904 - protein, 9 aa, Homo Sapiens
ATEKSRWSG

SEQ ID NO: 678905 - protein, 9 aa, Homo Sapiens
TKHVFSVLK

SEQ ID NO: 678906 - protein, 9 aa, Homo Sapiens
MQQREQWRS

SEQ ID NO: 678907 - protein, 9 aa, Homo Sapiens
SQKAMRPHP

SEQ ID NO: 678908 - protein, 9 aa, Homo Sapiens
TIVGGMDMV

SEQ ID NO: 678909 - protein, 9 aa, Homo Sapiens
EYMLVGADG

SEQ ID NO: 678910 - protein, 9 aa, Homo Sapiens
LFEVQWQLA

SEQ ID NO: 678911 - protein, 9 aa, Homo Sapiens
WRSEHLDTQ

SEQ ID NO: 678912 - protein, 9 aa, Homo Sapiens
FSSTTYSVT

SEQ ID NO: 678913 - protein, 9 aa, Homo Sapiens
KLVTGAAGL

SEQ ID NO: 678914 - protein, 9 aa, Homo Sapiens
ACKERGSDV

SEQ ID NO: 678915 - protein, 9 aa, Homo Sapiens
SSTTYSVTI

SEQ ID NO: 678916 - protein, 9 aa, Homo Sapiens
DDGDIDDVP

SEQ ID NO: 678917 - protein, 9 aa, Homo Sapiens
REQWRSEHL

SEQ ID NO: 678918 - protein, 9 aa, Homo Sapiens
DCTIVGGMD

SEQ ID NO: 678919 - protein, 9 aa, Homo Sapiens
DIDDVPASR

SEQ ID NO: 678920 - protein, 9 aa, Homo Sapiens
GVQTFHLER

SEQ ID NO: 678921 - protein, 9 aa, Homo Sapiens
MKCRSFVYS

SEQ ID NO: 678922 - protein, 9 aa, Homo Sapiens
TKIEELRTK

SEQ ID NO: 678923 - protein, 9 aa, Homo Sapiens
LPFRAGLTT

SEQ ID NO: 678924 - protein, 9 aa, Homo Sapiens
PFRAGLTTY

SEQ ID NO: 678925 - protein, 9 aa, Homo Sapiens
HLEREDRAK

SEQ ID NO: 678926 - protein, 9 aa, Homo Sapiens
VLTKIEELR

SEQ ID NO: 678927 - protein, 9 aa, Homo Sapiens
FGLATEKSR

SEQ ID NO: 678928 - protein, 9 aa, Homo Sapiens
SSNPAISNI

SEQ ID NO: 678929 - protein, 9 aa, Homo Sapiens
NDLRPLFSS

SEQ ID NO: 678930 - protein, 9 aa, Homo Sapiens
CCLVLLPFR

SEQ ID NO: 678931 - protein, 9 aa, Homo Sapiens
LKDCTIVGG

SEQ ID NO: 678932 - protein, 9 aa, Homo Sapiens
KQAAMILNK

SEQ ID NO: 678933 - protein, 9 aa, Homo Sapiens
AAISTGIHI

SEQ ID NO: 678934 - protein, 9 aa, Homo Sapiens
PRALTHCTA

SEQ ID NO: 678935 - protein, 9 aa, Homo Sapiens
QPRALTHCT

SEQ ID NO: 678936 - protein, 9 aa, Homo Sapiens
RILSGMALA

SEQ ID NO: 678937 - protein, 9 aa, Homo Sapiens
TLPVVITSP

SEQ ID NO: 678938 - protein, 9 aa, Homo Sapiens
VGEISSSNP

SEQ ID NO: 678939 - protein, 9 aa, Homo Sapiens
KVLTKIEEL

SEQ ID NO: 678940 - protein, 9 aa, Homo Sapiens
ISTGIHIPV

SEQ ID NO: 678941 - protein, 9 aa, Homo Sapiens
FTPSETPTT

SEQ ID NO: 678942 - protein, 9 aa, Homo Sapiens
KTMKCRSFV

SEQ ID NO: 678943 - protein, 9 aa, Homo Sapiens
STTYSVTIA

SEQ ID NO: 678944 - protein, 9 aa, Homo Sapiens
SSQKAMRPH

SEQ ID NO: 678945 - protein, 9 aa, Homo Sapiens
FDKEKREYM

SEQ ID NO: 678946 - protein, 9 aa, Homo Sapiens
VQTFHLERE

SEQ ID NO: 678947 - protein, 9 aa, Homo Sapiens
REYMLVGAD

SEQ ID NO: 678948 - protein, 9 aa, Homo Sapiens
DDDDGDIDD

SEQ ID NO: 678949 - protein, 9 aa, Homo Sapiens
PTTDIATKG

SEQ ID NO: 678950 - protein, 9 aa, Homo Sapiens
TEKSRWSGS

SEQ ID NO: 678951 - protein, 9 aa, Homo Sapiens
LPVVITSPG

SEQ ID NO: 678952 - protein, 9 aa, Homo Sapiens
HVFSVLKGQ

SEQ ID NO: 678953 - protein, 9 aa, Homo Sapiens
ISSSNPAIS

SEQ ID NO: 678954 - protein, 9 aa, Homo Sapiens
SQPRALTHC

SEQ ID NO: 678955 - protein, 9 aa, Homo Sapiens
QWQLAQLEA

SEQ ID NO: 678956 - protein, 9 aa, Homo Sapiens
TTLPVVITS

SEQ ID NO: 678957 - protein, 9 aa, Homo Sapiens
LVLLPFRAG

SEQ ID NO: 678958 - protein, 9 aa, Homo Sapiens
SSSNPAISN

SEQ ID NO: 678959 - protein, 9 aa, Homo Sapiens
IDDVPASRR

SEQ ID NO: 678960 - protein, 9 aa, Homo Sapiens
EAAISTGIH

SEQ ID NO: 678961 - protein, 9 aa, Homo Sapiens
FEVQWQLAQ

SEQ ID NO: 678962 - protein, 9 aa, Homo Sapiens
RSEHLDTQK

SEQ ID NO: 678963 - protein, 9 aa, Homo Sapiens
EVQWQLAQL

SEQ ID NO: 678964 - protein, 9 aa, Homo Sapiens
FSQPRALTH

SEQ ID NO: 678965 - protein, 9 aa, Homo Sapiens
GLRSKVLTK

SEQ ID NO: 678966 - protein, 9 aa, Homo Sapiens
SNPAISNIL

SEQ ID NO: 678967 - protein, 9 aa, Homo Sapiens
TFHLEREDR

SEQ ID NO: 678968 - protein, 9 aa, Homo Sapiens
LQATKHVFS

SEQ ID NO: 678969 - protein, 9 aa, Homo Sapiens
PSETPTTDI

SEQ ID NO: 678970 - protein, 9 aa, Homo Sapiens
KCRSFVYSR

SEQ ID NO: 678971 - protein, 9 aa, Homo Sapiens
DVLGPRLVC

SEQ ID NO: 678972 - protein, 9 aa, Homo Sapiens
SPISESMLE

SEQ ID NO: 678973 - protein, 9 aa, Homo Sapiens
SDTTLPVVI

SEQ ID NO: 678974 - protein, 9 aa, Homo Sapiens
KREYMLVGA

SEQ ID NO: 678975 - protein, 9 aa, Homo Sapiens
GLKDCTIVG

SEQ ID NO: 678976 - protein, 9 aa, Homo Sapiens
ILSGMALAG

SEQ ID NO: 678977 - protein, 9 aa, Homo Sapiens
HCTANMVQE

SEQ ID NO: 678978 - protein, 9 aa, Homo Sapiens
FRAGLTTYL

SEQ ID NO: 678979 - protein, 9 aa, Homo Sapiens
EQWRSEHLD

SEQ ID NO: 678980 - protein, 9 aa, Homo Sapiens
TTDIATKGP

SEQ ID NO: 678981 - protein, 9 aa, Homo Sapiens
RAGLTTYLL

SEQ ID NO: 678982 - protein, 9 aa, Homo Sapiens
DLRPLFSST

SEQ ID NO: 678983 - protein, 9 aa, Homo Sapiens
ACKTMKCRS

SEQ ID NO: 678984 - protein, 9 aa, Homo Sapiens
SDVLGPRLV

SEQ ID NO: 678985 - protein, 9 aa, Homo Sapiens
PIYCAFRIL

SEQ ID NO: 678986 - protein, 9 aa, Homo Sapiens
PLFSSTTYS

SEQ ID NO: 678987 - protein, 9 aa, Homo Sapiens
CTIVGGMDM

SEQ ID NO: 678988 - protein, 9 aa, Homo Sapiens
ILNKLVTGA

SEQ ID NO: 678989 - protein, 9 aa, Homo Sapiens
DGDIDDVPA

SEQ ID NO: 678990 - protein, 9 aa, Homo Sapiens
TSSSTPGTA

SEQ ID NO: 678991 - protein, 9 aa, Homo Sapiens
SNLAGKNCI

SEQ ID NO: 678992 - protein, 9 aa, Homo Sapiens
EERIQARRL

SEQ ID NO: 678993 - protein, 9 aa, Homo Sapiens
CHPPSLQLP

SEQ ID NO: 678994 - protein, 9 aa, Homo Sapiens
TFLSAKSGR

SEQ ID NO: 678995 - protein, 9 aa, Homo Sapiens
VTEKVLFLL

SEQ ID NO: 678996 - protein, 9 aa, Homo Sapiens
LSAQALQEE

SEQ ID NO: 678997 - protein, 9 aa, Homo Sapiens
NRGEYVEVP

SEQ ID NO: 678998 - protein, 9 aa, Homo Sapiens
LHHPNIQTL

SEQ ID NO: 678999 - protein, 9 aa, Homo Sapiens
THYPKPSVT

SEQ ID NO: 679000 - protein, 9 aa, Homo Sapiens
GHPGYLSDT

SEQ ID NO: 679001 - protein, 9 aa, Homo Sapiens
IMGHKSCAQ

SEQ ID NO: 679002 - protein, 9 aa, Homo Sapiens
HSSEVYSVP

SEQ ID NO: 679003 - protein, 9 aa, Homo Sapiens
SSVYPLSED

SEQ ID NO: 679004 - protein, 9 aa, Homo Sapiens
APQAGARKI

SEQ ID NO: 679005 - protein, 9 aa, Homo Sapiens
YGAKILAPH

SEQ ID NO: 679006 - protein, 9 aa, Homo Sapiens
ETGSPTTQE

SEQ ID NO: 679007 - protein, 9 aa, Homo Sapiens
LARLKIRTL

SEQ ID NO: 679008 - protein, 9 aa, Homo Sapiens
SHPVLKLSS

SEQ ID NO: 679009 - protein, 9 aa, Homo Sapiens
LQFMSLHIH

SEQ ID NO: 679010 - protein, 9 aa, Homo Sapiens
ENNSAVVDM

SEQ ID NO: 679011 - protein, 9 aa, Homo Sapiens
LNAGCFLVN

SEQ ID NO: 679012 - protein, 9 aa, Homo Sapiens
IQRCHVPLA

SEQ ID NO: 679013 - protein, 9 aa, Homo Sapiens
VHCQMFPQE

SEQ ID NO: 679014 - protein, 9 aa, Homo Sapiens
LSRRCPRQS

SEQ ID NO: 679015 - protein, 9 aa, Homo Sapiens
FSQTVQTTD

SEQ ID NO: 679016 - protein, 9 aa, Homo Sapiens
NLASVSTVP

SEQ ID NO: 679017 - protein, 9 aa, Homo Sapiens
SFSYADLAD

SEQ ID NO: 679018 - protein, 9 aa, Homo Sapiens
MMYLGVGIV

SEQ ID NO: 679019 - protein, 9 aa, Homo Sapiens
EPVPLERDI

SEQ ID NO: 679020 - protein, 9 aa, Homo Sapiens
ISNVHDDEL

SEQ ID NO: 679021 - protein, 9 aa, Homo Sapiens
EAAEKAERE

SEQ ID NO: 679022 - protein, 9 aa, Homo Sapiens
REWKVHEQK

SEQ ID NO: 679023 - protein, 9 aa, Homo Sapiens
FPWMKWCWS

SEQ ID NO: 679024 - protein, 9 aa, Homo Sapiens
LLWLLGGVF

SEQ ID NO: 679025 - protein, 9 aa, Homo Sapiens
SQTVQTTDS

SEQ ID NO: 679026 - protein, 9 aa, Homo Sapiens
YLGVGIVSV

SEQ ID NO: 679027 - protein, 9 aa, Homo Sapiens
RHRKKDTLV

SEQ ID NO: 679028 - protein, 9 aa, Homo Sapiens
ETYHGGLLS

SEQ ID NO: 679029 - protein, 9 aa, Homo Sapiens
LVGNRCASS

SEQ ID NO: 679030 - protein, 9 aa, Homo Sapiens
EANQFKSTV

SEQ ID NO: 679031 - protein, 9 aa, Homo Sapiens
PPTLVCVGG

SEQ ID NO: 679032 - protein, 9 aa, Homo Sapiens
ITNDSMSFF

SEQ ID NO: 679033 - protein, 9 aa, Homo Sapiens
APPVYLNSD

SEQ ID NO: 679034 - protein, 9 aa, Homo Sapiens
ALLPLVPTD

SEQ ID NO: 679035 - protein, 9 aa, Homo Sapiens
ATSSSTPGT

SEQ ID NO: 679036 - protein, 9 aa, Homo Sapiens
QFYPMNLLR

SEQ ID NO: 679037 - protein, 9 aa, Homo Sapiens
LKDLKDRLE

SEQ ID NO: 679038 - protein, 9 aa, Homo Sapiens
ELRVSCMQS

SEQ ID NO: 679039 - protein, 9 aa, Homo Sapiens
LLVKDKSDI

SEQ ID NO: 679040 - protein, 9 aa, Homo Sapiens
PVPPRGLLR

SEQ ID NO: 679041 - protein, 9 aa, Homo Sapiens
LEVNAIKNE

SEQ ID NO: 679042 - protein, 9 aa, Homo Sapiens
TLADPDFWT

SEQ ID NO: 679043 - protein, 9 aa, Homo Sapiens
ILEHILYFY

SEQ ID NO: 679044 - protein, 9 aa, Homo Sapiens
DIAENENGS

SEQ ID NO: 679045 - protein, 9 aa, Homo Sapiens
AHHTLLRES

SEQ ID NO: 679046 - protein, 9 aa, Homo Sapiens
AASATVSSE

SEQ ID NO: 679047 - protein, 9 aa, Homo Sapiens
KKRKITVDS

SEQ ID NO: 679048 - protein, 9 aa, Homo Sapiens
EGQFYPMNL

SEQ ID NO: 679049 - protein, 9 aa, Homo Sapiens
CHEQGKFIA

SEQ ID NO: 679050 - protein, 9 aa, Homo Sapiens
LSSSRTSTK

SEQ ID NO: 679051 - protein, 9 aa, Homo Sapiens
RILSLITHL

SEQ ID NO: 679052 - protein, 9 aa, Homo Sapiens
IKEYFNVVL

SEQ ID NO: 679053 - protein, 9 aa, Homo Sapiens
CLFLPSFAP

SEQ ID NO: 679054 - protein, 9 aa, Homo Sapiens
VFLHHPNIQ

SEQ ID NO: 679055 - protein, 9 aa, Homo Sapiens
QACRIPNKQ

SEQ ID NO: 679056 - protein, 9 aa, Homo Sapiens
SLSILKPLA

SEQ ID NO: 679057 - protein, 9 aa, Homo Sapiens
FREPGDKKK

SEQ ID NO: 679058 - protein, 9 aa, Homo Sapiens
ERIEFLNES

SEQ ID NO: 679059 - protein, 9 aa, Homo Sapiens
STVDTLRTL

SEQ ID NO: 679060 - protein, 9 aa, Homo Sapiens
HKSCAQLAA

SEQ ID NO: 679061 - protein, 9 aa, Homo Sapiens
LDRESWVTE

SEQ ID NO: 679062 - protein, 9 aa, Homo Sapiens
EAAASGSVL

SEQ ID NO: 679063 - protein, 9 aa, Homo Sapiens
EEGGKNGEA

SEQ ID NO: 679064 - protein, 9 aa, Homo Sapiens
AESKAAELR

SEQ ID NO: 679065 - protein, 9 aa, Homo Sapiens
RDDNPRRFR

SEQ ID NO: 679066 - protein, 9 aa, Homo Sapiens
LHIHEENRS

SEQ ID NO: 679067 - protein, 9 aa, Homo Sapiens
RTLADPDFW

SEQ ID NO: 679068 - protein, 9 aa, Homo Sapiens
GPSNPKRAK

SEQ ID NO: 679069 - protein, 9 aa, Homo Sapiens
IPNKQLFSL

SEQ ID NO: 679070 - protein, 9 aa, Homo Sapiens
VALPEALLL

SEQ ID NO: 679071 - protein, 9 aa, Homo Sapiens
GLLSLSILK

SEQ ID NO: 679072 - protein, 9 aa, Homo Sapiens
TWSFLDAFY

SEQ ID NO: 679073 - protein, 9 aa, Homo Sapiens
TRFPKWNVC

SEQ ID NO: 679074 - protein, 9 aa, Homo Sapiens
VSHPVLKLS

SEQ ID NO: 679075 - protein, 9 aa, Homo Sapiens
KSGRQLVPG

SEQ ID NO: 679076 - protein, 9 aa, Homo Sapiens
CIQRCHVPL

SEQ ID NO: 679077 - protein, 9 aa, Homo Sapiens
GDTFGEDWH

SEQ ID NO: 679078 - protein, 9 aa, Homo Sapiens
ICHPWRHRG

SEQ ID NO: 679079 - protein, 9 aa, Homo Sapiens
ATGSQPEVI

SEQ ID NO: 679080 - protein, 9 aa, Homo Sapiens
CTLFIIDEK

SEQ ID NO: 679081 - protein, 9 aa, Homo Sapiens
ILSFFAPQA

SEQ ID NO: 679082 - protein, 9 aa, Homo Sapiens
PLGQVNTSL

SEQ ID NO: 679083 - protein, 9 aa, Homo Sapiens
VVDMKTCSI

SEQ ID NO: 679084 - protein, 9 aa, Homo Sapiens
AMPGNTHRE

SEQ ID NO: 679085 - protein, 9 aa, Homo Sapiens
KENERLRSE

SEQ ID NO: 679086 - protein, 9 aa, Homo Sapiens
GQGGRLLRT

SEQ ID NO: 679087 - protein, 9 aa, Homo Sapiens
ENERLRSEL

SEQ ID NO: 679088 - protein, 9 aa, Homo Sapiens
LDGPSNPKR

SEQ ID NO: 679089 - protein, 9 aa, Homo Sapiens
GVGIVSVPL

SEQ ID NO: 679090 - protein, 9 aa, Homo Sapiens
EEPPIPVEI

SEQ ID NO: 679091 - protein, 9 aa, Homo Sapiens
QVKEVKRMH

SEQ ID NO: 679092 - protein, 9 aa, Homo Sapiens
PWPLFDLME

SEQ ID NO: 679093 - protein, 9 aa, Homo Sapiens
GGGDNATCC

SEQ ID NO: 679094 - protein, 9 aa, Homo Sapiens
SYADLADGV

SEQ ID NO: 679095 - protein, 9 aa, Homo Sapiens
SARSPLGQV

SEQ ID NO: 679096 - protein, 9 aa, Homo Sapiens
REAAEKAER

SEQ ID NO: 679097 - protein, 9 aa, Homo Sapiens
ELEFLERTV

SEQ ID NO: 679098 - protein, 9 aa, Homo Sapiens
SRAPEDEEK

SEQ ID NO: 679099 - protein, 9 aa, Homo Sapiens
SHVSCNFLN

SEQ ID NO: 679100 - protein, 9 aa, Homo Sapiens
INGQSKPNK

SEQ ID NO: 679101 - protein, 9 aa, Homo Sapiens
GPGAGQQHA

SEQ ID NO: 679102 - protein, 9 aa, Homo Sapiens
LIAAGRTIR

SEQ ID NO: 679103 - protein, 9 aa, Homo Sapiens
TFREPGDKK

SEQ ID NO: 679104 - protein, 9 aa, Homo Sapiens
VIHHRIHTG

SEQ ID NO: 679105 - protein, 9 aa, Homo Sapiens
IRNSATVNW

SEQ ID NO: 679106 - protein, 9 aa, Homo Sapiens
HPLLRLFSL

SEQ ID NO: 679107 - protein, 9 aa, Homo Sapiens
TVLFARKGA

SEQ ID NO: 679108 - protein, 9 aa, Homo Sapiens
LWLDAHRSC

SEQ ID NO: 679109 - protein, 9 aa, Homo Sapiens
ELHGRMISI

SEQ ID NO: 679110 - protein, 9 aa, Homo Sapiens
IMAVKEDQF

SEQ ID NO: 679111 - protein, 9 aa, Homo Sapiens
SATVNWRPE

SEQ ID NO: 679112 - protein, 9 aa, Homo Sapiens
LQSNSAQIA

SEQ ID NO: 679113 - protein, 9 aa, Homo Sapiens
DRMLASRAP

SEQ ID NO: 679114 - protein, 9 aa, Homo Sapiens
VARVRRNEA

SEQ ID NO: 679115 - protein, 9 aa, Homo Sapiens
PRRRRTLAD

SEQ ID NO: 679116 - protein, 9 aa, Homo Sapiens
SWQVTFLGT

SEQ ID NO: 679117 - protein, 9 aa, Homo Sapiens
LAYCYETHV

SEQ ID NO: 679118 - protein, 9 aa, Homo Sapiens
YITTLISEC

SEQ ID NO: 679119 - protein, 9 aa, Homo Sapiens
DLITNDSMS

SEQ ID NO: 679120 - protein, 9 aa, Homo Sapiens
MDLNAGCFL

SEQ ID NO: 679121 - protein, 9 aa, Homo Sapiens
LYFYRILSL

SEQ ID NO: 679122 - protein, 9 aa, Homo Sapiens
REGGGLGGG

SEQ ID NO: 679123 - protein, 9 aa, Homo Sapiens
VEHDFVEMR

SEQ ID NO: 679124 - protein, 9 aa, Homo Sapiens
INPSAASAT

SEQ ID NO: 679125 - protein, 9 aa, Homo Sapiens
VEVPFPNQY

SEQ ID NO: 679126 - protein, 9 aa, Homo Sapiens
ITDHGVEYF

SEQ ID NO: 679127 - protein, 9 aa, Homo Sapiens
GVTPVSSFP

SEQ ID NO: 679128 - protein, 9 aa, Homo Sapiens
HVTEGEKNV

SEQ ID NO: 679129 - protein, 9 aa, Homo Sapiens
DRFLEYSGL

SEQ ID NO: 679130 - protein, 9 aa, Homo Sapiens
PDRMLASRA

SEQ ID NO: 679131 - protein, 9 aa, Homo Sapiens
QIPDSKGNP

SEQ ID NO: 679132 - protein, 9 aa, Homo Sapiens
AAAEQGVLR

SEQ ID NO: 679133 - protein, 9 aa, Homo Sapiens
VEVLCSGSR

SEQ ID NO: 679134 - protein, 9 aa, Homo Sapiens
EEIDHQDLV

SEQ ID NO: 679135 - protein, 9 aa, Homo Sapiens
DHGVEYFAK

SEQ ID NO: 679136 - protein, 9 aa, Homo Sapiens
TATAPSLSG

SEQ ID NO: 679137 - protein, 9 aa, Homo Sapiens
NERLRSELK

SEQ ID NO: 679138 - protein, 9 aa, Homo Sapiens
IIYINGQSK

SEQ ID NO: 679139 - protein, 9 aa, Homo Sapiens
IYLQDKFRI

SEQ ID NO: 679140 - protein, 9 aa, Homo Sapiens
EMDLNAGCF

SEQ ID NO: 679141 - protein, 9 aa, Homo Sapiens
KNGEAEEEV

SEQ ID NO: 679142 - protein, 9 aa, Homo Sapiens
PRRFRPHRS

SEQ ID NO: 679143 - protein, 9 aa, Homo Sapiens
GRLLRTGRY

SEQ ID NO: 679144 - protein, 9 aa, Homo Sapiens
ARSPLGQVN

SEQ ID NO: 679145 - protein, 9 aa, Homo Sapiens
RRRTLADPD

SEQ ID NO: 679146 - protein, 9 aa, Homo Sapiens
LCSGSRHTV

SEQ ID NO: 679147 - protein, 9 aa, Homo Sapiens
YFAKNCTKL

SEQ ID NO: 679148 - protein, 9 aa, Homo Sapiens
LEEAQLLDL

SEQ ID NO: 679149 - protein, 9 aa, Homo Sapiens
TPLPTSLQH

SEQ ID NO: 679150 - protein, 9 aa, Homo Sapiens
KTNADIAGR

SEQ ID NO: 679151 - protein, 9 aa, Homo Sapiens
EKAEREHQE

SEQ ID NO: 679152 - protein, 9 aa, Homo Sapiens
IGYDVTDIS

SEQ ID NO: 679153 - protein, 9 aa, Homo Sapiens
SGVTPVSSF

SEQ ID NO: 679154 - protein, 9 aa, Homo Sapiens
PTPSPPIFS

SEQ ID NO: 679155 - protein, 9 aa, Homo Sapiens
TVSIEITPT

SEQ ID NO: 679156 - protein, 9 aa, Homo Sapiens
FGYRSGGMC

SEQ ID NO: 679157 - protein, 9 aa, Homo Sapiens
YQSRLKDLK

SEQ ID NO: 679158 - protein, 9 aa, Homo Sapiens
FILVGIIHY

SEQ ID NO: 679159 - protein, 9 aa, Homo Sapiens
FRNEEVKVS

SEQ ID NO: 679160 - protein, 9 aa, Homo Sapiens
YPMNLLRNV

SEQ ID NO: 679161 - protein, 9 aa, Homo Sapiens
TNTYFTGLS

SEQ ID NO: 679162 - protein, 9 aa, Homo Sapiens
RSPLGQVNT

SEQ ID NO: 679163 - protein, 9 aa, Homo Sapiens
ELSIDISNI

SEQ ID NO: 679164 - protein, 9 aa, Homo Sapiens
ARLKIRTLE

SEQ ID NO: 679165 - protein, 9 aa, Homo Sapiens
VPLERDICR

SEQ ID NO: 679166 - protein, 9 aa, Homo Sapiens
ATIGTYINT

SEQ ID NO: 679167 - protein, 9 aa, Homo Sapiens
GAGQQHATP

SEQ ID NO: 679168 - protein, 9 aa, Homo Sapiens
SLLREWKVH

SEQ ID NO: 679169 - protein, 9 aa, Homo Sapiens
IYINGQSKP

SEQ ID NO: 679170 - protein, 9 aa, Homo Sapiens
GILSFFAPQ

SEQ ID NO: 679171 - protein, 9 aa, Homo Sapiens
VFVGMMSIS

SEQ ID NO: 679172 - protein, 9 aa, Homo Sapiens
CRQWLLADA

SEQ ID NO: 679173 - protein, 9 aa, Homo Sapiens
VGVICHPWR

SEQ ID NO: 679174 - protein, 9 aa, Homo Sapiens
LIMGTIEEV

SEQ ID NO: 679175 - protein, 9 aa, Homo Sapiens
LFLFRNEEV

SEQ ID NO: 679176 - protein, 9 aa, Homo Sapiens
TYFTGLSMI

SEQ ID NO: 679177 - protein, 9 aa, Homo Sapiens
LVGELEFLE

SEQ ID NO: 679178 - protein, 9 aa, Homo Sapiens
LYQQDERAK

SEQ ID NO: 679179 - protein, 9 aa, Homo Sapiens
SGPGAGQQH

SEQ ID NO: 679180 - protein, 9 aa, Homo Sapiens
ARVRRNEAQ

SEQ ID NO: 679181 - protein, 9 aa, Homo Sapiens
EIDHQDLVS

SEQ ID NO: 679182 - protein, 9 aa, Homo Sapiens
GDHSKKDQS

SEQ ID NO: 679183 - protein, 9 aa, Homo Sapiens
MNLLRNVAM

SEQ ID NO: 679184 - protein, 9 aa, Homo Sapiens
PPDTITKKS

SEQ ID NO: 679185 - protein, 9 aa, Homo Sapiens
MAVKEDQFS

SEQ ID NO: 679186 - protein, 9 aa, Homo Sapiens
IPALLWLLG

SEQ ID NO: 679187 - protein, 9 aa, Homo Sapiens
FLNESSVMK

SEQ ID NO: 679188 - protein, 9 aa, Homo Sapiens
LLSLSILKP

SEQ ID NO: 679189 - protein, 9 aa, Homo Sapiens
SRTSTKSAK

SEQ ID NO: 679190 - protein, 9 aa, Homo Sapiens
RLNRGEYVE

SEQ ID NO: 679191 - protein, 9 aa, Homo Sapiens
WKVHEQKMI

SEQ ID NO: 679192 - protein, 9 aa, Homo Sapiens
DATIGTYIN

SEQ ID NO: 679193 - protein, 9 aa, Homo Sapiens
FKSTVSRCC

SEQ ID NO: 679194 - protein, 9 aa, Homo Sapiens
LEHTWGSLS

SEQ ID NO: 679195 - protein, 9 aa, Homo Sapiens
HQCIQRCHV

SEQ ID NO: 679196 - protein, 9 aa, Homo Sapiens
VLKLSSPED

SEQ ID NO: 679197 - protein, 9 aa, Homo Sapiens
LPPPAWPHE

SEQ ID NO: 679198 - protein, 9 aa, Homo Sapiens
LQGYITTLI

SEQ ID NO: 679199 - protein, 9 aa, Homo Sapiens
GNTHREITS

SEQ ID NO: 679200 - protein, 9 aa, Homo Sapiens
STVLFARKG

SEQ ID NO: 679201 - protein, 9 aa, Homo Sapiens
QQDERAKAT

SEQ ID NO: 679202 - protein, 9 aa, Homo Sapiens
EVLHACINW

SEQ ID NO: 679203 - protein, 9 aa, Homo Sapiens
GAEQALLPL

SEQ ID NO: 679204 - protein, 9 aa, Homo Sapiens
GGDNATCCA

SEQ ID NO: 679205 - protein, 9 aa, Homo Sapiens
YEMDLNAGC

SEQ ID NO: 679206 - protein, 9 aa, Homo Sapiens
QRQVFFHEI

SEQ ID NO: 679207 - protein, 9 aa, Homo Sapiens
SNPKRAKLS

SEQ ID NO: 679208 - protein, 9 aa, Homo Sapiens
LHPLLRLFS

SEQ ID NO: 679209 - protein, 9 aa, Homo Sapiens
IAENENGSR

SEQ ID NO: 679210 - protein, 9 aa, Homo Sapiens
QPAKSTCHE

SEQ ID NO: 679211 - protein, 9 aa, Homo Sapiens
DVTDISNVH

SEQ ID NO: 679212 - protein, 9 aa, Homo Sapiens
LLEEAQLLD

SEQ ID NO: 679213 - protein, 9 aa, Homo Sapiens
PTLVCVGGG

SEQ ID NO: 679214 - protein, 9 aa, Homo Sapiens
CRDEMAATR

SEQ ID NO: 679215 - protein, 9 aa, Homo Sapiens
GEAAASGSV

SEQ ID NO: 679216 - protein, 9 aa, Homo Sapiens
AIGDHSKKD

SEQ ID NO: 679217 - protein, 9 aa, Homo Sapiens
LKYTLQAKT

SEQ ID NO: 679218 - protein, 9 aa, Homo Sapiens
SRAQNIRNS

SEQ ID NO: 679219 - protein, 9 aa, Homo Sapiens
VIMAVKEDQ

SEQ ID NO: 679220 - protein, 9 aa, Homo Sapiens
SFGYRSGGM

SEQ ID NO: 679221 - protein, 9 aa, Homo Sapiens
YINGQSKPN

SEQ ID NO: 679222 - protein, 9 aa, Homo Sapiens
RFPKWNVCC

SEQ ID NO: 679223 - protein, 9 aa, Homo Sapiens
DWHQTPLRQ

SEQ ID NO: 679224 - protein, 9 aa, Homo Sapiens
ISTLWGNIS

SEQ ID NO: 679225 - protein, 9 aa, Homo Sapiens
MPGNTHREI

SEQ ID NO: 679226 - protein, 9 aa, Homo Sapiens
EMAATRGAL

SEQ ID NO: 679227 - protein, 9 aa, Homo Sapiens
EPPIPVEIC

SEQ ID NO: 679228 - protein, 9 aa, Homo Sapiens
VDFGIATGS

SEQ ID NO: 679229 - protein, 9 aa, Homo Sapiens
DPDINKKER

SEQ ID NO: 679230 - protein, 9 aa, Homo Sapiens
NQFKSTVSR

SEQ ID NO: 679231 - protein, 9 aa, Homo Sapiens
ARCTTSIMH

SEQ ID NO: 679232 - protein, 9 aa, Homo Sapiens
QLLDATIGT

SEQ ID NO: 679233 - protein, 9 aa, Homo Sapiens
EFLERTVVA

SEQ ID NO: 679234 - protein, 9 aa, Homo Sapiens
HLEEGGKNG

SEQ ID NO: 679235 - protein, 9 aa, Homo Sapiens
LNVIFLVIA

SEQ ID NO: 679236 - protein, 9 aa, Homo Sapiens
STVSRCCNA

SEQ ID NO: 679237 - protein, 9 aa, Homo Sapiens
SCNFLNMWK

SEQ ID NO: 679238 - protein, 9 aa, Homo Sapiens
LQAKTFEDK

SEQ ID NO: 679239 - protein, 9 aa, Homo Sapiens
GQQRFTSMT

SEQ ID NO: 679240 - protein, 9 aa, Homo Sapiens
VVFEVHKEL

SEQ ID NO: 679241 - protein, 9 aa, Homo Sapiens
EYFAKNCTK

SEQ ID NO: 679242 - protein, 9 aa, Homo Sapiens
MLNVIFLVI

SEQ ID NO: 679243 - protein, 9 aa, Homo Sapiens
GGGGLHTIN

SEQ ID NO: 679244 - protein, 9 aa, Homo Sapiens
NPSAASATV

SEQ ID NO: 679245 - protein, 9 aa, Homo Sapiens
FYPMNLLRN

SEQ ID NO: 679246 - protein, 9 aa, Homo Sapiens
KCRQWLLAD

SEQ ID NO: 679247 - protein, 9 aa, Homo Sapiens
TSNKDDDNI

SEQ ID NO: 679248 - protein, 9 aa, Homo Sapiens
VCVGGGGGL

SEQ ID NO: 679249 - protein, 9 aa, Homo Sapiens
TITKKSGSH

SEQ ID NO: 679250 - protein, 9 aa, Homo Sapiens
RGQGGRLLR

SEQ ID NO: 679251 - protein, 9 aa, Homo Sapiens
EWKVHEQKM

SEQ ID NO: 679252 - protein, 9 aa, Homo Sapiens
ICSAPWPLF

SEQ ID NO: 679253 - protein, 9 aa, Homo Sapiens
ETPYTHKEY

SEQ ID NO: 679254 - protein, 9 aa, Homo Sapiens
SSVMKEFNC

SEQ ID NO: 679255 - protein, 9 aa, Homo Sapiens
SSILEISFT

SEQ ID NO: 679256 - protein, 9 aa, Homo Sapiens
FLTQKYGWL

SEQ ID NO: 679257 - protein, 9 aa, Homo Sapiens
DGLLETYHG

SEQ ID NO: 679258 - protein, 9 aa, Homo Sapiens
LSLITHLRM

SEQ ID NO: 679259 - protein, 9 aa, Homo Sapiens
SDRFLEYSG

SEQ ID NO: 679260 - protein, 9 aa, Homo Sapiens
VYPLSEDLP

SEQ ID NO: 679261 - protein, 9 aa, Homo Sapiens
KFRILKKKS

SEQ ID NO: 679262 - protein, 9 aa, Homo Sapiens
IATGSQPEV

SEQ ID NO: 679263 - protein, 9 aa, Homo Sapiens
NGPRRSPRP

SEQ ID NO: 679264 - protein, 9 aa, Homo Sapiens
FTGLSMIAN

SEQ ID NO: 679265 - protein, 9 aa, Homo Sapiens
SSRTSTKSA

SEQ ID NO: 679266 - protein, 9 aa, Homo Sapiens
VTPVSSFPI

SEQ ID NO: 679267 - protein, 9 aa, Homo Sapiens
DATFLSAKS

SEQ ID NO: 679268 - protein, 9 aa, Homo Sapiens
THKVEAVAH

SEQ ID NO: 679269 - protein, 9 aa, Homo Sapiens
FAKNCTKLK

SEQ ID NO: 679270 - protein, 9 aa, Homo Sapiens
DTLVQASSH

SEQ ID NO: 679271 - protein, 9 aa, Homo Sapiens
WVTEKVLFL

SEQ ID NO: 679272 - protein, 9 aa, Homo Sapiens
WQLSLMDLL

SEQ ID NO: 679273 - protein, 9 aa, Homo Sapiens
RNEAQAREE

SEQ ID NO: 679274 - protein, 9 aa, Homo Sapiens
CFLVNGQCG

SEQ ID NO: 679275 - protein, 9 aa, Homo Sapiens
HPGYLSDTE

SEQ ID NO: 679276 - protein, 9 aa, Homo Sapiens
TVFLHHPNI

SEQ ID NO: 679277 - protein, 9 aa, Homo Sapiens
LHGRMISIE

SEQ ID NO: 679278 - protein, 9 aa, Homo Sapiens
QKMILEHIL

SEQ ID NO: 679279 - protein, 9 aa, Homo Sapiens
SSVDFGIAT

SEQ ID NO: 679280 - protein, 9 aa, Homo Sapiens
SGSRHTVPR

SEQ ID NO: 679281 - protein, 9 aa, Homo Sapiens
GEPVPLERD

SEQ ID NO: 679282 - protein, 9 aa, Homo Sapiens
TVQTTDSLP

SEQ ID NO: 679283 - protein, 9 aa, Homo Sapiens
VALKVPANL

SEQ ID NO: 679284 - protein, 9 aa, Homo Sapiens
VEEIDHQDL

SEQ ID NO: 679285 - protein, 9 aa, Homo Sapiens
THLRMSSML

SEQ ID NO: 679286 - protein, 9 aa, Homo Sapiens
GTHGRIGLP

SEQ ID NO: 679287 - protein, 9 aa, Homo Sapiens
KSSADFGIA

SEQ ID NO: 679288 - protein, 9 aa, Homo Sapiens
FPQEHPNLL

SEQ ID NO: 679289 - protein, 9 aa, Homo Sapiens
VATSSSTPG

SEQ ID NO: 679290 - protein, 9 aa, Homo Sapiens
GQFYPMNLL

SEQ ID NO: 679291 - protein, 9 aa, Homo Sapiens
MGTIEEVTD

SEQ ID NO: 679292 - protein, 9 aa, Homo Sapiens
CTNTYFTGL

SEQ ID NO: 679293 - protein, 9 aa, Homo Sapiens
VKKIYLQDK

SEQ ID NO: 679294 - protein, 9 aa, Homo Sapiens
TSLQHRSCD

SEQ ID NO: 679295 - protein, 9 aa, Homo Sapiens
SGTNLVALP

SEQ ID NO: 679296 - protein, 9 aa, Homo Sapiens
RTLPSQNVW

SEQ ID NO: 679297 - protein, 9 aa, Homo Sapiens
NVVLGTQLL

SEQ ID NO: 679298 - protein, 9 aa, Homo Sapiens
HPPSLQLPM

SEQ ID NO: 679299 - protein, 9 aa, Homo Sapiens
RPICSAPWP

SEQ ID NO: 679300 - protein, 9 aa, Homo Sapiens
AQPKSSADF

SEQ ID NO: 679301 - protein, 9 aa, Homo Sapiens
YPTHYTGHP

SEQ ID NO: 679302 - protein, 9 aa, Homo Sapiens
MPMYLLLWQ

SEQ ID NO: 679303 - protein, 9 aa, Homo Sapiens
AKSGRQLVP

SEQ ID NO: 679304 - protein, 9 aa, Homo Sapiens
GYRPFPWMK

SEQ ID NO: 679305 - protein, 9 aa, Homo Sapiens
DGACTLFII

SEQ ID NO: 679306 - protein, 9 aa, Homo Sapiens
LAQTHKVEA

SEQ ID NO: 679307 - protein, 9 aa, Homo Sapiens
NLETLCAKK

SEQ ID NO: 679308 - protein, 9 aa, Homo Sapiens
HTWGSLSEQ

SEQ ID NO: 679309 - protein, 9 aa, Homo Sapiens
TTDPDINKK

SEQ ID NO: 679310 - protein, 9 aa, Homo Sapiens
EAGMYQGTL

SEQ ID NO: 679311 - protein, 9 aa, Homo Sapiens
AATVSIEIT

SEQ ID NO: 679312 - protein, 9 aa, Homo Sapiens
RLAREAAEK

SEQ ID NO: 679313 - protein, 9 aa, Homo Sapiens
HPNIQTLSV

SEQ ID NO: 679314 - protein, 9 aa, Homo Sapiens
RLKIRTLEK

SEQ ID NO: 679315 - protein, 9 aa, Homo Sapiens
ERGCPKGCK

SEQ ID NO: 679316 - protein, 9 aa, Homo Sapiens
VPRRRRTLA

SEQ ID NO: 679317 - protein, 9 aa, Homo Sapiens
NASALHPLL

SEQ ID NO: 679318 - protein, 9 aa, Homo Sapiens
QKLPPPAWP

SEQ ID NO: 679319 - protein, 9 aa, Homo Sapiens
VLEKPPKDQ

SEQ ID NO: 679320 - protein, 9 aa, Homo Sapiens
KDLKDRLEQ

SEQ ID NO: 679321 - protein, 9 aa, Homo Sapiens
SDIAENENG

SEQ ID NO: 679322 - protein, 9 aa, Homo Sapiens
KFSIAGSYV

SEQ ID NO: 679323 - protein, 9 aa, Homo Sapiens
SLHIHEENR

SEQ ID NO: 679324 - protein, 9 aa, Homo Sapiens
SGIHSGATA

SEQ ID NO: 679325 - protein, 9 aa, Homo Sapiens
TGSVATSSS

SEQ ID NO: 679326 - protein, 9 aa, Homo Sapiens
SESAGQIDL

SEQ ID NO: 679327 - protein, 9 aa, Homo Sapiens
MYQGTLMSP

SEQ ID NO: 679328 - protein, 9 aa, Homo Sapiens
IPDSKGNPG

SEQ ID NO: 679329 - protein, 9 aa, Homo Sapiens
LSIDISNIK

SEQ ID NO: 679330 - protein, 9 aa, Homo Sapiens
HTAPPVYLN

SEQ ID NO: 679331 - protein, 9 aa, Homo Sapiens
LREFQEEMS

SEQ ID NO: 679332 - protein, 9 aa, Homo Sapiens
VIMGHKSCA

SEQ ID NO: 679333 - protein, 9 aa, Homo Sapiens
SMSFFRTSK

SEQ ID NO: 679334 - protein, 9 aa, Homo Sapiens
ITHLRMSSM

SEQ ID NO: 679335 - protein, 9 aa, Homo Sapiens
EVLCSGSRH

SEQ ID NO: 679336 - protein, 9 aa, Homo Sapiens
EITSFELAQ

SEQ ID NO: 679337 - protein, 9 aa, Homo Sapiens
SALHPLLRL

SEQ ID NO: 679338 - protein, 9 aa, Homo Sapiens
LHLPKFSIA

SEQ ID NO: 679339 - protein, 9 aa, Homo Sapiens
SLVGNRCAS

SEQ ID NO: 679340 - protein, 9 aa, Homo Sapiens
DACLAQIFS

SEQ ID NO: 679341 - protein, 9 aa, Homo Sapiens
IAAIGDHSK

SEQ ID NO: 679342 - protein, 9 aa, Homo Sapiens
ILSGDGACT

SEQ ID NO: 679343 - protein, 9 aa, Homo Sapiens
CSNSDIAEN

SEQ ID NO: 679344 - protein, 9 aa, Homo Sapiens
AETGSPTTQ

SEQ ID NO: 679345 - protein, 9 aa, Homo Sapiens
AEQGVLRDP

SEQ ID NO: 679346 - protein, 9 aa, Homo Sapiens
GQQHATPGA

SEQ ID NO: 679347 - protein, 9 aa, Homo Sapiens
FQEEMSALK

SEQ ID NO: 679348 - protein, 9 aa, Homo Sapiens
HVVLTDFVL

SEQ ID NO: 679349 - protein, 9 aa, Homo Sapiens
SVYPLSEDL

SEQ ID NO: 679350 - protein, 9 aa, Homo Sapiens
DGPSNPKRA

SEQ ID NO: 679351 - protein, 9 aa, Homo Sapiens
PGTHGRIGL

SEQ ID NO: 679352 - protein, 9 aa, Homo Sapiens
VVLGTQLLY

SEQ ID NO: 679353 - protein, 9 aa, Homo Sapiens
LDLEKALVL

SEQ ID NO: 679354 - protein, 9 aa, Homo Sapiens
HVSCNFLNM

SEQ ID NO: 679355 - protein, 9 aa, Homo Sapiens
LPHTAPPVY

SEQ ID NO: 679356 - protein, 9 aa, Homo Sapiens
NARDVAHWL

SEQ ID NO: 679357 - protein, 9 aa, Homo Sapiens
EMYNVIMAV

SEQ ID NO: 679358 - protein, 9 aa, Homo Sapiens
DEITKAVEH

SEQ ID NO: 679359 - protein, 9 aa, Homo Sapiens
FAPQAGARK

SEQ ID NO: 679360 - protein, 9 aa, Homo Sapiens
APEEKIQVK

SEQ ID NO: 679361 - protein, 9 aa, Homo Sapiens
EQGVLRDPC

SEQ ID NO: 679362 - protein, 9 aa, Homo Sapiens
VPSHPLLKT

SEQ ID NO: 679363 - protein, 9 aa, Homo Sapiens
DRRYQSRLK

SEQ ID NO: 679364 - protein, 9 aa, Homo Sapiens
PQAGARKIY

SEQ ID NO: 679365 - protein, 9 aa, Homo Sapiens
EALSAQALQ

SEQ ID NO: 679366 - protein, 9 aa, Homo Sapiens
KVPANLASV

SEQ ID NO: 679367 - protein, 9 aa, Homo Sapiens
VEYFAKNCT

SEQ ID NO: 679368 - protein, 9 aa, Homo Sapiens
QKQLEHTWG

SEQ ID NO: 679369 - protein, 9 aa, Homo Sapiens
QIDLNFKMP

SEQ ID NO: 679370 - protein, 9 aa, Homo Sapiens
ALTSNKDDD

SEQ ID NO: 679371 - protein, 9 aa, Homo Sapiens
TARCTTSIM

SEQ ID NO: 679372 - protein, 9 aa, Homo Sapiens
LLLLPLFPV

SEQ ID NO: 679373 - protein, 9 aa, Homo Sapiens
LDAHRSCRM

SEQ ID NO: 679374 - protein, 9 aa, Homo Sapiens
DRIFAMQSI

SEQ ID NO: 679375 - protein, 9 aa, Homo Sapiens
WPLFDLMER

SEQ ID NO: 679376 - protein, 9 aa, Homo Sapiens
SCSNSDIAE

SEQ ID NO: 679377 - protein, 9 aa, Homo Sapiens
LGQVNTSLE

SEQ ID NO: 679378 - protein, 9 aa, Homo Sapiens
PQKKRKITV

SEQ ID NO: 679379 - protein, 9 aa, Homo Sapiens
LSIWSSQEE

SEQ ID NO: 679380 - protein, 9 aa, Homo Sapiens
TTVQVKEVK

SEQ ID NO: 679381 - protein, 9 aa, Homo Sapiens
DTITKKSGS

SEQ ID NO: 679382 - protein, 9 aa, Homo Sapiens
NSDIAENEN

SEQ ID NO: 679383 - protein, 9 aa, Homo Sapiens
AGEVLKTNA

SEQ ID NO: 679384 - protein, 9 aa, Homo Sapiens
AEQALLPLV

SEQ ID NO: 679385 - protein, 9 aa, Homo Sapiens
NESSVMKEF

SEQ ID NO: 679386 - protein, 9 aa, Homo Sapiens
VSCNFLNMW

SEQ ID NO: 679387 - protein, 9 aa, Homo Sapiens
SILKPLAQT

SEQ ID NO: 679388 - protein, 9 aa, Homo Sapiens
SEVLHACIN

SEQ ID NO: 679389 - protein, 9 aa, Homo Sapiens
AGCFLVNGQ

SEQ ID NO: 679390 - protein, 9 aa, Homo Sapiens
VVLTDFVLC

SEQ ID NO: 679391 - protein, 9 aa, Homo Sapiens
VCCESEMSF

SEQ ID NO: 679392 - protein, 9 aa, Homo Sapiens
FLFRNEEVK

SEQ ID NO: 679393 - protein, 9 aa, Homo Sapiens
ESCSNSDIA

SEQ ID NO: 679394 - protein, 9 aa, Homo Sapiens
IHEENRSVD

SEQ ID NO: 679395 - protein, 9 aa, Homo Sapiens
DIAGQQRFT

SEQ ID NO: 679396 - protein, 9 aa, Homo Sapiens
HRSCRMEPP

SEQ ID NO: 679397 - protein, 9 aa, Homo Sapiens
ILVGIIHYP

SEQ ID NO: 679398 - protein, 9 aa, Homo Sapiens
TKAVEHDFV

SEQ ID NO: 679399 - protein, 9 aa, Homo Sapiens
YQKLPPPAW

SEQ ID NO: 679400 - protein, 9 aa, Homo Sapiens
QEEPPIPVE

SEQ ID NO: 679401 - protein, 9 aa, Homo Sapiens
KLSRRCPRQ

SEQ ID NO: 679402 - protein, 9 aa, Homo Sapiens
SGSFSYADL

SEQ ID NO: 679403 - protein, 9 aa, Homo Sapiens
RAPEDEEKL

SEQ ID NO: 679404 - protein, 9 aa, Homo Sapiens
SLQHRSCDA

SEQ ID NO: 679405 - protein, 9 aa, Homo Sapiens
HPWRHRGYL

SEQ ID NO: 679406 - protein, 9 aa, Homo Sapiens
EESQWPIQM

SEQ ID NO: 679407 - protein, 9 aa, Homo Sapiens
SAVVDMKTC

SEQ ID NO: 679408 - protein, 9 aa, Homo Sapiens
LVPTDEIEA

SEQ ID NO: 679409 - protein, 9 aa, Homo Sapiens
EESTVLFAR

SEQ ID NO: 679410 - protein, 9 aa, Homo Sapiens
MAAAESKAA

SEQ ID NO: 679411 - protein, 9 aa, Homo Sapiens
GRTIRVWDY

SEQ ID NO: 679412 - protein, 9 aa, Homo Sapiens
ACTNTYFTG

SEQ ID NO: 679413 - protein, 9 aa, Homo Sapiens
QLSSSRTST

SEQ ID NO: 679414 - protein, 9 aa, Homo Sapiens
EKEAGMYQG

SEQ ID NO: 679415 - protein, 9 aa, Homo Sapiens
GELEFLERT

SEQ ID NO: 679416 - protein, 9 aa, Homo Sapiens
SSMLTCYDR

SEQ ID NO: 679417 - protein, 9 aa, Homo Sapiens
PKGCKCEGK

SEQ ID NO: 679418 - protein, 9 aa, Homo Sapiens
RDVAHWLGC

SEQ ID NO: 679419 - protein, 9 aa, Homo Sapiens
MILEHILYF

SEQ ID NO: 679420 - protein, 9 aa, Homo Sapiens
LPCHRLICH

SEQ ID NO: 679421 - protein, 9 aa, Homo Sapiens
MNTWLLLLP

SEQ ID NO: 679422 - protein, 9 aa, Homo Sapiens
WLLLLPLFP

SEQ ID NO: 679423 - protein, 9 aa, Homo Sapiens
YFTGLSMIA

SEQ ID NO: 679424 - protein, 9 aa, Homo Sapiens
QPAPSFSQT

SEQ ID NO: 679425 - protein, 9 aa, Homo Sapiens
EMSALKENL

SEQ ID NO: 679426 - protein, 9 aa, Homo Sapiens
TCEKLDELS

SEQ ID NO: 679427 - protein, 9 aa, Homo Sapiens
SSPTPSPPI

SEQ ID NO: 679428 - protein, 9 aa, Homo Sapiens
DELSIDISN

SEQ ID NO: 679429 - protein, 9 aa, Homo Sapiens
GAVYGAKIL

SEQ ID NO: 679430 - protein, 9 aa, Homo Sapiens
KNEAGTKEE

SEQ ID NO: 679431 - protein, 9 aa, Homo Sapiens
ETWSFLDAF

SEQ ID NO: 679432 - protein, 9 aa, Homo Sapiens
QALTSNKDD

SEQ ID NO: 679433 - protein, 9 aa, Homo Sapiens
EICDGSGRA

SEQ ID NO: 679434 - protein, 9 aa, Homo Sapiens
SRHTVPRRY

SEQ ID NO: 679435 - protein, 9 aa, Homo Sapiens
LKTNADIAG

SEQ ID NO: 679436 - protein, 9 aa, Homo Sapiens
DSKGNPGED

SEQ ID NO: 679437 - protein, 9 aa, Homo Sapiens
ATHYPKPSV

SEQ ID NO: 679438 - protein, 9 aa, Homo Sapiens
QGVLRDPCQ

SEQ ID NO: 679439 - protein, 9 aa, Homo Sapiens
QGTLMSPGG

SEQ ID NO: 679440 - protein, 9 aa, Homo Sapiens
RGLLRGPLP

SEQ ID NO: 679441 - protein, 9 aa, Homo Sapiens
ANLASVSTV

SEQ ID NO: 679442 - protein, 9 aa, Homo Sapiens
PKSSADFGI

SEQ ID NO: 679443 - protein, 9 aa, Homo Sapiens
LRSELKDAV

SEQ ID NO: 679444 - protein, 9 aa, Homo Sapiens
CHRLICHPP

SEQ ID NO: 679445 - protein, 9 aa, Homo Sapiens
EREGGGLGG

SEQ ID NO: 679446 - protein, 9 aa, Homo Sapiens
TVDTLRTLP

SEQ ID NO: 679447 - protein, 9 aa, Homo Sapiens
DAHRSCRME

SEQ ID NO: 679448 - protein, 9 aa, Homo Sapiens
AAGSQRELL

SEQ ID NO: 679449 - protein, 9 aa, Homo Sapiens
NLVIHHRIH

SEQ ID NO: 679450 - protein, 9 aa, Homo Sapiens
VIKENERLR

SEQ ID NO: 679451 - protein, 9 aa, Homo Sapiens
AGMYQGTLM

SEQ ID NO: 679452 - protein, 9 aa, Homo Sapiens
DSTKARVLY

SEQ ID NO: 679453 - protein, 9 aa, Homo Sapiens
QRCHVPLAQ

SEQ ID NO: 679454 - protein, 9 aa, Homo Sapiens
QMSRVKSWQ

SEQ ID NO: 679455 - protein, 9 aa, Homo Sapiens
TYINTTHSR

SEQ ID NO: 679456 - protein, 9 aa, Homo Sapiens
FLSAKSGRQ

SEQ ID NO: 679457 - protein, 9 aa, Homo Sapiens
VKDKSDILK

SEQ ID NO: 679458 - protein, 9 aa, Homo Sapiens
IMLNVIFLV

SEQ ID NO: 679459 - protein, 9 aa, Homo Sapiens
VIALYKMFH

SEQ ID NO: 679460 - protein, 9 aa, Homo Sapiens
LFLPSFAPH

SEQ ID NO: 679461 - protein, 9 aa, Homo Sapiens
PICSAPWPL

SEQ ID NO: 679462 - protein, 9 aa, Homo Sapiens
KEVKRMHIS

SEQ ID NO: 679463 - protein, 9 aa, Homo Sapiens
GANGSPGTH

SEQ ID NO: 679464 - protein, 9 aa, Homo Sapiens
TLPSQNVWF

SEQ ID NO: 679465 - protein, 9 aa, Homo Sapiens
NAIKNEAGT

SEQ ID NO: 679466 - protein, 9 aa, Homo Sapiens
DKKKSGKGL

SEQ ID NO: 679467 - protein, 9 aa, Homo Sapiens
VIFAHLEET

SEQ ID NO: 679468 - protein, 9 aa, Homo Sapiens
AHLEETWSF

SEQ ID NO: 679469 - protein, 9 aa, Homo Sapiens
ASATVSSEG

SEQ ID NO: 679470 - protein, 9 aa, Homo Sapiens
AATRGALKK

SEQ ID NO: 679471 - protein, 9 aa, Homo Sapiens
QMFPQEHPN

SEQ ID NO: 679472 - protein, 9 aa, Homo Sapiens
LSSSLSNAR

SEQ ID NO: 679473 - protein, 9 aa, Homo Sapiens
GWLGKIHLI

SEQ ID NO: 679474 - protein, 9 aa, Homo Sapiens
GQIDLNFKM

SEQ ID NO: 679475 - protein, 9 aa, Homo Sapiens
KAEREHQEA

SEQ ID NO: 679476 - protein, 9 aa, Homo Sapiens
VSCMQSKKV

SEQ ID NO: 679477 - protein, 9 aa, Homo Sapiens
SSGSFSYAD

SEQ ID NO: 679478 - protein, 9 aa, Homo Sapiens
NPRRFRPHR

SEQ ID NO: 679479 - protein, 9 aa, Homo Sapiens
ESWVTEKVL

SEQ ID NO: 679480 - protein, 9 aa, Homo Sapiens
AYCYETHVT

SEQ ID NO: 679481 - protein, 9 aa, Homo Sapiens
NSQSRSSPS

SEQ ID NO: 679482 - protein, 9 aa, Homo Sapiens
REFQEEMSA

SEQ ID NO: 679483 - protein, 9 aa, Homo Sapiens
PVPASPQWV

SEQ ID NO: 679484 - protein, 9 aa, Homo Sapiens
ILYFYRILS

SEQ ID NO: 679485 - protein, 9 aa, Homo Sapiens
VCLKYTLQA

SEQ ID NO: 679486 - protein, 9 aa, Homo Sapiens
GYDVTDISN

SEQ ID NO: 679487 - protein, 9 aa, Homo Sapiens
GSTVDTLRT

SEQ ID NO: 679488 - protein, 9 aa, Homo Sapiens
RACGLIMFR

SEQ ID NO: 679489 - protein, 9 aa, Homo Sapiens
RIEFLNESS

SEQ ID NO: 679490 - protein, 9 aa, Homo Sapiens
RNEEVKVSV

SEQ ID NO: 679491 - protein, 9 aa, Homo Sapiens
NVIFLVIAL

SEQ ID NO: 679492 - protein, 9 aa, Homo Sapiens
GSFSYADLA

SEQ ID NO: 679493 - protein, 9 aa, Homo Sapiens
AGQQHATPG

SEQ ID NO: 679494 - protein, 9 aa, Homo Sapiens
EVYSVPSHP

SEQ ID NO: 679495 - protein, 9 aa, Homo Sapiens
RLLRTGRYA

SEQ ID NO: 679496 - protein, 9 aa, Homo Sapiens
SLSGVTPVS

SEQ ID NO: 679497 - protein, 9 aa, Homo Sapiens
MAALGEPVP

SEQ ID NO: 679498 - protein, 9 aa, Homo Sapiens
KPSVTSVVC

SEQ ID NO: 679499 - protein, 9 aa, Homo Sapiens
VHQCIQRCH

SEQ ID NO: 679500 - protein, 9 aa, Homo Sapiens
IVSVPLLCI

SEQ ID NO: 679501 - protein, 9 aa, Homo Sapiens
WTRFPKWNV

SEQ ID NO: 679502 - protein, 9 aa, Homo Sapiens
RVKSWQVTF

SEQ ID NO: 679503 - protein, 9 aa, Homo Sapiens
KPFGDVHRK

SEQ ID NO: 679504 - protein, 9 aa, Homo Sapiens
HDFVEMRKN

SEQ ID NO: 679505 - protein, 9 aa, Homo Sapiens
PSPPIFSLP

SEQ ID NO: 679506 - protein, 9 aa, Homo Sapiens
GYITTLISE

SEQ ID NO: 679507 - protein, 9 aa, Homo Sapiens
HEIIYINGQ

SEQ ID NO: 679508 - protein, 9 aa, Homo Sapiens
VEICDGSGR

SEQ ID NO: 679509 - protein, 9 aa, Homo Sapiens
LETLCAKKG

SEQ ID NO: 679510 - protein, 9 aa, Homo Sapiens
PKPSVTSVV

SEQ ID NO: 679511 - protein, 9 aa, Homo Sapiens
KQVHQCIQR

SEQ ID NO: 679512 - protein, 9 aa, Homo Sapiens
LVALPEALL

SEQ ID NO: 679513 - protein, 9 aa, Homo Sapiens
ARGQGGRLL

SEQ ID NO: 679514 - protein, 9 aa, Homo Sapiens
YNVIMAVKE

SEQ ID NO: 679515 - protein, 9 aa, Homo Sapiens
SFFAPQAGA

SEQ ID NO: 679516 - protein, 9 aa, Homo Sapiens
AVVFEVHKE

SEQ ID NO: 679517 - protein, 9 aa, Homo Sapiens
YRSGGMCGP

SEQ ID NO: 679518 - protein, 9 aa, Homo Sapiens
AGSYVLDQI

SEQ ID NO: 679519 - protein, 9 aa, Homo Sapiens
QRARNGPRR

SEQ ID NO: 679520 - protein, 9 aa, Homo Sapiens
KEGQFYPMN

SEQ ID NO: 679521 - protein, 9 aa, Homo Sapiens
FEVHKELFG

SEQ ID NO: 679522 - protein, 9 aa, Homo Sapiens
LRTGRYAAL

SEQ ID NO: 679523 - protein, 9 aa, Homo Sapiens
DSPNSQSRS

SEQ ID NO: 679524 - protein, 9 aa, Homo Sapiens
NQVLDAYAN

SEQ ID NO: 679525 - protein, 9 aa, Homo Sapiens
IMHNLSHHR

SEQ ID NO: 679526 - protein, 9 aa, Homo Sapiens
SVHSDNSEE

SEQ ID NO: 679527 - protein, 9 aa, Homo Sapiens
PDFQIPDSK

SEQ ID NO: 679528 - protein, 9 aa, Homo Sapiens
TTSIMHNLS

SEQ ID NO: 679529 - protein, 9 aa, Homo Sapiens
NTWLLLLPL

SEQ ID NO: 679530 - protein, 9 aa, Homo Sapiens
EGGKNGEAE

SEQ ID NO: 679531 - protein, 9 aa, Homo Sapiens
VKAGEVLKT

SEQ ID NO: 679532 - protein, 9 aa, Homo Sapiens
MQSKKVQIH

SEQ ID NO: 679533 - protein, 9 aa, Homo Sapiens
RTIRVWDYA

SEQ ID NO: 679534 - protein, 9 aa, Homo Sapiens
IFSDRFLEY

SEQ ID NO: 679535 - protein, 9 aa, Homo Sapiens
GSAAAEQGV

SEQ ID NO: 679536 - protein, 9 aa, Homo Sapiens
HCRDEMAAT

SEQ ID NO: 679537 - protein, 9 aa, Homo Sapiens
IEITPTNSL

SEQ ID NO: 679538 - protein, 9 aa, Homo Sapiens
NLLDGPSNP

SEQ ID NO: 679539 - protein, 9 aa, Homo Sapiens
SRRCPRQSK

SEQ ID NO: 679540 - protein, 9 aa, Homo Sapiens
LPTSLQHRS

SEQ ID NO: 679541 - protein, 9 aa, Homo Sapiens
RKITVDSEI

SEQ ID NO: 679542 - protein, 9 aa, Homo Sapiens
VPANLASVS

SEQ ID NO: 679543 - protein, 9 aa, Homo Sapiens
LRTLPSQNV

SEQ ID NO: 679544 - protein, 9 aa, Homo Sapiens
TIEEVTDSG

SEQ ID NO: 679545 - protein, 9 aa, Homo Sapiens
ALSAQALQE

SEQ ID NO: 679546 - protein, 9 aa, Homo Sapiens
NVRCESEVL

SEQ ID NO: 679547 - protein, 9 aa, Homo Sapiens
LSEDLPYVH

SEQ ID NO: 679548 - protein, 9 aa, Homo Sapiens
TLVQASSHH

SEQ ID NO: 679549 - protein, 9 aa, Homo Sapiens
KTGLSIWSS

SEQ ID NO: 679550 - protein, 9 aa, Homo Sapiens
KILAPHALV

SEQ ID NO: 679551 - protein, 9 aa, Homo Sapiens
ASALHPLLR

SEQ ID NO: 679552 - protein, 9 aa, Homo Sapiens
KTYNIFSDR

SEQ ID NO: 679553 - protein, 9 aa, Homo Sapiens
NMNTWLLLL

SEQ ID NO: 679554 - protein, 9 aa, Homo Sapiens
TNADIAGRP

SEQ ID NO: 679555 - protein, 9 aa, Homo Sapiens
MLASRAPED

SEQ ID NO: 679556 - protein, 9 aa, Homo Sapiens
SSTLIMGTI

SEQ ID NO: 679557 - protein, 9 aa, Homo Sapiens
LVIALYKMF

SEQ ID NO: 679558 - protein, 9 aa, Homo Sapiens
FGDVHRKLK

SEQ ID NO: 679559 - protein, 9 aa, Homo Sapiens
NSAVVDMKT

SEQ ID NO: 679560 - protein, 9 aa, Homo Sapiens
NSEERIQAR

SEQ ID NO: 679561 - protein, 9 aa, Homo Sapiens
QFMSLHIHE

SEQ ID NO: 679562 - protein, 9 aa, Homo Sapiens
TSIMHNLSH

SEQ ID NO: 679563 - protein, 9 aa, Homo Sapiens
TWLLLLPLF

SEQ ID NO: 679564 - protein, 9 aa, Homo Sapiens
DIIQEVEEI

SEQ ID NO: 679565 - protein, 9 aa, Homo Sapiens
LGEPVPLER

SEQ ID NO: 679566 - protein, 9 aa, Homo Sapiens
VRCESEVLH

SEQ ID NO: 679567 - protein, 9 aa, Homo Sapiens
QLQGYITTL

SEQ ID NO: 679568 - protein, 9 aa, Homo Sapiens
FLVIALYKM

SEQ ID NO: 679569 - protein, 9 aa, Homo Sapiens
RLLEEAQLL

SEQ ID NO: 679570 - protein, 9 aa, Homo Sapiens
EDWHQTPLR

SEQ ID NO: 679571 - protein, 9 aa, Homo Sapiens
PGAGQQHAT

SEQ ID NO: 679572 - protein, 9 aa, Homo Sapiens
ILFLFRNEE

SEQ ID NO: 679573 - protein, 9 aa, Homo Sapiens
PSHPLLKTL

SEQ ID NO: 679574 - protein, 9 aa, Homo Sapiens
LVRQEESQW

SEQ ID NO: 679575 - protein, 9 aa, Homo Sapiens
PIDLWLDAH

SEQ ID NO: 679576 - protein, 9 aa, Homo Sapiens
TQKQLEHTW

SEQ ID NO: 679577 - protein, 9 aa, Homo Sapiens
LITNDSMSF

SEQ ID NO: 679578 - protein, 9 aa, Homo Sapiens
WEYQKLPPP

SEQ ID NO: 679579 - protein, 9 aa, Homo Sapiens
LADPDFWTH

SEQ ID NO: 679580 - protein, 9 aa, Homo Sapiens
MAQPKSSAD

SEQ ID NO: 679581 - protein, 9 aa, Homo Sapiens
VFEVHKELF

SEQ ID NO: 679582 - protein, 9 aa, Homo Sapiens
SEERIQARR

SEQ ID NO: 679583 - protein, 9 aa, Homo Sapiens
SSSRTSTKS

SEQ ID NO: 679584 - protein, 9 aa, Homo Sapiens
HYTGHPGYL

SEQ ID NO: 679585 - protein, 9 aa, Homo Sapiens
INKKERKKM

SEQ ID NO: 679586 - protein, 9 aa, Homo Sapiens
VGGGGGLHT

SEQ ID NO: 679587 - protein, 9 aa, Homo Sapiens
LVQASSHHL

SEQ ID NO: 679588 - protein, 9 aa, Homo Sapiens
PDSKGNPGE

SEQ ID NO: 679589 - protein, 9 aa, Homo Sapiens
VQVKEVKRM

SEQ ID NO: 679590 - protein, 9 aa, Homo Sapiens
MCGPSPPCI

SEQ ID NO: 679591 - protein, 9 aa, Homo Sapiens
QDKDRIFAM

SEQ ID NO: 679592 - protein, 9 aa, Homo Sapiens
CGLIMFRRC

SEQ ID NO: 679593 - protein, 9 aa, Homo Sapiens
SVLEKPPKD

SEQ ID NO: 679594 - protein, 9 aa, Homo Sapiens
QALQEEAAF

SEQ ID NO: 679595 - protein, 9 aa, Homo Sapiens
PAKSTCHEQ

SEQ ID NO: 679596 - protein, 9 aa, Homo Sapiens
IQTLSVNQQ

SEQ ID NO: 679597 - protein, 9 aa, Homo Sapiens
PGNTHREIT

SEQ ID NO: 679598 - protein, 9 aa, Homo Sapiens
TDLITNDSM

SEQ ID NO: 679599 - protein, 9 aa, Homo Sapiens
LRQRQVFFH

SEQ ID NO: 679600 - protein, 9 aa, Homo Sapiens
QALLPLVPT

SEQ ID NO: 679601 - protein, 9 aa, Homo Sapiens
TPYTHKEYV

SEQ ID NO: 679602 - protein, 9 aa, Homo Sapiens
VSVPLLCII

SEQ ID NO: 679603 - protein, 9 aa, Homo Sapiens
HSEASLTSA

SEQ ID NO: 679604 - protein, 9 aa, Homo Sapiens
YPKPSVTSV

SEQ ID NO: 679605 - protein, 9 aa, Homo Sapiens
MMSISTLWG

SEQ ID NO: 679606 - protein, 9 aa, Homo Sapiens
LELYQQDER

SEQ ID NO: 679607 - protein, 9 aa, Homo Sapiens
AAASGSVLE

SEQ ID NO: 679608 - protein, 9 aa, Homo Sapiens
AKSTCHEQG

SEQ ID NO: 679609 - protein, 9 aa, Homo Sapiens
HRLICHPPS

SEQ ID NO: 679610 - protein, 9 aa, Homo Sapiens
LWLLGGVFA

SEQ ID NO: 679611 - protein, 9 aa, Homo Sapiens
SIEITPTNS

SEQ ID NO: 679612 - protein, 9 aa, Homo Sapiens
NSLLREWKV

SEQ ID NO: 679613 - protein, 9 aa, Homo Sapiens
EFQEEMSAL

SEQ ID NO: 679614 - protein, 9 aa, Homo Sapiens
ALRACGLIM

SEQ ID NO: 679615 - protein, 9 aa, Homo Sapiens
QVLDAYANK

SEQ ID NO: 679616 - protein, 9 aa, Homo Sapiens
DNSEERIQA

SEQ ID NO: 679617 - protein, 9 aa, Homo Sapiens
PDTITKKSG

SEQ ID NO: 679618 - protein, 9 aa, Homo Sapiens
QFKSTVSRC

SEQ ID NO: 679619 - protein, 9 aa, Homo Sapiens
GCGGFGAGP

SEQ ID NO: 679620 - protein, 9 aa, Homo Sapiens
RMSSMLTCY

SEQ ID NO: 679621 - protein, 9 aa, Homo Sapiens
CIILNMTEN

SEQ ID NO: 679622 - protein, 9 aa, Homo Sapiens
MAHHTLLRE

SEQ ID NO: 679623 - protein, 9 aa, Homo Sapiens
EEMAHHTLL

SEQ ID NO: 679624 - protein, 9 aa, Homo Sapiens
ELDRESWVT

SEQ ID NO: 679625 - protein, 9 aa, Homo Sapiens
GVEYFAKNC

SEQ ID NO: 679626 - protein, 9 aa, Homo Sapiens
TNLVALPEA

SEQ ID NO: 679627 - protein, 9 aa, Homo Sapiens
GGKNGEAEE

SEQ ID NO: 679628 - protein, 9 aa, Homo Sapiens
KLPHTAPPV

SEQ ID NO: 679629 - protein, 9 aa, Homo Sapiens
VFQMSRVKS

SEQ ID NO: 679630 - protein, 9 aa, Homo Sapiens
HKVEAVAHL

SEQ ID NO: 679631 - protein, 9 aa, Homo Sapiens
AAGRTIRVW

SEQ ID NO: 679632 - protein, 9 aa, Homo Sapiens
SCMQSKKVQ

SEQ ID NO: 679633 - protein, 9 aa, Homo Sapiens
DVHRKLKIQ

SEQ ID NO: 679634 - protein, 9 aa, Homo Sapiens
QTHKVEAVA

SEQ ID NO: 679635 - protein, 9 aa, Homo Sapiens
ALLWLLGGV

SEQ ID NO: 679636 - protein, 9 aa, Homo Sapiens
GDNATCCAK

SEQ ID NO: 679637 - protein, 9 aa, Homo Sapiens
RMLASRAPE

SEQ ID NO: 679638 - protein, 9 aa, Homo Sapiens
SGATATAPS

SEQ ID NO: 679639 - protein, 9 aa, Homo Sapiens
RQVFFHEII

SEQ ID NO: 679640 - protein, 9 aa, Homo Sapiens
LEKEAGMYQ

SEQ ID NO: 679641 - protein, 9 aa, Homo Sapiens
VIFLVIALY

SEQ ID NO: 679642 - protein, 9 aa, Homo Sapiens
EGGGLGGGA

SEQ ID NO: 679643 - protein, 9 aa, Homo Sapiens
STKARVLYD

SEQ ID NO: 679644 - protein, 9 aa, Homo Sapiens
ITKAVEHDF

SEQ ID NO: 679645 - protein, 9 aa, Homo Sapiens
HSDNSEERI

SEQ ID NO: 679646 - protein, 9 aa, Homo Sapiens
TDHGVEYFA

SEQ ID NO: 679647 - protein, 9 aa, Homo Sapiens
NPEALSAQA

SEQ ID NO: 679648 - protein, 9 aa, Homo Sapiens
NTYFTGLSM

SEQ ID NO: 679649 - protein, 9 aa, Homo Sapiens
MSALKENLL

SEQ ID NO: 679650 - protein, 9 aa, Homo Sapiens
PSVHSDNSE

SEQ ID NO: 679651 - protein, 9 aa, Homo Sapiens
PNSQSRSSP

SEQ ID NO: 679652 - protein, 9 aa, Homo Sapiens
RVEVLCSGS

SEQ ID NO: 679653 - protein, 9 aa, Homo Sapiens
PSSSGSFSY

SEQ ID NO: 679654 - protein, 9 aa, Homo Sapiens
SLSNARDVA

SEQ ID NO: 679655 - protein, 9 aa, Homo Sapiens
RKKDTLVQA

SEQ ID NO: 679656 - protein, 9 aa, Homo Sapiens
YLQDKFRIL

SEQ ID NO: 679657 - protein, 9 aa, Homo Sapiens
VHRKLKIQV

SEQ ID NO: 679658 - protein, 9 aa, Homo Sapiens
IWSSQEEEP

SEQ ID NO: 679659 - protein, 9 aa, Homo Sapiens
SPTTQEGVA

SEQ ID NO: 679660 - protein, 9 aa, Homo Sapiens
GRMISIEKA

SEQ ID NO: 679661 - protein, 9 aa, Homo Sapiens
PAPSFSQTV

SEQ ID NO: 679662 - protein, 9 aa, Homo Sapiens
GHSEASLTS

SEQ ID NO: 679663 - protein, 9 aa, Homo Sapiens
LTQKYGWLG

SEQ ID NO: 679664 - protein, 9 aa, Homo Sapiens
EFTPLPTSL

SEQ ID NO: 679665 - protein, 9 aa, Homo Sapiens
EDLPYVHII

SEQ ID NO: 679666 - protein, 9 aa, Homo Sapiens
EPDSTKARV

SEQ ID NO: 679667 - protein, 9 aa, Homo Sapiens
LFLTQKYGW

SEQ ID NO: 679668 - protein, 9 aa, Homo Sapiens
VRRNEAQAR

SEQ ID NO: 679669 - protein, 9 aa, Homo Sapiens
MAEREGGGL

SEQ ID NO: 679670 - protein, 9 aa, Homo Sapiens
ACTLFIIDE

SEQ ID NO: 679671 - protein, 9 aa, Homo Sapiens
LEHILYFYR

SEQ ID NO: 679672 - protein, 9 aa, Homo Sapiens
QGGRLLRTG

SEQ ID NO: 679673 - protein, 9 aa, Homo Sapiens
FILLELYQQ

SEQ ID NO: 679674 - protein, 9 aa, Homo Sapiens
AKTFEDKVT

SEQ ID NO: 679675 - protein, 9 aa, Homo Sapiens
KSDILKKCY

SEQ ID NO: 679676 - protein, 9 aa, Homo Sapiens
LWQLSLMDL

SEQ ID NO: 679677 - protein, 9 aa, Homo Sapiens
SFILLELYQ

SEQ ID NO: 679678 - protein, 9 aa, Homo Sapiens
THYTGHPGY

SEQ ID NO: 679679 - protein, 9 aa, Homo Sapiens
GGMCGPSPP

SEQ ID NO: 679680 - protein, 9 aa, Homo Sapiens
DAYPELQSN

SEQ ID NO: 679681 - protein, 9 aa, Homo Sapiens
ASGSVLEKP

SEQ ID NO: 679682 - protein, 9 aa, Homo Sapiens
SQRELLPGL

SEQ ID NO: 679683 - protein, 9 aa, Homo Sapiens
RNTTSLVGN

SEQ ID NO: 679684 - protein, 9 aa, Homo Sapiens
NRGCGGFGA

SEQ ID NO: 679685 - protein, 9 aa, Homo Sapiens
NEAQAREEE

SEQ ID NO: 679686 - protein, 9 aa, Homo Sapiens
RIPNKQLFS

SEQ ID NO: 679687 - protein, 9 aa, Homo Sapiens
WSSQEEEPV

SEQ ID NO: 679688 - protein, 9 aa, Homo Sapiens
PGANGSPGT

SEQ ID NO: 679689 - protein, 9 aa, Homo Sapiens
KLSSPEDLI

SEQ ID NO: 679690 - protein, 9 aa, Homo Sapiens
PMYLLLWQL

SEQ ID NO: 679691 - protein, 9 aa, Homo Sapiens
VPVSHPVLK

SEQ ID NO: 679692 - protein, 9 aa, Homo Sapiens
RGCGGFGAG

SEQ ID NO: 679693 - protein, 9 aa, Homo Sapiens
FEPDSTKAR

SEQ ID NO: 679694 - protein, 9 aa, Homo Sapiens
KKDTLVQAS

SEQ ID NO: 679695 - protein, 9 aa, Homo Sapiens
CMQSKKVQI

SEQ ID NO: 679696 - protein, 9 aa, Homo Sapiens
WDIAGQQRF

SEQ ID NO: 679697 - protein, 9 aa, Homo Sapiens
AAEKAEREH

SEQ ID NO: 679698 - protein, 9 aa, Homo Sapiens
GGGLGGGAA

SEQ ID NO: 679699 - protein, 9 aa, Homo Sapiens
LFRNEEVKV

SEQ ID NO: 679700 - protein, 9 aa, Homo Sapiens
HRKKDTLVQ

SEQ ID NO: 679701 - protein, 9 aa, Homo Sapiens
PFPWMKWCW

SEQ ID NO: 679702 - protein, 9 aa, Homo Sapiens
HQTPLRQGS

SEQ ID NO: 679703 - protein, 9 aa, Homo Sapiens
RPPVPPRGL

SEQ ID NO: 679704 - protein, 9 aa, Homo Sapiens
LKEEMAHHT

SEQ ID NO: 679705 - protein, 9 aa, Homo Sapiens
PASPQWVLV

SEQ ID NO: 679706 - protein, 9 aa, Homo Sapiens
QEVEEIDHQ

SEQ ID NO: 679707 - protein, 9 aa, Homo Sapiens
GMYQGTLMS

SEQ ID NO: 679708 - protein, 9 aa, Homo Sapiens
MFPQEHPNL

SEQ ID NO: 679709 - protein, 9 aa, Homo Sapiens
NDSMSFFRT

SEQ ID NO: 679710 - protein, 9 aa, Homo Sapiens
MYLGVGIVS

SEQ ID NO: 679711 - protein, 9 aa, Homo Sapiens
HYPVIMGHK

SEQ ID NO: 679712 - protein, 9 aa, Homo Sapiens
IGDHSKKDQ

SEQ ID NO: 679713 - protein, 9 aa, Homo Sapiens
QSKKVQIHS

SEQ ID NO: 679714 - protein, 9 aa, Homo Sapiens
PLLRLFSLS

SEQ ID NO: 679715 - protein, 9 aa, Homo Sapiens
ILAPHALVM

SEQ ID NO: 679716 - protein, 9 aa, Homo Sapiens
YFYRILSLI

SEQ ID NO: 679717 - protein, 9 aa, Homo Sapiens
LSILKPLAQ

SEQ ID NO: 679718 - protein, 9 aa, Homo Sapiens
HSKKDQSPG

SEQ ID NO: 679719 - protein, 9 aa, Homo Sapiens
AVVDMKTCS

SEQ ID NO: 679720 - protein, 9 aa, Homo Sapiens
KNMNTWLLL

SEQ ID NO: 679721 - protein, 9 aa, Homo Sapiens
LLWQLSLMD

SEQ ID NO: 679722 - protein, 9 aa, Homo Sapiens
SIMHNLSHH

SEQ ID NO: 679723 - protein, 9 aa, Homo Sapiens
QPGSAFADR

SEQ ID NO: 679724 - protein, 9 aa, Homo Sapiens
YFFLRNSSI

SEQ ID NO: 679725 - protein, 9 aa, Homo Sapiens
EHTWGSLSE

SEQ ID NO: 679726 - protein, 9 aa, Homo Sapiens
PNIQTLSVN

SEQ ID NO: 679727 - protein, 9 aa, Homo Sapiens
AREAAEKAE

SEQ ID NO: 679728 - protein, 9 aa, Homo Sapiens
PIPVEICDG

SEQ ID NO: 679729 - protein, 9 aa, Homo Sapiens
KDKSDILKK

SEQ ID NO: 679730 - protein, 9 aa, Homo Sapiens
TLLRESWEA

SEQ ID NO: 679731 - protein, 9 aa, Homo Sapiens
YPELQSNSA

SEQ ID NO: 679732 - protein, 9 aa, Homo Sapiens
KHTTDPDIN

SEQ ID NO: 679733 - protein, 9 aa, Homo Sapiens
LNFKMPQEI

SEQ ID NO: 679734 - protein, 9 aa, Homo Sapiens
IDLNFKMPQ

SEQ ID NO: 679735 - protein, 9 aa, Homo Sapiens
YILSGDGAC

SEQ ID NO: 679736 - protein, 9 aa, Homo Sapiens
ARDVAHWLG

SEQ ID NO: 679737 - protein, 9 aa, Homo Sapiens
GQVNTSLEL

SEQ ID NO: 679738 - protein, 9 aa, Homo Sapiens
HATPGALLQ

SEQ ID NO: 679739 - protein, 9 aa, Homo Sapiens
RGRQRARNG

SEQ ID NO: 679740 - protein, 9 aa, Homo Sapiens
ACLAQIFSC

SEQ ID NO: 679741 - protein, 9 aa, Homo Sapiens
IFILVGIIH

SEQ ID NO: 679742 - protein, 9 aa, Homo Sapiens
ASPQWVLVQ

SEQ ID NO: 679743 - protein, 9 aa, Homo Sapiens
AGRTIRVWD

SEQ ID NO: 679744 - protein, 9 aa, Homo Sapiens
IRQTVNRGC

SEQ ID NO: 679745 - protein, 9 aa, Homo Sapiens
LSLSILKPL

SEQ ID NO: 679746 - protein, 9 aa, Homo Sapiens
VKSWQVTFL

SEQ ID NO: 679747 - protein, 9 aa, Homo Sapiens
SGSVLEKPP

SEQ ID NO: 679748 - protein, 9 aa, Homo Sapiens
VNTSLELRL

SEQ ID NO: 679749 - protein, 9 aa, Homo Sapiens
YPLSEDLPY

SEQ ID NO: 679750 - protein, 9 aa, Homo Sapiens
APWPLFDLM

SEQ ID NO: 679751 - protein, 9 aa, Homo Sapiens
TYHGGLLSL

SEQ ID NO: 679752 - protein, 9 aa, Homo Sapiens
HHPNIQTLS

SEQ ID NO: 679753 - protein, 9 aa, Homo Sapiens
TPSPPIFSL

SEQ ID NO: 679754 - protein, 9 aa, Homo Sapiens
LKVPANLAS

SEQ ID NO: 679755 - protein, 9 aa, Homo Sapiens
YLLLWQLSL

SEQ ID NO: 679756 - protein, 9 aa, Homo Sapiens
KSGSHIQTL

SEQ ID NO: 679757 - protein, 9 aa, Homo Sapiens
PLEVNAIKN

SEQ ID NO: 679758 - protein, 9 aa, Homo Sapiens
LPSFAPHNA

SEQ ID NO: 679759 - protein, 9 aa, Homo Sapiens
EVNAIKNEA

SEQ ID NO: 679760 - protein, 9 aa, Homo Sapiens
GAAGSQREL

SEQ ID NO: 679761 - protein, 9 aa, Homo Sapiens
LREWKVHEQ

SEQ ID NO: 679762 - protein, 9 aa, Homo Sapiens
AVKEDQFSA

SEQ ID NO: 679763 - protein, 9 aa, Homo Sapiens
QTVQTTDSL

SEQ ID NO: 679764 - protein, 9 aa, Homo Sapiens
YSVPSHPLL

SEQ ID NO: 679765 - protein, 9 aa, Homo Sapiens
PANLASVST

SEQ ID NO: 679766 - protein, 9 aa, Homo Sapiens
DVGVICHPW

SEQ ID NO: 679767 - protein, 9 aa, Homo Sapiens
QGYITTLIS

SEQ ID NO: 679768 - protein, 9 aa, Homo Sapiens
SALKENLLE

SEQ ID NO: 679769 - protein, 9 aa, Homo Sapiens
TFGEDWHQT

SEQ ID NO: 679770 - protein, 9 aa, Homo Sapiens
KLACTNTYF

SEQ ID NO: 679771 - protein, 9 aa, Homo Sapiens
ISIEKAKNE

SEQ ID NO: 679772 - protein, 9 aa, Homo Sapiens
FSIAGSYVL

SEQ ID NO: 679773 - protein, 9 aa, Homo Sapiens
PCHRLICHP

SEQ ID NO: 679774 - protein, 9 aa, Homo Sapiens
FFHEIIYIN

SEQ ID NO: 679775 - protein, 9 aa, Homo Sapiens
SAGQIDLNF

SEQ ID NO: 679776 - protein, 9 aa, Homo Sapiens
PQWVLVQAA

SEQ ID NO: 679777 - protein, 9 aa, Homo Sapiens
HRKLKIQVT

SEQ ID NO: 679778 - protein, 9 aa, Homo Sapiens
SNLVIHHRI

SEQ ID NO: 679779 - protein, 9 aa, Homo Sapiens
MEMYNVIMA

SEQ ID NO: 679780 - protein, 9 aa, Homo Sapiens
RTSTKSAKS

SEQ ID NO: 679781 - protein, 9 aa, Homo Sapiens
LLFLTQKYG

SEQ ID NO: 679782 - protein, 9 aa, Homo Sapiens
CMIGYRPFP

SEQ ID NO: 679783 - protein, 9 aa, Homo Sapiens
RMISIEKAK

SEQ ID NO: 679784 - protein, 9 aa, Homo Sapiens
ATAPSLSGK

SEQ ID NO: 679785 - protein, 9 aa, Homo Sapiens
TPMQALTSN

SEQ ID NO: 679786 - protein, 9 aa, Homo Sapiens
TVNRGCGGF

SEQ ID NO: 679787 - protein, 9 aa, Homo Sapiens
DKDRIFAMQ

SEQ ID NO: 679788 - protein, 9 aa, Homo Sapiens
FSCSSLHWQ

SEQ ID NO: 679789 - protein, 9 aa, Homo Sapiens
CKCEGKMVY

SEQ ID NO: 679790 - protein, 9 aa, Homo Sapiens
FLILFLFRN

SEQ ID NO: 679791 - protein, 9 aa, Homo Sapiens
GTLPLASPE

SEQ ID NO: 679792 - protein, 9 aa, Homo Sapiens
GLLETYHGG

SEQ ID NO: 679793 - protein, 9 aa, Homo Sapiens
YHGGLLSLS

SEQ ID NO: 679794 - protein, 9 aa, Homo Sapiens
HHTLLRESW

SEQ ID NO: 679795 - protein, 9 aa, Homo Sapiens
SRDDNPRRF

SEQ ID NO: 679796 - protein, 9 aa, Homo Sapiens
EETWSFLDA

SEQ ID NO: 679797 - protein, 9 aa, Homo Sapiens
GEESTVLFA

SEQ ID NO: 679798 - protein, 9 aa, Homo Sapiens
KPLAQTHKV

SEQ ID NO: 679799 - protein, 9 aa, Homo Sapiens
DLNAGCFLV

SEQ ID NO: 679800 - protein, 9 aa, Homo Sapiens
LPLASPESA

SEQ ID NO: 679801 - protein, 9 aa, Homo Sapiens
RDEMAATRG

SEQ ID NO: 679802 - protein, 9 aa, Homo Sapiens
LLPLVPTDE

SEQ ID NO: 679803 - protein, 9 aa, Homo Sapiens
VEFTPLPTS

SEQ ID NO: 679804 - protein, 9 aa, Homo Sapiens
MTSSHVSCN

SEQ ID NO: 679805 - protein, 9 aa, Homo Sapiens
ICHPPSLQL

SEQ ID NO: 679806 - protein, 9 aa, Homo Sapiens
ATATAPSLS

SEQ ID NO: 679807 - protein, 9 aa, Homo Sapiens
QWLLADAGR

SEQ ID NO: 679808 - protein, 9 aa, Homo Sapiens
LASRAPEDE

SEQ ID NO: 679809 - protein, 9 aa, Homo Sapiens
TEKVLFLLH

SEQ ID NO: 679810 - protein, 9 aa, Homo Sapiens
AALGEPVPL

SEQ ID NO: 679811 - protein, 9 aa, Homo Sapiens
NGQSKPNKS

SEQ ID NO: 679812 - protein, 9 aa, Homo Sapiens
RRRRTLADP

SEQ ID NO: 679813 - protein, 9 aa, Homo Sapiens
ACMIGYRPF

SEQ ID NO: 679814 - protein, 9 aa, Homo Sapiens
AQNIRNSAT

SEQ ID NO: 679815 - protein, 9 aa, Homo Sapiens
DLEQLSSSR

SEQ ID NO: 679816 - protein, 9 aa, Homo Sapiens
PPIPVEICD

SEQ ID NO: 679817 - protein, 9 aa, Homo Sapiens
GDKKKSGKG

SEQ ID NO: 679818 - protein, 9 aa, Homo Sapiens
ILSPNLETL

SEQ ID NO: 679819 - protein, 9 aa, Homo Sapiens
ARNGPRRSP

SEQ ID NO: 679820 - protein, 9 aa, Homo Sapiens
TWGSLSEQQ

SEQ ID NO: 679821 - protein, 9 aa, Homo Sapiens
LERTVVAFV

SEQ ID NO: 679822 - protein, 9 aa, Homo Sapiens
AENLLDGPS

SEQ ID NO: 679823 - protein, 9 aa, Homo Sapiens
FVLCKEGVE

SEQ ID NO: 679824 - protein, 9 aa, Homo Sapiens
VGELEFLER

SEQ ID NO: 679825 - protein, 9 aa, Homo Sapiens
GDVHRKLKI

SEQ ID NO: 679826 - protein, 9 aa, Homo Sapiens
LVKDKSDIL

SEQ ID NO: 679827 - protein, 9 aa, Homo Sapiens
TGAAGSQRE

SEQ ID NO: 679828 - protein, 9 aa, Homo Sapiens
EILQLQGYI

SEQ ID NO: 679829 - protein, 9 aa, Homo Sapiens
PSFSQTVQT

SEQ ID NO: 679830 - protein, 9 aa, Homo Sapiens
PWRHRGYLS

SEQ ID NO: 679831 - protein, 9 aa, Homo Sapiens
TKKSGSHIQ

SEQ ID NO: 679832 - protein, 9 aa, Homo Sapiens
GCKCEGKMV

SEQ ID NO: 679833 - protein, 9 aa, Homo Sapiens
FTPLPTSLQ

SEQ ID NO: 679834 - protein, 9 aa, Homo Sapiens
SGSHIQTLM

SEQ ID NO: 679835 - protein, 9 aa, Homo Sapiens
GVAVVFEVH

SEQ ID NO: 679836 - protein, 9 aa, Homo Sapiens
PPVPPRGLL

SEQ ID NO: 679837 - protein, 9 aa, Homo Sapiens
YNIFSDRFL

SEQ ID NO: 679838 - protein, 9 aa, Homo Sapiens
SKKSKLEFS

SEQ ID NO: 679839 - protein, 9 aa, Homo Sapiens
GQSKPNKSD

SEQ ID NO: 679840 - protein, 9 aa, Homo Sapiens
KNCIILNMT

SEQ ID NO: 679841 - protein, 9 aa, Homo Sapiens
LQLQGYITT

SEQ ID NO: 679842 - protein, 9 aa, Homo Sapiens
IAAGRTIRV

SEQ ID NO: 679843 - protein, 9 aa, Homo Sapiens
ANQFKSTVS

SEQ ID NO: 679844 - protein, 9 aa, Homo Sapiens
VLGTQLLYK

SEQ ID NO: 679845 - protein, 9 aa, Homo Sapiens
MGHKSCAQL

SEQ ID NO: 679846 - protein, 9 aa, Homo Sapiens
AAESKAAEL

SEQ ID NO: 679847 - protein, 9 aa, Homo Sapiens
SAPWPLFDL

SEQ ID NO: 679848 - protein, 9 aa, Homo Sapiens
GIIHYPVFQ

SEQ ID NO: 679849 - protein, 9 aa, Homo Sapiens
IEEVTDSGS

SEQ ID NO: 679850 - protein, 9 aa, Homo Sapiens
NATCCAKWN

SEQ ID NO: 679851 - protein, 9 aa, Homo Sapiens
PTHYTGHPG

SEQ ID NO: 679852 - protein, 9 aa, Homo Sapiens
VPASPQWVL

SEQ ID NO: 679853 - protein, 9 aa, Homo Sapiens
PFGDVHRKL

SEQ ID NO: 679854 - protein, 9 aa, Homo Sapiens
ILLELYQQD

SEQ ID NO: 679855 - protein, 9 aa, Homo Sapiens
SFWIKCRQW

SEQ ID NO: 679856 - protein, 9 aa, Homo Sapiens
MYFFLRNSS

SEQ ID NO: 679857 - protein, 9 aa, Homo Sapiens
LLLWQLSLM

SEQ ID NO: 679858 - protein, 9 aa, Homo Sapiens
DISNVHDDE

SEQ ID NO: 679859 - protein, 9 aa, Homo Sapiens
WNSNLVIHH

SEQ ID NO: 679860 - protein, 9 aa, Homo Sapiens
SEDLPYVHI

SEQ ID NO: 679861 - protein, 9 aa, Homo Sapiens
FMSLHIHEE

SEQ ID NO: 679862 - protein, 9 aa, Homo Sapiens
AEKAEREHQ

SEQ ID NO: 679863 - protein, 9 aa, Homo Sapiens
PRGLLRGPL

SEQ ID NO: 679864 - protein, 9 aa, Homo Sapiens
LRMSSMLTC

SEQ ID NO: 679865 - protein, 9 aa, Homo Sapiens
RREAAETGS

SEQ ID NO: 679866 - protein, 9 aa, Homo Sapiens
DSMSFFRTS

SEQ ID NO: 679867 - protein, 9 aa, Homo Sapiens
SPGTHGRIG

SEQ ID NO: 679868 - protein, 9 aa, Homo Sapiens
MAATRGALK

SEQ ID NO: 679869 - protein, 9 aa, Homo Sapiens
NLVALPEAL

SEQ ID NO: 679870 - protein, 9 aa, Homo Sapiens
PYIPALLWL

SEQ ID NO: 679871 - protein, 9 aa, Homo Sapiens
QEEMSALKE

SEQ ID NO: 679872 - protein, 9 aa, Homo Sapiens
PVSSFPISP

SEQ ID NO: 679873 - protein, 9 aa, Homo Sapiens
RPFPWMKWC

SEQ ID NO: 679874 - protein, 9 aa, Homo Sapiens
TLPLASPES

SEQ ID NO: 679875 - protein, 9 aa, Homo Sapiens
VLCKEGVEP

SEQ ID NO: 679876 - protein, 9 aa, Homo Sapiens
KIQVKTFQA

SEQ ID NO: 679877 - protein, 9 aa, Homo Sapiens
QHATPGALL

SEQ ID NO: 679878 - protein, 9 aa, Homo Sapiens
VSRCCNAPA

SEQ ID NO: 679879 - protein, 9 aa, Homo Sapiens
AQALQEEAA

SEQ ID NO: 679880 - protein, 9 aa, Homo Sapiens
SFLILFLFR

SEQ ID NO: 679881 - protein, 9 aa, Homo Sapiens
WGSLSEQQE

SEQ ID NO: 679882 - protein, 9 aa, Homo Sapiens
GAKILAPHA

SEQ ID NO: 679883 - protein, 9 aa, Homo Sapiens
ENLLDGPSN

SEQ ID NO: 679884 - protein, 9 aa, Homo Sapiens
MFRRCLIPK

SEQ ID NO: 679885 - protein, 9 aa, Homo Sapiens
KSWQVTFLG

SEQ ID NO: 679886 - protein, 9 aa, Homo Sapiens
CRIPNKQLF

SEQ ID NO: 679887 - protein, 9 aa, Homo Sapiens
ASRAPEDEE

SEQ ID NO: 679888 - protein, 9 aa, Homo Sapiens
IQEVEEIDH

SEQ ID NO: 679889 - protein, 9 aa, Homo Sapiens
PLSEDLPYV

SEQ ID NO: 679890 - protein, 9 aa, Homo Sapiens
NRPICSAPW

SEQ ID NO: 679891 - protein, 9 aa, Homo Sapiens
KLPPPAWPH

SEQ ID NO: 679892 - protein, 9 aa, Homo Sapiens
SRGRQRARN

SEQ ID NO: 679893 - protein, 9 aa, Homo Sapiens
RGCPKGCKC

SEQ ID NO: 679894 - protein, 9 aa, Homo Sapiens
GYRSGGMCG

SEQ ID NO: 679895 - protein, 9 aa, Homo Sapiens
VLTDFVLCK

SEQ ID NO: 679896 - protein, 9 aa, Homo Sapiens
IFLVIALYK

SEQ ID NO: 679897 - protein, 9 aa, Homo Sapiens
MSFFRTSKK

SEQ ID NO: 679898 - protein, 9 aa, Homo Sapiens
SKLSRRCPR

SEQ ID NO: 679899 - protein, 9 aa, Homo Sapiens
PVEICDGSG

SEQ ID NO: 679900 - protein, 9 aa, Homo Sapiens
AIHQALVQP

SEQ ID NO: 679901 - protein, 9 aa, Homo Sapiens
EAPWEYQKL

SEQ ID NO: 679902 - protein, 9 aa, Homo Sapiens
SKGNPGEDP

SEQ ID NO: 679903 - protein, 9 aa, Homo Sapiens
HLRMSSMLT

SEQ ID NO: 679904 - protein, 9 aa, Homo Sapiens
SFAPHNAPT

SEQ ID NO: 679905 - protein, 9 aa, Homo Sapiens
RRNEAQARE

SEQ ID NO: 679906 - protein, 9 aa, Homo Sapiens
VLDAYANKK

SEQ ID NO: 679907 - protein, 9 aa, Homo Sapiens
EHILYFYRI

SEQ ID NO: 679908 - protein, 9 aa, Homo Sapiens
VLKTNADIA

SEQ ID NO: 679909 - protein, 9 aa, Homo Sapiens
PPQKKRKIT

SEQ ID NO: 679910 - protein, 9 aa, Homo Sapiens
VKEVKRMHI

SEQ ID NO: 679911 - protein, 9 aa, Homo Sapiens
HTLLRESWE

SEQ ID NO: 679912 - protein, 9 aa, Homo Sapiens
NVIMAVKED

SEQ ID NO: 679913 - protein, 9 aa, Homo Sapiens
LAREAAEKA

SEQ ID NO: 679914 - protein, 9 aa, Homo Sapiens
YVEVPFPNQ

SEQ ID NO: 679915 - protein, 9 aa, Homo Sapiens
KEVAPEEKI

SEQ ID NO: 679916 - protein, 9 aa, Homo Sapiens
SKKVQIHSW

SEQ ID NO: 679917 - protein, 9 aa, Homo Sapiens
GLARLKIRT

SEQ ID NO: 679918 - protein, 9 aa, Homo Sapiens
SIWSSQEEE

SEQ ID NO: 679919 - protein, 9 aa, Homo Sapiens
SNARDVAHW

SEQ ID NO: 679920 - protein, 9 aa, Homo Sapiens
RVRRNEAQA

SEQ ID NO: 679921 - protein, 9 aa, Homo Sapiens
YTGHPGYLS

SEQ ID NO: 679922 - protein, 9 aa, Homo Sapiens
GLLRGPLPQ

SEQ ID NO: 679923 - protein, 9 aa, Homo Sapiens
VNAIKNEAG

SEQ ID NO: 679924 - protein, 9 aa, Homo Sapiens
AIKNEAGTK

SEQ ID NO: 679925 - protein, 9 aa, Homo Sapiens
QALVQPGSA

SEQ ID NO: 679926 - protein, 9 aa, Homo Sapiens
TNDSMSFFR

SEQ ID NO: 679927 - protein, 9 aa, Homo Sapiens
KSCAQLAAA

SEQ ID NO: 679928 - protein, 9 aa, Homo Sapiens
CQILSPNLE

SEQ ID NO: 679929 - protein, 9 aa, Homo Sapiens
RQRQVFFHE

SEQ ID NO: 679930 - protein, 9 aa, Homo Sapiens
PGSAFADRP

SEQ ID NO: 679931 - protein, 9 aa, Homo Sapiens
LACTNTYFT

SEQ ID NO: 679932 - protein, 9 aa, Homo Sapiens
VFFHEIIYI

SEQ ID NO: 679933 - protein, 9 aa, Homo Sapiens
YDVTDISNV

SEQ ID NO: 679934 - protein, 9 aa, Homo Sapiens
RATSRDDNP

SEQ ID NO: 679935 - protein, 9 aa, Homo Sapiens
LLRLFSLSN

SEQ ID NO: 679936 - protein, 9 aa, Homo Sapiens
IAGQQRFTS

SEQ ID NO: 679937 - protein, 9 aa, Homo Sapiens
KEEMAHHTL

SEQ ID NO: 679938 - protein, 9 aa, Homo Sapiens
TVQVKEVKR

SEQ ID NO: 679939 - protein, 9 aa, Homo Sapiens
MYNVIMAVK

SEQ ID NO: 679940 - protein, 9 aa, Homo Sapiens
STLIMGTIE

SEQ ID NO: 679941 - protein, 9 aa, Homo Sapiens
YQGTLMSPG

SEQ ID NO: 679942 - protein, 9 aa, Homo Sapiens
VDMKTCSID

SEQ ID NO: 679943 - protein, 9 aa, Homo Sapiens
ETLCAKKGL

SEQ ID NO: 679944 - protein, 9 aa, Homo Sapiens
LKLSSPEDL

SEQ ID NO: 679945 - protein, 9 aa, Homo Sapiens
LPKFSIAGS

SEQ ID NO: 679946 - protein, 9 aa, Homo Sapiens
DFGIATGSQ

SEQ ID NO: 679947 - protein, 9 aa, Homo Sapiens
VNRGCGGFG

SEQ ID NO: 679948 - protein, 9 aa, Homo Sapiens
MKQVHQCIQ

SEQ ID NO: 679949 - protein, 9 aa, Homo Sapiens
QLKPFGDVH

SEQ ID NO: 679950 - protein, 9 aa, Homo Sapiens
LSGVTPVSS

SEQ ID NO: 679951 - protein, 9 aa, Homo Sapiens
YKEGQFYPM

SEQ ID NO: 679952 - protein, 9 aa, Homo Sapiens
WIKCRQWLL

SEQ ID NO: 679953 - protein, 9 aa, Homo Sapiens
SNSAQIANL

SEQ ID NO: 679954 - protein, 9 aa, Homo Sapiens
AQIFSCSSL

SEQ ID NO: 679955 - protein, 9 aa, Homo Sapiens
KAGEVLKTN

SEQ ID NO: 679956 - protein, 9 aa, Homo Sapiens
WRHRGYLSE

SEQ ID NO: 679957 - protein, 9 aa, Homo Sapiens
EITKAVEHD

SEQ ID NO: 679958 - protein, 9 aa, Homo Sapiens
NIQDKDRIF

SEQ ID NO: 679959 - protein, 9 aa, Homo Sapiens
VVFVGMMSI

SEQ ID NO: 679960 - protein, 9 aa, Homo Sapiens
EEMSALKEN

SEQ ID NO: 679961 - protein, 9 aa, Homo Sapiens
EVKRMHISP

SEQ ID NO: 679962 - protein, 9 aa, Homo Sapiens
SNKDDDNIL

SEQ ID NO: 679963 - protein, 9 aa, Homo Sapiens
CLKYTLQAK

SEQ ID NO: 679964 - protein, 9 aa, Homo Sapiens
EITPTNSLS

SEQ ID NO: 679965 - protein, 9 aa, Homo Sapiens
KKSGSHIQT

SEQ ID NO: 679966 - protein, 9 aa, Homo Sapiens
YANKKPFYL

SEQ ID NO: 679967 - protein, 9 aa, Homo Sapiens
AGQQRFTSM

SEQ ID NO: 679968 - protein, 9 aa, Homo Sapiens
SPNSQSRSS

SEQ ID NO: 679969 - protein, 9 aa, Homo Sapiens
KRNTTSLVG

SEQ ID NO: 679970 - protein, 9 aa, Homo Sapiens
KSSPTPSPP

SEQ ID NO: 679971 - protein, 9 aa, Homo Sapiens
IYPTHYTGH

SEQ ID NO: 679972 - protein, 9 aa, Homo Sapiens
QLFSLNAGE

SEQ ID NO: 679973 - protein, 9 aa, Homo Sapiens
TCHEQGKFI

SEQ ID NO: 679974 - protein, 9 aa, Homo Sapiens
LTSNKDDDN

SEQ ID NO: 679975 - protein, 9 aa, Homo Sapiens
SSEVYSVPS

SEQ ID NO: 679976 - protein, 9 aa, Homo Sapiens
LSPNLETLC

SEQ ID NO: 679977 - protein, 9 aa, Homo Sapiens
KVPRRRRTL

SEQ ID NO: 679978 - protein, 9 aa, Homo Sapiens
ACRIPNKQL

SEQ ID NO: 679979 - protein, 9 aa, Homo Sapiens
CPKGCKCEG

SEQ ID NO: 679980 - protein, 9 aa, Homo Sapiens
VYSVPSHPL

SEQ ID NO: 679981 - protein, 9 aa, Homo Sapiens
HIHEENRSV

SEQ ID NO: 679982 - protein, 9 aa, Homo Sapiens
REPGDKKKS

SEQ ID NO: 679983 - protein, 9 aa, Homo Sapiens
SDILKKCYS

SEQ ID NO: 679984 - protein, 9 aa, Homo Sapiens
PVLKLSSPE

SEQ ID NO: 679985 - protein, 9 aa, Homo Sapiens
SRLKDLKDR

SEQ ID NO: 679986 - protein, 9 aa, Homo Sapiens
RCTTSIMHN

SEQ ID NO: 679987 - protein, 9 aa, Homo Sapiens
DKSDILKKC

SEQ ID NO: 679988 - protein, 9 aa, Homo Sapiens
CIFILVGII

SEQ ID NO: 679989 - protein, 9 aa, Homo Sapiens
LVGIIHYPV

SEQ ID NO: 679990 - protein, 9 aa, Homo Sapiens
VICHPWRHR

SEQ ID NO: 679991 - protein, 9 aa, Homo Sapiens
NGSPGTHGR

SEQ ID NO: 679992 - protein, 9 aa, Homo Sapiens
LVCVGGGGG

SEQ ID NO: 679993 - protein, 9 aa, Homo Sapiens
LIMFRRCLI

SEQ ID NO: 679994 - protein, 9 aa, Homo Sapiens
VPDRMLASR

SEQ ID NO: 679995 - protein, 9 aa, Homo Sapiens
QAKTFEDKV

SEQ ID NO: 679996 - protein, 9 aa, Homo Sapiens
GTVHCQMFP

SEQ ID NO: 679997 - protein, 9 aa, Homo Sapiens
VKRMHISPN

SEQ ID NO: 679998 - protein, 9 aa, Homo Sapiens
LSGDGACTL

SEQ ID NO: 679999 - protein, 9 aa, Homo Sapiens
VHSDNSEER

SEQ ID NO: 680000 - protein, 9 aa, Homo Sapiens
GCLFLPSFA

SEQ ID NO: 680001 - protein, 9 aa, Homo Sapiens
GHKSCAQLA

SEQ ID NO: 680002 - protein, 9 aa, Homo Sapiens
LETYHGGLL

SEQ ID NO: 680003 - protein, 9 aa, Homo Sapiens
RLICHPPSL

SEQ ID NO: 680004 - protein, 9 aa, Homo Sapiens
GGRLLRTGR

SEQ ID NO: 680005 - protein, 9 aa, Homo Sapiens
IIQEVEEID

SEQ ID NO: 680006 - protein, 9 aa, Homo Sapiens
QIFSCSSLH

SEQ ID NO: 680007 - protein, 9 aa, Homo Sapiens
VGIIHYPVF

SEQ ID NO: 680008 - protein, 9 aa, Homo Sapiens
LASPESAVV

SEQ ID NO: 680009 - protein, 9 aa, Homo Sapiens
AVIAAIGDH

SEQ ID NO: 680010 - protein, 9 aa, Homo Sapiens
EYFNVVLGT

SEQ ID NO: 680011 - protein, 9 aa, Homo Sapiens
SATVSSEGK

SEQ ID NO: 680012 - protein, 9 aa, Homo Sapiens
GGETPYTHK

SEQ ID NO: 680013 - protein, 9 aa, Homo Sapiens
VTSVVCQWI

SEQ ID NO: 680014 - protein, 9 aa, Homo Sapiens
LKPLAQTHK

SEQ ID NO: 680015 - protein, 9 aa, Homo Sapiens
GSVLEKPPK

SEQ ID NO: 680016 - protein, 9 aa, Homo Sapiens
VIAAIGDHS

SEQ ID NO: 680017 - protein, 9 aa, Homo Sapiens
FFLRNSSIL

SEQ ID NO: 680018 - protein, 9 aa, Homo Sapiens
KMILEHILY

SEQ ID NO: 680019 - protein, 9 aa, Homo Sapiens
PSVTSVVCQ

SEQ ID NO: 680020 - protein, 9 aa, Homo Sapiens
MIGYRPFPW

SEQ ID NO: 680021 - protein, 9 aa, Homo Sapiens
QILSPNLET

SEQ ID NO: 680022 - protein, 9 aa, Homo Sapiens
AYPELQSNS

SEQ ID NO: 680023 - protein, 9 aa, Homo Sapiens
KAVEHDFVE

SEQ ID NO: 680024 - protein, 9 aa, Homo Sapiens
NTTSLVGNR

SEQ ID NO: 680025 - protein, 9 aa, Homo Sapiens
QVNTSLELR

SEQ ID NO: 680026 - protein, 9 aa, Homo Sapiens
DHSKKDQSP

SEQ ID NO: 680027 - protein, 9 aa, Homo Sapiens
LIGYDVTDI

SEQ ID NO: 680028 - protein, 9 aa, Homo Sapiens
ETHVTEGEK

SEQ ID NO: 680029 - protein, 9 aa, Homo Sapiens
NSNLVIHHR

SEQ ID NO: 680030 - protein, 9 aa, Homo Sapiens
IAGSYVLDQ

SEQ ID NO: 680031 - protein, 9 aa, Homo Sapiens
GHVVLTDFV

SEQ ID NO: 680032 - protein, 9 aa, Homo Sapiens
KDTLVQASS

SEQ ID NO: 680033 - protein, 9 aa, Homo Sapiens
LQPAKSTCH

SEQ ID NO: 680034 - protein, 9 aa, Homo Sapiens
WVLVQAASS

SEQ ID NO: 680035 - protein, 9 aa, Homo Sapiens
SAAAEQGVL

SEQ ID NO: 680036 - protein, 9 aa, Homo Sapiens
LRVSCMQSK

SEQ ID NO: 680037 - protein, 9 aa, Homo Sapiens
DNATCCAKW

SEQ ID NO: 680038 - protein, 9 aa, Homo Sapiens
CESCSNSDI

SEQ ID NO: 680039 - protein, 9 aa, Homo Sapiens
HEQKMILEH

SEQ ID NO: 680040 - protein, 9 aa, Homo Sapiens
VPPRGLLRG

SEQ ID NO: 680041 - protein, 9 aa, Homo Sapiens
PLASPESAV

SEQ ID NO: 680042 - protein, 9 aa, Homo Sapiens
YETHVTEGE

SEQ ID NO: 680043 - protein, 9 aa, Homo Sapiens
NIFSDRFLE

SEQ ID NO: 680044 - protein, 9 aa, Homo Sapiens
DNPRRFRPH

SEQ ID NO: 680045 - protein, 9 aa, Homo Sapiens
LNESSVMKE

SEQ ID NO: 680046 - protein, 9 aa, Homo Sapiens
LPLVPTDEI

SEQ ID NO: 680047 - protein, 9 aa, Homo Sapiens
TAPPVYLNS

SEQ ID NO: 680048 - protein, 9 aa, Homo Sapiens
SSHVSCNFL

SEQ ID NO: 680049 - protein, 9 aa, Homo Sapiens
LRACGLIMF

SEQ ID NO: 680050 - protein, 9 aa, Homo Sapiens
ANKKPFYLY

SEQ ID NO: 680051 - protein, 9 aa, Homo Sapiens
ILKPLAQTH

SEQ ID NO: 680052 - protein, 9 aa, Homo Sapiens
QNIRNSATV

SEQ ID NO: 680053 - protein, 9 aa, Homo Sapiens
SIAGSYVLD

SEQ ID NO: 680054 - protein, 9 aa, Homo Sapiens
IKNEAGTKE

SEQ ID NO: 680055 - protein, 9 aa, Homo Sapiens
IMGTIEEVT

SEQ ID NO: 680056 - protein, 9 aa, Homo Sapiens
PEILQLQGY

SEQ ID NO: 680057 - protein, 9 aa, Homo Sapiens
LLGTVHCQM

SEQ ID NO: 680058 - protein, 9 aa, Homo Sapiens
VPTGAAGSQ

SEQ ID NO: 680059 - protein, 9 aa, Homo Sapiens
FSDRFLEYS

SEQ ID NO: 680060 - protein, 9 aa, Homo Sapiens
WSNLAGKNC

SEQ ID NO: 680061 - protein, 9 aa, Homo Sapiens
FGIATGSQP

SEQ ID NO: 680062 - protein, 9 aa, Homo Sapiens
QVFFHEIIY

SEQ ID NO: 680063 - protein, 9 aa, Homo Sapiens
ESEVLHACI

SEQ ID NO: 680064 - protein, 9 aa, Homo Sapiens
FAPHNAPTN

SEQ ID NO: 680065 - protein, 9 aa, Homo Sapiens
IPVEICDGS

SEQ ID NO: 680066 - protein, 9 aa, Homo Sapiens
LDELSIDIS

SEQ ID NO: 680067 - protein, 9 aa, Homo Sapiens
IYGGETPYT

SEQ ID NO: 680068 - protein, 9 aa, Homo Sapiens
LQDKFRILK

SEQ ID NO: 680069 - protein, 9 aa, Homo Sapiens
SSSTPGTAH

SEQ ID NO: 680070 - protein, 9 aa, Homo Sapiens
CVRIYGGET

SEQ ID NO: 680071 - protein, 9 aa, Homo Sapiens
WLLGGVFAP

SEQ ID NO: 680072 - protein, 9 aa, Homo Sapiens
LICHPPSLQ

SEQ ID NO: 680073 - protein, 9 aa, Homo Sapiens
RTLEKLEVD

SEQ ID NO: 680074 - protein, 9 aa, Homo Sapiens
LLETYHGGL

SEQ ID NO: 680075 - protein, 9 aa, Homo Sapiens
FGEDWHQTP

SEQ ID NO: 680076 - protein, 9 aa, Homo Sapiens
TGLSIWSSQ

SEQ ID NO: 680077 - protein, 9 aa, Homo Sapiens
SPTPSPPIF

SEQ ID NO: 680078 - protein, 9 aa, Homo Sapiens
DKFRILKKK

SEQ ID NO: 680079 - protein, 9 aa, Homo Sapiens
RYQSRLKDL

SEQ ID NO: 680080 - protein, 9 aa, Homo Sapiens
NAATVSIEI

SEQ ID NO: 680081 - protein, 9 aa, Homo Sapiens
LLAYCYETH

SEQ ID NO: 680082 - protein, 9 aa, Homo Sapiens
LTDFVLCKE

SEQ ID NO: 680083 - protein, 9 aa, Homo Sapiens
LILFLFRNE

SEQ ID NO: 680084 - protein, 9 aa, Homo Sapiens
QDSPNSQSR

SEQ ID NO: 680085 - protein, 9 aa, Homo Sapiens
IGVAVVFEV

SEQ ID NO: 680086 - protein, 9 aa, Homo Sapiens
PSNPKRAKL

SEQ ID NO: 680087 - protein, 9 aa, Homo Sapiens
VLFARKGAL

SEQ ID NO: 680088 - protein, 9 aa, Homo Sapiens
KKSGKGLGK

SEQ ID NO: 680089 - protein, 9 aa, Homo Sapiens
ERTVVAFVR

SEQ ID NO: 680090 - protein, 9 aa, Homo Sapiens
RIYGGETPY

SEQ ID NO: 680091 - protein, 9 aa, Homo Sapiens
HRHRKKDTL

SEQ ID NO: 680092 - protein, 9 aa, Homo Sapiens
LGSAAAEQG

SEQ ID NO: 680093 - protein, 9 aa, Homo Sapiens
PALLWLLGG

SEQ ID NO: 680094 - protein, 9 aa, Homo Sapiens
DFQIPDSKG

SEQ ID NO: 680095 - protein, 9 aa, Homo Sapiens
SAQALQEEA

SEQ ID NO: 680096 - protein, 9 aa, Homo Sapiens
QPKSSADFG

SEQ ID NO: 680097 - protein, 9 aa, Homo Sapiens
QVHQCIQRC

SEQ ID NO: 680098 - protein, 9 aa, Homo Sapiens
VLHACINWV

SEQ ID NO: 680099 - protein, 9 aa, Homo Sapiens
KWNVCCESE

SEQ ID NO: 680100 - protein, 9 aa, Homo Sapiens
ATGSVATSS

SEQ ID NO: 680101 - protein, 9 aa, Homo Sapiens
KEKTGLSIW

SEQ ID NO: 680102 - protein, 9 aa, Homo Sapiens
LLREWKVHE

SEQ ID NO: 680103 - protein, 9 aa, Homo Sapiens
VYGAKILAP

SEQ ID NO: 680104 - protein, 9 aa, Homo Sapiens
TTSLVGNRC

SEQ ID NO: 680105 - protein, 9 aa, Homo Sapiens
IGTYINTTH

SEQ ID NO: 680106 - protein, 9 aa, Homo Sapiens
TRGALKKNA

SEQ ID NO: 680107 - protein, 9 aa, Homo Sapiens
TLIMGTIEE

SEQ ID NO: 680108 - protein, 9 aa, Homo Sapiens
MISIEKAKN

SEQ ID NO: 680109 - protein, 9 aa, Homo Sapiens
ITPTNSLSR

SEQ ID NO: 680110 - protein, 9 aa, Homo Sapiens
AAEQGVLRD

SEQ ID NO: 680111 - protein, 9 aa, Homo Sapiens
RSGGMCGPS

SEQ ID NO: 680112 - protein, 9 aa, Homo Sapiens
IHQALVQPG

SEQ ID NO: 680113 - protein, 9 aa, Homo Sapiens
TVHCQMFPQ

SEQ ID NO: 680114 - protein, 9 aa, Homo Sapiens
TYNIFSDRF

SEQ ID NO: 680115 - protein, 9 aa, Homo Sapiens
SVDFGIATG

SEQ ID NO: 680116 - protein, 9 aa, Homo Sapiens
SRVKSWQVT

SEQ ID NO: 680117 - protein, 9 aa, Homo Sapiens
DINKKERKK

SEQ ID NO: 680118 - protein, 9 aa, Homo Sapiens
RQEESQWPI

SEQ ID NO: 680119 - protein, 9 aa, Homo Sapiens
FYRILSLIT

SEQ ID NO: 680120 - protein, 9 aa, Homo Sapiens
ITVIGGGDN

SEQ ID NO: 680121 - protein, 9 aa, Homo Sapiens
QQRFTSMTR

SEQ ID NO: 680122 - protein, 9 aa, Homo Sapiens
LASVSTVPS

SEQ ID NO: 680123 - protein, 9 aa, Homo Sapiens
PGTLPLASP

SEQ ID NO: 680124 - protein, 9 aa, Homo Sapiens
CVGGGGGLH

SEQ ID NO: 680125 - protein, 9 aa, Homo Sapiens
ESSVMKEFN

SEQ ID NO: 680126 - protein, 9 aa, Homo Sapiens
RQRARNGPR

SEQ ID NO: 680127 - protein, 9 aa, Homo Sapiens
LLDATIGTY

SEQ ID NO: 680128 - protein, 9 aa, Homo Sapiens
DNIGVAVVF

SEQ ID NO: 680129 - protein, 9 aa, Homo Sapiens
QRFTSMTRL

SEQ ID NO: 680130 - protein, 9 aa, Homo Sapiens
QDKFRILKK

SEQ ID NO: 680131 - protein, 9 aa, Homo Sapiens
TGHPGYLSD

SEQ ID NO: 680132 - protein, 9 aa, Homo Sapiens
IKENERLRS

SEQ ID NO: 680133 - protein, 9 aa, Homo Sapiens
GVICHPWRH

SEQ ID NO: 680134 - protein, 9 aa, Homo Sapiens
KCEGKMVYC

SEQ ID NO: 680135 - protein, 9 aa, Homo Sapiens
TDISNVHDD

SEQ ID NO: 680136 - protein, 9 aa, Homo Sapiens
DMKTCSIDN

SEQ ID NO: 680137 - protein, 9 aa, Homo Sapiens
DRESWVTEK

SEQ ID NO: 680138 - protein, 9 aa, Homo Sapiens
RFLEYSGLN

SEQ ID NO: 680139 - protein, 9 aa, Homo Sapiens
KYGWLGKIH

SEQ ID NO: 680140 - protein, 9 aa, Homo Sapiens
GPYIPALLW

SEQ ID NO: 680141 - protein, 9 aa, Homo Sapiens
GTNLVALPE

SEQ ID NO: 680142 - protein, 9 aa, Homo Sapiens
GDAYPELQS

SEQ ID NO: 680143 - protein, 9 aa, Homo Sapiens
EVAPEEKIQ

SEQ ID NO: 680144 - protein, 9 aa, Homo Sapiens
MNQVLDAYA

SEQ ID NO: 680145 - protein, 9 aa, Homo Sapiens
DLNFKMPQE

SEQ ID NO: 680146 - protein, 9 aa, Homo Sapiens
KRMHISPNN

SEQ ID NO: 680147 - protein, 9 aa, Homo Sapiens
ASSVDFGIA

SEQ ID NO: 680148 - protein, 9 aa, Homo Sapiens
TDPDINKKE

SEQ ID NO: 680149 - protein, 9 aa, Homo Sapiens
VTDISNVHD

SEQ ID NO: 680150 - protein, 9 aa, Homo Sapiens
GCPKGCKCE

SEQ ID NO: 680151 - protein, 9 aa, Homo Sapiens
DNVARVRRN

SEQ ID NO: 680152 - protein, 9 aa, Homo Sapiens
SVATSSSTP

SEQ ID NO: 680153 - protein, 9 aa, Homo Sapiens
MSRVKSWQV

SEQ ID NO: 680154 - protein, 9 aa, Homo Sapiens
ESTVLFARK

SEQ ID NO: 680155 - protein, 9 aa, Homo Sapiens
GATGSVATS

SEQ ID NO: 680156 - protein, 9 aa, Homo Sapiens
SCHLEEGGK

SEQ ID NO: 680157 - protein, 9 aa, Homo Sapiens
RNSATVNWR

SEQ ID NO: 680158 - protein, 9 aa, Homo Sapiens
THGRIGLPG

SEQ ID NO: 680159 - protein, 9 aa, Homo Sapiens
PDINKKERK

SEQ ID NO: 680160 - protein, 9 aa, Homo Sapiens
QSRLKDLKD

SEQ ID NO: 680161 - protein, 9 aa, Homo Sapiens
KSTCHEQGK

SEQ ID NO: 680162 - protein, 9 aa, Homo Sapiens
LLDGPSNPK

SEQ ID NO: 680163 - protein, 9 aa, Homo Sapiens
TVIGGGDNA

SEQ ID NO: 680164 - protein, 9 aa, Homo Sapiens
CLAQIFSCS

SEQ ID NO: 680165 - protein, 9 aa, Homo Sapiens
PMYFFLRNS

SEQ ID NO: 680166 - protein, 9 aa, Homo Sapiens
GKNCIILNM

SEQ ID NO: 680167 - protein, 9 aa, Homo Sapiens
DLWLDAHRS

SEQ ID NO: 680168 - protein, 9 aa, Homo Sapiens
RARNGPRRS

SEQ ID NO: 680169 - protein, 9 aa, Homo Sapiens
VGIVSVPLL

SEQ ID NO: 680170 - protein, 9 aa, Homo Sapiens
GSRHTVPRR

SEQ ID NO: 680171 - protein, 9 aa, Homo Sapiens
SPNLETLCA

SEQ ID NO: 680172 - protein, 9 aa, Homo Sapiens
LWDIAGQQR

SEQ ID NO: 680173 - protein, 9 aa, Homo Sapiens
AGQIDLNFK

SEQ ID NO: 680174 - protein, 9 aa, Homo Sapiens
LSAKSGRQL

SEQ ID NO: 680175 - protein, 9 aa, Homo Sapiens
LDATIGTYI

SEQ ID NO: 680176 - protein, 9 aa, Homo Sapiens
SGDGACTLF

SEQ ID NO: 680177 - protein, 9 aa, Homo Sapiens
SPPIFSLPL

SEQ ID NO: 680178 - protein, 9 aa, Homo Sapiens
HQALVQPGS

SEQ ID NO: 680179 - protein, 9 aa, Homo Sapiens
WHQTPLRQG

SEQ ID NO: 680180 - protein, 9 aa, Homo Sapiens
IRVWDYATQ

SEQ ID NO: 680181 - protein, 9 aa, Homo Sapiens
RQTVNRGCG

SEQ ID NO: 680182 - protein, 9 aa, Homo Sapiens
SGRQLVPGW

SEQ ID NO: 680183 - protein, 9 aa, Homo Sapiens
MSSMLTCYD

SEQ ID NO: 680184 - protein, 9 aa, Homo Sapiens
YRILSLITH

SEQ ID NO: 680185 - protein, 9 aa, Homo Sapiens
GGLLSLSIL

SEQ ID NO: 680186 - protein, 9 aa, Homo Sapiens
PVSHPVLKL

SEQ ID NO: 680187 - protein, 9 aa, Homo Sapiens
FQMSRVKSW

SEQ ID NO: 680188 - protein, 9 aa, Homo Sapiens
HREITSFEL

SEQ ID NO: 680189 - protein, 9 aa, Homo Sapiens
REITSFELA

SEQ ID NO: 680190 - protein, 9 aa, Homo Sapiens
VGNRCASSP

SEQ ID NO: 680191 - protein, 9 aa, Homo Sapiens
CHPWRHRGY

SEQ ID NO: 680192 - protein, 9 aa, Homo Sapiens
WPIQMVKGG

SEQ ID NO: 680193 - protein, 9 aa, Homo Sapiens
RQWLLADAG

SEQ ID NO: 680194 - protein, 9 aa, Homo Sapiens
PDSTKARVL

SEQ ID NO: 680195 - protein, 9 aa, Homo Sapiens
GMMSISTLW

SEQ ID NO: 680196 - protein, 9 aa, Homo Sapiens
TIGTYINTT

SEQ ID NO: 680197 - protein, 9 aa, Homo Sapiens
KGCKCEGKM

SEQ ID NO: 680198 - protein, 9 aa, Homo Sapiens
PVPLERDIC

SEQ ID NO: 680199 - protein, 9 aa, Homo Sapiens
EGEESTVLF

SEQ ID NO: 680200 - protein, 9 aa, Homo Sapiens
VGMMSISTL

SEQ ID NO: 680201 - protein, 9 aa, Homo Sapiens
VIGGGDNAT

SEQ ID NO: 680202 - protein, 9 aa, Homo Sapiens
PNLETLCAK

SEQ ID NO: 680203 - protein, 9 aa, Homo Sapiens
TPVSSFPIS

SEQ ID NO: 680204 - protein, 9 aa, Homo Sapiens
EPGDKKKSG

SEQ ID NO: 680205 - protein, 9 aa, Homo Sapiens
DAYANKKPF

SEQ ID NO: 680206 - protein, 9 aa, Homo Sapiens
NIGVAVVFE

SEQ ID NO: 680207 - protein, 9 aa, Homo Sapiens
TGSPTTQEG

SEQ ID NO: 680208 - protein, 9 aa, Homo Sapiens
VLCSGSRHT

SEQ ID NO: 680209 - protein, 9 aa, Homo Sapiens
AAETGSPTT

SEQ ID NO: 680210 - protein, 9 aa, Homo Sapiens
ATFLSAKSG

SEQ ID NO: 680211 - protein, 9 aa, Homo Sapiens
NIQTLSVNQ

SEQ ID NO: 680212 - protein, 9 aa, Homo Sapiens
IEFLNESSV

SEQ ID NO: 680213 - protein, 9 aa, Homo Sapiens
EVEEIDHQD

SEQ ID NO: 680214 - protein, 9 aa, Homo Sapiens
LEQLSSSRT

SEQ ID NO: 680215 - protein, 9 aa, Homo Sapiens
RRYQSRLKD

SEQ ID NO: 680216 - protein, 9 aa, Homo Sapiens
GEVLKTNAD

SEQ ID NO: 680217 - protein, 9 aa, Homo Sapiens
VSSFPISPT

SEQ ID NO: 680218 - protein, 9 aa, Homo Sapiens
ATSRDDNPR

SEQ ID NO: 680219 - protein, 9 aa, Homo Sapiens
MHNLSHHRE

SEQ ID NO: 680220 - protein, 9 aa, Homo Sapiens
VAPEEKIQV

SEQ ID NO: 680221 - protein, 9 aa, Homo Sapiens
PMQALTSNK

SEQ ID NO: 680222 - protein, 9 aa, Homo Sapiens
SAASATVSS

SEQ ID NO: 680223 - protein, 9 aa, Homo Sapiens
CHLEEGGKN

SEQ ID NO: 680224 - protein, 9 aa, Homo Sapiens
LTSALVEGE

SEQ ID NO: 680225 - protein, 9 aa, Homo Sapiens
PESAVVEDL

SEQ ID NO: 680226 - protein, 9 aa, Homo Sapiens
AAIGDHSKK

SEQ ID NO: 680227 - protein, 9 aa, Homo Sapiens
HLEETWSFL

SEQ ID NO: 680228 - protein, 9 aa, Homo Sapiens
SLITHLRMS

SEQ ID NO: 680229 - protein, 9 aa, Homo Sapiens
FQIPDSKGN

SEQ ID NO: 680230 - protein, 9 aa, Homo Sapiens
SEVYSVPSH

SEQ ID NO: 680231 - protein, 9 aa, Homo Sapiens
NCIILNMTE

SEQ ID NO: 680232 - protein, 9 aa, Homo Sapiens
GLIMFRRCL

SEQ ID NO: 680233 - protein, 9 aa, Homo Sapiens
PELQSNSAQ

SEQ ID NO: 680234 - protein, 9 aa, Homo Sapiens
GEYVEVPFP

SEQ ID NO: 680235 - protein, 9 aa, Homo Sapiens
LKPFGDVHR

SEQ ID NO: 680236 - protein, 9 aa, Homo Sapiens
ALGEPVPLE

SEQ ID NO: 680237 - protein, 9 aa, Homo Sapiens
HILYFYRIL

SEQ ID NO: 680238 - protein, 9 aa, Homo Sapiens
VRQEESQWP

SEQ ID NO: 680239 - protein, 9 aa, Homo Sapiens
ILSLITHLR

SEQ ID NO: 680240 - protein, 9 aa, Homo Sapiens
KRKITVDSE

SEQ ID NO: 680241 - protein, 9 aa, Homo Sapiens
TSSHVSCNF

SEQ ID NO: 680242 - protein, 9 aa, Homo Sapiens
NIRNSATVN

SEQ ID NO: 680243 - protein, 9 aa, Homo Sapiens
YLQPAKSTC

SEQ ID NO: 680244 - protein, 9 aa, Homo Sapiens
GRQRARNGP

SEQ ID NO: 680245 - protein, 9 aa, Homo Sapiens
HGGLLSLSI

SEQ ID NO: 680246 - protein, 9 aa, Homo Sapiens
AGKNCIILN

SEQ ID NO: 680247 - protein, 9 aa, Homo Sapiens
EKIQVKTFQ

SEQ ID NO: 680248 - protein, 9 aa, Homo Sapiens
IGGGDNATC

SEQ ID NO: 680249 - protein, 9 aa, Homo Sapiens
RVSCMQSKK

SEQ ID NO: 680250 - protein, 9 aa, Homo Sapiens
PNKQLFSLN

SEQ ID NO: 680251 - protein, 9 aa, Homo Sapiens
MKTCSIDNK

SEQ ID NO: 680252 - protein, 9 aa, Homo Sapiens
AGSQRELLP

SEQ ID NO: 680253 - protein, 9 aa, Homo Sapiens
HTTDPDINK

SEQ ID NO: 680254 - protein, 9 aa, Homo Sapiens
RLRSELKDA

SEQ ID NO: 680255 - protein, 9 aa, Homo Sapiens
SDNSEERIQ

SEQ ID NO: 680256 - protein, 9 aa, Homo Sapiens
LSNARDVAH

SEQ ID NO: 680257 - protein, 9 aa, Homo Sapiens
IRTLEKLEV

SEQ ID NO: 680258 - protein, 9 aa, Homo Sapiens
SPQWVLVQA

SEQ ID NO: 680259 - protein, 9 aa, Homo Sapiens
SSSLSNARD

SEQ ID NO: 680260 - protein, 9 aa, Homo Sapiens
GCFLVNGQC

SEQ ID NO: 680261 - protein, 9 aa, Homo Sapiens
IIHYPVFQT

SEQ ID NO: 680262 - protein, 9 aa, Homo Sapiens
REAAETGSP

SEQ ID NO: 680263 - protein, 9 aa, Homo Sapiens
ACGLIMFRR

SEQ ID NO: 680264 - protein, 9 aa, Homo Sapiens
FAHLEETWS

SEQ ID NO: 680265 - protein, 9 aa, Homo Sapiens
ALKVPANLA

SEQ ID NO: 680266 - protein, 9 aa, Homo Sapiens
LVIHHRIHT

SEQ ID NO: 680267 - protein, 9 aa, Homo Sapiens
AKILAPHAL

SEQ ID NO: 680268 - protein, 9 aa, Homo Sapiens
KGNPGEDPR

SEQ ID NO: 680269 - protein, 9 aa, Homo Sapiens
RVWDYATQA

SEQ ID NO: 680270 - protein, 9 aa, Homo Sapiens
SWVTEKVLF

SEQ ID NO: 680271 - protein, 9 aa, Homo Sapiens
GKNGEAEEE

SEQ ID NO: 680272 - protein, 9 aa, Homo Sapiens
ANGSPGTHG

SEQ ID NO: 680273 - protein, 9 aa, Homo Sapiens
SGILSFFAP

SEQ ID NO: 680274 - protein, 9 aa, Homo Sapiens
VDTLRTLPS

SEQ ID NO: 680275 - protein, 9 aa, Homo Sapiens
GSPTTQEGV

SEQ ID NO: 680276 - protein, 9 aa, Homo Sapiens
PLPTSLQHR

SEQ ID NO: 680277 - protein, 9 aa, Homo Sapiens
ITKKSGSHI

SEQ ID NO: 680278 - protein, 9 aa, Homo Sapiens
DTFGEDWHQ

SEQ ID NO: 680279 - protein, 9 aa, Homo Sapiens
PTGAAGSQR

SEQ ID NO: 680280 - protein, 9 aa, Homo Sapiens
YADLADGVS

SEQ ID NO: 680281 - protein, 9 aa, Homo Sapiens
DTLRTLPSQ

SEQ ID NO: 680282 - protein, 9 aa, Homo Sapiens
DFVLCKEGV

SEQ ID NO: 680283 - protein, 9 aa, Homo Sapiens
QWVLVQAAS

SEQ ID NO: 680284 - protein, 9 aa, Homo Sapiens
LHACINWVK

SEQ ID NO: 680285 - protein, 9 aa, Homo Sapiens
TVSRCCNAP

SEQ ID NO: 680286 - protein, 9 aa, Homo Sapiens
PSFAPHNAP

SEQ ID NO: 680287 - protein, 9 aa, Homo Sapiens
CGGFGAGPG

SEQ ID NO: 680288 - protein, 9 aa, Homo Sapiens
DILKKCYSA

SEQ ID NO: 680289 - protein, 9 aa, Homo Sapiens
SGGMCGPSP

SEQ ID NO: 680290 - protein, 9 aa, Homo Sapiens
KVHEQKMIL

SEQ ID NO: 680291 - protein, 9 aa, Homo Sapiens
NVCCESEMS

SEQ ID NO: 680292 - protein, 9 aa, Homo Sapiens
HEENRSVDI

SEQ ID NO: 680293 - protein, 9 aa, Homo Sapiens
YPVIMGHKS

SEQ ID NO: 680294 - protein, 9 aa, Homo Sapiens
TLRTLPSQN

SEQ ID NO: 680295 - protein, 9 aa, Homo Sapiens
ILQLQGYIT

SEQ ID NO: 680296 - protein, 9 aa, Homo Sapiens
SISTLWGNI

SEQ ID NO: 680297 - protein, 9 aa, Homo Sapiens
KLDELSIDI

SEQ ID NO: 680298 - protein, 9 aa, Homo Sapiens
YCYETHVTE

SEQ ID NO: 680299 - protein, 9 aa, Homo Sapiens
YQQDERAKA

SEQ ID NO: 680300 - protein, 9 aa, Homo Sapiens
GLDAPLFGV

SEQ ID NO: 680301 - protein, 9 aa, Homo Sapiens
EASLTSALV

SEQ ID NO: 680302 - protein, 9 aa, Homo Sapiens
IEKAKNEPA

SEQ ID NO: 680303 - protein, 9 aa, Homo Sapiens
SPLGQVNTS

SEQ ID NO: 680304 - protein, 9 aa, Homo Sapiens
ELQSNSAQI

SEQ ID NO: 680305 - protein, 9 aa, Homo Sapiens
GTIEEVTDS

SEQ ID NO: 680306 - protein, 9 aa, Homo Sapiens
LLDLEKALV

SEQ ID NO: 680307 - protein, 9 aa, Homo Sapiens
GATATAPSL

SEQ ID NO: 680308 - protein, 9 aa, Homo Sapiens
PGDKKKSGK

SEQ ID NO: 680309 - protein, 9 aa, Homo Sapiens
KKKSGKGLG

SEQ ID NO: 680310 - protein, 9 aa, Homo Sapiens
STCHEQGKF

SEQ ID NO: 680311 - protein, 9 aa, Homo Sapiens
AAAESKAAE

SEQ ID NO: 680312 - protein, 9 aa, Homo Sapiens
PNASALHPL

SEQ ID NO: 680313 - protein, 9 aa, Homo Sapiens
PMNLLRNVA

SEQ ID NO: 680314 - protein, 9 aa, Homo Sapiens
CSGSRHTVP

SEQ ID NO: 680315 - protein, 9 aa, Homo Sapiens
QLEHTWGSL

SEQ ID NO: 680316 - protein, 9 aa, Homo Sapiens
ASPESAVVE

SEQ ID NO: 680317 - protein, 9 aa, Homo Sapiens
ALHPLLRLF

SEQ ID NO: 680318 - protein, 9 aa, Homo Sapiens
KDRIFAMQS

SEQ ID NO: 680319 - protein, 9 aa, Homo Sapiens
SVTSVVCQW

SEQ ID NO: 680320 - protein, 9 aa, Homo Sapiens
KVEAVAHLQ

SEQ ID NO: 680321 - protein, 9 aa, Homo Sapiens
NKKERKKMV

SEQ ID NO: 680322 - protein, 9 aa, Homo Sapiens
PEALSAQAL

SEQ ID NO: 680323 - protein, 9 aa, Homo Sapiens
HPVLKLSSP

SEQ ID NO: 680324 - protein, 9 aa, Homo Sapiens
PKFSIAGSY

SEQ ID NO: 680325 - protein, 9 aa, Homo Sapiens
NAGCFLVNG

SEQ ID NO: 680326 - protein, 9 aa, Homo Sapiens
AASGSVLEK

SEQ ID NO: 680327 - protein, 9 aa, Homo Sapiens
ANPEALSAQ

SEQ ID NO: 680328 - protein, 9 aa, Homo Sapiens
RNSSILEIS

SEQ ID NO: 680329 - protein, 9 aa, Homo Sapiens
EIIYINGQS

SEQ ID NO: 680330 - protein, 9 aa, Homo Sapiens
CESEVLHAC

SEQ ID NO: 680331 - protein, 9 aa, Homo Sapiens
LAQIFSCSS

SEQ ID NO: 680332 - protein, 9 aa, Homo Sapiens
QTVNRGCGG

SEQ ID NO: 680333 - protein, 9 aa, Homo Sapiens
WNVCCESEM

SEQ ID NO: 680334 - protein, 9 aa, Homo Sapiens
STPMQALTS

SEQ ID NO: 680335 - protein, 9 aa, Homo Sapiens
FGCLFLPSF

SEQ ID NO: 680336 - protein, 9 aa, Homo Sapiens
YFNVVLGTQ

SEQ ID NO: 680337 - protein, 9 aa, Homo Sapiens
ELYQQDERA

SEQ ID NO: 680338 - protein, 9 aa, Homo Sapiens
FLPSFAPHN

SEQ ID NO: 680339 - protein, 9 aa, Homo Sapiens
NSATVNWRP

SEQ ID NO: 680340 - protein, 9 aa, Homo Sapiens
NLAGKNCII

SEQ ID NO: 680341 - protein, 9 aa, Homo Sapiens
HSGATATAP

SEQ ID NO: 680342 - protein, 9 aa, Homo Sapiens
EVPFPNQYQ

SEQ ID NO: 680343 - protein, 9 aa, Homo Sapiens
PPVYLNSDL

SEQ ID NO: 680344 - protein, 9 aa, Homo Sapiens
PLVPTDEIE

SEQ ID NO: 680345 - protein, 9 aa, Homo Sapiens
IFAMQSIFQ

SEQ ID NO: 680346 - protein, 9 aa, Homo Sapiens
NTHREITSF

SEQ ID NO: 680347 - protein, 9 aa, Homo Sapiens
THVTEGEKN

SEQ ID NO: 680348 - protein, 9 aa, Homo Sapiens
YRPFPWMKW

SEQ ID NO: 680349 - protein, 9 aa, Homo Sapiens
FLERTVVAF

SEQ ID NO: 680350 - protein, 9 aa, Homo Sapiens
RCESEVLHA

SEQ ID NO: 680351 - protein, 9 aa, Homo Sapiens
LGVGIVSVP

SEQ ID NO: 680352 - protein, 9 aa, Homo Sapiens
QQHATPGAL

SEQ ID NO: 680353 - protein, 9 aa, Homo Sapiens
ILKKCYSAK

SEQ ID NO: 680354 - protein, 9 aa, Homo Sapiens
LDGLLETYH

SEQ ID NO: 680355 - protein, 9 aa, Homo Sapiens
IMFRRCLIP

SEQ ID NO: 680356 - protein, 9 aa, Homo Sapiens
LLELYQQDE

SEQ ID NO: 680357 - protein, 9 aa, Homo Sapiens
SSSVYPLSE

SEQ ID NO: 680358 - protein, 9 aa, Homo Sapiens
LFARKGALR

SEQ ID NO: 680359 - protein, 9 aa, Homo Sapiens
HCQMFPQEH

SEQ ID NO: 680360 - protein, 9 aa, Homo Sapiens
IFSCSSLHW

SEQ ID NO: 680361 - protein, 9 aa, Homo Sapiens
IGYRPFPWM

SEQ ID NO: 680362 - protein, 9 aa, Homo Sapiens
GIHSGATAT

SEQ ID NO: 680363 - protein, 9 aa, Homo Sapiens
EKLDELSID

SEQ ID NO: 680364 - protein, 9 aa, Homo Sapiens
YGWLGKIHL

SEQ ID NO: 680365 - protein, 9 aa, Homo Sapiens
SSLSNARDV

SEQ ID NO: 680366 - protein, 9 aa, Homo Sapiens
HGRMISIEK

SEQ ID NO: 680367 - protein, 9 aa, Homo Sapiens
LRNSSILEI

SEQ ID NO: 680368 - protein, 9 aa, Homo Sapiens
HYPKPSVTS

SEQ ID NO: 680369 - protein, 9 aa, Homo Sapiens
KITVDSEIR

SEQ ID NO: 680370 - protein, 9 aa, Homo Sapiens
RRTLADPDF

SEQ ID NO: 680371 - protein, 9 aa, Homo Sapiens
FLRNSSILE

SEQ ID NO: 680372 - protein, 9 aa, Homo Sapiens
TSALVEGEI

SEQ ID NO: 680373 - protein, 9 aa, Homo Sapiens
IHSGATATA

SEQ ID NO: 680374 - protein, 9 aa, Homo Sapiens
GGGGGLHTI

SEQ ID NO: 680375 - protein, 9 aa, Homo Sapiens
TLQAKTFED

SEQ ID NO: 680376 - protein, 9 aa, Homo Sapiens
FSYADLADG

SEQ ID NO: 680377 - protein, 9 aa, Homo Sapiens
VHEQKMILE

SEQ ID NO: 680378 - protein, 9 aa, Homo Sapiens
PKRNTTSLV

SEQ ID NO: 680379 - protein, 9 aa, Homo Sapiens
LCFEPDSTK

SEQ ID NO: 680380 - protein, 9 aa, Homo Sapiens
SNSDIAENE

SEQ ID NO: 680381 - protein, 9 aa, Homo Sapiens
FWIKCRQWL

SEQ ID NO: 680382 - protein, 9 aa, Homo Sapiens
SPESAVVED

SEQ ID NO: 680383 - protein, 9 aa, Homo Sapiens
YTLQAKTFE

SEQ ID NO: 680384 - protein, 9 aa, Homo Sapiens
QSNSAQIAN

SEQ ID NO: 680385 - protein, 9 aa, Homo Sapiens
ASLTSALVE

SEQ ID NO: 680386 - protein, 9 aa, Homo Sapiens
LAPHALVMT

SEQ ID NO: 680387 - protein, 9 aa, Homo Sapiens
ALPEALLLH

SEQ ID NO: 680388 - protein, 9 aa, Homo Sapiens
SEGEESTVL

SEQ ID NO: 680389 - protein, 9 aa, Homo Sapiens
MSLHIHEEN

SEQ ID NO: 680390 - protein, 9 aa, Homo Sapiens
PEEKIQVKT

SEQ ID NO: 680391 - protein, 9 aa, Homo Sapiens
EYQKLPPPA

SEQ ID NO: 680392 - protein, 9 aa, Homo Sapiens
PHTAPPVYL

SEQ ID NO: 680393 - protein, 9 aa, Homo Sapiens
KYTLQAKTF

SEQ ID NO: 680394 - protein, 9 aa, Homo Sapiens
CFEPDSTKA

SEQ ID NO: 680395 - protein, 9 aa, Homo Sapiens
THREITSFE

SEQ ID NO: 680396 - protein, 9 aa, Homo Sapiens
ESAGQIDLN

SEQ ID NO: 680397 - protein, 9 aa, Homo Sapiens
LVQPGSAFA

SEQ ID NO: 680398 - protein, 9 aa, Homo Sapiens
TSFWIKCRQ

SEQ ID NO: 680399 - protein, 9 aa, Homo Sapiens
TDFVLCKEG

SEQ ID NO: 680400 - protein, 9 aa, Homo Sapiens
SIDISNIKA

SEQ ID NO: 680401 - protein, 9 aa, Homo Sapiens
PKWNVCCES

SEQ ID NO: 680402 - protein, 9 aa, Homo Sapiens
NEAGTKEEP

SEQ ID NO: 680403 - protein, 9 aa, Homo Sapiens
EYVEVPFPN

SEQ ID NO: 680404 - protein, 9 aa, Homo Sapiens
IFAHLEETW

SEQ ID NO: 680405 - protein, 9 aa, Homo Sapiens
GIKEYFNVV

SEQ ID NO: 680406 - protein, 9 aa, Homo Sapiens
FVGMMSIST

SEQ ID NO: 680407 - protein, 9 aa, Homo Sapiens
GSQRELLPG

SEQ ID NO: 680408 - protein, 9 aa, Homo Sapiens
AHRSCRMEP

SEQ ID NO: 680409 - protein, 9 aa, Homo Sapiens
TLVCVGGGG

SEQ ID NO: 680410 - protein, 9 aa, Homo Sapiens
ATRGALKKN

SEQ ID NO: 680411 - protein, 9 aa, Homo Sapiens
DEMAATRGA

SEQ ID NO: 680412 - protein, 9 aa, Homo Sapiens
IQDKDRIFA

SEQ ID NO: 680413 - protein, 9 aa, Homo Sapiens
FHEIIYING

SEQ ID NO: 680414 - protein, 9 aa, Homo Sapiens
IHYPVFQTE

SEQ ID NO: 680415 - protein, 9 aa, Homo Sapiens
IDLWLDAHR

SEQ ID NO: 680416 - protein, 9 aa, Homo Sapiens
CYETHVTEG

SEQ ID NO: 680417 - protein, 9 aa, Homo Sapiens
EMAHHTLLR

SEQ ID NO: 680418 - protein, 9 aa, Homo Sapiens
PWEYQKLPP

SEQ ID NO: 680419 - protein, 9 aa, Homo Sapiens
GEDWHQTPL

SEQ ID NO: 680420 - protein, 9 aa, Homo Sapiens
GDGACTLFI

SEQ ID NO: 680421 - protein, 9 aa, Homo Sapiens
EVPTGAAGS

SEQ ID NO: 680422 - protein, 9 aa, Homo Sapiens
LGTVHCQMF

SEQ ID NO: 680423 - protein, 9 aa, Homo Sapiens
MYLLLWQLS

SEQ ID NO: 680424 - protein, 9 aa, Homo Sapiens
LEFLERTVV

SEQ ID NO: 680425 - protein, 9 aa, Homo Sapiens
VLCFEPDST

SEQ ID NO: 680426 - protein, 9 aa, Homo Sapiens
TSRDDNPRR

SEQ ID NO: 680427 - protein, 9 aa, Homo Sapiens
EQKMILEHI

SEQ ID NO: 680428 - protein, 9 aa, Homo Sapiens
CEKLDELSI

SEQ ID NO: 680429 - protein, 9 aa, Homo Sapiens
NVARVRRNE

SEQ ID NO: 680430 - protein, 9 aa, Homo Sapiens
LSFFAPQAG

SEQ ID NO: 680431 - protein, 9 aa, Homo Sapiens
GMCGPSPPC

SEQ ID NO: 680432 - protein, 9 aa, Homo Sapiens
RAQNIRNSA

SEQ ID NO: 680433 - protein, 9 aa, Homo Sapiens
AEREGGGLG

SEQ ID NO: 680434 - protein, 9 aa, Homo Sapiens
RNGPRRSPR

SEQ ID NO: 680435 - protein, 9 aa, Homo Sapiens
GTYINTTHS

SEQ ID NO: 680436 - protein, 9 aa, Homo Sapiens
MQALTSNKD

SEQ ID NO: 680437 - protein, 9 aa, Homo Sapiens
DDNPRRFRP

SEQ ID NO: 680438 - protein, 9 aa, Homo Sapiens
CQMFPQEHP

SEQ ID NO: 680439 - protein, 9 aa, Homo Sapiens
APWEYQKLP

SEQ ID NO: 680440 - protein, 9 aa, Homo Sapiens
SAKSGRQLV

SEQ ID NO: 680441 - protein, 9 aa, Homo Sapiens
DLSGTNLVA

SEQ ID NO: 680442 - protein, 9 aa, Homo Sapiens
GIVSVPLLC

SEQ ID NO: 680443 - protein, 9 aa, Homo Sapiens
PLERDICRA

SEQ ID NO: 680444 - protein, 9 aa, Homo Sapiens
KQLFSLNAG

SEQ ID NO: 680445 - protein, 9 aa, Homo Sapiens
ATVSIEITP

SEQ ID NO: 680446 - protein, 9 aa, Homo Sapiens
VYLNSDLKG

SEQ ID NO: 680447 - protein, 9 aa, Homo Sapiens
PPPQKKRKI

SEQ ID NO: 680448 - protein, 9 aa, Homo Sapiens
FAMQSIFQK

SEQ ID NO: 680449 - protein, 9 aa, Homo Sapiens
EAQLLDLEK

SEQ ID NO: 680450 - protein, 9 aa, Homo Sapiens
QEESQWPIQ

SEQ ID NO: 680451 - protein, 9 aa, Homo Sapiens
EEAQLLDLE

SEQ ID NO: 680452 - protein, 9 aa, Homo Sapiens
RESWVTEKV

SEQ ID NO: 680453 - protein, 9 aa, Homo Sapiens
KVLCFEPDS

SEQ ID NO: 680454 - protein, 9 aa, Homo Sapiens
AVEHDFVEM

SEQ ID NO: 680455 - protein, 9 aa, Homo Sapiens
APSFSQTVQ

SEQ ID NO: 680456 - protein, 9 aa, Homo Sapiens
LLRTGRYAA

SEQ ID NO: 680457 - protein, 9 aa, Homo Sapiens
KEAGMYQGT

SEQ ID NO: 680458 - protein, 9 aa, Homo Sapiens
FLHHPNIQT

SEQ ID NO: 680459 - protein, 9 aa, Homo Sapiens
TSLVGNRCA

SEQ ID NO: 680460 - protein, 9 aa, Homo Sapiens
EQALLPLVP

SEQ ID NO: 680461 - protein, 9 aa, Homo Sapiens
AVYGAKILA

SEQ ID NO: 680462 - protein, 9 aa, Homo Sapiens
PPPPQKKRK

SEQ ID NO: 680463 - protein, 9 aa, Homo Sapiens
LEEGGKNGE

SEQ ID NO: 680464 - protein, 9 aa, Homo Sapiens
LLLPLFPVQ

SEQ ID NO: 680465 - protein, 9 aa, Homo Sapiens
ALVQPGSAF

SEQ ID NO: 680466 - protein, 9 aa, Homo Sapiens
EVLKTNADI

SEQ ID NO: 680467 - protein, 9 aa, Homo Sapiens
QWPIQMVKG

SEQ ID NO: 680468 - protein, 9 aa, Homo Sapiens
GSPGTHGRI

SEQ ID NO: 680469 - protein, 9 aa, Homo Sapiens
WLDAHRSCR

SEQ ID NO: 680470 - protein, 9 aa, Homo Sapiens
KEYFNVVLG

SEQ ID NO: 680471 - protein, 9 aa, Homo Sapiens
SLTSALVEG

SEQ ID NO: 680472 - protein, 9 aa, Homo Sapiens
PVYLNSDLK

SEQ ID NO: 680473 - protein, 9 aa, Homo Sapiens
GLSIWSSQE

SEQ ID NO: 680474 - protein, 9 aa, Homo Sapiens
NSSILEISF

SEQ ID NO: 680475 - protein, 9 aa, Homo Sapiens
HGVEYFAKN

SEQ ID NO: 680476 - protein, 9 aa, Homo Sapiens
PTSLQHRSC

SEQ ID NO: 680477 - protein, 9 aa, Homo Sapiens
EEKIQVKTF

SEQ ID NO: 680478 - protein, 9 aa, Homo Sapiens
GIATGSQPE

SEQ ID NO: 680479 - protein, 9 aa, Homo Sapiens
SKKSSPTPS

SEQ ID NO: 680480 - protein, 9 aa, Homo Sapiens
SSFPISPTY

SEQ ID NO: 680481 - protein, 9 aa, Homo Sapiens
QCIQRCHVP

SEQ ID NO: 680482 - protein, 9 aa, Homo Sapiens
LAGKNCIIL

SEQ ID NO: 680483 - protein, 9 aa, Homo Sapiens
QLWDIAGQQ

SEQ ID NO: 680484 - protein, 9 aa, Homo Sapiens
AQTHKVEAV

SEQ ID NO: 680485 - protein, 9 aa, Homo Sapiens
LITHLRMSS

SEQ ID NO: 680486 - protein, 9 aa, Homo Sapiens
PPRGLLRGP

SEQ ID NO: 680487 - protein, 9 aa, Homo Sapiens
KQLEHTWGS

SEQ ID NO: 680488 - protein, 9 aa, Homo Sapiens
RRCPRQSKY

SEQ ID NO: 680489 - protein, 9 aa, Homo Sapiens
IDHQDLVSV

SEQ ID NO: 680490 - protein, 9 aa, Homo Sapiens
LSGTNLVAL

SEQ ID NO: 680491 - protein, 9 aa, Homo Sapiens
IQVKTFQAF

SEQ ID NO: 680492 - protein, 9 aa, Homo Sapiens
ESQWPIQMV

SEQ ID NO: 680493 - protein, 9 aa, Homo Sapiens
HLPKFSIAG

SEQ ID NO: 680494 - protein, 9 aa, Homo Sapiens
PVIMGHKSC

SEQ ID NO: 680495 - protein, 9 aa, Homo Sapiens
YGGETPYTH

SEQ ID NO: 680496 - protein, 9 aa, Homo Sapiens
GSVATSSST

SEQ ID NO: 680497 - protein, 9 aa, Homo Sapiens
EQLSSSRTS

SEQ ID NO: 680498 - protein, 9 aa, Homo Sapiens
EHDFVEMRK

SEQ ID NO: 680499 - protein, 9 aa, Homo Sapiens
EKTGLSIWS

SEQ ID NO: 680500 - protein, 9 aa, Homo Sapiens
NKQLFSLNA

SEQ ID NO: 680501 - protein, 9 aa, Homo Sapiens
PLAQTHKVE

SEQ ID NO: 680502 - protein, 9 aa, Homo Sapiens
VQPGSAFAD

SEQ ID NO: 680503 - protein, 9 aa, Homo Sapiens
ILGSAAAEQ

SEQ ID NO: 680504 - protein, 9 aa, Homo Sapiens
PPVPASPQW

SEQ ID NO: 680505 - protein, 9 aa, Homo Sapiens
RLKDLKDRL

SEQ ID NO: 680506 - protein, 9 aa, Homo Sapiens
RSELKDAVE

SEQ ID NO: 680507 - protein, 9 aa, Homo Sapiens
RGEYVEVPF

SEQ ID NO: 680508 - protein, 9 aa, Homo Sapiens
LLPLFPVQV

SEQ ID NO: 680509 - protein, 9 aa, Homo Sapiens
TLEKLEVDR

SEQ ID NO: 680510 - protein, 9 aa, Homo Sapiens
SEASLTSAL

SEQ ID NO: 680511 - protein, 9 aa, Homo Sapiens
PSAASATVS

SEQ ID NO: 680512 - protein, 9 aa, Homo Sapiens
RIFAMQSIF

SEQ ID NO: 680513 - protein, 9 aa, Homo Sapiens
VRIYGGETP

SEQ ID NO: 680514 - protein, 9 aa, Homo Sapiens
IKCRQWLLA

SEQ ID NO: 680515 - protein, 9 aa, Homo Sapiens
EAAETGSPT

SEQ ID NO: 680516 - protein, 9 aa, Homo Sapiens
TQKYGWLGK

SEQ ID NO: 680517 - protein, 9 aa, Homo Sapiens
FNVVLGTQL

SEQ ID NO: 680518 - protein, 9 aa, Homo Sapiens
ERLRSELKD

SEQ ID NO: 680519 - protein, 9 aa, Homo Sapiens
KSTVSRCCN

SEQ ID NO: 680520 - protein, 9 aa, Homo Sapiens
QKYGWLGKI

SEQ ID NO: 680521 - protein, 9 aa, Homo Sapiens
QLLDLEKAL

SEQ ID NO: 680522 - protein, 9 aa, Homo Sapiens
EGHSEASLT

SEQ ID NO: 680523 - protein, 9 aa, Homo Sapiens
LNRGEYVEV

SEQ ID NO: 680524 - protein, 9 aa, Homo Sapiens
GACTLFIID

SEQ ID NO: 680525 - protein, 9 aa, Homo Sapiens
KIYLQDKFR

SEQ ID NO: 680526 - protein, 9 aa, Homo Sapiens
KKSSPTPSP

SEQ ID NO: 680527 - protein, 9 aa, Homo Sapiens
LEETWSFLD

SEQ ID NO: 680528 - protein, 9 aa, Homo Sapiens
QKKRKITVD

SEQ ID NO: 680529 - protein, 9 aa, Homo Sapiens
SFSQTVQTT

SEQ ID NO: 680530 - protein, 9 aa, Homo Sapiens
CSAPWPLFD

SEQ ID NO: 680531 - protein, 9 aa, Homo Sapiens
KKIYLQDKF

SEQ ID NO: 680532 - protein, 9 aa, Homo Sapiens
VSIEITPTN

SEQ ID NO: 680533 - protein, 9 aa, Homo Sapiens
AQLLDLEKA

SEQ ID NO: 680534 - protein, 9 aa, Homo Sapiens
CTTSIMHNL

SEQ ID NO: 680535 - protein, 9 aa, Homo Sapiens
SQWPIQMVK

SEQ ID NO: 680536 - protein, 9 aa, Homo Sapiens
SIEKAKNEP

SEQ ID NO: 680537 - protein, 9 aa, Homo Sapiens
KIRTLEKLE

SEQ ID NO: 680538 - protein, 9 aa, Homo Sapiens
HMPMYLLLW

SEQ ID NO: 680539 - protein, 9 aa, Homo Sapiens
GETPYTHKE

SEQ ID NO: 680540 - protein, 9 aa, Homo Sapiens
YIPALLWLL

SEQ ID NO: 680541 - protein, 9 aa, Homo Sapiens
VAVVFEVHK

SEQ ID NO: 680542 - protein, 9 aa, Homo Sapiens
MSISTLWGN

SEQ ID NO: 680543 - protein, 9 aa, Homo Sapiens
SVPSHPLLK

SEQ ID NO: 680544 - protein, 9 aa, Homo Sapiens
LKIRTLEKL

SEQ ID NO: 680545 - protein, 9 aa, Homo Sapiens
EFLNESSVM

SEQ ID NO: 680546 - protein, 9 aa, Homo Sapiens
NNSAVVDMK

SEQ ID NO: 680547 - protein, 9 aa, Homo Sapiens
FFAPQAGAR

SEQ ID NO: 680548 - protein, 9 aa, Homo Sapiens
AYANKKPFY

SEQ ID NO: 680549 - protein, 9 aa, Homo Sapiens
TIRVWDYAT

SEQ ID NO: 680550 - protein, 9 aa, Homo Sapiens
FPKWNVCCE

SEQ ID NO: 680551 - protein, 9 aa, Homo Sapiens
SSSGSFSYA

SEQ ID NO: 680552 - protein, 9 aa, Homo Sapiens
LDAYANKKP

SEQ ID NO: 680553 - protein, 9 aa, Homo Sapiens
FLTATLQNI

SEQ ID NO: 680554 - protein, 9 aa, Homo Sapiens
PKYKTVSEP

SEQ ID NO: 680555 - protein, 9 aa, Homo Sapiens
LLCKEEFIK

SEQ ID NO: 680556 - protein, 9 aa, Homo Sapiens
QIYVIGGTT

SEQ ID NO: 680557 - protein, 9 aa, Homo Sapiens
NGQIYVIGG

SEQ ID NO: 680558 - protein, 9 aa, Homo Sapiens
VGKAPSEDL

SEQ ID NO: 680559 - protein, 9 aa, Homo Sapiens
LGQPGLMAQ

SEQ ID NO: 680560 - protein, 9 aa, Homo Sapiens
LACPCLCTE

SEQ ID NO: 680561 - protein, 9 aa, Homo Sapiens
YAANVLSQI

SEQ ID NO: 680562 - protein, 9 aa, Homo Sapiens
SSLKATQAE

SEQ ID NO: 680563 - protein, 9 aa, Homo Sapiens
VVLERGQYP

SEQ ID NO: 680564 - protein, 9 aa, Homo Sapiens
IIEHTNPAF

SEQ ID NO: 680565 - protein, 9 aa, Homo Sapiens
PRHKEDRSP

SEQ ID NO: 680566 - protein, 9 aa, Homo Sapiens
DLDHYEIKE

SEQ ID NO: 680567 - protein, 9 aa, Homo Sapiens
QMLLFELFS

SEQ ID NO: 680568 - protein, 9 aa, Homo Sapiens
SNHRQAEDG

SEQ ID NO: 680569 - protein, 9 aa, Homo Sapiens
DISPTPLLD

SEQ ID NO: 680570 - protein, 9 aa, Homo Sapiens
PNGKIATPL

SEQ ID NO: 680571 - protein, 9 aa, Homo Sapiens
SPRHKEDRS

SEQ ID NO: 680572 - protein, 9 aa, Homo Sapiens
SYYNGTYWP

SEQ ID NO: 680573 - protein, 9 aa, Homo Sapiens
MQLACTDIT

SEQ ID NO: 680574 - protein, 9 aa, Homo Sapiens
DASLVSTGH

SEQ ID NO: 680575 - protein, 9 aa, Homo Sapiens
SHLLAHTCY

SEQ ID NO: 680576 - protein, 9 aa, Homo Sapiens
MHILHLFIQ

SEQ ID NO: 680577 - protein, 9 aa, Homo Sapiens
YVTIMRKEV

SEQ ID NO: 680578 - protein, 9 aa, Homo Sapiens
RFLSEPFQV

SEQ ID NO: 680579 - protein, 9 aa, Homo Sapiens
ECHQEDMKH

SEQ ID NO: 680580 - protein, 9 aa, Homo Sapiens
DVDVSVPKM

SEQ ID NO: 680581 - protein, 9 aa, Homo Sapiens
TWREGWRSC

SEQ ID NO: 680582 - protein, 9 aa, Homo Sapiens
KLISSYYNG

SEQ ID NO: 680583 - protein, 9 aa, Homo Sapiens
RQRLQEDKM

SEQ ID NO: 680584 - protein, 9 aa, Homo Sapiens
HQEDMKHKG

SEQ ID NO: 680585 - protein, 9 aa, Homo Sapiens
PGFPVSFPL

SEQ ID NO: 680586 - protein, 9 aa, Homo Sapiens
RHVAGAVGV

SEQ ID NO: 680587 - protein, 9 aa, Homo Sapiens
ILQVHHMAS

SEQ ID NO: 680588 - protein, 9 aa, Homo Sapiens
ESGSSGKLS

SEQ ID NO: 680589 - protein, 9 aa, Homo Sapiens
VSFPLAYPP

SEQ ID NO: 680590 - protein, 9 aa, Homo Sapiens
AEWEELKKK

SEQ ID NO: 680591 - protein, 9 aa, Homo Sapiens
FERLASEAL

SEQ ID NO: 680592 - protein, 9 aa, Homo Sapiens
DQHQREQRR

SEQ ID NO: 680593 - protein, 9 aa, Homo Sapiens
EGGDLPGVG

SEQ ID NO: 680594 - protein, 9 aa, Homo Sapiens
AECHQEDMK

SEQ ID NO: 680595 - protein, 9 aa, Homo Sapiens
EYTRSPRQN

SEQ ID NO: 680596 - protein, 9 aa, Homo Sapiens
MMGEDHHGD

SEQ ID NO: 680597 - protein, 9 aa, Homo Sapiens
EKQYLSAEQ

SEQ ID NO: 680598 - protein, 9 aa, Homo Sapiens
VPQCVEDGD

SEQ ID NO: 680599 - protein, 9 aa, Homo Sapiens
AAATSSSEA

SEQ ID NO: 680600 - protein, 9 aa, Homo Sapiens
YEIKEEEPI

SEQ ID NO: 680601 - protein, 9 aa, Homo Sapiens
MTLSERFTS

SEQ ID NO: 680602 - protein, 9 aa, Homo Sapiens
KCSTPQEIK

SEQ ID NO: 680603 - protein, 9 aa, Homo Sapiens
QREQRREGD

SEQ ID NO: 680604 - protein, 9 aa, Homo Sapiens
LTVVMLFYG

SEQ ID NO: 680605 - protein, 9 aa, Homo Sapiens
LEKQIRHPS

SEQ ID NO: 680606 - protein, 9 aa, Homo Sapiens
KQIRHPSPP

SEQ ID NO: 680607 - protein, 9 aa, Homo Sapiens
YSEFIQFLS

SEQ ID NO: 680608 - protein, 9 aa, Homo Sapiens
SYVAICKPL

SEQ ID NO: 680609 - protein, 9 aa, Homo Sapiens
YFPEVTFPL

SEQ ID NO: 680610 - protein, 9 aa, Homo Sapiens
PAPLGQPGL

SEQ ID NO: 680611 - protein, 9 aa, Homo Sapiens
GQRCKSEVV

SEQ ID NO: 680612 - protein, 9 aa, Homo Sapiens
ECGECHFYK

SEQ ID NO: 680613 - protein, 9 aa, Homo Sapiens
QQDTSGKKL

SEQ ID NO: 680614 - protein, 9 aa, Homo Sapiens
PRHYSEFIQ

SEQ ID NO: 680615 - protein, 9 aa, Homo Sapiens
RFSISGGIS

SEQ ID NO: 680616 - protein, 9 aa, Homo Sapiens
QVNQSLTCV

SEQ ID NO: 680617 - protein, 9 aa, Homo Sapiens
TLSPKDQGP

SEQ ID NO: 680618 - protein, 9 aa, Homo Sapiens
GFPVSFPLA

SEQ ID NO: 680619 - protein, 9 aa, Homo Sapiens
FKEFKSFNL

SEQ ID NO: 680620 - protein, 9 aa, Homo Sapiens
EKLEQEGEE

SEQ ID NO: 680621 - protein, 9 aa, Homo Sapiens
FLALSRPSA

SEQ ID NO: 680622 - protein, 9 aa, Homo Sapiens
KIQRFLSEP

SEQ ID NO: 680623 - protein, 9 aa, Homo Sapiens
YIVSQLFVE

SEQ ID NO: 680624 - protein, 9 aa, Homo Sapiens
PLGGVGLGI

SEQ ID NO: 680625 - protein, 9 aa, Homo Sapiens
GGASNGGCK

SEQ ID NO: 680626 - protein, 9 aa, Homo Sapiens
ISESMLERL

SEQ ID NO: 680627 - protein, 9 aa, Homo Sapiens
EEAILQSKE

SEQ ID NO: 680628 - protein, 9 aa, Homo Sapiens
STPQEIKKR

SEQ ID NO: 680629 - protein, 9 aa, Homo Sapiens
EVMQLACTD

SEQ ID NO: 680630 - protein, 9 aa, Homo Sapiens
SSDEVKAAH

SEQ ID NO: 680631 - protein, 9 aa, Homo Sapiens
EIRDKNLNA

SEQ ID NO: 680632 - protein, 9 aa, Homo Sapiens
FPLAYPPPQ

SEQ ID NO: 680633 - protein, 9 aa, Homo Sapiens
GSVAKLSPT

SEQ ID NO: 680634 - protein, 9 aa, Homo Sapiens
QERELYKQV

SEQ ID NO: 680635 - protein, 9 aa, Homo Sapiens
CFAQSGRNL

SEQ ID NO: 680636 - protein, 9 aa, Homo Sapiens
EVMAFKNRT

SEQ ID NO: 680637 - protein, 9 aa, Homo Sapiens
DKNRQLTLP

SEQ ID NO: 680638 - protein, 9 aa, Homo Sapiens
CPKAWGAAY

SEQ ID NO: 680639 - protein, 9 aa, Homo Sapiens
PSHVSLAAD

SEQ ID NO: 680640 - protein, 9 aa, Homo Sapiens
IRDKNLNAV

SEQ ID NO: 680641 - protein, 9 aa, Homo Sapiens
SFSRSSFSH

SEQ ID NO: 680642 - protein, 9 aa, Homo Sapiens
PGRMLLDIL

SEQ ID NO: 680643 - protein, 9 aa, Homo Sapiens
AGASEPPPL

SEQ ID NO: 680644 - protein, 9 aa, Homo Sapiens
IYVKMRNVR

SEQ ID NO: 680645 - protein, 9 aa, Homo Sapiens
CQEEHGHSR

SEQ ID NO: 680646 - protein, 9 aa, Homo Sapiens
KLSSSLVRG

SEQ ID NO: 680647 - protein, 9 aa, Homo Sapiens
ERLASEALE

SEQ ID NO: 680648 - protein, 9 aa, Homo Sapiens
KNPRVGPVF

SEQ ID NO: 680649 - protein, 9 aa, Homo Sapiens
GRHTGEEPR

SEQ ID NO: 680650 - protein, 9 aa, Homo Sapiens
EKEHRLDYF

SEQ ID NO: 680651 - protein, 9 aa, Homo Sapiens
AFFYLDYVS

SEQ ID NO: 680652 - protein, 9 aa, Homo Sapiens
KEAEWEELK

SEQ ID NO: 680653 - protein, 9 aa, Homo Sapiens
VRTMLRMSK

SEQ ID NO: 680654 - protein, 9 aa, Homo Sapiens
LDSDEDEEL

SEQ ID NO: 680655 - protein, 9 aa, Homo Sapiens
IILLQVLIR

SEQ ID NO: 680656 - protein, 9 aa, Homo Sapiens
NSKNEQSKH

SEQ ID NO: 680657 - protein, 9 aa, Homo Sapiens
SSLDRAIRT

SEQ ID NO: 680658 - protein, 9 aa, Homo Sapiens
GLEENFCHN

SEQ ID NO: 680659 - protein, 9 aa, Homo Sapiens
LNAVGSVLS

SEQ ID NO: 680660 - protein, 9 aa, Homo Sapiens
PRRRAAKPH

SEQ ID NO: 680661 - protein, 9 aa, Homo Sapiens
SFDYSNTVI

SEQ ID NO: 680662 - protein, 9 aa, Homo Sapiens
ARQRLQEDK

SEQ ID NO: 680663 - protein, 9 aa, Homo Sapiens
IASNAEKAE

SEQ ID NO: 680664 - protein, 9 aa, Homo Sapiens
GLAEDHQQL

SEQ ID NO: 680665 - protein, 9 aa, Homo Sapiens
IQMLLFELF

SEQ ID NO: 680666 - protein, 9 aa, Homo Sapiens
AAEQCSESP

SEQ ID NO: 680667 - protein, 9 aa, Homo Sapiens
VYEHGCLLG

SEQ ID NO: 680668 - protein, 9 aa, Homo Sapiens
ERGLPKGDT

SEQ ID NO: 680669 - protein, 9 aa, Homo Sapiens
PISESMLER

SEQ ID NO: 680670 - protein, 9 aa, Homo Sapiens
LSLRQDKQK

SEQ ID NO: 680671 - protein, 9 aa, Homo Sapiens
QAVGKAPSE

SEQ ID NO: 680672 - protein, 9 aa, Homo Sapiens
RHFLVHASI

SEQ ID NO: 680673 - protein, 9 aa, Homo Sapiens
NIPQIAYST

SEQ ID NO: 680674 - protein, 9 aa, Homo Sapiens
HKEDRSPKP

SEQ ID NO: 680675 - protein, 9 aa, Homo Sapiens
KTVSEPIRW

SEQ ID NO: 680676 - protein, 9 aa, Homo Sapiens
QEDKMRRAA

SEQ ID NO: 680677 - protein, 9 aa, Homo Sapiens
HQEVMQLAC

SEQ ID NO: 680678 - protein, 9 aa, Homo Sapiens
IRTIENWGG

SEQ ID NO: 680679 - protein, 9 aa, Homo Sapiens
ARCTRRKRP

SEQ ID NO: 680680 - protein, 9 aa, Homo Sapiens
ATCIGEKIQ

SEQ ID NO: 680681 - protein, 9 aa, Homo Sapiens
IDPNPAAVS

SEQ ID NO: 680682 - protein, 9 aa, Homo Sapiens
TSSQQCLQD

SEQ ID NO: 680683 - protein, 9 aa, Homo Sapiens
SLRQDKQKN

SEQ ID NO: 680684 - protein, 9 aa, Homo Sapiens
KIKVLHSSL

SEQ ID NO: 680685 - protein, 9 aa, Homo Sapiens
QSLTCVPPM

SEQ ID NO: 680686 - protein, 9 aa, Homo Sapiens
QKQNIHDEN

SEQ ID NO: 680687 - protein, 9 aa, Homo Sapiens
FHVGSGEGG

SEQ ID NO: 680688 - protein, 9 aa, Homo Sapiens
GDKIAQKSF

SEQ ID NO: 680689 - protein, 9 aa, Homo Sapiens
AAAEHGRLR

SEQ ID NO: 680690 - protein, 9 aa, Homo Sapiens
ACPKAWGAA

SEQ ID NO: 680691 - protein, 9 aa, Homo Sapiens
YMYNREEYA

SEQ ID NO: 680692 - protein, 9 aa, Homo Sapiens
DIDLGLAED

SEQ ID NO: 680693 - protein, 9 aa, Homo Sapiens
PSLHHIIKG

SEQ ID NO: 680694 - protein, 9 aa, Homo Sapiens
NGGCKAAAD

SEQ ID NO: 680695 - protein, 9 aa, Homo Sapiens
QLFVEEWRK

SEQ ID NO: 680696 - protein, 9 aa, Homo Sapiens
ISSLPSVQL

SEQ ID NO: 680697 - protein, 9 aa, Homo Sapiens
CCVSVAAGL

SEQ ID NO: 680698 - protein, 9 aa, Homo Sapiens
HNPDGDPGG

SEQ ID NO: 680699 - protein, 9 aa, Homo Sapiens
SAHLMMDKA

SEQ ID NO: 680700 - protein, 9 aa, Homo Sapiens
KVLHSSLKA

SEQ ID NO: 680701 - protein, 9 aa, Homo Sapiens
PRAERPDDR

SEQ ID NO: 680702 - protein, 9 aa, Homo Sapiens
QMAEEEAIL

SEQ ID NO: 680703 - protein, 9 aa, Homo Sapiens
GHLILTSSQ

SEQ ID NO: 680704 - protein, 9 aa, Homo Sapiens
TLKINILHK

SEQ ID NO: 680705 - protein, 9 aa, Homo Sapiens
PAAVSPTWE

SEQ ID NO: 680706 - protein, 9 aa, Homo Sapiens
SGPGDFAYV

SEQ ID NO: 680707 - protein, 9 aa, Homo Sapiens
GLVSFQGFV

SEQ ID NO: 680708 - protein, 9 aa, Homo Sapiens
KTSNKVPVV

SEQ ID NO: 680709 - protein, 9 aa, Homo Sapiens
SSEAWTAGK

SEQ ID NO: 680710 - protein, 9 aa, Homo Sapiens
QCCVSVAAG

SEQ ID NO: 680711 - protein, 9 aa, Homo Sapiens
LVSFQGFVV

SEQ ID NO: 680712 - protein, 9 aa, Homo Sapiens
AAAPAPAPL

SEQ ID NO: 680713 - protein, 9 aa, Homo Sapiens
SHKLRCHLQ

SEQ ID NO: 680714 - protein, 9 aa, Homo Sapiens
PKKGERLGG

SEQ ID NO: 680715 - protein, 9 aa, Homo Sapiens
NFCHNPDGD

SEQ ID NO: 680716 - protein, 9 aa, Homo Sapiens
VCYKQTLSL

SEQ ID NO: 680717 - protein, 9 aa, Homo Sapiens
EFIKLKDIF

SEQ ID NO: 680718 - protein, 9 aa, Homo Sapiens
KNPGLRFSI

SEQ ID NO: 680719 - protein, 9 aa, Homo Sapiens
CKRCIIEHT

SEQ ID NO: 680720 - protein, 9 aa, Homo Sapiens
SRCAAATSS

SEQ ID NO: 680721 - protein, 9 aa, Homo Sapiens
HVSQYDQDI

SEQ ID NO: 680722 - protein, 9 aa, Homo Sapiens
NIDPNPAAV

SEQ ID NO: 680723 - protein, 9 aa, Homo Sapiens
AQICRKRKL

SEQ ID NO: 680724 - protein, 9 aa, Homo Sapiens
LDVEQPDSA

SEQ ID NO: 680725 - protein, 9 aa, Homo Sapiens
PTPLLDSDE

SEQ ID NO: 680726 - protein, 9 aa, Homo Sapiens
EDMKHKGGP

SEQ ID NO: 680727 - protein, 9 aa, Homo Sapiens
AAAEQCSES

SEQ ID NO: 680728 - protein, 9 aa, Homo Sapiens
RNVRELRGR

SEQ ID NO: 680729 - protein, 9 aa, Homo Sapiens
AMRERQLVV

SEQ ID NO: 680730 - protein, 9 aa, Homo Sapiens
DGPFHVGSG

SEQ ID NO: 680731 - protein, 9 aa, Homo Sapiens
NPRVGPVFQ

SEQ ID NO: 680732 - protein, 9 aa, Homo Sapiens
EPFQVAEVF

SEQ ID NO: 680733 - protein, 9 aa, Homo Sapiens
DAVVPQCVE

SEQ ID NO: 680734 - protein, 9 aa, Homo Sapiens
RCKSEVVMN

SEQ ID NO: 680735 - protein, 9 aa, Homo Sapiens
KDHNSQFID

SEQ ID NO: 680736 - protein, 9 aa, Homo Sapiens
LFVEEWRKF

SEQ ID NO: 680737 - protein, 9 aa, Homo Sapiens
LSERFTSYQ

SEQ ID NO: 680738 - protein, 9 aa, Homo Sapiens
LKERVYDGF

SEQ ID NO: 680739 - protein, 9 aa, Homo Sapiens
FRHNERRFL

SEQ ID NO: 680740 - protein, 9 aa, Homo Sapiens
AANVLSQIP

SEQ ID NO: 680741 - protein, 9 aa, Homo Sapiens
VTTKTAGPK

SEQ ID NO: 680742 - protein, 9 aa, Homo Sapiens
YNGTYWPLW

SEQ ID NO: 680743 - protein, 9 aa, Homo Sapiens
IISDPAMRL

SEQ ID NO: 680744 - protein, 9 aa, Homo Sapiens
RTLELAHQP

SEQ ID NO: 680745 - protein, 9 aa, Homo Sapiens
ASLPPYFCQ

SEQ ID NO: 680746 - protein, 9 aa, Homo Sapiens
FSIISQEAL

SEQ ID NO: 680747 - protein, 9 aa, Homo Sapiens
LERSFAKTQ

SEQ ID NO: 680748 - protein, 9 aa, Homo Sapiens
SDLLTFNSV

SEQ ID NO: 680749 - protein, 9 aa, Homo Sapiens
FADVVLERG

SEQ ID NO: 680750 - protein, 9 aa, Homo Sapiens
RGYVFKEFK

SEQ ID NO: 680751 - protein, 9 aa, Homo Sapiens
PPLGGVGLG

SEQ ID NO: 680752 - protein, 9 aa, Homo Sapiens
WAECHQEDM

SEQ ID NO: 680753 - protein, 9 aa, Homo Sapiens
DMARRVPRS

SEQ ID NO: 680754 - protein, 9 aa, Homo Sapiens
CLKIFFSIG

SEQ ID NO: 680755 - protein, 9 aa, Homo Sapiens
RAERPDDRK

SEQ ID NO: 680756 - protein, 9 aa, Homo Sapiens
EAEWEELKK

SEQ ID NO: 680757 - protein, 9 aa, Homo Sapiens
SCNSSSFVP

SEQ ID NO: 680758 - protein, 9 aa, Homo Sapiens
VFQTPHRHK

SEQ ID NO: 680759 - protein, 9 aa, Homo Sapiens
KGPGPGASE

SEQ ID NO: 680760 - protein, 9 aa, Homo Sapiens
WLEIAHVSQ

SEQ ID NO: 680761 - protein, 9 aa, Homo Sapiens
KRPSASKTP

SEQ ID NO: 680762 - protein, 9 aa, Homo Sapiens
PPEFRNESL

SEQ ID NO: 680763 - protein, 9 aa, Homo Sapiens
PQIAYSTTS

SEQ ID NO: 680764 - protein, 9 aa, Homo Sapiens
LEQEGEEEW

SEQ ID NO: 680765 - protein, 9 aa, Homo Sapiens
TCACLKIFF

SEQ ID NO: 680766 - protein, 9 aa, Homo Sapiens
TCVPPMNPA

SEQ ID NO: 680767 - protein, 9 aa, Homo Sapiens
LAEDHQQLI

SEQ ID NO: 680768 - protein, 9 aa, Homo Sapiens
AGAVGVTWA

SEQ ID NO: 680769 - protein, 9 aa, Homo Sapiens
LPPYFCQGP

SEQ ID NO: 680770 - protein, 9 aa, Homo Sapiens
KITTSSSAP

SEQ ID NO: 680771 - protein, 9 aa, Homo Sapiens
PKSVPVSLK

SEQ ID NO: 680772 - protein, 9 aa, Homo Sapiens
EAMRERQLV

SEQ ID NO: 680773 - protein, 9 aa, Homo Sapiens
GSVSEQLPC

SEQ ID NO: 680774 - protein, 9 aa, Homo Sapiens
VAKLSPTGT

SEQ ID NO: 680775 - protein, 9 aa, Homo Sapiens
HDSGRKDSE

SEQ ID NO: 680776 - protein, 9 aa, Homo Sapiens
PYFCQGPSN

SEQ ID NO: 680777 - protein, 9 aa, Homo Sapiens
PCDVWRSKF

SEQ ID NO: 680778 - protein, 9 aa, Homo Sapiens
SLADAMHIL

SEQ ID NO: 680779 - protein, 9 aa, Homo Sapiens
VAVRSNHRQ

SEQ ID NO: 680780 - protein, 9 aa, Homo Sapiens
EKEQCCVSV

SEQ ID NO: 680781 - protein, 9 aa, Homo Sapiens
LYIVSQLFV

SEQ ID NO: 680782 - protein, 9 aa, Homo Sapiens
PQLQPFLFG

SEQ ID NO: 680783 - protein, 9 aa, Homo Sapiens
FHDSGRKDS

SEQ ID NO: 680784 - protein, 9 aa, Homo Sapiens
QRREGDHCG

SEQ ID NO: 680785 - protein, 9 aa, Homo Sapiens
PAAQDPKKG

SEQ ID NO: 680786 - protein, 9 aa, Homo Sapiens
AALNGQIYV

SEQ ID NO: 680787 - protein, 9 aa, Homo Sapiens
SQSGPGDFA

SEQ ID NO: 680788 - protein, 9 aa, Homo Sapiens
RAIRTIENW

SEQ ID NO: 680789 - protein, 9 aa, Homo Sapiens
MKHKGGPAE

SEQ ID NO: 680790 - protein, 9 aa, Homo Sapiens
CEPKYKTVS

SEQ ID NO: 680791 - protein, 9 aa, Homo Sapiens
SNAEKAEIL

SEQ ID NO: 680792 - protein, 9 aa, Homo Sapiens
SPHGSLFPH

SEQ ID NO: 680793 - protein, 9 aa, Homo Sapiens
VKDYAFLHM

SEQ ID NO: 680794 - protein, 9 aa, Homo Sapiens
HIEAQDEDQ

SEQ ID NO: 680795 - protein, 9 aa, Homo Sapiens
ALVWFGPKE

SEQ ID NO: 680796 - protein, 9 aa, Homo Sapiens
ASKTPSQWL

SEQ ID NO: 680797 - protein, 9 aa, Homo Sapiens
PKAWGAAYS

SEQ ID NO: 680798 - protein, 9 aa, Homo Sapiens
SASKTPSQW

SEQ ID NO: 680799 - protein, 9 aa, Homo Sapiens
PSRIALVWF

SEQ ID NO: 680800 - protein, 9 aa, Homo Sapiens
TCYTFEVQA

SEQ ID NO: 680801 - protein, 9 aa, Homo Sapiens
CRWASSPHG

SEQ ID NO: 680802 - protein, 9 aa, Homo Sapiens
DADIQAMQD

SEQ ID NO: 680803 - protein, 9 aa, Homo Sapiens
FAYVLPGPG

SEQ ID NO: 680804 - protein, 9 aa, Homo Sapiens
DQDIFQDLI

SEQ ID NO: 680805 - protein, 9 aa, Homo Sapiens
HAVHLEERH

SEQ ID NO: 680806 - protein, 9 aa, Homo Sapiens
GEKFAPGPL

SEQ ID NO: 680807 - protein, 9 aa, Homo Sapiens
HWKHRVATQ

SEQ ID NO: 680808 - protein, 9 aa, Homo Sapiens
EFRNESLLA

SEQ ID NO: 680809 - protein, 9 aa, Homo Sapiens
MITNIREKN

SEQ ID NO: 680810 - protein, 9 aa, Homo Sapiens
LKSDNKVVD

SEQ ID NO: 680811 - protein, 9 aa, Homo Sapiens
LSEEPQLQP

SEQ ID NO: 680812 - protein, 9 aa, Homo Sapiens
EIERSLFLR

SEQ ID NO: 680813 - protein, 9 aa, Homo Sapiens
QRFLSEPFQ

SEQ ID NO: 680814 - protein, 9 aa, Homo Sapiens
QFLSKARET

SEQ ID NO: 680815 - protein, 9 aa, Homo Sapiens
KYKTVSEPI

SEQ ID NO: 680816 - protein, 9 aa, Homo Sapiens
PLLDSDEDE

SEQ ID NO: 680817 - protein, 9 aa, Homo Sapiens
LDYFPEVTF

SEQ ID NO: 680818 - protein, 9 aa, Homo Sapiens
SAALNGQIY

SEQ ID NO: 680819 - protein, 9 aa, Homo Sapiens
QLSLRQDKQ

SEQ ID NO: 680820 - protein, 9 aa, Homo Sapiens
GSSQQEHVH

SEQ ID NO: 680821 - protein, 9 aa, Homo Sapiens
DTKKPYPAS

SEQ ID NO: 680822 - protein, 9 aa, Homo Sapiens
GNMEINKET

SEQ ID NO: 680823 - protein, 9 aa, Homo Sapiens
KGHAQPYDP

SEQ ID NO: 680824 - protein, 9 aa, Homo Sapiens
HYLPKVAVK

SEQ ID NO: 680825 - protein, 9 aa, Homo Sapiens
PPAATFGAH

SEQ ID NO: 680826 - protein, 9 aa, Homo Sapiens
KKLDVEQPD

SEQ ID NO: 680827 - protein, 9 aa, Homo Sapiens
MAASGSSAM

SEQ ID NO: 680828 - protein, 9 aa, Homo Sapiens
VHLEERHVA

SEQ ID NO: 680829 - protein, 9 aa, Homo Sapiens
KHHHSAAHG

SEQ ID NO: 680830 - protein, 9 aa, Homo Sapiens
TIPKKTSCS

SEQ ID NO: 680831 - protein, 9 aa, Homo Sapiens
CLHQEVMQL

SEQ ID NO: 680832 - protein, 9 aa, Homo Sapiens
YRFRVFAEN

SEQ ID NO: 680833 - protein, 9 aa, Homo Sapiens
ADGSFSIIS

SEQ ID NO: 680834 - protein, 9 aa, Homo Sapiens
FPEVTFPLT

SEQ ID NO: 680835 - protein, 9 aa, Homo Sapiens
QKNQEIHLS

SEQ ID NO: 680836 - protein, 9 aa, Homo Sapiens
PLLQTLHNL

SEQ ID NO: 680837 - protein, 9 aa, Homo Sapiens
VCLMVTSSS

SEQ ID NO: 680838 - protein, 9 aa, Homo Sapiens
AAVCFAQSG

SEQ ID NO: 680839 - protein, 9 aa, Homo Sapiens
SGKKLSLKQ

SEQ ID NO: 680840 - protein, 9 aa, Homo Sapiens
SQEALSCLQ

SEQ ID NO: 680841 - protein, 9 aa, Homo Sapiens
TLHNLKEGK

SEQ ID NO: 680842 - protein, 9 aa, Homo Sapiens
AAEHGRLRV

SEQ ID NO: 680843 - protein, 9 aa, Homo Sapiens
EDFFGQKGP

SEQ ID NO: 680844 - protein, 9 aa, Homo Sapiens
TTFTSQPHL

SEQ ID NO: 680845 - protein, 9 aa, Homo Sapiens
YLTVVMLFY

SEQ ID NO: 680846 - protein, 9 aa, Homo Sapiens
KERVYDGFF

SEQ ID NO: 680847 - protein, 9 aa, Homo Sapiens
AMTLSERFT

SEQ ID NO: 680848 - protein, 9 aa, Homo Sapiens
KDQGPLDIE

SEQ ID NO: 680849 - protein, 9 aa, Homo Sapiens
KEQCCVSVA

SEQ ID NO: 680850 - protein, 9 aa, Homo Sapiens
LRNPHYLPK

SEQ ID NO: 680851 - protein, 9 aa, Homo Sapiens
ITVSWDRDA

SEQ ID NO: 680852 - protein, 9 aa, Homo Sapiens
HAQPYDPNF

SEQ ID NO: 680853 - protein, 9 aa, Homo Sapiens
PGDFAYVLP

SEQ ID NO: 680854 - protein, 9 aa, Homo Sapiens
EQTGAKISV

SEQ ID NO: 680855 - protein, 9 aa, Homo Sapiens
CIDHLWTEM

SEQ ID NO: 680856 - protein, 9 aa, Homo Sapiens
ISSGQHYWE

SEQ ID NO: 680857 - protein, 9 aa, Homo Sapiens
NRYGRRGPS

SEQ ID NO: 680858 - protein, 9 aa, Homo Sapiens
FPLLKEFVH

SEQ ID NO: 680859 - protein, 9 aa, Homo Sapiens
SPPIPKTSN

SEQ ID NO: 680860 - protein, 9 aa, Homo Sapiens
CQGPSNRPP

SEQ ID NO: 680861 - protein, 9 aa, Homo Sapiens
DINDKFAEY

SEQ ID NO: 680862 - protein, 9 aa, Homo Sapiens
SIPCDVWRS

SEQ ID NO: 680863 - protein, 9 aa, Homo Sapiens
CGHMMGEDH

SEQ ID NO: 680864 - protein, 9 aa, Homo Sapiens
TITVSWDRD

SEQ ID NO: 680865 - protein, 9 aa, Homo Sapiens
LSEDFFGQK

SEQ ID NO: 680866 - protein, 9 aa, Homo Sapiens
EEDINDKFA

SEQ ID NO: 680867 - protein, 9 aa, Homo Sapiens
LVHASIAAG

SEQ ID NO: 680868 - protein, 9 aa, Homo Sapiens
ISPGRMLLD

SEQ ID NO: 680869 - protein, 9 aa, Homo Sapiens
TQFTLPRFL

SEQ ID NO: 680870 - protein, 9 aa, Homo Sapiens
NPHYLPKVA

SEQ ID NO: 680871 - protein, 9 aa, Homo Sapiens
DSSGSVSEQ

SEQ ID NO: 680872 - protein, 9 aa, Homo Sapiens
VTCKSPRHK

SEQ ID NO: 680873 - protein, 9 aa, Homo Sapiens
EFIQFLSKA

SEQ ID NO: 680874 - protein, 9 aa, Homo Sapiens
GCGFKTATW

SEQ ID NO: 680875 - protein, 9 aa, Homo Sapiens
KRCIIEHTN

SEQ ID NO: 680876 - protein, 9 aa, Homo Sapiens
NYGCTIPKK

SEQ ID NO: 680877 - protein, 9 aa, Homo Sapiens
IRKDSSGSV

SEQ ID NO: 680878 - protein, 9 aa, Homo Sapiens
HHGDASPRA

SEQ ID NO: 680879 - protein, 9 aa, Homo Sapiens
LWTEMITNI

SEQ ID NO: 680880 - protein, 9 aa, Homo Sapiens
EKSPSHVSL

SEQ ID NO: 680881 - protein, 9 aa, Homo Sapiens
KSEFTQQLN

SEQ ID NO: 680882 - protein, 9 aa, Homo Sapiens
SSKEAEWEE

SEQ ID NO: 680883 - protein, 9 aa, Homo Sapiens
NVRELRGRL

SEQ ID NO: 680884 - protein, 9 aa, Homo Sapiens
THADSSGCL

SEQ ID NO: 680885 - protein, 9 aa, Homo Sapiens
WGFRHNERR

SEQ ID NO: 680886 - protein, 9 aa, Homo Sapiens
QQEHVHIEA

SEQ ID NO: 680887 - protein, 9 aa, Homo Sapiens
SEKLEQEGE

SEQ ID NO: 680888 - protein, 9 aa, Homo Sapiens
GTGNMEINK

SEQ ID NO: 680889 - protein, 9 aa, Homo Sapiens
KQKNQEIHL

SEQ ID NO: 680890 - protein, 9 aa, Homo Sapiens
SVSEQLPCR

SEQ ID NO: 680891 - protein, 9 aa, Homo Sapiens
MLLFELFSL

SEQ ID NO: 680892 - protein, 9 aa, Homo Sapiens
GVATLNGSF

SEQ ID NO: 680893 - protein, 9 aa, Homo Sapiens
RPGTWREGW

SEQ ID NO: 680894 - protein, 9 aa, Homo Sapiens
VATQFTLPR

SEQ ID NO: 680895 - protein, 9 aa, Homo Sapiens
GQCDGPFHV

SEQ ID NO: 680896 - protein, 9 aa, Homo Sapiens
SFSIISQEA

SEQ ID NO: 680897 - protein, 9 aa, Homo Sapiens
KMCLVAASG

SEQ ID NO: 680898 - protein, 9 aa, Homo Sapiens
EVCLLKSDN

SEQ ID NO: 680899 - protein, 9 aa, Homo Sapiens
SPAAQDPKK

SEQ ID NO: 680900 - protein, 9 aa, Homo Sapiens
TECGECHFY

SEQ ID NO: 680901 - protein, 9 aa, Homo Sapiens
AAPGPTEGV

SEQ ID NO: 680902 - protein, 9 aa, Homo Sapiens
TDASLVSTG

SEQ ID NO: 680903 - protein, 9 aa, Homo Sapiens
HYSEFIQFL

SEQ ID NO: 680904 - protein, 9 aa, Homo Sapiens
GDLPGVGSS

SEQ ID NO: 680905 - protein, 9 aa, Homo Sapiens
AGLAAMPMA

SEQ ID NO: 680906 - protein, 9 aa, Homo Sapiens
QGVDDVIGC

SEQ ID NO: 680907 - protein, 9 aa, Homo Sapiens
MGKDLQGAT

SEQ ID NO: 680908 - protein, 9 aa, Homo Sapiens
SAAHGHDAV

SEQ ID NO: 680909 - protein, 9 aa, Homo Sapiens
TSLCKSSFL

SEQ ID NO: 680910 - protein, 9 aa, Homo Sapiens
AKTQYPDIF

SEQ ID NO: 680911 - protein, 9 aa, Homo Sapiens
EVGPAPQGK

SEQ ID NO: 680912 - protein, 9 aa, Homo Sapiens
DNVLPSAHL

SEQ ID NO: 680913 - protein, 9 aa, Homo Sapiens
SLLVTDASL

SEQ ID NO: 680914 - protein, 9 aa, Homo Sapiens
GPFHVGSGE

SEQ ID NO: 680915 - protein, 9 aa, Homo Sapiens
EMITNIREK

SEQ ID NO: 680916 - protein, 9 aa, Homo Sapiens
SSQQEHVHI

SEQ ID NO: 680917 - protein, 9 aa, Homo Sapiens
SSDEKSPSH

SEQ ID NO: 680918 - protein, 9 aa, Homo Sapiens
PIPKTSNKV

SEQ ID NO: 680919 - protein, 9 aa, Homo Sapiens
QHQREQRRE

SEQ ID NO: 680920 - protein, 9 aa, Homo Sapiens
WQYSLAKRC

SEQ ID NO: 680921 - protein, 9 aa, Homo Sapiens
SNPQSSGLD

SEQ ID NO: 680922 - protein, 9 aa, Homo Sapiens
EPSTTFTSQ

SEQ ID NO: 680923 - protein, 9 aa, Homo Sapiens
NAVIHALQT

SEQ ID NO: 680924 - protein, 9 aa, Homo Sapiens
KAEILHSAC

SEQ ID NO: 680925 - protein, 9 aa, Homo Sapiens
STVEKIAIK

SEQ ID NO: 680926 - protein, 9 aa, Homo Sapiens
HRQAEDGAK

SEQ ID NO: 680927 - protein, 9 aa, Homo Sapiens
HCGHMMGED

SEQ ID NO: 680928 - protein, 9 aa, Homo Sapiens
ISQQDTSGK

SEQ ID NO: 680929 - protein, 9 aa, Homo Sapiens
GSLPSLHHI

SEQ ID NO: 680930 - protein, 9 aa, Homo Sapiens
VTIMRKEVW

SEQ ID NO: 680931 - protein, 9 aa, Homo Sapiens
LLQVLIRIS

SEQ ID NO: 680932 - protein, 9 aa, Homo Sapiens
SHVSLAADT

SEQ ID NO: 680933 - protein, 9 aa, Homo Sapiens
HASAALNGQ

SEQ ID NO: 680934 - protein, 9 aa, Homo Sapiens
VGVTWAECH

SEQ ID NO: 680935 - protein, 9 aa, Homo Sapiens
SARCTRRKR

SEQ ID NO: 680936 - protein, 9 aa, Homo Sapiens
GHDLSVDFW

SEQ ID NO: 680937 - protein, 9 aa, Homo Sapiens
AHDLVLTLS

SEQ ID NO: 680938 - protein, 9 aa, Homo Sapiens
GRPRLRPSR

SEQ ID NO: 680939 - protein, 9 aa, Homo Sapiens
LVPVAEVLD

SEQ ID NO: 680940 - protein, 9 aa, Homo Sapiens
EALEPMVLR

SEQ ID NO: 680941 - protein, 9 aa, Homo Sapiens
ICRKRKLEN

SEQ ID NO: 680942 - protein, 9 aa, Homo Sapiens
SGCLCPAPT

SEQ ID NO: 680943 - protein, 9 aa, Homo Sapiens
EMLSYQDDK

SEQ ID NO: 680944 - protein, 9 aa, Homo Sapiens
GFYLTVVML

SEQ ID NO: 680945 - protein, 9 aa, Homo Sapiens
ERLGLFFMD

SEQ ID NO: 680946 - protein, 9 aa, Homo Sapiens
EGDHCGHMM

SEQ ID NO: 680947 - protein, 9 aa, Homo Sapiens
DEDPEQDGQ

SEQ ID NO: 680948 - protein, 9 aa, Homo Sapiens
LPGVGSSQQ

SEQ ID NO: 680949 - protein, 9 aa, Homo Sapiens
LHYVTIMRK

SEQ ID NO: 680950 - protein, 9 aa, Homo Sapiens
VPQERELYK

SEQ ID NO: 680951 - protein, 9 aa, Homo Sapiens
NVLPSAHLM

SEQ ID NO: 680952 - protein, 9 aa, Homo Sapiens
EAQDEDQHQ

SEQ ID NO: 680953 - protein, 9 aa, Homo Sapiens
GYVFKEFKS

SEQ ID NO: 680954 - protein, 9 aa, Homo Sapiens
DASPRAERP

SEQ ID NO: 680955 - protein, 9 aa, Homo Sapiens
GFKTATWLE

SEQ ID NO: 680956 - protein, 9 aa, Homo Sapiens
GTWREGWRS

SEQ ID NO: 680957 - protein, 9 aa, Homo Sapiens
LCRWASSPH

SEQ ID NO: 680958 - protein, 9 aa, Homo Sapiens
VGSSQQEHV

SEQ ID NO: 680959 - protein, 9 aa, Homo Sapiens
QAGSAACLG

SEQ ID NO: 680960 - protein, 9 aa, Homo Sapiens
SFCLHQEVM

SEQ ID NO: 680961 - protein, 9 aa, Homo Sapiens
CIIEHTNPA

SEQ ID NO: 680962 - protein, 9 aa, Homo Sapiens
GSAACLGHG

SEQ ID NO: 680963 - protein, 9 aa, Homo Sapiens
NILHKQASG

SEQ ID NO: 680964 - protein, 9 aa, Homo Sapiens
PEYKALDAL

SEQ ID NO: 680965 - protein, 9 aa, Homo Sapiens
LLVTDASLV

SEQ ID NO: 680966 - protein, 9 aa, Homo Sapiens
GVLTGPEYK

SEQ ID NO: 680967 - protein, 9 aa, Homo Sapiens
LGLPSRIAL

SEQ ID NO: 680968 - protein, 9 aa, Homo Sapiens
GPAPQGKAF

SEQ ID NO: 680969 - protein, 9 aa, Homo Sapiens
ACLGHGAAQ

SEQ ID NO: 680970 - protein, 9 aa, Homo Sapiens
VSPISESML

SEQ ID NO: 680971 - protein, 9 aa, Homo Sapiens
LIASAGANA

SEQ ID NO: 680972 - protein, 9 aa, Homo Sapiens
HRVATQFTL

SEQ ID NO: 680973 - protein, 9 aa, Homo Sapiens
KFCSSLLAL

SEQ ID NO: 680974 - protein, 9 aa, Homo Sapiens
IEDSYTKQV

SEQ ID NO: 680975 - protein, 9 aa, Homo Sapiens
IQLVPVAEV

SEQ ID NO: 680976 - protein, 9 aa, Homo Sapiens
LQEQTGAKI

SEQ ID NO: 680977 - protein, 9 aa, Homo Sapiens
TAGKSLPTS

SEQ ID NO: 680978 - protein, 9 aa, Homo Sapiens
KAFLQKQNI

SEQ ID NO: 680979 - protein, 9 aa, Homo Sapiens
MGEDHHGDA

SEQ ID NO: 680980 - protein, 9 aa, Homo Sapiens
GAHDLVLTL

SEQ ID NO: 680981 - protein, 9 aa, Homo Sapiens
GIQTMAASG

SEQ ID NO: 680982 - protein, 9 aa, Homo Sapiens
RSQAGGGRM

SEQ ID NO: 680983 - protein, 9 aa, Homo Sapiens
DVWELIWMK

SEQ ID NO: 680984 - protein, 9 aa, Homo Sapiens
RIEKNPGLR

SEQ ID NO: 680985 - protein, 9 aa, Homo Sapiens
RLRPSRCAA

SEQ ID NO: 680986 - protein, 9 aa, Homo Sapiens
FLVHASIAA

SEQ ID NO: 680987 - protein, 9 aa, Homo Sapiens
SPSHVSLAA

SEQ ID NO: 680988 - protein, 9 aa, Homo Sapiens
PDGHLILTS

SEQ ID NO: 680989 - protein, 9 aa, Homo Sapiens
MAFKNRTLG

SEQ ID NO: 680990 - protein, 9 aa, Homo Sapiens
YVSISYYGF

SEQ ID NO: 680991 - protein, 9 aa, Homo Sapiens
TWAECHQED

SEQ ID NO: 680992 - protein, 9 aa, Homo Sapiens
PKDQGPLDI

SEQ ID NO: 680993 - protein, 9 aa, Homo Sapiens
QKSEFTQQL

SEQ ID NO: 680994 - protein, 9 aa, Homo Sapiens
QCVEDGDVA

SEQ ID NO: 680995 - protein, 9 aa, Homo Sapiens
IVSQLFVEE

SEQ ID NO: 680996 - protein, 9 aa, Homo Sapiens
RWASSPHGS

SEQ ID NO: 680997 - protein, 9 aa, Homo Sapiens
EKIQDFKVG

SEQ ID NO: 680998 - protein, 9 aa, Homo Sapiens
AASGSSAMS

SEQ ID NO: 680999 - protein, 9 aa, Homo Sapiens
TMAASGSSA

SEQ ID NO: 681000 - protein, 9 aa, Homo Sapiens
QDSLLQIQD

SEQ ID NO: 681001 - protein, 9 aa, Homo Sapiens
IQAMQDSLL

SEQ ID NO: 681002 - protein, 9 aa, Homo Sapiens
SSSEAWTAG

SEQ ID NO: 681003 - protein, 9 aa, Homo Sapiens
CKSHVDTKK

SEQ ID NO: 681004 - protein, 9 aa, Homo Sapiens
ERPDDRKHH

SEQ ID NO: 681005 - protein, 9 aa, Homo Sapiens
SLPTSELPS

SEQ ID NO: 681006 - protein, 9 aa, Homo Sapiens
SDNKVVDNQ

SEQ ID NO: 681007 - protein, 9 aa, Homo Sapiens
SELPSARCT

SEQ ID NO: 681008 - protein, 9 aa, Homo Sapiens
PGMKNAVIH

SEQ ID NO: 681009 - protein, 9 aa, Homo Sapiens
RVGPVFQTP

SEQ ID NO: 681010 - protein, 9 aa, Homo Sapiens
GASNGGCKA

SEQ ID NO: 681011 - protein, 9 aa, Homo Sapiens
FCQAVGKAP

SEQ ID NO: 681012 - protein, 9 aa, Homo Sapiens
NESLLASTL

SEQ ID NO: 681013 - protein, 9 aa, Homo Sapiens
PQEIKKRKK

SEQ ID NO: 681014 - protein, 9 aa, Homo Sapiens
TQAGSAACL

SEQ ID NO: 681015 - protein, 9 aa, Homo Sapiens
SQQEHVHIE

SEQ ID NO: 681016 - protein, 9 aa, Homo Sapiens
PVFQTPHRH

SEQ ID NO: 681017 - protein, 9 aa, Homo Sapiens
FLGSTVQME

SEQ ID NO: 681018 - protein, 9 aa, Homo Sapiens
RPFPTEQSI

SEQ ID NO: 681019 - protein, 9 aa, Homo Sapiens
GSGEGGDLP

SEQ ID NO: 681020 - protein, 9 aa, Homo Sapiens
SPHTVHYCH

SEQ ID NO: 681021 - protein, 9 aa, Homo Sapiens
YAEIRDKNL

SEQ ID NO: 681022 - protein, 9 aa, Homo Sapiens
PYRPGTWRE

SEQ ID NO: 681023 - protein, 9 aa, Homo Sapiens
HYEIKEEEP

SEQ ID NO: 681024 - protein, 9 aa, Homo Sapiens
LHNLKEGKH

SEQ ID NO: 681025 - protein, 9 aa, Homo Sapiens
FVPSGRRGR

SEQ ID NO: 681026 - protein, 9 aa, Homo Sapiens
SRDISGLNN

SEQ ID NO: 681027 - protein, 9 aa, Homo Sapiens
DSYTKQVEV

SEQ ID NO: 681028 - protein, 9 aa, Homo Sapiens
RHTGEEPRR

SEQ ID NO: 681029 - protein, 9 aa, Homo Sapiens
YPILQVHHM

SEQ ID NO: 681030 - protein, 9 aa, Homo Sapiens
RDKNLNAVG

SEQ ID NO: 681031 - protein, 9 aa, Homo Sapiens
GFRHNERRF

SEQ ID NO: 681032 - protein, 9 aa, Homo Sapiens
VLSQIPAVH

SEQ ID NO: 681033 - protein, 9 aa, Homo Sapiens
YKQVNCFFS

SEQ ID NO: 681034 - protein, 9 aa, Homo Sapiens
ACFRQDGRT

SEQ ID NO: 681035 - protein, 9 aa, Homo Sapiens
HGHDAVVPQ

SEQ ID NO: 681036 - protein, 9 aa, Homo Sapiens
SGRPRLRPS

SEQ ID NO: 681037 - protein, 9 aa, Homo Sapiens
VNQSLTCVP

SEQ ID NO: 681038 - protein, 9 aa, Homo Sapiens
DGIAHDQHA

SEQ ID NO: 681039 - protein, 9 aa, Homo Sapiens
SQCISSGQH

SEQ ID NO: 681040 - protein, 9 aa, Homo Sapiens
CKEEFIKLK

SEQ ID NO: 681041 - protein, 9 aa, Homo Sapiens
LQTLHNLKE

SEQ ID NO: 681042 - protein, 9 aa, Homo Sapiens
LMVTSSSTS

SEQ ID NO: 681043 - protein, 9 aa, Homo Sapiens
IEAQDEDQH

SEQ ID NO: 681044 - protein, 9 aa, Homo Sapiens
DIVKDYAFL

SEQ ID NO: 681045 - protein, 9 aa, Homo Sapiens
GVTWAECHQ

SEQ ID NO: 681046 - protein, 9 aa, Homo Sapiens
LLGLSEEPQ

SEQ ID NO: 681047 - protein, 9 aa, Homo Sapiens
ATEEDINDK

SEQ ID NO: 681048 - protein, 9 aa, Homo Sapiens
LTSSQQCLQ

SEQ ID NO: 681049 - protein, 9 aa, Homo Sapiens
PLARNRYGR

SEQ ID NO: 681050 - protein, 9 aa, Homo Sapiens
STTFTSQPH

SEQ ID NO: 681051 - protein, 9 aa, Homo Sapiens
LRFHDSGRK

SEQ ID NO: 681052 - protein, 9 aa, Homo Sapiens
LARNRYGRR

SEQ ID NO: 681053 - protein, 9 aa, Homo Sapiens
RDISGLNNS

SEQ ID NO: 681054 - protein, 9 aa, Homo Sapiens
ANALAKVFV

SEQ ID NO: 681055 - protein, 9 aa, Homo Sapiens
IPKKTSCSV

SEQ ID NO: 681056 - protein, 9 aa, Homo Sapiens
GKSLPTSEL

SEQ ID NO: 681057 - protein, 9 aa, Homo Sapiens
GSFLALSRP

SEQ ID NO: 681058 - protein, 9 aa, Homo Sapiens
RRRAAKPHA

SEQ ID NO: 681059 - protein, 9 aa, Homo Sapiens
CGECHFYKD

SEQ ID NO: 681060 - protein, 9 aa, Homo Sapiens
PRVGPVFQT

SEQ ID NO: 681061 - protein, 9 aa, Homo Sapiens
GQKGPGPGA

SEQ ID NO: 681062 - protein, 9 aa, Homo Sapiens
MVTSSSTSL

SEQ ID NO: 681063 - protein, 9 aa, Homo Sapiens
VSWDRDAAP

SEQ ID NO: 681064 - protein, 9 aa, Homo Sapiens
VKRPATRQG

SEQ ID NO: 681065 - protein, 9 aa, Homo Sapiens
YTKQVEVDA

SEQ ID NO: 681066 - protein, 9 aa, Homo Sapiens
NQRQDAQGT

SEQ ID NO: 681067 - protein, 9 aa, Homo Sapiens
HRVVESLDV

SEQ ID NO: 681068 - protein, 9 aa, Homo Sapiens
KEEFIKLKD

SEQ ID NO: 681069 - protein, 9 aa, Homo Sapiens
KNRQLTLPE

SEQ ID NO: 681070 - protein, 9 aa, Homo Sapiens
SMALPQEFA

SEQ ID NO: 681071 - protein, 9 aa, Homo Sapiens
EFTQQLNAL

SEQ ID NO: 681072 - protein, 9 aa, Homo Sapiens
TVVMLFYGS

SEQ ID NO: 681073 - protein, 9 aa, Homo Sapiens
EPKYKTVSE

SEQ ID NO: 681074 - protein, 9 aa, Homo Sapiens
IFLTATLQN

SEQ ID NO: 681075 - protein, 9 aa, Homo Sapiens
LGPLQISPG

SEQ ID NO: 681076 - protein, 9 aa, Homo Sapiens
AAWACFRQD

SEQ ID NO: 681077 - protein, 9 aa, Homo Sapiens
DKQGVDDVI

SEQ ID NO: 681078 - protein, 9 aa, Homo Sapiens
FIQLVPVAE

SEQ ID NO: 681079 - protein, 9 aa, Homo Sapiens
LILTSSQQC

SEQ ID NO: 681080 - protein, 9 aa, Homo Sapiens
QEYEIERSL

SEQ ID NO: 681081 - protein, 9 aa, Homo Sapiens
DANKRSLIN

SEQ ID NO: 681082 - protein, 9 aa, Homo Sapiens
EQRREGDHC

SEQ ID NO: 681083 - protein, 9 aa, Homo Sapiens
VWELIWMKF

SEQ ID NO: 681084 - protein, 9 aa, Homo Sapiens
ATSSSEAWT

SEQ ID NO: 681085 - protein, 9 aa, Homo Sapiens
GRMKAISTC

SEQ ID NO: 681086 - protein, 9 aa, Homo Sapiens
QGTPPRTHQ

SEQ ID NO: 681087 - protein, 9 aa, Homo Sapiens
VSMNKAINT

SEQ ID NO: 681088 - protein, 9 aa, Homo Sapiens
IAHDQHAVH

SEQ ID NO: 681089 - protein, 9 aa, Homo Sapiens
IQTMAASGS

SEQ ID NO: 681090 - protein, 9 aa, Homo Sapiens
SKEQQGDAT

SEQ ID NO: 681091 - protein, 9 aa, Homo Sapiens
HVDTKKPYP

SEQ ID NO: 681092 - protein, 9 aa, Homo Sapiens
QQGDATGSP

SEQ ID NO: 681093 - protein, 9 aa, Homo Sapiens
LCTIAHWQY

SEQ ID NO: 681094 - protein, 9 aa, Homo Sapiens
EEHGHSRRI

SEQ ID NO: 681095 - protein, 9 aa, Homo Sapiens
TCKSHVDTK

SEQ ID NO: 681096 - protein, 9 aa, Homo Sapiens
GHMMGEDHH

SEQ ID NO: 681097 - protein, 9 aa, Homo Sapiens
ERVYDGFFS

SEQ ID NO: 681098 - protein, 9 aa, Homo Sapiens
LDMARRVPR

SEQ ID NO: 681099 - protein, 9 aa, Homo Sapiens
ACLKIFFSI

SEQ ID NO: 681100 - protein, 9 aa, Homo Sapiens
QTMAASGSS

SEQ ID NO: 681101 - protein, 9 aa, Homo Sapiens
PILQVHHMA

SEQ ID NO: 681102 - protein, 9 aa, Homo Sapiens
EIKEEEPIS

SEQ ID NO: 681103 - protein, 9 aa, Homo Sapiens
AACLGHGAA

SEQ ID NO: 681104 - protein, 9 aa, Homo Sapiens
FPTEQSIND

SEQ ID NO: 681105 - protein, 9 aa, Homo Sapiens
AEDEDPEQD

SEQ ID NO: 681106 - protein, 9 aa, Homo Sapiens
AAMPMAEGL

SEQ ID NO: 681107 - protein, 9 aa, Homo Sapiens
NFADVVLER

SEQ ID NO: 681108 - protein, 9 aa, Homo Sapiens
QYPDIFMRE

SEQ ID NO: 681109 - protein, 9 aa, Homo Sapiens
FVHRVVESL

SEQ ID NO: 681110 - protein, 9 aa, Homo Sapiens
WTFQELEAL

SEQ ID NO: 681111 - protein, 9 aa, Homo Sapiens
LAAMPMAEG

SEQ ID NO: 681112 - protein, 9 aa, Homo Sapiens
SESMLERLS

SEQ ID NO: 681113 - protein, 9 aa, Homo Sapiens
EKQIRHPSP

SEQ ID NO: 681114 - protein, 9 aa, Homo Sapiens
KYKEAVAEY

SEQ ID NO: 681115 - protein, 9 aa, Homo Sapiens
ESMLERLSK

SEQ ID NO: 681116 - protein, 9 aa, Homo Sapiens
YFCQAVGKA

SEQ ID NO: 681117 - protein, 9 aa, Homo Sapiens
SSLPSVQLS

SEQ ID NO: 681118 - protein, 9 aa, Homo Sapiens
KSFSRSSFS

SEQ ID NO: 681119 - protein, 9 aa, Homo Sapiens
VLHSSLKAT

SEQ ID NO: 681120 - protein, 9 aa, Homo Sapiens
AHVSQYDQD

SEQ ID NO: 681121 - protein, 9 aa, Homo Sapiens
EHGHSRRIP

SEQ ID NO: 681122 - protein, 9 aa, Homo Sapiens
KLSPTGTSV

SEQ ID NO: 681123 - protein, 9 aa, Homo Sapiens
NEQSKHNQE

SEQ ID NO: 681124 - protein, 9 aa, Homo Sapiens
AEEEAILQS

SEQ ID NO: 681125 - protein, 9 aa, Homo Sapiens
FGQKGPGPG

SEQ ID NO: 681126 - protein, 9 aa, Homo Sapiens
DKIAQKSFS

SEQ ID NO: 681127 - protein, 9 aa, Homo Sapiens
EENFCHNPD

SEQ ID NO: 681128 - protein, 9 aa, Homo Sapiens
DLSVDFWSL

SEQ ID NO: 681129 - protein, 9 aa, Homo Sapiens
EEEAILQSK

SEQ ID NO: 681130 - protein, 9 aa, Homo Sapiens
KAAVCFAQS

SEQ ID NO: 681131 - protein, 9 aa, Homo Sapiens
MCLVAASGS

SEQ ID NO: 681132 - protein, 9 aa, Homo Sapiens
GSNPQSSGL

SEQ ID NO: 681133 - protein, 9 aa, Homo Sapiens
GKKLSLKQK

SEQ ID NO: 681134 - protein, 9 aa, Homo Sapiens
ELPSARCTR

SEQ ID NO: 681135 - protein, 9 aa, Homo Sapiens
AHTCYTFEV

SEQ ID NO: 681136 - protein, 9 aa, Homo Sapiens
RLACPKAWG

SEQ ID NO: 681137 - protein, 9 aa, Homo Sapiens
ISLVHEVDT

SEQ ID NO: 681138 - protein, 9 aa, Homo Sapiens
HLWTEMITN

SEQ ID NO: 681139 - protein, 9 aa, Homo Sapiens
ATLQNISED

SEQ ID NO: 681140 - protein, 9 aa, Homo Sapiens
QAMQDSLLQ

SEQ ID NO: 681141 - protein, 9 aa, Homo Sapiens
TNQVYAANK

SEQ ID NO: 681142 - protein, 9 aa, Homo Sapiens
DERLGLFFM

SEQ ID NO: 681143 - protein, 9 aa, Homo Sapiens
AIFLTATLQ

SEQ ID NO: 681144 - protein, 9 aa, Homo Sapiens
LVMNFADVV

SEQ ID NO: 681145 - protein, 9 aa, Homo Sapiens
SSGSVSEQL

SEQ ID NO: 681146 - protein, 9 aa, Homo Sapiens
RVPRSGRPR

SEQ ID NO: 681147 - protein, 9 aa, Homo Sapiens
TRRKRPSAS

SEQ ID NO: 681148 - protein, 9 aa, Homo Sapiens
HLPYPILQV

SEQ ID NO: 681149 - protein, 9 aa, Homo Sapiens
DAMHILHLF

SEQ ID NO: 681150 - protein, 9 aa, Homo Sapiens
HTGEEPRRR

SEQ ID NO: 681151 - protein, 9 aa, Homo Sapiens
EYEIERSLF

SEQ ID NO: 681152 - protein, 9 aa, Homo Sapiens
QTLHNLKEG

SEQ ID NO: 681153 - protein, 9 aa, Homo Sapiens
EDVWELIWM

SEQ ID NO: 681154 - protein, 9 aa, Homo Sapiens
ISQEALSCL

SEQ ID NO: 681155 - protein, 9 aa, Homo Sapiens
NKGHDLSVD

SEQ ID NO: 681156 - protein, 9 aa, Homo Sapiens
LDNVLPSAH

SEQ ID NO: 681157 - protein, 9 aa, Homo Sapiens
VQQIISDPA

SEQ ID NO: 681158 - protein, 9 aa, Homo Sapiens
DGFNKKFAQ

SEQ ID NO: 681159 - protein, 9 aa, Homo Sapiens
RPSRCAAAT

SEQ ID NO: 681160 - protein, 9 aa, Homo Sapiens
QKSFSRSSF

SEQ ID NO: 681161 - protein, 9 aa, Homo Sapiens
FSIGDDSLQ

SEQ ID NO: 681162 - protein, 9 aa, Homo Sapiens
VQLSNLKVL

SEQ ID NO: 681163 - protein, 9 aa, Homo Sapiens
NAGGDSQKD

SEQ ID NO: 681164 - protein, 9 aa, Homo Sapiens
STTSMDLSD

SEQ ID NO: 681165 - protein, 9 aa, Homo Sapiens
GCTIPKKTS

SEQ ID NO: 681166 - protein, 9 aa, Homo Sapiens
GPYIGSVAK

SEQ ID NO: 681167 - protein, 9 aa, Homo Sapiens
LHLFIQRST

SEQ ID NO: 681168 - protein, 9 aa, Homo Sapiens
GLAAMPMAE

SEQ ID NO: 681169 - protein, 9 aa, Homo Sapiens
EDGDVAVRS

SEQ ID NO: 681170 - protein, 9 aa, Homo Sapiens
MNFADVVLE

SEQ ID NO: 681171 - protein, 9 aa, Homo Sapiens
AAAPGPTEG

SEQ ID NO: 681172 - protein, 9 aa, Homo Sapiens
VYAANKDHN

SEQ ID NO: 681173 - protein, 9 aa, Homo Sapiens
FIKRMYKKE

SEQ ID NO: 681174 - protein, 9 aa, Homo Sapiens
ILSSQAGAM

SEQ ID NO: 681175 - protein, 9 aa, Homo Sapiens
FTSQPHLIF

SEQ ID NO: 681176 - protein, 9 aa, Homo Sapiens
NKDHNSQFI

SEQ ID NO: 681177 - protein, 9 aa, Homo Sapiens
ADAMHILHL

SEQ ID NO: 681178 - protein, 9 aa, Homo Sapiens
TVHYCHSYE

SEQ ID NO: 681179 - protein, 9 aa, Homo Sapiens
SPGRMLLDI

SEQ ID NO: 681180 - protein, 9 aa, Homo Sapiens
LGLVSFQGF

SEQ ID NO: 681181 - protein, 9 aa, Homo Sapiens
PYIGSVAKL

SEQ ID NO: 681182 - protein, 9 aa, Homo Sapiens
VYDGFFSPK

SEQ ID NO: 681183 - protein, 9 aa, Homo Sapiens
RAKETLKIN

SEQ ID NO: 681184 - protein, 9 aa, Homo Sapiens
ANVLSQIPA

SEQ ID NO: 681185 - protein, 9 aa, Homo Sapiens
LLKEFVHRV

SEQ ID NO: 681186 - protein, 9 aa, Homo Sapiens
YLSAEQLLD

SEQ ID NO: 681187 - protein, 9 aa, Homo Sapiens
IKQYTSNIK

SEQ ID NO: 681188 - protein, 9 aa, Homo Sapiens
PKVAVKVCL

SEQ ID NO: 681189 - protein, 9 aa, Homo Sapiens
EVLVTSRTL

SEQ ID NO: 681190 - protein, 9 aa, Homo Sapiens
KDSGIQTMA

SEQ ID NO: 681191 - protein, 9 aa, Homo Sapiens
NKVAAQICR

SEQ ID NO: 681192 - protein, 9 aa, Homo Sapiens
HRSMLQKTW

SEQ ID NO: 681193 - protein, 9 aa, Homo Sapiens
QRCKSEVVM

SEQ ID NO: 681194 - protein, 9 aa, Homo Sapiens
FEVMAFKNR

SEQ ID NO: 681195 - protein, 9 aa, Homo Sapiens
VPRSGRPRL

SEQ ID NO: 681196 - protein, 9 aa, Homo Sapiens
LDHYEIKEE

SEQ ID NO: 681197 - protein, 9 aa, Homo Sapiens
NGTEETVCY

SEQ ID NO: 681198 - protein, 9 aa, Homo Sapiens
AYSTTSMDL

SEQ ID NO: 681199 - protein, 9 aa, Homo Sapiens
MARRVPRSG

SEQ ID NO: 681200 - protein, 9 aa, Homo Sapiens
CAVSSICTL

SEQ ID NO: 681201 - protein, 9 aa, Homo Sapiens
FKTATWLEI

SEQ ID NO: 681202 - protein, 9 aa, Homo Sapiens
KVAAQICRK

SEQ ID NO: 681203 - protein, 9 aa, Homo Sapiens
APLGQPGLM

SEQ ID NO: 681204 - protein, 9 aa, Homo Sapiens
RQDGRTLLR

SEQ ID NO: 681205 - protein, 9 aa, Homo Sapiens
TKKLDVEQP

SEQ ID NO: 681206 - protein, 9 aa, Homo Sapiens
IAQKSFSRS

SEQ ID NO: 681207 - protein, 9 aa, Homo Sapiens
VIRTIKLEH

SEQ ID NO: 681208 - protein, 9 aa, Homo Sapiens
VELLRFHDS

SEQ ID NO: 681209 - protein, 9 aa, Homo Sapiens
IRPFPTEQS

SEQ ID NO: 681210 - protein, 9 aa, Homo Sapiens
DGHLILTSS

SEQ ID NO: 681211 - protein, 9 aa, Homo Sapiens
RHYSEFIQF

SEQ ID NO: 681212 - protein, 9 aa, Homo Sapiens
TVQMELSGS

SEQ ID NO: 681213 - protein, 9 aa, Homo Sapiens
LSAEQLLDS

SEQ ID NO: 681214 - protein, 9 aa, Homo Sapiens
VILNKGHDL

SEQ ID NO: 681215 - protein, 9 aa, Homo Sapiens
GGCKAAADV

SEQ ID NO: 681216 - protein, 9 aa, Homo Sapiens
KAPSEDLFP

SEQ ID NO: 681217 - protein, 9 aa, Homo Sapiens
EKAFLQKQN

SEQ ID NO: 681218 - protein, 9 aa, Homo Sapiens
SQAGGGRMK

SEQ ID NO: 681219 - protein, 9 aa, Homo Sapiens
HADSSGCLC

SEQ ID NO: 681220 - protein, 9 aa, Homo Sapiens
PTFEVMAFK

SEQ ID NO: 681221 - protein, 9 aa, Homo Sapiens
IKGHAQPYD

SEQ ID NO: 681222 - protein, 9 aa, Homo Sapiens
LDEVPWTFQ

SEQ ID NO: 681223 - protein, 9 aa, Homo Sapiens
TVIRTIKLE

SEQ ID NO: 681224 - protein, 9 aa, Homo Sapiens
LEIAHVSQY

SEQ ID NO: 681225 - protein, 9 aa, Homo Sapiens
TFEVMAFKN

SEQ ID NO: 681226 - protein, 9 aa, Homo Sapiens
RIALVWFGP

SEQ ID NO: 681227 - protein, 9 aa, Homo Sapiens
GDATGSPKQ

SEQ ID NO: 681228 - protein, 9 aa, Homo Sapiens
HHHSAAHGH

SEQ ID NO: 681229 - protein, 9 aa, Homo Sapiens
VSQYDQDIF

SEQ ID NO: 681230 - protein, 9 aa, Homo Sapiens
RTMLRMSKI

SEQ ID NO: 681231 - protein, 9 aa, Homo Sapiens
KETLKINIL

SEQ ID NO: 681232 - protein, 9 aa, Homo Sapiens
SLLASTLKT

SEQ ID NO: 681233 - protein, 9 aa, Homo Sapiens
QPDSANSSF

SEQ ID NO: 681234 - protein, 9 aa, Homo Sapiens
LESGSSGKL

SEQ ID NO: 681235 - protein, 9 aa, Homo Sapiens
ALVSPISES

SEQ ID NO: 681236 - protein, 9 aa, Homo Sapiens
VQMELSGSD

SEQ ID NO: 681237 - protein, 9 aa, Homo Sapiens
GSSGKLSSS

SEQ ID NO: 681238 - protein, 9 aa, Homo Sapiens
PQVNQSLTC

SEQ ID NO: 681239 - protein, 9 aa, Homo Sapiens
NSHKLRCHL

SEQ ID NO: 681240 - protein, 9 aa, Homo Sapiens
IALSPHTVH

SEQ ID NO: 681241 - protein, 9 aa, Homo Sapiens
GECHFYKDM

SEQ ID NO: 681242 - protein, 9 aa, Homo Sapiens
STLKQWRSD

SEQ ID NO: 681243 - protein, 9 aa, Homo Sapiens
VMNFADVVL

SEQ ID NO: 681244 - protein, 9 aa, Homo Sapiens
LSVDFWSLG

SEQ ID NO: 681245 - protein, 9 aa, Homo Sapiens
PKKTSCSVY

SEQ ID NO: 681246 - protein, 9 aa, Homo Sapiens
IKRLQEQTG

SEQ ID NO: 681247 - protein, 9 aa, Homo Sapiens
GPTEGVLER

SEQ ID NO: 681248 - protein, 9 aa, Homo Sapiens
LRPSRCAAA

SEQ ID NO: 681249 - protein, 9 aa, Homo Sapiens
PPGLWGFRH

SEQ ID NO: 681250 - protein, 9 aa, Homo Sapiens
VLVTSRTLE

SEQ ID NO: 681251 - protein, 9 aa, Homo Sapiens
FAPGPLACP

SEQ ID NO: 681252 - protein, 9 aa, Homo Sapiens
SLVSTGHAT

SEQ ID NO: 681253 - protein, 9 aa, Homo Sapiens
WACFRQDGR

SEQ ID NO: 681254 - protein, 9 aa, Homo Sapiens
EDSYTKQVE

SEQ ID NO: 681255 - protein, 9 aa, Homo Sapiens
KEAVAEYQM

SEQ ID NO: 681256 - protein, 9 aa, Homo Sapiens
LGGVGLGIR

SEQ ID NO: 681257 - protein, 9 aa, Homo Sapiens
ETVCYKQTL

SEQ ID NO: 681258 - protein, 9 aa, Homo Sapiens
GIRPFPTEQ

SEQ ID NO: 681259 - protein, 9 aa, Homo Sapiens
GHSRRIPHL

SEQ ID NO: 681260 - protein, 9 aa, Homo Sapiens
SFLALSRPS

SEQ ID NO: 681261 - protein, 9 aa, Homo Sapiens
EERHVAGAV

SEQ ID NO: 681262 - protein, 9 aa, Homo Sapiens
HHIIKGNKE

SEQ ID NO: 681263 - protein, 9 aa, Homo Sapiens
HWQYSLAKR

SEQ ID NO: 681264 - protein, 9 aa, Homo Sapiens
YIGSVAKLS

SEQ ID NO: 681265 - protein, 9 aa, Homo Sapiens
FRQDGRTLL

SEQ ID NO: 681266 - protein, 9 aa, Homo Sapiens
PYVCPFDGF

SEQ ID NO: 681267 - protein, 9 aa, Homo Sapiens
TKLDNDECS

SEQ ID NO: 681268 - protein, 9 aa, Homo Sapiens
GCKAAADVA

SEQ ID NO: 681269 - protein, 9 aa, Homo Sapiens
KSSFLPASQ

SEQ ID NO: 681270 - protein, 9 aa, Homo Sapiens
KFAPGPLAC

SEQ ID NO: 681271 - protein, 9 aa, Homo Sapiens
QAGAMGKDL

SEQ ID NO: 681272 - protein, 9 aa, Homo Sapiens
LKIFFSIGD

SEQ ID NO: 681273 - protein, 9 aa, Homo Sapiens
HTVHYCHSY

SEQ ID NO: 681274 - protein, 9 aa, Homo Sapiens
ERSFAKTQY

SEQ ID NO: 681275 - protein, 9 aa, Homo Sapiens
GPLQISPGR

SEQ ID NO: 681276 - protein, 9 aa, Homo Sapiens
GQIYVIGGT

SEQ ID NO: 681277 - protein, 9 aa, Homo Sapiens
MQFIQLVPV

SEQ ID NO: 681278 - protein, 9 aa, Homo Sapiens
KAQMAEEEA

SEQ ID NO: 681279 - protein, 9 aa, Homo Sapiens
GSFSIISQE

SEQ ID NO: 681280 - protein, 9 aa, Homo Sapiens
FDYSNTVIR

SEQ ID NO: 681281 - protein, 9 aa, Homo Sapiens
SQAGAMGKD

SEQ ID NO: 681282 - protein, 9 aa, Homo Sapiens
GGGRMKAIS

SEQ ID NO: 681283 - protein, 9 aa, Homo Sapiens
VAAQICRKR

SEQ ID NO: 681284 - protein, 9 aa, Homo Sapiens
RPSASKTPS

SEQ ID NO: 681285 - protein, 9 aa, Homo Sapiens
NIHDENQKQ

SEQ ID NO: 681286 - protein, 9 aa, Homo Sapiens
VFELGLVSF

SEQ ID NO: 681287 - protein, 9 aa, Homo Sapiens
MYNREEYAR

SEQ ID NO: 681288 - protein, 9 aa, Homo Sapiens
PNPAAVSPT

SEQ ID NO: 681289 - protein, 9 aa, Homo Sapiens
PSASKTPSQ

SEQ ID NO: 681290 - protein, 9 aa, Homo Sapiens
FKSFNLSPL

SEQ ID NO: 681291 - protein, 9 aa, Homo Sapiens
DEKSPSHVS

SEQ ID NO: 681292 - protein, 9 aa, Homo Sapiens
TKKPYPASI

SEQ ID NO: 681293 - protein, 9 aa, Homo Sapiens
RQDKQKNQE

SEQ ID NO: 681294 - protein, 9 aa, Homo Sapiens
SPRQNLEYH

SEQ ID NO: 681295 - protein, 9 aa, Homo Sapiens
GDTPQDTSG

SEQ ID NO: 681296 - protein, 9 aa, Homo Sapiens
YRPGTWREG

SEQ ID NO: 681297 - protein, 9 aa, Homo Sapiens
RMKAISTCT

SEQ ID NO: 681298 - protein, 9 aa, Homo Sapiens
EHRLDYFPE

SEQ ID NO: 681299 - protein, 9 aa, Homo Sapiens
QGEDKQGVD

SEQ ID NO: 681300 - protein, 9 aa, Homo Sapiens
SRIALVWFG

SEQ ID NO: 681301 - protein, 9 aa, Homo Sapiens
TKTAGPKQQ

SEQ ID NO: 681302 - protein, 9 aa, Homo Sapiens
EERGLPKGD

SEQ ID NO: 681303 - protein, 9 aa, Homo Sapiens
QCKFCSSLL

SEQ ID NO: 681304 - protein, 9 aa, Homo Sapiens
GASEPPPLG

SEQ ID NO: 681305 - protein, 9 aa, Homo Sapiens
DEDVWELIW

SEQ ID NO: 681306 - protein, 9 aa, Homo Sapiens
VDDVIGCGF

SEQ ID NO: 681307 - protein, 9 aa, Homo Sapiens
QCISSGQHY

SEQ ID NO: 681308 - protein, 9 aa, Homo Sapiens
VRLVTRYMY

SEQ ID NO: 681309 - protein, 9 aa, Homo Sapiens
ASEPPPLGG

SEQ ID NO: 681310 - protein, 9 aa, Homo Sapiens
AAAYAANVL

SEQ ID NO: 681311 - protein, 9 aa, Homo Sapiens
HNAGGDSQK

SEQ ID NO: 681312 - protein, 9 aa, Homo Sapiens
VKQRGISLV

SEQ ID NO: 681313 - protein, 9 aa, Homo Sapiens
TFQELEALL

SEQ ID NO: 681314 - protein, 9 aa, Homo Sapiens
AMQDSLLQI

SEQ ID NO: 681315 - protein, 9 aa, Homo Sapiens
LSSKEAEWE

SEQ ID NO: 681316 - protein, 9 aa, Homo Sapiens
RKCSTPQEI

SEQ ID NO: 681317 - protein, 9 aa, Homo Sapiens
MSKITTSSS

SEQ ID NO: 681318 - protein, 9 aa, Homo Sapiens
SAGANALAK

SEQ ID NO: 681319 - protein, 9 aa, Homo Sapiens
EQEGEEEWD

SEQ ID NO: 681320 - protein, 9 aa, Homo Sapiens
PGLRFSISG

SEQ ID NO: 681321 - protein, 9 aa, Homo Sapiens
RLASEALEP

SEQ ID NO: 681322 - protein, 9 aa, Homo Sapiens
LIWMKFHST

SEQ ID NO: 681323 - protein, 9 aa, Homo Sapiens
YVKMRNVRE

SEQ ID NO: 681324 - protein, 9 aa, Homo Sapiens
VHYCHSYEL

SEQ ID NO: 681325 - protein, 9 aa, Homo Sapiens
SSQQCLQDS

SEQ ID NO: 681326 - protein, 9 aa, Homo Sapiens
SDVDEKRQV

SEQ ID NO: 681327 - protein, 9 aa, Homo Sapiens
FAKTQYPDI

SEQ ID NO: 681328 - protein, 9 aa, Homo Sapiens
NGLEENFCH

SEQ ID NO: 681329 - protein, 9 aa, Homo Sapiens
IQFLSKARE

SEQ ID NO: 681330 - protein, 9 aa, Homo Sapiens
LPSVQLSNL

SEQ ID NO: 681331 - protein, 9 aa, Homo Sapiens
VPVSLKKKE

SEQ ID NO: 681332 - protein, 9 aa, Homo Sapiens
MNKAINTQE

SEQ ID NO: 681333 - protein, 9 aa, Homo Sapiens
TGSPKQDSP

SEQ ID NO: 681334 - protein, 9 aa, Homo Sapiens
AAFFYLDYV

SEQ ID NO: 681335 - protein, 9 aa, Homo Sapiens
QLVPVAEVL

SEQ ID NO: 681336 - protein, 9 aa, Homo Sapiens
TQTVSMNKA

SEQ ID NO: 681337 - protein, 9 aa, Homo Sapiens
VSISYYGFG

SEQ ID NO: 681338 - protein, 9 aa, Homo Sapiens
LPSLHHIIK

SEQ ID NO: 681339 - protein, 9 aa, Homo Sapiens
KRPATRQGT

SEQ ID NO: 681340 - protein, 9 aa, Homo Sapiens
QGTSCVCLP

SEQ ID NO: 681341 - protein, 9 aa, Homo Sapiens
GGPAEDEDP

SEQ ID NO: 681342 - protein, 9 aa, Homo Sapiens
FELGLVSFQ

SEQ ID NO: 681343 - protein, 9 aa, Homo Sapiens
QWRSDVDEK

SEQ ID NO: 681344 - protein, 9 aa, Homo Sapiens
YDSYVAICK

SEQ ID NO: 681345 - protein, 9 aa, Homo Sapiens
NDECSSVNT

SEQ ID NO: 681346 - protein, 9 aa, Homo Sapiens
QDTSGKKLS

SEQ ID NO: 681347 - protein, 9 aa, Homo Sapiens
PKTSNKVPV

SEQ ID NO: 681348 - protein, 9 aa, Homo Sapiens
GPEYKALDA

SEQ ID NO: 681349 - protein, 9 aa, Homo Sapiens
HSSLKATQA

SEQ ID NO: 681350 - protein, 9 aa, Homo Sapiens
VLTGPEYKA

SEQ ID NO: 681351 - protein, 9 aa, Homo Sapiens
KNAVIHALQ

SEQ ID NO: 681352 - protein, 9 aa, Homo Sapiens
ERSLFLRMK

SEQ ID NO: 681353 - protein, 9 aa, Homo Sapiens
IRGYVFKEF

SEQ ID NO: 681354 - protein, 9 aa, Homo Sapiens
KEFKSFNLS

SEQ ID NO: 681355 - protein, 9 aa, Homo Sapiens
FYLTVVMLF

SEQ ID NO: 681356 - protein, 9 aa, Homo Sapiens
VVPQCVEDG

SEQ ID NO: 681357 - protein, 9 aa, Homo Sapiens
KKKYRFRVF

SEQ ID NO: 681358 - protein, 9 aa, Homo Sapiens
AEKAEILHS

SEQ ID NO: 681359 - protein, 9 aa, Homo Sapiens
ISDPAMRLI

SEQ ID NO: 681360 - protein, 9 aa, Homo Sapiens
DHCGHMMGE

SEQ ID NO: 681361 - protein, 9 aa, Homo Sapiens
QKAHKEANA

SEQ ID NO: 681362 - protein, 9 aa, Homo Sapiens
HLMMDKAVV

SEQ ID NO: 681363 - protein, 9 aa, Homo Sapiens
EEFIKLKDI

SEQ ID NO: 681364 - protein, 9 aa, Homo Sapiens
RQNLEYHVF

SEQ ID NO: 681365 - protein, 9 aa, Homo Sapiens
AAMTLSERF

SEQ ID NO: 681366 - protein, 9 aa, Homo Sapiens
QEDERLGLF

SEQ ID NO: 681367 - protein, 9 aa, Homo Sapiens
KAAHRSMLQ

SEQ ID NO: 681368 - protein, 9 aa, Homo Sapiens
PQSSGLDCG

SEQ ID NO: 681369 - protein, 9 aa, Homo Sapiens
MLRMSKITT

SEQ ID NO: 681370 - protein, 9 aa, Homo Sapiens
SPKDQGPLD

SEQ ID NO: 681371 - protein, 9 aa, Homo Sapiens
ANIDPNPAA

SEQ ID NO: 681372 - protein, 9 aa, Homo Sapiens
CLLKSDNKV

SEQ ID NO: 681373 - protein, 9 aa, Homo Sapiens
QPYRPGTWR

SEQ ID NO: 681374 - protein, 9 aa, Homo Sapiens
PIKGHAQPY

SEQ ID NO: 681375 - protein, 9 aa, Homo Sapiens
YEHGCLLGL

SEQ ID NO: 681376 - protein, 9 aa, Homo Sapiens
MSIPCDVWR

SEQ ID NO: 681377 - protein, 9 aa, Homo Sapiens
QSGPGDFAY

SEQ ID NO: 681378 - protein, 9 aa, Homo Sapiens
EAWTAGKSL

SEQ ID NO: 681379 - protein, 9 aa, Homo Sapiens
GDASPRAER

SEQ ID NO: 681380 - protein, 9 aa, Homo Sapiens
LNNSVQQFY

SEQ ID NO: 681381 - protein, 9 aa, Homo Sapiens
AATFGAHDL

SEQ ID NO: 681382 - protein, 9 aa, Homo Sapiens
LSPPIPKTS

SEQ ID NO: 681383 - protein, 9 aa, Homo Sapiens
DVAVRSNHR

SEQ ID NO: 681384 - protein, 9 aa, Homo Sapiens
IFFSIGDDS

SEQ ID NO: 681385 - protein, 9 aa, Homo Sapiens
PCQEEHGHS

SEQ ID NO: 681386 - protein, 9 aa, Homo Sapiens
AAHRSMLQK

SEQ ID NO: 681387 - protein, 9 aa, Homo Sapiens
CSTPQEIKK

SEQ ID NO: 681388 - protein, 9 aa, Homo Sapiens
LLLDMARRV

SEQ ID NO: 681389 - protein, 9 aa, Homo Sapiens
ASSLEKQIR

SEQ ID NO: 681390 - protein, 9 aa, Homo Sapiens
QSINDEDIY

SEQ ID NO: 681391 - protein, 9 aa, Homo Sapiens
CLCPAPTPD

SEQ ID NO: 681392 - protein, 9 aa, Homo Sapiens
NNSVQQFYS

SEQ ID NO: 681393 - protein, 9 aa, Homo Sapiens
QVYAANKDH

SEQ ID NO: 681394 - protein, 9 aa, Homo Sapiens
KRLQEQTGA

SEQ ID NO: 681395 - protein, 9 aa, Homo Sapiens
LGLFFMDTH

SEQ ID NO: 681396 - protein, 9 aa, Homo Sapiens
IAHVSQYDQ

SEQ ID NO: 681397 - protein, 9 aa, Homo Sapiens
TEMITNIRE

SEQ ID NO: 681398 - protein, 9 aa, Homo Sapiens
QRLQEDKMR

SEQ ID NO: 681399 - protein, 9 aa, Homo Sapiens
MLFYGSIFC

SEQ ID NO: 681400 - protein, 9 aa, Homo Sapiens
VLTAMAYDS

SEQ ID NO: 681401 - protein, 9 aa, Homo Sapiens
SPIKGHAQP

SEQ ID NO: 681402 - protein, 9 aa, Homo Sapiens
VPKMEGDLK

SEQ ID NO: 681403 - protein, 9 aa, Homo Sapiens
MVSTINTIT

SEQ ID NO: 681404 - protein, 9 aa, Homo Sapiens
IIVPGMKNA

SEQ ID NO: 681405 - protein, 9 aa, Homo Sapiens
VSFQGFVVA

SEQ ID NO: 681406 - protein, 9 aa, Homo Sapiens
PLACPCLCT

SEQ ID NO: 681407 - protein, 9 aa, Homo Sapiens
SLPSLHHII

SEQ ID NO: 681408 - protein, 9 aa, Homo Sapiens
FTQQLNALF

SEQ ID NO: 681409 - protein, 9 aa, Homo Sapiens
SQLFVEEWR

SEQ ID NO: 681410 - protein, 9 aa, Homo Sapiens
HLAAVYEHG

SEQ ID NO: 681411 - protein, 9 aa, Homo Sapiens
KNEQSKHNQ

SEQ ID NO: 681412 - protein, 9 aa, Homo Sapiens
LVSTGHATA

SEQ ID NO: 681413 - protein, 9 aa, Homo Sapiens
TTLKMCLVA

SEQ ID NO: 681414 - protein, 9 aa, Homo Sapiens
SSFLPASQN

SEQ ID NO: 681415 - protein, 9 aa, Homo Sapiens
DVDEKRQVF

SEQ ID NO: 681416 - protein, 9 aa, Homo Sapiens
SEEPQLQPF

SEQ ID NO: 681417 - protein, 9 aa, Homo Sapiens
SAACLGHGA

SEQ ID NO: 681418 - protein, 9 aa, Homo Sapiens
AEDHQQLIL

SEQ ID NO: 681419 - protein, 9 aa, Homo Sapiens
GKYGFSDLL

SEQ ID NO: 681420 - protein, 9 aa, Homo Sapiens
AGGGRMKAI

SEQ ID NO: 681421 - protein, 9 aa, Homo Sapiens
TCIGEKIQD

SEQ ID NO: 681422 - protein, 9 aa, Homo Sapiens
RMFERLASE

SEQ ID NO: 681423 - protein, 9 aa, Homo Sapiens
LDNDECSSV

SEQ ID NO: 681424 - protein, 9 aa, Homo Sapiens
PALKERVYD

SEQ ID NO: 681425 - protein, 9 aa, Homo Sapiens
LLQTLHNLK

SEQ ID NO: 681426 - protein, 9 aa, Homo Sapiens
CLGHGAAQI

SEQ ID NO: 681427 - protein, 9 aa, Homo Sapiens
QEDMKHKGG

SEQ ID NO: 681428 - protein, 9 aa, Homo Sapiens
CDGPFHVGS

SEQ ID NO: 681429 - protein, 9 aa, Homo Sapiens
DQMVSTINT

SEQ ID NO: 681430 - protein, 9 aa, Homo Sapiens
HLLAHTCYT

SEQ ID NO: 681431 - protein, 9 aa, Homo Sapiens
EFKSFNLSP

SEQ ID NO: 681432 - protein, 9 aa, Homo Sapiens
RCAAATSSS

SEQ ID NO: 681433 - protein, 9 aa, Homo Sapiens
TFGAHDLVL

SEQ ID NO: 681434 - protein, 9 aa, Homo Sapiens
YSLAKRCIC

SEQ ID NO: 681435 - protein, 9 aa, Homo Sapiens
QEHVHIEAQ

SEQ ID NO: 681436 - protein, 9 aa, Homo Sapiens
SPISESMLE

SEQ ID NO: 681437 - protein, 9 aa, Homo Sapiens
CQAVGKAPS

SEQ ID NO: 681438 - protein, 9 aa, Homo Sapiens
INKETAAEI

SEQ ID NO: 681439 - protein, 9 aa, Homo Sapiens
MEDAAAPGP

SEQ ID NO: 681440 - protein, 9 aa, Homo Sapiens
LVHEVDTQY

SEQ ID NO: 681441 - protein, 9 aa, Homo Sapiens
YKTVSEPIR

SEQ ID NO: 681442 - protein, 9 aa, Homo Sapiens
SESPNGKIA

SEQ ID NO: 681443 - protein, 9 aa, Homo Sapiens
FCQGPSNRP

SEQ ID NO: 681444 - protein, 9 aa, Homo Sapiens
VHASIAAGI

SEQ ID NO: 681445 - protein, 9 aa, Homo Sapiens
RERQLVVSL

SEQ ID NO: 681446 - protein, 9 aa, Homo Sapiens
EQQGDATGS

SEQ ID NO: 681447 - protein, 9 aa, Homo Sapiens
KAKNEQEHN

SEQ ID NO: 681448 - protein, 9 aa, Homo Sapiens
PGVGSSQQE

SEQ ID NO: 681449 - protein, 9 aa, Homo Sapiens
DAIFLTATL

SEQ ID NO: 681450 - protein, 9 aa, Homo Sapiens
PLQISPGRM

SEQ ID NO: 681451 - protein, 9 aa, Homo Sapiens
NSCNSSSFV

SEQ ID NO: 681452 - protein, 9 aa, Homo Sapiens
RCTRRKRPS

SEQ ID NO: 681453 - protein, 9 aa, Homo Sapiens
KHLAAVYEH

SEQ ID NO: 681454 - protein, 9 aa, Homo Sapiens
DMKHKGGPA

SEQ ID NO: 681455 - protein, 9 aa, Homo Sapiens
VPPGLWGFR

SEQ ID NO: 681456 - protein, 9 aa, Homo Sapiens
IERSLFLRM

SEQ ID NO: 681457 - protein, 9 aa, Homo Sapiens
VFKEFKSFN

SEQ ID NO: 681458 - protein, 9 aa, Homo Sapiens
PKGDTPQDT

SEQ ID NO: 681459 - protein, 9 aa, Homo Sapiens
GGRMKAIST

SEQ ID NO: 681460 - protein, 9 aa, Homo Sapiens
QYLSAEQLL

SEQ ID NO: 681461 - protein, 9 aa, Homo Sapiens
PGTWREGWR

SEQ ID NO: 681462 - protein, 9 aa, Homo Sapiens
DYVSISYYG

SEQ ID NO: 681463 - protein, 9 aa, Homo Sapiens
EYFCQAVGK

SEQ ID NO: 681464 - protein, 9 aa, Homo Sapiens
QFTLPRFLQ

SEQ ID NO: 681465 - protein, 9 aa, Homo Sapiens
TSSSEAWTA

SEQ ID NO: 681466 - protein, 9 aa, Homo Sapiens
YYNGTYWPL

SEQ ID NO: 681467 - protein, 9 aa, Homo Sapiens
AKPLHYVTI

SEQ ID NO: 681468 - protein, 9 aa, Homo Sapiens
CKSEVVMNV

SEQ ID NO: 681469 - protein, 9 aa, Homo Sapiens
ISGLNNSVQ

SEQ ID NO: 681470 - protein, 9 aa, Homo Sapiens
PSARCTRRK

SEQ ID NO: 681471 - protein, 9 aa, Homo Sapiens
RNESLLAST

SEQ ID NO: 681472 - protein, 9 aa, Homo Sapiens
LAAVYEHGC

SEQ ID NO: 681473 - protein, 9 aa, Homo Sapiens
PEQDGQCDG

SEQ ID NO: 681474 - protein, 9 aa, Homo Sapiens
QSKHNQELT

SEQ ID NO: 681475 - protein, 9 aa, Homo Sapiens
REGDHCGHM

SEQ ID NO: 681476 - protein, 9 aa, Homo Sapiens
AANKDHNSQ

SEQ ID NO: 681477 - protein, 9 aa, Homo Sapiens
SKNEQSKHN

SEQ ID NO: 681478 - protein, 9 aa, Homo Sapiens
ASNGGCKAA

SEQ ID NO: 681479 - protein, 9 aa, Homo Sapiens
HVGSGEGGD

SEQ ID NO: 681480 - protein, 9 aa, Homo Sapiens
ATWLEIAHV

SEQ ID NO: 681481 - protein, 9 aa, Homo Sapiens
ASSPHGSLF

SEQ ID NO: 681482 - protein, 9 aa, Homo Sapiens
QNLEYHVFF

SEQ ID NO: 681483 - protein, 9 aa, Homo Sapiens
KLDVEQPDS

SEQ ID NO: 681484 - protein, 9 aa, Homo Sapiens
LACPKAWGA

SEQ ID NO: 681485 - protein, 9 aa, Homo Sapiens
LVWFGPKEV

SEQ ID NO: 681486 - protein, 9 aa, Homo Sapiens
SMNKAINTQ

SEQ ID NO: 681487 - protein, 9 aa, Homo Sapiens
PHYLPKVAV

SEQ ID NO: 681488 - protein, 9 aa, Homo Sapiens
EDHHGDASP

SEQ ID NO: 681489 - protein, 9 aa, Homo Sapiens
CACLKIFFS

SEQ ID NO: 681490 - protein, 9 aa, Homo Sapiens
PAPQGKAFS

SEQ ID NO: 681491 - protein, 9 aa, Homo Sapiens
YVCPFDGFN

SEQ ID NO: 681492 - protein, 9 aa, Homo Sapiens
HHSAAHGHD

SEQ ID NO: 681493 - protein, 9 aa, Homo Sapiens
IPCDVWRSK

SEQ ID NO: 681494 - protein, 9 aa, Homo Sapiens
RLGLFFMDT

SEQ ID NO: 681495 - protein, 9 aa, Homo Sapiens
PTITVSWDR

SEQ ID NO: 681496 - protein, 9 aa, Homo Sapiens
RFRVFAENL

SEQ ID NO: 681497 - protein, 9 aa, Homo Sapiens
ATRQGTPPR

SEQ ID NO: 681498 - protein, 9 aa, Homo Sapiens
EEPQLQPFL

SEQ ID NO: 681499 - protein, 9 aa, Homo Sapiens
SASLPPYFC

SEQ ID NO: 681500 - protein, 9 aa, Homo Sapiens
ESTVEKIAI

SEQ ID NO: 681501 - protein, 9 aa, Homo Sapiens
PDANKRSLI

SEQ ID NO: 681502 - protein, 9 aa, Homo Sapiens
SSFVPSGRR

SEQ ID NO: 681503 - protein, 9 aa, Homo Sapiens
ILNKGHDLS

SEQ ID NO: 681504 - protein, 9 aa, Homo Sapiens
EHLQKSEFT

SEQ ID NO: 681505 - protein, 9 aa, Homo Sapiens
YAANKDHNS

SEQ ID NO: 681506 - protein, 9 aa, Homo Sapiens
PTSELPSAR

SEQ ID NO: 681507 - protein, 9 aa, Homo Sapiens
DTPQDTSGL

SEQ ID NO: 681508 - protein, 9 aa, Homo Sapiens
SAEQLLDSH

SEQ ID NO: 681509 - protein, 9 aa, Homo Sapiens
FMQFIQLVP

SEQ ID NO: 681510 - protein, 9 aa, Homo Sapiens
VLHGVEKMK

SEQ ID NO: 681511 - protein, 9 aa, Homo Sapiens
ELYKQVNCF

SEQ ID NO: 681512 - protein, 9 aa, Homo Sapiens
CKSSFLPAS

SEQ ID NO: 681513 - protein, 9 aa, Homo Sapiens
DPPTITVSW

SEQ ID NO: 681514 - protein, 9 aa, Homo Sapiens
LTATLQNIS

SEQ ID NO: 681515 - protein, 9 aa, Homo Sapiens
RYFLGQRCK

SEQ ID NO: 681516 - protein, 9 aa, Homo Sapiens
AGANALAKV

SEQ ID NO: 681517 - protein, 9 aa, Homo Sapiens
RGISLVHEV

SEQ ID NO: 681518 - protein, 9 aa, Homo Sapiens
SEPFQVAEV

SEQ ID NO: 681519 - protein, 9 aa, Homo Sapiens
DVSVPKMEG

SEQ ID NO: 681520 - protein, 9 aa, Homo Sapiens
VLIRISLYV

SEQ ID NO: 681521 - protein, 9 aa, Homo Sapiens
CWSNGQWSS

SEQ ID NO: 681522 - protein, 9 aa, Homo Sapiens
DISGLNNSV

SEQ ID NO: 681523 - protein, 9 aa, Homo Sapiens
CSSLLALPP

SEQ ID NO: 681524 - protein, 9 aa, Homo Sapiens
REQRREGDH

SEQ ID NO: 681525 - protein, 9 aa, Homo Sapiens
KQGEDKQGV

SEQ ID NO: 681526 - protein, 9 aa, Homo Sapiens
LGLAEDHQQ

SEQ ID NO: 681527 - protein, 9 aa, Homo Sapiens
PEFRNESLL

SEQ ID NO: 681528 - protein, 9 aa, Homo Sapiens
SDEKSPSHV

SEQ ID NO: 681529 - protein, 9 aa, Homo Sapiens
RHCKRCIIE

SEQ ID NO: 681530 - protein, 9 aa, Homo Sapiens
AERPDDRKH

SEQ ID NO: 681531 - protein, 9 aa, Homo Sapiens
FCSSLLALP

SEQ ID NO: 681532 - protein, 9 aa, Homo Sapiens
IKEEEPISG

SEQ ID NO: 681533 - protein, 9 aa, Homo Sapiens
RVATQFTLP

SEQ ID NO: 681534 - protein, 9 aa, Homo Sapiens
QEHNAGGDS

SEQ ID NO: 681535 - protein, 9 aa, Homo Sapiens
VFAENLAGP

SEQ ID NO: 681536 - protein, 9 aa, Homo Sapiens
GLSEEPQLQ

SEQ ID NO: 681537 - protein, 9 aa, Homo Sapiens
GSQSGPGDF

SEQ ID NO: 681538 - protein, 9 aa, Homo Sapiens
EQCSESPGR

SEQ ID NO: 681539 - protein, 9 aa, Homo Sapiens
DGQCDGPFH

SEQ ID NO: 681540 - protein, 9 aa, Homo Sapiens
CTRRKRPSA

SEQ ID NO: 681541 - protein, 9 aa, Homo Sapiens
ISESPIKGH

SEQ ID NO: 681542 - protein, 9 aa, Homo Sapiens
AWTAGKSLP

SEQ ID NO: 681543 - protein, 9 aa, Homo Sapiens
QDFKVGNLL

SEQ ID NO: 681544 - protein, 9 aa, Homo Sapiens
DLLTFNSVV

SEQ ID NO: 681545 - protein, 9 aa, Homo Sapiens
SGEGGDLPG

SEQ ID NO: 681546 - protein, 9 aa, Homo Sapiens
FCLHQEVMQ

SEQ ID NO: 681547 - protein, 9 aa, Homo Sapiens
NSSSFVPSG

SEQ ID NO: 681548 - protein, 9 aa, Homo Sapiens
VRLQCKFCS

SEQ ID NO: 681549 - protein, 9 aa, Homo Sapiens
RNRYGRRGP

SEQ ID NO: 681550 - protein, 9 aa, Homo Sapiens
AKQGEDKQG

SEQ ID NO: 681551 - protein, 9 aa, Homo Sapiens
TVCYKQTLS

SEQ ID NO: 681552 - protein, 9 aa, Homo Sapiens
EDEDPEQDG

SEQ ID NO: 681553 - protein, 9 aa, Homo Sapiens
DYAFLHMER

SEQ ID NO: 681554 - protein, 9 aa, Homo Sapiens
DPEQDGQCD

SEQ ID NO: 681555 - protein, 9 aa, Homo Sapiens
GEDKQGVDD

SEQ ID NO: 681556 - protein, 9 aa, Homo Sapiens
PDADIQAMQ

SEQ ID NO: 681557 - protein, 9 aa, Homo Sapiens
MKNAVIHAL

SEQ ID NO: 681558 - protein, 9 aa, Homo Sapiens
LTCVPPMNP

SEQ ID NO: 681559 - protein, 9 aa, Homo Sapiens
IVPGMKNAV

SEQ ID NO: 681560 - protein, 9 aa, Homo Sapiens
DHLWTEMIT

SEQ ID NO: 681561 - protein, 9 aa, Homo Sapiens
VEDGDVAVR

SEQ ID NO: 681562 - protein, 9 aa, Homo Sapiens
KCGKAFNCS

SEQ ID NO: 681563 - protein, 9 aa, Homo Sapiens
EKFAPGPLA

SEQ ID NO: 681564 - protein, 9 aa, Homo Sapiens
VSEQLPCRD

SEQ ID NO: 681565 - protein, 9 aa, Homo Sapiens
YQDDKNRQL

SEQ ID NO: 681566 - protein, 9 aa, Homo Sapiens
QISPGRMLL

SEQ ID NO: 681567 - protein, 9 aa, Homo Sapiens
ARLACPKAW

SEQ ID NO: 681568 - protein, 9 aa, Homo Sapiens
GFSDLLTFN

SEQ ID NO: 681569 - protein, 9 aa, Homo Sapiens
KQNIHDENQ

SEQ ID NO: 681570 - protein, 9 aa, Homo Sapiens
IQDFKVGNL

SEQ ID NO: 681571 - protein, 9 aa, Homo Sapiens
KKGERLGGA

SEQ ID NO: 681572 - protein, 9 aa, Homo Sapiens
LAHTCYTFE

SEQ ID NO: 681573 - protein, 9 aa, Homo Sapiens
ANQRQDAQG

SEQ ID NO: 681574 - protein, 9 aa, Homo Sapiens
LPSRIALVW

SEQ ID NO: 681575 - protein, 9 aa, Homo Sapiens
CVPPMNPAT

SEQ ID NO: 681576 - protein, 9 aa, Homo Sapiens
HVHIEAQDE

SEQ ID NO: 681577 - protein, 9 aa, Homo Sapiens
KIFFSIGDD

SEQ ID NO: 681578 - protein, 9 aa, Homo Sapiens
NGTYWPLWY

SEQ ID NO: 681579 - protein, 9 aa, Homo Sapiens
KEANAARKL

SEQ ID NO: 681580 - protein, 9 aa, Homo Sapiens
PHTVHYCHS

SEQ ID NO: 681581 - protein, 9 aa, Homo Sapiens
RNPHYLPKV

SEQ ID NO: 681582 - protein, 9 aa, Homo Sapiens
AVAEYQMII

SEQ ID NO: 681583 - protein, 9 aa, Homo Sapiens
LEERHVAGA

SEQ ID NO: 681584 - protein, 9 aa, Homo Sapiens
MRERQLVVS

SEQ ID NO: 681585 - protein, 9 aa, Homo Sapiens
ATGSPKQDS

SEQ ID NO: 681586 - protein, 9 aa, Homo Sapiens
LCKEEFIKL

SEQ ID NO: 681587 - protein, 9 aa, Homo Sapiens
PDDRKHHHS

SEQ ID NO: 681588 - protein, 9 aa, Homo Sapiens
EAVAEYQMI

SEQ ID NO: 681589 - protein, 9 aa, Homo Sapiens
AIDAIFLTA

SEQ ID NO: 681590 - protein, 9 aa, Homo Sapiens
AHWQYSLAK

SEQ ID NO: 681591 - protein, 9 aa, Homo Sapiens
DVVLERGQY

SEQ ID NO: 681592 - protein, 9 aa, Homo Sapiens
TAMAYDSYV

SEQ ID NO: 681593 - protein, 9 aa, Homo Sapiens
EKIAIKQYT

SEQ ID NO: 681594 - protein, 9 aa, Homo Sapiens
TSGKKLSLK

SEQ ID NO: 681595 - protein, 9 aa, Homo Sapiens
VAGAVGVTW

SEQ ID NO: 681596 - protein, 9 aa, Homo Sapiens
RREGDHCGH

SEQ ID NO: 681597 - protein, 9 aa, Homo Sapiens
NPQSSGLDC

SEQ ID NO: 681598 - protein, 9 aa, Homo Sapiens
LPKVAVKVC

SEQ ID NO: 681599 - protein, 9 aa, Homo Sapiens
TQYPDIFMR

SEQ ID NO: 681600 - protein, 9 aa, Homo Sapiens
PGAAGLAAM

SEQ ID NO: 681601 - protein, 9 aa, Homo Sapiens
SGSSGKLSS

SEQ ID NO: 681602 - protein, 9 aa, Homo Sapiens
RKHHHSAAH

SEQ ID NO: 681603 - protein, 9 aa, Homo Sapiens
LRQDKQKNQ

SEQ ID NO: 681604 - protein, 9 aa, Homo Sapiens
SLDRAIRTI

SEQ ID NO: 681605 - protein, 9 aa, Homo Sapiens
LSEPFQVAE

SEQ ID NO: 681606 - protein, 9 aa, Homo Sapiens
QTGAKISVL

SEQ ID NO: 681607 - protein, 9 aa, Homo Sapiens
IAIKQYTSN

SEQ ID NO: 681608 - protein, 9 aa, Homo Sapiens
VSQLFVEEW

SEQ ID NO: 681609 - protein, 9 aa, Homo Sapiens
TTSMDLSDK

SEQ ID NO: 681610 - protein, 9 aa, Homo Sapiens
AGSAACLGH

SEQ ID NO: 681611 - protein, 9 aa, Homo Sapiens
IDHLWTEMI

SEQ ID NO: 681612 - protein, 9 aa, Homo Sapiens
HSAAHGHDA

SEQ ID NO: 681613 - protein, 9 aa, Homo Sapiens
LNKGHDLSV

SEQ ID NO: 681614 - protein, 9 aa, Homo Sapiens
TEQSINDED

SEQ ID NO: 681615 - protein, 9 aa, Homo Sapiens
WSNGQWSSP

SEQ ID NO: 681616 - protein, 9 aa, Homo Sapiens
NPGLRFSIS

SEQ ID NO: 681617 - protein, 9 aa, Homo Sapiens
QDGQCDGPF

SEQ ID NO: 681618 - protein, 9 aa, Homo Sapiens
RQKAHKEAN

SEQ ID NO: 681619 - protein, 9 aa, Homo Sapiens
GAMGKDLQG

SEQ ID NO: 681620 - protein, 9 aa, Homo Sapiens
LERMSIPCD

SEQ ID NO: 681621 - protein, 9 aa, Homo Sapiens
PRIQMLLFE

SEQ ID NO: 681622 - protein, 9 aa, Homo Sapiens
QDDKNRQLT

SEQ ID NO: 681623 - protein, 9 aa, Homo Sapiens
RSFAKTQYP

SEQ ID NO: 681624 - protein, 9 aa, Homo Sapiens
KSHVDTKKP

SEQ ID NO: 681625 - protein, 9 aa, Homo Sapiens
LRMSKITTS

SEQ ID NO: 681626 - protein, 9 aa, Homo Sapiens
AQKSFSRSS

SEQ ID NO: 681627 - protein, 9 aa, Homo Sapiens
NQVYAANKD

SEQ ID NO: 681628 - protein, 9 aa, Homo Sapiens
KKLSLKQKI

SEQ ID NO: 681629 - protein, 9 aa, Homo Sapiens
EQPDSANSS

SEQ ID NO: 681630 - protein, 9 aa, Homo Sapiens
PSVQLSNLK

SEQ ID NO: 681631 - protein, 9 aa, Homo Sapiens
DRAIRTIEN

SEQ ID NO: 681632 - protein, 9 aa, Homo Sapiens
ACNSHKLRC

SEQ ID NO: 681633 - protein, 9 aa, Homo Sapiens
KALDALPDA

SEQ ID NO: 681634 - protein, 9 aa, Homo Sapiens
RMSESPNGK

SEQ ID NO: 681635 - protein, 9 aa, Homo Sapiens
AIKQYTSNI

SEQ ID NO: 681636 - protein, 9 aa, Homo Sapiens
PFDGFNKKF

SEQ ID NO: 681637 - protein, 9 aa, Homo Sapiens
QDKQKNQEI

SEQ ID NO: 681638 - protein, 9 aa, Homo Sapiens
EDQHQREQR

SEQ ID NO: 681639 - protein, 9 aa, Homo Sapiens
AQDPKKGER

SEQ ID NO: 681640 - protein, 9 aa, Homo Sapiens
DPKKGERLG

SEQ ID NO: 681641 - protein, 9 aa, Homo Sapiens
KTATWLEIA

SEQ ID NO: 681642 - protein, 9 aa, Homo Sapiens
KAAADVANG

SEQ ID NO: 681643 - protein, 9 aa, Homo Sapiens
KYGFSDLLT

SEQ ID NO: 681644 - protein, 9 aa, Homo Sapiens
TSSSTSLTV

SEQ ID NO: 681645 - protein, 9 aa, Homo Sapiens
ELSGSDFPD

SEQ ID NO: 681646 - protein, 9 aa, Homo Sapiens
VTRYMYNRE

SEQ ID NO: 681647 - protein, 9 aa, Homo Sapiens
VKMRNVREL

SEQ ID NO: 681648 - protein, 9 aa, Homo Sapiens
FQELEALLL

SEQ ID NO: 681649 - protein, 9 aa, Homo Sapiens
SDEVKAAHR

SEQ ID NO: 681650 - protein, 9 aa, Homo Sapiens
SPNGKIATP

SEQ ID NO: 681651 - protein, 9 aa, Homo Sapiens
KMRNVRELR

SEQ ID NO: 681652 - protein, 9 aa, Homo Sapiens
NVLSQIPAV

SEQ ID NO: 681653 - protein, 9 aa, Homo Sapiens
LLFIKRMYK

SEQ ID NO: 681654 - protein, 9 aa, Homo Sapiens
AEIRDKNLN

SEQ ID NO: 681655 - protein, 9 aa, Homo Sapiens
VHIEAQDED

SEQ ID NO: 681656 - protein, 9 aa, Homo Sapiens
GLPKGDTPQ

SEQ ID NO: 681657 - protein, 9 aa, Homo Sapiens
MEINKETAA

SEQ ID NO: 681658 - protein, 9 aa, Homo Sapiens
KAWGAAYSL

SEQ ID NO: 681659 - protein, 9 aa, Homo Sapiens
SSYYNGTYW

SEQ ID NO: 681660 - protein, 9 aa, Homo Sapiens
NKRSLINEF

SEQ ID NO: 681661 - protein, 9 aa, Homo Sapiens
NEQEHNAGG

SEQ ID NO: 681662 - protein, 9 aa, Homo Sapiens
AAQICRKRK

SEQ ID NO: 681663 - protein, 9 aa, Homo Sapiens
ETLKINILH

SEQ ID NO: 681664 - protein, 9 aa, Homo Sapiens
FELFSLFYI

SEQ ID NO: 681665 - protein, 9 aa, Homo Sapiens
GDHCGHMMG

SEQ ID NO: 681666 - protein, 9 aa, Homo Sapiens
TLELAHQPL

SEQ ID NO: 681667 - protein, 9 aa, Homo Sapiens
DSLQRQLSM

SEQ ID NO: 681668 - protein, 9 aa, Homo Sapiens
PLLKEFVHR

SEQ ID NO: 681669 - protein, 9 aa, Homo Sapiens
PGGAAAEHG

SEQ ID NO: 681670 - protein, 9 aa, Homo Sapiens
LHQEVMQLA

SEQ ID NO: 681671 - protein, 9 aa, Homo Sapiens
DYSNTVIRT

SEQ ID NO: 681672 - protein, 9 aa, Homo Sapiens
QLSMALPQE

SEQ ID NO: 681673 - protein, 9 aa, Homo Sapiens
AVCFAQSGR

SEQ ID NO: 681674 - protein, 9 aa, Homo Sapiens
PGPLACPCL

SEQ ID NO: 681675 - protein, 9 aa, Homo Sapiens
SEKQYLSAE

SEQ ID NO: 681676 - protein, 9 aa, Homo Sapiens
VFLEVLHGV

SEQ ID NO: 681677 - protein, 9 aa, Homo Sapiens
NTVIRTIKL

SEQ ID NO: 681678 - protein, 9 aa, Homo Sapiens
LFLRMKCVL

SEQ ID NO: 681679 - protein, 9 aa, Homo Sapiens
QYSLAKRCI

SEQ ID NO: 681680 - protein, 9 aa, Homo Sapiens
VSSICTLRQ

SEQ ID NO: 681681 - protein, 9 aa, Homo Sapiens
YDQDIFQDL

SEQ ID NO: 681682 - protein, 9 aa, Homo Sapiens
SLEKQIRHP

SEQ ID NO: 681683 - protein, 9 aa, Homo Sapiens
MAKRQKAHK

SEQ ID NO: 681684 - protein, 9 aa, Homo Sapiens
QGDATGSPK

SEQ ID NO: 681685 - protein, 9 aa, Homo Sapiens
VPSGRRGRQ

SEQ ID NO: 681686 - protein, 9 aa, Homo Sapiens
DYFPEVTFP

SEQ ID NO: 681687 - protein, 9 aa, Homo Sapiens
VCFAQSGRN

SEQ ID NO: 681688 - protein, 9 aa, Homo Sapiens
GGDLPGVGS

SEQ ID NO: 681689 - protein, 9 aa, Homo Sapiens
EDKMRRAAE

SEQ ID NO: 681690 - protein, 9 aa, Homo Sapiens
GLFFMDTHG

SEQ ID NO: 681691 - protein, 9 aa, Homo Sapiens
QIRHPSPPP

SEQ ID NO: 681692 - protein, 9 aa, Homo Sapiens
SFLPASQNN

SEQ ID NO: 681693 - protein, 9 aa, Homo Sapiens
SFAKTQYPD

SEQ ID NO: 681694 - protein, 9 aa, Homo Sapiens
HDLVLTLSN

SEQ ID NO: 681695 - protein, 9 aa, Homo Sapiens
TRYMYNREE

SEQ ID NO: 681696 - protein, 9 aa, Homo Sapiens
LSMALPQEF

SEQ ID NO: 681697 - protein, 9 aa, Homo Sapiens
TGEEPRRRA

SEQ ID NO: 681698 - protein, 9 aa, Homo Sapiens
CIGEKIQDF

SEQ ID NO: 681699 - protein, 9 aa, Homo Sapiens
CKAAADVAN

SEQ ID NO: 681700 - protein, 9 aa, Homo Sapiens
ENFCHNPDG

SEQ ID NO: 681701 - protein, 9 aa, Homo Sapiens
KINILHKQA

SEQ ID NO: 681702 - protein, 9 aa, Homo Sapiens
EDERLGLFF

SEQ ID NO: 681703 - protein, 9 aa, Homo Sapiens
GNKSEADQM

SEQ ID NO: 681704 - protein, 9 aa, Homo Sapiens
AVRSNHRQA

SEQ ID NO: 681705 - protein, 9 aa, Homo Sapiens
KVAVKVCLL

SEQ ID NO: 681706 - protein, 9 aa, Homo Sapiens
EKLEPSTTF

SEQ ID NO: 681707 - protein, 9 aa, Homo Sapiens
LPKGDTPQD

SEQ ID NO: 681708 - protein, 9 aa, Homo Sapiens
LTAMAYDSY

SEQ ID NO: 681709 - protein, 9 aa, Homo Sapiens
ATFGAHDLV

SEQ ID NO: 681710 - protein, 9 aa, Homo Sapiens
EDGAKQGED

SEQ ID NO: 681711 - protein, 9 aa, Homo Sapiens
LLKSDNKVV

SEQ ID NO: 681712 - protein, 9 aa, Homo Sapiens
FSRSSFSHR

SEQ ID NO: 681713 - protein, 9 aa, Homo Sapiens
AHLMMDKAV

SEQ ID NO: 681714 - protein, 9 aa, Homo Sapiens
PQCVEDGDV

SEQ ID NO: 681715 - protein, 9 aa, Homo Sapiens
LFIKRMYKK

SEQ ID NO: 681716 - protein, 9 aa, Homo Sapiens
GPAEDEDPE

SEQ ID NO: 681717 - protein, 9 aa, Homo Sapiens
YKKEQLREY

SEQ ID NO: 681718 - protein, 9 aa, Homo Sapiens
DNDECSSVN

SEQ ID NO: 681719 - protein, 9 aa, Homo Sapiens
LLAHTCYTF

SEQ ID NO: 681720 - protein, 9 aa, Homo Sapiens
RPATRQGTP

SEQ ID NO: 681721 - protein, 9 aa, Homo Sapiens
SWDRDAAPA

SEQ ID NO: 681722 - protein, 9 aa, Homo Sapiens
KLEPSTTFT

SEQ ID NO: 681723 - protein, 9 aa, Homo Sapiens
SSGKLSSSL

SEQ ID NO: 681724 - protein, 9 aa, Homo Sapiens
PPYFCQGPS

SEQ ID NO: 681725 - protein, 9 aa, Homo Sapiens
MFERLASEA

SEQ ID NO: 681726 - protein, 9 aa, Homo Sapiens
NPAAVSPTW

SEQ ID NO: 681727 - protein, 9 aa, Homo Sapiens
DTRHFLVHA

SEQ ID NO: 681728 - protein, 9 aa, Homo Sapiens
NKETAAEIL

SEQ ID NO: 681729 - protein, 9 aa, Homo Sapiens
EEPRRRAAK

SEQ ID NO: 681730 - protein, 9 aa, Homo Sapiens
KSEADQMVS

SEQ ID NO: 681731 - protein, 9 aa, Homo Sapiens
LGSTVQMEL

SEQ ID NO: 681732 - protein, 9 aa, Homo Sapiens
QAEDGAKQG

SEQ ID NO: 681733 - protein, 9 aa, Homo Sapiens
EDHQQLILY

SEQ ID NO: 681734 - protein, 9 aa, Homo Sapiens
SYQDDKNRQ

SEQ ID NO: 681735 - protein, 9 aa, Homo Sapiens
APAPLGQPG

SEQ ID NO: 681736 - protein, 9 aa, Homo Sapiens
RLVTRYMYN

SEQ ID NO: 681737 - protein, 9 aa, Homo Sapiens
CHNPDGDPG

SEQ ID NO: 681738 - protein, 9 aa, Homo Sapiens
DLGLAEDHQ

SEQ ID NO: 681739 - protein, 9 aa, Homo Sapiens
QNIHDENQK

SEQ ID NO: 681740 - protein, 9 aa, Homo Sapiens
VMAFKNRTL

SEQ ID NO: 681741 - protein, 9 aa, Homo Sapiens
HSRRIPHLP

SEQ ID NO: 681742 - protein, 9 aa, Homo Sapiens
LHSSLKATQ

SEQ ID NO: 681743 - protein, 9 aa, Homo Sapiens
CGFYLTVVM

SEQ ID NO: 681744 - protein, 9 aa, Homo Sapiens
YSTTSMDLS

SEQ ID NO: 681745 - protein, 9 aa, Homo Sapiens
GSTVQMELS

SEQ ID NO: 681746 - protein, 9 aa, Homo Sapiens
ICTLRQLGK

SEQ ID NO: 681747 - protein, 9 aa, Homo Sapiens
GDFAYVLPG

SEQ ID NO: 681748 - protein, 9 aa, Homo Sapiens
LLDEDVWEL

SEQ ID NO: 681749 - protein, 9 aa, Homo Sapiens
TSRTLELAH

SEQ ID NO: 681750 - protein, 9 aa, Homo Sapiens
GEGGDLPGV

SEQ ID NO: 681751 - protein, 9 aa, Homo Sapiens
ELLRFHDSG

SEQ ID NO: 681752 - protein, 9 aa, Homo Sapiens
HVSLAADTD

SEQ ID NO: 681753 - protein, 9 aa, Homo Sapiens
FYKDMKKFG

SEQ ID NO: 681754 - protein, 9 aa, Homo Sapiens
DDVIGCGFK

SEQ ID NO: 681755 - protein, 9 aa, Homo Sapiens
ASNAEKAEI

SEQ ID NO: 681756 - protein, 9 aa, Homo Sapiens
HNLKEGKHH

SEQ ID NO: 681757 - protein, 9 aa, Homo Sapiens
LCKSSFLPA

SEQ ID NO: 681758 - protein, 9 aa, Homo Sapiens
KKTSCSVYG

SEQ ID NO: 681759 - protein, 9 aa, Homo Sapiens
KNLNAVGSV

SEQ ID NO: 681760 - protein, 9 aa, Homo Sapiens
VEKIAIKQY

SEQ ID NO: 681761 - protein, 9 aa, Homo Sapiens
CNSHKLRCH

SEQ ID NO: 681762 - protein, 9 aa, Homo Sapiens
HCKRCIIEH

SEQ ID NO: 681763 - protein, 9 aa, Homo Sapiens
LQRQLSMAL

SEQ ID NO: 681764 - protein, 9 aa, Homo Sapiens
YFCQGPSNR

SEQ ID NO: 681765 - protein, 9 aa, Homo Sapiens
MLSYQDDKN

SEQ ID NO: 681766 - protein, 9 aa, Homo Sapiens
IKLKDIFSV

SEQ ID NO: 681767 - protein, 9 aa, Homo Sapiens
RISLYVSIE

SEQ ID NO: 681768 - protein, 9 aa, Homo Sapiens
WRSDVDEKR

SEQ ID NO: 681769 - protein, 9 aa, Homo Sapiens
LRCHLQNLH

SEQ ID NO: 681770 - protein, 9 aa, Homo Sapiens
AHGHDAVVP

SEQ ID NO: 681771 - protein, 9 aa, Homo Sapiens
EHVHIEAQD

SEQ ID NO: 681772 - protein, 9 aa, Homo Sapiens
HTCYTFEVQ

SEQ ID NO: 681773 - protein, 9 aa, Homo Sapiens
SPTPLLDSD

SEQ ID NO: 681774 - protein, 9 aa, Homo Sapiens
YEIERSLFL

SEQ ID NO: 681775 - protein, 9 aa, Homo Sapiens
RPDDRKHHH

SEQ ID NO: 681776 - protein, 9 aa, Homo Sapiens
QRQLSMALP

SEQ ID NO: 681777 - protein, 9 aa, Homo Sapiens
TGPEYKALD

SEQ ID NO: 681778 - protein, 9 aa, Homo Sapiens
EQDGQCDGP

SEQ ID NO: 681779 - protein, 9 aa, Homo Sapiens
EEATEEDIN

SEQ ID NO: 681780 - protein, 9 aa, Homo Sapiens
WCAVSSICT

SEQ ID NO: 681781 - protein, 9 aa, Homo Sapiens
KDSSGSVSE

SEQ ID NO: 681782 - protein, 9 aa, Homo Sapiens
NHLPYPILQ

SEQ ID NO: 681783 - protein, 9 aa, Homo Sapiens
CVSVAAGLP

SEQ ID NO: 681784 - protein, 9 aa, Homo Sapiens
TRHFLVHAS

SEQ ID NO: 681785 - protein, 9 aa, Homo Sapiens
TCKSPRHKE

SEQ ID NO: 681786 - protein, 9 aa, Homo Sapiens
DKQKNQEIH

SEQ ID NO: 681787 - protein, 9 aa, Homo Sapiens
HKLRCHLQN

SEQ ID NO: 681788 - protein, 9 aa, Homo Sapiens
SSLEKQIRH

SEQ ID NO: 681789 - protein, 9 aa, Homo Sapiens
LQISPGRML

SEQ ID NO: 681790 - protein, 9 aa, Homo Sapiens
LGTGNMEIN

SEQ ID NO: 681791 - protein, 9 aa, Homo Sapiens
VTDASLVST

SEQ ID NO: 681792 - protein, 9 aa, Homo Sapiens
GDVAVRSNH

SEQ ID NO: 681793 - protein, 9 aa, Homo Sapiens
YLPKVAVKV

SEQ ID NO: 681794 - protein, 9 aa, Homo Sapiens
RVYDGFFSP

SEQ ID NO: 681795 - protein, 9 aa, Homo Sapiens
ADVVLERGQ

SEQ ID NO: 681796 - protein, 9 aa, Homo Sapiens
PTEQSINDE

SEQ ID NO: 681797 - protein, 9 aa, Homo Sapiens
EVKAAHRSM

SEQ ID NO: 681798 - protein, 9 aa, Homo Sapiens
VMLFYGSIF

SEQ ID NO: 681799 - protein, 9 aa, Homo Sapiens
LKQWRSDVD

SEQ ID NO: 681800 - protein, 9 aa, Homo Sapiens
AEHGRLRVN

SEQ ID NO: 681801 - protein, 9 aa, Homo Sapiens
ECSSVNTAI

SEQ ID NO: 681802 - protein, 9 aa, Homo Sapiens
DAAAPGPTE

SEQ ID NO: 681803 - protein, 9 aa, Homo Sapiens
DEVKAAHRS

SEQ ID NO: 681804 - protein, 9 aa, Homo Sapiens
VDTKKPYPA

SEQ ID NO: 681805 - protein, 9 aa, Homo Sapiens
VSVPKMEGD

SEQ ID NO: 681806 - protein, 9 aa, Homo Sapiens
ADIQAMQDS

SEQ ID NO: 681807 - protein, 9 aa, Homo Sapiens
EQCCVSVAA

SEQ ID NO: 681808 - protein, 9 aa, Homo Sapiens
VPWTFQELE

SEQ ID NO: 681809 - protein, 9 aa, Homo Sapiens
KNEQEHNAG

SEQ ID NO: 681810 - protein, 9 aa, Homo Sapiens
EVQQIISDP

SEQ ID NO: 681811 - protein, 9 aa, Homo Sapiens
EDLDHYEIK

SEQ ID NO: 681812 - protein, 9 aa, Homo Sapiens
NKSEADQMV

SEQ ID NO: 681813 - protein, 9 aa, Homo Sapiens
AAPAPAPLG

SEQ ID NO: 681814 - protein, 9 aa, Homo Sapiens
GVGSSQQEH

SEQ ID NO: 681815 - protein, 9 aa, Homo Sapiens
QKGPGPGAS

SEQ ID NO: 681816 - protein, 9 aa, Homo Sapiens
AQSGRNLHS

SEQ ID NO: 681817 - protein, 9 aa, Homo Sapiens
PFPTEQSIN

SEQ ID NO: 681818 - protein, 9 aa, Homo Sapiens
QIISDPAMR

SEQ ID NO: 681819 - protein, 9 aa, Homo Sapiens
RRVPRSGRP

SEQ ID NO: 681820 - protein, 9 aa, Homo Sapiens
VARLACPKA

SEQ ID NO: 681821 - protein, 9 aa, Homo Sapiens
EDAAAPGPT

SEQ ID NO: 681822 - protein, 9 aa, Homo Sapiens
QVLIRISLY

SEQ ID NO: 681823 - protein, 9 aa, Homo Sapiens
FYLDYVSIS

SEQ ID NO: 681824 - protein, 9 aa, Homo Sapiens
RPGFPVSFP

SEQ ID NO: 681825 - protein, 9 aa, Homo Sapiens
DQHAVHLEE

SEQ ID NO: 681826 - protein, 9 aa, Homo Sapiens
TTKTAGPKQ

SEQ ID NO: 681827 - protein, 9 aa, Homo Sapiens
ELGLVSFQG

SEQ ID NO: 681828 - protein, 9 aa, Homo Sapiens
DTSGKKLSL

SEQ ID NO: 681829 - protein, 9 aa, Homo Sapiens
CSESPGRIR

SEQ ID NO: 681830 - protein, 9 aa, Homo Sapiens
LASEALEPM

SEQ ID NO: 681831 - protein, 9 aa, Homo Sapiens
RHKEDRSPK

SEQ ID NO: 681832 - protein, 9 aa, Homo Sapiens
QICRKRKLE

SEQ ID NO: 681833 - protein, 9 aa, Homo Sapiens
IASAGANAL

SEQ ID NO: 681834 - protein, 9 aa, Homo Sapiens
KSLPTSELP

SEQ ID NO: 681835 - protein, 9 aa, Homo Sapiens
KEHRLDYFP

SEQ ID NO: 681836 - protein, 9 aa, Homo Sapiens
HQREQRREG

SEQ ID NO: 681837 - protein, 9 aa, Homo Sapiens
RLQEQTGAK

SEQ ID NO: 681838 - protein, 9 aa, Homo Sapiens
AFLQKQNIH

SEQ ID NO: 681839 - protein, 9 aa, Homo Sapiens
IDLGLAEDH

SEQ ID NO: 681840 - protein, 9 aa, Homo Sapiens
LIRISLYVS

SEQ ID NO: 681841 - protein, 9 aa, Homo Sapiens
CHQEDMKHK

SEQ ID NO: 681842 - protein, 9 aa, Homo Sapiens
LVSPISESM

SEQ ID NO: 681843 - protein, 9 aa, Homo Sapiens
GFNKKFAQS

SEQ ID NO: 681844 - protein, 9 aa, Homo Sapiens
VEHLQKSEF

SEQ ID NO: 681845 - protein, 9 aa, Homo Sapiens
RPRLRPSRC

SEQ ID NO: 681846 - protein, 9 aa, Homo Sapiens
DEVPWTFQE

SEQ ID NO: 681847 - protein, 9 aa, Homo Sapiens
EQSINDEDI

SEQ ID NO: 681848 - protein, 9 aa, Homo Sapiens
CTIAHWQYS

SEQ ID NO: 681849 - protein, 9 aa, Homo Sapiens
SLPSVQLSN

SEQ ID NO: 681850 - protein, 9 aa, Homo Sapiens
CKFCSSLLA

SEQ ID NO: 681851 - protein, 9 aa, Homo Sapiens
GRRGPSSRE

SEQ ID NO: 681852 - protein, 9 aa, Homo Sapiens
EPPPLGGVG

SEQ ID NO: 681853 - protein, 9 aa, Homo Sapiens
LHHIIKGNK

SEQ ID NO: 681854 - protein, 9 aa, Homo Sapiens
PRSGRPRLR

SEQ ID NO: 681855 - protein, 9 aa, Homo Sapiens
QIAYSTTSM

SEQ ID NO: 681856 - protein, 9 aa, Homo Sapiens
NGSFLALSR

SEQ ID NO: 681857 - protein, 9 aa, Homo Sapiens
AAHGHDAVV

SEQ ID NO: 681858 - protein, 9 aa, Homo Sapiens
VRSNHRQAE

SEQ ID NO: 681859 - protein, 9 aa, Homo Sapiens
GANALAKVF

SEQ ID NO: 681860 - protein, 9 aa, Homo Sapiens
LNGSFLALS

SEQ ID NO: 681861 - protein, 9 aa, Homo Sapiens
IKRMYKKEQ

SEQ ID NO: 681862 - protein, 9 aa, Homo Sapiens
CLMVTSSST

SEQ ID NO: 681863 - protein, 9 aa, Homo Sapiens
DGWIYPDAN

SEQ ID NO: 681864 - protein, 9 aa, Homo Sapiens
RQGTPPRTH

SEQ ID NO: 681865 - protein, 9 aa, Homo Sapiens
PAPAPLGQP

SEQ ID NO: 681866 - protein, 9 aa, Homo Sapiens
HMMGEDHHG

SEQ ID NO: 681867 - protein, 9 aa, Homo Sapiens
GAAAEHGRL

SEQ ID NO: 681868 - protein, 9 aa, Homo Sapiens
QEIKKRKKA

SEQ ID NO: 681869 - protein, 9 aa, Homo Sapiens
RYMYNREEY

SEQ ID NO: 681870 - protein, 9 aa, Homo Sapiens
GKIATPLLC

SEQ ID NO: 681871 - protein, 9 aa, Homo Sapiens
PGLWGFRHN

SEQ ID NO: 681872 - protein, 9 aa, Homo Sapiens
LTGPEYKAL

SEQ ID NO: 681873 - protein, 9 aa, Homo Sapiens
LNGQIYVIG

SEQ ID NO: 681874 - protein, 9 aa, Homo Sapiens
VIGCGFKTA

SEQ ID NO: 681875 - protein, 9 aa, Homo Sapiens
EFVHRVVES

SEQ ID NO: 681876 - protein, 9 aa, Homo Sapiens
LPYPILQVH

SEQ ID NO: 681877 - protein, 9 aa, Homo Sapiens
ERQLVVSLA

SEQ ID NO: 681878 - protein, 9 aa, Homo Sapiens
DSSGCLCPA

SEQ ID NO: 681879 - protein, 9 aa, Homo Sapiens
SGSLPSLHH

SEQ ID NO: 681880 - protein, 9 aa, Homo Sapiens
GKAPSEDLF

SEQ ID NO: 681881 - protein, 9 aa, Homo Sapiens
RSLFLRMKC

SEQ ID NO: 681882 - protein, 9 aa, Homo Sapiens
PQGKAFSLE

SEQ ID NO: 681883 - protein, 9 aa, Homo Sapiens
IPGGAAAEH

SEQ ID NO: 681884 - protein, 9 aa, Homo Sapiens
GEDHHGDAS

SEQ ID NO: 681885 - protein, 9 aa, Homo Sapiens
LQKSEFTQQ

SEQ ID NO: 681886 - protein, 9 aa, Homo Sapiens
QLQPFLFGL

SEQ ID NO: 681887 - protein, 9 aa, Homo Sapiens
DKMRRAAEE

SEQ ID NO: 681888 - protein, 9 aa, Homo Sapiens
HIIKGNKEI

SEQ ID NO: 681889 - protein, 9 aa, Homo Sapiens
DATGSPKQD

SEQ ID NO: 681890 - protein, 9 aa, Homo Sapiens
HDLSVDFWS

SEQ ID NO: 681891 - protein, 9 aa, Homo Sapiens
DRKHHHSAA

SEQ ID NO: 681892 - protein, 9 aa, Homo Sapiens
PWTFQELEA

SEQ ID NO: 681893 - protein, 9 aa, Homo Sapiens
SRRIPHLPG

SEQ ID NO: 681894 - protein, 9 aa, Homo Sapiens
LLFELFSLF

SEQ ID NO: 681895 - protein, 9 aa, Homo Sapiens
VRPGFPVSF

SEQ ID NO: 681896 - protein, 9 aa, Homo Sapiens
WDRDAAPAR

SEQ ID NO: 681897 - protein, 9 aa, Homo Sapiens
NTIKRLQEQ

SEQ ID NO: 681898 - protein, 9 aa, Homo Sapiens
QAGGGRMKA

SEQ ID NO: 681899 - protein, 9 aa, Homo Sapiens
FTLSPKDQG

SEQ ID NO: 681900 - protein, 9 aa, Homo Sapiens
EINKETAAE

SEQ ID NO: 681901 - protein, 9 aa, Homo Sapiens
CNSSSFVPS

SEQ ID NO: 681902 - protein, 9 aa, Homo Sapiens
ASPRAERPD

SEQ ID NO: 681903 - protein, 9 aa, Homo Sapiens
SVPVSLKKK

SEQ ID NO: 681904 - protein, 9 aa, Homo Sapiens
AAVYEHGCL

SEQ ID NO: 681905 - protein, 9 aa, Homo Sapiens
ADPEVQQII

SEQ ID NO: 681906 - protein, 9 aa, Homo Sapiens
EHNAGGDSQ

SEQ ID NO: 681907 - protein, 9 aa, Homo Sapiens
TVSMNKAIN

SEQ ID NO: 681908 - protein, 9 aa, Homo Sapiens
HDAVVPQCV

SEQ ID NO: 681909 - protein, 9 aa, Homo Sapiens
IAHWQYSLA

SEQ ID NO: 681910 - protein, 9 aa, Homo Sapiens
SYTKQVEVD

SEQ ID NO: 681911 - protein, 9 aa, Homo Sapiens
KMRRAAEER

SEQ ID NO: 681912 - protein, 9 aa, Homo Sapiens
KQWRSDVDE

SEQ ID NO: 681913 - protein, 9 aa, Homo Sapiens
EHGRLRVND

SEQ ID NO: 681914 - protein, 9 aa, Homo Sapiens
SERFTSYQK

SEQ ID NO: 681915 - protein, 9 aa, Homo Sapiens
AGKSLPTSE

SEQ ID NO: 681916 - protein, 9 aa, Homo Sapiens
CGFKTATWL

SEQ ID NO: 681917 - protein, 9 aa, Homo Sapiens
IIASNAEKA

SEQ ID NO: 681918 - protein, 9 aa, Homo Sapiens
PPLARNRYG

SEQ ID NO: 681919 - protein, 9 aa, Homo Sapiens
TRQGTPPRT

SEQ ID NO: 681920 - protein, 9 aa, Homo Sapiens
LVTDASLVS

SEQ ID NO: 681921 - protein, 9 aa, Homo Sapiens
DHHGDASPR

SEQ ID NO: 681922 - protein, 9 aa, Homo Sapiens
GKYKEAVAE

SEQ ID NO: 681923 - protein, 9 aa, Homo Sapiens
YFLGQRCKS

SEQ ID NO: 681924 - protein, 9 aa, Homo Sapiens
PHGSLFPHL

SEQ ID NO: 681925 - protein, 9 aa, Homo Sapiens
EYKALDALP

SEQ ID NO: 681926 - protein, 9 aa, Homo Sapiens
GTEETVCYK

SEQ ID NO: 681927 - protein, 9 aa, Homo Sapiens
DDSEKLEQE

SEQ ID NO: 681928 - protein, 9 aa, Homo Sapiens
SGLNNSVQQ

SEQ ID NO: 681929 - protein, 9 aa, Homo Sapiens
LMPLLQTLH

SEQ ID NO: 681930 - protein, 9 aa, Homo Sapiens
AHKEANAAR

SEQ ID NO: 681931 - protein, 9 aa, Homo Sapiens
EQEHNAGGD

SEQ ID NO: 681932 - protein, 9 aa, Homo Sapiens
FLGQRCKSE

SEQ ID NO: 681933 - protein, 9 aa, Homo Sapiens
EPRRRAAKP

SEQ ID NO: 681934 - protein, 9 aa, Homo Sapiens
KAHKEANAA

SEQ ID NO: 681935 - protein, 9 aa, Homo Sapiens
NAEKAEILH

SEQ ID NO: 681936 - protein, 9 aa, Homo Sapiens
NQSLTCVPP

SEQ ID NO: 681937 - protein, 9 aa, Homo Sapiens
GSQCISSGQ

SEQ ID NO: 681938 - protein, 9 aa, Homo Sapiens
YGCTIPKKT

SEQ ID NO: 681939 - protein, 9 aa, Homo Sapiens
RSNHRQAED

SEQ ID NO: 681940 - protein, 9 aa, Homo Sapiens
RTQTVSMNK

SEQ ID NO: 681941 - protein, 9 aa, Homo Sapiens
LVVSLAAMR

SEQ ID NO: 681942 - protein, 9 aa, Homo Sapiens
EVLHGVEKM

SEQ ID NO: 681943 - protein, 9 aa, Homo Sapiens
AHDQHAVHL

SEQ ID NO: 681944 - protein, 9 aa, Homo Sapiens
MAEEEAILQ

SEQ ID NO: 681945 - protein, 9 aa, Homo Sapiens
ASEALEPMV

SEQ ID NO: 681946 - protein, 9 aa, Homo Sapiens
GKNKVAAQI

SEQ ID NO: 681947 - protein, 9 aa, Homo Sapiens
AVGVTWAEC

SEQ ID NO: 681948 - protein, 9 aa, Homo Sapiens
KQGVDDVIG

SEQ ID NO: 681949 - protein, 9 aa, Homo Sapiens
KHRVATQFT

SEQ ID NO: 681950 - protein, 9 aa, Homo Sapiens
EKIKVLHSS

SEQ ID NO: 681951 - protein, 9 aa, Homo Sapiens
PATRQGTPP

SEQ ID NO: 681952 - protein, 9 aa, Homo Sapiens
LKKKEASLQ

SEQ ID NO: 681953 - protein, 9 aa, Homo Sapiens
PCKFTLSPK

SEQ ID NO: 681954 - protein, 9 aa, Homo Sapiens
TQISSLPSV

SEQ ID NO: 681955 - protein, 9 aa, Homo Sapiens
IRISLYVSI

SEQ ID NO: 681956 - protein, 9 aa, Homo Sapiens
APGPLACPC

SEQ ID NO: 681957 - protein, 9 aa, Homo Sapiens
QSGRNLHSS

SEQ ID NO: 681958 - protein, 9 aa, Homo Sapiens
QGKAFSLES

SEQ ID NO: 681959 - protein, 9 aa, Homo Sapiens
SLHHIIKGN

SEQ ID NO: 681960 - protein, 9 aa, Homo Sapiens
YGRRGPSSR

SEQ ID NO: 681961 - protein, 9 aa, Homo Sapiens
AMKAQMAEE

SEQ ID NO: 681962 - protein, 9 aa, Homo Sapiens
RDDSEKLEQ

SEQ ID NO: 681963 - protein, 9 aa, Homo Sapiens
IPTFEVMAF

SEQ ID NO: 681964 - protein, 9 aa, Homo Sapiens
EDINDKFAE

SEQ ID NO: 681965 - protein, 9 aa, Homo Sapiens
SEQPYRPGT

SEQ ID NO: 681966 - protein, 9 aa, Homo Sapiens
IRHPSPPPE

SEQ ID NO: 681967 - protein, 9 aa, Homo Sapiens
KEFVHRVVE

SEQ ID NO: 681968 - protein, 9 aa, Homo Sapiens
TIAHWQYSL

SEQ ID NO: 681969 - protein, 9 aa, Homo Sapiens
ALKERVYDG

SEQ ID NO: 681970 - protein, 9 aa, Homo Sapiens
SEPPPLGGV

SEQ ID NO: 681971 - protein, 9 aa, Homo Sapiens
ESPNGKIAT

SEQ ID NO: 681972 - protein, 9 aa, Homo Sapiens
ELFSLFYIF

SEQ ID NO: 681973 - protein, 9 aa, Homo Sapiens
MRNVRELRG

SEQ ID NO: 681974 - protein, 9 aa, Homo Sapiens
GMKNAVIHA

SEQ ID NO: 681975 - protein, 9 aa, Homo Sapiens
LEVCLLKSD

SEQ ID NO: 681976 - protein, 9 aa, Homo Sapiens
ERMSIPCDV

SEQ ID NO: 681977 - protein, 9 aa, Homo Sapiens
ERELYKQVN

SEQ ID NO: 681978 - protein, 9 aa, Homo Sapiens
IAYSTTSMD

SEQ ID NO: 681979 - protein, 9 aa, Homo Sapiens
GAAWACFRQ

SEQ ID NO: 681980 - protein, 9 aa, Homo Sapiens
VAEYQMIIK

SEQ ID NO: 681981 - protein, 9 aa, Homo Sapiens
ESLLASTLK

SEQ ID NO: 681982 - protein, 9 aa, Homo Sapiens
SGSVSEQLP

SEQ ID NO: 681983 - protein, 9 aa, Homo Sapiens
PSRCAAATS

SEQ ID NO: 681984 - protein, 9 aa, Homo Sapiens
SKEAEWEEL

SEQ ID NO: 681985 - protein, 9 aa, Homo Sapiens
HLILTSSQQ

SEQ ID NO: 681986 - protein, 9 aa, Homo Sapiens
IQRFLSEPF

SEQ ID NO: 681987 - protein, 9 aa, Homo Sapiens
GLWGFRHNE

SEQ ID NO: 681988 - protein, 9 aa, Homo Sapiens
KSAAMTLSE

SEQ ID NO: 681989 - protein, 9 aa, Homo Sapiens
KIAIKQYTS

SEQ ID NO: 681990 - protein, 9 aa, Homo Sapiens
EPQLQPFLF

SEQ ID NO: 681991 - protein, 9 aa, Homo Sapiens
DVCEPKYKT

SEQ ID NO: 681992 - protein, 9 aa, Homo Sapiens
QFIQLVPVA

SEQ ID NO: 681993 - protein, 9 aa, Homo Sapiens
KLKDIFSVK

SEQ ID NO: 681994 - protein, 9 aa, Homo Sapiens
AKLSPTGTS

SEQ ID NO: 681995 - protein, 9 aa, Homo Sapiens
CKSPRHKED

SEQ ID NO: 681996 - protein, 9 aa, Homo Sapiens
RAPGAAGLA

SEQ ID NO: 681997 - protein, 9 aa, Homo Sapiens
FFGQKGPGP

SEQ ID NO: 681998 - protein, 9 aa, Homo Sapiens
RRKRPSASK

SEQ ID NO: 681999 - protein, 9 aa, Homo Sapiens
GLNNSVQQF

SEQ ID NO: 682000 - protein, 9 aa, Homo Sapiens
ASAALNGQI

SEQ ID NO: 682001 - protein, 9 aa, Homo Sapiens
ALNGQIYVI

SEQ ID NO: 682002 - protein, 9 aa, Homo Sapiens
HVAGAVGVT

SEQ ID NO: 682003 - protein, 9 aa, Homo Sapiens
LPALKERVY

SEQ ID NO: 682004 - protein, 9 aa, Homo Sapiens
AEDGAKQGE

SEQ ID NO: 682005 - protein, 9 aa, Homo Sapiens
PRQNLEYHV

SEQ ID NO: 682006 - protein, 9 aa, Homo Sapiens
FDGFNKKFA

SEQ ID NO: 682007 - protein, 9 aa, Homo Sapiens
MTKKLDVEQ

SEQ ID NO: 682008 - protein, 9 aa, Homo Sapiens
MYKKEQLRE

SEQ ID NO: 682009 - protein, 9 aa, Homo Sapiens
ELIWMKFHS

SEQ ID NO: 682010 - protein, 9 aa, Homo Sapiens
HKEANAARK

SEQ ID NO: 682011 - protein, 9 aa, Homo Sapiens
MKAISTCTS

SEQ ID NO: 682012 - protein, 9 aa, Homo Sapiens
EDPEQDGQC

SEQ ID NO: 682013 - protein, 9 aa, Homo Sapiens
SVAAGLPHF

SEQ ID NO: 682014 - protein, 9 aa, Homo Sapiens
PINGTEETV

SEQ ID NO: 682015 - protein, 9 aa, Homo Sapiens
TKQVEVDAQ

SEQ ID NO: 682016 - protein, 9 aa, Homo Sapiens
ERHVAGAVG

SEQ ID NO: 682017 - protein, 9 aa, Homo Sapiens
PSTTFTSQP

SEQ ID NO: 682018 - protein, 9 aa, Homo Sapiens
VPGMKNAVI

SEQ ID NO: 682019 - protein, 9 aa, Homo Sapiens
HGRLRVNDC

SEQ ID NO: 682020 - protein, 9 aa, Homo Sapiens
HKGGPAEDE

SEQ ID NO: 682021 - protein, 9 aa, Homo Sapiens
KGHDLSVDF

SEQ ID NO: 682022 - protein, 9 aa, Homo Sapiens
LKEFVHRVV

SEQ ID NO: 682023 - protein, 9 aa, Homo Sapiens
NLEYHVFFS

SEQ ID NO: 682024 - protein, 9 aa, Homo Sapiens
RIYVKMRNV

SEQ ID NO: 682025 - protein, 9 aa, Homo Sapiens
ADQMVSTIN

SEQ ID NO: 682026 - protein, 9 aa, Homo Sapiens
RLQCKFCSS

SEQ ID NO: 682027 - protein, 9 aa, Homo Sapiens
RIQMLLFEL

SEQ ID NO: 682028 - protein, 9 aa, Homo Sapiens
IGSVAKLSP

SEQ ID NO: 682029 - protein, 9 aa, Homo Sapiens
RKRPSASKT

SEQ ID NO: 682030 - protein, 9 aa, Homo Sapiens
GPVFQTPHR

SEQ ID NO: 682031 - protein, 9 aa, Homo Sapiens
DAQGTSCVC

SEQ ID NO: 682032 - protein, 9 aa, Homo Sapiens
PPPLGGVGL

SEQ ID NO: 682033 - protein, 9 aa, Homo Sapiens
ILTSSQQCL

SEQ ID NO: 682034 - protein, 9 aa, Homo Sapiens
SQVELLRFH

SEQ ID NO: 682035 - protein, 9 aa, Homo Sapiens
QLERMSIPC

SEQ ID NO: 682036 - protein, 9 aa, Homo Sapiens
YVFKEFKSF

SEQ ID NO: 682037 - protein, 9 aa, Homo Sapiens
INDKFAEYG

SEQ ID NO: 682038 - protein, 9 aa, Homo Sapiens
KGGPAEDED

SEQ ID NO: 682039 - protein, 9 aa, Homo Sapiens
DWCAVSSIC

SEQ ID NO: 682040 - protein, 9 aa, Homo Sapiens
PVSLKKKEA

SEQ ID NO: 682041 - protein, 9 aa, Homo Sapiens
RFHDSGRKD

SEQ ID NO: 682042 - protein, 9 aa, Homo Sapiens
YSNTVIRTI

SEQ ID NO: 682043 - protein, 9 aa, Homo Sapiens
GTYWPLWYI

SEQ ID NO: 682044 - protein, 9 aa, Homo Sapiens
QDEDQHQRE

SEQ ID NO: 682045 - protein, 9 aa, Homo Sapiens
IPQIAYSTT

SEQ ID NO: 682046 - protein, 9 aa, Homo Sapiens
QCAKCGKAF

SEQ ID NO: 682047 - protein, 9 aa, Homo Sapiens
DFAYVLPGP

SEQ ID NO: 682048 - protein, 9 aa, Homo Sapiens
GGAAAEHGR

SEQ ID NO: 682049 - protein, 9 aa, Homo Sapiens
LPSARCTRR

SEQ ID NO: 682050 - protein, 9 aa, Homo Sapiens
AQDEDQHQR

SEQ ID NO: 682051 - protein, 9 aa, Homo Sapiens
PAATFGAHD

SEQ ID NO: 682052 - protein, 9 aa, Homo Sapiens
LEVLHGVEK

SEQ ID NO: 682053 - protein, 9 aa, Homo Sapiens
SLVHEVDTQ

SEQ ID NO: 682054 - protein, 9 aa, Homo Sapiens
EADQMVSTI

SEQ ID NO: 682055 - protein, 9 aa, Homo Sapiens
FKSAAMTLS

SEQ ID NO: 682056 - protein, 9 aa, Homo Sapiens
DSYVAICKP

SEQ ID NO: 682057 - protein, 9 aa, Homo Sapiens
AAYAANVLS

SEQ ID NO: 682058 - protein, 9 aa, Homo Sapiens
LLTFNSVVE

SEQ ID NO: 682059 - protein, 9 aa, Homo Sapiens
IALVWFGPK

SEQ ID NO: 682060 - protein, 9 aa, Homo Sapiens
GLPSRIALV

SEQ ID NO: 682061 - protein, 9 aa, Homo Sapiens
AMGKDLQGA

SEQ ID NO: 682062 - protein, 9 aa, Homo Sapiens
AVHLEERHV

SEQ ID NO: 682063 - protein, 9 aa, Homo Sapiens
NGKIATPLL

SEQ ID NO: 682064 - protein, 9 aa, Homo Sapiens
PAEDEDPEQ

SEQ ID NO: 682065 - protein, 9 aa, Homo Sapiens
AATSSSEAW

SEQ ID NO: 682066 - protein, 9 aa, Homo Sapiens
HGHSRRIPH

SEQ ID NO: 682067 - protein, 9 aa, Homo Sapiens
SAAMTLSER

SEQ ID NO: 682068 - protein, 9 aa, Homo Sapiens
RQDAQGTSC

SEQ ID NO: 682069 - protein, 9 aa, Homo Sapiens
PEVQQIISD

SEQ ID NO: 682070 - protein, 9 aa, Homo Sapiens
RGLPKGDTP

SEQ ID NO: 682071 - protein, 9 aa, Homo Sapiens
VDVSVPKME

SEQ ID NO: 682072 - protein, 9 aa, Homo Sapiens
QISSLPSVQ

SEQ ID NO: 682073 - protein, 9 aa, Homo Sapiens
LKMCLVAAS

SEQ ID NO: 682074 - protein, 9 aa, Homo Sapiens
YKAAVCFAQ

SEQ ID NO: 682075 - protein, 9 aa, Homo Sapiens
EKNPGLRFS

SEQ ID NO: 682076 - protein, 9 aa, Homo Sapiens
AKETLKINI

SEQ ID NO: 682077 - protein, 9 aa, Homo Sapiens
SEALEPMVL

SEQ ID NO: 682078 - protein, 9 aa, Homo Sapiens
GTQAGSAAC

SEQ ID NO: 682079 - protein, 9 aa, Homo Sapiens
ASLVSTGHA

SEQ ID NO: 682080 - protein, 9 aa, Homo Sapiens
TVSWDRDAA

SEQ ID NO: 682081 - protein, 9 aa, Homo Sapiens
YKALDALPD

SEQ ID NO: 682082 - protein, 9 aa, Homo Sapiens
VLPSAHLMM

SEQ ID NO: 682083 - protein, 9 aa, Homo Sapiens
SICTLRQLG

SEQ ID NO: 682084 - protein, 9 aa, Homo Sapiens
VSRAQCWSN

SEQ ID NO: 682085 - protein, 9 aa, Homo Sapiens
QQIISDPAM

SEQ ID NO: 682086 - protein, 9 aa, Homo Sapiens
VSSSLDRAI

SEQ ID NO: 682087 - protein, 9 aa, Homo Sapiens
FERTQTVSM

SEQ ID NO: 682088 - protein, 9 aa, Homo Sapiens
DQTKLDNDE

SEQ ID NO: 682089 - protein, 9 aa, Homo Sapiens
RSGRPRLRP

SEQ ID NO: 682090 - protein, 9 aa, Homo Sapiens
VHRVVESLD

SEQ ID NO: 682091 - protein, 9 aa, Homo Sapiens
HDQHAVHLE

SEQ ID NO: 682092 - protein, 9 aa, Homo Sapiens
ILHLFIQRS

SEQ ID NO: 682093 - protein, 9 aa, Homo Sapiens
YTRSPRQNL

SEQ ID NO: 682094 - protein, 9 aa, Homo Sapiens
QRGISLVHE

SEQ ID NO: 682095 - protein, 9 aa, Homo Sapiens
QSSGLDCGN

SEQ ID NO: 682096 - protein, 9 aa, Homo Sapiens
PYPILQVHH

SEQ ID NO: 682097 - protein, 9 aa, Homo Sapiens
VVMLFYGSI

SEQ ID NO: 682098 - protein, 9 aa, Homo Sapiens
VTSSSTSLT

SEQ ID NO: 682099 - protein, 9 aa, Homo Sapiens
HYCHSYELF

SEQ ID NO: 682100 - protein, 9 aa, Homo Sapiens
KYRFRVFAE

SEQ ID NO: 682101 - protein, 9 aa, Homo Sapiens
LSYTTLKMC

SEQ ID NO: 682102 - protein, 9 aa, Homo Sapiens
VRKCSTPQE

SEQ ID NO: 682103 - protein, 9 aa, Homo Sapiens
TSAAAEQCS

SEQ ID NO: 682104 - protein, 9 aa, Homo Sapiens
NDKFAEYGE

SEQ ID NO: 682105 - protein, 9 aa, Homo Sapiens
TPLLDSDED

SEQ ID NO: 682106 - protein, 9 aa, Homo Sapiens
FIQFLSKAR

SEQ ID NO: 682107 - protein, 9 aa, Homo Sapiens
LEPSTTFTS

SEQ ID NO: 682108 - protein, 9 aa, Homo Sapiens
TSGSEKKKK

SEQ ID NO: 682109 - protein, 9 aa, Homo Sapiens
KIATPLLCW

SEQ ID NO: 682110 - protein, 9 aa, Homo Sapiens
TRSPRQNLE

SEQ ID NO: 682111 - protein, 9 aa, Homo Sapiens
VTWAECHQE

SEQ ID NO: 682112 - protein, 9 aa, Homo Sapiens
LFFMDTHGY

SEQ ID NO: 682113 - protein, 9 aa, Homo Sapiens
DGSFSIISQ

SEQ ID NO: 682114 - protein, 9 aa, Homo Sapiens
GPGDFAYVL

SEQ ID NO: 682115 - protein, 9 aa, Homo Sapiens
KRMYKKEQL

SEQ ID NO: 682116 - protein, 9 aa, Homo Sapiens
ISHLLAHTC

SEQ ID NO: 682117 - protein, 9 aa, Homo Sapiens
SLQRQLSMA

SEQ ID NO: 682118 - protein, 9 aa, Homo Sapiens
LSPKDQGPL

SEQ ID NO: 682119 - protein, 9 aa, Homo Sapiens
AQMAEEEAI

SEQ ID NO: 682120 - protein, 9 aa, Homo Sapiens
TMLRMSKIT

SEQ ID NO: 682121 - protein, 9 aa, Homo Sapiens
YAFLHMERA

SEQ ID NO: 682122 - protein, 9 aa, Homo Sapiens
CKFTLSPKD

SEQ ID NO: 682123 - protein, 9 aa, Homo Sapiens
FNKKFAQST

SEQ ID NO: 682124 - protein, 9 aa, Homo Sapiens
TIIVPGMKN

SEQ ID NO: 682125 - protein, 9 aa, Homo Sapiens
KIAQKSFSR

SEQ ID NO: 682126 - protein, 9 aa, Homo Sapiens
PGPTEGVLE

SEQ ID NO: 682127 - protein, 9 aa, Homo Sapiens
FRNESLLAS

SEQ ID NO: 682128 - protein, 9 aa, Homo Sapiens
MSESPNGKI

SEQ ID NO: 682129 - protein, 9 aa, Homo Sapiens
FFYLDYVSI

SEQ ID NO: 682130 - protein, 9 aa, Homo Sapiens
TGNMEINKE

SEQ ID NO: 682131 - protein, 9 aa, Homo Sapiens
QCDGPFHVG

SEQ ID NO: 682132 - protein, 9 aa, Homo Sapiens
QRYFLGQRC

SEQ ID NO: 682133 - protein, 9 aa, Homo Sapiens
GVDDVIGCG

SEQ ID NO: 682134 - protein, 9 aa, Homo Sapiens
GVSRAQCWS

SEQ ID NO: 682135 - protein, 9 aa, Homo Sapiens
YGFSDLLTF

SEQ ID NO: 682136 - protein, 9 aa, Homo Sapiens
AVGKAPSED

SEQ ID NO: 682137 - protein, 9 aa, Homo Sapiens
AAGLAAMPM

SEQ ID NO: 682138 - protein, 9 aa, Homo Sapiens
TEEDINDKF

SEQ ID NO: 682139 - protein, 9 aa, Homo Sapiens
AKCGKAFNC

SEQ ID NO: 682140 - protein, 9 aa, Homo Sapiens
DLDEVPWTF

SEQ ID NO: 682141 - protein, 9 aa, Homo Sapiens
KIQDFKVGN

SEQ ID NO: 682142 - protein, 9 aa, Homo Sapiens
ALCRWASSP

SEQ ID NO: 682143 - protein, 9 aa, Homo Sapiens
DGKYGFSDL

SEQ ID NO: 682144 - protein, 9 aa, Homo Sapiens
EIAHVSQYD

SEQ ID NO: 682145 - protein, 9 aa, Homo Sapiens
GKAFSLESC

SEQ ID NO: 682146 - protein, 9 aa, Homo Sapiens
RMSKITTSS

SEQ ID NO: 682147 - protein, 9 aa, Homo Sapiens
SGIQTMAAS

SEQ ID NO: 682148 - protein, 9 aa, Homo Sapiens
IRTIKLEHV

SEQ ID NO: 682149 - protein, 9 aa, Homo Sapiens
FCHNPDGDP

SEQ ID NO: 682150 - protein, 9 aa, Homo Sapiens
PFHVGSGEG

SEQ ID NO: 682151 - protein, 9 aa, Homo Sapiens
KHKGGPAED

SEQ ID NO: 682152 - protein, 9 aa, Homo Sapiens
KNKVAAQIC

SEQ ID NO: 682153 - protein, 9 aa, Homo Sapiens
IMRKEVWVA

SEQ ID NO: 682154 - protein, 9 aa, Homo Sapiens
LLRFHDSGR

SEQ ID NO: 682155 - protein, 9 aa, Homo Sapiens
LQKQNIHDE

SEQ ID NO: 682156 - protein, 9 aa, Homo Sapiens
CTLRQLGKK

SEQ ID NO: 682157 - protein, 9 aa, Homo Sapiens
VAAGLPHFS

SEQ ID NO: 682158 - protein, 9 aa, Homo Sapiens
RLQEDKMRR

SEQ ID NO: 682159 - protein, 9 aa, Homo Sapiens
LPTSELPSA

SEQ ID NO: 682160 - protein, 9 aa, Homo Sapiens
DECSSVNTA

SEQ ID NO: 682161 - protein, 9 aa, Homo Sapiens
QEQTGAKIS

SEQ ID NO: 682162 - protein, 9 aa, Homo Sapiens
GAKQGEDKQ

SEQ ID NO: 682163 - protein, 9 aa, Homo Sapiens
RTHADSSGC

SEQ ID NO: 682164 - protein, 9 aa, Homo Sapiens
APQGKAFSL

SEQ ID NO: 682165 - protein, 9 aa, Homo Sapiens
SPRAERPDD

SEQ ID NO: 682166 - protein, 9 aa, Homo Sapiens
KKPYPASIP

SEQ ID NO: 682167 - protein, 9 aa, Homo Sapiens
RMYKKEQLR

SEQ ID NO: 682168 - protein, 9 aa, Homo Sapiens
VGPVFQTPH

SEQ ID NO: 682169 - protein, 9 aa, Homo Sapiens
KLRCHLQNL

SEQ ID NO: 682170 - protein, 9 aa, Homo Sapiens
YVKRPATRQ

SEQ ID NO: 682171 - protein, 9 aa, Homo Sapiens
DGAKQGEDK

SEQ ID NO: 682172 - protein, 9 aa, Homo Sapiens
AWACFRQDG

SEQ ID NO: 682173 - protein, 9 aa, Homo Sapiens
FGAHDLVLT

SEQ ID NO: 682174 - protein, 9 aa, Homo Sapiens
PLGQPGLMA

SEQ ID NO: 682175 - protein, 9 aa, Homo Sapiens
QDPKKGERL

SEQ ID NO: 682176 - protein, 9 aa, Homo Sapiens
VGPAPQGKA

SEQ ID NO: 682177 - protein, 9 aa, Homo Sapiens
DGDVAVRSN

SEQ ID NO: 682178 - protein, 9 aa, Homo Sapiens
AQGTSCVCL

SEQ ID NO: 682179 - protein, 9 aa, Homo Sapiens
EDIDLGLAE

SEQ ID NO: 682180 - protein, 9 aa, Homo Sapiens
IVKDYAFLH

SEQ ID NO: 682181 - protein, 9 aa, Homo Sapiens
MALPQEFAA

SEQ ID NO: 682182 - protein, 9 aa, Homo Sapiens
YKEAVAEYQ

SEQ ID NO: 682183 - protein, 9 aa, Homo Sapiens
DLSYTTLKM

SEQ ID NO: 682184 - protein, 9 aa, Homo Sapiens
NHRQAEDGA

SEQ ID NO: 682185 - protein, 9 aa, Homo Sapiens
KFTLSPKDQ

SEQ ID NO: 682186 - protein, 9 aa, Homo Sapiens
DVLYIVSQL

SEQ ID NO: 682187 - protein, 9 aa, Homo Sapiens
CHFYKDMKK

SEQ ID NO: 682188 - protein, 9 aa, Homo Sapiens
QYDQDIFQD

SEQ ID NO: 682189 - protein, 9 aa, Homo Sapiens
DSEKLEQEG

SEQ ID NO: 682190 - protein, 9 aa, Homo Sapiens
ALIASAGAN

SEQ ID NO: 682191 - protein, 9 aa, Homo Sapiens
LGQRCKSEV

SEQ ID NO: 682192 - protein, 9 aa, Homo Sapiens
SLKKKEASL

SEQ ID NO: 682193 - protein, 9 aa, Homo Sapiens
VLYIVSQLF

SEQ ID NO: 682194 - protein, 9 aa, Homo Sapiens
KSPRHKEDR

SEQ ID NO: 682195 - protein, 9 aa, Homo Sapiens
KRHCKRCII

SEQ ID NO: 682196 - protein, 9 aa, Homo Sapiens
HLEERHVAG

SEQ ID NO: 682197 - protein, 9 aa, Homo Sapiens
WKHRVATQF

SEQ ID NO: 682198 - protein, 9 aa, Homo Sapiens
SEFTQQLNA

SEQ ID NO: 682199 - protein, 9 aa, Homo Sapiens
HPKSVPVSL

SEQ ID NO: 682200 - protein, 9 aa, Homo Sapiens
TLKMCLVAA

SEQ ID NO: 682201 - protein, 9 aa, Homo Sapiens
VSLKKKEAS

SEQ ID NO: 682202 - protein, 9 aa, Homo Sapiens
SRTLELAHQ

SEQ ID NO: 682203 - protein, 9 aa, Homo Sapiens
LLDMARRVP

SEQ ID NO: 682204 - protein, 9 aa, Homo Sapiens
WTAGKSLPT

SEQ ID NO: 682205 - protein, 9 aa, Homo Sapiens
DPEVQQIIS

SEQ ID NO: 682206 - protein, 9 aa, Homo Sapiens
EIPTFEVMA

SEQ ID NO: 682207 - protein, 9 aa, Homo Sapiens
DDRKHHHSA

SEQ ID NO: 682208 - protein, 9 aa, Homo Sapiens
RLDYFPEVT

SEQ ID NO: 682209 - protein, 9 aa, Homo Sapiens
KKEQLREYV

SEQ ID NO: 682210 - protein, 9 aa, Homo Sapiens
KAFSLESCQ

SEQ ID NO: 682211 - protein, 9 aa, Homo Sapiens
LADAMHILH

SEQ ID NO: 682212 - protein, 9 aa, Homo Sapiens
QDAQGTSCV

SEQ ID NO: 682213 - protein, 9 aa, Homo Sapiens
MELSGSDFP

SEQ ID NO: 682214 - protein, 9 aa, Homo Sapiens
DIQAMQDSL

SEQ ID NO: 682215 - protein, 9 aa, Homo Sapiens
GISLVHEVD

SEQ ID NO: 682216 - protein, 9 aa, Homo Sapiens
LFELFSLFY

SEQ ID NO: 682217 - protein, 9 aa, Homo Sapiens
SEDFFGQKG

SEQ ID NO: 682218 - protein, 9 aa, Homo Sapiens
GKLSSSLVR

SEQ ID NO: 682219 - protein, 9 aa, Homo Sapiens
GFMQFIQLV

SEQ ID NO: 682220 - protein, 9 aa, Homo Sapiens
LRFSISGGI

SEQ ID NO: 682221 - protein, 9 aa, Homo Sapiens
HRLDYFPEV

SEQ ID NO: 682222 - protein, 9 aa, Homo Sapiens
LVFELGLVS

SEQ ID NO: 682223 - protein, 9 aa, Homo Sapiens
WASSPHGSL

SEQ ID NO: 682224 - protein, 9 aa, Homo Sapiens
ERENSKNEQ

SEQ ID NO: 682225 - protein, 9 aa, Homo Sapiens
RYGRRGPSS

SEQ ID NO: 682226 - protein, 9 aa, Homo Sapiens
QEEHGHSRR

SEQ ID NO: 682227 - protein, 9 aa, Homo Sapiens
RSDVDEKRQ

SEQ ID NO: 682228 - protein, 9 aa, Homo Sapiens
QCWSNGQWS

SEQ ID NO: 682229 - protein, 9 aa, Homo Sapiens
SGSEKKKKV

SEQ ID NO: 682230 - protein, 9 aa, Homo Sapiens
DNKVVDNQA

SEQ ID NO: 682231 - protein, 9 aa, Homo Sapiens
TATWLEIAH

SEQ ID NO: 682232 - protein, 9 aa, Homo Sapiens
ECHFYKDMK

SEQ ID NO: 682233 - protein, 9 aa, Homo Sapiens
TLNGSFLAL

SEQ ID NO: 682234 - protein, 9 aa, Homo Sapiens
DDKNRQLTL

SEQ ID NO: 682235 - protein, 9 aa, Homo Sapiens
RCHLQNLHW

SEQ ID NO: 682236 - protein, 9 aa, Homo Sapiens
KGDTPQDTS

SEQ ID NO: 682237 - protein, 9 aa, Homo Sapiens
YLDYVSISY

SEQ ID NO: 682238 - protein, 9 aa, Homo Sapiens
EELSSKEAE

SEQ ID NO: 682239 - protein, 9 aa, Homo Sapiens
SLCKSSFLP

SEQ ID NO: 682240 - protein, 9 aa, Homo Sapiens
DPNPAAVSP

SEQ ID NO: 682241 - protein, 9 aa, Homo Sapiens
SIISQEALS

SEQ ID NO: 682242 - protein, 9 aa, Homo Sapiens
DVIGCGFKT

SEQ ID NO: 682243 - protein, 9 aa, Homo Sapiens
QHAVHLEER

SEQ ID NO: 682244 - protein, 9 aa, Homo Sapiens
PSAHLMMDK

SEQ ID NO: 682245 - protein, 9 aa, Homo Sapiens
TPQEIKKRK

SEQ ID NO: 682246 - protein, 9 aa, Homo Sapiens
LLDSDEDEE

SEQ ID NO: 682247 - protein, 9 aa, Homo Sapiens
LVTSRTLEL

SEQ ID NO: 682248 - protein, 9 aa, Homo Sapiens
TIIASNAEK

SEQ ID NO: 682249 - protein, 9 aa, Homo Sapiens
WEVFLEVLH

SEQ ID NO: 682250 - protein, 9 aa, Homo Sapiens
LDYVSISYY

SEQ ID NO: 682251 - protein, 9 aa, Homo Sapiens
SRAQCWSNG

SEQ ID NO: 682252 - protein, 9 aa, Homo Sapiens
NMEINKETA

SEQ ID NO: 682253 - protein, 9 aa, Homo Sapiens
LQVLIRISL

SEQ ID NO: 682254 - protein, 9 aa, Homo Sapiens
SYTTLKMCL

SEQ ID NO: 682255 - protein, 9 aa, Homo Sapiens
SLSPPIPKT

SEQ ID NO: 682256 - protein, 9 aa, Homo Sapiens
AAQDPKKGE

SEQ ID NO: 682257 - protein, 9 aa, Homo Sapiens
AHRSMLQKT

SEQ ID NO: 682258 - protein, 9 aa, Homo Sapiens
EQSKHNQEL

SEQ ID NO: 682259 - protein, 9 aa, Homo Sapiens
LHMERAEDA

SEQ ID NO: 682260 - protein, 9 aa, Homo Sapiens
KVRKCSTPQ

SEQ ID NO: 682261 - protein, 9 aa, Homo Sapiens
GWIYPDANK

SEQ ID NO: 682262 - protein, 9 aa, Homo Sapiens
GLRFSISGG

SEQ ID NO: 682263 - protein, 9 aa, Homo Sapiens
TATLQNISE

SEQ ID NO: 682264 - protein, 9 aa, Homo Sapiens
PQERELYKQ

SEQ ID NO: 682265 - protein, 9 aa, Homo Sapiens
SSQAGAMGK

SEQ ID NO: 682266 - protein, 9 aa, Homo Sapiens
SLPPYFCQG

SEQ ID NO: 682267 - protein, 9 aa, Homo Sapiens
FSDLLTFNS

SEQ ID NO: 682268 - protein, 9 aa, Homo Sapiens
IGEKIQDFK

SEQ ID NO: 682269 - protein, 9 aa, Homo Sapiens
GPLACPCLC

SEQ ID NO: 682270 - protein, 9 aa, Homo Sapiens
LQCKFCSSL

SEQ ID NO: 682271 - protein, 9 aa, Homo Sapiens
IDAIFLTAT

SEQ ID NO: 682272 - protein, 9 aa, Homo Sapiens
GCLCPAPTP

SEQ ID NO: 682273 - protein, 9 aa, Homo Sapiens
ENSKNEQSK

SEQ ID NO: 682274 - protein, 9 aa, Homo Sapiens
VCLLKSDNK

SEQ ID NO: 682275 - protein, 9 aa, Homo Sapiens
TVEKIAIKQ

SEQ ID NO: 682276 - protein, 9 aa, Homo Sapiens
DKNLNAVGS

SEQ ID NO: 682277 - protein, 9 aa, Homo Sapiens
LSPHTVHYC

SEQ ID NO: 682278 - protein, 9 aa, Homo Sapiens
DVEQPDSAN

SEQ ID NO: 682279 - protein, 9 aa, Homo Sapiens
AVSSICTLR

SEQ ID NO: 682280 - protein, 9 aa, Homo Sapiens
QDGRTLLRV

SEQ ID NO: 682281 - protein, 9 aa, Homo Sapiens
SKTPSQWLN

SEQ ID NO: 682282 - protein, 9 aa, Homo Sapiens
QMVSTINTI

SEQ ID NO: 682283 - protein, 9 aa, Homo Sapiens
RVRLVTRYM

SEQ ID NO: 682284 - protein, 9 aa, Homo Sapiens
ANKDHNSQF

SEQ ID NO: 682285 - protein, 9 aa, Homo Sapiens
WKNPRVGPV

SEQ ID NO: 682286 - protein, 9 aa, Homo Sapiens
PEIPTFEVM

SEQ ID NO: 682287 - protein, 9 aa, Homo Sapiens
HGFMQFIQL

SEQ ID NO: 682288 - protein, 9 aa, Homo Sapiens
PPTITVSWD

SEQ ID NO: 682289 - protein, 9 aa, Homo Sapiens
SDVCEPKYK

SEQ ID NO: 682290 - protein, 9 aa, Homo Sapiens
DFFGQKGPG

SEQ ID NO: 682291 - protein, 9 aa, Homo Sapiens
IISQEALSC

SEQ ID NO: 682292 - protein, 9 aa, Homo Sapiens
GAAGLAAMP

SEQ ID NO: 682293 - protein, 9 aa, Homo Sapiens
SEFIQFLSK

SEQ ID NO: 682294 - protein, 9 aa, Homo Sapiens
HSRDISGLN

SEQ ID NO: 682295 - protein, 9 aa, Homo Sapiens
KLEQEGEEE

SEQ ID NO: 682296 - protein, 9 aa, Homo Sapiens
GIAHDQHAV

SEQ ID NO: 682297 - protein, 9 aa, Homo Sapiens
AFLHMERAE

SEQ ID NO: 682298 - protein, 9 aa, Homo Sapiens
ATQFTLPRF

SEQ ID NO: 682299 - protein, 9 aa, Homo Sapiens
QEGEEEWDD

SEQ ID NO: 682300 - protein, 9 aa, Homo Sapiens
DHYEIKEEE

SEQ ID NO: 682301 - protein, 9 aa, Homo Sapiens
SKITTSSSA

SEQ ID NO: 682302 - protein, 9 aa, Homo Sapiens
VEQPDSANS

SEQ ID NO: 682303 - protein, 9 aa, Homo Sapiens
VTSRTLELA

SEQ ID NO: 682304 - protein, 9 aa, Homo Sapiens
SLFLRMKCV

SEQ ID NO: 682305 - protein, 9 aa, Homo Sapiens
TIMRKEVWV

SEQ ID NO: 682306 - protein, 9 aa, Homo Sapiens
TFTSQPHLI

SEQ ID NO: 682307 - protein, 9 aa, Homo Sapiens
HLGPLQISP

SEQ ID NO: 682308 - protein, 9 aa, Homo Sapiens
SNTVIRTIK

SEQ ID NO: 682309 - protein, 9 aa, Homo Sapiens
ASAGANALA

SEQ ID NO: 682310 - protein, 9 aa, Homo Sapiens
RMSIPCDVW

SEQ ID NO: 682311 - protein, 9 aa, Homo Sapiens
HYVTIMRKE

SEQ ID NO: 682312 - protein, 9 aa, Homo Sapiens
WIYPDANKR

SEQ ID NO: 682313 - protein, 9 aa, Homo Sapiens
RQLSMALPQ

SEQ ID NO: 682314 - protein, 9 aa, Homo Sapiens
KRQKAHKEA

SEQ ID NO: 682315 - protein, 9 aa, Homo Sapiens
APAPAPLGQ

SEQ ID NO: 682316 - protein, 9 aa, Homo Sapiens
SFPLAYPPP

SEQ ID NO: 682317 - protein, 9 aa, Homo Sapiens
EVPWTFQEL

SEQ ID NO: 682318 - protein, 9 aa, Homo Sapiens
VLERGQYPY

SEQ ID NO: 682319 - protein, 9 aa, Homo Sapiens
AEYQMIIKK

SEQ ID NO: 682320 - protein, 9 aa, Homo Sapiens
EHGCLLGLS

SEQ ID NO: 682321 - protein, 9 aa, Homo Sapiens
CYTFEVQAV

SEQ ID NO: 682322 - protein, 9 aa, Homo Sapiens
SEADQMVST

SEQ ID NO: 682323 - protein, 9 aa, Homo Sapiens
FLPALKERV

SEQ ID NO: 682324 - protein, 9 aa, Homo Sapiens
EEAMRERQL

SEQ ID NO: 682325 - protein, 9 aa, Homo Sapiens
RCIIEHTNP

SEQ ID NO: 682326 - protein, 9 aa, Homo Sapiens
TWLEIAHVS

SEQ ID NO: 682327 - protein, 9 aa, Homo Sapiens
QVELLRFHD

SEQ ID NO: 682328 - protein, 9 aa, Homo Sapiens
ISPTPLLDS

SEQ ID NO: 682329 - protein, 9 aa, Homo Sapiens
KSVPVSLKK

SEQ ID NO: 682330 - protein, 9 aa, Homo Sapiens
SAAAEQCSE

SEQ ID NO: 682331 - protein, 9 aa, Homo Sapiens
LSYQDDKNR

SEQ ID NO: 682332 - protein, 9 aa, Homo Sapiens
VGSGEGGDL

SEQ ID NO: 682333 - protein, 9 aa, Homo Sapiens
YKDMKKFGG

SEQ ID NO: 682334 - protein, 9 aa, Homo Sapiens
LISSYYNGT

SEQ ID NO: 682335 - protein, 9 aa, Homo Sapiens
LANIDPNPA

SEQ ID NO: 682336 - protein, 9 aa, Homo Sapiens
PLHYVTIMR

SEQ ID NO: 682337 - protein, 9 aa, Homo Sapiens
LLASTLKTL

SEQ ID NO: 682338 - protein, 9 aa, Homo Sapiens
MQDSLLQIQ

SEQ ID NO: 682339 - protein, 9 aa, Homo Sapiens
AIRTIENWG

SEQ ID NO: 682340 - protein, 9 aa, Homo Sapiens
EATEEDIND

SEQ ID NO: 682341 - protein, 9 aa, Homo Sapiens
KSDNKVVDN

SEQ ID NO: 682342 - protein, 9 aa, Homo Sapiens
SVPKMEGDL

SEQ ID NO: 682343 - protein, 9 aa, Homo Sapiens
LHGVEKMKS

SEQ ID NO: 682344 - protein, 9 aa, Homo Sapiens
EYQMIIKKK

SEQ ID NO: 682345 - protein, 9 aa, Homo Sapiens
SVQLSNLKV

SEQ ID NO: 682346 - protein, 9 aa, Homo Sapiens
LSQIPAVHD

SEQ ID NO: 682347 - protein, 9 aa, Homo Sapiens
CAKCGKAFN

SEQ ID NO: 682348 - protein, 9 aa, Homo Sapiens
SSSLDRAIR

SEQ ID NO: 682349 - protein, 9 aa, Homo Sapiens
FLSEPFQVA

SEQ ID NO: 682350 - protein, 9 aa, Homo Sapiens
ELSSKEAEW

SEQ ID NO: 682351 - protein, 9 aa, Homo Sapiens
RAQCWSNGQ

SEQ ID NO: 682352 - protein, 9 aa, Homo Sapiens
AVVPQCVED

SEQ ID NO: 682353 - protein, 8 aa, Homo Sapiens
RSRKLTGA

SEQ ID NO: 682354 - protein, 9 aa, Homo Sapiens
AVYEHGCLL

SEQ ID NO: 682355 - protein, 9 aa, Homo Sapiens
AKNEQEHNA

SEQ ID NO: 682356 - protein, 9 aa, Homo Sapiens
HFYKDMKKF

SEQ ID NO: 682357 - protein, 9 aa, Homo Sapiens
SVAKLSPTG

SEQ ID NO: 682358 - protein, 9 aa, Homo Sapiens
LWGFRHNER

SEQ ID NO: 682359 - protein, 9 aa, Homo Sapiens
FLQKQNIHD

SEQ ID NO: 682360 - protein, 9 aa, Homo Sapiens
VCPFDGFNK

SEQ ID NO: 682361 - protein, 9 aa, Homo Sapiens
MPLLQTLHN

SEQ ID NO: 682362 - protein, 9 aa, Homo Sapiens
LQVHHMASQ

SEQ ID NO: 682363 - protein, 9 aa, Homo Sapiens
HLQKSEFTQ

SEQ ID NO: 682364 - protein, 9 aa, Homo Sapiens
EWEELKKKA

SEQ ID NO: 682365 - protein, 9 aa, Homo Sapiens
INILHKQAS

SEQ ID NO: 682366 - protein, 9 aa, Homo Sapiens
ADSSGCLCP

SEQ ID NO: 682367 - protein, 9 aa, Homo Sapiens
VATLNGSFL

SEQ ID NO: 682368 - protein, 9 aa, Homo Sapiens
YPDANKRSL

SEQ ID NO: 682369 - protein, 9 aa, Homo Sapiens
CVEDGDVAV

SEQ ID NO: 682370 - protein, 9 aa, Homo Sapiens
NLNAVGSVL

SEQ ID NO: 682371 - protein, 9 aa, Homo Sapiens
LPSAHLMMD

SEQ ID NO: 682372 - protein, 9 aa, Homo Sapiens
VCEPKYKTV

SEQ ID NO: 682373 - protein, 9 aa, Homo Sapiens
AYAANVLSQ

SEQ ID NO: 682374 - protein, 9 aa, Homo Sapiens
IEDLDHYEI

SEQ ID NO: 682375 - protein, 9 aa, Homo Sapiens
WSPAAQDPK

SEQ ID NO: 682376 - protein, 9 aa, Homo Sapiens
IEKNPGLRF

SEQ ID NO: 682377 - protein, 9 aa, Homo Sapiens
CPFDGFNKK

SEQ ID NO: 682378 - protein, 9 aa, Homo Sapiens
GEKIQDFKV

SEQ ID NO: 682379 - protein, 9 aa, Homo Sapiens
EVFLEVLHG

SEQ ID NO: 682380 - protein, 9 aa, Homo Sapiens
VKAAHRSML

SEQ ID NO: 682381 - protein, 9 aa, Homo Sapiens
HGVEKMKSM

SEQ ID NO: 682382 - protein, 9 aa, Homo Sapiens
FLEVLHGVE

SEQ ID NO: 682383 - protein, 9 aa, Homo Sapiens
ESPIKGHAQ

SEQ ID NO: 682384 - protein, 9 aa, Homo Sapiens
ISSYYNGTY

SEQ ID NO: 682385 - protein, 9 aa, Homo Sapiens
CVPQERELY

SEQ ID NO: 682386 - protein, 9 aa, Homo Sapiens
EDISPTPLL

SEQ ID NO: 682387 - protein, 9 aa, Homo Sapiens
RKIQRFLSE

SEQ ID NO: 682388 - protein, 9 aa, Homo Sapiens
SSPHGSLFP

SEQ ID NO: 682389 - protein, 9 aa, Homo Sapiens
ERTQTVSMN

SEQ ID NO: 682390 - protein, 9 aa, Homo Sapiens
KKYRFRVFA

SEQ ID NO: 682391 - protein, 9 aa, Homo Sapiens
APGAAGLAA

SEQ ID NO: 682392 - protein, 9 aa, Homo Sapiens
QEVMQLACT

SEQ ID NO: 682393 - protein, 9 aa, Homo Sapiens
SESPIKGHA

SEQ ID NO: 682394 - protein, 9 aa, Homo Sapiens
EDKQGVDDV

SEQ ID NO: 682395 - protein, 9 aa, Homo Sapiens
AQCWSNGQW

SEQ ID NO: 682396 - protein, 9 aa, Homo Sapiens
AGAMGKDLQ

SEQ ID NO: 682397 - protein, 9 aa, Homo Sapiens
TEETVCYKQ

SEQ ID NO: 682398 - protein, 9 aa, Homo Sapiens
LELAHQPLH

SEQ ID NO: 682399 - protein, 9 aa, Homo Sapiens
LYKQVNCFF

SEQ ID NO: 682400 - protein, 9 aa, Homo Sapiens
QCSESPGRI

SEQ ID NO: 682401 - protein, 9 aa, Homo Sapiens
PRLRPSRCA

SEQ ID NO: 682402 - protein, 9 aa, Homo Sapiens
AEQCSESPG

SEQ ID NO: 682403 - protein, 9 aa, Homo Sapiens
FLPASQNNL

SEQ ID NO: 682404 - protein, 9 aa, Homo Sapiens
EQPYRPGTW

SEQ ID NO: 682405 - protein, 9 aa, Homo Sapiens
RTSAAAEQC

SEQ ID NO: 682406 - protein, 9 aa, Homo Sapiens
KEQQGDATG

SEQ ID NO: 682407 - protein, 9 aa, Homo Sapiens
KTQYPDIFM

SEQ ID NO: 682408 - protein, 9 aa, Homo Sapiens
FFMDTHGYS

SEQ ID NO: 682409 - protein, 9 aa, Homo Sapiens
TVTCKSPRH

SEQ ID NO: 682410 - protein, 9 aa, Homo Sapiens
QGVSRAQCW

SEQ ID NO: 682411 - protein, 9 aa, Homo Sapiens
SLKATQAEL

SEQ ID NO: 682412 - protein, 9 aa, Homo Sapiens
RVRLQCKFC

SEQ ID NO: 682413 - protein, 9 aa, Homo Sapiens
LKINILHKQ

SEQ ID NO: 682414 - protein, 9 aa, Homo Sapiens
TLKQWRSDV

SEQ ID NO: 682415 - protein, 9 aa, Homo Sapiens
SHVDTKKPY

SEQ ID NO: 682416 - protein, 9 aa, Homo Sapiens
LSSQAGAMG

SEQ ID NO: 682417 - protein, 9 aa, Homo Sapiens
IYPDANKRS

SEQ ID NO: 682418 - protein, 9 aa, Homo Sapiens
QRQDAQGTS

SEQ ID NO: 682419 - protein, 9 aa, Homo Sapiens
APGPTEGVL

SEQ ID NO: 682420 - protein, 9 aa, Homo Sapiens
FPVSFPLAY

SEQ ID NO: 682421 - protein, 9 aa, Homo Sapiens
AKRQKAHKE

SEQ ID NO: 682422 - protein, 9 aa, Homo Sapiens
PTEGVLERQ

SEQ ID NO: 682423 - protein, 9 aa, Homo Sapiens
FFSIGDDSL

SEQ ID NO: 682424 - protein, 9 aa, Homo Sapiens
RELYKQVNC

SEQ ID NO: 682425 - protein, 9 aa, Homo Sapiens
VSVAAGLPH

SEQ ID NO: 682426 - protein, 9 aa, Homo Sapiens
DLPGVGSSQ

SEQ ID NO: 682427 - protein, 9 aa, Homo Sapiens
SEAWTAGKS

SEQ ID NO: 682428 - protein, 9 aa, Homo Sapiens
TSELPSARC

SEQ ID NO: 682429 - protein, 9 aa, Homo Sapiens
LEENFCHNP

SEQ ID NO: 682430 - protein, 9 aa, Homo Sapiens
AALVSPISE

SEQ ID NO: 682431 - protein, 9 aa, Homo Sapiens
GEEPRRRAA

SEQ ID NO: 682432 - protein, 9 aa, Homo Sapiens
DSGIQTMAA

SEQ ID NO: 682433 - protein, 9 aa, Homo Sapiens
SQYDQDIFQ

SEQ ID NO: 682434 - protein, 9 aa, Homo Sapiens
SSGCLCPAP

SEQ ID NO: 682435 - protein, 9 aa, Homo Sapiens
FAQSGRNLH

SEQ ID NO: 682436 - protein, 9 aa, Homo Sapiens
LVPPGLWGF

SEQ ID NO: 682437 - protein, 9 aa, Homo Sapiens
MKHLAAVYE

SEQ ID NO: 682438 - protein, 9 aa, Homo Sapiens
VTSLCKSSF

SEQ ID NO: 682439 - protein, 9 aa, Homo Sapiens
RQLVVSLAA

SEQ ID NO: 682440 - protein, 9 aa, Homo Sapiens
ARRVPRSGR

SEQ ID NO: 682441 - protein, 9 aa, Homo Sapiens
SSICTLRQL

SEQ ID NO: 682442 - protein, 9 aa, Homo Sapiens
FLHMERAED

SEQ ID NO: 682443 - protein, 9 aa, Homo Sapiens
LVTRYMYNR

SEQ ID NO: 682444 - protein, 9 aa, Homo Sapiens
AMHILHLFI

SEQ ID NO: 682445 - protein, 9 aa, Homo Sapiens
VHEVDTQYS

SEQ ID NO: 682446 - protein, 9 aa, Homo Sapiens
VGSNPQSSG

SEQ ID NO: 682447 - protein, 9 aa, Homo Sapiens
GHDAVVPQC

SEQ ID NO: 682448 - protein, 9 aa, Homo Sapiens
EQLERMSIP

SEQ ID NO: 682449 - protein, 9 aa, Homo Sapiens
GANQRQDAQ

SEQ ID NO: 682450 - protein, 9 aa, Homo Sapiens
MKAQMAEEE

SEQ ID NO: 682451 - protein, 9 aa, Homo Sapiens
QLVVSLAAM

SEQ ID NO: 682452 - protein, 9 aa, Homo Sapiens
KQYLSAEQL

SEQ ID NO: 682453 - protein, 9 aa, Homo Sapiens
DEDQHQREQ

SEQ ID NO: 682454 - protein, 9 aa, Homo Sapiens
LSSSLVRGV

SEQ ID NO: 682455 - protein, 9 aa, Homo Sapiens
SQQDTSGKK

SEQ ID NO: 682456 - protein, 9 aa, Homo Sapiens
CAAATSSSE

SEQ ID NO: 682457 - protein, 9 aa, Homo Sapiens
GHAQPYDPN

SEQ ID NO: 682458 - protein, 9 aa, Homo Sapiens
RENSKNEQS

SEQ ID NO: 682459 - protein, 9 aa, Homo Sapiens
AAVSPTWEQ

SEQ ID NO: 682460 - protein, 9 aa, Homo Sapiens
IGCGFKTAT

SEQ ID NO: 682461 - protein, 9 aa, Homo Sapiens
INGTEETVC

SEQ ID NO: 682462 - protein, 9 aa, Homo Sapiens
RQAEDGAKQ

SEQ ID NO: 682463 - protein, 9 aa, Homo Sapiens
SFVPSGRRG

SEQ ID NO: 682464 - protein, 9 aa, Homo Sapiens
KLDNDECSS

SEQ ID NO: 682465 - protein, 9 aa, Homo Sapiens
PISEKQYLS

SEQ ID NO: 682466 - protein, 9 aa, Homo Sapiens
KSPSHVSLA

SEQ ID NO: 682467 - protein, 9 aa, Homo Sapiens
LQEDKMRRA

SEQ ID NO: 682468 - protein, 9 aa, Homo Sapiens
CHLQNLHWK

SEQ ID NO: 682469 - protein, 9 aa, Homo Sapiens
FAENLAGPG

SEQ ID NO: 682470 - protein, 9 aa, Homo Sapiens
EKAEILHSA

SEQ ID NO: 682471 - protein, 9 aa, Homo Sapiens
HGDASPRAE

SEQ ID NO: 682472 - protein, 9 aa, Homo Sapiens
ARNRYGRRG

SEQ ID NO: 682473 - protein, 9 aa, Homo Sapiens
VRELRGRLH

SEQ ID NO: 682474 - protein, 9 aa, Homo Sapiens
FIKLKDIFS

SEQ ID NO: 682475 - protein, 9 aa, Homo Sapiens
YQCAKCGKA

SEQ ID NO: 682476 - protein, 9 aa, Homo Sapiens
LGLSEEPQL

SEQ ID NO: 682477 - protein, 9 aa, Homo Sapiens
QTVSMNKAI

SEQ ID NO: 682478 - protein, 9 aa, Homo Sapiens
IKVLHSSLK

SEQ ID NO: 682479 - protein, 9 aa, Homo Sapiens
SGKLSSSLV

SEQ ID NO: 682480 - protein, 9 aa, Homo Sapiens
STVQMELSG

SEQ ID NO: 682481 - protein, 9 aa, Homo Sapiens
HILHLFIQR

SEQ ID NO: 682482 - protein, 9 aa, Homo Sapiens
NNHLPYPIL

SEQ ID NO: 682483 - protein, 9 aa, Homo Sapiens
LDEDVWELI

SEQ ID NO: 682484 - protein, 9 aa, Homo Sapiens
TIKRLQEQT

SEQ ID NO: 682485 - protein, 9 aa, Homo Sapiens
HFLVHASIA

SEQ ID NO: 682486 - protein, 9 aa, Homo Sapiens
WTEMITNIR

SEQ ID NO: 682487 - protein, 9 aa, Homo Sapiens
SSSFVPSGR

SEQ ID NO: 682488 - protein, 9 aa, Homo Sapiens
QMELSGSDF

SEQ ID NO: 682489 - protein, 9 aa, Homo Sapiens
YTTLKMCLV

SEQ ID NO: 682490 - protein, 9 aa, Homo Sapiens
RSPRQNLEY

SEQ ID NO: 682491 - protein, 9 aa, Homo Sapiens
GSLSPPIPK

SEQ ID NO: 682492 - protein, 9 aa, Homo Sapiens
DVARLACPK

SEQ ID NO: 682493 - protein, 9 aa, Homo Sapiens
VKRHCKRCI

SEQ ID NO: 682494 - protein, 9 aa, Homo Sapiens
EETVCYKQT

SEQ ID NO: 682495 - protein, 9 aa, Homo Sapiens
IPKTSNKVP

SEQ ID NO: 682496 - protein, 9 aa, Homo Sapiens
ALSPHTVHY

SEQ ID NO: 682497 - protein, 9 aa, Homo Sapiens
SLTCVPPMN

SEQ ID NO: 682498 - protein, 9 aa, Homo Sapiens
ATLNGSFLA

SEQ ID NO: 682499 - protein, 9 aa, Homo Sapiens
QTKLDNDEC

SEQ ID NO: 682500 - protein, 9 aa, Homo Sapiens
PNYGCTIPK

SEQ ID NO: 682501 - protein, 9 aa, Homo Sapiens
PPIPKTSNK

SEQ ID NO: 682502 - protein, 9 aa, Homo Sapiens
ANKRSLINE

SEQ ID NO: 682503 - protein, 9 aa, Homo Sapiens
GAVGVTWAE

SEQ ID NO: 682504 - protein, 9 aa, Homo Sapiens
RLVFELGLV

SEQ ID NO: 682505 - protein, 9 aa, Homo Sapiens
KQRGISLVH

SEQ ID NO: 682506 - protein, 9 aa, Homo Sapiens
CFRQDGRTL

SEQ ID NO: 682507 - protein, 9 aa, Homo Sapiens
KDYAFLHME

SEQ ID NO: 682508 - protein, 9 aa, Homo Sapiens
SNGGCKAAA

SEQ ID NO: 682509 - protein, 9 aa, Homo Sapiens
LDRAIRTIE

SEQ ID NO: 682510 - protein, 9 aa, Homo Sapiens
VMQLACTDI

SEQ ID NO: 682511 - protein, 9 aa, Homo Sapiens
ISEKQYLSA

SEQ ID NO: 682512 - protein, 9 aa, Homo Sapiens
PVSFPLAYP

SEQ ID NO: 682513 - protein, 9 aa, Homo Sapiens
WELIWMKFH

SEQ ID NO: 682514 - protein, 9 aa, Homo Sapiens
RHPSPPPEK

SEQ ID NO: 682515 - protein, 9 aa, Homo Sapiens
CISSGQHYW

SEQ ID NO: 682516 - protein, 9 aa, Homo Sapiens
ILLQVLIRI

SEQ ID NO: 682517 - protein, 9 aa, Homo Sapiens
CTIPKKTSC

SEQ ID NO: 682518 - protein, 9 aa, Homo Sapiens
TLSERFTSY

SEQ ID NO: 682519 - protein, 9 aa, Homo Sapiens
ASFVLDYWA

SEQ ID NO: 682520 - protein, 9 aa, Homo Sapiens
SYDILWQWK

SEQ ID NO: 682521 - protein, 9 aa, Homo Sapiens
LAHWMACIC

SEQ ID NO: 682522 - protein, 9 aa, Homo Sapiens
LQAAHVSKP

SEQ ID NO: 682523 - protein, 9 aa, Homo Sapiens
TDFGLAKQL

SEQ ID NO: 682524 - protein, 9 aa, Homo Sapiens
PLPAGVYFT

SEQ ID NO: 682525 - protein, 9 aa, Homo Sapiens
YPGRGSTIS

SEQ ID NO: 682526 - protein, 9 aa, Homo Sapiens
RGSTISMVS

SEQ ID NO: 682527 - protein, 9 aa, Homo Sapiens
EYAGPGQAT

SEQ ID NO: 682528 - protein, 9 aa, Homo Sapiens
HNEHCAACK

SEQ ID NO: 682529 - protein, 9 aa, Homo Sapiens
VMSTNISAT

SEQ ID NO: 682530 - protein, 9 aa, Homo Sapiens
DATKMSTVR

SEQ ID NO: 682531 - protein, 9 aa, Homo Sapiens
SFVLDYWAQ

SEQ ID NO: 682532 - protein, 9 aa, Homo Sapiens
IVAALQDKM

SEQ ID NO: 682533 - protein, 9 aa, Homo Sapiens
WSCFLCWKP

SEQ ID NO: 682534 - protein, 9 aa, Homo Sapiens
SGKHKAFST

SEQ ID NO: 682535 - protein, 9 aa, Homo Sapiens
ELDKETGTF

SEQ ID NO: 682536 - protein, 9 aa, Homo Sapiens
AGVYFTLCL

SEQ ID NO: 682537 - protein, 9 aa, Homo Sapiens
GLAKQLGAE

SEQ ID NO: 682538 - protein, 9 aa, Homo Sapiens
EVYQQQTLQ

SEQ ID NO: 682539 - protein, 9 aa, Homo Sapiens
KPELAQKPS

SEQ ID NO: 682540 - protein, 9 aa, Homo Sapiens
SHQKVIYIS

SEQ ID NO: 682541 - protein, 9 aa, Homo Sapiens
ATARSPHAG

SEQ ID NO: 682542 - protein, 9 aa, Homo Sapiens
AAAFCHFTS

SEQ ID NO: 682543 - protein, 9 aa, Homo Sapiens
VLCIKPNMQ

SEQ ID NO: 682544 - protein, 9 aa, Homo Sapiens
TNPYDFTFV

SEQ ID NO: 682545 - protein, 9 aa, Homo Sapiens
LLETPPSIV

SEQ ID NO: 682546 - protein, 9 aa, Homo Sapiens
EFHLRSAKK

SEQ ID NO: 682547 - protein, 9 aa, Homo Sapiens
DGSRVHPDT

SEQ ID NO: 682548 - protein, 9 aa, Homo Sapiens
AKQLGAEEK

SEQ ID NO: 682549 - protein, 9 aa, Homo Sapiens
EDGALRAPD

SEQ ID NO: 682550 - protein, 9 aa, Homo Sapiens
GDLKTQTEK

SEQ ID NO: 682551 - protein, 9 aa, Homo Sapiens
TGCEEYAGP

SEQ ID NO: 682552 - protein, 9 aa, Homo Sapiens
AGPGQATKR

SEQ ID NO: 682553 - protein, 9 aa, Homo Sapiens
NEVYQQQTL

SEQ ID NO: 682554 - protein, 9 aa, Homo Sapiens
MACICYVIG

SEQ ID NO: 682555 - protein, 9 aa, Homo Sapiens
EFNFASFVL

SEQ ID NO: 682556 - protein, 9 aa, Homo Sapiens
CWKNEITHN

SEQ ID NO: 682557 - protein, 9 aa, Homo Sapiens
NILQAAHVS

SEQ ID NO: 682558 - protein, 9 aa, Homo Sapiens
LPLLETPPS

SEQ ID NO: 682559 - protein, 9 aa, Homo Sapiens
INPALALEQ

SEQ ID NO: 682560 - protein, 9 aa, Homo Sapiens
DEEAGGNER

SEQ ID NO: 682561 - protein, 9 aa, Homo Sapiens
QPPQHRMAP

SEQ ID NO: 682562 - protein, 9 aa, Homo Sapiens
QKSEEMWIK

SEQ ID NO: 682563 - protein, 9 aa, Homo Sapiens
GTNLSRKQK

SEQ ID NO: 682564 - protein, 9 aa, Homo Sapiens
AAAEAALSQ

SEQ ID NO: 682565 - protein, 9 aa, Homo Sapiens
IRKCVMSTN

SEQ ID NO: 682566 - protein, 9 aa, Homo Sapiens
RDLAFEVAE

SEQ ID NO: 682567 - protein, 9 aa, Homo Sapiens
PGTPGWKTG

SEQ ID NO: 682568 - protein, 9 aa, Homo Sapiens
GIRKCVMST

SEQ ID NO: 682569 - protein, 9 aa, Homo Sapiens
TKGSFFTMF

SEQ ID NO: 682570 - protein, 9 aa, Homo Sapiens
GVVKVTNHL

SEQ ID NO: 682571 - protein, 9 aa, Homo Sapiens
DTYEWARKM

SEQ ID NO: 682572 - protein, 9 aa, Homo Sapiens
TGTFNSSLL

SEQ ID NO: 682573 - protein, 9 aa, Homo Sapiens
SLSRRGFHL

SEQ ID NO: 682574 - protein, 9 aa, Homo Sapiens
ETPPSIVSP

SEQ ID NO: 682575 - protein, 9 aa, Homo Sapiens
NPFFVLCIK

SEQ ID NO: 682576 - protein, 9 aa, Homo Sapiens
KTGGAQWPS

SEQ ID NO: 682577 - protein, 9 aa, Homo Sapiens
PPGIRKCVM

SEQ ID NO: 682578 - protein, 9 aa, Homo Sapiens
VFNILQAAH

SEQ ID NO: 682579 - protein, 9 aa, Homo Sapiens
VHPDTYEWA

SEQ ID NO: 682580 - protein, 9 aa, Homo Sapiens
PHQDISHRV

SEQ ID NO: 682581 - protein, 9 aa, Homo Sapiens
NLSRKQKKD

SEQ ID NO: 682582 - protein, 9 aa, Homo Sapiens
NERMEISAE

SEQ ID NO: 682583 - protein, 9 aa, Homo Sapiens
SVSTATQKV

SEQ ID NO: 682584 - protein, 9 aa, Homo Sapiens
WTLKDRRPE

SEQ ID NO: 682585 - protein, 9 aa, Homo Sapiens
TISMVSLGS

SEQ ID NO: 682586 - protein, 9 aa, Homo Sapiens
ILSYVGPDI

SEQ ID NO: 682587 - protein, 9 aa, Homo Sapiens
KKKNCGESV

SEQ ID NO: 682588 - protein, 9 aa, Homo Sapiens
KHKAFSTCV

SEQ ID NO: 682589 - protein, 9 aa, Homo Sapiens
ITTNPYDFT

SEQ ID NO: 682590 - protein, 9 aa, Homo Sapiens
PQHRMAPAR

SEQ ID NO: 682591 - protein, 9 aa, Homo Sapiens
PNKPELAQK

SEQ ID NO: 682592 - protein, 9 aa, Homo Sapiens
DINPALALE

SEQ ID NO: 682593 - protein, 9 aa, Homo Sapiens
DSVVLKRVL

SEQ ID NO: 682594 - protein, 9 aa, Homo Sapiens
ESPGTPGWK

SEQ ID NO: 682595 - protein, 9 aa, Homo Sapiens
TPGWKTGGA

SEQ ID NO: 682596 - protein, 9 aa, Homo Sapiens
TAAAFCHFT

SEQ ID NO: 682597 - protein, 9 aa, Homo Sapiens
ARSPHAGDF

SEQ ID NO: 682598 - protein, 9 aa, Homo Sapiens
IVQQRYKDL

SEQ ID NO: 682599 - protein, 9 aa, Homo Sapiens
AAKGRERST

SEQ ID NO: 682600 - protein, 9 aa, Homo Sapiens
TLCLSLMVG

SEQ ID NO: 682601 - protein, 9 aa, Homo Sapiens
EQDSVVLKR

SEQ ID NO: 682602 - protein, 9 aa, Homo Sapiens
FTLCLSLMV

SEQ ID NO: 682603 - protein, 9 aa, Homo Sapiens
SGPETPAAK

SEQ ID NO: 682604 - protein, 9 aa, Homo Sapiens
ATWCWALAE

SEQ ID NO: 682605 - protein, 9 aa, Homo Sapiens
RSQQQQQQG

SEQ ID NO: 682606 - protein, 9 aa, Homo Sapiens
LAFEVAERG

SEQ ID NO: 682607 - protein, 9 aa, Homo Sapiens
ISHRVAAFR

SEQ ID NO: 682608 - protein, 9 aa, Homo Sapiens
SRDPACSPS

SEQ ID NO: 682609 - protein, 9 aa, Homo Sapiens
DTARTASPD

SEQ ID NO: 682610 - protein, 9 aa, Homo Sapiens
YQGSYGFLL

SEQ ID NO: 682611 - protein, 9 aa, Homo Sapiens
DELDKETGT

SEQ ID NO: 682612 - protein, 9 aa, Homo Sapiens
SRVHPDTYE

SEQ ID NO: 682613 - protein, 9 aa, Homo Sapiens
AAFCHFTSI

SEQ ID NO: 682614 - protein, 9 aa, Homo Sapiens
PLLKMLQEA

SEQ ID NO: 682615 - protein, 9 aa, Homo Sapiens
QQRYKDLNV

SEQ ID NO: 682616 - protein, 9 aa, Homo Sapiens
IRLLDSPAT

SEQ ID NO: 682617 - protein, 9 aa, Homo Sapiens
ILTAAAFCH

SEQ ID NO: 682618 - protein, 9 aa, Homo Sapiens
ALSQTGFSY

SEQ ID NO: 682619 - protein, 9 aa, Homo Sapiens
AKGRERSTP

SEQ ID NO: 682620 - protein, 9 aa, Homo Sapiens
QKKDVPKPI

SEQ ID NO: 682621 - protein, 9 aa, Homo Sapiens
TYQGSYGFL

SEQ ID NO: 682622 - protein, 9 aa, Homo Sapiens
EEAGGNERM

SEQ ID NO: 682623 - protein, 9 aa, Homo Sapiens
GPDINPALA

SEQ ID NO: 682624 - protein, 9 aa, Homo Sapiens
LYFDWEYPG

SEQ ID NO: 682625 - protein, 9 aa, Homo Sapiens
AVSSPELIF

SEQ ID NO: 682626 - protein, 9 aa, Homo Sapiens
SFFTMFLAG

SEQ ID NO: 682627 - protein, 9 aa, Homo Sapiens
RGWSRDPAC

SEQ ID NO: 682628 - protein, 9 aa, Homo Sapiens
KKNCGESVS

SEQ ID NO: 682629 - protein, 9 aa, Homo Sapiens
PELPLLETP

SEQ ID NO: 682630 - protein, 9 aa, Homo Sapiens
MWIKQGKLE

SEQ ID NO: 682631 - protein, 9 aa, Homo Sapiens
TPLPSTQAP

SEQ ID NO: 682632 - protein, 9 aa, Homo Sapiens
KQKKDVPKP

SEQ ID NO: 682633 - protein, 9 aa, Homo Sapiens
AHVSKPGAQ

SEQ ID NO: 682634 - protein, 9 aa, Homo Sapiens
HPDTYEWAR

SEQ ID NO: 682635 - protein, 9 aa, Homo Sapiens
FVLDYWAQK

SEQ ID NO: 682636 - protein, 9 aa, Homo Sapiens
RKQKKDVPK

SEQ ID NO: 682637 - protein, 9 aa, Homo Sapiens
SLGQRSHQK

SEQ ID NO: 682638 - protein, 9 aa, Homo Sapiens
CGESVSLLQ

SEQ ID NO: 682639 - protein, 9 aa, Homo Sapiens
AFCHFTSIE

SEQ ID NO: 682640 - protein, 9 aa, Homo Sapiens
PWTLKDRRP

SEQ ID NO: 682641 - protein, 9 aa, Homo Sapiens
DIPGTAMVK

SEQ ID NO: 682642 - protein, 9 aa, Homo Sapiens
NPYDFTFVS

SEQ ID NO: 682643 - protein, 9 aa, Homo Sapiens
GGYIQKKKN

SEQ ID NO: 682644 - protein, 9 aa, Homo Sapiens
EEFNFASFV

SEQ ID NO: 682645 - protein, 9 aa, Homo Sapiens
LRAPDSQSV

SEQ ID NO: 682646 - protein, 9 aa, Homo Sapiens
PDSQSVTPK

SEQ ID NO: 682647 - protein, 9 aa, Homo Sapiens
EVREIGSLS

SEQ ID NO: 682648 - protein, 9 aa, Homo Sapiens
NCGESVSLL

SEQ ID NO: 682649 - protein, 9 aa, Homo Sapiens
HVSKPGAQL

SEQ ID NO: 682650 - protein, 9 aa, Homo Sapiens
DFQLSYDIL

SEQ ID NO: 682651 - protein, 9 aa, Homo Sapiens
DGDLKTQTE

SEQ ID NO: 682652 - protein, 9 aa, Homo Sapiens
CFLCWKPVQ

SEQ ID NO: 682653 - protein, 9 aa, Homo Sapiens
INSTSGKHK

SEQ ID NO: 682654 - protein, 9 aa, Homo Sapiens
LVDTARTAS

SEQ ID NO: 682655 - protein, 9 aa, Homo Sapiens
EGKEFHLRS

SEQ ID NO: 682656 - protein, 9 aa, Homo Sapiens
RTASPDYDI

SEQ ID NO: 682657 - protein, 9 aa, Homo Sapiens
GTAMVKGGG

SEQ ID NO: 682658 - protein, 9 aa, Homo Sapiens
SSPELIFVA

SEQ ID NO: 682659 - protein, 9 aa, Homo Sapiens
ADEEAGGNE

SEQ ID NO: 682660 - protein, 9 aa, Homo Sapiens
YPWTLKDRR

SEQ ID NO: 682661 - protein, 9 aa, Homo Sapiens
PEGVVKVTN

SEQ ID NO: 682662 - protein, 9 aa, Homo Sapiens
ASPDYDILL

SEQ ID NO: 682663 - protein, 9 aa, Homo Sapiens
HQKVIYISD

SEQ ID NO: 682664 - protein, 9 aa, Homo Sapiens
YVGPDINPA

SEQ ID NO: 682665 - protein, 9 aa, Homo Sapiens
SIRGWSRDP

SEQ ID NO: 682666 - protein, 9 aa, Homo Sapiens
PELAQKPSS

SEQ ID NO: 682667 - protein, 9 aa, Homo Sapiens
ITDFGLAKQ

SEQ ID NO: 682668 - protein, 9 aa, Homo Sapiens
HYPGRGSTI

SEQ ID NO: 682669 - protein, 9 aa, Homo Sapiens
AALQDKMKA

SEQ ID NO: 682670 - protein, 9 aa, Homo Sapiens
GVYFTLCLS

SEQ ID NO: 682671 - protein, 9 aa, Homo Sapiens
YIQKKKNCG

SEQ ID NO: 682672 - protein, 9 aa, Homo Sapiens
LIFVAVFRE

SEQ ID NO: 682673 - protein, 9 aa, Homo Sapiens
KDRRPEKLR

SEQ ID NO: 682674 - protein, 9 aa, Homo Sapiens
DGALRAPDS

SEQ ID NO: 682675 - protein, 9 aa, Homo Sapiens
VSSPELIFV

SEQ ID NO: 682676 - protein, 9 aa, Homo Sapiens
RDPACSPSE

SEQ ID NO: 682677 - protein, 9 aa, Homo Sapiens
DVATWCWAL

SEQ ID NO: 682678 - protein, 9 aa, Homo Sapiens
LGFQIKKKN

SEQ ID NO: 682679 - protein, 9 aa, Homo Sapiens
LPAGVYFTL

SEQ ID NO: 682680 - protein, 9 aa, Homo Sapiens
QKPSSPLVT

SEQ ID NO: 682681 - protein, 9 aa, Homo Sapiens
TNKDATKMS

SEQ ID NO: 682682 - protein, 9 aa, Homo Sapiens
GWSRDPACS

SEQ ID NO: 682683 - protein, 9 aa, Homo Sapiens
QEAEQDSVV

SEQ ID NO: 682684 - protein, 9 aa, Homo Sapiens
DLKTQTEKL

SEQ ID NO: 682685 - protein, 9 aa, Homo Sapiens
EAEGKEFHL

SEQ ID NO: 682686 - protein, 9 aa, Homo Sapiens
ALRAPDSQS

SEQ ID NO: 682687 - protein, 9 aa, Homo Sapiens
KSEEMWIKQ

SEQ ID NO: 682688 - protein, 9 aa, Homo Sapiens
GPETPAAKG

SEQ ID NO: 682689 - protein, 9 aa, Homo Sapiens
QRSHQKVIY

SEQ ID NO: 682690 - protein, 9 aa, Homo Sapiens
GSLSRRGFH

SEQ ID NO: 682691 - protein, 9 aa, Homo Sapiens
NPNKPELAQ

SEQ ID NO: 682692 - protein, 9 aa, Homo Sapiens
RYKDLNVYV

SEQ ID NO: 682693 - protein, 9 aa, Homo Sapiens
EEMWIKQGK

SEQ ID NO: 682694 - protein, 9 aa, Homo Sapiens
ELAQKPSSP

SEQ ID NO: 682695 - protein, 9 aa, Homo Sapiens
KGSFFTMFL

SEQ ID NO: 682696 - protein, 9 aa, Homo Sapiens
RRDLAFEVA

SEQ ID NO: 682697 - protein, 9 aa, Homo Sapiens
IKQGKLEWK

SEQ ID NO: 682698 - protein, 9 aa, Homo Sapiens
MADEEAGGN

SEQ ID NO: 682699 - protein, 9 aa, Homo Sapiens
KMSTVRVQG

SEQ ID NO: 682700 - protein, 9 aa, Homo Sapiens
APDSQSVTP

SEQ ID NO: 682701 - protein, 9 aa, Homo Sapiens
FQLSYDILW

SEQ ID NO: 682702 - protein, 9 aa, Homo Sapiens
PGIRKCVMS

SEQ ID NO: 682703 - protein, 9 aa, Homo Sapiens
AQKPSSPLV

SEQ ID NO: 682704 - protein, 9 aa, Homo Sapiens
AAHVSKPGA

SEQ ID NO: 682705 - protein, 9 aa, Homo Sapiens
PYDFTFVSQ

SEQ ID NO: 682706 - protein, 9 aa, Homo Sapiens
PLPSTQAPR

SEQ ID NO: 682707 - protein, 9 aa, Homo Sapiens
NEHCAACKR

SEQ ID NO: 682708 - protein, 9 aa, Homo Sapiens
NPSISVSTA

SEQ ID NO: 682709 - protein, 9 aa, Homo Sapiens
PLLETPPSI

SEQ ID NO: 682710 - protein, 9 aa, Homo Sapiens
PATARSPHA

SEQ ID NO: 682711 - protein, 9 aa, Homo Sapiens
SPELIFVAV

SEQ ID NO: 682712 - protein, 9 aa, Homo Sapiens
VTNHLPLPG

SEQ ID NO: 682713 - protein, 9 aa, Homo Sapiens
HWMACICYV

SEQ ID NO: 682714 - protein, 9 aa, Homo Sapiens
EEAVSSPEL

SEQ ID NO: 682715 - protein, 9 aa, Homo Sapiens
VGPDINPAL

SEQ ID NO: 682716 - protein, 9 aa, Homo Sapiens
QRYKDLNVY

SEQ ID NO: 682717 - protein, 9 aa, Homo Sapiens
SNPFFVLCI

SEQ ID NO: 682718 - protein, 9 aa, Homo Sapiens
DSPATCIRA

SEQ ID NO: 682719 - protein, 9 aa, Homo Sapiens
CTNEVYQQQ

SEQ ID NO: 682720 - protein, 9 aa, Homo Sapiens
PGTPLPSTQ

SEQ ID NO: 682721 - protein, 9 aa, Homo Sapiens
ELPLLETPP

SEQ ID NO: 682722 - protein, 9 aa, Homo Sapiens
PGWKTGGAQ

SEQ ID NO: 682723 - protein, 9 aa, Homo Sapiens
GRGSTISMV

SEQ ID NO: 682724 - protein, 9 aa, Homo Sapiens
STSGKHKAF

SEQ ID NO: 682725 - protein, 9 aa, Homo Sapiens
AHWMACICY

SEQ ID NO: 682726 - protein, 9 aa, Homo Sapiens
YAGPGQATK

SEQ ID NO: 682727 - protein, 9 aa, Homo Sapiens
GYIQKKKNC

SEQ ID NO: 682728 - protein, 9 aa, Homo Sapiens
GESVSLLQQ

SEQ ID NO: 682729 - protein, 9 aa, Homo Sapiens
KVCPGSCSK

SEQ ID NO: 682730 - protein, 9 aa, Homo Sapiens
EAEQDSVVL

SEQ ID NO: 682731 - protein, 9 aa, Homo Sapiens
DFTFVSQGE

SEQ ID NO: 682732 - protein, 9 aa, Homo Sapiens
PAGVYFTLC

SEQ ID NO: 682733 - protein, 9 aa, Homo Sapiens
AFEVAERGS

SEQ ID NO: 682734 - protein, 9 aa, Homo Sapiens
AEGKEFHLR

SEQ ID NO: 682735 - protein, 9 aa, Homo Sapiens
THNEHCAAC

SEQ ID NO: 682736 - protein, 9 aa, Homo Sapiens
GNERMEISA

SEQ ID NO: 682737 - protein, 9 aa, Homo Sapiens
LNVYVNPKK

SEQ ID NO: 682738 - protein, 9 aa, Homo Sapiens
GQQPPQHRM

SEQ ID NO: 682739 - protein, 9 aa, Homo Sapiens
WCWALAEYA

SEQ ID NO: 682740 - protein, 9 aa, Homo Sapiens
KRIDFQLSY

SEQ ID NO: 682741 - protein, 9 aa, Homo Sapiens
SEEMWIKQG

SEQ ID NO: 682742 - protein, 9 aa, Homo Sapiens
TQAPRVDLQ

SEQ ID NO: 682743 - protein, 9 aa, Homo Sapiens
LDKETGTFN

SEQ ID NO: 682744 - protein, 9 aa, Homo Sapiens
VKVTNHLPL

SEQ ID NO: 682745 - protein, 9 aa, Homo Sapiens
EFDGLYFDW

SEQ ID NO: 682746 - protein, 9 aa, Homo Sapiens
ALQDKMKAR

SEQ ID NO: 682747 - protein, 9 aa, Homo Sapiens
TPHQDISHR

SEQ ID NO: 682748 - protein, 9 aa, Homo Sapiens
YGFLLGFLH

SEQ ID NO: 682749 - protein, 9 aa, Homo Sapiens
SCFLCWKPV

SEQ ID NO: 682750 - protein, 9 aa, Homo Sapiens
VATWCWALA

SEQ ID NO: 682751 - protein, 9 aa, Homo Sapiens
WKNEITHNE

SEQ ID NO: 682752 - protein, 9 aa, Homo Sapiens
FGLAKQLGA

SEQ ID NO: 682753 - protein, 9 aa, Homo Sapiens
QKVCPGSCS

SEQ ID NO: 682754 - protein, 9 aa, Homo Sapiens
MLQEAFPAE

SEQ ID NO: 682755 - protein, 9 aa, Homo Sapiens
PFFVLCIKP

SEQ ID NO: 682756 - protein, 9 aa, Homo Sapiens
YKDLNVYVN

SEQ ID NO: 682757 - protein, 9 aa, Homo Sapiens
RLLDSPATC

SEQ ID NO: 682758 - protein, 9 aa, Homo Sapiens
ILQAAHVSK

SEQ ID NO: 682759 - protein, 9 aa, Homo Sapiens
QKRIDFQLS

SEQ ID NO: 682760 - protein, 9 aa, Homo Sapiens
YQQQTLQKL

SEQ ID NO: 682761 - protein, 9 aa, Homo Sapiens
PAAKGRERS

SEQ ID NO: 682762 - protein, 9 aa, Homo Sapiens
LKMLQEAFP

SEQ ID NO: 682763 - protein, 9 aa, Homo Sapiens
NEITHNEHC

SEQ ID NO: 682764 - protein, 9 aa, Homo Sapiens
QYEFDGLYF

SEQ ID NO: 682765 - protein, 9 aa, Homo Sapiens
KQLGAEEKE

SEQ ID NO: 682766 - protein, 9 aa, Homo Sapiens
EIGSLSRRG

SEQ ID NO: 682767 - protein, 9 aa, Homo Sapiens
REIGSLSRR

SEQ ID NO: 682768 - protein, 9 aa, Homo Sapiens
DYPWTLKDR

SEQ ID NO: 682769 - protein, 9 aa, Homo Sapiens
SISVSTATQ

SEQ ID NO: 682770 - protein, 9 aa, Homo Sapiens
DLIKPLLKM

SEQ ID NO: 682771 - protein, 9 aa, Homo Sapiens
ETGTFNSSL

SEQ ID NO: 682772 - protein, 9 aa, Homo Sapiens
KVTNHLPLP

SEQ ID NO: 682773 - protein, 9 aa, Homo Sapiens
HQDISHRVA

SEQ ID NO: 682774 - protein, 9 aa, Homo Sapiens
AAEAALSQT

SEQ ID NO: 682775 - protein, 9 aa, Homo Sapiens
LIKPLLKML

SEQ ID NO: 682776 - protein, 9 aa, Homo Sapiens
GKEFHLRSA

SEQ ID NO: 682777 - protein, 9 aa, Homo Sapiens
DPELPLLET

SEQ ID NO: 682778 - protein, 9 aa, Homo Sapiens
SQQQQQQGL

SEQ ID NO: 682779 - protein, 9 aa, Homo Sapiens
PDTYEWARK

SEQ ID NO: 682780 - protein, 9 aa, Homo Sapiens
FNFASFVLD

SEQ ID NO: 682781 - protein, 9 aa, Homo Sapiens
PDVVVTGLT

SEQ ID NO: 682782 - protein, 9 aa, Homo Sapiens
RMAPARPPP

SEQ ID NO: 682783 - protein, 9 aa, Homo Sapiens
KIVAALQDK

SEQ ID NO: 682784 - protein, 9 aa, Homo Sapiens
QTEKLWTEV

SEQ ID NO: 682785 - protein, 9 aa, Homo Sapiens
AEAALSQTG

SEQ ID NO: 682786 - protein, 9 aa, Homo Sapiens
RPGTPLPST

SEQ ID NO: 682787 - protein, 9 aa, Homo Sapiens
PGRGSTISM

SEQ ID NO: 682788 - protein, 9 aa, Homo Sapiens
TNHLPLPGP

SEQ ID NO: 682789 - protein, 9 aa, Homo Sapiens
EAVSSPELI

SEQ ID NO: 682790 - protein, 9 aa, Homo Sapiens
STISMVSLG

SEQ ID NO: 682791 - protein, 9 aa, Homo Sapiens
GLYFDWEYP

SEQ ID NO: 682792 - protein, 9 aa, Homo Sapiens
ATCIRAKAF

SEQ ID NO: 682793 - protein, 9 aa, Homo Sapiens
RSHQKVIYI

SEQ ID NO: 682794 - protein, 9 aa, Homo Sapiens
GQRSHQKVI

SEQ ID NO: 682795 - protein, 9 aa, Homo Sapiens
TATQKVCPG

SEQ ID NO: 682796 - protein, 9 aa, Homo Sapiens
LAKQLGAEE

SEQ ID NO: 682797 - protein, 9 aa, Homo Sapiens
RSPHAGDFG

SEQ ID NO: 682798 - protein, 9 aa, Homo Sapiens
ICYVIGKME

SEQ ID NO: 682799 - protein, 9 aa, Homo Sapiens
KNCGESVSL

SEQ ID NO: 682800 - protein, 9 aa, Homo Sapiens
WIKQGKLEW

SEQ ID NO: 682801 - protein, 9 aa, Homo Sapiens
LDGSRVHPD

SEQ ID NO: 682802 - protein, 9 aa, Homo Sapiens
VREIGSLSR

SEQ ID NO: 682803 - protein, 9 aa, Homo Sapiens
GALRAPDSQ

SEQ ID NO: 682804 - protein, 9 aa, Homo Sapiens
ATQKVCPGS

SEQ ID NO: 682805 - protein, 9 aa, Homo Sapiens
LPSTQAPRV

SEQ ID NO: 682806 - protein, 9 aa, Homo Sapiens
PEEFNFASF

SEQ ID NO: 682807 - protein, 9 aa, Homo Sapiens
GPGQATKRK

SEQ ID NO: 682808 - protein, 9 aa, Homo Sapiens
VYFTLCLSL

SEQ ID NO: 682809 - protein, 9 aa, Homo Sapiens
SYGFLLGFL

SEQ ID NO: 682810 - protein, 9 aa, Homo Sapiens
EAGGNERME

SEQ ID NO: 682811 - protein, 9 aa, Homo Sapiens
PNVPDVVVT

SEQ ID NO: 682812 - protein, 9 aa, Homo Sapiens
FLLGFLHSG

SEQ ID NO: 682813 - protein, 9 aa, Homo Sapiens
IQKKKNCGE

SEQ ID NO: 682814 - protein, 9 aa, Homo Sapiens
KKIVAALQD

SEQ ID NO: 682815 - protein, 9 aa, Homo Sapiens
FVLCIKPNM

SEQ ID NO: 682816 - protein, 9 aa, Homo Sapiens
QSIRGWSRD

SEQ ID NO: 682817 - protein, 9 aa, Homo Sapiens
RDYPWTLKD

SEQ ID NO: 682818 - protein, 9 aa, Homo Sapiens
GKKIVAALQ

SEQ ID NO: 682819 - protein, 9 aa, Homo Sapiens
QHRMAPARP

SEQ ID NO: 682820 - protein, 9 aa, Homo Sapiens
MAPARPPPK

SEQ ID NO: 682821 - protein, 9 aa, Homo Sapiens
VTNKDATKM

SEQ ID NO: 682822 - protein, 9 aa, Homo Sapiens
IPGTAMVKG

SEQ ID NO: 682823 - protein, 9 aa, Homo Sapiens
GQEAEQDSV

SEQ ID NO: 682824 - protein, 9 aa, Homo Sapiens
SPHAGDFGA

SEQ ID NO: 682825 - protein, 9 aa, Homo Sapiens
FHLRSAKKA

SEQ ID NO: 682826 - protein, 9 aa, Homo Sapiens
SSNPFFVLC

SEQ ID NO: 682827 - protein, 9 aa, Homo Sapiens
CWALAEYAR

SEQ ID NO: 682828 - protein, 9 aa, Homo Sapiens
PGQATKRKK

SEQ ID NO: 682829 - protein, 9 aa, Homo Sapiens
TNSLGQRSH

SEQ ID NO: 682830 - protein, 9 aa, Homo Sapiens
DLNVYVNPK

SEQ ID NO: 682831 - protein, 9 aa, Homo Sapiens
NVPDVVVTG

SEQ ID NO: 682832 - protein, 9 aa, Homo Sapiens
STQAPRVDL

SEQ ID NO: 682833 - protein, 9 aa, Homo Sapiens
GETKGSFFT

SEQ ID NO: 682834 - protein, 9 aa, Homo Sapiens
STATQKVCP

SEQ ID NO: 682835 - protein, 9 aa, Homo Sapiens
YFDWEYPGS

SEQ ID NO: 682836 - protein, 9 aa, Homo Sapiens
QDISHRVAA

SEQ ID NO: 682837 - protein, 9 aa, Homo Sapiens
GGNERMEIS

SEQ ID NO: 682838 - protein, 9 aa, Homo Sapiens
GTPGWKTGG

SEQ ID NO: 682839 - protein, 9 aa, Homo Sapiens
LQSIRGWSR

SEQ ID NO: 682840 - protein, 9 aa, Homo Sapiens
GSYGFLLGF

SEQ ID NO: 682841 - protein, 9 aa, Homo Sapiens
ELIFVAVFR

SEQ ID NO: 682842 - protein, 9 aa, Homo Sapiens
DVVVTGLTL

SEQ ID NO: 682843 - protein, 9 aa, Homo Sapiens
FASFVLDYW

SEQ ID NO: 682844 - protein, 9 aa, Homo Sapiens
PSTQAPRVD

SEQ ID NO: 682845 - protein, 9 aa, Homo Sapiens
KDGDLKTQT

SEQ ID NO: 682846 - protein, 9 aa, Homo Sapiens
VSTATQKVC

SEQ ID NO: 682847 - protein, 9 aa, Homo Sapiens
CICYVIGKM

SEQ ID NO: 682848 - protein, 9 aa, Homo Sapiens
PATCIRAKA

SEQ ID NO: 682849 - protein, 9 aa, Homo Sapiens
QLSYDILWQ

SEQ ID NO: 682850 - protein, 9 aa, Homo Sapiens
KNEITHNEH

SEQ ID NO: 682851 - protein, 9 aa, Homo Sapiens
HLRSAKKAS

SEQ ID NO: 682852 - protein, 9 aa, Homo Sapiens
SADPNVPDV

SEQ ID NO: 682853 - protein, 9 aa, Homo Sapiens
RIDFQLSYD

SEQ ID NO: 682854 - protein, 9 aa, Homo Sapiens
QAAHVSKPG

SEQ ID NO: 682855 - protein, 9 aa, Homo Sapiens
QLGAEEKEY

SEQ ID NO: 682856 - protein, 9 aa, Homo Sapiens
RILTAAAFC

SEQ ID NO: 682857 - protein, 9 aa, Homo Sapiens
IRGWSRDPA

SEQ ID NO: 682858 - protein, 9 aa, Homo Sapiens
PPQHRMAPA

SEQ ID NO: 682859 - protein, 9 aa, Homo Sapiens
ATPHQDISH

SEQ ID NO: 682860 - protein, 9 aa, Homo Sapiens
LETPPSIVS

SEQ ID NO: 682861 - protein, 9 aa, Homo Sapiens
TASPDYDIL

SEQ ID NO: 682862 - protein, 9 aa, Homo Sapiens
QQTLQKLLA

SEQ ID NO: 682863 - protein, 9 aa, Homo Sapiens
DPNVPDVVV

SEQ ID NO: 682864 - protein, 9 aa, Homo Sapiens
LSRKQKKDV

SEQ ID NO: 682865 - protein, 9 aa, Homo Sapiens
QQQTLQKLL

SEQ ID NO: 682866 - protein, 9 aa, Homo Sapiens
KDLNVYVNP

SEQ ID NO: 682867 - protein, 9 aa, Homo Sapiens
GCEEYAGPG

SEQ ID NO: 682868 - protein, 9 aa, Homo Sapiens
DSQSVTPKP

SEQ ID NO: 682869 - protein, 9 aa, Homo Sapiens
NSLGQRSHQ

SEQ ID NO: 682870 - protein, 9 aa, Homo Sapiens
LSYDILWQW

SEQ ID NO: 682871 - protein, 9 aa, Homo Sapiens
FTFVSQGEI

SEQ ID NO: 682872 - protein, 9 aa, Homo Sapiens
SYVGPDINP

SEQ ID NO: 682873 - protein, 9 aa, Homo Sapiens
VVKVTNHLP

SEQ ID NO: 682874 - protein, 9 aa, Homo Sapiens
MSTNISATS

SEQ ID NO: 682875 - protein, 9 aa, Homo Sapiens
PELIFVAVF

SEQ ID NO: 682876 - protein, 9 aa, Homo Sapiens
VAERGSRPA

SEQ ID NO: 682877 - protein, 9 aa, Homo Sapiens
TSGKHKAFS

SEQ ID NO: 682878 - protein, 9 aa, Homo Sapiens
DLAFEVAER

SEQ ID NO: 682879 - protein, 9 aa, Homo Sapiens
PDINPALAL

SEQ ID NO: 682880 - protein, 9 aa, Homo Sapiens
PSISVSTAT

SEQ ID NO: 682881 - protein, 9 aa, Homo Sapiens
SPDYDILLP

SEQ ID NO: 682882 - protein, 9 aa, Homo Sapiens
LTAAAFCHF

SEQ ID NO: 682883 - protein, 9 aa, Homo Sapiens
VTSGETKGS

SEQ ID NO: 682884 - protein, 9 aa, Homo Sapiens
TSGETKGSF

SEQ ID NO: 682885 - protein, 9 aa, Homo Sapiens
RAPDSQSVT

SEQ ID NO: 682886 - protein, 9 aa, Homo Sapiens
KPLLKMLQE

SEQ ID NO: 682887 - protein, 9 aa, Homo Sapiens
NKPELAQKP

SEQ ID NO: 682888 - protein, 9 aa, Homo Sapiens
DGKKIVAAL

SEQ ID NO: 682889 - protein, 9 aa, Homo Sapiens
TWCWALAEY

SEQ ID NO: 682890 - protein, 9 aa, Homo Sapiens
QDSVVLKRV

SEQ ID NO: 682891 - protein, 9 aa, Homo Sapiens
TKMSTVRVQ

SEQ ID NO: 682892 - protein, 9 aa, Homo Sapiens
NSTSGKHKA

SEQ ID NO: 682893 - protein, 9 aa, Homo Sapiens
RAAAEAALS

SEQ ID NO: 682894 - protein, 9 aa, Homo Sapiens
KINSTSGKH

SEQ ID NO: 682895 - protein, 9 aa, Homo Sapiens
QQPPQHRMA

SEQ ID NO: 682896 - protein, 9 aa, Homo Sapiens
VDGKKIVAA

SEQ ID NO: 682897 - protein, 9 aa, Homo Sapiens
IDFQLSYDI

SEQ ID NO: 682898 - protein, 9 aa, Homo Sapiens
LSYVGPDIN

SEQ ID NO: 682899 - protein, 9 aa, Homo Sapiens
SDELDKETG

SEQ ID NO: 682900 - protein, 9 aa, Homo Sapiens
VQQRYKDLN

SEQ ID NO: 682901 - protein, 9 aa, Homo Sapiens
FEVAERGSR

SEQ ID NO: 682902 - protein, 9 aa, Homo Sapiens
YRILTAAAF

SEQ ID NO: 682903 - protein, 9 aa, Homo Sapiens
GTFNSSLLR

SEQ ID NO: 682904 - protein, 9 aa, Homo Sapiens
FNILQAAHV

SEQ ID NO: 682905 - protein, 9 aa, Homo Sapiens
LLKMLQEAF

SEQ ID NO: 682906 - protein, 9 aa, Homo Sapiens
DFGLAKQLG

SEQ ID NO: 682907 - protein, 9 aa, Homo Sapiens
MSTVRVQGN

SEQ ID NO: 682908 - protein, 9 aa, Homo Sapiens
SGETKGSFF

SEQ ID NO: 682909 - protein, 9 aa, Homo Sapiens
TQTEKLWTE

SEQ ID NO: 682910 - protein, 9 aa, Homo Sapiens
CGQEAEQDS

SEQ ID NO: 682911 - protein, 9 aa, Homo Sapiens
EITHNEHCA

SEQ ID NO: 682912 - protein, 9 aa, Homo Sapiens
VCPGSCSKT

SEQ ID NO: 682913 - protein, 9 aa, Homo Sapiens
GSRVHPDTY

SEQ ID NO: 682914 - protein, 9 aa, Homo Sapiens
TNEVYQQQT

SEQ ID NO: 682915 - protein, 9 aa, Homo Sapiens
WMACICYVI

SEQ ID NO: 682916 - protein, 9 aa, Homo Sapiens
SHRVAAFRF

SEQ ID NO: 682917 - protein, 9 aa, Homo Sapiens
KEAEGKEFH

SEQ ID NO: 682918 - protein, 9 aa, Homo Sapiens
YFTLCLSLM

SEQ ID NO: 682919 - protein, 9 aa, Homo Sapiens
LCIKPNMQK

SEQ ID NO: 682920 - protein, 9 aa, Homo Sapiens
PETPAAKGR

SEQ ID NO: 682921 - protein, 9 aa, Homo Sapiens
DGLYFDWEY

SEQ ID NO: 682922 - protein, 9 aa, Homo Sapiens
GSFFTMFLA

SEQ ID NO: 682923 - protein, 9 aa, Homo Sapiens
TLKDRRPEK

SEQ ID NO: 682924 - protein, 9 aa, Homo Sapiens
HAGDFGAAF

SEQ ID NO: 682925 - protein, 9 aa, Homo Sapiens
LRAAAEAAL

SEQ ID NO: 682926 - protein, 9 aa, Homo Sapiens
GWKTGGAQW

SEQ ID NO: 682927 - protein, 9 aa, Homo Sapiens
RQYEFDGLY

SEQ ID NO: 682928 - protein, 9 aa, Homo Sapiens
LKDRRPEKL

SEQ ID NO: 682929 - protein, 9 aa, Homo Sapiens
LHYPGRGST

SEQ ID NO: 682930 - protein, 9 aa, Homo Sapiens
ADPNVPDVV

SEQ ID NO: 682931 - protein, 9 aa, Homo Sapiens
SPATCIRAK

SEQ ID NO: 682932 - protein, 9 aa, Homo Sapiens
LLGFLHSGT

SEQ ID NO: 682933 - protein, 9 aa, Homo Sapiens
TARTASPDY

SEQ ID NO: 682934 - protein, 9 aa, Homo Sapiens
ETPAAKGRE

SEQ ID NO: 682935 - protein, 9 aa, Homo Sapiens
NFASFVLDY

SEQ ID NO: 682936 - protein, 9 aa, Homo Sapiens
ISVSTATQK

SEQ ID NO: 682937 - protein, 9 aa, Homo Sapiens
RVHPDTYEW

SEQ ID NO: 682938 - protein, 9 aa, Homo Sapiens
KETGTFNSS

SEQ ID NO: 682939 - protein, 9 aa, Homo Sapiens
SSSNPFFVL

SEQ ID NO: 682940 - protein, 9 aa, Homo Sapiens
KGRERSTPL

SEQ ID NO: 682941 - protein, 9 aa, Homo Sapiens
CYVIGKMER

SEQ ID NO: 682942 - protein, 9 aa, Homo Sapiens
YEFDGLYFD

SEQ ID NO: 682943 - protein, 9 aa, Homo Sapiens
DKETGTFNS

SEQ ID NO: 682944 - protein, 9 aa, Homo Sapiens
GFLLGFLHS

SEQ ID NO: 682945 - protein, 9 aa, Homo Sapiens
VYQQQTLQK

SEQ ID NO: 682946 - protein, 9 aa, Homo Sapiens
LRDAWLPRP

SEQ ID NO: 682947 - protein, 9 aa, Homo Sapiens
LDSPATCIR

SEQ ID NO: 682948 - protein, 9 aa, Homo Sapiens
HRVAAFRFE

SEQ ID NO: 682949 - protein, 9 aa, Homo Sapiens
EAALSQTGF

SEQ ID NO: 682950 - protein, 9 aa, Homo Sapiens
QTLQKLLAT

SEQ ID NO: 682951 - protein, 9 aa, Homo Sapiens
SVSLLQQLT

SEQ ID NO: 682952 - protein, 9 aa, Homo Sapiens
ITHNEHCAA

SEQ ID NO: 682953 - protein, 9 aa, Homo Sapiens
TTNPYDFTF

SEQ ID NO: 682954 - protein, 9 aa, Homo Sapiens
ACICYVIGK

SEQ ID NO: 682955 - protein, 9 aa, Homo Sapiens
VDTARTASP

SEQ ID NO: 682956 - protein, 9 aa, Homo Sapiens
FDGLYFDWE

SEQ ID NO: 682957 - protein, 9 aa, Homo Sapiens
GDVATWCWA

SEQ ID NO: 682958 - protein, 9 aa, Homo Sapiens
MWSCFLCWK

SEQ ID NO: 682959 - protein, 9 aa, Homo Sapiens
QKKKNCGES

SEQ ID NO: 682960 - protein, 9 aa, Homo Sapiens
EVAERGSRP

SEQ ID NO: 682961 - protein, 9 aa, Homo Sapiens
TEKLWTEVN

SEQ ID NO: 682962 - protein, 9 aa, Homo Sapiens
VPDVVVTGL

SEQ ID NO: 682963 - protein, 9 aa, Homo Sapiens
PGTAMVKGG

SEQ ID NO: 682964 - protein, 9 aa, Homo Sapiens
FFVLCIKPN

SEQ ID NO: 682965 - protein, 9 aa, Homo Sapiens
AERGSRPAS

SEQ ID NO: 682966 - protein, 9 aa, Homo Sapiens
KTQTEKLWT

SEQ ID NO: 682967 - protein, 9 aa, Homo Sapiens
ARTASPDYD

SEQ ID NO: 682968 - protein, 9 aa, Homo Sapiens
LSQTGFSYD

SEQ ID NO: 682969 - protein, 9 aa, Homo Sapiens
EGVVKVTNH

SEQ ID NO: 682970 - protein, 9 aa, Homo Sapiens
ESVSLLQQL

SEQ ID NO: 682971 - protein, 9 aa, Homo Sapiens
TNLSRKQKK

SEQ ID NO: 682972 - protein, 9 aa, Homo Sapiens
CVMSTNISA

SEQ ID NO: 682973 - protein, 9 aa, Homo Sapiens
MGDVATWCW

SEQ ID NO: 682974 - protein, 9 aa, Homo Sapiens
WALAEYARA

SEQ ID NO: 682975 - protein, 9 aa, Homo Sapiens
VAALQDKMK

SEQ ID NO: 682976 - protein, 9 aa, Homo Sapiens
TPAAKGRER

SEQ ID NO: 682977 - protein, 9 aa, Homo Sapiens
EMWIKQGKL

SEQ ID NO: 682978 - protein, 9 aa, Homo Sapiens
SPGTPGWKT

SEQ ID NO: 682979 - protein, 9 aa, Homo Sapiens
IGSLSRRGF

SEQ ID NO: 682980 - protein, 9 aa, Homo Sapiens
QGSYGFLLG

SEQ ID NO: 682981 - protein, 9 aa, Homo Sapiens
FCHFTSIEV

SEQ ID NO: 682982 - protein, 9 aa, Homo Sapiens
WKTGGAQWP

SEQ ID NO: 682983 - protein, 9 aa, Homo Sapiens
AEQDSVVLK

SEQ ID NO: 682984 - protein, 9 aa, Homo Sapiens
TARSPHAGD

SEQ ID NO: 682985 - protein, 9 aa, Homo Sapiens
LAQKPSSPL

SEQ ID NO: 682986 - protein, 9 aa, Homo Sapiens
HPATARSPH

SEQ ID NO: 682987 - protein, 9 aa, Homo Sapiens
LKTQTEKLW

SEQ ID NO: 682988 - protein, 9 aa, Homo Sapiens
TFVSQGEIT

SEQ ID NO: 682989 - protein, 9 aa, Homo Sapiens
AALSQTGFS

SEQ ID NO: 682990 - protein, 9 aa, Homo Sapiens
ATKMSTVRV

SEQ ID NO: 682991 - protein, 9 aa, Homo Sapiens
TQKVCPGSC

SEQ ID NO: 682992 - protein, 9 aa, Homo Sapiens
DDPELPLLE

SEQ ID NO: 682993 - protein, 9 aa, Homo Sapiens
KMLQEAFPA

SEQ ID NO: 682994 - protein, 9 aa, Homo Sapiens
PPEGVVKVT

SEQ ID NO: 682995 - protein, 9 aa, Homo Sapiens
ETKGSFFTM

SEQ ID NO: 682996 - protein, 9 aa, Homo Sapiens
KCVMSTNIS

SEQ ID NO: 682997 - protein, 9 aa, Homo Sapiens
DISHRVAAF

SEQ ID NO: 682998 - protein, 9 aa, Homo Sapiens
KQGKLEWKN

SEQ ID NO: 682999 - protein, 9 aa, Homo Sapiens
GTPLPSTQA

SEQ ID NO: 683000 - protein, 9 aa, Homo Sapiens
WSRDPACSP

SEQ ID NO: 683001 - protein, 9 aa, Homo Sapiens
CEEYAGPGQ

SEQ ID NO: 683002 - protein, 9 aa, Homo Sapiens
IKPLLKMLQ

SEQ ID NO: 683003 - protein, 9 aa, Homo Sapiens
LGQRSHQKV

SEQ ID NO: 683004 - protein, 9 aa, Homo Sapiens
GSTISMVSL

SEQ ID NO: 683005 - protein, 9 aa, Homo Sapiens
YDFTFVSQG

SEQ ID NO: 683006 - protein, 9 aa, Homo Sapiens
EEYAGPGQA

SEQ ID NO: 683007 - protein, 9 aa, Homo Sapiens
DRRPEKLRD

SEQ ID NO: 683008 - protein, 9 aa, Homo Sapiens
SRKQKKDVP

SEQ ID NO: 683009 - protein, 9 aa, Homo Sapiens
NTEVREIGS

SEQ ID NO: 683010 - protein, 9 aa, Homo Sapiens
LLDSPATCI

SEQ ID NO: 683011 - protein, 9 aa, Homo Sapiens
KDATKMSTV

SEQ ID NO: 683012 - protein, 9 aa, Homo Sapiens
HRMAPARPP

SEQ ID NO: 683013 - protein, 9 aa, Homo Sapiens
TEVREIGSL

SEQ ID NO: 683014 - protein, 9 aa, Homo Sapiens
MLRDAWLPR

SEQ ID NO: 683015 - protein, 9 aa, Homo Sapiens
RKCVMSTNI

SEQ ID NO: 683016 - protein, 9 aa, Homo Sapiens
PHAGDFGAA

SEQ ID NO: 683017 - protein, 9 aa, Homo Sapiens
RGTNLSRKQ

SEQ ID NO: 683018 - protein, 9 aa, Homo Sapiens
VSADPNVPD

SEQ ID NO: 683019 - protein, 9 aa, Homo Sapiens
NKDATKMST

SEQ ID NO: 683020 - protein, 9 aa, Homo Sapiens
KEFHLRSAK

SEQ ID NO: 683021 - protein, 9 aa, Homo Sapiens
IIRLLDSPA

SEQ ID NO: 683022 - protein, 9 aa, Homo Sapiens
AGGNERMEI

SEQ ID NO: 683023 - protein, 9 aa, Homo Sapiens
HKAFSTCVS

SEQ ID NO: 683024 - protein, 9 aa, Homo Sapiens
NPTLPLTSY

SEQ ID NO: 683025 - protein, 9 aa, Homo Sapiens
ALKAQLIDV

SEQ ID NO: 683026 - protein, 9 aa, Homo Sapiens
HVKQSSKLT

SEQ ID NO: 683027 - protein, 9 aa, Homo Sapiens
HSPLPGRSP

SEQ ID NO: 683028 - protein, 9 aa, Homo Sapiens
ISATKTQLA

SEQ ID NO: 683029 - protein, 9 aa, Homo Sapiens
GGVKLWLKH

SEQ ID NO: 683030 - protein, 9 aa, Homo Sapiens
SGNYTCMAD

SEQ ID NO: 683031 - protein, 9 aa, Homo Sapiens
PTINLGDLP

SEQ ID NO: 683032 - protein, 9 aa, Homo Sapiens
TKYNVTGLR

SEQ ID NO: 683033 - protein, 9 aa, Homo Sapiens
KSISSMEGI

SEQ ID NO: 683034 - protein, 9 aa, Homo Sapiens
DGILSGDNA

SEQ ID NO: 683035 - protein, 9 aa, Homo Sapiens
FFWVQDLND

SEQ ID NO: 683036 - protein, 9 aa, Homo Sapiens
ILGPNLGDQ

SEQ ID NO: 683037 - protein, 9 aa, Homo Sapiens
DVKCINKKN

SEQ ID NO: 683038 - protein, 9 aa, Homo Sapiens
KPSVQKTKY

SEQ ID NO: 683039 - protein, 9 aa, Homo Sapiens
PYSYSAVIA

SEQ ID NO: 683040 - protein, 9 aa, Homo Sapiens
SEDQGCSLP

SEQ ID NO: 683041 - protein, 9 aa, Homo Sapiens
WAVQNIGNV

SEQ ID NO: 683042 - protein, 9 aa, Homo Sapiens
LNNAHDADV

SEQ ID NO: 683043 - protein, 9 aa, Homo Sapiens
YQSLEQELQ

SEQ ID NO: 683044 - protein, 9 aa, Homo Sapiens
RSPENLTHG

SEQ ID NO: 683045 - protein, 9 aa, Homo Sapiens
SPENLTHGD

SEQ ID NO: 683046 - protein, 9 aa, Homo Sapiens
VGLVRTVEL

SEQ ID NO: 683047 - protein, 9 aa, Homo Sapiens
VGFTGPKGP

SEQ ID NO: 683048 - protein, 9 aa, Homo Sapiens
YQNATAEEE

SEQ ID NO: 683049 - protein, 9 aa, Homo Sapiens
CWRTRLCAP

SEQ ID NO: 683050 - protein, 9 aa, Homo Sapiens
FTGPKGPPG

SEQ ID NO: 683051 - protein, 9 aa, Homo Sapiens
RSRHLRVRT

SEQ ID NO: 683052 - protein, 9 aa, Homo Sapiens
PYSNVSSLK

SEQ ID NO: 683053 - protein, 9 aa, Homo Sapiens
LGVSPEVFD

SEQ ID NO: 683054 - protein, 9 aa, Homo Sapiens
GHPGEPGYA

SEQ ID NO: 683055 - protein, 9 aa, Homo Sapiens
YLVFNDVNG

SEQ ID NO: 683056 - protein, 9 aa, Homo Sapiens
GQKRDVFEH

SEQ ID NO: 683057 - protein, 9 aa, Homo Sapiens
PAPPFPLMT

SEQ ID NO: 683058 - protein, 9 aa, Homo Sapiens
IKYDENMGL

SEQ ID NO: 683059 - protein, 9 aa, Homo Sapiens
GRYSSRRGA

SEQ ID NO: 683060 - protein, 9 aa, Homo Sapiens
APLRKYADS

SEQ ID NO: 683061 - protein, 9 aa, Homo Sapiens
LGRWRQESV

SEQ ID NO: 683062 - protein, 9 aa, Homo Sapiens
RQESVNSNR

SEQ ID NO: 683063 - protein, 9 aa, Homo Sapiens
YLVYRHVPG

SEQ ID NO: 683064 - protein, 9 aa, Homo Sapiens
SKDSDDSSS

SEQ ID NO: 683065 - protein, 9 aa, Homo Sapiens
TGIHLPSED

SEQ ID NO: 683066 - protein, 9 aa, Homo Sapiens
VPSSRLSPP

SEQ ID NO: 683067 - protein, 9 aa, Homo Sapiens
PPSKASPTQ

SEQ ID NO: 683068 - protein, 9 aa, Homo Sapiens
SGGPASSSP

SEQ ID NO: 683069 - protein, 9 aa, Homo Sapiens
HGSIAASQG

SEQ ID NO: 683070 - protein, 9 aa, Homo Sapiens
EAKTKEDGP

SEQ ID NO: 683071 - protein, 9 aa, Homo Sapiens
YDDNTLKVW

SEQ ID NO: 683072 - protein, 9 aa, Homo Sapiens
TRVYSIGRR

SEQ ID NO: 683073 - protein, 9 aa, Homo Sapiens
KGDHDQVSI

SEQ ID NO: 683074 - protein, 9 aa, Homo Sapiens
RCWRTRLCA

SEQ ID NO: 683075 - protein, 9 aa, Homo Sapiens
PVGFTGPKG

SEQ ID NO: 683076 - protein, 9 aa, Homo Sapiens
KRKKQNSSD

SEQ ID NO: 683077 - protein, 9 aa, Homo Sapiens
GFAPGKVVG

SEQ ID NO: 683078 - protein, 9 aa, Homo Sapiens
CPARVVCCS

SEQ ID NO: 683079 - protein, 9 aa, Homo Sapiens
RDEWLAPWK

SEQ ID NO: 683080 - protein, 9 aa, Homo Sapiens
DLEVDVKCI

SEQ ID NO: 683081 - protein, 9 aa, Homo Sapiens
LTSTSCSTM

SEQ ID NO: 683082 - protein, 9 aa, Homo Sapiens
TVPKEKSPL

SEQ ID NO: 683083 - protein, 9 aa, Homo Sapiens
DNFYNADPS

SEQ ID NO: 683084 - protein, 9 aa, Homo Sapiens
TSCSTMSCL

SEQ ID NO: 683085 - protein, 9 aa, Homo Sapiens
ATQSLSHEQ

SEQ ID NO: 683086 - protein, 9 aa, Homo Sapiens
KRFGITRPA

SEQ ID NO: 683087 - protein, 9 aa, Homo Sapiens
SSSKDSDDS

SEQ ID NO: 683088 - protein, 9 aa, Homo Sapiens
LRITENGLE

SEQ ID NO: 683089 - protein, 9 aa, Homo Sapiens
KIGYYVIQT

SEQ ID NO: 683090 - protein, 9 aa, Homo Sapiens
QNQSFSPIL

SEQ ID NO: 683091 - protein, 9 aa, Homo Sapiens
RRVEGRHLY

SEQ ID NO: 683092 - protein, 9 aa, Homo Sapiens
QAGTPGEPR

SEQ ID NO: 683093 - protein, 9 aa, Homo Sapiens
TRLLVKGPV

SEQ ID NO: 683094 - protein, 9 aa, Homo Sapiens
EKDCLRAVE

SEQ ID NO: 683095 - protein, 9 aa, Homo Sapiens
LQVQMHYEM

SEQ ID NO: 683096 - protein, 9 aa, Homo Sapiens
KDVKNKTDK

SEQ ID NO: 683097 - protein, 9 aa, Homo Sapiens
GYDSSPLTP

SEQ ID NO: 683098 - protein, 9 aa, Homo Sapiens
SNVSSLKVW

SEQ ID NO: 683099 - protein, 9 aa, Homo Sapiens
NTMNGYSMS

SEQ ID NO: 683100 - protein, 9 aa, Homo Sapiens
MAYDRFVAM

SEQ ID NO: 683101 - protein, 9 aa, Homo Sapiens
DEARYSLSE

SEQ ID NO: 683102 - protein, 9 aa, Homo Sapiens
LESMETHLK

SEQ ID NO: 683103 - protein, 9 aa, Homo Sapiens
MAAPESGPT

SEQ ID NO: 683104 - protein, 9 aa, Homo Sapiens
TLLRVLFSQ

SEQ ID NO: 683105 - protein, 9 aa, Homo Sapiens
KRIPYSKVQ

SEQ ID NO: 683106 - protein, 9 aa, Homo Sapiens
LKFLEILEK

SEQ ID NO: 683107 - protein, 9 aa, Homo Sapiens
PLNNAHDAD

SEQ ID NO: 683108 - protein, 9 aa, Homo Sapiens
ARSRDQDRM

SEQ ID NO: 683109 - protein, 9 aa, Homo Sapiens
VITSVHVSA

SEQ ID NO: 683110 - protein, 9 aa, Homo Sapiens
NVTTEDSED

SEQ ID NO: 683111 - protein, 9 aa, Homo Sapiens
GSGQAGTPG

SEQ ID NO: 683112 - protein, 9 aa, Homo Sapiens
TELPPPLER

SEQ ID NO: 683113 - protein, 9 aa, Homo Sapiens
SRQTKDNQD

SEQ ID NO: 683114 - protein, 9 aa, Homo Sapiens
KFKDSDENE

SEQ ID NO: 683115 - protein, 9 aa, Homo Sapiens
LRKLGRWRQ

SEQ ID NO: 683116 - protein, 9 aa, Homo Sapiens
KGAVEVISL

SEQ ID NO: 683117 - protein, 9 aa, Homo Sapiens
VHVSAEDVD

SEQ ID NO: 683118 - protein, 9 aa, Homo Sapiens
SVHSSALFG

SEQ ID NO: 683119 - protein, 9 aa, Homo Sapiens
VPKEKSPLV

SEQ ID NO: 683120 - protein, 9 aa, Homo Sapiens
QSAFTLSAV

SEQ ID NO: 683121 - protein, 9 aa, Homo Sapiens
NIISYYFCE

SEQ ID NO: 683122 - protein, 9 aa, Homo Sapiens
KVKFLTDKL

SEQ ID NO: 683123 - protein, 9 aa, Homo Sapiens
RTEDTSYPL

SEQ ID NO: 683124 - protein, 9 aa, Homo Sapiens
IGLLHNLQH

SEQ ID NO: 683125 - protein, 9 aa, Homo Sapiens
ALGVALLLS

SEQ ID NO: 683126 - protein, 9 aa, Homo Sapiens
LFGALVELL

SEQ ID NO: 683127 - protein, 9 aa, Homo Sapiens
VASASLEVY

SEQ ID NO: 683128 - protein, 9 aa, Homo Sapiens
GTVNSKTRQ

SEQ ID NO: 683129 - protein, 9 aa, Homo Sapiens
KISYFPCLV

SEQ ID NO: 683130 - protein, 9 aa, Homo Sapiens
KQGYDSSPL

SEQ ID NO: 683131 - protein, 9 aa, Homo Sapiens
PYSYSALIT

SEQ ID NO: 683132 - protein, 9 aa, Homo Sapiens
SPSGTFAAL

SEQ ID NO: 683133 - protein, 9 aa, Homo Sapiens
ISLLTHQLR

SEQ ID NO: 683134 - protein, 9 aa, Homo Sapiens
FAYCAADIK

SEQ ID NO: 683135 - protein, 9 aa, Homo Sapiens
VPQVTTPER

SEQ ID NO: 683136 - protein, 9 aa, Homo Sapiens
HECEECGKA

SEQ ID NO: 683137 - protein, 9 aa, Homo Sapiens
SSSVSGGPA

SEQ ID NO: 683138 - protein, 9 aa, Homo Sapiens
LEKKGHVSL

SEQ ID NO: 683139 - protein, 9 aa, Homo Sapiens
VEGSGVVSA

SEQ ID NO: 683140 - protein, 9 aa, Homo Sapiens
GWAALQRLT

SEQ ID NO: 683141 - protein, 9 aa, Homo Sapiens
ISAPQQPAS

SEQ ID NO: 683142 - protein, 9 aa, Homo Sapiens
RVLRHDAGR

SEQ ID NO: 683143 - protein, 9 aa, Homo Sapiens
PTFCPENVL

SEQ ID NO: 683144 - protein, 9 aa, Homo Sapiens
PGKVVGSHI

SEQ ID NO: 683145 - protein, 9 aa, Homo Sapiens
FAYHSELKA

SEQ ID NO: 683146 - protein, 9 aa, Homo Sapiens
MFQSAVPKV

SEQ ID NO: 683147 - protein, 9 aa, Homo Sapiens
SPILNASSR

SEQ ID NO: 683148 - protein, 9 aa, Homo Sapiens
PELVTNPLI

SEQ ID NO: 683149 - protein, 9 aa, Homo Sapiens
YYFCETQLA

SEQ ID NO: 683150 - protein, 9 aa, Homo Sapiens
TSEKAYCLG

SEQ ID NO: 683151 - protein, 9 aa, Homo Sapiens
GCATEIFFY

SEQ ID NO: 683152 - protein, 9 aa, Homo Sapiens
PASRIFSHC

SEQ ID NO: 683153 - protein, 9 aa, Homo Sapiens
MRRKMTLVW

SEQ ID NO: 683154 - protein, 9 aa, Homo Sapiens
GYDDNTLKV

SEQ ID NO: 683155 - protein, 9 aa, Homo Sapiens
PGLHHHGLR

SEQ ID NO: 683156 - protein, 9 aa, Homo Sapiens
YCAADIKSA

SEQ ID NO: 683157 - protein, 9 aa, Homo Sapiens
DAATKIVNE

SEQ ID NO: 683158 - protein, 9 aa, Homo Sapiens
QREAPVVSR

SEQ ID NO: 683159 - protein, 9 aa, Homo Sapiens
KIVNEVSKP

SEQ ID NO: 683160 - protein, 9 aa, Homo Sapiens
ESCPETKYN

SEQ ID NO: 683161 - protein, 9 aa, Homo Sapiens
EQELQKHVS

SEQ ID NO: 683162 - protein, 9 aa, Homo Sapiens
GTITVGVVI

SEQ ID NO: 683163 - protein, 9 aa, Homo Sapiens
GTFAALGAL

SEQ ID NO: 683164 - protein, 9 aa, Homo Sapiens
HPINPLVAL

SEQ ID NO: 683165 - protein, 9 aa, Homo Sapiens
ENKRFGITR

SEQ ID NO: 683166 - protein, 9 aa, Homo Sapiens
FRQIFQELF

SEQ ID NO: 683167 - protein, 9 aa, Homo Sapiens
AEHPAVLEL

SEQ ID NO: 683168 - protein, 9 aa, Homo Sapiens
SMEGIMEAL

SEQ ID NO: 683169 - protein, 9 aa, Homo Sapiens
SQGTDSHTE

SEQ ID NO: 683170 - protein, 9 aa, Homo Sapiens
VMFRNGLED

SEQ ID NO: 683171 - protein, 9 aa, Homo Sapiens
TRLCAPLSS

SEQ ID NO: 683172 - protein, 9 aa, Homo Sapiens
LPPEVWPAG

SEQ ID NO: 683173 - protein, 9 aa, Homo Sapiens
EDSFSGGLQ

SEQ ID NO: 683174 - protein, 9 aa, Homo Sapiens
DDAATKIVN

SEQ ID NO: 683175 - protein, 9 aa, Homo Sapiens
FREKEGDFK

SEQ ID NO: 683176 - protein, 9 aa, Homo Sapiens
VNGWISLIS

SEQ ID NO: 683177 - protein, 9 aa, Homo Sapiens
VAFNTLMLK

SEQ ID NO: 683178 - protein, 9 aa, Homo Sapiens
LLRITENGL

SEQ ID NO: 683179 - protein, 9 aa, Homo Sapiens
SESNDILQH

SEQ ID NO: 683180 - protein, 9 aa, Homo Sapiens
VPRGAESDH

SEQ ID NO: 683181 - protein, 9 aa, Homo Sapiens
TTLVSATIL

SEQ ID NO: 683182 - protein, 9 aa, Homo Sapiens
SPLGICLLE

SEQ ID NO: 683183 - protein, 9 aa, Homo Sapiens
VCKQGYDSS

SEQ ID NO: 683184 - protein, 9 aa, Homo Sapiens
HKISYFPCL

SEQ ID NO: 683185 - protein, 9 aa, Homo Sapiens
DTGIHLPSE

SEQ ID NO: 683186 - protein, 9 aa, Homo Sapiens
QELQKHVSR

SEQ ID NO: 683187 - protein, 9 aa, Homo Sapiens
ITMAIQSAP

SEQ ID NO: 683188 - protein, 9 aa, Homo Sapiens
TEDLALFQK

SEQ ID NO: 683189 - protein, 9 aa, Homo Sapiens
NDEDRESDV

SEQ ID NO: 683190 - protein, 9 aa, Homo Sapiens
AEGVLPLRG

SEQ ID NO: 683191 - protein, 9 aa, Homo Sapiens
PEPSGSGQA

SEQ ID NO: 683192 - protein, 9 aa, Homo Sapiens
RHQRNKVKF

SEQ ID NO: 683193 - protein, 9 aa, Homo Sapiens
LRKYADSSI

SEQ ID NO: 683194 - protein, 9 aa, Homo Sapiens
SEKAYCLGD

SEQ ID NO: 683195 - protein, 9 aa, Homo Sapiens
EVDTGIHLP

SEQ ID NO: 683196 - protein, 9 aa, Homo Sapiens
VLQLIFGYR

SEQ ID NO: 683197 - protein, 9 aa, Homo Sapiens
MKSGSRCAL

SEQ ID NO: 683198 - protein, 9 aa, Homo Sapiens
ETFGFLLMG

SEQ ID NO: 683199 - protein, 9 aa, Homo Sapiens
KLESMETHL

SEQ ID NO: 683200 - protein, 9 aa, Homo Sapiens
SEPSFNRAG

SEQ ID NO: 683201 - protein, 9 aa, Homo Sapiens
DGINGTVNS

SEQ ID NO: 683202 - protein, 9 aa, Homo Sapiens
VESTNEGNP

SEQ ID NO: 683203 - protein, 9 aa, Homo Sapiens
ILVPAVTSD

SEQ ID NO: 683204 - protein, 9 aa, Homo Sapiens
RECPLPPPS

SEQ ID NO: 683205 - protein, 9 aa, Homo Sapiens
VGLGTRSLP

SEQ ID NO: 683206 - protein, 9 aa, Homo Sapiens
LRYPVLLSR

SEQ ID NO: 683207 - protein, 9 aa, Homo Sapiens
SSSDTTAPT

SEQ ID NO: 683208 - protein, 9 aa, Homo Sapiens
QEGQKRDVF

SEQ ID NO: 683209 - protein, 9 aa, Homo Sapiens
QLIDVRTKL

SEQ ID NO: 683210 - protein, 9 aa, Homo Sapiens
KPSWDIFKQ

SEQ ID NO: 683211 - protein, 9 aa, Homo Sapiens
NFEDGFFFW

SEQ ID NO: 683212 - protein, 9 aa, Homo Sapiens
SGPTLSPGT

SEQ ID NO: 683213 - protein, 9 aa, Homo Sapiens
TSVSLTGVI

SEQ ID NO: 683214 - protein, 9 aa, Homo Sapiens
SALITMAIQ

SEQ ID NO: 683215 - protein, 9 aa, Homo Sapiens
GRGFAYHSE

SEQ ID NO: 683216 - protein, 9 aa, Homo Sapiens
GPPTRLLVK

SEQ ID NO: 683217 - protein, 9 aa, Homo Sapiens
HVVTEETFG

SEQ ID NO: 683218 - protein, 9 aa, Homo Sapiens
LMGAQTVTS

SEQ ID NO: 683219 - protein, 9 aa, Homo Sapiens
TSSAFICLI

SEQ ID NO: 683220 - protein, 9 aa, Homo Sapiens
AVEKDCLRA

SEQ ID NO: 683221 - protein, 9 aa, Homo Sapiens
IGRRVEGRH

SEQ ID NO: 683222 - protein, 9 aa, Homo Sapiens
LFDKFYKYV

SEQ ID NO: 683223 - protein, 9 aa, Homo Sapiens
IFSHCDLFP

SEQ ID NO: 683224 - protein, 9 aa, Homo Sapiens
AGCATEIFF

SEQ ID NO: 683225 - protein, 9 aa, Homo Sapiens
AIQNPTLPL

SEQ ID NO: 683226 - protein, 9 aa, Homo Sapiens
TPENPVIHY

SEQ ID NO: 683227 - protein, 9 aa, Homo Sapiens
GGISSDETR

SEQ ID NO: 683228 - protein, 9 aa, Homo Sapiens
TKEDGPANT

SEQ ID NO: 683229 - protein, 9 aa, Homo Sapiens
LTDNFYNAD

SEQ ID NO: 683230 - protein, 9 aa, Homo Sapiens
LKGSLGYSG

SEQ ID NO: 683231 - protein, 9 aa, Homo Sapiens
GWISLISIT

SEQ ID NO: 683232 - protein, 9 aa, Homo Sapiens
VYSQNAIQP

SEQ ID NO: 683233 - protein, 9 aa, Homo Sapiens
RLRSPSGTF

SEQ ID NO: 683234 - protein, 9 aa, Homo Sapiens
MPYAGGVGA

SEQ ID NO: 683235 - protein, 9 aa, Homo Sapiens
ILSMLLGNT

SEQ ID NO: 683236 - protein, 9 aa, Homo Sapiens
VWRMRQMLI

SEQ ID NO: 683237 - protein, 9 aa, Homo Sapiens
LVFVSSAVV

SEQ ID NO: 683238 - protein, 9 aa, Homo Sapiens
KAITDAAIM

SEQ ID NO: 683239 - protein, 9 aa, Homo Sapiens
GLQREAPVV

SEQ ID NO: 683240 - protein, 9 aa, Homo Sapiens
LTFHFQAPT

SEQ ID NO: 683241 - protein, 9 aa, Homo Sapiens
SCSTMSCLS

SEQ ID NO: 683242 - protein, 9 aa, Homo Sapiens
STMVHPATP

SEQ ID NO: 683243 - protein, 9 aa, Homo Sapiens
ERECPLPPP

SEQ ID NO: 683244 - protein, 9 aa, Homo Sapiens
GVLDLDRRG

SEQ ID NO: 683245 - protein, 9 aa, Homo Sapiens
GGQPPGLHH

SEQ ID NO: 683246 - protein, 9 aa, Homo Sapiens
YDRTLRVFE

SEQ ID NO: 683247 - protein, 9 aa, Homo Sapiens
LASLVSINR

SEQ ID NO: 683248 - protein, 9 aa, Homo Sapiens
TKMRLQQEE

SEQ ID NO: 683249 - protein, 9 aa, Homo Sapiens
SSLKVWDFY

SEQ ID NO: 683250 - protein, 9 aa, Homo Sapiens
KRDVFEHHG

SEQ ID NO: 683251 - protein, 9 aa, Homo Sapiens
QSRARAQDR

SEQ ID NO: 683252 - protein, 9 aa, Homo Sapiens
SLDLKRRLI

SEQ ID NO: 683253 - protein, 9 aa, Homo Sapiens
LGHREEDLQ

SEQ ID NO: 683254 - protein, 9 aa, Homo Sapiens
RAQDRNNVL

SEQ ID NO: 683255 - protein, 9 aa, Homo Sapiens
SLVCPHLEC

SEQ ID NO: 683256 - protein, 9 aa, Homo Sapiens
SAWIRKMEI

SEQ ID NO: 683257 - protein, 9 aa, Homo Sapiens
PDYILRLGW

SEQ ID NO: 683258 - protein, 9 aa, Homo Sapiens
LRDTSDTLL

SEQ ID NO: 683259 - protein, 9 aa, Homo Sapiens
SLLTHQLRT

SEQ ID NO: 683260 - protein, 9 aa, Homo Sapiens
HGGPRRPSV

SEQ ID NO: 683261 - protein, 9 aa, Homo Sapiens
VVIRLLDWF

SEQ ID NO: 683262 - protein, 9 aa, Homo Sapiens
YFRQIFQEL

SEQ ID NO: 683263 - protein, 9 aa, Homo Sapiens
NTGTVHTVP

SEQ ID NO: 683264 - protein, 9 aa, Homo Sapiens
ELPAGSGVE

SEQ ID NO: 683265 - protein, 9 aa, Homo Sapiens
IMVSQSLGS

SEQ ID NO: 683266 - protein, 9 aa, Homo Sapiens
TGEKPHECE

SEQ ID NO: 683267 - protein, 9 aa, Homo Sapiens
WILRQLTMM

SEQ ID NO: 683268 - protein, 9 aa, Homo Sapiens
KSGSRCALL

SEQ ID NO: 683269 - protein, 9 aa, Homo Sapiens
EGQSFSSLY

SEQ ID NO: 683270 - protein, 9 aa, Homo Sapiens
AESDHSNMG

SEQ ID NO: 683271 - protein, 9 aa, Homo Sapiens
RMTRQKRRR

SEQ ID NO: 683272 - protein, 9 aa, Homo Sapiens
QVESTNEGN

SEQ ID NO: 683273 - protein, 9 aa, Homo Sapiens
ICLLEGVNQ

SEQ ID NO: 683274 - protein, 9 aa, Homo Sapiens
EDFQPLFGV

SEQ ID NO: 683275 - protein, 9 aa, Homo Sapiens
SDVLLDEPP

SEQ ID NO: 683276 - protein, 9 aa, Homo Sapiens
AQSLKSPSI

SEQ ID NO: 683277 - protein, 9 aa, Homo Sapiens
RHDAGRPLR

SEQ ID NO: 683278 - protein, 9 aa, Homo Sapiens
IKKFKDSDE

SEQ ID NO: 683279 - protein, 9 aa, Homo Sapiens
VDETKWITS

SEQ ID NO: 683280 - protein, 9 aa, Homo Sapiens
LVRTVELGQ

SEQ ID NO: 683281 - protein, 9 aa, Homo Sapiens
RFLRAWNPP

SEQ ID NO: 683282 - protein, 9 aa, Homo Sapiens
YEKPSLSAL

SEQ ID NO: 683283 - protein, 9 aa, Homo Sapiens
VCNNQKHCH

SEQ ID NO: 683284 - protein, 9 aa, Homo Sapiens
RKYADSSIS

SEQ ID NO: 683285 - protein, 9 aa, Homo Sapiens
GPQGPLVCE

SEQ ID NO: 683286 - protein, 9 aa, Homo Sapiens
RKKQNESIS

SEQ ID NO: 683287 - protein, 9 aa, Homo Sapiens
GIHLPSEDI

SEQ ID NO: 683288 - protein, 9 aa, Homo Sapiens
LLVKGPVTS

SEQ ID NO: 683289 - protein, 9 aa, Homo Sapiens
LVRCLRWGG

SEQ ID NO: 683290 - protein, 9 aa, Homo Sapiens
ITNYFNWVV

SEQ ID NO: 683291 - protein, 9 aa, Homo Sapiens
DENMGLVSL

SEQ ID NO: 683292 - protein, 9 aa, Homo Sapiens
KGSLGYSGC

SEQ ID NO: 683293 - protein, 9 aa, Homo Sapiens
WRMRQMLIT

SEQ ID NO: 683294 - protein, 9 aa, Homo Sapiens
SSMEGIMEA

SEQ ID NO: 683295 - protein, 9 aa, Homo Sapiens
KKFKDSDEN

SEQ ID NO: 683296 - protein, 9 aa, Homo Sapiens
ESNMGNGTV

SEQ ID NO: 683297 - protein, 9 aa, Homo Sapiens
HEFFDEKPS

SEQ ID NO: 683298 - protein, 9 aa, Homo Sapiens
APWKREAEK

SEQ ID NO: 683299 - protein, 9 aa, Homo Sapiens
CLGDLPMKL

SEQ ID NO: 683300 - protein, 9 aa, Homo Sapiens
HQFGWSMLP

SEQ ID NO: 683301 - protein, 9 aa, Homo Sapiens
AQLIDVRTK

SEQ ID NO: 683302 - protein, 9 aa, Homo Sapiens
NATAEEEGE

SEQ ID NO: 683303 - protein, 9 aa, Homo Sapiens
PTLSPGTAE

SEQ ID NO: 683304 - protein, 9 aa, Homo Sapiens
IIAAKEAMK

SEQ ID NO: 683305 - protein, 9 aa, Homo Sapiens
GSRIHLAFN

SEQ ID NO: 683306 - protein, 9 aa, Homo Sapiens
EIADVLSSF

SEQ ID NO: 683307 - protein, 9 aa, Homo Sapiens
VARSRDQDR

SEQ ID NO: 683308 - protein, 9 aa, Homo Sapiens
EKPSWDIFK

SEQ ID NO: 683309 - protein, 9 aa, Homo Sapiens
LTHQLRTQW

SEQ ID NO: 683310 - protein, 9 aa, Homo Sapiens
ILDLSEVLC

SEQ ID NO: 683311 - protein, 9 aa, Homo Sapiens
VLRHDAGRP

SEQ ID NO: 683312 - protein, 9 aa, Homo Sapiens
KHFYDRTLR

SEQ ID NO: 683313 - protein, 9 aa, Homo Sapiens
GAVEVISLW

SEQ ID NO: 683314 - protein, 9 aa, Homo Sapiens
HCSAAVGRT

SEQ ID NO: 683315 - protein, 9 aa, Homo Sapiens
GDFKDVKNK

SEQ ID NO: 683316 - protein, 9 aa, Homo Sapiens
PRMTRQKRR

SEQ ID NO: 683317 - protein, 9 aa, Homo Sapiens
SVLVNGTKV

SEQ ID NO: 683318 - protein, 9 aa, Homo Sapiens
GLLHNLQHL

SEQ ID NO: 683319 - protein, 9 aa, Homo Sapiens
GSIAASQGY

SEQ ID NO: 683320 - protein, 9 aa, Homo Sapiens
INPLVALRH

SEQ ID NO: 683321 - protein, 9 aa, Homo Sapiens
ESMETHLKA

SEQ ID NO: 683322 - protein, 9 aa, Homo Sapiens
QTVTSGHSF

SEQ ID NO: 683323 - protein, 9 aa, Homo Sapiens
LFQKLTQKW

SEQ ID NO: 683324 - protein, 9 aa, Homo Sapiens
AKHFYDRTL

SEQ ID NO: 683325 - protein, 9 aa, Homo Sapiens
LTRSRSESD

SEQ ID NO: 683326 - protein, 9 aa, Homo Sapiens
GITKMRLQQ

SEQ ID NO: 683327 - protein, 9 aa, Homo Sapiens
QLIFGYRGR

SEQ ID NO: 683328 - protein, 9 aa, Homo Sapiens
PHLECPVLG

SEQ ID NO: 683329 - protein, 9 aa, Homo Sapiens
QFGWSMLPH

SEQ ID NO: 683330 - protein, 9 aa, Homo Sapiens
NPPPVSARM

SEQ ID NO: 683331 - protein, 9 aa, Homo Sapiens
SMAGCATEI

SEQ ID NO: 683332 - protein, 9 aa, Homo Sapiens
EPRHTVLTA

SEQ ID NO: 683333 - protein, 9 aa, Homo Sapiens
AGGGHPVVI

SEQ ID NO: 683334 - protein, 9 aa, Homo Sapiens
SSGGISSDE

SEQ ID NO: 683335 - protein, 9 aa, Homo Sapiens
STMSCLSRP

SEQ ID NO: 683336 - protein, 9 aa, Homo Sapiens
DETKWITSS

SEQ ID NO: 683337 - protein, 9 aa, Homo Sapiens
PTQDGRPPQ

SEQ ID NO: 683338 - protein, 9 aa, Homo Sapiens
STTSVYSQN

SEQ ID NO: 683339 - protein, 9 aa, Homo Sapiens
LRVFEVMLP

SEQ ID NO: 683340 - protein, 9 aa, Homo Sapiens
DPGSRIHLA

SEQ ID NO: 683341 - protein, 9 aa, Homo Sapiens
ERGIYHGIC

SEQ ID NO: 683342 - protein, 9 aa, Homo Sapiens
RKMTLVWRM

SEQ ID NO: 683343 - protein, 9 aa, Homo Sapiens
TLKYHMEHG

SEQ ID NO: 683344 - protein, 9 aa, Homo Sapiens
AWIRKMEIP

SEQ ID NO: 683345 - protein, 9 aa, Homo Sapiens
RRRTMRRKM

SEQ ID NO: 683346 - protein, 9 aa, Homo Sapiens
REAKTKEDG

SEQ ID NO: 683347 - protein, 9 aa, Homo Sapiens
DTRVGDAVL

SEQ ID NO: 683348 - protein, 9 aa, Homo Sapiens
ADSGTDCSQ

SEQ ID NO: 683349 - protein, 9 aa, Homo Sapiens
KYNVTGLRD

SEQ ID NO: 683350 - protein, 9 aa, Homo Sapiens
ENVLNVLSR

SEQ ID NO: 683351 - protein, 9 aa, Homo Sapiens
VFEHHGKKL

SEQ ID NO: 683352 - protein, 9 aa, Homo Sapiens
PIEIGLLHN

SEQ ID NO: 683353 - protein, 9 aa, Homo Sapiens
MTRQKRRRR

SEQ ID NO: 683354 - protein, 9 aa, Homo Sapiens
REREREQER

SEQ ID NO: 683355 - protein, 9 aa, Homo Sapiens
DSHTELPPP

SEQ ID NO: 683356 - protein, 9 aa, Homo Sapiens
LLHNLQHLH

SEQ ID NO: 683357 - protein, 9 aa, Homo Sapiens
VPTSPQGDA

SEQ ID NO: 683358 - protein, 9 aa, Homo Sapiens
SLSALPGPT

SEQ ID NO: 683359 - protein, 9 aa, Homo Sapiens
NLTHGDVRT

SEQ ID NO: 683360 - protein, 9 aa, Homo Sapiens
WQPSVLVNG

SEQ ID NO: 683361 - protein, 9 aa, Homo Sapiens
SWRFLTYMF

SEQ ID NO: 683362 - protein, 9 aa, Homo Sapiens
LAVNGISLC

SEQ ID NO: 683363 - protein, 9 aa, Homo Sapiens
VREAKTKED

SEQ ID NO: 683364 - protein, 9 aa, Homo Sapiens
NGWISLISI

SEQ ID NO: 683365 - protein, 9 aa, Homo Sapiens
CMADNIVAK

SEQ ID NO: 683366 - protein, 9 aa, Homo Sapiens
MLLLISLLT

SEQ ID NO: 683367 - protein, 9 aa, Homo Sapiens
IDLGVSPEV

SEQ ID NO: 683368 - protein, 9 aa, Homo Sapiens
LRIADTRVG

SEQ ID NO: 683369 - protein, 9 aa, Homo Sapiens
NDLSFSRSF

SEQ ID NO: 683370 - protein, 9 aa, Homo Sapiens
MYSVMFRNG

SEQ ID NO: 683371 - protein, 9 aa, Homo Sapiens
TPPSNTSFK

SEQ ID NO: 683372 - protein, 9 aa, Homo Sapiens
TITVGVVIF

SEQ ID NO: 683373 - protein, 9 aa, Homo Sapiens
EAFTVILIS

SEQ ID NO: 683374 - protein, 9 aa, Homo Sapiens
ARSWRFLTY

SEQ ID NO: 683375 - protein, 9 aa, Homo Sapiens
LPSPISAPQ

SEQ ID NO: 683376 - protein, 9 aa, Homo Sapiens
SRIFSHCDL

SEQ ID NO: 683377 - protein, 9 aa, Homo Sapiens
GEPILTFHF

SEQ ID NO: 683378 - protein, 9 aa, Homo Sapiens
EKLSCEPKL

SEQ ID NO: 683379 - protein, 9 aa, Homo Sapiens
SSLLHHQSS

SEQ ID NO: 683380 - protein, 9 aa, Homo Sapiens
ITKMRLQQE

SEQ ID NO: 683381 - protein, 9 aa, Homo Sapiens
GVKLWLKHR

SEQ ID NO: 683382 - protein, 9 aa, Homo Sapiens
LIIAAKEAM

SEQ ID NO: 683383 - protein, 9 aa, Homo Sapiens
TLLCQLSQG

SEQ ID NO: 683384 - protein, 9 aa, Homo Sapiens
VDSSNYIPQ

SEQ ID NO: 683385 - protein, 9 aa, Homo Sapiens
MNTLNTMNG

SEQ ID NO: 683386 - protein, 9 aa, Homo Sapiens
SMLPHRSML

SEQ ID NO: 683387 - protein, 9 aa, Homo Sapiens
ASSLKGSLG

SEQ ID NO: 683388 - protein, 9 aa, Homo Sapiens
CNFEDGFFF

SEQ ID NO: 683389 - protein, 9 aa, Homo Sapiens
RSSSLLHHQ

SEQ ID NO: 683390 - protein, 9 aa, Homo Sapiens
VHTREKPYM

SEQ ID NO: 683391 - protein, 9 aa, Homo Sapiens
MNMNTLNTM

SEQ ID NO: 683392 - protein, 9 aa, Homo Sapiens
RPSPASQLF

SEQ ID NO: 683393 - protein, 9 aa, Homo Sapiens
VCGRGFAYH

SEQ ID NO: 683394 - protein, 9 aa, Homo Sapiens
IPIEIGLLH

SEQ ID NO: 683395 - protein, 9 aa, Homo Sapiens
FYNADPSKP

SEQ ID NO: 683396 - protein, 9 aa, Homo Sapiens
TVASASLEV

SEQ ID NO: 683397 - protein, 9 aa, Homo Sapiens
SKTRQANNF

SEQ ID NO: 683398 - protein, 9 aa, Homo Sapiens
LGVALLLSS

SEQ ID NO: 683399 - protein, 9 aa, Homo Sapiens
GWSMLPHRS

SEQ ID NO: 683400 - protein, 9 aa, Homo Sapiens
QGTDSHTEL

SEQ ID NO: 683401 - protein, 9 aa, Homo Sapiens
GVCNNQKHC

SEQ ID NO: 683402 - protein, 9 aa, Homo Sapiens
HSKIWFESN

SEQ ID NO: 683403 - protein, 9 aa, Homo Sapiens
PSARVPTSP

SEQ ID NO: 683404 - protein, 9 aa, Homo Sapiens
DLAVNGISL

SEQ ID NO: 683405 - protein, 9 aa, Homo Sapiens
PNLGDQKRK

SEQ ID NO: 683406 - protein, 9 aa, Homo Sapiens
SIAASQGYS

SEQ ID NO: 683407 - protein, 9 aa, Homo Sapiens
GSGDFWRMY

SEQ ID NO: 683408 - protein, 9 aa, Homo Sapiens
EPSFNRAGF

SEQ ID NO: 683409 - protein, 9 aa, Homo Sapiens
RTLRVFEVM

SEQ ID NO: 683410 - protein, 9 aa, Homo Sapiens
REREQERER

SEQ ID NO: 683411 - protein, 9 aa, Homo Sapiens
LSLLILSML

SEQ ID NO: 683412 - protein, 9 aa, Homo Sapiens
KVDGKQVEL

SEQ ID NO: 683413 - protein, 9 aa, Homo Sapiens
PGRKYEMHL

SEQ ID NO: 683414 - protein, 9 aa, Homo Sapiens
RRGEPAGEE

SEQ ID NO: 683415 - protein, 9 aa, Homo Sapiens
KKAPTHIWQ

SEQ ID NO: 683416 - protein, 9 aa, Homo Sapiens
STYSRVYIK

SEQ ID NO: 683417 - protein, 9 aa, Homo Sapiens
EKPSLSALP

SEQ ID NO: 683418 - protein, 9 aa, Homo Sapiens
EELANLLIN

SEQ ID NO: 683419 - protein, 9 aa, Homo Sapiens
LRGITKMRL

SEQ ID NO: 683420 - protein, 9 aa, Homo Sapiens
PERGIYHGI

SEQ ID NO: 683421 - protein, 9 aa, Homo Sapiens
RQTKDNQDI

SEQ ID NO: 683422 - protein, 9 aa, Homo Sapiens
VEPRGSVFT

SEQ ID NO: 683423 - protein, 9 aa, Homo Sapiens
ETQLAFFLV

SEQ ID NO: 683424 - protein, 9 aa, Homo Sapiens
FKDVKNKTD

SEQ ID NO: 683425 - protein, 9 aa, Homo Sapiens
GTDSHTELP

SEQ ID NO: 683426 - protein, 9 aa, Homo Sapiens
NHYEEQQAW

SEQ ID NO: 683427 - protein, 9 aa, Homo Sapiens
SARVPTSPQ

SEQ ID NO: 683428 - protein, 9 aa, Homo Sapiens
LRLRSPSGT

SEQ ID NO: 683429 - protein, 9 aa, Homo Sapiens
RLQQEEMVQ

SEQ ID NO: 683430 - protein, 9 aa, Homo Sapiens
GLVRTVELG

SEQ ID NO: 683431 - protein, 9 aa, Homo Sapiens
KKGHVSLVG

SEQ ID NO: 683432 - protein, 9 aa, Homo Sapiens
LEITVTEER

SEQ ID NO: 683433 - protein, 9 aa, Homo Sapiens
AGAEATQSL

SEQ ID NO: 683434 - protein, 9 aa, Homo Sapiens
KEDGPANTE

SEQ ID NO: 683435 - protein, 9 aa, Homo Sapiens
AQNQSFSPI

SEQ ID NO: 683436 - protein, 9 aa, Homo Sapiens
PQLLLRSLG

SEQ ID NO: 683437 - protein, 9 aa, Homo Sapiens
IEPGFYSTY

SEQ ID NO: 683438 - protein, 9 aa, Homo Sapiens
SEYQQYQNA

SEQ ID NO: 683439 - protein, 9 aa, Homo Sapiens
MSCLSRPGW

SEQ ID NO: 683440 - protein, 9 aa, Homo Sapiens
DTEDLALFQ

SEQ ID NO: 683441 - protein, 9 aa, Homo Sapiens
VSGTLLQVQ

SEQ ID NO: 683442 - protein, 9 aa, Homo Sapiens
SLVGSSGGI

SEQ ID NO: 683443 - protein, 9 aa, Homo Sapiens
EDGFFFWVQ

SEQ ID NO: 683444 - protein, 9 aa, Homo Sapiens
LLTHQLRTQ

SEQ ID NO: 683445 - protein, 9 aa, Homo Sapiens
RHSQMIQDQ

SEQ ID NO: 683446 - protein, 9 aa, Homo Sapiens
IPYSKVQLR

SEQ ID NO: 683447 - protein, 9 aa, Homo Sapiens
LRGRLLRIT

SEQ ID NO: 683448 - protein, 9 aa, Homo Sapiens
QRVHIGQKP

SEQ ID NO: 683449 - protein, 9 aa, Homo Sapiens
LLCQLSQGI

SEQ ID NO: 683450 - protein, 9 aa, Homo Sapiens
NLTVPKEKS

SEQ ID NO: 683451 - protein, 9 aa, Homo Sapiens
LPAGSGVEL

SEQ ID NO: 683452 - protein, 9 aa, Homo Sapiens
SDTTAPTTV

SEQ ID NO: 683453 - protein, 9 aa, Homo Sapiens
GLQSWWTDT

SEQ ID NO: 683454 - protein, 9 aa, Homo Sapiens
RQMLITEPR

SEQ ID NO: 683455 - protein, 9 aa, Homo Sapiens
LTPRTSQED

SEQ ID NO: 683456 - protein, 9 aa, Homo Sapiens
LLTLLRVLF

SEQ ID NO: 683457 - protein, 9 aa, Homo Sapiens
NGQQTLSAE

SEQ ID NO: 683458 - protein, 9 aa, Homo Sapiens
VTSGHSFSS

SEQ ID NO: 683459 - protein, 9 aa, Homo Sapiens
TKDNQDIYK

SEQ ID NO: 683460 - protein, 9 aa, Homo Sapiens
VDVKCINKK

SEQ ID NO: 683461 - protein, 9 aa, Homo Sapiens
FGGKPNDGI

SEQ ID NO: 683462 - protein, 9 aa, Homo Sapiens
HSNTGTVHT

SEQ ID NO: 683463 - protein, 9 aa, Homo Sapiens
KCEEIADVL

SEQ ID NO: 683464 - protein, 9 aa, Homo Sapiens
RDNGHLFAL

SEQ ID NO: 683465 - protein, 9 aa, Homo Sapiens
GVSPEVFDF

SEQ ID NO: 683466 - protein, 9 aa, Homo Sapiens
ATGLADSGT

SEQ ID NO: 683467 - protein, 9 aa, Homo Sapiens
PDGKMYSVM

SEQ ID NO: 683468 - protein, 9 aa, Homo Sapiens
DRPGPPTRL

SEQ ID NO: 683469 - protein, 9 aa, Homo Sapiens
RTKWRSYRL

SEQ ID NO: 683470 - protein, 9 aa, Homo Sapiens
LIIVTIMVS

SEQ ID NO: 683471 - protein, 9 aa, Homo Sapiens
IMAEELKKE

SEQ ID NO: 683472 - protein, 9 aa, Homo Sapiens
AEATQSLSH

SEQ ID NO: 683473 - protein, 9 aa, Homo Sapiens
RRSRHLRVR

SEQ ID NO: 683474 - protein, 9 aa, Homo Sapiens
GFTGPKGPP

SEQ ID NO: 683475 - protein, 9 aa, Homo Sapiens
RRTKWRSYR

SEQ ID NO: 683476 - protein, 9 aa, Homo Sapiens
ILVFVSSAV

SEQ ID NO: 683477 - protein, 9 aa, Homo Sapiens
LGICLLEGV

SEQ ID NO: 683478 - protein, 9 aa, Homo Sapiens
GPIDAITDE

SEQ ID NO: 683479 - protein, 9 aa, Homo Sapiens
LRKKQNESI

SEQ ID NO: 683480 - protein, 9 aa, Homo Sapiens
AGGVGAQLM

SEQ ID NO: 683481 - protein, 9 aa, Homo Sapiens
KVQLRELER

SEQ ID NO: 683482 - protein, 9 aa, Homo Sapiens
VYAVPCSRS

SEQ ID NO: 683483 - protein, 9 aa, Homo Sapiens
VPGLVGSYL

SEQ ID NO: 683484 - protein, 9 aa, Homo Sapiens
GDHDQVSIQ

SEQ ID NO: 683485 - protein, 9 aa, Homo Sapiens
TVTSGHSFS

SEQ ID NO: 683486 - protein, 9 aa, Homo Sapiens
VYSIGRRVE

SEQ ID NO: 683487 - protein, 9 aa, Homo Sapiens
SSSSKDSDD

SEQ ID NO: 683488 - protein, 9 aa, Homo Sapiens
FLSLLILSM

SEQ ID NO: 683489 - protein, 9 aa, Homo Sapiens
MVHPATPNH

SEQ ID NO: 683490 - protein, 9 aa, Homo Sapiens
NSKIYSVNL

SEQ ID NO: 683491 - protein, 9 aa, Homo Sapiens
SSIHSMDTD

SEQ ID NO: 683492 - protein, 9 aa, Homo Sapiens
VELGQLPAL

SEQ ID NO: 683493 - protein, 9 aa, Homo Sapiens
QRLPSPISA

SEQ ID NO: 683494 - protein, 9 aa, Homo Sapiens
PNDGIPTRE

SEQ ID NO: 683495 - protein, 9 aa, Homo Sapiens
GGVGAQLMA

SEQ ID NO: 683496 - protein, 9 aa, Homo Sapiens
NPLVALRHM

SEQ ID NO: 683497 - protein, 9 aa, Homo Sapiens
KGLDELEFH

SEQ ID NO: 683498 - protein, 9 aa, Homo Sapiens
TSEGNVTTE

SEQ ID NO: 683499 - protein, 9 aa, Homo Sapiens
SRPSPASQL

SEQ ID NO: 683500 - protein, 9 aa, Homo Sapiens
VNEVSKPLA

SEQ ID NO: 683501 - protein, 9 aa, Homo Sapiens
PTSGEPRHT

SEQ ID NO: 683502 - protein, 9 aa, Homo Sapiens
SDENEEVKE

SEQ ID NO: 683503 - protein, 9 aa, Homo Sapiens
RGSVFTNER

SEQ ID NO: 683504 - protein, 9 aa, Homo Sapiens
IMQDDTNVQ

SEQ ID NO: 683505 - protein, 9 aa, Homo Sapiens
LLSILVFVS

SEQ ID NO: 683506 - protein, 9 aa, Homo Sapiens
VTTPERGIY

SEQ ID NO: 683507 - protein, 9 aa, Homo Sapiens
RKYEMHLYG

SEQ ID NO: 683508 - protein, 9 aa, Homo Sapiens
SCGHPINPL

SEQ ID NO: 683509 - protein, 9 aa, Homo Sapiens
SASEPSFNR

SEQ ID NO: 683510 - protein, 9 aa, Homo Sapiens
LPSDGILSG

SEQ ID NO: 683511 - protein, 9 aa, Homo Sapiens
ANLLINHYE

SEQ ID NO: 683512 - protein, 9 aa, Homo Sapiens
SDGILSGDN

SEQ ID NO: 683513 - protein, 9 aa, Homo Sapiens
SLPPEVWPA

SEQ ID NO: 683514 - protein, 9 aa, Homo Sapiens
GNDLVRCLR

SEQ ID NO: 683515 - protein, 9 aa, Homo Sapiens
DLVLQLIFG

SEQ ID NO: 683516 - protein, 9 aa, Homo Sapiens
LSCEPKLEK

SEQ ID NO: 683517 - protein, 9 aa, Homo Sapiens
GTRSLPSAS

SEQ ID NO: 683518 - protein, 9 aa, Homo Sapiens
RKLGRWRQE

SEQ ID NO: 683519 - protein, 9 aa, Homo Sapiens
RLIHQCDFA

SEQ ID NO: 683520 - protein, 9 aa, Homo Sapiens
DAITDEARY

SEQ ID NO: 683521 - protein, 9 aa, Homo Sapiens
EEFPLERRQ

SEQ ID NO: 683522 - protein, 9 aa, Homo Sapiens
PVVIRLLDW

SEQ ID NO: 683523 - protein, 9 aa, Homo Sapiens
SLKGSLGYS

SEQ ID NO: 683524 - protein, 9 aa, Homo Sapiens
RRAQSLKSP

SEQ ID NO: 683525 - protein, 9 aa, Homo Sapiens
CSRSGSESA

SEQ ID NO: 683526 - protein, 9 aa, Homo Sapiens
GARRGGPLM

SEQ ID NO: 683527 - protein, 9 aa, Homo Sapiens
PAELLGERG

SEQ ID NO: 683528 - protein, 9 aa, Homo Sapiens
SLPSASWSR

SEQ ID NO: 683529 - protein, 9 aa, Homo Sapiens
SPQCPILSY

SEQ ID NO: 683530 - protein, 9 aa, Homo Sapiens
PLRYTSMKS

SEQ ID NO: 683531 - protein, 9 aa, Homo Sapiens
TQYISRRSQ

SEQ ID NO: 683532 - protein, 9 aa, Homo Sapiens
LVCPHLECP

SEQ ID NO: 683533 - protein, 9 aa, Homo Sapiens
GRRVEGRHL

SEQ ID NO: 683534 - protein, 9 aa, Homo Sapiens
GEEEFPLER

SEQ ID NO: 683535 - protein, 9 aa, Homo Sapiens
LFMPIGPPS

SEQ ID NO: 683536 - protein, 9 aa, Homo Sapiens
LTHGDVRTI

SEQ ID NO: 683537 - protein, 9 aa, Homo Sapiens
SIGRRVEGR

SEQ ID NO: 683538 - protein, 9 aa, Homo Sapiens
PTEPPCLLE

SEQ ID NO: 683539 - protein, 9 aa, Homo Sapiens
DEDRESDVD

SEQ ID NO: 683540 - protein, 9 aa, Homo Sapiens
TTKIVCKSP

SEQ ID NO: 683541 - protein, 9 aa, Homo Sapiens
APLSRQTKD

SEQ ID NO: 683542 - protein, 9 aa, Homo Sapiens
VCPHLECPV

SEQ ID NO: 683543 - protein, 9 aa, Homo Sapiens
GLPMSMLTN

SEQ ID NO: 683544 - protein, 9 aa, Homo Sapiens
VFVSSAVVV

SEQ ID NO: 683545 - protein, 9 aa, Homo Sapiens
TSKCEEIAD

SEQ ID NO: 683546 - protein, 9 aa, Homo Sapiens
REKEGDFKG

SEQ ID NO: 683547 - protein, 9 aa, Homo Sapiens
NYIPQLFWN

SEQ ID NO: 683548 - protein, 9 aa, Homo Sapiens
PKDQEKTHS

SEQ ID NO: 683549 - protein, 9 aa, Homo Sapiens
KYEMHLYGL

SEQ ID NO: 683550 - protein, 9 aa, Homo Sapiens
RTQYISRRS

SEQ ID NO: 683551 - protein, 9 aa, Homo Sapiens
SISSMEGIM

SEQ ID NO: 683552 - protein, 9 aa, Homo Sapiens
PGLDALVAP

SEQ ID NO: 683553 - protein, 9 aa, Homo Sapiens
IDAITDEAR

SEQ ID NO: 683554 - protein, 9 aa, Homo Sapiens
PTFLQDSGL

SEQ ID NO: 683555 - protein, 9 aa, Homo Sapiens
FIYLQPSSI

SEQ ID NO: 683556 - protein, 9 aa, Homo Sapiens
ALPGPTVLA

SEQ ID NO: 683557 - protein, 9 aa, Homo Sapiens
AFNTLMLKR

SEQ ID NO: 683558 - protein, 9 aa, Homo Sapiens
YTCMADNIV

SEQ ID NO: 683559 - protein, 9 aa, Homo Sapiens
VPCSRSGSE

SEQ ID NO: 683560 - protein, 9 aa, Homo Sapiens
FPASRIFSH

SEQ ID NO: 683561 - protein, 9 aa, Homo Sapiens
HMEHGIITN

SEQ ID NO: 683562 - protein, 9 aa, Homo Sapiens
RIVSGYDDN

SEQ ID NO: 683563 - protein, 9 aa, Homo Sapiens
DALVAPTIN

SEQ ID NO: 683564 - protein, 9 aa, Homo Sapiens
QRNKVKFLT

SEQ ID NO: 683565 - protein, 9 aa, Homo Sapiens
ELPPPLERT

SEQ ID NO: 683566 - protein, 9 aa, Homo Sapiens
ASWSRCWRT

SEQ ID NO: 683567 - protein, 9 aa, Homo Sapiens
HNLQHLHIT

SEQ ID NO: 683568 - protein, 9 aa, Homo Sapiens
NESLVCPHL

SEQ ID NO: 683569 - protein, 9 aa, Homo Sapiens
GGPASSSPA

SEQ ID NO: 683570 - protein, 9 aa, Homo Sapiens
YSASNDVAA

SEQ ID NO: 683571 - protein, 9 aa, Homo Sapiens
YVRAVRNSK

SEQ ID NO: 683572 - protein, 9 aa, Homo Sapiens
SKLTANDLP

SEQ ID NO: 683573 - protein, 9 aa, Homo Sapiens
ENAGAEATQ

SEQ ID NO: 683574 - protein, 9 aa, Homo Sapiens
LSPGATLTS

SEQ ID NO: 683575 - protein, 9 aa, Homo Sapiens
QRWEYFRQI

SEQ ID NO: 683576 - protein, 9 aa, Homo Sapiens
PLFGVLLDA

SEQ ID NO: 683577 - protein, 9 aa, Homo Sapiens
NVKLRGRLL

SEQ ID NO: 683578 - protein, 9 aa, Homo Sapiens
ARVVCCSME

SEQ ID NO: 683579 - protein, 9 aa, Homo Sapiens
SWWTDTERL

SEQ ID NO: 683580 - protein, 9 aa, Homo Sapiens
EENAGAEAT

SEQ ID NO: 683581 - protein, 9 aa, Homo Sapiens
VLLGGLDSL

SEQ ID NO: 683582 - protein, 9 aa, Homo Sapiens
CGNRIVSGY

SEQ ID NO: 683583 - protein, 9 aa, Homo Sapiens
QASSSDTTA

SEQ ID NO: 683584 - protein, 9 aa, Homo Sapiens
NPENNVKER

SEQ ID NO: 683585 - protein, 9 aa, Homo Sapiens
NRIVSGYDD

SEQ ID NO: 683586 - protein, 9 aa, Homo Sapiens
SLTGVIVVM

SEQ ID NO: 683587 - protein, 9 aa, Homo Sapiens
TYSRVYIKL

SEQ ID NO: 683588 - protein, 9 aa, Homo Sapiens
WFESNMGNG

SEQ ID NO: 683589 - protein, 9 aa, Homo Sapiens
CLSRPGWAA

SEQ ID NO: 683590 - protein, 9 aa, Homo Sapiens
ADIKVDGKQ

SEQ ID NO: 683591 - protein, 9 aa, Homo Sapiens
GAVTVASAS

SEQ ID NO: 683592 - protein, 9 aa, Homo Sapiens
WSGGVKLWL

SEQ ID NO: 683593 - protein, 9 aa, Homo Sapiens
VGSSGGISS

SEQ ID NO: 683594 - protein, 9 aa, Homo Sapiens
IDVRTKLGD

SEQ ID NO: 683595 - protein, 9 aa, Homo Sapiens
TEETFGFLL

SEQ ID NO: 683596 - protein, 9 aa, Homo Sapiens
DVRTKLGDY

SEQ ID NO: 683597 - protein, 9 aa, Homo Sapiens
SQVPRGAES

SEQ ID NO: 683598 - protein, 9 aa, Homo Sapiens
LAAFTTSSA

SEQ ID NO: 683599 - protein, 9 aa, Homo Sapiens
PPCLLEACD

SEQ ID NO: 683600 - protein, 9 aa, Homo Sapiens
ISMAGCATE

SEQ ID NO: 683601 - protein, 9 aa, Homo Sapiens
VAMCRPLHY

SEQ ID NO: 683602 - protein, 9 aa, Homo Sapiens
PSLSALPGP

SEQ ID NO: 683603 - protein, 9 aa, Homo Sapiens
VSKLGLPSD

SEQ ID NO: 683604 - protein, 9 aa, Homo Sapiens
ASGLLREWY

SEQ ID NO: 683605 - protein, 9 aa, Homo Sapiens
QRMYQSLEQ

SEQ ID NO: 683606 - protein, 9 aa, Homo Sapiens
SGDFWRMYL

SEQ ID NO: 683607 - protein, 9 aa, Homo Sapiens
PCLHGDYLQ

SEQ ID NO: 683608 - protein, 9 aa, Homo Sapiens
VALLLSSIE

SEQ ID NO: 683609 - protein, 8 aa, Homo Sapiens
GHFTEEDK

SEQ ID NO: 683610 - protein, 9 aa, Homo Sapiens
LQAAVEKDC

SEQ ID NO: 683611 - protein, 9 aa, Homo Sapiens
TVVDTPSHS

SEQ ID NO: 683612 - protein, 9 aa, Homo Sapiens
TQALAWQAK

SEQ ID NO: 683613 - protein, 9 aa, Homo Sapiens
TNYFNWVVR

SEQ ID NO: 683614 - protein, 9 aa, Homo Sapiens
PPTRLLVKG

SEQ ID NO: 683615 - protein, 9 aa, Homo Sapiens
PLTDNFYNA

SEQ ID NO: 683616 - protein, 9 aa, Homo Sapiens
LHNLQHLHI

SEQ ID NO: 683617 - protein, 9 aa, Homo Sapiens
PSGTFAALG

SEQ ID NO: 683618 - protein, 9 aa, Homo Sapiens
PASSSPAAG

SEQ ID NO: 683619 - protein, 9 aa, Homo Sapiens
CPETKYNVT

SEQ ID NO: 683620 - protein, 9 aa, Homo Sapiens
PGKSPTLGS

SEQ ID NO: 683621 - protein, 9 aa, Homo Sapiens
SSSASSLKG

SEQ ID NO: 683622 - protein, 9 aa, Homo Sapiens
LPQRLPSPI

SEQ ID NO: 683623 - protein, 9 aa, Homo Sapiens
GVVIFITAV

SEQ ID NO: 683624 - protein, 9 aa, Homo Sapiens
ASEPSFNRA

SEQ ID NO: 683625 - protein, 9 aa, Homo Sapiens
QHGGPRRPS

SEQ ID NO: 683626 - protein, 9 aa, Homo Sapiens
MPTFCPENV

SEQ ID NO: 683627 - protein, 9 aa, Homo Sapiens
NGDFKDVKN

SEQ ID NO: 683628 - protein, 9 aa, Homo Sapiens
ENNVKEREC

SEQ ID NO: 683629 - protein, 9 aa, Homo Sapiens
NNAHDADVG

SEQ ID NO: 683630 - protein, 9 aa, Homo Sapiens
DQKKGLDEL

SEQ ID NO: 683631 - protein, 9 aa, Homo Sapiens
QRRSRHLRV

SEQ ID NO: 683632 - protein, 9 aa, Homo Sapiens
AVAACAARG

SEQ ID NO: 683633 - protein, 9 aa, Homo Sapiens
ENMGLVSLL

SEQ ID NO: 683634 - protein, 9 aa, Homo Sapiens
QEEEEARKN

SEQ ID NO: 683635 - protein, 9 aa, Homo Sapiens
QYDNRCRNM

SEQ ID NO: 683636 - protein, 9 aa, Homo Sapiens
AMCRPLHYT

SEQ ID NO: 683637 - protein, 9 aa, Homo Sapiens
FAKVTKALM

SEQ ID NO: 683638 - protein, 9 aa, Homo Sapiens
RVEGRHLYV

SEQ ID NO: 683639 - protein, 9 aa, Homo Sapiens
HTVPLRKGT

SEQ ID NO: 683640 - protein, 9 aa, Homo Sapiens
NLLINHYEE

SEQ ID NO: 683641 - protein, 9 aa, Homo Sapiens
WDAFAKVTK

SEQ ID NO: 683642 - protein, 9 aa, Homo Sapiens
LSRPGWAAL

SEQ ID NO: 683643 - protein, 9 aa, Homo Sapiens
SASTGDTSP

SEQ ID NO: 683644 - protein, 9 aa, Homo Sapiens
EYSASNDVA

SEQ ID NO: 683645 - protein, 9 aa, Homo Sapiens
HLRVRTEGK

SEQ ID NO: 683646 - protein, 9 aa, Homo Sapiens
SGGVKLWLK

SEQ ID NO: 683647 - protein, 9 aa, Homo Sapiens
SAEEFINLV

SEQ ID NO: 683648 - protein, 9 aa, Homo Sapiens
QKKGLDELE

SEQ ID NO: 683649 - protein, 9 aa, Homo Sapiens
SATKTQLAD

SEQ ID NO: 683650 - protein, 9 aa, Homo Sapiens
SRARAQDRN

SEQ ID NO: 683651 - protein, 9 aa, Homo Sapiens
RHPHHNQTF

SEQ ID NO: 683652 - protein, 9 aa, Homo Sapiens
IMFQSAVPK

SEQ ID NO: 683653 - protein, 9 aa, Homo Sapiens
YEMHLYGLH

SEQ ID NO: 683654 - protein, 9 aa, Homo Sapiens
GHPVVIRLL

SEQ ID NO: 683655 - protein, 9 aa, Homo Sapiens
SDTLLCQLS

SEQ ID NO: 683656 - protein, 9 aa, Homo Sapiens
NSSDEDDDD

SEQ ID NO: 683657 - protein, 9 aa, Homo Sapiens
DSVHSSALF

SEQ ID NO: 683658 - protein, 9 aa, Homo Sapiens
TEFSGNGWN

SEQ ID NO: 683659 - protein, 9 aa, Homo Sapiens
SQGYSPQRT

SEQ ID NO: 683660 - protein, 9 aa, Homo Sapiens
KQQKSISSM

SEQ ID NO: 683661 - protein, 9 aa, Homo Sapiens
PGHPGEPGY

SEQ ID NO: 683662 - protein, 9 aa, Homo Sapiens
AALGVALLL

SEQ ID NO: 683663 - protein, 9 aa, Homo Sapiens
TGDTSPLPV

SEQ ID NO: 683664 - protein, 9 aa, Homo Sapiens
NPLRYPVLL

SEQ ID NO: 683665 - protein, 9 aa, Homo Sapiens
YSVMFRNGL

SEQ ID NO: 683666 - protein, 9 aa, Homo Sapiens
LTLLRVLFS

SEQ ID NO: 683667 - protein, 9 aa, Homo Sapiens
LADSGTDCS

SEQ ID NO: 683668 - protein, 9 aa, Homo Sapiens
VSINRDNGH

SEQ ID NO: 683669 - protein, 9 aa, Homo Sapiens
YRHVPGTDP

SEQ ID NO: 683670 - protein, 9 aa, Homo Sapiens
SQSRARAQD

SEQ ID NO: 683671 - protein, 9 aa, Homo Sapiens
KFRVLRHDA

SEQ ID NO: 683672 - protein, 9 aa, Homo Sapiens
RSLGWASPE

SEQ ID NO: 683673 - protein, 9 aa, Homo Sapiens
FEWDAFAKV

SEQ ID NO: 683674 - protein, 9 aa, Homo Sapiens
NCNFEDGFF

SEQ ID NO: 683675 - protein, 9 aa, Homo Sapiens
RPGWAALQR

SEQ ID NO: 683676 - protein, 9 aa, Homo Sapiens
YYVIQTYLP

SEQ ID NO: 683677 - protein, 9 aa, Homo Sapiens
RDGEEEFPL

SEQ ID NO: 683678 - protein, 9 aa, Homo Sapiens
SLKSPSIAT

SEQ ID NO: 683679 - protein, 9 aa, Homo Sapiens
SSRGLQSWW

SEQ ID NO: 683680 - protein, 9 aa, Homo Sapiens
SGDYEYSAS

SEQ ID NO: 683681 - protein, 9 aa, Homo Sapiens
SNIRNQMES

SEQ ID NO: 683682 - protein, 9 aa, Homo Sapiens
WGKTLMPRM

SEQ ID NO: 683683 - protein, 9 aa, Homo Sapiens
GQDASGLLR

SEQ ID NO: 683684 - protein, 9 aa, Homo Sapiens
SRDQDRMNS

SEQ ID NO: 683685 - protein, 9 aa, Homo Sapiens
VKIYLQVPS

SEQ ID NO: 683686 - protein, 9 aa, Homo Sapiens
YHPGHRARS

SEQ ID NO: 683687 - protein, 9 aa, Homo Sapiens
TMAIQSAPL

SEQ ID NO: 683688 - protein, 9 aa, Homo Sapiens
SLHSQPHQE

SEQ ID NO: 683689 - protein, 9 aa, Homo Sapiens
NYLVFNDVN

SEQ ID NO: 683690 - protein, 9 aa, Homo Sapiens
RSLPSASWS

SEQ ID NO: 683691 - protein, 9 aa, Homo Sapiens
QKRDVFEHH

SEQ ID NO: 683692 - protein, 9 aa, Homo Sapiens
GDVSGASTY

SEQ ID NO: 683693 - protein, 9 aa, Homo Sapiens
YCLGDLPMK

SEQ ID NO: 683694 - protein, 9 aa, Homo Sapiens
REKHDLEVD

SEQ ID NO: 683695 - protein, 9 aa, Homo Sapiens
LDELEFHTV

SEQ ID NO: 683696 - protein, 9 aa, Homo Sapiens
VASSSASSL

SEQ ID NO: 683697 - protein, 9 aa, Homo Sapiens
AKKAPTHIW

SEQ ID NO: 683698 - protein, 9 aa, Homo Sapiens
TVTEERRRL

SEQ ID NO: 683699 - protein, 9 aa, Homo Sapiens
FYDRTLRVF

SEQ ID NO: 683700 - protein, 9 aa, Homo Sapiens
SFSPILNAS

SEQ ID NO: 683701 - protein, 9 aa, Homo Sapiens
SRSPPAPPF

SEQ ID NO: 683702 - protein, 9 aa, Homo Sapiens
LLILSMLLG

SEQ ID NO: 683703 - protein, 9 aa, Homo Sapiens
LPTEPPCLL

SEQ ID NO: 683704 - protein, 9 aa, Homo Sapiens
KISAWIRKM

SEQ ID NO: 683705 - protein, 9 aa, Homo Sapiens
GCSHLPGHS

SEQ ID NO: 683706 - protein, 9 aa, Homo Sapiens
SYRLPRPGP

SEQ ID NO: 683707 - protein, 9 aa, Homo Sapiens
ASSSASSLK

SEQ ID NO: 683708 - protein, 9 aa, Homo Sapiens
LTPDYILRL

SEQ ID NO: 683709 - protein, 9 aa, Homo Sapiens
CLHGDYLQL

SEQ ID NO: 683710 - protein, 9 aa, Homo Sapiens
SFLFGALVE

SEQ ID NO: 683711 - protein, 9 aa, Homo Sapiens
VSGGPASSS

SEQ ID NO: 683712 - protein, 9 aa, Homo Sapiens
GCFVQCYFF

SEQ ID NO: 683713 - protein, 9 aa, Homo Sapiens
FFDEKPSWD

SEQ ID NO: 683714 - protein, 9 aa, Homo Sapiens
GIVGAVTVA

SEQ ID NO: 683715 - protein, 9 aa, Homo Sapiens
GDFKGCTVS

SEQ ID NO: 683716 - protein, 9 aa, Homo Sapiens
DDKTTKIVC

SEQ ID NO: 683717 - protein, 9 aa, Homo Sapiens
TLGKPDSIL

SEQ ID NO: 683718 - protein, 9 aa, Homo Sapiens
IGYYVIQTY

SEQ ID NO: 683719 - protein, 9 aa, Homo Sapiens
PGPPTRLLV

SEQ ID NO: 683720 - protein, 9 aa, Homo Sapiens
MLLGNTLVC

SEQ ID NO: 683721 - protein, 9 aa, Homo Sapiens
PWKREAEKK

SEQ ID NO: 683722 - protein, 9 aa, Homo Sapiens
AVQNIGNVL

SEQ ID NO: 683723 - protein, 9 aa, Homo Sapiens
HDQVSIQSL

SEQ ID NO: 683724 - protein, 9 aa, Homo Sapiens
QRGKRKKQN

SEQ ID NO: 683725 - protein, 9 aa, Homo Sapiens
QQYQNATAE

SEQ ID NO: 683726 - protein, 9 aa, Homo Sapiens
REAPVVSRG

SEQ ID NO: 683727 - protein, 9 aa, Homo Sapiens
LECPVLGPW

SEQ ID NO: 683728 - protein, 9 aa, Homo Sapiens
YSYSALITM

SEQ ID NO: 683729 - protein, 9 aa, Homo Sapiens
QHEPNDEDR

SEQ ID NO: 683730 - protein, 9 aa, Homo Sapiens
AYHSELKAH

SEQ ID NO: 683731 - protein, 9 aa, Homo Sapiens
ESLDLKRRL

SEQ ID NO: 683732 - protein, 9 aa, Homo Sapiens
KTHSLSETL

SEQ ID NO: 683733 - protein, 9 aa, Homo Sapiens
FSHCDLFPE

SEQ ID NO: 683734 - protein, 9 aa, Homo Sapiens
NQSFSPILN

SEQ ID NO: 683735 - protein, 9 aa, Homo Sapiens
FFIMQDDTN

SEQ ID NO: 683736 - protein, 9 aa, Homo Sapiens
WSRCWRTRL

SEQ ID NO: 683737 - protein, 9 aa, Homo Sapiens
DAGRPLRLL

SEQ ID NO: 683738 - protein, 9 aa, Homo Sapiens
RAWNPPPVS

SEQ ID NO: 683739 - protein, 9 aa, Homo Sapiens
GAESDHSNM

SEQ ID NO: 683740 - protein, 9 aa, Homo Sapiens
PETKYNVTG

SEQ ID NO: 683741 - protein, 9 aa, Homo Sapiens
QGPLVCEAS

SEQ ID NO: 683742 - protein, 9 aa, Homo Sapiens
LVFNDVNGL

SEQ ID NO: 683743 - protein, 9 aa, Homo Sapiens
ASTYSRVYI

SEQ ID NO: 683744 - protein, 9 aa, Homo Sapiens
ASQLFMPIG

SEQ ID NO: 683745 - protein, 9 aa, Homo Sapiens
YVIQTYLPC

SEQ ID NO: 683746 - protein, 9 aa, Homo Sapiens
SQVESTNEG

SEQ ID NO: 683747 - protein, 9 aa, Homo Sapiens
PWALSVLLM

SEQ ID NO: 683748 - protein, 9 aa, Homo Sapiens
SYSALITMA

SEQ ID NO: 683749 - protein, 9 aa, Homo Sapiens
TVDETKWIT

SEQ ID NO: 683750 - protein, 9 aa, Homo Sapiens
LMEDRNACL

SEQ ID NO: 683751 - protein, 9 aa, Homo Sapiens
AWQAKKAPT

SEQ ID NO: 683752 - protein, 9 aa, Homo Sapiens
SNTGTVHTV

SEQ ID NO: 683753 - protein, 9 aa, Homo Sapiens
LGDQKRKQG

SEQ ID NO: 683754 - protein, 9 aa, Homo Sapiens
SGYDDNTLK

SEQ ID NO: 683755 - protein, 9 aa, Homo Sapiens
EQSGDYEYS

SEQ ID NO: 683756 - protein, 9 aa, Homo Sapiens
PKEKSPLVT

SEQ ID NO: 683757 - protein, 9 aa, Homo Sapiens
DTNVQAPRL

SEQ ID NO: 683758 - protein, 9 aa, Homo Sapiens
AFAKVTKAL

SEQ ID NO: 683759 - protein, 9 aa, Homo Sapiens
VLELAVVSS

SEQ ID NO: 683760 - protein, 9 aa, Homo Sapiens
QESTMVHPA

SEQ ID NO: 683761 - protein, 9 aa, Homo Sapiens
RNSKIYSVN

SEQ ID NO: 683762 - protein, 9 aa, Homo Sapiens
VQKMLLLIS

SEQ ID NO: 683763 - protein, 9 aa, Homo Sapiens
EWLAPWKRE

SEQ ID NO: 683764 - protein, 9 aa, Homo Sapiens
GHVSLVGWQ

SEQ ID NO: 683765 - protein, 9 aa, Homo Sapiens
YIPQLFWNA

SEQ ID NO: 683766 - protein, 9 aa, Homo Sapiens
QAISTTSVY

SEQ ID NO: 683767 - protein, 9 aa, Homo Sapiens
HRSASEPSF

SEQ ID NO: 683768 - protein, 9 aa, Homo Sapiens
GGIVGAVTV

SEQ ID NO: 683769 - protein, 9 aa, Homo Sapiens
SKSHKKRSL

SEQ ID NO: 683770 - protein, 9 aa, Homo Sapiens
ERRRLLWCY

SEQ ID NO: 683771 - protein, 9 aa, Homo Sapiens
TLVSATILD

SEQ ID NO: 683772 - protein, 9 aa, Homo Sapiens
TSATEPNDL

SEQ ID NO: 683773 - protein, 9 aa, Homo Sapiens
SEEDSSSSK

SEQ ID NO: 683774 - protein, 9 aa, Homo Sapiens
VGAVTVASA

SEQ ID NO: 683775 - protein, 9 aa, Homo Sapiens
GPPGIPGHP

SEQ ID NO: 683776 - protein, 9 aa, Homo Sapiens
SSPLTPLSE

SEQ ID NO: 683777 - protein, 9 aa, Homo Sapiens
GQPPGLHHH

SEQ ID NO: 683778 - protein, 9 aa, Homo Sapiens
FNDVNGLYT

SEQ ID NO: 683779 - protein, 9 aa, Homo Sapiens
AAVGRTGVF

SEQ ID NO: 683780 - protein, 9 aa, Homo Sapiens
LVTNPLIKG

SEQ ID NO: 683781 - protein, 9 aa, Homo Sapiens
SCIGDHSMR

SEQ ID NO: 683782 - protein, 9 aa, Homo Sapiens
VIVVMLIFT

SEQ ID NO: 683783 - protein, 9 aa, Homo Sapiens
TTSSAFICL

SEQ ID NO: 683784 - protein, 9 aa, Homo Sapiens
SFNRAGFQT

SEQ ID NO: 683785 - protein, 9 aa, Homo Sapiens
DQDRMNSGA

SEQ ID NO: 683786 - protein, 9 aa, Homo Sapiens
GDTSPLPVT

SEQ ID NO: 683787 - protein, 9 aa, Homo Sapiens
LVGSYLCSP

SEQ ID NO: 683788 - protein, 9 aa, Homo Sapiens
LRTQWWGKT

SEQ ID NO: 683789 - protein, 9 aa, Homo Sapiens
YLQVPSSES

SEQ ID NO: 683790 - protein, 9 aa, Homo Sapiens
LPSEDIPET

SEQ ID NO: 683791 - protein, 9 aa, Homo Sapiens
LISATKTQL

SEQ ID NO: 683792 - protein, 9 aa, Homo Sapiens
GVALLLSSI

SEQ ID NO: 683793 - protein, 9 aa, Homo Sapiens
RSRSESDVL

SEQ ID NO: 683794 - protein, 9 aa, Homo Sapiens
MVSQSLGSP

SEQ ID NO: 683795 - protein, 9 aa, Homo Sapiens
PSKASPTQD

SEQ ID NO: 683796 - protein, 9 aa, Homo Sapiens
DRTLRVFEV

SEQ ID NO: 683797 - protein, 9 aa, Homo Sapiens
YAWAVQNIG

SEQ ID NO: 683798 - protein, 9 aa, Homo Sapiens
SHKKRSLEG

SEQ ID NO: 683799 - protein, 9 aa, Homo Sapiens
SPEVFDFSQ

SEQ ID NO: 683800 - protein, 9 aa, Homo Sapiens
MTLVWRMRQ

SEQ ID NO: 683801 - protein, 9 aa, Homo Sapiens
LAWQAKKAP

SEQ ID NO: 683802 - protein, 9 aa, Homo Sapiens
APPFPLMTK

SEQ ID NO: 683803 - protein, 9 aa, Homo Sapiens
MLPHRSMLR

SEQ ID NO: 683804 - protein, 9 aa, Homo Sapiens
DCLRAVEVT

SEQ ID NO: 683805 - protein, 9 aa, Homo Sapiens
VILISKDRL

SEQ ID NO: 683806 - protein, 9 aa, Homo Sapiens
THSLSETLE

SEQ ID NO: 683807 - protein, 9 aa, Homo Sapiens
VKNKTDKKD

SEQ ID NO: 683808 - protein, 9 aa, Homo Sapiens
DPAELLGER

SEQ ID NO: 683809 - protein, 9 aa, Homo Sapiens
ALITMAIQS

SEQ ID NO: 683810 - protein, 9 aa, Homo Sapiens
EGAVAACAA

SEQ ID NO: 683811 - protein, 9 aa, Homo Sapiens
CSHLPGHSP

SEQ ID NO: 683812 - protein, 9 aa, Homo Sapiens
PENNVKERE

SEQ ID NO: 683813 - protein, 9 aa, Homo Sapiens
RYSSRRGAR

SEQ ID NO: 683814 - protein, 9 aa, Homo Sapiens
NQTFAGKDS

SEQ ID NO: 683815 - protein, 9 aa, Homo Sapiens
KMGFAPGKV

SEQ ID NO: 683816 - protein, 9 aa, Homo Sapiens
EVDVKCINK

SEQ ID NO: 683817 - protein, 9 aa, Homo Sapiens
LERRQIPLY

SEQ ID NO: 683818 - protein, 9 aa, Homo Sapiens
QWWGKTLMP

SEQ ID NO: 683819 - protein, 9 aa, Homo Sapiens
SHSSQSARF

SEQ ID NO: 683820 - protein, 9 aa, Homo Sapiens
GLLGVVAFN

SEQ ID NO: 683821 - protein, 9 aa, Homo Sapiens
EIGLLHNLQ

SEQ ID NO: 683822 - protein, 9 aa, Homo Sapiens
KDQEKTHSL

SEQ ID NO: 683823 - protein, 9 aa, Homo Sapiens
ALRNHQTPQ

SEQ ID NO: 683824 - protein, 9 aa, Homo Sapiens
DENEEVKET

SEQ ID NO: 683825 - protein, 9 aa, Homo Sapiens
ISYVGCFVQ

SEQ ID NO: 683826 - protein, 9 aa, Homo Sapiens
FLEILEKSG

SEQ ID NO: 683827 - protein, 9 aa, Homo Sapiens
VVKVFAIQN

SEQ ID NO: 683828 - protein, 9 aa, Homo Sapiens
PGLVPGLVG

SEQ ID NO: 683829 - protein, 9 aa, Homo Sapiens
RPIEDLVLQ

SEQ ID NO: 683830 - protein, 9 aa, Homo Sapiens
PTSPQGDAL

SEQ ID NO: 683831 - protein, 9 aa, Homo Sapiens
ACLGECVNL

SEQ ID NO: 683832 - protein, 9 aa, Homo Sapiens
AEEFINLVF

SEQ ID NO: 683833 - protein, 9 aa, Homo Sapiens
PHRSMLRGI

SEQ ID NO: 683834 - protein, 9 aa, Homo Sapiens
ELGQLPALP

SEQ ID NO: 683835 - protein, 9 aa, Homo Sapiens
IRNQMESLH

SEQ ID NO: 683836 - protein, 9 aa, Homo Sapiens
RVVCCSMEW

SEQ ID NO: 683837 - protein, 9 aa, Homo Sapiens
TILDLSEVL

SEQ ID NO: 683838 - protein, 9 aa, Homo Sapiens
EPILTFHFQ

SEQ ID NO: 683839 - protein, 9 aa, Homo Sapiens
NYVADIKVD

SEQ ID NO: 683840 - protein, 9 aa, Homo Sapiens
FQRSSSLLH

SEQ ID NO: 683841 - protein, 9 aa, Homo Sapiens
AGSGVELVN

SEQ ID NO: 683842 - protein, 9 aa, Homo Sapiens
LIHQCDFAG

SEQ ID NO: 683843 - protein, 9 aa, Homo Sapiens
VRTVELGQL

SEQ ID NO: 683844 - protein, 9 aa, Homo Sapiens
GQSFSSLYE

SEQ ID NO: 683845 - protein, 9 aa, Homo Sapiens
IRKMEIPRT

SEQ ID NO: 683846 - protein, 9 aa, Homo Sapiens
IADVLSSFL

SEQ ID NO: 683847 - protein, 9 aa, Homo Sapiens
TNAHFYCQY

SEQ ID NO: 683848 - protein, 9 aa, Homo Sapiens
GLVPGLVGS

SEQ ID NO: 683849 - protein, 9 aa, Homo Sapiens
MRQMLITEP

SEQ ID NO: 683850 - protein, 9 aa, Homo Sapiens
LQGKGDHDQ

SEQ ID NO: 683851 - protein, 9 aa, Homo Sapiens
EKPHECEEC

SEQ ID NO: 683852 - protein, 9 aa, Homo Sapiens
ISQETVNGW

SEQ ID NO: 683853 - protein, 9 aa, Homo Sapiens
HDFDVKIYL

SEQ ID NO: 683854 - protein, 9 aa, Homo Sapiens
ATEPNDLSF

SEQ ID NO: 683855 - protein, 9 aa, Homo Sapiens
RRVREAKTK

SEQ ID NO: 683856 - protein, 9 aa, Homo Sapiens
MGLVSLLKH

SEQ ID NO: 683857 - protein, 9 aa, Homo Sapiens
TFCPENVLN

SEQ ID NO: 683858 - protein, 9 aa, Homo Sapiens
QMCFFVLLG

SEQ ID NO: 683859 - protein, 9 aa, Homo Sapiens
GAGGGHPVV

SEQ ID NO: 683860 - protein, 9 aa, Homo Sapiens
QALAWQAKK

SEQ ID NO: 683861 - protein, 9 aa, Homo Sapiens
HQLRTQWWG

SEQ ID NO: 683862 - protein, 9 aa, Homo Sapiens
TSSRIRETM

SEQ ID NO: 683863 - protein, 9 aa, Homo Sapiens
GITRPANEF

SEQ ID NO: 683864 - protein, 9 aa, Homo Sapiens
RDQDRMNSG

SEQ ID NO: 683865 - protein, 9 aa, Homo Sapiens
KTTKIVCKS

SEQ ID NO: 683866 - protein, 9 aa, Homo Sapiens
ARRGGPLMC

SEQ ID NO: 683867 - protein, 9 aa, Homo Sapiens
QVTTPERGI

SEQ ID NO: 683868 - protein, 9 aa, Homo Sapiens
SATEPNDLS

SEQ ID NO: 683869 - protein, 9 aa, Homo Sapiens
SASWSRCWR

SEQ ID NO: 683870 - protein, 9 aa, Homo Sapiens
QDQQQQILQ

SEQ ID NO: 683871 - protein, 9 aa, Homo Sapiens
ACAARGQGG

SEQ ID NO: 683872 - protein, 9 aa, Homo Sapiens
EKTHSLSET

SEQ ID NO: 683873 - protein, 9 aa, Homo Sapiens
QQEEMVQKM

SEQ ID NO: 683874 - protein, 9 aa, Homo Sapiens
STSCSTMSC

SEQ ID NO: 683875 - protein, 9 aa, Homo Sapiens
ISRAMCALL

SEQ ID NO: 683876 - protein, 9 aa, Homo Sapiens
EPPCLLEAC

SEQ ID NO: 683877 - protein, 9 aa, Homo Sapiens
FFFWVQDLN

SEQ ID NO: 683878 - protein, 9 aa, Homo Sapiens
NNVKERECP

SEQ ID NO: 683879 - protein, 9 aa, Homo Sapiens
ENLTHGDVR

SEQ ID NO: 683880 - protein, 9 aa, Homo Sapiens
TSNGSIYTS

SEQ ID NO: 683881 - protein, 9 aa, Homo Sapiens
NHQTPQYDN

SEQ ID NO: 683882 - protein, 9 aa, Homo Sapiens
AIKKFKDSD

SEQ ID NO: 683883 - protein, 9 aa, Homo Sapiens
DIDLGVSPE

SEQ ID NO: 683884 - protein, 9 aa, Homo Sapiens
GSVFTNERF

SEQ ID NO: 683885 - protein, 9 aa, Homo Sapiens
PINPLVALR

SEQ ID NO: 683886 - protein, 9 aa, Homo Sapiens
TFWHKISYF

SEQ ID NO: 683887 - protein, 9 aa, Homo Sapiens
QGPVGFTGP

SEQ ID NO: 683888 - protein, 9 aa, Homo Sapiens
QPPGLHHHG

SEQ ID NO: 683889 - protein, 9 aa, Homo Sapiens
CITTSCIGD

SEQ ID NO: 683890 - protein, 9 aa, Homo Sapiens
SEGNVTTED

SEQ ID NO: 683891 - protein, 9 aa, Homo Sapiens
AGGQPPGLH

SEQ ID NO: 683892 - protein, 9 aa, Homo Sapiens
IRNIMFQSA

SEQ ID NO: 683893 - protein, 9 aa, Homo Sapiens
LLINHYEEQ

SEQ ID NO: 683894 - protein, 9 aa, Homo Sapiens
NSESNDILQ

SEQ ID NO: 683895 - protein, 9 aa, Homo Sapiens
EYQQYQNAT

SEQ ID NO: 683896 - protein, 9 aa, Homo Sapiens
YEEALGSRH

SEQ ID NO: 683897 - protein, 9 aa, Homo Sapiens
TLMPRMTRQ

SEQ ID NO: 683898 - protein, 9 aa, Homo Sapiens
DFDVKIYLQ

SEQ ID NO: 683899 - protein, 9 aa, Homo Sapiens
ADNIVAKRR

SEQ ID NO: 683900 - protein, 9 aa, Homo Sapiens
IPEAPSKSH

SEQ ID NO: 683901 - protein, 9 aa, Homo Sapiens
TEIFFYTSL

SEQ ID NO: 683902 - protein, 9 aa, Homo Sapiens
SSNYIPQLF

SEQ ID NO: 683903 - protein, 9 aa, Homo Sapiens
TEDTSYPLG

SEQ ID NO: 683904 - protein, 9 aa, Homo Sapiens
EDLVLQLIF

SEQ ID NO: 683905 - protein, 9 aa, Homo Sapiens
FTLSAVGGF

SEQ ID NO: 683906 - protein, 9 aa, Homo Sapiens
AFTVILISK

SEQ ID NO: 683907 - protein, 9 aa, Homo Sapiens
RVDSSNYIP

SEQ ID NO: 683908 - protein, 9 aa, Homo Sapiens
SSVSGGPAS

SEQ ID NO: 683909 - protein, 9 aa, Homo Sapiens
SQSLYDSVH

SEQ ID NO: 683910 - protein, 9 aa, Homo Sapiens
TLSAEEFIN

SEQ ID NO: 683911 - protein, 9 aa, Homo Sapiens
AACAARGQG

SEQ ID NO: 683912 - protein, 9 aa, Homo Sapiens
GNVTTEDSE

SEQ ID NO: 683913 - protein, 9 aa, Homo Sapiens
HNQTFAGKD

SEQ ID NO: 683914 - protein, 9 aa, Homo Sapiens
HLKAVKLFR

SEQ ID NO: 683915 - protein, 9 aa, Homo Sapiens
QEKTHSLSE

SEQ ID NO: 683916 - protein, 9 aa, Homo Sapiens
YDSSPLTPL

SEQ ID NO: 683917 - protein, 9 aa, Homo Sapiens
TDNFYNADP

SEQ ID NO: 683918 - protein, 9 aa, Homo Sapiens
TEVDTGIHL

SEQ ID NO: 683919 - protein, 9 aa, Homo Sapiens
RNACLGECV

SEQ ID NO: 683920 - protein, 9 aa, Homo Sapiens
LWILRQLTM

SEQ ID NO: 683921 - protein, 9 aa, Homo Sapiens
EKEGDFKGC

SEQ ID NO: 683922 - protein, 9 aa, Homo Sapiens
QQTLSAEEF

SEQ ID NO: 683923 - protein, 9 aa, Homo Sapiens
NACLGECVN

SEQ ID NO: 683924 - protein, 9 aa, Homo Sapiens
PLVALRHME

SEQ ID NO: 683925 - protein, 9 aa, Homo Sapiens
NGTVNSKTR

SEQ ID NO: 683926 - protein, 9 aa, Homo Sapiens
TLVWRMRQM

SEQ ID NO: 683927 - protein, 9 aa, Homo Sapiens
VHTVPLRKG

SEQ ID NO: 683928 - protein, 9 aa, Homo Sapiens
ETAPLRKYA

SEQ ID NO: 683929 - protein, 9 aa, Homo Sapiens
KTLMPRMTR

SEQ ID NO: 683930 - protein, 9 aa, Homo Sapiens
IVHGEHQFG

SEQ ID NO: 683931 - protein, 9 aa, Homo Sapiens
LADAKRYIE

SEQ ID NO: 683932 - protein, 9 aa, Homo Sapiens
FGVLLDAGK

SEQ ID NO: 683933 - protein, 9 aa, Homo Sapiens
QLMAPLSPG

SEQ ID NO: 683934 - protein, 9 aa, Homo Sapiens
MESLHSQPH

SEQ ID NO: 683935 - protein, 9 aa, Homo Sapiens
WRQESVNSN

SEQ ID NO: 683936 - protein, 9 aa, Homo Sapiens
PSHSSQSAR

SEQ ID NO: 683937 - protein, 9 aa, Homo Sapiens
TSGEPRHTV

SEQ ID NO: 683938 - protein, 9 aa, Homo Sapiens
VEVISLWIL

SEQ ID NO: 683939 - protein, 9 aa, Homo Sapiens
LRPYSNVSS

SEQ ID NO: 683940 - protein, 9 aa, Homo Sapiens
TVELGQLPA

SEQ ID NO: 683941 - protein, 9 aa, Homo Sapiens
KAYCLGDLP

SEQ ID NO: 683942 - protein, 9 aa, Homo Sapiens
GNRIVSGYD

SEQ ID NO: 683943 - protein, 9 aa, Homo Sapiens
SWQPSVLVN

SEQ ID NO: 683944 - protein, 9 aa, Homo Sapiens
ETVNGWISL

SEQ ID NO: 683945 - protein, 9 aa, Homo Sapiens
AQTVTSGHS

SEQ ID NO: 683946 - protein, 9 aa, Homo Sapiens
NFETSRCDT

SEQ ID NO: 683947 - protein, 9 aa, Homo Sapiens
LVPGLVGSY

SEQ ID NO: 683948 - protein, 9 aa, Homo Sapiens
TKIVCKSPP

SEQ ID NO: 683949 - protein, 9 aa, Homo Sapiens
MRLQQEEMV

SEQ ID NO: 683950 - protein, 9 aa, Homo Sapiens
EGPKLPTEP

SEQ ID NO: 683951 - protein, 9 aa, Homo Sapiens
LIVGLGTRS

SEQ ID NO: 683952 - protein, 9 aa, Homo Sapiens
ESNDILQHQ

SEQ ID NO: 683953 - protein, 9 aa, Homo Sapiens
ESTMVHPAT

SEQ ID NO: 683954 - protein, 9 aa, Homo Sapiens
QKMLLLISL

SEQ ID NO: 683955 - protein, 9 aa, Homo Sapiens
EPGRKYEMH

SEQ ID NO: 683956 - protein, 9 aa, Homo Sapiens
HPAVLELAV

SEQ ID NO: 683957 - protein, 9 aa, Homo Sapiens
QTKDNQDIY

SEQ ID NO: 683958 - protein, 9 aa, Homo Sapiens
AVEVISLWI

SEQ ID NO: 683959 - protein, 9 aa, Homo Sapiens
DKTTKIVCK

SEQ ID NO: 683960 - protein, 9 aa, Homo Sapiens
LNPENKRFG

SEQ ID NO: 683961 - protein, 9 aa, Homo Sapiens
ISVHCSAAV

SEQ ID NO: 683962 - protein, 9 aa, Homo Sapiens
PPNLTVPKE

SEQ ID NO: 683963 - protein, 9 aa, Homo Sapiens
GKPNDGIPT

SEQ ID NO: 683964 - protein, 9 aa, Homo Sapiens
PGHRARSWR

SEQ ID NO: 683965 - protein, 9 aa, Homo Sapiens
GVELVNTSC

SEQ ID NO: 683966 - protein, 9 aa, Homo Sapiens
SIYTSVKLN

SEQ ID NO: 683967 - protein, 9 aa, Homo Sapiens
HRSMLRGIT

SEQ ID NO: 683968 - protein, 9 aa, Homo Sapiens
TDLAVNGIS

SEQ ID NO: 683969 - protein, 9 aa, Homo Sapiens
KQNSSDEDD

SEQ ID NO: 683970 - protein, 9 aa, Homo Sapiens
TLSPGTAEG

SEQ ID NO: 683971 - protein, 9 aa, Homo Sapiens
REVARSRDQ

SEQ ID NO: 683972 - protein, 9 aa, Homo Sapiens
IVGTLSVAS

SEQ ID NO: 683973 - protein, 9 aa, Homo Sapiens
ISRRSQLLR

SEQ ID NO: 683974 - protein, 9 aa, Homo Sapiens
VSPEVFDFS

SEQ ID NO: 683975 - protein, 9 aa, Homo Sapiens
PIRNIMFQS

SEQ ID NO: 683976 - protein, 9 aa, Homo Sapiens
VSRGGRQCA

SEQ ID NO: 683977 - protein, 9 aa, Homo Sapiens
AFNDFDLES

SEQ ID NO: 683978 - protein, 9 aa, Homo Sapiens
MNCEAFTVI

SEQ ID NO: 683979 - protein, 9 aa, Homo Sapiens
PPQASSSDT

SEQ ID NO: 683980 - protein, 9 aa, Homo Sapiens
TDDAATKIV

SEQ ID NO: 683981 - protein, 9 aa, Homo Sapiens
RQIFQELFK

SEQ ID NO: 683982 - protein, 9 aa, Homo Sapiens
HPGEPGYAK

SEQ ID NO: 683983 - protein, 9 aa, Homo Sapiens
PNDLSFSRS

SEQ ID NO: 683984 - protein, 9 aa, Homo Sapiens
MSMLTNPAT

SEQ ID NO: 683985 - protein, 9 aa, Homo Sapiens
RKRDEWLAP

SEQ ID NO: 683986 - protein, 9 aa, Homo Sapiens
HDLEVDVKC

SEQ ID NO: 683987 - protein, 9 aa, Homo Sapiens
EDRNACLGE

SEQ ID NO: 683988 - protein, 9 aa, Homo Sapiens
INHYEEQQA

SEQ ID NO: 683989 - protein, 9 aa, Homo Sapiens
MPWALSVLL

SEQ ID NO: 683990 - protein, 9 aa, Homo Sapiens
TMRRKMTLV

SEQ ID NO: 683991 - protein, 9 aa, Homo Sapiens
LTITNYFNW

SEQ ID NO: 683992 - protein, 9 aa, Homo Sapiens
EKAYCLGDL

SEQ ID NO: 683993 - protein, 9 aa, Homo Sapiens
KLGLPSDGI

SEQ ID NO: 683994 - protein, 9 aa, Homo Sapiens
LQVCPARVV

SEQ ID NO: 683995 - protein, 9 aa, Homo Sapiens
FLQDSGLYA

SEQ ID NO: 683996 - protein, 9 aa, Homo Sapiens
RPYSNVSSL

SEQ ID NO: 683997 - protein, 9 aa, Homo Sapiens
SHLPGHSPL

SEQ ID NO: 683998 - protein, 9 aa, Homo Sapiens
CEAFTVILI

SEQ ID NO: 683999 - protein, 9 aa, Homo Sapiens
PPAPPFPLM

SEQ ID NO: 684000 - protein, 9 aa, Homo Sapiens
NDVNGLYTY

SEQ ID NO: 684001 - protein, 9 aa, Homo Sapiens
RVLFSQTSA

SEQ ID NO: 684002 - protein, 9 aa, Homo Sapiens
VLLSRRVCW

SEQ ID NO: 684003 - protein, 9 aa, Homo Sapiens
KDSDDSSSE

SEQ ID NO: 684004 - protein, 9 aa, Homo Sapiens
LRHDAGRPL

SEQ ID NO: 684005 - protein, 9 aa, Homo Sapiens
RLEKLSCEP

SEQ ID NO: 684006 - protein, 9 aa, Homo Sapiens
LRLGWSIFE

SEQ ID NO: 684007 - protein, 9 aa, Homo Sapiens
FRTQYISRR

SEQ ID NO: 684008 - protein, 9 aa, Homo Sapiens
ISYYFCETQ

SEQ ID NO: 684009 - protein, 9 aa, Homo Sapiens
TCMADNIVA

SEQ ID NO: 684010 - protein, 9 aa, Homo Sapiens
PKLPTEPPC

SEQ ID NO: 684011 - protein, 9 aa, Homo Sapiens
APSKSHKKR

SEQ ID NO: 684012 - protein, 9 aa, Homo Sapiens
LEPGRKYEM

SEQ ID NO: 684013 - protein, 9 aa, Homo Sapiens
RRLIHQCDF

SEQ ID NO: 684014 - protein, 9 aa, Homo Sapiens
TPVTAVPSS

SEQ ID NO: 684015 - protein, 9 aa, Homo Sapiens
PSPASQLFM

SEQ ID NO: 684016 - protein, 9 aa, Homo Sapiens
VNLQGKGDH

SEQ ID NO: 684017 - protein, 9 aa, Homo Sapiens
TQSAFTLSA

SEQ ID NO: 684018 - protein, 9 aa, Homo Sapiens
INGTVNSKT

SEQ ID NO: 684019 - protein, 9 aa, Homo Sapiens
MYLLKSPLH

SEQ ID NO: 684020 - protein, 9 aa, Homo Sapiens
ITSSRIRET

SEQ ID NO: 684021 - protein, 9 aa, Homo Sapiens
RLLRITENG

SEQ ID NO: 684022 - protein, 9 aa, Homo Sapiens
LGKPDSILV

SEQ ID NO: 684023 - protein, 9 aa, Homo Sapiens
KLTANDLPP

SEQ ID NO: 684024 - protein, 9 aa, Homo Sapiens
VITPPSNTS

SEQ ID NO: 684025 - protein, 9 aa, Homo Sapiens
GFAYHSELK

SEQ ID NO: 684026 - protein, 9 aa, Homo Sapiens
FVAMCRPLH

SEQ ID NO: 684027 - protein, 9 aa, Homo Sapiens
TSHVEGSGV

SEQ ID NO: 684028 - protein, 9 aa, Homo Sapiens
IVCKSPPPE

SEQ ID NO: 684029 - protein, 9 aa, Homo Sapiens
TLAGDPAEL

SEQ ID NO: 684030 - protein, 9 aa, Homo Sapiens
HSQMIQDQQ

SEQ ID NO: 684031 - protein, 9 aa, Homo Sapiens
FTVILISKD

SEQ ID NO: 684032 - protein, 9 aa, Homo Sapiens
WALSVLLMG

SEQ ID NO: 684033 - protein, 9 aa, Homo Sapiens
TQLADAKRY

SEQ ID NO: 684034 - protein, 9 aa, Homo Sapiens
LSILVFVSS

SEQ ID NO: 684035 - protein, 9 aa, Homo Sapiens
AITDAAIMA

SEQ ID NO: 684036 - protein, 9 aa, Homo Sapiens
EDLALFQKL

SEQ ID NO: 684037 - protein, 9 aa, Homo Sapiens
RHTVLTAAG

SEQ ID NO: 684038 - protein, 9 aa, Homo Sapiens
KSVITSVHV

SEQ ID NO: 684039 - protein, 9 aa, Homo Sapiens
PRHTVLTAA

SEQ ID NO: 684040 - protein, 9 aa, Homo Sapiens
RWRQESVNS

SEQ ID NO: 684041 - protein, 9 aa, Homo Sapiens
GPGKSPTLG

SEQ ID NO: 684042 - protein, 9 aa, Homo Sapiens
RFGITRPAN

SEQ ID NO: 684043 - protein, 9 aa, Homo Sapiens
PMSMLTNPA

SEQ ID NO: 684044 - protein, 9 aa, Homo Sapiens
KKQNSSDED

SEQ ID NO: 684045 - protein, 9 aa, Homo Sapiens
TRSLPSASW

SEQ ID NO: 684046 - protein, 9 aa, Homo Sapiens
LQELPAGSG

SEQ ID NO: 684047 - protein, 9 aa, Homo Sapiens
RDTSDTLLC

SEQ ID NO: 684048 - protein, 9 aa, Homo Sapiens
MCFFVLLGG

SEQ ID NO: 684049 - protein, 9 aa, Homo Sapiens
LPMSMLTNP

SEQ ID NO: 684050 - protein, 9 aa, Homo Sapiens
IEDLVLQLI

SEQ ID NO: 684051 - protein, 9 aa, Homo Sapiens
LVYRHVPGT

SEQ ID NO: 684052 - protein, 9 aa, Homo Sapiens
LATGLADSG

SEQ ID NO: 684053 - protein, 9 aa, Homo Sapiens
QMLITEPRM

SEQ ID NO: 684054 - protein, 9 aa, Homo Sapiens
QKSISSMEG

SEQ ID NO: 684055 - protein, 9 aa, Homo Sapiens
SRRNEITSW

SEQ ID NO: 684056 - protein, 9 aa, Homo Sapiens
QKTKYASSA

SEQ ID NO: 684057 - protein, 9 aa, Homo Sapiens
SNGSIYTSV

SEQ ID NO: 684058 - protein, 9 aa, Homo Sapiens
QPSVLVNGT

SEQ ID NO: 684059 - protein, 9 aa, Homo Sapiens
HQRNKVKFL

SEQ ID NO: 684060 - protein, 9 aa, Homo Sapiens
DMLCNSESN

SEQ ID NO: 684061 - protein, 9 aa, Homo Sapiens
VHCSAAVGR

SEQ ID NO: 684062 - protein, 9 aa, Homo Sapiens
HFYDRTLRV

SEQ ID NO: 684063 - protein, 9 aa, Homo Sapiens
IAAKEAMKS

SEQ ID NO: 684064 - protein, 9 aa, Homo Sapiens
GKPDSILVP

SEQ ID NO: 684065 - protein, 9 aa, Homo Sapiens
HPGHRARSW

SEQ ID NO: 684066 - protein, 9 aa, Homo Sapiens
TSVHVSAED

SEQ ID NO: 684067 - protein, 9 aa, Homo Sapiens
STGDTSPLP

SEQ ID NO: 684068 - protein, 9 aa, Homo Sapiens
FWIDQKKGL

SEQ ID NO: 684069 - protein, 9 aa, Homo Sapiens
DYILRLGWS

SEQ ID NO: 684070 - protein, 9 aa, Homo Sapiens
AAIMAEELK

SEQ ID NO: 684071 - protein, 9 aa, Homo Sapiens
RIFSHCDLF

SEQ ID NO: 684072 - protein, 9 aa, Homo Sapiens
VTIMVSQSL

SEQ ID NO: 684073 - protein, 9 aa, Homo Sapiens
VLVNGTKVE

SEQ ID NO: 684074 - protein, 9 aa, Homo Sapiens
IPLNNAHDA

SEQ ID NO: 684075 - protein, 9 aa, Homo Sapiens
HTELPPPLE

SEQ ID NO: 684076 - protein, 9 aa, Homo Sapiens
FLRAWNPPP

SEQ ID NO: 684077 - protein, 9 aa, Homo Sapiens
QDEVEPRGS

SEQ ID NO: 684078 - protein, 9 aa, Homo Sapiens
VHQRVHIGQ

SEQ ID NO: 684079 - protein, 9 aa, Homo Sapiens
GPLVCEASP

SEQ ID NO: 684080 - protein, 9 aa, Homo Sapiens
QEQQEEEEA

SEQ ID NO: 684081 - protein, 9 aa, Homo Sapiens
NSKTRQANN

SEQ ID NO: 684082 - protein, 9 aa, Homo Sapiens
VGEEDCTEF

SEQ ID NO: 684083 - protein, 9 aa, Homo Sapiens
QLFMPIGPP

SEQ ID NO: 684084 - protein, 9 aa, Homo Sapiens
SMLLGNTLV

SEQ ID NO: 684085 - protein, 9 aa, Homo Sapiens
RQSQESTMV

SEQ ID NO: 684086 - protein, 9 aa, Homo Sapiens
HLQVCPARV

SEQ ID NO: 684087 - protein, 9 aa, Homo Sapiens
LYEEALGSR

SEQ ID NO: 684088 - protein, 9 aa, Homo Sapiens
GVVAFNTLM

SEQ ID NO: 684089 - protein, 9 aa, Homo Sapiens
PRRAQSLKS

SEQ ID NO: 684090 - protein, 9 aa, Homo Sapiens
LGPNLGDQK

SEQ ID NO: 684091 - protein, 9 aa, Homo Sapiens
ELANLLINH

SEQ ID NO: 684092 - protein, 9 aa, Homo Sapiens
HTFLRIADT

SEQ ID NO: 684093 - protein, 9 aa, Homo Sapiens
LEVDVKCIN

SEQ ID NO: 684094 - protein, 9 aa, Homo Sapiens
DVKNKTDKK

SEQ ID NO: 684095 - protein, 9 aa, Homo Sapiens
VNSKTRQAN

SEQ ID NO: 684096 - protein, 9 aa, Homo Sapiens
FVLLGGLDS

SEQ ID NO: 684097 - protein, 9 aa, Homo Sapiens
SCLSRPGWA

SEQ ID NO: 684098 - protein, 9 aa, Homo Sapiens
HGDVRTIEL

SEQ ID NO: 684099 - protein, 9 aa, Homo Sapiens
LQREAPVVS

SEQ ID NO: 684100 - protein, 9 aa, Homo Sapiens
ALSVLLMGF

SEQ ID NO: 684101 - protein, 9 aa, Homo Sapiens
PLTPRTSQE

SEQ ID NO: 684102 - protein, 9 aa, Homo Sapiens
KMRLQQEEM

SEQ ID NO: 684103 - protein, 9 aa, Homo Sapiens
DLKRRLIHQ

SEQ ID NO: 684104 - protein, 9 aa, Homo Sapiens
FPLERRQIP

SEQ ID NO: 684105 - protein, 9 aa, Homo Sapiens
GKTLMPRMT

SEQ ID NO: 684106 - protein, 9 aa, Homo Sapiens
KLPTEPPCL

SEQ ID NO: 684107 - protein, 9 aa, Homo Sapiens
LTGVIVVML

SEQ ID NO: 684108 - protein, 9 aa, Homo Sapiens
IIRKAASDV

SEQ ID NO: 684109 - protein, 9 aa, Homo Sapiens
ITVGVVIFI

SEQ ID NO: 684110 - protein, 9 aa, Homo Sapiens
QPIRNIMFQ

SEQ ID NO: 684111 - protein, 9 aa, Homo Sapiens
EREQERERE

SEQ ID NO: 684112 - protein, 9 aa, Homo Sapiens
FDVKIYLQV

SEQ ID NO: 684113 - protein, 9 aa, Homo Sapiens
LYDSVHSSA

SEQ ID NO: 684114 - protein, 9 aa, Homo Sapiens
PAVLELAVV

SEQ ID NO: 684115 - protein, 9 aa, Homo Sapiens
EGQDASGLL

SEQ ID NO: 684116 - protein, 9 aa, Homo Sapiens
DGEEEFPLE

SEQ ID NO: 684117 - protein, 9 aa, Homo Sapiens
RLMEDRNAC

SEQ ID NO: 684118 - protein, 9 aa, Homo Sapiens
STISRRNEI

SEQ ID NO: 684119 - protein, 9 aa, Homo Sapiens
KPNDGIPTR

SEQ ID NO: 684120 - protein, 9 aa, Homo Sapiens
YHSELKAHE

SEQ ID NO: 684121 - protein, 9 aa, Homo Sapiens
GNYTCMADN

SEQ ID NO: 684122 - protein, 9 aa, Homo Sapiens
TSMKSGSRC

SEQ ID NO: 684123 - protein, 9 aa, Homo Sapiens
NLQGKGDHD

SEQ ID NO: 684124 - protein, 9 aa, Homo Sapiens
VIHYKRRSK

SEQ ID NO: 684125 - protein, 9 aa, Homo Sapiens
ILSYSGQTP

SEQ ID NO: 684126 - protein, 9 aa, Homo Sapiens
FLFGALVEL

SEQ ID NO: 684127 - protein, 9 aa, Homo Sapiens
DTLLCQLSQ

SEQ ID NO: 684128 - protein, 9 aa, Homo Sapiens
ETSRCDTLQ

SEQ ID NO: 684129 - protein, 9 aa, Homo Sapiens
GICLLEGVN

SEQ ID NO: 684130 - protein, 9 aa, Homo Sapiens
NDNSPVVIT

SEQ ID NO: 684131 - protein, 9 aa, Homo Sapiens
AVTVASASL

SEQ ID NO: 684132 - protein, 9 aa, Homo Sapiens
GAEATQSLS

SEQ ID NO: 684133 - protein, 9 aa, Homo Sapiens
FSSLYEEAL

SEQ ID NO: 684134 - protein, 9 aa, Homo Sapiens
EDTSYPLGS

SEQ ID NO: 684135 - protein, 9 aa, Homo Sapiens
RTQWWGKTL

SEQ ID NO: 684136 - protein, 9 aa, Homo Sapiens
PCSRSGSES

SEQ ID NO: 684137 - protein, 9 aa, Homo Sapiens
QVPRGAESD

SEQ ID NO: 684138 - protein, 9 aa, Homo Sapiens
RKKQNSSDE

SEQ ID NO: 684139 - protein, 9 aa, Homo Sapiens
PASQLFMPI

SEQ ID NO: 684140 - protein, 9 aa, Homo Sapiens
LLGVVAFNT

SEQ ID NO: 684141 - protein, 9 aa, Homo Sapiens
SPSIATIKS

SEQ ID NO: 684142 - protein, 9 aa, Homo Sapiens
AFAYCAADI

SEQ ID NO: 684143 - protein, 9 aa, Homo Sapiens
LSRQTKDNQ

SEQ ID NO: 684144 - protein, 9 aa, Homo Sapiens
SLATGLADS

SEQ ID NO: 684145 - protein, 9 aa, Homo Sapiens
NSPVVITPP

SEQ ID NO: 684146 - protein, 9 aa, Homo Sapiens
PRTSQEDLY

SEQ ID NO: 684147 - protein, 9 aa, Homo Sapiens
SLVGWQTLG

SEQ ID NO: 684148 - protein, 9 aa, Homo Sapiens
NPPGASITQ

SEQ ID NO: 684149 - protein, 9 aa, Homo Sapiens
QNPTLPLTS

SEQ ID NO: 684150 - protein, 9 aa, Homo Sapiens
DNSPVVITP

SEQ ID NO: 684151 - protein, 9 aa, Homo Sapiens
DGKMYSVMF

SEQ ID NO: 684152 - protein, 9 aa, Homo Sapiens
GKRKKQNSS

SEQ ID NO: 684153 - protein, 9 aa, Homo Sapiens
SLEKKGHVS

SEQ ID NO: 684154 - protein, 9 aa, Homo Sapiens
LQPSSIHSM

SEQ ID NO: 684155 - protein, 9 aa, Homo Sapiens
DSFSGGLQR

SEQ ID NO: 684156 - protein, 9 aa, Homo Sapiens
AEDFQPLFG

SEQ ID NO: 684157 - protein, 9 aa, Homo Sapiens
KYHMEHGII

SEQ ID NO: 684158 - protein, 9 aa, Homo Sapiens
GLPSDGILS

SEQ ID NO: 684159 - protein, 9 aa, Homo Sapiens
EPSGSGQAG

SEQ ID NO: 684160 - protein, 9 aa, Homo Sapiens
HRARSWRFL

SEQ ID NO: 684161 - protein, 9 aa, Homo Sapiens
QDRNNVLNR

SEQ ID NO: 684162 - protein, 9 aa, Homo Sapiens
CILIVGLGT

SEQ ID NO: 684163 - protein, 9 aa, Homo Sapiens
LRAWNPPPV

SEQ ID NO: 684164 - protein, 9 aa, Homo Sapiens
WWGKTLMPR

SEQ ID NO: 684165 - protein, 9 aa, Homo Sapiens
KHSKIWFES

SEQ ID NO: 684166 - protein, 9 aa, Homo Sapiens
PQFRTQYIS

SEQ ID NO: 684167 - protein, 9 aa, Homo Sapiens
SQLFMPIGP

SEQ ID NO: 684168 - protein, 9 aa, Homo Sapiens
LPGHSPLPG

SEQ ID NO: 684169 - protein, 9 aa, Homo Sapiens
GLVSLLKHY

SEQ ID NO: 684170 - protein, 9 aa, Homo Sapiens
FGALVELLD

SEQ ID NO: 684171 - protein, 9 aa, Homo Sapiens
GGPRRPSVP

SEQ ID NO: 684172 - protein, 9 aa, Homo Sapiens
YVGCFVQCY

SEQ ID NO: 684173 - protein, 9 aa, Homo Sapiens
LATTDLAVN

SEQ ID NO: 684174 - protein, 9 aa, Homo Sapiens
NVLNVLSRF

SEQ ID NO: 684175 - protein, 9 aa, Homo Sapiens
RSESDVLLD

SEQ ID NO: 684176 - protein, 9 aa, Homo Sapiens
SGGLQREAP

SEQ ID NO: 684177 - protein, 9 aa, Homo Sapiens
DRHSQMIQD

SEQ ID NO: 684178 - protein, 9 aa, Homo Sapiens
FQKLTQKWR

SEQ ID NO: 684179 - protein, 9 aa, Homo Sapiens
NKQQKSISS

SEQ ID NO: 684180 - protein, 9 aa, Homo Sapiens
WIRKMEIPR

SEQ ID NO: 684181 - protein, 9 aa, Homo Sapiens
EKYLVYRHV

SEQ ID NO: 684182 - protein, 9 aa, Homo Sapiens
KSHKKRSLE

SEQ ID NO: 684183 - protein, 9 aa, Homo Sapiens
WIDQKKGLD

SEQ ID NO: 684184 - protein, 9 aa, Homo Sapiens
KPHECEECG

SEQ ID NO: 684185 - protein, 9 aa, Homo Sapiens
YSSRRGARR

SEQ ID NO: 684186 - protein, 9 aa, Homo Sapiens
EYFRQIFQE

SEQ ID NO: 684187 - protein, 9 aa, Homo Sapiens
SASSLKGSL

SEQ ID NO: 684188 - protein, 9 aa, Homo Sapiens
NNQKHCHCS

SEQ ID NO: 684189 - protein, 9 aa, Homo Sapiens
DEVEPRGSV

SEQ ID NO: 684190 - protein, 9 aa, Homo Sapiens
KEKSPLVTR

SEQ ID NO: 684191 - protein, 9 aa, Homo Sapiens
EQERERERE

SEQ ID NO: 684192 - protein, 9 aa, Homo Sapiens
GHSPLPGRS

SEQ ID NO: 684193 - protein, 9 aa, Homo Sapiens
ASLVSINRD

SEQ ID NO: 684194 - protein, 9 aa, Homo Sapiens
PQVTTPERG

SEQ ID NO: 684195 - protein, 9 aa, Homo Sapiens
GYYVIQTYL

SEQ ID NO: 684196 - protein, 9 aa, Homo Sapiens
KQNESISRA

SEQ ID NO: 684197 - protein, 9 aa, Homo Sapiens
AIMAEELKK

SEQ ID NO: 684198 - protein, 9 aa, Homo Sapiens
MLGAGGQPP

SEQ ID NO: 684199 - protein, 9 aa, Homo Sapiens
TLFDKFYKY

SEQ ID NO: 684200 - protein, 9 aa, Homo Sapiens
KTKEDGPAN

SEQ ID NO: 684201 - protein, 9 aa, Homo Sapiens
NVKERECPL

SEQ ID NO: 684202 - protein, 9 aa, Homo Sapiens
VGAGGGHPV

SEQ ID NO: 684203 - protein, 9 aa, Homo Sapiens
YFNWVVRNL

SEQ ID NO: 684204 - protein, 9 aa, Homo Sapiens
CQLKFLEIL

SEQ ID NO: 684205 - protein, 9 aa, Homo Sapiens
VHGEHQFGW

SEQ ID NO: 684206 - protein, 9 aa, Homo Sapiens
RRRLLWCYH

SEQ ID NO: 684207 - protein, 9 aa, Homo Sapiens
LRNHQTPQY

SEQ ID NO: 684208 - protein, 9 aa, Homo Sapiens
FLATTDLAV

SEQ ID NO: 684209 - protein, 9 aa, Homo Sapiens
DDSWQPSVL

SEQ ID NO: 684210 - protein, 9 aa, Homo Sapiens
HLPGHSPLP

SEQ ID NO: 684211 - protein, 9 aa, Homo Sapiens
QSLKSPSIA

SEQ ID NO: 684212 - protein, 9 aa, Homo Sapiens
SLYEEALGS

SEQ ID NO: 684213 - protein, 9 aa, Homo Sapiens
GTVHTVPLR

SEQ ID NO: 684214 - protein, 9 aa, Homo Sapiens
YHTFLRIAD

SEQ ID NO: 684215 - protein, 9 aa, Homo Sapiens
RLGWSIFEL

SEQ ID NO: 684216 - protein, 9 aa, Homo Sapiens
SQESTMVHP

SEQ ID NO: 684217 - protein, 9 aa, Homo Sapiens
RFVAMCRPL

SEQ ID NO: 684218 - protein, 9 aa, Homo Sapiens
MEDRNACLG

SEQ ID NO: 684219 - protein, 9 aa, Homo Sapiens
RVREAKTKE

SEQ ID NO: 684220 - protein, 9 aa, Homo Sapiens
NPENKRFGI

SEQ ID NO: 684221 - protein, 9 aa, Homo Sapiens
KWITSSRIR

SEQ ID NO: 684222 - protein, 9 aa, Homo Sapiens
LQRLTWVCR

SEQ ID NO: 684223 - protein, 9 aa, Homo Sapiens
ILTFHFQAP

SEQ ID NO: 684224 - protein, 9 aa, Homo Sapiens
QRSSSLLHH

SEQ ID NO: 684225 - protein, 9 aa, Homo Sapiens
PPSPPPPVP

SEQ ID NO: 684226 - protein, 9 aa, Homo Sapiens
GEHQFGWSM

SEQ ID NO: 684227 - protein, 9 aa, Homo Sapiens
SVSGGPASS

SEQ ID NO: 684228 - protein, 9 aa, Homo Sapiens
AVAGTITVG

SEQ ID NO: 684229 - protein, 9 aa, Homo Sapiens
PVVSRGGRQ

SEQ ID NO: 684230 - protein, 9 aa, Homo Sapiens
SRPGWAALQ

SEQ ID NO: 684231 - protein, 9 aa, Homo Sapiens
GHREEDLQG

SEQ ID NO: 684232 - protein, 9 aa, Homo Sapiens
THLKAVKLF

SEQ ID NO: 684233 - protein, 9 aa, Homo Sapiens
YSRYDRTED

SEQ ID NO: 684234 - protein, 9 aa, Homo Sapiens
RGEPAGEES

SEQ ID NO: 684235 - protein, 9 aa, Homo Sapiens
RPPYSYSAV

SEQ ID NO: 684236 - protein, 9 aa, Homo Sapiens
GKSPTLGST

SEQ ID NO: 684237 - protein, 9 aa, Homo Sapiens
PLPVTGASS

SEQ ID NO: 684238 - protein, 9 aa, Homo Sapiens
QVAFAYCAA

SEQ ID NO: 684239 - protein, 9 aa, Homo Sapiens
DSTISRRNE

SEQ ID NO: 684240 - protein, 9 aa, Homo Sapiens
PQASSSDTT

SEQ ID NO: 684241 - protein, 9 aa, Homo Sapiens
QFRTQYISR

SEQ ID NO: 684242 - protein, 9 aa, Homo Sapiens
SLLHHQSSH

SEQ ID NO: 684243 - protein, 9 aa, Homo Sapiens
DQGCSLPAT

SEQ ID NO: 684244 - protein, 9 aa, Homo Sapiens
LILSMLLGN

SEQ ID NO: 684245 - protein, 9 aa, Homo Sapiens
PEVWPAGEQ

SEQ ID NO: 684246 - protein, 9 aa, Homo Sapiens
VGSYLCSPL

SEQ ID NO: 684247 - protein, 9 aa, Homo Sapiens
SRSESDVLL

SEQ ID NO: 684248 - protein, 9 aa, Homo Sapiens
AISTTSVYS

SEQ ID NO: 684249 - protein, 9 aa, Homo Sapiens
VQNIGNVLV

SEQ ID NO: 684250 - protein, 9 aa, Homo Sapiens
SLEQELQKH

SEQ ID NO: 684251 - protein, 9 aa, Homo Sapiens
LIVGTLSVA

SEQ ID NO: 684252 - protein, 9 aa, Homo Sapiens
ADMLCNSES

SEQ ID NO: 684253 - protein, 9 aa, Homo Sapiens
VKFRVLRHD

SEQ ID NO: 684254 - protein, 9 aa, Homo Sapiens
KASPTQDGR

SEQ ID NO: 684255 - protein, 9 aa, Homo Sapiens
SWSRCWRTR

SEQ ID NO: 684256 - protein, 9 aa, Homo Sapiens
LSLATGLAD

SEQ ID NO: 684257 - protein, 9 aa, Homo Sapiens
LRVRTEGKE

SEQ ID NO: 684258 - protein, 9 aa, Homo Sapiens
KRKIGYYVI

SEQ ID NO: 684259 - protein, 9 aa, Homo Sapiens
GVGAQLMAP

SEQ ID NO: 684260 - protein, 9 aa, Homo Sapiens
DYEYSASND

SEQ ID NO: 684261 - protein, 9 aa, Homo Sapiens
RNIMFQSAV

SEQ ID NO: 684262 - protein, 9 aa, Homo Sapiens
WDDSWQPSV

SEQ ID NO: 684263 - protein, 9 aa, Homo Sapiens
AQDRNNVLN

SEQ ID NO: 684264 - protein, 9 aa, Homo Sapiens
FENYVADIK

SEQ ID NO: 684265 - protein, 9 aa, Homo Sapiens
TEHQRVHTR

SEQ ID NO: 684266 - protein, 9 aa, Homo Sapiens
KVVGSHIRG

SEQ ID NO: 684267 - protein, 9 aa, Homo Sapiens
FPCLVLFYP

SEQ ID NO: 684268 - protein, 9 aa, Homo Sapiens
ITDEARYSL

SEQ ID NO: 684269 - protein, 9 aa, Homo Sapiens
CLGECVNLS

SEQ ID NO: 684270 - protein, 9 aa, Homo Sapiens
PPALAALGV

SEQ ID NO: 684271 - protein, 9 aa, Homo Sapiens
QDRMNSGAG

SEQ ID NO: 684272 - protein, 9 aa, Homo Sapiens
SITQISASD

SEQ ID NO: 684273 - protein, 9 aa, Homo Sapiens
AGTITVGVV

SEQ ID NO: 684274 - protein, 9 aa, Homo Sapiens
LSVASSSAS

SEQ ID NO: 684275 - protein, 9 aa, Homo Sapiens
THQLRTQWW

SEQ ID NO: 684276 - protein, 9 aa, Homo Sapiens
RGILTLKYH

SEQ ID NO: 684277 - protein, 9 aa, Homo Sapiens
EREREQERE

SEQ ID NO: 684278 - protein, 9 aa, Homo Sapiens
IVGLGTRSL

SEQ ID NO: 684279 - protein, 9 aa, Homo Sapiens
ITVTEERRR

SEQ ID NO: 684280 - protein, 9 aa, Homo Sapiens
CGHPINPLV

SEQ ID NO: 684281 - protein, 9 aa, Homo Sapiens
DQKRKQGTK

SEQ ID NO: 684282 - protein, 9 aa, Homo Sapiens
LLSRRVCWM

SEQ ID NO: 684283 - protein, 9 aa, Homo Sapiens
MGAQTVTSG

SEQ ID NO: 684284 - protein, 9 aa, Homo Sapiens
LEKLSCEPK

SEQ ID NO: 684285 - protein, 9 aa, Homo Sapiens
NYTCMADNI

SEQ ID NO: 684286 - protein, 9 aa, Homo Sapiens
TFQRSSSLL

SEQ ID NO: 684287 - protein, 9 aa, Homo Sapiens
YDENMGLVS

SEQ ID NO: 684288 - protein, 9 aa, Homo Sapiens
IFQELFKAI

SEQ ID NO: 684289 - protein, 9 aa, Homo Sapiens
SIPLTPRTS

SEQ ID NO: 684290 - protein, 9 aa, Homo Sapiens
LFGVLLDAG

SEQ ID NO: 684291 - protein, 9 aa, Homo Sapiens
GDFWRMYLL

SEQ ID NO: 684292 - protein, 9 aa, Homo Sapiens
YALMGAQTV

SEQ ID NO: 684293 - protein, 9 aa, Homo Sapiens
WLKHRRSEP

SEQ ID NO: 684294 - protein, 9 aa, Homo Sapiens
ASPQLLLRS

SEQ ID NO: 684295 - protein, 9 aa, Homo Sapiens
FKDSDENEE

SEQ ID NO: 684296 - protein, 9 aa, Homo Sapiens
VRTKLGDYA

SEQ ID NO: 684297 - protein, 9 aa, Homo Sapiens
ESSRGLQSW

SEQ ID NO: 684298 - protein, 9 aa, Homo Sapiens
SMLRGITKM

SEQ ID NO: 684299 - protein, 9 aa, Homo Sapiens
VPPNLTVPK

SEQ ID NO: 684300 - protein, 9 aa, Homo Sapiens
GQQTLSAEE

SEQ ID NO: 684301 - protein, 9 aa, Homo Sapiens
TLRVFEVML

SEQ ID NO: 684302 - protein, 9 aa, Homo Sapiens
DIKVDGKQV

SEQ ID NO: 684303 - protein, 9 aa, Homo Sapiens
LALFQKLTQ

SEQ ID NO: 684304 - protein, 9 aa, Homo Sapiens
YSKVQLREL

SEQ ID NO: 684305 - protein, 9 aa, Homo Sapiens
LAPWKREAE

SEQ ID NO: 684306 - protein, 9 aa, Homo Sapiens
MGFAPGKVV

SEQ ID NO: 684307 - protein, 9 aa, Homo Sapiens
DFKGCTVSP

SEQ ID NO: 684308 - protein, 9 aa, Homo Sapiens
GEEGQDASG

SEQ ID NO: 684309 - protein, 9 aa, Homo Sapiens
RTLGKPDSI

SEQ ID NO: 684310 - protein, 9 aa, Homo Sapiens
WSMLPHRSM

SEQ ID NO: 684311 - protein, 9 aa, Homo Sapiens
VHDFDVKIY

SEQ ID NO: 684312 - protein, 9 aa, Homo Sapiens
VTNPLIKGP

SEQ ID NO: 684313 - protein, 9 aa, Homo Sapiens
RIPLNNAHD

SEQ ID NO: 684314 - protein, 9 aa, Homo Sapiens
LMSTLFDKF

SEQ ID NO: 684315 - protein, 9 aa, Homo Sapiens
AAFTTSSAF

SEQ ID NO: 684316 - protein, 9 aa, Homo Sapiens
CNSESNDIL

SEQ ID NO: 684317 - protein, 9 aa, Homo Sapiens
APESGPTLS

SEQ ID NO: 684318 - protein, 9 aa, Homo Sapiens
ATILDLSEV

SEQ ID NO: 684319 - protein, 9 aa, Homo Sapiens
QSSKLTAND

SEQ ID NO: 684320 - protein, 9 aa, Homo Sapiens
PGLGPQGPL

SEQ ID NO: 684321 - protein, 9 aa, Homo Sapiens
KKGLDELEF

SEQ ID NO: 684322 - protein, 9 aa, Homo Sapiens
FNWVVRNLA

SEQ ID NO: 684323 - protein, 9 aa, Homo Sapiens
VKVFAIQNP

SEQ ID NO: 684324 - protein, 9 aa, Homo Sapiens
MELMSTLFD

SEQ ID NO: 684325 - protein, 9 aa, Homo Sapiens
PLGICLLEG

SEQ ID NO: 684326 - protein, 9 aa, Homo Sapiens
PYSKVQLRE

SEQ ID NO: 684327 - protein, 9 aa, Homo Sapiens
SPPAPPFPL

SEQ ID NO: 684328 - protein, 9 aa, Homo Sapiens
ELMSTLFDK

SEQ ID NO: 684329 - protein, 9 aa, Homo Sapiens
PHECEECGK

SEQ ID NO: 684330 - protein, 9 aa, Homo Sapiens
SVYSQNAIQ

SEQ ID NO: 684331 - protein, 9 aa, Homo Sapiens
AIQKGAVEV

SEQ ID NO: 684332 - protein, 9 aa, Homo Sapiens
RSMLRGITK

SEQ ID NO: 684333 - protein, 9 aa, Homo Sapiens
RMYQSLEQE

SEQ ID NO: 684334 - protein, 9 aa, Homo Sapiens
YFPCLVLFY

SEQ ID NO: 684335 - protein, 9 aa, Homo Sapiens
TQSLSHEQP

SEQ ID NO: 684336 - protein, 9 aa, Homo Sapiens
RSASEPSFN

SEQ ID NO: 684337 - protein, 9 aa, Homo Sapiens
WLAPWKREA

SEQ ID NO: 684338 - protein, 9 aa, Homo Sapiens
PSSIHSMDT

SEQ ID NO: 684339 - protein, 9 aa, Homo Sapiens
LLGGLDSLL

SEQ ID NO: 684340 - protein, 9 aa, Homo Sapiens
KAMPWALSV

SEQ ID NO: 684341 - protein, 9 aa, Homo Sapiens
GILTLKYHM

SEQ ID NO: 684342 - protein, 9 aa, Homo Sapiens
VSLVGWQTL

SEQ ID NO: 684343 - protein, 9 aa, Homo Sapiens
AYDRFVAMC

SEQ ID NO: 684344 - protein, 9 aa, Homo Sapiens
ALAAFTTSS

SEQ ID NO: 684345 - protein, 9 aa, Homo Sapiens
AELLGERGT

SEQ ID NO: 684346 - protein, 9 aa, Homo Sapiens
DVSGASTYS

SEQ ID NO: 684347 - protein, 9 aa, Homo Sapiens
REQERERER

SEQ ID NO: 684348 - protein, 9 aa, Homo Sapiens
NTLNTMNGY

SEQ ID NO: 684349 - protein, 9 aa, Homo Sapiens
QVCPARVVC

SEQ ID NO: 684350 - protein, 9 aa, Homo Sapiens
LEILEKSGR

SEQ ID NO: 684351 - protein, 9 aa, Homo Sapiens
AWSGGVKLW

SEQ ID NO: 684352 - protein, 9 aa, Homo Sapiens
PIEDLVLQL

SEQ ID NO: 684353 - protein, 9 aa, Homo Sapiens
LAGDPAELL

SEQ ID NO: 684354 - protein, 9 aa, Homo Sapiens
QIEPGFYST

SEQ ID NO: 684355 - protein, 9 aa, Homo Sapiens
ILISKDRLC

SEQ ID NO: 684356 - protein, 9 aa, Homo Sapiens
NGLYTYTFE

SEQ ID NO: 684357 - protein, 9 aa, Homo Sapiens
NCITTSCIG

SEQ ID NO: 684358 - protein, 9 aa, Homo Sapiens
HVSAEDVDS

SEQ ID NO: 684359 - protein, 9 aa, Homo Sapiens
SQMIQDQQQ

SEQ ID NO: 684360 - protein, 9 aa, Homo Sapiens
YEMPYAGGV

SEQ ID NO: 684361 - protein, 9 aa, Homo Sapiens
KKAITDAAI

SEQ ID NO: 684362 - protein, 9 aa, Homo Sapiens
RHVPGTDPA

SEQ ID NO: 684363 - protein, 9 aa, Homo Sapiens
FWHKISYFP

SEQ ID NO: 684364 - protein, 9 aa, Homo Sapiens
HSLSETLEI

SEQ ID NO: 684365 - protein, 9 aa, Homo Sapiens
FGWSMLPHR

SEQ ID NO: 684366 - protein, 9 aa, Homo Sapiens
IPQLFWNAG

SEQ ID NO: 684367 - protein, 9 aa, Homo Sapiens
SRRTKWRSY

SEQ ID NO: 684368 - protein, 9 aa, Homo Sapiens
AVLELAVVS

SEQ ID NO: 684369 - protein, 9 aa, Homo Sapiens
TSVKLNREV

SEQ ID NO: 684370 - protein, 9 aa, Homo Sapiens
DDKVLKEKR

SEQ ID NO: 684371 - protein, 9 aa, Homo Sapiens
WRTRLCAPL

SEQ ID NO: 684372 - protein, 9 aa, Homo Sapiens
ITPPSNTSF

SEQ ID NO: 684373 - protein, 9 aa, Homo Sapiens
TPGLVPGLV

SEQ ID NO: 684374 - protein, 9 aa, Homo Sapiens
ELVTNPLIK

SEQ ID NO: 684375 - protein, 9 aa, Homo Sapiens
IPLTDNFYN

SEQ ID NO: 684376 - protein, 9 aa, Homo Sapiens
DSIWFRPTF

SEQ ID NO: 684377 - protein, 9 aa, Homo Sapiens
VGTLSVASS

SEQ ID NO: 684378 - protein, 9 aa, Homo Sapiens
FCETQLAFF

SEQ ID NO: 684379 - protein, 9 aa, Homo Sapiens
TGLADSGTD

SEQ ID NO: 684380 - protein, 9 aa, Homo Sapiens
HLECPVLGP

SEQ ID NO: 684381 - protein, 9 aa, Homo Sapiens
SAVIAMAIH

SEQ ID NO: 684382 - protein, 9 aa, Homo Sapiens
TPDYILRLG

SEQ ID NO: 684383 - protein, 9 aa, Homo Sapiens
PGIPGHPGE

SEQ ID NO: 684384 - protein, 9 aa, Homo Sapiens
DEWLAPWKR

SEQ ID NO: 684385 - protein, 9 aa, Homo Sapiens
SRHLRVRTE

SEQ ID NO: 684386 - protein, 9 aa, Homo Sapiens
SSKLTANDL

SEQ ID NO: 684387 - protein, 9 aa, Homo Sapiens
TDAAIMAEE

SEQ ID NO: 684388 - protein, 9 aa, Homo Sapiens
DASGLLREW

SEQ ID NO: 684389 - protein, 9 aa, Homo Sapiens
IHLPSEDIP

SEQ ID NO: 684390 - protein, 9 aa, Homo Sapiens
DCTGLPMSM

SEQ ID NO: 684391 - protein, 9 aa, Homo Sapiens
EKKGHVSLV

SEQ ID NO: 684392 - protein, 9 aa, Homo Sapiens
HSSQSARFY

SEQ ID NO: 684393 - protein, 9 aa, Homo Sapiens
TEDSEDEDE

SEQ ID NO: 684394 - protein, 9 aa, Homo Sapiens
SGEPRHTVL

SEQ ID NO: 684395 - protein, 9 aa, Homo Sapiens
NGESLYGRQ

SEQ ID NO: 684396 - protein, 9 aa, Homo Sapiens
GPTLSPGTA

SEQ ID NO: 684397 - protein, 9 aa, Homo Sapiens
YLQPSSIHS

SEQ ID NO: 684398 - protein, 9 aa, Homo Sapiens
GPQGPVGFT

SEQ ID NO: 684399 - protein, 9 aa, Homo Sapiens
ALAALGVAL

SEQ ID NO: 684400 - protein, 9 aa, Homo Sapiens
VFNDVNGLY

SEQ ID NO: 684401 - protein, 9 aa, Homo Sapiens
LVAPTINLG

SEQ ID NO: 684402 - protein, 9 aa, Homo Sapiens
FTTSSAFIC

SEQ ID NO: 684403 - protein, 9 aa, Homo Sapiens
YVADIKVDG

SEQ ID NO: 684404 - protein, 9 aa, Homo Sapiens
EITVTEERR

SEQ ID NO: 684405 - protein, 9 aa, Homo Sapiens
DLGVSPEVF

SEQ ID NO: 684406 - protein, 9 aa, Homo Sapiens
VLDLDRRGE

SEQ ID NO: 684407 - protein, 9 aa, Homo Sapiens
GSIYTSVKL

SEQ ID NO: 684408 - protein, 9 aa, Homo Sapiens
TTPERGIYH

SEQ ID NO: 684409 - protein, 9 aa, Homo Sapiens
GDYEYSASN

SEQ ID NO: 684410 - protein, 9 aa, Homo Sapiens
PLVCEASPF

SEQ ID NO: 684411 - protein, 9 aa, Homo Sapiens
NVTGLRDGQ

SEQ ID NO: 684412 - protein, 9 aa, Homo Sapiens
SLLILSMLL

SEQ ID NO: 684413 - protein, 9 aa, Homo Sapiens
RGVLDLDRR

SEQ ID NO: 684414 - protein, 9 aa, Homo Sapiens
TFLRIADTR

SEQ ID NO: 684415 - protein, 9 aa, Homo Sapiens
GGHPVVIRL

SEQ ID NO: 684416 - protein, 9 aa, Homo Sapiens
TDEARYSLS

SEQ ID NO: 684417 - protein, 9 aa, Homo Sapiens
STLFDKFYK

SEQ ID NO: 684418 - protein, 9 aa, Homo Sapiens
SRGGRQCAP

SEQ ID NO: 684419 - protein, 9 aa, Homo Sapiens
EDCTEFSGN

SEQ ID NO: 684420 - protein, 9 aa, Homo Sapiens
EPNDEDRES

SEQ ID NO: 684421 - protein, 9 aa, Homo Sapiens
SPVVITPPS

SEQ ID NO: 684422 - protein, 9 aa, Homo Sapiens
KKRIPYSKV

SEQ ID NO: 684423 - protein, 9 aa, Homo Sapiens
QKRRRRTMR

SEQ ID NO: 684424 - protein, 9 aa, Homo Sapiens
FRPTFLQDS

SEQ ID NO: 684425 - protein, 9 aa, Homo Sapiens
NEITSWLWD

SEQ ID NO: 684426 - protein, 9 aa, Homo Sapiens
YDSVHSSAL

SEQ ID NO: 684427 - protein, 9 aa, Homo Sapiens
AGDPAELLG

SEQ ID NO: 684428 - protein, 9 aa, Homo Sapiens
EITSWLWDL

SEQ ID NO: 684429 - protein, 9 aa, Homo Sapiens
SGTFAALGA

SEQ ID NO: 684430 - protein, 9 aa, Homo Sapiens
YPLRYTSMK

SEQ ID NO: 684431 - protein, 9 aa, Homo Sapiens
IVVMLIFTV

SEQ ID NO: 684432 - protein, 9 aa, Homo Sapiens
NGSIYTSVK

SEQ ID NO: 684433 - protein, 9 aa, Homo Sapiens
VGVVIFITA

SEQ ID NO: 684434 - protein, 9 aa, Homo Sapiens
WHKISYFPC

SEQ ID NO: 684435 - protein, 9 aa, Homo Sapiens
RTRLCAPLS

SEQ ID NO: 684436 - protein, 9 aa, Homo Sapiens
RIPYSKVQL

SEQ ID NO: 684437 - protein, 9 aa, Homo Sapiens
NIMFQSAVP

SEQ ID NO: 684438 - protein, 9 aa, Homo Sapiens
HGDYLQLRE

SEQ ID NO: 684439 - protein, 9 aa, Homo Sapiens
TEERRRLLW

SEQ ID NO: 684440 - protein, 9 aa, Homo Sapiens
PQPIRNIMF

SEQ ID NO: 684441 - protein, 9 aa, Homo Sapiens
IVTIMVSQS

SEQ ID NO: 684442 - protein, 9 aa, Homo Sapiens
AVPSSRLSP

SEQ ID NO: 684443 - protein, 9 aa, Homo Sapiens
FAPGKVVGS

SEQ ID NO: 684444 - protein, 9 aa, Homo Sapiens
LKSPSIATI

SEQ ID NO: 684445 - protein, 9 aa, Homo Sapiens
NQKHCHCSA

SEQ ID NO: 684446 - protein, 9 aa, Homo Sapiens
TLNTMNGYS

SEQ ID NO: 684447 - protein, 9 aa, Homo Sapiens
PALAALGVA

SEQ ID NO: 684448 - protein, 9 aa, Homo Sapiens
VCKSPPPES

SEQ ID NO: 684449 - protein, 9 aa, Homo Sapiens
SSRLSPPML

SEQ ID NO: 684450 - protein, 9 aa, Homo Sapiens
GDQKRKQGT

SEQ ID NO: 684451 - protein, 9 aa, Homo Sapiens
KTISYVGCF

SEQ ID NO: 684452 - protein, 9 aa, Homo Sapiens
NDLVRCLRW

SEQ ID NO: 684453 - protein, 9 aa, Homo Sapiens
DEKPSWDIF

SEQ ID NO: 684454 - protein, 9 aa, Homo Sapiens
HLKRKIGYY

SEQ ID NO: 684455 - protein, 9 aa, Homo Sapiens
KGSGDFWRM

SEQ ID NO: 684456 - protein, 9 aa, Homo Sapiens
REQSGDYEY

SEQ ID NO: 684457 - protein, 9 aa, Homo Sapiens
SGGISSDET

SEQ ID NO: 684458 - protein, 9 aa, Homo Sapiens
YAGGVGAQL

SEQ ID NO: 684459 - protein, 9 aa, Homo Sapiens
TKTQLADAK

SEQ ID NO: 684460 - protein, 9 aa, Homo Sapiens
GDVRTIELE

SEQ ID NO: 684461 - protein, 9 aa, Homo Sapiens
ILRQLTMMA

SEQ ID NO: 684462 - protein, 9 aa, Homo Sapiens
APLSPGATL

SEQ ID NO: 684463 - protein, 9 aa, Homo Sapiens
SVMFRNGLE

SEQ ID NO: 684464 - protein, 9 aa, Homo Sapiens
DIKYTQSAF

SEQ ID NO: 684465 - protein, 9 aa, Homo Sapiens
DSWQPSVLV

SEQ ID NO: 684466 - protein, 9 aa, Homo Sapiens
GTLLQVQMH

SEQ ID NO: 684467 - protein, 9 aa, Homo Sapiens
FLQHGGPRR

SEQ ID NO: 684468 - protein, 9 aa, Homo Sapiens
ENPVIHYKR

SEQ ID NO: 684469 - protein, 9 aa, Homo Sapiens
QCPILSYSG

SEQ ID NO: 684470 - protein, 9 aa, Homo Sapiens
YEKISAWIR

SEQ ID NO: 684471 - protein, 9 aa, Homo Sapiens
VLLTLLRVL

SEQ ID NO: 684472 - protein, 9 aa, Homo Sapiens
PGASITQIS

SEQ ID NO: 684473 - protein, 9 aa, Homo Sapiens
NAQNQSFSP

SEQ ID NO: 684474 - protein, 9 aa, Homo Sapiens
LSRRVCWMI

SEQ ID NO: 684475 - protein, 9 aa, Homo Sapiens
FQPLFGVLL

SEQ ID NO: 684476 - protein, 9 aa, Homo Sapiens
EFFDEKPSW

SEQ ID NO: 684477 - protein, 9 aa, Homo Sapiens
SLYDSVHSS

SEQ ID NO: 684478 - protein, 9 aa, Homo Sapiens
FGITRPANE

SEQ ID NO: 684479 - protein, 9 aa, Homo Sapiens
YSNVSSLKV

SEQ ID NO: 684480 - protein, 9 aa, Homo Sapiens
TFAALGALV

SEQ ID NO: 684481 - protein, 9 aa, Homo Sapiens
LLLISLLTH

SEQ ID NO: 684482 - protein, 9 aa, Homo Sapiens
KMYSVMFRN

SEQ ID NO: 684483 - protein, 9 aa, Homo Sapiens
LMTFGGKPN

SEQ ID NO: 684484 - protein, 9 aa, Homo Sapiens
LIKYDENMG

SEQ ID NO: 684485 - protein, 9 aa, Homo Sapiens
PELQVAFAY

SEQ ID NO: 684486 - protein, 9 aa, Homo Sapiens
NAGAEATQS

SEQ ID NO: 684487 - protein, 9 aa, Homo Sapiens
RPSVPAGMN

SEQ ID NO: 684488 - protein, 9 aa, Homo Sapiens
TAEDFQPLF

SEQ ID NO: 684489 - protein, 9 aa, Homo Sapiens
LQVAFAYCA

SEQ ID NO: 684490 - protein, 9 aa, Homo Sapiens
WRMYLLKSP

SEQ ID NO: 684491 - protein, 9 aa, Homo Sapiens
PILSYSGQT

SEQ ID NO: 684492 - protein, 9 aa, Homo Sapiens
ENYVADIKV

SEQ ID NO: 684493 - protein, 9 aa, Homo Sapiens
TGPKGPPGP

SEQ ID NO: 684494 - protein, 9 aa, Homo Sapiens
PGFRIPLNN

SEQ ID NO: 684495 - protein, 9 aa, Homo Sapiens
LKYHMEHGI

SEQ ID NO: 684496 - protein, 9 aa, Homo Sapiens
PLGTGNDLV

SEQ ID NO: 684497 - protein, 9 aa, Homo Sapiens
DQDGEPILT

SEQ ID NO: 684498 - protein, 9 aa, Homo Sapiens
SPASQLFMP

SEQ ID NO: 684499 - protein, 9 aa, Homo Sapiens
SGVVSAKGK

SEQ ID NO: 684500 - protein, 9 aa, Homo Sapiens
YAVPCSRSG

SEQ ID NO: 684501 - protein, 9 aa, Homo Sapiens
VLLIVGTLS

SEQ ID NO: 684502 - protein, 9 aa, Homo Sapiens
GKMYSVMFR

SEQ ID NO: 684503 - protein, 9 aa, Homo Sapiens
PNDEDRESD

SEQ ID NO: 684504 - protein, 9 aa, Homo Sapiens
YASSALASL

SEQ ID NO: 684505 - protein, 9 aa, Homo Sapiens
KDSDENEEV

SEQ ID NO: 684506 - protein, 9 aa, Homo Sapiens
TQWWGKTLM

SEQ ID NO: 684507 - protein, 9 aa, Homo Sapiens
KDTEDLALF

SEQ ID NO: 684508 - protein, 9 aa, Homo Sapiens
DFWRMYLLK

SEQ ID NO: 684509 - protein, 9 aa, Homo Sapiens
WAPLSRQTK

SEQ ID NO: 684510 - protein, 9 aa, Homo Sapiens
SVITSVHVS

SEQ ID NO: 684511 - protein, 9 aa, Homo Sapiens
DTPSHSSQS

SEQ ID NO: 684512 - protein, 9 aa, Homo Sapiens
EQQEEEEAR

SEQ ID NO: 684513 - protein, 9 aa, Homo Sapiens
LGVVAFNTL

SEQ ID NO: 684514 - protein, 9 aa, Homo Sapiens
LTVPKEKSP

SEQ ID NO: 684515 - protein, 9 aa, Homo Sapiens
MDDKVLKEK

SEQ ID NO: 684516 - protein, 9 aa, Homo Sapiens
PLRKYADSS

SEQ ID NO: 684517 - protein, 9 aa, Homo Sapiens
TRVDSSNYI

SEQ ID NO: 684518 - protein, 9 aa, Homo Sapiens
CSTMSCLSR

SEQ ID NO: 684519 - protein, 9 aa, Homo Sapiens
SHCDLFPEE

SEQ ID NO: 684520 - protein, 9 aa, Homo Sapiens
FNRAGFQTE

SEQ ID NO: 684521 - protein, 9 aa, Homo Sapiens
MLRGITKMR

SEQ ID NO: 684522 - protein, 9 aa, Homo Sapiens
VSAEDVDSL

SEQ ID NO: 684523 - protein, 9 aa, Homo Sapiens
SKLGLPSDG

SEQ ID NO: 684524 - protein, 9 aa, Homo Sapiens
LARHQRNKV

SEQ ID NO: 684525 - protein, 9 aa, Homo Sapiens
EEDSFSGGL

SEQ ID NO: 684526 - protein, 9 aa, Homo Sapiens
MLCNSESND

SEQ ID NO: 684527 - protein, 9 aa, Homo Sapiens
GLEPGRKYE

SEQ ID NO: 684528 - protein, 9 aa, Homo Sapiens
RGVCNNQKH

SEQ ID NO: 684529 - protein, 9 aa, Homo Sapiens
GGKPNDGIP

SEQ ID NO: 684530 - protein, 9 aa, Homo Sapiens
SCPETKYNV

SEQ ID NO: 684531 - protein, 9 aa, Homo Sapiens
IIVTIMVSQ

SEQ ID NO: 684532 - protein, 9 aa, Homo Sapiens
DAAIMAEEL

SEQ ID NO: 684533 - protein, 9 aa, Homo Sapiens
KAQLIDVRT

SEQ ID NO: 684534 - protein, 9 aa, Homo Sapiens
RRNEITSWL

SEQ ID NO: 684535 - protein, 9 aa, Homo Sapiens
VAFAYCAAD

SEQ ID NO: 684536 - protein, 9 aa, Homo Sapiens
SKVQLRELE

SEQ ID NO: 684537 - protein, 9 aa, Homo Sapiens
GHPINPLVA

SEQ ID NO: 684538 - protein, 9 aa, Homo Sapiens
KIYLQVPSS

SEQ ID NO: 684539 - protein, 9 aa, Homo Sapiens
YSRVYIKLY

SEQ ID NO: 684540 - protein, 9 aa, Homo Sapiens
ATTDLAVNG

SEQ ID NO: 684541 - protein, 9 aa, Homo Sapiens
VVDTPSHSS

SEQ ID NO: 684542 - protein, 9 aa, Homo Sapiens
IHLAFNDFD

SEQ ID NO: 684543 - protein, 9 aa, Homo Sapiens
DSDENEEVK

SEQ ID NO: 684544 - protein, 9 aa, Homo Sapiens
CFVQCYFFI

SEQ ID NO: 684545 - protein, 9 aa, Homo Sapiens
RSPPAPPFP

SEQ ID NO: 684546 - protein, 9 aa, Homo Sapiens
DGFFFWVQD

SEQ ID NO: 684547 - protein, 9 aa, Homo Sapiens
SYSAVIAMA

SEQ ID NO: 684548 - protein, 9 aa, Homo Sapiens
MSTLFDKFY

SEQ ID NO: 684549 - protein, 9 aa, Homo Sapiens
GFLLMGCIQ

SEQ ID NO: 684550 - protein, 9 aa, Homo Sapiens
IVSGYDDNT

SEQ ID NO: 684551 - protein, 9 aa, Homo Sapiens
HVSLVGWQT

SEQ ID NO: 684552 - protein, 9 aa, Homo Sapiens
AMNGESLYG

SEQ ID NO: 684553 - protein, 9 aa, Homo Sapiens
NDGIPTREI

SEQ ID NO: 684554 - protein, 9 aa, Homo Sapiens
PLRYPVLLS

SEQ ID NO: 684555 - protein, 9 aa, Homo Sapiens
IVGAVTVAS

SEQ ID NO: 684556 - protein, 9 aa, Homo Sapiens
AVNGISLCL

SEQ ID NO: 684557 - protein, 9 aa, Homo Sapiens
SIHSMDTDK

SEQ ID NO: 684558 - protein, 9 aa, Homo Sapiens
PQCPILSYS

SEQ ID NO: 684559 - protein, 9 aa, Homo Sapiens
LLISLLTHQ

SEQ ID NO: 684560 - protein, 9 aa, Homo Sapiens
PSGSGQAGT

SEQ ID NO: 684561 - protein, 9 aa, Homo Sapiens
AWAVQNIGN

SEQ ID NO: 684562 - protein, 9 aa, Homo Sapiens
KLWLKHRRS

SEQ ID NO: 684563 - protein, 9 aa, Homo Sapiens
EIFFYTSLL

SEQ ID NO: 684564 - protein, 9 aa, Homo Sapiens
GRLLRITEN

SEQ ID NO: 684565 - protein, 9 aa, Homo Sapiens
GLGPQGPLV

SEQ ID NO: 684566 - protein, 9 aa, Homo Sapiens
TGVIVVMLI

SEQ ID NO: 684567 - protein, 9 aa, Homo Sapiens
HTVLTAAGS

SEQ ID NO: 684568 - protein, 9 aa, Homo Sapiens
QKGAVEVIS

SEQ ID NO: 684569 - protein, 9 aa, Homo Sapiens
PESGPTLSP

SEQ ID NO: 684570 - protein, 9 aa, Homo Sapiens
ARHQRNKVK

SEQ ID NO: 684571 - protein, 9 aa, Homo Sapiens
DVNGLYTYT

SEQ ID NO: 684572 - protein, 9 aa, Homo Sapiens
RIADTRVGD

SEQ ID NO: 684573 - protein, 9 aa, Homo Sapiens
YEYSASNDV

SEQ ID NO: 684574 - protein, 9 aa, Homo Sapiens
RGIYHGICL

SEQ ID NO: 684575 - protein, 9 aa, Homo Sapiens
PRGSVFTNE

SEQ ID NO: 684576 - protein, 9 aa, Homo Sapiens
GRKYEMHLY

SEQ ID NO: 684577 - protein, 9 aa, Homo Sapiens
RLTWVCRRP

SEQ ID NO: 684578 - protein, 9 aa, Homo Sapiens
DAFAKVTKA

SEQ ID NO: 684579 - protein, 9 aa, Homo Sapiens
EMHLYGLHE

SEQ ID NO: 684580 - protein, 9 aa, Homo Sapiens
REKPYMCNE

SEQ ID NO: 684581 - protein, 9 aa, Homo Sapiens
PRRPSVPAG

SEQ ID NO: 684582 - protein, 9 aa, Homo Sapiens
ATLTSTSCS

SEQ ID NO: 684583 - protein, 9 aa, Homo Sapiens
MVQKMLLLI

SEQ ID NO: 684584 - protein, 9 aa, Homo Sapiens
YNADPSKPI

SEQ ID NO: 684585 - protein, 9 aa, Homo Sapiens
VKLRGRLLR

SEQ ID NO: 684586 - protein, 9 aa, Homo Sapiens
QEKYLVYRH

SEQ ID NO: 684587 - protein, 9 aa, Homo Sapiens
VYRHVPGTD

SEQ ID NO: 684588 - protein, 9 aa, Homo Sapiens
FQIEPGFYS

SEQ ID NO: 684589 - protein, 9 aa, Homo Sapiens
SQRRSRHLR

SEQ ID NO: 684590 - protein, 9 aa, Homo Sapiens
WAALQRLTW

SEQ ID NO: 684591 - protein, 9 aa, Homo Sapiens
VQLRELERE

SEQ ID NO: 684592 - protein, 9 aa, Homo Sapiens
EEEDSFSGG

SEQ ID NO: 684593 - protein, 9 aa, Homo Sapiens
LVWRMRQML

SEQ ID NO: 684594 - protein, 9 aa, Homo Sapiens
QESVNSNRY

SEQ ID NO: 684595 - protein, 9 aa, Homo Sapiens
FNTLMLKRF

SEQ ID NO: 684596 - protein, 9 aa, Homo Sapiens
LRVLFSQTS

SEQ ID NO: 684597 - protein, 9 aa, Homo Sapiens
AFTTSSAFI

SEQ ID NO: 684598 - protein, 9 aa, Homo Sapiens
GHRARSWRF

SEQ ID NO: 684599 - protein, 9 aa, Homo Sapiens
QWAPLSRQT

SEQ ID NO: 684600 - protein, 9 aa, Homo Sapiens
CIGDHSMRA

SEQ ID NO: 684601 - protein, 9 aa, Homo Sapiens
KIWFESNMG

SEQ ID NO: 684602 - protein, 9 aa, Homo Sapiens
QNESISRAM

SEQ ID NO: 684603 - protein, 9 aa, Homo Sapiens
PSPPPPVPI

SEQ ID NO: 684604 - protein, 9 aa, Homo Sapiens
DLGHREEDL

SEQ ID NO: 684605 - protein, 9 aa, Homo Sapiens
ARVPTSPQG

SEQ ID NO: 684606 - protein, 9 aa, Homo Sapiens
PHHNQTFAG

SEQ ID NO: 684607 - protein, 9 aa, Homo Sapiens
SSRRGARRG

SEQ ID NO: 684608 - protein, 9 aa, Homo Sapiens
RGAESDHSN

SEQ ID NO: 684609 - protein, 9 aa, Homo Sapiens
NNPPGASIT

SEQ ID NO: 684610 - protein, 9 aa, Homo Sapiens
PLSPGATLT

SEQ ID NO: 684611 - protein, 9 aa, Homo Sapiens
NVQAPRLAA

SEQ ID NO: 684612 - protein, 9 aa, Homo Sapiens
TTDLAVNGI

SEQ ID NO: 684613 - protein, 9 aa, Homo Sapiens
NCEAFTVIL

SEQ ID NO: 684614 - protein, 9 aa, Homo Sapiens
GLVGSYLCS

SEQ ID NO: 684615 - protein, 9 aa, Homo Sapiens
VEKDCLRAV

SEQ ID NO: 684616 - protein, 9 aa, Homo Sapiens
KNPCLHGDY

SEQ ID NO: 684617 - protein, 9 aa, Homo Sapiens
SNYIPQLFW

SEQ ID NO: 684618 - protein, 9 aa, Homo Sapiens
GLDALVAPT

SEQ ID NO: 684619 - protein, 9 aa, Homo Sapiens
KHDLEVDVK

SEQ ID NO: 684620 - protein, 9 aa, Homo Sapiens
VSEYQQYQN

SEQ ID NO: 684621 - protein, 9 aa, Homo Sapiens
LVGSSGGIS

SEQ ID NO: 684622 - protein, 9 aa, Homo Sapiens
EKISAWIRK

SEQ ID NO: 684623 - protein, 9 aa, Homo Sapiens
VTEETFGFL

SEQ ID NO: 684624 - protein, 9 aa, Homo Sapiens
GALVELLDN

SEQ ID NO: 684625 - protein, 9 aa, Homo Sapiens
ASTGDTSPL

SEQ ID NO: 684626 - protein, 9 aa, Homo Sapiens
VIAMAIHGA

SEQ ID NO: 684627 - protein, 9 aa, Homo Sapiens
SPRFLRAWN

SEQ ID NO: 684628 - protein, 9 aa, Homo Sapiens
MNGESLYGR

SEQ ID NO: 684629 - protein, 9 aa, Homo Sapiens
SSASSLKGS

SEQ ID NO: 684630 - protein, 9 aa, Homo Sapiens
LLRSLGWAS

SEQ ID NO: 684631 - protein, 9 aa, Homo Sapiens
HLPSEDIPE

SEQ ID NO: 684632 - protein, 9 aa, Homo Sapiens
NTLMLKRFR

SEQ ID NO: 684633 - protein, 9 aa, Homo Sapiens
PSHGSIAAS

SEQ ID NO: 684634 - protein, 9 aa, Homo Sapiens
LLIVGTLSV

SEQ ID NO: 684635 - protein, 9 aa, Homo Sapiens
FIMQDDTNV

SEQ ID NO: 684636 - protein, 9 aa, Homo Sapiens
EVSGTLLQV

SEQ ID NO: 684637 - protein, 9 aa, Homo Sapiens
GESLYGRQI

SEQ ID NO: 684638 - protein, 9 aa, Homo Sapiens
TSDTLLCQL

SEQ ID NO: 684639 - protein, 9 aa, Homo Sapiens
CMELMSTLF

SEQ ID NO: 684640 - protein, 9 aa, Homo Sapiens
WWTDTERLY

SEQ ID NO: 684641 - protein, 9 aa, Homo Sapiens
QQNGDFKDV

SEQ ID NO: 684642 - protein, 9 aa, Homo Sapiens
PENKRFGIT

SEQ ID NO: 684643 - protein, 9 aa, Homo Sapiens
GDYLQLRET

SEQ ID NO: 684644 - protein, 9 aa, Homo Sapiens
CPENVLNVL

SEQ ID NO: 684645 - protein, 9 aa, Homo Sapiens
QTPQYDNRC

SEQ ID NO: 684646 - protein, 9 aa, Homo Sapiens
TGNDLVRCL

SEQ ID NO: 684647 - protein, 9 aa, Homo Sapiens
DGTSKCEEI

SEQ ID NO: 684648 - protein, 9 aa, Homo Sapiens
MYQSLEQEL

SEQ ID NO: 684649 - protein, 9 aa, Homo Sapiens
KTKYASSAL

SEQ ID NO: 684650 - protein, 9 aa, Homo Sapiens
SRCDTLQYC

SEQ ID NO: 684651 - protein, 9 aa, Homo Sapiens
DRNACLGEC

SEQ ID NO: 684652 - protein, 9 aa, Homo Sapiens
GSGVELVNT

SEQ ID NO: 684653 - protein, 9 aa, Homo Sapiens
DRESDVDWQ

SEQ ID NO: 684654 - protein, 9 aa, Homo Sapiens
NLGDQKRKQ

SEQ ID NO: 684655 - protein, 9 aa, Homo Sapiens
GPNLGDQKR

SEQ ID NO: 684656 - protein, 9 aa, Homo Sapiens
RSLPPEVWP

SEQ ID NO: 684657 - protein, 9 aa, Homo Sapiens
PSKSHKKRS

SEQ ID NO: 684658 - protein, 9 aa, Homo Sapiens
TFLQDSGLY

SEQ ID NO: 684659 - protein, 9 aa, Homo Sapiens
GFFFWVQDL

SEQ ID NO: 684660 - protein, 9 aa, Homo Sapiens
VKFLTDKLQ

SEQ ID NO: 684661 - protein, 9 aa, Homo Sapiens
EGNVTTEDS

SEQ ID NO: 684662 - protein, 9 aa, Homo Sapiens
TPQYDNRCR

SEQ ID NO: 684663 - protein, 9 aa, Homo Sapiens
SSAVVVALL

SEQ ID NO: 684664 - protein, 9 aa, Homo Sapiens
RRRRTMRRK

SEQ ID NO: 684665 - protein, 9 aa, Homo Sapiens
GPEPSGSGQ

SEQ ID NO: 684666 - protein, 9 aa, Homo Sapiens
QPELVTNPL

SEQ ID NO: 684667 - protein, 9 aa, Homo Sapiens
VKQSSKLTA

SEQ ID NO: 684668 - protein, 9 aa, Homo Sapiens
AVIAMAIHG

SEQ ID NO: 684669 - protein, 9 aa, Homo Sapiens
QAIQKGAVE

SEQ ID NO: 684670 - protein, 9 aa, Homo Sapiens
KEGDFKGCT

SEQ ID NO: 684671 - protein, 9 aa, Homo Sapiens
ESLYGRQIR

SEQ ID NO: 684672 - protein, 9 aa, Homo Sapiens
ALVAPTINL

SEQ ID NO: 684673 - protein, 9 aa, Homo Sapiens
TVHTVPLRK

SEQ ID NO: 684674 - protein, 9 aa, Homo Sapiens
TGLPMSMLT

SEQ ID NO: 684675 - protein, 9 aa, Homo Sapiens
KTQLADAKR

SEQ ID NO: 684676 - protein, 9 aa, Homo Sapiens
IPLTPRTSQ

SEQ ID NO: 684677 - protein, 9 aa, Homo Sapiens
KMLLLISLL

SEQ ID NO: 684678 - protein, 9 aa, Homo Sapiens
ITDAAIMAE

SEQ ID NO: 684679 - protein, 9 aa, Homo Sapiens
NMGLVSLLK

SEQ ID NO: 684680 - protein, 9 aa, Homo Sapiens
VAPTINLGD

SEQ ID NO: 684681 - protein, 9 aa, Homo Sapiens
ISYFPCLVL

SEQ ID NO: 684682 - protein, 9 aa, Homo Sapiens
PVVITPPSN

SEQ ID NO: 684683 - protein, 9 aa, Homo Sapiens
VVTEETFGF

SEQ ID NO: 684684 - protein, 9 aa, Homo Sapiens
SIWFRPTFL

SEQ ID NO: 684685 - protein, 9 aa, Homo Sapiens
SQPELVTNP

SEQ ID NO: 684686 - protein, 9 aa, Homo Sapiens
PEAPSKSHK

SEQ ID NO: 684687 - protein, 9 aa, Homo Sapiens
YPVLLSRRV

SEQ ID NO: 684688 - protein, 9 aa, Homo Sapiens
TRQKRRRRT

SEQ ID NO: 684689 - protein, 9 aa, Homo Sapiens
LQLIFGYRG

SEQ ID NO: 684690 - protein, 9 aa, Homo Sapiens
QNIGNVLVD

SEQ ID NO: 684691 - protein, 9 aa, Homo Sapiens
LGTRSLPSA

SEQ ID NO: 684692 - protein, 9 aa, Homo Sapiens
RAVRNSKIY

SEQ ID NO: 684693 - protein, 9 aa, Homo Sapiens
ESSQVESTN

SEQ ID NO: 684694 - protein, 9 aa, Homo Sapiens
PSVLVNGTK

SEQ ID NO: 684695 - protein, 9 aa, Homo Sapiens
TRSRSESDV

SEQ ID NO: 684696 - protein, 9 aa, Homo Sapiens
RARSWRFLT

SEQ ID NO: 684697 - protein, 9 aa, Homo Sapiens
ASPSARVPT

SEQ ID NO: 684698 - protein, 9 aa, Homo Sapiens
YQQYQNATA

SEQ ID NO: 684699 - protein, 9 aa, Homo Sapiens
PGFYSTYES

SEQ ID NO: 684700 - protein, 9 aa, Homo Sapiens
TKWRSYRLP

SEQ ID NO: 684701 - protein, 9 aa, Homo Sapiens
SPLPVTGAS

SEQ ID NO: 684702 - protein, 9 aa, Homo Sapiens
EHPAVLELA

SEQ ID NO: 684703 - protein, 9 aa, Homo Sapiens
SRRGARRGG

SEQ ID NO: 684704 - protein, 9 aa, Homo Sapiens
SRCWRTRLC

SEQ ID NO: 684705 - protein, 9 aa, Homo Sapiens
QGCSLPATP

SEQ ID NO: 684706 - protein, 9 aa, Homo Sapiens
LLGERGTAP

SEQ ID NO: 684707 - protein, 9 aa, Homo Sapiens
DDRHSQMIQ

SEQ ID NO: 684708 - protein, 9 aa, Homo Sapiens
PRGAESDHS

SEQ ID NO: 684709 - protein, 9 aa, Homo Sapiens
KQSSKLTAN

SEQ ID NO: 684710 - protein, 9 aa, Homo Sapiens
PGHSPLPGR

SEQ ID NO: 684711 - protein, 9 aa, Homo Sapiens
SHVKQSSKL

SEQ ID NO: 684712 - protein, 9 aa, Homo Sapiens
SSSIPLTPR

SEQ ID NO: 684713 - protein, 9 aa, Homo Sapiens
RRGARRGGP

SEQ ID NO: 684714 - protein, 9 aa, Homo Sapiens
AATKIVNEV

SEQ ID NO: 684715 - protein, 9 aa, Homo Sapiens
AASQGYSPQ

SEQ ID NO: 684716 - protein, 9 aa, Homo Sapiens
GIPGHPGEP

SEQ ID NO: 684717 - protein, 9 aa, Homo Sapiens
RHLRVRTEG

SEQ ID NO: 684718 - protein, 9 aa, Homo Sapiens
TPERGIYHG

SEQ ID NO: 684719 - protein, 9 aa, Homo Sapiens
DDTNVQAPR

SEQ ID NO: 684720 - protein, 9 aa, Homo Sapiens
YNVTGLRDG

SEQ ID NO: 684721 - protein, 9 aa, Homo Sapiens
KHLQVCPAR

SEQ ID NO: 684722 - protein, 9 aa, Homo Sapiens
IKHSKIWFE

SEQ ID NO: 684723 - protein, 9 aa, Homo Sapiens
LLQVQMHYE

SEQ ID NO: 684724 - protein, 9 aa, Homo Sapiens
AFTLSAVGG

SEQ ID NO: 684725 - protein, 9 aa, Homo Sapiens
LTLKYHMEH

SEQ ID NO: 684726 - protein, 9 aa, Homo Sapiens
SVQKTKYAS

SEQ ID NO: 684727 - protein, 9 aa, Homo Sapiens
RAQSLKSPS

SEQ ID NO: 684728 - protein, 9 aa, Homo Sapiens
TVNSKTRQA

SEQ ID NO: 684729 - protein, 9 aa, Homo Sapiens
SINRDNGHL

SEQ ID NO: 684730 - protein, 9 aa, Homo Sapiens
TVGVVIFIT

SEQ ID NO: 684731 - protein, 9 aa, Homo Sapiens
DLDRRGEPA

SEQ ID NO: 684732 - protein, 9 aa, Homo Sapiens
VVGSHIRGH

SEQ ID NO: 684733 - protein, 9 aa, Homo Sapiens
EQIVHGEHQ

SEQ ID NO: 684734 - protein, 9 aa, Homo Sapiens
SLYGRQIRV

SEQ ID NO: 684735 - protein, 9 aa, Homo Sapiens
EREREREQE

SEQ ID NO: 684736 - protein, 9 aa, Homo Sapiens
LVALRHMER

SEQ ID NO: 684737 - protein, 9 aa, Homo Sapiens
RVSQVPRGA

SEQ ID NO: 684738 - protein, 9 aa, Homo Sapiens
DTLQYCPDP

SEQ ID NO: 684739 - protein, 9 aa, Homo Sapiens
QIVHGEHQF

SEQ ID NO: 684740 - protein, 9 aa, Homo Sapiens
PIDAITDEA

SEQ ID NO: 684741 - protein, 9 aa, Homo Sapiens
QSQRRSRHL

SEQ ID NO: 684742 - protein, 9 aa, Homo Sapiens
PSVQKTKYA

SEQ ID NO: 684743 - protein, 9 aa, Homo Sapiens
NMNMNTLNT

SEQ ID NO: 684744 - protein, 9 aa, Homo Sapiens
DTTAPTTVA

SEQ ID NO: 684745 - protein, 9 aa, Homo Sapiens
IHSMDTDKM

SEQ ID NO: 684746 - protein, 9 aa, Homo Sapiens
HEPNDEDRE

SEQ ID NO: 684747 - protein, 9 aa, Homo Sapiens
KGHVSLVGW

SEQ ID NO: 684748 - protein, 9 aa, Homo Sapiens
PSPISAPQQ

SEQ ID NO: 684749 - protein, 9 aa, Homo Sapiens
EWDAFAKVT

SEQ ID NO: 684750 - protein, 9 aa, Homo Sapiens
SGLLREWYM

SEQ ID NO: 684751 - protein, 9 aa, Homo Sapiens
QGIKDSFQK

SEQ ID NO: 684752 - protein, 9 aa, Homo Sapiens
YSIGRRVEG

SEQ ID NO: 684753 - protein, 9 aa, Homo Sapiens
KTFQRSSSL

SEQ ID NO: 684754 - protein, 9 aa, Homo Sapiens
KPDSILVPA

SEQ ID NO: 684755 - protein, 9 aa, Homo Sapiens
CKQGYDSSP

SEQ ID NO: 684756 - protein, 9 aa, Homo Sapiens
QYISRRSQL

SEQ ID NO: 684757 - protein, 9 aa, Homo Sapiens
ALVELLDNA

SEQ ID NO: 684758 - protein, 9 aa, Homo Sapiens
YSTYESTLF

SEQ ID NO: 684759 - protein, 9 aa, Homo Sapiens
TGTVHTVPL

SEQ ID NO: 684760 - protein, 9 aa, Homo Sapiens
RVYSIGRRV

SEQ ID NO: 684761 - protein, 9 aa, Homo Sapiens
QSFSSLYEE

SEQ ID NO: 684762 - protein, 9 aa, Homo Sapiens
VSPLGICLL

SEQ ID NO: 684763 - protein, 9 aa, Homo Sapiens
CSSSVSGGP

SEQ ID NO: 684764 - protein, 9 aa, Homo Sapiens
DLVRCLRWG

SEQ ID NO: 684765 - protein, 9 aa, Homo Sapiens
THGDVRTIE

SEQ ID NO: 684766 - protein, 9 aa, Homo Sapiens
KLRGRLLRI

SEQ ID NO: 684767 - protein, 9 aa, Homo Sapiens
AWNPPPVSA

SEQ ID NO: 684768 - protein, 9 aa, Homo Sapiens
QSLEQELQK

SEQ ID NO: 684769 - protein, 9 aa, Homo Sapiens
GGPGKSPTL

SEQ ID NO: 684770 - protein, 9 aa, Homo Sapiens
SSLKGSLGY

SEQ ID NO: 684771 - protein, 9 aa, Homo Sapiens
ILTSATEPN

SEQ ID NO: 684772 - protein, 9 aa, Homo Sapiens
IKVDGKQVE

SEQ ID NO: 684773 - protein, 9 aa, Homo Sapiens
QNATAEEEG

SEQ ID NO: 684774 - protein, 9 aa, Homo Sapiens
ISTTSVYSQ

SEQ ID NO: 684775 - protein, 9 aa, Homo Sapiens
SRGLQSWWT

SEQ ID NO: 684776 - protein, 9 aa, Homo Sapiens
PRFLRAWNP

SEQ ID NO: 684777 - protein, 9 aa, Homo Sapiens
GISSDETRS

SEQ ID NO: 684778 - protein, 9 aa, Homo Sapiens
AYCLGDLPM

SEQ ID NO: 684779 - protein, 9 aa, Homo Sapiens
KETAPLRKY

SEQ ID NO: 684780 - protein, 9 aa, Homo Sapiens
RPGPPTRLL

SEQ ID NO: 684781 - protein, 9 aa, Homo Sapiens
QDLLSEDQG

SEQ ID NO: 684782 - protein, 9 aa, Homo Sapiens
AKTKEDGPA

SEQ ID NO: 684783 - protein, 9 aa, Homo Sapiens
LISLLTHQL

SEQ ID NO: 684784 - protein, 9 aa, Homo Sapiens
DCTEFSGNG

SEQ ID NO: 684785 - protein, 9 aa, Homo Sapiens
VSGASTYSR

SEQ ID NO: 684786 - protein, 9 aa, Homo Sapiens
QRQSQESTM

SEQ ID NO: 684787 - protein, 9 aa, Homo Sapiens
IWFESNMGN

SEQ ID NO: 684788 - protein, 9 aa, Homo Sapiens
FRVLRHDAG

SEQ ID NO: 684789 - protein, 9 aa, Homo Sapiens
ITTSCIGDH

SEQ ID NO: 684790 - protein, 9 aa, Homo Sapiens
QRLTWVCRR

SEQ ID NO: 684791 - protein, 9 aa, Homo Sapiens
RKMEIPRTY

SEQ ID NO: 684792 - protein, 9 aa, Homo Sapiens
LLRVLFSQT

SEQ ID NO: 684793 - protein, 9 aa, Homo Sapiens
RYTSMKSGS

SEQ ID NO: 684794 - protein, 9 aa, Homo Sapiens
TTSVYSQNA

SEQ ID NO: 684795 - protein, 9 aa, Homo Sapiens
RESDVDWQG

SEQ ID NO: 684796 - protein, 9 aa, Homo Sapiens
GEEDCTEFS

SEQ ID NO: 684797 - protein, 9 aa, Homo Sapiens
SSHVKQSSK

SEQ ID NO: 684798 - protein, 9 aa, Homo Sapiens
ATKIVNEVS

SEQ ID NO: 684799 - protein, 9 aa, Homo Sapiens
GPRRPSVPA

SEQ ID NO: 684800 - protein, 9 aa, Homo Sapiens
SESDVLLDE

SEQ ID NO: 684801 - protein, 9 aa, Homo Sapiens
YDQDGEPIL

SEQ ID NO: 684802 - protein, 9 aa, Homo Sapiens
SYYFCETQL

SEQ ID NO: 684803 - protein, 9 aa, Homo Sapiens
SMETHLKAV

SEQ ID NO: 684804 - protein, 9 aa, Homo Sapiens
TPSHSSQSA

SEQ ID NO: 684805 - protein, 9 aa, Homo Sapiens
SILVPAVTS

SEQ ID NO: 684806 - protein, 9 aa, Homo Sapiens
MPRMTRQKR

SEQ ID NO: 684807 - protein, 9 aa, Homo Sapiens
RCDTLQYCP

SEQ ID NO: 684808 - protein, 9 aa, Homo Sapiens
VSLTGVIVV

SEQ ID NO: 684809 - protein, 9 aa, Homo Sapiens
LYGRQIRVD

SEQ ID NO: 684810 - protein, 9 aa, Homo Sapiens
PLERRQIPL

SEQ ID NO: 684811 - protein, 9 aa, Homo Sapiens
PPGLHHHGL

SEQ ID NO: 684812 - protein, 9 aa, Homo Sapiens
PAGEQELLL

SEQ ID NO: 684813 - protein, 9 aa, Homo Sapiens
EMVQKMLLL

SEQ ID NO: 684814 - protein, 9 aa, Homo Sapiens
IYLQPSSIH

SEQ ID NO: 684815 - protein, 9 aa, Homo Sapiens
MGPPGIPGH

SEQ ID NO: 684816 - protein, 9 aa, Homo Sapiens
PVLLSRRVC

SEQ ID NO: 684817 - protein, 9 aa, Homo Sapiens
SGASTYSRV

SEQ ID NO: 684818 - protein, 9 aa, Homo Sapiens
KYDENMGLV

SEQ ID NO: 684819 - protein, 9 aa, Homo Sapiens
PSFNRAGFQ

SEQ ID NO: 684820 - protein, 9 aa, Homo Sapiens
KDCLRAVEV

SEQ ID NO: 684821 - protein, 9 aa, Homo Sapiens
KYASSALAS

SEQ ID NO: 684822 - protein, 9 aa, Homo Sapiens
AITDEARYS

SEQ ID NO: 684823 - protein, 9 aa, Homo Sapiens
QKRKQGTKT

SEQ ID NO: 684824 - protein, 9 aa, Homo Sapiens
FYSTYESTL

SEQ ID NO: 684825 - protein, 9 aa, Homo Sapiens
PSDGILSGD

SEQ ID NO: 684826 - protein, 9 aa, Homo Sapiens
AVGRTGVFI

SEQ ID NO: 684827 - protein, 9 aa, Homo Sapiens
KVFAIQNPT

SEQ ID NO: 684828 - protein, 9 aa, Homo Sapiens
NESISRAMC

SEQ ID NO: 684829 - protein, 9 aa, Homo Sapiens
KERECPLPP

SEQ ID NO: 684830 - protein, 9 aa, Homo Sapiens
PAGSGVELV

SEQ ID NO: 684831 - protein, 9 aa, Homo Sapiens
RSYRLPRPG

SEQ ID NO: 684832 - protein, 9 aa, Homo Sapiens
YFCETQLAF

SEQ ID NO: 684833 - protein, 9 aa, Homo Sapiens
APTINLGDL

SEQ ID NO: 684834 - protein, 9 aa, Homo Sapiens
NPLIKGPKG

SEQ ID NO: 684835 - protein, 9 aa, Homo Sapiens
PSSRLSPPM

SEQ ID NO: 684836 - protein, 9 aa, Homo Sapiens
RVPTSPQGD

SEQ ID NO: 684837 - protein, 9 aa, Homo Sapiens
PGWAALQRL

SEQ ID NO: 684838 - protein, 9 aa, Homo Sapiens
NEGNPSTTA

SEQ ID NO: 684839 - protein, 9 aa, Homo Sapiens
QSGDYEYSA

SEQ ID NO: 684840 - protein, 9 aa, Homo Sapiens
ESGPTLSPG

SEQ ID NO: 684841 - protein, 9 aa, Homo Sapiens
ICMELMSTL

SEQ ID NO: 684842 - protein, 9 aa, Homo Sapiens
ASQGYSPQR

SEQ ID NO: 684843 - protein, 9 aa, Homo Sapiens
GDPAELLGE

SEQ ID NO: 684844 - protein, 9 aa, Homo Sapiens
VKERECPLP

SEQ ID NO: 684845 - protein, 9 aa, Homo Sapiens
TQISASDPD

SEQ ID NO: 684846 - protein, 9 aa, Homo Sapiens
RGLQSWWTD

SEQ ID NO: 684847 - protein, 9 aa, Homo Sapiens
FCPENVLNV

SEQ ID NO: 684848 - protein, 9 aa, Homo Sapiens
NPVIHYKRR

SEQ ID NO: 684849 - protein, 9 aa, Homo Sapiens
CSAAVGRTG

SEQ ID NO: 684850 - protein, 9 aa, Homo Sapiens
EGQKRDVFE

SEQ ID NO: 684851 - protein, 9 aa, Homo Sapiens
IADTRVGDA

SEQ ID NO: 684852 - protein, 9 aa, Homo Sapiens
RYPVLLSRR

SEQ ID NO: 684853 - protein, 9 aa, Homo Sapiens
EKHDLEVDV

SEQ ID NO: 684854 - protein, 9 aa, Homo Sapiens
SVKLNREVR

SEQ ID NO: 684855 - protein, 9 aa, Homo Sapiens
SKCEEIADV

SEQ ID NO: 684856 - protein, 9 aa, Homo Sapiens
SPPPPVPIS

SEQ ID NO: 684857 - protein, 9 aa, Homo Sapiens
TFGFLLMGC

SEQ ID NO: 684858 - protein, 9 aa, Homo Sapiens
GEPRHTVLT

SEQ ID NO: 684859 - protein, 9 aa, Homo Sapiens
RGFAYHSEL

SEQ ID NO: 684860 - protein, 9 aa, Homo Sapiens
SHGSIAASQ

SEQ ID NO: 684861 - protein, 9 aa, Homo Sapiens
SCEPKLEKY

SEQ ID NO: 684862 - protein, 9 aa, Homo Sapiens
SFSGGLQRE

SEQ ID NO: 684863 - protein, 9 aa, Homo Sapiens
HGEHQFGWS

SEQ ID NO: 684864 - protein, 9 aa, Homo Sapiens
EEEFPLERR

SEQ ID NO: 684865 - protein, 9 aa, Homo Sapiens
LGAGGQPPG

SEQ ID NO: 684866 - protein, 9 aa, Homo Sapiens
ESISRAMCA

SEQ ID NO: 684867 - protein, 9 aa, Homo Sapiens
SSDTTAPTT

SEQ ID NO: 684868 - protein, 9 aa, Homo Sapiens
HDAGRPLRL

SEQ ID NO: 684869 - protein, 9 aa, Homo Sapiens
EEIADVLSS

SEQ ID NO: 684870 - protein, 9 aa, Homo Sapiens
SSIPLTPRT

SEQ ID NO: 684871 - protein, 9 aa, Homo Sapiens
STNEGNPST

SEQ ID NO: 684872 - protein, 9 aa, Homo Sapiens
NQMESLHSQ

SEQ ID NO: 684873 - protein, 9 aa, Homo Sapiens
VADIKVDGK

SEQ ID NO: 684874 - protein, 9 aa, Homo Sapiens
SSAFICLIS

SEQ ID NO: 684875 - protein, 9 aa, Homo Sapiens
LMAPLSPGA

SEQ ID NO: 684876 - protein, 9 aa, Homo Sapiens
EAPDLGHRE

SEQ ID NO: 684877 - protein, 9 aa, Homo Sapiens
NFREKEGDF

SEQ ID NO: 684878 - protein, 9 aa, Homo Sapiens
ATKTQLADA

SEQ ID NO: 684879 - protein, 9 aa, Homo Sapiens
IVNEVSKPL

SEQ ID NO: 684880 - protein, 9 aa, Homo Sapiens
YTSMKSGSR

SEQ ID NO: 684881 - protein, 9 aa, Homo Sapiens
RRPSVPAGM

SEQ ID NO: 684882 - protein, 9 aa, Homo Sapiens
QQKSISSME

SEQ ID NO: 684883 - protein, 9 aa, Homo Sapiens
NADPSKPIP

SEQ ID NO: 684884 - protein, 9 aa, Homo Sapiens
LSEDQGCSL

SEQ ID NO: 684885 - protein, 9 aa, Homo Sapiens
NVGEEDCTE

SEQ ID NO: 684886 - protein, 9 aa, Homo Sapiens
RGARRGGPL

SEQ ID NO: 684887 - protein, 9 aa, Homo Sapiens
CFFVLLGGL

SEQ ID NO: 684888 - protein, 9 aa, Homo Sapiens
METHLKAVK

SEQ ID NO: 684889 - protein, 9 aa, Homo Sapiens
QPSSIHSMD

SEQ ID NO: 684890 - protein, 9 aa, Homo Sapiens
TNEGNPSTT

SEQ ID NO: 684891 - protein, 9 aa, Homo Sapiens
SYSGQTPLG

SEQ ID NO: 684892 - protein, 9 aa, Homo Sapiens
TFGGKPNDG

SEQ ID NO: 684893 - protein, 9 aa, Homo Sapiens
CPHLECPVL

SEQ ID NO: 684894 - protein, 9 aa, Homo Sapiens
GKTFQRSSS

SEQ ID NO: 684895 - protein, 9 aa, Homo Sapiens
QPLFGVLLD

SEQ ID NO: 684896 - protein, 9 aa, Homo Sapiens
EGSGVVSAK

SEQ ID NO: 684897 - protein, 9 aa, Homo Sapiens
LELAVVSSP

SEQ ID NO: 684898 - protein, 9 aa, Homo Sapiens
AYCAADIKS

SEQ ID NO: 684899 - protein, 9 aa, Homo Sapiens
DLALFQKLT

SEQ ID NO: 684900 - protein, 9 aa, Homo Sapiens
IQDQQQQIL

SEQ ID NO: 684901 - protein, 9 aa, Homo Sapiens
HSFLFGALV

SEQ ID NO: 684902 - protein, 9 aa, Homo Sapiens
REQIVHGEH

SEQ ID NO: 684903 - protein, 9 aa, Homo Sapiens
RLPSPISAP

SEQ ID NO: 684904 - protein, 9 aa, Homo Sapiens
SVHCSAAVG

SEQ ID NO: 684905 - protein, 9 aa, Homo Sapiens
DHSNTGTVH

SEQ ID NO: 684906 - protein, 9 aa, Homo Sapiens
LVLLTLLRV

SEQ ID NO: 684907 - protein, 9 aa, Homo Sapiens
TQDGRPPQT

SEQ ID NO: 684908 - protein, 9 aa, Homo Sapiens
ESLHSQPHQ

SEQ ID NO: 684909 - protein, 9 aa, Homo Sapiens
EGVLPLRGL

SEQ ID NO: 684910 - protein, 9 aa, Homo Sapiens
PGLVGSYLC

SEQ ID NO: 684911 - protein, 9 aa, Homo Sapiens
RDVFEHHGK

SEQ ID NO: 684912 - protein, 9 aa, Homo Sapiens
PGCSHLPGH

SEQ ID NO: 684913 - protein, 9 aa, Homo Sapiens
SKASPTQDG

SEQ ID NO: 684914 - protein, 9 aa, Homo Sapiens
QTLSAEEFI

SEQ ID NO: 684915 - protein, 9 aa, Homo Sapiens
ADTRVGDAV

SEQ ID NO: 684916 - protein, 9 aa, Homo Sapiens
EPNDLSFSR

SEQ ID NO: 684917 - protein, 9 aa, Homo Sapiens
QQEEEEARK

SEQ ID NO: 684918 - protein, 9 aa, Homo Sapiens
QNGDFKDVK

SEQ ID NO: 684919 - protein, 9 aa, Homo Sapiens
EHQFGWSML

SEQ ID NO: 684920 - protein, 9 aa, Homo Sapiens
PISAPQQPA

SEQ ID NO: 684921 - protein, 9 aa, Homo Sapiens
QPTSGEPRH

SEQ ID NO: 684922 - protein, 9 aa, Homo Sapiens
QETVNGWIS

SEQ ID NO: 684923 - protein, 9 aa, Homo Sapiens
GQAGTPGEP

SEQ ID NO: 684924 - protein, 9 aa, Homo Sapiens
FGFLLMGCI

SEQ ID NO: 684925 - protein, 9 aa, Homo Sapiens
HPVVIRLLD

SEQ ID NO: 684926 - protein, 9 aa, Homo Sapiens
KLSCEPKLE

SEQ ID NO: 684927 - protein, 9 aa, Homo Sapiens
KFLEILEKS

SEQ ID NO: 684928 - protein, 9 aa, Homo Sapiens
FESNMGNGT

SEQ ID NO: 684929 - protein, 9 aa, Homo Sapiens
SQETVNGWI

SEQ ID NO: 684930 - protein, 9 aa, Homo Sapiens
FEDGFFFWV

SEQ ID NO: 684931 - protein, 9 aa, Homo Sapiens
QDDTNVQAP

SEQ ID NO: 684932 - protein, 9 aa, Homo Sapiens
GAGGQPPGL

SEQ ID NO: 684933 - protein, 9 aa, Homo Sapiens
IQKGAVEVI

SEQ ID NO: 684934 - protein, 9 aa, Homo Sapiens
WPAGEQELL

SEQ ID NO: 684935 - protein, 9 aa, Homo Sapiens
FDVYAVPCS

SEQ ID NO: 684936 - protein, 9 aa, Homo Sapiens
QEEMVQKML

SEQ ID NO: 684937 - protein, 9 aa, Homo Sapiens
LRSLGWASP

SEQ ID NO: 684938 - protein, 9 aa, Homo Sapiens
GTSKCEEIA

SEQ ID NO: 684939 - protein, 9 aa, Homo Sapiens
GFRIPLNNA

SEQ ID NO: 684940 - protein, 9 aa, Homo Sapiens
GLGTRSLPS

SEQ ID NO: 684941 - protein, 9 aa, Homo Sapiens
TLSVASSSA

SEQ ID NO: 684942 - protein, 9 aa, Homo Sapiens
RNHQTPQYD

SEQ ID NO: 684943 - protein, 9 aa, Homo Sapiens
SSRSPPAPP

SEQ ID NO: 684944 - protein, 9 aa, Homo Sapiens
YDRFVAMCR

SEQ ID NO: 684945 - protein, 9 aa, Homo Sapiens
LLIIVTIMV

SEQ ID NO: 684946 - protein, 9 aa, Homo Sapiens
LINHYEEQQ

SEQ ID NO: 684947 - protein, 9 aa, Homo Sapiens
GNVLVDASA

SEQ ID NO: 684948 - protein, 9 aa, Homo Sapiens
VFAIQNPTL

SEQ ID NO: 684949 - protein, 9 aa, Homo Sapiens
EMPYAGGVG

SEQ ID NO: 684950 - protein, 9 aa, Homo Sapiens
SSSLLHHQS

SEQ ID NO: 684951 - protein, 9 aa, Homo Sapiens
SSKDSDDSS

SEQ ID NO: 684952 - protein, 9 aa, Homo Sapiens
HCDLFPEEF

SEQ ID NO: 684953 - protein, 9 aa, Homo Sapiens
FVCKQGYDS

SEQ ID NO: 684954 - protein, 9 aa, Homo Sapiens
LGLPSDGIL

SEQ ID NO: 684955 - protein, 9 aa, Homo Sapiens
DRTEDTSYP

SEQ ID NO: 684956 - protein, 9 aa, Homo Sapiens
KADMLCNSE

SEQ ID NO: 684957 - protein, 9 aa, Homo Sapiens
ESTNEGNPS

SEQ ID NO: 684958 - protein, 9 aa, Homo Sapiens
NKRFGITRP

SEQ ID NO: 684959 - protein, 9 aa, Homo Sapiens
LSVLLMGFQ

SEQ ID NO: 684960 - protein, 9 aa, Homo Sapiens
REREREREQ

SEQ ID NO: 684961 - protein, 9 aa, Homo Sapiens
RNEITSWLW

SEQ ID NO: 684962 - protein, 9 aa, Homo Sapiens
VDTGIHLPS

SEQ ID NO: 684963 - protein, 9 aa, Homo Sapiens
TIMVSQSLG

SEQ ID NO: 684964 - protein, 9 aa, Homo Sapiens
EVEPRGSVF

SEQ ID NO: 684965 - protein, 9 aa, Homo Sapiens
AAPESGPTL

SEQ ID NO: 684966 - protein, 9 aa, Homo Sapiens
SISRAMCAL

SEQ ID NO: 684967 - protein, 9 aa, Homo Sapiens
HQTPQYDNR

SEQ ID NO: 684968 - protein, 9 aa, Homo Sapiens
EAYVRAVRN

SEQ ID NO: 684969 - protein, 9 aa, Homo Sapiens
FVSSAVVVA

SEQ ID NO: 684970 - protein, 9 aa, Homo Sapiens
VLLMGFQLL

SEQ ID NO: 684971 - protein, 9 aa, Homo Sapiens
YSGQTPLGR

SEQ ID NO: 684972 - protein, 9 aa, Homo Sapiens
APGKVVGSH

SEQ ID NO: 684973 - protein, 9 aa, Homo Sapiens
RAMNGESLY

SEQ ID NO: 684974 - protein, 9 aa, Homo Sapiens
SHTELPPPL

SEQ ID NO: 684975 - protein, 9 aa, Homo Sapiens
NQDEVEPRG

SEQ ID NO: 684976 - protein, 9 aa, Homo Sapiens
SKIWFESNM

SEQ ID NO: 684977 - protein, 9 aa, Homo Sapiens
SSQPELVTN

SEQ ID NO: 684978 - protein, 9 aa, Homo Sapiens
RGKRKKQNS

SEQ ID NO: 684979 - protein, 9 aa, Homo Sapiens
IISYYFCET

SEQ ID NO: 684980 - protein, 9 aa, Homo Sapiens
EAPVVSRGG

SEQ ID NO: 684981 - protein, 9 aa, Homo Sapiens
QSQESTMVH

SEQ ID NO: 684982 - protein, 9 aa, Homo Sapiens
TISYVGCFV

SEQ ID NO: 684983 - protein, 9 aa, Homo Sapiens
KRRLIHQCD

SEQ ID NO: 684984 - protein, 9 aa, Homo Sapiens
NVSSLKVWD

SEQ ID NO: 684985 - protein, 9 aa, Homo Sapiens
VTEERRRLL

SEQ ID NO: 684986 - protein, 9 aa, Homo Sapiens
KGPIDAITD

SEQ ID NO: 684987 - protein, 9 aa, Homo Sapiens
GTLSVASSS

SEQ ID NO: 684988 - protein, 9 aa, Homo Sapiens
PQYDNRCRN

SEQ ID NO: 684989 - protein, 9 aa, Homo Sapiens
KWRSYRLPR

SEQ ID NO: 684990 - protein, 9 aa, Homo Sapiens
SPPSKASPT

SEQ ID NO: 684991 - protein, 9 aa, Homo Sapiens
QLADAKRYI

SEQ ID NO: 684992 - protein, 9 aa, Homo Sapiens
KVTKALMDE

SEQ ID NO: 684993 - protein, 9 aa, Homo Sapiens
TKIVNEVSK

SEQ ID NO: 684994 - protein, 9 aa, Homo Sapiens
VWPAGEQEL

SEQ ID NO: 684995 - protein, 9 aa, Homo Sapiens
LSAEEFINL

SEQ ID NO: 684996 - protein, 9 aa, Homo Sapiens
QLLLRSLGW

SEQ ID NO: 684997 - protein, 9 aa, Homo Sapiens
KLGRWRQES

SEQ ID NO: 684998 - protein, 9 aa, Homo Sapiens
NKVKFLTDK

SEQ ID NO: 684999 - protein, 9 aa, Homo Sapiens
MLITEPRMT

SEQ ID NO: 685000 - protein, 9 aa, Homo Sapiens
SDCTGLPMS

SEQ ID NO: 685001 - protein, 9 aa, Homo Sapiens
RYDRTEDTS

SEQ ID NO: 685002 - protein, 9 aa, Homo Sapiens
TSTSCSTMS

SEQ ID NO: 685003 - protein, 9 aa, Homo Sapiens
TPGFRIPLN

SEQ ID NO: 685004 - protein, 9 aa, Homo Sapiens
PPSQSLYDS

SEQ ID NO: 685005 - protein, 9 aa, Homo Sapiens
FFVLLGGLD

SEQ ID NO: 685006 - protein, 9 aa, Homo Sapiens
EEAPDLGHR

SEQ ID NO: 685007 - protein, 9 aa, Homo Sapiens
YRLPRPGPV

SEQ ID NO: 685008 - protein, 9 aa, Homo Sapiens
QDIDLGVSP

SEQ ID NO: 685009 - protein, 9 aa, Homo Sapiens
WEYFRQIFQ

SEQ ID NO: 685010 - protein, 9 aa, Homo Sapiens
RSRDQDRMN

SEQ ID NO: 685011 - protein, 9 aa, Homo Sapiens
AACQLKFLE

SEQ ID NO: 685012 - protein, 9 aa, Homo Sapiens
DTSDTLLCQ

SEQ ID NO: 685013 - protein, 9 aa, Homo Sapiens
IYLQVPSSE

SEQ ID NO: 685014 - protein, 9 aa, Homo Sapiens
VSGYDDNTL

SEQ ID NO: 685015 - protein, 9 aa, Homo Sapiens
LLVLLTLLR

SEQ ID NO: 685016 - protein, 9 aa, Homo Sapiens
RTSQEDLYF

SEQ ID NO: 685017 - protein, 9 aa, Homo Sapiens
EPRGSVFTN

SEQ ID NO: 685018 - protein, 9 aa, Homo Sapiens
HLAFNDFDL

SEQ ID NO: 685019 - protein, 9 aa, Homo Sapiens
CDTLQYCPD

SEQ ID NO: 685020 - protein, 9 aa, Homo Sapiens
WRSYRLPRP

SEQ ID NO: 685021 - protein, 9 aa, Homo Sapiens
VISLWILRQ

SEQ ID NO: 685022 - protein, 9 aa, Homo Sapiens
QIFQELFKA

SEQ ID NO: 685023 - protein, 9 aa, Homo Sapiens
RTMRRKMTL

SEQ ID NO: 685024 - protein, 9 aa, Homo Sapiens
LQSWWTDTE

SEQ ID NO: 685025 - protein, 9 aa, Homo Sapiens
GKVVGSHIR

SEQ ID NO: 685026 - protein, 9 aa, Homo Sapiens
GASITQISA

SEQ ID NO: 685027 - protein, 9 aa, Homo Sapiens
ASITQISAS

SEQ ID NO: 685028 - protein, 9 aa, Homo Sapiens
LDRRGEPAG

SEQ ID NO: 685029 - protein, 9 aa, Homo Sapiens
TVNGWISLI

SEQ ID NO: 685030 - protein, 9 aa, Homo Sapiens
SRYDRTEDT

SEQ ID NO: 685031 - protein, 9 aa, Homo Sapiens
TSRCDTLQY

SEQ ID NO: 685032 - protein, 9 aa, Homo Sapiens
GPKLPTEPP

SEQ ID NO: 685033 - protein, 9 aa, Homo Sapiens
CTEFSGNGW

SEQ ID NO: 685034 - protein, 9 aa, Homo Sapiens
TNPLIKGPK

SEQ ID NO: 685035 - protein, 9 aa, Homo Sapiens
LAALGVALL

SEQ ID NO: 685036 - protein, 9 aa, Homo Sapiens
SRSGSESAP

SEQ ID NO: 685037 - protein, 9 aa, Homo Sapiens
LCNSESNDI

SEQ ID NO: 685038 - protein, 9 aa, Homo Sapiens
VSSLKVWDF

SEQ ID NO: 685039 - protein, 9 aa, Homo Sapiens
AYVRAVRNS

SEQ ID NO: 685040 - protein, 9 aa, Homo Sapiens
KMTLVWRMR

SEQ ID NO: 685041 - protein, 9 aa, Homo Sapiens
IAACQLKFL

SEQ ID NO: 685042 - protein, 9 aa, Homo Sapiens
ILTLKYHME

SEQ ID NO: 685043 - protein, 9 aa, Homo Sapiens
LRYTSMKSG

SEQ ID NO: 685044 - protein, 9 aa, Homo Sapiens
LDLSEVLCK

SEQ ID NO: 685045 - protein, 9 aa, Homo Sapiens
AKLESMETH

SEQ ID NO: 685046 - protein, 9 aa, Homo Sapiens
FPPSPPPPV

SEQ ID NO: 685047 - protein, 9 aa, Homo Sapiens
MAGCATEIF

SEQ ID NO: 685048 - protein, 9 aa, Homo Sapiens
FLRIADTRV

SEQ ID NO: 685049 - protein, 9 aa, Homo Sapiens
TEPNDLSFS

SEQ ID NO: 685050 - protein, 9 aa, Homo Sapiens
ALAWQAKKA

SEQ ID NO: 685051 - protein, 9 aa, Homo Sapiens
RPRHPHHNQ

SEQ ID NO: 685052 - protein, 9 aa, Homo Sapiens
EERRRLLWC

SEQ ID NO: 685053 - protein, 9 aa, Homo Sapiens
ALTITNYFN

SEQ ID NO: 685054 - protein, 9 aa, Homo Sapiens
SPISAPQQP

SEQ ID NO: 685055 - protein, 9 aa, Homo Sapiens
TTSCIGDHS

SEQ ID NO: 685056 - protein, 9 aa, Homo Sapiens
WQAKKAPTH

SEQ ID NO: 685057 - protein, 9 aa, Homo Sapiens
KYTQSAFTL

SEQ ID NO: 685058 - protein, 9 aa, Homo Sapiens
CGRGFAYHS

SEQ ID NO: 685059 - protein, 9 aa, Homo Sapiens
VQKTKYASS

SEQ ID NO: 685060 - protein, 9 aa, Homo Sapiens
NAHFYCQYC

SEQ ID NO: 685061 - protein, 9 aa, Homo Sapiens
SLGWASPEV

SEQ ID NO: 685062 - protein, 9 aa, Homo Sapiens
VSQSLGSPM

SEQ ID NO: 685063 - protein, 9 aa, Homo Sapiens
CYGRLEKLS

SEQ ID NO: 685064 - protein, 9 aa, Homo Sapiens
LTSATEPND

SEQ ID NO: 685065 - protein, 9 aa, Homo Sapiens
QGKGDHDQV

SEQ ID NO: 685066 - protein, 9 aa, Homo Sapiens
PDLGHREED

SEQ ID NO: 685067 - protein, 9 aa, Homo Sapiens
APDLGHREE

SEQ ID NO: 685068 - protein, 9 aa, Homo Sapiens
DSGTDCSQL

SEQ ID NO: 685069 - protein, 9 aa, Homo Sapiens
ISLWILRQL

SEQ ID NO: 685070 - protein, 9 aa, Homo Sapiens
GFYSTYEST

SEQ ID NO: 685071 - protein, 9 aa, Homo Sapiens
PISVHCSAA

SEQ ID NO: 685072 - protein, 9 aa, Homo Sapiens
AKVTKALMD

SEQ ID NO: 685073 - protein, 9 aa, Homo Sapiens
HSELKAHEA

SEQ ID NO: 685074 - protein, 9 aa, Homo Sapiens
DVFEHHGKK

SEQ ID NO: 685075 - protein, 9 aa, Homo Sapiens
QKHCHCSAS

SEQ ID NO: 685076 - protein, 9 aa, Homo Sapiens
YGRLEKLSC

SEQ ID NO: 685077 - protein, 9 aa, Homo Sapiens
GLADSGTDC

SEQ ID NO: 685078 - protein, 9 aa, Homo Sapiens
SALPGPTVL

SEQ ID NO: 685079 - protein, 9 aa, Homo Sapiens
LGWSIFELE

SEQ ID NO: 685080 - protein, 9 aa, Homo Sapiens
QLRTQWWGK

SEQ ID NO: 685081 - protein, 9 aa, Homo Sapiens
WNPPPVSAR

SEQ ID NO: 685082 - protein, 9 aa, Homo Sapiens
VTKALMDEI

SEQ ID NO: 685083 - protein, 9 aa, Homo Sapiens
RWEYFRQIF

SEQ ID NO: 685084 - protein, 9 aa, Homo Sapiens
PLSRQTKDN

SEQ ID NO: 685085 - protein, 9 aa, Homo Sapiens
EEGQDASGL

SEQ ID NO: 685086 - protein, 9 aa, Homo Sapiens
YADSSISVL

SEQ ID NO: 685087 - protein, 9 aa, Homo Sapiens
LIDVRTKLG

SEQ ID NO: 685088 - protein, 9 aa, Homo Sapiens
EPGFYSTYE

SEQ ID NO: 685089 - protein, 9 aa, Homo Sapiens
VVSRGGRQC

SEQ ID NO: 685090 - protein, 9 aa, Homo Sapiens
HPHHNQTFA

SEQ ID NO: 685091 - protein, 9 aa, Homo Sapiens
YISRRSQLL

SEQ ID NO: 685092 - protein, 9 aa, Homo Sapiens
NIRNQMESL

SEQ ID NO: 685093 - protein, 9 aa, Homo Sapiens
QELPAGSGV

SEQ ID NO: 685094 - protein, 9 aa, Homo Sapiens
GKGDHDQVS

SEQ ID NO: 685095 - protein, 9 aa, Homo Sapiens
DVKIYLQVP

SEQ ID NO: 685096 - protein, 9 aa, Homo Sapiens
SRRSQLLRE

SEQ ID NO: 685097 - protein, 9 aa, Homo Sapiens
RQKRRRRTM

SEQ ID NO: 685098 - protein, 9 aa, Homo Sapiens
QDGEPILTF

SEQ ID NO: 685099 - protein, 9 aa, Homo Sapiens
QYQNATAEE

SEQ ID NO: 685100 - protein, 9 aa, Homo Sapiens
GVIVVMLIF

SEQ ID NO: 685101 - protein, 9 aa, Homo Sapiens
PSQSLYDSV

SEQ ID NO: 685102 - protein, 9 aa, Homo Sapiens
NISQETVNG

SEQ ID NO: 685103 - protein, 9 aa, Homo Sapiens
SMKSGSRCA

SEQ ID NO: 685104 - protein, 9 aa, Homo Sapiens
SAAVGRTGV

SEQ ID NO: 685105 - protein, 9 aa, Homo Sapiens
RSWRFLTYM

SEQ ID NO: 685106 - protein, 9 aa, Homo Sapiens
EEDCTEFSG

SEQ ID NO: 685107 - protein, 9 aa, Homo Sapiens
YTQSAFTLS

SEQ ID NO: 685108 - protein, 9 aa, Homo Sapiens
NDRGVCNNQ

SEQ ID NO: 685109 - protein, 9 aa, Homo Sapiens
PPFPLMTKA

SEQ ID NO: 685110 - protein, 9 aa, Homo Sapiens
YALTITNYF

SEQ ID NO: 685111 - protein, 9 aa, Homo Sapiens
ISAWIRKME

SEQ ID NO: 685112 - protein, 9 aa, Homo Sapiens
GTGNDLVRC

SEQ ID NO: 685113 - protein, 9 aa, Homo Sapiens
ASQSRARAQ

SEQ ID NO: 685114 - protein, 9 aa, Homo Sapiens
RTVELGQLP

SEQ ID NO: 685115 - protein, 9 aa, Homo Sapiens
PILTFHFQA

SEQ ID NO: 685116 - protein, 9 aa, Homo Sapiens
LGTGNDLVR

SEQ ID NO: 685117 - protein, 9 aa, Homo Sapiens
SYVGCFVQC

SEQ ID NO: 685118 - protein, 9 aa, Homo Sapiens
SHVEGSGVV

SEQ ID NO: 685119 - protein, 9 aa, Homo Sapiens
LVSATILDL

SEQ ID NO: 685120 - protein, 9 aa, Homo Sapiens
WFRPTFLQD

SEQ ID NO: 685121 - protein, 9 aa, Homo Sapiens
QMESLHSQP

SEQ ID NO: 685122 - protein, 9 aa, Homo Sapiens
YSAVIAMAI

SEQ ID NO: 685123 - protein, 9 aa, Homo Sapiens
DHDQVSIQS

SEQ ID NO: 685124 - protein, 9 aa, Homo Sapiens
VGAQLMAPL

SEQ ID NO: 685125 - protein, 9 aa, Homo Sapiens
NIGNVLVDA

SEQ ID NO: 685126 - protein, 9 aa, Homo Sapiens
SLWILRQLT

SEQ ID NO: 685127 - protein, 9 aa, Homo Sapiens
PILNASSRG

SEQ ID NO: 685128 - protein, 9 aa, Homo Sapiens
MTNAHFYCQ

SEQ ID NO: 685129 - protein, 9 aa, Homo Sapiens
ETHLKAVKL

SEQ ID NO: 685130 - protein, 9 aa, Homo Sapiens
VQDLLSEDQ

SEQ ID NO: 685131 - protein, 9 aa, Homo Sapiens
GAVAACAAR

SEQ ID NO: 685132 - protein, 9 aa, Homo Sapiens
ALFQKLTQK

SEQ ID NO: 685133 - protein, 9 aa, Homo Sapiens
PENPVIHYK

SEQ ID NO: 685134 - protein, 9 aa, Homo Sapiens
LGQLPALPA

SEQ ID NO: 685135 - protein, 9 aa, Homo Sapiens
GEKPHECEE

SEQ ID NO: 685136 - protein, 9 aa, Homo Sapiens
ILIVGLGTR

SEQ ID NO: 685137 - protein, 9 aa, Homo Sapiens
TITNYFNWV

SEQ ID NO: 685138 - protein, 9 aa, Homo Sapiens
LLSEDQGCS

SEQ ID NO: 685139 - protein, 9 aa, Homo Sapiens
ELQVAFAYC

SEQ ID NO: 685140 - protein, 9 aa, Homo Sapiens
RGITKMRLQ

SEQ ID NO: 685141 - protein, 9 aa, Homo Sapiens
SLRDTSDTL

SEQ ID NO: 685142 - protein, 9 aa, Homo Sapiens
QSWWTDTER

SEQ ID NO: 685143 - protein, 9 aa, Homo Sapiens
ISSMEGIME

SEQ ID NO: 685144 - protein, 9 aa, Homo Sapiens
AVPCSRSGS

SEQ ID NO: 685145 - protein, 9 aa, Homo Sapiens
TSPLPVTGA

SEQ ID NO: 685146 - protein, 9 aa, Homo Sapiens
YDRTEDTSY

SEQ ID NO: 685147 - protein, 9 aa, Homo Sapiens
SVLLMGFQL

SEQ ID NO: 685148 - protein, 9 aa, Homo Sapiens
VNGLYTYTF

SEQ ID NO: 685149 - protein, 9 aa, Homo Sapiens
TISRRNEIT

SEQ ID NO: 685150 - protein, 9 aa, Homo Sapiens
SPGATLTST

SEQ ID NO: 685151 - protein, 9 aa, Homo Sapiens
LHGDYLQLR

SEQ ID NO: 685152 - protein, 9 aa, Homo Sapiens
SLKVWDFYT

SEQ ID NO: 685153 - protein, 9 aa, Homo Sapiens
RPTFLQDSG

SEQ ID NO: 685154 - protein, 9 aa, Homo Sapiens
ETKWITSSR

SEQ ID NO: 685155 - protein, 9 aa, Homo Sapiens
EEMVQKMLL

SEQ ID NO: 685156 - protein, 9 aa, Homo Sapiens
STTSEKAYC

SEQ ID NO: 685157 - protein, 9 aa, Homo Sapiens
FDEKPSWDI

SEQ ID NO: 685158 - protein, 9 aa, Homo Sapiens
CETQLAFFL

SEQ ID NO: 685159 - protein, 9 aa, Homo Sapiens
DNIVAKRRS

SEQ ID NO: 685160 - protein, 9 aa, Homo Sapiens
NMNTLNTMN

SEQ ID NO: 685161 - protein, 9 aa, Homo Sapiens
TDSHTELPP

SEQ ID NO: 685162 - protein, 9 aa, Homo Sapiens
NRDNGHLFA

SEQ ID NO: 685163 - protein, 9 aa, Homo Sapiens
FSGGLQREA

SEQ ID NO: 685164 - protein, 9 aa, Homo Sapiens
AALQRLTWV

SEQ ID NO: 685165 - protein, 9 aa, Homo Sapiens
EVARSRDQD

SEQ ID NO: 685166 - protein, 9 aa, Homo Sapiens
LDALVAPTI

SEQ ID NO: 685167 - protein, 9 aa, Homo Sapiens
KYADSSISV

SEQ ID NO: 685168 - protein, 9 aa, Homo Sapiens
SGVELVNTS

SEQ ID NO: 685169 - protein, 9 aa, Homo Sapiens
INRDNGHLF

SEQ ID NO: 685170 - protein, 9 aa, Homo Sapiens
LNTMNGYSM

SEQ ID NO: 685171 - protein, 9 aa, Homo Sapiens
KPSLSALPG

SEQ ID NO: 685172 - protein, 9 aa, Homo Sapiens
VSSAVVVAL

SEQ ID NO: 685173 - protein, 9 aa, Homo Sapiens
SPSARVPTS

SEQ ID NO: 685174 - protein, 9 aa, Homo Sapiens
FRIPLNNAH

SEQ ID NO: 685175 - protein, 9 aa, Homo Sapiens
PENVLNVLS

SEQ ID NO: 685176 - protein, 9 aa, Homo Sapiens
DRFVAMCRP

SEQ ID NO: 685177 - protein, 9 aa, Homo Sapiens
PENLTHGDV

SEQ ID NO: 685178 - protein, 9 aa, Homo Sapiens
PYSRYDRTE

SEQ ID NO: 685179 - protein, 9 aa, Homo Sapiens
VTAVPSSRL

SEQ ID NO: 685180 - protein, 9 aa, Homo Sapiens
VAGTITVGV

SEQ ID NO: 685181 - protein, 9 aa, Homo Sapiens
LGPQGPLVC

SEQ ID NO: 685182 - protein, 9 aa, Homo Sapiens
ILRLGWSIF

SEQ ID NO: 685183 - protein, 9 aa, Homo Sapiens
SYFPCLVLF

SEQ ID NO: 685184 - protein, 9 aa, Homo Sapiens
RMYLLKSPL

SEQ ID NO: 685185 - protein, 9 aa, Homo Sapiens
ELLGERGTA

SEQ ID NO: 685186 - protein, 9 aa, Homo Sapiens
EEDSSSSKD

SEQ ID NO: 685187 - protein, 9 aa, Homo Sapiens
LKRRLIHQC

SEQ ID NO: 685188 - protein, 9 aa, Homo Sapiens
SVASSSASS

SEQ ID NO: 685189 - protein, 9 aa, Homo Sapiens
WPDGKMYSV

SEQ ID NO: 685190 - protein, 9 aa, Homo Sapiens
GSGVVSAKG

SEQ ID NO: 685191 - protein, 9 aa, Homo Sapiens
SATILDLSE

SEQ ID NO: 685192 - protein, 9 aa, Homo Sapiens
YSALITMAI

SEQ ID NO: 685193 - protein, 9 aa, Homo Sapiens
SSQVESTNE

SEQ ID NO: 685194 - protein, 9 aa, Homo Sapiens
QAKKAPTHI

SEQ ID NO: 685195 - protein, 9 aa, Homo Sapiens
QSLYDSVHS

SEQ ID NO: 685196 - protein, 9 aa, Homo Sapiens
HQRVHIGQK

SEQ ID NO: 685197 - protein, 9 aa, Homo Sapiens
ISRRNEITS

SEQ ID NO: 685198 - protein, 9 aa, Homo Sapiens
EGDFKGCTV

SEQ ID NO: 685199 - protein, 9 aa, Homo Sapiens
NFYNADPSK

SEQ ID NO: 685200 - protein, 9 aa, Homo Sapiens
PPGIPGHPG

SEQ ID NO: 685201 - protein, 9 aa, Homo Sapiens
LWLKHRRSE

SEQ ID NO: 685202 - protein, 9 aa, Homo Sapiens
LVSINRDNG

SEQ ID NO: 685203 - protein, 9 aa, Homo Sapiens
MADNIVAKR

SEQ ID NO: 685204 - protein, 9 aa, Homo Sapiens
LMPRMTRQK

SEQ ID NO: 685205 - protein, 9 aa, Homo Sapiens
GASTYSRVY

SEQ ID NO: 685206 - protein, 9 aa, Homo Sapiens
KSPSIATIK

SEQ ID NO: 685207 - protein, 9 aa, Homo Sapiens
NYFNWVVRN

SEQ ID NO: 685208 - protein, 9 aa, Homo Sapiens
QAAVEKDCL

SEQ ID NO: 685209 - protein, 9 aa, Homo Sapiens
STYESTLFE

SEQ ID NO: 685210 - protein, 9 aa, Homo Sapiens
RGRLLRITE

SEQ ID NO: 685211 - protein, 9 aa, Homo Sapiens
VQVSPLGIC

SEQ ID NO: 685212 - protein, 9 aa, Homo Sapiens
SLVSINRDN

SEQ ID NO: 685213 - protein, 9 aa, Homo Sapiens
ASPTQDGRP

SEQ ID NO: 685214 - protein, 9 aa, Homo Sapiens
LVCEASPFS

SEQ ID NO: 685215 - protein, 9 aa, Homo Sapiens
RKIGYYVIQ

SEQ ID NO: 685216 - protein, 9 aa, Homo Sapiens
ETKYNVTGL

SEQ ID NO: 685217 - protein, 9 aa, Homo Sapiens
SVSLTGVIV

SEQ ID NO: 685218 - protein, 9 aa, Homo Sapiens
SSQSARFYK

SEQ ID NO: 685219 - protein, 9 aa, Homo Sapiens
TTEDSEDED

SEQ ID NO: 685220 - protein, 9 aa, Homo Sapiens
LLTRSRSES

SEQ ID NO: 685221 - protein, 9 aa, Homo Sapiens
PEEAPDLGH

SEQ ID NO: 685222 - protein, 9 aa, Homo Sapiens
GPVGFTGPK

SEQ ID NO: 685223 - protein, 9 aa, Homo Sapiens
PRHPHHNQT

SEQ ID NO: 685224 - protein, 9 aa, Homo Sapiens
PARVVCCSM

SEQ ID NO: 685225 - protein, 9 aa, Homo Sapiens
QPKDQEKTH

SEQ ID NO: 685226 - protein, 9 aa, Homo Sapiens
CAARGQGGR

SEQ ID NO: 685227 - protein, 9 aa, Homo Sapiens
QMIQDQQQQ

SEQ ID NO: 685228 - protein, 9 aa, Homo Sapiens
LQQEEMVQK

SEQ ID NO: 685229 - protein, 9 aa, Homo Sapiens
KYLVYRHVP

SEQ ID NO: 685230 - protein, 9 aa, Homo Sapiens
KRDEWLAPW

SEQ ID NO: 685231 - protein, 9 aa, Homo Sapiens
FKGCTVSPQ

SEQ ID NO: 685232 - protein, 9 aa, Homo Sapiens
VRAVRNSKI

SEQ ID NO: 685233 - protein, 9 aa, Homo Sapiens
TKYASSALA

SEQ ID NO: 685234 - protein, 9 aa, Homo Sapiens
DRRGEPAGE

SEQ ID NO: 685235 - protein, 9 aa, Homo Sapiens
IQNPTLPLT

SEQ ID NO: 685236 - protein, 9 aa, Homo Sapiens
PDSILVPAV

SEQ ID NO: 685237 - protein, 9 aa, Homo Sapiens
GVVSAKGKR

SEQ ID NO: 685238 - protein, 9 aa, Homo Sapiens
VTVASASLE

SEQ ID NO: 685239 - protein, 9 aa, Homo Sapiens
PQRLPSPIS

SEQ ID NO: 685240 - protein, 9 aa, Homo Sapiens
LDLKRRLIH

SEQ ID NO: 685241 - protein, 9 aa, Homo Sapiens
LAFNDFDLE

SEQ ID NO: 685242 - protein, 9 aa, Homo Sapiens
PGSRIHLAF

SEQ ID NO: 685243 - protein, 9 aa, Homo Sapiens
PVTAVPSSR

SEQ ID NO: 685244 - protein, 9 aa, Homo Sapiens
VSATILDLS

SEQ ID NO: 685245 - protein, 9 aa, Homo Sapiens
DTSPLPVTG

SEQ ID NO: 685246 - protein, 9 aa, Homo Sapiens
SRPRHPHHN

SEQ ID NO: 685247 - protein, 9 aa, Homo Sapiens
SPQLLLRSL

SEQ ID NO: 685248 - protein, 9 aa, Homo Sapiens
IWFRPTFLQ

SEQ ID NO: 685249 - protein, 9 aa, Homo Sapiens
QLKFLEILE

SEQ ID NO: 685250 - protein, 9 aa, Homo Sapiens
TEPPCLLEA

SEQ ID NO: 685251 - protein, 9 aa, Homo Sapiens
ESDVLLDEP

SEQ ID NO: 685252 - protein, 9 aa, Homo Sapiens
TREKPYMCN

SEQ ID NO: 685253 - protein, 9 aa, Homo Sapiens
PPYSYSAVI

SEQ ID NO: 685254 - protein, 9 aa, Homo Sapiens
FETSRCDTL

SEQ ID NO: 685255 - protein, 9 aa, Homo Sapiens
SPTQDGRPP

SEQ ID NO: 685256 - protein, 9 aa, Homo Sapiens
HKKRSLEGM

SEQ ID NO: 685257 - protein, 9 aa, Homo Sapiens
LRSPSGTFA

SEQ ID NO: 685258 - protein, 9 aa, Homo Sapiens
SAFTLSAVG

SEQ ID NO: 685259 - protein, 9 aa, Homo Sapiens
PVIHYKRRS

SEQ ID NO: 685260 - protein, 9 aa, Homo Sapiens
LGGLDSLLL

SEQ ID NO: 685261 - protein, 9 aa, Homo Sapiens
APVVSRGGR

SEQ ID NO: 685262 - protein, 9 aa, Homo Sapiens
IPGHPGEPG

SEQ ID NO: 685263 - protein, 9 aa, Homo Sapiens
LVELLDNAR

SEQ ID NO: 685264 - protein, 9 aa, Homo Sapiens
HVPGTDPAC

SEQ ID NO: 685265 - protein, 9 aa, Homo Sapiens
CEEIADVLS

SEQ ID NO: 685266 - protein, 9 aa, Homo Sapiens
MQDDTNVQA

SEQ ID NO: 685267 - protein, 9 aa, Homo Sapiens
ALMGAQTVT

SEQ ID NO: 685268 - protein, 9 aa, Homo Sapiens
DSSSSKDSD

SEQ ID NO: 685269 - protein, 9 aa, Homo Sapiens
IKYTQSAFT

SEQ ID NO: 685270 - protein, 9 aa, Homo Sapiens
SGSGQAGTP

SEQ ID NO: 685271 - protein, 9 aa, Homo Sapiens
TTSEKAYCL

SEQ ID NO: 685272 - protein, 9 aa, Homo Sapiens
IGDHSMRAR

SEQ ID NO: 685273 - protein, 9 aa, Homo Sapiens
VVAFNTLML

SEQ ID NO: 685274 - protein, 9 aa, Homo Sapiens
FAIQNPTLP

SEQ ID NO: 685275 - protein, 9 aa, Homo Sapiens
IYTSVKLNR

SEQ ID NO: 685276 - protein, 9 aa, Homo Sapiens
HVEGSGVVS

SEQ ID NO: 685277 - protein, 9 aa, Homo Sapiens
QNSSDEDDD

SEQ ID NO: 685278 - protein, 9 aa, Homo Sapiens
EVWPAGEQE

SEQ ID NO: 685279 - protein, 9 aa, Homo Sapiens
RARAQDRNN

SEQ ID NO: 685280 - protein, 9 aa, Homo Sapiens
VTTEDSEDE

SEQ ID NO: 685281 - protein, 9 aa, Homo Sapiens
APQPIRNIM

SEQ ID NO: 685282 - protein, 9 aa, Homo Sapiens
EGEEGQDAS

SEQ ID NO: 685283 - protein, 9 aa, Homo Sapiens
GLDELEFHT

SEQ ID NO: 685284 - protein, 9 aa, Homo Sapiens
RNKVKFLTD

SEQ ID NO: 685285 - protein, 9 aa, Homo Sapiens
TLLQVQMHY

SEQ ID NO: 685286 - protein, 9 aa, Homo Sapiens
GPASSSPAA

SEQ ID NO: 685287 - protein, 9 aa, Homo Sapiens
MAEGVLPLR

SEQ ID NO: 685288 - protein, 9 aa, Homo Sapiens
RNQMESLHS

SEQ ID NO: 685289 - protein, 9 aa, Homo Sapiens
VELLDNARD

SEQ ID NO: 685290 - protein, 9 aa, Homo Sapiens
LEQELQKHV

SEQ ID NO: 685291 - protein, 9 aa, Homo Sapiens
FWRMYLLKS

SEQ ID NO: 685292 - protein, 9 aa, Homo Sapiens
ATEIFFYTS

SEQ ID NO: 685293 - protein, 9 aa, Homo Sapiens
CLRAVEVTE

SEQ ID NO: 685294 - protein, 9 aa, Homo Sapiens
EPEGAVAAC

SEQ ID NO: 685295 - protein, 9 aa, Homo Sapiens
RRKMTLVWR

SEQ ID NO: 685296 - protein, 9 aa, Homo Sapiens
ACQLKFLEI

SEQ ID NO: 685297 - protein, 9 aa, Homo Sapiens
VRNSKIYSV

SEQ ID NO: 685298 - protein, 9 aa, Homo Sapiens
SGQAGTPGE

SEQ ID NO: 685299 - protein, 9 aa, Homo Sapiens
TMVHPATPN

SEQ ID NO: 685300 - protein, 9 aa, Homo Sapiens
EDQGCSLPA

SEQ ID NO: 685301 - protein, 9 aa, Homo Sapiens
ISSDETRSL

SEQ ID NO: 685302 - protein, 9 aa, Homo Sapiens
IRKAASDVN

SEQ ID NO: 685303 - protein, 9 aa, Homo Sapiens
VGCFVQCYF

SEQ ID NO: 685304 - protein, 9 aa, Homo Sapiens
YILRLGWSI

SEQ ID NO: 685305 - protein, 9 aa, Homo Sapiens
MAPLSPGAT

SEQ ID NO: 685306 - protein, 9 aa, Homo Sapiens
VRCLRWGGG

SEQ ID NO: 685307 - protein, 9 aa, Homo Sapiens
DQEKTHSLS

SEQ ID NO: 685308 - protein, 9 aa, Homo Sapiens
EFPLERRQI

SEQ ID NO: 685309 - protein, 9 aa, Homo Sapiens
DVYAVPCSR

SEQ ID NO: 685310 - protein, 9 aa, Homo Sapiens
LPGPTVLAG

SEQ ID NO: 685311 - protein, 9 aa, Homo Sapiens
SGTLLQVQM

SEQ ID NO: 685312 - protein, 9 aa, Homo Sapiens
KSDCTGLPM

SEQ ID NO: 685313 - protein, 9 aa, Homo Sapiens
TDDKTTKIV

SEQ ID NO: 685314 - protein, 9 aa, Homo Sapiens
QVSPLGICL

SEQ ID NO: 685315 - protein, 9 aa, Homo Sapiens
LKAQLIDVR

SEQ ID NO: 685316 - protein, 9 aa, Homo Sapiens
QSFSPILNA

SEQ ID NO: 685317 - protein, 9 aa, Homo Sapiens
SWDIFKQFL

SEQ ID NO: 685318 - protein, 9 aa, Homo Sapiens
CNNQKHCHC

SEQ ID NO: 685319 - protein, 9 aa, Homo Sapiens
PPGASITQI

SEQ ID NO: 685320 - protein, 9 aa, Homo Sapiens
CPILSYSGQ

SEQ ID NO: 685321 - protein, 9 aa, Homo Sapiens
EATQSLSHE

SEQ ID NO: 685322 - protein, 9 aa, Homo Sapiens
DYLQLRETV

SEQ ID NO: 685323 - protein, 9 aa, Homo Sapiens
VSQVPRGAE

SEQ ID NO: 685324 - protein, 9 aa, Homo Sapiens
TPRTSQEDL

SEQ ID NO: 685325 - protein, 9 aa, Homo Sapiens
TVILISKDR

SEQ ID NO: 685326 - protein, 9 aa, Homo Sapiens
SSLYEEALG

SEQ ID NO: 685327 - protein, 9 aa, Homo Sapiens
MNFETSRCD

SEQ ID NO: 685328 - protein, 9 aa, Homo Sapiens
GINGTVNSK

SEQ ID NO: 685329 - protein, 9 aa, Homo Sapiens
RIHLAFNDF

SEQ ID NO: 685330 - protein, 9 aa, Homo Sapiens
IEIGLLHNL

SEQ ID NO: 685331 - protein, 9 aa, Homo Sapiens
KKQNESISR

SEQ ID NO: 685332 - protein, 9 aa, Homo Sapiens
EDRESDVDW

SEQ ID NO: 685333 - protein, 9 aa, Homo Sapiens
TNCITTSCI

SEQ ID NO: 685334 - protein, 9 aa, Homo Sapiens
TAVPSSRLS

SEQ ID NO: 685335 - protein, 9 aa, Homo Sapiens
TEVSGTLLQ

SEQ ID NO: 685336 - protein, 9 aa, Homo Sapiens
SILVFVSSA

SEQ ID NO: 685337 - protein, 9 aa, Homo Sapiens
GAQLMAPLS

SEQ ID NO: 685338 - protein, 9 aa, Homo Sapiens
FSPILNASS

SEQ ID NO: 685339 - protein, 9 aa, Homo Sapiens
QGYDSSPLT

SEQ ID NO: 685340 - protein, 9 aa, Homo Sapiens
EAPSKSHKK

SEQ ID NO: 685341 - protein, 9 aa, Homo Sapiens
KRRRRTMRR

SEQ ID NO: 685342 - protein, 9 aa, Homo Sapiens
DSSPLTPLS

SEQ ID NO: 685343 - protein, 9 aa, Homo Sapiens
ARAQDRNNV

SEQ ID NO: 685344 - protein, 9 aa, Homo Sapiens
EETFGFLLM

SEQ ID NO: 685345 - protein, 9 aa, Homo Sapiens
QDASGLLRE

SEQ ID NO: 685346 - protein, 9 aa, Homo Sapiens
ALQRLTWVC

SEQ ID NO: 685347 - protein, 9 aa, Homo Sapiens
PEVFDFSQR

SEQ ID NO: 685348 - protein, 9 aa, Homo Sapiens
VDTPSHSSQ

SEQ ID NO: 685349 - protein, 9 aa, Homo Sapiens
HTREKPYMC

SEQ ID NO: 685350 - protein, 9 aa, Homo Sapiens
AMPWALSVL

SEQ ID NO: 685351 - protein, 9 aa, Homo Sapiens
RMRQMLITE

SEQ ID NO: 685352 - protein, 9 aa, Homo Sapiens
TSPQGDALL

SEQ ID NO: 685353 - protein, 9 aa, Homo Sapiens
HREEDLQGL

SEQ ID NO: 685354 - protein, 9 aa, Homo Sapiens
DFKDVKNKT

SEQ ID NO: 685355 - protein, 9 aa, Homo Sapiens
TKWITSSRI

SEQ ID NO: 685356 - protein, 9 aa, Homo Sapiens
IDQKKGLDE

SEQ ID NO: 685357 - protein, 9 aa, Homo Sapiens
VVITPPSNT

SEQ ID NO: 685358 - protein, 9 aa, Homo Sapiens
VCPARVVCC

SEQ ID NO: 685359 - protein, 9 aa, Homo Sapiens
NNVGEEDCT

SEQ ID NO: 685360 - protein, 9 aa, Homo Sapiens
EHQRVHTRE

SEQ ID NO: 685361 - protein, 9 aa, Homo Sapiens
GAQTVTSGH

SEQ ID NO: 685362 - protein, 9 aa, Homo Sapiens
YSQNAIQPL

SEQ ID NO: 685363 - protein, 9 aa, Homo Sapiens
GATLTSTSC

SEQ ID NO: 685364 - protein, 9 aa, Homo Sapiens
MTFGGKPND

SEQ ID NO: 685365 - protein, 9 aa, Homo Sapiens
FEHHGKKLQ

SEQ ID NO: 685366 - protein, 9 aa, Homo Sapiens
PGATLTSTS

SEQ ID NO: 685367 - protein, 9 aa, Homo Sapiens
SAFICLISI

SEQ ID NO: 685368 - protein, 9 aa, Homo Sapiens
VAACAARGQ

SEQ ID NO: 685369 - protein, 9 aa, Homo Sapiens
ITSEGNVTT

SEQ ID NO: 685370 - protein, 9 aa, Homo Sapiens
GRWRQESVN

SEQ ID NO: 685371 - protein, 9 aa, Homo Sapiens
PYAGGVGAQ

SEQ ID NO: 685372 - protein, 9 aa, Homo Sapiens
EDSSSSKDS

SEQ ID NO: 685373 - protein, 9 aa, Homo Sapiens
YTEVSGTLL

SEQ ID NO: 685374 - protein, 9 aa, Homo Sapiens
DKNPCLHGD

SEQ ID NO: 685375 - protein, 9 aa, Homo Sapiens
SVHVSAEDV

SEQ ID NO: 685376 - protein, 9 aa, Homo Sapiens
PEGAVAACA

SEQ ID NO: 685377 - protein, 9 aa, Homo Sapiens
IGNVLVDAS

SEQ ID NO: 685378 - protein, 9 aa, Homo Sapiens
LLLRSLGWA

SEQ ID NO: 685379 - protein, 9 aa, Homo Sapiens
STPVTAVPS

SEQ ID NO: 685380 - protein, 9 aa, Homo Sapiens
TSVYSQNAI

SEQ ID NO: 685381 - protein, 9 aa, Homo Sapiens
LPHRSMLRG

SEQ ID NO: 685382 - protein, 9 aa, Homo Sapiens
PTRLLVKGP

SEQ ID NO: 685383 - protein, 9 aa, Homo Sapiens
TLTSTSCST

SEQ ID NO: 685384 - protein, 9 aa, Homo Sapiens
LQHGGPRRP

SEQ ID NO: 685385 - protein, 9 aa, Homo Sapiens
ASSSDTTAP

SEQ ID NO: 685386 - protein, 9 aa, Homo Sapiens
VVSAKGKRK

SEQ ID NO: 685387 - protein, 9 aa, Homo Sapiens
ITQISASDP

SEQ ID NO: 685388 - protein, 9 aa, Homo Sapiens
EVISLWILR

SEQ ID NO: 685389 - protein, 9 aa, Homo Sapiens
HTPENPVIH

SEQ ID NO: 685390 - protein, 9 aa, Homo Sapiens
RLLVKGPVT

SEQ ID NO: 685391 - protein, 9 aa, Homo Sapiens
PSASWSRCW

SEQ ID NO: 685392 - protein, 9 aa, Homo Sapiens
PQGPVGFTG

SEQ ID NO: 685393 - protein, 9 aa, Homo Sapiens
TQMCFFVLL

SEQ ID NO: 685394 - protein, 9 aa, Homo Sapiens
TMSCLSRPG

SEQ ID NO: 685395 - protein, 9 aa, Homo Sapiens
PPEVWPAGE

SEQ ID NO: 685396 - protein, 9 aa, Homo Sapiens
LAVVSSPDP

SEQ ID NO: 685397 - protein, 9 aa, Homo Sapiens
CTGLPMSML

SEQ ID NO: 685398 - protein, 9 aa, Homo Sapiens
LKRKIGYYV

SEQ ID NO: 685399 - protein, 9 aa, Homo Sapiens
DLLSEDQGC

SEQ ID NO: 685400 - protein, 9 aa, Homo Sapiens
IAASQGYSP

SEQ ID NO: 685401 - protein, 9 aa, Homo Sapiens
RSPSGTFAA

SEQ ID NO: 685402 - protein, 9 aa, Homo Sapiens
LITMAIQSA

SEQ ID NO: 685403 - protein, 9 aa, Homo Sapiens
QFLATTDLA

SEQ ID NO: 685404 - protein, 9 aa, Homo Sapiens
ELAVVSSPD

SEQ ID NO: 685405 - protein, 9 aa, Homo Sapiens
YHMEHGIIT

SEQ ID NO: 685406 - protein, 9 aa, Homo Sapiens
VKLWLKHRR

SEQ ID NO: 685407 - protein, 9 aa, Homo Sapiens
TAPLRKYAD

SEQ ID NO: 685408 - protein, 9 aa, Homo Sapiens
AQLMAPLSP

SEQ ID NO: 685409 - protein, 9 aa, Homo Sapiens
DRGVCNNQK

SEQ ID NO: 685410 - protein, 9 aa, Homo Sapiens
MPPQASSSD

SEQ ID NO: 685411 - protein, 9 aa, Homo Sapiens
SFSSLYEEA

SEQ ID NO: 685412 - protein, 9 aa, Homo Sapiens
AAVEKDCLR

SEQ ID NO: 685413 - protein, 9 aa, Homo Sapiens
LDLDRRGEP

SEQ ID NO: 685414 - protein, 9 aa, Homo Sapiens
YTSVKLNRE

SEQ ID NO: 685415 - protein, 9 aa, Homo Sapiens
ASRIFSHCD

SEQ ID NO: 685416 - protein, 9 aa, Homo Sapiens
GGLQREAPV

SEQ ID NO: 685417 - protein, 9 aa, Homo Sapiens
HMPTFCPEN

SEQ ID NO: 685418 - protein, 9 aa, Homo Sapiens
DFQPLFGVL

SEQ ID NO: 685419 - protein, 9 aa, Homo Sapiens
ESLVCPHLE

SEQ ID NO: 685420 - protein, 9 aa, Homo Sapiens
PNLTVPKEK

SEQ ID NO: 685421 - protein, 9 aa, Homo Sapiens
TSCIGDHSM

SEQ ID NO: 685422 - protein, 9 aa, Homo Sapiens
CLLEGVNQL

SEQ ID NO: 685423 - protein, 9 aa, Homo Sapiens
LSALPGPTV

SEQ ID NO: 685424 - protein, 9 aa, Homo Sapiens
MCRPLHYTA

SEQ ID NO: 685425 - protein, 9 aa, Homo Sapiens
CATEIFFYT

SEQ ID NO: 685426 - protein, 9 aa, Homo Sapiens
ITSVHVSAE

SEQ ID NO: 685427 - protein, 9 aa, Homo Sapiens
KIVCKSPPP

SEQ ID NO: 685428 - protein, 9 aa, Homo Sapiens
HHNQTFAGK

SEQ ID NO: 685429 - protein, 9 aa, Homo Sapiens
GRLEKLSCE

SEQ ID NO: 685430 - protein, 9 aa, Homo Sapiens
TNVQAPRLA

SEQ ID NO: 685431 - protein, 9 aa, Homo Sapiens
DSSNYIPQL

SEQ ID NO: 685432 - protein, 9 aa, Homo Sapiens
FVQCYFFIA

SEQ ID NO: 685433 - protein, 9 aa, Homo Sapiens
NPCLHGDYL

SEQ ID NO: 685434 - protein, 9 aa, Homo Sapiens
PSWDIFKQF

SEQ ID NO: 685435 - protein, 9 aa, Homo Sapiens
LSMLLGNTL

SEQ ID NO: 685436 - protein, 9 aa, Homo Sapiens
GSSGGISSD

SEQ ID NO: 685437 - protein, 9 aa, Homo Sapiens
TMNGYSMSQ

SEQ ID NO: 685438 - protein, 9 aa, Homo Sapiens
RRTMRRKMT

SEQ ID NO: 685439 - protein, 9 aa, Homo Sapiens
AVRNSKIYS

SEQ ID NO: 685440 - protein, 9 aa, Homo Sapiens
PQGPLVCEA

SEQ ID NO: 685441 - protein, 9 aa, Homo Sapiens
WITSSRIRE

SEQ ID NO: 685442 - protein, 9 aa, Homo Sapiens
LREQIVHGE

SEQ ID NO: 685443 - protein, 9 aa, Homo Sapiens
YSYSAVIAM

SEQ ID NO: 685444 - protein, 9 aa, Homo Sapiens
MIQDQQQQI

SEQ ID NO: 685445 - protein, 9 aa, Homo Sapiens
PFPLMTKAV

SEQ ID NO: 685446 - protein, 9 aa, Homo Sapiens
GGGHPVVIR

SEQ ID NO: 685447 - protein, 9 aa, Homo Sapiens
LNGQQTLSA

SEQ ID NO: 685448 - protein, 9 aa, Homo Sapiens
LVLQLIFGY

SEQ ID NO: 685449 - protein, 9 aa, Homo Sapiens
YGRQIRVDH

SEQ ID NO: 685450 - protein, 9 aa, Homo Sapiens
QERERERER

SEQ ID NO: 685451 - protein, 9 aa, Homo Sapiens
LANLLINHY

SEQ ID NO: 685452 - protein, 9 aa, Homo Sapiens
DSILVPAVT

SEQ ID NO: 685453 - protein, 9 aa, Homo Sapiens
DGEPILTFH

SEQ ID NO: 685454 - protein, 9 aa, Homo Sapiens
LSYSGQTPL

SEQ ID NO: 685455 - protein, 9 aa, Homo Sapiens
LPSASWSRC

SEQ ID NO: 685456 - protein, 9 aa, Homo Sapiens
LPEAIHLDK

SEQ ID NO: 685457 - protein, 9 aa, Homo Sapiens
LERCYNDVR

SEQ ID NO: 685458 - protein, 9 aa, Homo Sapiens
WVLVGNRYC

SEQ ID NO: 685459 - protein, 9 aa, Homo Sapiens
QPDEYLDPD

SEQ ID NO: 685460 - protein, 9 aa, Homo Sapiens
RQGNIGNPP

SEQ ID NO: 685461 - protein, 9 aa, Homo Sapiens
NCLQHALEK

SEQ ID NO: 685462 - protein, 9 aa, Homo Sapiens
LVFSDQPRL

SEQ ID NO: 685463 - protein, 9 aa, Homo Sapiens
RPPATFQAT

SEQ ID NO: 685464 - protein, 9 aa, Homo Sapiens
NPKLQTQVR

SEQ ID NO: 685465 - protein, 9 aa, Homo Sapiens
SMRSEEEGE

SEQ ID NO: 685466 - protein, 9 aa, Homo Sapiens
DEVIIPLWL

SEQ ID NO: 685467 - protein, 9 aa, Homo Sapiens
DSPGRPEAI

SEQ ID NO: 685468 - protein, 9 aa, Homo Sapiens
VPVEQPDEY

SEQ ID NO: 685469 - protein, 9 aa, Homo Sapiens
VGPSKPLSQ

SEQ ID NO: 685470 - protein, 9 aa, Homo Sapiens
QWARGEDAL

SEQ ID NO: 685471 - protein, 9 aa, Homo Sapiens
QSGAPGAPT

SEQ ID NO: 685472 - protein, 9 aa, Homo Sapiens
CVSLSNVEA

SEQ ID NO: 685473 - protein, 9 aa, Homo Sapiens
RFPPMVDAV

SEQ ID NO: 685474 - protein, 9 aa, Homo Sapiens
LFHYCGVCL

SEQ ID NO: 685475 - protein, 9 aa, Homo Sapiens
ILVWGSECA

SEQ ID NO: 685476 - protein, 9 aa, Homo Sapiens
AYSILECKI

SEQ ID NO: 685477 - protein, 9 aa, Homo Sapiens
SVQAAIQVD

SEQ ID NO: 685478 - protein, 9 aa, Homo Sapiens
KVLESSAPS

SEQ ID NO: 685479 - protein, 9 aa, Homo Sapiens
NTGPTLEWH

SEQ ID NO: 685480 - protein, 9 aa, Homo Sapiens
SEDPMMMTA

SEQ ID NO: 685481 - protein, 9 aa, Homo Sapiens
EYYFYGKGK

SEQ ID NO: 685482 - protein, 9 aa, Homo Sapiens
STAKKCLSC

SEQ ID NO: 685483 - protein, 9 aa, Homo Sapiens
YYIFLFALS

SEQ ID NO: 685484 - protein, 9 aa, Homo Sapiens
RCYNDVRLL

SEQ ID NO: 685485 - protein, 9 aa, Homo Sapiens
WARGEDALQ

SEQ ID NO: 685486 - protein, 9 aa, Homo Sapiens
AKKCLSCQN

SEQ ID NO: 685487 - protein, 9 aa, Homo Sapiens
KFSPSERTY

SEQ ID NO: 685488 - protein, 9 aa, Homo Sapiens
WQGKIRELN

SEQ ID NO: 685489 - protein, 9 aa, Homo Sapiens
CKIQGMSVF

SEQ ID NO: 685490 - protein, 9 aa, Homo Sapiens
QNLQEQVFP

SEQ ID NO: 685491 - protein, 9 aa, Homo Sapiens
APSSCSSPG

SEQ ID NO: 685492 - protein, 9 aa, Homo Sapiens
LQEQVFPEP

SEQ ID NO: 685493 - protein, 9 aa, Homo Sapiens
PPLPRAGIP

SEQ ID NO: 685494 - protein, 9 aa, Homo Sapiens
GQDTLPVAA

SEQ ID NO: 685495 - protein, 9 aa, Homo Sapiens
IGGQKSLRS

SEQ ID NO: 685496 - protein, 9 aa, Homo Sapiens
RKTVMIDVC

SEQ ID NO: 685497 - protein, 9 aa, Homo Sapiens
ISPLTLTTP

SEQ ID NO: 685498 - protein, 9 aa, Homo Sapiens
PGPKWKLYS

SEQ ID NO: 685499 - protein, 9 aa, Homo Sapiens
HKVDGPFFL

SEQ ID NO: 685500 - protein, 9 aa, Homo Sapiens
KFTQSSMRS

SEQ ID NO: 685501 - protein, 9 aa, Homo Sapiens
SDPMDIVVT

SEQ ID NO: 685502 - protein, 9 aa, Homo Sapiens
WKLYSAVPG

SEQ ID NO: 685503 - protein, 9 aa, Homo Sapiens
TAKFSPSER

SEQ ID NO: 685504 - protein, 9 aa, Homo Sapiens
QNLPTVTLP

SEQ ID NO: 685505 - protein, 9 aa, Homo Sapiens
HALEKETMT

SEQ ID NO: 685506 - protein, 9 aa, Homo Sapiens
PRWWEHGPE

SEQ ID NO: 685507 - protein, 9 aa, Homo Sapiens
SKPLSQPRR

SEQ ID NO: 685508 - protein, 9 aa, Homo Sapiens
SLYISFVSL

SEQ ID NO: 685509 - protein, 9 aa, Homo Sapiens
SWIPVQIPA

SEQ ID NO: 685510 - protein, 9 aa, Homo Sapiens
KILVNEDVP

SEQ ID NO: 685511 - protein, 9 aa, Homo Sapiens
RYKMEDNSA

SEQ ID NO: 685512 - protein, 9 aa, Homo Sapiens
WYVSSTFPK

SEQ ID NO: 685513 - protein, 9 aa, Homo Sapiens
FLHEKQREL

SEQ ID NO: 685514 - protein, 9 aa, Homo Sapiens
HSYEILCLL

SEQ ID NO: 685515 - protein, 9 aa, Homo Sapiens
DGRVTVGQP

SEQ ID NO: 685516 - protein, 9 aa, Homo Sapiens
PVACLLEPT

SEQ ID NO: 685517 - protein, 9 aa, Homo Sapiens
LNGTVIGPR

SEQ ID NO: 685518 - protein, 9 aa, Homo Sapiens
LEFLHEKQR

SEQ ID NO: 685519 - protein, 9 aa, Homo Sapiens
TDEVIIPLW

SEQ ID NO: 685520 - protein, 9 aa, Homo Sapiens
LTFLGTQDD

SEQ ID NO: 685521 - protein, 9 aa, Homo Sapiens
IPLLLLLLV

SEQ ID NO: 685522 - protein, 9 aa, Homo Sapiens
CVNTMGNYM

SEQ ID NO: 685523 - protein, 9 aa, Homo Sapiens
EDKTDIKKR

SEQ ID NO: 685524 - protein, 9 aa, Homo Sapiens
FPFFEARPE

SEQ ID NO: 685525 - protein, 9 aa, Homo Sapiens
SPGRPEAII

SEQ ID NO: 685526 - protein, 9 aa, Homo Sapiens
VEIRSNEIR

SEQ ID NO: 685527 - protein, 9 aa, Homo Sapiens
LPRAGIPPP

SEQ ID NO: 685528 - protein, 9 aa, Homo Sapiens
LSNKCVSSI

SEQ ID NO: 685529 - protein, 9 aa, Homo Sapiens
AILISLPIW

SEQ ID NO: 685530 - protein, 9 aa, Homo Sapiens
DYGLLTAEA

SEQ ID NO: 685531 - protein, 9 aa, Homo Sapiens
KEMSEYYFY

SEQ ID NO: 685532 - protein, 9 aa, Homo Sapiens
NSKVSDTAY

SEQ ID NO: 685533 - protein, 9 aa, Homo Sapiens
YYFYGKGKA

SEQ ID NO: 685534 - protein, 9 aa, Homo Sapiens
SHHHLSKQK

SEQ ID NO: 685535 - protein, 9 aa, Homo Sapiens
QVSTEDLKT

SEQ ID NO: 685536 - protein, 9 aa, Homo Sapiens
LSAPSSCSS

SEQ ID NO: 685537 - protein, 9 aa, Homo Sapiens
CALSLIGLG

SEQ ID NO: 685538 - protein, 9 aa, Homo Sapiens
QTILQLQNK

SEQ ID NO: 685539 - protein, 9 aa, Homo Sapiens
MPPWLSDSS

SEQ ID NO: 685540 - protein, 9 aa, Homo Sapiens
KPLSQPRRN

SEQ ID NO: 685541 - protein, 9 aa, Homo Sapiens
VSTEDLKTL

SEQ ID NO: 685542 - protein, 9 aa, Homo Sapiens
QKALKLLAT

SEQ ID NO: 685543 - protein, 9 aa, Homo Sapiens
WHNYDLRED

SEQ ID NO: 685544 - protein, 9 aa, Homo Sapiens
GTVIGPRKT

SEQ ID NO: 685545 - protein, 9 aa, Homo Sapiens
PKPSLLTHL

SEQ ID NO: 685546 - protein, 9 aa, Homo Sapiens
PLFFAEKLY

SEQ ID NO: 685547 - protein, 9 aa, Homo Sapiens
EVPVEQPDE

SEQ ID NO: 685548 - protein, 9 aa, Homo Sapiens
FYEVQPQVS

SEQ ID NO: 685549 - protein, 9 aa, Homo Sapiens
DEFRNMLTR

SEQ ID NO: 685550 - protein, 9 aa, Homo Sapiens
SRISALLIH

SEQ ID NO: 685551 - protein, 9 aa, Homo Sapiens
DASYLAEGG

SEQ ID NO: 685552 - protein, 9 aa, Homo Sapiens
SSTFPKMLV

SEQ ID NO: 685553 - protein, 9 aa, Homo Sapiens
DIKKRQIKD

SEQ ID NO: 685554 - protein, 9 aa, Homo Sapiens
ATMVQHGEA

SEQ ID NO: 685555 - protein, 9 aa, Homo Sapiens
GQVNATDEV

SEQ ID NO: 685556 - protein, 9 aa, Homo Sapiens
LMPPWLSDS

SEQ ID NO: 685557 - protein, 9 aa, Homo Sapiens
GEALNRSVQ

SEQ ID NO: 685558 - protein, 9 aa, Homo Sapiens
VQHGEALNR

SEQ ID NO: 685559 - protein, 9 aa, Homo Sapiens
HVVEKVETE

SEQ ID NO: 685560 - protein, 9 aa, Homo Sapiens
VTVGQPCTR

SEQ ID NO: 685561 - protein, 9 aa, Homo Sapiens
ILPLPPLPR

SEQ ID NO: 685562 - protein, 9 aa, Homo Sapiens
ARDPCDSPG

SEQ ID NO: 685563 - protein, 9 aa, Homo Sapiens
IKWLRRLKS

SEQ ID NO: 685564 - protein, 9 aa, Homo Sapiens
VVVVGALVV

SEQ ID NO: 685565 - protein, 9 aa, Homo Sapiens
QEYFEKQGA

SEQ ID NO: 685566 - protein, 9 aa, Homo Sapiens
VCSFGKHVV

SEQ ID NO: 685567 - protein, 9 aa, Homo Sapiens
LREITLLSS

SEQ ID NO: 685568 - protein, 9 aa, Homo Sapiens
SQRWFNLYL

SEQ ID NO: 685569 - protein, 9 aa, Homo Sapiens
FSEEALFRD

SEQ ID NO: 685570 - protein, 9 aa, Homo Sapiens
QLSAPSDPM

SEQ ID NO: 685571 - protein, 9 aa, Homo Sapiens
VEQPDEYLD

SEQ ID NO: 685572 - protein, 9 aa, Homo Sapiens
ETIPCDAVE

SEQ ID NO: 685573 - protein, 9 aa, Homo Sapiens
PRKACNAWL

SEQ ID NO: 685574 - protein, 9 aa, Homo Sapiens
PSERTYDGK

SEQ ID NO: 685575 - protein, 9 aa, Homo Sapiens
TQSSMRSEE

SEQ ID NO: 685576 - protein, 9 aa, Homo Sapiens
KTITRSTVS

SEQ ID NO: 685577 - protein, 9 aa, Homo Sapiens
LVGNRYCDI

SEQ ID NO: 685578 - protein, 9 aa, Homo Sapiens
KWKLYSAVP

SEQ ID NO: 685579 - protein, 9 aa, Homo Sapiens
LRAVLQDDA

SEQ ID NO: 685580 - protein, 9 aa, Homo Sapiens
KTFFQMFPA

SEQ ID NO: 685581 - protein, 9 aa, Homo Sapiens
FIFAGHDTT

SEQ ID NO: 685582 - protein, 9 aa, Homo Sapiens
SIGFTLAHK

SEQ ID NO: 685583 - protein, 9 aa, Homo Sapiens
ISHHHLSKQ

SEQ ID NO: 685584 - protein, 9 aa, Homo Sapiens
VSDTAYRVS

SEQ ID NO: 685585 - protein, 9 aa, Homo Sapiens
KNVKQHADL

SEQ ID NO: 685586 - protein, 9 aa, Homo Sapiens
ETEKMRNSD

SEQ ID NO: 685587 - protein, 9 aa, Homo Sapiens
STEPAPRSP

SEQ ID NO: 685588 - protein, 9 aa, Homo Sapiens
VLEDGLDPV

SEQ ID NO: 685589 - protein, 9 aa, Homo Sapiens
MGNYMCQCR

SEQ ID NO: 685590 - protein, 9 aa, Homo Sapiens
GQFIKEVVK

SEQ ID NO: 685591 - protein, 9 aa, Homo Sapiens
PKAVQRFPP

SEQ ID NO: 685592 - protein, 9 aa, Homo Sapiens
CGPPLVTHS

SEQ ID NO: 685593 - protein, 9 aa, Homo Sapiens
APLWEIKKQ

SEQ ID NO: 685594 - protein, 9 aa, Homo Sapiens
DSVRRAVYK

SEQ ID NO: 685595 - protein, 9 aa, Homo Sapiens
PVAPRKACN

SEQ ID NO: 685596 - protein, 9 aa, Homo Sapiens
IRLKRALYF

SEQ ID NO: 685597 - protein, 9 aa, Homo Sapiens
LCIPEKHLG

SEQ ID NO: 685598 - protein, 9 aa, Homo Sapiens
EEWEKAQKV

SEQ ID NO: 685599 - protein, 9 aa, Homo Sapiens
PRAGIPPPP

SEQ ID NO: 685600 - protein, 9 aa, Homo Sapiens
LVLENNKNY

SEQ ID NO: 685601 - protein, 9 aa, Homo Sapiens
VARDPCDSP

SEQ ID NO: 685602 - protein, 9 aa, Homo Sapiens
HVYAVIMTD

SEQ ID NO: 685603 - protein, 9 aa, Homo Sapiens
SPVACLLEP

SEQ ID NO: 685604 - protein, 9 aa, Homo Sapiens
SMISPLTLT

SEQ ID NO: 685605 - protein, 9 aa, Homo Sapiens
RTEAGGLGM

SEQ ID NO: 685606 - protein, 9 aa, Homo Sapiens
HLCCVSISE

SEQ ID NO: 685607 - protein, 9 aa, Homo Sapiens
SLDAIEKSS

SEQ ID NO: 685608 - protein, 9 aa, Homo Sapiens
RNSDNSSTA

SEQ ID NO: 685609 - protein, 9 aa, Homo Sapiens
DFREHNFNT

SEQ ID NO: 685610 - protein, 9 aa, Homo Sapiens
PLSMISPLT

SEQ ID NO: 685611 - protein, 9 aa, Homo Sapiens
IPPRYKMED

SEQ ID NO: 685612 - protein, 9 aa, Homo Sapiens
NGDFREHNF

SEQ ID NO: 685613 - protein, 9 aa, Homo Sapiens
AHQVLQHPC

SEQ ID NO: 685614 - protein, 9 aa, Homo Sapiens
QHADLTVNE

SEQ ID NO: 685615 - protein, 9 aa, Homo Sapiens
TVGQPCTRK

SEQ ID NO: 685616 - protein, 9 aa, Homo Sapiens
LPFPTVFLS

SEQ ID NO: 685617 - protein, 9 aa, Homo Sapiens
QQNLPTVTL

SEQ ID NO: 685618 - protein, 9 aa, Homo Sapiens
IILVWGSEC

SEQ ID NO: 685619 - protein, 9 aa, Homo Sapiens
GNMLMVTLS

SEQ ID NO: 685620 - protein, 9 aa, Homo Sapiens
GGNKLQLTG

SEQ ID NO: 685621 - protein, 9 aa, Homo Sapiens
VFSDQPRLE

SEQ ID NO: 685622 - protein, 9 aa, Homo Sapiens
LESSAPSEV

SEQ ID NO: 685623 - protein, 9 aa, Homo Sapiens
MGLSLSYLP

SEQ ID NO: 685624 - protein, 9 aa, Homo Sapiens
DHYNWGLRA

SEQ ID NO: 685625 - protein, 9 aa, Homo Sapiens
GISCSSEIG

SEQ ID NO: 685626 - protein, 9 aa, Homo Sapiens
VQVSTEDLK

SEQ ID NO: 685627 - protein, 9 aa, Homo Sapiens
EITLLSSQS

SEQ ID NO: 685628 - protein, 9 aa, Homo Sapiens
ALKLLATGR

SEQ ID NO: 685629 - protein, 9 aa, Homo Sapiens
RKKGPARLL

SEQ ID NO: 685630 - protein, 9 aa, Homo Sapiens
NKSHLFVYE

SEQ ID NO: 685631 - protein, 9 aa, Homo Sapiens
RDILVDADS

SEQ ID NO: 685632 - protein, 9 aa, Homo Sapiens
CIETAGKTN

SEQ ID NO: 685633 - protein, 9 aa, Homo Sapiens
SSVLCDCQL

SEQ ID NO: 685634 - protein, 9 aa, Homo Sapiens
FKTITRSTV

SEQ ID NO: 685635 - protein, 9 aa, Homo Sapiens
GELTFLGTQ

SEQ ID NO: 685636 - protein, 9 aa, Homo Sapiens
LFPSRTPGW

SEQ ID NO: 685637 - protein, 9 aa, Homo Sapiens
RQSVQAAIQ

SEQ ID NO: 685638 - protein, 9 aa, Homo Sapiens
MLEKTPSYF

SEQ ID NO: 685639 - protein, 9 aa, Homo Sapiens
CDVEIRSNE

SEQ ID NO: 685640 - protein, 9 aa, Homo Sapiens
TACLIAVSK

SEQ ID NO: 685641 - protein, 9 aa, Homo Sapiens
MILIVFFVA

SEQ ID NO: 685642 - protein, 9 aa, Homo Sapiens
CSSPGAGVS

SEQ ID NO: 685643 - protein, 9 aa, Homo Sapiens
VGQPCTRKK

SEQ ID NO: 685644 - protein, 9 aa, Homo Sapiens
VLQDDAVYE

SEQ ID NO: 685645 - protein, 9 aa, Homo Sapiens
AALILGPLL

SEQ ID NO: 685646 - protein, 9 aa, Homo Sapiens
VRTILARGC

SEQ ID NO: 685647 - protein, 9 aa, Homo Sapiens
KDPCELLPL

SEQ ID NO: 685648 - protein, 9 aa, Homo Sapiens
FSGTPGIVK

SEQ ID NO: 685649 - protein, 9 aa, Homo Sapiens
TTEIPPRYK

SEQ ID NO: 685650 - protein, 9 aa, Homo Sapiens
MGEGGGPAG

SEQ ID NO: 685651 - protein, 9 aa, Homo Sapiens
VTSISDETH

SEQ ID NO: 685652 - protein, 9 aa, Homo Sapiens
PWCPKTGEL

SEQ ID NO: 685653 - protein, 9 aa, Homo Sapiens
LSLSYLPTM

SEQ ID NO: 685654 - protein, 9 aa, Homo Sapiens
TPPGAAVAS

SEQ ID NO: 685655 - protein, 9 aa, Homo Sapiens
AQRMIKEEI

SEQ ID NO: 685656 - protein, 9 aa, Homo Sapiens
LTLIQKVFS

SEQ ID NO: 685657 - protein, 9 aa, Homo Sapiens
TFSRISALL

SEQ ID NO: 685658 - protein, 9 aa, Homo Sapiens
LGMGEGGGP

SEQ ID NO: 685659 - protein, 9 aa, Homo Sapiens
NCGPPLVTH

SEQ ID NO: 685660 - protein, 9 aa, Homo Sapiens
SYLPRWWEH

SEQ ID NO: 685661 - protein, 9 aa, Homo Sapiens
TEIPPRYKM

SEQ ID NO: 685662 - protein, 9 aa, Homo Sapiens
RALYFEATP

SEQ ID NO: 685663 - protein, 9 aa, Homo Sapiens
GYALDCNEY

SEQ ID NO: 685664 - protein, 9 aa, Homo Sapiens
CSFGKHVVE

SEQ ID NO: 685665 - protein, 9 aa, Homo Sapiens
IWQGKIREL

SEQ ID NO: 685666 - protein, 9 aa, Homo Sapiens
GPSKPLSQP

SEQ ID NO: 685667 - protein, 9 aa, Homo Sapiens
ADSITWLYD

SEQ ID NO: 685668 - protein, 9 aa, Homo Sapiens
LCLLPGTKY

SEQ ID NO: 685669 - protein, 9 aa, Homo Sapiens
EEALFRDPC

SEQ ID NO: 685670 - protein, 9 aa, Homo Sapiens
ESGDGVDGN

SEQ ID NO: 685671 - protein, 9 aa, Homo Sapiens
SKQDHYNWG

SEQ ID NO: 685672 - protein, 9 aa, Homo Sapiens
SLSAPSSCS

SEQ ID NO: 685673 - protein, 9 aa, Homo Sapiens
QKGFWTEFM

SEQ ID NO: 685674 - protein, 9 aa, Homo Sapiens
EILCLLPGT

SEQ ID NO: 685675 - protein, 9 aa, Homo Sapiens
GAVVQVLVE

SEQ ID NO: 685676 - protein, 9 aa, Homo Sapiens
CQGYFTALG

SEQ ID NO: 685677 - protein, 9 aa, Homo Sapiens
AVIMTDLFT

SEQ ID NO: 685678 - protein, 9 aa, Homo Sapiens
VNEDVPQKP

SEQ ID NO: 685679 - protein, 9 aa, Homo Sapiens
IAVSKTDGE

SEQ ID NO: 685680 - protein, 9 aa, Homo Sapiens
LSVKNKFPS

SEQ ID NO: 685681 - protein, 9 aa, Homo Sapiens
EQCWTAPKK

SEQ ID NO: 685682 - protein, 9 aa, Homo Sapiens
KADEELLQA

SEQ ID NO: 685683 - protein, 9 aa, Homo Sapiens
SQRPPATFQ

SEQ ID NO: 685684 - protein, 9 aa, Homo Sapiens
GIWQGKIRE

SEQ ID NO: 685685 - protein, 9 aa, Homo Sapiens
FPPMVDAVA

SEQ ID NO: 685686 - protein, 9 aa, Homo Sapiens
LSKQDHYNW

SEQ ID NO: 685687 - protein, 9 aa, Homo Sapiens
EIATGKLSF

SEQ ID NO: 685688 - protein, 9 aa, Homo Sapiens
DGLPEAIHL

SEQ ID NO: 685689 - protein, 9 aa, Homo Sapiens
VIIPLWLGA

SEQ ID NO: 685690 - protein, 9 aa, Homo Sapiens
EPPTDVNVT

SEQ ID NO: 685691 - protein, 9 aa, Homo Sapiens
APKKLTQPI

SEQ ID NO: 685692 - protein, 9 aa, Homo Sapiens
VEPPTDVNV

SEQ ID NO: 685693 - protein, 9 aa, Homo Sapiens
IQKVFSPQT

SEQ ID NO: 685694 - protein, 9 aa, Homo Sapiens
YTLEELAQR

SEQ ID NO: 685695 - protein, 9 aa, Homo Sapiens
HKADEELLQ

SEQ ID NO: 685696 - protein, 9 aa, Homo Sapiens
AQTILQLQN

SEQ ID NO: 685697 - protein, 9 aa, Homo Sapiens
LLCFWEVHY

SEQ ID NO: 685698 - protein, 9 aa, Homo Sapiens
EMSEYYFYG

SEQ ID NO: 685699 - protein, 9 aa, Homo Sapiens
AERDILVDA

SEQ ID NO: 685700 - protein, 9 aa, Homo Sapiens
VLVEKLEKT

SEQ ID NO: 685701 - protein, 9 aa, Homo Sapiens
FEAAVQVST

SEQ ID NO: 685702 - protein, 9 aa, Homo Sapiens
LLTVGFVSF

SEQ ID NO: 685703 - protein, 9 aa, Homo Sapiens
LDCNEYFRD

SEQ ID NO: 685704 - protein, 9 aa, Homo Sapiens
TIRSGKRQE

SEQ ID NO: 685705 - protein, 9 aa, Homo Sapiens
LGHYSQSPV

SEQ ID NO: 685706 - protein, 9 aa, Homo Sapiens
CELLPLCRL

SEQ ID NO: 685707 - protein, 9 aa, Homo Sapiens
IRSNEIRKM

SEQ ID NO: 685708 - protein, 9 aa, Homo Sapiens
RELELNAEQ

SEQ ID NO: 685709 - protein, 9 aa, Homo Sapiens
NRYCDIVNL

SEQ ID NO: 685710 - protein, 9 aa, Homo Sapiens
WGSECAIDR

SEQ ID NO: 685711 - protein, 9 aa, Homo Sapiens
GGQKSLRSS

SEQ ID NO: 685712 - protein, 9 aa, Homo Sapiens
TFQATKTDD

SEQ ID NO: 685713 - protein, 9 aa, Homo Sapiens
VTLPGNLMV

SEQ ID NO: 685714 - protein, 9 aa, Homo Sapiens
ELQQLREIT

SEQ ID NO: 685715 - protein, 9 aa, Homo Sapiens
ATPPGAAVA

SEQ ID NO: 685716 - protein, 9 aa, Homo Sapiens
FLFHYCGVC

SEQ ID NO: 685717 - protein, 9 aa, Homo Sapiens
VISHHHLSK

SEQ ID NO: 685718 - protein, 9 aa, Homo Sapiens
LIRKKGPAR

SEQ ID NO: 685719 - protein, 9 aa, Homo Sapiens
DAIEKSSSS

SEQ ID NO: 685720 - protein, 9 aa, Homo Sapiens
KEKGGELTF

SEQ ID NO: 685721 - protein, 9 aa, Homo Sapiens
RERLFTSSC

SEQ ID NO: 685722 - protein, 9 aa, Homo Sapiens
RGYLNQVDL

SEQ ID NO: 685723 - protein, 9 aa, Homo Sapiens
VTWAYNLQA

SEQ ID NO: 685724 - protein, 9 aa, Homo Sapiens
APRKACNAW

SEQ ID NO: 685725 - protein, 9 aa, Homo Sapiens
VSSTFPKML

SEQ ID NO: 685726 - protein, 9 aa, Homo Sapiens
LQHALEKET

SEQ ID NO: 685727 - protein, 9 aa, Homo Sapiens
GKHVVEKVE

SEQ ID NO: 685728 - protein, 9 aa, Homo Sapiens
NATDEVKRE

SEQ ID NO: 685729 - protein, 9 aa, Homo Sapiens
QRELELNAE

SEQ ID NO: 685730 - protein, 9 aa, Homo Sapiens
LMVRQGNIG

SEQ ID NO: 685731 - protein, 9 aa, Homo Sapiens
LSLYISFVS

SEQ ID NO: 685732 - protein, 9 aa, Homo Sapiens
NMLMVTLSP

SEQ ID NO: 685733 - protein, 9 aa, Homo Sapiens
VLENNKNYK

SEQ ID NO: 685734 - protein, 9 aa, Homo Sapiens
KVVEEEERR

SEQ ID NO: 685735 - protein, 9 aa, Homo Sapiens
GEDALQALK

SEQ ID NO: 685736 - protein, 9 aa, Homo Sapiens
AASPVACLL

SEQ ID NO: 685737 - protein, 9 aa, Homo Sapiens
QDHYNWGLR

SEQ ID NO: 685738 - protein, 9 aa, Homo Sapiens
KNKPLFFAE

SEQ ID NO: 685739 - protein, 9 aa, Homo Sapiens
KLTLIQKVF

SEQ ID NO: 685740 - protein, 9 aa, Homo Sapiens
RGLCIPEKH

SEQ ID NO: 685741 - protein, 9 aa, Homo Sapiens
LKLFMQMNQ

SEQ ID NO: 685742 - protein, 9 aa, Homo Sapiens
WEVHYGILA

SEQ ID NO: 685743 - protein, 9 aa, Homo Sapiens
IGIPSSSSE

SEQ ID NO: 685744 - protein, 9 aa, Homo Sapiens
SIGSQWARG

SEQ ID NO: 685745 - protein, 9 aa, Homo Sapiens
VLERCYNDV

SEQ ID NO: 685746 - protein, 9 aa, Homo Sapiens
LDNFKTITR

SEQ ID NO: 685747 - protein, 9 aa, Homo Sapiens
EKETMTNLH

SEQ ID NO: 685748 - protein, 9 aa, Homo Sapiens
GNPPKTPLV

SEQ ID NO: 685749 - protein, 9 aa, Homo Sapiens
RIAQRLTEA

SEQ ID NO: 685750 - protein, 9 aa, Homo Sapiens
SAPSEVQKA

SEQ ID NO: 685751 - protein, 9 aa, Homo Sapiens
SDETHPGTE

SEQ ID NO: 685752 - protein, 9 aa, Homo Sapiens
TFQSSGNMT

SEQ ID NO: 685753 - protein, 9 aa, Homo Sapiens
FCMILIVFF

SEQ ID NO: 685754 - protein, 9 aa, Homo Sapiens
DGLDPVDTG

SEQ ID NO: 685755 - protein, 9 aa, Homo Sapiens
MISPLTLTT

SEQ ID NO: 685756 - protein, 9 aa, Homo Sapiens
GLGMERNIP

SEQ ID NO: 685757 - protein, 9 aa, Homo Sapiens
TFYTNPSRS

SEQ ID NO: 685758 - protein, 9 aa, Homo Sapiens
PSDPMDIVV

SEQ ID NO: 685759 - protein, 9 aa, Homo Sapiens
TEPAPRSPV

SEQ ID NO: 685760 - protein, 9 aa, Homo Sapiens
HLNTSSVLC

SEQ ID NO: 685761 - protein, 9 aa, Homo Sapiens
DKTDIKKRQ

SEQ ID NO: 685762 - protein, 9 aa, Homo Sapiens
DPCDSPGRP

SEQ ID NO: 685763 - protein, 9 aa, Homo Sapiens
SQIMLEKTP

SEQ ID NO: 685764 - protein, 9 aa, Homo Sapiens
LDAIEKSSS

SEQ ID NO: 685765 - protein, 9 aa, Homo Sapiens
LTVNEDSEG

SEQ ID NO: 685766 - protein, 9 aa, Homo Sapiens
TEAGGLGMG

SEQ ID NO: 685767 - protein, 9 aa, Homo Sapiens
EHGPEAPPS

SEQ ID NO: 685768 - protein, 9 aa, Homo Sapiens
NLPTVTLPG

SEQ ID NO: 685769 - protein, 9 aa, Homo Sapiens
KILRAVLQD

SEQ ID NO: 685770 - protein, 9 aa, Homo Sapiens
IIPLWLGAG

SEQ ID NO: 685771 - protein, 9 aa, Homo Sapiens
GARERLFTS

SEQ ID NO: 685772 - protein, 9 aa, Homo Sapiens
FLSPPDPLL

SEQ ID NO: 685773 - protein, 9 aa, Homo Sapiens
GGQDTLPVA

SEQ ID NO: 685774 - protein, 9 aa, Homo Sapiens
LTRCNNVGV

SEQ ID NO: 685775 - protein, 9 aa, Homo Sapiens
YIFLFALSL

SEQ ID NO: 685776 - protein, 9 aa, Homo Sapiens
ECVNTMGNY

SEQ ID NO: 685777 - protein, 9 aa, Homo Sapiens
QHALEKETM

SEQ ID NO: 685778 - protein, 9 aa, Homo Sapiens
EWEKAQKVV

SEQ ID NO: 685779 - protein, 9 aa, Homo Sapiens
HEKQRELEL

SEQ ID NO: 685780 - protein, 9 aa, Homo Sapiens
ISVMGGLIP

SEQ ID NO: 685781 - protein, 9 aa, Homo Sapiens
GVDGNMLMV

SEQ ID NO: 685782 - protein, 9 aa, Homo Sapiens
KLSVKNKFP

SEQ ID NO: 685783 - protein, 9 aa, Homo Sapiens
LTFYTNPSR

SEQ ID NO: 685784 - protein, 9 aa, Homo Sapiens
HLMPPWLSD

SEQ ID NO: 685785 - protein, 9 aa, Homo Sapiens
SYEILCLLP

SEQ ID NO: 685786 - protein, 9 aa, Homo Sapiens
ICWINVEIS

SEQ ID NO: 685787 - protein, 9 aa, Homo Sapiens
QSPVYESGQ

SEQ ID NO: 685788 - protein, 9 aa, Homo Sapiens
FDMMFRLTS

SEQ ID NO: 685789 - protein, 9 aa, Homo Sapiens
LYQTVILAL

SEQ ID NO: 685790 - protein, 9 aa, Homo Sapiens
PGTAKVVTW

SEQ ID NO: 685791 - protein, 9 aa, Homo Sapiens
ISDETHPGT

SEQ ID NO: 685792 - protein, 9 aa, Homo Sapiens
SPDGAVVQV

SEQ ID NO: 685793 - protein, 9 aa, Homo Sapiens
NMLTRCNNV

SEQ ID NO: 685794 - protein, 9 aa, Homo Sapiens
CCVSISEDK

SEQ ID NO: 685795 - protein, 9 aa, Homo Sapiens
PFYLSGKVM

SEQ ID NO: 685796 - protein, 9 aa, Homo Sapiens
PVSRRSAST

SEQ ID NO: 685797 - protein, 9 aa, Homo Sapiens
EKGGELTFL

SEQ ID NO: 685798 - protein, 9 aa, Homo Sapiens
VNTMGNYMC

SEQ ID NO: 685799 - protein, 9 aa, Homo Sapiens
ALILGPLLL

SEQ ID NO: 685800 - protein, 9 aa, Homo Sapiens
IGSQWARGE

SEQ ID NO: 685801 - protein, 9 aa, Homo Sapiens
RKALKLTLI

SEQ ID NO: 685802 - protein, 9 aa, Homo Sapiens
EKQRELELN

SEQ ID NO: 685803 - protein, 9 aa, Homo Sapiens
HGPEAPPSA

SEQ ID NO: 685804 - protein, 9 aa, Homo Sapiens
ICTGMTETD

SEQ ID NO: 685805 - protein, 9 aa, Homo Sapiens
LHEKQRELE

SEQ ID NO: 685806 - protein, 9 aa, Homo Sapiens
MVRQGNIGN

SEQ ID NO: 685807 - protein, 9 aa, Homo Sapiens
ETHPGTEII

SEQ ID NO: 685808 - protein, 9 aa, Homo Sapiens
PPLVTHSSV

SEQ ID NO: 685809 - protein, 9 aa, Homo Sapiens
LAYSILECK

SEQ ID NO: 685810 - protein, 9 aa, Homo Sapiens
CIPEKHLGE

SEQ ID NO: 685811 - protein, 9 aa, Homo Sapiens
EYPGPKWKL

SEQ ID NO: 685812 - protein, 9 aa, Homo Sapiens
FCPRGLCIP

SEQ ID NO: 685813 - protein, 9 aa, Homo Sapiens
KDSAHGYLK

SEQ ID NO: 685814 - protein, 9 aa, Homo Sapiens
PLVTHSSVQ

SEQ ID NO: 685815 - protein, 9 aa, Homo Sapiens
IAQRMIKEE

SEQ ID NO: 685816 - protein, 9 aa, Homo Sapiens
QCWTAPKKL

SEQ ID NO: 685817 - protein, 9 aa, Homo Sapiens
MDIVVTGPY

SEQ ID NO: 685818 - protein, 9 aa, Homo Sapiens
IHETLIRKK

SEQ ID NO: 685819 - protein, 9 aa, Homo Sapiens
KLFMQMNQK

SEQ ID NO: 685820 - protein, 9 aa, Homo Sapiens
PQLTFYTNP

SEQ ID NO: 685821 - protein, 9 aa, Homo Sapiens
ILRQFNQTF

SEQ ID NO: 685822 - protein, 9 aa, Homo Sapiens
KNKFPSDPE

SEQ ID NO: 685823 - protein, 9 aa, Homo Sapiens
NQTFQSSGN

SEQ ID NO: 685824 - protein, 9 aa, Homo Sapiens
IRKKGPARL

SEQ ID NO: 685825 - protein, 9 aa, Homo Sapiens
TIPCDAVEK

SEQ ID NO: 685826 - protein, 9 aa, Homo Sapiens
GKIPVKTFF

SEQ ID NO: 685827 - protein, 9 aa, Homo Sapiens
KCLSCQNLN

SEQ ID NO: 685828 - protein, 9 aa, Homo Sapiens
TDEVKREII

SEQ ID NO: 685829 - protein, 9 aa, Homo Sapiens
GRHHRPGSY

SEQ ID NO: 685830 - protein, 9 aa, Homo Sapiens
ENGDFREHN

SEQ ID NO: 685831 - protein, 9 aa, Homo Sapiens
GSLDAIEKS

SEQ ID NO: 685832 - protein, 9 aa, Homo Sapiens
VRLLSVSSK

SEQ ID NO: 685833 - protein, 9 aa, Homo Sapiens
AFEYPGPKW

SEQ ID NO: 685834 - protein, 9 aa, Homo Sapiens
IGLGMERNI

SEQ ID NO: 685835 - protein, 9 aa, Homo Sapiens
LARGCSHAL

SEQ ID NO: 685836 - protein, 9 aa, Homo Sapiens
YLSGKVMGN

SEQ ID NO: 685837 - protein, 9 aa, Homo Sapiens
EDEFRNMLT

SEQ ID NO: 685838 - protein, 9 aa, Homo Sapiens
PSLLTHLIL

SEQ ID NO: 685839 - protein, 9 aa, Homo Sapiens
RRQNPSRCC

SEQ ID NO: 685840 - protein, 9 aa, Homo Sapiens
CSSEIGVGV

SEQ ID NO: 685841 - protein, 9 aa, Homo Sapiens
HYSQSPVYE

SEQ ID NO: 685842 - protein, 9 aa, Homo Sapiens
KSLRSSWNT

SEQ ID NO: 685843 - protein, 9 aa, Homo Sapiens
TLENDVALV

SEQ ID NO: 685844 - protein, 9 aa, Homo Sapiens
AEVKTFIFA

SEQ ID NO: 685845 - protein, 9 aa, Homo Sapiens
SNRSHVYAV

SEQ ID NO: 685846 - protein, 9 aa, Homo Sapiens
RQVVLEDGL

SEQ ID NO: 685847 - protein, 9 aa, Homo Sapiens
LIGLGMERN

SEQ ID NO: 685848 - protein, 9 aa, Homo Sapiens
PSRCCVSLS

SEQ ID NO: 685849 - protein, 9 aa, Homo Sapiens
TTQLFVSSW

SEQ ID NO: 685850 - protein, 9 aa, Homo Sapiens
IFLFALSLI

SEQ ID NO: 685851 - protein, 9 aa, Homo Sapiens
THTTSTVEL

SEQ ID NO: 685852 - protein, 9 aa, Homo Sapiens
SFGKHVVEK

SEQ ID NO: 685853 - protein, 9 aa, Homo Sapiens
NKCVSSIIQ

SEQ ID NO: 685854 - protein, 9 aa, Homo Sapiens
IVKSSSGSS

SEQ ID NO: 685855 - protein, 9 aa, Homo Sapiens
PRSWIPVQI

SEQ ID NO: 685856 - protein, 9 aa, Homo Sapiens
SILECKIQG

SEQ ID NO: 685857 - protein, 9 aa, Homo Sapiens
AKVLIAVSL

SEQ ID NO: 685858 - protein, 9 aa, Homo Sapiens
NKPLFFAEK

SEQ ID NO: 685859 - protein, 9 aa, Homo Sapiens
SKTDGEVQV

SEQ ID NO: 685860 - protein, 9 aa, Homo Sapiens
DSKIGIPSS

SEQ ID NO: 685861 - protein, 9 aa, Homo Sapiens
DQDYEFIDH

SEQ ID NO: 685862 - protein, 9 aa, Homo Sapiens
AAAASPVAC

SEQ ID NO: 685863 - protein, 9 aa, Homo Sapiens
RTRASSFPY

SEQ ID NO: 685864 - protein, 9 aa, Homo Sapiens
RQEWLFTGK

SEQ ID NO: 685865 - protein, 9 aa, Homo Sapiens
FVYEGLKNY

SEQ ID NO: 685866 - protein, 9 aa, Homo Sapiens
SPRSWIPVQ

SEQ ID NO: 685867 - protein, 9 aa, Homo Sapiens
FEYPGPKWK

SEQ ID NO: 685868 - protein, 9 aa, Homo Sapiens
YKDPCELLP

SEQ ID NO: 685869 - protein, 9 aa, Homo Sapiens
KPCIIFIDE

SEQ ID NO: 685870 - protein, 9 aa, Homo Sapiens
MGGGARERL

SEQ ID NO: 685871 - protein, 9 aa, Homo Sapiens
GLPEAIHLD

SEQ ID NO: 685872 - protein, 9 aa, Homo Sapiens
RAGIPPPPP

SEQ ID NO: 685873 - protein, 9 aa, Homo Sapiens
PFEYYIFLF

SEQ ID NO: 685874 - protein, 9 aa, Homo Sapiens
TFGIWQGKI

SEQ ID NO: 685875 - protein, 9 aa, Homo Sapiens
LQTQVRGYL

SEQ ID NO: 685876 - protein, 9 aa, Homo Sapiens
QLHLNTSSV

SEQ ID NO: 685877 - protein, 9 aa, Homo Sapiens
LIVFFVAML

SEQ ID NO: 685878 - protein, 9 aa, Homo Sapiens
PQVSEEVPT

SEQ ID NO: 685879 - protein, 9 aa, Homo Sapiens
SGAPGAPTT

SEQ ID NO: 685880 - protein, 9 aa, Homo Sapiens
IDHECLAKK

SEQ ID NO: 685881 - protein, 9 aa, Homo Sapiens
SYQKGFWTE

SEQ ID NO: 685882 - protein, 9 aa, Homo Sapiens
QVRGYLNQV

SEQ ID NO: 685883 - protein, 9 aa, Homo Sapiens
YNSQRWFNL

SEQ ID NO: 685884 - protein, 9 aa, Homo Sapiens
SSMRSEEEG

SEQ ID NO: 685885 - protein, 9 aa, Homo Sapiens
SQCDEVFPF

SEQ ID NO: 685886 - protein, 9 aa, Homo Sapiens
NKLQLTGNK

SEQ ID NO: 685887 - protein, 9 aa, Homo Sapiens
DLTVNEDSE

SEQ ID NO: 685888 - protein, 9 aa, Homo Sapiens
LKSLPIVAK

SEQ ID NO: 685889 - protein, 9 aa, Homo Sapiens
RRAVYKDLV

SEQ ID NO: 685890 - protein, 9 aa, Homo Sapiens
ILCLLPGTK

SEQ ID NO: 685891 - protein, 9 aa, Homo Sapiens
TLAHKVDGP

SEQ ID NO: 685892 - protein, 9 aa, Homo Sapiens
EKAQKVVEE

SEQ ID NO: 685893 - protein, 9 aa, Homo Sapiens
FYMFLGQTP

SEQ ID NO: 685894 - protein, 9 aa, Homo Sapiens
NKLEHYHRK

SEQ ID NO: 685895 - protein, 9 aa, Homo Sapiens
QGAKDFACS

SEQ ID NO: 685896 - protein, 9 aa, Homo Sapiens
QRLTEAQNT

SEQ ID NO: 685897 - protein, 9 aa, Homo Sapiens
YCDIVNLTE

SEQ ID NO: 685898 - protein, 9 aa, Homo Sapiens
NASTAKKCL

SEQ ID NO: 685899 - protein, 9 aa, Homo Sapiens
IFAGHDTTS

SEQ ID NO: 685900 - protein, 9 aa, Homo Sapiens
YEGLKNYVP

SEQ ID NO: 685901 - protein, 9 aa, Homo Sapiens
LFVYEGLKN

SEQ ID NO: 685902 - protein, 9 aa, Homo Sapiens
RTILARGCS

SEQ ID NO: 685903 - protein, 9 aa, Homo Sapiens
EAGGLGMGE

SEQ ID NO: 685904 - protein, 9 aa, Homo Sapiens
ELSKVGVKE

SEQ ID NO: 685905 - protein, 9 aa, Homo Sapiens
KVGVKELLA

SEQ ID NO: 685906 - protein, 9 aa, Homo Sapiens
MMFRLTSIF

SEQ ID NO: 685907 - protein, 9 aa, Homo Sapiens
VIMTDLFTK

SEQ ID NO: 685908 - protein, 9 aa, Homo Sapiens
HTSFDMMFR

SEQ ID NO: 685909 - protein, 9 aa, Homo Sapiens
DNFKTITRS

SEQ ID NO: 685910 - protein, 9 aa, Homo Sapiens
PPWLSDSSV

SEQ ID NO: 685911 - protein, 9 aa, Homo Sapiens
LMWDIGGQK

SEQ ID NO: 685912 - protein, 9 aa, Homo Sapiens
NNKNYKCCQ

SEQ ID NO: 685913 - protein, 9 aa, Homo Sapiens
EEVPVEQPD

SEQ ID NO: 685914 - protein, 9 aa, Homo Sapiens
KRQSVQAAI

SEQ ID NO: 685915 - protein, 9 aa, Homo Sapiens
EYFEKQGAK

SEQ ID NO: 685916 - protein, 9 aa, Homo Sapiens
GKRQEWLFT

SEQ ID NO: 685917 - protein, 9 aa, Homo Sapiens
CCVSLSNVE

SEQ ID NO: 685918 - protein, 9 aa, Homo Sapiens
SVGPSKPLS

SEQ ID NO: 685919 - protein, 9 aa, Homo Sapiens
SEYYFYGKG

SEQ ID NO: 685920 - protein, 9 aa, Homo Sapiens
FSRISALLI

SEQ ID NO: 685921 - protein, 9 aa, Homo Sapiens
PCDAVEKMV

SEQ ID NO: 685922 - protein, 9 aa, Homo Sapiens
CDAVEKMVS

SEQ ID NO: 685923 - protein, 9 aa, Homo Sapiens
LRQFNQTFQ

SEQ ID NO: 685924 - protein, 9 aa, Homo Sapiens
CLQHALEKE

SEQ ID NO: 685925 - protein, 9 aa, Homo Sapiens
NKPCIIFID

SEQ ID NO: 685926 - protein, 9 aa, Homo Sapiens
TMGNYMCQC

SEQ ID NO: 685927 - protein, 9 aa, Homo Sapiens
VIGPRKTVM

SEQ ID NO: 685928 - protein, 9 aa, Homo Sapiens
PSSSSEDTI

SEQ ID NO: 685929 - protein, 9 aa, Homo Sapiens
NGTVIGPRK

SEQ ID NO: 685930 - protein, 9 aa, Homo Sapiens
CWINVEISG

SEQ ID NO: 685931 - protein, 9 aa, Homo Sapiens
VSLATSFCV

SEQ ID NO: 685932 - protein, 9 aa, Homo Sapiens
HLFVYEGLK

SEQ ID NO: 685933 - protein, 9 aa, Homo Sapiens
PLSKPNRPD

SEQ ID NO: 685934 - protein, 9 aa, Homo Sapiens
TSFDMMFRL

SEQ ID NO: 685935 - protein, 9 aa, Homo Sapiens
TLTHTTSTV

SEQ ID NO: 685936 - protein, 9 aa, Homo Sapiens
QKSLRSSWN

SEQ ID NO: 685937 - protein, 9 aa, Homo Sapiens
AQRLTEAQN

SEQ ID NO: 685938 - protein, 9 aa, Homo Sapiens
RQRIAQRLT

SEQ ID NO: 685939 - protein, 9 aa, Homo Sapiens
SFDMMFRLT

SEQ ID NO: 685940 - protein, 9 aa, Homo Sapiens
MMTAVPSAT

SEQ ID NO: 685941 - protein, 9 aa, Homo Sapiens
KPSLLTHLI

SEQ ID NO: 685942 - protein, 9 aa, Homo Sapiens
RLFPSRTPG

SEQ ID NO: 685943 - protein, 9 aa, Homo Sapiens
SITWLYDNT

SEQ ID NO: 685944 - protein, 9 aa, Homo Sapiens
ELLPLCRLT

SEQ ID NO: 685945 - protein, 9 aa, Homo Sapiens
KQMCHKADE

SEQ ID NO: 685946 - protein, 9 aa, Homo Sapiens
LPPLPRAGI

SEQ ID NO: 685947 - protein, 9 aa, Homo Sapiens
SGHLMPPWL

SEQ ID NO: 685948 - protein, 9 aa, Homo Sapiens
NESTEFEES

SEQ ID NO: 685949 - protein, 9 aa, Homo Sapiens
RLTEAQNTC

SEQ ID NO: 685950 - protein, 9 aa, Homo Sapiens
WLAALILGP

SEQ ID NO: 685951 - protein, 9 aa, Homo Sapiens
KVSDTAYRV

SEQ ID NO: 685952 - protein, 9 aa, Homo Sapiens
GDGRVTVGQ

SEQ ID NO: 685953 - protein, 9 aa, Homo Sapiens
RGCSHALQA

SEQ ID NO: 685954 - protein, 9 aa, Homo Sapiens
AVASVPLSL

SEQ ID NO: 685955 - protein, 9 aa, Homo Sapiens
KVLIAVSLA

SEQ ID NO: 685956 - protein, 9 aa, Homo Sapiens
LVWGSECAI

SEQ ID NO: 685957 - protein, 9 aa, Homo Sapiens
LQQLREITL

SEQ ID NO: 685958 - protein, 9 aa, Homo Sapiens
LWEIKKQSF

SEQ ID NO: 685959 - protein, 9 aa, Homo Sapiens
HLPFPTVFL

SEQ ID NO: 685960 - protein, 9 aa, Homo Sapiens
AYLDNFKTI

SEQ ID NO: 685961 - protein, 9 aa, Homo Sapiens
NTPWCPKTG

SEQ ID NO: 685962 - protein, 9 aa, Homo Sapiens
EFEESSATI

SEQ ID NO: 685963 - protein, 9 aa, Homo Sapiens
WLSDSSVSV

SEQ ID NO: 685964 - protein, 9 aa, Homo Sapiens
KIGIPSSSS

SEQ ID NO: 685965 - protein, 9 aa, Homo Sapiens
FTFGIWQGK

SEQ ID NO: 685966 - protein, 9 aa, Homo Sapiens
SSCSSPGAG

SEQ ID NO: 685967 - protein, 9 aa, Homo Sapiens
APSEVQKAE

SEQ ID NO: 685968 - protein, 9 aa, Homo Sapiens
TFFQMFPAD

SEQ ID NO: 685969 - protein, 9 aa, Homo Sapiens
QRGKMIPSD

SEQ ID NO: 685970 - protein, 9 aa, Homo Sapiens
DEYLDPDAC

SEQ ID NO: 685971 - protein, 9 aa, Homo Sapiens
IELRDSYQK

SEQ ID NO: 685972 - protein, 9 aa, Homo Sapiens
MGSLDAIEK

SEQ ID NO: 685973 - protein, 9 aa, Homo Sapiens
RKFTQSSMR

SEQ ID NO: 685974 - protein, 9 aa, Homo Sapiens
FEYYIFLFA

SEQ ID NO: 685975 - protein, 9 aa, Homo Sapiens
DEVFPFFEA

SEQ ID NO: 685976 - protein, 9 aa, Homo Sapiens
KLQLTGNKA

SEQ ID NO: 685977 - protein, 9 aa, Homo Sapiens
QVNATDEVK

SEQ ID NO: 685978 - protein, 9 aa, Homo Sapiens
VWLAALILG

SEQ ID NO: 685979 - protein, 9 aa, Homo Sapiens
EESSATISK

SEQ ID NO: 685980 - protein, 9 aa, Homo Sapiens
RKEPEPLSK

SEQ ID NO: 685981 - protein, 9 aa, Homo Sapiens
EHNFNTAMQ

SEQ ID NO: 685982 - protein, 9 aa, Homo Sapiens
GLCIPEKHL

SEQ ID NO: 685983 - protein, 9 aa, Homo Sapiens
FRNMLTRCN

SEQ ID NO: 685984 - protein, 9 aa, Homo Sapiens
IFAEVNADS

SEQ ID NO: 685985 - protein, 9 aa, Homo Sapiens
TEAQNTCAM

SEQ ID NO: 685986 - protein, 9 aa, Homo Sapiens
MKDPQEMKT

SEQ ID NO: 685987 - protein, 9 aa, Homo Sapiens
ETAKFSPSE

SEQ ID NO: 685988 - protein, 9 aa, Homo Sapiens
APSDPMDIV

SEQ ID NO: 685989 - protein, 9 aa, Homo Sapiens
CLSCQNLNP

SEQ ID NO: 685990 - protein, 9 aa, Homo Sapiens
FTLAHKVDG

SEQ ID NO: 685991 - protein, 9 aa, Homo Sapiens
YNALKLFMQ

SEQ ID NO: 685992 - protein, 9 aa, Homo Sapiens
QRWFNLYLS

SEQ ID NO: 685993 - protein, 9 aa, Homo Sapiens
IPSSSSEDT

SEQ ID NO: 685994 - protein, 9 aa, Homo Sapiens
PPATFQATK

SEQ ID NO: 685995 - protein, 9 aa, Homo Sapiens
YEFIDHECL

SEQ ID NO: 685996 - protein, 9 aa, Homo Sapiens
AGGLGMGEG

SEQ ID NO: 685997 - protein, 9 aa, Homo Sapiens
WEKAQKVVE

SEQ ID NO: 685998 - protein, 9 aa, Homo Sapiens
CCTTQLFVS

SEQ ID NO: 685999 - protein, 9 aa, Homo Sapiens
VGEFSEEAL

SEQ ID NO: 686000 - protein, 9 aa, Homo Sapiens
SIILVWGSE

SEQ ID NO: 686001 - protein, 9 aa, Homo Sapiens
PKLQTQVRG

SEQ ID NO: 686002 - protein, 9 aa, Homo Sapiens
QLQNKLEHY

SEQ ID NO: 686003 - protein, 9 aa, Homo Sapiens
ALDCNEYFR

SEQ ID NO: 686004 - protein, 9 aa, Homo Sapiens
FNQTFQSSG

SEQ ID NO: 686005 - protein, 9 aa, Homo Sapiens
LFCMILIVF

SEQ ID NO: 686006 - protein, 9 aa, Homo Sapiens
PNTPWCPKT

SEQ ID NO: 686007 - protein, 9 aa, Homo Sapiens
EIPPRYKME

SEQ ID NO: 686008 - protein, 9 aa, Homo Sapiens
RTLESQIML

SEQ ID NO: 686009 - protein, 9 aa, Homo Sapiens
LRDSYQKGF

SEQ ID NO: 686010 - protein, 9 aa, Homo Sapiens
IPVQIPASH

SEQ ID NO: 686011 - protein, 9 aa, Homo Sapiens
HHLSKQKQL

SEQ ID NO: 686012 - protein, 9 aa, Homo Sapiens
PEAIHLDKN

SEQ ID NO: 686013 - protein, 9 aa, Homo Sapiens
QMLLFWLFS

SEQ ID NO: 686014 - protein, 9 aa, Homo Sapiens
ESNKILVNE

SEQ ID NO: 686015 - protein, 9 aa, Homo Sapiens
RSHVYAVIM

SEQ ID NO: 686016 - protein, 9 aa, Homo Sapiens
SFAVWLAAL

SEQ ID NO: 686017 - protein, 9 aa, Homo Sapiens
CTTQLFVSS

SEQ ID NO: 686018 - protein, 9 aa, Homo Sapiens
GNYMCQCRN

SEQ ID NO: 686019 - protein, 9 aa, Homo Sapiens
ASFAVWLAA

SEQ ID NO: 686020 - protein, 9 aa, Homo Sapiens
PMDIVVTGP

SEQ ID NO: 686021 - protein, 9 aa, Homo Sapiens
PGIVKSSSG

SEQ ID NO: 686022 - protein, 9 aa, Homo Sapiens
VHYGILAGA

SEQ ID NO: 686023 - protein, 9 aa, Homo Sapiens
VSRRSASTE

SEQ ID NO: 686024 - protein, 9 aa, Homo Sapiens
SSSEDTILA

SEQ ID NO: 686025 - protein, 9 aa, Homo Sapiens
QVSEEVPTV

SEQ ID NO: 686026 - protein, 9 aa, Homo Sapiens
EAAVQVSTE

SEQ ID NO: 686027 - protein, 9 aa, Homo Sapiens
RWWEHGPEA

SEQ ID NO: 686028 - protein, 9 aa, Homo Sapiens
VKNKFPSDP

SEQ ID NO: 686029 - protein, 9 aa, Homo Sapiens
SRLFPSRTP

SEQ ID NO: 686030 - protein, 9 aa, Homo Sapiens
CTGMTETDY

SEQ ID NO: 686031 - protein, 9 aa, Homo Sapiens
SVILIKCDQ

SEQ ID NO: 686032 - protein, 9 aa, Homo Sapiens
HPQYDPNTL

SEQ ID NO: 686033 - protein, 9 aa, Homo Sapiens
REITLLSSQ

SEQ ID NO: 686034 - protein, 9 aa, Homo Sapiens
LDELSKVGV

SEQ ID NO: 686035 - protein, 9 aa, Homo Sapiens
EQPDEYLDP

SEQ ID NO: 686036 - protein, 9 aa, Homo Sapiens
SPLSMISPL

SEQ ID NO: 686037 - protein, 9 aa, Homo Sapiens
FFAEKLYKS

SEQ ID NO: 686038 - protein, 9 aa, Homo Sapiens
IPCDAVEKM

SEQ ID NO: 686039 - protein, 9 aa, Homo Sapiens
SVKNKFPSD

SEQ ID NO: 686040 - protein, 9 aa, Homo Sapiens
IATGKLSFP

SEQ ID NO: 686041 - protein, 9 aa, Homo Sapiens
VSEEVPTVL

SEQ ID NO: 686042 - protein, 9 aa, Homo Sapiens
GSFSGTPGI

SEQ ID NO: 686043 - protein, 9 aa, Homo Sapiens
NPSRSRRRS

SEQ ID NO: 686044 - protein, 9 aa, Homo Sapiens
TITSPLSMI

SEQ ID NO: 686045 - protein, 9 aa, Homo Sapiens
PIELRDSYQ

SEQ ID NO: 686046 - protein, 9 aa, Homo Sapiens
PRLEIPPFV

SEQ ID NO: 686047 - protein, 9 aa, Homo Sapiens
EFRNMLTRC

SEQ ID NO: 686048 - protein, 9 aa, Homo Sapiens
QLTGNKAED

SEQ ID NO: 686049 - protein, 9 aa, Homo Sapiens
SEVQKAEES

SEQ ID NO: 686050 - protein, 9 aa, Homo Sapiens
TILARGCSH

SEQ ID NO: 686051 - protein, 9 aa, Homo Sapiens
TMGGQDTLP

SEQ ID NO: 686052 - protein, 9 aa, Homo Sapiens
VRRAVYKDL

SEQ ID NO: 686053 - protein, 9 aa, Homo Sapiens
STEDLKTLS

SEQ ID NO: 686054 - protein, 9 aa, Homo Sapiens
CTNRKNSKV

SEQ ID NO: 686055 - protein, 9 aa, Homo Sapiens
ITRSTVSVR

SEQ ID NO: 686056 - protein, 9 aa, Homo Sapiens
NRKNSKVSD

SEQ ID NO: 686057 - protein, 9 aa, Homo Sapiens
EQHSYEILC

SEQ ID NO: 686058 - protein, 9 aa, Homo Sapiens
AVSLATSFC

SEQ ID NO: 686059 - protein, 9 aa, Homo Sapiens
LGQTPEVAT

SEQ ID NO: 686060 - protein, 9 aa, Homo Sapiens
KRKFTQSSM

SEQ ID NO: 686061 - protein, 9 aa, Homo Sapiens
EPFLDQSGA

SEQ ID NO: 686062 - protein, 9 aa, Homo Sapiens
KALKLLATG

SEQ ID NO: 686063 - protein, 9 aa, Homo Sapiens
NSQRWFNLY

SEQ ID NO: 686064 - protein, 9 aa, Homo Sapiens
DGVDGNMLM

SEQ ID NO: 686065 - protein, 9 aa, Homo Sapiens
QVFPEPIFR

SEQ ID NO: 686066 - protein, 9 aa, Homo Sapiens
ATDEVKREI

SEQ ID NO: 686067 - protein, 9 aa, Homo Sapiens
IDRIAQRMI

SEQ ID NO: 686068 - protein, 9 aa, Homo Sapiens
AVQRFPPMV

SEQ ID NO: 686069 - protein, 9 aa, Homo Sapiens
TPGIVKSSS

SEQ ID NO: 686070 - protein, 9 aa, Homo Sapiens
VVVGALVVF

SEQ ID NO: 686071 - protein, 9 aa, Homo Sapiens
QMCHKADEE

SEQ ID NO: 686072 - protein, 9 aa, Homo Sapiens
TGKLSFPLK

SEQ ID NO: 686073 - protein, 9 aa, Homo Sapiens
GAKDFACSF

SEQ ID NO: 686074 - protein, 9 aa, Homo Sapiens
NICWINVEI

SEQ ID NO: 686075 - protein, 9 aa, Homo Sapiens
TLIRKKGPA

SEQ ID NO: 686076 - protein, 9 aa, Homo Sapiens
HPCIETAGK

SEQ ID NO: 686077 - protein, 9 aa, Homo Sapiens
AKDFACSFS

SEQ ID NO: 686078 - protein, 9 aa, Homo Sapiens
CMILIVFFV

SEQ ID NO: 686079 - protein, 9 aa, Homo Sapiens
DGAVVQVLV

SEQ ID NO: 686080 - protein, 9 aa, Homo Sapiens
LLSKQDHYN

SEQ ID NO: 686081 - protein, 9 aa, Homo Sapiens
YVARDPCDS

SEQ ID NO: 686082 - protein, 9 aa, Homo Sapiens
LPRWWEHGP

SEQ ID NO: 686083 - protein, 9 aa, Homo Sapiens
SAHGYLKVP

SEQ ID NO: 686084 - protein, 9 aa, Homo Sapiens
SEIGVGVTR

SEQ ID NO: 686085 - protein, 9 aa, Homo Sapiens
QLFVSSWGW

SEQ ID NO: 686086 - protein, 9 aa, Homo Sapiens
AEVNADSIT

SEQ ID NO: 686087 - protein, 9 aa, Homo Sapiens
GHLCCVSIS

SEQ ID NO: 686088 - protein, 9 aa, Homo Sapiens
YFYGKGKAF

SEQ ID NO: 686089 - protein, 9 aa, Homo Sapiens
FGKHVVEKV

SEQ ID NO: 686090 - protein, 9 aa, Homo Sapiens
WLRRLKSLP

SEQ ID NO: 686091 - protein, 9 aa, Homo Sapiens
KQHADLTVN

SEQ ID NO: 686092 - protein, 9 aa, Homo Sapiens
HETLIRKKG

SEQ ID NO: 686093 - protein, 9 aa, Homo Sapiens
TRASSFPYV

SEQ ID NO: 686094 - protein, 9 aa, Homo Sapiens
EVHYGILAG

SEQ ID NO: 686095 - protein, 9 aa, Homo Sapiens
SEDGLPEAI

SEQ ID NO: 686096 - protein, 9 aa, Homo Sapiens
EEETEKMRN

SEQ ID NO: 686097 - protein, 9 aa, Homo Sapiens
LLSNKCVSS

SEQ ID NO: 686098 - protein, 9 aa, Homo Sapiens
TDYGLLTAE

SEQ ID NO: 686099 - protein, 9 aa, Homo Sapiens
KQGAKDFAC

SEQ ID NO: 686100 - protein, 9 aa, Homo Sapiens
PGAAVASVP

SEQ ID NO: 686101 - protein, 9 aa, Homo Sapiens
GKVMGNVYM

SEQ ID NO: 686102 - protein, 9 aa, Homo Sapiens
FYLSGKVMG

SEQ ID NO: 686103 - protein, 9 aa, Homo Sapiens
KIQGMSVFT

SEQ ID NO: 686104 - protein, 9 aa, Homo Sapiens
DPQEMKTYS

SEQ ID NO: 686105 - protein, 9 aa, Homo Sapiens
PPTDVNVTE

SEQ ID NO: 686106 - protein, 9 aa, Homo Sapiens
EVIIPLWLG

SEQ ID NO: 686107 - protein, 9 aa, Homo Sapiens
EAIHLDKND

SEQ ID NO: 686108 - protein, 9 aa, Homo Sapiens
THPGTEIIN

SEQ ID NO: 686109 - protein, 9 aa, Homo Sapiens
VMGNVYMYY

SEQ ID NO: 686110 - protein, 9 aa, Homo Sapiens
VFPFFEARP

SEQ ID NO: 686111 - protein, 9 aa, Homo Sapiens
RKACNAWLQ

SEQ ID NO: 686112 - protein, 9 aa, Homo Sapiens
VNATDEVKR

SEQ ID NO: 686113 - protein, 9 aa, Homo Sapiens
DVNVTEGMA

SEQ ID NO: 686114 - protein, 9 aa, Homo Sapiens
VLCDCQLKW

SEQ ID NO: 686115 - protein, 9 aa, Homo Sapiens
TNKSHLFVY

SEQ ID NO: 686116 - protein, 9 aa, Homo Sapiens
FYGKGKAFR

SEQ ID NO: 686117 - protein, 9 aa, Homo Sapiens
GPRESGRHH

SEQ ID NO: 686118 - protein, 9 aa, Homo Sapiens
MIKEEIEYL

SEQ ID NO: 686119 - protein, 9 aa, Homo Sapiens
EKQGAKDFA

SEQ ID NO: 686120 - protein, 9 aa, Homo Sapiens
CHKADEELL

SEQ ID NO: 686121 - protein, 9 aa, Homo Sapiens
ALKLTLIQK

SEQ ID NO: 686122 - protein, 9 aa, Homo Sapiens
EVKTFIFAG

SEQ ID NO: 686123 - protein, 9 aa, Homo Sapiens
GLSLSYLPT

SEQ ID NO: 686124 - protein, 9 aa, Homo Sapiens
ACLIAVSKT

SEQ ID NO: 686125 - protein, 9 aa, Homo Sapiens
VKQHADLTV

SEQ ID NO: 686126 - protein, 9 aa, Homo Sapiens
EGKIPVKTF

SEQ ID NO: 686127 - protein, 9 aa, Homo Sapiens
RLKRALYFE

SEQ ID NO: 686128 - protein, 9 aa, Homo Sapiens
LEPNTPWCP

SEQ ID NO: 686129 - protein, 9 aa, Homo Sapiens
CNEYFRDLN

SEQ ID NO: 686130 - protein, 9 aa, Homo Sapiens
LGDSVRRAV

SEQ ID NO: 686131 - protein, 9 aa, Homo Sapiens
EVFPFFEAR

SEQ ID NO: 686132 - protein, 9 aa, Homo Sapiens
PNTLENDVA

SEQ ID NO: 686133 - protein, 9 aa, Homo Sapiens
LFKDSAHGY

SEQ ID NO: 686134 - protein, 9 aa, Homo Sapiens
FPSDPEVPV

SEQ ID NO: 686135 - protein, 9 aa, Homo Sapiens
VGALVVFAL

SEQ ID NO: 686136 - protein, 9 aa, Homo Sapiens
DMGLSLSYL

SEQ ID NO: 686137 - protein, 9 aa, Homo Sapiens
ASTEPAPRS

SEQ ID NO: 686138 - protein, 9 aa, Homo Sapiens
KAQKVVEEE

SEQ ID NO: 686139 - protein, 9 aa, Homo Sapiens
ENNKNYKCC

SEQ ID NO: 686140 - protein, 9 aa, Homo Sapiens
EETEKMRNS

SEQ ID NO: 686141 - protein, 9 aa, Homo Sapiens
VLESSAPSE

SEQ ID NO: 686142 - protein, 9 aa, Homo Sapiens
SSAPSEVQK

SEQ ID NO: 686143 - protein, 9 aa, Homo Sapiens
NKNYKCCQS

SEQ ID NO: 686144 - protein, 9 aa, Homo Sapiens
TFLGTQDDI

SEQ ID NO: 686145 - protein, 9 aa, Homo Sapiens
VGVKELLAD

SEQ ID NO: 686146 - protein, 9 aa, Homo Sapiens
ALYFEATPY

SEQ ID NO: 686147 - protein, 9 aa, Homo Sapiens
SYLAEGGRR

SEQ ID NO: 686148 - protein, 9 aa, Homo Sapiens
YNDVRLLSV

SEQ ID NO: 686149 - protein, 9 aa, Homo Sapiens
LAHKVDGPF

SEQ ID NO: 686150 - protein, 9 aa, Homo Sapiens
KEPEPLSKP

SEQ ID NO: 686151 - protein, 9 aa, Homo Sapiens
GDSGISCSS

SEQ ID NO: 686152 - protein, 9 aa, Homo Sapiens
FVSSWGWQP

SEQ ID NO: 686153 - protein, 9 aa, Homo Sapiens
LIQKVFSPQ

SEQ ID NO: 686154 - protein, 9 aa, Homo Sapiens
IEKSSSSQK

SEQ ID NO: 686155 - protein, 9 aa, Homo Sapiens
QPGHLCCVS

SEQ ID NO: 686156 - protein, 9 aa, Homo Sapiens
IVFFVAMLG

SEQ ID NO: 686157 - protein, 9 aa, Homo Sapiens
PMMMTAVPS

SEQ ID NO: 686158 - protein, 9 aa, Homo Sapiens
STFPKMLVN

SEQ ID NO: 686159 - protein, 9 aa, Homo Sapiens
TLPGNLMVV

SEQ ID NO: 686160 - protein, 9 aa, Homo Sapiens
FEESSATIS

SEQ ID NO: 686161 - protein, 9 aa, Homo Sapiens
VWVLVGNRY

SEQ ID NO: 686162 - protein, 9 aa, Homo Sapiens
FPEPIFRFF

SEQ ID NO: 686163 - protein, 9 aa, Homo Sapiens
QTQVRGYLN

SEQ ID NO: 686164 - protein, 9 aa, Homo Sapiens
KEEETEKMR

SEQ ID NO: 686165 - protein, 9 aa, Homo Sapiens
FYTNPSRSR

SEQ ID NO: 686166 - protein, 9 aa, Homo Sapiens
MSGLLYQTV

SEQ ID NO: 686167 - protein, 9 aa, Homo Sapiens
VVGYALDCN

SEQ ID NO: 686168 - protein, 9 aa, Homo Sapiens
RYCDIVNLT

SEQ ID NO: 686169 - protein, 9 aa, Homo Sapiens
QFNQTFQSS

SEQ ID NO: 686170 - protein, 9 aa, Homo Sapiens
SRLPVAPRK

SEQ ID NO: 686171 - protein, 9 aa, Homo Sapiens
SSIGFTLAH

SEQ ID NO: 686172 - protein, 9 aa, Homo Sapiens
VFFVAMLGM

SEQ ID NO: 686173 - protein, 9 aa, Homo Sapiens
EDVPQKPGG

SEQ ID NO: 686174 - protein, 9 aa, Homo Sapiens
VVILGDSVR

SEQ ID NO: 686175 - protein, 9 aa, Homo Sapiens
LENNKNYKC

SEQ ID NO: 686176 - protein, 9 aa, Homo Sapiens
LLPLCRLTI

SEQ ID NO: 686177 - protein, 9 aa, Homo Sapiens
RENKPCIIF

SEQ ID NO: 686178 - protein, 9 aa, Homo Sapiens
TIDRIAQRM

SEQ ID NO: 686179 - protein, 9 aa, Homo Sapiens
VFPEPIFRF

SEQ ID NO: 686180 - protein, 9 aa, Homo Sapiens
RIAQRMIKE

SEQ ID NO: 686181 - protein, 9 aa, Homo Sapiens
YLKVPPRMD

SEQ ID NO: 686182 - protein, 9 aa, Homo Sapiens
SSATISKEW

SEQ ID NO: 686183 - protein, 9 aa, Homo Sapiens
TAPKKLTQP

SEQ ID NO: 686184 - protein, 9 aa, Homo Sapiens
PLSQPRRNI

SEQ ID NO: 686185 - protein, 9 aa, Homo Sapiens
YFEATPYYN

SEQ ID NO: 686186 - protein, 9 aa, Homo Sapiens
CDEVFPFFE

SEQ ID NO: 686187 - protein, 9 aa, Homo Sapiens
QEQVFPEPI

SEQ ID NO: 686188 - protein, 9 aa, Homo Sapiens
GDSVRRAVY

SEQ ID NO: 686189 - protein, 9 aa, Homo Sapiens
TAVPSATSL

SEQ ID NO: 686190 - protein, 9 aa, Homo Sapiens
PVQIPASHP

SEQ ID NO: 686191 - protein, 9 aa, Homo Sapiens
QDYEFIDHE

SEQ ID NO: 686192 - protein, 9 aa, Homo Sapiens
VCLHTVRWH

SEQ ID NO: 686193 - protein, 9 aa, Homo Sapiens
PRESGRHHR

SEQ ID NO: 686194 - protein, 9 aa, Homo Sapiens
SVMGGLIPL

SEQ ID NO: 686195 - protein, 9 aa, Homo Sapiens
QLREITLLS

SEQ ID NO: 686196 - protein, 9 aa, Homo Sapiens
IPFYLSGKV

SEQ ID NO: 686197 - protein, 9 aa, Homo Sapiens
SEGKIPVKT

SEQ ID NO: 686198 - protein, 9 aa, Homo Sapiens
SQSPVYESG

SEQ ID NO: 686199 - protein, 9 aa, Homo Sapiens
VSISEDKWW

SEQ ID NO: 686200 - protein, 9 aa, Homo Sapiens
LSKPNRPDT

SEQ ID NO: 686201 - protein, 9 aa, Homo Sapiens
SGKVMGNVY

SEQ ID NO: 686202 - protein, 9 aa, Homo Sapiens
HPGTEIINV

SEQ ID NO: 686203 - protein, 9 aa, Homo Sapiens
IPISRLFPS

SEQ ID NO: 686204 - protein, 9 aa, Homo Sapiens
DVRLLSVSS

SEQ ID NO: 686205 - protein, 9 aa, Homo Sapiens
SKIGIPSSS

SEQ ID NO: 686206 - protein, 9 aa, Homo Sapiens
ISQCDEVFP

SEQ ID NO: 686207 - protein, 9 aa, Homo Sapiens
NLETIPCDA

SEQ ID NO: 686208 - protein, 9 aa, Homo Sapiens
GCSHALQAE

SEQ ID NO: 686209 - protein, 9 aa, Homo Sapiens
IWYVSSTFP

SEQ ID NO: 686210 - protein, 9 aa, Homo Sapiens
CVSISEDKW

SEQ ID NO: 686211 - protein, 9 aa, Homo Sapiens
RCCVSLSNV

SEQ ID NO: 686212 - protein, 9 aa, Homo Sapiens
IPLWLGAGT

SEQ ID NO: 686213 - protein, 9 aa, Homo Sapiens
KDPQEMKTY

SEQ ID NO: 686214 - protein, 9 aa, Homo Sapiens
VIVEPPTDV

SEQ ID NO: 686215 - protein, 9 aa, Homo Sapiens
GLGMGEGGG

SEQ ID NO: 686216 - protein, 9 aa, Homo Sapiens
GPTLEWHNY

SEQ ID NO: 686217 - protein, 9 aa, Homo Sapiens
ACLLEPTAP

SEQ ID NO: 686218 - protein, 9 aa, Homo Sapiens
PRKTVMIDV

SEQ ID NO: 686219 - protein, 9 aa, Homo Sapiens
RWFNLYLSA

SEQ ID NO: 686220 - protein, 9 aa, Homo Sapiens
TVELEEHNR

SEQ ID NO: 686221 - protein, 9 aa, Homo Sapiens
AVSKTDGEV

SEQ ID NO: 686222 - protein, 9 aa, Homo Sapiens
SNKILVNED

SEQ ID NO: 686223 - protein, 9 aa, Homo Sapiens
SNEIRKMLM

SEQ ID NO: 686224 - protein, 9 aa, Homo Sapiens
KRQEWLFTG

SEQ ID NO: 686225 - protein, 9 aa, Homo Sapiens
LEDKTDIKK

SEQ ID NO: 686226 - protein, 9 aa, Homo Sapiens
LSQPRRNIV

SEQ ID NO: 686227 - protein, 9 aa, Homo Sapiens
YLPTMLRVF

SEQ ID NO: 686228 - protein, 9 aa, Homo Sapiens
ARKEPEPLS

SEQ ID NO: 686229 - protein, 9 aa, Homo Sapiens
QHSYEILCL

SEQ ID NO: 686230 - protein, 9 aa, Homo Sapiens
ELTFLGTQD

SEQ ID NO: 686231 - protein, 9 aa, Homo Sapiens
LTHTTSTVE

SEQ ID NO: 686232 - protein, 9 aa, Homo Sapiens
VQPQVSEEV

SEQ ID NO: 686233 - protein, 9 aa, Homo Sapiens
GVKELLADQ

SEQ ID NO: 686234 - protein, 9 aa, Homo Sapiens
NPSRCCVSL

SEQ ID NO: 686235 - protein, 9 aa, Homo Sapiens
NQASVISHH

SEQ ID NO: 686236 - protein, 9 aa, Homo Sapiens
FSPEQCWTA

SEQ ID NO: 686237 - protein, 9 aa, Homo Sapiens
TSPLSMISP

SEQ ID NO: 686238 - protein, 9 aa, Homo Sapiens
IQMLLFWLF

SEQ ID NO: 686239 - protein, 9 aa, Homo Sapiens
TAKVVTWAY

SEQ ID NO: 686240 - protein, 9 aa, Homo Sapiens
QNKLEHYHR

SEQ ID NO: 686241 - protein, 9 aa, Homo Sapiens
SDMGLSLSY

SEQ ID NO: 686242 - protein, 9 aa, Homo Sapiens
PVEQPDEYL

SEQ ID NO: 686243 - protein, 9 aa, Homo Sapiens
EFSEEALFR

SEQ ID NO: 686244 - protein, 9 aa, Homo Sapiens
VELEEHNRT

SEQ ID NO: 686245 - protein, 9 aa, Homo Sapiens
EPEPLSKPN

SEQ ID NO: 686246 - protein, 9 aa, Homo Sapiens
QQLREITLL

SEQ ID NO: 686247 - protein, 9 aa, Homo Sapiens
KIPVKTFFQ

SEQ ID NO: 686248 - protein, 9 aa, Homo Sapiens
EIRSNEIRK

SEQ ID NO: 686249 - protein, 9 aa, Homo Sapiens
TITRSTVSV

SEQ ID NO: 686250 - protein, 9 aa, Homo Sapiens
NFKTITRST

SEQ ID NO: 686251 - protein, 9 aa, Homo Sapiens
SPEQCWTAP

SEQ ID NO: 686252 - protein, 9 aa, Homo Sapiens
VLVGNRYCD

SEQ ID NO: 686253 - protein, 9 aa, Homo Sapiens
DYEFIDHEC

SEQ ID NO: 686254 - protein, 9 aa, Homo Sapiens
TSISDETHP

SEQ ID NO: 686255 - protein, 9 aa, Homo Sapiens
ILQLQNKLE

SEQ ID NO: 686256 - protein, 9 aa, Homo Sapiens
LLVLENNKN

SEQ ID NO: 686257 - protein, 9 aa, Homo Sapiens
HTTSTVELE

SEQ ID NO: 686258 - protein, 9 aa, Homo Sapiens
MFRLTSIFH

SEQ ID NO: 686259 - protein, 9 aa, Homo Sapiens
PPGAAVASV

SEQ ID NO: 686260 - protein, 9 aa, Homo Sapiens
LKLTLIQKV

SEQ ID NO: 686261 - protein, 9 aa, Homo Sapiens
GLIPLLLLL

SEQ ID NO: 686262 - protein, 9 aa, Homo Sapiens
KGPARLLSS

SEQ ID NO: 686263 - protein, 9 aa, Homo Sapiens
LKLLATGRE

SEQ ID NO: 686264 - protein, 9 aa, Homo Sapiens
IPVKTFFQM

SEQ ID NO: 686265 - protein, 9 aa, Homo Sapiens
FQSSGNMTD

SEQ ID NO: 686266 - protein, 9 aa, Homo Sapiens
PRIQMLLFW

SEQ ID NO: 686267 - protein, 9 aa, Homo Sapiens
AAPLWEIKK

SEQ ID NO: 686268 - protein, 9 aa, Homo Sapiens
FPKMLVNFL

SEQ ID NO: 686269 - protein, 9 aa, Homo Sapiens
SRRSASTEP

SEQ ID NO: 686270 - protein, 9 aa, Homo Sapiens
GIPSSSSED

SEQ ID NO: 686271 - protein, 9 aa, Homo Sapiens
TSTVELEEH

SEQ ID NO: 686272 - protein, 9 aa, Homo Sapiens
LECKIQGMS

SEQ ID NO: 686273 - protein, 9 aa, Homo Sapiens
EYYIFLFAL

SEQ ID NO: 686274 - protein, 9 aa, Homo Sapiens
PPMVDAVAR

SEQ ID NO: 686275 - protein, 9 aa, Homo Sapiens
GFTLAHKVD

SEQ ID NO: 686276 - protein, 9 aa, Homo Sapiens
GPRKTVMID

SEQ ID NO: 686277 - protein, 9 aa, Homo Sapiens
MCHKADEEL

SEQ ID NO: 686278 - protein, 9 aa, Homo Sapiens
PLWEIKKQS

SEQ ID NO: 686279 - protein, 9 aa, Homo Sapiens
DMMFRLTSI

SEQ ID NO: 686280 - protein, 9 aa, Homo Sapiens
VLQHPCIET

SEQ ID NO: 686281 - protein, 9 aa, Homo Sapiens
GSQWARGED

SEQ ID NO: 686282 - protein, 9 aa, Homo Sapiens
PEQCWTAPK

SEQ ID NO: 686283 - protein, 9 aa, Homo Sapiens
FMQMNQKLF

SEQ ID NO: 686284 - protein, 9 aa, Homo Sapiens
ILVDADSLW

SEQ ID NO: 686285 - protein, 9 aa, Homo Sapiens
STVELEEHN

SEQ ID NO: 686286 - protein, 9 aa, Homo Sapiens
LARENKPCI

SEQ ID NO: 686287 - protein, 9 aa, Homo Sapiens
TVFLSPPDP

SEQ ID NO: 686288 - protein, 9 aa, Homo Sapiens
QHGEALNRS

SEQ ID NO: 686289 - protein, 9 aa, Homo Sapiens
HRQVVLEDG

SEQ ID NO: 686290 - protein, 9 aa, Homo Sapiens
HYCGVCLHT

SEQ ID NO: 686291 - protein, 9 aa, Homo Sapiens
EDGLDPVDT

SEQ ID NO: 686292 - protein, 9 aa, Homo Sapiens
LPGNLMVVQ

SEQ ID NO: 686293 - protein, 9 aa, Homo Sapiens
LTEAQNTCA

SEQ ID NO: 686294 - protein, 9 aa, Homo Sapiens
VTACLIAVS

SEQ ID NO: 686295 - protein, 9 aa, Homo Sapiens
PQYDPNTLE

SEQ ID NO: 686296 - protein, 9 aa, Homo Sapiens
RMIKEEIEY

SEQ ID NO: 686297 - protein, 9 aa, Homo Sapiens
SKVCSFGKH

SEQ ID NO: 686298 - protein, 9 aa, Homo Sapiens
NKLSVKNKF

SEQ ID NO: 686299 - protein, 9 aa, Homo Sapiens
AVVQVLVEK

SEQ ID NO: 686300 - protein, 9 aa, Homo Sapiens
TETDYGLLT

SEQ ID NO: 686301 - protein, 9 aa, Homo Sapiens
FGIWQGKIR

SEQ ID NO: 686302 - protein, 9 aa, Homo Sapiens
PLCRLTIRN

SEQ ID NO: 686303 - protein, 9 aa, Homo Sapiens
PLLLLLLVF

SEQ ID NO: 686304 - protein, 9 aa, Homo Sapiens
LHLNTSSVL

SEQ ID NO: 686305 - protein, 9 aa, Homo Sapiens
DIYTLEELA

SEQ ID NO: 686306 - protein, 9 aa, Homo Sapiens
DQSGAPGAP

SEQ ID NO: 686307 - protein, 9 aa, Homo Sapiens
CATMVQHGE

SEQ ID NO: 686308 - protein, 9 aa, Homo Sapiens
CGVCLHTVR

SEQ ID NO: 686309 - protein, 9 aa, Homo Sapiens
QIMLEKTPS

SEQ ID NO: 686310 - protein, 9 aa, Homo Sapiens
HADLTVNED

SEQ ID NO: 686311 - protein, 9 aa, Homo Sapiens
MQMNQKLFD

SEQ ID NO: 686312 - protein, 9 aa, Homo Sapiens
CLLPGTKYI

SEQ ID NO: 686313 - protein, 9 aa, Homo Sapiens
SCCTTQLFV

SEQ ID NO: 686314 - protein, 9 aa, Homo Sapiens
NSIILVWGS

SEQ ID NO: 686315 - protein, 9 aa, Homo Sapiens
YGKGKAFRP

SEQ ID NO: 686316 - protein, 9 aa, Homo Sapiens
WTAPKKLTQ

SEQ ID NO: 686317 - protein, 9 aa, Homo Sapiens
CFWEVHYGI

SEQ ID NO: 686318 - protein, 9 aa, Homo Sapiens
WINVEISGD

SEQ ID NO: 686319 - protein, 9 aa, Homo Sapiens
VQAAIQVDP

SEQ ID NO: 686320 - protein, 9 aa, Homo Sapiens
ALGQFIKEV

SEQ ID NO: 686321 - protein, 9 aa, Homo Sapiens
TLESQIMLE

SEQ ID NO: 686322 - protein, 9 aa, Homo Sapiens
PFPTVFLSP

SEQ ID NO: 686323 - protein, 9 aa, Homo Sapiens
AHKVDGPFF

SEQ ID NO: 686324 - protein, 9 aa, Homo Sapiens
DIGGQKSLR

SEQ ID NO: 686325 - protein, 9 aa, Homo Sapiens
FVVGYALDC

SEQ ID NO: 686326 - protein, 9 aa, Homo Sapiens
ETLIRKKGP

SEQ ID NO: 686327 - protein, 9 aa, Homo Sapiens
ITLLSSQSS

SEQ ID NO: 686328 - protein, 9 aa, Homo Sapiens
SPRMSGLLY

SEQ ID NO: 686329 - protein, 9 aa, Homo Sapiens
RKRQSVQAA

SEQ ID NO: 686330 - protein, 9 aa, Homo Sapiens
WDIGGQKSL

SEQ ID NO: 686331 - protein, 9 aa, Homo Sapiens
WEIKKQSFV

SEQ ID NO: 686332 - protein, 9 aa, Homo Sapiens
DSGISCSSE

SEQ ID NO: 686333 - protein, 9 aa, Homo Sapiens
GSEDGLPEA

SEQ ID NO: 686334 - protein, 9 aa, Homo Sapiens
LFWLFSLFY

SEQ ID NO: 686335 - protein, 9 aa, Homo Sapiens
PETAKFSPS

SEQ ID NO: 686336 - protein, 9 aa, Homo Sapiens
CPRGLCIPE

SEQ ID NO: 686337 - protein, 9 aa, Homo Sapiens
LFFAEKLYK

SEQ ID NO: 686338 - protein, 9 aa, Homo Sapiens
TLEELAQRT

SEQ ID NO: 686339 - protein, 9 aa, Homo Sapiens
LRDLSLYIS

SEQ ID NO: 686340 - protein, 9 aa, Homo Sapiens
HHHLSKQKQ

SEQ ID NO: 686341 - protein, 9 aa, Homo Sapiens
WLFSLFYIF

SEQ ID NO: 686342 - protein, 9 aa, Homo Sapiens
SRTPGWHQL

SEQ ID NO: 686343 - protein, 9 aa, Homo Sapiens
LFVSSWGWQ

SEQ ID NO: 686344 - protein, 9 aa, Homo Sapiens
AVQVSTEDL

SEQ ID NO: 686345 - protein, 9 aa, Homo Sapiens
TSSVLCDCQ

SEQ ID NO: 686346 - protein, 9 aa, Homo Sapiens
VAPRKACNA

SEQ ID NO: 686347 - protein, 9 aa, Homo Sapiens
KSHLFVYEG

SEQ ID NO: 686348 - protein, 9 aa, Homo Sapiens
QKVVEEEER

SEQ ID NO: 686349 - protein, 9 aa, Homo Sapiens
QLTFYTNPS

SEQ ID NO: 686350 - protein, 9 aa, Homo Sapiens
THLILSPDL

SEQ ID NO: 686351 - protein, 9 aa, Homo Sapiens
PRMSGLLYQ

SEQ ID NO: 686352 - protein, 9 aa, Homo Sapiens
GGGARERLF

SEQ ID NO: 686353 - protein, 9 aa, Homo Sapiens
VILIKCDQR

SEQ ID NO: 686354 - protein, 9 aa, Homo Sapiens
ALKLFMQMN

SEQ ID NO: 686355 - protein, 9 aa, Homo Sapiens
PIWVLVTLE

SEQ ID NO: 686356 - protein, 9 aa, Homo Sapiens
TQVRGYLNQ

SEQ ID NO: 686357 - protein, 9 aa, Homo Sapiens
RDSYQKGFW

SEQ ID NO: 686358 - protein, 9 aa, Homo Sapiens
RSASTEPAP

SEQ ID NO: 686359 - protein, 9 aa, Homo Sapiens
KIRELNDMA

SEQ ID NO: 686360 - protein, 9 aa, Homo Sapiens
SSVGPSKPL

SEQ ID NO: 686361 - protein, 9 aa, Homo Sapiens
KKRQIKDLE

SEQ ID NO: 686362 - protein, 9 aa, Homo Sapiens
GPKWKLYSA

SEQ ID NO: 686363 - protein, 9 aa, Homo Sapiens
PGHLCCVSI

SEQ ID NO: 686364 - protein, 9 aa, Homo Sapiens
SSIIQGIGK

SEQ ID NO: 686365 - protein, 9 aa, Homo Sapiens
RDLSLYISF

SEQ ID NO: 686366 - protein, 9 aa, Homo Sapiens
PRGLCIPEK

SEQ ID NO: 686367 - protein, 9 aa, Homo Sapiens
LLTHLILSP

SEQ ID NO: 686368 - protein, 9 aa, Homo Sapiens
KPLFFAEKL

SEQ ID NO: 686369 - protein, 9 aa, Homo Sapiens
QTPEVATKQ

SEQ ID NO: 686370 - protein, 9 aa, Homo Sapiens
YCGVCLHTV

SEQ ID NO: 686371 - protein, 9 aa, Homo Sapiens
ASYLAEGGR

SEQ ID NO: 686372 - protein, 9 aa, Homo Sapiens
KSLPIVAKG

SEQ ID NO: 686373 - protein, 9 aa, Homo Sapiens
GEFSEEALF

SEQ ID NO: 686374 - protein, 9 aa, Homo Sapiens
AIHLDKNDD

SEQ ID NO: 686375 - protein, 9 aa, Homo Sapiens
VMGGLIPLL

SEQ ID NO: 686376 - protein, 9 aa, Homo Sapiens
SQWARGEDA

SEQ ID NO: 686377 - protein, 9 aa, Homo Sapiens
LSYLPTMLR

SEQ ID NO: 686378 - protein, 9 aa, Homo Sapiens
SISEDKWWY

SEQ ID NO: 686379 - protein, 9 aa, Homo Sapiens
VRGYLNQVD

SEQ ID NO: 686380 - protein, 9 aa, Homo Sapiens
SALLIHTAI

SEQ ID NO: 686381 - protein, 9 aa, Homo Sapiens
KQDHYNWGL

SEQ ID NO: 686382 - protein, 9 aa, Homo Sapiens
SHLFVYEGL

SEQ ID NO: 686383 - protein, 9 aa, Homo Sapiens
HLRDLSLYI

SEQ ID NO: 686384 - protein, 9 aa, Homo Sapiens
SLSYLPTML

SEQ ID NO: 686385 - protein, 9 aa, Homo Sapiens
TTNCGPPLV

SEQ ID NO: 686386 - protein, 9 aa, Homo Sapiens
GYFTALGQF

SEQ ID NO: 686387 - protein, 9 aa, Homo Sapiens
SASTEPAPR

SEQ ID NO: 686388 - protein, 9 aa, Homo Sapiens
VTTEIPPRY

SEQ ID NO: 686389 - protein, 9 aa, Homo Sapiens
FKDSAHGYL

SEQ ID NO: 686390 - protein, 9 aa, Homo Sapiens
YVSSTFPKM

SEQ ID NO: 686391 - protein, 9 aa, Homo Sapiens
QLARENKPC

SEQ ID NO: 686392 - protein, 9 aa, Homo Sapiens
EDPMMMTAV

SEQ ID NO: 686393 - protein, 9 aa, Homo Sapiens
EIWYVSSTF

SEQ ID NO: 686394 - protein, 9 aa, Homo Sapiens
PDGAVVQVL

SEQ ID NO: 686395 - protein, 9 aa, Homo Sapiens
MWDIGGQKS

SEQ ID NO: 686396 - protein, 9 aa, Homo Sapiens
FPSRTPGWH

SEQ ID NO: 686397 - protein, 9 aa, Homo Sapiens
DENGDFREH

SEQ ID NO: 686398 - protein, 9 aa, Homo Sapiens
DQPRLEIPP

SEQ ID NO: 686399 - protein, 9 aa, Homo Sapiens
HYPDIYTLE

SEQ ID NO: 686400 - protein, 9 aa, Homo Sapiens
LSAPSDPMD

SEQ ID NO: 686401 - protein, 9 aa, Homo Sapiens
PLHLRDLSL

SEQ ID NO: 686402 - protein, 9 aa, Homo Sapiens
ADEELLQAF

SEQ ID NO: 686403 - protein, 9 aa, Homo Sapiens
HYGILAGAL

SEQ ID NO: 686404 - protein, 9 aa, Homo Sapiens
ILECKIQGM

SEQ ID NO: 686405 - protein, 9 aa, Homo Sapiens
ALVVFALAN

SEQ ID NO: 686406 - protein, 9 aa, Homo Sapiens
TALGQFIKE

SEQ ID NO: 686407 - protein, 9 aa, Homo Sapiens
FAILISLPI

SEQ ID NO: 686408 - protein, 9 aa, Homo Sapiens
ILISLPIWV

SEQ ID NO: 686409 - protein, 9 aa, Homo Sapiens
ARGCSHALQ

SEQ ID NO: 686410 - protein, 9 aa, Homo Sapiens
ERCYNDVRL

SEQ ID NO: 686411 - protein, 9 aa, Homo Sapiens
HGYLKVPPR

SEQ ID NO: 686412 - protein, 9 aa, Homo Sapiens
SKVSDTAYR

SEQ ID NO: 686413 - protein, 9 aa, Homo Sapiens
GTPGIVKSS

SEQ ID NO: 686414 - protein, 9 aa, Homo Sapiens
ESGRHHRPG

SEQ ID NO: 686415 - protein, 9 aa, Homo Sapiens
PATFQATKT

SEQ ID NO: 686416 - protein, 9 aa, Homo Sapiens
LTGNKAEDI

SEQ ID NO: 686417 - protein, 9 aa, Homo Sapiens
VLLVLENNK

SEQ ID NO: 686418 - protein, 9 aa, Homo Sapiens
PRTLESQIM

SEQ ID NO: 686419 - protein, 9 aa, Homo Sapiens
LYISFVSLE

SEQ ID NO: 686420 - protein, 9 aa, Homo Sapiens
TLIQKVFSP

SEQ ID NO: 686421 - protein, 9 aa, Homo Sapiens
RLPVAPRKA

SEQ ID NO: 686422 - protein, 9 aa, Homo Sapiens
FSDQPRLEI

SEQ ID NO: 686423 - protein, 9 aa, Homo Sapiens
VVLEDGLDP

SEQ ID NO: 686424 - protein, 9 aa, Homo Sapiens
RKNSKVSDT

SEQ ID NO: 686425 - protein, 9 aa, Homo Sapiens
ATFQATKTD

SEQ ID NO: 686426 - protein, 9 aa, Homo Sapiens
HQVLQHPCI

SEQ ID NO: 686427 - protein, 9 aa, Homo Sapiens
VDCALSLIG

SEQ ID NO: 686428 - protein, 9 aa, Homo Sapiens
GQKSLRSSW

SEQ ID NO: 686429 - protein, 9 aa, Homo Sapiens
LSPPDPLLG

SEQ ID NO: 686430 - protein, 9 aa, Homo Sapiens
NEDEFRNML

SEQ ID NO: 686431 - protein, 9 aa, Homo Sapiens
TVGFVSFFL

SEQ ID NO: 686432 - protein, 9 aa, Homo Sapiens
ESSAPSEVQ

SEQ ID NO: 686433 - protein, 9 aa, Homo Sapiens
TGMTETDYG

SEQ ID NO: 686434 - protein, 9 aa, Homo Sapiens
KMRNSDNSS

SEQ ID NO: 686435 - protein, 9 aa, Homo Sapiens
PFCPRGLCI

SEQ ID NO: 686436 - protein, 9 aa, Homo Sapiens
KKGPARLLS

SEQ ID NO: 686437 - protein, 9 aa, Homo Sapiens
ISMKDPQEM

SEQ ID NO: 686438 - protein, 9 aa, Homo Sapiens
EFIDHECLA

SEQ ID NO: 686439 - protein, 9 aa, Homo Sapiens
GDGVDGNML

SEQ ID NO: 686440 - protein, 9 aa, Homo Sapiens
LVDADSLWV

SEQ ID NO: 686441 - protein, 9 aa, Homo Sapiens
RLKSLPIVA

SEQ ID NO: 686442 - protein, 9 aa, Homo Sapiens
RNMLTRCNN

SEQ ID NO: 686443 - protein, 9 aa, Homo Sapiens
LCATPPGAA

SEQ ID NO: 686444 - protein, 9 aa, Homo Sapiens
VSKTDGEVQ

SEQ ID NO: 686445 - protein, 9 aa, Homo Sapiens
ALEKETMTN

SEQ ID NO: 686446 - protein, 9 aa, Homo Sapiens
YPDIYTLEE

SEQ ID NO: 686447 - protein, 9 aa, Homo Sapiens
PSPLTMGGQ

SEQ ID NO: 686448 - protein, 9 aa, Homo Sapiens
GGELTFLGT

SEQ ID NO: 686449 - protein, 9 aa, Homo Sapiens
ILARGCSHA

SEQ ID NO: 686450 - protein, 9 aa, Homo Sapiens
LVRTILARG

SEQ ID NO: 686451 - protein, 9 aa, Homo Sapiens
PLGPRESGR

SEQ ID NO: 686452 - protein, 9 aa, Homo Sapiens
ERDILVDAD

SEQ ID NO: 686453 - protein, 9 aa, Homo Sapiens
KHVVEKVET

SEQ ID NO: 686454 - protein, 9 aa, Homo Sapiens
QNPSRCCVS

SEQ ID NO: 686455 - protein, 9 aa, Homo Sapiens
GNRYCDIVN

SEQ ID NO: 686456 - protein, 9 aa, Homo Sapiens
LKILRAVLQ

SEQ ID NO: 686457 - protein, 9 aa, Homo Sapiens
SAPSDPMDI

SEQ ID NO: 686458 - protein, 9 aa, Homo Sapiens
ESSATISKE

SEQ ID NO: 686459 - protein, 9 aa, Homo Sapiens
ISALLIHTA

SEQ ID NO: 686460 - protein, 9 aa, Homo Sapiens
LDFYMFLGQ

SEQ ID NO: 686461 - protein, 9 aa, Homo Sapiens
VGYALDCNE

SEQ ID NO: 686462 - protein, 9 aa, Homo Sapiens
DLEDKTDIK

SEQ ID NO: 686463 - protein, 9 aa, Homo Sapiens
CVSSIIQGI

SEQ ID NO: 686464 - protein, 9 aa, Homo Sapiens
VYEGLKNYV

SEQ ID NO: 686465 - protein, 9 aa, Homo Sapiens
PLTMGGQDT

SEQ ID NO: 686466 - protein, 9 aa, Homo Sapiens
QASVISHHH

SEQ ID NO: 686467 - protein, 9 aa, Homo Sapiens
DILVDADSL

SEQ ID NO: 686468 - protein, 9 aa, Homo Sapiens
FPYVIWIDE

SEQ ID NO: 686469 - protein, 9 aa, Homo Sapiens
ATGKLSFPL

SEQ ID NO: 686470 - protein, 9 aa, Homo Sapiens
TLEWHNYDL

SEQ ID NO: 686471 - protein, 9 aa, Homo Sapiens
ASTAKKCLS

SEQ ID NO: 686472 - protein, 9 aa, Homo Sapiens
VVGALVVFA

SEQ ID NO: 686473 - protein, 9 aa, Homo Sapiens
GDDASYLAE

SEQ ID NO: 686474 - protein, 9 aa, Homo Sapiens
GNIGNPPKT

SEQ ID NO: 686475 - protein, 9 aa, Homo Sapiens
LYFEATPYY

SEQ ID NO: 686476 - protein, 9 aa, Homo Sapiens
NKFPSDPEV

SEQ ID NO: 686477 - protein, 9 aa, Homo Sapiens
LDQSGAPGA

SEQ ID NO: 686478 - protein, 9 aa, Homo Sapiens
QPCTRKKGS

SEQ ID NO: 686479 - protein, 9 aa, Homo Sapiens
FRLTSIFHL

SEQ ID NO: 686480 - protein, 9 aa, Homo Sapiens
KVVTWAYNL

SEQ ID NO: 686481 - protein, 9 aa, Homo Sapiens
FREHNFNTA

SEQ ID NO: 686482 - protein, 9 aa, Homo Sapiens
DSITWLYDN

SEQ ID NO: 686483 - protein, 9 aa, Homo Sapiens
TGPTLEWHN

SEQ ID NO: 686484 - protein, 9 aa, Homo Sapiens
DPNTLENDV

SEQ ID NO: 686485 - protein, 9 aa, Homo Sapiens
IMLEKTPSY

SEQ ID NO: 686486 - protein, 9 aa, Homo Sapiens
GKLSFPLKN

SEQ ID NO: 686487 - protein, 9 aa, Homo Sapiens
PVKTFFQMF

SEQ ID NO: 686488 - protein, 9 aa, Homo Sapiens
SSSSEDTIL

SEQ ID NO: 686489 - protein, 9 aa, Homo Sapiens
TEKMRNSDN

SEQ ID NO: 686490 - protein, 9 aa, Homo Sapiens
SGDGVDGNM

SEQ ID NO: 686491 - protein, 9 aa, Homo Sapiens
SSFPYVIWI

SEQ ID NO: 686492 - protein, 9 aa, Homo Sapiens
VLIAVSLAT

SEQ ID NO: 686493 - protein, 9 aa, Homo Sapiens
HNFNTAMQV

SEQ ID NO: 686494 - protein, 9 aa, Homo Sapiens
WFNLYLSAC

SEQ ID NO: 686495 - protein, 9 aa, Homo Sapiens
QYDPNTLEN

SEQ ID NO: 686496 - protein, 9 aa, Homo Sapiens
GPPLVTHSS

SEQ ID NO: 686497 - protein, 9 aa, Homo Sapiens
ILGDSVRRA

SEQ ID NO: 686498 - protein, 9 aa, Homo Sapiens
LLEPNTPWC

SEQ ID NO: 686499 - protein, 9 aa, Homo Sapiens
LEDGLDPVD

SEQ ID NO: 686500 - protein, 9 aa, Homo Sapiens
PFLDQSGAP

SEQ ID NO: 686501 - protein, 9 aa, Homo Sapiens
DELSKVGVK

SEQ ID NO: 686502 - protein, 9 aa, Homo Sapiens
PLPPLPRAG

SEQ ID NO: 686503 - protein, 9 aa, Homo Sapiens
GMGEGGGPA

SEQ ID NO: 686504 - protein, 9 aa, Homo Sapiens
LPLCRLTIR

SEQ ID NO: 686505 - protein, 9 aa, Homo Sapiens
GKIRELNDM

SEQ ID NO: 686506 - protein, 9 aa, Homo Sapiens
TILQLQNKL

SEQ ID NO: 686507 - protein, 9 aa, Homo Sapiens
QMNQKLFDD

SEQ ID NO: 686508 - protein, 9 aa, Homo Sapiens
LVTHSSVQP

SEQ ID NO: 686509 - protein, 9 aa, Homo Sapiens
YQKGFWTEF

SEQ ID NO: 686510 - protein, 9 aa, Homo Sapiens
SDSPRSWIP

SEQ ID NO: 686511 - protein, 9 aa, Homo Sapiens
PWLSDSSVS

SEQ ID NO: 686512 - protein, 9 aa, Homo Sapiens
RRSASTEPA

SEQ ID NO: 686513 - protein, 9 aa, Homo Sapiens
DCNEYFRDL

SEQ ID NO: 686514 - protein, 9 aa, Homo Sapiens
DSPRSWIPV

SEQ ID NO: 686515 - protein, 9 aa, Homo Sapiens
MFLGQTPEV

SEQ ID NO: 686516 - protein, 9 aa, Homo Sapiens
RIQMLLFWL

SEQ ID NO: 686517 - protein, 9 aa, Homo Sapiens
VDGNMLMVT

SEQ ID NO: 686518 - protein, 9 aa, Homo Sapiens
ILRAVLQDD

SEQ ID NO: 686519 - protein, 9 aa, Homo Sapiens
SRLYGDDAS

SEQ ID NO: 686520 - protein, 9 aa, Homo Sapiens
NISMKDPQE

SEQ ID NO: 686521 - protein, 9 aa, Homo Sapiens
LTHLILSPD

SEQ ID NO: 686522 - protein, 9 aa, Homo Sapiens
TFPKMLVNF

SEQ ID NO: 686523 - protein, 9 aa, Homo Sapiens
SRCCVSLSN

SEQ ID NO: 686524 - protein, 9 aa, Homo Sapiens
RAAPLWEIK

SEQ ID NO: 686525 - protein, 9 aa, Homo Sapiens
YEVQPQVSE

SEQ ID NO: 686526 - protein, 9 aa, Homo Sapiens
YTNPSRSRR

SEQ ID NO: 686527 - protein, 9 aa, Homo Sapiens
FFEAAVQVS

SEQ ID NO: 686528 - protein, 9 aa, Homo Sapiens
TFIFAGHDT

SEQ ID NO: 686529 - protein, 9 aa, Homo Sapiens
GIVKSSSGS

SEQ ID NO: 686530 - protein, 9 aa, Homo Sapiens
NTSSVLCDC

SEQ ID NO: 686531 - protein, 9 aa, Homo Sapiens
GNKLQLTGN

SEQ ID NO: 686532 - protein, 9 aa, Homo Sapiens
PPRYKMEDN

SEQ ID NO: 686533 - protein, 9 aa, Homo Sapiens
VRAAPLWEI

SEQ ID NO: 686534 - protein, 9 aa, Homo Sapiens
FHTSFDMMF

SEQ ID NO: 686535 - protein, 9 aa, Homo Sapiens
GQTPEVATK

SEQ ID NO: 686536 - protein, 9 aa, Homo Sapiens
LIAVSLATS

SEQ ID NO: 686537 - protein, 9 aa, Homo Sapiens
AQKVVEEEE

SEQ ID NO: 686538 - protein, 9 aa, Homo Sapiens
LYGDDASYL

SEQ ID NO: 686539 - protein, 9 aa, Homo Sapiens
LPLPPLPRA

SEQ ID NO: 686540 - protein, 9 aa, Homo Sapiens
CLHTVRWHQ

SEQ ID NO: 686541 - protein, 9 aa, Homo Sapiens
AIEKSSSSQ

SEQ ID NO: 686542 - protein, 9 aa, Homo Sapiens
IKKQSFVGM

SEQ ID NO: 686543 - protein, 9 aa, Homo Sapiens
YAVIMTDLF

SEQ ID NO: 686544 - protein, 9 aa, Homo Sapiens
FIDHECLAK

SEQ ID NO: 686545 - protein, 9 aa, Homo Sapiens
LPIWVLVTL

SEQ ID NO: 686546 - protein, 9 aa, Homo Sapiens
PSEVQKAEE

SEQ ID NO: 686547 - protein, 9 aa, Homo Sapiens
GTAKVVTWA

SEQ ID NO: 686548 - protein, 9 aa, Homo Sapiens
SCSSPGAGV

SEQ ID NO: 686549 - protein, 9 aa, Homo Sapiens
LTVGFVSFF

SEQ ID NO: 686550 - protein, 9 aa, Homo Sapiens
LVVFALANA

SEQ ID NO: 686551 - protein, 9 aa, Homo Sapiens
IYNISMKDP

SEQ ID NO: 686552 - protein, 9 aa, Homo Sapiens
NTMGNYMCQ

SEQ ID NO: 686553 - protein, 9 aa, Homo Sapiens
YVIWIDELF

SEQ ID NO: 686554 - protein, 9 aa, Homo Sapiens
VGGNKLQLT

SEQ ID NO: 686555 - protein, 9 aa, Homo Sapiens
ARGEDALQA

SEQ ID NO: 686556 - protein, 9 aa, Homo Sapiens
SYNSQRWFN

SEQ ID NO: 686557 - protein, 9 aa, Homo Sapiens
DSYQKGFWT

SEQ ID NO: 686558 - protein, 9 aa, Homo Sapiens
RESGRHHRP

SEQ ID NO: 686559 - protein, 9 aa, Homo Sapiens
HNYDLREDA

SEQ ID NO: 686560 - protein, 9 aa, Homo Sapiens
LSGKVMGNV

SEQ ID NO: 686561 - protein, 9 aa, Homo Sapiens
LLFWLFSLF

SEQ ID NO: 686562 - protein, 9 aa, Homo Sapiens
EKMRNSDNS

SEQ ID NO: 686563 - protein, 9 aa, Homo Sapiens
EFLHEKQRE

SEQ ID NO: 686564 - protein, 9 aa, Homo Sapiens
EQVFPEPIF

SEQ ID NO: 686565 - protein, 9 aa, Homo Sapiens
GGARERLFT

SEQ ID NO: 686566 - protein, 9 aa, Homo Sapiens
CLLEPTAPT

SEQ ID NO: 686567 - protein, 9 aa, Homo Sapiens
RSWIPVQIP

SEQ ID NO: 686568 - protein, 9 aa, Homo Sapiens
RQFNQTFQS

SEQ ID NO: 686569 - protein, 9 aa, Homo Sapiens
VKELLADQN

SEQ ID NO: 686570 - protein, 9 aa, Homo Sapiens
FHYCGVCLH

SEQ ID NO: 686571 - protein, 9 aa, Homo Sapiens
LPTVTLPGN

SEQ ID NO: 686572 - protein, 9 aa, Homo Sapiens
TTSTVELEE

SEQ ID NO: 686573 - protein, 9 aa, Homo Sapiens
RSGKRQEWL

SEQ ID NO: 686574 - protein, 9 aa, Homo Sapiens
LLIHTAIHT

SEQ ID NO: 686575 - protein, 9 aa, Homo Sapiens
YNWGLRAIK

SEQ ID NO: 686576 - protein, 9 aa, Homo Sapiens
QGYFTALGQ

SEQ ID NO: 686577 - protein, 9 aa, Homo Sapiens
GTIRSGKRQ

SEQ ID NO: 686578 - protein, 9 aa, Homo Sapiens
YDPNTLEND

SEQ ID NO: 686579 - protein, 9 aa, Homo Sapiens
LFMQMNQKL

SEQ ID NO: 686580 - protein, 9 aa, Homo Sapiens
CDQRGKMIP

SEQ ID NO: 686581 - protein, 9 aa, Homo Sapiens
SVCDVEIRS

SEQ ID NO: 686582 - protein, 9 aa, Homo Sapiens
CLIAVSKTD

SEQ ID NO: 686583 - protein, 9 aa, Homo Sapiens
DGNMLMVTL

SEQ ID NO: 686584 - protein, 9 aa, Homo Sapiens
LLYQTVILA

SEQ ID NO: 686585 - protein, 9 aa, Homo Sapiens
SISDETHPG

SEQ ID NO: 686586 - protein, 9 aa, Homo Sapiens
FTQSSMRSE

SEQ ID NO: 686587 - protein, 9 aa, Homo Sapiens
YALDCNEYF

SEQ ID NO: 686588 - protein, 9 aa, Homo Sapiens
SSEIGVGVT

SEQ ID NO: 686589 - protein, 9 aa, Homo Sapiens
PDEYLDPDA

SEQ ID NO: 686590 - protein, 9 aa, Homo Sapiens
FEKQGAKDF

SEQ ID NO: 686591 - protein, 9 aa, Homo Sapiens
MLTRCNNVG

SEQ ID NO: 686592 - protein, 9 aa, Homo Sapiens
DRIAQRMIK

SEQ ID NO: 686593 - protein, 9 aa, Homo Sapiens
EVQPQVSEE

SEQ ID NO: 686594 - protein, 9 aa, Homo Sapiens
ARENKPCII

SEQ ID NO: 686595 - protein, 9 aa, Homo Sapiens
KQRELELNA

SEQ ID NO: 686596 - protein, 9 aa, Homo Sapiens
VKTFIFAGH

SEQ ID NO: 686597 - protein, 9 aa, Homo Sapiens
QAEVKTFIF

SEQ ID NO: 686598 - protein, 9 aa, Homo Sapiens
KFPSDPEVP

SEQ ID NO: 686599 - protein, 9 aa, Homo Sapiens
DDASYLAEG

SEQ ID NO: 686600 - protein, 9 aa, Homo Sapiens
IKCDQRGKM

SEQ ID NO: 686601 - protein, 9 aa, Homo Sapiens
DLSLYISFV

SEQ ID NO: 686602 - protein, 9 aa, Homo Sapiens
VFALANALG

SEQ ID NO: 686603 - protein, 9 aa, Homo Sapiens
LSCQNLNPS

SEQ ID NO: 686604 - protein, 9 aa, Homo Sapiens
AVWLAALIL

SEQ ID NO: 686605 - protein, 9 aa, Homo Sapiens
CDSPGRPEA

SEQ ID NO: 686606 - protein, 9 aa, Homo Sapiens
RMSGLLYQT

SEQ ID NO: 686607 - protein, 9 aa, Homo Sapiens
VILGDSVRR

SEQ ID NO: 686608 - protein, 9 aa, Homo Sapiens
ILIKCDQRG

SEQ ID NO: 686609 - protein, 9 aa, Homo Sapiens
QPRLEIPPF

SEQ ID NO: 686610 - protein, 9 aa, Homo Sapiens
YCATMVQHG

SEQ ID NO: 686611 - protein, 9 aa, Homo Sapiens
FWLFSLFYI

SEQ ID NO: 686612 - protein, 9 aa, Homo Sapiens
VVTWAYNLQ

SEQ ID NO: 686613 - protein, 9 aa, Homo Sapiens
EVKREIIHQ

SEQ ID NO: 686614 - protein, 9 aa, Homo Sapiens
EPNTPWCPK

SEQ ID NO: 686615 - protein, 9 aa, Homo Sapiens
TDIKKRQIK

SEQ ID NO: 686616 - protein, 9 aa, Homo Sapiens
SGKRQEWLF

SEQ ID NO: 686617 - protein, 9 aa, Homo Sapiens
KNSKVSDTA

SEQ ID NO: 686618 - protein, 9 aa, Homo Sapiens
EWHNYDLRE

SEQ ID NO: 686619 - protein, 9 aa, Homo Sapiens
MGGQDTLPV

SEQ ID NO: 686620 - protein, 9 aa, Homo Sapiens
GAPGAPTTP

SEQ ID NO: 686621 - protein, 9 aa, Homo Sapiens
YEILCLLPG

SEQ ID NO: 686622 - protein, 9 aa, Homo Sapiens
ITSPLSMIS

SEQ ID NO: 686623 - protein, 9 aa, Homo Sapiens
NNLETIPCD

SEQ ID NO: 686624 - protein, 9 aa, Homo Sapiens
KALKLTLIQ

SEQ ID NO: 686625 - protein, 9 aa, Homo Sapiens
FLGQTPEVA

SEQ ID NO: 686626 - protein, 9 aa, Homo Sapiens
EIRLKRALY

SEQ ID NO: 686627 - protein, 9 aa, Homo Sapiens
THYPDIYTL

SEQ ID NO: 686628 - protein, 9 aa, Homo Sapiens
HLKILRAVL

SEQ ID NO: 686629 - protein, 9 aa, Homo Sapiens
PCIETAGKT

SEQ ID NO: 686630 - protein, 9 aa, Homo Sapiens
LEKETMTNL

SEQ ID NO: 686631 - protein, 9 aa, Homo Sapiens
GALVVFALA

SEQ ID NO: 686632 - protein, 9 aa, Homo Sapiens
GLLYQTVIL

SEQ ID NO: 686633 - protein, 9 aa, Homo Sapiens
ELRDSYQKG

SEQ ID NO: 686634 - protein, 9 aa, Homo Sapiens
KETMTNLHP

SEQ ID NO: 686635 - protein, 9 aa, Homo Sapiens
KVCSFGKHV

SEQ ID NO: 686636 - protein, 9 aa, Homo Sapiens
GVCLHTVRW

SEQ ID NO: 686637 - protein, 9 aa, Homo Sapiens
RISALLIHT

SEQ ID NO: 686638 - protein, 9 aa, Homo Sapiens
VVEEEERRY

SEQ ID NO: 686639 - protein, 9 aa, Homo Sapiens
KVMGNVYMY

SEQ ID NO: 686640 - protein, 9 aa, Homo Sapiens
NRSHVYAVI

SEQ ID NO: 686641 - protein, 9 aa, Homo Sapiens
IGNPPKTPL

SEQ ID NO: 686642 - protein, 9 aa, Homo Sapiens
LQNKLEHYH

SEQ ID NO: 686643 - protein, 9 aa, Homo Sapiens
ASPVACLLE

SEQ ID NO: 686644 - protein, 9 aa, Homo Sapiens
GQNLQEQVF

SEQ ID NO: 686645 - protein, 9 aa, Homo Sapiens
SHVYAVIMT

SEQ ID NO: 686646 - protein, 9 aa, Homo Sapiens
ALSLIGLGM

SEQ ID NO: 686647 - protein, 9 aa, Homo Sapiens
TSQRPPATF

SEQ ID NO: 686648 - protein, 9 aa, Homo Sapiens
FFVAMLGML

SEQ ID NO: 686649 - protein, 9 aa, Homo Sapiens
SERTYDGKV

SEQ ID NO: 686650 - protein, 9 aa, Homo Sapiens
GLDPVDTGN

SEQ ID NO: 686651 - protein, 9 aa, Homo Sapiens
ASVISHHHL

SEQ ID NO: 686652 - protein, 9 aa, Homo Sapiens
QPKPSLLTH

SEQ ID NO: 686653 - protein, 9 aa, Homo Sapiens
KACNAWLQK

SEQ ID NO: 686654 - protein, 9 aa, Homo Sapiens
KTFIFAGHD

SEQ ID NO: 686655 - protein, 9 aa, Homo Sapiens
FSPSERTYD

SEQ ID NO: 686656 - protein, 9 aa, Homo Sapiens
TNRKNSKVS

SEQ ID NO: 686657 - protein, 9 aa, Homo Sapiens
QGNIGNPPK

SEQ ID NO: 686658 - protein, 9 aa, Homo Sapiens
HYNWGLRAI

SEQ ID NO: 686659 - protein, 9 aa, Homo Sapiens
LTMGGQDTL

SEQ ID NO: 686660 - protein, 9 aa, Homo Sapiens
KSEIATGKL

SEQ ID NO: 686661 - protein, 9 aa, Homo Sapiens
PKWKLYSAV

SEQ ID NO: 686662 - protein, 9 aa, Homo Sapiens
RVTVGQPCT

SEQ ID NO: 686663 - protein, 9 aa, Homo Sapiens
DVEIRSNEI

SEQ ID NO: 686664 - protein, 9 aa, Homo Sapiens
VSEDPMMMT

SEQ ID NO: 686665 - protein, 9 aa, Homo Sapiens
LIKCDQRGK

SEQ ID NO: 686666 - protein, 9 aa, Homo Sapiens
VCDVEIRSN

SEQ ID NO: 686667 - protein, 9 aa, Homo Sapiens
NYMCQCRNG

SEQ ID NO: 686668 - protein, 9 aa, Homo Sapiens
LSMISPLTL

SEQ ID NO: 686669 - protein, 9 aa, Homo Sapiens
PTVTLPGNL

SEQ ID NO: 686670 - protein, 9 aa, Homo Sapiens
LFALSLITQ

SEQ ID NO: 686671 - protein, 9 aa, Homo Sapiens
IRSGKRQEW

SEQ ID NO: 686672 - protein, 9 aa, Homo Sapiens
QHPCIETAG

SEQ ID NO: 686673 - protein, 9 aa, Homo Sapiens
EVNADSITW

SEQ ID NO: 686674 - protein, 9 aa, Homo Sapiens
EPLSKPNRP

SEQ ID NO: 686675 - protein, 9 aa, Homo Sapiens
DFYMFLGQT

SEQ ID NO: 686676 - protein, 9 aa, Homo Sapiens
PCELLPLCR

SEQ ID NO: 686677 - protein, 9 aa, Homo Sapiens
TDVNVTEGM

SEQ ID NO: 686678 - protein, 9 aa, Homo Sapiens
LHLRDLSLY

SEQ ID NO: 686679 - protein, 9 aa, Homo Sapiens
GDFREHNFN

SEQ ID NO: 686680 - protein, 9 aa, Homo Sapiens
GRVTVGQPC

SEQ ID NO: 686681 - protein, 9 aa, Homo Sapiens
VQVLVEKLE

SEQ ID NO: 686682 - protein, 9 aa, Homo Sapiens
SFSGTPGIV

SEQ ID NO: 686683 - protein, 9 aa, Homo Sapiens
DSAHGYLKV

SEQ ID NO: 686684 - protein, 9 aa, Homo Sapiens
AAASPVACL

SEQ ID NO: 686685 - protein, 9 aa, Homo Sapiens
RASSFPYVI

SEQ ID NO: 686686 - protein, 9 aa, Homo Sapiens
ISCSSEIGV

SEQ ID NO: 686687 - protein, 9 aa, Homo Sapiens
NTLENDVAL

SEQ ID NO: 686688 - protein, 9 aa, Homo Sapiens
TMVQHGEAL

SEQ ID NO: 686689 - protein, 9 aa, Homo Sapiens
VGFVSFFLV

SEQ ID NO: 686690 - protein, 9 aa, Homo Sapiens
FAEVNADSI

SEQ ID NO: 686691 - protein, 9 aa, Homo Sapiens
YMFLGQTPE

SEQ ID NO: 686692 - protein, 9 aa, Homo Sapiens
KTDIKKRQI

SEQ ID NO: 686693 - protein, 9 aa, Homo Sapiens
SGRHHRPGS

SEQ ID NO: 686694 - protein, 9 aa, Homo Sapiens
ADLTVNEDS

SEQ ID NO: 686695 - protein, 9 aa, Homo Sapiens
TVTLPGNLM

SEQ ID NO: 686696 - protein, 9 aa, Homo Sapiens
KGGELTFLG

SEQ ID NO: 686697 - protein, 9 aa, Homo Sapiens
LIAVSKTDG

SEQ ID NO: 686698 - protein, 9 aa, Homo Sapiens
SPKAVQRFP

SEQ ID NO: 686699 - protein, 9 aa, Homo Sapiens
QSVQAAIQV

SEQ ID NO: 686700 - protein, 9 aa, Homo Sapiens
VGNRYCDIV

SEQ ID NO: 686701 - protein, 9 aa, Homo Sapiens
NEDVPQKPG

SEQ ID NO: 686702 - protein, 9 aa, Homo Sapiens
AAVQVSTED

SEQ ID NO: 686703 - protein, 9 aa, Homo Sapiens
TPWCPKTGE

SEQ ID NO: 686704 - protein, 9 aa, Homo Sapiens
DETHPGTEI

SEQ ID NO: 686705 - protein, 9 aa, Homo Sapiens
HECVNTMGN

SEQ ID NO: 686706 - protein, 9 aa, Homo Sapiens
NADSITWLY

SEQ ID NO: 686707 - protein, 9 aa, Homo Sapiens
GAAVASVPL

SEQ ID NO: 686708 - protein, 9 aa, Homo Sapiens
QAAIQVDPI

SEQ ID NO: 686709 - protein, 9 aa, Homo Sapiens
PDIYTLEEL

SEQ ID NO: 686710 - protein, 9 aa, Homo Sapiens
WEHGPEAPP

SEQ ID NO: 686711 - protein, 9 aa, Homo Sapiens
EALFRDPCR

SEQ ID NO: 686712 - protein, 9 aa, Homo Sapiens
RAERDILVD

SEQ ID NO: 686713 - protein, 9 aa, Homo Sapiens
DEVKREIIH

SEQ ID NO: 686714 - protein, 9 aa, Homo Sapiens
SLIGLGMER

SEQ ID NO: 686715 - protein, 9 aa, Homo Sapiens
GMTETDYGL

SEQ ID NO: 686716 - protein, 9 aa, Homo Sapiens
FPTVFLSPP

SEQ ID NO: 686717 - protein, 9 aa, Homo Sapiens
REHNFNTAM

SEQ ID NO: 686718 - protein, 9 aa, Homo Sapiens
RLYGDDASY

SEQ ID NO: 686719 - protein, 9 aa, Homo Sapiens
CYNDVRLLS

SEQ ID NO: 686720 - protein, 9 aa, Homo Sapiens
YSILECKIQ

SEQ ID NO: 686721 - protein, 9 aa, Homo Sapiens
DADSLWVVK

SEQ ID NO: 686722 - protein, 9 aa, Homo Sapiens
DPMDIVVTG

SEQ ID NO: 686723 - protein, 9 aa, Homo Sapiens
SLATSFCVA

SEQ ID NO: 686724 - protein, 9 aa, Homo Sapiens
LLVFSDQPR

SEQ ID NO: 686725 - protein, 9 aa, Homo Sapiens
EIKKQSFVG

SEQ ID NO: 686726 - protein, 9 aa, Homo Sapiens
AKSEIATGK

SEQ ID NO: 686727 - protein, 9 aa, Homo Sapiens
DQRGKMIPS

SEQ ID NO: 686728 - protein, 9 aa, Homo Sapiens
AKFSPSERT

SEQ ID NO: 686729 - protein, 9 aa, Homo Sapiens
ESQIMLEKT

SEQ ID NO: 686730 - protein, 9 aa, Homo Sapiens
DIKWLRRLK

SEQ ID NO: 686731 - protein, 9 aa, Homo Sapiens
YNISMKDPQ

SEQ ID NO: 686732 - protein, 9 aa, Homo Sapiens
PTVFLSPPD

SEQ ID NO: 686733 - protein, 9 aa, Homo Sapiens
DPQLTFYTN

SEQ ID NO: 686734 - protein, 9 aa, Homo Sapiens
SVISHHHLS

SEQ ID NO: 686735 - protein, 9 aa, Homo Sapiens
VNADSITWL

SEQ ID NO: 686736 - protein, 9 aa, Homo Sapiens
ISLPIWVLV

SEQ ID NO: 686737 - protein, 9 aa, Homo Sapiens
ARKRQSVQA

SEQ ID NO: 686738 - protein, 9 aa, Homo Sapiens
KCDQRGKMI

SEQ ID NO: 686739 - protein, 9 aa, Homo Sapiens
FLFALSLIT

SEQ ID NO: 686740 - protein, 9 aa, Homo Sapiens
MTAVPSATS

SEQ ID NO: 686741 - protein, 9 aa, Homo Sapiens
MTETDYGLL

SEQ ID NO: 686742 - protein, 9 aa, Homo Sapiens
SAPSSCSSP

SEQ ID NO: 686743 - protein, 9 aa, Homo Sapiens
AAVASVPLS

SEQ ID NO: 686744 - protein, 9 aa, Homo Sapiens
LQKALKLLA

SEQ ID NO: 686745 - protein, 9 aa, Homo Sapiens
EFAILISLP

SEQ ID NO: 686746 - protein, 9 aa, Homo Sapiens
SSGHLMPPW

SEQ ID NO: 686747 - protein, 9 aa, Homo Sapiens
MVQHGEALN

SEQ ID NO: 686748 - protein, 9 aa, Homo Sapiens
VKREIIHQL

SEQ ID NO: 686749 - protein, 9 aa, Homo Sapiens
VVQVLVEKL

SEQ ID NO: 686750 - protein, 9 aa, Homo Sapiens
APGAPTTPR

SEQ ID NO: 686751 - protein, 9 aa, Homo Sapiens
MGGLIPLLL

SEQ ID NO: 686752 - protein, 9 aa, Homo Sapiens
ALLIHTAIH

SEQ ID NO: 686753 - protein, 9 aa, Homo Sapiens
SKPNRPDTS

SEQ ID NO: 686754 - protein, 9 aa, Homo Sapiens
WCPKTGELN

SEQ ID NO: 686755 - protein, 9 aa, Homo Sapiens
LCFWEVHYG

SEQ ID NO: 686756 - protein, 9 aa, Homo Sapiens
PCDSPGRPE

SEQ ID NO: 686757 - protein, 9 aa, Homo Sapiens
IPGTAKVVT

SEQ ID NO: 686758 - protein, 9 aa, Homo Sapiens
ARERLFTSS

SEQ ID NO: 686759 - protein, 9 aa, Homo Sapiens
SGISCSSEI

SEQ ID NO: 686760 - protein, 9 aa, Homo Sapiens
NWGLRAIKS

SEQ ID NO: 686761 - protein, 9 aa, Homo Sapiens
ENKPCIIFI

SEQ ID NO: 686762 - protein, 9 aa, Homo Sapiens
KKCLSCQNL

SEQ ID NO: 686763 - protein, 9 aa, Homo Sapiens
YGDDASYLA

SEQ ID NO: 686764 - protein, 9 aa, Homo Sapiens
VYAVIMTDL

SEQ ID NO: 686765 - protein, 9 aa, Homo Sapiens
QSSMRSEEE

SEQ ID NO: 686766 - protein, 9 aa, Homo Sapiens
YLDNFKTIT

SEQ ID NO: 686767 - protein, 9 aa, Homo Sapiens
SLLTHLILS

SEQ ID NO: 686768 - protein, 9 aa, Homo Sapiens
TVIGPRKTV

SEQ ID NO: 686769 - protein, 9 aa, Homo Sapiens
PISRLFPSR

SEQ ID NO: 686770 - protein, 9 aa, Homo Sapiens
QRPPATFQA

SEQ ID NO: 686771 - protein, 9 aa, Homo Sapiens
YLPRWWEHG

SEQ ID NO: 686772 - protein, 9 aa, Homo Sapiens
RLEIPPFVM

SEQ ID NO: 686773 - protein, 9 aa, Homo Sapiens
MELQQLREI

SEQ ID NO: 686774 - protein, 9 aa, Homo Sapiens
QGKIRELND

SEQ ID NO: 686775 - protein, 9 aa, Homo Sapiens
AHGYLKVPP

SEQ ID NO: 686776 - protein, 9 aa, Homo Sapiens
TQLFVSSWG

SEQ ID NO: 686777 - protein, 9 aa, Homo Sapiens
GAKSEIATG

SEQ ID NO: 686778 - protein, 9 aa, Homo Sapiens
SEIATGKLS

SEQ ID NO: 686779 - protein, 9 aa, Homo Sapiens
RAVLQDDAV

SEQ ID NO: 686780 - protein, 9 aa, Homo Sapiens
VQRFPPMVD

SEQ ID NO: 686781 - protein, 9 aa, Homo Sapiens
EDGLPEAIH

SEQ ID NO: 686782 - protein, 9 aa, Homo Sapiens
SIPGTAKVV

SEQ ID NO: 686783 - protein, 9 aa, Homo Sapiens
VSSWGWQPP

SEQ ID NO: 686784 - protein, 9 aa, Homo Sapiens
LSLIGLGME

SEQ ID NO: 686785 - protein, 9 aa, Homo Sapiens
TAKKCLSCQ

SEQ ID NO: 686786 - protein, 9 aa, Homo Sapiens
VSSIIQGIG

SEQ ID NO: 686787 - protein, 9 aa, Homo Sapiens
KAVQRFPPM

SEQ ID NO: 686788 - protein, 9 aa, Homo Sapiens
GMGSLDAIE

SEQ ID NO: 686789 - protein, 9 aa, Homo Sapiens
LSKVGVKEL

SEQ ID NO: 686790 - protein, 9 aa, Homo Sapiens
LESQIMLEK

SEQ ID NO: 686791 - protein, 9 aa, Homo Sapiens
STEFEESSA

SEQ ID NO: 686792 - protein, 9 aa, Homo Sapiens
MRNSDNSST

SEQ ID NO: 686793 - protein, 9 aa, Homo Sapiens
VWGSECAID

SEQ ID NO: 686794 - protein, 9 aa, Homo Sapiens
PQPKPSLLT

SEQ ID NO: 686795 - protein, 9 aa, Homo Sapiens
AKRKFTQSS

SEQ ID NO: 686796 - protein, 9 aa, Homo Sapiens
LETIPCDAV

SEQ ID NO: 686797 - protein, 9 aa, Homo Sapiens
QCDEVFPFF

SEQ ID NO: 686798 - protein, 9 aa, Homo Sapiens
LGPRESGRH

SEQ ID NO: 686799 - protein, 9 aa, Homo Sapiens
HHLKILRAV

SEQ ID NO: 686800 - protein, 9 aa, Homo Sapiens
LARKRQSVQ

SEQ ID NO: 686801 - protein, 9 aa, Homo Sapiens
QRIAQRLTE

SEQ ID NO: 686802 - protein, 9 aa, Homo Sapiens
IAVSLATSF

SEQ ID NO: 686803 - protein, 9 aa, Homo Sapiens
WIPVQIPAS

SEQ ID NO: 686804 - protein, 9 aa, Homo Sapiens
ILIVFFVAM

SEQ ID NO: 686805 - protein, 9 aa, Homo Sapiens
NIGNPPKTP

SEQ ID NO: 686806 - protein, 9 aa, Homo Sapiens
LQLQNKLEH

SEQ ID NO: 686807 - protein, 9 aa, Homo Sapiens
SMKDPQEMK

SEQ ID NO: 686808 - protein, 9 aa, Homo Sapiens
IPEKHLGEI

SEQ ID NO: 686809 - protein, 9 aa, Homo Sapiens
RSNEIRKML

SEQ ID NO: 686810 - protein, 9 aa, Homo Sapiens
FTALGQFIK

SEQ ID NO: 686811 - protein, 9 aa, Homo Sapiens
SEEVPTVLF

SEQ ID NO: 686812 - protein, 9 aa, Homo Sapiens
VFLSPPDPL

SEQ ID NO: 686813 - protein, 9 aa, Homo Sapiens
AVLQDDAVY

SEQ ID NO: 686814 - protein, 9 aa, Homo Sapiens
SCSSEIGVG

SEQ ID NO: 686815 - protein, 9 aa, Homo Sapiens
NDVRLLSVS

SEQ ID NO: 686816 - protein, 9 aa, Homo Sapiens
PSSCSSPGA

SEQ ID NO: 686817 - protein, 9 aa, Homo Sapiens
QVVLEDGLD

SEQ ID NO: 686818 - protein, 9 aa, Homo Sapiens
MMMTAVPSA

SEQ ID NO: 686819 - protein, 9 aa, Homo Sapiens
PRYKMEDNS

SEQ ID NO: 686820 - protein, 9 aa, Homo Sapiens
DPCELLPLC

SEQ ID NO: 686821 - protein, 9 aa, Homo Sapiens
YQTVILALI

SEQ ID NO: 686822 - protein, 9 aa, Homo Sapiens
KLQTQVRGY

SEQ ID NO: 686823 - protein, 9 aa, Homo Sapiens
SDQPRLEIP

SEQ ID NO: 686824 - protein, 9 aa, Homo Sapiens
LNTSSVLCD

SEQ ID NO: 686825 - protein, 9 aa, Homo Sapiens
SGTPGIVKS

SEQ ID NO: 686826 - protein, 9 aa, Homo Sapiens
NALKLFMQM

SEQ ID NO: 686827 - protein, 9 aa, Homo Sapiens
NLQEQVFPE

SEQ ID NO: 686828 - protein, 9 aa, Homo Sapiens
SPSERTYDG

SEQ ID NO: 686829 - protein, 9 aa, Homo Sapiens
QVLVEKLEK

SEQ ID NO: 686830 - protein, 9 aa, Homo Sapiens
HGEALNRSV

SEQ ID NO: 686831 - protein, 9 aa, Homo Sapiens
DCALSLIGL

SEQ ID NO: 686832 - protein, 9 aa, Homo Sapiens
FVGGNKLQL

SEQ ID NO: 686833 - protein, 9 aa, Homo Sapiens
RRLKSLPIV

SEQ ID NO: 686834 - protein, 9 aa, Homo Sapiens
DEELLQAFG

SEQ ID NO: 686835 - protein, 9 aa, Homo Sapiens
FAVWLAALI

SEQ ID NO: 686836 - protein, 9 aa, Homo Sapiens
PTLEWHNYD

SEQ ID NO: 686837 - protein, 9 aa, Homo Sapiens
IGFTLAHKV

SEQ ID NO: 686838 - protein, 9 aa, Homo Sapiens
KNYKCCQSE

SEQ ID NO: 686839 - protein, 9 aa, Homo Sapiens
YFTALGQFI

SEQ ID NO: 686840 - protein, 9 aa, Homo Sapiens
NKILVNEDV

SEQ ID NO: 686841 - protein, 9 aa, Homo Sapiens
VDADSLWVV

SEQ ID NO: 686842 - protein, 9 aa, Homo Sapiens
RVRLGHYSQ

SEQ ID NO: 686843 - protein, 9 aa, Homo Sapiens
ALFRDPCRS

SEQ ID NO: 686844 - protein, 9 aa, Homo Sapiens
LQHPCIETA

SEQ ID NO: 686845 - protein, 9 aa, Homo Sapiens
FLLCFWEVH

SEQ ID NO: 686846 - protein, 9 aa, Homo Sapiens
TEFEESSAT

SEQ ID NO: 686847 - protein, 9 aa, Homo Sapiens
YFEKQGAKD

SEQ ID NO: 686848 - protein, 9 aa, Homo Sapiens
ESTEFEESS

SEQ ID NO: 686849 - protein, 9 aa, Homo Sapiens
LIHTAIHTG

SEQ ID NO: 686850 - protein, 9 aa, Homo Sapiens
PYVIWIDEL

SEQ ID NO: 686851 - protein, 9 aa, Homo Sapiens
GHYSQSPVY

SEQ ID NO: 686852 - protein, 9 aa, Homo Sapiens
LPVAPRKAC

SEQ ID NO: 686853 - protein, 9 aa, Homo Sapiens
LGQFIKEVV

SEQ ID NO: 686854 - protein, 9 aa, Homo Sapiens
QRMIKEEIE

SEQ ID NO: 686855 - protein, 9 aa, Homo Sapiens
LKRALYFEA

SEQ ID NO: 686856 - protein, 9 aa, Homo Sapiens
DPMMMTAVP

SEQ ID NO: 686857 - protein, 9 aa, Homo Sapiens
RLGHYSQSP

SEQ ID NO: 686858 - protein, 9 aa, Homo Sapiens
LRRLKSLPI

SEQ ID NO: 686859 - protein, 9 aa, Homo Sapiens
PLPRAGIPP

SEQ ID NO: 686860 - protein, 9 aa, Homo Sapiens
ECKIQGMSV

SEQ ID NO: 686861 - protein, 9 aa, Homo Sapiens
RQNPSRCCV

SEQ ID NO: 686862 - protein, 9 aa, Homo Sapiens
LEELAQRTK

SEQ ID NO: 686863 - protein, 9 aa, Homo Sapiens
YKMEDNSAL

SEQ ID NO: 686864 - protein, 9 aa, Homo Sapiens
LENDVALVE

SEQ ID NO: 686865 - protein, 9 aa, Homo Sapiens
TNPSRSRRR

SEQ ID NO: 686866 - protein, 9 aa, Homo Sapiens
AKVVTWAYN

SEQ ID NO: 686867 - protein, 9 aa, Homo Sapiens
LFRDPCRSY

SEQ ID NO: 686868 - protein, 9 aa, Homo Sapiens
IYTLEELAQ

SEQ ID NO: 686869 - protein, 9 aa, Homo Sapiens
ISRLFPSRT

SEQ ID NO: 686870 - protein, 9 aa, Homo Sapiens
PSRTPGWHQ

SEQ ID NO: 686871 - protein, 9 aa, Homo Sapiens
LQAEVKTFI

SEQ ID NO: 686872 - protein, 9 aa, Homo Sapiens
ASSFPYVIW

SEQ ID NO: 686873 - protein, 9 aa, Homo Sapiens
IGPRKTVMI

SEQ ID NO: 686874 - protein, 9 aa, Homo Sapiens
RHHRPGSYL

SEQ ID NO: 686875 - protein, 9 aa, Homo Sapiens
FQATKTDDC

SEQ ID NO: 686876 - protein, 9 aa, Homo Sapiens
SGLLYQTVI

SEQ ID NO: 686877 - protein, 9 aa, Homo Sapiens
QNSIILVWG

SEQ ID NO: 686878 - protein, 9 aa, Homo Sapiens
WWEHGPEAP

SEQ ID NO: 686879 - protein, 9 aa, Homo Sapiens
IVEPPTDVN

SEQ ID NO: 686880 - protein, 9 aa, Homo Sapiens
VNVTEGMAA

SEQ ID NO: 686881 - protein, 9 aa, Homo Sapiens
VRLGHYSQS

SEQ ID NO: 686882 - protein, 9 aa, Homo Sapiens
SVRRAVYKD

SEQ ID NO: 686883 - protein, 9 aa, Homo Sapiens
TSYNSQRWF

SEQ ID NO: 686884 - protein, 9 aa, Homo Sapiens
FNLYLSACK

SEQ ID NO: 686885 - protein, 9 aa, Homo Sapiens
LQLTGNKAE

SEQ ID NO: 686886 - protein, 9 aa, Homo Sapiens
FWEVHYGIL

SEQ ID NO: 686887 - protein, 9 aa, Homo Sapiens
SEEALFRDP

SEQ ID NO: 686888 - protein, 9 aa, Homo Sapiens
RGEDALQAL

SEQ ID NO: 686889 - protein, 9 aa, Homo Sapiens
SIIQGIGKD

SEQ ID NO: 686890 - protein, 9 aa, Homo Sapiens
QVLQHPCIE

SEQ ID NO: 686891 - protein, 9 aa, Homo Sapiens
LAALILGPL

SEQ ID NO: 686892 - protein, 9 aa, Homo Sapiens
RGMGSLDAI

SEQ ID NO: 686893 - protein, 9 aa, Homo Sapiens
GGLIPLLLL

SEQ ID NO: 686894 - protein, 9 aa, Homo Sapiens
VTHSSVQPS

SEQ ID NO: 686895 - protein, 9 aa, Homo Sapiens
YPGPKWKLY

SEQ ID NO: 686896 - protein, 9 aa, Homo Sapiens
NVKQHADLT

SEQ ID NO: 686897 - protein, 9 aa, Homo Sapiens
YSQSPVYES

SEQ ID NO: 686898 - protein, 9 aa, Homo Sapiens
QEWLFTGKK

SEQ ID NO: 686899 - protein, 9 aa, Homo Sapiens
LISLPIWVL

SEQ ID NO: 686900 - protein, 9 aa, Homo Sapiens
KWLRRLKSL

SEQ ID NO: 686901 - protein, 9 aa, Homo Sapiens
GGLGMGEGG

SEQ ID NO: 686902 - protein, 9 aa, Homo Sapiens
SPLTMGGQD

SEQ ID NO: 686903 - protein, 9 aa, Homo Sapiens
AFNNSSTLK

SEQ ID NO: 686904 - protein, 9 aa, Homo Sapiens
KRALYFEAT

SEQ ID NO: 686905 - protein, 9 aa, Homo Sapiens
INVEISGDY

SEQ ID NO: 686906 - protein, 9 aa, Homo Sapiens
LEWHNYDLR

SEQ ID NO: 686907 - protein, 9 aa, Homo Sapiens
LVNEDVPQK

SEQ ID NO: 686908 - protein, 9 aa, Homo Sapiens
KCVSSIIQG

SEQ ID NO: 686909 - protein, 9 aa, Homo Sapiens
SKVGVKELL

SEQ ID NO: 686910 - protein, 9 aa, Homo Sapiens
VVFALANAL

SEQ ID NO: 686911 - protein, 9 aa, Homo Sapiens
GHLMPPWLS

SEQ ID NO: 686912 - protein, 9 aa, Homo Sapiens
VKTFFQMFP

SEQ ID NO: 686913 - protein, 9 aa, Homo Sapiens
QPQVSEEVP

SEQ ID NO: 686914 - protein, 9 aa, Homo Sapiens
LCCVSISED

SEQ ID NO: 686915 - protein, 9 aa, Homo Sapiens
GYLKVPPRM

SEQ ID NO: 686916 - protein, 9 aa, Homo Sapiens
LTDEVIIPL

SEQ ID NO: 686917 - protein, 9 aa, Homo Sapiens
FLDQSGAPG

SEQ ID NO: 686918 - protein, 9 aa, Homo Sapiens
MSEYYFYGK

SEQ ID NO: 686919 - protein, 9 aa, Homo Sapiens
MLLFWLFSL

SEQ ID NO: 686920 - protein, 9 aa, Homo Sapiens
SYLPTMLRV

SEQ ID NO: 686921 - protein, 9 aa, Homo Sapiens
KIYNISMKD

SEQ ID NO: 686922 - protein, 9 aa, Homo Sapiens
VRQGNIGNP

SEQ ID NO: 686923 - protein, 9 aa, Homo Sapiens
CWTAPKKLT

SEQ ID NO: 686924 - protein, 9 aa, Homo Sapiens
TNCGPPLVT

SEQ ID NO: 686925 - protein, 9 aa, Homo Sapiens
PFFEARPED

SEQ ID NO: 686926 - protein, 9 aa, Homo Sapiens
ILVNEDVPQ

SEQ ID NO: 686927 - protein, 9 aa, Homo Sapiens
PEPLSKPNR

SEQ ID NO: 686928 - protein, 9 aa, Homo Sapiens
VACLLEPTA

SEQ ID NO: 686929 - protein, 9 aa, Homo Sapiens
PSKPLSQPR

SEQ ID NO: 686930 - protein, 9 aa, Homo Sapiens
GQPCTRKKG

SEQ ID NO: 686931 - protein, 9 aa, Homo Sapiens
RDPCDSPGR

SEQ ID NO: 686932 - protein, 9 aa, Homo Sapiens
ETDYGLLTA

SEQ ID NO: 686933 - protein, 9 aa, Homo Sapiens
PQNSIILVW

SEQ ID NO: 686934 - protein, 9 aa, Homo Sapiens
GPSPLTMGG

SEQ ID NO: 686935 - protein, 9 aa, Homo Sapiens
PTDVNVTEG

SEQ ID NO: 686936 - protein, 9 aa, Homo Sapiens
IKKRQIKDL

SEQ ID NO: 686937 - protein, 9 aa, Homo Sapiens
QTFQSSGNM

SEQ ID NO: 686938 - protein, 9 aa, Homo Sapiens
CATPPGAAV

SEQ ID NO: 686939 - protein, 9 aa, Homo Sapiens
IAQRLTEAQ

SEQ ID NO: 686940 - protein, 9 aa, Homo Sapiens
EELLQAFGD

SEQ ID NO: 686941 - protein, 9 aa, Homo Sapiens
FSLSAPSSC

SEQ ID NO: 686942 - protein, 9 aa, Homo Sapiens
NPFEYYIFL

SEQ ID NO: 686943 - protein, 9 aa, Homo Sapiens
QRFPPMVDA

SEQ ID NO: 686944 - protein, 9 aa, Homo Sapiens
FLGTQDDIS

SEQ ID NO: 686945 - protein, 9 aa, Homo Sapiens
SFPYVIWID

SEQ ID NO: 686946 - protein, 9 aa, Homo Sapiens
SVLCDCQLK

SEQ ID NO: 686947 - protein, 9 aa, Homo Sapiens
SNKCVSSII

SEQ ID NO: 686948 - protein, 9 aa, Homo Sapiens
YNNLETIPC

SEQ ID NO: 686949 - protein, 9 aa, Homo Sapiens
CPKTGELNA

SEQ ID NO: 686950 - protein, 9 aa, Homo Sapiens
LATSFCVAF

SEQ ID NO: 686951 - protein, 9 aa, Homo Sapiens
SLPIWVLVT

SEQ ID NO: 686952 - protein, 9 aa, Homo Sapiens
TLNNLDLTA

SEQ ID NO: 686953 - protein, 9 aa, Homo Sapiens
GSAIMDVLP

SEQ ID NO: 686954 - protein, 9 aa, Homo Sapiens
RPLGDPSNL

SEQ ID NO: 686955 - protein, 9 aa, Homo Sapiens
IHAVLHLKQ

SEQ ID NO: 686956 - protein, 9 aa, Homo Sapiens
SRVCRHKMD

SEQ ID NO: 686957 - protein, 9 aa, Homo Sapiens
KYNQQNDNY

SEQ ID NO: 686958 - protein, 9 aa, Homo Sapiens
KMWHPNIYK

SEQ ID NO: 686959 - protein, 9 aa, Homo Sapiens
NVNFDFTRS

SEQ ID NO: 686960 - protein, 9 aa, Homo Sapiens
EFLTYVEHY

SEQ ID NO: 686961 - protein, 9 aa, Homo Sapiens
NKIHYIPSV

SEQ ID NO: 686962 - protein, 9 aa, Homo Sapiens
GKYRDRHTM

SEQ ID NO: 686963 - protein, 9 aa, Homo Sapiens
ESVSTSDEC

SEQ ID NO: 686964 - protein, 9 aa, Homo Sapiens
LAPGIEIYE

SEQ ID NO: 686965 - protein, 9 aa, Homo Sapiens
GNWSVCSTT

SEQ ID NO: 686966 - protein, 9 aa, Homo Sapiens
SKSQKRIMP

SEQ ID NO: 686967 - protein, 9 aa, Homo Sapiens
EVEPKHYAD

SEQ ID NO: 686968 - protein, 9 aa, Homo Sapiens
AYKIFERDL

SEQ ID NO: 686969 - protein, 9 aa, Homo Sapiens
QCHSFYIPR

SEQ ID NO: 686970 - protein, 9 aa, Homo Sapiens
GKTDNTRSL

SEQ ID NO: 686971 - protein, 9 aa, Homo Sapiens
FSVFAPSGE

SEQ ID NO: 686972 - protein, 9 aa, Homo Sapiens
NHMNNGNGA

SEQ ID NO: 686973 - protein, 9 aa, Homo Sapiens
KGWAQATSS

SEQ ID NO: 686974 - protein, 9 aa, Homo Sapiens
TLTTLKMEA

SEQ ID NO: 686975 - protein, 9 aa, Homo Sapiens
MLSQMSQER

SEQ ID NO: 686976 - protein, 9 aa, Homo Sapiens
EDDEENYEI

SEQ ID NO: 686977 - protein, 9 aa, Homo Sapiens
DPGTNLEPG

SEQ ID NO: 686978 - protein, 9 aa, Homo Sapiens
EFYMCDHGQ

SEQ ID NO: 686979 - protein, 9 aa, Homo Sapiens
RVSLEAVIA

SEQ ID NO: 686980 - protein, 9 aa, Homo Sapiens
KDFVLNSEV

SEQ ID NO: 686981 - protein, 9 aa, Homo Sapiens
FREQGKALV

SEQ ID NO: 686982 - protein, 9 aa, Homo Sapiens
DCFIRFLHI

SEQ ID NO: 686983 - protein, 9 aa, Homo Sapiens
ATATPSTFA

SEQ ID NO: 686984 - protein, 9 aa, Homo Sapiens
NTLPAVGPY

SEQ ID NO: 686985 - protein, 9 aa, Homo Sapiens
DLHSTAPIP

SEQ ID NO: 686986 - protein, 9 aa, Homo Sapiens
NRHKLSHLD

SEQ ID NO: 686987 - protein, 9 aa, Homo Sapiens
KLSNGVDFC

SEQ ID NO: 686988 - protein, 9 aa, Homo Sapiens
GQEKIQVKA

SEQ ID NO: 686989 - protein, 9 aa, Homo Sapiens
MSLGSLRDE

SEQ ID NO: 686990 - protein, 9 aa, Homo Sapiens
PGLRGETGT

SEQ ID NO: 686991 - protein, 9 aa, Homo Sapiens
TEHPPSGIF

SEQ ID NO: 686992 - protein, 9 aa, Homo Sapiens
CIYREFERL

SEQ ID NO: 686993 - protein, 9 aa, Homo Sapiens
QDLDPGDYK

SEQ ID NO: 686994 - protein, 9 aa, Homo Sapiens
MLQDCMAVK

SEQ ID NO: 686995 - protein, 9 aa, Homo Sapiens
IRSCRTPHS

SEQ ID NO: 686996 - protein, 9 aa, Homo Sapiens
HCSIPRAEG

SEQ ID NO: 686997 - protein, 9 aa, Homo Sapiens
DYMEGREGM

SEQ ID NO: 686998 - protein, 9 aa, Homo Sapiens
PWLKENRTI

SEQ ID NO: 686999 - protein, 9 aa, Homo Sapiens
KASVPSACF

SEQ ID NO: 687000 - protein, 9 aa, Homo Sapiens
NLKLPEEKA

SEQ ID NO: 687001 - protein, 9 aa, Homo Sapiens
WPEFQEFLL

SEQ ID NO: 687002 - protein, 9 aa, Homo Sapiens
KRPGTILTT

SEQ ID NO: 687003 - protein, 9 aa, Homo Sapiens
SRSYHAAVI

SEQ ID NO: 687004 - protein, 9 aa, Homo Sapiens
AGCDVRLNA

SEQ ID NO: 687005 - protein, 9 aa, Homo Sapiens
HCALEFKYV

SEQ ID NO: 687006 - protein, 9 aa, Homo Sapiens
FLLLANQKT

SEQ ID NO: 687007 - protein, 9 aa, Homo Sapiens
IHEYAQRDT

SEQ ID NO: 687008 - protein, 9 aa, Homo Sapiens
RQPKQRWLF

SEQ ID NO: 687009 - protein, 9 aa, Homo Sapiens
ENRTIEFGE

SEQ ID NO: 687010 - protein, 9 aa, Homo Sapiens
ECQNRMHFN

SEQ ID NO: 687011 - protein, 9 aa, Homo Sapiens
LCANSTLNN

SEQ ID NO: 687012 - protein, 9 aa, Homo Sapiens
KKVQFKLNK

SEQ ID NO: 687013 - protein, 9 aa, Homo Sapiens
FCVLGTLSN

SEQ ID NO: 687014 - protein, 9 aa, Homo Sapiens
PVETPPPDA

SEQ ID NO: 687015 - protein, 9 aa, Homo Sapiens
MYERRIECL

SEQ ID NO: 687016 - protein, 9 aa, Homo Sapiens
LPNHHPFHT

SEQ ID NO: 687017 - protein, 9 aa, Homo Sapiens
PGSGGPPTE

SEQ ID NO: 687018 - protein, 9 aa, Homo Sapiens
SRFENFLED

SEQ ID NO: 687019 - protein, 9 aa, Homo Sapiens
SGRWLLAGL

SEQ ID NO: 687020 - protein, 9 aa, Homo Sapiens
PTPETLHCY

SEQ ID NO: 687021 - protein, 9 aa, Homo Sapiens
LEASSNQEG

SEQ ID NO: 687022 - protein, 9 aa, Homo Sapiens
LPARTQERI

SEQ ID NO: 687023 - protein, 9 aa, Homo Sapiens
PPRGKASGQ

SEQ ID NO: 687024 - protein, 9 aa, Homo Sapiens
LQDSNITHC

SEQ ID NO: 687025 - protein, 9 aa, Homo Sapiens
KLFNAELAP

SEQ ID NO: 687026 - protein, 9 aa, Homo Sapiens
GPSASTELH

SEQ ID NO: 687027 - protein, 9 aa, Homo Sapiens
SGIFNSELE

SEQ ID NO: 687028 - protein, 9 aa, Homo Sapiens
GHRAVRCRL

SEQ ID NO: 687029 - protein, 9 aa, Homo Sapiens
CQKEFEKHK

SEQ ID NO: 687030 - protein, 9 aa, Homo Sapiens
VGPPGPPCP

SEQ ID NO: 687031 - protein, 9 aa, Homo Sapiens
MEVAKPEDS

SEQ ID NO: 687032 - protein, 9 aa, Homo Sapiens
QLERGSITF

SEQ ID NO: 687033 - protein, 9 aa, Homo Sapiens
AAVFGTQLV

SEQ ID NO: 687034 - protein, 9 aa, Homo Sapiens
IDDTLEDSI

SEQ ID NO: 687035 - protein, 9 aa, Homo Sapiens
TTEPTPPPF

SEQ ID NO: 687036 - protein, 9 aa, Homo Sapiens
FGHEGFHER

SEQ ID NO: 687037 - protein, 9 aa, Homo Sapiens
LRQDPSGVI

SEQ ID NO: 687038 - protein, 9 aa, Homo Sapiens
LLNGTDISG

SEQ ID NO: 687039 - protein, 9 aa, Homo Sapiens
KAFTTIQIL

SEQ ID NO: 687040 - protein, 9 aa, Homo Sapiens
LISSLHLKR

SEQ ID NO: 687041 - protein, 9 aa, Homo Sapiens
KNYSKVQIR

SEQ ID NO: 687042 - protein, 9 aa, Homo Sapiens
LYRPKAPDT

SEQ ID NO: 687043 - protein, 9 aa, Homo Sapiens
QQGARENIA

SEQ ID NO: 687044 - protein, 9 aa, Homo Sapiens
RLFRKRARA

SEQ ID NO: 687045 - protein, 9 aa, Homo Sapiens
PAKGPVVTA

SEQ ID NO: 687046 - protein, 9 aa, Homo Sapiens
GEPQRFARI

SEQ ID NO: 687047 - protein, 9 aa, Homo Sapiens
NVKKDDKEK

SEQ ID NO: 687048 - protein, 9 aa, Homo Sapiens
AASMRERRR

SEQ ID NO: 687049 - protein, 9 aa, Homo Sapiens
FRVLREALQ

SEQ ID NO: 687050 - protein, 9 aa, Homo Sapiens
PRVPMPVAG

SEQ ID NO: 687051 - protein, 9 aa, Homo Sapiens
DLAKVIVVI

SEQ ID NO: 687052 - protein, 9 aa, Homo Sapiens
QKIESGEMG

SEQ ID NO: 687053 - protein, 9 aa, Homo Sapiens
GAVRDHEKR

SEQ ID NO: 687054 - protein, 9 aa, Homo Sapiens
GIGDKIGML

SEQ ID NO: 687055 - protein, 9 aa, Homo Sapiens
QDMIRSQDR

SEQ ID NO: 687056 - protein, 9 aa, Homo Sapiens
GNKVDETVL

SEQ ID NO: 687057 - protein, 9 aa, Homo Sapiens
IQEKLLQLL

SEQ ID NO: 687058 - protein, 9 aa, Homo Sapiens
NKEETSPQC

SEQ ID NO: 687059 - protein, 9 aa, Homo Sapiens
IRRLQAFAN

SEQ ID NO: 687060 - protein, 9 aa, Homo Sapiens
VCTMLSGLL

SEQ ID NO: 687061 - protein, 9 aa, Homo Sapiens
LRPDPLFQR

SEQ ID NO: 687062 - protein, 9 aa, Homo Sapiens
SYHAAVIPD

SEQ ID NO: 687063 - protein, 9 aa, Homo Sapiens
LHIASDCPT

SEQ ID NO: 687064 - protein, 9 aa, Homo Sapiens
MGCKILENR

SEQ ID NO: 687065 - protein, 9 aa, Homo Sapiens
VQNMRAFDG

SEQ ID NO: 687066 - protein, 9 aa, Homo Sapiens
SWELFISNV

SEQ ID NO: 687067 - protein, 9 aa, Homo Sapiens
GASTVTASL

SEQ ID NO: 687068 - protein, 9 aa, Homo Sapiens
TLLPTMQEK

SEQ ID NO: 687069 - protein, 9 aa, Homo Sapiens
TDLLAQGLT

SEQ ID NO: 687070 - protein, 9 aa, Homo Sapiens
MVVARLARR

SEQ ID NO: 687071 - protein, 9 aa, Homo Sapiens
LIGEIFQLM

SEQ ID NO: 687072 - protein, 9 aa, Homo Sapiens
PKGSILAEP

SEQ ID NO: 687073 - protein, 9 aa, Homo Sapiens
AKCRPLRVR

SEQ ID NO: 687074 - protein, 9 aa, Homo Sapiens
PAQISGLVL

SEQ ID NO: 687075 - protein, 9 aa, Homo Sapiens
RRILNKEET

SEQ ID NO: 687076 - protein, 9 aa, Homo Sapiens
SNSNRYETL

SEQ ID NO: 687077 - protein, 9 aa, Homo Sapiens
SWLSKQLVN

SEQ ID NO: 687078 - protein, 9 aa, Homo Sapiens
SFSIGAGSN

SEQ ID NO: 687079 - protein, 9 aa, Homo Sapiens
KVLATAKVM

SEQ ID NO: 687080 - protein, 9 aa, Homo Sapiens
TPYVRFIAK

SEQ ID NO: 687081 - protein, 9 aa, Homo Sapiens
PQLSGNSST

SEQ ID NO: 687082 - protein, 9 aa, Homo Sapiens
EKSRVKWDQ

SEQ ID NO: 687083 - protein, 9 aa, Homo Sapiens
PAGSAELRK

SEQ ID NO: 687084 - protein, 9 aa, Homo Sapiens
AARRFFLHI

SEQ ID NO: 687085 - protein, 9 aa, Homo Sapiens
NVQKKRVSA

SEQ ID NO: 687086 - protein, 9 aa, Homo Sapiens
EAEALLDEI

SEQ ID NO: 687087 - protein, 9 aa, Homo Sapiens
SIRRWSLHS

SEQ ID NO: 687088 - protein, 9 aa, Homo Sapiens
NRNIQTNNN

SEQ ID NO: 687089 - protein, 9 aa, Homo Sapiens
PRKYVMGHL

SEQ ID NO: 687090 - protein, 9 aa, Homo Sapiens
AHQASVARL

SEQ ID NO: 687091 - protein, 9 aa, Homo Sapiens
WKGSACEFY

SEQ ID NO: 687092 - protein, 9 aa, Homo Sapiens
RQGAARFAL

SEQ ID NO: 687093 - protein, 9 aa, Homo Sapiens
YQKCAMKTL

SEQ ID NO: 687094 - protein, 9 aa, Homo Sapiens
THMDLSISH

SEQ ID NO: 687095 - protein, 9 aa, Homo Sapiens
SLSSLREQN

SEQ ID NO: 687096 - protein, 9 aa, Homo Sapiens
GSTCSESEP

SEQ ID NO: 687097 - protein, 9 aa, Homo Sapiens
IPRKDLIVM

SEQ ID NO: 687098 - protein, 9 aa, Homo Sapiens
GLSGCSMLA

SEQ ID NO: 687099 - protein, 9 aa, Homo Sapiens
LAAQSSRAH

SEQ ID NO: 687100 - protein, 9 aa, Homo Sapiens
LVGTQSAGK

SEQ ID NO: 687101 - protein, 9 aa, Homo Sapiens
VYEAFYKVS

SEQ ID NO: 687102 - protein, 9 aa, Homo Sapiens
VRYVYEAFY

SEQ ID NO: 687103 - protein, 9 aa, Homo Sapiens
EALPCLPSM

SEQ ID NO: 687104 - protein, 9 aa, Homo Sapiens
GATVRIHGV

SEQ ID NO: 687105 - protein, 9 aa, Homo Sapiens
TPETLHCYQ

SEQ ID NO: 687106 - protein, 9 aa, Homo Sapiens
RSFSGVTAC

SEQ ID NO: 687107 - protein, 9 aa, Homo Sapiens
PVPGEYSLP

SEQ ID NO: 687108 - protein, 9 aa, Homo Sapiens
QLLAAAVDK

SEQ ID NO: 687109 - protein, 9 aa, Homo Sapiens
KEFEKHKDD

SEQ ID NO: 687110 - protein, 9 aa, Homo Sapiens
PNNTFYTTK

SEQ ID NO: 687111 - protein, 9 aa, Homo Sapiens
RQREKECSQ

SEQ ID NO: 687112 - protein, 9 aa, Homo Sapiens
LWVTQPHPH

SEQ ID NO: 687113 - protein, 9 aa, Homo Sapiens
KQLHTATNF

SEQ ID NO: 687114 - protein, 9 aa, Homo Sapiens
PAGRGPPGW

SEQ ID NO: 687115 - protein, 9 aa, Homo Sapiens
AEDILGNNG

SEQ ID NO: 687116 - protein, 9 aa, Homo Sapiens
KEHILQQRF

SEQ ID NO: 687117 - protein, 9 aa, Homo Sapiens
LHSDISCPL

SEQ ID NO: 687118 - protein, 9 aa, Homo Sapiens
FGVAVMDNK

SEQ ID NO: 687119 - protein, 9 aa, Homo Sapiens
VTPPSGTSL

SEQ ID NO: 687120 - protein, 9 aa, Homo Sapiens
NKKMLSDSH

SEQ ID NO: 687121 - protein, 9 aa, Homo Sapiens
KQVLEHEIE

SEQ ID NO: 687122 - protein, 9 aa, Homo Sapiens
KLNMYKRKV

SEQ ID NO: 687123 - protein, 9 aa, Homo Sapiens
FLGGGSSRI

SEQ ID NO: 687124 - protein, 9 aa, Homo Sapiens
VAERDISSS

SEQ ID NO: 687125 - protein, 9 aa, Homo Sapiens
NNPKETTSV

SEQ ID NO: 687126 - protein, 9 aa, Homo Sapiens
ESALWECEH

SEQ ID NO: 687127 - protein, 9 aa, Homo Sapiens
NWSVCSTTC

SEQ ID NO: 687128 - protein, 9 aa, Homo Sapiens
VFKNFAFAH

SEQ ID NO: 687129 - protein, 9 aa, Homo Sapiens
YGSPLCKER

SEQ ID NO: 687130 - protein, 9 aa, Homo Sapiens
DRASPLGLA

SEQ ID NO: 687131 - protein, 9 aa, Homo Sapiens
SSNYCNCSG

SEQ ID NO: 687132 - protein, 9 aa, Homo Sapiens
VEPKHYADG

SEQ ID NO: 687133 - protein, 9 aa, Homo Sapiens
LREDRREDM

SEQ ID NO: 687134 - protein, 9 aa, Homo Sapiens
RQLAVRPFT

SEQ ID NO: 687135 - protein, 9 aa, Homo Sapiens
FEEMLQNKL

SEQ ID NO: 687136 - protein, 9 aa, Homo Sapiens
CQTGTAEEF

SEQ ID NO: 687137 - protein, 9 aa, Homo Sapiens
LHEDIDAKQ

SEQ ID NO: 687138 - protein, 9 aa, Homo Sapiens
SNLKLPEEK

SEQ ID NO: 687139 - protein, 9 aa, Homo Sapiens
VEYLRLVIF

SEQ ID NO: 687140 - protein, 9 aa, Homo Sapiens
RHKMDTFLG

SEQ ID NO: 687141 - protein, 9 aa, Homo Sapiens
LQTRGAVSL

SEQ ID NO: 687142 - protein, 9 aa, Homo Sapiens
LPGGGPATV

SEQ ID NO: 687143 - protein, 9 aa, Homo Sapiens
EANENTREA

SEQ ID NO: 687144 - protein, 9 aa, Homo Sapiens
GAELSVLED

SEQ ID NO: 687145 - protein, 9 aa, Homo Sapiens
DVLSPEKQR

SEQ ID NO: 687146 - protein, 9 aa, Homo Sapiens
ISATCKDEM

SEQ ID NO: 687147 - protein, 9 aa, Homo Sapiens
QLHTPMCFF

SEQ ID NO: 687148 - protein, 9 aa, Homo Sapiens
DDEVSRFVA

SEQ ID NO: 687149 - protein, 9 aa, Homo Sapiens
EQSNFGSKS

SEQ ID NO: 687150 - protein, 9 aa, Homo Sapiens
CKNEGNCVM

SEQ ID NO: 687151 - protein, 9 aa, Homo Sapiens
KDCFIRFLH

SEQ ID NO: 687152 - protein, 9 aa, Homo Sapiens
DRYVAINDP

SEQ ID NO: 687153 - protein, 9 aa, Homo Sapiens
CGQRRACYR

SEQ ID NO: 687154 - protein, 9 aa, Homo Sapiens
VWEEIYSKF

SEQ ID NO: 687155 - protein, 9 aa, Homo Sapiens
THCHDVYLR

SEQ ID NO: 687156 - protein, 9 aa, Homo Sapiens
IVFYGLTYS

SEQ ID NO: 687157 - protein, 9 aa, Homo Sapiens
RYVAINDPL

SEQ ID NO: 687158 - protein, 9 aa, Homo Sapiens
KQPQAGHCR

SEQ ID NO: 687159 - protein, 9 aa, Homo Sapiens
RSPTVEENN

SEQ ID NO: 687160 - protein, 9 aa, Homo Sapiens
RDVEGYYPG

SEQ ID NO: 687161 - protein, 9 aa, Homo Sapiens
ILYDGWALG

SEQ ID NO: 687162 - protein, 9 aa, Homo Sapiens
ISTKRYERE

SEQ ID NO: 687163 - protein, 9 aa, Homo Sapiens
SPPRGKASG

SEQ ID NO: 687164 - protein, 9 aa, Homo Sapiens
KRARAKEEE

SEQ ID NO: 687165 - protein, 9 aa, Homo Sapiens
NACALEKDI

SEQ ID NO: 687166 - protein, 9 aa, Homo Sapiens
TENGKSQQA

SEQ ID NO: 687167 - protein, 9 aa, Homo Sapiens
LSIQDVTEE

SEQ ID NO: 687168 - protein, 9 aa, Homo Sapiens
SKGCQNKEH

SEQ ID NO: 687169 - protein, 9 aa, Homo Sapiens
DIQHEGKGQ

SEQ ID NO: 687170 - protein, 9 aa, Homo Sapiens
EVAKPEDSW

SEQ ID NO: 687171 - protein, 9 aa, Homo Sapiens
AMKQAPEAT

SEQ ID NO: 687172 - protein, 9 aa, Homo Sapiens
QQLLAAFTI

SEQ ID NO: 687173 - protein, 9 aa, Homo Sapiens
ELHCWKGRT

SEQ ID NO: 687174 - protein, 9 aa, Homo Sapiens
LTTTSRKSR

SEQ ID NO: 687175 - protein, 9 aa, Homo Sapiens
DKADKTENG

SEQ ID NO: 687176 - protein, 9 aa, Homo Sapiens
CECMSSYFR

SEQ ID NO: 687177 - protein, 9 aa, Homo Sapiens
KEVMDVIDE

SEQ ID NO: 687178 - protein, 9 aa, Homo Sapiens
TFARTKEKA

SEQ ID NO: 687179 - protein, 9 aa, Homo Sapiens
FDTAFGTVG

SEQ ID NO: 687180 - protein, 9 aa, Homo Sapiens
LAFIVKKTL

SEQ ID NO: 687181 - protein, 9 aa, Homo Sapiens
PRRGLSGCS

SEQ ID NO: 687182 - protein, 9 aa, Homo Sapiens
FRRRTEQNP

SEQ ID NO: 687183 - protein, 9 aa, Homo Sapiens
GTFLKSTCN

SEQ ID NO: 687184 - protein, 9 aa, Homo Sapiens
KEMAKGVAE

SEQ ID NO: 687185 - protein, 9 aa, Homo Sapiens
EGPRRRRLN

SEQ ID NO: 687186 - protein, 9 aa, Homo Sapiens
EESLGEDIH

SEQ ID NO: 687187 - protein, 9 aa, Homo Sapiens
TVSLSPCIW

SEQ ID NO: 687188 - protein, 9 aa, Homo Sapiens
NELDLMDLV

SEQ ID NO: 687189 - protein, 9 aa, Homo Sapiens
SASTELHNL

SEQ ID NO: 687190 - protein, 9 aa, Homo Sapiens
EIAQDLKTD

SEQ ID NO: 687191 - protein, 9 aa, Homo Sapiens
TGPAPELAL

SEQ ID NO: 687192 - protein, 9 aa, Homo Sapiens
PSASQSAGI

SEQ ID NO: 687193 - protein, 9 aa, Homo Sapiens
EMLQNKLKV

SEQ ID NO: 687194 - protein, 9 aa, Homo Sapiens
IAKKHVLPN

SEQ ID NO: 687195 - protein, 9 aa, Homo Sapiens
LVREIAQDL

SEQ ID NO: 687196 - protein, 9 aa, Homo Sapiens
IPRNVIHQL

SEQ ID NO: 687197 - protein, 9 aa, Homo Sapiens
SSQRKNELK

SEQ ID NO: 687198 - protein, 9 aa, Homo Sapiens
GTKQACRCL

SEQ ID NO: 687199 - protein, 9 aa, Homo Sapiens
EHVWLQKWY

SEQ ID NO: 687200 - protein, 9 aa, Homo Sapiens
SAAYGSPLC

SEQ ID NO: 687201 - protein, 9 aa, Homo Sapiens
SAPDQTEQD

SEQ ID NO: 687202 - protein, 9 aa, Homo Sapiens
LLPALWGGE

SEQ ID NO: 687203 - protein, 9 aa, Homo Sapiens
FLKPQDIQI

SEQ ID NO: 687204 - protein, 9 aa, Homo Sapiens
SCVSPVSEN

SEQ ID NO: 687205 - protein, 9 aa, Homo Sapiens
SNSSTKAEP

SEQ ID NO: 687206 - protein, 9 aa, Homo Sapiens
PNVDYQFTV

SEQ ID NO: 687207 - protein, 9 aa, Homo Sapiens
HISNDYEAK

SEQ ID NO: 687208 - protein, 9 aa, Homo Sapiens
IGPDPQYVG

SEQ ID NO: 687209 - protein, 9 aa, Homo Sapiens
ILDSENLNS

SEQ ID NO: 687210 - protein, 9 aa, Homo Sapiens
ESASKGLNH

SEQ ID NO: 687211 - protein, 9 aa, Homo Sapiens
FLLEPPGPY

SEQ ID NO: 687212 - protein, 9 aa, Homo Sapiens
DGSFKIGNL

SEQ ID NO: 687213 - protein, 9 aa, Homo Sapiens
RSYHAAVIP

SEQ ID NO: 687214 - protein, 9 aa, Homo Sapiens
QEEFLTYVE

SEQ ID NO: 687215 - protein, 9 aa, Homo Sapiens
QDTELMETR

SEQ ID NO: 687216 - protein, 9 aa, Homo Sapiens
TMDRRKAAS

SEQ ID NO: 687217 - protein, 9 aa, Homo Sapiens
PLWVTQPHP

SEQ ID NO: 687218 - protein, 9 aa, Homo Sapiens
REIGEFGLR

SEQ ID NO: 687219 - protein, 9 aa, Homo Sapiens
EFQHVLPKM

SEQ ID NO: 687220 - protein, 9 aa, Homo Sapiens
DHHNPRLMK

SEQ ID NO: 687221 - protein, 9 aa, Homo Sapiens
EISGQSVAK

SEQ ID NO: 687222 - protein, 9 aa, Homo Sapiens
RGPVGGFLK

SEQ ID NO: 687223 - protein, 9 aa, Homo Sapiens
GSKKFCNNV

SEQ ID NO: 687224 - protein, 9 aa, Homo Sapiens
HDVYLRCFN

SEQ ID NO: 687225 - protein, 9 aa, Homo Sapiens
PHSPARFCV

SEQ ID NO: 687226 - protein, 9 aa, Homo Sapiens
ACALEKDIG

SEQ ID NO: 687227 - protein, 9 aa, Homo Sapiens
LLVSDVMAC

SEQ ID NO: 687228 - protein, 9 aa, Homo Sapiens
KAKCRPLRV

SEQ ID NO: 687229 - protein, 9 aa, Homo Sapiens
SLILQNSSA

SEQ ID NO: 687230 - protein, 9 aa, Homo Sapiens
HGTICDPIS

SEQ ID NO: 687231 - protein, 9 aa, Homo Sapiens
AICFTILGM

SEQ ID NO: 687232 - protein, 9 aa, Homo Sapiens
FLCFIFHGL

SEQ ID NO: 687233 - protein, 9 aa, Homo Sapiens
MFKDLQKMA

SEQ ID NO: 687234 - protein, 9 aa, Homo Sapiens
RLVGQQGRG

SEQ ID NO: 687235 - protein, 9 aa, Homo Sapiens
GSYAVLVLT

SEQ ID NO: 687236 - protein, 9 aa, Homo Sapiens
RMATERRGK

SEQ ID NO: 687237 - protein, 9 aa, Homo Sapiens
LQQEYPGKQ

SEQ ID NO: 687238 - protein, 9 aa, Homo Sapiens
LFSTVSISL

SEQ ID NO: 687239 - protein, 9 aa, Homo Sapiens
SLWASIRTE

SEQ ID NO: 687240 - protein, 9 aa, Homo Sapiens
QSVAKQLQK

SEQ ID NO: 687241 - protein, 9 aa, Homo Sapiens
RSSSMSSFT

SEQ ID NO: 687242 - protein, 9 aa, Homo Sapiens
KNSEPMKRP

SEQ ID NO: 687243 - protein, 9 aa, Homo Sapiens
EKVEEPRYK

SEQ ID NO: 687244 - protein, 9 aa, Homo Sapiens
PIHEFIALT

SEQ ID NO: 687245 - protein, 9 aa, Homo Sapiens
TGLQAVTGK

SEQ ID NO: 687246 - protein, 9 aa, Homo Sapiens
SCRCHELFF

SEQ ID NO: 687247 - protein, 9 aa, Homo Sapiens
RYETLKATQ

SEQ ID NO: 687248 - protein, 9 aa, Homo Sapiens
GHSFSTDAA

SEQ ID NO: 687249 - protein, 9 aa, Homo Sapiens
LRQQMPPPR

SEQ ID NO: 687250 - protein, 9 aa, Homo Sapiens
PPSGTSLAA

SEQ ID NO: 687251 - protein, 9 aa, Homo Sapiens
FELVQEYYK

SEQ ID NO: 687252 - protein, 9 aa, Homo Sapiens
PEENQVFPQ

SEQ ID NO: 687253 - protein, 9 aa, Homo Sapiens
QARSSQAPS

SEQ ID NO: 687254 - protein, 9 aa, Homo Sapiens
KGCQESGLS

SEQ ID NO: 687255 - protein, 9 aa, Homo Sapiens
HDGRPVPIE

SEQ ID NO: 687256 - protein, 9 aa, Homo Sapiens
EFEKHKDDD

SEQ ID NO: 687257 - protein, 9 aa, Homo Sapiens
ASCRPHKEL

SEQ ID NO: 687258 - protein, 9 aa, Homo Sapiens
PYVRFIAKV

SEQ ID NO: 687259 - protein, 9 aa, Homo Sapiens
IPCKLEKRT

SEQ ID NO: 687260 - protein, 9 aa, Homo Sapiens
WGGEGWTQA

SEQ ID NO: 687261 - protein, 9 aa, Homo Sapiens
AFGSPEVAG

SEQ ID NO: 687262 - protein, 9 aa, Homo Sapiens
SVGHDWSAL

SEQ ID NO: 687263 - protein, 9 aa, Homo Sapiens
APSCIWRIP

SEQ ID NO: 687264 - protein, 9 aa, Homo Sapiens
CEILPSRLY

SEQ ID NO: 687265 - protein, 9 aa, Homo Sapiens
LNAIPIQAA

SEQ ID NO: 687266 - protein, 9 aa, Homo Sapiens
KVQIRCQRL

SEQ ID NO: 687267 - protein, 9 aa, Homo Sapiens
EDRSIFSAI

SEQ ID NO: 687268 - protein, 9 aa, Homo Sapiens
LPLVLLLLH

SEQ ID NO: 687269 - protein, 9 aa, Homo Sapiens
ESHSQERIS

SEQ ID NO: 687270 - protein, 9 aa, Homo Sapiens
AEETYVQVQ

SEQ ID NO: 687271 - protein, 9 aa, Homo Sapiens
SLEEARAQR

SEQ ID NO: 687272 - protein, 9 aa, Homo Sapiens
KIFERDLKK

SEQ ID NO: 687273 - protein, 9 aa, Homo Sapiens
KQSAMAMCQ

SEQ ID NO: 687274 - protein, 9 aa, Homo Sapiens
FCGSCLGIF

SEQ ID NO: 687275 - protein, 9 aa, Homo Sapiens
YTNQNPNNF

SEQ ID NO: 687276 - protein, 9 aa, Homo Sapiens
RLAKEYGAR

SEQ ID NO: 687277 - protein, 9 aa, Homo Sapiens
VWLQKWYGG

SEQ ID NO: 687278 - protein, 9 aa, Homo Sapiens
DDNMKTPAE

SEQ ID NO: 687279 - protein, 9 aa, Homo Sapiens
PEDKYELLM

SEQ ID NO: 687280 - protein, 9 aa, Homo Sapiens
ADTNQQDGG

SEQ ID NO: 687281 - protein, 9 aa, Homo Sapiens
CSRALLNMQ

SEQ ID NO: 687282 - protein, 9 aa, Homo Sapiens
LNLTRSYRL

SEQ ID NO: 687283 - protein, 9 aa, Homo Sapiens
CHSTGIPAQ

SEQ ID NO: 687284 - protein, 9 aa, Homo Sapiens
ENNKTKQSF

SEQ ID NO: 687285 - protein, 9 aa, Homo Sapiens
LRVRGQHTN

SEQ ID NO: 687286 - protein, 9 aa, Homo Sapiens
KHCWVGELN

SEQ ID NO: 687287 - protein, 9 aa, Homo Sapiens
STWKMEKGD

SEQ ID NO: 687288 - protein, 9 aa, Homo Sapiens
QKPGLIKVV

SEQ ID NO: 687289 - protein, 9 aa, Homo Sapiens
QEDGSLFYE

SEQ ID NO: 687290 - protein, 9 aa, Homo Sapiens
MNNIFCYRI

SEQ ID NO: 687291 - protein, 9 aa, Homo Sapiens
CLLSWCYLQ

SEQ ID NO: 687292 - protein, 9 aa, Homo Sapiens
LLEPPGPYR

SEQ ID NO: 687293 - protein, 9 aa, Homo Sapiens
PPLLAISCC

SEQ ID NO: 687294 - protein, 9 aa, Homo Sapiens
NPLQRNEIG

SEQ ID NO: 687295 - protein, 9 aa, Homo Sapiens
QMHSPPAAW

SEQ ID NO: 687296 - protein, 9 aa, Homo Sapiens
KIPRFKVSQ

SEQ ID NO: 687297 - protein, 9 aa, Homo Sapiens
ESGGKGSKG

SEQ ID NO: 687298 - protein, 9 aa, Homo Sapiens
VLTALMGCC

SEQ ID NO: 687299 - protein, 9 aa, Homo Sapiens
QKCPRDRVD

SEQ ID NO: 687300 - protein, 9 aa, Homo Sapiens
PRMRKLQVD

SEQ ID NO: 687301 - protein, 9 aa, Homo Sapiens
KQARTLIMM

SEQ ID NO: 687302 - protein, 9 aa, Homo Sapiens
ANKASSFSN

SEQ ID NO: 687303 - protein, 9 aa, Homo Sapiens
GLLQSGYIS

SEQ ID NO: 687304 - protein, 9 aa, Homo Sapiens
AANRRNVKQ

SEQ ID NO: 687305 - protein, 9 aa, Homo Sapiens
VSENARMFT

SEQ ID NO: 687306 - protein, 9 aa, Homo Sapiens
AILSKVPVD

SEQ ID NO: 687307 - protein, 9 aa, Homo Sapiens
LPPKKKRLH

SEQ ID NO: 687308 - protein, 9 aa, Homo Sapiens
CFMNNIFCY

SEQ ID NO: 687309 - protein, 9 aa, Homo Sapiens
IRNNKKMLS

SEQ ID NO: 687310 - protein, 9 aa, Homo Sapiens
YEFRRERLT

SEQ ID NO: 687311 - protein, 9 aa, Homo Sapiens
LCFWETQPL

SEQ ID NO: 687312 - protein, 9 aa, Homo Sapiens
SVGTYGRVF

SEQ ID NO: 687313 - protein, 9 aa, Homo Sapiens
AQSSHYQQR

SEQ ID NO: 687314 - protein, 9 aa, Homo Sapiens
IDSYYEYLF

SEQ ID NO: 687315 - protein, 9 aa, Homo Sapiens
LAPGQPFSS

SEQ ID NO: 687316 - protein, 9 aa, Homo Sapiens
NTNVVVKKL

SEQ ID NO: 687317 - protein, 9 aa, Homo Sapiens
SEPMKRPDS

SEQ ID NO: 687318 - protein, 9 aa, Homo Sapiens
ELHMVKETL

SEQ ID NO: 687319 - protein, 9 aa, Homo Sapiens
EEVTAVRRQ

SEQ ID NO: 687320 - protein, 9 aa, Homo Sapiens
VDKSFGSAI

SEQ ID NO: 687321 - protein, 9 aa, Homo Sapiens
NNLFVVHRS

SEQ ID NO: 687322 - protein, 9 aa, Homo Sapiens
VVVKVQAQV

SEQ ID NO: 687323 - protein, 9 aa, Homo Sapiens
DYGPCDPPR

SEQ ID NO: 687324 - protein, 9 aa, Homo Sapiens
QEWVVVKVQ

SEQ ID NO: 687325 - protein, 9 aa, Homo Sapiens
ENYEIVPRV

SEQ ID NO: 687326 - protein, 9 aa, Homo Sapiens
NQVFPQGRN

SEQ ID NO: 687327 - protein, 9 aa, Homo Sapiens
EGNCVMDMY

SEQ ID NO: 687328 - protein, 9 aa, Homo Sapiens
CLSLASRRI

SEQ ID NO: 687329 - protein, 9 aa, Homo Sapiens
VLFLLQPTS

SEQ ID NO: 687330 - protein, 9 aa, Homo Sapiens
RKSHFTCNH

SEQ ID NO: 687331 - protein, 9 aa, Homo Sapiens
NFLVEKSRV

SEQ ID NO: 687332 - protein, 9 aa, Homo Sapiens
VLSPPRGKA

SEQ ID NO: 687333 - protein, 9 aa, Homo Sapiens
LGIQSVIAF

SEQ ID NO: 687334 - protein, 9 aa, Homo Sapiens
VAYVVTPLW

SEQ ID NO: 687335 - protein, 9 aa, Homo Sapiens
DFNKEKKIT

SEQ ID NO: 687336 - protein, 9 aa, Homo Sapiens
RNFDVEESL

SEQ ID NO: 687337 - protein, 9 aa, Homo Sapiens
MNLSDFISM

SEQ ID NO: 687338 - protein, 9 aa, Homo Sapiens
STTLSDSSQ

SEQ ID NO: 687339 - protein, 9 aa, Homo Sapiens
LQKVIPTRY

SEQ ID NO: 687340 - protein, 9 aa, Homo Sapiens
NKTKQSFCL

SEQ ID NO: 687341 - protein, 9 aa, Homo Sapiens
ELIEDFKTL

SEQ ID NO: 687342 - protein, 9 aa, Homo Sapiens
IFSAILDEL

SEQ ID NO: 687343 - protein, 9 aa, Homo Sapiens
HLAEEAGFP

SEQ ID NO: 687344 - protein, 9 aa, Homo Sapiens
LSPVKHHPA

SEQ ID NO: 687345 - protein, 9 aa, Homo Sapiens
LQNSLAASF

SEQ ID NO: 687346 - protein, 9 aa, Homo Sapiens
GSASRNDHG

SEQ ID NO: 687347 - protein, 9 aa, Homo Sapiens
SGGHINPSI

SEQ ID NO: 687348 - protein, 9 aa, Homo Sapiens
TGAMTAGPH

SEQ ID NO: 687349 - protein, 9 aa, Homo Sapiens
SEDQRTLLM

SEQ ID NO: 687350 - protein, 9 aa, Homo Sapiens
PQQINEHKF

SEQ ID NO: 687351 - protein, 9 aa, Homo Sapiens
SSGSLGSEC

SEQ ID NO: 687352 - protein, 9 aa, Homo Sapiens
FSPDTELSP

SEQ ID NO: 687353 - protein, 9 aa, Homo Sapiens
VREIAQDLK

SEQ ID NO: 687354 - protein, 9 aa, Homo Sapiens
GLGPPAAAS

SEQ ID NO: 687355 - protein, 9 aa, Homo Sapiens
SGFATDSTV

SEQ ID NO: 687356 - protein, 9 aa, Homo Sapiens
VNRNISSLF

SEQ ID NO: 687357 - protein, 9 aa, Homo Sapiens
SGGPPTEGG

SEQ ID NO: 687358 - protein, 9 aa, Homo Sapiens
NNVLFYTTQ

SEQ ID NO: 687359 - protein, 9 aa, Homo Sapiens
FGSPEVAGA

SEQ ID NO: 687360 - protein, 9 aa, Homo Sapiens
VQQAKCENP

SEQ ID NO: 687361 - protein, 9 aa, Homo Sapiens
GYISGLKIP

SEQ ID NO: 687362 - protein, 9 aa, Homo Sapiens
DSPGGLAVD

SEQ ID NO: 687363 - protein, 9 aa, Homo Sapiens
SEILKRNIK

SEQ ID NO: 687364 - protein, 9 aa, Homo Sapiens
EDESGTPRK

SEQ ID NO: 687365 - protein, 9 aa, Homo Sapiens
PPKKKRLHL

SEQ ID NO: 687366 - protein, 9 aa, Homo Sapiens
VMGHLRWDR

SEQ ID NO: 687367 - protein, 9 aa, Homo Sapiens
VSMVVSARP

SEQ ID NO: 687368 - protein, 9 aa, Homo Sapiens
PEAPPLPPA

SEQ ID NO: 687369 - protein, 9 aa, Homo Sapiens
PEEEDDQNE

SEQ ID NO: 687370 - protein, 9 aa, Homo Sapiens
EGNRSQPIS

SEQ ID NO: 687371 - protein, 9 aa, Homo Sapiens
QRNEIGHTP

SEQ ID NO: 687372 - protein, 9 aa, Homo Sapiens
DLRQQMPPP

SEQ ID NO: 687373 - protein, 9 aa, Homo Sapiens
TKQSAMAMC

SEQ ID NO: 687374 - protein, 9 aa, Homo Sapiens
EVKPKPSQL

SEQ ID NO: 687375 - protein, 9 aa, Homo Sapiens
KNNLFVVHR

SEQ ID NO: 687376 - protein, 9 aa, Homo Sapiens
PEASQQTYS

SEQ ID NO: 687377 - protein, 9 aa, Homo Sapiens
SWVFKNFAF

SEQ ID NO: 687378 - protein, 9 aa, Homo Sapiens
WEENETLVE

SEQ ID NO: 687379 - protein, 9 aa, Homo Sapiens
LCNTKECQK

SEQ ID NO: 687380 - protein, 9 aa, Homo Sapiens
YLCSLHSRA

SEQ ID NO: 687381 - protein, 9 aa, Homo Sapiens
KEYGARVVR

SEQ ID NO: 687382 - protein, 9 aa, Homo Sapiens
FLLKQLDDK

SEQ ID NO: 687383 - protein, 9 aa, Homo Sapiens
GCAPQQLRR

SEQ ID NO: 687384 - protein, 9 aa, Homo Sapiens
NISIYLNNV

SEQ ID NO: 687385 - protein, 9 aa, Homo Sapiens
LLAAAVDKG

SEQ ID NO: 687386 - protein, 9 aa, Homo Sapiens
PAVQNLPAN

SEQ ID NO: 687387 - protein, 9 aa, Homo Sapiens
QEKLLQLLA

SEQ ID NO: 687388 - protein, 9 aa, Homo Sapiens
QSVGTYGRV

SEQ ID NO: 687389 - protein, 9 aa, Homo Sapiens
ISCEHVNEE

SEQ ID NO: 687390 - protein, 9 aa, Homo Sapiens
IDDTCGRHH

SEQ ID NO: 687391 - protein, 9 aa, Homo Sapiens
CLGIELHAS

SEQ ID NO: 687392 - protein, 9 aa, Homo Sapiens
QFCTEDVDK

SEQ ID NO: 687393 - protein, 9 aa, Homo Sapiens
KLHQDLKSA

SEQ ID NO: 687394 - protein, 9 aa, Homo Sapiens
LKVSRDNSF

SEQ ID NO: 687395 - protein, 9 aa, Homo Sapiens
KYEVKASVP

SEQ ID NO: 687396 - protein, 9 aa, Homo Sapiens
VVEGPSAST

SEQ ID NO: 687397 - protein, 9 aa, Homo Sapiens
AVRRQVRPM

SEQ ID NO: 687398 - protein, 9 aa, Homo Sapiens
AVLVLTPAV

SEQ ID NO: 687399 - protein, 9 aa, Homo Sapiens
SRARVLSCS

SEQ ID NO: 687400 - protein, 9 aa, Homo Sapiens
SGNGREIGE

SEQ ID NO: 687401 - protein, 9 aa, Homo Sapiens
VRLNAIPIQ

SEQ ID NO: 687402 - protein, 9 aa, Homo Sapiens
KNRQLTLPE

SEQ ID NO: 687403 - protein, 9 aa, Homo Sapiens
AIKCSTSLH

SEQ ID NO: 687404 - protein, 9 aa, Homo Sapiens
IPVTIHNLV

SEQ ID NO: 687405 - protein, 9 aa, Homo Sapiens
KMLRSMMGK

SEQ ID NO: 687406 - protein, 9 aa, Homo Sapiens
ERFVSSPKE

SEQ ID NO: 687407 - protein, 9 aa, Homo Sapiens
TQSNKFDLV

SEQ ID NO: 687408 - protein, 9 aa, Homo Sapiens
GTVENEHLK

SEQ ID NO: 687409 - protein, 9 aa, Homo Sapiens
VFLCFIFHG

SEQ ID NO: 687410 - protein, 9 aa, Homo Sapiens
NNKKMLSDS

SEQ ID NO: 687411 - protein, 9 aa, Homo Sapiens
LFGGAPGHR

SEQ ID NO: 687412 - protein, 9 aa, Homo Sapiens
EQTGSRGPV

SEQ ID NO: 687413 - protein, 9 aa, Homo Sapiens
LSHGGGGWG

SEQ ID NO: 687414 - protein, 9 aa, Homo Sapiens
PTMQEKHLH

SEQ ID NO: 687415 - protein, 9 aa, Homo Sapiens
NTTGRRGRT

SEQ ID NO: 687416 - protein, 9 aa, Homo Sapiens
GGDDYLEDE

SEQ ID NO: 687417 - protein, 9 aa, Homo Sapiens
SLFNVCGCA

SEQ ID NO: 687418 - protein, 9 aa, Homo Sapiens
AAKQTPPVQ

SEQ ID NO: 687419 - protein, 9 aa, Homo Sapiens
KYRDRHTMK

SEQ ID NO: 687420 - protein, 9 aa, Homo Sapiens
GSAATLHMT

SEQ ID NO: 687421 - protein, 9 aa, Homo Sapiens
TNFHDGRPV

SEQ ID NO: 687422 - protein, 9 aa, Homo Sapiens
AALTYTISL

SEQ ID NO: 687423 - protein, 9 aa, Homo Sapiens
FRISELQKA

SEQ ID NO: 687424 - protein, 9 aa, Homo Sapiens
TSSEQAHPS

SEQ ID NO: 687425 - protein, 9 aa, Homo Sapiens
NFDVEESLQ

SEQ ID NO: 687426 - protein, 9 aa, Homo Sapiens
QNQPSEIFL

SEQ ID NO: 687427 - protein, 9 aa, Homo Sapiens
ALSKAVYEK

SEQ ID NO: 687428 - protein, 9 aa, Homo Sapiens
RRERLTVHR

SEQ ID NO: 687429 - protein, 9 aa, Homo Sapiens
GTELIGKNK

SEQ ID NO: 687430 - protein, 9 aa, Homo Sapiens
NSAHELGFQ

SEQ ID NO: 687431 - protein, 9 aa, Homo Sapiens
SLQTLHRSS

SEQ ID NO: 687432 - protein, 9 aa, Homo Sapiens
CSGIQCNVR

SEQ ID NO: 687433 - protein, 9 aa, Homo Sapiens
LCCTGSCYS

SEQ ID NO: 687434 - protein, 9 aa, Homo Sapiens
YRLRLGGRL

SEQ ID NO: 687435 - protein, 9 aa, Homo Sapiens
TLHMTVRDL

SEQ ID NO: 687436 - protein, 9 aa, Homo Sapiens
NYVAPKVLL

SEQ ID NO: 687437 - protein, 9 aa, Homo Sapiens
TDDLLCVAN

SEQ ID NO: 687438 - protein, 9 aa, Homo Sapiens
VENGTPCGP

SEQ ID NO: 687439 - protein, 9 aa, Homo Sapiens
EALQPETEG

SEQ ID NO: 687440 - protein, 9 aa, Homo Sapiens
AIDDKDFVL

SEQ ID NO: 687441 - protein, 9 aa, Homo Sapiens
LKTSETAGE

SEQ ID NO: 687442 - protein, 9 aa, Homo Sapiens
LSMLKGKPW

SEQ ID NO: 687443 - protein, 9 aa, Homo Sapiens
SAPLGIGRL

SEQ ID NO: 687444 - protein, 9 aa, Homo Sapiens
IYEETRGVF

SEQ ID NO: 687445 - protein, 9 aa, Homo Sapiens
LVLSSHETL

SEQ ID NO: 687446 - protein, 9 aa, Homo Sapiens
GEEWSMGGY

SEQ ID NO: 687447 - protein, 9 aa, Homo Sapiens
YAVILCCIR

SEQ ID NO: 687448 - protein, 9 aa, Homo Sapiens
DSNLKLPEE

SEQ ID NO: 687449 - protein, 9 aa, Homo Sapiens
LCKERQALY

SEQ ID NO: 687450 - protein, 9 aa, Homo Sapiens
KGVAEKVEE

SEQ ID NO: 687451 - protein, 9 aa, Homo Sapiens
SEIYRCYGW

SEQ ID NO: 687452 - protein, 9 aa, Homo Sapiens
YFREQGKAL

SEQ ID NO: 687453 - protein, 9 aa, Homo Sapiens
RWLTNIEVP

SEQ ID NO: 687454 - protein, 9 aa, Homo Sapiens
CSHFHVRFG

SEQ ID NO: 687455 - protein, 9 aa, Homo Sapiens
SVATATPST

SEQ ID NO: 687456 - protein, 9 aa, Homo Sapiens
ISLANNHIL

SEQ ID NO: 687457 - protein, 9 aa, Homo Sapiens
VCLRPLGDP

SEQ ID NO: 687458 - protein, 9 aa, Homo Sapiens
PPVTRVAYV

SEQ ID NO: 687459 - protein, 9 aa, Homo Sapiens
PYLLSPVKH

SEQ ID NO: 687460 - protein, 9 aa, Homo Sapiens
LCFMNNIFC

SEQ ID NO: 687461 - protein, 9 aa, Homo Sapiens
VCSTPPTGH

SEQ ID NO: 687462 - protein, 9 aa, Homo Sapiens
IANPGSGEV

SEQ ID NO: 687463 - protein, 9 aa, Homo Sapiens
LCDPSLDMK

SEQ ID NO: 687464 - protein, 9 aa, Homo Sapiens
YTKAYSRQG

SEQ ID NO: 687465 - protein, 9 aa, Homo Sapiens
ARFRPSLEK

SEQ ID NO: 687466 - protein, 9 aa, Homo Sapiens
LPEGKVEVF

SEQ ID NO: 687467 - protein, 9 aa, Homo Sapiens
LREQVIVPP

SEQ ID NO: 687468 - protein, 9 aa, Homo Sapiens
MMGKCCHHC

SEQ ID NO: 687469 - protein, 9 aa, Homo Sapiens
QYRYTSEIL

SEQ ID NO: 687470 - protein, 9 aa, Homo Sapiens
LAKEYGARV

SEQ ID NO: 687471 - protein, 9 aa, Homo Sapiens
PHSAFSMVK

SEQ ID NO: 687472 - protein, 9 aa, Homo Sapiens
NAMITNTNN

SEQ ID NO: 687473 - protein, 9 aa, Homo Sapiens
DKEVSEFAL

SEQ ID NO: 687474 - protein, 9 aa, Homo Sapiens
SLFHFCGSC

SEQ ID NO: 687475 - protein, 9 aa, Homo Sapiens
HPQFLADVL

SEQ ID NO: 687476 - protein, 9 aa, Homo Sapiens
VEDYKINIP

SEQ ID NO: 687477 - protein, 9 aa, Homo Sapiens
RARAPMSNY

SEQ ID NO: 687478 - protein, 9 aa, Homo Sapiens
MPDAPDHDS

SEQ ID NO: 687479 - protein, 9 aa, Homo Sapiens
KPGLIKVVR

SEQ ID NO: 687480 - protein, 9 aa, Homo Sapiens
DKCQLQPNA

SEQ ID NO: 687481 - protein, 9 aa, Homo Sapiens
WLKENRTIE

SEQ ID NO: 687482 - protein, 9 aa, Homo Sapiens
RVQTMMGLC

SEQ ID NO: 687483 - protein, 9 aa, Homo Sapiens
TEQSNFGSK

SEQ ID NO: 687484 - protein, 9 aa, Homo Sapiens
NMQYCPHCQ

SEQ ID NO: 687485 - protein, 9 aa, Homo Sapiens
TSPTPPVVC

SEQ ID NO: 687486 - protein, 9 aa, Homo Sapiens
RAAWWGKIP

SEQ ID NO: 687487 - protein, 9 aa, Homo Sapiens
TKRYERERA

SEQ ID NO: 687488 - protein, 9 aa, Homo Sapiens
VEAVSSPSA

SEQ ID NO: 687489 - protein, 9 aa, Homo Sapiens
IQDVTEESK

SEQ ID NO: 687490 - protein, 9 aa, Homo Sapiens
VIKFRKDII

SEQ ID NO: 687491 - protein, 9 aa, Homo Sapiens
SNCFATDLS

SEQ ID NO: 687492 - protein, 9 aa, Homo Sapiens
QLSGNSSTL

SEQ ID NO: 687493 - protein, 9 aa, Homo Sapiens
FLYECETSK

SEQ ID NO: 687494 - protein, 9 aa, Homo Sapiens
LLLPVLQIS

SEQ ID NO: 687495 - protein, 9 aa, Homo Sapiens
APARGDSEH

SEQ ID NO: 687496 - protein, 9 aa, Homo Sapiens
ISSLHLKRY

SEQ ID NO: 687497 - protein, 9 aa, Homo Sapiens
TASSHFGGP

SEQ ID NO: 687498 - protein, 9 aa, Homo Sapiens
LHSLMSTLS

SEQ ID NO: 687499 - protein, 9 aa, Homo Sapiens
NVFYVQQAK

SEQ ID NO: 687500 - protein, 9 aa, Homo Sapiens
TAVSAGPGV

SEQ ID NO: 687501 - protein, 9 aa, Homo Sapiens
AQKLLETVG

SEQ ID NO: 687502 - protein, 9 aa, Homo Sapiens
LTFHIIRKN

SEQ ID NO: 687503 - protein, 9 aa, Homo Sapiens
EGIPPTSRG

SEQ ID NO: 687504 - protein, 9 aa, Homo Sapiens
MRAFDGILV

SEQ ID NO: 687505 - protein, 9 aa, Homo Sapiens
KPPLTFHII

SEQ ID NO: 687506 - protein, 9 aa, Homo Sapiens
SLRMLLLQG

SEQ ID NO: 687507 - protein, 9 aa, Homo Sapiens
NTREAQQAL

SEQ ID NO: 687508 - protein, 9 aa, Homo Sapiens
KSRVKWDQY

SEQ ID NO: 687509 - protein, 9 aa, Homo Sapiens
GPISAPSCI

SEQ ID NO: 687510 - protein, 9 aa, Homo Sapiens
TDPSIPISK

SEQ ID NO: 687511 - protein, 9 aa, Homo Sapiens
SIRKFERKL

SEQ ID NO: 687512 - protein, 9 aa, Homo Sapiens
ISPRKMPSQ

SEQ ID NO: 687513 - protein, 9 aa, Homo Sapiens
EGESFVCSS

SEQ ID NO: 687514 - protein, 9 aa, Homo Sapiens
LGEDIHYPG

SEQ ID NO: 687515 - protein, 9 aa, Homo Sapiens
GLVVRITFI

SEQ ID NO: 687516 - protein, 9 aa, Homo Sapiens
LMERLAKEY

SEQ ID NO: 687517 - protein, 9 aa, Homo Sapiens
ATLHMTVRD

SEQ ID NO: 687518 - protein, 9 aa, Homo Sapiens
SLFWSVQGC

SEQ ID NO: 687519 - protein, 9 aa, Homo Sapiens
AHRAGIRMF

SEQ ID NO: 687520 - protein, 9 aa, Homo Sapiens
MGNKVDETV

SEQ ID NO: 687521 - protein, 9 aa, Homo Sapiens
KLHPHDVAG

SEQ ID NO: 687522 - protein, 9 aa, Homo Sapiens
FCNPLFTAL

SEQ ID NO: 687523 - protein, 9 aa, Homo Sapiens
RYLKEKFLI

SEQ ID NO: 687524 - protein, 9 aa, Homo Sapiens
KGEPGLLPV

SEQ ID NO: 687525 - protein, 9 aa, Homo Sapiens
IGPPGLQGP

SEQ ID NO: 687526 - protein, 9 aa, Homo Sapiens
LLQQARSSQ

SEQ ID NO: 687527 - protein, 9 aa, Homo Sapiens
DVAMFDPPQ

SEQ ID NO: 687528 - protein, 9 aa, Homo Sapiens
LGPQPAGPS

SEQ ID NO: 687529 - protein, 9 aa, Homo Sapiens
RRSPAFLLL

SEQ ID NO: 687530 - protein, 9 aa, Homo Sapiens
YGCQTGTAE

SEQ ID NO: 687531 - protein, 9 aa, Homo Sapiens
RRSCAFTPT

SEQ ID NO: 687532 - protein, 9 aa, Homo Sapiens
GCTWPQPFL

SEQ ID NO: 687533 - protein, 9 aa, Homo Sapiens
SARRRPPQL

SEQ ID NO: 687534 - protein, 9 aa, Homo Sapiens
RQNNNPDWH

SEQ ID NO: 687535 - protein, 9 aa, Homo Sapiens
DLSRLLLGL

SEQ ID NO: 687536 - protein, 9 aa, Homo Sapiens
YPGLRGETG

SEQ ID NO: 687537 - protein, 9 aa, Homo Sapiens
RAPRTVFRN

SEQ ID NO: 687538 - protein, 9 aa, Homo Sapiens
YTCQEWVVV

SEQ ID NO: 687539 - protein, 9 aa, Homo Sapiens
VAKQLQKAD

SEQ ID NO: 687540 - protein, 9 aa, Homo Sapiens
SMPSPGGRI

SEQ ID NO: 687541 - protein, 9 aa, Homo Sapiens
EGVTCMSEE

SEQ ID NO: 687542 - protein, 9 aa, Homo Sapiens
IGIKHYNIL

SEQ ID NO: 687543 - protein, 9 aa, Homo Sapiens
HHAQLLKPR

SEQ ID NO: 687544 - protein, 9 aa, Homo Sapiens
PGPYRLRLG

SEQ ID NO: 687545 - protein, 9 aa, Homo Sapiens
TPPVQPVAP

SEQ ID NO: 687546 - protein, 9 aa, Homo Sapiens
GYRKHLGVS

SEQ ID NO: 687547 - protein, 9 aa, Homo Sapiens
VRLRKAQAL

SEQ ID NO: 687548 - protein, 9 aa, Homo Sapiens
LRNPAMMQD

SEQ ID NO: 687549 - protein, 9 aa, Homo Sapiens
DSGEPQRFA

SEQ ID NO: 687550 - protein, 9 aa, Homo Sapiens
SQKVSEKET

SEQ ID NO: 687551 - protein, 9 aa, Homo Sapiens
HLRWDRFGR

SEQ ID NO: 687552 - protein, 9 aa, Homo Sapiens
DKKCQLDVL

SEQ ID NO: 687553 - protein, 9 aa, Homo Sapiens
FTPNSRKPA

SEQ ID NO: 687554 - protein, 9 aa, Homo Sapiens
IENAQERSW

SEQ ID NO: 687555 - protein, 9 aa, Homo Sapiens
SGGFRRTIC

SEQ ID NO: 687556 - protein, 9 aa, Homo Sapiens
NAVGALSKA

SEQ ID NO: 687557 - protein, 9 aa, Homo Sapiens
KESLEESVG

SEQ ID NO: 687558 - protein, 9 aa, Homo Sapiens
AEKVEEPRY

SEQ ID NO: 687559 - protein, 9 aa, Homo Sapiens
FTPTTPSSL

SEQ ID NO: 687560 - protein, 9 aa, Homo Sapiens
LPEEITKES

SEQ ID NO: 687561 - protein, 9 aa, Homo Sapiens
SSYFREQGK

SEQ ID NO: 687562 - protein, 9 aa, Homo Sapiens
LLLLVVLTA

SEQ ID NO: 687563 - protein, 9 aa, Homo Sapiens
ILMIDEMND

SEQ ID NO: 687564 - protein, 9 aa, Homo Sapiens
SSSCGGSVA

SEQ ID NO: 687565 - protein, 9 aa, Homo Sapiens
YSIRSCTNG

SEQ ID NO: 687566 - protein, 9 aa, Homo Sapiens
SHLNSDDIE

SEQ ID NO: 687567 - protein, 9 aa, Homo Sapiens
RGSRARGCK

SEQ ID NO: 687568 - protein, 9 aa, Homo Sapiens
DFSNSSTKA

SEQ ID NO: 687569 - protein, 9 aa, Homo Sapiens
DDYTGRDSE

SEQ ID NO: 687570 - protein, 9 aa, Homo Sapiens
PTSTWSHVP

SEQ ID NO: 687571 - protein, 9 aa, Homo Sapiens
VKAIESYVL

SEQ ID NO: 687572 - protein, 9 aa, Homo Sapiens
PHRCAGRME

SEQ ID NO: 687573 - protein, 9 aa, Homo Sapiens
IAASISATA

SEQ ID NO: 687574 - protein, 9 aa, Homo Sapiens
LLDEKEPKV

SEQ ID NO: 687575 - protein, 9 aa, Homo Sapiens
DPEVKFNWF

SEQ ID NO: 687576 - protein, 9 aa, Homo Sapiens
SLSFHRHII

SEQ ID NO: 687577 - protein, 9 aa, Homo Sapiens
LDEKEPKVL

SEQ ID NO: 687578 - protein, 9 aa, Homo Sapiens
RWLLAGLVS

SEQ ID NO: 687579 - protein, 9 aa, Homo Sapiens
YDQVLLEDR

SEQ ID NO: 687580 - protein, 9 aa, Homo Sapiens
PATVPSVTN

SEQ ID NO: 687581 - protein, 9 aa, Homo Sapiens
LEKIGNQEV

SEQ ID NO: 687582 - protein, 9 aa, Homo Sapiens
WKIGGLPVT

SEQ ID NO: 687583 - protein, 9 aa, Homo Sapiens
QGKYRDRHT

SEQ ID NO: 687584 - protein, 9 aa, Homo Sapiens
IRNHEELNK

SEQ ID NO: 687585 - protein, 9 aa, Homo Sapiens
NPQGAKLNM

SEQ ID NO: 687586 - protein, 9 aa, Homo Sapiens
NKTICESSG

SEQ ID NO: 687587 - protein, 9 aa, Homo Sapiens
GFRRTICRL

SEQ ID NO: 687588 - protein, 9 aa, Homo Sapiens
RSIFSAILD

SEQ ID NO: 687589 - protein, 9 aa, Homo Sapiens
SSLFHFCGS

SEQ ID NO: 687590 - protein, 9 aa, Homo Sapiens
LMLQDCMAV

SEQ ID NO: 687591 - protein, 9 aa, Homo Sapiens
VPTCKLASK

SEQ ID NO: 687592 - protein, 9 aa, Homo Sapiens
SGYQYLGTS

SEQ ID NO: 687593 - protein, 9 aa, Homo Sapiens
SECTNLAAL

SEQ ID NO: 687594 - protein, 9 aa, Homo Sapiens
SLQCSLDWL

SEQ ID NO: 687595 - protein, 9 aa, Homo Sapiens
NDKITHTEE

SEQ ID NO: 687596 - protein, 9 aa, Homo Sapiens
GLLPVVTGI

SEQ ID NO: 687597 - protein, 9 aa, Homo Sapiens
ATAVVSRGA

SEQ ID NO: 687598 - protein, 9 aa, Homo Sapiens
DDEPKFMFK

SEQ ID NO: 687599 - protein, 9 aa, Homo Sapiens
VSCGEPFGH

SEQ ID NO: 687600 - protein, 9 aa, Homo Sapiens
CGCAPQQLR

SEQ ID NO: 687601 - protein, 9 aa, Homo Sapiens
LKRQPKQRW

SEQ ID NO: 687602 - protein, 9 aa, Homo Sapiens
SAFNKKENK

SEQ ID NO: 687603 - protein, 9 aa, Homo Sapiens
PSGIFNSEL

SEQ ID NO: 687604 - protein, 9 aa, Homo Sapiens
AVSPREALT

SEQ ID NO: 687605 - protein, 9 aa, Homo Sapiens
LVTDLLAQG

SEQ ID NO: 687606 - protein, 9 aa, Homo Sapiens
RKDIKSIRN

SEQ ID NO: 687607 - protein, 9 aa, Homo Sapiens
LRPLGDPSN

SEQ ID NO: 687608 - protein, 9 aa, Homo Sapiens
AEAANKIHY

SEQ ID NO: 687609 - protein, 9 aa, Homo Sapiens
DSSPEASQQ

SEQ ID NO: 687610 - protein, 9 aa, Homo Sapiens
LNNLDLTAN

SEQ ID NO: 687611 - protein, 9 aa, Homo Sapiens
ACAAAKKKL

SEQ ID NO: 687612 - protein, 9 aa, Homo Sapiens
RPYFPVAKG

SEQ ID NO: 687613 - protein, 9 aa, Homo Sapiens
RRLQAFANL

SEQ ID NO: 687614 - protein, 9 aa, Homo Sapiens
LYPQGSRQI

SEQ ID NO: 687615 - protein, 9 aa, Homo Sapiens
IERKSNGPN

SEQ ID NO: 687616 - protein, 9 aa, Homo Sapiens
AKHPKKGSQ

SEQ ID NO: 687617 - protein, 9 aa, Homo Sapiens
RILNKEETS

SEQ ID NO: 687618 - protein, 9 aa, Homo Sapiens
PTTPSSLRS

SEQ ID NO: 687619 - protein, 9 aa, Homo Sapiens
CLGIFEWLC

SEQ ID NO: 687620 - protein, 9 aa, Homo Sapiens
QPAGPSIPG

SEQ ID NO: 687621 - protein, 9 aa, Homo Sapiens
SWMDLPHTE

SEQ ID NO: 687622 - protein, 9 aa, Homo Sapiens
FPDPALYPQ

SEQ ID NO: 687623 - protein, 9 aa, Homo Sapiens
PALWGGEGW

SEQ ID NO: 687624 - protein, 9 aa, Homo Sapiens
IVFYGCQTG

SEQ ID NO: 687625 - protein, 9 aa, Homo Sapiens
PAKNKYPEY

SEQ ID NO: 687626 - protein, 9 aa, Homo Sapiens
RPTLVISQR

SEQ ID NO: 687627 - protein, 9 aa, Homo Sapiens
LSHLDEKPY

SEQ ID NO: 687628 - protein, 9 aa, Homo Sapiens
CCGQRRACY

SEQ ID NO: 687629 - protein, 9 aa, Homo Sapiens
ERQLAVRPF

SEQ ID NO: 687630 - protein, 9 aa, Homo Sapiens
WFHNRRMKW

SEQ ID NO: 687631 - protein, 9 aa, Homo Sapiens
GLLLQELPD

SEQ ID NO: 687632 - protein, 9 aa, Homo Sapiens
WPELPARTQ

SEQ ID NO: 687633 - protein, 9 aa, Homo Sapiens
TATNFLILS

SEQ ID NO: 687634 - protein, 9 aa, Homo Sapiens
SSVKGQGFG

SEQ ID NO: 687635 - protein, 9 aa, Homo Sapiens
FSAILDELK

SEQ ID NO: 687636 - protein, 9 aa, Homo Sapiens
HHCSIPRAE

SEQ ID NO: 687637 - protein, 9 aa, Homo Sapiens
RRFMKLDAQ

SEQ ID NO: 687638 - protein, 9 aa, Homo Sapiens
SLPAMQQLL

SEQ ID NO: 687639 - protein, 9 aa, Homo Sapiens
QFIFDVVNK

SEQ ID NO: 687640 - protein, 9 aa, Homo Sapiens
EEFLTYVEH

SEQ ID NO: 687641 - protein, 9 aa, Homo Sapiens
VLPLVLLLL

SEQ ID NO: 687642 - protein, 9 aa, Homo Sapiens
FTRGKLISS

SEQ ID NO: 687643 - protein, 9 aa, Homo Sapiens
ATAVSAGPG

SEQ ID NO: 687644 - protein, 9 aa, Homo Sapiens
SYAVLVLTP

SEQ ID NO: 687645 - protein, 9 aa, Homo Sapiens
EAFELMNQG

SEQ ID NO: 687646 - protein, 9 aa, Homo Sapiens
INQENFELV

SEQ ID NO: 687647 - protein, 9 aa, Homo Sapiens
RVEDYKINI

SEQ ID NO: 687648 - protein, 9 aa, Homo Sapiens
CVVHGLRRR

SEQ ID NO: 687649 - protein, 9 aa, Homo Sapiens
YSFSTNSPP

SEQ ID NO: 687650 - protein, 9 aa, Homo Sapiens
SYGRPKTSN

SEQ ID NO: 687651 - protein, 9 aa, Homo Sapiens
LLSKQKQLQ

SEQ ID NO: 687652 - protein, 9 aa, Homo Sapiens
EVPQTKLVL

SEQ ID NO: 687653 - protein, 9 aa, Homo Sapiens
TFLVDKKCQ

SEQ ID NO: 687654 - protein, 9 aa, Homo Sapiens
FDGLHLGSG

SEQ ID NO: 687655 - protein, 9 aa, Homo Sapiens
GGFHCMQRD

SEQ ID NO: 687656 - protein, 9 aa, Homo Sapiens
DIGVFRCIA

SEQ ID NO: 687657 - protein, 9 aa, Homo Sapiens
GHEGFHERE

SEQ ID NO: 687658 - protein, 9 aa, Homo Sapiens
EFIALTNTE

SEQ ID NO: 687659 - protein, 9 aa, Homo Sapiens
DNSEEPPER

SEQ ID NO: 687660 - protein, 9 aa, Homo Sapiens
RTICRLERS

SEQ ID NO: 687661 - protein, 9 aa, Homo Sapiens
CAPQQLRRV

SEQ ID NO: 687662 - protein, 9 aa, Homo Sapiens
QTEEILDSE

SEQ ID NO: 687663 - protein, 9 aa, Homo Sapiens
GTSPLLAAQ

SEQ ID NO: 687664 - protein, 9 aa, Homo Sapiens
SGSVVSGSP

SEQ ID NO: 687665 - protein, 9 aa, Homo Sapiens
RLKTSETAG

SEQ ID NO: 687666 - protein, 9 aa, Homo Sapiens
NPGSGEVGS

SEQ ID NO: 687667 - protein, 9 aa, Homo Sapiens
LPCDFSRVR

SEQ ID NO: 687668 - protein, 9 aa, Homo Sapiens
SSAMKQAPE

SEQ ID NO: 687669 - protein, 9 aa, Homo Sapiens
AVLPLVLLL

SEQ ID NO: 687670 - protein, 9 aa, Homo Sapiens
TTDNLRFIW

SEQ ID NO: 687671 - protein, 9 aa, Homo Sapiens
NTGALKLTT

SEQ ID NO: 687672 - protein, 9 aa, Homo Sapiens
PCIWVIFYN

SEQ ID NO: 687673 - protein, 9 aa, Homo Sapiens
AVFESAVNL

SEQ ID NO: 687674 - protein, 9 aa, Homo Sapiens
SSQVHSCLE

SEQ ID NO: 687675 - protein, 9 aa, Homo Sapiens
AKKHNFAKP

SEQ ID NO: 687676 - protein, 9 aa, Homo Sapiens
DASGEAVSK

SEQ ID NO: 687677 - protein, 9 aa, Homo Sapiens
CFNWHSGYR

SEQ ID NO: 687678 - protein, 9 aa, Homo Sapiens
QNEPLPPGT

SEQ ID NO: 687679 - protein, 9 aa, Homo Sapiens
SKESPHTGD

SEQ ID NO: 687680 - protein, 9 aa, Homo Sapiens
RKTEEVTAV

SEQ ID NO: 687681 - protein, 9 aa, Homo Sapiens
SGQGKYRDR

SEQ ID NO: 687682 - protein, 9 aa, Homo Sapiens
EHSFWKLIP

SEQ ID NO: 687683 - protein, 9 aa, Homo Sapiens
LAKVIVVIG

SEQ ID NO: 687684 - protein, 9 aa, Homo Sapiens
DEFNISFMK

SEQ ID NO: 687685 - protein, 9 aa, Homo Sapiens
LAAAVDKGC

SEQ ID NO: 687686 - protein, 9 aa, Homo Sapiens
LAISCCDTH

SEQ ID NO: 687687 - protein, 9 aa, Homo Sapiens
CDWWISCRC

SEQ ID NO: 687688 - protein, 9 aa, Homo Sapiens
LHSTLGELP

SEQ ID NO: 687689 - protein, 9 aa, Homo Sapiens
SYKSAILNK

SEQ ID NO: 687690 - protein, 9 aa, Homo Sapiens
PEDSWELII

SEQ ID NO: 687691 - protein, 9 aa, Homo Sapiens
TTWPEEFDH

SEQ ID NO: 687692 - protein, 9 aa, Homo Sapiens
MHSSYMQIS

SEQ ID NO: 687693 - protein, 9 aa, Homo Sapiens
VQKKRVSAA

SEQ ID NO: 687694 - protein, 9 aa, Homo Sapiens
RLLKDIVTQ

SEQ ID NO: 687695 - protein, 9 aa, Homo Sapiens
QYLGTSDSG

SEQ ID NO: 687696 - protein, 9 aa, Homo Sapiens
FVLNSEVEY

SEQ ID NO: 687697 - protein, 9 aa, Homo Sapiens
AKSIPELNS

SEQ ID NO: 687698 - protein, 9 aa, Homo Sapiens
GKTPKIQQL

SEQ ID NO: 687699 - protein, 9 aa, Homo Sapiens
NSEVIYVWT

SEQ ID NO: 687700 - protein, 9 aa, Homo Sapiens
FKTLRHKQV

SEQ ID NO: 687701 - protein, 9 aa, Homo Sapiens
KLVMNTMDK

SEQ ID NO: 687702 - protein, 9 aa, Homo Sapiens
LVEYLRLVI

SEQ ID NO: 687703 - protein, 9 aa, Homo Sapiens
GSGNNEDRL

SEQ ID NO: 687704 - protein, 9 aa, Homo Sapiens
LWRNALETW

SEQ ID NO: 687705 - protein, 9 aa, Homo Sapiens
NTENLQQRL

SEQ ID NO: 687706 - protein, 9 aa, Homo Sapiens
VGRHLTIAE

SEQ ID NO: 687707 - protein, 9 aa, Homo Sapiens
PRISYPILH

SEQ ID NO: 687708 - protein, 9 aa, Homo Sapiens
INVNFDFTR

SEQ ID NO: 687709 - protein, 9 aa, Homo Sapiens
LNHMNNGNG

SEQ ID NO: 687710 - protein, 9 aa, Homo Sapiens
SGGFPGGRG

SEQ ID NO: 687711 - protein, 9 aa, Homo Sapiens
HLIRSCRTP

SEQ ID NO: 687712 - protein, 9 aa, Homo Sapiens
ITHCHDVYL

SEQ ID NO: 687713 - protein, 9 aa, Homo Sapiens
YCNCSGIQC

SEQ ID NO: 687714 - protein, 9 aa, Homo Sapiens
TPPRWTEDQ

SEQ ID NO: 687715 - protein, 9 aa, Homo Sapiens
TFWHNLNYW

SEQ ID NO: 687716 - protein, 9 aa, Homo Sapiens
DRDDMADEV

SEQ ID NO: 687717 - protein, 9 aa, Homo Sapiens
VLTPAVCAV

SEQ ID NO: 687718 - protein, 9 aa, Homo Sapiens
AILNKWTLT

SEQ ID NO: 687719 - protein, 9 aa, Homo Sapiens
SPEVAGALL

SEQ ID NO: 687720 - protein, 9 aa, Homo Sapiens
KIVDVIDSS

SEQ ID NO: 687721 - protein, 9 aa, Homo Sapiens
HSSQVHSCL

SEQ ID NO: 687722 - protein, 9 aa, Homo Sapiens
TEDVDKCQL

SEQ ID NO: 687723 - protein, 9 aa, Homo Sapiens
QKRIMPDPV

SEQ ID NO: 687724 - protein, 9 aa, Homo Sapiens
RKSLRSGSL

SEQ ID NO: 687725 - protein, 9 aa, Homo Sapiens
YQYLGTSDS

SEQ ID NO: 687726 - protein, 9 aa, Homo Sapiens
ASLCCTGSC

SEQ ID NO: 687727 - protein, 9 aa, Homo Sapiens
KCRPLRVRD

SEQ ID NO: 687728 - protein, 9 aa, Homo Sapiens
ESPHTGDSG

SEQ ID NO: 687729 - protein, 9 aa, Homo Sapiens
KLLETVGVS

SEQ ID NO: 687730 - protein, 9 aa, Homo Sapiens
VLGNLMGSY

SEQ ID NO: 687731 - protein, 9 aa, Homo Sapiens
SNKLQKLRP

SEQ ID NO: 687732 - protein, 9 aa, Homo Sapiens
FTDQSFFTP

SEQ ID NO: 687733 - protein, 9 aa, Homo Sapiens
VVYSSVATA

SEQ ID NO: 687734 - protein, 9 aa, Homo Sapiens
PSAEQEEEE

SEQ ID NO: 687735 - protein, 9 aa, Homo Sapiens
YTSEILREF

SEQ ID NO: 687736 - protein, 9 aa, Homo Sapiens
WEQEDLNRK

SEQ ID NO: 687737 - protein, 9 aa, Homo Sapiens
LALLASFAG

SEQ ID NO: 687738 - protein, 9 aa, Homo Sapiens
NELLMLTFS

SEQ ID NO: 687739 - protein, 9 aa, Homo Sapiens
WSQRVEDYK

SEQ ID NO: 687740 - protein, 9 aa, Homo Sapiens
QLERKREEN

SEQ ID NO: 687741 - protein, 9 aa, Homo Sapiens
GSGSVVSGS

SEQ ID NO: 687742 - protein, 9 aa, Homo Sapiens
AGLRPASCR

SEQ ID NO: 687743 - protein, 9 aa, Homo Sapiens
PGPGGQTPK

SEQ ID NO: 687744 - protein, 9 aa, Homo Sapiens
LGTVENEHL

SEQ ID NO: 687745 - protein, 9 aa, Homo Sapiens
HSTGIPAQT

SEQ ID NO: 687746 - protein, 9 aa, Homo Sapiens
RWKLFNAEL

SEQ ID NO: 687747 - protein, 9 aa, Homo Sapiens
QSSHYQQRF

SEQ ID NO: 687748 - protein, 9 aa, Homo Sapiens
KWTLTPLAL

SEQ ID NO: 687749 - protein, 9 aa, Homo Sapiens
GLSNVQKKR

SEQ ID NO: 687750 - protein, 9 aa, Homo Sapiens
VPGVPQRTL

SEQ ID NO: 687751 - protein, 9 aa, Homo Sapiens
LSLSLNQQL

SEQ ID NO: 687752 - protein, 9 aa, Homo Sapiens
QAHPSAPCL

SEQ ID NO: 687753 - protein, 9 aa, Homo Sapiens
EEIYSKFTA

SEQ ID NO: 687754 - protein, 9 aa, Homo Sapiens
TSTWSHVPI

SEQ ID NO: 687755 - protein, 9 aa, Homo Sapiens
ADKDLQASC

SEQ ID NO: 687756 - protein, 9 aa, Homo Sapiens
EWSMGGYVK

SEQ ID NO: 687757 - protein, 9 aa, Homo Sapiens
VYSFEPLCR

SEQ ID NO: 687758 - protein, 9 aa, Homo Sapiens
LGPPAAASA

SEQ ID NO: 687759 - protein, 9 aa, Homo Sapiens
CLPCKGDRN

SEQ ID NO: 687760 - protein, 9 aa, Homo Sapiens
KLWRNALET

SEQ ID NO: 687761 - protein, 9 aa, Homo Sapiens
SLYENQTPL

SEQ ID NO: 687762 - protein, 9 aa, Homo Sapiens
TVRIHGVNS

SEQ ID NO: 687763 - protein, 9 aa, Homo Sapiens
FLGLTHMDL

SEQ ID NO: 687764 - protein, 9 aa, Homo Sapiens
PGSVAFSDF

SEQ ID NO: 687765 - protein, 9 aa, Homo Sapiens
LSKQKQLQK

SEQ ID NO: 687766 - protein, 9 aa, Homo Sapiens
PPSASQSAG

SEQ ID NO: 687767 - protein, 9 aa, Homo Sapiens
ERLSTAVTD

SEQ ID NO: 687768 - protein, 9 aa, Homo Sapiens
FWSQRVEDY

SEQ ID NO: 687769 - protein, 9 aa, Homo Sapiens
RRRTEQNPG

SEQ ID NO: 687770 - protein, 9 aa, Homo Sapiens
QLCNTKECQ

SEQ ID NO: 687771 - protein, 9 aa, Homo Sapiens
KQFVPGVPQ

SEQ ID NO: 687772 - protein, 9 aa, Homo Sapiens
SSKPNKLSN

SEQ ID NO: 687773 - protein, 9 aa, Homo Sapiens
SDALAVQDD

SEQ ID NO: 687774 - protein, 9 aa, Homo Sapiens
GLPRRPKPW

SEQ ID NO: 687775 - protein, 9 aa, Homo Sapiens
STLGELPAK

SEQ ID NO: 687776 - protein, 9 aa, Homo Sapiens
SIDDTLEDS

SEQ ID NO: 687777 - protein, 9 aa, Homo Sapiens
SYKSMTVEV

SEQ ID NO: 687778 - protein, 9 aa, Homo Sapiens
LLTLLLLLV

SEQ ID NO: 687779 - protein, 9 aa, Homo Sapiens
SAVNLKGIP

SEQ ID NO: 687780 - protein, 9 aa, Homo Sapiens
AGGSGTGPA

SEQ ID NO: 687781 - protein, 9 aa, Homo Sapiens
VVRITFIKD

SEQ ID NO: 687782 - protein, 9 aa, Homo Sapiens
DHFFCEVPV

SEQ ID NO: 687783 - protein, 9 aa, Homo Sapiens
NEGNCVMDM

SEQ ID NO: 687784 - protein, 9 aa, Homo Sapiens
AKNKYPEYG

SEQ ID NO: 687785 - protein, 9 aa, Homo Sapiens
YSLRLSVGY

SEQ ID NO: 687786 - protein, 9 aa, Homo Sapiens
SYKVPDEHF

SEQ ID NO: 687787 - protein, 9 aa, Homo Sapiens
NRSPTVEEN

SEQ ID NO: 687788 - protein, 9 aa, Homo Sapiens
YTTKRLIGR

SEQ ID NO: 687789 - protein, 9 aa, Homo Sapiens
LQKLRPDPL

SEQ ID NO: 687790 - protein, 9 aa, Homo Sapiens
VFLTTTSRK

SEQ ID NO: 687791 - protein, 9 aa, Homo Sapiens
VKKTLTHLT

SEQ ID NO: 687792 - protein, 9 aa, Homo Sapiens
KQVLDLKEE

SEQ ID NO: 687793 - protein, 9 aa, Homo Sapiens
PLTRRSCAF

SEQ ID NO: 687794 - protein, 9 aa, Homo Sapiens
HTNTTGRRG

SEQ ID NO: 687795 - protein, 9 aa, Homo Sapiens
IISLANNHI

SEQ ID NO: 687796 - protein, 9 aa, Homo Sapiens
LISPRKMPS

SEQ ID NO: 687797 - protein, 9 aa, Homo Sapiens
SLRQNNNPD

SEQ ID NO: 687798 - protein, 9 aa, Homo Sapiens
LAQLGIAKL

SEQ ID NO: 687799 - protein, 9 aa, Homo Sapiens
HARSPEDKY

SEQ ID NO: 687800 - protein, 9 aa, Homo Sapiens
VIYVWTNGS

SEQ ID NO: 687801 - protein, 9 aa, Homo Sapiens
LCEIPCKLE

SEQ ID NO: 687802 - protein, 9 aa, Homo Sapiens
SEIFLSMSD

SEQ ID NO: 687803 - protein, 9 aa, Homo Sapiens
VSRDNSFLL

SEQ ID NO: 687804 - protein, 9 aa, Homo Sapiens
ISLYECAVR

SEQ ID NO: 687805 - protein, 9 aa, Homo Sapiens
CSQTSDNNA

SEQ ID NO: 687806 - protein, 9 aa, Homo Sapiens
VTHLIRSCR

SEQ ID NO: 687807 - protein, 9 aa, Homo Sapiens
TNQVQCHPY

SEQ ID NO: 687808 - protein, 9 aa, Homo Sapiens
ARLTADKDL

SEQ ID NO: 687809 - protein, 9 aa, Homo Sapiens
LIGYDVGLT

SEQ ID NO: 687810 - protein, 9 aa, Homo Sapiens
IQGVIKFRK

SEQ ID NO: 687811 - protein, 9 aa, Homo Sapiens
STMPFCGSN

SEQ ID NO: 687812 - protein, 9 aa, Homo Sapiens
MLFERHLCV

SEQ ID NO: 687813 - protein, 9 aa, Homo Sapiens
KEAIRRLQA

SEQ ID NO: 687814 - protein, 9 aa, Homo Sapiens
KNGLQLGVQ

SEQ ID NO: 687815 - protein, 9 aa, Homo Sapiens
CTMLSGLLF

SEQ ID NO: 687816 - protein, 9 aa, Homo Sapiens
SFGYTTDNL

SEQ ID NO: 687817 - protein, 9 aa, Homo Sapiens
IVDVIDSSQ

SEQ ID NO: 687818 - protein, 9 aa, Homo Sapiens
RVDFRAAQC

SEQ ID NO: 687819 - protein, 9 aa, Homo Sapiens
PRGSRARGC

SEQ ID NO: 687820 - protein, 9 aa, Homo Sapiens
TEEILDSEN

SEQ ID NO: 687821 - protein, 9 aa, Homo Sapiens
NNHILLWDL

SEQ ID NO: 687822 - protein, 9 aa, Homo Sapiens
VRDHEKRLE

SEQ ID NO: 687823 - protein, 9 aa, Homo Sapiens
CSWELFISN

SEQ ID NO: 687824 - protein, 9 aa, Homo Sapiens
SSMGRQEEP

SEQ ID NO: 687825 - protein, 9 aa, Homo Sapiens
QFKLNKDTS

SEQ ID NO: 687826 - protein, 9 aa, Homo Sapiens
LRDEVIYPD

SEQ ID NO: 687827 - protein, 9 aa, Homo Sapiens
FRIRNNKKM

SEQ ID NO: 687828 - protein, 9 aa, Homo Sapiens
HTDGSIVDT

SEQ ID NO: 687829 - protein, 9 aa, Homo Sapiens
GAALANALQ

SEQ ID NO: 687830 - protein, 9 aa, Homo Sapiens
VFVNLLKNT

SEQ ID NO: 687831 - protein, 9 aa, Homo Sapiens
RGGKIPMRW

SEQ ID NO: 687832 - protein, 9 aa, Homo Sapiens
TTIQILFVG

SEQ ID NO: 687833 - protein, 9 aa, Homo Sapiens
LRRSREFLG

SEQ ID NO: 687834 - protein, 9 aa, Homo Sapiens
EQLVKYQNE

SEQ ID NO: 687835 - protein, 9 aa, Homo Sapiens
DISGNYHLP

SEQ ID NO: 687836 - protein, 9 aa, Homo Sapiens
LLKVSRDNS

SEQ ID NO: 687837 - protein, 9 aa, Homo Sapiens
RFLKPQDIQ

SEQ ID NO: 687838 - protein, 9 aa, Homo Sapiens
TEQDPKHCP

SEQ ID NO: 687839 - protein, 9 aa, Homo Sapiens
KGSCYGKVF

SEQ ID NO: 687840 - protein, 9 aa, Homo Sapiens
TFQIIWDTV

SEQ ID NO: 687841 - protein, 9 aa, Homo Sapiens
LMERVQTMM

SEQ ID NO: 687842 - protein, 9 aa, Homo Sapiens
QGAKLNMYK

SEQ ID NO: 687843 - protein, 9 aa, Homo Sapiens
EKLLQLLAA

SEQ ID NO: 687844 - protein, 9 aa, Homo Sapiens
PPGTTEPTP

SEQ ID NO: 687845 - protein, 9 aa, Homo Sapiens
FTPHTITLQ

SEQ ID NO: 687846 - protein, 9 aa, Homo Sapiens
KYPLTLKPF

SEQ ID NO: 687847 - protein, 9 aa, Homo Sapiens
CVELHCWKG

SEQ ID NO: 687848 - protein, 9 aa, Homo Sapiens
RHARSPEDK

SEQ ID NO: 687849 - protein, 9 aa, Homo Sapiens
EIDHTQYRL

SEQ ID NO: 687850 - protein, 9 aa, Homo Sapiens
HCHDVYLRC

SEQ ID NO: 687851 - protein, 9 aa, Homo Sapiens
LYVQAEILN

SEQ ID NO: 687852 - protein, 9 aa, Homo Sapiens
DVRQVQLQG

SEQ ID NO: 687853 - protein, 9 aa, Homo Sapiens
PKQRWLFWN

SEQ ID NO: 687854 - protein, 9 aa, Homo Sapiens
VPQRTLGAS

SEQ ID NO: 687855 - protein, 9 aa, Homo Sapiens
NFYPAVQNL

SEQ ID NO: 687856 - protein, 9 aa, Homo Sapiens
ECSCQVSLI

SEQ ID NO: 687857 - protein, 9 aa, Homo Sapiens
KLSHLDEKP

SEQ ID NO: 687858 - protein, 9 aa, Homo Sapiens
QRVSLEAVI

SEQ ID NO: 687859 - protein, 9 aa, Homo Sapiens
SQRTEVLGS

SEQ ID NO: 687860 - protein, 9 aa, Homo Sapiens
CAFTPTTPS

SEQ ID NO: 687861 - protein, 9 aa, Homo Sapiens
KAGATVRIH

SEQ ID NO: 687862 - protein, 9 aa, Homo Sapiens
YQDDKNRQL

SEQ ID NO: 687863 - protein, 9 aa, Homo Sapiens
KLIKGSCYG

SEQ ID NO: 687864 - protein, 9 aa, Homo Sapiens
ALAPAQISG

SEQ ID NO: 687865 - protein, 9 aa, Homo Sapiens
RKSLPLVTR

SEQ ID NO: 687866 - protein, 9 aa, Homo Sapiens
NFHDGRPVP

SEQ ID NO: 687867 - protein, 9 aa, Homo Sapiens
NSSTLANDK

SEQ ID NO: 687868 - protein, 9 aa, Homo Sapiens
IFCAEEEPP

SEQ ID NO: 687869 - protein, 9 aa, Homo Sapiens
RRSREFLGS

SEQ ID NO: 687870 - protein, 9 aa, Homo Sapiens
NMRAFDGIL

SEQ ID NO: 687871 - protein, 9 aa, Homo Sapiens
ETDARIQEE

SEQ ID NO: 687872 - protein, 9 aa, Homo Sapiens
RYTSEILRE

SEQ ID NO: 687873 - protein, 9 aa, Homo Sapiens
ERLAKEYGA

SEQ ID NO: 687874 - protein, 9 aa, Homo Sapiens
ISGQSVAKQ

SEQ ID NO: 687875 - protein, 9 aa, Homo Sapiens
CVNVLQEFG

SEQ ID NO: 687876 - protein, 9 aa, Homo Sapiens
NIMNGTIVG

SEQ ID NO: 687877 - protein, 9 aa, Homo Sapiens
HPPSGIFNS

SEQ ID NO: 687878 - protein, 9 aa, Homo Sapiens
VFYGCQTGT

SEQ ID NO: 687879 - protein, 9 aa, Homo Sapiens
QMCLLLQYH

SEQ ID NO: 687880 - protein, 9 aa, Homo Sapiens
PLTFHIIRK

SEQ ID NO: 687881 - protein, 9 aa, Homo Sapiens
MELPVDKIG

SEQ ID NO: 687882 - protein, 9 aa, Homo Sapiens
LVGASMLQC

SEQ ID NO: 687883 - protein, 9 aa, Homo Sapiens
KISYVMIAL

SEQ ID NO: 687884 - protein, 9 aa, Homo Sapiens
RLTVHRTHL

SEQ ID NO: 687885 - protein, 9 aa, Homo Sapiens
SSEYDQVLL

SEQ ID NO: 687886 - protein, 9 aa, Homo Sapiens
YKPVTNQVQ

SEQ ID NO: 687887 - protein, 9 aa, Homo Sapiens
RLGPQPAGP

SEQ ID NO: 687888 - protein, 9 aa, Homo Sapiens
GAGSNTPGA

SEQ ID NO: 687889 - protein, 9 aa, Homo Sapiens
IQRWLAEKK

SEQ ID NO: 687890 - protein, 9 aa, Homo Sapiens
SPQTSPFQE

SEQ ID NO: 687891 - protein, 9 aa, Homo Sapiens
RTVFRNLRS

SEQ ID NO: 687892 - protein, 9 aa, Homo Sapiens
VQGCLLSWC

SEQ ID NO: 687893 - protein, 9 aa, Homo Sapiens
IGAGSNTPG

SEQ ID NO: 687894 - protein, 9 aa, Homo Sapiens
RLHLAEMAQ

SEQ ID NO: 687895 - protein, 9 aa, Homo Sapiens
FYIGGVSEN

SEQ ID NO: 687896 - protein, 9 aa, Homo Sapiens
EALTEAMHT

SEQ ID NO: 687897 - protein, 9 aa, Homo Sapiens
ASSHFGGPP

SEQ ID NO: 687898 - protein, 9 aa, Homo Sapiens
MCLLLQYHC

SEQ ID NO: 687899 - protein, 9 aa, Homo Sapiens
GVSRSDQVI

SEQ ID NO: 687900 - protein, 9 aa, Homo Sapiens
SYRLLAGHV

SEQ ID NO: 687901 - protein, 9 aa, Homo Sapiens
KIQRWLAEK

SEQ ID NO: 687902 - protein, 9 aa, Homo Sapiens
EMGLHFFPV

SEQ ID NO: 687903 - protein, 9 aa, Homo Sapiens
LLAAQSSRA

SEQ ID NO: 687904 - protein, 9 aa, Homo Sapiens
GCKILENRN

SEQ ID NO: 687905 - protein, 9 aa, Homo Sapiens
FVIKYPLTL

SEQ ID NO: 687906 - protein, 9 aa, Homo Sapiens
INDPLRYSV

SEQ ID NO: 687907 - protein, 9 aa, Homo Sapiens
KFCNNVLPH

SEQ ID NO: 687908 - protein, 9 aa, Homo Sapiens
WDQYWPARG

SEQ ID NO: 687909 - protein, 9 aa, Homo Sapiens
RISELQKAS

SEQ ID NO: 687910 - protein, 9 aa, Homo Sapiens
EYKDENTLF

SEQ ID NO: 687911 - protein, 9 aa, Homo Sapiens
EWQSSILVQ

SEQ ID NO: 687912 - protein, 9 aa, Homo Sapiens
EEQNLQLQN

SEQ ID NO: 687913 - protein, 9 aa, Homo Sapiens
VLNSEVEYF

SEQ ID NO: 687914 - protein, 9 aa, Homo Sapiens
LRMFKDLQK

SEQ ID NO: 687915 - protein, 9 aa, Homo Sapiens
EDIHYPGKK

SEQ ID NO: 687916 - protein, 9 aa, Homo Sapiens
SWGEEWSMG

SEQ ID NO: 687917 - protein, 9 aa, Homo Sapiens
SEFHTSAAY

SEQ ID NO: 687918 - protein, 9 aa, Homo Sapiens
EKQTPESLR

SEQ ID NO: 687919 - protein, 9 aa, Homo Sapiens
GSWLSKQLV

SEQ ID NO: 687920 - protein, 9 aa, Homo Sapiens
VSPREALTE

SEQ ID NO: 687921 - protein, 9 aa, Homo Sapiens
QSSRAHIKD

SEQ ID NO: 687922 - protein, 9 aa, Homo Sapiens
IDKRIPSMA

SEQ ID NO: 687923 - protein, 9 aa, Homo Sapiens
PSASTELHN

SEQ ID NO: 687924 - protein, 9 aa, Homo Sapiens
FTTIQILFV

SEQ ID NO: 687925 - protein, 9 aa, Homo Sapiens
DLVLKCRKG

SEQ ID NO: 687926 - protein, 9 aa, Homo Sapiens
LQKIESGEM

SEQ ID NO: 687927 - protein, 9 aa, Homo Sapiens
SSQDKEGSF

SEQ ID NO: 687928 - protein, 9 aa, Homo Sapiens
MSGNGREIG

SEQ ID NO: 687929 - protein, 9 aa, Homo Sapiens
ILQTRGAVS

SEQ ID NO: 687930 - protein, 9 aa, Homo Sapiens
YNQLLSQVD

SEQ ID NO: 687931 - protein, 9 aa, Homo Sapiens
ECTNLAALS

SEQ ID NO: 687932 - protein, 9 aa, Homo Sapiens
EAAEDADTN

SEQ ID NO: 687933 - protein, 9 aa, Homo Sapiens
FFTFGNLNV

SEQ ID NO: 687934 - protein, 9 aa, Homo Sapiens
SCLGIFEWL

SEQ ID NO: 687935 - protein, 9 aa, Homo Sapiens
AQERSWPQG

SEQ ID NO: 687936 - protein, 9 aa, Homo Sapiens
DKDLQASCL

SEQ ID NO: 687937 - protein, 9 aa, Homo Sapiens
IFDVVNKGG

SEQ ID NO: 687938 - protein, 9 aa, Homo Sapiens
GLLLVGASM

SEQ ID NO: 687939 - protein, 9 aa, Homo Sapiens
SLSFRISEL

SEQ ID NO: 687940 - protein, 9 aa, Homo Sapiens
KPLENKFVR

SEQ ID NO: 687941 - protein, 9 aa, Homo Sapiens
PLPPGTTEP

SEQ ID NO: 687942 - protein, 9 aa, Homo Sapiens
SNFLVAIIC

SEQ ID NO: 687943 - protein, 9 aa, Homo Sapiens
LLLVVLTAL

SEQ ID NO: 687944 - protein, 9 aa, Homo Sapiens
SGTGPAPEL

SEQ ID NO: 687945 - protein, 9 aa, Homo Sapiens
MEMYAIYQE

SEQ ID NO: 687946 - protein, 9 aa, Homo Sapiens
KRNIKRYNS

SEQ ID NO: 687947 - protein, 9 aa, Homo Sapiens
KDKHCWVGE

SEQ ID NO: 687948 - protein, 9 aa, Homo Sapiens
MITTLKKIP

SEQ ID NO: 687949 - protein, 9 aa, Homo Sapiens
QEDILRQHI

SEQ ID NO: 687950 - protein, 9 aa, Homo Sapiens
RPHKELDRN

SEQ ID NO: 687951 - protein, 9 aa, Homo Sapiens
GKIPSEMPC

SEQ ID NO: 687952 - protein, 9 aa, Homo Sapiens
LDYPSTEPH

SEQ ID NO: 687953 - protein, 9 aa, Homo Sapiens
MPRGKKVAG

SEQ ID NO: 687954 - protein, 9 aa, Homo Sapiens
ERMVVARLA

SEQ ID NO: 687955 - protein, 9 aa, Homo Sapiens
PQGSRQILT

SEQ ID NO: 687956 - protein, 9 aa, Homo Sapiens
SIGAGSNTP

SEQ ID NO: 687957 - protein, 9 aa, Homo Sapiens
TITLSKISC

SEQ ID NO: 687958 - protein, 9 aa, Homo Sapiens
YANKMALRY

SEQ ID NO: 687959 - protein, 9 aa, Homo Sapiens
LSTDLEPGT

SEQ ID NO: 687960 - protein, 9 aa, Homo Sapiens
DSLTGSSAY

SEQ ID NO: 687961 - protein, 9 aa, Homo Sapiens
IQNRNIQTN

SEQ ID NO: 687962 - protein, 9 aa, Homo Sapiens
SRHRIQSKQ

SEQ ID NO: 687963 - protein, 9 aa, Homo Sapiens
ERKSNGPNT

SEQ ID NO: 687964 - protein, 9 aa, Homo Sapiens
ELDLCDPSL

SEQ ID NO: 687965 - protein, 9 aa, Homo Sapiens
WISCRCHEL

SEQ ID NO: 687966 - protein, 9 aa, Homo Sapiens
PVPIERVKK

SEQ ID NO: 687967 - protein, 9 aa, Homo Sapiens
TSSWPRLQH

SEQ ID NO: 687968 - protein, 9 aa, Homo Sapiens
RSCTNGCKA

SEQ ID NO: 687969 - protein, 9 aa, Homo Sapiens
FGNLNVGYH

SEQ ID NO: 687970 - protein, 9 aa, Homo Sapiens
RFCYGQCHS

SEQ ID NO: 687971 - protein, 9 aa, Homo Sapiens
LTDSNLKLP

SEQ ID NO: 687972 - protein, 9 aa, Homo Sapiens
MAAAVRRTL

SEQ ID NO: 687973 - protein, 9 aa, Homo Sapiens
TLPQAAMLS

SEQ ID NO: 687974 - protein, 9 aa, Homo Sapiens
ALQRHLPFL

SEQ ID NO: 687975 - protein, 9 aa, Homo Sapiens
QESYNSQSS

SEQ ID NO: 687976 - protein, 9 aa, Homo Sapiens
KVNSQKPGL

SEQ ID NO: 687977 - protein, 9 aa, Homo Sapiens
AARDSNITL

SEQ ID NO: 687978 - protein, 9 aa, Homo Sapiens
AALSSMPSP

SEQ ID NO: 687979 - protein, 9 aa, Homo Sapiens
YHSIRRPDV

SEQ ID NO: 687980 - protein, 9 aa, Homo Sapiens
GNLNVGYHR

SEQ ID NO: 687981 - protein, 9 aa, Homo Sapiens
QYRLGITKV

SEQ ID NO: 687982 - protein, 9 aa, Homo Sapiens
QSLGQNWSW

SEQ ID NO: 687983 - protein, 9 aa, Homo Sapiens
SHSQERISP

SEQ ID NO: 687984 - protein, 9 aa, Homo Sapiens
SASRNDHGS

SEQ ID NO: 687985 - protein, 9 aa, Homo Sapiens
QNHFKDSGV

SEQ ID NO: 687986 - protein, 9 aa, Homo Sapiens
TEPRPDSIR

SEQ ID NO: 687987 - protein, 9 aa, Homo Sapiens
TEESKAVYS

SEQ ID NO: 687988 - protein, 9 aa, Homo Sapiens
FVLEEHIGP

SEQ ID NO: 687989 - protein, 9 aa, Homo Sapiens
PEATSGLME

SEQ ID NO: 687990 - protein, 9 aa, Homo Sapiens
SYYEYLFKA

SEQ ID NO: 687991 - protein, 9 aa, Homo Sapiens
RQRHLDNSE

SEQ ID NO: 687992 - protein, 9 aa, Homo Sapiens
GGSAITAFK

SEQ ID NO: 687993 - protein, 9 aa, Homo Sapiens
PAVGPYESR

SEQ ID NO: 687994 - protein, 9 aa, Homo Sapiens
SNVQKKRVS

SEQ ID NO: 687995 - protein, 9 aa, Homo Sapiens
YLRYKAIYE

SEQ ID NO: 687996 - protein, 9 aa, Homo Sapiens
PLEDFSRAW

SEQ ID NO: 687997 - protein, 9 aa, Homo Sapiens
RLLLGLAPG

SEQ ID NO: 687998 - protein, 9 aa, Homo Sapiens
ESLQLQTFS

SEQ ID NO: 687999 - protein, 9 aa, Homo Sapiens
VATATPSTF

SEQ ID NO: 688000 - protein, 9 aa, Homo Sapiens
DADFQGTKQ

SEQ ID NO: 688001 - protein, 9 aa, Homo Sapiens
HIIRKNVEN

SEQ ID NO: 688002 - protein, 9 aa, Homo Sapiens
YLMGFYSGI

SEQ ID NO: 688003 - protein, 9 aa, Homo Sapiens
RKAASMRER

SEQ ID NO: 688004 - protein, 9 aa, Homo Sapiens
CLRPLGDPS

SEQ ID NO: 688005 - protein, 9 aa, Homo Sapiens
AVYKCKNEG

SEQ ID NO: 688006 - protein, 9 aa, Homo Sapiens
PPTEGGAHI

SEQ ID NO: 688007 - protein, 9 aa, Homo Sapiens
RTPGGVFVN

SEQ ID NO: 688008 - protein, 9 aa, Homo Sapiens
CTKDKTPSV

SEQ ID NO: 688009 - protein, 9 aa, Homo Sapiens
GNNEDRLLL

SEQ ID NO: 688010 - protein, 9 aa, Homo Sapiens
GGFQTGTSF

SEQ ID NO: 688011 - protein, 9 aa, Homo Sapiens
AFSMVKEDF

SEQ ID NO: 688012 - protein, 9 aa, Homo Sapiens
PLSWVFKNF

SEQ ID NO: 688013 - protein, 9 aa, Homo Sapiens
GGHINPSIT

SEQ ID NO: 688014 - protein, 9 aa, Homo Sapiens
SKADKSKKV

SEQ ID NO: 688015 - protein, 9 aa, Homo Sapiens
LREQNELDL

SEQ ID NO: 688016 - protein, 9 aa, Homo Sapiens
ETALTFLVE

SEQ ID NO: 688017 - protein, 9 aa, Homo Sapiens
GGCREHFKN

SEQ ID NO: 688018 - protein, 9 aa, Homo Sapiens
LLQYHCDCQ

SEQ ID NO: 688019 - protein, 9 aa, Homo Sapiens
GLSLRTEQS

SEQ ID NO: 688020 - protein, 9 aa, Homo Sapiens
VHDAMLFAL

SEQ ID NO: 688021 - protein, 9 aa, Homo Sapiens
RRDYHSIRR

SEQ ID NO: 688022 - protein, 9 aa, Homo Sapiens
VKYNQQNDN

SEQ ID NO: 688023 - protein, 9 aa, Homo Sapiens
HVWLQKWYG

SEQ ID NO: 688024 - protein, 9 aa, Homo Sapiens
FIRSSVHHC

SEQ ID NO: 688025 - protein, 9 aa, Homo Sapiens
HRTSSEQAH

SEQ ID NO: 688026 - protein, 9 aa, Homo Sapiens
CQVLHEDID

SEQ ID NO: 688027 - protein, 9 aa, Homo Sapiens
YILSMQKFG

SEQ ID NO: 688028 - protein, 9 aa, Homo Sapiens
LYQKCAMKT

SEQ ID NO: 688029 - protein, 9 aa, Homo Sapiens
KIAAESSKN

SEQ ID NO: 688030 - protein, 9 aa, Homo Sapiens
SPSAAFPSD

SEQ ID NO: 688031 - protein, 9 aa, Homo Sapiens
CREHFKNHW

SEQ ID NO: 688032 - protein, 9 aa, Homo Sapiens
HRRGPGQKT

SEQ ID NO: 688033 - protein, 9 aa, Homo Sapiens
KSRLRESKV

SEQ ID NO: 688034 - protein, 9 aa, Homo Sapiens
PSLPKKPIT

SEQ ID NO: 688035 - protein, 9 aa, Homo Sapiens
DTCGRHHSQ

SEQ ID NO: 688036 - protein, 9 aa, Homo Sapiens
PAMQQLLAA

SEQ ID NO: 688037 - protein, 9 aa, Homo Sapiens
HTMNAMITN

SEQ ID NO: 688038 - protein, 9 aa, Homo Sapiens
NPHVSSIIQ

SEQ ID NO: 688039 - protein, 9 aa, Homo Sapiens
CRVGKKIME

SEQ ID NO: 688040 - protein, 9 aa, Homo Sapiens
TLTLWSSEA

SEQ ID NO: 688041 - protein, 9 aa, Homo Sapiens
EEVVSTGLD

SEQ ID NO: 688042 - protein, 9 aa, Homo Sapiens
DTLRDCDQQ

SEQ ID NO: 688043 - protein, 9 aa, Homo Sapiens
TEVFQTASE

SEQ ID NO: 688044 - protein, 9 aa, Homo Sapiens
FRAILSKVP

SEQ ID NO: 688045 - protein, 9 aa, Homo Sapiens
EILKRNIKR

SEQ ID NO: 688046 - protein, 9 aa, Homo Sapiens
YLRCFNWHS

SEQ ID NO: 688047 - protein, 9 aa, Homo Sapiens
TWPEEFDHY

SEQ ID NO: 688048 - protein, 9 aa, Homo Sapiens
SQGGGRKPF

SEQ ID NO: 688049 - protein, 9 aa, Homo Sapiens
QAQQDRDDM

SEQ ID NO: 688050 - protein, 9 aa, Homo Sapiens
GRPTPETLH

SEQ ID NO: 688051 - protein, 9 aa, Homo Sapiens
KYVMGHLRW

SEQ ID NO: 688052 - protein, 9 aa, Homo Sapiens
IKYPLTLKP

SEQ ID NO: 688053 - protein, 9 aa, Homo Sapiens
GSLRDEVIY

SEQ ID NO: 688054 - protein, 9 aa, Homo Sapiens
IWEQEDLNR

SEQ ID NO: 688055 - protein, 9 aa, Homo Sapiens
SYQDDKNRQ

SEQ ID NO: 688056 - protein, 9 aa, Homo Sapiens
QQLAAPECK

SEQ ID NO: 688057 - protein, 9 aa, Homo Sapiens
ADTPTACSF

SEQ ID NO: 688058 - protein, 9 aa, Homo Sapiens
TSSSFSSSS

SEQ ID NO: 688059 - protein, 9 aa, Homo Sapiens
KLEKIGNQE

SEQ ID NO: 688060 - protein, 9 aa, Homo Sapiens
DGLHLGSGR

SEQ ID NO: 688061 - protein, 9 aa, Homo Sapiens
YLYANKMAL

SEQ ID NO: 688062 - protein, 9 aa, Homo Sapiens
YIGKTPKIQ

SEQ ID NO: 688063 - protein, 9 aa, Homo Sapiens
HIKKVSQQI

SEQ ID NO: 688064 - protein, 9 aa, Homo Sapiens
DVFEHLLAK

SEQ ID NO: 688065 - protein, 9 aa, Homo Sapiens
PMLFERHLC

SEQ ID NO: 688066 - protein, 9 aa, Homo Sapiens
EILREFFKW

SEQ ID NO: 688067 - protein, 9 aa, Homo Sapiens
LSRIVDELY

SEQ ID NO: 688068 - protein, 9 aa, Homo Sapiens
HYWTSINHF

SEQ ID NO: 688069 - protein, 9 aa, Homo Sapiens
KPVTNQVQC

SEQ ID NO: 688070 - protein, 9 aa, Homo Sapiens
YSTASSHFG

SEQ ID NO: 688071 - protein, 9 aa, Homo Sapiens
MERVQTMMG

SEQ ID NO: 688072 - protein, 9 aa, Homo Sapiens
QKCQVLHED

SEQ ID NO: 688073 - protein, 9 aa, Homo Sapiens
ELGSWLSKQ

SEQ ID NO: 688074 - protein, 9 aa, Homo Sapiens
NSNRYETLK

SEQ ID NO: 688075 - protein, 9 aa, Homo Sapiens
ADTEADTVL

SEQ ID NO: 688076 - protein, 9 aa, Homo Sapiens
LLDDGSNCF

SEQ ID NO: 688077 - protein, 9 aa, Homo Sapiens
EARAQRERA

SEQ ID NO: 688078 - protein, 9 aa, Homo Sapiens
LQTTQSVQG

SEQ ID NO: 688079 - protein, 9 aa, Homo Sapiens
NLNVGYHRW

SEQ ID NO: 688080 - protein, 9 aa, Homo Sapiens
QFTVCARGD

SEQ ID NO: 688081 - protein, 9 aa, Homo Sapiens
QKVEMELPV

SEQ ID NO: 688082 - protein, 9 aa, Homo Sapiens
EPMKRPDSE

SEQ ID NO: 688083 - protein, 9 aa, Homo Sapiens
KPRAHLPDC

SEQ ID NO: 688084 - protein, 9 aa, Homo Sapiens
ENSTLPQAA

SEQ ID NO: 688085 - protein, 9 aa, Homo Sapiens
ASGEAVSKT

SEQ ID NO: 688086 - protein, 9 aa, Homo Sapiens
KQVLTTGGG

SEQ ID NO: 688087 - protein, 9 aa, Homo Sapiens
AVLHLKQVL

SEQ ID NO: 688088 - protein, 9 aa, Homo Sapiens
EMELPVDKI

SEQ ID NO: 688089 - protein, 9 aa, Homo Sapiens
PLYISDVAM

SEQ ID NO: 688090 - protein, 9 aa, Homo Sapiens
RFPKFKRHY

SEQ ID NO: 688091 - protein, 9 aa, Homo Sapiens
IAGTSTSVM

SEQ ID NO: 688092 - protein, 9 aa, Homo Sapiens
LYGYVTMLN

SEQ ID NO: 688093 - protein, 9 aa, Homo Sapiens
SCAFTPTTP

SEQ ID NO: 688094 - protein, 9 aa, Homo Sapiens
NSLAASFHQ

SEQ ID NO: 688095 - protein, 9 aa, Homo Sapiens
IAQSSHYQQ

SEQ ID NO: 688096 - protein, 9 aa, Homo Sapiens
GRARAPMSN

SEQ ID NO: 688097 - protein, 9 aa, Homo Sapiens
LLVVLTALM

SEQ ID NO: 688098 - protein, 9 aa, Homo Sapiens
REVVVEGPS

SEQ ID NO: 688099 - protein, 9 aa, Homo Sapiens
PGREDSRAG

SEQ ID NO: 688100 - protein, 9 aa, Homo Sapiens
LTKQTPKKP

SEQ ID NO: 688101 - protein, 9 aa, Homo Sapiens
TASLDSSRS

SEQ ID NO: 688102 - protein, 9 aa, Homo Sapiens
NFLYIIGSY

SEQ ID NO: 688103 - protein, 9 aa, Homo Sapiens
WSALFSEYS

SEQ ID NO: 688104 - protein, 9 aa, Homo Sapiens
SNQQFRYLK

SEQ ID NO: 688105 - protein, 9 aa, Homo Sapiens
KLSDALAVQ

SEQ ID NO: 688106 - protein, 9 aa, Homo Sapiens
LLQELPDRR

SEQ ID NO: 688107 - protein, 9 aa, Homo Sapiens
FYGLTYSYD

SEQ ID NO: 688108 - protein, 9 aa, Homo Sapiens
NACAAAKKK

SEQ ID NO: 688109 - protein, 9 aa, Homo Sapiens
WTIWSRARV

SEQ ID NO: 688110 - protein, 9 aa, Homo Sapiens
YEIQGVIKF

SEQ ID NO: 688111 - protein, 9 aa, Homo Sapiens
LSSLREQNE

SEQ ID NO: 688112 - protein, 9 aa, Homo Sapiens
LGRLKTSET

SEQ ID NO: 688113 - protein, 9 aa, Homo Sapiens
IGLAFLVLV

SEQ ID NO: 688114 - protein, 9 aa, Homo Sapiens
DHDSLKLLQ

SEQ ID NO: 688115 - protein, 9 aa, Homo Sapiens
VHEELHKKQ

SEQ ID NO: 688116 - protein, 9 aa, Homo Sapiens
KATLFGSPE

SEQ ID NO: 688117 - protein, 9 aa, Homo Sapiens
KAVRKGPNQ

SEQ ID NO: 688118 - protein, 9 aa, Homo Sapiens
NIKRYNSFI

SEQ ID NO: 688119 - protein, 9 aa, Homo Sapiens
ENARMFTSV

SEQ ID NO: 688120 - protein, 9 aa, Homo Sapiens
VASKADKSK

SEQ ID NO: 688121 - protein, 9 aa, Homo Sapiens
HIFALVKYN

SEQ ID NO: 688122 - protein, 9 aa, Homo Sapiens
MTVRDLMRS

SEQ ID NO: 688123 - protein, 9 aa, Homo Sapiens
EGLCTKDKT

SEQ ID NO: 688124 - protein, 9 aa, Homo Sapiens
NCSGIQCNV

SEQ ID NO: 688125 - protein, 9 aa, Homo Sapiens
CPRDRVDFR

SEQ ID NO: 688126 - protein, 9 aa, Homo Sapiens
SNLIQLTGH

SEQ ID NO: 688127 - protein, 9 aa, Homo Sapiens
ESYNSQSSV

SEQ ID NO: 688128 - protein, 9 aa, Homo Sapiens
AVRFYFLCT

SEQ ID NO: 688129 - protein, 9 aa, Homo Sapiens
ERVQTMMGL

SEQ ID NO: 688130 - protein, 9 aa, Homo Sapiens
CVGRLKFWV

SEQ ID NO: 688131 - protein, 9 aa, Homo Sapiens
ETTSVAVFV

SEQ ID NO: 688132 - protein, 9 aa, Homo Sapiens
KFERKLMLE

SEQ ID NO: 688133 - protein, 9 aa, Homo Sapiens
WDNFIGGVD

SEQ ID NO: 688134 - protein, 9 aa, Homo Sapiens
WAETGHTDD

SEQ ID NO: 688135 - protein, 9 aa, Homo Sapiens
YECETSKAF

SEQ ID NO: 688136 - protein, 9 aa, Homo Sapiens
ISAPSCIWR

SEQ ID NO: 688137 - protein, 9 aa, Homo Sapiens
LDNSEEPPE

SEQ ID NO: 688138 - protein, 9 aa, Homo Sapiens
KQTPESLRQ

SEQ ID NO: 688139 - protein, 9 aa, Homo Sapiens
IHVQTSLRE

SEQ ID NO: 688140 - protein, 9 aa, Homo Sapiens
DPSIPISKK

SEQ ID NO: 688141 - protein, 9 aa, Homo Sapiens
KPFPVTREQ

SEQ ID NO: 688142 - protein, 9 aa, Homo Sapiens
SKEDLKFDL

SEQ ID NO: 688143 - protein, 9 aa, Homo Sapiens
FCYGQCHSF

SEQ ID NO: 688144 - protein, 9 aa, Homo Sapiens
ISIYLNNVL

SEQ ID NO: 688145 - protein, 9 aa, Homo Sapiens
LPDVGGGYF

SEQ ID NO: 688146 - protein, 9 aa, Homo Sapiens
SIKDSSMGR

SEQ ID NO: 688147 - protein, 9 aa, Homo Sapiens
LTYIVWKIG

SEQ ID NO: 688148 - protein, 9 aa, Homo Sapiens
QNSLAASFH

SEQ ID NO: 688149 - protein, 9 aa, Homo Sapiens
NQQLAAPEC

SEQ ID NO: 688150 - protein, 9 aa, Homo Sapiens
GQKGEPGLL

SEQ ID NO: 688151 - protein, 9 aa, Homo Sapiens
FQGTKQACR

SEQ ID NO: 688152 - protein, 9 aa, Homo Sapiens
DQTQDTELM

SEQ ID NO: 688153 - protein, 9 aa, Homo Sapiens
ILREFFKWA

SEQ ID NO: 688154 - protein, 9 aa, Homo Sapiens
LEKRLESII

SEQ ID NO: 688155 - protein, 9 aa, Homo Sapiens
NRSQPISCK

SEQ ID NO: 688156 - protein, 9 aa, Homo Sapiens
PCKGDRNVI

SEQ ID NO: 688157 - protein, 9 aa, Homo Sapiens
TGSRGPVGG

SEQ ID NO: 688158 - protein, 9 aa, Homo Sapiens
TFYADQMFL

SEQ ID NO: 688159 - protein, 9 aa, Homo Sapiens
FRVGLVLPL

SEQ ID NO: 688160 - protein, 9 aa, Homo Sapiens
VFAPSGEHT

SEQ ID NO: 688161 - protein, 9 aa, Homo Sapiens
QPPPEEEDD

SEQ ID NO: 688162 - protein, 9 aa, Homo Sapiens
TLLMEAAEN

SEQ ID NO: 688163 - protein, 9 aa, Homo Sapiens
GLAPGQPFS

SEQ ID NO: 688164 - protein, 9 aa, Homo Sapiens
IGYDVGLTS

SEQ ID NO: 688165 - protein, 9 aa, Homo Sapiens
KEETSPQCQ

SEQ ID NO: 688166 - protein, 9 aa, Homo Sapiens
VVVQSVGTY

SEQ ID NO: 688167 - protein, 9 aa, Homo Sapiens
LPLYISDVA

SEQ ID NO: 688168 - protein, 9 aa, Homo Sapiens
SAACVNVLQ

SEQ ID NO: 688169 - protein, 9 aa, Homo Sapiens
VCIHISNDY

SEQ ID NO: 688170 - protein, 9 aa, Homo Sapiens
PAKQSEEGP

SEQ ID NO: 688171 - protein, 9 aa, Homo Sapiens
YDKEPCCLP

SEQ ID NO: 688172 - protein, 9 aa, Homo Sapiens
PGTGAMTAG

SEQ ID NO: 688173 - protein, 9 aa, Homo Sapiens
KENKILKES

SEQ ID NO: 688174 - protein, 9 aa, Homo Sapiens
TEGPNSSLR

SEQ ID NO: 688175 - protein, 9 aa, Homo Sapiens
TIVMKAQTE

SEQ ID NO: 688176 - protein, 9 aa, Homo Sapiens
VPSVTNPFQ

SEQ ID NO: 688177 - protein, 9 aa, Homo Sapiens
VSLPSYLES

SEQ ID NO: 688178 - protein, 9 aa, Homo Sapiens
EDTGIISNT

SEQ ID NO: 688179 - protein, 9 aa, Homo Sapiens
EPQRFARIL

SEQ ID NO: 688180 - protein, 9 aa, Homo Sapiens
LQCFYEWQS

SEQ ID NO: 688181 - protein, 9 aa, Homo Sapiens
SLPPGCLQP

SEQ ID NO: 688182 - protein, 9 aa, Homo Sapiens
YYEYLFKAY

SEQ ID NO: 688183 - protein, 9 aa, Homo Sapiens
TNNNKSIGC

SEQ ID NO: 688184 - protein, 9 aa, Homo Sapiens
SHLDEKPYQ

SEQ ID NO: 688185 - protein, 9 aa, Homo Sapiens
YEVGVVQDD

SEQ ID NO: 688186 - protein, 9 aa, Homo Sapiens
TDNSSFDKD

SEQ ID NO: 688187 - protein, 9 aa, Homo Sapiens
VKISYVMIA

SEQ ID NO: 688188 - protein, 9 aa, Homo Sapiens
ARRFMKLDA

SEQ ID NO: 688189 - protein, 9 aa, Homo Sapiens
ENKSISYYV

SEQ ID NO: 688190 - protein, 9 aa, Homo Sapiens
QCHPYLTQE

SEQ ID NO: 688191 - protein, 9 aa, Homo Sapiens
IRGIYSSSV

SEQ ID NO: 688192 - protein, 9 aa, Homo Sapiens
IRVTSHNRS

SEQ ID NO: 688193 - protein, 9 aa, Homo Sapiens
FFEAQGARP

SEQ ID NO: 688194 - protein, 9 aa, Homo Sapiens
KKKRLHLAE

SEQ ID NO: 688195 - protein, 9 aa, Homo Sapiens
GIFESCVCK

SEQ ID NO: 688196 - protein, 9 aa, Homo Sapiens
AESSKNVDC

SEQ ID NO: 688197 - protein, 9 aa, Homo Sapiens
KMRVKISYV

SEQ ID NO: 688198 - protein, 9 aa, Homo Sapiens
YHTPDQDKA

SEQ ID NO: 688199 - protein, 9 aa, Homo Sapiens
RQYDDIIQQ

SEQ ID NO: 688200 - protein, 9 aa, Homo Sapiens
PSAKCLGIE

SEQ ID NO: 688201 - protein, 9 aa, Homo Sapiens
NLVNALRQD

SEQ ID NO: 688202 - protein, 9 aa, Homo Sapiens
HELFFTFGN

SEQ ID NO: 688203 - protein, 9 aa, Homo Sapiens
IGEIFQLMQ

SEQ ID NO: 688204 - protein, 9 aa, Homo Sapiens
LVEGVTCMS

SEQ ID NO: 688205 - protein, 9 aa, Homo Sapiens
KEKDVKKDT

SEQ ID NO: 688206 - protein, 9 aa, Homo Sapiens
TNQNPNNFQ

SEQ ID NO: 688207 - protein, 9 aa, Homo Sapiens
RDPFWNTMK

SEQ ID NO: 688208 - protein, 9 aa, Homo Sapiens
KSNGPNTTA

SEQ ID NO: 688209 - protein, 9 aa, Homo Sapiens
SGSASRNDH

SEQ ID NO: 688210 - protein, 9 aa, Homo Sapiens
DDKEKDVKK

SEQ ID NO: 688211 - protein, 9 aa, Homo Sapiens
TVISVKMLL

SEQ ID NO: 688212 - protein, 9 aa, Homo Sapiens
SLGEDIHYP

SEQ ID NO: 688213 - protein, 9 aa, Homo Sapiens
GPGVAGYLI

SEQ ID NO: 688214 - protein, 9 aa, Homo Sapiens
HGGGGWGGG

SEQ ID NO: 688215 - protein, 9 aa, Homo Sapiens
LHTPMCFFL

SEQ ID NO: 688216 - protein, 9 aa, Homo Sapiens
DYTGRDSER

SEQ ID NO: 688217 - protein, 9 aa, Homo Sapiens
WKMAAVFLT

SEQ ID NO: 688218 - protein, 9 aa, Homo Sapiens
GWHVYNDSC

SEQ ID NO: 688219 - protein, 9 aa, Homo Sapiens
VSRELLAWR

SEQ ID NO: 688220 - protein, 9 aa, Homo Sapiens
SIFSAILDE

SEQ ID NO: 688221 - protein, 9 aa, Homo Sapiens
PDSIRQQQE

SEQ ID NO: 688222 - protein, 9 aa, Homo Sapiens
DAMLFALSR

SEQ ID NO: 688223 - protein, 9 aa, Homo Sapiens
RDATRLFFN

SEQ ID NO: 688224 - protein, 9 aa, Homo Sapiens
QCFYEWQSS

SEQ ID NO: 688225 - protein, 9 aa, Homo Sapiens
AAPDIGVFR

SEQ ID NO: 688226 - protein, 9 aa, Homo Sapiens
HELGFQKYY

SEQ ID NO: 688227 - protein, 9 aa, Homo Sapiens
VLQISLIEN

SEQ ID NO: 688228 - protein, 9 aa, Homo Sapiens
FPGGRGKQD

SEQ ID NO: 688229 - protein, 9 aa, Homo Sapiens
VDDPISLLY

SEQ ID NO: 688230 - protein, 9 aa, Homo Sapiens
DIQIIFINI

SEQ ID NO: 688231 - protein, 9 aa, Homo Sapiens
VLKCRKGDE

SEQ ID NO: 688232 - protein, 9 aa, Homo Sapiens
LQDCMAVKT

SEQ ID NO: 688233 - protein, 9 aa, Homo Sapiens
LHLKRQPKQ

SEQ ID NO: 688234 - protein, 9 aa, Homo Sapiens
QKASNKKKF

SEQ ID NO: 688235 - protein, 9 aa, Homo Sapiens
LFHFCGSCL

SEQ ID NO: 688236 - protein, 9 aa, Homo Sapiens
RRVSRCTPT

SEQ ID NO: 688237 - protein, 9 aa, Homo Sapiens
KPQDPAAVS

SEQ ID NO: 688238 - protein, 9 aa, Homo Sapiens
SGEPQRFAR

SEQ ID NO: 688239 - protein, 9 aa, Homo Sapiens
KRQPKQRWL

SEQ ID NO: 688240 - protein, 9 aa, Homo Sapiens
SVAYNNVVG

SEQ ID NO: 688241 - protein, 9 aa, Homo Sapiens
QTKLVLSTD

SEQ ID NO: 688242 - protein, 9 aa, Homo Sapiens
TDDEFESET

SEQ ID NO: 688243 - protein, 9 aa, Homo Sapiens
GYDVGLTSY

SEQ ID NO: 688244 - protein, 9 aa, Homo Sapiens
FIGGVDMVT

SEQ ID NO: 688245 - protein, 9 aa, Homo Sapiens
KCSTSLHVD

SEQ ID NO: 688246 - protein, 9 aa, Homo Sapiens
FLTYVEHYQ

SEQ ID NO: 688247 - protein, 9 aa, Homo Sapiens
SSHYQQRFA

SEQ ID NO: 688248 - protein, 9 aa, Homo Sapiens
IMDVLPASA

SEQ ID NO: 688249 - protein, 9 aa, Homo Sapiens
NKERLSTAV

SEQ ID NO: 688250 - protein, 9 aa, Homo Sapiens
NTTYLYTLG

SEQ ID NO: 688251 - protein, 9 aa, Homo Sapiens
NEIGHTPLD

SEQ ID NO: 688252 - protein, 9 aa, Homo Sapiens
NPSITLALL

SEQ ID NO: 688253 - protein, 9 aa, Homo Sapiens
KLDTVQKPY

SEQ ID NO: 688254 - protein, 9 aa, Homo Sapiens
RNIQTNNNK

SEQ ID NO: 688255 - protein, 9 aa, Homo Sapiens
SNYCNCSGI

SEQ ID NO: 688256 - protein, 9 aa, Homo Sapiens
VSTGLDSPG

SEQ ID NO: 688257 - protein, 9 aa, Homo Sapiens
AINDPLRYS

SEQ ID NO: 688258 - protein, 9 aa, Homo Sapiens
PAAASARRR

SEQ ID NO: 688259 - protein, 9 aa, Homo Sapiens
ADREEVEQQ

SEQ ID NO: 688260 - protein, 9 aa, Homo Sapiens
DPIHEFIAL

SEQ ID NO: 688261 - protein, 9 aa, Homo Sapiens
LSQMSQERG

SEQ ID NO: 688262 - protein, 9 aa, Homo Sapiens
VLNPFINTL

SEQ ID NO: 688263 - protein, 9 aa, Homo Sapiens
MEAYNIDDT

SEQ ID NO: 688264 - protein, 9 aa, Homo Sapiens
PQTSPFQEH

SEQ ID NO: 688265 - protein, 9 aa, Homo Sapiens
SGVRCKDID

SEQ ID NO: 688266 - protein, 9 aa, Homo Sapiens
TGIISNTRF

SEQ ID NO: 688267 - protein, 9 aa, Homo Sapiens
MSSYFREQG

SEQ ID NO: 688268 - protein, 9 aa, Homo Sapiens
VKWDQYWPA

SEQ ID NO: 688269 - protein, 9 aa, Homo Sapiens
PNRPRTVCR

SEQ ID NO: 688270 - protein, 9 aa, Homo Sapiens
TLSKISCTD

SEQ ID NO: 688271 - protein, 9 aa, Homo Sapiens
SISTFLGTV

SEQ ID NO: 688272 - protein, 9 aa, Homo Sapiens
DYHSIRRPD

SEQ ID NO: 688273 - protein, 9 aa, Homo Sapiens
SVGPPGPPC

SEQ ID NO: 688274 - protein, 9 aa, Homo Sapiens
KCYRVTKGR

SEQ ID NO: 688275 - protein, 9 aa, Homo Sapiens
FKKPMLFER

SEQ ID NO: 688276 - protein, 9 aa, Homo Sapiens
SFRISELQK

SEQ ID NO: 688277 - protein, 9 aa, Homo Sapiens
KDKEDQWVE

SEQ ID NO: 688278 - protein, 9 aa, Homo Sapiens
QLTGHSFST

SEQ ID NO: 688279 - protein, 9 aa, Homo Sapiens
QAFANLQEA

SEQ ID NO: 688280 - protein, 9 aa, Homo Sapiens
RARGCKRKR

SEQ ID NO: 688281 - protein, 9 aa, Homo Sapiens
KSHFTCNHR

SEQ ID NO: 688282 - protein, 9 aa, Homo Sapiens
KQESYNSQS

SEQ ID NO: 688283 - protein, 9 aa, Homo Sapiens
LKQLDDKEV

SEQ ID NO: 688284 - protein, 9 aa, Homo Sapiens
IPFLYSLRL

SEQ ID NO: 688285 - protein, 9 aa, Homo Sapiens
ESLRQNNNP

SEQ ID NO: 688286 - protein, 9 aa, Homo Sapiens
QTITEANEN

SEQ ID NO: 688287 - protein, 9 aa, Homo Sapiens
HYSFSTNSP

SEQ ID NO: 688288 - protein, 9 aa, Homo Sapiens
MQTLEGTAV

SEQ ID NO: 688289 - protein, 9 aa, Homo Sapiens
RAILSKVPV

SEQ ID NO: 688290 - protein, 9 aa, Homo Sapiens
QTVMSEVSG

SEQ ID NO: 688291 - protein, 9 aa, Homo Sapiens
SETCRPPLK

SEQ ID NO: 688292 - protein, 9 aa, Homo Sapiens
CDPPRHNQG

SEQ ID NO: 688293 - protein, 9 aa, Homo Sapiens
AQNLLRIGL

SEQ ID NO: 688294 - protein, 9 aa, Homo Sapiens
GRHHAQLLK

SEQ ID NO: 688295 - protein, 9 aa, Homo Sapiens
MSSKSQKRI

SEQ ID NO: 688296 - protein, 9 aa, Homo Sapiens
KKIPRFKVS

SEQ ID NO: 688297 - protein, 9 aa, Homo Sapiens
MNPRMRKLQ

SEQ ID NO: 688298 - protein, 9 aa, Homo Sapiens
RPHFKLHPH

SEQ ID NO: 688299 - protein, 9 aa, Homo Sapiens
HEIEIQGLL

SEQ ID NO: 688300 - protein, 9 aa, Homo Sapiens
IHTMNAMIT

SEQ ID NO: 688301 - protein, 9 aa, Homo Sapiens
WMDLPHTEG

SEQ ID NO: 688302 - protein, 9 aa, Homo Sapiens
REQNELDLM

SEQ ID NO: 688303 - protein, 9 aa, Homo Sapiens
DLNANFLDH

SEQ ID NO: 688304 - protein, 9 aa, Homo Sapiens
EEADFGDPW

SEQ ID NO: 688305 - protein, 9 aa, Homo Sapiens
HHPFHTDLL

SEQ ID NO: 688306 - protein, 9 aa, Homo Sapiens
VCRHKMDTF

SEQ ID NO: 688307 - protein, 9 aa, Homo Sapiens
KEGRSFSGV

SEQ ID NO: 688308 - protein, 9 aa, Homo Sapiens
RKDLVLKCR

SEQ ID NO: 688309 - protein, 9 aa, Homo Sapiens
AKLNMYKRK

SEQ ID NO: 688310 - protein, 9 aa, Homo Sapiens
FSGSAANEN

SEQ ID NO: 688311 - protein, 9 aa, Homo Sapiens
LRLSVGYTV

SEQ ID NO: 688312 - protein, 9 aa, Homo Sapiens
TLIMMFLAS

SEQ ID NO: 688313 - protein, 9 aa, Homo Sapiens
HSPLHLTKQ

SEQ ID NO: 688314 - protein, 9 aa, Homo Sapiens
MSTLSSSNP

SEQ ID NO: 688315 - protein, 9 aa, Homo Sapiens
VQEAFELMN

SEQ ID NO: 688316 - protein, 9 aa, Homo Sapiens
PGTILTTQQ

SEQ ID NO: 688317 - protein, 9 aa, Homo Sapiens
SAGRPTPET

SEQ ID NO: 688318 - protein, 9 aa, Homo Sapiens
GCQESGLSV

SEQ ID NO: 688319 - protein, 9 aa, Homo Sapiens
EARTLKEEE

SEQ ID NO: 688320 - protein, 9 aa, Homo Sapiens
SFNLSVTSF

SEQ ID NO: 688321 - protein, 9 aa, Homo Sapiens
MPETAIGLL

SEQ ID NO: 688322 - protein, 9 aa, Homo Sapiens
KEEKKGGPA

SEQ ID NO: 688323 - protein, 9 aa, Homo Sapiens
KARQDYSES

SEQ ID NO: 688324 - protein, 9 aa, Homo Sapiens
FKEKLSQKV

SEQ ID NO: 688325 - protein, 9 aa, Homo Sapiens
SEVIYVWTN

SEQ ID NO: 688326 - protein, 9 aa, Homo Sapiens
FKRHYVNST

SEQ ID NO: 688327 - protein, 9 aa, Homo Sapiens
TPKIQQLSN

SEQ ID NO: 688328 - protein, 9 aa, Homo Sapiens
DGHCALEFK

SEQ ID NO: 688329 - protein, 9 aa, Homo Sapiens
LGRADFDDY

SEQ ID NO: 688330 - protein, 9 aa, Homo Sapiens
FRRETDARI

SEQ ID NO: 688331 - protein, 9 aa, Homo Sapiens
IYTVKILRF

SEQ ID NO: 688332 - protein, 9 aa, Homo Sapiens
VWLLSSKPK

SEQ ID NO: 688333 - protein, 9 aa, Homo Sapiens
KRLESIISG

SEQ ID NO: 688334 - protein, 9 aa, Homo Sapiens
KLLPGIFAL

SEQ ID NO: 688335 - protein, 9 aa, Homo Sapiens
SKYEVKASV

SEQ ID NO: 688336 - protein, 9 aa, Homo Sapiens
EVGVVQDDK

SEQ ID NO: 688337 - protein, 9 aa, Homo Sapiens
KECGKAFCH

SEQ ID NO: 688338 - protein, 9 aa, Homo Sapiens
GCKRILQKG

SEQ ID NO: 688339 - protein, 9 aa, Homo Sapiens
STISKMLGI

SEQ ID NO: 688340 - protein, 9 aa, Homo Sapiens
GGEGWTQAD

SEQ ID NO: 688341 - protein, 9 aa, Homo Sapiens
MNGTIVGTD

SEQ ID NO: 688342 - protein, 9 aa, Homo Sapiens
VAMFDPPQQ

SEQ ID NO: 688343 - protein, 9 aa, Homo Sapiens
QIIWDTVVI

SEQ ID NO: 688344 - protein, 9 aa, Homo Sapiens
TNIEVPKTE

SEQ ID NO: 688345 - protein, 9 aa, Homo Sapiens
FHNRRMKWK

SEQ ID NO: 688346 - protein, 9 aa, Homo Sapiens
SMHKYKHRV

SEQ ID NO: 688347 - protein, 9 aa, Homo Sapiens
QDIQIIFIN

SEQ ID NO: 688348 - protein, 9 aa, Homo Sapiens
GAPGHRAVR

SEQ ID NO: 688349 - protein, 9 aa, Homo Sapiens
NVGYHRWSL

SEQ ID NO: 688350 - protein, 9 aa, Homo Sapiens
RTKDKIVDI

SEQ ID NO: 688351 - protein, 9 aa, Homo Sapiens
RELLAWRGW

SEQ ID NO: 688352 - protein, 9 aa, Homo Sapiens
GTLHGTICD

SEQ ID NO: 688353 - protein, 9 aa, Homo Sapiens
GLSTSTISK

SEQ ID NO: 688354 - protein, 9 aa, Homo Sapiens
KGRARAPMS

SEQ ID NO: 688355 - protein, 9 aa, Homo Sapiens
WGFPLVICI

SEQ ID NO: 688356 - protein, 9 aa, Homo Sapiens
LSGRWLLAG

SEQ ID NO: 688357 - protein, 9 aa, Homo Sapiens
MKIEKVPEL

SEQ ID NO: 688358 - protein, 9 aa, Homo Sapiens
LLAQGLTVD

SEQ ID NO: 688359 - protein, 9 aa, Homo Sapiens
GDASKRKAV

SEQ ID NO: 688360 - protein, 9 aa, Homo Sapiens
DDTLEDSIG

SEQ ID NO: 688361 - protein, 9 aa, Homo Sapiens
DKHCWVGEL

SEQ ID NO: 688362 - protein, 9 aa, Homo Sapiens
IPVFVIKYP

SEQ ID NO: 688363 - protein, 9 aa, Homo Sapiens
ECEHREWGS

SEQ ID NO: 688364 - protein, 9 aa, Homo Sapiens
DIKSIRNFA

SEQ ID NO: 688365 - protein, 9 aa, Homo Sapiens
VVADRMVEI

SEQ ID NO: 688366 - protein, 9 aa, Homo Sapiens
DAVCVLGSG

SEQ ID NO: 688367 - protein, 9 aa, Homo Sapiens
PKVVPPDPG

SEQ ID NO: 688368 - protein, 9 aa, Homo Sapiens
CQITPAKGP

SEQ ID NO: 688369 - protein, 9 aa, Homo Sapiens
HLLAKDLLS

SEQ ID NO: 688370 - protein, 9 aa, Homo Sapiens
CFIFHGLHQ

SEQ ID NO: 688371 - protein, 9 aa, Homo Sapiens
SDSSDPQGL

SEQ ID NO: 688372 - protein, 9 aa, Homo Sapiens
IGCTWPQPF

SEQ ID NO: 688373 - protein, 9 aa, Homo Sapiens
LAAPECKVL

SEQ ID NO: 688374 - protein, 9 aa, Homo Sapiens
FFVLEEHIG

SEQ ID NO: 688375 - protein, 9 aa, Homo Sapiens
NFPSAKCLG

SEQ ID NO: 688376 - protein, 9 aa, Homo Sapiens
AAASARRRI

SEQ ID NO: 688377 - protein, 9 aa, Homo Sapiens
IMHSSYMQI

SEQ ID NO: 688378 - protein, 9 aa, Homo Sapiens
PMCFFLSHL

SEQ ID NO: 688379 - protein, 9 aa, Homo Sapiens
ISTFLGTVE

SEQ ID NO: 688380 - protein, 9 aa, Homo Sapiens
FLYSLRLSV

SEQ ID NO: 688381 - protein, 9 aa, Homo Sapiens
RYFFHHADE

SEQ ID NO: 688382 - protein, 9 aa, Homo Sapiens
EVASNQAAG

SEQ ID NO: 688383 - protein, 9 aa, Homo Sapiens
PLDPVETPP

SEQ ID NO: 688384 - protein, 9 aa, Homo Sapiens
KDYMISVKT

SEQ ID NO: 688385 - protein, 9 aa, Homo Sapiens
GSIVDTTGL

SEQ ID NO: 688386 - protein, 9 aa, Homo Sapiens
IDHTQYRLG

SEQ ID NO: 688387 - protein, 9 aa, Homo Sapiens
LGLLQSGYI

SEQ ID NO: 688388 - protein, 9 aa, Homo Sapiens
NKSISYYVC

SEQ ID NO: 688389 - protein, 9 aa, Homo Sapiens
QFVPGVPQR

SEQ ID NO: 688390 - protein, 9 aa, Homo Sapiens
FPDLNANFL

SEQ ID NO: 688391 - protein, 9 aa, Homo Sapiens
NSSKPNKLS

SEQ ID NO: 688392 - protein, 9 aa, Homo Sapiens
GKESYKSMT

SEQ ID NO: 688393 - protein, 9 aa, Homo Sapiens
RPGTILTTQ

SEQ ID NO: 688394 - protein, 9 aa, Homo Sapiens
LKRETTWKI

SEQ ID NO: 688395 - protein, 9 aa, Homo Sapiens
QVQLQGFNT

SEQ ID NO: 688396 - protein, 9 aa, Homo Sapiens
QTMMGLCCG

SEQ ID NO: 688397 - protein, 9 aa, Homo Sapiens
EIPCKLEKR

SEQ ID NO: 688398 - protein, 9 aa, Homo Sapiens
IEIYEESQQ

SEQ ID NO: 688399 - protein, 9 aa, Homo Sapiens
SHEDTGIIS

SEQ ID NO: 688400 - protein, 9 aa, Homo Sapiens
SQRVEDYKI

SEQ ID NO: 688401 - protein, 9 aa, Homo Sapiens
SGCKRILQK

SEQ ID NO: 688402 - protein, 9 aa, Homo Sapiens
TSMNELLML

SEQ ID NO: 688403 - protein, 9 aa, Homo Sapiens
IFQLMQFLF

SEQ ID NO: 688404 - protein, 9 aa, Homo Sapiens
DSIRQQQEA

SEQ ID NO: 688405 - protein, 9 aa, Homo Sapiens
HILLCSQTS

SEQ ID NO: 688406 - protein, 9 aa, Homo Sapiens
EHLLAKDLL

SEQ ID NO: 688407 - protein, 9 aa, Homo Sapiens
LVAFTTFQI

SEQ ID NO: 688408 - protein, 9 aa, Homo Sapiens
GQNHFKDSG

SEQ ID NO: 688409 - protein, 9 aa, Homo Sapiens
LKQVLTTGG

SEQ ID NO: 688410 - protein, 9 aa, Homo Sapiens
SMGGYVKMA

SEQ ID NO: 688411 - protein, 9 aa, Homo Sapiens
SAGPGVIEC

SEQ ID NO: 688412 - protein, 9 aa, Homo Sapiens
SISYYVCAL

SEQ ID NO: 688413 - protein, 9 aa, Homo Sapiens
ELEEGESFV

SEQ ID NO: 688414 - protein, 9 aa, Homo Sapiens
PVLQISLIE

SEQ ID NO: 688415 - protein, 9 aa, Homo Sapiens
LGLKEGRSF

SEQ ID NO: 688416 - protein, 9 aa, Homo Sapiens
NLFVVHRSD

SEQ ID NO: 688417 - protein, 9 aa, Homo Sapiens
DQDKAVSAF

SEQ ID NO: 688418 - protein, 9 aa, Homo Sapiens
AEKCYRVTK

SEQ ID NO: 688419 - protein, 9 aa, Homo Sapiens
QLSHSSQVH

SEQ ID NO: 688420 - protein, 9 aa, Homo Sapiens
SKKFCNNVL

SEQ ID NO: 688421 - protein, 9 aa, Homo Sapiens
WVTILPAKN

SEQ ID NO: 688422 - protein, 9 aa, Homo Sapiens
ANSGVAHTD

SEQ ID NO: 688423 - protein, 9 aa, Homo Sapiens
YTLGAQIYY

SEQ ID NO: 688424 - protein, 9 aa, Homo Sapiens
AMQAIPRKA

SEQ ID NO: 688425 - protein, 9 aa, Homo Sapiens
VLPKMKAET

SEQ ID NO: 688426 - protein, 9 aa, Homo Sapiens
RKQESYNSQ

SEQ ID NO: 688427 - protein, 9 aa, Homo Sapiens
LRTEQSNFG

SEQ ID NO: 688428 - protein, 9 aa, Homo Sapiens
AQATSSWPR

SEQ ID NO: 688429 - protein, 9 aa, Homo Sapiens
DVGTFLKST

SEQ ID NO: 688430 - protein, 9 aa, Homo Sapiens
TLFGSPEMP

SEQ ID NO: 688431 - protein, 9 aa, Homo Sapiens
ACLSPGSVA

SEQ ID NO: 688432 - protein, 9 aa, Homo Sapiens
ATEPRPDSI

SEQ ID NO: 688433 - protein, 9 aa, Homo Sapiens
QKWSMERLQ

SEQ ID NO: 688434 - protein, 9 aa, Homo Sapiens
QTGSRGPVG

SEQ ID NO: 688435 - protein, 9 aa, Homo Sapiens
NILPCDFSR

SEQ ID NO: 688436 - protein, 9 aa, Homo Sapiens
THESLQLQT

SEQ ID NO: 688437 - protein, 9 aa, Homo Sapiens
CPCEILPSR

SEQ ID NO: 688438 - protein, 9 aa, Homo Sapiens
MQQNCSILC

SEQ ID NO: 688439 - protein, 9 aa, Homo Sapiens
KILENRNGS

SEQ ID NO: 688440 - protein, 9 aa, Homo Sapiens
VYKCKNEGN

SEQ ID NO: 688441 - protein, 9 aa, Homo Sapiens
LEESRQYDD

SEQ ID NO: 688442 - protein, 9 aa, Homo Sapiens
SDRAFYTFK

SEQ ID NO: 688443 - protein, 9 aa, Homo Sapiens
DDKEVSEFA

SEQ ID NO: 688444 - protein, 9 aa, Homo Sapiens
HNVFYVQQA

SEQ ID NO: 688445 - protein, 9 aa, Homo Sapiens
SCEVAQDHM

SEQ ID NO: 688446 - protein, 9 aa, Homo Sapiens
KLRPDPLFQ

SEQ ID NO: 688447 - protein, 9 aa, Homo Sapiens
AAEDADTNQ

SEQ ID NO: 688448 - protein, 9 aa, Homo Sapiens
HTSAAYKSI

SEQ ID NO: 688449 - protein, 9 aa, Homo Sapiens
GDGLSKSSK

SEQ ID NO: 688450 - protein, 9 aa, Homo Sapiens
DEMGKQEME

SEQ ID NO: 688451 - protein, 9 aa, Homo Sapiens
TRVAYVVTP

SEQ ID NO: 688452 - protein, 9 aa, Homo Sapiens
IHQLKTVSA

SEQ ID NO: 688453 - protein, 9 aa, Homo Sapiens
PRLGPQPAG

SEQ ID NO: 688454 - protein, 9 aa, Homo Sapiens
TAYKIFERD

SEQ ID NO: 688455 - protein, 9 aa, Homo Sapiens
SIRQQQEAT

SEQ ID NO: 688456 - protein, 9 aa, Homo Sapiens
SKTLTLWSS

SEQ ID NO: 688457 - protein, 9 aa, Homo Sapiens
ISNVTKETE

SEQ ID NO: 688458 - protein, 9 aa, Homo Sapiens
RRPPQLLER

SEQ ID NO: 688459 - protein, 9 aa, Homo Sapiens
QVLDLKEEG

SEQ ID NO: 688460 - protein, 9 aa, Homo Sapiens
LFGSPEMPP

SEQ ID NO: 688461 - protein, 9 aa, Homo Sapiens
PHTAIQKAS

SEQ ID NO: 688462 - protein, 9 aa, Homo Sapiens
AGYLIAGTS

SEQ ID NO: 688463 - protein, 9 aa, Homo Sapiens
NRLKKMKEL

SEQ ID NO: 688464 - protein, 9 aa, Homo Sapiens
SYQCSHFHV

SEQ ID NO: 688465 - protein, 9 aa, Homo Sapiens
PVTIHNLVE

SEQ ID NO: 688466 - protein, 9 aa, Homo Sapiens
PASCRPHKE

SEQ ID NO: 688467 - protein, 9 aa, Homo Sapiens
GVFRCIAGS

SEQ ID NO: 688468 - protein, 9 aa, Homo Sapiens
VSSDTSSNK

SEQ ID NO: 688469 - protein, 9 aa, Homo Sapiens
VVKKLSSLA

SEQ ID NO: 688470 - protein, 9 aa, Homo Sapiens
TSFPDLNAN

SEQ ID NO: 688471 - protein, 9 aa, Homo Sapiens
GVFKVFLEN

SEQ ID NO: 688472 - protein, 9 aa, Homo Sapiens
EPTPLWVPN

SEQ ID NO: 688473 - protein, 9 aa, Homo Sapiens
IKSIRNFAA

SEQ ID NO: 688474 - protein, 9 aa, Homo Sapiens
EIFLSMSDN

SEQ ID NO: 688475 - protein, 9 aa, Homo Sapiens
NKLSNGVDF

SEQ ID NO: 688476 - protein, 9 aa, Homo Sapiens
FSTNSPPLI

SEQ ID NO: 688477 - protein, 9 aa, Homo Sapiens
AWRGWDTPY

SEQ ID NO: 688478 - protein, 9 aa, Homo Sapiens
YPILHEWAL

SEQ ID NO: 688479 - protein, 9 aa, Homo Sapiens
VIKLDKDLY

SEQ ID NO: 688480 - protein, 9 aa, Homo Sapiens
SQQTYSLVC

SEQ ID NO: 688481 - protein, 9 aa, Homo Sapiens
GDYKELHNY

SEQ ID NO: 688482 - protein, 9 aa, Homo Sapiens
HTDLLRYAK

SEQ ID NO: 688483 - protein, 9 aa, Homo Sapiens
FYEWQSSIL

SEQ ID NO: 688484 - protein, 9 aa, Homo Sapiens
MNLMEVSYP

SEQ ID NO: 688485 - protein, 9 aa, Homo Sapiens
HKANPFYEE

SEQ ID NO: 688486 - protein, 9 aa, Homo Sapiens
GPAGIIGPP

SEQ ID NO: 688487 - protein, 9 aa, Homo Sapiens
EKELIEDFK

SEQ ID NO: 688488 - protein, 9 aa, Homo Sapiens
DPGGGSGGF

SEQ ID NO: 688489 - protein, 9 aa, Homo Sapiens
ELFAVIFCA

SEQ ID NO: 688490 - protein, 9 aa, Homo Sapiens
MEKGDVIYI

SEQ ID NO: 688491 - protein, 9 aa, Homo Sapiens
SGLPRRPKP

SEQ ID NO: 688492 - protein, 9 aa, Homo Sapiens
NLQSRFENF

SEQ ID NO: 688493 - protein, 9 aa, Homo Sapiens
MICWRHPFA

SEQ ID NO: 688494 - protein, 9 aa, Homo Sapiens
SLRSGSLRS

SEQ ID NO: 688495 - protein, 9 aa, Homo Sapiens
SSVATATPS

SEQ ID NO: 688496 - protein, 9 aa, Homo Sapiens
NHPFFECVD

SEQ ID NO: 688497 - protein, 9 aa, Homo Sapiens
CRSSEMGLH

SEQ ID NO: 688498 - protein, 9 aa, Homo Sapiens
YSYDKSIEW

SEQ ID NO: 688499 - protein, 9 aa, Homo Sapiens
SGYISGLKI

SEQ ID NO: 688500 - protein, 9 aa, Homo Sapiens
KTSNHYSFS

SEQ ID NO: 688501 - protein, 9 aa, Homo Sapiens
LLMEAAENN

SEQ ID NO: 688502 - protein, 9 aa, Homo Sapiens
YLYTLGAQI

SEQ ID NO: 688503 - protein, 9 aa, Homo Sapiens
VGTFLKSTC

SEQ ID NO: 688504 - protein, 9 aa, Homo Sapiens
SMVKEDFQQ

SEQ ID NO: 688505 - protein, 9 aa, Homo Sapiens
LEEDESGTP

SEQ ID NO: 688506 - protein, 9 aa, Homo Sapiens
DSEVVMLCA

SEQ ID NO: 688507 - protein, 9 aa, Homo Sapiens
PKKKRLHLA

SEQ ID NO: 688508 - protein, 9 aa, Homo Sapiens
QIEAALSSM

SEQ ID NO: 688509 - protein, 9 aa, Homo Sapiens
LKNQATGQG

SEQ ID NO: 688510 - protein, 9 aa, Homo Sapiens
VTFLVDKKC

SEQ ID NO: 688511 - protein, 9 aa, Homo Sapiens
QLQTFSQAK

SEQ ID NO: 688512 - protein, 9 aa, Homo Sapiens
YMQQGAREN

SEQ ID NO: 688513 - protein, 9 aa, Homo Sapiens
QREKECSQA

SEQ ID NO: 688514 - protein, 9 aa, Homo Sapiens
QETSLQTLH

SEQ ID NO: 688515 - protein, 9 aa, Homo Sapiens
AATPRDPEL

SEQ ID NO: 688516 - protein, 9 aa, Homo Sapiens
VARLVGQQG

SEQ ID NO: 688517 - protein, 9 aa, Homo Sapiens
RRNWICENQ

SEQ ID NO: 688518 - protein, 9 aa, Homo Sapiens
RFVAQAQPP

SEQ ID NO: 688519 - protein, 9 aa, Homo Sapiens
SYLLRHKRT

SEQ ID NO: 688520 - protein, 9 aa, Homo Sapiens
GGSGSVVSG

SEQ ID NO: 688521 - protein, 9 aa, Homo Sapiens
PSGAGGSGT

SEQ ID NO: 688522 - protein, 9 aa, Homo Sapiens
TEGVLYNQL

SEQ ID NO: 688523 - protein, 9 aa, Homo Sapiens
ECRKTVPQE

SEQ ID NO: 688524 - protein, 9 aa, Homo Sapiens
INTMITINS

SEQ ID NO: 688525 - protein, 9 aa, Homo Sapiens
DVLTEKGIF

SEQ ID NO: 688526 - protein, 9 aa, Homo Sapiens
HSPPAAWPA

SEQ ID NO: 688527 - protein, 9 aa, Homo Sapiens
SVASKADKS

SEQ ID NO: 688528 - protein, 9 aa, Homo Sapiens
TCQEWVVVK

SEQ ID NO: 688529 - protein, 9 aa, Homo Sapiens
IPRFKVSQV

SEQ ID NO: 688530 - protein, 9 aa, Homo Sapiens
PSIAATPRD

SEQ ID NO: 688531 - protein, 9 aa, Homo Sapiens
ILSKVPVDK

SEQ ID NO: 688532 - protein, 9 aa, Homo Sapiens
EFQQFHYEY

SEQ ID NO: 688533 - protein, 9 aa, Homo Sapiens
TPESLRQNN

SEQ ID NO: 688534 - protein, 9 aa, Homo Sapiens
SFEEMLQNK

SEQ ID NO: 688535 - protein, 9 aa, Homo Sapiens
TRLFFNWFY

SEQ ID NO: 688536 - protein, 9 aa, Homo Sapiens
LLMLTFSGV

SEQ ID NO: 688537 - protein, 9 aa, Homo Sapiens
GKSYGRPKT

SEQ ID NO: 688538 - protein, 9 aa, Homo Sapiens
VSRMVCTML

SEQ ID NO: 688539 - protein, 9 aa, Homo Sapiens
IRRWSLHSW

SEQ ID NO: 688540 - protein, 9 aa, Homo Sapiens
QNKERLSTA

SEQ ID NO: 688541 - protein, 9 aa, Homo Sapiens
RCPCEILPS

SEQ ID NO: 688542 - protein, 9 aa, Homo Sapiens
GRDAAHLAE

SEQ ID NO: 688543 - protein, 9 aa, Homo Sapiens
HFKNHWKGR

SEQ ID NO: 688544 - protein, 9 aa, Homo Sapiens
LQHLYGYVT

SEQ ID NO: 688545 - protein, 9 aa, Homo Sapiens
FVVHRSDKL

SEQ ID NO: 688546 - protein, 9 aa, Homo Sapiens
VTATDQKVQ

SEQ ID NO: 688547 - protein, 9 aa, Homo Sapiens
PLLAISCCD

SEQ ID NO: 688548 - protein, 9 aa, Homo Sapiens
DFTRGKLIS

SEQ ID NO: 688549 - protein, 9 aa, Homo Sapiens
PGCLQPLLS

SEQ ID NO: 688550 - protein, 9 aa, Homo Sapiens
KSFGSAIMD

SEQ ID NO: 688551 - protein, 9 aa, Homo Sapiens
TSGQGKYRD

SEQ ID NO: 688552 - protein, 9 aa, Homo Sapiens
DDIEACVSG

SEQ ID NO: 688553 - protein, 9 aa, Homo Sapiens
NPFINTLRN

SEQ ID NO: 688554 - protein, 9 aa, Homo Sapiens
NQRATNMLG

SEQ ID NO: 688555 - protein, 9 aa, Homo Sapiens
RAGNKEKAI

SEQ ID NO: 688556 - protein, 9 aa, Homo Sapiens
FMNNIFCYR

SEQ ID NO: 688557 - protein, 9 aa, Homo Sapiens
NKVDETVLD

SEQ ID NO: 688558 - protein, 9 aa, Homo Sapiens
GEVGSVGRK

SEQ ID NO: 688559 - protein, 9 aa, Homo Sapiens
SALFSEYSG

SEQ ID NO: 688560 - protein, 9 aa, Homo Sapiens
RHLDNSEEP

SEQ ID NO: 688561 - protein, 9 aa, Homo Sapiens
SLMSTLSSS

SEQ ID NO: 688562 - protein, 9 aa, Homo Sapiens
YIVWKIGGL

SEQ ID NO: 688563 - protein, 9 aa, Homo Sapiens
SQSSVDNAA

SEQ ID NO: 688564 - protein, 9 aa, Homo Sapiens
SKKSKDGKG

SEQ ID NO: 688565 - protein, 9 aa, Homo Sapiens
GSYRCVCPT

SEQ ID NO: 688566 - protein, 9 aa, Homo Sapiens
GDSEHRRGP

SEQ ID NO: 688567 - protein, 9 aa, Homo Sapiens
NDAVLPLVL

SEQ ID NO: 688568 - protein, 9 aa, Homo Sapiens
YKSAILNKW

SEQ ID NO: 688569 - protein, 9 aa, Homo Sapiens
LRSEIAQSS

SEQ ID NO: 688570 - protein, 9 aa, Homo Sapiens
EDSWELIID

SEQ ID NO: 688571 - protein, 9 aa, Homo Sapiens
PEQGSQSLG

SEQ ID NO: 688572 - protein, 9 aa, Homo Sapiens
QLQNTLQQL

SEQ ID NO: 688573 - protein, 9 aa, Homo Sapiens
APDTWASAP

SEQ ID NO: 688574 - protein, 9 aa, Homo Sapiens
LNRHKLSHL

SEQ ID NO: 688575 - protein, 9 aa, Homo Sapiens
MYLMGFYSG

SEQ ID NO: 688576 - protein, 9 aa, Homo Sapiens
FVDGVEVHN

SEQ ID NO: 688577 - protein, 9 aa, Homo Sapiens
QTVSWSKAG

SEQ ID NO: 688578 - protein, 9 aa, Homo Sapiens
AERPPSEAA

SEQ ID NO: 688579 - protein, 9 aa, Homo Sapiens
GLHFFPVYS

SEQ ID NO: 688580 - protein, 9 aa, Homo Sapiens
RTRAFNVPT

SEQ ID NO: 688581 - protein, 9 aa, Homo Sapiens
CIRASSSEA

SEQ ID NO: 688582 - protein, 9 aa, Homo Sapiens
EVAPPNRPR

SEQ ID NO: 688583 - protein, 9 aa, Homo Sapiens
SSKNVDCPE

SEQ ID NO: 688584 - protein, 9 aa, Homo Sapiens
ALANALQRH

SEQ ID NO: 688585 - protein, 9 aa, Homo Sapiens
HMYDSYKVP

SEQ ID NO: 688586 - protein, 9 aa, Homo Sapiens
IEAALSSMP

SEQ ID NO: 688587 - protein, 9 aa, Homo Sapiens
CCIRASSSE

SEQ ID NO: 688588 - protein, 9 aa, Homo Sapiens
IRRPDVLLH

SEQ ID NO: 688589 - protein, 9 aa, Homo Sapiens
EIVPRVLLA

SEQ ID NO: 688590 - protein, 9 aa, Homo Sapiens
SHSPLHLTK

SEQ ID NO: 688591 - protein, 9 aa, Homo Sapiens
EAASMLLLG

SEQ ID NO: 688592 - protein, 9 aa, Homo Sapiens
FPDSLPAMQ

SEQ ID NO: 688593 - protein, 9 aa, Homo Sapiens
MIDEMNDIR

SEQ ID NO: 688594 - protein, 9 aa, Homo Sapiens
LTEAMHTVP

SEQ ID NO: 688595 - protein, 9 aa, Homo Sapiens
KSIRNFAAD

SEQ ID NO: 688596 - protein, 9 aa, Homo Sapiens
LMKDLLQDL

SEQ ID NO: 688597 - protein, 9 aa, Homo Sapiens
AKCAPGLQL

SEQ ID NO: 688598 - protein, 9 aa, Homo Sapiens
RWTEDQNSL

SEQ ID NO: 688599 - protein, 9 aa, Homo Sapiens
VVGLYQKCA

SEQ ID NO: 688600 - protein, 9 aa, Homo Sapiens
QTEVQTVMS

SEQ ID NO: 688601 - protein, 9 aa, Homo Sapiens
VIKYPLTLK

SEQ ID NO: 688602 - protein, 9 aa, Homo Sapiens
STIKAQSND

SEQ ID NO: 688603 - protein, 9 aa, Homo Sapiens
QTFSQAKRN

SEQ ID NO: 688604 - protein, 9 aa, Homo Sapiens
LQRHLPFLE

SEQ ID NO: 688605 - protein, 9 aa, Homo Sapiens
RTSSEQAHP

SEQ ID NO: 688606 - protein, 9 aa, Homo Sapiens
IPLPKVGLI

SEQ ID NO: 688607 - protein, 9 aa, Homo Sapiens
ENGKSQQAS

SEQ ID NO: 688608 - protein, 9 aa, Homo Sapiens
KDPCLRGEK

SEQ ID NO: 688609 - protein, 9 aa, Homo Sapiens
FGYTTDNLR

SEQ ID NO: 688610 - protein, 9 aa, Homo Sapiens
MDALRIHME

SEQ ID NO: 688611 - protein, 9 aa, Homo Sapiens
PRDPELVGP

SEQ ID NO: 688612 - protein, 9 aa, Homo Sapiens
EKEAIRRLQ

SEQ ID NO: 688613 - protein, 9 aa, Homo Sapiens
VLDLKEEGL

SEQ ID NO: 688614 - protein, 9 aa, Homo Sapiens
PAASRVWTM

SEQ ID NO: 688615 - protein, 9 aa, Homo Sapiens
PALYPQGSR

SEQ ID NO: 688616 - protein, 9 aa, Homo Sapiens
KLISSLHLK

SEQ ID NO: 688617 - protein, 9 aa, Homo Sapiens
GPAGRGPPG

SEQ ID NO: 688618 - protein, 9 aa, Homo Sapiens
ASKTLTLWS

SEQ ID NO: 688619 - protein, 9 aa, Homo Sapiens
RQISTKRYE

SEQ ID NO: 688620 - protein, 9 aa, Homo Sapiens
DKPRAHLPD

SEQ ID NO: 688621 - protein, 9 aa, Homo Sapiens
LLLLVAGDR

SEQ ID NO: 688622 - protein, 9 aa, Homo Sapiens
PRRFMDLAK

SEQ ID NO: 688623 - protein, 9 aa, Homo Sapiens
EKGIFESCV

SEQ ID NO: 688624 - protein, 9 aa, Homo Sapiens
ICWRHPFAP

SEQ ID NO: 688625 - protein, 9 aa, Homo Sapiens
LQEDGSLFY

SEQ ID NO: 688626 - protein, 9 aa, Homo Sapiens
AIVSKFLYY

SEQ ID NO: 688627 - protein, 9 aa, Homo Sapiens
PDIGVFRCI

SEQ ID NO: 688628 - protein, 9 aa, Homo Sapiens
ISKMLGIFW

SEQ ID NO: 688629 - protein, 9 aa, Homo Sapiens
APLGIGRLP

SEQ ID NO: 688630 - protein, 9 aa, Homo Sapiens
CMLIGEIFQ

SEQ ID NO: 688631 - protein, 9 aa, Homo Sapiens
PELLLVARH

SEQ ID NO: 688632 - protein, 9 aa, Homo Sapiens
ILKRNIKRY

SEQ ID NO: 688633 - protein, 9 aa, Homo Sapiens
WSMGGYVKM

SEQ ID NO: 688634 - protein, 9 aa, Homo Sapiens
AGTGDAGGL

SEQ ID NO: 688635 - protein, 9 aa, Homo Sapiens
GRSFSGVTA

SEQ ID NO: 688636 - protein, 9 aa, Homo Sapiens
RFRPSLEKR

SEQ ID NO: 688637 - protein, 9 aa, Homo Sapiens
NYSKVQIRC

SEQ ID NO: 688638 - protein, 9 aa, Homo Sapiens
ASVARLVGQ

SEQ ID NO: 688639 - protein, 9 aa, Homo Sapiens
CLSVKAIES

SEQ ID NO: 688640 - protein, 9 aa, Homo Sapiens
KLVAERDIS

SEQ ID NO: 688641 - protein, 9 aa, Homo Sapiens
LQEFWDNFI

SEQ ID NO: 688642 - protein, 9 aa, Homo Sapiens
IGEFGLREY

SEQ ID NO: 688643 - protein, 9 aa, Homo Sapiens
SFPDLNANF

SEQ ID NO: 688644 - protein, 9 aa, Homo Sapiens
YGQCHSFYI

SEQ ID NO: 688645 - protein, 9 aa, Homo Sapiens
LFFNWFYWS

SEQ ID NO: 688646 - protein, 9 aa, Homo Sapiens
DLKFDLGEK

SEQ ID NO: 688647 - protein, 9 aa, Homo Sapiens
TDISGNYHL

SEQ ID NO: 688648 - protein, 9 aa, Homo Sapiens
QTPPVQPVA

SEQ ID NO: 688649 - protein, 9 aa, Homo Sapiens
CRTPHSTRC

SEQ ID NO: 688650 - protein, 9 aa, Homo Sapiens
ASQQTYSLV

SEQ ID NO: 688651 - protein, 9 aa, Homo Sapiens
KMEVAKPED

SEQ ID NO: 688652 - protein, 9 aa, Homo Sapiens
SITFWHNLN

SEQ ID NO: 688653 - protein, 9 aa, Homo Sapiens
AVRIGAELS

SEQ ID NO: 688654 - protein, 9 aa, Homo Sapiens
PGENILFST

SEQ ID NO: 688655 - protein, 9 aa, Homo Sapiens
KANPQAQKH

SEQ ID NO: 688656 - protein, 9 aa, Homo Sapiens
FQKRYILKT

SEQ ID NO: 688657 - protein, 9 aa, Homo Sapiens
ASTVTASLD

SEQ ID NO: 688658 - protein, 9 aa, Homo Sapiens
DQQSTCYNT

SEQ ID NO: 688659 - protein, 9 aa, Homo Sapiens
TVYSAAFAP

SEQ ID NO: 688660 - protein, 9 aa, Homo Sapiens
NKFQGENTK

SEQ ID NO: 688661 - protein, 9 aa, Homo Sapiens
KGQEKIQVK

SEQ ID NO: 688662 - protein, 9 aa, Homo Sapiens
VSQKDKHCW

SEQ ID NO: 688663 - protein, 9 aa, Homo Sapiens
LYESEFHTS

SEQ ID NO: 688664 - protein, 9 aa, Homo Sapiens
KPYLLSPVK

SEQ ID NO: 688665 - protein, 9 aa, Homo Sapiens
EKDVKKDTE

SEQ ID NO: 688666 - protein, 9 aa, Homo Sapiens
YIIGSYTLV

SEQ ID NO: 688667 - protein, 9 aa, Homo Sapiens
FKDSGVRCK

SEQ ID NO: 688668 - protein, 9 aa, Homo Sapiens
GFHCMQRDV

SEQ ID NO: 688669 - protein, 9 aa, Homo Sapiens
EKLSQKVSE

SEQ ID NO: 688670 - protein, 9 aa, Homo Sapiens
TTIETSVNT

SEQ ID NO: 688671 - protein, 9 aa, Homo Sapiens
SIKNTEWSR

SEQ ID NO: 688672 - protein, 9 aa, Homo Sapiens
GKKIMEEES

SEQ ID NO: 688673 - protein, 9 aa, Homo Sapiens
TINSGSTCS

SEQ ID NO: 688674 - protein, 9 aa, Homo Sapiens
RIPSMAGHS

SEQ ID NO: 688675 - protein, 9 aa, Homo Sapiens
AELRLQLSR

SEQ ID NO: 688676 - protein, 9 aa, Homo Sapiens
TALGQVCSS

SEQ ID NO: 688677 - protein, 9 aa, Homo Sapiens
PESLRQNNN

SEQ ID NO: 688678 - protein, 9 aa, Homo Sapiens
RFCVLGTLS

SEQ ID NO: 688679 - protein, 9 aa, Homo Sapiens
GGGSGYQYL

SEQ ID NO: 688680 - protein, 9 aa, Homo Sapiens
SIYLNNVLF

SEQ ID NO: 688681 - protein, 9 aa, Homo Sapiens
PVDKIGLHL

SEQ ID NO: 688682 - protein, 9 aa, Homo Sapiens
MAAVFLTTT

SEQ ID NO: 688683 - protein, 9 aa, Homo Sapiens
PELPARTQE

SEQ ID NO: 688684 - protein, 9 aa, Homo Sapiens
SPLTRRSCA

SEQ ID NO: 688685 - protein, 9 aa, Homo Sapiens
EENYEIVPR

SEQ ID NO: 688686 - protein, 9 aa, Homo Sapiens
DKGWAQATS

SEQ ID NO: 688687 - protein, 9 aa, Homo Sapiens
IKKRALIGY

SEQ ID NO: 688688 - protein, 9 aa, Homo Sapiens
QHVLPKMKA

SEQ ID NO: 688689 - protein, 9 aa, Homo Sapiens
AMFDPPQQF

SEQ ID NO: 688690 - protein, 9 aa, Homo Sapiens
HPKKGSQVV

SEQ ID NO: 688691 - protein, 9 aa, Homo Sapiens
SSIIQKWSM

SEQ ID NO: 688692 - protein, 9 aa, Homo Sapiens
STKAEPSVF

SEQ ID NO: 688693 - protein, 9 aa, Homo Sapiens
SSPSAAFPS

SEQ ID NO: 688694 - protein, 9 aa, Homo Sapiens
RDHEKRLEA

SEQ ID NO: 688695 - protein, 9 aa, Homo Sapiens
KVRFKKVQF

SEQ ID NO: 688696 - protein, 9 aa, Homo Sapiens
QRTLLMEAA

SEQ ID NO: 688697 - protein, 9 aa, Homo Sapiens
EQNPGSASA

SEQ ID NO: 688698 - protein, 9 aa, Homo Sapiens
LLVEALHVN

SEQ ID NO: 688699 - protein, 9 aa, Homo Sapiens
TCKLASKDG

SEQ ID NO: 688700 - protein, 9 aa, Homo Sapiens
DCEDVWGKT

SEQ ID NO: 688701 - protein, 9 aa, Homo Sapiens
DQETSLQTL

SEQ ID NO: 688702 - protein, 9 aa, Homo Sapiens
YDRYVAIND

SEQ ID NO: 688703 - protein, 9 aa, Homo Sapiens
DLDPGDYKE

SEQ ID NO: 688704 - protein, 9 aa, Homo Sapiens
AYSRQGAAR

SEQ ID NO: 688705 - protein, 9 aa, Homo Sapiens
PDTWASAPD

SEQ ID NO: 688706 - protein, 9 aa, Homo Sapiens
VSAGPGVIE

SEQ ID NO: 688707 - protein, 9 aa, Homo Sapiens
LSLNQQLAA

SEQ ID NO: 688708 - protein, 9 aa, Homo Sapiens
LCAEGLCTK

SEQ ID NO: 688709 - protein, 9 aa, Homo Sapiens
ENAQERSWP

SEQ ID NO: 688710 - protein, 9 aa, Homo Sapiens
APSGEHTLQ

SEQ ID NO: 688711 - protein, 9 aa, Homo Sapiens
LDEKPYQCP

SEQ ID NO: 688712 - protein, 9 aa, Homo Sapiens
FRKRARAKE

SEQ ID NO: 688713 - protein, 9 aa, Homo Sapiens
NHEELNKLL

SEQ ID NO: 688714 - protein, 9 aa, Homo Sapiens
MPVAGHPHR

SEQ ID NO: 688715 - protein, 9 aa, Homo Sapiens
ELPARTQER

SEQ ID NO: 688716 - protein, 9 aa, Homo Sapiens
DVDIIFTLL

SEQ ID NO: 688717 - protein, 9 aa, Homo Sapiens
SSAVTPPSG

SEQ ID NO: 688718 - protein, 9 aa, Homo Sapiens
EPPKLEKIG

SEQ ID NO: 688719 - protein, 9 aa, Homo Sapiens
FFKSLVIKL

SEQ ID NO: 688720 - protein, 9 aa, Homo Sapiens
SSQVDPGTN

SEQ ID NO: 688721 - protein, 9 aa, Homo Sapiens
RRTQLELCP

SEQ ID NO: 688722 - protein, 9 aa, Homo Sapiens
MDTFLGPVL

SEQ ID NO: 688723 - protein, 9 aa, Homo Sapiens
HNTGALKLT

SEQ ID NO: 688724 - protein, 9 aa, Homo Sapiens
IDVGTFLKS

SEQ ID NO: 688725 - protein, 9 aa, Homo Sapiens
PTPLWVPNN

SEQ ID NO: 688726 - protein, 9 aa, Homo Sapiens
LTFLVEKMN

SEQ ID NO: 688727 - protein, 9 aa, Homo Sapiens
AECRSRGQF

SEQ ID NO: 688728 - protein, 9 aa, Homo Sapiens
QAFKQSFLE

SEQ ID NO: 688729 - protein, 9 aa, Homo Sapiens
FDVVNKGGE

SEQ ID NO: 688730 - protein, 9 aa, Homo Sapiens
DRRKAASMR

SEQ ID NO: 688731 - protein, 9 aa, Homo Sapiens
DSLREDRRE

SEQ ID NO: 688732 - protein, 9 aa, Homo Sapiens
RITFIKDSG

SEQ ID NO: 688733 - protein, 9 aa, Homo Sapiens
SAYGDTVII

SEQ ID NO: 688734 - protein, 9 aa, Homo Sapiens
YRLGITKVF

SEQ ID NO: 688735 - protein, 9 aa, Homo Sapiens
CYRIFSNMY

SEQ ID NO: 688736 - protein, 9 aa, Homo Sapiens
RLASKPQDP

SEQ ID NO: 688737 - protein, 9 aa, Homo Sapiens
FLQDSNITH

SEQ ID NO: 688738 - protein, 9 aa, Homo Sapiens
WLAEMTSTV

SEQ ID NO: 688739 - protein, 9 aa, Homo Sapiens
VEKKVQGNK

SEQ ID NO: 688740 - protein, 9 aa, Homo Sapiens
AAHRAGIRM

SEQ ID NO: 688741 - protein, 9 aa, Homo Sapiens
GPNSSLRKR

SEQ ID NO: 688742 - protein, 9 aa, Homo Sapiens
ASMLLLGDA

SEQ ID NO: 688743 - protein, 9 aa, Homo Sapiens
RSKPLIWIH

SEQ ID NO: 688744 - protein, 9 aa, Homo Sapiens
RSYRLLAGH

SEQ ID NO: 688745 - protein, 9 aa, Homo Sapiens
VSRCTPTGL

SEQ ID NO: 688746 - protein, 9 aa, Homo Sapiens
RKHLGVSEG

SEQ ID NO: 688747 - protein, 9 aa, Homo Sapiens
TAIGLLPDV

SEQ ID NO: 688748 - protein, 9 aa, Homo Sapiens
RELHMVKET

SEQ ID NO: 688749 - protein, 9 aa, Homo Sapiens
WSLSCSFLQ

SEQ ID NO: 688750 - protein, 9 aa, Homo Sapiens
TREIQGIRV

SEQ ID NO: 688751 - protein, 9 aa, Homo Sapiens
QPSLPPGCL

SEQ ID NO: 688752 - protein, 9 aa, Homo Sapiens
APMSNYIML

SEQ ID NO: 688753 - protein, 9 aa, Homo Sapiens
PLQQEYPGK

SEQ ID NO: 688754 - protein, 9 aa, Homo Sapiens
EPPGPYRLR

SEQ ID NO: 688755 - protein, 9 aa, Homo Sapiens
LTADKDLQA

SEQ ID NO: 688756 - protein, 9 aa, Homo Sapiens
GHFKPLENK

SEQ ID NO: 688757 - protein, 9 aa, Homo Sapiens
ALAVQDDQV

SEQ ID NO: 688758 - protein, 9 aa, Homo Sapiens
KGKPWEGCL

SEQ ID NO: 688759 - protein, 9 aa, Homo Sapiens
LIYTVKILR

SEQ ID NO: 688760 - protein, 9 aa, Homo Sapiens
EIDLSYVLS

SEQ ID NO: 688761 - protein, 9 aa, Homo Sapiens
IAATPRDPE

SEQ ID NO: 688762 - protein, 9 aa, Homo Sapiens
LDVLTEKGI

SEQ ID NO: 688763 - protein, 9 aa, Homo Sapiens
GVAVMDNKL

SEQ ID NO: 688764 - protein, 9 aa, Homo Sapiens
ASKDRVSET

SEQ ID NO: 688765 - protein, 9 aa, Homo Sapiens
PMKRPDSET

SEQ ID NO: 688766 - protein, 9 aa, Homo Sapiens
GIRVTSHNR

SEQ ID NO: 688767 - protein, 9 aa, Homo Sapiens
EEARAQRER

SEQ ID NO: 688768 - protein, 9 aa, Homo Sapiens
FCYRIFSNM

SEQ ID NO: 688769 - protein, 9 aa, Homo Sapiens
KSLPLVTRP

SEQ ID NO: 688770 - protein, 9 aa, Homo Sapiens
RIGLAFLVL

SEQ ID NO: 688771 - protein, 9 aa, Homo Sapiens
EETYVQVQP

SEQ ID NO: 688772 - protein, 9 aa, Homo Sapiens
DSYKVPDEH

SEQ ID NO: 688773 - protein, 9 aa, Homo Sapiens
GIIGPPGLQ

SEQ ID NO: 688774 - protein, 9 aa, Homo Sapiens
PILHEWALR

SEQ ID NO: 688775 - protein, 9 aa, Homo Sapiens
GRMATERRG

SEQ ID NO: 688776 - protein, 9 aa, Homo Sapiens
EKRLESIIS

SEQ ID NO: 688777 - protein, 9 aa, Homo Sapiens
GSLGSECTN

SEQ ID NO: 688778 - protein, 9 aa, Homo Sapiens
RPGDGPPGA

SEQ ID NO: 688779 - protein, 9 aa, Homo Sapiens
INTLRNKEV

SEQ ID NO: 688780 - protein, 9 aa, Homo Sapiens
KDDKEKDVK

SEQ ID NO: 688781 - protein, 9 aa, Homo Sapiens
KIWFHNRRM

SEQ ID NO: 688782 - protein, 9 aa, Homo Sapiens
VGYVENGTP

SEQ ID NO: 688783 - protein, 9 aa, Homo Sapiens
DVMACGGNT

SEQ ID NO: 688784 - protein, 9 aa, Homo Sapiens
TPMCFFLSH

SEQ ID NO: 688785 - protein, 9 aa, Homo Sapiens
THQQPSGSD

SEQ ID NO: 688786 - protein, 9 aa, Homo Sapiens
NRVDLQHLY

SEQ ID NO: 688787 - protein, 9 aa, Homo Sapiens
CGHRTLDHF

SEQ ID NO: 688788 - protein, 9 aa, Homo Sapiens
CEIPCKLEK

SEQ ID NO: 688789 - protein, 9 aa, Homo Sapiens
MVEHSFFEA

SEQ ID NO: 688790 - protein, 9 aa, Homo Sapiens
GCLQPLLSC

SEQ ID NO: 688791 - protein, 9 aa, Homo Sapiens
LKMEAKFEL

SEQ ID NO: 688792 - protein, 9 aa, Homo Sapiens
SAMKQAPEA

SEQ ID NO: 688793 - protein, 9 aa, Homo Sapiens
YGNLVSVWL

SEQ ID NO: 688794 - protein, 9 aa, Homo Sapiens
GSFKIGNLL

SEQ ID NO: 688795 - protein, 9 aa, Homo Sapiens
QWQMHSPPA

SEQ ID NO: 688796 - protein, 9 aa, Homo Sapiens
FSDVAMFDP

SEQ ID NO: 688797 - protein, 9 aa, Homo Sapiens
TDDSLTGSS

SEQ ID NO: 688798 - protein, 9 aa, Homo Sapiens
LRWKLFNAE

SEQ ID NO: 688799 - protein, 9 aa, Homo Sapiens
MLQNKLKVP

SEQ ID NO: 688800 - protein, 9 aa, Homo Sapiens
PDQDKAVSA

SEQ ID NO: 688801 - protein, 9 aa, Homo Sapiens
QFQEDILRQ

SEQ ID NO: 688802 - protein, 9 aa, Homo Sapiens
LCDWWISCR

SEQ ID NO: 688803 - protein, 9 aa, Homo Sapiens
VNALRQDPS

SEQ ID NO: 688804 - protein, 9 aa, Homo Sapiens
QHLEASSNQ

SEQ ID NO: 688805 - protein, 9 aa, Homo Sapiens
RPFTPHTIT

SEQ ID NO: 688806 - protein, 9 aa, Homo Sapiens
SNHVPKNFF

SEQ ID NO: 688807 - protein, 9 aa, Homo Sapiens
TLLGPCVLS

SEQ ID NO: 688808 - protein, 9 aa, Homo Sapiens
ELLFSIREF

SEQ ID NO: 688809 - protein, 9 aa, Homo Sapiens
AMLFALSRK

SEQ ID NO: 688810 - protein, 9 aa, Homo Sapiens
RNHYPLTLY

SEQ ID NO: 688811 - protein, 9 aa, Homo Sapiens
SAANENSTL

SEQ ID NO: 688812 - protein, 9 aa, Homo Sapiens
RQVQLQGFN

SEQ ID NO: 688813 - protein, 9 aa, Homo Sapiens
LQISLIENK

SEQ ID NO: 688814 - protein, 9 aa, Homo Sapiens
TVKILRFNK

SEQ ID NO: 688815 - protein, 9 aa, Homo Sapiens
RRETDARIQ

SEQ ID NO: 688816 - protein, 9 aa, Homo Sapiens
RKGPNQALL

SEQ ID NO: 688817 - protein, 9 aa, Homo Sapiens
SKDRVSETS

SEQ ID NO: 688818 - protein, 9 aa, Homo Sapiens
HEGKGQEKI

SEQ ID NO: 688819 - protein, 9 aa, Homo Sapiens
VLREALQPE

SEQ ID NO: 688820 - protein, 9 aa, Homo Sapiens
TVENEHLKK

SEQ ID NO: 688821 - protein, 9 aa, Homo Sapiens
QNLLRIGLA

SEQ ID NO: 688822 - protein, 9 aa, Homo Sapiens
ALFSEYSGF

SEQ ID NO: 688823 - protein, 9 aa, Homo Sapiens
GCKRKRSWN

SEQ ID NO: 688824 - protein, 9 aa, Homo Sapiens
SNITHCHDV

SEQ ID NO: 688825 - protein, 9 aa, Homo Sapiens
EVHEELHKK

SEQ ID NO: 688826 - protein, 9 aa, Homo Sapiens
DTVIIPCRL

SEQ ID NO: 688827 - protein, 9 aa, Homo Sapiens
LVMNTMDKT

SEQ ID NO: 688828 - protein, 9 aa, Homo Sapiens
DPDADDSAF

SEQ ID NO: 688829 - protein, 9 aa, Homo Sapiens
ESSKNVDCP

SEQ ID NO: 688830 - protein, 9 aa, Homo Sapiens
METVARRFM

SEQ ID NO: 688831 - protein, 9 aa, Homo Sapiens
LSPGSVAFS

SEQ ID NO: 688832 - protein, 9 aa, Homo Sapiens
HIASDCPTS

SEQ ID NO: 688833 - protein, 9 aa, Homo Sapiens
NMKTPAERL

SEQ ID NO: 688834 - protein, 9 aa, Homo Sapiens
GVAEKVEEP

SEQ ID NO: 688835 - protein, 9 aa, Homo Sapiens
RGLVVRITF

SEQ ID NO: 688836 - protein, 9 aa, Homo Sapiens
QIDFNKEKK

SEQ ID NO: 688837 - protein, 9 aa, Homo Sapiens
VTQSNKFDL

SEQ ID NO: 688838 - protein, 9 aa, Homo Sapiens
PLPVTITSS

SEQ ID NO: 688839 - protein, 9 aa, Homo Sapiens
NTEWSREEE

SEQ ID NO: 688840 - protein, 9 aa, Homo Sapiens
ACVVHGLRR

SEQ ID NO: 688841 - protein, 9 aa, Homo Sapiens
AVNLKGIPV

SEQ ID NO: 688842 - protein, 9 aa, Homo Sapiens
VTASLDSSR

SEQ ID NO: 688843 - protein, 9 aa, Homo Sapiens
AKDLLSEED

SEQ ID NO: 688844 - protein, 9 aa, Homo Sapiens
AMAMCQHFY

SEQ ID NO: 688845 - protein, 9 aa, Homo Sapiens
YMISVKTHN

SEQ ID NO: 688846 - protein, 9 aa, Homo Sapiens
AIGLLPDVG

SEQ ID NO: 688847 - protein, 9 aa, Homo Sapiens
ESFGYTTDN

SEQ ID NO: 688848 - protein, 9 aa, Homo Sapiens
ADDSAFNKK

SEQ ID NO: 688849 - protein, 9 aa, Homo Sapiens
TLVISQRTE

SEQ ID NO: 688850 - protein, 9 aa, Homo Sapiens
RNIIVFYGC

SEQ ID NO: 688851 - protein, 9 aa, Homo Sapiens
FALYKKHAE

SEQ ID NO: 688852 - protein, 9 aa, Homo Sapiens
QIGCTWPQP

SEQ ID NO: 688853 - protein, 9 aa, Homo Sapiens
QLGVQALKN

SEQ ID NO: 688854 - protein, 9 aa, Homo Sapiens
VMDNKLYVV

SEQ ID NO: 688855 - protein, 9 aa, Homo Sapiens
EDYKINIPT

SEQ ID NO: 688856 - protein, 9 aa, Homo Sapiens
HLKQVLTTG

SEQ ID NO: 688857 - protein, 9 aa, Homo Sapiens
KMPSQQDAL

SEQ ID NO: 688858 - protein, 9 aa, Homo Sapiens
LQLSRPVDL

SEQ ID NO: 688859 - protein, 9 aa, Homo Sapiens
PDAKENKIL

SEQ ID NO: 688860 - protein, 9 aa, Homo Sapiens
LEFKYVKTV

SEQ ID NO: 688861 - protein, 9 aa, Homo Sapiens
TVIAEDILG

SEQ ID NO: 688862 - protein, 9 aa, Homo Sapiens
ELCPRGSSP

SEQ ID NO: 688863 - protein, 9 aa, Homo Sapiens
VCAKCAPGL

SEQ ID NO: 688864 - protein, 9 aa, Homo Sapiens
KPSQLQGKK

SEQ ID NO: 688865 - protein, 9 aa, Homo Sapiens
LQQEIWEQE

SEQ ID NO: 688866 - protein, 9 aa, Homo Sapiens
WQDCCAECR

SEQ ID NO: 688867 - protein, 9 aa, Homo Sapiens
FKSLVIKLD

SEQ ID NO: 688868 - protein, 9 aa, Homo Sapiens
FNKKENKGC

SEQ ID NO: 688869 - protein, 9 aa, Homo Sapiens
VGLYQKCAM

SEQ ID NO: 688870 - protein, 9 aa, Homo Sapiens
SMLQCLATG

SEQ ID NO: 688871 - protein, 9 aa, Homo Sapiens
GIFALYKKH

SEQ ID NO: 688872 - protein, 9 aa, Homo Sapiens
TPEFQQFHY

SEQ ID NO: 688873 - protein, 9 aa, Homo Sapiens
WSGSASRND

SEQ ID NO: 688874 - protein, 9 aa, Homo Sapiens
DGNFKFHVD

SEQ ID NO: 688875 - protein, 9 aa, Homo Sapiens
WGEEWSMGG

SEQ ID NO: 688876 - protein, 9 aa, Homo Sapiens
VDYQFTVCA

SEQ ID NO: 688877 - protein, 9 aa, Homo Sapiens
AGGAQDESG

SEQ ID NO: 688878 - protein, 9 aa, Homo Sapiens
RLDFSLMGL

SEQ ID NO: 688879 - protein, 9 aa, Homo Sapiens
DSSFLGGGS

SEQ ID NO: 688880 - protein, 9 aa, Homo Sapiens
RSSEMGLHF

SEQ ID NO: 688881 - protein, 9 aa, Homo Sapiens
LAKDLLSEE

SEQ ID NO: 688882 - protein, 9 aa, Homo Sapiens
DRAFYTFKK

SEQ ID NO: 688883 - protein, 9 aa, Homo Sapiens
LTYTISLRA

SEQ ID NO: 688884 - protein, 9 aa, Homo Sapiens
KTLTLWSSE

SEQ ID NO: 688885 - protein, 9 aa, Homo Sapiens
ASKPQDPAA

SEQ ID NO: 688886 - protein, 9 aa, Homo Sapiens
QEFGAKAQL

SEQ ID NO: 688887 - protein, 9 aa, Homo Sapiens
DCMAVKTLL

SEQ ID NO: 688888 - protein, 9 aa, Homo Sapiens
SDSSQDKEG

SEQ ID NO: 688889 - protein, 9 aa, Homo Sapiens
DDLLCVANL

SEQ ID NO: 688890 - protein, 9 aa, Homo Sapiens
QASSRPSGS

SEQ ID NO: 688891 - protein, 9 aa, Homo Sapiens
GIPAQTVSW

SEQ ID NO: 688892 - protein, 9 aa, Homo Sapiens
SALTFCLPC

SEQ ID NO: 688893 - protein, 9 aa, Homo Sapiens
LLYTNQNPN

SEQ ID NO: 688894 - protein, 9 aa, Homo Sapiens
EPLCRKSIL

SEQ ID NO: 688895 - protein, 9 aa, Homo Sapiens
TSNHYSFST

SEQ ID NO: 688896 - protein, 9 aa, Homo Sapiens
LEGTAVFVH

SEQ ID NO: 688897 - protein, 9 aa, Homo Sapiens
FLRGTTFYA

SEQ ID NO: 688898 - protein, 9 aa, Homo Sapiens
TSVNTENLQ

SEQ ID NO: 688899 - protein, 9 aa, Homo Sapiens
IGMLFQSMA

SEQ ID NO: 688900 - protein, 9 aa, Homo Sapiens
EFEKASEEV

SEQ ID NO: 688901 - protein, 9 aa, Homo Sapiens
LLANQKTRL

SEQ ID NO: 688902 - protein, 9 aa, Homo Sapiens
ALYPQGSRQ

SEQ ID NO: 688903 - protein, 9 aa, Homo Sapiens
VAKGQSYSY

SEQ ID NO: 688904 - protein, 9 aa, Homo Sapiens
GSWAETGHT

SEQ ID NO: 688905 - protein, 9 aa, Homo Sapiens
KADKTENGK

SEQ ID NO: 688906 - protein, 9 aa, Homo Sapiens
IVTKNTLPA

SEQ ID NO: 688907 - protein, 9 aa, Homo Sapiens
TWASAPDQT

SEQ ID NO: 688908 - protein, 9 aa, Homo Sapiens
WLCDWWISC

SEQ ID NO: 688909 - protein, 9 aa, Homo Sapiens
KHHPADHPY

SEQ ID NO: 688910 - protein, 9 aa, Homo Sapiens
KRYNSFISL

SEQ ID NO: 688911 - protein, 9 aa, Homo Sapiens
LRQKKRNGS

SEQ ID NO: 688912 - protein, 9 aa, Homo Sapiens
LAVQDDQVA

SEQ ID NO: 688913 - protein, 9 aa, Homo Sapiens
DSSDPQGLE

SEQ ID NO: 688914 - protein, 9 aa, Homo Sapiens
LADVLSPEK

SEQ ID NO: 688915 - protein, 9 aa, Homo Sapiens
LRHELSLKQ

SEQ ID NO: 688916 - protein, 9 aa, Homo Sapiens
FGGAPGHRA

SEQ ID NO: 688917 - protein, 9 aa, Homo Sapiens
LPAKNKYPE

SEQ ID NO: 688918 - protein, 9 aa, Homo Sapiens
LCMVRYVYE

SEQ ID NO: 688919 - protein, 9 aa, Homo Sapiens
QWLQIDFNK

SEQ ID NO: 688920 - protein, 9 aa, Homo Sapiens
RDRVDFRAA

SEQ ID NO: 688921 - protein, 9 aa, Homo Sapiens
HRLSCSENE

SEQ ID NO: 688922 - protein, 9 aa, Homo Sapiens
LLVSNLNEQ

SEQ ID NO: 688923 - protein, 9 aa, Homo Sapiens
GEPGLLPVV

SEQ ID NO: 688924 - protein, 9 aa, Homo Sapiens
GCSMLAIGI

SEQ ID NO: 688925 - protein, 9 aa, Homo Sapiens
ENLNSRRSP

SEQ ID NO: 688926 - protein, 9 aa, Homo Sapiens
LLLQYHCDC

SEQ ID NO: 688927 - protein, 9 aa, Homo Sapiens
SDPQGLEAA

SEQ ID NO: 688928 - protein, 9 aa, Homo Sapiens
ESGETEGPN

SEQ ID NO: 688929 - protein, 9 aa, Homo Sapiens
KAYSRQGAA

SEQ ID NO: 688930 - protein, 9 aa, Homo Sapiens
RYILKTDNS

SEQ ID NO: 688931 - protein, 9 aa, Homo Sapiens
RNHPFFECV

SEQ ID NO: 688932 - protein, 9 aa, Homo Sapiens
HISTWLYEA

SEQ ID NO: 688933 - protein, 9 aa, Homo Sapiens
NEPLPPGTT

SEQ ID NO: 688934 - protein, 9 aa, Homo Sapiens
SKQKQLQKI

SEQ ID NO: 688935 - protein, 9 aa, Homo Sapiens
LLKQLDDKE

SEQ ID NO: 688936 - protein, 9 aa, Homo Sapiens
PYNSHAASF

SEQ ID NO: 688937 - protein, 9 aa, Homo Sapiens
GLPPTNESQ

SEQ ID NO: 688938 - protein, 9 aa, Homo Sapiens
RDFCLAFIV

SEQ ID NO: 688939 - protein, 9 aa, Homo Sapiens
TTFYADQMF

SEQ ID NO: 688940 - protein, 9 aa, Homo Sapiens
LKTVSAVCS

SEQ ID NO: 688941 - protein, 9 aa, Homo Sapiens
KAEKFHFVL

SEQ ID NO: 688942 - protein, 9 aa, Homo Sapiens
YECAVRFYF

SEQ ID NO: 688943 - protein, 9 aa, Homo Sapiens
VIIPCRLDV

SEQ ID NO: 688944 - protein, 9 aa, Homo Sapiens
HVPKNFFFF

SEQ ID NO: 688945 - protein, 9 aa, Homo Sapiens
YVYEAFYKV

SEQ ID NO: 688946 - protein, 9 aa, Homo Sapiens
YAQFQGRRR

SEQ ID NO: 688947 - protein, 9 aa, Homo Sapiens
GTNACALEK

SEQ ID NO: 688948 - protein, 9 aa, Homo Sapiens
LDEHIKKVS

SEQ ID NO: 688949 - protein, 9 aa, Homo Sapiens
KEQLSHSSQ

SEQ ID NO: 688950 - protein, 9 aa, Homo Sapiens
ATGKESYKS

SEQ ID NO: 688951 - protein, 9 aa, Homo Sapiens
NEQMVTPQS

SEQ ID NO: 688952 - protein, 9 aa, Homo Sapiens
DISSSATYE

SEQ ID NO: 688953 - protein, 9 aa, Homo Sapiens
AQLGIAKLV

SEQ ID NO: 688954 - protein, 9 aa, Homo Sapiens
RGAVSLQGS

SEQ ID NO: 688955 - protein, 9 aa, Homo Sapiens
PMRWTAPEA

SEQ ID NO: 688956 - protein, 9 aa, Homo Sapiens
THILLCSQT

SEQ ID NO: 688957 - protein, 9 aa, Homo Sapiens
CETSKAFPL

SEQ ID NO: 688958 - protein, 9 aa, Homo Sapiens
RYSPLTVPM

SEQ ID NO: 688959 - protein, 9 aa, Homo Sapiens
NHYSFSTNS

SEQ ID NO: 688960 - protein, 9 aa, Homo Sapiens
SNGPNTTAG

SEQ ID NO: 688961 - protein, 9 aa, Homo Sapiens
NAQERSWPQ

SEQ ID NO: 688962 - protein, 9 aa, Homo Sapiens
WKLFNAELA

SEQ ID NO: 688963 - protein, 9 aa, Homo Sapiens
GFAVKAKKP

SEQ ID NO: 688964 - protein, 9 aa, Homo Sapiens
IVSPVPKSR

SEQ ID NO: 688965 - protein, 9 aa, Homo Sapiens
KSLSRNPKK

SEQ ID NO: 688966 - protein, 9 aa, Homo Sapiens
QEIWEQEDL

SEQ ID NO: 688967 - protein, 9 aa, Homo Sapiens
DLGLLQSGY

SEQ ID NO: 688968 - protein, 9 aa, Homo Sapiens
YNAVGALSK

SEQ ID NO: 688969 - protein, 9 aa, Homo Sapiens
TEVQTVMSE

SEQ ID NO: 688970 - protein, 9 aa, Homo Sapiens
QGSVGHDWS

SEQ ID NO: 688971 - protein, 9 aa, Homo Sapiens
NIIVFYGCQ

SEQ ID NO: 688972 - protein, 9 aa, Homo Sapiens
QGATGSAVK

SEQ ID NO: 688973 - protein, 9 aa, Homo Sapiens
DQRTLLMEA

SEQ ID NO: 688974 - protein, 9 aa, Homo Sapiens
YLKEKFLIS

SEQ ID NO: 688975 - protein, 9 aa, Homo Sapiens
VDKCQLQPN

SEQ ID NO: 688976 - protein, 9 aa, Homo Sapiens
ERGVQPAPF

SEQ ID NO: 688977 - protein, 9 aa, Homo Sapiens
CPSLEKAQI

SEQ ID NO: 688978 - protein, 9 aa, Homo Sapiens
HPHDVAGIQ

SEQ ID NO: 688979 - protein, 9 aa, Homo Sapiens
GKAFCHSPS

SEQ ID NO: 688980 - protein, 9 aa, Homo Sapiens
AKENKEGAR

SEQ ID NO: 688981 - protein, 9 aa, Homo Sapiens
ILFSTVSIS

SEQ ID NO: 688982 - protein, 9 aa, Homo Sapiens
ATILHLGKP

SEQ ID NO: 688983 - protein, 9 aa, Homo Sapiens
EEKRDIHRI

SEQ ID NO: 688984 - protein, 9 aa, Homo Sapiens
TVGPKAPLG

SEQ ID NO: 688985 - protein, 9 aa, Homo Sapiens
LLCPSLEKA

SEQ ID NO: 688986 - protein, 9 aa, Homo Sapiens
SFVCSSDNF

SEQ ID NO: 688987 - protein, 9 aa, Homo Sapiens
FSLMGLFRQ

SEQ ID NO: 688988 - protein, 9 aa, Homo Sapiens
STASSHFGG

SEQ ID NO: 688989 - protein, 9 aa, Homo Sapiens
LDLCDPSLD

SEQ ID NO: 688990 - protein, 9 aa, Homo Sapiens
QVVHRHSRK

SEQ ID NO: 688991 - protein, 9 aa, Homo Sapiens
FGGGGRMAT

SEQ ID NO: 688992 - protein, 9 aa, Homo Sapiens
LVSVWLLSS

SEQ ID NO: 688993 - protein, 9 aa, Homo Sapiens
IQLTGHSFS

SEQ ID NO: 688994 - protein, 9 aa, Homo Sapiens
DIERMVVAR

SEQ ID NO: 688995 - protein, 9 aa, Homo Sapiens
EPTNSSFNL

SEQ ID NO: 688996 - protein, 9 aa, Homo Sapiens
FVCSSDNFF

SEQ ID NO: 688997 - protein, 9 aa, Homo Sapiens
SGLAGCIYR

SEQ ID NO: 688998 - protein, 9 aa, Homo Sapiens
SAMAMCQHF

SEQ ID NO: 688999 - protein, 9 aa, Homo Sapiens
ERDISSSAT

SEQ ID NO: 689000 - protein, 9 aa, Homo Sapiens
VLRHELSLK

SEQ ID NO: 689001 - protein, 9 aa, Homo Sapiens
DTLVVVSWE

SEQ ID NO: 689002 - protein, 9 aa, Homo Sapiens
ISYYVCALQ

SEQ ID NO: 689003 - protein, 9 aa, Homo Sapiens
FHGLHQALL

SEQ ID NO: 689004 - protein, 9 aa, Homo Sapiens
MARRNWICE

SEQ ID NO: 689005 - protein, 9 aa, Homo Sapiens
GVYSFEPLC

SEQ ID NO: 689006 - protein, 9 aa, Homo Sapiens
GSPLCKERQ

SEQ ID NO: 689007 - protein, 9 aa, Homo Sapiens
VDKARQDYS

SEQ ID NO: 689008 - protein, 9 aa, Homo Sapiens
HLTREIQGI

SEQ ID NO: 689009 - protein, 9 aa, Homo Sapiens
ALGDRVSIL

SEQ ID NO: 689010 - protein, 9 aa, Homo Sapiens
FISASTWKM

SEQ ID NO: 689011 - protein, 9 aa, Homo Sapiens
SYYVCALQF

SEQ ID NO: 689012 - protein, 9 aa, Homo Sapiens
AANENSTLP

SEQ ID NO: 689013 - protein, 9 aa, Homo Sapiens
KKHNFAKPN

SEQ ID NO: 689014 - protein, 9 aa, Homo Sapiens
VPQEPGAPV

SEQ ID NO: 689015 - protein, 9 aa, Homo Sapiens
AVKAKKPKR

SEQ ID NO: 689016 - protein, 9 aa, Homo Sapiens
LSVKAIESY

SEQ ID NO: 689017 - protein, 9 aa, Homo Sapiens
GPRISYPIL

SEQ ID NO: 689018 - protein, 9 aa, Homo Sapiens
VALVEGVTC

SEQ ID NO: 689019 - protein, 9 aa, Homo Sapiens
RGGFAVKAK

SEQ ID NO: 689020 - protein, 9 aa, Homo Sapiens
TPKVVPPDP

SEQ ID NO: 689021 - protein, 9 aa, Homo Sapiens
NSQTRRSVS

SEQ ID NO: 689022 - protein, 9 aa, Homo Sapiens
TRGAVSLQG

SEQ ID NO: 689023 - protein, 9 aa, Homo Sapiens
GAMTAGPHA

SEQ ID NO: 689024 - protein, 9 aa, Homo Sapiens
GARNMIEVV

SEQ ID NO: 689025 - protein, 9 aa, Homo Sapiens
EMAKGVAEK

SEQ ID NO: 689026 - protein, 9 aa, Homo Sapiens
FRCIAGSAQ

SEQ ID NO: 689027 - protein, 9 aa, Homo Sapiens
GPPTEGGAH

SEQ ID NO: 689028 - protein, 9 aa, Homo Sapiens
TEKAFRAIL

SEQ ID NO: 689029 - protein, 9 aa, Homo Sapiens
SDFISMDPK

SEQ ID NO: 689030 - protein, 9 aa, Homo Sapiens
PECNFFTSV

SEQ ID NO: 689031 - protein, 9 aa, Homo Sapiens
TCSEDQRTL

SEQ ID NO: 689032 - protein, 9 aa, Homo Sapiens
ALCANSTLN

SEQ ID NO: 689033 - protein, 9 aa, Homo Sapiens
IEHVWLQKW

SEQ ID NO: 689034 - protein, 9 aa, Homo Sapiens
CAEGLCTKD

SEQ ID NO: 689035 - protein, 9 aa, Homo Sapiens
APVVEAVSS

SEQ ID NO: 689036 - protein, 9 aa, Homo Sapiens
PRFKVSQVI

SEQ ID NO: 689037 - protein, 9 aa, Homo Sapiens
YISDVAMNF

SEQ ID NO: 689038 - protein, 9 aa, Homo Sapiens
KEDFRRETD

SEQ ID NO: 689039 - protein, 9 aa, Homo Sapiens
AESHSQERI

SEQ ID NO: 689040 - protein, 9 aa, Homo Sapiens
SSEMGLHFF

SEQ ID NO: 689041 - protein, 9 aa, Homo Sapiens
TLEEFQHVL

SEQ ID NO: 689042 - protein, 9 aa, Homo Sapiens
LFYEQSKKC

SEQ ID NO: 689043 - protein, 9 aa, Homo Sapiens
KIPMRWTAP

SEQ ID NO: 689044 - protein, 9 aa, Homo Sapiens
HAAPSEAHE

SEQ ID NO: 689045 - protein, 9 aa, Homo Sapiens
DPNVDYQFT

SEQ ID NO: 689046 - protein, 9 aa, Homo Sapiens
PIPQLSGNS

SEQ ID NO: 689047 - protein, 9 aa, Homo Sapiens
NKGGEAEKM

SEQ ID NO: 689048 - protein, 9 aa, Homo Sapiens
VSVGDGLSK

SEQ ID NO: 689049 - protein, 9 aa, Homo Sapiens
ESNQQFRYL

SEQ ID NO: 689050 - protein, 9 aa, Homo Sapiens
PPGPYRLRL

SEQ ID NO: 689051 - protein, 9 aa, Homo Sapiens
RPPQLLERR

SEQ ID NO: 689052 - protein, 9 aa, Homo Sapiens
SPSDSSDPQ

SEQ ID NO: 689053 - protein, 9 aa, Homo Sapiens
PLLAAQSSR

SEQ ID NO: 689054 - protein, 9 aa, Homo Sapiens
NIYKNGDVC

SEQ ID NO: 689055 - protein, 9 aa, Homo Sapiens
TDNTRSLKA

SEQ ID NO: 689056 - protein, 9 aa, Homo Sapiens
YQERRMEKI

SEQ ID NO: 689057 - protein, 9 aa, Homo Sapiens
HDSLKLLQR

SEQ ID NO: 689058 - protein, 9 aa, Homo Sapiens
NESALWECE

SEQ ID NO: 689059 - protein, 9 aa, Homo Sapiens
HMEERFMAS

SEQ ID NO: 689060 - protein, 9 aa, Homo Sapiens
CLLCGSGNN

SEQ ID NO: 689061 - protein, 9 aa, Homo Sapiens
VAFTTFQII

SEQ ID NO: 689062 - protein, 9 aa, Homo Sapiens
EEAIEERKK

SEQ ID NO: 689063 - protein, 9 aa, Homo Sapiens
NSRKPAEPN

SEQ ID NO: 689064 - protein, 9 aa, Homo Sapiens
KPLIWIHRL

SEQ ID NO: 689065 - protein, 9 aa, Homo Sapiens
QTLEGTAVF

SEQ ID NO: 689066 - protein, 9 aa, Homo Sapiens
AIANPGSGE

SEQ ID NO: 689067 - protein, 9 aa, Homo Sapiens
ASYAVILCC

SEQ ID NO: 689068 - protein, 9 aa, Homo Sapiens
CALEFKYVK

SEQ ID NO: 689069 - protein, 9 aa, Homo Sapiens
PIHVQTSLR

SEQ ID NO: 689070 - protein, 9 aa, Homo Sapiens
ERHYEVGVV

SEQ ID NO: 689071 - protein, 9 aa, Homo Sapiens
LDRASPLGL

SEQ ID NO: 689072 - protein, 9 aa, Homo Sapiens
GDAPYSLVA

SEQ ID NO: 689073 - protein, 9 aa, Homo Sapiens
CPLPGTFAY

SEQ ID NO: 689074 - protein, 9 aa, Homo Sapiens
VSLEAVIAD

SEQ ID NO: 689075 - protein, 9 aa, Homo Sapiens
ARLYESEFH

SEQ ID NO: 689076 - protein, 9 aa, Homo Sapiens
HWYQKAIVS

SEQ ID NO: 689077 - protein, 9 aa, Homo Sapiens
PAHKANPFY

SEQ ID NO: 689078 - protein, 9 aa, Homo Sapiens
TRYGKSGHD

SEQ ID NO: 689079 - protein, 9 aa, Homo Sapiens
KTPPRWTED

SEQ ID NO: 689080 - protein, 9 aa, Homo Sapiens
SLRRELHMV

SEQ ID NO: 689081 - protein, 9 aa, Homo Sapiens
LLGLAPGQP

SEQ ID NO: 689082 - protein, 9 aa, Homo Sapiens
HSILMIDEM

SEQ ID NO: 689083 - protein, 9 aa, Homo Sapiens
TPLPVTITS

SEQ ID NO: 689084 - protein, 9 aa, Homo Sapiens
PVPLPPCTP

SEQ ID NO: 689085 - protein, 9 aa, Homo Sapiens
TKQACRCLI

SEQ ID NO: 689086 - protein, 9 aa, Homo Sapiens
RNHEELNKL

SEQ ID NO: 689087 - protein, 9 aa, Homo Sapiens
WKLVMNTMD

SEQ ID NO: 689088 - protein, 9 aa, Homo Sapiens
DAEDYDRRA

SEQ ID NO: 689089 - protein, 9 aa, Homo Sapiens
HRWSLSCSF

SEQ ID NO: 689090 - protein, 9 aa, Homo Sapiens
MSCTECQNR

SEQ ID NO: 689091 - protein, 9 aa, Homo Sapiens
NIFCYRIFS

SEQ ID NO: 689092 - protein, 9 aa, Homo Sapiens
ARTLIMMFL

SEQ ID NO: 689093 - protein, 9 aa, Homo Sapiens
YVQAEILNS

SEQ ID NO: 689094 - protein, 9 aa, Homo Sapiens
EHRRGPGQK

SEQ ID NO: 689095 - protein, 9 aa, Homo Sapiens
HHIYCDTIT

SEQ ID NO: 689096 - protein, 9 aa, Homo Sapiens
HVDDFAESW

SEQ ID NO: 689097 - protein, 9 aa, Homo Sapiens
HTATNFLIL

SEQ ID NO: 689098 - protein, 9 aa, Homo Sapiens
IMAKTAANR

SEQ ID NO: 689099 - protein, 9 aa, Homo Sapiens
RATNMLGSG

SEQ ID NO: 689100 - protein, 9 aa, Homo Sapiens
GDAGGLAVG

SEQ ID NO: 689101 - protein, 9 aa, Homo Sapiens
LTHMDLSIS

SEQ ID NO: 689102 - protein, 9 aa, Homo Sapiens
LTWDEEADF

SEQ ID NO: 689103 - protein, 9 aa, Homo Sapiens
FNWHSGYRW

SEQ ID NO: 689104 - protein, 9 aa, Homo Sapiens
IFGQDRATA

SEQ ID NO: 689105 - protein, 9 aa, Homo Sapiens
TKAYSRQGA

SEQ ID NO: 689106 - protein, 9 aa, Homo Sapiens
SSFLGGGSS

SEQ ID NO: 689107 - protein, 9 aa, Homo Sapiens
LSRNPKKPK

SEQ ID NO: 689108 - protein, 9 aa, Homo Sapiens
SEVEPKHYA

SEQ ID NO: 689109 - protein, 9 aa, Homo Sapiens
DRQAESHSQ

SEQ ID NO: 689110 - protein, 9 aa, Homo Sapiens
RKLQVDMTF

SEQ ID NO: 689111 - protein, 9 aa, Homo Sapiens
EGTAVFVHA

SEQ ID NO: 689112 - protein, 9 aa, Homo Sapiens
LFTALGQVC

SEQ ID NO: 689113 - protein, 9 aa, Homo Sapiens
KIVDIDDPE

SEQ ID NO: 689114 - protein, 9 aa, Homo Sapiens
NRRNVKQNQ

SEQ ID NO: 689115 - protein, 9 aa, Homo Sapiens
IGAELSVLE

SEQ ID NO: 689116 - protein, 9 aa, Homo Sapiens
PKDPCLRGE

SEQ ID NO: 689117 - protein, 9 aa, Homo Sapiens
RKNYSKVQI

SEQ ID NO: 689118 - protein, 9 aa, Homo Sapiens
TDMDSLRED

SEQ ID NO: 689119 - protein, 9 aa, Homo Sapiens
PQTKLVLST

SEQ ID NO: 689120 - protein, 9 aa, Homo Sapiens
KDSSMGRQE

SEQ ID NO: 689121 - protein, 9 aa, Homo Sapiens
LSRHHHVVR

SEQ ID NO: 689122 - protein, 9 aa, Homo Sapiens
ARRNWICEN

SEQ ID NO: 689123 - protein, 9 aa, Homo Sapiens
DVDKCQLQP

SEQ ID NO: 689124 - protein, 9 aa, Homo Sapiens
TVLSRHHHV

SEQ ID NO: 689125 - protein, 9 aa, Homo Sapiens
LHPHDVAGI

SEQ ID NO: 689126 - protein, 9 aa, Homo Sapiens
ASIKKEQKT

SEQ ID NO: 689127 - protein, 9 aa, Homo Sapiens
DPNDSSFTL

SEQ ID NO: 689128 - protein, 9 aa, Homo Sapiens
SARPLSSEK

SEQ ID NO: 689129 - protein, 9 aa, Homo Sapiens
LHCWKGRTA

SEQ ID NO: 689130 - protein, 9 aa, Homo Sapiens
FRTNKTLHS

SEQ ID NO: 689131 - protein, 9 aa, Homo Sapiens
TYIHTMNAM

SEQ ID NO: 689132 - protein, 9 aa, Homo Sapiens
MAVKTLLLK

SEQ ID NO: 689133 - protein, 9 aa, Homo Sapiens
LTNIEVPKT

SEQ ID NO: 689134 - protein, 9 aa, Homo Sapiens
SSEQAHPSA

SEQ ID NO: 689135 - protein, 9 aa, Homo Sapiens
DYKINIPTH

SEQ ID NO: 689136 - protein, 9 aa, Homo Sapiens
VLHLRRSRE

SEQ ID NO: 689137 - protein, 9 aa, Homo Sapiens
GKISNFLVE

SEQ ID NO: 689138 - protein, 9 aa, Homo Sapiens
SMGRQEEPP

SEQ ID NO: 689139 - protein, 9 aa, Homo Sapiens
ATPSTFAIT

SEQ ID NO: 689140 - protein, 9 aa, Homo Sapiens
YGYVTMLNA

SEQ ID NO: 689141 - protein, 9 aa, Homo Sapiens
APDIGVFRC

SEQ ID NO: 689142 - protein, 9 aa, Homo Sapiens
LSISHKNTQ

SEQ ID NO: 689143 - protein, 9 aa, Homo Sapiens
NSDAVLTLF

SEQ ID NO: 689144 - protein, 9 aa, Homo Sapiens
INSGSTCSE

SEQ ID NO: 689145 - protein, 9 aa, Homo Sapiens
IAWISTMPF

SEQ ID NO: 689146 - protein, 9 aa, Homo Sapiens
QQAKCENPE

SEQ ID NO: 689147 - protein, 9 aa, Homo Sapiens
RLFFNWFYW

SEQ ID NO: 689148 - protein, 9 aa, Homo Sapiens
LPLDPVETP

SEQ ID NO: 689149 - protein, 9 aa, Homo Sapiens
YFPVAKGQS

SEQ ID NO: 689150 - protein, 9 aa, Homo Sapiens
KDRVSETSS

SEQ ID NO: 689151 - protein, 9 aa, Homo Sapiens
EHAAPSEAH

SEQ ID NO: 689152 - protein, 9 aa, Homo Sapiens
YEYLFKAYV

SEQ ID NO: 689153 - protein, 9 aa, Homo Sapiens
PKKGSQVVH

SEQ ID NO: 689154 - protein, 9 aa, Homo Sapiens
LDLSENAMQ

SEQ ID NO: 689155 - protein, 9 aa, Homo Sapiens
RWLAEKKQQ

SEQ ID NO: 689156 - protein, 9 aa, Homo Sapiens
RFKKVQFKL

SEQ ID NO: 689157 - protein, 9 aa, Homo Sapiens
GETEGPNSS

SEQ ID NO: 689158 - protein, 9 aa, Homo Sapiens
QQALSCFLH

SEQ ID NO: 689159 - protein, 9 aa, Homo Sapiens
SLMGLFRQS

SEQ ID NO: 689160 - protein, 9 aa, Homo Sapiens
SKPLIWIHR

SEQ ID NO: 689161 - protein, 9 aa, Homo Sapiens
KHRVHVIEQ

SEQ ID NO: 689162 - protein, 9 aa, Homo Sapiens
CPEVAPPNR

SEQ ID NO: 689163 - protein, 9 aa, Homo Sapiens
RQTPEFQQF

SEQ ID NO: 689164 - protein, 9 aa, Homo Sapiens
AVFPLSNGN

SEQ ID NO: 689165 - protein, 9 aa, Homo Sapiens
LFVVHRSDK

SEQ ID NO: 689166 - protein, 9 aa, Homo Sapiens
TACLDFLWR

SEQ ID NO: 689167 - protein, 9 aa, Homo Sapiens
RKSNGPNTT

SEQ ID NO: 689168 - protein, 9 aa, Homo Sapiens
SVHDAMLFA

SEQ ID NO: 689169 - protein, 9 aa, Homo Sapiens
TQGLSNVQK

SEQ ID NO: 689170 - protein, 9 aa, Homo Sapiens
TLHCYQELP

SEQ ID NO: 689171 - protein, 9 aa, Homo Sapiens
HTPDQDKAV

SEQ ID NO: 689172 - protein, 9 aa, Homo Sapiens
FHIIRKNVE

SEQ ID NO: 689173 - protein, 9 aa, Homo Sapiens
HEINLLPLA

SEQ ID NO: 689174 - protein, 9 aa, Homo Sapiens
SQVHSCLEG

SEQ ID NO: 689175 - protein, 9 aa, Homo Sapiens
PLGDPSNLN

SEQ ID NO: 689176 - protein, 9 aa, Homo Sapiens
QHTNTTGRR

SEQ ID NO: 689177 - protein, 9 aa, Homo Sapiens
IHPQFLADV

SEQ ID NO: 689178 - protein, 9 aa, Homo Sapiens
VFPLSNGNS

SEQ ID NO: 689179 - protein, 9 aa, Homo Sapiens
IPISKKSKD

SEQ ID NO: 689180 - protein, 9 aa, Homo Sapiens
SGAGGSGTG

SEQ ID NO: 689181 - protein, 9 aa, Homo Sapiens
EIWEQEDLN

SEQ ID NO: 689182 - protein, 9 aa, Homo Sapiens
RAPMSNYIM

SEQ ID NO: 689183 - protein, 9 aa, Homo Sapiens
FGTQLVGTQ

SEQ ID NO: 689184 - protein, 9 aa, Homo Sapiens
APFLQTQFP

SEQ ID NO: 689185 - protein, 9 aa, Homo Sapiens
NFIGGVDMV

SEQ ID NO: 689186 - protein, 9 aa, Homo Sapiens
SLGTLHGTI

SEQ ID NO: 689187 - protein, 9 aa, Homo Sapiens
GPPAAASAR

SEQ ID NO: 689188 - protein, 9 aa, Homo Sapiens
DDMADEVAN

SEQ ID NO: 689189 - protein, 9 aa, Homo Sapiens
EGKGQEKIQ

SEQ ID NO: 689190 - protein, 9 aa, Homo Sapiens
KQITPYVRF

SEQ ID NO: 689191 - protein, 9 aa, Homo Sapiens
FHDGRPVPI

SEQ ID NO: 689192 - protein, 9 aa, Homo Sapiens
ESFLRGTTF

SEQ ID NO: 689193 - protein, 9 aa, Homo Sapiens
ALDTHYWTS

SEQ ID NO: 689194 - protein, 9 aa, Homo Sapiens
VEGVTCMSE

SEQ ID NO: 689195 - protein, 9 aa, Homo Sapiens
RFENFLEDS

SEQ ID NO: 689196 - protein, 9 aa, Homo Sapiens
ISASTWKME

SEQ ID NO: 689197 - protein, 9 aa, Homo Sapiens
VHGLRRRAA

SEQ ID NO: 689198 - protein, 9 aa, Homo Sapiens
ERHLCVRQL

SEQ ID NO: 689199 - protein, 9 aa, Homo Sapiens
LIKVVRHSK

SEQ ID NO: 689200 - protein, 9 aa, Homo Sapiens
TCKDEMGKQ

SEQ ID NO: 689201 - protein, 9 aa, Homo Sapiens
IDDKDFVLN

SEQ ID NO: 689202 - protein, 9 aa, Homo Sapiens
DYLEDEGDS

SEQ ID NO: 689203 - protein, 9 aa, Homo Sapiens
CLQPLLSCS

SEQ ID NO: 689204 - protein, 9 aa, Homo Sapiens
FWKLIPLPK

SEQ ID NO: 689205 - protein, 9 aa, Homo Sapiens
LNANFLDHF

SEQ ID NO: 689206 - protein, 9 aa, Homo Sapiens
ALRIHMEER

SEQ ID NO: 689207 - protein, 9 aa, Homo Sapiens
SRKSRPCIW

SEQ ID NO: 689208 - protein, 9 aa, Homo Sapiens
DNSFLLDRL

SEQ ID NO: 689209 - protein, 9 aa, Homo Sapiens
LLKDIVTQS

SEQ ID NO: 689210 - protein, 9 aa, Homo Sapiens
SQSLGQNWS

SEQ ID NO: 689211 - protein, 9 aa, Homo Sapiens
TLANDKITH

SEQ ID NO: 689212 - protein, 9 aa, Homo Sapiens
LLEYDKEPC

SEQ ID NO: 689213 - protein, 9 aa, Homo Sapiens
KITVNCSPI

SEQ ID NO: 689214 - protein, 9 aa, Homo Sapiens
CSIPRAEGI

SEQ ID NO: 689215 - protein, 9 aa, Homo Sapiens
TYVQVQPST

SEQ ID NO: 689216 - protein, 9 aa, Homo Sapiens
YEAFYKVSL

SEQ ID NO: 689217 - protein, 9 aa, Homo Sapiens
DDPISLLYN

SEQ ID NO: 689218 - protein, 9 aa, Homo Sapiens
TVIIPCRLD

SEQ ID NO: 689219 - protein, 9 aa, Homo Sapiens
STVSISLAL

SEQ ID NO: 689220 - protein, 9 aa, Homo Sapiens
RSSVHHCSI

SEQ ID NO: 689221 - protein, 9 aa, Homo Sapiens
VPEIRKEEV

SEQ ID NO: 689222 - protein, 9 aa, Homo Sapiens
EILDSENLN

SEQ ID NO: 689223 - protein, 9 aa, Homo Sapiens
VLATAKVMV

SEQ ID NO: 689224 - protein, 9 aa, Homo Sapiens
LQPETEGGG

SEQ ID NO: 689225 - protein, 9 aa, Homo Sapiens
SSVDASEHT

SEQ ID NO: 689226 - protein, 9 aa, Homo Sapiens
KGNLTEQDP

SEQ ID NO: 689227 - protein, 9 aa, Homo Sapiens
SRMVCTMLS

SEQ ID NO: 689228 - protein, 9 aa, Homo Sapiens
SFMKMLRSM

SEQ ID NO: 689229 - protein, 9 aa, Homo Sapiens
AKPGREDSR

SEQ ID NO: 689230 - protein, 9 aa, Homo Sapiens
NILFSTVSI

SEQ ID NO: 689231 - protein, 9 aa, Homo Sapiens
QQMPPPRVF

SEQ ID NO: 689232 - protein, 9 aa, Homo Sapiens
PEIAWISTM

SEQ ID NO: 689233 - protein, 9 aa, Homo Sapiens
FIVKKTLTH

SEQ ID NO: 689234 - protein, 9 aa, Homo Sapiens
AEQKEAKFK

SEQ ID NO: 689235 - protein, 9 aa, Homo Sapiens
ELLAWRGWD

SEQ ID NO: 689236 - protein, 9 aa, Homo Sapiens
GLQNSLAAS

SEQ ID NO: 689237 - protein, 9 aa, Homo Sapiens
AVEACVVHG

SEQ ID NO: 689238 - protein, 9 aa, Homo Sapiens
FEHLLAKDL

SEQ ID NO: 689239 - protein, 9 aa, Homo Sapiens
HEGFHEREG

SEQ ID NO: 689240 - protein, 9 aa, Homo Sapiens
GSQVVHRHS

SEQ ID NO: 689241 - protein, 9 aa, Homo Sapiens
MHSPPAAWP

SEQ ID NO: 689242 - protein, 9 aa, Homo Sapiens
NVSEIYRCY

SEQ ID NO: 689243 - protein, 9 aa, Homo Sapiens
ETVEEYKDE

SEQ ID NO: 689244 - protein, 9 aa, Homo Sapiens
ECMSSYFRE

SEQ ID NO: 689245 - protein, 9 aa, Homo Sapiens
KDKTPSVSS

SEQ ID NO: 689246 - protein, 9 aa, Homo Sapiens
SGETEGPNS

SEQ ID NO: 689247 - protein, 9 aa, Homo Sapiens
GQRRACYRW

SEQ ID NO: 689248 - protein, 9 aa, Homo Sapiens
KMGGFHCMQ

SEQ ID NO: 689249 - protein, 9 aa, Homo Sapiens
GRDVEGYYP

SEQ ID NO: 689250 - protein, 9 aa, Homo Sapiens
TKDKIVDID

SEQ ID NO: 689251 - protein, 9 aa, Homo Sapiens
TSLHVDDRE

SEQ ID NO: 689252 - protein, 9 aa, Homo Sapiens
AQDLKTDLR

SEQ ID NO: 689253 - protein, 9 aa, Homo Sapiens
VDELYLEPL

SEQ ID NO: 689254 - protein, 9 aa, Homo Sapiens
VLMRDMCVV

SEQ ID NO: 689255 - protein, 9 aa, Homo Sapiens
VNSQKPGLI

SEQ ID NO: 689256 - protein, 9 aa, Homo Sapiens
NSAYGDTVI

SEQ ID NO: 689257 - protein, 9 aa, Homo Sapiens
TDLISPRKM

SEQ ID NO: 689258 - protein, 9 aa, Homo Sapiens
LETWAVPVV

SEQ ID NO: 689259 - protein, 9 aa, Homo Sapiens
PKTSNRERS

SEQ ID NO: 689260 - protein, 9 aa, Homo Sapiens
QNKLKVPES

SEQ ID NO: 689261 - protein, 9 aa, Homo Sapiens
PAGPPGESG

SEQ ID NO: 689262 - protein, 9 aa, Homo Sapiens
QVNAIDKRI

SEQ ID NO: 689263 - protein, 9 aa, Homo Sapiens
SCCDTHTNQ

SEQ ID NO: 689264 - protein, 9 aa, Homo Sapiens
KCQLQPNAC

SEQ ID NO: 689265 - protein, 9 aa, Homo Sapiens
SVNTENLQQ

SEQ ID NO: 689266 - protein, 9 aa, Homo Sapiens
KPMLFERHL

SEQ ID NO: 689267 - protein, 9 aa, Homo Sapiens
ETVGVSNPH

SEQ ID NO: 689268 - protein, 9 aa, Homo Sapiens
VVRKTDAVY

SEQ ID NO: 689269 - protein, 9 aa, Homo Sapiens
LIENAQERS

SEQ ID NO: 689270 - protein, 9 aa, Homo Sapiens
LASHTDDSL

SEQ ID NO: 689271 - protein, 9 aa, Homo Sapiens
PLPPAYYRY

SEQ ID NO: 689272 - protein, 9 aa, Homo Sapiens
SFTGAYTSG

SEQ ID NO: 689273 - protein, 9 aa, Homo Sapiens
LHLKQVLTT

SEQ ID NO: 689274 - protein, 9 aa, Homo Sapiens
EGGREPPKD

SEQ ID NO: 689275 - protein, 9 aa, Homo Sapiens
NLQEFWDNF

SEQ ID NO: 689276 - protein, 9 aa, Homo Sapiens
CRHKMDTFL

SEQ ID NO: 689277 - protein, 9 aa, Homo Sapiens
ARPLSSEKA

SEQ ID NO: 689278 - protein, 9 aa, Homo Sapiens
ELIENAQER

SEQ ID NO: 689279 - protein, 9 aa, Homo Sapiens
SGRGRQEAA

SEQ ID NO: 689280 - protein, 9 aa, Homo Sapiens
HRAGIRMFA

SEQ ID NO: 689281 - protein, 9 aa, Homo Sapiens
PGPSRLPAA

SEQ ID NO: 689282 - protein, 9 aa, Homo Sapiens
SFLRGTTFY

SEQ ID NO: 689283 - protein, 9 aa, Homo Sapiens
DAGGLAVGG

SEQ ID NO: 689284 - protein, 9 aa, Homo Sapiens
VSEIYRCYG

SEQ ID NO: 689285 - protein, 9 aa, Homo Sapiens
PPTSRGSSL

SEQ ID NO: 689286 - protein, 9 aa, Homo Sapiens
YRCVCPTGY

SEQ ID NO: 689287 - protein, 9 aa, Homo Sapiens
DAPYSLVAV

SEQ ID NO: 689288 - protein, 9 aa, Homo Sapiens
TFGNLNVGY

SEQ ID NO: 689289 - protein, 9 aa, Homo Sapiens
ILQNSSARA

SEQ ID NO: 689290 - protein, 9 aa, Homo Sapiens
LPVTITSSA

SEQ ID NO: 689291 - protein, 9 aa, Homo Sapiens
HKYKHRVHV

SEQ ID NO: 689292 - protein, 9 aa, Homo Sapiens
IQKWSMERL

SEQ ID NO: 689293 - protein, 9 aa, Homo Sapiens
PRRVSRCTP

SEQ ID NO: 689294 - protein, 9 aa, Homo Sapiens
KQLDDKEVS

SEQ ID NO: 689295 - protein, 9 aa, Homo Sapiens
EEITKESLE

SEQ ID NO: 689296 - protein, 9 aa, Homo Sapiens
YKIFERDLK

SEQ ID NO: 689297 - protein, 9 aa, Homo Sapiens
QLVKYQNEY

SEQ ID NO: 689298 - protein, 9 aa, Homo Sapiens
TGKALDRAS

SEQ ID NO: 689299 - protein, 9 aa, Homo Sapiens
LAPAQISGL

SEQ ID NO: 689300 - protein, 9 aa, Homo Sapiens
RTKEKAKQK

SEQ ID NO: 689301 - protein, 9 aa, Homo Sapiens
DPISLLYNM

SEQ ID NO: 689302 - protein, 9 aa, Homo Sapiens
QVLEHEIEI

SEQ ID NO: 689303 - protein, 9 aa, Homo Sapiens
QGGGRKPFP

SEQ ID NO: 689304 - protein, 9 aa, Homo Sapiens
RGTTFYADQ

SEQ ID NO: 689305 - protein, 9 aa, Homo Sapiens
QKVSEKETI

SEQ ID NO: 689306 - protein, 9 aa, Homo Sapiens
EASLQTGMM

SEQ ID NO: 689307 - protein, 9 aa, Homo Sapiens
NIQTNNNKS

SEQ ID NO: 689308 - protein, 9 aa, Homo Sapiens
PSLSKSKAG

SEQ ID NO: 689309 - protein, 9 aa, Homo Sapiens
PSETCRPPL

SEQ ID NO: 689310 - protein, 9 aa, Homo Sapiens
YVEVTDAED

SEQ ID NO: 689311 - protein, 9 aa, Homo Sapiens
ENQTPLWVT

SEQ ID NO: 689312 - protein, 9 aa, Homo Sapiens
PGESGGKGS

SEQ ID NO: 689313 - protein, 9 aa, Homo Sapiens
ERKREENRL

SEQ ID NO: 689314 - protein, 9 aa, Homo Sapiens
TITVSDKAY

SEQ ID NO: 689315 - protein, 9 aa, Homo Sapiens
DILGNNGYV

SEQ ID NO: 689316 - protein, 9 aa, Homo Sapiens
DKTIVLPPL

SEQ ID NO: 689317 - protein, 9 aa, Homo Sapiens
DYMISVKTH

SEQ ID NO: 689318 - protein, 9 aa, Homo Sapiens
AEGGTESKT

SEQ ID NO: 689319 - protein, 9 aa, Homo Sapiens
DSGVRCKDI

SEQ ID NO: 689320 - protein, 9 aa, Homo Sapiens
SKTLQFKAQ

SEQ ID NO: 689321 - protein, 9 aa, Homo Sapiens
RQQMPPPRV

SEQ ID NO: 689322 - protein, 9 aa, Homo Sapiens
WVQHSIWEN

SEQ ID NO: 689323 - protein, 9 aa, Homo Sapiens
RLDLSENAM

SEQ ID NO: 689324 - protein, 9 aa, Homo Sapiens
PVMVPAQSE

SEQ ID NO: 689325 - protein, 9 aa, Homo Sapiens
QTPESLRQN

SEQ ID NO: 689326 - protein, 9 aa, Homo Sapiens
SVARLVGQQ

SEQ ID NO: 689327 - protein, 9 aa, Homo Sapiens
EDADTNQQD

SEQ ID NO: 689328 - protein, 9 aa, Homo Sapiens
NRTIEFGEA

SEQ ID NO: 689329 - protein, 9 aa, Homo Sapiens
LAEMTSTVI

SEQ ID NO: 689330 - protein, 9 aa, Homo Sapiens
LHLTKQTPK

SEQ ID NO: 689331 - protein, 9 aa, Homo Sapiens
QIKIWFHNR

SEQ ID NO: 689332 - protein, 9 aa, Homo Sapiens
SCSGCKRIL

SEQ ID NO: 689333 - protein, 9 aa, Homo Sapiens
VYEESLGED

SEQ ID NO: 689334 - protein, 9 aa, Homo Sapiens
QISEVEPKH

SEQ ID NO: 689335 - protein, 9 aa, Homo Sapiens
EASSNQEGK

SEQ ID NO: 689336 - protein, 9 aa, Homo Sapiens
QEHTILTHK

SEQ ID NO: 689337 - protein, 9 aa, Homo Sapiens
TNQQDGGFA

SEQ ID NO: 689338 - protein, 9 aa, Homo Sapiens
PNIYKNGDV

SEQ ID NO: 689339 - protein, 9 aa, Homo Sapiens
KTVPQEPGA

SEQ ID NO: 689340 - protein, 9 aa, Homo Sapiens
DGRPVPIER

SEQ ID NO: 689341 - protein, 9 aa, Homo Sapiens
GSRARGCKR

SEQ ID NO: 689342 - protein, 9 aa, Homo Sapiens
DVLSPPRGK

SEQ ID NO: 689343 - protein, 9 aa, Homo Sapiens
WICENQEAQ

SEQ ID NO: 689344 - protein, 9 aa, Homo Sapiens
FWTIWSRAR

SEQ ID NO: 689345 - protein, 9 aa, Homo Sapiens
RFMKLDAQR

SEQ ID NO: 689346 - protein, 9 aa, Homo Sapiens
EAYNIDDTC

SEQ ID NO: 689347 - protein, 9 aa, Homo Sapiens
EAPPLPPAY

SEQ ID NO: 689348 - protein, 9 aa, Homo Sapiens
GLTSFPDLN

SEQ ID NO: 689349 - protein, 9 aa, Homo Sapiens
VGNWSVCST

SEQ ID NO: 689350 - protein, 9 aa, Homo Sapiens
KPWEGCLHC

SEQ ID NO: 689351 - protein, 9 aa, Homo Sapiens
HSFSTDAAG

SEQ ID NO: 689352 - protein, 9 aa, Homo Sapiens
LDHFFCEVP

SEQ ID NO: 689353 - protein, 9 aa, Homo Sapiens
SKTPVDDPI

SEQ ID NO: 689354 - protein, 9 aa, Homo Sapiens
PKSRLRESK

SEQ ID NO: 689355 - protein, 9 aa, Homo Sapiens
QAESHSQER

SEQ ID NO: 689356 - protein, 9 aa, Homo Sapiens
EEVEQQADN

SEQ ID NO: 689357 - protein, 9 aa, Homo Sapiens
QAVQEAFEL

SEQ ID NO: 689358 - protein, 9 aa, Homo Sapiens
YVQVQPSTE

SEQ ID NO: 689359 - protein, 9 aa, Homo Sapiens
AGPPGESGG

SEQ ID NO: 689360 - protein, 9 aa, Homo Sapiens
TINSALYTT

SEQ ID NO: 689361 - protein, 9 aa, Homo Sapiens
SGSTCSESE

SEQ ID NO: 689362 - protein, 9 aa, Homo Sapiens
SPSQSVPAH

SEQ ID NO: 689363 - protein, 9 aa, Homo Sapiens
HFTCNHRVH

SEQ ID NO: 689364 - protein, 9 aa, Homo Sapiens
LCLDIHNMS

SEQ ID NO: 689365 - protein, 9 aa, Homo Sapiens
AHLAEEAGF

SEQ ID NO: 689366 - protein, 9 aa, Homo Sapiens
EYPGKQVAG

SEQ ID NO: 689367 - protein, 9 aa, Homo Sapiens
KAFRAILSK

SEQ ID NO: 689368 - protein, 9 aa, Homo Sapiens
EKAKCRPLR

SEQ ID NO: 689369 - protein, 9 aa, Homo Sapiens
LSRVCRHKM

SEQ ID NO: 689370 - protein, 9 aa, Homo Sapiens
GTFAYRKLC

SEQ ID NO: 689371 - protein, 9 aa, Homo Sapiens
LLAISCCDT

SEQ ID NO: 689372 - protein, 9 aa, Homo Sapiens
FMFKVIGAN

SEQ ID NO: 689373 - protein, 9 aa, Homo Sapiens
VSTSDECYY

SEQ ID NO: 689374 - protein, 9 aa, Homo Sapiens
ACEFYMCDH

SEQ ID NO: 689375 - protein, 9 aa, Homo Sapiens
ETSLQTLHR

SEQ ID NO: 689376 - protein, 9 aa, Homo Sapiens
SGEFQIAKK

SEQ ID NO: 689377 - protein, 9 aa, Homo Sapiens
KGPNQALLE

SEQ ID NO: 689378 - protein, 9 aa, Homo Sapiens
HMDLSISHK

SEQ ID NO: 689379 - protein, 9 aa, Homo Sapiens
GVAGYLIAG

SEQ ID NO: 689380 - protein, 9 aa, Homo Sapiens
MKQGSEKEK

SEQ ID NO: 689381 - protein, 9 aa, Homo Sapiens
VTDPSIPIS

SEQ ID NO: 689382 - protein, 9 aa, Homo Sapiens
PLLELTAYK

SEQ ID NO: 689383 - protein, 9 aa, Homo Sapiens
RADFDDYTG

SEQ ID NO: 689384 - protein, 9 aa, Homo Sapiens
LPLSMLKGK

SEQ ID NO: 689385 - protein, 9 aa, Homo Sapiens
EYSGFATDS

SEQ ID NO: 689386 - protein, 9 aa, Homo Sapiens
TLHGTICDP

SEQ ID NO: 689387 - protein, 9 aa, Homo Sapiens
CTEDVDKCQ

SEQ ID NO: 689388 - protein, 9 aa, Homo Sapiens
VEVSAPLGI

SEQ ID NO: 689389 - protein, 9 aa, Homo Sapiens
SGVAHTDAS

SEQ ID NO: 689390 - protein, 9 aa, Homo Sapiens
HNLVEYLRL

SEQ ID NO: 689391 - protein, 9 aa, Homo Sapiens
IAELLFSIR

SEQ ID NO: 689392 - protein, 9 aa, Homo Sapiens
KECQKHFED

SEQ ID NO: 689393 - protein, 9 aa, Homo Sapiens
HDSIDDTLE

SEQ ID NO: 689394 - protein, 9 aa, Homo Sapiens
KSQKRIMPD

SEQ ID NO: 689395 - protein, 9 aa, Homo Sapiens
GSGRIPRAV

SEQ ID NO: 689396 - protein, 9 aa, Homo Sapiens
ITLLGPCVL

SEQ ID NO: 689397 - protein, 9 aa, Homo Sapiens
SRDPFWNTM

SEQ ID NO: 689398 - protein, 9 aa, Homo Sapiens
RTLMERVQT

SEQ ID NO: 689399 - protein, 9 aa, Homo Sapiens
KSAEVTLAE

SEQ ID NO: 689400 - protein, 9 aa, Homo Sapiens
TSFLHVYDG

SEQ ID NO: 689401 - protein, 9 aa, Homo Sapiens
RTEVLGSVG

SEQ ID NO: 689402 - protein, 9 aa, Homo Sapiens
EPLPPGTTE

SEQ ID NO: 689403 - protein, 9 aa, Homo Sapiens
PPVQPVAPH

SEQ ID NO: 689404 - protein, 9 aa, Homo Sapiens
ADFDDYTGR

SEQ ID NO: 689405 - protein, 9 aa, Homo Sapiens
SKKVCSVCN

SEQ ID NO: 689406 - protein, 9 aa, Homo Sapiens
IDQENNKTK

SEQ ID NO: 689407 - protein, 9 aa, Homo Sapiens
QGSRQILTC

SEQ ID NO: 689408 - protein, 9 aa, Homo Sapiens
ARQDYSESI

SEQ ID NO: 689409 - protein, 9 aa, Homo Sapiens
VFRQYHGTW

SEQ ID NO: 689410 - protein, 9 aa, Homo Sapiens
IEIQGLLQS

SEQ ID NO: 689411 - protein, 9 aa, Homo Sapiens
ESRQYDDII

SEQ ID NO: 689412 - protein, 9 aa, Homo Sapiens
HQDYLCSLH

SEQ ID NO: 689413 - protein, 9 aa, Homo Sapiens
LSVDGRLSG

SEQ ID NO: 689414 - protein, 9 aa, Homo Sapiens
HCMQRDVQD

SEQ ID NO: 689415 - protein, 9 aa, Homo Sapiens
NPECNFFTS

SEQ ID NO: 689416 - protein, 9 aa, Homo Sapiens
INWVQHSIW

SEQ ID NO: 689417 - protein, 9 aa, Homo Sapiens
FRRTICRLE

SEQ ID NO: 689418 - protein, 9 aa, Homo Sapiens
VPIERVKKN

SEQ ID NO: 689419 - protein, 9 aa, Homo Sapiens
TPNYVAPKV

SEQ ID NO: 689420 - protein, 9 aa, Homo Sapiens
LGIFEWLCD

SEQ ID NO: 689421 - protein, 9 aa, Homo Sapiens
SRIVDELYL

SEQ ID NO: 689422 - protein, 9 aa, Homo Sapiens
LRKAQALAE

SEQ ID NO: 689423 - protein, 9 aa, Homo Sapiens
PGQTLLPTM

SEQ ID NO: 689424 - protein, 9 aa, Homo Sapiens
PNSSLRKRP

SEQ ID NO: 689425 - protein, 9 aa, Homo Sapiens
VNELIENAQ

SEQ ID NO: 689426 - protein, 9 aa, Homo Sapiens
FLPLYISDV

SEQ ID NO: 689427 - protein, 9 aa, Homo Sapiens
ANRRNVKQN

SEQ ID NO: 689428 - protein, 9 aa, Homo Sapiens
TNSSFNLSV

SEQ ID NO: 689429 - protein, 9 aa, Homo Sapiens
ALDRASPLG

SEQ ID NO: 689430 - protein, 9 aa, Homo Sapiens
PTSRGSSLQ

SEQ ID NO: 689431 - protein, 9 aa, Homo Sapiens
YMQISGQRA

SEQ ID NO: 689432 - protein, 9 aa, Homo Sapiens
IQNKERLST

SEQ ID NO: 689433 - protein, 9 aa, Homo Sapiens
LVSNLNEQM

SEQ ID NO: 689434 - protein, 9 aa, Homo Sapiens
DKEGIPPTS

SEQ ID NO: 689435 - protein, 9 aa, Homo Sapiens
SPKEVMDVI

SEQ ID NO: 689436 - protein, 9 aa, Homo Sapiens
LVLTPAVCA

SEQ ID NO: 689437 - protein, 9 aa, Homo Sapiens
FKKVQFKLN

SEQ ID NO: 689438 - protein, 9 aa, Homo Sapiens
MRRKSLRSG

SEQ ID NO: 689439 - protein, 9 aa, Homo Sapiens
LKRKDIKSI

SEQ ID NO: 689440 - protein, 9 aa, Homo Sapiens
FIVSPVPKS

SEQ ID NO: 689441 - protein, 9 aa, Homo Sapiens
CPTNCHMNL

SEQ ID NO: 689442 - protein, 9 aa, Homo Sapiens
PKGNLTEQD

SEQ ID NO: 689443 - protein, 9 aa, Homo Sapiens
ALEFKYVKT

SEQ ID NO: 689444 - protein, 9 aa, Homo Sapiens
LLGPCVLSP

SEQ ID NO: 689445 - protein, 9 aa, Homo Sapiens
AGRMEVWHG

SEQ ID NO: 689446 - protein, 9 aa, Homo Sapiens
KQKMGGFHC

SEQ ID NO: 689447 - protein, 9 aa, Homo Sapiens
NTLRNKEVR

SEQ ID NO: 689448 - protein, 9 aa, Homo Sapiens
TRRSVSSDT

SEQ ID NO: 689449 - protein, 9 aa, Homo Sapiens
VARHYTKAI

SEQ ID NO: 689450 - protein, 9 aa, Homo Sapiens
IMNGTIVGT

SEQ ID NO: 689451 - protein, 9 aa, Homo Sapiens
RQAQQDRDD

SEQ ID NO: 689452 - protein, 9 aa, Homo Sapiens
HKPYQLKET

SEQ ID NO: 689453 - protein, 9 aa, Homo Sapiens
LKKVDQNWY

SEQ ID NO: 689454 - protein, 9 aa, Homo Sapiens
PCPAGGPGA

SEQ ID NO: 689455 - protein, 9 aa, Homo Sapiens
IRMFAVGVG

SEQ ID NO: 689456 - protein, 9 aa, Homo Sapiens
IVSQKDKHC

SEQ ID NO: 689457 - protein, 9 aa, Homo Sapiens
SLSLNQQLA

SEQ ID NO: 689458 - protein, 9 aa, Homo Sapiens
CTPAPVPVS

SEQ ID NO: 689459 - protein, 9 aa, Homo Sapiens
QENNKTKQS

SEQ ID NO: 689460 - protein, 9 aa, Homo Sapiens
HSFWKLIPL

SEQ ID NO: 689461 - protein, 9 aa, Homo Sapiens
RNALETWAV

SEQ ID NO: 689462 - protein, 9 aa, Homo Sapiens
HLYGYVTML

SEQ ID NO: 689463 - protein, 9 aa, Homo Sapiens
EAFYKVSLF

SEQ ID NO: 689464 - protein, 9 aa, Homo Sapiens
TSDECYYDS

SEQ ID NO: 689465 - protein, 9 aa, Homo Sapiens
TTTTSSSFS

SEQ ID NO: 689466 - protein, 9 aa, Homo Sapiens
PNKPPLTFH

SEQ ID NO: 689467 - protein, 9 aa, Homo Sapiens
AETGHTDDE

SEQ ID NO: 689468 - protein, 9 aa, Homo Sapiens
TVEEYKDEN

SEQ ID NO: 689469 - protein, 9 aa, Homo Sapiens
NDHGSAQEQ

SEQ ID NO: 689470 - protein, 9 aa, Homo Sapiens
LQYHCDCQV

SEQ ID NO: 689471 - protein, 9 aa, Homo Sapiens
FSIGAGSNT

SEQ ID NO: 689472 - protein, 9 aa, Homo Sapiens
TDSNLKLPE

SEQ ID NO: 689473 - protein, 9 aa, Homo Sapiens
ELGFQKYYQ

SEQ ID NO: 689474 - protein, 9 aa, Homo Sapiens
CDPSLDMKS

SEQ ID NO: 689475 - protein, 9 aa, Homo Sapiens
YNDSCVSPV

SEQ ID NO: 689476 - protein, 9 aa, Homo Sapiens
EGREGMHLK

SEQ ID NO: 689477 - protein, 9 aa, Homo Sapiens
IMMFLASGT

SEQ ID NO: 689478 - protein, 9 aa, Homo Sapiens
QERGVQPAP

SEQ ID NO: 689479 - protein, 9 aa, Homo Sapiens
LDTHYWTSI

SEQ ID NO: 689480 - protein, 9 aa, Homo Sapiens
CQVSLILQN

SEQ ID NO: 689481 - protein, 9 aa, Homo Sapiens
TCNHRVHTG

SEQ ID NO: 689482 - protein, 9 aa, Homo Sapiens
EAIRRLQAF

SEQ ID NO: 689483 - protein, 9 aa, Homo Sapiens
GGRSNMTSL

SEQ ID NO: 689484 - protein, 9 aa, Homo Sapiens
RSDQVIGAV

SEQ ID NO: 689485 - protein, 9 aa, Homo Sapiens
ECGKAFCHS

SEQ ID NO: 689486 - protein, 9 aa, Homo Sapiens
PEVKFNWFV

SEQ ID NO: 689487 - protein, 9 aa, Homo Sapiens
NTDTLVVVS

SEQ ID NO: 689488 - protein, 9 aa, Homo Sapiens
PARERRGRQ

SEQ ID NO: 689489 - protein, 9 aa, Homo Sapiens
IALTNTETA

SEQ ID NO: 689490 - protein, 9 aa, Homo Sapiens
TYPGLRGET

SEQ ID NO: 689491 - protein, 9 aa, Homo Sapiens
MPNKFQGEN

SEQ ID NO: 689492 - protein, 9 aa, Homo Sapiens
MKLDAQRKR

SEQ ID NO: 689493 - protein, 9 aa, Homo Sapiens
TDTLVVVSW

SEQ ID NO: 689494 - protein, 9 aa, Homo Sapiens
LDLRQQMPP

SEQ ID NO: 689495 - protein, 9 aa, Homo Sapiens
RELGSWLSK

SEQ ID NO: 689496 - protein, 9 aa, Homo Sapiens
KAQSNDGYH

SEQ ID NO: 689497 - protein, 9 aa, Homo Sapiens
PKLDTVQKP

SEQ ID NO: 689498 - protein, 9 aa, Homo Sapiens
CKDEMGKQE

SEQ ID NO: 689499 - protein, 9 aa, Homo Sapiens
PLENKFVRV

SEQ ID NO: 689500 - protein, 9 aa, Homo Sapiens
ATCKDEMGK

SEQ ID NO: 689501 - protein, 9 aa, Homo Sapiens
GKIPMRWTA

SEQ ID NO: 689502 - protein, 9 aa, Homo Sapiens
FLSVHDAML

SEQ ID NO: 689503 - protein, 9 aa, Homo Sapiens
CKECGKGLR

SEQ ID NO: 689504 - protein, 9 aa, Homo Sapiens
LDDGSNCFA

SEQ ID NO: 689505 - protein, 9 aa, Homo Sapiens
WYPQQINEH

SEQ ID NO: 689506 - protein, 9 aa, Homo Sapiens
LPGIFALYK

SEQ ID NO: 689507 - protein, 9 aa, Homo Sapiens
SASTWKMEK

SEQ ID NO: 689508 - protein, 9 aa, Homo Sapiens
WPSAEQEEE

SEQ ID NO: 689509 - protein, 9 aa, Homo Sapiens
YGIGAVCSA

SEQ ID NO: 689510 - protein, 9 aa, Homo Sapiens
RRELHMVKE

SEQ ID NO: 689511 - protein, 9 aa, Homo Sapiens
MATERRGKN

SEQ ID NO: 689512 - protein, 9 aa, Homo Sapiens
YQLHTPMCF

SEQ ID NO: 689513 - protein, 9 aa, Homo Sapiens
SCGEPFGHE

SEQ ID NO: 689514 - protein, 9 aa, Homo Sapiens
SECRKTVPQ

SEQ ID NO: 689515 - protein, 9 aa, Homo Sapiens
SQRKNELKL

SEQ ID NO: 689516 - protein, 9 aa, Homo Sapiens
MYAIYQERR

SEQ ID NO: 689517 - protein, 9 aa, Homo Sapiens
KDSLHSLMS

SEQ ID NO: 689518 - protein, 9 aa, Homo Sapiens
LTPAVCAVA

SEQ ID NO: 689519 - protein, 9 aa, Homo Sapiens
FERKLMLEQ

SEQ ID NO: 689520 - protein, 9 aa, Homo Sapiens
VSPVPKSRL

SEQ ID NO: 689521 - protein, 9 aa, Homo Sapiens
LRSMMGKCC

SEQ ID NO: 689522 - protein, 9 aa, Homo Sapiens
GPANSGVAH

SEQ ID NO: 689523 - protein, 9 aa, Homo Sapiens
LVDKKCQLD

SEQ ID NO: 689524 - protein, 9 aa, Homo Sapiens
LAIKCSTSL

SEQ ID NO: 689525 - protein, 9 aa, Homo Sapiens
AKVMVSQPK

SEQ ID NO: 689526 - protein, 9 aa, Homo Sapiens
GREPPKDPC

SEQ ID NO: 689527 - protein, 9 aa, Homo Sapiens
PLHASLCCT

SEQ ID NO: 689528 - protein, 9 aa, Homo Sapiens
IKLDKDLYG

SEQ ID NO: 689529 - protein, 9 aa, Homo Sapiens
SLQTGMMGT

SEQ ID NO: 689530 - protein, 9 aa, Homo Sapiens
AMTAGPHAA

SEQ ID NO: 689531 - protein, 9 aa, Homo Sapiens
HSPARFCVL

SEQ ID NO: 689532 - protein, 9 aa, Homo Sapiens
PTLVISQRT

SEQ ID NO: 689533 - protein, 9 aa, Homo Sapiens
DKITHTEEK

SEQ ID NO: 689534 - protein, 9 aa, Homo Sapiens
CIARWLTNI

SEQ ID NO: 689535 - protein, 9 aa, Homo Sapiens
VLSSHETLI

SEQ ID NO: 689536 - protein, 9 aa, Homo Sapiens
MSSFTGAYT

SEQ ID NO: 689537 - protein, 9 aa, Homo Sapiens
MQQGARENI

SEQ ID NO: 689538 - protein, 9 aa, Homo Sapiens
PKAPLGGKK

SEQ ID NO: 689539 - protein, 9 aa, Homo Sapiens
IANLAISNF

SEQ ID NO: 689540 - protein, 9 aa, Homo Sapiens
LSTSTISKM

SEQ ID NO: 689541 - protein, 9 aa, Homo Sapiens
CYYDSFSPG

SEQ ID NO: 689542 - protein, 9 aa, Homo Sapiens
EAANKIHYI

SEQ ID NO: 689543 - protein, 9 aa, Homo Sapiens
NRYTNILPC

SEQ ID NO: 689544 - protein, 9 aa, Homo Sapiens
KLAAKQTPP

SEQ ID NO: 689545 - protein, 9 aa, Homo Sapiens
SGPSIGIKH

SEQ ID NO: 689546 - protein, 9 aa, Homo Sapiens
ENKFVRVSG

SEQ ID NO: 689547 - protein, 9 aa, Homo Sapiens
TDAEDYDRR

SEQ ID NO: 689548 - protein, 9 aa, Homo Sapiens
TEGGAHITQ

SEQ ID NO: 689549 - protein, 9 aa, Homo Sapiens
VKAKKPKRN

SEQ ID NO: 689550 - protein, 9 aa, Homo Sapiens
QQNETEFHH

SEQ ID NO: 689551 - protein, 9 aa, Homo Sapiens
PDMKIEKVP

SEQ ID NO: 689552 - protein, 9 aa, Homo Sapiens
LKETKRIKR

SEQ ID NO: 689553 - protein, 9 aa, Homo Sapiens
EEHIGPDPQ

SEQ ID NO: 689554 - protein, 9 aa, Homo Sapiens
FRNHPFFEC

SEQ ID NO: 689555 - protein, 9 aa, Homo Sapiens
DTHYWTSIN

SEQ ID NO: 689556 - protein, 9 aa, Homo Sapiens
HVSSIIQKW

SEQ ID NO: 689557 - protein, 9 aa, Homo Sapiens
KLKRETTWK

SEQ ID NO: 689558 - protein, 9 aa, Homo Sapiens
RLSVDGRLS

SEQ ID NO: 689559 - protein, 9 aa, Homo Sapiens
FTLTTLKME

SEQ ID NO: 689560 - protein, 9 aa, Homo Sapiens
SCSFLQDSN

SEQ ID NO: 689561 - protein, 9 aa, Homo Sapiens
LVTRPRLRV

SEQ ID NO: 689562 - protein, 9 aa, Homo Sapiens
GWAQATSSW

SEQ ID NO: 689563 - protein, 9 aa, Homo Sapiens
DLSENAMQA

SEQ ID NO: 689564 - protein, 9 aa, Homo Sapiens
QRTEVLGSV

SEQ ID NO: 689565 - protein, 9 aa, Homo Sapiens
YDVGLTSYK

SEQ ID NO: 689566 - protein, 9 aa, Homo Sapiens
ETAIGLLPD

SEQ ID NO: 689567 - protein, 9 aa, Homo Sapiens
LQQARSSQA

SEQ ID NO: 689568 - protein, 9 aa, Homo Sapiens
QGLLLQELP

SEQ ID NO: 689569 - protein, 9 aa, Homo Sapiens
QLAVRPFTP

SEQ ID NO: 689570 - protein, 9 aa, Homo Sapiens
HSAFSMVKE

SEQ ID NO: 689571 - protein, 9 aa, Homo Sapiens
TAVVSRGAQ

SEQ ID NO: 689572 - protein, 9 aa, Homo Sapiens
TRGKLISSL

SEQ ID NO: 689573 - protein, 9 aa, Homo Sapiens
MLKGKPWEG

SEQ ID NO: 689574 - protein, 9 aa, Homo Sapiens
APLGGKKAT

SEQ ID NO: 689575 - protein, 9 aa, Homo Sapiens
FNAELAPPQ

SEQ ID NO: 689576 - protein, 9 aa, Homo Sapiens
VWKIGGLPV

SEQ ID NO: 689577 - protein, 9 aa, Homo Sapiens
PSNHVPKNF

SEQ ID NO: 689578 - protein, 9 aa, Homo Sapiens
VQLQPTDDL

SEQ ID NO: 689579 - protein, 9 aa, Homo Sapiens
EADFGDPWS

SEQ ID NO: 689580 - protein, 9 aa, Homo Sapiens
ITPAKGPVV

SEQ ID NO: 689581 - protein, 9 aa, Homo Sapiens
LEHEIEIQG

SEQ ID NO: 689582 - protein, 9 aa, Homo Sapiens
GFPGGRGKQ

SEQ ID NO: 689583 - protein, 9 aa, Homo Sapiens
VGHDWSALT

SEQ ID NO: 689584 - protein, 9 aa, Homo Sapiens
DEENYEIVP

SEQ ID NO: 689585 - protein, 9 aa, Homo Sapiens
MSVRLRKAQ

SEQ ID NO: 689586 - protein, 9 aa, Homo Sapiens
GYQYLGTSD

SEQ ID NO: 689587 - protein, 9 aa, Homo Sapiens
RRTPGGVFV

SEQ ID NO: 689588 - protein, 9 aa, Homo Sapiens
DQVLLEDRR

SEQ ID NO: 689589 - protein, 9 aa, Homo Sapiens
LNGTDISGN

SEQ ID NO: 689590 - protein, 9 aa, Homo Sapiens
DRVILLKKV

SEQ ID NO: 689591 - protein, 9 aa, Homo Sapiens
DGSNCFATD

SEQ ID NO: 689592 - protein, 9 aa, Homo Sapiens
SVQGATGSA

SEQ ID NO: 689593 - protein, 9 aa, Homo Sapiens
EFKYVKTVC

SEQ ID NO: 689594 - protein, 9 aa, Homo Sapiens
DADTEADTV

SEQ ID NO: 689595 - protein, 9 aa, Homo Sapiens
GPKAPLGGK

SEQ ID NO: 689596 - protein, 9 aa, Homo Sapiens
ALKENLLEY

SEQ ID NO: 689597 - protein, 9 aa, Homo Sapiens
SFSDVAMFD

SEQ ID NO: 689598 - protein, 9 aa, Homo Sapiens
RLGLKEGRS

SEQ ID NO: 689599 - protein, 9 aa, Homo Sapiens
KGPVVTAQY

SEQ ID NO: 689600 - protein, 9 aa, Homo Sapiens
AIRRLQAFA

SEQ ID NO: 689601 - protein, 9 aa, Homo Sapiens
QISLIENKI

SEQ ID NO: 689602 - protein, 9 aa, Homo Sapiens
TKATLFGSP

SEQ ID NO: 689603 - protein, 9 aa, Homo Sapiens
CNNVLPHYL

SEQ ID NO: 689604 - protein, 9 aa, Homo Sapiens
PQLLERRGS

SEQ ID NO: 689605 - protein, 9 aa, Homo Sapiens
TEVHEELHK

SEQ ID NO: 689606 - protein, 9 aa, Homo Sapiens
PARTQERIR

SEQ ID NO: 689607 - protein, 9 aa, Homo Sapiens
VSSPSAAFP

SEQ ID NO: 689608 - protein, 9 aa, Homo Sapiens
RDDMADEVA

SEQ ID NO: 689609 - protein, 9 aa, Homo Sapiens
FIALTNTET

SEQ ID NO: 689610 - protein, 9 aa, Homo Sapiens
SMSSFTGAY

SEQ ID NO: 689611 - protein, 9 aa, Homo Sapiens
ELPVDKIGL

SEQ ID NO: 689612 - protein, 9 aa, Homo Sapiens
LAQGLTVDH

SEQ ID NO: 689613 - protein, 9 aa, Homo Sapiens
NGLQLGVQL

SEQ ID NO: 689614 - protein, 9 aa, Homo Sapiens
TFNVKFYSP

SEQ ID NO: 689615 - protein, 9 aa, Homo Sapiens
KVIVVIGGC

SEQ ID NO: 689616 - protein, 9 aa, Homo Sapiens
KEEEKRDIH

SEQ ID NO: 689617 - protein, 9 aa, Homo Sapiens
HLEASSNQE

SEQ ID NO: 689618 - protein, 9 aa, Homo Sapiens
CFATDLSSG

SEQ ID NO: 689619 - protein, 9 aa, Homo Sapiens
STAVTDLNI

SEQ ID NO: 689620 - protein, 9 aa, Homo Sapiens
HVVLEKAKC

SEQ ID NO: 689621 - protein, 9 aa, Homo Sapiens
EMTSTVISV

SEQ ID NO: 689622 - protein, 9 aa, Homo Sapiens
LLTSGDPPP

SEQ ID NO: 689623 - protein, 9 aa, Homo Sapiens
FSSSSSSSD

SEQ ID NO: 689624 - protein, 9 aa, Homo Sapiens
FYVQQAKCE

SEQ ID NO: 689625 - protein, 9 aa, Homo Sapiens
ARTKEKAKQ

SEQ ID NO: 689626 - protein, 9 aa, Homo Sapiens
FFCVGRLKF

SEQ ID NO: 689627 - protein, 9 aa, Homo Sapiens
VYNAVGALS

SEQ ID NO: 689628 - protein, 9 aa, Homo Sapiens
AASMLLLGD

SEQ ID NO: 689629 - protein, 9 aa, Homo Sapiens
PRPAEETYV

SEQ ID NO: 689630 - protein, 9 aa, Homo Sapiens
RHLTIAELL

SEQ ID NO: 689631 - protein, 9 aa, Homo Sapiens
DLLDDGSNC

SEQ ID NO: 689632 - protein, 9 aa, Homo Sapiens
WLLSSKPKL

SEQ ID NO: 689633 - protein, 9 aa, Homo Sapiens
TQYRLGITK

SEQ ID NO: 689634 - protein, 9 aa, Homo Sapiens
DLSLEEAIE

SEQ ID NO: 689635 - protein, 9 aa, Homo Sapiens
LTGKALDRA

SEQ ID NO: 689636 - protein, 9 aa, Homo Sapiens
VLSRHHHVV

SEQ ID NO: 689637 - protein, 9 aa, Homo Sapiens
LRWDRFGRR

SEQ ID NO: 689638 - protein, 9 aa, Homo Sapiens
QQLEYTACL

SEQ ID NO: 689639 - protein, 9 aa, Homo Sapiens
SQIGCTWPQ

SEQ ID NO: 689640 - protein, 9 aa, Homo Sapiens
CTNGCKAVY

SEQ ID NO: 689641 - protein, 9 aa, Homo Sapiens
LDETVEEYK

SEQ ID NO: 689642 - protein, 9 aa, Homo Sapiens
QCTLEGAYK

SEQ ID NO: 689643 - protein, 9 aa, Homo Sapiens
LHFFPVYSI

SEQ ID NO: 689644 - protein, 9 aa, Homo Sapiens
TLMERVQTM

SEQ ID NO: 689645 - protein, 9 aa, Homo Sapiens
WECEHREWG

SEQ ID NO: 689646 - protein, 9 aa, Homo Sapiens
RHHAQLLKP

SEQ ID NO: 689647 - protein, 9 aa, Homo Sapiens
ANLAISNFL

SEQ ID NO: 689648 - protein, 9 aa, Homo Sapiens
TTLLIKLCK

SEQ ID NO: 689649 - protein, 9 aa, Homo Sapiens
AMMQDMIRS

SEQ ID NO: 689650 - protein, 9 aa, Homo Sapiens
HCLVTDLLA

SEQ ID NO: 689651 - protein, 9 aa, Homo Sapiens
QRTLGASGP

SEQ ID NO: 689652 - protein, 9 aa, Homo Sapiens
EIGHTPLDY

SEQ ID NO: 689653 - protein, 9 aa, Homo Sapiens
TSLFRHLHL

SEQ ID NO: 689654 - protein, 9 aa, Homo Sapiens
KENKEGARN

SEQ ID NO: 689655 - protein, 9 aa, Homo Sapiens
LGMLTSLVV

SEQ ID NO: 689656 - protein, 9 aa, Homo Sapiens
YLFRNESVH

SEQ ID NO: 689657 - protein, 9 aa, Homo Sapiens
DLGDCDLGI

SEQ ID NO: 689658 - protein, 9 aa, Homo Sapiens
EFTLTTLKM

SEQ ID NO: 689659 - protein, 9 aa, Homo Sapiens
VIHQLKTVS

SEQ ID NO: 689660 - protein, 9 aa, Homo Sapiens
FTFGNLNVG

SEQ ID NO: 689661 - protein, 9 aa, Homo Sapiens
IAQDLKTDL

SEQ ID NO: 689662 - protein, 9 aa, Homo Sapiens
AADYAQFQG

SEQ ID NO: 689663 - protein, 9 aa, Homo Sapiens
SGSKKFCNN

SEQ ID NO: 689664 - protein, 9 aa, Homo Sapiens
ASAEAANKI

SEQ ID NO: 689665 - protein, 9 aa, Homo Sapiens
EPPKDPCLR

SEQ ID NO: 689666 - protein, 9 aa, Homo Sapiens
RSCRTPHST

SEQ ID NO: 689667 - protein, 9 aa, Homo Sapiens
IRKFERKLM

SEQ ID NO: 689668 - protein, 9 aa, Homo Sapiens
SSDRAFYTF

SEQ ID NO: 689669 - protein, 9 aa, Homo Sapiens
HFKDSGVRC

SEQ ID NO: 689670 - protein, 9 aa, Homo Sapiens
SPAFTDQSF

SEQ ID NO: 689671 - protein, 9 aa, Homo Sapiens
LELTAYKIF

SEQ ID NO: 689672 - protein, 9 aa, Homo Sapiens
SSFTLYLVV

SEQ ID NO: 689673 - protein, 9 aa, Homo Sapiens
LIAGTSTSV

SEQ ID NO: 689674 - protein, 9 aa, Homo Sapiens
HPSAPCLAP

SEQ ID NO: 689675 - protein, 9 aa, Homo Sapiens
IEDFKTLRH

SEQ ID NO: 689676 - protein, 9 aa, Homo Sapiens
LVDKARQDY

SEQ ID NO: 689677 - protein, 9 aa, Homo Sapiens
SPAGSAELR

SEQ ID NO: 689678 - protein, 9 aa, Homo Sapiens
EVVVEGPSA

SEQ ID NO: 689679 - protein, 9 aa, Homo Sapiens
AKVIVVIGG

SEQ ID NO: 689680 - protein, 9 aa, Homo Sapiens
FPSAKCLGI

SEQ ID NO: 689681 - protein, 9 aa, Homo Sapiens
ILNSDAVLT

SEQ ID NO: 689682 - protein, 9 aa, Homo Sapiens
LHTATNFLI

SEQ ID NO: 689683 - protein, 9 aa, Homo Sapiens
EVQTVMSEV

SEQ ID NO: 689684 - protein, 9 aa, Homo Sapiens
MMFLASGTH

SEQ ID NO: 689685 - protein, 9 aa, Homo Sapiens
YSPLTVPMF

SEQ ID NO: 689686 - protein, 9 aa, Homo Sapiens
LVISQRTEV

SEQ ID NO: 689687 - protein, 9 aa, Homo Sapiens
PETLHCYQE

SEQ ID NO: 689688 - protein, 9 aa, Homo Sapiens
IIRDKRGMH

SEQ ID NO: 689689 - protein, 9 aa, Homo Sapiens
QATSSWPRL

SEQ ID NO: 689690 - protein, 9 aa, Homo Sapiens
KASNKKKFE

SEQ ID NO: 689691 - protein, 9 aa, Homo Sapiens
SVFAPSGEH

SEQ ID NO: 689692 - protein, 9 aa, Homo Sapiens
IQVNAIDKR

SEQ ID NO: 689693 - protein, 9 aa, Homo Sapiens
FKNFAFAHP

SEQ ID NO: 689694 - protein, 9 aa, Homo Sapiens
GRLKFWVLM

SEQ ID NO: 689695 - protein, 9 aa, Homo Sapiens
NFLVAIICC

SEQ ID NO: 689696 - protein, 9 aa, Homo Sapiens
VEVFLGMKV

SEQ ID NO: 689697 - protein, 9 aa, Homo Sapiens
TKVINWVQH

SEQ ID NO: 689698 - protein, 9 aa, Homo Sapiens
ASIRTEVFQ

SEQ ID NO: 689699 - protein, 9 aa, Homo Sapiens
RFMDLAKVI

SEQ ID NO: 689700 - protein, 9 aa, Homo Sapiens
CAMKTLAQL

SEQ ID NO: 689701 - protein, 9 aa, Homo Sapiens
LAHHLRMFK

SEQ ID NO: 689702 - protein, 9 aa, Homo Sapiens
TSSASSGHT

SEQ ID NO: 689703 - protein, 9 aa, Homo Sapiens
GAYKPGAAP

SEQ ID NO: 689704 - protein, 9 aa, Homo Sapiens
DAKENKILK

SEQ ID NO: 689705 - protein, 9 aa, Homo Sapiens
QRERARAEV

SEQ ID NO: 689706 - protein, 9 aa, Homo Sapiens
FIAKVKERL

SEQ ID NO: 689707 - protein, 9 aa, Homo Sapiens
AVQNLPANT

SEQ ID NO: 689708 - protein, 9 aa, Homo Sapiens
PKLEKIGNQ

SEQ ID NO: 689709 - protein, 9 aa, Homo Sapiens
AVFLTTTSR

SEQ ID NO: 689710 - protein, 9 aa, Homo Sapiens
RVPMPVAGH

SEQ ID NO: 689711 - protein, 9 aa, Homo Sapiens
VKPKPSQLQ

SEQ ID NO: 689712 - protein, 9 aa, Homo Sapiens
EDQETSLQT

SEQ ID NO: 689713 - protein, 9 aa, Homo Sapiens
DSENLNSRR

SEQ ID NO: 689714 - protein, 9 aa, Homo Sapiens
MLTSLVVLG

SEQ ID NO: 689715 - protein, 9 aa, Homo Sapiens
PQPAGPSIP

SEQ ID NO: 689716 - protein, 9 aa, Homo Sapiens
PICLPCKGD

SEQ ID NO: 689717 - protein, 9 aa, Homo Sapiens
QQEYPGKQV

SEQ ID NO: 689718 - protein, 9 aa, Homo Sapiens
YAVFESAVN

SEQ ID NO: 689719 - protein, 9 aa, Homo Sapiens
EEILDSENL

SEQ ID NO: 689720 - protein, 9 aa, Homo Sapiens
NNLDLTANL

SEQ ID NO: 689721 - protein, 9 aa, Homo Sapiens
QAGARCPCE

SEQ ID NO: 689722 - protein, 9 aa, Homo Sapiens
PPSGIFNSE

SEQ ID NO: 689723 - protein, 9 aa, Homo Sapiens
PGVPQRTLG

SEQ ID NO: 689724 - protein, 9 aa, Homo Sapiens
GDTVIIPCR

SEQ ID NO: 689725 - protein, 9 aa, Homo Sapiens
TLKKIPRFK

SEQ ID NO: 689726 - protein, 9 aa, Homo Sapiens
PQGLEAAKE

SEQ ID NO: 689727 - protein, 9 aa, Homo Sapiens
LVLKCRKGD

SEQ ID NO: 689728 - protein, 9 aa, Homo Sapiens
LLQPLEDFS

SEQ ID NO: 689729 - protein, 9 aa, Homo Sapiens
RKTLVLHLR

SEQ ID NO: 689730 - protein, 9 aa, Homo Sapiens
EWVVVKVQA

SEQ ID NO: 689731 - protein, 9 aa, Homo Sapiens
PLVTRPRLR

SEQ ID NO: 689732 - protein, 9 aa, Homo Sapiens
LRRELHMVK

SEQ ID NO: 689733 - protein, 9 aa, Homo Sapiens
VCGCAPQQL

SEQ ID NO: 689734 - protein, 9 aa, Homo Sapiens
LQLQNTLQQ

SEQ ID NO: 689735 - protein, 9 aa, Homo Sapiens
SDDIEACVS

SEQ ID NO: 689736 - protein, 9 aa, Homo Sapiens
QQEIWEQED

SEQ ID NO: 689737 - protein, 9 aa, Homo Sapiens
PLVLSSHET

SEQ ID NO: 689738 - protein, 9 aa, Homo Sapiens
SIIQKWSME

SEQ ID NO: 689739 - protein, 9 aa, Homo Sapiens
HMEVTWYKD

SEQ ID NO: 689740 - protein, 9 aa, Homo Sapiens
GSGGPPTEG

SEQ ID NO: 689741 - protein, 9 aa, Homo Sapiens
PLTLYVTVR

SEQ ID NO: 689742 - protein, 9 aa, Homo Sapiens
LTYSYDKSI

SEQ ID NO: 689743 - protein, 9 aa, Homo Sapiens
PGEYSLPTL

SEQ ID NO: 689744 - protein, 9 aa, Homo Sapiens
VKVLATAKV

SEQ ID NO: 689745 - protein, 9 aa, Homo Sapiens
IEKVPELTL

SEQ ID NO: 689746 - protein, 9 aa, Homo Sapiens
VAHTDASES

SEQ ID NO: 689747 - protein, 9 aa, Homo Sapiens
GIQCNVRDS

SEQ ID NO: 689748 - protein, 9 aa, Homo Sapiens
EPGQTLLPT

SEQ ID NO: 689749 - protein, 9 aa, Homo Sapiens
VSARPLSSE

SEQ ID NO: 689750 - protein, 9 aa, Homo Sapiens
GGPPTEGGA

SEQ ID NO: 689751 - protein, 9 aa, Homo Sapiens
PAGPAGIIG

SEQ ID NO: 689752 - protein, 9 aa, Homo Sapiens
VSGGHINPS

SEQ ID NO: 689753 - protein, 9 aa, Homo Sapiens
SSFSNVAEE

SEQ ID NO: 689754 - protein, 9 aa, Homo Sapiens
WIHRLSCSE

SEQ ID NO: 689755 - protein, 9 aa, Homo Sapiens
ALGSLRMLL

SEQ ID NO: 689756 - protein, 9 aa, Homo Sapiens
LLELTAYKI

SEQ ID NO: 689757 - protein, 9 aa, Homo Sapiens
TTSSSFSSS

SEQ ID NO: 689758 - protein, 9 aa, Homo Sapiens
TGTSFLHVY

SEQ ID NO: 689759 - protein, 9 aa, Homo Sapiens
PRLMKDLLQ

SEQ ID NO: 689760 - protein, 9 aa, Homo Sapiens
GVPQRTLGA

SEQ ID NO: 689761 - protein, 9 aa, Homo Sapiens
VKKLSSLAR

SEQ ID NO: 689762 - protein, 9 aa, Homo Sapiens
TSYGLQNSL

SEQ ID NO: 689763 - protein, 9 aa, Homo Sapiens
RKAVRKGPN

SEQ ID NO: 689764 - protein, 9 aa, Homo Sapiens
VGKKIMEEE

SEQ ID NO: 689765 - protein, 9 aa, Homo Sapiens
TILHLGKPS

SEQ ID NO: 689766 - protein, 9 aa, Homo Sapiens
KWPEFQEFL

SEQ ID NO: 689767 - protein, 9 aa, Homo Sapiens
TCRPPLKDI

SEQ ID NO: 689768 - protein, 9 aa, Homo Sapiens
ASARRRIPR

SEQ ID NO: 689769 - protein, 9 aa, Homo Sapiens
DILRQHIAK

SEQ ID NO: 689770 - protein, 9 aa, Homo Sapiens
ALRQDPSGV

SEQ ID NO: 689771 - protein, 9 aa, Homo Sapiens
NHFKDSGVR

SEQ ID NO: 689772 - protein, 9 aa, Homo Sapiens
PQFLADVLS

SEQ ID NO: 689773 - protein, 9 aa, Homo Sapiens
KASSFSNVA

SEQ ID NO: 689774 - protein, 9 aa, Homo Sapiens
NKASSFSNV

SEQ ID NO: 689775 - protein, 9 aa, Homo Sapiens
FRNLRSSLK

SEQ ID NO: 689776 - protein, 9 aa, Homo Sapiens
CVCPTGYRS

SEQ ID NO: 689777 - protein, 9 aa, Homo Sapiens
LIHAVLHLK

SEQ ID NO: 689778 - protein, 9 aa, Homo Sapiens
GSLFYEQSK

SEQ ID NO: 689779 - protein, 9 aa, Homo Sapiens
SAKCLGIEL

SEQ ID NO: 689780 - protein, 9 aa, Homo Sapiens
ENAMQAIPR

SEQ ID NO: 689781 - protein, 9 aa, Homo Sapiens
WHPNIYKNG

SEQ ID NO: 689782 - protein, 9 aa, Homo Sapiens
SPDTELSPS

SEQ ID NO: 689783 - protein, 9 aa, Homo Sapiens
GFTHILLCS

SEQ ID NO: 689784 - protein, 9 aa, Homo Sapiens
IYQSSVKGQ

SEQ ID NO: 689785 - protein, 9 aa, Homo Sapiens
CMSSYFREQ

SEQ ID NO: 689786 - protein, 9 aa, Homo Sapiens
RPCLRCELC

SEQ ID NO: 689787 - protein, 9 aa, Homo Sapiens
IEAGYRKHL

SEQ ID NO: 689788 - protein, 9 aa, Homo Sapiens
VHEINLLPL

SEQ ID NO: 689789 - protein, 9 aa, Homo Sapiens
VMYTTLLIK

SEQ ID NO: 689790 - protein, 9 aa, Homo Sapiens
MALRYPEPE

SEQ ID NO: 689791 - protein, 9 aa, Homo Sapiens
FQIIWDTVV

SEQ ID NO: 689792 - protein, 9 aa, Homo Sapiens
ELSPSGSPG

SEQ ID NO: 689793 - protein, 9 aa, Homo Sapiens
LTRRSCAFT

SEQ ID NO: 689794 - protein, 9 aa, Homo Sapiens
VQHSIWENG

SEQ ID NO: 689795 - protein, 9 aa, Homo Sapiens
RETDARIQE

SEQ ID NO: 689796 - protein, 9 aa, Homo Sapiens
CNPLFTALG

SEQ ID NO: 689797 - protein, 9 aa, Homo Sapiens
GLRGETGTA

SEQ ID NO: 689798 - protein, 9 aa, Homo Sapiens
IKNTEWSRE

SEQ ID NO: 689799 - protein, 9 aa, Homo Sapiens
LRSGSLRSL

SEQ ID NO: 689800 - protein, 9 aa, Homo Sapiens
NKEHILQQR

SEQ ID NO: 689801 - protein, 9 aa, Homo Sapiens
ALSGRWLLA

SEQ ID NO: 689802 - protein, 9 aa, Homo Sapiens
LASIKKEQK

SEQ ID NO: 689803 - protein, 9 aa, Homo Sapiens
VAPPNRPRT

SEQ ID NO: 689804 - protein, 9 aa, Homo Sapiens
FSNSSTKAE

SEQ ID NO: 689805 - protein, 9 aa, Homo Sapiens
IARWLTNIE

SEQ ID NO: 689806 - protein, 9 aa, Homo Sapiens
DYPSTEPHP

SEQ ID NO: 689807 - protein, 9 aa, Homo Sapiens
LCRKSILRQ

SEQ ID NO: 689808 - protein, 9 aa, Homo Sapiens
DEANQRATN

SEQ ID NO: 689809 - protein, 9 aa, Homo Sapiens
GHINPSITL

SEQ ID NO: 689810 - protein, 9 aa, Homo Sapiens
GYVENGTPC

SEQ ID NO: 689811 - protein, 9 aa, Homo Sapiens
FSMVKEDFQ

SEQ ID NO: 689812 - protein, 9 aa, Homo Sapiens
MNFSGRGRQ

SEQ ID NO: 689813 - protein, 9 aa, Homo Sapiens
TITEANENT

SEQ ID NO: 689814 - protein, 9 aa, Homo Sapiens
GKEVKPKPS

SEQ ID NO: 689815 - protein, 9 aa, Homo Sapiens
SLWEENETL

SEQ ID NO: 689816 - protein, 9 aa, Homo Sapiens
MCQHFYKRG

SEQ ID NO: 689817 - protein, 9 aa, Homo Sapiens
DPPRHNQGH

SEQ ID NO: 689818 - protein, 9 aa, Homo Sapiens
YQCSHFHVR

SEQ ID NO: 689819 - protein, 9 aa, Homo Sapiens
GLNHMNNGN

SEQ ID NO: 689820 - protein, 9 aa, Homo Sapiens
ASKGLNHMN

SEQ ID NO: 689821 - protein, 9 aa, Homo Sapiens
IKAQSNDGY

SEQ ID NO: 689822 - protein, 9 aa, Homo Sapiens
KMDTFLGPV

SEQ ID NO: 689823 - protein, 9 aa, Homo Sapiens
KMREQLVKY

SEQ ID NO: 689824 - protein, 9 aa, Homo Sapiens
DAGALAPAQ

SEQ ID NO: 689825 - protein, 9 aa, Homo Sapiens
WSRARVLSC

SEQ ID NO: 689826 - protein, 9 aa, Homo Sapiens
TVCARGDGR

SEQ ID NO: 689827 - protein, 9 aa, Homo Sapiens
GGRMATERR

SEQ ID NO: 689828 - protein, 9 aa, Homo Sapiens
KETTSVAVF

SEQ ID NO: 689829 - protein, 9 aa, Homo Sapiens
WTEDQNSLR

SEQ ID NO: 689830 - protein, 9 aa, Homo Sapiens
NVLHNTGAL

SEQ ID NO: 689831 - protein, 9 aa, Homo Sapiens
TISKMLGIF

SEQ ID NO: 689832 - protein, 9 aa, Homo Sapiens
QWVEKKVQG

SEQ ID NO: 689833 - protein, 9 aa, Homo Sapiens
WLTNIEVPK

SEQ ID NO: 689834 - protein, 9 aa, Homo Sapiens
RIEHVWLQK

SEQ ID NO: 689835 - protein, 9 aa, Homo Sapiens
HFFPVYSIT

SEQ ID NO: 689836 - protein, 9 aa, Homo Sapiens
GRQQSTLES

SEQ ID NO: 689837 - protein, 9 aa, Homo Sapiens
DELEEGESF

SEQ ID NO: 689838 - protein, 9 aa, Homo Sapiens
RSPEDKYEL

SEQ ID NO: 689839 - protein, 9 aa, Homo Sapiens
SCFLHTRLG

SEQ ID NO: 689840 - protein, 9 aa, Homo Sapiens
SENLNSRRS

SEQ ID NO: 689841 - protein, 9 aa, Homo Sapiens
SVWLLSSKP

SEQ ID NO: 689842 - protein, 9 aa, Homo Sapiens
NYGNLVSVW

SEQ ID NO: 689843 - protein, 9 aa, Homo Sapiens
HLSPLHASL

SEQ ID NO: 689844 - protein, 9 aa, Homo Sapiens
LGRDATRLF

SEQ ID NO: 689845 - protein, 9 aa, Homo Sapiens
ANENTREAQ

SEQ ID NO: 689846 - protein, 9 aa, Homo Sapiens
GRQEEPPPA

SEQ ID NO: 689847 - protein, 9 aa, Homo Sapiens
SNFLVEKSR

SEQ ID NO: 689848 - protein, 9 aa, Homo Sapiens
PPCPAGGPG

SEQ ID NO: 689849 - protein, 9 aa, Homo Sapiens
PAPDTWASA

SEQ ID NO: 689850 - protein, 9 aa, Homo Sapiens
LANALQRHL

SEQ ID NO: 689851 - protein, 9 aa, Homo Sapiens
QQFHYEYYC

SEQ ID NO: 689852 - protein, 9 aa, Homo Sapiens
ITINSALYT

SEQ ID NO: 689853 - protein, 9 aa, Homo Sapiens
RGSITFWHN

SEQ ID NO: 689854 - protein, 9 aa, Homo Sapiens
DKDFVLNSE

SEQ ID NO: 689855 - protein, 9 aa, Homo Sapiens
FLYRPKAPD

SEQ ID NO: 689856 - protein, 9 aa, Homo Sapiens
WPQPFLVRP

SEQ ID NO: 689857 - protein, 9 aa, Homo Sapiens
ISKKSKDGK

SEQ ID NO: 689858 - protein, 9 aa, Homo Sapiens
SKRKAVVAD

SEQ ID NO: 689859 - protein, 9 aa, Homo Sapiens
NYCNCSGIQ

SEQ ID NO: 689860 - protein, 9 aa, Homo Sapiens
PCDFSRVRL

SEQ ID NO: 689861 - protein, 9 aa, Homo Sapiens
EEEELTAEV

SEQ ID NO: 689862 - protein, 9 aa, Homo Sapiens
NQQDGGFAE

SEQ ID NO: 689863 - protein, 9 aa, Homo Sapiens
LSEVAEVFR

SEQ ID NO: 689864 - protein, 9 aa, Homo Sapiens
EKRDIHRIQ

SEQ ID NO: 689865 - protein, 9 aa, Homo Sapiens
SISCEHVNE

SEQ ID NO: 689866 - protein, 9 aa, Homo Sapiens
FYEQSKKCV

SEQ ID NO: 689867 - protein, 9 aa, Homo Sapiens
RPICLPCKG

SEQ ID NO: 689868 - protein, 9 aa, Homo Sapiens
SEVAEVFRQ

SEQ ID NO: 689869 - protein, 9 aa, Homo Sapiens
QTPEFQQFH

SEQ ID NO: 689870 - protein, 9 aa, Homo Sapiens
AAEDKPRAH

SEQ ID NO: 689871 - protein, 9 aa, Homo Sapiens
ITKESLEES

SEQ ID NO: 689872 - protein, 9 aa, Homo Sapiens
TPEQGSQSL

SEQ ID NO: 689873 - protein, 9 aa, Homo Sapiens
CRKSILRQL

SEQ ID NO: 689874 - protein, 9 aa, Homo Sapiens
LPPTNESQP

SEQ ID NO: 689875 - protein, 9 aa, Homo Sapiens
RRFMDLAKV

SEQ ID NO: 689876 - protein, 9 aa, Homo Sapiens
FKQSFLELT

SEQ ID NO: 689877 - protein, 9 aa, Homo Sapiens
QSRFENFLE

SEQ ID NO: 689878 - protein, 9 aa, Homo Sapiens
VKFYSPDPS

SEQ ID NO: 689879 - protein, 9 aa, Homo Sapiens
LFLYECETS

SEQ ID NO: 689880 - protein, 9 aa, Homo Sapiens
SVASIKTGL

SEQ ID NO: 689881 - protein, 9 aa, Homo Sapiens
GRRKSLPLV

SEQ ID NO: 689882 - protein, 9 aa, Homo Sapiens
AEQEEEEEE

SEQ ID NO: 689883 - protein, 9 aa, Homo Sapiens
TACSFSYTS

SEQ ID NO: 689884 - protein, 9 aa, Homo Sapiens
TTLKMEAKF

SEQ ID NO: 689885 - protein, 9 aa, Homo Sapiens
LEEAIEERK

SEQ ID NO: 689886 - protein, 9 aa, Homo Sapiens
APRTVFRNL

SEQ ID NO: 689887 - protein, 9 aa, Homo Sapiens
YEQSKKCVQ

SEQ ID NO: 689888 - protein, 9 aa, Homo Sapiens
LQPSLPPGC

SEQ ID NO: 689889 - protein, 9 aa, Homo Sapiens
DLAHHLRMF

SEQ ID NO: 689890 - protein, 9 aa, Homo Sapiens
QLKTVSAVC

SEQ ID NO: 689891 - protein, 9 aa, Homo Sapiens
YKAIYETEL

SEQ ID NO: 689892 - protein, 9 aa, Homo Sapiens
NVPTCKLAS

SEQ ID NO: 689893 - protein, 9 aa, Homo Sapiens
PAYYRYIEK

SEQ ID NO: 689894 - protein, 9 aa, Homo Sapiens
KQACRCLIL

SEQ ID NO: 689895 - protein, 9 aa, Homo Sapiens
SGGGSGYQY

SEQ ID NO: 689896 - protein, 9 aa, Homo Sapiens
ALTEAMHTV

SEQ ID NO: 689897 - protein, 9 aa, Homo Sapiens
SCRTPHSTR

SEQ ID NO: 689898 - protein, 9 aa, Homo Sapiens
GTILTTQQR

SEQ ID NO: 689899 - protein, 9 aa, Homo Sapiens
PLCKAKSLS

SEQ ID NO: 689900 - protein, 9 aa, Homo Sapiens
TVFRNLRSS

SEQ ID NO: 689901 - protein, 9 aa, Homo Sapiens
EGVLYNQLL

SEQ ID NO: 689902 - protein, 9 aa, Homo Sapiens
SIRRPDVLL

SEQ ID NO: 689903 - protein, 9 aa, Homo Sapiens
KWDQYWPAR

SEQ ID NO: 689904 - protein, 9 aa, Homo Sapiens
PEFQQFHYE

SEQ ID NO: 689905 - protein, 9 aa, Homo Sapiens
HMVKETLQA

SEQ ID NO: 689906 - protein, 9 aa, Homo Sapiens
GSCRVGKKI

SEQ ID NO: 689907 - protein, 9 aa, Homo Sapiens
VPSIAATPR

SEQ ID NO: 689908 - protein, 9 aa, Homo Sapiens
EPFGHEGFH

SEQ ID NO: 689909 - protein, 9 aa, Homo Sapiens
PRRRRLNRE

SEQ ID NO: 689910 - protein, 9 aa, Homo Sapiens
PLPKVGLIA

SEQ ID NO: 689911 - protein, 9 aa, Homo Sapiens
QLSRPVDLP

SEQ ID NO: 689912 - protein, 9 aa, Homo Sapiens
QNELDLMDL

SEQ ID NO: 689913 - protein, 9 aa, Homo Sapiens
RMVVARLAR

SEQ ID NO: 689914 - protein, 9 aa, Homo Sapiens
AEEVCIHIS

SEQ ID NO: 689915 - protein, 9 aa, Homo Sapiens
LQAFANLQE

SEQ ID NO: 689916 - protein, 9 aa, Homo Sapiens
SRVKWDQYW

SEQ ID NO: 689917 - protein, 9 aa, Homo Sapiens
ARGDSEHRR

SEQ ID NO: 689918 - protein, 9 aa, Homo Sapiens
RETTWKITD

SEQ ID NO: 689919 - protein, 9 aa, Homo Sapiens
RSQPISCKG

SEQ ID NO: 689920 - protein, 9 aa, Homo Sapiens
EGSLPLDPV

SEQ ID NO: 689921 - protein, 9 aa, Homo Sapiens
LSPSGSPGG

SEQ ID NO: 689922 - protein, 9 aa, Homo Sapiens
RKREENRLK

SEQ ID NO: 689923 - protein, 9 aa, Homo Sapiens
VLEHEIEIQ

SEQ ID NO: 689924 - protein, 9 aa, Homo Sapiens
LHCLVTDLL

SEQ ID NO: 689925 - protein, 9 aa, Homo Sapiens
QKIAAESSK

SEQ ID NO: 689926 - protein, 9 aa, Homo Sapiens
EVVTFLVDK

SEQ ID NO: 689927 - protein, 9 aa, Homo Sapiens
AVRRTQLEL

SEQ ID NO: 689928 - protein, 9 aa, Homo Sapiens
MERDSYPDF

SEQ ID NO: 689929 - protein, 9 aa, Homo Sapiens
HEELHKKQE

SEQ ID NO: 689930 - protein, 9 aa, Homo Sapiens
VVQSVGTYG

SEQ ID NO: 689931 - protein, 9 aa, Homo Sapiens
ECRSRGQFR

SEQ ID NO: 689932 - protein, 9 aa, Homo Sapiens
RNIKRYNSF

SEQ ID NO: 689933 - protein, 9 aa, Homo Sapiens
GSGEVGSVG

SEQ ID NO: 689934 - protein, 9 aa, Homo Sapiens
VILCCIRAS

SEQ ID NO: 689935 - protein, 9 aa, Homo Sapiens
AQSSRAHIK

SEQ ID NO: 689936 - protein, 9 aa, Homo Sapiens
GTESKTSSE

SEQ ID NO: 689937 - protein, 9 aa, Homo Sapiens
MTVEVSAPL

SEQ ID NO: 689938 - protein, 9 aa, Homo Sapiens
EVVMLCAHW

SEQ ID NO: 689939 - protein, 9 aa, Homo Sapiens
FPLSNGNSG

SEQ ID NO: 689940 - protein, 9 aa, Homo Sapiens
CKILENRNG

SEQ ID NO: 689941 - protein, 9 aa, Homo Sapiens
AHISTWLYE

SEQ ID NO: 689942 - protein, 9 aa, Homo Sapiens
MEASLQTGM

SEQ ID NO: 689943 - protein, 9 aa, Homo Sapiens
VVVKKLSSL

SEQ ID NO: 689944 - protein, 9 aa, Homo Sapiens
SSKSQKRIM

SEQ ID NO: 689945 - protein, 9 aa, Homo Sapiens
RDSTKRALA

SEQ ID NO: 689946 - protein, 9 aa, Homo Sapiens
FWNTMKKPL

SEQ ID NO: 689947 - protein, 9 aa, Homo Sapiens
AGIRMFAVG

SEQ ID NO: 689948 - protein, 9 aa, Homo Sapiens
GREGMHLKN

SEQ ID NO: 689949 - protein, 9 aa, Homo Sapiens
LDDKEVSEF

SEQ ID NO: 689950 - protein, 9 aa, Homo Sapiens
LFLSVHDAM

SEQ ID NO: 689951 - protein, 9 aa, Homo Sapiens
RYLLQPLED

SEQ ID NO: 689952 - protein, 9 aa, Homo Sapiens
SFTWKYEGK

SEQ ID NO: 689953 - protein, 9 aa, Homo Sapiens
NEAEKDCFI

SEQ ID NO: 689954 - protein, 9 aa, Homo Sapiens
ECNFFTSVD

SEQ ID NO: 689955 - protein, 9 aa, Homo Sapiens
PTPPVVCST

SEQ ID NO: 689956 - protein, 9 aa, Homo Sapiens
LNSTTLSDS

SEQ ID NO: 689957 - protein, 9 aa, Homo Sapiens
EMGKQEMET

SEQ ID NO: 689958 - protein, 9 aa, Homo Sapiens
EVTDAEDYD

SEQ ID NO: 689959 - protein, 9 aa, Homo Sapiens
TVPQEPGAP

SEQ ID NO: 689960 - protein, 9 aa, Homo Sapiens
MLVDKARQD

SEQ ID NO: 689961 - protein, 9 aa, Homo Sapiens
PGLPPTNES

SEQ ID NO: 689962 - protein, 9 aa, Homo Sapiens
YQKAIVSKF

SEQ ID NO: 689963 - protein, 9 aa, Homo Sapiens
DPVETPPPD

SEQ ID NO: 689964 - protein, 9 aa, Homo Sapiens
TEQNPGSAS

SEQ ID NO: 689965 - protein, 9 aa, Homo Sapiens
RDRHTMKHS

SEQ ID NO: 689966 - protein, 9 aa, Homo Sapiens
MGFYSGIFF

SEQ ID NO: 689967 - protein, 9 aa, Homo Sapiens
KFKRHYVNS

SEQ ID NO: 689968 - protein, 9 aa, Homo Sapiens
MGGCREHFK

SEQ ID NO: 689969 - protein, 9 aa, Homo Sapiens
ETSVNTENL

SEQ ID NO: 689970 - protein, 9 aa, Homo Sapiens
FSNVAEEET

SEQ ID NO: 689971 - protein, 9 aa, Homo Sapiens
KETKRIKRA

SEQ ID NO: 689972 - protein, 9 aa, Homo Sapiens
EELTAEVSL

SEQ ID NO: 689973 - protein, 9 aa, Homo Sapiens
LGIAKLVHF

SEQ ID NO: 689974 - protein, 9 aa, Homo Sapiens
FDGILVVVY

SEQ ID NO: 689975 - protein, 9 aa, Homo Sapiens
AFACPRVPM

SEQ ID NO: 689976 - protein, 9 aa, Homo Sapiens
QGVIKFRKD

SEQ ID NO: 689977 - protein, 9 aa, Homo Sapiens
PPSADDNMK

SEQ ID NO: 689978 - protein, 9 aa, Homo Sapiens
TQLVGTQSA

SEQ ID NO: 689979 - protein, 9 aa, Homo Sapiens
LQCSLDWLL

SEQ ID NO: 689980 - protein, 9 aa, Homo Sapiens
DDYLEDEGD

SEQ ID NO: 689981 - protein, 9 aa, Homo Sapiens
RKAQALAEG

SEQ ID NO: 689982 - protein, 9 aa, Homo Sapiens
YARGRTTYE

SEQ ID NO: 689983 - protein, 9 aa, Homo Sapiens
TYGRVFHFL

SEQ ID NO: 689984 - protein, 9 aa, Homo Sapiens
DVTEESKAV

SEQ ID NO: 689985 - protein, 9 aa, Homo Sapiens
EVKFNWFVD

SEQ ID NO: 689986 - protein, 9 aa, Homo Sapiens
EVIYVWTNG

SEQ ID NO: 689987 - protein, 9 aa, Homo Sapiens
PTNCHMNLM

SEQ ID NO: 689988 - protein, 9 aa, Homo Sapiens
ILLKKVDQN

SEQ ID NO: 689989 - protein, 9 aa, Homo Sapiens
MLSYQDDKN

SEQ ID NO: 689990 - protein, 9 aa, Homo Sapiens
ATNFLILSM

SEQ ID NO: 689991 - protein, 9 aa, Homo Sapiens
AGLSLRTEQ

SEQ ID NO: 689992 - protein, 9 aa, Homo Sapiens
PAFLLLANQ

SEQ ID NO: 689993 - protein, 9 aa, Homo Sapiens
NSGGWSAVL

SEQ ID NO: 689994 - protein, 9 aa, Homo Sapiens
EKCYRVTKG

SEQ ID NO: 689995 - protein, 9 aa, Homo Sapiens
DYLCSLHSR

SEQ ID NO: 689996 - protein, 9 aa, Homo Sapiens
ENFLEDSQE

SEQ ID NO: 689997 - protein, 9 aa, Homo Sapiens
KESPHTGDS

SEQ ID NO: 689998 - protein, 9 aa, Homo Sapiens
KEQKTVLLD

SEQ ID NO: 689999 - protein, 9 aa, Homo Sapiens
RSMMGKCCH

SEQ ID NO: 690000 - protein, 9 aa, Homo Sapiens
LGLAPGQPF

SEQ ID NO: 690001 - protein, 9 aa, Homo Sapiens
FEWLCDWWI

SEQ ID NO: 690002 - protein, 9 aa, Homo Sapiens
QRWLAEKKQ

SEQ ID NO: 690003 - protein, 9 aa, Homo Sapiens
PRTVFRNLR

SEQ ID NO: 690004 - protein, 9 aa, Homo Sapiens
SSMSSFTGA

SEQ ID NO: 690005 - protein, 9 aa, Homo Sapiens
EQNLQLQNT

SEQ ID NO: 690006 - protein, 9 aa, Homo Sapiens
VVSILHTMF

SEQ ID NO: 690007 - protein, 9 aa, Homo Sapiens
MQFMGNKVD

SEQ ID NO: 690008 - protein, 9 aa, Homo Sapiens
VRFYFLCTV

SEQ ID NO: 690009 - protein, 9 aa, Homo Sapiens
GLSKSSKPT

SEQ ID NO: 690010 - protein, 9 aa, Homo Sapiens
KSIPELNSV

SEQ ID NO: 690011 - protein, 9 aa, Homo Sapiens
RWSLSCSFL

SEQ ID NO: 690012 - protein, 9 aa, Homo Sapiens
KVCLRPLGD

SEQ ID NO: 690013 - protein, 9 aa, Homo Sapiens
ATSSWPRLQ

SEQ ID NO: 690014 - protein, 9 aa, Homo Sapiens
PRAHLPDCA

SEQ ID NO: 690015 - protein, 9 aa, Homo Sapiens
YRDRHTMKH

SEQ ID NO: 690016 - protein, 9 aa, Homo Sapiens
LSPCIWVIF

SEQ ID NO: 690017 - protein, 9 aa, Homo Sapiens
PQPFLVRPL

SEQ ID NO: 690018 - protein, 9 aa, Homo Sapiens
AWWGKIPRK

SEQ ID NO: 690019 - protein, 9 aa, Homo Sapiens
LEDEGDSSV

SEQ ID NO: 690020 - protein, 9 aa, Homo Sapiens
VKASVPSAC

SEQ ID NO: 690021 - protein, 9 aa, Homo Sapiens
LNKWTLTPL

SEQ ID NO: 690022 - protein, 9 aa, Homo Sapiens
QTPLWVTQP

SEQ ID NO: 690023 - protein, 9 aa, Homo Sapiens
MNPECNFFT

SEQ ID NO: 690024 - protein, 9 aa, Homo Sapiens
RYVYEAFYK

SEQ ID NO: 690025 - protein, 9 aa, Homo Sapiens
DHTQYRLGI

SEQ ID NO: 690026 - protein, 9 aa, Homo Sapiens
GGGRKPFPV

SEQ ID NO: 690027 - protein, 9 aa, Homo Sapiens
KIGGLPVTR

SEQ ID NO: 690028 - protein, 9 aa, Homo Sapiens
ISLLYNMND

SEQ ID NO: 690029 - protein, 9 aa, Homo Sapiens
PTEGGAHIT

SEQ ID NO: 690030 - protein, 9 aa, Homo Sapiens
KEVSEFALD

SEQ ID NO: 690031 - protein, 9 aa, Homo Sapiens
LQPTDDLLC

SEQ ID NO: 690032 - protein, 9 aa, Homo Sapiens
LTLLLLLVA

SEQ ID NO: 690033 - protein, 9 aa, Homo Sapiens
ECDSLGTLH

SEQ ID NO: 690034 - protein, 9 aa, Homo Sapiens
RCFNWHSGY

SEQ ID NO: 690035 - protein, 9 aa, Homo Sapiens
HPDMKIEKV

SEQ ID NO: 690036 - protein, 9 aa, Homo Sapiens
GLLPDVGGG

SEQ ID NO: 690037 - protein, 9 aa, Homo Sapiens
IVGNWSVCS

SEQ ID NO: 690038 - protein, 9 aa, Homo Sapiens
LSDFISMDP

SEQ ID NO: 690039 - protein, 9 aa, Homo Sapiens
AACVNVLQE

SEQ ID NO: 690040 - protein, 9 aa, Homo Sapiens
SENARMFTS

SEQ ID NO: 690041 - protein, 9 aa, Homo Sapiens
CVDWERLAS

SEQ ID NO: 690042 - protein, 9 aa, Homo Sapiens
SSVHHCSIP

SEQ ID NO: 690043 - protein, 9 aa, Homo Sapiens
KKKRTKDKI

SEQ ID NO: 690044 - protein, 9 aa, Homo Sapiens
PLSMLKGKP

SEQ ID NO: 690045 - protein, 9 aa, Homo Sapiens
IQHEGKGQE

SEQ ID NO: 690046 - protein, 9 aa, Homo Sapiens
PKRGLVVRI

SEQ ID NO: 690047 - protein, 9 aa, Homo Sapiens
DFRRETDAR

SEQ ID NO: 690048 - protein, 9 aa, Homo Sapiens
FLHVYDGKF

SEQ ID NO: 690049 - protein, 9 aa, Homo Sapiens
LVLHLRRSR

SEQ ID NO: 690050 - protein, 9 aa, Homo Sapiens
KYELLMPHR

SEQ ID NO: 690051 - protein, 9 aa, Homo Sapiens
HAASFTWKY

SEQ ID NO: 690052 - protein, 9 aa, Homo Sapiens
KNFFFFFFF

SEQ ID NO: 690053 - protein, 9 aa, Homo Sapiens
PPAAWPAAS

SEQ ID NO: 690054 - protein, 9 aa, Homo Sapiens
LLRHKRTHS

SEQ ID NO: 690055 - protein, 9 aa, Homo Sapiens
EPKVLQDSL

SEQ ID NO: 690056 - protein, 9 aa, Homo Sapiens
NALRQDPSG

SEQ ID NO: 690057 - protein, 9 aa, Homo Sapiens
DKIVDIDDP

SEQ ID NO: 690058 - protein, 9 aa, Homo Sapiens
TSPFQEHTI

SEQ ID NO: 690059 - protein, 9 aa, Homo Sapiens
TITSSASSG

SEQ ID NO: 690060 - protein, 9 aa, Homo Sapiens
YPQGSRQIL

SEQ ID NO: 690061 - protein, 9 aa, Homo Sapiens
SKAVYEKMF

SEQ ID NO: 690062 - protein, 9 aa, Homo Sapiens
EMDALRIHM

SEQ ID NO: 690063 - protein, 9 aa, Homo Sapiens
KRGLVVRIT

SEQ ID NO: 690064 - protein, 9 aa, Homo Sapiens
GIGAVCSAL

SEQ ID NO: 690065 - protein, 9 aa, Homo Sapiens
VFRNLRSSL

SEQ ID NO: 690066 - protein, 9 aa, Homo Sapiens
ICNMGTNAC

SEQ ID NO: 690067 - protein, 9 aa, Homo Sapiens
PSTEPHPGP

SEQ ID NO: 690068 - protein, 9 aa, Homo Sapiens
GSLSFRISE

SEQ ID NO: 690069 - protein, 9 aa, Homo Sapiens
SRNTDTLVV

SEQ ID NO: 690070 - protein, 9 aa, Homo Sapiens
LCAHWEKKK

SEQ ID NO: 690071 - protein, 9 aa, Homo Sapiens
KYLKRKDIK

SEQ ID NO: 690072 - protein, 9 aa, Homo Sapiens
QLLERRGSG

SEQ ID NO: 690073 - protein, 9 aa, Homo Sapiens
PHTGDSGKV

SEQ ID NO: 690074 - protein, 9 aa, Homo Sapiens
PCVLSPTTS

SEQ ID NO: 690075 - protein, 9 aa, Homo Sapiens
EGRSFSGVT

SEQ ID NO: 690076 - protein, 9 aa, Homo Sapiens
AVQDDQVAP

SEQ ID NO: 690077 - protein, 9 aa, Homo Sapiens
HEDTGIISN

SEQ ID NO: 690078 - protein, 9 aa, Homo Sapiens
NSGEFQIAK

SEQ ID NO: 690079 - protein, 9 aa, Homo Sapiens
TNTTGRRGR

SEQ ID NO: 690080 - protein, 9 aa, Homo Sapiens
FIGLAGTGD

SEQ ID NO: 690081 - protein, 9 aa, Homo Sapiens
LLNLTRSYR

SEQ ID NO: 690082 - protein, 9 aa, Homo Sapiens
LNVSEIYRC

SEQ ID NO: 690083 - protein, 9 aa, Homo Sapiens
DLPHTAIQK

SEQ ID NO: 690084 - protein, 9 aa, Homo Sapiens
HSKEDLKFD

SEQ ID NO: 690085 - protein, 9 aa, Homo Sapiens
VKILRFNKA

SEQ ID NO: 690086 - protein, 9 aa, Homo Sapiens
YNNVVGGQR

SEQ ID NO: 690087 - protein, 9 aa, Homo Sapiens
PLGIGRLPL

SEQ ID NO: 690088 - protein, 9 aa, Homo Sapiens
KTENGKSQQ

SEQ ID NO: 690089 - protein, 9 aa, Homo Sapiens
QSVPAHKAN

SEQ ID NO: 690090 - protein, 9 aa, Homo Sapiens
TMFRVGLVL

SEQ ID NO: 690091 - protein, 9 aa, Homo Sapiens
EDQRTLLME

SEQ ID NO: 690092 - protein, 9 aa, Homo Sapiens
MISVKTHNF

SEQ ID NO: 690093 - protein, 9 aa, Homo Sapiens
CGRGGDDYL

SEQ ID NO: 690094 - protein, 9 aa, Homo Sapiens
PHFKLHPHD

SEQ ID NO: 690095 - protein, 9 aa, Homo Sapiens
KALGDRVSI

SEQ ID NO: 690096 - protein, 9 aa, Homo Sapiens
DRKNYSKVQ

SEQ ID NO: 690097 - protein, 9 aa, Homo Sapiens
EMARRNWIC

SEQ ID NO: 690098 - protein, 9 aa, Homo Sapiens
NYSTASSHF

SEQ ID NO: 690099 - protein, 9 aa, Homo Sapiens
LKEEGLWPE

SEQ ID NO: 690100 - protein, 9 aa, Homo Sapiens
CHDTTWPEE

SEQ ID NO: 690101 - protein, 9 aa, Homo Sapiens
SLEKAQINI

SEQ ID NO: 690102 - protein, 9 aa, Homo Sapiens
SEEVRHLKT

SEQ ID NO: 690103 - protein, 9 aa, Homo Sapiens
GESFVCSSD

SEQ ID NO: 690104 - protein, 9 aa, Homo Sapiens
IKCSTSLHV

SEQ ID NO: 690105 - protein, 9 aa, Homo Sapiens
HSTLGELPA

SEQ ID NO: 690106 - protein, 9 aa, Homo Sapiens
VAESEEARL

SEQ ID NO: 690107 - protein, 9 aa, Homo Sapiens
IKIWFHNRR

SEQ ID NO: 690108 - protein, 9 aa, Homo Sapiens
QALSCFLHT

SEQ ID NO: 690109 - protein, 9 aa, Homo Sapiens
ETKEAALTY

SEQ ID NO: 690110 - protein, 9 aa, Homo Sapiens
EPRPAEETY

SEQ ID NO: 690111 - protein, 9 aa, Homo Sapiens
LVQNMRAFD

SEQ ID NO: 690112 - protein, 9 aa, Homo Sapiens
LDTVQKPYV

SEQ ID NO: 690113 - protein, 9 aa, Homo Sapiens
HLRRSREFL

SEQ ID NO: 690114 - protein, 9 aa, Homo Sapiens
PHSYHTPDQ

SEQ ID NO: 690115 - protein, 9 aa, Homo Sapiens
SGATFIYQS

SEQ ID NO: 690116 - protein, 9 aa, Homo Sapiens
VNLLKNTPS

SEQ ID NO: 690117 - protein, 9 aa, Homo Sapiens
HYVNSTRRA

SEQ ID NO: 690118 - protein, 9 aa, Homo Sapiens
PPGGRSNMT

SEQ ID NO: 690119 - protein, 9 aa, Homo Sapiens
PAAWPAASR

SEQ ID NO: 690120 - protein, 9 aa, Homo Sapiens
LAFHQRISL

SEQ ID NO: 690121 - protein, 9 aa, Homo Sapiens
MDLPHTEGA

SEQ ID NO: 690122 - protein, 9 aa, Homo Sapiens
DICSWELFI

SEQ ID NO: 690123 - protein, 9 aa, Homo Sapiens
MLIGEIFQL

SEQ ID NO: 690124 - protein, 9 aa, Homo Sapiens
LRALLQQAR

SEQ ID NO: 690125 - protein, 9 aa, Homo Sapiens
YMCDHGQVT

SEQ ID NO: 690126 - protein, 9 aa, Homo Sapiens
KFHVDDFAE

SEQ ID NO: 690127 - protein, 9 aa, Homo Sapiens
LHGTICDPI

SEQ ID NO: 690128 - protein, 9 aa, Homo Sapiens
SSRIDNTTT

SEQ ID NO: 690129 - protein, 9 aa, Homo Sapiens
KSISCEHVN

SEQ ID NO: 690130 - protein, 9 aa, Homo Sapiens
LLAWRGWDT

SEQ ID NO: 690131 - protein, 9 aa, Homo Sapiens
ESFEEMLQN

SEQ ID NO: 690132 - protein, 9 aa, Homo Sapiens
CDLGIQSVI

SEQ ID NO: 690133 - protein, 9 aa, Homo Sapiens
WHVYNDSCV

SEQ ID NO: 690134 - protein, 9 aa, Homo Sapiens
HTGRLDFSL

SEQ ID NO: 690135 - protein, 9 aa, Homo Sapiens
PKFMFKVIG

SEQ ID NO: 690136 - protein, 9 aa, Homo Sapiens
NLIQLTGHS

SEQ ID NO: 690137 - protein, 9 aa, Homo Sapiens
YSKFTASFT

SEQ ID NO: 690138 - protein, 9 aa, Homo Sapiens
GEIFQLMQF

SEQ ID NO: 690139 - protein, 9 aa, Homo Sapiens
NKMALRYPE

SEQ ID NO: 690140 - protein, 9 aa, Homo Sapiens
DASRYLFRN

SEQ ID NO: 690141 - protein, 9 aa, Homo Sapiens
EGGTESKTS

SEQ ID NO: 690142 - protein, 9 aa, Homo Sapiens
VVCSTPPTG

SEQ ID NO: 690143 - protein, 9 aa, Homo Sapiens
GATFIYQSS

SEQ ID NO: 690144 - protein, 9 aa, Homo Sapiens
SMRRKSLRS

SEQ ID NO: 690145 - protein, 9 aa, Homo Sapiens
LDPSIKNTE

SEQ ID NO: 690146 - protein, 9 aa, Homo Sapiens
SIPISKKSK

SEQ ID NO: 690147 - protein, 9 aa, Homo Sapiens
TKECQKHFE

SEQ ID NO: 690148 - protein, 9 aa, Homo Sapiens
TSVAVFVRI

SEQ ID NO: 690149 - protein, 9 aa, Homo Sapiens
SYAVILCCI

SEQ ID NO: 690150 - protein, 9 aa, Homo Sapiens
PSRLPAAGS

SEQ ID NO: 690151 - protein, 9 aa, Homo Sapiens
PSGEHTLQV

SEQ ID NO: 690152 - protein, 9 aa, Homo Sapiens
SAILNKWTL

SEQ ID NO: 690153 - protein, 9 aa, Homo Sapiens
PKEVMDVID

SEQ ID NO: 690154 - protein, 9 aa, Homo Sapiens
FQHVLPKMK

SEQ ID NO: 690155 - protein, 9 aa, Homo Sapiens
QILFVGFSL

SEQ ID NO: 690156 - protein, 9 aa, Homo Sapiens
KEGIPPTSR

SEQ ID NO: 690157 - protein, 9 aa, Homo Sapiens
KNVDCPENP

SEQ ID NO: 690158 - protein, 9 aa, Homo Sapiens
FSTVSISLA

SEQ ID NO: 690159 - protein, 9 aa, Homo Sapiens
VNKGGEAEK

SEQ ID NO: 690160 - protein, 9 aa, Homo Sapiens
NSSFNLSVT

SEQ ID NO: 690161 - protein, 9 aa, Homo Sapiens
LQSMHKYKH

SEQ ID NO: 690162 - protein, 9 aa, Homo Sapiens
PITLLGPCV

SEQ ID NO: 690163 - protein, 9 aa, Homo Sapiens
VYSAAFAPK

SEQ ID NO: 690164 - protein, 9 aa, Homo Sapiens
PGTNLEPGV

SEQ ID NO: 690165 - protein, 9 aa, Homo Sapiens
KGSACEFYM

SEQ ID NO: 690166 - protein, 9 aa, Homo Sapiens
RKSRPCIWS

SEQ ID NO: 690167 - protein, 9 aa, Homo Sapiens
LVAERDISS

SEQ ID NO: 690168 - protein, 9 aa, Homo Sapiens
SCTNGCKAV

SEQ ID NO: 690169 - protein, 9 aa, Homo Sapiens
LSFRISELQ

SEQ ID NO: 690170 - protein, 9 aa, Homo Sapiens
MPFCGSNHL

SEQ ID NO: 690171 - protein, 9 aa, Homo Sapiens
SGGKGSKGS

SEQ ID NO: 690172 - protein, 9 aa, Homo Sapiens
RLTDSNLKL

SEQ ID NO: 690173 - protein, 9 aa, Homo Sapiens
KIGMLFQSM

SEQ ID NO: 690174 - protein, 9 aa, Homo Sapiens
PEVAPPNRP

SEQ ID NO: 690175 - protein, 9 aa, Homo Sapiens
TEFHHVAQA

SEQ ID NO: 690176 - protein, 9 aa, Homo Sapiens
QQSDRWSLI

SEQ ID NO: 690177 - protein, 9 aa, Homo Sapiens
ETEGPNSSL

SEQ ID NO: 690178 - protein, 9 aa, Homo Sapiens
SGNWWCWGS

SEQ ID NO: 690179 - protein, 9 aa, Homo Sapiens
HPFHTDLLR

SEQ ID NO: 690180 - protein, 9 aa, Homo Sapiens
DYQFTVCAR

SEQ ID NO: 690181 - protein, 9 aa, Homo Sapiens
AEKLKRETT

SEQ ID NO: 690182 - protein, 9 aa, Homo Sapiens
YQSSVKGQG

SEQ ID NO: 690183 - protein, 9 aa, Homo Sapiens
SYTKAYSRQ

SEQ ID NO: 690184 - protein, 9 aa, Homo Sapiens
VPLPPCTPA

SEQ ID NO: 690185 - protein, 9 aa, Homo Sapiens
KAGCDVRLN

SEQ ID NO: 690186 - protein, 9 aa, Homo Sapiens
SLEEAIEER

SEQ ID NO: 690187 - protein, 9 aa, Homo Sapiens
NEQVRQREK

SEQ ID NO: 690188 - protein, 9 aa, Homo Sapiens
TVRDLMRSI

SEQ ID NO: 690189 - protein, 9 aa, Homo Sapiens
TFYTTKRLI

SEQ ID NO: 690190 - protein, 9 aa, Homo Sapiens
DSEHRRGPG

SEQ ID NO: 690191 - protein, 9 aa, Homo Sapiens
FLHTRLGKL

SEQ ID NO: 690192 - protein, 9 aa, Homo Sapiens
ISTMPFCGS

SEQ ID NO: 690193 - protein, 9 aa, Homo Sapiens
LTEKGIFES

SEQ ID NO: 690194 - protein, 9 aa, Homo Sapiens
IFFCVGRLK

SEQ ID NO: 690195 - protein, 9 aa, Homo Sapiens
SEVVMLCAH

SEQ ID NO: 690196 - protein, 9 aa, Homo Sapiens
QAKCENPEF

SEQ ID NO: 690197 - protein, 9 aa, Homo Sapiens
ISSLFHFCG

SEQ ID NO: 690198 - protein, 9 aa, Homo Sapiens
DKARQDYSE

SEQ ID NO: 690199 - protein, 9 aa, Homo Sapiens
EKVPELTLP

SEQ ID NO: 690200 - protein, 9 aa, Homo Sapiens
LERGSITFW

SEQ ID NO: 690201 - protein, 9 aa, Homo Sapiens
DFMGSLSFR

SEQ ID NO: 690202 - protein, 9 aa, Homo Sapiens
TVQKPYVHK

SEQ ID NO: 690203 - protein, 9 aa, Homo Sapiens
KTEEVTAVR

SEQ ID NO: 690204 - protein, 9 aa, Homo Sapiens
KRYILKTDN

SEQ ID NO: 690205 - protein, 9 aa, Homo Sapiens
GQTPKVVPP

SEQ ID NO: 690206 - protein, 9 aa, Homo Sapiens
QRKNELKLA

SEQ ID NO: 690207 - protein, 9 aa, Homo Sapiens
THYWTSINH

SEQ ID NO: 690208 - protein, 9 aa, Homo Sapiens
LKTDLRFQS

SEQ ID NO: 690209 - protein, 9 aa, Homo Sapiens
HHNPRLMKD

SEQ ID NO: 690210 - protein, 9 aa, Homo Sapiens
LVFHNPINR

SEQ ID NO: 690211 - protein, 9 aa, Homo Sapiens
KHYNILTRI

SEQ ID NO: 690212 - protein, 9 aa, Homo Sapiens
SGCSMLAIG

SEQ ID NO: 690213 - protein, 9 aa, Homo Sapiens
YVLSGNGKV

SEQ ID NO: 690214 - protein, 9 aa, Homo Sapiens
IRNKNGLQL

SEQ ID NO: 690215 - protein, 9 aa, Homo Sapiens
VQNLPANTQ

SEQ ID NO: 690216 - protein, 9 aa, Homo Sapiens
NKAEKFHFV

SEQ ID NO: 690217 - protein, 9 aa, Homo Sapiens
YSGFATDST

SEQ ID NO: 690218 - protein, 9 aa, Homo Sapiens
RSLEEARAQ

SEQ ID NO: 690219 - protein, 9 aa, Homo Sapiens
AAWPAASRV

SEQ ID NO: 690220 - protein, 9 aa, Homo Sapiens
AWISTMPFC

SEQ ID NO: 690221 - protein, 9 aa, Homo Sapiens
KIGNQEVVI

SEQ ID NO: 690222 - protein, 9 aa, Homo Sapiens
AEVTLAEID

SEQ ID NO: 690223 - protein, 9 aa, Homo Sapiens
VDKKCQLDV

SEQ ID NO: 690224 - protein, 9 aa, Homo Sapiens
SVAKQLQKA

SEQ ID NO: 690225 - protein, 9 aa, Homo Sapiens
AVQEAFELM

SEQ ID NO: 690226 - protein, 9 aa, Homo Sapiens
VTILPAKNK

SEQ ID NO: 690227 - protein, 9 aa, Homo Sapiens
YDRQAESHS

SEQ ID NO: 690228 - protein, 9 aa, Homo Sapiens
RKVMQFMGN

SEQ ID NO: 690229 - protein, 9 aa, Homo Sapiens
HKKQELIED

SEQ ID NO: 690230 - protein, 9 aa, Homo Sapiens
LEIFELDLC

SEQ ID NO: 690231 - protein, 9 aa, Homo Sapiens
VARRFMKLD

SEQ ID NO: 690232 - protein, 9 aa, Homo Sapiens
SYPILHEWA

SEQ ID NO: 690233 - protein, 9 aa, Homo Sapiens
TRRSCAFTP

SEQ ID NO: 690234 - protein, 9 aa, Homo Sapiens
EELHKKQEL

SEQ ID NO: 690235 - protein, 9 aa, Homo Sapiens
PANSGVAHT

SEQ ID NO: 690236 - protein, 9 aa, Homo Sapiens
EQLSHSSQV

SEQ ID NO: 690237 - protein, 9 aa, Homo Sapiens
TTVITIVMK

SEQ ID NO: 690238 - protein, 9 aa, Homo Sapiens
APSPQVVYE

SEQ ID NO: 690239 - protein, 9 aa, Homo Sapiens
AKQSEEGPA

SEQ ID NO: 690240 - protein, 9 aa, Homo Sapiens
HHCLKITVN

SEQ ID NO: 690241 - protein, 9 aa, Homo Sapiens
GGLPVTRVI

SEQ ID NO: 690242 - protein, 9 aa, Homo Sapiens
KLSQKVSEK

SEQ ID NO: 690243 - protein, 9 aa, Homo Sapiens
SQSVPAHKA

SEQ ID NO: 690244 - protein, 9 aa, Homo Sapiens
NWFVDGVEV

SEQ ID NO: 690245 - protein, 9 aa, Homo Sapiens
LLTWDEEAD

SEQ ID NO: 690246 - protein, 9 aa, Homo Sapiens
AASISATAV

SEQ ID NO: 690247 - protein, 9 aa, Homo Sapiens
QFLADVLSP

SEQ ID NO: 690248 - protein, 9 aa, Homo Sapiens
IGGLPVTRV

SEQ ID NO: 690249 - protein, 9 aa, Homo Sapiens
LLGDAGLSL

SEQ ID NO: 690250 - protein, 9 aa, Homo Sapiens
ASLQTGMMG

SEQ ID NO: 690251 - protein, 9 aa, Homo Sapiens
EVLPEEITK

SEQ ID NO: 690252 - protein, 9 aa, Homo Sapiens
ALETWAVPV

SEQ ID NO: 690253 - protein, 9 aa, Homo Sapiens
SACLSPGSV

SEQ ID NO: 690254 - protein, 9 aa, Homo Sapiens
TTPLPVTIT

SEQ ID NO: 690255 - protein, 9 aa, Homo Sapiens
CDSLGTLHG

SEQ ID NO: 690256 - protein, 9 aa, Homo Sapiens
FDDFLFQAS

SEQ ID NO: 690257 - protein, 9 aa, Homo Sapiens
VNFDFTRSY

SEQ ID NO: 690258 - protein, 9 aa, Homo Sapiens
NHTGRLDFS

SEQ ID NO: 690259 - protein, 9 aa, Homo Sapiens
LPVDKIGLH

SEQ ID NO: 690260 - protein, 9 aa, Homo Sapiens
SPLHLTKQT

SEQ ID NO: 690261 - protein, 9 aa, Homo Sapiens
YVAINDPLR

SEQ ID NO: 690262 - protein, 9 aa, Homo Sapiens
FQEHTILTH

SEQ ID NO: 690263 - protein, 9 aa, Homo Sapiens
LPPLALLAS

SEQ ID NO: 690264 - protein, 9 aa, Homo Sapiens
MVRYVYEAF

SEQ ID NO: 690265 - protein, 9 aa, Homo Sapiens
TCMSEEEVL

SEQ ID NO: 690266 - protein, 9 aa, Homo Sapiens
GIKHYNILT

SEQ ID NO: 690267 - protein, 9 aa, Homo Sapiens
LEEKSRVKW

SEQ ID NO: 690268 - protein, 9 aa, Homo Sapiens
KQTPPVQPV

SEQ ID NO: 690269 - protein, 9 aa, Homo Sapiens
LKENLLEYD

SEQ ID NO: 690270 - protein, 9 aa, Homo Sapiens
ERQIKIWFH

SEQ ID NO: 690271 - protein, 9 aa, Homo Sapiens
FLKSTCNTF

SEQ ID NO: 690272 - protein, 9 aa, Homo Sapiens
VKHHPADHP

SEQ ID NO: 690273 - protein, 9 aa, Homo Sapiens
YEESLGEDI

SEQ ID NO: 690274 - protein, 9 aa, Homo Sapiens
RTEQNPGSA

SEQ ID NO: 690275 - protein, 9 aa, Homo Sapiens
FLTTTSRKS

SEQ ID NO: 690276 - protein, 9 aa, Homo Sapiens
HMVEHSFFE

SEQ ID NO: 690277 - protein, 9 aa, Homo Sapiens
SRPVDLPTE

SEQ ID NO: 690278 - protein, 9 aa, Homo Sapiens
ACLDFLWRV

SEQ ID NO: 690279 - protein, 9 aa, Homo Sapiens
SSFLTKRYS

SEQ ID NO: 690280 - protein, 9 aa, Homo Sapiens
AFNNKGDAP

SEQ ID NO: 690281 - protein, 9 aa, Homo Sapiens
CRLERSGIR

SEQ ID NO: 690282 - protein, 9 aa, Homo Sapiens
WISTMPFCG

SEQ ID NO: 690283 - protein, 9 aa, Homo Sapiens
EVSLPSYLE

SEQ ID NO: 690284 - protein, 9 aa, Homo Sapiens
FSSDRAFYT

SEQ ID NO: 690285 - protein, 9 aa, Homo Sapiens
RGMHRGLFP

SEQ ID NO: 690286 - protein, 9 aa, Homo Sapiens
GRGRQEAAG

SEQ ID NO: 690287 - protein, 9 aa, Homo Sapiens
AEMTSTVIS

SEQ ID NO: 690288 - protein, 9 aa, Homo Sapiens
LVARHYTKA

SEQ ID NO: 690289 - protein, 9 aa, Homo Sapiens
GPRRRRLNR

SEQ ID NO: 690290 - protein, 9 aa, Homo Sapiens
DIHYPGKKV

SEQ ID NO: 690291 - protein, 9 aa, Homo Sapiens
FEAASMLLL

SEQ ID NO: 690292 - protein, 9 aa, Homo Sapiens
MYTTLLIKL

SEQ ID NO: 690293 - protein, 9 aa, Homo Sapiens
MQISGQRAT

SEQ ID NO: 690294 - protein, 9 aa, Homo Sapiens
IVMKAQTEC

SEQ ID NO: 690295 - protein, 9 aa, Homo Sapiens
QARTLIMMF

SEQ ID NO: 690296 - protein, 9 aa, Homo Sapiens
AEKDCFIRF

SEQ ID NO: 690297 - protein, 9 aa, Homo Sapiens
SLVIKLDKD

SEQ ID NO: 690298 - protein, 9 aa, Homo Sapiens
INSALYTTK

SEQ ID NO: 690299 - protein, 9 aa, Homo Sapiens
AFTDQSFFT

SEQ ID NO: 690300 - protein, 9 aa, Homo Sapiens
SPLHASLCC

SEQ ID NO: 690301 - protein, 9 aa, Homo Sapiens
FLGTVENEH

SEQ ID NO: 690302 - protein, 9 aa, Homo Sapiens
NARMFTSVL

SEQ ID NO: 690303 - protein, 9 aa, Homo Sapiens
GCLLSWCYL

SEQ ID NO: 690304 - protein, 9 aa, Homo Sapiens
LLVGASMLQ

SEQ ID NO: 690305 - protein, 9 aa, Homo Sapiens
VSKFLYYSI

SEQ ID NO: 690306 - protein, 9 aa, Homo Sapiens
EDQWVEKKV

SEQ ID NO: 690307 - protein, 9 aa, Homo Sapiens
GGGSGGFPG

SEQ ID NO: 690308 - protein, 9 aa, Homo Sapiens
RPEPTNSSF

SEQ ID NO: 690309 - protein, 9 aa, Homo Sapiens
TLRDCDQQS

SEQ ID NO: 690310 - protein, 9 aa, Homo Sapiens
PLALLASFA

SEQ ID NO: 690311 - protein, 9 aa, Homo Sapiens
IYQERRMEK

SEQ ID NO: 690312 - protein, 9 aa, Homo Sapiens
ANDKITHTE

SEQ ID NO: 690313 - protein, 9 aa, Homo Sapiens
YNSHAASFT

SEQ ID NO: 690314 - protein, 9 aa, Homo Sapiens
QGCLLSWCY

SEQ ID NO: 690315 - protein, 9 aa, Homo Sapiens
VEESLQCSL

SEQ ID NO: 690316 - protein, 9 aa, Homo Sapiens
KTLQFKAQD

SEQ ID NO: 690317 - protein, 9 aa, Homo Sapiens
SKFTASFTS

SEQ ID NO: 690318 - protein, 9 aa, Homo Sapiens
SRDNSFLLD

SEQ ID NO: 690319 - protein, 9 aa, Homo Sapiens
DKEKDVKKD

SEQ ID NO: 690320 - protein, 9 aa, Homo Sapiens
MNTMDKTIV

SEQ ID NO: 690321 - protein, 9 aa, Homo Sapiens
VPMPVAGHP

SEQ ID NO: 690322 - protein, 9 aa, Homo Sapiens
MGGFHCMQR

SEQ ID NO: 690323 - protein, 9 aa, Homo Sapiens
RTEVFQTAS

SEQ ID NO: 690324 - protein, 9 aa, Homo Sapiens
SSYMQISGQ

SEQ ID NO: 690325 - protein, 9 aa, Homo Sapiens
RKRARAKEE

SEQ ID NO: 690326 - protein, 9 aa, Homo Sapiens
AYNIDDTCG

SEQ ID NO: 690327 - protein, 9 aa, Homo Sapiens
VQKMLISSI

SEQ ID NO: 690328 - protein, 9 aa, Homo Sapiens
EITKESLEE

SEQ ID NO: 690329 - protein, 9 aa, Homo Sapiens
ARRFFLHIA

SEQ ID NO: 690330 - protein, 9 aa, Homo Sapiens
FHNPINRQR

SEQ ID NO: 690331 - protein, 9 aa, Homo Sapiens
PLLVSDVMA

SEQ ID NO: 690332 - protein, 9 aa, Homo Sapiens
EAVSSPSAA

SEQ ID NO: 690333 - protein, 9 aa, Homo Sapiens
QKHPKKDRP

SEQ ID NO: 690334 - protein, 9 aa, Homo Sapiens
ANNHILLWD

SEQ ID NO: 690335 - protein, 9 aa, Homo Sapiens
YHRWSLSCS

SEQ ID NO: 690336 - protein, 9 aa, Homo Sapiens
CYGKVFVIL

SEQ ID NO: 690337 - protein, 9 aa, Homo Sapiens
VKKDDKEKD

SEQ ID NO: 690338 - protein, 9 aa, Homo Sapiens
RPPLKDILC

SEQ ID NO: 690339 - protein, 9 aa, Homo Sapiens
YLKRKDIKS

SEQ ID NO: 690340 - protein, 9 aa, Homo Sapiens
QFFYLPYFK

SEQ ID NO: 690341 - protein, 9 aa, Homo Sapiens
YLFKAYVLL

SEQ ID NO: 690342 - protein, 9 aa, Homo Sapiens
QINEHKFEG

SEQ ID NO: 690343 - protein, 9 aa, Homo Sapiens
AEVSLPSYL

SEQ ID NO: 690344 - protein, 9 aa, Homo Sapiens
PLGRADFDD

SEQ ID NO: 690345 - protein, 9 aa, Homo Sapiens
FNVKFYSPD

SEQ ID NO: 690346 - protein, 9 aa, Homo Sapiens
DIIFTLLKE

SEQ ID NO: 690347 - protein, 9 aa, Homo Sapiens
LQLLAAAVD

SEQ ID NO: 690348 - protein, 9 aa, Homo Sapiens
HPGPELPPG

SEQ ID NO: 690349 - protein, 9 aa, Homo Sapiens
EINLLPLAQ

SEQ ID NO: 690350 - protein, 9 aa, Homo Sapiens
YRLLAGHVS

SEQ ID NO: 690351 - protein, 9 aa, Homo Sapiens
SVKAIESYV

SEQ ID NO: 690352 - protein, 9 aa, Homo Sapiens
CVLSPTTSR

SEQ ID NO: 690353 - protein, 9 aa, Homo Sapiens
QMSQERGVQ

SEQ ID NO: 690354 - protein, 9 aa, Homo Sapiens
PSIKNTEWS

SEQ ID NO: 690355 - protein, 9 aa, Homo Sapiens
NKWTLTPLA

SEQ ID NO: 690356 - protein, 9 aa, Homo Sapiens
HTEWQQLVD

SEQ ID NO: 690357 - protein, 9 aa, Homo Sapiens
RFYFLCTVE

SEQ ID NO: 690358 - protein, 9 aa, Homo Sapiens
IECLSLASR

SEQ ID NO: 690359 - protein, 9 aa, Homo Sapiens
ERRIECLSL

SEQ ID NO: 690360 - protein, 9 aa, Homo Sapiens
ETSPLTRRS

SEQ ID NO: 690361 - protein, 9 aa, Homo Sapiens
GTGDAGGLA

SEQ ID NO: 690362 - protein, 9 aa, Homo Sapiens
GIFGQDRAT

SEQ ID NO: 690363 - protein, 9 aa, Homo Sapiens
VEGPSASTE

SEQ ID NO: 690364 - protein, 9 aa, Homo Sapiens
LCGSGNNED

SEQ ID NO: 690365 - protein, 9 aa, Homo Sapiens
FGDTAKSIP

SEQ ID NO: 690366 - protein, 9 aa, Homo Sapiens
CEFYMCDHG

SEQ ID NO: 690367 - protein, 9 aa, Homo Sapiens
NTPGARQRL

SEQ ID NO: 690368 - protein, 9 aa, Homo Sapiens
NVCGCAPQQ

SEQ ID NO: 690369 - protein, 9 aa, Homo Sapiens
KRTKDKIVD

SEQ ID NO: 690370 - protein, 9 aa, Homo Sapiens
KQAPEATSG

SEQ ID NO: 690371 - protein, 9 aa, Homo Sapiens
RDNSFLLDR

SEQ ID NO: 690372 - protein, 9 aa, Homo Sapiens
FCLSVKAIE

SEQ ID NO: 690373 - protein, 9 aa, Homo Sapiens
EYSIRSCTN

SEQ ID NO: 690374 - protein, 9 aa, Homo Sapiens
ERRGRQQST

SEQ ID NO: 690375 - protein, 9 aa, Homo Sapiens
AMGCKILEN

SEQ ID NO: 690376 - protein, 9 aa, Homo Sapiens
KPGREDSRA

SEQ ID NO: 690377 - protein, 9 aa, Homo Sapiens
FLYIIGSYT

SEQ ID NO: 690378 - protein, 9 aa, Homo Sapiens
DQENNKTKQ

SEQ ID NO: 690379 - protein, 9 aa, Homo Sapiens
SMLLLGDAG

SEQ ID NO: 690380 - protein, 9 aa, Homo Sapiens
NLEPGVLMS

SEQ ID NO: 690381 - protein, 9 aa, Homo Sapiens
TIWSRARVL

SEQ ID NO: 690382 - protein, 9 aa, Homo Sapiens
NTMDKTIVL

SEQ ID NO: 690383 - protein, 9 aa, Homo Sapiens
RRQRRVLGN

SEQ ID NO: 690384 - protein, 9 aa, Homo Sapiens
KTLNVLHNT

SEQ ID NO: 690385 - protein, 9 aa, Homo Sapiens
ISEVEPKHY

SEQ ID NO: 690386 - protein, 9 aa, Homo Sapiens
CGSCLGIFE

SEQ ID NO: 690387 - protein, 9 aa, Homo Sapiens
PGVEQTGSR

SEQ ID NO: 690388 - protein, 9 aa, Homo Sapiens
KPSLPKKPI

SEQ ID NO: 690389 - protein, 9 aa, Homo Sapiens
LRQHIAKAE

SEQ ID NO: 690390 - protein, 9 aa, Homo Sapiens
ASSQRKNEL

SEQ ID NO: 690391 - protein, 9 aa, Homo Sapiens
PDLNANFLD

SEQ ID NO: 690392 - protein, 9 aa, Homo Sapiens
LMQTLEGTA

SEQ ID NO: 690393 - protein, 9 aa, Homo Sapiens
DSLHSLMST

SEQ ID NO: 690394 - protein, 9 aa, Homo Sapiens
LEKELIEDF

SEQ ID NO: 690395 - protein, 9 aa, Homo Sapiens
VHRSDKLGR

SEQ ID NO: 690396 - protein, 9 aa, Homo Sapiens
LEEFQHVLP

SEQ ID NO: 690397 - protein, 9 aa, Homo Sapiens
VLKFYCRKN

SEQ ID NO: 690398 - protein, 9 aa, Homo Sapiens
HLDEKPYQC

SEQ ID NO: 690399 - protein, 9 aa, Homo Sapiens
CMQRDVQDP

SEQ ID NO: 690400 - protein, 9 aa, Homo Sapiens
LRFNKAKPE

SEQ ID NO: 690401 - protein, 9 aa, Homo Sapiens
PTRYGKSGH

SEQ ID NO: 690402 - protein, 9 aa, Homo Sapiens
LQSGYISGL

SEQ ID NO: 690403 - protein, 9 aa, Homo Sapiens
AGCIYREFE

SEQ ID NO: 690404 - protein, 9 aa, Homo Sapiens
QSSILVQFN

SEQ ID NO: 690405 - protein, 9 aa, Homo Sapiens
TKAEPSVFT

SEQ ID NO: 690406 - protein, 9 aa, Homo Sapiens
CTSYDYCRV

SEQ ID NO: 690407 - protein, 9 aa, Homo Sapiens
YESFKKQEG

SEQ ID NO: 690408 - protein, 9 aa, Homo Sapiens
HNPINRQRL

SEQ ID NO: 690409 - protein, 9 aa, Homo Sapiens
SPSGSPGGS

SEQ ID NO: 690410 - protein, 9 aa, Homo Sapiens
RMQLVPEIR

SEQ ID NO: 690411 - protein, 9 aa, Homo Sapiens
SNGKDYMIS

SEQ ID NO: 690412 - protein, 9 aa, Homo Sapiens
CWRHPFAPC

SEQ ID NO: 690413 - protein, 9 aa, Homo Sapiens
RNFYPAVQN

SEQ ID NO: 690414 - protein, 9 aa, Homo Sapiens
LRGETGTAP

SEQ ID NO: 690415 - protein, 9 aa, Homo Sapiens
EDILRQHIA

SEQ ID NO: 690416 - protein, 9 aa, Homo Sapiens
FLADVLSPE

SEQ ID NO: 690417 - protein, 9 aa, Homo Sapiens
PGTTEPTPP

SEQ ID NO: 690418 - protein, 9 aa, Homo Sapiens
NFLEDSQES

SEQ ID NO: 690419 - protein, 9 aa, Homo Sapiens
PAMMQDMIR

SEQ ID NO: 690420 - protein, 9 aa, Homo Sapiens
EETRGVFKV

SEQ ID NO: 690421 - protein, 9 aa, Homo Sapiens
RTQERIRGA

SEQ ID NO: 690422 - protein, 9 aa, Homo Sapiens
GQTLLPTMQ

SEQ ID NO: 690423 - protein, 9 aa, Homo Sapiens
KGSILAEPE

SEQ ID NO: 690424 - protein, 9 aa, Homo Sapiens
NGNSGGWSA

SEQ ID NO: 690425 - protein, 9 aa, Homo Sapiens
RKTVPQEPG

SEQ ID NO: 690426 - protein, 9 aa, Homo Sapiens
KGIFESCVC

SEQ ID NO: 690427 - protein, 9 aa, Homo Sapiens
EHPPSGIFN

SEQ ID NO: 690428 - protein, 9 aa, Homo Sapiens
VLQEFGAKA

SEQ ID NO: 690429 - protein, 9 aa, Homo Sapiens
QSDRWSLIR

SEQ ID NO: 690430 - protein, 9 aa, Homo Sapiens
RPLSSEKAE

SEQ ID NO: 690431 - protein, 9 aa, Homo Sapiens
LNSDDIEAC

SEQ ID NO: 690432 - protein, 9 aa, Homo Sapiens
SALWECEHR

SEQ ID NO: 690433 - protein, 9 aa, Homo Sapiens
VPKSRLRES

SEQ ID NO: 690434 - protein, 9 aa, Homo Sapiens
DDKNRQLTL

SEQ ID NO: 690435 - protein, 9 aa, Homo Sapiens
QNETEFHHV

SEQ ID NO: 690436 - protein, 9 aa, Homo Sapiens
GQSVAKQLQ

SEQ ID NO: 690437 - protein, 9 aa, Homo Sapiens
EDTGAEGGT

SEQ ID NO: 690438 - protein, 9 aa, Homo Sapiens
IETSVNTEN

SEQ ID NO: 690439 - protein, 9 aa, Homo Sapiens
NAELAPPQG

SEQ ID NO: 690440 - protein, 9 aa, Homo Sapiens
GRKPFPVTR

SEQ ID NO: 690441 - protein, 9 aa, Homo Sapiens
KRKDIKSIR

SEQ ID NO: 690442 - protein, 9 aa, Homo Sapiens
LVPEIRKEE

SEQ ID NO: 690443 - protein, 9 aa, Homo Sapiens
QGSEKEKPQ

SEQ ID NO: 690444 - protein, 9 aa, Homo Sapiens
VCPTGYRSQ

SEQ ID NO: 690445 - protein, 9 aa, Homo Sapiens
QQPSGSDLY

SEQ ID NO: 690446 - protein, 9 aa, Homo Sapiens
FLVKIVDVI

SEQ ID NO: 690447 - protein, 9 aa, Homo Sapiens
MKRPDSETM

SEQ ID NO: 690448 - protein, 9 aa, Homo Sapiens
SIRNKNGLQ

SEQ ID NO: 690449 - protein, 9 aa, Homo Sapiens
DCCAECRSR

SEQ ID NO: 690450 - protein, 9 aa, Homo Sapiens
NSPVLVHEI

SEQ ID NO: 690451 - protein, 9 aa, Homo Sapiens
VAEKVEEPR

SEQ ID NO: 690452 - protein, 9 aa, Homo Sapiens
TMQEKHLHL

SEQ ID NO: 690453 - protein, 9 aa, Homo Sapiens
LLHMYDSYK

SEQ ID NO: 690454 - protein, 9 aa, Homo Sapiens
EKIGNQEVV

SEQ ID NO: 690455 - protein, 9 aa, Homo Sapiens
SWMYLMGFY

SEQ ID NO: 690456 - protein, 9 aa, Homo Sapiens
NSGVAHTDA

SEQ ID NO: 690457 - protein, 9 aa, Homo Sapiens
QKLLETVGV

SEQ ID NO: 690458 - protein, 9 aa, Homo Sapiens
GSSSCGGSV

SEQ ID NO: 690459 - protein, 9 aa, Homo Sapiens
FAPSGEHTL

SEQ ID NO: 690460 - protein, 9 aa, Homo Sapiens
TKAFTTIQI

SEQ ID NO: 690461 - protein, 9 aa, Homo Sapiens
GVEQTGSRG

SEQ ID NO: 690462 - protein, 9 aa, Homo Sapiens
HPKKDRPLA

SEQ ID NO: 690463 - protein, 9 aa, Homo Sapiens
RSLSFHRHI

SEQ ID NO: 690464 - protein, 9 aa, Homo Sapiens
HRNACAAAK

SEQ ID NO: 690465 - protein, 9 aa, Homo Sapiens
ESAVNLKGI

SEQ ID NO: 690466 - protein, 9 aa, Homo Sapiens
SRCTPTGLI

SEQ ID NO: 690467 - protein, 9 aa, Homo Sapiens
HTPEQGSQS

SEQ ID NO: 690468 - protein, 9 aa, Homo Sapiens
IVGTDFKLG

SEQ ID NO: 690469 - protein, 9 aa, Homo Sapiens
EAKENKEGA

SEQ ID NO: 690470 - protein, 9 aa, Homo Sapiens
KLLVEALHV

SEQ ID NO: 690471 - protein, 9 aa, Homo Sapiens
GGPATVPSV

SEQ ID NO: 690472 - protein, 9 aa, Homo Sapiens
QHSIWENGD

SEQ ID NO: 690473 - protein, 9 aa, Homo Sapiens
FLVDKKCQL

SEQ ID NO: 690474 - protein, 9 aa, Homo Sapiens
EYVEVTDAE

SEQ ID NO: 690475 - protein, 9 aa, Homo Sapiens
CWSGNWWCW

SEQ ID NO: 690476 - protein, 9 aa, Homo Sapiens
VVSTGLDSP

SEQ ID NO: 690477 - protein, 9 aa, Homo Sapiens
FIFDVVNKG

SEQ ID NO: 690478 - protein, 9 aa, Homo Sapiens
LSCFLHTRL

SEQ ID NO: 690479 - protein, 9 aa, Homo Sapiens
HQQNETEFH

SEQ ID NO: 690480 - protein, 9 aa, Homo Sapiens
RPDSIRQQQ

SEQ ID NO: 690481 - protein, 9 aa, Homo Sapiens
HLRQKKRNG

SEQ ID NO: 690482 - protein, 9 aa, Homo Sapiens
VSGSPCLDR

SEQ ID NO: 690483 - protein, 9 aa, Homo Sapiens
DECYYDSFS

SEQ ID NO: 690484 - protein, 9 aa, Homo Sapiens
MLRALLQQA

SEQ ID NO: 690485 - protein, 9 aa, Homo Sapiens
HEELNKLLG

SEQ ID NO: 690486 - protein, 9 aa, Homo Sapiens
QPTSTWSHV

SEQ ID NO: 690487 - protein, 9 aa, Homo Sapiens
GVRSLSFHR

SEQ ID NO: 690488 - protein, 9 aa, Homo Sapiens
PTNESQPGR

SEQ ID NO: 690489 - protein, 9 aa, Homo Sapiens
IYAVFESAV

SEQ ID NO: 690490 - protein, 9 aa, Homo Sapiens
HQDLKSAEV

SEQ ID NO: 690491 - protein, 9 aa, Homo Sapiens
APENLDEHI

SEQ ID NO: 690492 - protein, 9 aa, Homo Sapiens
ATSKESPHT

SEQ ID NO: 690493 - protein, 9 aa, Homo Sapiens
QMNPECNFF

SEQ ID NO: 690494 - protein, 9 aa, Homo Sapiens
MGHLRWDRF

SEQ ID NO: 690495 - protein, 9 aa, Homo Sapiens
LLSPVKHHP

SEQ ID NO: 690496 - protein, 9 aa, Homo Sapiens
DEKEPKVLQ

SEQ ID NO: 690497 - protein, 9 aa, Homo Sapiens
APEATSGLM

SEQ ID NO: 690498 - protein, 9 aa, Homo Sapiens
HRCAGRMEV

SEQ ID NO: 690499 - protein, 9 aa, Homo Sapiens
GRGGDDYLE

SEQ ID NO: 690500 - protein, 9 aa, Homo Sapiens
WGKIPRKDL

SEQ ID NO: 690501 - protein, 9 aa, Homo Sapiens
TSEILREFF

SEQ ID NO: 690502 - protein, 9 aa, Homo Sapiens
ATVGPKAPL

SEQ ID NO: 690503 - protein, 9 aa, Homo Sapiens
EEHAAPSEA

SEQ ID NO: 690504 - protein, 9 aa, Homo Sapiens
WEGGREPPK

SEQ ID NO: 690505 - protein, 9 aa, Homo Sapiens
EPFDDFLFQ

SEQ ID NO: 690506 - protein, 9 aa, Homo Sapiens
RNEIGHTPL

SEQ ID NO: 690507 - protein, 9 aa, Homo Sapiens
ILLCSQTSD

SEQ ID NO: 690508 - protein, 9 aa, Homo Sapiens
WVVVKVQAQ

SEQ ID NO: 690509 - protein, 9 aa, Homo Sapiens
DLFLYECET

SEQ ID NO: 690510 - protein, 9 aa, Homo Sapiens
YRYTSEILR

SEQ ID NO: 690511 - protein, 9 aa, Homo Sapiens
VRRTQLELC

SEQ ID NO: 690512 - protein, 9 aa, Homo Sapiens
CNMGTNACA

SEQ ID NO: 690513 - protein, 9 aa, Homo Sapiens
IIQKWSMER

SEQ ID NO: 690514 - protein, 9 aa, Homo Sapiens
KKGSQVVHR

SEQ ID NO: 690515 - protein, 9 aa, Homo Sapiens
LKDIVTQSN

SEQ ID NO: 690516 - protein, 9 aa, Homo Sapiens
MKTPAERLR

SEQ ID NO: 690517 - protein, 9 aa, Homo Sapiens
RVGASTVTA

SEQ ID NO: 690518 - protein, 9 aa, Homo Sapiens
NTDKFVLMR

SEQ ID NO: 690519 - protein, 9 aa, Homo Sapiens
EILPSRLYL

SEQ ID NO: 690520 - protein, 9 aa, Homo Sapiens
MISWMYLMG

SEQ ID NO: 690521 - protein, 9 aa, Homo Sapiens
LQEDVEENR

SEQ ID NO: 690522 - protein, 9 aa, Homo Sapiens
LRGTTFYAD

SEQ ID NO: 690523 - protein, 9 aa, Homo Sapiens
HYADGEDAY

SEQ ID NO: 690524 - protein, 9 aa, Homo Sapiens
LNVLHNTGA

SEQ ID NO: 690525 - protein, 9 aa, Homo Sapiens
LTHESLQLQ

SEQ ID NO: 690526 - protein, 9 aa, Homo Sapiens
TEANENTRE

SEQ ID NO: 690527 - protein, 9 aa, Homo Sapiens
GQENFPDAK

SEQ ID NO: 690528 - protein, 9 aa, Homo Sapiens
EEELTAEVS

SEQ ID NO: 690529 - protein, 9 aa, Homo Sapiens
GRWLLAGLV

SEQ ID NO: 690530 - protein, 9 aa, Homo Sapiens
RGPLVLPAA

SEQ ID NO: 690531 - protein, 9 aa, Homo Sapiens
SSFNLSVTS

SEQ ID NO: 690532 - protein, 9 aa, Homo Sapiens
RQRRVLGNL

SEQ ID NO: 690533 - protein, 9 aa, Homo Sapiens
LGSWLSKQL

SEQ ID NO: 690534 - protein, 9 aa, Homo Sapiens
QGGSRDVLG

SEQ ID NO: 690535 - protein, 9 aa, Homo Sapiens
AFIVKKTLT

SEQ ID NO: 690536 - protein, 9 aa, Homo Sapiens
NNKTKQSFC

SEQ ID NO: 690537 - protein, 9 aa, Homo Sapiens
LLRIGLAFL

SEQ ID NO: 690538 - protein, 9 aa, Homo Sapiens
KAPLGGKKA

SEQ ID NO: 690539 - protein, 9 aa, Homo Sapiens
FYPAVQNLP

SEQ ID NO: 690540 - protein, 9 aa, Homo Sapiens
WRGWDTPYS

SEQ ID NO: 690541 - protein, 9 aa, Homo Sapiens
GVTCMSEEE

SEQ ID NO: 690542 - protein, 9 aa, Homo Sapiens
IQSVIAFAT

SEQ ID NO: 690543 - protein, 9 aa, Homo Sapiens
ARAPMSNYI

SEQ ID NO: 690544 - protein, 9 aa, Homo Sapiens
KTLVLHLRR

SEQ ID NO: 690545 - protein, 9 aa, Homo Sapiens
SGRDAAHLA

SEQ ID NO: 690546 - protein, 9 aa, Homo Sapiens
DDFLFQASS

SEQ ID NO: 690547 - protein, 9 aa, Homo Sapiens
DMGSMNGQK

SEQ ID NO: 690548 - protein, 9 aa, Homo Sapiens
QGTKQACRC

SEQ ID NO: 690549 - protein, 9 aa, Homo Sapiens
DLQHLYGYV

SEQ ID NO: 690550 - protein, 9 aa, Homo Sapiens
IVDTTGLKG

SEQ ID NO: 690551 - protein, 9 aa, Homo Sapiens
YFKQLHTAT

SEQ ID NO: 690552 - protein, 9 aa, Homo Sapiens
RRRLNREQL

SEQ ID NO: 690553 - protein, 9 aa, Homo Sapiens
SLQLQTFSQ

SEQ ID NO: 690554 - protein, 9 aa, Homo Sapiens
LIKGSCYGK

SEQ ID NO: 690555 - protein, 9 aa, Homo Sapiens
SLLGPDAVC

SEQ ID NO: 690556 - protein, 9 aa, Homo Sapiens
NVSMVVSAR

SEQ ID NO: 690557 - protein, 9 aa, Homo Sapiens
EWLCDWWIS

SEQ ID NO: 690558 - protein, 9 aa, Homo Sapiens
GGPAGRGPP

SEQ ID NO: 690559 - protein, 9 aa, Homo Sapiens
KHPKKGSQV

SEQ ID NO: 690560 - protein, 9 aa, Homo Sapiens
PKVLLRQGH

SEQ ID NO: 690561 - protein, 9 aa, Homo Sapiens
QTSPFQEHT

SEQ ID NO: 690562 - protein, 9 aa, Homo Sapiens
LREALQPET

SEQ ID NO: 690563 - protein, 9 aa, Homo Sapiens
EEKLMKQGS

SEQ ID NO: 690564 - protein, 9 aa, Homo Sapiens
RTNKTLHSD

SEQ ID NO: 690565 - protein, 9 aa, Homo Sapiens
GAGSDADTE

SEQ ID NO: 690566 - protein, 9 aa, Homo Sapiens
LDLFLDSLW

SEQ ID NO: 690567 - protein, 9 aa, Homo Sapiens
LHSWSIPVG

SEQ ID NO: 690568 - protein, 9 aa, Homo Sapiens
EYSLPTLEV

SEQ ID NO: 690569 - protein, 9 aa, Homo Sapiens
VPQTKLVLS

SEQ ID NO: 690570 - protein, 9 aa, Homo Sapiens
VMQFMGNKV

SEQ ID NO: 690571 - protein, 9 aa, Homo Sapiens
DRVSETSSA

SEQ ID NO: 690572 - protein, 9 aa, Homo Sapiens
EGALTSPGH

SEQ ID NO: 690573 - protein, 9 aa, Homo Sapiens
SDEIDLSYV

SEQ ID NO: 690574 - protein, 9 aa, Homo Sapiens
EHSFFEAQG

SEQ ID NO: 690575 - protein, 9 aa, Homo Sapiens
FQQFHYEYY

SEQ ID NO: 690576 - protein, 9 aa, Homo Sapiens
LSNGVDFCD

SEQ ID NO: 690577 - protein, 9 aa, Homo Sapiens
LLAKDLLSE

SEQ ID NO: 690578 - protein, 9 aa, Homo Sapiens
SGCRCVELH

SEQ ID NO: 690579 - protein, 9 aa, Homo Sapiens
RFLLYTNQN

SEQ ID NO: 690580 - protein, 9 aa, Homo Sapiens
PCLRCELCG

SEQ ID NO: 690581 - protein, 9 aa, Homo Sapiens
TECQNRMHF

SEQ ID NO: 690582 - protein, 9 aa, Homo Sapiens
LPRRGLSGC

SEQ ID NO: 690583 - protein, 9 aa, Homo Sapiens
QERRMEKIN

SEQ ID NO: 690584 - protein, 9 aa, Homo Sapiens
IYSKFTASF

SEQ ID NO: 690585 - protein, 9 aa, Homo Sapiens
PTAFGSPEV

SEQ ID NO: 690586 - protein, 9 aa, Homo Sapiens
LTEVHEELH

SEQ ID NO: 690587 - protein, 9 aa, Homo Sapiens
GSLPLDPVE

SEQ ID NO: 690588 - protein, 9 aa, Homo Sapiens
LQLQTFSQA

SEQ ID NO: 690589 - protein, 9 aa, Homo Sapiens
YSIERKSNG

SEQ ID NO: 690590 - protein, 9 aa, Homo Sapiens
KGLRRSSSL

SEQ ID NO: 690591 - protein, 9 aa, Homo Sapiens
GGFRRTICR

SEQ ID NO: 690592 - protein, 9 aa, Homo Sapiens
SLIRGIYSS

SEQ ID NO: 690593 - protein, 9 aa, Homo Sapiens
RNDHGSAQE

SEQ ID NO: 690594 - protein, 9 aa, Homo Sapiens
LLLLLVAGD

SEQ ID NO: 690595 - protein, 9 aa, Homo Sapiens
GSNCFATDL

SEQ ID NO: 690596 - protein, 9 aa, Homo Sapiens
EKAGATVRI

SEQ ID NO: 690597 - protein, 9 aa, Homo Sapiens
KREENRLKK

SEQ ID NO: 690598 - protein, 9 aa, Homo Sapiens
SFKKQEGEV

SEQ ID NO: 690599 - protein, 9 aa, Homo Sapiens
RPAEETYVQ

SEQ ID NO: 690600 - protein, 9 aa, Homo Sapiens
CPTGYRSQG

SEQ ID NO: 690601 - protein, 9 aa, Homo Sapiens
TTPSSLRSC

SEQ ID NO: 690602 - protein, 9 aa, Homo Sapiens
LKEQLSHSS

SEQ ID NO: 690603 - protein, 9 aa, Homo Sapiens
DLESGVYSF

SEQ ID NO: 690604 - protein, 9 aa, Homo Sapiens
PLSNGNSGG

SEQ ID NO: 690605 - protein, 9 aa, Homo Sapiens
VIFCAEEEP

SEQ ID NO: 690606 - protein, 9 aa, Homo Sapiens
ILDLLCPSL

SEQ ID NO: 690607 - protein, 9 aa, Homo Sapiens
STLSSSNPF

SEQ ID NO: 690608 - protein, 9 aa, Homo Sapiens
FVLMRDMCV

SEQ ID NO: 690609 - protein, 9 aa, Homo Sapiens
VGDVLKFYC

SEQ ID NO: 690610 - protein, 9 aa, Homo Sapiens
HLGKPSLPK

SEQ ID NO: 690611 - protein, 9 aa, Homo Sapiens
TTSRKSRPC

SEQ ID NO: 690612 - protein, 9 aa, Homo Sapiens
LSRLLLGLA

SEQ ID NO: 690613 - protein, 9 aa, Homo Sapiens
FKKQEGEVT

SEQ ID NO: 690614 - protein, 9 aa, Homo Sapiens
QGLSNVQKK

SEQ ID NO: 690615 - protein, 9 aa, Homo Sapiens
CTWPQPFLV

SEQ ID NO: 690616 - protein, 9 aa, Homo Sapiens
SLSCSFLQD

SEQ ID NO: 690617 - protein, 9 aa, Homo Sapiens
GKPSLPKKP

SEQ ID NO: 690618 - protein, 9 aa, Homo Sapiens
IVTQSNKFD

SEQ ID NO: 690619 - protein, 9 aa, Homo Sapiens
TEAMHTVPV

SEQ ID NO: 690620 - protein, 9 aa, Homo Sapiens
DSYYEYLFK

SEQ ID NO: 690621 - protein, 9 aa, Homo Sapiens
AGRGPPGWR

SEQ ID NO: 690622 - protein, 9 aa, Homo Sapiens
SHFTPNSRK

SEQ ID NO: 690623 - protein, 9 aa, Homo Sapiens
SYMQISGQR

SEQ ID NO: 690624 - protein, 9 aa, Homo Sapiens
RDDDSHEDT

SEQ ID NO: 690625 - protein, 9 aa, Homo Sapiens
PPNRPRTVC

SEQ ID NO: 690626 - protein, 9 aa, Homo Sapiens
VHHCSIPRA

SEQ ID NO: 690627 - protein, 9 aa, Homo Sapiens
SQVDPGTNL

SEQ ID NO: 690628 - protein, 9 aa, Homo Sapiens
LQYRYTSEI

SEQ ID NO: 690629 - protein, 9 aa, Homo Sapiens
GGVFVNLLK

SEQ ID NO: 690630 - protein, 9 aa, Homo Sapiens
SSLREQNEL

SEQ ID NO: 690631 - protein, 9 aa, Homo Sapiens
LLASFAGRL

SEQ ID NO: 690632 - protein, 9 aa, Homo Sapiens
DQKVQKMLI

SEQ ID NO: 690633 - protein, 9 aa, Homo Sapiens
KLDKDLYGP

SEQ ID NO: 690634 - protein, 9 aa, Homo Sapiens
LLLHMYDSY

SEQ ID NO: 690635 - protein, 9 aa, Homo Sapiens
GIPPTSRGS

SEQ ID NO: 690636 - protein, 9 aa, Homo Sapiens
ADASRYLFR

SEQ ID NO: 690637 - protein, 9 aa, Homo Sapiens
NVDYQFTVC

SEQ ID NO: 690638 - protein, 9 aa, Homo Sapiens
PERHYEVGV

SEQ ID NO: 690639 - protein, 9 aa, Homo Sapiens
AMQQLLAAF

SEQ ID NO: 690640 - protein, 9 aa, Homo Sapiens
KRTHSGQKP

SEQ ID NO: 690641 - protein, 9 aa, Homo Sapiens
EASQQTYSL

SEQ ID NO: 690642 - protein, 9 aa, Homo Sapiens
PAGLPPLAL

SEQ ID NO: 690643 - protein, 9 aa, Homo Sapiens
SAIMDVLPA

SEQ ID NO: 690644 - protein, 9 aa, Homo Sapiens
NQQAFKQSF

SEQ ID NO: 690645 - protein, 9 aa, Homo Sapiens
YVEHYQLTI

SEQ ID NO: 690646 - protein, 9 aa, Homo Sapiens
RTLDHFFCE

SEQ ID NO: 690647 - protein, 9 aa, Homo Sapiens
LKRNIKRYN

SEQ ID NO: 690648 - protein, 9 aa, Homo Sapiens
ARGRTTYEA

SEQ ID NO: 690649 - protein, 9 aa, Homo Sapiens
ENQVFPQGR

SEQ ID NO: 690650 - protein, 9 aa, Homo Sapiens
RRKAASMRE

SEQ ID NO: 690651 - protein, 9 aa, Homo Sapiens
PVDDPISLL

SEQ ID NO: 690652 - protein, 9 aa, Homo Sapiens
DDIIQQEYL

SEQ ID NO: 690653 - protein, 9 aa, Homo Sapiens
LRPLLVSDV

SEQ ID NO: 690654 - protein, 9 aa, Homo Sapiens
RVLGNLMGS

SEQ ID NO: 690655 - protein, 9 aa, Homo Sapiens
QTGTSFLHV

SEQ ID NO: 690656 - protein, 9 aa, Homo Sapiens
LTVHRTHLY

SEQ ID NO: 690657 - protein, 9 aa, Homo Sapiens
AYGSPLCKE

SEQ ID NO: 690658 - protein, 9 aa, Homo Sapiens
GNIPVFVIK

SEQ ID NO: 690659 - protein, 9 aa, Homo Sapiens
LDMSQGTGL

SEQ ID NO: 690660 - protein, 9 aa, Homo Sapiens
PLVLPAAGG

SEQ ID NO: 690661 - protein, 9 aa, Homo Sapiens
LRSMRRKSL

SEQ ID NO: 690662 - protein, 9 aa, Homo Sapiens
LTAEVSLPS

SEQ ID NO: 690663 - protein, 9 aa, Homo Sapiens
KPGAAPAAA

SEQ ID NO: 690664 - protein, 9 aa, Homo Sapiens
YVQQAKCEN

SEQ ID NO: 690665 - protein, 9 aa, Homo Sapiens
FSEYSGFAT

SEQ ID NO: 690666 - protein, 9 aa, Homo Sapiens
NSEPMKRPD

SEQ ID NO: 690667 - protein, 9 aa, Homo Sapiens
IWRIPWQGL

SEQ ID NO: 690668 - protein, 9 aa, Homo Sapiens
HLHLRQKKR

SEQ ID NO: 690669 - protein, 9 aa, Homo Sapiens
ECSRALLNM

SEQ ID NO: 690670 - protein, 9 aa, Homo Sapiens
STKRALAKV

SEQ ID NO: 690671 - protein, 9 aa, Homo Sapiens
VVLEKAKCR

SEQ ID NO: 690672 - protein, 9 aa, Homo Sapiens
EEEDDQNED

SEQ ID NO: 690673 - protein, 9 aa, Homo Sapiens
DPRRPKRPG

SEQ ID NO: 690674 - protein, 9 aa, Homo Sapiens
LFKAYVLLG

SEQ ID NO: 690675 - protein, 9 aa, Homo Sapiens
CPRNHYPLT

SEQ ID NO: 690676 - protein, 9 aa, Homo Sapiens
DKSFGSAIM

SEQ ID NO: 690677 - protein, 9 aa, Homo Sapiens
IRQTPEFQQ

SEQ ID NO: 690678 - protein, 9 aa, Homo Sapiens
RKLMLEQQE

SEQ ID NO: 690679 - protein, 9 aa, Homo Sapiens
KEKLSQKVS

SEQ ID NO: 690680 - protein, 9 aa, Homo Sapiens
GMLTSLVVL

SEQ ID NO: 690681 - protein, 9 aa, Homo Sapiens
SAEQEEEEE

SEQ ID NO: 690682 - protein, 9 aa, Homo Sapiens
EYQWLQIDF

SEQ ID NO: 690683 - protein, 9 aa, Homo Sapiens
AAESSKNVD

SEQ ID NO: 690684 - protein, 9 aa, Homo Sapiens
LVCAKCAPG

SEQ ID NO: 690685 - protein, 9 aa, Homo Sapiens
RRWPSAEQE

SEQ ID NO: 690686 - protein, 9 aa, Homo Sapiens
KRETTWKIT

SEQ ID NO: 690687 - protein, 9 aa, Homo Sapiens
HRFAKKHNF

SEQ ID NO: 690688 - protein, 9 aa, Homo Sapiens
ANPQAQKHP

SEQ ID NO: 690689 - protein, 9 aa, Homo Sapiens
RFFLHIASD

SEQ ID NO: 690690 - protein, 9 aa, Homo Sapiens
RRACYRWSK

SEQ ID NO: 690691 - protein, 9 aa, Homo Sapiens
TTLSDSSQD

SEQ ID NO: 690692 - protein, 9 aa, Homo Sapiens
KLLKVSRDN

SEQ ID NO: 690693 - protein, 9 aa, Homo Sapiens
FAMAKGCQE

SEQ ID NO: 690694 - protein, 9 aa, Homo Sapiens
WLAEKKQQK

SEQ ID NO: 690695 - protein, 9 aa, Homo Sapiens
AHHCLKITV

SEQ ID NO: 690696 - protein, 9 aa, Homo Sapiens
GDCDLGIQS

SEQ ID NO: 690697 - protein, 9 aa, Homo Sapiens
QTRGAVSLQ

SEQ ID NO: 690698 - protein, 9 aa, Homo Sapiens
GSDLYQMNK

SEQ ID NO: 690699 - protein, 9 aa, Homo Sapiens
SQNQPSEIF

SEQ ID NO: 690700 - protein, 9 aa, Homo Sapiens
ETLHCYQEL

SEQ ID NO: 690701 - protein, 9 aa, Homo Sapiens
QTLLPTMQE

SEQ ID NO: 690702 - protein, 9 aa, Homo Sapiens
IYVWTNGST

SEQ ID NO: 690703 - protein, 9 aa, Homo Sapiens
EEMLQNKLK

SEQ ID NO: 690704 - protein, 9 aa, Homo Sapiens
ETYVQVQPS

SEQ ID NO: 690705 - protein, 9 aa, Homo Sapiens
DKYELLMPH

SEQ ID NO: 690706 - protein, 9 aa, Homo Sapiens
NITHCHDVY

SEQ ID NO: 690707 - protein, 9 aa, Homo Sapiens
NKYPEYGSL

SEQ ID NO: 690708 - protein, 9 aa, Homo Sapiens
SFWKLIPLP

SEQ ID NO: 690709 - protein, 9 aa, Homo Sapiens
DDGSNCFAT

SEQ ID NO: 690710 - protein, 9 aa, Homo Sapiens
ICSWELFIS

SEQ ID NO: 690711 - protein, 9 aa, Homo Sapiens
LRYPEPEDK

SEQ ID NO: 690712 - protein, 9 aa, Homo Sapiens
KLMKQGSEK

SEQ ID NO: 690713 - protein, 9 aa, Homo Sapiens
RERLTVHRT

SEQ ID NO: 690714 - protein, 9 aa, Homo Sapiens
LSQNQPSEI

SEQ ID NO: 690715 - protein, 9 aa, Homo Sapiens
KVHPSETCR

SEQ ID NO: 690716 - protein, 9 aa, Homo Sapiens
LKKIPRFKV

SEQ ID NO: 690717 - protein, 9 aa, Homo Sapiens
LLGPDAVCV

SEQ ID NO: 690718 - protein, 9 aa, Homo Sapiens
CSALCVIPP

SEQ ID NO: 690719 - protein, 9 aa, Homo Sapiens
CSESEPELG

SEQ ID NO: 690720 - protein, 9 aa, Homo Sapiens
SEMPCPNFG

SEQ ID NO: 690721 - protein, 9 aa, Homo Sapiens
EESLQCSLD

SEQ ID NO: 690722 - protein, 9 aa, Homo Sapiens
EQNELDLMD

SEQ ID NO: 690723 - protein, 9 aa, Homo Sapiens
CKVCLRPLG

SEQ ID NO: 690724 - protein, 9 aa, Homo Sapiens
TIVSQKDKH

SEQ ID NO: 690725 - protein, 9 aa, Homo Sapiens
LPGTFAYRK

SEQ ID NO: 690726 - protein, 9 aa, Homo Sapiens
DGILVVVYY

SEQ ID NO: 690727 - protein, 9 aa, Homo Sapiens
NNIFCYRIF

SEQ ID NO: 690728 - protein, 9 aa, Homo Sapiens
ISYVMIALT

SEQ ID NO: 690729 - protein, 9 aa, Homo Sapiens
SRNDHGSAQ

SEQ ID NO: 690730 - protein, 9 aa, Homo Sapiens
AIMDVLPAS

SEQ ID NO: 690731 - protein, 9 aa, Homo Sapiens
RLQAFANLQ

SEQ ID NO: 690732 - protein, 9 aa, Homo Sapiens
SRLPAAGSS

SEQ ID NO: 690733 - protein, 9 aa, Homo Sapiens
LGIGRLPLL

SEQ ID NO: 690734 - protein, 9 aa, Homo Sapiens
DLCDPSLDM

SEQ ID NO: 690735 - protein, 9 aa, Homo Sapiens
KGGEAEKME

SEQ ID NO: 690736 - protein, 9 aa, Homo Sapiens
EQVRQREKE

SEQ ID NO: 690737 - protein, 9 aa, Homo Sapiens
PSLEKAQIN

SEQ ID NO: 690738 - protein, 9 aa, Homo Sapiens
SAILDELKV

SEQ ID NO: 690739 - protein, 9 aa, Homo Sapiens
FKLHPHDVA

SEQ ID NO: 690740 - protein, 9 aa, Homo Sapiens
KCPRNHYPL

SEQ ID NO: 690741 - protein, 9 aa, Homo Sapiens
KWTHQQPSG

SEQ ID NO: 690742 - protein, 9 aa, Homo Sapiens
CLAFIVKKT

SEQ ID NO: 690743 - protein, 9 aa, Homo Sapiens
KVVPPDPGA

SEQ ID NO: 690744 - protein, 9 aa, Homo Sapiens
PVVCSTPPT

SEQ ID NO: 690745 - protein, 9 aa, Homo Sapiens
AQPPPEEED

SEQ ID NO: 690746 - protein, 9 aa, Homo Sapiens
HHLRMFKDL

SEQ ID NO: 690747 - protein, 9 aa, Homo Sapiens
SLTGSSAYI

SEQ ID NO: 690748 - protein, 9 aa, Homo Sapiens
AQFQGRRRS

SEQ ID NO: 690749 - protein, 9 aa, Homo Sapiens
PKETTSVAV

SEQ ID NO: 690750 - protein, 9 aa, Homo Sapiens
IPAQTVSWS

SEQ ID NO: 690751 - protein, 9 aa, Homo Sapiens
CQNKEHILQ

SEQ ID NO: 690752 - protein, 9 aa, Homo Sapiens
FHRFAKKHN

SEQ ID NO: 690753 - protein, 9 aa, Homo Sapiens
NNEDRLLLC

SEQ ID NO: 690754 - protein, 9 aa, Homo Sapiens
SEHTEWQQL

SEQ ID NO: 690755 - protein, 9 aa, Homo Sapiens
FKYVKTVCL

SEQ ID NO: 690756 - protein, 9 aa, Homo Sapiens
KQRWLFWNS

SEQ ID NO: 690757 - protein, 9 aa, Homo Sapiens
FMPDAPDHD

SEQ ID NO: 690758 - protein, 9 aa, Homo Sapiens
LSLMERLAK

SEQ ID NO: 690759 - protein, 9 aa, Homo Sapiens
WSVCSTTCG

SEQ ID NO: 690760 - protein, 9 aa, Homo Sapiens
NSTLNNLDL

SEQ ID NO: 690761 - protein, 9 aa, Homo Sapiens
VPGEYSLPT

SEQ ID NO: 690762 - protein, 9 aa, Homo Sapiens
VNAIDKRIP

SEQ ID NO: 690763 - protein, 9 aa, Homo Sapiens
NMYKRKVEQ

SEQ ID NO: 690764 - protein, 9 aa, Homo Sapiens
IGVDPKGSI

SEQ ID NO: 690765 - protein, 9 aa, Homo Sapiens
TDARIQEEL

SEQ ID NO: 690766 - protein, 9 aa, Homo Sapiens
KNVKKDDKE

SEQ ID NO: 690767 - protein, 9 aa, Homo Sapiens
PDAPDHDSL

SEQ ID NO: 690768 - protein, 9 aa, Homo Sapiens
AHELGFQKY

SEQ ID NO: 690769 - protein, 9 aa, Homo Sapiens
NFNTNVVVK

SEQ ID NO: 690770 - protein, 9 aa, Homo Sapiens
PDHDSLKLL

SEQ ID NO: 690771 - protein, 9 aa, Homo Sapiens
CKKQVLDLK

SEQ ID NO: 690772 - protein, 9 aa, Homo Sapiens
PPGPPCPAG

SEQ ID NO: 690773 - protein, 9 aa, Homo Sapiens
DESGTPRKG

SEQ ID NO: 690774 - protein, 9 aa, Homo Sapiens
PSGSDLYQM

SEQ ID NO: 690775 - protein, 9 aa, Homo Sapiens
PSRNTDTLV

SEQ ID NO: 690776 - protein, 9 aa, Homo Sapiens
NRYETLKAT

SEQ ID NO: 690777 - protein, 9 aa, Homo Sapiens
LQTFSQAKR

SEQ ID NO: 690778 - protein, 9 aa, Homo Sapiens
NNKGDAPYS

SEQ ID NO: 690779 - protein, 9 aa, Homo Sapiens
HLDMSQGTG

SEQ ID NO: 690780 - protein, 9 aa, Homo Sapiens
WFVDGVEVH

SEQ ID NO: 690781 - protein, 9 aa, Homo Sapiens
GIMHSSYMQ

SEQ ID NO: 690782 - protein, 9 aa, Homo Sapiens
LGFQKYYQR

SEQ ID NO: 690783 - protein, 9 aa, Homo Sapiens
SCIWRIPWQ

SEQ ID NO: 690784 - protein, 9 aa, Homo Sapiens
ASRYLFRNE

SEQ ID NO: 690785 - protein, 9 aa, Homo Sapiens
SKGLNHMNN

SEQ ID NO: 690786 - protein, 9 aa, Homo Sapiens
GPSRLPAAG

SEQ ID NO: 690787 - protein, 9 aa, Homo Sapiens
YESEFHTSA

SEQ ID NO: 690788 - protein, 9 aa, Homo Sapiens
EEGIDVGTF

SEQ ID NO: 690789 - protein, 9 aa, Homo Sapiens
NIEVPKTEK

SEQ ID NO: 690790 - protein, 9 aa, Homo Sapiens
PLPGTFAYR

SEQ ID NO: 690791 - protein, 9 aa, Homo Sapiens
KHKDDDEVF

SEQ ID NO: 690792 - protein, 9 aa, Homo Sapiens
PGGGPATVP

SEQ ID NO: 690793 - protein, 9 aa, Homo Sapiens
SKMNLSDFI

SEQ ID NO: 690794 - protein, 9 aa, Homo Sapiens
GNLTEQDPK

SEQ ID NO: 690795 - protein, 9 aa, Homo Sapiens
GKKKRTKDK

SEQ ID NO: 690796 - protein, 9 aa, Homo Sapiens
FMKLDAQRK

SEQ ID NO: 690797 - protein, 9 aa, Homo Sapiens
DKEDQWVEK

SEQ ID NO: 690798 - protein, 9 aa, Homo Sapiens
VVTFLVDKK

SEQ ID NO: 690799 - protein, 9 aa, Homo Sapiens
SGIQCNVRD

SEQ ID NO: 690800 - protein, 9 aa, Homo Sapiens
PSLPPGCLQ

SEQ ID NO: 690801 - protein, 9 aa, Homo Sapiens
LPCKGDRNV

SEQ ID NO: 690802 - protein, 9 aa, Homo Sapiens
RSCAFTPTT

SEQ ID NO: 690803 - protein, 9 aa, Homo Sapiens
CAGQRLASK

SEQ ID NO: 690804 - protein, 9 aa, Homo Sapiens
SRSSSMSSF

SEQ ID NO: 690805 - protein, 9 aa, Homo Sapiens
ALWECEHRE

SEQ ID NO: 690806 - protein, 9 aa, Homo Sapiens
LTAYKIFER

SEQ ID NO: 690807 - protein, 9 aa, Homo Sapiens
RNEQVRQRE

SEQ ID NO: 690808 - protein, 9 aa, Homo Sapiens
ARLVGQQGR

SEQ ID NO: 690809 - protein, 9 aa, Homo Sapiens
ITIVSQKDK

SEQ ID NO: 690810 - protein, 9 aa, Homo Sapiens
VRITFIKDS

SEQ ID NO: 690811 - protein, 9 aa, Homo Sapiens
EWLDPSIKN

SEQ ID NO: 690812 - protein, 9 aa, Homo Sapiens
DNFIGGVDM

SEQ ID NO: 690813 - protein, 9 aa, Homo Sapiens
TNILPCDFS

SEQ ID NO: 690814 - protein, 9 aa, Homo Sapiens
TLEPPKLEK

SEQ ID NO: 690815 - protein, 9 aa, Homo Sapiens
HRVHVIEQG

SEQ ID NO: 690816 - protein, 9 aa, Homo Sapiens
CKRKRSWNT

SEQ ID NO: 690817 - protein, 9 aa, Homo Sapiens
CKAKSLSRN

SEQ ID NO: 690818 - protein, 9 aa, Homo Sapiens
AKTAANRRN

SEQ ID NO: 690819 - protein, 9 aa, Homo Sapiens
KKNNLFVVH

SEQ ID NO: 690820 - protein, 9 aa, Homo Sapiens
EACVVHGLR

SEQ ID NO: 690821 - protein, 9 aa, Homo Sapiens
ELIGKNKTI

SEQ ID NO: 690822 - protein, 9 aa, Homo Sapiens
PLGGKKATQ

SEQ ID NO: 690823 - protein, 9 aa, Homo Sapiens
KTLHSDISC

SEQ ID NO: 690824 - protein, 9 aa, Homo Sapiens
NLAISNFLV

SEQ ID NO: 690825 - protein, 9 aa, Homo Sapiens
NRPRTVCRV

SEQ ID NO: 690826 - protein, 9 aa, Homo Sapiens
RDKRGMHRG

SEQ ID NO: 690827 - protein, 9 aa, Homo Sapiens
LIGIFGQDR

SEQ ID NO: 690828 - protein, 9 aa, Homo Sapiens
LLLQELPDR

SEQ ID NO: 690829 - protein, 9 aa, Homo Sapiens
SLEAVIADA

SEQ ID NO: 690830 - protein, 9 aa, Homo Sapiens
QYHCDCQVR

SEQ ID NO: 690831 - protein, 9 aa, Homo Sapiens
IKKEQKTVL

SEQ ID NO: 690832 - protein, 9 aa, Homo Sapiens
TIVGTDFKL

SEQ ID NO: 690833 - protein, 9 aa, Homo Sapiens
IIVFYGCQT

SEQ ID NO: 690834 - protein, 9 aa, Homo Sapiens
MWHPNIYKN

SEQ ID NO: 690835 - protein, 9 aa, Homo Sapiens
EHWYQKAIV

SEQ ID NO: 690836 - protein, 9 aa, Homo Sapiens
TPNSRKPAE

SEQ ID NO: 690837 - protein, 9 aa, Homo Sapiens
GKLISSLHL

SEQ ID NO: 690838 - protein, 9 aa, Homo Sapiens
QKMLISSIK

SEQ ID NO: 690839 - protein, 9 aa, Homo Sapiens
PVPKSRLRE

SEQ ID NO: 690840 - protein, 9 aa, Homo Sapiens
FPDAKENKI

SEQ ID NO: 690841 - protein, 9 aa, Homo Sapiens
TYIVWKIGG

SEQ ID NO: 690842 - protein, 9 aa, Homo Sapiens
AAYGSPLCK

SEQ ID NO: 690843 - protein, 9 aa, Homo Sapiens
NESQPGRYP

SEQ ID NO: 690844 - protein, 9 aa, Homo Sapiens
LPPGTTEPT

SEQ ID NO: 690845 - protein, 9 aa, Homo Sapiens
AEKFHFVLQ

SEQ ID NO: 690846 - protein, 9 aa, Homo Sapiens
MLRWKLFNA

SEQ ID NO: 690847 - protein, 9 aa, Homo Sapiens
ESFKKQEGE

SEQ ID NO: 690848 - protein, 9 aa, Homo Sapiens
VQKPYVHKE

SEQ ID NO: 690849 - protein, 9 aa, Homo Sapiens
PSITLALLV

SEQ ID NO: 690850 - protein, 9 aa, Homo Sapiens
VRIGAELSV

SEQ ID NO: 690851 - protein, 9 aa, Homo Sapiens
RKNELKLAD

SEQ ID NO: 690852 - protein, 9 aa, Homo Sapiens
IAAESSKNV

SEQ ID NO: 690853 - protein, 9 aa, Homo Sapiens
EVAGALLRK

SEQ ID NO: 690854 - protein, 9 aa, Homo Sapiens
QPSEIFLSM

SEQ ID NO: 690855 - protein, 9 aa, Homo Sapiens
ADKSKKVCS

SEQ ID NO: 690856 - protein, 9 aa, Homo Sapiens
AVIFCAEEE

SEQ ID NO: 690857 - protein, 9 aa, Homo Sapiens
RFIVSPVPK

SEQ ID NO: 690858 - protein, 9 aa, Homo Sapiens
KFVLMRDMC

SEQ ID NO: 690859 - protein, 9 aa, Homo Sapiens
SNLQSRFEN

SEQ ID NO: 690860 - protein, 9 aa, Homo Sapiens
TADKDLQAS

SEQ ID NO: 690861 - protein, 9 aa, Homo Sapiens
RSPAFLLLA

SEQ ID NO: 690862 - protein, 9 aa, Homo Sapiens
YLGTSDSGR

SEQ ID NO: 690863 - protein, 9 aa, Homo Sapiens
LGPDPVCSQ

SEQ ID NO: 690864 - protein, 9 aa, Homo Sapiens
AEPSVFTAS

SEQ ID NO: 690865 - protein, 9 aa, Homo Sapiens
LGPCVLSPT

SEQ ID NO: 690866 - protein, 9 aa, Homo Sapiens
GPNQALLEN

SEQ ID NO: 690867 - protein, 9 aa, Homo Sapiens
TLVLHLRRS

SEQ ID NO: 690868 - protein, 9 aa, Homo Sapiens
QDPSGVILT

SEQ ID NO: 690869 - protein, 9 aa, Homo Sapiens
ISDVAMNFH

SEQ ID NO: 690870 - protein, 9 aa, Homo Sapiens
RGRQQSTLE

SEQ ID NO: 690871 - protein, 9 aa, Homo Sapiens
EANQRATNM

SEQ ID NO: 690872 - protein, 9 aa, Homo Sapiens
VRRQVRPMS

SEQ ID NO: 690873 - protein, 9 aa, Homo Sapiens
CRPHKELDR

SEQ ID NO: 690874 - protein, 9 aa, Homo Sapiens
DLLCPSLEK

SEQ ID NO: 690875 - protein, 9 aa, Homo Sapiens
MMQDMIRSQ

SEQ ID NO: 690876 - protein, 9 aa, Homo Sapiens
VHPSETCRP

SEQ ID NO: 690877 - protein, 9 aa, Homo Sapiens
MTAGPHAAA

SEQ ID NO: 690878 - protein, 9 aa, Homo Sapiens
REQVIVPPV

SEQ ID NO: 690879 - protein, 9 aa, Homo Sapiens
RAHLPDCAP

SEQ ID NO: 690880 - protein, 9 aa, Homo Sapiens
VEENRSPTV

SEQ ID NO: 690881 - protein, 9 aa, Homo Sapiens
YHCDCQVRH

SEQ ID NO: 690882 - protein, 9 aa, Homo Sapiens
AYMQQGARE

SEQ ID NO: 690883 - protein, 9 aa, Homo Sapiens
NVAEEETWH

SEQ ID NO: 690884 - protein, 9 aa, Homo Sapiens
SASAEAANK

SEQ ID NO: 690885 - protein, 9 aa, Homo Sapiens
TGKESYKSM

SEQ ID NO: 690886 - protein, 9 aa, Homo Sapiens
ARWLTNIEV

SEQ ID NO: 690887 - protein, 9 aa, Homo Sapiens
PVTRVAYVV

SEQ ID NO: 690888 - protein, 9 aa, Homo Sapiens
PFAPCGRGE

SEQ ID NO: 690889 - protein, 9 aa, Homo Sapiens
LKLPEEKAA

SEQ ID NO: 690890 - protein, 9 aa, Homo Sapiens
FAVIFCAEE

SEQ ID NO: 690891 - protein, 9 aa, Homo Sapiens
LKTDNSSFD

SEQ ID NO: 690892 - protein, 9 aa, Homo Sapiens
RMFKDLQKM

SEQ ID NO: 690893 - protein, 9 aa, Homo Sapiens
PCEILPSRL

SEQ ID NO: 690894 - protein, 9 aa, Homo Sapiens
RVDLQHLYG

SEQ ID NO: 690895 - protein, 9 aa, Homo Sapiens
LIANLAISN

SEQ ID NO: 690896 - protein, 9 aa, Homo Sapiens
EEFQHVLPK

SEQ ID NO: 690897 - protein, 9 aa, Homo Sapiens
FALVKYNQQ

SEQ ID NO: 690898 - protein, 9 aa, Homo Sapiens
AANKIHYIP

SEQ ID NO: 690899 - protein, 9 aa, Homo Sapiens
IGMRELGSW

SEQ ID NO: 690900 - protein, 9 aa, Homo Sapiens
AFNVPTCKL

SEQ ID NO: 690901 - protein, 9 aa, Homo Sapiens
HQQPSGSDL

SEQ ID NO: 690902 - protein, 9 aa, Homo Sapiens
SLEKRLESI

SEQ ID NO: 690903 - protein, 9 aa, Homo Sapiens
VEALHVNIG

SEQ ID NO: 690904 - protein, 9 aa, Homo Sapiens
AIRNHEELN

SEQ ID NO: 690905 - protein, 9 aa, Homo Sapiens
GNYHLPSIA

SEQ ID NO: 690906 - protein, 9 aa, Homo Sapiens
LANQKTRLF

SEQ ID NO: 690907 - protein, 9 aa, Homo Sapiens
HNAHHCLKI

SEQ ID NO: 690908 - protein, 9 aa, Homo Sapiens
PVTNQVQCH

SEQ ID NO: 690909 - protein, 9 aa, Homo Sapiens
VTITSSASS

SEQ ID NO: 690910 - protein, 9 aa, Homo Sapiens
NIDDTCGRH

SEQ ID NO: 690911 - protein, 9 aa, Homo Sapiens
AMLRALLQQ

SEQ ID NO: 690912 - protein, 9 aa, Homo Sapiens
RQAESHSQE

SEQ ID NO: 690913 - protein, 9 aa, Homo Sapiens
GFDGLHLGS

SEQ ID NO: 690914 - protein, 9 aa, Homo Sapiens
PDPALYPQG

SEQ ID NO: 690915 - protein, 9 aa, Homo Sapiens
AQKHPKKDR

SEQ ID NO: 690916 - protein, 9 aa, Homo Sapiens
QKDKHCWVG

SEQ ID NO: 690917 - protein, 9 aa, Homo Sapiens
AEDKPRAHL

SEQ ID NO: 690918 - protein, 9 aa, Homo Sapiens
AKNAMGCKI

SEQ ID NO: 690919 - protein, 9 aa, Homo Sapiens
RDLFCLSVK

SEQ ID NO: 690920 - protein, 9 aa, Homo Sapiens
HDAMLFALS

SEQ ID NO: 690921 - protein, 9 aa, Homo Sapiens
KFYCRKNLI

SEQ ID NO: 690922 - protein, 9 aa, Homo Sapiens
VAYNNVVGG

SEQ ID NO: 690923 - protein, 9 aa, Homo Sapiens
NQLLSQVDF

SEQ ID NO: 690924 - protein, 9 aa, Homo Sapiens
VQDDQVAPV

SEQ ID NO: 690925 - protein, 9 aa, Homo Sapiens
VLLLLHHDK

SEQ ID NO: 690926 - protein, 9 aa, Homo Sapiens
HNRRMKWKK

SEQ ID NO: 690927 - protein, 9 aa, Homo Sapiens
AGIIGPPGL

SEQ ID NO: 690928 - protein, 9 aa, Homo Sapiens
AKGQSYSYY

SEQ ID NO: 690929 - protein, 9 aa, Homo Sapiens
RERRGRQQS

SEQ ID NO: 690930 - protein, 9 aa, Homo Sapiens
EMYAIYQER

SEQ ID NO: 690931 - protein, 9 aa, Homo Sapiens
AQLLKPRCS

SEQ ID NO: 690932 - protein, 9 aa, Homo Sapiens
IVSKFLYYS

SEQ ID NO: 690933 - protein, 9 aa, Homo Sapiens
VLTEKGIFE

SEQ ID NO: 690934 - protein, 9 aa, Homo Sapiens
LGGGSSRID

SEQ ID NO: 690935 - protein, 9 aa, Homo Sapiens
SHFGGPPQP

SEQ ID NO: 690936 - protein, 9 aa, Homo Sapiens
RRWSLHSWS

SEQ ID NO: 690937 - protein, 9 aa, Homo Sapiens
ALVEGVTCM

SEQ ID NO: 690938 - protein, 9 aa, Homo Sapiens
VTRVAYVVT

SEQ ID NO: 690939 - protein, 9 aa, Homo Sapiens
AEGLCTKDK

SEQ ID NO: 690940 - protein, 9 aa, Homo Sapiens
YISGLKIPA

SEQ ID NO: 690941 - protein, 9 aa, Homo Sapiens
SDADTEADT

SEQ ID NO: 690942 - protein, 9 aa, Homo Sapiens
QGLEAAKEA

SEQ ID NO: 690943 - protein, 9 aa, Homo Sapiens
FHTSAAYKS

SEQ ID NO: 690944 - protein, 9 aa, Homo Sapiens
YRPKAPDTA

SEQ ID NO: 690945 - protein, 9 aa, Homo Sapiens
FINTLRNKE

SEQ ID NO: 690946 - protein, 9 aa, Homo Sapiens
YYVCALQFY

SEQ ID NO: 690947 - protein, 9 aa, Homo Sapiens
VGPKAPLGG

SEQ ID NO: 690948 - protein, 9 aa, Homo Sapiens
RALLQQARS

SEQ ID NO: 690949 - protein, 9 aa, Homo Sapiens
RMVCTMLSG

SEQ ID NO: 690950 - protein, 9 aa, Homo Sapiens
YSPDPSQLT

SEQ ID NO: 690951 - protein, 9 aa, Homo Sapiens
INEHKFEGK

SEQ ID NO: 690952 - protein, 9 aa, Homo Sapiens
GDSKMNLSD

SEQ ID NO: 690953 - protein, 9 aa, Homo Sapiens
LHMVKETLQ

SEQ ID NO: 690954 - protein, 9 aa, Homo Sapiens
MLLLQGNAL

SEQ ID NO: 690955 - protein, 9 aa, Homo Sapiens
RHHHVVRKT

SEQ ID NO: 690956 - protein, 9 aa, Homo Sapiens
HDVAGIQAL

SEQ ID NO: 690957 - protein, 9 aa, Homo Sapiens
PFGHEGFHE

SEQ ID NO: 690958 - protein, 9 aa, Homo Sapiens
PEGKVEVFL

SEQ ID NO: 690959 - protein, 9 aa, Homo Sapiens
VVMLCAHWE

SEQ ID NO: 690960 - protein, 9 aa, Homo Sapiens
MYDSYKVPD

SEQ ID NO: 690961 - protein, 9 aa, Homo Sapiens
ELMETRPAG

SEQ ID NO: 690962 - protein, 9 aa, Homo Sapiens
TGRLDFSLM

SEQ ID NO: 690963 - protein, 9 aa, Homo Sapiens
HRAVRIGAE

SEQ ID NO: 690964 - protein, 9 aa, Homo Sapiens
PFDDFLFQA

SEQ ID NO: 690965 - protein, 9 aa, Homo Sapiens
AHKANPFYE

SEQ ID NO: 690966 - protein, 9 aa, Homo Sapiens
QQLSNMIVK

SEQ ID NO: 690967 - protein, 9 aa, Homo Sapiens
KGCQNKEHI

SEQ ID NO: 690968 - protein, 9 aa, Homo Sapiens
LLETVGVSN

SEQ ID NO: 690969 - protein, 9 aa, Homo Sapiens
SYGLQNSLA

SEQ ID NO: 690970 - protein, 9 aa, Homo Sapiens
GEMDALRIH

SEQ ID NO: 690971 - protein, 9 aa, Homo Sapiens
LERKREENR

SEQ ID NO: 690972 - protein, 9 aa, Homo Sapiens
EEDRKNYSK

SEQ ID NO: 690973 - protein, 9 aa, Homo Sapiens
PYRLRLGGR

SEQ ID NO: 690974 - protein, 9 aa, Homo Sapiens
APKVLLRQG

SEQ ID NO: 690975 - protein, 9 aa, Homo Sapiens
AIAGAVRDH

SEQ ID NO: 690976 - protein, 9 aa, Homo Sapiens
QVFPQGRNC

SEQ ID NO: 690977 - protein, 9 aa, Homo Sapiens
APPGGRSNM

SEQ ID NO: 690978 - protein, 9 aa, Homo Sapiens
LSAAYGSPL

SEQ ID NO: 690979 - protein, 9 aa, Homo Sapiens
DALRIHMEE

SEQ ID NO: 690980 - protein, 9 aa, Homo Sapiens
SLSRNPKKP

SEQ ID NO: 690981 - protein, 9 aa, Homo Sapiens
RYTNILPCD

SEQ ID NO: 690982 - protein, 9 aa, Homo Sapiens
LKQPQAGHC

SEQ ID NO: 690983 - protein, 9 aa, Homo Sapiens
TSLREQVIV

SEQ ID NO: 690984 - protein, 9 aa, Homo Sapiens
SVDPNDSSF

SEQ ID NO: 690985 - protein, 9 aa, Homo Sapiens
QLAIRNHEE

SEQ ID NO: 690986 - protein, 9 aa, Homo Sapiens
WKLIPLPKV

SEQ ID NO: 690987 - protein, 9 aa, Homo Sapiens
APAPDTWAS

SEQ ID NO: 690988 - protein, 9 aa, Homo Sapiens
DVVNKGGEA

SEQ ID NO: 690989 - protein, 9 aa, Homo Sapiens
SPEDKYELL

SEQ ID NO: 690990 - protein, 9 aa, Homo Sapiens
AAFAPKMIV

SEQ ID NO: 690991 - protein, 9 aa, Homo Sapiens
QQAFKQSFL

SEQ ID NO: 690992 - protein, 9 aa, Homo Sapiens
DGPPGARLL

SEQ ID NO: 690993 - protein, 9 aa, Homo Sapiens
AHHLRMFKD

SEQ ID NO: 690994 - protein, 9 aa, Homo Sapiens
PPLVLSSHE

SEQ ID NO: 690995 - protein, 9 aa, Homo Sapiens
YKNGDVCIS

SEQ ID NO: 690996 - protein, 9 aa, Homo Sapiens
GPLVLPAAG

SEQ ID NO: 690997 - protein, 9 aa, Homo Sapiens
PTCKLASKD

SEQ ID NO: 690998 - protein, 9 aa, Homo Sapiens
GGGGRMATE

SEQ ID NO: 690999 - protein, 9 aa, Homo Sapiens
NQPSEIFLS

SEQ ID NO: 691000 - protein, 9 aa, Homo Sapiens
ELLDEKEPK

SEQ ID NO: 691001 - protein, 9 aa, Homo Sapiens
MDLAKVIVV

SEQ ID NO: 691002 - protein, 9 aa, Homo Sapiens
PVTITSSAS

SEQ ID NO: 691003 - protein, 9 aa, Homo Sapiens
IGVFRCIAG

SEQ ID NO: 691004 - protein, 9 aa, Homo Sapiens
LLSQNQPSE

SEQ ID NO: 691005 - protein, 9 aa, Homo Sapiens
VAGYLIAGT

SEQ ID NO: 691006 - protein, 9 aa, Homo Sapiens
LSSVDASEH

SEQ ID NO: 691007 - protein, 9 aa, Homo Sapiens
LSVGYTVEK

SEQ ID NO: 691008 - protein, 9 aa, Homo Sapiens
GTIVGTDFK

SEQ ID NO: 691009 - protein, 9 aa, Homo Sapiens
QISGLVLEN

SEQ ID NO: 691010 - protein, 9 aa, Homo Sapiens
EIEIQGLLQ

SEQ ID NO: 691011 - protein, 9 aa, Homo Sapiens
RRKSLPLVT

SEQ ID NO: 691012 - protein, 9 aa, Homo Sapiens
EKHKDDDEV

SEQ ID NO: 691013 - protein, 9 aa, Homo Sapiens
SGEVGSVGR

SEQ ID NO: 691014 - protein, 9 aa, Homo Sapiens
REIQGIRVT

SEQ ID NO: 691015 - protein, 9 aa, Homo Sapiens
RANGGSAIT

SEQ ID NO: 691016 - protein, 9 aa, Homo Sapiens
HKPLSWVFK

SEQ ID NO: 691017 - protein, 9 aa, Homo Sapiens
KNKYPEYGS

SEQ ID NO: 691018 - protein, 9 aa, Homo Sapiens
TEGALTSPG

SEQ ID NO: 691019 - protein, 9 aa, Homo Sapiens
EEKSRVKWD

SEQ ID NO: 691020 - protein, 9 aa, Homo Sapiens
DSKMNLSDF

SEQ ID NO: 691021 - protein, 9 aa, Homo Sapiens
FLTKRYSPL

SEQ ID NO: 691022 - protein, 9 aa, Homo Sapiens
HFGGPPQPS

SEQ ID NO: 691023 - protein, 9 aa, Homo Sapiens
YLLSPVKHH

SEQ ID NO: 691024 - protein, 9 aa, Homo Sapiens
IQRPGDGPP

SEQ ID NO: 691025 - protein, 9 aa, Homo Sapiens
WWGKIPRKD

SEQ ID NO: 691026 - protein, 9 aa, Homo Sapiens
TICRLERSG

SEQ ID NO: 691027 - protein, 9 aa, Homo Sapiens
AITAFKVEY

SEQ ID NO: 691028 - protein, 9 aa, Homo Sapiens
VLLEDRRTN

SEQ ID NO: 691029 - protein, 9 aa, Homo Sapiens
TTTTTSSSF

SEQ ID NO: 691030 - protein, 9 aa, Homo Sapiens
QPKQRWLFW

SEQ ID NO: 691031 - protein, 9 aa, Homo Sapiens
LVKIVDVID

SEQ ID NO: 691032 - protein, 9 aa, Homo Sapiens
LVKVLATAK

SEQ ID NO: 691033 - protein, 9 aa, Homo Sapiens
GHLRWDRFG

SEQ ID NO: 691034 - protein, 9 aa, Homo Sapiens
SMVVSARPL

SEQ ID NO: 691035 - protein, 9 aa, Homo Sapiens
QSMHKYKHR

SEQ ID NO: 691036 - protein, 9 aa, Homo Sapiens
CEDVWGKTD

SEQ ID NO: 691037 - protein, 9 aa, Homo Sapiens
AFKQSFLEL

SEQ ID NO: 691038 - protein, 9 aa, Homo Sapiens
QPTDDLLCV

SEQ ID NO: 691039 - protein, 9 aa, Homo Sapiens
QQARSSQAP

SEQ ID NO: 691040 - protein, 9 aa, Homo Sapiens
MFKVIGANK

SEQ ID NO: 691041 - protein, 9 aa, Homo Sapiens
QEDLNRKEI

SEQ ID NO: 691042 - protein, 9 aa, Homo Sapiens
IYKNGDVCI

SEQ ID NO: 691043 - protein, 9 aa, Homo Sapiens
KTGLQAVTG

SEQ ID NO: 691044 - protein, 9 aa, Homo Sapiens
SLQKVIPTR

SEQ ID NO: 691045 - protein, 9 aa, Homo Sapiens
VTIHNLVEY

SEQ ID NO: 691046 - protein, 9 aa, Homo Sapiens
KLIPLPKVG

SEQ ID NO: 691047 - protein, 9 aa, Homo Sapiens
EGAYKPGAA

SEQ ID NO: 691048 - protein, 9 aa, Homo Sapiens
LPAAGSSSK

SEQ ID NO: 691049 - protein, 9 aa, Homo Sapiens
IVPRVLLAS

SEQ ID NO: 691050 - protein, 9 aa, Homo Sapiens
RAVRIGAEL

SEQ ID NO: 691051 - protein, 9 aa, Homo Sapiens
AGFAGSSSC

SEQ ID NO: 691052 - protein, 9 aa, Homo Sapiens
ARFCVLGTL

SEQ ID NO: 691053 - protein, 9 aa, Homo Sapiens
SGSAANENS

SEQ ID NO: 691054 - protein, 9 aa, Homo Sapiens
ASAPDQTEQ

SEQ ID NO: 691055 - protein, 9 aa, Homo Sapiens
NDSCVSPVS

SEQ ID NO: 691056 - protein, 9 aa, Homo Sapiens
PRKMPSQQD

SEQ ID NO: 691057 - protein, 9 aa, Homo Sapiens
PETAIGLLP

SEQ ID NO: 691058 - protein, 9 aa, Homo Sapiens
HWYPQQINE

SEQ ID NO: 691059 - protein, 9 aa, Homo Sapiens
SGEHTLQVK

SEQ ID NO: 691060 - protein, 9 aa, Homo Sapiens
HESLQLQTF

SEQ ID NO: 691061 - protein, 9 aa, Homo Sapiens
EGPNSSLRK

SEQ ID NO: 691062 - protein, 9 aa, Homo Sapiens
EIYSKFTAS

SEQ ID NO: 691063 - protein, 9 aa, Homo Sapiens
DKRGMHRGL

SEQ ID NO: 691064 - protein, 9 aa, Homo Sapiens
GCIARWLTN

SEQ ID NO: 691065 - protein, 9 aa, Homo Sapiens
APPNRPRTV

SEQ ID NO: 691066 - protein, 9 aa, Homo Sapiens
ATLFGSPEM

SEQ ID NO: 691067 - protein, 9 aa, Homo Sapiens
QNLQLQNTL

SEQ ID NO: 691068 - protein, 9 aa, Homo Sapiens
FKIGNLLVI

SEQ ID NO: 691069 - protein, 9 aa, Homo Sapiens
VCSALCVIP

SEQ ID NO: 691070 - protein, 9 aa, Homo Sapiens
EMLSYQDDK

SEQ ID NO: 691071 - protein, 9 aa, Homo Sapiens
MRDMCVVCG

SEQ ID NO: 691072 - protein, 9 aa, Homo Sapiens
SVRLRKAQA

SEQ ID NO: 691073 - protein, 9 aa, Homo Sapiens
GNLVSVWLL

SEQ ID NO: 691074 - protein, 9 aa, Homo Sapiens
EKECSQALS

SEQ ID NO: 691075 - protein, 9 aa, Homo Sapiens
ISCCDTHTN

SEQ ID NO: 691076 - protein, 9 aa, Homo Sapiens
LAAPDIGVF

SEQ ID NO: 691077 - protein, 9 aa, Homo Sapiens
LTQGLSNVQ

SEQ ID NO: 691078 - protein, 9 aa, Homo Sapiens
GRDATRLFF

SEQ ID NO: 691079 - protein, 9 aa, Homo Sapiens
SFSYTSRQI

SEQ ID NO: 691080 - protein, 9 aa, Homo Sapiens
SKSSKPTRK

SEQ ID NO: 691081 - protein, 9 aa, Homo Sapiens
FSGRGRQEA

SEQ ID NO: 691082 - protein, 9 aa, Homo Sapiens
SPVKHHPAD

SEQ ID NO: 691083 - protein, 9 aa, Homo Sapiens
FISNVTKET

SEQ ID NO: 691084 - protein, 9 aa, Homo Sapiens
FDSSPEASQ

SEQ ID NO: 691085 - protein, 9 aa, Homo Sapiens
GGFAVKAKK

SEQ ID NO: 691086 - protein, 9 aa, Homo Sapiens
EHILQQRFR

SEQ ID NO: 691087 - protein, 9 aa, Homo Sapiens
PHPGPELPP

SEQ ID NO: 691088 - protein, 9 aa, Homo Sapiens
APELLLVAR

SEQ ID NO: 691089 - protein, 9 aa, Homo Sapiens
PKLLPGIFA

SEQ ID NO: 691090 - protein, 9 aa, Homo Sapiens
TFIYQSSVK

SEQ ID NO: 691091 - protein, 9 aa, Homo Sapiens
SNSSTLAND

SEQ ID NO: 691092 - protein, 9 aa, Homo Sapiens
ILHLGKPSL

SEQ ID NO: 691093 - protein, 9 aa, Homo Sapiens
SDVAMNFHW

SEQ ID NO: 691094 - protein, 9 aa, Homo Sapiens
NCCGQRRAC

SEQ ID NO: 691095 - protein, 9 aa, Homo Sapiens
TFCNPLFTA

SEQ ID NO: 691096 - protein, 9 aa, Homo Sapiens
CSTPPTGHP

SEQ ID NO: 691097 - protein, 9 aa, Homo Sapiens
DQSFFTPTS

SEQ ID NO: 691098 - protein, 9 aa, Homo Sapiens
QKKRVSAAR

SEQ ID NO: 691099 - protein, 9 aa, Homo Sapiens
QDDQVAPVP

SEQ ID NO: 691100 - protein, 9 aa, Homo Sapiens
YLDVLTEKG

SEQ ID NO: 691101 - protein, 9 aa, Homo Sapiens
LGDPSNLNK

SEQ ID NO: 691102 - protein, 9 aa, Homo Sapiens
SAKPGREDS

SEQ ID NO: 691103 - protein, 9 aa, Homo Sapiens
SDVMACGGN

SEQ ID NO: 691104 - protein, 9 aa, Homo Sapiens
ESLGEDIHY

SEQ ID NO: 691105 - protein, 9 aa, Homo Sapiens
GNYRYFFHH

SEQ ID NO: 691106 - protein, 9 aa, Homo Sapiens
ITTLKKIPR

SEQ ID NO: 691107 - protein, 9 aa, Homo Sapiens
PGLIKVVRH

SEQ ID NO: 691108 - protein, 9 aa, Homo Sapiens
KKFCNNVLP

SEQ ID NO: 691109 - protein, 9 aa, Homo Sapiens
KSKKVCSVC

SEQ ID NO: 691110 - protein, 9 aa, Homo Sapiens
NLLEYDKEP

SEQ ID NO: 691111 - protein, 9 aa, Homo Sapiens
AYVVTPLWT

SEQ ID NO: 691112 - protein, 9 aa, Homo Sapiens
LILQNSSAR

SEQ ID NO: 691113 - protein, 9 aa, Homo Sapiens
AHQGRDVEG

SEQ ID NO: 691114 - protein, 9 aa, Homo Sapiens
LHLGSGRIP

SEQ ID NO: 691115 - protein, 9 aa, Homo Sapiens
AGSSSCGGS

SEQ ID NO: 691116 - protein, 9 aa, Homo Sapiens
ACPRVPMPV

SEQ ID NO: 691117 - protein, 9 aa, Homo Sapiens
QASVARLVG

SEQ ID NO: 691118 - protein, 9 aa, Homo Sapiens
NFKFHVDDF

SEQ ID NO: 691119 - protein, 9 aa, Homo Sapiens
PNSRKPAEP

SEQ ID NO: 691120 - protein, 9 aa, Homo Sapiens
SAAFAPKMI

SEQ ID NO: 691121 - protein, 9 aa, Homo Sapiens
RIGAELSVL

SEQ ID NO: 691122 - protein, 9 aa, Homo Sapiens
DLFCLSVKA

SEQ ID NO: 691123 - protein, 9 aa, Homo Sapiens
LQPTSTWSH

SEQ ID NO: 691124 - protein, 9 aa, Homo Sapiens
AFRAILSKV

SEQ ID NO: 691125 - protein, 9 aa, Homo Sapiens
TILGMLTSL

SEQ ID NO: 691126 - protein, 9 aa, Homo Sapiens
KENRTIEFG

SEQ ID NO: 691127 - protein, 9 aa, Homo Sapiens
AIDKRIPSM

SEQ ID NO: 691128 - protein, 9 aa, Homo Sapiens
KQLQKIESG

SEQ ID NO: 691129 - protein, 9 aa, Homo Sapiens
GGDGNFKFH

SEQ ID NO: 691130 - protein, 9 aa, Homo Sapiens
SAELRKPSG

SEQ ID NO: 691131 - protein, 9 aa, Homo Sapiens
RLYTCQEWV

SEQ ID NO: 691132 - protein, 9 aa, Homo Sapiens
ADSGEPQRF

SEQ ID NO: 691133 - protein, 9 aa, Homo Sapiens
TGLDSPGGL

SEQ ID NO: 691134 - protein, 9 aa, Homo Sapiens
TSNKLQKLR

SEQ ID NO: 691135 - protein, 9 aa, Homo Sapiens
YTACLDFLW

SEQ ID NO: 691136 - protein, 9 aa, Homo Sapiens
AEDYDRRAD

SEQ ID NO: 691137 - protein, 9 aa, Homo Sapiens
SSWKMAAVF

SEQ ID NO: 691138 - protein, 9 aa, Homo Sapiens
SVSRELLAW

SEQ ID NO: 691139 - protein, 9 aa, Homo Sapiens
LRDSTKRAL

SEQ ID NO: 691140 - protein, 9 aa, Homo Sapiens
GDVLKFYCR

SEQ ID NO: 691141 - protein, 9 aa, Homo Sapiens
TYVEHYQLT

SEQ ID NO: 691142 - protein, 9 aa, Homo Sapiens
RVGKKIMEE

SEQ ID NO: 691143 - protein, 9 aa, Homo Sapiens
LQRNEIGHT

SEQ ID NO: 691144 - protein, 9 aa, Homo Sapiens
CLKITVNCS

SEQ ID NO: 691145 - protein, 9 aa, Homo Sapiens
AVCSALCVI

SEQ ID NO: 691146 - protein, 9 aa, Homo Sapiens
STVTASLDS

SEQ ID NO: 691147 - protein, 9 aa, Homo Sapiens
KADKSKKVC

SEQ ID NO: 691148 - protein, 9 aa, Homo Sapiens
VTKNTLPAV

SEQ ID NO: 691149 - protein, 9 aa, Homo Sapiens
NDEFNISFM

SEQ ID NO: 691150 - protein, 9 aa, Homo Sapiens
RNKNGLQLG

SEQ ID NO: 691151 - protein, 9 aa, Homo Sapiens
CPNFGKNIY

SEQ ID NO: 691152 - protein, 9 aa, Homo Sapiens
PDADDSAFN

SEQ ID NO: 691153 - protein, 9 aa, Homo Sapiens
KYKHRVHVI

SEQ ID NO: 691154 - protein, 9 aa, Homo Sapiens
GPATVPSVT

SEQ ID NO: 691155 - protein, 9 aa, Homo Sapiens
IPEGPRRRR

SEQ ID NO: 691156 - protein, 9 aa, Homo Sapiens
CFTILGMLT

SEQ ID NO: 691157 - protein, 9 aa, Homo Sapiens
VEHSFFEAQ

SEQ ID NO: 691158 - protein, 9 aa, Homo Sapiens
KAASMRERR

SEQ ID NO: 691159 - protein, 9 aa, Homo Sapiens
TCSESEPEL

SEQ ID NO: 691160 - protein, 9 aa, Homo Sapiens
TATPSTFAI

SEQ ID NO: 691161 - protein, 9 aa, Homo Sapiens
TAANRRNVK

SEQ ID NO: 691162 - protein, 9 aa, Homo Sapiens
IFEWLCDWW

SEQ ID NO: 691163 - protein, 9 aa, Homo Sapiens
YAVLVLTPA

SEQ ID NO: 691164 - protein, 9 aa, Homo Sapiens
ISVKTHNFS

SEQ ID NO: 691165 - protein, 9 aa, Homo Sapiens
RNLLSVAYN

SEQ ID NO: 691166 - protein, 9 aa, Homo Sapiens
ECAVRFYFL

SEQ ID NO: 691167 - protein, 9 aa, Homo Sapiens
QSLRRELHM

SEQ ID NO: 691168 - protein, 9 aa, Homo Sapiens
PGGGSGGFP

SEQ ID NO: 691169 - protein, 9 aa, Homo Sapiens
KGGPAGRGP

SEQ ID NO: 691170 - protein, 9 aa, Homo Sapiens
SRGPVGGFL

SEQ ID NO: 691171 - protein, 9 aa, Homo Sapiens
IRTEVFQTA

SEQ ID NO: 691172 - protein, 9 aa, Homo Sapiens
NRMHFNSNG

SEQ ID NO: 691173 - protein, 9 aa, Homo Sapiens
KCQVLHEDI

SEQ ID NO: 691174 - protein, 9 aa, Homo Sapiens
DLNVSEIYR

SEQ ID NO: 691175 - protein, 9 aa, Homo Sapiens
FESAVNLKG

SEQ ID NO: 691176 - protein, 9 aa, Homo Sapiens
SLRPLLVSD

SEQ ID NO: 691177 - protein, 9 aa, Homo Sapiens
DHGSAQEQS

SEQ ID NO: 691178 - protein, 9 aa, Homo Sapiens
RGLSGCSML

SEQ ID NO: 691179 - protein, 9 aa, Homo Sapiens
VQSVGTYGR

SEQ ID NO: 691180 - protein, 9 aa, Homo Sapiens
IPRANGGSA

SEQ ID NO: 691181 - protein, 9 aa, Homo Sapiens
SGSLGSECT

SEQ ID NO: 691182 - protein, 9 aa, Homo Sapiens
DASEHTEWQ

SEQ ID NO: 691183 - protein, 9 aa, Homo Sapiens
SAFSMVKED

SEQ ID NO: 691184 - protein, 9 aa, Homo Sapiens
LMKQGSEKE

SEQ ID NO: 691185 - protein, 9 aa, Homo Sapiens
TRLPGPSRL

SEQ ID NO: 691186 - protein, 9 aa, Homo Sapiens
GTNLEPGVL

SEQ ID NO: 691187 - protein, 9 aa, Homo Sapiens
PFLQTQFPH

SEQ ID NO: 691188 - protein, 9 aa, Homo Sapiens
QQNCSILCF

SEQ ID NO: 691189 - protein, 9 aa, Homo Sapiens
SPRKMPSQQ

SEQ ID NO: 691190 - protein, 9 aa, Homo Sapiens
RVILLKKVD

SEQ ID NO: 691191 - protein, 9 aa, Homo Sapiens
TKEAALTYT

SEQ ID NO: 691192 - protein, 9 aa, Homo Sapiens
RYLVDVRQV

SEQ ID NO: 691193 - protein, 9 aa, Homo Sapiens
EESRQYDDI

SEQ ID NO: 691194 - protein, 9 aa, Homo Sapiens
MASSQRKNE

SEQ ID NO: 691195 - protein, 9 aa, Homo Sapiens
TNACALEKD

SEQ ID NO: 691196 - protein, 9 aa, Homo Sapiens
SVPAHKANP

SEQ ID NO: 691197 - protein, 9 aa, Homo Sapiens
KRALIGYDV

SEQ ID NO: 691198 - protein, 9 aa, Homo Sapiens
MRVKISYVM

SEQ ID NO: 691199 - protein, 9 aa, Homo Sapiens
SQKCPRDRV

SEQ ID NO: 691200 - protein, 9 aa, Homo Sapiens
PVLNPFINT

SEQ ID NO: 691201 - protein, 9 aa, Homo Sapiens
PQAQKHPKK

SEQ ID NO: 691202 - protein, 9 aa, Homo Sapiens
HSYHTPDQD

SEQ ID NO: 691203 - protein, 9 aa, Homo Sapiens
GLRRSSSLH

SEQ ID NO: 691204 - protein, 9 aa, Homo Sapiens
LIMMFLASG

SEQ ID NO: 691205 - protein, 9 aa, Homo Sapiens
VEQTGSRGP

SEQ ID NO: 691206 - protein, 9 aa, Homo Sapiens
CRPPLKDIL

SEQ ID NO: 691207 - protein, 9 aa, Homo Sapiens
QCPEVAPPN

SEQ ID NO: 691208 - protein, 9 aa, Homo Sapiens
QIAKKHVLP

SEQ ID NO: 691209 - protein, 9 aa, Homo Sapiens
RVKWDQYWP

SEQ ID NO: 691210 - protein, 9 aa, Homo Sapiens
GSRDVLGPD

SEQ ID NO: 691211 - protein, 9 aa, Homo Sapiens
LEDRRTNRL

SEQ ID NO: 691212 - protein, 9 aa, Homo Sapiens
FDDYTGRDS

SEQ ID NO: 691213 - protein, 9 aa, Homo Sapiens
PSEMPCPNF

SEQ ID NO: 691214 - protein, 9 aa, Homo Sapiens
DEPKFMFKV

SEQ ID NO: 691215 - protein, 9 aa, Homo Sapiens
KIKSISCEH

SEQ ID NO: 691216 - protein, 9 aa, Homo Sapiens
LPPCTPAPV

SEQ ID NO: 691217 - protein, 9 aa, Homo Sapiens
SKPNKLSNG

SEQ ID NO: 691218 - protein, 9 aa, Homo Sapiens
IVDELYLEP

SEQ ID NO: 691219 - protein, 9 aa, Homo Sapiens
HNPRLMKDL

SEQ ID NO: 691220 - protein, 9 aa, Homo Sapiens
EKIKSISCE

SEQ ID NO: 691221 - protein, 9 aa, Homo Sapiens
PLHLTKQTP

SEQ ID NO: 691222 - protein, 9 aa, Homo Sapiens
KPYQLKETK

SEQ ID NO: 691223 - protein, 9 aa, Homo Sapiens
PGGRSNMTS

SEQ ID NO: 691224 - protein, 9 aa, Homo Sapiens
EGLDDYMEG

SEQ ID NO: 691225 - protein, 9 aa, Homo Sapiens
NKVRFKKVQ

SEQ ID NO: 691226 - protein, 9 aa, Homo Sapiens
VQPAPFLQT

SEQ ID NO: 691227 - protein, 9 aa, Homo Sapiens
KILRFNKAK

SEQ ID NO: 691228 - protein, 9 aa, Homo Sapiens
VSRFVAQAQ

SEQ ID NO: 691229 - protein, 9 aa, Homo Sapiens
LTYVEHYQL

SEQ ID NO: 691230 - protein, 9 aa, Homo Sapiens
VELHCWKGR

SEQ ID NO: 691231 - protein, 9 aa, Homo Sapiens
RAFYTFKKQ

SEQ ID NO: 691232 - protein, 9 aa, Homo Sapiens
QFMGNKVDE

SEQ ID NO: 691233 - protein, 9 aa, Homo Sapiens
GHTDDEFES

SEQ ID NO: 691234 - protein, 9 aa, Homo Sapiens
ALSCFLHTR

SEQ ID NO: 691235 - protein, 9 aa, Homo Sapiens
EIFELDLCD

SEQ ID NO: 691236 - protein, 9 aa, Homo Sapiens
ELFFTFGNL

SEQ ID NO: 691237 - protein, 9 aa, Homo Sapiens
KVSRDNSFL

SEQ ID NO: 691238 - protein, 9 aa, Homo Sapiens
ETEFHHVAQ

SEQ ID NO: 691239 - protein, 9 aa, Homo Sapiens
GSRGPVGGF

SEQ ID NO: 691240 - protein, 9 aa, Homo Sapiens
KEAALTYTI

SEQ ID NO: 691241 - protein, 9 aa, Homo Sapiens
GDRVILLKK

SEQ ID NO: 691242 - protein, 9 aa, Homo Sapiens
QQSTCYNTV

SEQ ID NO: 691243 - protein, 9 aa, Homo Sapiens
NSTTLSDSS

SEQ ID NO: 691244 - protein, 9 aa, Homo Sapiens
PQRTLGASG

SEQ ID NO: 691245 - protein, 9 aa, Homo Sapiens
LLLVARHYT

SEQ ID NO: 691246 - protein, 9 aa, Homo Sapiens
YGRVFHFLV

SEQ ID NO: 691247 - protein, 9 aa, Homo Sapiens
LHSTAPIPS

SEQ ID NO: 691248 - protein, 9 aa, Homo Sapiens
PEIRKEEVD

SEQ ID NO: 691249 - protein, 9 aa, Homo Sapiens
HVNIGIKGL

SEQ ID NO: 691250 - protein, 9 aa, Homo Sapiens
EKAITFFTE

SEQ ID NO: 691251 - protein, 9 aa, Homo Sapiens
GVIECWFVE

SEQ ID NO: 691252 - protein, 9 aa, Homo Sapiens
QEDVEENRS

SEQ ID NO: 691253 - protein, 9 aa, Homo Sapiens
LEKAQINIR

SEQ ID NO: 691254 - protein, 9 aa, Homo Sapiens
AKPEDSWEL

SEQ ID NO: 691255 - protein, 9 aa, Homo Sapiens
IWSRARVLS

SEQ ID NO: 691256 - protein, 9 aa, Homo Sapiens
DCNKAEKFH

SEQ ID NO: 691257 - protein, 9 aa, Homo Sapiens
VCVLGSGLG

SEQ ID NO: 691258 - protein, 9 aa, Homo Sapiens
LSTIKAQSN

SEQ ID NO: 691259 - protein, 9 aa, Homo Sapiens
SALCVIPPS

SEQ ID NO: 691260 - protein, 9 aa, Homo Sapiens
QLVGTQSAG

SEQ ID NO: 691261 - protein, 9 aa, Homo Sapiens
EKQTEVQTV

SEQ ID NO: 691262 - protein, 9 aa, Homo Sapiens
TSPLTRRSC

SEQ ID NO: 691263 - protein, 9 aa, Homo Sapiens
FCTEDVDKC

SEQ ID NO: 691264 - protein, 9 aa, Homo Sapiens
TWKMEKGDV

SEQ ID NO: 691265 - protein, 9 aa, Homo Sapiens
LTKRYSPLT

SEQ ID NO: 691266 - protein, 9 aa, Homo Sapiens
HCGRHHAQL

SEQ ID NO: 691267 - protein, 9 aa, Homo Sapiens
VAEVFRQYH

SEQ ID NO: 691268 - protein, 9 aa, Homo Sapiens
TQERIRGAR

SEQ ID NO: 691269 - protein, 9 aa, Homo Sapiens
KVGDVLKFY

SEQ ID NO: 691270 - protein, 9 aa, Homo Sapiens
SIAATPRDP

SEQ ID NO: 691271 - protein, 9 aa, Homo Sapiens
AELLFSIRE

SEQ ID NO: 691272 - protein, 9 aa, Homo Sapiens
LEYDKEPCC

SEQ ID NO: 691273 - protein, 9 aa, Homo Sapiens
PNKLSNGVD

SEQ ID NO: 691274 - protein, 9 aa, Homo Sapiens
SSPKEVMDV

SEQ ID NO: 691275 - protein, 9 aa, Homo Sapiens
CEVAQDHME

SEQ ID NO: 691276 - protein, 9 aa, Homo Sapiens
WKMEKGDVI

SEQ ID NO: 691277 - protein, 9 aa, Homo Sapiens
ASHTDDSLT

SEQ ID NO: 691278 - protein, 9 aa, Homo Sapiens
FVNLLKNTP

SEQ ID NO: 691279 - protein, 9 aa, Homo Sapiens
PQDIQIIFI

SEQ ID NO: 691280 - protein, 9 aa, Homo Sapiens
KNLVNALRQ

SEQ ID NO: 691281 - protein, 9 aa, Homo Sapiens
GAKLNMYKR

SEQ ID NO: 691282 - protein, 9 aa, Homo Sapiens
ELLTWDEEA

SEQ ID NO: 691283 - protein, 9 aa, Homo Sapiens
SKLIKGSCY

SEQ ID NO: 691284 - protein, 9 aa, Homo Sapiens
TLKEEEKRD

SEQ ID NO: 691285 - protein, 9 aa, Homo Sapiens
TGDAGGLAV

SEQ ID NO: 691286 - protein, 9 aa, Homo Sapiens
HFLCEIPCK

SEQ ID NO: 691287 - protein, 9 aa, Homo Sapiens
TNVVVKKLS

SEQ ID NO: 691288 - protein, 9 aa, Homo Sapiens
EEGESFVCS

SEQ ID NO: 691289 - protein, 9 aa, Homo Sapiens
LHTRLGKLA

SEQ ID NO: 691290 - protein, 9 aa, Homo Sapiens
YVAPKVLLR

SEQ ID NO: 691291 - protein, 9 aa, Homo Sapiens
VVARLARRV

SEQ ID NO: 691292 - protein, 9 aa, Homo Sapiens
VQTVMSEVS

SEQ ID NO: 691293 - protein, 9 aa, Homo Sapiens
ANGGSAITA

SEQ ID NO: 691294 - protein, 9 aa, Homo Sapiens
VEACVVHGL

SEQ ID NO: 691295 - protein, 9 aa, Homo Sapiens
LEKAKCRPL

SEQ ID NO: 691296 - protein, 9 aa, Homo Sapiens
PGTFAYRKL

SEQ ID NO: 691297 - protein, 9 aa, Homo Sapiens
VGYHRWSLS

SEQ ID NO: 691298 - protein, 9 aa, Homo Sapiens
SFSGVTACL

SEQ ID NO: 691299 - protein, 9 aa, Homo Sapiens
EDFTRGKLI

SEQ ID NO: 691300 - protein, 9 aa, Homo Sapiens
YRYFFHHAD

SEQ ID NO: 691301 - protein, 9 aa, Homo Sapiens
KMALRYPEP

SEQ ID NO: 691302 - protein, 9 aa, Homo Sapiens
ICLPCKGDR

SEQ ID NO: 691303 - protein, 9 aa, Homo Sapiens
RGRTTYEAL

SEQ ID NO: 691304 - protein, 9 aa, Homo Sapiens
AIEERKKNP

SEQ ID NO: 691305 - protein, 9 aa, Homo Sapiens
SAHELGFQK

SEQ ID NO: 691306 - protein, 9 aa, Homo Sapiens
PSEIFLSMS

SEQ ID NO: 691307 - protein, 9 aa, Homo Sapiens
VKFNWFVDG

SEQ ID NO: 691308 - protein, 9 aa, Homo Sapiens
HDWSALTFC

SEQ ID NO: 691309 - protein, 9 aa, Homo Sapiens
LSLKQPQAG

SEQ ID NO: 691310 - protein, 9 aa, Homo Sapiens
LQPLEDFSR

SEQ ID NO: 691311 - protein, 9 aa, Homo Sapiens
AAMLSQMSQ

SEQ ID NO: 691312 - protein, 9 aa, Homo Sapiens
STSLHVDDR

SEQ ID NO: 691313 - protein, 9 aa, Homo Sapiens
RCVELHCWK

SEQ ID NO: 691314 - protein, 9 aa, Homo Sapiens
YKSMTVEVS

SEQ ID NO: 691315 - protein, 9 aa, Homo Sapiens
TAVRRQVRP

SEQ ID NO: 691316 - protein, 9 aa, Homo Sapiens
LAGCIYREF

SEQ ID NO: 691317 - protein, 9 aa, Homo Sapiens
HPSETCRPP

SEQ ID NO: 691318 - protein, 9 aa, Homo Sapiens
SAPSCIWRI

SEQ ID NO: 691319 - protein, 9 aa, Homo Sapiens
MDNKLYVVG

SEQ ID NO: 691320 - protein, 9 aa, Homo Sapiens
QGARENIAY

SEQ ID NO: 691321 - protein, 9 aa, Homo Sapiens
KDLQASCLL

SEQ ID NO: 691322 - protein, 9 aa, Homo Sapiens
KEDQWVEKK

SEQ ID NO: 691323 - protein, 9 aa, Homo Sapiens
LLKKVDQNW

SEQ ID NO: 691324 - protein, 9 aa, Homo Sapiens
GSQSLGQNW

SEQ ID NO: 691325 - protein, 9 aa, Homo Sapiens
QILQTRGAV

SEQ ID NO: 691326 - protein, 9 aa, Homo Sapiens
VDPKGSILA

SEQ ID NO: 691327 - protein, 9 aa, Homo Sapiens
CATSKESPH

SEQ ID NO: 691328 - protein, 9 aa, Homo Sapiens
GSMNGQKGD

SEQ ID NO: 691329 - protein, 9 aa, Homo Sapiens
VKIVDVIDS

SEQ ID NO: 691330 - protein, 9 aa, Homo Sapiens
ETCRPPLKD

SEQ ID NO: 691331 - protein, 9 aa, Homo Sapiens
VEGYYPGQL

SEQ ID NO: 691332 - protein, 9 aa, Homo Sapiens
VSSPKEVMD

SEQ ID NO: 691333 - protein, 9 aa, Homo Sapiens
GREIGEFGL

SEQ ID NO: 691334 - protein, 9 aa, Homo Sapiens
QDVTEESKA

SEQ ID NO: 691335 - protein, 9 aa, Homo Sapiens
MGSYAVLVL

SEQ ID NO: 691336 - protein, 9 aa, Homo Sapiens
PMPVAGHPH

SEQ ID NO: 691337 - protein, 9 aa, Homo Sapiens
AVGALSKAV

SEQ ID NO: 691338 - protein, 9 aa, Homo Sapiens
GSCYGKVFV

SEQ ID NO: 691339 - protein, 9 aa, Homo Sapiens
GGSRDVLGP

SEQ ID NO: 691340 - protein, 9 aa, Homo Sapiens
FMGSLSFRI

SEQ ID NO: 691341 - protein, 9 aa, Homo Sapiens
GVIKFRKDI

SEQ ID NO: 691342 - protein, 9 aa, Homo Sapiens
RMRKLQVDM

SEQ ID NO: 691343 - protein, 9 aa, Homo Sapiens
AESNQQFRY

SEQ ID NO: 691344 - protein, 9 aa, Homo Sapiens
NGTDISGNY

SEQ ID NO: 691345 - protein, 9 aa, Homo Sapiens
CKGDRNVIY

SEQ ID NO: 691346 - protein, 9 aa, Homo Sapiens
LVTEHPPSG

SEQ ID NO: 691347 - protein, 9 aa, Homo Sapiens
IKGSCYGKV

SEQ ID NO: 691348 - protein, 9 aa, Homo Sapiens
PPLALLASF

SEQ ID NO: 691349 - protein, 9 aa, Homo Sapiens
NHRVHTGEK

SEQ ID NO: 691350 - protein, 9 aa, Homo Sapiens
ETTWKITDA

SEQ ID NO: 691351 - protein, 9 aa, Homo Sapiens
CHELFFTFG

SEQ ID NO: 691352 - protein, 9 aa, Homo Sapiens
DNISGEDLH

SEQ ID NO: 691353 - protein, 9 aa, Homo Sapiens
DYKELHNYM

SEQ ID NO: 691354 - protein, 9 aa, Homo Sapiens
LHMYDSYKV

SEQ ID NO: 691355 - protein, 9 aa, Homo Sapiens
GLCTKDKTP

SEQ ID NO: 691356 - protein, 9 aa, Homo Sapiens
EIPEGPRRR

SEQ ID NO: 691357 - protein, 9 aa, Homo Sapiens
ILPCDFSRV

SEQ ID NO: 691358 - protein, 9 aa, Homo Sapiens
KNGMSSKSQ

SEQ ID NO: 691359 - protein, 9 aa, Homo Sapiens
VIFGNFLYI

SEQ ID NO: 691360 - protein, 9 aa, Homo Sapiens
NPNNTFYTT

SEQ ID NO: 691361 - protein, 9 aa, Homo Sapiens
KHYADGEDA

SEQ ID NO: 691362 - protein, 9 aa, Homo Sapiens
QDCCAECRS

SEQ ID NO: 691363 - protein, 9 aa, Homo Sapiens
VGASMLQCL

SEQ ID NO: 691364 - protein, 9 aa, Homo Sapiens
LPVVTGIRG

SEQ ID NO: 691365 - protein, 9 aa, Homo Sapiens
HQRISLCLD

SEQ ID NO: 691366 - protein, 9 aa, Homo Sapiens
EDFRRETDA

SEQ ID NO: 691367 - protein, 9 aa, Homo Sapiens
GCIYREFER

SEQ ID NO: 691368 - protein, 9 aa, Homo Sapiens
FKFHVDDFA

SEQ ID NO: 691369 - protein, 9 aa, Homo Sapiens
IRSCTNGCK

SEQ ID NO: 691370 - protein, 9 aa, Homo Sapiens
FIRFLHIIG

SEQ ID NO: 691371 - protein, 9 aa, Homo Sapiens
AKLVHFSQS

SEQ ID NO: 691372 - protein, 9 aa, Homo Sapiens
RVWQDCCAE

SEQ ID NO: 691373 - protein, 9 aa, Homo Sapiens
EDRKNYSKV

SEQ ID NO: 691374 - protein, 9 aa, Homo Sapiens
TAVTDLNII

SEQ ID NO: 691375 - protein, 9 aa, Homo Sapiens
EYQLCNTKE

SEQ ID NO: 691376 - protein, 9 aa, Homo Sapiens
ISCRCHELF

SEQ ID NO: 691377 - protein, 9 aa, Homo Sapiens
EAVSKTLQF

SEQ ID NO: 691378 - protein, 9 aa, Homo Sapiens
PEEITKESL

SEQ ID NO: 691379 - protein, 9 aa, Homo Sapiens
SFLHVYDGK

SEQ ID NO: 691380 - protein, 9 aa, Homo Sapiens
LFNAELAPP

SEQ ID NO: 691381 - protein, 9 aa, Homo Sapiens
EFWDNFIGG

SEQ ID NO: 691382 - protein, 9 aa, Homo Sapiens
ALLASFAGR

SEQ ID NO: 691383 - protein, 9 aa, Homo Sapiens
LSNVQKKRV

SEQ ID NO: 691384 - protein, 9 aa, Homo Sapiens
KDLVLKCRK

SEQ ID NO: 691385 - protein, 9 aa, Homo Sapiens
LSCSFLQDS

SEQ ID NO: 691386 - protein, 9 aa, Homo Sapiens
LQAVTGKRA

SEQ ID NO: 691387 - protein, 9 aa, Homo Sapiens
HLVCAKCAP

SEQ ID NO: 691388 - protein, 9 aa, Homo Sapiens
VTKGRGIFA

SEQ ID NO: 691389 - protein, 9 aa, Homo Sapiens
VSLILQNSS

SEQ ID NO: 691390 - protein, 9 aa, Homo Sapiens
MDRRKAASM

SEQ ID NO: 691391 - protein, 9 aa, Homo Sapiens
GKVEVFLGM

SEQ ID NO: 691392 - protein, 9 aa, Homo Sapiens
EYTACLDFL

SEQ ID NO: 691393 - protein, 9 aa, Homo Sapiens
LFLDSLWEE

SEQ ID NO: 691394 - protein, 9 aa, Homo Sapiens
CKALSGRWL

SEQ ID NO: 691395 - protein, 9 aa, Homo Sapiens
LWASIRTEV

SEQ ID NO: 691396 - protein, 9 aa, Homo Sapiens
AAQAARDSN

SEQ ID NO: 691397 - protein, 9 aa, Homo Sapiens
LLPDVGGGY

SEQ ID NO: 691398 - protein, 9 aa, Homo Sapiens
PHQQNETEF

SEQ ID NO: 691399 - protein, 9 aa, Homo Sapiens
LVKYQNEYN

SEQ ID NO: 691400 - protein, 9 aa, Homo Sapiens
IKHYNILTR

SEQ ID NO: 691401 - protein, 9 aa, Homo Sapiens
LGIELHASL

SEQ ID NO: 691402 - protein, 9 aa, Homo Sapiens
ISQRTEVLG

SEQ ID NO: 691403 - protein, 9 aa, Homo Sapiens
SQKCQVLHE

SEQ ID NO: 691404 - protein, 9 aa, Homo Sapiens
GVAHTDASE

SEQ ID NO: 691405 - protein, 9 aa, Homo Sapiens
PAGIIGPPG

SEQ ID NO: 691406 - protein, 9 aa, Homo Sapiens
LNMYKRKVE

SEQ ID NO: 691407 - protein, 9 aa, Homo Sapiens
KGQSYSYYC

SEQ ID NO: 691408 - protein, 9 aa, Homo Sapiens
LPTLEVSPN

SEQ ID NO: 691409 - protein, 9 aa, Homo Sapiens
SQEEFLTYV

SEQ ID NO: 691410 - protein, 9 aa, Homo Sapiens
SLRDEVIYP

SEQ ID NO: 691411 - protein, 9 aa, Homo Sapiens
HDTTWPEEF

SEQ ID NO: 691412 - protein, 9 aa, Homo Sapiens
DDEENYEIV

SEQ ID NO: 691413 - protein, 9 aa, Homo Sapiens
PPPSASQSA

SEQ ID NO: 691414 - protein, 9 aa, Homo Sapiens
VCYRNCREE

SEQ ID NO: 691415 - protein, 9 aa, Homo Sapiens
QLSIQDVTE

SEQ ID NO: 691416 - protein, 9 aa, Homo Sapiens
LGSLRDEVI

SEQ ID NO: 691417 - protein, 9 aa, Homo Sapiens
CSGCKRILQ

SEQ ID NO: 691418 - protein, 9 aa, Homo Sapiens
RLMKDLLQD

SEQ ID NO: 691419 - protein, 9 aa, Homo Sapiens
DEEADFGDP

SEQ ID NO: 691420 - protein, 9 aa, Homo Sapiens
DASKRKAVV

SEQ ID NO: 691421 - protein, 9 aa, Homo Sapiens
RSMRRKSLR

SEQ ID NO: 691422 - protein, 9 aa, Homo Sapiens
DLGIQSVIA

SEQ ID NO: 691423 - protein, 9 aa, Homo Sapiens
GSRSYHAAV

SEQ ID NO: 691424 - protein, 9 aa, Homo Sapiens
TSINHFVIW

SEQ ID NO: 691425 - protein, 9 aa, Homo Sapiens
MEAKFELRA

SEQ ID NO: 691426 - protein, 9 aa, Homo Sapiens
TGDSKMNLS

SEQ ID NO: 691427 - protein, 9 aa, Homo Sapiens
NKLKVPESE

SEQ ID NO: 691428 - protein, 9 aa, Homo Sapiens
QAQKHPKKD

SEQ ID NO: 691429 - protein, 9 aa, Homo Sapiens
ENTTYLYTL

SEQ ID NO: 691430 - protein, 9 aa, Homo Sapiens
AVMDNKLYV

SEQ ID NO: 691431 - protein, 9 aa, Homo Sapiens
DDHHNPRLM

SEQ ID NO: 691432 - protein, 9 aa, Homo Sapiens
QLHTATNFL

SEQ ID NO: 691433 - protein, 9 aa, Homo Sapiens
NSDDIEACV

SEQ ID NO: 691434 - protein, 9 aa, Homo Sapiens
YGFDGLHLG

SEQ ID NO: 691435 - protein, 9 aa, Homo Sapiens
KSYGRPKTS

SEQ ID NO: 691436 - protein, 9 aa, Homo Sapiens
HGEPTASGL

SEQ ID NO: 691437 - protein, 9 aa, Homo Sapiens
KRHYVNSTR

SEQ ID NO: 691438 - protein, 9 aa, Homo Sapiens
FIFHGLHQA

SEQ ID NO: 691439 - protein, 9 aa, Homo Sapiens
FQASSRPSG

SEQ ID NO: 691440 - protein, 9 aa, Homo Sapiens
ILVAILYDG

SEQ ID NO: 691441 - protein, 9 aa, Homo Sapiens
GLTHMDLSI

SEQ ID NO: 691442 - protein, 9 aa, Homo Sapiens
TLDLRQQMP

SEQ ID NO: 691443 - protein, 9 aa, Homo Sapiens
RLNAIPIQA

SEQ ID NO: 691444 - protein, 9 aa, Homo Sapiens
RCQKEFEKH

SEQ ID NO: 691445 - protein, 9 aa, Homo Sapiens
QENFELVQE

SEQ ID NO: 691446 - protein, 9 aa, Homo Sapiens
VDIIFTLLK

SEQ ID NO: 691447 - protein, 9 aa, Homo Sapiens
KSISYYVCA

SEQ ID NO: 691448 - protein, 9 aa, Homo Sapiens
ARLSVDGRL

SEQ ID NO: 691449 - protein, 9 aa, Homo Sapiens
RLYESEFHT

SEQ ID NO: 691450 - protein, 9 aa, Homo Sapiens
ICFTILGML

SEQ ID NO: 691451 - protein, 9 aa, Homo Sapiens
VYEIQGVIK

SEQ ID NO: 691452 - protein, 9 aa, Homo Sapiens
AKQTPPVQP

SEQ ID NO: 691453 - protein, 9 aa, Homo Sapiens
AVRKGPNQA

SEQ ID NO: 691454 - protein, 9 aa, Homo Sapiens
SCQVSLILQ

SEQ ID NO: 691455 - protein, 9 aa, Homo Sapiens
KPQDIQIIF

SEQ ID NO: 691456 - protein, 9 aa, Homo Sapiens
VKEDFQQKL

SEQ ID NO: 691457 - protein, 9 aa, Homo Sapiens
KEDFQQKLE

SEQ ID NO: 691458 - protein, 9 aa, Homo Sapiens
QDKHDSIDD

SEQ ID NO: 691459 - protein, 9 aa, Homo Sapiens
AEVFRQYHG

SEQ ID NO: 691460 - protein, 9 aa, Homo Sapiens
EAALTYTIS

SEQ ID NO: 691461 - protein, 9 aa, Homo Sapiens
QMLVDKARQ

SEQ ID NO: 691462 - protein, 9 aa, Homo Sapiens
SIERKSNGP

SEQ ID NO: 691463 - protein, 9 aa, Homo Sapiens
SEQAHPSAP

SEQ ID NO: 691464 - protein, 9 aa, Homo Sapiens
HSFYIPRHV

SEQ ID NO: 691465 - protein, 9 aa, Homo Sapiens
CELCGKTLT

SEQ ID NO: 691466 - protein, 9 aa, Homo Sapiens
GFAGSSSCG

SEQ ID NO: 691467 - protein, 9 aa, Homo Sapiens
EIAQSSHYQ

SEQ ID NO: 691468 - protein, 9 aa, Homo Sapiens
YKELHNYME

SEQ ID NO: 691469 - protein, 9 aa, Homo Sapiens
HKDDDEVFE

SEQ ID NO: 691470 - protein, 9 aa, Homo Sapiens
KIPRKDLIV

SEQ ID NO: 691471 - protein, 9 aa, Homo Sapiens
KKRLHLAEM

SEQ ID NO: 691472 - protein, 9 aa, Homo Sapiens
GKASGQGNR

SEQ ID NO: 691473 - protein, 9 aa, Homo Sapiens
TRGVFKVFL

SEQ ID NO: 691474 - protein, 9 aa, Homo Sapiens
QSAMAMCQH

SEQ ID NO: 691475 - protein, 9 aa, Homo Sapiens
LFNVCGCAP

SEQ ID NO: 691476 - protein, 9 aa, Homo Sapiens
YMEGREGMH

SEQ ID NO: 691477 - protein, 9 aa, Homo Sapiens
DSNITHCHD

SEQ ID NO: 691478 - protein, 9 aa, Homo Sapiens
PVKHHPADH

SEQ ID NO: 691479 - protein, 9 aa, Homo Sapiens
DDSHEDTGI

SEQ ID NO: 691480 - protein, 9 aa, Homo Sapiens
YSKVQIRCQ

SEQ ID NO: 691481 - protein, 9 aa, Homo Sapiens
KELFAVIFC

SEQ ID NO: 691482 - protein, 9 aa, Homo Sapiens
LTGSSAYIP

SEQ ID NO: 691483 - protein, 9 aa, Homo Sapiens
MRKLQVDMT

SEQ ID NO: 691484 - protein, 9 aa, Homo Sapiens
MKLAAKQTP

SEQ ID NO: 691485 - protein, 9 aa, Homo Sapiens
GLAGCIYRE

SEQ ID NO: 691486 - protein, 9 aa, Homo Sapiens
QPSGSDLYQ

SEQ ID NO: 691487 - protein, 9 aa, Homo Sapiens
SIKTGLQAV

SEQ ID NO: 691488 - protein, 9 aa, Homo Sapiens
EHKFEGKEG

SEQ ID NO: 691489 - protein, 9 aa, Homo Sapiens
TMITINSAL

SEQ ID NO: 691490 - protein, 9 aa, Homo Sapiens
KRIPSMAGH

SEQ ID NO: 691491 - protein, 9 aa, Homo Sapiens
ATDQKVQKM

SEQ ID NO: 691492 - protein, 9 aa, Homo Sapiens
KNKTICESS

SEQ ID NO: 691493 - protein, 9 aa, Homo Sapiens
LCTKDKTPS

SEQ ID NO: 691494 - protein, 9 aa, Homo Sapiens
NLRFIWQSG

SEQ ID NO: 691495 - protein, 9 aa, Homo Sapiens
LRDCDQQST

SEQ ID NO: 691496 - protein, 9 aa, Homo Sapiens
GDGPPGARL

SEQ ID NO: 691497 - protein, 9 aa, Homo Sapiens
CGGKTKATL

SEQ ID NO: 691498 - protein, 9 aa, Homo Sapiens
DVYLRCFNW

SEQ ID NO: 691499 - protein, 9 aa, Homo Sapiens
MERLAKEYG

SEQ ID NO: 691500 - protein, 9 aa, Homo Sapiens
PEPTNSSFN

SEQ ID NO: 691501 - protein, 9 aa, Homo Sapiens
GTAVFVHAG

SEQ ID NO: 691502 - protein, 9 aa, Homo Sapiens
IFALYKKHA

SEQ ID NO: 691503 - protein, 9 aa, Homo Sapiens
SYNSQSSVD

SEQ ID NO: 691504 - protein, 9 aa, Homo Sapiens
FWSVQGCLL

SEQ ID NO: 691505 - protein, 9 aa, Homo Sapiens
DMDSLREDR

SEQ ID NO: 691506 - protein, 9 aa, Homo Sapiens
YQLKETKRI

SEQ ID NO: 691507 - protein, 9 aa, Homo Sapiens
SQTRRSVSS

SEQ ID NO: 691508 - protein, 9 aa, Homo Sapiens
FMKMLRSMM

SEQ ID NO: 691509 - protein, 9 aa, Homo Sapiens
SRQYDDIIQ

SEQ ID NO: 691510 - protein, 9 aa, Homo Sapiens
VGASTVTAS

SEQ ID NO: 691511 - protein, 9 aa, Homo Sapiens
PCDPPRHNQ

SEQ ID NO: 691512 - protein, 9 aa, Homo Sapiens
NLVSVWLLS

SEQ ID NO: 691513 - protein, 9 aa, Homo Sapiens
MGRQEEPPP

SEQ ID NO: 691514 - protein, 9 aa, Homo Sapiens
ISATAVVSR

SEQ ID NO: 691515 - protein, 9 aa, Homo Sapiens
VLHLKQVLT

SEQ ID NO: 691516 - protein, 9 aa, Homo Sapiens
HYPLTLYVT

SEQ ID NO: 691517 - protein, 9 aa, Homo Sapiens
LLVARHYTK

SEQ ID NO: 691518 - protein, 9 aa, Homo Sapiens
SVGDGLSKS

SEQ ID NO: 691519 - protein, 9 aa, Homo Sapiens
SADASRYLF

SEQ ID NO: 691520 - protein, 9 aa, Homo Sapiens
QEFWDNFIG

SEQ ID NO: 691521 - protein, 9 aa, Homo Sapiens
PTGYRSQGV

SEQ ID NO: 691522 - protein, 9 aa, Homo Sapiens
RDVLGPDPV

SEQ ID NO: 691523 - protein, 9 aa, Homo Sapiens
GGAPGHRAV

SEQ ID NO: 691524 - protein, 9 aa, Homo Sapiens
ERKLMLEQQ

SEQ ID NO: 691525 - protein, 9 aa, Homo Sapiens
NQVQCHPYL

SEQ ID NO: 691526 - protein, 9 aa, Homo Sapiens
QKEFEKHKD

SEQ ID NO: 691527 - protein, 9 aa, Homo Sapiens
REEVEQQAD

SEQ ID NO: 691528 - protein, 9 aa, Homo Sapiens
FNNKGDAPY

SEQ ID NO: 691529 - protein, 9 aa, Homo Sapiens
ELLMLTFSG

SEQ ID NO: 691530 - protein, 9 aa, Homo Sapiens
CDFSRVRLV

SEQ ID NO: 691531 - protein, 9 aa, Homo Sapiens
HFFCEVPVL

SEQ ID NO: 691532 - protein, 9 aa, Homo Sapiens
SFMKSNEEN

SEQ ID NO: 691533 - protein, 9 aa, Homo Sapiens
MFAVGVGEA

SEQ ID NO: 691534 - protein, 9 aa, Homo Sapiens
NFHRFAKKH

SEQ ID NO: 691535 - protein, 9 aa, Homo Sapiens
RHPDMKIEK

SEQ ID NO: 691536 - protein, 9 aa, Homo Sapiens
AILYDGWAL

SEQ ID NO: 691537 - protein, 9 aa, Homo Sapiens
VPAQSEAGS

SEQ ID NO: 691538 - protein, 9 aa, Homo Sapiens
FPVAKGQSY

SEQ ID NO: 691539 - protein, 9 aa, Homo Sapiens
LSVAYNNVV

SEQ ID NO: 691540 - protein, 9 aa, Homo Sapiens
DGIASKTLT

SEQ ID NO: 691541 - protein, 9 aa, Homo Sapiens
KDIVTQSNK

SEQ ID NO: 691542 - protein, 9 aa, Homo Sapiens
AGTVSLSPC

SEQ ID NO: 691543 - protein, 9 aa, Homo Sapiens
DRVDFRAAQ

SEQ ID NO: 691544 - protein, 9 aa, Homo Sapiens
GGFPGGRGK

SEQ ID NO: 691545 - protein, 9 aa, Homo Sapiens
KQSFSDVAM

SEQ ID NO: 691546 - protein, 9 aa, Homo Sapiens
TDQKVQKML

SEQ ID NO: 691547 - protein, 9 aa, Homo Sapiens
DADDSAFNK

SEQ ID NO: 691548 - protein, 9 aa, Homo Sapiens
TAQNLLRIG

SEQ ID NO: 691549 - protein, 9 aa, Homo Sapiens
GQQLEYTAC

SEQ ID NO: 691550 - protein, 9 aa, Homo Sapiens
ITVIAEDIL

SEQ ID NO: 691551 - protein, 9 aa, Homo Sapiens
PQGAKLNMY

SEQ ID NO: 691552 - protein, 9 aa, Homo Sapiens
LVHEINLLP

SEQ ID NO: 691553 - protein, 9 aa, Homo Sapiens
AILRRILNK

SEQ ID NO: 691554 - protein, 9 aa, Homo Sapiens
IAEDILGNN

SEQ ID NO: 691555 - protein, 9 aa, Homo Sapiens
WASIRTEVF

SEQ ID NO: 691556 - protein, 9 aa, Homo Sapiens
DLLAQGLTV

SEQ ID NO: 691557 - protein, 9 aa, Homo Sapiens
DEIDLSYVL

SEQ ID NO: 691558 - protein, 9 aa, Homo Sapiens
YQWLQIDFN

SEQ ID NO: 691559 - protein, 9 aa, Homo Sapiens
KTTVITIVM

SEQ ID NO: 691560 - protein, 9 aa, Homo Sapiens
GKGQEKIQV

SEQ ID NO: 691561 - protein, 9 aa, Homo Sapiens
RIHMEERFM

SEQ ID NO: 691562 - protein, 9 aa, Homo Sapiens
SVSTSDECY

SEQ ID NO: 691563 - protein, 9 aa, Homo Sapiens
RTQLELCPR

SEQ ID NO: 691564 - protein, 9 aa, Homo Sapiens
EARLSVDGR

SEQ ID NO: 691565 - protein, 9 aa, Homo Sapiens
TPGSGGPPT

SEQ ID NO: 691566 - protein, 9 aa, Homo Sapiens
RKPFPVTRE

SEQ ID NO: 691567 - protein, 9 aa, Homo Sapiens
QDYSESIDW

SEQ ID NO: 691568 - protein, 9 aa, Homo Sapiens
SLGSECTNL

SEQ ID NO: 691569 - protein, 9 aa, Homo Sapiens
IKTGLQAVT

SEQ ID NO: 691570 - protein, 9 aa, Homo Sapiens
ENKEGARNM

SEQ ID NO: 691571 - protein, 9 aa, Homo Sapiens
YVVTPLWTV

SEQ ID NO: 691572 - protein, 9 aa, Homo Sapiens
DGSYQCSHF

SEQ ID NO: 691573 - protein, 9 aa, Homo Sapiens
DPAVFRKWP

SEQ ID NO: 691574 - protein, 9 aa, Homo Sapiens
SNVAEEETW

SEQ ID NO: 691575 - protein, 9 aa, Homo Sapiens
CHMNLMEVS

SEQ ID NO: 691576 - protein, 9 aa, Homo Sapiens
PLQRNEIGH

SEQ ID NO: 691577 - protein, 9 aa, Homo Sapiens
NTKECQKHF

SEQ ID NO: 691578 - protein, 9 aa, Homo Sapiens
WRHPFAPCG

SEQ ID NO: 691579 - protein, 9 aa, Homo Sapiens
TTQSVQGAT

SEQ ID NO: 691580 - protein, 9 aa, Homo Sapiens
EVSAPLGIG

SEQ ID NO: 691581 - protein, 9 aa, Homo Sapiens
HSTAPIPSV

SEQ ID NO: 691582 - protein, 9 aa, Homo Sapiens
GLRPASCRP

SEQ ID NO: 691583 - protein, 9 aa, Homo Sapiens
RAFDGILVV

SEQ ID NO: 691584 - protein, 9 aa, Homo Sapiens
EFRRERLTV

SEQ ID NO: 691585 - protein, 9 aa, Homo Sapiens
VFRCIAGSA

SEQ ID NO: 691586 - protein, 9 aa, Homo Sapiens
QLQKIESGE

SEQ ID NO: 691587 - protein, 9 aa, Homo Sapiens
NGREIGEFG

SEQ ID NO: 691588 - protein, 9 aa, Homo Sapiens
VAKPEDSWE

SEQ ID NO: 691589 - protein, 9 aa, Homo Sapiens
PQRNFYPAV

SEQ ID NO: 691590 - protein, 9 aa, Homo Sapiens
VDLQHLYGY

SEQ ID NO: 691591 - protein, 9 aa, Homo Sapiens
QKLRPDPLF

SEQ ID NO: 691592 - protein, 9 aa, Homo Sapiens
LVLLLLHHD

SEQ ID NO: 691593 - protein, 9 aa, Homo Sapiens
GKALDRASP

SEQ ID NO: 691594 - protein, 9 aa, Homo Sapiens
AEDADTNQQ

SEQ ID NO: 691595 - protein, 9 aa, Homo Sapiens
GSAELRKPS

SEQ ID NO: 691596 - protein, 9 aa, Homo Sapiens
YFFHHADED

SEQ ID NO: 691597 - protein, 9 aa, Homo Sapiens
VAPKVLLRQ

SEQ ID NO: 691598 - protein, 9 aa, Homo Sapiens
CRCVELHCW

SEQ ID NO: 691599 - protein, 9 aa, Homo Sapiens
GGKIPMRWT

SEQ ID NO: 691600 - protein, 9 aa, Homo Sapiens
PLPPCTPAP

SEQ ID NO: 691601 - protein, 9 aa, Homo Sapiens
EPPVTRVAY

SEQ ID NO: 691602 - protein, 9 aa, Homo Sapiens
KETSPLTRR

SEQ ID NO: 691603 - protein, 9 aa, Homo Sapiens
DEVIYPDSV

SEQ ID NO: 691604 - protein, 9 aa, Homo Sapiens
KAPDTALGI

SEQ ID NO: 691605 - protein, 9 aa, Homo Sapiens
SATAVVSRG

SEQ ID NO: 691606 - protein, 9 aa, Homo Sapiens
SYHTPDQDK

SEQ ID NO: 691607 - protein, 9 aa, Homo Sapiens
SQPISCKGV

SEQ ID NO: 691608 - protein, 9 aa, Homo Sapiens
DFLFQASSR

SEQ ID NO: 691609 - protein, 9 aa, Homo Sapiens
EGFTHILLC

SEQ ID NO: 691610 - protein, 9 aa, Homo Sapiens
NPGNYRYFF

SEQ ID NO: 691611 - protein, 9 aa, Homo Sapiens
LLLGDAGLS

SEQ ID NO: 691612 - protein, 9 aa, Homo Sapiens
KSLRSGSLR

SEQ ID NO: 691613 - protein, 9 aa, Homo Sapiens
LGITKVFFK

SEQ ID NO: 691614 - protein, 9 aa, Homo Sapiens
LRMLLLQGN

SEQ ID NO: 691615 - protein, 9 aa, Homo Sapiens
AGARCPCEI

SEQ ID NO: 691616 - protein, 9 aa, Homo Sapiens
CSILCFWET

SEQ ID NO: 691617 - protein, 9 aa, Homo Sapiens
LLSQVDFEL

SEQ ID NO: 691618 - protein, 9 aa, Homo Sapiens
TPDQDKAVS

SEQ ID NO: 691619 - protein, 9 aa, Homo Sapiens
TFLGTVENE

SEQ ID NO: 691620 - protein, 9 aa, Homo Sapiens
QSSVKGQGF

SEQ ID NO: 691621 - protein, 9 aa, Homo Sapiens
RKTHQDYLC

SEQ ID NO: 691622 - protein, 9 aa, Homo Sapiens
MVPAQSEAG

SEQ ID NO: 691623 - protein, 9 aa, Homo Sapiens
LHQDLKSAE

SEQ ID NO: 691624 - protein, 9 aa, Homo Sapiens
DGSIVDTTG

SEQ ID NO: 691625 - protein, 9 aa, Homo Sapiens
EYDQVLLED

SEQ ID NO: 691626 - protein, 9 aa, Homo Sapiens
LKENRTIEF

SEQ ID NO: 691627 - protein, 9 aa, Homo Sapiens
RLSVGYTVE

SEQ ID NO: 691628 - protein, 9 aa, Homo Sapiens
DKSKKVCSV

SEQ ID NO: 691629 - protein, 9 aa, Homo Sapiens
PRRAPRTVF

SEQ ID NO: 691630 - protein, 9 aa, Homo Sapiens
TRAFNVPTC

SEQ ID NO: 691631 - protein, 9 aa, Homo Sapiens
SSSMSSFTG

SEQ ID NO: 691632 - protein, 9 aa, Homo Sapiens
PMHPRLGPQ

SEQ ID NO: 691633 - protein, 9 aa, Homo Sapiens
LPAMQQLLA

SEQ ID NO: 691634 - protein, 9 aa, Homo Sapiens
TVARRFMKL

SEQ ID NO: 691635 - protein, 9 aa, Homo Sapiens
DLKEEGLWP

SEQ ID NO: 691636 - protein, 9 aa, Homo Sapiens
VIADAEQYG

SEQ ID NO: 691637 - protein, 9 aa, Homo Sapiens
ITFWHNLNY

SEQ ID NO: 691638 - protein, 9 aa, Homo Sapiens
RHKRTHSGQ

SEQ ID NO: 691639 - protein, 9 aa, Homo Sapiens
KAKQKTVEL

SEQ ID NO: 691640 - protein, 9 aa, Homo Sapiens
SAADYAQFQ

SEQ ID NO: 691641 - protein, 9 aa, Homo Sapiens
SCYGKVFVI

SEQ ID NO: 691642 - protein, 9 aa, Homo Sapiens
TFLKSTCNT

SEQ ID NO: 691643 - protein, 9 aa, Homo Sapiens
REIAQDLKT

SEQ ID NO: 691644 - protein, 9 aa, Homo Sapiens
ADYAQFQGR

SEQ ID NO: 691645 - protein, 9 aa, Homo Sapiens
RISLCLDIH

SEQ ID NO: 691646 - protein, 9 aa, Homo Sapiens
FMDLAKVIV

SEQ ID NO: 691647 - protein, 9 aa, Homo Sapiens
GLKEGRSFS

SEQ ID NO: 691648 - protein, 9 aa, Homo Sapiens
EAKFKAMLE

SEQ ID NO: 691649 - protein, 9 aa, Homo Sapiens
RIDQENNKT

SEQ ID NO: 691650 - protein, 9 aa, Homo Sapiens
YRAPELLLV

SEQ ID NO: 691651 - protein, 9 aa, Homo Sapiens
VNTENLQQR

SEQ ID NO: 691652 - protein, 9 aa, Homo Sapiens
LPALWGGEG

SEQ ID NO: 691653 - protein, 9 aa, Homo Sapiens
YTFKKQRDV

SEQ ID NO: 691654 - protein, 9 aa, Homo Sapiens
RHELSLKQP

SEQ ID NO: 691655 - protein, 9 aa, Homo Sapiens
FHVDDFAES

SEQ ID NO: 691656 - protein, 9 aa, Homo Sapiens
MDKTIVLPP

SEQ ID NO: 691657 - protein, 9 aa, Homo Sapiens
RRRPPQLLE

SEQ ID NO: 691658 - protein, 9 aa, Homo Sapiens
GMHRGLFPT

SEQ ID NO: 691659 - protein, 9 aa, Homo Sapiens
EGPSASTEL

SEQ ID NO: 691660 - protein, 9 aa, Homo Sapiens
SIGIKHYNI

SEQ ID NO: 691661 - protein, 9 aa, Homo Sapiens
TSPQTSPFQ

SEQ ID NO: 691662 - protein, 9 aa, Homo Sapiens
VQTMMGLCC

SEQ ID NO: 691663 - protein, 9 aa, Homo Sapiens
GYHRWSLSC

SEQ ID NO: 691664 - protein, 9 aa, Homo Sapiens
LKFDLGEKV

SEQ ID NO: 691665 - protein, 9 aa, Homo Sapiens
WVFKNFAFA

SEQ ID NO: 691666 - protein, 9 aa, Homo Sapiens
FTILGMLTS

SEQ ID NO: 691667 - protein, 9 aa, Homo Sapiens
RALGSLRML

SEQ ID NO: 691668 - protein, 9 aa, Homo Sapiens
PRNHYPLTL

SEQ ID NO: 691669 - protein, 9 aa, Homo Sapiens
KCKVCLRPL

SEQ ID NO: 691670 - protein, 9 aa, Homo Sapiens
FTLLKEVKA

SEQ ID NO: 691671 - protein, 9 aa, Homo Sapiens
KLVLSTDLE

SEQ ID NO: 691672 - protein, 9 aa, Homo Sapiens
GSGGFPGGR

SEQ ID NO: 691673 - protein, 9 aa, Homo Sapiens
LTRSYRLLA

SEQ ID NO: 691674 - protein, 9 aa, Homo Sapiens
NCSILCFWE

SEQ ID NO: 691675 - protein, 9 aa, Homo Sapiens
ARDIERMVV

SEQ ID NO: 691676 - protein, 9 aa, Homo Sapiens
YNSGEFQIA

SEQ ID NO: 691677 - protein, 9 aa, Homo Sapiens
GPCVLSPTT

SEQ ID NO: 691678 - protein, 9 aa, Homo Sapiens
TATDQKVQK

SEQ ID NO: 691679 - protein, 9 aa, Homo Sapiens
EAEFEKASE

SEQ ID NO: 691680 - protein, 9 aa, Homo Sapiens
KERLSTAVT

SEQ ID NO: 691681 - protein, 9 aa, Homo Sapiens
PPGESGGKG

SEQ ID NO: 691682 - protein, 9 aa, Homo Sapiens
DTTGLKGPA

SEQ ID NO: 691683 - protein, 9 aa, Homo Sapiens
KMEAYNIDD

SEQ ID NO: 691684 - protein, 9 aa, Homo Sapiens
YTNILPCDF

SEQ ID NO: 691685 - protein, 9 aa, Homo Sapiens
LMSCTECQN

SEQ ID NO: 691686 - protein, 9 aa, Homo Sapiens
ETKRIKRAG

SEQ ID NO: 691687 - protein, 9 aa, Homo Sapiens
MTYPGLRGE

SEQ ID NO: 691688 - protein, 9 aa, Homo Sapiens
HAVLHLKQV

SEQ ID NO: 691689 - protein, 9 aa, Homo Sapiens
SFGSAIMDV

SEQ ID NO: 691690 - protein, 9 aa, Homo Sapiens
DKIGMLFQS

SEQ ID NO: 691691 - protein, 9 aa, Homo Sapiens
PLCRKSILR

SEQ ID NO: 691692 - protein, 9 aa, Homo Sapiens
SVDASEHTE

SEQ ID NO: 691693 - protein, 9 aa, Homo Sapiens
LPSAPLHST

SEQ ID NO: 691694 - protein, 9 aa, Homo Sapiens
VLSTDLEPG

SEQ ID NO: 691695 - protein, 9 aa, Homo Sapiens
RPDPLFQRA

SEQ ID NO: 691696 - protein, 9 aa, Homo Sapiens
PQGLLLQEL

SEQ ID NO: 691697 - protein, 9 aa, Homo Sapiens
RVRGQHTNT

SEQ ID NO: 691698 - protein, 9 aa, Homo Sapiens
ENRSPTVEE

SEQ ID NO: 691699 - protein, 9 aa, Homo Sapiens
FEWFLYRPK

SEQ ID NO: 691700 - protein, 9 aa, Homo Sapiens
KAFCHSPSL

SEQ ID NO: 691701 - protein, 9 aa, Homo Sapiens
PSADDNMKT

SEQ ID NO: 691702 - protein, 9 aa, Homo Sapiens
PPTNESQPG

SEQ ID NO: 691703 - protein, 9 aa, Homo Sapiens
YRKHLGVSE

SEQ ID NO: 691704 - protein, 9 aa, Homo Sapiens
RLQFGVAVM

SEQ ID NO: 691705 - protein, 9 aa, Homo Sapiens
TELSPSGSP

SEQ ID NO: 691706 - protein, 9 aa, Homo Sapiens
FQIAKKHVL

SEQ ID NO: 691707 - protein, 9 aa, Homo Sapiens
FHFVLQYLN

SEQ ID NO: 691708 - protein, 9 aa, Homo Sapiens
LNQQLAAPE

SEQ ID NO: 691709 - protein, 9 aa, Homo Sapiens
YVNSTRRAQ

SEQ ID NO: 691710 - protein, 9 aa, Homo Sapiens
CALEKDIGP

SEQ ID NO: 691711 - protein, 9 aa, Homo Sapiens
CGRHHAQLL

SEQ ID NO: 691712 - protein, 9 aa, Homo Sapiens
VVYEVASNQ

SEQ ID NO: 691713 - protein, 9 aa, Homo Sapiens
TTWKITDAE

SEQ ID NO: 691714 - protein, 9 aa, Homo Sapiens
LRRILNKEE

SEQ ID NO: 691715 - protein, 9 aa, Homo Sapiens
LVIFGNFLY

SEQ ID NO: 691716 - protein, 9 aa, Homo Sapiens
EFKKPMLFE

SEQ ID NO: 691717 - protein, 9 aa, Homo Sapiens
SENTTYLYT

SEQ ID NO: 691718 - protein, 9 aa, Homo Sapiens
WLQIDFNKE

SEQ ID NO: 691719 - protein, 9 aa, Homo Sapiens
TQDTELMET

SEQ ID NO: 691720 - protein, 9 aa, Homo Sapiens
HPNIYKNGD

SEQ ID NO: 691721 - protein, 9 aa, Homo Sapiens
TFLVEKMNV

SEQ ID NO: 691722 - protein, 9 aa, Homo Sapiens
SKAGSASGS

SEQ ID NO: 691723 - protein, 9 aa, Homo Sapiens
MPCPNFGKN

SEQ ID NO: 691724 - protein, 9 aa, Homo Sapiens
GTTFYADQM

SEQ ID NO: 691725 - protein, 9 aa, Homo Sapiens
NGMSSKSQK

SEQ ID NO: 691726 - protein, 9 aa, Homo Sapiens
KVMVSQPKD

SEQ ID NO: 691727 - protein, 9 aa, Homo Sapiens
DMKIEKVPE

SEQ ID NO: 691728 - protein, 9 aa, Homo Sapiens
EAVIADAEQ

SEQ ID NO: 691729 - protein, 9 aa, Homo Sapiens
CMVRYVYEA

SEQ ID NO: 691730 - protein, 9 aa, Homo Sapiens
PSPQVVYEV

SEQ ID NO: 691731 - protein, 9 aa, Homo Sapiens
TTLKKIPRF

SEQ ID NO: 691732 - protein, 9 aa, Homo Sapiens
FRLMLQDCM

SEQ ID NO: 691733 - protein, 9 aa, Homo Sapiens
PLVLLLLHH

SEQ ID NO: 691734 - protein, 9 aa, Homo Sapiens
ELHKKQELI

SEQ ID NO: 691735 - protein, 9 aa, Homo Sapiens
ENTREAQQA

SEQ ID NO: 691736 - protein, 9 aa, Homo Sapiens
MSQSINITE

SEQ ID NO: 691737 - protein, 9 aa, Homo Sapiens
ARKAVRKGP

SEQ ID NO: 691738 - protein, 9 aa, Homo Sapiens
SRHHHVVRK

SEQ ID NO: 691739 - protein, 9 aa, Homo Sapiens
TMPFCGSNH

SEQ ID NO: 691740 - protein, 9 aa, Homo Sapiens
AGNKEKAIT

SEQ ID NO: 691741 - protein, 9 aa, Homo Sapiens
VAGALLRKQ

SEQ ID NO: 691742 - protein, 9 aa, Homo Sapiens
TLKATQVSK

SEQ ID NO: 691743 - protein, 9 aa, Homo Sapiens
LKITVNCSP

SEQ ID NO: 691744 - protein, 9 aa, Homo Sapiens
SSDPQGLEA

SEQ ID NO: 691745 - protein, 9 aa, Homo Sapiens
RVSRCTPTG

SEQ ID NO: 691746 - protein, 9 aa, Homo Sapiens
RTLIMMFLA

SEQ ID NO: 691747 - protein, 9 aa, Homo Sapiens
QFGVAVMDN

SEQ ID NO: 691748 - protein, 9 aa, Homo Sapiens
YEAEALLDE

SEQ ID NO: 691749 - protein, 9 aa, Homo Sapiens
LFRNESVHP

SEQ ID NO: 691750 - protein, 9 aa, Homo Sapiens
VFLGMKVQG

SEQ ID NO: 691751 - protein, 9 aa, Homo Sapiens
ANQNQQAFK

SEQ ID NO: 691752 - protein, 9 aa, Homo Sapiens
LYDGWALGE

SEQ ID NO: 691753 - protein, 9 aa, Homo Sapiens
ASVPSACFR

SEQ ID NO: 691754 - protein, 9 aa, Homo Sapiens
LGNNGYVEL

SEQ ID NO: 691755 - protein, 9 aa, Homo Sapiens
PKAPDTALG

SEQ ID NO: 691756 - protein, 9 aa, Homo Sapiens
VYSSVATAT

SEQ ID NO: 691757 - protein, 9 aa, Homo Sapiens
RDPELVGPL

SEQ ID NO: 691758 - protein, 9 aa, Homo Sapiens
AFCHSPSLI

SEQ ID NO: 691759 - protein, 9 aa, Homo Sapiens
LTLYVTVRG

SEQ ID NO: 691760 - protein, 9 aa, Homo Sapiens
VENEHLKKF

SEQ ID NO: 691761 - protein, 9 aa, Homo Sapiens
AWPAASRVW

SEQ ID NO: 691762 - protein, 9 aa, Homo Sapiens
YAPENLDEH

SEQ ID NO: 691763 - protein, 9 aa, Homo Sapiens
EKMEVAKPE

SEQ ID NO: 691764 - protein, 9 aa, Homo Sapiens
VGRLKFWVL

SEQ ID NO: 691765 - protein, 9 aa, Homo Sapiens
ESGVYSFEP

SEQ ID NO: 691766 - protein, 9 aa, Homo Sapiens
TELMETRPA

SEQ ID NO: 691767 - protein, 9 aa, Homo Sapiens
DDSAFNKKE

SEQ ID NO: 691768 - protein, 9 aa, Homo Sapiens
NELIENAQE

SEQ ID NO: 691769 - protein, 9 aa, Homo Sapiens
FNTNVVVKK

SEQ ID NO: 691770 - protein, 9 aa, Homo Sapiens
SLNQQLAAP

SEQ ID NO: 691771 - protein, 9 aa, Homo Sapiens
QRLFRKRAR

SEQ ID NO: 691772 - protein, 9 aa, Homo Sapiens
PRKGVDYAS

SEQ ID NO: 691773 - protein, 9 aa, Homo Sapiens
QITPYVRFI

SEQ ID NO: 691774 - protein, 9 aa, Homo Sapiens
FCVGRLKFW

SEQ ID NO: 691775 - protein, 9 aa, Homo Sapiens
LQIDFNKEK

SEQ ID NO: 691776 - protein, 9 aa, Homo Sapiens
RHMVEHSFF

SEQ ID NO: 691777 - protein, 9 aa, Homo Sapiens
EKDCFIRFL

SEQ ID NO: 691778 - protein, 9 aa, Homo Sapiens
MQAIPRKAF

SEQ ID NO: 691779 - protein, 9 aa, Homo Sapiens
HLTIAELLF

SEQ ID NO: 691780 - protein, 9 aa, Homo Sapiens
GHLVCAKCA

SEQ ID NO: 691781 - protein, 9 aa, Homo Sapiens
CCDTHTNQL

SEQ ID NO: 691782 - protein, 9 aa, Homo Sapiens
TGHSFSTDA

SEQ ID NO: 691783 - protein, 9 aa, Homo Sapiens
SLRLSVGYT

SEQ ID NO: 691784 - protein, 9 aa, Homo Sapiens
ESFVCSSDN

SEQ ID NO: 691785 - protein, 9 aa, Homo Sapiens
SSHETLISK

SEQ ID NO: 691786 - protein, 9 aa, Homo Sapiens
LYECAVRFY

SEQ ID NO: 691787 - protein, 9 aa, Homo Sapiens
AKGCQESGL

SEQ ID NO: 691788 - protein, 9 aa, Homo Sapiens
VLEEHIGPD

SEQ ID NO: 691789 - protein, 9 aa, Homo Sapiens
DTAFGTVGG

SEQ ID NO: 691790 - protein, 9 aa, Homo Sapiens
IHISNDYEA

SEQ ID NO: 691791 - protein, 9 aa, Homo Sapiens
GPGGQTPKV

SEQ ID NO: 691792 - protein, 9 aa, Homo Sapiens
PYFPVAKGQ

SEQ ID NO: 691793 - protein, 9 aa, Homo Sapiens
KGRGIFASG

SEQ ID NO: 691794 - protein, 9 aa, Homo Sapiens
VAQAQPPTP

SEQ ID NO: 691795 - protein, 9 aa, Homo Sapiens
CPGLPPTNE

SEQ ID NO: 691796 - protein, 9 aa, Homo Sapiens
CIHISNDYE

SEQ ID NO: 691797 - protein, 9 aa, Homo Sapiens
EDVWGKTDN

SEQ ID NO: 691798 - protein, 9 aa, Homo Sapiens
TMMGLCCGY

SEQ ID NO: 691799 - protein, 9 aa, Homo Sapiens
ALCVIPPSD

SEQ ID NO: 691800 - protein, 9 aa, Homo Sapiens
VMNTMDKTI

SEQ ID NO: 691801 - protein, 9 aa, Homo Sapiens
QVDPGTNLE

SEQ ID NO: 691802 - protein, 9 aa, Homo Sapiens
NALETWAVP

SEQ ID NO: 691803 - protein, 9 aa, Homo Sapiens
VVVEGPSAS

SEQ ID NO: 691804 - protein, 9 aa, Homo Sapiens
FLFQASSRP

SEQ ID NO: 691805 - protein, 9 aa, Homo Sapiens
CLVTDLLAQ

SEQ ID NO: 691806 - protein, 9 aa, Homo Sapiens
DLKSAEVTL

SEQ ID NO: 691807 - protein, 9 aa, Homo Sapiens
ILGMLTSLV

SEQ ID NO: 691808 - protein, 9 aa, Homo Sapiens
SNGVDFCDM

SEQ ID NO: 691809 - protein, 9 aa, Homo Sapiens
TVKNSEPMK

SEQ ID NO: 691810 - protein, 9 aa, Homo Sapiens
KQKQLQKIE

SEQ ID NO: 691811 - protein, 9 aa, Homo Sapiens
VFESAVNLK

SEQ ID NO: 691812 - protein, 9 aa, Homo Sapiens
GGRKPFPVT

SEQ ID NO: 691813 - protein, 9 aa, Homo Sapiens
FYADQMFLL

SEQ ID NO: 691814 - protein, 9 aa, Homo Sapiens
DPRRDYHSI

SEQ ID NO: 691815 - protein, 9 aa, Homo Sapiens
LYTLGAQIY

SEQ ID NO: 691816 - protein, 9 aa, Homo Sapiens
TILPAKNKY

SEQ ID NO: 691817 - protein, 9 aa, Homo Sapiens
GGSGYQYLG

SEQ ID NO: 691818 - protein, 9 aa, Homo Sapiens
PGGQTPKVV

SEQ ID NO: 691819 - protein, 9 aa, Homo Sapiens
ETVARRFMK

SEQ ID NO: 691820 - protein, 9 aa, Homo Sapiens
RMLLLQGNA

SEQ ID NO: 691821 - protein, 9 aa, Homo Sapiens
DPQGLEAAK

SEQ ID NO: 691822 - protein, 9 aa, Homo Sapiens
YSLFNVCGC

SEQ ID NO: 691823 - protein, 9 aa, Homo Sapiens
VRFIAKVKE

SEQ ID NO: 691824 - protein, 9 aa, Homo Sapiens
QVLHEDIDA

SEQ ID NO: 691825 - protein, 9 aa, Homo Sapiens
SCPVCYRNC

SEQ ID NO: 691826 - protein, 9 aa, Homo Sapiens
MVKEDFQQK

SEQ ID NO: 691827 - protein, 9 aa, Homo Sapiens
SIKKEQKTV

SEQ ID NO: 691828 - protein, 9 aa, Homo Sapiens
VRIHGVNSG

SEQ ID NO: 691829 - protein, 9 aa, Homo Sapiens
PGDGPPGAR

SEQ ID NO: 691830 - protein, 9 aa, Homo Sapiens
NEDRLLLCD

SEQ ID NO: 691831 - protein, 9 aa, Homo Sapiens
LIDPIHEFI

SEQ ID NO: 691832 - protein, 9 aa, Homo Sapiens
NPKETTSVA

SEQ ID NO: 691833 - protein, 9 aa, Homo Sapiens
LGSECTNLA

SEQ ID NO: 691834 - protein, 9 aa, Homo Sapiens
IQKASNKKK

SEQ ID NO: 691835 - protein, 9 aa, Homo Sapiens
HLQCFYEWQ

SEQ ID NO: 691836 - protein, 9 aa, Homo Sapiens
TYEALPCLP

SEQ ID NO: 691837 - protein, 9 aa, Homo Sapiens
APDHDSLKL

SEQ ID NO: 691838 - protein, 9 aa, Homo Sapiens
CSTSLHVDD

SEQ ID NO: 691839 - protein, 9 aa, Homo Sapiens
RGKSYGRPK

SEQ ID NO: 691840 - protein, 9 aa, Homo Sapiens
RCTPTGLIK

SEQ ID NO: 691841 - protein, 9 aa, Homo Sapiens
LFCLSVKAI

SEQ ID NO: 691842 - protein, 9 aa, Homo Sapiens
AVSKTLQFK

SEQ ID NO: 691843 - protein, 9 aa, Homo Sapiens
IQSLRRELH

SEQ ID NO: 691844 - protein, 9 aa, Homo Sapiens
SEILREFFK

SEQ ID NO: 691845 - protein, 9 aa, Homo Sapiens
KRYERERAI

SEQ ID NO: 691846 - protein, 9 aa, Homo Sapiens
TKRIKRAGG

SEQ ID NO: 691847 - protein, 9 aa, Homo Sapiens
AVHSLSRIV

SEQ ID NO: 691848 - protein, 9 aa, Homo Sapiens
RLRKAQALA

SEQ ID NO: 691849 - protein, 9 aa, Homo Sapiens
ELSLKQPQA

SEQ ID NO: 691850 - protein, 9 aa, Homo Sapiens
EAIEERKKN

SEQ ID NO: 691851 - protein, 9 aa, Homo Sapiens
QNPGSASAD

SEQ ID NO: 691852 - protein, 9 aa, Homo Sapiens
NPQAQKHPK

SEQ ID NO: 691853 - protein, 9 aa, Homo Sapiens
ARCPCEILP

SEQ ID NO: 691854 - protein, 9 aa, Homo Sapiens
SYRCVCPTG

SEQ ID NO: 691855 - protein, 9 aa, Homo Sapiens
ILCCIRASS

SEQ ID NO: 691856 - protein, 9 aa, Homo Sapiens
KLVHFSQST

SEQ ID NO: 691857 - protein, 9 aa, Homo Sapiens
DQIEAALSS

SEQ ID NO: 691858 - protein, 9 aa, Homo Sapiens
SARRRIPRT

SEQ ID NO: 691859 - protein, 9 aa, Homo Sapiens
STKRYERER

SEQ ID NO: 691860 - protein, 9 aa, Homo Sapiens
EINPGNYRY

SEQ ID NO: 691861 - protein, 9 aa, Homo Sapiens
NDPLRYSVK

SEQ ID NO: 691862 - protein, 9 aa, Homo Sapiens
TQLELCPRG

SEQ ID NO: 691863 - protein, 9 aa, Homo Sapiens
RKLPHRNAC

SEQ ID NO: 691864 - protein, 9 aa, Homo Sapiens
LLLVAGDRA

SEQ ID NO: 691865 - protein, 9 aa, Homo Sapiens
VIGAVTTVG

SEQ ID NO: 691866 - protein, 9 aa, Homo Sapiens
LSGNSSTLG

SEQ ID NO: 691867 - protein, 9 aa, Homo Sapiens
ARGCKRKRS

SEQ ID NO: 691868 - protein, 9 aa, Homo Sapiens
GTGAMTAGP

SEQ ID NO: 691869 - protein, 9 aa, Homo Sapiens
VQAEILNSD

SEQ ID NO: 691870 - protein, 9 aa, Homo Sapiens
RLMLQDCMA

SEQ ID NO: 691871 - protein, 9 aa, Homo Sapiens
LYSIERKSN

SEQ ID NO: 691872 - protein, 9 aa, Homo Sapiens
GEDIHYPGK

SEQ ID NO: 691873 - protein, 9 aa, Homo Sapiens
SENAMQAIP

SEQ ID NO: 691874 - protein, 9 aa, Homo Sapiens
EMPCPNFGK

SEQ ID NO: 691875 - protein, 9 aa, Homo Sapiens
EHREWGSHN

SEQ ID NO: 691876 - protein, 9 aa, Homo Sapiens
DTGAEGGTE

SEQ ID NO: 691877 - protein, 9 aa, Homo Sapiens
RHPFAPCGR

SEQ ID NO: 691878 - protein, 9 aa, Homo Sapiens
TSETAGEGE

SEQ ID NO: 691879 - protein, 9 aa, Homo Sapiens
EKKQQKEQL

SEQ ID NO: 691880 - protein, 9 aa, Homo Sapiens
NFSGRGRQE

SEQ ID NO: 691881 - protein, 9 aa, Homo Sapiens
SDRWSLIRG

SEQ ID NO: 691882 - protein, 9 aa, Homo Sapiens
HRPCLRCEL

SEQ ID NO: 691883 - protein, 9 aa, Homo Sapiens
IQTNNNKSI

SEQ ID NO: 691884 - protein, 9 aa, Homo Sapiens
PFQEHTILT

SEQ ID NO: 691885 - protein, 9 aa, Homo Sapiens
IKRYNSFIS

SEQ ID NO: 691886 - protein, 9 aa, Homo Sapiens
CSEDQRTLL

SEQ ID NO: 691887 - protein, 9 aa, Homo Sapiens
VSRSDQVIG

SEQ ID NO: 691888 - protein, 9 aa, Homo Sapiens
GDPPPSASQ

SEQ ID NO: 691889 - protein, 9 aa, Homo Sapiens
LSCEVAQDH

SEQ ID NO: 691890 - protein, 9 aa, Homo Sapiens
SIRTEVFQT

SEQ ID NO: 691891 - protein, 9 aa, Homo Sapiens
AEILNSDAV

SEQ ID NO: 691892 - protein, 9 aa, Homo Sapiens
FKVIGANKN

SEQ ID NO: 691893 - protein, 9 aa, Homo Sapiens
TVLCHDTTW

SEQ ID NO: 691894 - protein, 9 aa, Homo Sapiens
DPPPSASQS

SEQ ID NO: 691895 - protein, 9 aa, Homo Sapiens
AQRERARAE

SEQ ID NO: 691896 - protein, 9 aa, Homo Sapiens
GVFSVFAPS

SEQ ID NO: 691897 - protein, 9 aa, Homo Sapiens
YAYPNSEVI

SEQ ID NO: 691898 - protein, 9 aa, Homo Sapiens
YNSQSSVDN

SEQ ID NO: 691899 - protein, 9 aa, Homo Sapiens
HKMDTFLGP

SEQ ID NO: 691900 - protein, 9 aa, Homo Sapiens
LHLRRSREF

SEQ ID NO: 691901 - protein, 9 aa, Homo Sapiens
HCDCQVRHR

SEQ ID NO: 691902 - protein, 9 aa, Homo Sapiens
FTTFQIIWD

SEQ ID NO: 691903 - protein, 9 aa, Homo Sapiens
NENTREAQQ

SEQ ID NO: 691904 - protein, 9 aa, Homo Sapiens
GDLSLEEAI

SEQ ID NO: 691905 - protein, 9 aa, Homo Sapiens
DDDSHEDTG

SEQ ID NO: 691906 - protein, 9 aa, Homo Sapiens
KMAAVFLTT

SEQ ID NO: 691907 - protein, 9 aa, Homo Sapiens
CFYEWQSSI

SEQ ID NO: 691908 - protein, 9 aa, Homo Sapiens
AGPGVIECW

SEQ ID NO: 691909 - protein, 9 aa, Homo Sapiens
EPKHYADGE

SEQ ID NO: 691910 - protein, 9 aa, Homo Sapiens
GPQPAGPSI

SEQ ID NO: 691911 - protein, 9 aa, Homo Sapiens
SYVMIALTV

SEQ ID NO: 691912 - protein, 9 aa, Homo Sapiens
EDRREDMLR

SEQ ID NO: 691913 - protein, 9 aa, Homo Sapiens
CNTKECQKH

SEQ ID NO: 691914 - protein, 9 aa, Homo Sapiens
FEPLCRKSI

SEQ ID NO: 691915 - protein, 9 aa, Homo Sapiens
SLQQEIWEQ

SEQ ID NO: 691916 - protein, 9 aa, Homo Sapiens
LDLLCPSLE

SEQ ID NO: 691917 - protein, 9 aa, Homo Sapiens
DSSMGRQEE

SEQ ID NO: 691918 - protein, 9 aa, Homo Sapiens
KAIVSKFLY

SEQ ID NO: 691919 - protein, 9 aa, Homo Sapiens
AGSAELRKP

SEQ ID NO: 691920 - protein, 9 aa, Homo Sapiens
RAEEVCIHI

SEQ ID NO: 691921 - protein, 9 aa, Homo Sapiens
HQLKTVSAV

SEQ ID NO: 691922 - protein, 9 aa, Homo Sapiens
VQTSLREQV

SEQ ID NO: 691923 - protein, 9 aa, Homo Sapiens
VRKGPNQAL

SEQ ID NO: 691924 - protein, 9 aa, Homo Sapiens
HSLMSTLSS

SEQ ID NO: 691925 - protein, 9 aa, Homo Sapiens
WSLHSWSIP

SEQ ID NO: 691926 - protein, 9 aa, Homo Sapiens
PPGCLQPLL

SEQ ID NO: 691927 - protein, 9 aa, Homo Sapiens
KTPKIQQLS

SEQ ID NO: 691928 - protein, 9 aa, Homo Sapiens
LLPGIFALY

SEQ ID NO: 691929 - protein, 9 aa, Homo Sapiens
DTGIISNTR

SEQ ID NO: 691930 - protein, 9 aa, Homo Sapiens
APGHRAVRC

SEQ ID NO: 691931 - protein, 9 aa, Homo Sapiens
GSCLGIFEW

SEQ ID NO: 691932 - protein, 9 aa, Homo Sapiens
ARERRGRQQ

SEQ ID NO: 691933 - protein, 9 aa, Homo Sapiens
LLVTEHPPS

SEQ ID NO: 691934 - protein, 9 aa, Homo Sapiens
FCNNVLPHY

SEQ ID NO: 691935 - protein, 9 aa, Homo Sapiens
FGSAIMDVL

SEQ ID NO: 691936 - protein, 9 aa, Homo Sapiens
LMLTFSGVI

SEQ ID NO: 691937 - protein, 9 aa, Homo Sapiens
QLEYTACLD

SEQ ID NO: 691938 - protein, 9 aa, Homo Sapiens
CTECQNRMH

SEQ ID NO: 691939 - protein, 9 aa, Homo Sapiens
DSAFNKKEN

SEQ ID NO: 691940 - protein, 9 aa, Homo Sapiens
QLDDKEVSE

SEQ ID NO: 691941 - protein, 9 aa, Homo Sapiens
HWIVGNWSV

SEQ ID NO: 691942 - protein, 9 aa, Homo Sapiens
GGSGTGPAP

SEQ ID NO: 691943 - protein, 9 aa, Homo Sapiens
IRDKRGMHR

SEQ ID NO: 691944 - protein, 9 aa, Homo Sapiens
VYLRCFNWH

SEQ ID NO: 691945 - protein, 9 aa, Homo Sapiens
KAGSASGSN

SEQ ID NO: 691946 - protein, 9 aa, Homo Sapiens
NQTPLWVTQ

SEQ ID NO: 691947 - protein, 9 aa, Homo Sapiens
LAEKKQQKE

SEQ ID NO: 691948 - protein, 9 aa, Homo Sapiens
QRQRHLDNS

SEQ ID NO: 691949 - protein, 9 aa, Homo Sapiens
QITPAKGPV

SEQ ID NO: 691950 - protein, 9 aa, Homo Sapiens
VVLTALMGC

SEQ ID NO: 691951 - protein, 9 aa, Homo Sapiens
ALAKVAPQR

SEQ ID NO: 691952 - protein, 9 aa, Homo Sapiens
NGCKAVYKA

SEQ ID NO: 691953 - protein, 9 aa, Homo Sapiens
FGNFLYIIG

SEQ ID NO: 691954 - protein, 9 aa, Homo Sapiens
SLFYEQSKK

SEQ ID NO: 691955 - protein, 9 aa, Homo Sapiens
TEPHPGPEL

SEQ ID NO: 691956 - protein, 9 aa, Homo Sapiens
KDIKSIRNF

SEQ ID NO: 691957 - protein, 9 aa, Homo Sapiens
SPCIWVIFY

SEQ ID NO: 691958 - protein, 9 aa, Homo Sapiens
EVAEVFRQY

SEQ ID NO: 691959 - protein, 9 aa, Homo Sapiens
NAMGCKILE

SEQ ID NO: 691960 - protein, 9 aa, Homo Sapiens
LQNKLKVPE

SEQ ID NO: 691961 - protein, 9 aa, Homo Sapiens
LVLPAAGGA

SEQ ID NO: 691962 - protein, 9 aa, Homo Sapiens
TDGSIVDTT

SEQ ID NO: 691963 - protein, 9 aa, Homo Sapiens
QRPICLPCK

SEQ ID NO: 691964 - protein, 9 aa, Homo Sapiens
QERIRGARL

SEQ ID NO: 691965 - protein, 9 aa, Homo Sapiens
VYNDSCVSP

SEQ ID NO: 691966 - protein, 9 aa, Homo Sapiens
TFHIIRKNV

SEQ ID NO: 691967 - protein, 9 aa, Homo Sapiens
FYSPDPSQL

SEQ ID NO: 691968 - protein, 9 aa, Homo Sapiens
YLEDEGDSS

SEQ ID NO: 691969 - protein, 9 aa, Homo Sapiens
VGVVQDDKF

SEQ ID NO: 691970 - protein, 9 aa, Homo Sapiens
LGKPSLPKK

SEQ ID NO: 691971 - protein, 9 aa, Homo Sapiens
SYFKQLHTA

SEQ ID NO: 691972 - protein, 9 aa, Homo Sapiens
ERGSITFWH

SEQ ID NO: 691973 - protein, 9 aa, Homo Sapiens
FQKYYQRLN

SEQ ID NO: 691974 - protein, 9 aa, Homo Sapiens
LSSFLTKRY

SEQ ID NO: 691975 - protein, 9 aa, Homo Sapiens
VSDKAYILS

SEQ ID NO: 691976 - protein, 9 aa, Homo Sapiens
RPVPGEYSL

SEQ ID NO: 691977 - protein, 9 aa, Homo Sapiens
KVMQFMGNK

SEQ ID NO: 691978 - protein, 9 aa, Homo Sapiens
SASKGLNHM

SEQ ID NO: 691979 - protein, 9 aa, Homo Sapiens
SRRQRRVLG

SEQ ID NO: 691980 - protein, 9 aa, Homo Sapiens
TPVDDPISL

SEQ ID NO: 691981 - protein, 9 aa, Homo Sapiens
NPGSASADP

SEQ ID NO: 691982 - protein, 9 aa, Homo Sapiens
EDLKFDLGE

SEQ ID NO: 691983 - protein, 9 aa, Homo Sapiens
DKVDMGSMN

SEQ ID NO: 691984 - protein, 9 aa, Homo Sapiens
QPEAPPLPP

SEQ ID NO: 691985 - protein, 9 aa, Homo Sapiens
ARAEEVCIH

SEQ ID NO: 691986 - protein, 9 aa, Homo Sapiens
FHQRISLCL

SEQ ID NO: 691987 - protein, 9 aa, Homo Sapiens
YDSYKVPDE

SEQ ID NO: 691988 - protein, 9 aa, Homo Sapiens
FDDEPKFMF

SEQ ID NO: 691989 - protein, 9 aa, Homo Sapiens
IASKTLTLW

SEQ ID NO: 691990 - protein, 9 aa, Homo Sapiens
PVCYRNCRE

SEQ ID NO: 691991 - protein, 9 aa, Homo Sapiens
SLSRIVDEL

SEQ ID NO: 691992 - protein, 9 aa, Homo Sapiens
RALLNMQYC

SEQ ID NO: 691993 - protein, 9 aa, Homo Sapiens
RILQKGQTA

SEQ ID NO: 691994 - protein, 9 aa, Homo Sapiens
PAVFRKWPE

SEQ ID NO: 691995 - protein, 9 aa, Homo Sapiens
KQTPKKPPP

SEQ ID NO: 691996 - protein, 9 aa, Homo Sapiens
KTSNRERSD

SEQ ID NO: 691997 - protein, 9 aa, Homo Sapiens
MLLLGDAGL

SEQ ID NO: 691998 - protein, 9 aa, Homo Sapiens
QNPNNFQEV

SEQ ID NO: 691999 - protein, 9 aa, Homo Sapiens
RPVDLPTEG

SEQ ID NO: 692000 - protein, 9 aa, Homo Sapiens
HKRTHSGQK

SEQ ID NO: 692001 - protein, 9 aa, Homo Sapiens
FAPCGRGEW

SEQ ID NO: 692002 - protein, 9 aa, Homo Sapiens
TNGCKAVYK

SEQ ID NO: 692003 - protein, 9 aa, Homo Sapiens
SLSPCIWVI

SEQ ID NO: 692004 - protein, 9 aa, Homo Sapiens
QADNILKDA

SEQ ID NO: 692005 - protein, 9 aa, Homo Sapiens
SFSTNSPPL

SEQ ID NO: 692006 - protein, 9 aa, Homo Sapiens
KPNKLSNGV

SEQ ID NO: 692007 - protein, 9 aa, Homo Sapiens
EHTEWQQLV

SEQ ID NO: 692008 - protein, 9 aa, Homo Sapiens
VLEKAKCRP

SEQ ID NO: 692009 - protein, 9 aa, Homo Sapiens
VSDVMACGG

SEQ ID NO: 692010 - protein, 9 aa, Homo Sapiens
WASAPDQTE

SEQ ID NO: 692011 - protein, 9 aa, Homo Sapiens
SNGNSGGWS

SEQ ID NO: 692012 - protein, 9 aa, Homo Sapiens
LTREIQGIR

SEQ ID NO: 692013 - protein, 9 aa, Homo Sapiens
CSFSYTSRQ

SEQ ID NO: 692014 - protein, 9 aa, Homo Sapiens
RTLLMEAAE

SEQ ID NO: 692015 - protein, 9 aa, Homo Sapiens
LGGSGSVVS

SEQ ID NO: 692016 - protein, 9 aa, Homo Sapiens
ADKTENGKS

SEQ ID NO: 692017 - protein, 9 aa, Homo Sapiens
DWWISCRCH

SEQ ID NO: 692018 - protein, 9 aa, Homo Sapiens
ACVNVLQEF

SEQ ID NO: 692019 - protein, 9 aa, Homo Sapiens
RMFAVGVGE

SEQ ID NO: 692020 - protein, 9 aa, Homo Sapiens
HIGPDPQYV

SEQ ID NO: 692021 - protein, 9 aa, Homo Sapiens
MNELLMLTF

SEQ ID NO: 692022 - protein, 9 aa, Homo Sapiens
DFDDYTGRD

SEQ ID NO: 692023 - protein, 9 aa, Homo Sapiens
AQDHMEVTW

SEQ ID NO: 692024 - protein, 9 aa, Homo Sapiens
QRLASKPQD

SEQ ID NO: 692025 - protein, 9 aa, Homo Sapiens
QNCSILCFW

SEQ ID NO: 692026 - protein, 9 aa, Homo Sapiens
ALTYTISLR

SEQ ID NO: 692027 - protein, 9 aa, Homo Sapiens
ILEESRQYD

SEQ ID NO: 692028 - protein, 9 aa, Homo Sapiens
TLGAQIYYF

SEQ ID NO: 692029 - protein, 9 aa, Homo Sapiens
PNDSSFTLY

SEQ ID NO: 692030 - protein, 9 aa, Homo Sapiens
QAARDSNIT

SEQ ID NO: 692031 - protein, 9 aa, Homo Sapiens
CMSEEEVLP

SEQ ID NO: 692032 - protein, 9 aa, Homo Sapiens
TAGPHAAAD

SEQ ID NO: 692033 - protein, 9 aa, Homo Sapiens
TFAYRKLCP

SEQ ID NO: 692034 - protein, 9 aa, Homo Sapiens
SSKPKLDTV

SEQ ID NO: 692035 - protein, 9 aa, Homo Sapiens
KLLQLLAAA

SEQ ID NO: 692036 - protein, 9 aa, Homo Sapiens
HRGLFPTYY

SEQ ID NO: 692037 - protein, 9 aa, Homo Sapiens
GTPNYVAPK

SEQ ID NO: 692038 - protein, 9 aa, Homo Sapiens
ASSWKMAAV

SEQ ID NO: 692039 - protein, 9 aa, Homo Sapiens
LQSHLNSDD

SEQ ID NO: 692040 - protein, 9 aa, Homo Sapiens
EKAFRAILS

SEQ ID NO: 692041 - protein, 9 aa, Homo Sapiens
ISNFLVAII

SEQ ID NO: 692042 - protein, 9 aa, Homo Sapiens
QSFFTPTSL

SEQ ID NO: 692043 - protein, 9 aa, Homo Sapiens
LIQLTGHSF

SEQ ID NO: 692044 - protein, 9 aa, Homo Sapiens
PFRVLREAL

SEQ ID NO: 692045 - protein, 9 aa, Homo Sapiens
ADFQGTKQA

SEQ ID NO: 692046 - protein, 9 aa, Homo Sapiens
NSQKPGLIK

SEQ ID NO: 692047 - protein, 9 aa, Homo Sapiens
SGSPCLDRH

SEQ ID NO: 692048 - protein, 9 aa, Homo Sapiens
LSKVPVDKV

SEQ ID NO: 692049 - protein, 9 aa, Homo Sapiens
QEYPGKQVA

SEQ ID NO: 692050 - protein, 9 aa, Homo Sapiens
DCDQQSTCY

SEQ ID NO: 692051 - protein, 9 aa, Homo Sapiens
PGNYRYFFH

SEQ ID NO: 692052 - protein, 9 aa, Homo Sapiens
ASEHTEWQQ

SEQ ID NO: 692053 - protein, 9 aa, Homo Sapiens
LIPLPKVGL

SEQ ID NO: 692054 - protein, 9 aa, Homo Sapiens
IRFLHIIGN

SEQ ID NO: 692055 - protein, 9 aa, Homo Sapiens
ETSSAGAHK

SEQ ID NO: 692056 - protein, 9 aa, Homo Sapiens
YPGKQVAGP

SEQ ID NO: 692057 - protein, 9 aa, Homo Sapiens
GAVSLQGSI

SEQ ID NO: 692058 - protein, 9 aa, Homo Sapiens
GPHRCAGRM

SEQ ID NO: 692059 - protein, 9 aa, Homo Sapiens
EPKFMFKVI

SEQ ID NO: 692060 - protein, 9 aa, Homo Sapiens
CAHWEKKKT

SEQ ID NO: 692061 - protein, 9 aa, Homo Sapiens
RRRRLNREQ

SEQ ID NO: 692062 - protein, 9 aa, Homo Sapiens
QLKETKRIK

SEQ ID NO: 692063 - protein, 9 aa, Homo Sapiens
LRIHMEERF

SEQ ID NO: 692064 - protein, 9 aa, Homo Sapiens
AKEYGARVV

SEQ ID NO: 692065 - protein, 9 aa, Homo Sapiens
QRATNMLGS

SEQ ID NO: 692066 - protein, 9 aa, Homo Sapiens
LMIDEMNDI

SEQ ID NO: 692067 - protein, 9 aa, Homo Sapiens
FECVDWERL

SEQ ID NO: 692068 - protein, 9 aa, Homo Sapiens
SGSGGGSSS

SEQ ID NO: 692069 - protein, 9 aa, Homo Sapiens
VTNQVQCHP

SEQ ID NO: 692070 - protein, 9 aa, Homo Sapiens
FHCMQRDVQ

SEQ ID NO: 692071 - protein, 9 aa, Homo Sapiens
NEHKFEGKE

SEQ ID NO: 692072 - protein, 9 aa, Homo Sapiens
QALKNQATG

SEQ ID NO: 692073 - protein, 9 aa, Homo Sapiens
TNPNNTFYT

SEQ ID NO: 692074 - protein, 9 aa, Homo Sapiens
EEAQKLLET

SEQ ID NO: 692075 - protein, 9 aa, Homo Sapiens
MFDPPQQFH

SEQ ID NO: 692076 - protein, 9 aa, Homo Sapiens
ETLKATQVS

SEQ ID NO: 692077 - protein, 9 aa, Homo Sapiens
EFHTSAAYK

SEQ ID NO: 692078 - protein, 9 aa, Homo Sapiens
CNHRVHTGE

SEQ ID NO: 692079 - protein, 9 aa, Homo Sapiens
QRVEDYKIN

SEQ ID NO: 692080 - protein, 9 aa, Homo Sapiens
TRSYRLLAG

SEQ ID NO: 692081 - protein, 9 aa, Homo Sapiens
VDVIDSSQQ

SEQ ID NO: 692082 - protein, 9 aa, Homo Sapiens
GIQSVIAFA

SEQ ID NO: 692083 - protein, 9 aa, Homo Sapiens
YWTSINHFV

SEQ ID NO: 692084 - protein, 9 aa, Homo Sapiens
LRCFNWHSG

SEQ ID NO: 692085 - protein, 9 aa, Homo Sapiens
KMISWMYLM

SEQ ID NO: 692086 - protein, 9 aa, Homo Sapiens
WYQKAIVSK

SEQ ID NO: 692087 - protein, 9 aa, Homo Sapiens
LETVGVSNP

SEQ ID NO: 692088 - protein, 9 aa, Homo Sapiens
VSVWLLSSK

SEQ ID NO: 692089 - protein, 9 aa, Homo Sapiens
GPAGPPGES

SEQ ID NO: 692090 - protein, 9 aa, Homo Sapiens
IKSISCEHV

SEQ ID NO: 692091 - protein, 9 aa, Homo Sapiens
QGRNCSIAG

SEQ ID NO: 692092 - protein, 9 aa, Homo Sapiens
VAINDPLRY

SEQ ID NO: 692093 - protein, 9 aa, Homo Sapiens
VDKIGLHLR

SEQ ID NO: 692094 - protein, 9 aa, Homo Sapiens
SCTECQNRM

SEQ ID NO: 692095 - protein, 9 aa, Homo Sapiens
FWDNFIGGV

SEQ ID NO: 692096 - protein, 9 aa, Homo Sapiens
CGSGNNEDR

SEQ ID NO: 692097 - protein, 9 aa, Homo Sapiens
KKDDKEKDV

SEQ ID NO: 692098 - protein, 9 aa, Homo Sapiens
TRCRMQLVP

SEQ ID NO: 692099 - protein, 9 aa, Homo Sapiens
TEDQNSLRK

SEQ ID NO: 692100 - protein, 9 aa, Homo Sapiens
WWISCRCHE

SEQ ID NO: 692101 - protein, 9 aa, Homo Sapiens
IHCGRHHAQ

SEQ ID NO: 692102 - protein, 9 aa, Homo Sapiens
CLLLQYHCD

SEQ ID NO: 692103 - protein, 9 aa, Homo Sapiens
INNPKETTS

SEQ ID NO: 692104 - protein, 9 aa, Homo Sapiens
PRRDYHSIR

SEQ ID NO: 692105 - protein, 9 aa, Homo Sapiens
PAFTDQSFF

SEQ ID NO: 692106 - protein, 9 aa, Homo Sapiens
LHVNIGIKG

SEQ ID NO: 692107 - protein, 9 aa, Homo Sapiens
WVEKKVQGN

SEQ ID NO: 692108 - protein, 9 aa, Homo Sapiens
VIDSSQQKT

SEQ ID NO: 692109 - protein, 9 aa, Homo Sapiens
AGMPKGNLT

SEQ ID NO: 692110 - protein, 9 aa, Homo Sapiens
LVNALRQDP

SEQ ID NO: 692111 - protein, 9 aa, Homo Sapiens
ISFMKSNEE

SEQ ID NO: 692112 - protein, 9 aa, Homo Sapiens
HLRMFKDLQ

SEQ ID NO: 692113 - protein, 9 aa, Homo Sapiens
HFCGSCLGI

SEQ ID NO: 692114 - protein, 9 aa, Homo Sapiens
VTEESKAVY

SEQ ID NO: 692115 - protein, 9 aa, Homo Sapiens
AVILCCIRA

SEQ ID NO: 692116 - protein, 9 aa, Homo Sapiens
NVGAYMQQG

SEQ ID NO: 692117 - protein, 9 aa, Homo Sapiens
SIQDVTEES

SEQ ID NO: 692118 - protein, 9 aa, Homo Sapiens
PEGPRRRRL

SEQ ID NO: 692119 - protein, 9 aa, Homo Sapiens
GSVGHDWSA

SEQ ID NO: 692120 - protein, 9 aa, Homo Sapiens
EWFLYRPKA

SEQ ID NO: 692121 - protein, 9 aa, Homo Sapiens
SADDNMKTP

SEQ ID NO: 692122 - protein, 9 aa, Homo Sapiens
HLPDCAPAT

SEQ ID NO: 692123 - protein, 9 aa, Homo Sapiens
LHASLCCTG

SEQ ID NO: 692124 - protein, 9 aa, Homo Sapiens
LSLRTEQSN

SEQ ID NO: 692125 - protein, 9 aa, Homo Sapiens
SRQGAARFA

SEQ ID NO: 692126 - protein, 9 aa, Homo Sapiens
GRADFDDYT

SEQ ID NO: 692127 - protein, 9 aa, Homo Sapiens
TTSVAVFVR

SEQ ID NO: 692128 - protein, 9 aa, Homo Sapiens
YPAVQNLPA

SEQ ID NO: 692129 - protein, 9 aa, Homo Sapiens
WRKTHQDYL

SEQ ID NO: 692130 - protein, 9 aa, Homo Sapiens
DTELMETRP

SEQ ID NO: 692131 - protein, 9 aa, Homo Sapiens
QNMRAFDGI

SEQ ID NO: 692132 - protein, 9 aa, Homo Sapiens
YPLILVAIL

SEQ ID NO: 692133 - protein, 9 aa, Homo Sapiens
ENLLEYDKE

SEQ ID NO: 692134 - protein, 9 aa, Homo Sapiens
TCQITPAKG

SEQ ID NO: 692135 - protein, 9 aa, Homo Sapiens
SPGSVAFSD

SEQ ID NO: 692136 - protein, 9 aa, Homo Sapiens
DEHIKKVSQ

SEQ ID NO: 692137 - protein, 9 aa, Homo Sapiens
EILNSDAVL

SEQ ID NO: 692138 - protein, 9 aa, Homo Sapiens
YSSVATATP

SEQ ID NO: 692139 - protein, 9 aa, Homo Sapiens
NTTIETSVN

SEQ ID NO: 692140 - protein, 9 aa, Homo Sapiens
YTISLRAQG

SEQ ID NO: 692141 - protein, 9 aa, Homo Sapiens
TGIPAQTVS

SEQ ID NO: 692142 - protein, 9 aa, Homo Sapiens
INPSITLAL

SEQ ID NO: 692143 - protein, 9 aa, Homo Sapiens
TELIGKNKT

SEQ ID NO: 692144 - protein, 9 aa, Homo Sapiens
GPDAVCVLG

SEQ ID NO: 692145 - protein, 9 aa, Homo Sapiens
VIPTRYGKS

SEQ ID NO: 692146 - protein, 9 aa, Homo Sapiens
CSFLQDSNI

SEQ ID NO: 692147 - protein, 9 aa, Homo Sapiens
LPGPSRLPA

SEQ ID NO: 692148 - protein, 9 aa, Homo Sapiens
ISLCLDIHN

SEQ ID NO: 692149 - protein, 9 aa, Homo Sapiens
PSLEKRLES

SEQ ID NO: 692150 - protein, 9 aa, Homo Sapiens
YHGFGDTAK

SEQ ID NO: 692151 - protein, 9 aa, Homo Sapiens
ETRGVFKVF

SEQ ID NO: 692152 - protein, 9 aa, Homo Sapiens
PLHSTLGEL

SEQ ID NO: 692153 - protein, 9 aa, Homo Sapiens
TEEVTAVRR

SEQ ID NO: 692154 - protein, 9 aa, Homo Sapiens
LEEHIGPDP

SEQ ID NO: 692155 - protein, 9 aa, Homo Sapiens
RDYHSIRRP

SEQ ID NO: 692156 - protein, 9 aa, Homo Sapiens
QTCQITPAK

SEQ ID NO: 692157 - protein, 9 aa, Homo Sapiens
NGQNHFKDS

SEQ ID NO: 692158 - protein, 9 aa, Homo Sapiens
SNISIYLNN

SEQ ID NO: 692159 - protein, 9 aa, Homo Sapiens
RVSGLAGCI

SEQ ID NO: 692160 - protein, 9 aa, Homo Sapiens
KRALAKVAP

SEQ ID NO: 692161 - protein, 9 aa, Homo Sapiens
FFEGNRSQP

SEQ ID NO: 692162 - protein, 9 aa, Homo Sapiens
PFFECVDWE

SEQ ID NO: 692163 - protein, 9 aa, Homo Sapiens
RGRQEAAGS

SEQ ID NO: 692164 - protein, 9 aa, Homo Sapiens
FRPSLEKRL

SEQ ID NO: 692165 - protein, 9 aa, Homo Sapiens
AVSLQGSIM

SEQ ID NO: 692166 - protein, 9 aa, Homo Sapiens
ENFELVQEY

SEQ ID NO: 692167 - protein, 9 aa, Homo Sapiens
QTTQSVQGA

SEQ ID NO: 692168 - protein, 9 aa, Homo Sapiens
SHTDDSLTG

SEQ ID NO: 692169 - protein, 9 aa, Homo Sapiens
SLANNHILL

SEQ ID NO: 692170 - protein, 9 aa, Homo Sapiens
PKPSQLQGK

SEQ ID NO: 692171 - protein, 9 aa, Homo Sapiens
FKNHWKGRA

SEQ ID NO: 692172 - protein, 9 aa, Homo Sapiens
CQDLDPGDY

SEQ ID NO: 692173 - protein, 9 aa, Homo Sapiens
LVEALHVNI

SEQ ID NO: 692174 - protein, 9 aa, Homo Sapiens
LLLVGASML

SEQ ID NO: 692175 - protein, 9 aa, Homo Sapiens
KEKAITFFT

SEQ ID NO: 692176 - protein, 9 aa, Homo Sapiens
RYKAIYETE

SEQ ID NO: 692177 - protein, 9 aa, Homo Sapiens
NPINRQRLH

SEQ ID NO: 692178 - protein, 9 aa, Homo Sapiens
NFELVQEYY

SEQ ID NO: 692179 - protein, 9 aa, Homo Sapiens
CTPTGLIKL

SEQ ID NO: 692180 - protein, 9 aa, Homo Sapiens
QGAARFALQ

SEQ ID NO: 692181 - protein, 9 aa, Homo Sapiens
AFTTFQIIW

SEQ ID NO: 692182 - protein, 9 aa, Homo Sapiens
NYEIVPRVL

SEQ ID NO: 692183 - protein, 9 aa, Homo Sapiens
SQKPGLIKV

SEQ ID NO: 692184 - protein, 9 aa, Homo Sapiens
KDLLSEEDP

SEQ ID NO: 692185 - protein, 9 aa, Homo Sapiens
GALAPAQIS

SEQ ID NO: 692186 - protein, 9 aa, Homo Sapiens
CPRVPMPVA

SEQ ID NO: 692187 - protein, 9 aa, Homo Sapiens
FEGNRSQPI

SEQ ID NO: 692188 - protein, 9 aa, Homo Sapiens
SPAFLLLAN

SEQ ID NO: 692189 - protein, 9 aa, Homo Sapiens
PSLWASIRT

SEQ ID NO: 692190 - protein, 9 aa, Homo Sapiens
EEVCIHISN

SEQ ID NO: 692191 - protein, 9 aa, Homo Sapiens
LVVVSWEES

SEQ ID NO: 692192 - protein, 9 aa, Homo Sapiens
KSRDPFWNT

SEQ ID NO: 692193 - protein, 9 aa, Homo Sapiens
DPQRQRHLD

SEQ ID NO: 692194 - protein, 9 aa, Homo Sapiens
ELCPLPGTF

SEQ ID NO: 692195 - protein, 9 aa, Homo Sapiens
SSPIPQLSG

SEQ ID NO: 692196 - protein, 9 aa, Homo Sapiens
TTTSRKSRP

SEQ ID NO: 692197 - protein, 9 aa, Homo Sapiens
YVENGTPCG

SEQ ID NO: 692198 - protein, 9 aa, Homo Sapiens
IAHQGRDVE

SEQ ID NO: 692199 - protein, 9 aa, Homo Sapiens
QDCMAVKTL

SEQ ID NO: 692200 - protein, 9 aa, Homo Sapiens
PPKLEKIGN

SEQ ID NO: 692201 - protein, 9 aa, Homo Sapiens
KEEGLWPEL

SEQ ID NO: 692202 - protein, 9 aa, Homo Sapiens
IERMVVARL

SEQ ID NO: 692203 - protein, 9 aa, Homo Sapiens
IQGIRVTSH

SEQ ID NO: 692204 - protein, 9 aa, Homo Sapiens
MCECMSSYF

SEQ ID NO: 692205 - protein, 9 aa, Homo Sapiens
LVDVRQVQL

SEQ ID NO: 692206 - protein, 9 aa, Homo Sapiens
LEEARAQRE

SEQ ID NO: 692207 - protein, 9 aa, Homo Sapiens
ISGEDLHST

SEQ ID NO: 692208 - protein, 9 aa, Homo Sapiens
TQSVQGATG

SEQ ID NO: 692209 - protein, 9 aa, Homo Sapiens
VMLCAHWEK

SEQ ID NO: 692210 - protein, 9 aa, Homo Sapiens
KAKKPKRNE

SEQ ID NO: 692211 - protein, 9 aa, Homo Sapiens
PSDSSDPQG

SEQ ID NO: 692212 - protein, 9 aa, Homo Sapiens
SFFEAQGAR

SEQ ID NO: 692213 - protein, 9 aa, Homo Sapiens
VMIALTVVG

SEQ ID NO: 692214 - protein, 9 aa, Homo Sapiens
VSSIIQKWS

SEQ ID NO: 692215 - protein, 9 aa, Homo Sapiens
RFAKKHNFA

SEQ ID NO: 692216 - protein, 9 aa, Homo Sapiens
YLLQPLEDF

SEQ ID NO: 692217 - protein, 9 aa, Homo Sapiens
IHRLSCSEN

SEQ ID NO: 692218 - protein, 9 aa, Homo Sapiens
MFLASGTHF

SEQ ID NO: 692219 - protein, 9 aa, Homo Sapiens
VRPFTPHTI

SEQ ID NO: 692220 - protein, 9 aa, Homo Sapiens
GSGYQYLGT

SEQ ID NO: 692221 - protein, 9 aa, Homo Sapiens
VVNKGGEAE

SEQ ID NO: 692222 - protein, 9 aa, Homo Sapiens
EQMVTPQSL

SEQ ID NO: 692223 - protein, 9 aa, Homo Sapiens
AQQDRDDMA

SEQ ID NO: 692224 - protein, 9 aa, Homo Sapiens
CGKAFCHSP

SEQ ID NO: 692225 - protein, 9 aa, Homo Sapiens
DQVIGAVTT

SEQ ID NO: 692226 - protein, 9 aa, Homo Sapiens
IPMRWTAPE

SEQ ID NO: 692227 - protein, 9 aa, Homo Sapiens
NETEFHHVA

SEQ ID NO: 692228 - protein, 9 aa, Homo Sapiens
GRPVPIERV

SEQ ID NO: 692229 - protein, 9 aa, Homo Sapiens
ACSFSYTSR

SEQ ID NO: 692230 - protein, 9 aa, Homo Sapiens
STEPHPGPE

SEQ ID NO: 692231 - protein, 9 aa, Homo Sapiens
EFHHVAQAS

SEQ ID NO: 692232 - protein, 9 aa, Homo Sapiens
GMPKGNLTE

SEQ ID NO: 692233 - protein, 9 aa, Homo Sapiens
GLAGTGDAG

SEQ ID NO: 692234 - protein, 9 aa, Homo Sapiens
PISAPSCIW

SEQ ID NO: 692235 - protein, 9 aa, Homo Sapiens
KALSGRWLL

SEQ ID NO: 692236 - protein, 9 aa, Homo Sapiens
CGEPFGHEG

SEQ ID NO: 692237 - protein, 9 aa, Homo Sapiens
GSAITAFKV

SEQ ID NO: 692238 - protein, 9 aa, Homo Sapiens
GRIDQENNK

SEQ ID NO: 692239 - protein, 9 aa, Homo Sapiens
VICIISLSF

SEQ ID NO: 692240 - protein, 9 aa, Homo Sapiens
VWQDCCAEC

SEQ ID NO: 692241 - protein, 9 aa, Homo Sapiens
RGVFKVFLE

SEQ ID NO: 692242 - protein, 9 aa, Homo Sapiens
DSSFTLYLV

SEQ ID NO: 692243 - protein, 9 aa, Homo Sapiens
ELRLQLSRP

SEQ ID NO: 692244 - protein, 9 aa, Homo Sapiens
DTPTACSFS

SEQ ID NO: 692245 - protein, 9 aa, Homo Sapiens
RVSCSGCKR

SEQ ID NO: 692246 - protein, 9 aa, Homo Sapiens
TYTISLRAQ

SEQ ID NO: 692247 - protein, 9 aa, Homo Sapiens
LSWVFKNFA

SEQ ID NO: 692248 - protein, 9 aa, Homo Sapiens
FFCEVPVLI

SEQ ID NO: 692249 - protein, 9 aa, Homo Sapiens
PRANGGSAI

SEQ ID NO: 692250 - protein, 9 aa, Homo Sapiens
RRAPRTVFR

SEQ ID NO: 692251 - protein, 9 aa, Homo Sapiens
RNTDTLVVV

SEQ ID NO: 692252 - protein, 9 aa, Homo Sapiens
EEAEQKEAK

SEQ ID NO: 692253 - protein, 9 aa, Homo Sapiens
NWDGIASKT

SEQ ID NO: 692254 - protein, 9 aa, Homo Sapiens
NGPNTTAGI

SEQ ID NO: 692255 - protein, 9 aa, Homo Sapiens
NAHHCLKIT

SEQ ID NO: 692256 - protein, 9 aa, Homo Sapiens
QPAPFLQTQ

SEQ ID NO: 692257 - protein, 9 aa, Homo Sapiens
GSLRMLLLQ

SEQ ID NO: 692258 - protein, 9 aa, Homo Sapiens
MSNYIMLAD

SEQ ID NO: 692259 - protein, 9 aa, Homo Sapiens
AKCLGIELH

SEQ ID NO: 692260 - protein, 9 aa, Homo Sapiens
AAVFLTTTS

SEQ ID NO: 692261 - protein, 9 aa, Homo Sapiens
EEWSMGGYV

SEQ ID NO: 692262 - protein, 9 aa, Homo Sapiens
GRSNMTSLS

SEQ ID NO: 692263 - protein, 9 aa, Homo Sapiens
ELFISNVTK

SEQ ID NO: 692264 - protein, 9 aa, Homo Sapiens
GENILFSTV

SEQ ID NO: 692265 - protein, 9 aa, Homo Sapiens
SVQLQPTDD

SEQ ID NO: 692266 - protein, 9 aa, Homo Sapiens
SCWSGNWWC

SEQ ID NO: 692267 - protein, 9 aa, Homo Sapiens
GKTTVITIV

SEQ ID NO: 692268 - protein, 9 aa, Homo Sapiens
TKRYSPLTV

SEQ ID NO: 692269 - protein, 9 aa, Homo Sapiens
TKLVLSTDL

SEQ ID NO: 692270 - protein, 9 aa, Homo Sapiens
EVFRQYHGT

SEQ ID NO: 692271 - protein, 9 aa, Homo Sapiens
CYRNCREED

SEQ ID NO: 692272 - protein, 9 aa, Homo Sapiens
RQDYSESID

SEQ ID NO: 692273 - protein, 9 aa, Homo Sapiens
SRLLLGLAP

SEQ ID NO: 692274 - protein, 9 aa, Homo Sapiens
ITEANENTR

SEQ ID NO: 692275 - protein, 9 aa, Homo Sapiens
GNFLYIIGS

SEQ ID NO: 692276 - protein, 9 aa, Homo Sapiens
SRSDQVIGA

SEQ ID NO: 692277 - protein, 9 aa, Homo Sapiens
YPNSEVIYV

SEQ ID NO: 692278 - protein, 9 aa, Homo Sapiens
PENLDEHIK

SEQ ID NO: 692279 - protein, 9 aa, Homo Sapiens
RMYERRIEC

SEQ ID NO: 692280 - protein, 9 aa, Homo Sapiens
LLAGLVSWG

SEQ ID NO: 692281 - protein, 9 aa, Homo Sapiens
SPIPQLSGN

SEQ ID NO: 692282 - protein, 9 aa, Homo Sapiens
SKMLGIFWF

SEQ ID NO: 692283 - protein, 9 aa, Homo Sapiens
LKCRKGDED

SEQ ID NO: 692284 - protein, 9 aa, Homo Sapiens
KAQALAEGR

SEQ ID NO: 692285 - protein, 9 aa, Homo Sapiens
APLHSTLGE

SEQ ID NO: 692286 - protein, 9 aa, Homo Sapiens
MFRVGLVLP

SEQ ID NO: 692287 - protein, 9 aa, Homo Sapiens
VVHRSDKLG

SEQ ID NO: 692288 - protein, 9 aa, Homo Sapiens
RHNQGHCCH

SEQ ID NO: 692289 - protein, 9 aa, Homo Sapiens
SCRPHKELD

SEQ ID NO: 692290 - protein, 9 aa, Homo Sapiens
AATLHMTVR

SEQ ID NO: 692291 - protein, 9 aa, Homo Sapiens
DVLGPDPVC

SEQ ID NO: 692292 - protein, 9 aa, Homo Sapiens
FRHLHLRQK

SEQ ID NO: 692293 - protein, 9 aa, Homo Sapiens
LENKFVRVS

SEQ ID NO: 692294 - protein, 9 aa, Homo Sapiens
IHEFIALTN

SEQ ID NO: 692295 - protein, 9 aa, Homo Sapiens
REKECSQAL

SEQ ID NO: 692296 - protein, 9 aa, Homo Sapiens
GVQALKNQA

SEQ ID NO: 692297 - protein, 9 aa, Homo Sapiens
SILCFWETQ

SEQ ID NO: 692298 - protein, 9 aa, Homo Sapiens
DPKGSILAE

SEQ ID NO: 692299 - protein, 9 aa, Homo Sapiens
YTINSGSTC

SEQ ID NO: 692300 - protein, 9 aa, Homo Sapiens
PGHRAVRCR

SEQ ID NO: 692301 - protein, 9 aa, Homo Sapiens
QSTCYNTVI

SEQ ID NO: 692302 - protein, 9 aa, Homo Sapiens
GGSGGFPGG

SEQ ID NO: 692303 - protein, 9 aa, Homo Sapiens
STLANDKIT

SEQ ID NO: 692304 - protein, 9 aa, Homo Sapiens
CQCHFDINV

SEQ ID NO: 692305 - protein, 9 aa, Homo Sapiens
QVLLEDRRT

SEQ ID NO: 692306 - protein, 9 aa, Homo Sapiens
EAQKLLETV

SEQ ID NO: 692307 - protein, 9 aa, Homo Sapiens
FLLQPTSTW

SEQ ID NO: 692308 - protein, 9 aa, Homo Sapiens
EEEQRLFRK

SEQ ID NO: 692309 - protein, 9 aa, Homo Sapiens
REENRLKKM

SEQ ID NO: 692310 - protein, 9 aa, Homo Sapiens
ANALQRHLP

SEQ ID NO: 692311 - protein, 9 aa, Homo Sapiens
SGNNEDRLL

SEQ ID NO: 692312 - protein, 9 aa, Homo Sapiens
PPCTPAPVP

SEQ ID NO: 692313 - protein, 9 aa, Homo Sapiens
KIMEEESRT

SEQ ID NO: 692314 - protein, 9 aa, Homo Sapiens
QKQLQKIES

SEQ ID NO: 692315 - protein, 9 aa, Homo Sapiens
ALWGGEGWT

SEQ ID NO: 692316 - protein, 9 aa, Homo Sapiens
ISTWLYEAE

SEQ ID NO: 692317 - protein, 9 aa, Homo Sapiens
RPTPETLHC

SEQ ID NO: 692318 - protein, 9 aa, Homo Sapiens
TEADTVLSP

SEQ ID NO: 692319 - protein, 9 aa, Homo Sapiens
RLTADKDLQ

SEQ ID NO: 692320 - protein, 9 aa, Homo Sapiens
CNKAEKFHF

SEQ ID NO: 692321 - protein, 9 aa, Homo Sapiens
TTTSSSFSS

SEQ ID NO: 692322 - protein, 9 aa, Homo Sapiens
LNKEETSPQ

SEQ ID NO: 692323 - protein, 9 aa, Homo Sapiens
VRQVQLQGF

SEQ ID NO: 692324 - protein, 9 aa, Homo Sapiens
GFGDTAKSI

SEQ ID NO: 692325 - protein, 9 aa, Homo Sapiens
ALKRQISTK

SEQ ID NO: 692326 - protein, 9 aa, Homo Sapiens
EEARLSVDG

SEQ ID NO: 692327 - protein, 9 aa, Homo Sapiens
SLFRHLHLR

SEQ ID NO: 692328 - protein, 9 aa, Homo Sapiens
LESGVYSFE

SEQ ID NO: 692329 - protein, 9 aa, Homo Sapiens
KEAKFKAML

SEQ ID NO: 692330 - protein, 9 aa, Homo Sapiens
NRFCYGQCH

SEQ ID NO: 692331 - protein, 9 aa, Homo Sapiens
HFTPNSRKP

SEQ ID NO: 692332 - protein, 9 aa, Homo Sapiens
DTTWPEEFD

SEQ ID NO: 692333 - protein, 9 aa, Homo Sapiens
IDSSQQKTF

SEQ ID NO: 692334 - protein, 9 aa, Homo Sapiens
HTIFEPTPL

SEQ ID NO: 692335 - protein, 9 aa, Homo Sapiens
AQTVSWSKA

SEQ ID NO: 692336 - protein, 9 aa, Homo Sapiens
DMADEVANG

SEQ ID NO: 692337 - protein, 9 aa, Homo Sapiens
TSKESPHTG

SEQ ID NO: 692338 - protein, 9 aa, Homo Sapiens
NLVEYLRLV

SEQ ID NO: 692339 - protein, 9 aa, Homo Sapiens
IYLNNVLFY

SEQ ID NO: 692340 - protein, 9 aa, Homo Sapiens
LFQASSRPS

SEQ ID NO: 692341 - protein, 9 aa, Homo Sapiens
RKMPSQQDA

SEQ ID NO: 692342 - protein, 9 aa, Homo Sapiens
NIPVFVIKY

SEQ ID NO: 692343 - protein, 9 aa, Homo Sapiens
NAVYKCKNE

SEQ ID NO: 692344 - protein, 9 aa, Homo Sapiens
GRMEVWHGG

SEQ ID NO: 692345 - protein, 9 aa, Homo Sapiens
ADVLSPEKQ

SEQ ID NO: 692346 - protein, 9 aa, Homo Sapiens
IGGVSENAR

SEQ ID NO: 692347 - protein, 9 aa, Homo Sapiens
KFPWLKENR

SEQ ID NO: 692348 - protein, 9 aa, Homo Sapiens
ARRRPPQLL

SEQ ID NO: 692349 - protein, 9 aa, Homo Sapiens
PKTPPRWTE

SEQ ID NO: 692350 - protein, 9 aa, Homo Sapiens
NKQVLEHEI

SEQ ID NO: 692351 - protein, 9 aa, Homo Sapiens
DIVTQSNKF

SEQ ID NO: 692352 - protein, 9 aa, Homo Sapiens
EMNDIRIIG

SEQ ID NO: 692353 - protein, 9 aa, Homo Sapiens
HSPSLIKHQ

SEQ ID NO: 692354 - protein, 9 aa, Homo Sapiens
LAIRNHEEL

SEQ ID NO: 692355 - protein, 9 aa, Homo Sapiens
IKFPWLKEN

SEQ ID NO: 692356 - protein, 9 aa, Homo Sapiens
VFEHLLAKD

SEQ ID NO: 692357 - protein, 9 aa, Homo Sapiens
LIWIHRLSC

SEQ ID NO: 692358 - protein, 9 aa, Homo Sapiens
WIVGNWSVC

SEQ ID NO: 692359 - protein, 9 aa, Homo Sapiens
VRFKKVQFK

SEQ ID NO: 692360 - protein, 9 aa, Homo Sapiens
YKCKNEGNC

SEQ ID NO: 692361 - protein, 9 aa, Homo Sapiens
FPWLKENRT

SEQ ID NO: 692362 - protein, 9 aa, Homo Sapiens
ILPAKNKYP

SEQ ID NO: 692363 - protein, 9 aa, Homo Sapiens
SCEHVNEEK

SEQ ID NO: 692364 - protein, 9 aa, Homo Sapiens
KRGMHRGLF

SEQ ID NO: 692365 - protein, 9 aa, Homo Sapiens
LTTLKMEAK

SEQ ID NO: 692366 - protein, 9 aa, Homo Sapiens
SLREQNELD

SEQ ID NO: 692367 - protein, 9 aa, Homo Sapiens
FCPTNCHMN

SEQ ID NO: 692368 - protein, 9 aa, Homo Sapiens
YCRKNLIRV

SEQ ID NO: 692369 - protein, 9 aa, Homo Sapiens
PKHYADGED

SEQ ID NO: 692370 - protein, 9 aa, Homo Sapiens
PPRWTEDQN

SEQ ID NO: 692371 - protein, 9 aa, Homo Sapiens
DVEENRSPT

SEQ ID NO: 692372 - protein, 9 aa, Homo Sapiens
VDASEHTEW

SEQ ID NO: 692373 - protein, 9 aa, Homo Sapiens
RCELCGKTL

SEQ ID NO: 692374 - protein, 9 aa, Homo Sapiens
RNWICENQE

SEQ ID NO: 692375 - protein, 9 aa, Homo Sapiens
SILMIDEMN

SEQ ID NO: 692376 - protein, 9 aa, Homo Sapiens
SDKGWAQAT

SEQ ID NO: 692377 - protein, 9 aa, Homo Sapiens
DPSIKNTEW

SEQ ID NO: 692378 - protein, 9 aa, Homo Sapiens
TERFVSSPK

SEQ ID NO: 692379 - protein, 9 aa, Homo Sapiens
CIWVIFYNI

SEQ ID NO: 692380 - protein, 9 aa, Homo Sapiens
QVVYEVASN

SEQ ID NO: 692381 - protein, 9 aa, Homo Sapiens
IDPIHEFIA

SEQ ID NO: 692382 - protein, 9 aa, Homo Sapiens
CFLHTRLGK

SEQ ID NO: 692383 - protein, 9 aa, Homo Sapiens
SFFKSLVIK

SEQ ID NO: 692384 - protein, 9 aa, Homo Sapiens
EQQADNILK

SEQ ID NO: 692385 - protein, 9 aa, Homo Sapiens
RPKTSNRER

SEQ ID NO: 692386 - protein, 9 aa, Homo Sapiens
HTMFRVGLV

SEQ ID NO: 692387 - protein, 9 aa, Homo Sapiens
RRVLGNLMG

SEQ ID NO: 692388 - protein, 9 aa, Homo Sapiens
QLQPTDDLL

SEQ ID NO: 692389 - protein, 9 aa, Homo Sapiens
ILDELKVAQ

SEQ ID NO: 692390 - protein, 9 aa, Homo Sapiens
LTYIHTMNA

SEQ ID NO: 692391 - protein, 9 aa, Homo Sapiens
LYENQTPLW

SEQ ID NO: 692392 - protein, 9 aa, Homo Sapiens
RLQLSRPVD

SEQ ID NO: 692393 - protein, 9 aa, Homo Sapiens
VSKTLQFKA

SEQ ID NO: 692394 - protein, 9 aa, Homo Sapiens
SNVGAYMQQ

SEQ ID NO: 692395 - protein, 9 aa, Homo Sapiens
PFTPHTITL

SEQ ID NO: 692396 - protein, 9 aa, Homo Sapiens
AYNNVVGGQ

SEQ ID NO: 692397 - protein, 9 aa, Homo Sapiens
PGARLLSQD

SEQ ID NO: 692398 - protein, 9 aa, Homo Sapiens
AHTDASESI

SEQ ID NO: 692399 - protein, 9 aa, Homo Sapiens
VFYVQQAKC

SEQ ID NO: 692400 - protein, 9 aa, Homo Sapiens
HEYAQRDTW

SEQ ID NO: 692401 - protein, 9 aa, Homo Sapiens
KSKAGSASG

SEQ ID NO: 692402 - protein, 9 aa, Homo Sapiens
LASKPQDPA

SEQ ID NO: 692403 - protein, 9 aa, Homo Sapiens
GKTKATLFG

SEQ ID NO: 692404 - protein, 9 aa, Homo Sapiens
MNGQKGDQG

SEQ ID NO: 692405 - protein, 9 aa, Homo Sapiens
QNQQAFKQS

SEQ ID NO: 692406 - protein, 9 aa, Homo Sapiens
RKFERKLML

SEQ ID NO: 692407 - protein, 9 aa, Homo Sapiens
VQFKLNKDT

SEQ ID NO: 692408 - protein, 9 aa, Homo Sapiens
GTVSLSPCI

SEQ ID NO: 692409 - protein, 9 aa, Homo Sapiens
ITIVMKAQT

SEQ ID NO: 692410 - protein, 9 aa, Homo Sapiens
LHNTGALKL

SEQ ID NO: 692411 - protein, 9 aa, Homo Sapiens
LGDAGLSLE

SEQ ID NO: 692412 - protein, 9 aa, Homo Sapiens
HMTVRDLMR

SEQ ID NO: 692413 - protein, 9 aa, Homo Sapiens
ATETALTFL

SEQ ID NO: 692414 - protein, 9 aa, Homo Sapiens
TPLWVTQPH

SEQ ID NO: 692415 - protein, 9 aa, Homo Sapiens
QKEAKFKAM

SEQ ID NO: 692416 - protein, 9 aa, Homo Sapiens
KEDLKFDLG

SEQ ID NO: 692417 - protein, 9 aa, Homo Sapiens
LSPPRGKAS

SEQ ID NO: 692418 - protein, 9 aa, Homo Sapiens
ANPLQRNEI

SEQ ID NO: 692419 - protein, 9 aa, Homo Sapiens
DVEESLQCS

SEQ ID NO: 692420 - protein, 9 aa, Homo Sapiens
AISNFLVAI

SEQ ID NO: 692421 - protein, 9 aa, Homo Sapiens
QQDRDDMAD

SEQ ID NO: 692422 - protein, 9 aa, Homo Sapiens
CRMQLVPEI

SEQ ID NO: 692423 - protein, 9 aa, Homo Sapiens
GPSIGIKHY

SEQ ID NO: 692424 - protein, 9 aa, Homo Sapiens
KCRKGDEDS

SEQ ID NO: 692425 - protein, 9 aa, Homo Sapiens
HILQQRFRK

SEQ ID NO: 692426 - protein, 9 aa, Homo Sapiens
TSTISKMLG

SEQ ID NO: 692427 - protein, 9 aa, Homo Sapiens
DETVEEYKD

SEQ ID NO: 692428 - protein, 9 aa, Homo Sapiens
QNRMHFNSN

SEQ ID NO: 692429 - protein, 9 aa, Homo Sapiens
VQLQGFNTR

SEQ ID NO: 692430 - protein, 9 aa, Homo Sapiens
VEMELPVDK

SEQ ID NO: 692431 - protein, 9 aa, Homo Sapiens
KRYSPLTVP

SEQ ID NO: 692432 - protein, 9 aa, Homo Sapiens
TGHFKPLEN

SEQ ID NO: 692433 - protein, 9 aa, Homo Sapiens
ATFIYQSSV

SEQ ID NO: 692434 - protein, 9 aa, Homo Sapiens
AVTPPSGTS

SEQ ID NO: 692435 - protein, 9 aa, Homo Sapiens
GIFEWLCDW

SEQ ID NO: 692436 - protein, 9 aa, Homo Sapiens
PGLNCCGQR

SEQ ID NO: 692437 - protein, 9 aa, Homo Sapiens
GHCALEFKY

SEQ ID NO: 692438 - protein, 9 aa, Homo Sapiens
APYSLVAVI

SEQ ID NO: 692439 - protein, 9 aa, Homo Sapiens
FLHIASDCP

SEQ ID NO: 692440 - protein, 9 aa, Homo Sapiens
GVQPAPFLQ

SEQ ID NO: 692441 - protein, 9 aa, Homo Sapiens
LNSDAVLTL

SEQ ID NO: 692442 - protein, 9 aa, Homo Sapiens
SLFGGAPGH

SEQ ID NO: 692443 - protein, 9 aa, Homo Sapiens
VQALKNQAT

SEQ ID NO: 692444 - protein, 9 aa, Homo Sapiens
NKGDAPYSL

SEQ ID NO: 692445 - protein, 9 aa, Homo Sapiens
TRFLLYTNQ

SEQ ID NO: 692446 - protein, 9 aa, Homo Sapiens
QACRCLILD

SEQ ID NO: 692447 - protein, 9 aa, Homo Sapiens
SFHRHIITV

SEQ ID NO: 692448 - protein, 9 aa, Homo Sapiens
LWECEHREW

SEQ ID NO: 692449 - protein, 9 aa, Homo Sapiens
GGREPPKDP

SEQ ID NO: 692450 - protein, 9 aa, Homo Sapiens
GNFKFHVDD

SEQ ID NO: 692451 - protein, 9 aa, Homo Sapiens
SYDKSIEWL

SEQ ID NO: 692452 - protein, 9 aa, Homo Sapiens
TAFGSPEVA

SEQ ID NO: 692453 - protein, 9 aa, Homo Sapiens
RRKDLVLKC

SEQ ID NO: 692454 - protein, 9 aa, Homo Sapiens
IAKLVHFSQ

SEQ ID NO: 692455 - protein, 9 aa, Homo Sapiens
IFELDLCDP

SEQ ID NO: 692456 - protein, 9 aa, Homo Sapiens
IFCYRIFSN

SEQ ID NO: 692457 - protein, 9 aa, Homo Sapiens
PMSNYIMLA

SEQ ID NO: 692458 - protein, 9 aa, Homo Sapiens
LNPFINTLR

SEQ ID NO: 692459 - protein, 9 aa, Homo Sapiens
GTVGGLFQV

SEQ ID NO: 692460 - protein, 9 aa, Homo Sapiens
FELMNQGIL

SEQ ID NO: 692461 - protein, 9 aa, Homo Sapiens
FNISFMKSN

SEQ ID NO: 692462 - protein, 9 aa, Homo Sapiens
SFTLYLVVA

SEQ ID NO: 692463 - protein, 9 aa, Homo Sapiens
IFGNFLYII

SEQ ID NO: 692464 - protein, 9 aa, Homo Sapiens
HQASVARLV

SEQ ID NO: 692465 - protein, 9 aa, Homo Sapiens
LANDKITHT

SEQ ID NO: 692466 - protein, 9 aa, Homo Sapiens
QDSNITHCH

SEQ ID NO: 692467 - protein, 9 aa, Homo Sapiens
HGLHQALLS

SEQ ID NO: 692468 - protein, 9 aa, Homo Sapiens
ESYKSMTVE

SEQ ID NO: 692469 - protein, 9 aa, Homo Sapiens
TGRAGNKEK

SEQ ID NO: 692470 - protein, 9 aa, Homo Sapiens
MYKRKVEQA

SEQ ID NO: 692471 - protein, 9 aa, Homo Sapiens
IHNLVEYLR

SEQ ID NO: 692472 - protein, 9 aa, Homo Sapiens
NSALYTTKE

SEQ ID NO: 692473 - protein, 9 aa, Homo Sapiens
LLVAFTTFQ

SEQ ID NO: 692474 - protein, 9 aa, Homo Sapiens
LVLSTDLEP

SEQ ID NO: 692475 - protein, 9 aa, Homo Sapiens
TIHNLVEYL

SEQ ID NO: 692476 - protein, 9 aa, Homo Sapiens
GGGRMATER

SEQ ID NO: 692477 - protein, 9 aa, Homo Sapiens
EKAKQKTVE

SEQ ID NO: 692478 - protein, 9 aa, Homo Sapiens
LAISNFLVA

SEQ ID NO: 692479 - protein, 9 aa, Homo Sapiens
MEVWHGGRW

SEQ ID NO: 692480 - protein, 9 aa, Homo Sapiens
KTPVDDPIS

SEQ ID NO: 692481 - protein, 9 aa, Homo Sapiens
GQRLASKPQ

SEQ ID NO: 692482 - protein, 9 aa, Homo Sapiens
YEIVPRVLL

SEQ ID NO: 692483 - protein, 9 aa, Homo Sapiens
LSYVLSGNG

SEQ ID NO: 692484 - protein, 9 aa, Homo Sapiens
YTVKILRFN

SEQ ID NO: 692485 - protein, 9 aa, Homo Sapiens
LMGFYSGIF

SEQ ID NO: 692486 - protein, 9 aa, Homo Sapiens
FVSSPKEVM

SEQ ID NO: 692487 - protein, 9 aa, Homo Sapiens
PCGHLVCAK

SEQ ID NO: 692488 - protein, 9 aa, Homo Sapiens
SGTPRKGVD

SEQ ID NO: 692489 - protein, 9 aa, Homo Sapiens
KPKPSQLQG

SEQ ID NO: 692490 - protein, 9 aa, Homo Sapiens
CYGQCHSFY

SEQ ID NO: 692491 - protein, 9 aa, Homo Sapiens
DVIDSSQQK

SEQ ID NO: 692492 - protein, 9 aa, Homo Sapiens
ILRQHIAKA

SEQ ID NO: 692493 - protein, 9 aa, Homo Sapiens
ILNKWTLTP

SEQ ID NO: 692494 - protein, 9 aa, Homo Sapiens
SQLQGKKEE

SEQ ID NO: 692495 - protein, 9 aa, Homo Sapiens
NAIPIQAAK

SEQ ID NO: 692496 - protein, 9 aa, Homo Sapiens
SPARFCVLG

SEQ ID NO: 692497 - protein, 9 aa, Homo Sapiens
GIEIYEESQ

SEQ ID NO: 692498 - protein, 9 aa, Homo Sapiens
GHRTLDHFF

SEQ ID NO: 692499 - protein, 9 aa, Homo Sapiens
PKIQQLSNM

SEQ ID NO: 692500 - protein, 9 aa, Homo Sapiens
EIQGIRVTS

SEQ ID NO: 692501 - protein, 9 aa, Homo Sapiens
EPGLLPVVT

SEQ ID NO: 692502 - protein, 9 aa, Homo Sapiens
LHLAEMAQS

SEQ ID NO: 692503 - protein, 9 aa, Homo Sapiens
GLHLGSGRI

SEQ ID NO: 692504 - protein, 9 aa, Homo Sapiens
LWGGEGWTQ

SEQ ID NO: 692505 - protein, 9 aa, Homo Sapiens
PVLVHEINL

SEQ ID NO: 692506 - protein, 9 aa, Homo Sapiens
VAQDHMEVT

SEQ ID NO: 692507 - protein, 9 aa, Homo Sapiens
RIVDELYLE

SEQ ID NO: 692508 - protein, 9 aa, Homo Sapiens
DLSEVAEVF

SEQ ID NO: 692509 - protein, 9 aa, Homo Sapiens
ENFWTIWSR

SEQ ID NO: 692510 - protein, 9 aa, Homo Sapiens
NQEGKSNGK

SEQ ID NO: 692511 - protein, 9 aa, Homo Sapiens
TDLLRYAKL

SEQ ID NO: 692512 - protein, 9 aa, Homo Sapiens
EHIGPDPQY

SEQ ID NO: 692513 - protein, 9 aa, Homo Sapiens
QRISLCLDI

SEQ ID NO: 692514 - protein, 9 aa, Homo Sapiens
NPPLVLSSH

SEQ ID NO: 692515 - protein, 9 aa, Homo Sapiens
IYCDTITLS

SEQ ID NO: 692516 - protein, 9 aa, Homo Sapiens
LQVDMTFDV

SEQ ID NO: 692517 - protein, 9 aa, Homo Sapiens
SPTPPVVCS

SEQ ID NO: 692518 - protein, 9 aa, Homo Sapiens
DVEGYYPGQ

SEQ ID NO: 692519 - protein, 9 aa, Homo Sapiens
ITPYVRFIA

SEQ ID NO: 692520 - protein, 9 aa, Homo Sapiens
AFELMNQGI

SEQ ID NO: 692521 - protein, 9 aa, Homo Sapiens
RSPAGSAEL

SEQ ID NO: 692522 - protein, 9 aa, Homo Sapiens
PKFKRHYVN

SEQ ID NO: 692523 - protein, 9 aa, Homo Sapiens
FGTVGGLFQ

SEQ ID NO: 692524 - protein, 9 aa, Homo Sapiens
QKYYQRLND

SEQ ID NO: 692525 - protein, 9 aa, Homo Sapiens
IDLSYVLSG

SEQ ID NO: 692526 - protein, 9 aa, Homo Sapiens
HSQERISPQ

SEQ ID NO: 692527 - protein, 9 aa, Homo Sapiens
TTYEALPCL

SEQ ID NO: 692528 - protein, 9 aa, Homo Sapiens
VEEYKDENT

SEQ ID NO: 692529 - protein, 9 aa, Homo Sapiens
METRPAGDG

SEQ ID NO: 692530 - protein, 9 aa, Homo Sapiens
KCPRDRVDF

SEQ ID NO: 692531 - protein, 9 aa, Homo Sapiens
NNTFYTTKR

SEQ ID NO: 692532 - protein, 9 aa, Homo Sapiens
VPAHKANPF

SEQ ID NO: 692533 - protein, 9 aa, Homo Sapiens
YHAAVIPDG

SEQ ID NO: 692534 - protein, 9 aa, Homo Sapiens
HLQLAIRNH

SEQ ID NO: 692535 - protein, 9 aa, Homo Sapiens
GSNTPGARQ

SEQ ID NO: 692536 - protein, 9 aa, Homo Sapiens
SEYDQVLLE

SEQ ID NO: 692537 - protein, 9 aa, Homo Sapiens
VFRKWPEFQ

SEQ ID NO: 692538 - protein, 9 aa, Homo Sapiens
QRFARILLG

SEQ ID NO: 692539 - protein, 9 aa, Homo Sapiens
PDTELSPSG

SEQ ID NO: 692540 - protein, 9 aa, Homo Sapiens
STSTISKML

SEQ ID NO: 692541 - protein, 9 aa, Homo Sapiens
LEPPGPYRL

SEQ ID NO: 692542 - protein, 9 aa, Homo Sapiens
RISYPILHE

SEQ ID NO: 692543 - protein, 9 aa, Homo Sapiens
SATCKDEMG

SEQ ID NO: 692544 - protein, 9 aa, Homo Sapiens
EKFHFVLQY

SEQ ID NO: 692545 - protein, 9 aa, Homo Sapiens
MLFQSMATF

SEQ ID NO: 692546 - protein, 9 aa, Homo Sapiens
KKRALIGYD

SEQ ID NO: 692547 - protein, 9 aa, Homo Sapiens
SDQVIGAVT

SEQ ID NO: 692548 - protein, 9 aa, Homo Sapiens
AVIADAEQY

SEQ ID NO: 692549 - protein, 9 aa, Homo Sapiens
SEMGLHFFP

SEQ ID NO: 692550 - protein, 9 aa, Homo Sapiens
FQTGTSFLH

SEQ ID NO: 692551 - protein, 9 aa, Homo Sapiens
GDGNFKFHV

SEQ ID NO: 692552 - protein, 9 aa, Homo Sapiens
SYFREQGKA

SEQ ID NO: 692553 - protein, 9 aa, Homo Sapiens
FQAVQEAFE

SEQ ID NO: 692554 - protein, 9 aa, Homo Sapiens
HRTLDHFFC

SEQ ID NO: 692555 - protein, 9 aa, Homo Sapiens
LCHDTTWPE

SEQ ID NO: 692556 - protein, 9 aa, Homo Sapiens
TIQILFVGF

SEQ ID NO: 692557 - protein, 9 aa, Homo Sapiens
IGLLPDVGG

SEQ ID NO: 692558 - protein, 9 aa, Homo Sapiens
TNLEPGVLM

SEQ ID NO: 692559 - protein, 9 aa, Homo Sapiens
VARLARRVL

SEQ ID NO: 692560 - protein, 9 aa, Homo Sapiens
QFRYLKEKF

SEQ ID NO: 692561 - protein, 9 aa, Homo Sapiens
DLSISHKNT

SEQ ID NO: 692562 - protein, 9 aa, Homo Sapiens
TAVFVHAGP

SEQ ID NO: 692563 - protein, 9 aa, Homo Sapiens
TETALTFLV

SEQ ID NO: 692564 - protein, 9 aa, Homo Sapiens
KEKAKQKTV

SEQ ID NO: 692565 - protein, 9 aa, Homo Sapiens
SRARGCKRK

SEQ ID NO: 692566 - protein, 9 aa, Homo Sapiens
VVEAVSSPS

SEQ ID NO: 692567 - protein, 9 aa, Homo Sapiens
GPPCPAGGP

SEQ ID NO: 692568 - protein, 9 aa, Homo Sapiens
QSNFGSKSQ

SEQ ID NO: 692569 - protein, 9 aa, Homo Sapiens
TKDKTPSVS

SEQ ID NO: 692570 - protein, 9 aa, Homo Sapiens
LPHRNACAA

SEQ ID NO: 692571 - protein, 9 aa, Homo Sapiens
NTLQQLRQD

SEQ ID NO: 692572 - protein, 9 aa, Homo Sapiens
KKEQKTVLL

SEQ ID NO: 692573 - protein, 9 aa, Homo Sapiens
QHIAKAEAE

SEQ ID NO: 692574 - protein, 9 aa, Homo Sapiens
KFMFKVIGA

SEQ ID NO: 692575 - protein, 9 aa, Homo Sapiens
LSGCSMLAI

SEQ ID NO: 692576 - protein, 9 aa, Homo Sapiens
WEEIYSKFT

SEQ ID NO: 692577 - protein, 9 aa, Homo Sapiens
TPGGVFVNL

SEQ ID NO: 692578 - protein, 9 aa, Homo Sapiens
KHDSIDDTL

SEQ ID NO: 692579 - protein, 9 aa, Homo Sapiens
YGLTYSYDK

SEQ ID NO: 692580 - protein, 9 aa, Homo Sapiens
PGIFALYKK

SEQ ID NO: 692581 - protein, 9 aa, Homo Sapiens
GWGFPLVIC

SEQ ID NO: 692582 - protein, 9 aa, Homo Sapiens
NDSSFTLYL

SEQ ID NO: 692583 - protein, 9 aa, Homo Sapiens
TSRGSSLQA

SEQ ID NO: 692584 - protein, 9 aa, Homo Sapiens
HSIRRPDVL

SEQ ID NO: 692585 - protein, 9 aa, Homo Sapiens
LELCPRGSS

SEQ ID NO: 692586 - protein, 9 aa, Homo Sapiens
AGALAPAQI

SEQ ID NO: 692587 - protein, 9 aa, Homo Sapiens
LGSGRIPRA

SEQ ID NO: 692588 - protein, 9 aa, Homo Sapiens
GHLDMSQGT

SEQ ID NO: 692589 - protein, 9 aa, Homo Sapiens
VFSPDTELS

SEQ ID NO: 692590 - protein, 9 aa, Homo Sapiens
PGLLPVVTG

SEQ ID NO: 692591 - protein, 9 aa, Homo Sapiens
VPVPLPPCT

SEQ ID NO: 692592 - protein, 9 aa, Homo Sapiens
KSAILNKWT

SEQ ID NO: 692593 - protein, 9 aa, Homo Sapiens
NPRMRKLQV

SEQ ID NO: 692594 - protein, 9 aa, Homo Sapiens
FEKHKDDDE

SEQ ID NO: 692595 - protein, 9 aa, Homo Sapiens
INPGNYRYF

SEQ ID NO: 692596 - protein, 9 aa, Homo Sapiens
YKDENTLFD

SEQ ID NO: 692597 - protein, 9 aa, Homo Sapiens
RNPAMMQDM

SEQ ID NO: 692598 - protein, 9 aa, Homo Sapiens
YLVDVRQVQ

SEQ ID NO: 692599 - protein, 9 aa, Homo Sapiens
KVEMELPVD

SEQ ID NO: 692600 - protein, 9 aa, Homo Sapiens
NVKFYSPDP

SEQ ID NO: 692601 - protein, 9 aa, Homo Sapiens
MVVSARPLS

SEQ ID NO: 692602 - protein, 9 aa, Homo Sapiens
PGVAGYLIA

SEQ ID NO: 692603 - protein, 9 aa, Homo Sapiens
TIKAQSNDG

SEQ ID NO: 692604 - protein, 9 aa, Homo Sapiens
LLLGLAPGQ

SEQ ID NO: 692605 - protein, 9 aa, Homo Sapiens
RKWPEFQEF

SEQ ID NO: 692606 - protein, 9 aa, Homo Sapiens
CENQEAQNQ

SEQ ID NO: 692607 - protein, 9 aa, Homo Sapiens
RQQSTLESE

SEQ ID NO: 692608 - protein, 9 aa, Homo Sapiens
PRGKASGQG

SEQ ID NO: 692609 - protein, 9 aa, Homo Sapiens
ATVRIHGVN

SEQ ID NO: 692610 - protein, 9 aa, Homo Sapiens
ACTSYDYCR

SEQ ID NO: 692611 - protein, 9 aa, Homo Sapiens
SACEFYMCD

SEQ ID NO: 692612 - protein, 9 aa, Homo Sapiens
IDFNKEKKI

SEQ ID NO: 692613 - protein, 9 aa, Homo Sapiens
GTGPAPELA

SEQ ID NO: 692614 - protein, 9 aa, Homo Sapiens
EVGSVGRKG

SEQ ID NO: 692615 - protein, 9 aa, Homo Sapiens
YLLRHKRTH

SEQ ID NO: 692616 - protein, 9 aa, Homo Sapiens
HPRLGPQPA

SEQ ID NO: 692617 - protein, 9 aa, Homo Sapiens
EENQVFPQG

SEQ ID NO: 692618 - protein, 9 aa, Homo Sapiens
GVSENARMF

SEQ ID NO: 692619 - protein, 9 aa, Homo Sapiens
TKQTPKKPP

SEQ ID NO: 692620 - protein, 9 aa, Homo Sapiens
EVTAVRRQV

SEQ ID NO: 692621 - protein, 9 aa, Homo Sapiens
MHKYKHRVH

SEQ ID NO: 692622 - protein, 9 aa, Homo Sapiens
TPLWVPNNG

SEQ ID NO: 692623 - protein, 9 aa, Homo Sapiens
DSLWEENET

SEQ ID NO: 692624 - protein, 9 aa, Homo Sapiens
PPPEEEDDQ

SEQ ID NO: 692625 - protein, 9 aa, Homo Sapiens
LTSFPDLNA

SEQ ID NO: 692626 - protein, 9 aa, Homo Sapiens
CIWRIPWQG

SEQ ID NO: 692627 - protein, 9 aa, Homo Sapiens
CYRVTKGRG

SEQ ID NO: 692628 - protein, 9 aa, Homo Sapiens
SAATLHMTV

SEQ ID NO: 692629 - protein, 9 aa, Homo Sapiens
VLVLTPAVC

SEQ ID NO: 692630 - protein, 9 aa, Homo Sapiens
TPRDPELVG

SEQ ID NO: 692631 - protein, 9 aa, Homo Sapiens
GGGPATVPS

SEQ ID NO: 692632 - protein, 9 aa, Homo Sapiens
FRRERLTVH

SEQ ID NO: 692633 - protein, 9 aa, Homo Sapiens
IAGAVRDHE

SEQ ID NO: 692634 - protein, 9 aa, Homo Sapiens
RCHELFFTF

SEQ ID NO: 692635 - protein, 9 aa, Homo Sapiens
SPVPKSRLR

SEQ ID NO: 692636 - protein, 9 aa, Homo Sapiens
SVQGCLLSW

SEQ ID NO: 692637 - protein, 9 aa, Homo Sapiens
PNSEVIYVW

SEQ ID NO: 692638 - protein, 9 aa, Homo Sapiens
HFKPLENKF

SEQ ID NO: 692639 - protein, 9 aa, Homo Sapiens
SGEDLHSTA

SEQ ID NO: 692640 - protein, 9 aa, Homo Sapiens
QLLLPVLQI

SEQ ID NO: 692641 - protein, 9 aa, Homo Sapiens
AGQRLASKP

SEQ ID NO: 692642 - protein, 9 aa, Homo Sapiens
GTPRKGVDY

SEQ ID NO: 692643 - protein, 9 aa, Homo Sapiens
ADDNMKTPA

SEQ ID NO: 692644 - protein, 9 aa, Homo Sapiens
ERVSGLAGC

SEQ ID NO: 692645 - protein, 9 aa, Homo Sapiens
HRSDKLGRV

SEQ ID NO: 692646 - protein, 9 aa, Homo Sapiens
QSNDGYHII

SEQ ID NO: 692647 - protein, 9 aa, Homo Sapiens
GNRSQPISC

SEQ ID NO: 692648 - protein, 9 aa, Homo Sapiens
PVDLNVSEI

SEQ ID NO: 692649 - protein, 9 aa, Homo Sapiens
RNFPSAKCL

SEQ ID NO: 692650 - protein, 9 aa, Homo Sapiens
SIYAVFESA

SEQ ID NO: 692651 - protein, 9 aa, Homo Sapiens
QPFLVRPLF

SEQ ID NO: 692652 - protein, 9 aa, Homo Sapiens
EDVDKCQLQ

SEQ ID NO: 692653 - protein, 9 aa, Homo Sapiens
LSQKVSEKE

SEQ ID NO: 692654 - protein, 9 aa, Homo Sapiens
ARSPEDKYE

SEQ ID NO: 692655 - protein, 9 aa, Homo Sapiens
QGRRRSKSR

SEQ ID NO: 692656 - protein, 9 aa, Homo Sapiens
GLIDGSFKI

SEQ ID NO: 692657 - protein, 9 aa, Homo Sapiens
DFCLAFIVK

SEQ ID NO: 692658 - protein, 9 aa, Homo Sapiens
RGKLISSLH

SEQ ID NO: 692659 - protein, 9 aa, Homo Sapiens
RRTEQNPGS

SEQ ID NO: 692660 - protein, 9 aa, Homo Sapiens
KTSETAGEG

SEQ ID NO: 692661 - protein, 9 aa, Homo Sapiens
RQDPSGVIL

SEQ ID NO: 692662 - protein, 9 aa, Homo Sapiens
ALSSMPSPG

SEQ ID NO: 692663 - protein, 9 aa, Homo Sapiens
LPHSYHTPD

SEQ ID NO: 692664 - protein, 9 aa, Homo Sapiens
LSGRDAAHL

SEQ ID NO: 692665 - protein, 9 aa, Homo Sapiens
MVSRMVCTM

SEQ ID NO: 692666 - protein, 9 aa, Homo Sapiens
CNCSGIQCN

SEQ ID NO: 692667 - protein, 9 aa, Homo Sapiens
GDDYLEDEG

SEQ ID NO: 692668 - protein, 9 aa, Homo Sapiens
QDKEGIPPT

SEQ ID NO: 692669 - protein, 9 aa, Homo Sapiens
FENFLEDSQ

SEQ ID NO: 692670 - protein, 9 aa, Homo Sapiens
KPEDSWELI

SEQ ID NO: 692671 - protein, 9 aa, Homo Sapiens
FRYLKEKFL

SEQ ID NO: 692672 - protein, 9 aa, Homo Sapiens
YRNCREEDL

SEQ ID NO: 692673 - protein, 9 aa, Homo Sapiens
DVGYVENGT

SEQ ID NO: 692674 - protein, 9 aa, Homo Sapiens
FYTFKKQRD

SEQ ID NO: 692675 - protein, 9 aa, Homo Sapiens
KTAANRRNV

SEQ ID NO: 692676 - protein, 9 aa, Homo Sapiens
PFQAVQEAF

SEQ ID NO: 692677 - protein, 9 aa, Homo Sapiens
IQIIFINIE

SEQ ID NO: 692678 - protein, 9 aa, Homo Sapiens
FAGSSSCGG

SEQ ID NO: 692679 - protein, 9 aa, Homo Sapiens
TAGEGENSG

SEQ ID NO: 692680 - protein, 9 aa, Homo Sapiens
SWLAEMTST

SEQ ID NO: 692681 - protein, 9 aa, Homo Sapiens
KAIESYVLG

SEQ ID NO: 692682 - protein, 9 aa, Homo Sapiens
YKVPDEHFS

SEQ ID NO: 692683 - protein, 9 aa, Homo Sapiens
GRLDFSLMG

SEQ ID NO: 692684 - protein, 9 aa, Homo Sapiens
MGKQEMETG

SEQ ID NO: 692685 - protein, 9 aa, Homo Sapiens
KCLGIELHA

SEQ ID NO: 692686 - protein, 9 aa, Homo Sapiens
TEKGIFESC

SEQ ID NO: 692687 - protein, 9 aa, Homo Sapiens
ASMRERRRL

SEQ ID NO: 692688 - protein, 9 aa, Homo Sapiens
AILDELKVA

SEQ ID NO: 692689 - protein, 9 aa, Homo Sapiens
LMSVRLRKA

SEQ ID NO: 692690 - protein, 9 aa, Homo Sapiens
PSQLQGKKE

SEQ ID NO: 692691 - protein, 9 aa, Homo Sapiens
PEVAGALLR

SEQ ID NO: 692692 - protein, 9 aa, Homo Sapiens
CGKGLRRSS

SEQ ID NO: 692693 - protein, 9 aa, Homo Sapiens
HASLCCTGS

SEQ ID NO: 692694 - protein, 9 aa, Homo Sapiens
LLPVVTGIR

SEQ ID NO: 692695 - protein, 9 aa, Homo Sapiens
GKIPRKDLI

SEQ ID NO: 692696 - protein, 9 aa, Homo Sapiens
CPLCKAKSL

SEQ ID NO: 692697 - protein, 9 aa, Homo Sapiens
NSFLLDRLL

SEQ ID NO: 692698 - protein, 9 aa, Homo Sapiens
HAQLLKPRC

SEQ ID NO: 692699 - protein, 9 aa, Homo Sapiens
EATETALTF

SEQ ID NO: 692700 - protein, 9 aa, Homo Sapiens
TERRGKNVV

SEQ ID NO: 692701 - protein, 9 aa, Homo Sapiens
EIYRCYGWY

SEQ ID NO: 692702 - protein, 9 aa, Homo Sapiens
ALVKYNQQN

SEQ ID NO: 692703 - protein, 9 aa, Homo Sapiens
LPVLQISLI

SEQ ID NO: 692704 - protein, 9 aa, Homo Sapiens
HTDDSLTGS

SEQ ID NO: 692705 - protein, 9 aa, Homo Sapiens
CDQQSTCYN

SEQ ID NO: 692706 - protein, 9 aa, Homo Sapiens
GLLLLVVLT

SEQ ID NO: 692707 - protein, 9 aa, Homo Sapiens
LLQPTSTWS

SEQ ID NO: 692708 - protein, 9 aa, Homo Sapiens
ERLTVHRTH

SEQ ID NO: 692709 - protein, 9 aa, Homo Sapiens
KVDMGSMNG

SEQ ID NO: 692710 - protein, 9 aa, Homo Sapiens
QKCAMKTLA

SEQ ID NO: 692711 - protein, 9 aa, Homo Sapiens
TLVVVSWEE

SEQ ID NO: 692712 - protein, 9 aa, Homo Sapiens
TPSSLRSCW

SEQ ID NO: 692713 - protein, 9 aa, Homo Sapiens
HGFGDTAKS

SEQ ID NO: 692714 - protein, 9 aa, Homo Sapiens
TPPVVCSTP

SEQ ID NO: 692715 - protein, 9 aa, Homo Sapiens
RVLREALQP

SEQ ID NO: 692716 - protein, 9 aa, Homo Sapiens
LRQNNNPDW

SEQ ID NO: 692717 - protein, 9 aa, Homo Sapiens
DKHDSIDDT

SEQ ID NO: 692718 - protein, 9 aa, Homo Sapiens
SLSKSKAGS

SEQ ID NO: 692719 - protein, 9 aa, Homo Sapiens
SISATAVVS

SEQ ID NO: 692720 - protein, 9 aa, Homo Sapiens
PVPVPLPPC

SEQ ID NO: 692721 - protein, 9 aa, Homo Sapiens
AHLPDCAPA

SEQ ID NO: 692722 - protein, 9 aa, Homo Sapiens
GTSFLHVYD

SEQ ID NO: 692723 - protein, 9 aa, Homo Sapiens
ENRLKKMKE

SEQ ID NO: 692724 - protein, 9 aa, Homo Sapiens
TEMKALGDR

SEQ ID NO: 692725 - protein, 9 aa, Homo Sapiens
ITLSKISCT

SEQ ID NO: 692726 - protein, 9 aa, Homo Sapiens
LDSPGGLAV

SEQ ID NO: 692727 - protein, 9 aa, Homo Sapiens
KECSRALLN

SEQ ID NO: 692728 - protein, 9 aa, Homo Sapiens
VPKNFFFFF

SEQ ID NO: 692729 - protein, 9 aa, Homo Sapiens
LVIKLDKDL

SEQ ID NO: 692730 - protein, 9 aa, Homo Sapiens
VRQREKECS

SEQ ID NO: 692731 - protein, 9 aa, Homo Sapiens
SSMPSPGGR

SEQ ID NO: 692732 - protein, 9 aa, Homo Sapiens
FLGMKVQGD

SEQ ID NO: 692733 - protein, 9 aa, Homo Sapiens
AQISGLVLE

SEQ ID NO: 692734 - protein, 9 aa, Homo Sapiens
NPLFTALGQ

SEQ ID NO: 692735 - protein, 9 aa, Homo Sapiens
SNLNEQMVT

SEQ ID NO: 692736 - protein, 9 aa, Homo Sapiens
GMLFQSMAT

SEQ ID NO: 692737 - protein, 9 aa, Homo Sapiens
PPLQQEYPG

SEQ ID NO: 692738 - protein, 9 aa, Homo Sapiens
KFTASFTSV

SEQ ID NO: 692739 - protein, 9 aa, Homo Sapiens
YQFTVCARG

SEQ ID NO: 692740 - protein, 9 aa, Homo Sapiens
GVTHLIRSC

SEQ ID NO: 692741 - protein, 9 aa, Homo Sapiens
LSVHDAMLF

SEQ ID NO: 692742 - protein, 9 aa, Homo Sapiens
VSETSSAGA

SEQ ID NO: 692743 - protein, 9 aa, Homo Sapiens
VFHNPINRQ

SEQ ID NO: 692744 - protein, 9 aa, Homo Sapiens
QTRRSVSSD

SEQ ID NO: 692745 - protein, 9 aa, Homo Sapiens
SNHYSFSTN

SEQ ID NO: 692746 - protein, 9 aa, Homo Sapiens
DSCVSPVSE

SEQ ID NO: 692747 - protein, 9 aa, Homo Sapiens
YVCALQFYF

SEQ ID NO: 692748 - protein, 9 aa, Homo Sapiens
MKQAPEATS

SEQ ID NO: 692749 - protein, 9 aa, Homo Sapiens
MGSCRVGKK

SEQ ID NO: 692750 - protein, 9 aa, Homo Sapiens
VDGHCALEF

SEQ ID NO: 692751 - protein, 9 aa, Homo Sapiens
LAASFHQPT

SEQ ID NO: 692752 - protein, 9 aa, Homo Sapiens
HTDASESIR

SEQ ID NO: 692753 - protein, 9 aa, Homo Sapiens
KNQATGQGI

SEQ ID NO: 692754 - protein, 9 aa, Homo Sapiens
LIRGIYSSS

SEQ ID NO: 692755 - protein, 9 aa, Homo Sapiens
FRQYHGTWL

SEQ ID NO: 692756 - protein, 9 aa, Homo Sapiens
SLREDRRED

SEQ ID NO: 692757 - protein, 9 aa, Homo Sapiens
TKRALAKVA

SEQ ID NO: 692758 - protein, 9 aa, Homo Sapiens
PVYEIQGVI

SEQ ID NO: 692759 - protein, 9 aa, Homo Sapiens
DQMNPECNF

SEQ ID NO: 692760 - protein, 9 aa, Homo Sapiens
VSLSPCIWV

SEQ ID NO: 692761 - protein, 9 aa, Homo Sapiens
STGIPAQTV

SEQ ID NO: 692762 - protein, 9 aa, Homo Sapiens
AGRPTPETL

SEQ ID NO: 692763 - protein, 9 aa, Homo Sapiens
LLKEVKAFE

SEQ ID NO: 692764 - protein, 9 aa, Homo Sapiens
GGGSSRIDN

SEQ ID NO: 692765 - protein, 9 aa, Homo Sapiens
SFEPLCRKS

SEQ ID NO: 692766 - protein, 9 aa, Homo Sapiens
TTYLYTLGA

SEQ ID NO: 692767 - protein, 9 aa, Homo Sapiens
KDKADKTEN

SEQ ID NO: 692768 - protein, 9 aa, Homo Sapiens
PHVSSIIQK

SEQ ID NO: 692769 - protein, 9 aa, Homo Sapiens
CRKGDEDSL

SEQ ID NO: 692770 - protein, 9 aa, Homo Sapiens
PGDQMNPEC

SEQ ID NO: 692771 - protein, 9 aa, Homo Sapiens
QLMQFLFVV

SEQ ID NO: 692772 - protein, 9 aa, Homo Sapiens
RGGDDYLED

SEQ ID NO: 692773 - protein, 9 aa, Homo Sapiens
MAERPPSEA

SEQ ID NO: 692774 - protein, 9 aa, Homo Sapiens
VIAEDILGN

SEQ ID NO: 692775 - protein, 9 aa, Homo Sapiens
RAFNVPTCK

SEQ ID NO: 692776 - protein, 9 aa, Homo Sapiens
SHFTCNHRV

SEQ ID NO: 692777 - protein, 9 aa, Homo Sapiens
DMLRWKLFN

SEQ ID NO: 692778 - protein, 9 aa, Homo Sapiens
AAGGAQDES

SEQ ID NO: 692779 - protein, 9 aa, Homo Sapiens
EKKGGPAGR

SEQ ID NO: 692780 - protein, 9 aa, Homo Sapiens
AAQSSRAHI

SEQ ID NO: 692781 - protein, 9 aa, Homo Sapiens
KMNLSDFIS

SEQ ID NO: 692782 - protein, 9 aa, Homo Sapiens
EFRTNKTLH

SEQ ID NO: 692783 - protein, 9 aa, Homo Sapiens
IRSSVHHCS

SEQ ID NO: 692784 - protein, 9 aa, Homo Sapiens
CTNLAALSL

SEQ ID NO: 692785 - protein, 9 aa, Homo Sapiens
SPFQEHTIL

SEQ ID NO: 692786 - protein, 9 aa, Homo Sapiens
PQRFARILL

SEQ ID NO: 692787 - protein, 9 aa, Homo Sapiens
REALQPETE

SEQ ID NO: 692788 - protein, 9 aa, Homo Sapiens
PAQSEAGSL

SEQ ID NO: 692789 - protein, 9 aa, Homo Sapiens
VGALSKAVY

SEQ ID NO: 692790 - protein, 9 aa, Homo Sapiens
GIDVGTFLK

SEQ ID NO: 692791 - protein, 9 aa, Homo Sapiens
CCAECRSRG

SEQ ID NO: 692792 - protein, 9 aa, Homo Sapiens
RMEVWHGGR

SEQ ID NO: 692793 - protein, 9 aa, Homo Sapiens
FMGNKVDET

SEQ ID NO: 692794 - protein, 9 aa, Homo Sapiens
NQENFELVQ

SEQ ID NO: 692795 - protein, 9 aa, Homo Sapiens
CTLEGAYKP

SEQ ID NO: 692796 - protein, 9 aa, Homo Sapiens
MAKTAANRR

SEQ ID NO: 692797 - protein, 9 aa, Homo Sapiens
PGSGEVGSV

SEQ ID NO: 692798 - protein, 9 aa, Homo Sapiens
ISWMYLMGF

SEQ ID NO: 692799 - protein, 9 aa, Homo Sapiens
CGLLLLVVL

SEQ ID NO: 692800 - protein, 9 aa, Homo Sapiens
LTGHSFSTD

SEQ ID NO: 692801 - protein, 9 aa, Homo Sapiens
PAPFLQTQF

SEQ ID NO: 692802 - protein, 9 aa, Homo Sapiens
KLCKLQPGS

SEQ ID NO: 692803 - protein, 9 aa, Homo Sapiens
GAEGGTESK

SEQ ID NO: 692804 - protein, 9 aa, Homo Sapiens
DLLCVANLP

SEQ ID NO: 692805 - protein, 9 aa, Homo Sapiens
MNAMITNTN

SEQ ID NO: 692806 - protein, 9 aa, Homo Sapiens
APHQQNETE

SEQ ID NO: 692807 - protein, 9 aa, Homo Sapiens
FMKSNEENK

SEQ ID NO: 692808 - protein, 9 aa, Homo Sapiens
QMVTPQSLF

SEQ ID NO: 692809 - protein, 9 aa, Homo Sapiens
CRKTVPQEP

SEQ ID NO: 692810 - protein, 9 aa, Homo Sapiens
KEKAGATVR

SEQ ID NO: 692811 - protein, 9 aa, Homo Sapiens
KFHFVLQYL

SEQ ID NO: 692812 - protein, 9 aa, Homo Sapiens
PFPVTREQG

SEQ ID NO: 692813 - protein, 9 aa, Homo Sapiens
LATAKVMVS

SEQ ID NO: 692814 - protein, 9 aa, Homo Sapiens
SGVYSFEPL

SEQ ID NO: 692815 - protein, 9 aa, Homo Sapiens
SPPAAWPAA

SEQ ID NO: 692816 - protein, 9 aa, Homo Sapiens
DYQLHTPMC

SEQ ID NO: 692817 - protein, 9 aa, Homo Sapiens
LFISNVTKE

SEQ ID NO: 692818 - protein, 9 aa, Homo Sapiens
VSKMREQLV

SEQ ID NO: 692819 - protein, 9 aa, Homo Sapiens
GCREHFKNH

SEQ ID NO: 692820 - protein, 9 aa, Homo Sapiens
SVKTHNFSP

SEQ ID NO: 692821 - protein, 9 aa, Homo Sapiens
YGRPKTSNR

SEQ ID NO: 692822 - protein, 9 aa, Homo Sapiens
FQEDILRQH

SEQ ID NO: 692823 - protein, 9 aa, Homo Sapiens
AMAKGCQES

SEQ ID NO: 692824 - protein, 9 aa, Homo Sapiens
LHTMFRVGL

SEQ ID NO: 692825 - protein, 9 aa, Homo Sapiens
PGPPCPAGG

SEQ ID NO: 692826 - protein, 9 aa, Homo Sapiens
NENSTLPQA

SEQ ID NO: 692827 - protein, 9 aa, Homo Sapiens
LYIIGSYTL

SEQ ID NO: 692828 - protein, 9 aa, Homo Sapiens
KIPSEMPCP

SEQ ID NO: 692829 - protein, 9 aa, Homo Sapiens
SHAASFTWK

SEQ ID NO: 692830 - protein, 9 aa, Homo Sapiens
IHGEPTASG

SEQ ID NO: 692831 - protein, 9 aa, Homo Sapiens
LRLQLSRPV

SEQ ID NO: 692832 - protein, 9 aa, Homo Sapiens
FTHIFALVK

SEQ ID NO: 692833 - protein, 9 aa, Homo Sapiens
SQSINITEL

SEQ ID NO: 692834 - protein, 9 aa, Homo Sapiens
GYLIAGTST

SEQ ID NO: 692835 - protein, 9 aa, Homo Sapiens
KALDRASPL

SEQ ID NO: 692836 - protein, 9 aa, Homo Sapiens
DKTENGKSQ

SEQ ID NO: 692837 - protein, 9 aa, Homo Sapiens
NISFMKSNE

SEQ ID NO: 692838 - protein, 9 aa, Homo Sapiens
VLVHEINLL

SEQ ID NO: 692839 - protein, 9 aa, Homo Sapiens
AAWWGKIPR

SEQ ID NO: 692840 - protein, 9 aa, Homo Sapiens
SEYSGFATD

SEQ ID NO: 692841 - protein, 9 aa, Homo Sapiens
YEVASNQAA

SEQ ID NO: 692842 - protein, 9 aa, Homo Sapiens
KHPKKDRPL

SEQ ID NO: 692843 - protein, 9 aa, Homo Sapiens
ATRLFFNWF

SEQ ID NO: 692844 - protein, 9 aa, Homo Sapiens
AASRVWTMS

SEQ ID NO: 692845 - protein, 9 aa, Homo Sapiens
LDSENLNSR

SEQ ID NO: 692846 - protein, 9 aa, Homo Sapiens
MNDIRIIGA

SEQ ID NO: 692847 - protein, 9 aa, Homo Sapiens
FTGAYTSGI

SEQ ID NO: 692848 - protein, 9 aa, Homo Sapiens
MGWGFPLVI

SEQ ID NO: 692849 - protein, 9 aa, Homo Sapiens
GPGSAKPGR

SEQ ID NO: 692850 - protein, 9 aa, Homo Sapiens
LSTAVTDLN

SEQ ID NO: 692851 - protein, 9 aa, Homo Sapiens
DTVQKPYVH

SEQ ID NO: 692852 - protein, 9 aa, Homo Sapiens
EAEQKEAKF

SEQ ID NO: 692853 - protein, 9 aa, Homo Sapiens
MSQERGVQP

SEQ ID NO: 692854 - protein, 9 aa, Homo Sapiens
CQNRMHFNS

SEQ ID NO: 692855 - protein, 9 aa, Homo Sapiens
THNVFYVQQ

SEQ ID NO: 692856 - protein, 9 aa, Homo Sapiens
PNKFQGENT

SEQ ID NO: 692857 - protein, 9 aa, Homo Sapiens
ASTWKMEKG

SEQ ID NO: 692858 - protein, 9 aa, Homo Sapiens
PRPDSIRQQ

SEQ ID NO: 692859 - protein, 9 aa, Homo Sapiens
GPVDLNVSE

SEQ ID NO: 692860 - protein, 9 aa, Homo Sapiens
CYEFRRERL

SEQ ID NO: 692861 - protein, 9 aa, Homo Sapiens
FDINVNFDF

SEQ ID NO: 692862 - protein, 9 aa, Homo Sapiens
NSSTKAEPS

SEQ ID NO: 692863 - protein, 9 aa, Homo Sapiens
QKAIVSKFL

SEQ ID NO: 692864 - protein, 9 aa, Homo Sapiens
DTAKSIPEL

SEQ ID NO: 692865 - protein, 9 aa, Homo Sapiens
ESSPIPQLS

SEQ ID NO: 692866 - protein, 9 aa, Homo Sapiens
MGSRSYHAA

SEQ ID NO: 692867 - protein, 9 aa, Homo Sapiens
YVMIALTVV

SEQ ID NO: 692868 - protein, 9 aa, Homo Sapiens
VCSTTCGLG

SEQ ID NO: 692869 - protein, 9 aa, Homo Sapiens
PSQSVPAHK

SEQ ID NO: 692870 - protein, 9 aa, Homo Sapiens
ASIKTGLQA

SEQ ID NO: 692871 - protein, 9 aa, Homo Sapiens
DRREDMLRL

SEQ ID NO: 692872 - protein, 9 aa, Homo Sapiens
MHPRLGPQP

SEQ ID NO: 692873 - protein, 9 aa, Homo Sapiens
SLREQVIVP

SEQ ID NO: 692874 - protein, 9 aa, Homo Sapiens
MKMLRSMMG

SEQ ID NO: 692875 - protein, 9 aa, Homo Sapiens
SLRTEQSNF

SEQ ID NO: 692876 - protein, 9 aa, Homo Sapiens
NLLSVAYNN

SEQ ID NO: 692877 - protein, 9 aa, Homo Sapiens
VSAPLGIGR

SEQ ID NO: 692878 - protein, 9 aa, Homo Sapiens
DHMEVTWYK

SEQ ID NO: 692879 - protein, 9 aa, Homo Sapiens
DLGRDATRL

SEQ ID NO: 692880 - protein, 9 aa, Homo Sapiens
ELLLVARHY

SEQ ID NO: 692881 - protein, 9 aa, Homo Sapiens
EKLKRETTW

SEQ ID NO: 692882 - protein, 9 aa, Homo Sapiens
LAWRGWDTP

SEQ ID NO: 692883 - protein, 9 aa, Homo Sapiens
LGNLMGSYR

SEQ ID NO: 692884 - protein, 9 aa, Homo Sapiens
FTVCARGDG

SEQ ID NO: 692885 - protein, 9 aa, Homo Sapiens
EVAQDHMEV

SEQ ID NO: 692886 - protein, 9 aa, Homo Sapiens
PPKDPCLRG

SEQ ID NO: 692887 - protein, 9 aa, Homo Sapiens
PRRPKRPGT

SEQ ID NO: 692888 - protein, 9 aa, Homo Sapiens
NWICENQEA

SEQ ID NO: 692889 - protein, 9 aa, Homo Sapiens
MKALGDRVS

SEQ ID NO: 692890 - protein, 9 aa, Homo Sapiens
PKRPGTILT

SEQ ID NO: 692891 - protein, 9 aa, Homo Sapiens
HFHVRFGKL

SEQ ID NO: 692892 - protein, 9 aa, Homo Sapiens
MVCTMLSGL

SEQ ID NO: 692893 - protein, 9 aa, Homo Sapiens
PRDRVDFRA

SEQ ID NO: 692894 - protein, 9 aa, Homo Sapiens
LMRDMCVVC

SEQ ID NO: 692895 - protein, 9 aa, Homo Sapiens
GSVVSGSPC

SEQ ID NO: 692896 - protein, 9 aa, Homo Sapiens
LNCCGQRRA

SEQ ID NO: 692897 - protein, 9 aa, Homo Sapiens
DADTNQQDG

SEQ ID NO: 692898 - protein, 9 aa, Homo Sapiens
KRLHLAEMA

SEQ ID NO: 692899 - protein, 9 aa, Homo Sapiens
TGALKLTTG

SEQ ID NO: 692900 - protein, 9 aa, Homo Sapiens
TGAEGGTES

SEQ ID NO: 692901 - protein, 9 aa, Homo Sapiens
QNSQTRRSV

SEQ ID NO: 692902 - protein, 9 aa, Homo Sapiens
DRATALLEQ

SEQ ID NO: 692903 - protein, 9 aa, Homo Sapiens
ISSSATYEL

SEQ ID NO: 692904 - protein, 9 aa, Homo Sapiens
YPSTEPHPG

SEQ ID NO: 692905 - protein, 9 aa, Homo Sapiens
QERSWPQGL

SEQ ID NO: 692906 - protein, 9 aa, Homo Sapiens
LHKKQELIE

SEQ ID NO: 692907 - protein, 9 aa, Homo Sapiens
DKFVLMRDM

SEQ ID NO: 692908 - protein, 9 aa, Homo Sapiens
AVFRKWPEF

SEQ ID NO: 692909 - protein, 9 aa, Homo Sapiens
IGKTPKIQQ

SEQ ID NO: 692910 - protein, 9 aa, Homo Sapiens
LVSDVMACG

SEQ ID NO: 692911 - protein, 9 aa, Homo Sapiens
SHYQQRFAV

SEQ ID NO: 692912 - protein, 9 aa, Homo Sapiens
FFTPTSLME

SEQ ID NO: 692913 - protein, 9 aa, Homo Sapiens
DMIRSQDRV

SEQ ID NO: 692914 - protein, 9 aa, Homo Sapiens
WSLIRGIYS

SEQ ID NO: 692915 - protein, 9 aa, Homo Sapiens
LFSEYSGFA

SEQ ID NO: 692916 - protein, 9 aa, Homo Sapiens
REDRREDML

SEQ ID NO: 692917 - protein, 9 aa, Homo Sapiens
KDKIVDIDD

SEQ ID NO: 692918 - protein, 9 aa, Homo Sapiens
LNVGYHRWS

SEQ ID NO: 692919 - protein, 9 aa, Homo Sapiens
LKSAEVTLA

SEQ ID NO: 692920 - protein, 9 aa, Homo Sapiens
KEPKVLQDS

SEQ ID NO: 692921 - protein, 9 aa, Homo Sapiens
PAQTVSWSK

SEQ ID NO: 692922 - protein, 9 aa, Homo Sapiens
ILRRILNKE

SEQ ID NO: 692923 - protein, 9 aa, Homo Sapiens
PPAYYRYIE

SEQ ID NO: 692924 - protein, 9 aa, Homo Sapiens
QKMGGFHCM

SEQ ID NO: 692925 - protein, 9 aa, Homo Sapiens
RDEVIYPDS

SEQ ID NO: 692926 - protein, 9 aa, Homo Sapiens
LNNVLFYTT

SEQ ID NO: 692927 - protein, 9 aa, Homo Sapiens
SLMERLAKE

SEQ ID NO: 692928 - protein, 9 aa, Homo Sapiens
QSHLNSDDI

SEQ ID NO: 692929 - protein, 9 aa, Homo Sapiens
FLDSLWEEN

SEQ ID NO: 692930 - protein, 9 aa, Homo Sapiens
LYTCQEWVV

SEQ ID NO: 692931 - protein, 9 aa, Homo Sapiens
CAAAKKKLL

SEQ ID NO: 692932 - protein, 9 aa, Homo Sapiens
KDENTLFDM

SEQ ID NO: 692933 - protein, 9 aa, Homo Sapiens
KTKATLFGS

SEQ ID NO: 692934 - protein, 9 aa, Homo Sapiens
HTAQNLLRI

SEQ ID NO: 692935 - protein, 9 aa, Homo Sapiens
GLPPLALLA

SEQ ID NO: 692936 - protein, 9 aa, Homo Sapiens
PHTEGALTS

SEQ ID NO: 692937 - protein, 9 aa, Homo Sapiens
AGSASGSNR

SEQ ID NO: 692938 - protein, 9 aa, Homo Sapiens
DVWGKTDNT

SEQ ID NO: 692939 - protein, 9 aa, Homo Sapiens
AASARRRIP

SEQ ID NO: 692940 - protein, 9 aa, Homo Sapiens
PLFTALGQV

SEQ ID NO: 692941 - protein, 9 aa, Homo Sapiens
YIGGVSENA

SEQ ID NO: 692942 - protein, 9 aa, Homo Sapiens
SSTKAEPSV

SEQ ID NO: 692943 - protein, 9 aa, Homo Sapiens
DLAPGIEIY

SEQ ID NO: 692944 - protein, 9 aa, Homo Sapiens
KKGGPAGRG

SEQ ID NO: 692945 - protein, 9 aa, Homo Sapiens
CMAVKTLLL

SEQ ID NO: 692946 - protein, 9 aa, Homo Sapiens
DTLEDSIGI

SEQ ID NO: 692947 - protein, 9 aa, Homo Sapiens
RSVSSDTSS

SEQ ID NO: 692948 - protein, 9 aa, Homo Sapiens
VFYGLTYSY

SEQ ID NO: 692949 - protein, 9 aa, Homo Sapiens
PCKLEKRTK

SEQ ID NO: 692950 - protein, 9 aa, Homo Sapiens
KVIPTRYGK

SEQ ID NO: 692951 - protein, 9 aa, Homo Sapiens
DKNRQLTLP

SEQ ID NO: 692952 - protein, 9 aa, Homo Sapiens
GSACEFYMC

SEQ ID NO: 692953 - protein, 9 aa, Homo Sapiens
DLFLDSLWE

SEQ ID NO: 692954 - protein, 9 aa, Homo Sapiens
HCWKGRTAE

SEQ ID NO: 692955 - protein, 9 aa, Homo Sapiens
RAPELLLVA

SEQ ID NO: 692956 - protein, 9 aa, Homo Sapiens
IGDKIGMLF

SEQ ID NO: 692957 - protein, 9 aa, Homo Sapiens
IGAVTTVGV

SEQ ID NO: 692958 - protein, 9 aa, Homo Sapiens
ASGLPRRPK

SEQ ID NO: 692959 - protein, 9 aa, Homo Sapiens
FIDTVYSAA

SEQ ID NO: 692960 - protein, 9 aa, Homo Sapiens
ELSVLEDLA

SEQ ID NO: 692961 - protein, 9 aa, Homo Sapiens
WTHQQPSGS

SEQ ID NO: 692962 - protein, 9 aa, Homo Sapiens
AERDISSSA

SEQ ID NO: 692963 - protein, 9 aa, Homo Sapiens
GVFVNLLKN

SEQ ID NO: 692964 - protein, 9 aa, Homo Sapiens
SKVQIRCQR

SEQ ID NO: 692965 - protein, 9 aa, Homo Sapiens
SSIRRWSLH

SEQ ID NO: 692966 - protein, 9 aa, Homo Sapiens
RASPLGLAL

SEQ ID NO: 692967 - protein, 9 aa, Homo Sapiens
VQCHPYLTQ

SEQ ID NO: 692968 - protein, 9 aa, Homo Sapiens
GCGLLLLVV

SEQ ID NO: 692969 - protein, 9 aa, Homo Sapiens
FDLGEKVER

SEQ ID NO: 692970 - protein, 9 aa, Homo Sapiens
PYQLKETKR

SEQ ID NO: 692971 - protein, 9 aa, Homo Sapiens
LQASCLLGA

SEQ ID NO: 692972 - protein, 9 aa, Homo Sapiens
VQGATGSAV

SEQ ID NO: 692973 - protein, 9 aa, Homo Sapiens
GSYQCSHFH

SEQ ID NO: 692974 - protein, 9 aa, Homo Sapiens
RQEEPPPAE

SEQ ID NO: 692975 - protein, 9 aa, Homo Sapiens
KKQEGEVTT

SEQ ID NO: 692976 - protein, 9 aa, Homo Sapiens
WLLAGLVSW

SEQ ID NO: 692977 - protein, 9 aa, Homo Sapiens
DLKTDLRFQ

SEQ ID NO: 692978 - protein, 9 aa, Homo Sapiens
VDPNDSSFT

SEQ ID NO: 692979 - protein, 9 aa, Homo Sapiens
QRNFYPAVQ

SEQ ID NO: 692980 - protein, 9 aa, Homo Sapiens
AKSLSRNPK

SEQ ID NO: 692981 - protein, 9 aa, Homo Sapiens
SATGKESYK

SEQ ID NO: 692982 - protein, 9 aa, Homo Sapiens
STLNNLDLT

SEQ ID NO: 692983 - protein, 9 aa, Homo Sapiens
PLVICIISL

SEQ ID NO: 692984 - protein, 9 aa, Homo Sapiens
FCHSPSLIK

SEQ ID NO: 692985 - protein, 9 aa, Homo Sapiens
GEFQIAKKH

SEQ ID NO: 692986 - protein, 9 aa, Homo Sapiens
KEVKPKPSQ

SEQ ID NO: 692987 - protein, 9 aa, Homo Sapiens
AAHLAEEAG

SEQ ID NO: 692988 - protein, 9 aa, Homo Sapiens
VKNSEPMKR

SEQ ID NO: 692989 - protein, 9 aa, Homo Sapiens
VTDLLAQGL

SEQ ID NO: 692990 - protein, 9 aa, Homo Sapiens
KLPEEKAAK

SEQ ID NO: 692991 - protein, 9 aa, Homo Sapiens
LQNTLQQLR

SEQ ID NO: 692992 - protein, 9 aa, Homo Sapiens
CPAGGPGAK

SEQ ID NO: 692993 - protein, 9 aa, Homo Sapiens
PARGDSEHR

SEQ ID NO: 692994 - protein, 9 aa, Homo Sapiens
TVSISLALA

SEQ ID NO: 692995 - protein, 9 aa, Homo Sapiens
GGQTPKVVP

SEQ ID NO: 692996 - protein, 9 aa, Homo Sapiens
PSGTSLAAS

SEQ ID NO: 692997 - protein, 9 aa, Homo Sapiens
FERHLCVRQ

SEQ ID NO: 692998 - protein, 9 aa, Homo Sapiens
EGTELIGKN

SEQ ID NO: 692999 - protein, 9 aa, Homo Sapiens
IGKNKTICE

SEQ ID NO: 693000 - protein, 9 aa, Homo Sapiens
EQEDLNRKE

SEQ ID NO: 693001 - protein, 9 aa, Homo Sapiens
VLYNQLLSQ

SEQ ID NO: 693002 - protein, 9 aa, Homo Sapiens
WLAIKCSTS

SEQ ID NO: 693003 - protein, 9 aa, Homo Sapiens
VEQQADNIL

SEQ ID NO: 693004 - protein, 9 aa, Homo Sapiens
LFRKRARAK

SEQ ID NO: 693005 - protein, 9 aa, Homo Sapiens
PAEETYVQV

SEQ ID NO: 693006 - protein, 9 aa, Homo Sapiens
CAVRFYFLC

SEQ ID NO: 693007 - protein, 9 aa, Homo Sapiens
PGIMHSSYM

SEQ ID NO: 693008 - protein, 9 aa, Homo Sapiens
WELFISNVT

SEQ ID NO: 693009 - protein, 9 aa, Homo Sapiens
AVSSPSAAF

SEQ ID NO: 693010 - protein, 9 aa, Homo Sapiens
DATEPRPDS

SEQ ID NO: 693011 - protein, 9 aa, Homo Sapiens
DNLRFIWQS

SEQ ID NO: 693012 - protein, 9 aa, Homo Sapiens
PTLDLRQQM

SEQ ID NO: 693013 - protein, 9 aa, Homo Sapiens
PRNVIHQLK

SEQ ID NO: 693014 - protein, 9 aa, Homo Sapiens
RQHIAKAEA

SEQ ID NO: 693015 - protein, 9 aa, Homo Sapiens
QELPDRRSC

SEQ ID NO: 693016 - protein, 9 aa, Homo Sapiens
KKPMLFERH

SEQ ID NO: 693017 - protein, 9 aa, Homo Sapiens
QRHLDNSEE

SEQ ID NO: 693018 - protein, 9 aa, Homo Sapiens
SSNQEGKSN

SEQ ID NO: 693019 - protein, 9 aa, Homo Sapiens
DATRLFFNW

SEQ ID NO: 693020 - protein, 9 aa, Homo Sapiens
RLGITKVFF

SEQ ID NO: 693021 - protein, 9 aa, Homo Sapiens
ASSFSNVAE

SEQ ID NO: 693022 - protein, 9 aa, Homo Sapiens
GCRCVELHC

SEQ ID NO: 693023 - protein, 9 aa, Homo Sapiens
TWPQPFLVR

SEQ ID NO: 693024 - protein, 9 aa, Homo Sapiens
AFYTFKKQR

SEQ ID NO: 693025 - protein, 9 aa, Homo Sapiens
VDLNVSEIY

SEQ ID NO: 693026 - protein, 9 aa, Homo Sapiens
TVPSVTNPF

SEQ ID NO: 693027 - protein, 9 aa, Homo Sapiens
ICENQEAQN

SEQ ID NO: 693028 - protein, 9 aa, Homo Sapiens
TKEKAKQKT

SEQ ID NO: 693029 - protein, 9 aa, Homo Sapiens
ETEMKALGD

SEQ ID NO: 693030 - protein, 9 aa, Homo Sapiens
SMLKGKPWE

SEQ ID NO: 693031 - protein, 9 aa, Homo Sapiens
GLDSPGGLA

SEQ ID NO: 693032 - protein, 9 aa, Homo Sapiens
APAQISGLV

SEQ ID NO: 693033 - protein, 9 aa, Homo Sapiens
ELTAEVSLP

SEQ ID NO: 693034 - protein, 9 aa, Homo Sapiens
SRELLAWRG

SEQ ID NO: 693035 - protein, 9 aa, Homo Sapiens
GFQKYYQRL

SEQ ID NO: 693036 - protein, 9 aa, Homo Sapiens
GCDVRLNAI

SEQ ID NO: 693037 - protein, 9 aa, Homo Sapiens
LDLAPGIEI

SEQ ID NO: 693038 - protein, 9 aa, Homo Sapiens
DSNITLFAI

SEQ ID NO: 693039 - protein, 9 aa, Homo Sapiens
HTQYRLGIT

SEQ ID NO: 693040 - protein, 9 aa, Homo Sapiens
SGQSVAKQL

SEQ ID NO: 693041 - protein, 9 aa, Homo Sapiens
TWDEEADFG

SEQ ID NO: 693042 - protein, 9 aa, Homo Sapiens
PSCIWRIPW

SEQ ID NO: 693043 - protein, 9 aa, Homo Sapiens
CSMLAIGIG

SEQ ID NO: 693044 - protein, 9 aa, Homo Sapiens
SVCSTTCGL

SEQ ID NO: 693045 - protein, 9 aa, Homo Sapiens
LIDGSFKIG

SEQ ID NO: 693046 - protein, 9 aa, Homo Sapiens
DFQGTKQAC

SEQ ID NO: 693047 - protein, 9 aa, Homo Sapiens
SMRERRRLK

SEQ ID NO: 693048 - protein, 9 aa, Homo Sapiens
YKPGAAPAA

SEQ ID NO: 693049 - protein, 9 aa, Homo Sapiens
LLLLHHDKL

SEQ ID NO: 693050 - protein, 9 aa, Homo Sapiens
QDHMEVTWY

SEQ ID NO: 693051 - protein, 9 aa, Homo Sapiens
ATERRGKNV

SEQ ID NO: 693052 - protein, 9 aa, Homo Sapiens
GFPLVICII

SEQ ID NO: 693053 - protein, 9 aa, Homo Sapiens
LSRPVDLPT

SEQ ID NO: 693054 - protein, 9 aa, Homo Sapiens
LDFSLMGLF

SEQ ID NO: 693055 - protein, 9 aa, Homo Sapiens
PGIEIYEES

SEQ ID NO: 693056 - protein, 9 aa, Homo Sapiens
DTITLSKIS

SEQ ID NO: 693057 - protein, 9 aa, Homo Sapiens
TLAQLGIAK

SEQ ID NO: 693058 - protein, 9 aa, Homo Sapiens
HRAAWWGKI

SEQ ID NO: 693059 - protein, 9 aa, Homo Sapiens
IGIFGQDRA

SEQ ID NO: 693060 - protein, 9 aa, Homo Sapiens
STGLDSPGG

SEQ ID NO: 693061 - protein, 9 aa, Homo Sapiens
MAKGVAEKV

SEQ ID NO: 693062 - protein, 9 aa, Homo Sapiens
CEHREWGSH

SEQ ID NO: 693063 - protein, 9 aa, Homo Sapiens
LSSMPSPGG

SEQ ID NO: 693064 - protein, 9 aa, Homo Sapiens
YTTLLIKLC

SEQ ID NO: 693065 - protein, 9 aa, Homo Sapiens
KAFNNKGDA

SEQ ID NO: 693066 - protein, 9 aa, Homo Sapiens
ICRLERSGI

SEQ ID NO: 693067 - protein, 9 aa, Homo Sapiens
FGGPPQPSA

SEQ ID NO: 693068 - protein, 9 aa, Homo Sapiens
SSYLLRHKR

SEQ ID NO: 693069 - protein, 9 aa, Homo Sapiens
PSIPISKKS

SEQ ID NO: 693070 - protein, 9 aa, Homo Sapiens
GPPGPPCPA

SEQ ID NO: 693071 - protein, 9 aa, Homo Sapiens
FQGRRRSKS

SEQ ID NO: 693072 - protein, 9 aa, Homo Sapiens
SNTPGARQR

SEQ ID NO: 693073 - protein, 9 aa, Homo Sapiens
CRCHELFFT

SEQ ID NO: 693074 - protein, 9 aa, Homo Sapiens
LNEQMVTPQ

SEQ ID NO: 693075 - protein, 9 aa, Homo Sapiens
PGNIMNGTI

SEQ ID NO: 693076 - protein, 9 aa, Homo Sapiens
CHFDINVNF

SEQ ID NO: 693077 - protein, 9 aa, Homo Sapiens
SGEAVSKTL

SEQ ID NO: 693078 - protein, 9 aa, Homo Sapiens
WRNALETWA

SEQ ID NO: 693079 - protein, 9 aa, Homo Sapiens
AIYQERRME

SEQ ID NO: 693080 - protein, 9 aa, Homo Sapiens
SRPCIWSCV

SEQ ID NO: 693081 - protein, 9 aa, Homo Sapiens
LPPLQQEYP

SEQ ID NO: 693082 - protein, 9 aa, Homo Sapiens
TVGVSNPHL

SEQ ID NO: 693083 - protein, 9 aa, Homo Sapiens
FPSLSKSKA

SEQ ID NO: 693084 - protein, 9 aa, Homo Sapiens
FYCRKNLIR

SEQ ID NO: 693085 - protein, 9 aa, Homo Sapiens
TWKITDAEL

SEQ ID NO: 693086 - protein, 9 aa, Homo Sapiens
GALSKAVYE

SEQ ID NO: 693087 - protein, 9 aa, Homo Sapiens
RWSLHSWSI

SEQ ID NO: 693088 - protein, 9 aa, Homo Sapiens
LYTNQNPNN

SEQ ID NO: 693089 - protein, 9 aa, Homo Sapiens
LMSTLSSSN

SEQ ID NO: 693090 - protein, 9 aa, Homo Sapiens
SAITAFKVE

SEQ ID NO: 693091 - protein, 9 aa, Homo Sapiens
AESEEARLS

SEQ ID NO: 693092 - protein, 9 aa, Homo Sapiens
YCDTITLSK

SEQ ID NO: 693093 - protein, 9 aa, Homo Sapiens
KAVVADRMV

SEQ ID NO: 693094 - protein, 9 aa, Homo Sapiens
DEMNDIRII

SEQ ID NO: 693095 - protein, 9 aa, Homo Sapiens
RNNKKMLSD

SEQ ID NO: 693096 - protein, 9 aa, Homo Sapiens
DSLKLLQRV

SEQ ID NO: 693097 - protein, 9 aa, Homo Sapiens
TTFQIIWDT

SEQ ID NO: 693098 - protein, 9 aa, Homo Sapiens
RRPYFPVAK

SEQ ID NO: 693099 - protein, 9 aa, Homo Sapiens
KKMLSDSHG

SEQ ID NO: 693100 - protein, 9 aa, Homo Sapiens
GAVCSALCV

SEQ ID NO: 693101 - protein, 9 aa, Homo Sapiens
PCTPAPVPV

SEQ ID NO: 693102 - protein, 9 aa, Homo Sapiens
FHFCGSCLG

SEQ ID NO: 693103 - protein, 9 aa, Homo Sapiens
GRNFHRFAK

SEQ ID NO: 693104 - protein, 9 aa, Homo Sapiens
LSFHRHIIT

SEQ ID NO: 693105 - protein, 9 aa, Homo Sapiens
LTIAELLFS

SEQ ID NO: 693106 - protein, 9 aa, Homo Sapiens
KMEAKFELR

SEQ ID NO: 693107 - protein, 9 aa, Homo Sapiens
MLRSMMGKC

SEQ ID NO: 693108 - protein, 9 aa, Homo Sapiens
EHEIEIQGL

SEQ ID NO: 693109 - protein, 9 aa, Homo Sapiens
GQRVSLEAV

SEQ ID NO: 693110 - protein, 9 aa, Homo Sapiens
SPGTGAMTA

SEQ ID NO: 693111 - protein, 9 aa, Homo Sapiens
TVVGLYQKC

SEQ ID NO: 693112 - protein, 9 aa, Homo Sapiens
STSDECYYD

SEQ ID NO: 693113 - protein, 9 aa, Homo Sapiens
SVAVFVRIL

SEQ ID NO: 693114 - protein, 9 aa, Homo Sapiens
APPLPPAYY

SEQ ID NO: 693115 - protein, 9 aa, Homo Sapiens
SILHTMFRV

SEQ ID NO: 693116 - protein, 9 aa, Homo Sapiens
LGSLRMLLL

SEQ ID NO: 693117 - protein, 9 aa, Homo Sapiens
LAGTGDAGG

SEQ ID NO: 693118 - protein, 9 aa, Homo Sapiens
SFFTPTSLM

SEQ ID NO: 693119 - protein, 9 aa, Homo Sapiens
RLPGPSRLP

SEQ ID NO: 693120 - protein, 9 aa, Homo Sapiens
TLPAVGPYE

SEQ ID NO: 693121 - protein, 9 aa, Homo Sapiens
FLLNLTRSY

SEQ ID NO: 693122 - protein, 9 aa, Homo Sapiens
RGQHTNTTG

SEQ ID NO: 693123 - protein, 9 aa, Homo Sapiens
DLPHTEGAL

SEQ ID NO: 693124 - protein, 9 aa, Homo Sapiens
GGSSRIDNT

SEQ ID NO: 693125 - protein, 9 aa, Homo Sapiens
CHSFYIPRH

SEQ ID NO: 693126 - protein, 9 aa, Homo Sapiens
EKASEEVRH

SEQ ID NO: 693127 - protein, 9 aa, Homo Sapiens
QPISCKGVV

SEQ ID NO: 693128 - protein, 9 aa, Homo Sapiens
RSCWSGNWW

SEQ ID NO: 693129 - protein, 9 aa, Homo Sapiens
FNVCGCAPQ

SEQ ID NO: 693130 - protein, 9 aa, Homo Sapiens
RRKSLRSGS

SEQ ID NO: 693131 - protein, 9 aa, Homo Sapiens
RPVPIERVK

SEQ ID NO: 693132 - protein, 9 aa, Homo Sapiens
LQFGVAVMD

SEQ ID NO: 693133 - protein, 9 aa, Homo Sapiens
LMETRPAGD

SEQ ID NO: 693134 - protein, 9 aa, Homo Sapiens
LVVLTALMG

SEQ ID NO: 693135 - protein, 9 aa, Homo Sapiens
YGLQNSLAA

SEQ ID NO: 693136 - protein, 9 aa, Homo Sapiens
TTKRLIGRR

SEQ ID NO: 693137 - protein, 9 aa, Homo Sapiens
ECYYDSFSP

SEQ ID NO: 693138 - protein, 9 aa, Homo Sapiens
FKAYVLLGD

SEQ ID NO: 693139 - protein, 9 aa, Homo Sapiens
SNITLFAIG

SEQ ID NO: 693140 - protein, 9 aa, Homo Sapiens
LSHSSQVHS

SEQ ID NO: 693141 - protein, 9 aa, Homo Sapiens
QLAAPECKV

SEQ ID NO: 693142 - protein, 9 aa, Homo Sapiens
EEDESGTPR

SEQ ID NO: 693143 - protein, 9 aa, Homo Sapiens
LKGKPWEGC

SEQ ID NO: 693144 - protein, 9 aa, Homo Sapiens
FFLHIASDC

SEQ ID NO: 693145 - protein, 9 aa, Homo Sapiens
TVSDKAYIL

SEQ ID NO: 693146 - protein, 9 aa, Homo Sapiens
LPAAGGAQD

SEQ ID NO: 693147 - protein, 9 aa, Homo Sapiens
LSKSSKPTR

SEQ ID NO: 693148 - protein, 9 aa, Homo Sapiens
CDVRLNAIP

SEQ ID NO: 693149 - protein, 9 aa, Homo Sapiens
SQERGVQPA

SEQ ID NO: 693150 - protein, 9 aa, Homo Sapiens
LLVFHNPIN

SEQ ID NO: 693151 - protein, 9 aa, Homo Sapiens
NGQKGDQGE

SEQ ID NO: 693152 - protein, 9 aa, Homo Sapiens
LEAVIADAE

SEQ ID NO: 693153 - protein, 9 aa, Homo Sapiens
LSNGNSGGW

SEQ ID NO: 693154 - protein, 9 aa, Homo Sapiens
VAGDRASSN

SEQ ID NO: 693155 - protein, 9 aa, Homo Sapiens
VMKAQTECG

SEQ ID NO: 693156 - protein, 9 aa, Homo Sapiens
KKQVLDLKE

SEQ ID NO: 693157 - protein, 9 aa, Homo Sapiens
SKPKLDTVQ

SEQ ID NO: 693158 - protein, 9 aa, Homo Sapiens
SQQALSCFL

SEQ ID NO: 693159 - protein, 9 aa, Homo Sapiens
RGKKVAGGG

SEQ ID NO: 693160 - protein, 9 aa, Homo Sapiens
WGKTDNTRS

SEQ ID NO: 693161 - protein, 9 aa, Homo Sapiens
ASKADKSKK

SEQ ID NO: 693162 - protein, 9 aa, Homo Sapiens
EEYKDENTL

SEQ ID NO: 693163 - protein, 9 aa, Homo Sapiens
QDLKTDLRF

SEQ ID NO: 693164 - protein, 9 aa, Homo Sapiens
PRHNQGHCC

SEQ ID NO: 693165 - protein, 9 aa, Homo Sapiens
LRRSSSLHN

SEQ ID NO: 693166 - protein, 9 aa, Homo Sapiens
SLYECAVRF

SEQ ID NO: 693167 - protein, 9 aa, Homo Sapiens
CVLGTLSNS

SEQ ID NO: 693168 - protein, 9 aa, Homo Sapiens
PHDVAGIQA

SEQ ID NO: 693169 - protein, 9 aa, Homo Sapiens
GPSGSKKFC

SEQ ID NO: 693170 - protein, 9 aa, Homo Sapiens
DSIRKFERK

SEQ ID NO: 693171 - protein, 9 aa, Homo Sapiens
QSDEIDLSY

SEQ ID NO: 693172 - protein, 9 aa, Homo Sapiens
RDIERMVVA

SEQ ID NO: 693173 - protein, 9 aa, Homo Sapiens
FLVEKSRVV

SEQ ID NO: 693174 - protein, 9 aa, Homo Sapiens
AHPSAPCLA

SEQ ID NO: 693175 - protein, 9 aa, Homo Sapiens
ELTAYKIFE

SEQ ID NO: 693176 - protein, 9 aa, Homo Sapiens
RDCDQQSTC

SEQ ID NO: 693177 - protein, 9 aa, Homo Sapiens
SLHSWSIPV

SEQ ID NO: 693178 - protein, 9 aa, Homo Sapiens
RPASCRPHK

SEQ ID NO: 693179 - protein, 9 aa, Homo Sapiens
RHYVNSTRR

SEQ ID NO: 693180 - protein, 9 aa, Homo Sapiens
KMEKGDVIY

SEQ ID NO: 693181 - protein, 9 aa, Homo Sapiens
VINWVQHSI

SEQ ID NO: 693182 - protein, 9 aa, Homo Sapiens
SKMREQLVK

SEQ ID NO: 693183 - protein, 9 aa, Homo Sapiens
QKVQKMLIS

SEQ ID NO: 693184 - protein, 9 aa, Homo Sapiens
KQTEVQTVM

SEQ ID NO: 693185 - protein, 9 aa, Homo Sapiens
QENFPDAKE

SEQ ID NO: 693186 - protein, 9 aa, Homo Sapiens
SDECYYDSF

SEQ ID NO: 693187 - protein, 9 aa, Homo Sapiens
TLDHFFCEV

SEQ ID NO: 693188 - protein, 9 aa, Homo Sapiens
DTEADTVLS

SEQ ID NO: 693189 - protein, 9 aa, Homo Sapiens
NWVQHSIWE

SEQ ID NO: 693190 - protein, 9 aa, Homo Sapiens
YEETRGVFK

SEQ ID NO: 693191 - protein, 9 aa, Homo Sapiens
GPCDPPRHN

SEQ ID NO: 693192 - protein, 9 aa, Homo Sapiens
ALHVNIGIK

SEQ ID NO: 693193 - protein, 9 aa, Homo Sapiens
LEPPKLEKI

SEQ ID NO: 693194 - protein, 9 aa, Homo Sapiens
QHEGKGQEK

SEQ ID NO: 693195 - protein, 9 aa, Homo Sapiens
KNEGNCVMD

SEQ ID NO: 693196 - protein, 9 aa, Homo Sapiens
GKPWEGCLH

SEQ ID NO: 693197 - protein, 9 aa, Homo Sapiens
TMKKPLHLL

SEQ ID NO: 693198 - protein, 9 aa, Homo Sapiens
LPTLDLRQQ

SEQ ID NO: 693199 - protein, 9 aa, Homo Sapiens
LTEKQTEVQ

SEQ ID NO: 693200 - protein, 9 aa, Homo Sapiens
HINPSITLA

SEQ ID NO: 693201 - protein, 9 aa, Homo Sapiens
RFIAKVKER

SEQ ID NO: 693202 - protein, 9 aa, Homo Sapiens
YPLTLYVTV

SEQ ID NO: 693203 - protein, 9 aa, Homo Sapiens
KPLSWVFKN

SEQ ID NO: 693204 - protein, 9 aa, Homo Sapiens
CREEDLILQ

SEQ ID NO: 693205 - protein, 9 aa, Homo Sapiens
YKINIPTHS

SEQ ID NO: 693206 - protein, 9 aa, Homo Sapiens
PNHHPFHTD

SEQ ID NO: 693207 - protein, 9 aa, Homo Sapiens
SHFLCEIPC

SEQ ID NO: 693208 - protein, 9 aa, Homo Sapiens
KIGNLLVIV

SEQ ID NO: 693209 - protein, 9 aa, Homo Sapiens
VLHNTGALK

SEQ ID NO: 693210 - protein, 9 aa, Homo Sapiens
EGIDVGTFL

SEQ ID NO: 693211 - protein, 9 aa, Homo Sapiens
PNFNTNVVV

SEQ ID NO: 693212 - protein, 9 aa, Homo Sapiens
GVLYNQLLS

SEQ ID NO: 693213 - protein, 9 aa, Homo Sapiens
TKNTLPAVG

SEQ ID NO: 693214 - protein, 9 aa, Homo Sapiens
ALLQQARSS

SEQ ID NO: 693215 - protein, 9 aa, Homo Sapiens
VGDGLSKSS

SEQ ID NO: 693216 - protein, 9 aa, Homo Sapiens
LLIYTVKIL

SEQ ID NO: 693217 - protein, 9 aa, Homo Sapiens
FPLVICIIS

SEQ ID NO: 693218 - protein, 9 aa, Homo Sapiens
IFEPTPLWV

SEQ ID NO: 693219 - protein, 9 aa, Homo Sapiens
HMNNGNGAN

SEQ ID NO: 693220 - protein, 9 aa, Homo Sapiens
SINHFVIWG

SEQ ID NO: 693221 - protein, 9 aa, Homo Sapiens
LYEAEALLD

SEQ ID NO: 693222 - protein, 9 aa, Homo Sapiens
DTDVGYVEN

SEQ ID NO: 693223 - protein, 9 aa, Homo Sapiens
FYTTKRLIG

SEQ ID NO: 693224 - protein, 9 aa, Homo Sapiens
HTDDEFESE

SEQ ID NO: 693225 - protein, 9 aa, Homo Sapiens
DLISPRKMP

SEQ ID NO: 693226 - protein, 9 aa, Homo Sapiens
GDQMNPECN

SEQ ID NO: 693227 - protein, 9 aa, Homo Sapiens
LLIGIFGQD

SEQ ID NO: 693228 - protein, 9 aa, Homo Sapiens
LYANKMALR

SEQ ID NO: 693229 - protein, 9 aa, Homo Sapiens
PPAAASARR

SEQ ID NO: 693230 - protein, 9 aa, Homo Sapiens
AQAARDSNI

SEQ ID NO: 693231 - protein, 9 aa, Homo Sapiens
GTSLAASVM

SEQ ID NO: 693232 - protein, 9 aa, Homo Sapiens
QKGEPGLLP

SEQ ID NO: 693233 - protein, 9 aa, Homo Sapiens
WAQATSSWP

SEQ ID NO: 693234 - protein, 9 aa, Homo Sapiens
TAEVSLPSY

SEQ ID NO: 693235 - protein, 9 aa, Homo Sapiens
PKNFFFFFF

SEQ ID NO: 693236 - protein, 9 aa, Homo Sapiens
DDSLTGSSA

SEQ ID NO: 693237 - protein, 9 aa, Homo Sapiens
ILHTMFRVG

SEQ ID NO: 693238 - protein, 9 aa, Homo Sapiens
FFYLPYFKK

SEQ ID NO: 693239 - protein, 9 aa, Homo Sapiens
NGKDYMISV

SEQ ID NO: 693240 - protein, 9 aa, Homo Sapiens
GGTESKTSS

SEQ ID NO: 693241 - protein, 9 aa, Homo Sapiens
PQAAMLSQM

SEQ ID NO: 693242 - protein, 9 aa, Homo Sapiens
CTSGQGKYR

SEQ ID NO: 693243 - protein, 9 aa, Homo Sapiens
LTSGDPPPS

SEQ ID NO: 693244 - protein, 8 aa, Homo Sapiens
HNTADEVV

SEQ ID NO: 693245 - protein, 9 aa, Homo Sapiens
AVFVHAGPF

SEQ ID NO: 693246 - protein, 9 aa, Homo Sapiens
HSSYMQISG

SEQ ID NO: 693247 - protein, 9 aa, Homo Sapiens
FVPGVPQRT

SEQ ID NO: 693248 - protein, 9 aa, Homo Sapiens
PVFVIKYPL

SEQ ID NO: 693249 - protein, 9 aa, Homo Sapiens
HHHVVRKTD

SEQ ID NO: 693250 - protein, 9 aa, Homo Sapiens
KVINWVQHS

SEQ ID NO: 693251 - protein, 9 aa, Homo Sapiens
FLQSHLNSD

SEQ ID NO: 693252 - protein, 9 aa, Homo Sapiens
INRQRLHCE

SEQ ID NO: 693253 - protein, 9 aa, Homo Sapiens
DVLKFYCRK

SEQ ID NO: 693254 - protein, 9 aa, Homo Sapiens
TTRGGKIPM

SEQ ID NO: 693255 - protein, 9 aa, Homo Sapiens
HCLKITVNC

SEQ ID NO: 693256 - protein, 9 aa, Homo Sapiens
QLQTTQSVQ

SEQ ID NO: 693257 - protein, 9 aa, Homo Sapiens
TSLQTLHRS

SEQ ID NO: 693258 - protein, 9 aa, Homo Sapiens
LGPDAVCVL

SEQ ID NO: 693259 - protein, 9 aa, Homo Sapiens
VEKSRVVMR

SEQ ID NO: 693260 - protein, 9 aa, Homo Sapiens
ALKNQATGQ

SEQ ID NO: 693261 - protein, 9 aa, Homo Sapiens
RWSLIRGIY

SEQ ID NO: 693262 - protein, 9 aa, Homo Sapiens
QIIFINIED

SEQ ID NO: 693263 - protein, 9 aa, Homo Sapiens
THLIRSCRT

SEQ ID NO: 693264 - protein, 9 aa, Homo Sapiens
SIRSCTNGC

SEQ ID NO: 693265 - protein, 9 aa, Homo Sapiens
NAIDKRIPS

SEQ ID NO: 693266 - protein, 9 aa, Homo Sapiens
GRAGNKEKA

SEQ ID NO: 693267 - protein, 9 aa, Homo Sapiens
EKLMKQGSE

SEQ ID NO: 693268 - protein, 9 aa, Homo Sapiens
ISGNYHLPS

SEQ ID NO: 693269 - protein, 9 aa, Homo Sapiens
QSVQGATGS

SEQ ID NO: 693270 - protein, 9 aa, Homo Sapiens
ECVDWERLA

SEQ ID NO: 693271 - protein, 9 aa, Homo Sapiens
RKAVVADRM

SEQ ID NO: 693272 - protein, 9 aa, Homo Sapiens
TAIDDKDFV

SEQ ID NO: 693273 - protein, 9 aa, Homo Sapiens
NPRLMKDLL

SEQ ID NO: 693274 - protein, 9 aa, Homo Sapiens
FYGCQTGTA

SEQ ID NO: 693275 - protein, 9 aa, Homo Sapiens
ISRRQRRVL

SEQ ID NO: 693276 - protein, 9 aa, Homo Sapiens
GQHTNTTGR

SEQ ID NO: 693277 - protein, 9 aa, Homo Sapiens
NFFFFFFFL

SEQ ID NO: 693278 - protein, 9 aa, Homo Sapiens
PISKKSKDG

SEQ ID NO: 693279 - protein, 9 aa, Homo Sapiens
WQMHSPPAA

SEQ ID NO: 693280 - protein, 9 aa, Homo Sapiens
TMNAMITNT

SEQ ID NO: 693281 - protein, 9 aa, Homo Sapiens
LHLGKPSLP

SEQ ID NO: 693282 - protein, 9 aa, Homo Sapiens
RSPGTGAMT

SEQ ID NO: 693283 - protein, 9 aa, Homo Sapiens
PGSAKPGRE

SEQ ID NO: 693284 - protein, 9 aa, Homo Sapiens
TAKNAMGCK

SEQ ID NO: 693285 - protein, 9 aa, Homo Sapiens
CFRIRNNKK

SEQ ID NO: 693286 - protein, 9 aa, Homo Sapiens
IIFTLLKEV

SEQ ID NO: 693287 - protein, 9 aa, Homo Sapiens
VFVIKYPLT

SEQ ID NO: 693288 - protein, 9 aa, Homo Sapiens
SKPQDPAAV

SEQ ID NO: 693289 - protein, 9 aa, Homo Sapiens
GHKPLSWVF

SEQ ID NO: 693290 - protein, 9 aa, Homo Sapiens
HPFFECVDW

SEQ ID NO: 693291 - protein, 9 aa, Homo Sapiens
EDGSLFYEQ

SEQ ID NO: 693292 - protein, 9 aa, Homo Sapiens
ATVPSVTNP

SEQ ID NO: 693293 - protein, 9 aa, Homo Sapiens
VTCMSEEEV

SEQ ID NO: 693294 - protein, 9 aa, Homo Sapiens
GSVAFSDFL

SEQ ID NO: 693295 - protein, 9 aa, Homo Sapiens
MQLVPEIRK

SEQ ID NO: 693296 - protein, 9 aa, Homo Sapiens
RRGGFAVKA

SEQ ID NO: 693297 - protein, 9 aa, Homo Sapiens
HVYNDSCVS

SEQ ID NO: 693298 - protein, 9 aa, Homo Sapiens
GIRMFAVGV

SEQ ID NO: 693299 - protein, 9 aa, Homo Sapiens
HSLSRIVDE

SEQ ID NO: 693300 - protein, 9 aa, Homo Sapiens
EYDKEPCCL

SEQ ID NO: 693301 - protein, 9 aa, Homo Sapiens
TSRKSRPCI

SEQ ID NO: 693302 - protein, 9 aa, Homo Sapiens
SHGGGGWGG

SEQ ID NO: 693303 - protein, 9 aa, Homo Sapiens
TPTGLIKLA

SEQ ID NO: 693304 - protein, 9 aa, Homo Sapiens
TFDSSPEAS

SEQ ID NO: 693305 - protein, 9 aa, Homo Sapiens
AELSVLEDL

SEQ ID NO: 693306 - protein, 9 aa, Homo Sapiens
AELRKPSGS

SEQ ID NO: 693307 - protein, 9 aa, Homo Sapiens
DSLPAMQQL

SEQ ID NO: 693308 - protein, 9 aa, Homo Sapiens
IFTLLKEVK

SEQ ID NO: 693309 - protein, 9 aa, Homo Sapiens
ENGTPCGPS

SEQ ID NO: 693310 - protein, 9 aa, Homo Sapiens
ELMSVRLRK

SEQ ID NO: 693311 - protein, 9 aa, Homo Sapiens
GSAKPGRED

SEQ ID NO: 693312 - protein, 9 aa, Homo Sapiens
LLPTMQEKH

SEQ ID NO: 693313 - protein, 9 aa, Homo Sapiens
ASRNDHGSA

SEQ ID NO: 693314 - protein, 9 aa, Homo Sapiens
DREEVEQQA

SEQ ID NO: 693315 - protein, 9 aa, Homo Sapiens
TKGRGIFAS

SEQ ID NO: 693316 - protein, 9 aa, Homo Sapiens
IEERKKNPS

SEQ ID NO: 693317 - protein, 9 aa, Homo Sapiens
KDEMGKQEM

SEQ ID NO: 693318 - protein, 9 aa, Homo Sapiens
HKLSHLDEK

SEQ ID NO: 693319 - protein, 9 aa, Homo Sapiens
AEFEKASEE

SEQ ID NO: 693320 - protein, 9 aa, Homo Sapiens
KFDLGEKVE

SEQ ID NO: 693321 - protein, 9 aa, Homo Sapiens
LPAVGPYES

SEQ ID NO: 693322 - protein, 9 aa, Homo Sapiens
ITSSASSGH

SEQ ID NO: 693323 - protein, 9 aa, Homo Sapiens
CNFFTSVDH

SEQ ID NO: 693324 - protein, 9 aa, Homo Sapiens
EDKPRAHLP

SEQ ID NO: 693325 - protein, 9 aa, Homo Sapiens
SDKAYILSM

SEQ ID NO: 693326 - protein, 9 aa, Homo Sapiens
TLEGAYKPG

SEQ ID NO: 693327 - protein, 9 aa, Homo Sapiens
DSLGTLHGT

SEQ ID NO: 693328 - protein, 9 aa, Homo Sapiens
GQGKYRDRH

SEQ ID NO: 693329 - protein, 9 aa, Homo Sapiens
TDKFVLMRD

SEQ ID NO: 693330 - protein, 9 aa, Homo Sapiens
LSLEEAIEE

SEQ ID NO: 693331 - protein, 9 aa, Homo Sapiens
GDTAKSIPE

SEQ ID NO: 693332 - protein, 9 aa, Homo Sapiens
NLQLQNTLQ

SEQ ID NO: 693333 - protein, 9 aa, Homo Sapiens
VLSPEKQRD

SEQ ID NO: 693334 - protein, 9 aa, Homo Sapiens
KMSGNGREI

SEQ ID NO: 693335 - protein, 9 aa, Homo Sapiens
QTPKVVPPD

SEQ ID NO: 693336 - protein, 9 aa, Homo Sapiens
IDTVYSAAF

SEQ ID NO: 693337 - protein, 9 aa, Homo Sapiens
YERRIECLS

SEQ ID NO: 693338 - protein, 9 aa, Homo Sapiens
EDYDRRADK

SEQ ID NO: 693339 - protein, 9 aa, Homo Sapiens
RIECLSLAS

SEQ ID NO: 693340 - protein, 9 aa, Homo Sapiens
TMNPRMRKL

SEQ ID NO: 693341 - protein, 9 aa, Homo Sapiens
VSGLAGCIY

SEQ ID NO: 693342 - protein, 9 aa, Homo Sapiens
RRFFLHIAS

SEQ ID NO: 693343 - protein, 9 aa, Homo Sapiens
YTTDNLRFI

SEQ ID NO: 693344 - protein, 9 aa, Homo Sapiens
GTQLVGTQS

SEQ ID NO: 693345 - protein, 9 aa, Homo Sapiens
GLQLGVQLL

SEQ ID NO: 693346 - protein, 9 aa, Homo Sapiens
RDSNITLFA

SEQ ID NO: 693347 - protein, 9 aa, Homo Sapiens
KKQQKEQLE

SEQ ID NO: 693348 - protein, 9 aa, Homo Sapiens
AVFGTQLVG

SEQ ID NO: 693349 - protein, 9 aa, Homo Sapiens
KELIEDFKT

SEQ ID NO: 693350 - protein, 9 aa, Homo Sapiens
HRVGASTVT

SEQ ID NO: 693351 - protein, 9 aa, Homo Sapiens
LCSQTSDNN

SEQ ID NO: 693352 - protein, 9 aa, Homo Sapiens
KHLGVSEGG

SEQ ID NO: 693353 - protein, 9 aa, Homo Sapiens
LYECETSKA

SEQ ID NO: 693354 - protein, 9 aa, Homo Sapiens
FPKFKRHYV

SEQ ID NO: 693355 - protein, 9 aa, Homo Sapiens
FNVPTCKLA

SEQ ID NO: 693356 - protein, 9 aa, Homo Sapiens
GFAMAKGCQ

SEQ ID NO: 693357 - protein, 9 aa, Homo Sapiens
KVPELTLPI

SEQ ID NO: 693358 - protein, 9 aa, Homo Sapiens
PSAPLHSTL

SEQ ID NO: 693359 - protein, 9 aa, Homo Sapiens
SPLLAAQSS

SEQ ID NO: 693360 - protein, 9 aa, Homo Sapiens
TALTFLVEK

SEQ ID NO: 693361 - protein, 9 aa, Homo Sapiens
TLGELPAKG

SEQ ID NO: 693362 - protein, 9 aa, Homo Sapiens
KRKAVVADR

SEQ ID NO: 693363 - protein, 9 aa, Homo Sapiens
GEAVSKTLQ

SEQ ID NO: 693364 - protein, 9 aa, Homo Sapiens
RRSVSSDTS

SEQ ID NO: 693365 - protein, 9 aa, Homo Sapiens
ANQRATNML

SEQ ID NO: 693366 - protein, 9 aa, Homo Sapiens
DFCPTNCHM

SEQ ID NO: 693367 - protein, 9 aa, Homo Sapiens
FSFKEKLSQ

SEQ ID NO: 693368 - protein, 9 aa, Homo Sapiens
CSCQVSLIL

SEQ ID NO: 693369 - protein, 9 aa, Homo Sapiens
VDTTGLKGP

SEQ ID NO: 693370 - protein, 9 aa, Homo Sapiens
LWEENETLV

SEQ ID NO: 693371 - protein, 9 aa, Homo Sapiens
VLPEEITKE

SEQ ID NO: 693372 - protein, 9 aa, Homo Sapiens
ALLNMQYCP

SEQ ID NO: 693373 - protein, 9 aa, Homo Sapiens
CQESGLSVW

SEQ ID NO: 693374 - protein, 9 aa, Homo Sapiens
QVQCHPYLT

SEQ ID NO: 693375 - protein, 9 aa, Homo Sapiens
KRQISTKRY

SEQ ID NO: 693376 - protein, 9 aa, Homo Sapiens
FTWKYEGKN

SEQ ID NO: 693377 - protein, 9 aa, Homo Sapiens
HVQTSLREQ

SEQ ID NO: 693378 - protein, 9 aa, Homo Sapiens
FLVEKMNVF

SEQ ID NO: 693379 - protein, 9 aa, Homo Sapiens
MKSNEENKT

SEQ ID NO: 693380 - protein, 9 aa, Homo Sapiens
VHTDGSIVD

SEQ ID NO: 693381 - protein, 9 aa, Homo Sapiens
VHSLSRIVD

SEQ ID NO: 693382 - protein, 9 aa, Homo Sapiens
SCGGSVAGS

SEQ ID NO: 693383 - protein, 9 aa, Homo Sapiens
RRPKRPGTI

SEQ ID NO: 693384 - protein, 9 aa, Homo Sapiens
YTLEEFQHV

SEQ ID NO: 693385 - protein, 9 aa, Homo Sapiens
MGAGSDADT

SEQ ID NO: 693386 - protein, 9 aa, Homo Sapiens
DSSYLLRHK

SEQ ID NO: 693387 - protein, 9 aa, Homo Sapiens
LLQSGYISG

SEQ ID NO: 693388 - protein, 9 aa, Homo Sapiens
SLPLVTRPR

SEQ ID NO: 693389 - protein, 9 aa, Homo Sapiens
DAARRFFLH

SEQ ID NO: 693390 - protein, 9 aa, Homo Sapiens
VLSTIKAQS

SEQ ID NO: 693391 - protein, 9 aa, Homo Sapiens
MGSLSFRIS

SEQ ID NO: 693392 - protein, 9 aa, Homo Sapiens
SWAETGHTD

SEQ ID NO: 693393 - protein, 9 aa, Homo Sapiens
TDQSFFTPT

SEQ ID NO: 693394 - protein, 9 aa, Homo Sapiens
GRPKTSNRE

SEQ ID NO: 693395 - protein, 9 aa, Homo Sapiens
EMQQNCSIL

SEQ ID NO: 693396 - protein, 9 aa, Homo Sapiens
LVQEYYKIF

SEQ ID NO: 693397 - protein, 9 aa, Homo Sapiens
LRPASCRPH

SEQ ID NO: 693398 - protein, 9 aa, Homo Sapiens
LPTMQEKHL

SEQ ID NO: 693399 - protein, 9 aa, Homo Sapiens
REPPKDPCL

SEQ ID NO: 693400 - protein, 9 aa, Homo Sapiens
NNVVGGQRA

SEQ ID NO: 693401 - protein, 9 aa, Homo Sapiens
GAGFAGSSS

SEQ ID NO: 693402 - protein, 9 aa, Homo Sapiens
QDRATALLE

SEQ ID NO: 693403 - protein, 9 aa, Homo Sapiens
GDKIGMLFQ

SEQ ID NO: 693404 - protein, 9 aa, Homo Sapiens
VRGEVMGKK

SEQ ID NO: 693405 - protein, 9 aa, Homo Sapiens
LDSLWEENE

SEQ ID NO: 693406 - protein, 9 aa, Homo Sapiens
KIISLANNH

SEQ ID NO: 693407 - protein, 9 aa, Homo Sapiens
AMLSQMSQE

SEQ ID NO: 693408 - protein, 9 aa, Homo Sapiens
LQEFGAKAQ

SEQ ID NO: 693409 - protein, 9 aa, Homo Sapiens
NKTLHSDIS

SEQ ID NO: 693410 - protein, 9 aa, Homo Sapiens
GTDISGNYH

SEQ ID NO: 693411 - protein, 9 aa, Homo Sapiens
YVRFIAKVK

SEQ ID NO: 693412 - protein, 9 aa, Homo Sapiens
SSCGGSVAG

SEQ ID NO: 693413 - protein, 9 aa, Homo Sapiens
QCSHFHVRF

SEQ ID NO: 693414 - protein, 9 aa, Homo Sapiens
KRILQKGQT

SEQ ID NO: 693415 - protein, 9 aa, Homo Sapiens
VETPPPDAL

SEQ ID NO: 693416 - protein, 9 aa, Homo Sapiens
EVSRFVAQA

SEQ ID NO: 693417 - protein, 9 aa, Homo Sapiens
IQILFVGFS

SEQ ID NO: 693418 - protein, 9 aa, Homo Sapiens
TSSAGAHKT

SEQ ID NO: 693419 - protein, 9 aa, Homo Sapiens
ASISATAVV

SEQ ID NO: 693420 - protein, 9 aa, Homo Sapiens
EAALSSMPS

SEQ ID NO: 693421 - protein, 9 aa, Homo Sapiens
EFNISFMKS

SEQ ID NO: 693422 - protein, 9 aa, Homo Sapiens
SLCLDIHNM

SEQ ID NO: 693423 - protein, 9 aa, Homo Sapiens
WSVQGCLLS

SEQ ID NO: 693424 - protein, 9 aa, Homo Sapiens
EGKVEVFLG

SEQ ID NO: 693425 - protein, 9 aa, Homo Sapiens
ILGNNGYVE

SEQ ID NO: 693426 - protein, 9 aa, Homo Sapiens
NISGEDLHS

SEQ ID NO: 693427 - protein, 9 aa, Homo Sapiens
HSFFEAQGA

SEQ ID NO: 693428 - protein, 9 aa, Homo Sapiens
AGATVRIHG

SEQ ID NO: 693429 - protein, 9 aa, Homo Sapiens
IHTPEQGSQ

SEQ ID NO: 693430 - protein, 9 aa, Homo Sapiens
GPAGPAGII

SEQ ID NO: 693431 - protein, 9 aa, Homo Sapiens
TIFEPTPLW

SEQ ID NO: 693432 - protein, 9 aa, Homo Sapiens
LTEQDPKHC

SEQ ID NO: 693433 - protein, 9 aa, Homo Sapiens
LKRQISTKR

SEQ ID NO: 693434 - protein, 9 aa, Homo Sapiens
TNESQPGRY

SEQ ID NO: 693435 - protein, 9 aa, Homo Sapiens
LSKYEVKAS

SEQ ID NO: 693436 - protein, 9 aa, Homo Sapiens
DCDLGIQSV

SEQ ID NO: 693437 - protein, 9 aa, Homo Sapiens
KNAMGCKIL

SEQ ID NO: 693438 - protein, 9 aa, Homo Sapiens
PLPQGLLLQ

SEQ ID NO: 693439 - protein, 9 aa, Homo Sapiens
KNSWGEEWS

SEQ ID NO: 693440 - protein, 9 aa, Homo Sapiens
PPGARLLSQ

SEQ ID NO: 693441 - protein, 9 aa, Homo Sapiens
AQSNDGYHI

SEQ ID NO: 693442 - protein, 9 aa, Homo Sapiens
SDVAMFDPP

SEQ ID NO: 693443 - protein, 9 aa, Homo Sapiens
CLDFLWRVQ

SEQ ID NO: 693444 - protein, 9 aa, Homo Sapiens
DKAYILSMQ

SEQ ID NO: 693445 - protein, 9 aa, Homo Sapiens
SKNVDCPEN

SEQ ID NO: 693446 - protein, 9 aa, Homo Sapiens
APGIEIYEE

SEQ ID NO: 693447 - protein, 9 aa, Homo Sapiens
IKLCKLQPG

SEQ ID NO: 693448 - protein, 9 aa, Homo Sapiens
PARFCVLGT

SEQ ID NO: 693449 - protein, 9 aa, Homo Sapiens
SSTLANDKI

SEQ ID NO: 693450 - protein, 9 aa, Homo Sapiens
TPTACSFSY

SEQ ID NO: 693451 - protein, 9 aa, Homo Sapiens
AVRDHEKRL

SEQ ID NO: 693452 - protein, 9 aa, Homo Sapiens
RNACAAAKK

SEQ ID NO: 693453 - protein, 9 aa, Homo Sapiens
DDQNEDQDV

SEQ ID NO: 693454 - protein, 9 aa, Homo Sapiens
AVGPYESRM

SEQ ID NO: 693455 - protein, 9 aa, Homo Sapiens
QRHLPFLEA

SEQ ID NO: 693456 - protein, 9 aa, Homo Sapiens
MRWTAPEAI

SEQ ID NO: 693457 - protein, 9 aa, Homo Sapiens
KTKAFTTIQ

SEQ ID NO: 693458 - protein, 9 aa, Homo Sapiens
EQKEAKFKA

SEQ ID NO: 693459 - protein, 9 aa, Homo Sapiens
QQSTLESEE

SEQ ID NO: 693460 - protein, 9 aa, Homo Sapiens
ARALGSLRM

SEQ ID NO: 693461 - protein, 9 aa, Homo Sapiens
ELCGKTLTP

SEQ ID NO: 693462 - protein, 9 aa, Homo Sapiens
NLDEHIKKV

SEQ ID NO: 693463 - protein, 9 aa, Homo Sapiens
DVAMNFHWP

SEQ ID NO: 693464 - protein, 9 aa, Homo Sapiens
LGTLHGTIC

SEQ ID NO: 693465 - protein, 9 aa, Homo Sapiens
LIEDFKTLR

SEQ ID NO: 693466 - protein, 9 aa, Homo Sapiens
PQGRNCSIA

SEQ ID NO: 693467 - protein, 9 aa, Homo Sapiens
NHVPKNFFF

SEQ ID NO: 693468 - protein, 9 aa, Homo Sapiens
KAKSLSRNP

SEQ ID NO: 693469 - protein, 9 aa, Homo Sapiens
EEQRLFRKR

SEQ ID NO: 693470 - protein, 9 aa, Homo Sapiens
LVAILYDGW

SEQ ID NO: 693471 - protein, 9 aa, Homo Sapiens
SPREALTEA

SEQ ID NO: 693472 - protein, 9 aa, Homo Sapiens
LCGKTLTPG

SEQ ID NO: 693473 - protein, 9 aa, Homo Sapiens
WQSSILVQF

SEQ ID NO: 693474 - protein, 9 aa, Homo Sapiens
KGDAPYSLV

SEQ ID NO: 693475 - protein, 9 aa, Homo Sapiens
YDDIIQQEY

SEQ ID NO: 693476 - protein, 9 aa, Homo Sapiens
KQLQKADAY

SEQ ID NO: 693477 - protein, 9 aa, Homo Sapiens
LPPSADDNM

SEQ ID NO: 693478 - protein, 9 aa, Homo Sapiens
GRLKTSETA

SEQ ID NO: 693479 - protein, 9 aa, Homo Sapiens
RGKASGQGN

SEQ ID NO: 693480 - protein, 9 aa, Homo Sapiens
KAYILSMQK

SEQ ID NO: 693481 - protein, 9 aa, Homo Sapiens
KNTEWSREE

SEQ ID NO: 693482 - protein, 9 aa, Homo Sapiens
ARTLKEEEK

SEQ ID NO: 693483 - protein, 9 aa, Homo Sapiens
LCPSLEKAQ

SEQ ID NO: 693484 - protein, 9 aa, Homo Sapiens
SKDKEDQWV

SEQ ID NO: 693485 - protein, 9 aa, Homo Sapiens
ETAGEGENS

SEQ ID NO: 693486 - protein, 9 aa, Homo Sapiens
TNKTLHSDI

SEQ ID NO: 693487 - protein, 9 aa, Homo Sapiens
EQAHPSAPC

SEQ ID NO: 693488 - protein, 9 aa, Homo Sapiens
SPEASQQTY

SEQ ID NO: 693489 - protein, 9 aa, Homo Sapiens
SMNELLMLT

SEQ ID NO: 693490 - protein, 9 aa, Homo Sapiens
SSLRSCWSG

SEQ ID NO: 693491 - protein, 9 aa, Homo Sapiens
ASMLQCLAT

SEQ ID NO: 693492 - protein, 9 aa, Homo Sapiens
RTGRAGNKE

SEQ ID NO: 693493 - protein, 9 aa, Homo Sapiens
YAIYQERRM

SEQ ID NO: 693494 - protein, 9 aa, Homo Sapiens
AMCQHFYKR

SEQ ID NO: 693495 - protein, 9 aa, Homo Sapiens
HLGVSEGGG

SEQ ID NO: 693496 - protein, 9 aa, Homo Sapiens
YKHRVHVIE

SEQ ID NO: 693497 - protein, 9 aa, Homo Sapiens
ESEEARLSV

SEQ ID NO: 693498 - protein, 9 aa, Homo Sapiens
QHLYGYVTM

SEQ ID NO: 693499 - protein, 9 aa, Homo Sapiens
RRGRQQSTL

SEQ ID NO: 693500 - protein, 9 aa, Homo Sapiens
LWVPNNGVH

SEQ ID NO: 693501 - protein, 9 aa, Homo Sapiens
VVSARPLSS

SEQ ID NO: 693502 - protein, 9 aa, Homo Sapiens
IKFRKDIIR

SEQ ID NO: 693503 - protein, 9 aa, Homo Sapiens
DLQASCLLG

SEQ ID NO: 693504 - protein, 9 aa, Homo Sapiens
EHFKNHWKG

SEQ ID NO: 693505 - protein, 9 aa, Homo Sapiens
ECETSKAFP

SEQ ID NO: 693506 - protein, 9 aa, Homo Sapiens
TLNVLHNTG

SEQ ID NO: 693507 - protein, 9 aa, Homo Sapiens
RLPAAGSSS

SEQ ID NO: 693508 - protein, 9 aa, Homo Sapiens
QNTLQQLRQ

SEQ ID NO: 693509 - protein, 9 aa, Homo Sapiens
CEHVNEEKA

SEQ ID NO: 693510 - protein, 9 aa, Homo Sapiens
QAEILNSDA

SEQ ID NO: 693511 - protein, 9 aa, Homo Sapiens
DINVNFDFT

SEQ ID NO: 693512 - protein, 9 aa, Homo Sapiens
VLPAAGGAQ

SEQ ID NO: 693513 - protein, 9 aa, Homo Sapiens
TLLIKLCKL

SEQ ID NO: 693514 - protein, 9 aa, Homo Sapiens
IFALVKYNQ

SEQ ID NO: 693515 - protein, 9 aa, Homo Sapiens
QMPPPRVFK

SEQ ID NO: 693516 - protein, 9 aa, Homo Sapiens
RCAGRMEVW

SEQ ID NO: 693517 - protein, 9 aa, Homo Sapiens
WPAASRVWT

SEQ ID NO: 693518 - protein, 9 aa, Homo Sapiens
MKDLLQDLS

SEQ ID NO: 693519 - protein, 9 aa, Homo Sapiens
AYGDTVIIP

SEQ ID NO: 693520 - protein, 9 aa, Homo Sapiens
IDEMNDIRI

SEQ ID NO: 693521 - protein, 9 aa, Homo Sapiens
ESLQCSLDW

SEQ ID NO: 693522 - protein, 9 aa, Homo Sapiens
GEPTASGLP

SEQ ID NO: 693523 - protein, 9 aa, Homo Sapiens
RLSTAVTDL

SEQ ID NO: 693524 - protein, 9 aa, Homo Sapiens
LYISDVAMN

SEQ ID NO: 693525 - protein, 9 aa, Homo Sapiens
TRGGKIPMR

SEQ ID NO: 693526 - protein, 9 aa, Homo Sapiens
LEYTACLDF

SEQ ID NO: 693527 - protein, 9 aa, Homo Sapiens
MDLSISHKN

SEQ ID NO: 693528 - protein, 9 aa, Homo Sapiens
GQCHSFYIP

SEQ ID NO: 693529 - protein, 9 aa, Homo Sapiens
VFGTQLVGT

SEQ ID NO: 693530 - protein, 9 aa, Homo Sapiens
SFKEKLSQK

SEQ ID NO: 693531 - protein, 9 aa, Homo Sapiens
LQLAIRNHE

SEQ ID NO: 693532 - protein, 9 aa, Homo Sapiens
TDDEVSRFV

SEQ ID NO: 693533 - protein, 9 aa, Homo Sapiens
TPITLLGPC

SEQ ID NO: 693534 - protein, 9 aa, Homo Sapiens
WPEEFDHYV

SEQ ID NO: 693535 - protein, 9 aa, Homo Sapiens
LKETSPLTR

SEQ ID NO: 693536 - protein, 9 aa, Homo Sapiens
NITLFAIGV

SEQ ID NO: 693537 - protein, 9 aa, Homo Sapiens
FTHILLCSQ

SEQ ID NO: 693538 - protein, 9 aa, Homo Sapiens
HEAKENKEG

SEQ ID NO: 693539 - protein, 9 aa, Homo Sapiens
IKDSSMGRQ

SEQ ID NO: 693540 - protein, 9 aa, Homo Sapiens
MQQLLAAFT

SEQ ID NO: 693541 - protein, 9 aa, Homo Sapiens
SIVDTTGLK

SEQ ID NO: 693542 - protein, 9 aa, Homo Sapiens
DKRIPSMAG

SEQ ID NO: 693543 - protein, 9 aa, Homo Sapiens
MTSTVISVK

SEQ ID NO: 693544 - protein, 9 aa, Homo Sapiens
RGVQPAPFL

SEQ ID NO: 693545 - protein, 9 aa, Homo Sapiens
NFPDAKENK

SEQ ID NO: 693546 - protein, 9 aa, Homo Sapiens
QDYLCSLHS

SEQ ID NO: 693547 - protein, 9 aa, Homo Sapiens
EFQIAKKHV

SEQ ID NO: 693548 - protein, 9 aa, Homo Sapiens
HFVLQYLNK

SEQ ID NO: 693549 - protein, 9 aa, Homo Sapiens
RGCKRKRSW

SEQ ID NO: 693550 - protein, 9 aa, Homo Sapiens
RTEQSNFGS

SEQ ID NO: 693551 - protein, 9 aa, Homo Sapiens
SPKTPPRWT

SEQ ID NO: 693552 - protein, 9 aa, Homo Sapiens
LLPVLQISL

SEQ ID NO: 693553 - protein, 9 aa, Homo Sapiens
GQDRATALL

SEQ ID NO: 693554 - protein, 9 aa, Homo Sapiens
KFNWFVDGV

SEQ ID NO: 693555 - protein, 9 aa, Homo Sapiens
PPKRGLVVR

SEQ ID NO: 693556 - protein, 9 aa, Homo Sapiens
PPQLLERRG

SEQ ID NO: 693557 - protein, 9 aa, Homo Sapiens
ELVQEYYKI

SEQ ID NO: 693558 - protein, 9 aa, Homo Sapiens
WNTMKKPLH

SEQ ID NO: 693559 - protein, 9 aa, Homo Sapiens
TVITIVMKA

SEQ ID NO: 693560 - protein, 9 aa, Homo Sapiens
GSITFWHNL

SEQ ID NO: 693561 - protein, 9 aa, Homo Sapiens
YRVTKGRGI

SEQ ID NO: 693562 - protein, 9 aa, Homo Sapiens
LRCELCGKT

SEQ ID NO: 693563 - protein, 9 aa, Homo Sapiens
GIAKLVHFS

SEQ ID NO: 693564 - protein, 9 aa, Homo Sapiens
EIFQLMQFL

SEQ ID NO: 693565 - protein, 9 aa, Homo Sapiens
QDDKNRQLT

SEQ ID NO: 693566 - protein, 9 aa, Homo Sapiens
KIEKVPELT

SEQ ID NO: 693567 - protein, 9 aa, Homo Sapiens
ETWAVPVVL

SEQ ID NO: 693568 - protein, 9 aa, Homo Sapiens
PRWTEDQNS

SEQ ID NO: 693569 - protein, 9 aa, Homo Sapiens
HRHIITVGT

SEQ ID NO: 693570 - protein, 9 aa, Homo Sapiens
LFFEGNRSQ

SEQ ID NO: 693571 - protein, 9 aa, Homo Sapiens
SFLQDSNIT

SEQ ID NO: 693572 - protein, 9 aa, Homo Sapiens
TPAKGPVVT

SEQ ID NO: 693573 - protein, 9 aa, Homo Sapiens
RGDSEHRRG

SEQ ID NO: 693574 - protein, 9 aa, Homo Sapiens
NQNPNNFQE

SEQ ID NO: 693575 - protein, 9 aa, Homo Sapiens
LEEGESFVC

SEQ ID NO: 693576 - protein, 9 aa, Homo Sapiens
QDRDDMADE

SEQ ID NO: 693577 - protein, 9 aa, Homo Sapiens
PGVIECWFV

SEQ ID NO: 693578 - protein, 9 aa, Homo Sapiens
YENQTPLWV

SEQ ID NO: 693579 - protein, 9 aa, Homo Sapiens
CKLEKRTKV

SEQ ID NO: 693580 - protein, 9 aa, Homo Sapiens
IFHGLHQAL

SEQ ID NO: 693581 - protein, 9 aa, Homo Sapiens
HYNILTRIT

SEQ ID NO: 693582 - protein, 9 aa, Homo Sapiens
VVHGLRRRA

SEQ ID NO: 693583 - protein, 9 aa, Homo Sapiens
HLAEMAQSS

SEQ ID NO: 693584 - protein, 9 aa, Homo Sapiens
SQVVHRHSR

SEQ ID NO: 693585 - protein, 9 aa, Homo Sapiens
FFECVDWER

SEQ ID NO: 693586 - protein, 9 aa, Homo Sapiens
GTYGRVFHF

SEQ ID NO: 693587 - protein, 9 aa, Homo Sapiens
PPRHNQGHC

SEQ ID NO: 693588 - protein, 9 aa, Homo Sapiens
PINRQRLHC

SEQ ID NO: 693589 - protein, 9 aa, Homo Sapiens
DSSQDKEGS

SEQ ID NO: 693590 - protein, 9 aa, Homo Sapiens
TAKVMVSQP

SEQ ID NO: 693591 - protein, 9 aa, Homo Sapiens
FEAQGARPR

SEQ ID NO: 693592 - protein, 9 aa, Homo Sapiens
SPQVVYEVA

SEQ ID NO: 693593 - protein, 9 aa, Homo Sapiens
SEIAQSSHY

SEQ ID NO: 693594 - protein, 9 aa, Homo Sapiens
HTAIQKASN

SEQ ID NO: 693595 - protein, 9 aa, Homo Sapiens
KASEEVRHL

SEQ ID NO: 693596 - protein, 9 aa, Homo Sapiens
TVSVGDGLS

SEQ ID NO: 693597 - protein, 9 aa, Homo Sapiens
HHVVRKTDA

SEQ ID NO: 693598 - protein, 9 aa, Homo Sapiens
KVQKMLISS

SEQ ID NO: 693599 - protein, 9 aa, Homo Sapiens
TLKMEAKFE

SEQ ID NO: 693600 - protein, 9 aa, Homo Sapiens
KISNFLVEK

SEQ ID NO: 693601 - protein, 9 aa, Homo Sapiens
TLLLLLVAG

SEQ ID NO: 693602 - protein, 9 aa, Homo Sapiens
AVCVLGSGL

SEQ ID NO: 693603 - protein, 9 aa, Homo Sapiens
HELSLKQPQ

SEQ ID NO: 693604 - protein, 9 aa, Homo Sapiens
ASEEVRHLK

SEQ ID NO: 693605 - protein, 9 aa, Homo Sapiens
AVSAGPGVI

SEQ ID NO: 693606 - protein, 9 aa, Homo Sapiens
AKGVAEKVE

SEQ ID NO: 693607 - protein, 9 aa, Homo Sapiens
SYVLSGNGK

SEQ ID NO: 693608 - protein, 9 aa, Homo Sapiens
SKTSNHYSF

SEQ ID NO: 693609 - protein, 9 aa, Homo Sapiens
LGDCDLGIQ

SEQ ID NO: 693610 - protein, 9 aa, Homo Sapiens
KLPHRNACA

SEQ ID NO: 693611 - protein, 9 aa, Homo Sapiens
STWLYEAEA

SEQ ID NO: 693612 - protein, 9 aa, Homo Sapiens
REALTEAMH

SEQ ID NO: 693613 - protein, 9 aa, Homo Sapiens
NHHPFHTDL

SEQ ID NO: 693614 - protein, 9 aa, Homo Sapiens
PDPAVFRKW

SEQ ID NO: 693615 - protein, 9 aa, Homo Sapiens
TLEGTAVFV

SEQ ID NO: 693616 - protein, 9 aa, Homo Sapiens
AMITNTNNG

SEQ ID NO: 693617 - protein, 9 aa, Homo Sapiens
EIQGVIKFR

SEQ ID NO: 693618 - protein, 9 aa, Homo Sapiens
EENRLKKMK

SEQ ID NO: 693619 - protein, 9 aa, Homo Sapiens
GNKEKAITF

SEQ ID NO: 693620 - protein, 9 aa, Homo Sapiens
IHMEERFMA

SEQ ID NO: 693621 - protein, 9 aa, Homo Sapiens
DSIDDTLED

SEQ ID NO: 693622 - protein, 9 aa, Homo Sapiens
ASSNQEGKS

SEQ ID NO: 693623 - protein, 9 aa, Homo Sapiens
GQLGVQALK

SEQ ID NO: 693624 - protein, 9 aa, Homo Sapiens
VTAVRRQVR

SEQ ID NO: 693625 - protein, 9 aa, Homo Sapiens
TYSYDKSIE

SEQ ID NO: 693626 - protein, 9 aa, Homo Sapiens
EVVSTGLDS

SEQ ID NO: 693627 - protein, 9 aa, Homo Sapiens
VDSEVVMLC

SEQ ID NO: 693628 - protein, 9 aa, Homo Sapiens
GGVSENARM

SEQ ID NO: 693629 - protein, 9 aa, Homo Sapiens
LCPRGSSPW

SEQ ID NO: 693630 - protein, 9 aa, Homo Sapiens
GPPGARLLS

SEQ ID NO: 693631 - protein, 9 aa, Homo Sapiens
EQGSQSLGQ

SEQ ID NO: 693632 - protein, 9 aa, Homo Sapiens
QVSLILQNS

SEQ ID NO: 693633 - protein, 9 aa, Homo Sapiens
DDTCGRHHS

SEQ ID NO: 693634 - protein, 9 aa, Homo Sapiens
VASIKTGLQ

SEQ ID NO: 693635 - protein, 9 aa, Homo Sapiens
WMYLMGFYS

SEQ ID NO: 693636 - protein, 9 aa, Homo Sapiens
AEKKQQKEQ

SEQ ID NO: 693637 - protein, 9 aa, Homo Sapiens
IRSPAGSAE

SEQ ID NO: 693638 - protein, 9 aa, Homo Sapiens
NCFATDLSS

SEQ ID NO: 693639 - protein, 9 aa, Homo Sapiens
QKVIPTRYG

SEQ ID NO: 693640 - protein, 9 aa, Homo Sapiens
QRRVLGNLM

SEQ ID NO: 693641 - protein, 9 aa, Homo Sapiens
HSWSIPVGF

SEQ ID NO: 693642 - protein, 9 aa, Homo Sapiens
QTQDTELME

SEQ ID NO: 693643 - protein, 9 aa, Homo Sapiens
DEVSRFVAQ

SEQ ID NO: 693644 - protein, 9 aa, Homo Sapiens
ETSKAFPLE

SEQ ID NO: 693645 - protein, 9 aa, Homo Sapiens
CAGRMEVWH

SEQ ID NO: 693646 - protein, 9 aa, Homo Sapiens
CDTITLSKI

SEQ ID NO: 693647 - protein, 9 aa, Homo Sapiens
LFRHLHLRQ

SEQ ID NO: 693648 - protein, 9 aa, Homo Sapiens
FWHNLNYWQ

SEQ ID NO: 693649 - protein, 9 aa, Homo Sapiens
HLGSGRIPR

SEQ ID NO: 693650 - protein, 9 aa, Homo Sapiens
YSLPTLEVS

SEQ ID NO: 693651 - protein, 9 aa, Homo Sapiens
SGNYHLPSI

SEQ ID NO: 693652 - protein, 9 aa, Homo Sapiens
KCKNEGNCV

SEQ ID NO: 693653 - protein, 9 aa, Homo Sapiens
LPPAYYRYI

SEQ ID NO: 693654 - protein, 9 aa, Homo Sapiens
HHNAHHCLK

SEQ ID NO: 693655 - protein, 9 aa, Homo Sapiens
EDVEENRSP

SEQ ID NO: 693656 - protein, 9 aa, Homo Sapiens
PQRQRHLDN

SEQ ID NO: 693657 - protein, 9 aa, Homo Sapiens
GAGGSGTGP

SEQ ID NO: 693658 - protein, 9 aa, Homo Sapiens
NVVVKKLSS

SEQ ID NO: 693659 - protein, 9 aa, Homo Sapiens
RRGLSGCSM

SEQ ID NO: 693660 - protein, 9 aa, Homo Sapiens
VLGPDPVCS

SEQ ID NO: 693661 - protein, 9 aa, Homo Sapiens
AGPAGIIGP

SEQ ID NO: 693662 - protein, 9 aa, Homo Sapiens
CVLGSGLGL

SEQ ID NO: 693663 - protein, 9 aa, Homo Sapiens
CHSPSLIKH

SEQ ID NO: 693664 - protein, 9 aa, Homo Sapiens
WSGNWWCWG

SEQ ID NO: 693665 - protein, 9 aa, Homo Sapiens
LSDSSQDKE

SEQ ID NO: 693666 - protein, 9 aa, Homo Sapiens
EQRLFRKRA

SEQ ID NO: 693667 - protein, 9 aa, Homo Sapiens
PPEEEDDQN

SEQ ID NO: 693668 - protein, 9 aa, Homo Sapiens
EDKYELLMP

SEQ ID NO: 693669 - protein, 9 aa, Homo Sapiens
VRSLSFHRH

SEQ ID NO: 693670 - protein, 9 aa, Homo Sapiens
QDGSYQCSH

SEQ ID NO: 693671 - protein, 9 aa, Homo Sapiens
RYLFRNESV

SEQ ID NO: 693672 - protein, 9 aa, Homo Sapiens
RRTICRLER

SEQ ID NO: 693673 - protein, 9 aa, Homo Sapiens
RSEIAQSSH

SEQ ID NO: 693674 - protein, 9 aa, Homo Sapiens
KGLNHMNNG

SEQ ID NO: 693675 - protein, 9 aa, Homo Sapiens
VSCSGCKRI

SEQ ID NO: 693676 - protein, 9 aa, Homo Sapiens
ANSTLNNLD

SEQ ID NO: 693677 - protein, 9 aa, Homo Sapiens
LDLKEEGLW

SEQ ID NO: 693678 - protein, 9 aa, Homo Sapiens
KLMLEQQEM

SEQ ID NO: 693679 - protein, 9 aa, Homo Sapiens
TWLAIKCST

SEQ ID NO: 693680 - protein, 9 aa, Homo Sapiens
VGTYGRVFH

SEQ ID NO: 693681 - protein, 9 aa, Homo Sapiens
VFSVFAPSG

SEQ ID NO: 693682 - protein, 9 aa, Homo Sapiens
TDNLRFIWQ

SEQ ID NO: 693683 - protein, 9 aa, Homo Sapiens
KENLLEYDK

SEQ ID NO: 693684 - protein, 9 aa, Homo Sapiens
KTKQSFCLS

SEQ ID NO: 693685 - protein, 9 aa, Homo Sapiens
DVRLNAIPI

SEQ ID NO: 693686 - protein, 9 aa, Homo Sapiens
ANENSTLPQ

SEQ ID NO: 693687 - protein, 9 aa, Homo Sapiens
SRFVAQAQP

SEQ ID NO: 693688 - protein, 9 aa, Homo Sapiens
HMNLMEVSY

SEQ ID NO: 693689 - protein, 9 aa, Homo Sapiens
DAPDHDSLK

SEQ ID NO: 693690 - protein, 9 aa, Homo Sapiens
PGGVFVNLL

SEQ ID NO: 693691 - protein, 9 aa, Homo Sapiens
DDKDFVLNS

SEQ ID NO: 693692 - protein, 9 aa, Homo Sapiens
AFHQRISLC

SEQ ID NO: 693693 - protein, 9 aa, Homo Sapiens
FELDLCDPS

SEQ ID NO: 693694 - protein, 9 aa, Homo Sapiens
DFSLMGLFR

SEQ ID NO: 693695 - protein, 9 aa, Homo Sapiens
ANKMALRYP

SEQ ID NO: 693696 - protein, 9 aa, Homo Sapiens
RWPSAEQEE

SEQ ID NO: 693697 - protein, 9 aa, Homo Sapiens
ESEFHTSAA

SEQ ID NO: 693698 - protein, 9 aa, Homo Sapiens
NNNKSIGCF

SEQ ID NO: 693699 - protein, 9 aa, Homo Sapiens
YPQQINEHK

SEQ ID NO: 693700 - protein, 9 aa, Homo Sapiens
HVLPKMKAE

SEQ ID NO: 693701 - protein, 9 aa, Homo Sapiens
HEFIALTNT

SEQ ID NO: 693702 - protein, 9 aa, Homo Sapiens
LKEEEKRDI

SEQ ID NO: 693703 - protein, 9 aa, Homo Sapiens
LRIGLAFLV

SEQ ID NO: 693704 - protein, 9 aa, Homo Sapiens
KKIISLANN

SEQ ID NO: 693705 - protein, 9 aa, Homo Sapiens
LLLANQKTR

SEQ ID NO: 693706 - protein, 9 aa, Homo Sapiens
LYSLRLSVG

SEQ ID NO: 693707 - protein, 9 aa, Homo Sapiens
GVVQDDKFL

SEQ ID NO: 693708 - protein, 9 aa, Homo Sapiens
GPPGESGGK

SEQ ID NO: 693709 - protein, 9 aa, Homo Sapiens
NSATGKESY

SEQ ID NO: 693710 - protein, 9 aa, Homo Sapiens
SQMSQERGV

SEQ ID NO: 693711 - protein, 9 aa, Homo Sapiens
KCAMKTLAQ

SEQ ID NO: 693712 - protein, 9 aa, Homo Sapiens
PCPNFGKNI

SEQ ID NO: 693713 - protein, 9 aa, Homo Sapiens
AQSEAGSLV

SEQ ID NO: 693714 - protein, 9 aa, Homo Sapiens
SSFTGAYTS

SEQ ID NO: 693715 - protein, 9 aa, Homo Sapiens
NLTEQDPKH

SEQ ID NO: 693716 - protein, 9 aa, Homo Sapiens
SLHSLMSTL

SEQ ID NO: 693717 - protein, 9 aa, Homo Sapiens
MEEHAAPSE

SEQ ID NO: 693718 - protein, 9 aa, Homo Sapiens
VTEHPPSGI

SEQ ID NO: 693719 - protein, 9 aa, Homo Sapiens
TMDKTIVLP

SEQ ID NO: 693720 - protein, 9 aa, Homo Sapiens
NCHMNLMEV

SEQ ID NO: 693721 - protein, 9 aa, Homo Sapiens
SLAASFHQP

SEQ ID NO: 693722 - protein, 9 aa, Homo Sapiens
KKVDQNWYE

SEQ ID NO: 693723 - protein, 9 aa, Homo Sapiens
YQLCNTKEC

SEQ ID NO: 693724 - protein, 9 aa, Homo Sapiens
PLWVPNNGV

SEQ ID NO: 693725 - protein, 9 aa, Homo Sapiens
HSDISCPLL

SEQ ID NO: 693726 - protein, 9 aa, Homo Sapiens
LANNHILLW

SEQ ID NO: 693727 - protein, 9 aa, Homo Sapiens
FLCEIPCKL

SEQ ID NO: 693728 - protein, 9 aa, Homo Sapiens
HFKLHPHDV

SEQ ID NO: 693729 - protein, 9 aa, Homo Sapiens
SVHHCSIPR

SEQ ID NO: 693730 - protein, 9 aa, Homo Sapiens
MQDMIRSQD

SEQ ID NO: 693731 - protein, 9 aa, Homo Sapiens
KLQKLRPDP

SEQ ID NO: 693732 - protein, 9 aa, Homo Sapiens
CVSPVSENQ

SEQ ID NO: 693733 - protein, 9 aa, Homo Sapiens
AISCCDTHT

SEQ ID NO: 693734 - protein, 9 aa, Homo Sapiens
TDVGYVENG

SEQ ID NO: 693735 - protein, 9 aa, Homo Sapiens
LKEGRSFSG

SEQ ID NO: 693736 - protein, 9 aa, Homo Sapiens
LPLVTRPRL

SEQ ID NO: 693737 - protein, 9 aa, Homo Sapiens
EEEKLMKQG

SEQ ID NO: 693738 - protein, 9 aa, Homo Sapiens
SFRRRTEQN

SEQ ID NO: 693739 - protein, 9 aa, Homo Sapiens
GEYSLPTLE

SEQ ID NO: 693740 - protein, 9 aa, Homo Sapiens
ITVSDKAYI

SEQ ID NO: 693741 - protein, 9 aa, Homo Sapiens
NKNGLQLGV

SEQ ID NO: 693742 - protein, 9 aa, Homo Sapiens
GIASKTLTL

SEQ ID NO: 693743 - protein, 9 aa, Homo Sapiens
SFLTKRYSP

SEQ ID NO: 693744 - protein, 9 aa, Homo Sapiens
CRPLRVRDN

SEQ ID NO: 693745 - protein, 9 aa, Homo Sapiens
MKMRIEHVW

SEQ ID NO: 693746 - protein, 9 aa, Homo Sapiens
AYDRYVAIN

SEQ ID NO: 693747 - protein, 9 aa, Homo Sapiens
GMGWGFPLV

SEQ ID NO: 693748 - protein, 9 aa, Homo Sapiens
GNSGGWSAV

SEQ ID NO: 693749 - protein, 9 aa, Homo Sapiens
ELSGRDAAH

SEQ ID NO: 693750 - protein, 9 aa, Homo Sapiens
FARTKEKAK

SEQ ID NO: 693751 - protein, 9 aa, Homo Sapiens
IPSRNTDTL

SEQ ID NO: 693752 - protein, 9 aa, Homo Sapiens
MPAKQSEEG

SEQ ID NO: 693753 - protein, 9 aa, Homo Sapiens
QVIGAVTTV

SEQ ID NO: 693754 - protein, 9 aa, Homo Sapiens
KPKLDTVQK

SEQ ID NO: 693755 - protein, 9 aa, Homo Sapiens
LFLLQPTST

SEQ ID NO: 693756 - protein, 9 aa, Homo Sapiens
NVLFYTTQQ

SEQ ID NO: 693757 - protein, 9 aa, Homo Sapiens
TPTTPSSLR

SEQ ID NO: 693758 - protein, 9 aa, Homo Sapiens
TSGDPPPSA

SEQ ID NO: 693759 - protein, 9 aa, Homo Sapiens
CANSTLNNL

SEQ ID NO: 693760 - protein, 9 aa, Homo Sapiens
DSLQKVIPT

SEQ ID NO: 693761 - protein, 9 aa, Homo Sapiens
SPHTGDSGK

SEQ ID NO: 693762 - protein, 9 aa, Homo Sapiens
ISYPILHEW

SEQ ID NO: 693763 - protein, 9 aa, Homo Sapiens
NAMQAIPRK

SEQ ID NO: 693764 - protein, 9 aa, Homo Sapiens
YWRKTHQDY

SEQ ID NO: 693765 - protein, 9 aa, Homo Sapiens
VISQRTEVL

SEQ ID NO: 693766 - protein, 9 aa, Homo Sapiens
LDDYMEGRE

SEQ ID NO: 693767 - protein, 9 aa, Homo Sapiens
WFLYRPKAP

SEQ ID NO: 693768 - protein, 9 aa, Homo Sapiens
RAQRERARA

SEQ ID NO: 693769 - protein, 9 aa, Homo Sapiens
ETGHTDDEF

SEQ ID NO: 693770 - protein, 9 aa, Homo Sapiens
PISLLYNMN

SEQ ID NO: 693771 - protein, 9 aa, Homo Sapiens
TYLYTLGAQ

SEQ ID NO: 693772 - protein, 9 aa, Homo Sapiens
YIHTMNAMI

SEQ ID NO: 693773 - protein, 9 aa, Homo Sapiens
STLPQAAML

SEQ ID NO: 693774 - protein, 9 aa, Homo Sapiens
RVSETSSAG

SEQ ID NO: 693775 - protein, 9 aa, Homo Sapiens
WSALTFCLP

SEQ ID NO: 693776 - protein, 9 aa, Homo Sapiens
QLLSQVDFE

SEQ ID NO: 693777 - protein, 9 aa, Homo Sapiens
PFLYSLRLS

SEQ ID NO: 693778 - protein, 9 aa, Homo Sapiens
GFQTGTSFL

SEQ ID NO: 693779 - protein, 9 aa, Homo Sapiens
EIRSPAGSA

SEQ ID NO: 693780 - protein, 9 aa, Homo Sapiens
AVVSRGAQE

SEQ ID NO: 693781 - protein, 9 aa, Homo Sapiens
SPLCKERQA

SEQ ID NO: 693782 - protein, 9 aa, Homo Sapiens
QAPEATSGL

SEQ ID NO: 693783 - protein, 9 aa, Homo Sapiens
VEVTDAEDY

SEQ ID NO: 693784 - protein, 9 aa, Homo Sapiens
ILCFWETQP

SEQ ID NO: 693785 - protein, 9 aa, Homo Sapiens
PSIGIKHYN

SEQ ID NO: 693786 - protein, 9 aa, Homo Sapiens
TNCHMNLME

SEQ ID NO: 693787 - protein, 9 aa, Homo Sapiens
WDEEADFGD

SEQ ID NO: 693788 - protein, 9 aa, Homo Sapiens
PPLTFHIIR

SEQ ID NO: 693789 - protein, 9 aa, Homo Sapiens
TAFGTVGGL

SEQ ID NO: 693790 - protein, 9 aa, Homo Sapiens
AADSGEPQR

SEQ ID NO: 693791 - protein, 9 aa, Homo Sapiens
QFFVLEEHI

SEQ ID NO: 693792 - protein, 9 aa, Homo Sapiens
RRYLLQPLE

SEQ ID NO: 693793 - protein, 9 aa, Homo Sapiens
FAYRKLCPH

SEQ ID NO: 693794 - protein, 9 aa, Homo Sapiens
NSGSTCSES

SEQ ID NO: 693795 - protein, 9 aa, Homo Sapiens
DALAVQDDQ

SEQ ID NO: 693796 - protein, 9 aa, Homo Sapiens
VLPPLQQEY

SEQ ID NO: 693797 - protein, 9 aa, Homo Sapiens
SWKMAAVFL

SEQ ID NO: 693798 - protein, 9 aa, Homo Sapiens
EHIKKVSQQ

SEQ ID NO: 693799 - protein, 9 aa, Homo Sapiens
VDMGSMNGQ

SEQ ID NO: 693800 - protein, 9 aa, Homo Sapiens
EAGYRKHLG

SEQ ID NO: 693801 - protein, 9 aa, Homo Sapiens
LPQAAMLSQ

SEQ ID NO: 693802 - protein, 9 aa, Homo Sapiens
FTCNHRVHT

SEQ ID NO: 693803 - protein, 9 aa, Homo Sapiens
SEHRRGPGQ

SEQ ID NO: 693804 - protein, 9 aa, Homo Sapiens
YILKTDNSS

SEQ ID NO: 693805 - protein, 9 aa, Homo Sapiens
ECGKGLRRS

SEQ ID NO: 693806 - protein, 9 aa, Homo Sapiens
SFSNVAEEE

SEQ ID NO: 693807 - protein, 9 aa, Homo Sapiens
NPAMMQDMI

SEQ ID NO: 693808 - protein, 9 aa, Homo Sapiens
EMKALGDRV

SEQ ID NO: 693809 - protein, 9 aa, Homo Sapiens
ISNFLVEKS

SEQ ID NO: 693810 - protein, 9 aa, Homo Sapiens
RPLLVSDVM

SEQ ID NO: 693811 - protein, 9 aa, Homo Sapiens
PREALTEAM

SEQ ID NO: 693812 - protein, 9 aa, Homo Sapiens
NISSLFHFC

SEQ ID NO: 693813 - protein, 9 aa, Homo Sapiens
PLTGKALDR

SEQ ID NO: 693814 - protein, 9 aa, Homo Sapiens
SFKIGNLLV

SEQ ID NO: 693815 - protein, 9 aa, Homo Sapiens
MAKGCQESG

SEQ ID NO: 693816 - protein, 9 aa, Homo Sapiens
VLCHDTTWP

SEQ ID NO: 693817 - protein, 9 aa, Homo Sapiens
GEPFGHEGF

SEQ ID NO: 693818 - protein, 9 aa, Homo Sapiens
QRRACYRWS

SEQ ID NO: 693819 - protein, 9 aa, Homo Sapiens
SQKRIMPDP

SEQ ID NO: 693820 - protein, 9 aa, Homo Sapiens
KKIMEEESR

SEQ ID NO: 693821 - protein, 9 aa, Homo Sapiens
WLYEAEALL

SEQ ID NO: 693822 - protein, 9 aa, Homo Sapiens
MRELGSWLS

SEQ ID NO: 693823 - protein, 9 aa, Homo Sapiens
AYKPGAAPA

SEQ ID NO: 693824 - protein, 9 aa, Homo Sapiens
ILNKEETSP

SEQ ID NO: 693825 - protein, 9 aa, Homo Sapiens
GLDDYMEGR

SEQ ID NO: 693826 - protein, 9 aa, Homo Sapiens
CAECRSRGQ

SEQ ID NO: 693827 - protein, 9 aa, Homo Sapiens
NHYPLTLYV

SEQ ID NO: 693828 - protein, 9 aa, Homo Sapiens
CKRILQKGQ

SEQ ID NO: 693829 - protein, 9 aa, Homo Sapiens
NSHAASFTW

SEQ ID NO: 693830 - protein, 9 aa, Homo Sapiens
NKLQKLRPD

SEQ ID NO: 693831 - protein, 9 aa, Homo Sapiens
SYDRQAESH

SEQ ID NO: 693832 - protein, 9 aa, Homo Sapiens
FTLYLVVAV

SEQ ID NO: 693833 - protein, 9 aa, Homo Sapiens
AASFTWKYE

SEQ ID NO: 693834 - protein, 9 aa, Homo Sapiens
EKEPKVLQD

SEQ ID NO: 693835 - protein, 9 aa, Homo Sapiens
EEKKGGPAG

SEQ ID NO: 693836 - protein, 9 aa, Homo Sapiens
HLKRQPKQR

SEQ ID NO: 693837 - protein, 9 aa, Homo Sapiens
SRALLNMQY

SEQ ID NO: 693838 - protein, 9 aa, Homo Sapiens
FDVEESLQC

SEQ ID NO: 693839 - protein, 9 aa, Homo Sapiens
MRIEHVWLQ

SEQ ID NO: 693840 - protein, 9 aa, Homo Sapiens
YEWQSSILV

SEQ ID NO: 693841 - protein, 9 aa, Homo Sapiens
AVRRTLLGV

SEQ ID NO: 693842 - protein, 9 aa, Homo Sapiens
RALAKVAPQ

SEQ ID NO: 693843 - protein, 9 aa, Homo Sapiens
KAEPSVFTA

SEQ ID NO: 693844 - protein, 9 aa, Homo Sapiens
EDILGNNGY

SEQ ID NO: 693845 - protein, 9 aa, Homo Sapiens
KVEVFLGMK

SEQ ID NO: 693846 - protein, 9 aa, Homo Sapiens
YETLKATQV

SEQ ID NO: 693847 - protein, 9 aa, Homo Sapiens
MLTFSGVIA

SEQ ID NO: 693848 - protein, 9 aa, Homo Sapiens
CDTHTNQLL

SEQ ID NO: 693849 - protein, 9 aa, Homo Sapiens
NMGTNACAL

SEQ ID NO: 693850 - protein, 9 aa, Homo Sapiens
FCAEEEPPS

SEQ ID NO: 693851 - protein, 9 aa, Homo Sapiens
SPDPSQLTE

SEQ ID NO: 693852 - protein, 9 aa, Homo Sapiens
FAVKAKKPK

SEQ ID NO: 693853 - protein, 9 aa, Homo Sapiens
LFFTFGNLN

SEQ ID NO: 693854 - protein, 9 aa, Homo Sapiens
LLEDRRTNR

SEQ ID NO: 693855 - protein, 9 aa, Homo Sapiens
NANFLDHFE

SEQ ID NO: 693856 - protein, 9 aa, Homo Sapiens
GNGREIGEF

SEQ ID NO: 693857 - protein, 9 aa, Homo Sapiens
ERRMEKINP

SEQ ID NO: 693858 - protein, 9 aa, Homo Sapiens
EDVDIIFTL

SEQ ID NO: 693859 - protein, 9 aa, Homo Sapiens
YLNNVLFYT

SEQ ID NO: 693860 - protein, 9 aa, Homo Sapiens
ASKRKAVVA

SEQ ID NO: 693861 - protein, 9 aa, Homo Sapiens
EPTASGLPR

SEQ ID NO: 693862 - protein, 9 aa, Homo Sapiens
LVVRITFIK

SEQ ID NO: 693863 - protein, 9 aa, Homo Sapiens
KSRPCIWSC

SEQ ID NO: 693864 - protein, 9 aa, Homo Sapiens
LFAVIFCAE

SEQ ID NO: 693865 - protein, 9 aa, Homo Sapiens
CFIRFLHII

SEQ ID NO: 693866 - protein, 9 aa, Homo Sapiens
NLLRIGLAF

SEQ ID NO: 693867 - protein, 9 aa, Homo Sapiens
DPHSPARFC

SEQ ID NO: 693868 - protein, 9 aa, Homo Sapiens
FIYQSSVKG

SEQ ID NO: 693869 - protein, 9 aa, Homo Sapiens
CLSPGSVAF

SEQ ID NO: 693870 - protein, 9 aa, Homo Sapiens
YSRQGAARF

SEQ ID NO: 693871 - protein, 9 aa, Homo Sapiens
MLFALSRKV

SEQ ID NO: 693872 - protein, 9 aa, Homo Sapiens
EDFSRAWDV

SEQ ID NO: 693873 - protein, 9 aa, Homo Sapiens
FEKASEEVR

SEQ ID NO: 693874 - protein, 9 aa, Homo Sapiens
LNMQYCPHC

SEQ ID NO: 693875 - protein, 9 aa, Homo Sapiens
CGHLVCAKC

SEQ ID NO: 693876 - protein, 9 aa, Homo Sapiens
LFDTAFGTV

SEQ ID NO: 693877 - protein, 9 aa, Homo Sapiens
LFERHLCVR

SEQ ID NO: 693878 - protein, 9 aa, Homo Sapiens
GHDWSALTF

SEQ ID NO: 693879 - protein, 9 aa, Homo Sapiens
LCPLPGTFA

SEQ ID NO: 693880 - protein, 9 aa, Homo Sapiens
IPTRYGKSG

SEQ ID NO: 693881 - protein, 9 aa, Homo Sapiens
AKQLQKADA

SEQ ID NO: 693882 - protein, 9 aa, Homo Sapiens
LVFLCFIFH

SEQ ID NO: 693883 - protein, 9 aa, Homo Sapiens
GKNKTICES

SEQ ID NO: 693884 - protein, 9 aa, Homo Sapiens
VAADSGEPQ

SEQ ID NO: 693885 - protein, 9 aa, Homo Sapiens
HFDINVNFD

SEQ ID NO: 693886 - protein, 9 aa, Homo Sapiens
NKPPLTFHI

SEQ ID NO: 693887 - protein, 9 aa, Homo Sapiens
GDLFLYECE

SEQ ID NO: 693888 - protein, 9 aa, Homo Sapiens
YSAAFAPKM

SEQ ID NO: 693889 - protein, 9 aa, Homo Sapiens
ANSPVLVHE

SEQ ID NO: 693890 - protein, 9 aa, Homo Sapiens
GMRELGSWL

SEQ ID NO: 693891 - protein, 9 aa, Homo Sapiens
GSSRIDNTT

SEQ ID NO: 693892 - protein, 9 aa, Homo Sapiens
MPKGNLTEQ

SEQ ID NO: 693893 - protein, 9 aa, Homo Sapiens
FSIRNKNGL

SEQ ID NO: 693894 - protein, 9 aa, Homo Sapiens
STVISVKML

SEQ ID NO: 693895 - protein, 9 aa, Homo Sapiens
FHRHIITVG

SEQ ID NO: 693896 - protein, 9 aa, Homo Sapiens
GMSSKSQKR

SEQ ID NO: 693897 - protein, 9 aa, Homo Sapiens
FEPTPLWVP

SEQ ID NO: 693898 - protein, 9 aa, Homo Sapiens
EALHVNIGI

SEQ ID NO: 693899 - protein, 9 aa, Homo Sapiens
CPVCYRNCR

SEQ ID NO: 693900 - protein, 9 aa, Homo Sapiens
AFTTIQILF

SEQ ID NO: 693901 - protein, 9 aa, Homo Sapiens
NKEKAITFF

SEQ ID NO: 693902 - protein, 9 aa, Homo Sapiens
DFKTLRHKQ

SEQ ID NO: 693903 - protein, 9 aa, Homo Sapiens
MGTNACALE

SEQ ID NO: 693904 - protein, 9 aa, Homo Sapiens
SCRVGKKIM

SEQ ID NO: 693905 - protein, 9 aa, Homo Sapiens
ILHEWALRE

SEQ ID NO: 693906 - protein, 9 aa, Homo Sapiens
ARTQERIRG

SEQ ID NO: 693907 - protein, 9 aa, Homo Sapiens
QNRNIQTNN

SEQ ID NO: 693908 - protein, 9 aa, Homo Sapiens
SETSSAGAH

SEQ ID NO: 693909 - protein, 9 aa, Homo Sapiens
RNVIHQLKT

SEQ ID NO: 693910 - protein, 9 aa, Homo Sapiens
QSFSDVAMF

SEQ ID NO: 693911 - protein, 9 aa, Homo Sapiens
VSILHTMFR

SEQ ID NO: 693912 - protein, 9 aa, Homo Sapiens
PDAVCVLGS

SEQ ID NO: 693913 - protein, 9 aa, Homo Sapiens
MIMAKTAAN

SEQ ID NO: 693914 - protein, 9 aa, Homo Sapiens
KLQVDMTFD

SEQ ID NO: 693915 - protein, 9 aa, Homo Sapiens
QSNKFDLVS

SEQ ID NO: 693916 - protein, 9 aa, Homo Sapiens
YSFEPLCRK

SEQ ID NO: 693917 - protein, 9 aa, Homo Sapiens
QVRQREKEC

SEQ ID NO: 693918 - protein, 9 aa, Homo Sapiens
TEKQTEVQT

SEQ ID NO: 693919 - protein, 9 aa, Homo Sapiens
FVAQAQPPT

SEQ ID NO: 693920 - protein, 9 aa, Homo Sapiens
LVKYNQQND

SEQ ID NO: 693921 - protein, 9 aa, Homo Sapiens
SRDVLGPDP

SEQ ID NO: 693922 - protein, 9 aa, Homo Sapiens
QTNNNKSIG

SEQ ID NO: 693923 - protein, 9 aa, Homo Sapiens
VFPQGRNCS

SEQ ID NO: 693924 - protein, 9 aa, Homo Sapiens
FACPRVPMP

SEQ ID NO: 693925 - protein, 9 aa, Homo Sapiens
GEDLHSTAP

SEQ ID NO: 693926 - protein, 9 aa, Homo Sapiens
MPSQQDALG

SEQ ID NO: 693927 - protein, 9 aa, Homo Sapiens
HTPMCFFLS

SEQ ID NO: 693928 - protein, 9 aa, Homo Sapiens
GLYQKCAMK

SEQ ID NO: 693929 - protein, 9 aa, Homo Sapiens
RVKISYVMI

SEQ ID NO: 693930 - protein, 9 aa, Homo Sapiens
EIRQTPEFQ

SEQ ID NO: 693931 - protein, 9 aa, Homo Sapiens
GTFARTKEK

SEQ ID NO: 693932 - protein, 9 aa, Homo Sapiens
LPKLLPGIF

SEQ ID NO: 693933 - protein, 9 aa, Homo Sapiens
PFINTLRNK

SEQ ID NO: 693934 - protein, 9 aa, Homo Sapiens
QRWLFWNSP

SEQ ID NO: 693935 - protein, 9 aa, Homo Sapiens
EENRSPTVE

SEQ ID NO: 693936 - protein, 9 aa, Homo Sapiens
KEGARNMIE

SEQ ID NO: 693937 - protein, 9 aa, Homo Sapiens
MITINSALY

SEQ ID NO: 693938 - protein, 9 aa, Homo Sapiens
TWAVPVVLG

SEQ ID NO: 693939 - protein, 9 aa, Homo Sapiens
NGTPCGPSM

SEQ ID NO: 693940 - protein, 9 aa, Homo Sapiens
DGLSKSSKP

SEQ ID NO: 693941 - protein, 9 aa, Homo Sapiens
AADTPTACS

SEQ ID NO: 693942 - protein, 9 aa, Homo Sapiens
FPVTREQGV

SEQ ID NO: 693943 - protein, 9 aa, Homo Sapiens
EVKASVPSA

SEQ ID NO: 693944 - protein, 9 aa, Homo Sapiens
ESGTPRKGV

SEQ ID NO: 693945 - protein, 9 aa, Homo Sapiens
YVMGHLRWD

SEQ ID NO: 693946 - protein, 9 aa, Homo Sapiens
ARDSNITLF

SEQ ID NO: 693947 - protein, 9 aa, Homo Sapiens
KGSQVVHRH

SEQ ID NO: 693948 - protein, 9 aa, Homo Sapiens
LLSVAYNNV

SEQ ID NO: 693949 - protein, 9 aa, Homo Sapiens
TLHSDISCP

SEQ ID NO: 693950 - protein, 9 aa, Homo Sapiens
SAPLHSTLG

SEQ ID NO: 693951 - protein, 9 aa, Homo Sapiens
PLIWIHRLS

SEQ ID NO: 693952 - protein, 9 aa, Homo Sapiens
LCFIFHGLH

SEQ ID NO: 693953 - protein, 9 aa, Homo Sapiens
IGLAGTGDA

SEQ ID NO: 693954 - protein, 9 aa, Homo Sapiens
NTMKKPLHL

SEQ ID NO: 693955 - protein, 9 aa, Homo Sapiens
QRPGDGPPG

SEQ ID NO: 693956 - protein, 9 aa, Homo Sapiens
MGLHFFPVY

SEQ ID NO: 693957 - protein, 9 aa, Homo Sapiens
RKYVMGHLR

SEQ ID NO: 693958 - protein, 9 aa, Homo Sapiens
KVLLRQGHG

SEQ ID NO: 693959 - protein, 9 aa, Homo Sapiens
PHSKEDLKF

SEQ ID NO: 693960 - protein, 9 aa, Homo Sapiens
QNKEHILQQ

SEQ ID NO: 693961 - protein, 9 aa, Homo Sapiens
NKFVRVSGE

SEQ ID NO: 693962 - protein, 9 aa, Homo Sapiens
SHFHVRFGK

SEQ ID NO: 693963 - protein, 9 aa, Homo Sapiens
KVDQNWYEG

SEQ ID NO: 693964 - protein, 9 aa, Homo Sapiens
QEPGAPVDF

SEQ ID NO: 693965 - protein, 9 aa, Homo Sapiens
AAVRRTLLG

SEQ ID NO: 693966 - protein, 9 aa, Homo Sapiens
REHFKNHWK

SEQ ID NO: 693967 - protein, 9 aa, Homo Sapiens
FGQDRATAL

SEQ ID NO: 693968 - protein, 9 aa, Homo Sapiens
KESYKSMTV

SEQ ID NO: 693969 - protein, 9 aa, Homo Sapiens
RTTYEALPC

SEQ ID NO: 693970 - protein, 9 aa, Homo Sapiens
GSPEVAGAL

SEQ ID NO: 693971 - protein, 9 aa, Homo Sapiens
VAILYDGWA

SEQ ID NO: 693972 - protein, 9 aa, Homo Sapiens
YEVKASVPS

SEQ ID NO: 693973 - protein, 9 aa, Homo Sapiens
ALIGYDVGL

SEQ ID NO: 693974 - protein, 9 aa, Homo Sapiens
FYMCDHGQV

SEQ ID NO: 693975 - protein, 9 aa, Homo Sapiens
AGYRKHLGV

SEQ ID NO: 693976 - protein, 9 aa, Homo Sapiens
KVQFKLNKD

SEQ ID NO: 693977 - protein, 9 aa, Homo Sapiens
EDFKTLRHK

SEQ ID NO: 693978 - protein, 9 aa, Homo Sapiens
LHMTVRDLM

SEQ ID NO: 693979 - protein, 9 aa, Homo Sapiens
DSHEDTGII

SEQ ID NO: 693980 - protein, 9 aa, Homo Sapiens
NSQKCPRDR

SEQ ID NO: 693981 - protein, 9 aa, Homo Sapiens
QGIRVTSHN

SEQ ID NO: 693982 - protein, 9 aa, Homo Sapiens
SHSSQVHSC

SEQ ID NO: 693983 - protein, 9 aa, Homo Sapiens
GGKTKATLF

SEQ ID NO: 693984 - protein, 9 aa, Homo Sapiens
HTGDSGKVD

SEQ ID NO: 693985 - protein, 9 aa, Homo Sapiens
DTELSPSGS

SEQ ID NO: 693986 - protein, 9 aa, Homo Sapiens
KFKAMLEQL

SEQ ID NO: 693987 - protein, 9 aa, Homo Sapiens
QSSVDNAAS

SEQ ID NO: 693988 - protein, 9 aa, Homo Sapiens
QQINEHKFE

SEQ ID NO: 693989 - protein, 9 aa, Homo Sapiens
HYEVGVVQD

SEQ ID NO: 693990 - protein, 9 aa, Homo Sapiens
EATSGLMEP

SEQ ID NO: 693991 - protein, 9 aa, Homo Sapiens
AALANALQR

SEQ ID NO: 693992 - protein, 9 aa, Homo Sapiens
SSARRRPPQ

SEQ ID NO: 693993 - protein, 9 aa, Homo Sapiens
NSWGEEWSM

SEQ ID NO: 693994 - protein, 9 aa, Homo Sapiens
PGEMTYPGL

SEQ ID NO: 693995 - protein, 9 aa, Homo Sapiens
LKELFAVIF

SEQ ID NO: 693996 - protein, 9 aa, Homo Sapiens
LKPQDIQII

SEQ ID NO: 693997 - protein, 9 aa, Homo Sapiens
LPHTAIQKA

SEQ ID NO: 693998 - protein, 9 aa, Homo Sapiens
HRAVRCRLS

SEQ ID NO: 693999 - protein, 9 aa, Homo Sapiens
DTWASAPDQ

SEQ ID NO: 694000 - protein, 9 aa, Homo Sapiens
IINTMITIN

SEQ ID NO: 694001 - protein, 9 aa, Homo Sapiens
LIGKNKTIC

SEQ ID NO: 694002 - protein, 9 aa, Homo Sapiens
TKESLEESV

SEQ ID NO: 694003 - protein, 9 aa, Homo Sapiens
PHRNACAAA

SEQ ID NO: 694004 - protein, 9 aa, Homo Sapiens
WLSKQLVNV

SEQ ID NO: 694005 - protein, 9 aa, Homo Sapiens
IQQLSNMIV

SEQ ID NO: 694006 - protein, 9 aa, Homo Sapiens
LVAGDRASS

SEQ ID NO: 694007 - protein, 9 aa, Homo Sapiens
VGAYMQQGA

SEQ ID NO: 694008 - protein, 9 aa, Homo Sapiens
VGGLFQVVF

SEQ ID NO: 694009 - protein, 9 aa, Homo Sapiens
SKSKAGSAS

SEQ ID NO: 694010 - protein, 9 aa, Homo Sapiens
LYNQLLSQV

SEQ ID NO: 694011 - protein, 9 aa, Homo Sapiens
EGARNMIEV

SEQ ID NO: 694012 - protein, 9 aa, Homo Sapiens
KMRIEHVWL

SEQ ID NO: 694013 - protein, 9 aa, Homo Sapiens
GRHLTIAEL

SEQ ID NO: 694014 - protein, 9 aa, Homo Sapiens
ANKIHYIPS

SEQ ID NO: 694015 - protein, 9 aa, Homo Sapiens
RIRNNKKML

SEQ ID NO: 694016 - protein, 9 aa, Homo Sapiens
PDSLPAMQQ

SEQ ID NO: 694017 - protein, 9 aa, Homo Sapiens
PTNSSFNLS

SEQ ID NO: 694018 - protein, 9 aa, Homo Sapiens
GKGLRRSSS

SEQ ID NO: 694019 - protein, 9 aa, Homo Sapiens
PPLPPAYYR

SEQ ID NO: 694020 - protein, 9 aa, Homo Sapiens
LPQGLLLQE

SEQ ID NO: 694021 - protein, 9 aa, Homo Sapiens
DTNQQDGGF

SEQ ID NO: 694022 - protein, 9 aa, Homo Sapiens
IPSEMPCPN

SEQ ID NO: 694023 - protein, 9 aa, Homo Sapiens
IPQLSGNSS

SEQ ID NO: 694024 - protein, 9 aa, Homo Sapiens
RQIKIWFHN

SEQ ID NO: 694025 - protein, 9 aa, Homo Sapiens
TGVRSLSFH

SEQ ID NO: 694026 - protein, 9 aa, Homo Sapiens
AFLLLANQK

SEQ ID NO: 694027 - protein, 9 aa, Homo Sapiens
LIKLCKLQP

SEQ ID NO: 694028 - protein, 9 aa, Homo Sapiens
ENLDEHIKK

SEQ ID NO: 694029 - protein, 9 aa, Homo Sapiens
VTDAEDYDR

SEQ ID NO: 694030 - protein, 9 aa, Homo Sapiens
MGSMNGQKG

SEQ ID NO: 694031 - protein, 9 aa, Homo Sapiens
HIYCDTITL

SEQ ID NO: 694032 - protein, 9 aa, Homo Sapiens
TGHTDDEFE

SEQ ID NO: 694033 - protein, 9 aa, Homo Sapiens
PTDDLLCVA

SEQ ID NO: 694034 - protein, 9 aa, Homo Sapiens
EPRPDSIRQ

SEQ ID NO: 694035 - protein, 9 aa, Homo Sapiens
FNLSVTSFK

SEQ ID NO: 694036 - protein, 9 aa, Homo Sapiens
CQEWVVVKV

SEQ ID NO: 694037 - protein, 9 aa, Homo Sapiens
SSSATYELA

SEQ ID NO: 694038 - protein, 9 aa, Homo Sapiens
ALRYPEPED

SEQ ID NO: 694039 - protein, 9 aa, Homo Sapiens
CAAVEACVV

SEQ ID NO: 694040 - protein, 9 aa, Homo Sapiens
DRSIFSAIL

SEQ ID NO: 694041 - protein, 9 aa, Homo Sapiens
LIRSCRTPH

SEQ ID NO: 694042 - protein, 9 aa, Homo Sapiens
GAAVFGTQL

SEQ ID NO: 694043 - protein, 9 aa, Homo Sapiens
NTMITINSA

SEQ ID NO: 694044 - protein, 9 aa, Homo Sapiens
NGTIVGTDF

SEQ ID NO: 694045 - protein, 9 aa, Homo Sapiens
TFSGSAANE

SEQ ID NO: 694046 - protein, 9 aa, Homo Sapiens
PRGKKVAGG

SEQ ID NO: 694047 - protein, 9 aa, Homo Sapiens
STCSESEPE

SEQ ID NO: 694048 - protein, 9 aa, Homo Sapiens
GEAEFEKAS

SEQ ID NO: 694049 - protein, 9 aa, Homo Sapiens
ILRFNKAKP

SEQ ID NO: 694050 - protein, 9 aa, Homo Sapiens
AGLIDGSFK

SEQ ID NO: 694051 - protein, 9 aa, Homo Sapiens
AIQKASNKK

SEQ ID NO: 694052 - protein, 9 aa, Homo Sapiens
RAGIRMFAV

SEQ ID NO: 694053 - protein, 9 aa, Homo Sapiens
VVSGSPCLD

SEQ ID NO: 694054 - protein, 9 aa, Homo Sapiens
LIEAGYRKH

SEQ ID NO: 694055 - protein, 9 aa, Homo Sapiens
ECLSLASRR

SEQ ID NO: 694056 - protein, 9 aa, Homo Sapiens
PLCKERQAL

SEQ ID NO: 694057 - protein, 9 aa, Homo Sapiens
RRLNREQLL

SEQ ID NO: 694058 - protein, 9 aa, Homo Sapiens
MESSPIPQL

SEQ ID NO: 694059 - protein, 9 aa, Homo Sapiens
TIETSVNTE

SEQ ID NO: 694060 - protein, 9 aa, Homo Sapiens
LPHTEGALT

SEQ ID NO: 694061 - protein, 9 aa, Homo Sapiens
GYTTDNLRF

SEQ ID NO: 694062 - protein, 9 aa, Homo Sapiens
QASSWKMAA

SEQ ID NO: 694063 - protein, 9 aa, Homo Sapiens
HLNSDDIEA

SEQ ID NO: 694064 - protein, 9 aa, Homo Sapiens
PAAGGAQDE

SEQ ID NO: 694065 - protein, 9 aa, Homo Sapiens
KIQQLSNMI

SEQ ID NO: 694066 - protein, 9 aa, Homo Sapiens
GSNSNRYET

SEQ ID NO: 694067 - protein, 9 aa, Homo Sapiens
MEGREGMHL

SEQ ID NO: 694068 - protein, 9 aa, Homo Sapiens
ATAKVMVSQ

SEQ ID NO: 694069 - protein, 9 aa, Homo Sapiens
DPFWNTMKK

SEQ ID NO: 694070 - protein, 9 aa, Homo Sapiens
LFLPLYISD

SEQ ID NO: 694071 - protein, 9 aa, Homo Sapiens
QCHFDINVN

SEQ ID NO: 694072 - protein, 9 aa, Homo Sapiens
IVWKIGGLP

SEQ ID NO: 694073 - protein, 9 aa, Homo Sapiens
GAYMQQGAR

SEQ ID NO: 694074 - protein, 9 aa, Homo Sapiens
HMERDSYPD

SEQ ID NO: 694075 - protein, 9 aa, Homo Sapiens
TAIQKASNK

SEQ ID NO: 694076 - protein, 9 aa, Homo Sapiens
DWSALTFCL

SEQ ID NO: 694077 - protein, 9 aa, Homo Sapiens
AYILSMQKF

SEQ ID NO: 694078 - protein, 9 aa, Homo Sapiens
MSKLIKGSC

SEQ ID NO: 694079 - protein, 9 aa, Homo Sapiens
PQVVYEVAS

SEQ ID NO: 694080 - protein, 9 aa, Homo Sapiens
IWIHRLSCS

SEQ ID NO: 694081 - protein, 9 aa, Homo Sapiens
SGDPPPSAS

SEQ ID NO: 694082 - protein, 9 aa, Homo Sapiens
RDISSSATY

SEQ ID NO: 694083 - protein, 9 aa, Homo Sapiens
VLHEDIDAK

SEQ ID NO: 694084 - protein, 9 aa, Homo Sapiens
LHLRQKKRN

SEQ ID NO: 694085 - protein, 9 aa, Homo Sapiens
NFWTIWSRA

SEQ ID NO: 694086 - protein, 9 aa, Homo Sapiens
RFVSSPKEV

SEQ ID NO: 694087 - protein, 9 aa, Homo Sapiens
GCQNKEHIL

SEQ ID NO: 694088 - protein, 9 aa, Homo Sapiens
LSENAMQAI

SEQ ID NO: 694089 - protein, 9 aa, Homo Sapiens
VQEYYKIFM

SEQ ID NO: 694090 - protein, 9 aa, Homo Sapiens
AFDGILVVV

SEQ ID NO: 694091 - protein, 9 aa, Homo Sapiens
IPPTSRGSS

SEQ ID NO: 694092 - protein, 9 aa, Homo Sapiens
TLSDSSQDK

SEQ ID NO: 694093 - protein, 9 aa, Homo Sapiens
LLCGSGNNE

SEQ ID NO: 694094 - protein, 9 aa, Homo Sapiens
SLPTLEVSP

SEQ ID NO: 694095 - protein, 9 aa, Homo Sapiens
PGDYKELHN

SEQ ID NO: 694096 - protein, 9 aa, Homo Sapiens
DAVLPLVLL

SEQ ID NO: 694097 - protein, 9 aa, Homo Sapiens
LPEEKAAKV

SEQ ID NO: 694098 - protein, 9 aa, Homo Sapiens
NCREEDLIL

SEQ ID NO: 694099 - protein, 9 aa, Homo Sapiens
MACTSYDYC

SEQ ID NO: 694100 - protein, 9 aa, Homo Sapiens
WLDPSIKNT

SEQ ID NO: 694101 - protein, 9 aa, Homo Sapiens
LQELPDRRS

SEQ ID NO: 694102 - protein, 9 aa, Homo Sapiens
LRYKAIYET

SEQ ID NO: 694103 - protein, 9 aa, Homo Sapiens
YLIAGTSTS

SEQ ID NO: 694104 - protein, 9 aa, Homo Sapiens
TVGGLFQVV

SEQ ID NO: 694105 - protein, 9 aa, Homo Sapiens
LEGAYKPGA

SEQ ID NO: 694106 - protein, 9 aa, Homo Sapiens
GKDYMISVK

SEQ ID NO: 694107 - protein, 9 aa, Homo Sapiens
QKRYILKTD

SEQ ID NO: 694108 - protein, 9 aa, Homo Sapiens
DHEKRLEAR

SEQ ID NO: 694109 - protein, 9 aa, Homo Sapiens
NSQSSVDNA

SEQ ID NO: 694110 - protein, 9 aa, Homo Sapiens
LFSIRNKNG

SEQ ID NO: 694111 - protein, 9 aa, Homo Sapiens
GARCPCEIL

SEQ ID NO: 694112 - protein, 9 aa, Homo Sapiens
SFIDTVYSA

SEQ ID NO: 694113 - protein, 9 aa, Homo Sapiens
IYNSGEFQI

SEQ ID NO: 694114 - protein, 9 aa, Homo Sapiens
HQGRDVEGY

SEQ ID NO: 694115 - protein, 9 aa, Homo Sapiens
FEYQLCNTK

SEQ ID NO: 694116 - protein, 9 aa, Homo Sapiens
STFLGTVEN

SEQ ID NO: 694117 - protein, 9 aa, Homo Sapiens
SAEVTLAEI

SEQ ID NO: 694118 - protein, 9 aa, Homo Sapiens
SNQEGKSNG

SEQ ID NO: 694119 - protein, 9 aa, Homo Sapiens
ISQKCQVLH

SEQ ID NO: 694120 - protein, 9 aa, Homo Sapiens
ILKTDNSSF

SEQ ID NO: 694121 - protein, 9 aa, Homo Sapiens
RRIECLSLA

SEQ ID NO: 694122 - protein, 9 aa, Homo Sapiens
MHRGLFPTY

SEQ ID NO: 694123 - protein, 9 aa, Homo Sapiens
KKRTKDKIV

SEQ ID NO: 694124 - protein, 9 aa, Homo Sapiens
DYAQFQGRR

SEQ ID NO: 694125 - protein, 9 aa, Homo Sapiens
VITIVMKAQ

SEQ ID NO: 694126 - protein, 9 aa, Homo Sapiens
RPKRPGTIL

SEQ ID NO: 694127 - protein, 9 aa, Homo Sapiens
KFYSPDPSQ

SEQ ID NO: 694128 - protein, 9 aa, Homo Sapiens
TPPSGTSLA

SEQ ID NO: 694129 - protein, 9 aa, Homo Sapiens
AVRPFTPHT

SEQ ID NO: 694130 - protein, 9 aa, Homo Sapiens
TVEVSAPLG

SEQ ID NO: 694131 - protein, 9 aa, Homo Sapiens
FHTDLLRYA

SEQ ID NO: 694132 - protein, 9 aa, Homo Sapiens
RTFCNPLFT

SEQ ID NO: 694133 - protein, 9 aa, Homo Sapiens
GCQTGTAEE

SEQ ID NO: 694134 - protein, 9 aa, Homo Sapiens
VYEVASNQA

SEQ ID NO: 694135 - protein, 9 aa, Homo Sapiens
NLSDFISMD

SEQ ID NO: 694136 - protein, 9 aa, Homo Sapiens
KASGQGNRY

SEQ ID NO: 694137 - protein, 9 aa, Homo Sapiens
SRYLFRNES

SEQ ID NO: 694138 - protein, 9 aa, Homo Sapiens
EPGPGSAKP

SEQ ID NO: 694139 - protein, 9 aa, Homo Sapiens
MREQLVKYQ

SEQ ID NO: 694140 - protein, 9 aa, Homo Sapiens
LAVRPFTPH

SEQ ID NO: 694141 - protein, 9 aa, Homo Sapiens
LAAKQTPPV

SEQ ID NO: 694142 - protein, 9 aa, Homo Sapiens
EIGEFGLRE

SEQ ID NO: 694143 - protein, 9 aa, Homo Sapiens
TSPLLAAQS

SEQ ID NO: 694144 - protein, 9 aa, Homo Sapiens
RHYEVGVVQ

SEQ ID NO: 694145 - protein, 9 aa, Homo Sapiens
LSKSKAGSA

SEQ ID NO: 694146 - protein, 9 aa, Homo Sapiens
CHDVYLRCF

SEQ ID NO: 694147 - protein, 9 aa, Homo Sapiens
ANPGSGEVG

SEQ ID NO: 694148 - protein, 9 aa, Homo Sapiens
QGRDVEGYY

SEQ ID NO: 694149 - protein, 9 aa, Homo Sapiens
QLGIAKLVH

SEQ ID NO: 694150 - protein, 9 aa, Homo Sapiens
PPVVCSTPP

SEQ ID NO: 694151 - protein, 9 aa, Homo Sapiens
KSLVIKLDK

SEQ ID NO: 694152 - protein, 9 aa, Homo Sapiens
PGPGSAKPG

SEQ ID NO: 694153 - protein, 9 aa, Homo Sapiens
RDMCVVCGS

SEQ ID NO: 694154 - protein, 9 aa, Homo Sapiens
PFWNTMKKP

SEQ ID NO: 694155 - protein, 9 aa, Homo Sapiens
PVVEAVSSP

SEQ ID NO: 694156 - protein, 9 aa, Homo Sapiens
SVPSACFRN

SEQ ID NO: 694157 - protein, 9 aa, Homo Sapiens
KEKIKSISC

SEQ ID NO: 694158 - protein, 9 aa, Homo Sapiens
VILLKKVDQ

SEQ ID NO: 694159 - protein, 9 aa, Homo Sapiens
SAEAANKIH

SEQ ID NO: 694160 - protein, 9 aa, Homo Sapiens
GPGVIECWF

SEQ ID NO: 694161 - protein, 9 aa, Homo Sapiens
YGDTVIIPC

SEQ ID NO: 694162 - protein, 9 aa, Homo Sapiens
EPHPGPELP

SEQ ID NO: 694163 - protein, 9 aa, Homo Sapiens
NQQFRYLKE

SEQ ID NO: 694164 - protein, 9 aa, Homo Sapiens
NSSLRKRPS

SEQ ID NO: 694165 - protein, 9 aa, Homo Sapiens
VWGKTDNTR

SEQ ID NO: 694166 - protein, 9 aa, Homo Sapiens
GLIKVVRHS

SEQ ID NO: 694167 - protein, 9 aa, Homo Sapiens
AKFKAMLEQ

SEQ ID NO: 694168 - protein, 9 aa, Homo Sapiens
LSKPDLITC

SEQ ID NO: 694169 - protein, 9 aa, Homo Sapiens
RPKAPDTAL

SEQ ID NO: 694170 - protein, 9 aa, Homo Sapiens
LLQLLAAAV

SEQ ID NO: 694171 - protein, 9 aa, Homo Sapiens
QISTKRYER

SEQ ID NO: 694172 - protein, 9 aa, Homo Sapiens
LVGQQGRGR

SEQ ID NO: 694173 - protein, 9 aa, Homo Sapiens
AGSNTPGAR

SEQ ID NO: 694174 - protein, 9 aa, Homo Sapiens
IGHTPLDYA

SEQ ID NO: 694175 - protein, 9 aa, Homo Sapiens
GRTTYEALP

SEQ ID NO: 694176 - protein, 9 aa, Homo Sapiens
VAVMDNKLY

SEQ ID NO: 694177 - protein, 9 aa, Homo Sapiens
DLSYVLSGN

SEQ ID NO: 694178 - protein, 9 aa, Homo Sapiens
SVSSDTSSN

SEQ ID NO: 694179 - protein, 9 aa, Homo Sapiens
RVTKGRGIF

SEQ ID NO: 694180 - protein, 9 aa, Homo Sapiens
CRIIGVDPK

SEQ ID NO: 694181 - protein, 9 aa, Homo Sapiens
SVVSGSPCL

SEQ ID NO: 694182 - protein, 9 aa, Homo Sapiens
GTKQSAMAM

SEQ ID NO: 694183 - protein, 9 aa, Homo Sapiens
YGPCDPPRH

SEQ ID NO: 694184 - protein, 9 aa, Homo Sapiens
DGSLFYEQS

SEQ ID NO: 694185 - protein, 9 aa, Homo Sapiens
GTTEPTPPP

SEQ ID NO: 694186 - protein, 9 aa, Homo Sapiens
NRNISSLFH

SEQ ID NO: 694187 - protein, 9 aa, Homo Sapiens
LGVQALKNQ

SEQ ID NO: 694188 - protein, 9 aa, Homo Sapiens
FQLMQFLFV

SEQ ID NO: 694189 - protein, 9 aa, Homo Sapiens
SNRYETLKA

SEQ ID NO: 694190 - protein, 9 aa, Homo Sapiens
KQGGSRDVL

SEQ ID NO: 694191 - protein, 9 aa, Homo Sapiens
EGYYPGQLA

SEQ ID NO: 694192 - protein, 9 aa, Homo Sapiens
SSHFGGPPQ

SEQ ID NO: 694193 - protein, 9 aa, Homo Sapiens
FTFNVKFYS

SEQ ID NO: 694194 - protein, 9 aa, Homo Sapiens
HVVRKTDAV

SEQ ID NO: 694195 - protein, 9 aa, Homo Sapiens
LEDFSRAWD

SEQ ID NO: 694196 - protein, 9 aa, Homo Sapiens
AVVADRMVE

SEQ ID NO: 694197 - protein, 9 aa, Homo Sapiens
VSNLNEQMV

SEQ ID NO: 694198 - protein, 9 aa, Homo Sapiens
GPYRLRLGG

SEQ ID NO: 694199 - protein, 9 aa, Homo Sapiens
RCVCPTGYR

SEQ ID NO: 694200 - protein, 9 aa, Homo Sapiens
VMVPAQSEA

SEQ ID NO: 694201 - protein, 9 aa, Homo Sapiens
DNMKTPAER

SEQ ID NO: 694202 - protein, 9 aa, Homo Sapiens
SLKQPQAGH

SEQ ID NO: 694203 - protein, 9 aa, Homo Sapiens
ALQPETEGG

SEQ ID NO: 694204 - protein, 9 aa, Homo Sapiens
ALSHGGGGW

SEQ ID NO: 694205 - protein, 9 aa, Homo Sapiens
AKGPVVTAQ

SEQ ID NO: 694206 - protein, 9 aa, Homo Sapiens
TESKTSSEN

SEQ ID NO: 694207 - protein, 9 aa, Homo Sapiens
TDLAHHLRM

SEQ ID NO: 694208 - protein, 9 aa, Homo Sapiens
AYPNSEVIY

SEQ ID NO: 694209 - protein, 9 aa, Homo Sapiens
GASMLQCLA

SEQ ID NO: 694210 - protein, 9 aa, Homo Sapiens
SAVTPPSGT

SEQ ID NO: 694211 - protein, 9 aa, Homo Sapiens
LGLSTSTIS

SEQ ID NO: 694212 - protein, 9 aa, Homo Sapiens
LLLVFHNPI

SEQ ID NO: 694213 - protein, 9 aa, Homo Sapiens
GGPRISYPI

SEQ ID NO: 694214 - protein, 9 aa, Homo Sapiens
VKEKAGATV

SEQ ID NO: 694215 - protein, 9 aa, Homo Sapiens
KRRGGFAVK

SEQ ID NO: 694216 - protein, 9 aa, Homo Sapiens
EYLFKAYVL

SEQ ID NO: 694217 - protein, 9 aa, Homo Sapiens
AGAVRDHEK

SEQ ID NO: 694218 - protein, 9 aa, Homo Sapiens
EMTYPGLRG

SEQ ID NO: 694219 - protein, 9 aa, Homo Sapiens
AFGTVGGLF

SEQ ID NO: 694220 - protein, 9 aa, Homo Sapiens
KNHWKGRAR

SEQ ID NO: 694221 - protein, 9 aa, Homo Sapiens
RVAYVVTPL

SEQ ID NO: 694222 - protein, 9 aa, Homo Sapiens
HLDNSEEPP

SEQ ID NO: 694223 - protein, 9 aa, Homo Sapiens
SKGRARAPM

SEQ ID NO: 694224 - protein, 9 aa, Homo Sapiens
HPFAPCGRG

SEQ ID NO: 694225 - protein, 9 aa, Homo Sapiens
SEEARLSVD

SEQ ID NO: 694226 - protein, 9 aa, Homo Sapiens
LSPLHASLC

SEQ ID NO: 694227 - protein, 9 aa, Homo Sapiens
FKQLHTATN

SEQ ID NO: 694228 - protein, 9 aa, Homo Sapiens
QTSLREQVI

SEQ ID NO: 694229 - protein, 9 aa, Homo Sapiens
RTLKEEEKR

SEQ ID NO: 694230 - protein, 9 aa, Homo Sapiens
FLLYTNQNP

SEQ ID NO: 694231 - protein, 9 aa, Homo Sapiens
EDLHSTAPI

SEQ ID NO: 694232 - protein, 9 aa, Homo Sapiens
KTDNTRSLK

SEQ ID NO: 694233 - protein, 9 aa, Homo Sapiens
GVWEEIYSK

SEQ ID NO: 694234 - protein, 9 aa, Homo Sapiens
LPPGCLQPL

SEQ ID NO: 694235 - protein, 9 aa, Homo Sapiens
RNFHRFAKK

SEQ ID NO: 694236 - protein, 9 aa, Homo Sapiens
LSYQDDKNR

SEQ ID NO: 694237 - protein, 9 aa, Homo Sapiens
RDAAHLAEE

SEQ ID NO: 694238 - protein, 9 aa, Homo Sapiens
RHKLSHLDE

SEQ ID NO: 694239 - protein, 9 aa, Homo Sapiens
TPVLNPFIN

SEQ ID NO: 694240 - protein, 9 aa, Homo Sapiens
QPLEDFSRA

SEQ ID NO: 694241 - protein, 9 aa, Homo Sapiens
SQKDKHCWV

SEQ ID NO: 694242 - protein, 9 aa, Homo Sapiens
CLRCELCGK

SEQ ID NO: 694243 - protein, 9 aa, Homo Sapiens
ARAQRERAR

SEQ ID NO: 694244 - protein, 9 aa, Homo Sapiens
FAKKHNFAK

SEQ ID NO: 694245 - protein, 9 aa, Homo Sapiens
TSTVISVKM

SEQ ID NO: 694246 - protein, 9 aa, Homo Sapiens
SPRRVSRCT

SEQ ID NO: 694247 - protein, 9 aa, Homo Sapiens
MLCAHWEKK

SEQ ID NO: 694248 - protein, 9 aa, Homo Sapiens
VNVLQEFGA

SEQ ID NO: 694249 - protein, 9 aa, Homo Sapiens
RHLHLRQKK

SEQ ID NO: 694250 - protein, 9 aa, Homo Sapiens
ENILFSTVS

SEQ ID NO: 694251 - protein, 9 aa, Homo Sapiens
HCPGLPPTN

SEQ ID NO: 694252 - protein, 9 aa, Homo Sapiens
LILVAILYD

SEQ ID NO: 694253 - protein, 9 aa, Homo Sapiens
DTSMNELLM

SEQ ID NO: 694254 - protein, 9 aa, Homo Sapiens
EVFLGMKVQ

SEQ ID NO: 694255 - protein, 9 aa, Homo Sapiens
MDSLREDRR

SEQ ID NO: 694256 - protein, 9 aa, Homo Sapiens
RIIGVDPKG

SEQ ID NO: 694257 - protein, 9 aa, Homo Sapiens
KEEEKLMKQ

SEQ ID NO: 694258 - protein, 9 aa, Homo Sapiens
EVEQQADNI

SEQ ID NO: 694259 - protein, 9 aa, Homo Sapiens
SLGSLRDEV

SEQ ID NO: 694260 - protein, 9 aa, Homo Sapiens
QGSQSLGQN

SEQ ID NO: 694261 - protein, 9 aa, Homo Sapiens
LVEKSRVVM

SEQ ID NO: 694262 - protein, 9 aa, Homo Sapiens
FCLAFIVKK

SEQ ID NO: 694263 - protein, 9 aa, Homo Sapiens
QLELCPRGS

SEQ ID NO: 694264 - protein, 9 aa, Homo Sapiens
FRKWPEFQE

SEQ ID NO: 694265 - protein, 9 aa, Homo Sapiens
HEKRLEARR

SEQ ID NO: 694266 - protein, 9 aa, Homo Sapiens
LQSRFENFL

SEQ ID NO: 694267 - protein, 9 aa, Homo Sapiens
GEMTYPGLR

SEQ ID NO: 694268 - protein, 9 aa, Homo Sapiens
QAAMLSQMS

SEQ ID NO: 694269 - protein, 9 aa, Homo Sapiens
QSGYISGLK

SEQ ID NO: 694270 - protein, 9 aa, Homo Sapiens
AKENKILKE

SEQ ID NO: 694271 - protein, 9 aa, Homo Sapiens
SLCCTGSCY

SEQ ID NO: 694272 - protein, 9 aa, Homo Sapiens
NFSSDRAFY

SEQ ID NO: 694273 - protein, 9 aa, Homo Sapiens
LLIKLCKLQ

SEQ ID NO: 694274 - protein, 9 aa, Homo Sapiens
YEALPCLPS

SEQ ID NO: 694275 - protein, 9 aa, Homo Sapiens
RALIGYDVG

SEQ ID NO: 694276 - protein, 9 aa, Homo Sapiens
NKEGARNMI

SEQ ID NO: 694277 - protein, 9 aa, Homo Sapiens
LFWSVQGCL

SEQ ID NO: 694278 - protein, 9 aa, Homo Sapiens
ASFTWKYEG

SEQ ID NO: 694279 - protein, 9 aa, Homo Sapiens
VEHYQLTIP

SEQ ID NO: 694280 - protein, 9 aa, Homo Sapiens
EANQNQQAF

SEQ ID NO: 694281 - protein, 9 aa, Homo Sapiens
LSDALAVQD

SEQ ID NO: 694282 - protein, 9 aa, Homo Sapiens
FVLSTIKAQ

SEQ ID NO: 694283 - protein, 9 aa, Homo Sapiens
VRGQHTNTT

SEQ ID NO: 694284 - protein, 9 aa, Homo Sapiens
PTACSFSYT

SEQ ID NO: 694285 - protein, 9 aa, Homo Sapiens
MLQCLATGN

SEQ ID NO: 694286 - protein, 9 aa, Homo Sapiens
GLQAVTGKR

SEQ ID NO: 694287 - protein, 9 aa, Homo Sapiens
DRWSLIRGI

SEQ ID NO: 694288 - protein, 9 aa, Homo Sapiens
PLILVAILY

SEQ ID NO: 694289 - protein, 9 aa, Homo Sapiens
PSSLRSCWS

SEQ ID NO: 694290 - protein, 9 aa, Homo Sapiens
GLNCCGQRR

SEQ ID NO: 694291 - protein, 9 aa, Homo Sapiens
RVCRHKMDT

SEQ ID NO: 694292 - protein, 9 aa, Homo Sapiens
QQADNILKD

SEQ ID NO: 694293 - protein, 9 aa, Homo Sapiens
RNCREEDLI

SEQ ID NO: 694294 - protein, 9 aa, Homo Sapiens
GNIMNGTIV

SEQ ID NO: 694295 - protein, 9 aa, Homo Sapiens
VCALQFYFF

SEQ ID NO: 694296 - protein, 9 aa, Homo Sapiens
GLTYSYDKS

SEQ ID NO: 694297 - protein, 9 aa, Homo Sapiens
NQNQQAFKQ

SEQ ID NO: 694298 - protein, 9 aa, Homo Sapiens
VDVRQVQLQ

SEQ ID NO: 694299 - protein, 9 aa, Homo Sapiens
ENFPDAKEN

SEQ ID NO: 694300 - protein, 9 aa, Homo Sapiens
IDGSFKIGN

SEQ ID NO: 694301 - protein, 9 aa, Homo Sapiens
HEDIDAKQK

SEQ ID NO: 694302 - protein, 9 aa, Homo Sapiens
LRHKRTHSG

SEQ ID NO: 694303 - protein, 9 aa, Homo Sapiens
SGTSLAASV

SEQ ID NO: 694304 - protein, 9 aa, Homo Sapiens
AFTPTTPSS

SEQ ID NO: 694305 - protein, 9 aa, Homo Sapiens
DAAHLAEEA

SEQ ID NO: 694306 - protein, 9 aa, Homo Sapiens
LQHLEASSN

SEQ ID NO: 694307 - protein, 9 aa, Homo Sapiens
AAAVRRTLL

SEQ ID NO: 694308 - protein, 9 aa, Homo Sapiens
NVLQEFGAK

SEQ ID NO: 694309 - protein, 9 aa, Homo Sapiens
DSTKRALAK

SEQ ID NO: 694310 - protein, 9 aa, Homo Sapiens
KNTLPAVGP

SEQ ID NO: 694311 - protein, 9 aa, Homo Sapiens
RCRMQLVPE

SEQ ID NO: 694312 - protein, 9 aa, Homo Sapiens
CFFLSHLSF

SEQ ID NO: 694313 - protein, 9 aa, Homo Sapiens
THQDYLCSL

SEQ ID NO: 694314 - protein, 9 aa, Homo Sapiens
NSTLPQAAM

SEQ ID NO: 694315 - protein, 9 aa, Homo Sapiens
LLCSQTSDN

SEQ ID NO: 694316 - protein, 9 aa, Homo Sapiens
DTVYSAAFA

SEQ ID NO: 694317 - protein, 9 aa, Homo Sapiens
QEAFELMNQ

SEQ ID NO: 694318 - protein, 9 aa, Homo Sapiens
LGLTHMDLS

SEQ ID NO: 694319 - protein, 9 aa, Homo Sapiens
SFLGGGSSR

SEQ ID NO: 694320 - protein, 9 aa, Homo Sapiens
KDSGVRCKD

SEQ ID NO: 694321 - protein, 9 aa, Homo Sapiens
SGSDLYQMN

SEQ ID NO: 694322 - protein, 9 aa, Homo Sapiens
YNIDDTCGR

SEQ ID NO: 694323 - protein, 9 aa, Homo Sapiens
LDPVETPPP

SEQ ID NO: 694324 - protein, 9 aa, Homo Sapiens
GKKIISLAN

SEQ ID NO: 694325 - protein, 9 aa, Homo Sapiens
LLNMQYCPH

SEQ ID NO: 694326 - protein, 9 aa, Homo Sapiens
KTHQDYLCS

SEQ ID NO: 694327 - protein, 9 aa, Homo Sapiens
AAVEACVVH

SEQ ID NO: 694328 - protein, 9 aa, Homo Sapiens
RARVLSCSP

SEQ ID NO: 694329 - protein, 9 aa, Homo Sapiens
DTVKNSEPM

SEQ ID NO: 694330 - protein, 9 aa, Homo Sapiens
HLTKQTPKK

SEQ ID NO: 694331 - protein, 9 aa, Homo Sapiens
GGKISNFLV

SEQ ID NO: 694332 - protein, 9 aa, Homo Sapiens
IIGVDPKGS

SEQ ID NO: 694333 - protein, 9 aa, Homo Sapiens
KKCQLDVLD

SEQ ID NO: 694334 - protein, 9 aa, Homo Sapiens
NVIHQLKTV

SEQ ID NO: 694335 - protein, 9 aa, Homo Sapiens
TLLKEVKAF

SEQ ID NO: 694336 - protein, 9 aa, Homo Sapiens
SSPEASQQT

SEQ ID NO: 694337 - protein, 9 aa, Homo Sapiens
WTSINHFVI

SEQ ID NO: 694338 - protein, 9 aa, Homo Sapiens
VDPGTNLEP

SEQ ID NO: 694339 - protein, 9 aa, Homo Sapiens
TIAELLFSI

SEQ ID NO: 694340 - protein, 9 aa, Homo Sapiens
AGSDADTEA

SEQ ID NO: 694341 - protein, 9 aa, Homo Sapiens
NLTRSYRLL

SEQ ID NO: 694342 - protein, 9 aa, Homo Sapiens
EEEKRDIHR

SEQ ID NO: 694343 - protein, 9 aa, Homo Sapiens
KCFRIRNNK

SEQ ID NO: 694344 - protein, 9 aa, Homo Sapiens
LSSHETLIS

SEQ ID NO: 694345 - protein, 9 aa, Homo Sapiens
HSIWENGDS

SEQ ID NO: 694346 - protein, 9 aa, Homo Sapiens
RKLLVEALH

SEQ ID NO: 694347 - protein, 9 aa, Homo Sapiens
KCAPGLQLC

SEQ ID NO: 694348 - protein, 9 aa, Homo Sapiens
LSKAVYEKM

SEQ ID NO: 694349 - protein, 9 aa, Homo Sapiens
PQEPGAPVD

SEQ ID NO: 694350 - protein, 9 aa, Homo Sapiens
PTASGLPRR

SEQ ID NO: 694351 - protein, 9 aa, Homo Sapiens
ASADASRYL

SEQ ID NO: 694352 - protein, 9 aa, Homo Sapiens
TGYRSQGVG

SEQ ID NO: 694353 - protein, 9 aa, Homo Sapiens
TAKSIPELN

SEQ ID NO: 694354 - protein, 9 aa, Homo Sapiens
ADFGDPWSR

SEQ ID NO: 694355 - protein, 9 aa, Homo Sapiens
PVAKGQSYS

SEQ ID NO: 694356 - protein, 9 aa, Homo Sapiens
IGAVCSALC

SEQ ID NO: 694357 - protein, 9 aa, Homo Sapiens
GVDPKGSIL

SEQ ID NO: 694358 - protein, 9 aa, Homo Sapiens
ALTFLVEKM

SEQ ID NO: 694359 - protein, 9 aa, Homo Sapiens
GESGGKGSK

SEQ ID NO: 694360 - protein, 9 aa, Homo Sapiens
GSECTNLAA

SEQ ID NO: 694361 - protein, 9 aa, Homo Sapiens
SETAGEGEN

SEQ ID NO: 694362 - protein, 9 aa, Homo Sapiens
LDPGDYKEL

SEQ ID NO: 694363 - protein, 9 aa, Homo Sapiens
NGGSAITAF

SEQ ID NO: 694364 - protein, 9 aa, Homo Sapiens
NGKSQQASN

SEQ ID NO: 694365 - protein, 9 aa, Homo Sapiens
LLVAGDRAS

SEQ ID NO: 694366 - protein, 9 aa, Homo Sapiens
SPVLVHEIN

SEQ ID NO: 694367 - protein, 9 aa, Homo Sapiens
LCKAKSLSR

SEQ ID NO: 694368 - protein, 9 aa, Homo Sapiens
SMMGKCCHH

SEQ ID NO: 694369 - protein, 9 aa, Homo Sapiens
MAMCQHFYK

SEQ ID NO: 694370 - protein, 9 aa, Homo Sapiens
AARKAVRKG

SEQ ID NO: 694371 - protein, 9 aa, Homo Sapiens
DQWVEKKVQ

SEQ ID NO: 694372 - protein, 9 aa, Homo Sapiens
LCCIRASSS

SEQ ID NO: 694373 - protein, 9 aa, Homo Sapiens
GSGTGPAPE

SEQ ID NO: 694374 - protein, 9 aa, Homo Sapiens
FPQGRNCSI

SEQ ID NO: 694375 - protein, 9 aa, Homo Sapiens
QYDDIIQQE

SEQ ID NO: 694376 - protein, 9 aa, Homo Sapiens
SRKSHFTCN

SEQ ID NO: 694377 - protein, 9 aa, Homo Sapiens
DFVLNSEVE

SEQ ID NO: 694378 - protein, 9 aa, Homo Sapiens
VSLQGSIMT

SEQ ID NO: 694379 - protein, 9 aa, Homo Sapiens
FNWFVDGVE

SEQ ID NO: 694380 - protein, 9 aa, Homo Sapiens
DPGDYKELH

SEQ ID NO: 694381 - protein, 9 aa, Homo Sapiens
PSGSKKFCN

SEQ ID NO: 694382 - protein, 9 aa, Homo Sapiens
NTFYTTKRL

SEQ ID NO: 694383 - protein, 9 aa, Homo Sapiens
TVTASLDSS

SEQ ID NO: 694384 - protein, 9 aa, Homo Sapiens
CAKCAPGLQ

SEQ ID NO: 694385 - protein, 9 aa, Homo Sapiens
ATPRDPELV

SEQ ID NO: 694386 - protein, 9 aa, Homo Sapiens
GSDADTEAD

SEQ ID NO: 694387 - protein, 9 aa, Homo Sapiens
SMNGQKGDQ

SEQ ID NO: 694388 - protein, 9 aa, Homo Sapiens
EDDQNEDQD

SEQ ID NO: 694389 - protein, 9 aa, Homo Sapiens
TASGLPRRP

SEQ ID NO: 694390 - protein, 9 aa, Homo Sapiens
NLNEQMVTP

SEQ ID NO: 694391 - protein, 9 aa, Homo Sapiens
QEKIQVKAQ

SEQ ID NO: 694392 - protein, 9 aa, Homo Sapiens
LKFYCRKNL

SEQ ID NO: 694393 - protein, 9 aa, Homo Sapiens
SITLALLVG

SEQ ID NO: 694394 - protein, 9 aa, Homo Sapiens
LRSCWSGNW

SEQ ID NO: 694395 - protein, 9 aa, Homo Sapiens
LVICIISLS

SEQ ID NO: 694396 - protein, 9 aa, Homo Sapiens
FMKMRIEHV

SEQ ID NO: 694397 - protein, 9 aa, Homo Sapiens
WDGIASKTL

SEQ ID NO: 694398 - protein, 9 aa, Homo Sapiens
NALQRHLPF

SEQ ID NO: 694399 - protein, 9 aa, Homo Sapiens
LAKVAPQRT

SEQ ID NO: 694400 - protein, 9 aa, Homo Sapiens
AFNKKENKG

SEQ ID NO: 694401 - protein, 9 aa, Homo Sapiens
PNYVAPKVL

SEQ ID NO: 694402 - protein, 9 aa, Homo Sapiens
DDYMEGREG

SEQ ID NO: 694403 - protein, 9 aa, Homo Sapiens
THIFALVKY

SEQ ID NO: 694404 - protein, 9 aa, Homo Sapiens
QQFRYLKEK

SEQ ID NO: 694405 - protein, 9 aa, Homo Sapiens
RNISSLFHF

SEQ ID NO: 694406 - protein, 9 aa, Homo Sapiens
RRRWPSAEQ

SEQ ID NO: 694407 - protein, 9 aa, Homo Sapiens
HTEGALTSP

SEQ ID NO: 694408 - protein, 9 aa, Homo Sapiens
IVKKTLTHL

SEQ ID NO: 694409 - protein, 9 aa, Homo Sapiens
DARIQEELS

SEQ ID NO: 694410 - protein, 9 aa, Homo Sapiens
EAEKDCFIR

SEQ ID NO: 694411 - protein, 9 aa, Homo Sapiens
KTDNSSFDK

SEQ ID NO: 694412 - protein, 9 aa, Homo Sapiens
VNSAYGDTV

SEQ ID NO: 694413 - protein, 9 aa, Homo Sapiens
EEDDQNEDQ

SEQ ID NO: 694414 - protein, 9 aa, Homo Sapiens
FKPLENKFV

SEQ ID NO: 694415 - protein, 9 aa, Homo Sapiens
QLLKPRCSA

SEQ ID NO: 694416 - protein, 9 aa, Homo Sapiens
TPRKGVDYA

SEQ ID NO: 694417 - protein, 9 aa, Homo Sapiens
KIHYIPSVL

SEQ ID NO: 694418 - protein, 9 aa, Homo Sapiens
KQGSEKEKP

SEQ ID NO: 694419 - protein, 9 aa, Homo Sapiens
IGRRKSLPL

SEQ ID NO: 694420 - protein, 9 aa, Homo Sapiens
FNKEKKITG

SEQ ID NO: 694421 - protein, 9 aa, Homo Sapiens
FTALGQVCS

SEQ ID NO: 694422 - protein, 9 aa, Homo Sapiens
SLRSCWSGN

SEQ ID NO: 694423 - protein, 9 aa, Homo Sapiens
GSAANENST

SEQ ID NO: 694424 - protein, 9 aa, Homo Sapiens
LGGKKATQA

SEQ ID NO: 694425 - protein, 9 aa, Homo Sapiens
EVCIHISND

SEQ ID NO: 694426 - protein, 9 aa, Homo Sapiens
EESKAVYST

SEQ ID NO: 694427 - protein, 9 aa, Homo Sapiens
IIGPPGLQG
